United States Patent 11,369,692 (MATERIALS AND METHODS FOR TREATMENT OF DUCHENNE MUSCULAR DYSTROPHY) - sequence listing, part 14

SEQ ID NO: 445380 - DNA, 20 bp, Artificial Sequence
  chemically synthesized
taaattgttgcatattgcaa

SEQ ID NO: 445381 - DNA, 20 bp, Artificial Sequence
  chemically synthesized
tattgcaatatgcaacaatt

SEQ ID NO: 445382 - DNA, 20 bp, Artificial Sequence
  chemically synthesized
gcaatatgcaacaatttaga

SEQ ID NO: 445383 - DNA, 20 bp, Artificial Sequence
  chemically synthesized
aacaatttagatggatcatt

SEQ ID NO: 445384 - DNA, 20 bp, Artificial Sequence
  chemically synthesized
ggatcattaagcaattatgc

SEQ ID NO: 445385 - DNA, 20 bp, Artificial Sequence
  chemically synthesized
tcgaactagcttttttcagc

SEQ ID NO: 445386 - DNA, 20 bp, Artificial Sequence
  chemically synthesized
gcaattatgctggctgaaaa

SEQ ID NO: 445387 - DNA, 20 bp, Artificial Sequence
  chemically synthesized
cctttcgaactagctttttt

SEQ ID NO: 445388 - DNA, 20 bp, Artificial Sequence
  chemically synthesized
ttatgctggctgaaaaaagc

SEQ ID NO: 445389 - DNA, 20 bp, Artificial Sequence
  chemically synthesized
gctgaaaaaagctagttcga

SEQ ID NO: 445390 - DNA, 20 bp, Artificial Sequence
  chemically synthesized
ctgaaaaaagctagttcgaa

SEQ ID NO: 445391 - DNA, 20 bp, Artificial Sequence
  chemically synthesized
ggtatttaatcctttcgaac

SEQ ID NO: 445392 - DNA, 20 bp, Artificial Sequence
  chemically synthesized
attatgcaaatagaattgta

SEQ ID NO: 445393 - DNA, 20 bp, Artificial Sequence
  chemically synthesized
tttcaagaatattatgcaaa

SEQ ID NO: 445394 - DNA, 20 bp, Artificial Sequence
  chemically synthesized
gtctataattttgtcatttc

SEQ ID NO: 445395 - DNA, 20 bp, Artificial Sequence
  chemically synthesized
ttcttgaaatgacaaaatta

SEQ ID NO: 445396 - DNA, 20 bp, Artificial Sequence
  chemically synthesized
atgacaaaattatagacatg

SEQ ID NO: 445397 - DNA, 20 bp, Artificial Sequence
  chemically synthesized
aaaattatagacatgaagaa

SEQ ID NO: 445398 - DNA, 20 bp, Artificial Sequence
  chemically synthesized
agacatgaagaacagattaa

SEQ ID NO: 445399 - DNA, 20 bp, Artificial Sequence
  chemically synthesized
gattaatggttgccacatgt

SEQ ID NO: 445400 - DNA, 20 bp, Artificial Sequence
  chemically synthesized
attaatggttgccacatgtt

SEQ ID NO: 445401 - DNA, 20 bp, Artificial Sequence
  chemically synthesized
cctgtcccatgcctaacatg

SEQ ID NO: 445402 - DNA, 20 bp, Artificial Sequence
  chemically synthesized
tggttgccacatgttaggca

SEQ ID NO: 445403 - DNA, 20 bp, Artificial Sequence
  chemically synthesized
ggttgccacatgttaggcat

SEQ ID NO: 445404 - DNA, 20 bp, Artificial Sequence
  chemically synthesized
gccacatgttaggcatggga

SEQ ID NO: 445405 - DNA, 20 bp, Artificial Sequence
  chemically synthesized
ccacatgttaggcatgggac

SEQ ID NO: 445406 - DNA, 20 bp, Artificial Sequence
  chemically synthesized
cacatgttaggcatgggaca

SEQ ID NO: 445407 - DNA, 20 bp, Artificial Sequence
  chemically synthesized
taggcatgggacagggtgac

SEQ ID NO: 445408 - DNA, 20 bp, Artificial Sequence
  chemically synthesized
ggcatgggacagggtgacaa

SEQ ID NO: 445409 - DNA, 20 bp, Artificial Sequence
  chemically synthesized
gcatgggacagggtgacaag

SEQ ID NO: 445410 - DNA, 20 bp, Artificial Sequence
  chemically synthesized
tgggacagggtgacaagagg

SEQ ID NO: 445411 - DNA, 20 bp, Artificial Sequence
  chemically synthesized
tgacctttaataaaatcatc

SEQ ID NO: 445412 - DNA, 20 bp, Artificial Sequence
  chemically synthesized
gaagcttgatgattttatta

SEQ ID NO: 445413 - DNA, 20 bp, Artificial Sequence
  chemically synthesized
aagcttgatgattttattaa

SEQ ID NO: 445414 - DNA, 20 bp, Artificial Sequence
  chemically synthesized
atgattttattaaaggtcaa

SEQ ID NO: 445415 - DNA, 20 bp, Artificial Sequence
  chemically synthesized
tgattttattaaaggtcaac

SEQ ID NO: 445416 - DNA, 20 bp, Artificial Sequence
  chemically synthesized
attttattaaaggtcaacag

SEQ ID NO: 445417 - DNA, 20 bp, Artificial Sequence
  chemically synthesized
tttattaaaggtcaacagga

SEQ ID NO: 445418 - DNA, 20 bp, Artificial Sequence
  chemically synthesized
gtcaacaggagagatctttg

SEQ ID NO: 445419 - DNA, 20 bp, Artificial Sequence
  chemically synthesized
acggatgttacatgaccaca

SEQ ID NO: 445420 - DNA, 20 bp, Artificial Sequence
  chemically synthesized
ccaccacgacagtcaaaata

SEQ ID NO: 445421 - DNA, 20 bp, Artificial Sequence
  chemically synthesized
catccgtattttgactgtcg

SEQ ID NO: 445422 - DNA, 20 bp, Artificial Sequence
  chemically synthesized
ccgtattttgactgtcgtgg

SEQ ID NO: 445423 - DNA, 20 bp, Artificial Sequence
  chemically synthesized
gattagtgcgtccaccacga

SEQ ID NO: 445424 - DNA, 20 bp, Artificial Sequence
  chemically synthesized
caatttttacacatgtagat

SEQ ID NO: 445425 - DNA, 20 bp, Artificial Sequence
  chemically synthesized
aaatgcaatttttacacatg

SEQ ID NO: 445426 - DNA, 20 bp, Artificial Sequence
  chemically synthesized
ctcatgtgtgtgtatatatt

SEQ ID NO: 445427 - DNA, 20 bp, Artificial Sequence
  chemically synthesized
ctaaatatatacacacacat

SEQ ID NO: 445428 - DNA, 20 bp, Artificial Sequence
  chemically synthesized
tatatacacacacatgagta

SEQ ID NO: 445429 - DNA, 20 bp, Artificial Sequence
  chemically synthesized
atatacacacacatgagtat

SEQ ID NO: 445430 - DNA, 20 bp, Artificial Sequence
  chemically synthesized
cacatgagtataggtaaaac

SEQ ID NO: 445431 - DNA, 20 bp, Artificial Sequence
  chemically synthesized
acatgagtataggtaaaact

SEQ ID NO: 445432 - DNA, 20 bp, Artificial Sequence
  chemically synthesized
ctctctaattcagattttcc

SEQ ID NO: 445433 - DNA, 20 bp, Artificial Sequence
  chemically synthesized
aaaactgggaaaatctgaat

SEQ ID NO: 445434 - DNA, 20 bp, Artificial Sequence
  chemically synthesized
aactgggaaaatctgaatta

SEQ ID NO: 445435 - DNA, 20 bp, Artificial Sequence
  chemically synthesized
ctgggaaaatctgaattaga

SEQ ID NO: 445436 - DNA, 20 bp, Artificial Sequence
  chemically synthesized
tacaattaacctctctaatt

SEQ ID NO: 445437 - DNA, 20 bp, Artificial Sequence
  chemically synthesized
tgggaaaatctgaattagag

SEQ ID NO: 445438 - DNA, 20 bp, Artificial Sequence
  chemically synthesized
tatattcaaacattataatg

SEQ ID NO: 445439 - DNA, 20 bp, Artificial Sequence
  chemically synthesized
ttatattcaaacattataat

SEQ ID NO: 445440 - DNA, 20 bp, Artificial Sequence
  chemically synthesized
aatgtttgaatataatttgc

SEQ ID NO: 445441 - DNA, 20 bp, Artificial Sequence
  chemically synthesized
aatttgcaagatattacaat

SEQ ID NO: 445442 - DNA, 20 bp, Artificial Sequence
  chemically synthesized
atttgcaagatattacaatt

SEQ ID NO: 445443 - DNA, 20 bp, Artificial Sequence
  chemically synthesized
tttgcaagatattacaattg

SEQ ID NO: 445444 - DNA, 20 bp, Artificial Sequence
  chemically synthesized
tattacaattggggataacc

SEQ ID NO: 445445 - DNA, 20 bp, Artificial Sequence
  chemically synthesized
aattggggataaccgagcaa

SEQ ID NO: 445446 - DNA, 20 bp, Artificial Sequence
  chemically synthesized
tatcctgtgtggcttttgct

SEQ ID NO: 445447 - DNA, 20 bp, Artificial Sequence
  chemically synthesized
ataaccgagcaaaagccaca

SEQ ID NO: 445448 - DNA, 20 bp, Artificial Sequence
  chemically synthesized
taaccgagcaaaagccacac

SEQ ID NO: 445449 - DNA, 20 bp, Artificial Sequence
  chemically synthesized
cctatgtgaaatatcctgtg

SEQ ID NO: 445450 - DNA, 20 bp, Artificial Sequence
  chemically synthesized
gccacacaggatatttcaca

SEQ ID NO: 445451 - DNA, 20 bp, Artificial Sequence
  chemically synthesized
ccacacaggatatttcacat

SEQ ID NO: 445452 - DNA, 20 bp, Artificial Sequence
  chemically synthesized
agttgtaaaaaataatataa

SEQ ID NO: 445453 - DNA, 20 bp, Artificial Sequence
  chemically synthesized
aagagttgtagagttaagaa

SEQ ID NO: 445454 - DNA, 20 bp, Artificial Sequence
  chemically synthesized
tttcaaagagttgtagagtt

SEQ ID NO: 445455 - DNA, 20 bp, Artificial Sequence
  chemically synthesized
tttattttcaaagagttgta

SEQ ID NO: 445456 - DNA, 20 bp, Artificial Sequence
  chemically synthesized
attttattttcaaagagttg

SEQ ID NO: 445457 - DNA, 20 bp, Artificial Sequence
  chemically synthesized
ttaaacattttattttcaaa

SEQ ID NO: 445458 - DNA, 20 bp, Artificial Sequence
  chemically synthesized
agttaaacattttattttca

SEQ ID NO: 445459 - DNA, 20 bp, Artificial Sequence
  chemically synthesized
taaaatgtttaacttttaaa

SEQ ID NO: 445460 - DNA, 20 bp, Artificial Sequence
  chemically synthesized
aagcttgagaaactttttaa

SEQ ID NO: 445461 - DNA, 20 bp, Artificial Sequence
  chemically synthesized
taacttttaaaaagtttctc

SEQ ID NO: 445462 - DNA, 20 bp, Artificial Sequence
  chemically synthesized
gacacaagctaagcaagctt

SEQ ID NO: 445463 - DNA, 20 bp, Artificial Sequence
  chemically synthesized
aaaagtttctcaagcttgct

SEQ ID NO: 445464 - DNA, 20 bp, Artificial Sequence
  chemically synthesized
agctctgacacaagctaagc

SEQ ID NO: 445465 - DNA, 20 bp, Artificial Sequence
  chemically synthesized
tccaagctctgacacaagct

SEQ ID NO: 445466 - DNA, 20 bp, Artificial Sequence
  chemically synthesized
caagcttgcttagcttgtgt

SEQ ID NO: 445467 - DNA, 20 bp, Artificial Sequence
  chemically synthesized
agcttgcttagcttgtgtca

SEQ ID NO: 445468 - DNA, 20 bp, Artificial Sequence
  chemically synthesized
tggaatccaagctctgacac

SEQ ID NO: 445469 - DNA, 20 bp, Artificial Sequence
  chemically synthesized
gcttagcttgtgtcagagct

SEQ ID NO: 445470 - DNA, 20 bp, Artificial Sequence
  chemically synthesized
tcatatctgcattggaatcc

SEQ ID NO: 445471 - DNA, 20 bp, Artificial Sequence
  chemically synthesized
tcagagcttggattccaatg

SEQ ID NO: 445472 - DNA, 20 bp, Artificial Sequence
  chemically synthesized
ctctggcttcatatctgcat

SEQ ID NO: 445473 - DNA, 20 bp, Artificial Sequence
  chemically synthesized
tggattccaatgcagatatg

SEQ ID NO: 445474 - DNA, 20 bp, Artificial Sequence
  chemically synthesized
ttccaatgcagatatgaagc

SEQ ID NO: 445475 - DNA, 20 bp, Artificial Sequence
  chemically synthesized
ccaatgcagatatgaagcca

SEQ ID NO: 445476 - DNA, 20 bp, Artificial Sequence
  chemically synthesized
atgacaggaagcaagggctc

SEQ ID NO: 445477 - DNA, 20 bp, Artificial Sequence
  chemically synthesized
agagcaatgacaggaagcaa

SEQ ID NO: 445478 - DNA, 20 bp, Artificial Sequence
  chemically synthesized
tagagcaatgacaggaagca

SEQ ID NO: 445479 - DNA, 20 bp, Artificial Sequence
  chemically synthesized
atagagcaatgacaggaagc

SEQ ID NO: 445480 - DNA, 20 bp, Artificial Sequence
  chemically synthesized
cggtatagagcaatgacagg

SEQ ID NO: 445481 - DNA, 20 bp, Artificial Sequence
  chemically synthesized
gaccggtatagagcaatgac

SEQ ID NO: 445482 - DNA, 20 bp, Artificial Sequence
  chemically synthesized
ggaccggtatagagcaatga

SEQ ID NO: 445483 - DNA, 20 bp, Artificial Sequence
  chemically synthesized
ttcctgtcattgctctatac

SEQ ID NO: 445484 - DNA, 20 bp, Artificial Sequence
  chemically synthesized
gaactctgaggaccggtata

SEQ ID NO: 445485 - DNA, 20 bp, Artificial Sequence
  chemically synthesized
gggaactctgaggaccggta

SEQ ID NO: 445486 - DNA, 20 bp, Artificial Sequence
  chemically synthesized
cattgctctataccggtcct

SEQ ID NO: 445487 - DNA, 20 bp, Artificial Sequence
  chemically synthesized
ttgctctataccggtcctca

SEQ ID NO: 445488 - DNA, 20 bp, Artificial Sequence
  chemically synthesized
gtcctgggaactctgaggac

SEQ ID NO: 445489 - DNA, 20 bp, Artificial Sequence
  chemically synthesized
cctgcgtcctgggaactctg

SEQ ID NO: 445490 - DNA, 20 bp, Artificial Sequence
  chemically synthesized
tcctgcgtcctgggaactct

SEQ ID NO: 445491 - DNA, 20 bp, Artificial Sequence
  chemically synthesized
ataccggtcctcagagttcc

SEQ ID NO: 445492 - DNA, 20 bp, Artificial Sequence
  chemically synthesized
taccggtcctcagagttccc

SEQ ID NO: 445493 - DNA, 20 bp, Artificial Sequence
  chemically synthesized
tcctcagagttcccaggacg

SEQ ID NO: 445494 - DNA, 20 bp, Artificial Sequence
  chemically synthesized
cctcagagttcccaggacgc

SEQ ID NO: 445495 - DNA, 20 bp, Artificial Sequence
  chemically synthesized
aatctaccttcctgcgtcct

SEQ ID NO: 445496 - DNA, 20 bp, Artificial Sequence
  chemically synthesized
caatctaccttcctgcgtcc

SEQ ID NO: 445497 - DNA, 20 bp, Artificial Sequence
  chemically synthesized
cagagttcccaggacgcagg

SEQ ID NO: 445498 - DNA, 20 bp, Artificial Sequence
  chemically synthesized
agagttcccaggacgcagga

SEQ ID NO: 445499 - DNA, 20 bp, Artificial Sequence
  chemically synthesized
gttcccaggacgcaggaagg

SEQ ID NO: 445500 - DNA, 20 bp, Artificial Sequence
  chemically synthesized
caggacgcaggaaggtagat

SEQ ID NO: 445501 - DNA, 20 bp, Artificial Sequence
  chemically synthesized
ggtagattggaattgcactg

SEQ ID NO: 445502 - DNA, 20 bp, Artificial Sequence
  chemically synthesized
gtagattggaattgcactgc

SEQ ID NO: 445503 - DNA, 20 bp, Artificial Sequence
  chemically synthesized
tggtggttaaattgtgcctg

SEQ ID NO: 445504 - DNA, 20 bp, Artificial Sequence
  chemically synthesized
gcacaatttaaccaccataa

SEQ ID NO: 445505 - DNA, 20 bp, Artificial Sequence
  chemically synthesized
atttaggatatctgttatgg

SEQ ID NO: 445506 - DNA, 20 bp, Artificial Sequence
  chemically synthesized
ataatttaggatatctgtta

SEQ ID NO: 445507 - DNA, 20 bp, Artificial Sequence
  chemically synthesized
taaaaataaaaaaataattt

SEQ ID NO: 445508 - DNA, 20 bp, Artificial Sequence
  chemically synthesized
ttaaaaataaaaaaataatt

SEQ ID NO: 445509 - DNA, 20 bp, Artificial Sequence
  chemically synthesized
tttttatttttaatttttgt

SEQ ID NO: 445510 - DNA, 20 bp, Artificial Sequence
  chemically synthesized
taatttttgtgagtacacaa

SEQ ID NO: 445511 - DNA, 20 bp, Artificial Sequence
  chemically synthesized
acacaatagatgtacatatt

SEQ ID NO: 445512 - DNA, 20 bp, Artificial Sequence
  chemically synthesized
caatagatgtacatatttag

SEQ ID NO: 445513 - DNA, 20 bp, Artificial Sequence
  chemically synthesized
tttagcggtacataaattct

SEQ ID NO: 445514 - DNA, 20 bp, Artificial Sequence
  chemically synthesized
tctaaaatctattggtagct

SEQ ID NO: 445515 - DNA, 20 bp, Artificial Sequence
  chemically synthesized
cataaattctaagctaccaa

SEQ ID NO: 445516 - DNA, 20 bp, Artificial Sequence
  chemically synthesized
tatgatctaaaatctattgg

SEQ ID NO: 445517 - DNA, 20 bp, Artificial Sequence
  chemically synthesized
ccatatgatctaaaatctat

SEQ ID NO: 445518 - DNA, 20 bp, Artificial Sequence
  chemically synthesized
tctaagctaccaatagattt

SEQ ID NO: 445519 - DNA, 20 bp, Artificial Sequence
  chemically synthesized
ccaatagattttagatcata

SEQ ID NO: 445520 - DNA, 20 bp, Artificial Sequence
  chemically synthesized
gatcatatggtcttgtaaaa

SEQ ID NO: 445521 - DNA, 20 bp, Artificial Sequence
  chemically synthesized
gcatgctcatactattttac

SEQ ID NO: 445522 - DNA, 20 bp, Artificial Sequence
  chemically synthesized
atggtcttgtaaaatagtat

SEQ ID NO: 445523 - DNA, 20 bp, Artificial Sequence
  chemically synthesized
aaaatagtatgagcatgcaa

SEQ ID NO: 445524 - DNA, 20 bp, Artificial Sequence
  chemically synthesized
tagtatgagcatgcaacggt

SEQ ID NO: 445525 - DNA, 20 bp, Artificial Sequence
  chemically synthesized
agtatgagcatgcaacggtt

SEQ ID NO: 445526 - DNA, 20 bp, Artificial Sequence
  chemically synthesized
tattaagtggtagaggttgg

SEQ ID NO: 445527 - DNA, 20 bp, Artificial Sequence
  chemically synthesized
atctattaagtggtagaggt

SEQ ID NO: 445528 - DNA, 20 bp, Artificial Sequence
  chemically synthesized
acccatctattaagtggtag

SEQ ID NO: 445529 - DNA, 20 bp, Artificial Sequence
  chemically synthesized
cacccatctattaagtggta

SEQ ID NO: 445530 - DNA, 20 bp, Artificial Sequence
  chemically synthesized
cacacccatctattaagtgg

SEQ ID NO: 445531 - DNA, 20 bp, Artificial Sequence
  chemically synthesized
tgccaacctctaccacttaa

SEQ ID NO: 445532 - DNA, 20 bp, Artificial Sequence
  chemically synthesized
acacacacccatctattaag

SEQ ID NO: 445533 - DNA, 20 bp, Artificial Sequence
  chemically synthesized
aacctctaccacttaataga

SEQ ID NO: 445534 - DNA, 20 bp, Artificial Sequence
  chemically synthesized
acctctaccacttaatagat

SEQ ID NO: 445535 - DNA, 20 bp, Artificial Sequence
  chemically synthesized
cacacacacacccatctatt

SEQ ID NO: 445536 - DNA, 20 bp, Artificial Sequence
  chemically synthesized
cacacagacacacacacaca

SEQ ID NO: 445537 - DNA, 20 bp, Artificial Sequence
  chemically synthesized
cacacattcacaaatacaca

SEQ ID NO: 445538 - DNA, 20 bp, Artificial Sequence
  chemically synthesized
tttgtgaatgtgtgacacct

SEQ ID NO: 445539 - DNA, 20 bp, Artificial Sequence
  chemically synthesized
tgtgaatgtgtgacaccttg

SEQ ID NO: 445540 - DNA, 20 bp, Artificial Sequence
  chemically synthesized
gaatgtgtgacaccttggag

SEQ ID NO: 445541 - DNA, 20 bp, Artificial Sequence
  chemically synthesized
gtgaaaaattttcttctcca

SEQ ID NO: 445542 - DNA, 20 bp, Artificial Sequence
  chemically synthesized
tgtgaaaaattttcttctcc

SEQ ID NO: 445543 - DNA, 20 bp, Artificial Sequence
  chemically synthesized
gaagaaaatttttcacacct

SEQ ID NO: 445544 - DNA, 20 bp, Artificial Sequence
  chemically synthesized
tttaacaattggggaaactg

SEQ ID NO: 445545 - DNA, 20 bp, Artificial Sequence
  chemically synthesized
atttaacaattggggaaact

SEQ ID NO: 445546 - DNA, 20 bp, Artificial Sequence
  chemically synthesized
tatccctcatttaacaattg

SEQ ID NO: 445547 - DNA, 20 bp, Artificial Sequence
  chemically synthesized
ttatccctcatttaacaatt

SEQ ID NO: 445548 - DNA, 20 bp, Artificial Sequence
  chemically synthesized
gttatccctcatttaacaat

SEQ ID NO: 445549 - DNA, 20 bp, Artificial Sequence
  chemically synthesized
agtttccccaattgttaaat

SEQ ID NO: 445550 - DNA, 20 bp, Artificial Sequence
  chemically synthesized
gtttccccaattgttaaatg

SEQ ID NO: 445551 - DNA, 20 bp, Artificial Sequence
  chemically synthesized
tttccccaattgttaaatga

SEQ ID NO: 445552 - DNA, 20 bp, Artificial Sequence
  chemically synthesized
gtaactcagtgagttagcaa

SEQ ID NO: 445553 - DNA, 20 bp, Artificial Sequence
  chemically synthesized
acaactgttgctaactcact

SEQ ID NO: 445554 - DNA, 20 bp, Artificial Sequence
  chemically synthesized
tcatttgtaactcagtgagt

SEQ ID NO: 445555 - DNA, 20 bp, Artificial Sequence
  chemically synthesized
taagtcatttgtaactcagt

SEQ ID NO: 445556 - DNA, 20 bp, Artificial Sequence
  chemically synthesized
atattaagtcatttgtaact

SEQ ID NO: 445557 - DNA, 20 bp, Artificial Sequence
  chemically synthesized
ctaagtgcattgtcgatatt

SEQ ID NO: 445558 - DNA, 20 bp, Artificial Sequence
  chemically synthesized
cttaatatcgacaatgcact

SEQ ID NO: 445559 - DNA, 20 bp, Artificial Sequence
  chemically synthesized
tatgttctgggtggtattct

SEQ ID NO: 445560 - DNA, 20 bp, Artificial Sequence
  chemically synthesized
aatgcacttagaataccacc

SEQ ID NO: 445561 - DNA, 20 bp, Artificial Sequence
  chemically synthesized
acaacttagtatgttctggg

SEQ ID NO: 445562 - DNA, 20 bp, Artificial Sequence
  chemically synthesized
catacaacttagtatgttct

SEQ ID NO: 445563 - DNA, 20 bp, Artificial Sequence
  chemically synthesized
acatacaacttagtatgttc

SEQ ID NO: 445564 - DNA, 20 bp, Artificial Sequence
  chemically synthesized
aataccacccagaacatact

SEQ ID NO: 445565 - DNA, 20 bp, Artificial Sequence
  chemically synthesized
aatatctaacacatacaact

SEQ ID NO: 445566 - DNA, 20 bp, Artificial Sequence
  chemically synthesized
acatactaagttgtatgtgt

SEQ ID NO: 445567 - DNA, 20 bp, Artificial Sequence
  chemically synthesized
atcatttctgcaatcagtag

SEQ ID NO: 445568 - DNA, 20 bp, Artificial Sequence
  chemically synthesized
attattactactactgattg

SEQ ID NO: 445569 - DNA, 20 bp, Artificial Sequence
  chemically synthesized
tttatcatttctgcaatcag

SEQ ID NO: 445570 - DNA, 20 bp, Artificial Sequence
  chemically synthesized
tattttatcatttctgcaat

SEQ ID NO: 445571 - DNA, 20 bp, Artificial Sequence
  chemically synthesized
aaatatgaaaaatgttcttt

SEQ ID NO: 445572 - DNA, 20 bp, Artificial Sequence
  chemically synthesized
tatgaaaaatgttcttttag

SEQ ID NO: 445573 - DNA, 20 bp, Artificial Sequence
  chemically synthesized
gtttgccacatttcttctaa

SEQ ID NO: 445574 - DNA, 20 bp, Artificial Sequence
  chemically synthesized
atgttcttttagaagaaatg

SEQ ID NO: 445575 - DNA, 20 bp, Artificial Sequence
  chemically synthesized
tgctgttcattgaatcatgt

SEQ ID NO: 445576 - DNA, 20 bp, Artificial Sequence
  chemically synthesized
cactgacatgattcaatgaa

SEQ ID NO: 445577 - DNA, 20 bp, Artificial Sequence
  chemically synthesized
tgacatgattcaatgaacag

SEQ ID NO: 445578 - DNA, 20 bp, Artificial Sequence
  chemically synthesized
tgattcaatgaacagcagtc

SEQ ID NO: 445579 - DNA, 20 bp, Artificial Sequence
  chemically synthesized
ataagacaatatacataatc

SEQ ID NO: 445580 - DNA, 20 bp, Artificial Sequence
  chemically synthesized
cacgtagatgataaaattat

SEQ ID NO: 445581 - DNA, 20 bp, Artificial Sequence
  chemically synthesized
tggctaatacttaggtcacg

SEQ ID NO: 445582 - DNA, 20 bp, Artificial Sequence
  chemically synthesized
ttttatcatctacgtgacct

SEQ ID NO: 445583 - DNA, 20 bp, Artificial Sequence
  chemically synthesized
catctacgtgacctaagtat

SEQ ID NO: 445584 - DNA, 20 bp, Artificial Sequence
  chemically synthesized
ggcagcggtggctaatactt

SEQ ID NO: 445585 - DNA, 20 bp, Artificial Sequence
  chemically synthesized
tggcagcggtggctaatact

SEQ ID NO: 445586 - DNA, 20 bp, Artificial Sequence
  chemically synthesized
gactcttggaatggcagcgg

SEQ ID NO: 445587 - DNA, 20 bp, Artificial Sequence
  chemically synthesized
atcgactcttggaatggcag

SEQ ID NO: 445588 - DNA, 20 bp, Artificial Sequence
  chemically synthesized
ttagccaccgctgccattcc

SEQ ID NO: 445589 - DNA, 20 bp, Artificial Sequence
  chemically synthesized
aaaatcgactcttggaatgg

SEQ ID NO: 445590 - DNA, 20 bp, Artificial Sequence
  chemically synthesized
agccaccgctgccattccaa

SEQ ID NO: 445591 - DNA, 20 bp, Artificial Sequence
  chemically synthesized
caaaaaatcgactcttggaa

SEQ ID NO: 445592 - DNA, 20 bp, Artificial Sequence
  chemically synthesized
ttttacaaaaaatcgactct

SEQ ID NO: 445593 - DNA, 20 bp, Artificial Sequence
  chemically synthesized
gtcgattttttgtaaaattc

SEQ ID NO: 445594 - DNA, 20 bp, Artificial Sequence
  chemically synthesized
tcgattttttgtaaaattct

SEQ ID NO: 445595 - DNA, 20 bp, Artificial Sequence
  chemically synthesized
tttttgtaaaattctgggaa

SEQ ID NO: 445596 - DNA, 20 bp, Artificial Sequence
  chemically synthesized
tttgtaaaattctgggaaaa

SEQ ID NO: 445597 - DNA, 20 bp, Artificial Sequence
  chemically synthesized
agaagcaaaatctcttttcc

SEQ ID NO: 445598 - DNA, 20 bp, Artificial Sequence
  chemically synthesized
gacttaggagtaaatgtgag

SEQ ID NO: 445599 - DNA, 20 bp, Artificial Sequence
  chemically synthesized
tctgacttaggagtaaatgt

SEQ ID NO: 445600 - DNA, 20 bp, Artificial Sequence
  chemically synthesized
tgcttctcacatttactcct

SEQ ID NO: 445601 - DNA, 20 bp, Artificial Sequence
  chemically synthesized
tctcacatttactcctaagt

SEQ ID NO: 445602 - DNA, 20 bp, Artificial Sequence
  chemically synthesized
ccaatagacttctgacttag

SEQ ID NO: 445603 - DNA, 20 bp, Artificial Sequence
  chemically synthesized
cacatttactcctaagtcag

SEQ ID NO: 445604 - DNA, 20 bp, Artificial Sequence
  chemically synthesized
acccaatagacttctgactt

SEQ ID NO: 445605 - DNA, 20 bp, Artificial Sequence
  chemically synthesized
tacccaatagacttctgact

SEQ ID NO: 445606 - DNA, 20 bp, Artificial Sequence
  chemically synthesized
ctcctaagtcagaagtctat

SEQ ID NO: 445607 - DNA, 20 bp, Artificial Sequence
  chemically synthesized
tcctaagtcagaagtctatt

SEQ ID NO: 445608 - DNA, 20 bp, Artificial Sequence
  chemically synthesized
ccagagaagtgattacccaa

SEQ ID NO: 445609 - DNA, 20 bp, Artificial Sequence
  chemically synthesized
ctattgggtaatcacttctc

SEQ ID NO: 445610 - DNA, 20 bp, Artificial Sequence
  chemically synthesized
tattgggtaatcacttctct

SEQ ID NO: 445611 - DNA, 20 bp, Artificial Sequence
  chemically synthesized
ggagggatctaaacccagag

SEQ ID NO: 445612 - DNA, 20 bp, Artificial Sequence
  chemically synthesized
ggtaatcacttctctgggtt

SEQ ID NO: 445613 - DNA, 20 bp, Artificial Sequence
  chemically synthesized
ccaggagggatctaaaccca

SEQ ID NO: 445614 - DNA, 20 bp, Artificial Sequence
  chemically synthesized
ggccaggagggatctaaacc

SEQ ID NO: 445615 - DNA, 20 bp, Artificial Sequence
  chemically synthesized
ctctgggtttagatccctcc

SEQ ID NO: 445616 - DNA, 20 bp, Artificial Sequence
  chemically synthesized
atcactgagagtggccagga

SEQ ID NO: 445617 - DNA, 20 bp, Artificial Sequence
  chemically synthesized
aatcactgagagtggccagg

SEQ ID NO: 445618 - DNA, 20 bp, Artificial Sequence
  chemically synthesized
gaatcactgagagtggccag

SEQ ID NO: 445619 - DNA, 20 bp, Artificial Sequence
  chemically synthesized
aagaatcactgagagtggcc

SEQ ID NO: 445620 - DNA, 20 bp, Artificial Sequence
  chemically synthesized
aaagaatcactgagagtggc

SEQ ID NO: 445621 - DNA, 20 bp, Artificial Sequence
  chemically synthesized
agatccctcctggccactct

SEQ ID NO: 445622 - DNA, 20 bp, Artificial Sequence
  chemically synthesized
ggcgaaagaatcactgagag

SEQ ID NO: 445623 - DNA, 20 bp, Artificial Sequence
  chemically synthesized
ctgggcgaaagaatcactga

SEQ ID NO: 445624 - DNA, 20 bp, Artificial Sequence
  chemically synthesized
gcctgggcgaaagaatcact

SEQ ID NO: 445625 - DNA, 20 bp, Artificial Sequence
  chemically synthesized
ctctcagtgattctttcgcc

SEQ ID NO: 445626 - DNA, 20 bp, Artificial Sequence
  chemically synthesized
tctcagtgattctttcgccc

SEQ ID NO: 445627 - DNA, 20 bp, Artificial Sequence
  chemically synthesized
gcgaacagtggcctgggcga

SEQ ID NO: 445628 - DNA, 20 bp, Artificial Sequence
  chemically synthesized
agcttagcgaacagtggcct

SEQ ID NO: 445629 - DNA, 20 bp, Artificial Sequence
  chemically synthesized
aagcttagcgaacagtggcc

SEQ ID NO: 445630 - DNA, 20 bp, Artificial Sequence
  chemically synthesized
gtgacaagcttagcgaacag

SEQ ID NO: 445631 - DNA, 20 bp, Artificial Sequence
  chemically synthesized
cgcccaggccactgttcgct

SEQ ID NO: 445632 - DNA, 20 bp, Artificial Sequence
  chemically synthesized
gtggtgacaagcttagcgaa

SEQ ID NO: 445633 - DNA, 20 bp, Artificial Sequence
  chemically synthesized
aatccatgtggtgacaagct

SEQ ID NO: 445634 - DNA, 20 bp, Artificial Sequence
  chemically synthesized
cagtaaatccatgtggtgac

SEQ ID NO: 445635 - DNA, 20 bp, Artificial Sequence
  chemically synthesized
tcgctaagcttgtcaccaca

SEQ ID NO: 445636 - DNA, 20 bp, Artificial Sequence
  chemically synthesized
aattgtccagtaaatccatg

SEQ ID NO: 445637 - DNA, 20 bp, Artificial Sequence
  chemically synthesized
ttgtcaccacatggatttac

SEQ ID NO: 445638 - DNA, 20 bp, Artificial Sequence
  chemically synthesized
ccagtaaatggacaattgtc

SEQ ID NO: 445639 - DNA, 20 bp, Artificial Sequence
  chemically synthesized
ctggacaattgtccatttac

SEQ ID NO: 445640 - DNA, 20 bp, Artificial Sequence
  chemically synthesized
aagagccattgtccagtaaa

SEQ ID NO: 445641 - DNA, 20 bp, Artificial Sequence
  chemically synthesized
attgtccatttactggacaa

SEQ ID NO: 445642 - DNA, 20 bp, Artificial Sequence
  chemically synthesized
cactaggaagagccattgtc

SEQ ID NO: 445643 - DNA, 20 bp, Artificial Sequence
  chemically synthesized
tactggacaatggctcttcc

SEQ ID NO: 445644 - DNA, 20 bp, Artificial Sequence
  chemically synthesized
gggcagcagcacactaggaa

SEQ ID NO: 445645 - DNA, 20 bp, Artificial Sequence
  chemically synthesized
aggggcagcagcacactagg

SEQ ID NO: 445646 - DNA, 20 bp, Artificial Sequence
  chemically synthesized
ctgaggggcagcagcacact

SEQ ID NO: 445647 - DNA, 20 bp, Artificial Sequence
  chemically synthesized
gctgaggggcagcagcacac

SEQ ID NO: 445648 - DNA, 20 bp, Artificial Sequence
  chemically synthesized
aagcccatgctgaggggcag

SEQ ID NO: 445649 - DNA, 20 bp, Artificial Sequence
  chemically synthesized
cctagtgtgctgctgcccct

SEQ ID NO: 445650 - DNA, 20 bp, Artificial Sequence
  chemically synthesized
ctgaagcccatgctgagggg

SEQ ID NO: 445651 - DNA, 20 bp, Artificial Sequence
  chemically synthesized
tgtgctgctgcccctcagca

SEQ ID NO: 445652 - DNA, 20 bp, Artificial Sequence
  chemically synthesized
gggctgaagcccatgctgag

SEQ ID NO: 445653 - DNA, 20 bp, Artificial Sequence
  chemically synthesized
gtgctgctgcccctcagcat

SEQ ID NO: 445654 - DNA, 20 bp, Artificial Sequence
  chemically synthesized
ggggctgaagcccatgctga

SEQ ID NO: 445655 - DNA, 20 bp, Artificial Sequence
  chemically synthesized
tggggctgaagcccatgctg

SEQ ID NO: 445656 - DNA, 20 bp, Artificial Sequence
  chemically synthesized
gtggggctgaagcccatgct

SEQ ID NO: 445657 - DNA, 20 bp, Artificial Sequence
  chemically synthesized
ctgcccctcagcatgggctt

SEQ ID NO: 445658 - DNA, 20 bp, Artificial Sequence
  chemically synthesized
ccatgtttggtgtggggctg

SEQ ID NO: 445659 - DNA, 20 bp, Artificial Sequence
  chemically synthesized
cctgttccatgtttggtgtg

SEQ ID NO: 445660 - DNA, 20 bp, Artificial Sequence
  chemically synthesized
gcctgttccatgtttggtgt

SEQ ID NO: 445661 - DNA, 20 bp, Artificial Sequence
  chemically synthesized
agcctgttccatgtttggtg

SEQ ID NO: 445662 - DNA, 20 bp, Artificial Sequence
  chemically synthesized
cttcagccccacaccaaaca

SEQ ID NO: 445663 - DNA, 20 bp, Artificial Sequence
  chemically synthesized
aggagagcctgttccatgtt

SEQ ID NO: 445664 - DNA, 20 bp, Artificial Sequence
  chemically synthesized
gccccacaccaaacatggaa

SEQ ID NO: 445665 - DNA, 20 bp, Artificial Sequence
  chemically synthesized
ccccacaccaaacatggaac

SEQ ID NO: 445666 - DNA, 20 bp, Artificial Sequence
  chemically synthesized
ggtgagtagtaacaggagga

SEQ ID NO: 445667 - DNA, 20 bp, Artificial Sequence
  chemically synthesized
agggtgagtagtaacaggag

SEQ ID NO: 445668 - DNA, 20 bp, Artificial Sequence
  chemically synthesized
taagggtgagtagtaacagg

SEQ ID NO: 445669 - DNA, 20 bp, Artificial Sequence
  chemically synthesized
ataagggtgagtagtaacag

SEQ ID NO: 445670 - DNA, 20 bp, Artificial Sequence
  chemically synthesized
ctataagggtgagtagtaac

SEQ ID NO: 445671 - DNA, 20 bp, Artificial Sequence
  chemically synthesized
actataagggtgagtagtaa

SEQ ID NO: 445672 - DNA, 20 bp, Artificial Sequence
  chemically synthesized
gtggggactataagggtgag

SEQ ID NO: 445673 - DNA, 20 bp, Artificial Sequence
  chemically synthesized
cctgttactactcaccctta

SEQ ID NO: 445674 - DNA, 20 bp, Artificial Sequence
  chemically synthesized
gttgtggggactataagggt

SEQ ID NO: 445675 - DNA, 20 bp, Artificial Sequence
  chemically synthesized
tggagttgtggggactataa

SEQ ID NO: 445676 - DNA, 20 bp, Artificial Sequence
  chemically synthesized
atggagttgtggggactata

SEQ ID NO: 445677 - DNA, 20 bp, Artificial Sequence
  chemically synthesized
gatggagttgtggggactat

SEQ ID NO: 445678 - DNA, 20 bp, Artificial Sequence
  chemically synthesized
aactctctgatggagttgtg

SEQ ID NO: 445679 - DNA, 20 bp, Artificial Sequence
  chemically synthesized
gaactctctgatggagttgt

SEQ ID NO: 445680 - DNA, 20 bp, Artificial Sequence
  chemically synthesized
agaactctctgatggagttg

SEQ ID NO: 445681 - DNA, 20 bp, Artificial Sequence
  chemically synthesized
tatagtccccacaactccat

SEQ ID NO: 445682 - DNA, 20 bp, Artificial Sequence
  chemically synthesized
tagtccccacaactccatca

SEQ ID NO: 445683 - DNA, 20 bp, Artificial Sequence
  chemically synthesized
gtccccacaactccatcaga

SEQ ID NO: 445684 - DNA, 20 bp, Artificial Sequence
  chemically synthesized
tcctacagaactctctgatg

SEQ ID NO: 445685 - DNA, 20 bp, Artificial Sequence
  chemically synthesized
attcctacagaactctctga

SEQ ID NO: 445686 - DNA, 20 bp, Artificial Sequence
  chemically synthesized
aactccatcagagagttctg

SEQ ID NO: 445687 - DNA, 20 bp, Artificial Sequence
  chemically synthesized
actccatcagagagttctgt

SEQ ID NO: 445688 - DNA, 20 bp, Artificial Sequence
  chemically synthesized
agtaaaggccagtattccta

SEQ ID NO: 445689 - DNA, 20 bp, Artificial Sequence
  chemically synthesized
agagagttctgtaggaatac

SEQ ID NO: 445690 - DNA, 20 bp, Artificial Sequence
  chemically synthesized
cccaaccctccagtaaaggc

SEQ ID NO: 445691 - DNA, 20 bp, Artificial Sequence
  chemically synthesized
gtaggaatactggcctttac

SEQ ID NO: 445692 - DNA, 20 bp, Artificial Sequence
  chemically synthesized
aggaatactggcctttactg

SEQ ID NO: 445693 - DNA, 20 bp, Artificial Sequence
  chemically synthesized
ggaatactggcctttactgg

SEQ ID NO: 445694 - DNA, 20 bp, Artificial Sequence
  chemically synthesized
caatcccaaccctccagtaa

SEQ ID NO: 445695 - DNA, 20 bp, Artificial Sequence
  chemically synthesized
gaatactggcctttactgga

SEQ ID NO: 445696 - DNA, 20 bp, Artificial Sequence
  chemically synthesized
ccaatcccaaccctccagta

SEQ ID NO: 445697 - DNA, 20 bp, Artificial Sequence
  chemically synthesized
actggcctttactggagggt

SEQ ID NO: 445698 - DNA, 20 bp, Artificial Sequence
  chemically synthesized
ctggcctttactggagggtt

SEQ ID NO: 445699 - DNA, 20 bp, Artificial Sequence
  chemically synthesized
tacccccaatcccaaccctc

SEQ ID NO: 445700 - DNA, 20 bp, Artificial Sequence
  chemically synthesized
ctttactggagggttgggat

SEQ ID NO: 445701 - DNA, 20 bp, Artificial Sequence
  chemically synthesized
tttactggagggttgggatt

SEQ ID NO: 445702 - DNA, 20 bp, Artificial Sequence
  chemically synthesized
ttactggagggttgggattg

SEQ ID NO: 445703 - DNA, 20 bp, Artificial Sequence
  chemically synthesized
tactggagggttgggattgg

SEQ ID NO: 445704 - DNA, 20 bp, Artificial Sequence
  chemically synthesized
ggttgggattgggggtaact

SEQ ID NO: 445705 - DNA, 20 bp, Artificial Sequence
  chemically synthesized
ttgggattgggggtaactaa

SEQ ID NO: 445706 - DNA, 20 bp, Artificial Sequence
  chemically synthesized
atcccttaacgtaattctct

SEQ ID NO: 445707 - DNA, 20 bp, Artificial Sequence
  chemically synthesized
gtaactaagagaattacgtt

SEQ ID NO: 445708 - DNA, 20 bp, Artificial Sequence
  chemically synthesized
taactaagagaattacgtta

SEQ ID NO: 445709 - DNA, 20 bp, Artificial Sequence
  chemically synthesized
aactaagagaattacgttaa

SEQ ID NO: 445710 - DNA, 20 bp, Artificial Sequence
  chemically synthesized
aagagaattacgttaaggga

SEQ ID NO: 445711 - DNA, 20 bp, Artificial Sequence
  chemically synthesized
gagaattacgttaagggatg

SEQ ID NO: 445712 - DNA, 20 bp, Artificial Sequence
  chemically synthesized
attacgttaagggatggaga

SEQ ID NO: 445713 - DNA, 20 bp, Artificial Sequence
  chemically synthesized
ttacgttaagggatggagaa

SEQ ID NO: 445714 - DNA, 20 bp, Artificial Sequence
  chemically synthesized
gccattgttagtatagagtt

SEQ ID NO: 445715 - DNA, 20 bp, Artificial Sequence
  chemically synthesized
accaagccattgttagtata

SEQ ID NO: 445716 - DNA, 20 bp, Artificial Sequence
  chemically synthesized
agaccaagccattgttagta

SEQ ID NO: 445717 - DNA, 20 bp, Artificial Sequence
  chemically synthesized
gccaaactctatactaacaa

SEQ ID NO: 445718 - DNA, 20 bp, Artificial Sequence
  chemically synthesized
acacaagaccaagccattgt

SEQ ID NO: 445719 - DNA, 20 bp, Artificial Sequence
  chemically synthesized
actctatactaacaatggct

SEQ ID NO: 445720 - DNA, 20 bp, Artificial Sequence
  chemically synthesized
ctgctacacaacacaagacc

SEQ ID NO: 445721 - DNA, 20 bp, Artificial Sequence
  chemically synthesized
gcttttctgctacacaacac

SEQ ID NO: 445722 - DNA, 20 bp, Artificial Sequence
  chemically synthesized
tggcttggtcttgtgttgtg

SEQ ID NO: 445723 - DNA, 20 bp, Artificial Sequence
  chemically synthesized
cttggtcttgtgttgtgtag

SEQ ID NO: 445724 - DNA, 20 bp, Artificial Sequence
  chemically synthesized
tcttgtgttgtgtagcagaa

SEQ ID NO: 445725 - DNA, 20 bp, Artificial Sequence
  chemically synthesized
tgtgttgtgtagcagaaaag

SEQ ID NO: 445726 - DNA, 20 bp, Artificial Sequence
  chemically synthesized
gtgttgtgtagcagaaaagc

SEQ ID NO: 445727 - DNA, 20 bp, Artificial Sequence
  chemically synthesized
tcacaaaaaacgttgtgtag

SEQ ID NO: 445728 - DNA, 20 bp, Artificial Sequence
  chemically synthesized
ctcacaaaaaacgttgtgta

SEQ ID NO: 445729 - DNA, 20 bp, Artificial Sequence
  chemically synthesized
gctcacaaaaaacgttgtgt

SEQ ID NO: 445730 - DNA, 20 bp, Artificial Sequence
  chemically synthesized
tgctcacaaaaaacgttgtg

SEQ ID NO: 445731 - DNA, 20 bp, Artificial Sequence
  chemically synthesized
ccctacacaacgttttttgt

SEQ ID NO: 445732 - DNA, 20 bp, Artificial Sequence
  chemically synthesized
cgttttttgtgagcacgcac

SEQ ID NO: 445733 - DNA, 20 bp, Artificial Sequence
  chemically synthesized
gaaagagtaagaataggaac

SEQ ID NO: 445734 - DNA, 20 bp, Artificial Sequence
  chemically synthesized
caataggaaagagtaagaat

SEQ ID NO: 445735 - DNA, 20 bp, Artificial Sequence
  chemically synthesized
tcaataggaaagagtaagaa

SEQ ID NO: 445736 - DNA, 20 bp, Artificial Sequence
  chemically synthesized
agccttcaataggaaagagt

SEQ ID NO: 445737 - DNA, 20 bp, Artificial Sequence
  chemically synthesized
ccatagccttcaataggaaa

SEQ ID NO: 445738 - DNA, 20 bp, Artificial Sequence
  chemically synthesized
gcccatagccttcaatagga

SEQ ID NO: 445739 - DNA, 20 bp, Artificial Sequence
  chemically synthesized
attcttactctttcctattg

SEQ ID NO: 445740 - DNA, 20 bp, Artificial Sequence
  chemically synthesized
ttcttactctttcctattga

SEQ ID NO: 445741 - DNA, 20 bp, Artificial Sequence
  chemically synthesized
ggaagcccatagccttcaat

SEQ ID NO: 445742 - DNA, 20 bp, Artificial Sequence
  chemically synthesized
aggaagcccatagccttcaa

SEQ ID NO: 445743 - DNA, 20 bp, Artificial Sequence
  chemically synthesized
ctctttcctattgaaggcta

SEQ ID NO: 445744 - DNA, 20 bp, Artificial Sequence
  chemically synthesized
tctttcctattgaaggctat

SEQ ID NO: 445745 - DNA, 20 bp, Artificial Sequence
  chemically synthesized
ccttttagaaaggaagccca

SEQ ID NO: 445746 - DNA, 20 bp, Artificial Sequence
  chemically synthesized
atggaggccttttagaaagg

SEQ ID NO: 445747 - DNA, 20 bp, Artificial Sequence
  chemically synthesized
gctatgggcttcctttctaa

SEQ ID NO: 445748 - DNA, 20 bp, Artificial Sequence
  chemically synthesized
ctatgggcttcctttctaaa

SEQ ID NO: 445749 - DNA, 20 bp, Artificial Sequence
  chemically synthesized
aaaatggaggccttttagaa

SEQ ID NO: 445750 - DNA, 20 bp, Artificial Sequence
  chemically synthesized
gaaaatggaggccttttaga

SEQ ID NO: 445751 - DNA, 20 bp, Artificial Sequence
  chemically synthesized
gcttgaaaatggaggccttt

SEQ ID NO: 445752 - DNA, 20 bp, Artificial Sequence
  chemically synthesized
catttctagcttgaaaatgg

SEQ ID NO: 445753 - DNA, 20 bp, Artificial Sequence
  chemically synthesized
tctaaaaggcctccattttc

SEQ ID NO: 445754 - DNA, 20 bp, Artificial Sequence
  chemically synthesized
tcatttctagcttgaaaatg

SEQ ID NO: 445755 - DNA, 20 bp, Artificial Sequence
  chemically synthesized
agtcatttctagcttgaaaa

SEQ ID NO: 445756 - DNA, 20 bp, Artificial Sequence
  chemically synthesized
aaaggcctccattttcaagc

SEQ ID NO: 445757 - DNA, 20 bp, Artificial Sequence
  chemically synthesized
tgaaggaaggcagtcatttc

SEQ ID NO: 445758 - DNA, 20 bp, Artificial Sequence
  chemically synthesized
ggaatttccctgaaggaagg

SEQ ID NO: 445759 - DNA, 20 bp, Artificial Sequence
  chemically synthesized
tagaaatgactgccttcctt

SEQ ID NO: 445760 - DNA, 20 bp, Artificial Sequence
  chemically synthesized
agaaatgactgccttccttc

SEQ ID NO: 445761 - DNA, 20 bp, Artificial Sequence
  chemically synthesized
gaaatgactgccttccttca

SEQ ID NO: 445762 - DNA, 20 bp, Artificial Sequence
  chemically synthesized
ggtggaatttccctgaagga

SEQ ID NO: 445763 - DNA, 20 bp, Artificial Sequence
  chemically synthesized
gggtggaatttccctgaagg

SEQ ID NO: 445764 - DNA, 20 bp, Artificial Sequence
  chemically synthesized
atggggtggaatttccctga

SEQ ID NO: 445765 - DNA, 20 bp, Artificial Sequence
  chemically synthesized
tatggggtggaatttccctg

SEQ ID NO: 445766 - DNA, 20 bp, Artificial Sequence
  chemically synthesized
caatgtttcctattatgggg

SEQ ID NO: 445767 - DNA, 20 bp, Artificial Sequence
  chemically synthesized
agggaaattccaccccataa

SEQ ID NO: 445768 - DNA, 20 bp, Artificial Sequence
  chemically synthesized
gggaaattccaccccataat

SEQ ID NO: 445769 - DNA, 20 bp, Artificial Sequence
  chemically synthesized
gatcaatgtttcctattatg

SEQ ID NO: 445770 - DNA, 20 bp, Artificial Sequence
  chemically synthesized
tgatcaatgtttcctattat

SEQ ID NO: 445771 - DNA, 20 bp, Artificial Sequence
  chemically synthesized
atgatcaatgtttcctatta

SEQ ID NO: 445772 - DNA, 20 bp, Artificial Sequence
  chemically synthesized
ttgatcatttactatatgcc

SEQ ID NO: 445773 - DNA, 20 bp, Artificial Sequence
  chemically synthesized
ttagatcaatacttggcata

SEQ ID NO: 445774 - DNA, 20 bp, Artificial Sequence
  chemically synthesized
gagttgcttagatcaatact

SEQ ID NO: 445775 - DNA, 20 bp, Artificial Sequence
  chemically synthesized
tatatgccaagtattgatct

SEQ ID NO: 445776 - DNA, 20 bp, Artificial Sequence
  chemically synthesized
gttaattctgatgagttgct

SEQ ID NO: 445777 - DNA, 20 bp, Artificial Sequence
  chemically synthesized
tattgatctaagcaactcat

SEQ ID NO: 445778 - DNA, 20 bp, Artificial Sequence
  chemically synthesized
atacagtagttaattctgat

SEQ ID NO: 445779 - DNA, 20 bp, Artificial Sequence
  chemically synthesized
tcagaatcaattaaatacag

SEQ ID NO: 445780 - DNA, 20 bp, Artificial Sequence
  chemically synthesized
atctcagaatcaattaaata

SEQ ID NO: 445781 - DNA, 20 bp, Artificial Sequence
  chemically synthesized
tactgtatttaattgattct

SEQ ID NO: 445782 - DNA, 20 bp, Artificial Sequence
  chemically synthesized
taaaatgtgaaatgtcatct

SEQ ID NO: 445783 - DNA, 20 bp, Artificial Sequence
  chemically synthesized
attttaagacatattgattt

SEQ ID NO: 445784 - DNA, 20 bp, Artificial Sequence
  chemically synthesized
cgctatacactaatgatttt

SEQ ID NO: 445785 - DNA, 20 bp, Artificial Sequence
  chemically synthesized
tcaatatgtcttaaaatcat

SEQ ID NO: 445786 - DNA, 20 bp, Artificial Sequence
  chemically synthesized
gtcttaaaatcattagtgta

SEQ ID NO: 445787 - DNA, 20 bp, Artificial Sequence
  chemically synthesized
aatcattagtgtatagcgtt

SEQ ID NO: 445788 - DNA, 20 bp, Artificial Sequence
  chemically synthesized
atcattagtgtatagcgttt

SEQ ID NO: 445789 - DNA, 20 bp, Artificial Sequence
  chemically synthesized
tcattagtgtatagcgttta

SEQ ID NO: 445790 - DNA, 20 bp, Artificial Sequence
  chemically synthesized
cattagtgtatagcgtttag

SEQ ID NO: 445791 - DNA, 20 bp, Artificial Sequence
  chemically synthesized
ggactaacaaattaaaaaac

SEQ ID NO: 445792 - DNA, 20 bp, Artificial Sequence
  chemically synthesized
aggactaacaaattaaaaaa

SEQ ID NO: 445793 - DNA, 20 bp, Artificial Sequence
  chemically synthesized
tatcctgttttttaatttgt

SEQ ID NO: 445794 - DNA, 20 bp, Artificial Sequence
  chemically synthesized
gatagaccattgttgtgtgt

SEQ ID NO: 445795 - DNA, 20 bp, Artificial Sequence
  chemically synthesized
agatagaccattgttgtgtg

SEQ ID NO: 445796 - DNA, 20 bp, Artificial Sequence
  chemically synthesized
gttagtcctacacacaacaa

SEQ ID NO: 445797 - DNA, 20 bp, Artificial Sequence
  chemically synthesized
agaaataataaattgcaaga

SEQ ID NO: 445798 - DNA, 20 bp, Artificial Sequence
  chemically synthesized
tctaagaaataataaattgc

SEQ ID NO: 445799 - DNA, 20 bp, Artificial Sequence
  chemically synthesized
tcttgcaatttattatttct

SEQ ID NO: 445800 - DNA, 20 bp, Artificial Sequence
  chemically synthesized
tgctgtatgtcattgaatct

SEQ ID NO: 445801 - DNA, 20 bp, Artificial Sequence
  chemically synthesized
ttcttagattcaatgacata

SEQ ID NO: 445802 - DNA, 20 bp, Artificial Sequence
  chemically synthesized
ttcaatgacatacagcaata

SEQ ID NO: 445803 - DNA, 20 bp, Artificial Sequence
  chemically synthesized
cagcaatatagttttcacaa

SEQ ID NO: 445804 - DNA, 20 bp, Artificial Sequence
  chemically synthesized
ttcacaacagtttaatcatt

SEQ ID NO: 445805 - DNA, 20 bp, Artificial Sequence
  chemically synthesized
tcacaacagtttaatcattt

SEQ ID NO: 445806 - DNA, 20 bp, Artificial Sequence
  chemically synthesized
cacaacagtttaatcattta

SEQ ID NO: 445807 - DNA, 20 bp, Artificial Sequence
  chemically synthesized
ctataaaatgttgataaaat

SEQ ID NO: 445808 - DNA, 20 bp, Artificial Sequence
  chemically synthesized
cttattttatcaacatttta

SEQ ID NO: 445809 - DNA, 20 bp, Artificial Sequence
  chemically synthesized
attttatagatgtcacaatc

SEQ ID NO: 445810 - DNA, 20 bp, Artificial Sequence
  chemically synthesized
tagatgtcacaatcgagtct

SEQ ID NO: 445811 - DNA, 20 bp, Artificial Sequence
  chemically synthesized
gatgtcacaatcgagtctca

SEQ ID NO: 445812 - DNA, 20 bp, Artificial Sequence
  chemically synthesized
atgtcacaatcgagtctcag

SEQ ID NO: 445813 - DNA, 20 bp, Artificial Sequence
  chemically synthesized
gctaggtgtgtatcacctct

SEQ ID NO: 445814 - DNA, 20 bp, Artificial Sequence
  chemically synthesized
tctcagaggtgatacacacc

SEQ ID NO: 445815 - DNA, 20 bp, Artificial Sequence
  chemically synthesized
tgagcaaccttgaggttgct

SEQ ID NO: 445816 - DNA, 20 bp, Artificial Sequence
  chemically synthesized
ttgagcaaccttgaggttgc

SEQ ID NO: 445817 - DNA, 20 bp, Artificial Sequence
  chemically synthesized
gatacacacctagcaacctc

SEQ ID NO: 445818 - DNA, 20 bp, Artificial Sequence
  chemically synthesized
atacacacctagcaacctca

SEQ ID NO: 445819 - DNA, 20 bp, Artificial Sequence
  chemically synthesized
tgtgaccttgagcaaccttg

SEQ ID NO: 445820 - DNA, 20 bp, Artificial Sequence
  chemically synthesized
gtgtgaccttgagcaacctt

SEQ ID NO: 445821 - DNA, 20 bp, Artificial Sequence
  chemically synthesized
tagcaacctcaaggttgctc

SEQ ID NO: 445822 - DNA, 20 bp, Artificial Sequence
  chemically synthesized
agcaacctcaaggttgctca

SEQ ID NO: 445823 - DNA, 20 bp, Artificial Sequence
  chemically synthesized
ttgactagctgtgtgacctt

SEQ ID NO: 445824 - DNA, 20 bp, Artificial Sequence
  chemically synthesized
caaggttgctcaaggtcaca

SEQ ID NO: 445825 - DNA, 20 bp, Artificial Sequence
  chemically synthesized
gttgctcaaggtcacacagc

SEQ ID NO: 445826 - DNA, 20 bp, Artificial Sequence
  chemically synthesized
aaggtcacacagctagtcaa

SEQ ID NO: 445827 - DNA, 20 bp, Artificial Sequence
  chemically synthesized
ggattaaatctaccattgac

SEQ ID NO: 445828 - DNA, 20 bp, Artificial Sequence
  chemically synthesized
gtcacacagctagtcaatgg

SEQ ID NO: 445829 - DNA, 20 bp, Artificial Sequence
  chemically synthesized
gtcaatggtagatttaatcc

SEQ ID NO: 445830 - DNA, 20 bp, Artificial Sequence
  chemically synthesized
atggtagatttaatcccaga

SEQ ID NO: 445831 - DNA, 20 bp, Artificial Sequence
  chemically synthesized
gctcttggatcaggctatct

SEQ ID NO: 445832 - DNA, 20 bp, Artificial Sequence
  chemically synthesized
ggctcttggatcaggctatc

SEQ ID NO: 445833 - DNA, 20 bp, Artificial Sequence
  chemically synthesized
aatcccagatagcctgatcc

SEQ ID NO: 445834 - DNA, 20 bp, Artificial Sequence
  chemically synthesized
tcccagatagcctgatccaa

SEQ ID NO: 445835 - DNA, 20 bp, Artificial Sequence
  chemically synthesized
agggtacaggctcttggatc

SEQ ID NO: 445836 - DNA, 20 bp, Artificial Sequence
  chemically synthesized
aagggtacaggctcttggat

SEQ ID NO: 445837 - DNA, 20 bp, Artificial Sequence
  chemically synthesized
attctaagggtacaggctct

SEQ ID NO: 445838 - DNA, 20 bp, Artificial Sequence
  chemically synthesized
gatccaagagcctgtaccct

SEQ ID NO: 445839 - DNA, 20 bp, Artificial Sequence
  chemically synthesized
agattatattctaagggtac

SEQ ID NO: 445840 - DNA, 20 bp, Artificial Sequence
  chemically synthesized
cagattatattctaagggta

SEQ ID NO: 445841 - DNA, 20 bp, Artificial Sequence
  chemically synthesized
aggagcagattatattctaa

SEQ ID NO: 445842 - DNA, 20 bp, Artificial Sequence
  chemically synthesized
gaggagcagattatattcta

SEQ ID NO: 445843 - DNA, 20 bp, Artificial Sequence
  chemically synthesized
ggaggagcagattatattct

SEQ ID NO: 445844 - DNA, 20 bp, Artificial Sequence
  chemically synthesized
agaatataatctgctcctcc

SEQ ID NO: 445845 - DNA, 20 bp, Artificial Sequence
  chemically synthesized
tggcgctaatctgggaggag

SEQ ID NO: 445846 - DNA, 20 bp, Artificial Sequence
  chemically synthesized
agatggcgctaatctgggag

SEQ ID NO: 445847 - DNA, 20 bp, Artificial Sequence
  chemically synthesized
ataatctgctcctcccagat

SEQ ID NO: 445848 - DNA, 20 bp, Artificial Sequence
  chemically synthesized
ggagatggcgctaatctggg

SEQ ID NO: 445849 - DNA, 20 bp, Artificial Sequence
  chemically synthesized
gggagatggcgctaatctgg

SEQ ID NO: 445850 - DNA, 20 bp, Artificial Sequence
  chemically synthesized
atgggagatggcgctaatct

SEQ ID NO: 445851 - DNA, 20 bp, Artificial Sequence
  chemically synthesized
catgggagatggcgctaatc

SEQ ID NO: 445852 - DNA, 20 bp, Artificial Sequence
  chemically synthesized
cagattagcgccatctccca

SEQ ID NO: 445853 - DNA, 20 bp, Artificial Sequence
  chemically synthesized
taatggggacccatgggaga

SEQ ID NO: 445854 - DNA, 20 bp, Artificial Sequence
  chemically synthesized
agattagcgccatctcccat

SEQ ID NO: 445855 - DNA, 20 bp, Artificial Sequence
  chemically synthesized
taattaatggggacccatgg

SEQ ID NO: 445856 - DNA, 20 bp, Artificial Sequence
  chemically synthesized
gctaattaatggggacccat

SEQ ID NO: 445857 - DNA, 20 bp, Artificial Sequence
  chemically synthesized
tgctaattaatggggaccca

SEQ ID NO: 445858 - DNA, 20 bp, Artificial Sequence
  chemically synthesized
tcccatgggtccccattaat

SEQ ID NO: 445859 - DNA, 20 bp, Artificial Sequence
  chemically synthesized
gctgtccttgctaattaatg

SEQ ID NO: 445860 - DNA, 20 bp, Artificial Sequence
  chemically synthesized
ggctgtccttgctaattaat

SEQ ID NO: 445861 - DNA, 20 bp, Artificial Sequence
  chemically synthesized
aggctgtccttgctaattaa

SEQ ID NO: 445862 - DNA, 20 bp, Artificial Sequence
  chemically synthesized
atgggtccccattaattagc

SEQ ID NO: 445863 - DNA, 20 bp, Artificial Sequence
  chemically synthesized
tgggtccccattaattagca

SEQ ID NO: 445864 - DNA, 20 bp, Artificial Sequence
  chemically synthesized
tccccattaattagcaagga

SEQ ID NO: 445865 - DNA, 20 bp, Artificial Sequence
  chemically synthesized
tcctcactatgaattagatt

SEQ ID NO: 445866 - DNA, 20 bp, Artificial Sequence
  chemically synthesized
ttcctcactatgaattagat

SEQ ID NO: 445867 - DNA, 20 bp, Artificial Sequence
  chemically synthesized
ggacagcctaatctaattca

SEQ ID NO: 445868 - DNA, 20 bp, Artificial Sequence
  chemically synthesized
ttctcttcctcactatgaat

SEQ ID NO: 445869 - DNA, 20 bp, Artificial Sequence
  chemically synthesized
agcctaatctaattcatagt

SEQ ID NO: 445870 - DNA, 20 bp, Artificial Sequence
  chemically synthesized
gcctaatctaattcatagtg

SEQ ID NO: 445871 - DNA, 20 bp, Artificial Sequence
  chemically synthesized
taatctaattcatagtgagg

SEQ ID NO: 445872 - DNA, 20 bp, Artificial Sequence
  chemically synthesized
atctaattcatagtgaggaa

SEQ ID NO: 445873 - DNA, 20 bp, Artificial Sequence
  chemically synthesized
aggaagagaaacattttcca

SEQ ID NO: 445874 - DNA, 20 bp, Artificial Sequence
  chemically synthesized
ttggcaagttttgcaaactt

SEQ ID NO: 445875 - DNA, 20 bp, Artificial Sequence
  chemically synthesized
caaagtttgcaaaacttgcc

SEQ ID NO: 445876 - DNA, 20 bp, Artificial Sequence
  chemically synthesized
gtttgcaaaacttgccaagc

SEQ ID NO: 445877 - DNA, 20 bp, Artificial Sequence
  chemically synthesized
tataagttggccagcttggc

SEQ ID NO: 445878 - DNA, 20 bp, Artificial Sequence
  chemically synthesized
ataatataagttggccagct

SEQ ID NO: 445879 - DNA, 20 bp, Artificial Sequence
  chemically synthesized
taataataatataagttggc

SEQ ID NO: 445880 - DNA, 20 bp, Artificial Sequence
  chemically synthesized
ataataataataatataagt

SEQ ID NO: 445881 - DNA, 20 bp, Artificial Sequence
  chemically synthesized
aataataataataataatat

SEQ ID NO: 445882 - DNA, 20 bp, Artificial Sequence
  chemically synthesized
ttatttttttttttttttat

SEQ ID NO: 445883 - DNA, 20 bp, Artificial Sequence
  chemically synthesized
ttttttttttttttatgaga

SEQ ID NO: 445884 - DNA, 20 bp, Artificial Sequence
  chemically synthesized
tttttttatgagacggaatc

SEQ ID NO: 445885 - DNA, 20 bp, Artificial Sequence
  chemically synthesized
ttatgagacggaatctggct

SEQ ID NO: 445886 - DNA, 20 bp, Artificial Sequence
  chemically synthesized
tccagcctggacgactgagc

SEQ ID NO: 445887 - DNA, 20 bp, Artificial Sequence
  chemically synthesized
cggaatctggctcagtcgtc

SEQ ID NO: 445888 - DNA, 20 bp, Artificial Sequence
  chemically synthesized
gcactccagcctggacgact

SEQ ID NO: 445889 - DNA, 20 bp, Artificial Sequence
  chemically synthesized
ggaatctggctcagtcgtcc

SEQ ID NO: 445890 - DNA, 20 bp, Artificial Sequence
  chemically synthesized
tctggctcagtcgtccaggc

SEQ ID NO: 445891 - DNA, 20 bp, Artificial Sequence
  chemically synthesized
tggctcagtcgtccaggctg

SEQ ID NO: 445892 - DNA, 20 bp, Artificial Sequence
  chemically synthesized
cgcgccactgcactccagcc

SEQ ID NO: 445893 - DNA, 20 bp, Artificial Sequence
  chemically synthesized
cagtcgtccaggctggagtg

SEQ ID NO: 445894 - DNA, 20 bp, Artificial Sequence
  chemically synthesized
gagatcgcgccactgcactc

SEQ ID NO: 445895 - DNA, 20 bp, Artificial Sequence
  chemically synthesized
tcgtccaggctggagtgcag

SEQ ID NO: 445896 - DNA, 20 bp, Artificial Sequence
  chemically synthesized
ggagtgcagtggcgcgatct

SEQ ID NO: 445897 - DNA, 20 bp, Artificial Sequence
  chemically synthesized
ggcggagcttgcagtgagcc

SEQ ID NO: 445898 - DNA, 20 bp, Artificial Sequence
  chemically synthesized
gcgcgatctcggctcactgc

SEQ ID NO: 445899 - DNA, 20 bp, Artificial Sequence
  chemically synthesized
cgggaggcggagcttgcagt

SEQ ID NO: 445900 - DNA, 20 bp, Artificial Sequence
  chemically synthesized
aacccgggaggcggagcttg

SEQ ID NO: 445901 - DNA, 20 bp, Artificial Sequence
  chemically synthesized
tcactgcaagctccgcctcc

SEQ ID NO: 445902 - DNA, 20 bp, Artificial Sequence
  chemically synthesized
tggcatgaacccgggaggcg

SEQ ID NO: 445903 - DNA, 20 bp, Artificial Sequence
  chemically synthesized
cactgcaagctccgcctccc

SEQ ID NO: 445904 - DNA, 20 bp, Artificial Sequence
  chemically synthesized
aatggcatgaacccgggagg

SEQ ID NO: 445905 - DNA, 20 bp, Artificial Sequence
  chemically synthesized
gagaatggcatgaacccggg

SEQ ID NO: 445906 - DNA, 20 bp, Artificial Sequence
  chemically synthesized
ggagaatggcatgaacccgg

SEQ ID NO: 445907 - DNA, 20 bp, Artificial Sequence
  chemically synthesized
caggagaatggcatgaaccc

SEQ ID NO: 445908 - DNA, 20 bp, Artificial Sequence
  chemically synthesized
gcaggagaatggcatgaacc

SEQ ID NO: 445909 - DNA, 20 bp, Artificial Sequence
  chemically synthesized
aggaggcagaggcaggagaa

SEQ ID NO: 445910 - DNA, 20 bp, Artificial Sequence
  chemically synthesized
tactcaggaggcagaggcag

SEQ ID NO: 445911 - DNA, 20 bp, Artificial Sequence
  chemically synthesized
gctactcaggaggcagaggc

SEQ ID NO: 445912 - DNA, 20 bp, Artificial Sequence
  chemically synthesized
agctactcaggaggcagagg

SEQ ID NO: 445913 - DNA, 20 bp, Artificial Sequence
  chemically synthesized
cccagctactcaggaggcag

SEQ ID NO: 445914 - DNA, 20 bp, Artificial Sequence
  chemically synthesized
tcccagctactcaggaggca

SEQ ID NO: 445915 - DNA, 20 bp, Artificial Sequence
  chemically synthesized
ttctcctgcctctgcctcct

SEQ ID NO: 445916 - DNA, 20 bp, Artificial Sequence
  chemically synthesized
ggtcccagctactcaggagg

SEQ ID NO: 445917 - DNA, 20 bp, Artificial Sequence
  chemically synthesized
tcctgcctctgcctcctgag

SEQ ID NO: 445918 - DNA, 20 bp, Artificial Sequence
  chemically synthesized
tgtggtcccagctactcagg

SEQ ID NO: 445919 - DNA, 20 bp, Artificial Sequence
  chemically synthesized
ctgtggtcccagctactcag

SEQ ID NO: 445920 - DNA, 20 bp, Artificial Sequence
  chemically synthesized
gcctctgcctcctgagtagc

SEQ ID NO: 445921 - DNA, 20 bp, Artificial Sequence
  chemically synthesized
gcctgtggtcccagctactc

SEQ ID NO: 445922 - DNA, 20 bp, Artificial Sequence
  chemically synthesized
cctctgcctcctgagtagct

SEQ ID NO: 445923 - DNA, 20 bp, Artificial Sequence
  chemically synthesized
tgcctgtggtcccagctact

SEQ ID NO: 445924 - DNA, 20 bp, Artificial Sequence
  chemically synthesized
ctcctgagtagctgggacca

SEQ ID NO: 445925 - DNA, 20 bp, Artificial Sequence
  chemically synthesized
tcctgagtagctgggaccac

SEQ ID NO: 445926 - DNA, 20 bp, Artificial Sequence
  chemically synthesized
gtggcaggtgcctgtggtcc

SEQ ID NO: 445927 - DNA, 20 bp, Artificial Sequence
  chemically synthesized
ggcgtggtggcaggtgcctg

SEQ ID NO: 445928 - DNA, 20 bp, Artificial Sequence
  chemically synthesized
aattagccgggcgtggtggc

SEQ ID NO: 445929 - DNA, 20 bp, Artificial Sequence
  chemically synthesized
aaattagccgggcgtggtgg

SEQ ID NO: 445930 - DNA, 20 bp, Artificial Sequence
  chemically synthesized
caggcacctgccaccacgcc

SEQ ID NO: 445931 - DNA, 20 bp, Artificial Sequence
  chemically synthesized
aaaaaattagccgggcgtgg

SEQ ID NO: 445932 - DNA, 20 bp, Artificial Sequence
  chemically synthesized
acaaaaaaattagccgggcg

SEQ ID NO: 445933 - DNA, 20 bp, Artificial Sequence
  chemically synthesized
aaaatacaaaaaaattagcc

SEQ ID NO: 445934 - DNA, 20 bp, Artificial Sequence
  chemically synthesized
aaaaatacaaaaaaattagc

SEQ ID NO: 445935 - DNA, 20 bp, Artificial Sequence
  chemically synthesized
tactaaaaatacaaaaaaat

SEQ ID NO: 445936 - DNA, 20 bp, Artificial Sequence
  chemically synthesized
ggctaatttttttgtatttt

SEQ ID NO: 445937 - DNA, 20 bp, Artificial Sequence
  chemically synthesized
taatttttttgtatttttag

SEQ ID NO: 445938 - DNA, 20 bp, Artificial Sequence
  chemically synthesized
atttttttgtatttttagta

SEQ ID NO: 445939 - DNA, 20 bp, Artificial Sequence
  chemically synthesized
ttttgtatttttagtagaga

SEQ ID NO: 445940 - DNA, 20 bp, Artificial Sequence
  chemically synthesized
tttgtatttttagtagagat

SEQ ID NO: 445941 - DNA, 20 bp, Artificial Sequence
  chemically synthesized
ttgtatttttagtagagatg

SEQ ID NO: 445942 - DNA, 20 bp, Artificial Sequence
  chemically synthesized
gagatggggtttcaccttgt

SEQ ID NO: 445943 - DNA, 20 bp, Artificial Sequence
  chemically synthesized
tggggtttcaccttgttagc

SEQ ID NO: 445944 - DNA, 20 bp, Artificial Sequence
  chemically synthesized
cgagaccatcctggctaaca

SEQ ID NO: 445945 - DNA, 20 bp, Artificial Sequence
  chemically synthesized
ggggtttcaccttgttagcc

SEQ ID NO: 445946 - DNA, 20 bp, Artificial Sequence
  chemically synthesized
tcgagaccatcctggctaac

SEQ ID NO: 445947 - DNA, 20 bp, Artificial Sequence
  chemically synthesized
tttcaccttgttagccagga

SEQ ID NO: 445948 - DNA, 20 bp, Artificial Sequence
  chemically synthesized
tcatgagatcgagaccatcc

SEQ ID NO: 445949 - DNA, 20 bp, Artificial Sequence
  chemically synthesized
gatcacgaggtcatgagatc

SEQ ID NO: 445950 - DNA, 20 bp, Artificial Sequence
  chemically synthesized
cgggcggatcacgaggtcat

SEQ ID NO: 445951 - DNA, 20 bp, Artificial Sequence
  chemically synthesized
gccgaggcgggcggatcacg

SEQ ID NO: 445952 - DNA, 20 bp, Artificial Sequence
  chemically synthesized
ggccgaggcgggcggatcac

SEQ ID NO: 445953 - DNA, 20 bp, Artificial Sequence
  chemically synthesized
acctcgtgatccgcccgcct

SEQ ID NO: 445954 - DNA, 20 bp, Artificial Sequence
  chemically synthesized
ctttgggaggccgaggcggg

SEQ ID NO: 445955 - DNA, 20 bp, Artificial Sequence
  chemically synthesized
gcactttgggaggccgaggc

SEQ ID NO: 445956 - DNA, 20 bp, Artificial Sequence
  chemically synthesized
agcactttgggaggccgagg

SEQ ID NO: 445957 - DNA, 20 bp, Artificial Sequence
  chemically synthesized
cccagcactttgggaggccg

SEQ ID NO: 445958 - DNA, 20 bp, Artificial Sequence
  chemically synthesized
tcccagcactttgggaggcc

SEQ ID NO: 445959 - DNA, 20 bp, Artificial Sequence
  chemically synthesized
ccgcccgcctcggcctccca

SEQ ID NO: 445960 - DNA, 20 bp, Artificial Sequence
  chemically synthesized
tgtaatcccagcactttggg

SEQ ID NO: 445961 - DNA, 20 bp, Artificial Sequence
  chemically synthesized
ctgtaatcccagcactttgg

SEQ ID NO: 445962 - DNA, 20 bp, Artificial Sequence
  chemically synthesized
gcctcggcctcccaaagtgc

SEQ ID NO: 445963 - DNA, 20 bp, Artificial Sequence
  chemically synthesized
acctgtaatcccagcacttt

SEQ ID NO: 445964 - DNA, 20 bp, Artificial Sequence
  chemically synthesized
cctcggcctcccaaagtgct

SEQ ID NO: 445965 - DNA, 20 bp, Artificial Sequence
  chemically synthesized
cacctgtaatcccagcactt

SEQ ID NO: 445966 - DNA, 20 bp, Artificial Sequence
  chemically synthesized
ctcccaaagtgctgggatta

SEQ ID NO: 445967 - DNA, 20 bp, Artificial Sequence
  chemically synthesized
tcccaaagtgctgggattac

SEQ ID NO: 445968 - DNA, 20 bp, Artificial Sequence
  chemically synthesized
gtggctcacacctgtaatcc

SEQ ID NO: 445969 - DNA, 20 bp, Artificial Sequence
  chemically synthesized
agtgctgggattacaggtgt

SEQ ID NO: 445970 - DNA, 20 bp, Artificial Sequence
  chemically synthesized
actataacggacaggcgcag

SEQ ID NO: 445971 - DNA, 20 bp, Artificial Sequence
  chemically synthesized
aatactataacggacaggcg

SEQ ID NO: 445972 - DNA, 20 bp, Artificial Sequence
  chemically synthesized
tgcttaatactataacggac

SEQ ID NO: 445973 - DNA, 20 bp, Artificial Sequence
  chemically synthesized
gccactgcgcctgtccgtta

SEQ ID NO: 445974 - DNA, 20 bp, Artificial Sequence
  chemically synthesized
ttgcttaatactataacgga

SEQ ID NO: 445975 - DNA, 20 bp, Artificial Sequence
  chemically synthesized
cgttttgcttaatactataa

SEQ ID NO: 445976 - DNA, 20 bp, Artificial Sequence
  chemically synthesized
cgcctgtccgttatagtatt

SEQ ID NO: 445977 - DNA, 20 bp, Artificial Sequence
  chemically synthesized
gttatagtattaagcaaaac

SEQ ID NO: 445978 - DNA, 20 bp, Artificial Sequence
  chemically synthesized
gcaaaacgagtgccaatatt

SEQ ID NO: 445979 - DNA, 20 bp, Artificial Sequence
  chemically synthesized
aggaaggagaagccaaatat

SEQ ID NO: 445980 - DNA, 20 bp, Artificial Sequence
  chemically synthesized
gaaaaaaaaaaaggaaggag

SEQ ID NO: 445981 - DNA, 20 bp, Artificial Sequence
  chemically synthesized
aaagaaaaaaaaaaaggaag

SEQ ID NO: 445982 - DNA, 20 bp, Artificial Sequence
  chemically synthesized
aaaaagaaaaaaaaaaagga

SEQ ID NO: 445983 - DNA, 20 bp, Artificial Sequence
  chemically synthesized
aaaaaagaaaaaaaaaaagg

SEQ ID NO: 445984 - DNA, 20 bp, Artificial Sequence
  chemically synthesized
aaaaaaaaagaaaaaaaaaa

SEQ ID NO: 445985 - DNA, 20 bp, Artificial Sequence
  chemically synthesized
caaaaaaaaagaaaaaaaaa

SEQ ID NO: 445986 - DNA, 20 bp, Artificial Sequence
  chemically synthesized
gggaaactttgtcaaaaaaa

SEQ ID NO: 445987 - DNA, 20 bp, Artificial Sequence
  chemically synthesized
ttttttctttttttttgaca

SEQ ID NO: 445988 - DNA, 20 bp, Artificial Sequence
  chemically synthesized
ctccagcctaggtgacaaga

SEQ ID NO: 445989 - DNA, 20 bp, Artificial Sequence
  chemically synthesized
actccagcctaggtgacaag

SEQ ID NO: 445990 - DNA, 20 bp, Artificial Sequence
  chemically synthesized
cactccagcctaggtgacaa

SEQ ID NO: 445991 - DNA, 20 bp, Artificial Sequence
  chemically synthesized
aaagtttccctcttgtcacc

SEQ ID NO: 445992 - DNA, 20 bp, Artificial Sequence
  chemically synthesized
aagtttccctcttgtcacct

SEQ ID NO: 445993 - DNA, 20 bp, Artificial Sequence
  chemically synthesized
tgcactccagcctaggtgac

SEQ ID NO: 445994 - DNA, 20 bp, Artificial Sequence
  chemically synthesized
ttccctcttgtcacctaggc

SEQ ID NO: 445995 - DNA, 20 bp, Artificial Sequence
  chemically synthesized
ccctcttgtcacctaggctg

SEQ ID NO: 445996 - DNA, 20 bp, Artificial Sequence
  chemically synthesized
gcgccattgcactccagcct

SEQ ID NO: 445997 - DNA, 20 bp, Artificial Sequence
  chemically synthesized
cgcgccattgcactccagcc

SEQ ID NO: 445998 - DNA, 20 bp, Artificial Sequence
  chemically synthesized
gagatcgcgccattgcactc

SEQ ID NO: 445999 - DNA, 20 bp, Artificial Sequence
  chemically synthesized
tcacctaggctggagtgcaa

SEQ ID NO: 446000 - DNA, 20 bp, Artificial Sequence
  chemically synthesized
ggagtgcaatggcgcgatct

SEQ ID NO: 446001 - DNA, 20 bp, Artificial Sequence
  chemically synthesized
ggctgaggttgcagtgagcc

SEQ ID NO: 446002 - DNA, 20 bp, Artificial Sequence
  chemically synthesized
tggaaggctgaggttgcagt

SEQ ID NO: 446003 - DNA, 20 bp, Artificial Sequence
  chemically synthesized
atctcggctcactgcaacct

SEQ ID NO: 446004 - DNA, 20 bp, Artificial Sequence
  chemically synthesized
aacctggaaggctgaggttg

SEQ ID NO: 446005 - DNA, 20 bp, Artificial Sequence
  chemically synthesized
cactagaacctggaaggctg

SEQ ID NO: 446006 - DNA, 20 bp, Artificial Sequence
  chemically synthesized
tcactgcaacctcagccttc

SEQ ID NO: 446007 - DNA, 20 bp, Artificial Sequence
  chemically synthesized
tcactagaacctggaaggct

SEQ ID NO: 446008 - DNA, 20 bp, Artificial Sequence
  chemically synthesized
cactgcaacctcagccttcc

SEQ ID NO: 446009 - DNA, 20 bp, Artificial Sequence
  chemically synthesized
gagaatcactagaacctgga

SEQ ID NO: 446010 - DNA, 20 bp, Artificial Sequence
  chemically synthesized
ggagaatcactagaacctgg

SEQ ID NO: 446011 - DNA, 20 bp, Artificial Sequence
  chemically synthesized
aacctcagccttccaggttc

SEQ ID NO: 446012 - DNA, 20 bp, Artificial Sequence
  chemically synthesized
gcaggagaatcactagaacc

SEQ ID NO: 446013 - DNA, 20 bp, Artificial Sequence
  chemically synthesized
ggctgaggcaggagaatcac

SEQ ID NO: 446014 - DNA, 20 bp, Artificial Sequence
  chemically synthesized
ttctagtgattctcctgcct

SEQ ID NO: 446015 - DNA, 20 bp, Artificial Sequence
  chemically synthesized
tacttgagaggctgaggcag

SEQ ID NO: 446016 - DNA, 20 bp, Artificial Sequence
  chemically synthesized
gctacttgagaggctgaggc

SEQ ID NO: 446017 - DNA, 20 bp, Artificial Sequence
  chemically synthesized
agctacttgagaggctgagg

SEQ ID NO: 446018 - DNA, 20 bp, Artificial Sequence
  chemically synthesized
cccagctacttgagaggctg

SEQ ID NO: 446019 - DNA, 20 bp, Artificial Sequence
  chemically synthesized
tcccagctacttgagaggct

SEQ ID NO: 446020 - DNA, 20 bp, Artificial Sequence
  chemically synthesized
ttctcctgcctcagcctctc

SEQ ID NO: 446021 - DNA, 20 bp, Artificial Sequence
  chemically synthesized
tcctgcctcagcctctcaag

SEQ ID NO: 446022 - DNA, 20 bp, Artificial Sequence
  chemically synthesized
tgtaatcccagctacttgag

SEQ ID NO: 446023 - DNA, 20 bp, Artificial Sequence
  chemically synthesized
ctgtaatcccagctacttga

SEQ ID NO: 446024 - DNA, 20 bp, Artificial Sequence
  chemically synthesized
gcctcagcctctcaagtagc

SEQ ID NO: 446025 - DNA, 20 bp, Artificial Sequence
  chemically synthesized
gcctgtaatcccagctactt

SEQ ID NO: 446026 - DNA, 20 bp, Artificial Sequence
  chemically synthesized
cctcagcctctcaagtagct

SEQ ID NO: 446027 - DNA, 20 bp, Artificial Sequence
  chemically synthesized
ctctcaagtagctgggatta

SEQ ID NO: 446028 - DNA, 20 bp, Artificial Sequence
  chemically synthesized
tctcaagtagctgggattac

SEQ ID NO: 446029 - DNA, 20 bp, Artificial Sequence
  chemically synthesized
gtggtgcatgcctgtaatcc

SEQ ID NO: 446030 - DNA, 20 bp, Artificial Sequence
  chemically synthesized
caggcatgcaccaccacacc

SEQ ID NO: 446031 - DNA, 20 bp, Artificial Sequence
  chemically synthesized
caacaattagctgggtgtgg

SEQ ID NO: 446032 - DNA, 20 bp, Artificial Sequence
  chemically synthesized
atacaacaattagctgggtg

SEQ ID NO: 446033 - DNA, 20 bp, Artificial Sequence
  chemically synthesized
taaaaatacaacaattagct

SEQ ID NO: 446034 - DNA, 20 bp, Artificial Sequence
  chemically synthesized
ctaaaaatacaacaattagc

SEQ ID NO: 446035 - DNA, 20 bp, Artificial Sequence
  chemically synthesized
tgtactaaaaatacaacaat

SEQ ID NO: 446036 - DNA, 20 bp, Artificial Sequence
  chemically synthesized
ccagctaattgttgtatttt

SEQ ID NO: 446037 - DNA, 20 bp, Artificial Sequence
  chemically synthesized
taattgttgtatttttagta

SEQ ID NO: 446038 - DNA, 20 bp, Artificial Sequence
  chemically synthesized
tgttgtatttttagtacaga

SEQ ID NO: 446039 - DNA, 20 bp, Artificial Sequence
  chemically synthesized
gttgtatttttagtacagat

SEQ ID NO: 446040 - DNA, 20 bp, Artificial Sequence
  chemically synthesized
ttgtatttttagtacagatg

SEQ ID NO: 446041 - DNA, 20 bp, Artificial Sequence
  chemically synthesized
cagatggggtttcaccatgt

SEQ ID NO: 446042 - DNA, 20 bp, Artificial Sequence
  chemically synthesized
tggggtttcaccatgttggc

SEQ ID NO: 446043 - DNA, 20 bp, Artificial Sequence
  chemically synthesized
caagaccagcctggccaaca

SEQ ID NO: 446044 - DNA, 20 bp, Artificial Sequence
  chemically synthesized
ggggtttcaccatgttggcc

SEQ ID NO: 446045 - DNA, 20 bp, Artificial Sequence
  chemically synthesized
tttcaccatgttggccaggc

SEQ ID NO: 446046 - DNA, 20 bp, Artificial Sequence
  chemically synthesized
tcaggagttcaagaccagcc

SEQ ID NO: 446047 - DNA, 20 bp, Artificial Sequence
  chemically synthesized
tgagatcaggagttcaagac

SEQ ID NO: 446048 - DNA, 20 bp, Artificial Sequence
  chemically synthesized
tcacttgagatcaggagttc

SEQ ID NO: 446049 - DNA, 20 bp, Artificial Sequence
  chemically synthesized
ggtgggtcacttgagatcag

SEQ ID NO: 446050 - DNA, 20 bp, Artificial Sequence
  chemically synthesized
ggtcttgaactcctgatctc

SEQ ID NO: 446051 - DNA, 20 bp, Artificial Sequence
  chemically synthesized
tgggtgggtcacttgagatc

SEQ ID NO: 446052 - DNA, 20 bp, Artificial Sequence
  chemically synthesized
ttgggtgggtcacttgagat

SEQ ID NO: 446053 - DNA, 20 bp, Artificial Sequence
  chemically synthesized
ccaagttgggtgggtcactt

SEQ ID NO: 446054 - DNA, 20 bp, Artificial Sequence
  chemically synthesized
tttgggaggccaagttgggt

SEQ ID NO: 446055 - DNA, 20 bp, Artificial Sequence
  chemically synthesized
ctcaagtgacccacccaact

SEQ ID NO: 446056 - DNA, 20 bp, Artificial Sequence
  chemically synthesized
gtttgggaggccaagttggg

SEQ ID NO: 446057 - DNA, 20 bp, Artificial Sequence
  chemically synthesized
gaagtttgggaggccaagtt

SEQ ID NO: 446058 - DNA, 20 bp, Artificial Sequence
  chemically synthesized
agaagtttgggaggccaagt

SEQ ID NO: 446059 - DNA, 20 bp, Artificial Sequence
  chemically synthesized
tcccagaagtttgggaggcc

SEQ ID NO: 446060 - DNA, 20 bp, Artificial Sequence
  chemically synthesized
tgtaatcccagaagtttggg

SEQ ID NO: 446061 - DNA, 20 bp, Artificial Sequence
  chemically synthesized
ctgtaatcccagaagtttgg

SEQ ID NO: 446062 - DNA, 20 bp, Artificial Sequence
  chemically synthesized
aacttggcctcccaaacttc

SEQ ID NO: 446063 - DNA, 20 bp, Artificial Sequence
  chemically synthesized
acctgtaatcccagaagttt

SEQ ID NO: 446064 - DNA, 20 bp, Artificial Sequence
  chemically synthesized
acttggcctcccaaacttct

SEQ ID NO: 446065 - DNA, 20 bp, Artificial Sequence
  chemically synthesized
cacctgtaatcccagaagtt

SEQ ID NO: 446066 - DNA, 20 bp, Artificial Sequence
  chemically synthesized
gctcacacctgtaatcccag

SEQ ID NO: 446067 - DNA, 20 bp, Artificial Sequence
  chemically synthesized
ctcccaaacttctgggatta

SEQ ID NO: 446068 - DNA, 20 bp, Artificial Sequence
  chemically synthesized
tcccaaacttctgggattac

SEQ ID NO: 446069 - DNA, 20 bp, Artificial Sequence
  chemically synthesized
gtggctcacacctgtaatcc

SEQ ID NO: 446070 - DNA, 20 bp, Artificial Sequence
  chemically synthesized
acttctgggattacaggtgt

SEQ ID NO: 446071 - DNA, 20 bp, Artificial Sequence
  chemically synthesized
caggtgtgagccaccgcgtc

SEQ ID NO: 446072 - DNA, 20 bp, Artificial Sequence
  chemically synthesized
gaaggagagtccggacgcgg

SEQ ID NO: 446073 - DNA, 20 bp, Artificial Sequence
  chemically synthesized
gaggaaggagagtccggacg

SEQ ID NO: 446074 - DNA, 20 bp, Artificial Sequence
  chemically synthesized
ttgaaagaggaaggagagtc

SEQ ID NO: 446075 - DNA, 20 bp, Artificial Sequence
  chemically synthesized
acaacttgaaagaggaagga

SEQ ID NO: 446076 - DNA, 20 bp, Artificial Sequence
  chemically synthesized
aaacaacttgaaagaggaag

SEQ ID NO: 446077 - DNA, 20 bp, Artificial Sequence
  chemically synthesized
ggaaacaacttgaaagagga

SEQ ID NO: 446078 - DNA, 20 bp, Artificial Sequence
  chemically synthesized
aggaaacaacttgaaagagg

SEQ ID NO: 446079 - DNA, 20 bp, Artificial Sequence
  chemically synthesized
cggactctccttcctctttc

SEQ ID NO: 446080 - DNA, 20 bp, Artificial Sequence
  chemically synthesized
cccaggaaacaacttgaaag

SEQ ID NO: 446081 - DNA, 20 bp, Artificial Sequence
  chemically synthesized
acccaggaaacaacttgaaa

SEQ ID NO: 446082 - DNA, 20 bp, Artificial Sequence
  chemically synthesized
acacccaggaaacaacttga

SEQ ID NO: 446083 - DNA, 20 bp, Artificial Sequence
  chemically synthesized
tcctctttcaagttgtttcc

SEQ ID NO: 446084 - DNA, 20 bp, Artificial Sequence
  chemically synthesized
cctctttcaagttgtttcct

SEQ ID NO: 446085 - DNA, 20 bp, Artificial Sequence
  chemically synthesized
ttcaagttgtttcctgggtg

SEQ ID NO: 446086 - DNA, 20 bp, Artificial Sequence
  chemically synthesized
tcaagttgtttcctgggtgt

SEQ ID NO: 446087 - DNA, 20 bp, Artificial Sequence
  chemically synthesized
caagttgtttcctgggtgtg

SEQ ID NO: 446088 - DNA, 20 bp, Artificial Sequence
  chemically synthesized
ccccaccacaccccacaccc

SEQ ID NO: 446089 - DNA, 20 bp, Artificial Sequence
  chemically synthesized
tccccaccacaccccacacc

SEQ ID NO: 446090 - DNA, 20 bp, Artificial Sequence
  chemically synthesized
tgtttcctgggtgtggggtg

SEQ ID NO: 446091 - DNA, 20 bp, Artificial Sequence
  chemically synthesized
ttcctgggtgtggggtgtgg

SEQ ID NO: 446092 - DNA, 20 bp, Artificial Sequence
  chemically synthesized
tcctgggtgtggggtgtggt

SEQ ID NO: 446093 - DNA, 20 bp, Artificial Sequence
  chemically synthesized
cctgggtgtggggtgtggtg

SEQ ID NO: 446094 - DNA, 20 bp, Artificial Sequence
  chemically synthesized
gtgtggggtgtggtggggaa

SEQ ID NO: 446095 - DNA, 20 bp, Artificial Sequence
  chemically synthesized
gtggggtgtggtggggaaca

SEQ ID NO: 446096 - DNA, 20 bp, Artificial Sequence
  chemically synthesized
tggggtgtggtggggaacag

SEQ ID NO: 446097 - DNA, 20 bp, Artificial Sequence
  chemically synthesized
gtggggaacagaggcgtaaa

SEQ ID NO: 446098 - DNA, 20 bp, Artificial Sequence
  chemically synthesized
gggaacagaggcgtaaatag

SEQ ID NO: 446099 - DNA, 20 bp, Artificial Sequence
  chemically synthesized
ggaacagaggcgtaaatagc

SEQ ID NO: 446100 - DNA, 20 bp, Artificial Sequence
  chemically synthesized
cgtaaatagcaggtccttta

SEQ ID NO: 446101 - DNA, 20 bp, Artificial Sequence
  chemically synthesized
tgtggtaggtggttctgtaa

SEQ ID NO: 446102 - DNA, 20 bp, Artificial Sequence
  chemically synthesized
ttgtggtaggtggttctgta

SEQ ID NO: 446103 - DNA, 20 bp, Artificial Sequence
  chemically synthesized
gtagtcatctttgtggtagg

SEQ ID NO: 446104 - DNA, 20 bp, Artificial Sequence
  chemically synthesized
ttacagaaccacctaccaca

SEQ ID NO: 446105 - DNA, 20 bp, Artificial Sequence
  chemically synthesized
agtgtagtcatctttgtggt

SEQ ID NO: 446106 - DNA, 20 bp, Artificial Sequence
  chemically synthesized
aagtgtagtcatctttgtgg

SEQ ID NO: 446107 - DNA, 20 bp, Artificial Sequence
  chemically synthesized
gcaaagtgtagtcatctttg

SEQ ID NO: 446108 - DNA, 20 bp, Artificial Sequence
  chemically synthesized
ctttttgtgtaggcaaagtg

SEQ ID NO: 446109 - DNA, 20 bp, Artificial Sequence
  chemically synthesized
gccagctttttgtgtaggca

SEQ ID NO: 446110 - DNA, 20 bp, Artificial Sequence
  chemically synthesized
ctacactttgcctacacaaa

SEQ ID NO: 446111 - DNA, 20 bp, Artificial Sequence
  chemically synthesized
cttctgccagctttttgtgt

SEQ ID NO: 446112 - DNA, 20 bp, Artificial Sequence
  chemically synthesized
gcttctgccagctttttgtg

SEQ ID NO: 446113 - DNA, 20 bp, Artificial Sequence
  chemically synthesized
actttgcctacacaaaaagc

SEQ ID NO: 446114 - DNA, 20 bp, Artificial Sequence
  chemically synthesized
ttgcctacacaaaaagctgg

SEQ ID NO: 446115 - DNA, 20 bp, Artificial Sequence
  chemically synthesized
cctacacaaaaagctggcag

SEQ ID NO: 446116 - DNA, 20 bp, Artificial Sequence
  chemically synthesized
ataaagcaaaaagcttctgc

SEQ ID NO: 446117 - DNA, 20 bp, Artificial Sequence
  chemically synthesized
ggcctccaaaataaagcaaa

SEQ ID NO: 446118 - DNA, 20 bp, Artificial Sequence
  chemically synthesized
agaagctttttgctttattt

SEQ ID NO: 446119 - DNA, 20 bp, Artificial Sequence
  chemically synthesized
aagctttttgctttattttg

SEQ ID NO: 446120 - DNA, 20 bp, Artificial Sequence
  chemically synthesized
ttgataaggcctccaaaata

SEQ ID NO: 446121 - DNA, 20 bp, Artificial Sequence
  chemically synthesized
agctttttgctttattttgg

SEQ ID NO: 446122 - DNA, 20 bp, Artificial Sequence
  chemically synthesized
ttctgccctggtgtttgata

SEQ ID NO: 446123 - DNA, 20 bp, Artificial Sequence
  chemically synthesized
attctgccctggtgtttgat

SEQ ID NO: 446124 - DNA, 20 bp, Artificial Sequence
  chemically synthesized
ttggaggccttatcaaacac

SEQ ID NO: 446125 - DNA, 20 bp, Artificial Sequence
  chemically synthesized
tggaggccttatcaaacacc

SEQ ID NO: 446126 - DNA, 20 bp, Artificial Sequence
  chemically synthesized
ggaggccttatcaaacacca

SEQ ID NO: 446127 - DNA, 20 bp, Artificial Sequence
  chemically synthesized
ggccttatcaaacaccaggg

SEQ ID NO: 446128 - DNA, 20 bp, Artificial Sequence
  chemically synthesized
gattacagatcattctgccc

SEQ ID NO: 446129 - DNA, 20 bp, Artificial Sequence
  chemically synthesized
gcttctcacctcagagatta

SEQ ID NO: 446130 - DNA, 20 bp, Artificial Sequence
  chemically synthesized
cagaatgatctgtaatctct

SEQ ID NO: 446131 - DNA, 20 bp, Artificial Sequence
  chemically synthesized
agaatgatctgtaatctctg

SEQ ID NO: 446132 - DNA, 20 bp, Artificial Sequence
  chemically synthesized
tgatctgtaatctctgaggt

SEQ ID NO: 446133 - DNA, 20 bp, Artificial Sequence
  chemically synthesized
ctcactagcttctcacctca

SEQ ID NO: 446134 - DNA, 20 bp, Artificial Sequence
  chemically synthesized
tctgtaatctctgaggtgag

SEQ ID NO: 446135 - DNA, 20 bp, Artificial Sequence
  chemically synthesized
tcctcactagcttctcacct

SEQ ID NO: 446136 - DNA, 20 bp, Artificial Sequence
  chemically synthesized
taatctctgaggtgagaagc

SEQ ID NO: 446137 - DNA, 20 bp, Artificial Sequence
  chemically synthesized
ctctgaggtgagaagctagt

SEQ ID NO: 446138 - DNA, 20 bp, Artificial Sequence
  chemically synthesized
tctgaggtgagaagctagtg

SEQ ID NO: 446139 - DNA, 20 bp, Artificial Sequence
  chemically synthesized
gaaaagtggttaatcctcac

SEQ ID NO: 446140 - DNA, 20 bp, Artificial Sequence
  chemically synthesized
tttttgctaggagagaaaag

SEQ ID NO: 446141 - DNA, 20 bp, Artificial Sequence
  chemically synthesized
gagtttttgctaggagagaa

SEQ ID NO: 446142 - DNA, 20 bp, Artificial Sequence
  chemically synthesized
gattaaccacttttctctcc

SEQ ID NO: 446143 - DNA, 20 bp, Artificial Sequence
  chemically synthesized
tttgggagtttttgctagga

SEQ ID NO: 446144 - DNA, 20 bp, Artificial Sequence
  chemically synthesized
catttgggagtttttgctag

SEQ ID NO: 446145 - DNA, 20 bp, Artificial Sequence
  chemically synthesized
accatttgggagtttttgct

SEQ ID NO: 446146 - DNA, 20 bp, Artificial Sequence
  chemically synthesized
caccatttgggagtttttgc

SEQ ID NO: 446147 - DNA, 20 bp, Artificial Sequence
  chemically synthesized
tcctagcaaaaactcccaaa

SEQ ID NO: 446148 - DNA, 20 bp, Artificial Sequence
  chemically synthesized
ccactagcctcaccatttgg

SEQ ID NO: 446149 - DNA, 20 bp, Artificial Sequence
  chemically synthesized
agcaaaaactcccaaatggt

SEQ ID NO: 446150 - DNA, 20 bp, Artificial Sequence
  chemically synthesized
ccccactagcctcaccattt

SEQ ID NO: 446151 - DNA, 20 bp, Artificial Sequence
  chemically synthesized
gcaaaaactcccaaatggtg

SEQ ID NO: 446152 - DNA, 20 bp, Artificial Sequence
  chemically synthesized
tccccactagcctcaccatt

SEQ ID NO: 446153 - DNA, 20 bp, Artificial Sequence
  chemically synthesized
aaactcccaaatggtgaggc

SEQ ID NO: 446154 - DNA, 20 bp, Artificial Sequence
  chemically synthesized
ctcccaaatggtgaggctag

SEQ ID NO: 446155 - DNA, 20 bp, Artificial Sequence
  chemically synthesized
tcccaaatggtgaggctagt

SEQ ID NO: 446156 - DNA, 20 bp, Artificial Sequence
  chemically synthesized
cccaaatggtgaggctagtg

SEQ ID NO: 446157 - DNA, 20 bp, Artificial Sequence
  chemically synthesized
aaatggtgaggctagtgggg

SEQ ID NO: 446158 - DNA, 20 bp, Artificial Sequence
  chemically synthesized
aatggtgaggctagtgggga

SEQ ID NO: 446159 - DNA, 20 bp, Artificial Sequence
  chemically synthesized
accacccggtccttccccac

SEQ ID NO: 446160 - DNA, 20 bp, Artificial Sequence
  chemically synthesized
tgaggctagtggggaaggac

SEQ ID NO: 446161 - DNA, 20 bp, Artificial Sequence
  chemically synthesized
gaggctagtggggaaggacc

SEQ ID NO: 446162 - DNA, 20 bp, Artificial Sequence
  chemically synthesized
gctagtggggaaggaccggg

SEQ ID NO: 446163 - DNA, 20 bp, Artificial Sequence
  chemically synthesized
agtggggaaggaccgggtgg

SEQ ID NO: 446164 - DNA, 20 bp, Artificial Sequence
  chemically synthesized
agaacaataacactaccacc

SEQ ID NO: 446165 - DNA, 20 bp, Artificial Sequence
  chemically synthesized
tggtagtgttattgttcttc

SEQ ID NO: 446166 - DNA, 20 bp, Artificial Sequence
  chemically synthesized
ttacaaatacatgtaactgg

SEQ ID NO: 446167 - DNA, 20 bp, Artificial Sequence
  chemically synthesized
atattacaaatacatgtaac

SEQ ID NO: 446168 - DNA, 20 bp, Artificial Sequence
  chemically synthesized
atatacataattaatagata

SEQ ID NO: 446169 - DNA, 20 bp, Artificial Sequence
  chemically synthesized
aatatacataattaatagat

SEQ ID NO: 446170 - DNA, 20 bp, Artificial Sequence
  chemically synthesized
gataaaatatacataattaa

SEQ ID NO: 446171 - DNA, 20 bp, Artificial Sequence
  chemically synthesized
attaattatgtatattttat

SEQ ID NO: 446172 - DNA, 20 bp, Artificial Sequence
  chemically synthesized
gtcacagttggatggggaat

SEQ ID NO: 446173 - DNA, 20 bp, Artificial Sequence
  chemically synthesized
ccctctgtcacagttggatg

SEQ ID NO: 446174 - DNA, 20 bp, Artificial Sequence
  chemically synthesized
tccctctgtcacagttggat

SEQ ID NO: 446175 - DNA, 20 bp, Artificial Sequence
  chemically synthesized
ttccctctgtcacagttgga

SEQ ID NO: 446176 - DNA, 20 bp, Artificial Sequence
  chemically synthesized
cattccccatccaactgtga

SEQ ID NO: 446177 - DNA, 20 bp, Artificial Sequence
  chemically synthesized
acacttccctctgtcacagt

SEQ ID NO: 446178 - DNA, 20 bp, Artificial Sequence
  chemically synthesized
ttccccatccaactgtgaca

SEQ ID NO: 446179 - DNA, 20 bp, Artificial Sequence
  chemically synthesized
tccccatccaactgtgacag

SEQ ID NO: 446180 - DNA, 20 bp, Artificial Sequence
  chemically synthesized
ccccatccaactgtgacaga

SEQ ID NO: 446181 - DNA, 20 bp, Artificial Sequence
  chemically synthesized
tgtcacacttccctctgtca

SEQ ID NO: 446182 - DNA, 20 bp, Artificial Sequence
  chemically synthesized
catccaactgtgacagaggg

SEQ ID NO: 446183 - DNA, 20 bp, Artificial Sequence
  chemically synthesized
gacagagggaagtgtgacac

SEQ ID NO: 446184 - DNA, 20 bp, Artificial Sequence
  chemically synthesized
agagggaagtgtgacacaag

SEQ ID NO: 446185 - DNA, 20 bp, Artificial Sequence
  chemically synthesized
gggaagtgtgacacaagaag

SEQ ID NO: 446186 - DNA, 20 bp, Artificial Sequence
  chemically synthesized
gctggatgcatgaacatgtt

SEQ ID NO: 446187 - DNA, 20 bp, Artificial Sequence
  chemically synthesized
tctcaacatgttcatgcatc

SEQ ID NO: 446188 - DNA, 20 bp, Artificial Sequence
  chemically synthesized
aacatgttcatgcatccagc

SEQ ID NO: 446189 - DNA, 20 bp, Artificial Sequence
  chemically synthesized
tagtctgggtttttgctcgc

SEQ ID NO: 446190 - DNA, 20 bp, Artificial Sequence
  chemically synthesized
gcatccagcgagcaaaaacc

SEQ ID NO: 446191 - DNA, 20 bp, Artificial Sequence
  chemically synthesized
tccttacttcaaagtagtct

SEQ ID NO: 446192 - DNA, 20 bp, Artificial Sequence
  chemically synthesized
atccttacttcaaagtagtc

SEQ ID NO: 446193 - DNA, 20 bp, Artificial Sequence
  chemically synthesized
caaaaacccagactactttg

SEQ ID NO: 446194 - DNA, 20 bp, Artificial Sequence
  chemically synthesized
agtctatccttacttcaaag

SEQ ID NO: 446195 - DNA, 20 bp, Artificial Sequence
  chemically synthesized
aacccagactactttgaagt

SEQ ID NO: 446196 - DNA, 20 bp, Artificial Sequence
  chemically synthesized
acccagactactttgaagta

SEQ ID NO: 446197 - DNA, 20 bp, Artificial Sequence
  chemically synthesized
catagtctatccttacttca

SEQ ID NO: 446198 - DNA, 20 bp, Artificial Sequence
  chemically synthesized
agactactttgaagtaagga

SEQ ID NO: 446199 - DNA, 20 bp, Artificial Sequence
  chemically synthesized
gaagtaaggatagactatgt

SEQ ID NO: 446200 - DNA, 20 bp, Artificial Sequence
  chemically synthesized
atttggtaatggggctgaca

SEQ ID NO: 446201 - DNA, 20 bp, Artificial Sequence
  chemically synthesized
ccctcaaatatttggtaatg

SEQ ID NO: 446202 - DNA, 20 bp, Artificial Sequence
  chemically synthesized
tccctcaaatatttggtaat

SEQ ID NO: 446203 - DNA, 20 bp, Artificial Sequence
  chemically synthesized
ttccctcaaatatttggtaa

SEQ ID NO: 446204 - DNA, 20 bp, Artificial Sequence
  chemically synthesized
agccccattaccaaatattt

SEQ ID NO: 446205 - DNA, 20 bp, Artificial Sequence
  chemically synthesized
aaccgtttccctcaaatatt

SEQ ID NO: 446206 - DNA, 20 bp, Artificial Sequence
  chemically synthesized
gccccattaccaaatatttg

SEQ ID NO: 446207 - DNA, 20 bp, Artificial Sequence
  chemically synthesized
ccccattaccaaatatttga

SEQ ID NO: 446208 - DNA, 20 bp, Artificial Sequence
  chemically synthesized
taccaaatatttgagggaaa

SEQ ID NO: 446209 - DNA, 20 bp, Artificial Sequence
  chemically synthesized
actcctctaaaattcagaaa

SEQ ID NO: 446210 - DNA, 20 bp, Artificial Sequence
  chemically synthesized
ataaaaccatttctgaattt

SEQ ID NO: 446211 - DNA, 20 bp, Artificial Sequence
  chemically synthesized
aaaaccatttctgaatttta

SEQ ID NO: 446212 - DNA, 20 bp, Artificial Sequence
  chemically synthesized
tatttgactcctctaaaatt

SEQ ID NO: 446213 - DNA, 20 bp, Artificial Sequence
  chemically synthesized
aaaccatttctgaattttag

SEQ ID NO: 446214 - DNA, 20 bp, Artificial Sequence
  chemically synthesized
accatttctgaattttagag

SEQ ID NO: 446215 - DNA, 20 bp, Artificial Sequence
  chemically synthesized
attttagaggagtcaaatat

SEQ ID NO: 446216 - DNA, 20 bp, Artificial Sequence
  chemically synthesized
ttttagaggagtcaaatata

SEQ ID NO: 446217 - DNA, 20 bp, Artificial Sequence
  chemically synthesized
ggcgtgcgttttatattatt

SEQ ID NO: 446218 - DNA, 20 bp, Artificial Sequence
  chemically synthesized
taatataaaacgcacgccat

SEQ ID NO: 446219 - DNA, 20 bp, Artificial Sequence
  chemically synthesized
ggagggagggaggaaaccaa

SEQ ID NO: 446220 - DNA, 20 bp, Artificial Sequence
  chemically synthesized
ggaaggggagggagggaggg

SEQ ID NO: 446221 - DNA, 20 bp, Artificial Sequence
  chemically synthesized
aggaaggggagggagggagg

SEQ ID NO: 446222 - DNA, 20 bp, Artificial Sequence
  chemically synthesized
ggaggaaggggagggaggga

SEQ ID NO: 446223 - DNA, 20 bp, Artificial Sequence
  chemically synthesized
gggaggaaggggagggaggg

SEQ ID NO: 446224 - DNA, 20 bp, Artificial Sequence
  chemically synthesized
agggaggaaggggagggagg

SEQ ID NO: 446225 - DNA, 20 bp, Artificial Sequence
  chemically synthesized
ggagggaggaaggggaggga

SEQ ID NO: 446226 - DNA, 20 bp, Artificial Sequence
  chemically synthesized
aggagggaggaaggggaggg

SEQ ID NO: 446227 - DNA, 20 bp, Artificial Sequence
  chemically synthesized
aaggagggaggaaggggagg

SEQ ID NO: 446228 - DNA, 20 bp, Artificial Sequence
  chemically synthesized
ggaaggagggaggaagggga

SEQ ID NO: 446229 - DNA, 20 bp, Artificial Sequence
  chemically synthesized
gggaaggagggaggaagggg

SEQ ID NO: 446230 - DNA, 20 bp, Artificial Sequence
  chemically synthesized
agggaaggagggaggaaggg

SEQ ID NO: 446231 - DNA, 20 bp, Artificial Sequence
  chemically synthesized
ggagggaaggagggaggaag

SEQ ID NO: 446232 - DNA, 20 bp, Artificial Sequence
  chemically synthesized
gggagggaaggagggaggaa

SEQ ID NO: 446233 - DNA, 20 bp, Artificial Sequence
  chemically synthesized
agggagggaaggagggagga

SEQ ID NO: 446234 - DNA, 20 bp, Artificial Sequence
  chemically synthesized
aagggagggaaggagggagg

SEQ ID NO: 446235 - DNA, 20 bp, Artificial Sequence
  chemically synthesized
aggaagggagggaaggaggg

SEQ ID NO: 446236 - DNA, 20 bp, Artificial Sequence
  chemically synthesized
gaggaagggagggaaggagg

SEQ ID NO: 446237 - DNA, 20 bp, Artificial Sequence
  chemically synthesized
gggaggaagggagggaagga

SEQ ID NO: 446238 - DNA, 20 bp, Artificial Sequence
  chemically synthesized
agggaggaagggagggaagg

SEQ ID NO: 446239 - DNA, 20 bp, Artificial Sequence
  chemically synthesized
aagggaggaagggagggaag

SEQ ID NO: 446240 - DNA, 20 bp, Artificial Sequence
  chemically synthesized
ggaagggaggaagggaggga

SEQ ID NO: 446241 - DNA, 20 bp, Artificial Sequence
  chemically synthesized
aggaagggaggaagggaggg

SEQ ID NO: 446242 - DNA, 20 bp, Artificial Sequence
  chemically synthesized
ggaaggaagggaggaaggga

SEQ ID NO: 446243 - DNA, 20 bp, Artificial Sequence
  chemically synthesized
gggaaggaagggaggaaggg

SEQ ID NO: 446244 - DNA, 20 bp, Artificial Sequence
  chemically synthesized
agggaaggaagggaggaagg

SEQ ID NO: 446245 - DNA, 20 bp, Artificial Sequence
  chemically synthesized
ggagggaaggaagggaggaa

SEQ ID NO: 446246 - DNA, 20 bp, Artificial Sequence
  chemically synthesized
gggagggaaggaagggagga

SEQ ID NO: 446247 - DNA, 20 bp, Artificial Sequence
  chemically synthesized
agggagggaaggaagggagg

SEQ ID NO: 446248 - DNA, 20 bp, Artificial Sequence
  chemically synthesized
gggagggagggaaggaaggg

SEQ ID NO: 446249 - DNA, 20 bp, Artificial Sequence
  chemically synthesized
agggagggagggaaggaagg

SEQ ID NO: 446250 - DNA, 20 bp, Artificial Sequence
  chemically synthesized
ggagggagggagggaaggaa

SEQ ID NO: 446251 - DNA, 20 bp, Artificial Sequence
  chemically synthesized
gggagggagggagggaagga

SEQ ID NO: 446252 - DNA, 20 bp, Artificial Sequence
  chemically synthesized
agggagggagggagggaagg

SEQ ID NO: 446253 - DNA, 20 bp, Artificial Sequence
  chemically synthesized
aagagggagggagggaggga

SEQ ID NO: 446254 - DNA, 20 bp, Artificial Sequence
  chemically synthesized
aaagagggagggagggaggg

SEQ ID NO: 446255 - DNA, 20 bp, Artificial Sequence
  chemically synthesized
aagaaagagggagggaggga

SEQ ID NO: 446256 - DNA, 20 bp, Artificial Sequence
  chemically synthesized
aaagaaagagggagggaggg

SEQ ID NO: 446257 - DNA, 20 bp, Artificial Sequence
  chemically synthesized
aaaagaaagagggagggagg

SEQ ID NO: 446258 - DNA, 20 bp, Artificial Sequence
  chemically synthesized
gaaaaagaaagagggaggga

SEQ ID NO: 446259 - DNA, 20 bp, Artificial Sequence
  chemically synthesized
agaaaaagaaagagggaggg

SEQ ID NO: 446260 - DNA, 20 bp, Artificial Sequence
  chemically synthesized
aagaaaaagaaagagggagg

SEQ ID NO: 446261 - DNA, 20 bp, Artificial Sequence
  chemically synthesized
gaaagaaaaagaaagaggga

SEQ ID NO: 446262 - DNA, 20 bp, Artificial Sequence
  chemically synthesized
agaaagaaaaagaaagaggg

SEQ ID NO: 446263 - DNA, 20 bp, Artificial Sequence
  chemically synthesized
gagaaagaaaaagaaagagg

SEQ ID NO: 446264 - DNA, 20 bp, Artificial Sequence
  chemically synthesized
gagagaaagaaaaagaaaga

SEQ ID NO: 446265 - DNA, 20 bp, Artificial Sequence
  chemically synthesized
agagagaaagaaaaagaaag

SEQ ID NO: 446266 - DNA, 20 bp, Artificial Sequence
  chemically synthesized
aagagagaaagaaaaagaaa

SEQ ID NO: 446267 - DNA, 20 bp, Artificial Sequence
  chemically synthesized
aaaagagagaaagaaaaaga

SEQ ID NO: 446268 - DNA, 20 bp, Artificial Sequence
  chemically synthesized
aaaaaaaagagagaaagaaa

SEQ ID NO: 446269 - DNA, 20 bp, Artificial Sequence
  chemically synthesized
tttcaaaaaaaaaagagaga

SEQ ID NO: 446270 - DNA, 20 bp, Artificial Sequence
  chemically synthesized
tccatttcaaaaaaaaaaga

SEQ ID NO: 446271 - DNA, 20 bp, Artificial Sequence
  chemically synthesized
actccatttcaaaaaaaaaa

SEQ ID NO: 446272 - DNA, 20 bp, Artificial Sequence
  chemically synthesized
aaactccatttcaaaaaaaa

SEQ ID NO: 446273 - DNA, 20 bp, Artificial Sequence
  chemically synthesized
tctctcttttttttttgaaa

SEQ ID NO: 446274 - DNA, 20 bp, Artificial Sequence
  chemically synthesized
tctcttttttttttgaaatg

SEQ ID NO: 446275 - DNA, 20 bp, Artificial Sequence
  chemically synthesized
tactccagcctgggcaacaa

SEQ ID NO: 446276 - DNA, 20 bp, Artificial Sequence
  chemically synthesized
ggagtttcactcttgttgcc

SEQ ID NO: 446277 - DNA, 20 bp, Artificial Sequence
  chemically synthesized
gagtttcactcttgttgccc

SEQ ID NO: 446278 - DNA, 20 bp, Artificial Sequence
  chemically synthesized
tgtactccagcctgggcaac

SEQ ID NO: 446279 - DNA, 20 bp, Artificial Sequence
  chemically synthesized
ttcactcttgttgcccaggc

SEQ ID NO: 446280 - DNA, 20 bp, Artificial Sequence
  chemically synthesized
cactcttgttgcccaggctg

SEQ ID NO: 446281 - DNA, 20 bp, Artificial Sequence
  chemically synthesized
gcgccattgtactccagcct

SEQ ID NO: 446282 - DNA, 20 bp, Artificial Sequence
  chemically synthesized
cgcgccattgtactccagcc

SEQ ID NO: 446283 - DNA, 20 bp, Artificial Sequence
  chemically synthesized
gagatcgcgccattgtactc

SEQ ID NO: 446284 - DNA, 20 bp, Artificial Sequence
  chemically synthesized
ttgcccaggctggagtacaa

SEQ ID NO: 446285 - DNA, 20 bp, Artificial Sequence
  chemically synthesized
ggagtacaatggcgcgatct

SEQ ID NO: 446286 - DNA, 20 bp, Artificial Sequence
  chemically synthesized
ggcacaggttgcagtgagcc

SEQ ID NO: 446287 - DNA, 20 bp, Artificial Sequence
  chemically synthesized
tggaaggcacaggttgcagt

SEQ ID NO: 446288 - DNA, 20 bp, Artificial Sequence
  chemically synthesized
aacctggaaggcacaggttg

SEQ ID NO: 446289 - DNA, 20 bp, Artificial Sequence
  chemically synthesized
cgcttgaacctggaaggcac

SEQ ID NO: 446290 - DNA, 20 bp, Artificial Sequence
  chemically synthesized
tcactgcaacctgtgccttc

SEQ ID NO: 446291 - DNA, 20 bp, Artificial Sequence
  chemically synthesized
tcgcttgaacctggaaggca

SEQ ID NO: 446292 - DNA, 20 bp, Artificial Sequence
  chemically synthesized
cactgcaacctgtgccttcc

SEQ ID NO: 446293 - DNA, 20 bp, Artificial Sequence
  chemically synthesized
aagaatcgcttgaacctgga

SEQ ID NO: 446294 - DNA, 20 bp, Artificial Sequence
  chemically synthesized
gaagaatcgcttgaacctgg

SEQ ID NO: 446295 - DNA, 20 bp, Artificial Sequence
  chemically synthesized
aacctgtgccttccaggttc

SEQ ID NO: 446296 - DNA, 20 bp, Artificial Sequence
  chemically synthesized
gcagaagaatcgcttgaacc

SEQ ID NO: 446297 - DNA, 20 bp, Artificial Sequence
  chemically synthesized
ttcaagcgattcttctgcct

SEQ ID NO: 446298 - DNA, 20 bp, Artificial Sequence
  chemically synthesized
tacttgggaggctgaggcag

SEQ ID NO: 446299 - DNA, 20 bp, Artificial Sequence
  chemically synthesized
agctacttgggaggctgagg

SEQ ID NO: 446300 - DNA, 20 bp, Artificial Sequence
  chemically synthesized
ctcagctacttgggaggctg

SEQ ID NO: 446301 - DNA, 20 bp, Artificial Sequence
  chemically synthesized
tctcagctacttgggaggct

SEQ ID NO: 446302 - DNA, 20 bp, Artificial Sequence
  chemically synthesized
ttcttctgcctcagcctccc

SEQ ID NO: 446303 - DNA, 20 bp, Artificial Sequence
  chemically synthesized
ttctgcctcagcctcccaag

SEQ ID NO: 446304 - DNA, 20 bp, Artificial Sequence
  chemically synthesized
tgtaatctcagctacttggg

SEQ ID NO: 446305 - DNA, 20 bp, Artificial Sequence
  chemically synthesized
ctgtaatctcagctacttgg

SEQ ID NO: 446306 - DNA, 20 bp, Artificial Sequence
  chemically synthesized
gcctgtaatctcagctactt

SEQ ID NO: 446307 - DNA, 20 bp, Artificial Sequence
  chemically synthesized
cctcagcctcccaagtagct

SEQ ID NO: 446308 - DNA, 20 bp, Artificial Sequence
  chemically synthesized
cgcctgtaatctcagctact

SEQ ID NO: 446309 - DNA, 20 bp, Artificial Sequence
  chemically synthesized
ctcccaagtagctgagatta

SEQ ID NO: 446310 - DNA, 20 bp, Artificial Sequence
  chemically synthesized
tcccaagtagctgagattac

SEQ ID NO: 446311 - DNA, 20 bp, Artificial Sequence
  chemically synthesized
gtggcacacgcctgtaatct

SEQ ID NO: 446312 - DNA, 20 bp, Artificial Sequence
  chemically synthesized
caggcgtgtgccaccacgcc

SEQ ID NO: 446313 - DNA, 20 bp, Artificial Sequence
  chemically synthesized
acaaaattagccgggcgtgg

SEQ ID NO: 446314 - DNA, 20 bp, Artificial Sequence
  chemically synthesized
aatacaaaattagccgggcg

SEQ ID NO: 446315 - DNA, 20 bp, Artificial Sequence
  chemically synthesized
aaaaaaatacaaaattagcc

SEQ ID NO: 446316 - DNA, 20 bp, Artificial Sequence
  chemically synthesized
taaaaaaatacaaaattagc

SEQ ID NO: 446317 - DNA, 20 bp, Artificial Sequence
  chemically synthesized
ctactaaaaaaatacaaaat

SEQ ID NO: 446318 - DNA, 20 bp, Artificial Sequence
  chemically synthesized
cggctaattttgtatttttt

SEQ ID NO: 446319 - DNA, 20 bp, Artificial Sequence
  chemically synthesized
ctaattttgtatttttttag

SEQ ID NO: 446320 - DNA, 20 bp, Artificial Sequence
  chemically synthesized
aattttgtatttttttagta

SEQ ID NO: 446321 - DNA, 20 bp, Artificial Sequence
  chemically synthesized
ttgtatttttttagtagaga

SEQ ID NO: 446322 - DNA, 20 bp, Artificial Sequence
  chemically synthesized
gtatttttttagtagagaca

SEQ ID NO: 446323 - DNA, 20 bp, Artificial Sequence
  chemically synthesized
gagacagagtttcaccatgt

SEQ ID NO: 446324 - DNA, 20 bp, Artificial Sequence
  chemically synthesized
cagagtttcaccatgttggt

SEQ ID NO: 446325 - DNA, 20 bp, Artificial Sequence
  chemically synthesized
caagtccagcctgaccaaca

SEQ ID NO: 446326 - DNA, 20 bp, Artificial Sequence
  chemically synthesized
agagtttcaccatgttggtc

SEQ ID NO: 446327 - DNA, 20 bp, Artificial Sequence
  chemically synthesized
tttcaccatgttggtcaggc

SEQ ID NO: 446328 - DNA, 20 bp, Artificial Sequence
  chemically synthesized
tgaggtcaggagttcaagtc

SEQ ID NO: 446329 - DNA, 20 bp, Artificial Sequence
  chemically synthesized
tcacttgaggtcaggagttc

SEQ ID NO: 446330 - DNA, 20 bp, Artificial Sequence
  chemically synthesized
agtggatcacttgaggtcag

SEQ ID NO: 446331 - DNA, 20 bp, Artificial Sequence
  chemically synthesized
ggacttgaactcctgacctc

SEQ ID NO: 446332 - DNA, 20 bp, Artificial Sequence
  chemically synthesized
tgagtggatcacttgaggtc

SEQ ID NO: 446333 - DNA, 20 bp, Artificial Sequence
  chemically synthesized
gtgagtggatcacttgaggt

SEQ ID NO: 446334 - DNA, 20 bp, Artificial Sequence
  chemically synthesized
caaggtgagtggatcacttg

SEQ ID NO: 446335 - DNA, 20 bp, Artificial Sequence
  chemically synthesized
ccaaggtgagtggatcactt

SEQ ID NO: 446336 - DNA, 20 bp, Artificial Sequence
  chemically synthesized
ctcaagtgatccactcacct

SEQ ID NO: 446337 - DNA, 20 bp, Artificial Sequence
  chemically synthesized
ttttgggaagccaaggtgag

SEQ ID NO: 446338 - DNA, 20 bp, Artificial Sequence
  chemically synthesized
gcattttgggaagccaaggt

SEQ ID NO: 446339 - DNA, 20 bp, Artificial Sequence
  chemically synthesized
cccagcattttgggaagcca

SEQ ID NO: 446340 - DNA, 20 bp, Artificial Sequence
  chemically synthesized
tcccagcattttgggaagcc

SEQ ID NO: 446341 - DNA, 20 bp, Artificial Sequence
  chemically synthesized
tgtaatcccagcattttggg

SEQ ID NO: 446342 - DNA, 20 bp, Artificial Sequence
  chemically synthesized
accttggcttcccaaaatgc

SEQ ID NO: 446343 - DNA, 20 bp, Artificial Sequence
  chemically synthesized
gcctgtaatcccagcatttt

SEQ ID NO: 446344 - DNA, 20 bp, Artificial Sequence
  chemically synthesized
ccttggcttcccaaaatgct

SEQ ID NO: 446345 - DNA, 20 bp, Artificial Sequence
  chemically synthesized
tgcctgtaatcccagcattt

SEQ ID NO: 446346 - DNA, 20 bp, Artificial Sequence
  chemically synthesized
ttcccaaaatgctgggatta

SEQ ID NO: 446347 - DNA, 20 bp, Artificial Sequence
  chemically synthesized
tcccaaaatgctgggattac

SEQ ID NO: 446348 - DNA, 20 bp, Artificial Sequence
  chemically synthesized
gtggctcgtgcctgtaatcc

SEQ ID NO: 446349 - DNA, 20 bp, Artificial Sequence
  chemically synthesized
aatgctgggattacaggcac

SEQ ID NO: 446350 - DNA, 20 bp, Artificial Sequence
  chemically synthesized
gggattacaggcacgagcca

SEQ ID NO: 446351 - DNA, 20 bp, Artificial Sequence
  chemically synthesized
agataactggcggggcactg

SEQ ID NO: 446352 - DNA, 20 bp, Artificial Sequence
  chemically synthesized
cacgagccacagtgccccgc

SEQ ID NO: 446353 - DNA, 20 bp, Artificial Sequence
  chemically synthesized
ccaaagaaagataactggcg

SEQ ID NO: 446354 - DNA, 20 bp, Artificial Sequence
  chemically synthesized
gccaaagaaagataactggc

SEQ ID NO: 446355 - DNA, 20 bp, Artificial Sequence
  chemically synthesized
agccaaagaaagataactgg

SEQ ID NO: 446356 - DNA, 20 bp, Artificial Sequence
  chemically synthesized
tgtagccaaagaaagataac

SEQ ID NO: 446357 - DNA, 20 bp, Artificial Sequence
  chemically synthesized
ccccgccagttatctttctt

SEQ ID NO: 446358 - DNA, 20 bp, Artificial Sequence
  chemically synthesized
caaaaaggtgtagccaaaga

SEQ ID NO: 446359 - DNA, 20 bp, Artificial Sequence
  chemically synthesized
acctcaaaaaggtgtagcca

SEQ ID NO: 446360 - DNA, 20 bp, Artificial Sequence
  chemically synthesized
agtcctacctcaaaaaggtg

SEQ ID NO: 446361 - DNA, 20 bp, Artificial Sequence
  chemically synthesized
ttctttggctacaccttttt

SEQ ID NO: 446362 - DNA, 20 bp, Artificial Sequence
  chemically synthesized
tctttggctacacctttttg

SEQ ID NO: 446363 - DNA, 20 bp, Artificial Sequence
  chemically synthesized
atgaaagtcctacctcaaaa

SEQ ID NO: 446364 - DNA, 20 bp, Artificial Sequence
  chemically synthesized
ttggctacacctttttgagg

SEQ ID NO: 446365 - DNA, 20 bp, Artificial Sequence
  chemically synthesized
tatgaaagtcctacctcaaa

SEQ ID NO: 446366 - DNA, 20 bp, Artificial Sequence
  chemically synthesized
tggctacacctttttgaggt

SEQ ID NO: 446367 - DNA, 20 bp, Artificial Sequence
  chemically synthesized
gctattgcccagtggtatga

SEQ ID NO: 446368 - DNA, 20 bp, Artificial Sequence
  chemically synthesized
aggtaggactttcataccac

SEQ ID NO: 446369 - DNA, 20 bp, Artificial Sequence
  chemically synthesized
ggtaggactttcataccact

SEQ ID NO: 446370 - DNA, 20 bp, Artificial Sequence
  chemically synthesized
attcagttgctattgcccag

SEQ ID NO: 446371 - DNA, 20 bp, Artificial Sequence
  chemically synthesized
actttcataccactgggcaa

SEQ ID NO: 446372 - DNA, 20 bp, Artificial Sequence
  chemically synthesized
tatattcagttgctattgcc

SEQ ID NO: 446373 - DNA, 20 bp, Artificial Sequence
  chemically synthesized
tgggcaatagcaactgaata

SEQ ID NO: 446374 - DNA, 20 bp, Artificial Sequence
  chemically synthesized
gggcaatagcaactgaatat

SEQ ID NO: 446375 - DNA, 20 bp, Artificial Sequence
  chemically synthesized
attaagttcattcctatatt

SEQ ID NO: 446376 - DNA, 20 bp, Artificial Sequence
  chemically synthesized
cttcatgtatgagaaatatt

SEQ ID NO: 446377 - DNA, 20 bp, Artificial Sequence
  chemically synthesized
cttaatatttctcatacatg

SEQ ID NO: 446378 - DNA, 20 bp, Artificial Sequence
  chemically synthesized
atgccataatcttcatgtat

SEQ ID NO: 446379 - DNA, 20 bp, Artificial Sequence
  chemically synthesized
tttctcatacatgaagatta

SEQ ID NO: 446380 - DNA, 20 bp, Artificial Sequence
  chemically synthesized
gcatttcatttctatttgtg

SEQ ID NO: 446381 - DNA, 20 bp, Artificial Sequence
  chemically synthesized
atccgtgcccacttcacaaa

SEQ ID NO: 446382 - DNA, 20 bp, Artificial Sequence
  chemically synthesized
tttcatttctatttgtgaag

SEQ ID NO: 446383 - DNA, 20 bp, Artificial Sequence
  chemically synthesized
ttcatttctatttgtgaagt

SEQ ID NO: 446384 - DNA, 20 bp, Artificial Sequence
  chemically synthesized
ttctatttgtgaagtgggca

SEQ ID NO: 446385 - DNA, 20 bp, Artificial Sequence
  chemically synthesized
gcacggatatattaaaaata

SEQ ID NO: 446386 - DNA, 20 bp, Artificial Sequence
  chemically synthesized
aattttaaatgagaacagta

SEQ ID NO: 446387 - DNA, 20 bp, Artificial Sequence
  chemically synthesized
aaattttaaatgagaacagt

SEQ ID NO: 446388 - DNA, 20 bp, Artificial Sequence
  chemically synthesized
gaaaaaattttaaatgagaa

SEQ ID NO: 446389 - DNA, 20 bp, Artificial Sequence
  chemically synthesized
atcgtgaaaaaattttaaat

SEQ ID NO: 446390 - DNA, 20 bp, Artificial Sequence
  chemically synthesized
gtacaagatatatcaaaatc

SEQ ID NO: 446391 - DNA, 20 bp, Artificial Sequence
  chemically synthesized
tttaattgacaatcaagtac

SEQ ID NO: 446392 - DNA, 20 bp, Artificial Sequence
  chemically synthesized
attcattttaattgacaatc

SEQ ID NO: 446393 - DNA, 20 bp, Artificial Sequence
  chemically synthesized
aatttttgtattgaaaaatt

SEQ ID NO: 446394 - DNA, 20 bp, Artificial Sequence
  chemically synthesized
aaaatttagtaataaaaact

SEQ ID NO: 446395 - DNA, 20 bp, Artificial Sequence
  chemically synthesized
gggtgtgtagttcacattct

SEQ ID NO: 446396 - DNA, 20 bp, Artificial Sequence
  chemically synthesized
tgtgcacgtatatgggtgtg

SEQ ID NO: 446397 - DNA, 20 bp, Artificial Sequence
  chemically synthesized
cttttgttgtgcacgtatat

SEQ ID NO: 446398 - DNA, 20 bp, Artificial Sequence
  chemically synthesized
gcttttgttgtgcacgtata

SEQ ID NO: 446399 - DNA, 20 bp, Artificial Sequence
  chemically synthesized
cccatatacgtgcacaacaa

SEQ ID NO: 446400 - DNA, 20 bp, Artificial Sequence
  chemically synthesized
tgcacaacaaaagcttaaca

SEQ ID NO: 446401 - DNA, 20 bp, Artificial Sequence
  chemically synthesized
cttattatagataccatgtt

SEQ ID NO: 446402 - DNA, 20 bp, Artificial Sequence
  chemically synthesized
cttaacatggtatctataat

SEQ ID NO: 446403 - DNA, 20 bp, Artificial Sequence
  chemically synthesized
agaactctgtaggcttatta

SEQ ID NO: 446404 - DNA, 20 bp, Artificial Sequence
  chemically synthesized
tggtatctataataagccta

SEQ ID NO: 446405 - DNA, 20 bp, Artificial Sequence
  chemically synthesized
gtatctataataagcctaca

SEQ ID NO: 446406 - DNA, 20 bp, Artificial Sequence
  chemically synthesized
ttagtttaaaagaactctgt

SEQ ID NO: 446407 - DNA, 20 bp, Artificial Sequence
  chemically synthesized
tttagtttaaaagaactctg

SEQ ID NO: 446408 - DNA, 20 bp, Artificial Sequence
  chemically synthesized
aactattatgtttagtttaa

SEQ ID NO: 446409 - DNA, 20 bp, Artificial Sequence
  chemically synthesized
ttcttttaaactaaacataa

SEQ ID NO: 446410 - DNA, 20 bp, Artificial Sequence
  chemically synthesized
cttttggcaactattatgtt

SEQ ID NO: 446411 - DNA, 20 bp, Artificial Sequence
  chemically synthesized
ctaaacataatagttgccaa

SEQ ID NO: 446412 - DNA, 20 bp, Artificial Sequence
  chemically synthesized
taaacataatagttgccaaa

SEQ ID NO: 446413 - DNA, 20 bp, Artificial Sequence
  chemically synthesized
aaacataatagttgccaaaa

SEQ ID NO: 446414 - DNA, 20 bp, Artificial Sequence
  chemically synthesized
caaaagctatgaatcccttt

SEQ ID NO: 446415 - DNA, 20 bp, Artificial Sequence
  chemically synthesized
tagttgccaaaagggattca

SEQ ID NO: 446416 - DNA, 20 bp, Artificial Sequence
  chemically synthesized
ttaattttaaatcaattcaa

SEQ ID NO: 446417 - DNA, 20 bp, Artificial Sequence
  chemically synthesized
ttcatttggaagtgacaggg

SEQ ID NO: 446418 - DNA, 20 bp, Artificial Sequence
  chemically synthesized
attcatttggaagtgacagg

SEQ ID NO: 446419 - DNA, 20 bp, Artificial Sequence
  chemically synthesized
aaattcatttggaagtgaca

SEQ ID NO: 446420 - DNA, 20 bp, Artificial Sequence
  chemically synthesized
gaaattcatttggaagtgac

SEQ ID NO: 446421 - DNA, 20 bp, Artificial Sequence
  chemically synthesized
ggaaattcatttggaagtga

SEQ ID NO: 446422 - DNA, 20 bp, Artificial Sequence
  chemically synthesized
ataaatggaaattcatttgg

SEQ ID NO: 446423 - DNA, 20 bp, Artificial Sequence
  chemically synthesized
tacataaatggaaattcatt

SEQ ID NO: 446424 - DNA, 20 bp, Artificial Sequence
  chemically synthesized
acaattttatgttacataaa

SEQ ID NO: 446425 - DNA, 20 bp, Artificial Sequence
  chemically synthesized
ccggctgaaagttttgtcat

SEQ ID NO: 446426 - DNA, 20 bp, Artificial Sequence
  chemically synthesized
tccggctgaaagttttgtca

SEQ ID NO: 446427 - DNA, 20 bp, Artificial Sequence
  chemically synthesized
ttgtcccatgacaaaacttt

SEQ ID NO: 446428 - DNA, 20 bp, Artificial Sequence
  chemically synthesized
cccatgacaaaactttcagc

SEQ ID NO: 446429 - DNA, 20 bp, Artificial Sequence
  chemically synthesized
aataaatgtattccggctga

SEQ ID NO: 446430 - DNA, 20 bp, Artificial Sequence
  chemically synthesized
aagaaggaataaatgtattc

SEQ ID NO: 446431 - DNA, 20 bp, Artificial Sequence
  chemically synthesized
gaatacatttattccttctt

SEQ ID NO: 446432 - DNA, 20 bp, Artificial Sequence
  chemically synthesized
tgcaaatgatagactcaaga

SEQ ID NO: 446433 - DNA, 20 bp, Artificial Sequence
  chemically synthesized
ttgcaaatgatagactcaag

SEQ ID NO: 446434 - DNA, 20 bp, Artificial Sequence
  chemically synthesized
gctttgcaaatgatagactc

SEQ ID NO: 446435 - DNA, 20 bp, Artificial Sequence
  chemically synthesized
ccatagtgctttgcaaatga

SEQ ID NO: 446436 - DNA, 20 bp, Artificial Sequence
  chemically synthesized
tcttgagtctatcatttgca

SEQ ID NO: 446437 - DNA, 20 bp, Artificial Sequence
  chemically synthesized
ctatcatttgcaaagcacta

SEQ ID NO: 446438 - DNA, 20 bp, Artificial Sequence
  chemically synthesized
cctttccaagtggcacacca

SEQ ID NO: 446439 - DNA, 20 bp, Artificial Sequence
  chemically synthesized
aagcactatggtgtgccact

SEQ ID NO: 446440 - DNA, 20 bp, Artificial Sequence
  chemically synthesized
actatggtgtgccacttgga

SEQ ID NO: 446441 - DNA, 20 bp, Artificial Sequence
  chemically synthesized
ctatggtgtgccacttggaa

SEQ ID NO: 446442 - DNA, 20 bp, Artificial Sequence
  chemically synthesized
aatttagatccctttccaag

SEQ ID NO: 446443 - DNA, 20 bp, Artificial Sequence
  chemically synthesized
tatggtgtgccacttggaaa

SEQ ID NO: 446444 - DNA, 20 bp, Artificial Sequence
  chemically synthesized
tctaatttagatccctttcc

SEQ ID NO: 446445 - DNA, 20 bp, Artificial Sequence
  chemically synthesized
acttggaaagggatctaaat

SEQ ID NO: 446446 - DNA, 20 bp, Artificial Sequence
  chemically synthesized
ttttgggaaaaattctaatt

SEQ ID NO: 446447 - DNA, 20 bp, Artificial Sequence
  chemically synthesized
taaattagaatttttcccaa

SEQ ID NO: 446448 - DNA, 20 bp, Artificial Sequence
  chemically synthesized
tatacctggttatggctttt

SEQ ID NO: 446449 - DNA, 20 bp, Artificial Sequence
  chemically synthesized
atatacctggttatggcttt

SEQ ID NO: 446450 - DNA, 20 bp, Artificial Sequence
  chemically synthesized
tttttcccaaaagccataac

SEQ ID NO: 446451 - DNA, 20 bp, Artificial Sequence
  chemically synthesized
ttttcccaaaagccataacc

SEQ ID NO: 446452 - DNA, 20 bp, Artificial Sequence
  chemically synthesized
gcatgtcatatacctggtta

SEQ ID NO: 446453 - DNA, 20 bp, Artificial Sequence
  chemically synthesized
aatgctgcatgtcatatacc

SEQ ID NO: 446454 - DNA, 20 bp, Artificial Sequence
  chemically synthesized
ataaccaggtatatgacatg

SEQ ID NO: 446455 - DNA, 20 bp, Artificial Sequence
  chemically synthesized
atatgacatgcagcatttta

SEQ ID NO: 446456 - DNA, 20 bp, Artificial Sequence
  chemically synthesized
tatgacatgcagcattttaa

SEQ ID NO: 446457 - DNA, 20 bp, Artificial Sequence
  chemically synthesized
atgacatgcagcattttaaa

SEQ ID NO: 446458 - DNA, 20 bp, Artificial Sequence
  chemically synthesized
aggcatcaaaatgaattcaa

SEQ ID NO: 446459 - DNA, 20 bp, Artificial Sequence
  chemically synthesized
acaggcatcaaaatgaattc

SEQ ID NO: 446460 - DNA, 20 bp, Artificial Sequence
  chemically synthesized
atatgtgctcaagtgagtac

SEQ ID NO: 446461 - DNA, 20 bp, Artificial Sequence
  chemically synthesized
catatgtgctcaagtgagta

SEQ ID NO: 446462 - DNA, 20 bp, Artificial Sequence
  chemically synthesized
tttgatgcctgtactcactt

SEQ ID NO: 446463 - DNA, 20 bp, Artificial Sequence
  chemically synthesized
taaaacatatgtgctcaagt

SEQ ID NO: 446464 - DNA, 20 bp, Artificial Sequence
  chemically synthesized
gttgtaaaacatatgtgctc

SEQ ID NO: 446465 - DNA, 20 bp, Artificial Sequence
  chemically synthesized
acatatgttttacaactttg

SEQ ID NO: 446466 - DNA, 20 bp, Artificial Sequence
  chemically synthesized
ctaagagagggaggtcttca

SEQ ID NO: 446467 - DNA, 20 bp, Artificial Sequence
  chemically synthesized
agaacccagctaagagaggg

SEQ ID NO: 446468 - DNA, 20 bp, Artificial Sequence
  chemically synthesized
ctttgaagacctccctctct

SEQ ID NO: 446469 - DNA, 20 bp, Artificial Sequence
  chemically synthesized
tagaacccagctaagagagg

SEQ ID NO: 446470 - DNA, 20 bp, Artificial Sequence
  chemically synthesized
gctagaacccagctaagaga

SEQ ID NO: 446471 - DNA, 20 bp, Artificial Sequence
  chemically synthesized
agctagaacccagctaagag

SEQ ID NO: 446472 - DNA, 20 bp, Artificial Sequence
  chemically synthesized
gaagacctccctctcttagc

SEQ ID NO: 446473 - DNA, 20 bp, Artificial Sequence
  chemically synthesized
gagctagaacccagctaaga

SEQ ID NO: 446474 - DNA, 20 bp, Artificial Sequence
  chemically synthesized
aagacctccctctcttagct

SEQ ID NO: 446475 - DNA, 20 bp, Artificial Sequence
  chemically synthesized
gtgagctagaacccagctaa

SEQ ID NO: 446476 - DNA, 20 bp, Artificial Sequence
  chemically synthesized
gtgtgagctagaacccagct

SEQ ID NO: 446477 - DNA, 20 bp, Artificial Sequence
  chemically synthesized
tccctctcttagctgggttc

SEQ ID NO: 446478 - DNA, 20 bp, Artificial Sequence
  chemically synthesized
gcattgtgtgagctagaacc

SEQ ID NO: 446479 - DNA, 20 bp, Artificial Sequence
  chemically synthesized
tgctggagcattgtgtgagc

SEQ ID NO: 446480 - DNA, 20 bp, Artificial Sequence
  chemically synthesized
tcaatgctggagcattgtgt

SEQ ID NO: 446481 - DNA, 20 bp, Artificial Sequence
  chemically synthesized
ttctagctcacacaatgctc

SEQ ID NO: 446482 - DNA, 20 bp, Artificial Sequence
  chemically synthesized
tttcaacatcttcaatgctg

SEQ ID NO: 446483 - DNA, 20 bp, Artificial Sequence
  chemically synthesized
cacacaatgctccagcattg

SEQ ID NO: 446484 - DNA, 20 bp, Artificial Sequence
  chemically synthesized
tttttcaacatcttcaatgc

SEQ ID NO: 446485 - DNA, 20 bp, Artificial Sequence
  chemically synthesized
agcattgaagatgttgaaaa

SEQ ID NO: 446486 - DNA, 20 bp, Artificial Sequence
  chemically synthesized
cttgtgtgtgtgtgaatatt

SEQ ID NO: 446487 - DNA, 20 bp, Artificial Sequence
  chemically synthesized
ctgaatattcacacacacac

SEQ ID NO: 446488 - DNA, 20 bp, Artificial Sequence
  chemically synthesized
ccatcaacccagtattatgt

SEQ ID NO: 446489 - DNA, 20 bp, Artificial Sequence
  chemically synthesized
accatcaacccagtattatg

SEQ ID NO: 446490 - DNA, 20 bp, Artificial Sequence
  chemically synthesized
tgataatacctacataatac

SEQ ID NO: 446491 - DNA, 20 bp, Artificial Sequence
  chemically synthesized
gataatacctacataatact

SEQ ID NO: 446492 - DNA, 20 bp, Artificial Sequence
  chemically synthesized
cctacataatactgggttga

SEQ ID NO: 446493 - DNA, 20 bp, Artificial Sequence
  chemically synthesized
gttttaataaaccatcaacc

SEQ ID NO: 446494 - DNA, 20 bp, Artificial Sequence
  chemically synthesized
ttgatggtttattaaaacac

SEQ ID NO: 446495 - DNA, 20 bp, Artificial Sequence
  chemically synthesized
atggtttattaaaacacaag

SEQ ID NO: 446496 - DNA, 20 bp, Artificial Sequence
  chemically synthesized
atgatatttgtggggcagtt

SEQ ID NO: 446497 - DNA, 20 bp, Artificial Sequence
  chemically synthesized
tatgcatgatatttgtgggg

SEQ ID NO: 446498 - DNA, 20 bp, Artificial Sequence
  chemically synthesized
aaatatgcatgatatttgtg

SEQ ID NO: 446499 - DNA, 20 bp, Artificial Sequence
  chemically synthesized
taaatatgcatgatatttgt

SEQ ID NO: 446500 - DNA, 20 bp, Artificial Sequence
  chemically synthesized
ctaaatatgcatgatatttg

SEQ ID NO: 446501 - DNA, 20 bp, Artificial Sequence
  chemically synthesized
ccacaaatatcatgcatatt

SEQ ID NO: 446502 - DNA, 20 bp, Artificial Sequence
  chemically synthesized
tcatgcatatttagaaatac

SEQ ID NO: 446503 - DNA, 20 bp, Artificial Sequence
  chemically synthesized
caagatatgcaaaatgaatc

SEQ ID NO: 446504 - DNA, 20 bp, Artificial Sequence
  chemically synthesized
gattcattttgcatatcttg

SEQ ID NO: 446505 - DNA, 20 bp, Artificial Sequence
  chemically synthesized
gtgctgtataaggaatccac

SEQ ID NO: 446506 - DNA, 20 bp, Artificial Sequence
  chemically synthesized
tatcttgtggattccttata

SEQ ID NO: 446507 - DNA, 20 bp, Artificial Sequence
  chemically synthesized
gggagagagggtgctgtata

SEQ ID NO: 446508 - DNA, 20 bp, Artificial Sequence
  chemically synthesized
ggggagagagggtgctgtat

SEQ ID NO: 446509 - DNA, 20 bp, Artificial Sequence
  chemically synthesized
acacaaacaggggggagaga

SEQ ID NO: 446510 - DNA, 20 bp, Artificial Sequence
  chemically synthesized
cacacaaacaggggggagag

SEQ ID NO: 446511 - DNA, 20 bp, Artificial Sequence
  chemically synthesized
acacacaaacaggggggaga

SEQ ID NO: 446512 - DNA, 20 bp, Artificial Sequence
  chemically synthesized
acacacacaaacagggggga

SEQ ID NO: 446513 - DNA, 20 bp, Artificial Sequence
  chemically synthesized
atacacacacaaacaggggg

SEQ ID NO: 446514 - DNA, 20 bp, Artificial Sequence
  chemically synthesized
acatacacacacaaacaggg

SEQ ID NO: 446515 - DNA, 20 bp, Artificial Sequence
  chemically synthesized
cacatacacacacaaacagg

SEQ ID NO: 446516 - DNA, 20 bp, Artificial Sequence
  chemically synthesized
acacatacacacacaaacag

SEQ ID NO: 446517 - DNA, 20 bp, Artificial Sequence
  chemically synthesized
cacacatacacacacaaaca

SEQ ID NO: 446518 - DNA, 20 bp, Artificial Sequence
  chemically synthesized
acacacatacacacacaaac

SEQ ID NO: 446519 - DNA, 20 bp, Artificial Sequence
  chemically synthesized
cacacacatacacacacaaa

SEQ ID NO: 446520 - DNA, 20 bp, Artificial Sequence
  chemically synthesized
ttaatgtgtgtgtctgtgtg

SEQ ID NO: 446521 - DNA, 20 bp, Artificial Sequence
  chemically synthesized
tccttctacacatctacaca

SEQ ID NO: 446522 - DNA, 20 bp, Artificial Sequence
  chemically synthesized
tgtgtctgtgtgtagatgtg

SEQ ID NO: 446523 - DNA, 20 bp, Artificial Sequence
  chemically synthesized
gtctgtgtgtagatgtgtag

SEQ ID NO: 446524 - DNA, 20 bp, Artificial Sequence
  chemically synthesized
tctgtgtgtagatgtgtaga

SEQ ID NO: 446525 - DNA, 20 bp, Artificial Sequence
  chemically synthesized
gtagatgtgtagaaggaatc

SEQ ID NO: 446526 - DNA, 20 bp, Artificial Sequence
  chemically synthesized
tcatgtgaatttagaaatac

SEQ ID NO: 446527 - DNA, 20 bp, Artificial Sequence
  chemically synthesized
ccacaattatcatgtgaatt

SEQ ID NO: 446528 - DNA, 20 bp, Artificial Sequence
  chemically synthesized
ctaaattcacatgataattg

SEQ ID NO: 446529 - DNA, 20 bp, Artificial Sequence
  chemically synthesized
taaattcacatgataattgt

SEQ ID NO: 446530 - DNA, 20 bp, Artificial Sequence
  chemically synthesized
aaattcacatgataattgtg

SEQ ID NO: 446531 - DNA, 20 bp, Artificial Sequence
  chemically synthesized
atgataattgtggggcattt

SEQ ID NO: 446532 - DNA, 20 bp, Artificial Sequence
  chemically synthesized
atggtttattcaatcacaaa

SEQ ID NO: 446533 - DNA, 20 bp, Artificial Sequence
  chemically synthesized
gattgaataaaccattaaca

SEQ ID NO: 446534 - DNA, 20 bp, Artificial Sequence
  chemically synthesized
cttacacaatactgtgttaa

SEQ ID NO: 446535 - DNA, 20 bp, Artificial Sequence
  chemically synthesized
ccattaacacagtattgtgt

SEQ ID NO: 446536 - DNA, 20 bp, Artificial Sequence
  chemically synthesized
ttaacacagtattgtgtaag

SEQ ID NO: 446537 - DNA, 20 bp, Artificial Sequence
  chemically synthesized
gtagaattattcacattttg

SEQ ID NO: 446538 - DNA, 20 bp, Artificial Sequence
  chemically synthesized
attattcacattttgcagat

SEQ ID NO: 446539 - DNA, 20 bp, Artificial Sequence
  chemically synthesized
attttgcagataagaaaact

SEQ ID NO: 446540 - DNA, 20 bp, Artificial Sequence
  chemically synthesized
cagataagaaaactgagatt

SEQ ID NO: 446541 - DNA, 20 bp, Artificial Sequence
  chemically synthesized
acaaaaaacttactaaatct

SEQ ID NO: 446542 - DNA, 20 bp, Artificial Sequence
  chemically synthesized
taagaaaactgagatttagt

SEQ ID NO: 446543 - DNA, 20 bp, Artificial Sequence
  chemically synthesized
tttagtaagttttttgtcca

SEQ ID NO: 446544 - DNA, 20 bp, Artificial Sequence
  chemically synthesized
taaaatctcggttatagctt

SEQ ID NO: 446545 - DNA, 20 bp, Artificial Sequence
  chemically synthesized
ttttgtccaaagctataacc

SEQ ID NO: 446546 - DNA, 20 bp, Artificial Sequence
  chemically synthesized
ggactttaaaatctcggtta

SEQ ID NO: 446547 - DNA, 20 bp, Artificial Sequence
  chemically synthesized
gtcacaggactttaaaatct

SEQ ID NO: 446548 - DNA, 20 bp, Artificial Sequence
  chemically synthesized
aagctataaccgagatttta

SEQ ID NO: 446549 - DNA, 20 bp, Artificial Sequence
  chemically synthesized
gttttagggtttaacgtcac

SEQ ID NO: 446550 - DNA, 20 bp, Artificial Sequence
  chemically synthesized
tgttttagggtttaacgtca

SEQ ID NO: 446551 - DNA, 20 bp, Artificial Sequence
  chemically synthesized
tactaaaagcatatgtttta

SEQ ID NO: 446552 - DNA, 20 bp, Artificial Sequence
  chemically synthesized
atactaaaagcatatgtttt

SEQ ID NO: 446553 - DNA, 20 bp, Artificial Sequence
  chemically synthesized
gatactaaaagcatatgttt

SEQ ID NO: 446554 - DNA, 20 bp, Artificial Sequence
  chemically synthesized
aaccctaaaacatatgcttt

SEQ ID NO: 446555 - DNA, 20 bp, Artificial Sequence
  chemically synthesized
ggtaaagattatgatactaa

SEQ ID NO: 446556 - DNA, 20 bp, Artificial Sequence
  chemically synthesized
tagtatcataatctttacca

SEQ ID NO: 446557 - DNA, 20 bp, Artificial Sequence
  chemically synthesized
gtcatctggtaaccatggta

SEQ ID NO: 446558 - DNA, 20 bp, Artificial Sequence
  chemically synthesized
ataatctttaccatggttac

SEQ ID NO: 446559 - DNA, 20 bp, Artificial Sequence
  chemically synthesized
aacatgtcatctggtaacca

SEQ ID NO: 446560 - DNA, 20 bp, Artificial Sequence
  chemically synthesized
cagatttttaacatgtcatc

SEQ ID NO: 446561 - DNA, 20 bp, Artificial Sequence
  chemically synthesized
tgacatgttaaaaatctgct

SEQ ID NO: 446562 - DNA, 20 bp, Artificial Sequence
  chemically synthesized
tgttaaaaatctgctaagta

SEQ ID NO: 446563 - DNA, 20 bp, Artificial Sequence
  chemically synthesized
gtgtcctatcctttacttag

SEQ ID NO: 446564 - DNA, 20 bp, Artificial Sequence
  chemically synthesized
gttaaaaatctgctaagtaa

SEQ ID NO: 446565 - DNA, 20 bp, Artificial Sequence
  chemically synthesized
ttggtgtcctatcctttact

SEQ ID NO: 446566 - DNA, 20 bp, Artificial Sequence
  chemically synthesized
aaaatctgctaagtaaagga

SEQ ID NO: 446567 - DNA, 20 bp, Artificial Sequence
  chemically synthesized
aaatctgctaagtaaaggat

SEQ ID NO: 446568 - DNA, 20 bp, Artificial Sequence
  chemically synthesized
catttaataatttgggttat

SEQ ID NO: 446569 - DNA, 20 bp, Artificial Sequence
  chemically synthesized
tagatagcatttaataattt

SEQ ID NO: 446570 - DNA, 20 bp, Artificial Sequence
  chemically synthesized
ctagatagcatttaataatt

SEQ ID NO: 446571 - DNA, 20 bp, Artificial Sequence
  chemically synthesized
ccaaattattaaatgctatc

SEQ ID NO: 446572 - DNA, 20 bp, Artificial Sequence
  chemically synthesized
caaattattaaatgctatct

SEQ ID NO: 446573 - DNA, 20 bp, Artificial Sequence
  chemically synthesized
agccctcacttaaacctaga

SEQ ID NO: 446574 - DNA, 20 bp, Artificial Sequence
  chemically synthesized
attaaatgctatctaggttt

SEQ ID NO: 446575 - DNA, 20 bp, Artificial Sequence
  chemically synthesized
tggaagccctcacttaaacc

SEQ ID NO: 446576 - DNA, 20 bp, Artificial Sequence
  chemically synthesized
aatgctatctaggtttaagt

SEQ ID NO: 446577 - DNA, 20 bp, Artificial Sequence
  chemically synthesized
atgctatctaggtttaagtg

SEQ ID NO: 446578 - DNA, 20 bp, Artificial Sequence
  chemically synthesized
tgctatctaggtttaagtga

SEQ ID NO: 446579 - DNA, 20 bp, Artificial Sequence
  chemically synthesized
agttttctcagtattgatgg

SEQ ID NO: 446580 - DNA, 20 bp, Artificial Sequence
  chemically synthesized
caaagttttctcagtattga

SEQ ID NO: 446581 - DNA, 20 bp, Artificial Sequence
  chemically synthesized
tgagggcttccatcaatact

SEQ ID NO: 446582 - DNA, 20 bp, Artificial Sequence
  chemically synthesized
gcatgcaggcaaagttttct

SEQ ID NO: 446583 - DNA, 20 bp, Artificial Sequence
  chemically synthesized
agcaagggtgcatgcaggca

SEQ ID NO: 446584 - DNA, 20 bp, Artificial Sequence
  chemically synthesized
taagtagcaagggtgcatgc

SEQ ID NO: 446585 - DNA, 20 bp, Artificial Sequence
  chemically synthesized
gtaagtagcaagggtgcatg

SEQ ID NO: 446586 - DNA, 20 bp, Artificial Sequence
  chemically synthesized
tgttaattggtaagtagcaa

SEQ ID NO: 446587 - DNA, 20 bp, Artificial Sequence
  chemically synthesized
ctgttaattggtaagtagca

SEQ ID NO: 446588 - DNA, 20 bp, Artificial Sequence
  chemically synthesized
gctgttaattggtaagtagc

SEQ ID NO: 446589 - DNA, 20 bp, Artificial Sequence
  chemically synthesized
cgatgctgttaattggtaag

SEQ ID NO: 446590 - DNA, 20 bp, Artificial Sequence
  chemically synthesized
cggcgatgctgttaattggt

SEQ ID NO: 446591 - DNA, 20 bp, Artificial Sequence
  chemically synthesized
ccttgctacttaccaattaa

SEQ ID NO: 446592 - DNA, 20 bp, Artificial Sequence
  chemically synthesized
ataacggcgatgctgttaat

SEQ ID NO: 446593 - DNA, 20 bp, Artificial Sequence
  chemically synthesized
cttaacaagctcatatataa

SEQ ID NO: 446594 - DNA, 20 bp, Artificial Sequence
  chemically synthesized
acagcatcgccgttatatat

SEQ ID NO: 446595 - DNA, 20 bp, Artificial Sequence
  chemically synthesized
ccgttatatatgagcttgtt

SEQ ID NO: 446596 - DNA, 20 bp, Artificial Sequence
  chemically synthesized
tatatatgagcttgttaagt

SEQ ID NO: 446597 - DNA, 20 bp, Artificial Sequence
  chemically synthesized
tattcaacatcttacttaac

SEQ ID NO: 446598 - DNA, 20 bp, Artificial Sequence
  chemically synthesized
ttaagtaagatgttgaatac

SEQ ID NO: 446599 - DNA, 20 bp, Artificial Sequence
  chemically synthesized
gtaagatgttgaatactggc

SEQ ID NO: 446600 - DNA, 20 bp, Artificial Sequence
  chemically synthesized
taagatgttgaatactggcc

SEQ ID NO: 446601 - DNA, 20 bp, Artificial Sequence
  chemically synthesized
tgtgagccaccacacccggc

SEQ ID NO: 446602 - DNA, 20 bp, Artificial Sequence
  chemically synthesized
tgttgaatactggccgggtg

SEQ ID NO: 446603 - DNA, 20 bp, Artificial Sequence
  chemically synthesized
tgaatactggccgggtgtgg

SEQ ID NO: 446604 - DNA, 20 bp, Artificial Sequence
  chemically synthesized
caagtgtgagccaccacacc

SEQ ID NO: 446605 - DNA, 20 bp, Artificial Sequence
  chemically synthesized
agttctgggattacaagtgt

SEQ ID NO: 446606 - DNA, 20 bp, Artificial Sequence
  chemically synthesized
gtggctcacacttgtaatcc

SEQ ID NO: 446607 - DNA, 20 bp, Artificial Sequence
  chemically synthesized
tcccaaagttctgggattac

SEQ ID NO: 446608 - DNA, 20 bp, Artificial Sequence
  chemically synthesized
cacttgtaatcccagaactt

SEQ ID NO: 446609 - DNA, 20 bp, Artificial Sequence
  chemically synthesized
cctcagcctcccaaagttct

SEQ ID NO: 446610 - DNA, 20 bp, Artificial Sequence
  chemically synthesized
acttgtaatcccagaacttt

SEQ ID NO: 446611 - DNA, 20 bp, Artificial Sequence
  chemically synthesized
ccctcagcctcccaaagttc

SEQ ID NO: 446612 - DNA, 20 bp, Artificial Sequence
  chemically synthesized
ttgtaatcccagaactttgg

SEQ ID NO: 446613 - DNA, 20 bp, Artificial Sequence
  chemically synthesized
tgtaatcccagaactttggg

SEQ ID NO: 446614 - DNA, 20 bp, Artificial Sequence
  chemically synthesized
ctaaccccctcagcctccca

SEQ ID NO: 446615 - DNA, 20 bp, Artificial Sequence
  chemically synthesized
tcccagaactttgggaggct

SEQ ID NO: 446616 - DNA, 20 bp, Artificial Sequence
  chemically synthesized
cccagaactttgggaggctg

SEQ ID NO: 446617 - DNA, 20 bp, Artificial Sequence
  chemically synthesized
ccagaactttgggaggctga

SEQ ID NO: 446618 - DNA, 20 bp, Artificial Sequence
  chemically synthesized
cagaactttgggaggctgag

SEQ ID NO: 446619 - DNA, 20 bp, Artificial Sequence
  chemically synthesized
agaactttgggaggctgagg

SEQ ID NO: 446620 - DNA, 20 bp, Artificial Sequence
  chemically synthesized
ctttgggaggctgagggggt

SEQ ID NO: 446621 - DNA, 20 bp, Artificial Sequence
  chemically synthesized
ctcaagtgatctaaccccct

SEQ ID NO: 446622 - DNA, 20 bp, Artificial Sequence
  chemically synthesized
ctgagggggttagatcactt

SEQ ID NO: 446623 - DNA, 20 bp, Artificial Sequence
  chemically synthesized
tgagggggttagatcacttg

SEQ ID NO: 446624 - DNA, 20 bp, Artificial Sequence
  chemically synthesized
ggggttagatcacttgaggt

SEQ ID NO: 446625 - DNA, 20 bp, Artificial Sequence
  chemically synthesized
gggttagatcacttgaggtc

SEQ ID NO: 446626 - DNA, 20 bp, Artificial Sequence
  chemically synthesized
ggtctcgaactcctgacctc

SEQ ID NO: 446627 - DNA, 20 bp, Artificial Sequence
  chemically synthesized
gttagatcacttgaggtcag

SEQ ID NO: 446628 - DNA, 20 bp, Artificial Sequence
  chemically synthesized
tcacttgaggtcaggagttc

SEQ ID NO: 446629 - DNA, 20 bp, Artificial Sequence
  chemically synthesized
tgaggtcaggagttcgagac

SEQ ID NO: 446630 - DNA, 20 bp, Artificial Sequence
  chemically synthesized
tcaggagttcgagaccagcc

SEQ ID NO: 446631 - DNA, 20 bp, Artificial Sequence
  chemically synthesized
tttcaccatgttggccaggc

SEQ ID NO: 446632 - DNA, 20 bp, Artificial Sequence
  chemically synthesized
ggtgtttcaccatgttggcc

SEQ ID NO: 446633 - DNA, 20 bp, Artificial Sequence
  chemically synthesized
cgagaccagcctggccaaca

SEQ ID NO: 446634 - DNA, 20 bp, Artificial Sequence
  chemically synthesized
cggtgtttcaccatgttggc

SEQ ID NO: 446635 - DNA, 20 bp, Artificial Sequence
  chemically synthesized
gagacggtgtttcaccatgt

SEQ ID NO: 446636 - DNA, 20 bp, Artificial Sequence
  chemically synthesized
ttttgtatttttagtagaga

SEQ ID NO: 446637 - DNA, 20 bp, Artificial Sequence
  chemically synthesized
taatttttgtatttttagta

SEQ ID NO: 446638 - DNA, 20 bp, Artificial Sequence
  chemically synthesized
gctaatttttgtatttttag

SEQ ID NO: 446639 - DNA, 20 bp, Artificial Sequence
  chemically synthesized
ccagctaatttttgtatttt

SEQ ID NO: 446640 - DNA, 20 bp, Artificial Sequence
  chemically synthesized
tctactaaaaatacaaaaat

SEQ ID NO: 446641 - DNA, 20 bp, Artificial Sequence
  chemically synthesized
ctaaaaatacaaaaattagc

SEQ ID NO: 446642 - DNA, 20 bp, Artificial Sequence
  chemically synthesized
taaaaatacaaaaattagct

SEQ ID NO: 446643 - DNA, 20 bp, Artificial Sequence
  chemically synthesized
atacaaaaattagctgggtg

SEQ ID NO: 446644 - DNA, 20 bp, Artificial Sequence
  chemically synthesized
caaaaattagctgggtgtgg

SEQ ID NO: 446645 - DNA, 20 bp, Artificial Sequence
  chemically synthesized
caggcgcccaccaccacacc

SEQ ID NO: 446646 - DNA, 20 bp, Artificial Sequence
  chemically synthesized
aaattagctgggtgtggtgg

SEQ ID NO: 446647 - DNA, 20 bp, Artificial Sequence
  chemically synthesized
aattagctgggtgtggtggt

SEQ ID NO: 446648 - DNA, 20 bp, Artificial Sequence
  chemically synthesized
gtggtgggcgcctgtaatcc

SEQ ID NO: 446649 - DNA, 20 bp, Artificial Sequence
  chemically synthesized
cccagagtagctgggattac

SEQ ID NO: 446650 - DNA, 20 bp, Artificial Sequence
  chemically synthesized
ccccagagtagctgggatta

SEQ ID NO: 446651 - DNA, 20 bp, Artificial Sequence
  chemically synthesized
cctcagcccccagagtagct

SEQ ID NO: 446652 - DNA, 20 bp, Artificial Sequence
  chemically synthesized
gcctgtaatcccagctactc

SEQ ID NO: 446653 - DNA, 20 bp, Artificial Sequence
  chemically synthesized
gcctcagcccccagagtagc

SEQ ID NO: 446654 - DNA, 20 bp, Artificial Sequence
  chemically synthesized
cctgtaatcccagctactct

SEQ ID NO: 446655 - DNA, 20 bp, Artificial Sequence
  chemically synthesized
ctgtaatcccagctactctg

SEQ ID NO: 446656 - DNA, 20 bp, Artificial Sequence
  chemically synthesized
tgtaatcccagctactctgg

SEQ ID NO: 446657 - DNA, 20 bp, Artificial Sequence
  chemically synthesized
tcctgcctcagcccccagag

SEQ ID NO: 446658 - DNA, 20 bp, Artificial Sequence
  chemically synthesized
ttctcctgcctcagccccca

SEQ ID NO: 446659 - DNA, 20 bp, Artificial Sequence
  chemically synthesized
tcccagctactctgggggct

SEQ ID NO: 446660 - DNA, 20 bp, Artificial Sequence
  chemically synthesized
cccagctactctgggggctg

SEQ ID NO: 446661 - DNA, 20 bp, Artificial Sequence
  chemically synthesized
gattctcctgcctcagcccc

SEQ ID NO: 446662 - DNA, 20 bp, Artificial Sequence
  chemically synthesized
agctactctgggggctgagg

SEQ ID NO: 446663 - DNA, 20 bp, Artificial Sequence
  chemically synthesized
gctactctgggggctgaggc

SEQ ID NO: 446664 - DNA, 20 bp, Artificial Sequence
  chemically synthesized
tactctgggggctgaggcag

SEQ ID NO: 446665 - DNA, 20 bp, Artificial Sequence
  chemically synthesized
ttcaagtgattctcctgcct

SEQ ID NO: 446666 - DNA, 20 bp, Artificial Sequence
  chemically synthesized
caggagaatcacttgaaccc

SEQ ID NO: 446667 - DNA, 20 bp, Artificial Sequence
  chemically synthesized
aacctccacctccggggttc

SEQ ID NO: 446668 - DNA, 20 bp, Artificial Sequence
  chemically synthesized
ggagaatcacttgaaccccg

SEQ ID NO: 446669 - DNA, 20 bp, Artificial Sequence
  chemically synthesized
gagaatcacttgaaccccgg

SEQ ID NO: 446670 - DNA, 20 bp, Artificial Sequence
  chemically synthesized
aatcacttgaaccccggagg

SEQ ID NO: 446671 - DNA, 20 bp, Artificial Sequence
  chemically synthesized
cactgcaacctccacctccg

SEQ ID NO: 446672 - DNA, 20 bp, Artificial Sequence
  chemically synthesized
tcacttgaaccccggaggtg

SEQ ID NO: 446673 - DNA, 20 bp, Artificial Sequence
  chemically synthesized
tcactgcaacctccacctcc

SEQ ID NO: 446674 - DNA, 20 bp, Artificial Sequence
  chemically synthesized
cacttgaaccccggaggtgg

SEQ ID NO: 446675 - DNA, 20 bp, Artificial Sequence
  chemically synthesized
ctcactgcaacctccacctc

SEQ ID NO: 446676 - DNA, 20 bp, Artificial Sequence
  chemically synthesized
aaccccggaggtggaggttg

SEQ ID NO: 446677 - DNA, 20 bp, Artificial Sequence
  chemically synthesized
ccggaggtggaggttgcagt

SEQ ID NO: 446678 - DNA, 20 bp, Artificial Sequence
  chemically synthesized
ggtggaggttgcagtgagcc

SEQ ID NO: 446679 - DNA, 20 bp, Artificial Sequence
  chemically synthesized
ggagtgcagtggtgggatct

SEQ ID NO: 446680 - DNA, 20 bp, Artificial Sequence
  chemically synthesized
ggtggctggagtgcagtggt

SEQ ID NO: 446681 - DNA, 20 bp, Artificial Sequence
  chemically synthesized
tggtggctggagtgcagtgg

SEQ ID NO: 446682 - DNA, 20 bp, Artificial Sequence
  chemically synthesized
cagtggtggctggagtgcag

SEQ ID NO: 446683 - DNA, 20 bp, Artificial Sequence
  chemically synthesized
gagatcccaccactgcactc

SEQ ID NO: 446684 - DNA, 20 bp, Artificial Sequence
  chemically synthesized
gttcagtggtggctggagtg

SEQ ID NO: 446685 - DNA, 20 bp, Artificial Sequence
  chemically synthesized
ctggagttcagtggtggctg

SEQ ID NO: 446686 - DNA, 20 bp, Artificial Sequence
  chemically synthesized
ggctggagttcagtggtggc

SEQ ID NO: 446687 - DNA, 20 bp, Artificial Sequence
  chemically synthesized
cccaggctggagttcagtgg

SEQ ID NO: 446688 - DNA, 20 bp, Artificial Sequence
  chemically synthesized
tcacccaggctggagttcag

SEQ ID NO: 446689 - DNA, 20 bp, Artificial Sequence
  chemically synthesized
ctccagccaccactgaactc

SEQ ID NO: 446690 - DNA, 20 bp, Artificial Sequence
  chemically synthesized
ctgtcacccaggctggagtt

SEQ ID NO: 446691 - DNA, 20 bp, Artificial Sequence
  chemically synthesized
gccaccactgaactccagcc

SEQ ID NO: 446692 - DNA, 20 bp, Artificial Sequence
  chemically synthesized
ccaccactgaactccagcct

SEQ ID NO: 446693 - DNA, 20 bp, Artificial Sequence
  chemically synthesized
ttgctctgtcacccaggctg

SEQ ID NO: 446694 - DNA, 20 bp, Artificial Sequence
  chemically synthesized
tcttgctctgtcacccaggc

SEQ ID NO: 446695 - DNA, 20 bp, Artificial Sequence
  chemically synthesized
ctgaactccagcctgggtga

SEQ ID NO: 446696 - DNA, 20 bp, Artificial Sequence
  chemically synthesized
agagtcttgctctgtcaccc

SEQ ID NO: 446697 - DNA, 20 bp, Artificial Sequence
  chemically synthesized
gaactccagcctgggtgaca

SEQ ID NO: 446698 - DNA, 20 bp, Artificial Sequence
  chemically synthesized
cagagtcttgctctgtcacc

SEQ ID NO: 446699 - DNA, 20 bp, Artificial Sequence
  chemically synthesized
tccagcctgggtgacagagc

SEQ ID NO: 446700 - DNA, 20 bp, Artificial Sequence
  chemically synthesized
tttttttttttttggagaca

SEQ ID NO: 446701 - DNA, 20 bp, Artificial Sequence
  chemically synthesized
tttttttttttttttggaga

SEQ ID NO: 446702 - DNA, 20 bp, Artificial Sequence
  chemically synthesized
tttttttttttttttttttg

SEQ ID NO: 446703 - DNA, 20 bp, Artificial Sequence
  chemically synthesized
tttttttttttttttttttt

SEQ ID NO: 446704 - DNA, 20 bp, Artificial Sequence
  chemically synthesized
aaaaaaaaaatgtcgaatgt

SEQ ID NO: 446705 - DNA, 20 bp, Artificial Sequence
  chemically synthesized
aaaaaaaaatgtcgaatgtc

SEQ ID NO: 446706 - DNA, 20 bp, Artificial Sequence
  chemically synthesized
agagtctgtttcagtaggtt

SEQ ID NO: 446707 - DNA, 20 bp, Artificial Sequence
  chemically synthesized
acattccaaacctactgaaa

SEQ ID NO: 446708 - DNA, 20 bp, Artificial Sequence
  chemically synthesized
attttagagtctgtttcagt

SEQ ID NO: 446709 - DNA, 20 bp, Artificial Sequence
  chemically synthesized
aattttagagtctgtttcag

SEQ ID NO: 446710 - DNA, 20 bp, Artificial Sequence
  chemically synthesized
ttaaattttagagtctgttt

SEQ ID NO: 446711 - DNA, 20 bp, Artificial Sequence
  chemically synthesized
ggggttcttgttaaatttta

SEQ ID NO: 446712 - DNA, 20 bp, Artificial Sequence
  chemically synthesized
ctggggttcttgttaaattt

SEQ ID NO: 446713 - DNA, 20 bp, Artificial Sequence
  chemically synthesized
aacagactctaaaatttaac

SEQ ID NO: 446714 - DNA, 20 bp, Artificial Sequence
  chemically synthesized
ctaaaatttaacaagaaccc

SEQ ID NO: 446715 - DNA, 20 bp, Artificial Sequence
  chemically synthesized
aactgtgtctaaataatctg

SEQ ID NO: 446716 - DNA, 20 bp, Artificial Sequence
  chemically synthesized
taactgtgtctaaataatct

SEQ ID NO: 446717 - DNA, 20 bp, Artificial Sequence
  chemically synthesized
aacaagaaccccagattatt

SEQ ID NO: 446718 - DNA, 20 bp, Artificial Sequence
  chemically synthesized
ataactgtgtctaaataatc

SEQ ID NO: 446719 - DNA, 20 bp, Artificial Sequence
  chemically synthesized
aaccccagattatttagaca

SEQ ID NO: 446720 - DNA, 20 bp, Artificial Sequence
  chemically synthesized
agacacagttatgtatgcaa

SEQ ID NO: 446721 - DNA, 20 bp, Artificial Sequence
  chemically synthesized
tatgcaacagctatattcta

SEQ ID NO: 446722 - DNA, 20 bp, Artificial Sequence
  chemically synthesized
cttgttacacctgtagaata

SEQ ID NO: 446723 - DNA, 20 bp, Artificial Sequence
  chemically synthesized
atgcaacagctatattctac

SEQ ID NO: 446724 - DNA, 20 bp, Artificial Sequence
  chemically synthesized
tttgtttcttgttacacctg

SEQ ID NO: 446725 - DNA, 20 bp, Artificial Sequence
  chemically synthesized
ctatattctacaggtgtaac

SEQ ID NO: 446726 - DNA, 20 bp, Artificial Sequence
  chemically synthesized
tacaggtgtaacaagaaaca

SEQ ID NO: 446727 - DNA, 20 bp, Artificial Sequence
  chemically synthesized
gtgtaacaagaaacaaagct

SEQ ID NO: 446728 - DNA, 20 bp, Artificial Sequence
  chemically synthesized
tgtaacaagaaacaaagcta

SEQ ID NO: 446729 - DNA, 20 bp, Artificial Sequence
  chemically synthesized
gaaatgtttagattggtcct

SEQ ID NO: 446730 - DNA, 20 bp, Artificial Sequence
  chemically synthesized
tccttaggaaatgtttagat

SEQ ID NO: 446731 - DNA, 20 bp, Artificial Sequence
  chemically synthesized
ttttttccttaggaaatgtt

SEQ ID NO: 446732 - DNA, 20 bp, Artificial Sequence
  chemically synthesized
gaccaatctaaacatttcct

SEQ ID NO: 446733 - DNA, 20 bp, Artificial Sequence
  chemically synthesized
accaatctaaacatttccta

SEQ ID NO: 446734 - DNA, 20 bp, Artificial Sequence
  chemically synthesized
tgccctccttttttttcctt

SEQ ID NO: 446735 - DNA, 20 bp, Artificial Sequence
  chemically synthesized
ttgccctccttttttttcct

SEQ ID NO: 446736 - DNA, 20 bp, Artificial Sequence
  chemically synthesized
aacatttcctaaggaaaaaa

SEQ ID NO: 446737 - DNA, 20 bp, Artificial Sequence
  chemically synthesized
acatttcctaaggaaaaaaa

SEQ ID NO: 446738 - DNA, 20 bp, Artificial Sequence
  chemically synthesized
atttcctaaggaaaaaaaag

SEQ ID NO: 446739 - DNA, 20 bp, Artificial Sequence
  chemically synthesized
tttcctaaggaaaaaaaagg

SEQ ID NO: 446740 - DNA, 20 bp, Artificial Sequence
  chemically synthesized
ttcctaaggaaaaaaaagga

SEQ ID NO: 446741 - DNA, 20 bp, Artificial Sequence
  chemically synthesized
agtaataaaggaataagtaa

SEQ ID NO: 446742 - DNA, 20 bp, Artificial Sequence
  chemically synthesized
aagtaataaaggaataagta

SEQ ID NO: 446743 - DNA, 20 bp, Artificial Sequence
  chemically synthesized
tttgaaagtaataaaggaat

SEQ ID NO: 446744 - DNA, 20 bp, Artificial Sequence
  chemically synthesized
aatctttttgaaagtaataa

SEQ ID NO: 446745 - DNA, 20 bp, Artificial Sequence
  chemically synthesized
aaatctttttgaaagtaata

SEQ ID NO: 446746 - DNA, 20 bp, Artificial Sequence
  chemically synthesized
attcctttattactttcaaa

SEQ ID NO: 446747 - DNA, 20 bp, Artificial Sequence
  chemically synthesized
tcattataaaatctttttga

SEQ ID NO: 446748 - DNA, 20 bp, Artificial Sequence
  chemically synthesized
tgatcagggcgaacagaatt

SEQ ID NO: 446749 - DNA, 20 bp, Artificial Sequence
  chemically synthesized
tattatctgatcagggcgaa

SEQ ID NO: 446750 - DNA, 20 bp, Artificial Sequence
  chemically synthesized
taaattctgttcgccctgat

SEQ ID NO: 446751 - DNA, 20 bp, Artificial Sequence
  chemically synthesized
gcagacatattatctgatca

SEQ ID NO: 446752 - DNA, 20 bp, Artificial Sequence
  chemically synthesized
tgcagacatattatctgatc

SEQ ID NO: 446753 - DNA, 20 bp, Artificial Sequence
  chemically synthesized
atgcagacatattatctgat

SEQ ID NO: 446754 - DNA, 20 bp, Artificial Sequence
  chemically synthesized
cagataatatgtctgcatct

SEQ ID NO: 446755 - DNA, 20 bp, Artificial Sequence
  chemically synthesized
ggatttttttaacttagatg

SEQ ID NO: 446756 - DNA, 20 bp, Artificial Sequence
  chemically synthesized
gattctggatttttttaact

SEQ ID NO: 446757 - DNA, 20 bp, Artificial Sequence
  chemically synthesized
gcatctaagttaaaaaaatc

SEQ ID NO: 446758 - DNA, 20 bp, Artificial Sequence
  chemically synthesized
tacaagtttgattttgattc

SEQ ID NO: 446759 - DNA, 20 bp, Artificial Sequence
  chemically synthesized
cttgaaaacaagaattttac

SEQ ID NO: 446760 - DNA, 20 bp, Artificial Sequence
  chemically synthesized
cttgtaaaattcttgttttc

SEQ ID NO: 446761 - DNA, 20 bp, Artificial Sequence
  chemically synthesized
taaaaaataagcttgaaaac

SEQ ID NO: 446762 - DNA, 20 bp, Artificial Sequence
  chemically synthesized
tctatgttcatttaaaaaat

SEQ ID NO: 446763 - DNA, 20 bp, Artificial Sequence
  chemically synthesized
gcttattttttaaatgaaca

SEQ ID NO: 446764 - DNA, 20 bp, Artificial Sequence
  chemically synthesized
ttattttttaaatgaacata

SEQ ID NO: 446765 - DNA, 20 bp, Artificial Sequence
  chemically synthesized
atttattgtgttcaacatga

SEQ ID NO: 446766 - DNA, 20 bp, Artificial Sequence
  chemically synthesized
gtgttcaacatgatggtttg

SEQ ID NO: 446767 - DNA, 20 bp, Artificial Sequence
  chemically synthesized
agtacatatacattgtgata

SEQ ID NO: 446768 - DNA, 20 bp, Artificial Sequence
  chemically synthesized
cattgtgatatggttaaatc

SEQ ID NO: 446769 - DNA, 20 bp, Artificial Sequence
  chemically synthesized
gaatgcatttgttaattagc

SEQ ID NO: 446770 - DNA, 20 bp, Artificial Sequence
  chemically synthesized
gagggaatgcatttgttaat

SEQ ID NO: 446771 - DNA, 20 bp, Artificial Sequence
  chemically synthesized
tgttaaatgataacatgtga

SEQ ID NO: 446772 - DNA, 20 bp, Artificial Sequence
  chemically synthesized
atgttaaatgataacatgtg

SEQ ID NO: 446773 - DNA, 20 bp, Artificial Sequence
  chemically synthesized
gatgttaaatgataacatgt

SEQ ID NO: 446774 - DNA, 20 bp, Artificial Sequence
  chemically synthesized
tcatttaacatccactctct

SEQ ID NO: 446775 - DNA, 20 bp, Artificial Sequence
  chemically synthesized
aatgaaaaatactaagagag

SEQ ID NO: 446776 - DNA, 20 bp, Artificial Sequence
  chemically synthesized
tcaaatgaaaaatactaaga

SEQ ID NO: 446777 - DNA, 20 bp, Artificial Sequence
  chemically synthesized
tttcaaatgaaaaatactaa

SEQ ID NO: 446778 - DNA, 20 bp, Artificial Sequence
  chemically synthesized
tttttcaaatgaaaaatact

SEQ ID NO: 446779 - DNA, 20 bp, Artificial Sequence
  chemically synthesized
atttttcatttgaaaaaaat

SEQ ID NO: 446780 - DNA, 20 bp, Artificial Sequence
  chemically synthesized
tttttcatttgaaaaaaatt

SEQ ID NO: 446781 - DNA, 20 bp, Artificial Sequence
  chemically synthesized
catttgaaaaaaattaggtt

SEQ ID NO: 446782 - DNA, 20 bp, Artificial Sequence
  chemically synthesized
gagtgtgtatttttggatta

SEQ ID NO: 446783 - DNA, 20 bp, Artificial Sequence
  chemically synthesized
agagtgtgtatttttggatt

SEQ ID NO: 446784 - DNA, 20 bp, Artificial Sequence
  chemically synthesized
cagagtgtgtatttttggat

SEQ ID NO: 446785 - DNA, 20 bp, Artificial Sequence
  chemically synthesized
catttcagagtgtgtatttt

SEQ ID NO: 446786 - DNA, 20 bp, Artificial Sequence
  chemically synthesized
tcagattttggagcatttca

SEQ ID NO: 446787 - DNA, 20 bp, Artificial Sequence
  chemically synthesized
tttcagattttggagcattt

SEQ ID NO: 446788 - DNA, 20 bp, Artificial Sequence
  chemically synthesized
tcaaaaagtttcagattttg

SEQ ID NO: 446789 - DNA, 20 bp, Artificial Sequence
  chemically synthesized
gctcaaaaagtttcagattt

SEQ ID NO: 446790 - DNA, 20 bp, Artificial Sequence
  chemically synthesized
tttcagtgctcaaaaagttt

SEQ ID NO: 446791 - DNA, 20 bp, Artificial Sequence
  chemically synthesized
tccaaaatctgaaacttttt

SEQ ID NO: 446792 - DNA, 20 bp, Artificial Sequence
  chemically synthesized
acatcatttcagtgctcaaa

SEQ ID NO: 446793 - DNA, 20 bp, Artificial Sequence
  chemically synthesized
ttccacgtatgacatcattt

SEQ ID NO: 446794 - DNA, 20 bp, Artificial Sequence
  chemically synthesized
cactgaaatgatgtcatacg

SEQ ID NO: 446795 - DNA, 20 bp, Artificial Sequence
  chemically synthesized
tgatgtcatacgtggaaaat

SEQ ID NO: 446796 - DNA, 20 bp, Artificial Sequence
  chemically synthesized
acgtggaaaattggacatat

SEQ ID NO: 446797 - DNA, 20 bp, Artificial Sequence
  chemically synthesized
tttaatgcaaactttttttc

SEQ ID NO: 446798 - DNA, 20 bp, Artificial Sequence
  chemically synthesized
gcagttttgtgcttgaaaaa

SEQ ID NO: 446799 - DNA, 20 bp, Artificial Sequence
  chemically synthesized
attttatacagtatttttag

SEQ ID NO: 446800 - DNA, 20 bp, Artificial Sequence
  chemically synthesized
gtaattttatacagtatttt

SEQ ID NO: 446801 - DNA, 20 bp, Artificial Sequence
  chemically synthesized
aactttgaggtaattttata

SEQ ID NO: 446802 - DNA, 20 bp, Artificial Sequence
  chemically synthesized
tactgtataaaattacctca

SEQ ID NO: 446803 - DNA, 20 bp, Artificial Sequence
  chemically synthesized
actttatacacgtaactttg

SEQ ID NO: 446804 - DNA, 20 bp, Artificial Sequence
  chemically synthesized
cactttatacacgtaacttt

SEQ ID NO: 446805 - DNA, 20 bp, Artificial Sequence
  chemically synthesized
acctcaaagttacgtgtata

SEQ ID NO: 446806 - DNA, 20 bp, Artificial Sequence
  chemically synthesized
aaagttacgtgtataaagtg

SEQ ID NO: 446807 - DNA, 20 bp, Artificial Sequence
  chemically synthesized
aagttacgtgtataaagtgc

SEQ ID NO: 446808 - DNA, 20 bp, Artificial Sequence
  chemically synthesized
tataaagtgcaggaaaacat

SEQ ID NO: 446809 - DNA, 20 bp, Artificial Sequence
  chemically synthesized
aacataagtgaatttgtgtt

SEQ ID NO: 446810 - DNA, 20 bp, Artificial Sequence
  chemically synthesized
agtgaatttgtgtttagtct

SEQ ID NO: 446811 - DNA, 20 bp, Artificial Sequence
  chemically synthesized
gtgaatttgtgtttagtctt

SEQ ID NO: 446812 - DNA, 20 bp, Artificial Sequence
  chemically synthesized
gtatcttgggcatgggaccc

SEQ ID NO: 446813 - DNA, 20 bp, Artificial Sequence
  chemically synthesized
tagtcttgggtcccatgccc

SEQ ID NO: 446814 - DNA, 20 bp, Artificial Sequence
  chemically synthesized
taataaggtatcttgggcat

SEQ ID NO: 446815 - DNA, 20 bp, Artificial Sequence
  chemically synthesized
ataataaggtatcttgggca

SEQ ID NO: 446816 - DNA, 20 bp, Artificial Sequence
  chemically synthesized
tatacataataaggtatctt

SEQ ID NO: 446817 - DNA, 20 bp, Artificial Sequence
  chemically synthesized
atatacataataaggtatct

SEQ ID NO: 446818 - DNA, 20 bp, Artificial Sequence
  chemically synthesized
atgcttacatatacataata

SEQ ID NO: 446819 - DNA, 20 bp, Artificial Sequence
  chemically synthesized
aatgcttacatatacataat

SEQ ID NO: 446820 - DNA, 20 bp, Artificial Sequence
  chemically synthesized
ataccttattatgtatatgt

SEQ ID NO: 446821 - DNA, 20 bp, Artificial Sequence
  chemically synthesized
gtttcagatttgggatttta

SEQ ID NO: 446822 - DNA, 20 bp, Artificial Sequence
  chemically synthesized
acctgaagtgtttcagattt

SEQ ID NO: 446823 - DNA, 20 bp, Artificial Sequence
  chemically synthesized
gacctgaagtgtttcagatt

SEQ ID NO: 446824 - DNA, 20 bp, Artificial Sequence
  chemically synthesized
gcttgggacctgaagtgttt

SEQ ID NO: 446825 - DNA, 20 bp, Artificial Sequence
  chemically synthesized
atcccaaatctgaaacactt

SEQ ID NO: 446826 - DNA, 20 bp, Artificial Sequence
  chemically synthesized
tcccaaatctgaaacacttc

SEQ ID NO: 446827 - DNA, 20 bp, Artificial Sequence
  chemically synthesized
tccaaaatgcttgggacctg

SEQ ID NO: 446828 - DNA, 20 bp, Artificial Sequence
  chemically synthesized
tctgaaacacttcaggtccc

SEQ ID NO: 446829 - DNA, 20 bp, Artificial Sequence
  chemically synthesized
attccttatccaaaatgctt

SEQ ID NO: 446830 - DNA, 20 bp, Artificial Sequence
  chemically synthesized
acttcaggtcccaagcattt

SEQ ID NO: 446831 - DNA, 20 bp, Artificial Sequence
  chemically synthesized
tattccttatccaaaatgct

SEQ ID NO: 446832 - DNA, 20 bp, Artificial Sequence
  chemically synthesized
aggtcccaagcattttggat

SEQ ID NO: 446833 - DNA, 20 bp, Artificial Sequence
  chemically synthesized
ggtcccaagcattttggata

SEQ ID NO: 446834 - DNA, 20 bp, Artificial Sequence
  chemically synthesized
agttaatgatgatacggatt

SEQ ID NO: 446835 - DNA, 20 bp, Artificial Sequence
  chemically synthesized
gactatagttaatgatgata

SEQ ID NO: 446836 - DNA, 20 bp, Artificial Sequence
  chemically synthesized
atccgtatcatcattaacta

SEQ ID NO: 446837 - DNA, 20 bp, Artificial Sequence
  chemically synthesized
attgtacaatatggtgacta

SEQ ID NO: 446838 - DNA, 20 bp, Artificial Sequence
  chemically synthesized
aagagatctattgtacaata

SEQ ID NO: 446839 - DNA, 20 bp, Artificial Sequence
  chemically synthesized
atagtcaccatattgtacaa

SEQ ID NO: 446840 - DNA, 20 bp, Artificial Sequence
  chemically synthesized
gatatgagaaataaaatcaa

SEQ ID NO: 446841 - DNA, 20 bp, Artificial Sequence
  chemically synthesized
tagatatgagaaataaaatc

SEQ ID NO: 446842 - DNA, 20 bp, Artificial Sequence
  chemically synthesized
acatatttacagttagatat

SEQ ID NO: 446843 - DNA, 20 bp, Artificial Sequence
  chemically synthesized
aaataatacatatttacagt

SEQ ID NO: 446844 - DNA, 20 bp, Artificial Sequence
  chemically synthesized
ggttaaataatacatattta

SEQ ID NO: 446845 - DNA, 20 bp, Artificial Sequence
  chemically synthesized
agggaggattatgaagataa

SEQ ID NO: 446846 - DNA, 20 bp, Artificial Sequence
  chemically synthesized
aagagagagggaggattatg

SEQ ID NO: 446847 - DNA, 20 bp, Artificial Sequence
  chemically synthesized
gaggtagttaagagagaggg

SEQ ID NO: 446848 - DNA, 20 bp, Artificial Sequence
  chemically synthesized
tgaggtagttaagagagagg

SEQ ID NO: 446849 - DNA, 20 bp, Artificial Sequence
  chemically synthesized
ggtgaggtagttaagagaga

SEQ ID NO: 446850 - DNA, 20 bp, Artificial Sequence
  chemically synthesized
aggtgaggtagttaagagag

SEQ ID NO: 446851 - DNA, 20 bp, Artificial Sequence
  chemically synthesized
aaggtgaggtagttaagaga

SEQ ID NO: 446852 - DNA, 20 bp, Artificial Sequence
  chemically synthesized
agaaggtgaggtagttaaga

SEQ ID NO: 446853 - DNA, 20 bp, Artificial Sequence
  chemically synthesized
ccagaaggtgaggtagttaa

SEQ ID NO: 446854 - DNA, 20 bp, Artificial Sequence
  chemically synthesized
taccagaaggtgaggtagtt

SEQ ID NO: 446855 - DNA, 20 bp, Artificial Sequence
  chemically synthesized
ttggttaccagaaggtgagg

SEQ ID NO: 446856 - DNA, 20 bp, Artificial Sequence
  chemically synthesized
ctcttaactacctcaccttc

SEQ ID NO: 446857 - DNA, 20 bp, Artificial Sequence
  chemically synthesized
atgttggttaccagaaggtg

SEQ ID NO: 446858 - DNA, 20 bp, Artificial Sequence
  chemically synthesized
aatgttggttaccagaaggt

SEQ ID NO: 446859 - DNA, 20 bp, Artificial Sequence
  chemically synthesized
ataaaatgttggttaccaga

SEQ ID NO: 446860 - DNA, 20 bp, Artificial Sequence
  chemically synthesized
aataaaatgttggttaccag

SEQ ID NO: 446861 - DNA, 20 bp, Artificial Sequence
  chemically synthesized
gagaataaaatgttggttac

SEQ ID NO: 446862 - DNA, 20 bp, Artificial Sequence
  chemically synthesized
taaagtagagaataaaatgt

SEQ ID NO: 446863 - DNA, 20 bp, Artificial Sequence
  chemically synthesized
aaaaggttgattttaaagta

SEQ ID NO: 446864 - DNA, 20 bp, Artificial Sequence
  chemically synthesized
tgaaaaggttgattttaaag

SEQ ID NO: 446865 - DNA, 20 bp, Artificial Sequence
  chemically synthesized
atctgaaaaggttgatttta

SEQ ID NO: 446866 - DNA, 20 bp, Artificial Sequence
  chemically synthesized
tactttaaaatcaacctttt

SEQ ID NO: 446867 - DNA, 20 bp, Artificial Sequence
  chemically synthesized
actttatgcggaatctgaaa

SEQ ID NO: 446868 - DNA, 20 bp, Artificial Sequence
  chemically synthesized
tactttatgcggaatctgaa

SEQ ID NO: 446869 - DNA, 20 bp, Artificial Sequence
  chemically synthesized
accttttcagattccgcata

SEQ ID NO: 446870 - DNA, 20 bp, Artificial Sequence
  chemically synthesized
ccacgttatcttactttatg

SEQ ID NO: 446871 - DNA, 20 bp, Artificial Sequence
  chemically synthesized
tttcagattccgcataaagt

SEQ ID NO: 446872 - DNA, 20 bp, Artificial Sequence
  chemically synthesized
ccgcataaagtaagataacg

SEQ ID NO: 446873 - DNA, 20 bp, Artificial Sequence
  chemically synthesized
ttaaataagccaggcagaga

SEQ ID NO: 446874 - DNA, 20 bp, Artificial Sequence
  chemically synthesized
gtattttttctttctctgcc

SEQ ID NO: 446875 - DNA, 20 bp, Artificial Sequence
  chemically synthesized
taagttaaataagccaggca

SEQ ID NO: 446876 - DNA, 20 bp, Artificial Sequence
  chemically synthesized
attaagttaaataagccagg

SEQ ID NO: 446877 - DNA, 20 bp, Artificial Sequence
  chemically synthesized
gatattaagttaaataagcc

SEQ ID NO: 446878 - DNA, 20 bp, Artificial Sequence
  chemically synthesized
ggatattaagttaaataagc

SEQ ID NO: 446879 - DNA, 20 bp, Artificial Sequence
  chemically synthesized
tggaggatattaagttaaat

SEQ ID NO: 446880 - DNA, 20 bp, Artificial Sequence
  chemically synthesized
gaatgaacctggaggatatt

SEQ ID NO: 446881 - DNA, 20 bp, Artificial Sequence
  chemically synthesized
ttatttaacttaatatcctc

SEQ ID NO: 446882 - DNA, 20 bp, Artificial Sequence
  chemically synthesized
tatttaacttaatatcctcc

SEQ ID NO: 446883 - DNA, 20 bp, Artificial Sequence
  chemically synthesized
agcaacatgaatgaacctgg

SEQ ID NO: 446884 - DNA, 20 bp, Artificial Sequence
  chemically synthesized
cagcaacatgaatgaacctg

SEQ ID NO: 446885 - DNA, 20 bp, Artificial Sequence
  chemically synthesized
tgcagcaacatgaatgaacc

SEQ ID NO: 446886 - DNA, 20 bp, Artificial Sequence
  chemically synthesized
ttcattcatgttgctgcaaa

SEQ ID NO: 446887 - DNA, 20 bp, Artificial Sequence
  chemically synthesized
attcatgttgctgcaaatgg

SEQ ID NO: 446888 - DNA, 20 bp, Artificial Sequence
  chemically synthesized
agaatgaaacctgccatttg

SEQ ID NO: 446889 - DNA, 20 bp, Artificial Sequence
  chemically synthesized
ttcatgttgctgcaaatggc

SEQ ID NO: 446890 - DNA, 20 bp, Artificial Sequence
  chemically synthesized
ggcaggtttcattctcttca

SEQ ID NO: 446891 - DNA, 20 bp, Artificial Sequence
  chemically synthesized
gaatactgttcatccatgaa

SEQ ID NO: 446892 - DNA, 20 bp, Artificial Sequence
  chemically synthesized
tagaatactgttcatccatg

SEQ ID NO: 446893 - DNA, 20 bp, Artificial Sequence
  chemically synthesized
tcattctcttcatggatgaa

SEQ ID NO: 446894 - DNA, 20 bp, Artificial Sequence
  chemically synthesized
aatgtggtatacgtacacaa

SEQ ID NO: 446895 - DNA, 20 bp, Artificial Sequence
  chemically synthesized
aatgaataaaagaaaaaatg

SEQ ID NO: 446896 - DNA, 20 bp, Artificial Sequence
  chemically synthesized
atcaactggtgaatgaataa

SEQ ID NO: 446897 - DNA, 20 bp, Artificial Sequence
  chemically synthesized
tttttcttttattcattcac

SEQ ID NO: 446898 - DNA, 20 bp, Artificial Sequence
  chemically synthesized
tttattcattcaccagttga

SEQ ID NO: 446899 - DNA, 20 bp, Artificial Sequence
  chemically synthesized
caacctaagggtccatcaac

SEQ ID NO: 446900 - DNA, 20 bp, Artificial Sequence
  chemically synthesized
ttcaccagttgatggaccct

SEQ ID NO: 446901 - DNA, 20 bp, Artificial Sequence
  chemically synthesized
tcaccagttgatggaccctt

SEQ ID NO: 446902 - DNA, 20 bp, Artificial Sequence
  chemically synthesized
gagatatggaatcaacctaa

SEQ ID NO: 446903 - DNA, 20 bp, Artificial Sequence
  chemically synthesized
tgagatatggaatcaaccta

SEQ ID NO: 446904 - DNA, 20 bp, Artificial Sequence
  chemically synthesized
ctgagatatggaatcaacct

SEQ ID NO: 446905 - DNA, 20 bp, Artificial Sequence
  chemically synthesized
cttaggttgattccatatct

SEQ ID NO: 446906 - DNA, 20 bp, Artificial Sequence
  chemically synthesized
cattcacaattgctgagata

SEQ ID NO: 446907 - DNA, 20 bp, Artificial Sequence
  chemically synthesized
gcagcacattcacaattgct

SEQ ID NO: 446908 - DNA, 20 bp, Artificial Sequence
  chemically synthesized
ctgcacacccaagtttattg

SEQ ID NO: 446909 - DNA, 20 bp, Artificial Sequence
  chemically synthesized
tgaatgtgctgcaataaact

SEQ ID NO: 446910 - DNA, 20 bp, Artificial Sequence
  chemically synthesized
gaatgtgctgcaataaactt

SEQ ID NO: 446911 - DNA, 20 bp, Artificial Sequence
  chemically synthesized
ctgcaataaacttgggtgtg

SEQ ID NO: 446912 - DNA, 20 bp, Artificial Sequence
  chemically synthesized
gaagagatatctgcacaccc

SEQ ID NO: 446913 - DNA, 20 bp, Artificial Sequence
  chemically synthesized
aatgaaatcaacacgttgaa

SEQ ID NO: 446914 - DNA, 20 bp, Artificial Sequence
  chemically synthesized
gaaatgaaatcaacacgttg

SEQ ID NO: 446915 - DNA, 20 bp, Artificial Sequence
  chemically synthesized
gtgttgatttcatttccttt

SEQ ID NO: 446916 - DNA, 20 bp, Artificial Sequence
  chemically synthesized
actactggctatataccgaa

SEQ ID NO: 446917 - DNA, 20 bp, Artificial Sequence
  chemically synthesized
cactactggctatataccga

SEQ ID NO: 446918 - DNA, 20 bp, Artificial Sequence
  chemically synthesized
tttcatttcctttcggtata

SEQ ID NO: 446919 - DNA, 20 bp, Artificial Sequence
  chemically synthesized
atttcctttcggtatatagc

SEQ ID NO: 446920 - DNA, 20 bp, Artificial Sequence
  chemically synthesized
tcctttcggtatatagccag

SEQ ID NO: 446921 - DNA, 20 bp, Artificial Sequence
  chemically synthesized
tttcggtatatagccagtag

SEQ ID NO: 446922 - DNA, 20 bp, Artificial Sequence
  chemically synthesized
ttcggtatatagccagtagt

SEQ ID NO: 446923 - DNA, 20 bp, Artificial Sequence
  chemically synthesized
tgatccagcagtcccactac

SEQ ID NO: 446924 - DNA, 20 bp, Artificial Sequence
  chemically synthesized
atagccagtagtgggactgc

SEQ ID NO: 446925 - DNA, 20 bp, Artificial Sequence
  chemically synthesized
agaactaacatatgatccag

SEQ ID NO: 446926 - DNA, 20 bp, Artificial Sequence
  chemically synthesized
actagaactaacatatgatc

SEQ ID NO: 446927 - DNA, 20 bp, Artificial Sequence
  chemically synthesized
gggactgctggatcatatgt

SEQ ID NO: 446928 - DNA, 20 bp, Artificial Sequence
  chemically synthesized
gctggatcatatgttagttc

SEQ ID NO: 446929 - DNA, 20 bp, Artificial Sequence
  chemically synthesized
tttctcaaaaaaattaaaac

SEQ ID NO: 446930 - DNA, 20 bp, Artificial Sequence
  chemically synthesized
gttctagttttaattttttt

SEQ ID NO: 446931 - DNA, 20 bp, Artificial Sequence
  chemically synthesized
tagttttaatttttttgaga

SEQ ID NO: 446932 - DNA, 20 bp, Artificial Sequence
  chemically synthesized
accattattgaaaacagtag

SEQ ID NO: 446933 - DNA, 20 bp, Artificial Sequence
  chemically synthesized
aaccattattgaaaacagta

SEQ ID NO: 446934 - DNA, 20 bp, Artificial Sequence
  chemically synthesized
taaccattattgaaaacagt

SEQ ID NO: 446935 - DNA, 20 bp, Artificial Sequence
  chemically synthesized
ataaccattattgaaaacag

SEQ ID NO: 446936 - DNA, 20 bp, Artificial Sequence
  chemically synthesized
aatataaccattattgaaaa

SEQ ID NO: 446937 - DNA, 20 bp, Artificial Sequence
  chemically synthesized
gcccctactgttttcaataa

SEQ ID NO: 446938 - DNA, 20 bp, Artificial Sequence
  chemically synthesized
ttaattcacattcccaccaa

SEQ ID NO: 446939 - DNA, 20 bp, Artificial Sequence
  chemically synthesized
aacccttgcacaccgttggt

SEQ ID NO: 446940 - DNA, 20 bp, Artificial Sequence
  chemically synthesized
gaacccttgcacaccgttgg

SEQ ID NO: 446941 - DNA, 20 bp, Artificial Sequence
  chemically synthesized
agggaacccttgcacaccgt

SEQ ID NO: 446942 - DNA, 20 bp, Artificial Sequence
  chemically synthesized
cattcccaccaacggtgtgc

SEQ ID NO: 446943 - DNA, 20 bp, Artificial Sequence
  chemically synthesized
attcccaccaacggtgtgca

SEQ ID NO: 446944 - DNA, 20 bp, Artificial Sequence
  chemically synthesized
ttcccaccaacggtgtgcaa

SEQ ID NO: 446945 - DNA, 20 bp, Artificial Sequence
  chemically synthesized
tcctgagaaggtagagaaaa

SEQ ID NO: 446946 - DNA, 20 bp, Artificial Sequence
  chemically synthesized
ttcctgagaaggtagagaaa

SEQ ID NO: 446947 - DNA, 20 bp, Artificial Sequence
  chemically synthesized
gttcctgagaaggtagagaa

SEQ ID NO: 446948 - DNA, 20 bp, Artificial Sequence
  chemically synthesized
caagtgttcctgagaaggta

SEQ ID NO: 446949 - DNA, 20 bp, Artificial Sequence
  chemically synthesized
ttcccttttctctaccttct

SEQ ID NO: 446950 - DNA, 20 bp, Artificial Sequence
  chemically synthesized
tcccttttctctaccttctc

SEQ ID NO: 446951 - DNA, 20 bp, Artificial Sequence
  chemically synthesized
aacaagtgttcctgagaagg

SEQ ID NO: 446952 - DNA, 20 bp, Artificial Sequence
  chemically synthesized
gataacaagtgttcctgaga

SEQ ID NO: 446953 - DNA, 20 bp, Artificial Sequence
  chemically synthesized
agataacaagtgttcctgag

SEQ ID NO: 446954 - DNA, 20 bp, Artificial Sequence
  chemically synthesized
aaaagataacaagtgttcct

SEQ ID NO: 446955 - DNA, 20 bp, Artificial Sequence
  chemically synthesized
tcaagaaggcaaaagataac

SEQ ID NO: 446956 - DNA, 20 bp, Artificial Sequence
  chemically synthesized
gaatgacatcaagaaggcaa

SEQ ID NO: 446957 - DNA, 20 bp, Artificial Sequence
  chemically synthesized
ctgttagaatgacatcaaga

SEQ ID NO: 446958 - DNA, 20 bp, Artificial Sequence
  chemically synthesized
cctgttagaatgacatcaag

SEQ ID NO: 446959 - DNA, 20 bp, Artificial Sequence
  chemically synthesized
aaacctgttagaatgacatc

SEQ ID NO: 446960 - DNA, 20 bp, Artificial Sequence
  chemically synthesized
ccttcttgatgtcattctaa

SEQ ID NO: 446961 - DNA, 20 bp, Artificial Sequence
  chemically synthesized
cttcttgatgtcattctaac

SEQ ID NO: 446962 - DNA, 20 bp, Artificial Sequence
  chemically synthesized
agatatcaactcaaacctgt

SEQ ID NO: 446963 - DNA, 20 bp, Artificial Sequence
  chemically synthesized
gatgtcattctaacaggttt

SEQ ID NO: 446964 - DNA, 20 bp, Artificial Sequence
  chemically synthesized
tttgagttgatatctcactg

SEQ ID NO: 446965 - DNA, 20 bp, Artificial Sequence
  chemically synthesized
aatgtaaataaatccacagt

SEQ ID NO: 446966 - DNA, 20 bp, Artificial Sequence
  chemically synthesized
ggtaaatgtaaataaatcca

SEQ ID NO: 446967 - DNA, 20 bp, Artificial Sequence
  chemically synthesized
gttcagcatcattaaacatc

SEQ ID NO: 446968 - DNA, 20 bp, Artificial Sequence
  chemically synthesized
tgttcagcatcattaaacat

SEQ ID NO: 446969 - DNA, 20 bp, Artificial Sequence
  chemically synthesized
caggaatacgaaaacatgtt

SEQ ID NO: 446970 - DNA, 20 bp, Artificial Sequence
  chemically synthesized
acatgttttcgtattcctgt

SEQ ID NO: 446971 - DNA, 20 bp, Artificial Sequence
  chemically synthesized
aagacattcacatagccaac

SEQ ID NO: 446972 - DNA, 20 bp, Artificial Sequence
  chemically synthesized
gaagacattcacatagccaa

SEQ ID NO: 446973 - DNA, 20 bp, Artificial Sequence
  chemically synthesized
ctcaagagaagacattcaca

SEQ ID NO: 446974 - DNA, 20 bp, Artificial Sequence
  chemically synthesized
ctatgtgaatgtcttctctt

SEQ ID NO: 446975 - DNA, 20 bp, Artificial Sequence
  chemically synthesized
gagcaggcatttctcaagag

SEQ ID NO: 446976 - DNA, 20 bp, Artificial Sequence
  chemically synthesized
tctgagcaggcatttctcaa

SEQ ID NO: 446977 - DNA, 20 bp, Artificial Sequence
  chemically synthesized
gatctgagcaggcatttctc

SEQ ID NO: 446978 - DNA, 20 bp, Artificial Sequence
  chemically synthesized
tctcttgagaaatgcctgct

SEQ ID NO: 446979 - DNA, 20 bp, Artificial Sequence
  chemically synthesized
aatgagcaaaagatctgagc

SEQ ID NO: 446980 - DNA, 20 bp, Artificial Sequence
  chemically synthesized
aaatgagcaaaagatctgag

SEQ ID NO: 446981 - DNA, 20 bp, Artificial Sequence
  chemically synthesized
taaaaatgagcaaaagatct

SEQ ID NO: 446982 - DNA, 20 bp, Artificial Sequence
  chemically synthesized
acccaattaaaaatgagcaa

SEQ ID NO: 446983 - DNA, 20 bp, Artificial Sequence
  chemically synthesized
caaataacccaattaaaaat

SEQ ID NO: 446984 - DNA, 20 bp, Artificial Sequence
  chemically synthesized
atcttttgctcatttttaat

SEQ ID NO: 446985 - DNA, 20 bp, Artificial Sequence
  chemically synthesized
tcttttgctcatttttaatt

SEQ ID NO: 446986 - DNA, 20 bp, Artificial Sequence
  chemically synthesized
aactcaaacaaataaatagc

SEQ ID NO: 446987 - DNA, 20 bp, Artificial Sequence
  chemically synthesized
cagtaactcaaacaaataaa

SEQ ID NO: 446988 - DNA, 20 bp, Artificial Sequence
  chemically synthesized
ttcttgctatttatttgttt

SEQ ID NO: 446989 - DNA, 20 bp, Artificial Sequence
  chemically synthesized
ggttagtagccaaaatagat

SEQ ID NO: 446990 - DNA, 20 bp, Artificial Sequence
  chemically synthesized
tttgagttactgatctattt

SEQ ID NO: 446991 - DNA, 20 bp, Artificial Sequence
  chemically synthesized
taaggggttagtagccaaaa

SEQ ID NO: 446992 - DNA, 20 bp, Artificial Sequence
  chemically synthesized
tacatcttataaggggttag

SEQ ID NO: 446993 - DNA, 20 bp, Artificial Sequence
  chemically synthesized
ccatacatcttataaggggt

SEQ ID NO: 446994 - DNA, 20 bp, Artificial Sequence
  chemically synthesized
tttggctactaaccccttat

SEQ ID NO: 446995 - DNA, 20 bp, Artificial Sequence
  chemically synthesized
tacaccatacatcttataag

SEQ ID NO: 446996 - DNA, 20 bp, Artificial Sequence
  chemically synthesized
gtacaccatacatcttataa

SEQ ID NO: 446997 - DNA, 20 bp, Artificial Sequence
  chemically synthesized
tgtacaccatacatcttata

SEQ ID NO: 446998 - DNA, 20 bp, Artificial Sequence
  chemically synthesized
ttgtacaccatacatcttat

SEQ ID NO: 446999 - DNA, 20 bp, Artificial Sequence
  chemically synthesized
ctaaccccttataagatgta

SEQ ID NO: 447000 - DNA, 20 bp, Artificial Sequence
  chemically synthesized
aaatatttcatcccattctg

SEQ ID NO: 447001 - DNA, 20 bp, Artificial Sequence
  chemically synthesized
aatatttcatcccattctgt

SEQ ID NO: 447002 - DNA, 20 bp, Artificial Sequence
  chemically synthesized
gaagagaaaacctacagaat

SEQ ID NO: 447003 - DNA, 20 bp, Artificial Sequence
  chemically synthesized
tgaagagaaaacctacagaa

SEQ ID NO: 447004 - DNA, 20 bp, Artificial Sequence
  chemically synthesized
cagagtgaagagaaaaccta

SEQ ID NO: 447005 - DNA, 20 bp, Artificial Sequence
  chemically synthesized
gaaagaatcaacagagtgaa

SEQ ID NO: 447006 - DNA, 20 bp, Artificial Sequence
  chemically synthesized
aggaaagaatcaacagagtg

SEQ ID NO: 447007 - DNA, 20 bp, Artificial Sequence
  chemically synthesized
agtaaaggaaagaatcaaca

SEQ ID NO: 447008 - DNA, 20 bp, Artificial Sequence
  chemically synthesized
acagtaaaggaaagaatcaa

SEQ ID NO: 447009 - DNA, 20 bp, Artificial Sequence
  chemically synthesized
aagttctgcacagtaaagga

SEQ ID NO: 447010 - DNA, 20 bp, Artificial Sequence
  chemically synthesized
caaaaagttctgcacagtaa

SEQ ID NO: 447011 - DNA, 20 bp, Artificial Sequence
  chemically synthesized
tgattctttcctttactgtg

SEQ ID NO: 447012 - DNA, 20 bp, Artificial Sequence
  chemically synthesized
tcaaaaagttctgcacagta

SEQ ID NO: 447013 - DNA, 20 bp, Artificial Sequence
  chemically synthesized
caaactcaaaaagttctgca

SEQ ID NO: 447014 - DNA, 20 bp, Artificial Sequence
  chemically synthesized
tttactgtgcagaacttttt

SEQ ID NO: 447015 - DNA, 20 bp, Artificial Sequence
  chemically synthesized
gggattacatcaaactcaaa

SEQ ID NO: 447016 - DNA, 20 bp, Artificial Sequence
  chemically synthesized
aaaaccaaatatagacaaat

SEQ ID NO: 447017 - DNA, 20 bp, Artificial Sequence
  chemically synthesized
caaaaccaaatatagacaaa

SEQ ID NO: 447018 - DNA, 20 bp, Artificial Sequence
  chemically synthesized
taatcccatttgtctatatt

SEQ ID NO: 447019 - DNA, 20 bp, Artificial Sequence
  chemically synthesized
acaggaaacaaaaccaaata

SEQ ID NO: 447020 - DNA, 20 bp, Artificial Sequence
  chemically synthesized
ggatatgacctcaaaagcac

SEQ ID NO: 447021 - DNA, 20 bp, Artificial Sequence
  chemically synthesized
gttttgtttcctgtgctttt

SEQ ID NO: 447022 - DNA, 20 bp, Artificial Sequence
  chemically synthesized
tggatatgacctcaaaagca

SEQ ID NO: 447023 - DNA, 20 bp, Artificial Sequence
  chemically synthesized
ttttgtttcctgtgcttttg

SEQ ID NO: 447024 - DNA, 20 bp, Artificial Sequence
  chemically synthesized
ttttctggatatgacctcaa

SEQ ID NO: 447025 - DNA, 20 bp, Artificial Sequence
  chemically synthesized
tgtgcttttgaggtcatatc

SEQ ID NO: 447026 - DNA, 20 bp, Artificial Sequence
  chemically synthesized
tgatctgggcaaaaattttc

SEQ ID NO: 447027 - DNA, 20 bp, Artificial Sequence
  chemically synthesized
atatccagaaaatttttgcc

SEQ ID NO: 447028 - DNA, 20 bp, Artificial Sequence
  chemically synthesized
gaaaatttttgcccagatca

SEQ ID NO: 447029 - DNA, 20 bp, Artificial Sequence
  chemically synthesized
agtctccatgactatgatct

SEQ ID NO: 447030 - DNA, 20 bp, Artificial Sequence
  chemically synthesized
aagtctccatgactatgatc

SEQ ID NO: 447031 - DNA, 20 bp, Artificial Sequence
  chemically synthesized
ttttgcccagatcatagtca

SEQ ID NO: 447032 - DNA, 20 bp, Artificial Sequence
  chemically synthesized
ttgcccagatcatagtcatg

SEQ ID NO: 447033 - DNA, 20 bp, Artificial Sequence
  chemically synthesized
accagaaggaaacataaggg

SEQ ID NO: 447034 - DNA, 20 bp, Artificial Sequence
  chemically synthesized
actaccagaaggaaacataa

SEQ ID NO: 447035 - DNA, 20 bp, Artificial Sequence
  chemically synthesized
gactaccagaaggaaacata

SEQ ID NO: 447036 - DNA, 20 bp, Artificial Sequence
  chemically synthesized
agactaccagaaggaaacat

SEQ ID NO: 447037 - DNA, 20 bp, Artificial Sequence
  chemically synthesized
acttcccttatgtttccttc

SEQ ID NO: 447038 - DNA, 20 bp, Artificial Sequence
  chemically synthesized
tcccttatgtttccttctgg

SEQ ID NO: 447039 - DNA, 20 bp, Artificial Sequence
  chemically synthesized
gaaactataagactaccaga

SEQ ID NO: 447040 - DNA, 20 bp, Artificial Sequence
  chemically synthesized
tgaaactataagactaccag

SEQ ID NO: 447041 - DNA, 20 bp, Artificial Sequence
  chemically synthesized
acctgaaactataagactac

SEQ ID NO: 447042 - DNA, 20 bp, Artificial Sequence
  chemically synthesized
gtttccttctggtagtctta

SEQ ID NO: 447043 - DNA, 20 bp, Artificial Sequence
  chemically synthesized
ttctggtagtcttatagttt

SEQ ID NO: 447044 - DNA, 20 bp, Artificial Sequence
  chemically synthesized
aacgtaagacctgaaactat

SEQ ID NO: 447045 - DNA, 20 bp, Artificial Sequence
  chemically synthesized
tctggtagtcttatagtttc

SEQ ID NO: 447046 - DNA, 20 bp, Artificial Sequence
  chemically synthesized
tggattaaaggcataaacgt

SEQ ID NO: 447047 - DNA, 20 bp, Artificial Sequence
  chemically synthesized
attaactcataatggattaa

SEQ ID NO: 447048 - DNA, 20 bp, Artificial Sequence
  chemically synthesized
aattaactcataatggatta

SEQ ID NO: 447049 - DNA, 20 bp, Artificial Sequence
  chemically synthesized
ttatgcctttaatccattat

SEQ ID NO: 447050 - DNA, 20 bp, Artificial Sequence
  chemically synthesized
gtacaaaaattaactcataa

SEQ ID NO: 447051 - DNA, 20 bp, Artificial Sequence
  chemically synthesized
tatgagttaatttttgtaca

SEQ ID NO: 447052 - DNA, 20 bp, Artificial Sequence
  chemically synthesized
ttttgtacatggtctgatat

SEQ ID NO: 447053 - DNA, 20 bp, Artificial Sequence
  chemically synthesized
tttgtacatggtctgatata

SEQ ID NO: 447054 - DNA, 20 bp, Artificial Sequence
  chemically synthesized
ttgtacatggtctgatataa

SEQ ID NO: 447055 - DNA, 20 bp, Artificial Sequence
  chemically synthesized
aaaaaattagacccttatat

SEQ ID NO: 447056 - DNA, 20 bp, Artificial Sequence
  chemically synthesized
tatccacatgcagaaaaaat

SEQ ID NO: 447057 - DNA, 20 bp, Artificial Sequence
  chemically synthesized
ggtctaattttttctgcatg

SEQ ID NO: 447058 - DNA, 20 bp, Artificial Sequence
  chemically synthesized
aaaaaatagatatccacatg

SEQ ID NO: 447059 - DNA, 20 bp, Artificial Sequence
  chemically synthesized
atgtggatatctattttttc

SEQ ID NO: 447060 - DNA, 20 bp, Artificial Sequence
  chemically synthesized
ataaatggtgctggaaaaaa

SEQ ID NO: 447061 - DNA, 20 bp, Artificial Sequence
  chemically synthesized
atcttctcaataaatggtgc

SEQ ID NO: 447062 - DNA, 20 bp, Artificial Sequence
  chemically synthesized
tttttccagcaccatttatt

SEQ ID NO: 447063 - DNA, 20 bp, Artificial Sequence
  chemically synthesized
agaacaatcttctcaataaa

SEQ ID NO: 447064 - DNA, 20 bp, Artificial Sequence
  chemically synthesized
ttccagcaccatttattgag

SEQ ID NO: 447065 - DNA, 20 bp, Artificial Sequence
  chemically synthesized
gaagattgttcttttcgcat

SEQ ID NO: 447066 - DNA, 20 bp, Artificial Sequence
  chemically synthesized
ccaggtatatccaatgcgaa

SEQ ID NO: 447067 - DNA, 20 bp, Artificial Sequence
  chemically synthesized
cttttcgcattggatatacc

SEQ ID NO: 447068 - DNA, 20 bp, Artificial Sequence
  chemically synthesized
tgattttcaacaatggtacc

SEQ ID NO: 447069 - DNA, 20 bp, Artificial Sequence
  chemically synthesized
ctgattttcaacaatggtac

SEQ ID NO: 447070 - DNA, 20 bp, Artificial Sequence
  chemically synthesized
agccagctgattttcaacaa

SEQ ID NO: 447071 - DNA, 20 bp, Artificial Sequence
  chemically synthesized
ctggtaccattgttgaaaat

SEQ ID NO: 447072 - DNA, 20 bp, Artificial Sequence
  chemically synthesized
taccattgttgaaaatcagc

SEQ ID NO: 447073 - DNA, 20 bp, Artificial Sequence
  chemically synthesized
taaatccacagaattatagc

SEQ ID NO: 447074 - DNA, 20 bp, Artificial Sequence
  chemically synthesized
gaaataaatccacagaatta

SEQ ID NO: 447075 - DNA, 20 bp, Artificial Sequence
  chemically synthesized
atcagctggctataattctg

SEQ ID NO: 447076 - DNA, 20 bp, Artificial Sequence
  chemically synthesized
agaggccagaaataaatcca

SEQ ID NO: 447077 - DNA, 20 bp, Artificial Sequence
  chemically synthesized
taattctgtggatttatttc

SEQ ID NO: 447078 - DNA, 20 bp, Artificial Sequence
  chemically synthesized
caatggaataaaacagaggc

SEQ ID NO: 447079 - DNA, 20 bp, Artificial Sequence
  chemically synthesized
agaccaatggaataaaacag

SEQ ID NO: 447080 - DNA, 20 bp, Artificial Sequence
  chemically synthesized
tagaccaatggaataaaaca

SEQ ID NO: 447081 - DNA, 20 bp, Artificial Sequence
  chemically synthesized
catagaccaatggaataaaa

SEQ ID NO: 447082 - DNA, 20 bp, Artificial Sequence
  chemically synthesized
tggcctctgttttattccat

SEQ ID NO: 447083 - DNA, 20 bp, Artificial Sequence
  chemically synthesized
aaaacagacacatagaccaa

SEQ ID NO: 447084 - DNA, 20 bp, Artificial Sequence
  chemically synthesized
ctggcataaaaacagacaca

SEQ ID NO: 447085 - DNA, 20 bp, Artificial Sequence
  chemically synthesized
agatggtgctggcataaaaa

SEQ ID NO: 447086 - DNA, 20 bp, Artificial Sequence
  chemically synthesized
ctatgtgtctgtttttatgc

SEQ ID NO: 447087 - DNA, 20 bp, Artificial Sequence
  chemically synthesized
gtaaccaaaacagatggtgc

SEQ ID NO: 447088 - DNA, 20 bp, Artificial Sequence
  chemically synthesized
tatgccagcaccatctgttt

SEQ ID NO: 447089 - DNA, 20 bp, Artificial Sequence
  chemically synthesized
gctatggtaaccaaaacaga

SEQ ID NO: 447090 - DNA, 20 bp, Artificial Sequence
  chemically synthesized
caaagctatggtaaccaaaa

SEQ ID NO: 447091 - DNA, 20 bp, Artificial Sequence
  chemically synthesized
accatctgttttggttacca

SEQ ID NO: 447092 - DNA, 20 bp, Artificial Sequence
  chemically synthesized
caaaatatactacaaagcta

SEQ ID NO: 447093 - DNA, 20 bp, Artificial Sequence
  chemically synthesized
ttttggttaccatagctttg

SEQ ID NO: 447094 - DNA, 20 bp, Artificial Sequence
  chemically synthesized
tgacaccaaaatatactaca

SEQ ID NO: 447095 - DNA, 20 bp, Artificial Sequence
  chemically synthesized
catagctttgtagtatattt

SEQ ID NO: 447096 - DNA, 20 bp, Artificial Sequence
  chemically synthesized
ttgtagtatattttggtgtc

SEQ ID NO: 447097 - DNA, 20 bp, Artificial Sequence
  chemically synthesized
tagtatattttggtgtcaag

SEQ ID NO: 447098 - DNA, 20 bp, Artificial Sequence
  chemically synthesized
gtcaagtagtgtgatgacac

SEQ ID NO: 447099 - DNA, 20 bp, Artificial Sequence
  chemically synthesized
ttgagcaaaaagaacaaaac

SEQ ID NO: 447100 - DNA, 20 bp, Artificial Sequence
  chemically synthesized
ccaaaataatgttgagcaaa

SEQ ID NO: 447101 - DNA, 20 bp, Artificial Sequence
  chemically synthesized
tgaagacccaaaataatgtt

SEQ ID NO: 447102 - DNA, 20 bp, Artificial Sequence
  chemically synthesized
ctttttgctcaacattattt

SEQ ID NO: 447103 - DNA, 20 bp, Artificial Sequence
  chemically synthesized
tttttgctcaacattatttt

SEQ ID NO: 447104 - DNA, 20 bp, Artificial Sequence
  chemically synthesized
caacattattttgggtcttc

SEQ ID NO: 447105 - DNA, 20 bp, Artificial Sequence
  chemically synthesized
tggaaccacaaaagagcttg

SEQ ID NO: 447106 - DNA, 20 bp, Artificial Sequence
  chemically synthesized
tgggtcttcaagctcttttg

SEQ ID NO: 447107 - DNA, 20 bp, Artificial Sequence
  chemically synthesized
cagaaattggaaccacaaaa

SEQ ID NO: 447108 - DNA, 20 bp, Artificial Sequence
  chemically synthesized
tacagaaattggaaccacaa

SEQ ID NO: 447109 - DNA, 20 bp, Artificial Sequence
  chemically synthesized
gtgacattttttacagaaat

SEQ ID NO: 447110 - DNA, 20 bp, Artificial Sequence
  chemically synthesized
aacaccagtgacatttttta

SEQ ID NO: 447111 - DNA, 20 bp, Artificial Sequence
  chemically synthesized
atttctgtaaaaaatgtcac

SEQ ID NO: 447112 - DNA, 20 bp, Artificial Sequence
  chemically synthesized
tgcaatctttatcaaaacac

SEQ ID NO: 447113 - DNA, 20 bp, Artificial Sequence
  chemically synthesized
atgtcactggtgttttgata

SEQ ID NO: 447114 - DNA, 20 bp, Artificial Sequence
  chemically synthesized
gataaagattgcattgactg

SEQ ID NO: 447115 - DNA, 20 bp, Artificial Sequence
  chemically synthesized
aagattgcattgactgtaga

SEQ ID NO: 447116 - DNA, 20 bp, Artificial Sequence
  chemically synthesized
acactacccaaagctttcta

SEQ ID NO: 447117 - DNA, 20 bp, Artificial Sequence
  chemically synthesized
gcattgactgtagaaagctt

SEQ ID NO: 447118 - DNA, 20 bp, Artificial Sequence
  chemically synthesized
cattgactgtagaaagcttt

SEQ ID NO: 447119 - DNA, 20 bp, Artificial Sequence
  chemically synthesized
tgactgtagaaagctttggg

SEQ ID NO: 447120 - DNA, 20 bp, Artificial Sequence
  chemically synthesized
taaaattcctacactaccca

SEQ ID NO: 447121 - DNA, 20 bp, Artificial Sequence
  chemically synthesized
gtagaaagctttgggtagtg

SEQ ID NO: 447122 - DNA, 20 bp, Artificial Sequence
  chemically synthesized
tagaaagctttgggtagtgt

SEQ ID NO: 447123 - DNA, 20 bp, Artificial Sequence
  chemically synthesized
attctgtgttcatgtattgg

SEQ ID NO: 447124 - DNA, 20 bp, Artificial Sequence
  chemically synthesized
ggtattctgtgttcatgtat

SEQ ID NO: 447125 - DNA, 20 bp, Artificial Sequence
  chemically synthesized
attcttccaatacatgaaca

SEQ ID NO: 447126 - DNA, 20 bp, Artificial Sequence
  chemically synthesized
gaagccacaaataaatggaa

SEQ ID NO: 447127 - DNA, 20 bp, Artificial Sequence
  chemically synthesized
agaagccacaaataaatgga

SEQ ID NO: 447128 - DNA, 20 bp, Artificial Sequence
  chemically synthesized
ttgaagaagccacaaataaa

SEQ ID NO: 447129 - DNA, 20 bp, Artificial Sequence
  chemically synthesized
aatacctttccatttatttg

SEQ ID NO: 447130 - DNA, 20 bp, Artificial Sequence
  chemically synthesized
attgatgaaagcaattgaag

SEQ ID NO: 447131 - DNA, 20 bp, Artificial Sequence
  chemically synthesized
gacattgatgaaagcaattg

SEQ ID NO: 447132 - DNA, 20 bp, Artificial Sequence
  chemically synthesized
aaactgtaagacattgatga

SEQ ID NO: 447133 - DNA, 20 bp, Artificial Sequence
  chemically synthesized
ttgctttcatcaatgtctta

SEQ ID NO: 447134 - DNA, 20 bp, Artificial Sequence
  chemically synthesized
gtgaaagacctggaaactgt

SEQ ID NO: 447135 - DNA, 20 bp, Artificial Sequence
  chemically synthesized
catcaatgtcttacagtttc

SEQ ID NO: 447136 - DNA, 20 bp, Artificial Sequence
  chemically synthesized
atcaatgtcttacagtttcc

SEQ ID NO: 447137 - DNA, 20 bp, Artificial Sequence
  chemically synthesized
aaccaaagaagtgaaagacc

SEQ ID NO: 447138 - DNA, 20 bp, Artificial Sequence
  chemically synthesized
aaatttaaccaaagaagtga

SEQ ID NO: 447139 - DNA, 20 bp, Artificial Sequence
  chemically synthesized
ttccaggtctttcacttctt

SEQ ID NO: 447140 - DNA, 20 bp, Artificial Sequence
  chemically synthesized
aggaataaatttaaccaaag

SEQ ID NO: 447141 - DNA, 20 bp, Artificial Sequence
  chemically synthesized
aaaaggaataaatttaacca

SEQ ID NO: 447142 - DNA, 20 bp, Artificial Sequence
  chemically synthesized
taaatttattcctttttttg

SEQ ID NO: 447143 - DNA, 20 bp, Artificial Sequence
  chemically synthesized
ccacccgcccccacaaaaaa

SEQ ID NO: 447144 - DNA, 20 bp, Artificial Sequence
  chemically synthesized
aaatttattcctttttttgt

SEQ ID NO: 447145 - DNA, 20 bp, Artificial Sequence
  chemically synthesized
tccacccgcccccacaaaaa

SEQ ID NO: 447146 - DNA, 20 bp, Artificial Sequence
  chemically synthesized
aatttattcctttttttgtg

SEQ ID NO: 447147 - DNA, 20 bp, Artificial Sequence
  chemically synthesized
atttattcctttttttgtgg

SEQ ID NO: 447148 - DNA, 20 bp, Artificial Sequence
  chemically synthesized
tattcctttttttgtggggg

SEQ ID NO: 447149 - DNA, 20 bp, Artificial Sequence
  chemically synthesized
attcctttttttgtgggggc

SEQ ID NO: 447150 - DNA, 20 bp, Artificial Sequence
  chemically synthesized
cctttttttgtgggggcggg

SEQ ID NO: 447151 - DNA, 20 bp, Artificial Sequence
  chemically synthesized
tttttgtgggggcgggtgga

SEQ ID NO: 447152 - DNA, 20 bp, Artificial Sequence
  chemically synthesized
tttgtgggggcgggtggaca

SEQ ID NO: 447153 - DNA, 20 bp, Artificial Sequence
  chemically synthesized
ttgtgggggcgggtggacag

SEQ ID NO: 447154 - DNA, 20 bp, Artificial Sequence
  chemically synthesized
gggggcgggtggacagagga

SEQ ID NO: 447155 - DNA, 20 bp, Artificial Sequence
  chemically synthesized
gggcgggtggacagaggaca

SEQ ID NO: 447156 - DNA, 20 bp, Artificial Sequence
  chemically synthesized
tccagactgggcgacagagc

SEQ ID NO: 447157 - DNA, 20 bp, Artificial Sequence
  chemically synthesized
cagagtcttgctctgtcgcc

SEQ ID NO: 447158 - DNA, 20 bp, Artificial Sequence
  chemically synthesized
gcactccagactgggcgaca

SEQ ID NO: 447159 - DNA, 20 bp, Artificial Sequence
  chemically synthesized
ctgcactccagactgggcga

SEQ ID NO: 447160 - DNA, 20 bp, Artificial Sequence
  chemically synthesized
tcttgctctgtcgcccagtc

SEQ ID NO: 447161 - DNA, 20 bp, Artificial Sequence
  chemically synthesized
ttgctctgtcgcccagtctg

SEQ ID NO: 447162 - DNA, 20 bp, Artificial Sequence
  chemically synthesized
atgacactgcactccagact

SEQ ID NO: 447163 - DNA, 20 bp, Artificial Sequence
  chemically synthesized
catgacactgcactccagac

SEQ ID NO: 447164 - DNA, 20 bp, Artificial Sequence
  chemically synthesized
ctgtcgcccagtctggagtg

SEQ ID NO: 447165 - DNA, 20 bp, Artificial Sequence
  chemically synthesized
gagatcatgacactgcactc

SEQ ID NO: 447166 - DNA, 20 bp, Artificial Sequence
  chemically synthesized
ggcagaggttgcagtgagca

SEQ ID NO: 447167 - DNA, 20 bp, Artificial Sequence
  chemically synthesized
gaggcagaggttgcagtgag

SEQ ID NO: 447168 - DNA, 20 bp, Artificial Sequence
  chemically synthesized
caggaggcagaggttgcagt

SEQ ID NO: 447169 - DNA, 20 bp, Artificial Sequence
  chemically synthesized
aatccaggaggcagaggttg

SEQ ID NO: 447170 - DNA, 20 bp, Artificial Sequence
  chemically synthesized
cgctggaatccaggaggcag

SEQ ID NO: 447171 - DNA, 20 bp, Artificial Sequence
  chemically synthesized
tcactgcaacctctgcctcc

SEQ ID NO: 447172 - DNA, 20 bp, Artificial Sequence
  chemically synthesized
tcgctggaatccaggaggca

SEQ ID NO: 447173 - DNA, 20 bp, Artificial Sequence
  chemically synthesized
aatcgctggaatccaggagg

SEQ ID NO: 447174 - DNA, 20 bp, Artificial Sequence
  chemically synthesized
gagaatcgctggaatccagg

SEQ ID NO: 447175 - DNA, 20 bp, Artificial Sequence
  chemically synthesized
tgagaatcgctggaatccag

SEQ ID NO: 447176 - DNA, 20 bp, Artificial Sequence
  chemically synthesized
aacctctgcctcctggattc

SEQ ID NO: 447177 - DNA, 20 bp, Artificial Sequence
  chemically synthesized
catgagaatcgctggaatcc

SEQ ID NO: 447178 - DNA, 20 bp, Artificial Sequence
  chemically synthesized
gcatgagaatcgctggaatc

SEQ ID NO: 447179 - DNA, 20 bp, Artificial Sequence
  chemically synthesized
ggccgaggcatgagaatcgc

SEQ ID NO: 447180 - DNA, 20 bp, Artificial Sequence
  chemically synthesized
ttccagcgattctcatgcct

SEQ ID NO: 447181 - DNA, 20 bp, Artificial Sequence
  chemically synthesized
tacctgggtggccgaggcat

SEQ ID NO: 447182 - DNA, 20 bp, Artificial Sequence
  chemically synthesized
cccagctacctgggtggccg

SEQ ID NO: 447183 - DNA, 20 bp, Artificial Sequence
  chemically synthesized
attctcatgcctcggccacc

SEQ ID NO: 447184 - DNA, 20 bp, Artificial Sequence
  chemically synthesized
tcccagctacctgggtggcc

SEQ ID NO: 447185 - DNA, 20 bp, Artificial Sequence
  chemically synthesized
ttctcatgcctcggccaccc

SEQ ID NO: 447186 - DNA, 20 bp, Artificial Sequence
  chemically synthesized
tcatgcctcggccacccagg

SEQ ID NO: 447187 - DNA, 20 bp, Artificial Sequence
  chemically synthesized
tgtaatcccagctacctggg

SEQ ID NO: 447188 - DNA, 20 bp, Artificial Sequence
  chemically synthesized
gcctcggccacccaggtagc

SEQ ID NO: 447189 - DNA, 20 bp, Artificial Sequence
  chemically synthesized
acctgtaatcccagctacct

SEQ ID NO: 447190 - DNA, 20 bp, Artificial Sequence
  chemically synthesized
cctcggccacccaggtagct

SEQ ID NO: 447191 - DNA, 20 bp, Artificial Sequence
  chemically synthesized
cacctgtaatcccagctacc

SEQ ID NO: 447192 - DNA, 20 bp, Artificial Sequence
  chemically synthesized
cacccaggtagctgggatta

SEQ ID NO: 447193 - DNA, 20 bp, Artificial Sequence
  chemically synthesized
acccaggtagctgggattac

SEQ ID NO: 447194 - DNA, 20 bp, Artificial Sequence
  chemically synthesized
gaggcacacacctgtaatcc

SEQ ID NO: 447195 - DNA, 20 bp, Artificial Sequence
  chemically synthesized
acaggtgtgtgcctccacat

SEQ ID NO: 447196 - DNA, 20 bp, Artificial Sequence
  chemically synthesized
caggtgtgtgcctccacatt

SEQ ID NO: 447197 - DNA, 20 bp, Artificial Sequence
  chemically synthesized
caaaaattagcctaatgtgg

SEQ ID NO: 447198 - DNA, 20 bp, Artificial Sequence
  chemically synthesized
acaaaaattagcctaatgtg

SEQ ID NO: 447199 - DNA, 20 bp, Artificial Sequence
  chemically synthesized
atacaaaaattagcctaatg

SEQ ID NO: 447200 - DNA, 20 bp, Artificial Sequence
  chemically synthesized
tctactaaaaatacaaaaat

SEQ ID NO: 447201 - DNA, 20 bp, Artificial Sequence
  chemically synthesized
taggctaatttttgtatttt

SEQ ID NO: 447202 - DNA, 20 bp, Artificial Sequence
  chemically synthesized
gctaatttttgtatttttag

SEQ ID NO: 447203 - DNA, 20 bp, Artificial Sequence
  chemically synthesized
taatttttgtatttttagta

SEQ ID NO: 447204 - DNA, 20 bp, Artificial Sequence
  chemically synthesized
ttttgtatttttagtagaga

SEQ ID NO: 447205 - DNA, 20 bp, Artificial Sequence
  chemically synthesized
tttgtatttttagtagagac

SEQ ID NO: 447206 - DNA, 20 bp, Artificial Sequence
  chemically synthesized
ttgtatttttagtagagaca

SEQ ID NO: 447207 - DNA, 20 bp, Artificial Sequence
  chemically synthesized
ccagactgaccaacgtggtg

SEQ ID NO: 447208 - DNA, 20 bp, Artificial Sequence
  chemically synthesized
gagacagggcttcaccacgt

SEQ ID NO: 447209 - DNA, 20 bp, Artificial Sequence
  chemically synthesized
cagggcttcaccacgttggt

SEQ ID NO: 447210 - DNA, 20 bp, Artificial Sequence
  chemically synthesized
tgaaaccagactgaccaacg

SEQ ID NO: 447211 - DNA, 20 bp, Artificial Sequence
  chemically synthesized
cttcaccacgttggtcagtc

SEQ ID NO: 447212 - DNA, 20 bp, Artificial Sequence
  chemically synthesized
tgaggtcaggagtttgaaac

SEQ ID NO: 447213 - DNA, 20 bp, Artificial Sequence
  chemically synthesized
tggtttcaaactcctgacct

SEQ ID NO: 447214 - DNA, 20 bp, Artificial Sequence
  chemically synthesized
ggcggatcacctgaggtcag

SEQ ID NO: 447215 - DNA, 20 bp, Artificial Sequence
  chemically synthesized
ggtttcaaactcctgacctc

SEQ ID NO: 447216 - DNA, 20 bp, Artificial Sequence
  chemically synthesized
ttggcggatcacctgaggtc

SEQ ID NO: 447217 - DNA, 20 bp, Artificial Sequence
  chemically synthesized
gttggcggatcacctgaggt

SEQ ID NO: 447218 - DNA, 20 bp, Artificial Sequence
  chemically synthesized
cgaggttggcggatcacctg

SEQ ID NO: 447219 - DNA, 20 bp, Artificial Sequence
  chemically synthesized
ccgaggttggcggatcacct

SEQ ID NO: 447220 - DNA, 20 bp, Artificial Sequence
  chemically synthesized
ctcaggtgatccgccaacct

SEQ ID NO: 447221 - DNA, 20 bp, Artificial Sequence
  chemically synthesized
ctttgggaggccgaggttgg

SEQ ID NO: 447222 - DNA, 20 bp, Artificial Sequence
  chemically synthesized
tcactttgggaggccgaggt

SEQ ID NO: 447223 - DNA, 20 bp, Artificial Sequence
  chemically synthesized
cccatcactttgggaggccg

SEQ ID NO: 447224 - DNA, 20 bp, Artificial Sequence
  chemically synthesized
tcccatcactttgggaggcc

SEQ ID NO: 447225 - DNA, 20 bp, Artificial Sequence
  chemically synthesized
ccgccaacctcggcctccca

SEQ ID NO: 447226 - DNA, 20 bp, Artificial Sequence
  chemically synthesized
tgtaatcccatcactttggg

SEQ ID NO: 447227 - DNA, 20 bp, Artificial Sequence
  chemically synthesized
ctgtaatcccatcactttgg

SEQ ID NO: 447228 - DNA, 20 bp, Artificial Sequence
  chemically synthesized
acctcggcctcccaaagtga

SEQ ID NO: 447229 - DNA, 20 bp, Artificial Sequence
  chemically synthesized
gcctgtaatcccatcacttt

SEQ ID NO: 447230 - DNA, 20 bp, Artificial Sequence
  chemically synthesized
cctcggcctcccaaagtgat

SEQ ID NO: 447231 - DNA, 20 bp, Artificial Sequence
  chemically synthesized
cgcctgtaatcccatcactt

SEQ ID NO: 447232 - DNA, 20 bp, Artificial Sequence
  chemically synthesized
ctcccaaagtgatgggatta

SEQ ID NO: 447233 - DNA, 20 bp, Artificial Sequence
  chemically synthesized
tcccaaagtgatgggattac

SEQ ID NO: 447234 - DNA, 20 bp, Artificial Sequence
  chemically synthesized
agtgatgggattacaggcgt

SEQ ID NO: 447235 - DNA, 20 bp, Artificial Sequence
  chemically synthesized
caggcgtgagccaccgtgcc

SEQ ID NO: 447236 - DNA, 20 bp, Artificial Sequence
  chemically synthesized
taggaactggccgggcacgg

SEQ ID NO: 447237 - DNA, 20 bp, Artificial Sequence
  chemically synthesized
acttaggaactggccgggca

SEQ ID NO: 447238 - DNA, 20 bp, Artificial Sequence
  chemically synthesized
cgtgagccaccgtgcccggc

SEQ ID NO: 447239 - DNA, 20 bp, Artificial Sequence
  chemically synthesized
aaaatacttaggaactggcc

SEQ ID NO: 447240 - DNA, 20 bp, Artificial Sequence
  chemically synthesized
aaaaatacttaggaactggc

SEQ ID NO: 447241 - DNA, 20 bp, Artificial Sequence
  chemically synthesized
accgtgcccggccagttcct

SEQ ID NO: 447242 - DNA, 20 bp, Artificial Sequence
  chemically synthesized
tacaaaaaatacttaggaac

SEQ ID NO: 447243 - DNA, 20 bp, Artificial Sequence
  chemically synthesized
aatagctacaaaaaatactt

SEQ ID NO: 447244 - DNA, 20 bp, Artificial Sequence
  chemically synthesized
caatagctacaaaaaatact

SEQ ID NO: 447245 - DNA, 20 bp, Artificial Sequence
  chemically synthesized
cagttcctaagtattttttg

SEQ ID NO: 447246 - DNA, 20 bp, Artificial Sequence
  chemically synthesized
ttttttgtagctattgtaaa

SEQ ID NO: 447247 - DNA, 20 bp, Artificial Sequence
  chemically synthesized
ttaaaaaatcccatttacaa

SEQ ID NO: 447248 - DNA, 20 bp, Artificial Sequence
  chemically synthesized
tttttgtagctattgtaaat

SEQ ID NO: 447249 - DNA, 20 bp, Artificial Sequence
  chemically synthesized
atttattttttattttccct

SEQ ID NO: 447250 - DNA, 20 bp, Artificial Sequence
  chemically synthesized
acctgtaccccaataactta

SEQ ID NO: 447251 - DNA, 20 bp, Artificial Sequence
  chemically synthesized
ttttattttccctaagttat

SEQ ID NO: 447252 - DNA, 20 bp, Artificial Sequence
  chemically synthesized
cacctgtaccccaataactt

SEQ ID NO: 447253 - DNA, 20 bp, Artificial Sequence
  chemically synthesized
tttattttccctaagttatt

SEQ ID NO: 447254 - DNA, 20 bp, Artificial Sequence
  chemically synthesized
ccacctgtaccccaataact

SEQ ID NO: 447255 - DNA, 20 bp, Artificial Sequence
  chemically synthesized
ttattttccctaagttattg

SEQ ID NO: 447256 - DNA, 20 bp, Artificial Sequence
  chemically synthesized
ttccctaagttattggggta

SEQ ID NO: 447257 - DNA, 20 bp, Artificial Sequence
  chemically synthesized
tccctaagttattggggtac

SEQ ID NO: 447258 - DNA, 20 bp, Artificial Sequence
  chemically synthesized
ctaagttattggggtacagg

SEQ ID NO: 447259 - DNA, 20 bp, Artificial Sequence
  chemically synthesized
tggtatttgattgcatgact

SEQ ID NO: 447260 - DNA, 20 bp, Artificial Sequence
  chemically synthesized
gattgcatgactaagttctt

SEQ ID NO: 447261 - DNA, 20 bp, Artificial Sequence
  chemically synthesized
caaatcaccactaaagaact

SEQ ID NO: 447262 - DNA, 20 bp, Artificial Sequence
  chemically synthesized
tgcatgactaagttctttag

SEQ ID NO: 447263 - DNA, 20 bp, Artificial Sequence
  chemically synthesized
aatctcacaaatcaccacta

SEQ ID NO: 447264 - DNA, 20 bp, Artificial Sequence
  chemically synthesized
gttctttagtggtgatttgt

SEQ ID NO: 447265 - DNA, 20 bp, Artificial Sequence
  chemically synthesized
agtggtgatttgtgagattt

SEQ ID NO: 447266 - DNA, 20 bp, Artificial Sequence
  chemically synthesized
ttttggtgcacccatcaccc

SEQ ID NO: 447267 - DNA, 20 bp, Artificial Sequence
  chemically synthesized
gtgtatactgcttgggtgat

SEQ ID NO: 447268 - DNA, 20 bp, Artificial Sequence
  chemically synthesized
tgtgtatactgcttgggtga

SEQ ID NO: 447269 - DNA, 20 bp, Artificial Sequence
  chemically synthesized
tggtgcacccatcacccaag

SEQ ID NO: 447270 - DNA, 20 bp, Artificial Sequence
  chemically synthesized
cggtgctgtgtatactgctt

SEQ ID NO: 447271 - DNA, 20 bp, Artificial Sequence
  chemically synthesized
acggtgctgtgtatactgct

SEQ ID NO: 447272 - DNA, 20 bp, Artificial Sequence
  chemically synthesized
catcacccaagcagtataca

SEQ ID NO: 447273 - DNA, 20 bp, Artificial Sequence
  chemically synthesized
tatacacagcaccgtatttg

SEQ ID NO: 447274 - DNA, 20 bp, Artificial Sequence
  chemically synthesized
gggataaaagactacaaata

SEQ ID NO: 447275 - DNA, 20 bp, Artificial Sequence
  chemically synthesized
ttgggggaggcaagggataa

SEQ ID NO: 447276 - DNA, 20 bp, Artificial Sequence
  chemically synthesized
agaagagttgggggaggcaa

SEQ ID NO: 447277 - DNA, 20 bp, Artificial Sequence
  chemically synthesized
gagaagagttgggggaggca

SEQ ID NO: 447278 - DNA, 20 bp, Artificial Sequence
  chemically synthesized
ggagaagagttgggggaggc

SEQ ID NO: 447279 - DNA, 20 bp, Artificial Sequence
  chemically synthesized
ttggggagaagagttggggg

SEQ ID NO: 447280 - DNA, 20 bp, Artificial Sequence
  chemically synthesized
cttggggagaagagttgggg

SEQ ID NO: 447281 - DNA, 20 bp, Artificial Sequence
  chemically synthesized
gacttggggagaagagttgg

SEQ ID NO: 447282 - DNA, 20 bp, Artificial Sequence
  chemically synthesized
ggacttggggagaagagttg

SEQ ID NO: 447283 - DNA, 20 bp, Artificial Sequence
  chemically synthesized
gggacttggggagaagagtt

SEQ ID NO: 447284 - DNA, 20 bp, Artificial Sequence
  chemically synthesized
ggggacttggggagaagagt

SEQ ID NO: 447285 - DNA, 20 bp, Artificial Sequence
  chemically synthesized
ctttggggacttggggagaa

SEQ ID NO: 447286 - DNA, 20 bp, Artificial Sequence
  chemically synthesized
ctcccccaactcttctcccc

SEQ ID NO: 447287 - DNA, 20 bp, Artificial Sequence
  chemically synthesized
gactttggggacttggggag

SEQ ID NO: 447288 - DNA, 20 bp, Artificial Sequence
  chemically synthesized
atggactttggggacttggg

SEQ ID NO: 447289 - DNA, 20 bp, Artificial Sequence
  chemically synthesized
caatggactttggggacttg

SEQ ID NO: 447290 - DNA, 20 bp, Artificial Sequence
  chemically synthesized
acaatggactttggggactt

SEQ ID NO: 447291 - DNA, 20 bp, Artificial Sequence
  chemically synthesized
tacaatggactttggggact

SEQ ID NO: 447292 - DNA, 20 bp, Artificial Sequence
  chemically synthesized
ctcttctccccaagtcccca

SEQ ID NO: 447293 - DNA, 20 bp, Artificial Sequence
  chemically synthesized
gaataatacaatggactttg

SEQ ID NO: 447294 - DNA, 20 bp, Artificial Sequence
  chemically synthesized
agaataatacaatggacttt

SEQ ID NO: 447295 - DNA, 20 bp, Artificial Sequence
  chemically synthesized
aagaataatacaatggactt

SEQ ID NO: 447296 - DNA, 20 bp, Artificial Sequence
  chemically synthesized
aaggcataagaataatacaa

SEQ ID NO: 447297 - DNA, 20 bp, Artificial Sequence
  chemically synthesized
ctataagaacacaaaggcat

SEQ ID NO: 447298 - DNA, 20 bp, Artificial Sequence
  chemically synthesized
gataagctataagaacacaa

SEQ ID NO: 447299 - DNA, 20 bp, Artificial Sequence
  chemically synthesized
agataagctataagaacaca

SEQ ID NO: 447300 - DNA, 20 bp, Artificial Sequence
  chemically synthesized
cttatgcctttgtgttctta

SEQ ID NO: 447301 - DNA, 20 bp, Artificial Sequence
  chemically synthesized
atatgtaggagataagctat

SEQ ID NO: 447302 - DNA, 20 bp, Artificial Sequence
  chemically synthesized
ctcactgatatgtaggagat

SEQ ID NO: 447303 - DNA, 20 bp, Artificial Sequence
  chemically synthesized
gtgttctcactgatatgtag

SEQ ID NO: 447304 - DNA, 20 bp, Artificial Sequence
  chemically synthesized
atagcttatctcctacatat

SEQ ID NO: 447305 - DNA, 20 bp, Artificial Sequence
  chemically synthesized
gtgtgttctcactgatatgt

SEQ ID NO: 447306 - DNA, 20 bp, Artificial Sequence
  chemically synthesized
cgtgtgttctcactgatatg

SEQ ID NO: 447307 - DNA, 20 bp, Artificial Sequence
  chemically synthesized
cttatctcctacatatcagt

SEQ ID NO: 447308 - DNA, 20 bp, Artificial Sequence
  chemically synthesized
cagtgagaacacacgatgtt

SEQ ID NO: 447309 - DNA, 20 bp, Artificial Sequence
  chemically synthesized
atgtttggttttccattcct

SEQ ID NO: 447310 - DNA, 20 bp, Artificial Sequence
  chemically synthesized
taagtgaagtaactcaggaa

SEQ ID NO: 447311 - DNA, 20 bp, Artificial Sequence
  chemically synthesized
tattctaagtgaagtaactc

SEQ ID NO: 447312 - DNA, 20 bp, Artificial Sequence
  chemically synthesized
ttattctaagtgaagtaact

SEQ ID NO: 447313 - DNA, 20 bp, Artificial Sequence
  chemically synthesized
cattcctgagttacttcact

SEQ ID NO: 447314 - DNA, 20 bp, Artificial Sequence
  chemically synthesized
ggagactattattctaagtg

SEQ ID NO: 447315 - DNA, 20 bp, Artificial Sequence
  chemically synthesized
agttacttcacttagaataa

SEQ ID NO: 447316 - DNA, 20 bp, Artificial Sequence
  chemically synthesized
agattggagactattattct

SEQ ID NO: 447317 - DNA, 20 bp, Artificial Sequence
  chemically synthesized
cagtgacctggatgagattg

SEQ ID NO: 447318 - DNA, 20 bp, Artificial Sequence
  chemically synthesized
tgcagtgacctggatgagat

SEQ ID NO: 447319 - DNA, 20 bp, Artificial Sequence
  chemically synthesized
taatagtctccaatctcatc

SEQ ID NO: 447320 - DNA, 20 bp, Artificial Sequence
  chemically synthesized
aatagtctccaatctcatcc

SEQ ID NO: 447321 - DNA, 20 bp, Artificial Sequence
  chemically synthesized
gcatttgcagtgacctggat

SEQ ID NO: 447322 - DNA, 20 bp, Artificial Sequence
  chemically synthesized
taacagcatttgcagtgacc

SEQ ID NO: 447323 - DNA, 20 bp, Artificial Sequence
  chemically synthesized
gaagaaattaacagcatttg

SEQ ID NO: 447324 - DNA, 20 bp, Artificial Sequence
  chemically synthesized
cacaaaaaggaagaaattaa

SEQ ID NO: 447325 - DNA, 20 bp, Artificial Sequence
  chemically synthesized
taactgtggccacaaaaagg

SEQ ID NO: 447326 - DNA, 20 bp, Artificial Sequence
  chemically synthesized
tgttaatttcttcctttttg

SEQ ID NO: 447327 - DNA, 20 bp, Artificial Sequence
  chemically synthesized
gtataactgtggccacaaaa

SEQ ID NO: 447328 - DNA, 20 bp, Artificial Sequence
  chemically synthesized
ggtataactgtggccacaaa

SEQ ID NO: 447329 - DNA, 20 bp, Artificial Sequence
  chemically synthesized
tttcttcctttttgtggcca

SEQ ID NO: 447330 - DNA, 20 bp, Artificial Sequence
  chemically synthesized
gagaaactgtggtataactg

SEQ ID NO: 447331 - DNA, 20 bp, Artificial Sequence
  chemically synthesized
ttgtggccacagttatacca

SEQ ID NO: 447332 - DNA, 20 bp, Artificial Sequence
  chemically synthesized
gagtggataaagagaaactg

SEQ ID NO: 447333 - DNA, 20 bp, Artificial Sequence
  chemically synthesized
tcaatcaacgagtggataaa

SEQ ID NO: 447334 - DNA, 20 bp, Artificial Sequence
  chemically synthesized
catcaatcaacgagtggata

SEQ ID NO: 447335 - DNA, 20 bp, Artificial Sequence
  chemically synthesized
aaggcccatcaatcaacgag

SEQ ID NO: 447336 - DNA, 20 bp, Artificial Sequence
  chemically synthesized
ccaaaggcccatcaatcaac

SEQ ID NO: 447337 - DNA, 20 bp, Artificial Sequence
  chemically synthesized
tttatccactcgttgattga

SEQ ID NO: 447338 - DNA, 20 bp, Artificial Sequence
  chemically synthesized
ttatccactcgttgattgat

SEQ ID NO: 447339 - DNA, 20 bp, Artificial Sequence
  chemically synthesized
ctcgttgattgatgggcctt

SEQ ID NO: 447340 - DNA, 20 bp, Artificial Sequence
  chemically synthesized
tcgttgattgatgggccttt

SEQ ID NO: 447341 - DNA, 20 bp, Artificial Sequence
  chemically synthesized
tgattgatgggcctttgggt

SEQ ID NO: 447342 - DNA, 20 bp, Artificial Sequence
  chemically synthesized
aaatcgtggaaccaacccaa

SEQ ID NO: 447343 - DNA, 20 bp, Artificial Sequence
  chemically synthesized
aaaatcgtggaaccaaccca

SEQ ID NO: 447344 - DNA, 20 bp, Artificial Sequence
  chemically synthesized
aaagcgcaattgcaaaatcg

SEQ ID NO: 447345 - DNA, 20 bp, Artificial Sequence
  chemically synthesized
cacaagtttacagcaacaca

SEQ ID NO: 447346 - DNA, 20 bp, Artificial Sequence
  chemically synthesized
tacttgcacacacaagttta

SEQ ID NO: 447347 - DNA, 20 bp, Artificial Sequence
  chemically synthesized
taaaagatacttgcacacac

SEQ ID NO: 447348 - DNA, 20 bp, Artificial Sequence
  chemically synthesized
tgctgtaaacttgtgtgtgc

SEQ ID NO: 447349 - DNA, 20 bp, Artificial Sequence
  chemically synthesized
aaataagttattatatgtaa

SEQ ID NO: 447350 - DNA, 20 bp, Artificial Sequence
  chemically synthesized
atatctacccagacaaaaat

SEQ ID NO: 447351 - DNA, 20 bp, Artificial Sequence
  chemically synthesized
tataataacttatttttgtc

SEQ ID NO: 447352 - DNA, 20 bp, Artificial Sequence
  chemically synthesized
ataataacttatttttgtct

SEQ ID NO: 447353 - DNA, 20 bp, Artificial Sequence
  chemically synthesized
ataacttatttttgtctggg

SEQ ID NO: 447354 - DNA, 20 bp, Artificial Sequence
  chemically synthesized
cccactaccagatatctacc

SEQ ID NO: 447355 - DNA, 20 bp, Artificial Sequence
  chemically synthesized
tttttgtctgggtagatatc

SEQ ID NO: 447356 - DNA, 20 bp, Artificial Sequence
  chemically synthesized
ttgtctgggtagatatctgg

SEQ ID NO: 447357 - DNA, 20 bp, Artificial Sequence
  chemically synthesized
tctgggtagatatctggtag

SEQ ID NO: 447358 - DNA, 20 bp, Artificial Sequence
  chemically synthesized
ctgggtagatatctggtagt

SEQ ID NO: 447359 - DNA, 20 bp, Artificial Sequence
  chemically synthesized
tgattcagcaatcccactac

SEQ ID NO: 447360 - DNA, 20 bp, Artificial Sequence
  chemically synthesized
agtgggattgctgaatcaaa

SEQ ID NO: 447361 - DNA, 20 bp, Artificial Sequence
  chemically synthesized
agtagaactaccatttgatt

SEQ ID NO: 447362 - DNA, 20 bp, Artificial Sequence
  chemically synthesized
gggattgctgaatcaaatgg

SEQ ID NO: 447363 - DNA, 20 bp, Artificial Sequence
  chemically synthesized
tcaaatggtagttctacttt

SEQ ID NO: 447364 - DNA, 20 bp, Artificial Sequence
  chemically synthesized
attccttaaataactaaaag

SEQ ID NO: 447365 - DNA, 20 bp, Artificial Sequence
  chemically synthesized
gagattccttaaataactaa

SEQ ID NO: 447366 - DNA, 20 bp, Artificial Sequence
  chemically synthesized
agttctacttttagttattt

SEQ ID NO: 447367 - DNA, 20 bp, Artificial Sequence
  chemically synthesized
gttctacttttagttattta

SEQ ID NO: 447368 - DNA, 20 bp, Artificial Sequence
  chemically synthesized
ccgctatggaaaacagtgtg

SEQ ID NO: 447369 - DNA, 20 bp, Artificial Sequence
  chemically synthesized
aaccgctatggaaaacagtg

SEQ ID NO: 447370 - DNA, 20 bp, Artificial Sequence
  chemically synthesized
aatctccacactgttttcca

SEQ ID NO: 447371 - DNA, 20 bp, Artificial Sequence
  chemically synthesized
tatacaaccgctatggaaaa

SEQ ID NO: 447372 - DNA, 20 bp, Artificial Sequence
  chemically synthesized
ctccacactgttttccatag

SEQ ID NO: 447373 - DNA, 20 bp, Artificial Sequence
  chemically synthesized
agactagtatacaaccgcta

SEQ ID NO: 447374 - DNA, 20 bp, Artificial Sequence
  chemically synthesized
tttccatagcggttgtatac

SEQ ID NO: 447375 - DNA, 20 bp, Artificial Sequence
  chemically synthesized
ctgctggtggggatgtagac

SEQ ID NO: 447376 - DNA, 20 bp, Artificial Sequence
  chemically synthesized
ctacactgctggtggggatg

SEQ ID NO: 447377 - DNA, 20 bp, Artificial Sequence
  chemically synthesized
atactagtctacatccccac

SEQ ID NO: 447378 - DNA, 20 bp, Artificial Sequence
  chemically synthesized
ctagtctacatccccaccag

SEQ ID NO: 447379 - DNA, 20 bp, Artificial Sequence
  chemically synthesized
acacttctacactgctggtg

SEQ ID NO: 447380 - DNA, 20 bp, Artificial Sequence
  chemically synthesized
aacacttctacactgctggt

SEQ ID NO: 447381 - DNA, 20 bp, Artificial Sequence
  chemically synthesized
gaacacttctacactgctgg

SEQ ID NO: 447382 - DNA, 20 bp, Artificial Sequence
  chemically synthesized
ctacatccccaccagcagtg

SEQ ID NO: 447383 - DNA, 20 bp, Artificial Sequence
  chemically synthesized
agggaacacttctacactgc

SEQ ID NO: 447384 - DNA, 20 bp, Artificial Sequence
  chemically synthesized
catccccaccagcagtgtag

SEQ ID NO: 447385 - DNA, 20 bp, Artificial Sequence
  chemically synthesized
tggcatggatgtggtgatca

SEQ ID NO: 447386 - DNA, 20 bp, Artificial Sequence
  chemically synthesized
ttggcatggatgtggtgatc

SEQ ID NO: 447387 - DNA, 20 bp, Artificial Sequence
  chemically synthesized
gttggcatggatgtggtgat

SEQ ID NO: 447388 - DNA, 20 bp, Artificial Sequence
  chemically synthesized
ggtagatgttggcatggatg

SEQ ID NO: 447389 - DNA, 20 bp, Artificial Sequence
  chemically synthesized
aaaaacggtagatgttggca

SEQ ID NO: 447390 - DNA, 20 bp, Artificial Sequence
  chemically synthesized
aatcaaaaaacggtagatgt

SEQ ID NO: 447391 - DNA, 20 bp, Artificial Sequence
  chemically synthesized
atcaaaaaatcaaaaaacgg

SEQ ID NO: 447392 - DNA, 20 bp, Artificial Sequence
  chemically synthesized
ataatcaaaaaatcaaaaaa

SEQ ID NO: 447393 - DNA, 20 bp, Artificial Sequence
  chemically synthesized
gttttttgattttttgatta

SEQ ID NO: 447394 - DNA, 20 bp, Artificial Sequence
  chemically synthesized
tttgattatggccattcttg

SEQ ID NO: 447395 - DNA, 20 bp, Artificial Sequence
  chemically synthesized
ttgattatggccattcttgc

SEQ ID NO: 447396 - DNA, 20 bp, Artificial Sequence
  chemically synthesized
ccaccttactcctgcaagaa

SEQ ID NO: 447397 - DNA, 20 bp, Artificial Sequence
  chemically synthesized
gattatggccattcttgcag

SEQ ID NO: 447398 - DNA, 20 bp, Artificial Sequence
  chemically synthesized
tgataccaccttactcctgc

SEQ ID NO: 447399 - DNA, 20 bp, Artificial Sequence
  chemically synthesized
atggccattcttgcaggagt

SEQ ID NO: 447400 - DNA, 20 bp, Artificial Sequence
  chemically synthesized
tggccattcttgcaggagta

SEQ ID NO: 447401 - DNA, 20 bp, Artificial Sequence
  chemically synthesized
ccattcttgcaggagtaagg

SEQ ID NO: 447402 - DNA, 20 bp, Artificial Sequence
  chemically synthesized
agtaaggtggtatcacatcg

SEQ ID NO: 447403 - DNA, 20 bp, Artificial Sequence
  chemically synthesized
atttgcatttccctgatcat

SEQ ID NO: 447404 - DNA, 20 bp, Artificial Sequence
  chemically synthesized
ctcaacatcactaatgatca

SEQ ID NO: 447405 - DNA, 20 bp, Artificial Sequence
  chemically synthesized
gctcaacatcactaatgatc

SEQ ID NO: 447406 - DNA, 20 bp, Artificial Sequence
  chemically synthesized
tgctcaacatcactaatgat

SEQ ID NO: 447407 - DNA, 20 bp, Artificial Sequence
  chemically synthesized
ccctgatcattagtgatgtt

SEQ ID NO: 447408 - DNA, 20 bp, Artificial Sequence
  chemically synthesized
gcattttttcatatgtttgt

SEQ ID NO: 447409 - DNA, 20 bp, Artificial Sequence
  chemically synthesized
atatgtttgttggccatctg

SEQ ID NO: 447410 - DNA, 20 bp, Artificial Sequence
  chemically synthesized
ccctaaagaagatctacaga

SEQ ID NO: 447411 - DNA, 20 bp, Artificial Sequence
  chemically synthesized
aattccctaaagaagatcta

SEQ ID NO: 447412 - DNA, 20 bp, Artificial Sequence
  chemically synthesized
ggccatctgtagatcttctt

SEQ ID NO: 447413 - DNA, 20 bp, Artificial Sequence
  chemically synthesized
gccatctgtagatcttcttt

SEQ ID NO: 447414 - DNA, 20 bp, Artificial Sequence
  chemically synthesized
ccatctgtagatcttcttta

SEQ ID NO: 447415 - DNA, 20 bp, Artificial Sequence
  chemically synthesized
gaatagacaattccctaaag

SEQ ID NO: 447416 - DNA, 20 bp, Artificial Sequence
  chemically synthesized
tatgaatagacaattcccta

SEQ ID NO: 447417 - DNA, 20 bp, Artificial Sequence
  chemically synthesized
aagtgttctaaggatatgaa

SEQ ID NO: 447418 - DNA, 20 bp, Artificial Sequence
  chemically synthesized
gaattgtctattcatatcct

SEQ ID NO: 447419 - DNA, 20 bp, Artificial Sequence
  chemically synthesized
tcccatcaaaaagtgttcta

SEQ ID NO: 447420 - DNA, 20 bp, Artificial Sequence
  chemically synthesized
atcccatcaaaaagtgttct

SEQ ID NO: 447421 - DNA, 20 bp, Artificial Sequence
  chemically synthesized
atccttagaacactttttga

SEQ ID NO: 447422 - DNA, 20 bp, Artificial Sequence
  chemically synthesized
tccttagaacactttttgat

SEQ ID NO: 447423 - DNA, 20 bp, Artificial Sequence
  chemically synthesized
aaacaaacaatcccatcaaa

SEQ ID NO: 447424 - DNA, 20 bp, Artificial Sequence
  chemically synthesized
acacaaacaaatcagtaaga

SEQ ID NO: 447425 - DNA, 20 bp, Artificial Sequence
  chemically synthesized
aacacaaacaaatcagtaag

SEQ ID NO: 447426 - DNA, 20 bp, Artificial Sequence
  chemically synthesized
atgaacacaaacaaatcagt

SEQ ID NO: 447427 - DNA, 20 bp, Artificial Sequence
  chemically synthesized
tacaatgaacacaaacaaat

SEQ ID NO: 447428 - DNA, 20 bp, Artificial Sequence
  chemically synthesized
tgatttgtttgtgttcattg

SEQ ID NO: 447429 - DNA, 20 bp, Artificial Sequence
  chemically synthesized
tttgtgttcattgtagattc

SEQ ID NO: 447430 - DNA, 20 bp, Artificial Sequence
  chemically synthesized
tcattgtagattctggatat

SEQ ID NO: 447431 - DNA, 20 bp, Artificial Sequence
  chemically synthesized
tctgacagaggactaatatc

SEQ ID NO: 447432 - DNA, 20 bp, Artificial Sequence
  chemically synthesized
tctggatattagtcctctgt

SEQ ID NO: 447433 - DNA, 20 bp, Artificial Sequence
  chemically synthesized
acaatctatacatctgacag

SEQ ID NO: 447434 - DNA, 20 bp, Artificial Sequence
  chemically synthesized
cacaatctatacatctgaca

SEQ ID NO: 447435 - DNA, 20 bp, Artificial Sequence
  chemically synthesized
ttcacaatctatacatctga

SEQ ID NO: 447436 - DNA, 20 bp, Artificial Sequence
  chemically synthesized
ttagtcctctgtcagatgta

SEQ ID NO: 447437 - DNA, 20 bp, Artificial Sequence
  chemically synthesized
tgtcagatgtatagattgtg

SEQ ID NO: 447438 - DNA, 20 bp, Artificial Sequence
  chemically synthesized
acagacaacacacagagcgg

SEQ ID NO: 447439 - DNA, 20 bp, Artificial Sequence
  chemically synthesized
caaacagacaacacacagag

SEQ ID NO: 447440 - DNA, 20 bp, Artificial Sequence
  chemically synthesized
aaacaaacagacaacacaca

SEQ ID NO: 447441 - DNA, 20 bp, Artificial Sequence
  chemically synthesized
gtaaacaaacagacaacaca

SEQ ID NO: 447442 - DNA, 20 bp, Artificial Sequence
  chemically synthesized
cagtcagcagagtaaacaaa

SEQ ID NO: 447443 - DNA, 20 bp, Artificial Sequence
  chemically synthesized
ggcaaaaggaacagtcagca

SEQ ID NO: 447444 - DNA, 20 bp, Artificial Sequence
  chemically synthesized
agggcaaaaggaacagtcag

SEQ ID NO: 447445 - DNA, 20 bp, Artificial Sequence
  chemically synthesized
tgcagggcaaaaggaacagt

SEQ ID NO: 447446 - DNA, 20 bp, Artificial Sequence
  chemically synthesized
cttttgcagggcaaaaggaa

SEQ ID NO: 447447 - DNA, 20 bp, Artificial Sequence
  chemically synthesized
aagagcttttgcagggcaaa

SEQ ID NO: 447448 - DNA, 20 bp, Artificial Sequence
  chemically synthesized
aaagagcttttgcagggcaa

SEQ ID NO: 447449 - DNA, 20 bp, Artificial Sequence
  chemically synthesized
ctgttccttttgccctgcaa

SEQ ID NO: 447450 - DNA, 20 bp, Artificial Sequence
  chemically synthesized
gaaactaaagagcttttgca

SEQ ID NO: 447451 - DNA, 20 bp, Artificial Sequence
  chemically synthesized
tgaaactaaagagcttttgc

SEQ ID NO: 447452 - DNA, 20 bp, Artificial Sequence
  chemically synthesized
atgaaactaaagagcttttg

SEQ ID NO: 447453 - DNA, 20 bp, Artificial Sequence
  chemically synthesized
tttgccctgcaaaagctctt

SEQ ID NO: 447454 - DNA, 20 bp, Artificial Sequence
  chemically synthesized
tggggcctaatgaaactaaa

SEQ ID NO: 447455 - DNA, 20 bp, Artificial Sequence
  chemically synthesized
gctggggcctaatgaaacta

SEQ ID NO: 447456 - DNA, 20 bp, Artificial Sequence
  chemically synthesized
caaaagctctttagtttcat

SEQ ID NO: 447457 - DNA, 20 bp, Artificial Sequence
  chemically synthesized
aaaagctctttagtttcatt

SEQ ID NO: 447458 - DNA, 20 bp, Artificial Sequence
  chemically synthesized
tctttagtttcattaggccc

SEQ ID NO: 447459 - DNA, 20 bp, Artificial Sequence
  chemically synthesized
aaaacaaagataaatagctg

SEQ ID NO: 447460 - DNA, 20 bp, Artificial Sequence
  chemically synthesized
aaaaacaaagataaatagct

SEQ ID NO: 447461 - DNA, 20 bp, Artificial Sequence
  chemically synthesized
taaaaacaaagataaatagc

SEQ ID NO: 447462 - DNA, 20 bp, Artificial Sequence
  chemically synthesized
gcagtaaaaacaaagataaa

SEQ ID NO: 447463 - DNA, 20 bp, Artificial Sequence
  chemically synthesized
aagcaaatgcagtaaaaaca

SEQ ID NO: 447464 - DNA, 20 bp, Artificial Sequence
  chemically synthesized
caagaacccaaaagcaaatg

SEQ ID NO: 447465 - DNA, 20 bp, Artificial Sequence
  chemically synthesized
gtttttactgcatttgcttt

SEQ ID NO: 447466 - DNA, 20 bp, Artificial Sequence
  chemically synthesized
tttttactgcatttgctttt

SEQ ID NO: 447467 - DNA, 20 bp, Artificial Sequence
  chemically synthesized
tttcatgaccaagaacccaa

SEQ ID NO: 447468 - DNA, 20 bp, Artificial Sequence
  chemically synthesized
tgcatttgcttttgggttct

SEQ ID NO: 447469 - DNA, 20 bp, Artificial Sequence
  chemically synthesized
taggcaaggatttcatgacc

SEQ ID NO: 447470 - DNA, 20 bp, Artificial Sequence
  chemically synthesized
tggtcatgaaatccttgcct

SEQ ID NO: 447471 - DNA, 20 bp, Artificial Sequence
  chemically synthesized
tctagacattggcttaggca

SEQ ID NO: 447472 - DNA, 20 bp, Artificial Sequence
  chemically synthesized
ttctagacattggcttaggc

SEQ ID NO: 447473 - DNA, 20 bp, Artificial Sequence
  chemically synthesized
acccttctagacattggctt

SEQ ID NO: 447474 - DNA, 20 bp, Artificial Sequence
  chemically synthesized
aacccttctagacattggct

SEQ ID NO: 447475 - DNA, 20 bp, Artificial Sequence
  chemically synthesized
tccttgcctaagccaatgtc

SEQ ID NO: 447476 - DNA, 20 bp, Artificial Sequence
  chemically synthesized
ggaaaaacccttctagacat

SEQ ID NO: 447477 - DNA, 20 bp, Artificial Sequence
  chemically synthesized
ttgcctaagccaatgtctag

SEQ ID NO: 447478 - DNA, 20 bp, Artificial Sequence
  chemically synthesized
tgcctaagccaatgtctaga

SEQ ID NO: 447479 - DNA, 20 bp, Artificial Sequence
  chemically synthesized
gcctaagccaatgtctagaa

SEQ ID NO: 447480 - DNA, 20 bp, Artificial Sequence
  chemically synthesized
taacattggaaaaacccttc

SEQ ID NO: 447481 - DNA, 20 bp, Artificial Sequence
  chemically synthesized
aaaattctagaagataacat

SEQ ID NO: 447482 - DNA, 20 bp, Artificial Sequence
  chemically synthesized
gtttttccaatgttatcttc

SEQ ID NO: 447483 - DNA, 20 bp, Artificial Sequence
  chemically synthesized
tgaaactataaaaattctag

SEQ ID NO: 447484 - DNA, 20 bp, Artificial Sequence
  chemically synthesized
acctgaaactataaaaattc

SEQ ID NO: 447485 - DNA, 20 bp, Artificial Sequence
  chemically synthesized
gttatcttctagaattttta

SEQ ID NO: 447486 - DNA, 20 bp, Artificial Sequence
  chemically synthesized
ttctagaatttttatagttt

SEQ ID NO: 447487 - DNA, 20 bp, Artificial Sequence
  chemically synthesized
tctagaatttttatagtttc

SEQ ID NO: 447488 - DNA, 20 bp, Artificial Sequence
  chemically synthesized
aatttttatagtttcaggtc

SEQ ID NO: 447489 - DNA, 20 bp, Artificial Sequence
  chemically synthesized
atctatctgaaaaagaaatc

SEQ ID NO: 447490 - DNA, 20 bp, Artificial Sequence
  chemically synthesized
tcaggtctggatttcttttt

SEQ ID NO: 447491 - DNA, 20 bp, Artificial Sequence
  chemically synthesized
gtctggatttctttttcaga

SEQ ID NO: 447492 - DNA, 20 bp, Artificial Sequence
  chemically synthesized
ccatagcaatctatctgaaa

SEQ ID NO: 447493 - DNA, 20 bp, Artificial Sequence
  chemically synthesized
ctttttcagatagattgcta

SEQ ID NO: 447494 - DNA, 20 bp, Artificial Sequence
  chemically synthesized
tttttcagatagattgctat

SEQ ID NO: 447495 - DNA, 20 bp, Artificial Sequence
  chemically synthesized
acatatcagtagcattccca

SEQ ID NO: 447496 - DNA, 20 bp, Artificial Sequence
  chemically synthesized
atacaaaatcaacatatcag

SEQ ID NO: 447497 - DNA, 20 bp, Artificial Sequence
  chemically synthesized
aggatacaaaatcaacatat

SEQ ID NO: 447498 - DNA, 20 bp, Artificial Sequence
  chemically synthesized
aacaaattcagtaaaattgc

SEQ ID NO: 447499 - DNA, 20 bp, Artificial Sequence
  chemically synthesized
aaacaaattcagtaaaattg

SEQ ID NO: 447500 - DNA, 20 bp, Artificial Sequence
  chemically synthesized
ttagaaataataaacaaatt

SEQ ID NO: 447501 - DNA, 20 bp, Artificial Sequence
  chemically synthesized
aatttgtttattatttctaa

SEQ ID NO: 447502 - DNA, 20 bp, Artificial Sequence
  chemically synthesized
aaaattccaccaaaaactgt

SEQ ID NO: 447503 - DNA, 20 bp, Artificial Sequence
  chemically synthesized
ttattatttctaacagtttt

SEQ ID NO: 447504 - DNA, 20 bp, Artificial Sequence
  chemically synthesized
ttatttctaacagtttttgg

SEQ ID NO: 447505 - DNA, 20 bp, Artificial Sequence
  chemically synthesized
tttggtggaattttttacac

SEQ ID NO: 447506 - DNA, 20 bp, Artificial Sequence
  chemically synthesized
attttttacaccagtcaaaa

SEQ ID NO: 447507 - DNA, 20 bp, Artificial Sequence
  chemically synthesized
ttaataatagccattttgac

SEQ ID NO: 447508 - DNA, 20 bp, Artificial Sequence
  chemically synthesized
gtttatttgttttttaataa

SEQ ID NO: 447509 - DNA, 20 bp, Artificial Sequence
  chemically synthesized
acaaaaaaatctccacatgt

SEQ ID NO: 447510 - DNA, 20 bp, Artificial Sequence
  chemically synthesized
catatccttgccaacatgtg

SEQ ID NO: 447511 - DNA, 20 bp, Artificial Sequence
  chemically synthesized
tccatatccttgccaacatg

SEQ ID NO: 447512 - DNA, 20 bp, Artificial Sequence
  chemically synthesized
aaaaatctccacatgttggc

SEQ ID NO: 447513 - DNA, 20 bp, Artificial Sequence
  chemically synthesized
aaaatctccacatgttggca

SEQ ID NO: 447514 - DNA, 20 bp, Artificial Sequence
  chemically synthesized
tccacatgttggcaaggata

SEQ ID NO: 447515 - DNA, 20 bp, Artificial Sequence
  chemically synthesized
cacatgttggcaaggatatg

SEQ ID NO: 447516 - DNA, 20 bp, Artificial Sequence
  chemically synthesized
gttggcaaggatatggagaa

SEQ ID NO: 447517 - DNA, 20 bp, Artificial Sequence
  chemically synthesized
gaaaagacaatgcttaaata

SEQ ID NO: 447518 - DNA, 20 bp, Artificial Sequence
  chemically synthesized
cattgtcaccaaccgtattt

SEQ ID NO: 447519 - DNA, 20 bp, Artificial Sequence
  chemically synthesized
agacaatgcttaaatacggt

SEQ ID NO: 447520 - DNA, 20 bp, Artificial Sequence
  chemically synthesized
cggttggtgacaatgtaaat

SEQ ID NO: 447521 - DNA, 20 bp, Artificial Sequence
  chemically synthesized
attagtacatctatgaaaaa

SEQ ID NO: 447522 - DNA, 20 bp, Artificial Sequence
  chemically synthesized
aatctccattctatttttca

SEQ ID NO: 447523 - DNA, 20 bp, Artificial Sequence
  chemically synthesized
tacatctatgaaaaatagaa

SEQ ID NO: 447524 - DNA, 20 bp, Artificial Sequence
  chemically synthesized
catctatgaaaaatagaatg

SEQ ID NO: 447525 - DNA, 20 bp, Artificial Sequence
  chemically synthesized
aatagaatggagatttctct

SEQ ID NO: 447526 - DNA, 20 bp, Artificial Sequence
  chemically synthesized
agctctatttttaattctta

SEQ ID NO: 447527 - DNA, 20 bp, Artificial Sequence
  chemically synthesized
gtagctctatttttaattct

SEQ ID NO: 447528 - DNA, 20 bp, Artificial Sequence
  chemically synthesized
atttctctaagaattaaaaa

SEQ ID NO: 447529 - DNA, 20 bp, Artificial Sequence
  chemically synthesized
ttctctaagaattaaaaata

SEQ ID NO: 447530 - DNA, 20 bp, Artificial Sequence
  chemically synthesized
gagaatactatatcaaatgg

SEQ ID NO: 447531 - DNA, 20 bp, Artificial Sequence
  chemically synthesized
aatagagctaccatttgata

SEQ ID NO: 447532 - DNA, 20 bp, Artificial Sequence
  chemically synthesized
tgtgagaatactatatcaaa

SEQ ID NO: 447533 - DNA, 20 bp, Artificial Sequence
  chemically synthesized
tgatatagtattctcacaac

SEQ ID NO: 447534 - DNA, 20 bp, Artificial Sequence
  chemically synthesized
gatatagtattctcacaact

SEQ ID NO: 447535 - DNA, 20 bp, Artificial Sequence
  chemically synthesized
ttgggtagatacccagttgt

SEQ ID NO: 447536 - DNA, 20 bp, Artificial Sequence
  chemically synthesized
ttttcatttgggtagatacc

SEQ ID NO: 447537 - DNA, 20 bp, Artificial Sequence
  chemically synthesized
attatttcttttcatttggg

SEQ ID NO: 447538 - DNA, 20 bp, Artificial Sequence
  chemically synthesized
tgggtatctacccaaatgaa

SEQ ID NO: 447539 - DNA, 20 bp, Artificial Sequence
  chemically synthesized
ataattatttcttttcattt

SEQ ID NO: 447540 - DNA, 20 bp, Artificial Sequence
  chemically synthesized
tataattatttcttttcatt

SEQ ID NO: 447541 - DNA, 20 bp, Artificial Sequence
  chemically synthesized
aaagaaataattatattaaa

SEQ ID NO: 447542 - DNA, 20 bp, Artificial Sequence
  chemically synthesized
ctgcagtaaacatatgagtg

SEQ ID NO: 447543 - DNA, 20 bp, Artificial Sequence
  chemically synthesized
gctgcagtaaacatatgagt

SEQ ID NO: 447544 - DNA, 20 bp, Artificial Sequence
  chemically synthesized
tagtgctgcagtaaacatat

SEQ ID NO: 447545 - DNA, 20 bp, Artificial Sequence
  chemically synthesized
cctcactcatatgtttactg

SEQ ID NO: 447546 - DNA, 20 bp, Artificial Sequence
  chemically synthesized
tgctattgtgaatagtgctg

SEQ ID NO: 447547 - DNA, 20 bp, Artificial Sequence
  chemically synthesized
tactgcagcactattcacaa

SEQ ID NO: 447548 - DNA, 20 bp, Artificial Sequence
  chemically synthesized
tatatatttgctattgtgaa

SEQ ID NO: 447549 - DNA, 20 bp, Artificial Sequence
  chemically synthesized
tattcacaatagcaaatata

SEQ ID NO: 447550 - DNA, 20 bp, Artificial Sequence
  chemically synthesized
caaatatatagaatttactt

SEQ ID NO: 447551 - DNA, 20 bp, Artificial Sequence
  chemically synthesized
tttcctcatccaatcaactt

SEQ ID NO: 447552 - DNA, 20 bp, Artificial Sequence
  chemically synthesized
tagaatttacttaagttgat

SEQ ID NO: 447553 - DNA, 20 bp, Artificial Sequence
  chemically synthesized
tttacttaagttgattggat

SEQ ID NO: 447554 - DNA, 20 bp, Artificial Sequence
  chemically synthesized
ttacttaagttgattggatg

SEQ ID NO: 447555 - DNA, 20 bp, Artificial Sequence
  chemically synthesized
ttgattggatgaggaaaatg

SEQ ID NO: 447556 - DNA, 20 bp, Artificial Sequence
  chemically synthesized
atacacaataaaacattatt

SEQ ID NO: 447557 - DNA, 20 bp, Artificial Sequence
  chemically synthesized
aaaacattatttagccacaa

SEQ ID NO: 447558 - DNA, 20 bp, Artificial Sequence
  chemically synthesized
aaacattatttagccacaaa

SEQ ID NO: 447559 - DNA, 20 bp, Artificial Sequence
  chemically synthesized
acatgattttattccttttg

SEQ ID NO: 447560 - DNA, 20 bp, Artificial Sequence
  chemically synthesized
ttccatccatgttgttgcaa

SEQ ID NO: 447561 - DNA, 20 bp, Artificial Sequence
  chemically synthesized
tcatgtcttttgcaacaaca

SEQ ID NO: 447562 - DNA, 20 bp, Artificial Sequence
  chemically synthesized
gtcttttgcaacaacatgga

SEQ ID NO: 447563 - DNA, 20 bp, Artificial Sequence
  chemically synthesized
tgcaacaacatggatggaac

SEQ ID NO: 447564 - DNA, 20 bp, Artificial Sequence
  chemically synthesized
caacaacatggatggaaccg

SEQ ID NO: 447565 - DNA, 20 bp, Artificial Sequence
  chemically synthesized
aacaacatggatggaaccgg

SEQ ID NO: 447566 - DNA, 20 bp, Artificial Sequence
  chemically synthesized
tcacttaagataatggcctc

SEQ ID NO: 447567 - DNA, 20 bp, Artificial Sequence
  chemically synthesized
gaaccggaggccattatctt

SEQ ID NO: 447568 - DNA, 20 bp, Artificial Sequence
  chemically synthesized
aattgtttcacttaagataa

SEQ ID NO: 447569 - DNA, 20 bp, Artificial Sequence
  chemically synthesized
gtgtctgaattgtttcactt

SEQ ID NO: 447570 - DNA, 20 bp, Artificial Sequence
  chemically synthesized
ttatcttaagtgaaacaatt

SEQ ID NO: 447571 - DNA, 20 bp, Artificial Sequence
  chemically synthesized
tgaaacaattcagacactga

SEQ ID NO: 447572 - DNA, 20 bp, Artificial Sequence
  chemically synthesized
aacatgcagtatttgtcttt

SEQ ID NO: 447573 - DNA, 20 bp, Artificial Sequence
  chemically synthesized
cacatgtaagtgagaacatg

SEQ ID NO: 447574 - DNA, 20 bp, Artificial Sequence
  chemically synthesized
ttttgctcccacatgtaagt

SEQ ID NO: 447575 - DNA, 20 bp, Artificial Sequence
  chemically synthesized
tgcatgttctcacttacatg

SEQ ID NO: 447576 - DNA, 20 bp, Artificial Sequence
  chemically synthesized
gcatgttctcacttacatgt

SEQ ID NO: 447577 - DNA, 20 bp, Artificial Sequence
  chemically synthesized
attattttgctcccacatgt

SEQ ID NO: 447578 - DNA, 20 bp, Artificial Sequence
  chemically synthesized
atgttctcacttacatgtgg

SEQ ID NO: 447579 - DNA, 20 bp, Artificial Sequence
  chemically synthesized
aaaataatgtgtacatttga

SEQ ID NO: 447580 - DNA, 20 bp, Artificial Sequence
  chemically synthesized
ataatgtgtacatttgaaag

SEQ ID NO: 447581 - DNA, 20 bp, Artificial Sequence
  chemically synthesized
aatgtgtacatttgaaagta

SEQ ID NO: 447582 - DNA, 20 bp, Artificial Sequence
  chemically synthesized
gtacatttgaaagtagagtg

SEQ ID NO: 447583 - DNA, 20 bp, Artificial Sequence
  chemically synthesized
gagtgtggaatgattgacaa

SEQ ID NO: 447584 - DNA, 20 bp, Artificial Sequence
  chemically synthesized
agtgtggaatgattgacaat

SEQ ID NO: 447585 - DNA, 20 bp, Artificial Sequence
  chemically synthesized
gtgtggaatgattgacaatg

SEQ ID NO: 447586 - DNA, 20 bp, Artificial Sequence
  chemically synthesized
aatgattgacaatggggaat

SEQ ID NO: 447587 - DNA, 20 bp, Artificial Sequence
  chemically synthesized
gattgacaatggggaatcag

SEQ ID NO: 447588 - DNA, 20 bp, Artificial Sequence
  chemically synthesized
attgacaatggggaatcaga

SEQ ID NO: 447589 - DNA, 20 bp, Artificial Sequence
  chemically synthesized
ttgacaatggggaatcagaa

SEQ ID NO: 447590 - DNA, 20 bp, Artificial Sequence
  chemically synthesized
acaatggggaatcagaaggg

SEQ ID NO: 447591 - DNA, 20 bp, Artificial Sequence
  chemically synthesized
aatggggaatcagaagggtg

SEQ ID NO: 447592 - DNA, 20 bp, Artificial Sequence
  chemically synthesized
atggggaatcagaagggtgg

SEQ ID NO: 447593 - DNA, 20 bp, Artificial Sequence
  chemically synthesized
gaatcagaagggtggaggca

SEQ ID NO: 447594 - DNA, 20 bp, Artificial Sequence
  chemically synthesized
aatcagaagggtggaggcat

SEQ ID NO: 447595 - DNA, 20 bp, Artificial Sequence
  chemically synthesized
tcagaagggtggaggcatgg

SEQ ID NO: 447596 - DNA, 20 bp, Artificial Sequence
  chemically synthesized
cagaagggtggaggcatggg

SEQ ID NO: 447597 - DNA, 20 bp, Artificial Sequence
  chemically synthesized
agaagggtggaggcatggga

SEQ ID NO: 447598 - DNA, 20 bp, Artificial Sequence
  chemically synthesized
gaagggtggaggcatgggag

SEQ ID NO: 447599 - DNA, 20 bp, Artificial Sequence
  chemically synthesized
aagggtggaggcatgggagg

SEQ ID NO: 447600 - DNA, 20 bp, Artificial Sequence
  chemically synthesized
atgggagggggttgtatgat

SEQ ID NO: 447601 - DNA, 20 bp, Artificial Sequence
  chemically synthesized
taatatgcattgtacacatt

SEQ ID NO: 447602 - DNA, 20 bp, Artificial Sequence
  chemically synthesized
tgtgtacaatgcatattatt

SEQ ID NO: 447603 - DNA, 20 bp, Artificial Sequence
  chemically synthesized
gtgtacaatgcatattattc

SEQ ID NO: 447604 - DNA, 20 bp, Artificial Sequence
  chemically synthesized
acaagtgtaattttatttta

SEQ ID NO: 447605 - DNA, 20 bp, Artificial Sequence
  chemically synthesized
tacaagtgtaattttatttt

SEQ ID NO: 447606 - DNA, 20 bp, Artificial Sequence
  chemically synthesized
atacaagtgtaattttattt

SEQ ID NO: 447607 - DNA, 20 bp, Artificial Sequence
  chemically synthesized
tgtatatatttaaggaatac

SEQ ID NO: 447608 - DNA, 20 bp, Artificial Sequence
  chemically synthesized
atgttatttgtatatattta

SEQ ID NO: 447609 - DNA, 20 bp, Artificial Sequence
  chemically synthesized
aatgttatttgtatatattt

SEQ ID NO: 447610 - DNA, 20 bp, Artificial Sequence
  chemically synthesized
aacatttttaaaaataaaaa

SEQ ID NO: 447611 - DNA, 20 bp, Artificial Sequence
  chemically synthesized
acatttttaaaaataaaaat

SEQ ID NO: 447612 - DNA, 20 bp, Artificial Sequence
  chemically synthesized
catttttaaaaataaaaata

SEQ ID NO: 447613 - DNA, 20 bp, Artificial Sequence
  chemically synthesized
atttttaaaaataaaaatag

SEQ ID NO: 447614 - DNA, 20 bp, Artificial Sequence
  chemically synthesized
gtgccgatgacataatgtta

SEQ ID NO: 447615 - DNA, 20 bp, Artificial Sequence
  chemically synthesized
gttctataacattatgtcat

SEQ ID NO: 447616 - DNA, 20 bp, Artificial Sequence
  chemically synthesized
aacattatgtcatcggcaca

SEQ ID NO: 447617 - DNA, 20 bp, Artificial Sequence
  chemically synthesized
acattatgtcatcggcacac

SEQ ID NO: 447618 - DNA, 20 bp, Artificial Sequence
  chemically synthesized
cattatgtcatcggcacaca

SEQ ID NO: 447619 - DNA, 20 bp, Artificial Sequence
  chemically synthesized
aaataggaaaaaaagaagtt

SEQ ID NO: 447620 - DNA, 20 bp, Artificial Sequence
  chemically synthesized
catccaaataggaaaaaaag

SEQ ID NO: 447621 - DNA, 20 bp, Artificial Sequence
  chemically synthesized
aggcatccaaataggaaaaa

SEQ ID NO: 447622 - DNA, 20 bp, Artificial Sequence
  chemically synthesized
taacttctttttttcctatt

SEQ ID NO: 447623 - DNA, 20 bp, Artificial Sequence
  chemically synthesized
taaacaaaaggcatccaaat

SEQ ID NO: 447624 - DNA, 20 bp, Artificial Sequence
  chemically synthesized
ataaacaaaaggcatccaaa

SEQ ID NO: 447625 - DNA, 20 bp, Artificial Sequence
  chemically synthesized
aggcaagaagaataaacaaa

SEQ ID NO: 447626 - DNA, 20 bp, Artificial Sequence
  chemically synthesized
taggcaagaagaataaacaa

SEQ ID NO: 447627 - DNA, 20 bp, Artificial Sequence
  chemically synthesized
cctggaagtaattaggcaag

SEQ ID NO: 447628 - DNA, 20 bp, Artificial Sequence
  chemically synthesized
agtcctggaagtaattaggc

SEQ ID NO: 447629 - DNA, 20 bp, Artificial Sequence
  chemically synthesized
acacagtcctggaagtaatt

SEQ ID NO: 447630 - DNA, 20 bp, Artificial Sequence
  chemically synthesized
aacacagtcctggaagtaat

SEQ ID NO: 447631 - DNA, 20 bp, Artificial Sequence
  chemically synthesized
tcttcttgcctaattacttc

SEQ ID NO: 447632 - DNA, 20 bp, Artificial Sequence
  chemically synthesized
cttcttgcctaattacttcc

SEQ ID NO: 447633 - DNA, 20 bp, Artificial Sequence
  chemically synthesized
tctattcaacacagtcctgg

SEQ ID NO: 447634 - DNA, 20 bp, Artificial Sequence
  chemically synthesized
acttctattcaacacagtcc

SEQ ID NO: 447635 - DNA, 20 bp, Artificial Sequence
  chemically synthesized
acttccaggactgtgttgaa

SEQ ID NO: 447636 - DNA, 20 bp, Artificial Sequence
  chemically synthesized
gtctccacttctattcaaca

SEQ ID NO: 447637 - DNA, 20 bp, Artificial Sequence
  chemically synthesized
tccaggactgtgttgaatag

SEQ ID NO: 447638 - DNA, 20 bp, Artificial Sequence
  chemically synthesized
aggactgtgttgaatagaag

SEQ ID NO: 447639 - DNA, 20 bp, Artificial Sequence
  chemically synthesized
gactgtgttgaatagaagtg

SEQ ID NO: 447640 - DNA, 20 bp, Artificial Sequence
  chemically synthesized
gtgttgaatagaagtggaga

SEQ ID NO: 447641 - DNA, 20 bp, Artificial Sequence
  chemically synthesized
tgaatagaagtggagacagt

SEQ ID NO: 447642 - DNA, 20 bp, Artificial Sequence
  chemically synthesized
ctaagatctggcacaagacg

SEQ ID NO: 447643 - DNA, 20 bp, Artificial Sequence
  chemically synthesized
tctaagatctggcacaagac

SEQ ID NO: 447644 - DNA, 20 bp, Artificial Sequence
  chemically synthesized
tgagtatcctcgtcttgtgc

SEQ ID NO: 447645 - DNA, 20 bp, Artificial Sequence
  chemically synthesized
tttcctctaagatctggcac

SEQ ID NO: 447646 - DNA, 20 bp, Artificial Sequence
  chemically synthesized
cctcgtcttgtgccagatct

SEQ ID NO: 447647 - DNA, 20 bp, Artificial Sequence
  chemically synthesized
tcgtcttgtgccagatctta

SEQ ID NO: 447648 - DNA, 20 bp, Artificial Sequence
  chemically synthesized
aaagcttttcctctaagatc

SEQ ID NO: 447649 - DNA, 20 bp, Artificial Sequence
  chemically synthesized
cgtcttgtgccagatcttag

SEQ ID NO: 447650 - DNA, 20 bp, Artificial Sequence
  chemically synthesized
tgtgccagatcttagaggaa

SEQ ID NO: 447651 - DNA, 20 bp, Artificial Sequence
  chemically synthesized
aagttgaaagcttttcctct

SEQ ID NO: 447652 - DNA, 20 bp, Artificial Sequence
  chemically synthesized
actggatggggaaaagttga

SEQ ID NO: 447653 - DNA, 20 bp, Artificial Sequence
  chemically synthesized
gaattatactggatggggaa

SEQ ID NO: 447654 - DNA, 20 bp, Artificial Sequence
  chemically synthesized
gctttcaacttttccccatc

SEQ ID NO: 447655 - DNA, 20 bp, Artificial Sequence
  chemically synthesized
agcaagaattatactggatg

SEQ ID NO: 447656 - DNA, 20 bp, Artificial Sequence
  chemically synthesized
aagcaagaattatactggat

SEQ ID NO: 447657 - DNA, 20 bp, Artificial Sequence
  chemically synthesized
aaagcaagaattatactgga

SEQ ID NO: 447658 - DNA, 20 bp, Artificial Sequence
  chemically synthesized
caataaagcaagaattatac

SEQ ID NO: 447659 - DNA, 20 bp, Artificial Sequence
  chemically synthesized
ggcattttcttcaataaagc

SEQ ID NO: 447660 - DNA, 20 bp, Artificial Sequence
  chemically synthesized
gtataattcttgctttattg

SEQ ID NO: 447661 - DNA, 20 bp, Artificial Sequence
  chemically synthesized
gtatggcattttcttcaata

SEQ ID NO: 447662 - DNA, 20 bp, Artificial Sequence
  chemically synthesized
accagtggttgacagaagta

SEQ ID NO: 447663 - DNA, 20 bp, Artificial Sequence
  chemically synthesized
tctataccagtggttgacag

SEQ ID NO: 447664 - DNA, 20 bp, Artificial Sequence
  chemically synthesized
ctgtctataccagtggttga

SEQ ID NO: 447665 - DNA, 20 bp, Artificial Sequence
  chemically synthesized
gccatacttctgtcaaccac

SEQ ID NO: 447666 - DNA, 20 bp, Artificial Sequence
  chemically synthesized
acttctgtcaaccactggta

SEQ ID NO: 447667 - DNA, 20 bp, Artificial Sequence
  chemically synthesized
taatcagctgtctataccag

SEQ ID NO: 447668 - DNA, 20 bp, Artificial Sequence
  chemically synthesized
ctgtcaaccactggtataga

SEQ ID NO: 447669 - DNA, 20 bp, Artificial Sequence
  chemically synthesized
atataatcagctgtctatac

SEQ ID NO: 447670 - DNA, 20 bp, Artificial Sequence
  chemically synthesized
gtatagacagctgattatat

SEQ ID NO: 447671 - DNA, 20 bp, Artificial Sequence
  chemically synthesized
taagatccaacttatataat

SEQ ID NO: 447672 - DNA, 20 bp, Artificial Sequence
  chemically synthesized
agacagctgattatataagt

SEQ ID NO: 447673 - DNA, 20 bp, Artificial Sequence
  chemically synthesized
ataagttggatcttattaat

SEQ ID NO: 447674 - DNA, 20 bp, Artificial Sequence
  chemically synthesized
tgactttctcacttattaat

SEQ ID NO: 447675 - DNA, 20 bp, Artificial Sequence
  chemically synthesized
gttggatcttattaataagt

SEQ ID NO: 447676 - DNA, 20 bp, Artificial Sequence
  chemically synthesized
gatcttattaataagtgaga

SEQ ID NO: 447677 - DNA, 20 bp, Artificial Sequence
  chemically synthesized
ttattaataagtgagaaagt

SEQ ID NO: 447678 - DNA, 20 bp, Artificial Sequence
  chemically synthesized
tgagaaagtcagcaaaatta

SEQ ID NO: 447679 - DNA, 20 bp, Artificial Sequence
  chemically synthesized
ctttaaaattatataaaaag

SEQ ID NO: 447680 - DNA, 20 bp, Artificial Sequence
  chemically synthesized
atcctttaaaattatataaa

SEQ ID NO: 447681 - DNA, 20 bp, Artificial Sequence
  chemically synthesized
ctgctttttatataatttta

SEQ ID NO: 447682 - DNA, 20 bp, Artificial Sequence
  chemically synthesized
tgctttttatataattttaa

SEQ ID NO: 447683 - DNA, 20 bp, Artificial Sequence
  chemically synthesized
tatcgtaatcatattgtttt

SEQ ID NO: 447684 - DNA, 20 bp, Artificial Sequence
  chemically synthesized
attacgataaaatctgaaaa

SEQ ID NO: 447685 - DNA, 20 bp, Artificial Sequence
  chemically synthesized
agatatccatttactttttt

SEQ ID NO: 447686 - DNA, 20 bp, Artificial Sequence
  chemically synthesized
taaaatctgaaaaaagtaaa

SEQ ID NO: 447687 - DNA, 20 bp, Artificial Sequence
  chemically synthesized
aagtaaatggatatctatac

SEQ ID NO: 447688 - DNA, 20 bp, Artificial Sequence
  chemically synthesized
tagttctgagcaaactggta

SEQ ID NO: 447689 - DNA, 20 bp, Artificial Sequence
  chemically synthesized
gatatctataccagtttgct

SEQ ID NO: 447690 - DNA, 20 bp, Artificial Sequence
  chemically synthesized
ttatatagttctgagcaaac

SEQ ID NO: 447691 - DNA, 20 bp, Artificial Sequence
  chemically synthesized
taccatccttatatagttct

SEQ ID NO: 447692 - DNA, 20 bp, Artificial Sequence
  chemically synthesized
cagtttgctcagaactatat

SEQ ID NO: 447693 - DNA, 20 bp, Artificial Sequence
  chemically synthesized
agtttgctcagaactatata

SEQ ID NO: 447694 - DNA, 20 bp, Artificial Sequence
  chemically synthesized
aacctgataccatccttata

SEQ ID NO: 447695 - DNA, 20 bp, Artificial Sequence
  chemically synthesized
tgctcagaactatataagga

SEQ ID NO: 447696 - DNA, 20 bp, Artificial Sequence
  chemically synthesized
gaactatataaggatggtat

SEQ ID NO: 447697 - DNA, 20 bp, Artificial Sequence
  chemically synthesized
aactatataaggatggtatc

SEQ ID NO: 447698 - DNA, 20 bp, Artificial Sequence
  chemically synthesized
atataaggatggtatcaggt

SEQ ID NO: 447699 - DNA, 20 bp, Artificial Sequence
  chemically synthesized
aggatggtatcaggttagct

SEQ ID NO: 447700 - DNA, 20 bp, Artificial Sequence
  chemically synthesized
ttatgtacttgtatttgacc

SEQ ID NO: 447701 - DNA, 20 bp, Artificial Sequence
  chemically synthesized
aggttagcttggtcaaatac

SEQ ID NO: 447702 - DNA, 20 bp, Artificial Sequence
  chemically synthesized
aatacaagtacataacaaaa

SEQ ID NO: 447703 - DNA, 20 bp, Artificial Sequence
  chemically synthesized
aaagtaaaataaatattttt

SEQ ID NO: 447704 - DNA, 20 bp, Artificial Sequence
  chemically synthesized
aagtaaaataaatattttta

SEQ ID NO: 447705 - DNA, 20 bp, Artificial Sequence
  chemically synthesized
aaataaatatttttaaggct

SEQ ID NO: 447706 - DNA, 20 bp, Artificial Sequence
  chemically synthesized
gaaatagcttgagttgaact

SEQ ID NO: 447707 - DNA, 20 bp, Artificial Sequence
  chemically synthesized
tttaaggctgagttcaactc

SEQ ID NO: 447708 - DNA, 20 bp, Artificial Sequence
  chemically synthesized
actcagagtagaaatagctt

SEQ ID NO: 447709 - DNA, 20 bp, Artificial Sequence
  chemically synthesized
ttgcaaactcagagtagaaa

SEQ ID NO: 447710 - DNA, 20 bp, Artificial Sequence
  chemically synthesized
actcaagctatttctactct

SEQ ID NO: 447711 - DNA, 20 bp, Artificial Sequence
  chemically synthesized
ctaaacttgcaaactcagag

SEQ ID NO: 447712 - DNA, 20 bp, Artificial Sequence
  chemically synthesized
taactaaacttgcaaactca

SEQ ID NO: 447713 - DNA, 20 bp, Artificial Sequence
  chemically synthesized
tatttctactctgagtttgc

SEQ ID NO: 447714 - DNA, 20 bp, Artificial Sequence
  chemically synthesized
aataactaaacttgcaaact

SEQ ID NO: 447715 - DNA, 20 bp, Artificial Sequence
  chemically synthesized
ctactctgagtttgcaagtt

SEQ ID NO: 447716 - DNA, 20 bp, Artificial Sequence
  chemically synthesized
tttcaaatgatccttttgct

SEQ ID NO: 447717 - DNA, 20 bp, Artificial Sequence
  chemically synthesized
ggaaaatcaaaccaagcaaa

SEQ ID NO: 447718 - DNA, 20 bp, Artificial Sequence
  chemically synthesized
gggaaaatcaaaccaagcaa

SEQ ID NO: 447719 - DNA, 20 bp, Artificial Sequence
  chemically synthesized
atttcggggaaaatcaaacc

SEQ ID NO: 447720 - DNA, 20 bp, Artificial Sequence
  chemically synthesized
tggtttgattttccccgaaa

SEQ ID NO: 447721 - DNA, 20 bp, Artificial Sequence
  chemically synthesized
attcacaattgaccatttcg

SEQ ID NO: 447722 - DNA, 20 bp, Artificial Sequence
  chemically synthesized
tattcacaattgaccatttc

SEQ ID NO: 447723 - DNA, 20 bp, Artificial Sequence
  chemically synthesized
ttattcacaattgaccattt

SEQ ID NO: 447724 - DNA, 20 bp, Artificial Sequence
  chemically synthesized
aaattgtttgatttgattcg

SEQ ID NO: 447725 - DNA, 20 bp, Artificial Sequence
  chemically synthesized
tgattcgtagttttttaact

SEQ ID NO: 447726 - DNA, 20 bp, Artificial Sequence
  chemically synthesized
ttcgtagttttttaactgag

SEQ ID NO: 447727 - DNA, 20 bp, Artificial Sequence
  chemically synthesized
tcgtagttttttaactgagt

SEQ ID NO: 447728 - DNA, 20 bp, Artificial Sequence
  chemically synthesized
agttttttaactgagtaggc

SEQ ID NO: 447729 - DNA, 20 bp, Artificial Sequence
  chemically synthesized
aatctgagaccttgcctact

SEQ ID NO: 447730 - DNA, 20 bp, Artificial Sequence
  chemically synthesized
gttttttaactgagtaggca

SEQ ID NO: 447731 - DNA, 20 bp, Artificial Sequence
  chemically synthesized
taactgagtaggcaaggtct

SEQ ID NO: 447732 - DNA, 20 bp, Artificial Sequence
  chemically synthesized
tcttcaagagaagtaaatct

SEQ ID NO: 447733 - DNA, 20 bp, Artificial Sequence
  chemically synthesized
tctcagatttacttctcttg

SEQ ID NO: 447734 - DNA, 20 bp, Artificial Sequence
  chemically synthesized
tctttattagtcttcaagag

SEQ ID NO: 447735 - DNA, 20 bp, Artificial Sequence
  chemically synthesized
tcttctttattagtcttcaa

SEQ ID NO: 447736 - DNA, 20 bp, Artificial Sequence
  chemically synthesized
tgtcttctttattagtcttc

SEQ ID NO: 447737 - DNA, 20 bp, Artificial Sequence
  chemically synthesized
acttctcttgaagactaata

SEQ ID NO: 447738 - DNA, 20 bp, Artificial Sequence
  chemically synthesized
tctcttgaagactaataaag

SEQ ID NO: 447739 - DNA, 20 bp, Artificial Sequence
  chemically synthesized
gatattaatgtcttctttat

SEQ ID NO: 447740 - DNA, 20 bp, Artificial Sequence
  chemically synthesized
ctctgttcctgtaaacaggt

SEQ ID NO: 447741 - DNA, 20 bp, Artificial Sequence
  chemically synthesized
attaatatctaacctgttta

SEQ ID NO: 447742 - DNA, 20 bp, Artificial Sequence
  chemically synthesized
ttaatatctaacctgtttac

SEQ ID NO: 447743 - DNA, 20 bp, Artificial Sequence
  chemically synthesized
gaaactctgttcctgtaaac

SEQ ID NO: 447744 - DNA, 20 bp, Artificial Sequence
  chemically synthesized
agaaactctgttcctgtaaa

SEQ ID NO: 447745 - DNA, 20 bp, Artificial Sequence
  chemically synthesized
atctaacctgtttacaggaa

SEQ ID NO: 447746 - DNA, 20 bp, Artificial Sequence
  chemically synthesized
ctaacctgtttacaggaaca

SEQ ID NO: 447747 - DNA, 20 bp, Artificial Sequence
  chemically synthesized
ttacaggaacagagtttctt

SEQ ID NO: 447748 - DNA, 20 bp, Artificial Sequence
  chemically synthesized
ggaacagagtttcttgagca

SEQ ID NO: 447749 - DNA, 20 bp, Artificial Sequence
  chemically synthesized
tgggaagctcagctgtgctc

SEQ ID NO: 447750 - DNA, 20 bp, Artificial Sequence
  chemically synthesized
agagtttcttgagcacagct

SEQ ID NO: 447751 - DNA, 20 bp, Artificial Sequence
  chemically synthesized
tctatggcatttgggaagct

SEQ ID NO: 447752 - DNA, 20 bp, Artificial Sequence
  chemically synthesized
ttgtttctatggcatttggg

SEQ ID NO: 447753 - DNA, 20 bp, Artificial Sequence
  chemically synthesized
gttttgtttctatggcattt

SEQ ID NO: 447754 - DNA, 20 bp, Artificial Sequence
  chemically synthesized
gctgagcttcccaaatgcca

SEQ ID NO: 447755 - DNA, 20 bp, Artificial Sequence
  chemically synthesized
cgttttgtttctatggcatt

SEQ ID NO: 447756 - DNA, 20 bp, Artificial Sequence
  chemically synthesized
tccatttcgttttgtttcta

SEQ ID NO: 447757 - DNA, 20 bp, Artificial Sequence
  chemically synthesized
gccatagaaacaaaacgaaa

SEQ ID NO: 447758 - DNA, 20 bp, Artificial Sequence
  chemically synthesized
atagaaacaaaacgaaatgg

SEQ ID NO: 447759 - DNA, 20 bp, Artificial Sequence
  chemically synthesized
acgaaatggaagaatttatc

SEQ ID NO: 447760 - DNA, 20 bp, Artificial Sequence
  chemically synthesized
aaatggaagaatttatctgg

SEQ ID NO: 447761 - DNA, 20 bp, Artificial Sequence
  chemically synthesized
aatggaagaatttatctggt

SEQ ID NO: 447762 - DNA, 20 bp, Artificial Sequence
  chemically synthesized
tggaagaatttatctggtag

SEQ ID NO: 447763 - DNA, 20 bp, Artificial Sequence
  chemically synthesized
acatcaaaatacactcctac

SEQ ID NO: 447764 - DNA, 20 bp, Artificial Sequence
  chemically synthesized
tgtattttgatgtgacctaa

SEQ ID NO: 447765 - DNA, 20 bp, Artificial Sequence
  chemically synthesized
aagcttcattgaattctatt

SEQ ID NO: 447766 - DNA, 20 bp, Artificial Sequence
  chemically synthesized
gaagcttcattgaattctat

SEQ ID NO: 447767 - DNA, 20 bp, Artificial Sequence
  chemically synthesized
tgacctaatagaattcaatg

SEQ ID NO: 447768 - DNA, 20 bp, Artificial Sequence
  chemically synthesized
gtatagcaagttataaaatg

SEQ ID NO: 447769 - DNA, 20 bp, Artificial Sequence
  chemically synthesized
atatatattaattgtatagc

SEQ ID NO: 447770 - DNA, 20 bp, Artificial Sequence
  chemically synthesized
gtcaatatatattaattgta

SEQ ID NO: 447771 - DNA, 20 bp, Artificial Sequence
  chemically synthesized
tacaattaatatatattgac

SEQ ID NO: 447772 - DNA, 20 bp, Artificial Sequence
  chemically synthesized
taatatatattgacaagccc

SEQ ID NO: 447773 - DNA, 20 bp, Artificial Sequence
  chemically synthesized
tgcatgacttgaagacacta

SEQ ID NO: 447774 - DNA, 20 bp, Artificial Sequence
  chemically synthesized
atgcatgacttgaagacact

SEQ ID NO: 447775 - DNA, 20 bp, Artificial Sequence
  chemically synthesized
tatgcatgacttgaagacac

SEQ ID NO: 447776 - DNA, 20 bp, Artificial Sequence
  chemically synthesized
tgacaagccctagtgtcttc

SEQ ID NO: 447777 - DNA, 20 bp, Artificial Sequence
  chemically synthesized
agcattttatgcatgacttg

SEQ ID NO: 447778 - DNA, 20 bp, Artificial Sequence
  chemically synthesized
atgctgataatttgtttcaa

SEQ ID NO: 447779 - DNA, 20 bp, Artificial Sequence
  chemically synthesized
atgcttttgaaacaaattat

SEQ ID NO: 447780 - DNA, 20 bp, Artificial Sequence
  chemically synthesized
aattatcagcatttatttgt

SEQ ID NO: 447781 - DNA, 20 bp, Artificial Sequence
  chemically synthesized
gtgagttaaataacttttct

SEQ ID NO: 447782 - DNA, 20 bp, Artificial Sequence
  chemically synthesized
ttctcatgatacacttagaa

SEQ ID NO: 447783 - DNA, 20 bp, Artificial Sequence
  chemically synthesized
cccatttctcatgatacact

SEQ ID NO: 447784 - DNA, 20 bp, Artificial Sequence
  chemically synthesized
aacttttctaagtgtatcat

SEQ ID NO: 447785 - DNA, 20 bp, Artificial Sequence
  chemically synthesized
tctaagtgtatcatgagaaa

SEQ ID NO: 447786 - DNA, 20 bp, Artificial Sequence
  chemically synthesized
ctaagtgtatcatgagaaat

SEQ ID NO: 447787 - DNA, 20 bp, Artificial Sequence
  chemically synthesized
atgggttaaacacaactttt

SEQ ID NO: 447788 - DNA, 20 bp, Artificial Sequence
  chemically synthesized
agcaggaagaatatgccaaa

SEQ ID NO: 447789 - DNA, 20 bp, Artificial Sequence
  chemically synthesized
cttttttaagtggtagcagg

SEQ ID NO: 447790 - DNA, 20 bp, Artificial Sequence
  chemically synthesized
gtgcttttttaagtggtagc

SEQ ID NO: 447791 - DNA, 20 bp, Artificial Sequence
  chemically synthesized
tgtgcttttttaagtggtag

SEQ ID NO: 447792 - DNA, 20 bp, Artificial Sequence
  chemically synthesized
tgatgtgcttttttaagtgg

SEQ ID NO: 447793 - DNA, 20 bp, Artificial Sequence
  chemically synthesized
cttcctgctaccacttaaaa

SEQ ID NO: 447794 - DNA, 20 bp, Artificial Sequence
  chemically synthesized
aaatgatgtgcttttttaag

SEQ ID NO: 447795 - DNA, 20 bp, Artificial Sequence
  chemically synthesized
tacaaatgatgtgctttttt

SEQ ID NO: 447796 - DNA, 20 bp, Artificial Sequence
  chemically synthesized
ttaaatcatgaacaggaagg

SEQ ID NO: 447797 - DNA, 20 bp, Artificial Sequence
  chemically synthesized
ggattaaatcatgaacagga

SEQ ID NO: 447798 - DNA, 20 bp, Artificial Sequence
  chemically synthesized
tggattaaatcatgaacagg

SEQ ID NO: 447799 - DNA, 20 bp, Artificial Sequence
  chemically synthesized
atatggattaaatcatgaac

SEQ ID NO: 447800 - DNA, 20 bp, Artificial Sequence
  chemically synthesized
aatatggattaaatcatgaa

SEQ ID NO: 447801 - DNA, 20 bp, Artificial Sequence
  chemically synthesized
ttattttatgtttaaaaata

SEQ ID NO: 447802 - DNA, 20 bp, Artificial Sequence
  chemically synthesized
catatttttaaacataaaat

SEQ ID NO: 447803 - DNA, 20 bp, Artificial Sequence
  chemically synthesized
tttttaaacataaaataagc

SEQ ID NO: 447804 - DNA, 20 bp, Artificial Sequence
  chemically synthesized
tgttgtaataaaagttaagc

SEQ ID NO: 447805 - DNA, 20 bp, Artificial Sequence
  chemically synthesized
cttctgttgtaataaaagtt

SEQ ID NO: 447806 - DNA, 20 bp, Artificial Sequence
  chemically synthesized
acagacttctgttgtaataa

SEQ ID NO: 447807 - DNA, 20 bp, Artificial Sequence
  chemically synthesized
tagcttaacttttattacaa

SEQ ID NO: 447808 - DNA, 20 bp, Artificial Sequence
  chemically synthesized
cttaacttttattacaacag

SEQ ID NO: 447809 - DNA, 20 bp, Artificial Sequence
  chemically synthesized
acaacagaagtctgtttatc

SEQ ID NO: 447810 - DNA, 20 bp, Artificial Sequence
  chemically synthesized
aaaacctcactccagataaa

SEQ ID NO: 447811 - DNA, 20 bp, Artificial Sequence
  chemically synthesized
aacagaagtctgtttatctg

SEQ ID NO: 447812 - DNA, 20 bp, Artificial Sequence
  chemically synthesized
gaagtctgtttatctggagt

SEQ ID NO: 447813 - DNA, 20 bp, Artificial Sequence
  chemically synthesized
aagtctgtttatctggagtg

SEQ ID NO: 447814 - DNA, 20 bp, Artificial Sequence
  chemically synthesized
ctatatttaaaacctcactc

SEQ ID NO: 447815 - DNA, 20 bp, Artificial Sequence
  chemically synthesized
ctggagtgaggttttaaata

SEQ ID NO: 447816 - DNA, 20 bp, Artificial Sequence
  chemically synthesized
tatagacatttttgctcctt

SEQ ID NO: 447817 - DNA, 20 bp, Artificial Sequence
  chemically synthesized
agtttaaaacaatactgaag

SEQ ID NO: 447818 - DNA, 20 bp, Artificial Sequence
  chemically synthesized
ttagtttaaaacaatactga

SEQ ID NO: 447819 - DNA, 20 bp, Artificial Sequence
  chemically synthesized
attagtttaaaacaatactg

SEQ ID NO: 447820 - DNA, 20 bp, Artificial Sequence
  chemically synthesized
ctagtcttattgaaatgcat

SEQ ID NO: 447821 - DNA, 20 bp, Artificial Sequence
  chemically synthesized
ttaaactaatgcatttcaat

SEQ ID NO: 447822 - DNA, 20 bp, Artificial Sequence
  chemically synthesized
ctaatgcatttcaataagac

SEQ ID NO: 447823 - DNA, 20 bp, Artificial Sequence
  chemically synthesized
cagtacaatgtataataaac

SEQ ID NO: 447824 - DNA, 20 bp, Artificial Sequence
  chemically synthesized
tttattatacattgtactga

SEQ ID NO: 447825 - DNA, 20 bp, Artificial Sequence
  chemically synthesized
atacattgtactgatagtta

SEQ ID NO: 447826 - DNA, 20 bp, Artificial Sequence
  chemically synthesized
ttaacagttactttaactat

SEQ ID NO: 447827 - DNA, 20 bp, Artificial Sequence
  chemically synthesized
atagttaaagtaactgttaa

SEQ ID NO: 447828 - DNA, 20 bp, Artificial Sequence
  chemically synthesized
cctgaaaaaatagccattaa

SEQ ID NO: 447829 - DNA, 20 bp, Artificial Sequence
  chemically synthesized
actgttaatggctatttttt

SEQ ID NO: 447830 - DNA, 20 bp, Artificial Sequence
  chemically synthesized
ctgttaatggctattttttc

SEQ ID NO: 447831 - DNA, 20 bp, Artificial Sequence
  chemically synthesized
ttttcagagccctgaaaaaa

SEQ ID NO: 447832 - DNA, 20 bp, Artificial Sequence
  chemically synthesized
tgttaatggctattttttca

SEQ ID NO: 447833 - DNA, 20 bp, Artificial Sequence
  chemically synthesized
tattttttcagggctctgaa

SEQ ID NO: 447834 - DNA, 20 bp, Artificial Sequence
  chemically synthesized
ttttttttttttacttttca

SEQ ID NO: 447835 - DNA, 20 bp, Artificial Sequence
  chemically synthesized
ctttttttttttttactttt

SEQ ID NO: 447836 - DNA, 20 bp, Artificial Sequence
  chemically synthesized
ctgaaaagtaaaaaaaaaaa

SEQ ID NO: 447837 - DNA, 20 bp, Artificial Sequence
  chemically synthesized
cctaagaatgatatttcggg

SEQ ID NO: 447838 - DNA, 20 bp, Artificial Sequence
  chemically synthesized
tttcctaagaatgatatttc

SEQ ID NO: 447839 - DNA, 20 bp, Artificial Sequence
  chemically synthesized
ttttcctaagaatgatattt

SEQ ID NO: 447840 - DNA, 20 bp, Artificial Sequence
  chemically synthesized
actacccgaaatatcattct

SEQ ID NO: 447841 - DNA, 20 bp, Artificial Sequence
  chemically synthesized
ctacccgaaatatcattctt

SEQ ID NO: 447842 - DNA, 20 bp, Artificial Sequence
  chemically synthesized
gaaatatcattcttaggaaa

SEQ ID NO: 447843 - DNA, 20 bp, Artificial Sequence
  chemically synthesized
ttaactcccagctttttcct

SEQ ID NO: 447844 - DNA, 20 bp, Artificial Sequence
  chemically synthesized
tatcattcttaggaaaaagc

SEQ ID NO: 447845 - DNA, 20 bp, Artificial Sequence
  chemically synthesized
atcattcttaggaaaaagct

SEQ ID NO: 447846 - DNA, 20 bp, Artificial Sequence
  chemically synthesized
cattcttaggaaaaagctgg

SEQ ID NO: 447847 - DNA, 20 bp, Artificial Sequence
  chemically synthesized
ttcactttccaattaactcc

SEQ ID NO: 447848 - DNA, 20 bp, Artificial Sequence
  chemically synthesized
ggaaaaagctgggagttaat

SEQ ID NO: 447849 - DNA, 20 bp, Artificial Sequence
  chemically synthesized
aaagctgggagttaattgga

SEQ ID NO: 447850 - DNA, 20 bp, Artificial Sequence
  chemically synthesized
ggagttaattggaaagtgaa

SEQ ID NO: 447851 - DNA, 20 bp, Artificial Sequence
  chemically synthesized
cagttttgactattcagagt

SEQ ID NO: 447852 - DNA, 20 bp, Artificial Sequence
  chemically synthesized
atagaaacactcactctgaa

SEQ ID NO: 447853 - DNA, 20 bp, Artificial Sequence
  chemically synthesized
tcatcagttttgactattca

SEQ ID NO: 447854 - DNA, 20 bp, Artificial Sequence
  chemically synthesized
tttcatcagttttgactatt

SEQ ID NO: 447855 - DNA, 20 bp, Artificial Sequence
  chemically synthesized
tgtagttttattaatttcat

SEQ ID NO: 447856 - DNA, 20 bp, Artificial Sequence
  chemically synthesized
ataaataaatgcaacatatg

SEQ ID NO: 447857 - DNA, 20 bp, Artificial Sequence
  chemically synthesized
ttagtgactgattattaaca

SEQ ID NO: 447858 - DNA, 20 bp, Artificial Sequence
  chemically synthesized
ttatgttctttgttaataat

SEQ ID NO: 447859 - DNA, 20 bp, Artificial Sequence
  chemically synthesized
taatggaaaaattataggtt

SEQ ID NO: 447860 - DNA, 20 bp, Artificial Sequence
  chemically synthesized
gtgaataatggaaaaattat

SEQ ID NO: 447861 - DNA, 20 bp, Artificial Sequence
  chemically synthesized
agtgaataatggaaaaatta

SEQ ID NO: 447862 - DNA, 20 bp, Artificial Sequence
  chemically synthesized
attttttggtaagtgaataa

SEQ ID NO: 447863 - DNA, 20 bp, Artificial Sequence
  chemically synthesized
ttttccttttattttttggt

SEQ ID NO: 447864 - DNA, 20 bp, Artificial Sequence
  chemically synthesized
taaattttccttttattttt

SEQ ID NO: 447865 - DNA, 20 bp, Artificial Sequence
  chemically synthesized
attcacttaccaaaaaataa

SEQ ID NO: 447866 - DNA, 20 bp, Artificial Sequence
  chemically synthesized
ttcacttaccaaaaaataaa

SEQ ID NO: 447867 - DNA, 20 bp, Artificial Sequence
  chemically synthesized
caaaaaataaaaggaaaatt

SEQ ID NO: 447868 - DNA, 20 bp, Artificial Sequence
  chemically synthesized
aaaataaaaggaaaatttag

SEQ ID NO: 447869 - DNA, 20 bp, Artificial Sequence
  chemically synthesized
aaataaaaggaaaatttaga

SEQ ID NO: 447870 - DNA, 20 bp, Artificial Sequence
  chemically synthesized
ggaaaatttagaaggtgaac

SEQ ID NO: 447871 - DNA, 20 bp, Artificial Sequence
  chemically synthesized
acaacaacacagaatagatc

SEQ ID NO: 447872 - DNA, 20 bp, Artificial Sequence
  chemically synthesized
aacaagacaacaacacagaa

SEQ ID NO: 447873 - DNA, 20 bp, Artificial Sequence
  chemically synthesized
agcagaacaagacaacaaca

SEQ ID NO: 447874 - DNA, 20 bp, Artificial Sequence
  chemically synthesized
attcataacttcagcagaac

SEQ ID NO: 447875 - DNA, 20 bp, Artificial Sequence
  chemically synthesized
gttgttgtcttgttctgctg

SEQ ID NO: 447876 - DNA, 20 bp, Artificial Sequence
  chemically synthesized
caaatcattcataacttcag

SEQ ID NO: 447877 - DNA, 20 bp, Artificial Sequence
  chemically synthesized
tcacaaatcattcataactt

SEQ ID NO: 447878 - DNA, 20 bp, Artificial Sequence
  chemically synthesized
gttatgaatgatttgtgatg

SEQ ID NO: 447879 - DNA, 20 bp, Artificial Sequence
  chemically synthesized
aatgatttgtgatgaagtcc

SEQ ID NO: 447880 - DNA, 20 bp, Artificial Sequence
  chemically synthesized
tttgtgatgaagtccaagta

SEQ ID NO: 447881 - DNA, 20 bp, Artificial Sequence
  chemically synthesized
ttgtgatgaagtccaagtat

SEQ ID NO: 447882 - DNA, 20 bp, Artificial Sequence
  chemically synthesized
tctagactgaggcccatact

SEQ ID NO: 447883 - DNA, 20 bp, Artificial Sequence
  chemically synthesized
tgaagtccaagtatgggcct

SEQ ID NO: 447884 - DNA, 20 bp, Artificial Sequence
  chemically synthesized
tccaagtatgggcctcagtc

SEQ ID NO: 447885 - DNA, 20 bp, Artificial Sequence
  chemically synthesized
caagtatgggcctcagtcta

SEQ ID NO: 447886 - DNA, 20 bp, Artificial Sequence
  chemically synthesized
ccagccagttctctagactg

SEQ ID NO: 447887 - DNA, 20 bp, Artificial Sequence
  chemically synthesized
gccagccagttctctagact

SEQ ID NO: 447888 - DNA, 20 bp, Artificial Sequence
  chemically synthesized
tgggcctcagtctagagaac

SEQ ID NO: 447889 - DNA, 20 bp, Artificial Sequence
  chemically synthesized
gttttggccagccagttctc

SEQ ID NO: 447890 - DNA, 20 bp, Artificial Sequence
  chemically synthesized
cctcagtctagagaactggc

SEQ ID NO: 447891 - DNA, 20 bp, Artificial Sequence
  chemically synthesized
tcatagttgttttggccagc

SEQ ID NO: 447892 - DNA, 20 bp, Artificial Sequence
  chemically synthesized
aaattcatagttgttttggc

SEQ ID NO: 447893 - DNA, 20 bp, Artificial Sequence
  chemically synthesized
gttaaaattcatagttgttt

SEQ ID NO: 447894 - DNA, 20 bp, Artificial Sequence
  chemically synthesized
tgcaattctgttaaaattca

SEQ ID NO: 447895 - DNA, 20 bp, Artificial Sequence
  chemically synthesized
aaaacaactatgaattttaa

SEQ ID NO: 447896 - DNA, 20 bp, Artificial Sequence
  chemically synthesized
aattttaacagaattgcatg

SEQ ID NO: 447897 - DNA, 20 bp, Artificial Sequence
  chemically synthesized
aacagaattgcatgaagtgc

SEQ ID NO: 447898 - DNA, 20 bp, Artificial Sequence
  chemically synthesized
tgcatgaagtgctagaatct

SEQ ID NO: 447899 - DNA, 20 bp, Artificial Sequence
  chemically synthesized
attcatttaaactgagattc

SEQ ID NO: 447900 - DNA, 20 bp, Artificial Sequence
  chemically synthesized
ccactgcattcatttaaact

SEQ ID NO: 447901 - DNA, 20 bp, Artificial Sequence
  chemically synthesized
aatctcagtttaaatgaatg

SEQ ID NO: 447902 - DNA, 20 bp, Artificial Sequence
  chemically synthesized
ctcagtttaaatgaatgcag

SEQ ID NO: 447903 - DNA, 20 bp, Artificial Sequence
  chemically synthesized
gtctactgactatttagaag

SEQ ID NO: 447904 - DNA, 20 bp, Artificial Sequence
  chemically synthesized
atgcagtggctacttctaaa

SEQ ID NO: 447905 - DNA, 20 bp, Artificial Sequence
  chemically synthesized
agagtctactgactatttag

SEQ ID NO: 447906 - DNA, 20 bp, Artificial Sequence
  chemically synthesized
agtggctacttctaaatagt

SEQ ID NO: 447907 - DNA, 20 bp, Artificial Sequence
  chemically synthesized
agtagagtctactgactatt

SEQ ID NO: 447908 - DNA, 20 bp, Artificial Sequence
  chemically synthesized
ggctacttctaaatagtcag

SEQ ID NO: 447909 - DNA, 20 bp, Artificial Sequence
  chemically synthesized
tacttctatgatacaaagta

SEQ ID NO: 447910 - DNA, 20 bp, Artificial Sequence
  chemically synthesized
attacttctatgatacaaag

SEQ ID NO: 447911 - DNA, 20 bp, Artificial Sequence
  chemically synthesized
gtagactctactttgtatca

SEQ ID NO: 447912 - DNA, 20 bp, Artificial Sequence
  chemically synthesized
agtattacttctatgataca

SEQ ID NO: 447913 - DNA, 20 bp, Artificial Sequence
  chemically synthesized
gactctactttgtatcatag

SEQ ID NO: 447914 - DNA, 20 bp, Artificial Sequence
  chemically synthesized
caacaaagttgtaaatttac

SEQ ID NO: 447915 - DNA, 20 bp, Artificial Sequence
  chemically synthesized
aaatttacaactttgttgat

SEQ ID NO: 447916 - DNA, 20 bp, Artificial Sequence
  chemically synthesized
tcatgcaaaactcatcaaca

SEQ ID NO: 447917 - DNA, 20 bp, Artificial Sequence
  chemically synthesized
caaatttttctttaaaaatg

SEQ ID NO: 447918 - DNA, 20 bp, Artificial Sequence
  chemically synthesized
tgcatgattccacattttta

SEQ ID NO: 447919 - DNA, 20 bp, Artificial Sequence
  chemically synthesized
ttacaaaaatatgttcagtt

SEQ ID NO: 447920 - DNA, 20 bp, Artificial Sequence
  chemically synthesized
atggattacaaaaatatgtt

SEQ ID NO: 447921 - DNA, 20 bp, Artificial Sequence
  chemically synthesized
acatatttttgtaatccatt

SEQ ID NO: 447922 - DNA, 20 bp, Artificial Sequence
  chemically synthesized
tttttgtaatccattaagaa

SEQ ID NO: 447923 - DNA, 20 bp, Artificial Sequence
  chemically synthesized
agttttcattctgttcttaa

SEQ ID NO: 447924 - DNA, 20 bp, Artificial Sequence
  chemically synthesized
acatagatcatattgttatt

SEQ ID NO: 447925 - DNA, 20 bp, Artificial Sequence
  chemically synthesized
attaggttttgggtacaaca

SEQ ID NO: 447926 - DNA, 20 bp, Artificial Sequence
  chemically synthesized
aggaaaatacattaggtttt

SEQ ID NO: 447927 - DNA, 20 bp, Artificial Sequence
  chemically synthesized
caggaaaatacattaggttt

SEQ ID NO: 447928 - DNA, 20 bp, Artificial Sequence
  chemically synthesized
tttttacaggaaaatacatt

SEQ ID NO: 447929 - DNA, 20 bp, Artificial Sequence
  chemically synthesized
ttttttacaggaaaatacat

SEQ ID NO: 447930 - DNA, 20 bp, Artificial Sequence
  chemically synthesized
ctagatttttatttttttac

SEQ ID NO: 447931 - DNA, 20 bp, Artificial Sequence
  chemically synthesized
gctagatttttattttttta

SEQ ID NO: 447932 - DNA, 20 bp, Artificial Sequence
  chemically synthesized
cctgtaaaaaaataaaaatc

SEQ ID NO: 447933 - DNA, 20 bp, Artificial Sequence
  chemically synthesized
gtgttcctagttacagaagc

SEQ ID NO: 447934 - DNA, 20 bp, Artificial Sequence
  chemically synthesized
aaaaatctagcttctgtaac

SEQ ID NO: 447935 - DNA, 20 bp, Artificial Sequence
  chemically synthesized
tgtagtgttcctagttacag

SEQ ID NO: 447936 - DNA, 20 bp, Artificial Sequence
  chemically synthesized
aaaatctagcttctgtaact

SEQ ID NO: 447937 - DNA, 20 bp, Artificial Sequence
  chemically synthesized
ttttgtagtgttcctagtta

SEQ ID NO: 447938 - DNA, 20 bp, Artificial Sequence
  chemically synthesized
tttcagttttgtagtgttcc

SEQ ID NO: 447939 - DNA, 20 bp, Artificial Sequence
  chemically synthesized
agtctacagtttcagttttg

SEQ ID NO: 447940 - DNA, 20 bp, Artificial Sequence
  chemically synthesized
acactacaaaactgaaactg

SEQ ID NO: 447941 - DNA, 20 bp, Artificial Sequence
  chemically synthesized
aattaaagagtctacagttt

SEQ ID NO: 447942 - DNA, 20 bp, Artificial Sequence
  chemically synthesized
ccctgaaattaaagagtcta

SEQ ID NO: 447943 - DNA, 20 bp, Artificial Sequence
  chemically synthesized
tcatgaaccctgaaattaaa

SEQ ID NO: 447944 - DNA, 20 bp, Artificial Sequence
  chemically synthesized
aactgtagactctttaattt

SEQ ID NO: 447945 - DNA, 20 bp, Artificial Sequence
  chemically synthesized
actgtagactctttaatttc

SEQ ID NO: 447946 - DNA, 20 bp, Artificial Sequence
  chemically synthesized
cttcatgaaccctgaaatta

SEQ ID NO: 447947 - DNA, 20 bp, Artificial Sequence
  chemically synthesized
ctgtagactctttaatttca

SEQ ID NO: 447948 - DNA, 20 bp, Artificial Sequence
  chemically synthesized
ctttaatttcagggttcatg

SEQ ID NO: 447949 - DNA, 20 bp, Artificial Sequence
  chemically synthesized
tttaatttcagggttcatga

SEQ ID NO: 447950 - DNA, 20 bp, Artificial Sequence
  chemically synthesized
attaatgtaacatgtcagta

SEQ ID NO: 447951 - DNA, 20 bp, Artificial Sequence
  chemically synthesized
agagtattaatgtaacatgt

SEQ ID NO: 447952 - DNA, 20 bp, Artificial Sequence
  chemically synthesized
gacatgttacattaatactc

SEQ ID NO: 447953 - DNA, 20 bp, Artificial Sequence
  chemically synthesized
acatgttacattaatactct

SEQ ID NO: 447954 - DNA, 20 bp, Artificial Sequence
  chemically synthesized
acttctaacattaattccta

SEQ ID NO: 447955 - DNA, 20 bp, Artificial Sequence
  chemically synthesized
atacttctaacattaattcc

SEQ ID NO: 447956 - DNA, 20 bp, Artificial Sequence
  chemically synthesized
aatactctaggaattaatgt

SEQ ID NO: 447957 - DNA, 20 bp, Artificial Sequence
  chemically synthesized
actctaggaattaatgttag

SEQ ID NO: 447958 - DNA, 20 bp, Artificial Sequence
  chemically synthesized
aatgttagaagtatttgaac

SEQ ID NO: 447959 - DNA, 20 bp, Artificial Sequence
  chemically synthesized
cattaacatatattgaatac

SEQ ID NO: 447960 - DNA, 20 bp, Artificial Sequence
  chemically synthesized
caatatatgttaatgaaatg

SEQ ID NO: 447961 - DNA, 20 bp, Artificial Sequence
  chemically synthesized
aatgtagtacatatccccat

SEQ ID NO: 447962 - DNA, 20 bp, Artificial Sequence
  chemically synthesized
cgattaggtcacaaccaatg

SEQ ID NO: 447963 - DNA, 20 bp, Artificial Sequence
  chemically synthesized
acgattaggtcacaaccaat

SEQ ID NO: 447964 - DNA, 20 bp, Artificial Sequence
  chemically synthesized
aacgattaggtcacaaccaa

SEQ ID NO: 447965 - DNA, 20 bp, Artificial Sequence
  chemically synthesized
gtacgtatttaaaaacgatt

SEQ ID NO: 447966 - DNA, 20 bp, Artificial Sequence
  chemically synthesized
tgtacgtatttaaaaacgat

SEQ ID NO: 447967 - DNA, 20 bp, Artificial Sequence
  chemically synthesized
aatacgtacattacatttga

SEQ ID NO: 447968 - DNA, 20 bp, Artificial Sequence
  chemically synthesized
aaaaagcaggattcataatt

SEQ ID NO: 447969 - DNA, 20 bp, Artificial Sequence
  chemically synthesized
atattccaccttgaaaaagc

SEQ ID NO: 447970 - DNA, 20 bp, Artificial Sequence
  chemically synthesized
attatgaatcctgctttttc

SEQ ID NO: 447971 - DNA, 20 bp, Artificial Sequence
  chemically synthesized
gatattccaccttgaaaaag

SEQ ID NO: 447972 - DNA, 20 bp, Artificial Sequence
  chemically synthesized
ttatgaatcctgctttttca

SEQ ID NO: 447973 - DNA, 20 bp, Artificial Sequence
  chemically synthesized
tcagatattccaccttgaaa

SEQ ID NO: 447974 - DNA, 20 bp, Artificial Sequence
  chemically synthesized
tgaatcctgctttttcaagg

SEQ ID NO: 447975 - DNA, 20 bp, Artificial Sequence
  chemically synthesized
tttttcaaggtggaatatct

SEQ ID NO: 447976 - DNA, 20 bp, Artificial Sequence
  chemically synthesized
gatcagtgaaacaagtttct

SEQ ID NO: 447977 - DNA, 20 bp, Artificial Sequence
  chemically synthesized
ggacatttgatcagtgaaac

SEQ ID NO: 447978 - DNA, 20 bp, Artificial Sequence
  chemically synthesized
atcacatcaggacatttgat

SEQ ID NO: 447979 - DNA, 20 bp, Artificial Sequence
  chemically synthesized
ctgtatcttaatatcacatc

SEQ ID NO: 447980 - DNA, 20 bp, Artificial Sequence
  chemically synthesized
actgtatcttaatatcacat

SEQ ID NO: 447981 - DNA, 20 bp, Artificial Sequence
  chemically synthesized
aaatgtcctgatgtgatatt

SEQ ID NO: 447982 - DNA, 20 bp, Artificial Sequence
  chemically synthesized
cctgatgtgatattaagata

SEQ ID NO: 447983 - DNA, 20 bp, Artificial Sequence
  chemically synthesized
tattaagatacagtactaaa

SEQ ID NO: 447984 - DNA, 20 bp, Artificial Sequence
  chemically synthesized
gctcactgcctcaggctgtt

SEQ ID NO: 447985 - DNA, 20 bp, Artificial Sequence
  chemically synthesized
gatacagtactaaacagcct

SEQ ID NO: 447986 - DNA, 20 bp, Artificial Sequence
  chemically synthesized
atacagtactaaacagcctg

SEQ ID NO: 447987 - DNA, 20 bp, Artificial Sequence
  chemically synthesized
cagtactaaacagcctgagg

SEQ ID NO: 447988 - DNA, 20 bp, Artificial Sequence
  chemically synthesized
gactaaatgctcactgcctc

SEQ ID NO: 447989 - DNA, 20 bp, Artificial Sequence
  chemically synthesized
actaaacagcctgaggcagt

SEQ ID NO: 447990 - DNA, 20 bp, Artificial Sequence
  chemically synthesized
agactaaatgctcactgcct

SEQ ID NO: 447991 - DNA, 20 bp, Artificial Sequence
  chemically synthesized
agcctgaggcagtgagcatt

SEQ ID NO: 447992 - DNA, 20 bp, Artificial Sequence
  chemically synthesized
agtgagcatttagtctaatc

SEQ ID NO: 447993 - DNA, 20 bp, Artificial Sequence
  chemically synthesized
agcatttagtctaatctggc

SEQ ID NO: 447994 - DNA, 20 bp, Artificial Sequence
  chemically synthesized
gtgttctgcactggccagat

SEQ ID NO: 447995 - DNA, 20 bp, Artificial Sequence
  chemically synthesized
ttagtctaatctggccagtg

SEQ ID NO: 447996 - DNA, 20 bp, Artificial Sequence
  chemically synthesized
caggtgtgttctgcactggc

SEQ ID NO: 447997 - DNA, 20 bp, Artificial Sequence
  chemically synthesized
ggcccaggtgtgttctgcac

SEQ ID NO: 447998 - DNA, 20 bp, Artificial Sequence
  chemically synthesized
tggccagtgcagaacacacc

SEQ ID NO: 447999 - DNA, 20 bp, Artificial Sequence
  chemically synthesized
ggccagtgcagaacacacct

SEQ ID NO: 448000 - DNA, 20 bp, Artificial Sequence
  chemically synthesized
cagcaaccccagggaggccc

SEQ ID NO: 448001 - DNA, 20 bp, Artificial Sequence
  chemically synthesized
acagcaaccccagggaggcc

SEQ ID NO: 448002 - DNA, 20 bp, Artificial Sequence
  chemically synthesized
agaacacacctgggcctccc

SEQ ID NO: 448003 - DNA, 20 bp, Artificial Sequence
  chemically synthesized
gaacacacctgggcctccct

SEQ ID NO: 448004 - DNA, 20 bp, Artificial Sequence
  chemically synthesized
aacacacctgggcctccctg

SEQ ID NO: 448005 - DNA, 20 bp, Artificial Sequence
  chemically synthesized
tcaccacagcaaccccaggg

SEQ ID NO: 448006 - DNA, 20 bp, Artificial Sequence
  chemically synthesized
gtcaccacagcaaccccagg

SEQ ID NO: 448007 - DNA, 20 bp, Artificial Sequence
  chemically synthesized
tggtcaccacagcaacccca

SEQ ID NO: 448008 - DNA, 20 bp, Artificial Sequence
  chemically synthesized
atggtcaccacagcaacccc

SEQ ID NO: 448009 - DNA, 20 bp, Artificial Sequence
  chemically synthesized
aatggtcaccacagcaaccc

SEQ ID NO: 448010 - DNA, 20 bp, Artificial Sequence
  chemically synthesized
gggcctccctggggttgctg

SEQ ID NO: 448011 - DNA, 20 bp, Artificial Sequence
  chemically synthesized
agatggcagaatggtcacca

SEQ ID NO: 448012 - DNA, 20 bp, Artificial Sequence
  chemically synthesized
ctgaggactagatggcagaa

SEQ ID NO: 448013 - DNA, 20 bp, Artificial Sequence
  chemically synthesized
gtggtgaccattctgccatc

SEQ ID NO: 448014 - DNA, 20 bp, Artificial Sequence
  chemically synthesized
tgatgctgaggactagatgg

SEQ ID NO: 448015 - DNA, 20 bp, Artificial Sequence
  chemically synthesized
tgatgatgctgaggactaga

SEQ ID NO: 448016 - DNA, 20 bp, Artificial Sequence
  chemically synthesized
ccattctgccatctagtcct

SEQ ID NO: 448017 - DNA, 20 bp, Artificial Sequence
  chemically synthesized
accctgatgatgctgaggac

SEQ ID NO: 448018 - DNA, 20 bp, Artificial Sequence
  chemically synthesized
tgttgaccctgatgatgctg

SEQ ID NO: 448019 - DNA, 20 bp, Artificial Sequence
  chemically synthesized
ttgttgaccctgatgatgct

SEQ ID NO: 448020 - DNA, 20 bp, Artificial Sequence
  chemically synthesized
catctagtcctcagcatcat

SEQ ID NO: 448021 - DNA, 20 bp, Artificial Sequence
  chemically synthesized
atctagtcctcagcatcatc

SEQ ID NO: 448022 - DNA, 20 bp, Artificial Sequence
  chemically synthesized
tctagtcctcagcatcatca

SEQ ID NO: 448023 - DNA, 20 bp, Artificial Sequence
  chemically synthesized
tcagcatcatcagggtcaac

SEQ ID NO: 448024 - DNA, 20 bp, Artificial Sequence
  chemically synthesized
catcagggtcaacaagctaa

SEQ ID NO: 448025 - DNA, 20 bp, Artificial Sequence
  chemically synthesized
cagggtcaacaagctaacag

SEQ ID NO: 448026 - DNA, 20 bp, Artificial Sequence
  chemically synthesized
aacaactctgttgccactgt

SEQ ID NO: 448027 - DNA, 20 bp, Artificial Sequence
  chemically synthesized
caacaagctaacagtggcaa

SEQ ID NO: 448028 - DNA, 20 bp, Artificial Sequence
  chemically synthesized
acaagctaacagtggcaaca

SEQ ID NO: 448029 - DNA, 20 bp, Artificial Sequence
  chemically synthesized
acagagttgtttcatttata

SEQ ID NO: 448030 - DNA, 20 bp, Artificial Sequence
  chemically synthesized
ttgtttcatttatacagttc

SEQ ID NO: 448031 - DNA, 20 bp, Artificial Sequence
  chemically synthesized
caggaaggcaacgatatcac

SEQ ID NO: 448032 - DNA, 20 bp, Artificial Sequence
  chemically synthesized
cagtgatatcgttgccttcc

SEQ ID NO: 448033 - DNA, 20 bp, Artificial Sequence
  chemically synthesized
gaaacacaacacagccagga

SEQ ID NO: 448034 - DNA, 20 bp, Artificial Sequence
  chemically synthesized
agaaacacaacacagccagg

SEQ ID NO: 448035 - DNA, 20 bp, Artificial Sequence
  chemically synthesized
attagaaacacaacacagcc

SEQ ID NO: 448036 - DNA, 20 bp, Artificial Sequence
  chemically synthesized
cattagaaacacaacacagc

SEQ ID NO: 448037 - DNA, 20 bp, Artificial Sequence
  chemically synthesized
gcaacattagaaacacaaca

SEQ ID NO: 448038 - DNA, 20 bp, Artificial Sequence
  chemically synthesized
caaagagctaggagcaacat

SEQ ID NO: 448039 - DNA, 20 bp, Artificial Sequence
  chemically synthesized
tgtgtttctaatgttgctcc

SEQ ID NO: 448040 - DNA, 20 bp, Artificial Sequence
  chemically synthesized
aaatggtggcaaagagctag

SEQ ID NO: 448041 - DNA, 20 bp, Artificial Sequence
  chemically synthesized
agaaatggtggcaaagagct

SEQ ID NO: 448042 - DNA, 20 bp, Artificial Sequence
  chemically synthesized
tagaaatggtggcaaagagc

SEQ ID NO: 448043 - DNA, 20 bp, Artificial Sequence
  chemically synthesized
gaattagaaatggtggcaaa

SEQ ID NO: 448044 - DNA, 20 bp, Artificial Sequence
  chemically synthesized
aagaattagaaatggtggca

SEQ ID NO: 448045 - DNA, 20 bp, Artificial Sequence
  chemically synthesized
agcagaagaattagaaatgg

SEQ ID NO: 448046 - DNA, 20 bp, Artificial Sequence
  chemically synthesized
gggagcagaagaattagaaa

SEQ ID NO: 448047 - DNA, 20 bp, Artificial Sequence
  chemically synthesized
ctcttggggagcagaagaat

SEQ ID NO: 448048 - DNA, 20 bp, Artificial Sequence
  chemically synthesized
caaagactcttggggagcag

SEQ ID NO: 448049 - DNA, 20 bp, Artificial Sequence
  chemically synthesized
ttctaattcttctgctcccc

SEQ ID NO: 448050 - DNA, 20 bp, Artificial Sequence
  chemically synthesized
tatcaaagactcttggggag

SEQ ID NO: 448051 - DNA, 20 bp, Artificial Sequence
  chemically synthesized
ctaattcttctgctccccaa

SEQ ID NO: 448052 - DNA, 20 bp, Artificial Sequence
  chemically synthesized
taatatcaaagactcttggg

SEQ ID NO: 448053 - DNA, 20 bp, Artificial Sequence
  chemically synthesized
gataatatcaaagactcttg

SEQ ID NO: 448054 - DNA, 20 bp, Artificial Sequence
  chemically synthesized
agataatatcaaagactctt

SEQ ID NO: 448055 - DNA, 20 bp, Artificial Sequence
  chemically synthesized
aagataatatcaaagactct

SEQ ID NO: 448056 - DNA, 20 bp, Artificial Sequence
  chemically synthesized
ccacactaaagataatatca

SEQ ID NO: 448057 - DNA, 20 bp, Artificial Sequence
  chemically synthesized
agagtctttgatattatctt

SEQ ID NO: 448058 - DNA, 20 bp, Artificial Sequence
  chemically synthesized
ctttgatattatctttagtg

SEQ ID NO: 448059 - DNA, 20 bp, Artificial Sequence
  chemically synthesized
aaacagtaagggccacacta

SEQ ID NO: 448060 - DNA, 20 bp, Artificial Sequence
  chemically synthesized
atctctagggtaaacagtaa

SEQ ID NO: 448061 - DNA, 20 bp, Artificial Sequence
  chemically synthesized
tatctctagggtaaacagta

SEQ ID NO: 448062 - DNA, 20 bp, Artificial Sequence
  chemically synthesized
ctatctctagggtaaacagt

SEQ ID NO: 448063 - DNA, 20 bp, Artificial Sequence
  chemically synthesized
gtggcccttactgtttaccc

SEQ ID NO: 448064 - DNA, 20 bp, Artificial Sequence
  chemically synthesized
ttcactatctctagggtaaa

SEQ ID NO: 448065 - DNA, 20 bp, Artificial Sequence
  chemically synthesized
ggcccttactgtttacccta

SEQ ID NO: 448066 - DNA, 20 bp, Artificial Sequence
  chemically synthesized
cttactgtttaccctagaga

SEQ ID NO: 448067 - DNA, 20 bp, Artificial Sequence
  chemically synthesized
aacagaattcactatctcta

SEQ ID NO: 448068 - DNA, 20 bp, Artificial Sequence
  chemically synthesized
taacagaattcactatctct

SEQ ID NO: 448069 - DNA, 20 bp, Artificial Sequence
  chemically synthesized
gtaacagaattcactatctc

SEQ ID NO: 448070 - DNA, 20 bp, Artificial Sequence
  chemically synthesized
tgtcctaaattgtcaagtaa

SEQ ID NO: 448071 - DNA, 20 bp, Artificial Sequence
  chemically synthesized
aattctgttacttgacaatt

SEQ ID NO: 448072 - DNA, 20 bp, Artificial Sequence
  chemically synthesized
catcagtgtcctaaattgtc

SEQ ID NO: 448073 - DNA, 20 bp, Artificial Sequence
  chemically synthesized
attctgttacttgacaattt

SEQ ID NO: 448074 - DNA, 20 bp, Artificial Sequence
  chemically synthesized
caatttaggacactgatgaa

SEQ ID NO: 448075 - DNA, 20 bp, Artificial Sequence
  chemically synthesized
ttatactttattctgttcat

SEQ ID NO: 448076 - DNA, 20 bp, Artificial Sequence
  chemically synthesized
ggacactgatgaacagaata

SEQ ID NO: 448077 - DNA, 20 bp, Artificial Sequence
  chemically synthesized
ataattgtatcaatgtctat

SEQ ID NO: 448078 - DNA, 20 bp, Artificial Sequence
  chemically synthesized
attgtatcaatgtctataag

SEQ ID NO: 448079 - DNA, 20 bp, Artificial Sequence
  chemically synthesized
aatttttaaatggctactta

SEQ ID NO: 448080 - DNA, 20 bp, Artificial Sequence
  chemically synthesized
cttatgtataaatttttaaa

SEQ ID NO: 448081 - DNA, 20 bp, Artificial Sequence
  chemically synthesized
ccatttaaaaatttatacat

SEQ ID NO: 448082 - DNA, 20 bp, Artificial Sequence
  chemically synthesized
atacataagaatcattctct

SEQ ID NO: 448083 - DNA, 20 bp, Artificial Sequence
  chemically synthesized
tacataagaatcattctctc

SEQ ID NO: 448084 - DNA, 20 bp, Artificial Sequence
  chemically synthesized
taatttcatttaatgcctga

SEQ ID NO: 448085 - DNA, 20 bp, Artificial Sequence
  chemically synthesized
tctaatttcatttaatgcct

SEQ ID NO: 448086 - DNA, 20 bp, Artificial Sequence
  chemically synthesized
tctcaggcattaaatgaaat

SEQ ID NO: 448087 - DNA, 20 bp, Artificial Sequence
  chemically synthesized
tcaggcattaaatgaaatta

SEQ ID NO: 448088 - DNA, 20 bp, Artificial Sequence
  chemically synthesized
tagagaaattatttcatttt

SEQ ID NO: 448089 - DNA, 20 bp, Artificial Sequence
  chemically synthesized
acaaaacaaaacaaacaaac

SEQ ID NO: 448090 - DNA, 20 bp, Artificial Sequence
  chemically synthesized
ttgttttgttttgttttttt

SEQ ID NO: 448091 - DNA, 20 bp, Artificial Sequence
  chemically synthesized
tttgttttgtttttttgaga

SEQ ID NO: 448092 - DNA, 20 bp, Artificial Sequence
  chemically synthesized
tccagcctgggcaacagagc

SEQ ID NO: 448093 - DNA, 20 bp, Artificial Sequence
  chemically synthesized
tggaatctcgctctgttgcc

SEQ ID NO: 448094 - DNA, 20 bp, Artificial Sequence
  chemically synthesized
acactccagcctgggcaaca

SEQ ID NO: 448095 - DNA, 20 bp, Artificial Sequence
  chemically synthesized
ggaatctcgctctgttgccc

SEQ ID NO: 448096 - DNA, 20 bp, Artificial Sequence
  chemically synthesized
ccacactccagcctgggcaa

SEQ ID NO: 448097 - DNA, 20 bp, Artificial Sequence
  chemically synthesized
tctcgctctgttgcccaggc

SEQ ID NO: 448098 - DNA, 20 bp, Artificial Sequence
  chemically synthesized
tcgctctgttgcccaggctg

SEQ ID NO: 448099 - DNA, 20 bp, Artificial Sequence
  chemically synthesized
gcgccaccacactccagcct

SEQ ID NO: 448100 - DNA, 20 bp, Artificial Sequence
  chemically synthesized
cgcgccaccacactccagcc

SEQ ID NO: 448101 - DNA, 20 bp, Artificial Sequence
  chemically synthesized
ctgttgcccaggctggagtg

SEQ ID NO: 448102 - DNA, 20 bp, Artificial Sequence
  chemically synthesized
gaggtcgcgccaccacactc

SEQ ID NO: 448103 - DNA, 20 bp, Artificial Sequence
  chemically synthesized
ttgcccaggctggagtgtgg

SEQ ID NO: 448104 - DNA, 20 bp, Artificial Sequence
  chemically synthesized
ggagtgtggtggcgcgacct

SEQ ID NO: 448105 - DNA, 20 bp, Artificial Sequence
  chemically synthesized
gtggacgttgcagtgagctg

SEQ ID NO: 448106 - DNA, 20 bp, Artificial Sequence
  chemically synthesized
ggtggacgttgcagtgagct

SEQ ID NO: 448107 - DNA, 20 bp, Artificial Sequence
  chemically synthesized
cggaaggtggacgttgcagt

SEQ ID NO: 448108 - DNA, 20 bp, Artificial Sequence
  chemically synthesized
aacccggaaggtggacgttg

SEQ ID NO: 448109 - DNA, 20 bp, Artificial Sequence
  chemically synthesized
tcactgcaacgtccaccttc

SEQ ID NO: 448110 - DNA, 20 bp, Artificial Sequence
  chemically synthesized
cactgcaacgtccaccttcc

SEQ ID NO: 448111 - DNA, 20 bp, Artificial Sequence
  chemically synthesized
agtctcttgaacccggaagg

SEQ ID NO: 448112 - DNA, 20 bp, Artificial Sequence
  chemically synthesized
gagagtctcttgaacccgga

SEQ ID NO: 448113 - DNA, 20 bp, Artificial Sequence
  chemically synthesized
ggagagtctcttgaacccgg

SEQ ID NO: 448114 - DNA, 20 bp, Artificial Sequence
  chemically synthesized
aacgtccaccttccgggttc

SEQ ID NO: 448115 - DNA, 20 bp, Artificial Sequence
  chemically synthesized
cgtccaccttccgggttcaa

SEQ ID NO: 448116 - DNA, 20 bp, Artificial Sequence
  chemically synthesized
gcaggagagtctcttgaacc

SEQ ID NO: 448117 - DNA, 20 bp, Artificial Sequence
  chemically synthesized
ttcaggaggctgaggcagga

SEQ ID NO: 448118 - DNA, 20 bp, Artificial Sequence
  chemically synthesized
ttcaagagactctcctgcct

SEQ ID NO: 448119 - DNA, 20 bp, Artificial Sequence
  chemically synthesized
tattcaggaggctgaggcag

SEQ ID NO: 448120 - DNA, 20 bp, Artificial Sequence
  chemically synthesized
gctattcaggaggctgaggc

SEQ ID NO: 448121 - DNA, 20 bp, Artificial Sequence
  chemically synthesized
agctattcaggaggctgagg

SEQ ID NO: 448122 - DNA, 20 bp, Artificial Sequence
  chemically synthesized
cccagctattcaggaggctg

SEQ ID NO: 448123 - DNA, 20 bp, Artificial Sequence
  chemically synthesized
tcccagctattcaggaggct

SEQ ID NO: 448124 - DNA, 20 bp, Artificial Sequence
  chemically synthesized
tcctgcctcagcctcctgaa

SEQ ID NO: 448125 - DNA, 20 bp, Artificial Sequence
  chemically synthesized
tgtaatcccagctattcagg

SEQ ID NO: 448126 - DNA, 20 bp, Artificial Sequence
  chemically synthesized
ctgtaatcccagctattcag

SEQ ID NO: 448127 - DNA, 20 bp, Artificial Sequence
  chemically synthesized
gcctcagcctcctgaatagc

SEQ ID NO: 448128 - DNA, 20 bp, Artificial Sequence
  chemically synthesized
gcctgtaatcccagctattc

SEQ ID NO: 448129 - DNA, 20 bp, Artificial Sequence
  chemically synthesized
cctcagcctcctgaatagct

SEQ ID NO: 448130 - DNA, 20 bp, Artificial Sequence
  chemically synthesized
cgcctgtaatcccagctatt

SEQ ID NO: 448131 - DNA, 20 bp, Artificial Sequence
  chemically synthesized
ctcctgaatagctgggatta

SEQ ID NO: 448132 - DNA, 20 bp, Artificial Sequence
  chemically synthesized
tcctgaatagctgggattac

SEQ ID NO: 448133 - DNA, 20 bp, Artificial Sequence
  chemically synthesized
gtggtgtgcgcctgtaatcc

SEQ ID NO: 448134 - DNA, 20 bp, Artificial Sequence
  chemically synthesized
caggcgcacaccaccacccc

SEQ ID NO: 448135 - DNA, 20 bp, Artificial Sequence
  chemically synthesized
caaaaattagctgggggtgg

SEQ ID NO: 448136 - DNA, 20 bp, Artificial Sequence
  chemically synthesized
ctacaaaaattagctggggg

SEQ ID NO: 448137 - DNA, 20 bp, Artificial Sequence
  chemically synthesized
aaactacaaaaattagctgg

SEQ ID NO: 448138 - DNA, 20 bp, Artificial Sequence
  chemically synthesized
aaaactacaaaaattagctg

SEQ ID NO: 448139 - DNA, 20 bp, Artificial Sequence
  chemically synthesized
taaaactacaaaaattagct

SEQ ID NO: 448140 - DNA, 20 bp, Artificial Sequence
  chemically synthesized
ctaaaactacaaaaattagc

SEQ ID NO: 448141 - DNA, 20 bp, Artificial Sequence
  chemically synthesized
ccacccccagctaatttttg

SEQ ID NO: 448142 - DNA, 20 bp, Artificial Sequence
  chemically synthesized
tctactaaaactacaaaaat

SEQ ID NO: 448143 - DNA, 20 bp, Artificial Sequence
  chemically synthesized
ccagctaatttttgtagttt

SEQ ID NO: 448144 - DNA, 20 bp, Artificial Sequence
  chemically synthesized
gctaatttttgtagttttag

SEQ ID NO: 448145 - DNA, 20 bp, Artificial Sequence
  chemically synthesized
taatttttgtagttttagta

SEQ ID NO: 448146 - DNA, 20 bp, Artificial Sequence
  chemically synthesized
ttttgtagttttagtagaga

SEQ ID NO: 448147 - DNA, 20 bp, Artificial Sequence
  chemically synthesized
tttgtagttttagtagagac

SEQ ID NO: 448148 - DNA, 20 bp, Artificial Sequence
  chemically synthesized
ttgtagttttagtagagacg

SEQ ID NO: 448149 - DNA, 20 bp, Artificial Sequence
  chemically synthesized
ccagcctgacaagcatggtg

SEQ ID NO: 448150 - DNA, 20 bp, Artificial Sequence
  chemically synthesized
cggggcttcaccatgcttgt

SEQ ID NO: 448151 - DNA, 20 bp, Artificial Sequence
  chemically synthesized
cgagaccagcctgacaagca

SEQ ID NO: 448152 - DNA, 20 bp, Artificial Sequence
  chemically synthesized
ggggcttcaccatgcttgtc

SEQ ID NO: 448153 - DNA, 20 bp, Artificial Sequence
  chemically synthesized
cttcaccatgcttgtcaggc

SEQ ID NO: 448154 - DNA, 20 bp, Artificial Sequence
  chemically synthesized
gagttcgagaccagcctgac

SEQ ID NO: 448155 - DNA, 20 bp, Artificial Sequence
  chemically synthesized
tgaggtcaggagttcgagac

SEQ ID NO: 448156 - DNA, 20 bp, Artificial Sequence
  chemically synthesized
gatcatgaggtcaggagttc

SEQ ID NO: 448157 - DNA, 20 bp, Artificial Sequence
  chemically synthesized
tgggcagatcatgaggtcag

SEQ ID NO: 448158 - DNA, 20 bp, Artificial Sequence
  chemically synthesized
ggtgggcagatcatgaggtc

SEQ ID NO: 448159 - DNA, 20 bp, Artificial Sequence
  chemically synthesized
aggtgggcagatcatgaggt

SEQ ID NO: 448160 - DNA, 20 bp, Artificial Sequence
  chemically synthesized
gctgaggtgggcagatcatg

SEQ ID NO: 448161 - DNA, 20 bp, Artificial Sequence
  chemically synthesized
agctgaggtgggcagatcat

SEQ ID NO: 448162 - DNA, 20 bp, Artificial Sequence
  chemically synthesized
acctcatgatctgcccacct

SEQ ID NO: 448163 - DNA, 20 bp, Artificial Sequence
  chemically synthesized
ctttgggaagctgaggtggg

SEQ ID NO: 448164 - DNA, 20 bp, Artificial Sequence
  chemically synthesized
gcactttgggaagctgaggt

SEQ ID NO: 448165 - DNA, 20 bp, Artificial Sequence
  chemically synthesized
agcactttgggaagctgagg

SEQ ID NO: 448166 - DNA, 20 bp, Artificial Sequence
  chemically synthesized
gccagcactttgggaagctg

SEQ ID NO: 448167 - DNA, 20 bp, Artificial Sequence
  chemically synthesized
tgccagcactttgggaagct

SEQ ID NO: 448168 - DNA, 20 bp, Artificial Sequence
  chemically synthesized
ctgcccacctcagcttccca

SEQ ID NO: 448169 - DNA, 20 bp, Artificial Sequence
  chemically synthesized
cgtaatgccagcactttggg

SEQ ID NO: 448170 - DNA, 20 bp, Artificial Sequence
  chemically synthesized
acctcagcttcccaaagtgc

SEQ ID NO: 448171 - DNA, 20 bp, Artificial Sequence
  chemically synthesized
gcccgtaatgccagcacttt

SEQ ID NO: 448172 - DNA, 20 bp, Artificial Sequence
  chemically synthesized
tgcccgtaatgccagcactt

SEQ ID NO: 448173 - DNA, 20 bp, Artificial Sequence
  chemically synthesized
ttcccaaagtgctggcatta

SEQ ID NO: 448174 - DNA, 20 bp, Artificial Sequence
  chemically synthesized
tcccaaagtgctggcattac

SEQ ID NO: 448175 - DNA, 20 bp, Artificial Sequence
  chemically synthesized
gtggctcatgcccgtaatgc

SEQ ID NO: 448176 - DNA, 20 bp, Artificial Sequence
  chemically synthesized
agtgctggcattacgggcat

SEQ ID NO: 448177 - DNA, 20 bp, Artificial Sequence
  chemically synthesized
cgggcatgagccaccatgcc

SEQ ID NO: 448178 - DNA, 20 bp, Artificial Sequence
  chemically synthesized
agataattggccgggcatgg

SEQ ID NO: 448179 - DNA, 20 bp, Artificial Sequence
  chemically synthesized
ccgagataattggccgggca

SEQ ID NO: 448180 - DNA, 20 bp, Artificial Sequence
  chemically synthesized
gaagaccgagataattggcc

SEQ ID NO: 448181 - DNA, 20 bp, Artificial Sequence
  chemically synthesized
tgaagaccgagataattggc

SEQ ID NO: 448182 - DNA, 20 bp, Artificial Sequence
  chemically synthesized
ccatgcccggccaattatct

SEQ ID NO: 448183 - DNA, 20 bp, Artificial Sequence
  chemically synthesized
agtttgaagaccgagataat

SEQ ID NO: 448184 - DNA, 20 bp, Artificial Sequence
  chemically synthesized
taaaacagagtttgaagacc

SEQ ID NO: 448185 - DNA, 20 bp, Artificial Sequence
  chemically synthesized
aagtactaaaacagagtttg

SEQ ID NO: 448186 - DNA, 20 bp, Artificial Sequence
  chemically synthesized
tcggtcttcaaactctgttt

SEQ ID NO: 448187 - DNA, 20 bp, Artificial Sequence
  chemically synthesized
tttgtttaagtactaaaaca

SEQ ID NO: 448188 - DNA, 20 bp, Artificial Sequence
  chemically synthesized
gctttgtttaagtactaaaa

SEQ ID NO: 448189 - DNA, 20 bp, Artificial Sequence
  chemically synthesized
tctgttttagtacttaaaca

SEQ ID NO: 448190 - DNA, 20 bp, Artificial Sequence
  chemically synthesized
agcagtttaaggctttgttt

SEQ ID NO: 448191 - DNA, 20 bp, Artificial Sequence
  chemically synthesized
agtgttcttgaagcagttta

SEQ ID NO: 448192 - DNA, 20 bp, Artificial Sequence
  chemically synthesized
cagtgttcttgaagcagttt

SEQ ID NO: 448193 - DNA, 20 bp, Artificial Sequence
  chemically synthesized
acaaagccttaaactgcttc

SEQ ID NO: 448194 - DNA, 20 bp, Artificial Sequence
  chemically synthesized
atcattcagtgttcttgaag

SEQ ID NO: 448195 - DNA, 20 bp, Artificial Sequence
  chemically synthesized
tttatcattcagtgttcttg

SEQ ID NO: 448196 - DNA, 20 bp, Artificial Sequence
  chemically synthesized
agaataattcatttatcatt

SEQ ID NO: 448197 - DNA, 20 bp, Artificial Sequence
  chemically synthesized
ataaaagttcattttcaatg

SEQ ID NO: 448198 - DNA, 20 bp, Artificial Sequence
  chemically synthesized
tattcaactaaaattgataa

SEQ ID NO: 448199 - DNA, 20 bp, Artificial Sequence
  chemically synthesized
aaatgaacttttatcaattt

SEQ ID NO: 448200 - DNA, 20 bp, Artificial Sequence
  chemically synthesized
ttatcaattttagttgaata

SEQ ID NO: 448201 - DNA, 20 bp, Artificial Sequence
  chemically synthesized
aatatggtttcttcttcctt

SEQ ID NO: 448202 - DNA, 20 bp, Artificial Sequence
  chemically synthesized
tttaactggactcaaggaag

SEQ ID NO: 448203 - DNA, 20 bp, Artificial Sequence
  chemically synthesized
acctttaactggactcaagg

SEQ ID NO: 448204 - DNA, 20 bp, Artificial Sequence
  chemically synthesized
ggtttcttcttccttgagtc

SEQ ID NO: 448205 - DNA, 20 bp, Artificial Sequence
  chemically synthesized
gctacctttaactggactca

SEQ ID NO: 448206 - DNA, 20 bp, Artificial Sequence
  chemically synthesized
agctacctttaactggactc

SEQ ID NO: 448207 - DNA, 20 bp, Artificial Sequence
  chemically synthesized
ttcttccttgagtccagtta

SEQ ID NO: 448208 - DNA, 20 bp, Artificial Sequence
  chemically synthesized
tcttccttgagtccagttaa

SEQ ID NO: 448209 - DNA, 20 bp, Artificial Sequence
  chemically synthesized
gctcccaagctacctttaac

SEQ ID NO: 448210 - DNA, 20 bp, Artificial Sequence
  chemically synthesized
tccttgagtccagttaaagg

SEQ ID NO: 448211 - DNA, 20 bp, Artificial Sequence
  chemically synthesized
gagtccagttaaaggtagct

SEQ ID NO: 448212 - DNA, 20 bp, Artificial Sequence
  chemically synthesized
agtccagttaaaggtagctt

SEQ ID NO: 448213 - DNA, 20 bp, Artificial Sequence
  chemically synthesized
tccagttaaaggtagcttgg

SEQ ID NO: 448214 - DNA, 20 bp, Artificial Sequence
  chemically synthesized
gtgacttgagtattgctccc

SEQ ID NO: 448215 - DNA, 20 bp, Artificial Sequence
  chemically synthesized
gtagcttgggagcaatactc

SEQ ID NO: 448216 - DNA, 20 bp, Artificial Sequence
  chemically synthesized
aactacatgtgatgtgactt

SEQ ID NO: 448217 - DNA, 20 bp, Artificial Sequence
  chemically synthesized
tactcaagtcacatcacatg

SEQ ID NO: 448218 - DNA, 20 bp, Artificial Sequence
  chemically synthesized
aggactgattcggaatataa

SEQ ID NO: 448219 - DNA, 20 bp, Artificial Sequence
  chemically synthesized
taaacttttatattccgaat

SEQ ID NO: 448220 - DNA, 20 bp, Artificial Sequence
  chemically synthesized
tcttacttaaaggactgatt

SEQ ID NO: 448221 - DNA, 20 bp, Artificial Sequence
  chemically synthesized
atattccgaatcagtccttt

SEQ ID NO: 448222 - DNA, 20 bp, Artificial Sequence
  chemically synthesized
tccgaatcagtcctttaagt

SEQ ID NO: 448223 - DNA, 20 bp, Artificial Sequence
  chemically synthesized
cccctggctgtcttacttaa

SEQ ID NO: 448224 - DNA, 20 bp, Artificial Sequence
  chemically synthesized
acccctggctgtcttactta

SEQ ID NO: 448225 - DNA, 20 bp, Artificial Sequence
  chemically synthesized
aatcagtcctttaagtaaga

SEQ ID NO: 448226 - DNA, 20 bp, Artificial Sequence
  chemically synthesized
agtcctttaagtaagacagc

SEQ ID NO: 448227 - DNA, 20 bp, Artificial Sequence
  chemically synthesized
gtcctttaagtaagacagcc

SEQ ID NO: 448228 - DNA, 20 bp, Artificial Sequence
  chemically synthesized
tcctttaagtaagacagcca

SEQ ID NO: 448229 - DNA, 20 bp, Artificial Sequence
  chemically synthesized
cctttaagtaagacagccag

SEQ ID NO: 448230 - DNA, 20 bp, Artificial Sequence
  chemically synthesized
ttggttagtttatcaacccc

SEQ ID NO: 448231 - DNA, 20 bp, Artificial Sequence
  chemically synthesized
gtgacggataggattttggt

SEQ ID NO: 448232 - DNA, 20 bp, Artificial Sequence
  chemically synthesized
ggatgtgacggataggattt

SEQ ID NO: 448233 - DNA, 20 bp, Artificial Sequence
  chemically synthesized
ttgtaatggatgtgacggat

SEQ ID NO: 448234 - DNA, 20 bp, Artificial Sequence
  chemically synthesized
cttgtaatggatgtgacgga

SEQ ID NO: 448235 - DNA, 20 bp, Artificial Sequence
  chemically synthesized
aatgcttgtaatggatgtga

SEQ ID NO: 448236 - DNA, 20 bp, Artificial Sequence
  chemically synthesized
ctatccgtcacatccattac

SEQ ID NO: 448237 - DNA, 20 bp, Artificial Sequence
  chemically synthesized
ttacattgtaatgcttgtaa

SEQ ID NO: 448238 - DNA, 20 bp, Artificial Sequence
  chemically synthesized
ttacaagcattacaatgtaa

SEQ ID NO: 448239 - DNA, 20 bp, Artificial Sequence
  chemically synthesized
caaaatatataagaaaattc

SEQ ID NO: 448240 - DNA, 20 bp, Artificial Sequence
  chemically synthesized
acaaaatatataagaaaatt

SEQ ID NO: 448241 - DNA, 20 bp, Artificial Sequence
  chemically synthesized
atataagaaacaaaatatat

SEQ ID NO: 448242 - DNA, 20 bp, Artificial Sequence
  chemically synthesized
ctactaaattttaagaatat

SEQ ID NO: 448243 - DNA, 20 bp, Artificial Sequence
  chemically synthesized
tttcttatattcttaaaatt

SEQ ID NO: 448244 - DNA, 20 bp, Artificial Sequence
  chemically synthesized
tgtatttgctactaaatttt

SEQ ID NO: 448245 - DNA, 20 bp, Artificial Sequence
  chemically synthesized
cttatattcttaaaatttag

SEQ ID NO: 448246 - DNA, 20 bp, Artificial Sequence
  chemically synthesized
aaatatgataaattttcaat

SEQ ID NO: 448247 - DNA, 20 bp, Artificial Sequence
  chemically synthesized
taaatatgataaattttcaa

SEQ ID NO: 448248 - DNA, 20 bp, Artificial Sequence
  chemically synthesized
tattgaaaatttatcatatt

SEQ ID NO: 448249 - DNA, 20 bp, Artificial Sequence
  chemically synthesized
aaatttatcatatttagctt

SEQ ID NO: 448250 - DNA, 20 bp, Artificial Sequence
  chemically synthesized
aatttatcatatttagcttt

SEQ ID NO: 448251 - DNA, 20 bp, Artificial Sequence
  chemically synthesized
atttatcatatttagctttg

SEQ ID NO: 448252 - DNA, 20 bp, Artificial Sequence
  chemically synthesized
aaattaaaaatatttcccca

SEQ ID NO: 448253 - DNA, 20 bp, Artificial Sequence
  chemically synthesized
gggaaatatttttaattttt

SEQ ID NO: 448254 - DNA, 20 bp, Artificial Sequence
  chemically synthesized
tgaaatataaaatactctgt

SEQ ID NO: 448255 - DNA, 20 bp, Artificial Sequence
  chemically synthesized
ttctaggaattgtactaaca

SEQ ID NO: 448256 - DNA, 20 bp, Artificial Sequence
  chemically synthesized
tattctaggaattgtactaa

SEQ ID NO: 448257 - DNA, 20 bp, Artificial Sequence
  chemically synthesized
tactctgttagtacaattcc

SEQ ID NO: 448258 - DNA, 20 bp, Artificial Sequence
  chemically synthesized
acagaagttaaatatattct

SEQ ID NO: 448259 - DNA, 20 bp, Artificial Sequence
  chemically synthesized
tacagaagttaaatatattc

SEQ ID NO: 448260 - DNA, 20 bp, Artificial Sequence
  chemically synthesized
tctaaacatatggagtacag

SEQ ID NO: 448261 - DNA, 20 bp, Artificial Sequence
  chemically synthesized
tcttctaaacatatggagta

SEQ ID NO: 448262 - DNA, 20 bp, Artificial Sequence
  chemically synthesized
ctcattcttctaaacatatg

SEQ ID NO: 448263 - DNA, 20 bp, Artificial Sequence
  chemically synthesized
acttctgtactccatatgtt

SEQ ID NO: 448264 - DNA, 20 bp, Artificial Sequence
  chemically synthesized
ttctcattcttctaaacata

SEQ ID NO: 448265 - DNA, 20 bp, Artificial Sequence
  chemically synthesized
tctgtactccatatgtttag

SEQ ID NO: 448266 - DNA, 20 bp, Artificial Sequence
  chemically synthesized
ctccatatgtttagaagaat

SEQ ID NO: 448267 - DNA, 20 bp, Artificial Sequence
  chemically synthesized
catatgtttagaagaatgag

SEQ ID NO: 448268 - DNA, 20 bp, Artificial Sequence
  chemically synthesized
gtattgaaaattgtatctta

SEQ ID NO: 448269 - DNA, 20 bp, Artificial Sequence
  chemically synthesized
ttttatagtagaacaactat

SEQ ID NO: 448270 - DNA, 20 bp, Artificial Sequence
  chemically synthesized
atttacaattggttttatag

SEQ ID NO: 448271 - DNA, 20 bp, Artificial Sequence
  chemically synthesized
gatatttacaattggtttta

SEQ ID NO: 448272 - DNA, 20 bp, Artificial Sequence
  chemically synthesized
cattgaatgatatttacaat

SEQ ID NO: 448273 - DNA, 20 bp, Artificial Sequence
  chemically synthesized
caattgtaaatatcattcaa

SEQ ID NO: 448274 - DNA, 20 bp, Artificial Sequence
  chemically synthesized
attgttatttaatcccaaat

SEQ ID NO: 448275 - DNA, 20 bp, Artificial Sequence
  chemically synthesized
cacattaagtagaccaattt

SEQ ID NO: 448276 - DNA, 20 bp, Artificial Sequence
  chemically synthesized
ccacattaagtagaccaatt

SEQ ID NO: 448277 - DNA, 20 bp, Artificial Sequence
  chemically synthesized
ccaaattggtctacttaatg

SEQ ID NO: 448278 - DNA, 20 bp, Artificial Sequence
  chemically synthesized
gaaattttagccacattaag

SEQ ID NO: 448279 - DNA, 20 bp, Artificial Sequence
  chemically synthesized
tgagaaattttagccacatt

SEQ ID NO: 448280 - DNA, 20 bp, Artificial Sequence
  chemically synthesized
ttagagtctatgagaaattt

SEQ ID NO: 448281 - DNA, 20 bp, Artificial Sequence
  chemically synthesized
aatgtggctaaaatttctca

SEQ ID NO: 448282 - DNA, 20 bp, Artificial Sequence
  chemically synthesized
ttttctgaattagagtctat

SEQ ID NO: 448283 - DNA, 20 bp, Artificial Sequence
  chemically synthesized
atttctcatagactctaatt

SEQ ID NO: 448284 - DNA, 20 bp, Artificial Sequence
  chemically synthesized
aaaatatattttctgaatta

SEQ ID NO: 448285 - DNA, 20 bp, Artificial Sequence
  chemically synthesized
acaaaatatattttctgaat

SEQ ID NO: 448286 - DNA, 20 bp, Artificial Sequence
  chemically synthesized
cagaaaatatattttgtttt

SEQ ID NO: 448287 - DNA, 20 bp, Artificial Sequence
  chemically synthesized
aaatatctatcacaagtagt

SEQ ID NO: 448288 - DNA, 20 bp, Artificial Sequence
  chemically synthesized
tttgcactaactacttgtga

SEQ ID NO: 448289 - DNA, 20 bp, Artificial Sequence
  chemically synthesized
ttttaaatatctatcacaag

SEQ ID NO: 448290 - DNA, 20 bp, Artificial Sequence
  chemically synthesized
tatttttaaatatctatcac

SEQ ID NO: 448291 - DNA, 20 bp, Artificial Sequence
  chemically synthesized
ataaaatcactattcaggat

SEQ ID NO: 448292 - DNA, 20 bp, Artificial Sequence
  chemically synthesized
tatatgtgactcatcctgaa

SEQ ID NO: 448293 - DNA, 20 bp, Artificial Sequence
  chemically synthesized
tgtgcataaaatcactattc

SEQ ID NO: 448294 - DNA, 20 bp, Artificial Sequence
  chemically synthesized
ctgtgcataaaatcactatt

SEQ ID NO: 448295 - DNA, 20 bp, Artificial Sequence
  chemically synthesized
ctgaatagtgattttatgca

SEQ ID NO: 448296 - DNA, 20 bp, Artificial Sequence
  chemically synthesized
agtgattttatgcacagctg

SEQ ID NO: 448297 - DNA, 20 bp, Artificial Sequence
  chemically synthesized
atatacttcatttgcatcta

SEQ ID NO: 448298 - DNA, 20 bp, Artificial Sequence
  chemically synthesized
cacagctgtagatgcaaatg

SEQ ID NO: 448299 - DNA, 20 bp, Artificial Sequence
  chemically synthesized
aaaatgcttatagcatttgt

SEQ ID NO: 448300 - DNA, 20 bp, Artificial Sequence
  chemically synthesized
tattaactaacaaatgctat

SEQ ID NO: 448301 - DNA, 20 bp, Artificial Sequence
  chemically synthesized
taccaacataaaaatgctta

SEQ ID NO: 448302 - DNA, 20 bp, Artificial Sequence
  chemically synthesized
tgctataagcatttttatgt

SEQ ID NO: 448303 - DNA, 20 bp, Artificial Sequence
  chemically synthesized
catttttatgttggtaaatt

SEQ ID NO: 448304 - DNA, 20 bp, Artificial Sequence
  chemically synthesized
ttatgttggtaaattaagac

SEQ ID NO: 448305 - DNA, 20 bp, Artificial Sequence
  chemically synthesized
tatgttggtaaattaagact

SEQ ID NO: 448306 - DNA, 20 bp, Artificial Sequence
  chemically synthesized
aattcaactatcatgcaacc

SEQ ID NO: 448307 - DNA, 20 bp, Artificial Sequence
  chemically synthesized
attaagactgggttgcatga

SEQ ID NO: 448308 - DNA, 20 bp, Artificial Sequence
  chemically synthesized
tgatagttgaatttaattca

SEQ ID NO: 448309 - DNA, 20 bp, Artificial Sequence
  chemically synthesized
ttatgtaaattattttaggg

SEQ ID NO: 448310 - DNA, 20 bp, Artificial Sequence
  chemically synthesized
tagttatgtaaattatttta

SEQ ID NO: 448311 - DNA, 20 bp, Artificial Sequence
  chemically synthesized
atagttatgtaaattatttt

SEQ ID NO: 448312 - DNA, 20 bp, Artificial Sequence
  chemically synthesized
catagttatgtaaattattt

SEQ ID NO: 448313 - DNA, 20 bp, Artificial Sequence
  chemically synthesized
ataatttacataactatgac

SEQ ID NO: 448314 - DNA, 20 bp, Artificial Sequence
  chemically synthesized
aattttgatataacttgtca

SEQ ID NO: 448315 - DNA, 20 bp, Artificial Sequence
  chemically synthesized
tcaaaatttactctcaaatt

SEQ ID NO: 448316 - DNA, 20 bp, Artificial Sequence
  chemically synthesized
gaataaccaacttaatttga

SEQ ID NO: 448317 - DNA, 20 bp, Artificial Sequence
  chemically synthesized
ttgaataaccaacttaattt

SEQ ID NO: 448318 - DNA, 20 bp, Artificial Sequence
  chemically synthesized
aatttactctcaaattaagt

SEQ ID NO: 448319 - DNA, 20 bp, Artificial Sequence
  chemically synthesized
tcacttgtatttatacagaa

SEQ ID NO: 448320 - DNA, 20 bp, Artificial Sequence
  chemically synthesized
ggcaatcacttgtatttata

SEQ ID NO: 448321 - DNA, 20 bp, Artificial Sequence
  chemically synthesized
tgtccattctgtataaatac

SEQ ID NO: 448322 - DNA, 20 bp, Artificial Sequence
  chemically synthesized
acaagtgattgccatactgt

SEQ ID NO: 448323 - DNA, 20 bp, Artificial Sequence
  chemically synthesized
tgagcatgagtcttacagta

SEQ ID NO: 448324 - DNA, 20 bp, Artificial Sequence
  chemically synthesized
cattatgagcatgagtctta

SEQ ID NO: 448325 - DNA, 20 bp, Artificial Sequence
  chemically synthesized
ttattctccattatgagcat

SEQ ID NO: 448326 - DNA, 20 bp, Artificial Sequence
  chemically synthesized
tgtaagactcatgctcataa

SEQ ID NO: 448327 - DNA, 20 bp, Artificial Sequence
  chemically synthesized
taagactcatgctcataatg

SEQ ID NO: 448328 - DNA, 20 bp, Artificial Sequence
  chemically synthesized
tattatttattctccattat

SEQ ID NO: 448329 - DNA, 20 bp, Artificial Sequence
  chemically synthesized
tccatctcaaaaaaataaat

SEQ ID NO: 448330 - DNA, 20 bp, Artificial Sequence
  chemically synthesized
atttacttatttattttttt

SEQ ID NO: 448331 - DNA, 20 bp, Artificial Sequence
  chemically synthesized
acttatttatttttttgaga

SEQ ID NO: 448332 - DNA, 20 bp, Artificial Sequence
  chemically synthesized
ttatttatttttttgagatg

SEQ ID NO: 448333 - DNA, 20 bp, Artificial Sequence
  chemically synthesized
tgagatggagcctcgctctg

SEQ ID NO: 448334 - DNA, 20 bp, Artificial Sequence
  chemically synthesized
ccagcctgggccacagagcg

SEQ ID NO: 448335 - DNA, 20 bp, Artificial Sequence
  chemically synthesized
tccagcctgggccacagagc

SEQ ID NO: 448336 - DNA, 20 bp, Artificial Sequence
  chemically synthesized
tggagcctcgctctgtggcc

SEQ ID NO: 448337 - DNA, 20 bp, Artificial Sequence
  chemically synthesized
gcactccagcctgggccaca

SEQ ID NO: 448338 - DNA, 20 bp, Artificial Sequence
  chemically synthesized
ggagcctcgctctgtggccc

SEQ ID NO: 448339 - DNA, 20 bp, Artificial Sequence
  chemically synthesized
ccgcactccagcctgggcca

SEQ ID NO: 448340 - DNA, 20 bp, Artificial Sequence
  chemically synthesized
cctcgctctgtggcccaggc

SEQ ID NO: 448341 - DNA, 20 bp, Artificial Sequence
  chemically synthesized
tcgctctgtggcccaggctg

SEQ ID NO: 448342 - DNA, 20 bp, Artificial Sequence
  chemically synthesized
gcgccaccgcactccagcct

SEQ ID NO: 448343 - DNA, 20 bp, Artificial Sequence
  chemically synthesized
cgcgccaccgcactccagcc

SEQ ID NO: 448344 - DNA, 20 bp, Artificial Sequence
  chemically synthesized
ctgtggcccaggctggagtg

SEQ ID NO: 448345 - DNA, 20 bp, Artificial Sequence
  chemically synthesized
gagatcgcgccaccgcactc

SEQ ID NO: 448346 - DNA, 20 bp, Artificial Sequence
  chemically synthesized
tggcccaggctggagtgcgg

SEQ ID NO: 448347 - DNA, 20 bp, Artificial Sequence
  chemically synthesized
ggagtgcggtggcgcgatct

SEQ ID NO: 448348 - DNA, 20 bp, Artificial Sequence
  chemically synthesized
ggcggagcttacagtgagct

SEQ ID NO: 448349 - DNA, 20 bp, Artificial Sequence
  chemically synthesized
gcgcgatctcagctcactgt

SEQ ID NO: 448350 - DNA, 20 bp, Artificial Sequence
  chemically synthesized
cgggaggcggagcttacagt

SEQ ID NO: 448351 - DNA, 20 bp, Artificial Sequence
  chemically synthesized
aacccgggaggcggagctta

SEQ ID NO: 448352 - DNA, 20 bp, Artificial Sequence
  chemically synthesized
tcactgtaagctccgcctcc

SEQ ID NO: 448353 - DNA, 20 bp, Artificial Sequence
  chemically synthesized
tggtgtgaacccgggaggcg

SEQ ID NO: 448354 - DNA, 20 bp, Artificial Sequence
  chemically synthesized
cactgtaagctccgcctccc

SEQ ID NO: 448355 - DNA, 20 bp, Artificial Sequence
  chemically synthesized
aatggtgtgaacccgggagg

SEQ ID NO: 448356 - DNA, 20 bp, Artificial Sequence
  chemically synthesized
gagaatggtgtgaacccggg

SEQ ID NO: 448357 - DNA, 20 bp, Artificial Sequence
  chemically synthesized
ggagaatggtgtgaacccgg

SEQ ID NO: 448358 - DNA, 20 bp, Artificial Sequence
  chemically synthesized
caggagaatggtgtgaaccc

SEQ ID NO: 448359 - DNA, 20 bp, Artificial Sequence
  chemically synthesized
gcaggagaatggtgtgaacc

SEQ ID NO: 448360 - DNA, 20 bp, Artificial Sequence
  chemically synthesized
gggaggctgaggcaggagaa

SEQ ID NO: 448361 - DNA, 20 bp, Artificial Sequence
  chemically synthesized
ttcacaccattctcctgcct

SEQ ID NO: 448362 - DNA, 20 bp, Artificial Sequence
  chemically synthesized
tactggggaggctgaggcag

SEQ ID NO: 448363 - DNA, 20 bp, Artificial Sequence
  chemically synthesized
gctactggggaggctgaggc

SEQ ID NO: 448364 - DNA, 20 bp, Artificial Sequence
  chemically synthesized
agctactggggaggctgagg

SEQ ID NO: 448365 - DNA, 20 bp, Artificial Sequence
  chemically synthesized
cgcagctactggggaggctg

SEQ ID NO: 448366 - DNA, 20 bp, Artificial Sequence
  chemically synthesized
tcgcagctactggggaggct

SEQ ID NO: 448367 - DNA, 20 bp, Artificial Sequence
  chemically synthesized
ttctcctgcctcagcctccc

SEQ ID NO: 448368 - DNA, 20 bp, Artificial Sequence
  chemically synthesized
tcctgcctcagcctccccag

SEQ ID NO: 448369 - DNA, 20 bp, Artificial Sequence
  chemically synthesized
tgtagtcgcagctactgggg

SEQ ID NO: 448370 - DNA, 20 bp, Artificial Sequence
  chemically synthesized
ctgtagtcgcagctactggg

SEQ ID NO: 448371 - DNA, 20 bp, Artificial Sequence
  chemically synthesized
gcctgtagtcgcagctactg

SEQ ID NO: 448372 - DNA, 20 bp, Artificial Sequence
  chemically synthesized
tgcctgtagtcgcagctact

SEQ ID NO: 448373 - DNA, 20 bp, Artificial Sequence
  chemically synthesized
gtgcctgtagtcgcagctac

SEQ ID NO: 448374 - DNA, 20 bp, Artificial Sequence
  chemically synthesized
ctccccagtagctgcgacta

SEQ ID NO: 448375 - DNA, 20 bp, Artificial Sequence
  chemically synthesized
tccccagtagctgcgactac

SEQ ID NO: 448376 - DNA, 20 bp, Artificial Sequence
  chemically synthesized
gtggcgggtgcctgtagtcg

SEQ ID NO: 448377 - DNA, 20 bp, Artificial Sequence
  chemically synthesized
ggcgtggtggcgggtgcctg

SEQ ID NO: 448378 - DNA, 20 bp, Artificial Sequence
  chemically synthesized
aattagtcaggcgtggtggc

SEQ ID NO: 448379 - DNA, 20 bp, Artificial Sequence
  chemically synthesized
aaattagtcaggcgtggtgg

SEQ ID NO: 448380 - DNA, 20 bp, Artificial Sequence
  chemically synthesized
aaaaaattagtcaggcgtgg

SEQ ID NO: 448381 - DNA, 20 bp, Artificial Sequence
  chemically synthesized
tacaaaaaattagtcaggcg

SEQ ID NO: 448382 - DNA, 20 bp, Artificial Sequence
  chemically synthesized
aaaaatacaaaaaattagtc

SEQ ID NO: 448383 - DNA, 20 bp, Artificial Sequence
  chemically synthesized
taaaaatacaaaaaattagt

SEQ ID NO: 448384 - DNA, 20 bp, Artificial Sequence
  chemically synthesized
atactaaaaatacaaaaaat

SEQ ID NO: 448385 - DNA, 20 bp, Artificial Sequence
  chemically synthesized
tgactaattttttgtatttt

SEQ ID NO: 448386 - DNA, 20 bp, Artificial Sequence
  chemically synthesized
aattttttgtatttttagta

SEQ ID NO: 448387 - DNA, 20 bp, Artificial Sequence
  chemically synthesized
ttgtatttttagtatagacg

SEQ ID NO: 448388 - DNA, 20 bp, Artificial Sequence
  chemically synthesized
tagacgtggtttcaccgtgt

SEQ ID NO: 448389 - DNA, 20 bp, Artificial Sequence
  chemically synthesized
cgtggtttcaccgtgttagc

SEQ ID NO: 448390 - DNA, 20 bp, Artificial Sequence
  chemically synthesized
cgagaccatcctggctaaca

SEQ ID NO: 448391 - DNA, 20 bp, Artificial Sequence
  chemically synthesized
gtggtttcaccgtgttagcc

SEQ ID NO: 448392 - DNA, 20 bp, Artificial Sequence
  chemically synthesized
tttcaccgtgttagccagga

SEQ ID NO: 448393 - DNA, 20 bp, Artificial Sequence
  chemically synthesized
tcaggagatcgagaccatcc

SEQ ID NO: 448394 - DNA, 20 bp, Artificial Sequence
  chemically synthesized
gatcatgaggtcaggagatc

SEQ ID NO: 448395 - DNA, 20 bp, Artificial Sequence
  chemically synthesized
tgggcggatcatgaggtcag

SEQ ID NO: 448396 - DNA, 20 bp, Artificial Sequence
  chemically synthesized
ggtgggcggatcatgaggtc

SEQ ID NO: 448397 - DNA, 20 bp, Artificial Sequence
  chemically synthesized
aggtgggcggatcatgaggt

SEQ ID NO: 448398 - DNA, 20 bp, Artificial Sequence
  chemically synthesized
gctgaggtgggcggatcatg

SEQ ID NO: 448399 - DNA, 20 bp, Artificial Sequence
  chemically synthesized
ggctgaggtgggcggatcat

SEQ ID NO: 448400 - DNA, 20 bp, Artificial Sequence
  chemically synthesized
acctcatgatccgcccacct

SEQ ID NO: 448401 - DNA, 20 bp, Artificial Sequence
  chemically synthesized
ctttgggaggctgaggtggg

SEQ ID NO: 448402 - DNA, 20 bp, Artificial Sequence
  chemically synthesized
gcactttgggaggctgaggt

SEQ ID NO: 448403 - DNA, 20 bp, Artificial Sequence
  chemically synthesized
agcactttgggaggctgagg

SEQ ID NO: 448404 - DNA, 20 bp, Artificial Sequence
  chemically synthesized
cccagcactttgggaggctg

SEQ ID NO: 448405 - DNA, 20 bp, Artificial Sequence
  chemically synthesized
tcccagcactttgggaggct

SEQ ID NO: 448406 - DNA, 20 bp, Artificial Sequence
  chemically synthesized
ccgcccacctcagcctccca

SEQ ID NO: 448407 - DNA, 20 bp, Artificial Sequence
  chemically synthesized
tgtaatcccagcactttggg

SEQ ID NO: 448408 - DNA, 20 bp, Artificial Sequence
  chemically synthesized
ctgtaatcccagcactttgg

SEQ ID NO: 448409 - DNA, 20 bp, Artificial Sequence
  chemically synthesized
acctcagcctcccaaagtgc

SEQ ID NO: 448410 - DNA, 20 bp, Artificial Sequence
  chemically synthesized
gcctgtaatcccagcacttt

SEQ ID NO: 448411 - DNA, 20 bp, Artificial Sequence
  chemically synthesized
cctcagcctcccaaagtgct

SEQ ID NO: 448412 - DNA, 20 bp, Artificial Sequence
  chemically synthesized
cgcctgtaatcccagcactt

SEQ ID NO: 448413 - DNA, 20 bp, Artificial Sequence
  chemically synthesized
ctcccaaagtgctgggatta

SEQ ID NO: 448414 - DNA, 20 bp, Artificial Sequence
  chemically synthesized
tcccaaagtgctgggattac

SEQ ID NO: 448415 - DNA, 20 bp, Artificial Sequence
  chemically synthesized
gtggctcacgcctgtaatcc

SEQ ID NO: 448416 - DNA, 20 bp, Artificial Sequence
  chemically synthesized
agtgctgggattacaggcgt

SEQ ID NO: 448417 - DNA, 20 bp, Artificial Sequence
  chemically synthesized
caggcgtgagccactgcgcc

SEQ ID NO: 448418 - DNA, 20 bp, Artificial Sequence
  chemically synthesized
attctcgcggccaggcgcag

SEQ ID NO: 448419 - DNA, 20 bp, Artificial Sequence
  chemically synthesized
tttattctcgcggccaggcg

SEQ ID NO: 448420 - DNA, 20 bp, Artificial Sequence
  chemically synthesized
gagccactgcgcctggccgc

SEQ ID NO: 448421 - DNA, 20 bp, Artificial Sequence
  chemically synthesized
tattatttattctcgcggcc

SEQ ID NO: 448422 - DNA, 20 bp, Artificial Sequence
  chemically synthesized
atattatttattctcgcggc

SEQ ID NO: 448423 - DNA, 20 bp, Artificial Sequence
  chemically synthesized
gaaaatattatttattctcg

SEQ ID NO: 448424 - DNA, 20 bp, Artificial Sequence
  chemically synthesized
gagaataaataatattttct

SEQ ID NO: 448425 - DNA, 20 bp, Artificial Sequence
  chemically synthesized
aaattaaaagttaattttct

SEQ ID NO: 448426 - DNA, 20 bp, Artificial Sequence
  chemically synthesized
atttttaggtgaaaaattaa

SEQ ID NO: 448427 - DNA, 20 bp, Artificial Sequence
  chemically synthesized
aatggaaaattaggattttt

SEQ ID NO: 448428 - DNA, 20 bp, Artificial Sequence
  chemically synthesized
aaatggaaaattaggatttt

SEQ ID NO: 448429 - DNA, 20 bp, Artificial Sequence
  chemically synthesized
atagaaaaaaatggaaaatt

SEQ ID NO: 448430 - DNA, 20 bp, Artificial Sequence
  chemically synthesized
catagaaaaaaatggaaaat

SEQ ID NO: 448431 - DNA, 20 bp, Artificial Sequence
  chemically synthesized
aatttcctcatagaaaaaaa

SEQ ID NO: 448432 - DNA, 20 bp, Artificial Sequence
  chemically synthesized
aattttccatttttttctat

SEQ ID NO: 448433 - DNA, 20 bp, Artificial Sequence
  chemically synthesized
attttccatttttttctatg

SEQ ID NO: 448434 - DNA, 20 bp, Artificial Sequence
  chemically synthesized
aaataatgataatttcctca

SEQ ID NO: 448435 - DNA, 20 bp, Artificial Sequence
  chemically synthesized
tttatttttgttttaaaaac

SEQ ID NO: 448436 - DNA, 20 bp, Artificial Sequence
  chemically synthesized
tgttttaaaaacaagtttca

SEQ ID NO: 448437 - DNA, 20 bp, Artificial Sequence
  chemically synthesized
ttaaaaacaagtttcacaga

SEQ ID NO: 448438 - DNA, 20 bp, Artificial Sequence
  chemically synthesized
taaaaacaagtttcacagat

SEQ ID NO: 448439 - DNA, 20 bp, Artificial Sequence
  chemically synthesized
aaaacaagtttcacagatag

SEQ ID NO: 448440 - DNA, 20 bp, Artificial Sequence
  chemically synthesized
atgggtgaaaaaataaaata

SEQ ID NO: 448441 - DNA, 20 bp, Artificial Sequence
  chemically synthesized
aaatgggtgaaaaaataaaa

SEQ ID NO: 448442 - DNA, 20 bp, Artificial Sequence
  chemically synthesized
taaaatgtgagaataaaaat

SEQ ID NO: 448443 - DNA, 20 bp, Artificial Sequence
  chemically synthesized
ataaaatgtgagaataaaaa

SEQ ID NO: 448444 - DNA, 20 bp, Artificial Sequence
  chemically synthesized
ttttactaaaaataaaatgt

SEQ ID NO: 448445 - DNA, 20 bp, Artificial Sequence
  chemically synthesized
ttattctcacattttatttt

SEQ ID NO: 448446 - DNA, 20 bp, Artificial Sequence
  chemically synthesized
gtctgtaaaaaaatgacaat

SEQ ID NO: 448447 - DNA, 20 bp, Artificial Sequence
  chemically synthesized
aactaattgtcattttttta

SEQ ID NO: 448448 - DNA, 20 bp, Artificial Sequence
  chemically synthesized
attgtcatttttttacagac

SEQ ID NO: 448449 - DNA, 20 bp, Artificial Sequence
  chemically synthesized
tttctaattttcagagtttc

SEQ ID NO: 448450 - DNA, 20 bp, Artificial Sequence
  chemically synthesized
agaccagaaactctgaaaat

SEQ ID NO: 448451 - DNA, 20 bp, Artificial Sequence
  chemically synthesized
atgtcactttctaattttca

SEQ ID NO: 448452 - DNA, 20 bp, Artificial Sequence
  chemically synthesized
gaatgtcactttctaatttt

SEQ ID NO: 448453 - DNA, 20 bp, Artificial Sequence
  chemically synthesized
cagaaactctgaaaattaga

SEQ ID NO: 448454 - DNA, 20 bp, Artificial Sequence
  chemically synthesized
gaaagtgacattcatgaatg

SEQ ID NO: 448455 - DNA, 20 bp, Artificial Sequence
  chemically synthesized
ttattcctgtgaaagatgga

SEQ ID NO: 448456 - DNA, 20 bp, Artificial Sequence
  chemically synthesized
atttattcctgtgaaagatg

SEQ ID NO: 448457 - DNA, 20 bp, Artificial Sequence
  chemically synthesized
aaaatactctccatctttca

SEQ ID NO: 448458 - DNA, 20 bp, Artificial Sequence
  chemically synthesized
acatttattcctgtgaaaga

SEQ ID NO: 448459 - DNA, 20 bp, Artificial Sequence
  chemically synthesized
aaatactctccatctttcac

SEQ ID NO: 448460 - DNA, 20 bp, Artificial Sequence
  chemically synthesized
tctaacatttattcctgtga

SEQ ID NO: 448461 - DNA, 20 bp, Artificial Sequence
  chemically synthesized
tctttcacaggaataaatgt

SEQ ID NO: 448462 - DNA, 20 bp, Artificial Sequence
  chemically synthesized
ttcacaggaataaatgttag

SEQ ID NO: 448463 - DNA, 20 bp, Artificial Sequence
  chemically synthesized
gttagaagtatgcttattta

SEQ ID NO: 448464 - DNA, 20 bp, Artificial Sequence
  chemically synthesized
ctggtaattatgccataaat

SEQ ID NO: 448465 - DNA, 20 bp, Artificial Sequence
  chemically synthesized
cttatttatggcataattac

SEQ ID NO: 448466 - DNA, 20 bp, Artificial Sequence
  chemically synthesized
tatttatggcataattacca

SEQ ID NO: 448467 - DNA, 20 bp, Artificial Sequence
  chemically synthesized
atttatggcataattaccag

SEQ ID NO: 448468 - DNA, 20 bp, Artificial Sequence
  chemically synthesized
tatggcataattaccagagg

SEQ ID NO: 448469 - DNA, 20 bp, Artificial Sequence
  chemically synthesized
tggcataattaccagaggaa

SEQ ID NO: 448470 - DNA, 20 bp, Artificial Sequence
  chemically synthesized
aggataattttctcttcctc

SEQ ID NO: 448471 - DNA, 20 bp, Artificial Sequence
  chemically synthesized
ctagataaaattcaattgat

SEQ ID NO: 448472 - DNA, 20 bp, Artificial Sequence
  chemically synthesized
tctagataaaattcaattga

SEQ ID NO: 448473 - DNA, 20 bp, Artificial Sequence
  chemically synthesized
cctatcaattgaattttatc

SEQ ID NO: 448474 - DNA, 20 bp, Artificial Sequence
  chemically synthesized
taacaatacttttcattttc

SEQ ID NO: 448475 - DNA, 20 bp, Artificial Sequence
  chemically synthesized
aattttatctagaaaatgaa

SEQ ID NO: 448476 - DNA, 20 bp, Artificial Sequence
  chemically synthesized
tagaaaatgaaaagtattgt

SEQ ID NO: 448477 - DNA, 20 bp, Artificial Sequence
  chemically synthesized
aagtattgttagtaattcct

SEQ ID NO: 448478 - DNA, 20 bp, Artificial Sequence
  chemically synthesized
tatagctgtatcatttactg

SEQ ID NO: 448479 - DNA, 20 bp, Artificial Sequence
  chemically synthesized
gtatagctgtatcatttact

SEQ ID NO: 448480 - DNA, 20 bp, Artificial Sequence
  chemically synthesized
taattcctcagtaaatgata

SEQ ID NO: 448481 - DNA, 20 bp, Artificial Sequence
  chemically synthesized
gagttatatattattatgta

SEQ ID NO: 448482 - DNA, 20 bp, Artificial Sequence
  chemically synthesized
aataatatataactctaatt

SEQ ID NO: 448483 - DNA, 20 bp, Artificial Sequence
  chemically synthesized
ttaagaacatatctaaatta

SEQ ID NO: 448484 - DNA, 20 bp, Artificial Sequence
  chemically synthesized
cgttaagaacatatctaaat

SEQ ID NO: 448485 - DNA, 20 bp, Artificial Sequence
  chemically synthesized
ggttgtttcagcaaatcgtt

SEQ ID NO: 448486 - DNA, 20 bp, Artificial Sequence
  chemically synthesized
caatcatttctgggttgttt

SEQ ID NO: 448487 - DNA, 20 bp, Artificial Sequence
  chemically synthesized
aacgatttgctgaaacaacc

SEQ ID NO: 448488 - DNA, 20 bp, Artificial Sequence
  chemically synthesized
attctggatcaatcatttct

SEQ ID NO: 448489 - DNA, 20 bp, Artificial Sequence
  chemically synthesized
gattctggatcaatcatttc

SEQ ID NO: 448490 - DNA, 20 bp, Artificial Sequence
  chemically synthesized
caacccagaaatgattgatc

SEQ ID NO: 448491 - DNA, 20 bp, Artificial Sequence
  chemically synthesized
aatgattgatccagaatcat

SEQ ID NO: 448492 - DNA, 20 bp, Artificial Sequence
  chemically synthesized
atctaatttgctcatgattc

SEQ ID NO: 448493 - DNA, 20 bp, Artificial Sequence
  chemically synthesized
atccagaatcatgagcaaat

SEQ ID NO: 448494 - DNA, 20 bp, Artificial Sequence
  chemically synthesized
gagcaaattagataaatcat

SEQ ID NO: 448495 - DNA, 20 bp, Artificial Sequence
  chemically synthesized
tttcaaattgttgatttttt

SEQ ID NO: 448496 - DNA, 20 bp, Artificial Sequence
  chemically synthesized
ttgaaaattaaaattatttt

SEQ ID NO: 448497 - DNA, 20 bp, Artificial Sequence
  chemically synthesized
ttaaaattatttttggtata

SEQ ID NO: 448498 - DNA, 20 bp, Artificial Sequence
  chemically synthesized
tttggtatatagtatgtgcc

SEQ ID NO: 448499 - DNA, 20 bp, Artificial Sequence
  chemically synthesized
tatatagtatgtgccaagct

SEQ ID NO: 448500 - DNA, 20 bp, Artificial Sequence
  chemically synthesized
tttatgtttaatactaagct

SEQ ID NO: 448501 - DNA, 20 bp, Artificial Sequence
  chemically synthesized
ttggctttatgtttaatact

SEQ ID NO: 448502 - DNA, 20 bp, Artificial Sequence
  chemically synthesized
caagcttagtattaaacata

SEQ ID NO: 448503 - DNA, 20 bp, Artificial Sequence
  chemically synthesized
acatgctgaattgcatttat

SEQ ID NO: 448504 - DNA, 20 bp, Artificial Sequence
  chemically synthesized
taaagccaataaatgcaatt

SEQ ID NO: 448505 - DNA, 20 bp, Artificial Sequence
  chemically synthesized
gtgaaaatgtaactttgaat

SEQ ID NO: 448506 - DNA, 20 bp, Artificial Sequence
  chemically synthesized
tgaaaatgtaactttgaatt

SEQ ID NO: 448507 - DNA, 20 bp, Artificial Sequence
  chemically synthesized
tctgcaattttcctaattca

SEQ ID NO: 448508 - DNA, 20 bp, Artificial Sequence
  chemically synthesized
actttgaattaggaaaattg

SEQ ID NO: 448509 - DNA, 20 bp, Artificial Sequence
  chemically synthesized
attaggaaaattgcagaatg

SEQ ID NO: 448510 - DNA, 20 bp, Artificial Sequence
  chemically synthesized
taggaaaattgcagaatgca

SEQ ID NO: 448511 - DNA, 20 bp, Artificial Sequence
  chemically synthesized
aggaaaattgcagaatgcag

SEQ ID NO: 448512 - DNA, 20 bp, Artificial Sequence
  chemically synthesized
ggaaaattgcagaatgcaga

SEQ ID NO: 448513 - DNA, 20 bp, Artificial Sequence
  chemically synthesized
aacaagattgaagaaacata

SEQ ID NO: 448514 - DNA, 20 bp, Artificial Sequence
  chemically synthesized
ataacaagattgaagaaaca

SEQ ID NO: 448515 - DNA, 20 bp, Artificial Sequence
  chemically synthesized
ttctgtcaataacaagattg

SEQ ID NO: 448516 - DNA, 20 bp, Artificial Sequence
  chemically synthesized
tacaaatttctgtcaataac

SEQ ID NO: 448517 - DNA, 20 bp, Artificial Sequence
  chemically synthesized
ttcttcaatcttgttattga

SEQ ID NO: 448518 - DNA, 20 bp, Artificial Sequence
  chemically synthesized
ttgacagaaatttgtatgta

SEQ ID NO: 448519 - DNA, 20 bp, Artificial Sequence
  chemically synthesized
cagaaatttgtatgtataga

SEQ ID NO: 448520 - DNA, 20 bp, Artificial Sequence
  chemically synthesized
gaaagttacttattttcata

SEQ ID NO: 448521 - DNA, 20 bp, Artificial Sequence
  chemically synthesized
atagaaagctgtatgaaaat

SEQ ID NO: 448522 - DNA, 20 bp, Artificial Sequence
  chemically synthesized
ttatttgggctttgtatgga

SEQ ID NO: 448523 - DNA, 20 bp, Artificial Sequence
  chemically synthesized
aataagtaactttccataca

SEQ ID NO: 448524 - DNA, 20 bp, Artificial Sequence
  chemically synthesized
gtggttatttgggctttgta

SEQ ID NO: 448525 - DNA, 20 bp, Artificial Sequence
  chemically synthesized
ataataaagggtggttattt

SEQ ID NO: 448526 - DNA, 20 bp, Artificial Sequence
  chemically synthesized
gataataaagggtggttatt

SEQ ID NO: 448527 - DNA, 20 bp, Artificial Sequence
  chemically synthesized
atttgagcgataataaaggg

SEQ ID NO: 448528 - DNA, 20 bp, Artificial Sequence
  chemically synthesized
taaatttgagcgataataaa

SEQ ID NO: 448529 - DNA, 20 bp, Artificial Sequence
  chemically synthesized
ataaatttgagcgataataa

SEQ ID NO: 448530 - DNA, 20 bp, Artificial Sequence
  chemically synthesized
aataaatttgagcgataata

SEQ ID NO: 448531 - DNA, 20 bp, Artificial Sequence
  chemically synthesized
aaataaaaataaataaattt

SEQ ID NO: 448532 - DNA, 20 bp, Artificial Sequence
  chemically synthesized
atttttatttatttattttt

SEQ ID NO: 448533 - DNA, 20 bp, Artificial Sequence
  chemically synthesized
ttatttatttatttttgaga

SEQ ID NO: 448534 - DNA, 20 bp, Artificial Sequence
  chemically synthesized
atttatttatttttgagatg

SEQ ID NO: 448535 - DNA, 20 bp, Artificial Sequence
  chemically synthesized
cactccagcctgggcaacaa

SEQ ID NO: 448536 - DNA, 20 bp, Artificial Sequence
  chemically synthesized
ggagttttgctcttgttgcc

SEQ ID NO: 448537 - DNA, 20 bp, Artificial Sequence
  chemically synthesized
gagttttgctcttgttgccc

SEQ ID NO: 448538 - DNA, 20 bp, Artificial Sequence
  chemically synthesized
tgcactccagcctgggcaac

SEQ ID NO: 448539 - DNA, 20 bp, Artificial Sequence
  chemically synthesized
tttgctcttgttgcccaggc

SEQ ID NO: 448540 - DNA, 20 bp, Artificial Sequence
  chemically synthesized
tgctcttgttgcccaggctg

SEQ ID NO: 448541 - DNA, 20 bp, Artificial Sequence
  chemically synthesized
gtgccattgcactccagcct

SEQ ID NO: 448542 - DNA, 20 bp, Artificial Sequence
  chemically synthesized
tgtgccattgcactccagcc

SEQ ID NO: 448543 - DNA, 20 bp, Artificial Sequence
  chemically synthesized
gagattgtgccattgcactc

SEQ ID NO: 448544 - DNA, 20 bp, Artificial Sequence
  chemically synthesized
ttgcccaggctggagtgcaa

SEQ ID NO: 448545 - DNA, 20 bp, Artificial Sequence
  chemically synthesized
ggagtgcaatggcacaatct

SEQ ID NO: 448546 - DNA, 20 bp, Artificial Sequence
  chemically synthesized
ggtggaggtcgcaatgagcc

SEQ ID NO: 448547 - DNA, 20 bp, Artificial Sequence
  chemically synthesized
caggaggtggaggtcgcaat

SEQ ID NO: 448548 - DNA, 20 bp, Artificial Sequence
  chemically synthesized
ggcttgaacccaggaggtgg

SEQ ID NO: 448549 - DNA, 20 bp, Artificial Sequence
  chemically synthesized
tcattgcgacctccacctcc

SEQ ID NO: 448550 - DNA, 20 bp, Artificial Sequence
  chemically synthesized
tggcttgaacccaggaggtg

SEQ ID NO: 448551 - DNA, 20 bp, Artificial Sequence
  chemically synthesized
cattgcgacctccacctcct

SEQ ID NO: 448552 - DNA, 20 bp, Artificial Sequence
  chemically synthesized
aatggcttgaacccaggagg

SEQ ID NO: 448553 - DNA, 20 bp, Artificial Sequence
  chemically synthesized
gagaatggcttgaacccagg

SEQ ID NO: 448554 - DNA, 20 bp, Artificial Sequence
  chemically synthesized
ggagaatggcttgaacccag

SEQ ID NO: 448555 - DNA, 20 bp, Artificial Sequence
  chemically synthesized
gacctccacctcctgggttc

SEQ ID NO: 448556 - DNA, 20 bp, Artificial Sequence
  chemically synthesized
caggagaatggcttgaaccc

SEQ ID NO: 448557 - DNA, 20 bp, Artificial Sequence
  chemically synthesized
gcaggagaatggcttgaacc

SEQ ID NO: 448558 - DNA, 20 bp, Artificial Sequence
  chemically synthesized
gggaggctgaggcaggagaa

SEQ ID NO: 448559 - DNA, 20 bp, Artificial Sequence
  chemically synthesized
ttcaagccattctcctgcct

SEQ ID NO: 448560 - DNA, 20 bp, Artificial Sequence
  chemically synthesized
tactagggaggctgaggcag

SEQ ID NO: 448561 - DNA, 20 bp, Artificial Sequence
  chemically synthesized
gctactagggaggctgaggc

SEQ ID NO: 448562 - DNA, 20 bp, Artificial Sequence
  chemically synthesized
agctactagggaggctgagg

SEQ ID NO: 448563 - DNA, 20 bp, Artificial Sequence
  chemically synthesized
cccagctactagggaggctg

SEQ ID NO: 448564 - DNA, 20 bp, Artificial Sequence
  chemically synthesized
tcccagctactagggaggct

SEQ ID NO: 448565 - DNA, 20 bp, Artificial Sequence
  chemically synthesized
ttctcctgcctcagcctccc

SEQ ID NO: 448566 - DNA, 20 bp, Artificial Sequence
  chemically synthesized
tcctgcctcagcctccctag

SEQ ID NO: 448567 - DNA, 20 bp, Artificial Sequence
  chemically synthesized
tgtcatcccagctactaggg

SEQ ID NO: 448568 - DNA, 20 bp, Artificial Sequence
  chemically synthesized
ctgtcatcccagctactagg

SEQ ID NO: 448569 - DNA, 20 bp, Artificial Sequence
  chemically synthesized
gcctcagcctccctagtagc

SEQ ID NO: 448570 - DNA, 20 bp, Artificial Sequence
  chemically synthesized
gcctgtcatcccagctacta

SEQ ID NO: 448571 - DNA, 20 bp, Artificial Sequence
  chemically synthesized
cctcagcctccctagtagct

SEQ ID NO: 448572 - DNA, 20 bp, Artificial Sequence
  chemically synthesized
tgcctgtcatcccagctact

SEQ ID NO: 448573 - DNA, 20 bp, Artificial Sequence
  chemically synthesized
atgcctgtcatcccagctac

SEQ ID NO: 448574 - DNA, 20 bp, Artificial Sequence
  chemically synthesized
ctccctagtagctgggatga

SEQ ID NO: 448575 - DNA, 20 bp, Artificial Sequence
  chemically synthesized
tccctagtagctgggatgac

SEQ ID NO: 448576 - DNA, 20 bp, Artificial Sequence
  chemically synthesized
gtggcagatgcctgtcatcc

SEQ ID NO: 448577 - DNA, 20 bp, Artificial Sequence
  chemically synthesized
aaattagccaggtgtggtgg

SEQ ID NO: 448578 - DNA, 20 bp, Artificial Sequence
  chemically synthesized
caggcatctgccaccacacc

SEQ ID NO: 448579 - DNA, 20 bp, Artificial Sequence
  chemically synthesized
caaaaattagccaggtgtgg

SEQ ID NO: 448580 - DNA, 20 bp, Artificial Sequence
  chemically synthesized
atacaaaaattagccaggtg

SEQ ID NO: 448581 - DNA, 20 bp, Artificial Sequence
  chemically synthesized
tgaaaatacaaaaattagcc

SEQ ID NO: 448582 - DNA, 20 bp, Artificial Sequence
  chemically synthesized
ctgaaaatacaaaaattagc

SEQ ID NO: 448583 - DNA, 20 bp, Artificial Sequence
  chemically synthesized
tctactgaaaatacaaaaat

SEQ ID NO: 448584 - DNA, 20 bp, Artificial Sequence
  chemically synthesized
ctggctaatttttgtatttt

SEQ ID NO: 448585 - DNA, 20 bp, Artificial Sequence
  chemically synthesized
gctaatttttgtattttcag

SEQ ID NO: 448586 - DNA, 20 bp, Artificial Sequence
  chemically synthesized
taatttttgtattttcagta

SEQ ID NO: 448587 - DNA, 20 bp, Artificial Sequence
  chemically synthesized
tttgtattttcagtagagac

SEQ ID NO: 448588 - DNA, 20 bp, Artificial Sequence
  chemically synthesized
ttgtattttcagtagagacc

SEQ ID NO: 448589 - DNA, 20 bp, Artificial Sequence
  chemically synthesized
ctggccaacgtggtgaaacc

SEQ ID NO: 448590 - DNA, 20 bp, Artificial Sequence
  chemically synthesized
gagaccgggtttcaccacgt

SEQ ID NO: 448591 - DNA, 20 bp, Artificial Sequence
  chemically synthesized
ccgggtttcaccacgttggc

SEQ ID NO: 448592 - DNA, 20 bp, Artificial Sequence
  chemically synthesized
cgagaccagcctggccaacg

SEQ ID NO: 448593 - DNA, 20 bp, Artificial Sequence
  chemically synthesized
cgggtttcaccacgttggcc

SEQ ID NO: 448594 - DNA, 20 bp, Artificial Sequence
  chemically synthesized
tttcaccacgttggccaggc

SEQ ID NO: 448595 - DNA, 20 bp, Artificial Sequence
  chemically synthesized
tcaggagttcgagaccagcc

SEQ ID NO: 448596 - DNA, 20 bp, Artificial Sequence
  chemically synthesized
taaggtcaggagttcgagac

SEQ ID NO: 448597 - DNA, 20 bp, Artificial Sequence
  chemically synthesized
tcacctaaggtcaggagttc

SEQ ID NO: 448598 - DNA, 20 bp, Artificial Sequence
  chemically synthesized
tggtctcgaactcctgacct

SEQ ID NO: 448599 - DNA, 20 bp, Artificial Sequence
  chemically synthesized
ggcagatcacctaaggtcag

SEQ ID NO: 448600 - DNA, 20 bp, Artificial Sequence
  chemically synthesized
ggtctcgaactcctgacctt

SEQ ID NO: 448601 - DNA, 20 bp, Artificial Sequence
  chemically synthesized
tgggcagatcacctaaggtc

SEQ ID NO: 448602 - DNA, 20 bp, Artificial Sequence
  chemically synthesized
gtgggcagatcacctaaggt

SEQ ID NO: 448603 - DNA, 20 bp, Artificial Sequence
  chemically synthesized
caaggtgggcagatcaccta

SEQ ID NO: 448604 - DNA, 20 bp, Artificial Sequence
  chemically synthesized
ccaaggtgggcagatcacct

SEQ ID NO: 448605 - DNA, 20 bp, Artificial Sequence
  chemically synthesized
cttaggtgatctgcccacct

SEQ ID NO: 448606 - DNA, 20 bp, Artificial Sequence
  chemically synthesized
ctttgggaggccaaggtggg

SEQ ID NO: 448607 - DNA, 20 bp, Artificial Sequence
  chemically synthesized
gcactttgggaggccaaggt

SEQ ID NO: 448608 - DNA, 20 bp, Artificial Sequence
  chemically synthesized
agcactttgggaggccaagg

SEQ ID NO: 448609 - DNA, 20 bp, Artificial Sequence
  chemically synthesized
accagcactttgggaggcca

SEQ ID NO: 448610 - DNA, 20 bp, Artificial Sequence
  chemically synthesized
taccagcactttgggaggcc

SEQ ID NO: 448611 - DNA, 20 bp, Artificial Sequence
  chemically synthesized
ctgcccaccttggcctccca

SEQ ID NO: 448612 - DNA, 20 bp, Artificial Sequence
  chemically synthesized
tgtaataccagcactttggg

SEQ ID NO: 448613 - DNA, 20 bp, Artificial Sequence
  chemically synthesized
ctgtaataccagcactttgg

SEQ ID NO: 448614 - DNA, 20 bp, Artificial Sequence
  chemically synthesized
accttggcctcccaaagtgc

SEQ ID NO: 448615 - DNA, 20 bp, Artificial Sequence
  chemically synthesized
gcctgtaataccagcacttt

SEQ ID NO: 448616 - DNA, 20 bp, Artificial Sequence
  chemically synthesized
tgcctgtaataccagcactt

SEQ ID NO: 448617 - DNA, 20 bp, Artificial Sequence
  chemically synthesized
ctcccaaagtgctggtatta

SEQ ID NO: 448618 - DNA, 20 bp, Artificial Sequence
  chemically synthesized
tcccaaagtgctggtattac

SEQ ID NO: 448619 - DNA, 20 bp, Artificial Sequence
  chemically synthesized
gtggctcatgcctgtaatac

SEQ ID NO: 448620 - DNA, 20 bp, Artificial Sequence
  chemically synthesized
agtgctggtattacaggcat

SEQ ID NO: 448621 - DNA, 20 bp, Artificial Sequence
  chemically synthesized
caggcatgagccaccatgcc

SEQ ID NO: 448622 - DNA, 20 bp, Artificial Sequence
  chemically synthesized
gagcaattggccaggcatgg

SEQ ID NO: 448623 - DNA, 20 bp, Artificial Sequence
  chemically synthesized
tgagagcaattggccaggca

SEQ ID NO: 448624 - DNA, 20 bp, Artificial Sequence
  chemically synthesized
ttaaatgagagcaattggcc

SEQ ID NO: 448625 - DNA, 20 bp, Artificial Sequence
  chemically synthesized
tttaaatgagagcaattggc

SEQ ID NO: 448626 - DNA, 20 bp, Artificial Sequence
  chemically synthesized
tgaatttaaatgagagcaat

SEQ ID NO: 448627 - DNA, 20 bp, Artificial Sequence
  chemically synthesized
cataatttgaatttaaatga

SEQ ID NO: 448628 - DNA, 20 bp, Artificial Sequence
  chemically synthesized
tacataatttgaatttaaat

SEQ ID NO: 448629 - DNA, 20 bp, Artificial Sequence
  chemically synthesized
tcatttaaattcaaattatg

SEQ ID NO: 448630 - DNA, 20 bp, Artificial Sequence
  chemically synthesized
aaatgcaataatgatatggg

SEQ ID NO: 448631 - DNA, 20 bp, Artificial Sequence
  chemically synthesized
gtaaatgcaataatgatatg

SEQ ID NO: 448632 - DNA, 20 bp, Artificial Sequence
  chemically synthesized
agtaaatgcaataatgatat

SEQ ID NO: 448633 - DNA, 20 bp, Artificial Sequence
  chemically synthesized
aagtaaatgcaataatgata

SEQ ID NO: 448634 - DNA, 20 bp, Artificial Sequence
  chemically synthesized
cattattgcatttacttcat

SEQ ID NO: 448635 - DNA, 20 bp, Artificial Sequence
  chemically synthesized
ttatgtaagtatgtcttatg

SEQ ID NO: 448636 - DNA, 20 bp, Artificial Sequence
  chemically synthesized
caatcaaatcaaatttatgt

SEQ ID NO: 448637 - DNA, 20 bp, Artificial Sequence
  chemically synthesized
ttacataaatttgatttgat

SEQ ID NO: 448638 - DNA, 20 bp, Artificial Sequence
  chemically synthesized
tacataaatttgatttgatt

SEQ ID NO: 448639 - DNA, 20 bp, Artificial Sequence
  chemically synthesized
tatctttaacataatgtcgt

SEQ ID NO: 448640 - DNA, 20 bp, Artificial Sequence
  chemically synthesized
ttacttacgacattatgtta

SEQ ID NO: 448641 - DNA, 20 bp, Artificial Sequence
  chemically synthesized
ttaaagatacattgcactct

SEQ ID NO: 448642 - DNA, 20 bp, Artificial Sequence
  chemically synthesized
gttaaaaatgggcaggccaa

SEQ ID NO: 448643 - DNA, 20 bp, Artificial Sequence
  chemically synthesized
ttgttaaaaatgggcaggcc

SEQ ID NO: 448644 - DNA, 20 bp, Artificial Sequence
  chemically synthesized
ctacgttgttaaaaatgggc

SEQ ID NO: 448645 - DNA, 20 bp, Artificial Sequence
  chemically synthesized
cctacgttgttaaaaatggg

SEQ ID NO: 448646 - DNA, 20 bp, Artificial Sequence
  chemically synthesized
tttcctacgttgttaaaaat

SEQ ID NO: 448647 - DNA, 20 bp, Artificial Sequence
  chemically synthesized
gtttcctacgttgttaaaaa

SEQ ID NO: 448648 - DNA, 20 bp, Artificial Sequence
  chemically synthesized
cctgcccatttttaacaacg

SEQ ID NO: 448649 - DNA, 20 bp, Artificial Sequence
  chemically synthesized
ctgcccatttttaacaacgt

SEQ ID NO: 448650 - DNA, 20 bp, Artificial Sequence
  chemically synthesized
atttttaacaacgtaggaaa

SEQ ID NO: 448651 - DNA, 20 bp, Artificial Sequence
  chemically synthesized
gcaggagtaaggagtgtttg

SEQ ID NO: 448652 - DNA, 20 bp, Artificial Sequence
  chemically synthesized
tgcatttttgcaggagtaag

SEQ ID NO: 448653 - DNA, 20 bp, Artificial Sequence
  chemically synthesized
cttgcatttttgcaggagta

SEQ ID NO: 448654 - DNA, 20 bp, Artificial Sequence
  chemically synthesized
ccttgcatttttgcaggagt

SEQ ID NO: 448655 - DNA, 20 bp, Artificial Sequence
  chemically synthesized
aattccttgcatttttgcag

SEQ ID NO: 448656 - DNA, 20 bp, Artificial Sequence
  chemically synthesized
tcaattccttgcatttttgc

SEQ ID NO: 448657 - DNA, 20 bp, Artificial Sequence
  chemically synthesized
ttcaattccttgcatttttg

SEQ ID NO: 448658 - DNA, 20 bp, Artificial Sequence
  chemically synthesized
ccttactcctgcaaaaatgc

SEQ ID NO: 448659 - DNA, 20 bp, Artificial Sequence
  chemically synthesized
cttactcctgcaaaaatgca

SEQ ID NO: 448660 - DNA, 20 bp, Artificial Sequence
  chemically synthesized
agtgcaacatgattggacat

SEQ ID NO: 448661 - DNA, 20 bp, Artificial Sequence
  chemically synthesized
aagtgcaacatgattggaca

SEQ ID NO: 448662 - DNA, 20 bp, Artificial Sequence
  chemically synthesized
ttgcaaaagtgcaacatgat

SEQ ID NO: 448663 - DNA, 20 bp, Artificial Sequence
  chemically synthesized
gaggtagggaatgtttgcaa

SEQ ID NO: 448664 - DNA, 20 bp, Artificial Sequence
  chemically synthesized
acttcatttggggagaggta

SEQ ID NO: 448665 - DNA, 20 bp, Artificial Sequence
  chemically synthesized
tacttcatttggggagaggt

SEQ ID NO: 448666 - DNA, 20 bp, Artificial Sequence
  chemically synthesized
ttacttcatttggggagagg

SEQ ID NO: 448667 - DNA, 20 bp, Artificial Sequence
  chemically synthesized
gtgttacttcatttggggag

SEQ ID NO: 448668 - DNA, 20 bp, Artificial Sequence
  chemically synthesized
tgtgttacttcatttgggga

SEQ ID NO: 448669 - DNA, 20 bp, Artificial Sequence
  chemically synthesized
actgtgttacttcatttggg

SEQ ID NO: 448670 - DNA, 20 bp, Artificial Sequence
  chemically synthesized
tccctacctctccccaaatg

SEQ ID NO: 448671 - DNA, 20 bp, Artificial Sequence
  chemically synthesized
aaactgtgttacttcatttg

SEQ ID NO: 448672 - DNA, 20 bp, Artificial Sequence
  chemically synthesized
aaaactgtgttacttcattt

SEQ ID NO: 448673 - DNA, 20 bp, Artificial Sequence
  chemically synthesized
caaaactgtgttacttcatt

SEQ ID NO: 448674 - DNA, 20 bp, Artificial Sequence
  chemically synthesized
tctccccaaatgaagtaaca

SEQ ID NO: 448675 - DNA, 20 bp, Artificial Sequence
  chemically synthesized
taaaaagaaaagaaatgatg

SEQ ID NO: 448676 - DNA, 20 bp, Artificial Sequence
  chemically synthesized
taataaacatataaaaagaa

SEQ ID NO: 448677 - DNA, 20 bp, Artificial Sequence
  chemically synthesized
gtgtttaataaacatataaa

SEQ ID NO: 448678 - DNA, 20 bp, Artificial Sequence
  chemically synthesized
acacacacatattattccta

SEQ ID NO: 448679 - DNA, 20 bp, Artificial Sequence
  chemically synthesized
aaaataaaattttagtcttt

SEQ ID NO: 448680 - DNA, 20 bp, Artificial Sequence
  chemically synthesized
gaaaataaaattttagtctt

SEQ ID NO: 448681 - DNA, 20 bp, Artificial Sequence
  chemically synthesized
acatattgaaaataaaattt

SEQ ID NO: 448682 - DNA, 20 bp, Artificial Sequence
  chemically synthesized
aattttattttcaatatgtt

SEQ ID NO: 448683 - DNA, 20 bp, Artificial Sequence
  chemically synthesized
tttcaatatgtttggcttta

SEQ ID NO: 448684 - DNA, 20 bp, Artificial Sequence
  chemically synthesized
tcaatatgtttggctttatg

SEQ ID NO: 448685 - DNA, 20 bp, Artificial Sequence
  chemically synthesized
tggtaaatatcatctccata

SEQ ID NO: 448686 - DNA, 20 bp, Artificial Sequence
  chemically synthesized
tggagatgatatttaccatg

SEQ ID NO: 448687 - DNA, 20 bp, Artificial Sequence
  chemically synthesized
cctgaatggaacatactaca

SEQ ID NO: 448688 - DNA, 20 bp, Artificial Sequence
  chemically synthesized
accatgtagtatgttccatt

SEQ ID NO: 448689 - DNA, 20 bp, Artificial Sequence
  chemically synthesized
ccatgtagtatgttccattc

SEQ ID NO: 448690 - DNA, 20 bp, Artificial Sequence
  chemically synthesized
agtatcccttgatacctgaa

SEQ ID NO: 448691 - DNA, 20 bp, Artificial Sequence
  chemically synthesized
gtatgttccattcaggtatc

SEQ ID NO: 448692 - DNA, 20 bp, Artificial Sequence
  chemically synthesized
tatgttccattcaggtatca

SEQ ID NO: 448693 - DNA, 20 bp, Artificial Sequence
  chemically synthesized
atgttccattcaggtatcaa

SEQ ID NO: 448694 - DNA, 20 bp, Artificial Sequence
  chemically synthesized
gtatcaagggatactgtact

SEQ ID NO: 448695 - DNA, 20 bp, Artificial Sequence
  chemically synthesized
atcaagggatactgtactca

SEQ ID NO: 448696 - DNA, 20 bp, Artificial Sequence
  chemically synthesized
gatggtgcattctctgagta

SEQ ID NO: 448697 - DNA, 20 bp, Artificial Sequence
  chemically synthesized
tgtcagatggtgcattctct

SEQ ID NO: 448698 - DNA, 20 bp, Artificial Sequence
  chemically synthesized
aatttaataaaaatgtcaga

SEQ ID NO: 448699 - DNA, 20 bp, Artificial Sequence
  chemically synthesized
aataaatttaataaaaatgt

SEQ ID NO: 448700 - DNA, 20 bp, Artificial Sequence
  chemically synthesized
gacatttttattaaatttat

SEQ ID NO: 448701 - DNA, 20 bp, Artificial Sequence
  chemically synthesized
aaatttattggatttaatat

SEQ ID NO: 448702 - DNA, 20 bp, Artificial Sequence
  chemically synthesized
aatttattggatttaatatt

SEQ ID NO: 448703 - DNA, 20 bp, Artificial Sequence
  chemically synthesized
ggttttttgaattataatgt

SEQ ID NO: 448704 - DNA, 20 bp, Artificial Sequence
  chemically synthesized
gttggatttatttttttctt

SEQ ID NO: 448705 - DNA, 20 bp, Artificial Sequence
  chemically synthesized
tgttagcagtataatatcca

SEQ ID NO: 448706 - DNA, 20 bp, Artificial Sequence
  chemically synthesized
acaatatcgatgaatgttag

SEQ ID NO: 448707 - DNA, 20 bp, Artificial Sequence
  chemically synthesized
aaaacaatatcgatgaatgt

SEQ ID NO: 448708 - DNA, 20 bp, Artificial Sequence
  chemically synthesized
gatattgttttgtgttgttg

SEQ ID NO: 448709 - DNA, 20 bp, Artificial Sequence
  chemically synthesized
tgttgttgtggttctttttt

SEQ ID NO: 448710 - DNA, 20 bp, Artificial Sequence
  chemically synthesized
ctattatacagaactgaaaa

SEQ ID NO: 448711 - DNA, 20 bp, Artificial Sequence
  chemically synthesized
cttttttcagttctgtataa

SEQ ID NO: 448712 - DNA, 20 bp, Artificial Sequence
  chemically synthesized
ctactatgtgggctattata

SEQ ID NO: 448713 - DNA, 20 bp, Artificial Sequence
  chemically synthesized
gttctgtataatagcccaca

SEQ ID NO: 448714 - DNA, 20 bp, Artificial Sequence
  chemically synthesized
ctgtataatagcccacatag

SEQ ID NO: 448715 - DNA, 20 bp, Artificial Sequence
  chemically synthesized
tgaatagtttactactatgt

SEQ ID NO: 448716 - DNA, 20 bp, Artificial Sequence
  chemically synthesized
atgaatagtttactactatg

SEQ ID NO: 448717 - DNA, 20 bp, Artificial Sequence
  chemically synthesized
atatatatatatataatgaa

SEQ ID NO: 448718 - DNA, 20 bp, Artificial Sequence
  chemically synthesized
acacacacatacatacatac

SEQ ID NO: 448719 - DNA, 20 bp, Artificial Sequence
  chemically synthesized
atgtgtgtgtatgtgtgtat

SEQ ID NO: 448720 - DNA, 20 bp, Artificial Sequence
  chemically synthesized
tgtgtatgtgtgtattagaa

SEQ ID NO: 448721 - DNA, 20 bp, Artificial Sequence
  chemically synthesized
gtatgtgtgtattagaacag

SEQ ID NO: 448722 - DNA, 20 bp, Artificial Sequence
  chemically synthesized
ccctagtgccaaaaaggttg

SEQ ID NO: 448723 - DNA, 20 bp, Artificial Sequence
  chemically synthesized
tccctagtgccaaaaaggtt

SEQ ID NO: 448724 - DNA, 20 bp, Artificial Sequence
  chemically synthesized
acagtggtccccaacctttt

SEQ ID NO: 448725 - DNA, 20 bp, Artificial Sequence
  chemically synthesized
ttccctagtgccaaaaaggt

SEQ ID NO: 448726 - DNA, 20 bp, Artificial Sequence
  chemically synthesized
actgttccctagtgccaaaa

SEQ ID NO: 448727 - DNA, 20 bp, Artificial Sequence
  chemically synthesized
aactgttccctagtgccaaa

SEQ ID NO: 448728 - DNA, 20 bp, Artificial Sequence
  chemically synthesized
gtccccaacctttttggcac

SEQ ID NO: 448729 - DNA, 20 bp, Artificial Sequence
  chemically synthesized
tccccaacctttttggcact

SEQ ID NO: 448730 - DNA, 20 bp, Artificial Sequence
  chemically synthesized
ccccaacctttttggcacta

SEQ ID NO: 448731 - DNA, 20 bp, Artificial Sequence
  chemically synthesized
acctttttggcactagggaa

SEQ ID NO: 448732 - DNA, 20 bp, Artificial Sequence
  chemically synthesized
tcttccacaaaactgttccc

SEQ ID NO: 448733 - DNA, 20 bp, Artificial Sequence
  chemically synthesized
ggcactagggaacagttttg

SEQ ID NO: 448734 - DNA, 20 bp, Artificial Sequence
  chemically synthesized
actagggaacagttttgtgg

SEQ ID NO: 448735 - DNA, 20 bp, Artificial Sequence
  chemically synthesized
tgtggaagacaattattcca

SEQ ID NO: 448736 - DNA, 20 bp, Artificial Sequence
  chemically synthesized
gaagacaattattccacaga

SEQ ID NO: 448737 - DNA, 20 bp, Artificial Sequence
  chemically synthesized
aagacaattattccacagac

SEQ ID NO: 448738 - DNA, 20 bp, Artificial Sequence
  chemically synthesized
agacaattattccacagaca

SEQ ID NO: 448739 - DNA, 20 bp, Artificial Sequence
  chemically synthesized
gacaattattccacagacag

SEQ ID NO: 448740 - DNA, 20 bp, Artificial Sequence
  chemically synthesized
ctcccccaaacccctgtctg

SEQ ID NO: 448741 - DNA, 20 bp, Artificial Sequence
  chemically synthesized
ttattccacagacaggggtt

SEQ ID NO: 448742 - DNA, 20 bp, Artificial Sequence
  chemically synthesized
tattccacagacaggggttt

SEQ ID NO: 448743 - DNA, 20 bp, Artificial Sequence
  chemically synthesized
attccacagacaggggtttg

SEQ ID NO: 448744 - DNA, 20 bp, Artificial Sequence
  chemically synthesized
ttccacagacaggggtttgg

SEQ ID NO: 448745 - DNA, 20 bp, Artificial Sequence
  chemically synthesized
ccacagacaggggtttgggg

SEQ ID NO: 448746 - DNA, 20 bp, Artificial Sequence
  chemically synthesized
cacagacaggggtttggggg

SEQ ID NO: 448747 - DNA, 20 bp, Artificial Sequence
  chemically synthesized
gtttgggggaggtgaaaatc

SEQ ID NO: 448748 - DNA, 20 bp, Artificial Sequence
  chemically synthesized
tttgggggaggtgaaaatct

SEQ ID NO: 448749 - DNA, 20 bp, Artificial Sequence
  chemically synthesized
ttgggggaggtgaaaatctg

SEQ ID NO: 448750 - DNA, 20 bp, Artificial Sequence
  chemically synthesized
tgggggaggtgaaaatctgg

SEQ ID NO: 448751 - DNA, 20 bp, Artificial Sequence
  chemically synthesized
gaggtgaaaatctgggggta

SEQ ID NO: 448752 - DNA, 20 bp, Artificial Sequence
  chemically synthesized
aggtgaaaatctgggggtat

SEQ ID NO: 448753 - DNA, 20 bp, Artificial Sequence
  chemically synthesized
aaccacaacccctatacccc

SEQ ID NO: 448754 - DNA, 20 bp, Artificial Sequence
  chemically synthesized
ggtgaaaatctgggggtata

SEQ ID NO: 448755 - DNA, 20 bp, Artificial Sequence
  chemically synthesized
gtgaaaatctgggggtatag

SEQ ID NO: 448756 - DNA, 20 bp, Artificial Sequence
  chemically synthesized
atctgggggtataggggttg

SEQ ID NO: 448757 - DNA, 20 bp, Artificial Sequence
  chemically synthesized
ggggtataggggttgtggtt

SEQ ID NO: 448758 - DNA, 20 bp, Artificial Sequence
  chemically synthesized
gggtataggggttgtggttt

SEQ ID NO: 448759 - DNA, 20 bp, Artificial Sequence
  chemically synthesized
ggtataggggttgtggtttg

SEQ ID NO: 448760 - DNA, 20 bp, Artificial Sequence
  chemically synthesized
cctaatgagctgaggtggaa

SEQ ID NO: 448761 - DNA, 20 bp, Artificial Sequence
  chemically synthesized
gggttgaaactgttccacct

SEQ ID NO: 448762 - DNA, 20 bp, Artificial Sequence
  chemically synthesized
taatgcctaatgagctgagg

SEQ ID NO: 448763 - DNA, 20 bp, Artificial Sequence
  chemically synthesized
atctaatgcctaatgagctg

SEQ ID NO: 448764 - DNA, 20 bp, Artificial Sequence
  chemically synthesized
actgttccacctcagctcat

SEQ ID NO: 448765 - DNA, 20 bp, Artificial Sequence
  chemically synthesized
aatctaatgcctaatgagct

SEQ ID NO: 448766 - DNA, 20 bp, Artificial Sequence
  chemically synthesized
ctgttccacctcagctcatt

SEQ ID NO: 448767 - DNA, 20 bp, Artificial Sequence
  chemically synthesized
atatgaatctaatgcctaat

SEQ ID NO: 448768 - DNA, 20 bp, Artificial Sequence
  chemically synthesized
cacctcagctcattaggcat

SEQ ID NO: 448769 - DNA, 20 bp, Artificial Sequence
  chemically synthesized
attaggcattagattcatat

SEQ ID NO: 448770 - DNA, 20 bp, Artificial Sequence
  chemically synthesized
ttaggcattagattcatata

SEQ ID NO: 448771 - DNA, 20 bp, Artificial Sequence
  chemically synthesized
aggcattagattcatataag

SEQ ID NO: 448772 - DNA, 20 bp, Artificial Sequence
  chemically synthesized
atgtgagggaaataagttgc

SEQ ID NO: 448773 - DNA, 20 bp, Artificial Sequence
  chemically synthesized
catgtgagggaaataagttg

SEQ ID NO: 448774 - DNA, 20 bp, Artificial Sequence
  chemically synthesized
actgcgcatgtgagggaaat

SEQ ID NO: 448775 - DNA, 20 bp, Artificial Sequence
  chemically synthesized
actgtgaactgcgcatgtga

SEQ ID NO: 448776 - DNA, 20 bp, Artificial Sequence
  chemically synthesized
tactgtgaactgcgcatgtg

SEQ ID NO: 448777 - DNA, 20 bp, Artificial Sequence
  chemically synthesized
acttatttccctcacatgcg

SEQ ID NO: 448778 - DNA, 20 bp, Artificial Sequence
  chemically synthesized
ctactgtgaactgcgcatgt

SEQ ID NO: 448779 - DNA, 20 bp, Artificial Sequence
  chemically synthesized
tccctcacatgcgcagttca

SEQ ID NO: 448780 - DNA, 20 bp, Artificial Sequence
  chemically synthesized
ctcacatgcgcagttcacag

SEQ ID NO: 448781 - DNA, 20 bp, Artificial Sequence
  chemically synthesized
tcacatgcgcagttcacagt

SEQ ID NO: 448782 - DNA, 20 bp, Artificial Sequence
  chemically synthesized
cacatgcgcagttcacagta

SEQ ID NO: 448783 - DNA, 20 bp, Artificial Sequence
  chemically synthesized
tgcgcagttcacagtagggt

SEQ ID NO: 448784 - DNA, 20 bp, Artificial Sequence
  chemically synthesized
agtagggttggctctcctat

SEQ ID NO: 448785 - DNA, 20 bp, Artificial Sequence
  chemically synthesized
agcattagattctcatagga

SEQ ID NO: 448786 - DNA, 20 bp, Artificial Sequence
  chemically synthesized
gcagcattagattctcatag

SEQ ID NO: 448787 - DNA, 20 bp, Artificial Sequence
  chemically synthesized
tggcagcattagattctcat

SEQ ID NO: 448788 - DNA, 20 bp, Artificial Sequence
  chemically synthesized
gtggcagcattagattctca

SEQ ID NO: 448789 - DNA, 20 bp, Artificial Sequence
  chemically synthesized
tgtcatatcagtggcagcat

SEQ ID NO: 448790 - DNA, 20 bp, Artificial Sequence
  chemically synthesized
gcctcctgtcatatcagtgg

SEQ ID NO: 448791 - DNA, 20 bp, Artificial Sequence
  chemically synthesized
tctgcctcctgtcatatcag

SEQ ID NO: 448792 - DNA, 20 bp, Artificial Sequence
  chemically synthesized
taatgctgccactgatatga

SEQ ID NO: 448793 - DNA, 20 bp, Artificial Sequence
  chemically synthesized
aatgctgccactgatatgac

SEQ ID NO: 448794 - DNA, 20 bp, Artificial Sequence
  chemically synthesized
agctctgcctcctgtcatat

SEQ ID NO: 448795 - DNA, 20 bp, Artificial Sequence
  chemically synthesized
tgctgccactgatatgacag

SEQ ID NO: 448796 - DNA, 20 bp, Artificial Sequence
  chemically synthesized
gctgccactgatatgacagg

SEQ ID NO: 448797 - DNA, 20 bp, Artificial Sequence
  chemically synthesized
gccactgatatgacaggagg

SEQ ID NO: 448798 - DNA, 20 bp, Artificial Sequence
  chemically synthesized
cactgatatgacaggaggca

SEQ ID NO: 448799 - DNA, 20 bp, Artificial Sequence
  chemically synthesized
atatgacaggaggcagagct

SEQ ID NO: 448800 - DNA, 20 bp, Artificial Sequence
  chemically synthesized
tatgacaggaggcagagctc

SEQ ID NO: 448801 - DNA, 20 bp, Artificial Sequence
  chemically synthesized
gacaggaggcagagctcagg

SEQ ID NO: 448802 - DNA, 20 bp, Artificial Sequence
  chemically synthesized
gtgagcaaacattactgcct

SEQ ID NO: 448803 - DNA, 20 bp, Artificial Sequence
  chemically synthesized
gcaggaggtgagcagaaggt

SEQ ID NO: 448804 - DNA, 20 bp, Artificial Sequence
  chemically synthesized
cacagcaggaggtgagcaga

SEQ ID NO: 448805 - DNA, 20 bp, Artificial Sequence
  chemically synthesized
gcacagcaggaggtgagcag

SEQ ID NO: 448806 - DNA, 20 bp, Artificial Sequence
  chemically synthesized
gctgcacagcaggaggtgag

SEQ ID NO: 448807 - DNA, 20 bp, Artificial Sequence
  chemically synthesized
ccagctgcacagcaggaggt

SEQ ID NO: 448808 - DNA, 20 bp, Artificial Sequence
  chemically synthesized
gaacccagctgcacagcagg

SEQ ID NO: 448809 - DNA, 20 bp, Artificial Sequence
  chemically synthesized
ggaacccagctgcacagcag

SEQ ID NO: 448810 - DNA, 20 bp, Artificial Sequence
  chemically synthesized
tctgctcacctcctgctgtg

SEQ ID NO: 448811 - DNA, 20 bp, Artificial Sequence
  chemically synthesized
taggaacccagctgcacagc

SEQ ID NO: 448812 - DNA, 20 bp, Artificial Sequence
  chemically synthesized
ttaggaacccagctgcacag

SEQ ID NO: 448813 - DNA, 20 bp, Artificial Sequence
  chemically synthesized
ctcacctcctgctgtgcagc

SEQ ID NO: 448814 - DNA, 20 bp, Artificial Sequence
  chemically synthesized
tcacctcctgctgtgcagct

SEQ ID NO: 448815 - DNA, 20 bp, Artificial Sequence
  chemically synthesized
ctgttaggaacccagctgca

SEQ ID NO: 448816 - DNA, 20 bp, Artificial Sequence
  chemically synthesized
tctgtggcctgttaggaacc

SEQ ID NO: 448817 - DNA, 20 bp, Artificial Sequence
  chemically synthesized
ctgtgcagctgggttcctaa

SEQ ID NO: 448818 - DNA, 20 bp, Artificial Sequence
  chemically synthesized
tgtgcagctgggttcctaac

SEQ ID NO: 448819 - DNA, 20 bp, Artificial Sequence
  chemically synthesized
gtactggtctgtggcctgtt

SEQ ID NO: 448820 - DNA, 20 bp, Artificial Sequence
  chemically synthesized
ggtactggtctgtggcctgt

SEQ ID NO: 448821 - DNA, 20 bp, Artificial Sequence
  chemically synthesized
gctgggttcctaacaggcca

SEQ ID NO: 448822 - DNA, 20 bp, Artificial Sequence
  chemically synthesized
gttcctaacaggccacagac

SEQ ID NO: 448823 - DNA, 20 bp, Artificial Sequence
  chemically synthesized
caaggaccggtactggtctg

SEQ ID NO: 448824 - DNA, 20 bp, Artificial Sequence
  chemically synthesized
aacaggccacagaccagtac

SEQ ID NO: 448825 - DNA, 20 bp, Artificial Sequence
  chemically synthesized
cctgggccaaggaccggtac

SEQ ID NO: 448826 - DNA, 20 bp, Artificial Sequence
  chemically synthesized
cacagaccagtaccggtcct

SEQ ID NO: 448827 - DNA, 20 bp, Artificial Sequence
  chemically synthesized
ccaacccctgggccaaggac

SEQ ID NO: 448828 - DNA, 20 bp, Artificial Sequence
  chemically synthesized
accagtaccggtccttggcc

SEQ ID NO: 448829 - DNA, 20 bp, Artificial Sequence
  chemically synthesized
ccagtaccggtccttggccc

SEQ ID NO: 448830 - DNA, 20 bp, Artificial Sequence
  chemically synthesized
cagtaccggtccttggccca

SEQ ID NO: 448831 - DNA, 20 bp, Artificial Sequence
  chemically synthesized
ggtccccaacccctgggcca

SEQ ID NO: 448832 - DNA, 20 bp, Artificial Sequence
  chemically synthesized
agtaccggtccttggcccag

SEQ ID NO: 448833 - DNA, 20 bp, Artificial Sequence
  chemically synthesized
gggtccccaacccctgggcc

SEQ ID NO: 448834 - DNA, 20 bp, Artificial Sequence
  chemically synthesized
ccggtccttggcccaggggt

SEQ ID NO: 448835 - DNA, 20 bp, Artificial Sequence
  chemically synthesized
cggtccttggcccaggggtt

SEQ ID NO: 448836 - DNA, 20 bp, Artificial Sequence
  chemically synthesized
tacaagggtccccaacccct

SEQ ID NO: 448837 - DNA, 20 bp, Artificial Sequence
  chemically synthesized
ggtccttggcccaggggttg

SEQ ID NO: 448838 - DNA, 20 bp, Artificial Sequence
  chemically synthesized
atacaagggtccccaacccc

SEQ ID NO: 448839 - DNA, 20 bp, Artificial Sequence
  chemically synthesized
ggggttggggacccttgtat

SEQ ID NO: 448840 - DNA, 20 bp, Artificial Sequence
  chemically synthesized
atgtgtgtcttctaatacaa

SEQ ID NO: 448841 - DNA, 20 bp, Artificial Sequence
  chemically synthesized
tatgtgtgtcttctaataca

SEQ ID NO: 448842 - DNA, 20 bp, Artificial Sequence
  chemically synthesized
gttggggacccttgtattag

SEQ ID NO: 448843 - DNA, 20 bp, Artificial Sequence
  chemically synthesized
atatgtgtgtcttctaatac

SEQ ID NO: 448844 - DNA, 20 bp, Artificial Sequence
  chemically synthesized
tatatgtttgtgatttgtaa

SEQ ID NO: 448845 - DNA, 20 bp, Artificial Sequence
  chemically synthesized
aacttaccttgaattaaaaa

SEQ ID NO: 448846 - DNA, 20 bp, Artificial Sequence
  chemically synthesized
gtattgtctatttttaattc

SEQ ID NO: 448847 - DNA, 20 bp, Artificial Sequence
  chemically synthesized
tattgtctatttttaattca

SEQ ID NO: 448848 - DNA, 20 bp, Artificial Sequence
  chemically synthesized
gtctatttttaattcaaggt

SEQ ID NO: 448849 - DNA, 20 bp, Artificial Sequence
  chemically synthesized
ttttaattcaaggtaagttt

SEQ ID NO: 448850 - DNA, 20 bp, Artificial Sequence
  chemically synthesized
tcaaggtaagttttggcaaa

SEQ ID NO: 448851 - DNA, 20 bp, Artificial Sequence
  chemically synthesized
ggtaagttttggcaaataga

SEQ ID NO: 448852 - DNA, 20 bp, Artificial Sequence
  chemically synthesized
aataaatatgatagttaaga

SEQ ID NO: 448853 - DNA, 20 bp, Artificial Sequence
  chemically synthesized
tttgaataaatatgatagtt

SEQ ID NO: 448854 - DNA, 20 bp, Artificial Sequence
  chemically synthesized
atatatttgaataaatatga

SEQ ID NO: 448855 - DNA, 20 bp, Artificial Sequence
  chemically synthesized
atcatatttattcaaatata

SEQ ID NO: 448856 - DNA, 20 bp, Artificial Sequence
  chemically synthesized
ttaacaaatttgatatttgg

SEQ ID NO: 448857 - DNA, 20 bp, Artificial Sequence
  chemically synthesized
tttaacaaatttgatatttg

SEQ ID NO: 448858 - DNA, 20 bp, Artificial Sequence
  chemically synthesized
tgtttaacaaatttgatatt

SEQ ID NO: 448859 - DNA, 20 bp, Artificial Sequence
  chemically synthesized
caaatatcaaatttgttaaa

SEQ ID NO: 448860 - DNA, 20 bp, Artificial Sequence
  chemically synthesized
aaatatcaaatttgttaaac

SEQ ID NO: 448861 - DNA, 20 bp, Artificial Sequence
  chemically synthesized
tatcaaatttgttaaacagg

SEQ ID NO: 448862 - DNA, 20 bp, Artificial Sequence
  chemically synthesized
tcaaatttgttaaacaggtg

SEQ ID NO: 448863 - DNA, 20 bp, Artificial Sequence
  chemically synthesized
tttgttaaacaggtggagaa

SEQ ID NO: 448864 - DNA, 20 bp, Artificial Sequence
  chemically synthesized
gttaaacaggtggagaatag

SEQ ID NO: 448865 - DNA, 20 bp, Artificial Sequence
  chemically synthesized
ttaaatggttttgatatgaa

SEQ ID NO: 448866 - DNA, 20 bp, Artificial Sequence
  chemically synthesized
aattatatttatattttaaa

SEQ ID NO: 448867 - DNA, 20 bp, Artificial Sequence
  chemically synthesized
ataatttagaatatatagta

SEQ ID NO: 448868 - DNA, 20 bp, Artificial Sequence
  chemically synthesized
atataatttagaatatatag

SEQ ID NO: 448869 - DNA, 20 bp, Artificial Sequence
  chemically synthesized
aatatataatttagaatata

SEQ ID NO: 448870 - DNA, 20 bp, Artificial Sequence
  chemically synthesized
caaataaaaaatatataatt

SEQ ID NO: 448871 - DNA, 20 bp, Artificial Sequence
  chemically synthesized
ttatatattttttatttgtg

SEQ ID NO: 448872 - DNA, 20 bp, Artificial Sequence
  chemically synthesized
atatattttttatttgtgca

SEQ ID NO: 448873 - DNA, 20 bp, Artificial Sequence
  chemically synthesized
tatattttttatttgtgcag

SEQ ID NO: 448874 - DNA, 20 bp, Artificial Sequence
  chemically synthesized
tttatttgtgcagaggaatg

SEQ ID NO: 448875 - DNA, 20 bp, Artificial Sequence
  chemically synthesized
tgcagaggaatgcagttgta

SEQ ID NO: 448876 - DNA, 20 bp, Artificial Sequence
  chemically synthesized
aataaatttatattttgaaa

SEQ ID NO: 448877 - DNA, 20 bp, Artificial Sequence
  chemically synthesized
ataaatttatattttgaaat

SEQ ID NO: 448878 - DNA, 20 bp, Artificial Sequence
  chemically synthesized
taaatttatattttgaaatg

SEQ ID NO: 448879 - DNA, 20 bp, Artificial Sequence
  chemically synthesized
tattttgaaatggggcaaaa

SEQ ID NO: 448880 - DNA, 20 bp, Artificial Sequence
  chemically synthesized
caaaaaagatgtcaaatatt

SEQ ID NO: 448881 - DNA, 20 bp, Artificial Sequence
  chemically synthesized
gtcaaatattgagatataaa

SEQ ID NO: 448882 - DNA, 20 bp, Artificial Sequence
  chemically synthesized
aaatattgagatataaaaag

SEQ ID NO: 448883 - DNA, 20 bp, Artificial Sequence
  chemically synthesized
tgagatataaaaagtagtac

SEQ ID NO: 448884 - DNA, 20 bp, Artificial Sequence
  chemically synthesized
taaaaagtagtaccagataa

SEQ ID NO: 448885 - DNA, 20 bp, Artificial Sequence
  chemically synthesized
ttatctatgcatcttttatc

SEQ ID NO: 448886 - DNA, 20 bp, Artificial Sequence
  chemically synthesized
agtaccagataaaagatgca

SEQ ID NO: 448887 - DNA, 20 bp, Artificial Sequence
  chemically synthesized
aaagatgcatagataaccct

SEQ ID NO: 448888 - DNA, 20 bp, Artificial Sequence
  chemically synthesized
gcatagataaccctaagaat

SEQ ID NO: 448889 - DNA, 20 bp, Artificial Sequence
  chemically synthesized
aaatgtgattctcattctta

SEQ ID NO: 448890 - DNA, 20 bp, Artificial Sequence
  chemically synthesized
aaaatgtgattctcattctt

SEQ ID NO: 448891 - DNA, 20 bp, Artificial Sequence
  chemically synthesized
taaaatgtgattctcattct

SEQ ID NO: 448892 - DNA, 20 bp, Artificial Sequence
  chemically synthesized
tgagaatcacattttatatg

SEQ ID NO: 448893 - DNA, 20 bp, Artificial Sequence
  chemically synthesized
gagaatcacattttatatgt

SEQ ID NO: 448894 - DNA, 20 bp, Artificial Sequence
  chemically synthesized
agaatcacattttatatgta

SEQ ID NO: 448895 - DNA, 20 bp, Artificial Sequence
  chemically synthesized
cacattttatatgtagggct

SEQ ID NO: 448896 - DNA, 20 bp, Artificial Sequence
  chemically synthesized
aatatatataggaaatggct

SEQ ID NO: 448897 - DNA, 20 bp, Artificial Sequence
  chemically synthesized
cagaaaatatatataggaaa

SEQ ID NO: 448898 - DNA, 20 bp, Artificial Sequence
  chemically synthesized
gtcagccagaaaatatatat

SEQ ID NO: 448899 - DNA, 20 bp, Artificial Sequence
  chemically synthesized
agtcagccagaaaatatata

SEQ ID NO: 448900 - DNA, 20 bp, Artificial Sequence
  chemically synthesized
catttcctatatatattttc

SEQ ID NO: 448901 - DNA, 20 bp, Artificial Sequence
  chemically synthesized
accattgctaattagtcagc

SEQ ID NO: 448902 - DNA, 20 bp, Artificial Sequence
  chemically synthesized
atattttctggctgactaat

SEQ ID NO: 448903 - DNA, 20 bp, Artificial Sequence
  chemically synthesized
ctttaccattgctaattagt

SEQ ID NO: 448904 - DNA, 20 bp, Artificial Sequence
  chemically synthesized
tgatctttaccattgctaat

SEQ ID NO: 448905 - DNA, 20 bp, Artificial Sequence
  chemically synthesized
tctggctgactaattagcaa

SEQ ID NO: 448906 - DNA, 20 bp, Artificial Sequence
  chemically synthesized
ctgactaattagcaatggta

SEQ ID NO: 448907 - DNA, 20 bp, Artificial Sequence
  chemically synthesized
aattagcaatggtaaagatc

SEQ ID NO: 448908 - DNA, 20 bp, Artificial Sequence
  chemically synthesized
aaataaacaccatgatttga

SEQ ID NO: 448909 - DNA, 20 bp, Artificial Sequence
  chemically synthesized
acatcaatgctttcaaatca

SEQ ID NO: 448910 - DNA, 20 bp, Artificial Sequence
  chemically synthesized
gtttattttttctacttgct

SEQ ID NO: 448911 - DNA, 20 bp, Artificial Sequence
  chemically synthesized
caaagtacgggctcagcaag

SEQ ID NO: 448912 - DNA, 20 bp, Artificial Sequence
  chemically synthesized
ttccaaagtacgggctcagc

SEQ ID NO: 448913 - DNA, 20 bp, Artificial Sequence
  chemically synthesized
ataattccaaagtacgggct

SEQ ID NO: 448914 - DNA, 20 bp, Artificial Sequence
  chemically synthesized
tacttgctgagcccgtactt

SEQ ID NO: 448915 - DNA, 20 bp, Artificial Sequence
  chemically synthesized
aatatataattccaaagtac

SEQ ID NO: 448916 - DNA, 20 bp, Artificial Sequence
  chemically synthesized
taatatataattccaaagta

SEQ ID NO: 448917 - DNA, 20 bp, Artificial Sequence
  chemically synthesized
tatagtaatatataattcca

SEQ ID NO: 448918 - DNA, 20 bp, Artificial Sequence
  chemically synthesized
agagggcacacaataaaata

SEQ ID NO: 448919 - DNA, 20 bp, Artificial Sequence
  chemically synthesized
atgaataaatacattcaaga

SEQ ID NO: 448920 - DNA, 20 bp, Artificial Sequence
  chemically synthesized
catgaataaatacattcaag

SEQ ID NO: 448921 - DNA, 20 bp, Artificial Sequence
  chemically synthesized
acatgaataaatacattcaa

SEQ ID NO: 448922 - DNA, 20 bp, Artificial Sequence
  chemically synthesized
ctacatgaataaatacattc

SEQ ID NO: 448923 - DNA, 20 bp, Artificial Sequence
  chemically synthesized
cttgaatgtatttattcatg

SEQ ID NO: 448924 - DNA, 20 bp, Artificial Sequence
  chemically synthesized
ataaaaattaattaattaat

SEQ ID NO: 448925 - DNA, 20 bp, Artificial Sequence
  chemically synthesized
attaattaattaataagata

SEQ ID NO: 448926 - DNA, 20 bp, Artificial Sequence
  chemically synthesized
ttaattaattaataagataa

SEQ ID NO: 448927 - DNA, 20 bp, Artificial Sequence
  chemically synthesized
taagataaaggtaattatgt

SEQ ID NO: 448928 - DNA, 20 bp, Artificial Sequence
  chemically synthesized
aaaggtaattatgtaagatt

SEQ ID NO: 448929 - DNA, 20 bp, Artificial Sequence
  chemically synthesized
gtaattatgtaagattaaga

SEQ ID NO: 448930 - DNA, 20 bp, Artificial Sequence
  chemically synthesized
atgtaagattaagaaagtca

SEQ ID NO: 448931 - DNA, 20 bp, Artificial Sequence
  chemically synthesized
ttaagaaagtcacagaaaca

SEQ ID NO: 448932 - DNA, 20 bp, Artificial Sequence
  chemically synthesized
agaaacatagaaactgacct

SEQ ID NO: 448933 - DNA, 20 bp, Artificial Sequence
  chemically synthesized
tagtacgcactaacttaggt

SEQ ID NO: 448934 - DNA, 20 bp, Artificial Sequence
  chemically synthesized
acatagaaactgacctaagt

SEQ ID NO: 448935 - DNA, 20 bp, Artificial Sequence
  chemically synthesized
attatagtacgcactaactt

SEQ ID NO: 448936 - DNA, 20 bp, Artificial Sequence
  chemically synthesized
tattatagtacgcactaact

SEQ ID NO: 448937 - DNA, 20 bp, Artificial Sequence
  chemically synthesized
gaaataagtaggttttatta

SEQ ID NO: 448938 - DNA, 20 bp, Artificial Sequence
  chemically synthesized
acatagacaaagaaataagt

SEQ ID NO: 448939 - DNA, 20 bp, Artificial Sequence
  chemically synthesized
gacatagacaaagaaataag

SEQ ID NO: 448940 - DNA, 20 bp, Artificial Sequence
  chemically synthesized
ttagacatagacaaagaaat

SEQ ID NO: 448941 - DNA, 20 bp, Artificial Sequence
  chemically synthesized
tgcatttttagacatagaca

SEQ ID NO: 448942 - DNA, 20 bp, Artificial Sequence
  chemically synthesized
aagaaatgcatttttagaca

SEQ ID NO: 448943 - DNA, 20 bp, Artificial Sequence
  chemically synthesized
tagagaaagaaatgcatttt

SEQ ID NO: 448944 - DNA, 20 bp, Artificial Sequence
  chemically synthesized
tgcatttttagacatagaga

SEQ ID NO: 448945 - DNA, 20 bp, Artificial Sequence
  chemically synthesized
attgtgcatttttagacata

SEQ ID NO: 448946 - DNA, 20 bp, Artificial Sequence
  chemically synthesized
gaattgtgcatttttagaca

SEQ ID NO: 448947 - DNA, 20 bp, Artificial Sequence
  chemically synthesized
gaatttgaattgtgcatttt

SEQ ID NO: 448948 - DNA, 20 bp, Artificial Sequence
  chemically synthesized
aaaatgcacaattcaaattc

SEQ ID NO: 448949 - DNA, 20 bp, Artificial Sequence
  chemically synthesized
gggcaggtctagagtttatc

SEQ ID NO: 448950 - DNA, 20 bp, Artificial Sequence
  chemically synthesized
ttcaaattccagataaactc

SEQ ID NO: 448951 - DNA, 20 bp, Artificial Sequence
  chemically synthesized
aaactggatgggcaggtcta

SEQ ID NO: 448952 - DNA, 20 bp, Artificial Sequence
  chemically synthesized
ggaaactggatgggcaggtc

SEQ ID NO: 448953 - DNA, 20 bp, Artificial Sequence
  chemically synthesized
aaactctagacctgcccatc

SEQ ID NO: 448954 - DNA, 20 bp, Artificial Sequence
  chemically synthesized
gaggaggaaactggatgggc

SEQ ID NO: 448955 - DNA, 20 bp, Artificial Sequence
  chemically synthesized
agaggaggaaactggatggg

SEQ ID NO: 448956 - DNA, 20 bp, Artificial Sequence
  chemically synthesized
caaagaggaggaaactggat

SEQ ID NO: 448957 - DNA, 20 bp, Artificial Sequence
  chemically synthesized
acaaagaggaggaaactgga

SEQ ID NO: 448958 - DNA, 20 bp, Artificial Sequence
  chemically synthesized
gttgacaaagaggaggaaac

SEQ ID NO: 448959 - DNA, 20 bp, Artificial Sequence
  chemically synthesized
gagttctgttgacaaagagg

SEQ ID NO: 448960 - DNA, 20 bp, Artificial Sequence
  chemically synthesized
ggagttctgttgacaaagag

SEQ ID NO: 448961 - DNA, 20 bp, Artificial Sequence
  chemically synthesized
ttggagttctgttgacaaag

SEQ ID NO: 448962 - DNA, 20 bp, Artificial Sequence
  chemically synthesized
attggagttctgttgacaaa

SEQ ID NO: 448963 - DNA, 20 bp, Artificial Sequence
  chemically synthesized
agtttcctcctctttgtcaa

SEQ ID NO: 448964 - DNA, 20 bp, Artificial Sequence
  chemically synthesized
gaattggagttctgttgaca

SEQ ID NO: 448965 - DNA, 20 bp, Artificial Sequence
  chemically synthesized
ttgatacccgaatggaattg

SEQ ID NO: 448966 - DNA, 20 bp, Artificial Sequence
  chemically synthesized
ccttgatacccgaatggaat

SEQ ID NO: 448967 - DNA, 20 bp, Artificial Sequence
  chemically synthesized
aacagaactccaattccatt

SEQ ID NO: 448968 - DNA, 20 bp, Artificial Sequence
  chemically synthesized
acagaactccaattccattc

SEQ ID NO: 448969 - DNA, 20 bp, Artificial Sequence
  chemically synthesized
agtctcccttgatacccgaa

SEQ ID NO: 448970 - DNA, 20 bp, Artificial Sequence
  chemically synthesized
tccaattccattcgggtatc

SEQ ID NO: 448971 - DNA, 20 bp, Artificial Sequence
  chemically synthesized
ccaattccattcgggtatca

SEQ ID NO: 448972 - DNA, 20 bp, Artificial Sequence
  chemically synthesized
caattccattcgggtatcaa

SEQ ID NO: 448973 - DNA, 20 bp, Artificial Sequence
  chemically synthesized
attccattcgggtatcaagg

SEQ ID NO: 448974 - DNA, 20 bp, Artificial Sequence
  chemically synthesized
tatcaagggagactgtgcac

SEQ ID NO: 448975 - DNA, 20 bp, Artificial Sequence
  chemically synthesized
atgagtacattgcttgtgca

SEQ ID NO: 448976 - DNA, 20 bp, Artificial Sequence
  chemically synthesized
caagcaatgtactcatccca

SEQ ID NO: 448977 - DNA, 20 bp, Artificial Sequence
  chemically synthesized
catgatttgttctttgggat

SEQ ID NO: 448978 - DNA, 20 bp, Artificial Sequence
  chemically synthesized
ccaatcatgatttgttcttt

SEQ ID NO: 448979 - DNA, 20 bp, Artificial Sequence
  chemically synthesized
gccaatcatgatttgttctt

SEQ ID NO: 448980 - DNA, 20 bp, Artificial Sequence
  chemically synthesized
cccaaagaacaaatcatgat

SEQ ID NO: 448981 - DNA, 20 bp, Artificial Sequence
  chemically synthesized
aagaacaaatcatgattggc

SEQ ID NO: 448982 - DNA, 20 bp, Artificial Sequence
  chemically synthesized
agaacaaatcatgattggcc

SEQ ID NO: 448983 - DNA, 20 bp, Artificial Sequence
  chemically synthesized
caggatcaacatgattagcc

SEQ ID NO: 448984 - DNA, 20 bp, Artificial Sequence
  chemically synthesized
aagaacaggatcaacatgat

SEQ ID NO: 448985 - DNA, 20 bp, Artificial Sequence
  chemically synthesized
gtccctggcagaaaaagaac

SEQ ID NO: 448986 - DNA, 20 bp, Artificial Sequence
  chemically synthesized
agtccctggcagaaaaagaa

SEQ ID NO: 448987 - DNA, 20 bp, Artificial Sequence
  chemically synthesized
tgatcctgttctttttctgc

SEQ ID NO: 448988 - DNA, 20 bp, Artificial Sequence
  chemically synthesized
caggcagtccctggcagaaa

SEQ ID NO: 448989 - DNA, 20 bp, Artificial Sequence
  chemically synthesized
gatcctgttctttttctgcc

SEQ ID NO: 448990 - DNA, 20 bp, Artificial Sequence
  chemically synthesized
atcctgttctttttctgcca

SEQ ID NO: 448991 - DNA, 20 bp, Artificial Sequence
  chemically synthesized
ccattccaggcagtccctgg

SEQ ID NO: 448992 - DNA, 20 bp, Artificial Sequence
  chemically synthesized
actccattccaggcagtccc

SEQ ID NO: 448993 - DNA, 20 bp, Artificial Sequence
  chemically synthesized
tttttctgccagggactgcc

SEQ ID NO: 448994 - DNA, 20 bp, Artificial Sequence
  chemically synthesized
ctgccagggactgcctggaa

SEQ ID NO: 448995 - DNA, 20 bp, Artificial Sequence
  chemically synthesized
caatttcactccattccagg

SEQ ID NO: 448996 - DNA, 20 bp, Artificial Sequence
  chemically synthesized
gccagggactgcctggaatg

SEQ ID NO: 448997 - DNA, 20 bp, Artificial Sequence
  chemically synthesized
tctcaatttcactccattcc

SEQ ID NO: 448998 - DNA, 20 bp, Artificial Sequence
  chemically synthesized
atctcaatttcactccattc

SEQ ID NO: 448999 - DNA, 20 bp, Artificial Sequence
  chemically synthesized
gcctggaatggagtgaaatt

SEQ ID NO: 449000 - DNA, 20 bp, Artificial Sequence
  chemically synthesized
agcttttctgtcattggttt

SEQ ID NO: 449001 - DNA, 20 bp, Artificial Sequence
  chemically synthesized
tagcttttctgtcattggtt

SEQ ID NO: 449002 - DNA, 20 bp, Artificial Sequence
  chemically synthesized
tgagatgcctaaaccaatga

SEQ ID NO: 449003 - DNA, 20 bp, Artificial Sequence
  chemically synthesized
agaggtagcttttctgtcat

SEQ ID NO: 449004 - DNA, 20 bp, Artificial Sequence
  chemically synthesized
tgcctaaaccaatgacagaa

SEQ ID NO: 449005 - DNA, 20 bp, Artificial Sequence
  chemically synthesized
tgtagcaaggagtgcagagg

SEQ ID NO: 449006 - DNA, 20 bp, Artificial Sequence
  chemically synthesized
tcatgtagcaaggagtgcag

SEQ ID NO: 449007 - DNA, 20 bp, Artificial Sequence
  chemically synthesized
ttcatgtagcaaggagtgca

SEQ ID NO: 449008 - DNA, 20 bp, Artificial Sequence
  chemically synthesized
atttcatgtagcaaggagtg

SEQ ID NO: 449009 - DNA, 20 bp, Artificial Sequence
  chemically synthesized
gaattatttcatgtagcaag

SEQ ID NO: 449010 - DNA, 20 bp, Artificial Sequence
  chemically synthesized
gtgaattatttcatgtagca

SEQ ID NO: 449011 - DNA, 20 bp, Artificial Sequence
  chemically synthesized
ggtgaattatttcatgtagc

SEQ ID NO: 449012 - DNA, 20 bp, Artificial Sequence
  chemically synthesized
aaaaggtgaattatttcatg

SEQ ID NO: 449013 - DNA, 20 bp, Artificial Sequence
  chemically synthesized
taaatgtagctcgggaaaaa

SEQ ID NO: 449014 - DNA, 20 bp, Artificial Sequence
  chemically synthesized
aataattcaccttttttccc

SEQ ID NO: 449015 - DNA, 20 bp, Artificial Sequence
  chemically synthesized
ataaatgtagctcgggaaaa

SEQ ID NO: 449016 - DNA, 20 bp, Artificial Sequence
  chemically synthesized
ataccagataaatgtagctc

SEQ ID NO: 449017 - DNA, 20 bp, Artificial Sequence
  chemically synthesized
aataccagataaatgtagct

SEQ ID NO: 449018 - DNA, 20 bp, Artificial Sequence
  chemically synthesized
acctgaataccagataaatg

SEQ ID NO: 449019 - DNA, 20 bp, Artificial Sequence
  chemically synthesized
tttcccgagctacatttatc

SEQ ID NO: 449020 - DNA, 20 bp, Artificial Sequence
  chemically synthesized
agctacatttatctggtatt

SEQ ID NO: 449021 - DNA, 20 bp, Artificial Sequence
  chemically synthesized
gctacatttatctggtattc

SEQ ID NO: 449022 - DNA, 20 bp, Artificial Sequence
  chemically synthesized
aacactatatacctgaatac

SEQ ID NO: 449023 - DNA, 20 bp, Artificial Sequence
  chemically synthesized
ttatctggtattcaggtata

SEQ ID NO: 449024 - DNA, 20 bp, Artificial Sequence
  chemically synthesized
gtatatagtgttacatgcaa

SEQ ID NO: 449025 - DNA, 20 bp, Artificial Sequence
  chemically synthesized
tgcaatagatatatgaccat

SEQ ID NO: 449026 - DNA, 20 bp, Artificial Sequence
  chemically synthesized
tctactgcatataacactga

SEQ ID NO: 449027 - DNA, 20 bp, Artificial Sequence
  chemically synthesized
atgaccatcagtgttatatg

SEQ ID NO: 449028 - DNA, 20 bp, Artificial Sequence
  chemically synthesized
accatcagtgttatatgcag

SEQ ID NO: 449029 - DNA, 20 bp, Artificial Sequence
  chemically synthesized
cagtagatatatgaccaatc

SEQ ID NO: 449030 - DNA, 20 bp, Artificial Sequence
  chemically synthesized
attatattaaaaaactagat

SEQ ID NO: 449031 - DNA, 20 bp, Artificial Sequence
  chemically synthesized
ataccattatattaaaaaac

SEQ ID NO: 449032 - DNA, 20 bp, Artificial Sequence
  chemically synthesized
aatctagttttttaatataa

SEQ ID NO: 449033 - DNA, 20 bp, Artificial Sequence
  chemically synthesized
tttttaatataatggtatat

SEQ ID NO: 449034 - DNA, 20 bp, Artificial Sequence
  chemically synthesized
tggatattttttatactatc

SEQ ID NO: 449035 - DNA, 20 bp, Artificial Sequence
  chemically synthesized
ggatattttttatactatca

SEQ ID NO: 449036 - DNA, 20 bp, Artificial Sequence
  chemically synthesized
gatattttttatactatcaa

SEQ ID NO: 449037 - DNA, 20 bp, Artificial Sequence
  chemically synthesized
tggggagaagaatcccttga

SEQ ID NO: 449038 - DNA, 20 bp, Artificial Sequence
  chemically synthesized
tatcaagggattcttctccc

SEQ ID NO: 449039 - DNA, 20 bp, Artificial Sequence
  chemically synthesized
tcaagggattcttctcccca

SEQ ID NO: 449040 - DNA, 20 bp, Artificial Sequence
  chemically synthesized
cagttggtatctctggggag

SEQ ID NO: 449041 - DNA, 20 bp, Artificial Sequence
  chemically synthesized
tctcagttggtatctctggg

SEQ ID NO: 449042 - DNA, 20 bp, Artificial Sequence
  chemically synthesized
tttctcagttggtatctctg

SEQ ID NO: 449043 - DNA, 20 bp, Artificial Sequence
  chemically synthesized
ttttctcagttggtatctct

SEQ ID NO: 449044 - DNA, 20 bp, Artificial Sequence
  chemically synthesized
gttttctcagttggtatctc

SEQ ID NO: 449045 - DNA, 20 bp, Artificial Sequence
  chemically synthesized
tctccccagagataccaact

SEQ ID NO: 449046 - DNA, 20 bp, Artificial Sequence
  chemically synthesized
caaccacaggttttctcagt

SEQ ID NO: 449047 - DNA, 20 bp, Artificial Sequence
  chemically synthesized
ctgccaaccacaggttttct

SEQ ID NO: 449048 - DNA, 20 bp, Artificial Sequence
  chemically synthesized
ataccaactgagaaaacctg

SEQ ID NO: 449049 - DNA, 20 bp, Artificial Sequence
  chemically synthesized
caactgagaaaacctgtggt

SEQ ID NO: 449050 - DNA, 20 bp, Artificial Sequence
  chemically synthesized
ccacctgcactgccaaccac

SEQ ID NO: 449051 - DNA, 20 bp, Artificial Sequence
  chemically synthesized
ctgagaaaacctgtggttgg

SEQ ID NO: 449052 - DNA, 20 bp, Artificial Sequence
  chemically synthesized
gccacctgcactgccaacca

SEQ ID NO: 449053 - DNA, 20 bp, Artificial Sequence
  chemically synthesized
aaaacctgtggttggcagtg

SEQ ID NO: 449054 - DNA, 20 bp, Artificial Sequence
  chemically synthesized
aaacctgtggttggcagtgc

SEQ ID NO: 449055 - DNA, 20 bp, Artificial Sequence
  chemically synthesized
cctgtggttggcagtgcagg

SEQ ID NO: 449056 - DNA, 20 bp, Artificial Sequence
  chemically synthesized
ttggcagtgcaggtggcttg

SEQ ID NO: 449057 - DNA, 20 bp, Artificial Sequence
  chemically synthesized
tggcagtgcaggtggcttgt

SEQ ID NO: 449058 - DNA, 20 bp, Artificial Sequence
  chemically synthesized
tttctcaagatgtggcccac

SEQ ID NO: 449059 - DNA, 20 bp, Artificial Sequence
  chemically synthesized
tggcttgtgggccacatctt

SEQ ID NO: 449060 - DNA, 20 bp, Artificial Sequence
  chemically synthesized
gacattattttctcaagatg

SEQ ID NO: 449061 - DNA, 20 bp, Artificial Sequence
  chemically synthesized
ctttaagacattattttctc

SEQ ID NO: 449062 - DNA, 20 bp, Artificial Sequence
  chemically synthesized
cttgagaaaataatgtctta

SEQ ID NO: 449063 - DNA, 20 bp, Artificial Sequence
  chemically synthesized
ttgagaaaataatgtcttaa

SEQ ID NO: 449064 - DNA, 20 bp, Artificial Sequence
  chemically synthesized
tatttcactggaattccttt

SEQ ID NO: 449065 - DNA, 20 bp, Artificial Sequence
  chemically synthesized
ataatgtcttaaaggaattc

SEQ ID NO: 449066 - DNA, 20 bp, Artificial Sequence
  chemically synthesized
tccttatttatttatttcac

SEQ ID NO: 449067 - DNA, 20 bp, Artificial Sequence
  chemically synthesized
ttccagtgaaataaataaat

SEQ ID NO: 449068 - DNA, 20 bp, Artificial Sequence
  chemically synthesized
tccagtgaaataaataaata

SEQ ID NO: 449069 - DNA, 20 bp, Artificial Sequence
  chemically synthesized
ataaataaggaaaatatgtt

SEQ ID NO: 449070 - DNA, 20 bp, Artificial Sequence
  chemically synthesized
tatgtttagtttaacttgtg

SEQ ID NO: 449071 - DNA, 20 bp, Artificial Sequence
  chemically synthesized
tttagtttaacttgtgaaga

SEQ ID NO: 449072 - DNA, 20 bp, Artificial Sequence
  chemically synthesized
acatttgctgctttcttcac

SEQ ID NO: 449073 - DNA, 20 bp, Artificial Sequence
  chemically synthesized
agtttaacttgtgaagaaag

SEQ ID NO: 449074 - DNA, 20 bp, Artificial Sequence
  chemically synthesized
caaatgttaatgtgtgaaat

SEQ ID NO: 449075 - DNA, 20 bp, Artificial Sequence
  chemically synthesized
tgtgtgaaataagaactttc

SEQ ID NO: 449076 - DNA, 20 bp, Artificial Sequence
  chemically synthesized
tgaaataagaactttctagt

SEQ ID NO: 449077 - DNA, 20 bp, Artificial Sequence
  chemically synthesized
gaaataagaactttctagtt

SEQ ID NO: 449078 - DNA, 20 bp, Artificial Sequence
  chemically synthesized
taagggtatccccaactaga

SEQ ID NO: 449079 - DNA, 20 bp, Artificial Sequence
  chemically synthesized
aaataagaactttctagttg

SEQ ID NO: 449080 - DNA, 20 bp, Artificial Sequence
  chemically synthesized
gctctaagggtatccccaac

SEQ ID NO: 449081 - DNA, 20 bp, Artificial Sequence
  chemically synthesized
tttctagttggggataccct

SEQ ID NO: 449082 - DNA, 20 bp, Artificial Sequence
  chemically synthesized
tctagttggggataccctta

SEQ ID NO: 449083 - DNA, 20 bp, Artificial Sequence
  chemically synthesized
gtaaactattgtagctctaa

SEQ ID NO: 449084 - DNA, 20 bp, Artificial Sequence
  chemically synthesized
tgtaaactattgtagctcta

SEQ ID NO: 449085 - DNA, 20 bp, Artificial Sequence
  chemically synthesized
atgtaaactattgtagctct

SEQ ID NO: 449086 - DNA, 20 bp, Artificial Sequence
  chemically synthesized
ggatacccttagagctacaa

SEQ ID NO: 449087 - DNA, 20 bp, Artificial Sequence
  chemically synthesized
tcagtaaatgtaaactattg

SEQ ID NO: 449088 - DNA, 20 bp, Artificial Sequence
  chemically synthesized
tacaatagtttacatttact

SEQ ID NO: 449089 - DNA, 20 bp, Artificial Sequence
  chemically synthesized
acaatagtttacatttactg

SEQ ID NO: 449090 - DNA, 20 bp, Artificial Sequence
  chemically synthesized
gttggaattgtttgaatcct

SEQ ID NO: 449091 - DNA, 20 bp, Artificial Sequence
  chemically synthesized
tcaaacaattccaactgaaa

SEQ ID NO: 449092 - DNA, 20 bp, Artificial Sequence
  chemically synthesized
aaattgctttctatttcagt

SEQ ID NO: 449093 - DNA, 20 bp, Artificial Sequence
  chemically synthesized
acaattccaactgaaataga

SEQ ID NO: 449094 - DNA, 20 bp, Artificial Sequence
  chemically synthesized
cataaaattgctttctattt

SEQ ID NO: 449095 - DNA, 20 bp, Artificial Sequence
  chemically synthesized
tctaaatgcttgagtagttt

SEQ ID NO: 449096 - DNA, 20 bp, Artificial Sequence
  chemically synthesized
tgtcaatacttaaactactc

SEQ ID NO: 449097 - DNA, 20 bp, Artificial Sequence
  chemically synthesized
acatgttctaaatgcttgag

SEQ ID NO: 449098 - DNA, 20 bp, Artificial Sequence
  chemically synthesized
acttaaactactcaagcatt

SEQ ID NO: 449099 - DNA, 20 bp, Artificial Sequence
  chemically synthesized
gtaacatgttctaaatgctt

SEQ ID NO: 449100 - DNA, 20 bp, Artificial Sequence
  chemically synthesized
agaacatgttactaaaatgt

SEQ ID NO: 449101 - DNA, 20 bp, Artificial Sequence
  chemically synthesized
gagattatatactaacattt

SEQ ID NO: 449102 - DNA, 20 bp, Artificial Sequence
  chemically synthesized
aatgttagtatataatctct

SEQ ID NO: 449103 - DNA, 20 bp, Artificial Sequence
  chemically synthesized
atgttagtatataatctctg

SEQ ID NO: 449104 - DNA, 20 bp, Artificial Sequence
  chemically synthesized
ttagtatataatctctgagg

SEQ ID NO: 449105 - DNA, 20 bp, Artificial Sequence
  chemically synthesized
catttttataggctacctca

SEQ ID NO: 449106 - DNA, 20 bp, Artificial Sequence
  chemically synthesized
aacatttttataggctacct

SEQ ID NO: 449107 - DNA, 20 bp, Artificial Sequence
  chemically synthesized
gaaagctgaaacatttttat

SEQ ID NO: 449108 - DNA, 20 bp, Artificial Sequence
  chemically synthesized
agaaagctgaaacattttta

SEQ ID NO: 449109 - DNA, 20 bp, Artificial Sequence
  chemically synthesized
ggtagcctataaaaatgttt

SEQ ID NO: 449110 - DNA, 20 bp, Artificial Sequence
  chemically synthesized
tatttccatttgtaaaaaga

SEQ ID NO: 449111 - DNA, 20 bp, Artificial Sequence
  chemically synthesized
tatttatttccatttgtaaa

SEQ ID NO: 449112 - DNA, 20 bp, Artificial Sequence
  chemically synthesized
ttcagctttctttttacaaa

SEQ ID NO: 449113 - DNA, 20 bp, Artificial Sequence
  chemically synthesized
aaatggaaataaatatcttg

SEQ ID NO: 449114 - DNA, 20 bp, Artificial Sequence
  chemically synthesized
aaataaatatcttgaagatg

SEQ ID NO: 449115 - DNA, 20 bp, Artificial Sequence
  chemically synthesized
ctgtttctagcttcatcttc

SEQ ID NO: 449116 - DNA, 20 bp, Artificial Sequence
  chemically synthesized
aaatatcttgaagatgaagc

SEQ ID NO: 449117 - DNA, 20 bp, Artificial Sequence
  chemically synthesized
cttgaagatgaagctagaaa

SEQ ID NO: 449118 - DNA, 20 bp, Artificial Sequence
  chemically synthesized
acacgagaaaacgctgtttc

SEQ ID NO: 449119 - DNA, 20 bp, Artificial Sequence
  chemically synthesized
aacagcgttttctcgtgttc

SEQ ID NO: 449120 - DNA, 20 bp, Artificial Sequence
  chemically synthesized
ataccatgcctcttgaacac

SEQ ID NO: 449121 - DNA, 20 bp, Artificial Sequence
  chemically synthesized
cagcgttttctcgtgttcaa

SEQ ID NO: 449122 - DNA, 20 bp, Artificial Sequence
  chemically synthesized
agcgttttctcgtgttcaag

SEQ ID NO: 449123 - DNA, 20 bp, Artificial Sequence
  chemically synthesized
tttctcgtgttcaagaggca

SEQ ID NO: 449124 - DNA, 20 bp, Artificial Sequence
  chemically synthesized
tgttcaagaggcatggtatt

SEQ ID NO: 449125 - DNA, 20 bp, Artificial Sequence
  chemically synthesized
tggtattgagaaacaattta

SEQ ID NO: 449126 - DNA, 20 bp, Artificial Sequence
  chemically synthesized
aacaatttacagaatgaaat

SEQ ID NO: 449127 - DNA, 20 bp, Artificial Sequence
  chemically synthesized
ttacagaatgaaatgagtga

SEQ ID NO: 449128 - DNA, 20 bp, Artificial Sequence
  chemically synthesized
acagaatgaaatgagtgaaa

SEQ ID NO: 449129 - DNA, 20 bp, Artificial Sequence
  chemically synthesized
cagaatgaaatgagtgaaag

SEQ ID NO: 449130 - DNA, 20 bp, Artificial Sequence
  chemically synthesized
aatgaaatgagtgaaagagg

SEQ ID NO: 449131 - DNA, 20 bp, Artificial Sequence
  chemically synthesized
atgagtgaaagaggaagcta

SEQ ID NO: 449132 - DNA, 20 bp, Artificial Sequence
  chemically synthesized
gtgaaagaggaagctacagt

SEQ ID NO: 449133 - DNA, 20 bp, Artificial Sequence
  chemically synthesized
catctcaaaatatctgactg

SEQ ID NO: 449134 - DNA, 20 bp, Artificial Sequence
  chemically synthesized
aagctacagtcagatatttt

SEQ ID NO: 449135 - DNA, 20 bp, Artificial Sequence
  chemically synthesized
agatattttgagatgattta

SEQ ID NO: 449136 - DNA, 20 bp, Artificial Sequence
  chemically synthesized
gatattttgagatgatttac

SEQ ID NO: 449137 - DNA, 20 bp, Artificial Sequence
  chemically synthesized
ttttgagatgatttacagga

SEQ ID NO: 449138 - DNA, 20 bp, Artificial Sequence
  chemically synthesized
aaataaaacaaaacaaaaac

SEQ ID NO: 449139 - DNA, 20 bp, Artificial Sequence
  chemically synthesized
aataaaacaaaacaaaaaca

SEQ ID NO: 449140 - DNA, 20 bp, Artificial Sequence
  chemically synthesized
aaaacaaaacaaaaacaagg

SEQ ID NO: 449141 - DNA, 20 bp, Artificial Sequence
  chemically synthesized
aacaaaaacaaggcagctac

SEQ ID NO: 449142 - DNA, 20 bp, Artificial Sequence
  chemically synthesized
caaaaacaaggcagctacca

SEQ ID NO: 449143 - DNA, 20 bp, Artificial Sequence
  chemically synthesized
aaaacaaggcagctaccaga

SEQ ID NO: 449144 - DNA, 20 bp, Artificial Sequence
  chemically synthesized
aacaaggcagctaccagaga

SEQ ID NO: 449145 - DNA, 20 bp, Artificial Sequence
  chemically synthesized
ctgtcagtatctctctctgg

SEQ ID NO: 449146 - DNA, 20 bp, Artificial Sequence
  chemically synthesized
aatctgtcagtatctctctc

SEQ ID NO: 449147 - DNA, 20 bp, Artificial Sequence
  chemically synthesized
ctaccagagagagatactga

SEQ ID NO: 449148 - DNA, 20 bp, Artificial Sequence
  chemically synthesized
tacttaagaaaaaaatctgt

SEQ ID NO: 449149 - DNA, 20 bp, Artificial Sequence
  chemically synthesized
tactgacagatttttttctt

SEQ ID NO: 449150 - DNA, 20 bp, Artificial Sequence
  chemically synthesized
gacaaaaggagatagtactt

SEQ ID NO: 449151 - DNA, 20 bp, Artificial Sequence
  chemically synthesized
cactaaaagacaaaaggaga

SEQ ID NO: 449152 - DNA, 20 bp, Artificial Sequence
  chemically synthesized
accccactaaaagacaaaag

SEQ ID NO: 449153 - DNA, 20 bp, Artificial Sequence
  chemically synthesized
agaccccactaaaagacaaa

SEQ ID NO: 449154 - DNA, 20 bp, Artificial Sequence
  chemically synthesized
tagaccccactaaaagacaa

SEQ ID NO: 449155 - DNA, 20 bp, Artificial Sequence
  chemically synthesized
tactatctccttttgtcttt

SEQ ID NO: 449156 - DNA, 20 bp, Artificial Sequence
  chemically synthesized
tatctccttttgtcttttag

SEQ ID NO: 449157 - DNA, 20 bp, Artificial Sequence
  chemically synthesized
atctccttttgtcttttagt

SEQ ID NO: 449158 - DNA, 20 bp, Artificial Sequence
  chemically synthesized
tctccttttgtcttttagtg

SEQ ID NO: 449159 - DNA, 20 bp, Artificial Sequence
  chemically synthesized
aggtggatagaccccactaa

SEQ ID NO: 449160 - DNA, 20 bp, Artificial Sequence
  chemically synthesized
aaggaagtgagtgaggtgga

SEQ ID NO: 449161 - DNA, 20 bp, Artificial Sequence
  chemically synthesized
gctaaaggaagtgagtgagg

SEQ ID NO: 449162 - DNA, 20 bp, Artificial Sequence
  chemically synthesized
taagctaaaggaagtgagtg

SEQ ID NO: 449163 - DNA, 20 bp, Artificial Sequence
  chemically synthesized
ttaagctaaaggaagtgagt

SEQ ID NO: 449164 - DNA, 20 bp, Artificial Sequence
  chemically synthesized
caacttaagctaaaggaagt

SEQ ID NO: 449165 - DNA, 20 bp, Artificial Sequence
  chemically synthesized
tccacctcactcacttcctt

SEQ ID NO: 449166 - DNA, 20 bp, Artificial Sequence
  chemically synthesized
aaggcaacttaagctaaagg

SEQ ID NO: 449167 - DNA, 20 bp, Artificial Sequence
  chemically synthesized
tcactcacttcctttagctt

SEQ ID NO: 449168 - DNA, 20 bp, Artificial Sequence
  chemically synthesized
gggaaggcaacttaagctaa

SEQ ID NO: 449169 - DNA, 20 bp, Artificial Sequence
  chemically synthesized
agggaaggcaacttaagcta

SEQ ID NO: 449170 - DNA, 20 bp, Artificial Sequence
  chemically synthesized
tggtaaagggaaggcaactt

SEQ ID NO: 449171 - DNA, 20 bp, Artificial Sequence
  chemically synthesized
ggcaaaatttggtaaaggga

SEQ ID NO: 449172 - DNA, 20 bp, Artificial Sequence
  chemically synthesized
aggcaaaatttggtaaaggg

SEQ ID NO: 449173 - DNA, 20 bp, Artificial Sequence
  chemically synthesized
aagaggcaaaatttggtaaa

SEQ ID NO: 449174 - DNA, 20 bp, Artificial Sequence
  chemically synthesized
taagaggcaaaatttggtaa

SEQ ID NO: 449175 - DNA, 20 bp, Artificial Sequence
  chemically synthesized
ataagaggcaaaatttggta

SEQ ID NO: 449176 - DNA, 20 bp, Artificial Sequence
  chemically synthesized
taatgataagaggcaaaatt

SEQ ID NO: 449177 - DNA, 20 bp, Artificial Sequence
  chemically synthesized
aggtggctgttaatgataag

SEQ ID NO: 449178 - DNA, 20 bp, Artificial Sequence
  chemically synthesized
taggtggctgttaatgataa

SEQ ID NO: 449179 - DNA, 20 bp, Artificial Sequence
  chemically synthesized
gataggtggctgttaatgat

SEQ ID NO: 449180 - DNA, 20 bp, Artificial Sequence
  chemically synthesized
attttgcctcttatcattaa

SEQ ID NO: 449181 - DNA, 20 bp, Artificial Sequence
  chemically synthesized
gcagagagaagacagatagg

SEQ ID NO: 449182 - DNA, 20 bp, Artificial Sequence
  chemically synthesized
agagcagagagaagacagat

SEQ ID NO: 449183 - DNA, 20 bp, Artificial Sequence
  chemically synthesized
gagagcagagagaagacaga

SEQ ID NO: 449184 - DNA, 20 bp, Artificial Sequence
  chemically synthesized
tgtggagagcagagagaaga

SEQ ID NO: 449185 - DNA, 20 bp, Artificial Sequence
  chemically synthesized
gccctgtggagagcagagag

SEQ ID NO: 449186 - DNA, 20 bp, Artificial Sequence
  chemically synthesized
aaagccctgtggagagcaga

SEQ ID NO: 449187 - DNA, 20 bp, Artificial Sequence
  chemically synthesized
agaaagccctgtggagagca

SEQ ID NO: 449188 - DNA, 20 bp, Artificial Sequence
  chemically synthesized
tgtcttctctctgctctcca

SEQ ID NO: 449189 - DNA, 20 bp, Artificial Sequence
  chemically synthesized
aaagaaagccctgtggagag

SEQ ID NO: 449190 - DNA, 20 bp, Artificial Sequence
  chemically synthesized
gtcttctctctgctctccac

SEQ ID NO: 449191 - DNA, 20 bp, Artificial Sequence
  chemically synthesized
tcttctctctgctctccaca

SEQ ID NO: 449192 - DNA, 20 bp, Artificial Sequence
  chemically synthesized
aacaaagaaagccctgtgga

SEQ ID NO: 449193 - DNA, 20 bp, Artificial Sequence
  chemically synthesized
ggaacaaagaaagccctgtg

SEQ ID NO: 449194 - DNA, 20 bp, Artificial Sequence
  chemically synthesized
aaggaacaaagaaagccctg

SEQ ID NO: 449195 - DNA, 20 bp, Artificial Sequence
  chemically synthesized
gcaagttcaaggaacaaaga

SEQ ID NO: 449196 - DNA, 20 bp, Artificial Sequence
  chemically synthesized
ctttgcaagttcaaggaaca

SEQ ID NO: 449197 - DNA, 20 bp, Artificial Sequence
  chemically synthesized
actgtccctttgcaagttca

SEQ ID NO: 449198 - DNA, 20 bp, Artificial Sequence
  chemically synthesized
aactgtccctttgcaagttc

SEQ ID NO: 449199 - DNA, 20 bp, Artificial Sequence
  chemically synthesized
ctttgttccttgaacttgca

SEQ ID NO: 449200 - DNA, 20 bp, Artificial Sequence
  chemically synthesized
tttgttccttgaacttgcaa

SEQ ID NO: 449201 - DNA, 20 bp, Artificial Sequence
  chemically synthesized
ttgttccttgaacttgcaaa

SEQ ID NO: 449202 - DNA, 20 bp, Artificial Sequence
  chemically synthesized
ttagttaactgtccctttgc

SEQ ID NO: 449203 - DNA, 20 bp, Artificial Sequence
  chemically synthesized
tccttgaacttgcaaaggga

SEQ ID NO: 449204 - DNA, 20 bp, Artificial Sequence
  chemically synthesized
gtcatgtccattaatgagat

SEQ ID NO: 449205 - DNA, 20 bp, Artificial Sequence
  chemically synthesized
cagttaactaatctcattaa

SEQ ID NO: 449206 - DNA, 20 bp, Artificial Sequence
  chemically synthesized
taaatgtcatgtccattaat

SEQ ID NO: 449207 - DNA, 20 bp, Artificial Sequence
  chemically synthesized
agcaaagaatgtagaacatc

SEQ ID NO: 449208 - DNA, 20 bp, Artificial Sequence
  chemically synthesized
atgttttaaagcaaagaatg

SEQ ID NO: 449209 - DNA, 20 bp, Artificial Sequence
  chemically synthesized
atgccacatgttttaaagca

SEQ ID NO: 449210 - DNA, 20 bp, Artificial Sequence
  chemically synthesized
catgaatgccacatgtttta

SEQ ID NO: 449211 - DNA, 20 bp, Artificial Sequence
  chemically synthesized
attctttgctttaaaacatg

SEQ ID NO: 449212 - DNA, 20 bp, Artificial Sequence
  chemically synthesized
aaaacatgtggcattcatgt

SEQ ID NO: 449213 - DNA, 20 bp, Artificial Sequence
  chemically synthesized
tgtggcattcatgttagcct

SEQ ID NO: 449214 - DNA, 20 bp, Artificial Sequence
  chemically synthesized
gtggcattcatgttagcctt

SEQ ID NO: 449215 - DNA, 20 bp, Artificial Sequence
  chemically synthesized
gcattcatgttagccttagg

SEQ ID NO: 449216 - DNA, 20 bp, Artificial Sequence
  chemically synthesized
gggaggactagttcttccta

SEQ ID NO: 449217 - DNA, 20 bp, Artificial Sequence
  chemically synthesized
agggaggactagttcttcct

SEQ ID NO: 449218 - DNA, 20 bp, Artificial Sequence
  chemically synthesized
atgttagccttaggaagaac

SEQ ID NO: 449219 - DNA, 20 bp, Artificial Sequence
  chemically synthesized
cctacattctcagggaggac

SEQ ID NO: 449220 - DNA, 20 bp, Artificial Sequence
  chemically synthesized
aggaagaactagtcctccct

SEQ ID NO: 449221 - DNA, 20 bp, Artificial Sequence
  chemically synthesized
aatcccctacattctcaggg

SEQ ID NO: 449222 - DNA, 20 bp, Artificial Sequence
  chemically synthesized
aaatcccctacattctcagg

SEQ ID NO: 449223 - DNA, 20 bp, Artificial Sequence
  chemically synthesized
ccaaatcccctacattctca

SEQ ID NO: 449224 - DNA, 20 bp, Artificial Sequence
  chemically synthesized
actagtcctccctgagaatg

SEQ ID NO: 449225 - DNA, 20 bp, Artificial Sequence
  chemically synthesized
cccaaatcccctacattctc

SEQ ID NO: 449226 - DNA, 20 bp, Artificial Sequence
  chemically synthesized
ctagtcctccctgagaatgt

SEQ ID NO: 449227 - DNA, 20 bp, Artificial Sequence
  chemically synthesized
ccccaaatcccctacattct

SEQ ID NO: 449228 - DNA, 20 bp, Artificial Sequence
  chemically synthesized
tagtcctccctgagaatgta

SEQ ID NO: 449229 - DNA, 20 bp, Artificial Sequence
  chemically synthesized
agtcctccctgagaatgtag

SEQ ID NO: 449230 - DNA, 20 bp, Artificial Sequence
  chemically synthesized
ccctgagaatgtaggggatt

SEQ ID NO: 449231 - DNA, 20 bp, Artificial Sequence
  chemically synthesized
cctgagaatgtaggggattt

SEQ ID NO: 449232 - DNA, 20 bp, Artificial Sequence
  chemically synthesized
ctgagaatgtaggggatttg

SEQ ID NO: 449233 - DNA, 20 bp, Artificial Sequence
  chemically synthesized
gtaggggatttggggttgaa

SEQ ID NO: 449234 - DNA, 20 bp, Artificial Sequence
  chemically synthesized
taggggatttggggttgaat

SEQ ID NO: 449235 - DNA, 20 bp, Artificial Sequence
  chemically synthesized
aggggatttggggttgaatg

SEQ ID NO: 449236 - DNA, 20 bp, Artificial Sequence
  chemically synthesized
ggggatttggggttgaatgg

SEQ ID NO: 449237 - DNA, 20 bp, Artificial Sequence
  chemically synthesized
gggatttggggttgaatggg

SEQ ID NO: 449238 - DNA, 20 bp, Artificial Sequence
  chemically synthesized
ggatttggggttgaatgggg

SEQ ID NO: 449239 - DNA, 20 bp, Artificial Sequence
  chemically synthesized
gatttggggttgaatggggg

SEQ ID NO: 449240 - DNA, 20 bp, Artificial Sequence
  chemically synthesized
gggttgaatggggggggtga

SEQ ID NO: 449241 - DNA, 20 bp, Artificial Sequence
  chemically synthesized
ggttgaatggggggggtgac

SEQ ID NO: 449242 - DNA, 20 bp, Artificial Sequence
  chemically synthesized
gatcctctccaggatgtgat

SEQ ID NO: 449243 - DNA, 20 bp, Artificial Sequence
  chemically synthesized
acaggtgactcatcacatcc

SEQ ID NO: 449244 - DNA, 20 bp, Artificial Sequence
  chemically synthesized
aggtgactcatcacatcctg

SEQ ID NO: 449245 - DNA, 20 bp, Artificial Sequence
  chemically synthesized
gtgactcatcacatcctgga

SEQ ID NO: 449246 - DNA, 20 bp, Artificial Sequence
  chemically synthesized
tgactcatcacatcctggag

SEQ ID NO: 449247 - DNA, 20 bp, Artificial Sequence
  chemically synthesized
tgtggcattggatcctctcc

SEQ ID NO: 449248 - DNA, 20 bp, Artificial Sequence
  chemically synthesized
atgtggcattggatcctctc

SEQ ID NO: 449249 - DNA, 20 bp, Artificial Sequence
  chemically synthesized
aatgcaaaccaatgtggcat

SEQ ID NO: 449250 - DNA, 20 bp, Artificial Sequence
  chemically synthesized
gagaggatccaatgccacat

SEQ ID NO: 449251 - DNA, 20 bp, Artificial Sequence
  chemically synthesized
tagcaaaatgcaaaccaatg

SEQ ID NO: 449252 - DNA, 20 bp, Artificial Sequence
  chemically synthesized
gtttgcattttgctattcac

SEQ ID NO: 449253 - DNA, 20 bp, Artificial Sequence
  chemically synthesized
ttatcatagtgacttgtgaa

SEQ ID NO: 449254 - DNA, 20 bp, Artificial Sequence
  chemically synthesized
tttaagtagcgaaattatca

SEQ ID NO: 449255 - DNA, 20 bp, Artificial Sequence
  chemically synthesized
atggtatatcattttttaag

SEQ ID NO: 449256 - DNA, 20 bp, Artificial Sequence
  chemically synthesized
cagatggtatatcatttttt

SEQ ID NO: 449257 - DNA, 20 bp, Artificial Sequence
  chemically synthesized
gctttaataaaaatttcaga

SEQ ID NO: 449258 - DNA, 20 bp, Artificial Sequence
  chemically synthesized
tattgctttaataaaaattt

SEQ ID NO: 449259 - DNA, 20 bp, Artificial Sequence
  chemically synthesized
accatctgaaatttttatta

SEQ ID NO: 449260 - DNA, 20 bp, Artificial Sequence
  chemically synthesized
tatatacatacacacacatt

SEQ ID NO: 449261 - DNA, 20 bp, Artificial Sequence
  chemically synthesized
atacatacacacacatttag

SEQ ID NO: 449262 - DNA, 20 bp, Artificial Sequence
  chemically synthesized
cattaagctaagcaaataaa

SEQ ID NO: 449263 - DNA, 20 bp, Artificial Sequence
  chemically synthesized
caaataaccatttatttgct

SEQ ID NO: 449264 - DNA, 20 bp, Artificial Sequence
  chemically synthesized
tacctaagcaacattaagct

SEQ ID NO: 449265 - DNA, 20 bp, Artificial Sequence
  chemically synthesized
ggaaatacctaagcaacatt

SEQ ID NO: 449266 - DNA, 20 bp, Artificial Sequence
  chemically synthesized
ttgcttagcttaatgttgct

SEQ ID NO: 449267 - DNA, 20 bp, Artificial Sequence
  chemically synthesized
tgcttagcttaatgttgctt

SEQ ID NO: 449268 - DNA, 20 bp, Artificial Sequence
  chemically synthesized
tcccttatgaggaaatacct

SEQ ID NO: 449269 - DNA, 20 bp, Artificial Sequence
  chemically synthesized
ttgcttaggtatttcctcat

SEQ ID NO: 449270 - DNA, 20 bp, Artificial Sequence
  chemically synthesized
tgcttaggtatttcctcata

SEQ ID NO: 449271 - DNA, 20 bp, Artificial Sequence
  chemically synthesized
gcttaggtatttcctcataa

SEQ ID NO: 449272 - DNA, 20 bp, Artificial Sequence
  chemically synthesized
ttctgggtttttcccttatg

SEQ ID NO: 449273 - DNA, 20 bp, Artificial Sequence
  chemically synthesized
attctgggtttttcccttat

SEQ ID NO: 449274 - DNA, 20 bp, Artificial Sequence
  chemically synthesized
ttcctcataagggaaaaacc

SEQ ID NO: 449275 - DNA, 20 bp, Artificial Sequence
  chemically synthesized
ataagggaaaaacccagaat

SEQ ID NO: 449276 - DNA, 20 bp, Artificial Sequence
  chemically synthesized
aaatataaatgactgattct

SEQ ID NO: 449277 - DNA, 20 bp, Artificial Sequence
  chemically synthesized
taaatataaatgactgattc

SEQ ID NO: 449278 - DNA, 20 bp, Artificial Sequence
  chemically synthesized
tatttatatttaaaatgtga

SEQ ID NO: 449279 - DNA, 20 bp, Artificial Sequence
  chemically synthesized
gtcatatacaaacatgtaag

SEQ ID NO: 449280 - DNA, 20 bp, Artificial Sequence
  chemically synthesized
gctgtcatatacaaacatgt

SEQ ID NO: 449281 - DNA, 20 bp, Artificial Sequence
  chemically synthesized
tcttacatgtttgtatatga

SEQ ID NO: 449282 - DNA, 20 bp, Artificial Sequence
  chemically synthesized
aagtgaatcaagaaaaaatt

SEQ ID NO: 449283 - DNA, 20 bp, Artificial Sequence
  chemically synthesized
attattggctaaagtgaatc

SEQ ID NO: 449284 - DNA, 20 bp, Artificial Sequence
  chemically synthesized
aattttttcttgattcactt

SEQ ID NO: 449285 - DNA, 20 bp, Artificial Sequence
  chemically synthesized
acagaaagtattattggcta

SEQ ID NO: 449286 - DNA, 20 bp, Artificial Sequence
  chemically synthesized
atcataacagaaagtattat

SEQ ID NO: 449287 - DNA, 20 bp, Artificial Sequence
  chemically synthesized
tccaactaaatcataacaga

SEQ ID NO: 449288 - DNA, 20 bp, Artificial Sequence
  chemically synthesized
attatccaactaaatcataa

SEQ ID NO: 449289 - DNA, 20 bp, Artificial Sequence
  chemically synthesized
taatactttctgttatgatt

SEQ ID NO: 449290 - DNA, 20 bp, Artificial Sequence
  chemically synthesized
actttctgttatgatttagt

SEQ ID NO: 449291 - DNA, 20 bp, Artificial Sequence
  chemically synthesized
atgatttagttggataattc

SEQ ID NO: 449292 - DNA, 20 bp, Artificial Sequence
  chemically synthesized
gttggataattctggattat

SEQ ID NO: 449293 - DNA, 20 bp, Artificial Sequence
  chemically synthesized
tttcaaactgactcataatc

SEQ ID NO: 449294 - DNA, 20 bp, Artificial Sequence
  chemically synthesized
gataattctggattatgagt

SEQ ID NO: 449295 - DNA, 20 bp, Artificial Sequence
  chemically synthesized
attatgagtcagtttgaaat

SEQ ID NO: 449296 - DNA, 20 bp, Artificial Sequence
  chemically synthesized
ttatgagtcagtttgaaatg

SEQ ID NO: 449297 - DNA, 20 bp, Artificial Sequence
  chemically synthesized
ctttgattttatttttgtca

SEQ ID NO: 449298 - DNA, 20 bp, Artificial Sequence
  chemically synthesized
ccatgacaaaaataaaatca

SEQ ID NO: 449299 - DNA, 20 bp, Artificial Sequence
  chemically synthesized
ctcttgatgttcgatatttt

SEQ ID NO: 449300 - DNA, 20 bp, Artificial Sequence
  chemically synthesized
aactaaaaatatcgaacatc

SEQ ID NO: 449301 - DNA, 20 bp, Artificial Sequence
  chemically synthesized
ctaaaaatatcgaacatcaa

SEQ ID NO: 449302 - DNA, 20 bp, Artificial Sequence
  chemically synthesized
aaaaatatcgaacatcaaga

SEQ ID NO: 449303 - DNA, 20 bp, Artificial Sequence
  chemically synthesized
caagagagtatccatctcct

SEQ ID NO: 449304 - DNA, 20 bp, Artificial Sequence
  chemically synthesized
aagagagtatccatctccta

SEQ ID NO: 449305 - DNA, 20 bp, Artificial Sequence
  chemically synthesized
cacctcaaacccttaggaga

SEQ ID NO: 449306 - DNA, 20 bp, Artificial Sequence
  chemically synthesized
agagagtatccatctcctaa

SEQ ID NO: 449307 - DNA, 20 bp, Artificial Sequence
  chemically synthesized
tcatcacctcaaacccttag

SEQ ID NO: 449308 - DNA, 20 bp, Artificial Sequence
  chemically synthesized
actcatcacctcaaaccctt

SEQ ID NO: 449309 - DNA, 20 bp, Artificial Sequence
  chemically synthesized
tatccatctcctaagggttt

SEQ ID NO: 449310 - DNA, 20 bp, Artificial Sequence
  chemically synthesized
tactcatcacctcaaaccct

SEQ ID NO: 449311 - DNA, 20 bp, Artificial Sequence
  chemically synthesized
atccatctcctaagggtttg

SEQ ID NO: 449312 - DNA, 20 bp, Artificial Sequence
  chemically synthesized
tcctaagggtttgaggtgat

SEQ ID NO: 449313 - DNA, 20 bp, Artificial Sequence
  chemically synthesized
atgatcaaatcaggataatt

SEQ ID NO: 449314 - DNA, 20 bp, Artificial Sequence
  chemically synthesized
aatgatcaaatcaggataat

SEQ ID NO: 449315 - DNA, 20 bp, Artificial Sequence
  chemically synthesized
taatgtataatgatcaaatc

SEQ ID NO: 449316 - DNA, 20 bp, Artificial Sequence
  chemically synthesized
gtaatgtataatgatcaaat

SEQ ID NO: 449317 - DNA, 20 bp, Artificial Sequence
  chemically synthesized
cattatacattacataaaca

SEQ ID NO: 449318 - DNA, 20 bp, Artificial Sequence
  chemically synthesized
tacatattttgaggtcacat

SEQ ID NO: 449319 - DNA, 20 bp, Artificial Sequence
  chemically synthesized
taatagttgtacatattttg

SEQ ID NO: 449320 - DNA, 20 bp, Artificial Sequence
  chemically synthesized
ataatagttgtacatatttt

SEQ ID NO: 449321 - DNA, 20 bp, Artificial Sequence
  chemically synthesized
atccttttattgatacataa

SEQ ID NO: 449322 - DNA, 20 bp, Artificial Sequence
  chemically synthesized
caactattatgtatcaataa

SEQ ID NO: 449323 - DNA, 20 bp, Artificial Sequence
  chemically synthesized
aactattatgtatcaataaa

SEQ ID NO: 449324 - DNA, 20 bp, Artificial Sequence
  chemically synthesized
tatagtttctcaataggagg

SEQ ID NO: 449325 - DNA, 20 bp, Artificial Sequence
  chemically synthesized
aaaaggatccacctcctatt

SEQ ID NO: 449326 - DNA, 20 bp, Artificial Sequence
  chemically synthesized
aagtatagtttctcaatagg

SEQ ID NO: 449327 - DNA, 20 bp, Artificial Sequence
  chemically synthesized
caagtatagtttctcaatag

SEQ ID NO: 449328 - DNA, 20 bp, Artificial Sequence
  chemically synthesized
ttcaagtatagtttctcaat

SEQ ID NO: 449329 - DNA, 20 bp, Artificial Sequence
  chemically synthesized
gttcaagtatagtttctcaa

SEQ ID NO: 449330 - DNA, 20 bp, Artificial Sequence
  chemically synthesized
tactaaaatgggttcaagta

SEQ ID NO: 449331 - DNA, 20 bp, Artificial Sequence
  chemically synthesized
atacatactaaaatgggttc

SEQ ID NO: 449332 - DNA, 20 bp, Artificial Sequence
  chemically synthesized
aactatacttgaacccattt

SEQ ID NO: 449333 - DNA, 20 bp, Artificial Sequence
  chemically synthesized
tgacatatacatactaaaat

SEQ ID NO: 449334 - DNA, 20 bp, Artificial Sequence
  chemically synthesized
ctgacatatacatactaaaa

SEQ ID NO: 449335 - DNA, 20 bp, Artificial Sequence
  chemically synthesized
ccattttagtatgtatatgt

SEQ ID NO: 449336 - DNA, 20 bp, Artificial Sequence
  chemically synthesized
cattttagtatgtatatgtc

SEQ ID NO: 449337 - DNA, 20 bp, Artificial Sequence
  chemically synthesized
aaagttccaattattatttg

SEQ ID NO: 449338 - DNA, 20 bp, Artificial Sequence
  chemically synthesized
tacatactgcaaataataat

SEQ ID NO: 449339 - DNA, 20 bp, Artificial Sequence
  chemically synthesized
gcaaataataattggaactt

SEQ ID NO: 449340 - DNA, 20 bp, Artificial Sequence
  chemically synthesized
taataattggaactttggta

SEQ ID NO: 449341 - DNA, 20 bp, Artificial Sequence
  chemically synthesized
attattcttggtccatacca

SEQ ID NO: 449342 - DNA, 20 bp, Artificial Sequence
  chemically synthesized
ttggaactttggtatggacc

SEQ ID NO: 449343 - DNA, 20 bp, Artificial Sequence
  chemically synthesized
aaatgtccattcattattct

SEQ ID NO: 449344 - DNA, 20 bp, Artificial Sequence
  chemically synthesized
tatggaccaagaataatgaa

SEQ ID NO: 449345 - DNA, 20 bp, Artificial Sequence
  chemically synthesized
aatgaatggacatttatcta

SEQ ID NO: 449346 - DNA, 20 bp, Artificial Sequence
  chemically synthesized
atgaatggacatttatctac

SEQ ID NO: 449347 - DNA, 20 bp, Artificial Sequence
  chemically synthesized
aatatgtctaaataaacctg

SEQ ID NO: 449348 - DNA, 20 bp, Artificial Sequence
  chemically synthesized
catttatctacaggtttatt

SEQ ID NO: 449349 - DNA, 20 bp, Artificial Sequence
  chemically synthesized
acaggtttatttagacatat

SEQ ID NO: 449350 - DNA, 20 bp, Artificial Sequence
  chemically synthesized
cttcataatcaattgttatc

SEQ ID NO: 449351 - DNA, 20 bp, Artificial Sequence
  chemically synthesized
cttgataacaattgattatg

SEQ ID NO: 449352 - DNA, 20 bp, Artificial Sequence
  chemically synthesized
ttctattaaattagtagaag

SEQ ID NO: 449353 - DNA, 20 bp, Artificial Sequence
  chemically synthesized
tagttctattaaattagtag

SEQ ID NO: 449354 - DNA, 20 bp, Artificial Sequence
  chemically synthesized
ctctagttctattaaattag

SEQ ID NO: 449355 - DNA, 20 bp, Artificial Sequence
  chemically synthesized
aactacttctactaatttaa

SEQ ID NO: 449356 - DNA, 20 bp, Artificial Sequence
  chemically synthesized
attctctagttctattaaat

SEQ ID NO: 449357 - DNA, 20 bp, Artificial Sequence
  chemically synthesized
ttctactaatttaatagaac

SEQ ID NO: 449358 - DNA, 20 bp, Artificial Sequence
  chemically synthesized
ctactaatttaatagaacta

SEQ ID NO: 449359 - DNA, 20 bp, Artificial Sequence
  chemically synthesized
atttaatagaactagagaat

SEQ ID NO: 449360 - DNA, 20 bp, Artificial Sequence
  chemically synthesized
tttaatagaactagagaatc

SEQ ID NO: 449361 - DNA, 20 bp, Artificial Sequence
  chemically synthesized
cttgtctttccctgattctc

SEQ ID NO: 449362 - DNA, 20 bp, Artificial Sequence
  chemically synthesized
ttaatagaactagagaatca

SEQ ID NO: 449363 - DNA, 20 bp, Artificial Sequence
  chemically synthesized
tagaactagagaatcaggga

SEQ ID NO: 449364 - DNA, 20 bp, Artificial Sequence
  chemically synthesized
ctagagaatcagggaaagac

SEQ ID NO: 449365 - DNA, 20 bp, Artificial Sequence
  chemically synthesized
tcagggaaagacaagctgta

SEQ ID NO: 449366 - DNA, 20 bp, Artificial Sequence
  chemically synthesized
cttccactttaaattctata

SEQ ID NO: 449367 - DNA, 20 bp, Artificial Sequence
  chemically synthesized
gacaagctgtatagaattta

SEQ ID NO: 449368 - DNA, 20 bp, Artificial Sequence
  chemically synthesized
aagctgtatagaatttaaag

SEQ ID NO: 449369 - DNA, 20 bp, Artificial Sequence
  chemically synthesized
ctgtatagaatttaaagtgg

SEQ ID NO: 449370 - DNA, 20 bp, Artificial Sequence
  chemically synthesized
taaagtggaagaatttatta

SEQ ID NO: 449371 - DNA, 20 bp, Artificial Sequence
  chemically synthesized
aagtggaagaatttattata

SEQ ID NO: 449372 - DNA, 20 bp, Artificial Sequence
  chemically synthesized
aagaatttattatagagtta

SEQ ID NO: 449373 - DNA, 20 bp, Artificial Sequence
  chemically synthesized
tagcattaataaaatggatg

SEQ ID NO: 449374 - DNA, 20 bp, Artificial Sequence
  chemically synthesized
tatttttagcattaataaaa

SEQ ID NO: 449375 - DNA, 20 bp, Artificial Sequence
  chemically synthesized
cattttattaatgctaaaaa

SEQ ID NO: 449376 - DNA, 20 bp, Artificial Sequence
  chemically synthesized
atgataaatgtatctatttt

SEQ ID NO: 449377 - DNA, 20 bp, Artificial Sequence
  chemically synthesized
aatagatacatttatcatta

SEQ ID NO: 449378 - DNA, 20 bp, Artificial Sequence
  chemically synthesized
tagatacatttatcattata

SEQ ID NO: 449379 - DNA, 20 bp, Artificial Sequence
  chemically synthesized
tcaaacaaaaaaatttcaat

SEQ ID NO: 449380 - DNA, 20 bp, Artificial Sequence
  chemically synthesized
gagtgaattttaatgtactg

SEQ ID NO: 449381 - DNA, 20 bp, Artificial Sequence
  chemically synthesized
ttttaatgtactgtagactg

SEQ ID NO: 449382 - DNA, 20 bp, Artificial Sequence
  chemically synthesized
ttcaatatctccacagtcta

SEQ ID NO: 449383 - DNA, 20 bp, Artificial Sequence
  chemically synthesized
ttaatgtactgtagactgtg

SEQ ID NO: 449384 - DNA, 20 bp, Artificial Sequence
  chemically synthesized
ttaaactttcaatatctcca

SEQ ID NO: 449385 - DNA, 20 bp, Artificial Sequence
  chemically synthesized
gtagactgtggagatattga

SEQ ID NO: 449386 - DNA, 20 bp, Artificial Sequence
  chemically synthesized
agatattgaaagtttaactg

SEQ ID NO: 449387 - DNA, 20 bp, Artificial Sequence
  chemically synthesized
aaagctagacagattttctt

SEQ ID NO: 449388 - DNA, 20 bp, Artificial Sequence
  chemically synthesized
ttaactgaagaaaatctgtc

SEQ ID NO: 449389 - DNA, 20 bp, Artificial Sequence
  chemically synthesized
ggatgagaagtaaagctaga

SEQ ID NO: 449390 - DNA, 20 bp, Artificial Sequence
  chemically synthesized
taatggatgagaagtaaagc

SEQ ID NO: 449391 - DNA, 20 bp, Artificial Sequence
  chemically synthesized
tatttaatggatgagaagta

SEQ ID NO: 449392 - DNA, 20 bp, Artificial Sequence
  chemically synthesized
tgctctatttaatggatgag

SEQ ID NO: 449393 - DNA, 20 bp, Artificial Sequence
  chemically synthesized
acttgctctatttaatggat

SEQ ID NO: 449394 - DNA, 20 bp, Artificial Sequence
  chemically synthesized
tttacttctcatccattaaa

SEQ ID NO: 449395 - DNA, 20 bp, Artificial Sequence
  chemically synthesized
tacttctcatccattaaata

SEQ ID NO: 449396 - DNA, 20 bp, Artificial Sequence
  chemically synthesized
agcatacttgctctatttaa

SEQ ID NO: 449397 - DNA, 20 bp, Artificial Sequence
  chemically synthesized
tctcatccattaaatagagc

SEQ ID NO: 449398 - DNA, 20 bp, Artificial Sequence
  chemically synthesized
ttaaatagagcaagtatgct

SEQ ID NO: 449399 - DNA, 20 bp, Artificial Sequence
  chemically synthesized
agagcaagtatgcttggcaa

SEQ ID NO: 449400 - DNA, 20 bp, Artificial Sequence
  chemically synthesized
tttttaggtattcttttgcc

SEQ ID NO: 449401 - DNA, 20 bp, Artificial Sequence
  chemically synthesized
aagggactggaaattttttt

SEQ ID NO: 449402 - DNA, 20 bp, Artificial Sequence
  chemically synthesized
gaagggactggaaatttttt

SEQ ID NO: 449403 - DNA, 20 bp, Artificial Sequence
  chemically synthesized
agaatacctaaaaaaatttc

SEQ ID NO: 449404 - DNA, 20 bp, Artificial Sequence
  chemically synthesized
ttgtcacttagagaagggac

SEQ ID NO: 449405 - DNA, 20 bp, Artificial Sequence
  chemically synthesized
aaatttccagtcccttctct

SEQ ID NO: 449406 - DNA, 20 bp, Artificial Sequence
  chemically synthesized
gaattttgtcacttagagaa

SEQ ID NO: 449407 - DNA, 20 bp, Artificial Sequence
  chemically synthesized
agaattttgtcacttagaga

SEQ ID NO: 449408 - DNA, 20 bp, Artificial Sequence
  chemically synthesized
cagaattttgtcacttagag

SEQ ID NO: 449409 - DNA, 20 bp, Artificial Sequence
  chemically synthesized
catcagaattttgtcactta

SEQ ID NO: 449410 - DNA, 20 bp, Artificial Sequence
  chemically synthesized
gccatcagaattttgtcact

SEQ ID NO: 449411 - DNA, 20 bp, Artificial Sequence
  chemically synthesized
tctaagtgacaaaattctga

SEQ ID NO: 449412 - DNA, 20 bp, Artificial Sequence
  chemically synthesized
gtaaaatatcgagaggccat

SEQ ID NO: 449413 - DNA, 20 bp, Artificial Sequence
  chemically synthesized
acctgttgtaaaatatcgag

SEQ ID NO: 449414 - DNA, 20 bp, Artificial Sequence
  chemically synthesized
tacctgttgtaaaatatcga

SEQ ID NO: 449415 - DNA, 20 bp, Artificial Sequence
  chemically synthesized
tatacctgttgtaaaatatc

SEQ ID NO: 449416 - DNA, 20 bp, Artificial Sequence
  chemically synthesized
ggcctctcgatattttacaa

SEQ ID NO: 449417 - DNA, 20 bp, Artificial Sequence
  chemically synthesized
gcctctcgatattttacaac

SEQ ID NO: 449418 - DNA, 20 bp, Artificial Sequence
  chemically synthesized
cgatattttacaacaggtat

SEQ ID NO: 449419 - DNA, 20 bp, Artificial Sequence
  chemically synthesized
tattttacaacaggtataag

SEQ ID NO: 449420 - DNA, 20 bp, Artificial Sequence
  chemically synthesized
aacaggtataagcggttatg

SEQ ID NO: 449421 - DNA, 20 bp, Artificial Sequence
  chemically synthesized
aaaaatatcaccgtctctga

SEQ ID NO: 449422 - DNA, 20 bp, Artificial Sequence
  chemically synthesized
gactagatgaccatcagaga

SEQ ID NO: 449423 - DNA, 20 bp, Artificial Sequence
  chemically synthesized
tagagactagatgaccatca

SEQ ID NO: 449424 - DNA, 20 bp, Artificial Sequence
  chemically synthesized
attagagactagatgaccat

SEQ ID NO: 449425 - DNA, 20 bp, Artificial Sequence
  chemically synthesized
caccgtctctgatggtcatc

SEQ ID NO: 449426 - DNA, 20 bp, Artificial Sequence
  chemically synthesized
tggtttccctcattagagac

SEQ ID NO: 449427 - DNA, 20 bp, Artificial Sequence
  chemically synthesized
atggtcatctagtctctaat

SEQ ID NO: 449428 - DNA, 20 bp, Artificial Sequence
  chemically synthesized
tggtcatctagtctctaatg

SEQ ID NO: 449429 - DNA, 20 bp, Artificial Sequence
  chemically synthesized
ggtcatctagtctctaatga

SEQ ID NO: 449430 - DNA, 20 bp, Artificial Sequence
  chemically synthesized
tttattggtttccctcatta

SEQ ID NO: 449431 - DNA, 20 bp, Artificial Sequence
  chemically synthesized
gatttattggtttccctcat

SEQ ID NO: 449432 - DNA, 20 bp, Artificial Sequence
  chemically synthesized
attagtatttatggatttat

SEQ ID NO: 449433 - DNA, 20 bp, Artificial Sequence
  chemically synthesized
aaaaatttcattagtattta

SEQ ID NO: 449434 - DNA, 20 bp, Artificial Sequence
  chemically synthesized
tagagtttgaaaaatttcat

SEQ ID NO: 449435 - DNA, 20 bp, Artificial Sequence
  chemically synthesized
ataactaagaatggggatta

SEQ ID NO: 449436 - DNA, 20 bp, Artificial Sequence
  chemically synthesized
tgataactaagaatggggat

SEQ ID NO: 449437 - DNA, 20 bp, Artificial Sequence
  chemically synthesized
caaactctaatccccattct

SEQ ID NO: 449438 - DNA, 20 bp, Artificial Sequence
  chemically synthesized
aaaattgataactaagaatg

SEQ ID NO: 449439 - DNA, 20 bp, Artificial Sequence
  chemically synthesized
aaaaattgataactaagaat

SEQ ID NO: 449440 - DNA, 20 bp, Artificial Sequence
  chemically synthesized
caaaaattgataactaagaa

SEQ ID NO: 449441 - DNA, 20 bp, Artificial Sequence
  chemically synthesized
aataacaaaaattgataact

SEQ ID NO: 449442 - DNA, 20 bp, Artificial Sequence
  chemically synthesized
atcaatttttgttattttaa

SEQ ID NO: 449443 - DNA, 20 bp, Artificial Sequence
  chemically synthesized
aatttattcatgtataaaac

SEQ ID NO: 449444 - DNA, 20 bp, Artificial Sequence
  chemically synthesized
taattaatgatgggattttc

SEQ ID NO: 449445 - DNA, 20 bp, Artificial Sequence
  chemically synthesized
agctattgctaattaatgat

SEQ ID NO: 449446 - DNA, 20 bp, Artificial Sequence
  chemically synthesized
gagctattgctaattaatga

SEQ ID NO: 449447 - DNA, 20 bp, Artificial Sequence
  chemically synthesized
tggaaaatcccatcattaat

SEQ ID NO: 449448 - DNA, 20 bp, Artificial Sequence
  chemically synthesized
atcccatcattaattagcaa

SEQ ID NO: 449449 - DNA, 20 bp, Artificial Sequence
  chemically synthesized
tattttaaaatattaataaa

SEQ ID NO: 449450 - DNA, 20 bp, Artificial Sequence
  chemically synthesized
actattttaaaatattaata

SEQ ID NO: 449451 - DNA, 20 bp, Artificial Sequence
  chemically synthesized
tctttattaatattttaaaa

SEQ ID NO: 449452 - DNA, 20 bp, Artificial Sequence
  chemically synthesized
ggcatattaagagtttagtt

SEQ ID NO: 449453 - DNA, 20 bp, Artificial Sequence
  chemically synthesized
cattaggcatattaagagtt

SEQ ID NO: 449454 - DNA, 20 bp, Artificial Sequence
  chemically synthesized
catgacattaggcatattaa

SEQ ID NO: 449455 - DNA, 20 bp, Artificial Sequence
  chemically synthesized
atcatgacattaggcatatt

SEQ ID NO: 449456 - DNA, 20 bp, Artificial Sequence
  chemically synthesized
attaaagggatcatgacatt

SEQ ID NO: 449457 - DNA, 20 bp, Artificial Sequence
  chemically synthesized
cattaaagggatcatgacat

SEQ ID NO: 449458 - DNA, 20 bp, Artificial Sequence
  chemically synthesized
aatgtcatgatccctttaat

SEQ ID NO: 449459 - DNA, 20 bp, Artificial Sequence
  chemically synthesized
atggctagtttctcattaaa

SEQ ID NO: 449460 - DNA, 20 bp, Artificial Sequence
  chemically synthesized
aatggctagtttctcattaa

SEQ ID NO: 449461 - DNA, 20 bp, Artificial Sequence
  chemically synthesized
taatggctagtttctcatta

SEQ ID NO: 449462 - DNA, 20 bp, Artificial Sequence
  chemically synthesized
tgatccctttaatgagaaac

SEQ ID NO: 449463 - DNA, 20 bp, Artificial Sequence
  chemically synthesized
agctattttcttttaatggc

SEQ ID NO: 449464 - DNA, 20 bp, Artificial Sequence
  chemically synthesized
aatgagaaactagccattaa

SEQ ID NO: 449465 - DNA, 20 bp, Artificial Sequence
  chemically synthesized
tataagctattttcttttaa

SEQ ID NO: 449466 - DNA, 20 bp, Artificial Sequence
  chemically synthesized
aactagccattaaaagaaaa

SEQ ID NO: 449467 - DNA, 20 bp, Artificial Sequence
  chemically synthesized
ttatatatagaaatgagtat

SEQ ID NO: 449468 - DNA, 20 bp, Artificial Sequence
  chemically synthesized
atgtacttatatatagaaat

SEQ ID NO: 449469 - DNA, 20 bp, Artificial Sequence
  chemically synthesized
ttatactcatttctatatat

SEQ ID NO: 449470 - DNA, 20 bp, Artificial Sequence
  chemically synthesized
aaataatatgtacttatata

SEQ ID NO: 449471 - DNA, 20 bp, Artificial Sequence
  chemically synthesized
agtacatattattttgtaaa

SEQ ID NO: 449472 - DNA, 20 bp, Artificial Sequence
  chemically synthesized
catattattttgtaaacagt

SEQ ID NO: 449473 - DNA, 20 bp, Artificial Sequence
  chemically synthesized
attattttgtaaacagttag

SEQ ID NO: 449474 - DNA, 20 bp, Artificial Sequence
  chemically synthesized
ggaaaatatttcatttttaa

SEQ ID NO: 449475 - DNA, 20 bp, Artificial Sequence
  chemically synthesized
cagatattcaaatgcaaaaa

SEQ ID NO: 449476 - DNA, 20 bp, Artificial Sequence
  chemically synthesized
atttttgcatttgaatatct

SEQ ID NO: 449477 - DNA, 20 bp, Artificial Sequence
  chemically synthesized
gaatatcgggaacatattct

SEQ ID NO: 449478 - DNA, 20 bp, Artificial Sequence
  chemically synthesized
tataaactggcaagaatatc

SEQ ID NO: 449479 - DNA, 20 bp, Artificial Sequence
  chemically synthesized
ttataaactggcaagaatat

SEQ ID NO: 449480 - DNA, 20 bp, Artificial Sequence
  chemically synthesized
tatgttcccgatattcttgc

SEQ ID NO: 449481 - DNA, 20 bp, Artificial Sequence
  chemically synthesized
atataggtttataaactggc

SEQ ID NO: 449482 - DNA, 20 bp, Artificial Sequence
  chemically synthesized
taaaatataggtttataaac

SEQ ID NO: 449483 - DNA, 20 bp, Artificial Sequence
  chemically synthesized
taccagtactgttaaaatat

SEQ ID NO: 449484 - DNA, 20 bp, Artificial Sequence
  chemically synthesized
ttaccagtactgttaaaata

SEQ ID NO: 449485 - DNA, 20 bp, Artificial Sequence
  chemically synthesized
tttataaacctatattttaa

SEQ ID NO: 449486 - DNA, 20 bp, Artificial Sequence
  chemically synthesized
aacctatattttaacagtac

SEQ ID NO: 449487 - DNA, 20 bp, Artificial Sequence
  chemically synthesized
tgtgtataattaagcattac

SEQ ID NO: 449488 - DNA, 20 bp, Artificial Sequence
  chemically synthesized
aagcaaatttgtgtataatt

SEQ ID NO: 449489 - DNA, 20 bp, Artificial Sequence
  chemically synthesized
aagccttgtgatgtgaaata

SEQ ID NO: 449490 - DNA, 20 bp, Artificial Sequence
  chemically synthesized
tttgctttatttcacatcac

SEQ ID NO: 449491 - DNA, 20 bp, Artificial Sequence
  chemically synthesized
ttgctttatttcacatcaca

SEQ ID NO: 449492 - DNA, 20 bp, Artificial Sequence
  chemically synthesized
gtgtatgctccagacaaaca

SEQ ID NO: 449493 - DNA, 20 bp, Artificial Sequence
  chemically synthesized
atcacaaggctttgtttgtc

SEQ ID NO: 449494 - DNA, 20 bp, Artificial Sequence
  chemically synthesized
cacaaggctttgtttgtctg

SEQ ID NO: 449495 - DNA, 20 bp, Artificial Sequence
  chemically synthesized
gtaaacaatagtgtatgctc

SEQ ID NO: 449496 - DNA, 20 bp, Artificial Sequence
  chemically synthesized
gaactgtacagtgtaaacaa

SEQ ID NO: 449497 - DNA, 20 bp, Artificial Sequence
  chemically synthesized
acactattgtttacactgta

SEQ ID NO: 449498 - DNA, 20 bp, Artificial Sequence
  chemically synthesized
tcgtaacaaaaagaactgta

SEQ ID NO: 449499 - DNA, 20 bp, Artificial Sequence
  chemically synthesized
agcatccaaatcgtaacaaa

SEQ ID NO: 449500 - DNA, 20 bp, Artificial Sequence
  chemically synthesized
cagttctttttgttacgatt

SEQ ID NO: 449501 - DNA, 20 bp, Artificial Sequence
  chemically synthesized
tacgatttggatgcttttaa

SEQ ID NO: 449502 - DNA, 20 bp, Artificial Sequence
  chemically synthesized
cgatttggatgcttttaaaa

SEQ ID NO: 449503 - DNA, 20 bp, Artificial Sequence
  chemically synthesized
atatttaaaatctcttttaa

SEQ ID NO: 449504 - DNA, 20 bp, Artificial Sequence
  chemically synthesized
agattttaaatatttgctct

SEQ ID NO: 449505 - DNA, 20 bp, Artificial Sequence
  chemically synthesized
gattttaaatatttgctctc

SEQ ID NO: 449506 - DNA, 20 bp, Artificial Sequence
  chemically synthesized
atgttttttaataaacctga

SEQ ID NO: 449507 - DNA, 20 bp, Artificial Sequence
  chemically synthesized
ctatgttttttaataaacct

SEQ ID NO: 449508 - DNA, 20 bp, Artificial Sequence
  chemically synthesized
ctcaggtttattaaaaaaca

SEQ ID NO: 449509 - DNA, 20 bp, Artificial Sequence
  chemically synthesized
aaaaaacatagacttgaaaa

SEQ ID NO: 449510 - DNA, 20 bp, Artificial Sequence
  chemically synthesized
aatatatcatatcttttttc

SEQ ID NO: 449511 - DNA, 20 bp, Artificial Sequence
  chemically synthesized
attgtattaacaaattctaa

SEQ ID NO: 449512 - DNA, 20 bp, Artificial Sequence
  chemically synthesized
ttaggataatgataaacttt

SEQ ID NO: 449513 - DNA, 20 bp, Artificial Sequence
  chemically synthesized
tttatcattatcctaaaatt

SEQ ID NO: 449514 - DNA, 20 bp, Artificial Sequence
  chemically synthesized
ttatcattatcctaaaattt

SEQ ID NO: 449515 - DNA, 20 bp, Artificial Sequence
  chemically synthesized
tgccccagaccccaaatttt

SEQ ID NO: 449516 - DNA, 20 bp, Artificial Sequence
  chemically synthesized
tatcattatcctaaaatttg

SEQ ID NO: 449517 - DNA, 20 bp, Artificial Sequence
  chemically synthesized
ttgccccagaccccaaattt

SEQ ID NO: 449518 - DNA, 20 bp, Artificial Sequence
  chemically synthesized
ttatcctaaaatttggggtc

SEQ ID NO: 449519 - DNA, 20 bp, Artificial Sequence
  chemically synthesized
tatcctaaaatttggggtct

SEQ ID NO: 449520 - DNA, 20 bp, Artificial Sequence
  chemically synthesized
atcctaaaatttggggtctg

SEQ ID NO: 449521 - DNA, 20 bp, Artificial Sequence
  chemically synthesized
tgcatatctctaatttgccc

SEQ ID NO: 449522 - DNA, 20 bp, Artificial Sequence
  chemically synthesized
atttggggtctggggcaaat

SEQ ID NO: 449523 - DNA, 20 bp, Artificial Sequence
  chemically synthesized
ttggggtctggggcaaatta

SEQ ID NO: 449524 - DNA, 20 bp, Artificial Sequence
  chemically synthesized
aaattagagatatgcaaaaa

SEQ ID NO: 449525 - DNA, 20 bp, Artificial Sequence
  chemically synthesized
tagagatatgcaaaaatggt

SEQ ID NO: 449526 - DNA, 20 bp, Artificial Sequence
  chemically synthesized
gcaaatttttgaatgtgtct

SEQ ID NO: 449527 - DNA, 20 bp, Artificial Sequence
  chemically synthesized
caagtgaaaattttttttct

SEQ ID NO: 449528 - DNA, 20 bp, Artificial Sequence
  chemically synthesized
aaaattttcacttgcgacct

SEQ ID NO: 449529 - DNA, 20 bp, Artificial Sequence
  chemically synthesized
ggggaaaagcctaaggtcgc

SEQ ID NO: 449530 - DNA, 20 bp, Artificial Sequence
  chemically synthesized
aaattttcacttgcgacctt

SEQ ID NO: 449531 - DNA, 20 bp, Artificial Sequence
  chemically synthesized
aatatagggggaaaagccta

SEQ ID NO: 449532 - DNA, 20 bp, Artificial Sequence
  chemically synthesized
aaatatagggggaaaagcct

SEQ ID NO: 449533 - DNA, 20 bp, Artificial Sequence
  chemically synthesized
atatcaaaatatagggggaa

SEQ ID NO: 449534 - DNA, 20 bp, Artificial Sequence
  chemically synthesized
agtctatatcaaaatatagg

SEQ ID NO: 449535 - DNA, 20 bp, Artificial Sequence
  chemically synthesized
aagtctatatcaaaatatag

SEQ ID NO: 449536 - DNA, 20 bp, Artificial Sequence
  chemically synthesized
gaagtctatatcaaaatata

SEQ ID NO: 449537 - DNA, 20 bp, Artificial Sequence
  chemically synthesized
tgaagtctatatcaaaatat

SEQ ID NO: 449538 - DNA, 20 bp, Artificial Sequence
  chemically synthesized
gtgaagtctatatcaaaata

SEQ ID NO: 449539 - DNA, 20 bp, Artificial Sequence
  chemically synthesized
tttccccctatattttgata

SEQ ID NO: 449540 - DNA, 20 bp, Artificial Sequence
  chemically synthesized
ttgatatagacttcacaata

SEQ ID NO: 449541 - DNA, 20 bp, Artificial Sequence
  chemically synthesized
attataagaactatattgtg

SEQ ID NO: 449542 - DNA, 20 bp, Artificial Sequence
  chemically synthesized
tcacaatatagttcttataa

SEQ ID NO: 449543 - DNA, 20 bp, Artificial Sequence
  chemically synthesized
caatatagttcttataatag

SEQ ID NO: 449544 - DNA, 20 bp, Artificial Sequence
  chemically synthesized
ttgtatctccccactattat

SEQ ID NO: 449545 - DNA, 20 bp, Artificial Sequence
  chemically synthesized
aatatagttcttataatagt

SEQ ID NO: 449546 - DNA, 20 bp, Artificial Sequence
  chemically synthesized
atatagttcttataatagtg

SEQ ID NO: 449547 - DNA, 20 bp, Artificial Sequence
  chemically synthesized
atagttcttataatagtggg

SEQ ID NO: 449548 - DNA, 20 bp, Artificial Sequence
  chemically synthesized
caattttaattgacaacttt

SEQ ID NO: 449549 - DNA, 20 bp, Artificial Sequence
  chemically synthesized
acatcaaataataaatctta

SEQ ID NO: 449550 - DNA, 20 bp, Artificial Sequence
  chemically synthesized
tatttgatgtgatgattcga

SEQ ID NO: 449551 - DNA, 20 bp, Artificial Sequence
  chemically synthesized
atgattcgaaagaaataaat

SEQ ID NO: 449552 - DNA, 20 bp, Artificial Sequence
  chemically synthesized
gattcgaaagaaataaatca

SEQ ID NO: 449553 - DNA, 20 bp, Artificial Sequence
  chemically synthesized
gaaataaatcagagaaaaaa

SEQ ID NO: 449554 - DNA, 20 bp, Artificial Sequence
  chemically synthesized
tctgtataagatttacattt

SEQ ID NO: 449555 - DNA, 20 bp, Artificial Sequence
  chemically synthesized
gctaaaatgtaaatcttata

SEQ ID NO: 449556 - DNA, 20 bp, Artificial Sequence
  chemically synthesized
ccaaagcaatcagtctgtat

SEQ ID NO: 449557 - DNA, 20 bp, Artificial Sequence
  chemically synthesized
cttatacagactgattgctt

SEQ ID NO: 449558 - DNA, 20 bp, Artificial Sequence
  chemically synthesized
tatatatttaccaaagcaat

SEQ ID NO: 449559 - DNA, 20 bp, Artificial Sequence
  chemically synthesized
attattttatatatttacca

SEQ ID NO: 449560 - DNA, 20 bp, Artificial Sequence
  chemically synthesized
tggtaaatatataaaataat

SEQ ID NO: 449561 - DNA, 20 bp, Artificial Sequence
  chemically synthesized
gtaaatatataaaataataa

SEQ ID NO: 449562 - DNA, 20 bp, Artificial Sequence
  chemically synthesized
aagagttattaaaacttgtt

SEQ ID NO: 449563 - DNA, 20 bp, Artificial Sequence
  chemically synthesized
aattttgggtttttctaaac

SEQ ID NO: 449564 - DNA, 20 bp, Artificial Sequence
  chemically synthesized
gtttagaaaaacccaaaatt

SEQ ID NO: 449565 - DNA, 20 bp, Artificial Sequence
  chemically synthesized
ctcaatcttgtccaaatttt

SEQ ID NO: 449566 - DNA, 20 bp, Artificial Sequence
  chemically synthesized
cctcaatcttgtccaaattt

SEQ ID NO: 449567 - DNA, 20 bp, Artificial Sequence
  chemically synthesized
gaaaaacccaaaatttggac

SEQ ID NO: 449568 - DNA, 20 bp, Artificial Sequence
  chemically synthesized
cccaaaatttggacaagatt

SEQ ID NO: 449569 - DNA, 20 bp, Artificial Sequence
  chemically synthesized
ccaaaatttggacaagattg

SEQ ID NO: 449570 - DNA, 20 bp, Artificial Sequence
  chemically synthesized
ttggacaagattgaggaaca

SEQ ID NO: 449571 - DNA, 20 bp, Artificial Sequence
  chemically synthesized
tggacaagattgaggaacaa

SEQ ID NO: 449572 - DNA, 20 bp, Artificial Sequence
  chemically synthesized
acaagattgaggaacaaagg

SEQ ID NO: 449573 - DNA, 20 bp, Artificial Sequence
  chemically synthesized
ttgaggaacaaaggtggttt

SEQ ID NO: 449574 - DNA, 20 bp, Artificial Sequence
  chemically synthesized
aacaaaggtggttttggata

SEQ ID NO: 449575 - DNA, 20 bp, Artificial Sequence
  chemically synthesized
acaaaggtggttttggataa

SEQ ID NO: 449576 - DNA, 20 bp, Artificial Sequence
  chemically synthesized
gataaaggttttgatttcat

SEQ ID NO: 449577 - DNA, 20 bp, Artificial Sequence
  chemically synthesized
ccatcacattttgcaataag

SEQ ID NO: 449578 - DNA, 20 bp, Artificial Sequence
  chemically synthesized
agaccatcacattttgcaat

SEQ ID NO: 449579 - DNA, 20 bp, Artificial Sequence
  chemically synthesized
cttcttattgcaaaatgtga

SEQ ID NO: 449580 - DNA, 20 bp, Artificial Sequence
  chemically synthesized
tcatatgaaaatcatatgaa

SEQ ID NO: 449581 - DNA, 20 bp, Artificial Sequence
  chemically synthesized
atatgattttcatatgacaa

SEQ ID NO: 449582 - DNA, 20 bp, Artificial Sequence
  chemically synthesized
tcatatgacaaaagctcctt

SEQ ID NO: 449583 - DNA, 20 bp, Artificial Sequence
  chemically synthesized
tatcttttaggttactaaag

SEQ ID NO: 449584 - DNA, 20 bp, Artificial Sequence
  chemically synthesized
aatatcttttaggttactaa

SEQ ID NO: 449585 - DNA, 20 bp, Artificial Sequence
  chemically synthesized
aaatatcttttaggttacta

SEQ ID NO: 449586 - DNA, 20 bp, Artificial Sequence
  chemically synthesized
aagctcctttagtaacctaa

SEQ ID NO: 449587 - DNA, 20 bp, Artificial Sequence
  chemically synthesized
aaatcattcaaatatctttt

SEQ ID NO: 449588 - DNA, 20 bp, Artificial Sequence
  chemically synthesized
aaaatcattcaaatatcttt

SEQ ID NO: 449589 - DNA, 20 bp, Artificial Sequence
  chemically synthesized
aaagatatttgaatgatttt

SEQ ID NO: 449590 - DNA, 20 bp, Artificial Sequence
  chemically synthesized
atttgaatgattttaagaaa

SEQ ID NO: 449591 - DNA, 20 bp, Artificial Sequence
  chemically synthesized
agaaatagtttgacataaaa

SEQ ID NO: 449592 - DNA, 20 bp, Artificial Sequence
  chemically synthesized
atggtgtaattgcacacgtg

SEQ ID NO: 449593 - DNA, 20 bp, Artificial Sequence
  chemically synthesized
aatggtgtaattgcacacgt

SEQ ID NO: 449594 - DNA, 20 bp, Artificial Sequence
  chemically synthesized
taatatataagaaaataaaa

SEQ ID NO: 449595 - DNA, 20 bp, Artificial Sequence
  chemically synthesized
tataaagaaggataatatat

SEQ ID NO: 449596 - DNA, 20 bp, Artificial Sequence
  chemically synthesized
ataatgcacaaatataaaga

SEQ ID NO: 449597 - DNA, 20 bp, Artificial Sequence
  chemically synthesized
aataatgcacaaatataaag

SEQ ID NO: 449598 - DNA, 20 bp, Artificial Sequence
  chemically synthesized
taaaataatgcacaaatata

SEQ ID NO: 449599 - DNA, 20 bp, Artificial Sequence
  chemically synthesized
ttgtgcattattttataatg

SEQ ID NO: 449600 - DNA, 20 bp, Artificial Sequence
  chemically synthesized
gtgcattattttataatgtg

SEQ ID NO: 449601 - DNA, 20 bp, Artificial Sequence
  chemically synthesized
gcattattttataatgtgga

SEQ ID NO: 449602 - DNA, 20 bp, Artificial Sequence
  chemically synthesized
cattattttataatgtggag

SEQ ID NO: 449603 - DNA, 20 bp, Artificial Sequence
  chemically synthesized
aacatataatagatattcaa

SEQ ID NO: 449604 - DNA, 20 bp, Artificial Sequence
  chemically synthesized
gtttatgtgtaaacatataa

SEQ ID NO: 449605 - DNA, 20 bp, Artificial Sequence
  chemically synthesized
tatatgtttacacataaaca

SEQ ID NO: 449606 - DNA, 20 bp, Artificial Sequence
  chemically synthesized
tatgtttacacataaacaca

SEQ ID NO: 449607 - DNA, 20 bp, Artificial Sequence
  chemically synthesized
acataaacacagagaatgca

SEQ ID NO: 449608 - DNA, 20 bp, Artificial Sequence
  chemically synthesized
aaacacagagaatgcacagt

SEQ ID NO: 449609 - DNA, 20 bp, Artificial Sequence
  chemically synthesized
tgcacagtaagtgatatcta

SEQ ID NO: 449610 - DNA, 20 bp, Artificial Sequence
  chemically synthesized
ttactttcaatagagtgcca

SEQ ID NO: 449611 - DNA, 20 bp, Artificial Sequence
  chemically synthesized
tatctatggcactctattga

SEQ ID NO: 449612 - DNA, 20 bp, Artificial Sequence
  chemically synthesized
ccaagaatttactttcaata

SEQ ID NO: 449613 - DNA, 20 bp, Artificial Sequence
  chemically synthesized
caccaagaatttactttcaa

SEQ ID NO: 449614 - DNA, 20 bp, Artificial Sequence
  chemically synthesized
ctctattgaaagtaaattct

SEQ ID NO: 449615 - DNA, 20 bp, Artificial Sequence
  chemically synthesized
atgatcaagagtgttacacc

SEQ ID NO: 449616 - DNA, 20 bp, Artificial Sequence
  chemically synthesized
aaatatctgttcatgatcaa

SEQ ID NO: 449617 - DNA, 20 bp, Artificial Sequence
  chemically synthesized
gtaaatatctgttcatgatc

SEQ ID NO: 449618 - DNA, 20 bp, Artificial Sequence
  chemically synthesized
gtaacactcttgatcatgaa

SEQ ID NO: 449619 - DNA, 20 bp, Artificial Sequence
  chemically synthesized
acagatatttaccaactatc

SEQ ID NO: 449620 - DNA, 20 bp, Artificial Sequence
  chemically synthesized
cttaagtttttcttgatagt

SEQ ID NO: 449621 - DNA, 20 bp, Artificial Sequence
  chemically synthesized
atgtcttaagtttttcttga

SEQ ID NO: 449622 - DNA, 20 bp, Artificial Sequence
  chemically synthesized
ccaactatcaagaaaaactt

SEQ ID NO: 449623 - DNA, 20 bp, Artificial Sequence
  chemically synthesized
tgacatttgctcaatgtctt

SEQ ID NO: 449624 - DNA, 20 bp, Artificial Sequence
  chemically synthesized
caagaaaaacttaagacatt

SEQ ID NO: 449625 - DNA, 20 bp, Artificial Sequence
  chemically synthesized
agacattgagcaaatgtcat

SEQ ID NO: 449626 - DNA, 20 bp, Artificial Sequence
  chemically synthesized
ttgagcaaatgtcattagtt

SEQ ID NO: 449627 - DNA, 20 bp, Artificial Sequence
  chemically synthesized
acttagatttgttaaatatg

SEQ ID NO: 449628 - DNA, 20 bp, Artificial Sequence
  chemically synthesized
cacttagatttgttaaatat

SEQ ID NO: 449629 - DNA, 20 bp, Artificial Sequence
  chemically synthesized
acctcatatttaacaaatct

SEQ ID NO: 449630 - DNA, 20 bp, Artificial Sequence
  chemically synthesized
tcatatttaacaaatctaag

SEQ ID NO: 449631 - DNA, 20 bp, Artificial Sequence
  chemically synthesized
tatttaacaaatctaagtgg

SEQ ID NO: 449632 - DNA, 20 bp, Artificial Sequence
  chemically synthesized
attccccttggacttccact

SEQ ID NO: 449633 - DNA, 20 bp, Artificial Sequence
  chemically synthesized
acaaatctaagtggaagtcc

SEQ ID NO: 449634 - DNA, 20 bp, Artificial Sequence
  chemically synthesized
caaatctaagtggaagtcca

SEQ ID NO: 449635 - DNA, 20 bp, Artificial Sequence
  chemically synthesized
aaatctaagtggaagtccaa

SEQ ID NO: 449636 - DNA, 20 bp, Artificial Sequence
  chemically synthesized
aatctaagtggaagtccaag

SEQ ID NO: 449637 - DNA, 20 bp, Artificial Sequence
  chemically synthesized
tgtttatttggaattcccct

SEQ ID NO: 449638 - DNA, 20 bp, Artificial Sequence
  chemically synthesized
gtataacagtgatgtttatt

SEQ ID NO: 449639 - DNA, 20 bp, Artificial Sequence
  chemically synthesized
attgactacattcagtataa

SEQ ID NO: 449640 - DNA, 20 bp, Artificial Sequence
  chemically synthesized
catcactgttatactgaatg

SEQ ID NO: 449641 - DNA, 20 bp, Artificial Sequence
  chemically synthesized
aattctctattgactacatt

SEQ ID NO: 449642 - DNA, 20 bp, Artificial Sequence
  chemically synthesized
gttatactgaatgtagtcaa

SEQ ID NO: 449643 - DNA, 20 bp, Artificial Sequence
  chemically synthesized
tatactgaatgtagtcaata

SEQ ID NO: 449644 - DNA, 20 bp, Artificial Sequence
  chemically synthesized
atagagaattattatatcat

SEQ ID NO: 449645 - DNA, 20 bp, Artificial Sequence
  chemically synthesized
agagaattattatatcattg

SEQ ID NO: 449646 - DNA, 20 bp, Artificial Sequence
  chemically synthesized
acatttatttagaaatgtaa

SEQ ID NO: 449647 - DNA, 20 bp, Artificial Sequence
  chemically synthesized
aagcacttcccacatttatt

SEQ ID NO: 449648 - DNA, 20 bp, Artificial Sequence
  chemically synthesized
attacatttctaaataaatg

SEQ ID NO: 449649 - DNA, 20 bp, Artificial Sequence
  chemically synthesized
ttacatttctaaataaatgt

SEQ ID NO: 449650 - DNA, 20 bp, Artificial Sequence
  chemically synthesized
catttctaaataaatgtggg

SEQ ID NO: 449651 - DNA, 20 bp, Artificial Sequence
  chemically synthesized
gtgggaagtgctttttatcc

SEQ ID NO: 449652 - DNA, 20 bp, Artificial Sequence
  chemically synthesized
gttattccgtctgggataaa

SEQ ID NO: 449653 - DNA, 20 bp, Artificial Sequence
  chemically synthesized
gaagtgctttttatcccaga

SEQ ID NO: 449654 - DNA, 20 bp, Artificial Sequence
  chemically synthesized
ttagcattgttattccgtct

SEQ ID NO: 449655 - DNA, 20 bp, Artificial Sequence
  chemically synthesized
tttagcattgttattccgtc

SEQ ID NO: 449656 - DNA, 20 bp, Artificial Sequence
  chemically synthesized
cagacggaataacaatgcta

SEQ ID NO: 449657 - DNA, 20 bp, Artificial Sequence
  chemically synthesized
agacggaataacaatgctaa

SEQ ID NO: 449658 - DNA, 20 bp, Artificial Sequence
  chemically synthesized
acggaataacaatgctaaag

SEQ ID NO: 449659 - DNA, 20 bp, Artificial Sequence
  chemically synthesized
atacggatgacaatctcctt

SEQ ID NO: 449660 - DNA, 20 bp, Artificial Sequence
  chemically synthesized
agattgtcatccgtatttta

SEQ ID NO: 449661 - DNA, 20 bp, Artificial Sequence
  chemically synthesized
agtacctttcctataaaata

SEQ ID NO: 449662 - DNA, 20 bp, Artificial Sequence
  chemically synthesized
gattgtcatccgtattttat

SEQ ID NO: 449663 - DNA, 20 bp, Artificial Sequence
  chemically synthesized
gtcatccgtattttatagga

SEQ ID NO: 449664 - DNA, 20 bp, Artificial Sequence
  chemically synthesized
tcatccgtattttataggaa

SEQ ID NO: 449665 - DNA, 20 bp, Artificial Sequence
  chemically synthesized
attttataggaaaggtactc

SEQ ID NO: 449666 - DNA, 20 bp, Artificial Sequence
  chemically synthesized
tagcaacataaacatttctg

SEQ ID NO: 449667 - DNA, 20 bp, Artificial Sequence
  chemically synthesized
gttagcaacataaacatttc

SEQ ID NO: 449668 - DNA, 20 bp, Artificial Sequence
  chemically synthesized
atattagtaaatttgattgt

SEQ ID NO: 449669 - DNA, 20 bp, Artificial Sequence
  chemically synthesized
acaatcaaatttactaatat

SEQ ID NO: 449670 - DNA, 20 bp, Artificial Sequence
  chemically synthesized
tggtcaagtttgactaatat

SEQ ID NO: 449671 - DNA, 20 bp, Artificial Sequence
  chemically synthesized
taaatccgatttatatggtc

SEQ ID NO: 449672 - DNA, 20 bp, Artificial Sequence
  chemically synthesized
tcaaacttgaccatataaat

SEQ ID NO: 449673 - DNA, 20 bp, Artificial Sequence
  chemically synthesized
ttatataaatccgatttata

SEQ ID NO: 449674 - DNA, 20 bp, Artificial Sequence
  chemically synthesized
gaagttagaattttaagata

SEQ ID NO: 449675 - DNA, 20 bp, Artificial Sequence
  chemically synthesized
tgttaagaagttagaatttt

SEQ ID NO: 449676 - DNA, 20 bp, Artificial Sequence
  chemically synthesized
agtggtatttgttaagaagt

SEQ ID NO: 449677 - DNA, 20 bp, Artificial Sequence
  chemically synthesized
atcaagtggtatttgttaag

SEQ ID NO: 449678 - DNA, 20 bp, Artificial Sequence
  chemically synthesized
ataatcaagtggtatttgtt

SEQ ID NO: 449679 - DNA, 20 bp, Artificial Sequence
  chemically synthesized
atggttttaaaataatcaag

SEQ ID NO: 449680 - DNA, 20 bp, Artificial Sequence
  chemically synthesized
tctatggttttaaaataatc

SEQ ID NO: 449681 - DNA, 20 bp, Artificial Sequence
  chemically synthesized
acttgattattttaaaacca

SEQ ID NO: 449682 - DNA, 20 bp, Artificial Sequence
  chemically synthesized
ctcagtgttcttttcatcta

SEQ ID NO: 449683 - DNA, 20 bp, Artificial Sequence
  chemically synthesized
attttaaaaccatagatgaa

SEQ ID NO: 449684 - DNA, 20 bp, Artificial Sequence
  chemically synthesized
ccatagatgaaaagaacact

SEQ ID NO: 449685 - DNA, 20 bp, Artificial Sequence
  chemically synthesized
atagatgaaaagaacactga

SEQ ID NO: 449686 - DNA, 20 bp, Artificial Sequence
  chemically synthesized
tagatgaaaagaacactgag

SEQ ID NO: 449687 - DNA, 20 bp, Artificial Sequence
  chemically synthesized
agatgaaaagaacactgaga

SEQ ID NO: 449688 - DNA, 20 bp, Artificial Sequence
  chemically synthesized
atgaaaagaacactgagagg

SEQ ID NO: 449689 - DNA, 20 bp, Artificial Sequence
  chemically synthesized
tgaaaagaacactgagaggg

SEQ ID NO: 449690 - DNA, 20 bp, Artificial Sequence
  chemically synthesized
ctgcttctaaacctccctct

SEQ ID NO: 449691 - DNA, 20 bp, Artificial Sequence
  chemically synthesized
agaacactgagagggaggtt

SEQ ID NO: 449692 - DNA, 20 bp, Artificial Sequence
  chemically synthesized
acactgagagggaggtttag

SEQ ID NO: 449693 - DNA, 20 bp, Artificial Sequence
  chemically synthesized
ctgagagggaggtttagaag

SEQ ID NO: 449694 - DNA, 20 bp, Artificial Sequence
  chemically synthesized
tgagagggaggtttagaagc

SEQ ID NO: 449695 - DNA, 20 bp, Artificial Sequence
  chemically synthesized
ccaaggctttgcagttattg

SEQ ID NO: 449696 - DNA, 20 bp, Artificial Sequence
  chemically synthesized
ttgatgcttcaataactgca

SEQ ID NO: 449697 - DNA, 20 bp, Artificial Sequence
  chemically synthesized
gtgaattgtccaaggctttg

SEQ ID NO: 449698 - DNA, 20 bp, Artificial Sequence
  chemically synthesized
cttcaataactgcaaagcct

SEQ ID NO: 449699 - DNA, 20 bp, Artificial Sequence
  chemically synthesized
acacagaggtgaattgtcca

SEQ ID NO: 449700 - DNA, 20 bp, Artificial Sequence
  chemically synthesized
aacacagaggtgaattgtcc

SEQ ID NO: 449701 - DNA, 20 bp, Artificial Sequence
  chemically synthesized
tgaaatctggggaaacacag

SEQ ID NO: 449702 - DNA, 20 bp, Artificial Sequence
  chemically synthesized
atgaaatctggggaaacaca

SEQ ID NO: 449703 - DNA, 20 bp, Artificial Sequence
  chemically synthesized
atatgaaatctggggaaaca

SEQ ID NO: 449704 - DNA, 20 bp, Artificial Sequence
  chemically synthesized
aattcacctctgtgtttccc

SEQ ID NO: 449705 - DNA, 20 bp, Artificial Sequence
  chemically synthesized
gtttacagatatgaaatctg

SEQ ID NO: 449706 - DNA, 20 bp, Artificial Sequence
  chemically synthesized
tgtttacagatatgaaatct

SEQ ID NO: 449707 - DNA, 20 bp, Artificial Sequence
  chemically synthesized
ctgtttacagatatgaaatc

SEQ ID NO: 449708 - DNA, 20 bp, Artificial Sequence
  chemically synthesized
ccagatttcatatctgtaaa

SEQ ID NO: 449709 - DNA, 20 bp, Artificial Sequence
  chemically synthesized
gagatcatctagtctgttta

SEQ ID NO: 449710 - DNA, 20 bp, Artificial Sequence
  chemically synthesized
tttcatatctgtaaacagac

SEQ ID NO: 449711 - DNA, 20 bp, Artificial Sequence
  chemically synthesized
aattcttttgagagatcatc

SEQ ID NO: 449712 - DNA, 20 bp, Artificial Sequence
  chemically synthesized
cagactagatgatctctcaa

SEQ ID NO: 449713 - DNA, 20 bp, Artificial Sequence
  chemically synthesized
tagatgtggaattcttttga

SEQ ID NO: 449714 - DNA, 20 bp, Artificial Sequence
  chemically synthesized
tttagatgtggaattctttt

SEQ ID NO: 449715 - DNA, 20 bp, Artificial Sequence
  chemically synthesized
gaaaaagagagttttagatg

SEQ ID NO: 449716 - DNA, 20 bp, Artificial Sequence
  chemically synthesized
gacacagaaaaagagagttt

SEQ ID NO: 449717 - DNA, 20 bp, Artificial Sequence
  chemically synthesized
aggcaggacacagaaaaaga

SEQ ID NO: 449718 - DNA, 20 bp, Artificial Sequence
  chemically synthesized
aaaggcaggacacagaaaaa

SEQ ID NO: 449719 - DNA, 20 bp, Artificial Sequence
  chemically synthesized
tgaaaggcaggacacagaaa

SEQ ID NO: 449720 - DNA, 20 bp, Artificial Sequence
  chemically synthesized
aaatactgaaaggcaggaca

SEQ ID NO: 449721 - DNA, 20 bp, Artificial Sequence
  chemically synthesized
tttttctgtgtcctgccttt

SEQ ID NO: 449722 - DNA, 20 bp, Artificial Sequence
  chemically synthesized
aaggaaaaatactgaaaggc

SEQ ID NO: 449723 - DNA, 20 bp, Artificial Sequence
  chemically synthesized
aaaggaaaaatactgaaagg

SEQ ID NO: 449724 - DNA, 20 bp, Artificial Sequence
  chemically synthesized
attaaaggaaaaatactgaa

SEQ ID NO: 449725 - DNA, 20 bp, Artificial Sequence
  chemically synthesized
aattaaaggaaaaatactga

SEQ ID NO: 449726 - DNA, 20 bp, Artificial Sequence
  chemically synthesized
aaaataaatgattcaattaa

SEQ ID NO: 449727 - DNA, 20 bp, Artificial Sequence
  chemically synthesized
gaaaataaatgattcaatta

SEQ ID NO: 449728 - DNA, 20 bp, Artificial Sequence
  chemically synthesized
agcattgcataagatcaaag

SEQ ID NO: 449729 - DNA, 20 bp, Artificial Sequence
  chemically synthesized
tgtagcattgcataagatca

SEQ ID NO: 449730 - DNA, 20 bp, Artificial Sequence
  chemically synthesized
tttttattgtagcattgcat

SEQ ID NO: 449731 - DNA, 20 bp, Artificial Sequence
  chemically synthesized
ctttgtttttgtttttattg

SEQ ID NO: 449732 - DNA, 20 bp, Artificial Sequence
  chemically synthesized
ctacaataaaaacaaaaaca

SEQ ID NO: 449733 - DNA, 20 bp, Artificial Sequence
  chemically synthesized
aatgtgatattttatcaaat

SEQ ID NO: 449734 - DNA, 20 bp, Artificial Sequence
  chemically synthesized
taaaatatcacattctctat

SEQ ID NO: 449735 - DNA, 20 bp, Artificial Sequence
  chemically synthesized
gataacaaaaatcactaata

SEQ ID NO: 449736 - DNA, 20 bp, Artificial Sequence
  chemically synthesized
cagataacaaaaatcactaa

SEQ ID NO: 449737 - DNA, 20 bp, Artificial Sequence
  chemically synthesized
attagtgatttttgttatct

SEQ ID NO: 449738 - DNA, 20 bp, Artificial Sequence
  chemically synthesized
caaccacttttgtaacagct

SEQ ID NO: 449739 - DNA, 20 bp, Artificial Sequence
  chemically synthesized
tgttatctgagctgttacaa

SEQ ID NO: 449740 - DNA, 20 bp, Artificial Sequence
  chemically synthesized
aaatccaaccacttttgtaa

SEQ ID NO: 449741 - DNA, 20 bp, Artificial Sequence
  chemically synthesized
tatctgagctgttacaaaag

SEQ ID NO: 449742 - DNA, 20 bp, Artificial Sequence
  chemically synthesized
tgagctgttacaaaagtggt

SEQ ID NO: 449743 - DNA, 20 bp, Artificial Sequence
  chemically synthesized
gttggatttattccacaaat

SEQ ID NO: 449744 - DNA, 20 bp, Artificial Sequence
  chemically synthesized
ttggatttattccacaaatt

SEQ ID NO: 449745 - DNA, 20 bp, Artificial Sequence
  chemically synthesized
ggtatggatggcctaatttg

SEQ ID NO: 449746 - DNA, 20 bp, Artificial Sequence
  chemically synthesized
tacagaaaggcaggtatgga

SEQ ID NO: 449747 - DNA, 20 bp, Artificial Sequence
  chemically synthesized
tgattacagaaaggcaggta

SEQ ID NO: 449748 - DNA, 20 bp, Artificial Sequence
  chemically synthesized
gcatatgattacagaaaggc

SEQ ID NO: 449749 - DNA, 20 bp, Artificial Sequence
  chemically synthesized
tgcatatgattacagaaagg

SEQ ID NO: 449750 - DNA, 20 bp, Artificial Sequence
  chemically synthesized
tcatgcatatgattacagaa

SEQ ID NO: 449751 - DNA, 20 bp, Artificial Sequence
  chemically synthesized
ttcatgcatatgattacaga

SEQ ID NO: 449752 - DNA, 20 bp, Artificial Sequence
  chemically synthesized
tttcttcatgcatatgatta

SEQ ID NO: 449753 - DNA, 20 bp, Artificial Sequence
  chemically synthesized
tttctgtaatcatatgcatg

SEQ ID NO: 449754 - DNA, 20 bp, Artificial Sequence
  chemically synthesized
tgtaatcatatgcatgaaga

SEQ ID NO: 449755 - DNA, 20 bp, Artificial Sequence
  chemically synthesized
agactcctacacaagttgtg

SEQ ID NO: 449756 - DNA, 20 bp, Artificial Sequence
  chemically synthesized
gaaaaacttcacaacttgtg

SEQ ID NO: 449757 - DNA, 20 bp, Artificial Sequence
  chemically synthesized
aaaaacttcacaacttgtgt

SEQ ID NO: 449758 - DNA, 20 bp, Artificial Sequence
  chemically synthesized
aaacttcacaacttgtgtag

SEQ ID NO: 449759 - DNA, 20 bp, Artificial Sequence
  chemically synthesized
gaaaaattagactcctacac

SEQ ID NO: 449760 - DNA, 20 bp, Artificial Sequence
  chemically synthesized
tcaatactaaattgaaaaat

SEQ ID NO: 449761 - DNA, 20 bp, Artificial Sequence
  chemically synthesized
aggagtctaatttttcaatt

SEQ ID NO: 449762 - DNA, 20 bp, Artificial Sequence
  chemically synthesized
atttttcaatttagtattga

SEQ ID NO: 449763 - DNA, 20 bp, Artificial Sequence
  chemically synthesized
tagtattgacagtctgacca

SEQ ID NO: 449764 - DNA, 20 bp, Artificial Sequence
  chemically synthesized
agtattgacagtctgaccat

SEQ ID NO: 449765 - DNA, 20 bp, Artificial Sequence
  chemically synthesized
ctttcactcaaacccatggt

SEQ ID NO: 449766 - DNA, 20 bp, Artificial Sequence
  chemically synthesized
gacagtctgaccatgggttt

SEQ ID NO: 449767 - DNA, 20 bp, Artificial Sequence
  chemically synthesized
taaactttcactcaaaccca

SEQ ID NO: 449768 - DNA, 20 bp, Artificial Sequence
  chemically synthesized
ctgaccatgggtttgagtga

SEQ ID NO: 449769 - DNA, 20 bp, Artificial Sequence
  chemically synthesized
catgggtttgagtgaaagtt

SEQ ID NO: 449770 - DNA, 20 bp, Artificial Sequence
  chemically synthesized
gagtgaaagtttagattttg

SEQ ID NO: 449771 - DNA, 20 bp, Artificial Sequence
  chemically synthesized
tttagattttgtagatactt

SEQ ID NO: 449772 - DNA, 20 bp, Artificial Sequence
  chemically synthesized
ttgagattatcaggaaacca

SEQ ID NO: 449773 - DNA, 20 bp, Artificial Sequence
  chemically synthesized
actgagcttttgagattatc

SEQ ID NO: 449774 - DNA, 20 bp, Artificial Sequence
  chemically synthesized
aactgagcttttgagattat

SEQ ID NO: 449775 - DNA, 20 bp, Artificial Sequence
  chemically synthesized
tggtttcctgataatctcaa

SEQ ID NO: 449776 - DNA, 20 bp, Artificial Sequence
  chemically synthesized
tcctgataatctcaaaagct

SEQ ID NO: 449777 - DNA, 20 bp, Artificial Sequence
  chemically synthesized
taaagtataactgagctttt

SEQ ID NO: 449778 - DNA, 20 bp, Artificial Sequence
  chemically synthesized
aaatattataaagtataact

SEQ ID NO: 449779 - DNA, 20 bp, Artificial Sequence
  chemically synthesized
ttgtaaacataaatattata

SEQ ID NO: 449780 - DNA, 20 bp, Artificial Sequence
  chemically synthesized
taatatttatgtttacaatc

SEQ ID NO: 449781 - DNA, 20 bp, Artificial Sequence
  chemically synthesized
atttatgtttacaatcaaga

SEQ ID NO: 449782 - DNA, 20 bp, Artificial Sequence
  chemically synthesized
ttattatagaaatatatgta

SEQ ID NO: 449783 - DNA, 20 bp, Artificial Sequence
  chemically synthesized
tttacatatatttctataat

SEQ ID NO: 449784 - DNA, 20 bp, Artificial Sequence
  chemically synthesized
ataatatttatagcttatta

SEQ ID NO: 449785 - DNA, 20 bp, Artificial Sequence
  chemically synthesized
agagaaggtgataatattta

SEQ ID NO: 449786 - DNA, 20 bp, Artificial Sequence
  chemically synthesized
ataattagacaattcagaga

SEQ ID NO: 449787 - DNA, 20 bp, Artificial Sequence
  chemically synthesized
aataattagacaattcagag

SEQ ID NO: 449788 - DNA, 20 bp, Artificial Sequence
  chemically synthesized
gacaataattagacaattca

SEQ ID NO: 449789 - DNA, 20 bp, Artificial Sequence
  chemically synthesized
aggacaataattagacaatt

SEQ ID NO: 449790 - DNA, 20 bp, Artificial Sequence
  chemically synthesized
ctatgcagaaggacaataat

SEQ ID NO: 449791 - DNA, 20 bp, Artificial Sequence
  chemically synthesized
ctaattattgtccttctgca

SEQ ID NO: 449792 - DNA, 20 bp, Artificial Sequence
  chemically synthesized
tgctagcttgtctatgcaga

SEQ ID NO: 449793 - DNA, 20 bp, Artificial Sequence
  chemically synthesized
atgctagcttgtctatgcag

SEQ ID NO: 449794 - DNA, 20 bp, Artificial Sequence
  chemically synthesized
tattgtccttctgcatagac

SEQ ID NO: 449795 - DNA, 20 bp, Artificial Sequence
  chemically synthesized
agcatgctagcttgtctatg

SEQ ID NO: 449796 - DNA, 20 bp, Artificial Sequence
  chemically synthesized
gtccttctgcatagacaagc

SEQ ID NO: 449797 - DNA, 20 bp, Artificial Sequence
  chemically synthesized
ccatatgatgtatagcatgc

SEQ ID NO: 449798 - DNA, 20 bp, Artificial Sequence
  chemically synthesized
ggctttatccatatgatgta

SEQ ID NO: 449799 - DNA, 20 bp, Artificial Sequence
  chemically synthesized
ctagcatgctatacatcata

SEQ ID NO: 449800 - DNA, 20 bp, Artificial Sequence
  chemically synthesized
tgctatacatcatatggata

SEQ ID NO: 449801 - DNA, 20 bp, Artificial Sequence
  chemically synthesized
attatctggcaagaaatttg

SEQ ID NO: 449802 - DNA, 20 bp, Artificial Sequence
  chemically synthesized
taaagccacaaatttcttgc

SEQ ID NO: 449803 - DNA, 20 bp, Artificial Sequence
  chemically synthesized
ctagttcaaaattatctggc

SEQ ID NO: 449804 - DNA, 20 bp, Artificial Sequence
  chemically synthesized
gaaactagttcaaaattatc

SEQ ID NO: 449805 - DNA, 20 bp, Artificial Sequence
  chemically synthesized
cttgccagataattttgaac

SEQ ID NO: 449806 - DNA, 20 bp, Artificial Sequence
  chemically synthesized
tatttgctaatatttgaaac

SEQ ID NO: 449807 - DNA, 20 bp, Artificial Sequence
  chemically synthesized
tttgaactagtttcaaatat

SEQ ID NO: 449808 - DNA, 20 bp, Artificial Sequence
  chemically synthesized
tcaaatattagcaaatatat

SEQ ID NO: 449809 - DNA, 20 bp, Artificial Sequence
  chemically synthesized
caaatattagcaaatatatt

SEQ ID NO: 449810 - DNA, 20 bp, Artificial Sequence
  chemically synthesized
aaatattagcaaatatatta

SEQ ID NO: 449811 - DNA, 20 bp, Artificial Sequence
  chemically synthesized
caatttcatgtcaaaacatt

SEQ ID NO: 449812 - DNA, 20 bp, Artificial Sequence
  chemically synthesized
tttcatgtcaaaacattgag

SEQ ID NO: 449813 - DNA, 20 bp, Artificial Sequence
  chemically synthesized
tgagtagtcatgatataata

SEQ ID NO: 449814 - DNA, 20 bp, Artificial Sequence
  chemically synthesized
catgatataataaagtataa

SEQ ID NO: 449815 - DNA, 20 bp, Artificial Sequence
  chemically synthesized
aatactaatttttaaacatt

SEQ ID NO: 449816 - DNA, 20 bp, Artificial Sequence
  chemically synthesized
gaatactaatttttaaacat

SEQ ID NO: 449817 - DNA, 20 bp, Artificial Sequence
  chemically synthesized
aattcctaatgtttaaaaat

SEQ ID NO: 449818 - DNA, 20 bp, Artificial Sequence
  chemically synthesized
gtttaaaaattagtattcaa

SEQ ID NO: 449819 - DNA, 20 bp, Artificial Sequence
  chemically synthesized
aaattagtattcaacagtca

SEQ ID NO: 449820 - DNA, 20 bp, Artificial Sequence
  chemically synthesized
tagtattcaacagtcacaga

SEQ ID NO: 449821 - DNA, 20 bp, Artificial Sequence
  chemically synthesized
gtattcaacagtcacagaaa

SEQ ID NO: 449822 - DNA, 20 bp, Artificial Sequence
  chemically synthesized
tattcaacagtcacagaaag

SEQ ID NO: 449823 - DNA, 20 bp, Artificial Sequence
  chemically synthesized
agaaagaggaaattatgctt

SEQ ID NO: 449824 - DNA, 20 bp, Artificial Sequence
  chemically synthesized
atggtgttaccatcaaacta

SEQ ID NO: 449825 - DNA, 20 bp, Artificial Sequence
  chemically synthesized
gaaattatgctttagtttga

SEQ ID NO: 449826 - DNA, 20 bp, Artificial Sequence
  chemically synthesized
gtttgatggtaacaccatcc

SEQ ID NO: 449827 - DNA, 20 bp, Artificial Sequence
  chemically synthesized
aaccatgcttgacgctagga

SEQ ID NO: 449828 - DNA, 20 bp, Artificial Sequence
  chemically synthesized
ggtaacaccatcctagcgtc

SEQ ID NO: 449829 - DNA, 20 bp, Artificial Sequence
  chemically synthesized
atgtaaccatgcttgacgct

SEQ ID NO: 449830 - DNA, 20 bp, Artificial Sequence
  chemically synthesized
aatgtaaccatgcttgacgc

SEQ ID NO: 449831 - DNA, 20 bp, Artificial Sequence
  chemically synthesized
caccatcctagcgtcaagca

SEQ ID NO: 449832 - DNA, 20 bp, Artificial Sequence
  chemically synthesized
ttttctaggaaaaatattaa

SEQ ID NO: 449833 - DNA, 20 bp, Artificial Sequence
  chemically synthesized
gcttttctaggaaaaatatt

SEQ ID NO: 449834 - DNA, 20 bp, Artificial Sequence
  chemically synthesized
atttctcttaatatttttcc

SEQ ID NO: 449835 - DNA, 20 bp, Artificial Sequence
  chemically synthesized
tcttaatatttttcctagaa

SEQ ID NO: 449836 - DNA, 20 bp, Artificial Sequence
  chemically synthesized
gctagaagccacgcttttct

SEQ ID NO: 449837 - DNA, 20 bp, Artificial Sequence
  chemically synthesized
agctagaagccacgcttttc

SEQ ID NO: 449838 - DNA, 20 bp, Artificial Sequence
  chemically synthesized
atatttttcctagaaaagcg

SEQ ID NO: 449839 - DNA, 20 bp, Artificial Sequence
  chemically synthesized
tcctagaaaagcgtggcttc

SEQ ID NO: 449840 - DNA, 20 bp, Artificial Sequence
  chemically synthesized
gtattaatcaaataagctag

SEQ ID NO: 449841 - DNA, 20 bp, Artificial Sequence
  chemically synthesized
tttgtattaatcaaataagc

SEQ ID NO: 449842 - DNA, 20 bp, Artificial Sequence
  chemically synthesized
aggatttgtattaatcaaat

SEQ ID NO: 449843 - DNA, 20 bp, Artificial Sequence
  chemically synthesized
acagaataaaaagattttga

SEQ ID NO: 449844 - DNA, 20 bp, Artificial Sequence
  chemically synthesized
aacagaataaaaagattttg

SEQ ID NO: 449845 - DNA, 20 bp, Artificial Sequence
  chemically synthesized
tcatcctagaacagaataaa

SEQ ID NO: 449846 - DNA, 20 bp, Artificial Sequence
  chemically synthesized
aaaatctttttattctgttc

SEQ ID NO: 449847 - DNA, 20 bp, Artificial Sequence
  chemically synthesized
aaatctttttattctgttct

SEQ ID NO: 449848 - DNA, 20 bp, Artificial Sequence
  chemically synthesized
tatttcctctcatcctagaa

SEQ ID NO: 449849 - DNA, 20 bp, Artificial Sequence
  chemically synthesized
tttttattctgttctaggat

SEQ ID NO: 449850 - DNA, 20 bp, Artificial Sequence
  chemically synthesized
tttattctgttctaggatga

SEQ ID NO: 449851 - DNA, 20 bp, Artificial Sequence
  chemically synthesized
ttattctgttctaggatgag

SEQ ID NO: 449852 - DNA, 20 bp, Artificial Sequence
  chemically synthesized
tgttatatttcctctcatcc

SEQ ID NO: 449853 - DNA, 20 bp, Artificial Sequence
  chemically synthesized
tttaaatcaagattaatgta

SEQ ID NO: 449854 - DNA, 20 bp, Artificial Sequence
  chemically synthesized
gtaggtttctattttaaatc

SEQ ID NO: 449855 - DNA, 20 bp, Artificial Sequence
  chemically synthesized
acattaatcttgatttaaaa

SEQ ID NO: 449856 - DNA, 20 bp, Artificial Sequence
  chemically synthesized
tacattctcggttgaaaagt

SEQ ID NO: 449857 - DNA, 20 bp, Artificial Sequence
  chemically synthesized
gtacattctcggttgaaaag

SEQ ID NO: 449858 - DNA, 20 bp, Artificial Sequence
  chemically synthesized
tagaaacctacttttcaacc

SEQ ID NO: 449859 - DNA, 20 bp, Artificial Sequence
  chemically synthesized
ggtgtacattctcggttgaa

SEQ ID NO: 449860 - DNA, 20 bp, Artificial Sequence
  chemically synthesized
agatgacaggtgtacattct

SEQ ID NO: 449861 - DNA, 20 bp, Artificial Sequence
  chemically synthesized
ataccttcttttgagatgac

SEQ ID NO: 449862 - DNA, 20 bp, Artificial Sequence
  chemically synthesized
tataccttcttttgagatga

SEQ ID NO: 449863 - DNA, 20 bp, Artificial Sequence
  chemically synthesized
atgtacacctgtcatctcaa

SEQ ID NO: 449864 - DNA, 20 bp, Artificial Sequence
  chemically synthesized
tacacctgtcatctcaaaag

SEQ ID NO: 449865 - DNA, 20 bp, Artificial Sequence
  chemically synthesized
acacctgtcatctcaaaaga

SEQ ID NO: 449866 - DNA, 20 bp, Artificial Sequence
  chemically synthesized
atgtaaatataccttctttt

SEQ ID NO: 449867 - DNA, 20 bp, Artificial Sequence
  chemically synthesized
tacatattaattttatattt

SEQ ID NO: 449868 - DNA, 20 bp, Artificial Sequence
  chemically synthesized
gttcaggtgaaacaaaaaat

SEQ ID NO: 449869 - DNA, 20 bp, Artificial Sequence
  chemically synthesized
ctctaactacatgttagttc

SEQ ID NO: 449870 - DNA, 20 bp, Artificial Sequence
  chemically synthesized
tctctaactacatgttagtt

SEQ ID NO: 449871 - DNA, 20 bp, Artificial Sequence
  chemically synthesized
gtttcacctgaactaacatg

SEQ ID NO: 449872 - DNA, 20 bp, Artificial Sequence
  chemically synthesized
gtatttctctaactacatgt

SEQ ID NO: 449873 - DNA, 20 bp, Artificial Sequence
  chemically synthesized
cacctgaactaacatgtagt

SEQ ID NO: 449874 - DNA, 20 bp, Artificial Sequence
  chemically synthesized
cctgaactaacatgtagtta

SEQ ID NO: 449875 - DNA, 20 bp, Artificial Sequence
  chemically synthesized
gtagttagagaaatacattt

SEQ ID NO: 449876 - DNA, 20 bp, Artificial Sequence
  chemically synthesized
tacattttagaaaaaattaa

SEQ ID NO: 449877 - DNA, 20 bp, Artificial Sequence
  chemically synthesized
ttttagaaaaaattaatagt

SEQ ID NO: 449878 - DNA, 20 bp, Artificial Sequence
  chemically synthesized
tagagtgaattattttgagt

SEQ ID NO: 449879 - DNA, 20 bp, Artificial Sequence
  chemically synthesized
aatctagagtgaattatttt

SEQ ID NO: 449880 - DNA, 20 bp, Artificial Sequence
  chemically synthesized
ttactcaaaataattcactc

SEQ ID NO: 449881 - DNA, 20 bp, Artificial Sequence
  chemically synthesized
ttaataattgagaaaatcta

SEQ ID NO: 449882 - DNA, 20 bp, Artificial Sequence
  chemically synthesized
atttaataattgagaaaatc

SEQ ID NO: 449883 - DNA, 20 bp, Artificial Sequence
  chemically synthesized
gcacttgccatttaataatt

SEQ ID NO: 449884 - DNA, 20 bp, Artificial Sequence
  chemically synthesized
agattttctcaattattaaa

SEQ ID NO: 449885 - DNA, 20 bp, Artificial Sequence
  chemically synthesized
tttctcaattattaaatggc

SEQ ID NO: 449886 - DNA, 20 bp, Artificial Sequence
  chemically synthesized
agtgcaatgtttcttcttta

SEQ ID NO: 449887 - DNA, 20 bp, Artificial Sequence
  chemically synthesized
aatatcataatactgtaaag

SEQ ID NO: 449888 - DNA, 20 bp, Artificial Sequence
  chemically synthesized
aacaatatcataatactgta

SEQ ID NO: 449889 - DNA, 20 bp, Artificial Sequence
  chemically synthesized
attatgatattgttactatg

SEQ ID NO: 449890 - DNA, 20 bp, Artificial Sequence
  chemically synthesized
aaaatgaatagtggtctgca

SEQ ID NO: 449891 - DNA, 20 bp, Artificial Sequence
  chemically synthesized
gtaacaggaaaaatgaatag

SEQ ID NO: 449892 - DNA, 20 bp, Artificial Sequence
  chemically synthesized
gaagtaacaggaaaaatgaa

SEQ ID NO: 449893 - DNA, 20 bp, Artificial Sequence
  chemically synthesized
actcagttataggaagtaac

SEQ ID NO: 449894 - DNA, 20 bp, Artificial Sequence
  chemically synthesized
aactcagttataggaagtaa

SEQ ID NO: 449895 - DNA, 20 bp, Artificial Sequence
  chemically synthesized
agaagaaactcagttatagg

SEQ ID NO: 449896 - DNA, 20 bp, Artificial Sequence
  chemically synthesized
tcctgttacttcctataact

SEQ ID NO: 449897 - DNA, 20 bp, Artificial Sequence
  chemically synthesized
taaagaagaaactcagttat

SEQ ID NO: 449898 - DNA, 20 bp, Artificial Sequence
  chemically synthesized
ctaaagaagaaactcagtta

SEQ ID NO: 449899 - DNA, 20 bp, Artificial Sequence
  chemically synthesized
ttaatactaaagaagaaact

SEQ ID NO: 449900 - DNA, 20 bp, Artificial Sequence
  chemically synthesized
ctataactgagtttcttctt

SEQ ID NO: 449901 - DNA, 20 bp, Artificial Sequence
  chemically synthesized
gcattttattaatactaaag

SEQ ID NO: 449902 - DNA, 20 bp, Artificial Sequence
  chemically synthesized
gttgcattttattaatacta

SEQ ID NO: 449903 - DNA, 20 bp, Artificial Sequence
  chemically synthesized
acaaaggggctgaagagata

SEQ ID NO: 449904 - DNA, 20 bp, Artificial Sequence
  chemically synthesized
atgcaacatctatatctctt

SEQ ID NO: 449905 - DNA, 20 bp, Artificial Sequence
  chemically synthesized
acgtttacaaaggggctgaa

SEQ ID NO: 449906 - DNA, 20 bp, Artificial Sequence
  chemically synthesized
acacgtttacaaaggggctg

SEQ ID NO: 449907 - DNA, 20 bp, Artificial Sequence
  chemically synthesized
tccgttacacgtttacaaag

SEQ ID NO: 449908 - DNA, 20 bp, Artificial Sequence
  chemically synthesized
ctccgttacacgtttacaaa

SEQ ID NO: 449909 - DNA, 20 bp, Artificial Sequence
  chemically synthesized
actccgttacacgtttacaa

SEQ ID NO: 449910 - DNA, 20 bp, Artificial Sequence
  chemically synthesized
tactccgttacacgtttaca

SEQ ID NO: 449911 - DNA, 20 bp, Artificial Sequence
  chemically synthesized
gcccctttgtaaacgtgtaa

SEQ ID NO: 449912 - DNA, 20 bp, Artificial Sequence
  chemically synthesized
ccctttgtaaacgtgtaacg

SEQ ID NO: 449913 - DNA, 20 bp, Artificial Sequence
  chemically synthesized
aatggtgactagaattgttc

SEQ ID NO: 449914 - DNA, 20 bp, Artificial Sequence
  chemically synthesized
taacacatcttgaacaattc

SEQ ID NO: 449915 - DNA, 20 bp, Artificial Sequence
  chemically synthesized
acatatcgtaaaatggtgac

SEQ ID NO: 449916 - DNA, 20 bp, Artificial Sequence
  chemically synthesized
tttttgcacatatcgtaaaa

SEQ ID NO: 449917 - DNA, 20 bp, Artificial Sequence
  chemically synthesized
ttacgatatgtgcaaaaatt

SEQ ID NO: 449918 - DNA, 20 bp, Artificial Sequence
  chemically synthesized
tacgatatgtgcaaaaattc

SEQ ID NO: 449919 - DNA, 20 bp, Artificial Sequence
  chemically synthesized
acgatatgtgcaaaaattca

SEQ ID NO: 449920 - DNA, 20 bp, Artificial Sequence
  chemically synthesized
tgcaaaaattcagggactgt

SEQ ID NO: 449921 - DNA, 20 bp, Artificial Sequence
  chemically synthesized
ttgtaggtaggttatactta

SEQ ID NO: 449922 - DNA, 20 bp, Artificial Sequence
  chemically synthesized
aaaatagaaaaattgtaggt

SEQ ID NO: 449923 - DNA, 20 bp, Artificial Sequence
  chemically synthesized
gaaaatagaaaaattgtagg

SEQ ID NO: 449924 - DNA, 20 bp, Artificial Sequence
  chemically synthesized
tctgaaaatagaaaaattgt

SEQ ID NO: 449925 - DNA, 20 bp, Artificial Sequence
  chemically synthesized
ttctgaaaatagaaaaattg

SEQ ID NO: 449926 - DNA, 20 bp, Artificial Sequence
  chemically synthesized
acctacaatttttctatttt

SEQ ID NO: 449927 - DNA, 20 bp, Artificial Sequence
  chemically synthesized
caagtatggctttctgaaaa

SEQ ID NO: 449928 - DNA, 20 bp, Artificial Sequence
  chemically synthesized
acaatttttctattttcaga

SEQ ID NO: 449929 - DNA, 20 bp, Artificial Sequence
  chemically synthesized
tcacaccaaaagagcaagta

SEQ ID NO: 449930 - DNA, 20 bp, Artificial Sequence
  chemically synthesized
gaaagccatacttgctcttt

SEQ ID NO: 449931 - DNA, 20 bp, Artificial Sequence
  chemically synthesized
cttgatcacaccaaaagagc

SEQ ID NO: 449932 - DNA, 20 bp, Artificial Sequence
  chemically synthesized
accccttgatcacaccaaaa

SEQ ID NO: 449933 - DNA, 20 bp, Artificial Sequence
  chemically synthesized
aaaccccttgatcacaccaa

SEQ ID NO: 449934 - DNA, 20 bp, Artificial Sequence
  chemically synthesized
cttgctcttttggtgtgatc

SEQ ID NO: 449935 - DNA, 20 bp, Artificial Sequence
  chemically synthesized
ttgctcttttggtgtgatca

SEQ ID NO: 449936 - DNA, 20 bp, Artificial Sequence
  chemically synthesized
tgctcttttggtgtgatcaa

SEQ ID NO: 449937 - DNA, 20 bp, Artificial Sequence
  chemically synthesized
gctcttttggtgtgatcaag

SEQ ID NO: 449938 - DNA, 20 bp, Artificial Sequence
  chemically synthesized
tggtgtgatcaaggggtttc

SEQ ID NO: 449939 - DNA, 20 bp, Artificial Sequence
  chemically synthesized
gtgtgatcaaggggtttctg

SEQ ID NO: 449940 - DNA, 20 bp, Artificial Sequence
  chemically synthesized
tcaaggggtttctggagacc

SEQ ID NO: 449941 - DNA, 20 bp, Artificial Sequence
  chemically synthesized
cattttcccttctcggtctc

SEQ ID NO: 449942 - DNA, 20 bp, Artificial Sequence
  chemically synthesized
aggggtttctggagaccgag

SEQ ID NO: 449943 - DNA, 20 bp, Artificial Sequence
  chemically synthesized
ggggtttctggagaccgaga

SEQ ID NO: 449944 - DNA, 20 bp, Artificial Sequence
  chemically synthesized
gggtttctggagaccgagaa

SEQ ID NO: 449945 - DNA, 20 bp, Artificial Sequence
  chemically synthesized
atggacacattttcccttct

SEQ ID NO: 449946 - DNA, 20 bp, Artificial Sequence
  chemically synthesized
gggaaaatgtgtccatttct

SEQ ID NO: 449947 - DNA, 20 bp, Artificial Sequence
  chemically synthesized
cagtgagtgtttctcagaaa

SEQ ID NO: 449948 - DNA, 20 bp, Artificial Sequence
  chemically synthesized
ttcctacagtgagtgtttct

SEQ ID NO: 449949 - DNA, 20 bp, Artificial Sequence
  chemically synthesized
tttctgagaaacactcactg

SEQ ID NO: 449950 - DNA, 20 bp, Artificial Sequence
  chemically synthesized
ttctgagaaacactcactgt

SEQ ID NO: 449951 - DNA, 20 bp, Artificial Sequence
  chemically synthesized
agcaccttctttcctacagt

SEQ ID NO: 449952 - DNA, 20 bp, Artificial Sequence
  chemically synthesized
gagaaacactcactgtagga

SEQ ID NO: 449953 - DNA, 20 bp, Artificial Sequence
  chemically synthesized
aaatagcaccttctttccta

SEQ ID NO: 449954 - DNA, 20 bp, Artificial Sequence
  chemically synthesized
aaacactcactgtaggaaag

SEQ ID NO: 449955 - DNA, 20 bp, Artificial Sequence
  chemically synthesized
aacactcactgtaggaaaga

SEQ ID NO: 449956 - DNA, 20 bp, Artificial Sequence
  chemically synthesized
gtatttacattaaatgcaaa

SEQ ID NO: 449957 - DNA, 20 bp, Artificial Sequence
  chemically synthesized
ttaattaaaaggaacgaaag

SEQ ID NO: 449958 - DNA, 20 bp, Artificial Sequence
  chemically synthesized
cttttaattaaaaggaacga

SEQ ID NO: 449959 - DNA, 20 bp, Artificial Sequence
  chemically synthesized
ctgtttctcttttaattaaa

SEQ ID NO: 449960 - DNA, 20 bp, Artificial Sequence
  chemically synthesized
tctgtttctcttttaattaa

SEQ ID NO: 449961 - DNA, 20 bp, Artificial Sequence
  chemically synthesized
ctttcgttccttttaattaa

SEQ ID NO: 449962 - DNA, 20 bp, Artificial Sequence
  chemically synthesized
ttcgttccttttaattaaaa

SEQ ID NO: 449963 - DNA, 20 bp, Artificial Sequence
  chemically synthesized
ccttttaattaaaagagaaa

SEQ ID NO: 449964 - DNA, 20 bp, Artificial Sequence
  chemically synthesized
tttatgtttagaatatagaa

SEQ ID NO: 449965 - DNA, 20 bp, Artificial Sequence
  chemically synthesized
ttttatgtttagaatataga

SEQ ID NO: 449966 - DNA, 20 bp, Artificial Sequence
  chemically synthesized
tttttatgtttagaatatag

SEQ ID NO: 449967 - DNA, 20 bp, Artificial Sequence
  chemically synthesized
tattttttatgtttagaata

SEQ ID NO: 449968 - DNA, 20 bp, Artificial Sequence
  chemically synthesized
aaacttttattttttatgtt

SEQ ID NO: 449969 - DNA, 20 bp, Artificial Sequence
  chemically synthesized
attctaaacataaaaaataa

SEQ ID NO: 449970 - DNA, 20 bp, Artificial Sequence
  chemically synthesized
ataaaagttttttctcaata

SEQ ID NO: 449971 - DNA, 20 bp, Artificial Sequence
  chemically synthesized
aaagttttttctcaatatgg

SEQ ID NO: 449972 - DNA, 20 bp, Artificial Sequence
  chemically synthesized
ttgcaatcaactaccatatt

SEQ ID NO: 449973 - DNA, 20 bp, Artificial Sequence
  chemically synthesized
caatatggtagttgattgca

SEQ ID NO: 449974 - DNA, 20 bp, Artificial Sequence
  chemically synthesized
gaccatctctacatacagaa

SEQ ID NO: 449975 - DNA, 20 bp, Artificial Sequence
  chemically synthesized
tgcaaagaccattctgtatg

SEQ ID NO: 449976 - DNA, 20 bp, Artificial Sequence
  chemically synthesized
caaagaccattctgtatgta

SEQ ID NO: 449977 - DNA, 20 bp, Artificial Sequence
  chemically synthesized
gggaggaccatctctacata

SEQ ID NO: 449978 - DNA, 20 bp, Artificial Sequence
  chemically synthesized
gaccattctgtatgtagaga

SEQ ID NO: 449979 - DNA, 20 bp, Artificial Sequence
  chemically synthesized
tgctaaaaaaaattggaggg

SEQ ID NO: 449980 - DNA, 20 bp, Artificial Sequence
  chemically synthesized
atgctaaaaaaaattggagg

SEQ ID NO: 449981 - DNA, 20 bp, Artificial Sequence
  chemically synthesized
tgatgctaaaaaaaattgga

SEQ ID NO: 449982 - DNA, 20 bp, Artificial Sequence
  chemically synthesized
atgatgctaaaaaaaattgg

SEQ ID NO: 449983 - DNA, 20 bp, Artificial Sequence
  chemically synthesized
catgatgctaaaaaaaattg

SEQ ID NO: 449984 - DNA, 20 bp, Artificial Sequence
  chemically synthesized
agcatgatgctaaaaaaaat

SEQ ID NO: 449985 - DNA, 20 bp, Artificial Sequence
  chemically synthesized
gtcctccctccaattttttt

SEQ ID NO: 449986 - DNA, 20 bp, Artificial Sequence
  chemically synthesized
gtgacctttctaaatgaaaa

SEQ ID NO: 449987 - DNA, 20 bp, Artificial Sequence
  chemically synthesized
agcatcatgctattttcatt

SEQ ID NO: 449988 - DNA, 20 bp, Artificial Sequence
  chemically synthesized
tcatgctattttcatttaga

SEQ ID NO: 449989 - DNA, 20 bp, Artificial Sequence
  chemically synthesized
catgctattttcatttagaa

SEQ ID NO: 449990 - DNA, 20 bp, Artificial Sequence
  chemically synthesized
ttcatttagaaaggtcacat

SEQ ID NO: 449991 - DNA, 20 bp, Artificial Sequence
  chemically synthesized
aatcacattggtttcagcaa

SEQ ID NO: 449992 - DNA, 20 bp, Artificial Sequence
  chemically synthesized
taggaaaatcacattggttt

SEQ ID NO: 449993 - DNA, 20 bp, Artificial Sequence
  chemically synthesized
gcttattaggaaaatcacat

SEQ ID NO: 449994 - DNA, 20 bp, Artificial Sequence
  chemically synthesized
accaatgtgattttcctaat

SEQ ID NO: 449995 - DNA, 20 bp, Artificial Sequence
  chemically synthesized
cttagcatggtgagcttatt

SEQ ID NO: 449996 - DNA, 20 bp, Artificial Sequence
  chemically synthesized
acttagcatggtgagcttat

SEQ ID NO: 449997 - DNA, 20 bp, Artificial Sequence
  chemically synthesized
gttggatcacttagcatggt

SEQ ID NO: 449998 - DNA, 20 bp, Artificial Sequence
  chemically synthesized
cctaataagctcaccatgct

SEQ ID NO: 449999 - DNA, 20 bp, Artificial Sequence
  chemically synthesized
ttctgttggatcacttagca

SEQ ID NO: 450000 - DNA, 20 bp, Artificial Sequence
  chemically synthesized
agcaattctgttggatcact

SEQ ID NO: 450001 - DNA, 20 bp, Artificial Sequence
  chemically synthesized
caccatgctaagtgatccaa

SEQ ID NO: 450002 - DNA, 20 bp, Artificial Sequence
  chemically synthesized
aacaaacagagcaattctgt

SEQ ID NO: 450003 - DNA, 20 bp, Artificial Sequence
  chemically synthesized
actctccttattaacaaaca

SEQ ID NO: 450004 - DNA, 20 bp, Artificial Sequence
  chemically synthesized
ttactctccttattaacaaa

SEQ ID NO: 450005 - DNA, 20 bp, Artificial Sequence
  chemically synthesized
gaattgctctgtttgttaat

SEQ ID NO: 450006 - DNA, 20 bp, Artificial Sequence
  chemically synthesized
aattgctctgtttgttaata

SEQ ID NO: 450007 - DNA, 20 bp, Artificial Sequence
  chemically synthesized
ttgctctgtttgttaataag

SEQ ID NO: 450008 - DNA, 20 bp, Artificial Sequence
  chemically synthesized
gctctgtttgttaataagga

SEQ ID NO: 450009 - DNA, 20 bp, Artificial Sequence
  chemically synthesized
gagtaaatgacattacttga

SEQ ID NO: 450010 - DNA, 20 bp, Artificial Sequence
  chemically synthesized
attgaaagagcgtttctgtc

SEQ ID NO: 450011 - DNA, 20 bp, Artificial Sequence
  chemically synthesized
tgacagaaacgctctttcaa

SEQ ID NO: 450012 - DNA, 20 bp, Artificial Sequence
  chemically synthesized
ggaataaaccaccattgaaa

SEQ ID NO: 450013 - DNA, 20 bp, Artificial Sequence
  chemically synthesized
cagaaacgctctttcaatgg

SEQ ID NO: 450014 - DNA, 20 bp, Artificial Sequence
  chemically synthesized
ttggaataaaccaccattga

SEQ ID NO: 450015 - DNA, 20 bp, Artificial Sequence
  chemically synthesized
tttcaatggtggtttattcc

SEQ ID NO: 450016 - DNA, 20 bp, Artificial Sequence
  chemically synthesized
tcaatggtggtttattccaa

SEQ ID NO: 450017 - DNA, 20 bp, Artificial Sequence
  chemically synthesized
gtaaggatgaattaatctct

SEQ ID NO: 450018 - DNA, 20 bp, Artificial Sequence
  chemically synthesized
tatgtgacactggacaagta

SEQ ID NO: 450019 - DNA, 20 bp, Artificial Sequence
  chemically synthesized
ttaattcatccttacttgtc

SEQ ID NO: 450020 - DNA, 20 bp, Artificial Sequence
  chemically synthesized
atatgtgacactggacaagt

SEQ ID NO: 450021 - DNA, 20 bp, Artificial Sequence
  chemically synthesized
acgtatatgtgacactggac

SEQ ID NO: 450022 - DNA, 20 bp, Artificial Sequence
  chemically synthesized
taataacgtatatgtgacac

SEQ ID NO: 450023 - DNA, 20 bp, Artificial Sequence
  chemically synthesized
acgttattaaatatgcaatg

SEQ ID NO: 450024 - DNA, 20 bp, Artificial Sequence
  chemically synthesized
attatcataattgaataaga

SEQ ID NO: 450025 - DNA, 20 bp, Artificial Sequence
  chemically synthesized
aattatcataattgaataag

SEQ ID NO: 450026 - DNA, 20 bp, Artificial Sequence
  chemically synthesized
gcaaattatcataattgaat

SEQ ID NO: 450027 - DNA, 20 bp, Artificial Sequence
  chemically synthesized
atttccaagtattaataaaa

SEQ ID NO: 450028 - DNA, 20 bp, Artificial Sequence
  chemically synthesized
tttgctgttttattaatact

SEQ ID NO: 450029 - DNA, 20 bp, Artificial Sequence
  chemically synthesized
gagtgatatattttatttcc

SEQ ID NO: 450030 - DNA, 20 bp, Artificial Sequence
  chemically synthesized
aaatatatcactccatccat

SEQ ID NO: 450031 - DNA, 20 bp, Artificial Sequence
  chemically synthesized
accgtgattactaatggatg

SEQ ID NO: 450032 - DNA, 20 bp, Artificial Sequence
  chemically synthesized
tcaccgtgattactaatgga

SEQ ID NO: 450033 - DNA, 20 bp, Artificial Sequence
  chemically synthesized
ttcatcaccgtgattactaa

SEQ ID NO: 450034 - DNA, 20 bp, Artificial Sequence
  chemically synthesized
actccatccattagtaatca

SEQ ID NO: 450035 - DNA, 20 bp, Artificial Sequence
  chemically synthesized
gcttctaatatggtatcaca

SEQ ID NO: 450036 - DNA, 20 bp, Artificial Sequence
  chemically synthesized
gaaactatgtgataccatat

SEQ ID NO: 450037 - DNA, 20 bp, Artificial Sequence
  chemically synthesized
actatgtgataccatattag

SEQ ID NO: 450038 - DNA, 20 bp, Artificial Sequence
  chemically synthesized
ccttggacttgcttctaata

SEQ ID NO: 450039 - DNA, 20 bp, Artificial Sequence
  chemically synthesized
tgtgataccatattagaagc

SEQ ID NO: 450040 - DNA, 20 bp, Artificial Sequence
  chemically synthesized
accatattagaagcaagtcc

SEQ ID NO: 450041 - DNA, 20 bp, Artificial Sequence
  chemically synthesized
ccatattagaagcaagtcca

SEQ ID NO: 450042 - DNA, 20 bp, Artificial Sequence
  chemically synthesized
tagaagcaagtccaaggtat

SEQ ID NO: 450043 - DNA, 20 bp, Artificial Sequence
  chemically synthesized
aacatggatctctaatacct

SEQ ID NO: 450044 - DNA, 20 bp, Artificial Sequence
  chemically synthesized
gaagcaagtccaaggtatta

SEQ ID NO: 450045 - DNA, 20 bp, Artificial Sequence
  chemically synthesized
cattttatagaagttgaaca

SEQ ID NO: 450046 - DNA, 20 bp, Artificial Sequence
  chemically synthesized
tcgaacttaccattttatag

SEQ ID NO: 450047 - DNA, 20 bp, Artificial Sequence
  chemically synthesized
catgttcaacttctataaaa

SEQ ID NO: 450048 - DNA, 20 bp, Artificial Sequence
  chemically synthesized
ttatcgaacttaccatttta

SEQ ID NO: 450049 - DNA, 20 bp, Artificial Sequence
  chemically synthesized
ttcaacttctataaaatggt

SEQ ID NO: 450050 - DNA, 20 bp, Artificial Sequence
  chemically synthesized
tataaaatggtaagttcgat

SEQ ID NO: 450051 - DNA, 20 bp, Artificial Sequence
  chemically synthesized
gttcgataagccattttgca

SEQ ID NO: 450052 - DNA, 20 bp, Artificial Sequence
  chemically synthesized
aaaaatataactgtgcaaaa

SEQ ID NO: 450053 - DNA, 20 bp, Artificial Sequence
  chemically synthesized
ttgcacagttatatttttcc

SEQ ID NO: 450054 - DNA, 20 bp, Artificial Sequence
  chemically synthesized
aatctgaaggacaagaagct

SEQ ID NO: 450055 - DNA, 20 bp, Artificial Sequence
  chemically synthesized
aactaaatctgaaggacaag

SEQ ID NO: 450056 - DNA, 20 bp, Artificial Sequence
  chemically synthesized
tttccaagcttcttgtcctt

SEQ ID NO: 450057 - DNA, 20 bp, Artificial Sequence
  chemically synthesized
actaactaaatctgaaggac

SEQ ID NO: 450058 - DNA, 20 bp, Artificial Sequence
  chemically synthesized
agcttcttgtccttcagatt

SEQ ID NO: 450059 - DNA, 20 bp, Artificial Sequence
  chemically synthesized
tgaccactaactaaatctga

SEQ ID NO: 450060 - DNA, 20 bp, Artificial Sequence
  chemically synthesized
ttgaccactaactaaatctg

SEQ ID NO: 450061 - DNA, 20 bp, Artificial Sequence
  chemically synthesized
tcttgtccttcagatttagt

SEQ ID NO: 450062 - DNA, 20 bp, Artificial Sequence
  chemically synthesized
tgtccttcagatttagttag

SEQ ID NO: 450063 - DNA, 20 bp, Artificial Sequence
  chemically synthesized
gttagtggtcaattcactat

SEQ ID NO: 450064 - DNA, 20 bp, Artificial Sequence
  chemically synthesized
tagtggtcaattcactatta

SEQ ID NO: 450065 - DNA, 20 bp, Artificial Sequence
  chemically synthesized
agtggtcaattcactattag

SEQ ID NO: 450066 - DNA, 20 bp, Artificial Sequence
  chemically synthesized
aaataattacattcctctaa

SEQ ID NO: 450067 - DNA, 20 bp, Artificial Sequence
  chemically synthesized
agaggaatgtaattattttc

SEQ ID NO: 450068 - DNA, 20 bp, Artificial Sequence
  chemically synthesized
gaatgtaattattttctggt

SEQ ID NO: 450069 - DNA, 20 bp, Artificial Sequence
  chemically synthesized
tactcatcctcagtgccaac

SEQ ID NO: 450070 - DNA, 20 bp, Artificial Sequence
  chemically synthesized
attattttctggttggcact

SEQ ID NO: 450071 - DNA, 20 bp, Artificial Sequence
  chemically synthesized
ttattttctggttggcactg

SEQ ID NO: 450072 - DNA, 20 bp, Artificial Sequence
  chemically synthesized
ttctggttggcactgaggat

SEQ ID NO: 450073 - DNA, 20 bp, Artificial Sequence
  chemically synthesized
atttttgtcttactcatcct

SEQ ID NO: 450074 - DNA, 20 bp, Artificial Sequence
  chemically synthesized
ggttggcactgaggatgagt

SEQ ID NO: 450075 - DNA, 20 bp, Artificial Sequence
  chemically synthesized
ctatggcaccttcagtgata

SEQ ID NO: 450076 - DNA, 20 bp, Artificial Sequence
  chemically synthesized
caaaaatcaccctatcactg

SEQ ID NO: 450077 - DNA, 20 bp, Artificial Sequence
  chemically synthesized
gctatggcaccttcagtgat

SEQ ID NO: 450078 - DNA, 20 bp, Artificial Sequence
  chemically synthesized
aaaaatcaccctatcactga

SEQ ID NO: 450079 - DNA, 20 bp, Artificial Sequence
  chemically synthesized
ggctatggcaccttcagtga

SEQ ID NO: 450080 - DNA, 20 bp, Artificial Sequence
  chemically synthesized
atttgaggctatggcacctt

SEQ ID NO: 450081 - DNA, 20 bp, Artificial Sequence
  chemically synthesized
ccctatcactgaaggtgcca

SEQ ID NO: 450082 - DNA, 20 bp, Artificial Sequence
  chemically synthesized
gagtagggtatttgaggcta

SEQ ID NO: 450083 - DNA, 20 bp, Artificial Sequence
  chemically synthesized
tggagtgagtagggtatttg

SEQ ID NO: 450084 - DNA, 20 bp, Artificial Sequence
  chemically synthesized
ctggagtgagtagggtattt

SEQ ID NO: 450085 - DNA, 20 bp, Artificial Sequence
  chemically synthesized
aaatgcagctggagtgagta

SEQ ID NO: 450086 - DNA, 20 bp, Artificial Sequence
  chemically synthesized
taaatgcagctggagtgagt

SEQ ID NO: 450087 - DNA, 20 bp, Artificial Sequence
  chemically synthesized
ctcaaataccctactcactc

SEQ ID NO: 450088 - DNA, 20 bp, Artificial Sequence
  chemically synthesized
ataaatgcagctggagtgag

SEQ ID NO: 450089 - DNA, 20 bp, Artificial Sequence
  chemically synthesized
tatataaatgcagctggagt

SEQ ID NO: 450090 - DNA, 20 bp, Artificial Sequence
  chemically synthesized
cctctatataaatgcagctg

SEQ ID NO: 450091 - DNA, 20 bp, Artificial Sequence
  chemically synthesized
agcctctatataaatgcagc

SEQ ID NO: 450092 - DNA, 20 bp, Artificial Sequence
  chemically synthesized
tgagagcctctatataaatg

SEQ ID NO: 450093 - DNA, 20 bp, Artificial Sequence
  chemically synthesized
tcactccagctgcatttata

SEQ ID NO: 450094 - DNA, 20 bp, Artificial Sequence
  chemically synthesized
actccagctgcatttatata

SEQ ID NO: 450095 - DNA, 20 bp, Artificial Sequence
  chemically synthesized
ctccagctgcatttatatag

SEQ ID NO: 450096 - DNA, 20 bp, Artificial Sequence
  chemically synthesized
tgcatttatatagaggctct

SEQ ID NO: 450097 - DNA, 20 bp, Artificial Sequence
  chemically synthesized
ttgatcttttgtgcaactga

SEQ ID NO: 450098 - DNA, 20 bp, Artificial Sequence
  chemically synthesized
gtttgatcttttgtgcaact

SEQ ID NO: 450099 - DNA, 20 bp, Artificial Sequence
  chemically synthesized
agaggctctcagttgcacaa

SEQ ID NO: 450100 - DNA, 20 bp, Artificial Sequence
  chemically synthesized
ggcttgatctttagatacaa

SEQ ID NO: 450101 - DNA, 20 bp, Artificial Sequence
  chemically synthesized
agatcaaactgttgtatcta

SEQ ID NO: 450102 - DNA, 20 bp, Artificial Sequence
  chemically synthesized
aactgttgtatctaaagatc

SEQ ID NO: 450103 - DNA, 20 bp, Artificial Sequence
  chemically synthesized
aagcattctggcttgatctt

SEQ ID NO: 450104 - DNA, 20 bp, Artificial Sequence
  chemically synthesized
gttgtatctaaagatcaagc

SEQ ID NO: 450105 - DNA, 20 bp, Artificial Sequence
  chemically synthesized
ctaatgtttgaaaagcattc

SEQ ID NO: 450106 - DNA, 20 bp, Artificial Sequence
  chemically synthesized
ggaaggatctaatgtttgaa

SEQ ID NO: 450107 - DNA, 20 bp, Artificial Sequence
  chemically synthesized
ccagaatgcttttcaaacat

SEQ ID NO: 450108 - DNA, 20 bp, Artificial Sequence
  chemically synthesized
caaacattagatccttccca

SEQ ID NO: 450109 - DNA, 20 bp, Artificial Sequence
  chemically synthesized
cacaaagaattgctttggga

SEQ ID NO: 450110 - DNA, 20 bp, Artificial Sequence
  chemically synthesized
acacaaagaattgctttggg

SEQ ID NO: 450111 - DNA, 20 bp, Artificial Sequence
  chemically synthesized
gttacacaaagaattgcttt

SEQ ID NO: 450112 - DNA, 20 bp, Artificial Sequence
  chemically synthesized
ggttacacaaagaattgctt

SEQ ID NO: 450113 - DNA, 20 bp, Artificial Sequence
  chemically synthesized
ttttggaaactggttacaca

SEQ ID NO: 450114 - DNA, 20 bp, Artificial Sequence
  chemically synthesized
aaagcaattctttgtgtaac

SEQ ID NO: 450115 - DNA, 20 bp, Artificial Sequence
  chemically synthesized
cctcagacttttttggaaac

SEQ ID NO: 450116 - DNA, 20 bp, Artificial Sequence
  chemically synthesized
tgtgtaaccagtttccaaaa

SEQ ID NO: 450117 - DNA, 20 bp, Artificial Sequence
  chemically synthesized
aatttttcctcagacttttt

SEQ ID NO: 450118 - DNA, 20 bp, Artificial Sequence
  chemically synthesized
accagtttccaaaaaagtct

SEQ ID NO: 450119 - DNA, 20 bp, Artificial Sequence
  chemically synthesized
ccagtttccaaaaaagtctg

SEQ ID NO: 450120 - DNA, 20 bp, Artificial Sequence
  chemically synthesized
aaacaatggaaatttttcct

SEQ ID NO: 450121 - DNA, 20 bp, Artificial Sequence
  chemically synthesized
ctaataacgataggaaacaa

SEQ ID NO: 450122 - DNA, 20 bp, Artificial Sequence
  chemically synthesized
cccaacagtctaataacgat

SEQ ID NO: 450123 - DNA, 20 bp, Artificial Sequence
  chemically synthesized
ccattgtttcctatcgttat

SEQ ID NO: 450124 - DNA, 20 bp, Artificial Sequence
  chemically synthesized
acccaacagtctaataacga

SEQ ID NO: 450125 - DNA, 20 bp, Artificial Sequence
  chemically synthesized
tcctatcgttattagactgt

SEQ ID NO: 450126 - DNA, 20 bp, Artificial Sequence
  chemically synthesized
cctatcgttattagactgtt

SEQ ID NO: 450127 - DNA, 20 bp, Artificial Sequence
  chemically synthesized
attacgtcagtaggacccaa

SEQ ID NO: 450128 - DNA, 20 bp, Artificial Sequence
  chemically synthesized
tgtatatttattacgtcagt

SEQ ID NO: 450129 - DNA, 20 bp, Artificial Sequence
  chemically synthesized
ttgtatatttattacgtcag

SEQ ID NO: 450130 - DNA, 20 bp, Artificial Sequence
  chemically synthesized
gatttgtatatttattacgt

SEQ ID NO: 450131 - DNA, 20 bp, Artificial Sequence
  chemically synthesized
tatacaaatcactattgttt

SEQ ID NO: 450132 - DNA, 20 bp, Artificial Sequence
  chemically synthesized
aaaacattgtgctgaaacaa

SEQ ID NO: 450133 - DNA, 20 bp, Artificial Sequence
  chemically synthesized
tgttttatgcatgacatttt

SEQ ID NO: 450134 - DNA, 20 bp, Artificial Sequence
  chemically synthesized
ttttaatattgtgttttgta

SEQ ID NO: 450135 - DNA, 20 bp, Artificial Sequence
  chemically synthesized
aacacaatattaaaattctg

SEQ ID NO: 450136 - DNA, 20 bp, Artificial Sequence
  chemically synthesized
aatgctattatttttcactt

SEQ ID NO: 450137 - DNA, 20 bp, Artificial Sequence
  chemically synthesized
aattctgaagtgaaaaataa

SEQ ID NO: 450138 - DNA, 20 bp, Artificial Sequence
  chemically synthesized
agtgaaaaataatagcatta

SEQ ID NO: 450139 - DNA, 20 bp, Artificial Sequence
  chemically synthesized
accacaatatagaatgtaat

SEQ ID NO: 450140 - DNA, 20 bp, Artificial Sequence
  chemically synthesized
gctcattacattctatattg

SEQ ID NO: 450141 - DNA, 20 bp, Artificial Sequence
  chemically synthesized
cagttcaaactaccacaata

SEQ ID NO: 450142 - DNA, 20 bp, Artificial Sequence
  chemically synthesized
cattacattctatattgtgg

SEQ ID NO: 450143 - DNA, 20 bp, Artificial Sequence
  chemically synthesized
attgtggtagtttgaactgt

SEQ ID NO: 450144 - DNA, 20 bp, Artificial Sequence
  chemically synthesized
gatgacagtacagttactca

SEQ ID NO: 450145 - DNA, 20 bp, Artificial Sequence
  chemically synthesized
gagttgacaggatgacagta

SEQ ID NO: 450146 - DNA, 20 bp, Artificial Sequence
  chemically synthesized
aaagtgagttgacaggatga

SEQ ID NO: 450147 - DNA, 20 bp, Artificial Sequence
  chemically synthesized
atcttttaaagtgagttgac

SEQ ID NO: 450148 - DNA, 20 bp, Artificial Sequence
  chemically synthesized
gatcttttaaagtgagttga

SEQ ID NO: 450149 - DNA, 20 bp, Artificial Sequence
  chemically synthesized
atcctgtcaactcactttaa

SEQ ID NO: 450150 - DNA, 20 bp, Artificial Sequence
  chemically synthesized
tatagcggatcttttaaagt

SEQ ID NO: 450151 - DNA, 20 bp, Artificial Sequence
  chemically synthesized
acaatatagcggatctttta

SEQ ID NO: 450152 - DNA, 20 bp, Artificial Sequence
  chemically synthesized
cattgtgtaaaacaatatag

SEQ ID NO: 450153 - DNA, 20 bp, Artificial Sequence
  chemically synthesized
tgacattgtgtaaaacaata

SEQ ID NO: 450154 - DNA, 20 bp, Artificial Sequence
  chemically synthesized
acacaatgtcatttatttca

SEQ ID NO: 450155 - DNA, 20 bp, Artificial Sequence
  chemically synthesized
cacaatgtcatttatttcac

SEQ ID NO: 450156 - DNA, 20 bp, Artificial Sequence
  chemically synthesized
tcacaggtataactatacca

SEQ ID NO: 450157 - DNA, 20 bp, Artificial Sequence
  chemically synthesized
caaaccggaacactttggta

SEQ ID NO: 450158 - DNA, 20 bp, Artificial Sequence
  chemically synthesized
gtttccaaaccggaacactt

SEQ ID NO: 450159 - DNA, 20 bp, Artificial Sequence
  chemically synthesized
ataactataccaaagtgttc

SEQ ID NO: 450160 - DNA, 20 bp, Artificial Sequence
  chemically synthesized
tataccaaagtgttccggtt

SEQ ID NO: 450161 - DNA, 20 bp, Artificial Sequence
  chemically synthesized
tttacactatgtttccaaac

SEQ ID NO: 450162 - DNA, 20 bp, Artificial Sequence
  chemically synthesized
agtgttccggtttggaaaca

SEQ ID NO: 450163 - DNA, 20 bp, Artificial Sequence
  chemically synthesized
tgtttaaaaatattttcaca

SEQ ID NO: 450164 - DNA, 20 bp, Artificial Sequence
  chemically synthesized
tttcagtgcaagtatttttc

SEQ ID NO: 450165 - DNA, 20 bp, Artificial Sequence
  chemically synthesized
ctttcagtgcaagtattttt

SEQ ID NO: 450166 - DNA, 20 bp, Artificial Sequence
  chemically synthesized
ctgaaaaatacttgcactga

SEQ ID NO: 450167 - DNA, 20 bp, Artificial Sequence
  chemically synthesized
tgatgattagctttcagtgc

SEQ ID NO: 450168 - DNA, 20 bp, Artificial Sequence
  chemically synthesized
tgtaactgatgattagcttt

SEQ ID NO: 450169 - DNA, 20 bp, Artificial Sequence
  chemically synthesized
ttgcactgaaagctaatcat

SEQ ID NO: 450170 - DNA, 20 bp, Artificial Sequence
  chemically synthesized
gtggttctgtaactgatgat

SEQ ID NO: 450171 - DNA, 20 bp, Artificial Sequence
  chemically synthesized
tgaaagctaatcatcagtta

SEQ ID NO: 450172 - DNA, 20 bp, Artificial Sequence
  chemically synthesized
agttacagaaccaccaacaa

SEQ ID NO: 450173 - DNA, 20 bp, Artificial Sequence
  chemically synthesized
agtagcagaacttttgttgg

SEQ ID NO: 450174 - DNA, 20 bp, Artificial Sequence
  chemically synthesized
tgtagtagcagaacttttgt

SEQ ID NO: 450175 - DNA, 20 bp, Artificial Sequence
  chemically synthesized
atcaaaactatttgtagtag

SEQ ID NO: 450176 - DNA, 20 bp, Artificial Sequence
  chemically synthesized
aaaagttctgctactacaaa

SEQ ID NO: 450177 - DNA, 20 bp, Artificial Sequence
  chemically synthesized
ttcatcaaaactatttgtag

SEQ ID NO: 450178 - DNA, 20 bp, Artificial Sequence
  chemically synthesized
tgtttcatcaaaactatttg

SEQ ID NO: 450179 - DNA, 20 bp, Artificial Sequence
  chemically synthesized
acaaatagttttgatgaaac

SEQ ID NO: 450180 - DNA, 20 bp, Artificial Sequence
  chemically synthesized
aaacaacgtactaaacattt

SEQ ID NO: 450181 - DNA, 20 bp, Artificial Sequence
  chemically synthesized
aaaaattattccaaaatgtt

SEQ ID NO: 450182 - DNA, 20 bp, Artificial Sequence
  chemically synthesized
aagtctaagaacaaatcaga

SEQ ID NO: 450183 - DNA, 20 bp, Artificial Sequence
  chemically synthesized
aaagtctaagaacaaatcag

SEQ ID NO: 450184 - DNA, 20 bp, Artificial Sequence
  chemically synthesized
tttaaagtctaagaacaaat

SEQ ID NO: 450185 - DNA, 20 bp, Artificial Sequence
  chemically synthesized
attaccttctgatttgttct

SEQ ID NO: 450186 - DNA, 20 bp, Artificial Sequence
  chemically synthesized
ttagggaatctttaaagtct

SEQ ID NO: 450187 - DNA, 20 bp, Artificial Sequence
  chemically synthesized
tgatttgttcttagacttta

SEQ ID NO: 450188 - DNA, 20 bp, Artificial Sequence
  chemically synthesized
aatattttagggaatcttta

SEQ ID NO: 450189 - DNA, 20 bp, Artificial Sequence
  chemically synthesized
catcatttaccaatatttta

SEQ ID NO: 450190 - DNA, 20 bp, Artificial Sequence
  chemically synthesized
ttaaagattccctaaaatat

SEQ ID NO: 450191 - DNA, 20 bp, Artificial Sequence
  chemically synthesized
tcatcatttaccaatatttt

SEQ ID NO: 450192 - DNA, 20 bp, Artificial Sequence
  chemically synthesized
atcatcatttaccaatattt

SEQ ID NO: 450193 - DNA, 20 bp, Artificial Sequence
  chemically synthesized
aaaatattggtaaatgatga

SEQ ID NO: 450194 - DNA, 20 bp, Artificial Sequence
  chemically synthesized
aaagcaatatttttagaaaa

SEQ ID NO: 450195 - DNA, 20 bp, Artificial Sequence
  chemically synthesized
caaagcaatatttttagaaa

SEQ ID NO: 450196 - DNA, 20 bp, Artificial Sequence
  chemically synthesized
taccatcaaagcaatatttt

SEQ ID NO: 450197 - DNA, 20 bp, Artificial Sequence
  chemically synthesized
ttctaaaaatattgctttga

SEQ ID NO: 450198 - DNA, 20 bp, Artificial Sequence
  chemically synthesized
tgccagtcgttttaccatca

SEQ ID NO: 450199 - DNA, 20 bp, Artificial Sequence
  chemically synthesized
tgctttgatggtaaaacgac

SEQ ID NO: 450200 - DNA, 20 bp, Artificial Sequence
  chemically synthesized
atcttctgtcattttgttgc

SEQ ID NO: 450201 - DNA, 20 bp, Artificial Sequence
  chemically synthesized
aacgactggcaacaaaatga

SEQ ID NO: 450202 - DNA, 20 bp, Artificial Sequence
  chemically synthesized
gactggcaacaaaatgacag

SEQ ID NO: 450203 - DNA, 20 bp, Artificial Sequence
  chemically synthesized
ggcaacaaaatgacagaaga

SEQ ID NO: 450204 - DNA, 20 bp, Artificial Sequence
  chemically synthesized
aaaatgacagaagatagccc

SEQ ID NO: 450205 - DNA, 20 bp, Artificial Sequence
  chemically synthesized
aatgacagaagatagcccta

SEQ ID NO: 450206 - DNA, 20 bp, Artificial Sequence
  chemically synthesized
agtggagaaaggcatctcta

SEQ ID NO: 450207 - DNA, 20 bp, Artificial Sequence
  chemically synthesized
aagtggagaaaggcatctct

SEQ ID NO: 450208 - DNA, 20 bp, Artificial Sequence
  chemically synthesized
aaagtggagaaaggcatctc

SEQ ID NO: 450209 - DNA, 20 bp, Artificial Sequence
  chemically synthesized
tactaggataaagtggagaa

SEQ ID NO: 450210 - DNA, 20 bp, Artificial Sequence
  chemically synthesized
atactaggataaagtggaga

SEQ ID NO: 450211 - DNA, 20 bp, Artificial Sequence
  chemically synthesized
agacatactaggataaagtg

SEQ ID NO: 450212 - DNA, 20 bp, Artificial Sequence
  chemically synthesized
aaagacatactaggataaag

SEQ ID NO: 450213 - DNA, 20 bp, Artificial Sequence
  chemically synthesized
tgcctttctccactttatcc

SEQ ID NO: 450214 - DNA, 20 bp, Artificial Sequence
  chemically synthesized
tctaaagacatactaggata

SEQ ID NO: 450215 - DNA, 20 bp, Artificial Sequence
  chemically synthesized
cagggctctaaagacatact

SEQ ID NO: 450216 - DNA, 20 bp, Artificial Sequence
  chemically synthesized
tcagggctctaaagacatac

SEQ ID NO: 450217 - DNA, 20 bp, Artificial Sequence
  chemically synthesized
actttatcctagtatgtctt

SEQ ID NO: 450218 - DNA, 20 bp, Artificial Sequence
  chemically synthesized
tttatcctagtatgtcttta

SEQ ID NO: 450219 - DNA, 20 bp, Artificial Sequence
  chemically synthesized
atatttatatcagggctcta

SEQ ID NO: 450220 - DNA, 20 bp, Artificial Sequence
  chemically synthesized
tatcatatatatttatatca

SEQ ID NO: 450221 - DNA, 20 bp, Artificial Sequence
  chemically synthesized
atatcatatatatttatatc

SEQ ID NO: 450222 - DNA, 20 bp, Artificial Sequence
  chemically synthesized
aatatcatatatatttatat

SEQ ID NO: 450223 - DNA, 20 bp, Artificial Sequence
  chemically synthesized
ataaatatatatgatattcc

SEQ ID NO: 450224 - DNA, 20 bp, Artificial Sequence
  chemically synthesized
atgatgaaagcaaagggtct

SEQ ID NO: 450225 - DNA, 20 bp, Artificial Sequence
  chemically synthesized
tgtaaaatgatgaaagcaaa

SEQ ID NO: 450226 - DNA, 20 bp, Artificial Sequence
  chemically synthesized
gtgtaaaatgatgaaagcaa

SEQ ID NO: 450227 - DNA, 20 bp, Artificial Sequence
  chemically synthesized
tgtgtaaaatgatgaaagca

SEQ ID NO: 450228 - DNA, 20 bp, Artificial Sequence
  chemically synthesized
gtgactgtgtaaaatgatga

SEQ ID NO: 450229 - DNA, 20 bp, Artificial Sequence
  chemically synthesized
tttgctttcatcattttaca

SEQ ID NO: 450230 - DNA, 20 bp, Artificial Sequence
  chemically synthesized
attttacacagtcactccta

SEQ ID NO: 450231 - DNA, 20 bp, Artificial Sequence
  chemically synthesized
ttacacagtcactcctacag

SEQ ID NO: 450232 - DNA, 20 bp, Artificial Sequence
  chemically synthesized
tatgaggaaagcttctgtag

SEQ ID NO: 450233 - DNA, 20 bp, Artificial Sequence
  chemically synthesized
gttatgaggaaagcttctgt

SEQ ID NO: 450234 - DNA, 20 bp, Artificial Sequence
  chemically synthesized
agttatgaggaaagcttctg

SEQ ID NO: 450235 - DNA, 20 bp, Artificial Sequence
  chemically synthesized
tgatcctacagttatgagga

SEQ ID NO: 450236 - DNA, 20 bp, Artificial Sequence
  chemically synthesized
cagatgatcctacagttatg

SEQ ID NO: 450237 - DNA, 20 bp, Artificial Sequence
  chemically synthesized
agaagctttcctcataactg

SEQ ID NO: 450238 - DNA, 20 bp, Artificial Sequence
  chemically synthesized
gcagatgatcctacagttat

SEQ ID NO: 450239 - DNA, 20 bp, Artificial Sequence
  chemically synthesized
gaagctttcctcataactgt

SEQ ID NO: 450240 - DNA, 20 bp, Artificial Sequence
  chemically synthesized
atcagcggcagatgatccta

SEQ ID NO: 450241 - DNA, 20 bp, Artificial Sequence
  chemically synthesized
gtaggatcatctgccgctga

SEQ ID NO: 450242 - DNA, 20 bp, Artificial Sequence
  chemically synthesized
tccgaacaaaccatcagcgg

SEQ ID NO: 450243 - DNA, 20 bp, Artificial Sequence
  chemically synthesized
agatccgaacaaaccatcag

SEQ ID NO: 450244 - DNA, 20 bp, Artificial Sequence
  chemically synthesized
ttaagatccgaacaaaccat

SEQ ID NO: 450245 - DNA, 20 bp, Artificial Sequence
  chemically synthesized
tctgccgctgatggtttgtt

SEQ ID NO: 450246 - DNA, 20 bp, Artificial Sequence
  chemically synthesized
atgtactacataagacaatt

SEQ ID NO: 450247 - DNA, 20 bp, Artificial Sequence
  chemically synthesized
cggatcttaattgtcttatg

SEQ ID NO: 450248 - DNA, 20 bp, Artificial Sequence
  chemically synthesized
taattgagtatgtactacat

SEQ ID NO: 450249 - DNA, 20 bp, Artificial Sequence
  chemically synthesized
ctccagcatgagttttaatt

SEQ ID NO: 450250 - DNA, 20 bp, Artificial Sequence
  chemically synthesized
tactcaattaaaactcatgc

SEQ ID NO: 450251 - DNA, 20 bp, Artificial Sequence
  chemically synthesized
ctcaattaaaactcatgctg

SEQ ID NO: 450252 - DNA, 20 bp, Artificial Sequence
  chemically synthesized
agacagtcctgctccagcat

SEQ ID NO: 450253 - DNA, 20 bp, Artificial Sequence
  chemically synthesized
aattaaaactcatgctggag

SEQ ID NO: 450254 - DNA, 20 bp, Artificial Sequence
  chemically synthesized
attaaaactcatgctggagc

SEQ ID NO: 450255 - DNA, 20 bp, Artificial Sequence
  chemically synthesized
aagtctagacagtcctgctc

SEQ ID NO: 450256 - DNA, 20 bp, Artificial Sequence
  chemically synthesized
catgctggagcaggactgtc

SEQ ID NO: 450257 - DNA, 20 bp, Artificial Sequence
  chemically synthesized
agcagttaccaaagtctaga

SEQ ID NO: 450258 - DNA, 20 bp, Artificial Sequence
  chemically synthesized
gagcaggactgtctagactt

SEQ ID NO: 450259 - DNA, 20 bp, Artificial Sequence
  chemically synthesized
aataagcagttaccaaagtc

SEQ ID NO: 450260 - DNA, 20 bp, Artificial Sequence
  chemically synthesized
tatttaataagcagttacca

SEQ ID NO: 450261 - DNA, 20 bp, Artificial Sequence
  chemically synthesized
catcttaactatttaataag

SEQ ID NO: 450262 - DNA, 20 bp, Artificial Sequence
  chemically synthesized
tttggtaactgcttattaaa

SEQ ID NO: 450263 - DNA, 20 bp, Artificial Sequence
  chemically synthesized
caacatcttaactatttaat

SEQ ID NO: 450264 - DNA, 20 bp, Artificial Sequence
  chemically synthesized
taactgcttattaaatagtt

SEQ ID NO: 450265 - DNA, 20 bp, Artificial Sequence
  chemically synthesized
aaatagttaagatgttgtat

SEQ ID NO: 450266 - DNA, 20 bp, Artificial Sequence
  chemically synthesized
aatagttaagatgttgtatg

SEQ ID NO: 450267 - DNA, 20 bp, Artificial Sequence
  chemically synthesized
tagttaagatgttgtatgag

SEQ ID NO: 450268 - DNA, 20 bp, Artificial Sequence
  chemically synthesized
taagatgttgtatgaggagc

SEQ ID NO: 450269 - DNA, 20 bp, Artificial Sequence
  chemically synthesized
atgaggagcaagtgacaaat

SEQ ID NO: 450270 - DNA, 20 bp, Artificial Sequence
  chemically synthesized
acaaattagcaaacatatat

SEQ ID NO: 450271 - DNA, 20 bp, Artificial Sequence
  chemically synthesized
caaattagcaaacatatatg

SEQ ID NO: 450272 - DNA, 20 bp, Artificial Sequence
  chemically synthesized
atatatgaggctttgaataa

SEQ ID NO: 450273 - DNA, 20 bp, Artificial Sequence
  chemically synthesized
attactctggctgttattca

SEQ ID NO: 450274 - DNA, 20 bp, Artificial Sequence
  chemically synthesized
atgaggctttgaataacagc

SEQ ID NO: 450275 - DNA, 20 bp, Artificial Sequence
  chemically synthesized
gaggctttgaataacagcca

SEQ ID NO: 450276 - DNA, 20 bp, Artificial Sequence
  chemically synthesized
aattcagcctggtattactc

SEQ ID NO: 450277 - DNA, 20 bp, Artificial Sequence
  chemically synthesized
aataacagccagagtaatac

SEQ ID NO: 450278 - DNA, 20 bp, Artificial Sequence
  chemically synthesized
ataacagccagagtaatacc

SEQ ID NO: 450279 - DNA, 20 bp, Artificial Sequence
  chemically synthesized
acatggtaattaattcagcc

SEQ ID NO: 450280 - DNA, 20 bp, Artificial Sequence
  chemically synthesized
atttaacatggtaattaatt

SEQ ID NO: 450281 - DNA, 20 bp, Artificial Sequence
  chemically synthesized
cattctgcatatatttaaca

SEQ ID NO: 450282 - DNA, 20 bp, Artificial Sequence
  chemically synthesized
attaccatgttaaatatatg

SEQ ID NO: 450283 - DNA, 20 bp, Artificial Sequence
  chemically synthesized
catgttaaatatatgcagaa

SEQ ID NO: 450284 - DNA, 20 bp, Artificial Sequence
  chemically synthesized
atgttaaatatatgcagaat

SEQ ID NO: 450285 - DNA, 20 bp, Artificial Sequence
  chemically synthesized
agttttgtccatatcatagc

SEQ ID NO: 450286 - DNA, 20 bp, Artificial Sequence
  chemically synthesized
aagttttgtccatatcatag

SEQ ID NO: 450287 - DNA, 20 bp, Artificial Sequence
  chemically synthesized
ataaaatacctgctatgata

SEQ ID NO: 450288 - DNA, 20 bp, Artificial Sequence
  chemically synthesized
gataagttttgtccatatca

SEQ ID NO: 450289 - DNA, 20 bp, Artificial Sequence
  chemically synthesized
tcaaacaagtatattaagat

SEQ ID NO: 450290 - DNA, 20 bp, Artificial Sequence
  chemically synthesized
catcttcaaacaagtatatt

SEQ ID NO: 450291 - DNA, 20 bp, Artificial Sequence
  chemically synthesized
tatcttaatatacttgtttg

SEQ ID NO: 450292 - DNA, 20 bp, Artificial Sequence
  chemically synthesized
ggaagcgcccatcttcaaac

SEQ ID NO: 450293 - DNA, 20 bp, Artificial Sequence
  chemically synthesized
ttaatatacttgtttgaaga

SEQ ID NO: 450294 - DNA, 20 bp, Artificial Sequence
  chemically synthesized
taatatacttgtttgaagat

SEQ ID NO: 450295 - DNA, 20 bp, Artificial Sequence
  chemically synthesized
tttgaagatgggcgcttcca

SEQ ID NO: 450296 - DNA, 20 bp, Artificial Sequence
  chemically synthesized
ttgaagatgggcgcttccaa

SEQ ID NO: 450297 - DNA, 20 bp, Artificial Sequence
  chemically synthesized
aagatgggcgcttccaaagg

SEQ ID NO: 450298 - DNA, 20 bp, Artificial Sequence
  chemically synthesized
tgctcatgagcttcctttgg

SEQ ID NO: 450299 - DNA, 20 bp, Artificial Sequence
  chemically synthesized
atatgctcatgagcttcctt

SEQ ID NO: 450300 - DNA, 20 bp, Artificial Sequence
  chemically synthesized
cgcttccaaaggaagctcat

SEQ ID NO: 450301 - DNA, 20 bp, Artificial Sequence
  chemically synthesized
gtaaagcgccatatgctcat

SEQ ID NO: 450302 - DNA, 20 bp, Artificial Sequence
  chemically synthesized
aaaggaagctcatgagcata

SEQ ID NO: 450303 - DNA, 20 bp, Artificial Sequence
  chemically synthesized
aattttttaaacgcacagta

SEQ ID NO: 450304 - DNA, 20 bp, Artificial Sequence
  chemically synthesized
agcacaattttttaaacgca

SEQ ID NO: 450305 - DNA, 20 bp, Artificial Sequence
  chemically synthesized
actaggacaaaacatgtttt

SEQ ID NO: 450306 - DNA, 20 bp, Artificial Sequence
  chemically synthesized
gctaaaaacatgttttgtcc

SEQ ID NO: 450307 - DNA, 20 bp, Artificial Sequence
  chemically synthesized
tttttaaaaaaacatttact

SEQ ID NO: 450308 - DNA, 20 bp, Artificial Sequence
  chemically synthesized
atttttaaaaaaacatttac

SEQ ID NO: 450309 - DNA, 20 bp, Artificial Sequence
  chemically synthesized
agtaaatgtttttttaaaaa

SEQ ID NO: 450310 - DNA, 20 bp, Artificial Sequence
  chemically synthesized
taaaaatagactttgttttt

SEQ ID NO: 450311 - DNA, 20 bp, Artificial Sequence
  chemically synthesized
taaaactcctctaaaaaaca

SEQ ID NO: 450312 - DNA, 20 bp, Artificial Sequence
  chemically synthesized
aaaatagactttgtttttta

SEQ ID NO: 450313 - DNA, 20 bp, Artificial Sequence
  chemically synthesized
aaatagactttgttttttag

SEQ ID NO: 450314 - DNA, 20 bp, Artificial Sequence
  chemically synthesized
atagactttgttttttagag

SEQ ID NO: 450315 - DNA, 20 bp, Artificial Sequence
  chemically synthesized
ttagaggagttttacgttca

SEQ ID NO: 450316 - DNA, 20 bp, Artificial Sequence
  chemically synthesized
gaggagttttacgttcacag

SEQ ID NO: 450317 - DNA, 20 bp, Artificial Sequence
  chemically synthesized
aggagttttacgttcacagc

SEQ ID NO: 450318 - DNA, 20 bp, Artificial Sequence
  chemically synthesized
tttacgttcacagcaggact

SEQ ID NO: 450319 - DNA, 20 bp, Artificial Sequence
  chemically synthesized
acgttcacagcaggactaag

SEQ ID NO: 450320 - DNA, 20 bp, Artificial Sequence
  chemically synthesized
ttcacagcaggactaagtgg

SEQ ID NO: 450321 - DNA, 20 bp, Artificial Sequence
  chemically synthesized
tcacagcaggactaagtgga

SEQ ID NO: 450322 - DNA, 20 bp, Artificial Sequence
  chemically synthesized
aaacctctcttccttccact

SEQ ID NO: 450323 - DNA, 20 bp, Artificial Sequence
  chemically synthesized
cagcaggactaagtggaagg

SEQ ID NO: 450324 - DNA, 20 bp, Artificial Sequence
  chemically synthesized
gcaggactaagtggaaggaa

SEQ ID NO: 450325 - DNA, 20 bp, Artificial Sequence
  chemically synthesized
aggactaagtggaaggaaga

SEQ ID NO: 450326 - DNA, 20 bp, Artificial Sequence
  chemically synthesized
ggactaagtggaaggaagag

SEQ ID NO: 450327 - DNA, 20 bp, Artificial Sequence
  chemically synthesized
cgtagggctagatggtatat

SEQ ID NO: 450328 - DNA, 20 bp, Artificial Sequence
  chemically synthesized
gaggtttctcatataccatc

SEQ ID NO: 450329 - DNA, 20 bp, Artificial Sequence
  chemically synthesized
tgtatgttcgtagggctaga

SEQ ID NO: 450330 - DNA, 20 bp, Artificial Sequence
  chemically synthesized
aagctgtatgttcgtagggc

SEQ ID NO: 450331 - DNA, 20 bp, Artificial Sequence
  chemically synthesized
ggggaagctgtatgttcgta

SEQ ID NO: 450332 - DNA, 20 bp, Artificial Sequence
  chemically synthesized
gggggaagctgtatgttcgt

SEQ ID NO: 450333 - DNA, 20 bp, Artificial Sequence
  chemically synthesized
tgggggaagctgtatgttcg

SEQ ID NO: 450334 - DNA, 20 bp, Artificial Sequence
  chemically synthesized
catctagccctacgaacata

SEQ ID NO: 450335 - DNA, 20 bp, Artificial Sequence
  chemically synthesized
tgaagttttgatggtggggg

SEQ ID NO: 450336 - DNA, 20 bp, Artificial Sequence
  chemically synthesized
gtatgaagttttgatggtgg

SEQ ID NO: 450337 - DNA, 20 bp, Artificial Sequence
  chemically synthesized
ggtatgaagttttgatggtg

SEQ ID NO: 450338 - DNA, 20 bp, Artificial Sequence
  chemically synthesized
tggtatgaagttttgatggt

SEQ ID NO: 450339 - DNA, 20 bp, Artificial Sequence
  chemically synthesized
gtggtatgaagttttgatgg

SEQ ID NO: 450340 - DNA, 20 bp, Artificial Sequence
  chemically synthesized
attgtggtatgaagttttga

SEQ ID NO: 450341 - DNA, 20 bp, Artificial Sequence
  chemically synthesized
taacataccattgtggtatg

SEQ ID NO: 450342 - DNA, 20 bp, Artificial Sequence
  chemically synthesized
atcaaaacttcataccacaa

SEQ ID NO: 450343 - DNA, 20 bp, Artificial Sequence
  chemically synthesized
tcaattgtaacataccattg

SEQ ID NO: 450344 - DNA, 20 bp, Artificial Sequence
  chemically synthesized
aatggtatgttacaattgat

SEQ ID NO: 450345 - DNA, 20 bp, Artificial Sequence
  chemically synthesized
ggctgacattgtatcaatgt

SEQ ID NO: 450346 - DNA, 20 bp, Artificial Sequence
  chemically synthesized
tggctgacattgtatcaatg

SEQ ID NO: 450347 - DNA, 20 bp, Artificial Sequence
  chemically synthesized
agcctacattgatacaatgt

SEQ ID NO: 450348 - DNA, 20 bp, Artificial Sequence
  chemically synthesized
cattgatacaatgtcagcca

SEQ ID NO: 450349 - DNA, 20 bp, Artificial Sequence
  chemically synthesized
acaatgtcagccaaagtcca

SEQ ID NO: 450350 - DNA, 20 bp, Artificial Sequence
  chemically synthesized
ctaatgtaatctatggactt

SEQ ID NO: 450351 - DNA, 20 bp, Artificial Sequence
  chemically synthesized
gtgaaacctaatgtaatcta

SEQ ID NO: 450352 - DNA, 20 bp, Artificial Sequence
  chemically synthesized
ccaaagtccatagattacat

SEQ ID NO: 450353 - DNA, 20 bp, Artificial Sequence
  chemically synthesized
caaagtccatagattacatt

SEQ ID NO: 450354 - DNA, 20 bp, Artificial Sequence
  chemically synthesized
agattacattaggtttcact

SEQ ID NO: 450355 - DNA, 20 bp, Artificial Sequence
  chemically synthesized
cctatagcatgtacaacact

SEQ ID NO: 450356 - DNA, 20 bp, Artificial Sequence
  chemically synthesized
actcagtgttgtacatgcta

SEQ ID NO: 450357 - DNA, 20 bp, Artificial Sequence
  chemically synthesized
ctcagtgttgtacatgctat

SEQ ID NO: 450358 - DNA, 20 bp, Artificial Sequence
  chemically synthesized
tgttgtacatgctataggtt

SEQ ID NO: 450359 - DNA, 20 bp, Artificial Sequence
  chemically synthesized
gttgtacatgctataggttt

SEQ ID NO: 450360 - DNA, 20 bp, Artificial Sequence
  chemically synthesized
tgaatacttgcccaaaccta

SEQ ID NO: 450361 - DNA, 20 bp, Artificial Sequence
  chemically synthesized
tacatgctataggtttgggc

SEQ ID NO: 450362 - DNA, 20 bp, Artificial Sequence
  chemically synthesized
caacgatgtgtccaccacta

SEQ ID NO: 450363 - DNA, 20 bp, Artificial Sequence
  chemically synthesized
cctgtatgattctatagtgg

SEQ ID NO: 450364 - DNA, 20 bp, Artificial Sequence
  chemically synthesized
caacctgtatgattctatag

SEQ ID NO: 450365 - DNA, 20 bp, Artificial Sequence
  chemically synthesized
gttcaacctgtatgattcta

SEQ ID NO: 450366 - DNA, 20 bp, Artificial Sequence
  chemically synthesized
tccaccactatagaatcata

SEQ ID NO: 450367 - DNA, 20 bp, Artificial Sequence
  chemically synthesized
ccaccactatagaatcatac

SEQ ID NO: 450368 - DNA, 20 bp, Artificial Sequence
  chemically synthesized
aattttagatttttagattt

SEQ ID NO: 450369 - DNA, 20 bp, Artificial Sequence
  chemically synthesized
gcatttgaattttagatttt

SEQ ID NO: 450370 - DNA, 20 bp, Artificial Sequence
  chemically synthesized
attttggagcatttgaattt

SEQ ID NO: 450371 - DNA, 20 bp, Artificial Sequence
  chemically synthesized
ttcaaaagttttgaattttg

SEQ ID NO: 450372 - DNA, 20 bp, Artificial Sequence
  chemically synthesized
acttcaaaagttttgaattt

SEQ ID NO: 450373 - DNA, 20 bp, Artificial Sequence
  chemically synthesized
tccaaaattcaaaacttttg

SEQ ID NO: 450374 - DNA, 20 bp, Artificial Sequence
  chemically synthesized
acatcttatcagcacttcaa

SEQ ID NO: 450375 - DNA, 20 bp, Artificial Sequence
  chemically synthesized
aaaacttttgaagtgctgat

SEQ ID NO: 450376 - DNA, 20 bp, Artificial Sequence
  chemically synthesized
atttgctttggacatcttat

SEQ ID NO: 450377 - DNA, 20 bp, Artificial Sequence
  chemically synthesized
aagtgctgataagatgtcca

SEQ ID NO: 450378 - DNA, 20 bp, Artificial Sequence
  chemically synthesized
gctccaatgagcatttgctt

SEQ ID NO: 450379 - DNA, 20 bp, Artificial Sequence
  chemically synthesized
tgtccaaagcaaatgctcat

SEQ ID NO: 450380 - DNA, 20 bp, Artificial Sequence
  chemically synthesized
tccaaagcaaatgctcattg

SEQ ID NO: 450381 - DNA, 20 bp, Artificial Sequence
  chemically synthesized
gaaatccaaaatgctccaat

SEQ ID NO: 450382 - DNA, 20 bp, Artificial Sequence
  chemically synthesized
aaatgctcattggagcattt

SEQ ID NO: 450383 - DNA, 20 bp, Artificial Sequence
  chemically synthesized
cattttggatttcaaatttt

SEQ ID NO: 450384 - DNA, 20 bp, Artificial Sequence
  chemically synthesized
ggatttcaaattttcagatt

SEQ ID NO: 450385 - DNA, 20 bp, Artificial Sequence
  chemically synthesized
gatttcaaattttcagattt

SEQ ID NO: 450386 - DNA, 20 bp, Artificial Sequence
  chemically synthesized
tcagatttgggatgctcaac

SEQ ID NO: 450387 - DNA, 20 bp, Artificial Sequence
  chemically synthesized
atttgggatgctcaactggt

SEQ ID NO: 450388 - DNA, 20 bp, Artificial Sequence
  chemically synthesized
ttacattacacttaccagtt

SEQ ID NO: 450389 - DNA, 20 bp, Artificial Sequence
  chemically synthesized
aatatttacattacacttac

SEQ ID NO: 450390 - DNA, 20 bp, Artificial Sequence
  chemically synthesized
tttttttttttggggggggg

SEQ ID NO: 450391 - DNA, 20 bp, Artificial Sequence
  chemically synthesized
ctttttttttttgggggggg

SEQ ID NO: 450392 - DNA, 20 bp, Artificial Sequence
  chemically synthesized
cctttttttttttggggggg

SEQ ID NO: 450393 - DNA, 20 bp, Artificial Sequence
  chemically synthesized
tcctttttttttttgggggg

SEQ ID NO: 450394 - DNA, 20 bp, Artificial Sequence
  chemically synthesized
ttcctttttttttttggggg

SEQ ID NO: 450395 - DNA, 20 bp, Artificial Sequence
  chemically synthesized
tttcctttttttttttgggg

SEQ ID NO: 450396 - DNA, 20 bp, Artificial Sequence
  chemically synthesized
atttcctttttttttttggg

SEQ ID NO: 450397 - DNA, 20 bp, Artificial Sequence
  chemically synthesized
gatttcctttttttttttgg

SEQ ID NO: 450398 - DNA, 20 bp, Artificial Sequence
  chemically synthesized
agatttcctttttttttttg

SEQ ID NO: 450399 - DNA, 20 bp, Artificial Sequence
  chemically synthesized
cagatttccttttttttttt

SEQ ID NO: 450400 - DNA, 20 bp, Artificial Sequence
  chemically synthesized
tcagatttcctttttttttt

SEQ ID NO: 450401 - DNA, 20 bp, Artificial Sequence
  chemically synthesized
cccccccccccaaaaaaaaa

SEQ ID NO: 450402 - DNA, 20 bp, Artificial Sequence
  chemically synthesized
ccccccccccaaaaaaaaaa

SEQ ID NO: 450403 - DNA, 20 bp, Artificial Sequence
  chemically synthesized
gcttgcgaccagaagtgttt

SEQ ID NO: 450404 - DNA, 20 bp, Artificial Sequence
  chemically synthesized
aaggaaatctgaaacacttc

SEQ ID NO: 450405 - DNA, 20 bp, Artificial Sequence
  chemically synthesized
tccgaaatgcttgcgaccag

SEQ ID NO: 450406 - DNA, 20 bp, Artificial Sequence
  chemically synthesized
tctgaaacacttctggtcgc

SEQ ID NO: 450407 - DNA, 20 bp, Artificial Sequence
  chemically synthesized
ttatccgaaatgcttgcgac

SEQ ID NO: 450408 - DNA, 20 bp, Artificial Sequence
  chemically synthesized
acttctggtcgcaagcattt

SEQ ID NO: 450409 - DNA, 20 bp, Artificial Sequence
  chemically synthesized
aatatataatcactgcctta

SEQ ID NO: 450410 - DNA, 20 bp, Artificial Sequence
  chemically synthesized
attacagaagatctttaagg

SEQ ID NO: 450411 - DNA, 20 bp, Artificial Sequence
  chemically synthesized
cagattacagaagatcttta

SEQ ID NO: 450412 - DNA, 20 bp, Artificial Sequence
  chemically synthesized
acagattacagaagatcttt

SEQ ID NO: 450413 - DNA, 20 bp, Artificial Sequence
  chemically synthesized
aatgtatagacagattacag

SEQ ID NO: 450414 - DNA, 20 bp, Artificial Sequence
  chemically synthesized
tggaatgtatagacagatta

SEQ ID NO: 450415 - DNA, 20 bp, Artificial Sequence
  chemically synthesized
caggaggtggaatgtataga

SEQ ID NO: 450416 - DNA, 20 bp, Artificial Sequence
  chemically synthesized
gcggcaggaggtggaatgta

SEQ ID NO: 450417 - DNA, 20 bp, Artificial Sequence
  chemically synthesized
ccaggggttgcggcaggagg

SEQ ID NO: 450418 - DNA, 20 bp, Artificial Sequence
  chemically synthesized
ttgccaggggttgcggcagg

SEQ ID NO: 450419 - DNA, 20 bp, Artificial Sequence
  chemically synthesized
gttgccaggggttgcggcag

SEQ ID NO: 450420 - DNA, 20 bp, Artificial Sequence
  chemically synthesized
tggttgccaggggttgcggc

SEQ ID NO: 450421 - DNA, 20 bp, Artificial Sequence
  chemically synthesized
gtggttgccaggggttgcgg

SEQ ID NO: 450422 - DNA, 20 bp, Artificial Sequence
  chemically synthesized
ccacctcctgccgcaacccc

SEQ ID NO: 450423 - DNA, 20 bp, Artificial Sequence
  chemically synthesized
tcagtggttgccaggggttg

SEQ ID NO: 450424 - DNA, 20 bp, Artificial Sequence
  chemically synthesized
gtggtttcagtggttgccag

SEQ ID NO: 450425 - DNA, 20 bp, Artificial Sequence
  chemically synthesized
agtggtttcagtggttgcca

SEQ ID NO: 450426 - DNA, 20 bp, Artificial Sequence
  chemically synthesized
gagtggtttcagtggttgcc

SEQ ID NO: 450427 - DNA, 20 bp, Artificial Sequence
  chemically synthesized
tgagtggtttcagtggttgc

SEQ ID NO: 450428 - DNA, 20 bp, Artificial Sequence
  chemically synthesized
aaacagatgagtggtttcag

SEQ ID NO: 450429 - DNA, 20 bp, Artificial Sequence
  chemically synthesized
agtaaacagatgagtggttt

SEQ ID NO: 450430 - DNA, 20 bp, Artificial Sequence
  chemically synthesized
gatcacagtaaacagatgag

SEQ ID NO: 450431 - DNA, 20 bp, Artificial Sequence
  chemically synthesized
tatgatcacagtaaacagat

SEQ ID NO: 450432 - DNA, 20 bp, Artificial Sequence
  chemically synthesized
aaaactatgatcacagtaaa

SEQ ID NO: 450433 - DNA, 20 bp, Artificial Sequence
  chemically synthesized
tcatctgtttactgtgatca

SEQ ID NO: 450434 - DNA, 20 bp, Artificial Sequence
  chemically synthesized
aaatggcaaaactatgatca

SEQ ID NO: 450435 - DNA, 20 bp, Artificial Sequence
  chemically synthesized
gatcatagttttgccatttc

SEQ ID NO: 450436 - DNA, 20 bp, Artificial Sequence
  chemically synthesized
actatgtggcattctagaaa

SEQ ID NO: 450437 - DNA, 20 bp, Artificial Sequence
  chemically synthesized
atttcgactatgtggcattc

SEQ ID NO: 450438 - DNA, 20 bp, Artificial Sequence
  chemically synthesized
gccatttctagaatgccaca

SEQ ID NO: 450439 - DNA, 20 bp, Artificial Sequence
  chemically synthesized
actgttgaatttcgactatg

SEQ ID NO: 450440 - DNA, 20 bp, Artificial Sequence
  chemically synthesized
gccacatagtcgaaattcaa

SEQ ID NO: 450441 - DNA, 20 bp, Artificial Sequence
  chemically synthesized
tgaaagaagctaatttgaaa

SEQ ID NO: 450442 - DNA, 20 bp, Artificial Sequence
  chemically synthesized
agtatgtaaccctttcaaat

SEQ ID NO: 450443 - DNA, 20 bp, Artificial Sequence
  chemically synthesized
gtgaaagaagctaatttgaa

SEQ ID NO: 450444 - DNA, 20 bp, Artificial Sequence
  chemically synthesized
agtgaaagaagctaatttga

SEQ ID NO: 450445 - DNA, 20 bp, Artificial Sequence
  chemically synthesized
tgcatattactaagtgaaag

SEQ ID NO: 450446 - DNA, 20 bp, Artificial Sequence
  chemically synthesized
tcaaattagcttctttcact

SEQ ID NO: 450447 - DNA, 20 bp, Artificial Sequence
  chemically synthesized
aagtgcatattactaagtga

SEQ ID NO: 450448 - DNA, 20 bp, Artificial Sequence
  chemically synthesized
aactgtaagtgcatattact

SEQ ID NO: 450449 - DNA, 20 bp, Artificial Sequence
  chemically synthesized
cacttagtaatatgcactta

SEQ ID NO: 450450 - DNA, 20 bp, Artificial Sequence
  chemically synthesized
aacaaatatgggggaactgt

SEQ ID NO: 450451 - DNA, 20 bp, Artificial Sequence
  chemically synthesized
aaaaagaccaacaaatatgg

SEQ ID NO: 450452 - DNA, 20 bp, Artificial Sequence
  chemically synthesized
aaaaaagaccaacaaatatg

SEQ ID NO: 450453 - DNA, 20 bp, Artificial Sequence
  chemically synthesized
gaaaaaagaccaacaaatat

SEQ ID NO: 450454 - DNA, 20 bp, Artificial Sequence
  chemically synthesized
tacagttcccccatatttgt

SEQ ID NO: 450455 - DNA, 20 bp, Artificial Sequence
  chemically synthesized
tgaaaaaagaccaacaaata

SEQ ID NO: 450456 - DNA, 20 bp, Artificial Sequence
  chemically synthesized
tatttgttggtcttttttca

SEQ ID NO: 450457 - DNA, 20 bp, Artificial Sequence
  chemically synthesized
gagctataaagccatgaaaa

SEQ ID NO: 450458 - DNA, 20 bp, Artificial Sequence
  chemically synthesized
ggtcttttttcatggcttta

SEQ ID NO: 450459 - DNA, 20 bp, Artificial Sequence
  chemically synthesized
gacctttgaaatgagctata

SEQ ID NO: 450460 - DNA, 20 bp, Artificial Sequence
  chemically synthesized
tggctttatagctcatttca

SEQ ID NO: 450461 - DNA, 20 bp, Artificial Sequence
  chemically synthesized
ggctttatagctcatttcaa

SEQ ID NO: 450462 - DNA, 20 bp, Artificial Sequence
  chemically synthesized
ttattcaggacctttgaaat

SEQ ID NO: 450463 - DNA, 20 bp, Artificial Sequence
  chemically synthesized
cagccaatagaatattattc

SEQ ID NO: 450464 - DNA, 20 bp, Artificial Sequence
  chemically synthesized
gcagccaatagaatattatt

SEQ ID NO: 450465 - DNA, 20 bp, Artificial Sequence
  chemically synthesized
ggtcctgaataatattctat

SEQ ID NO: 450466 - DNA, 20 bp, Artificial Sequence
  chemically synthesized
gaacaggtacatgcagccaa

SEQ ID NO: 450467 - DNA, 20 bp, Artificial Sequence
  chemically synthesized
aatgaatgaacaggtacatg

SEQ ID NO: 450468 - DNA, 20 bp, Artificial Sequence
  chemically synthesized
gagtgaatgaatgaatgaac

SEQ ID NO: 450469 - DNA, 20 bp, Artificial Sequence
  chemically synthesized
tgagtgaatgaatgaatgaa

SEQ ID NO: 450470 - DNA, 20 bp, Artificial Sequence
  chemically synthesized
ttcattcattcactcaccta

SEQ ID NO: 450471 - DNA, 20 bp, Artificial Sequence
  chemically synthesized
caagctctccttccataggt

SEQ ID NO: 450472 - DNA, 20 bp, Artificial Sequence
  chemically synthesized
attcattcactcacctatgg

SEQ ID NO: 450473 - DNA, 20 bp, Artificial Sequence
  chemically synthesized
ttcattcactcacctatgga

SEQ ID NO: 450474 - DNA, 20 bp, Artificial Sequence
  chemically synthesized
cattcactcacctatggaag

SEQ ID NO: 450475 - DNA, 20 bp, Artificial Sequence
  chemically synthesized
caatcaagctctccttccat

SEQ ID NO: 450476 - DNA, 20 bp, Artificial Sequence
  chemically synthesized
acaatcaagctctccttcca

SEQ ID NO: 450477 - DNA, 20 bp, Artificial Sequence
  chemically synthesized
ttcactcacctatggaagga

SEQ ID NO: 450478 - DNA, 20 bp, Artificial Sequence
  chemically synthesized
gaccaaacttgtaaacaatc

SEQ ID NO: 450479 - DNA, 20 bp, Artificial Sequence
  chemically synthesized
aggagagcttgattgtttac

SEQ ID NO: 450480 - DNA, 20 bp, Artificial Sequence
  chemically synthesized
agcttgattgtttacaagtt

SEQ ID NO: 450481 - DNA, 20 bp, Artificial Sequence
  chemically synthesized
taattataaatatttgcact

SEQ ID NO: 450482 - DNA, 20 bp, Artificial Sequence
  chemically synthesized
aattataaatatttgcactc

SEQ ID NO: 450483 - DNA, 20 bp, Artificial Sequence
  chemically synthesized
acatatccacacaaaaacct

SEQ ID NO: 450484 - DNA, 20 bp, Artificial Sequence
  chemically synthesized
tttgcactcaggtttttgtg

SEQ ID NO: 450485 - DNA, 20 bp, Artificial Sequence
  chemically synthesized
tttttgtgtggatatgtttt

SEQ ID NO: 450486 - DNA, 20 bp, Artificial Sequence
  chemically synthesized
ggatatgttttaagcttatc

SEQ ID NO: 450487 - DNA, 20 bp, Artificial Sequence
  chemically synthesized
gatatgttttaagcttatct

SEQ ID NO: 450488 - DNA, 20 bp, Artificial Sequence
  chemically synthesized
tccttggtatttacccagat

SEQ ID NO: 450489 - DNA, 20 bp, Artificial Sequence
  chemically synthesized
tgtactccttggtatttacc

SEQ ID NO: 450490 - DNA, 20 bp, Artificial Sequence
  chemically synthesized
agcttatctgggtaaatacc

SEQ ID NO: 450491 - DNA, 20 bp, Artificial Sequence
  chemically synthesized
gcttatctgggtaaatacca

SEQ ID NO: 450492 - DNA, 20 bp, Artificial Sequence
  chemically synthesized
ttatctgggtaaataccaag

SEQ ID NO: 450493 - DNA, 20 bp, Artificial Sequence
  chemically synthesized
gatctagcaattgtactcct

SEQ ID NO: 450494 - DNA, 20 bp, Artificial Sequence
  chemically synthesized
ataccaaggagtacaattgc

SEQ ID NO: 450495 - DNA, 20 bp, Artificial Sequence
  chemically synthesized
cacacacttatcatatgatc

SEQ ID NO: 450496 - DNA, 20 bp, Artificial Sequence
  chemically synthesized
caattgctagatcatatgat

SEQ ID NO: 450497 - DNA, 20 bp, Artificial Sequence
  chemically synthesized
tcatatgataagtgtgtgtt

SEQ ID NO: 450498 - DNA, 20 bp, Artificial Sequence
  chemically synthesized
aagtgtgtgtttagttttgt

SEQ ID NO: 450499 - DNA, 20 bp, Artificial Sequence
  chemically synthesized
ctctttggaaaacaatttgg

SEQ ID NO: 450500 - DNA, 20 bp, Artificial Sequence
  chemically synthesized
agcctctttggaaaacaatt

SEQ ID NO: 450501 - DNA, 20 bp, Artificial Sequence
  chemically synthesized
aactgccaaattgttttcca

SEQ ID NO: 450502 - DNA, 20 bp, Artificial Sequence
  chemically synthesized
ctgccaaattgttttccaaa

SEQ ID NO: 450503 - DNA, 20 bp, Artificial Sequence
  chemically synthesized
tgccaaattgttttccaaag

SEQ ID NO: 450504 - DNA, 20 bp, Artificial Sequence
  chemically synthesized
gcaaaagggtacagcctctt

SEQ ID NO: 450505 - DNA, 20 bp, Artificial Sequence
  chemically synthesized
ggtgggaatgcaaaagggta

SEQ ID NO: 450506 - DNA, 20 bp, Artificial Sequence
  chemically synthesized
ttgctggtgggaatgcaaaa

SEQ ID NO: 450507 - DNA, 20 bp, Artificial Sequence
  chemically synthesized
attgctggtgggaatgcaaa

SEQ ID NO: 450508 - DNA, 20 bp, Artificial Sequence
  chemically synthesized
cattgctggtgggaatgcaa

SEQ ID NO: 450509 - DNA, 20 bp, Artificial Sequence
  chemically synthesized
gtacccttttgcattcccac

SEQ ID NO: 450510 - DNA, 20 bp, Artificial Sequence
  chemically synthesized
aaatctctttcattgctggt

SEQ ID NO: 450511 - DNA, 20 bp, Artificial Sequence
  chemically synthesized
aaaatctctttcattgctgg

SEQ ID NO: 450512 - DNA, 20 bp, Artificial Sequence
  chemically synthesized
tgcattcccaccagcaatga

SEQ ID NO: 450513 - DNA, 20 bp, Artificial Sequence
  chemically synthesized
aacaaaatctctttcattgc

SEQ ID NO: 450514 - DNA, 20 bp, Artificial Sequence
  chemically synthesized
cattcccaccagcaatgaaa

SEQ ID NO: 450515 - DNA, 20 bp, Artificial Sequence
  chemically synthesized
gattttgttgttacataacc

SEQ ID NO: 450516 - DNA, 20 bp, Artificial Sequence
  chemically synthesized
ttgttgttacataacctggt

SEQ ID NO: 450517 - DNA, 20 bp, Artificial Sequence
  chemically synthesized
gacaacatcaaatgctgacc

SEQ ID NO: 450518 - DNA, 20 bp, Artificial Sequence
  chemically synthesized
tgacaacatcaaatgctgac

SEQ ID NO: 450519 - DNA, 20 bp, Artificial Sequence
  chemically synthesized
tggtcagcatttgatgttgt

SEQ ID NO: 450520 - DNA, 20 bp, Artificial Sequence
  chemically synthesized
atttgatgttgtcagtgttt

SEQ ID NO: 450521 - DNA, 20 bp, Artificial Sequence
  chemically synthesized
gttgtcagtgttttggattt

SEQ ID NO: 450522 - DNA, 20 bp, Artificial Sequence
  chemically synthesized
ttttggattttggccattct

SEQ ID NO: 450523 - DNA, 20 bp, Artificial Sequence
  chemically synthesized
ttggattttggccattctaa

SEQ ID NO: 450524 - DNA, 20 bp, Artificial Sequence
  chemically synthesized
tggattttggccattctaag

SEQ ID NO: 450525 - DNA, 20 bp, Artificial Sequence
  chemically synthesized
ctgttaagcacctcttagaa

SEQ ID NO: 450526 - DNA, 20 bp, Artificial Sequence
  chemically synthesized
tttacctgttaagcacctct

SEQ ID NO: 450527 - DNA, 20 bp, Artificial Sequence
  chemically synthesized
ccattctaagaggtgcttaa

SEQ ID NO: 450528 - DNA, 20 bp, Artificial Sequence
  chemically synthesized
cattctaagaggtgcttaac

SEQ ID NO: 450529 - DNA, 20 bp, Artificial Sequence
  chemically synthesized
cttaaaaatatttacctgtt

SEQ ID NO: 450530 - DNA, 20 bp, Artificial Sequence
  chemically synthesized
cttaacaggtaaatattttt

SEQ ID NO: 450531 - DNA, 20 bp, Artificial Sequence
  chemically synthesized
aataatgatgctttcttaaa

SEQ ID NO: 450532 - DNA, 20 bp, Artificial Sequence
  chemically synthesized
tttttaaaatctttttaaga

SEQ ID NO: 450533 - DNA, 20 bp, Artificial Sequence
  chemically synthesized
aatttttttaaaatcttttt

SEQ ID NO: 450534 - DNA, 20 bp, Artificial Sequence
  chemically synthesized
agattttaaaaaaattcttc

SEQ ID NO: 450535 - DNA, 20 bp, Artificial Sequence
  chemically synthesized
taaaaaaattcttcaagaat

SEQ ID NO: 450536 - DNA, 20 bp, Artificial Sequence
  chemically synthesized
gagtgtgtcgctgattcttg

SEQ ID NO: 450537 - DNA, 20 bp, Artificial Sequence
  chemically synthesized
gttcagtatttggattttag

SEQ ID NO: 450538 - DNA, 20 bp, Artificial Sequence
  chemically synthesized
ctgttcagtatttggatttt

SEQ ID NO: 450539 - DNA, 20 bp, Artificial Sequence
  chemically synthesized
cctgttcagtatttggattt

SEQ ID NO: 450540 - DNA, 20 bp, Artificial Sequence
  chemically synthesized
atgcactcctgttcagtatt

SEQ ID NO: 450541 - DNA, 20 bp, Artificial Sequence
  chemically synthesized
cctaaaatccaaatactgaa

SEQ ID NO: 450542 - DNA, 20 bp, Artificial Sequence
  chemically synthesized
ctaaaatccaaatactgaac

SEQ ID NO: 450543 - DNA, 20 bp, Artificial Sequence
  chemically synthesized
aaaatccaaatactgaacag

SEQ ID NO: 450544 - DNA, 20 bp, Artificial Sequence
  chemically synthesized
tgtgaacatgcactcctgtt

SEQ ID NO: 450545 - DNA, 20 bp, Artificial Sequence
  chemically synthesized
gagtgcatgttcacattctc

SEQ ID NO: 450546 - DNA, 20 bp, Artificial Sequence
  chemically synthesized
catgttcacattctccagtc

SEQ ID NO: 450547 - DNA, 20 bp, Artificial Sequence
  chemically synthesized
actgaaaagtaactggactg

SEQ ID NO: 450548 - DNA, 20 bp, Artificial Sequence
  chemically synthesized
ttactgaaaagtaactggac

SEQ ID NO: 450549 - DNA, 20 bp, Artificial Sequence
  chemically synthesized
ctatgttactgaaaagtaac

SEQ ID NO: 450550 - DNA, 20 bp, Artificial Sequence
  chemically synthesized
tctccagtccagttactttt

SEQ ID NO: 450551 - DNA, 20 bp, Artificial Sequence
  chemically synthesized
ctgttgtctatgttactgaa

SEQ ID NO: 450552 - DNA, 20 bp, Artificial Sequence
  chemically synthesized
ccagttacttttcagtaaca

SEQ ID NO: 450553 - DNA, 20 bp, Artificial Sequence
  chemically synthesized
cttttcagtaacatagacaa

SEQ ID NO: 450554 - DNA, 20 bp, Artificial Sequence
  chemically synthesized
cttgaagatttttagtaggg

SEQ ID NO: 450555 - DNA, 20 bp, Artificial Sequence
  chemically synthesized
tcacttgaagatttttagta

SEQ ID NO: 450556 - DNA, 20 bp, Artificial Sequence
  chemically synthesized
atcacttgaagatttttagt

SEQ ID NO: 450557 - DNA, 20 bp, Artificial Sequence
  chemically synthesized
catcacttgaagatttttag

SEQ ID NO: 450558 - DNA, 20 bp, Artificial Sequence
  chemically synthesized
acacatcacttgaagatttt

SEQ ID NO: 450559 - DNA, 20 bp, Artificial Sequence
  chemically synthesized
ctgccctactaaaaatcttc

SEQ ID NO: 450560 - DNA, 20 bp, Artificial Sequence
  chemically synthesized
ttttgagaacacatcacttg

SEQ ID NO: 450561 - DNA, 20 bp, Artificial Sequence
  chemically synthesized
taattctctgatgatgtttt

SEQ ID NO: 450562 - DNA, 20 bp, Artificial Sequence
  chemically synthesized
atgtgttctcaaaacatcat

SEQ ID NO: 450563 - DNA, 20 bp, Artificial Sequence
  chemically synthesized
gtgttctcaaaacatcatca

SEQ ID NO: 450564 - DNA, 20 bp, Artificial Sequence
  chemically synthesized
catcatcagagaattaaaat

SEQ ID NO: 450565 - DNA, 20 bp, Artificial Sequence
  chemically synthesized
tcagagaattaaaattagcg

SEQ ID NO: 450566 - DNA, 20 bp, Artificial Sequence
  chemically synthesized
gaattaaaattagcgaagac

SEQ ID NO: 450567 - DNA, 20 bp, Artificial Sequence
  chemically synthesized
attaaaattagcgaagacaa

SEQ ID NO: 450568 - DNA, 20 bp, Artificial Sequence
  chemically synthesized
aaggtatctatttgattcag

SEQ ID NO: 450569 - DNA, 20 bp, Artificial Sequence
  chemically synthesized
aaaggtatctatttgattca

SEQ ID NO: 450570 - DNA, 20 bp, Artificial Sequence
  chemically synthesized
ataataacctctgaatcaaa

SEQ ID NO: 450571 - DNA, 20 bp, Artificial Sequence
  chemically synthesized
taaaaggtatctatttgatt

SEQ ID NO: 450572 - DNA, 20 bp, Artificial Sequence
  chemically synthesized
aatcaaatagatacctttta

SEQ ID NO: 450573 - DNA, 20 bp, Artificial Sequence
  chemically synthesized
atcaaatagataccttttaa

SEQ ID NO: 450574 - DNA, 20 bp, Artificial Sequence
  chemically synthesized
tcaaatagataccttttaaa

SEQ ID NO: 450575 - DNA, 20 bp, Artificial Sequence
  chemically synthesized
gtaatgactatccctttaaa

SEQ ID NO: 450576 - DNA, 20 bp, Artificial Sequence
  chemically synthesized
agtaatgactatccctttaa

SEQ ID NO: 450577 - DNA, 20 bp, Artificial Sequence
  chemically synthesized
atagataccttttaaaggga

SEQ ID NO: 450578 - DNA, 20 bp, Artificial Sequence
  chemically synthesized
atcttctctatattttgtaa

SEQ ID NO: 450579 - DNA, 20 bp, Artificial Sequence
  chemically synthesized
gtcattactgttacaaaata

SEQ ID NO: 450580 - DNA, 20 bp, Artificial Sequence
  chemically synthesized
cattactgttacaaaatata

SEQ ID NO: 450581 - DNA, 20 bp, Artificial Sequence
  chemically synthesized
tactgttacaaaatatagag

SEQ ID NO: 450582 - DNA, 20 bp, Artificial Sequence
  chemically synthesized
atttatgtaaatataatagc

SEQ ID NO: 450583 - DNA, 20 bp, Artificial Sequence
  chemically synthesized
taatatttatgtaaatataa

SEQ ID NO: 450584 - DNA, 20 bp, Artificial Sequence
  chemically synthesized
tatatttacataaatattat

SEQ ID NO: 450585 - DNA, 20 bp, Artificial Sequence
  chemically synthesized
atatttacataaatattatt

SEQ ID NO: 450586 - DNA, 20 bp, Artificial Sequence
  chemically synthesized
ttctcagtgaggcatttgat

SEQ ID NO: 450587 - DNA, 20 bp, Artificial Sequence
  chemically synthesized
aactcatcaaatgcctcact

SEQ ID NO: 450588 - DNA, 20 bp, Artificial Sequence
  chemically synthesized
tactttttaaattctcagtg

SEQ ID NO: 450589 - DNA, 20 bp, Artificial Sequence
  chemically synthesized
atactttttaaattctcagt

SEQ ID NO: 450590 - DNA, 20 bp, Artificial Sequence
  chemically synthesized
caaaatactttttaaattct

SEQ ID NO: 450591 - DNA, 20 bp, Artificial Sequence
  chemically synthesized
tgcctcactgagaatttaaa

SEQ ID NO: 450592 - DNA, 20 bp, Artificial Sequence
  chemically synthesized
atttaaaaagtattttgtat

SEQ ID NO: 450593 - DNA, 20 bp, Artificial Sequence
  chemically synthesized
tttgtatcagctttatataa

SEQ ID NO: 450594 - DNA, 20 bp, Artificial Sequence
  chemically synthesized
ttttgataggcttttatata

SEQ ID NO: 450595 - DNA, 20 bp, Artificial Sequence
  chemically synthesized
tttatataaaagcctatcaa

SEQ ID NO: 450596 - DNA, 20 bp, Artificial Sequence
  chemically synthesized
aatcccatttcacttttgat

SEQ ID NO: 450597 - DNA, 20 bp, Artificial Sequence
  chemically synthesized
taatcccatttcacttttga

SEQ ID NO: 450598 - DNA, 20 bp, Artificial Sequence
  chemically synthesized
aaagcctatcaaaagtgaaa

SEQ ID NO: 450599 - DNA, 20 bp, Artificial Sequence
  chemically synthesized
aagcctatcaaaagtgaaat

SEQ ID NO: 450600 - DNA, 20 bp, Artificial Sequence
  chemically synthesized
gaatgaataagaatgtgtaa

SEQ ID NO: 450601 - DNA, 20 bp, Artificial Sequence
  chemically synthesized
agcaagaaaacagaatgaat

SEQ ID NO: 450602 - DNA, 20 bp, Artificial Sequence
  chemically synthesized
taaagtgatgagcaagaaaa

SEQ ID NO: 450603 - DNA, 20 bp, Artificial Sequence
  chemically synthesized
aattgtataaagtgatgagc

SEQ ID NO: 450604 - DNA, 20 bp, Artificial Sequence
  chemically synthesized
atataattgtataaagtgat

SEQ ID NO: 450605 - DNA, 20 bp, Artificial Sequence
  chemically synthesized
taaaaatatataattgtata

SEQ ID NO: 450606 - DNA, 20 bp, Artificial Sequence
  chemically synthesized
tacaattatatatttttaaa

SEQ ID NO: 450607 - DNA, 20 bp, Artificial Sequence
  chemically synthesized
cgacaaaatacaaaggcaat

SEQ ID NO: 450608 - DNA, 20 bp, Artificial Sequence
  chemically synthesized
ctatcatcgacaaaatacaa

SEQ ID NO: 450609 - DNA, 20 bp, Artificial Sequence
  chemically synthesized
cctatcatcgacaaaataca

SEQ ID NO: 450610 - DNA, 20 bp, Artificial Sequence
  chemically synthesized
cctttgtattttgtcgatga

SEQ ID NO: 450611 - DNA, 20 bp, Artificial Sequence
  chemically synthesized
ctttgtattttgtcgatgat

SEQ ID NO: 450612 - DNA, 20 bp, Artificial Sequence
  chemically synthesized
ttttgtcgatgataggttgt

SEQ ID NO: 450613 - DNA, 20 bp, Artificial Sequence
  chemically synthesized
tttgtcgatgataggttgta

SEQ ID NO: 450614 - DNA, 20 bp, Artificial Sequence
  chemically synthesized
tgataggttgtaaggtactg

SEQ ID NO: 450615 - DNA, 20 bp, Artificial Sequence
  chemically synthesized
ggttgtaaggtactgtagta

SEQ ID NO: 450616 - DNA, 20 bp, Artificial Sequence
  chemically synthesized
tagatgcagcttctgtacta

SEQ ID NO: 450617 - DNA, 20 bp, Artificial Sequence
  chemically synthesized
tgtaaggtactgtagtacag

SEQ ID NO: 450618 - DNA, 20 bp, Artificial Sequence
  chemically synthesized
gagacacacaggcatagatg

SEQ ID NO: 450619 - DNA, 20 bp, Artificial Sequence
  chemically synthesized
gtttaggagacacacaggca

SEQ ID NO: 450620 - DNA, 20 bp, Artificial Sequence
  chemically synthesized
tgactgtttaggagacacac

SEQ ID NO: 450621 - DNA, 20 bp, Artificial Sequence
  chemically synthesized
atgactgtttaggagacaca

SEQ ID NO: 450622 - DNA, 20 bp, Artificial Sequence
  chemically synthesized
atgcctgtgtgtctcctaaa

SEQ ID NO: 450623 - DNA, 20 bp, Artificial Sequence
  chemically synthesized
ttgaatcaatgactgtttag

SEQ ID NO: 450624 - DNA, 20 bp, Artificial Sequence
  chemically synthesized
aattgaatcaatgactgttt

SEQ ID NO: 450625 - DNA, 20 bp, Artificial Sequence
  chemically synthesized
taattgaatcaatgactgtt

SEQ ID NO: 450626 - DNA, 20 bp, Artificial Sequence
  chemically synthesized
attgattcaattaatatttg

SEQ ID NO: 450627 - DNA, 20 bp, Artificial Sequence
  chemically synthesized
atatttgtggacctgttttc

SEQ ID NO: 450628 - DNA, 20 bp, Artificial Sequence
  chemically synthesized
tagcatgatagctggaaaac

SEQ ID NO: 450629 - DNA, 20 bp, Artificial Sequence
  chemically synthesized
ctagcatgatagctggaaaa

SEQ ID NO: 450630 - DNA, 20 bp, Artificial Sequence
  chemically synthesized
ctggaaactagcatgatagc

SEQ ID NO: 450631 - DNA, 20 bp, Artificial Sequence
  chemically synthesized
ctgttttccagctatcatgc

SEQ ID NO: 450632 - DNA, 20 bp, Artificial Sequence
  chemically synthesized
acttctggaaactagcatga

SEQ ID NO: 450633 - DNA, 20 bp, Artificial Sequence
  chemically synthesized
ccagctatcatgctagtttc

SEQ ID NO: 450634 - DNA, 20 bp, Artificial Sequence
  chemically synthesized
ttgatcatacttctggaaac

SEQ ID NO: 450635 - DNA, 20 bp, Artificial Sequence
  chemically synthesized
gctatcatgctagtttccag

SEQ ID NO: 450636 - DNA, 20 bp, Artificial Sequence
  chemically synthesized
gtaatttttgatcatacttc

SEQ ID NO: 450637 - DNA, 20 bp, Artificial Sequence
  chemically synthesized
atgatcaaaaattacaacaa

SEQ ID NO: 450638 - DNA, 20 bp, Artificial Sequence
  chemically synthesized
tgctgttgtgtgtgtaagtg

SEQ ID NO: 450639 - DNA, 20 bp, Artificial Sequence
  chemically synthesized
aggactgctgttgtgtgtgt

SEQ ID NO: 450640 - DNA, 20 bp, Artificial Sequence
  chemically synthesized
atccacacttacacacacaa

SEQ ID NO: 450641 - DNA, 20 bp, Artificial Sequence
  chemically synthesized
cacacttacacacacaacag

SEQ ID NO: 450642 - DNA, 20 bp, Artificial Sequence
  chemically synthesized
caacagcagtcctaattctc

SEQ ID NO: 450643 - DNA, 20 bp, Artificial Sequence
  chemically synthesized
aatacaggttcttgagaatt

SEQ ID NO: 450644 - DNA, 20 bp, Artificial Sequence
  chemically synthesized
taatacaggttcttgagaat

SEQ ID NO: 450645 - DNA, 20 bp, Artificial Sequence
  chemically synthesized
tgtctataatacaggttctt

SEQ ID NO: 450646 - DNA, 20 bp, Artificial Sequence
  chemically synthesized
attctcaagaacctgtatta

SEQ ID NO: 450647 - DNA, 20 bp, Artificial Sequence
  chemically synthesized
tatattactgtctataatac

SEQ ID NO: 450648 - DNA, 20 bp, Artificial Sequence
  chemically synthesized
ctatattactgtctataata

SEQ ID NO: 450649 - DNA, 20 bp, Artificial Sequence
  chemically synthesized
tcaagaacctgtattataga

SEQ ID NO: 450650 - DNA, 20 bp, Artificial Sequence
  chemically synthesized
ctgtattatagacagtaata

SEQ ID NO: 450651 - DNA, 20 bp, Artificial Sequence
  chemically synthesized
acataaaaacaattaaaatt

SEQ ID NO: 450652 - DNA, 20 bp, Artificial Sequence
  chemically synthesized
aattaaaattcagctttaat

SEQ ID NO: 450653 - DNA, 20 bp, Artificial Sequence
  chemically synthesized
ttaaaattcagctttaataa

SEQ ID NO: 450654 - DNA, 20 bp, Artificial Sequence
  chemically synthesized
accagaggtttctcttatta

SEQ ID NO: 450655 - DNA, 20 bp, Artificial Sequence
  chemically synthesized
gctttaataagagaaacctc

SEQ ID NO: 450656 - DNA, 20 bp, Artificial Sequence
  chemically synthesized
aacataaaaccaaacaccag

SEQ ID NO: 450657 - DNA, 20 bp, Artificial Sequence
  chemically synthesized
taagagaaacctctggtgtt

SEQ ID NO: 450658 - DNA, 20 bp, Artificial Sequence
  chemically synthesized
taacataaaaccaaacacca

SEQ ID NO: 450659 - DNA, 20 bp, Artificial Sequence
  chemically synthesized
attaacataaaaccaaacac

SEQ ID NO: 450660 - DNA, 20 bp, Artificial Sequence
  chemically synthesized
acacacatactatcatgaca

SEQ ID NO: 450661 - DNA, 20 bp, Artificial Sequence
  chemically synthesized
ttaattgtactgtgtcatga

SEQ ID NO: 450662 - DNA, 20 bp, Artificial Sequence
  chemically synthesized
aactaggatcattatgttta

SEQ ID NO: 450663 - DNA, 20 bp, Artificial Sequence
  chemically synthesized
aaactaggatcattatgttt

SEQ ID NO: 450664 - DNA, 20 bp, Artificial Sequence
  chemically synthesized
caaactaggatcattatgtt

SEQ ID NO: 450665 - DNA, 20 bp, Artificial Sequence
  chemically synthesized
ttccctaaacataatgatcc

SEQ ID NO: 450666 - DNA, 20 bp, Artificial Sequence
  chemically synthesized
atactaatagaagacaaact

SEQ ID NO: 450667 - DNA, 20 bp, Artificial Sequence
  chemically synthesized
aatactaatagaagacaaac

SEQ ID NO: 450668 - DNA, 20 bp, Artificial Sequence
  chemically synthesized
gatcctagtttgtcttctat

SEQ ID NO: 450669 - DNA, 20 bp, Artificial Sequence
  chemically synthesized
tactactaaaatactaatag

SEQ ID NO: 450670 - DNA, 20 bp, Artificial Sequence
  chemically synthesized
atatactactaaaatactaa

SEQ ID NO: 450671 - DNA, 20 bp, Artificial Sequence
  chemically synthesized
tttgtcttctattagtattt

SEQ ID NO: 450672 - DNA, 20 bp, Artificial Sequence
  chemically synthesized
gtcttctattagtattttag

SEQ ID NO: 450673 - DNA, 20 bp, Artificial Sequence
  chemically synthesized
agtagtatatgcctgaatgt

SEQ ID NO: 450674 - DNA, 20 bp, Artificial Sequence
  chemically synthesized
tcaaattaaaactcacattc

SEQ ID NO: 450675 - DNA, 20 bp, Artificial Sequence
  chemically synthesized
gtcaaattaaaactcacatt

SEQ ID NO: 450676 - DNA, 20 bp, Artificial Sequence
  chemically synthesized
agttttaatttgacattgta

SEQ ID NO: 450677 - DNA, 20 bp, Artificial Sequence
  chemically synthesized
attgtaaagtcaataaataa

SEQ ID NO: 450678 - DNA, 20 bp, Artificial Sequence
  chemically synthesized
ttgtaaagtcaataaataac

SEQ ID NO: 450679 - DNA, 20 bp, Artificial Sequence
  chemically synthesized
gtaaagtcaataaataacgg

SEQ ID NO: 450680 - DNA, 20 bp, Artificial Sequence
  chemically synthesized
ataaaacatttaaacctctt

SEQ ID NO: 450681 - DNA, 20 bp, Artificial Sequence
  chemically synthesized
ccatgccatcttaactgaag

SEQ ID NO: 450682 - DNA, 20 bp, Artificial Sequence
  chemically synthesized
acatttaaacctcttcagtt

SEQ ID NO: 450683 - DNA, 20 bp, Artificial Sequence
  chemically synthesized
tccatgccatcttaactgaa

SEQ ID NO: 450684 - DNA, 20 bp, Artificial Sequence
  chemically synthesized
tttccatgccatcttaactg

SEQ ID NO: 450685 - DNA, 20 bp, Artificial Sequence
  chemically synthesized
ttaaacctcttcagttaaga

SEQ ID NO: 450686 - DNA, 20 bp, Artificial Sequence
  chemically synthesized
cctcttcagttaagatggca

SEQ ID NO: 450687 - DNA, 20 bp, Artificial Sequence
  chemically synthesized
ctatatattaaataagtgtc

SEQ ID NO: 450688 - DNA, 20 bp, Artificial Sequence
  chemically synthesized
tattcttctatatattaaat

SEQ ID NO: 450689 - DNA, 20 bp, Artificial Sequence
  chemically synthesized
cttgacacttatttaatata

SEQ ID NO: 450690 - DNA, 20 bp, Artificial Sequence
  chemically synthesized
gacacttatttaatatatag

SEQ ID NO: 450691 - DNA, 20 bp, Artificial Sequence
  chemically synthesized
tatttaatatatagaagaat

SEQ ID NO: 450692 - DNA, 20 bp, Artificial Sequence
  chemically synthesized
taatatatagaagaataaga

SEQ ID NO: 450693 - DNA, 20 bp, Artificial Sequence
  chemically synthesized
taagaaagaaaatataaaaa

SEQ ID NO: 450694 - DNA, 20 bp, Artificial Sequence
  chemically synthesized
aaagaaaatataaaaaaaga

SEQ ID NO: 450695 - DNA, 20 bp, Artificial Sequence
  chemically synthesized
agaaaatataaaaaaagaaa

SEQ ID NO: 450696 - DNA, 20 bp, Artificial Sequence
  chemically synthesized
aaagaaagagtgttataaca

SEQ ID NO: 450697 - DNA, 20 bp, Artificial Sequence
  chemically synthesized
gaaagagtgttataacacag

SEQ ID NO: 450698 - DNA, 20 bp, Artificial Sequence
  chemically synthesized
aaagagtgttataacacagt

SEQ ID NO: 450699 - DNA, 20 bp, Artificial Sequence
  chemically synthesized
tgttataacacagtaggact

SEQ ID NO: 450700 - DNA, 20 bp, Artificial Sequence
  chemically synthesized
gaggtgccaagattgtgtct

SEQ ID NO: 450701 - DNA, 20 bp, Artificial Sequence
  chemically synthesized
gtaggacttagacacaatct

SEQ ID NO: 450702 - DNA, 20 bp, Artificial Sequence
  chemically synthesized
gtctgatatgtggaggtgcc

SEQ ID NO: 450703 - DNA, 20 bp, Artificial Sequence
  chemically synthesized
ctactgtgtctgatatgtgg

SEQ ID NO: 450704 - DNA, 20 bp, Artificial Sequence
  chemically synthesized
atcttggcacctccacatat

SEQ ID NO: 450705 - DNA, 20 bp, Artificial Sequence
  chemically synthesized
gctactgtgtctgatatgtg

SEQ ID NO: 450706 - DNA, 20 bp, Artificial Sequence
  chemically synthesized
cagctactgtgtctgatatg

SEQ ID NO: 450707 - DNA, 20 bp, Artificial Sequence
  chemically synthesized
gcacctccacatatcagaca

SEQ ID NO: 450708 - DNA, 20 bp, Artificial Sequence
  chemically synthesized
cctccacatatcagacacag

SEQ ID NO: 450709 - DNA, 20 bp, Artificial Sequence
  chemically synthesized
catatcagacacagtagctg

SEQ ID NO: 450710 - DNA, 20 bp, Artificial Sequence
  chemically synthesized
aaaatagtctgtcaggactg

SEQ ID NO: 450711 - DNA, 20 bp, Artificial Sequence
  chemically synthesized
cacagtagctgcagtcctga

SEQ ID NO: 450712 - DNA, 20 bp, Artificial Sequence
  chemically synthesized
tggggggaaaatagtctgtc

SEQ ID NO: 450713 - DNA, 20 bp, Artificial Sequence
  chemically synthesized
atggggggaaaatagtctgt

SEQ ID NO: 450714 - DNA, 20 bp, Artificial Sequence
  chemically synthesized
cactacccatggggggaaaa

SEQ ID NO: 450715 - DNA, 20 bp, Artificial Sequence
  chemically synthesized
gacagactattttcccccca

SEQ ID NO: 450716 - DNA, 20 bp, Artificial Sequence
  chemically synthesized
acagactattttccccccat

SEQ ID NO: 450717 - DNA, 20 bp, Artificial Sequence
  chemically synthesized
gcgaagccactacccatggg

SEQ ID NO: 450718 - DNA, 20 bp, Artificial Sequence
  chemically synthesized
gactattttccccccatggg

SEQ ID NO: 450719 - DNA, 20 bp, Artificial Sequence
  chemically synthesized
tgcgaagccactacccatgg

SEQ ID NO: 450720 - DNA, 20 bp, Artificial Sequence
  chemically synthesized
atgcgaagccactacccatg

SEQ ID NO: 450721 - DNA, 20 bp, Artificial Sequence
  chemically synthesized
aatgcgaagccactacccat

SEQ ID NO: 450722 - DNA, 20 bp, Artificial Sequence
  chemically synthesized
tattttccccccatgggtag

SEQ ID NO: 450723 - DNA, 20 bp, Artificial Sequence
  chemically synthesized
aaatgcgaagccactaccca

SEQ ID NO: 450724 - DNA, 20 bp, Artificial Sequence
  chemically synthesized
atgggtagtggcttcgcatt

SEQ ID NO: 450725 - DNA, 20 bp, Artificial Sequence
  chemically synthesized
agtgaaggaatctaaatgcg

SEQ ID NO: 450726 - DNA, 20 bp, Artificial Sequence
  chemically synthesized
cgcatttagattccttcact

SEQ ID NO: 450727 - DNA, 20 bp, Artificial Sequence
  chemically synthesized
catttagattccttcactaa

SEQ ID NO: 450728 - DNA, 20 bp, Artificial Sequence
  chemically synthesized
tacatgtggactcttagtga

SEQ ID NO: 450729 - DNA, 20 bp, Artificial Sequence
  chemically synthesized
gtacatgtggactcttagtg

SEQ ID NO: 450730 - DNA, 20 bp, Artificial Sequence
  chemically synthesized
atcctgtacatgtggactct

SEQ ID NO: 450731 - DNA, 20 bp, Artificial Sequence
  chemically synthesized
tcactaagagtccacatgta

SEQ ID NO: 450732 - DNA, 20 bp, Artificial Sequence
  chemically synthesized
cactaagagtccacatgtac

SEQ ID NO: 450733 - DNA, 20 bp, Artificial Sequence
  chemically synthesized
tctagtttatcctgtacatg

SEQ ID NO: 450734 - DNA, 20 bp, Artificial Sequence
  chemically synthesized
tccacatgtacaggataaac

SEQ ID NO: 450735 - DNA, 20 bp, Artificial Sequence
  chemically synthesized
gtacaggataaactagaatt

SEQ ID NO: 450736 - DNA, 20 bp, Artificial Sequence
  chemically synthesized
tcaagcagtgatcttaattc

SEQ ID NO: 450737 - DNA, 20 bp, Artificial Sequence
  chemically synthesized
agaattaagatcactgcttg

SEQ ID NO: 450738 - DNA, 20 bp, Artificial Sequence
  chemically synthesized
ccataacttgtgacttcaag

SEQ ID NO: 450739 - DNA, 20 bp, Artificial Sequence
  chemically synthesized
ttgccataacttgtgacttc

SEQ ID NO: 450740 - DNA, 20 bp, Artificial Sequence
  chemically synthesized
agatcactgcttgaagtcac

SEQ ID NO: 450741 - DNA, 20 bp, Artificial Sequence
  chemically synthesized
ctgcttgaagtcacaagtta

SEQ ID NO: 450742 - DNA, 20 bp, Artificial Sequence
  chemically synthesized
gaagtcacaagttatggcaa

SEQ ID NO: 450743 - DNA, 20 bp, Artificial Sequence
  chemically synthesized
agttatggcaaaagttcacc

SEQ ID NO: 450744 - DNA, 20 bp, Artificial Sequence
  chemically synthesized
tcttttcaagaatgattgct

SEQ ID NO: 450745 - DNA, 20 bp, Artificial Sequence
  chemically synthesized
ttcttttcaagaatgattgc

SEQ ID NO: 450746 - DNA, 20 bp, Artificial Sequence
  chemically synthesized
acccagcaatcattcttgaa

SEQ ID NO: 450747 - DNA, 20 bp, Artificial Sequence
  chemically synthesized
tttaagacatttttcttttc

SEQ ID NO: 450748 - DNA, 20 bp, Artificial Sequence
  chemically synthesized
agcaggtcagcaaaattttt

SEQ ID NO: 450749 - DNA, 20 bp, Artificial Sequence
  chemically synthesized
taggctctcaggcagcaggt

SEQ ID NO: 450750 - DNA, 20 bp, Artificial Sequence
  chemically synthesized
attttgctgacctgctgcct

SEQ ID NO: 450751 - DNA, 20 bp, Artificial Sequence
  chemically synthesized
ataataggctctcaggcagc

SEQ ID NO: 450752 - DNA, 20 bp, Artificial Sequence
  chemically synthesized
cataataggctctcaggcag

SEQ ID NO: 450753 - DNA, 20 bp, Artificial Sequence
  chemically synthesized
tttgctgacctgctgcctga

SEQ ID NO: 450754 - DNA, 20 bp, Artificial Sequence
  chemically synthesized
taacataataggctctcagg

SEQ ID NO: 450755 - DNA, 20 bp, Artificial Sequence
  chemically synthesized
tcctaacataataggctctc

SEQ ID NO: 450756 - DNA, 20 bp, Artificial Sequence
  chemically synthesized
ttcctaacataataggctct

SEQ ID NO: 450757 - DNA, 20 bp, Artificial Sequence
  chemically synthesized
tgcctgagagcctattatgt

SEQ ID NO: 450758 - DNA, 20 bp, Artificial Sequence
  chemically synthesized
taacagattcctaacataat

SEQ ID NO: 450759 - DNA, 20 bp, Artificial Sequence
  chemically synthesized
gcctgagagcctattatgtt

SEQ ID NO: 450760 - DNA, 20 bp, Artificial Sequence
  chemically synthesized
gtaacagattcctaacataa

SEQ ID NO: 450761 - DNA, 20 bp, Artificial Sequence
  chemically synthesized
atgttaggaatctgttacac

SEQ ID NO: 450762 - DNA, 20 bp, Artificial Sequence
  chemically synthesized
ttcccgtatctctagtgtaa

SEQ ID NO: 450763 - DNA, 20 bp, Artificial Sequence
  chemically synthesized
gttaggaatctgttacacta

SEQ ID NO: 450764 - DNA, 20 bp, Artificial Sequence
  chemically synthesized
aatctgttacactagagata

SEQ ID NO: 450765 - DNA, 20 bp, Artificial Sequence
  chemically synthesized
atctgttacactagagatac

SEQ ID NO: 450766 - DNA, 20 bp, Artificial Sequence
  chemically synthesized
gtgtgttcttcccgtatctc

SEQ ID NO: 450767 - DNA, 20 bp, Artificial Sequence
  chemically synthesized
tgttacactagagatacggg

SEQ ID NO: 450768 - DNA, 20 bp, Artificial Sequence
  chemically synthesized
acacacacacacacgccatg

SEQ ID NO: 450769 - DNA, 20 bp, Artificial Sequence
  chemically synthesized
cacacacacacacgccatga

SEQ ID NO: 450770 - DNA, 20 bp, Artificial Sequence
  chemically synthesized
acacacacacgccatgaagg

SEQ ID NO: 450771 - DNA, 20 bp, Artificial Sequence
  chemically synthesized
ttgggctgcttctgccttca

SEQ ID NO: 450772 - DNA, 20 bp, Artificial Sequence
  chemically synthesized
cacacacgccatgaaggcag

SEQ ID NO: 450773 - DNA, 20 bp, Artificial Sequence
  chemically synthesized
acacgccatgaaggcagaag

SEQ ID NO: 450774 - DNA, 20 bp, Artificial Sequence
  chemically synthesized
tactcaaattcatttgtttt

SEQ ID NO: 450775 - DNA, 20 bp, Artificial Sequence
  chemically synthesized
gtactcaaattcatttgttt

SEQ ID NO: 450776 - DNA, 20 bp, Artificial Sequence
  chemically synthesized
agcccaaaacaaatgaattt

SEQ ID NO: 450777 - DNA, 20 bp, Artificial Sequence
  chemically synthesized
aattagaaatattgaagatt

SEQ ID NO: 450778 - DNA, 20 bp, Artificial Sequence
  chemically synthesized
ataattaattagaaatattg

SEQ ID NO: 450779 - DNA, 20 bp, Artificial Sequence
  chemically synthesized
tgtttgtggtgataattaat

SEQ ID NO: 450780 - DNA, 20 bp, Artificial Sequence
  chemically synthesized
taattaattatcaccacaaa

SEQ ID NO: 450781 - DNA, 20 bp, Artificial Sequence
  chemically synthesized
accacgtggagtgctgtttg

SEQ ID NO: 450782 - DNA, 20 bp, Artificial Sequence
  chemically synthesized
accacaaacagcactccacg

SEQ ID NO: 450783 - DNA, 20 bp, Artificial Sequence
  chemically synthesized
acaaacagcactccacgtgg

SEQ ID NO: 450784 - DNA, 20 bp, Artificial Sequence
  chemically synthesized
agatagtctactaccacgtg

SEQ ID NO: 450785 - DNA, 20 bp, Artificial Sequence
  chemically synthesized
tcagatagtctactaccacg

SEQ ID NO: 450786 - DNA, 20 bp, Artificial Sequence
  chemically synthesized
aacagcactccacgtggtag

SEQ ID NO: 450787 - DNA, 20 bp, Artificial Sequence
  chemically synthesized
aatagctgcctagattcaga

SEQ ID NO: 450788 - DNA, 20 bp, Artificial Sequence
  chemically synthesized
ggtagtagactatctgaatc

SEQ ID NO: 450789 - DNA, 20 bp, Artificial Sequence
  chemically synthesized
gtagtagactatctgaatct

SEQ ID NO: 450790 - DNA, 20 bp, Artificial Sequence
  chemically synthesized
ctggaatagctgcctagatt

SEQ ID NO: 450791 - DNA, 20 bp, Artificial Sequence
  chemically synthesized
gtagactatctgaatctagg

SEQ ID NO: 450792 - DNA, 20 bp, Artificial Sequence
  chemically synthesized
tggcccctggaatagctgcc

SEQ ID NO: 450793 - DNA, 20 bp, Artificial Sequence
  chemically synthesized
ctgaatctaggcagctattc

SEQ ID NO: 450794 - DNA, 20 bp, Artificial Sequence
  chemically synthesized
tgaatctaggcagctattcc

SEQ ID NO: 450795 - DNA, 20 bp, Artificial Sequence
  chemically synthesized
gaatctaggcagctattcca

SEQ ID NO: 450796 - DNA, 20 bp, Artificial Sequence
  chemically synthesized
aatctaggcagctattccag

SEQ ID NO: 450797 - DNA, 20 bp, Artificial Sequence
  chemically synthesized
tccccatctggcccctggaa

SEQ ID NO: 450798 - DNA, 20 bp, Artificial Sequence
  chemically synthesized
taggcagctattccaggggc

SEQ ID NO: 450799 - DNA, 20 bp, Artificial Sequence
  chemically synthesized
tgttgtccccatctggcccc

SEQ ID NO: 450800 - DNA, 20 bp, Artificial Sequence
  chemically synthesized
cagctattccaggggccaga

SEQ ID NO: 450801 - DNA, 20 bp, Artificial Sequence
  chemically synthesized
agctattccaggggccagat

SEQ ID NO: 450802 - DNA, 20 bp, Artificial Sequence
  chemically synthesized
gctattccaggggccagatg

SEQ ID NO: 450803 - DNA, 20 bp, Artificial Sequence
  chemically synthesized
actttgctgttgtccccatc

SEQ ID NO: 450804 - DNA, 20 bp, Artificial Sequence
  chemically synthesized
caggggccagatggggacaa

SEQ ID NO: 450805 - DNA, 20 bp, Artificial Sequence
  chemically synthesized
gccagatggggacaacagca

SEQ ID NO: 450806 - DNA, 20 bp, Artificial Sequence
  chemically synthesized
agatggggacaacagcaaag

SEQ ID NO: 450807 - DNA, 20 bp, Artificial Sequence
  chemically synthesized
tggggacaacagcaaagtgg

SEQ ID NO: 450808 - DNA, 20 bp, Artificial Sequence
  chemically synthesized
acaacagcaaagtggtggaa

SEQ ID NO: 450809 - DNA, 20 bp, Artificial Sequence
  chemically synthesized
aataaacacaatgacaataa

SEQ ID NO: 450810 - DNA, 20 bp, Artificial Sequence
  chemically synthesized
ctggagcatttagagtaaaa

SEQ ID NO: 450811 - DNA, 20 bp, Artificial Sequence
  chemically synthesized
tctggagcatttagagtaaa

SEQ ID NO: 450812 - DNA, 20 bp, Artificial Sequence
  chemically synthesized
ttctggagcatttagagtaa

SEQ ID NO: 450813 - DNA, 20 bp, Artificial Sequence
  chemically synthesized
acagatttctggagcattta

SEQ ID NO: 450814 - DNA, 20 bp, Artificial Sequence
  chemically synthesized
cccttttactctaaatgctc

SEQ ID NO: 450815 - DNA, 20 bp, Artificial Sequence
  chemically synthesized
tcacagatttctggagcatt

SEQ ID NO: 450816 - DNA, 20 bp, Artificial Sequence
  chemically synthesized
tatttattcacagatttctg

SEQ ID NO: 450817 - DNA, 20 bp, Artificial Sequence
  chemically synthesized
tttatttattcacagatttc

SEQ ID NO: 450818 - DNA, 20 bp, Artificial Sequence
  chemically synthesized
tttaggcctttatttattca

SEQ ID NO: 450819 - DNA, 20 bp, Artificial Sequence
  chemically synthesized
cagaaatctgtgaataaata

SEQ ID NO: 450820 - DNA, 20 bp, Artificial Sequence
  chemically synthesized
agaaatctgtgaataaataa

SEQ ID NO: 450821 - DNA, 20 bp, Artificial Sequence
  chemically synthesized
gaataaataaaggcctaaaa

SEQ ID NO: 450822 - DNA, 20 bp, Artificial Sequence
  chemically synthesized
aataaataaaggcctaaaaa

SEQ ID NO: 450823 - DNA, 20 bp, Artificial Sequence
  chemically synthesized
ggtggttttctgcctttttt

SEQ ID NO: 450824 - DNA, 20 bp, Artificial Sequence
  chemically synthesized
aaataaaggcctaaaaaagg

SEQ ID NO: 450825 - DNA, 20 bp, Artificial Sequence
  chemically synthesized
tggtggttttctgccttttt

SEQ ID NO: 450826 - DNA, 20 bp, Artificial Sequence
  chemically synthesized
ggtggtggtggtggtggtgg

SEQ ID NO: 450827 - DNA, 20 bp, Artificial Sequence
  chemically synthesized
ggtggtggtggtggtggtgg

SEQ ID NO: 450828 - DNA, 20 bp, Artificial Sequence
  chemically synthesized
ggtggtggtggtggtggtgg

SEQ ID NO: 450829 - DNA, 20 bp, Artificial Sequence
  chemically synthesized
tgtggtggtggtggtggtgg

SEQ ID NO: 450830 - DNA, 20 bp, Artificial Sequence
  chemically synthesized
ggttgtggtggtggtggtgg

SEQ ID NO: 450831 - DNA, 20 bp, Artificial Sequence
  chemically synthesized
tgtggttgtggtggtggtgg

SEQ ID NO: 450832 - DNA, 20 bp, Artificial Sequence
  chemically synthesized
cattgtggttgtggtggtgg

SEQ ID NO: 450833 - DNA, 20 bp, Artificial Sequence
  chemically synthesized
aatcattgtggttgtggtgg

SEQ ID NO: 450834 - DNA, 20 bp, Artificial Sequence
  chemically synthesized
ttgaatcattgtggttgtgg

SEQ ID NO: 450835 - DNA, 20 bp, Artificial Sequence
  chemically synthesized
tggttgaatcattgtggttg

SEQ ID NO: 450836 - DNA, 20 bp, Artificial Sequence
  chemically synthesized
aactcatggttgaatcattg

SEQ ID NO: 450837 - DNA, 20 bp, Artificial Sequence
  chemically synthesized
aaccacaatgattcaaccat

SEQ ID NO: 450838 - DNA, 20 bp, Artificial Sequence
  chemically synthesized
caatgattcaaccatgagtt

SEQ ID NO: 450839 - DNA, 20 bp, Artificial Sequence
  chemically synthesized
tttcatctagactgaactca

SEQ ID NO: 450840 - DNA, 20 bp, Artificial Sequence
  chemically synthesized
attcaaccatgagttcagtc

SEQ ID NO: 450841 - DNA, 20 bp, Artificial Sequence
  chemically synthesized
tatatgagaataatttcatc

SEQ ID NO: 450842 - DNA, 20 bp, Artificial Sequence
  chemically synthesized
tagatgaaattattctcata

SEQ ID NO: 450843 - DNA, 20 bp, Artificial Sequence
  chemically synthesized
tgttcttcagacatctatat

SEQ ID NO: 450844 - DNA, 20 bp, Artificial Sequence
  chemically synthesized
tattctcatatagatgtctg

SEQ ID NO: 450845 - DNA, 20 bp, Artificial Sequence
  chemically synthesized
tattatttaaaaatgttctt

SEQ ID NO: 450846 - DNA, 20 bp, Artificial Sequence
  chemically synthesized
acatttttaaataatatgtt

SEQ ID NO: 450847 - DNA, 20 bp, Artificial Sequence
  chemically synthesized
tatcttttaattttattgtt

SEQ ID NO: 450848 - DNA, 20 bp, Artificial Sequence
  chemically synthesized
attctcaacaataaaattaa

SEQ ID NO: 450849 - DNA, 20 bp, Artificial Sequence
  chemically synthesized
aaaagataaaactcaataaa

SEQ ID NO: 450850 - DNA, 20 bp, Artificial Sequence
  chemically synthesized
aactacttgttctttttatt

SEQ ID NO: 450851 - DNA, 20 bp, Artificial Sequence
  chemically synthesized
taaaactcaataaaaagaac

SEQ ID NO: 450852 - DNA, 20 bp, Artificial Sequence
  chemically synthesized
aactcaataaaaagaacaag

SEQ ID NO: 450853 - DNA, 20 bp, Artificial Sequence
  chemically synthesized
aacaagtagttataaaacaa

SEQ ID NO: 450854 - DNA, 20 bp, Artificial Sequence
  chemically synthesized
agttataaaacaaaagcatg

SEQ ID NO: 450855 - DNA, 20 bp, Artificial Sequence
  chemically synthesized
aattaaaataatttcatatt

SEQ ID NO: 450856 - DNA, 20 bp, Artificial Sequence
  chemically synthesized
taaaataatttcatattgag

SEQ ID NO: 450857 - DNA, 20 bp, Artificial Sequence
  chemically synthesized
atttcatattgagaagaaaa

SEQ ID NO: 450858 - DNA, 20 bp, Artificial Sequence
  chemically synthesized
aagaaaaaagctataaatgt

SEQ ID NO: 450859 - DNA, 20 bp, Artificial Sequence
  chemically synthesized
tttttcatttccaacattta

SEQ ID NO: 450860 - DNA, 20 bp, Artificial Sequence
  chemically synthesized
aatgttggaaatgaaaaatg

SEQ ID NO: 450861 - DNA, 20 bp, Artificial Sequence
  chemically synthesized
tagtaaatgaatcaatttta

SEQ ID NO: 450862 - DNA, 20 bp, Artificial Sequence
  chemically synthesized
atcaattttaaagaaataaa

SEQ ID NO: 450863 - DNA, 20 bp, Artificial Sequence
  chemically synthesized
tttaaagaaataaacagctt

SEQ ID NO: 450864 - DNA, 20 bp, Artificial Sequence
  chemically synthesized
aaataaacagcttaagtatc

SEQ ID NO: 450865 - DNA, 20 bp, Artificial Sequence
  chemically synthesized
cttgttcaatccagatactt

SEQ ID NO: 450866 - DNA, 20 bp, Artificial Sequence
  chemically synthesized
ttttatcttcttgttcaatc

SEQ ID NO: 450867 - DNA, 20 bp, Artificial Sequence
  chemically synthesized
cttaagtatctggattgaac

SEQ ID NO: 450868 - DNA, 20 bp, Artificial Sequence
  chemically synthesized
aagtatctggattgaacaag

SEQ ID NO: 450869 - DNA, 20 bp, Artificial Sequence
  chemically synthesized
attgaacaagaagataaaat

SEQ ID NO: 450870 - DNA, 20 bp, Artificial Sequence
  chemically synthesized
agaagataaaattagtgaat

SEQ ID NO: 450871 - DNA, 20 bp, Artificial Sequence
  chemically synthesized
agataaaattagtgaattag

SEQ ID NO: 450872 - DNA, 20 bp, Artificial Sequence
  chemically synthesized
tgaattagaagatactaatg

SEQ ID NO: 450873 - DNA, 20 bp, Artificial Sequence
  chemically synthesized
gttctggatgaattcttcat

SEQ ID NO: 450874 - DNA, 20 bp, Artificial Sequence
  chemically synthesized
atactaatgaagaattcatc

SEQ ID NO: 450875 - DNA, 20 bp, Artificial Sequence
  chemically synthesized
tgcctccctgtgttacgttc

SEQ ID NO: 450876 - DNA, 20 bp, Artificial Sequence
  chemically synthesized
aattcatccagaacgtaaca

SEQ ID NO: 450877 - DNA, 20 bp, Artificial Sequence
  chemically synthesized
attcatccagaacgtaacac

SEQ ID NO: 450878 - DNA, 20 bp, Artificial Sequence
  chemically synthesized
ttcatccagaacgtaacaca

SEQ ID NO: 450879 - DNA, 20 bp, Artificial Sequence
  chemically synthesized
catccagaacgtaacacagg

SEQ ID NO: 450880 - DNA, 20 bp, Artificial Sequence
  chemically synthesized
atccagaacgtaacacaggg

SEQ ID NO: 450881 - DNA, 20 bp, Artificial Sequence
  chemically synthesized
agaacgtaacacagggaggc

SEQ ID NO: 450882 - DNA, 20 bp, Artificial Sequence
  chemically synthesized
aatgttaaaaataaaatact

SEQ ID NO: 450883 - DNA, 20 bp, Artificial Sequence
  chemically synthesized
atgttaaaaataaaatacta

SEQ ID NO: 450884 - DNA, 20 bp, Artificial Sequence
  chemically synthesized
ttgtccatcttttatgtcct

SEQ ID NO: 450885 - DNA, 20 bp, Artificial Sequence
  chemically synthesized
ataaaatactaaggacataa

SEQ ID NO: 450886 - DNA, 20 bp, Artificial Sequence
  chemically synthesized
aatactaaggacataaaaga

SEQ ID NO: 450887 - DNA, 20 bp, Artificial Sequence
  chemically synthesized
ggacaatattatacgacaat

SEQ ID NO: 450888 - DNA, 20 bp, Artificial Sequence
  chemically synthesized
acaatattatacgacaataa

SEQ ID NO: 450889 - DNA, 20 bp, Artificial Sequence
  chemically synthesized
tacgacaataagagttccta

SEQ ID NO: 450890 - DNA, 20 bp, Artificial Sequence
  chemically synthesized
gacaataagagttcctaaag

SEQ ID NO: 450891 - DNA, 20 bp, Artificial Sequence
  chemically synthesized
caataagagttcctaaagaa

SEQ ID NO: 450892 - DNA, 20 bp, Artificial Sequence
  chemically synthesized
ttccattcattctcttcttt

SEQ ID NO: 450893 - DNA, 20 bp, Artificial Sequence
  chemically synthesized
attccattcattctcttctt

SEQ ID NO: 450894 - DNA, 20 bp, Artificial Sequence
  chemically synthesized
ttcctaaagaagagaatgaa

SEQ ID NO: 450895 - DNA, 20 bp, Artificial Sequence
  chemically synthesized
gaagagaatgaatggaattg

SEQ ID NO: 450896 - DNA, 20 bp, Artificial Sequence
  chemically synthesized
agagaatgaatggaattgca

SEQ ID NO: 450897 - DNA, 20 bp, Artificial Sequence
  chemically synthesized
gaatgaatggaattgcagag

SEQ ID NO: 450898 - DNA, 20 bp, Artificial Sequence
  chemically synthesized
gaatggaattgcagagaagc

SEQ ID NO: 450899 - DNA, 20 bp, Artificial Sequence
  chemically synthesized
ttgcagagaagccagattta

SEQ ID NO: 450900 - DNA, 20 bp, Artificial Sequence
  chemically synthesized
tcagccattatctttaaatc

SEQ ID NO: 450901 - DNA, 20 bp, Artificial Sequence
  chemically synthesized
gaagccagatttaaagataa

SEQ ID NO: 450902 - DNA, 20 bp, Artificial Sequence
  chemically synthesized
catcagttctataaaattat

SEQ ID NO: 450903 - DNA, 20 bp, Artificial Sequence
  chemically synthesized
gataatggctgataatttta

SEQ ID NO: 450904 - DNA, 20 bp, Artificial Sequence
  chemically synthesized
taattttatagaactgatga

SEQ ID NO: 450905 - DNA, 20 bp, Artificial Sequence
  chemically synthesized
ccttgccctttgtctatcat

SEQ ID NO: 450906 - DNA, 20 bp, Artificial Sequence
  chemically synthesized
tatagaactgatgatagaca

SEQ ID NO: 450907 - DNA, 20 bp, Artificial Sequence
  chemically synthesized
atagaactgatgatagacaa

SEQ ID NO: 450908 - DNA, 20 bp, Artificial Sequence
  chemically synthesized
tagaactgatgatagacaaa

SEQ ID NO: 450909 - DNA, 20 bp, Artificial Sequence
  chemically synthesized
actgatgatagacaaagggc

SEQ ID NO: 450910 - DNA, 20 bp, Artificial Sequence
  chemically synthesized
ctgatgatagacaaagggca

SEQ ID NO: 450911 - DNA, 20 bp, Artificial Sequence
  chemically synthesized
acaaagggcaaggtttatct

SEQ ID NO: 450912 - DNA, 20 bp, Artificial Sequence
  chemically synthesized
agggcaaggtttatctaaga

SEQ ID NO: 450913 - DNA, 20 bp, Artificial Sequence
  chemically synthesized
gtttttcttcaaaactttct

SEQ ID NO: 450914 - DNA, 20 bp, Artificial Sequence
  chemically synthesized
gtttatctaagaaagttttg

SEQ ID NO: 450915 - DNA, 20 bp, Artificial Sequence
  chemically synthesized
agaaagttttgaagaaaaac

SEQ ID NO: 450916 - DNA, 20 bp, Artificial Sequence
  chemically synthesized
agttttgaagaaaaacaagt

SEQ ID NO: 450917 - DNA, 20 bp, Artificial Sequence
  chemically synthesized
gttttgaagaaaaacaagtt

SEQ ID NO: 450918 - DNA, 20 bp, Artificial Sequence
  chemically synthesized
ttttgaagaaaaacaagtta

SEQ ID NO: 450919 - DNA, 20 bp, Artificial Sequence
  chemically synthesized
gaaaaacaagttagggtgtc

SEQ ID NO: 450920 - DNA, 20 bp, Artificial Sequence
  chemically synthesized
gccctgacatgtggtagggc

SEQ ID NO: 450921 - DNA, 20 bp, Artificial Sequence
  chemically synthesized
tttagccctgacatgtggta

SEQ ID NO: 450922 - DNA, 20 bp, Artificial Sequence
  chemically synthesized
atttagccctgacatgtggt

SEQ ID NO: 450923 - DNA, 20 bp, Artificial Sequence
  chemically synthesized
tatttagccctgacatgtgg

SEQ ID NO: 450924 - DNA, 20 bp, Artificial Sequence
  chemically synthesized
tgtctggccctaccacatgt

SEQ ID NO: 450925 - DNA, 20 bp, Artificial Sequence
  chemically synthesized
gtctggccctaccacatgtc

SEQ ID NO: 450926 - DNA, 20 bp, Artificial Sequence
  chemically synthesized
tctggccctaccacatgtca

SEQ ID NO: 450927 - DNA, 20 bp, Artificial Sequence
  chemically synthesized
ttatatttagccctgacatg

SEQ ID NO: 450928 - DNA, 20 bp, Artificial Sequence
  chemically synthesized
aattaccatagatttatatt

SEQ ID NO: 450929 - DNA, 20 bp, Artificial Sequence
  chemically synthesized
cagggctaaatataaatcta

SEQ ID NO: 450930 - DNA, 20 bp, Artificial Sequence
  chemically synthesized
ataatatgtctcaattacca

SEQ ID NO: 450931 - DNA, 20 bp, Artificial Sequence
  chemically synthesized
aatataaatctatggtaatt

SEQ ID NO: 450932 - DNA, 20 bp, Artificial Sequence
  chemically synthesized
atggtaattgagacatatta

SEQ ID NO: 450933 - DNA, 20 bp, Artificial Sequence
  chemically synthesized
attgagacatattatagtac

SEQ ID NO: 450934 - DNA, 20 bp, Artificial Sequence
  chemically synthesized
gacatattatagtactggca

SEQ ID NO: 450935 - DNA, 20 bp, Artificial Sequence
  chemically synthesized
acatattatagtactggcac

SEQ ID NO: 450936 - DNA, 20 bp, Artificial Sequence
  chemically synthesized
tcatttgccaattcctgtgc

SEQ ID NO: 450937 - DNA, 20 bp, Artificial Sequence
  chemically synthesized
tatagtactggcacaggaat

SEQ ID NO: 450938 - DNA, 20 bp, Artificial Sequence
  chemically synthesized
ggcacaggaattggcaaatg

SEQ ID NO: 450939 - DNA, 20 bp, Artificial Sequence
  chemically synthesized
aggaattggcaaatgaagaa

SEQ ID NO: 450940 - DNA, 20 bp, Artificial Sequence
  chemically synthesized
aatgaagaacagaacaaaaa

SEQ ID NO: 450941 - DNA, 20 bp, Artificial Sequence
  chemically synthesized
acagaacaaaaaaagatgcc

SEQ ID NO: 450942 - DNA, 20 bp, Artificial Sequence
  chemically synthesized
gtatgtacattagtatttct

SEQ ID NO: 450943 - DNA, 20 bp, Artificial Sequence
  chemically synthesized
agtatgtacattagtatttc

SEQ ID NO: 450944 - DNA, 20 bp, Artificial Sequence
  chemically synthesized
cattagattagtatgtacat

SEQ ID NO: 450945 - DNA, 20 bp, Artificial Sequence
  chemically synthesized
tatatacatgtacattagat

SEQ ID NO: 450946 - DNA, 20 bp, Artificial Sequence
  chemically synthesized
attagtatatacatgtacat

SEQ ID NO: 450947 - DNA, 20 bp, Artificial Sequence
  chemically synthesized
cctctgttttgcatcgagat

SEQ ID NO: 450948 - DNA, 20 bp, Artificial Sequence
  chemically synthesized
tgtcacctctgttttgcatc

SEQ ID NO: 450949 - DNA, 20 bp, Artificial Sequence
  chemically synthesized
atactaatctcgatgcaaaa

SEQ ID NO: 450950 - DNA, 20 bp, Artificial Sequence
  chemically synthesized
actaatctcgatgcaaaaca

SEQ ID NO: 450951 - DNA, 20 bp, Artificial Sequence
  chemically synthesized
ctaatctcgatgcaaaacag

SEQ ID NO: 450952 - DNA, 20 bp, Artificial Sequence
  chemically synthesized
gcaaaacagaggtgacacta

SEQ ID NO: 450953 - DNA, 20 bp, Artificial Sequence
  chemically synthesized
caaaacagaggtgacactac

SEQ ID NO: 450954 - DNA, 20 bp, Artificial Sequence
  chemically synthesized
accttttctctattcacctg

SEQ ID NO: 450955 - DNA, 20 bp, Artificial Sequence
  chemically synthesized
gaggtgacactacaggtgaa

SEQ ID NO: 450956 - DNA, 20 bp, Artificial Sequence
  chemically synthesized
ggtgacactacaggtgaata

SEQ ID NO: 450957 - DNA, 20 bp, Artificial Sequence
  chemically synthesized
cactacaggtgaatagagaa

SEQ ID NO: 450958 - DNA, 20 bp, Artificial Sequence
  chemically synthesized
actacaggtgaatagagaaa

SEQ ID NO: 450959 - DNA, 20 bp, Artificial Sequence
  chemically synthesized
acaggtgaatagagaaaagg

SEQ ID NO: 450960 - DNA, 20 bp, Artificial Sequence
  chemically synthesized
ggtagacatttaaacaatga

SEQ ID NO: 450961 - DNA, 20 bp, Artificial Sequence
  chemically synthesized
agacatttaaacaatgatgg

SEQ ID NO: 450962 - DNA, 20 bp, Artificial Sequence
  chemically synthesized
gacatttaaacaatgatggt

SEQ ID NO: 450963 - DNA, 20 bp, Artificial Sequence
  chemically synthesized
tttaaacaatgatggtagga

SEQ ID NO: 450964 - DNA, 20 bp, Artificial Sequence
  chemically synthesized
taattttgtgaattatttta

SEQ ID NO: 450965 - DNA, 20 bp, Artificial Sequence
  chemically synthesized
aataattttgtgaattattt

SEQ ID NO: 450966 - DNA, 20 bp, Artificial Sequence
  chemically synthesized
tttaggggtttttttgtgaa

SEQ ID NO: 450967 - DNA, 20 bp, Artificial Sequence
  chemically synthesized
aacttggaaataatttttag

SEQ ID NO: 450968 - DNA, 20 bp, Artificial Sequence
  chemically synthesized
aaacttggaaataattttta

SEQ ID NO: 450969 - DNA, 20 bp, Artificial Sequence
  chemically synthesized
taaacttggaaataattttt

SEQ ID NO: 450970 - DNA, 20 bp, Artificial Sequence
  chemically synthesized
ataaacttggaaataatttt

SEQ ID NO: 450971 - DNA, 20 bp, Artificial Sequence
  chemically synthesized
aacccctaaaaattatttcc

SEQ ID NO: 450972 - DNA, 20 bp, Artificial Sequence
  chemically synthesized
catcggtctctaaataaact

SEQ ID NO: 450973 - DNA, 20 bp, Artificial Sequence
  chemically synthesized
aaattatttccaagtttatt

SEQ ID NO: 450974 - DNA, 20 bp, Artificial Sequence
  chemically synthesized
attatttccaagtttattta

SEQ ID NO: 450975 - DNA, 20 bp, Artificial Sequence
  chemically synthesized
aagtttatttagagaccgat

SEQ ID NO: 450976 - DNA, 20 bp, Artificial Sequence
  chemically synthesized
agtttttccctttcactcat

SEQ ID NO: 450977 - DNA, 20 bp, Artificial Sequence
  chemically synthesized
atttagagaccgatgagtga

SEQ ID NO: 450978 - DNA, 20 bp, Artificial Sequence
  chemically synthesized
tttagagaccgatgagtgaa

SEQ ID NO: 450979 - DNA, 20 bp, Artificial Sequence
  chemically synthesized
ttagagaccgatgagtgaaa

SEQ ID NO: 450980 - DNA, 20 bp, Artificial Sequence
  chemically synthesized
atgtaattctttaggtatta

SEQ ID NO: 450981 - DNA, 20 bp, Artificial Sequence
  chemically synthesized
gggaaaaactgtaataccta

SEQ ID NO: 450982 - DNA, 20 bp, Artificial Sequence
  chemically synthesized
ttattttcatgtaattcttt

SEQ ID NO: 450983 - DNA, 20 bp, Artificial Sequence
  chemically synthesized
cttattttcatgtaattctt

SEQ ID NO: 450984 - DNA, 20 bp, Artificial Sequence
  chemically synthesized
ctaaagaattacatgaaaat

SEQ ID NO: 450985 - DNA, 20 bp, Artificial Sequence
  chemically synthesized
aattacatgaaaataagaaa

SEQ ID NO: 450986 - DNA, 20 bp, Artificial Sequence
  chemically synthesized
gaaaataagaaatagaccaa

SEQ ID NO: 450987 - DNA, 20 bp, Artificial Sequence
  chemically synthesized
ccaatttttcaattgacttt

SEQ ID NO: 450988 - DNA, 20 bp, Artificial Sequence
  chemically synthesized
ccaaaagtcaattgaaaaat

SEQ ID NO: 450989 - DNA, 20 bp, Artificial Sequence
  chemically synthesized
agtcaattgaaaaattggca

SEQ ID NO: 450990 - DNA, 20 bp, Artificial Sequence
  chemically synthesized
gtcaattgaaaaattggcaa

SEQ ID NO: 450991 - DNA, 20 bp, Artificial Sequence
  chemically synthesized
aaattggcaaaggacatgaa

SEQ ID NO: 450992 - DNA, 20 bp, Artificial Sequence
  chemically synthesized
aaggacatgaacagatgatt

SEQ ID NO: 450993 - DNA, 20 bp, Artificial Sequence
  chemically synthesized
ggacatgaacagatgattca

SEQ ID NO: 450994 - DNA, 20 bp, Artificial Sequence
  chemically synthesized
catgaacagatgattcagag

SEQ ID NO: 450995 - DNA, 20 bp, Artificial Sequence
  chemically synthesized
atgaacagatgattcagagc

SEQ ID NO: 450996 - DNA, 20 bp, Artificial Sequence
  chemically synthesized
attcagagcaggaaataata

SEQ ID NO: 450997 - DNA, 20 bp, Artificial Sequence
  chemically synthesized
ttcagagcaggaaataataa

SEQ ID NO: 450998 - DNA, 20 bp, Artificial Sequence
  chemically synthesized
tcagagcaggaaataataaa

SEQ ID NO: 450999 - DNA, 20 bp, Artificial Sequence
  chemically synthesized
taaagggtcaatgaatataa

SEQ ID NO: 451000 - DNA, 20 bp, Artificial Sequence
  chemically synthesized
acattgatcaaaaaacaaat

SEQ ID NO: 451001 - DNA, 20 bp, Artificial Sequence
  chemically synthesized
ataatttttatcaatttgat

SEQ ID NO: 451002 - DNA, 20 bp, Artificial Sequence
  chemically synthesized
tcaaattgataaaaattata

SEQ ID NO: 451003 - DNA, 20 bp, Artificial Sequence
  chemically synthesized
aattataaagtgtcaatatc

SEQ ID NO: 451004 - DNA, 20 bp, Artificial Sequence
  chemically synthesized
agtgtcaatatctagttgat

SEQ ID NO: 451005 - DNA, 20 bp, Artificial Sequence
  chemically synthesized
tttttcaaattcttatcaac

SEQ ID NO: 451006 - DNA, 20 bp, Artificial Sequence
  chemically synthesized
gttgataagaatttgaaaaa

SEQ ID NO: 451007 - DNA, 20 bp, Artificial Sequence
  chemically synthesized
ttgataagaatttgaaaaat

SEQ ID NO: 451008 - DNA, 20 bp, Artificial Sequence
  chemically synthesized
tgataagaatttgaaaaatg

SEQ ID NO: 451009 - DNA, 20 bp, Artificial Sequence
  chemically synthesized
gataagaatttgaaaaatgg

SEQ ID NO: 451010 - DNA, 20 bp, Artificial Sequence
  chemically synthesized
ggggatgcatacactactgt

SEQ ID NO: 451011 - DNA, 20 bp, Artificial Sequence
  chemically synthesized
ggatgcatacactactgttg

SEQ ID NO: 451012 - DNA, 20 bp, Artificial Sequence
  chemically synthesized
gatgcatacactactgttgg

SEQ ID NO: 451013 - DNA, 20 bp, Artificial Sequence
  chemically synthesized
ccaatttatgcctccaacag

SEQ ID NO: 451014 - DNA, 20 bp, Artificial Sequence
  chemically synthesized
gtaccaatttatgcctccaa

SEQ ID NO: 451015 - DNA, 20 bp, Artificial Sequence
  chemically synthesized
ctactgttggaggcataaat

SEQ ID NO: 451016 - DNA, 20 bp, Artificial Sequence
  chemically synthesized
cgtacttgattttagaatgg

SEQ ID NO: 451017 - DNA, 20 bp, Artificial Sequence
  chemically synthesized
tgccgtacttgattttagaa

SEQ ID NO: 451018 - DNA, 20 bp, Artificial Sequence
  chemically synthesized
ggtaccaccattctaaaatc

SEQ ID NO: 451019 - DNA, 20 bp, Artificial Sequence
  chemically synthesized
cattttgccgtacttgattt

SEQ ID NO: 451020 - DNA, 20 bp, Artificial Sequence
  chemically synthesized
caccattctaaaatcaagta

SEQ ID NO: 451021 - DNA, 20 bp, Artificial Sequence
  chemically synthesized
tgttatattaatattatttt

SEQ ID NO: 451022 - DNA, 20 bp, Artificial Sequence
  chemically synthesized
tattatttttagtcatcctc

SEQ ID NO: 451023 - DNA, 20 bp, Artificial Sequence
  chemically synthesized
gaaatatgtcaaacaactgg

SEQ ID NO: 451024 - DNA, 20 bp, Artificial Sequence
  chemically synthesized
tgaaatatgtcaaacaactg

SEQ ID NO: 451025 - DNA, 20 bp, Artificial Sequence
  chemically synthesized
tatgaaatatgtcaaacaac

SEQ ID NO: 451026 - DNA, 20 bp, Artificial Sequence
  chemically synthesized
aatatatacatgtatcaaaa

SEQ ID NO: 451027 - DNA, 20 bp, Artificial Sequence
  chemically synthesized
ttcattttctaatttaaatt

SEQ ID NO: 451028 - DNA, 20 bp, Artificial Sequence
  chemically synthesized
caaaatagctcaatttaaat

SEQ ID NO: 451029 - DNA, 20 bp, Artificial Sequence
  chemically synthesized
aatatacatgacctatcttt

SEQ ID NO: 451030 - DNA, 20 bp, Artificial Sequence
  chemically synthesized
acagactagttcttaaagat

SEQ ID NO: 451031 - DNA, 20 bp, Artificial Sequence
  chemically synthesized
tacagactagttcttaaaga

SEQ ID NO: 451032 - DNA, 20 bp, Artificial Sequence
  chemically synthesized
catgacctatctttaagaac

SEQ ID NO: 451033 - DNA, 20 bp, Artificial Sequence
  chemically synthesized
aacatacagactagttctta

SEQ ID NO: 451034 - DNA, 20 bp, Artificial Sequence
  chemically synthesized
gaaatggtaaacatacagac

SEQ ID NO: 451035 - DNA, 20 bp, Artificial Sequence
  chemically synthesized
aaatggaaatggtaaacata

SEQ ID NO: 451036 - DNA, 20 bp, Artificial Sequence
  chemically synthesized
aaaaaatgttcaaatggaaa

SEQ ID NO: 451037 - DNA, 20 bp, Artificial Sequence
  chemically synthesized
atgaataaaaaatgttcaaa

SEQ ID NO: 451038 - DNA, 20 bp, Artificial Sequence
  chemically synthesized
ttttttattcatttctctta

SEQ ID NO: 451039 - DNA, 20 bp, Artificial Sequence
  chemically synthesized
taaatatataggatctataa

SEQ ID NO: 451040 - DNA, 20 bp, Artificial Sequence
  chemically synthesized
attaaatatataggatctat

SEQ ID NO: 451041 - DNA, 20 bp, Artificial Sequence
  chemically synthesized
caagaacacattaaatatat

SEQ ID NO: 451042 - DNA, 20 bp, Artificial Sequence
  chemically synthesized
gcaagaacacattaaatata

SEQ ID NO: 451043 - DNA, 20 bp, Artificial Sequence
  chemically synthesized
ttgcctttaacagcaaaagc

SEQ ID NO: 451044 - DNA, 20 bp, Artificial Sequence
  chemically synthesized
agtcttgcctttaacagcaa

SEQ ID NO: 451045 - DNA, 20 bp, Artificial Sequence
  chemically synthesized
tgttcttgcttttgctgtta

SEQ ID NO: 451046 - DNA, 20 bp, Artificial Sequence
  chemically synthesized
gttcttgcttttgctgttaa

SEQ ID NO: 451047 - DNA, 20 bp, Artificial Sequence
  chemically synthesized
gtctccagtcttgcctttaa

SEQ ID NO: 451048 - DNA, 20 bp, Artificial Sequence
  chemically synthesized
ttgcttttgctgttaaaggc

SEQ ID NO: 451049 - DNA, 20 bp, Artificial Sequence
  chemically synthesized
tttgctgttaaaggcaagac

SEQ ID NO: 451050 - DNA, 20 bp, Artificial Sequence
  chemically synthesized
tgctgttaaaggcaagactg

SEQ ID NO: 451051 - DNA, 20 bp, Artificial Sequence
  chemically synthesized
ctgtaatttaaagaagtctc

SEQ ID NO: 451052 - DNA, 20 bp, Artificial Sequence
  chemically synthesized
taaagcactgtaatttaaag

SEQ ID NO: 451053 - DNA, 20 bp, Artificial Sequence
  chemically synthesized
ctggagacttctttaaatta

SEQ ID NO: 451054 - DNA, 20 bp, Artificial Sequence
  chemically synthesized
tgataaagcactgtaattta

SEQ ID NO: 451055 - DNA, 20 bp, Artificial Sequence
  chemically synthesized
taaaatgatgcatgttgata

SEQ ID NO: 451056 - DNA, 20 bp, Artificial Sequence
  chemically synthesized
tttatcaacatgcatcattt

SEQ ID NO: 451057 - DNA, 20 bp, Artificial Sequence
  chemically synthesized
atgcatcattttagattcac

SEQ ID NO: 451058 - DNA, 20 bp, Artificial Sequence
  chemically synthesized
gattcacaagcatccttaac

SEQ ID NO: 451059 - DNA, 20 bp, Artificial Sequence
  chemically synthesized
ttcacaagcatccttaacca

SEQ ID NO: 451060 - DNA, 20 bp, Artificial Sequence
  chemically synthesized
aagctctctgactctggtta

SEQ ID NO: 451061 - DNA, 20 bp, Artificial Sequence
  chemically synthesized
aaagctctctgactctggtt

SEQ ID NO: 451062 - DNA, 20 bp, Artificial Sequence
  chemically synthesized
caagcatccttaaccagagt

SEQ ID NO: 451063 - DNA, 20 bp, Artificial Sequence
  chemically synthesized
agcatccttaaccagagtca

SEQ ID NO: 451064 - DNA, 20 bp, Artificial Sequence
  chemically synthesized
tttaaaaagctctctgactc

SEQ ID NO: 451065 - DNA, 20 bp, Artificial Sequence
  chemically synthesized
catccttaaccagagtcaga

SEQ ID NO: 451066 - DNA, 20 bp, Artificial Sequence
  chemically synthesized
atatatatatattttttaaa

SEQ ID NO: 451067 - DNA, 20 bp, Artificial Sequence
  chemically synthesized
aaaatatatatatatatata

SEQ ID NO: 451068 - DNA, 20 bp, Artificial Sequence
  chemically synthesized
acacagaaagtaaaagggag

SEQ ID NO: 451069 - DNA, 20 bp, Artificial Sequence
  chemically synthesized
ataacacagaaagtaaaagg

SEQ ID NO: 451070 - DNA, 20 bp, Artificial Sequence
  chemically synthesized
atataacacagaaagtaaaa

SEQ ID NO: 451071 - DNA, 20 bp, Artificial Sequence
  chemically synthesized
catataacacagaaagtaaa

SEQ ID NO: 451072 - DNA, 20 bp, Artificial Sequence
  chemically synthesized
ccatataacacagaaagtaa

SEQ ID NO: 451073 - DNA, 20 bp, Artificial Sequence
  chemically synthesized
caaaatccatataacacaga

SEQ ID NO: 451074 - DNA, 20 bp, Artificial Sequence
  chemically synthesized
cttttactttctgtgttata

SEQ ID NO: 451075 - DNA, 20 bp, Artificial Sequence
  chemically synthesized
aactcaaaatccatataaca

SEQ ID NO: 451076 - DNA, 20 bp, Artificial Sequence
  chemically synthesized
ttctgtgttatatggatttt

SEQ ID NO: 451077 - DNA, 20 bp, Artificial Sequence
  chemically synthesized
tatatggattttgagtttct

SEQ ID NO: 451078 - DNA, 20 bp, Artificial Sequence
  chemically synthesized
attttgagtttcttagtttt

SEQ ID NO: 451079 - DNA, 20 bp, Artificial Sequence
  chemically synthesized
aaattccatagctcaaaact

SEQ ID NO: 451080 - DNA, 20 bp, Artificial Sequence
  chemically synthesized
agtttcttagttttgagcta

SEQ ID NO: 451081 - DNA, 20 bp, Artificial Sequence
  chemically synthesized
cccatagaaagaaaattcca

SEQ ID NO: 451082 - DNA, 20 bp, Artificial Sequence
  chemically synthesized
gctatggaattttctttcta

SEQ ID NO: 451083 - DNA, 20 bp, Artificial Sequence
  chemically synthesized
ctatggaattttctttctat

SEQ ID NO: 451084 - DNA, 20 bp, Artificial Sequence
  chemically synthesized
aaaaagaataaacccataga

SEQ ID NO: 451085 - DNA, 20 bp, Artificial Sequence
  chemically synthesized
ttttaaaaagaataaaccca

SEQ ID NO: 451086 - DNA, 20 bp, Artificial Sequence
  chemically synthesized
tatgggtttattctttttaa

SEQ ID NO: 451087 - DNA, 20 bp, Artificial Sequence
  chemically synthesized
taaatagcactacttttaaa

SEQ ID NO: 451088 - DNA, 20 bp, Artificial Sequence
  chemically synthesized
gggtttattctttttaaaag

SEQ ID NO: 451089 - DNA, 20 bp, Artificial Sequence
  chemically synthesized
tttttaaaagtagtgctatt

SEQ ID NO: 451090 - DNA, 20 bp, Artificial Sequence
  chemically synthesized
tatataaatggaaatctaaa

SEQ ID NO: 451091 - DNA, 20 bp, Artificial Sequence
  chemically synthesized
gctaaagaacaatatataaa

SEQ ID NO: 451092 - DNA, 20 bp, Artificial Sequence
  chemically synthesized
tccatttatatattgttctt

SEQ ID NO: 451093 - DNA, 20 bp, Artificial Sequence
  chemically synthesized
atgatttgcttaaggggcta

SEQ ID NO: 451094 - DNA, 20 bp, Artificial Sequence
  chemically synthesized
atattgttctttagcccctt

SEQ ID NO: 451095 - DNA, 20 bp, Artificial Sequence
  chemically synthesized
agtctgatgatttgcttaag

SEQ ID NO: 451096 - DNA, 20 bp, Artificial Sequence
  chemically synthesized
aagtctgatgatttgcttaa

SEQ ID NO: 451097 - DNA, 20 bp, Artificial Sequence
  chemically synthesized
taagtctgatgatttgctta

SEQ ID NO: 451098 - DNA, 20 bp, Artificial Sequence
  chemically synthesized
ttaagtctgatgatttgctt

SEQ ID NO: 451099 - DNA, 20 bp, Artificial Sequence
  chemically synthesized
tagccccttaagcaaatcat

SEQ ID NO: 451100 - DNA, 20 bp, Artificial Sequence
  chemically synthesized
ttaagcaaatcatcagactt

SEQ ID NO: 451101 - DNA, 20 bp, Artificial Sequence
  chemically synthesized
taagcaaatcatcagactta

SEQ ID NO: 451102 - DNA, 20 bp, Artificial Sequence
  chemically synthesized
aagcaaatcatcagacttaa

SEQ ID NO: 451103 - DNA, 20 bp, Artificial Sequence
  chemically synthesized
gtattatgaatggtgccctt

SEQ ID NO: 451104 - DNA, 20 bp, Artificial Sequence
  chemically synthesized
tgtaataatagtattatgaa

SEQ ID NO: 451105 - DNA, 20 bp, Artificial Sequence
  chemically synthesized
tgactaataatatgtaataa

SEQ ID NO: 451106 - DNA, 20 bp, Artificial Sequence
  chemically synthesized
atactattattacatattat

SEQ ID NO: 451107 - DNA, 20 bp, Artificial Sequence
  chemically synthesized
attagtcaaatatctataaa

SEQ ID NO: 451108 - DNA, 20 bp, Artificial Sequence
  chemically synthesized
gtgtcatattcatcttttta

SEQ ID NO: 451109 - DNA, 20 bp, Artificial Sequence
  chemically synthesized
aaaaagatgaatatgacacc

SEQ ID NO: 451110 - DNA, 20 bp, Artificial Sequence
  chemically synthesized
atgaatatgacaccaagtga

SEQ ID NO: 451111 - DNA, 20 bp, Artificial Sequence
  chemically synthesized
actgatgacattctatcact

SEQ ID NO: 451112 - DNA, 20 bp, Artificial Sequence
  chemically synthesized
accaagtgatagaatgtcat

SEQ ID NO: 451113 - DNA, 20 bp, Artificial Sequence
  chemically synthesized
ttattactattatttttaga

SEQ ID NO: 451114 - DNA, 20 bp, Artificial Sequence
  chemically synthesized
ttttattactattattttta

SEQ ID NO: 451115 - DNA, 20 bp, Artificial Sequence
  chemically synthesized
atcagtctctctaaaaataa

SEQ ID NO: 451116 - DNA, 20 bp, Artificial Sequence
  chemically synthesized
atttttattactattatttt

SEQ ID NO: 451117 - DNA, 20 bp, Artificial Sequence
  chemically synthesized
aaaaataatagtaataaaaa

SEQ ID NO: 451118 - DNA, 20 bp, Artificial Sequence
  chemically synthesized
aaatagtaatacaatcatac

SEQ ID NO: 451119 - DNA, 20 bp, Artificial Sequence
  chemically synthesized
tagtaatacaatcatacaag

SEQ ID NO: 451120 - DNA, 20 bp, Artificial Sequence
  chemically synthesized
catacaagaagttgtttgct

SEQ ID NO: 451121 - DNA, 20 bp, Artificial Sequence
  chemically synthesized
atacaagaagttgtttgctc

SEQ ID NO: 451122 - DNA, 20 bp, Artificial Sequence
  chemically synthesized
gtataaattaaatttaacct

SEQ ID NO: 451123 - DNA, 20 bp, Artificial Sequence
  chemically synthesized
atataattcttattatttca

SEQ ID NO: 451124 - DNA, 20 bp, Artificial Sequence
  chemically synthesized
aatataattcttattatttc

SEQ ID NO: 451125 - DNA, 20 bp, Artificial Sequence
  chemically synthesized
aatttataccctgaaataat

SEQ ID NO: 451126 - DNA, 20 bp, Artificial Sequence
  chemically synthesized
caatataattcttattattt

SEQ ID NO: 451127 - DNA, 20 bp, Artificial Sequence
  chemically synthesized
ttctgtttcccagacgtgca

SEQ ID NO: 451128 - DNA, 20 bp, Artificial Sequence
  chemically synthesized
attatattgctttgcacgtc

SEQ ID NO: 451129 - DNA, 20 bp, Artificial Sequence
  chemically synthesized
ttatattgctttgcacgtct

SEQ ID NO: 451130 - DNA, 20 bp, Artificial Sequence
  chemically synthesized
tgctttgcacgtctgggaaa

SEQ ID NO: 451131 - DNA, 20 bp, Artificial Sequence
  chemically synthesized
tttttgtaagttctgtttcc

SEQ ID NO: 451132 - DNA, 20 bp, Artificial Sequence
  chemically synthesized
gggaaacagaacttacaaaa

SEQ ID NO: 451133 - DNA, 20 bp, Artificial Sequence
  chemically synthesized
ggaaacagaacttacaaaaa

SEQ ID NO: 451134 - DNA, 20 bp, Artificial Sequence
  chemically synthesized
agtcagtttcccttttttgt

SEQ ID NO: 451135 - DNA, 20 bp, Artificial Sequence
  chemically synthesized
gaaacagaacttacaaaaaa

SEQ ID NO: 451136 - DNA, 20 bp, Artificial Sequence
  chemically synthesized
aaaagggaaactgactcata

SEQ ID NO: 451137 - DNA, 20 bp, Artificial Sequence
  chemically synthesized
aatataagtactttatgagt

SEQ ID NO: 451138 - DNA, 20 bp, Artificial Sequence
  chemically synthesized
ttaaaatataagtactttat

SEQ ID NO: 451139 - DNA, 20 bp, Artificial Sequence
  chemically synthesized
gataaataattttaaaatat

SEQ ID NO: 451140 - DNA, 20 bp, Artificial Sequence
  chemically synthesized
tttgttgaacaaatgagaat

SEQ ID NO: 451141 - DNA, 20 bp, Artificial Sequence
  chemically synthesized
gtgcaatttgttgaacaaat

SEQ ID NO: 451142 - DNA, 20 bp, Artificial Sequence
  chemically synthesized
aacaaattgcacaaatatac

SEQ ID NO: 451143 - DNA, 20 bp, Artificial Sequence
  chemically synthesized
acaaatatacaagttgaaaa

SEQ ID NO: 451144 - DNA, 20 bp, Artificial Sequence
  chemically synthesized
ataaaaataatcttacactt

SEQ ID NO: 451145 - DNA, 20 bp, Artificial Sequence
  chemically synthesized
tgaaagaagatcttaagtgt

SEQ ID NO: 451146 - DNA, 20 bp, Artificial Sequence
  chemically synthesized
tagatttgaaagaagatctt

SEQ ID NO: 451147 - DNA, 20 bp, Artificial Sequence
  chemically synthesized
gtttagactagatttgaaag

SEQ ID NO: 451148 - DNA, 20 bp, Artificial Sequence
  chemically synthesized
ttaagatcttctttcaaatc

SEQ ID NO: 451149 - DNA, 20 bp, Artificial Sequence
  chemically synthesized
cttgtttagactagatttga

SEQ ID NO: 451150 - DNA, 20 bp, Artificial Sequence
  chemically synthesized
tccagtagacttgtttagac

SEQ ID NO: 451151 - DNA, 20 bp, Artificial Sequence
  chemically synthesized
ctttcaaatctagtctaaac

SEQ ID NO: 451152 - DNA, 20 bp, Artificial Sequence
  chemically synthesized
agtcttccagtagacttgtt

SEQ ID NO: 451153 - DNA, 20 bp, Artificial Sequence
  chemically synthesized
tctagtctaaacaagtctac

SEQ ID NO: 451154 - DNA, 20 bp, Artificial Sequence
  chemically synthesized
agtctaaacaagtctactgg

SEQ ID NO: 451155 - DNA, 20 bp, Artificial Sequence
  chemically synthesized
gactatccaaagtcttccag

SEQ ID NO: 451156 - DNA, 20 bp, Artificial Sequence
  chemically synthesized
gaagactatccaaagtcttc

SEQ ID NO: 451157 - DNA, 20 bp, Artificial Sequence
  chemically synthesized
acaagtctactggaagactt

SEQ ID NO: 451158 - DNA, 20 bp, Artificial Sequence
  chemically synthesized
gtctactggaagactttgga

SEQ ID NO: 451159 - DNA, 20 bp, Artificial Sequence
  chemically synthesized
ctaacatagaagactatcca

SEQ ID NO: 451160 - DNA, 20 bp, Artificial Sequence
  chemically synthesized
ctttggatagtcttctatgt

SEQ ID NO: 451161 - DNA, 20 bp, Artificial Sequence
  chemically synthesized
gaggcaaagtactaacatag

SEQ ID NO: 451162 - DNA, 20 bp, Artificial Sequence
  chemically synthesized
gcagaggcaaagtactaaca

SEQ ID NO: 451163 - DNA, 20 bp, Artificial Sequence
  chemically synthesized
tctttcatccagcagaggca

SEQ ID NO: 451164 - DNA, 20 bp, Artificial Sequence
  chemically synthesized
tgttagtactttgcctctgc

SEQ ID NO: 451165 - DNA, 20 bp, Artificial Sequence
  chemically synthesized
tgtgttctttcatccagcag

SEQ ID NO: 451166 - DNA, 20 bp, Artificial Sequence
  chemically synthesized
ctgtgttctttcatccagca

SEQ ID NO: 451167 - DNA, 20 bp, Artificial Sequence
  chemically synthesized
gcctgtgttctttcatccag

SEQ ID NO: 451168 - DNA, 20 bp, Artificial Sequence
  chemically synthesized
actttgcctctgctggatga

SEQ ID NO: 451169 - DNA, 20 bp, Artificial Sequence
  chemically synthesized
attgcctgtgttctttcatc

SEQ ID NO: 451170 - DNA, 20 bp, Artificial Sequence
  chemically synthesized
ctctgctggatgaaagaaca

SEQ ID NO: 451171 - DNA, 20 bp, Artificial Sequence
  chemically synthesized
tctgctggatgaaagaacac

SEQ ID NO: 451172 - DNA, 20 bp, Artificial Sequence
  chemically synthesized
aagaacacaggcaatcaaca

SEQ ID NO: 451173 - DNA, 20 bp, Artificial Sequence
  chemically synthesized
ggcaatcaacacagttaatg

SEQ ID NO: 451174 - DNA, 20 bp, Artificial Sequence
  chemically synthesized
gaagaaaaatgtacatatta

SEQ ID NO: 451175 - DNA, 20 bp, Artificial Sequence
  chemically synthesized
tacatattatagtcattgtt

SEQ ID NO: 451176 - DNA, 20 bp, Artificial Sequence
  chemically synthesized
aagttccaatatgtatatac

SEQ ID NO: 451177 - DNA, 20 bp, Artificial Sequence
  chemically synthesized
taagttccaatatgtatata

SEQ ID NO: 451178 - DNA, 20 bp, Artificial Sequence
  chemically synthesized
tttggcctgtatatacatat

SEQ ID NO: 451179 - DNA, 20 bp, Artificial Sequence
  chemically synthesized
catattggaacttactctgc

SEQ ID NO: 451180 - DNA, 20 bp, Artificial Sequence
  chemically synthesized
gcaatttatcctagcagagt

SEQ ID NO: 451181 - DNA, 20 bp, Artificial Sequence
  chemically synthesized
atattggaacttactctgct

SEQ ID NO: 451182 - DNA, 20 bp, Artificial Sequence
  chemically synthesized
ttgtgcaatttatcctagca

SEQ ID NO: 451183 - DNA, 20 bp, Artificial Sequence
  chemically synthesized
atttgtgcaatttatcctag

SEQ ID NO: 451184 - DNA, 20 bp, Artificial Sequence
  chemically synthesized
tatatttgtgcaatttatcc

SEQ ID NO: 451185 - DNA, 20 bp, Artificial Sequence
  chemically synthesized
cagtgcatttattttagaaa

SEQ ID NO: 451186 - DNA, 20 bp, Artificial Sequence
  chemically synthesized
acagtgcatttattttagaa

SEQ ID NO: 451187 - DNA, 20 bp, Artificial Sequence
  chemically synthesized
actcgacagtgcatttattt

SEQ ID NO: 451188 - DNA, 20 bp, Artificial Sequence
  chemically synthesized
tctaaaataaatgcactgtc

SEQ ID NO: 451189 - DNA, 20 bp, Artificial Sequence
  chemically synthesized
gactttatccatggactcga

SEQ ID NO: 451190 - DNA, 20 bp, Artificial Sequence
  chemically synthesized
taaatgcactgtcgagtcca

SEQ ID NO: 451191 - DNA, 20 bp, Artificial Sequence
  chemically synthesized
cactgtcgagtccatggata

SEQ ID NO: 451192 - DNA, 20 bp, Artificial Sequence
  chemically synthesized
caaggataggactttatcca

SEQ ID NO: 451193 - DNA, 20 bp, Artificial Sequence
  chemically synthesized
aattattatctggcaaggat

SEQ ID NO: 451194 - DNA, 20 bp, Artificial Sequence
  chemically synthesized
ggataaagtcctatccttgc

SEQ ID NO: 451195 - DNA, 20 bp, Artificial Sequence
  chemically synthesized
gaattattatctggcaagga

SEQ ID NO: 451196 - DNA, 20 bp, Artificial Sequence
  chemically synthesized
tttagaattattatctggca

SEQ ID NO: 451197 - DNA, 20 bp, Artificial Sequence
  chemically synthesized
ttttagaattattatctggc

SEQ ID NO: 451198 - DNA, 20 bp, Artificial Sequence
  chemically synthesized
ttgtttttagaattattatc

SEQ ID NO: 451199 - DNA, 20 bp, Artificial Sequence
  chemically synthesized
cagataataattctaaaaac

SEQ ID NO: 451200 - DNA, 20 bp, Artificial Sequence
  chemically synthesized
tatttttggtttcttgtttt

SEQ ID NO: 451201 - DNA, 20 bp, Artificial Sequence
  chemically synthesized
aaattttatttttttatttt

SEQ ID NO: 451202 - DNA, 20 bp, Artificial Sequence
  chemically synthesized
ataaaaaaataaaattttga

SEQ ID NO: 451203 - DNA, 20 bp, Artificial Sequence
  chemically synthesized
taaaaaaataaaattttgaa

SEQ ID NO: 451204 - DNA, 20 bp, Artificial Sequence
  chemically synthesized
actcccttgaaaggtacatg

SEQ ID NO: 451205 - DNA, 20 bp, Artificial Sequence
  chemically synthesized
taaaacttcatgtacctttc

SEQ ID NO: 451206 - DNA, 20 bp, Artificial Sequence
  chemically synthesized
aaaacttcatgtacctttca

SEQ ID NO: 451207 - DNA, 20 bp, Artificial Sequence
  chemically synthesized
aaacttcatgtacctttcaa

SEQ ID NO: 451208 - DNA, 20 bp, Artificial Sequence
  chemically synthesized
acttcatgtacctttcaagg

SEQ ID NO: 451209 - DNA, 20 bp, Artificial Sequence
  chemically synthesized
tcgtcacctactcccttgaa

SEQ ID NO: 451210 - DNA, 20 bp, Artificial Sequence
  chemically synthesized
ttcgtcacctactcccttga

SEQ ID NO: 451211 - DNA, 20 bp, Artificial Sequence
  chemically synthesized
tcatgtacctttcaagggag

SEQ ID NO: 451212 - DNA, 20 bp, Artificial Sequence
  chemically synthesized
catgtacctttcaagggagt

SEQ ID NO: 451213 - DNA, 20 bp, Artificial Sequence
  chemically synthesized
tttcaagggagtaggtgacg

SEQ ID NO: 451214 - DNA, 20 bp, Artificial Sequence
  chemically synthesized
aagggagtaggtgacgaaga

SEQ ID NO: 451215 - DNA, 20 bp, Artificial Sequence
  chemically synthesized
gtaggtgacgaagatggtgc

SEQ ID NO: 451216 - DNA, 20 bp, Artificial Sequence
  chemically synthesized
ccctaggctgagagtcattc

SEQ ID NO: 451217 - DNA, 20 bp, Artificial Sequence
  chemically synthesized
gatggtgctagaatgactct

SEQ ID NO: 451218 - DNA, 20 bp, Artificial Sequence
  chemically synthesized
tgctagaatgactctcagcc

SEQ ID NO: 451219 - DNA, 20 bp, Artificial Sequence
  chemically synthesized
gctagaatgactctcagcct

SEQ ID NO: 451220 - DNA, 20 bp, Artificial Sequence
  chemically synthesized
gacacaccaccctaggctga

SEQ ID NO: 451221 - DNA, 20 bp, Artificial Sequence
  chemically synthesized
ctagaatgactctcagccta

SEQ ID NO: 451222 - DNA, 20 bp, Artificial Sequence
  chemically synthesized
atgacacaccaccctaggct

SEQ ID NO: 451223 - DNA, 20 bp, Artificial Sequence
  chemically synthesized
gaatgactctcagcctaggg

SEQ ID NO: 451224 - DNA, 20 bp, Artificial Sequence
  chemically synthesized
atcttatgacacaccaccct

SEQ ID NO: 451225 - DNA, 20 bp, Artificial Sequence
  chemically synthesized
aatcttatgacacaccaccc

SEQ ID NO: 451226 - DNA, 20 bp, Artificial Sequence
  chemically synthesized
agcctagggtggtgtgtcat

SEQ ID NO: 451227 - DNA, 20 bp, Artificial Sequence
  chemically synthesized
agggtggtgtgtcataagat

SEQ ID NO: 451228 - DNA, 20 bp, Artificial Sequence
  chemically synthesized
tggtgtgtcataagattaga

SEQ ID NO: 451229 - DNA, 20 bp, Artificial Sequence
  chemically synthesized
accacttggcttacagagat

SEQ ID NO: 451230 - DNA, 20 bp, Artificial Sequence
  chemically synthesized
agatgtgttctaatctctgt

SEQ ID NO: 451231 - DNA, 20 bp, Artificial Sequence
  chemically synthesized
gaactaccacttggcttaca

SEQ ID NO: 451232 - DNA, 20 bp, Artificial Sequence
  chemically synthesized
tgttctaatctctgtaagcc

SEQ ID NO: 451233 - DNA, 20 bp, Artificial Sequence
  chemically synthesized
atgaactaccacttggctta

SEQ ID NO: 451234 - DNA, 20 bp, Artificial Sequence
  chemically synthesized
tctaatctctgtaagccaag

SEQ ID NO: 451235 - DNA, 20 bp, Artificial Sequence
  chemically synthesized
aatctctgtaagccaagtgg

SEQ ID NO: 451236 - DNA, 20 bp, Artificial Sequence
  chemically synthesized
tttgctgatgaactaccact

SEQ ID NO: 451237 - DNA, 20 bp, Artificial Sequence
  chemically synthesized
taagccaagtggtagttcat

SEQ ID NO: 451238 - DNA, 20 bp, Artificial Sequence
  chemically synthesized
agttcatcagcaaaaattat

SEQ ID NO: 451239 - DNA, 20 bp, Artificial Sequence
  chemically synthesized
atcagttcattgttaattcc

SEQ ID NO: 451240 - DNA, 20 bp, Artificial Sequence
  chemically synthesized
aactgaaagagaaataaacc

SEQ ID NO: 451241 - DNA, 20 bp, Artificial Sequence
  chemically synthesized
aaactgaaagagaaataaac

SEQ ID NO: 451242 - DNA, 20 bp, Artificial Sequence
  chemically synthesized
ttcctggtttatttctcttt

SEQ ID NO: 451243 - DNA, 20 bp, Artificial Sequence
  chemically synthesized
ttaggcggtaaaaactgaaa

SEQ ID NO: 451244 - DNA, 20 bp, Artificial Sequence
  chemically synthesized
ctttaggcggtaaaaactga

SEQ ID NO: 451245 - DNA, 20 bp, Artificial Sequence
  chemically synthesized
ctttcagtttttaccgccta

SEQ ID NO: 451246 - DNA, 20 bp, Artificial Sequence
  chemically synthesized
gttttaaacaagactttagg

SEQ ID NO: 451247 - DNA, 20 bp, Artificial Sequence
  chemically synthesized
aaagttttaaacaagacttt

SEQ ID NO: 451248 - DNA, 20 bp, Artificial Sequence
  chemically synthesized
aaaagttttaaacaagactt

SEQ ID NO: 451249 - DNA, 20 bp, Artificial Sequence
  chemically synthesized
cccagtcaaaagttttaaac

SEQ ID NO: 451250 - DNA, 20 bp, Artificial Sequence
  chemically synthesized
tcttgtttaaaacttttgac

SEQ ID NO: 451251 - DNA, 20 bp, Artificial Sequence
  chemically synthesized
cttgtttaaaacttttgact

SEQ ID NO: 451252 - DNA, 20 bp, Artificial Sequence
  chemically synthesized
cttaaatctggcccagtcaa

SEQ ID NO: 451253 - DNA, 20 bp, Artificial Sequence
  chemically synthesized
tttaaaacttttgactgggc

SEQ ID NO: 451254 - DNA, 20 bp, Artificial Sequence
  chemically synthesized
gtgtaatcttaaatctggcc

SEQ ID NO: 451255 - DNA, 20 bp, Artificial Sequence
  chemically synthesized
cttttgactgggccagattt

SEQ ID NO: 451256 - DNA, 20 bp, Artificial Sequence
  chemically synthesized
aacatgtgtaatcttaaatc

SEQ ID NO: 451257 - DNA, 20 bp, Artificial Sequence
  chemically synthesized
ttaagattacacatgttgtt

SEQ ID NO: 451258 - DNA, 20 bp, Artificial Sequence
  chemically synthesized
taagattacacatgttgtta

SEQ ID NO: 451259 - DNA, 20 bp, Artificial Sequence
  chemically synthesized
aagattacacatgttgttaa

SEQ ID NO: 451260 - DNA, 20 bp, Artificial Sequence
  chemically synthesized
agattacacatgttgttaag

SEQ ID NO: 451261 - DNA, 20 bp, Artificial Sequence
  chemically synthesized
tacacatgttgttaaggggc

SEQ ID NO: 451262 - DNA, 20 bp, Artificial Sequence
  chemically synthesized
acacatgttgttaaggggca

SEQ ID NO: 451263 - DNA, 20 bp, Artificial Sequence
  chemically synthesized
catgttgttaaggggcaagg

SEQ ID NO: 451264 - DNA, 20 bp, Artificial Sequence
  chemically synthesized
atgttgttaaggggcaaggc

SEQ ID NO: 451265 - DNA, 20 bp, Artificial Sequence
  chemically synthesized
ttaaggggcaaggcaggtcc

SEQ ID NO: 451266 - DNA, 20 bp, Artificial Sequence
  chemically synthesized
ttctaatcctagggtaaact

SEQ ID NO: 451267 - DNA, 20 bp, Artificial Sequence
  chemically synthesized
attctaatcctagggtaaac

SEQ ID NO: 451268 - DNA, 20 bp, Artificial Sequence
  chemically synthesized
aggcaggtcctagtttaccc

SEQ ID NO: 451269 - DNA, 20 bp, Artificial Sequence
  chemically synthesized
ggcaggtcctagtttaccct

SEQ ID NO: 451270 - DNA, 20 bp, Artificial Sequence
  chemically synthesized
gtcctagtttaccctaggat

SEQ ID NO: 451271 - DNA, 20 bp, Artificial Sequence
  chemically synthesized
ggcttaacattctaatccta

SEQ ID NO: 451272 - DNA, 20 bp, Artificial Sequence
  chemically synthesized
tggcttaacattctaatcct

SEQ ID NO: 451273 - DNA, 20 bp, Artificial Sequence
  chemically synthesized
gtggcttaacattctaatcc

SEQ ID NO: 451274 - DNA, 20 bp, Artificial Sequence
  chemically synthesized
taccctaggattagaatgtt

SEQ ID NO: 451275 - DNA, 20 bp, Artificial Sequence
  chemically synthesized
tagaatgttaagccaccaac

SEQ ID NO: 451276 - DNA, 20 bp, Artificial Sequence
  chemically synthesized
agggttattttgctggttgg

SEQ ID NO: 451277 - DNA, 20 bp, Artificial Sequence
  chemically synthesized
cctagggttattttgctggt

SEQ ID NO: 451278 - DNA, 20 bp, Artificial Sequence
  chemically synthesized
tgtccctagggttattttgc

SEQ ID NO: 451279 - DNA, 20 bp, Artificial Sequence
  chemically synthesized
accaaccagcaaaataaccc

SEQ ID NO: 451280 - DNA, 20 bp, Artificial Sequence
  chemically synthesized
ccaaccagcaaaataaccct

SEQ ID NO: 451281 - DNA, 20 bp, Artificial Sequence
  chemically synthesized
caaccagcaaaataacccta

SEQ ID NO: 451282 - DNA, 20 bp, Artificial Sequence
  chemically synthesized
ctgactttattttgtcccta

SEQ ID NO: 451283 - DNA, 20 bp, Artificial Sequence
  chemically synthesized
actgactttattttgtccct

SEQ ID NO: 451284 - DNA, 20 bp, Artificial Sequence
  chemically synthesized
aactgactttattttgtccc

SEQ ID NO: 451285 - DNA, 20 bp, Artificial Sequence
  chemically synthesized
ataaccctagggacaaaata

SEQ ID NO: 451286 - DNA, 20 bp, Artificial Sequence
  chemically synthesized
ccctagggacaaaataaagt

SEQ ID NO: 451287 - DNA, 20 bp, Artificial Sequence
  chemically synthesized
agggacaaaataaagtcagt

SEQ ID NO: 451288 - DNA, 20 bp, Artificial Sequence
  chemically synthesized
caaaataaagtcagttggat

SEQ ID NO: 451289 - DNA, 20 bp, Artificial Sequence
  chemically synthesized
gttggatcagaattgaaact

SEQ ID NO: 451290 - DNA, 20 bp, Artificial Sequence
  chemically synthesized
ttggatcagaattgaaactg

SEQ ID NO: 451291 - DNA, 20 bp, Artificial Sequence
  chemically synthesized
tggatcagaattgaaactga

SEQ ID NO: 451292 - DNA, 20 bp, Artificial Sequence
  chemically synthesized
ggatcagaattgaaactgag

SEQ ID NO: 451293 - DNA, 20 bp, Artificial Sequence
  chemically synthesized
aaagaagagtggagacccct

SEQ ID NO: 451294 - DNA, 20 bp, Artificial Sequence
  chemically synthesized
tctttggggaaagaagagtg

SEQ ID NO: 451295 - DNA, 20 bp, Artificial Sequence
  chemically synthesized
attctttggggaaagaagag

SEQ ID NO: 451296 - DNA, 20 bp, Artificial Sequence
  chemically synthesized
aaaattctttggggaaagaa

SEQ ID NO: 451297 - DNA, 20 bp, Artificial Sequence
  chemically synthesized
agaaaattctttggggaaag

SEQ ID NO: 451298 - DNA, 20 bp, Artificial Sequence
  chemically synthesized
tctccactcttctttcccca

SEQ ID NO: 451299 - DNA, 20 bp, Artificial Sequence
  chemically synthesized
aggagaaaattctttgggga

SEQ ID NO: 451300 - DNA, 20 bp, Artificial Sequence
  chemically synthesized
acgaaggagaaaattctttg

SEQ ID NO: 451301 - DNA, 20 bp, Artificial Sequence
  chemically synthesized
aacgaaggagaaaattcttt

SEQ ID NO: 451302 - DNA, 20 bp, Artificial Sequence
  chemically synthesized
taacgaaggagaaaattctt

SEQ ID NO: 451303 - DNA, 20 bp, Artificial Sequence
  chemically synthesized
cctccagattcataacgaag

SEQ ID NO: 451304 - DNA, 20 bp, Artificial Sequence
  chemically synthesized
atcctccagattcataacga

SEQ ID NO: 451305 - DNA, 20 bp, Artificial Sequence
  chemically synthesized
tatcctccagattcataacg

SEQ ID NO: 451306 - DNA, 20 bp, Artificial Sequence
  chemically synthesized
tttctccttcgttatgaatc

SEQ ID NO: 451307 - DNA, 20 bp, Artificial Sequence
  chemically synthesized
tctccttcgttatgaatctg

SEQ ID NO: 451308 - DNA, 20 bp, Artificial Sequence
  chemically synthesized
ctccttcgttatgaatctgg

SEQ ID NO: 451309 - DNA, 20 bp, Artificial Sequence
  chemically synthesized
ttactaaaatacatatcctc

SEQ ID NO: 451310 - DNA, 20 bp, Artificial Sequence
  chemically synthesized
aatctggaggatatgtattt

SEQ ID NO: 451311 - DNA, 20 bp, Artificial Sequence
  chemically synthesized
ggaggatatgtattttagta

SEQ ID NO: 451312 - DNA, 20 bp, Artificial Sequence
  chemically synthesized
tatgtattttagtaaagata

SEQ ID NO: 451313 - DNA, 20 bp, Artificial Sequence
  chemically synthesized
atgtattttagtaaagataa

SEQ ID NO: 451314 - DNA, 20 bp, Artificial Sequence
  chemically synthesized
ttttttttacatatattgat

SEQ ID NO: 451315 - DNA, 20 bp, Artificial Sequence
  chemically synthesized
ttttttacatatattgattg

SEQ ID NO: 451316 - DNA, 20 bp, Artificial Sequence
  chemically synthesized
tttttacatatattgattgg

SEQ ID NO: 451317 - DNA, 20 bp, Artificial Sequence
  chemically synthesized
ttttacatatattgattgga

SEQ ID NO: 451318 - DNA, 20 bp, Artificial Sequence
  chemically synthesized
gcattcataatcaattttca

SEQ ID NO: 451319 - DNA, 20 bp, Artificial Sequence
  chemically synthesized
taatcaattttcaaagaaat

SEQ ID NO: 451320 - DNA, 20 bp, Artificial Sequence
  chemically synthesized
tttcaaagaaattagcattg

SEQ ID NO: 451321 - DNA, 20 bp, Artificial Sequence
  chemically synthesized
ttcaaagaaattagcattga

SEQ ID NO: 451322 - DNA, 20 bp, Artificial Sequence
  chemically synthesized
aaattagcattgaaggaaat

SEQ ID NO: 451323 - DNA, 20 bp, Artificial Sequence
  chemically synthesized
aattagcattgaaggaaata

SEQ ID NO: 451324 - DNA, 20 bp, Artificial Sequence
  chemically synthesized
ttagcattgaaggaaataag

SEQ ID NO: 451325 - DNA, 20 bp, Artificial Sequence
  chemically synthesized
gcattgaaggaaataaggag

SEQ ID NO: 451326 - DNA, 20 bp, Artificial Sequence
  chemically synthesized
cattgaaggaaataaggagc

SEQ ID NO: 451327 - DNA, 20 bp, Artificial Sequence
  chemically synthesized
agcaggttacaatttcttta

SEQ ID NO: 451328 - DNA, 20 bp, Artificial Sequence
  chemically synthesized
cacaacctactatgactgta

SEQ ID NO: 451329 - DNA, 20 bp, Artificial Sequence
  chemically synthesized
ttacaatttctttacagtca

SEQ ID NO: 451330 - DNA, 20 bp, Artificial Sequence
  chemically synthesized
caatttctttacagtcatag

SEQ ID NO: 451331 - DNA, 20 bp, Artificial Sequence
  chemically synthesized
aatttctttacagtcatagt

SEQ ID NO: 451332 - DNA, 20 bp, Artificial Sequence
  chemically synthesized
tttacagtcatagtaggttg

SEQ ID NO: 451333 - DNA, 20 bp, Artificial Sequence
  chemically synthesized
ttacagtcatagtaggttgt

SEQ ID NO: 451334 - DNA, 20 bp, Artificial Sequence
  chemically synthesized
acagtcatagtaggttgtgg

SEQ ID NO: 451335 - DNA, 20 bp, Artificial Sequence
  chemically synthesized
agtcatagtaggttgtggga

SEQ ID NO: 451336 - DNA, 20 bp, Artificial Sequence
  chemically synthesized
gtaggttgtgggagagatgc

SEQ ID NO: 451337 - DNA, 20 bp, Artificial Sequence
  chemically synthesized
gaatatgggagtttatagtc

SEQ ID NO: 451338 - DNA, 20 bp, Artificial Sequence
  chemically synthesized
gctcagaatatgggagttta

SEQ ID NO: 451339 - DNA, 20 bp, Artificial Sequence
  chemically synthesized
ataacaagctcagaatatgg

SEQ ID NO: 451340 - DNA, 20 bp, Artificial Sequence
  chemically synthesized
actataaactcccatattct

SEQ ID NO: 451341 - DNA, 20 bp, Artificial Sequence
  chemically synthesized
ggataacaagctcagaatat

SEQ ID NO: 451342 - DNA, 20 bp, Artificial Sequence
  chemically synthesized
aggataacaagctcagaata

SEQ ID NO: 451343 - DNA, 20 bp, Artificial Sequence
  chemically synthesized
ctgtgccaggataacaagct

SEQ ID NO: 451344 - DNA, 20 bp, Artificial Sequence
  chemically synthesized
atattctgagcttgttatcc

SEQ ID NO: 451345 - DNA, 20 bp, Artificial Sequence
  chemically synthesized
aatttctgtgccaggataac

SEQ ID NO: 451346 - DNA, 20 bp, Artificial Sequence
  chemically synthesized
ctgagcttgttatcctggca

SEQ ID NO: 451347 - DNA, 20 bp, Artificial Sequence
  chemically synthesized
gtcatcataatttctgtgcc

SEQ ID NO: 451348 - DNA, 20 bp, Artificial Sequence
  chemically synthesized
tgtcatcataatttctgtgc

SEQ ID NO: 451349 - DNA, 20 bp, Artificial Sequence
  chemically synthesized
aaaaaaatattttcataatg

SEQ ID NO: 451350 - DNA, 20 bp, Artificial Sequence
  chemically synthesized
aatgtagacatgaaatttaa

SEQ ID NO: 451351 - DNA, 20 bp, Artificial Sequence
  chemically synthesized
taaatttcatgtctacatta

SEQ ID NO: 451352 - DNA, 20 bp, Artificial Sequence
  chemically synthesized
acctctgagtttccataatg

SEQ ID NO: 451353 - DNA, 20 bp, Artificial Sequence
  chemically synthesized
atgtctacattatggaaact

SEQ ID NO: 451354 - DNA, 20 bp, Artificial Sequence
  chemically synthesized
gtctacattatggaaactca

SEQ ID NO: 451355 - DNA, 20 bp, Artificial Sequence
  chemically synthesized
tctacattatggaaactcag

SEQ ID NO: 451356 - DNA, 20 bp, Artificial Sequence
  chemically synthesized
ttatgtgaccataaacctct

SEQ ID NO: 451357 - DNA, 20 bp, Artificial Sequence
  chemically synthesized
tatggaaactcagaggttta

SEQ ID NO: 451358 - DNA, 20 bp, Artificial Sequence
  chemically synthesized
tcagaggtttatggtcacat

SEQ ID NO: 451359 - DNA, 20 bp, Artificial Sequence
  chemically synthesized
agaggtttatggtcacataa

SEQ ID NO: 451360 - DNA, 20 bp, Artificial Sequence
  chemically synthesized
ttatggtcacataagagtga

SEQ ID NO: 451361 - DNA, 20 bp, Artificial Sequence
  chemically synthesized
tatggtcacataagagtgaa

SEQ ID NO: 451362 - DNA, 20 bp, Artificial Sequence
  chemically synthesized
atggtcacataagagtgaaa

SEQ ID NO: 451363 - DNA, 20 bp, Artificial Sequence
  chemically synthesized
ataagagtgaaagggcaatc

SEQ ID NO: 451364 - DNA, 20 bp, Artificial Sequence
  chemically synthesized
taagagtgaaagggcaatca

SEQ ID NO: 451365 - DNA, 20 bp, Artificial Sequence
  chemically synthesized
agagtgaaagggcaatcaag

SEQ ID NO: 451366 - DNA, 20 bp, Artificial Sequence
  chemically synthesized
tgaaagggcaatcaaggagt

SEQ ID NO: 451367 - DNA, 20 bp, Artificial Sequence
  chemically synthesized
gaaagggcaatcaaggagta

SEQ ID NO: 451368 - DNA, 20 bp, Artificial Sequence
  chemically synthesized
aggagtaaggaaaaattatg

SEQ ID NO: 451369 - DNA, 20 bp, Artificial Sequence
  chemically synthesized
gtaaggaaaaattatgcaga

SEQ ID NO: 451370 - DNA, 20 bp, Artificial Sequence
  chemically synthesized
taaggaaaaattatgcagaa

SEQ ID NO: 451371 - DNA, 20 bp, Artificial Sequence
  chemically synthesized
aggaaaaattatgcagaaag

SEQ ID NO: 451372 - DNA, 20 bp, Artificial Sequence
  chemically synthesized
aaattatgcagaaaggagaa

SEQ ID NO: 451373 - DNA, 20 bp, Artificial Sequence
  chemically synthesized
aggagaaaagcaatgatgct

SEQ ID NO: 451374 - DNA, 20 bp, Artificial Sequence
  chemically synthesized
gaaaagcaatgatgcttggt

SEQ ID NO: 451375 - DNA, 20 bp, Artificial Sequence
  chemically synthesized
ttagtatgattgttctcacc

SEQ ID NO: 451376 - DNA, 20 bp, Artificial Sequence
  chemically synthesized
ttggtgagaacaatcatact

SEQ ID NO: 451377 - DNA, 20 bp, Artificial Sequence
  chemically synthesized
agaacaatcatactaagtgt

SEQ ID NO: 451378 - DNA, 20 bp, Artificial Sequence
  chemically synthesized
atcatctttgttctcacact

SEQ ID NO: 451379 - DNA, 20 bp, Artificial Sequence
  chemically synthesized
tcatactaagtgtgagaaca

SEQ ID NO: 451380 - DNA, 20 bp, Artificial Sequence
  chemically synthesized
gagaacaaagatgatgtacc

SEQ ID NO: 451381 - DNA, 20 bp, Artificial Sequence
  chemically synthesized
caaagatgatgtacctagtt

SEQ ID NO: 451382 - DNA, 20 bp, Artificial Sequence
  chemically synthesized
gtgactagaaaatctgaact

SEQ ID NO: 451383 - DNA, 20 bp, Artificial Sequence
  chemically synthesized
agtgactagaaaatctgaac

SEQ ID NO: 451384 - DNA, 20 bp, Artificial Sequence
  chemically synthesized
tgtacctagttcagattttc

SEQ ID NO: 451385 - DNA, 20 bp, Artificial Sequence
  chemically synthesized
tcagtaatatttcaagtgac

SEQ ID NO: 451386 - DNA, 20 bp, Artificial Sequence
  chemically synthesized
ttagaggtcagtaatatttc

SEQ ID NO: 451387 - DNA, 20 bp, Artificial Sequence
  chemically synthesized
tccccctaagttttagaggt

SEQ ID NO: 451388 - DNA, 20 bp, Artificial Sequence
  chemically synthesized
aaagtccccctaagttttag

SEQ ID NO: 451389 - DNA, 20 bp, Artificial Sequence
  chemically synthesized
tattactgacctctaaaact

SEQ ID NO: 451390 - DNA, 20 bp, Artificial Sequence
  chemically synthesized
taaagtccccctaagtttta

SEQ ID NO: 451391 - DNA, 20 bp, Artificial Sequence
  chemically synthesized
attactgacctctaaaactt

SEQ ID NO: 451392 - DNA, 20 bp, Artificial Sequence
  chemically synthesized
ttactgacctctaaaactta

SEQ ID NO: 451393 - DNA, 20 bp, Artificial Sequence
  chemically synthesized
cctaaagtccccctaagttt

SEQ ID NO: 451394 - DNA, 20 bp, Artificial Sequence
  chemically synthesized
tactgacctctaaaacttag

SEQ ID NO: 451395 - DNA, 20 bp, Artificial Sequence
  chemically synthesized
actgacctctaaaacttagg

SEQ ID NO: 451396 - DNA, 20 bp, Artificial Sequence
  chemically synthesized
actcagcctaaagtccccct

SEQ ID NO: 451397 - DNA, 20 bp, Artificial Sequence
  chemically synthesized
tctaaaacttagggggactt

SEQ ID NO: 451398 - DNA, 20 bp, Artificial Sequence
  chemically synthesized
ctaaaacttagggggacttt

SEQ ID NO: 451399 - DNA, 20 bp, Artificial Sequence
  chemically synthesized
acttagggggactttaggct

SEQ ID NO: 451400 - DNA, 20 bp, Artificial Sequence
  chemically synthesized
aaattcctggactcagccta

SEQ ID NO: 451401 - DNA, 20 bp, Artificial Sequence
  chemically synthesized
gggggactttaggctgagtc

SEQ ID NO: 451402 - DNA, 20 bp, Artificial Sequence
  chemically synthesized
ggggactttaggctgagtcc

SEQ ID NO: 451403 - DNA, 20 bp, Artificial Sequence
  chemically synthesized
gaaaaaaaaattcctggact

SEQ ID NO: 451404 - DNA, 20 bp, Artificial Sequence
  chemically synthesized
tttagggaaaaaaaaattcc

SEQ ID NO: 451405 - DNA, 20 bp, Artificial Sequence
  chemically synthesized
caggaatttttttttcccta

SEQ ID NO: 451406 - DNA, 20 bp, Artificial Sequence
  chemically synthesized
gccaagtctacagttcttta

SEQ ID NO: 451407 - DNA, 20 bp, Artificial Sequence
  chemically synthesized
tgccaagtctacagttcttt

SEQ ID NO: 451408 - DNA, 20 bp, Artificial Sequence
  chemically synthesized
ttgccaagtctacagttctt

SEQ ID NO: 451409 - DNA, 20 bp, Artificial Sequence
  chemically synthesized
tttttttccctaaagaactg

SEQ ID NO: 451410 - DNA, 20 bp, Artificial Sequence
  chemically synthesized
tccctaaagaactgtagact

SEQ ID NO: 451411 - DNA, 20 bp, Artificial Sequence
  chemically synthesized
atatagacttgccaagtcta

SEQ ID NO: 451412 - DNA, 20 bp, Artificial Sequence
  chemically synthesized
taaagaactgtagacttggc

SEQ ID NO: 451413 - DNA, 20 bp, Artificial Sequence
  chemically synthesized
acactaaatatagacttgcc

SEQ ID NO: 451414 - DNA, 20 bp, Artificial Sequence
  chemically synthesized
agacttggcaagtctatatt

SEQ ID NO: 451415 - DNA, 20 bp, Artificial Sequence
  chemically synthesized
aacagtgagtacactaaata

SEQ ID NO: 451416 - DNA, 20 bp, Artificial Sequence
  chemically synthesized
gcaaaattcagaaaaacagt

SEQ ID NO: 451417 - DNA, 20 bp, Artificial Sequence
  chemically synthesized
ctaggcaaaattcagaaaaa

SEQ ID NO: 451418 - DNA, 20 bp, Artificial Sequence
  chemically synthesized
gtcaggatctaggcaaaatt

SEQ ID NO: 451419 - DNA, 20 bp, Artificial Sequence
  chemically synthesized
ctgtttttctgaattttgcc

SEQ ID NO: 451420 - DNA, 20 bp, Artificial Sequence
  chemically synthesized
acctgtgacagtcaggatct

SEQ ID NO: 451421 - DNA, 20 bp, Artificial Sequence
  chemically synthesized
tacctgtgacagtcaggatc

SEQ ID NO: 451422 - DNA, 20 bp, Artificial Sequence
  chemically synthesized
catctgtacctgtgacagtc

SEQ ID NO: 451423 - DNA, 20 bp, Artificial Sequence
  chemically synthesized
tgcctagatcctgactgtca

SEQ ID NO: 451424 - DNA, 20 bp, Artificial Sequence
  chemically synthesized
tcatctgtacctgtgacagt

SEQ ID NO: 451425 - DNA, 20 bp, Artificial Sequence
  chemically synthesized
gcctagatcctgactgtcac

SEQ ID NO: 451426 - DNA, 20 bp, Artificial Sequence
  chemically synthesized
gaattcatctgtacctgtga

SEQ ID NO: 451427 - DNA, 20 bp, Artificial Sequence
  chemically synthesized
gatcctgactgtcacaggta

SEQ ID NO: 451428 - DNA, 20 bp, Artificial Sequence
  chemically synthesized
acagatgaattcaacacacc

SEQ ID NO: 451429 - DNA, 20 bp, Artificial Sequence
  chemically synthesized
agatgaattcaacacacccg

SEQ ID NO: 451430 - DNA, 20 bp, Artificial Sequence
  chemically synthesized
gatgaattcaacacacccgg

SEQ ID NO: 451431 - DNA, 20 bp, Artificial Sequence
  chemically synthesized
atgaattcaacacacccgga

SEQ ID NO: 451432 - DNA, 20 bp, Artificial Sequence
  chemically synthesized
gtttccaacaagagccctcc

SEQ ID NO: 451433 - DNA, 20 bp, Artificial Sequence
  chemically synthesized
ggtttccaacaagagccctc

SEQ ID NO: 451434 - DNA, 20 bp, Artificial Sequence
  chemically synthesized
cacacccggagggctcttgt

SEQ ID NO: 451435 - DNA, 20 bp, Artificial Sequence
  chemically synthesized
attcttcaggtttccaacaa

SEQ ID NO: 451436 - DNA, 20 bp, Artificial Sequence
  chemically synthesized
aaattcttcaggtttccaac

SEQ ID NO: 451437 - DNA, 20 bp, Artificial Sequence
  chemically synthesized
gggctcttgttggaaacctg

SEQ ID NO: 451438 - DNA, 20 bp, Artificial Sequence
  chemically synthesized
agatttcatggaaattcttc

SEQ ID NO: 451439 - DNA, 20 bp, Artificial Sequence
  chemically synthesized
gagatttcatggaaattctt

SEQ ID NO: 451440 - DNA, 20 bp, Artificial Sequence
  chemically synthesized
tttgacttttggagatttca

SEQ ID NO: 451441 - DNA, 20 bp, Artificial Sequence
  chemically synthesized
aatttccatgaaatctccaa

SEQ ID NO: 451442 - DNA, 20 bp, Artificial Sequence
  chemically synthesized
atggcatcttttgacttttg

SEQ ID NO: 451443 - DNA, 20 bp, Artificial Sequence
  chemically synthesized
taatggcatcttttgacttt

SEQ ID NO: 451444 - DNA, 20 bp, Artificial Sequence
  chemically synthesized
atgaaatctccaaaagtcaa

SEQ ID NO: 451445 - DNA, 20 bp, Artificial Sequence
  chemically synthesized
cctctagagtgttgtaataa

SEQ ID NO: 451446 - DNA, 20 bp, Artificial Sequence
  chemically synthesized
atgccattattacaacactc

SEQ ID NO: 451447 - DNA, 20 bp, Artificial Sequence
  chemically synthesized
gccattattacaacactcta

SEQ ID NO: 451448 - DNA, 20 bp, Artificial Sequence
  chemically synthesized
ccattattacaacactctag

SEQ ID NO: 451449 - DNA, 20 bp, Artificial Sequence
  chemically synthesized
tattacaacactctagaggt

SEQ ID NO: 451450 - DNA, 20 bp, Artificial Sequence
  chemically synthesized
aggtagtttgccaacctcta

SEQ ID NO: 451451 - DNA, 20 bp, Artificial Sequence
  chemically synthesized
aaaggtagtttgccaacctc

SEQ ID NO: 451452 - DNA, 20 bp, Artificial Sequence
  chemically synthesized
aaaaataaataaataaaagg

SEQ ID NO: 451453 - DNA, 20 bp, Artificial Sequence
  chemically synthesized
caaaaaaataaataaataaa

SEQ ID NO: 451454 - DNA, 20 bp, Artificial Sequence
  chemically synthesized
gcaaaaaaataaataaataa

SEQ ID NO: 451455 - DNA, 20 bp, Artificial Sequence
  chemically synthesized
gttggttttattttcaattg

SEQ ID NO: 451456 - DNA, 20 bp, Artificial Sequence
  chemically synthesized
gcctatggaacaatacatgt

SEQ ID NO: 451457 - DNA, 20 bp, Artificial Sequence
  chemically synthesized
aaccaacatgtattgttcca

SEQ ID NO: 451458 - DNA, 20 bp, Artificial Sequence
  chemically synthesized
accaacatgtattgttccat

SEQ ID NO: 451459 - DNA, 20 bp, Artificial Sequence
  chemically synthesized
ataaatttacaaggggccta

SEQ ID NO: 451460 - DNA, 20 bp, Artificial Sequence
  chemically synthesized
tatacaaataaatttacaag

SEQ ID NO: 451461 - DNA, 20 bp, Artificial Sequence
  chemically synthesized
ttatacaaataaatttacaa

SEQ ID NO: 451462 - DNA, 20 bp, Artificial Sequence
  chemically synthesized
tttatacaaataaatttaca

SEQ ID NO: 451463 - DNA, 20 bp, Artificial Sequence
  chemically synthesized
gtttatacaaataaatttac

SEQ ID NO: 451464 - DNA, 20 bp, Artificial Sequence
  chemically synthesized
atttatttgtataaactgct

SEQ ID NO: 451465 - DNA, 20 bp, Artificial Sequence
  chemically synthesized
acattaacgtaaattctcag

SEQ ID NO: 451466 - DNA, 20 bp, Artificial Sequence
  chemically synthesized
aagacattaacgtaaattct

SEQ ID NO: 451467 - DNA, 20 bp, Artificial Sequence
  chemically synthesized
aatgcaaaaagaagaagtaa

SEQ ID NO: 451468 - DNA, 20 bp, Artificial Sequence
  chemically synthesized
aattgaaatgcaaaaagaag

SEQ ID NO: 451469 - DNA, 20 bp, Artificial Sequence
  chemically synthesized
ttcaattgaaatgcaaaaag

SEQ ID NO: 451470 - DNA, 20 bp, Artificial Sequence
  chemically synthesized
gatttcaattgaaatgcaaa

SEQ ID NO: 451471 - DNA, 20 bp, Artificial Sequence
  chemically synthesized
ttgcatttcaattgaaatcc

SEQ ID NO: 451472 - DNA, 20 bp, Artificial Sequence
  chemically synthesized
tgcatttcaattgaaatcct

SEQ ID NO: 451473 - DNA, 20 bp, Artificial Sequence
  chemically synthesized
ttttattgccaaagtttcct

SEQ ID NO: 451474 - DNA, 20 bp, Artificial Sequence
  chemically synthesized
cttttattgccaaagtttcc

SEQ ID NO: 451475 - DNA, 20 bp, Artificial Sequence
  chemically synthesized
attgaaatcctaggaaactt

SEQ ID NO: 451476 - DNA, 20 bp, Artificial Sequence
  chemically synthesized
tattggatcttttattgcca

SEQ ID NO: 451477 - DNA, 20 bp, Artificial Sequence
  chemically synthesized
ctaggaaactttggcaataa

SEQ ID NO: 451478 - DNA, 20 bp, Artificial Sequence
  chemically synthesized
ttggcaataaaagatccaat

SEQ ID NO: 451479 - DNA, 20 bp, Artificial Sequence
  chemically synthesized
ttaaattatcaataacttat

SEQ ID NO: 451480 - DNA, 20 bp, Artificial Sequence
  chemically synthesized
taatttaaaaaatgattcca

SEQ ID NO: 451481 - DNA, 20 bp, Artificial Sequence
  chemically synthesized
aatatagtttgttgatgcta

SEQ ID NO: 451482 - DNA, 20 bp, Artificial Sequence
  chemically synthesized
tgggatattggaatttaata

SEQ ID NO: 451483 - DNA, 20 bp, Artificial Sequence
  chemically synthesized
tgaatcatagaatgggatat

SEQ ID NO: 451484 - DNA, 20 bp, Artificial Sequence
  chemically synthesized
ccaagactgaatcatagaat

SEQ ID NO: 451485 - DNA, 20 bp, Artificial Sequence
  chemically synthesized
gccaagactgaatcatagaa

SEQ ID NO: 451486 - DNA, 20 bp, Artificial Sequence
  chemically synthesized
caatatcccattctatgatt

SEQ ID NO: 451487 - DNA, 20 bp, Artificial Sequence
  chemically synthesized
catgggccaagactgaatca

SEQ ID NO: 451488 - DNA, 20 bp, Artificial Sequence
  chemically synthesized
cccattctatgattcagtct

SEQ ID NO: 451489 - DNA, 20 bp, Artificial Sequence
  chemically synthesized
atcacagatttacatgggcc

SEQ ID NO: 451490 - DNA, 20 bp, Artificial Sequence
  chemically synthesized
tttctatcacagatttacat

SEQ ID NO: 451491 - DNA, 20 bp, Artificial Sequence
  chemically synthesized
ttttctatcacagatttaca

SEQ ID NO: 451492 - DNA, 20 bp, Artificial Sequence
  chemically synthesized
tggcccatgtaaatctgtga

SEQ ID NO: 451493 - DNA, 20 bp, Artificial Sequence
  chemically synthesized
tttcagcttattttctatca

SEQ ID NO: 451494 - DNA, 20 bp, Artificial Sequence
  chemically synthesized
gtaaatctgtgatagaaaat

SEQ ID NO: 451495 - DNA, 20 bp, Artificial Sequence
  chemically synthesized
tctgcccatattggtatttt

SEQ ID NO: 451496 - DNA, 20 bp, Artificial Sequence
  chemically synthesized
ataagctgaaaataccaata

SEQ ID NO: 451497 - DNA, 20 bp, Artificial Sequence
  chemically synthesized
taagctgaaaataccaatat

SEQ ID NO: 451498 - DNA, 20 bp, Artificial Sequence
  chemically synthesized
gctgaaaataccaatatggg

SEQ ID NO: 451499 - DNA, 20 bp, Artificial Sequence
  chemically synthesized
gtattttgttctgcccatat

SEQ ID NO: 451500 - DNA, 20 bp, Artificial Sequence
  chemically synthesized
tgggcagaacaaaatacgta

SEQ ID NO: 451501 - DNA, 20 bp, Artificial Sequence
  chemically synthesized
acgtatgatataaaaattga

SEQ ID NO: 451502 - DNA, 20 bp, Artificial Sequence
  chemically synthesized
gaacgtatgatataaaaatt

SEQ ID NO: 451503 - DNA, 20 bp, Artificial Sequence
  chemically synthesized
aatttttatatcatacgttc

SEQ ID NO: 451504 - DNA, 20 bp, Artificial Sequence
  chemically synthesized
atttttatatcatacgttcc

SEQ ID NO: 451505 - DNA, 20 bp, Artificial Sequence
  chemically synthesized
gtgtttttcattaaatatcc

SEQ ID NO: 451506 - DNA, 20 bp, Artificial Sequence
  chemically synthesized
tatttaatgaaaaacacttt

SEQ ID NO: 451507 - DNA, 20 bp, Artificial Sequence
  chemically synthesized
atatggactcttaggactca

SEQ ID NO: 451508 - DNA, 20 bp, Artificial Sequence
  chemically synthesized
tgaaaaacactttgagtcct

SEQ ID NO: 451509 - DNA, 20 bp, Artificial Sequence
  chemically synthesized
aaaaacactttgagtcctaa

SEQ ID NO: 451510 - DNA, 20 bp, Artificial Sequence
  chemically synthesized
ttctattaatatggactctt

SEQ ID NO: 451511 - DNA, 20 bp, Artificial Sequence
  chemically synthesized
attctattaatatggactct

SEQ ID NO: 451512 - DNA, 20 bp, Artificial Sequence
  chemically synthesized
gtcctaagagtccatattaa

SEQ ID NO: 451513 - DNA, 20 bp, Artificial Sequence
  chemically synthesized
aacgtggaattctattaata

SEQ ID NO: 451514 - DNA, 20 bp, Artificial Sequence
  chemically synthesized
taagttcaggagttttaacg

SEQ ID NO: 451515 - DNA, 20 bp, Artificial Sequence
  chemically synthesized
aaagcttatattaagttcag

SEQ ID NO: 451516 - DNA, 20 bp, Artificial Sequence
  chemically synthesized
ataaagcttatattaagttc

SEQ ID NO: 451517 - DNA, 20 bp, Artificial Sequence
  chemically synthesized
gataaagcttatattaagtt

SEQ ID NO: 451518 - DNA, 20 bp, Artificial Sequence
  chemically synthesized
aaaactcctgaacttaatat

SEQ ID NO: 451519 - DNA, 20 bp, Artificial Sequence
  chemically synthesized
ttgctgataaagcttatatt

SEQ ID NO: 451520 - DNA, 20 bp, Artificial Sequence
  chemically synthesized
gaacttaatataagctttat

SEQ ID NO: 451521 - DNA, 20 bp, Artificial Sequence
  chemically synthesized
tgaaagctatgttgctgata

SEQ ID NO: 451522 - DNA, 20 bp, Artificial Sequence
  chemically synthesized
tataagctttatcagcaaca

SEQ ID NO: 451523 - DNA, 20 bp, Artificial Sequence
  chemically synthesized
tttatcagcaacatagcttt

SEQ ID NO: 451524 - DNA, 20 bp, Artificial Sequence
  chemically synthesized
atttattttatgttaactga

SEQ ID NO: 451525 - DNA, 20 bp, Artificial Sequence
  chemically synthesized
ataaatgtaaataacattga

SEQ ID NO: 451526 - DNA, 20 bp, Artificial Sequence
  chemically synthesized
taaatgtaaataacattgac

SEQ ID NO: 451527 - DNA, 20 bp, Artificial Sequence
  chemically synthesized
ataacattgacaggtcattt

SEQ ID NO: 451528 - DNA, 20 bp, Artificial Sequence
  chemically synthesized
gtcattttagtactaaatat

SEQ ID NO: 451529 - DNA, 20 bp, Artificial Sequence
  chemically synthesized
gcttataaagcactaatatt

SEQ ID NO: 451530 - DNA, 20 bp, Artificial Sequence
  chemically synthesized
actaaatattagtgctttat

SEQ ID NO: 451531 - DNA, 20 bp, Artificial Sequence
  chemically synthesized
aaataatttagttgcttata

SEQ ID NO: 451532 - DNA, 20 bp, Artificial Sequence
  chemically synthesized
ttataagcaactaaattatt

SEQ ID NO: 451533 - DNA, 20 bp, Artificial Sequence
  chemically synthesized
ataaagctgactaaataatt

SEQ ID NO: 451534 - DNA, 20 bp, Artificial Sequence
  chemically synthesized
aagcaactaaattatttagt

SEQ ID NO: 451535 - DNA, 20 bp, Artificial Sequence
  chemically synthesized
ttatttagtcagctttattc

SEQ ID NO: 451536 - DNA, 20 bp, Artificial Sequence
  chemically synthesized
gggtcttcttatctggaata

SEQ ID NO: 451537 - DNA, 20 bp, Artificial Sequence
  chemically synthesized
tagtcagctttattccagat

SEQ ID NO: 451538 - DNA, 20 bp, Artificial Sequence
  chemically synthesized
tcagctttattccagataag

SEQ ID NO: 451539 - DNA, 20 bp, Artificial Sequence
  chemically synthesized
aatccaagggtcttcttatc

SEQ ID NO: 451540 - DNA, 20 bp, Artificial Sequence
  chemically synthesized
attccagataagaagaccct

SEQ ID NO: 451541 - DNA, 20 bp, Artificial Sequence
  chemically synthesized
ctataatttaataaatccaa

SEQ ID NO: 451542 - DNA, 20 bp, Artificial Sequence
  chemically synthesized
tctataatttaataaatcca

SEQ ID NO: 451543 - DNA, 20 bp, Artificial Sequence
  chemically synthesized
atctataatttaataaatcc

SEQ ID NO: 451544 - DNA, 20 bp, Artificial Sequence
  chemically synthesized
cccttggatttattaaatta

SEQ ID NO: 451545 - DNA, 20 bp, Artificial Sequence
  chemically synthesized
tcaggaatagtcagacacat

SEQ ID NO: 451546 - DNA, 20 bp, Artificial Sequence
  chemically synthesized
cggtgtttctcaggaatagt

SEQ ID NO: 451547 - DNA, 20 bp, Artificial Sequence
  chemically synthesized
tgatgtgtctgactattcct

SEQ ID NO: 451548 - DNA, 20 bp, Artificial Sequence
  chemically synthesized
gcttcggtgtttctcaggaa

SEQ ID NO: 451549 - DNA, 20 bp, Artificial Sequence
  chemically synthesized
gtggggcttcggtgtttctc

SEQ ID NO: 451550 - DNA, 20 bp, Artificial Sequence
  chemically synthesized
agtggggcttcggtgtttct

SEQ ID NO: 451551 - DNA, 20 bp, Artificial Sequence
  chemically synthesized
actattcctgagaaacaccg

SEQ ID NO: 451552 - DNA, 20 bp, Artificial Sequence
  chemically synthesized
ttctagacatagtggggctt

SEQ ID NO: 451553 - DNA, 20 bp, Artificial Sequence
  chemically synthesized
tcaatattctagacatagtg

SEQ ID NO: 451554 - DNA, 20 bp, Artificial Sequence
  chemically synthesized
atcaatattctagacatagt

SEQ ID NO: 451555 - DNA, 20 bp, Artificial Sequence
  chemically synthesized
caccgaagccccactatgtc

SEQ ID NO: 451556 - DNA, 20 bp, Artificial Sequence
  chemically synthesized
tatcaatattctagacatag

SEQ ID NO: 451557 - DNA, 20 bp, Artificial Sequence
  chemically synthesized
aaatatcaatattctagaca

SEQ ID NO: 451558 - DNA, 20 bp, Artificial Sequence
  chemically synthesized
ctcagtaaatatcaatattc

SEQ ID NO: 451559 - DNA, 20 bp, Artificial Sequence
  chemically synthesized
ctagaatattgatatttact

SEQ ID NO: 451560 - DNA, 20 bp, Artificial Sequence
  chemically synthesized
tagaatattgatatttactg

SEQ ID NO: 451561 - DNA, 20 bp, Artificial Sequence
  chemically synthesized
agcgacttatgtatgaacct

SEQ ID NO: 451562 - DNA, 20 bp, Artificial Sequence
  chemically synthesized
atttactgaggttcatacat

SEQ ID NO: 451563 - DNA, 20 bp, Artificial Sequence
  chemically synthesized
tcatacataagtcgctatgc

SEQ ID NO: 451564 - DNA, 20 bp, Artificial Sequence
  chemically synthesized
acataagtcgctatgctagt

SEQ ID NO: 451565 - DNA, 20 bp, Artificial Sequence
  chemically synthesized
tcttgaatctctcactagca

SEQ ID NO: 451566 - DNA, 20 bp, Artificial Sequence
  chemically synthesized
ataagtcgctatgctagtga

SEQ ID NO: 451567 - DNA, 20 bp, Artificial Sequence
  chemically synthesized
tttcatcttgaatctctcac

SEQ ID NO: 451568 - DNA, 20 bp, Artificial Sequence
  chemically synthesized
gctatgctagtgagagattc

SEQ ID NO: 451569 - DNA, 20 bp, Artificial Sequence
  chemically synthesized
agagattcaagatgaaactc

SEQ ID NO: 451570 - DNA, 20 bp, Artificial Sequence
  chemically synthesized
atttaataaagagaaagcta

SEQ ID NO: 451571 - DNA, 20 bp, Artificial Sequence
  chemically synthesized
tgatttaataaagagaaagc

SEQ ID NO: 451572 - DNA, 20 bp, Artificial Sequence
  chemically synthesized
aggctgatttaataaagaga

SEQ ID NO: 451573 - DNA, 20 bp, Artificial Sequence
  chemically synthesized
gccaaggctgatttaataaa

SEQ ID NO: 451574 - DNA, 20 bp, Artificial Sequence
  chemically synthesized
aggccaaggctgatttaata

SEQ ID NO: 451575 - DNA, 20 bp, Artificial Sequence
  chemically synthesized
tagctttctctttattaaat

SEQ ID NO: 451576 - DNA, 20 bp, Artificial Sequence
  chemically synthesized
tctctttattaaatcagcct

SEQ ID NO: 451577 - DNA, 20 bp, Artificial Sequence
  chemically synthesized
ataaaaataaggggaggcca

SEQ ID NO: 451578 - DNA, 20 bp, Artificial Sequence
  chemically synthesized
cataaaaataaggggaggcc

SEQ ID NO: 451579 - DNA, 20 bp, Artificial Sequence
  chemically synthesized
acctacataaaaataagggg

SEQ ID NO: 451580 - DNA, 20 bp, Artificial Sequence
  chemically synthesized
tacctacataaaaataaggg

SEQ ID NO: 451581 - DNA, 20 bp, Artificial Sequence
  chemically synthesized
aatacctacataaaaataag

SEQ ID NO: 451582 - DNA, 20 bp, Artificial Sequence
  chemically synthesized
caatacctacataaaaataa

SEQ ID NO: 451583 - DNA, 20 bp, Artificial Sequence
  chemically synthesized
tcaatacctacataaaaata

SEQ ID NO: 451584 - DNA, 20 bp, Artificial Sequence
  chemically synthesized
atcaatacctacataaaaat

SEQ ID NO: 451585 - DNA, 20 bp, Artificial Sequence
  chemically synthesized
ggcctccccttatttttatg

SEQ ID NO: 451586 - DNA, 20 bp, Artificial Sequence
  chemically synthesized
gcctccccttatttttatgt

SEQ ID NO: 451587 - DNA, 20 bp, Artificial Sequence
  chemically synthesized
gtattgatttccttgatttg

SEQ ID NO: 451588 - DNA, 20 bp, Artificial Sequence
  chemically synthesized
ggaaagtttgcttcaaatca

SEQ ID NO: 451589 - DNA, 20 bp, Artificial Sequence
  chemically synthesized
aggaaagtttgcttcaaatc

SEQ ID NO: 451590 - DNA, 20 bp, Artificial Sequence
  chemically synthesized
ttatttttctcaaaagagga

SEQ ID NO: 451591 - DNA, 20 bp, Artificial Sequence
  chemically synthesized
gaagcaaactttcctctttt

SEQ ID NO: 451592 - DNA, 20 bp, Artificial Sequence
  chemically synthesized
tgatttatttttctcaaaag

SEQ ID NO: 451593 - DNA, 20 bp, Artificial Sequence
  chemically synthesized
gtgatttatttttctcaaaa

SEQ ID NO: 451594 - DNA, 20 bp, Artificial Sequence
  chemically synthesized
ttgtgatttatttttctcaa

SEQ ID NO: 451595 - DNA, 20 bp, Artificial Sequence
  chemically synthesized
gggagagatggtaaagcaat

SEQ ID NO: 451596 - DNA, 20 bp, Artificial Sequence
  chemically synthesized
aagaagtgggagagatggta

SEQ ID NO: 451597 - DNA, 20 bp, Artificial Sequence
  chemically synthesized
ggtagaagaagtgggagaga

SEQ ID NO: 451598 - DNA, 20 bp, Artificial Sequence
  chemically synthesized
ttagggtagaagaagtggga

SEQ ID NO: 451599 - DNA, 20 bp, Artificial Sequence
  chemically synthesized
ctttagggtagaagaagtgg

SEQ ID NO: 451600 - DNA, 20 bp, Artificial Sequence
  chemically synthesized
atctttagggtagaagaagt

SEQ ID NO: 451601 - DNA, 20 bp, Artificial Sequence
  chemically synthesized
tatctttagggtagaagaag

SEQ ID NO: 451602 - DNA, 20 bp, Artificial Sequence
  chemically synthesized
agctatctttagggtagaag

SEQ ID NO: 451603 - DNA, 20 bp, Artificial Sequence
  chemically synthesized
gtcagctatctttagggtag

SEQ ID NO: 451604 - DNA, 20 bp, Artificial Sequence
  chemically synthesized
ctcccacttcttctacccta

SEQ ID NO: 451605 - DNA, 20 bp, Artificial Sequence
  chemically synthesized
cttgtcagctatctttaggg

SEQ ID NO: 451606 - DNA, 20 bp, Artificial Sequence
  chemically synthesized
cacttcttctaccctaaaga

SEQ ID NO: 451607 - DNA, 20 bp, Artificial Sequence
  chemically synthesized
agccttgtcagctatcttta

SEQ ID NO: 451608 - DNA, 20 bp, Artificial Sequence
  chemically synthesized
cagccttgtcagctatcttt

SEQ ID NO: 451609 - DNA, 20 bp, Artificial Sequence
  chemically synthesized
ccagccttgtcagctatctt

SEQ ID NO: 451610 - DNA, 20 bp, Artificial Sequence
  chemically synthesized
ctaccctaaagatagctgac

SEQ ID NO: 451611 - DNA, 20 bp, Artificial Sequence
  chemically synthesized
taccctaaagatagctgaca

SEQ ID NO: 451612 - DNA, 20 bp, Artificial Sequence
  chemically synthesized
ctaaagatagctgacaaggc

SEQ ID NO: 451613 - DNA, 20 bp, Artificial Sequence
  chemically synthesized
ctttttattgccagccttgt

SEQ ID NO: 451614 - DNA, 20 bp, Artificial Sequence
  chemically synthesized
tttttctacctttttattgc

SEQ ID NO: 451615 - DNA, 20 bp, Artificial Sequence
  chemically synthesized
ctgacaaggctggcaataaa

SEQ ID NO: 451616 - DNA, 20 bp, Artificial Sequence
  chemically synthesized
tgacaaggctggcaataaaa

SEQ ID NO: 451617 - DNA, 20 bp, Artificial Sequence
  chemically synthesized
caaggctggcaataaaaagg

SEQ ID NO: 451618 - DNA, 20 bp, Artificial Sequence
  chemically synthesized
tggcaataaaaaggtagaaa

SEQ ID NO: 451619 - DNA, 20 bp, Artificial Sequence
  chemically synthesized
ataaaaaggtagaaaaagta

SEQ ID NO: 451620 - DNA, 20 bp, Artificial Sequence
  chemically synthesized
aaaaaggtagaaaaagtaaa

SEQ ID NO: 451621 - DNA, 20 bp, Artificial Sequence
  chemically synthesized
aagtaaagagtcttacaacg

SEQ ID NO: 451622 - DNA, 20 bp, Artificial Sequence
  chemically synthesized
tcaaaaatcatctacgttgt

SEQ ID NO: 451623 - DNA, 20 bp, Artificial Sequence
  chemically synthesized
aacgtagatgatttttgacc

SEQ ID NO: 451624 - DNA, 20 bp, Artificial Sequence
  chemically synthesized
acgtagatgatttttgaccc

SEQ ID NO: 451625 - DNA, 20 bp, Artificial Sequence
  chemically synthesized
tagatgatttttgacccagg

SEQ ID NO: 451626 - DNA, 20 bp, Artificial Sequence
  chemically synthesized
atattaaacttgtacttcct

SEQ ID NO: 451627 - DNA, 20 bp, Artificial Sequence
  chemically synthesized
tatattaaacttgtacttcc

SEQ ID NO: 451628 - DNA, 20 bp, Artificial Sequence
  chemically synthesized
atttttgacccaggaagtac

SEQ ID NO: 451629 - DNA, 20 bp, Artificial Sequence
  chemically synthesized
tacaagtttaatataattaa

SEQ ID NO: 451630 - DNA, 20 bp, Artificial Sequence
  chemically synthesized
taaaagtgcaatgttgaaat

SEQ ID NO: 451631 - DNA, 20 bp, Artificial Sequence
  chemically synthesized
agtgcaatgttgaaatcagc

SEQ ID NO: 451632 - DNA, 20 bp, Artificial Sequence
  chemically synthesized
tgcaatgttgaaatcagcaa

SEQ ID NO: 451633 - DNA, 20 bp, Artificial Sequence
  chemically synthesized
tttctatagagaacataatg

SEQ ID NO: 451634 - DNA, 20 bp, Artificial Sequence
  chemically synthesized
ttttctatagagaacataat

SEQ ID NO: 451635 - DNA, 20 bp, Artificial Sequence
  chemically synthesized
gttttctatagagaacataa

SEQ ID NO: 451636 - DNA, 20 bp, Artificial Sequence
  chemically synthesized
caaccccattatgttctcta

SEQ ID NO: 451637 - DNA, 20 bp, Artificial Sequence
  chemically synthesized
tttttctttggttttctata

SEQ ID NO: 451638 - DNA, 20 bp, Artificial Sequence
  chemically synthesized
tatttttctttggttttcta

SEQ ID NO: 451639 - DNA, 20 bp, Artificial Sequence
  chemically synthesized
atgttctctatagaaaacca

SEQ ID NO: 451640 - DNA, 20 bp, Artificial Sequence
  chemically synthesized
tttggttatttatttttctt

SEQ ID NO: 451641 - DNA, 20 bp, Artificial Sequence
  chemically synthesized
aaagaaaaataaataaccaa

SEQ ID NO: 451642 - DNA, 20 bp, Artificial Sequence
  chemically synthesized
agaaaaataaataaccaaaa

SEQ ID NO: 451643 - DNA, 20 bp, Artificial Sequence
  chemically synthesized
aaaataaataaccaaaagag

SEQ ID NO: 451644 - DNA, 20 bp, Artificial Sequence
  chemically synthesized
cacttttgcagcttctcttt

SEQ ID NO: 451645 - DNA, 20 bp, Artificial Sequence
  chemically synthesized
aaccaaaagagaagctgcaa

SEQ ID NO: 451646 - DNA, 20 bp, Artificial Sequence
  chemically synthesized
tactcaatgaaacacttttg

SEQ ID NO: 451647 - DNA, 20 bp, Artificial Sequence
  chemically synthesized
agctgcaaaagtgtttcatt

SEQ ID NO: 451648 - DNA, 20 bp, Artificial Sequence
  chemically synthesized
caaaagtgtttcattgagta

SEQ ID NO: 451649 - DNA, 20 bp, Artificial Sequence
  chemically synthesized
gcgttcaatacctcgtcaaa

SEQ ID NO: 451650 - DNA, 20 bp, Artificial Sequence
  chemically synthesized
tctttaactcctatttgacg

SEQ ID NO: 451651 - DNA, 20 bp, Artificial Sequence
  chemically synthesized
cgttcaatacctcgtcaaat

SEQ ID NO: 451652 - DNA, 20 bp, Artificial Sequence
  chemically synthesized
atctttaactcctatttgac

SEQ ID NO: 451653 - DNA, 20 bp, Artificial Sequence
  chemically synthesized
ttcaatacctcgtcaaatag

SEQ ID NO: 451654 - DNA, 20 bp, Artificial Sequence
  chemically synthesized
acctcgtcaaataggagtta

SEQ ID NO: 451655 - DNA, 20 bp, Artificial Sequence
  chemically synthesized
tcaaataggagttaaagatt

SEQ ID NO: 451656 - DNA, 20 bp, Artificial Sequence
  chemically synthesized
aggagttaaagatttagtga

SEQ ID NO: 451657 - DNA, 20 bp, Artificial Sequence
  chemically synthesized
aaagatttagtgaaagttga

SEQ ID NO: 451658 - DNA, 20 bp, Artificial Sequence
  chemically synthesized
aagatttagtgaaagttgaa

SEQ ID NO: 451659 - DNA, 20 bp, Artificial Sequence
  chemically synthesized
agatttagtgaaagttgaaa

SEQ ID NO: 451660 - DNA, 20 bp, Artificial Sequence
  chemically synthesized
tttagtgaaagttgaaaggg

SEQ ID NO: 451661 - DNA, 20 bp, Artificial Sequence
  chemically synthesized
tgaaagggtggttaacttga

SEQ ID NO: 451662 - DNA, 20 bp, Artificial Sequence
  chemically synthesized
aagggtggttaacttgaaag

SEQ ID NO: 451663 - DNA, 20 bp, Artificial Sequence
  chemically synthesized
gcctccaactatcttctttc

SEQ ID NO: 451664 - DNA, 20 bp, Artificial Sequence
  chemically synthesized
gtggttaacttgaaagaaga

SEQ ID NO: 451665 - DNA, 20 bp, Artificial Sequence
  chemically synthesized
ttaacttgaaagaagatagt

SEQ ID NO: 451666 - DNA, 20 bp, Artificial Sequence
  chemically synthesized
aacttgaaagaagatagttg

SEQ ID NO: 451667 - DNA, 20 bp, Artificial Sequence
  chemically synthesized
acttgaaagaagatagttgg

SEQ ID NO: 451668 - DNA, 20 bp, Artificial Sequence
  chemically synthesized
aatatgaattatgatgtttg

SEQ ID NO: 451669 - DNA, 20 bp, Artificial Sequence
  chemically synthesized
atatgaattatgatgtttgc

SEQ ID NO: 451670 - DNA, 20 bp, Artificial Sequence
  chemically synthesized
attatgatgtttgcaggttt

SEQ ID NO: 451671 - DNA, 20 bp, Artificial Sequence
  chemically synthesized
atgatgtttgcaggttttag

SEQ ID NO: 451672 - DNA, 20 bp, Artificial Sequence
  chemically synthesized
tgtttgcaggttttagaaga

SEQ ID NO: 451673 - DNA, 20 bp, Artificial Sequence
  chemically synthesized
caggttttagaagaaagtct

SEQ ID NO: 451674 - DNA, 20 bp, Artificial Sequence
  chemically synthesized
gtcatttgatgaaaaaatcc

SEQ ID NO: 451675 - DNA, 20 bp, Artificial Sequence
  chemically synthesized
tggattttttcatcaaatga

SEQ ID NO: 451676 - DNA, 20 bp, Artificial Sequence
  chemically synthesized
tttttcatcaaatgacagat

SEQ ID NO: 451677 - DNA, 20 bp, Artificial Sequence
  chemically synthesized
tttcatcaaatgacagatga

SEQ ID NO: 451678 - DNA, 20 bp, Artificial Sequence
  chemically synthesized
caaatgacagatgagagacg

SEQ ID NO: 451679 - DNA, 20 bp, Artificial Sequence
  chemically synthesized
ttttttatttctgtaataaa

SEQ ID NO: 451680 - DNA, 20 bp, Artificial Sequence
  chemically synthesized
gccacccatactttttatta

SEQ ID NO: 451681 - DNA, 20 bp, Artificial Sequence
  chemically synthesized
tatttctgtaataaaaagta

SEQ ID NO: 451682 - DNA, 20 bp, Artificial Sequence
  chemically synthesized
atttctgtaataaaaagtat

SEQ ID NO: 451683 - DNA, 20 bp, Artificial Sequence
  chemically synthesized
tctgtaataaaaagtatggg

SEQ ID NO: 451684 - DNA, 20 bp, Artificial Sequence
  chemically synthesized
aaaatatttaagtgacagta

SEQ ID NO: 451685 - DNA, 20 bp, Artificial Sequence
  chemically synthesized
aattaaaaatatttaagtga

SEQ ID NO: 451686 - DNA, 20 bp, Artificial Sequence
  chemically synthesized
cttcgcaattaaaaatattt

SEQ ID NO: 451687 - DNA, 20 bp, Artificial Sequence
  chemically synthesized
cttaaatatttttaattgcg

SEQ ID NO: 451688 - DNA, 20 bp, Artificial Sequence
  chemically synthesized
ttgcgaagaaacatctcatc

SEQ ID NO: 451689 - DNA, 20 bp, Artificial Sequence
  chemically synthesized
ttatctactttttacttgat

SEQ ID NO: 451690 - DNA, 20 bp, Artificial Sequence
  chemically synthesized
gaaacatctcatcaagtaaa

SEQ ID NO: 451691 - DNA, 20 bp, Artificial Sequence
  chemically synthesized
acatctcatcaagtaaaaag

SEQ ID NO: 451692 - DNA, 20 bp, Artificial Sequence
  chemically synthesized
tcatcaagtaaaaagtagat

SEQ ID NO: 451693 - DNA, 20 bp, Artificial Sequence
  chemically synthesized
aaaagtagataagaataaac

SEQ ID NO: 451694 - DNA, 20 bp, Artificial Sequence
  chemically synthesized
ataagaataaacaagacgct

SEQ ID NO: 451695 - DNA, 20 bp, Artificial Sequence
  chemically synthesized
aataaacaagacgctaagca

SEQ ID NO: 451696 - DNA, 20 bp, Artificial Sequence
  chemically synthesized
ggacactttctgtctatgct

SEQ ID NO: 451697 - DNA, 20 bp, Artificial Sequence
  chemically synthesized
aacaagacgctaagcataga

SEQ ID NO: 451698 - DNA, 20 bp, Artificial Sequence
  chemically synthesized
agacgctaagcatagacaga

SEQ ID NO: 451699 - DNA, 20 bp, Artificial Sequence
  chemically synthesized
acttttttctgcattaaaat

SEQ ID NO: 451700 - DNA, 20 bp, Artificial Sequence
  chemically synthesized
aacttttttctgcattaaaa

SEQ ID NO: 451701 - DNA, 20 bp, Artificial Sequence
  chemically synthesized
gaaagtgtcctattttaatg

SEQ ID NO: 451702 - DNA, 20 bp, Artificial Sequence
  chemically synthesized
tcctattttaatgcagaaaa

SEQ ID NO: 451703 - DNA, 20 bp, Artificial Sequence
  chemically synthesized
tttttatcatgaagggatgt

SEQ ID NO: 451704 - DNA, 20 bp, Artificial Sequence
  chemically synthesized
ttgagggtttttatcatgaa

SEQ ID NO: 451705 - DNA, 20 bp, Artificial Sequence
  chemically synthesized
gttgagggtttttatcatga

SEQ ID NO: 451706 - DNA, 20 bp, Artificial Sequence
  chemically synthesized
tgttgagggtttttatcatg

SEQ ID NO: 451707 - DNA, 20 bp, Artificial Sequence
  chemically synthesized
ttcatgataaaaaccctcaa

SEQ ID NO: 451708 - DNA, 20 bp, Artificial Sequence
  chemically synthesized
ttcagtgcctagtctgttga

SEQ ID NO: 451709 - DNA, 20 bp, Artificial Sequence
  chemically synthesized
cttcagtgcctagtctgttg

SEQ ID NO: 451710 - DNA, 20 bp, Artificial Sequence
  chemically synthesized
gataaaaaccctcaacagac

SEQ ID NO: 451711 - DNA, 20 bp, Artificial Sequence
  chemically synthesized
ccttcagtgcctagtctgtt

SEQ ID NO: 451712 - DNA, 20 bp, Artificial Sequence
  chemically synthesized
ataaaaaccctcaacagact

SEQ ID NO: 451713 - DNA, 20 bp, Artificial Sequence
  chemically synthesized
cctcaacagactaggcactg

SEQ ID NO: 451714 - DNA, 20 bp, Artificial Sequence
  chemically synthesized
aggtatgttccttcagtgcc

SEQ ID NO: 451715 - DNA, 20 bp, Artificial Sequence
  chemically synthesized
ctcaacagactaggcactga

SEQ ID NO: 451716 - DNA, 20 bp, Artificial Sequence
  chemically synthesized
tattttgaggtatgttcctt

SEQ ID NO: 451717 - DNA, 20 bp, Artificial Sequence
  chemically synthesized
agatggttcttattattttg

SEQ ID NO: 451718 - DNA, 20 bp, Artificial Sequence
  chemically synthesized
tagatggttcttattatttt

SEQ ID NO: 451719 - DNA, 20 bp, Artificial Sequence
  chemically synthesized
ggaacatacctcaaaataat

SEQ ID NO: 451720 - DNA, 20 bp, Artificial Sequence
  chemically synthesized
ggctatggatttgtcataga

SEQ ID NO: 451721 - DNA, 20 bp, Artificial Sequence
  chemically synthesized
tgttggctatggatttgtca

SEQ ID NO: 451722 - DNA, 20 bp, Artificial Sequence
  chemically synthesized
aaccatctatgacaaatcca

SEQ ID NO: 451723 - DNA, 20 bp, Artificial Sequence
  chemically synthesized
attcggtatgatgttggcta

SEQ ID NO: 451724 - DNA, 20 bp, Artificial Sequence
  chemically synthesized
ttgcccattcggtatgatgt

SEQ ID NO: 451725 - DNA, 20 bp, Artificial Sequence
  chemically synthesized
atagccaacatcataccgaa

SEQ ID NO: 451726 - DNA, 20 bp, Artificial Sequence
  chemically synthesized
tagccaacatcataccgaat

SEQ ID NO: 451727 - DNA, 20 bp, Artificial Sequence
  chemically synthesized
cgttccaacttttgcccatt

SEQ ID NO: 451728 - DNA, 20 bp, Artificial Sequence
  chemically synthesized
acatcataccgaatgggcaa

SEQ ID NO: 451729 - DNA, 20 bp, Artificial Sequence
  chemically synthesized
cataccgaatgggcaaaagt

SEQ ID NO: 451730 - DNA, 20 bp, Artificial Sequence
  chemically synthesized
aagttggaacgattcccact

SEQ ID NO: 451731 - DNA, 20 bp, Artificial Sequence
  chemically synthesized
gttttgttccagttctcagt

SEQ ID NO: 451732 - DNA, 20 bp, Artificial Sequence
  chemically synthesized
tgttttgttccagttctcag

SEQ ID NO: 451733 - DNA, 20 bp, Artificial Sequence
  chemically synthesized
gaacgattcccactgagaac

SEQ ID NO: 451734 - DNA, 20 bp, Artificial Sequence
  chemically synthesized
ccttgttttgttccagttct

SEQ ID NO: 451735 - DNA, 20 bp, Artificial Sequence
  chemically synthesized
tgggcatccttgttttgttc

SEQ ID NO: 451736 - DNA, 20 bp, Artificial Sequence
  chemically synthesized
actgagaactggaacaaaac

SEQ ID NO: 451737 - DNA, 20 bp, Artificial Sequence
  chemically synthesized
ctgagaactggaacaaaaca

SEQ ID NO: 451738 - DNA, 20 bp, Artificial Sequence
  chemically synthesized
ttaataaaactggtgagagt

SEQ ID NO: 451739 - DNA, 20 bp, Artificial Sequence
  chemically synthesized
acaaggatgcccactctcac

SEQ ID NO: 451740 - DNA, 20 bp, Artificial Sequence
  chemically synthesized
tttaataaaactggtgagag

SEQ ID NO: 451741 - DNA, 20 bp, Artificial Sequence
  chemically synthesized
atgtttaataaaactggtga

SEQ ID NO: 451742 - DNA, 20 bp, Artificial Sequence
  chemically synthesized
ctatgtttaataaaactggt

SEQ ID NO: 451743 - DNA, 20 bp, Artificial Sequence
  chemically synthesized
agtactatgtttaataaaac

SEQ ID NO: 451744 - DNA, 20 bp, Artificial Sequence
  chemically synthesized
ctcaccagttttattaaaca

SEQ ID NO: 451745 - DNA, 20 bp, Artificial Sequence
  chemically synthesized
agttttattaaacatagtac

SEQ ID NO: 451746 - DNA, 20 bp, Artificial Sequence
  chemically synthesized
tttattaaacatagtactgg

SEQ ID NO: 451747 - DNA, 20 bp, Artificial Sequence
  chemically synthesized
aaacatagtactggaagtcc

SEQ ID NO: 451748 - DNA, 20 bp, Artificial Sequence
  chemically synthesized
attgctgtggctaggacttc

SEQ ID NO: 451749 - DNA, 20 bp, Artificial Sequence
  chemically synthesized
agtactggaagtcctagcca

SEQ ID NO: 451750 - DNA, 20 bp, Artificial Sequence
  chemically synthesized
cttgcctaattgctgtggct

SEQ ID NO: 451751 - DNA, 20 bp, Artificial Sequence
  chemically synthesized
tcttgcctaattgctgtggc

SEQ ID NO: 451752 - DNA, 20 bp, Artificial Sequence
  chemically synthesized
gaagtcctagccacagcaat

SEQ ID NO: 451753 - DNA, 20 bp, Artificial Sequence
  chemically synthesized
tttctcttgcctaattgctg

SEQ ID NO: 451754 - DNA, 20 bp, Artificial Sequence
  chemically synthesized
aagtcctagccacagcaatt

SEQ ID NO: 451755 - DNA, 20 bp, Artificial Sequence
  chemically synthesized
cctagccacagcaattaggc

SEQ ID NO: 451756 - DNA, 20 bp, Artificial Sequence
  chemically synthesized
tagccacagcaattaggcaa

SEQ ID NO: 451757 - DNA, 20 bp, Artificial Sequence
  chemically synthesized
cacagcaattaggcaagaga

SEQ ID NO: 451758 - DNA, 20 bp, Artificial Sequence
  chemically synthesized
agaaataaaatgcatccaaa

SEQ ID NO: 451759 - DNA, 20 bp, Artificial Sequence
  chemically synthesized
gtttgacttctttttctatt

SEQ ID NO: 451760 - DNA, 20 bp, Artificial Sequence
  chemically synthesized
aaaatgcatccaaatagaaa

SEQ ID NO: 451761 - DNA, 20 bp, Artificial Sequence
  chemically synthesized
atgcatccaaatagaaaaag

SEQ ID NO: 451762 - DNA, 20 bp, Artificial Sequence
  chemically synthesized
ataccgtcagtgaaaaaaga

SEQ ID NO: 451763 - DNA, 20 bp, Artificial Sequence
  chemically synthesized
aatcataccgtcagtgaaaa

SEQ ID NO: 451764 - DNA, 20 bp, Artificial Sequence
  chemically synthesized
aaactatcttttttcactga

SEQ ID NO: 451765 - DNA, 20 bp, Artificial Sequence
  chemically synthesized
taagtatagaatcataccgt

SEQ ID NO: 451766 - DNA, 20 bp, Artificial Sequence
  chemically synthesized
tgacggtatgattctatact

SEQ ID NO: 451767 - DNA, 20 bp, Artificial Sequence
  chemically synthesized
gtctttgggttttctaagta

SEQ ID NO: 451768 - DNA, 20 bp, Artificial Sequence
  chemically synthesized
gtggagtctttgggttttct

SEQ ID NO: 451769 - DNA, 20 bp, Artificial Sequence
  chemically synthesized
ttctatacttagaaaaccca

SEQ ID NO: 451770 - DNA, 20 bp, Artificial Sequence
  chemically synthesized
agccttttggtggagtcttt

SEQ ID NO: 451771 - DNA, 20 bp, Artificial Sequence
  chemically synthesized
tagccttttggtggagtctt

SEQ ID NO: 451772 - DNA, 20 bp, Artificial Sequence
  chemically synthesized
aaacccaaagactccaccaa

SEQ ID NO: 451773 - DNA, 20 bp, Artificial Sequence
  chemically synthesized
aacccaaagactccaccaaa

SEQ ID NO: 451774 - DNA, 20 bp, Artificial Sequence
  chemically synthesized
gttctagtagccttttggtg

SEQ ID NO: 451775 - DNA, 20 bp, Artificial Sequence
  chemically synthesized
cagttctagtagccttttgg

SEQ ID NO: 451776 - DNA, 20 bp, Artificial Sequence
  chemically synthesized
tatcagttctagtagccttt

SEQ ID NO: 451777 - DNA, 20 bp, Artificial Sequence
  chemically synthesized
agactccaccaaaaggctac

SEQ ID NO: 451778 - DNA, 20 bp, Artificial Sequence
  chemically synthesized
aaattgtttatcagttctag

SEQ ID NO: 451779 - DNA, 20 bp, Artificial Sequence
  chemically synthesized
ttaaaattgtttatcagttc

SEQ ID NO: 451780 - DNA, 20 bp, Artificial Sequence
  chemically synthesized
acctcgttaaaattgtttat

SEQ ID NO: 451781 - DNA, 20 bp, Artificial Sequence
  chemically synthesized
aactgataaacaattttaac

SEQ ID NO: 451782 - DNA, 20 bp, Artificial Sequence
  chemically synthesized
actgataaacaattttaacg

SEQ ID NO: 451783 - DNA, 20 bp, Artificial Sequence
  chemically synthesized
aacaattttaacgaggtttc

SEQ ID NO: 451784 - DNA, 20 bp, Artificial Sequence
  chemically synthesized
tacataaaaatatattttta

SEQ ID NO: 451785 - DNA, 20 bp, Artificial Sequence
  chemically synthesized
gtaaaacatataaaaattaa

SEQ ID NO: 451786 - DNA, 20 bp, Artificial Sequence
  chemically synthesized
gcttggtcattattgttgta

SEQ ID NO: 451787 - DNA, 20 bp, Artificial Sequence
  chemically synthesized
tctatacaacaataatgacc

SEQ ID NO: 451788 - DNA, 20 bp, Artificial Sequence
  chemically synthesized
acaacaataatgaccaagct

SEQ ID NO: 451789 - DNA, 20 bp, Artificial Sequence
  chemically synthesized
aacaataatgaccaagctga

SEQ ID NO: 451790 - DNA, 20 bp, Artificial Sequence
  chemically synthesized
tcttcatttgactctcagct

SEQ ID NO: 451791 - DNA, 20 bp, Artificial Sequence
  chemically synthesized
tgtgttcttcatttgactct

SEQ ID NO: 451792 - DNA, 20 bp, Artificial Sequence
  chemically synthesized
accaagctgagagtcaaatg

SEQ ID NO: 451793 - DNA, 20 bp, Artificial Sequence
  chemically synthesized
tttctttggctattgtaaat

SEQ ID NO: 451794 - DNA, 20 bp, Artificial Sequence
  chemically synthesized
gaacacaatcccatttacaa

SEQ ID NO: 451795 - DNA, 20 bp, Artificial Sequence
  chemically synthesized
ttttctttggctattgtaaa

SEQ ID NO: 451796 - DNA, 20 bp, Artificial Sequence
  chemically synthesized
aatcccatttacaatagcca

SEQ ID NO: 451797 - DNA, 20 bp, Artificial Sequence
  chemically synthesized
cctaggtatttcattttctt

SEQ ID NO: 451798 - DNA, 20 bp, Artificial Sequence
  chemically synthesized
gccaaagaaaatgaaatacc

SEQ ID NO: 451799 - DNA, 20 bp, Artificial Sequence
  chemically synthesized
ccaaagaaaatgaaatacct

SEQ ID NO: 451800 - DNA, 20 bp, Artificial Sequence
  chemically synthesized
tcttggttaggtgtattcct

SEQ ID NO: 451801 - DNA, 20 bp, Artificial Sequence
  chemically synthesized
atcttggttaggtgtattcc

SEQ ID NO: 451802 - DNA, 20 bp, Artificial Sequence
  chemically synthesized
acctaggaatacacctaacc

SEQ ID NO: 451803 - DNA, 20 bp, Artificial Sequence
  chemically synthesized
gatctttcagcatcttggtt

SEQ ID NO: 451804 - DNA, 20 bp, Artificial Sequence
  chemically synthesized
agatctttcagcatcttggt

SEQ ID NO: 451805 - DNA, 20 bp, Artificial Sequence
  chemically synthesized
acagagatctttcagcatct

SEQ ID NO: 451806 - DNA, 20 bp, Artificial Sequence
  chemically synthesized
acacctaaccaagatgctga

SEQ ID NO: 451807 - DNA, 20 bp, Artificial Sequence
  chemically synthesized
tactccttacagagatcttt

SEQ ID NO: 451808 - DNA, 20 bp, Artificial Sequence
  chemically synthesized
agatgctgaaagatctctgt

SEQ ID NO: 451809 - DNA, 20 bp, Artificial Sequence
  chemically synthesized
gatgctgaaagatctctgta

SEQ ID NO: 451810 - DNA, 20 bp, Artificial Sequence
  chemically synthesized
tgctgaaagatctctgtaag

SEQ ID NO: 451811 - DNA, 20 bp, Artificial Sequence
  chemically synthesized
gttttttaatactccttaca

SEQ ID NO: 451812 - DNA, 20 bp, Artificial Sequence
  chemically synthesized
atgttttttaatactcctta

SEQ ID NO: 451813 - DNA, 20 bp, Artificial Sequence
  chemically synthesized
gtattaaaaaacattgttga

SEQ ID NO: 451814 - DNA, 20 bp, Artificial Sequence
  chemically synthesized
aaacattgttgaaagaaaca

SEQ ID NO: 451815 - DNA, 20 bp, Artificial Sequence
  chemically synthesized
agaaacacagataaacgaaa

SEQ ID NO: 451816 - DNA, 20 bp, Artificial Sequence
  chemically synthesized
aaaaagcattccatgctcat

SEQ ID NO: 451817 - DNA, 20 bp, Artificial Sequence
  chemically synthesized
attgtttcttccaatgagca

SEQ ID NO: 451818 - DNA, 20 bp, Artificial Sequence
  chemically synthesized
aagcattccatgctcattgg

SEQ ID NO: 451819 - DNA, 20 bp, Artificial Sequence
  chemically synthesized
attatattgtttcttccaat

SEQ ID NO: 451820 - DNA, 20 bp, Artificial Sequence
  chemically synthesized
aagaaacaatataattaaaa

SEQ ID NO: 451821 - DNA, 20 bp, Artificial Sequence
  chemically synthesized
ataagttgttttgtgcagta

SEQ ID NO: 451822 - DNA, 20 bp, Artificial Sequence
  chemically synthesized
aatctataagttgttttgtg

SEQ ID NO: 451823 - DNA, 20 bp, Artificial Sequence
  chemically synthesized
atactgcacaaaacaactta

SEQ ID NO: 451824 - DNA, 20 bp, Artificial Sequence
  chemically synthesized
aaggacagcattgaatctat

SEQ ID NO: 451825 - DNA, 20 bp, Artificial Sequence
  chemically synthesized
ccttggtagtttgataagga

SEQ ID NO: 451826 - DNA, 20 bp, Artificial Sequence
  chemically synthesized
atgaccttggtagtttgata

SEQ ID NO: 451827 - DNA, 20 bp, Artificial Sequence
  chemically synthesized
aatgaccttggtagtttgat

SEQ ID NO: 451828 - DNA, 20 bp, Artificial Sequence
  chemically synthesized
gctgtccttatcaaactacc

SEQ ID NO: 451829 - DNA, 20 bp, Artificial Sequence
  chemically synthesized
ctgtccttatcaaactacca

SEQ ID NO: 451830 - DNA, 20 bp, Artificial Sequence
  chemically synthesized
tctgtgaggaatgaccttgg

SEQ ID NO: 451831 - DNA, 20 bp, Artificial Sequence
  chemically synthesized
aattctgtgaggaatgacct

SEQ ID NO: 451832 - DNA, 20 bp, Artificial Sequence
  chemically synthesized
actaccaaggtcattcctca

SEQ ID NO: 451833 - DNA, 20 bp, Artificial Sequence
  chemically synthesized
ttgttttttctaattctgtg

SEQ ID NO: 451834 - DNA, 20 bp, Artificial Sequence
  chemically synthesized
aaggtcattcctcacagaat

SEQ ID NO: 451835 - DNA, 20 bp, Artificial Sequence
  chemically synthesized
attgttttttctaattctgt

SEQ ID NO: 451836 - DNA, 20 bp, Artificial Sequence
  chemically synthesized
ttttggttgcatatgaattt

SEQ ID NO: 451837 - DNA, 20 bp, Artificial Sequence
  chemically synthesized
cgctcttttatttttttttt

SEQ ID NO: 451838 - DNA, 20 bp, Artificial Sequence
  chemically synthesized
gcaaccaaaaaaaaaaataa

SEQ ID NO: 451839 - DNA, 20 bp, Artificial Sequence
  chemically synthesized
aaccaaaaaaaaaaataaaa

SEQ ID NO: 451840 - DNA, 20 bp, Artificial Sequence
  chemically synthesized
aaaaaataaaagagcgcata

SEQ ID NO: 451841 - DNA, 20 bp, Artificial Sequence
  chemically synthesized
taaaagagcgcatatagccg

SEQ ID NO: 451842 - DNA, 20 bp, Artificial Sequence
  chemically synthesized
cttgctgcttaggatggctt

SEQ ID NO: 451843 - DNA, 20 bp, Artificial Sequence
  chemically synthesized
catatagccgaagccatcct

SEQ ID NO: 451844 - DNA, 20 bp, Artificial Sequence
  chemically synthesized
atagccgaagccatcctaag

SEQ ID NO: 451845 - DNA, 20 bp, Artificial Sequence
  chemically synthesized
tttgttcttgctgcttagga

SEQ ID NO: 451846 - DNA, 20 bp, Artificial Sequence
  chemically synthesized
ccgaagccatcctaagcagc

SEQ ID NO: 451847 - DNA, 20 bp, Artificial Sequence
  chemically synthesized
caattttgttcttgctgctt

SEQ ID NO: 451848 - DNA, 20 bp, Artificial Sequence
  chemically synthesized
ccaattttgttcttgctgct

SEQ ID NO: 451849 - DNA, 20 bp, Artificial Sequence
  chemically synthesized
ctaagcagcaagaacaaaat

SEQ ID NO: 451850 - DNA, 20 bp, Artificial Sequence
  chemically synthesized
aagcagcaagaacaaaattg

SEQ ID NO: 451851 - DNA, 20 bp, Artificial Sequence
  chemically synthesized
agcagcaagaacaaaattgg

SEQ ID NO: 451852 - DNA, 20 bp, Artificial Sequence
  chemically synthesized
aaattggaggcatcacacta

SEQ ID NO: 451853 - DNA, 20 bp, Artificial Sequence
  chemically synthesized
tattgtagggtgaagtactg

SEQ ID NO: 451854 - DNA, 20 bp, Artificial Sequence
  chemically synthesized
gtgtgaattattgtagggtg

SEQ ID NO: 451855 - DNA, 20 bp, Artificial Sequence
  chemically synthesized
ctgtggtgtgaattattgta

SEQ ID NO: 451856 - DNA, 20 bp, Artificial Sequence
  chemically synthesized
actgtggtgtgaattattgt

SEQ ID NO: 451857 - DNA, 20 bp, Artificial Sequence
  chemically synthesized
tactgtggtgtgaattattg

SEQ ID NO: 451858 - DNA, 20 bp, Artificial Sequence
  chemically synthesized
ccctacaataattcacacca

SEQ ID NO: 451859 - DNA, 20 bp, Artificial Sequence
  chemically synthesized
ttctatagtgtgatgtactg

SEQ ID NO: 451860 - DNA, 20 bp, Artificial Sequence
  chemically synthesized
caccacagtacatcacacta

SEQ ID NO: 451861 - DNA, 20 bp, Artificial Sequence
  chemically synthesized
tagcatagttggaagttcta

SEQ ID NO: 451862 - DNA, 20 bp, Artificial Sequence
  chemically synthesized
tagtcttgtagcatagttgg

SEQ ID NO: 451863 - DNA, 20 bp, Artificial Sequence
  chemically synthesized
ctgtagtcttgtagcatagt

SEQ ID NO: 451864 - DNA, 20 bp, Artificial Sequence
  chemically synthesized
agaacttccaactatgctac

SEQ ID NO: 451865 - DNA, 20 bp, Artificial Sequence
  chemically synthesized
gctactgtagtcttgtagca

SEQ ID NO: 451866 - DNA, 20 bp, Artificial Sequence
  chemically synthesized
tattggctactgtagtcttg

SEQ ID NO: 451867 - DNA, 20 bp, Artificial Sequence
  chemically synthesized
ccaactatgctacaagacta

SEQ ID NO: 451868 - DNA, 20 bp, Artificial Sequence
  chemically synthesized
actatgctacaagactacag

SEQ ID NO: 451869 - DNA, 20 bp, Artificial Sequence
  chemically synthesized
ttatgctgtattggctactg

SEQ ID NO: 451870 - DNA, 20 bp, Artificial Sequence
  chemically synthesized
caagactacagtagccaata

SEQ ID NO: 451871 - DNA, 20 bp, Artificial Sequence
  chemically synthesized
gtaccaatattatgctgtat

SEQ ID NO: 451872 - DNA, 20 bp, Artificial Sequence
  chemically synthesized
tagccaatacagcataatat

SEQ ID NO: 451873 - DNA, 20 bp, Artificial Sequence
  chemically synthesized
aatacagcataatattggta

SEQ ID NO: 451874 - DNA, 20 bp, Artificial Sequence
  chemically synthesized
gcataatattggtacagaaa

SEQ ID NO: 451875 - DNA, 20 bp, Artificial Sequence
  chemically synthesized
ttggtacagaaacagacata

SEQ ID NO: 451876 - DNA, 20 bp, Artificial Sequence
  chemically synthesized
gaaacagacatatagaccaa

SEQ ID NO: 451877 - DNA, 20 bp, Artificial Sequence
  chemically synthesized
agacatatagaccaatggaa

SEQ ID NO: 451878 - DNA, 20 bp, Artificial Sequence
  chemically synthesized
tgttttctattctgttccat

SEQ ID NO: 451879 - DNA, 20 bp, Artificial Sequence
  chemically synthesized
tatagaccaatggaacagaa

SEQ ID NO: 451880 - DNA, 20 bp, Artificial Sequence
  chemically synthesized
atggaacagaatagaaaaca

SEQ ID NO: 451881 - DNA, 20 bp, Artificial Sequence
  chemically synthesized
gaatagaaaacacagaaata

SEQ ID NO: 451882 - DNA, 20 bp, Artificial Sequence
  chemically synthesized
gaaggctggttgaaggtgta

SEQ ID NO: 451883 - DNA, 20 bp, Artificial Sequence
  chemically synthesized
taaagccatacaccttcaac

SEQ ID NO: 451884 - DNA, 20 bp, Artificial Sequence
  chemically synthesized
ccttgtcgaaggctggttga

SEQ ID NO: 451885 - DNA, 20 bp, Artificial Sequence
  chemically synthesized
gccttgtcgaaggctggttg

SEQ ID NO: 451886 - DNA, 20 bp, Artificial Sequence
  chemically synthesized
ttgccagccttgtcgaaggc

SEQ ID NO: 451887 - DNA, 20 bp, Artificial Sequence
  chemically synthesized
accttcaaccagccttcgac

SEQ ID NO: 451888 - DNA, 20 bp, Artificial Sequence
  chemically synthesized
ccttcaaccagccttcgaca

SEQ ID NO: 451889 - DNA, 20 bp, Artificial Sequence
  chemically synthesized
gtttttgccagccttgtcga

SEQ ID NO: 451890 - DNA, 20 bp, Artificial Sequence
  chemically synthesized
tgtttttgccagccttgtcg

SEQ ID NO: 451891 - DNA, 20 bp, Artificial Sequence
  chemically synthesized
caaccagccttcgacaaggc

SEQ ID NO: 451892 - DNA, 20 bp, Artificial Sequence
  chemically synthesized
ttaccattgcttgtttttgc

SEQ ID NO: 451893 - DNA, 20 bp, Artificial Sequence
  chemically synthesized
tcgacaaggctggcaaaaac

SEQ ID NO: 451894 - DNA, 20 bp, Artificial Sequence
  chemically synthesized
aggctggcaaaaacaagcaa

SEQ ID NO: 451895 - DNA, 20 bp, Artificial Sequence
  chemically synthesized
gcaaaaacaagcaatggtaa

SEQ ID NO: 451896 - DNA, 20 bp, Artificial Sequence
  chemically synthesized
caaaaacaagcaatggtaaa

SEQ ID NO: 451897 - DNA, 20 bp, Artificial Sequence
  chemically synthesized
ggcatcatttattgaatagg

SEQ ID NO: 451898 - DNA, 20 bp, Artificial Sequence
  chemically synthesized
cctggcatcatttattgaat

SEQ ID NO: 451899 - DNA, 20 bp, Artificial Sequence
  chemically synthesized
tcctggcatcatttattgaa

SEQ ID NO: 451900 - DNA, 20 bp, Artificial Sequence
  chemically synthesized
tcctattcaataaatgatgc

SEQ ID NO: 451901 - DNA, 20 bp, Artificial Sequence
  chemically synthesized
cctattcaataaatgatgcc

SEQ ID NO: 451902 - DNA, 20 bp, Artificial Sequence
  chemically synthesized
ataaatgatgccaggatcac

SEQ ID NO: 451903 - DNA, 20 bp, Artificial Sequence
  chemically synthesized
atatggctagccagtgatcc

SEQ ID NO: 451904 - DNA, 20 bp, Artificial Sequence
  chemically synthesized
atgatgccaggatcactggc

SEQ ID NO: 451905 - DNA, 20 bp, Artificial Sequence
  chemically synthesized
ttcttctgcatatggctagc

SEQ ID NO: 451906 - DNA, 20 bp, Artificial Sequence
  chemically synthesized
ttcattcttctgcatatggc

SEQ ID NO: 451907 - DNA, 20 bp, Artificial Sequence
  chemically synthesized
gatcactggctagccatatg

SEQ ID NO: 451908 - DNA, 20 bp, Artificial Sequence
  chemically synthesized
cactggctagccatatgcag

SEQ ID NO: 451909 - DNA, 20 bp, Artificial Sequence
  chemically synthesized
aagtttcattcttctgcata

SEQ ID NO: 451910 - DNA, 20 bp, Artificial Sequence
  chemically synthesized
tatggcaaaaggtagggatc

SEQ ID NO: 451911 - DNA, 20 bp, Artificial Sequence
  chemically synthesized
tttgtatatggcaaaaggta

SEQ ID NO: 451912 - DNA, 20 bp, Artificial Sequence
  chemically synthesized
ttttgtatatggcaaaaggt

SEQ ID NO: 451913 - DNA, 20 bp, Artificial Sequence
  chemically synthesized
tttttgtatatggcaaaagg

SEQ ID NO: 451914 - DNA, 20 bp, Artificial Sequence
  chemically synthesized
ttatttttgtatatggcaaa

SEQ ID NO: 451915 - DNA, 20 bp, Artificial Sequence
  chemically synthesized
tttatttttgtatatggcaa

SEQ ID NO: 451916 - DNA, 20 bp, Artificial Sequence
  chemically synthesized
catgagtttatttttgtata

SEQ ID NO: 451917 - DNA, 20 bp, Artificial Sequence
  chemically synthesized
catatacaaaaataaactca

SEQ ID NO: 451918 - DNA, 20 bp, Artificial Sequence
  chemically synthesized
atacaaaaataaactcatgg

SEQ ID NO: 451919 - DNA, 20 bp, Artificial Sequence
  chemically synthesized
taatatctttaatccaccat

SEQ ID NO: 451920 - DNA, 20 bp, Artificial Sequence
  chemically synthesized
aataaactcatggtggatta

SEQ ID NO: 451921 - DNA, 20 bp, Artificial Sequence
  chemically synthesized
tggattaaagatattaatgt

SEQ ID NO: 451922 - DNA, 20 bp, Artificial Sequence
  chemically synthesized
tttctaggatttgtagtttt

SEQ ID NO: 451923 - DNA, 20 bp, Artificial Sequence
  chemically synthesized
gtttctaggatttgtagttt

SEQ ID NO: 451924 - DNA, 20 bp, Artificial Sequence
  chemically synthesized
agacctaaaactacaaatcc

SEQ ID NO: 451925 - DNA, 20 bp, Artificial Sequence
  chemically synthesized
aggtttgtttctaggatttg

SEQ ID NO: 451926 - DNA, 20 bp, Artificial Sequence
  chemically synthesized
catttcctaggtttgtttct

SEQ ID NO: 451927 - DNA, 20 bp, Artificial Sequence
  chemically synthesized
acatttcctaggtttgtttc

SEQ ID NO: 451928 - DNA, 20 bp, Artificial Sequence
  chemically synthesized
acaaatcctagaaacaaacc

SEQ ID NO: 451929 - DNA, 20 bp, Artificial Sequence
  chemically synthesized
caaatcctagaaacaaacct

SEQ ID NO: 451930 - DNA, 20 bp, Artificial Sequence
  chemically synthesized
tgtcaagaaggacatttcct

SEQ ID NO: 451931 - DNA, 20 bp, Artificial Sequence
  chemically synthesized
atgtcaagaaggacatttcc

SEQ ID NO: 451932 - DNA, 20 bp, Artificial Sequence
  chemically synthesized
tgccaatgccaatgtcaaga

SEQ ID NO: 451933 - DNA, 20 bp, Artificial Sequence
  chemically synthesized
ttgccaatgccaatgtcaag

SEQ ID NO: 451934 - DNA, 20 bp, Artificial Sequence
  chemically synthesized
ggaaatgtccttcttgacat

SEQ ID NO: 451935 - DNA, 20 bp, Artificial Sequence
  chemically synthesized
aaattgccaatgccaatgtc

SEQ ID NO: 451936 - DNA, 20 bp, Artificial Sequence
  chemically synthesized
gtccttcttgacattggcat

SEQ ID NO: 451937 - DNA, 20 bp, Artificial Sequence
  chemically synthesized
aattttttttttttttttga

SEQ ID NO: 451938 - DNA, 20 bp, Artificial Sequence
  chemically synthesized
ttttttttttttttttgaca

SEQ ID NO: 451939 - DNA, 20 bp, Artificial Sequence
  chemically synthesized
tccagcctgggcgacagagt

SEQ ID NO: 451940 - DNA, 20 bp, Artificial Sequence
  chemically synthesized
cagagtctcactctgtcgcc

SEQ ID NO: 451941 - DNA, 20 bp, Artificial Sequence
  chemically synthesized
gtactccagcctgggcgaca

SEQ ID NO: 451942 - DNA, 20 bp, Artificial Sequence
  chemically synthesized
agagtctcactctgtcgccc

SEQ ID NO: 451943 - DNA, 20 bp, Artificial Sequence
  chemically synthesized
ctgtactccagcctgggcga

SEQ ID NO: 451944 - DNA, 20 bp, Artificial Sequence
  chemically synthesized
tctcactctgtcgcccaggc

SEQ ID NO: 451945 - DNA, 20 bp, Artificial Sequence
  chemically synthesized
tcactctgtcgcccaggctg

SEQ ID NO: 451946 - DNA, 20 bp, Artificial Sequence
  chemically synthesized
acaccactgtactccagcct

SEQ ID NO: 451947 - DNA, 20 bp, Artificial Sequence
  chemically synthesized
cacaccactgtactccagcc

SEQ ID NO: 451948 - DNA, 20 bp, Artificial Sequence
  chemically synthesized
ctgtcgcccaggctggagta

SEQ ID NO: 451949 - DNA, 20 bp, Artificial Sequence
  chemically synthesized
cagatcacaccactgtactc

SEQ ID NO: 451950 - DNA, 20 bp, Artificial Sequence
  chemically synthesized
tcgcccaggctggagtacag

SEQ ID NO: 451951 - DNA, 20 bp, Artificial Sequence
  chemically synthesized
tggagtacagtggtgtgatc

SEQ ID NO: 451952 - DNA, 20 bp, Artificial Sequence
  chemically synthesized
ggcagaggttgcaatgagtc

SEQ ID NO: 451953 - DNA, 20 bp, Artificial Sequence
  chemically synthesized
caggaggcagaggttgcaat

SEQ ID NO: 451954 - DNA, 20 bp, Artificial Sequence
  chemically synthesized
tgtttgaccccaggaggcag

SEQ ID NO: 451955 - DNA, 20 bp, Artificial Sequence
  chemically synthesized
tcattgcaacctctgcctcc

SEQ ID NO: 451956 - DNA, 20 bp, Artificial Sequence
  chemically synthesized
ctgtttgaccccaggaggca

SEQ ID NO: 451957 - DNA, 20 bp, Artificial Sequence
  chemically synthesized
cattgcaacctctgcctcct

SEQ ID NO: 451958 - DNA, 20 bp, Artificial Sequence
  chemically synthesized
attgcaacctctgcctcctg

SEQ ID NO: 451959 - DNA, 20 bp, Artificial Sequence
  chemically synthesized
aactgtttgaccccaggagg

SEQ ID NO: 451960 - DNA, 20 bp, Artificial Sequence
  chemically synthesized
gagaactgtttgaccccagg

SEQ ID NO: 451961 - DNA, 20 bp, Artificial Sequence
  chemically synthesized
ggagaactgtttgaccccag

SEQ ID NO: 451962 - DNA, 20 bp, Artificial Sequence
  chemically synthesized
caggagaactgtttgacccc

SEQ ID NO: 451963 - DNA, 20 bp, Artificial Sequence
  chemically synthesized
gcaggagaactgtttgaccc

SEQ ID NO: 451964 - DNA, 20 bp, Artificial Sequence
  chemically synthesized
ctctgcctcctggggtcaaa

SEQ ID NO: 451965 - DNA, 20 bp, Artificial Sequence
  chemically synthesized
gtcaaacagttctcctgcct

SEQ ID NO: 451966 - DNA, 20 bp, Artificial Sequence
  chemically synthesized
tacttgggaggctgaggcag

SEQ ID NO: 451967 - DNA, 20 bp, Artificial Sequence
  chemically synthesized
gctacttgggaggctgaggc

SEQ ID NO: 451968 - DNA, 20 bp, Artificial Sequence
  chemically synthesized
agctacttgggaggctgagg

SEQ ID NO: 451969 - DNA, 20 bp, Artificial Sequence
  chemically synthesized
cccagctacttgggaggctg

SEQ ID NO: 451970 - DNA, 20 bp, Artificial Sequence
  chemically synthesized
tcccagctacttgggaggct

SEQ ID NO: 451971 - DNA, 20 bp, Artificial Sequence
  chemically synthesized
ttctcctgcctcagcctccc

SEQ ID NO: 451972 - DNA, 20 bp, Artificial Sequence
  chemically synthesized
tcctgcctcagcctcccaag

SEQ ID NO: 451973 - DNA, 20 bp, Artificial Sequence
  chemically synthesized
tgtaatcccagctacttggg

SEQ ID NO: 451974 - DNA, 20 bp, Artificial Sequence
  chemically synthesized
ctgtaatcccagctacttgg

SEQ ID NO: 451975 - DNA, 20 bp, Artificial Sequence
  chemically synthesized
gcctcagcctcccaagtagc

SEQ ID NO: 451976 - DNA, 20 bp, Artificial Sequence
  chemically synthesized
gcctgtaatcccagctactt

SEQ ID NO: 451977 - DNA, 20 bp, Artificial Sequence
  chemically synthesized
cctcagcctcccaagtagct

SEQ ID NO: 451978 - DNA, 20 bp, Artificial Sequence
  chemically synthesized
cgcctgtaatcccagctact

SEQ ID NO: 451979 - DNA, 20 bp, Artificial Sequence
  chemically synthesized
ctcccaagtagctgggatta

SEQ ID NO: 451980 - DNA, 20 bp, Artificial Sequence
  chemically synthesized
tcccaagtagctgggattac

SEQ ID NO: 451981 - DNA, 20 bp, Artificial Sequence
  chemically synthesized
gtggcagacgcctgtaatcc

SEQ ID NO: 451982 - DNA, 20 bp, Artificial Sequence
  chemically synthesized
aaattagccgggtgtggtgg

SEQ ID NO: 451983 - DNA, 20 bp, Artificial Sequence
  chemically synthesized
caggcgtctgccaccacacc

SEQ ID NO: 451984 - DNA, 20 bp, Artificial Sequence
  chemically synthesized
caaaaattagccgggtgtgg

SEQ ID NO: 451985 - DNA, 20 bp, Artificial Sequence
  chemically synthesized
atacaaaaattagccgggtg

SEQ ID NO: 451986 - DNA, 20 bp, Artificial Sequence
  chemically synthesized
caaaaatacaaaaattagcc

SEQ ID NO: 451987 - DNA, 20 bp, Artificial Sequence
  chemically synthesized
ccaaaaatacaaaaattagc

SEQ ID NO: 451988 - DNA, 20 bp, Artificial Sequence
  chemically synthesized
tctaccaaaaatacaaaaat

SEQ ID NO: 451989 - DNA, 20 bp, Artificial Sequence
  chemically synthesized
ccggctaatttttgtatttt

SEQ ID NO: 451990 - DNA, 20 bp, Artificial Sequence
  chemically synthesized
gctaatttttgtatttttgg

SEQ ID NO: 451991 - DNA, 20 bp, Artificial Sequence
  chemically synthesized
taatttttgtatttttggta

SEQ ID NO: 451992 - DNA, 20 bp, Artificial Sequence
  chemically synthesized
ttttgtatttttggtagaga

SEQ ID NO: 451993 - DNA, 20 bp, Artificial Sequence
  chemically synthesized
tttgtatttttggtagagac

SEQ ID NO: 451994 - DNA, 20 bp, Artificial Sequence
  chemically synthesized
ttgtatttttggtagagaca

SEQ ID NO: 451995 - DNA, 20 bp, Artificial Sequence
  chemically synthesized
gagacagggttttgccacgt

SEQ ID NO: 451996 - DNA, 20 bp, Artificial Sequence
  chemically synthesized
cagggttttgccacgttggt

SEQ ID NO: 451997 - DNA, 20 bp, Artificial Sequence
  chemically synthesized
cgaaagcagcctgaccaacg

SEQ ID NO: 451998 - DNA, 20 bp, Artificial Sequence
  chemically synthesized
agggttttgccacgttggtc

SEQ ID NO: 451999 - DNA, 20 bp, Artificial Sequence
  chemically synthesized
cgaagccaggagttcgaaag

SEQ ID NO: 452000 - DNA, 20 bp, Artificial Sequence
  chemically synthesized
acccgaagccaggagttcga

SEQ ID NO: 452001 - DNA, 20 bp, Artificial Sequence
  chemically synthesized
tcaggctgctttcgaactcc

SEQ ID NO: 452002 - DNA, 20 bp, Artificial Sequence
  chemically synthesized
tgctttcgaactcctggctt

SEQ ID NO: 452003 - DNA, 20 bp, Artificial Sequence
  chemically synthesized
ggtggattacccgaagccag

SEQ ID NO: 452004 - DNA, 20 bp, Artificial Sequence
  chemically synthesized
gctttcgaactcctggcttc

SEQ ID NO: 452005 - DNA, 20 bp, Artificial Sequence
  chemically synthesized
tgggtggattacccgaagcc

SEQ ID NO: 452006 - DNA, 20 bp, Artificial Sequence
  chemically synthesized
gtgggtggattacccgaagc

SEQ ID NO: 452007 - DNA, 20 bp, Artificial Sequence
  chemically synthesized
caaggtgggtggattacccg

SEQ ID NO: 452008 - DNA, 20 bp, Artificial Sequence
  chemically synthesized
ttcgggtaatccacccacct

SEQ ID NO: 452009 - DNA, 20 bp, Artificial Sequence
  chemically synthesized
ctttgggagaccaaggtggg

SEQ ID NO: 452010 - DNA, 20 bp, Artificial Sequence
  chemically synthesized
gcactttgggagaccaaggt

SEQ ID NO: 452011 - DNA, 20 bp, Artificial Sequence
  chemically synthesized
agcactttgggagaccaagg

SEQ ID NO: 452012 - DNA, 20 bp, Artificial Sequence
  chemically synthesized
cccagcactttgggagacca

SEQ ID NO: 452013 - DNA, 20 bp, Artificial Sequence
  chemically synthesized
tcccagcactttgggagacc

SEQ ID NO: 452014 - DNA, 20 bp, Artificial Sequence
  chemically synthesized
ccacccaccttggtctccca

SEQ ID NO: 452015 - DNA, 20 bp, Artificial Sequence
  chemically synthesized
ctgtaatcccagcactttgg

SEQ ID NO: 452016 - DNA, 20 bp, Artificial Sequence
  chemically synthesized
accttggtctcccaaagtgc

SEQ ID NO: 452017 - DNA, 20 bp, Artificial Sequence
  chemically synthesized
gcctgtaatcccagcacttt

SEQ ID NO: 452018 - DNA, 20 bp, Artificial Sequence
  chemically synthesized
ccttggtctcccaaagtgct

SEQ ID NO: 452019 - DNA, 20 bp, Artificial Sequence
  chemically synthesized
tgcctgtaatcccagcactt

SEQ ID NO: 452020 - DNA, 20 bp, Artificial Sequence
  chemically synthesized
ctcccaaagtgctgggatta

SEQ ID NO: 452021 - DNA, 20 bp, Artificial Sequence
  chemically synthesized
tcccaaagtgctgggattac

SEQ ID NO: 452022 - DNA, 20 bp, Artificial Sequence
  chemically synthesized
gtgcctcatgcctgtaatcc

SEQ ID NO: 452023 - DNA, 20 bp, Artificial Sequence
  chemically synthesized
agtgctgggattacaggcat

SEQ ID NO: 452024 - DNA, 20 bp, Artificial Sequence
  chemically synthesized
gtgctgggattacaggcatg

SEQ ID NO: 452025 - DNA, 20 bp, Artificial Sequence
  chemically synthesized
caggcatgaggcactgcgcc

SEQ ID NO: 452026 - DNA, 20 bp, Artificial Sequence
  chemically synthesized
aattctttgccggccgggcg

SEQ ID NO: 452027 - DNA, 20 bp, Artificial Sequence
  chemically synthesized
catgaggcactgcgcccggc

SEQ ID NO: 452028 - DNA, 20 bp, Artificial Sequence
  chemically synthesized
ccaaaaattctttgccggcc

SEQ ID NO: 452029 - DNA, 20 bp, Artificial Sequence
  chemically synthesized
ggcactgcgcccggccggca

SEQ ID NO: 452030 - DNA, 20 bp, Artificial Sequence
  chemically synthesized
gccaaaaattctttgccggc

SEQ ID NO: 452031 - DNA, 20 bp, Artificial Sequence
  chemically synthesized
cttagccaaaaattctttgc

SEQ ID NO: 452032 - DNA, 20 bp, Artificial Sequence
  chemically synthesized
cccggccggcaaagaatttt

SEQ ID NO: 452033 - DNA, 20 bp, Artificial Sequence
  chemically synthesized
ccggcaaagaatttttggct

SEQ ID NO: 452034 - DNA, 20 bp, Artificial Sequence
  chemically synthesized
tacaattacttttggggact

SEQ ID NO: 452035 - DNA, 20 bp, Artificial Sequence
  chemically synthesized
atttttggctaagtccccaa

SEQ ID NO: 452036 - DNA, 20 bp, Artificial Sequence
  chemically synthesized
ttttgttacaattacttttg

SEQ ID NO: 452037 - DNA, 20 bp, Artificial Sequence
  chemically synthesized
tttttgttacaattactttt

SEQ ID NO: 452038 - DNA, 20 bp, Artificial Sequence
  chemically synthesized
atttttgttacaattacttt

SEQ ID NO: 452039 - DNA, 20 bp, Artificial Sequence
  chemically synthesized
taacaaaaataaaaattgac

SEQ ID NO: 452040 - DNA, 20 bp, Artificial Sequence
  chemically synthesized
acaaaaataaaaattgacaa

SEQ ID NO: 452041 - DNA, 20 bp, Artificial Sequence
  chemically synthesized
caaaaataaaaattgacaag

SEQ ID NO: 452042 - DNA, 20 bp, Artificial Sequence
  chemically synthesized
aaaaataaaaattgacaaga

SEQ ID NO: 452043 - DNA, 20 bp, Artificial Sequence
  chemically synthesized
agaagctctttagtttaatt

SEQ ID NO: 452044 - DNA, 20 bp, Artificial Sequence
  chemically synthesized
cagaagctctttagtttaat

SEQ ID NO: 452045 - DNA, 20 bp, Artificial Sequence
  chemically synthesized
agagggacctaattaaacta

SEQ ID NO: 452046 - DNA, 20 bp, Artificial Sequence
  chemically synthesized
agggacctaattaaactaaa

SEQ ID NO: 452047 - DNA, 20 bp, Artificial Sequence
  chemically synthesized
ttggctgtgcagaagctctt

SEQ ID NO: 452048 - DNA, 20 bp, Artificial Sequence
  chemically synthesized
taaactaaagagcttctgca

SEQ ID NO: 452049 - DNA, 20 bp, Artificial Sequence
  chemically synthesized
tagtttctttggctgtgcag

SEQ ID NO: 452050 - DNA, 20 bp, Artificial Sequence
  chemically synthesized
tgatagtttctttggctgtg

SEQ ID NO: 452051 - DNA, 20 bp, Artificial Sequence
  chemically synthesized
aaagagcttctgcacagcca

SEQ ID NO: 452052 - DNA, 20 bp, Artificial Sequence
  chemically synthesized
tactttgttgatagtttctt

SEQ ID NO: 452053 - DNA, 20 bp, Artificial Sequence
  chemically synthesized
agccaaagaaactatcaaca

SEQ ID NO: 452054 - DNA, 20 bp, Artificial Sequence
  chemically synthesized
ttatctgtttactttgttga

SEQ ID NO: 452055 - DNA, 20 bp, Artificial Sequence
  chemically synthesized
gaaactatcaacaaagtaaa

SEQ ID NO: 452056 - DNA, 20 bp, Artificial Sequence
  chemically synthesized
caaagtaaacagataatcta

SEQ ID NO: 452057 - DNA, 20 bp, Artificial Sequence
  chemically synthesized
taaacagataatctacagaa

SEQ ID NO: 452058 - DNA, 20 bp, Artificial Sequence
  chemically synthesized
aaacagataatctacagaat

SEQ ID NO: 452059 - DNA, 20 bp, Artificial Sequence
  chemically synthesized
gaatattttctcccattctg

SEQ ID NO: 452060 - DNA, 20 bp, Artificial Sequence
  chemically synthesized
acagataatctacagaatgg

SEQ ID NO: 452061 - DNA, 20 bp, Artificial Sequence
  chemically synthesized
ttagacttttgtcaggtgca

SEQ ID NO: 452062 - DNA, 20 bp, Artificial Sequence
  chemically synthesized
acaaactgtgcacctgacaa

SEQ ID NO: 452063 - DNA, 20 bp, Artificial Sequence
  chemically synthesized
tttaatattagacttttgtc

SEQ ID NO: 452064 - DNA, 20 bp, Artificial Sequence
  chemically synthesized
ttttaatattagacttttgt

SEQ ID NO: 452065 - DNA, 20 bp, Artificial Sequence
  chemically synthesized
ttttgtccattttttaatat

SEQ ID NO: 452066 - DNA, 20 bp, Artificial Sequence
  chemically synthesized
aaaagtctaatattaaaaaa

SEQ ID NO: 452067 - DNA, 20 bp, Artificial Sequence
  chemically synthesized
taatattaaaaaatggacaa

SEQ ID NO: 452068 - DNA, 20 bp, Artificial Sequence
  chemically synthesized
acatgaacaaacacttctca

SEQ ID NO: 452069 - DNA, 20 bp, Artificial Sequence
  chemically synthesized
catgaacaaacacttctcaa

SEQ ID NO: 452070 - DNA, 20 bp, Artificial Sequence
  chemically synthesized
cttgcatgtcttcctttgag

SEQ ID NO: 452071 - DNA, 20 bp, Artificial Sequence
  chemically synthesized
gaacaaacacttctcaaagg

SEQ ID NO: 452072 - DNA, 20 bp, Artificial Sequence
  chemically synthesized
tcgcttgcatgtcttccttt

SEQ ID NO: 452073 - DNA, 20 bp, Artificial Sequence
  chemically synthesized
cttctcaaaggaagacatgc

SEQ ID NO: 452074 - DNA, 20 bp, Artificial Sequence
  chemically synthesized
gcatttcttcgtatgtttgt

SEQ ID NO: 452075 - DNA, 20 bp, Artificial Sequence
  chemically synthesized
aagcgaccaacaaacatacg

SEQ ID NO: 452076 - DNA, 20 bp, Artificial Sequence
  chemically synthesized
ctctgatgattaatgatgat

SEQ ID NO: 452077 - DNA, 20 bp, Artificial Sequence
  chemically synthesized
tgctcatcatcattaatcat

SEQ ID NO: 452078 - DNA, 20 bp, Artificial Sequence
  chemically synthesized
ctcatcatcattaatcatca

SEQ ID NO: 452079 - DNA, 20 bp, Artificial Sequence
  chemically synthesized
ttaatcatcagagaaatgaa

SEQ ID NO: 452080 - DNA, 20 bp, Artificial Sequence
  chemically synthesized
atgaaaagcaaaaccacaat

SEQ ID NO: 452081 - DNA, 20 bp, Artificial Sequence
  chemically synthesized
tgtgagatggtatctcattg

SEQ ID NO: 452082 - DNA, 20 bp, Artificial Sequence
  chemically synthesized
ccattctgtttggtgtgaga

SEQ ID NO: 452083 - DNA, 20 bp, Artificial Sequence
  chemically synthesized
atagccattctgtttggtgt

SEQ ID NO: 452084 - DNA, 20 bp, Artificial Sequence
  chemically synthesized
agataccatctcacaccaaa

SEQ ID NO: 452085 - DNA, 20 bp, Artificial Sequence
  chemically synthesized
ccatctcacaccaaacagaa

SEQ ID NO: 452086 - DNA, 20 bp, Artificial Sequence
  chemically synthesized
taaataatagccattctgtt

SEQ ID NO: 452087 - DNA, 20 bp, Artificial Sequence
  chemically synthesized
ctttcttgacttttaaataa

SEQ ID NO: 452088 - DNA, 20 bp, Artificial Sequence
  chemically synthesized
acagaatggctattatttaa

SEQ ID NO: 452089 - DNA, 20 bp, Artificial Sequence
  chemically synthesized
atggctattatttaaaagtc

SEQ ID NO: 452090 - DNA, 20 bp, Artificial Sequence
  chemically synthesized
ctattatttaaaagtcaaga

SEQ ID NO: 452091 - DNA, 20 bp, Artificial Sequence
  chemically synthesized
tattatttaaaagtcaagaa

SEQ ID NO: 452092 - DNA, 20 bp, Artificial Sequence
  chemically synthesized
tttaaaagtcaagaaaggct

SEQ ID NO: 452093 - DNA, 20 bp, Artificial Sequence
  chemically synthesized
aagtcaagaaaggctgagtg

SEQ ID NO: 452094 - DNA, 20 bp, Artificial Sequence
  chemically synthesized
tcaagaaaggctgagtgcag

SEQ ID NO: 452095 - DNA, 20 bp, Artificial Sequence
  chemically synthesized
caggcgcaagccactgcact

SEQ ID NO: 452096 - DNA, 20 bp, Artificial Sequence
  chemically synthesized
agtgctgggattacaggcgc

SEQ ID NO: 452097 - DNA, 20 bp, Artificial Sequence
  chemically synthesized
gtggcttgcgcctgtaatcc

SEQ ID NO: 452098 - DNA, 20 bp, Artificial Sequence
  chemically synthesized
tcctacagtgctgggattac

SEQ ID NO: 452099 - DNA, 20 bp, Artificial Sequence
  chemically synthesized
ctcctacagtgctgggatta

SEQ ID NO: 452100 - DNA, 20 bp, Artificial Sequence
  chemically synthesized
cgcctgtaatcccagcactg

SEQ ID NO: 452101 - DNA, 20 bp, Artificial Sequence
  chemically synthesized
cctaagcctcctacagtgct

SEQ ID NO: 452102 - DNA, 20 bp, Artificial Sequence
  chemically synthesized
gcctgtaatcccagcactgt

SEQ ID NO: 452103 - DNA, 20 bp, Artificial Sequence
  chemically synthesized
gcctaagcctcctacagtgc

SEQ ID NO: 452104 - DNA, 20 bp, Artificial Sequence
  chemically synthesized
ctgtaatcccagcactgtag

SEQ ID NO: 452105 - DNA, 20 bp, Artificial Sequence
  chemically synthesized
tgtaatcccagcactgtagg

SEQ ID NO: 452106 - DNA, 20 bp, Artificial Sequence
  chemically synthesized
cctcctgcctaagcctccta

SEQ ID NO: 452107 - DNA, 20 bp, Artificial Sequence
  chemically synthesized
tcccagcactgtaggaggct

SEQ ID NO: 452108 - DNA, 20 bp, Artificial Sequence
  chemically synthesized
cccagcactgtaggaggctt

SEQ ID NO: 452109 - DNA, 20 bp, Artificial Sequence
  chemically synthesized
agcactgtaggaggcttagg

SEQ ID NO: 452110 - DNA, 20 bp, Artificial Sequence
  chemically synthesized
gcactgtaggaggcttaggc

SEQ ID NO: 452111 - DNA, 20 bp, Artificial Sequence
  chemically synthesized
actgtaggaggcttaggcag

SEQ ID NO: 452112 - DNA, 20 bp, Artificial Sequence
  chemically synthesized
ctgtaggaggcttaggcagg

SEQ ID NO: 452113 - DNA, 20 bp, Artificial Sequence
  chemically synthesized
ctcatatgatcctcctgcct

SEQ ID NO: 452114 - DNA, 20 bp, Artificial Sequence
  chemically synthesized
cttaggcaggaggatcatat

SEQ ID NO: 452115 - DNA, 20 bp, Artificial Sequence
  chemically synthesized
ttaggcaggaggatcatatg

SEQ ID NO: 452116 - DNA, 20 bp, Artificial Sequence
  chemically synthesized
gcaggaggatcatatgaggc

SEQ ID NO: 452117 - DNA, 20 bp, Artificial Sequence
  chemically synthesized
caggaggatcatatgaggcc

SEQ ID NO: 452118 - DNA, 20 bp, Artificial Sequence
  chemically synthesized
ggaggatcatatgaggccag

SEQ ID NO: 452119 - DNA, 20 bp, Artificial Sequence
  chemically synthesized
tcatatgaggccaggagttc

SEQ ID NO: 452120 - DNA, 20 bp, Artificial Sequence
  chemically synthesized
ccagtctggtcttgaactcc

SEQ ID NO: 452121 - DNA, 20 bp, Artificial Sequence
  chemically synthesized
tgaggccaggagttcaagac

SEQ ID NO: 452122 - DNA, 20 bp, Artificial Sequence
  chemically synthesized
ccaggagttcaagaccagac

SEQ ID NO: 452123 - DNA, 20 bp, Artificial Sequence
  chemically synthesized
tttcaccattttggccagtc

SEQ ID NO: 452124 - DNA, 20 bp, Artificial Sequence
  chemically synthesized
caagaccagactggccaaaa

SEQ ID NO: 452125 - DNA, 20 bp, Artificial Sequence
  chemically synthesized
cggggtttcaccattttggc

SEQ ID NO: 452126 - DNA, 20 bp, Artificial Sequence
  chemically synthesized
gagtcggggtttcaccattt

SEQ ID NO: 452127 - DNA, 20 bp, Artificial Sequence
  chemically synthesized
aaatggtgaaaccccgactc

SEQ ID NO: 452128 - DNA, 20 bp, Artificial Sequence
  chemically synthesized
ttgtatttttactagagtcg

SEQ ID NO: 452129 - DNA, 20 bp, Artificial Sequence
  chemically synthesized
tttgtatttttactagagtc

SEQ ID NO: 452130 - DNA, 20 bp, Artificial Sequence
  chemically synthesized
ttttgtatttttactagagt

SEQ ID NO: 452131 - DNA, 20 bp, Artificial Sequence
  chemically synthesized
taatttttgtatttttacta

SEQ ID NO: 452132 - DNA, 20 bp, Artificial Sequence
  chemically synthesized
gctaatttttgtatttttac

SEQ ID NO: 452133 - DNA, 20 bp, Artificial Sequence
  chemically synthesized
tctagtaaaaatacaaaaat

SEQ ID NO: 452134 - DNA, 20 bp, Artificial Sequence
  chemically synthesized
gtaaaaatacaaaaattagc

SEQ ID NO: 452135 - DNA, 20 bp, Artificial Sequence
  chemically synthesized
taaaaatacaaaaattagct

SEQ ID NO: 452136 - DNA, 20 bp, Artificial Sequence
  chemically synthesized
atacaaaaattagctgggtg

SEQ ID NO: 452137 - DNA, 20 bp, Artificial Sequence
  chemically synthesized
caaaaattagctgggtgtgg

SEQ ID NO: 452138 - DNA, 20 bp, Artificial Sequence
  chemically synthesized
cagatgtgtaccaccacacc

SEQ ID NO: 452139 - DNA, 20 bp, Artificial Sequence
  chemically synthesized
gtggtacacatctgtaatcc

SEQ ID NO: 452140 - DNA, 20 bp, Artificial Sequence
  chemically synthesized
ctccctagcagctgggatta

SEQ ID NO: 452141 - DNA, 20 bp, Artificial Sequence
  chemically synthesized
acatctgtaatcccagctgc

SEQ ID NO: 452142 - DNA, 20 bp, Artificial Sequence
  chemically synthesized
catctgtaatcccagctgct

SEQ ID NO: 452143 - DNA, 20 bp, Artificial Sequence
  chemically synthesized
ctgcagcctccctagcagct

SEQ ID NO: 452144 - DNA, 20 bp, Artificial Sequence
  chemically synthesized
atctgtaatcccagctgcta

SEQ ID NO: 452145 - DNA, 20 bp, Artificial Sequence
  chemically synthesized
gctgcagcctccctagcagc

SEQ ID NO: 452146 - DNA, 20 bp, Artificial Sequence
  chemically synthesized
ctgtaatcccagctgctagg

SEQ ID NO: 452147 - DNA, 20 bp, Artificial Sequence
  chemically synthesized
tgtaatcccagctgctaggg

SEQ ID NO: 452148 - DNA, 20 bp, Artificial Sequence
  chemically synthesized
tcatgctgcagcctccctag

SEQ ID NO: 452149 - DNA, 20 bp, Artificial Sequence
  chemically synthesized
ttctcatgctgcagcctccc

SEQ ID NO: 452150 - DNA, 20 bp, Artificial Sequence
  chemically synthesized
cccagctgctagggaggctg

SEQ ID NO: 452151 - DNA, 20 bp, Artificial Sequence
  chemically synthesized
tgctagggaggctgcagcat

SEQ ID NO: 452152 - DNA, 20 bp, Artificial Sequence
  chemically synthesized
ttcaaatgattctcatgctg

SEQ ID NO: 452153 - DNA, 20 bp, Artificial Sequence
  chemically synthesized
gcatgagaatcatttgaacc

SEQ ID NO: 452154 - DNA, 20 bp, Artificial Sequence
  chemically synthesized
catgagaatcatttgaaccc

SEQ ID NO: 452155 - DNA, 20 bp, Artificial Sequence
  chemically synthesized
tgagaatcatttgaacccag

SEQ ID NO: 452156 - DNA, 20 bp, Artificial Sequence
  chemically synthesized
gagaatcatttgaacccagg

SEQ ID NO: 452157 - DNA, 20 bp, Artificial Sequence
  chemically synthesized
tcactgcacctcaacctcct

SEQ ID NO: 452158 - DNA, 20 bp, Artificial Sequence
  chemically synthesized
tcatttgaacccaggaggtt

SEQ ID NO: 452159 - DNA, 20 bp, Artificial Sequence
  chemically synthesized
ctcactgcacctcaacctcc

SEQ ID NO: 452160 - DNA, 20 bp, Artificial Sequence
  chemically synthesized
catttgaacccaggaggttg

SEQ ID NO: 452161 - DNA, 20 bp, Artificial Sequence
  chemically synthesized
gaacccaggaggttgaggtg

SEQ ID NO: 452162 - DNA, 20 bp, Artificial Sequence
  chemically synthesized
ccaggaggttgaggtgcagt

SEQ ID NO: 452163 - DNA, 20 bp, Artificial Sequence
  chemically synthesized
gaggttgaggtgcagtgagc

SEQ ID NO: 452164 - DNA, 20 bp, Artificial Sequence
  chemically synthesized
aggttgaggtgcagtgagcc

SEQ ID NO: 452165 - DNA, 20 bp, Artificial Sequence
  chemically synthesized
ggagtgcaatggggcaatcc

SEQ ID NO: 452166 - DNA, 20 bp, Artificial Sequence
  chemically synthesized
acccaggctggagtgcaatg

SEQ ID NO: 452167 - DNA, 20 bp, Artificial Sequence
  chemically synthesized
cacccaggctggagtgcaat

SEQ ID NO: 452168 - DNA, 20 bp, Artificial Sequence
  chemically synthesized
tcacccaggctggagtgcaa

SEQ ID NO: 452169 - DNA, 20 bp, Artificial Sequence
  chemically synthesized
aggattgccccattgcactc

SEQ ID NO: 452170 - DNA, 20 bp, Artificial Sequence
  chemically synthesized
tgccccattgcactccagcc

SEQ ID NO: 452171 - DNA, 20 bp, Artificial Sequence
  chemically synthesized
gccccattgcactccagcct

SEQ ID NO: 452172 - DNA, 20 bp, Artificial Sequence
  chemically synthesized
tttttttgtcacccaggctg

SEQ ID NO: 452173 - DNA, 20 bp, Artificial Sequence
  chemically synthesized
tttttttttgtcacccaggc

SEQ ID NO: 452174 - DNA, 20 bp, Artificial Sequence
  chemically synthesized
tttttttttttttgtcaccc

SEQ ID NO: 452175 - DNA, 20 bp, Artificial Sequence
  chemically synthesized
ttttttttttttttgtcacc

SEQ ID NO: 452176 - DNA, 20 bp, Artificial Sequence
  chemically synthesized
aaaaaaaaaaaaaaaatcaa

SEQ ID NO: 452177 - DNA, 20 bp, Artificial Sequence
  chemically synthesized
aaaaatcaaaagataaacgc

SEQ ID NO: 452178 - DNA, 20 bp, Artificial Sequence
  chemically synthesized
atcaaaagataaacgctggt

SEQ ID NO: 452179 - DNA, 20 bp, Artificial Sequence
  chemically synthesized
tcaaaagataaacgctggtg

SEQ ID NO: 452180 - DNA, 20 bp, Artificial Sequence
  chemically synthesized
ccttttatctacagcctcac

SEQ ID NO: 452181 - DNA, 20 bp, Artificial Sequence
  chemically synthesized
gataaacgctggtgaggctg

SEQ ID NO: 452182 - DNA, 20 bp, Artificial Sequence
  chemically synthesized
gctggtgaggctgtagataa

SEQ ID NO: 452183 - DNA, 20 bp, Artificial Sequence
  chemically synthesized
taagcactcccttttatcta

SEQ ID NO: 452184 - DNA, 20 bp, Artificial Sequence
  chemically synthesized
ctggtgaggctgtagataaa

SEQ ID NO: 452185 - DNA, 20 bp, Artificial Sequence
  chemically synthesized
tggtgaggctgtagataaaa

SEQ ID NO: 452186 - DNA, 20 bp, Artificial Sequence
  chemically synthesized
gtgaggctgtagataaaagg

SEQ ID NO: 452187 - DNA, 20 bp, Artificial Sequence
  chemically synthesized
cattccaaccaacagtgtat

SEQ ID NO: 452188 - DNA, 20 bp, Artificial Sequence
  chemically synthesized
agggagtgcttatacactgt

SEQ ID NO: 452189 - DNA, 20 bp, Artificial Sequence
  chemically synthesized
agtgcttatacactgttggt

SEQ ID NO: 452190 - DNA, 20 bp, Artificial Sequence
  chemically synthesized
ataatttacattccaaccaa

SEQ ID NO: 452191 - DNA, 20 bp, Artificial Sequence
  chemically synthesized
ggttggaatgtaaattattt

SEQ ID NO: 452192 - DNA, 20 bp, Artificial Sequence
  chemically synthesized
gtaaattatttcagcccccg

SEQ ID NO: 452193 - DNA, 20 bp, Artificial Sequence
  chemically synthesized
attatttcagcccccgtggc

SEQ ID NO: 452194 - DNA, 20 bp, Artificial Sequence
  chemically synthesized
ctccaaactgcttgccacgg

SEQ ID NO: 452195 - DNA, 20 bp, Artificial Sequence
  chemically synthesized
tctccaaactgcttgccacg

SEQ ID NO: 452196 - DNA, 20 bp, Artificial Sequence
  chemically synthesized
atctccaaactgcttgccac

SEQ ID NO: 452197 - DNA, 20 bp, Artificial Sequence
  chemically synthesized
atttcagcccccgtggcaag

SEQ ID NO: 452198 - DNA, 20 bp, Artificial Sequence
  chemically synthesized
aatctccaaactgcttgcca

SEQ ID NO: 452199 - DNA, 20 bp, Artificial Sequence
  chemically synthesized
agcccccgtggcaagcagtt

SEQ ID NO: 452200 - DNA, 20 bp, Artificial Sequence
  chemically synthesized
cccccgtggcaagcagtttg

SEQ ID NO: 452201 - DNA, 20 bp, Artificial Sequence
  chemically synthesized
agcagtttggagatttctca

SEQ ID NO: 452202 - DNA, 20 bp, Artificial Sequence
  chemically synthesized
agatctgttttaagttctgt

SEQ ID NO: 452203 - DNA, 20 bp, Artificial Sequence
  chemically synthesized
atttctcacagaacttaaaa

SEQ ID NO: 452204 - DNA, 20 bp, Artificial Sequence
  chemically synthesized
ttgaatgatagatctgtttt

SEQ ID NO: 452205 - DNA, 20 bp, Artificial Sequence
  chemically synthesized
gggattgctgaattgaatga

SEQ ID NO: 452206 - DNA, 20 bp, Artificial Sequence
  chemically synthesized
aacagatctatcattcaatt

SEQ ID NO: 452207 - DNA, 20 bp, Artificial Sequence
  chemically synthesized
aattcagcaatcccattact

SEQ ID NO: 452208 - DNA, 20 bp, Artificial Sequence
  chemically synthesized
ttgggtatatactcagtaat

SEQ ID NO: 452209 - DNA, 20 bp, Artificial Sequence
  chemically synthesized
tttgggtatatactcagtaa

SEQ ID NO: 452210 - DNA, 20 bp, Artificial Sequence
  chemically synthesized
ttttcctttgggtatatact

SEQ ID NO: 452211 - DNA, 20 bp, Artificial Sequence
  chemically synthesized
cattactgagtatataccca

SEQ ID NO: 452212 - DNA, 20 bp, Artificial Sequence
  chemically synthesized
attactgagtatatacccaa

SEQ ID NO: 452213 - DNA, 20 bp, Artificial Sequence
  chemically synthesized
aaaatgatctattttccttt

SEQ ID NO: 452214 - DNA, 20 bp, Artificial Sequence
  chemically synthesized
taaaatgatctattttcctt

SEQ ID NO: 452215 - DNA, 20 bp, Artificial Sequence
  chemically synthesized
agtatatacccaaaggaaaa

SEQ ID NO: 452216 - DNA, 20 bp, Artificial Sequence
  chemically synthesized
aaatagatcattttatcaaa

SEQ ID NO: 452217 - DNA, 20 bp, Artificial Sequence
  chemically synthesized
tatcaaaaagacacatgcac

SEQ ID NO: 452218 - DNA, 20 bp, Artificial Sequence
  chemically synthesized
ttgtgtgacaaagaacatac

SEQ ID NO: 452219 - DNA, 20 bp, Artificial Sequence
  chemically synthesized
ctattgtgaattgtgtgaca

SEQ ID NO: 452220 - DNA, 20 bp, Artificial Sequence
  chemically synthesized
ctttgtcacacaattcacaa

SEQ ID NO: 452221 - DNA, 20 bp, Artificial Sequence
  chemically synthesized
aaaatatcgaatcaacctaa

SEQ ID NO: 452222 - DNA, 20 bp, Artificial Sequence
  chemically synthesized
tcaaccattgatgagctttt

SEQ ID NO: 452223 - DNA, 20 bp, Artificial Sequence
  chemically synthesized
gtcaaccattgatgagcttt

SEQ ID NO: 452224 - DNA, 20 bp, Artificial Sequence
  chemically synthesized
tcaacctaaaagctcatcaa

SEQ ID NO: 452225 - DNA, 20 bp, Artificial Sequence
  chemically synthesized
ttatccagtcaaccattgat

SEQ ID NO: 452226 - DNA, 20 bp, Artificial Sequence
  chemically synthesized
aaagctcatcaatggttgac

SEQ ID NO: 452227 - DNA, 20 bp, Artificial Sequence
  chemically synthesized
catcaatggttgactggata

SEQ ID NO: 452228 - DNA, 20 bp, Artificial Sequence
  chemically synthesized
tgtactacattttctttatc

SEQ ID NO: 452229 - DNA, 20 bp, Artificial Sequence
  chemically synthesized
ttgactggataaagaaaatg

SEQ ID NO: 452230 - DNA, 20 bp, Artificial Sequence
  chemically synthesized
aatgtagtacatacacacca

SEQ ID NO: 452231 - DNA, 20 bp, Artificial Sequence
  chemically synthesized
tatggctgcataggattccg

SEQ ID NO: 452232 - DNA, 20 bp, Artificial Sequence
  chemically synthesized
acacaccacggaatcctatg

SEQ ID NO: 452233 - DNA, 20 bp, Artificial Sequence
  chemically synthesized
gttcttttttatggctgcat

SEQ ID NO: 452234 - DNA, 20 bp, Artificial Sequence
  chemically synthesized
tgttcttttttatggctgca

SEQ ID NO: 452235 - DNA, 20 bp, Artificial Sequence
  chemically synthesized
aatcctatgcagccataaaa

SEQ ID NO: 452236 - DNA, 20 bp, Artificial Sequence
  chemically synthesized
catgattttgttctttttta

SEQ ID NO: 452237 - DNA, 20 bp, Artificial Sequence
  chemically synthesized
gaacaaaatcatgtcctttg

SEQ ID NO: 452238 - DNA, 20 bp, Artificial Sequence
  chemically synthesized
ctccatccatgtcgctgcaa

SEQ ID NO: 452239 - DNA, 20 bp, Artificial Sequence
  chemically synthesized
gctccatccatgtcgctgca

SEQ ID NO: 452240 - DNA, 20 bp, Artificial Sequence
  chemically synthesized
tcatgtcctttgcagcgaca

SEQ ID NO: 452241 - DNA, 20 bp, Artificial Sequence
  chemically synthesized
gtcctttgcagcgacatgga

SEQ ID NO: 452242 - DNA, 20 bp, Artificial Sequence
  chemically synthesized
cctttgcagcgacatggatg

SEQ ID NO: 452243 - DNA, 20 bp, Artificial Sequence
  chemically synthesized
tgcagcgacatggatggagc

SEQ ID NO: 452244 - DNA, 20 bp, Artificial Sequence
  chemically synthesized
cagcgacatggatggagctg

SEQ ID NO: 452245 - DNA, 20 bp, Artificial Sequence
  chemically synthesized
agcgacatggatggagctgg

SEQ ID NO: 452246 - DNA, 20 bp, Artificial Sequence
  chemically synthesized
tcgcttaatataatgtcctc

SEQ ID NO: 452247 - DNA, 20 bp, Artificial Sequence
  chemically synthesized
gagctggaggacattatatt

SEQ ID NO: 452248 - DNA, 20 bp, Artificial Sequence
  chemically synthesized
ggaggacattatattaagcg

SEQ ID NO: 452249 - DNA, 20 bp, Artificial Sequence
  chemically synthesized
tatattaagcgaagtaatgc

SEQ ID NO: 452250 - DNA, 20 bp, Artificial Sequence
  chemically synthesized
taagcgaagtaatgcaagaa

SEQ ID NO: 452251 - DNA, 20 bp, Artificial Sequence
  chemically synthesized
aagtgagagcatgtggcatt

SEQ ID NO: 452252 - DNA, 20 bp, Artificial Sequence
  chemically synthesized
catttataagtgagagcatg

SEQ ID NO: 452253 - DNA, 20 bp, Artificial Sequence
  chemically synthesized
tagttcccatttataagtga

SEQ ID NO: 452254 - DNA, 20 bp, Artificial Sequence
  chemically synthesized
tttagttcccatttataagt

SEQ ID NO: 452255 - DNA, 20 bp, Artificial Sequence
  chemically synthesized
cacatgctctcacttataaa

SEQ ID NO: 452256 - DNA, 20 bp, Artificial Sequence
  chemically synthesized
acatgctctcacttataaat

SEQ ID NO: 452257 - DNA, 20 bp, Artificial Sequence
  chemically synthesized
aatgtttagttcccatttat

SEQ ID NO: 452258 - DNA, 20 bp, Artificial Sequence
  chemically synthesized
ataaatgggaactaaacatt

SEQ ID NO: 452259 - DNA, 20 bp, Artificial Sequence
  chemically synthesized
tgtccgttgtgctcaatgtt

SEQ ID NO: 452260 - DNA, 20 bp, Artificial Sequence
  chemically synthesized
gaactaaacattgagcacaa

SEQ ID NO: 452261 - DNA, 20 bp, Artificial Sequence
  chemically synthesized
agcacaacggacataaacat

SEQ ID NO: 452262 - DNA, 20 bp, Artificial Sequence
  chemically synthesized
ggacataaacatgagaacaa

SEQ ID NO: 452263 - DNA, 20 bp, Artificial Sequence
  chemically synthesized
catgagaacaacagacactg

SEQ ID NO: 452264 - DNA, 20 bp, Artificial Sequence
  chemically synthesized
ctccccactctagtagtcca

SEQ ID NO: 452265 - DNA, 20 bp, Artificial Sequence
  chemically synthesized
caacagacactgtggactac

SEQ ID NO: 452266 - DNA, 20 bp, Artificial Sequence
  chemically synthesized
acagacactgtggactacta

SEQ ID NO: 452267 - DNA, 20 bp, Artificial Sequence
  chemically synthesized
gacactgtggactactagag

SEQ ID NO: 452268 - DNA, 20 bp, Artificial Sequence
  chemically synthesized
acactgtggactactagagt

SEQ ID NO: 452269 - DNA, 20 bp, Artificial Sequence
  chemically synthesized
ccggtccctccccactctag

SEQ ID NO: 452270 - DNA, 20 bp, Artificial Sequence
  chemically synthesized
cactgtggactactagagtg

SEQ ID NO: 452271 - DNA, 20 bp, Artificial Sequence
  chemically synthesized
ctgtggactactagagtggg

SEQ ID NO: 452272 - DNA, 20 bp, Artificial Sequence
  chemically synthesized
ccgccggtccctccccactc

SEQ ID NO: 452273 - DNA, 20 bp, Artificial Sequence
  chemically synthesized
tgtggactactagagtgggg

SEQ ID NO: 452274 - DNA, 20 bp, Artificial Sequence
  chemically synthesized
gtggactactagagtgggga

SEQ ID NO: 452275 - DNA, 20 bp, Artificial Sequence
  chemically synthesized
ctactagagtggggagggac

SEQ ID NO: 452276 - DNA, 20 bp, Artificial Sequence
  chemically synthesized
ctagagtggggagggaccgg

SEQ ID NO: 452277 - DNA, 20 bp, Artificial Sequence
  chemically synthesized
tagagtggggagggaccggc

SEQ ID NO: 452278 - DNA, 20 bp, Artificial Sequence
  chemically synthesized
agagtggggagggaccggcg

SEQ ID NO: 452279 - DNA, 20 bp, Artificial Sequence
  chemically synthesized
gtggggagggaccggcgggg

SEQ ID NO: 452280 - DNA, 20 bp, Artificial Sequence
  chemically synthesized
tggggagggaccggcgggga

SEQ ID NO: 452281 - DNA, 20 bp, Artificial Sequence
  chemically synthesized
gcttttaactccttccccgc

SEQ ID NO: 452282 - DNA, 20 bp, Artificial Sequence
  chemically synthesized
gggagggaccggcggggaag

SEQ ID NO: 452283 - DNA, 20 bp, Artificial Sequence
  chemically synthesized
accggcggggaaggagttaa

SEQ ID NO: 452284 - DNA, 20 bp, Artificial Sequence
  chemically synthesized
aggagttaaaagctacctat

SEQ ID NO: 452285 - DNA, 20 bp, Artificial Sequence
  chemically synthesized
ggagttaaaagctacctatt

SEQ ID NO: 452286 - DNA, 20 bp, Artificial Sequence
  chemically synthesized
taagcatagtacccaatagg

SEQ ID NO: 452287 - DNA, 20 bp, Artificial Sequence
  chemically synthesized
tagtaagcatagtacccaat

SEQ ID NO: 452288 - DNA, 20 bp, Artificial Sequence
  chemically synthesized
atagtaagcatagtacccaa

SEQ ID NO: 452289 - DNA, 20 bp, Artificial Sequence
  chemically synthesized
ttgcacccagatagtaagca

SEQ ID NO: 452290 - DNA, 20 bp, Artificial Sequence
  chemically synthesized
tgggtactatgcttactatc

SEQ ID NO: 452291 - DNA, 20 bp, Artificial Sequence
  chemically synthesized
gggtactatgcttactatct

SEQ ID NO: 452292 - DNA, 20 bp, Artificial Sequence
  chemically synthesized
gtatattgcacccagatagt

SEQ ID NO: 452293 - DNA, 20 bp, Artificial Sequence
  chemically synthesized
aacggtatattgcacccaga

SEQ ID NO: 452294 - DNA, 20 bp, Artificial Sequence
  chemically synthesized
ttaaaacggtatattgcacc

SEQ ID NO: 452295 - DNA, 20 bp, Artificial Sequence
  chemically synthesized
cacatgcagatttgttaaaa

SEQ ID NO: 452296 - DNA, 20 bp, Artificial Sequence
  chemically synthesized
acatacagggagtacacatg

SEQ ID NO: 452297 - DNA, 20 bp, Artificial Sequence
  chemically synthesized
acttttattttacatacagg

SEQ ID NO: 452298 - DNA, 20 bp, Artificial Sequence
  chemically synthesized
caacttttattttacataca

SEQ ID NO: 452299 - DNA, 20 bp, Artificial Sequence
  chemically synthesized
tcaacttttattttacatac

SEQ ID NO: 452300 - DNA, 20 bp, Artificial Sequence
  chemically synthesized
ttcaacttttattttacata

SEQ ID NO: 452301 - DNA, 20 bp, Artificial Sequence
  chemically synthesized
actccctgtatgtaaaataa

SEQ ID NO: 452302 - DNA, 20 bp, Artificial Sequence
  chemically synthesized
aaagttgaaattaaaaataa

SEQ ID NO: 452303 - DNA, 20 bp, Artificial Sequence
  chemically synthesized
aataaaagtgtcctacttta

SEQ ID NO: 452304 - DNA, 20 bp, Artificial Sequence
  chemically synthesized
tggcatgttttctttaaagt

SEQ ID NO: 452305 - DNA, 20 bp, Artificial Sequence
  chemically synthesized
ctggcatgttttctttaaag

SEQ ID NO: 452306 - DNA, 20 bp, Artificial Sequence
  chemically synthesized
tgcctggcatgttttcttta

SEQ ID NO: 452307 - DNA, 20 bp, Artificial Sequence
  chemically synthesized
ctactttaaagaaaacatgc

SEQ ID NO: 452308 - DNA, 20 bp, Artificial Sequence
  chemically synthesized
tactttaaagaaaacatgcc

SEQ ID NO: 452309 - DNA, 20 bp, Artificial Sequence
  chemically synthesized
cttgctgtgtaataggtgcc

SEQ ID NO: 452310 - DNA, 20 bp, Artificial Sequence
  chemically synthesized
catgccaggcacctattaca

SEQ ID NO: 452311 - DNA, 20 bp, Artificial Sequence
  chemically synthesized
aatgatacttgctgtgtaat

SEQ ID NO: 452312 - DNA, 20 bp, Artificial Sequence
  chemically synthesized
taatgatacttgctgtgtaa

SEQ ID NO: 452313 - DNA, 20 bp, Artificial Sequence
  chemically synthesized
ccaggcacctattacacagc

SEQ ID NO: 452314 - DNA, 20 bp, Artificial Sequence
  chemically synthesized
aatctgaaaataattgtagt

SEQ ID NO: 452315 - DNA, 20 bp, Artificial Sequence
  chemically synthesized
cctcaatctgaaaataattg

SEQ ID NO: 452316 - DNA, 20 bp, Artificial Sequence
  chemically synthesized
tcgctcactacaattatttt

SEQ ID NO: 452317 - DNA, 20 bp, Artificial Sequence
  chemically synthesized
actacaattattttcagatt

SEQ ID NO: 452318 - DNA, 20 bp, Artificial Sequence
  chemically synthesized
ctacaattattttcagattg

SEQ ID NO: 452319 - DNA, 20 bp, Artificial Sequence
  chemically synthesized
aattattttcagattgaggc

SEQ ID NO: 452320 - DNA, 20 bp, Artificial Sequence
  chemically synthesized
ttcagattgaggcaagttca

SEQ ID NO: 452321 - DNA, 20 bp, Artificial Sequence
  chemically synthesized
ttcatagttaaaaatttaat

SEQ ID NO: 452322 - DNA, 20 bp, Artificial Sequence
  chemically synthesized
tcatagttaaaaatttaatt

SEQ ID NO: 452323 - DNA, 20 bp, Artificial Sequence
  chemically synthesized
catagttaaaaatttaattg

SEQ ID NO: 452324 - DNA, 20 bp, Artificial Sequence
  chemically synthesized
tggggtgatataatacaatg

SEQ ID NO: 452325 - DNA, 20 bp, Artificial Sequence
  chemically synthesized
ataatacaatgtggtttgtt

SEQ ID NO: 452326 - DNA, 20 bp, Artificial Sequence
  chemically synthesized
atacaatgtggtttgtttag

SEQ ID NO: 452327 - DNA, 20 bp, Artificial Sequence
  chemically synthesized
caatgtggtttgtttagtag

SEQ ID NO: 452328 - DNA, 20 bp, Artificial Sequence
  chemically synthesized
agtagtagattttattttaa

SEQ ID NO: 452329 - DNA, 20 bp, Artificial Sequence
  chemically synthesized
aatagtgttatatatgactt

SEQ ID NO: 452330 - DNA, 20 bp, Artificial Sequence
  chemically synthesized
cttgatgattgtataaactt

SEQ ID NO: 452331 - DNA, 20 bp, Artificial Sequence
  chemically synthesized
cttaagtttatacaatcatc

SEQ ID NO: 452332 - DNA, 20 bp, Artificial Sequence
  chemically synthesized
taagtttatacaatcatcaa

SEQ ID NO: 452333 - DNA, 20 bp, Artificial Sequence
  chemically synthesized
tacaatcatcaagagtctga

SEQ ID NO: 452334 - DNA, 20 bp, Artificial Sequence
  chemically synthesized
acaatcatcaagagtctgat

SEQ ID NO: 452335 - DNA, 20 bp, Artificial Sequence
  chemically synthesized
caatcatcaagagtctgatg

SEQ ID NO: 452336 - DNA, 20 bp, Artificial Sequence
  chemically synthesized
gctaattacagagaccccat

SEQ ID NO: 452337 - DNA, 20 bp, Artificial Sequence
  chemically synthesized
tctgatggggtctctgtaat

SEQ ID NO: 452338 - DNA, 20 bp, Artificial Sequence
  chemically synthesized
gtaaagtatggctaattaca

SEQ ID NO: 452339 - DNA, 20 bp, Artificial Sequence
  chemically synthesized
cagtaaagtatggctaatta

SEQ ID NO: 452340 - DNA, 20 bp, Artificial Sequence
  chemically synthesized
tcataaaatgcagtaaagta

SEQ ID NO: 452341 - DNA, 20 bp, Artificial Sequence
  chemically synthesized
tctactcataaaatgcagta

SEQ ID NO: 452342 - DNA, 20 bp, Artificial Sequence
  chemically synthesized
ataattctactcataaaatg

SEQ ID NO: 452343 - DNA, 20 bp, Artificial Sequence
  chemically synthesized
catactttactgcattttat

SEQ ID NO: 452344 - DNA, 20 bp, Artificial Sequence
  chemically synthesized
actttactgcattttatgag

SEQ ID NO: 452345 - DNA, 20 bp, Artificial Sequence
  chemically synthesized
atgagtagaattatatgcct

SEQ ID NO: 452346 - DNA, 20 bp, Artificial Sequence
  chemically synthesized
cgaatttgcaaacatcacta

SEQ ID NO: 452347 - DNA, 20 bp, Artificial Sequence
  chemically synthesized
ccgaatttgcaaacatcact

SEQ ID NO: 452348 - DNA, 20 bp, Artificial Sequence
  chemically synthesized
cttagtgatgtttgcaaatt

SEQ ID NO: 452349 - DNA, 20 bp, Artificial Sequence
  chemically synthesized
tagtgatgtttgcaaattcg

SEQ ID NO: 452350 - DNA, 20 bp, Artificial Sequence
  chemically synthesized
tgcaaattcggagttttgca

SEQ ID NO: 452351 - DNA, 20 bp, Artificial Sequence
  chemically synthesized
tcggagttttgcaaagatct

SEQ ID NO: 452352 - DNA, 20 bp, Artificial Sequence
  chemically synthesized
cggagttttgcaaagatctt

SEQ ID NO: 452353 - DNA, 20 bp, Artificial Sequence
  chemically synthesized
agccccagggtatttgtccc

SEQ ID NO: 452354 - DNA, 20 bp, Artificial Sequence
  chemically synthesized
agatcttgggacaaataccc

SEQ ID NO: 452355 - DNA, 20 bp, Artificial Sequence
  chemically synthesized
gatcttgggacaaataccct

SEQ ID NO: 452356 - DNA, 20 bp, Artificial Sequence
  chemically synthesized
atcttgggacaaataccctg

SEQ ID NO: 452357 - DNA, 20 bp, Artificial Sequence
  chemically synthesized
ttagactctgaagagcccca

SEQ ID NO: 452358 - DNA, 20 bp, Artificial Sequence
  chemically synthesized
attagactctgaagagcccc

SEQ ID NO: 452359 - DNA, 20 bp, Artificial Sequence
  chemically synthesized
tattagactctgaagagccc

SEQ ID NO: 452360 - DNA, 20 bp, Artificial Sequence
  chemically synthesized
acaaataccctggggctctt

SEQ ID NO: 452361 - DNA, 20 bp, Artificial Sequence
  chemically synthesized
aaataccctggggctcttca

SEQ ID NO: 452362 - DNA, 20 bp, Artificial Sequence
  chemically synthesized
cgtatatattagactctgaa

SEQ ID NO: 452363 - DNA, 20 bp, Artificial Sequence
  chemically synthesized
tacgtatatattagactctg

SEQ ID NO: 452364 - DNA, 20 bp, Artificial Sequence
  chemically synthesized
cttttattttacgtatatat

SEQ ID NO: 452365 - DNA, 20 bp, Artificial Sequence
  chemically synthesized
ctaatatatacgtaaaataa

SEQ ID NO: 452366 - DNA, 20 bp, Artificial Sequence
  chemically synthesized
taatatatacgtaaaataaa

SEQ ID NO: 452367 - DNA, 20 bp, Artificial Sequence
  chemically synthesized
tcataataaataaaatcata

SEQ ID NO: 452368 - DNA, 20 bp, Artificial Sequence
  chemically synthesized
ataataaataaaatcatatg

SEQ ID NO: 452369 - DNA, 20 bp, Artificial Sequence
  chemically synthesized
atatatatatacatatatat

SEQ ID NO: 452370 - DNA, 20 bp, Artificial Sequence
  chemically synthesized
tatgtatatatatataatca

SEQ ID NO: 452371 - DNA, 20 bp, Artificial Sequence
  chemically synthesized
acagatttataatgattacc

SEQ ID NO: 452372 - DNA, 20 bp, Artificial Sequence
  chemically synthesized
gatttataatgattaccaag

SEQ ID NO: 452373 - DNA, 20 bp, Artificial Sequence
  chemically synthesized
acttatagctacgatccact

SEQ ID NO: 452374 - DNA, 20 bp, Artificial Sequence
  chemically synthesized
aatgattaccaagtggatcg

SEQ ID NO: 452375 - DNA, 20 bp, Artificial Sequence
  chemically synthesized
accaagtggatcgtagctat

SEQ ID NO: 452376 - DNA, 20 bp, Artificial Sequence
  chemically synthesized
tgcccctgttaaatcactta

SEQ ID NO: 452377 - DNA, 20 bp, Artificial Sequence
  chemically synthesized
cgtagctataagtgatttaa

SEQ ID NO: 452378 - DNA, 20 bp, Artificial Sequence
  chemically synthesized
gtagctataagtgatttaac

SEQ ID NO: 452379 - DNA, 20 bp, Artificial Sequence
  chemically synthesized
tagctataagtgatttaaca

SEQ ID NO: 452380 - DNA, 20 bp, Artificial Sequence
  chemically synthesized
agctataagtgatttaacag

SEQ ID NO: 452381 - DNA, 20 bp, Artificial Sequence
  chemically synthesized
tgatcagggtagagtaaaga

SEQ ID NO: 452382 - DNA, 20 bp, Artificial Sequence
  chemically synthesized
gtgttgatcagggtagagta

SEQ ID NO: 452383 - DNA, 20 bp, Artificial Sequence
  chemically synthesized
atattgtgttgatcagggta

SEQ ID NO: 452384 - DNA, 20 bp, Artificial Sequence
  chemically synthesized
aaatattgtgttgatcaggg

SEQ ID NO: 452385 - DNA, 20 bp, Artificial Sequence
  chemically synthesized
cccaaatattgtgttgatca

SEQ ID NO: 452386 - DNA, 20 bp, Artificial Sequence
  chemically synthesized
acccaaatattgtgttgatc

SEQ ID NO: 452387 - DNA, 20 bp, Artificial Sequence
  chemically synthesized
aacccaaatattgtgttgat

SEQ ID NO: 452388 - DNA, 20 bp, Artificial Sequence
  chemically synthesized
accctgatcaacacaatatt

SEQ ID NO: 452389 - DNA, 20 bp, Artificial Sequence
  chemically synthesized
ccctgatcaacacaatattt

SEQ ID NO: 452390 - DNA, 20 bp, Artificial Sequence
  chemically synthesized
aatatttgggtttatgtctc

SEQ ID NO: 452391 - DNA, 20 bp, Artificial Sequence
  chemically synthesized
tttgggtttatgtctctagt

SEQ ID NO: 452392 - DNA, 20 bp, Artificial Sequence
  chemically synthesized
acataagcgttatctcacta

SEQ ID NO: 452393 - DNA, 20 bp, Artificial Sequence
  chemically synthesized
aaacataagcgttatctcac

SEQ ID NO: 452394 - DNA, 20 bp, Artificial Sequence
  chemically synthesized
aagtatcaagataaaaacat

SEQ ID NO: 452395 - DNA, 20 bp, Artificial Sequence
  chemically synthesized
gtgggaattttaaaagtatc

SEQ ID NO: 452396 - DNA, 20 bp, Artificial Sequence
  chemically synthesized
aggtgaagtgggaattttaa

SEQ ID NO: 452397 - DNA, 20 bp, Artificial Sequence
  chemically synthesized
taaggaccagaaggtgaagt

SEQ ID NO: 452398 - DNA, 20 bp, Artificial Sequence
  chemically synthesized
ataaggaccagaaggtgaag

SEQ ID NO: 452399 - DNA, 20 bp, Artificial Sequence
  chemically synthesized
aaaattcccacttcaccttc

SEQ ID NO: 452400 - DNA, 20 bp, Artificial Sequence
  chemically synthesized
aaaataaggaccagaaggtg

SEQ ID NO: 452401 - DNA, 20 bp, Artificial Sequence
  chemically synthesized
tgaaaaaaataaggaccaga

SEQ ID NO: 452402 - DNA, 20 bp, Artificial Sequence
  chemically synthesized
atgaaaaaaataaggaccag

SEQ ID NO: 452403 - DNA, 20 bp, Artificial Sequence
  chemically synthesized
tatatgaaaaaaataaggac

SEQ ID NO: 452404 - DNA, 20 bp, Artificial Sequence
  chemically synthesized
gatgatatatgaaaaaaata

SEQ ID NO: 452405 - DNA, 20 bp, Artificial Sequence
  chemically synthesized
tgatgatatatgaaaaaaat

SEQ ID NO: 452406 - DNA, 20 bp, Artificial Sequence
  chemically synthesized
tttttttcatatatcatcaa

SEQ ID NO: 452407 - DNA, 20 bp, Artificial Sequence
  chemically synthesized
ttttttcatatatcatcaat

SEQ ID NO: 452408 - DNA, 20 bp, Artificial Sequence
  chemically synthesized
tatatcatcaatgggtattc

SEQ ID NO: 452409 - DNA, 20 bp, Artificial Sequence
  chemically synthesized
atatcatcaatgggtattca

SEQ ID NO: 452410 - DNA, 20 bp, Artificial Sequence
  chemically synthesized
atcaatgggtattcaaggaa

SEQ ID NO: 452411 - DNA, 20 bp, Artificial Sequence
  chemically synthesized
ggaaaagaaaattattgtat

SEQ ID NO: 452412 - DNA, 20 bp, Artificial Sequence
  chemically synthesized
gaaaagaaaattattgtata

SEQ ID NO: 452413 - DNA, 20 bp, Artificial Sequence
  chemically synthesized
aaaagaaaattattgtataa

SEQ ID NO: 452414 - DNA, 20 bp, Artificial Sequence
  chemically synthesized
gtataagggttgaaaacatc

SEQ ID NO: 452415 - DNA, 20 bp, Artificial Sequence
  chemically synthesized
aaacatcaagaaacaataaa

SEQ ID NO: 452416 - DNA, 20 bp, Artificial Sequence
  chemically synthesized
atcaagaaacaataaatagt

SEQ ID NO: 452417 - DNA, 20 bp, Artificial Sequence
  chemically synthesized
tggctctcaaaagatagttt

SEQ ID NO: 452418 - DNA, 20 bp, Artificial Sequence
  chemically synthesized
ttggctctcaaaagatagtt

SEQ ID NO: 452419 - DNA, 20 bp, Artificial Sequence
  chemically synthesized
attttcccaaactatctttt

SEQ ID NO: 452420 - DNA, 20 bp, Artificial Sequence
  chemically synthesized
caattttggctctcaaaaga

SEQ ID NO: 452421 - DNA, 20 bp, Artificial Sequence
  chemically synthesized
tttcccaaactatcttttga

SEQ ID NO: 452422 - DNA, 20 bp, Artificial Sequence
  chemically synthesized
gctacaattttggctctcaa

SEQ ID NO: 452423 - DNA, 20 bp, Artificial Sequence
  chemically synthesized
tcttttgagagccaaaattg

SEQ ID NO: 452424 - DNA, 20 bp, Artificial Sequence
  chemically synthesized
tttactcacagctacaattt

SEQ ID NO: 452425 - DNA, 20 bp, Artificial Sequence
  chemically synthesized
agagccaaaattgtagctgt

SEQ ID NO: 452426 - DNA, 20 bp, Artificial Sequence
  chemically synthesized
caaaattgtagctgtgagta

SEQ ID NO: 452427 - DNA, 20 bp, Artificial Sequence
  chemically synthesized
actcagccttactttactca

SEQ ID NO: 452428 - DNA, 20 bp, Artificial Sequence
  chemically synthesized
attgtagctgtgagtaaagt

SEQ ID NO: 452429 - DNA, 20 bp, Artificial Sequence
  chemically synthesized
ttgtagctgtgagtaaagta

SEQ ID NO: 452430 - DNA, 20 bp, Artificial Sequence
  chemically synthesized
gctgtgagtaaagtaaggct

SEQ ID NO: 452431 - DNA, 20 bp, Artificial Sequence
  chemically synthesized
ctattgctttaggataaact

SEQ ID NO: 452432 - DNA, 20 bp, Artificial Sequence
  chemically synthesized
gtaaggctgagtttatccta

SEQ ID NO: 452433 - DNA, 20 bp, Artificial Sequence
  chemically synthesized
ctgagtttatcctaaagcaa

SEQ ID NO: 452434 - DNA, 20 bp, Artificial Sequence
  chemically synthesized
ttttccttgtctattgcttt

SEQ ID NO: 452435 - DNA, 20 bp, Artificial Sequence
  chemically synthesized
tttttccttgtctattgctt

SEQ ID NO: 452436 - DNA, 20 bp, Artificial Sequence
  chemically synthesized
tttatcctaaagcaatagac

SEQ ID NO: 452437 - DNA, 20 bp, Artificial Sequence
  chemically synthesized
ttatcctaaagcaatagaca

SEQ ID NO: 452438 - DNA, 20 bp, Artificial Sequence
  chemically synthesized
agacaaggaaaaaaaaaaat

SEQ ID NO: 452439 - DNA, 20 bp, Artificial Sequence
  chemically synthesized
ggaaaaaaaaaaatcagaca

SEQ ID NO: 452440 - DNA, 20 bp, Artificial Sequence
  chemically synthesized
aaaaaaaatcagacaaagaa

SEQ ID NO: 452441 - DNA, 20 bp, Artificial Sequence
  chemically synthesized
tctcagggtagagaggtata

SEQ ID NO: 452442 - DNA, 20 bp, Artificial Sequence
  chemically synthesized
tgtctcagggtagagaggta

SEQ ID NO: 452443 - DNA, 20 bp, Artificial Sequence
  chemically synthesized
aggtgtgtctcagggtagag

SEQ ID NO: 452444 - DNA, 20 bp, Artificial Sequence
  chemically synthesized
caggtgtgtctcagggtaga

SEQ ID NO: 452445 - DNA, 20 bp, Artificial Sequence
  chemically synthesized
actctatacctctctaccct

SEQ ID NO: 452446 - DNA, 20 bp, Artificial Sequence
  chemically synthesized
ctcaggtgtgtctcagggta

SEQ ID NO: 452447 - DNA, 20 bp, Artificial Sequence
  chemically synthesized
gtctcaggtgtgtctcaggg

SEQ ID NO: 452448 - DNA, 20 bp, Artificial Sequence
  chemically synthesized
gtggtctcaggtgtgtctca

SEQ ID NO: 452449 - DNA, 20 bp, Artificial Sequence
  chemically synthesized
ggtggtctcaggtgtgtctc

SEQ ID NO: 452450 - DNA, 20 bp, Artificial Sequence
  chemically synthesized
gggtggtctcaggtgtgtct

SEQ ID NO: 452451 - DNA, 20 bp, Artificial Sequence
  chemically synthesized
ctctaccctgagacacacct

SEQ ID NO: 452452 - DNA, 20 bp, Artificial Sequence
  chemically synthesized
gtgatttttagggtggtctc

SEQ ID NO: 452453 - DNA, 20 bp, Artificial Sequence
  chemically synthesized
ggtgatttttagggtggtct

SEQ ID NO: 452454 - DNA, 20 bp, Artificial Sequence
  chemically synthesized
agccctggtgatttttaggg

SEQ ID NO: 452455 - DNA, 20 bp, Artificial Sequence
  chemically synthesized
ctcagccctggtgattttta

SEQ ID NO: 452456 - DNA, 20 bp, Artificial Sequence
  chemically synthesized
tctcagccctggtgattttt

SEQ ID NO: 452457 - DNA, 20 bp, Artificial Sequence
  chemically synthesized
ttctcagccctggtgatttt

SEQ ID NO: 452458 - DNA, 20 bp, Artificial Sequence
  chemically synthesized
gagaccaccctaaaaatcac

SEQ ID NO: 452459 - DNA, 20 bp, Artificial Sequence
  chemically synthesized
agaccaccctaaaaatcacc

SEQ ID NO: 452460 - DNA, 20 bp, Artificial Sequence
  chemically synthesized
gaccaccctaaaaatcacca

SEQ ID NO: 452461 - DNA, 20 bp, Artificial Sequence
  chemically synthesized
ccctaaaaatcaccagggct

SEQ ID NO: 452462 - DNA, 20 bp, Artificial Sequence
  chemically synthesized
gtgcctcctattctcagccc

SEQ ID NO: 452463 - DNA, 20 bp, Artificial Sequence
  chemically synthesized
aaaatcaccagggctgagaa

SEQ ID NO: 452464 - DNA, 20 bp, Artificial Sequence
  chemically synthesized
aaatcaccagggctgagaat

SEQ ID NO: 452465 - DNA, 20 bp, Artificial Sequence
  chemically synthesized
atcaccagggctgagaatag

SEQ ID NO: 452466 - DNA, 20 bp, Artificial Sequence
  chemically synthesized
gagtgggtgcctcctattct

SEQ ID NO: 452467 - DNA, 20 bp, Artificial Sequence
  chemically synthesized
tcaccagggctgagaatagg

SEQ ID NO: 452468 - DNA, 20 bp, Artificial Sequence
  chemically synthesized
ggtagatacattttatgagt

SEQ ID NO: 452469 - DNA, 20 bp, Artificial Sequence
  chemically synthesized
gggtagatacattttatgag

SEQ ID NO: 452470 - DNA, 20 bp, Artificial Sequence
  chemically synthesized
agtgggtagatacattttat

SEQ ID NO: 452471 - DNA, 20 bp, Artificial Sequence
  chemically synthesized
gccatgcaaatgagagtggg

SEQ ID NO: 452472 - DNA, 20 bp, Artificial Sequence
  chemically synthesized
agagccatgcaaatgagagt

SEQ ID NO: 452473 - DNA, 20 bp, Artificial Sequence
  chemically synthesized
tagagccatgcaaatgagag

SEQ ID NO: 452474 - DNA, 20 bp, Artificial Sequence
  chemically synthesized
acgtagagccatgcaaatga

SEQ ID NO: 452475 - DNA, 20 bp, Artificial Sequence
  chemically synthesized
tctacccactctcatttgca

SEQ ID NO: 452476 - DNA, 20 bp, Artificial Sequence
  chemically synthesized
ccacgtagagccatgcaaat

SEQ ID NO: 452477 - DNA, 20 bp, Artificial Sequence
  chemically synthesized
ctcatttgcatggctctacg

SEQ ID NO: 452478 - DNA, 20 bp, Artificial Sequence
  chemically synthesized
tcatttgcatggctctacgt

SEQ ID NO: 452479 - DNA, 20 bp, Artificial Sequence
  chemically synthesized
aaagcagaaggacccacgta

SEQ ID NO: 452480 - DNA, 20 bp, Artificial Sequence
  chemically synthesized
caaaagcagaaggacccacg

SEQ ID NO: 452481 - DNA, 20 bp, Artificial Sequence
  chemically synthesized
caaggtattgcaaaagcaga

SEQ ID NO: 452482 - DNA, 20 bp, Artificial Sequence
  chemically synthesized
ccaaggtattgcaaaagcag

SEQ ID NO: 452483 - DNA, 20 bp, Artificial Sequence
  chemically synthesized
gtcccaaggtattgcaaaag

SEQ ID NO: 452484 - DNA, 20 bp, Artificial Sequence
  chemically synthesized
aatgtcccaaggtattgcaa

SEQ ID NO: 452485 - DNA, 20 bp, Artificial Sequence
  chemically synthesized
cttctgcttttgcaatacct

SEQ ID NO: 452486 - DNA, 20 bp, Artificial Sequence
  chemically synthesized
ttctgcttttgcaatacctt

SEQ ID NO: 452487 - DNA, 20 bp, Artificial Sequence
  chemically synthesized
ggttgattgtaaatgtccca

SEQ ID NO: 452488 - DNA, 20 bp, Artificial Sequence
  chemically synthesized
gggttgattgtaaatgtccc

SEQ ID NO: 452489 - DNA, 20 bp, Artificial Sequence
  chemically synthesized
cttaactctctgttgtgagg

SEQ ID NO: 452490 - DNA, 20 bp, Artificial Sequence
  chemically synthesized
tacaatcaaccccctcacaa

SEQ ID NO: 452491 - DNA, 20 bp, Artificial Sequence
  chemically synthesized
acttaactctctgttgtgag

SEQ ID NO: 452492 - DNA, 20 bp, Artificial Sequence
  chemically synthesized
cacttaactctctgttgtga

SEQ ID NO: 452493 - DNA, 20 bp, Artificial Sequence
  chemically synthesized
caatcaaccccctcacaaca

SEQ ID NO: 452494 - DNA, 20 bp, Artificial Sequence
  chemically synthesized
gcacttaactctctgttgtg

SEQ ID NO: 452495 - DNA, 20 bp, Artificial Sequence
  chemically synthesized
ggcacttaactctctgttgt

SEQ ID NO: 452496 - DNA, 20 bp, Artificial Sequence
  chemically synthesized
atcaaccccctcacaacaga

SEQ ID NO: 452497 - DNA, 20 bp, Artificial Sequence
  chemically synthesized
ccccctcacaacagagagtt

SEQ ID NO: 452498 - DNA, 20 bp, Artificial Sequence
  chemically synthesized
gagttaagtgccttgatttc

SEQ ID NO: 452499 - DNA, 20 bp, Artificial Sequence
  chemically synthesized
tcaccactgtctggaaatca

SEQ ID NO: 452500 - DNA, 20 bp, Artificial Sequence
  chemically synthesized
ctcaccactgtctggaaatc

SEQ ID NO: 452501 - DNA, 20 bp, Artificial Sequence
  chemically synthesized
taagtgccttgatttccaga

SEQ ID NO: 452502 - DNA, 20 bp, Artificial Sequence
  chemically synthesized
gtgccttgatttccagacag

SEQ ID NO: 452503 - DNA, 20 bp, Artificial Sequence
  chemically synthesized
tactaaaactcaccactgtc

SEQ ID NO: 452504 - DNA, 20 bp, Artificial Sequence
  chemically synthesized
cttgatttccagacagtggt

SEQ ID NO: 452505 - DNA, 20 bp, Artificial Sequence
  chemically synthesized
ttccagacagtggtgagttt

SEQ ID NO: 452506 - DNA, 20 bp, Artificial Sequence
  chemically synthesized
cagacagtggtgagttttag

SEQ ID NO: 452507 - DNA, 20 bp, Artificial Sequence
  chemically synthesized
agacagtggtgagttttagt

SEQ ID NO: 452508 - DNA, 20 bp, Artificial Sequence
  chemically synthesized
gacagtggtgagttttagta

SEQ ID NO: 452509 - DNA, 20 bp, Artificial Sequence
  chemically synthesized
agttttagtagggaacgcct

SEQ ID NO: 452510 - DNA, 20 bp, Artificial Sequence
  chemically synthesized
tagtagggaacgcctcagct

SEQ ID NO: 452511 - DNA, 20 bp, Artificial Sequence
  chemically synthesized
cttctcaagtgtctaagctg

SEQ ID NO: 452512 - DNA, 20 bp, Artificial Sequence
  chemically synthesized
tcttctcaagtgtctaagct

SEQ ID NO: 452513 - DNA, 20 bp, Artificial Sequence
  chemically synthesized
tagtttcttctcaagtgtct

SEQ ID NO: 452514 - DNA, 20 bp, Artificial Sequence
  chemically synthesized
acgcctcagcttagacactt

SEQ ID NO: 452515 - DNA, 20 bp, Artificial Sequence
  chemically synthesized
cctcagcttagacacttgag

SEQ ID NO: 452516 - DNA, 20 bp, Artificial Sequence
  chemically synthesized
ctgccgtctagtttcttctc

SEQ ID NO: 452517 - DNA, 20 bp, Artificial Sequence
  chemically synthesized
ttagacacttgagaagaaac

SEQ ID NO: 452518 - DNA, 20 bp, Artificial Sequence
  chemically synthesized
acacttgagaagaaactaga

SEQ ID NO: 452519 - DNA, 20 bp, Artificial Sequence
  chemically synthesized
cttgagaagaaactagacgg

SEQ ID NO: 452520 - DNA, 20 bp, Artificial Sequence
  chemically synthesized
ggatggattttgctgccgtc

SEQ ID NO: 452521 - DNA, 20 bp, Artificial Sequence
  chemically synthesized
tgaggacgtgtgcaacggga

SEQ ID NO: 452522 - DNA, 20 bp, Artificial Sequence
  chemically synthesized
tagttgaggacgtgtgcaac

SEQ ID NO: 452523 - DNA, 20 bp, Artificial Sequence
  chemically synthesized
ctagttgaggacgtgtgcaa

SEQ ID NO: 452524 - DNA, 20 bp, Artificial Sequence
  chemically synthesized
ccgttgcacacgtcctcaac

SEQ ID NO: 452525 - DNA, 20 bp, Artificial Sequence
  chemically synthesized
cgttgcacacgtcctcaact

SEQ ID NO: 452526 - DNA, 20 bp, Artificial Sequence
  chemically synthesized
gtgttaacatttcctagttg

SEQ ID NO: 452527 - DNA, 20 bp, Artificial Sequence
  chemically synthesized
ggtgttaacatttcctagtt

SEQ ID NO: 452528 - DNA, 20 bp, Artificial Sequence
  chemically synthesized
tggaaggtgttaacatttcc

SEQ ID NO: 452529 - DNA, 20 bp, Artificial Sequence
  chemically synthesized
aggaaatgttaacaccttcc

SEQ ID NO: 452530 - DNA, 20 bp, Artificial Sequence
  chemically synthesized
taaaattagataatcttgga

SEQ ID NO: 452531 - DNA, 20 bp, Artificial Sequence
  chemically synthesized
ataaaattagataatcttgg

SEQ ID NO: 452532 - DNA, 20 bp, Artificial Sequence
  chemically synthesized
accataaaattagataatct

SEQ ID NO: 452533 - DNA, 20 bp, Artificial Sequence
  chemically synthesized
tccaagattatctaatttta

SEQ ID NO: 452534 - DNA, 20 bp, Artificial Sequence
  chemically synthesized
ccaattattgaccataaaat

SEQ ID NO: 452535 - DNA, 20 bp, Artificial Sequence
  chemically synthesized
ctaattttatggtcaataat

SEQ ID NO: 452536 - DNA, 20 bp, Artificial Sequence
  chemically synthesized
tatggtcaataattggtctt

SEQ ID NO: 452537 - DNA, 20 bp, Artificial Sequence
  chemically synthesized
caataattggtcttcagaaa

SEQ ID NO: 452538 - DNA, 20 bp, Artificial Sequence
  chemically synthesized
atatttgctctctttttctg

SEQ ID NO: 452539 - DNA, 20 bp, Artificial Sequence
  chemically synthesized
ataattggtcttcagaaaaa

SEQ ID NO: 452540 - DNA, 20 bp, Artificial Sequence
  chemically synthesized
aattggtcttcagaaaaaga

SEQ ID NO: 452541 - DNA, 20 bp, Artificial Sequence
  chemically synthesized
cagaaaaagagagcaaatat

SEQ ID NO: 452542 - DNA, 20 bp, Artificial Sequence
  chemically synthesized
agcaaatataagcaaaatat

SEQ ID NO: 452543 - DNA, 20 bp, Artificial Sequence
  chemically synthesized
gcaaatataagcaaaatata

SEQ ID NO: 452544 - DNA, 20 bp, Artificial Sequence
  chemically synthesized
caaatataagcaaaatataa

SEQ ID NO: 452545 - DNA, 20 bp, Artificial Sequence
  chemically synthesized
ataagcaaaatataagggaa

SEQ ID NO: 452546 - DNA, 20 bp, Artificial Sequence
  chemically synthesized
aaacaaaaacaatttcaaca

SEQ ID NO: 452547 - DNA, 20 bp, Artificial Sequence
  chemically synthesized
aacaaaaacaatttcaacac

SEQ ID NO: 452548 - DNA, 20 bp, Artificial Sequence
  chemically synthesized
aaaaacaatttcaacacagg

SEQ ID NO: 452549 - DNA, 20 bp, Artificial Sequence
  chemically synthesized
ctaaaaattaatagtttatt

SEQ ID NO: 452550 - DNA, 20 bp, Artificial Sequence
  chemically synthesized
accctttctctaaaaattaa

SEQ ID NO: 452551 - DNA, 20 bp, Artificial Sequence
  chemically synthesized
ctgaataaactattaatttt

SEQ ID NO: 452552 - DNA, 20 bp, Artificial Sequence
  chemically synthesized
gaataaactattaattttta

SEQ ID NO: 452553 - DNA, 20 bp, Artificial Sequence
  chemically synthesized
aaactattaatttttagaga

SEQ ID NO: 452554 - DNA, 20 bp, Artificial Sequence
  chemically synthesized
aactattaatttttagagaa

SEQ ID NO: 452555 - DNA, 20 bp, Artificial Sequence
  chemically synthesized
actattaatttttagagaaa

SEQ ID NO: 452556 - DNA, 20 bp, Artificial Sequence
  chemically synthesized
tttagagaaagggtcaacat

SEQ ID NO: 452557 - DNA, 20 bp, Artificial Sequence
  chemically synthesized
tagtttatagcataaaaaag

SEQ ID NO: 452558 - DNA, 20 bp, Artificial Sequence
  chemically synthesized
atatagtttatagcataaaa

SEQ ID NO: 452559 - DNA, 20 bp, Artificial Sequence
  chemically synthesized
ggggccatatatatagttta

SEQ ID NO: 452560 - DNA, 20 bp, Artificial Sequence
  chemically synthesized
tatgctataaactatatata

SEQ ID NO: 452561 - DNA, 20 bp, Artificial Sequence
  chemically synthesized
atgtttgggggccatatata

SEQ ID NO: 452562 - DNA, 20 bp, Artificial Sequence
  chemically synthesized
ttatattcatttatgtttgg

SEQ ID NO: 452563 - DNA, 20 bp, Artificial Sequence
  chemically synthesized
attatattcatttatgtttg

SEQ ID NO: 452564 - DNA, 20 bp, Artificial Sequence
  chemically synthesized
gattatattcatttatgttt

SEQ ID NO: 452565 - DNA, 20 bp, Artificial Sequence
  chemically synthesized
agattatattcatttatgtt

SEQ ID NO: 452566 - DNA, 20 bp, Artificial Sequence
  chemically synthesized
aacataaatgaatataatct

SEQ ID NO: 452567 - DNA, 20 bp, Artificial Sequence
  chemically synthesized
caataaaaataaatacagcc

SEQ ID NO: 452568 - DNA, 20 bp, Artificial Sequence
  chemically synthesized
taaagcaataaaaataaata

SEQ ID NO: 452569 - DNA, 20 bp, Artificial Sequence
  chemically synthesized
atataaataattcattttta

SEQ ID NO: 452570 - DNA, 20 bp, Artificial Sequence
  chemically synthesized
tgaattatttatattatcaa

SEQ ID NO: 452571 - DNA, 20 bp, Artificial Sequence
  chemically synthesized
atttatattatcaacagctg

SEQ ID NO: 452572 - DNA, 20 bp, Artificial Sequence
  chemically synthesized
attatcaacagctgtggcta

SEQ ID NO: 452573 - DNA, 20 bp, Artificial Sequence
  chemically synthesized
aagtcttttttctttagcca

SEQ ID NO: 452574 - DNA, 20 bp, Artificial Sequence
  chemically synthesized
acagctgtggctaaagaaaa

SEQ ID NO: 452575 - DNA, 20 bp, Artificial Sequence
  chemically synthesized
tgacaaaagtcttttttctt

SEQ ID NO: 452576 - DNA, 20 bp, Artificial Sequence
  chemically synthesized
gttctttgtttggatgacaa

SEQ ID NO: 452577 - DNA, 20 bp, Artificial Sequence
  chemically synthesized
agacttttgtcatccaaaca

SEQ ID NO: 452578 - DNA, 20 bp, Artificial Sequence
  chemically synthesized
gttataaatagttctttgtt

SEQ ID NO: 452579 - DNA, 20 bp, Artificial Sequence
  chemically synthesized
tggaatatcagggttataaa

SEQ ID NO: 452580 - DNA, 20 bp, Artificial Sequence
  chemically synthesized
aaatacaccttggaatatca

SEQ ID NO: 452581 - DNA, 20 bp, Artificial Sequence
  chemically synthesized
taaatacaccttggaatatc

SEQ ID NO: 452582 - DNA, 20 bp, Artificial Sequence
  chemically synthesized
atttataaccctgatattcc

SEQ ID NO: 452583 - DNA, 20 bp, Artificial Sequence
  chemically synthesized
ttaaatacaccttggaatat

SEQ ID NO: 452584 - DNA, 20 bp, Artificial Sequence
  chemically synthesized
tttataaccctgatattcca

SEQ ID NO: 452585 - DNA, 20 bp, Artificial Sequence
  chemically synthesized
acacctttttaaatacacct

SEQ ID NO: 452586 - DNA, 20 bp, Artificial Sequence
  chemically synthesized
tattccaaggtgtatttaaa

SEQ ID NO: 452587 - DNA, 20 bp, Artificial Sequence
  chemically synthesized
attccaaggtgtatttaaaa

SEQ ID NO: 452588 - DNA, 20 bp, Artificial Sequence
  chemically synthesized
atttaaaaaggtgttatttg

SEQ ID NO: 452589 - DNA, 20 bp, Artificial Sequence
  chemically synthesized
ttttaagatcttcgagaaaa

SEQ ID NO: 452590 - DNA, 20 bp, Artificial Sequence
  chemically synthesized
atattgtatctattttctcg

SEQ ID NO: 452591 - DNA, 20 bp, Artificial Sequence
  chemically synthesized
ttgctaattttaagatcttc

SEQ ID NO: 452592 - DNA, 20 bp, Artificial Sequence
  chemically synthesized
tttctcgaagatcttaaaat

SEQ ID NO: 452593 - DNA, 20 bp, Artificial Sequence
  chemically synthesized
tgatagtaattgctaatttt

SEQ ID NO: 452594 - DNA, 20 bp, Artificial Sequence
  chemically synthesized
attcaataaatgttcattga

SEQ ID NO: 452595 - DNA, 20 bp, Artificial Sequence
  chemically synthesized
atgaacatttattgaatata

SEQ ID NO: 452596 - DNA, 20 bp, Artificial Sequence
  chemically synthesized
ttgaatataaagtaactgta

SEQ ID NO: 452597 - DNA, 20 bp, Artificial Sequence
  chemically synthesized
cattagatacaaatgctata

SEQ ID NO: 452598 - DNA, 20 bp, Artificial Sequence
  chemically synthesized
cttagcaattagaaatgcat

SEQ ID NO: 452599 - DNA, 20 bp, Artificial Sequence
  chemically synthesized
ctaatgcatttctaattgct

SEQ ID NO: 452600 - DNA, 20 bp, Artificial Sequence
  chemically synthesized
tggaactgtaacttagcaat

SEQ ID NO: 452601 - DNA, 20 bp, Artificial Sequence
  chemically synthesized
catttctaattgctaagtta

SEQ ID NO: 452602 - DNA, 20 bp, Artificial Sequence
  chemically synthesized
aaaatgttggaactgtaact

SEQ ID NO: 452603 - DNA, 20 bp, Artificial Sequence
  chemically synthesized
cttggacactatgaaaatgt

SEQ ID NO: 452604 - DNA, 20 bp, Artificial Sequence
  chemically synthesized
ttacagttccaacattttca

SEQ ID NO: 452605 - DNA, 20 bp, Artificial Sequence
  chemically synthesized
ccaacattttcatagtgtcc

SEQ ID NO: 452606 - DNA, 20 bp, Artificial Sequence
  chemically synthesized
aaatatataaaataatcact

SEQ ID NO: 452607 - DNA, 20 bp, Artificial Sequence
  chemically synthesized
tgatacttttattatttaaa

SEQ ID NO: 452608 - DNA, 20 bp, Artificial Sequence
  chemically synthesized
tatttctttttaaataataa

SEQ ID NO: 452609 - DNA, 20 bp, Artificial Sequence
  chemically synthesized
taaaagtatcataaactttt

SEQ ID NO: 452610 - DNA, 20 bp, Artificial Sequence
  chemically synthesized
ggaagtttagtttttccaaa

SEQ ID NO: 452611 - DNA, 20 bp, Artificial Sequence
  chemically synthesized
tagcaataaaataggaagtt

SEQ ID NO: 452612 - DNA, 20 bp, Artificial Sequence
  chemically synthesized
ataagtagcaataaaatagg

SEQ ID NO: 452613 - DNA, 20 bp, Artificial Sequence
  chemically synthesized
gcaataagtagcaataaaat

SEQ ID NO: 452614 - DNA, 20 bp, Artificial Sequence
  chemically synthesized
ggcaataagtagcaataaaa

SEQ ID NO: 452615 - DNA, 20 bp, Artificial Sequence
  chemically synthesized
attaaataataggcaataag

SEQ ID NO: 452616 - DNA, 20 bp, Artificial Sequence
  chemically synthesized
aagattaaataataggcaat

SEQ ID NO: 452617 - DNA, 20 bp, Artificial Sequence
  chemically synthesized
catataaaagattaaataat

SEQ ID NO: 452618 - DNA, 20 bp, Artificial Sequence
  chemically synthesized
acatataaaagattaaataa

SEQ ID NO: 452619 - DNA, 20 bp, Artificial Sequence
  chemically synthesized
ttgatcatgttaacatataa

SEQ ID NO: 452620 - DNA, 20 bp, Artificial Sequence
  chemically synthesized
tttatatgttaacatgatca

SEQ ID NO: 452621 - DNA, 20 bp, Artificial Sequence
  chemically synthesized
ttatatgttaacatgatcaa

SEQ ID NO: 452622 - DNA, 20 bp, Artificial Sequence
  chemically synthesized
tttagttttaggtaaaatta

SEQ ID NO: 452623 - DNA, 20 bp, Artificial Sequence
  chemically synthesized
ttttagttttaggtaaaatt

SEQ ID NO: 452624 - DNA, 20 bp, Artificial Sequence
  chemically synthesized
gcttttttttttttagtttt

SEQ ID NO: 452625 - DNA, 20 bp, Artificial Sequence
  chemically synthesized
tgcttttttttttttagttt

SEQ ID NO: 452626 - DNA, 20 bp, Artificial Sequence
  chemically synthesized
aatatttgcttttttttttt

SEQ ID NO: 452627 - DNA, 20 bp, Artificial Sequence
  chemically synthesized
acctaaaactaaaaaaaaaa

SEQ ID NO: 452628 - DNA, 20 bp, Artificial Sequence
  chemically synthesized
aacagtgcttaaaaaatatt

SEQ ID NO: 452629 - DNA, 20 bp, Artificial Sequence
  chemically synthesized
tcaaatgctgaatatttttt

SEQ ID NO: 452630 - DNA, 20 bp, Artificial Sequence
  chemically synthesized
gaatattttttaagcactgt

SEQ ID NO: 452631 - DNA, 20 bp, Artificial Sequence
  chemically synthesized
gacagatagataattgctaa

SEQ ID NO: 452632 - DNA, 20 bp, Artificial Sequence
  chemically synthesized
gagattctaggatagacaga

SEQ ID NO: 452633 - DNA, 20 bp, Artificial Sequence
  chemically synthesized
aattatctatctgtctatcc

SEQ ID NO: 452634 - DNA, 20 bp, Artificial Sequence
  chemically synthesized
agtggagattctaggataga

SEQ ID NO: 452635 - DNA, 20 bp, Artificial Sequence
  chemically synthesized
tcagagtggagattctagga

SEQ ID NO: 452636 - DNA, 20 bp, Artificial Sequence
  chemically synthesized
gtgttcagagtggagattct

SEQ ID NO: 452637 - DNA, 20 bp, Artificial Sequence
  chemically synthesized
agtgttcagagtggagattc

SEQ ID NO: 452638 - DNA, 20 bp, Artificial Sequence
  chemically synthesized
ggaatgcagtgttcagagtg

SEQ ID NO: 452639 - DNA, 20 bp, Artificial Sequence
  chemically synthesized
atggaatgcagtgttcagag

SEQ ID NO: 452640 - DNA, 20 bp, Artificial Sequence
  chemically synthesized
cacatggaatgcagtgttca

SEQ ID NO: 452641 - DNA, 20 bp, Artificial Sequence
  chemically synthesized
atcacatggaatgcagtgtt

SEQ ID NO: 452642 - DNA, 20 bp, Artificial Sequence
  chemically synthesized
atgtttcatcacatggaatg

SEQ ID NO: 452643 - DNA, 20 bp, Artificial Sequence
  chemically synthesized
atatctaatgtttcatcaca

SEQ ID NO: 452644 - DNA, 20 bp, Artificial Sequence
  chemically synthesized
cattccatgtgatgaaacat

SEQ ID NO: 452645 - DNA, 20 bp, Artificial Sequence
  chemically synthesized
aacattagatatgaaaacac

SEQ ID NO: 452646 - DNA, 20 bp, Artificial Sequence
  chemically synthesized
acattagatatgaaaacaca

SEQ ID NO: 452647 - DNA, 20 bp, Artificial Sequence
  chemically synthesized
tagatatgaaaacacaaggc

SEQ ID NO: 452648 - DNA, 20 bp, Artificial Sequence
  chemically synthesized
agatatgaaaacacaaggct

SEQ ID NO: 452649 - DNA, 20 bp, Artificial Sequence
  chemically synthesized
tgaaaacacaaggctgggcg

SEQ ID NO: 452650 - DNA, 20 bp, Artificial Sequence
  chemically synthesized
aaacacaaggctgggcgcgg

SEQ ID NO: 452651 - DNA, 20 bp, Artificial Sequence
  chemically synthesized
caggcatgagccaccgcgcc

SEQ ID NO: 452652 - DNA, 20 bp, Artificial Sequence
  chemically synthesized
agtgctggaattacaggcat

SEQ ID NO: 452653 - DNA, 20 bp, Artificial Sequence
  chemically synthesized
gtggctcatgcctgtaattc

SEQ ID NO: 452654 - DNA, 20 bp, Artificial Sequence
  chemically synthesized
tcccaaagtgctggaattac

SEQ ID NO: 452655 - DNA, 20 bp, Artificial Sequence
  chemically synthesized
ctcccaaagtgctggaatta

SEQ ID NO: 452656 - DNA, 20 bp, Artificial Sequence
  chemically synthesized
tgcctgtaattccagcactt

SEQ ID NO: 452657 - DNA, 20 bp, Artificial Sequence
  chemically synthesized
gcctgtaattccagcacttt

SEQ ID NO: 452658 - DNA, 20 bp, Artificial Sequence
  chemically synthesized
gccttggcctcccaaagtgc

SEQ ID NO: 452659 - DNA, 20 bp, Artificial Sequence
  chemically synthesized
ctgtaattccagcactttgg

SEQ ID NO: 452660 - DNA, 20 bp, Artificial Sequence
  chemically synthesized
tgtaattccagcactttggg

SEQ ID NO: 452661 - DNA, 20 bp, Artificial Sequence
  chemically synthesized
ctgcctgccttggcctccca

SEQ ID NO: 452662 - DNA, 20 bp, Artificial Sequence
  chemically synthesized
ttccagcactttgggaggcc

SEQ ID NO: 452663 - DNA, 20 bp, Artificial Sequence
  chemically synthesized
tccagcactttgggaggcca

SEQ ID NO: 452664 - DNA, 20 bp, Artificial Sequence
  chemically synthesized
agcactttgggaggccaagg

SEQ ID NO: 452665 - DNA, 20 bp, Artificial Sequence
  chemically synthesized
gcactttgggaggccaaggc

SEQ ID NO: 452666 - DNA, 20 bp, Artificial Sequence
  chemically synthesized
ctttgggaggccaaggcagg

SEQ ID NO: 452667 - DNA, 20 bp, Artificial Sequence
  chemically synthesized
ctcaggtgatctgcctgcct

SEQ ID NO: 452668 - DNA, 20 bp, Artificial Sequence
  chemically synthesized
ccaaggcaggcagatcacct

SEQ ID NO: 452669 - DNA, 20 bp, Artificial Sequence
  chemically synthesized
caaggcaggcagatcacctg

SEQ ID NO: 452670 - DNA, 20 bp, Artificial Sequence
  chemically synthesized
gcaggcagatcacctgaggt

SEQ ID NO: 452671 - DNA, 20 bp, Artificial Sequence
  chemically synthesized
caggcagatcacctgaggtc

SEQ ID NO: 452672 - DNA, 20 bp, Artificial Sequence
  chemically synthesized
ggtctgaaactcctgacctc

SEQ ID NO: 452673 - DNA, 20 bp, Artificial Sequence
  chemically synthesized
ggcagatcacctgaggtcag

SEQ ID NO: 452674 - DNA, 20 bp, Artificial Sequence
  chemically synthesized
tggtctgaaactcctgacct

SEQ ID NO: 452675 - DNA, 20 bp, Artificial Sequence
  chemically synthesized
tcacctgaggtcaggagttt

SEQ ID NO: 452676 - DNA, 20 bp, Artificial Sequence
  chemically synthesized
tgaggtcaggagtttcagac

SEQ ID NO: 452677 - DNA, 20 bp, Artificial Sequence
  chemically synthesized
tcaggagtttcagaccagcc

SEQ ID NO: 452678 - DNA, 20 bp, Artificial Sequence
  chemically synthesized
tttcaccatgttggccaggc

SEQ ID NO: 452679 - DNA, 20 bp, Artificial Sequence
  chemically synthesized
gaggtttcaccatgttggcc

SEQ ID NO: 452680 - DNA, 20 bp, Artificial Sequence
  chemically synthesized
tcagaccagcctggccaaca

SEQ ID NO: 452681 - DNA, 20 bp, Artificial Sequence
  chemically synthesized
cgaggtttcaccatgttggc

SEQ ID NO: 452682 - DNA, 20 bp, Artificial Sequence
  chemically synthesized
gagacgaggtttcaccatgt

SEQ ID NO: 452683 - DNA, 20 bp, Artificial Sequence
  chemically synthesized
ttatatttttagtagagacg

SEQ ID NO: 452684 - DNA, 20 bp, Artificial Sequence
  chemically synthesized
tttatatttttagtagagac

SEQ ID NO: 452685 - DNA, 20 bp, Artificial Sequence
  chemically synthesized
taatttttatatttttagta

SEQ ID NO: 452686 - DNA, 20 bp, Artificial Sequence
  chemically synthesized
gctaatttttatatttttag

SEQ ID NO: 452687 - DNA, 20 bp, Artificial Sequence
  chemically synthesized
ccggctaatttttatatttt

SEQ ID NO: 452688 - DNA, 20 bp, Artificial Sequence
  chemically synthesized
tctactaaaaatataaaaat

SEQ ID NO: 452689 - DNA, 20 bp, Artificial Sequence
  chemically synthesized
ctaaaaatataaaaattagc

SEQ ID NO: 452690 - DNA, 20 bp, Artificial Sequence
  chemically synthesized
taaaaatataaaaattagcc

SEQ ID NO: 452691 - DNA, 20 bp, Artificial Sequence
  chemically synthesized
ataaaaattagccgggtgtg

SEQ ID NO: 452692 - DNA, 20 bp, Artificial Sequence
  chemically synthesized
acaggcacccgccacacacc

SEQ ID NO: 452693 - DNA, 20 bp, Artificial Sequence
  chemically synthesized
aaaattagccgggtgtgtgg

SEQ ID NO: 452694 - DNA, 20 bp, Artificial Sequence
  chemically synthesized
aaattagccgggtgtgtggc

SEQ ID NO: 452695 - DNA, 20 bp, Artificial Sequence
  chemically synthesized
gtggcgggtgcctgtaatcc

SEQ ID NO: 452696 - DNA, 20 bp, Artificial Sequence
  chemically synthesized
tcccaagtagctgggattac

SEQ ID NO: 452697 - DNA, 20 bp, Artificial Sequence
  chemically synthesized
ctcccaagtagctgggatta

SEQ ID NO: 452698 - DNA, 20 bp, Artificial Sequence
  chemically synthesized
tgcctgtaatcccagctact

SEQ ID NO: 452699 - DNA, 20 bp, Artificial Sequence
  chemically synthesized
cctcagcctcccaagtagct

SEQ ID NO: 452700 - DNA, 20 bp, Artificial Sequence
  chemically synthesized
gcctgtaatcccagctactt

SEQ ID NO: 452701 - DNA, 20 bp, Artificial Sequence
  chemically synthesized
gcctcagcctcccaagtagc

SEQ ID NO: 452702 - DNA, 20 bp, Artificial Sequence
  chemically synthesized
ctgtaatcccagctacttgg

SEQ ID NO: 452703 - DNA, 20 bp, Artificial Sequence
  chemically synthesized
tgtaatcccagctacttggg

SEQ ID NO: 452704 - DNA, 20 bp, Artificial Sequence
  chemically synthesized
tcctgcctcagcctcccaag

SEQ ID NO: 452705 - DNA, 20 bp, Artificial Sequence
  chemically synthesized
ttctcctgcctcagcctccc

SEQ ID NO: 452706 - DNA, 20 bp, Artificial Sequence
  chemically synthesized
tcccagctacttgggaggct

SEQ ID NO: 452707 - DNA, 20 bp, Artificial Sequence
  chemically synthesized
cccagctacttgggaggctg

SEQ ID NO: 452708 - DNA, 20 bp, Artificial Sequence
  chemically synthesized
agctacttgggaggctgagg

SEQ ID NO: 452709 - DNA, 20 bp, Artificial Sequence
  chemically synthesized
gctacttgggaggctgaggc

SEQ ID NO: 452710 - DNA, 20 bp, Artificial Sequence
  chemically synthesized
tacttgggaggctgaggcag

SEQ ID NO: 452711 - DNA, 20 bp, Artificial Sequence
  chemically synthesized
ttcaagcaattctcctgcct

SEQ ID NO: 452712 - DNA, 20 bp, Artificial Sequence
  chemically synthesized
caggagaattgcttgaaccc

SEQ ID NO: 452713 - DNA, 20 bp, Artificial Sequence
  chemically synthesized
aacctccgcctctggggttc

SEQ ID NO: 452714 - DNA, 20 bp, Artificial Sequence
  chemically synthesized
ggagaattgcttgaacccca

SEQ ID NO: 452715 - DNA, 20 bp, Artificial Sequence
  chemically synthesized
gagaattgcttgaaccccag

SEQ ID NO: 452716 - DNA, 20 bp, Artificial Sequence
  chemically synthesized
aattgcttgaaccccagagg

SEQ ID NO: 452717 - DNA, 20 bp, Artificial Sequence
  chemically synthesized
caccacaacctccgcctctg

SEQ ID NO: 452718 - DNA, 20 bp, Artificial Sequence
  chemically synthesized
ttgcttgaaccccagaggcg

SEQ ID NO: 452719 - DNA, 20 bp, Artificial Sequence
  chemically synthesized
tcaccacaacctccgcctct

SEQ ID NO: 452720 - DNA, 20 bp, Artificial Sequence
  chemically synthesized
tgcttgaaccccagaggcgg

SEQ ID NO: 452721 - DNA, 20 bp, Artificial Sequence
  chemically synthesized
ctcaccacaacctccgcctc

SEQ ID NO: 452722 - DNA, 20 bp, Artificial Sequence
  chemically synthesized
aaccccagaggcggaggttg

SEQ ID NO: 452723 - DNA, 20 bp, Artificial Sequence
  chemically synthesized
ccagaggcggaggttgtggt

SEQ ID NO: 452724 - DNA, 20 bp, Artificial Sequence
  chemically synthesized
ggcggaggttgtggtgagcc

SEQ ID NO: 452725 - DNA, 20 bp, Artificial Sequence
  chemically synthesized
gaggttgtggtgagccgaga

SEQ ID NO: 452726 - DNA, 20 bp, Artificial Sequence
  chemically synthesized
ggagtgtggtggcactatct

SEQ ID NO: 452727 - DNA, 20 bp, Artificial Sequence
  chemically synthesized
tcgcccaggctggagtgtgg

SEQ ID NO: 452728 - DNA, 20 bp, Artificial Sequence
  chemically synthesized
gagatagtgccaccacactc

SEQ ID NO: 452729 - DNA, 20 bp, Artificial Sequence
  chemically synthesized
ttgtcgcccaggctggagtg

SEQ ID NO: 452730 - DNA, 20 bp, Artificial Sequence
  chemically synthesized
agtgccaccacactccagcc

SEQ ID NO: 452731 - DNA, 20 bp, Artificial Sequence
  chemically synthesized
gtgccaccacactccagcct

SEQ ID NO: 452732 - DNA, 20 bp, Artificial Sequence
  chemically synthesized
tcgctttgtcgcccaggctg

SEQ ID NO: 452733 - DNA, 20 bp, Artificial Sequence
  chemically synthesized
tctcgctttgtcgcccaggc

SEQ ID NO: 452734 - DNA, 20 bp, Artificial Sequence
  chemically synthesized
agagtctcgctttgtcgccc

SEQ ID NO: 452735 - DNA, 20 bp, Artificial Sequence
  chemically synthesized
acactccagcctgggcgaca

SEQ ID NO: 452736 - DNA, 20 bp, Artificial Sequence
  chemically synthesized
cagagtctcgctttgtcgcc

SEQ ID NO: 452737 - DNA, 20 bp, Artificial Sequence
  chemically synthesized
tccagcctgggcgacaaagc

SEQ ID NO: 452738 - DNA, 20 bp, Artificial Sequence
  chemically synthesized
ttggttttttttttgagaca

SEQ ID NO: 452739 - DNA, 20 bp, Artificial Sequence
  chemically synthesized
ttttggttttttttttgaga

SEQ ID NO: 452740 - DNA, 20 bp, Artificial Sequence
  chemically synthesized
ttttttttggtttttttttt

SEQ ID NO: 452741 - DNA, 20 bp, Artificial Sequence
  chemically synthesized
ttttttggtttttttttttt

SEQ ID NO: 452742 - DNA, 20 bp, Artificial Sequence
  chemically synthesized
aaaaaaaaaaaaccaaaaaa

SEQ ID NO: 452743 - DNA, 20 bp, Artificial Sequence
  chemically synthesized
ttattgtgttttcttttttt

SEQ ID NO: 452744 - DNA, 20 bp, Artificial Sequence
  chemically synthesized
caaaaaaaagaaaacacaat

SEQ ID NO: 452745 - DNA, 20 bp, Artificial Sequence
  chemically synthesized
ttttaacttaaatcattgaa

SEQ ID NO: 452746 - DNA, 20 bp, Artificial Sequence
  chemically synthesized
ataagaccattcaatgattt

SEQ ID NO: 452747 - DNA, 20 bp, Artificial Sequence
  chemically synthesized
gatttaagttaaaacatgaa

SEQ ID NO: 452748 - DNA, 20 bp, Artificial Sequence
  chemically synthesized
aacatgaatagtgaccatgt

SEQ ID NO: 452749 - DNA, 20 bp, Artificial Sequence
  chemically synthesized
atgaatagtgaccatgtgag

SEQ ID NO: 452750 - DNA, 20 bp, Artificial Sequence
  chemically synthesized
catttgctttgccactcaca

SEQ ID NO: 452751 - DNA, 20 bp, Artificial Sequence
  chemically synthesized
tagtgaccatgtgagtggca

SEQ ID NO: 452752 - DNA, 20 bp, Artificial Sequence
  chemically synthesized
caaaaaaaataaaaatgaaa

SEQ ID NO: 452753 - DNA, 20 bp, Artificial Sequence
  chemically synthesized
ttttcatttttatttttttt

SEQ ID NO: 452754 - DNA, 20 bp, Artificial Sequence
  chemically synthesized
catttttattttttttgaga

SEQ ID NO: 452755 - DNA, 20 bp, Artificial Sequence
  chemically synthesized
tttttattttttttgagaca

SEQ ID NO: 452756 - DNA, 20 bp, Artificial Sequence
  chemically synthesized
tccagcctgggcaacagagt

SEQ ID NO: 452757 - DNA, 20 bp, Artificial Sequence
  chemically synthesized
cagagtctcactctgttgcc

SEQ ID NO: 452758 - DNA, 20 bp, Artificial Sequence
  chemically synthesized
gcactccagcctgggcaaca

SEQ ID NO: 452759 - DNA, 20 bp, Artificial Sequence
  chemically synthesized
agagtctcactctgttgccc

SEQ ID NO: 452760 - DNA, 20 bp, Artificial Sequence
  chemically synthesized
ctgcactccagcctgggcaa

SEQ ID NO: 452761 - DNA, 20 bp, Artificial Sequence
  chemically synthesized
tctcactctgttgcccaggc

SEQ ID NO: 452762 - DNA, 20 bp, Artificial Sequence
  chemically synthesized
tcactctgttgcccaggctg

SEQ ID NO: 452763 - DNA, 20 bp, Artificial Sequence
  chemically synthesized
gcattactgcactccagcct

SEQ ID NO: 452764 - DNA, 20 bp, Artificial Sequence
  chemically synthesized
tgcattactgcactccagcc

SEQ ID NO: 452765 - DNA, 20 bp, Artificial Sequence
  chemically synthesized
ctgttgcccaggctggagtg

SEQ ID NO: 452766 - DNA, 20 bp, Artificial Sequence
  chemically synthesized
gagattgcattactgcactc

SEQ ID NO: 452767 - DNA, 20 bp, Artificial Sequence
  chemically synthesized
ggagtgcagtaatgcaatct

SEQ ID NO: 452768 - DNA, 20 bp, Artificial Sequence
  chemically synthesized
ggcagaggttgcagtgagct

SEQ ID NO: 452769 - DNA, 20 bp, Artificial Sequence
  chemically synthesized
caggaggcagaggttgcagt

SEQ ID NO: 452770 - DNA, 20 bp, Artificial Sequence
  chemically synthesized
aacccaggaggcagaggttg

SEQ ID NO: 452771 - DNA, 20 bp, Artificial Sequence
  chemically synthesized
cgcttgaacccaggaggcag

SEQ ID NO: 452772 - DNA, 20 bp, Artificial Sequence
  chemically synthesized
tcactgcaacctctgcctcc

SEQ ID NO: 452773 - DNA, 20 bp, Artificial Sequence
  chemically synthesized
tcgcttgaacccaggaggca

SEQ ID NO: 452774 - DNA, 20 bp, Artificial Sequence
  chemically synthesized
cactgcaacctctgcctcct

SEQ ID NO: 452775 - DNA, 20 bp, Artificial Sequence
  chemically synthesized
aatcgcttgaacccaggagg

SEQ ID NO: 452776 - DNA, 20 bp, Artificial Sequence
  chemically synthesized
gagaatcgcttgaacccagg

SEQ ID NO: 452777 - DNA, 20 bp, Artificial Sequence
  chemically synthesized
ggagaatcgcttgaacccag

SEQ ID NO: 452778 - DNA, 20 bp, Artificial Sequence
  chemically synthesized
aacctctgcctcctgggttc

SEQ ID NO: 452779 - DNA, 20 bp, Artificial Sequence
  chemically synthesized
caggagaatcgcttgaaccc

SEQ ID NO: 452780 - DNA, 20 bp, Artificial Sequence
  chemically synthesized
gcaggagaatcgcttgaacc

SEQ ID NO: 452781 - DNA, 20 bp, Artificial Sequence
  chemically synthesized
ttcaagcgattctcctgcct

SEQ ID NO: 452782 - DNA, 20 bp, Artificial Sequence
  chemically synthesized
tactagggaggctgaggcag

SEQ ID NO: 452783 - DNA, 20 bp, Artificial Sequence
  chemically synthesized
gctactagggaggctgaggc

SEQ ID NO: 452784 - DNA, 20 bp, Artificial Sequence
  chemically synthesized
agctactagggaggctgagg

SEQ ID NO: 452785 - DNA, 20 bp, Artificial Sequence
  chemically synthesized
cccagctactagggaggctg

SEQ ID NO: 452786 - DNA, 20 bp, Artificial Sequence
  chemically synthesized
tcccagctactagggaggct

SEQ ID NO: 452787 - DNA, 20 bp, Artificial Sequence
  chemically synthesized
ttctcctgcctcagcctccc

SEQ ID NO: 452788 - DNA, 20 bp, Artificial Sequence
  chemically synthesized
tcctgcctcagcctccctag

SEQ ID NO: 452789 - DNA, 20 bp, Artificial Sequence
  chemically synthesized
tgtaatcccagctactaggg

SEQ ID NO: 452790 - DNA, 20 bp, Artificial Sequence
  chemically synthesized
ctgtaatcccagctactagg

SEQ ID NO: 452791 - DNA, 20 bp, Artificial Sequence
  chemically synthesized
gcctcagcctccctagtagc

SEQ ID NO: 452792 - DNA, 20 bp, Artificial Sequence
  chemically synthesized
acctgtaatcccagctacta

SEQ ID NO: 452793 - DNA, 20 bp, Artificial Sequence
  chemically synthesized
cctcagcctccctagtagct

SEQ ID NO: 452794 - DNA, 20 bp, Artificial Sequence
  chemically synthesized
cacctgtaatcccagctact

SEQ ID NO: 452795 - DNA, 20 bp, Artificial Sequence
  chemically synthesized
gcacctgtaatcccagctac

SEQ ID NO: 452796 - DNA, 20 bp, Artificial Sequence
  chemically synthesized
ctccctagtagctgggatta

SEQ ID NO: 452797 - DNA, 20 bp, Artificial Sequence
  chemically synthesized
tccctagtagctgggattac

SEQ ID NO: 452798 - DNA, 20 bp, Artificial Sequence
  chemically synthesized
gtggtgggcacctgtaatcc

SEQ ID NO: 452799 - DNA, 20 bp, Artificial Sequence
  chemically synthesized
aattagtcaggcgtggtggt

SEQ ID NO: 452800 - DNA, 20 bp, Artificial Sequence
  chemically synthesized
aaattagtcaggcgtggtgg

SEQ ID NO: 452801 - DNA, 20 bp, Artificial Sequence
  chemically synthesized
caaaaattagtcaggcgtgg

SEQ ID NO: 452802 - DNA, 20 bp, Artificial Sequence
  chemically synthesized
atacaaaaattagtcaggcg

SEQ ID NO: 452803 - DNA, 20 bp, Artificial Sequence
  chemically synthesized
taaaaatacaaaaattagtc

SEQ ID NO: 452804 - DNA, 20 bp, Artificial Sequence
  chemically synthesized
ctaaaaatacaaaaattagt

SEQ ID NO: 452805 - DNA, 20 bp, Artificial Sequence
  chemically synthesized
tctactaaaaatacaaaaat

SEQ ID NO: 452806 - DNA, 20 bp, Artificial Sequence
  chemically synthesized
ctgactaatttttgtatttt

SEQ ID NO: 452807 - DNA, 20 bp, Artificial Sequence
  chemically synthesized
actaatttttgtatttttag

SEQ ID NO: 452808 - DNA, 20 bp, Artificial Sequence
  chemically synthesized
taatttttgtatttttagta

SEQ ID NO: 452809 - DNA, 20 bp, Artificial Sequence
  chemically synthesized
ttttgtatttttagtagaga

SEQ ID NO: 452810 - DNA, 20 bp, Artificial Sequence
  chemically synthesized
tttgtatttttagtagagac

SEQ ID NO: 452811 - DNA, 20 bp, Artificial Sequence
  chemically synthesized
ttgtatttttagtagagaca

SEQ ID NO: 452812 - DNA, 20 bp, Artificial Sequence
  chemically synthesized
gagacagggtttcaccatgt

SEQ ID NO: 452813 - DNA, 20 bp, Artificial Sequence
  chemically synthesized
cagggtttcaccatgttggc

SEQ ID NO: 452814 - DNA, 20 bp, Artificial Sequence
  chemically synthesized
tgagaccagcctggccaaca

SEQ ID NO: 452815 - DNA, 20 bp, Artificial Sequence
  chemically synthesized
agggtttcaccatgttggcc

SEQ ID NO: 452816 - DNA, 20 bp, Artificial Sequence
  chemically synthesized
tttcaccatgttggccaggc

SEQ ID NO: 452817 - DNA, 20 bp, Artificial Sequence
  chemically synthesized
tcaggagtttgagaccagcc

SEQ ID NO: 452818 - DNA, 20 bp, Artificial Sequence
  chemically synthesized
tgaggtcaggagtttgagac

SEQ ID NO: 452819 - DNA, 20 bp, Artificial Sequence
  chemically synthesized
tcacctgaggtcaggagttt

SEQ ID NO: 452820 - DNA, 20 bp, Artificial Sequence
  chemically synthesized
tggtctcaaactcctgacct

SEQ ID NO: 452821 - DNA, 20 bp, Artificial Sequence
  chemically synthesized
ggcggatcacctgaggtcag

SEQ ID NO: 452822 - DNA, 20 bp, Artificial Sequence
  chemically synthesized
ggtctcaaactcctgacctc

SEQ ID NO: 452823 - DNA, 20 bp, Artificial Sequence
  chemically synthesized
caggcggatcacctgaggtc

SEQ ID NO: 452824 - DNA, 20 bp, Artificial Sequence
  chemically synthesized
gcaggcggatcacctgaggt

SEQ ID NO: 452825 - DNA, 20 bp, Artificial Sequence
  chemically synthesized
tgaggcaggcggatcacctg

SEQ ID NO: 452826 - DNA, 20 bp, Artificial Sequence
  chemically synthesized
ctgaggcaggcggatcacct

SEQ ID NO: 452827 - DNA, 20 bp, Artificial Sequence
  chemically synthesized
ctcaggtgatccgcctgcct

SEQ ID NO: 452828 - DNA, 20 bp, Artificial Sequence
  chemically synthesized
ctttgggagactgaggcagg

SEQ ID NO: 452829 - DNA, 20 bp, Artificial Sequence
  chemically synthesized
gcactttgggagactgaggc

SEQ ID NO: 452830 - DNA, 20 bp, Artificial Sequence
  chemically synthesized
agcactttgggagactgagg

SEQ ID NO: 452831 - DNA, 20 bp, Artificial Sequence
  chemically synthesized
cccagcactttgggagactg

SEQ ID NO: 452832 - DNA, 20 bp, Artificial Sequence
  chemically synthesized
tcccagcactttgggagact

SEQ ID NO: 452833 - DNA, 20 bp, Artificial Sequence
  chemically synthesized
ccgcctgcctcagtctccca

SEQ ID NO: 452834 - DNA, 20 bp, Artificial Sequence
  chemically synthesized
ctgtaatcccagcactttgg

SEQ ID NO: 452835 - DNA, 20 bp, Artificial Sequence
  chemically synthesized
gcctcagtctcccaaagtgc

SEQ ID NO: 452836 - DNA, 20 bp, Artificial Sequence
  chemically synthesized
gcctgtaatcccagcacttt

SEQ ID NO: 452837 - DNA, 20 bp, Artificial Sequence
  chemically synthesized
cctcagtctcccaaagtgct

SEQ ID NO: 452838 - DNA, 20 bp, Artificial Sequence
  chemically synthesized
cgcctgtaatcccagcactt

SEQ ID NO: 452839 - DNA, 20 bp, Artificial Sequence
  chemically synthesized
ctcccaaagtgctgggatta

SEQ ID NO: 452840 - DNA, 20 bp, Artificial Sequence
  chemically synthesized
tcccaaagtgctgggattac

SEQ ID NO: 452841 - DNA, 20 bp, Artificial Sequence
  chemically synthesized
gaggctcacgcctgtaatcc

SEQ ID NO: 452842 - DNA, 20 bp, Artificial Sequence
  chemically synthesized
agtgctgggattacaggcgt

SEQ ID NO: 452843 - DNA, 20 bp, Artificial Sequence
  chemically synthesized
caggcgtgagcctccatacc

SEQ ID NO: 452844 - DNA, 20 bp, Artificial Sequence
  chemically synthesized
atcagggaggctgggtatgg

SEQ ID NO: 452845 - DNA, 20 bp, Artificial Sequence
  chemically synthesized
gatcagggaggctgggtatg

SEQ ID NO: 452846 - DNA, 20 bp, Artificial Sequence
  chemically synthesized
gggatcagggaggctgggta

SEQ ID NO: 452847 - DNA, 20 bp, Artificial Sequence
  chemically synthesized
ttaaagggatcagggaggct

SEQ ID NO: 452848 - DNA, 20 bp, Artificial Sequence
  chemically synthesized
cttaaagggatcagggaggc

SEQ ID NO: 452849 - DNA, 20 bp, Artificial Sequence
  chemically synthesized
agatcttaaagggatcaggg

SEQ ID NO: 452850 - DNA, 20 bp, Artificial Sequence
  chemically synthesized
aagatcttaaagggatcagg

SEQ ID NO: 452851 - DNA, 20 bp, Artificial Sequence
  chemically synthesized
aaaagatcttaaagggatca

SEQ ID NO: 452852 - DNA, 20 bp, Artificial Sequence
  chemically synthesized
gaaaagatcttaaagggatc

SEQ ID NO: 452853 - DNA, 20 bp, Artificial Sequence
  chemically synthesized
ggaaaagatcttaaagggat

SEQ ID NO: 452854 - DNA, 20 bp, Artificial Sequence
  chemically synthesized
ccagcctccctgatcccttt

SEQ ID NO: 452855 - DNA, 20 bp, Artificial Sequence
  chemically synthesized
atgggggaaaagatcttaaa

SEQ ID NO: 452856 - DNA, 20 bp, Artificial Sequence
  chemically synthesized
aatgggggaaaagatcttaa

SEQ ID NO: 452857 - DNA, 20 bp, Artificial Sequence
  chemically synthesized
aaatgggggaaaagatctta

SEQ ID NO: 452858 - DNA, 20 bp, Artificial Sequence
  chemically synthesized
tcattggaaaaatgggggaa

SEQ ID NO: 452859 - DNA, 20 bp, Artificial Sequence
  chemically synthesized
agatgtcattggaaaaatgg

SEQ ID NO: 452860 - DNA, 20 bp, Artificial Sequence
  chemically synthesized
aagatgtcattggaaaaatg

SEQ ID NO: 452861 - DNA, 20 bp, Artificial Sequence
  chemically synthesized
taagatgtcattggaaaaat

SEQ ID NO: 452862 - DNA, 20 bp, Artificial Sequence
  chemically synthesized
ataagatgtcattggaaaaa

SEQ ID NO: 452863 - DNA, 20 bp, Artificial Sequence
  chemically synthesized
atatgcatataagatgtcat

SEQ ID NO: 452864 - DNA, 20 bp, Artificial Sequence
  chemically synthesized
tatctcatgtatatgcatat

SEQ ID NO: 452865 - DNA, 20 bp, Artificial Sequence
  chemically synthesized
catcttatatgcatatacat

SEQ ID NO: 452866 - DNA, 20 bp, Artificial Sequence
  chemically synthesized
ttatatgcatatacatgaga

SEQ ID NO: 452867 - DNA, 20 bp, Artificial Sequence
  chemically synthesized
gaatttgtgttctaaattca

SEQ ID NO: 452868 - DNA, 20 bp, Artificial Sequence
  chemically synthesized
aactcttccttctttgaatt

SEQ ID NO: 452869 - DNA, 20 bp, Artificial Sequence
  chemically synthesized
tttgtgttctaaattcaaag

SEQ ID NO: 452870 - DNA, 20 bp, Artificial Sequence
  chemically synthesized
ttgtgttctaaattcaaaga

SEQ ID NO: 452871 - DNA, 20 bp, Artificial Sequence
  chemically synthesized
tgttctaaattcaaagaagg

SEQ ID NO: 452872 - DNA, 20 bp, Artificial Sequence
  chemically synthesized
ttctaaattcaaagaaggaa

SEQ ID NO: 452873 - DNA, 20 bp, Artificial Sequence
  chemically synthesized
tcaaagaaggaagagttcat

SEQ ID NO: 452874 - DNA, 20 bp, Artificial Sequence
  chemically synthesized
aaggaagagttcattggatt

SEQ ID NO: 452875 - DNA, 20 bp, Artificial Sequence
  chemically synthesized
aggaagagttcattggattt

SEQ ID NO: 452876 - DNA, 20 bp, Artificial Sequence
  chemically synthesized
ggaagagttcattggatttg

SEQ ID NO: 452877 - DNA, 20 bp, Artificial Sequence
  chemically synthesized
aagagttcattggatttggg

SEQ ID NO: 452878 - DNA, 20 bp, Artificial Sequence
  chemically synthesized
cattggatttggggagaact

SEQ ID NO: 452879 - DNA, 20 bp, Artificial Sequence
  chemically synthesized
caaccaactcaacatcgtcc

SEQ ID NO: 452880 - DNA, 20 bp, Artificial Sequence
  chemically synthesized
gggagaacttggacgatgtt

SEQ ID NO: 452881 - DNA, 20 bp, Artificial Sequence
  chemically synthesized
gaacttggacgatgttgagt

SEQ ID NO: 452882 - DNA, 20 bp, Artificial Sequence
  chemically synthesized
ttggacgatgttgagttggt

SEQ ID NO: 452883 - DNA, 20 bp, Artificial Sequence
  chemically synthesized
ttgagttggttggtattgat

SEQ ID NO: 452884 - DNA, 20 bp, Artificial Sequence
  chemically synthesized
gagttggttggtattgatca

SEQ ID NO: 452885 - DNA, 20 bp, Artificial Sequence
  chemically synthesized
gttggttggtattgatcaga

SEQ ID NO: 452886 - DNA, 20 bp, Artificial Sequence
  chemically synthesized
ttggttggtattgatcagag

SEQ ID NO: 452887 - DNA, 20 bp, Artificial Sequence
  chemically synthesized
tcagagaggaaatgtattta

SEQ ID NO: 452888 - DNA, 20 bp, Artificial Sequence
  chemically synthesized
agagaggaaatgtatttata

SEQ ID NO: 452889 - DNA, 20 bp, Artificial Sequence
  chemically synthesized
tatttatagagaaatccatg

SEQ ID NO: 452890 - DNA, 20 bp, Artificial Sequence
  chemically synthesized
tttatagagaaatccatgta

SEQ ID NO: 452891 - DNA, 20 bp, Artificial Sequence
  chemically synthesized
gataattacttcactctaca

SEQ ID NO: 452892 - DNA, 20 bp, Artificial Sequence
  chemically synthesized
agagaaatccatgtagagtg

SEQ ID NO: 452893 - DNA, 20 bp, Artificial Sequence
  chemically synthesized
tgtagagtgaagtaattatc

SEQ ID NO: 452894 - DNA, 20 bp, Artificial Sequence
  chemically synthesized
gtagagtgaagtaattatca

SEQ ID NO: 452895 - DNA, 20 bp, Artificial Sequence
  chemically synthesized
actgccccttgaattcatat

SEQ ID NO: 452896 - DNA, 20 bp, Artificial Sequence
  chemically synthesized
tttgtgactgatatgaattc

SEQ ID NO: 452897 - DNA, 20 bp, Artificial Sequence
  chemically synthesized
ttgtgactgatatgaattca

SEQ ID NO: 452898 - DNA, 20 bp, Artificial Sequence
  chemically synthesized
tgtgactgatatgaattcaa

SEQ ID NO: 452899 - DNA, 20 bp, Artificial Sequence
  chemically synthesized
gtgactgatatgaattcaag

SEQ ID NO: 452900 - DNA, 20 bp, Artificial Sequence
  chemically synthesized
actgatatgaattcaagggg

SEQ ID NO: 452901 - DNA, 20 bp, Artificial Sequence
  chemically synthesized
tcaaggggcagtttataatt

SEQ ID NO: 452902 - DNA, 20 bp, Artificial Sequence
  chemically synthesized
tataattcagtcacatgtta

SEQ ID NO: 452903 - DNA, 20 bp, Artificial Sequence
  chemically synthesized
gtcacatgttaaagaacaaa

SEQ ID NO: 452904 - DNA, 20 bp, Artificial Sequence
  chemically synthesized
tcacatgttaaagaacaaaa

SEQ ID NO: 452905 - DNA, 20 bp, Artificial Sequence
  chemically synthesized
ttaaagaacaaaaaggacga

SEQ ID NO: 452906 - DNA, 20 bp, Artificial Sequence
  chemically synthesized
aagaacaaaaaggacgaaag

SEQ ID NO: 452907 - DNA, 20 bp, Artificial Sequence
  chemically synthesized
aaaaggacgaaagaagaata

SEQ ID NO: 452908 - DNA, 20 bp, Artificial Sequence
  chemically synthesized
aggacgaaagaagaataaag

SEQ ID NO: 452909 - DNA, 20 bp, Artificial Sequence
  chemically synthesized
cgaaagaagaataaagcaga

SEQ ID NO: 452910 - DNA, 20 bp, Artificial Sequence
  chemically synthesized
aagcagatagaatcgtgaaa

SEQ ID NO: 452911 - DNA, 20 bp, Artificial Sequence
  chemically synthesized
agcagatagaatcgtgaaat

SEQ ID NO: 452912 - DNA, 20 bp, Artificial Sequence
  chemically synthesized
gttacattatttgcaccata

SEQ ID NO: 452913 - DNA, 20 bp, Artificial Sequence
  chemically synthesized
tttgatttacttaaacttta

SEQ ID NO: 452914 - DNA, 20 bp, Artificial Sequence
  chemically synthesized
ttatttgcaccataaagttt

SEQ ID NO: 452915 - DNA, 20 bp, Artificial Sequence
  chemically synthesized
gtttaagtaaatcaaattat

SEQ ID NO: 452916 - DNA, 20 bp, Artificial Sequence
  chemically synthesized
tttaagtaaatcaaattatt

SEQ ID NO: 452917 - DNA, 20 bp, Artificial Sequence
  chemically synthesized
caaattattgggaatattct

SEQ ID NO: 452918 - DNA, 20 bp, Artificial Sequence
  chemically synthesized
ttattgggaatattctgaga

SEQ ID NO: 452919 - DNA, 20 bp, Artificial Sequence
  chemically synthesized
attgggaatattctgagata

SEQ ID NO: 452920 - DNA, 20 bp, Artificial Sequence
  chemically synthesized
gaaagactttagctctatct

SEQ ID NO: 452921 - DNA, 20 bp, Artificial Sequence
  chemically synthesized
aatattctgagatagagcta

SEQ ID NO: 452922 - DNA, 20 bp, Artificial Sequence
  chemically synthesized
atgactcttgagaaagactt

SEQ ID NO: 452923 - DNA, 20 bp, Artificial Sequence
  chemically synthesized
atagagctaaagtctttctc

SEQ ID NO: 452924 - DNA, 20 bp, Artificial Sequence
  chemically synthesized
agagctaaagtctttctcaa

SEQ ID NO: 452925 - DNA, 20 bp, Artificial Sequence
  chemically synthesized
ttcaaccatgactcttgaga

SEQ ID NO: 452926 - DNA, 20 bp, Artificial Sequence
  chemically synthesized
tggtttcaaccatgactctt

SEQ ID NO: 452927 - DNA, 20 bp, Artificial Sequence
  chemically synthesized
aaagtctttctcaagagtca

SEQ ID NO: 452928 - DNA, 20 bp, Artificial Sequence
  chemically synthesized
atggttgaaaccacatgttg

SEQ ID NO: 452929 - DNA, 20 bp, Artificial Sequence
  chemically synthesized
atcagttcctccacaacatg

SEQ ID NO: 452930 - DNA, 20 bp, Artificial Sequence
  chemically synthesized
ggttgaaaccacatgttgtg

SEQ ID NO: 452931 - DNA, 20 bp, Artificial Sequence
  chemically synthesized
gttgaaaccacatgttgtgg

SEQ ID NO: 452932 - DNA, 20 bp, Artificial Sequence
  chemically synthesized
acatgttgtggaggaactga

SEQ ID NO: 452933 - DNA, 20 bp, Artificial Sequence
  chemically synthesized
aatggggcaacaatcaccat

SEQ ID NO: 452934 - DNA, 20 bp, Artificial Sequence
  chemically synthesized
tggtgattgttgccccattg

SEQ ID NO: 452935 - DNA, 20 bp, Artificial Sequence
  chemically synthesized
ggtgattgttgccccattgt

SEQ ID NO: 452936 - DNA, 20 bp, Artificial Sequence
  chemically synthesized
tagggaggaatcccacaatg

SEQ ID NO: 452937 - DNA, 20 bp, Artificial Sequence
  chemically synthesized
atagggaggaatcccacaat

SEQ ID NO: 452938 - DNA, 20 bp, Artificial Sequence
  chemically synthesized
catagggaggaatcccacaa

SEQ ID NO: 452939 - DNA, 20 bp, Artificial Sequence
  chemically synthesized
cattgtgggattcctcccta

SEQ ID NO: 452940 - DNA, 20 bp, Artificial Sequence
  chemically synthesized
ttgatgtcattaccataggg

SEQ ID NO: 452941 - DNA, 20 bp, Artificial Sequence
  chemically synthesized
tttgatgtcattaccatagg

SEQ ID NO: 452942 - DNA, 20 bp, Artificial Sequence
  chemically synthesized
attttgatgtcattaccata

SEQ ID NO: 452943 - DNA, 20 bp, Artificial Sequence
  chemically synthesized
cattttgatgtcattaccat

SEQ ID NO: 452944 - DNA, 20 bp, Artificial Sequence
  chemically synthesized
tcattttgatgtcattacca

SEQ ID NO: 452945 - DNA, 20 bp, Artificial Sequence
  chemically synthesized
aaaaaaaaacacacacacac

SEQ ID NO: 452946 - DNA, 20 bp, Artificial Sequence
  chemically synthesized
acacacacaagaaaatgacg

SEQ ID NO: 452947 - DNA, 20 bp, Artificial Sequence
  chemically synthesized
aaaatgacgcagattgtaat

SEQ ID NO: 452948 - DNA, 20 bp, Artificial Sequence
  chemically synthesized
aatgacgcagattgtaatta

SEQ ID NO: 452949 - DNA, 20 bp, Artificial Sequence
  chemically synthesized
atgacgcagattgtaattag

SEQ ID NO: 452950 - DNA, 20 bp, Artificial Sequence
  chemically synthesized
acgcagattgtaattagagg

SEQ ID NO: 452951 - DNA, 20 bp, Artificial Sequence
  chemically synthesized
gcagattgtaattagaggtg

SEQ ID NO: 452952 - DNA, 20 bp, Artificial Sequence
  chemically synthesized
ggagataaccagatcataaa

SEQ ID NO: 452953 - DNA, 20 bp, Artificial Sequence
  chemically synthesized
aggtggagctgtttatgatc

SEQ ID NO: 452954 - DNA, 20 bp, Artificial Sequence
  chemically synthesized
cagaacaatgtggagataac

SEQ ID NO: 452955 - DNA, 20 bp, Artificial Sequence
  chemically synthesized
ttctttcccagaacaatgtg

SEQ ID NO: 452956 - DNA, 20 bp, Artificial Sequence
  chemically synthesized
aattctttcccagaacaatg

SEQ ID NO: 452957 - DNA, 20 bp, Artificial Sequence
  chemically synthesized
tggttatctccacattgttc

SEQ ID NO: 452958 - DNA, 20 bp, Artificial Sequence
  chemically synthesized
ggttatctccacattgttct

SEQ ID NO: 452959 - DNA, 20 bp, Artificial Sequence
  chemically synthesized
atctccacattgttctggga

SEQ ID NO: 452960 - DNA, 20 bp, Artificial Sequence
  chemically synthesized
gtaatgtctcaattctttcc

SEQ ID NO: 452961 - DNA, 20 bp, Artificial Sequence
  chemically synthesized
cattgttctgggaaagaatt

SEQ ID NO: 452962 - DNA, 20 bp, Artificial Sequence
  chemically synthesized
ggaaagaattgagacattac

SEQ ID NO: 452963 - DNA, 20 bp, Artificial Sequence
  chemically synthesized
gaaagaattgagacattact

SEQ ID NO: 452964 - DNA, 20 bp, Artificial Sequence
  chemically synthesized
ctcacagacatgatttgacc

SEQ ID NO: 452965 - DNA, 20 bp, Artificial Sequence
  chemically synthesized
ctgggtcaaatcatgtctgt

SEQ ID NO: 452966 - DNA, 20 bp, Artificial Sequence
  chemically synthesized
ttacctttcattttgtctca

SEQ ID NO: 452967 - DNA, 20 bp, Artificial Sequence
  chemically synthesized
atgtctgtgagacaaaatga

SEQ ID NO: 452968 - DNA, 20 bp, Artificial Sequence
  chemically synthesized
tgtctgtgagacaaaatgaa

SEQ ID NO: 452969 - DNA, 20 bp, Artificial Sequence
  chemically synthesized
gacaaaatgaaaggtaaaaa

SEQ ID NO: 452970 - DNA, 20 bp, Artificial Sequence
  chemically synthesized
aggtaaaaatagtgaataaa

SEQ ID NO: 452971 - DNA, 20 bp, Artificial Sequence
  chemically synthesized
gtaaaaatagtgaataaaaa

SEQ ID NO: 452972 - DNA, 20 bp, Artificial Sequence
  chemically synthesized
aaatagtgaataaaaagaga

SEQ ID NO: 452973 - DNA, 20 bp, Artificial Sequence
  chemically synthesized
gtgaataaaaagagaaagat

SEQ ID NO: 452974 - DNA, 20 bp, Artificial Sequence
  chemically synthesized
aaaagagaaagattagaaac

SEQ ID NO: 452975 - DNA, 20 bp, Artificial Sequence
  chemically synthesized
gaaagattagaaacaagctt

SEQ ID NO: 452976 - DNA, 20 bp, Artificial Sequence
  chemically synthesized
caaggaagagcaagtgacta

SEQ ID NO: 452977 - DNA, 20 bp, Artificial Sequence
  chemically synthesized
ggcctaccgcaaggaagagc

SEQ ID NO: 452978 - DNA, 20 bp, Artificial Sequence
  chemically synthesized
tagtcacttgctcttccttg

SEQ ID NO: 452979 - DNA, 20 bp, Artificial Sequence
  chemically synthesized
caagggcctaccgcaaggaa

SEQ ID NO: 452980 - DNA, 20 bp, Artificial Sequence
  chemically synthesized
tccaagggcctaccgcaagg

SEQ ID NO: 452981 - DNA, 20 bp, Artificial Sequence
  chemically synthesized
tcacttgctcttccttgcgg

SEQ ID NO: 452982 - DNA, 20 bp, Artificial Sequence
  chemically synthesized
cacttgctcttccttgcggt

SEQ ID NO: 452983 - DNA, 20 bp, Artificial Sequence
  chemically synthesized
tattccaagggcctaccgca

SEQ ID NO: 452984 - DNA, 20 bp, Artificial Sequence
  chemically synthesized
atattccaagggcctaccgc

SEQ ID NO: 452985 - DNA, 20 bp, Artificial Sequence
  chemically synthesized
tcttccttgcggtaggccct

SEQ ID NO: 452986 - DNA, 20 bp, Artificial Sequence
  chemically synthesized
aggatttgtcaatattccaa

SEQ ID NO: 452987 - DNA, 20 bp, Artificial Sequence
  chemically synthesized
taggatttgtcaatattcca

SEQ ID NO: 452988 - DNA, 20 bp, Artificial Sequence
  chemically synthesized
ttaggatttgtcaatattcc

SEQ ID NO: 452989 - DNA, 20 bp, Artificial Sequence
  chemically synthesized
gtttttttttaaattatttt

SEQ ID NO: 452990 - DNA, 20 bp, Artificial Sequence
  chemically synthesized
tgtttttttttaaattattt

SEQ ID NO: 452991 - DNA, 20 bp, Artificial Sequence
  chemically synthesized
taaaataatttaaaaaaaaa

SEQ ID NO: 452992 - DNA, 20 bp, Artificial Sequence
  chemically synthesized
aataatttaaaaaaaaacag

SEQ ID NO: 452993 - DNA, 20 bp, Artificial Sequence
  chemically synthesized
cagtggattttaatcaccat

SEQ ID NO: 452994 - DNA, 20 bp, Artificial Sequence
  chemically synthesized
agtggattttaatcaccatg

SEQ ID NO: 452995 - DNA, 20 bp, Artificial Sequence
  chemically synthesized
gtggattttaatcaccatga

SEQ ID NO: 452996 - DNA, 20 bp, Artificial Sequence
  chemically synthesized
caagactatttttaccctca

SEQ ID NO: 452997 - DNA, 20 bp, Artificial Sequence
  chemically synthesized
aatcaccatgagggtaaaaa

SEQ ID NO: 452998 - DNA, 20 bp, Artificial Sequence
  chemically synthesized
ttggaaatacagtggtaaac

SEQ ID NO: 452999 - DNA, 20 bp, Artificial Sequence
  chemically synthesized
gctatgtgttggaaatacag

SEQ ID NO: 453000 - DNA, 20 bp, Artificial Sequence
  chemically synthesized
cacgctatgtgttggaaata

SEQ ID NO: 453001 - DNA, 20 bp, Artificial Sequence
  chemically synthesized
accactgtatttccaacaca

SEQ ID NO: 453002 - DNA, 20 bp, Artificial Sequence
  chemically synthesized
tcagataccacgctatgtgt

SEQ ID NO: 453003 - DNA, 20 bp, Artificial Sequence
  chemically synthesized
tgtatttccaacacatagcg

SEQ ID NO: 453004 - DNA, 20 bp, Artificial Sequence
  chemically synthesized
aataattatttagggagggt

SEQ ID NO: 453005 - DNA, 20 bp, Artificial Sequence
  chemically synthesized
attcaataattatttaggga

SEQ ID NO: 453006 - DNA, 20 bp, Artificial Sequence
  chemically synthesized
aattcaataattatttaggg

SEQ ID NO: 453007 - DNA, 20 bp, Artificial Sequence
  chemically synthesized
taattcaataattatttagg

SEQ ID NO: 453008 - DNA, 20 bp, Artificial Sequence
  chemically synthesized
aataattcaataattattta

SEQ ID NO: 453009 - DNA, 20 bp, Artificial Sequence
  chemically synthesized
caataattcaataattattt

SEQ ID NO: 453010 - DNA, 20 bp, Artificial Sequence
  chemically synthesized
tcaataattcaataattatt

SEQ ID NO: 453011 - DNA, 20 bp, Artificial Sequence
  chemically synthesized
gaattattgattgcacattt

SEQ ID NO: 453012 - DNA, 20 bp, Artificial Sequence
  chemically synthesized
cacattttagactactatat

SEQ ID NO: 453013 - DNA, 20 bp, Artificial Sequence
  chemically synthesized
ggtgggatatgctaatatag

SEQ ID NO: 453014 - DNA, 20 bp, Artificial Sequence
  chemically synthesized
agaggtgggatatgctaata

SEQ ID NO: 453015 - DNA, 20 bp, Artificial Sequence
  chemically synthesized
tattagcatatcccacctct

SEQ ID NO: 453016 - DNA, 20 bp, Artificial Sequence
  chemically synthesized
tcagggtaatgcttagaggt

SEQ ID NO: 453017 - DNA, 20 bp, Artificial Sequence
  chemically synthesized
ctcagggtaatgcttagagg

SEQ ID NO: 453018 - DNA, 20 bp, Artificial Sequence
  chemically synthesized
catctcagggtaatgcttag

SEQ ID NO: 453019 - DNA, 20 bp, Artificial Sequence
  chemically synthesized
acatctcagggtaatgctta

SEQ ID NO: 453020 - DNA, 20 bp, Artificial Sequence
  chemically synthesized
ttacatctcagggtaatgct

SEQ ID NO: 453021 - DNA, 20 bp, Artificial Sequence
  chemically synthesized
ccacctctaagcattaccct

SEQ ID NO: 453022 - DNA, 20 bp, Artificial Sequence
  chemically synthesized
tattgcacagttacatctca

SEQ ID NO: 453023 - DNA, 20 bp, Artificial Sequence
  chemically synthesized
gtattgcacagttacatctc

SEQ ID NO: 453024 - DNA, 20 bp, Artificial Sequence
  chemically synthesized
tgtattgcacagttacatct

SEQ ID NO: 453025 - DNA, 20 bp, Artificial Sequence
  chemically synthesized
tgagatgtaactgtgcaata

SEQ ID NO: 453026 - DNA, 20 bp, Artificial Sequence
  chemically synthesized
ccctttattgctgtattgca

SEQ ID NO: 453027 - DNA, 20 bp, Artificial Sequence
  chemically synthesized
aactgtgcaatacagcaata

SEQ ID NO: 453028 - DNA, 20 bp, Artificial Sequence
  chemically synthesized
actgtgcaatacagcaataa

SEQ ID NO: 453029 - DNA, 20 bp, Artificial Sequence
  chemically synthesized
ctgtgcaatacagcaataaa

SEQ ID NO: 453030 - DNA, 20 bp, Artificial Sequence
  chemically synthesized
aaagggtgtcactgtgtcct

SEQ ID NO: 453031 - DNA, 20 bp, Artificial Sequence
  chemically synthesized
ttaggcctggactgaggaca

SEQ ID NO: 453032 - DNA, 20 bp, Artificial Sequence
  chemically synthesized
gtgtcactgtgtcctcagtc

SEQ ID NO: 453033 - DNA, 20 bp, Artificial Sequence
  chemically synthesized
tgtcactgtgtcctcagtcc

SEQ ID NO: 453034 - DNA, 20 bp, Artificial Sequence
  chemically synthesized
tgtgtgttaggcctggactg

SEQ ID NO: 453035 - DNA, 20 bp, Artificial Sequence
  chemically synthesized
ctgtgtgttaggcctggact

SEQ ID NO: 453036 - DNA, 20 bp, Artificial Sequence
  chemically synthesized
gctcaactgtgtgttaggcc

SEQ ID NO: 453037 - DNA, 20 bp, Artificial Sequence
  chemically synthesized
ctcagtccaggcctaacaca

SEQ ID NO: 453038 - DNA, 20 bp, Artificial Sequence
  chemically synthesized
tcagagctcaactgtgtgtt

SEQ ID NO: 453039 - DNA, 20 bp, Artificial Sequence
  chemically synthesized
ttcagagctcaactgtgtgt

SEQ ID NO: 453040 - DNA, 20 bp, Artificial Sequence
  chemically synthesized
tccaggcctaacacacagtt

SEQ ID NO: 453041 - DNA, 20 bp, Artificial Sequence
  chemically synthesized
tgatgttacattgttgttca

SEQ ID NO: 453042 - DNA, 20 bp, Artificial Sequence
  chemically synthesized
tttgatgttacattgttgtt

SEQ ID NO: 453043 - DNA, 20 bp, Artificial Sequence
  chemically synthesized
aacaacaatgtaacatcaaa

SEQ ID NO: 453044 - DNA, 20 bp, Artificial Sequence
  chemically synthesized
gtccagaacatgttacaaca

SEQ ID NO: 453045 - DNA, 20 bp, Artificial Sequence
  chemically synthesized
agtccagaacatgttacaac

SEQ ID NO: 453046 - DNA, 20 bp, Artificial Sequence
  chemically synthesized
aagtccagaacatgttacaa

SEQ ID NO: 453047 - DNA, 20 bp, Artificial Sequence
  chemically synthesized
gaccctgttgtaacatgttc

SEQ ID NO: 453048 - DNA, 20 bp, Artificial Sequence
  chemically synthesized
aactttagcttagacaagtc

SEQ ID NO: 453049 - DNA, 20 bp, Artificial Sequence
  chemically synthesized
aacatgttctggacttgtct

SEQ ID NO: 453050 - DNA, 20 bp, Artificial Sequence
  chemically synthesized
atttgaactttagcttagac

SEQ ID NO: 453051 - DNA, 20 bp, Artificial Sequence
  chemically synthesized
ttctggacttgtctaagcta

SEQ ID NO: 453052 - DNA, 20 bp, Artificial Sequence
  chemically synthesized
atcatatttgaactttagct

SEQ ID NO: 453053 - DNA, 20 bp, Artificial Sequence
  chemically synthesized
gaagtatcatatttgaactt

SEQ ID NO: 453054 - DNA, 20 bp, Artificial Sequence
  chemically synthesized
aaatatgatacttccaaccc

SEQ ID NO: 453055 - DNA, 20 bp, Artificial Sequence
  chemically synthesized
gagattataaccagggttgg

SEQ ID NO: 453056 - DNA, 20 bp, Artificial Sequence
  chemically synthesized
tcagagattataaccagggt

SEQ ID NO: 453057 - DNA, 20 bp, Artificial Sequence
  chemically synthesized
tcattcagagattataacca

SEQ ID NO: 453058 - DNA, 20 bp, Artificial Sequence
  chemically synthesized
atcattcagagattataacc

SEQ ID NO: 453059 - DNA, 20 bp, Artificial Sequence
  chemically synthesized
catcattcagagattataac

SEQ ID NO: 453060 - DNA, 20 bp, Artificial Sequence
  chemically synthesized
tgtataaaatgcatcattca

SEQ ID NO: 453061 - DNA, 20 bp, Artificial Sequence
  chemically synthesized
tatgtataaaatgcatcatt

SEQ ID NO: 453062 - DNA, 20 bp, Artificial Sequence
  chemically synthesized
tgaatgatgcattttataca

SEQ ID NO: 453063 - DNA, 20 bp, Artificial Sequence
  chemically synthesized
ttcttttttaaaaaataaaa

SEQ ID NO: 453064 - DNA, 20 bp, Artificial Sequence
  chemically synthesized
gacttttttattttttaaaa

SEQ ID NO: 453065 - DNA, 20 bp, Artificial Sequence
  chemically synthesized
ttttttattttttaaaaaag

SEQ ID NO: 453066 - DNA, 20 bp, Artificial Sequence
  chemically synthesized
aaaagaagcatttaccatgc

SEQ ID NO: 453067 - DNA, 20 bp, Artificial Sequence
  chemically synthesized
atgttgtcctttttcttgca

SEQ ID NO: 453068 - DNA, 20 bp, Artificial Sequence
  chemically synthesized
agcatttaccatgcaagaaa

SEQ ID NO: 453069 - DNA, 20 bp, Artificial Sequence
  chemically synthesized
gcatttaccatgcaagaaaa

SEQ ID NO: 453070 - DNA, 20 bp, Artificial Sequence
  chemically synthesized
aaaaaggacaacattgcttc

SEQ ID NO: 453071 - DNA, 20 bp, Artificial Sequence
  chemically synthesized
ggacaacattgcttcaagaa

SEQ ID NO: 453072 - DNA, 20 bp, Artificial Sequence
  chemically synthesized
ctgactgattactattcttg

SEQ ID NO: 453073 - DNA, 20 bp, Artificial Sequence
  chemically synthesized
attgcttcaagaatagtaat

SEQ ID NO: 453074 - DNA, 20 bp, Artificial Sequence
  chemically synthesized
cttcaagaatagtaatcagt

SEQ ID NO: 453075 - DNA, 20 bp, Artificial Sequence
  chemically synthesized
caagaatagtaatcagtcag

SEQ ID NO: 453076 - DNA, 20 bp, Artificial Sequence
  chemically synthesized
gtaaatcctctcattaagat

SEQ ID NO: 453077 - DNA, 20 bp, Artificial Sequence
  chemically synthesized
tcagtggcacccatcttaat

SEQ ID NO: 453078 - DNA, 20 bp, Artificial Sequence
  chemically synthesized
tgtaaatcctctcattaaga

SEQ ID NO: 453079 - DNA, 20 bp, Artificial Sequence
  chemically synthesized
agtggcacccatcttaatga

SEQ ID NO: 453080 - DNA, 20 bp, Artificial Sequence
  chemically synthesized
gtggcacccatcttaatgag

SEQ ID NO: 453081 - DNA, 20 bp, Artificial Sequence
  chemically synthesized
gggatgtaaatcctctcatt

SEQ ID NO: 453082 - DNA, 20 bp, Artificial Sequence
  chemically synthesized
acatttaaaatgaaaacaat

SEQ ID NO: 453083 - DNA, 20 bp, Artificial Sequence
  chemically synthesized
gacatttaaaatgaaaacaa

SEQ ID NO: 453084 - DNA, 20 bp, Artificial Sequence
  chemically synthesized
tgtgcatacatataaacatt

SEQ ID NO: 453085 - DNA, 20 bp, Artificial Sequence
  chemically synthesized
catataaacatttagaaaaa

SEQ ID NO: 453086 - DNA, 20 bp, Artificial Sequence
  chemically synthesized
atataaacatttagaaaaac

SEQ ID NO: 453087 - DNA, 20 bp, Artificial Sequence
  chemically synthesized
catttagaaaaacaggtttc

SEQ ID NO: 453088 - DNA, 20 bp, Artificial Sequence
  chemically synthesized
ttagaaaaacaggtttccag

SEQ ID NO: 453089 - DNA, 20 bp, Artificial Sequence
  chemically synthesized
ctttacataacatgatctac

SEQ ID NO: 453090 - DNA, 20 bp, Artificial Sequence
  chemically synthesized
ccagtagatcatgttatgta

SEQ ID NO: 453091 - DNA, 20 bp, Artificial Sequence
  chemically synthesized
cagtagatcatgttatgtaa

SEQ ID NO: 453092 - DNA, 20 bp, Artificial Sequence
  chemically synthesized
catgttatgtaaaggtcata

SEQ ID NO: 453093 - DNA, 20 bp, Artificial Sequence
  chemically synthesized
gagatgcaggaatatttgca

SEQ ID NO: 453094 - DNA, 20 bp, Artificial Sequence
  chemically synthesized
agagatgcaggaatatttgc

SEQ ID NO: 453095 - DNA, 20 bp, Artificial Sequence
  chemically synthesized
attagattagttagagatgc

SEQ ID NO: 453096 - DNA, 20 bp, Artificial Sequence
  chemically synthesized
gattagattagttagagatg

SEQ ID NO: 453097 - DNA, 20 bp, Artificial Sequence
  chemically synthesized
gaaccggattagattagtta

SEQ ID NO: 453098 - DNA, 20 bp, Artificial Sequence
  chemically synthesized
aagaaccggattagattagt

SEQ ID NO: 453099 - DNA, 20 bp, Artificial Sequence
  chemically synthesized
agtcaagaaccggattagat

SEQ ID NO: 453100 - DNA, 20 bp, Artificial Sequence
  chemically synthesized
catctctaactaatctaatc

SEQ ID NO: 453101 - DNA, 20 bp, Artificial Sequence
  chemically synthesized
tttgaagtcaagaaccggat

SEQ ID NO: 453102 - DNA, 20 bp, Artificial Sequence
  chemically synthesized
tgatatttgaagtcaagaac

SEQ ID NO: 453103 - DNA, 20 bp, Artificial Sequence
  chemically synthesized
atcatttgatatttgaagtc

SEQ ID NO: 453104 - DNA, 20 bp, Artificial Sequence
  chemically synthesized
gggatatcatttgatatttg

SEQ ID NO: 453105 - DNA, 20 bp, Artificial Sequence
  chemically synthesized
aaaattctgggtggcagtaa

SEQ ID NO: 453106 - DNA, 20 bp, Artificial Sequence
  chemically synthesized
caaaattctgggtggcagta

SEQ ID NO: 453107 - DNA, 20 bp, Artificial Sequence
  chemically synthesized
tcaaaattctgggtggcagt

SEQ ID NO: 453108 - DNA, 20 bp, Artificial Sequence
  chemically synthesized
tgatatcccttactgccacc

SEQ ID NO: 453109 - DNA, 20 bp, Artificial Sequence
  chemically synthesized
acattcaaaattctgggtgg

SEQ ID NO: 453110 - DNA, 20 bp, Artificial Sequence
  chemically synthesized
cagacattcaaaattctggg

SEQ ID NO: 453111 - DNA, 20 bp, Artificial Sequence
  chemically synthesized
taccagacattcaaaattct

SEQ ID NO: 453112 - DNA, 20 bp, Artificial Sequence
  chemically synthesized
ataccagacattcaaaattc

SEQ ID NO: 453113 - DNA, 20 bp, Artificial Sequence
  chemically synthesized
cacccagaattttgaatgtc

SEQ ID NO: 453114 - DNA, 20 bp, Artificial Sequence
  chemically synthesized
aattttgaatgtctggtatt

SEQ ID NO: 453115 - DNA, 20 bp, Artificial Sequence
  chemically synthesized
ttttagaaaccactcaatac

SEQ ID NO: 453116 - DNA, 20 bp, Artificial Sequence
  chemically synthesized
tttgaatgtctggtattgag

SEQ ID NO: 453117 - DNA, 20 bp, Artificial Sequence
  chemically synthesized
tggtattgagtggtttctaa

SEQ ID NO: 453118 - DNA, 20 bp, Artificial Sequence
  chemically synthesized
aatataaaaagtcaaacttt

SEQ ID NO: 453119 - DNA, 20 bp, Artificial Sequence
  chemically synthesized
gtgggcccttcaaatataaa

SEQ ID NO: 453120 - DNA, 20 bp, Artificial Sequence
  chemically synthesized
agtttgactttttatatttg

SEQ ID NO: 453121 - DNA, 20 bp, Artificial Sequence
  chemically synthesized
gtttgactttttatatttga

SEQ ID NO: 453122 - DNA, 20 bp, Artificial Sequence
  chemically synthesized
tttgactttttatatttgaa

SEQ ID NO: 453123 - DNA, 20 bp, Artificial Sequence
  chemically synthesized
atatttgaagggcccacatg

SEQ ID NO: 453124 - DNA, 20 bp, Artificial Sequence
  chemically synthesized
aattgcgtatggcttcatgt

SEQ ID NO: 453125 - DNA, 20 bp, Artificial Sequence
  chemically synthesized
taattgcgtatggcttcatg

SEQ ID NO: 453126 - DNA, 20 bp, Artificial Sequence
  chemically synthesized
cagcatatgctaattgcgta

SEQ ID NO: 453127 - DNA, 20 bp, Artificial Sequence
  chemically synthesized
cacatgaagccatacgcaat

SEQ ID NO: 453128 - DNA, 20 bp, Artificial Sequence
  chemically synthesized
aattagcatatgctgtattg

SEQ ID NO: 453129 - DNA, 20 bp, Artificial Sequence
  chemically synthesized
taacagaacttgccacaata

SEQ ID NO: 453130 - DNA, 20 bp, Artificial Sequence
  chemically synthesized
agcatatgctgtattgtggc

SEQ ID NO: 453131 - DNA, 20 bp, Artificial Sequence
  chemically synthesized
gtggcaagttctgttaacat

SEQ ID NO: 453132 - DNA, 20 bp, Artificial Sequence
  chemically synthesized
aatcaaagagctgatgttaa

SEQ ID NO: 453133 - DNA, 20 bp, Artificial Sequence
  chemically synthesized
ttaacatcagctctttgatt

SEQ ID NO: 453134 - DNA, 20 bp, Artificial Sequence
  chemically synthesized
agtgttcttcctcaatcaaa

SEQ ID NO: 453135 - DNA, 20 bp, Artificial Sequence
  chemically synthesized
taacatcagctctttgattg

SEQ ID NO: 453136 - DNA, 20 bp, Artificial Sequence
  chemically synthesized
ttagtgttcttcctcaatca

SEQ ID NO: 453137 - DNA, 20 bp, Artificial Sequence
  chemically synthesized
catcagctctttgattgagg

SEQ ID NO: 453138 - DNA, 20 bp, Artificial Sequence
  chemically synthesized
tgttttgatgattcaacagt

SEQ ID NO: 453139 - DNA, 20 bp, Artificial Sequence
  chemically synthesized
gtagtgttttgatgattcaa

SEQ ID NO: 453140 - DNA, 20 bp, Artificial Sequence
  chemically synthesized
gttgaatcatcaaaacacta

SEQ ID NO: 453141 - DNA, 20 bp, Artificial Sequence
  chemically synthesized
gaatcatcaaaacactacag

SEQ ID NO: 453142 - DNA, 20 bp, Artificial Sequence
  chemically synthesized
gaggttgtaaaatactgctg

SEQ ID NO: 453143 - DNA, 20 bp, Artificial Sequence
  chemically synthesized
acagcagtattttacaacct

SEQ ID NO: 453144 - DNA, 20 bp, Artificial Sequence
  chemically synthesized
cttcacattatgcataactg

SEQ ID NO: 453145 - DNA, 20 bp, Artificial Sequence
  chemically synthesized
acttcacattatgcataact

SEQ ID NO: 453146 - DNA, 20 bp, Artificial Sequence
  chemically synthesized
cctcagttatgcataatgtg

SEQ ID NO: 453147 - DNA, 20 bp, Artificial Sequence
  chemically synthesized
ataatgtgaagtaatatgca

SEQ ID NO: 453148 - DNA, 20 bp, Artificial Sequence
  chemically synthesized
ctctcatatttacagagggc

SEQ ID NO: 453149 - DNA, 20 bp, Artificial Sequence
  chemically synthesized
cctctcatatttacagaggg

SEQ ID NO: 453150 - DNA, 20 bp, Artificial Sequence
  chemically synthesized
ttgcctctcatatttacaga

SEQ ID NO: 453151 - DNA, 20 bp, Artificial Sequence
  chemically synthesized
attgcctctcatatttacag

SEQ ID NO: 453152 - DNA, 20 bp, Artificial Sequence
  chemically synthesized
aattgcctctcatatttaca

SEQ ID NO: 453153 - DNA, 20 bp, Artificial Sequence
  chemically synthesized
ggcctgccctctgtaaatat

SEQ ID NO: 453154 - DNA, 20 bp, Artificial Sequence
  chemically synthesized
caaattgcctctcatattta

SEQ ID NO: 453155 - DNA, 20 bp, Artificial Sequence
  chemically synthesized
cctgccctctgtaaatatga

SEQ ID NO: 453156 - DNA, 20 bp, Artificial Sequence
  chemically synthesized
ctgccctctgtaaatatgag

SEQ ID NO: 453157 - DNA, 20 bp, Artificial Sequence
  chemically synthesized
aatatgagaggcaatttgtt

SEQ ID NO: 453158 - DNA, 20 bp, Artificial Sequence
  chemically synthesized
tgaaagcaaaataaaatgtg

SEQ ID NO: 453159 - DNA, 20 bp, Artificial Sequence
  chemically synthesized
cctgaaagcaaaataaaatg

SEQ ID NO: 453160 - DNA, 20 bp, Artificial Sequence
  chemically synthesized
tccacattttattttgcttt

SEQ ID NO: 453161 - DNA, 20 bp, Artificial Sequence
  chemically synthesized
ccacattttattttgctttc

SEQ ID NO: 453162 - DNA, 20 bp, Artificial Sequence
  chemically synthesized
agtaagtagtataatcctga

SEQ ID NO: 453163 - DNA, 20 bp, Artificial Sequence
  chemically synthesized
cttttgttgaagttagtaag

SEQ ID NO: 453164 - DNA, 20 bp, Artificial Sequence
  chemically synthesized
ttgcttttgttgaagttagt

SEQ ID NO: 453165 - DNA, 20 bp, Artificial Sequence
  chemically synthesized
tatattgcttttgttgaagt

SEQ ID NO: 453166 - DNA, 20 bp, Artificial Sequence
  chemically synthesized
ctacttactaacttcaacaa

SEQ ID NO: 453167 - DNA, 20 bp, Artificial Sequence
  chemically synthesized
ttattatattgcttttgttg

SEQ ID NO: 453168 - DNA, 20 bp, Artificial Sequence
  chemically synthesized
ttcaacaaaagcaatataat

SEQ ID NO: 453169 - DNA, 20 bp, Artificial Sequence
  chemically synthesized
gacagagctgtggtattgtg

SEQ ID NO: 453170 - DNA, 20 bp, Artificial Sequence
  chemically synthesized
ggacagagctgtggtattgt

SEQ ID NO: 453171 - DNA, 20 bp, Artificial Sequence
  chemically synthesized
aatattgcctcacaatacca

SEQ ID NO: 453172 - DNA, 20 bp, Artificial Sequence
  chemically synthesized
gctattgatggacagagctg

SEQ ID NO: 453173 - DNA, 20 bp, Artificial Sequence
  chemically synthesized
atttttgctattgatggaca

SEQ ID NO: 453174 - DNA, 20 bp, Artificial Sequence
  chemically synthesized
gaatttttgctattgatgga

SEQ ID NO: 453175 - DNA, 20 bp, Artificial Sequence
  chemically synthesized
accacagctctgtccatcaa

SEQ ID NO: 453176 - DNA, 20 bp, Artificial Sequence
  chemically synthesized
ttgagaatttttgctattga

SEQ ID NO: 453177 - DNA, 20 bp, Artificial Sequence
  chemically synthesized
atagcaaaaattctcaatct

SEQ ID NO: 453178 - DNA, 20 bp, Artificial Sequence
  chemically synthesized
ctggcactggtgctaagatt

SEQ ID NO: 453179 - DNA, 20 bp, Artificial Sequence
  chemically synthesized
aaaattctcaatcttagcac

SEQ ID NO: 453180 - DNA, 20 bp, Artificial Sequence
  chemically synthesized
catctcctggcactggtgct

SEQ ID NO: 453181 - DNA, 20 bp, Artificial Sequence
  chemically synthesized
ctcaatcttagcaccagtgc

SEQ ID NO: 453182 - DNA, 20 bp, Artificial Sequence
  chemically synthesized
tcaatcttagcaccagtgcc

SEQ ID NO: 453183 - DNA, 20 bp, Artificial Sequence
  chemically synthesized
aatcttagcaccagtgccag

SEQ ID NO: 453184 - DNA, 20 bp, Artificial Sequence
  chemically synthesized
tgagattcatctcctggcac

SEQ ID NO: 453185 - DNA, 20 bp, Artificial Sequence
  chemically synthesized
tcataatgagattcatctcc

SEQ ID NO: 453186 - DNA, 20 bp, Artificial Sequence
  chemically synthesized
aatcactgaattatcataat

SEQ ID NO: 453187 - DNA, 20 bp, Artificial Sequence
  chemically synthesized
tgaatctcattatgataatt

SEQ ID NO: 453188 - DNA, 20 bp, Artificial Sequence
  chemically synthesized
gataattcagtgattgtata

SEQ ID NO: 453189 - DNA, 20 bp, Artificial Sequence
  chemically synthesized
gtatacggattcacatttcc

SEQ ID NO: 453190 - DNA, 20 bp, Artificial Sequence
  chemically synthesized
tgtattctcttatgtatgct

SEQ ID NO: 453191 - DNA, 20 bp, Artificial Sequence
  chemically synthesized
ttgtattctcttatgtatgc

SEQ ID NO: 453192 - DNA, 20 bp, Artificial Sequence
  chemically synthesized
tcacatttcccagcatacat

SEQ ID NO: 453193 - DNA, 20 bp, Artificial Sequence
  chemically synthesized
acatttcccagcatacataa

SEQ ID NO: 453194 - DNA, 20 bp, Artificial Sequence
  chemically synthesized
agagaatacaaaacaaacac

SEQ ID NO: 453195 - DNA, 20 bp, Artificial Sequence
  chemically synthesized
gaatacaaaacaaacacaag

SEQ ID NO: 453196 - DNA, 20 bp, Artificial Sequence
  chemically synthesized
aatacaaaacaaacacaagt

SEQ ID NO: 453197 - DNA, 20 bp, Artificial Sequence
  chemically synthesized
aaaacaaacacaagtaggat

SEQ ID NO: 453198 - DNA, 20 bp, Artificial Sequence
  chemically synthesized
acacaagtaggataagcaat

SEQ ID NO: 453199 - DNA, 20 bp, Artificial Sequence
  chemically synthesized
gataagcaatcagataactg

SEQ ID NO: 453200 - DNA, 20 bp, Artificial Sequence
  chemically synthesized
atctttgacaaaaaaaactt

SEQ ID NO: 453201 - DNA, 20 bp, Artificial Sequence
  chemically synthesized
aactgaagttttttttgtca

SEQ ID NO: 453202 - DNA, 20 bp, Artificial Sequence
  chemically synthesized
tttttttgtcaaagatatta

SEQ ID NO: 453203 - DNA, 20 bp, Artificial Sequence
  chemically synthesized
tttttgtcaaagatattaaa

SEQ ID NO: 453204 - DNA, 20 bp, Artificial Sequence
  chemically synthesized
aagatattaaagagtatgtt

SEQ ID NO: 453205 - DNA, 20 bp, Artificial Sequence
  chemically synthesized
cagtaatagggagatgacat

SEQ ID NO: 453206 - DNA, 20 bp, Artificial Sequence
  chemically synthesized
ccattttttccagtaatagg

SEQ ID NO: 453207 - DNA, 20 bp, Artificial Sequence
  chemically synthesized
taatgtcatctccctattac

SEQ ID NO: 453208 - DNA, 20 bp, Artificial Sequence
  chemically synthesized
ttccattttttccagtaata

SEQ ID NO: 453209 - DNA, 20 bp, Artificial Sequence
  chemically synthesized
cttccattttttccagtaat

SEQ ID NO: 453210 - DNA, 20 bp, Artificial Sequence
  chemically synthesized
gcttccattttttccagtaa

SEQ ID NO: 453211 - DNA, 20 bp, Artificial Sequence
  chemically synthesized
ctccctattactggaaaaaa

SEQ ID NO: 453212 - DNA, 20 bp, Artificial Sequence
  chemically synthesized
tcctgagcttccattttttc

SEQ ID NO: 453213 - DNA, 20 bp, Artificial Sequence
  chemically synthesized
cctattactggaaaaaatgg

SEQ ID NO: 453214 - DNA, 20 bp, Artificial Sequence
  chemically synthesized
tactggaaaaaatggaagct

SEQ ID NO: 453215 - DNA, 20 bp, Artificial Sequence
  chemically synthesized
actggaaaaaatggaagctc

SEQ ID NO: 453216 - DNA, 20 bp, Artificial Sequence
  chemically synthesized
gagctaattatataaatcct

SEQ ID NO: 453217 - DNA, 20 bp, Artificial Sequence
  chemically synthesized
aagctcaggatttatataat

SEQ ID NO: 453218 - DNA, 20 bp, Artificial Sequence
  chemically synthesized
aggatttatataattagctc

SEQ ID NO: 453219 - DNA, 20 bp, Artificial Sequence
  chemically synthesized
ggatttatataattagctct

SEQ ID NO: 453220 - DNA, 20 bp, Artificial Sequence
  chemically synthesized
caaactacctgtgtgaccta

SEQ ID NO: 453221 - DNA, 20 bp, Artificial Sequence
  chemically synthesized
ataattagctctaggtcaca

SEQ ID NO: 453222 - DNA, 20 bp, Artificial Sequence
  chemically synthesized
atcaaactacctgtgtgacc

SEQ ID NO: 453223 - DNA, 20 bp, Artificial Sequence
  chemically synthesized
taattagctctaggtcacac

SEQ ID NO: 453224 - DNA, 20 bp, Artificial Sequence
  chemically synthesized
ttagctctaggtcacacagg

SEQ ID NO: 453225 - DNA, 20 bp, Artificial Sequence
  chemically synthesized
aggtcacacaggtagtttga

SEQ ID NO: 453226 - DNA, 20 bp, Artificial Sequence
  chemically synthesized
ggtagtttgatggtaaatcc

SEQ ID NO: 453227 - DNA, 20 bp, Artificial Sequence
  chemically synthesized
tagtttgatggtaaatccta

SEQ ID NO: 453228 - DNA, 20 bp, Artificial Sequence
  chemically synthesized
tatgaacagtagaattctct

SEQ ID NO: 453229 - DNA, 20 bp, Artificial Sequence
  chemically synthesized
atatgaacagtagaattctc

SEQ ID NO: 453230 - DNA, 20 bp, Artificial Sequence
  chemically synthesized
tgtttaagaaatatgaacag

SEQ ID NO: 453231 - DNA, 20 bp, Artificial Sequence
  chemically synthesized
atgtgtttaagaaatatgaa

SEQ ID NO: 453232 - DNA, 20 bp, Artificial Sequence
  chemically synthesized
aatgaagaaaatatgtgttt

SEQ ID NO: 453233 - DNA, 20 bp, Artificial Sequence
  chemically synthesized
gtaatacataaagtataatg

SEQ ID NO: 453234 - DNA, 20 bp, Artificial Sequence
  chemically synthesized
taatatcactgtaatacata

SEQ ID NO: 453235 - DNA, 20 bp, Artificial Sequence
  chemically synthesized
tcattatactttatgtatta

SEQ ID NO: 453236 - DNA, 20 bp, Artificial Sequence
  chemically synthesized
tttatgtattacagtgatat

SEQ ID NO: 453237 - DNA, 20 bp, Artificial Sequence
  chemically synthesized
cagtgatattagccactacc

SEQ ID NO: 453238 - DNA, 20 bp, Artificial Sequence
  chemically synthesized
aattagtgctgacttggtag

SEQ ID NO: 453239 - DNA, 20 bp, Artificial Sequence
  chemically synthesized
gatattagccactaccaagt

SEQ ID NO: 453240 - DNA, 20 bp, Artificial Sequence
  chemically synthesized
tataattagtgctgacttgg

SEQ ID NO: 453241 - DNA, 20 bp, Artificial Sequence
  chemically synthesized
agttataattagtgctgact

SEQ ID NO: 453242 - DNA, 20 bp, Artificial Sequence
  chemically synthesized
taaatctatcaagttataat

SEQ ID NO: 453243 - DNA, 20 bp, Artificial Sequence
  chemically synthesized
cagcactaattataacttga

SEQ ID NO: 453244 - DNA, 20 bp, Artificial Sequence
  chemically synthesized
cttagacctttaaatctatc

SEQ ID NO: 453245 - DNA, 20 bp, Artificial Sequence
  chemically synthesized
attataacttgatagattta

SEQ ID NO: 453246 - DNA, 20 bp, Artificial Sequence
  chemically synthesized
ttataacttgatagatttaa

SEQ ID NO: 453247 - DNA, 20 bp, Artificial Sequence
  chemically synthesized
cttgatagatttaaaggtct

SEQ ID NO: 453248 - DNA, 20 bp, Artificial Sequence
  chemically synthesized
ttttctaaatattttcagct

SEQ ID NO: 453249 - DNA, 20 bp, Artificial Sequence
  chemically synthesized
atgaattttctaaatatttt

SEQ ID NO: 453250 - DNA, 20 bp, Artificial Sequence
  chemically synthesized
aggtctaagctgaaaatatt

SEQ ID NO: 453251 - DNA, 20 bp, Artificial Sequence
  chemically synthesized
atatttagaaaattcatgtt

SEQ ID NO: 453252 - DNA, 20 bp, Artificial Sequence
  chemically synthesized
aaattcatgttgagaatatt

SEQ ID NO: 453253 - DNA, 20 bp, Artificial Sequence
  chemically synthesized
tgttgagaatattgagaaat

SEQ ID NO: 453254 - DNA, 20 bp, Artificial Sequence
  chemically synthesized
gttgagaatattgagaaata

SEQ ID NO: 453255 - DNA, 20 bp, Artificial Sequence
  chemically synthesized
gagaatattgagaaataagg

SEQ ID NO: 453256 - DNA, 20 bp, Artificial Sequence
  chemically synthesized
agaatattgagaaataaggt

SEQ ID NO: 453257 - DNA, 20 bp, Artificial Sequence
  chemically synthesized
tgagaaataaggtgggatcc

SEQ ID NO: 453258 - DNA, 20 bp, Artificial Sequence
  chemically synthesized
gagaaataaggtgggatcca

SEQ ID NO: 453259 - DNA, 20 bp, Artificial Sequence
  chemically synthesized
aaataaggtgggatccaagg

SEQ ID NO: 453260 - DNA, 20 bp, Artificial Sequence
  chemically synthesized
tctgacctttcatgccacct

SEQ ID NO: 453261 - DNA, 20 bp, Artificial Sequence
  chemically synthesized
tgggatccaaggtggcatga

SEQ ID NO: 453262 - DNA, 20 bp, Artificial Sequence
  chemically synthesized
gggatccaaggtggcatgaa

SEQ ID NO: 453263 - DNA, 20 bp, Artificial Sequence
  chemically synthesized
tccaaggtggcatgaaaggt

SEQ ID NO: 453264 - DNA, 20 bp, Artificial Sequence
  chemically synthesized
caaggtggcatgaaaggtca

SEQ ID NO: 453265 - DNA, 20 bp, Artificial Sequence
  chemically synthesized
ggcatgaaaggtcagagtct

SEQ ID NO: 453266 - DNA, 20 bp, Artificial Sequence
  chemically synthesized
catgcattctagttcagact

SEQ ID NO: 453267 - DNA, 20 bp, Artificial Sequence
  chemically synthesized
gtcagagtcttagtctgaac

SEQ ID NO: 453268 - DNA, 20 bp, Artificial Sequence
  chemically synthesized
tacatgcatgcattctagtt

SEQ ID NO: 453269 - DNA, 20 bp, Artificial Sequence
  chemically synthesized
tgccttacatgcatgcattc

SEQ ID NO: 453270 - DNA, 20 bp, Artificial Sequence
  chemically synthesized
gaactagaatgcatgcatgt

SEQ ID NO: 453271 - DNA, 20 bp, Artificial Sequence
  chemically synthesized
aactagaatgcatgcatgta

SEQ ID NO: 453272 - DNA, 20 bp, Artificial Sequence
  chemically synthesized
catgcatgtaaggcacatgc

SEQ ID NO: 453273 - DNA, 20 bp, Artificial Sequence
  chemically synthesized
ttcctttgctcacaaatttc

SEQ ID NO: 453274 - DNA, 20 bp, Artificial Sequence
  chemically synthesized
ggcacatgctagaaatttgt

SEQ ID NO: 453275 - DNA, 20 bp, Artificial Sequence
  chemically synthesized
atgctagaaatttgtgagca

SEQ ID NO: 453276 - DNA, 20 bp, Artificial Sequence
  chemically synthesized
tgctagaaatttgtgagcaa

SEQ ID NO: 453277 - DNA, 20 bp, Artificial Sequence
  chemically synthesized
tagaaatttgtgagcaaagg

SEQ ID NO: 453278 - DNA, 20 bp, Artificial Sequence
  chemically synthesized
aaatttgtgagcaaaggaag

SEQ ID NO: 453279 - DNA, 20 bp, Artificial Sequence
  chemically synthesized
ttgtgagcaaaggaagaagt

SEQ ID NO: 453280 - DNA, 20 bp, Artificial Sequence
  chemically synthesized
gtgagaaaaaaatgaatatt

SEQ ID NO: 453281 - DNA, 20 bp, Artificial Sequence
  chemically synthesized
gaaaaaaatgaatatttagt

SEQ ID NO: 453282 - DNA, 20 bp, Artificial Sequence
  chemically synthesized
aaaaaaatgaatatttagta

SEQ ID NO: 453283 - DNA, 20 bp, Artificial Sequence
  chemically synthesized
tagtaaggttaatttgtaat

SEQ ID NO: 453284 - DNA, 20 bp, Artificial Sequence
  chemically synthesized
gttaatttgtaattagtcta

SEQ ID NO: 453285 - DNA, 20 bp, Artificial Sequence
  chemically synthesized
ttaatttgtaattagtctat

SEQ ID NO: 453286 - DNA, 20 bp, Artificial Sequence
  chemically synthesized
ttgtaattagtctataggat

SEQ ID NO: 453287 - DNA, 20 bp, Artificial Sequence
  chemically synthesized
tgtaattagtctataggata

SEQ ID NO: 453288 - DNA, 20 bp, Artificial Sequence
  chemically synthesized
ctacactccaccttatccta

SEQ ID NO: 453289 - DNA, 20 bp, Artificial Sequence
  chemically synthesized
aattagtctataggataagg

SEQ ID NO: 453290 - DNA, 20 bp, Artificial Sequence
  chemically synthesized
ttagtctataggataaggtg

SEQ ID NO: 453291 - DNA, 20 bp, Artificial Sequence
  chemically synthesized
ctataggataaggtggagtg

SEQ ID NO: 453292 - DNA, 20 bp, Artificial Sequence
  chemically synthesized
gagtgtagaaaccattctgc

SEQ ID NO: 453293 - DNA, 20 bp, Artificial Sequence
  chemically synthesized
agtgtagaaaccattctgcc

SEQ ID NO: 453294 - DNA, 20 bp, Artificial Sequence
  chemically synthesized
ttttcatctccctggcagaa

SEQ ID NO: 453295 - DNA, 20 bp, Artificial Sequence
  chemically synthesized
gtgtagaaaccattctgcca

SEQ ID NO: 453296 - DNA, 20 bp, Artificial Sequence
  chemically synthesized
gtagaaaccattctgccagg

SEQ ID NO: 453297 - DNA, 20 bp, Artificial Sequence
  chemically synthesized
cctaattttcatctccctgg

SEQ ID NO: 453298 - DNA, 20 bp, Artificial Sequence
  chemically synthesized
ttccctaattttcatctccc

SEQ ID NO: 453299 - DNA, 20 bp, Artificial Sequence
  chemically synthesized
tctgccagggagatgaaaat

SEQ ID NO: 453300 - DNA, 20 bp, Artificial Sequence
  chemically synthesized
ctgccagggagatgaaaatt

SEQ ID NO: 453301 - DNA, 20 bp, Artificial Sequence
  chemically synthesized
tgccagggagatgaaaatta

SEQ ID NO: 453302 - DNA, 20 bp, Artificial Sequence
  chemically synthesized
aattgcatgtacaaattcat

SEQ ID NO: 453303 - DNA, 20 bp, Artificial Sequence
  chemically synthesized
acaaattcattagctaaaat

SEQ ID NO: 453304 - DNA, 20 bp, Artificial Sequence
  chemically synthesized
caaattcattagctaaaata

SEQ ID NO: 453305 - DNA, 20 bp, Artificial Sequence
  chemically synthesized
caaacaacagaaccttattt

SEQ ID NO: 453306 - DNA, 20 bp, Artificial Sequence
  chemically synthesized
aaaataaggttctgttgttt

SEQ ID NO: 453307 - DNA, 20 bp, Artificial Sequence
  chemically synthesized
cttttgagagactcaaacaa

SEQ ID NO: 453308 - DNA, 20 bp, Artificial Sequence
  chemically synthesized
ctgttgtttgagtctctcaa

SEQ ID NO: 453309 - DNA, 20 bp, Artificial Sequence
  chemically synthesized
tgagaagtgatttcttttga

SEQ ID NO: 453310 - DNA, 20 bp, Artificial Sequence
  chemically synthesized
attgagaagtgatttctttt

SEQ ID NO: 453311 - DNA, 20 bp, Artificial Sequence
  chemically synthesized
caaaagaaatcacttctcaa

SEQ ID NO: 453312 - DNA, 20 bp, Artificial Sequence
  chemically synthesized
gtatttacataactattgag

SEQ ID NO: 453313 - DNA, 20 bp, Artificial Sequence
  chemically synthesized
tcagtatttacataactatt

SEQ ID NO: 453314 - DNA, 20 bp, Artificial Sequence
  chemically synthesized
ttattttcaaagttgtattt

SEQ ID NO: 453315 - DNA, 20 bp, Artificial Sequence
  chemically synthesized
agtactaaaaattattttca

SEQ ID NO: 453316 - DNA, 20 bp, Artificial Sequence
  chemically synthesized
acaactttgaaaataatttt

SEQ ID NO: 453317 - DNA, 20 bp, Artificial Sequence
  chemically synthesized
ttgaaaataatttttagtac

SEQ ID NO: 453318 - DNA, 20 bp, Artificial Sequence
  chemically synthesized
aagccccaaattttgatggc

SEQ ID NO: 453319 - DNA, 20 bp, Artificial Sequence
  chemically synthesized
tcataagccccaaattttga

SEQ ID NO: 453320 - DNA, 20 bp, Artificial Sequence
  chemically synthesized
tagtactagccatcaaaatt

SEQ ID NO: 453321 - DNA, 20 bp, Artificial Sequence
  chemically synthesized
agtactagccatcaaaattt

SEQ ID NO: 453322 - DNA, 20 bp, Artificial Sequence
  chemically synthesized
gtactagccatcaaaatttg

SEQ ID NO: 453323 - DNA, 20 bp, Artificial Sequence
  chemically synthesized
acacacagtttgtacatcat

SEQ ID NO: 453324 - DNA, 20 bp, Artificial Sequence
  chemically synthesized
tcagtagtgtttgaaacaca

SEQ ID NO: 453325 - DNA, 20 bp, Artificial Sequence
  chemically synthesized
tgtgtttcaaacactactga

SEQ ID NO: 453326 - DNA, 20 bp, Artificial Sequence
  chemically synthesized
gtgtttcaaacactactgat

SEQ ID NO: 453327 - DNA, 20 bp, Artificial Sequence
  chemically synthesized
tcgatggcagatcccatcag

SEQ ID NO: 453328 - DNA, 20 bp, Artificial Sequence
  chemically synthesized
tcctcgatggcagatcccat

SEQ ID NO: 453329 - DNA, 20 bp, Artificial Sequence
  chemically synthesized
tactgatgggatctgccatc

SEQ ID NO: 453330 - DNA, 20 bp, Artificial Sequence
  chemically synthesized
actgatgggatctgccatcg

SEQ ID NO: 453331 - DNA, 20 bp, Artificial Sequence
  chemically synthesized
agtcatgggctcctcgatgg

SEQ ID NO: 453332 - DNA, 20 bp, Artificial Sequence
  chemically synthesized
tgatgggatctgccatcgag

SEQ ID NO: 453333 - DNA, 20 bp, Artificial Sequence
  chemically synthesized
ctcagtcatgggctcctcga

SEQ ID NO: 453334 - DNA, 20 bp, Artificial Sequence
  chemically synthesized
ccatcgaggagcccatgact

SEQ ID NO: 453335 - DNA, 20 bp, Artificial Sequence
  chemically synthesized
ataccaggaatctcagtcat

SEQ ID NO: 453336 - DNA, 20 bp, Artificial Sequence
  chemically synthesized
cataccaggaatctcagtca

SEQ ID NO: 453337 - DNA, 20 bp, Artificial Sequence
  chemically synthesized
gagcccatgactgagattcc

SEQ ID NO: 453338 - DNA, 20 bp, Artificial Sequence
  chemically synthesized
atagcacataccaggaatct

SEQ ID NO: 453339 - DNA, 20 bp, Artificial Sequence
  chemically synthesized
atacagatatagcacatacc

SEQ ID NO: 453340 - DNA, 20 bp, Artificial Sequence
  chemically synthesized
tatacagatatagcacatac

SEQ ID NO: 453341 - DNA, 20 bp, Artificial Sequence
  chemically synthesized
aggaggcagatatacagata

SEQ ID NO: 453342 - DNA, 20 bp, Artificial Sequence
  chemically synthesized
tcctggaggaggcagatata

SEQ ID NO: 453343 - DNA, 20 bp, Artificial Sequence
  chemically synthesized
atctgtatatctgcctcctc

SEQ ID NO: 453344 - DNA, 20 bp, Artificial Sequence
  chemically synthesized
tcaaatcttcctggaggagg

SEQ ID NO: 453345 - DNA, 20 bp, Artificial Sequence
  chemically synthesized
tctgtatatctgcctcctcc

SEQ ID NO: 453346 - DNA, 20 bp, Artificial Sequence
  chemically synthesized
ccctcaaatcttcctggagg

SEQ ID NO: 453347 - DNA, 20 bp, Artificial Sequence
  chemically synthesized
gtatatctgcctcctccagg

SEQ ID NO: 453348 - DNA, 20 bp, Artificial Sequence
  chemically synthesized
gccctcaaatcttcctggag

SEQ ID NO: 453349 - DNA, 20 bp, Artificial Sequence
  chemically synthesized
aggccctcaaatcttcctgg

SEQ ID NO: 453350 - DNA, 20 bp, Artificial Sequence
  chemically synthesized
gaggccctcaaatcttcctg

SEQ ID NO: 453351 - DNA, 20 bp, Artificial Sequence
  chemically synthesized
ctgaggccctcaaatcttcc

SEQ ID NO: 453352 - DNA, 20 bp, Artificial Sequence
  chemically synthesized
tgcctcctccaggaagattt

SEQ ID NO: 453353 - DNA, 20 bp, Artificial Sequence
  chemically synthesized
gcctcctccaggaagatttg

SEQ ID NO: 453354 - DNA, 20 bp, Artificial Sequence
  chemically synthesized
cctcctccaggaagatttga

SEQ ID NO: 453355 - DNA, 20 bp, Artificial Sequence
  chemically synthesized
ccaggaagatttgagggcct

SEQ ID NO: 453356 - DNA, 20 bp, Artificial Sequence
  chemically synthesized
acgtttggaaaaagtttctg

SEQ ID NO: 453357 - DNA, 20 bp, Artificial Sequence
  chemically synthesized
aacgtttggaaaaagtttct

SEQ ID NO: 453358 - DNA, 20 bp, Artificial Sequence
  chemically synthesized
ttgttataaacgtttggaaa

SEQ ID NO: 453359 - DNA, 20 bp, Artificial Sequence
  chemically synthesized
ggatccttgttataaacgtt

SEQ ID NO: 453360 - DNA, 20 bp, Artificial Sequence
  chemically synthesized
tttttccaaacgtttataac

SEQ ID NO: 453361 - DNA, 20 bp, Artificial Sequence
  chemically synthesized
ttttccaaacgtttataaca

SEQ ID NO: 453362 - DNA, 20 bp, Artificial Sequence
  chemically synthesized
acgtttataacaaggatcct

SEQ ID NO: 453363 - DNA, 20 bp, Artificial Sequence
  chemically synthesized
gctatgaaggcaatagtctt

SEQ ID NO: 453364 - DNA, 20 bp, Artificial Sequence
  chemically synthesized
cgctatgaaggcaatagtct

SEQ ID NO: 453365 - DNA, 20 bp, Artificial Sequence
  chemically synthesized
cttcctcgctatgaaggcaa

SEQ ID NO: 453366 - DNA, 20 bp, Artificial Sequence
  chemically synthesized
tcctaagactattgccttca

SEQ ID NO: 453367 - DNA, 20 bp, Artificial Sequence
  chemically synthesized
aagactattgccttcatagc

SEQ ID NO: 453368 - DNA, 20 bp, Artificial Sequence
  chemically synthesized
tgctggcttcctcgctatga

SEQ ID NO: 453369 - DNA, 20 bp, Artificial Sequence
  chemically synthesized
agactattgccttcatagcg

SEQ ID NO: 453370 - DNA, 20 bp, Artificial Sequence
  chemically synthesized
ttgctggcttcctcgctatg

SEQ ID NO: 453371 - DNA, 20 bp, Artificial Sequence
  chemically synthesized
ctattgccttcatagcgagg

SEQ ID NO: 453372 - DNA, 20 bp, Artificial Sequence
  chemically synthesized
tgccttcatagcgaggaagc

SEQ ID NO: 453373 - DNA, 20 bp, Artificial Sequence
  chemically synthesized
atagcgaggaagccagcaat

SEQ ID NO: 453374 - DNA, 20 bp, Artificial Sequence
  chemically synthesized
tccaggatccagctcattgc

SEQ ID NO: 453375 - DNA, 20 bp, Artificial Sequence
  chemically synthesized
cgaggaagccagcaatgagc

SEQ ID NO: 453376 - DNA, 20 bp, Artificial Sequence
  chemically synthesized
gccagcaatgagctggatcc

SEQ ID NO: 453377 - DNA, 20 bp, Artificial Sequence
  chemically synthesized
ccagcatgctgtccaggatc

SEQ ID NO: 453378 - DNA, 20 bp, Artificial Sequence
  chemically synthesized
gcaatgagctggatcctgga

SEQ ID NO: 453379 - DNA, 20 bp, Artificial Sequence
  chemically synthesized
caggggccagcatgctgtcc

SEQ ID NO: 453380 - DNA, 20 bp, Artificial Sequence
  chemically synthesized
tcaggggccagcatgctgtc

SEQ ID NO: 453381 - DNA, 20 bp, Artificial Sequence
  chemically synthesized
ctggatcctggacagcatgc

SEQ ID NO: 453382 - DNA, 20 bp, Artificial Sequence
  chemically synthesized
ttgttgcccatgtcaggggc

SEQ ID NO: 453383 - DNA, 20 bp, Artificial Sequence
  chemically synthesized
cagcatgctggcccctgaca

SEQ ID NO: 453384 - DNA, 20 bp, Artificial Sequence
  chemically synthesized
agcatgctggcccctgacat

SEQ ID NO: 453385 - DNA, 20 bp, Artificial Sequence
  chemically synthesized
taatttgttgcccatgtcag

SEQ ID NO: 453386 - DNA, 20 bp, Artificial Sequence
  chemically synthesized
ctaatttgttgcccatgtca

SEQ ID NO: 453387 - DNA, 20 bp, Artificial Sequence
  chemically synthesized
tctaatttgttgcccatgtc

SEQ ID NO: 453388 - DNA, 20 bp, Artificial Sequence
  chemically synthesized
atctaatttgttgcccatgt

SEQ ID NO: 453389 - DNA, 20 bp, Artificial Sequence
  chemically synthesized
ccctgacatgggcaacaaat

SEQ ID NO: 453390 - DNA, 20 bp, Artificial Sequence
  chemically synthesized
gacatgggcaacaaattaga

SEQ ID NO: 453391 - DNA, 20 bp, Artificial Sequence
  chemically synthesized
acatgggcaacaaattagat

SEQ ID NO: 453392 - DNA, 20 bp, Artificial Sequence
  chemically synthesized
gcaacaaattagatgggcca

SEQ ID NO: 453393 - DNA, 20 bp, Artificial Sequence
  chemically synthesized
gctatagaaattaggttctg

SEQ ID NO: 453394 - DNA, 20 bp, Artificial Sequence
  chemically synthesized
gagtcaaggctatagaaatt

SEQ ID NO: 453395 - DNA, 20 bp, Artificial Sequence
  chemically synthesized
gccacagaacctaatttcta

SEQ ID NO: 453396 - DNA, 20 bp, Artificial Sequence
  chemically synthesized
tgagtcaaggctatagaaat

SEQ ID NO: 453397 - DNA, 20 bp, Artificial Sequence
  chemically synthesized
cctgtggtgagtcaaggcta

SEQ ID NO: 453398 - DNA, 20 bp, Artificial Sequence
  chemically synthesized
cataaacctgtggtgagtca

SEQ ID NO: 453399 - DNA, 20 bp, Artificial Sequence
  chemically synthesized
gcataaacctgtggtgagtc

SEQ ID NO: 453400 - DNA, 20 bp, Artificial Sequence
  chemically synthesized
tctatagccttgactcacca

SEQ ID NO: 453401 - DNA, 20 bp, Artificial Sequence
  chemically synthesized
ctatagccttgactcaccac

SEQ ID NO: 453402 - DNA, 20 bp, Artificial Sequence
  chemically synthesized
ggagagcataaacctgtggt

SEQ ID NO: 453403 - DNA, 20 bp, Artificial Sequence
  chemically synthesized
tgcgggagagcataaacctg

SEQ ID NO: 453404 - DNA, 20 bp, Artificial Sequence
  chemically synthesized
cccaatgccattgtgcggga

SEQ ID NO: 453405 - DNA, 20 bp, Artificial Sequence
  chemically synthesized
gccccaatgccattgtgcgg

SEQ ID NO: 453406 - DNA, 20 bp, Artificial Sequence
  chemically synthesized
gtttatgctctcccgcacaa

SEQ ID NO: 453407 - DNA, 20 bp, Artificial Sequence
  chemically synthesized
ttgccccaatgccattgtgc

SEQ ID NO: 453408 - DNA, 20 bp, Artificial Sequence
  chemically synthesized
cttgccccaatgccattgtg

SEQ ID NO: 453409 - DNA, 20 bp, Artificial Sequence
  chemically synthesized
gctctcccgcacaatggcat

SEQ ID NO: 453410 - DNA, 20 bp, Artificial Sequence
  chemically synthesized
ctctcccgcacaatggcatt

SEQ ID NO: 453411 - DNA, 20 bp, Artificial Sequence
  chemically synthesized
tctcccgcacaatggcattg

SEQ ID NO: 453412 - DNA, 20 bp, Artificial Sequence
  chemically synthesized
ccgcacaatggcattggggc

SEQ ID NO: 453413 - DNA, 20 bp, Artificial Sequence
  chemically synthesized
acaaacagcacaacacgaca

SEQ ID NO: 453414 - DNA, 20 bp, Artificial Sequence
  chemically synthesized
ccctttgcttagaaaacaaa

SEQ ID NO: 453415 - DNA, 20 bp, Artificial Sequence
  chemically synthesized
tgttgtgctgtttgttttct

SEQ ID NO: 453416 - DNA, 20 bp, Artificial Sequence
  chemically synthesized
tgctgtttgttttctaagca

SEQ ID NO: 453417 - DNA, 20 bp, Artificial Sequence
  chemically synthesized
gctgtttgttttctaagcaa

SEQ ID NO: 453418 - DNA, 20 bp, Artificial Sequence
  chemically synthesized
ctgtttgttttctaagcaaa

SEQ ID NO: 453419 - DNA, 20 bp, Artificial Sequence
  chemically synthesized
ataggagactgccctttgct

SEQ ID NO: 453420 - DNA, 20 bp, Artificial Sequence
  chemically synthesized
tttgttttctaagcaaaggg

SEQ ID NO: 453421 - DNA, 20 bp, Artificial Sequence
  chemically synthesized
ttaaatttggcatgagatag

SEQ ID NO: 453422 - DNA, 20 bp, Artificial Sequence
  chemically synthesized
ttttaaatttggcatgagat

SEQ ID NO: 453423 - DNA, 20 bp, Artificial Sequence
  chemically synthesized
attttaaatttggcatgaga

SEQ ID NO: 453424 - DNA, 20 bp, Artificial Sequence
  chemically synthesized
ctgaattttaaatttggcat

SEQ ID NO: 453425 - DNA, 20 bp, Artificial Sequence
  chemically synthesized
tgcagcctgaattttaaatt

SEQ ID NO: 453426 - DNA, 20 bp, Artificial Sequence
  chemically synthesized
ctcatgccaaatttaaaatt

SEQ ID NO: 453427 - DNA, 20 bp, Artificial Sequence
  chemically synthesized
tcatgccaaatttaaaattc

SEQ ID NO: 453428 - DNA, 20 bp, Artificial Sequence
  chemically synthesized
gaaatctctaagatttcatg

SEQ ID NO: 453429 - DNA, 20 bp, Artificial Sequence
  chemically synthesized
attcaggctgcatgaaatct

SEQ ID NO: 453430 - DNA, 20 bp, Artificial Sequence
  chemically synthesized
tcaggctgcatgaaatctta

SEQ ID NO: 453431 - DNA, 20 bp, Artificial Sequence
  chemically synthesized
aaagcttaagtgaaatctct

SEQ ID NO: 453432 - DNA, 20 bp, Artificial Sequence
  chemically synthesized
aaatcttagagatttcactt

SEQ ID NO: 453433 - DNA, 20 bp, Artificial Sequence
  chemically synthesized
actaatttgcacaaaagctt

SEQ ID NO: 453434 - DNA, 20 bp, Artificial Sequence
  chemically synthesized
aaaccaactaatttgcacaa

SEQ ID NO: 453435 - DNA, 20 bp, Artificial Sequence
  chemically synthesized
acttaagcttttgtgcaaat

SEQ ID NO: 453436 - DNA, 20 bp, Artificial Sequence
  chemically synthesized
aagcttttgtgcaaattagt

SEQ ID NO: 453437 - DNA, 20 bp, Artificial Sequence
  chemically synthesized
attagttggtttgattgaat

SEQ ID NO: 453438 - DNA, 20 bp, Artificial Sequence
  chemically synthesized
ggtttgattgaatcagtgta

SEQ ID NO: 453439 - DNA, 20 bp, Artificial Sequence
  chemically synthesized
gattgaatcagtgtatggta

SEQ ID NO: 453440 - DNA, 20 bp, Artificial Sequence
  chemically synthesized
aatcagtgtatggtacagcc

SEQ ID NO: 453441 - DNA, 20 bp, Artificial Sequence
  chemically synthesized
atataagaatgacatttact

SEQ ID NO: 453442 - DNA, 20 bp, Artificial Sequence
  chemically synthesized
aatataagaatgacatttac

SEQ ID NO: 453443 - DNA, 20 bp, Artificial Sequence
  chemically synthesized
gtattcttttgaatgaatat

SEQ ID NO: 453444 - DNA, 20 bp, Artificial Sequence
  chemically synthesized
tcattcttatattcattcaa

SEQ ID NO: 453445 - DNA, 20 bp, Artificial Sequence
  chemically synthesized
ttttatgagcaaatttgtag

SEQ ID NO: 453446 - DNA, 20 bp, Artificial Sequence
  chemically synthesized
taattttatgagcaaatttg

SEQ ID NO: 453447 - DNA, 20 bp, Artificial Sequence
  chemically synthesized
tacaaatttgctcataaaat

SEQ ID NO: 453448 - DNA, 20 bp, Artificial Sequence
  chemically synthesized
gtattcattgctaattttat

SEQ ID NO: 453449 - DNA, 20 bp, Artificial Sequence
  chemically synthesized
ataaaattagcaatgaatac

SEQ ID NO: 453450 - DNA, 20 bp, Artificial Sequence
  chemically synthesized
aaattagcaatgaatactgg

SEQ ID NO: 453451 - DNA, 20 bp, Artificial Sequence
  chemically synthesized
attagcaatgaatactggtg

SEQ ID NO: 453452 - DNA, 20 bp, Artificial Sequence
  chemically synthesized
tagcaatgaatactggtgga

SEQ ID NO: 453453 - DNA, 20 bp, Artificial Sequence
  chemically synthesized
tcccatgtgtgactctccac

SEQ ID NO: 453454 - DNA, 20 bp, Artificial Sequence
  chemically synthesized
tactggtggagagtcacaca

SEQ ID NO: 453455 - DNA, 20 bp, Artificial Sequence
  chemically synthesized
actggtggagagtcacacat

SEQ ID NO: 453456 - DNA, 20 bp, Artificial Sequence
  chemically synthesized
gtggagagtcacacatggga

SEQ ID NO: 453457 - DNA, 20 bp, Artificial Sequence
  chemically synthesized
ggagagtcacacatgggaaa

SEQ ID NO: 453458 - DNA, 20 bp, Artificial Sequence
  chemically synthesized
cacatgggaaagagaaaacc

SEQ ID NO: 453459 - DNA, 20 bp, Artificial Sequence
  chemically synthesized
tagagctgagatttatagcc

SEQ ID NO: 453460 - DNA, 20 bp, Artificial Sequence
  chemically synthesized
gtagagctgagatttatagc

SEQ ID NO: 453461 - DNA, 20 bp, Artificial Sequence
  chemically synthesized
gaaaacctggctataaatct

SEQ ID NO: 453462 - DNA, 20 bp, Artificial Sequence
  chemically synthesized
agtggtagagctgagattta

SEQ ID NO: 453463 - DNA, 20 bp, Artificial Sequence
  chemically synthesized
agctagtcagtggtagagct

SEQ ID NO: 453464 - DNA, 20 bp, Artificial Sequence
  chemically synthesized
aactcagctagtcagtggta

SEQ ID NO: 453465 - DNA, 20 bp, Artificial Sequence
  chemically synthesized
ttaactcagctagtcagtgg

SEQ ID NO: 453466 - DNA, 20 bp, Artificial Sequence
  chemically synthesized
atctcagctctaccactgac

SEQ ID NO: 453467 - DNA, 20 bp, Artificial Sequence
  chemically synthesized
gtgttaactcagctagtcag

SEQ ID NO: 453468 - DNA, 20 bp, Artificial Sequence
  chemically synthesized
agctctaccactgactagct

SEQ ID NO: 453469 - DNA, 20 bp, Artificial Sequence
  chemically synthesized
ttcgtgttaactcagctagt

SEQ ID NO: 453470 - DNA, 20 bp, Artificial Sequence
  chemically synthesized
aaagttcgtgttaactcagc

SEQ ID NO: 453471 - DNA, 20 bp, Artificial Sequence
  chemically synthesized
gcttaaagttcgtgttaact

SEQ ID NO: 453472 - DNA, 20 bp, Artificial Sequence
  chemically synthesized
gctgagttaacacgaacttt

SEQ ID NO: 453473 - DNA, 20 bp, Artificial Sequence
  chemically synthesized
gccaaagttaaaagggctta

SEQ ID NO: 453474 - DNA, 20 bp, Artificial Sequence
  chemically synthesized
gagaaaagccaaagttaaaa

SEQ ID NO: 453475 - DNA, 20 bp, Artificial Sequence
  chemically synthesized
tgagaaaagccaaagttaaa

SEQ ID NO: 453476 - DNA, 20 bp, Artificial Sequence
  chemically synthesized
actttaagcccttttaactt

SEQ ID NO: 453477 - DNA, 20 bp, Artificial Sequence
  chemically synthesized
atgagaaaagccaaagttaa

SEQ ID NO: 453478 - DNA, 20 bp, Artificial Sequence
  chemically synthesized
ttttcagatgagaaaagcca

SEQ ID NO: 453479 - DNA, 20 bp, Artificial Sequence
  chemically synthesized
gcccatttttcagatgagaa

SEQ ID NO: 453480 - DNA, 20 bp, Artificial Sequence
  chemically synthesized
tttctgcccatttttcagat

SEQ ID NO: 453481 - DNA, 20 bp, Artificial Sequence
  chemically synthesized
ggcttttctcatctgaaaaa

SEQ ID NO: 453482 - DNA, 20 bp, Artificial Sequence
  chemically synthesized
gcttttctcatctgaaaaat

SEQ ID NO: 453483 - DNA, 20 bp, Artificial Sequence
  chemically synthesized
cacattttctgcccattttt

SEQ ID NO: 453484 - DNA, 20 bp, Artificial Sequence
  chemically synthesized
tttctcatctgaaaaatggg

SEQ ID NO: 453485 - DNA, 20 bp, Artificial Sequence
  chemically synthesized
tgaaaaatgggcagaaaatg

SEQ ID NO: 453486 - DNA, 20 bp, Artificial Sequence
  chemically synthesized
gaaaaatgggcagaaaatgt

SEQ ID NO: 453487 - DNA, 20 bp, Artificial Sequence
  chemically synthesized
cagaaaatgtgggattttgt

SEQ ID NO: 453488 - DNA, 20 bp, Artificial Sequence
  chemically synthesized
agaaaatgtgggattttgtg

SEQ ID NO: 453489 - DNA, 20 bp, Artificial Sequence
  chemically synthesized
atgtgggattttgtgaggaa

SEQ ID NO: 453490 - DNA, 20 bp, Artificial Sequence
  chemically synthesized
tgaggaatagaattaatact

SEQ ID NO: 453491 - DNA, 20 bp, Artificial Sequence
  chemically synthesized
atagaattaatactaagcaa

SEQ ID NO: 453492 - DNA, 20 bp, Artificial Sequence
  chemically synthesized
aacggatctgaacttttgct

SEQ ID NO: 453493 - DNA, 20 bp, Artificial Sequence
  chemically synthesized
attaatactaagcaaaagtt

SEQ ID NO: 453494 - DNA, 20 bp, Artificial Sequence
  chemically synthesized
ataattgctgacatttaaaa

SEQ ID NO: 453495 - DNA, 20 bp, Artificial Sequence
  chemically synthesized
ttcagatccgttttaaatgt

SEQ ID NO: 453496 - DNA, 20 bp, Artificial Sequence
  chemically synthesized
aattatttttctatttaaaa

SEQ ID NO: 453497 - DNA, 20 bp, Artificial Sequence
  chemically synthesized
acgctatatacttttttaaa

SEQ ID NO: 453498 - DNA, 20 bp, Artificial Sequence
  chemically synthesized
tttctatttaaaaaagtata

SEQ ID NO: 453499 - DNA, 20 bp, Artificial Sequence
  chemically synthesized
cttgtcccagaaatgatttt

SEQ ID NO: 453500 - DNA, 20 bp, Artificial Sequence
  chemically synthesized
gtatcactaaaaatcatttc

SEQ ID NO: 453501 - DNA, 20 bp, Artificial Sequence
  chemically synthesized
tatcactaaaaatcatttct

SEQ ID NO: 453502 - DNA, 20 bp, Artificial Sequence
  chemically synthesized
ctaaaaatcatttctgggac

SEQ ID NO: 453503 - DNA, 20 bp, Artificial Sequence
  chemically synthesized
tggtatgtctcagcttgtcc

SEQ ID NO: 453504 - DNA, 20 bp, Artificial Sequence
  chemically synthesized
aatcatttctgggacaagct

SEQ ID NO: 453505 - DNA, 20 bp, Artificial Sequence
  chemically synthesized
cacataattatggtatgtct

SEQ ID NO: 453506 - DNA, 20 bp, Artificial Sequence
  chemically synthesized
caggtgttgacacataatta

SEQ ID NO: 453507 - DNA, 20 bp, Artificial Sequence
  chemically synthesized
ataattatgtgtcaacacct

SEQ ID NO: 453508 - DNA, 20 bp, Artificial Sequence
  chemically synthesized
taattatgtgtcaacacctg

SEQ ID NO: 453509 - DNA, 20 bp, Artificial Sequence
  chemically synthesized
gcattaattacacgtacctc

SEQ ID NO: 453510 - DNA, 20 bp, Artificial Sequence
  chemically synthesized
agcattaattacacgtacct

SEQ ID NO: 453511 - DNA, 20 bp, Artificial Sequence
  chemically synthesized
gaggtacgtgtaattaatgc

SEQ ID NO: 453512 - DNA, 20 bp, Artificial Sequence
  chemically synthesized
ggtacgtgtaattaatgcta

SEQ ID NO: 453513 - DNA, 20 bp, Artificial Sequence
  chemically synthesized
acgtgtaattaatgctagag

SEQ ID NO: 453514 - DNA, 20 bp, Artificial Sequence
  chemically synthesized
cgtgtaattaatgctagaga

SEQ ID NO: 453515 - DNA, 20 bp, Artificial Sequence
  chemically synthesized
tcccttcttctgaccttctc

SEQ ID NO: 453516 - DNA, 20 bp, Artificial Sequence
  chemically synthesized
taattaatgctagagaaggt

SEQ ID NO: 453517 - DNA, 20 bp, Artificial Sequence
  chemically synthesized
ttaatgctagagaaggtcag

SEQ ID NO: 453518 - DNA, 20 bp, Artificial Sequence
  chemically synthesized
atgctagagaaggtcagaag

SEQ ID NO: 453519 - DNA, 20 bp, Artificial Sequence
  chemically synthesized
tgctagagaaggtcagaaga

SEQ ID NO: 453520 - DNA, 20 bp, Artificial Sequence
  chemically synthesized
gctagagaaggtcagaagaa

SEQ ID NO: 453521 - DNA, 20 bp, Artificial Sequence
  chemically synthesized
tagagaaggtcagaagaagg

SEQ ID NO: 453522 - DNA, 20 bp, Artificial Sequence
  chemically synthesized
agaagaagggagcttaacat

SEQ ID NO: 453523 - DNA, 20 bp, Artificial Sequence
  chemically synthesized
aatagcaaattgccaatgtt

SEQ ID NO: 453524 - DNA, 20 bp, Artificial Sequence
  chemically synthesized
aacattggcaatttgctatt

SEQ ID NO: 453525 - DNA, 20 bp, Artificial Sequence
  chemically synthesized
acattggcaatttgctattt

SEQ ID NO: 453526 - DNA, 20 bp, Artificial Sequence
  chemically synthesized
ttggcaatttgctatttagg

SEQ ID NO: 453527 - DNA, 20 bp, Artificial Sequence
  chemically synthesized
tctttggaacacttcctaaa

SEQ ID NO: 453528 - DNA, 20 bp, Artificial Sequence
  chemically synthesized
gctatttaggaagtgttcca

SEQ ID NO: 453529 - DNA, 20 bp, Artificial Sequence
  chemically synthesized
taggaagtgttccaaagaaa

SEQ ID NO: 453530 - DNA, 20 bp, Artificial Sequence
  chemically synthesized
tcacaatcccactttttctt

SEQ ID NO: 453531 - DNA, 20 bp, Artificial Sequence
  chemically synthesized
gaagtgttccaaagaaaaag

SEQ ID NO: 453532 - DNA, 20 bp, Artificial Sequence
  chemically synthesized
aagtgttccaaagaaaaagt

SEQ ID NO: 453533 - DNA, 20 bp, Artificial Sequence
  chemically synthesized
aagaaaaagtgggattgtga

SEQ ID NO: 453534 - DNA, 20 bp, Artificial Sequence
  chemically synthesized
agtgggattgtgatggacta

SEQ ID NO: 453535 - DNA, 20 bp, Artificial Sequence
  chemically synthesized
ttgtgatggactatggaact

SEQ ID NO: 453536 - DNA, 20 bp, Artificial Sequence
  chemically synthesized
tcttactaatctgagttcca

SEQ ID NO: 453537 - DNA, 20 bp, Artificial Sequence
  chemically synthesized
atggactatggaactcagat

SEQ ID NO: 453538 - DNA, 20 bp, Artificial Sequence
  chemically synthesized
agtccaagtcttactaatct

SEQ ID NO: 453539 - DNA, 20 bp, Artificial Sequence
  chemically synthesized
actatggaactcagattagt

SEQ ID NO: 453540 - DNA, 20 bp, Artificial Sequence
  chemically synthesized
gaactcagattagtaagact

SEQ ID NO: 453541 - DNA, 20 bp, Artificial Sequence
  chemically synthesized
ggatgtctttcatttagtcc

SEQ ID NO: 453542 - DNA, 20 bp, Artificial Sequence
  chemically synthesized
gtaagacttggactaaatga

SEQ ID NO: 453543 - DNA, 20 bp, Artificial Sequence
  chemically synthesized
tcattaggatgtctttcatt

SEQ ID NO: 453544 - DNA, 20 bp, Artificial Sequence
  chemically synthesized
tttagtcctgttgaatcatt

SEQ ID NO: 453545 - DNA, 20 bp, Artificial Sequence
  chemically synthesized
ttttagtcctgttgaatcat

SEQ ID NO: 453546 - DNA, 20 bp, Artificial Sequence
  chemically synthesized
aagacatcctaatgattcaa

SEQ ID NO: 453547 - DNA, 20 bp, Artificial Sequence
  chemically synthesized
agacatcctaatgattcaac

SEQ ID NO: 453548 - DNA, 20 bp, Artificial Sequence
  chemically synthesized
ctcaattccatatttaattt

SEQ ID NO: 453549 - DNA, 20 bp, Artificial Sequence
  chemically synthesized
aacaggactaaaattaaata

SEQ ID NO: 453550 - DNA, 20 bp, Artificial Sequence
  chemically synthesized
ctaaaattaaatatggaatt

SEQ ID NO: 453551 - DNA, 20 bp, Artificial Sequence
  chemically synthesized
ttaaatatggaattgagcaa

SEQ ID NO: 453552 - DNA, 20 bp, Artificial Sequence
  chemically synthesized
aaatatggaattgagcaaaa

SEQ ID NO: 453553 - DNA, 20 bp, Artificial Sequence
  chemically synthesized
ggaattgagcaaaagagact

SEQ ID NO: 453554 - DNA, 20 bp, Artificial Sequence
  chemically synthesized
ttttctaggatgttaacact

SEQ ID NO: 453555 - DNA, 20 bp, Artificial Sequence
  chemically synthesized
gagactgagtgttaacatcc

SEQ ID NO: 453556 - DNA, 20 bp, Artificial Sequence
  chemically synthesized
gtgttaacatcctagaaaat

SEQ ID NO: 453557 - DNA, 20 bp, Artificial Sequence
  chemically synthesized
caatattttcccaattttct

SEQ ID NO: 453558 - DNA, 20 bp, Artificial Sequence
  chemically synthesized
tgttaacatcctagaaaatt

SEQ ID NO: 453559 - DNA, 20 bp, Artificial Sequence
  chemically synthesized
ccaatattttcccaattttc

SEQ ID NO: 453560 - DNA, 20 bp, Artificial Sequence
  chemically synthesized
ctagaaaattgggaaaatat

SEQ ID NO: 453561 - DNA, 20 bp, Artificial Sequence
  chemically synthesized
ttggcataatcatttgccca

SEQ ID NO: 453562 - DNA, 20 bp, Artificial Sequence
  chemically synthesized
tggcataatcatttgcccat

SEQ ID NO: 453563 - DNA, 20 bp, Artificial Sequence
  chemically synthesized
ataatcatttgcccatggga

SEQ ID NO: 453564 - DNA, 20 bp, Artificial Sequence
  chemically synthesized
catgtcatatgctttcccat

SEQ ID NO: 453565 - DNA, 20 bp, Artificial Sequence
  chemically synthesized
acatgtcatatgctttccca

SEQ ID NO: 453566 - DNA, 20 bp, Artificial Sequence
  chemically synthesized
tatggaatatatgtgtatgc

SEQ ID NO: 453567 - DNA, 20 bp, Artificial Sequence
  chemically synthesized
cacagagatgcatgcatata

SEQ ID NO: 453568 - DNA, 20 bp, Artificial Sequence
  chemically synthesized
tatgtacgtaaacatacaca

SEQ ID NO: 453569 - DNA, 20 bp, Artificial Sequence
  chemically synthesized
tatatgtacgtaaacataca

SEQ ID NO: 453570 - DNA, 20 bp, Artificial Sequence
  chemically synthesized
atatacatatcatttgcact

SEQ ID NO: 453571 - DNA, 20 bp, Artificial Sequence
  chemically synthesized
tgttagtaatagtgttttct

SEQ ID NO: 453572 - DNA, 20 bp, Artificial Sequence
  chemically synthesized
tatgattgtagtgttagtaa

SEQ ID NO: 453573 - DNA, 20 bp, Artificial Sequence
  chemically synthesized
catatatatgattgtagtgt

SEQ ID NO: 453574 - DNA, 20 bp, Artificial Sequence
  chemically synthesized
acaccacatatatatgattg

SEQ ID NO: 453575 - DNA, 20 bp, Artificial Sequence
  chemically synthesized
acactacaatcatatatatg

SEQ ID NO: 453576 - DNA, 20 bp, Artificial Sequence
  chemically synthesized
aaaacaatcatacaattgta

SEQ ID NO: 453577 - DNA, 20 bp, Artificial Sequence
  chemically synthesized
ttgtatgattgttttctttg

SEQ ID NO: 453578 - DNA, 20 bp, Artificial Sequence
  chemically synthesized
tgtgattttaatgaacttca

SEQ ID NO: 453579 - DNA, 20 bp, Artificial Sequence
  chemically synthesized
tacataaatcggaaatttgc

SEQ ID NO: 453580 - DNA, 20 bp, Artificial Sequence
  chemically synthesized
gtatgcatatgtacataaat

SEQ ID NO: 453581 - DNA, 20 bp, Artificial Sequence
  chemically synthesized
catatgcatacctcttaaaa

SEQ ID NO: 453582 - DNA, 20 bp, Artificial Sequence
  chemically synthesized
actatatatcccattttaag

SEQ ID NO: 453583 - DNA, 20 bp, Artificial Sequence
  chemically synthesized
atatgcatacctcttaaaat

SEQ ID NO: 453584 - DNA, 20 bp, Artificial Sequence
  chemically synthesized
tactatatatcccattttaa

SEQ ID NO: 453585 - DNA, 20 bp, Artificial Sequence
  chemically synthesized
aatactatatatcccatttt

SEQ ID NO: 453586 - DNA, 20 bp, Artificial Sequence
  chemically synthesized
acctcttaaaatgggatata

SEQ ID NO: 453587 - DNA, 20 bp, Artificial Sequence
  chemically synthesized
atatagtattccatctaata

SEQ ID NO: 453588 - DNA, 20 bp, Artificial Sequence
  chemically synthesized
aaaatttcatctttattaga

SEQ ID NO: 453589 - DNA, 20 bp, Artificial Sequence
  chemically synthesized
gacaaaaatttcatctttat

SEQ ID NO: 453590 - DNA, 20 bp, Artificial Sequence
  chemically synthesized
aataaagatgaaatttttgt

SEQ ID NO: 453591 - DNA, 20 bp, Artificial Sequence
  chemically synthesized
ataaagatgaaatttttgtc

SEQ ID NO: 453592 - DNA, 20 bp, Artificial Sequence
  chemically synthesized
gatgaaatttttgtcaggct

SEQ ID NO: 453593 - DNA, 20 bp, Artificial Sequence
  chemically synthesized
ttttgtcaggcttggaattc

SEQ ID NO: 453594 - DNA, 20 bp, Artificial Sequence
  chemically synthesized
aggaagatctcttgaattcc

SEQ ID NO: 453595 - DNA, 20 bp, Artificial Sequence
  chemically synthesized
ttgtcaggcttggaattcaa

SEQ ID NO: 453596 - DNA, 20 bp, Artificial Sequence
  chemically synthesized
aaaatataatacataaaagg

SEQ ID NO: 453597 - DNA, 20 bp, Artificial Sequence
  chemically synthesized
gtaaaaatataatacataaa

SEQ ID NO: 453598 - DNA, 20 bp, Artificial Sequence
  chemically synthesized
agtaaaaatataatacataa

SEQ ID NO: 453599 - DNA, 20 bp, Artificial Sequence
  chemically synthesized
gtattatatttttactcaaa

SEQ ID NO: 453600 - DNA, 20 bp, Artificial Sequence
  chemically synthesized
taactagcagtggtccattt

SEQ ID NO: 453601 - DNA, 20 bp, Artificial Sequence
  chemically synthesized
ttactcaaatggaccactgc

SEQ ID NO: 453602 - DNA, 20 bp, Artificial Sequence
  chemically synthesized
gaaagaaacttaactagcag

SEQ ID NO: 453603 - DNA, 20 bp, Artificial Sequence
  chemically synthesized
caaatggaccactgctagtt

SEQ ID NO: 453604 - DNA, 20 bp, Artificial Sequence
  chemically synthesized
cttgaaagaaacttaactag

SEQ ID NO: 453605 - DNA, 20 bp, Artificial Sequence
  chemically synthesized
aaacttgaaagaaacttaac

SEQ ID NO: 453606 - DNA, 20 bp, Artificial Sequence
  chemically synthesized
ctgctagttaagtttctttc

SEQ ID NO: 453607 - DNA, 20 bp, Artificial Sequence
  chemically synthesized
ccgaatcagagaaaacttga

SEQ ID NO: 453608 - DNA, 20 bp, Artificial Sequence
  chemically synthesized
ctttcaagttttctctgatt

SEQ ID NO: 453609 - DNA, 20 bp, Artificial Sequence
  chemically synthesized
aaatggcatttaccgaatca

SEQ ID NO: 453610 - DNA, 20 bp, Artificial Sequence
  chemically synthesized
tcaaatggcatttaccgaat

SEQ ID NO: 453611 - DNA, 20 bp, Artificial Sequence
  chemically synthesized
tgattcggtaaatgccattt

SEQ ID NO: 453612 - DNA, 20 bp, Artificial Sequence
  chemically synthesized
gattcggtaaatgccatttg

SEQ ID NO: 453613 - DNA, 20 bp, Artificial Sequence
  chemically synthesized
ttcggtaaatgccatttgag

SEQ ID NO: 453614 - DNA, 20 bp, Artificial Sequence
  chemically synthesized
atgttaatgaactcctcaaa

SEQ ID NO: 453615 - DNA, 20 bp, Artificial Sequence
  chemically synthesized
cattaacatgcgtttaaatt

SEQ ID NO: 453616 - DNA, 20 bp, Artificial Sequence
  chemically synthesized
attaacatgcgtttaaattc

SEQ ID NO: 453617 - DNA, 20 bp, Artificial Sequence
  chemically synthesized
atgcgtttaaattcaggttc

SEQ ID NO: 453618 - DNA, 20 bp, Artificial Sequence
  chemically synthesized
atgtgaccgtcatcatgcac

SEQ ID NO: 453619 - DNA, 20 bp, Artificial Sequence
  chemically synthesized
caggttccagtgcatgatga

SEQ ID NO: 453620 - DNA, 20 bp, Artificial Sequence
  chemically synthesized
gtgcatgatgacggtcacat

SEQ ID NO: 453621 - DNA, 20 bp, Artificial Sequence
  chemically synthesized
tgcatgatgacggtcacatc

SEQ ID NO: 453622 - DNA, 20 bp, Artificial Sequence
  chemically synthesized
atgacggtcacatcaggcca

SEQ ID NO: 453623 - DNA, 20 bp, Artificial Sequence
  chemically synthesized
atgtgtttcctgtttcacca

SEQ ID NO: 453624 - DNA, 20 bp, Artificial Sequence
  chemically synthesized
cacatcaggccatggtgaaa

SEQ ID NO: 453625 - DNA, 20 bp, Artificial Sequence
  chemically synthesized
acatcaggccatggtgaaac

SEQ ID NO: 453626 - DNA, 20 bp, Artificial Sequence
  chemically synthesized
ggtgaaacaggaaacacatg

SEQ ID NO: 453627 - DNA, 20 bp, Artificial Sequence
  chemically synthesized
tgaaacaggaaacacatgaa

SEQ ID NO: 453628 - DNA, 20 bp, Artificial Sequence
  chemically synthesized
gaaacaggaaacacatgaag

SEQ ID NO: 453629 - DNA, 20 bp, Artificial Sequence
  chemically synthesized
caggaaacacatgaagaggc

SEQ ID NO: 453630 - DNA, 20 bp, Artificial Sequence
  chemically synthesized
ggaaacacatgaagaggctg

SEQ ID NO: 453631 - DNA, 20 bp, Artificial Sequence
  chemically synthesized
ataattaaaaaaaaatactc

SEQ ID NO: 453632 - DNA, 20 bp, Artificial Sequence
  chemically synthesized
tcattttttaattctgtgat

SEQ ID NO: 453633 - DNA, 20 bp, Artificial Sequence
  chemically synthesized
cattttttaattctgtgatc

SEQ ID NO: 453634 - DNA, 20 bp, Artificial Sequence
  chemically synthesized
aacttggaaggacctgatca

SEQ ID NO: 453635 - DNA, 20 bp, Artificial Sequence
  chemically synthesized
ttctgtgatcaggtccttcc

SEQ ID NO: 453636 - DNA, 20 bp, Artificial Sequence
  chemically synthesized
tatcagcaccaaaacttgga

SEQ ID NO: 453637 - DNA, 20 bp, Artificial Sequence
  chemically synthesized
ctatcagcaccaaaacttgg

SEQ ID NO: 453638 - DNA, 20 bp, Artificial Sequence
  chemically synthesized
gatcaggtccttccaagttt

SEQ ID NO: 453639 - DNA, 20 bp, Artificial Sequence
  chemically synthesized
accctatcagcaccaaaact

SEQ ID NO: 453640 - DNA, 20 bp, Artificial Sequence
  chemically synthesized
cttccaagttttggtgctga

SEQ ID NO: 453641 - DNA, 20 bp, Artificial Sequence
  chemically synthesized
ttccaagttttggtgctgat

SEQ ID NO: 453642 - DNA, 20 bp, Artificial Sequence
  chemically synthesized
tccaagttttggtgctgata

SEQ ID NO: 453643 - DNA, 20 bp, Artificial Sequence
  chemically synthesized
ataaaagaaaaagaccctat

SEQ ID NO: 453644 - DNA, 20 bp, Artificial Sequence
  chemically synthesized
ccattgtaatataaaagaaa

SEQ ID NO: 453645 - DNA, 20 bp, Artificial Sequence
  chemically synthesized
ttctcaccattgtaatataa

SEQ ID NO: 453646 - DNA, 20 bp, Artificial Sequence
  chemically synthesized
ctttttcttttatattacaa

SEQ ID NO: 453647 - DNA, 20 bp, Artificial Sequence
  chemically synthesized
ttcttttatattacaatggt

SEQ ID NO: 453648 - DNA, 20 bp, Artificial Sequence
  chemically synthesized
ttttatattacaatggtgag

SEQ ID NO: 453649 - DNA, 20 bp, Artificial Sequence
  chemically synthesized
caatggtgagaagccctaat

SEQ ID NO: 453650 - DNA, 20 bp, Artificial Sequence
  chemically synthesized
ttttcttactttgctaatta

SEQ ID NO: 453651 - DNA, 20 bp, Artificial Sequence
  chemically synthesized
attttcttactttgctaatt

SEQ ID NO: 453652 - DNA, 20 bp, Artificial Sequence
  chemically synthesized
gtgagaagccctaattagca

SEQ ID NO: 453653 - DNA, 20 bp, Artificial Sequence
  chemically synthesized
cattttcttactttgctaat

SEQ ID NO: 453654 - DNA, 20 bp, Artificial Sequence
  chemically synthesized
gaagccctaattagcaaagt

SEQ ID NO: 453655 - DNA, 20 bp, Artificial Sequence
  chemically synthesized
taattagcaaagtaagaaaa

SEQ ID NO: 453656 - DNA, 20 bp, Artificial Sequence
  chemically synthesized
aagtaagaaaatggcaactc

SEQ ID NO: 453657 - DNA, 20 bp, Artificial Sequence
  chemically synthesized
agtaagaaaatggcaactca

SEQ ID NO: 453658 - DNA, 20 bp, Artificial Sequence
  chemically synthesized
acaaaccagagatcaacctt

SEQ ID NO: 453659 - DNA, 20 bp, Artificial Sequence
  chemically synthesized
ggcaactcaaggttgatctc

SEQ ID NO: 453660 - DNA, 20 bp, Artificial Sequence
  chemically synthesized
aacaagttagaaacaaacca

SEQ ID NO: 453661 - DNA, 20 bp, Artificial Sequence
  chemically synthesized
aaaacaagttagaaacaaac

SEQ ID NO: 453662 - DNA, 20 bp, Artificial Sequence
  chemically synthesized
caactaaatttaaaacaagt

SEQ ID NO: 453663 - DNA, 20 bp, Artificial Sequence
  chemically synthesized
gattcaactaaatttaaaac

SEQ ID NO: 453664 - DNA, 20 bp, Artificial Sequence
  chemically synthesized
tttctaacttgttttaaatt

SEQ ID NO: 453665 - DNA, 20 bp, Artificial Sequence
  chemically synthesized
ttaaatttagttgaatcatg

SEQ ID NO: 453666 - DNA, 20 bp, Artificial Sequence
  chemically synthesized
agttgaatcatgaagtctaa

SEQ ID NO: 453667 - DNA, 20 bp, Artificial Sequence
  chemically synthesized
aatcatgaagtctaaaagtc

SEQ ID NO: 453668 - DNA, 20 bp, Artificial Sequence
  chemically synthesized
tttcgtgctctctggacttt

SEQ ID NO: 453669 - DNA, 20 bp, Artificial Sequence
  chemically synthesized
tcatgaagtctaaaagtcca

SEQ ID NO: 453670 - DNA, 20 bp, Artificial Sequence
  chemically synthesized
atgaagtctaaaagtccaga

SEQ ID NO: 453671 - DNA, 20 bp, Artificial Sequence
  chemically synthesized
tagcttagtttcgtgctctc

SEQ ID NO: 453672 - DNA, 20 bp, Artificial Sequence
  chemically synthesized
agtccagagagcacgaaact

SEQ ID NO: 453673 - DNA, 20 bp, Artificial Sequence
  chemically synthesized
atgttcaaattaatgtagct

SEQ ID NO: 453674 - DNA, 20 bp, Artificial Sequence
  chemically synthesized
gtcagatgttcaaattaatg

SEQ ID NO: 453675 - DNA, 20 bp, Artificial Sequence
  chemically synthesized
ttaatttgaacatctgacat

SEQ ID NO: 453676 - DNA, 20 bp, Artificial Sequence
  chemically synthesized
aatactagtctaacttatgt

SEQ ID NO: 453677 - DNA, 20 bp, Artificial Sequence
  chemically synthesized
tttgaacatctgacataagt

SEQ ID NO: 453678 - DNA, 20 bp, Artificial Sequence
  chemically synthesized
acatctgacataagttagac

SEQ ID NO: 453679 - DNA, 20 bp, Artificial Sequence
  chemically synthesized
gaatacaacttgaaaaatac

SEQ ID NO: 453680 - DNA, 20 bp, Artificial Sequence
  chemically synthesized
aagttagactagtatttttc

SEQ ID NO: 453681 - DNA, 20 bp, Artificial Sequence
  chemically synthesized
atttttcaagttgtattcta

SEQ ID NO: 453682 - DNA, 20 bp, Artificial Sequence
  chemically synthesized
ttttcaagttgtattctata

SEQ ID NO: 453683 - DNA, 20 bp, Artificial Sequence
  chemically synthesized
aatttaattggggagctcta

SEQ ID NO: 453684 - DNA, 20 bp, Artificial Sequence
  chemically synthesized
ttttgctgaatttaattggg

SEQ ID NO: 453685 - DNA, 20 bp, Artificial Sequence
  chemically synthesized
cattttgctgaatttaattg

SEQ ID NO: 453686 - DNA, 20 bp, Artificial Sequence
  chemically synthesized
tcattttgctgaatttaatt

SEQ ID NO: 453687 - DNA, 20 bp, Artificial Sequence
  chemically synthesized
atcattttgctgaatttaat

SEQ ID NO: 453688 - DNA, 20 bp, Artificial Sequence
  chemically synthesized
tagagctccccaattaaatt

SEQ ID NO: 453689 - DNA, 20 bp, Artificial Sequence
  chemically synthesized
taaattcagcaaaatgatac

SEQ ID NO: 453690 - DNA, 20 bp, Artificial Sequence
  chemically synthesized
caaaatgatactggtattgt

SEQ ID NO: 453691 - DNA, 20 bp, Artificial Sequence
  chemically synthesized
ttcttttttacttacaatac

SEQ ID NO: 453692 - DNA, 20 bp, Artificial Sequence
  chemically synthesized
tactggtattgtaagtaaaa

SEQ ID NO: 453693 - DNA, 20 bp, Artificial Sequence
  chemically synthesized
ggtattgtaagtaaaaaaga

SEQ ID NO: 453694 - DNA, 20 bp, Artificial Sequence
  chemically synthesized
gacaaagaaagaaatgtaat

SEQ ID NO: 453695 - DNA, 20 bp, Artificial Sequence
  chemically synthesized
tgacaaagaaagaaatgtaa

SEQ ID NO: 453696 - DNA, 20 bp, Artificial Sequence
  chemically synthesized
ttacatatttttgacaaaga

SEQ ID NO: 453697 - DNA, 20 bp, Artificial Sequence
  chemically synthesized
tagattacatatttttgaca

SEQ ID NO: 453698 - DNA, 20 bp, Artificial Sequence
  chemically synthesized
atgctcaccccaatgattcg

SEQ ID NO: 453699 - DNA, 20 bp, Artificial Sequence
  chemically synthesized
atatgtaatctacgaatcat

SEQ ID NO: 453700 - DNA, 20 bp, Artificial Sequence
  chemically synthesized
tatgtaatctacgaatcatt

SEQ ID NO: 453701 - DNA, 20 bp, Artificial Sequence
  chemically synthesized
atgtaatctacgaatcattg

SEQ ID NO: 453702 - DNA, 20 bp, Artificial Sequence
  chemically synthesized
aatctacgaatcattggggt

SEQ ID NO: 453703 - DNA, 20 bp, Artificial Sequence
  chemically synthesized
gagcatcaatattatataca

SEQ ID NO: 453704 - DNA, 20 bp, Artificial Sequence
  chemically synthesized
agcatcaatattatatacat

SEQ ID NO: 453705 - DNA, 20 bp, Artificial Sequence
  chemically synthesized
gaaaatgaatttaatttcat

SEQ ID NO: 453706 - DNA, 20 bp, Artificial Sequence
  chemically synthesized
aaaatgaatttaatttcatt

SEQ ID NO: 453707 - DNA, 20 bp, Artificial Sequence
  chemically synthesized
gaatttaatttcattaggat

SEQ ID NO: 453708 - DNA, 20 bp, Artificial Sequence
  chemically synthesized
aatttaatttcattaggatc

SEQ ID NO: 453709 - DNA, 20 bp, Artificial Sequence
  chemically synthesized
ttcattaggatcaggcttta

SEQ ID NO: 453710 - DNA, 20 bp, Artificial Sequence
  chemically synthesized
agccttagtttagatcttta

SEQ ID NO: 453711 - DNA, 20 bp, Artificial Sequence
  chemically synthesized
aggctttaaagatctaaact

SEQ ID NO: 453712 - DNA, 20 bp, Artificial Sequence
  chemically synthesized
ggctttaaagatctaaacta

SEQ ID NO: 453713 - DNA, 20 bp, Artificial Sequence
  chemically synthesized
aaattcaaacagccttagtt

SEQ ID NO: 453714 - DNA, 20 bp, Artificial Sequence
  chemically synthesized
aagaaaaattcaaacagcct

SEQ ID NO: 453715 - DNA, 20 bp, Artificial Sequence
  chemically synthesized
attaaaaagaaaaattcaaa

SEQ ID NO: 453716 - DNA, 20 bp, Artificial Sequence
  chemically synthesized
ttgtagtttatcaaattaaa

SEQ ID NO: 453717 - DNA, 20 bp, Artificial Sequence
  chemically synthesized
tttttaatttgataaactac

SEQ ID NO: 453718 - DNA, 20 bp, Artificial Sequence
  chemically synthesized
tgaaacttcctgtgaacttg

SEQ ID NO: 453719 - DNA, 20 bp, Artificial Sequence
  chemically synthesized
tttgataaactacaagttca

SEQ ID NO: 453720 - DNA, 20 bp, Artificial Sequence
  chemically synthesized
ttgataaactacaagttcac

SEQ ID NO: 453721 - DNA, 20 bp, Artificial Sequence
  chemically synthesized
ataaactacaagttcacagg

SEQ ID NO: 453722 - DNA, 20 bp, Artificial Sequence
  chemically synthesized
ggaagtttcaaaaaattgta

SEQ ID NO: 453723 - DNA, 20 bp, Artificial Sequence
  chemically synthesized
gaagtttcaaaaaattgtat

SEQ ID NO: 453724 - DNA, 20 bp, Artificial Sequence
  chemically synthesized
aagtttcaaaaaattgtata

SEQ ID NO: 453725 - DNA, 20 bp, Artificial Sequence
  chemically synthesized
gtttcaaaaaattgtatagg

SEQ ID NO: 453726 - DNA, 20 bp, Artificial Sequence
  chemically synthesized
tttcaaaaaattgtataggg

SEQ ID NO: 453727 - DNA, 20 bp, Artificial Sequence
  chemically synthesized
aaaattgtatagggaggttg

SEQ ID NO: 453728 - DNA, 20 bp, Artificial Sequence
  chemically synthesized
aaattgtatagggaggttga

SEQ ID NO: 453729 - DNA, 20 bp, Artificial Sequence
  chemically synthesized
agcctccgtgaagggtgcac

SEQ ID NO: 453730 - DNA, 20 bp, Artificial Sequence
  chemically synthesized
gagcctccgtgaagggtgca

SEQ ID NO: 453731 - DNA, 20 bp, Artificial Sequence
  chemically synthesized
aaggtcctgtgcacccttca

SEQ ID NO: 453732 - DNA, 20 bp, Artificial Sequence
  chemically synthesized
ggtcctgtgcacccttcacg

SEQ ID NO: 453733 - DNA, 20 bp, Artificial Sequence
  chemically synthesized
gtcctgtgcacccttcacgg

SEQ ID NO: 453734 - DNA, 20 bp, Artificial Sequence
  chemically synthesized
attgagtgagcctccgtgaa

SEQ ID NO: 453735 - DNA, 20 bp, Artificial Sequence
  chemically synthesized
tattgagtgagcctccgtga

SEQ ID NO: 453736 - DNA, 20 bp, Artificial Sequence
  chemically synthesized
atattgagtgagcctccgtg

SEQ ID NO: 453737 - DNA, 20 bp, Artificial Sequence
  chemically synthesized
gcaagatgtaaatattgagt

SEQ ID NO: 453738 - DNA, 20 bp, Artificial Sequence
  chemically synthesized
ttttgcaagatgtaaatatt

SEQ ID NO: 453739 - DNA, 20 bp, Artificial Sequence
  chemically synthesized
atattataccgcagttttgc

SEQ ID NO: 453740 - DNA, 20 bp, Artificial Sequence
  chemically synthesized
atttacatcttgcaaaactg

SEQ ID NO: 453741 - DNA, 20 bp, Artificial Sequence
  chemically synthesized
attcttttgatattataccg

SEQ ID NO: 453742 - DNA, 20 bp, Artificial Sequence
  chemically synthesized
aaactgcggtataatatcaa

SEQ ID NO: 453743 - DNA, 20 bp, Artificial Sequence
  chemically synthesized
aatatcaaaagaattgacat

SEQ ID NO: 453744 - DNA, 20 bp, Artificial Sequence
  chemically synthesized
tgaaatcagaagaaggttta

SEQ ID NO: 453745 - DNA, 20 bp, Artificial Sequence
  chemically synthesized
taaatggtgaaatcagaaga

SEQ ID NO: 453746 - DNA, 20 bp, Artificial Sequence
  chemically synthesized
ataaatggtgaaatcagaag

SEQ ID NO: 453747 - DNA, 20 bp, Artificial Sequence
  chemically synthesized
tacataaatggtgaaatcag

SEQ ID NO: 453748 - DNA, 20 bp, Artificial Sequence
  chemically synthesized
acgtacataaatggtgaaat

SEQ ID NO: 453749 - DNA, 20 bp, Artificial Sequence
  chemically synthesized
caaatgtatacgtacataaa

SEQ ID NO: 453750 - DNA, 20 bp, Artificial Sequence
  chemically synthesized
tgtatgtgtgtgtgtatata

SEQ ID NO: 453751 - DNA, 20 bp, Artificial Sequence
  chemically synthesized
gtgatctatgtggtaaaatt

SEQ ID NO: 453752 - DNA, 20 bp, Artificial Sequence
  chemically synthesized
ttatactcaattttaccaca

SEQ ID NO: 453753 - DNA, 20 bp, Artificial Sequence
  chemically synthesized
cttacgtgaagtgatctatg

SEQ ID NO: 453754 - DNA, 20 bp, Artificial Sequence
  chemically synthesized
ccacatagatcacttcacgt

SEQ ID NO: 453755 - DNA, 20 bp, Artificial Sequence
  chemically synthesized
acttgtgttgtgcttacgtg

SEQ ID NO: 453756 - DNA, 20 bp, Artificial Sequence
  chemically synthesized
acttcacgtaagcacaacac

SEQ ID NO: 453757 - DNA, 20 bp, Artificial Sequence
  chemically synthesized
tcacgtaagcacaacacaag

SEQ ID NO: 453758 - DNA, 20 bp, Artificial Sequence
  chemically synthesized
cgtaagcacaacacaagtgg

SEQ ID NO: 453759 - DNA, 20 bp, Artificial Sequence
  chemically synthesized
ggtagatgtaccatcacctc

SEQ ID NO: 453760 - DNA, 20 bp, Artificial Sequence
  chemically synthesized
catggggtgtcttgaggtga

SEQ ID NO: 453761 - DNA, 20 bp, Artificial Sequence
  chemically synthesized
ggataacatggggtgtcttg

SEQ ID NO: 453762 - DNA, 20 bp, Artificial Sequence
  chemically synthesized
aggataacatggggtgtctt

SEQ ID NO: 453763 - DNA, 20 bp, Artificial Sequence
  chemically synthesized
gcctataaaaggataacatg

SEQ ID NO: 453764 - DNA, 20 bp, Artificial Sequence
  chemically synthesized
ggcctataaaaggataacat

SEQ ID NO: 453765 - DNA, 20 bp, Artificial Sequence
  chemically synthesized
tggcctataaaaggataaca

SEQ ID NO: 453766 - DNA, 20 bp, Artificial Sequence
  chemically synthesized
caccccatgttatcctttta

SEQ ID NO: 453767 - DNA, 20 bp, Artificial Sequence
  chemically synthesized
accccatgttatccttttat

SEQ ID NO: 453768 - DNA, 20 bp, Artificial Sequence
  chemically synthesized
ggtggcaggtggcctataaa

SEQ ID NO: 453769 - DNA, 20 bp, Artificial Sequence
  chemically synthesized
aggtggcaggtggcctataa

SEQ ID NO: 453770 - DNA, 20 bp, Artificial Sequence
  chemically synthesized
gattgggggaaggtggcagg

SEQ ID NO: 453771 - DNA, 20 bp, Artificial Sequence
  chemically synthesized
atggattgggggaaggtggc

SEQ ID NO: 453772 - DNA, 20 bp, Artificial Sequence
  chemically synthesized
tatggattgggggaaggtgg

SEQ ID NO: 453773 - DNA, 20 bp, Artificial Sequence
  chemically synthesized
tgatatggattgggggaagg

SEQ ID NO: 453774 - DNA, 20 bp, Artificial Sequence
  chemically synthesized
atgtgatatggattggggga

SEQ ID NO: 453775 - DNA, 20 bp, Artificial Sequence
  chemically synthesized
aatgtgatatggattggggg

SEQ ID NO: 453776 - DNA, 20 bp, Artificial Sequence
  chemically synthesized
cataatgtgatatggattgg

SEQ ID NO: 453777 - DNA, 20 bp, Artificial Sequence
  chemically synthesized
gcataatgtgatatggattg

SEQ ID NO: 453778 - DNA, 20 bp, Artificial Sequence
  chemically synthesized
agcataatgtgatatggatt

SEQ ID NO: 453779 - DNA, 20 bp, Artificial Sequence
  chemically synthesized
cagcataatgtgatatggat

SEQ ID NO: 453780 - DNA, 20 bp, Artificial Sequence
  chemically synthesized
tcactcagcataatgtgata

SEQ ID NO: 453781 - DNA, 20 bp, Artificial Sequence
  chemically synthesized
aatccatatcacattatgct

SEQ ID NO: 453782 - DNA, 20 bp, Artificial Sequence
  chemically synthesized
tgtgactggtttatttcact

SEQ ID NO: 453783 - DNA, 20 bp, Artificial Sequence
  chemically synthesized
ttatgctgagtgaaataaac

SEQ ID NO: 453784 - DNA, 20 bp, Artificial Sequence
  chemically synthesized
gagtgaaataaaccagtcac

SEQ ID NO: 453785 - DNA, 20 bp, Artificial Sequence
  chemically synthesized
agtgaaataaaccagtcaca

SEQ ID NO: 453786 - DNA, 20 bp, Artificial Sequence
  chemically synthesized
gtgaaataaaccagtcacaa

SEQ ID NO: 453787 - DNA, 20 bp, Artificial Sequence
  chemically synthesized
tgtatgcagccccttgtgac

SEQ ID NO: 453788 - DNA, 20 bp, Artificial Sequence
  chemically synthesized
tgaaataaaccagtcacaag

SEQ ID NO: 453789 - DNA, 20 bp, Artificial Sequence
  chemically synthesized
cagtcacaaggggctgcata

SEQ ID NO: 453790 - DNA, 20 bp, Artificial Sequence
  chemically synthesized
caatggaatcatgctgtatg

SEQ ID NO: 453791 - DNA, 20 bp, Artificial Sequence
  chemically synthesized
tgacctggtcttcatgtcaa

SEQ ID NO: 453792 - DNA, 20 bp, Artificial Sequence
  chemically synthesized
agcatgattccattgacatg

SEQ ID NO: 453793 - DNA, 20 bp, Artificial Sequence
  chemically synthesized
gattccattgacatgaagac

SEQ ID NO: 453794 - DNA, 20 bp, Artificial Sequence
  chemically synthesized
attccattgacatgaagacc

SEQ ID NO: 453795 - DNA, 20 bp, Artificial Sequence
  chemically synthesized
ctctaaggatttgggtgacc

SEQ ID NO: 453796 - DNA, 20 bp, Artificial Sequence
  chemically synthesized
gaccaggtcacccaaatcct

SEQ ID NO: 453797 - DNA, 20 bp, Artificial Sequence
  chemically synthesized
ctttctgtctctaaggattt

SEQ ID NO: 453798 - DNA, 20 bp, Artificial Sequence
  chemically synthesized
actttctgtctctaaggatt

SEQ ID NO: 453799 - DNA, 20 bp, Artificial Sequence
  chemically synthesized
ccaggtcacccaaatcctta

SEQ ID NO: 453800 - DNA, 20 bp, Artificial Sequence
  chemically synthesized
gtcacccaaatccttagaga

SEQ ID NO: 453801 - DNA, 20 bp, Artificial Sequence
  chemically synthesized
gaaaccactttctgtctcta

SEQ ID NO: 453802 - DNA, 20 bp, Artificial Sequence
  chemically synthesized
cgaaaccactttctgtctct

SEQ ID NO: 453803 - DNA, 20 bp, Artificial Sequence
  chemically synthesized
cccaaatccttagagacaga

SEQ ID NO: 453804 - DNA, 20 bp, Artificial Sequence
  chemically synthesized
aaatccttagagacagaaag

SEQ ID NO: 453805 - DNA, 20 bp, Artificial Sequence
  chemically synthesized
agagacagaaagtggtttcg

SEQ ID NO: 453806 - DNA, 20 bp, Artificial Sequence
  chemically synthesized
agtggtttcgtggttgccaa

SEQ ID NO: 453807 - DNA, 20 bp, Artificial Sequence
  chemically synthesized
gtttcgtggttgccaacagc

SEQ ID NO: 453808 - DNA, 20 bp, Artificial Sequence
  chemically synthesized
tttcgtggttgccaacagct

SEQ ID NO: 453809 - DNA, 20 bp, Artificial Sequence
  chemically synthesized
ctcctccctcacccagctgt

SEQ ID NO: 453810 - DNA, 20 bp, Artificial Sequence
  chemically synthesized
gtggttgccaacagctgggt

SEQ ID NO: 453811 - DNA, 20 bp, Artificial Sequence
  chemically synthesized
tggttgccaacagctgggtg

SEQ ID NO: 453812 - DNA, 20 bp, Artificial Sequence
  chemically synthesized
ggttgccaacagctgggtga

SEQ ID NO: 453813 - DNA, 20 bp, Artificial Sequence
  chemically synthesized
ttgccaacagctgggtgagg

SEQ ID NO: 453814 - DNA, 20 bp, Artificial Sequence
  chemically synthesized
gtccacactcctccctcacc

SEQ ID NO: 453815 - DNA, 20 bp, Artificial Sequence
  chemically synthesized
tgccaacagctgggtgaggg

SEQ ID NO: 453816 - DNA, 20 bp, Artificial Sequence
  chemically synthesized
ccaacagctgggtgagggag

SEQ ID NO: 453817 - DNA, 20 bp, Artificial Sequence
  chemically synthesized
agctgggtgagggaggagtg

SEQ ID NO: 453818 - DNA, 20 bp, Artificial Sequence
  chemically synthesized
cactgtatccatttatcagt

SEQ ID NO: 453819 - DNA, 20 bp, Artificial Sequence
  chemically synthesized
agtgtggactaactgataaa

SEQ ID NO: 453820 - DNA, 20 bp, Artificial Sequence
  chemically synthesized
gcaccactgtatccatttat

SEQ ID NO: 453821 - DNA, 20 bp, Artificial Sequence
  chemically synthesized
gactaactgataaatggata

SEQ ID NO: 453822 - DNA, 20 bp, Artificial Sequence
  chemically synthesized
taactgataaatggatacag

SEQ ID NO: 453823 - DNA, 20 bp, Artificial Sequence
  chemically synthesized
aatggatacagtggtgcctt

SEQ ID NO: 453824 - DNA, 20 bp, Artificial Sequence
  chemically synthesized
atggatacagtggtgccttt

SEQ ID NO: 453825 - DNA, 20 bp, Artificial Sequence
  chemically synthesized
tggatacagtggtgcctttg

SEQ ID NO: 453826 - DNA, 20 bp, Artificial Sequence
  chemically synthesized
aaatattttcatcaccccaa

SEQ ID NO: 453827 - DNA, 20 bp, Artificial Sequence
  chemically synthesized
aaaatattttcatcacccca

SEQ ID NO: 453828 - DNA, 20 bp, Artificial Sequence
  chemically synthesized
ttggggtgatgaaaatattt

SEQ ID NO: 453829 - DNA, 20 bp, Artificial Sequence
  chemically synthesized
gaaaatattttggaccaaaa

SEQ ID NO: 453830 - DNA, 20 bp, Artificial Sequence
  chemically synthesized
aaatattttggaccaaaata

SEQ ID NO: 453831 - DNA, 20 bp, Artificial Sequence
  chemically synthesized
tgcaaccatcatctctattt

SEQ ID NO: 453832 - DNA, 20 bp, Artificial Sequence
  chemically synthesized
ttggaccaaaatagagatga

SEQ ID NO: 453833 - DNA, 20 bp, Artificial Sequence
  chemically synthesized
agcatttcgtacattcacga

SEQ ID NO: 453834 - DNA, 20 bp, Artificial Sequence
  chemically synthesized
ttttaaagtgtacaattcaa

SEQ ID NO: 453835 - DNA, 20 bp, Artificial Sequence
  chemically synthesized
ttgaattgtacactttaaaa

SEQ ID NO: 453836 - DNA, 20 bp, Artificial Sequence
  chemically synthesized
acataaaagtaaccatttta

SEQ ID NO: 453837 - DNA, 20 bp, Artificial Sequence
  chemically synthesized
gtaaaattcacataacataa

SEQ ID NO: 453838 - DNA, 20 bp, Artificial Sequence
  chemically synthesized
aggttgcattttttaaattg

SEQ ID NO: 453839 - DNA, 20 bp, Artificial Sequence
  chemically synthesized
gaggttgcattttttaaatt

SEQ ID NO: 453840 - DNA, 20 bp, Artificial Sequence
  chemically synthesized
atttaaaaaatgcaacctca

SEQ ID NO: 453841 - DNA, 20 bp, Artificial Sequence
  chemically synthesized
tggacagtcagagggccatg

SEQ ID NO: 453842 - DNA, 20 bp, Artificial Sequence
  chemically synthesized
atggacagtcagagggccat

SEQ ID NO: 453843 - DNA, 20 bp, Artificial Sequence
  chemically synthesized
ctctctcatggacagtcaga

SEQ ID NO: 453844 - DNA, 20 bp, Artificial Sequence
  chemically synthesized
cctctctcatggacagtcag

SEQ ID NO: 453845 - DNA, 20 bp, Artificial Sequence
  chemically synthesized
gcctctctcatggacagtca

SEQ ID NO: 453846 - DNA, 20 bp, Artificial Sequence
  chemically synthesized
tggcctctctcatggacagt

SEQ ID NO: 453847 - DNA, 20 bp, Artificial Sequence
  chemically synthesized
atggccctctgactgtccat

SEQ ID NO: 453848 - DNA, 20 bp, Artificial Sequence
  chemically synthesized
ggccctctgactgtccatga

SEQ ID NO: 453849 - DNA, 20 bp, Artificial Sequence
  chemically synthesized
agtctggcctctctcatgga

SEQ ID NO: 453850 - DNA, 20 bp, Artificial Sequence
  chemically synthesized
ccctctgactgtccatgaga

SEQ ID NO: 453851 - DNA, 20 bp, Artificial Sequence
  chemically synthesized
cctctgactgtccatgagag

SEQ ID NO: 453852 - DNA, 20 bp, Artificial Sequence
  chemically synthesized
tgcaagtctggcctctctca

SEQ ID NO: 453853 - DNA, 20 bp, Artificial Sequence
  chemically synthesized
tgactgtccatgagagaggc

SEQ ID NO: 453854 - DNA, 20 bp, Artificial Sequence
  chemically synthesized
catgagagaggccagacttg

SEQ ID NO: 453855 - DNA, 20 bp, Artificial Sequence
  chemically synthesized
atgagagaggccagacttgc

SEQ ID NO: 453856 - DNA, 20 bp, Artificial Sequence
  chemically synthesized
cagaccctgccctgcaagtc

SEQ ID NO: 453857 - DNA, 20 bp, Artificial Sequence
  chemically synthesized
tgagagaggccagacttgca

SEQ ID NO: 453858 - DNA, 20 bp, Artificial Sequence
  chemically synthesized
gagaggccagacttgcaggg

SEQ ID NO: 453859 - DNA, 20 bp, Artificial Sequence
  chemically synthesized
agaggccagacttgcagggc

SEQ ID NO: 453860 - DNA, 20 bp, Artificial Sequence
  chemically synthesized
aactgcagaccctgccctgc

SEQ ID NO: 453861 - DNA, 20 bp, Artificial Sequence
  chemically synthesized
gaggccagacttgcagggca

SEQ ID NO: 453862 - DNA, 20 bp, Artificial Sequence
  chemically synthesized
gacttgcagggcagggtctg

SEQ ID NO: 453863 - DNA, 20 bp, Artificial Sequence
  chemically synthesized
tgtgggttctcaggaaactg

SEQ ID NO: 453864 - DNA, 20 bp, Artificial Sequence
  chemically synthesized
ggcagggtctgcagtttcct

SEQ ID NO: 453865 - DNA, 20 bp, Artificial Sequence
  chemically synthesized
gtgtctgcttgtgggttctc

SEQ ID NO: 453866 - DNA, 20 bp, Artificial Sequence
  chemically synthesized
cgtgtctgcttgtgggttct

SEQ ID NO: 453867 - DNA, 20 bp, Artificial Sequence
  chemically synthesized
gcagtttcctgagaacccac

SEQ ID NO: 453868 - DNA, 20 bp, Artificial Sequence
  chemically synthesized
gtttcctgagaacccacaag

SEQ ID NO: 453869 - DNA, 20 bp, Artificial Sequence
  chemically synthesized
ataaggacgtgtctgcttgt

SEQ ID NO: 453870 - DNA, 20 bp, Artificial Sequence
  chemically synthesized
cataaggacgtgtctgcttg

SEQ ID NO: 453871 - DNA, 20 bp, Artificial Sequence
  chemically synthesized
acaagcagacacgtccttat

SEQ ID NO: 453872 - DNA, 20 bp, Artificial Sequence
  chemically synthesized
tccagggcatgcatctcata

SEQ ID NO: 453873 - DNA, 20 bp, Artificial Sequence
  chemically synthesized
ttccagggcatgcatctcat

SEQ ID NO: 453874 - DNA, 20 bp, Artificial Sequence
  chemically synthesized
tccttatgagatgcatgccc

SEQ ID NO: 453875 - DNA, 20 bp, Artificial Sequence
  chemically synthesized
cgttgtgaaagaaatttcca

SEQ ID NO: 453876 - DNA, 20 bp, Artificial Sequence
  chemically synthesized
acgttgtgaaagaaatttcc

SEQ ID NO: 453877 - DNA, 20 bp, Artificial Sequence
  chemically synthesized
cacgttgtgaaagaaatttc

SEQ ID NO: 453878 - DNA, 20 bp, Artificial Sequence
  chemically synthesized
gagtcataaacacgttgtga

SEQ ID NO: 453879 - DNA, 20 bp, Artificial Sequence
  chemically synthesized
cacaacgtgtttatgactcc

SEQ ID NO: 453880 - DNA, 20 bp, Artificial Sequence
  chemically synthesized
gttcagcccaaaatgtccag

SEQ ID NO: 453881 - DNA, 20 bp, Artificial Sequence
  chemically synthesized
ctgttcagcccaaaatgtcc

SEQ ID NO: 453882 - DNA, 20 bp, Artificial Sequence
  chemically synthesized
tttatgactcctggacattt

SEQ ID NO: 453883 - DNA, 20 bp, Artificial Sequence
  chemically synthesized
actgttcagcccaaaatgtc

SEQ ID NO: 453884 - DNA, 20 bp, Artificial Sequence
  chemically synthesized
ttatgactcctggacatttt

SEQ ID NO: 453885 - DNA, 20 bp, Artificial Sequence
  chemically synthesized
cctggacattttgggctgaa

SEQ ID NO: 453886 - DNA, 20 bp, Artificial Sequence
  chemically synthesized
tagcttctcttgtgactgtt

SEQ ID NO: 453887 - DNA, 20 bp, Artificial Sequence
  chemically synthesized
attttgggctgaacagtcac

SEQ ID NO: 453888 - DNA, 20 bp, Artificial Sequence
  chemically synthesized
tttgggctgaacagtcacaa

SEQ ID NO: 453889 - DNA, 20 bp, Artificial Sequence
  chemically synthesized
gggctgaacagtcacaagag

SEQ ID NO: 453890 - DNA, 20 bp, Artificial Sequence
  chemically synthesized
tgaacagtcacaagagaagc

SEQ ID NO: 453891 - DNA, 20 bp, Artificial Sequence
  chemically synthesized
aaaatatgattgagcatgac

SEQ ID NO: 453892 - DNA, 20 bp, Artificial Sequence
  chemically synthesized
catggaagcaaaatatgatt

SEQ ID NO: 453893 - DNA, 20 bp, Artificial Sequence
  chemically synthesized
tcaatcatattttgcttcca

SEQ ID NO: 453894 - DNA, 20 bp, Artificial Sequence
  chemically synthesized
agggtgggaaaatgccatgg

SEQ ID NO: 453895 - DNA, 20 bp, Artificial Sequence
  chemically synthesized
ctgagggtgggaaaatgcca

SEQ ID NO: 453896 - DNA, 20 bp, Artificial Sequence
  chemically synthesized
ccatggcattttcccaccct

SEQ ID NO: 453897 - DNA, 20 bp, Artificial Sequence
  chemically synthesized
aggagtaggaggctgagggt

SEQ ID NO: 453898 - DNA, 20 bp, Artificial Sequence
  chemically synthesized
aaggagtaggaggctgaggg

SEQ ID NO: 453899 - DNA, 20 bp, Artificial Sequence
  chemically synthesized
gaaaaggagtaggaggctga

SEQ ID NO: 453900 - DNA, 20 bp, Artificial Sequence
  chemically synthesized
tgaaaaggagtaggaggctg

SEQ ID NO: 453901 - DNA, 20 bp, Artificial Sequence
  chemically synthesized
atgaaaaggagtaggaggct

SEQ ID NO: 453902 - DNA, 20 bp, Artificial Sequence
  chemically synthesized
tgtctatgaaaaggagtagg

SEQ ID NO: 453903 - DNA, 20 bp, Artificial Sequence
  chemically synthesized
gtgtctatgaaaaggagtag

SEQ ID NO: 453904 - DNA, 20 bp, Artificial Sequence
  chemically synthesized
gtgtgtctatgaaaaggagt

SEQ ID NO: 453905 - DNA, 20 bp, Artificial Sequence
  chemically synthesized
tgtgtgtctatgaaaaggag

SEQ ID NO: 453906 - DNA, 20 bp, Artificial Sequence
  chemically synthesized
cagcctcctactccttttca

SEQ ID NO: 453907 - DNA, 20 bp, Artificial Sequence
  chemically synthesized
gtgtgtgtgtctatgaaaag

SEQ ID NO: 453908 - DNA, 20 bp, Artificial Sequence
  chemically synthesized
ttgtgtgtgtgtctatgaaa

SEQ ID NO: 453909 - DNA, 20 bp, Artificial Sequence
  chemically synthesized
tttgtgtgtgtgtctatgaa

SEQ ID NO: 453910 - DNA, 20 bp, Artificial Sequence
  chemically synthesized
ggctggatccatagatatag

SEQ ID NO: 453911 - DNA, 20 bp, Artificial Sequence
  chemically synthesized
aacacattctgctatatcta

SEQ ID NO: 453912 - DNA, 20 bp, Artificial Sequence
  chemically synthesized
agaggctggatccatagata

SEQ ID NO: 453913 - DNA, 20 bp, Artificial Sequence
  chemically synthesized
ttctgctatatctatggatc

SEQ ID NO: 453914 - DNA, 20 bp, Artificial Sequence
  chemically synthesized
gggctcagaggctggatcca

SEQ ID NO: 453915 - DNA, 20 bp, Artificial Sequence
  chemically synthesized
tatctatggatccagcctct

SEQ ID NO: 453916 - DNA, 20 bp, Artificial Sequence
  chemically synthesized
caccttgagggctcagaggc

SEQ ID NO: 453917 - DNA, 20 bp, Artificial Sequence
  chemically synthesized
cctccaccttgagggctcag

SEQ ID NO: 453918 - DNA, 20 bp, Artificial Sequence
  chemically synthesized
tcctccaccttgagggctca

SEQ ID NO: 453919 - DNA, 20 bp, Artificial Sequence
  chemically synthesized
gatccagcctctgagccctc

SEQ ID NO: 453920 - DNA, 20 bp, Artificial Sequence
  chemically synthesized
actcctccaccttgagggct

SEQ ID NO: 453921 - DNA, 20 bp, Artificial Sequence
  chemically synthesized
atccagcctctgagccctca

SEQ ID NO: 453922 - DNA, 20 bp, Artificial Sequence
  chemically synthesized
cagcctctgagccctcaagg

SEQ ID NO: 453923 - DNA, 20 bp, Artificial Sequence
  chemically synthesized
tgtgaactcctccaccttga

SEQ ID NO: 453924 - DNA, 20 bp, Artificial Sequence
  chemically synthesized
gcctctgagccctcaaggtg

SEQ ID NO: 453925 - DNA, 20 bp, Artificial Sequence
  chemically synthesized
ttgtgaactcctccaccttg

SEQ ID NO: 453926 - DNA, 20 bp, Artificial Sequence
  chemically synthesized
cctctgagccctcaaggtgg

SEQ ID NO: 453927 - DNA, 20 bp, Artificial Sequence
  chemically synthesized
cttgtgaactcctccacctt

SEQ ID NO: 453928 - DNA, 20 bp, Artificial Sequence
  chemically synthesized
tctgagccctcaaggtggag

SEQ ID NO: 453929 - DNA, 20 bp, Artificial Sequence
  chemically synthesized
ctcaaggtggaggagttcac

SEQ ID NO: 453930 - DNA, 20 bp, Artificial Sequence
  chemically synthesized
aaggtggaggagttcacaag

SEQ ID NO: 453931 - DNA, 20 bp, Artificial Sequence
  chemically synthesized
aggtggaggagttcacaagc

SEQ ID NO: 453932 - DNA, 20 bp, Artificial Sequence
  chemically synthesized
tattatggcaaatagatgag

SEQ ID NO: 453933 - DNA, 20 bp, Artificial Sequence
  chemically synthesized
cattattatggcaaatagat

SEQ ID NO: 453934 - DNA, 20 bp, Artificial Sequence
  chemically synthesized
agtaacattattatggcaaa

SEQ ID NO: 453935 - DNA, 20 bp, Artificial Sequence
  chemically synthesized
tttctgaagtaacattatta

SEQ ID NO: 453936 - DNA, 20 bp, Artificial Sequence
  chemically synthesized
ttgccataataatgttactt

SEQ ID NO: 453937 - DNA, 20 bp, Artificial Sequence
  chemically synthesized
ctatttgtgtaacatttctg

SEQ ID NO: 453938 - DNA, 20 bp, Artificial Sequence
  chemically synthesized
cttcagaaatgttacacaaa

SEQ ID NO: 453939 - DNA, 20 bp, Artificial Sequence
  chemically synthesized
tcagaaatgttacacaaata

SEQ ID NO: 453940 - DNA, 20 bp, Artificial Sequence
  chemically synthesized
aatgttacacaaatagagac

SEQ ID NO: 453941 - DNA, 20 bp, Artificial Sequence
  chemically synthesized
acacaaatagagaccagatg

SEQ ID NO: 453942 - DNA, 20 bp, Artificial Sequence
  chemically synthesized
caaatagagaccagatgcag

SEQ ID NO: 453943 - DNA, 20 bp, Artificial Sequence
  chemically synthesized
caggtgtgagccactgcatc

SEQ ID NO: 453944 - DNA, 20 bp, Artificial Sequence
  chemically synthesized
aatgctgagattacaggtgt

SEQ ID NO: 453945 - DNA, 20 bp, Artificial Sequence
  chemically synthesized
gtggctcacacctgtaatct

SEQ ID NO: 453946 - DNA, 20 bp, Artificial Sequence
  chemically synthesized
tctcgaaatgctgagattac

SEQ ID NO: 453947 - DNA, 20 bp, Artificial Sequence
  chemically synthesized
ttctcgaaatgctgagatta

SEQ ID NO: 453948 - DNA, 20 bp, Artificial Sequence
  chemically synthesized
ccttgacttctcgaaatgct

SEQ ID NO: 453949 - DNA, 20 bp, Artificial Sequence
  chemically synthesized
acctgtaatctcagcatttc

SEQ ID NO: 453950 - DNA, 20 bp, Artificial Sequence
  chemically synthesized
tgtaatctcagcatttcgag

SEQ ID NO: 453951 - DNA, 20 bp, Artificial Sequence
  chemically synthesized
tctcagcatttcgagaagtc

SEQ ID NO: 453952 - DNA, 20 bp, Artificial Sequence
  chemically synthesized
ctcagcatttcgagaagtca

SEQ ID NO: 453953 - DNA, 20 bp, Artificial Sequence
  chemically synthesized
agcatttcgagaagtcaagg

SEQ ID NO: 453954 - DNA, 20 bp, Artificial Sequence
  chemically synthesized
gcatttcgagaagtcaaggc

SEQ ID NO: 453955 - DNA, 20 bp, Artificial Sequence
  chemically synthesized
atttcgagaagtcaaggcgg

SEQ ID NO: 453956 - DNA, 20 bp, Artificial Sequence
  chemically synthesized
tttcgagaagtcaaggcggg

SEQ ID NO: 453957 - DNA, 20 bp, Artificial Sequence
  chemically synthesized
agtcaaggcgggaggatcgc

SEQ ID NO: 453958 - DNA, 20 bp, Artificial Sequence
  chemically synthesized
tcaaggcgggaggatcgctg

SEQ ID NO: 453959 - DNA, 20 bp, Artificial Sequence
  chemically synthesized
gcgggaggatcgctggagac

SEQ ID NO: 453960 - DNA, 20 bp, Artificial Sequence
  chemically synthesized
cgggaggatcgctggagacc

SEQ ID NO: 453961 - DNA, 20 bp, Artificial Sequence
  chemically synthesized
gggaggatcgctggagacca

SEQ ID NO: 453962 - DNA, 20 bp, Artificial Sequence
  chemically synthesized
agaccaggatccctggtctc

SEQ ID NO: 453963 - DNA, 20 bp, Artificial Sequence
  chemically synthesized
tcgctggagaccagggatcc

SEQ ID NO: 453964 - DNA, 20 bp, Artificial Sequence
  chemically synthesized
tggtgacagaccaggatccc

SEQ ID NO: 453965 - DNA, 20 bp, Artificial Sequence
  chemically synthesized
tctcactatggtgacagacc

SEQ ID NO: 453966 - DNA, 20 bp, Artificial Sequence
  chemically synthesized
gtctcactatggtgacagac

SEQ ID NO: 453967 - DNA, 20 bp, Artificial Sequence
  chemically synthesized
gggatcctggtctgtcacca

SEQ ID NO: 453968 - DNA, 20 bp, Artificial Sequence
  chemically synthesized
acagggtctcactatggtga

SEQ ID NO: 453969 - DNA, 20 bp, Artificial Sequence
  chemically synthesized
tcctggtctgtcaccatagt

SEQ ID NO: 453970 - DNA, 20 bp, Artificial Sequence
  chemically synthesized
gtgtagacagggtctcacta

SEQ ID NO: 453971 - DNA, 20 bp, Artificial Sequence
  chemically synthesized
aaaattgttttgtgtagaca

SEQ ID NO: 453972 - DNA, 20 bp, Artificial Sequence
  chemically synthesized
aaaaattgttttgtgtagac

SEQ ID NO: 453973 - DNA, 20 bp, Artificial Sequence
  chemically synthesized
taaaaattgttttgtgtaga

SEQ ID NO: 453974 - DNA, 20 bp, Artificial Sequence
  chemically synthesized
tttttaaaaattgttttgtg

SEQ ID NO: 453975 - DNA, 20 bp, Artificial Sequence
  chemically synthesized
cacaaaacaatttttaaaaa

SEQ ID NO: 453976 - DNA, 20 bp, Artificial Sequence
  chemically synthesized
acaaaacaatttttaaaaat

SEQ ID NO: 453977 - DNA, 20 bp, Artificial Sequence
  chemically synthesized
aacaatttttaaaaatgggc

SEQ ID NO: 453978 - DNA, 20 bp, Artificial Sequence
  chemically synthesized
acaatttttaaaaatgggcc

SEQ ID NO: 453979 - DNA, 20 bp, Artificial Sequence
  chemically synthesized
ttttaaaaatgggccaggtg

SEQ ID NO: 453980 - DNA, 20 bp, Artificial Sequence
  chemically synthesized
taaaaatgggccaggtgtgg

SEQ ID NO: 453981 - DNA, 20 bp, Artificial Sequence
  chemically synthesized
caggcacacaccaccacacc

SEQ ID NO: 453982 - DNA, 20 bp, Artificial Sequence
  chemically synthesized
ggtgtggtggtgtgtgcctg

SEQ ID NO: 453983 - DNA, 20 bp, Artificial Sequence
  chemically synthesized
gtggtgtgtgcctgtagtcc

SEQ ID NO: 453984 - DNA, 20 bp, Artificial Sequence
  chemically synthesized
ttctgaatagctgggactac

SEQ ID NO: 453985 - DNA, 20 bp, Artificial Sequence
  chemically synthesized
tttctgaatagctgggacta

SEQ ID NO: 453986 - DNA, 20 bp, Artificial Sequence
  chemically synthesized
tgcctgtagtcccagctatt

SEQ ID NO: 453987 - DNA, 20 bp, Artificial Sequence
  chemically synthesized
cctcagctttctgaatagct

SEQ ID NO: 453988 - DNA, 20 bp, Artificial Sequence
  chemically synthesized
gcctcagctttctgaatagc

SEQ ID NO: 453989 - DNA, 20 bp, Artificial Sequence
  chemically synthesized
tgtagtcccagctattcaga

SEQ ID NO: 453990 - DNA, 20 bp, Artificial Sequence
  chemically synthesized
tcctgcctcagctttctgaa

SEQ ID NO: 453991 - DNA, 20 bp, Artificial Sequence
  chemically synthesized
tcccagctattcagaaagct

SEQ ID NO: 453992 - DNA, 20 bp, Artificial Sequence
  chemically synthesized
cccagctattcagaaagctg

SEQ ID NO: 453993 - DNA, 20 bp, Artificial Sequence
  chemically synthesized
agctattcagaaagctgagg

SEQ ID NO: 453994 - DNA, 20 bp, Artificial Sequence
  chemically synthesized
gctattcagaaagctgaggc

SEQ ID NO: 453995 - DNA, 20 bp, Artificial Sequence
  chemically synthesized
tattcagaaagctgaggcag

SEQ ID NO: 453996 - DNA, 20 bp, Artificial Sequence
  chemically synthesized
ctcaagtaatactcctgcct

SEQ ID NO: 453997 - DNA, 20 bp, Artificial Sequence
  chemically synthesized
ctgaggcaggagtattactt

SEQ ID NO: 453998 - DNA, 20 bp, Artificial Sequence
  chemically synthesized
gcaggagtattacttgagcc

SEQ ID NO: 453999 - DNA, 20 bp, Artificial Sequence
  chemically synthesized
caggagtattacttgagccc

SEQ ID NO: 454000 - DNA, 20 bp, Artificial Sequence
  chemically synthesized
agccttgaagtcctgggctc

SEQ ID NO: 454001 - DNA, 20 bp, Artificial Sequence
  chemically synthesized
cactgcagccttgaagtcct

SEQ ID NO: 454002 - DNA, 20 bp, Artificial Sequence
  chemically synthesized
ttacttgagcccaggacttc

SEQ ID NO: 454003 - DNA, 20 bp, Artificial Sequence
  chemically synthesized
tcactgcagccttgaagtcc

SEQ ID NO: 454004 - DNA, 20 bp, Artificial Sequence
  chemically synthesized
tacttgagcccaggacttca

SEQ ID NO: 454005 - DNA, 20 bp, Artificial Sequence
  chemically synthesized
tgtagctcactgcagccttg

SEQ ID NO: 454006 - DNA, 20 bp, Artificial Sequence
  chemically synthesized
agcccaggacttcaaggctg

SEQ ID NO: 454007 - DNA, 20 bp, Artificial Sequence
  chemically synthesized
caggacttcaaggctgcagt

SEQ ID NO: 454008 - DNA, 20 bp, Artificial Sequence
  chemically synthesized
ggtgcgattgtagctcactg

SEQ ID NO: 454009 - DNA, 20 bp, Artificial Sequence
  chemically synthesized
agagtgcagtggtgcgattg

SEQ ID NO: 454010 - DNA, 20 bp, Artificial Sequence
  chemically synthesized
ttgcccaggctagagtgcag

SEQ ID NO: 454011 - DNA, 20 bp, Artificial Sequence
  chemically synthesized
acaatcgcaccactgcactc

SEQ ID NO: 454012 - DNA, 20 bp, Artificial Sequence
  chemically synthesized
ctcttgcccaggctagagtg

SEQ ID NO: 454013 - DNA, 20 bp, Artificial Sequence
  chemically synthesized
cgcaccactgcactctagcc

SEQ ID NO: 454014 - DNA, 20 bp, Artificial Sequence
  chemically synthesized
gcaccactgcactctagcct

SEQ ID NO: 454015 - DNA, 20 bp, Artificial Sequence
  chemically synthesized
tctcactcttgcccaggcta

SEQ ID NO: 454016 - DNA, 20 bp, Artificial Sequence
  chemically synthesized
gttctcactcttgcccaggc

SEQ ID NO: 454017 - DNA, 20 bp, Artificial Sequence
  chemically synthesized
cactgcactctagcctgggc

SEQ ID NO: 454018 - DNA, 20 bp, Artificial Sequence
  chemically synthesized
ctgcactctagcctgggcaa

SEQ ID NO: 454019 - DNA, 20 bp, Artificial Sequence
  chemically synthesized
acaggttctcactcttgccc

SEQ ID NO: 454020 - DNA, 20 bp, Artificial Sequence
  chemically synthesized
gacaggttctcactcttgcc

SEQ ID NO: 454021 - DNA, 20 bp, Artificial Sequence
  chemically synthesized
actctagcctgggcaagagt

SEQ ID NO: 454022 - DNA, 20 bp, Artificial Sequence
  chemically synthesized
tgcttgtttgtttttgagac

SEQ ID NO: 454023 - DNA, 20 bp, Artificial Sequence
  chemically synthesized
ttgcttgtttgtttttgaga

SEQ ID NO: 454024 - DNA, 20 bp, Artificial Sequence
  chemically synthesized
ttgcttgcttgtttgttttt

SEQ ID NO: 454025 - DNA, 20 bp, Artificial Sequence
  chemically synthesized
aacctgtctcaaaaacaaac

SEQ ID NO: 454026 - DNA, 20 bp, Artificial Sequence
  chemically synthesized
tgtctcaaaaacaaacaagc

SEQ ID NO: 454027 - DNA, 20 bp, Artificial Sequence
  chemically synthesized
aacaagcaagcaaaaacaaa

SEQ ID NO: 454028 - DNA, 20 bp, Artificial Sequence
  chemically synthesized
catgcaatatacattcattt

SEQ ID NO: 454029 - DNA, 20 bp, Artificial Sequence
  chemically synthesized
gttgaaatgtaaaaaaggaa

SEQ ID NO: 454030 - DNA, 20 bp, Artificial Sequence
  chemically synthesized
taaaagttgaaatgtaaaaa

SEQ ID NO: 454031 - DNA, 20 bp, Artificial Sequence
  chemically synthesized
ataaaagttgaaatgtaaaa

SEQ ID NO: 454032 - DNA, 20 bp, Artificial Sequence
  chemically synthesized
accccctggatgtaaaataa

SEQ ID NO: 454033 - DNA, 20 bp, Artificial Sequence
  chemically synthesized
ttcaacttttattttacatc

SEQ ID NO: 454034 - DNA, 20 bp, Artificial Sequence
  chemically synthesized
tcaacttttattttacatcc

SEQ ID NO: 454035 - DNA, 20 bp, Artificial Sequence
  chemically synthesized
caacttttattttacatcca

SEQ ID NO: 454036 - DNA, 20 bp, Artificial Sequence
  chemically synthesized
aacttttattttacatccag

SEQ ID NO: 454037 - DNA, 20 bp, Artificial Sequence
  chemically synthesized
acttttattttacatccagg

SEQ ID NO: 454038 - DNA, 20 bp, Artificial Sequence
  chemically synthesized
aaacctgcatatataccccc

SEQ ID NO: 454039 - DNA, 20 bp, Artificial Sequence
  chemically synthesized
acatccagggggtatatatg

SEQ ID NO: 454040 - DNA, 20 bp, Artificial Sequence
  chemically synthesized
catccagggggtatatatgc

SEQ ID NO: 454041 - DNA, 20 bp, Artificial Sequence
  chemically synthesized
tatatatgcaggtttgttac

SEQ ID NO: 454042 - DNA, 20 bp, Artificial Sequence
  chemically synthesized
tatatgcaggtttgttacaa

SEQ ID NO: 454043 - DNA, 20 bp, Artificial Sequence
  chemically synthesized
gagtatattgtgtgatattt

SEQ ID NO: 454044 - DNA, 20 bp, Artificial Sequence
  chemically synthesized
tattgtgtgatatttaagtc

SEQ ID NO: 454045 - DNA, 20 bp, Artificial Sequence
  chemically synthesized
attgtgtgatatttaagtct

SEQ ID NO: 454046 - DNA, 20 bp, Artificial Sequence
  chemically synthesized
ttgtgtgatatttaagtctg

SEQ ID NO: 454047 - DNA, 20 bp, Artificial Sequence
  chemically synthesized
tgatgacttcagttgtaccc

SEQ ID NO: 454048 - DNA, 20 bp, Artificial Sequence
  chemically synthesized
ttaagtctggggtacaactg

SEQ ID NO: 454049 - DNA, 20 bp, Artificial Sequence
  chemically synthesized
cactacctgggtgatgactt

SEQ ID NO: 454050 - DNA, 20 bp, Artificial Sequence
  chemically synthesized
gtacaactgaagtcatcacc

SEQ ID NO: 454051 - DNA, 20 bp, Artificial Sequence
  chemically synthesized
tacaactgaagtcatcaccc

SEQ ID NO: 454052 - DNA, 20 bp, Artificial Sequence
  chemically synthesized
aactgaagtcatcacccagg

SEQ ID NO: 454053 - DNA, 20 bp, Artificial Sequence
  chemically synthesized
gaagtcatcacccaggtagt

SEQ ID NO: 454054 - DNA, 20 bp, Artificial Sequence
  chemically synthesized
gggtactatgctcactacct

SEQ ID NO: 454055 - DNA, 20 bp, Artificial Sequence
  chemically synthesized
tgggtactatgctcactacc

SEQ ID NO: 454056 - DNA, 20 bp, Artificial Sequence
  chemically synthesized
catcacccaggtagtgagca

SEQ ID NO: 454057 - DNA, 20 bp, Artificial Sequence
  chemically synthesized
gtagtgagcatagtacccaa

SEQ ID NO: 454058 - DNA, 20 bp, Artificial Sequence
  chemically synthesized
tagtgagcatagtacccaat

SEQ ID NO: 454059 - DNA, 20 bp, Artificial Sequence
  chemically synthesized
tgagcatagtacccaatagg

SEQ ID NO: 454060 - DNA, 20 bp, Artificial Sequence
  chemically synthesized
aggctgaaaagctacctatt

SEQ ID NO: 454061 - DNA, 20 bp, Artificial Sequence
  chemically synthesized
aaggctgaaaagctacctat

SEQ ID NO: 454062 - DNA, 20 bp, Artificial Sequence
  chemically synthesized
gtacccaataggtagctttt

SEQ ID NO: 454063 - DNA, 20 bp, Artificial Sequence
  chemically synthesized
aggaaggggcaaaggctgaa

SEQ ID NO: 454064 - DNA, 20 bp, Artificial Sequence
  chemically synthesized
ggggagggaggaaggggcaa

SEQ ID NO: 454065 - DNA, 20 bp, Artificial Sequence
  chemically synthesized
aggggagggaggaaggggca

SEQ ID NO: 454066 - DNA, 20 bp, Artificial Sequence
  chemically synthesized
aatcgaggggagggaggaag

SEQ ID NO: 454067 - DNA, 20 bp, Artificial Sequence
  chemically synthesized
caatcgaggggagggaggaa

SEQ ID NO: 454068 - DNA, 20 bp, Artificial Sequence
  chemically synthesized
acaatcgaggggagggagga

SEQ ID NO: 454069 - DNA, 20 bp, Artificial Sequence
  chemically synthesized
tacaatcgaggggagggagg

SEQ ID NO: 454070 - DNA, 20 bp, Artificial Sequence
  chemically synthesized
gactacaatcgaggggaggg

SEQ ID NO: 454071 - DNA, 20 bp, Artificial Sequence
  chemically synthesized
ggactacaatcgaggggagg

SEQ ID NO: 454072 - DNA, 20 bp, Artificial Sequence
  chemically synthesized
ggggactacaatcgagggga

SEQ ID NO: 454073 - DNA, 20 bp, Artificial Sequence
  chemically synthesized
tggggactacaatcgagggg

SEQ ID NO: 454074 - DNA, 20 bp, Artificial Sequence
  chemically synthesized
ctggggactacaatcgaggg

SEQ ID NO: 454075 - DNA, 20 bp, Artificial Sequence
  chemically synthesized
ctctggggactacaatcgag

SEQ ID NO: 454076 - DNA, 20 bp, Artificial Sequence
  chemically synthesized
ttcctccctcccctcgattg

SEQ ID NO: 454077 - DNA, 20 bp, Artificial Sequence
  chemically synthesized
actctggggactacaatcga

SEQ ID NO: 454078 - DNA, 20 bp, Artificial Sequence
  chemically synthesized
gactctggggactacaatcg

SEQ ID NO: 454079 - DNA, 20 bp, Artificial Sequence
  chemically synthesized
agactctggggactacaatc

SEQ ID NO: 454080 - DNA, 20 bp, Artificial Sequence
  chemically synthesized
ctcccctcgattgtagtccc

SEQ ID NO: 454081 - DNA, 20 bp, Artificial Sequence
  chemically synthesized
cccctcgattgtagtcccca

SEQ ID NO: 454082 - DNA, 20 bp, Artificial Sequence
  chemically synthesized
gatgagaacagtagactctg

SEQ ID NO: 454083 - DNA, 20 bp, Artificial Sequence
  chemically synthesized
agatgagaacagtagactct

SEQ ID NO: 454084 - DNA, 20 bp, Artificial Sequence
  chemically synthesized
aagatgagaacagtagactc

SEQ ID NO: 454085 - DNA, 20 bp, Artificial Sequence
  chemically synthesized
gaacataaagatgagaacag

SEQ ID NO: 454086 - DNA, 20 bp, Artificial Sequence
  chemically synthesized
catgaacataaagatgagaa

SEQ ID NO: 454087 - DNA, 20 bp, Artificial Sequence
  chemically synthesized
gtacacatgaacataaagat

SEQ ID NO: 454088 - DNA, 20 bp, Artificial Sequence
  chemically synthesized
actgagtacacatgaacata

SEQ ID NO: 454089 - DNA, 20 bp, Artificial Sequence
  chemically synthesized
tctttatgttcatgtgtact

SEQ ID NO: 454090 - DNA, 20 bp, Artificial Sequence
  chemically synthesized
gttcatgtgtactcagtgtt

SEQ ID NO: 454091 - DNA, 20 bp, Artificial Sequence
  chemically synthesized
ataagtgggagctaaacact

SEQ ID NO: 454092 - DNA, 20 bp, Artificial Sequence
  chemically synthesized
acgttctcacttataagtgg

SEQ ID NO: 454093 - DNA, 20 bp, Artificial Sequence
  chemically synthesized
agtgtttagctcccacttat

SEQ ID NO: 454094 - DNA, 20 bp, Artificial Sequence
  chemically synthesized
acacgttctcacttataagt

SEQ ID NO: 454095 - DNA, 20 bp, Artificial Sequence
  chemically synthesized
cacacgttctcacttataag

SEQ ID NO: 454096 - DNA, 20 bp, Artificial Sequence
  chemically synthesized
tttagctcccacttataagt

SEQ ID NO: 454097 - DNA, 20 bp, Artificial Sequence
  chemically synthesized
caccacacgttctcacttat

SEQ ID NO: 454098 - DNA, 20 bp, Artificial Sequence
  chemically synthesized
cacttataagtgagaacgtg

SEQ ID NO: 454099 - DNA, 20 bp, Artificial Sequence
  chemically synthesized
aagtgagaacgtgtggtgct

SEQ ID NO: 454100 - DNA, 20 bp, Artificial Sequence
  chemically synthesized
taacacagaaacagaaaacc

SEQ ID NO: 454101 - DNA, 20 bp, Artificial Sequence
  chemically synthesized
taagcgaattaacacagaaa

SEQ ID NO: 454102 - DNA, 20 bp, Artificial Sequence
  chemically synthesized
ttatcctaagcgaattaaca

SEQ ID NO: 454103 - DNA, 20 bp, Artificial Sequence
  chemically synthesized
tgtttctgtgttaattcgct

SEQ ID NO: 454104 - DNA, 20 bp, Artificial Sequence
  chemically synthesized
gtttctgtgttaattcgctt

SEQ ID NO: 454105 - DNA, 20 bp, Artificial Sequence
  chemically synthesized
gagctggaggacattatcct

SEQ ID NO: 454106 - DNA, 20 bp, Artificial Sequence
  chemically synthesized
tcgcttaggataatgtcctc

SEQ ID NO: 454107 - DNA, 20 bp, Artificial Sequence
  chemically synthesized
aacaacattgatggagctgg

SEQ ID NO: 454108 - DNA, 20 bp, Artificial Sequence
  chemically synthesized
caacaacattgatggagctg

SEQ ID NO: 454109 - DNA, 20 bp, Artificial Sequence
  chemically synthesized
tgcaacaacattgatggagc

SEQ ID NO: 454110 - DNA, 20 bp, Artificial Sequence
  chemically synthesized
cctttgcaacaacattgatg

SEQ ID NO: 454111 - DNA, 20 bp, Artificial Sequence
  chemically synthesized
atcctttgcaacaacattga

SEQ ID NO: 454112 - DNA, 20 bp, Artificial Sequence
  chemically synthesized
gctccatcaatgttgttgca

SEQ ID NO: 454113 - DNA, 20 bp, Artificial Sequence
  chemically synthesized
ctccatcaatgttgttgcaa

SEQ ID NO: 454114 - DNA, 20 bp, Artificial Sequence
  chemically synthesized
atcctatgcagcaataaaaa

SEQ ID NO: 454115 - DNA, 20 bp, Artificial Sequence
  chemically synthesized
tttctttttttattgctgca

SEQ ID NO: 454116 - DNA, 20 bp, Artificial Sequence
  chemically synthesized
ttctttttttattgctgcat

SEQ ID NO: 454117 - DNA, 20 bp, Artificial Sequence
  chemically synthesized
acacatcatgaaatcctatg

SEQ ID NO: 454118 - DNA, 20 bp, Artificial Sequence
  chemically synthesized
ttgattggctgaagaaaata

SEQ ID NO: 454119 - DNA, 20 bp, Artificial Sequence
  chemically synthesized
tgtatgtaccatattttctt

SEQ ID NO: 454120 - DNA, 20 bp, Artificial Sequence
  chemically synthesized
ccacaatggttgattggctg

SEQ ID NO: 454121 - DNA, 20 bp, Artificial Sequence
  chemically synthesized
acatgcccacaatggttgat

SEQ ID NO: 454122 - DNA, 20 bp, Artificial Sequence
  chemically synthesized
cttcagccaatcaaccattg

SEQ ID NO: 454123 - DNA, 20 bp, Artificial Sequence
  chemically synthesized
ttcagccaatcaaccattgt

SEQ ID NO: 454124 - DNA, 20 bp, Artificial Sequence
  chemically synthesized
atcaacctacatgcccacaa

SEQ ID NO: 454125 - DNA, 20 bp, Artificial Sequence
  chemically synthesized
aatcaaccattgtgggcatg

SEQ ID NO: 454126 - DNA, 20 bp, Artificial Sequence
  chemically synthesized
atcaaccattgtgggcatgt

SEQ ID NO: 454127 - DNA, 20 bp, Artificial Sequence
  chemically synthesized
tgttcacaatagcaaagatg

SEQ ID NO: 454128 - DNA, 20 bp, Artificial Sequence
  chemically synthesized
cagcactgttcacaatagca

SEQ ID NO: 454129 - DNA, 20 bp, Artificial Sequence
  chemically synthesized
cacatctttgctattgtgaa

SEQ ID NO: 454130 - DNA, 20 bp, Artificial Sequence
  chemically synthesized
cattacagcactgttcacaa

SEQ ID NO: 454131 - DNA, 20 bp, Artificial Sequence
  chemically synthesized
atgcactgggatgttcatta

SEQ ID NO: 454132 - DNA, 20 bp, Artificial Sequence
  chemically synthesized
cagtgctgtaatgaacatcc

SEQ ID NO: 454133 - DNA, 20 bp, Artificial Sequence
  chemically synthesized
taccaaaaatcatatgcact

SEQ ID NO: 454134 - DNA, 20 bp, Artificial Sequence
  chemically synthesized
ctaccaaaaatcatatgcac

SEQ ID NO: 454135 - DNA, 20 bp, Artificial Sequence
  chemically synthesized
atcccagtgcatatgatttt

SEQ ID NO: 454136 - DNA, 20 bp, Artificial Sequence
  chemically synthesized
ccagtgcatatgatttttgg

SEQ ID NO: 454137 - DNA, 20 bp, Artificial Sequence
  chemically synthesized
ggtttatacccaaaggaaaa

SEQ ID NO: 454138 - DNA, 20 bp, Artificial Sequence
  chemically synthesized
tagaataatctattttcctt

SEQ ID NO: 454139 - DNA, 20 bp, Artificial Sequence
  chemically synthesized
agaataatctattttccttt

SEQ ID NO: 454140 - DNA, 20 bp, Artificial Sequence
  chemically synthesized
attactgggtttatacccaa

SEQ ID NO: 454141 - DNA, 20 bp, Artificial Sequence
  chemically synthesized
cattactgggtttataccca

SEQ ID NO: 454142 - DNA, 20 bp, Artificial Sequence
  chemically synthesized
ttttcctttgggtataaacc

SEQ ID NO: 454143 - DNA, 20 bp, Artificial Sequence
  chemically synthesized
ttgggtataaacccagtaat

SEQ ID NO: 454144 - DNA, 20 bp, Artificial Sequence
  chemically synthesized
gacccagcaatctcattact

SEQ ID NO: 454145 - DNA, 20 bp, Artificial Sequence
  chemically synthesized
tgacccagcaatctcattac

SEQ ID NO: 454146 - DNA, 20 bp, Artificial Sequence
  chemically synthesized
aaacccagtaatgagattgc

SEQ ID NO: 454147 - DNA, 20 bp, Artificial Sequence
  chemically synthesized
aacccagtaatgagattgct

SEQ ID NO: 454148 - DNA, 20 bp, Artificial Sequence
  chemically synthesized
aatgagattgctgggtcaaa

SEQ ID NO: 454149 - DNA, 20 bp, Artificial Sequence
  chemically synthesized
gtaaggactaccatttgacc

SEQ ID NO: 454150 - DNA, 20 bp, Artificial Sequence
  chemically synthesized
gagattgctgggtcaaatgg

SEQ ID NO: 454151 - DNA, 20 bp, Artificial Sequence
  chemically synthesized
caaatggtagtccttacttt

SEQ ID NO: 454152 - DNA, 20 bp, Artificial Sequence
  chemically synthesized
ttctcgaagaactaaaagta

SEQ ID NO: 454153 - DNA, 20 bp, Artificial Sequence
  chemically synthesized
tttctcgaagaactaaaagt

SEQ ID NO: 454154 - DNA, 20 bp, Artificial Sequence
  chemically synthesized
gagatttctcgaagaactaa

SEQ ID NO: 454155 - DNA, 20 bp, Artificial Sequence
  chemically synthesized
gtccttacttttagttcttc

SEQ ID NO: 454156 - DNA, 20 bp, Artificial Sequence
  chemically synthesized
agcagtttggagatttctcg

SEQ ID NO: 454157 - DNA, 20 bp, Artificial Sequence
  chemically synthesized
ctactgtgaaaagcagtttg

SEQ ID NO: 454158 - DNA, 20 bp, Artificial Sequence
  chemically synthesized
ggctactgtgaaaagcagtt

SEQ ID NO: 454159 - DNA, 20 bp, Artificial Sequence
  chemically synthesized
aatctccaaactgcttttca

SEQ ID NO: 454160 - DNA, 20 bp, Artificial Sequence
  chemically synthesized
aggtcggctactgtgaaaag

SEQ ID NO: 454161 - DNA, 20 bp, Artificial Sequence
  chemically synthesized
ctccaaactgcttttcacag

SEQ ID NO: 454162 - DNA, 20 bp, Artificial Sequence
  chemically synthesized
attaggtcggctactgtgaa

SEQ ID NO: 454163 - DNA, 20 bp, Artificial Sequence
  chemically synthesized
tgtgggagtgtaaattaggt

SEQ ID NO: 454164 - DNA, 20 bp, Artificial Sequence
  chemically synthesized
tgtttgtgggagtgtaaatt

SEQ ID NO: 454165 - DNA, 20 bp, Artificial Sequence
  chemically synthesized
ctgtttgtgggagtgtaaat

SEQ ID NO: 454166 - DNA, 20 bp, Artificial Sequence
  chemically synthesized
ctaatttacactcccacaaa

SEQ ID NO: 454167 - DNA, 20 bp, Artificial Sequence
  chemically synthesized
ttttactttactgtttgtgg

SEQ ID NO: 454168 - DNA, 20 bp, Artificial Sequence
  chemically synthesized
ttttttactttactgtttgt

SEQ ID NO: 454169 - DNA, 20 bp, Artificial Sequence
  chemically synthesized
cttttttactttactgtttg

SEQ ID NO: 454170 - DNA, 20 bp, Artificial Sequence
  chemically synthesized
ttacactcccacaaacagta

SEQ ID NO: 454171 - DNA, 20 bp, Artificial Sequence
  chemically synthesized
ccacaaacagtaaagtaaaa

SEQ ID NO: 454172 - DNA, 20 bp, Artificial Sequence
  chemically synthesized
cacaaacagtaaagtaaaaa

SEQ ID NO: 454173 - DNA, 20 bp, Artificial Sequence
  chemically synthesized
cagtaaagtaaaaaaggaca

SEQ ID NO: 454174 - DNA, 20 bp, Artificial Sequence
  chemically synthesized
taaagtaaaaaaggacaaag

SEQ ID NO: 454175 - DNA, 20 bp, Artificial Sequence
  chemically synthesized
aaagtaaaaaaggacaaaga

SEQ ID NO: 454176 - DNA, 20 bp, Artificial Sequence
  chemically synthesized
ttacaccctttatcattatg

SEQ ID NO: 454177 - DNA, 20 bp, Artificial Sequence
  chemically synthesized
aaggtcactacataatgata

SEQ ID NO: 454178 - DNA, 20 bp, Artificial Sequence
  chemically synthesized
aggtcactacataatgataa

SEQ ID NO: 454179 - DNA, 20 bp, Artificial Sequence
  chemically synthesized
ggtcactacataatgataaa

SEQ ID NO: 454180 - DNA, 20 bp, Artificial Sequence
  chemically synthesized
gataaagggtgtaattcaac

SEQ ID NO: 454181 - DNA, 20 bp, Artificial Sequence
  chemically synthesized
gggtgcatatatatttatga

SEQ ID NO: 454182 - DNA, 20 bp, Artificial Sequence
  chemically synthesized
atcataaatatatatgcacc

SEQ ID NO: 454183 - DNA, 20 bp, Artificial Sequence
  chemically synthesized
aatatatatgcacccagcat

SEQ ID NO: 454184 - DNA, 20 bp, Artificial Sequence
  chemically synthesized
gacattggtgtgccaatgct

SEQ ID NO: 454185 - DNA, 20 bp, Artificial Sequence
  chemically synthesized
ggacattggtgtgccaatgc

SEQ ID NO: 454186 - DNA, 20 bp, Artificial Sequence
  chemically synthesized
aagtacttgatttaggacat

SEQ ID NO: 454187 - DNA, 20 bp, Artificial Sequence
  chemically synthesized
gcacaccaatgtcctaaatc

SEQ ID NO: 454188 - DNA, 20 bp, Artificial Sequence
  chemically synthesized
tcttgaaaagtacttgattt

SEQ ID NO: 454189 - DNA, 20 bp, Artificial Sequence
  chemically synthesized
gtcttgaaaagtacttgatt

SEQ ID NO: 454190 - DNA, 20 bp, Artificial Sequence
  chemically synthesized
tcctaaatcaagtacttttc

SEQ ID NO: 454191 - DNA, 20 bp, Artificial Sequence
  chemically synthesized
gtgttttcgtaggtcttgaa

SEQ ID NO: 454192 - DNA, 20 bp, Artificial Sequence
  chemically synthesized
ggcttcctaagtgttttcgt

SEQ ID NO: 454193 - DNA, 20 bp, Artificial Sequence
  chemically synthesized
tggcttcctaagtgttttcg

SEQ ID NO: 454194 - DNA, 20 bp, Artificial Sequence
  chemically synthesized
tcaagacctacgaaaacact

SEQ ID NO: 454195 - DNA, 20 bp, Artificial Sequence
  chemically synthesized
caagacctacgaaaacactt

SEQ ID NO: 454196 - DNA, 20 bp, Artificial Sequence
  chemically synthesized
gacctacgaaaacacttagg

SEQ ID NO: 454197 - DNA, 20 bp, Artificial Sequence
  chemically synthesized
ttattactgtgtggcttcct

SEQ ID NO: 454198 - DNA, 20 bp, Artificial Sequence
  chemically synthesized
aaaacacttaggaagccaca

SEQ ID NO: 454199 - DNA, 20 bp, Artificial Sequence
  chemically synthesized
agtcccccattattactgtg

SEQ ID NO: 454200 - DNA, 20 bp, Artificial Sequence
  chemically synthesized
aggaagccacacagtaataa

SEQ ID NO: 454201 - DNA, 20 bp, Artificial Sequence
  chemically synthesized
ggaagccacacagtaataat

SEQ ID NO: 454202 - DNA, 20 bp, Artificial Sequence
  chemically synthesized
gaagccacacagtaataatg

SEQ ID NO: 454203 - DNA, 20 bp, Artificial Sequence
  chemically synthesized
aagccacacagtaataatgg

SEQ ID NO: 454204 - DNA, 20 bp, Artificial Sequence
  chemically synthesized
acactatcagtaggttgttg

SEQ ID NO: 454205 - DNA, 20 bp, Artificial Sequence
  chemically synthesized
ggacttcaacaacctactga

SEQ ID NO: 454206 - DNA, 20 bp, Artificial Sequence
  chemically synthesized
atcggtctaacactatcagt

SEQ ID NO: 454207 - DNA, 20 bp, Artificial Sequence
  chemically synthesized
gatcggtctaacactatcag

SEQ ID NO: 454208 - DNA, 20 bp, Artificial Sequence
  chemically synthesized
caacaacctactgatagtgt

SEQ ID NO: 454209 - DNA, 20 bp, Artificial Sequence
  chemically synthesized
agtgatcggtctaacactat

SEQ ID NO: 454210 - DNA, 20 bp, Artificial Sequence
  chemically synthesized
atagtgttagaccgatcact

SEQ ID NO: 454211 - DNA, 20 bp, Artificial Sequence
  chemically synthesized
tagtgttagaccgatcactg

SEQ ID NO: 454212 - DNA, 20 bp, Artificial Sequence
  chemically synthesized
tagttttctgcctcagtgat

SEQ ID NO: 454213 - DNA, 20 bp, Artificial Sequence
  chemically synthesized
tgttagaccgatcactgagg

SEQ ID NO: 454214 - DNA, 20 bp, Artificial Sequence
  chemically synthesized
tctttgttagttttctgcct

SEQ ID NO: 454215 - DNA, 20 bp, Artificial Sequence
  chemically synthesized
actgaggcagaaaactaaca

SEQ ID NO: 454216 - DNA, 20 bp, Artificial Sequence
  chemically synthesized
ttaatccagaatttctttgt

SEQ ID NO: 454217 - DNA, 20 bp, Artificial Sequence
  chemically synthesized
gaaaactaacaaagaaattc

SEQ ID NO: 454218 - DNA, 20 bp, Artificial Sequence
  chemically synthesized
gtcaagagtcaaatttaatc

SEQ ID NO: 454219 - DNA, 20 bp, Artificial Sequence
  chemically synthesized
tattaggtctagttggtcaa

SEQ ID NO: 454220 - DNA, 20 bp, Artificial Sequence
  chemically synthesized
aaatttgactcttgaccaac

SEQ ID NO: 454221 - DNA, 20 bp, Artificial Sequence
  chemically synthesized
tctattaggtctagttggtc

SEQ ID NO: 454222 - DNA, 20 bp, Artificial Sequence
  chemically synthesized
agatgtctattaggtctagt

SEQ ID NO: 454223 - DNA, 20 bp, Artificial Sequence
  chemically synthesized
tcttgaccaactagacctaa

SEQ ID NO: 454224 - DNA, 20 bp, Artificial Sequence
  chemically synthesized
atgtagatgtctattaggtc

SEQ ID NO: 454225 - DNA, 20 bp, Artificial Sequence
  chemically synthesized
gtagtatgtagatgtctatt

SEQ ID NO: 454226 - DNA, 20 bp, Artificial Sequence
  chemically synthesized
agtagtatgtagatgtctat

SEQ ID NO: 454227 - DNA, 20 bp, Artificial Sequence
  chemically synthesized
gttttgggtaaagtagtatg

SEQ ID NO: 454228 - DNA, 20 bp, Artificial Sequence
  chemically synthesized
ttctgtggttttgggtaaag

SEQ ID NO: 454229 - DNA, 20 bp, Artificial Sequence
  chemically synthesized
atattctgtggttttgggta

SEQ ID NO: 454230 - DNA, 20 bp, Artificial Sequence
  chemically synthesized
tactactttacccaaaacca

SEQ ID NO: 454231 - DNA, 20 bp, Artificial Sequence
  chemically synthesized
aatgtatattctgtggtttt

SEQ ID NO: 454232 - DNA, 20 bp, Artificial Sequence
  chemically synthesized
gaatgtatattctgtggttt

SEQ ID NO: 454233 - DNA, 20 bp, Artificial Sequence
  chemically synthesized
tgagaagaatgtatattctg

SEQ ID NO: 454234 - DNA, 20 bp, Artificial Sequence
  chemically synthesized
acattctgtgtgcagatgag

SEQ ID NO: 454235 - DNA, 20 bp, Artificial Sequence
  chemically synthesized
agtacattctgtgtgcagat

SEQ ID NO: 454236 - DNA, 20 bp, Artificial Sequence
  chemically synthesized
acattcttctcatctgcaca

SEQ ID NO: 454237 - DNA, 20 bp, Artificial Sequence
  chemically synthesized
cttgcagtacattctgtgtg

SEQ ID NO: 454238 - DNA, 20 bp, Artificial Sequence
  chemically synthesized
ctgcacacagaatgtactgc

SEQ ID NO: 454239 - DNA, 20 bp, Artificial Sequence
  chemically synthesized
tgagcatgtggtttatcttg

SEQ ID NO: 454240 - DNA, 20 bp, Artificial Sequence
  chemically synthesized
tgcaagataaaccacatgct

SEQ ID NO: 454241 - DNA, 20 bp, Artificial Sequence
  chemically synthesized
tcgctttatggctgagcatg

SEQ ID NO: 454242 - DNA, 20 bp, Artificial Sequence
  chemically synthesized
aaaccacatgctcagccata

SEQ ID NO: 454243 - DNA, 20 bp, Artificial Sequence
  chemically synthesized
ttgagattcgctttatggct

SEQ ID NO: 454244 - DNA, 20 bp, Artificial Sequence
  chemically synthesized
atttattgagattcgcttta

SEQ ID NO: 454245 - DNA, 20 bp, Artificial Sequence
  chemically synthesized
ttcaattttcgaaatttatt

SEQ ID NO: 454246 - DNA, 20 bp, Artificial Sequence
  chemically synthesized
aatttcgaaaattgaaataa

SEQ ID NO: 454247 - DNA, 20 bp, Artificial Sequence
  chemically synthesized
aataaaagcaaacaaattct

SEQ ID NO: 454248 - DNA, 20 bp, Artificial Sequence
  chemically synthesized
gcaaacaaattcttggacca

SEQ ID NO: 454249 - DNA, 20 bp, Artificial Sequence
  chemically synthesized
tttttattccactgtggtcc

SEQ ID NO: 454250 - DNA, 20 bp, Artificial Sequence
  chemically synthesized
aacaaattcttggaccacag

SEQ ID NO: 454251 - DNA, 20 bp, Artificial Sequence
  chemically synthesized
tttctatttttattccactg

SEQ ID NO: 454252 - DNA, 20 bp, Artificial Sequence
  chemically synthesized
ggaccacagtggaataaaaa

SEQ ID NO: 454253 - DNA, 20 bp, Artificial Sequence
  chemically synthesized
taaaaatagaaatcaatacc

SEQ ID NO: 454254 - DNA, 20 bp, Artificial Sequence
  chemically synthesized
aaaatagaaatcaataccaa

SEQ ID NO: 454255 - DNA, 20 bp, Artificial Sequence
  chemically synthesized
aaatagaaatcaataccaag

SEQ ID NO: 454256 - DNA, 20 bp, Artificial Sequence
  chemically synthesized
gtggttttgagaggtcctct

SEQ ID NO: 454257 - DNA, 20 bp, Artificial Sequence
  chemically synthesized
tgtaattgtgtggttttgag

SEQ ID NO: 454258 - DNA, 20 bp, Artificial Sequence
  chemically synthesized
atgtaattgtgtggttttga

SEQ ID NO: 454259 - DNA, 20 bp, Artificial Sequence
  chemically synthesized
ccatgtaattgtgtggtttt

SEQ ID NO: 454260 - DNA, 20 bp, Artificial Sequence
  chemically synthesized
ttggtttccatgtaattgtg

SEQ ID NO: 454261 - DNA, 20 bp, Artificial Sequence
  chemically synthesized
ctcaaaaccacacaattaca

SEQ ID NO: 454262 - DNA, 20 bp, Artificial Sequence
  chemically synthesized
tcattcaggagcaagttgtt

SEQ ID NO: 454263 - DNA, 20 bp, Artificial Sequence
  chemically synthesized
cccaaaagtcattcaggagc

SEQ ID NO: 454264 - DNA, 20 bp, Artificial Sequence
  chemically synthesized
ttcacccaaaagtcattcag

SEQ ID NO: 454265 - DNA, 20 bp, Artificial Sequence
  chemically synthesized
tgttcacccaaaagtcattc

SEQ ID NO: 454266 - DNA, 20 bp, Artificial Sequence
  chemically synthesized
ttgttcacccaaaagtcatt

SEQ ID NO: 454267 - DNA, 20 bp, Artificial Sequence
  chemically synthesized
acttgctcctgaatgacttt

SEQ ID NO: 454268 - DNA, 20 bp, Artificial Sequence
  chemically synthesized
cttgctcctgaatgactttt

SEQ ID NO: 454269 - DNA, 20 bp, Artificial Sequence
  chemically synthesized
taattttgttgttcacccaa

SEQ ID NO: 454270 - DNA, 20 bp, Artificial Sequence
  chemically synthesized
tttgggtgaacaacaaaatt

SEQ ID NO: 454271 - DNA, 20 bp, Artificial Sequence
  chemically synthesized
gggtgaacaacaaaattaag

SEQ ID NO: 454272 - DNA, 20 bp, Artificial Sequence
  chemically synthesized
gtgaacaacaaaattaagca

SEQ ID NO: 454273 - DNA, 20 bp, Artificial Sequence
  chemically synthesized
gattgttattttttttcact

SEQ ID NO: 454274 - DNA, 20 bp, Artificial Sequence
  chemically synthesized
aacctggtgtaatttatact

SEQ ID NO: 454275 - DNA, 20 bp, Artificial Sequence
  chemically synthesized
tcactcagtataaattacac

SEQ ID NO: 454276 - DNA, 20 bp, Artificial Sequence
  chemically synthesized
cactcagtataaattacacc

SEQ ID NO: 454277 - DNA, 20 bp, Artificial Sequence
  chemically synthesized
aattaactattggataaacc

SEQ ID NO: 454278 - DNA, 20 bp, Artificial Sequence
  chemically synthesized
attacaccaggtttatccaa

SEQ ID NO: 454279 - DNA, 20 bp, Artificial Sequence
  chemically synthesized
aataaaaaggaattaactat

SEQ ID NO: 454280 - DNA, 20 bp, Artificial Sequence
  chemically synthesized
aatattacccagcaataaaa

SEQ ID NO: 454281 - DNA, 20 bp, Artificial Sequence
  chemically synthesized
gaatattacccagcaataaa

SEQ ID NO: 454282 - DNA, 20 bp, Artificial Sequence
  chemically synthesized
agttaattcctttttattgc

SEQ ID NO: 454283 - DNA, 20 bp, Artificial Sequence
  chemically synthesized
gttaattcctttttattgct

SEQ ID NO: 454284 - DNA, 20 bp, Artificial Sequence
  chemically synthesized
gcataccatggaatattacc

SEQ ID NO: 454285 - DNA, 20 bp, Artificial Sequence
  chemically synthesized
tattgctgggtaatattcca

SEQ ID NO: 454286 - DNA, 20 bp, Artificial Sequence
  chemically synthesized
cctgtggtacatgcatacca

SEQ ID NO: 454287 - DNA, 20 bp, Artificial Sequence
  chemically synthesized
tccatggtatgcatgtacca

SEQ ID NO: 454288 - DNA, 20 bp, Artificial Sequence
  chemically synthesized
ccatggtatgcatgtaccac

SEQ ID NO: 454289 - DNA, 20 bp, Artificial Sequence
  chemically synthesized
catggtatgcatgtaccaca

SEQ ID NO: 454290 - DNA, 20 bp, Artificial Sequence
  chemically synthesized
ttaaaaaaaaaaaaaccctg

SEQ ID NO: 454291 - DNA, 20 bp, Artificial Sequence
  chemically synthesized
cacagggttttttttttttt

SEQ ID NO: 454292 - DNA, 20 bp, Artificial Sequence
  chemically synthesized
tttttaagcaattacatatc

SEQ ID NO: 454293 - DNA, 20 bp, Artificial Sequence
  chemically synthesized
ttttaagcaattacatatca

SEQ ID NO: 454294 - DNA, 20 bp, Artificial Sequence
  chemically synthesized
tttaagcaattacatatcaa

SEQ ID NO: 454295 - DNA, 20 bp, Artificial Sequence
  chemically synthesized
tagtaccaaaacacacaaaa

SEQ ID NO: 454296 - DNA, 20 bp, Artificial Sequence
  chemically synthesized
agggacttttttgtgtgttt

SEQ ID NO: 454297 - DNA, 20 bp, Artificial Sequence
  chemically synthesized
tttgtgtgttttggtactat

SEQ ID NO: 454298 - DNA, 20 bp, Artificial Sequence
  chemically synthesized
ttgtgtgttttggtactata

SEQ ID NO: 454299 - DNA, 20 bp, Artificial Sequence
  chemically synthesized
aaatattcatagcagcctta

SEQ ID NO: 454300 - DNA, 20 bp, Artificial Sequence
  chemically synthesized
gtatccacaaatattcatag

SEQ ID NO: 454301 - DNA, 20 bp, Artificial Sequence
  chemically synthesized
aacgtatccacaaatattca

SEQ ID NO: 454302 - DNA, 20 bp, Artificial Sequence
  chemically synthesized
aaggctgctatgaatatttg

SEQ ID NO: 454303 - DNA, 20 bp, Artificial Sequence
  chemically synthesized
aatgaaaacttgttttcata

SEQ ID NO: 454304 - DNA, 20 bp, Artificial Sequence
  chemically synthesized
atacgtttctgtatgaaaac

SEQ ID NO: 454305 - DNA, 20 bp, Artificial Sequence
  chemically synthesized
aaacaagttttcattttttt

SEQ ID NO: 454306 - DNA, 20 bp, Artificial Sequence
  chemically synthesized
tcatttttttaagaatgatt

SEQ ID NO: 454307 - DNA, 20 bp, Artificial Sequence
  chemically synthesized
atttttttaagaatgattaa

SEQ ID NO: 454308 - DNA, 20 bp, Artificial Sequence
  chemically synthesized
tttttttaagaatgattaag

SEQ ID NO: 454309 - DNA, 20 bp, Artificial Sequence
  chemically synthesized
ttttttaagaatgattaaga

SEQ ID NO: 454310 - DNA, 20 bp, Artificial Sequence
  chemically synthesized
aatggacttagcatatgaca

SEQ ID NO: 454311 - DNA, 20 bp, Artificial Sequence
  chemically synthesized
caattgctgtgtcatatgct

SEQ ID NO: 454312 - DNA, 20 bp, Artificial Sequence
  chemically synthesized
tttcaaactaaaaatggact

SEQ ID NO: 454313 - DNA, 20 bp, Artificial Sequence
  chemically synthesized
tcatatgctaagtccatttt

SEQ ID NO: 454314 - DNA, 20 bp, Artificial Sequence
  chemically synthesized
gttcattttcaaactaaaaa

SEQ ID NO: 454315 - DNA, 20 bp, Artificial Sequence
  chemically synthesized
cacactggaaaatagtttgg

SEQ ID NO: 454316 - DNA, 20 bp, Artificial Sequence
  chemically synthesized
agccacactggaaaatagtt

SEQ ID NO: 454317 - DNA, 20 bp, Artificial Sequence
  chemically synthesized
tgaactgccaaactattttc

SEQ ID NO: 454318 - DNA, 20 bp, Artificial Sequence
  chemically synthesized
ggtatagccacactggaaaa

SEQ ID NO: 454319 - DNA, 20 bp, Artificial Sequence
  chemically synthesized
tgccaaactattttccagtg

SEQ ID NO: 454320 - DNA, 20 bp, Artificial Sequence
  chemically synthesized
gttaaatggtatagccacac

SEQ ID NO: 454321 - DNA, 20 bp, Artificial Sequence
  chemically synthesized
ggtgggactgttaaatggta

SEQ ID NO: 454322 - DNA, 20 bp, Artificial Sequence
  chemically synthesized
agtgtggctataccatttaa

SEQ ID NO: 454323 - DNA, 20 bp, Artificial Sequence
  chemically synthesized
ttgctggtgggactgttaaa

SEQ ID NO: 454324 - DNA, 20 bp, Artificial Sequence
  chemically synthesized
ataccatttaacagtcccac

SEQ ID NO: 454325 - DNA, 20 bp, Artificial Sequence
  chemically synthesized
gtaaatcatatattgctggt

SEQ ID NO: 454326 - DNA, 20 bp, Artificial Sequence
  chemically synthesized
ggtaaatcatatattgctgg

SEQ ID NO: 454327 - DNA, 20 bp, Artificial Sequence
  chemically synthesized
ctgggtaaatcatatattgc

SEQ ID NO: 454328 - DNA, 20 bp, Artificial Sequence
  chemically synthesized
ccagcaatatatgatttacc

SEQ ID NO: 454329 - DNA, 20 bp, Artificial Sequence
  chemically synthesized
ggcaaggaagcggagaaact

SEQ ID NO: 454330 - DNA, 20 bp, Artificial Sequence
  chemically synthesized
tggcaaggaagcggagaaac

SEQ ID NO: 454331 - DNA, 20 bp, Artificial Sequence
  chemically synthesized
cagatgctggcaaggaagcg

SEQ ID NO: 454332 - DNA, 20 bp, Artificial Sequence
  chemically synthesized
accagatgctggcaaggaag

SEQ ID NO: 454333 - DNA, 20 bp, Artificial Sequence
  chemically synthesized
cagtttctccgcttccttgc

SEQ ID NO: 454334 - DNA, 20 bp, Artificial Sequence
  chemically synthesized
gacaccagatgctggcaagg

SEQ ID NO: 454335 - DNA, 20 bp, Artificial Sequence
  chemically synthesized
atagacaccagatgctggca

SEQ ID NO: 454336 - DNA, 20 bp, Artificial Sequence
  chemically synthesized
aatagacaccagatgctggc

SEQ ID NO: 454337 - DNA, 20 bp, Artificial Sequence
  chemically synthesized
tccgcttccttgccagcatc

SEQ ID NO: 454338 - DNA, 20 bp, Artificial Sequence
  chemically synthesized
agaaaatagacaccagatgc

SEQ ID NO: 454339 - DNA, 20 bp, Artificial Sequence
  chemically synthesized
taaaataagaaaatagacac

SEQ ID NO: 454340 - DNA, 20 bp, Artificial Sequence
  chemically synthesized
aaatggctaaaataagaaaa

SEQ ID NO: 454341 - DNA, 20 bp, Artificial Sequence
  chemically synthesized
tggtgtctattttcttattt

SEQ ID NO: 454342 - DNA, 20 bp, Artificial Sequence
  chemically synthesized
gtagtcaaaatggctaaaat

SEQ ID NO: 454343 - DNA, 20 bp, Artificial Sequence
  chemically synthesized
ttattacctagtagtcaaaa

SEQ ID NO: 454344 - DNA, 20 bp, Artificial Sequence
  chemically synthesized
attttagccattttgactac

SEQ ID NO: 454345 - DNA, 20 bp, Artificial Sequence
  chemically synthesized
ttttagccattttgactact

SEQ ID NO: 454346 - DNA, 20 bp, Artificial Sequence
  chemically synthesized
agtgagatattattacctag

SEQ ID NO: 454347 - DNA, 20 bp, Artificial Sequence
  chemically synthesized
caaagtgagatattattacc

SEQ ID NO: 454348 - DNA, 20 bp, Artificial Sequence
  chemically synthesized
taggtaataatatctcactt

SEQ ID NO: 454349 - DNA, 20 bp, Artificial Sequence
  chemically synthesized
atggaaattaaaaccaaagt

SEQ ID NO: 454350 - DNA, 20 bp, Artificial Sequence
  chemically synthesized
taaaatggaaattaaaacca

SEQ ID NO: 454351 - DNA, 20 bp, Artificial Sequence
  chemically synthesized
atcaacaaccattagtaaaa

SEQ ID NO: 454352 - DNA, 20 bp, Artificial Sequence
  chemically synthesized
tttaatttccattttactaa

SEQ ID NO: 454353 - DNA, 20 bp, Artificial Sequence
  chemically synthesized
tgttcaacatcaacaaccat

SEQ ID NO: 454354 - DNA, 20 bp, Artificial Sequence
  chemically synthesized
caccaatgaagatatacaga

SEQ ID NO: 454355 - DNA, 20 bp, Artificial Sequence
  chemically synthesized
gtttcaccaatgaagatata

SEQ ID NO: 454356 - DNA, 20 bp, Artificial Sequence
  chemically synthesized
tgccatctgtatatcttcat

SEQ ID NO: 454357 - DNA, 20 bp, Artificial Sequence
  chemically synthesized
gcacagatgtttcaccaatg

SEQ ID NO: 454358 - DNA, 20 bp, Artificial Sequence
  chemically synthesized
aaatggacaaaagacaggca

SEQ ID NO: 454359 - DNA, 20 bp, Artificial Sequence
  chemically synthesized
taagaaaatggacaaaagac

SEQ ID NO: 454360 - DNA, 20 bp, Artificial Sequence
  chemically synthesized
ataagaaaatggacaaaaga

SEQ ID NO: 454361 - DNA, 20 bp, Artificial Sequence
  chemically synthesized
tccaataagaaaatggacaa

SEQ ID NO: 454362 - DNA, 20 bp, Artificial Sequence
  chemically synthesized
ttaaaaatccaataagaaaa

SEQ ID NO: 454363 - DNA, 20 bp, Artificial Sequence
  chemically synthesized
tcttttgtccattttcttat

SEQ ID NO: 454364 - DNA, 20 bp, Artificial Sequence
  chemically synthesized
caacattttaaaaatccaat

SEQ ID NO: 454365 - DNA, 20 bp, Artificial Sequence
  chemically synthesized
tattggatttttaaaatgtt

SEQ ID NO: 454366 - DNA, 20 bp, Artificial Sequence
  chemically synthesized
tttttaaaatgttgagtttt

SEQ ID NO: 454367 - DNA, 20 bp, Artificial Sequence
  chemically synthesized
tttaaaatgttgagttttga

SEQ ID NO: 454368 - DNA, 20 bp, Artificial Sequence
  chemically synthesized
agttttgagagctctttatg

SEQ ID NO: 454369 - DNA, 20 bp, Artificial Sequence
  chemically synthesized
tagtatcaaaactacataaa

SEQ ID NO: 454370 - DNA, 20 bp, Artificial Sequence
  chemically synthesized
actagtatcaaaactacata

SEQ ID NO: 454371 - DNA, 20 bp, Artificial Sequence
  chemically synthesized
tctttatgtagttttgatac

SEQ ID NO: 454372 - DNA, 20 bp, Artificial Sequence
  chemically synthesized
tatatctagatatcaagaac

SEQ ID NO: 454373 - DNA, 20 bp, Artificial Sequence
  chemically synthesized
tgatactagttcttgatatc

SEQ ID NO: 454374 - DNA, 20 bp, Artificial Sequence
  chemically synthesized
aaaccatatatctagatatc

SEQ ID NO: 454375 - DNA, 20 bp, Artificial Sequence
  chemically synthesized
gttcttgatatctagatata

SEQ ID NO: 454376 - DNA, 20 bp, Artificial Sequence
  chemically synthesized
atattggcaaaccatatatc

SEQ ID NO: 454377 - DNA, 20 bp, Artificial Sequence
  chemically synthesized
tacagactgggagaaaatat

SEQ ID NO: 454378 - DNA, 20 bp, Artificial Sequence
  chemically synthesized
ggtttgccaatattttctcc

SEQ ID NO: 454379 - DNA, 20 bp, Artificial Sequence
  chemically synthesized
aaatacgagctacagactgg

SEQ ID NO: 454380 - DNA, 20 bp, Artificial Sequence
  chemically synthesized
caatattttctcccagtctg

SEQ ID NO: 454381 - DNA, 20 bp, Artificial Sequence
  chemically synthesized
tgaaatacgagctacagact

SEQ ID NO: 454382 - DNA, 20 bp, Artificial Sequence
  chemically synthesized
atgaaatacgagctacagac

SEQ ID NO: 454383 - DNA, 20 bp, Artificial Sequence
  chemically synthesized
aaaaaatgaaatacgagcta

SEQ ID NO: 454384 - DNA, 20 bp, Artificial Sequence
  chemically synthesized
aaaagaaaaaaatgaaatac

SEQ ID NO: 454385 - DNA, 20 bp, Artificial Sequence
  chemically synthesized
tttcatttttttcttttttt

SEQ ID NO: 454386 - DNA, 20 bp, Artificial Sequence
  chemically synthesized
tcatttttttctttttttga

SEQ ID NO: 454387 - DNA, 20 bp, Artificial Sequence
  chemically synthesized
taccactgcactctcaaaaa

SEQ ID NO: 454388 - DNA, 20 bp, Artificial Sequence
  chemically synthesized
tttttctttttttgagagtg

SEQ ID NO: 454389 - DNA, 20 bp, Artificial Sequence
  chemically synthesized
ttctttttttgagagtgcag

SEQ ID NO: 454390 - DNA, 20 bp, Artificial Sequence
  chemically synthesized
ggcagaggttgcagtgagtc

SEQ ID NO: 454391 - DNA, 20 bp, Artificial Sequence
  chemically synthesized
caggaggcagaggttgcagt

SEQ ID NO: 454392 - DNA, 20 bp, Artificial Sequence
  chemically synthesized
agcccaggaggcagaggttg

SEQ ID NO: 454393 - DNA, 20 bp, Artificial Sequence
  chemically synthesized
cgcttgagcccaggaggcag

SEQ ID NO: 454394 - DNA, 20 bp, Artificial Sequence
  chemically synthesized
tcactgcaacctctgcctcc

SEQ ID NO: 454395 - DNA, 20 bp, Artificial Sequence
  chemically synthesized
tcgcttgagcccaggaggca

SEQ ID NO: 454396 - DNA, 20 bp, Artificial Sequence
  chemically synthesized
cactgcaacctctgcctcct

SEQ ID NO: 454397 - DNA, 20 bp, Artificial Sequence
  chemically synthesized
aatcgcttgagcccaggagg

SEQ ID NO: 454398 - DNA, 20 bp, Artificial Sequence
  chemically synthesized
gagaatcgcttgagcccagg

SEQ ID NO: 454399 - DNA, 20 bp, Artificial Sequence
  chemically synthesized
tgagaatcgcttgagcccag

SEQ ID NO: 454400 - DNA, 20 bp, Artificial Sequence
  chemically synthesized
aacctctgcctcctgggctc

SEQ ID NO: 454401 - DNA, 20 bp, Artificial Sequence
  chemically synthesized
catgagaatcgcttgagccc

SEQ ID NO: 454402 - DNA, 20 bp, Artificial Sequence
  chemically synthesized
gcatgagaatcgcttgagcc

SEQ ID NO: 454403 - DNA, 20 bp, Artificial Sequence
  chemically synthesized
ctgaggcatgagaatcgctt

SEQ ID NO: 454404 - DNA, 20 bp, Artificial Sequence
  chemically synthesized
ctcaagcgattctcatgcct

SEQ ID NO: 454405 - DNA, 20 bp, Artificial Sequence
  chemically synthesized
tacttgggaagctgaggcat

SEQ ID NO: 454406 - DNA, 20 bp, Artificial Sequence
  chemically synthesized
accacctacttgggaagctg

SEQ ID NO: 454407 - DNA, 20 bp, Artificial Sequence
  chemically synthesized
taccacctacttgggaagct

SEQ ID NO: 454408 - DNA, 20 bp, Artificial Sequence
  chemically synthesized
ttctcatgcctcagcttccc

SEQ ID NO: 454409 - DNA, 20 bp, Artificial Sequence
  chemically synthesized
tcatgcctcagcttcccaag

SEQ ID NO: 454410 - DNA, 20 bp, Artificial Sequence
  chemically synthesized
catgcctcagcttcccaagt

SEQ ID NO: 454411 - DNA, 20 bp, Artificial Sequence
  chemically synthesized
tgtagtaccacctacttggg

SEQ ID NO: 454412 - DNA, 20 bp, Artificial Sequence
  chemically synthesized
gcctcagcttcccaagtagg

SEQ ID NO: 454413 - DNA, 20 bp, Artificial Sequence
  chemically synthesized
acctgtagtaccacctactt

SEQ ID NO: 454414 - DNA, 20 bp, Artificial Sequence
  chemically synthesized
cacctgtagtaccacctact

SEQ ID NO: 454415 - DNA, 20 bp, Artificial Sequence
  chemically synthesized
ttcccaagtaggtggtacta

SEQ ID NO: 454416 - DNA, 20 bp, Artificial Sequence
  chemically synthesized
tcccaagtaggtggtactac

SEQ ID NO: 454417 - DNA, 20 bp, Artificial Sequence
  chemically synthesized
ggcgtagtggcgcacacctg

SEQ ID NO: 454418 - DNA, 20 bp, Artificial Sequence
  chemically synthesized
caggtgtgcgccactacgcc

SEQ ID NO: 454419 - DNA, 20 bp, Artificial Sequence
  chemically synthesized
caaaaattagctgggcgtag

SEQ ID NO: 454420 - DNA, 20 bp, Artificial Sequence
  chemically synthesized
atacaaaaattagctgggcg

SEQ ID NO: 454421 - DNA, 20 bp, Artificial Sequence
  chemically synthesized
taaaaatacaaaaattagct

SEQ ID NO: 454422 - DNA, 20 bp, Artificial Sequence
  chemically synthesized
gtaaaaatacaaaaattagc

SEQ ID NO: 454423 - DNA, 20 bp, Artificial Sequence
  chemically synthesized
tctagtaaaaatacaaaaat

SEQ ID NO: 454424 - DNA, 20 bp, Artificial Sequence
  chemically synthesized
gctaatttttgtatttttac

SEQ ID NO: 454425 - DNA, 20 bp, Artificial Sequence
  chemically synthesized
taatttttgtatttttacta

SEQ ID NO: 454426 - DNA, 20 bp, Artificial Sequence
  chemically synthesized
ttttgtatttttactagaga

SEQ ID NO: 454427 - DNA, 20 bp, Artificial Sequence
  chemically synthesized
ttgtatttttactagagaca

SEQ ID NO: 454428 - DNA, 20 bp, Artificial Sequence
  chemically synthesized
acatgatgaaactctgtctc

SEQ ID NO: 454429 - DNA, 20 bp, Artificial Sequence
  chemically synthesized
gagacagagtttcatcatgt

SEQ ID NO: 454430 - DNA, 20 bp, Artificial Sequence
  chemically synthesized
cagagtttcatcatgttggc

SEQ ID NO: 454431 - DNA, 20 bp, Artificial Sequence
  chemically synthesized
agagtttcatcatgttggcc

SEQ ID NO: 454432 - DNA, 20 bp, Artificial Sequence
  chemically synthesized
tttcatcatgttggccaggc

SEQ ID NO: 454433 - DNA, 20 bp, Artificial Sequence
  chemically synthesized
tcaggagttcgagaccagcc

SEQ ID NO: 454434 - DNA, 20 bp, Artificial Sequence
  chemically synthesized
tacgctcaggagttcgagac

SEQ ID NO: 454435 - DNA, 20 bp, Artificial Sequence
  chemically synthesized
tcgcttacgctcaggagttc

SEQ ID NO: 454436 - DNA, 20 bp, Artificial Sequence
  chemically synthesized
caggctggtctcgaactcct

SEQ ID NO: 454437 - DNA, 20 bp, Artificial Sequence
  chemically synthesized
agctggtcgcttacgctcag

SEQ ID NO: 454438 - DNA, 20 bp, Artificial Sequence
  chemically synthesized
ggtctcgaactcctgagcgt

SEQ ID NO: 454439 - DNA, 20 bp, Artificial Sequence
  chemically synthesized
caagctggtcgcttacgctc

SEQ ID NO: 454440 - DNA, 20 bp, Artificial Sequence
  chemically synthesized
gcaagctggtcgcttacgct

SEQ ID NO: 454441 - DNA, 20 bp, Artificial Sequence
  chemically synthesized
aactcctgagcgtaagcgac

SEQ ID NO: 454442 - DNA, 20 bp, Artificial Sequence
  chemically synthesized
tttgggaagctgaggcaagc

SEQ ID NO: 454443 - DNA, 20 bp, Artificial Sequence
  chemically synthesized
cgtaagcgaccagcttgcct

SEQ ID NO: 454444 - DNA, 20 bp, Artificial Sequence
  chemically synthesized
tcactttgggaagctgaggc

SEQ ID NO: 454445 - DNA, 20 bp, Artificial Sequence
  chemically synthesized
accatcactttgggaagctg

SEQ ID NO: 454446 - DNA, 20 bp, Artificial Sequence
  chemically synthesized
taccatcactttgggaagct

SEQ ID NO: 454447 - DNA, 20 bp, Artificial Sequence
  chemically synthesized
cagcttgcctcagcttccca

SEQ ID NO: 454448 - DNA, 20 bp, Artificial Sequence
  chemically synthesized
gttaataccatcactttggg

SEQ ID NO: 454449 - DNA, 20 bp, Artificial Sequence
  chemically synthesized
gcctcagcttcccaaagtga

SEQ ID NO: 454450 - DNA, 20 bp, Artificial Sequence
  chemically synthesized
cctgttaataccatcacttt

SEQ ID NO: 454451 - DNA, 20 bp, Artificial Sequence
  chemically synthesized
gcctgttaataccatcactt

SEQ ID NO: 454452 - DNA, 20 bp, Artificial Sequence
  chemically synthesized
tcccaaagtgatggtattaa

SEQ ID NO: 454453 - DNA, 20 bp, Artificial Sequence
  chemically synthesized
cccaaagtgatggtattaac

SEQ ID NO: 454454 - DNA, 20 bp, Artificial Sequence
  chemically synthesized
gtgatggtattaacaggcac

SEQ ID NO: 454455 - DNA, 20 bp, Artificial Sequence
  chemically synthesized
caggcacgagccaccacgcc

SEQ ID NO: 454456 - DNA, 20 bp, Artificial Sequence
  chemically synthesized
agaaatataaccgggcgtgg

SEQ ID NO: 454457 - DNA, 20 bp, Artificial Sequence
  chemically synthesized
agaagaaatataaccgggcg

SEQ ID NO: 454458 - DNA, 20 bp, Artificial Sequence
  chemically synthesized
tgttaagaagaaatataacc

SEQ ID NO: 454459 - DNA, 20 bp, Artificial Sequence
  chemically synthesized
ctgttaagaagaaatataac

SEQ ID NO: 454460 - DNA, 20 bp, Artificial Sequence
  chemically synthesized
ccggttatatttcttcttaa

SEQ ID NO: 454461 - DNA, 20 bp, Artificial Sequence
  chemically synthesized
atgcaaaatattctgttaag

SEQ ID NO: 454462 - DNA, 20 bp, Artificial Sequence
  chemically synthesized
gctatgcaaaatattctgtt

SEQ ID NO: 454463 - DNA, 20 bp, Artificial Sequence
  chemically synthesized
tcttaacagaatattttgca

SEQ ID NO: 454464 - DNA, 20 bp, Artificial Sequence
  chemically synthesized
cagaatattttgcatagcaa

SEQ ID NO: 454465 - DNA, 20 bp, Artificial Sequence
  chemically synthesized
caaaagttttttattttaat

SEQ ID NO: 454466 - DNA, 20 bp, Artificial Sequence
  chemically synthesized
aaaagttttttattttaatg

SEQ ID NO: 454467 - DNA, 20 bp, Artificial Sequence
  chemically synthesized
cataaaaggaaattttgata

SEQ ID NO: 454468 - DNA, 20 bp, Artificial Sequence
  chemically synthesized
tttatcaaaatttcctttta

SEQ ID NO: 454469 - DNA, 20 bp, Artificial Sequence
  chemically synthesized
ccaaagtcgccatccataaa

SEQ ID NO: 454470 - DNA, 20 bp, Artificial Sequence
  chemically synthesized
tcaaaatttccttttatgga

SEQ ID NO: 454471 - DNA, 20 bp, Artificial Sequence
  chemically synthesized
accaaagtcgccatccataa

SEQ ID NO: 454472 - DNA, 20 bp, Artificial Sequence
  chemically synthesized
ccttttatggatggcgactt

SEQ ID NO: 454473 - DNA, 20 bp, Artificial Sequence
  chemically synthesized
tggatggcgactttggtgtc

SEQ ID NO: 454474 - DNA, 20 bp, Artificial Sequence
  chemically synthesized
tgttcttagacttgacacca

SEQ ID NO: 454475 - DNA, 20 bp, Artificial Sequence
  chemically synthesized
gcgactttggtgtcaagtct

SEQ ID NO: 454476 - DNA, 20 bp, Artificial Sequence
  chemically synthesized
atctaacgttaaagtgttct

SEQ ID NO: 454477 - DNA, 20 bp, Artificial Sequence
  chemically synthesized
gtctaagaacactttaacgt

SEQ ID NO: 454478 - DNA, 20 bp, Artificial Sequence
  chemically synthesized
atatttgggatctaacgtta

SEQ ID NO: 454479 - DNA, 20 bp, Artificial Sequence
  chemically synthesized
ctcaaaaatagaacatattt

SEQ ID NO: 454480 - DNA, 20 bp, Artificial Sequence
  chemically synthesized
actcaaaaatagaacatatt

SEQ ID NO: 454481 - DNA, 20 bp, Artificial Sequence
  chemically synthesized
cccaaatatgttctattttt

SEQ ID NO: 454482 - DNA, 20 bp, Artificial Sequence
  chemically synthesized
ctgtaaaacttactcaaaaa

SEQ ID NO: 454483 - DNA, 20 bp, Artificial Sequence
  chemically synthesized
aatatgttctatttttgagt

SEQ ID NO: 454484 - DNA, 20 bp, Artificial Sequence
  chemically synthesized
ctatttttgagtaagtttta

SEQ ID NO: 454485 - DNA, 20 bp, Artificial Sequence
  chemically synthesized
ttgagtaagttttacagttt

SEQ ID NO: 454486 - DNA, 20 bp, Artificial Sequence
  chemically synthesized
caccttgatctaaacatcag

SEQ ID NO: 454487 - DNA, 20 bp, Artificial Sequence
  chemically synthesized
gtttaagttcttctgatgtt

SEQ ID NO: 454488 - DNA, 20 bp, Artificial Sequence
  chemically synthesized
aaacaccttgatctaaacat

SEQ ID NO: 454489 - DNA, 20 bp, Artificial Sequence
  chemically synthesized
gttcttctgatgtttagatc

SEQ ID NO: 454490 - DNA, 20 bp, Artificial Sequence
  chemically synthesized
ttcttctgatgtttagatca

SEQ ID NO: 454491 - DNA, 20 bp, Artificial Sequence
  chemically synthesized
ttttgtttgttttttgccta

SEQ ID NO: 454492 - DNA, 20 bp, Artificial Sequence
  chemically synthesized
tttgtttgttttttgcctat

SEQ ID NO: 454493 - DNA, 20 bp, Artificial Sequence
  chemically synthesized
tgtagtaatccaacacccat

SEQ ID NO: 454494 - DNA, 20 bp, Artificial Sequence
  chemically synthesized
tgttttttgcctatgggtgt

SEQ ID NO: 454495 - DNA, 20 bp, Artificial Sequence
  chemically synthesized
ttgtagtaatccaacaccca

SEQ ID NO: 454496 - DNA, 20 bp, Artificial Sequence
  chemically synthesized
ctttttaataaatggtgttg

SEQ ID NO: 454497 - DNA, 20 bp, Artificial Sequence
  chemically synthesized
gggttagcctttttaataaa

SEQ ID NO: 454498 - DNA, 20 bp, Artificial Sequence
  chemically synthesized
ctacaacaccatttattaaa

SEQ ID NO: 454499 - DNA, 20 bp, Artificial Sequence
  chemically synthesized
tacaacaccatttattaaaa

SEQ ID NO: 454500 - DNA, 20 bp, Artificial Sequence
  chemically synthesized
aggaatccagtaaggagggt

SEQ ID NO: 454501 - DNA, 20 bp, Artificial Sequence
  chemically synthesized
aaaaggctaaccctccttac

SEQ ID NO: 454502 - DNA, 20 bp, Artificial Sequence
  chemically synthesized
aagcaggaatccagtaagga

SEQ ID NO: 454503 - DNA, 20 bp, Artificial Sequence
  chemically synthesized
gaagcaggaatccagtaagg

SEQ ID NO: 454504 - DNA, 20 bp, Artificial Sequence
  chemically synthesized
cgaagcaggaatccagtaag

SEQ ID NO: 454505 - DNA, 20 bp, Artificial Sequence
  chemically synthesized
gacgaagcaggaatccagta

SEQ ID NO: 454506 - DNA, 20 bp, Artificial Sequence
  chemically synthesized
ggacgaagcaggaatccagt

SEQ ID NO: 454507 - DNA, 20 bp, Artificial Sequence
  chemically synthesized
ttttggacgaagcaggaatc

SEQ ID NO: 454508 - DNA, 20 bp, Artificial Sequence
  chemically synthesized
ccctttgttttggacgaagc

SEQ ID NO: 454509 - DNA, 20 bp, Artificial Sequence
  chemically synthesized
tccctttgttttggacgaag

SEQ ID NO: 454510 - DNA, 20 bp, Artificial Sequence
  chemically synthesized
gtgtccctttgttttggacg

SEQ ID NO: 454511 - DNA, 20 bp, Artificial Sequence
  chemically synthesized
ttcctgcttcgtccaaaaca

SEQ ID NO: 454512 - DNA, 20 bp, Artificial Sequence
  chemically synthesized
tcctgcttcgtccaaaacaa

SEQ ID NO: 454513 - DNA, 20 bp, Artificial Sequence
  chemically synthesized
cctgcttcgtccaaaacaaa

SEQ ID NO: 454514 - DNA, 20 bp, Artificial Sequence
  chemically synthesized
ttccttgtgtccctttgttt

SEQ ID NO: 454515 - DNA, 20 bp, Artificial Sequence
  chemically synthesized
cgtccaaaacaaagggacac

SEQ ID NO: 454516 - DNA, 20 bp, Artificial Sequence
  chemically synthesized
gtccaaaacaaagggacaca

SEQ ID NO: 454517 - DNA, 20 bp, Artificial Sequence
  chemically synthesized
gggacacaaggaaacttttc

SEQ ID NO: 454518 - DNA, 20 bp, Artificial Sequence
  chemically synthesized
ggacacaaggaaacttttcc

SEQ ID NO: 454519 - DNA, 20 bp, Artificial Sequence
  chemically synthesized
gacacaaggaaacttttcca

SEQ ID NO: 454520 - DNA, 20 bp, Artificial Sequence
  chemically synthesized
caaacatcaattccctggaa

SEQ ID NO: 454521 - DNA, 20 bp, Artificial Sequence
  chemically synthesized
aataacaaacatcaattccc

SEQ ID NO: 454522 - DNA, 20 bp, Artificial Sequence
  chemically synthesized
tgatgtttgttatttgattg

SEQ ID NO: 454523 - DNA, 20 bp, Artificial Sequence
  chemically synthesized
ttgttatttgattgtggtga

SEQ ID NO: 454524 - DNA, 20 bp, Artificial Sequence
  chemically synthesized
tgattgtggtgatggtttca

SEQ ID NO: 454525 - DNA, 20 bp, Artificial Sequence
  chemically synthesized
gattgtggtgatggtttcac

SEQ ID NO: 454526 - DNA, 20 bp, Artificial Sequence
  chemically synthesized
tgtatacaatttgatgagtt

SEQ ID NO: 454527 - DNA, 20 bp, Artificial Sequence
  chemically synthesized
tttaatgtatacaatttgat

SEQ ID NO: 454528 - DNA, 20 bp, Artificial Sequence
  chemically synthesized
ttgtatacattaaatatgtg

SEQ ID NO: 454529 - DNA, 20 bp, Artificial Sequence
  chemically synthesized
ttgtatatcaattatacttt

SEQ ID NO: 454530 - DNA, 20 bp, Artificial Sequence
  chemically synthesized
ttatttatttttacagctta

SEQ ID NO: 454531 - DNA, 20 bp, Artificial Sequence
  chemically synthesized
gcccaatttatttattttta

SEQ ID NO: 454532 - DNA, 20 bp, Artificial Sequence
  chemically synthesized
agctgtaaaaataaataaat

SEQ ID NO: 454533 - DNA, 20 bp, Artificial Sequence
  chemically synthesized
gctgtaaaaataaataaatt

SEQ ID NO: 454534 - DNA, 20 bp, Artificial Sequence
  chemically synthesized
aaataaattgggcatatttg

SEQ ID NO: 454535 - DNA, 20 bp, Artificial Sequence
  chemically synthesized
catatttgtggatctatttc

SEQ ID NO: 454536 - DNA, 20 bp, Artificial Sequence
  chemically synthesized
atatttgtggatctatttct

SEQ ID NO: 454537 - DNA, 20 bp, Artificial Sequence
  chemically synthesized
cagaatagagagcccagaaa

SEQ ID NO: 454538 - DNA, 20 bp, Artificial Sequence
  chemically synthesized
gtgaaacagaatagagagcc

SEQ ID NO: 454539 - DNA, 20 bp, Artificial Sequence
  chemically synthesized
tatcagtgaaacagaataga

SEQ ID NO: 454540 - DNA, 20 bp, Artificial Sequence
  chemically synthesized
tatatcagtgaaacagaata

SEQ ID NO: 454541 - DNA, 20 bp, Artificial Sequence
  chemically synthesized
catatatcagtgaaacagaa

SEQ ID NO: 454542 - DNA, 20 bp, Artificial Sequence
  chemically synthesized
agactcatatatcagtgaaa

SEQ ID NO: 454543 - DNA, 20 bp, Artificial Sequence
  chemically synthesized
attctgtttcactgatatat

SEQ ID NO: 454544 - DNA, 20 bp, Artificial Sequence
  chemically synthesized
tggtgtacagactcatatat

SEQ ID NO: 454545 - DNA, 20 bp, Artificial Sequence
  chemically synthesized
agtctgatactggtggtgta

SEQ ID NO: 454546 - DNA, 20 bp, Artificial Sequence
  chemically synthesized
tatatgagtctgtacaccac

SEQ ID NO: 454547 - DNA, 20 bp, Artificial Sequence
  chemically synthesized
agtctgtacaccaccagtat

SEQ ID NO: 454548 - DNA, 20 bp, Artificial Sequence
  chemically synthesized
tctagacagtctgatactgg

SEQ ID NO: 454549 - DNA, 20 bp, Artificial Sequence
  chemically synthesized
tattctagacagtctgatac

SEQ ID NO: 454550 - DNA, 20 bp, Artificial Sequence
  chemically synthesized
accaccagtatcagactgtc

SEQ ID NO: 454551 - DNA, 20 bp, Artificial Sequence
  chemically synthesized
tatagcagcagtattctaga

SEQ ID NO: 454552 - DNA, 20 bp, Artificial Sequence
  chemically synthesized
attatatagcagcagtattc

SEQ ID NO: 454553 - DNA, 20 bp, Artificial Sequence
  chemically synthesized
taaagttaattatatagcag

SEQ ID NO: 454554 - DNA, 20 bp, Artificial Sequence
  chemically synthesized
tgttaaagttaattatatag

SEQ ID NO: 454555 - DNA, 20 bp, Artificial Sequence
  chemically synthesized
tgttgttaaagttaattata

SEQ ID NO: 454556 - DNA, 20 bp, Artificial Sequence
  chemically synthesized
tatataattaactttaacaa

SEQ ID NO: 454557 - DNA, 20 bp, Artificial Sequence
  chemically synthesized
aatcactcttactgttgtta

SEQ ID NO: 454558 - DNA, 20 bp, Artificial Sequence
  chemically synthesized
taattaactttaacaacagt

SEQ ID NO: 454559 - DNA, 20 bp, Artificial Sequence
  chemically synthesized
attaactttaacaacagtaa

SEQ ID NO: 454560 - DNA, 20 bp, Artificial Sequence
  chemically synthesized
gaataaggaaaaattaatta

SEQ ID NO: 454561 - DNA, 20 bp, Artificial Sequence
  chemically synthesized
ttgaataaggaaaaattaat

SEQ ID NO: 454562 - DNA, 20 bp, Artificial Sequence
  chemically synthesized
attaatttttccttattcaa

SEQ ID NO: 454563 - DNA, 20 bp, Artificial Sequence
  chemically synthesized
ctagccaaaactattgaata

SEQ ID NO: 454564 - DNA, 20 bp, Artificial Sequence
  chemically synthesized
actagccaaaactattgaat

SEQ ID NO: 454565 - DNA, 20 bp, Artificial Sequence
  chemically synthesized
ttttccttattcaatagttt

SEQ ID NO: 454566 - DNA, 20 bp, Artificial Sequence
  chemically synthesized
ccttattcaatagttttggc

SEQ ID NO: 454567 - DNA, 20 bp, Artificial Sequence
  chemically synthesized
ttcaatagttttggctagta

SEQ ID NO: 454568 - DNA, 20 bp, Artificial Sequence
  chemically synthesized
tcaatagttttggctagtat

SEQ ID NO: 454569 - DNA, 20 bp, Artificial Sequence
  chemically synthesized
gaatggcacaggacctatac

SEQ ID NO: 454570 - DNA, 20 bp, Artificial Sequence
  chemically synthesized
taggatgtatagaatggcac

SEQ ID NO: 454571 - DNA, 20 bp, Artificial Sequence
  chemically synthesized
ataggatgtatagaatggca

SEQ ID NO: 454572 - DNA, 20 bp, Artificial Sequence
  chemically synthesized
attatataggatgtatagaa

SEQ ID NO: 454573 - DNA, 20 bp, Artificial Sequence
  chemically synthesized
taaaaattatataggatgta

SEQ ID NO: 454574 - DNA, 20 bp, Artificial Sequence
  chemically synthesized
gcttattataaaaattatat

SEQ ID NO: 454575 - DNA, 20 bp, Artificial Sequence
  chemically synthesized
ggcttattataaaaattata

SEQ ID NO: 454576 - DNA, 20 bp, Artificial Sequence
  chemically synthesized
tcctatataatttttataat

SEQ ID NO: 454577 - DNA, 20 bp, Artificial Sequence
  chemically synthesized
tttttataataagcctgtgt

SEQ ID NO: 454578 - DNA, 20 bp, Artificial Sequence
  chemically synthesized
caatgtttttgaacttacac

SEQ ID NO: 454579 - DNA, 20 bp, Artificial Sequence
  chemically synthesized
gcaatgtttttgaacttaca

SEQ ID NO: 454580 - DNA, 20 bp, Artificial Sequence
  chemically synthesized
gacaattcttacgaaaattt

SEQ ID NO: 454581 - DNA, 20 bp, Artificial Sequence
  chemically synthesized
aacattgctaaaattttcgt

SEQ ID NO: 454582 - DNA, 20 bp, Artificial Sequence
  chemically synthesized
cgtaagaattgtcttaaaaa

SEQ ID NO: 454583 - DNA, 20 bp, Artificial Sequence
  chemically synthesized
ctctaagttgatctattttt

SEQ ID NO: 454584 - DNA, 20 bp, Artificial Sequence
  chemically synthesized
gtcttaaaaatagatcaact

SEQ ID NO: 454585 - DNA, 20 bp, Artificial Sequence
  chemically synthesized
cttaaaaatagatcaactta

SEQ ID NO: 454586 - DNA, 20 bp, Artificial Sequence
  chemically synthesized
taaaaatagatcaacttaga

SEQ ID NO: 454587 - DNA, 20 bp, Artificial Sequence
  chemically synthesized
taaagatgtgaattctctct

SEQ ID NO: 454588 - DNA, 20 bp, Artificial Sequence
  chemically synthesized
gagaattcacatctttacta

SEQ ID NO: 454589 - DNA, 20 bp, Artificial Sequence
  chemically synthesized
ttggaaaactcaccatagta

SEQ ID NO: 454590 - DNA, 20 bp, Artificial Sequence
  chemically synthesized
attcacatctttactatggt

SEQ ID NO: 454591 - DNA, 20 bp, Artificial Sequence
  chemically synthesized
atggattggaaaactcacca

SEQ ID NO: 454592 - DNA, 20 bp, Artificial Sequence
  chemically synthesized
gatacattatgttcatggat

SEQ ID NO: 454593 - DNA, 20 bp, Artificial Sequence
  chemically synthesized
atggagatacattatgttca

SEQ ID NO: 454594 - DNA, 20 bp, Artificial Sequence
  chemically synthesized
aaagaagacctaaatatatg

SEQ ID NO: 454595 - DNA, 20 bp, Artificial Sequence
  chemically synthesized
ataatgtatctccatatatt

SEQ ID NO: 454596 - DNA, 20 bp, Artificial Sequence
  chemically synthesized
taatgtatctccatatattt

SEQ ID NO: 454597 - DNA, 20 bp, Artificial Sequence
  chemically synthesized
ataaagaagacctaaatata

SEQ ID NO: 454598 - DNA, 20 bp, Artificial Sequence
  chemically synthesized
tgctagtaaaataaataaag

SEQ ID NO: 454599 - DNA, 20 bp, Artificial Sequence
  chemically synthesized
aagtgctagtaaaataaata

SEQ ID NO: 454600 - DNA, 20 bp, Artificial Sequence
  chemically synthesized
gtcttctttatttattttac

SEQ ID NO: 454601 - DNA, 20 bp, Artificial Sequence
  chemically synthesized
ttatttattttactagcact

SEQ ID NO: 454602 - DNA, 20 bp, Artificial Sequence
  chemically synthesized
tgataaaagttaccaagtgc

SEQ ID NO: 454603 - DNA, 20 bp, Artificial Sequence
  chemically synthesized
tctgtatgataaaagttacc

SEQ ID NO: 454604 - DNA, 20 bp, Artificial Sequence
  chemically synthesized
gcacagaatctgtatgataa

SEQ ID NO: 454605 - DNA, 20 bp, Artificial Sequence
  chemically synthesized
acttggtaacttttatcata

SEQ ID NO: 454606 - DNA, 20 bp, Artificial Sequence
  chemically synthesized
taaaactaacaaaacatgca

SEQ ID NO: 454607 - DNA, 20 bp, Artificial Sequence
  chemically synthesized
agattctgtgcatgttttgt

SEQ ID NO: 454608 - DNA, 20 bp, Artificial Sequence
  chemically synthesized
gttttgttagttttatatgt

SEQ ID NO: 454609 - DNA, 20 bp, Artificial Sequence
  chemically synthesized
tttgttagttttatatgtaa

SEQ ID NO: 454610 - DNA, 20 bp, Artificial Sequence
  chemically synthesized
taagagtttcattttctttg

SEQ ID NO: 454611 - DNA, 20 bp, Artificial Sequence
  chemically synthesized
tagcatttatgatttctgca

SEQ ID NO: 454612 - DNA, 20 bp, Artificial Sequence
  chemically synthesized
aaaaaaaaaaaaaaatgcaa

SEQ ID NO: 454613 - DNA, 20 bp, Artificial Sequence
  chemically synthesized
tgcatttttttttttttttt

SEQ ID NO: 454614 - DNA, 20 bp, Artificial Sequence
  chemically synthesized
ttttttttttttttttgaga

SEQ ID NO: 454615 - DNA, 20 bp, Artificial Sequence
  chemically synthesized
ttttttttttttttgagacg

SEQ ID NO: 454616 - DNA, 20 bp, Artificial Sequence
  chemically synthesized
tgagacggagtctcactctg

SEQ ID NO: 454617 - DNA, 20 bp, Artificial Sequence
  chemically synthesized
tccagcctggaccacagagt

SEQ ID NO: 454618 - DNA, 20 bp, Artificial Sequence
  chemically synthesized
cggagtctcactctgtggtc

SEQ ID NO: 454619 - DNA, 20 bp, Artificial Sequence
  chemically synthesized
gcactccagcctggaccaca

SEQ ID NO: 454620 - DNA, 20 bp, Artificial Sequence
  chemically synthesized
ggagtctcactctgtggtcc

SEQ ID NO: 454621 - DNA, 20 bp, Artificial Sequence
  chemically synthesized
ctgcactccagcctggacca

SEQ ID NO: 454622 - DNA, 20 bp, Artificial Sequence
  chemically synthesized
tctcactctgtggtccaggc

SEQ ID NO: 454623 - DNA, 20 bp, Artificial Sequence
  chemically synthesized
tcactctgtggtccaggctg

SEQ ID NO: 454624 - DNA, 20 bp, Artificial Sequence
  chemically synthesized
cgcgccactgcactccagcc

SEQ ID NO: 454625 - DNA, 20 bp, Artificial Sequence
  chemically synthesized
ctgtggtccaggctggagtg

SEQ ID NO: 454626 - DNA, 20 bp, Artificial Sequence
  chemically synthesized
gagatcgcgccactgcactc

SEQ ID NO: 454627 - DNA, 20 bp, Artificial Sequence
  chemically synthesized
tggtccaggctggagtgcag

SEQ ID NO: 454628 - DNA, 20 bp, Artificial Sequence
  chemically synthesized
ggagtgcagtggcgcgatct

SEQ ID NO: 454629 - DNA, 20 bp, Artificial Sequence
  chemically synthesized
gagagaggttgcagtgaacc

SEQ ID NO: 454630 - DNA, 20 bp, Artificial Sequence
  chemically synthesized
aacccgggagagagaggttg

SEQ ID NO: 454631 - DNA, 20 bp, Artificial Sequence
  chemically synthesized
ctcttgaacccgggagagag

SEQ ID NO: 454632 - DNA, 20 bp, Artificial Sequence
  chemically synthesized
tcactgcaacctctctctcc

SEQ ID NO: 454633 - DNA, 20 bp, Artificial Sequence
  chemically synthesized
tctcttgaacccgggagaga

SEQ ID NO: 454634 - DNA, 20 bp, Artificial Sequence
  chemically synthesized
cactgcaacctctctctccc

SEQ ID NO: 454635 - DNA, 20 bp, Artificial Sequence
  chemically synthesized
ggtctcttgaacccgggaga

SEQ ID NO: 454636 - DNA, 20 bp, Artificial Sequence
  chemically synthesized
agggtctcttgaacccggga

SEQ ID NO: 454637 - DNA, 20 bp, Artificial Sequence
  chemically synthesized
tgagggtctcttgaacccgg

SEQ ID NO: 454638 - DNA, 20 bp, Artificial Sequence
  chemically synthesized
aacctctctctcccgggttc

SEQ ID NO: 454639 - DNA, 20 bp, Artificial Sequence
  chemically synthesized
catgagggtctcttgaaccc

SEQ ID NO: 454640 - DNA, 20 bp, Artificial Sequence
  chemically synthesized
cctctctctcccgggttcaa

SEQ ID NO: 454641 - DNA, 20 bp, Artificial Sequence
  chemically synthesized
gcatgagggtctcttgaacc

SEQ ID NO: 454642 - DNA, 20 bp, Artificial Sequence
  chemically synthesized
ctcaggaggctgaggcatga

SEQ ID NO: 454643 - DNA, 20 bp, Artificial Sequence
  chemically synthesized
ttcaagagaccctcatgcct

SEQ ID NO: 454644 - DNA, 20 bp, Artificial Sequence
  chemically synthesized
actcaggaggctgaggcatg

SEQ ID NO: 454645 - DNA, 20 bp, Artificial Sequence
  chemically synthesized
tactcaggaggctgaggcat

SEQ ID NO: 454646 - DNA, 20 bp, Artificial Sequence
  chemically synthesized
cccagctactcaggaggctg

SEQ ID NO: 454647 - DNA, 20 bp, Artificial Sequence
  chemically synthesized
tcccagctactcaggaggct

SEQ ID NO: 454648 - DNA, 20 bp, Artificial Sequence
  chemically synthesized
ccctcatgcctcagcctcct

SEQ ID NO: 454649 - DNA, 20 bp, Artificial Sequence
  chemically synthesized
tcatgcctcagcctcctgag

SEQ ID NO: 454650 - DNA, 20 bp, Artificial Sequence
  chemically synthesized
tgtaatcccagctactcagg

SEQ ID NO: 454651 - DNA, 20 bp, Artificial Sequence
  chemically synthesized
ctgtaatcccagctactcag

SEQ ID NO: 454652 - DNA, 20 bp, Artificial Sequence
  chemically synthesized
gcctcagcctcctgagtagc

SEQ ID NO: 454653 - DNA, 20 bp, Artificial Sequence
  chemically synthesized
gcctgtaatcccagctactc

SEQ ID NO: 454654 - DNA, 20 bp, Artificial Sequence
  chemically synthesized
cctcagcctcctgagtagct

SEQ ID NO: 454655 - DNA, 20 bp, Artificial Sequence
  chemically synthesized
tgcctgtaatcccagctact

SEQ ID NO: 454656 - DNA, 20 bp, Artificial Sequence
  chemically synthesized
ctcctgagtagctgggatta

SEQ ID NO: 454657 - DNA, 20 bp, Artificial Sequence
  chemically synthesized
tcctgagtagctgggattac

SEQ ID NO: 454658 - DNA, 20 bp, Artificial Sequence
  chemically synthesized
atggtgtgtgcctgtaatcc

SEQ ID NO: 454659 - DNA, 20 bp, Artificial Sequence
  chemically synthesized
caggcacacaccatcatgcc

SEQ ID NO: 454660 - DNA, 20 bp, Artificial Sequence
  chemically synthesized
taaaaattagctgggcatga

SEQ ID NO: 454661 - DNA, 20 bp, Artificial Sequence
  chemically synthesized
taaaaatataaaaattagct

SEQ ID NO: 454662 - DNA, 20 bp, Artificial Sequence
  chemically synthesized
ctaaaaatataaaaattagc

SEQ ID NO: 454663 - DNA, 20 bp, Artificial Sequence
  chemically synthesized
tcgactaaaaatataaaaat

SEQ ID NO: 454664 - DNA, 20 bp, Artificial Sequence
  chemically synthesized
ccagctaatttttatatttt

SEQ ID NO: 454665 - DNA, 20 bp, Artificial Sequence
  chemically synthesized
taatttttatatttttagtc

SEQ ID NO: 454666 - DNA, 20 bp, Artificial Sequence
  chemically synthesized
ttttatatttttagtcgaga

SEQ ID NO: 454667 - DNA, 20 bp, Artificial Sequence
  chemically synthesized
tttatatttttagtcgagac

SEQ ID NO: 454668 - DNA, 20 bp, Artificial Sequence
  chemically synthesized
ttatatttttagtcgagaca

SEQ ID NO: 454669 - DNA, 20 bp, Artificial Sequence
  chemically synthesized
gagacagggtttcactatgt

SEQ ID NO: 454670 - DNA, 20 bp, Artificial Sequence
  chemically synthesized
cagggtttcactatgttggc

SEQ ID NO: 454671 - DNA, 20 bp, Artificial Sequence
  chemically synthesized
caagaccagcctggccaaca

SEQ ID NO: 454672 - DNA, 20 bp, Artificial Sequence
  chemically synthesized
agggtttcactatgttggcc

SEQ ID NO: 454673 - DNA, 20 bp, Artificial Sequence
  chemically synthesized
tttcactatgttggccaggc

SEQ ID NO: 454674 - DNA, 20 bp, Artificial Sequence
  chemically synthesized
tcaggagttcaagaccagcc

SEQ ID NO: 454675 - DNA, 20 bp, Artificial Sequence
  chemically synthesized
tgaggtcaggagttcaagac

SEQ ID NO: 454676 - DNA, 20 bp, Artificial Sequence
  chemically synthesized
tcacctgaggtcaggagttc

SEQ ID NO: 454677 - DNA, 20 bp, Artificial Sequence
  chemically synthesized
tggtcttgaactcctgacct

SEQ ID NO: 454678 - DNA, 20 bp, Artificial Sequence
  chemically synthesized
accggatcacctgaggtcag

SEQ ID NO: 454679 - DNA, 20 bp, Artificial Sequence
  chemically synthesized
ggtcttgaactcctgacctc

SEQ ID NO: 454680 - DNA, 20 bp, Artificial Sequence
  chemically synthesized
cgaccggatcacctgaggtc

SEQ ID NO: 454681 - DNA, 20 bp, Artificial Sequence
  chemically synthesized
gcgaccggatcacctgaggt

SEQ ID NO: 454682 - DNA, 20 bp, Artificial Sequence
  chemically synthesized
cccggcgaccggatcacctg

SEQ ID NO: 454683 - DNA, 20 bp, Artificial Sequence
  chemically synthesized
ccccggcgaccggatcacct

SEQ ID NO: 454684 - DNA, 20 bp, Artificial Sequence
  chemically synthesized
actcctgacctcaggtgatc

SEQ ID NO: 454685 - DNA, 20 bp, Artificial Sequence
  chemically synthesized
acctcaggtgatccggtcgc

SEQ ID NO: 454686 - DNA, 20 bp, Artificial Sequence
  chemically synthesized
cctcaggtgatccggtcgcc

SEQ ID NO: 454687 - DNA, 20 bp, Artificial Sequence
  chemically synthesized
ctcaggtgatccggtcgccg

SEQ ID NO: 454688 - DNA, 20 bp, Artificial Sequence
  chemically synthesized
ctttgggagaccccggcgac

SEQ ID NO: 454689 - DNA, 20 bp, Artificial Sequence
  chemically synthesized
cccagcactttgggagaccc

SEQ ID NO: 454690 - DNA, 20 bp, Artificial Sequence
  chemically synthesized
ccggtcgccggggtctccca

SEQ ID NO: 454691 - DNA, 20 bp, Artificial Sequence
  chemically synthesized
ccgtaatcccagcactttgg

SEQ ID NO: 454692 - DNA, 20 bp, Artificial Sequence
  chemically synthesized
gccggggtctcccaaagtgc

SEQ ID NO: 454693 - DNA, 20 bp, Artificial Sequence
  chemically synthesized
gcccgtaatcccagcacttt

SEQ ID NO: 454694 - DNA, 20 bp, Artificial Sequence
  chemically synthesized
ccggggtctcccaaagtgct

SEQ ID NO: 454695 - DNA, 20 bp, Artificial Sequence
  chemically synthesized
tgcccgtaatcccagcactt

SEQ ID NO: 454696 - DNA, 20 bp, Artificial Sequence
  chemically synthesized
ctcccaaagtgctgggatta

SEQ ID NO: 454697 - DNA, 20 bp, Artificial Sequence
  chemically synthesized
tcccaaagtgctgggattac

SEQ ID NO: 454698 - DNA, 20 bp, Artificial Sequence
  chemically synthesized
gtggctcatgcccgtaatcc

SEQ ID NO: 454699 - DNA, 20 bp, Artificial Sequence
  chemically synthesized
agtgctgggattacgggcat

SEQ ID NO: 454700 - DNA, 20 bp, Artificial Sequence
  chemically synthesized
cgggcatgagccactgcgcc

SEQ ID NO: 454701 - DNA, 20 bp, Artificial Sequence
  chemically synthesized
agaagtcaggccaggcgcag

SEQ ID NO: 454702 - DNA, 20 bp, Artificial Sequence
  chemically synthesized
agtagaagtcaggccaggcg

SEQ ID NO: 454703 - DNA, 20 bp, Artificial Sequence
  chemically synthesized
tttaaagtagaagtcaggcc

SEQ ID NO: 454704 - DNA, 20 bp, Artificial Sequence
  chemically synthesized
ttttaaagtagaagtcaggc

SEQ ID NO: 454705 - DNA, 20 bp, Artificial Sequence
  chemically synthesized
agaattttaaagtagaagtc

SEQ ID NO: 454706 - DNA, 20 bp, Artificial Sequence
  chemically synthesized
aagaattttaaagtagaagt

SEQ ID NO: 454707 - DNA, 20 bp, Artificial Sequence
  chemically synthesized
tgacaagaattttaaagtag

SEQ ID NO: 454708 - DNA, 20 bp, Artificial Sequence
  chemically synthesized
atctgacaagaattttaaag

SEQ ID NO: 454709 - DNA, 20 bp, Artificial Sequence
  chemically synthesized
attatctgacaagaatttta

SEQ ID NO: 454710 - DNA, 20 bp, Artificial Sequence
  chemically synthesized
ttctactttaaaattcttgt

SEQ ID NO: 454711 - DNA, 20 bp, Artificial Sequence
  chemically synthesized
agatgttgaaattatctgac

SEQ ID NO: 454712 - DNA, 20 bp, Artificial Sequence
  chemically synthesized
atgctatcacttagataaat

SEQ ID NO: 454713 - DNA, 20 bp, Artificial Sequence
  chemically synthesized
tttcaacatctaatttatct

SEQ ID NO: 454714 - DNA, 20 bp, Artificial Sequence
  chemically synthesized
catctaatttatctaagtga

SEQ ID NO: 454715 - DNA, 20 bp, Artificial Sequence
  chemically synthesized
catcgactaatgctatcact

SEQ ID NO: 454716 - DNA, 20 bp, Artificial Sequence
  chemically synthesized
atttatctaagtgatagcat

SEQ ID NO: 454717 - DNA, 20 bp, Artificial Sequence
  chemically synthesized
aaacaaaactagaatgagaa

SEQ ID NO: 454718 - DNA, 20 bp, Artificial Sequence
  chemically synthesized
gtcgatgtcttttctcattc

SEQ ID NO: 454719 - DNA, 20 bp, Artificial Sequence
  chemically synthesized
caaacaaacaaaactagaat

SEQ ID NO: 454720 - DNA, 20 bp, Artificial Sequence
  chemically synthesized
ccaaaacaaacaaacaaaac

SEQ ID NO: 454721 - DNA, 20 bp, Artificial Sequence
  chemically synthesized
ctagttttgtttgtttgttt

SEQ ID NO: 454722 - DNA, 20 bp, Artificial Sequence
  chemically synthesized
tgtttgtttgttttggttct

SEQ ID NO: 454723 - DNA, 20 bp, Artificial Sequence
  chemically synthesized
ttgttttggttctcagtatg

SEQ ID NO: 454724 - DNA, 20 bp, Artificial Sequence
  chemically synthesized
tgttttggttctcagtatgc

SEQ ID NO: 454725 - DNA, 20 bp, Artificial Sequence
  chemically synthesized
tcaaaagtcgcctgcatact

SEQ ID NO: 454726 - DNA, 20 bp, Artificial Sequence
  chemically synthesized
agtatgcaggcgacttttga

SEQ ID NO: 454727 - DNA, 20 bp, Artificial Sequence
  chemically synthesized
aatgtccagagtaccatcaa

SEQ ID NO: 454728 - DNA, 20 bp, Artificial Sequence
  chemically synthesized
ggcgacttttgatggtactc

SEQ ID NO: 454729 - DNA, 20 bp, Artificial Sequence
  chemically synthesized
tataatggacaaaatgtcca

SEQ ID NO: 454730 - DNA, 20 bp, Artificial Sequence
  chemically synthesized
tatataatggacaaaatgtc

SEQ ID NO: 454731 - DNA, 20 bp, Artificial Sequence
  chemically synthesized
tccagattctgcatatataa

SEQ ID NO: 454732 - DNA, 20 bp, Artificial Sequence
  chemically synthesized
cattttgtccattatatatg

SEQ ID NO: 454733 - DNA, 20 bp, Artificial Sequence
  chemically synthesized
tccattatatatgcagaatc

SEQ ID NO: 454734 - DNA, 20 bp, Artificial Sequence
  chemically synthesized
taaaagattgaaataagatc

SEQ ID NO: 454735 - DNA, 20 bp, Artificial Sequence
  chemically synthesized
ctaaaataaaagattgaaat

SEQ ID NO: 454736 - DNA, 20 bp, Artificial Sequence
  chemically synthesized
cttatttcaatcttttattt

SEQ ID NO: 454737 - DNA, 20 bp, Artificial Sequence
  chemically synthesized
gtaaatacctgctaaaataa

SEQ ID NO: 454738 - DNA, 20 bp, Artificial Sequence
  chemically synthesized
atttcaatcttttattttag

SEQ ID NO: 454739 - DNA, 20 bp, Artificial Sequence
  chemically synthesized
tttcaatcttttattttagc

SEQ ID NO: 454740 - DNA, 20 bp, Artificial Sequence
  chemically synthesized
tagcaggtatttaccatacg

SEQ ID NO: 454741 - DNA, 20 bp, Artificial Sequence
  chemically synthesized
cctgtgtattgaactacgta

SEQ ID NO: 454742 - DNA, 20 bp, Artificial Sequence
  chemically synthesized
accatacgtagttcaataca

SEQ ID NO: 454743 - DNA, 20 bp, Artificial Sequence
  chemically synthesized
ccatacgtagttcaatacac

SEQ ID NO: 454744 - DNA, 20 bp, Artificial Sequence
  chemically synthesized
cacagcccataaaagtagaa

SEQ ID NO: 454745 - DNA, 20 bp, Artificial Sequence
  chemically synthesized
caggtgccattctactttta

SEQ ID NO: 454746 - DNA, 20 bp, Artificial Sequence
  chemically synthesized
aggtgccattctacttttat

SEQ ID NO: 454747 - DNA, 20 bp, Artificial Sequence
  chemically synthesized
gggaccacagcccataaaag

SEQ ID NO: 454748 - DNA, 20 bp, Artificial Sequence
  chemically synthesized
tttgggaccacagcccataa

SEQ ID NO: 454749 - DNA, 20 bp, Artificial Sequence
  chemically synthesized
cattctacttttatgggctg

SEQ ID NO: 454750 - DNA, 20 bp, Artificial Sequence
  chemically synthesized
taaaactgtctttgggacca

SEQ ID NO: 454751 - DNA, 20 bp, Artificial Sequence
  chemically synthesized
ttttatgggctgtggtccca

SEQ ID NO: 454752 - DNA, 20 bp, Artificial Sequence
  chemically synthesized
atgggctgtggtcccaaaga

SEQ ID NO: 454753 - DNA, 20 bp, Artificial Sequence
  chemically synthesized
ctgaaaataaaactgtcttt

SEQ ID NO: 454754 - DNA, 20 bp, Artificial Sequence
  chemically synthesized
tctgaaaataaaactgtctt

SEQ ID NO: 454755 - DNA, 20 bp, Artificial Sequence
  chemically synthesized
cccaaagacagttttatttt

SEQ ID NO: 454756 - DNA, 20 bp, Artificial Sequence
  chemically synthesized
caaagacagttttattttca

SEQ ID NO: 454757 - DNA, 20 bp, Artificial Sequence
  chemically synthesized
caagcaggcctcaataacac

SEQ ID NO: 454758 - DNA, 20 bp, Artificial Sequence
  chemically synthesized
agagtatttctcgtgttatt

SEQ ID NO: 454759 - DNA, 20 bp, Artificial Sequence
  chemically synthesized
gagtatttctcgtgttattg

SEQ ID NO: 454760 - DNA, 20 bp, Artificial Sequence
  chemically synthesized
tcgtgttattgaggcctgct

SEQ ID NO: 454761 - DNA, 20 bp, Artificial Sequence
  chemically synthesized
catcactagataaaccaagc

SEQ ID NO: 454762 - DNA, 20 bp, Artificial Sequence
  chemically synthesized
gcatcactagataaaccaag

SEQ ID NO: 454763 - DNA, 20 bp, Artificial Sequence
  chemically synthesized
ccagcatcactagataaacc

SEQ ID NO: 454764 - DNA, 20 bp, Artificial Sequence
  chemically synthesized
tgaggcctgcttggtttatc

SEQ ID NO: 454765 - DNA, 20 bp, Artificial Sequence
  chemically synthesized
cttggtttatctagtgatgc

SEQ ID NO: 454766 - DNA, 20 bp, Artificial Sequence
  chemically synthesized
tttgagagtaccagcatcac

SEQ ID NO: 454767 - DNA, 20 bp, Artificial Sequence
  chemically synthesized
tcaaggatttttgagagtac

SEQ ID NO: 454768 - DNA, 20 bp, Artificial Sequence
  chemically synthesized
gtaccatcaaggatttttga

SEQ ID NO: 454769 - DNA, 20 bp, Artificial Sequence
  chemically synthesized
atgtaccatcaaggattttt

SEQ ID NO: 454770 - DNA, 20 bp, Artificial Sequence
  chemically synthesized
gtactctcaaaaatccttga

SEQ ID NO: 454771 - DNA, 20 bp, Artificial Sequence
  chemically synthesized
ccactcagaatgtaccatca

SEQ ID NO: 454772 - DNA, 20 bp, Artificial Sequence
  chemically synthesized
cccactcagaatgtaccatc

SEQ ID NO: 454773 - DNA, 20 bp, Artificial Sequence
  chemically synthesized
aatccttgatggtacattct

SEQ ID NO: 454774 - DNA, 20 bp, Artificial Sequence
  chemically synthesized
ccttgatggtacattctgag

SEQ ID NO: 454775 - DNA, 20 bp, Artificial Sequence
  chemically synthesized
cttgatggtacattctgagt

SEQ ID NO: 454776 - DNA, 20 bp, Artificial Sequence
  chemically synthesized
gatggtacattctgagtggg

SEQ ID NO: 454777 - DNA, 20 bp, Artificial Sequence
  chemically synthesized
gggaactccttctgcccact

SEQ ID NO: 454778 - DNA, 20 bp, Artificial Sequence
  chemically synthesized
ggtacattctgagtgggcag

SEQ ID NO: 454779 - DNA, 20 bp, Artificial Sequence
  chemically synthesized
gtacattctgagtgggcaga

SEQ ID NO: 454780 - DNA, 20 bp, Artificial Sequence
  chemically synthesized
acattctgagtgggcagaag

SEQ ID NO: 454781 - DNA, 20 bp, Artificial Sequence
  chemically synthesized
agtgggcagaaggagttccc

SEQ ID NO: 454782 - DNA, 20 bp, Artificial Sequence
  chemically synthesized
gcagaaggagttccccagac

SEQ ID NO: 454783 - DNA, 20 bp, Artificial Sequence
  chemically synthesized
cagaaggagttccccagact

SEQ ID NO: 454784 - DNA, 20 bp, Artificial Sequence
  chemically synthesized
agaaggagttccccagacta

SEQ ID NO: 454785 - DNA, 20 bp, Artificial Sequence
  chemically synthesized
agcaccagcaccctagtctg

SEQ ID NO: 454786 - DNA, 20 bp, Artificial Sequence
  chemically synthesized
cagcaccagcaccctagtct

SEQ ID NO: 454787 - DNA, 20 bp, Artificial Sequence
  chemically synthesized
gcagcaccagcaccctagtc

SEQ ID NO: 454788 - DNA, 20 bp, Artificial Sequence
  chemically synthesized
agttccccagactagggtgc

SEQ ID NO: 454789 - DNA, 20 bp, Artificial Sequence
  chemically synthesized
acctagcagcaccagcaccc

SEQ ID NO: 454790 - DNA, 20 bp, Artificial Sequence
  chemically synthesized
gactagggtgctggtgctgc

SEQ ID NO: 454791 - DNA, 20 bp, Artificial Sequence
  chemically synthesized
cctactctacctagcagcac

SEQ ID NO: 454792 - DNA, 20 bp, Artificial Sequence
  chemically synthesized
actagggtgctggtgctgct

SEQ ID NO: 454793 - DNA, 20 bp, Artificial Sequence
  chemically synthesized
agggtgctggtgctgctagg

SEQ ID NO: 454794 - DNA, 20 bp, Artificial Sequence
  chemically synthesized
ggtgctggtgctgctaggta

SEQ ID NO: 454795 - DNA, 20 bp, Artificial Sequence
  chemically synthesized
gaaacccctactctacctag

SEQ ID NO: 454796 - DNA, 20 bp, Artificial Sequence
  chemically synthesized
gctggtgctgctaggtagag

SEQ ID NO: 454797 - DNA, 20 bp, Artificial Sequence
  chemically synthesized
taagaaacccctactctacc

SEQ ID NO: 454798 - DNA, 20 bp, Artificial Sequence
  chemically synthesized
ctggtgctgctaggtagagt

SEQ ID NO: 454799 - DNA, 20 bp, Artificial Sequence
  chemically synthesized
tggtgctgctaggtagagta

SEQ ID NO: 454800 - DNA, 20 bp, Artificial Sequence
  chemically synthesized
ggtgctgctaggtagagtag

SEQ ID NO: 454801 - DNA, 20 bp, Artificial Sequence
  chemically synthesized
taggtagagtaggggtttct

SEQ ID NO: 454802 - DNA, 20 bp, Artificial Sequence
  chemically synthesized
gtaggggtttcttagatcta

SEQ ID NO: 454803 - DNA, 20 bp, Artificial Sequence
  chemically synthesized
acttttatctctatagatct

SEQ ID NO: 454804 - DNA, 20 bp, Artificial Sequence
  chemically synthesized
aggggtttcttagatctata

SEQ ID NO: 454805 - DNA, 20 bp, Artificial Sequence
  chemically synthesized
aggaaacacttttatctcta

SEQ ID NO: 454806 - DNA, 20 bp, Artificial Sequence
  chemically synthesized
tcttagatctatagagataa

SEQ ID NO: 454807 - DNA, 20 bp, Artificial Sequence
  chemically synthesized
atagagataaaagtgtttcc

SEQ ID NO: 454808 - DNA, 20 bp, Artificial Sequence
  chemically synthesized
agataaaagtgtttcctaga

SEQ ID NO: 454809 - DNA, 20 bp, Artificial Sequence
  chemically synthesized
gataaaagtgtttcctagat

SEQ ID NO: 454810 - DNA, 20 bp, Artificial Sequence
  chemically synthesized
ctaacacaataatcctatct

SEQ ID NO: 454811 - DNA, 20 bp, Artificial Sequence
  chemically synthesized
tctaacacaataatcctatc

SEQ ID NO: 454812 - DNA, 20 bp, Artificial Sequence
  chemically synthesized
cctagataggattattgtgt

SEQ ID NO: 454813 - DNA, 20 bp, Artificial Sequence
  chemically synthesized
ttgtgttagaatccctatac

SEQ ID NO: 454814 - DNA, 20 bp, Artificial Sequence
  chemically synthesized
agctggagggtaccagtata

SEQ ID NO: 454815 - DNA, 20 bp, Artificial Sequence
  chemically synthesized
cagctggagggtaccagtat

SEQ ID NO: 454816 - DNA, 20 bp, Artificial Sequence
  chemically synthesized
gcagctggagggtaccagta

SEQ ID NO: 454817 - DNA, 20 bp, Artificial Sequence
  chemically synthesized
ttggagcagctggagggtac

SEQ ID NO: 454818 - DNA, 20 bp, Artificial Sequence
  chemically synthesized
atccctatactggtaccctc

SEQ ID NO: 454819 - DNA, 20 bp, Artificial Sequence
  chemically synthesized
gagacattggagcagctgga

SEQ ID NO: 454820 - DNA, 20 bp, Artificial Sequence
  chemically synthesized
agagacattggagcagctgg

SEQ ID NO: 454821 - DNA, 20 bp, Artificial Sequence
  chemically synthesized
cagagacattggagcagctg

SEQ ID NO: 454822 - DNA, 20 bp, Artificial Sequence
  chemically synthesized
cccagagacattggagcagc

SEQ ID NO: 454823 - DNA, 20 bp, Artificial Sequence
  chemically synthesized
tttacccagagacattggag

SEQ ID NO: 454824 - DNA, 20 bp, Artificial Sequence
  chemically synthesized
acttttacccagagacattg

SEQ ID NO: 454825 - DNA, 20 bp, Artificial Sequence
  chemically synthesized
tccagctgctccaatgtctc

SEQ ID NO: 454826 - DNA, 20 bp, Artificial Sequence
  chemically synthesized
ccacttttacccagagacat

SEQ ID NO: 454827 - DNA, 20 bp, Artificial Sequence
  chemically synthesized
ccagctgctccaatgtctct

SEQ ID NO: 454828 - DNA, 20 bp, Artificial Sequence
  chemically synthesized
gctccaatgtctctgggtaa

SEQ ID NO: 454829 - DNA, 20 bp, Artificial Sequence
  chemically synthesized
aatccctccacttttaccca

SEQ ID NO: 454830 - DNA, 20 bp, Artificial Sequence
  chemically synthesized
agaatccctccacttttacc

SEQ ID NO: 454831 - DNA, 20 bp, Artificial Sequence
  chemically synthesized
ccaatgtctctgggtaaaag

SEQ ID NO: 454832 - DNA, 20 bp, Artificial Sequence
  chemically synthesized
aatgtctctgggtaaaagtg

SEQ ID NO: 454833 - DNA, 20 bp, Artificial Sequence
  chemically synthesized
atgtctctgggtaaaagtgg

SEQ ID NO: 454834 - DNA, 20 bp, Artificial Sequence
  chemically synthesized
tgtctctgggtaaaagtgga

SEQ ID NO: 454835 - DNA, 20 bp, Artificial Sequence
  chemically synthesized
taaaagtggagggattctca

SEQ ID NO: 454836 - DNA, 20 bp, Artificial Sequence
  chemically synthesized
tggagggattctcatggcca

SEQ ID NO: 454837 - DNA, 20 bp, Artificial Sequence
  chemically synthesized
ccgttggacgctatggccat

SEQ ID NO: 454838 - DNA, 20 bp, Artificial Sequence
  chemically synthesized
gggaagcccgttggacgcta

SEQ ID NO: 454839 - DNA, 20 bp, Artificial Sequence
  chemically synthesized
ctcatggccatagcgtccaa

SEQ ID NO: 454840 - DNA, 20 bp, Artificial Sequence
  chemically synthesized
tcatggccatagcgtccaac

SEQ ID NO: 454841 - DNA, 20 bp, Artificial Sequence
  chemically synthesized
gactagcctgggaagcccgt

SEQ ID NO: 454842 - DNA, 20 bp, Artificial Sequence
  chemically synthesized
atagcgtccaacgggcttcc

SEQ ID NO: 454843 - DNA, 20 bp, Artificial Sequence
  chemically synthesized
tagcgtccaacgggcttccc

SEQ ID NO: 454844 - DNA, 20 bp, Artificial Sequence
  chemically synthesized
gtccaacgggcttcccaggc

SEQ ID NO: 454845 - DNA, 20 bp, Artificial Sequence
  chemically synthesized
caaagagtgactagcctggg

SEQ ID NO: 454846 - DNA, 20 bp, Artificial Sequence
  chemically synthesized
ccacaaagagtgactagcct

SEQ ID NO: 454847 - DNA, 20 bp, Artificial Sequence
  chemically synthesized
accacaaagagtgactagcc

SEQ ID NO: 454848 - DNA, 20 bp, Artificial Sequence
  chemically synthesized
tatccaccacaaagagtgac

SEQ ID NO: 454849 - DNA, 20 bp, Artificial Sequence
  chemically synthesized
cccaggctagtcactctttg

SEQ ID NO: 454850 - DNA, 20 bp, Artificial Sequence
  chemically synthesized
aggctagtcactctttgtgg

SEQ ID NO: 454851 - DNA, 20 bp, Artificial Sequence
  chemically synthesized
gtaaggctatccaccacaaa

SEQ ID NO: 454852 - DNA, 20 bp, Artificial Sequence
  chemically synthesized
tggtaaggctatccaccaca

SEQ ID NO: 454853 - DNA, 20 bp, Artificial Sequence
  chemically synthesized
tagtcactctttgtggtgga

SEQ ID NO: 454854 - DNA, 20 bp, Artificial Sequence
  chemically synthesized
tttgtggtggatagccttac

SEQ ID NO: 454855 - DNA, 20 bp, Artificial Sequence
  chemically synthesized
gcaaacacagagcactggta

SEQ ID NO: 454856 - DNA, 20 bp, Artificial Sequence
  chemically synthesized
ggcaaacacagagcactggt

SEQ ID NO: 454857 - DNA, 20 bp, Artificial Sequence
  chemically synthesized
cctgggcaaacacagagcac

SEQ ID NO: 454858 - DNA, 20 bp, Artificial Sequence
  chemically synthesized
gagatacctgggcaaacaca

SEQ ID NO: 454859 - DNA, 20 bp, Artificial Sequence
  chemically synthesized
cagagatacctgggcaaaca

SEQ ID NO: 454860 - DNA, 20 bp, Artificial Sequence
  chemically synthesized
accagtgctctgtgtttgcc

SEQ ID NO: 454861 - DNA, 20 bp, Artificial Sequence
  chemically synthesized
ccagtgctctgtgtttgccc

SEQ ID NO: 454862 - DNA, 20 bp, Artificial Sequence
  chemically synthesized
ttccccacccagagatacct

SEQ ID NO: 454863 - DNA, 20 bp, Artificial Sequence
  chemically synthesized
cttccccacccagagatacc

SEQ ID NO: 454864 - DNA, 20 bp, Artificial Sequence
  chemically synthesized
tgtgtttgcccaggtatctc

SEQ ID NO: 454865 - DNA, 20 bp, Artificial Sequence
  chemically synthesized
gtgtttgcccaggtatctct

SEQ ID NO: 454866 - DNA, 20 bp, Artificial Sequence
  chemically synthesized
tttgcccaggtatctctggg

SEQ ID NO: 454867 - DNA, 20 bp, Artificial Sequence
  chemically synthesized
ttgcccaggtatctctgggt

SEQ ID NO: 454868 - DNA, 20 bp, Artificial Sequence
  chemically synthesized
tgcccaggtatctctgggtg

SEQ ID NO: 454869 - DNA, 20 bp, Artificial Sequence
  chemically synthesized
ggacttctcttccccaccca

SEQ ID NO: 454870 - DNA, 20 bp, Artificial Sequence
  chemically synthesized
ccaggtatctctgggtgggg

SEQ ID NO: 454871 - DNA, 20 bp, Artificial Sequence
  chemically synthesized
taggacttctcttccccacc

SEQ ID NO: 454872 - DNA, 20 bp, Artificial Sequence
  chemically synthesized
aggtatctctgggtggggaa

SEQ ID NO: 454873 - DNA, 20 bp, Artificial Sequence
  chemically synthesized
tatctctgggtggggaagag

SEQ ID NO: 454874 - DNA, 20 bp, Artificial Sequence
  chemically synthesized
tgggtggggaagagaagtcc

SEQ ID NO: 454875 - DNA, 20 bp, Artificial Sequence
  chemically synthesized
gggtggggaagagaagtcct

SEQ ID NO: 454876 - DNA, 20 bp, Artificial Sequence
  chemically synthesized
atctttggtcatatggacct

SEQ ID NO: 454877 - DNA, 20 bp, Artificial Sequence
  chemically synthesized
catctttggtcatatggacc

SEQ ID NO: 454878 - DNA, 20 bp, Artificial Sequence
  chemically synthesized
agaaagcatctttggtcata

SEQ ID NO: 454879 - DNA, 20 bp, Artificial Sequence
  chemically synthesized
gtcctaggtccatatgacca

SEQ ID NO: 454880 - DNA, 20 bp, Artificial Sequence
  chemically synthesized
cctggttcagaaagcatctt

SEQ ID NO: 454881 - DNA, 20 bp, Artificial Sequence
  chemically synthesized
accaaagatgctttctgaac

SEQ ID NO: 454882 - DNA, 20 bp, Artificial Sequence
  chemically synthesized
aataagtgacctggttcaga

SEQ ID NO: 454883 - DNA, 20 bp, Artificial Sequence
  chemically synthesized
ccaaagatgctttctgaacc

SEQ ID NO: 454884 - DNA, 20 bp, Artificial Sequence
  chemically synthesized
tcataataagtgacctggtt

SEQ ID NO: 454885 - DNA, 20 bp, Artificial Sequence
  chemically synthesized
cacaatcataataagtgacc

SEQ ID NO: 454886 - DNA, 20 bp, Artificial Sequence
  chemically synthesized
acaagagacacaatcataat

SEQ ID NO: 454887 - DNA, 20 bp, Artificial Sequence
  chemically synthesized
tggaaaggcagaaattacaa

SEQ ID NO: 454888 - DNA, 20 bp, Artificial Sequence
  chemically synthesized
ggtggaaaggcagaaattac

SEQ ID NO: 454889 - DNA, 20 bp, Artificial Sequence
  chemically synthesized
aagacatcgaggtggaaagg

SEQ ID NO: 454890 - DNA, 20 bp, Artificial Sequence
  chemically synthesized
aggaagacatcgaggtggaa

SEQ ID NO: 454891 - DNA, 20 bp, Artificial Sequence
  chemically synthesized
caggaagacatcgaggtgga

SEQ ID NO: 454892 - DNA, 20 bp, Artificial Sequence
  chemically synthesized
ccgacaggaagacatcgagg

SEQ ID NO: 454893 - DNA, 20 bp, Artificial Sequence
  chemically synthesized
tttccgacaggaagacatcg

SEQ ID NO: 454894 - DNA, 20 bp, Artificial Sequence
  chemically synthesized
ttttccgacaggaagacatc

SEQ ID NO: 454895 - DNA, 20 bp, Artificial Sequence
  chemically synthesized
ccacctcgatgtcttcctgt

SEQ ID NO: 454896 - DNA, 20 bp, Artificial Sequence
  chemically synthesized
aggctctcttttccgacagg

SEQ ID NO: 454897 - DNA, 20 bp, Artificial Sequence
  chemically synthesized
tcgatgtcttcctgtcggaa

SEQ ID NO: 454898 - DNA, 20 bp, Artificial Sequence
  chemically synthesized
ctgaggctctcttttccgac

SEQ ID NO: 454899 - DNA, 20 bp, Artificial Sequence
  chemically synthesized
actgaggctctcttttccga

SEQ ID NO: 454900 - DNA, 20 bp, Artificial Sequence
  chemically synthesized
gatgtcttcctgtcggaaaa

SEQ ID NO: 454901 - DNA, 20 bp, Artificial Sequence
  chemically synthesized
tgtcttcctgtcggaaaaga

SEQ ID NO: 454902 - DNA, 20 bp, Artificial Sequence
  chemically synthesized
cctgtcggaaaagagagcct

SEQ ID NO: 454903 - DNA, 20 bp, Artificial Sequence
  chemically synthesized
tcttcatacctgcagaactg

SEQ ID NO: 454904 - DNA, 20 bp, Artificial Sequence
  chemically synthesized
aaaagagagcctcagttctg

SEQ ID NO: 454905 - DNA, 20 bp, Artificial Sequence
  chemically synthesized
ctcttcatacctgcagaact

SEQ ID NO: 454906 - DNA, 20 bp, Artificial Sequence
  chemically synthesized
aaagagagcctcagttctgc

SEQ ID NO: 454907 - DNA, 20 bp, Artificial Sequence
  chemically synthesized
ctgaagcctcttcatacctg

SEQ ID NO: 454908 - DNA, 20 bp, Artificial Sequence
  chemically synthesized
gcctcagttctgcaggtatg

SEQ ID NO: 454909 - DNA, 20 bp, Artificial Sequence
  chemically synthesized
ctcagttctgcaggtatgaa

SEQ ID NO: 454910 - DNA, 20 bp, Artificial Sequence
  chemically synthesized
tcagttctgcaggtatgaag

SEQ ID NO: 454911 - DNA, 20 bp, Artificial Sequence
  chemically synthesized
ctgcaggtatgaagaggctt

SEQ ID NO: 454912 - DNA, 20 bp, Artificial Sequence
  chemically synthesized
caggtatgaagaggcttcag

SEQ ID NO: 454913 - DNA, 20 bp, Artificial Sequence
  chemically synthesized
tatgaagaggcttcagtagt

SEQ ID NO: 454914 - DNA, 20 bp, Artificial Sequence
  chemically synthesized
cacaagtgtcctaactactg

SEQ ID NO: 454915 - DNA, 20 bp, Artificial Sequence
  chemically synthesized
atgaagaggcttcagtagtt

SEQ ID NO: 454916 - DNA, 20 bp, Artificial Sequence
  chemically synthesized
ttcagtagttaggacacttg

SEQ ID NO: 454917 - DNA, 20 bp, Artificial Sequence
  chemically synthesized
gtagttaggacacttgtggc

SEQ ID NO: 454918 - DNA, 20 bp, Artificial Sequence
  chemically synthesized
aggcacagagatcttgccac

SEQ ID NO: 454919 - DNA, 20 bp, Artificial Sequence
  chemically synthesized
gtctgttcccaataggcaca

SEQ ID NO: 454920 - DNA, 20 bp, Artificial Sequence
  chemically synthesized
ggcaagatctctgtgcctat

SEQ ID NO: 454921 - DNA, 20 bp, Artificial Sequence
  chemically synthesized
ctgtctgttcccaataggca

SEQ ID NO: 454922 - DNA, 20 bp, Artificial Sequence
  chemically synthesized
gcaagatctctgtgcctatt

SEQ ID NO: 454923 - DNA, 20 bp, Artificial Sequence
  chemically synthesized
aagcactgtctgttcccaat

SEQ ID NO: 454924 - DNA, 20 bp, Artificial Sequence
  chemically synthesized
atctctgtgcctattgggaa

SEQ ID NO: 454925 - DNA, 20 bp, Artificial Sequence
  chemically synthesized
aaagcactgtctgttcccaa

SEQ ID NO: 454926 - DNA, 20 bp, Artificial Sequence
  chemically synthesized
ctgtgcctattgggaacaga

SEQ ID NO: 454927 - DNA, 20 bp, Artificial Sequence
  chemically synthesized
tgggaacagacagtgctttc

SEQ ID NO: 454928 - DNA, 20 bp, Artificial Sequence
  chemically synthesized
aacagacagtgctttctgga

SEQ ID NO: 454929 - DNA, 20 bp, Artificial Sequence
  chemically synthesized
acagacagtgctttctggat

SEQ ID NO: 454930 - DNA, 20 bp, Artificial Sequence
  chemically synthesized
agaacaaaatcccatccaga

SEQ ID NO: 454931 - DNA, 20 bp, Artificial Sequence
  chemically synthesized
ctcaagaacaaaatcccatc

SEQ ID NO: 454932 - DNA, 20 bp, Artificial Sequence
  chemically synthesized
ctggatgggattttgttctt

SEQ ID NO: 454933 - DNA, 20 bp, Artificial Sequence
  chemically synthesized
tggatgggattttgttcttg

SEQ ID NO: 454934 - DNA, 20 bp, Artificial Sequence
  chemically synthesized
ggatgggattttgttcttga

SEQ ID NO: 454935 - DNA, 20 bp, Artificial Sequence
  chemically synthesized
tactagaagagggatccctc

SEQ ID NO: 454936 - DNA, 20 bp, Artificial Sequence
  chemically synthesized
ttcttgagggatccctcttc

SEQ ID NO: 454937 - DNA, 20 bp, Artificial Sequence
  chemically synthesized
agccacagggtactagaaga

SEQ ID NO: 454938 - DNA, 20 bp, Artificial Sequence
  chemically synthesized
cagccacagggtactagaag

SEQ ID NO: 454939 - DNA, 20 bp, Artificial Sequence
  chemically synthesized
gcagccacagggtactagaa

SEQ ID NO: 454940 - DNA, 20 bp, Artificial Sequence
  chemically synthesized
gggcagccacagggtactag

SEQ ID NO: 454941 - DNA, 20 bp, Artificial Sequence
  chemically synthesized
ctggggcagccacagggtac

SEQ ID NO: 454942 - DNA, 20 bp, Artificial Sequence
  chemically synthesized
atccctcttctagtaccctg

SEQ ID NO: 454943 - DNA, 20 bp, Artificial Sequence
  chemically synthesized
gagatactggggcagccaca

SEQ ID NO: 454944 - DNA, 20 bp, Artificial Sequence
  chemically synthesized
agagatactggggcagccac

SEQ ID NO: 454945 - DNA, 20 bp, Artificial Sequence
  chemically synthesized
cagagatactggggcagcca

SEQ ID NO: 454946 - DNA, 20 bp, Artificial Sequence
  chemically synthesized
ctagtaccctgtggctgccc

SEQ ID NO: 454947 - DNA, 20 bp, Artificial Sequence
  chemically synthesized
attgtacagagatactgggg

SEQ ID NO: 454948 - DNA, 20 bp, Artificial Sequence
  chemically synthesized
tctattgtacagagatactg

SEQ ID NO: 454949 - DNA, 20 bp, Artificial Sequence
  chemically synthesized
ctctattgtacagagatact

SEQ ID NO: 454950 - DNA, 20 bp, Artificial Sequence
  chemically synthesized
cctctattgtacagagatac

SEQ ID NO: 454951 - DNA, 20 bp, Artificial Sequence
  chemically synthesized
gccccagtatctctgtacaa

SEQ ID NO: 454952 - DNA, 20 bp, Artificial Sequence
  chemically synthesized
aggctgccctctattgtaca

SEQ ID NO: 454953 - DNA, 20 bp, Artificial Sequence
  chemically synthesized
cccagtatctctgtacaata

SEQ ID NO: 454954 - DNA, 20 bp, Artificial Sequence
  chemically synthesized
tgaggctgccctctattgta

SEQ ID NO: 454955 - DNA, 20 bp, Artificial Sequence
  chemically synthesized
ccagtatctctgtacaatag

SEQ ID NO: 454956 - DNA, 20 bp, Artificial Sequence
  chemically synthesized
cagtatctctgtacaataga

SEQ ID NO: 454957 - DNA, 20 bp, Artificial Sequence
  chemically synthesized
tatctctgtacaatagaggg

SEQ ID NO: 454958 - DNA, 20 bp, Artificial Sequence
  chemically synthesized
tgtacaatagagggcagcct

SEQ ID NO: 454959 - DNA, 20 bp, Artificial Sequence
  chemically synthesized
tctttgttcctgtgggtctg

SEQ ID NO: 454960 - DNA, 20 bp, Artificial Sequence
  chemically synthesized
agagggcagcctcagaccca

SEQ ID NO: 454961 - DNA, 20 bp, Artificial Sequence
  chemically synthesized
ctctttgttcctgtgggtct

SEQ ID NO: 454962 - DNA, 20 bp, Artificial Sequence
  chemically synthesized
gagggcagcctcagacccac

SEQ ID NO: 454963 - DNA, 20 bp, Artificial Sequence
  chemically synthesized
ggaagcctctttgttcctgt

SEQ ID NO: 454964 - DNA, 20 bp, Artificial Sequence
  chemically synthesized
aggaagcctctttgttcctg

SEQ ID NO: 454965 - DNA, 20 bp, Artificial Sequence
  chemically synthesized
gcctcagacccacaggaaca

SEQ ID NO: 454966 - DNA, 20 bp, Artificial Sequence
  chemically synthesized
ctcagacccacaggaacaaa

SEQ ID NO: 454967 - DNA, 20 bp, Artificial Sequence
  chemically synthesized
tcagacccacaggaacaaag

SEQ ID NO: 454968 - DNA, 20 bp, Artificial Sequence
  chemically synthesized
aacaaagaggcttcctgcac

SEQ ID NO: 454969 - DNA, 20 bp, Artificial Sequence
  chemically synthesized
tctaagtggcctagtgcagg

SEQ ID NO: 454970 - DNA, 20 bp, Artificial Sequence
  chemically synthesized
acaaagaggcttcctgcact

SEQ ID NO: 454971 - DNA, 20 bp, Artificial Sequence
  chemically synthesized
cactctaagtggcctagtgc

SEQ ID NO: 454972 - DNA, 20 bp, Artificial Sequence
  chemically synthesized
ccactctaagtggcctagtg

SEQ ID NO: 454973 - DNA, 20 bp, Artificial Sequence
  chemically synthesized
gcttcctgcactaggccact

SEQ ID NO: 454974 - DNA, 20 bp, Artificial Sequence
  chemically synthesized
ttttaccactctaagtggcc

SEQ ID NO: 454975 - DNA, 20 bp, Artificial Sequence
  chemically synthesized
ttcctgcactaggccactta

SEQ ID NO: 454976 - DNA, 20 bp, Artificial Sequence
  chemically synthesized
ctgcactaggccacttagag

SEQ ID NO: 454977 - DNA, 20 bp, Artificial Sequence
  chemically synthesized
agggattttaccactctaag

SEQ ID NO: 454978 - DNA, 20 bp, Artificial Sequence
  chemically synthesized
acaagggattttaccactct

SEQ ID NO: 454979 - DNA, 20 bp, Artificial Sequence
  chemically synthesized
tagagtggtaaaatcccttg

SEQ ID NO: 454980 - DNA, 20 bp, Artificial Sequence
  chemically synthesized
agtggtaaaatcccttgtgg

SEQ ID NO: 454981 - DNA, 20 bp, Artificial Sequence
  chemically synthesized
gctgggtgcaactgccacaa

SEQ ID NO: 454982 - DNA, 20 bp, Artificial Sequence
  chemically synthesized
ggctgggtgcaactgccaca

SEQ ID NO: 454983 - DNA, 20 bp, Artificial Sequence
  chemically synthesized
tggctgggtgcaactgccac

SEQ ID NO: 454984 - DNA, 20 bp, Artificial Sequence
  chemically synthesized
tcccttgtggcagttgcacc

SEQ ID NO: 454985 - DNA, 20 bp, Artificial Sequence
  chemically synthesized
caggaaatacttaggtggct

SEQ ID NO: 454986 - DNA, 20 bp, Artificial Sequence
  chemically synthesized
gcagttgcacccagccacct

SEQ ID NO: 454987 - DNA, 20 bp, Artificial Sequence
  chemically synthesized
acaggaaatacttaggtggc

SEQ ID NO: 454988 - DNA, 20 bp, Artificial Sequence
  chemically synthesized
cacaacaggaaatacttagg

SEQ ID NO: 454989 - DNA, 20 bp, Artificial Sequence
  chemically synthesized
actcacaacaggaaatactt

SEQ ID NO: 454990 - DNA, 20 bp, Artificial Sequence
  chemically synthesized
cactcacaacaggaaatact

SEQ ID NO: 454991 - DNA, 20 bp, Artificial Sequence
  chemically synthesized
acctaagtatttcctgttgt

SEQ ID NO: 454992 - DNA, 20 bp, Artificial Sequence
  chemically synthesized
cactcactctcactcacaac

SEQ ID NO: 454993 - DNA, 20 bp, Artificial Sequence
  chemically synthesized
tcactcactctcactcacaa

SEQ ID NO: 454994 - DNA, 20 bp, Artificial Sequence
  chemically synthesized
aagtatttcctgttgtgagt

SEQ ID NO: 454995 - DNA, 20 bp, Artificial Sequence
  chemically synthesized
gtatttcctgttgtgagtga

SEQ ID NO: 454996 - DNA, 20 bp, Artificial Sequence
  chemically synthesized
ttcctgttgtgagtgagagt

SEQ ID NO: 454997 - DNA, 20 bp, Artificial Sequence
  chemically synthesized
tgttgtgagtgagagtgagt

SEQ ID NO: 454998 - DNA, 20 bp, Artificial Sequence
  chemically synthesized
ttgtgagtgagagtgagtga

SEQ ID NO: 454999 - DNA, 20 bp, Artificial Sequence
  chemically synthesized
gagagtgagtgagagtgtct

SEQ ID NO: 455000 - DNA, 20 bp, Artificial Sequence
  chemically synthesized
agagtgagtgagagtgtctt

SEQ ID NO: 455001 - DNA, 20 bp, Artificial Sequence
  chemically synthesized
gtgagagtgtcttaggcctg

SEQ ID NO: 455002 - DNA, 20 bp, Artificial Sequence
  chemically synthesized
ctctttgtccctacaggcct

SEQ ID NO: 455003 - DNA, 20 bp, Artificial Sequence
  chemically synthesized
tgagagtgtcttaggcctgt

SEQ ID NO: 455004 - DNA, 20 bp, Artificial Sequence
  chemically synthesized
gagagtgtcttaggcctgta

SEQ ID NO: 455005 - DNA, 20 bp, Artificial Sequence
  chemically synthesized
ggaagcctctttgtccctac

SEQ ID NO: 455006 - DNA, 20 bp, Artificial Sequence
  chemically synthesized
cggaagcctctttgtcccta

SEQ ID NO: 455007 - DNA, 20 bp, Artificial Sequence
  chemically synthesized
gtcttaggcctgtagggaca

SEQ ID NO: 455008 - DNA, 20 bp, Artificial Sequence
  chemically synthesized
cttaggcctgtagggacaaa

SEQ ID NO: 455009 - DNA, 20 bp, Artificial Sequence
  chemically synthesized
ttaggcctgtagggacaaag

SEQ ID NO: 455010 - DNA, 20 bp, Artificial Sequence
  chemically synthesized
gtagggacaaagaggcttcc

SEQ ID NO: 455011 - DNA, 20 bp, Artificial Sequence
  chemically synthesized
tagggacaaagaggcttccg

SEQ ID NO: 455012 - DNA, 20 bp, Artificial Sequence
  chemically synthesized
gacaaagaggcttccgaggt

SEQ ID NO: 455013 - DNA, 20 bp, Artificial Sequence
  chemically synthesized
agcaagtggcccaacctcgg

SEQ ID NO: 455014 - DNA, 20 bp, Artificial Sequence
  chemically synthesized
acaaagaggcttccgaggtt

SEQ ID NO: 455015 - DNA, 20 bp, Artificial Sequence
  chemically synthesized
cacagcaagtggcccaacct

SEQ ID NO: 455016 - DNA, 20 bp, Artificial Sequence
  chemically synthesized
aggaattttgtcacagcaag

SEQ ID NO: 455017 - DNA, 20 bp, Artificial Sequence
  chemically synthesized
tagaggaattttgtcacagc

SEQ ID NO: 455018 - DNA, 20 bp, Artificial Sequence
  chemically synthesized
tgtttagaggaattttgtca

SEQ ID NO: 455019 - DNA, 20 bp, Artificial Sequence
  chemically synthesized
caagtggcagtattgtttag

SEQ ID NO: 455020 - DNA, 20 bp, Artificial Sequence
  chemically synthesized
acaagtggcagtattgttta

SEQ ID NO: 455021 - DNA, 20 bp, Artificial Sequence
  chemically synthesized
agacaagtggcagtattgtt

SEQ ID NO: 455022 - DNA, 20 bp, Artificial Sequence
  chemically synthesized
gctgaaaaatagacaagtgg

SEQ ID NO: 455023 - DNA, 20 bp, Artificial Sequence
  chemically synthesized
tctgctgaaaaatagacaag

SEQ ID NO: 455024 - DNA, 20 bp, Artificial Sequence
  chemically synthesized
tgctctgctgaaaaatagac

SEQ ID NO: 455025 - DNA, 20 bp, Artificial Sequence
  chemically synthesized
actgccacttgtctattttt

SEQ ID NO: 455026 - DNA, 20 bp, Artificial Sequence
  chemically synthesized
taccatgctctgctgaaaaa

SEQ ID NO: 455027 - DNA, 20 bp, Artificial Sequence
  chemically synthesized
gccacttgtctatttttcag

SEQ ID NO: 455028 - DNA, 20 bp, Artificial Sequence
  chemically synthesized
cacttgtctatttttcagca

SEQ ID NO: 455029 - DNA, 20 bp, Artificial Sequence
  chemically synthesized
gtctatttttcagcagagca

SEQ ID NO: 455030 - DNA, 20 bp, Artificial Sequence
  chemically synthesized
tatttttcagcagagcatgg

SEQ ID NO: 455031 - DNA, 20 bp, Artificial Sequence
  chemically synthesized
gcatggtagtcctaaatccc

SEQ ID NO: 455032 - DNA, 20 bp, Artificial Sequence
  chemically synthesized
ctctcctttcccagggattt

SEQ ID NO: 455033 - DNA, 20 bp, Artificial Sequence
  chemically synthesized
catggtagtcctaaatccct

SEQ ID NO: 455034 - DNA, 20 bp, Artificial Sequence
  chemically synthesized
cctctcctttcccagggatt

SEQ ID NO: 455035 - DNA, 20 bp, Artificial Sequence
  chemically synthesized
gtagtcctaaatccctggga

SEQ ID NO: 455036 - DNA, 20 bp, Artificial Sequence
  chemically synthesized
tagtcctaaatccctgggaa

SEQ ID NO: 455037 - DNA, 20 bp, Artificial Sequence
  chemically synthesized
taagtgcctctcctttccca

SEQ ID NO: 455038 - DNA, 20 bp, Artificial Sequence
  chemically synthesized
gtcctaaatccctgggaaag

SEQ ID NO: 455039 - DNA, 20 bp, Artificial Sequence
  chemically synthesized
gtaagtgcctctcctttccc

SEQ ID NO: 455040 - DNA, 20 bp, Artificial Sequence
  chemically synthesized
ggtaagtgcctctcctttcc

SEQ ID NO: 455041 - DNA, 20 bp, Artificial Sequence
  chemically synthesized
cctaaatccctgggaaagga

SEQ ID NO: 455042 - DNA, 20 bp, Artificial Sequence
  chemically synthesized
ctaaatccctgggaaaggag

SEQ ID NO: 455043 - DNA, 20 bp, Artificial Sequence
  chemically synthesized
gaaaggagaggcacttaccc

SEQ ID NO: 455044 - DNA, 20 bp, Artificial Sequence
  chemically synthesized
taacattaagcagctagggt

SEQ ID NO: 455045 - DNA, 20 bp, Artificial Sequence
  chemically synthesized
catctaacattaagcagcta

SEQ ID NO: 455046 - DNA, 20 bp, Artificial Sequence
  chemically synthesized
ccatctaacattaagcagct

SEQ ID NO: 455047 - DNA, 20 bp, Artificial Sequence
  chemically synthesized
cccatctaacattaagcagc

SEQ ID NO: 455048 - DNA, 20 bp, Artificial Sequence
  chemically synthesized
ggagcccatctaacattaag

SEQ ID NO: 455049 - DNA, 20 bp, Artificial Sequence
  chemically synthesized
ttaccctagctgcttaatgt

SEQ ID NO: 455050 - DNA, 20 bp, Artificial Sequence
  chemically synthesized
atgggagcccatctaacatt

SEQ ID NO: 455051 - DNA, 20 bp, Artificial Sequence
  chemically synthesized
cctagctgcttaatgttaga

SEQ ID NO: 455052 - DNA, 20 bp, Artificial Sequence
  chemically synthesized
ctagctgcttaatgttagat

SEQ ID NO: 455053 - DNA, 20 bp, Artificial Sequence
  chemically synthesized
tggcaagggctattgaatgg

SEQ ID NO: 455054 - DNA, 20 bp, Artificial Sequence
  chemically synthesized
ttagatgggctcccattcaa

SEQ ID NO: 455055 - DNA, 20 bp, Artificial Sequence
  chemically synthesized
actggcaagggctattgaat

SEQ ID NO: 455056 - DNA, 20 bp, Artificial Sequence
  chemically synthesized
aactggcaagggctattgaa

SEQ ID NO: 455057 - DNA, 20 bp, Artificial Sequence
  chemically synthesized
tcccattcaatagcccttgc

SEQ ID NO: 455058 - DNA, 20 bp, Artificial Sequence
  chemically synthesized
gagcctggtataactggcaa

SEQ ID NO: 455059 - DNA, 20 bp, Artificial Sequence
  chemically synthesized
tgagcctggtataactggca

SEQ ID NO: 455060 - DNA, 20 bp, Artificial Sequence
  chemically synthesized
atgagcctggtataactggc

SEQ ID NO: 455061 - DNA, 20 bp, Artificial Sequence
  chemically synthesized
atagcccttgccagttatac

SEQ ID NO: 455062 - DNA, 20 bp, Artificial Sequence
  chemically synthesized
ccagatgagcctggtataac

SEQ ID NO: 455063 - DNA, 20 bp, Artificial Sequence
  chemically synthesized
tagcccttgccagttatacc

SEQ ID NO: 455064 - DNA, 20 bp, Artificial Sequence
  chemically synthesized
cagacaataccagatgagcc

SEQ ID NO: 455065 - DNA, 20 bp, Artificial Sequence
  chemically synthesized
ccagttataccaggctcatc

SEQ ID NO: 455066 - DNA, 20 bp, Artificial Sequence
  chemically synthesized
tctctcagacaataccagat

SEQ ID NO: 455067 - DNA, 20 bp, Artificial Sequence
  chemically synthesized
aggagtctctcagacaatac

SEQ ID NO: 455068 - DNA, 20 bp, Artificial Sequence
  chemically synthesized
aggctcatctggtattgtct

SEQ ID NO: 455069 - DNA, 20 bp, Artificial Sequence
  chemically synthesized
gctcatctggtattgtctga

SEQ ID NO: 455070 - DNA, 20 bp, Artificial Sequence
  chemically synthesized
tgaattgaataggagtctct

SEQ ID NO: 455071 - DNA, 20 bp, Artificial Sequence
  chemically synthesized
ttcctctctgaattgaatag

SEQ ID NO: 455072 - DNA, 20 bp, Artificial Sequence
  chemically synthesized
gtttcctctctgaattgaat

SEQ ID NO: 455073 - DNA, 20 bp, Artificial Sequence
  chemically synthesized
tgagagactcctattcaatt

SEQ ID NO: 455074 - DNA, 20 bp, Artificial Sequence
  chemically synthesized
agtttcctctctgaattgaa

SEQ ID NO: 455075 - DNA, 20 bp, Artificial Sequence
  chemically synthesized
agagactcctattcaattca

SEQ ID NO: 455076 - DNA, 20 bp, Artificial Sequence
  chemically synthesized
agactcctattcaattcaga

SEQ ID NO: 455077 - DNA, 20 bp, Artificial Sequence
  chemically synthesized
gactcctattcaattcagag

SEQ ID NO: 455078 - DNA, 20 bp, Artificial Sequence
  chemically synthesized
attcaattcagagaggaaac

SEQ ID NO: 455079 - DNA, 20 bp, Artificial Sequence
  chemically synthesized
aattcagagaggaaactagc

SEQ ID NO: 455080 - DNA, 20 bp, Artificial Sequence
  chemically synthesized
attcagagaggaaactagct

SEQ ID NO: 455081 - DNA, 20 bp, Artificial Sequence
  chemically synthesized
gtagcagaaggcagcccagc

SEQ ID NO: 455082 - DNA, 20 bp, Artificial Sequence
  chemically synthesized
cctagtagcagaaggcagcc

SEQ ID NO: 455083 - DNA, 20 bp, Artificial Sequence
  chemically synthesized
tcaagcctagtagcagaagg

SEQ ID NO: 455084 - DNA, 20 bp, Artificial Sequence
  chemically synthesized
ctttcaagcctagtagcaga

SEQ ID NO: 455085 - DNA, 20 bp, Artificial Sequence
  chemically synthesized
gctgggctgccttctgctac

SEQ ID NO: 455086 - DNA, 20 bp, Artificial Sequence
  chemically synthesized
actttcaagcctagtagcag

SEQ ID NO: 455087 - DNA, 20 bp, Artificial Sequence
  chemically synthesized
ctgggctgccttctgctact

SEQ ID NO: 455088 - DNA, 20 bp, Artificial Sequence
  chemically synthesized
ccaactttcaagcctagtag

SEQ ID NO: 455089 - DNA, 20 bp, Artificial Sequence
  chemically synthesized
tttccaactttcaagcctag

SEQ ID NO: 455090 - DNA, 20 bp, Artificial Sequence
  chemically synthesized
ccttctgctactaggcttga

SEQ ID NO: 455091 - DNA, 20 bp, Artificial Sequence
  chemically synthesized
cattttccaactttcaagcc

SEQ ID NO: 455092 - DNA, 20 bp, Artificial Sequence
  chemically synthesized
ctgctactaggcttgaaagt

SEQ ID NO: 455093 - DNA, 20 bp, Artificial Sequence
  chemically synthesized
cctgtcattttccaactttc

SEQ ID NO: 455094 - DNA, 20 bp, Artificial Sequence
  chemically synthesized
gcttgaaagttggaaaatga

SEQ ID NO: 455095 - DNA, 20 bp, Artificial Sequence
  chemically synthesized
cttgaaagttggaaaatgac

SEQ ID NO: 455096 - DNA, 20 bp, Artificial Sequence
  chemically synthesized
gaaagttggaaaatgacagg

SEQ ID NO: 455097 - DNA, 20 bp, Artificial Sequence
  chemically synthesized
aaagttggaaaatgacaggt

SEQ ID NO: 455098 - DNA, 20 bp, Artificial Sequence
  chemically synthesized
aagttggaaaatgacaggtg

SEQ ID NO: 455099 - DNA, 20 bp, Artificial Sequence
  chemically synthesized
agttggaaaatgacaggtgg

SEQ ID NO: 455100 - DNA, 20 bp, Artificial Sequence
  chemically synthesized
cccctatccaacagaagatg

SEQ ID NO: 455101 - DNA, 20 bp, Artificial Sequence
  chemically synthesized
gcccctatccaacagaagat

SEQ ID NO: 455102 - DNA, 20 bp, Artificial Sequence
  chemically synthesized
tgcccctatccaacagaaga

SEQ ID NO: 455103 - DNA, 20 bp, Artificial Sequence
  chemically synthesized
tgggggtccccatcttctgt

SEQ ID NO: 455104 - DNA, 20 bp, Artificial Sequence
  chemically synthesized
tatgtgcccctatccaacag

SEQ ID NO: 455105 - DNA, 20 bp, Artificial Sequence
  chemically synthesized
ggtccccatcttctgttgga

SEQ ID NO: 455106 - DNA, 20 bp, Artificial Sequence
  chemically synthesized
gtccccatcttctgttggat

SEQ ID NO: 455107 - DNA, 20 bp, Artificial Sequence
  chemically synthesized
tccccatcttctgttggata

SEQ ID NO: 455108 - DNA, 20 bp, Artificial Sequence
  chemically synthesized
tcatatgtgcccctatccaa

SEQ ID NO: 455109 - DNA, 20 bp, Artificial Sequence
  chemically synthesized
ccccatcttctgttggatag

SEQ ID NO: 455110 - DNA, 20 bp, Artificial Sequence
  chemically synthesized
tgttggataggggcacatat

SEQ ID NO: 455111 - DNA, 20 bp, Artificial Sequence
  chemically synthesized
gcacatatgagaatgtgctg

SEQ ID NO: 455112 - DNA, 20 bp, Artificial Sequence
  chemically synthesized
cgctagaggaaaataaactg

SEQ ID NO: 455113 - DNA, 20 bp, Artificial Sequence
  chemically synthesized
tgctgcagtttattttcctc

SEQ ID NO: 455114 - DNA, 20 bp, Artificial Sequence
  chemically synthesized
agtttattttcctctagcgc

SEQ ID NO: 455115 - DNA, 20 bp, Artificial Sequence
  chemically synthesized
ctttgagagcctcgcgctag

SEQ ID NO: 455116 - DNA, 20 bp, Artificial Sequence
  chemically synthesized
gtttattttcctctagcgcg

SEQ ID NO: 455117 - DNA, 20 bp, Artificial Sequence
  chemically synthesized
gctttgagagcctcgcgcta

SEQ ID NO: 455118 - DNA, 20 bp, Artificial Sequence
  chemically synthesized
ctgctttgagagcctcgcgc

SEQ ID NO: 455119 - DNA, 20 bp, Artificial Sequence
  chemically synthesized
cctctagcgcgaggctctca

SEQ ID NO: 455120 - DNA, 20 bp, Artificial Sequence
  chemically synthesized
ctagcgcgaggctctcaaag

SEQ ID NO: 455121 - DNA, 20 bp, Artificial Sequence
  chemically synthesized
agaaaagcaaactgctttga

SEQ ID NO: 455122 - DNA, 20 bp, Artificial Sequence
  chemically synthesized
agagaaaagcaaactgcttt

SEQ ID NO: 455123 - DNA, 20 bp, Artificial Sequence
  chemically synthesized
tgtaaaggatagtcagagaa

SEQ ID NO: 455124 - DNA, 20 bp, Artificial Sequence
  chemically synthesized
aaaattgtaaaggatagtca

SEQ ID NO: 455125 - DNA, 20 bp, Artificial Sequence
  chemically synthesized
agaaaattgtaaaggatagt

SEQ ID NO: 455126 - DNA, 20 bp, Artificial Sequence
  chemically synthesized
caaaagaaaattgtaaagga

SEQ ID NO: 455127 - DNA, 20 bp, Artificial Sequence
  chemically synthesized
ccatcaaaagaaaattgtaa

SEQ ID NO: 455128 - DNA, 20 bp, Artificial Sequence
  chemically synthesized
gccatcaaaagaaaattgta

SEQ ID NO: 455129 - DNA, 20 bp, Artificial Sequence
  chemically synthesized
cctttacaattttcttttga

SEQ ID NO: 455130 - DNA, 20 bp, Artificial Sequence
  chemically synthesized
acaaaacaagaggccatcaa

SEQ ID NO: 455131 - DNA, 20 bp, Artificial Sequence
  chemically synthesized
aaacctagaaacaaaacaag

SEQ ID NO: 455132 - DNA, 20 bp, Artificial Sequence
  chemically synthesized
aaaacctagaaacaaaacaa

SEQ ID NO: 455133 - DNA, 20 bp, Artificial Sequence
  chemically synthesized
ataaaacctagaaacaaaac

SEQ ID NO: 455134 - DNA, 20 bp, Artificial Sequence
  chemically synthesized
atggcctcttgttttgtttc

SEQ ID NO: 455135 - DNA, 20 bp, Artificial Sequence
  chemically synthesized
tggcctcttgttttgtttct

SEQ ID NO: 455136 - DNA, 20 bp, Artificial Sequence
  chemically synthesized
tgaagaagaacaataaaacc

SEQ ID NO: 455137 - DNA, 20 bp, Artificial Sequence
  chemically synthesized
ccctgctcctcatagtgaag

SEQ ID NO: 455138 - DNA, 20 bp, Artificial Sequence
  chemically synthesized
ttattgttcttcttcactat

SEQ ID NO: 455139 - DNA, 20 bp, Artificial Sequence
  chemically synthesized
tattgttcttcttcactatg

SEQ ID NO: 455140 - DNA, 20 bp, Artificial Sequence
  chemically synthesized
tttccctgctcctcatagtg

SEQ ID NO: 455141 - DNA, 20 bp, Artificial Sequence
  chemically synthesized
ttgttcttcttcactatgag

SEQ ID NO: 455142 - DNA, 20 bp, Artificial Sequence
  chemically synthesized
ttcttcttcactatgaggag

SEQ ID NO: 455143 - DNA, 20 bp, Artificial Sequence
  chemically synthesized
tgatttttccctgctcctca

SEQ ID NO: 455144 - DNA, 20 bp, Artificial Sequence
  chemically synthesized
tcttcttcactatgaggagc

SEQ ID NO: 455145 - DNA, 20 bp, Artificial Sequence
  chemically synthesized
cttcttcactatgaggagca

SEQ ID NO: 455146 - DNA, 20 bp, Artificial Sequence
  chemically synthesized
tatgaggagcagggaaaaat

SEQ ID NO: 455147 - DNA, 20 bp, Artificial Sequence
  chemically synthesized
gaattccatttcggacaaga

SEQ ID NO: 455148 - DNA, 20 bp, Artificial Sequence
  chemically synthesized
ctgagaattccatttcggac

SEQ ID NO: 455149 - DNA, 20 bp, Artificial Sequence
  chemically synthesized
ttatgccatcttgtccgaaa

SEQ ID NO: 455150 - DNA, 20 bp, Artificial Sequence
  chemically synthesized
caagactgagaattccattt

SEQ ID NO: 455151 - DNA, 20 bp, Artificial Sequence
  chemically synthesized
cttgtccgaaatggaattct

SEQ ID NO: 455152 - DNA, 20 bp, Artificial Sequence
  chemically synthesized
aaacatattaaaacaagact

SEQ ID NO: 455153 - DNA, 20 bp, Artificial Sequence
  chemically synthesized
gtgttaaaacatattaaaac

SEQ ID NO: 455154 - DNA, 20 bp, Artificial Sequence
  chemically synthesized
atatgttttaacacgtgatt

SEQ ID NO: 455155 - DNA, 20 bp, Artificial Sequence
  chemically synthesized
aacacgtgattcagataact

SEQ ID NO: 455156 - DNA, 20 bp, Artificial Sequence
  chemically synthesized
ttgtgcacattttaaaaacc

SEQ ID NO: 455157 - DNA, 20 bp, Artificial Sequence
  chemically synthesized
aaatgtgcacaacttttaaa

SEQ ID NO: 455158 - DNA, 20 bp, Artificial Sequence
  chemically synthesized
tttggaacatttctttttaa

SEQ ID NO: 455159 - DNA, 20 bp, Artificial Sequence
  chemically synthesized
tttaaaaagaaatgttccaa

SEQ ID NO: 455160 - DNA, 20 bp, Artificial Sequence
  chemically synthesized
ttaaatgtatatttagcttt

SEQ ID NO: 455161 - DNA, 20 bp, Artificial Sequence
  chemically synthesized
ggtacaattaaatgtatatt

SEQ ID NO: 455162 - DNA, 20 bp, Artificial Sequence
  chemically synthesized
cagctactctacacgcagca

SEQ ID NO: 455163 - DNA, 20 bp, Artificial Sequence
  chemically synthesized
taattgtaccatgctgcgtg

SEQ ID NO: 455164 - DNA, 20 bp, Artificial Sequence
  chemically synthesized
attgtaccatgctgcgtgta

SEQ ID NO: 455165 - DNA, 20 bp, Artificial Sequence
  chemically synthesized
gttaccagctactctacacg

SEQ ID NO: 455166 - DNA, 20 bp, Artificial Sequence
  chemically synthesized
gtaccatgctgcgtgtagag

SEQ ID NO: 455167 - DNA, 20 bp, Artificial Sequence
  chemically synthesized
catgctgcgtgtagagtagc

SEQ ID NO: 455168 - DNA, 20 bp, Artificial Sequence
  chemically synthesized
cttatgatttcagtagttac

SEQ ID NO: 455169 - DNA, 20 bp, Artificial Sequence
  chemically synthesized
acatgtacttatgatttcag

SEQ ID NO: 455170 - DNA, 20 bp, Artificial Sequence
  chemically synthesized
ctggtaactactgaaatcat

SEQ ID NO: 455171 - DNA, 20 bp, Artificial Sequence
  chemically synthesized
ctgacatgtacttatgattt

SEQ ID NO: 455172 - DNA, 20 bp, Artificial Sequence
  chemically synthesized
ctgaaatcataagtacatgt

SEQ ID NO: 455173 - DNA, 20 bp, Artificial Sequence
  chemically synthesized
ttatttgttattaatttcaa

SEQ ID NO: 455174 - DNA, 20 bp, Artificial Sequence
  chemically synthesized
tttatttgttattaatttca

SEQ ID NO: 455175 - DNA, 20 bp, Artificial Sequence
  chemically synthesized
taacaaataaaacatcaact

SEQ ID NO: 455176 - DNA, 20 bp, Artificial Sequence
  chemically synthesized
gtgagccaccgcatttgacc

SEQ ID NO: 455177 - DNA, 20 bp, Artificial Sequence
  chemically synthesized
aacatcaacttggtcaaatg

SEQ ID NO: 455178 - DNA, 20 bp, Artificial Sequence
  chemically synthesized
atcaacttggtcaaatgcgg

SEQ ID NO: 455179 - DNA, 20 bp, Artificial Sequence
  chemically synthesized
agtgctgggattacaggcgt

SEQ ID NO: 455180 - DNA, 20 bp, Artificial Sequence
  chemically synthesized
gtggctcacgcctgtaatcc

SEQ ID NO: 455181 - DNA, 20 bp, Artificial Sequence
  chemically synthesized
tcccaaagtgctgggattac

SEQ ID NO: 455182 - DNA, 20 bp, Artificial Sequence
  chemically synthesized
ctcccaaagtgctgggatta

SEQ ID NO: 455183 - DNA, 20 bp, Artificial Sequence
  chemically synthesized
cgcctgtaatcccagcactt

SEQ ID NO: 455184 - DNA, 20 bp, Artificial Sequence
  chemically synthesized
cgttggcctcccaaagtgct

SEQ ID NO: 455185 - DNA, 20 bp, Artificial Sequence
  chemically synthesized
gcctgtaatcccagcacttt

SEQ ID NO: 455186 - DNA, 20 bp, Artificial Sequence
  chemically synthesized
acgttggcctcccaaagtgc

SEQ ID NO: 455187 - DNA, 20 bp, Artificial Sequence
  chemically synthesized
ctgtaatcccagcactttgg

SEQ ID NO: 455188 - DNA, 20 bp, Artificial Sequence
  chemically synthesized
tgtaatcccagcactttggg

SEQ ID NO: 455189 - DNA, 20 bp, Artificial Sequence
  chemically synthesized
ccacccacgttggcctccca

SEQ ID NO: 455190 - DNA, 20 bp, Artificial Sequence
  chemically synthesized
agcactttgggaggccaacg

SEQ ID NO: 455191 - DNA, 20 bp, Artificial Sequence
  chemically synthesized
gcactttgggaggccaacgt

SEQ ID NO: 455192 - DNA, 20 bp, Artificial Sequence
  chemically synthesized
ctttgggaggccaacgtggg

SEQ ID NO: 455193 - DNA, 20 bp, Artificial Sequence
  chemically synthesized
ctcaggtgatccacccacgt

SEQ ID NO: 455194 - DNA, 20 bp, Artificial Sequence
  chemically synthesized
ccaacgtgggtggatcacct

SEQ ID NO: 455195 - DNA, 20 bp, Artificial Sequence
  chemically synthesized
caacgtgggtggatcacctg

SEQ ID NO: 455196 - DNA, 20 bp, Artificial Sequence
  chemically synthesized
gtgggtggatcacctgaggt

SEQ ID NO: 455197 - DNA, 20 bp, Artificial Sequence
  chemically synthesized
tgggtggatcacctgaggtc

SEQ ID NO: 455198 - DNA, 20 bp, Artificial Sequence
  chemically synthesized
ggtctcaaactcctgacctc

SEQ ID NO: 455199 - DNA, 20 bp, Artificial Sequence
  chemically synthesized
ggtggatcacctgaggtcag

SEQ ID NO: 455200 - DNA, 20 bp, Artificial Sequence
  chemically synthesized
tggtctcaaactcctgacct

SEQ ID NO: 455201 - DNA, 20 bp, Artificial Sequence
  chemically synthesized
tcacctgaggtcaggagttt

SEQ ID NO: 455202 - DNA, 20 bp, Artificial Sequence
  chemically synthesized
tgaggtcaggagtttgagac

SEQ ID NO: 455203 - DNA, 20 bp, Artificial Sequence
  chemically synthesized
tttcaccatgttggtcaggc

SEQ ID NO: 455204 - DNA, 20 bp, Artificial Sequence
  chemically synthesized
ggggtttcaccatgttggtc

SEQ ID NO: 455205 - DNA, 20 bp, Artificial Sequence
  chemically synthesized
tgagaccagcctgaccaaca

SEQ ID NO: 455206 - DNA, 20 bp, Artificial Sequence
  chemically synthesized
cggggtttcaccatgttggt

SEQ ID NO: 455207 - DNA, 20 bp, Artificial Sequence
  chemically synthesized
gagacggggtttcaccatgt

SEQ ID NO: 455208 - DNA, 20 bp, Artificial Sequence
  chemically synthesized
ttgtatttttagtagagacg

SEQ ID NO: 455209 - DNA, 20 bp, Artificial Sequence
  chemically synthesized
tttgtatttttagtagagac

SEQ ID NO: 455210 - DNA, 20 bp, Artificial Sequence
  chemically synthesized
ttttgtatttttagtagaga

SEQ ID NO: 455211 - DNA, 20 bp, Artificial Sequence
  chemically synthesized
aattttttgtatttttagta

SEQ ID NO: 455212 - DNA, 20 bp, Artificial Sequence
  chemically synthesized
ctaattttttgtatttttag

SEQ ID NO: 455213 - DNA, 20 bp, Artificial Sequence
  chemically synthesized
cggctaattttttgtatttt

SEQ ID NO: 455214 - DNA, 20 bp, Artificial Sequence
  chemically synthesized
ctactaaaaatacaaaaaat

SEQ ID NO: 455215 - DNA, 20 bp, Artificial Sequence
  chemically synthesized
aaaaatacaaaaaattagcc

SEQ ID NO: 455216 - DNA, 20 bp, Artificial Sequence
  chemically synthesized
tacaaaaaattagccgagcg

SEQ ID NO: 455217 - DNA, 20 bp, Artificial Sequence
  chemically synthesized
aaaaaattagccgagcgtgg

SEQ ID NO: 455218 - DNA, 20 bp, Artificial Sequence
  chemically synthesized
cgagtgcccaccaccacgct

SEQ ID NO: 455219 - DNA, 20 bp, Artificial Sequence
  chemically synthesized
aaattagccgagcgtggtgg

SEQ ID NO: 455220 - DNA, 20 bp, Artificial Sequence
  chemically synthesized
aattagccgagcgtggtggt

SEQ ID NO: 455221 - DNA, 20 bp, Artificial Sequence
  chemically synthesized
cgagcgtggtggtgggcact

SEQ ID NO: 455222 - DNA, 20 bp, Artificial Sequence
  chemically synthesized
gagcgtggtggtgggcactc

SEQ ID NO: 455223 - DNA, 20 bp, Artificial Sequence
  chemically synthesized
gcgtggtggtgggcactcgg

SEQ ID NO: 455224 - DNA, 20 bp, Artificial Sequence
  chemically synthesized
cgtggtggtgggcactcggg

SEQ ID NO: 455225 - DNA, 20 bp, Artificial Sequence
  chemically synthesized
ttctcctgcctcagcctccc

SEQ ID NO: 455226 - DNA, 20 bp, Artificial Sequence
  chemically synthesized
tggtgggcactcgggaggct

SEQ ID NO: 455227 - DNA, 20 bp, Artificial Sequence
  chemically synthesized
ggtgggcactcgggaggctg

SEQ ID NO: 455228 - DNA, 20 bp, Artificial Sequence
  chemically synthesized
gggcactcgggaggctgagg

SEQ ID NO: 455229 - DNA, 20 bp, Artificial Sequence
  chemically synthesized
ggcactcgggaggctgaggc

SEQ ID NO: 455230 - DNA, 20 bp, Artificial Sequence
  chemically synthesized
cactcgggaggctgaggcag

SEQ ID NO: 455231 - DNA, 20 bp, Artificial Sequence
  chemically synthesized
ttcaagcaattctcctgcct

SEQ ID NO: 455232 - DNA, 20 bp, Artificial Sequence
  chemically synthesized
gcaggagaattgcttgaacc

SEQ ID NO: 455233 - DNA, 20 bp, Artificial Sequence
  chemically synthesized
caggagaattgcttgaaccc

SEQ ID NO: 455234 - DNA, 20 bp, Artificial Sequence
  chemically synthesized
aacctccacctcctgggttc

SEQ ID NO: 455235 - DNA, 20 bp, Artificial Sequence
  chemically synthesized
ggagaattgcttgaacccag

SEQ ID NO: 455236 - DNA, 20 bp, Artificial Sequence
  chemically synthesized
gagaattgcttgaacccagg

SEQ ID NO: 455237 - DNA, 20 bp, Artificial Sequence
  chemically synthesized
aattgcttgaacccaggagg

SEQ ID NO: 455238 - DNA, 20 bp, Artificial Sequence
  chemically synthesized
cactgcaacctccacctcct

SEQ ID NO: 455239 - DNA, 20 bp, Artificial Sequence
  chemically synthesized
ttgcttgaacccaggaggtg

SEQ ID NO: 455240 - DNA, 20 bp, Artificial Sequence
  chemically synthesized
tcactgcaacctccacctcc

SEQ ID NO: 455241 - DNA, 20 bp, Artificial Sequence
  chemically synthesized
tgcttgaacccaggaggtgg

SEQ ID NO: 455242 - DNA, 20 bp, Artificial Sequence
  chemically synthesized
aacccaggaggtggaggttg

SEQ ID NO: 455243 - DNA, 20 bp, Artificial Sequence
  chemically synthesized
caggaggtggaggttgcagt

SEQ ID NO: 455244 - DNA, 20 bp, Artificial Sequence
  chemically synthesized
ggtggaggttgcagtgagct

SEQ ID NO: 455245 - DNA, 20 bp, Artificial Sequence
  chemically synthesized
ggagtacaatggtgcgatct

SEQ ID NO: 455246 - DNA, 20 bp, Artificial Sequence
  chemically synthesized
tcacccaggctggagtacaa

SEQ ID NO: 455247 - DNA, 20 bp, Artificial Sequence
  chemically synthesized
gagatcgcaccattgtactc

SEQ ID NO: 455248 - DNA, 20 bp, Artificial Sequence
  chemically synthesized
cgcaccattgtactccagcc

SEQ ID NO: 455249 - DNA, 20 bp, Artificial Sequence
  chemically synthesized
gcaccattgtactccagcct

SEQ ID NO: 455250 - DNA, 20 bp, Artificial Sequence
  chemically synthesized
gctctttgtcacccaggctg

SEQ ID NO: 455251 - DNA, 20 bp, Artificial Sequence
  chemically synthesized
ttgctctttgtcacccaggc

SEQ ID NO: 455252 - DNA, 20 bp, Artificial Sequence
  chemically synthesized
aattttgctctttgtcaccc

SEQ ID NO: 455253 - DNA, 20 bp, Artificial Sequence
  chemically synthesized
gtactccagcctgggtgaca

SEQ ID NO: 455254 - DNA, 20 bp, Artificial Sequence
  chemically synthesized
aaattttgctctttgtcacc

SEQ ID NO: 455255 - DNA, 20 bp, Artificial Sequence
  chemically synthesized
actccagcctgggtgacaaa

SEQ ID NO: 455256 - DNA, 20 bp, Artificial Sequence
  chemically synthesized
gggtgacaaagagcaaaatt

SEQ ID NO: 455257 - DNA, 20 bp, Artificial Sequence
  chemically synthesized
aagagcaaaatttggtctca

SEQ ID NO: 455258 - DNA, 20 bp, Artificial Sequence
  chemically synthesized
gtttttttttttttttcttt

SEQ ID NO: 455259 - DNA, 20 bp, Artificial Sequence
  chemically synthesized
aaaaaaacatcaactatacc

SEQ ID NO: 455260 - DNA, 20 bp, Artificial Sequence
  chemically synthesized
attctactcatcacttggta

SEQ ID NO: 455261 - DNA, 20 bp, Artificial Sequence
  chemically synthesized
catcaactataccaagtgat

SEQ ID NO: 455262 - DNA, 20 bp, Artificial Sequence
  chemically synthesized
cagtcattctactcatcact

SEQ ID NO: 455263 - DNA, 20 bp, Artificial Sequence
  chemically synthesized
caactataccaagtgatgag

SEQ ID NO: 455264 - DNA, 20 bp, Artificial Sequence
  chemically synthesized
gatgagtagaatgactgtac

SEQ ID NO: 455265 - DNA, 20 bp, Artificial Sequence
  chemically synthesized
atgagtagaatgactgtact

SEQ ID NO: 455266 - DNA, 20 bp, Artificial Sequence
  chemically synthesized
gaaaacgaacatacctagta

SEQ ID NO: 455267 - DNA, 20 bp, Artificial Sequence
  chemically synthesized
acaatgaaaacgaacatacc

SEQ ID NO: 455268 - DNA, 20 bp, Artificial Sequence
  chemically synthesized
gttcgttttcattgtatatt

SEQ ID NO: 455269 - DNA, 20 bp, Artificial Sequence
  chemically synthesized
tgtatatttagtatttattt

SEQ ID NO: 455270 - DNA, 20 bp, Artificial Sequence
  chemically synthesized
tgtcggcactatttttagtt

SEQ ID NO: 455271 - DNA, 20 bp, Artificial Sequence
  chemically synthesized
ttgtcggcactatttttagt

SEQ ID NO: 455272 - DNA, 20 bp, Artificial Sequence
  chemically synthesized
ttaagcaacctaactaaaaa

SEQ ID NO: 455273 - DNA, 20 bp, Artificial Sequence
  chemically synthesized
tttattgtcggcactatttt

SEQ ID NO: 455274 - DNA, 20 bp, Artificial Sequence
  chemically synthesized
aattgagatatttttattgt

SEQ ID NO: 455275 - DNA, 20 bp, Artificial Sequence
  chemically synthesized
aataaaaatatctcaattta

SEQ ID NO: 455276 - DNA, 20 bp, Artificial Sequence
  chemically synthesized
tttatatatttctgtaaatt

SEQ ID NO: 455277 - DNA, 20 bp, Artificial Sequence
  chemically synthesized
atatataaaactttaatatg

SEQ ID NO: 455278 - DNA, 20 bp, Artificial Sequence
  chemically synthesized
aaaatacaatctacatatta

SEQ ID NO: 455279 - DNA, 20 bp, Artificial Sequence
  chemically synthesized
attttatgaaaacatctgtc

SEQ ID NO: 455280 - DNA, 20 bp, Artificial Sequence
  chemically synthesized
ttttatgaaaacatctgtcg

SEQ ID NO: 455281 - DNA, 20 bp, Artificial Sequence
  chemically synthesized
atgaaaacatctgtcgaggc

SEQ ID NO: 455282 - DNA, 20 bp, Artificial Sequence
  chemically synthesized
gccaccgcacctggcctcga

SEQ ID NO: 455283 - DNA, 20 bp, Artificial Sequence
  chemically synthesized
tgaaaacatctgtcgaggcc

SEQ ID NO: 455284 - DNA, 20 bp, Artificial Sequence
  chemically synthesized
acatctgtcgaggccaggtg

SEQ ID NO: 455285 - DNA, 20 bp, Artificial Sequence
  chemically synthesized
tctgtcgaggccaggtgcgg

SEQ ID NO: 455286 - DNA, 20 bp, Artificial Sequence
  chemically synthesized
caggtgtgagccaccgcacc

SEQ ID NO: 455287 - DNA, 20 bp, Artificial Sequence
  chemically synthesized
agtactgggattacaggtgt

SEQ ID NO: 455288 - DNA, 20 bp, Artificial Sequence
  chemically synthesized
gtggctcacacctgtaatcc

SEQ ID NO: 455289 - DNA, 20 bp, Artificial Sequence
  chemically synthesized
tcccaaagtactgggattac

SEQ ID NO: 455290 - DNA, 20 bp, Artificial Sequence
  chemically synthesized
ctcccaaagtactgggatta

SEQ ID NO: 455291 - DNA, 20 bp, Artificial Sequence
  chemically synthesized
cacctgtaatcccagtactt

SEQ ID NO: 455292 - DNA, 20 bp, Artificial Sequence
  chemically synthesized
cctcggcctcccaaagtact

SEQ ID NO: 455293 - DNA, 20 bp, Artificial Sequence
  chemically synthesized
acctgtaatcccagtacttt

SEQ ID NO: 455294 - DNA, 20 bp, Artificial Sequence
  chemically synthesized
gcctcggcctcccaaagtac

SEQ ID NO: 455295 - DNA, 20 bp, Artificial Sequence
  chemically synthesized
ctgtaatcccagtactttgg

SEQ ID NO: 455296 - DNA, 20 bp, Artificial Sequence
  chemically synthesized
tgtaatcccagtactttggg

SEQ ID NO: 455297 - DNA, 20 bp, Artificial Sequence
  chemically synthesized
ccacccgcctcggcctccca

SEQ ID NO: 455298 - DNA, 20 bp, Artificial Sequence
  chemically synthesized
tcccagtactttgggaggcc

SEQ ID NO: 455299 - DNA, 20 bp, Artificial Sequence
  chemically synthesized
cccagtactttgggaggccg

SEQ ID NO: 455300 - DNA, 20 bp, Artificial Sequence
  chemically synthesized
agtactttgggaggccgagg

SEQ ID NO: 455301 - DNA, 20 bp, Artificial Sequence
  chemically synthesized
gtactttgggaggccgaggc

SEQ ID NO: 455302 - DNA, 20 bp, Artificial Sequence
  chemically synthesized
ctttgggaggccgaggcggg

SEQ ID NO: 455303 - DNA, 20 bp, Artificial Sequence
  chemically synthesized
accttgtgatccacccgcct

SEQ ID NO: 455304 - DNA, 20 bp, Artificial Sequence
  chemically synthesized
ggccgaggcgggtggatcac

SEQ ID NO: 455305 - DNA, 20 bp, Artificial Sequence
  chemically synthesized
gccgaggcgggtggatcaca

SEQ ID NO: 455306 - DNA, 20 bp, Artificial Sequence
  chemically synthesized
aggcgggtggatcacaaggt

SEQ ID NO: 455307 - DNA, 20 bp, Artificial Sequence
  chemically synthesized
ggcgggtggatcacaaggtc

SEQ ID NO: 455308 - DNA, 20 bp, Artificial Sequence
  chemically synthesized
cgggtggatcacaaggtcag

SEQ ID NO: 455309 - DNA, 20 bp, Artificial Sequence
  chemically synthesized
gatcacaaggtcaggagatt

SEQ ID NO: 455310 - DNA, 20 bp, Artificial Sequence
  chemically synthesized
tcaggagattgagaccatcc

SEQ ID NO: 455311 - DNA, 20 bp, Artificial Sequence
  chemically synthesized
tttcaccatgttagccagga

SEQ ID NO: 455312 - DNA, 20 bp, Artificial Sequence
  chemically synthesized
gaggtttcaccatgttagcc

SEQ ID NO: 455313 - DNA, 20 bp, Artificial Sequence
  chemically synthesized
tgagaccatcctggctaaca

SEQ ID NO: 455314 - DNA, 20 bp, Artificial Sequence
  chemically synthesized
tgaggtttcaccatgttagc

SEQ ID NO: 455315 - DNA, 20 bp, Artificial Sequence
  chemically synthesized
gagatgaggtttcaccatgt

SEQ ID NO: 455316 - DNA, 20 bp, Artificial Sequence
  chemically synthesized
ttgtatttttagtagagatg

SEQ ID NO: 455317 - DNA, 20 bp, Artificial Sequence
  chemically synthesized
tttgtatttttagtagagat

SEQ ID NO: 455318 - DNA, 20 bp, Artificial Sequence
  chemically synthesized
aattttttgtatttttagta

SEQ ID NO: 455319 - DNA, 20 bp, Artificial Sequence
  chemically synthesized
ctaattttttgtatttttag

SEQ ID NO: 455320 - DNA, 20 bp, Artificial Sequence
  chemically synthesized
cagctaattttttgtatttt

SEQ ID NO: 455321 - DNA, 20 bp, Artificial Sequence
  chemically synthesized
ctactaaaaatacaaaaaat

SEQ ID NO: 455322 - DNA, 20 bp, Artificial Sequence
  chemically synthesized
taaaaatacaaaaaattagc

SEQ ID NO: 455323 - DNA, 20 bp, Artificial Sequence
  chemically synthesized
aaaaatacaaaaaattagct

SEQ ID NO: 455324 - DNA, 20 bp, Artificial Sequence
  chemically synthesized
tacaaaaaattagctgggca

SEQ ID NO: 455325 - DNA, 20 bp, Artificial Sequence
  chemically synthesized
aaaaaattagctgggcatgg

SEQ ID NO: 455326 - DNA, 20 bp, Artificial Sequence
  chemically synthesized
caggcgcccgccaccatgcc

SEQ ID NO: 455327 - DNA, 20 bp, Artificial Sequence
  chemically synthesized
aaattagctgggcatggtgg

SEQ ID NO: 455328 - DNA, 20 bp, Artificial Sequence
  chemically synthesized
aattagctgggcatggtggc

SEQ ID NO: 455329 - DNA, 20 bp, Artificial Sequence
  chemically synthesized
ggcatggtggcgggcgcctg

SEQ ID NO: 455330 - DNA, 20 bp, Artificial Sequence
  chemically synthesized
gtggcgggcgcctgtagtcc

SEQ ID NO: 455331 - DNA, 20 bp, Artificial Sequence
  chemically synthesized
tcctgagtagctgggactac

SEQ ID NO: 455332 - DNA, 20 bp, Artificial Sequence
  chemically synthesized
ctcctgagtagctgggacta

SEQ ID NO: 455333 - DNA, 20 bp, Artificial Sequence
  chemically synthesized
cgcctgtagtcccagctact

SEQ ID NO: 455334 - DNA, 20 bp, Artificial Sequence
  chemically synthesized
cctcagcctcctgagtagct

SEQ ID NO: 455335 - DNA, 20 bp, Artificial Sequence
  chemically synthesized
gcctgtagtcccagctactc

SEQ ID NO: 455336 - DNA, 20 bp, Artificial Sequence
  chemically synthesized
gcctcagcctcctgagtagc

SEQ ID NO: 455337 - DNA, 20 bp, Artificial Sequence
  chemically synthesized
ctgtagtcccagctactcag

SEQ ID NO: 455338 - DNA, 20 bp, Artificial Sequence
  chemically synthesized
tgtagtcccagctactcagg

SEQ ID NO: 455339 - DNA, 20 bp, Artificial Sequence
  chemically synthesized
tcctgcctcagcctcctgag

SEQ ID NO: 455340 - DNA, 20 bp, Artificial Sequence
  chemically synthesized
ttctcctgcctcagcctcct

SEQ ID NO: 455341 - DNA, 20 bp, Artificial Sequence
  chemically synthesized
tcccagctactcaggaggct

SEQ ID NO: 455342 - DNA, 20 bp, Artificial Sequence
  chemically synthesized
cccagctactcaggaggctg

SEQ ID NO: 455343 - DNA, 20 bp, Artificial Sequence
  chemically synthesized
agctactcaggaggctgagg

SEQ ID NO: 455344 - DNA, 20 bp, Artificial Sequence
  chemically synthesized
gctactcaggaggctgaggc

SEQ ID NO: 455345 - DNA, 20 bp, Artificial Sequence
  chemically synthesized
tactcaggaggctgaggcag

SEQ ID NO: 455346 - DNA, 20 bp, Artificial Sequence
  chemically synthesized
ttcacgccattctcctgcct

SEQ ID NO: 455347 - DNA, 20 bp, Artificial Sequence
  chemically synthesized
aggaggctgaggcaggagaa

SEQ ID NO: 455348 - DNA, 20 bp, Artificial Sequence
  chemically synthesized
gcaggagaatggcgtgaacc

SEQ ID NO: 455349 - DNA, 20 bp, Artificial Sequence
  chemically synthesized
caggagaatggcgtgaaccc

SEQ ID NO: 455350 - DNA, 20 bp, Artificial Sequence
  chemically synthesized
ggagaatggcgtgaacccgg

SEQ ID NO: 455351 - DNA, 20 bp, Artificial Sequence
  chemically synthesized
gagaatggcgtgaacccggg

SEQ ID NO: 455352 - DNA, 20 bp, Artificial Sequence
  chemically synthesized
aatggcgtgaacccgggagg

SEQ ID NO: 455353 - DNA, 20 bp, Artificial Sequence
  chemically synthesized
cactgcaacctccgcctccc

SEQ ID NO: 455354 - DNA, 20 bp, Artificial Sequence
  chemically synthesized
tggcgtgaacccgggaggcg

SEQ ID NO: 455355 - DNA, 20 bp, Artificial Sequence
  chemically synthesized
tcactgcaacctccgcctcc

SEQ ID NO: 455356 - DNA, 20 bp, Artificial Sequence
  chemically synthesized
ggcgtgaacccgggaggcgg

SEQ ID NO: 455357 - DNA, 20 bp, Artificial Sequence
  chemically synthesized
aacccgggaggcggaggttg

SEQ ID NO: 455358 - DNA, 20 bp, Artificial Sequence
  chemically synthesized
cgggaggcggaggttgcagt

SEQ ID NO: 455359 - DNA, 20 bp, Artificial Sequence
  chemically synthesized
ggcggaggttgcagtgagcc

SEQ ID NO: 455360 - DNA, 20 bp, Artificial Sequence
  chemically synthesized
ggagtgcagtggcgcgatct

SEQ ID NO: 455361 - DNA, 20 bp, Artificial Sequence
  chemically synthesized
tcgcccaggctggagtgcag

SEQ ID NO: 455362 - DNA, 20 bp, Artificial Sequence
  chemically synthesized
aagatcgcgccactgcactc

SEQ ID NO: 455363 - DNA, 20 bp, Artificial Sequence
  chemically synthesized
ctgtcgcccaggctggagtg

SEQ ID NO: 455364 - DNA, 20 bp, Artificial Sequence
  chemically synthesized
cgcgccactgcactccagcc

SEQ ID NO: 455365 - DNA, 20 bp, Artificial Sequence
  chemically synthesized
gcgccactgcactccagcct

SEQ ID NO: 455366 - DNA, 20 bp, Artificial Sequence
  chemically synthesized
tttctctgtcgcccaggctg

SEQ ID NO: 455367 - DNA, 20 bp, Artificial Sequence
  chemically synthesized
tctttctctgtcgcccaggc

SEQ ID NO: 455368 - DNA, 20 bp, Artificial Sequence
  chemically synthesized
ctgcactccagcctgggcga

SEQ ID NO: 455369 - DNA, 20 bp, Artificial Sequence
  chemically synthesized
acagtctttctctgtcgccc

SEQ ID NO: 455370 - DNA, 20 bp, Artificial Sequence
  chemically synthesized
gcactccagcctgggcgaca

SEQ ID NO: 455371 - DNA, 20 bp, Artificial Sequence
  chemically synthesized
gacagtctttctctgtcgcc

SEQ ID NO: 455372 - DNA, 20 bp, Artificial Sequence
  chemically synthesized
tccagcctgggcgacagaga

SEQ ID NO: 455373 - DNA, 20 bp, Artificial Sequence
  chemically synthesized
ttttgtcttgttttttgaga

SEQ ID NO: 455374 - DNA, 20 bp, Artificial Sequence
  chemically synthesized
gaaagactgtctcaaaaaac

SEQ ID NO: 455375 - DNA, 20 bp, Artificial Sequence
  chemically synthesized
tttgttttgtcttgtttttt

SEQ ID NO: 455376 - DNA, 20 bp, Artificial Sequence
  chemically synthesized
ttttgtttgcataattttga

SEQ ID NO: 455377 - DNA, 20 bp, Artificial Sequence
  chemically synthesized
catctgtaatttcaagttgg

SEQ ID NO: 455378 - DNA, 20 bp, Artificial Sequence
  chemically synthesized
actcatctgtaatttcaagt

SEQ ID NO: 455379 - DNA, 20 bp, Artificial Sequence
  chemically synthesized
tgtctaccaacttgaaatta

SEQ ID NO: 455380 - DNA, 20 bp, Artificial Sequence
  chemically synthesized
atgtactcatctgtaatttc

SEQ ID NO: 455381 - DNA, 20 bp, Artificial Sequence
  chemically synthesized
accaacttgaaattacagat

SEQ ID NO: 455382 - DNA, 20 bp, Artificial Sequence
  chemically synthesized
tatatatatatataaaatta

SEQ ID NO: 455383 - DNA, 20 bp, Artificial Sequence
  chemically synthesized
tacacatataacatatgata

SEQ ID NO: 455384 - DNA, 20 bp, Artificial Sequence
  chemically synthesized
tcattaatcatttatgtctc

SEQ ID NO: 455385 - DNA, 20 bp, Artificial Sequence
  chemically synthesized
tccctgtgttgttcaaacta

SEQ ID NO: 455386 - DNA, 20 bp, Artificial Sequence
  chemically synthesized
actccctgtgttgttcaaac

SEQ ID NO: 455387 - DNA, 20 bp, Artificial Sequence
  chemically synthesized
tgtctctagtttgaacaaca

SEQ ID NO: 455388 - DNA, 20 bp, Artificial Sequence
  chemically synthesized
gtctctagtttgaacaacac

SEQ ID NO: 455389 - DNA, 20 bp, Artificial Sequence
  chemically synthesized
tctctagtttgaacaacaca

SEQ ID NO: 455390 - DNA, 20 bp, Artificial Sequence
  chemically synthesized
tctagtttgaacaacacagg

SEQ ID NO: 455391 - DNA, 20 bp, Artificial Sequence
  chemically synthesized
cagggagttcaacatgcacc

SEQ ID NO: 455392 - DNA, 20 bp, Artificial Sequence
  chemically synthesized
aaaggcttacgcagtgtgct

SEQ ID NO: 455393 - DNA, 20 bp, Artificial Sequence
  chemically synthesized
gaaaggcttacgcagtgtgc

SEQ ID NO: 455394 - DNA, 20 bp, Artificial Sequence
  chemically synthesized
atgcacctagcacactgcgt

SEQ ID NO: 455395 - DNA, 20 bp, Artificial Sequence
  chemically synthesized
catctatagaaaggcttacg

SEQ ID NO: 455396 - DNA, 20 bp, Artificial Sequence
  chemically synthesized
acactgcgtaagcctttcta

SEQ ID NO: 455397 - DNA, 20 bp, Artificial Sequence
  chemically synthesized
tggctaaaacatctatagaa

SEQ ID NO: 455398 - DNA, 20 bp, Artificial Sequence
  chemically synthesized
ttggctaaaacatctataga

SEQ ID NO: 455399 - DNA, 20 bp, Artificial Sequence
  chemically synthesized
gatcttggctaaaacatcta

SEQ ID NO: 455400 - DNA, 20 bp, Artificial Sequence
  chemically synthesized
aagcctttctatagatgttt

SEQ ID NO: 455401 - DNA, 20 bp, Artificial Sequence
  chemically synthesized
tttctatagatgttttagcc

SEQ ID NO: 455402 - DNA, 20 bp, Artificial Sequence
  chemically synthesized
tagatgttttagccaagatc

SEQ ID NO: 455403 - DNA, 20 bp, Artificial Sequence
  chemically synthesized
ttaatagacagtcttgatct

SEQ ID NO: 455404 - DNA, 20 bp, Artificial Sequence
  chemically synthesized
ttagatgtcttattaataga

SEQ ID NO: 455405 - DNA, 20 bp, Artificial Sequence
  chemically synthesized
gatcaagactgtctattaat

SEQ ID NO: 455406 - DNA, 20 bp, Artificial Sequence
  chemically synthesized
tgttttagatgtcttattaa

SEQ ID NO: 455407 - DNA, 20 bp, Artificial Sequence
  chemically synthesized
atgtgcttgattaaatgttt

SEQ ID NO: 455408 - DNA, 20 bp, Artificial Sequence
  chemically synthesized
gacatctaaaacatttaatc

SEQ ID NO: 455409 - DNA, 20 bp, Artificial Sequence
  chemically synthesized
aacatttaatcaagcacatt

SEQ ID NO: 455410 - DNA, 20 bp, Artificial Sequence
  chemically synthesized
acatttggtttgaatataaa

SEQ ID NO: 455411 - DNA, 20 bp, Artificial Sequence
  chemically synthesized
gtttgaatataaaaagatga

SEQ ID NO: 455412 - DNA, 20 bp, Artificial Sequence
  chemically synthesized
ttgaatataaaaagatgata

SEQ ID NO: 455413 - DNA, 20 bp, Artificial Sequence
  chemically synthesized
taaaaagatgatagagcaat

SEQ ID NO: 455414 - DNA, 20 bp, Artificial Sequence
  chemically synthesized
aaaaagatgatagagcaatc

SEQ ID NO: 455415 - DNA, 20 bp, Artificial Sequence
  chemically synthesized
atcaggtttttctcaacaat

SEQ ID NO: 455416 - DNA, 20 bp, Artificial Sequence
  chemically synthesized
gttaaaaaacactaattgtt

SEQ ID NO: 455417 - DNA, 20 bp, Artificial Sequence
  chemically synthesized
caattagtgttttttaacaa

SEQ ID NO: 455418 - DNA, 20 bp, Artificial Sequence
  chemically synthesized
aattagtgttttttaacaaa

SEQ ID NO: 455419 - DNA, 20 bp, Artificial Sequence
  chemically synthesized
tttttaacaaaaggacataa

SEQ ID NO: 455420 - DNA, 20 bp, Artificial Sequence
  chemically synthesized
caaaaggacataacagtgca

SEQ ID NO: 455421 - DNA, 20 bp, Artificial Sequence
  chemically synthesized
tccaaaaattaataaatttt

SEQ ID NO: 455422 - DNA, 20 bp, Artificial Sequence
  chemically synthesized
gccaaaaatttattaatttt

SEQ ID NO: 455423 - DNA, 20 bp, Artificial Sequence
  chemically synthesized
ttattaatttttggaacttt

SEQ ID NO: 455424 - DNA, 20 bp, Artificial Sequence
  chemically synthesized
aagaagaatttggaaactaa

SEQ ID NO: 455425 - DNA, 20 bp, Artificial Sequence
  chemically synthesized
gtgtttaatgaagaagaatt

SEQ ID NO: 455426 - DNA, 20 bp, Artificial Sequence
  chemically synthesized
ttatcttgtgtttaatgaag

SEQ ID NO: 455427 - DNA, 20 bp, Artificial Sequence
  chemically synthesized
tttttatcttgtgtttaatg

SEQ ID NO: 455428 - DNA, 20 bp, Artificial Sequence
  chemically synthesized
aattcttcttcattaaacac

SEQ ID NO: 455429 - DNA, 20 bp, Artificial Sequence
  chemically synthesized
ttcacctgtcttaaaaagtt

SEQ ID NO: 455430 - DNA, 20 bp, Artificial Sequence
  chemically synthesized
ataaaaatacttaacttttt

SEQ ID NO: 455431 - DNA, 20 bp, Artificial Sequence
  chemically synthesized
aaatacttaactttttaaga

SEQ ID NO: 455432 - DNA, 20 bp, Artificial Sequence
  chemically synthesized
ttctattcacctgtcttaaa

SEQ ID NO: 455433 - DNA, 20 bp, Artificial Sequence
  chemically synthesized
aatacttaactttttaagac

SEQ ID NO: 455434 - DNA, 20 bp, Artificial Sequence
  chemically synthesized
aactttttaagacaggtgaa

SEQ ID NO: 455435 - DNA, 20 bp, Artificial Sequence
  chemically synthesized
tttttaagacaggtgaatag

SEQ ID NO: 455436 - DNA, 20 bp, Artificial Sequence
  chemically synthesized
ttttaagacaggtgaataga

SEQ ID NO: 455437 - DNA, 20 bp, Artificial Sequence
  chemically synthesized
aatagaaggaaatttttgct

SEQ ID NO: 455438 - DNA, 20 bp, Artificial Sequence
  chemically synthesized
cataaaaagtagaagaggct

SEQ ID NO: 455439 - DNA, 20 bp, Artificial Sequence
  chemically synthesized
tttaacataaaaagtagaag

SEQ ID NO: 455440 - DNA, 20 bp, Artificial Sequence
  chemically synthesized
atttaacataaaaagtagaa

SEQ ID NO: 455441 - DNA, 20 bp, Artificial Sequence
  chemically synthesized
atatttaacataaaaagtag

SEQ ID NO: 455442 - DNA, 20 bp, Artificial Sequence
  chemically synthesized
aaaatatttaacataaaaag

SEQ ID NO: 455443 - DNA, 20 bp, Artificial Sequence
  chemically synthesized
aataaaatatttaacataaa

SEQ ID NO: 455444 - DNA, 20 bp, Artificial Sequence
  chemically synthesized
gtaagccatgataaaaagca

SEQ ID NO: 455445 - DNA, 20 bp, Artificial Sequence
  chemically synthesized
ttattctatgctttttatca

SEQ ID NO: 455446 - DNA, 20 bp, Artificial Sequence
  chemically synthesized
tttgtgtaagccatgataaa

SEQ ID NO: 455447 - DNA, 20 bp, Artificial Sequence
  chemically synthesized
aacattatgaaggtttgtgt

SEQ ID NO: 455448 - DNA, 20 bp, Artificial Sequence
  chemically synthesized
atattgcagcaacattatga

SEQ ID NO: 455449 - DNA, 20 bp, Artificial Sequence
  chemically synthesized
tatattgcagcaacattatg

SEQ ID NO: 455450 - DNA, 20 bp, Artificial Sequence
  chemically synthesized
gatagtcagtaaatatattg

SEQ ID NO: 455451 - DNA, 20 bp, Artificial Sequence
  chemically synthesized
ttgaagagagcattgatagt

SEQ ID NO: 455452 - DNA, 20 bp, Artificial Sequence
  chemically synthesized
aaatttgaagagagcattga

SEQ ID NO: 455453 - DNA, 20 bp, Artificial Sequence
  chemically synthesized
acctataccaaatttgaaga

SEQ ID NO: 455454 - DNA, 20 bp, Artificial Sequence
  chemically synthesized
atacctataccaaatttgaa

SEQ ID NO: 455455 - DNA, 20 bp, Artificial Sequence
  chemically synthesized
atcaatgctctcttcaaatt

SEQ ID NO: 455456 - DNA, 20 bp, Artificial Sequence
  chemically synthesized
atatacctataccaaatttg

SEQ ID NO: 455457 - DNA, 20 bp, Artificial Sequence
  chemically synthesized
tgctctcttcaaatttggta

SEQ ID NO: 455458 - DNA, 20 bp, Artificial Sequence
  chemically synthesized
gctctcttcaaatttggtat

SEQ ID NO: 455459 - DNA, 20 bp, Artificial Sequence
  chemically synthesized
tttggtataggtatattttt

SEQ ID NO: 455460 - DNA, 20 bp, Artificial Sequence
  chemically synthesized
ctggagacaagaagggggaa

SEQ ID NO: 455461 - DNA, 20 bp, Artificial Sequence
  chemically synthesized
actggagacaagaaggggga

SEQ ID NO: 455462 - DNA, 20 bp, Artificial Sequence
  chemically synthesized
tgtaactggagacaagaagg

SEQ ID NO: 455463 - DNA, 20 bp, Artificial Sequence
  chemically synthesized
ctgtaactggagacaagaag

SEQ ID NO: 455464 - DNA, 20 bp, Artificial Sequence
  chemically synthesized
cctgtaactggagacaagaa

SEQ ID NO: 455465 - DNA, 20 bp, Artificial Sequence
  chemically synthesized
gcctgtaactggagacaaga

SEQ ID NO: 455466 - DNA, 20 bp, Artificial Sequence
  chemically synthesized
ggcctgtaactggagacaag

SEQ ID NO: 455467 - DNA, 20 bp, Artificial Sequence
  chemically synthesized
cctttcccccttcttgtctc

SEQ ID NO: 455468 - DNA, 20 bp, Artificial Sequence
  chemically synthesized
aagggcctgtaactggagac

SEQ ID NO: 455469 - DNA, 20 bp, Artificial Sequence
  chemically synthesized
ccccttcttgtctccagtta

SEQ ID NO: 455470 - DNA, 20 bp, Artificial Sequence
  chemically synthesized
cccttcttgtctccagttac

SEQ ID NO: 455471 - DNA, 20 bp, Artificial Sequence
  chemically synthesized
cataaaagggcctgtaactg

SEQ ID NO: 455472 - DNA, 20 bp, Artificial Sequence
  chemically synthesized
cccataaaagggcctgtaac

SEQ ID NO: 455473 - DNA, 20 bp, Artificial Sequence
  chemically synthesized
tccagttacaggccctttta

SEQ ID NO: 455474 - DNA, 20 bp, Artificial Sequence
  chemically synthesized
ccagttacaggcccttttat

SEQ ID NO: 455475 - DNA, 20 bp, Artificial Sequence
  chemically synthesized
aacgttataggcccataaaa

SEQ ID NO: 455476 - DNA, 20 bp, Artificial Sequence
  chemically synthesized
caacgttataggcccataaa

SEQ ID NO: 455477 - DNA, 20 bp, Artificial Sequence
  chemically synthesized
ccaacgttataggcccataa

SEQ ID NO: 455478 - DNA, 20 bp, Artificial Sequence
  chemically synthesized
cttttatgggcctataacgt

SEQ ID NO: 455479 - DNA, 20 bp, Artificial Sequence
  chemically synthesized
agatagaaaaccaacgttat

SEQ ID NO: 455480 - DNA, 20 bp, Artificial Sequence
  chemically synthesized
gagatagaaaaccaacgtta

SEQ ID NO: 455481 - DNA, 20 bp, Artificial Sequence
  chemically synthesized
ttttgaattttgaattgaga

SEQ ID NO: 455482 - DNA, 20 bp, Artificial Sequence
  chemically synthesized
tttcttttgaattttgaatt

SEQ ID NO: 455483 - DNA, 20 bp, Artificial Sequence
  chemically synthesized
tatctcaattcaaaattcaa

SEQ ID NO: 455484 - DNA, 20 bp, Artificial Sequence
  chemically synthesized
caattcaaaattcaaaagaa

SEQ ID NO: 455485 - DNA, 20 bp, Artificial Sequence
  chemically synthesized
aaaaaaaaagatgattttta

SEQ ID NO: 455486 - DNA, 20 bp, Artificial Sequence
  chemically synthesized
agcattagggcaaaaaaaaa

SEQ ID NO: 455487 - DNA, 20 bp, Artificial Sequence
  chemically synthesized
acgctctaaattaagcatta

SEQ ID NO: 455488 - DNA, 20 bp, Artificial Sequence
  chemically synthesized
tacgctctaaattaagcatt

SEQ ID NO: 455489 - DNA, 20 bp, Artificial Sequence
  chemically synthesized
ctacgctctaaattaagcat

SEQ ID NO: 455490 - DNA, 20 bp, Artificial Sequence
  chemically synthesized
ttttgccctaatgcttaatt

SEQ ID NO: 455491 - DNA, 20 bp, Artificial Sequence
  chemically synthesized
ttgccctaatgcttaattta

SEQ ID NO: 455492 - DNA, 20 bp, Artificial Sequence
  chemically synthesized
tatgtgctacgctctaaatt

SEQ ID NO: 455493 - DNA, 20 bp, Artificial Sequence
  chemically synthesized
ctaatgcttaatttagagcg

SEQ ID NO: 455494 - DNA, 20 bp, Artificial Sequence
  chemically synthesized
ttaatttagagcgtagcaca

SEQ ID NO: 455495 - DNA, 20 bp, Artificial Sequence
  chemically synthesized
acctttaatgagaacatatt

SEQ ID NO: 455496 - DNA, 20 bp, Artificial Sequence
  chemically synthesized
tacctttaatgagaacatat

SEQ ID NO: 455497 - DNA, 20 bp, Artificial Sequence
  chemically synthesized
ttcccaatatgttctcatta

SEQ ID NO: 455498 - DNA, 20 bp, Artificial Sequence
  chemically synthesized
tcccaatatgttctcattaa

SEQ ID NO: 455499 - DNA, 20 bp, Artificial Sequence
  chemically synthesized
caaagatcaatacctttaat

SEQ ID NO: 455500 - DNA, 20 bp, Artificial Sequence
  chemically synthesized
ttacttacttttaaaaatca

SEQ ID NO: 455501 - DNA, 20 bp, Artificial Sequence
  chemically synthesized
tattgatctttgatttttaa

SEQ ID NO: 455502 - DNA, 20 bp, Artificial Sequence
  chemically synthesized
gatctttgatttttaaaagt

SEQ ID NO: 455503 - DNA, 20 bp, Artificial Sequence
  chemically synthesized
gtaagtaacaacaaaactgt

SEQ ID NO: 455504 - DNA, 20 bp, Artificial Sequence
  chemically synthesized
aagtaacaacaaaactgtga

SEQ ID NO: 455505 - DNA, 20 bp, Artificial Sequence
  chemically synthesized
gtaacaacaaaactgtgaga

SEQ ID NO: 455506 - DNA, 20 bp, Artificial Sequence
  chemically synthesized
taacaacaaaactgtgagag

SEQ ID NO: 455507 - DNA, 20 bp, Artificial Sequence
  chemically synthesized
aaaaagctgctcctctctca

SEQ ID NO: 455508 - DNA, 20 bp, Artificial Sequence
  chemically synthesized
acaacaaaactgtgagagag

SEQ ID NO: 455509 - DNA, 20 bp, Artificial Sequence
  chemically synthesized
acaaaactgtgagagaggag

SEQ ID NO: 455510 - DNA, 20 bp, Artificial Sequence
  chemically synthesized
accacagttctcaaaggaaa

SEQ ID NO: 455511 - DNA, 20 bp, Artificial Sequence
  chemically synthesized
gaggagcagctttttccttt

SEQ ID NO: 455512 - DNA, 20 bp, Artificial Sequence
  chemically synthesized
atttaaaccacagttctcaa

SEQ ID NO: 455513 - DNA, 20 bp, Artificial Sequence
  chemically synthesized
catttaaaccacagttctca

SEQ ID NO: 455514 - DNA, 20 bp, Artificial Sequence
  chemically synthesized
gctttttcctttgagaactg

SEQ ID NO: 455515 - DNA, 20 bp, Artificial Sequence
  chemically synthesized
ccctcactgcatttaaacca

SEQ ID NO: 455516 - DNA, 20 bp, Artificial Sequence
  chemically synthesized
tgagaactgtggtttaaatg

SEQ ID NO: 455517 - DNA, 20 bp, Artificial Sequence
  chemically synthesized
aactgtggtttaaatgcagt

SEQ ID NO: 455518 - DNA, 20 bp, Artificial Sequence
  chemically synthesized
actgtggtttaaatgcagtg

SEQ ID NO: 455519 - DNA, 20 bp, Artificial Sequence
  chemically synthesized
ctgtggtttaaatgcagtga

SEQ ID NO: 455520 - DNA, 20 bp, Artificial Sequence
  chemically synthesized
tgtggtttaaatgcagtgag

SEQ ID NO: 455521 - DNA, 20 bp, Artificial Sequence
  chemically synthesized
gaaataggaagtcatttatg

SEQ ID NO: 455522 - DNA, 20 bp, Artificial Sequence
  chemically synthesized
acataaatgacttcctattt

SEQ ID NO: 455523 - DNA, 20 bp, Artificial Sequence
  chemically synthesized
aaacacttcactgaaatagg

SEQ ID NO: 455524 - DNA, 20 bp, Artificial Sequence
  chemically synthesized
attaaacacttcactgaaat

SEQ ID NO: 455525 - DNA, 20 bp, Artificial Sequence
  chemically synthesized
tattaaacacttcactgaaa

SEQ ID NO: 455526 - DNA, 20 bp, Artificial Sequence
  chemically synthesized
aatgacttcctatttcagtg

SEQ ID NO: 455527 - DNA, 20 bp, Artificial Sequence
  chemically synthesized
atttcagtgaagtgtttaat

SEQ ID NO: 455528 - DNA, 20 bp, Artificial Sequence
  chemically synthesized
tttcagtgaagtgtttaata

SEQ ID NO: 455529 - DNA, 20 bp, Artificial Sequence
  chemically synthesized
gtttaataaggtctttaaaa

SEQ ID NO: 455530 - DNA, 20 bp, Artificial Sequence
  chemically synthesized
tgctatgaagtactgtttta

SEQ ID NO: 455531 - DNA, 20 bp, Artificial Sequence
  chemically synthesized
gtctttaaaacagtacttca

SEQ ID NO: 455532 - DNA, 20 bp, Artificial Sequence
  chemically synthesized
ttgaagagcaggatgctatg

SEQ ID NO: 455533 - DNA, 20 bp, Artificial Sequence
  chemically synthesized
cagatgttgctttgaagagc

SEQ ID NO: 455534 - DNA, 20 bp, Artificial Sequence
  chemically synthesized
tcatagcatcctgctcttca

SEQ ID NO: 455535 - DNA, 20 bp, Artificial Sequence
  chemically synthesized
acagatgttgctttgaagag

SEQ ID NO: 455536 - DNA, 20 bp, Artificial Sequence
  chemically synthesized
gccacagatgttgctttgaa

SEQ ID NO: 455537 - DNA, 20 bp, Artificial Sequence
  chemically synthesized
gagccacagatgttgctttg

SEQ ID NO: 455538 - DNA, 20 bp, Artificial Sequence
  chemically synthesized
gctcttcaaagcaacatctg

SEQ ID NO: 455539 - DNA, 20 bp, Artificial Sequence
  chemically synthesized
attggaaccaaaaagagcca

SEQ ID NO: 455540 - DNA, 20 bp, Artificial Sequence
  chemically synthesized
gcaacatctgtggctctttt

SEQ ID NO: 455541 - DNA, 20 bp, Artificial Sequence
  chemically synthesized
tcacttattggaaccaaaaa

SEQ ID NO: 455542 - DNA, 20 bp, Artificial Sequence
  chemically synthesized
tatcacttattggaaccaaa

SEQ ID NO: 455543 - DNA, 20 bp, Artificial Sequence
  chemically synthesized
tggctctttttggttccaat

SEQ ID NO: 455544 - DNA, 20 bp, Artificial Sequence
  chemically synthesized
tgttgttatttatcacttat

SEQ ID NO: 455545 - DNA, 20 bp, Artificial Sequence
  chemically synthesized
caataagtgataaataacaa

SEQ ID NO: 455546 - DNA, 20 bp, Artificial Sequence
  chemically synthesized
aataagtgataaataacaac

SEQ ID NO: 455547 - DNA, 20 bp, Artificial Sequence
  chemically synthesized
gataaataacaacaggattt

SEQ ID NO: 455548 - DNA, 20 bp, Artificial Sequence
  chemically synthesized
aacaggattttggttcacgt

SEQ ID NO: 455549 - DNA, 20 bp, Artificial Sequence
  chemically synthesized
acaggattttggttcacgta

SEQ ID NO: 455550 - DNA, 20 bp, Artificial Sequence
  chemically synthesized
gttcacgtaaggacctaaaa

SEQ ID NO: 455551 - DNA, 20 bp, Artificial Sequence
  chemically synthesized
ttcacgtaaggacctaaaac

SEQ ID NO: 455552 - DNA, 20 bp, Artificial Sequence
  chemically synthesized
cacgtaaggacctaaaacag

SEQ ID NO: 455553 - DNA, 20 bp, Artificial Sequence
  chemically synthesized
ttaaccaactctcctgtttt

SEQ ID NO: 455554 - DNA, 20 bp, Artificial Sequence
  chemically synthesized
cttaaccaactctcctgttt

SEQ ID NO: 455555 - DNA, 20 bp, Artificial Sequence
  chemically synthesized
cgtaaggacctaaaacagga

SEQ ID NO: 455556 - DNA, 20 bp, Artificial Sequence
  chemically synthesized
aggacctaaaacaggagagt

SEQ ID NO: 455557 - DNA, 20 bp, Artificial Sequence
  chemically synthesized
ctaaaacaggagagttggtt

SEQ ID NO: 455558 - DNA, 20 bp, Artificial Sequence
  chemically synthesized
tacaaagcaacatgtatgaa

SEQ ID NO: 455559 - DNA, 20 bp, Artificial Sequence
  chemically synthesized
catacatgttgctttgtaat

SEQ ID NO: 455560 - DNA, 20 bp, Artificial Sequence
  chemically synthesized
atacatgttgctttgtaatt

SEQ ID NO: 455561 - DNA, 20 bp, Artificial Sequence
  chemically synthesized
attacatcagcccaattaca

SEQ ID NO: 455562 - DNA, 20 bp, Artificial Sequence
  chemically synthesized
acaataaaataaaattacat

SEQ ID NO: 455563 - DNA, 20 bp, Artificial Sequence
  chemically synthesized
attgtgttcaaaatttacac

SEQ ID NO: 455564 - DNA, 20 bp, Artificial Sequence
  chemically synthesized
aaaggtaattgacaaaatac

SEQ ID NO: 455565 - DNA, 20 bp, Artificial Sequence
  chemically synthesized
actttgtaagttgagaaaaa

SEQ ID NO: 455566 - DNA, 20 bp, Artificial Sequence
  chemically synthesized
tactttgtaagttgagaaaa

SEQ ID NO: 455567 - DNA, 20 bp, Artificial Sequence
  chemically synthesized
aaaaatgtactttgtaagtt

SEQ ID NO: 455568 - DNA, 20 bp, Artificial Sequence
  chemically synthesized
accttttttctcaacttaca

SEQ ID NO: 455569 - DNA, 20 bp, Artificial Sequence
  chemically synthesized
tttttaaaaatgtactttgt

SEQ ID NO: 455570 - DNA, 20 bp, Artificial Sequence
  chemically synthesized
tacaaagtacatttttaaaa

SEQ ID NO: 455571 - DNA, 20 bp, Artificial Sequence
  chemically synthesized
aaaaaagaaaaccatataca

SEQ ID NO: 455572 - DNA, 20 bp, Artificial Sequence
  chemically synthesized
cacaacctatgctttgtata

SEQ ID NO: 455573 - DNA, 20 bp, Artificial Sequence
  chemically synthesized
agaaaaccatatacaaagca

SEQ ID NO: 455574 - DNA, 20 bp, Artificial Sequence
  chemically synthesized
gaaaaccatatacaaagcat

SEQ ID NO: 455575 - DNA, 20 bp, Artificial Sequence
  chemically synthesized
ggttgtgtaatataatgaac

SEQ ID NO: 455576 - DNA, 20 bp, Artificial Sequence
  chemically synthesized
gagataagaagaataatgac

SEQ ID NO: 455577 - DNA, 20 bp, Artificial Sequence
  chemically synthesized
gatttaaatagagagataag

SEQ ID NO: 455578 - DNA, 20 bp, Artificial Sequence
  chemically synthesized
tatgatttaaatagagagat

SEQ ID NO: 455579 - DNA, 20 bp, Artificial Sequence
  chemically synthesized
aaatctatgatttaaataga

SEQ ID NO: 455580 - DNA, 20 bp, Artificial Sequence
  chemically synthesized
tgaaatctatgatttaaata

SEQ ID NO: 455581 - DNA, 20 bp, Artificial Sequence
  chemically synthesized
tttgaaatctatgatttaaa

SEQ ID NO: 455582 - DNA, 20 bp, Artificial Sequence
  chemically synthesized
ttatctctctatttaaatca

SEQ ID NO: 455583 - DNA, 20 bp, Artificial Sequence
  chemically synthesized
tttaaatcatagatttcaaa

SEQ ID NO: 455584 - DNA, 20 bp, Artificial Sequence
  chemically synthesized
tgtgtgtgtgtgttataatg

SEQ ID NO: 455585 - DNA, 20 bp, Artificial Sequence
  chemically synthesized
gtgtgtgtgttataatgtag

SEQ ID NO: 455586 - DNA, 20 bp, Artificial Sequence
  chemically synthesized
gtgtgtgttataatgtagtg

SEQ ID NO: 455587 - DNA, 20 bp, Artificial Sequence
  chemically synthesized
tgtgttataatgtagtggag

SEQ ID NO: 455588 - DNA, 20 bp, Artificial Sequence
  chemically synthesized
gttacagcattaaatgtatc

SEQ ID NO: 455589 - DNA, 20 bp, Artificial Sequence
  chemically synthesized
tgcatcaatatgtaatgtta

SEQ ID NO: 455590 - DNA, 20 bp, Artificial Sequence
  chemically synthesized
attgatgcattcataattca

SEQ ID NO: 455591 - DNA, 20 bp, Artificial Sequence
  chemically synthesized
cataattcaaagtaacatga

SEQ ID NO: 455592 - DNA, 20 bp, Artificial Sequence
  chemically synthesized
attcaaagtaacatgataga

SEQ ID NO: 455593 - DNA, 20 bp, Artificial Sequence
  chemically synthesized
tagaaagaaacatacatgtg

SEQ ID NO: 455594 - DNA, 20 bp, Artificial Sequence
  chemically synthesized
agaaagaaacatacatgtga

SEQ ID NO: 455595 - DNA, 20 bp, Artificial Sequence
  chemically synthesized
ttaaaaacatttttgtttgt

SEQ ID NO: 455596 - DNA, 20 bp, Artificial Sequence
  chemically synthesized
taaaaacatttttgtttgta

SEQ ID NO: 455597 - DNA, 20 bp, Artificial Sequence
  chemically synthesized
tttgtaaggattttgaaact

SEQ ID NO: 455598 - DNA, 20 bp, Artificial Sequence
  chemically synthesized
tgtaaggattttgaaacttg

SEQ ID NO: 455599 - DNA, 20 bp, Artificial Sequence
  chemically synthesized
gtaaggattttgaaacttgg

SEQ ID NO: 455600 - DNA, 20 bp, Artificial Sequence
  chemically synthesized
gttatattatttgatcctcc

SEQ ID NO: 455601 - DNA, 20 bp, Artificial Sequence
  chemically synthesized
gaggatcaaataatataact

SEQ ID NO: 455602 - DNA, 20 bp, Artificial Sequence
  chemically synthesized
attttgacagaaagaattct

SEQ ID NO: 455603 - DNA, 20 bp, Artificial Sequence
  chemically synthesized
ttccacattattttgacaga

SEQ ID NO: 455604 - DNA, 20 bp, Artificial Sequence
  chemically synthesized
cttgttccacattattttga

SEQ ID NO: 455605 - DNA, 20 bp, Artificial Sequence
  chemically synthesized
ttctttctgtcaaaataatg

SEQ ID NO: 455606 - DNA, 20 bp, Artificial Sequence
  chemically synthesized
ctgtcaaaataatgtggaac

SEQ ID NO: 455607 - DNA, 20 bp, Artificial Sequence
  chemically synthesized
gaacaagaaacacactaaac

SEQ ID NO: 455608 - DNA, 20 bp, Artificial Sequence
  chemically synthesized
acaagaaacacactaaacaa

SEQ ID NO: 455609 - DNA, 20 bp, Artificial Sequence
  chemically synthesized
cttcccaaatatctcttgtt

SEQ ID NO: 455610 - DNA, 20 bp, Artificial Sequence
  chemically synthesized
cacactaaacaagagatatt

SEQ ID NO: 455611 - DNA, 20 bp, Artificial Sequence
  chemically synthesized
acactaaacaagagatattt

SEQ ID NO: 455612 - DNA, 20 bp, Artificial Sequence
  chemically synthesized
ctaaacaagagatatttggg

SEQ ID NO: 455613 - DNA, 20 bp, Artificial Sequence
  chemically synthesized
gatatttgggaagttctact

SEQ ID NO: 455614 - DNA, 20 bp, Artificial Sequence
  chemically synthesized
gagaaaaattatggactgag

SEQ ID NO: 455615 - DNA, 20 bp, Artificial Sequence
  chemically synthesized
agggagaaaaattatggact

SEQ ID NO: 455616 - DNA, 20 bp, Artificial Sequence
  chemically synthesized
cagagaagggagaaaaatta

SEQ ID NO: 455617 - DNA, 20 bp, Artificial Sequence
  chemically synthesized
cataatttttctcccttctc

SEQ ID NO: 455618 - DNA, 20 bp, Artificial Sequence
  chemically synthesized
gtgatagtcgccagagaagg

SEQ ID NO: 455619 - DNA, 20 bp, Artificial Sequence
  chemically synthesized
gggtgatagtcgccagagaa

SEQ ID NO: 455620 - DNA, 20 bp, Artificial Sequence
  chemically synthesized
agggtgatagtcgccagaga

SEQ ID NO: 455621 - DNA, 20 bp, Artificial Sequence
  chemically synthesized
gagggtgatagtcgccagag

SEQ ID NO: 455622 - DNA, 20 bp, Artificial Sequence
  chemically synthesized
ctggagggtgatagtcgcca

SEQ ID NO: 455623 - DNA, 20 bp, Artificial Sequence
  chemically synthesized
gactggagggtgatagtcgc

SEQ ID NO: 455624 - DNA, 20 bp, Artificial Sequence
  chemically synthesized
attgtttgactggagggtga

SEQ ID NO: 455625 - DNA, 20 bp, Artificial Sequence
  chemically synthesized
ctctggcgactatcaccctc

SEQ ID NO: 455626 - DNA, 20 bp, Artificial Sequence
  chemically synthesized
ttatggattgtttgactgga

SEQ ID NO: 455627 - DNA, 20 bp, Artificial Sequence
  chemically synthesized
cttatggattgtttgactgg

SEQ ID NO: 455628 - DNA, 20 bp, Artificial Sequence
  chemically synthesized
gcttatggattgtttgactg

SEQ ID NO: 455629 - DNA, 20 bp, Artificial Sequence
  chemically synthesized
ctgcttatggattgtttgac

SEQ ID NO: 455630 - DNA, 20 bp, Artificial Sequence
  chemically synthesized
cctccagtcaaacaatccat

SEQ ID NO: 455631 - DNA, 20 bp, Artificial Sequence
  chemically synthesized
ccagtcaaacaatccataag

SEQ ID NO: 455632 - DNA, 20 bp, Artificial Sequence
  chemically synthesized
agtcaaacaatccataagca

SEQ ID NO: 455633 - DNA, 20 bp, Artificial Sequence
  chemically synthesized
gatatcaaggactctgctta

SEQ ID NO: 455634 - DNA, 20 bp, Artificial Sequence
  chemically synthesized
acaatacaaacatgatatca

SEQ ID NO: 455635 - DNA, 20 bp, Artificial Sequence
  chemically synthesized
cacaatacaaacatgatatc

SEQ ID NO: 455636 - DNA, 20 bp, Artificial Sequence
  chemically synthesized
tattgtgtgatatttgcctc

SEQ ID NO: 455637 - DNA, 20 bp, Artificial Sequence
  chemically synthesized
attgtgtgatatttgcctct

SEQ ID NO: 455638 - DNA, 20 bp, Artificial Sequence
  chemically synthesized
gtgatatttgcctctaggac

SEQ ID NO: 455639 - DNA, 20 bp, Artificial Sequence
  chemically synthesized
tccagtcagccttgtcctag

SEQ ID NO: 455640 - DNA, 20 bp, Artificial Sequence
  chemically synthesized
tgatatttgcctctaggaca

SEQ ID NO: 455641 - DNA, 20 bp, Artificial Sequence
  chemically synthesized
gtccagtcagccttgtccta

SEQ ID NO: 455642 - DNA, 20 bp, Artificial Sequence
  chemically synthesized
tggtccagtcagccttgtcc

SEQ ID NO: 455643 - DNA, 20 bp, Artificial Sequence
  chemically synthesized
gcctctaggacaaggctgac

SEQ ID NO: 455644 - DNA, 20 bp, Artificial Sequence
  chemically synthesized
ggcctcaatcttggtccagt

SEQ ID NO: 455645 - DNA, 20 bp, Artificial Sequence
  chemically synthesized
aggacaaggctgactggacc

SEQ ID NO: 455646 - DNA, 20 bp, Artificial Sequence
  chemically synthesized
atcaggcctcaatcttggtc

SEQ ID NO: 455647 - DNA, 20 bp, Artificial Sequence
  chemically synthesized
aggctgactggaccaagatt

SEQ ID NO: 455648 - DNA, 20 bp, Artificial Sequence
  chemically synthesized
ggctgactggaccaagattg

SEQ ID NO: 455649 - DNA, 20 bp, Artificial Sequence
  chemically synthesized
gttgaatcaggcctcaatct

SEQ ID NO: 455650 - DNA, 20 bp, Artificial Sequence
  chemically synthesized
tgtttgttccaagttgaatc

SEQ ID NO: 455651 - DNA, 20 bp, Artificial Sequence
  chemically synthesized
ctgtttgttccaagttgaat

SEQ ID NO: 455652 - DNA, 20 bp, Artificial Sequence
  chemically synthesized
gattgaggcctgattcaact

SEQ ID NO: 455653 - DNA, 20 bp, Artificial Sequence
  chemically synthesized
gaagtgcatctgtttgttcc

SEQ ID NO: 455654 - DNA, 20 bp, Artificial Sequence
  chemically synthesized
ctgattcaacttggaacaaa

SEQ ID NO: 455655 - DNA, 20 bp, Artificial Sequence
  chemically synthesized
ctcaggtaaagtattttagg

SEQ ID NO: 455656 - DNA, 20 bp, Artificial Sequence
  chemically synthesized
agtctcaggtaaagtatttt

SEQ ID NO: 455657 - DNA, 20 bp, Artificial Sequence
  chemically synthesized
gagtctcaggtaaagtattt

SEQ ID NO: 455658 - DNA, 20 bp, Artificial Sequence
  chemically synthesized
cttcctaaaatactttacct

SEQ ID NO: 455659 - DNA, 20 bp, Artificial Sequence
  chemically synthesized
cattttatgagtctcaggta

SEQ ID NO: 455660 - DNA, 20 bp, Artificial Sequence
  chemically synthesized
attctcattttatgagtctc

SEQ ID NO: 455661 - DNA, 20 bp, Artificial Sequence
  chemically synthesized
aattctcattttatgagtct

SEQ ID NO: 455662 - DNA, 20 bp, Artificial Sequence
  chemically synthesized
ttacctgagactcataaaat

SEQ ID NO: 455663 - DNA, 20 bp, Artificial Sequence
  chemically synthesized
tgcacaaattctcattttat

SEQ ID NO: 455664 - DNA, 20 bp, Artificial Sequence
  chemically synthesized
aaaatgagaatttgtgcaat

SEQ ID NO: 455665 - DNA, 20 bp, Artificial Sequence
  chemically synthesized
tttgtgcaatgagtcattct

SEQ ID NO: 455666 - DNA, 20 bp, Artificial Sequence
  chemically synthesized
gtgcaatgagtcattcttag

SEQ ID NO: 455667 - DNA, 20 bp, Artificial Sequence
  chemically synthesized
ctccatagtggtatgctact

SEQ ID NO: 455668 - DNA, 20 bp, Artificial Sequence
  chemically synthesized
ttcttagtagcataccacta

SEQ ID NO: 455669 - DNA, 20 bp, Artificial Sequence
  chemically synthesized
cttagtagcataccactatg

SEQ ID NO: 455670 - DNA, 20 bp, Artificial Sequence
  chemically synthesized
gccataggccatctccatag

SEQ ID NO: 455671 - DNA, 20 bp, Artificial Sequence
  chemically synthesized
gtagcataccactatggaga

SEQ ID NO: 455672 - DNA, 20 bp, Artificial Sequence
  chemically synthesized
ggggccataggccatctcca

SEQ ID NO: 455673 - DNA, 20 bp, Artificial Sequence
  chemically synthesized
accactatggagatggccta

SEQ ID NO: 455674 - DNA, 20 bp, Artificial Sequence
  chemically synthesized
catgggaatgatggggccat

SEQ ID NO: 455675 - DNA, 20 bp, Artificial Sequence
  chemically synthesized
ccatgggaatgatggggcca

SEQ ID NO: 455676 - DNA, 20 bp, Artificial Sequence
  chemically synthesized
tacaggccatgggaatgatg

SEQ ID NO: 455677 - DNA, 20 bp, Artificial Sequence
  chemically synthesized
ctacaggccatgggaatgat

SEQ ID NO: 455678 - DNA, 20 bp, Artificial Sequence
  chemically synthesized
cctacaggccatgggaatga

SEQ ID NO: 455679 - DNA, 20 bp, Artificial Sequence
  chemically synthesized
ctatggccccatcattccca

SEQ ID NO: 455680 - DNA, 20 bp, Artificial Sequence
  chemically synthesized
aaatttaacctacaggccat

SEQ ID NO: 455681 - DNA, 20 bp, Artificial Sequence
  chemically synthesized
cccatcattcccatggcctg

SEQ ID NO: 455682 - DNA, 20 bp, Artificial Sequence
  chemically synthesized
aaaatttaacctacaggcca

SEQ ID NO: 455683 - DNA, 20 bp, Artificial Sequence
  chemically synthesized
ccatcattcccatggcctgt

SEQ ID NO: 455684 - DNA, 20 bp, Artificial Sequence
  chemically synthesized
ccaagaaaaatttaacctac

SEQ ID NO: 455685 - DNA, 20 bp, Artificial Sequence
  chemically synthesized
cccaagaaaaatttaaccta

SEQ ID NO: 455686 - DNA, 20 bp, Artificial Sequence
  chemically synthesized
cctgtaggttaaatttttct

SEQ ID NO: 455687 - DNA, 20 bp, Artificial Sequence
  chemically synthesized
ctgtaggttaaatttttctt

SEQ ID NO: 455688 - DNA, 20 bp, Artificial Sequence
  chemically synthesized
attatctactggtagaaccc

SEQ ID NO: 455689 - DNA, 20 bp, Artificial Sequence
  chemically synthesized
aaatttttcttgggttctac

SEQ ID NO: 455690 - DNA, 20 bp, Artificial Sequence
  chemically synthesized
tttttcttgggttctaccag

SEQ ID NO: 455691 - DNA, 20 bp, Artificial Sequence
  chemically synthesized
tactctggattatctactgg

SEQ ID NO: 455692 - DNA, 20 bp, Artificial Sequence
  chemically synthesized
gcatactctggattatctac

SEQ ID NO: 455693 - DNA, 20 bp, Artificial Sequence
  chemically synthesized
ggttctaccagtagataatc

SEQ ID NO: 455694 - DNA, 20 bp, Artificial Sequence
  chemically synthesized
ttctaccagtagataatcca

SEQ ID NO: 455695 - DNA, 20 bp, Artificial Sequence
  chemically synthesized
aggtgtatttgtgcatactc

SEQ ID NO: 455696 - DNA, 20 bp, Artificial Sequence
  chemically synthesized
aaaatacaattcaaaattca

SEQ ID NO: 455697 - DNA, 20 bp, Artificial Sequence
  chemically synthesized
caaaatacaattcaaaattc

SEQ ID NO: 455698 - DNA, 20 bp, Artificial Sequence
  chemically synthesized
attttgaattgtattttgtt

SEQ ID NO: 455699 - DNA, 20 bp, Artificial Sequence
  chemically synthesized
ttttgaattgtattttgttt

SEQ ID NO: 455700 - DNA, 20 bp, Artificial Sequence
  chemically synthesized
tctttctttcttgcaagaaa

SEQ ID NO: 455701 - DNA, 20 bp, Artificial Sequence
  chemically synthesized
tttgggtttctgtttcttgc

SEQ ID NO: 455702 - DNA, 20 bp, Artificial Sequence
  chemically synthesized
ggtttctgtttcttgcaaga

SEQ ID NO: 455703 - DNA, 20 bp, Artificial Sequence
  chemically synthesized
ataatgtctttctttcttgc

SEQ ID NO: 455704 - DNA, 20 bp, Artificial Sequence
  chemically synthesized
tctgtttcttgcaagaaaga

SEQ ID NO: 455705 - DNA, 20 bp, Artificial Sequence
  chemically synthesized
aagacattattgatatttac

SEQ ID NO: 455706 - DNA, 20 bp, Artificial Sequence
  chemically synthesized
ttacaagatgacttaaaaat

SEQ ID NO: 455707 - DNA, 20 bp, Artificial Sequence
  chemically synthesized
tacaagatgacttaaaaatc

SEQ ID NO: 455708 - DNA, 20 bp, Artificial Sequence
  chemically synthesized
ttagaatatacctgattttt

SEQ ID NO: 455709 - DNA, 20 bp, Artificial Sequence
  chemically synthesized
aaaaatcaggtatattctaa

SEQ ID NO: 455710 - DNA, 20 bp, Artificial Sequence
  chemically synthesized
tcaggtatattctaaaagaa

SEQ ID NO: 455711 - DNA, 20 bp, Artificial Sequence
  chemically synthesized
agtagtctcatcttttcttt

SEQ ID NO: 455712 - DNA, 20 bp, Artificial Sequence
  chemically synthesized
tatattctaaaagaaaagat

SEQ ID NO: 455713 - DNA, 20 bp, Artificial Sequence
  chemically synthesized
aagaaaagatgagactactt

SEQ ID NO: 455714 - DNA, 20 bp, Artificial Sequence
  chemically synthesized
gtttattttggtatctcaag

SEQ ID NO: 455715 - DNA, 20 bp, Artificial Sequence
  chemically synthesized
cctgtttattttggtatctc

SEQ ID NO: 455716 - DNA, 20 bp, Artificial Sequence
  chemically synthesized
acttgagataccaaaataaa

SEQ ID NO: 455717 - DNA, 20 bp, Artificial Sequence
  chemically synthesized
tttttgttccctgtttattt

SEQ ID NO: 455718 - DNA, 20 bp, Artificial Sequence
  chemically synthesized
cttgagataccaaaataaac

SEQ ID NO: 455719 - DNA, 20 bp, Artificial Sequence
  chemically synthesized
ttgagataccaaaataaaca

SEQ ID NO: 455720 - DNA, 20 bp, Artificial Sequence
  chemically synthesized
tctacatcacgataatatgt

SEQ ID NO: 455721 - DNA, 20 bp, Artificial Sequence
  chemically synthesized
accaacatattatcgtgatg

SEQ ID NO: 455722 - DNA, 20 bp, Artificial Sequence
  chemically synthesized
acatattatcgtgatgtaga

SEQ ID NO: 455723 - DNA, 20 bp, Artificial Sequence
  chemically synthesized
catattatcgtgatgtagat

SEQ ID NO: 455724 - DNA, 20 bp, Artificial Sequence
  chemically synthesized
atgtagataggatttttttc

SEQ ID NO: 455725 - DNA, 20 bp, Artificial Sequence
  chemically synthesized
tagataggatttttttcaag

SEQ ID NO: 455726 - DNA, 20 bp, Artificial Sequence
  chemically synthesized
ggatttttttcaagaagctt

SEQ ID NO: 455727 - DNA, 20 bp, Artificial Sequence
  chemically synthesized
atttttttcaagaagcttga

SEQ ID NO: 455728 - DNA, 20 bp, Artificial Sequence
  chemically synthesized
tgcaatactaatatgctctc

SEQ ID NO: 455729 - DNA, 20 bp, Artificial Sequence
  chemically synthesized
caagaagcttgagagcatat

SEQ ID NO: 455730 - DNA, 20 bp, Artificial Sequence
  chemically synthesized
gagcatattagtattgcatt

SEQ ID NO: 455731 - DNA, 20 bp, Artificial Sequence
  chemically synthesized
catttggtacataatctgaa

SEQ ID NO: 455732 - DNA, 20 bp, Artificial Sequence
  chemically synthesized
atttggtacataatctgaat

SEQ ID NO: 455733 - DNA, 20 bp, Artificial Sequence
  chemically synthesized
ctttatcgtatggtcctatt

SEQ ID NO: 455734 - DNA, 20 bp, Artificial Sequence
  chemically synthesized
ctgaataggaccatacgata

SEQ ID NO: 455735 - DNA, 20 bp, Artificial Sequence
  chemically synthesized
gtacagtgttctttatcgta

SEQ ID NO: 455736 - DNA, 20 bp, Artificial Sequence
  chemically synthesized
tactttggtggaacattgta

SEQ ID NO: 455737 - DNA, 20 bp, Artificial Sequence
  chemically synthesized
cactgtacaatgttccacca

SEQ ID NO: 455738 - DNA, 20 bp, Artificial Sequence
  chemically synthesized
gttattaaggtatactttgg

SEQ ID NO: 455739 - DNA, 20 bp, Artificial Sequence
  chemically synthesized
gttgttattaaggtatactt

SEQ ID NO: 455740 - DNA, 20 bp, Artificial Sequence
  chemically synthesized
aaaagctattgttgttatta

SEQ ID NO: 455741 - DNA, 20 bp, Artificial Sequence
  chemically synthesized
taaaagctattgttgttatt

SEQ ID NO: 455742 - DNA, 20 bp, Artificial Sequence
  chemically synthesized
gtataccttaataacaacaa

SEQ ID NO: 455743 - DNA, 20 bp, Artificial Sequence
  chemically synthesized
taaaacaagaatttttataa

SEQ ID NO: 455744 - DNA, 20 bp, Artificial Sequence
  chemically synthesized
aaattctagatatataaaac

SEQ ID NO: 455745 - DNA, 20 bp, Artificial Sequence
  chemically synthesized
aaattcttgttttatatatc

SEQ ID NO: 455746 - DNA, 20 bp, Artificial Sequence
  chemically synthesized
tttacatttatgtaaaattc

SEQ ID NO: 455747 - DNA, 20 bp, Artificial Sequence
  chemically synthesized
cataaatgtaaaaaataatg

SEQ ID NO: 455748 - DNA, 20 bp, Artificial Sequence
  chemically synthesized
ttttatattgatatttaaat

SEQ ID NO: 455749 - DNA, 20 bp, Artificial Sequence
  chemically synthesized
tcatttaaatatcaatataa

SEQ ID NO: 455750 - DNA, 20 bp, Artificial Sequence
  chemically synthesized
atatcaatataaaagttaat

SEQ ID NO: 455751 - DNA, 20 bp, Artificial Sequence
  chemically synthesized
taagttggatgtatttgtat

SEQ ID NO: 455752 - DNA, 20 bp, Artificial Sequence
  chemically synthesized
aataaataagttgagtaagt

SEQ ID NO: 455753 - DNA, 20 bp, Artificial Sequence
  chemically synthesized
agaaaataaataagttgagt

SEQ ID NO: 455754 - DNA, 20 bp, Artificial Sequence
  chemically synthesized
caaaagaaaataaataagtt

SEQ ID NO: 455755 - DNA, 20 bp, Artificial Sequence
  chemically synthesized
tttctcaaaagaaaataaat

SEQ ID NO: 455756 - DNA, 20 bp, Artificial Sequence
  chemically synthesized
caacttatttattttctttt

SEQ ID NO: 455757 - DNA, 20 bp, Artificial Sequence
  chemically synthesized
ttatttattttcttttgaga

SEQ ID NO: 455758 - DNA, 20 bp, Artificial Sequence
  chemically synthesized
tatttattttcttttgagaa

SEQ ID NO: 455759 - DNA, 20 bp, Artificial Sequence
  chemically synthesized
tctaattttacctttctcaa

SEQ ID NO: 455760 - DNA, 20 bp, Artificial Sequence
  chemically synthesized
tcttttgagaaaggtaaaat

SEQ ID NO: 455761 - DNA, 20 bp, Artificial Sequence
  chemically synthesized
ttttgagaaaggtaaaatta

SEQ ID NO: 455762 - DNA, 20 bp, Artificial Sequence
  chemically synthesized
tgagaaaggtaaaattagag

SEQ ID NO: 455763 - DNA, 20 bp, Artificial Sequence
  chemically synthesized
aaggtaaaattagagaagtc

SEQ ID NO: 455764 - DNA, 20 bp, Artificial Sequence
  chemically synthesized
ggtaaaattagagaagtcca

SEQ ID NO: 455765 - DNA, 20 bp, Artificial Sequence
  chemically synthesized
gtactcattgtataagtctc

SEQ ID NO: 455766 - DNA, 20 bp, Artificial Sequence
  chemically synthesized
agtccagagacttatacaat

SEQ ID NO: 455767 - DNA, 20 bp, Artificial Sequence
  chemically synthesized
gagatatgtactcattgtat

SEQ ID NO: 455768 - DNA, 20 bp, Artificial Sequence
  chemically synthesized
atacaatgagtacatatctc

SEQ ID NO: 455769 - DNA, 20 bp, Artificial Sequence
  chemically synthesized
tacaatgagtacatatctcc

SEQ ID NO: 455770 - DNA, 20 bp, Artificial Sequence
  chemically synthesized
ttcataattatgatttcctg

SEQ ID NO: 455771 - DNA, 20 bp, Artificial Sequence
  chemically synthesized
tattcataattatgatttcc

SEQ ID NO: 455772 - DNA, 20 bp, Artificial Sequence
  chemically synthesized
ttatgcacaataaattagga

SEQ ID NO: 455773 - DNA, 20 bp, Artificial Sequence
  chemically synthesized
tagattatgcacaataaatt

SEQ ID NO: 455774 - DNA, 20 bp, Artificial Sequence
  chemically synthesized
ttagattatgcacaataaat

SEQ ID NO: 455775 - DNA, 20 bp, Artificial Sequence
  chemically synthesized
tgtgcataatctaattataa

SEQ ID NO: 455776 - DNA, 20 bp, Artificial Sequence
  chemically synthesized
gaatcattttcttttataat

SEQ ID NO: 455777 - DNA, 20 bp, Artificial Sequence
  chemically synthesized
ggcctggagataaggaagta

SEQ ID NO: 455778 - DNA, 20 bp, Artificial Sequence
  chemically synthesized
gaacaggcctggagataagg

SEQ ID NO: 455779 - DNA, 20 bp, Artificial Sequence
  chemically synthesized
acactttacttccttatctc

SEQ ID NO: 455780 - DNA, 20 bp, Artificial Sequence
  chemically synthesized
cactttacttccttatctcc

SEQ ID NO: 455781 - DNA, 20 bp, Artificial Sequence
  chemically synthesized
ggagaacaggcctggagata

SEQ ID NO: 455782 - DNA, 20 bp, Artificial Sequence
  chemically synthesized
aggagaacaggcctggagat

SEQ ID NO: 455783 - DNA, 20 bp, Artificial Sequence
  chemically synthesized
agagcaggagaacaggcctg

SEQ ID NO: 455784 - DNA, 20 bp, Artificial Sequence
  chemically synthesized
cgagagcaggagaacaggcc

SEQ ID NO: 455785 - DNA, 20 bp, Artificial Sequence
  chemically synthesized
aaagacgagagcaggagaac

SEQ ID NO: 455786 - DNA, 20 bp, Artificial Sequence
  chemically synthesized
taaagacgagagcaggagaa

SEQ ID NO: 455787 - DNA, 20 bp, Artificial Sequence
  chemically synthesized
tcttataaagacgagagcag

SEQ ID NO: 455788 - DNA, 20 bp, Artificial Sequence
  chemically synthesized
cctcttataaagacgagagc

SEQ ID NO: 455789 - DNA, 20 bp, Artificial Sequence
  chemically synthesized
gcctcttataaagacgagag

SEQ ID NO: 455790 - DNA, 20 bp, Artificial Sequence
  chemically synthesized
atggcctcttataaagacga

SEQ ID NO: 455791 - DNA, 20 bp, Artificial Sequence
  chemically synthesized
tcatggcctcttataaagac

SEQ ID NO: 455792 - DNA, 20 bp, Artificial Sequence
  chemically synthesized
tctcctgctctcgtctttat

SEQ ID NO: 455793 - DNA, 20 bp, Artificial Sequence
  chemically synthesized
tcctgctctcgtctttataa

SEQ ID NO: 455794 - DNA, 20 bp, Artificial Sequence
  chemically synthesized
cctgctctcgtctttataag

SEQ ID NO: 455795 - DNA, 20 bp, Artificial Sequence
  chemically synthesized
atatatcatggcctcttata

SEQ ID NO: 455796 - DNA, 20 bp, Artificial Sequence
  chemically synthesized
aacataaaattcatatatca

SEQ ID NO: 455797 - DNA, 20 bp, Artificial Sequence
  chemically synthesized
gaattttatgttcattaatt

SEQ ID NO: 455798 - DNA, 20 bp, Artificial Sequence
  chemically synthesized
atgtgaaaagcagaacaatt

SEQ ID NO: 455799 - DNA, 20 bp, Artificial Sequence
  chemically synthesized
ataggaatgtatgtgaaaag

SEQ ID NO: 455800 - DNA, 20 bp, Artificial Sequence
  chemically synthesized
gatataggaatgtatgtgaa

SEQ ID NO: 455801 - DNA, 20 bp, Artificial Sequence
  chemically synthesized
tatgtattgtttatggatat

SEQ ID NO: 455802 - DNA, 20 bp, Artificial Sequence
  chemically synthesized
ttatgtattgtttatggata

SEQ ID NO: 455803 - DNA, 20 bp, Artificial Sequence
  chemically synthesized
acaacattatgtattgttta

SEQ ID NO: 455804 - DNA, 20 bp, Artificial Sequence
  chemically synthesized
agcactcaagtaaatttgta

SEQ ID NO: 455805 - DNA, 20 bp, Artificial Sequence
  chemically synthesized
tgttctttacaaatttactt

SEQ ID NO: 455806 - DNA, 20 bp, Artificial Sequence
  chemically synthesized
tacaaatttacttgagtgct

SEQ ID NO: 455807 - DNA, 20 bp, Artificial Sequence
  chemically synthesized
atgaaggatgccaagcactc

SEQ ID NO: 455808 - DNA, 20 bp, Artificial Sequence
  chemically synthesized
ttagctcaatgaaggatgcc

SEQ ID NO: 455809 - DNA, 20 bp, Artificial Sequence
  chemically synthesized
agtgcttggcatccttcatt

SEQ ID NO: 455810 - DNA, 20 bp, Artificial Sequence
  chemically synthesized
atagctcattagctcaatga

SEQ ID NO: 455811 - DNA, 20 bp, Artificial Sequence
  chemically synthesized
gatagctcattagctcaatg

SEQ ID NO: 455812 - DNA, 20 bp, Artificial Sequence
  chemically synthesized
gcatccttcattgagctaat

SEQ ID NO: 455813 - DNA, 20 bp, Artificial Sequence
  chemically synthesized
gattcttatggatagctcat

SEQ ID NO: 455814 - DNA, 20 bp, Artificial Sequence
  chemically synthesized
tgagctaatgagctatccat

SEQ ID NO: 455815 - DNA, 20 bp, Artificial Sequence
  chemically synthesized
tcaacatggattcttatgga

SEQ ID NO: 455816 - DNA, 20 bp, Artificial Sequence
  chemically synthesized
tggatcaacatggattctta

SEQ ID NO: 455817 - DNA, 20 bp, Artificial Sequence
  chemically synthesized
gggtatggagtggatcaaca

SEQ ID NO: 455818 - DNA, 20 bp, Artificial Sequence
  chemically synthesized
gatactacctgggtatggag

SEQ ID NO: 455819 - DNA, 20 bp, Artificial Sequence
  chemically synthesized
atgttgatccactccatacc

SEQ ID NO: 455820 - DNA, 20 bp, Artificial Sequence
  chemically synthesized
tgttgatccactccataccc

SEQ ID NO: 455821 - DNA, 20 bp, Artificial Sequence
  chemically synthesized
agcgatactacctgggtatg

SEQ ID NO: 455822 - DNA, 20 bp, Artificial Sequence
  chemically synthesized
tcagcgatactacctgggta

SEQ ID NO: 455823 - DNA, 20 bp, Artificial Sequence
  chemically synthesized
tgatccactccatacccagg

SEQ ID NO: 455824 - DNA, 20 bp, Artificial Sequence
  chemically synthesized
gcctgtcagcgatactacct

SEQ ID NO: 455825 - DNA, 20 bp, Artificial Sequence
  chemically synthesized
agcctgtcagcgatactacc

SEQ ID NO: 455826 - DNA, 20 bp, Artificial Sequence
  chemically synthesized
tacccaggtagtatcgctga

SEQ ID NO: 455827 - DNA, 20 bp, Artificial Sequence
  chemically synthesized
acccaggtagtatcgctgac

SEQ ID NO: 455828 - DNA, 20 bp, Artificial Sequence
  chemically synthesized
ttagaggctgaacagcctgt

SEQ ID NO: 455829 - DNA, 20 bp, Artificial Sequence
  chemically synthesized
agtatcgctgacaggctgtt

SEQ ID NO: 455830 - DNA, 20 bp, Artificial Sequence
  chemically synthesized
taatacaattagaggctgaa

SEQ ID NO: 455831 - DNA, 20 bp, Artificial Sequence
  chemically synthesized
gagctatataatacaattag

SEQ ID NO: 455832 - DNA, 20 bp, Artificial Sequence
  chemically synthesized
agagctatataatacaatta

SEQ ID NO: 455833 - DNA, 20 bp, Artificial Sequence
  chemically synthesized
gaagagctatataatacaat

SEQ ID NO: 455834 - DNA, 20 bp, Artificial Sequence
  chemically synthesized
cagcctctaattgtattata

SEQ ID NO: 455835 - DNA, 20 bp, Artificial Sequence
  chemically synthesized
accacacctgcatgcaagaa

SEQ ID NO: 455836 - DNA, 20 bp, Artificial Sequence
  chemically synthesized
taaccacacctgcatgcaag

SEQ ID NO: 455837 - DNA, 20 bp, Artificial Sequence
  chemically synthesized
tatatagctcttcttgcatg

SEQ ID NO: 455838 - DNA, 20 bp, Artificial Sequence
  chemically synthesized
atatagctcttcttgcatgc

SEQ ID NO: 455839 - DNA, 20 bp, Artificial Sequence
  chemically synthesized
aaataaccacacctgcatgc

SEQ ID NO: 455840 - DNA, 20 bp, Artificial Sequence
  chemically synthesized
gctcttcttgcatgcaggtg

SEQ ID NO: 455841 - DNA, 20 bp, Artificial Sequence
  chemically synthesized
gttatttgatttgtttctcc

SEQ ID NO: 455842 - DNA, 20 bp, Artificial Sequence
  chemically synthesized
atttgatttgtttctcccag

SEQ ID NO: 455843 - DNA, 20 bp, Artificial Sequence
  chemically synthesized
ttccactcatattctactgg

SEQ ID NO: 455844 - DNA, 20 bp, Artificial Sequence
  chemically synthesized
acttccactcatattctact

SEQ ID NO: 455845 - DNA, 20 bp, Artificial Sequence
  chemically synthesized
tacttccactcatattctac

SEQ ID NO: 455846 - DNA, 20 bp, Artificial Sequence
  chemically synthesized
tgtttctcccagtagaatat

SEQ ID NO: 455847 - DNA, 20 bp, Artificial Sequence
  chemically synthesized
ttctcccagtagaatatgag

SEQ ID NO: 455848 - DNA, 20 bp, Artificial Sequence
  chemically synthesized
tcccagtagaatatgagtgg

SEQ ID NO: 455849 - DNA, 20 bp, Artificial Sequence
  chemically synthesized
ggaagtaatttgtgtcaatt

SEQ ID NO: 455850 - DNA, 20 bp, Artificial Sequence
  chemically synthesized
aagtaatttgtgtcaattca

SEQ ID NO: 455851 - DNA, 20 bp, Artificial Sequence
  chemically synthesized
tttgtgtcaattcagagctt

SEQ ID NO: 455852 - DNA, 20 bp, Artificial Sequence
  chemically synthesized
tattagctttttaaaatctg

SEQ ID NO: 455853 - DNA, 20 bp, Artificial Sequence
  chemically synthesized
tcagagcttcagattttaaa

SEQ ID NO: 455854 - DNA, 20 bp, Artificial Sequence
  chemically synthesized
aaacagcagagaagatatat

SEQ ID NO: 455855 - DNA, 20 bp, Artificial Sequence
  chemically synthesized
atgggaaagaaacagcagag

SEQ ID NO: 455856 - DNA, 20 bp, Artificial Sequence
  chemically synthesized
agaatgggaaagaaacagca

SEQ ID NO: 455857 - DNA, 20 bp, Artificial Sequence
  chemically synthesized
atagaatgggaaagaaacag

SEQ ID NO: 455858 - DNA, 20 bp, Artificial Sequence
  chemically synthesized
tccatagaatgggaaagaaa

SEQ ID NO: 455859 - DNA, 20 bp, Artificial Sequence
  chemically synthesized
catacatccatagaatggga

SEQ ID NO: 455860 - DNA, 20 bp, Artificial Sequence
  chemically synthesized
gctgtttctttcccattcta

SEQ ID NO: 455861 - DNA, 20 bp, Artificial Sequence
  chemically synthesized
tctgcatacatccatagaat

SEQ ID NO: 455862 - DNA, 20 bp, Artificial Sequence
  chemically synthesized
atctgcatacatccatagaa

SEQ ID NO: 455863 - DNA, 20 bp, Artificial Sequence
  chemically synthesized
gagtcatctgcatacatcca

SEQ ID NO: 455864 - DNA, 20 bp, Artificial Sequence
  chemically synthesized
tcccattctatggatgtatg

SEQ ID NO: 455865 - DNA, 20 bp, Artificial Sequence
  chemically synthesized
ggatgtatgcagatgactct

SEQ ID NO: 455866 - DNA, 20 bp, Artificial Sequence
  chemically synthesized
gatgtatgcagatgactctg

SEQ ID NO: 455867 - DNA, 20 bp, Artificial Sequence
  chemically synthesized
cccgcatctcttcaacctca

SEQ ID NO: 455868 - DNA, 20 bp, Artificial Sequence
  chemically synthesized
tgcagatgactctgaggttg

SEQ ID NO: 455869 - DNA, 20 bp, Artificial Sequence
  chemically synthesized
cccccgcatctcttcaacct

SEQ ID NO: 455870 - DNA, 20 bp, Artificial Sequence
  chemically synthesized
cagatgactctgaggttgaa

SEQ ID NO: 455871 - DNA, 20 bp, Artificial Sequence
  chemically synthesized
actctgaggttgaagagatg

SEQ ID NO: 455872 - DNA, 20 bp, Artificial Sequence
  chemically synthesized
ctctgaggttgaagagatgc

SEQ ID NO: 455873 - DNA, 20 bp, Artificial Sequence
  chemically synthesized
tctgaggttgaagagatgcg

SEQ ID NO: 455874 - DNA, 20 bp, Artificial Sequence
  chemically synthesized
ctgaggttgaagagatgcgg

SEQ ID NO: 455875 - DNA, 20 bp, Artificial Sequence
  chemically synthesized
gaggttgaagagatgcgggg

SEQ ID NO: 455876 - DNA, 20 bp, Artificial Sequence
  chemically synthesized
gatgcgggggagcaacaaaa

SEQ ID NO: 455877 - DNA, 20 bp, Artificial Sequence
  chemically synthesized
gcgggggagcaacaaaatgg

SEQ ID NO: 455878 - DNA, 20 bp, Artificial Sequence
  chemically synthesized
gcaacaaaatggaagacgtc

SEQ ID NO: 455879 - DNA, 20 bp, Artificial Sequence
  chemically synthesized
catgtgacgatgcaaggatc

SEQ ID NO: 455880 - DNA, 20 bp, Artificial Sequence
  chemically synthesized
ttcctgcatgtgacgatgca

SEQ ID NO: 455881 - DNA, 20 bp, Artificial Sequence
  chemically synthesized
tttcctgcatgtgacgatgc

SEQ ID NO: 455882 - DNA, 20 bp, Artificial Sequence
  chemically synthesized
gatccttgcatcgtcacatg

SEQ ID NO: 455883 - DNA, 20 bp, Artificial Sequence
  chemically synthesized
atccttgcatcgtcacatgc

SEQ ID NO: 455884 - DNA, 20 bp, Artificial Sequence
  chemically synthesized
ttgcatcgtcacatgcagga

SEQ ID NO: 455885 - DNA, 20 bp, Artificial Sequence
  chemically synthesized
aggaaagcaacacgctgcca

SEQ ID NO: 455886 - DNA, 20 bp, Artificial Sequence
  chemically synthesized
cagtccatggcattccatgg

SEQ ID NO: 455887 - DNA, 20 bp, Artificial Sequence
  chemically synthesized
tcacagtccatggcattcca

SEQ ID NO: 455888 - DNA, 20 bp, Artificial Sequence
  chemically synthesized
cacgctgccatggaatgcca

SEQ ID NO: 455889 - DNA, 20 bp, Artificial Sequence
  chemically synthesized
tttgctcatgtcacagtcca

SEQ ID NO: 455890 - DNA, 20 bp, Artificial Sequence
  chemically synthesized
aatgccatggactgtgacat

SEQ ID NO: 455891 - DNA, 20 bp, Artificial Sequence
  chemically synthesized
tttattgtttgctcatgtca

SEQ ID NO: 455892 - DNA, 20 bp, Artificial Sequence
  chemically synthesized
caataaatatctgttgtgtt

SEQ ID NO: 455893 - DNA, 20 bp, Artificial Sequence
  chemically synthesized
atttcagtgccttaacacaa

SEQ ID NO: 455894 - DNA, 20 bp, Artificial Sequence
  chemically synthesized
aataaatatctgttgtgtta

SEQ ID NO: 455895 - DNA, 20 bp, Artificial Sequence
  chemically synthesized
gtgttaaggcactgaaattg

SEQ ID NO: 455896 - DNA, 20 bp, Artificial Sequence
  chemically synthesized
tgttaaggcactgaaattgt

SEQ ID NO: 455897 - DNA, 20 bp, Artificial Sequence
  chemically synthesized
gcaaaccaaacccacaattt

SEQ ID NO: 455898 - DNA, 20 bp, Artificial Sequence
  chemically synthesized
aggcactgaaattgtgggtt

SEQ ID NO: 455899 - DNA, 20 bp, Artificial Sequence
  chemically synthesized
gtgggtttggtttgctatgc

SEQ ID NO: 455900 - DNA, 20 bp, Artificial Sequence
  chemically synthesized
gtttggtttgctatgctagc

SEQ ID NO: 455901 - DNA, 20 bp, Artificial Sequence
  chemically synthesized
tcttttaatgctagctagca

SEQ ID NO: 455902 - DNA, 20 bp, Artificial Sequence
  chemically synthesized
ttcattcttttaatgctagc

SEQ ID NO: 455903 - DNA, 20 bp, Artificial Sequence
  chemically synthesized
gctatgctagctagcattaa

SEQ ID NO: 455904 - DNA, 20 bp, Artificial Sequence
  chemically synthesized
tatattcattcttttaatgc

SEQ ID NO: 455905 - DNA, 20 bp, Artificial Sequence
  chemically synthesized
agaacgattgcaaagcgtga

SEQ ID NO: 455906 - DNA, 20 bp, Artificial Sequence
  chemically synthesized
aaagttgtagaacgattgca

SEQ ID NO: 455907 - DNA, 20 bp, Artificial Sequence
  chemically synthesized
tgagtgaaaaaggaaagttg

SEQ ID NO: 455908 - DNA, 20 bp, Artificial Sequence
  chemically synthesized
taatattgagtgaaaaagga

SEQ ID NO: 455909 - DNA, 20 bp, Artificial Sequence
  chemically synthesized
tatataatattgagtgaaaa

SEQ ID NO: 455910 - DNA, 20 bp, Artificial Sequence
  chemically synthesized
atatataatattgagtgaaa

SEQ ID NO: 455911 - DNA, 20 bp, Artificial Sequence
  chemically synthesized
taacccaaatatataatatt

SEQ ID NO: 455912 - DNA, 20 bp, Artificial Sequence
  chemically synthesized
ttcactcaatattatatatt

SEQ ID NO: 455913 - DNA, 20 bp, Artificial Sequence
  chemically synthesized
tcactcaatattatatattt

SEQ ID NO: 455914 - DNA, 20 bp, Artificial Sequence
  chemically synthesized
ttgggttacataattattgt

SEQ ID NO: 455915 - DNA, 20 bp, Artificial Sequence
  chemically synthesized
tacataattattgtgagata

SEQ ID NO: 455916 - DNA, 20 bp, Artificial Sequence
  chemically synthesized
agatatggatctaattaata

SEQ ID NO: 455917 - DNA, 20 bp, Artificial Sequence
  chemically synthesized
ttgaaaaaccctgtattaat

SEQ ID NO: 455918 - DNA, 20 bp, Artificial Sequence
  chemically synthesized
gatatggatctaattaatac

SEQ ID NO: 455919 - DNA, 20 bp, Artificial Sequence
  chemically synthesized
atatggatctaattaataca

SEQ ID NO: 455920 - DNA, 20 bp, Artificial Sequence
  chemically synthesized
attaatacagggtttttcaa

SEQ ID NO: 455921 - DNA, 20 bp, Artificial Sequence
  chemically synthesized
aatacagggtttttcaaaag

SEQ ID NO: 455922 - DNA, 20 bp, Artificial Sequence
  chemically synthesized
ttatcagtccaaaacgttaa

SEQ ID NO: 455923 - DNA, 20 bp, Artificial Sequence
  chemically synthesized
aagtggcacttttaacgttt

SEQ ID NO: 455924 - DNA, 20 bp, Artificial Sequence
  chemically synthesized
tcccccgaacaaacaattat

SEQ ID NO: 455925 - DNA, 20 bp, Artificial Sequence
  chemically synthesized
tggactgataattgtttgtt

SEQ ID NO: 455926 - DNA, 20 bp, Artificial Sequence
  chemically synthesized
ggactgataattgtttgttc

SEQ ID NO: 455927 - DNA, 20 bp, Artificial Sequence
  chemically synthesized
gactgataattgtttgttcg

SEQ ID NO: 455928 - DNA, 20 bp, Artificial Sequence
  chemically synthesized
actgataattgtttgttcgg

SEQ ID NO: 455929 - DNA, 20 bp, Artificial Sequence
  chemically synthesized
tgataattgtttgttcgggg

SEQ ID NO: 455930 - DNA, 20 bp, Artificial Sequence
  chemically synthesized
gataattgtttgttcggggg

SEQ ID NO: 455931 - DNA, 20 bp, Artificial Sequence
  chemically synthesized
acatcctacaatgcaaagga

SEQ ID NO: 455932 - DNA, 20 bp, Artificial Sequence
  chemically synthesized
gcaaacatcctacaatgcaa

SEQ ID NO: 455933 - DNA, 20 bp, Artificial Sequence
  chemically synthesized
ggaggccgtcctttgcattg

SEQ ID NO: 455934 - DNA, 20 bp, Artificial Sequence
  chemically synthesized
ggcaaacatcctacaatgca

SEQ ID NO: 455935 - DNA, 20 bp, Artificial Sequence
  chemically synthesized
gaggccgtcctttgcattgt

SEQ ID NO: 455936 - DNA, 20 bp, Artificial Sequence
  chemically synthesized
ttgcattgtaggatgtttgc

SEQ ID NO: 455937 - DNA, 20 bp, Artificial Sequence
  chemically synthesized
taggtagaagacagagattc

SEQ ID NO: 455938 - DNA, 20 bp, Artificial Sequence
  chemically synthesized
catctagtaggtagaagaca

SEQ ID NO: 455939 - DNA, 20 bp, Artificial Sequence
  chemically synthesized
ggcatctagtaggtagaaga

SEQ ID NO: 455940 - DNA, 20 bp, Artificial Sequence
  chemically synthesized
tactggcatctagtaggtag

SEQ ID NO: 455941 - DNA, 20 bp, Artificial Sequence
  chemically synthesized
aatctctgtcttctacctac

SEQ ID NO: 455942 - DNA, 20 bp, Artificial Sequence
  chemically synthesized
ttgtactggcatctagtagg

SEQ ID NO: 455943 - DNA, 20 bp, Artificial Sequence
  chemically synthesized
gcattgtactggcatctagt

SEQ ID NO: 455944 - DNA, 20 bp, Artificial Sequence
  chemically synthesized
agcattgtactggcatctag

SEQ ID NO: 455945 - DNA, 20 bp, Artificial Sequence
  chemically synthesized
gtcttctacctactagatgc

SEQ ID NO: 455946 - DNA, 20 bp, Artificial Sequence
  chemically synthesized
ggtagcattgtactggcatc

SEQ ID NO: 455947 - DNA, 20 bp, Artificial Sequence
  chemically synthesized
cggaagtggtagcattgtac

SEQ ID NO: 455948 - DNA, 20 bp, Artificial Sequence
  chemically synthesized
cgtaattactgcggaagtgg

SEQ ID NO: 455949 - DNA, 20 bp, Artificial Sequence
  chemically synthesized
gtacaatgctaccacttccg

SEQ ID NO: 455950 - DNA, 20 bp, Artificial Sequence
  chemically synthesized
tatcgtaattactgcggaag

SEQ ID NO: 455951 - DNA, 20 bp, Artificial Sequence
  chemically synthesized
ttttatcgtaattactgcgg

SEQ ID NO: 455952 - DNA, 20 bp, Artificial Sequence
  chemically synthesized
tttttttatcgtaattactg

SEQ ID NO: 455953 - DNA, 20 bp, Artificial Sequence
  chemically synthesized
aattacgataaaaaaaactg

SEQ ID NO: 455954 - DNA, 20 bp, Artificial Sequence
  chemically synthesized
aagacatttgacaatgtctg

SEQ ID NO: 455955 - DNA, 20 bp, Artificial Sequence
  chemically synthesized
attgtcaaatgtcttattca

SEQ ID NO: 455956 - DNA, 20 bp, Artificial Sequence
  chemically synthesized
gcatgagtttggccatgaat

SEQ ID NO: 455957 - DNA, 20 bp, Artificial Sequence
  chemically synthesized
ttctcaaccaggcatgagtt

SEQ ID NO: 455958 - DNA, 20 bp, Artificial Sequence
  chemically synthesized
ttcatggccaaactcatgcc

SEQ ID NO: 455959 - DNA, 20 bp, Artificial Sequence
  chemically synthesized
agtggttctcaaccaggcat

SEQ ID NO: 455960 - DNA, 20 bp, Artificial Sequence
  chemically synthesized
ggccaaactcatgcctggtt

SEQ ID NO: 455961 - DNA, 20 bp, Artificial Sequence
  chemically synthesized
tagataagtggttctcaacc

SEQ ID NO: 455962 - DNA, 20 bp, Artificial Sequence
  chemically synthesized
ttagataagtggttctcaac

SEQ ID NO: 455963 - DNA, 20 bp, Artificial Sequence
  chemically synthesized
aaaagagtgtattagataag

SEQ ID NO: 455964 - DNA, 20 bp, Artificial Sequence
  chemically synthesized
ctaaaaagagtgtattagat

SEQ ID NO: 455965 - DNA, 20 bp, Artificial Sequence
  chemically synthesized
agcagctaaaaagagtgtat

SEQ ID NO: 455966 - DNA, 20 bp, Artificial Sequence
  chemically synthesized
cttatctaatacactctttt

SEQ ID NO: 455967 - DNA, 20 bp, Artificial Sequence
  chemically synthesized
tactatcaagcagctaaaaa

SEQ ID NO: 455968 - DNA, 20 bp, Artificial Sequence
  chemically synthesized
aatactatcaagcagctaaa

SEQ ID NO: 455969 - DNA, 20 bp, Artificial Sequence
  chemically synthesized
cactctttttagctgcttga

SEQ ID NO: 455970 - DNA, 20 bp, Artificial Sequence
  chemically synthesized
tgtggtgaaatactatcaag

SEQ ID NO: 455971 - DNA, 20 bp, Artificial Sequence
  chemically synthesized
gcctgtggtgaaatactatc

SEQ ID NO: 455972 - DNA, 20 bp, Artificial Sequence
  chemically synthesized
tgcttgatagtatttcacca

SEQ ID NO: 455973 - DNA, 20 bp, Artificial Sequence
  chemically synthesized
gcttgatagtatttcaccac

SEQ ID NO: 455974 - DNA, 20 bp, Artificial Sequence
  chemically synthesized
ataaatatccttgatgcctg

SEQ ID NO: 455975 - DNA, 20 bp, Artificial Sequence
  chemically synthesized
agtatttcaccacaggcatc

SEQ ID NO: 455976 - DNA, 20 bp, Artificial Sequence
  chemically synthesized
gtatttcaccacaggcatca

SEQ ID NO: 455977 - DNA, 20 bp, Artificial Sequence
  chemically synthesized
caaggattttcattgttcaa

SEQ ID NO: 455978 - DNA, 20 bp, Artificial Sequence
  chemically synthesized
tcagctcaaaatcagttaca

SEQ ID NO: 455979 - DNA, 20 bp, Artificial Sequence
  chemically synthesized
ttcagctcaaaatcagttac

SEQ ID NO: 455980 - DNA, 20 bp, Artificial Sequence
  chemically synthesized
aaatccttgtaactgatttt

SEQ ID NO: 455981 - DNA, 20 bp, Artificial Sequence
  chemically synthesized
atcataattcagctcaaaat

SEQ ID NO: 455982 - DNA, 20 bp, Artificial Sequence
  chemically synthesized
ctagtatgggtatcataatt

SEQ ID NO: 455983 - DNA, 20 bp, Artificial Sequence
  chemically synthesized
ctgaattatgatacccatac

SEQ ID NO: 455984 - DNA, 20 bp, Artificial Sequence
  chemically synthesized
tcttcttaagcagctagtat

SEQ ID NO: 455985 - DNA, 20 bp, Artificial Sequence
  chemically synthesized
ttcttcttaagcagctagta

SEQ ID NO: 455986 - DNA, 20 bp, Artificial Sequence
  chemically synthesized
gatacccatactagctgctt

SEQ ID NO: 455987 - DNA, 20 bp, Artificial Sequence
  chemically synthesized
atttcttcttcttaagcagc

SEQ ID NO: 455988 - DNA, 20 bp, Artificial Sequence
  chemically synthesized
acccatactagctgcttaag

SEQ ID NO: 455989 - DNA, 20 bp, Artificial Sequence
  chemically synthesized
aggcatttcttcttcttaag

SEQ ID NO: 455990 - DNA, 20 bp, Artificial Sequence
  chemically synthesized
catactagctgcttaagaag

SEQ ID NO: 455991 - DNA, 20 bp, Artificial Sequence
  chemically synthesized
aaaaggcatttcttcttctt

SEQ ID NO: 455992 - DNA, 20 bp, Artificial Sequence
  chemically synthesized
ttttattgatgttgaagaaa

SEQ ID NO: 455993 - DNA, 20 bp, Artificial Sequence
  chemically synthesized
tttttattgatgttgaagaa

SEQ ID NO: 455994 - DNA, 20 bp, Artificial Sequence
  chemically synthesized
tttactttttattgatgttg

SEQ ID NO: 455995 - DNA, 20 bp, Artificial Sequence
  chemically synthesized
ttttcttcaacatcaataaa

SEQ ID NO: 455996 - DNA, 20 bp, Artificial Sequence
  chemically synthesized
ttcaacatcaataaaaagta

SEQ ID NO: 455997 - DNA, 20 bp, Artificial Sequence
  chemically synthesized
aagtaaagcataaaattata

SEQ ID NO: 455998 - DNA, 20 bp, Artificial Sequence
  chemically synthesized
taaaattatatagatctgaa

SEQ ID NO: 455999 - DNA, 20 bp, Artificial Sequence
  chemically synthesized
attatatagatctgaaaagt

SEQ ID NO: 456000 - DNA, 20 bp, Artificial Sequence
  chemically synthesized
ttatatagatctgaaaagta

SEQ ID NO: 456001 - DNA, 20 bp, Artificial Sequence
  chemically synthesized
tttaaccgttccttactttt

SEQ ID NO: 456002 - DNA, 20 bp, Artificial Sequence
  chemically synthesized
tagatctgaaaagtaaggaa

SEQ ID NO: 456003 - DNA, 20 bp, Artificial Sequence
  chemically synthesized
aaaagtaaggaacggttaaa

SEQ ID NO: 456004 - DNA, 20 bp, Artificial Sequence
  chemically synthesized
gtaaggaacggttaaaaaga

SEQ ID NO: 456005 - DNA, 20 bp, Artificial Sequence
  chemically synthesized
taaggaacggttaaaaagac

SEQ ID NO: 456006 - DNA, 20 bp, Artificial Sequence
  chemically synthesized
aggaacggttaaaaagacag

SEQ ID NO: 456007 - DNA, 20 bp, Artificial Sequence
  chemically synthesized
aacggttaaaaagacaggag

SEQ ID NO: 456008 - DNA, 20 bp, Artificial Sequence
  chemically synthesized
aaaaagacaggagtagaatg

SEQ ID NO: 456009 - DNA, 20 bp, Artificial Sequence
  chemically synthesized
aaagacaggagtagaatgta

SEQ ID NO: 456010 - DNA, 20 bp, Artificial Sequence
  chemically synthesized
aggagtagaatgtagagcac

SEQ ID NO: 456011 - DNA, 20 bp, Artificial Sequence
  chemically synthesized
ggagtagaatgtagagcact

SEQ ID NO: 456012 - DNA, 20 bp, Artificial Sequence
  chemically synthesized
tagaatgtagagcactaggc

SEQ ID NO: 456013 - DNA, 20 bp, Artificial Sequence
  chemically synthesized
cttctatttttgcactggcc

SEQ ID NO: 456014 - DNA, 20 bp, Artificial Sequence
  chemically synthesized
ttcagcttctatttttgcac

SEQ ID NO: 456015 - DNA, 20 bp, Artificial Sequence
  chemically synthesized
gcactaggccagtgcaaaaa

SEQ ID NO: 456016 - DNA, 20 bp, Artificial Sequence
  chemically synthesized
ctaggccagtgcaaaaatag

SEQ ID NO: 456017 - DNA, 20 bp, Artificial Sequence
  chemically synthesized
ttgtgtcccagtttagagtt

SEQ ID NO: 456018 - DNA, 20 bp, Artificial Sequence
  chemically synthesized
atagaagctgaactctaaac

SEQ ID NO: 456019 - DNA, 20 bp, Artificial Sequence
  chemically synthesized
tagaagctgaactctaaact

SEQ ID NO: 456020 - DNA, 20 bp, Artificial Sequence
  chemically synthesized
tgtgattgtgtcccagttta

SEQ ID NO: 456021 - DNA, 20 bp, Artificial Sequence
  chemically synthesized
ggtgtgattgtgtcccagtt

SEQ ID NO: 456022 - DNA, 20 bp, Artificial Sequence
  chemically synthesized
actaaggtgtgattgtgtcc

SEQ ID NO: 456023 - DNA, 20 bp, Artificial Sequence
  chemically synthesized
actgggacacaatcacacct

SEQ ID NO: 456024 - DNA, 20 bp, Artificial Sequence
  chemically synthesized
attacttaaattaacaacta

SEQ ID NO: 456025 - DNA, 20 bp, Artificial Sequence
  chemically synthesized
cattacttaaattaacaact

SEQ ID NO: 456026 - DNA, 20 bp, Artificial Sequence
  chemically synthesized
cacaccttagttgttaattt

SEQ ID NO: 456027 - DNA, 20 bp, Artificial Sequence
  chemically synthesized
ttagttgttaatttaagtaa

SEQ ID NO: 456028 - DNA, 20 bp, Artificial Sequence
  chemically synthesized
tttaagtaatggatgcttct

SEQ ID NO: 456029 - DNA, 20 bp, Artificial Sequence
  chemically synthesized
agtaatggatgcttctgagt

SEQ ID NO: 456030 - DNA, 20 bp, Artificial Sequence
  chemically synthesized
gtaatggatgcttctgagtt

SEQ ID NO: 456031 - DNA, 20 bp, Artificial Sequence
  chemically synthesized
agctaatattcctaactcag

SEQ ID NO: 456032 - DNA, 20 bp, Artificial Sequence
  chemically synthesized
gtgagctaatattcctaact

SEQ ID NO: 456033 - DNA, 20 bp, Artificial Sequence
  chemically synthesized
tgcttctgagttaggaatat

SEQ ID NO: 456034 - DNA, 20 bp, Artificial Sequence
  chemically synthesized
tgatggattgtggtgtgagt

SEQ ID NO: 456035 - DNA, 20 bp, Artificial Sequence
  chemically synthesized
ctgatgatggattgtggtgt

SEQ ID NO: 456036 - DNA, 20 bp, Artificial Sequence
  chemically synthesized
gattgcctgatgatggattg

SEQ ID NO: 456037 - DNA, 20 bp, Artificial Sequence
  chemically synthesized
ctcacaccacaatccatcat

SEQ ID NO: 456038 - DNA, 20 bp, Artificial Sequence
  chemically synthesized
tcacaccacaatccatcatc

SEQ ID NO: 456039 - DNA, 20 bp, Artificial Sequence
  chemically synthesized
cataaaggattgcctgatga

SEQ ID NO: 456040 - DNA, 20 bp, Artificial Sequence
  chemically synthesized
ggagaaggtaagaatcataa

SEQ ID NO: 456041 - DNA, 20 bp, Artificial Sequence
  chemically synthesized
tggagaaggtaagaatcata

SEQ ID NO: 456042 - DNA, 20 bp, Artificial Sequence
  chemically synthesized
ggaattgttttggagaaggt

SEQ ID NO: 456043 - DNA, 20 bp, Artificial Sequence
  chemically synthesized
ggtaggaattgttttggaga

SEQ ID NO: 456044 - DNA, 20 bp, Artificial Sequence
  chemically synthesized
tggtaggaattgttttggag

SEQ ID NO: 456045 - DNA, 20 bp, Artificial Sequence
  chemically synthesized
gaatggtaggaattgttttg

SEQ ID NO: 456046 - DNA, 20 bp, Artificial Sequence
  chemically synthesized
ttgaatggtaggaattgttt

SEQ ID NO: 456047 - DNA, 20 bp, Artificial Sequence
  chemically synthesized
ttgcagatgagttgaatggt

SEQ ID NO: 456048 - DNA, 20 bp, Artificial Sequence
  chemically synthesized
tttgcagatgagttgaatgg

SEQ ID NO: 456049 - DNA, 20 bp, Artificial Sequence
  chemically synthesized
ggctttgcagatgagttgaa

SEQ ID NO: 456050 - DNA, 20 bp, Artificial Sequence
  chemically synthesized
taccattcaactcatctgca

SEQ ID NO: 456051 - DNA, 20 bp, Artificial Sequence
  chemically synthesized
cactgacaggctttgcagat

SEQ ID NO: 456052 - DNA, 20 bp, Artificial Sequence
  chemically synthesized
gggagcactgacaggctttg

SEQ ID NO: 456053 - DNA, 20 bp, Artificial Sequence
  chemically synthesized
aactcatctgcaaagcctgt

SEQ ID NO: 456054 - DNA, 20 bp, Artificial Sequence
  chemically synthesized
tatttgcagggagcactgac

SEQ ID NO: 456055 - DNA, 20 bp, Artificial Sequence
  chemically synthesized
ttatttgcagggagcactga

SEQ ID NO: 456056 - DNA, 20 bp, Artificial Sequence
  chemically synthesized
catgaagtattatttgcagg

SEQ ID NO: 456057 - DNA, 20 bp, Artificial Sequence
  chemically synthesized
cacatgaagtattatttgca

SEQ ID NO: 456058 - DNA, 20 bp, Artificial Sequence
  chemically synthesized
tcacatgaagtattatttgc

SEQ ID NO: 456059 - DNA, 20 bp, Artificial Sequence
  chemically synthesized
ctcacatgaagtattatttg

SEQ ID NO: 456060 - DNA, 20 bp, Artificial Sequence
  chemically synthesized
ctgcaaataatacttcatgt

SEQ ID NO: 456061 - DNA, 20 bp, Artificial Sequence
  chemically synthesized
tgcaaataatacttcatgtg

SEQ ID NO: 456062 - DNA, 20 bp, Artificial Sequence
  chemically synthesized
aaagaaagtagcctcacatg

SEQ ID NO: 456063 - DNA, 20 bp, Artificial Sequence
  chemically synthesized
cacttatgaaggaaagaaag

SEQ ID NO: 456064 - DNA, 20 bp, Artificial Sequence
  chemically synthesized
tggcacttatgaaggaaaga

SEQ ID NO: 456065 - DNA, 20 bp, Artificial Sequence
  chemically synthesized
gtagtggcacttatgaagga

SEQ ID NO: 456066 - DNA, 20 bp, Artificial Sequence
  chemically synthesized
ggctactttctttccttcat

SEQ ID NO: 456067 - DNA, 20 bp, Artificial Sequence
  chemically synthesized
aagggtagtggcacttatga

SEQ ID NO: 456068 - DNA, 20 bp, Artificial Sequence
  chemically synthesized
caagggtagtggcacttatg

SEQ ID NO: 456069 - DNA, 20 bp, Artificial Sequence
  chemically synthesized
ggtggctttgacaagggtag

SEQ ID NO: 456070 - DNA, 20 bp, Artificial Sequence
  chemically synthesized
cggggtggctttgacaaggg

SEQ ID NO: 456071 - DNA, 20 bp, Artificial Sequence
  chemically synthesized
aagtgccactacccttgtca

SEQ ID NO: 456072 - DNA, 20 bp, Artificial Sequence
  chemically synthesized
ttgcggggtggctttgacaa

SEQ ID NO: 456073 - DNA, 20 bp, Artificial Sequence
  chemically synthesized
tttgcggggtggctttgaca

SEQ ID NO: 456074 - DNA, 20 bp, Artificial Sequence
  chemically synthesized
ttttgcggggtggctttgac

SEQ ID NO: 456075 - DNA, 20 bp, Artificial Sequence
  chemically synthesized
gctctttcacttttgcgggg

SEQ ID NO: 456076 - DNA, 20 bp, Artificial Sequence
  chemically synthesized
ttgtcaaagccaccccgcaa

SEQ ID NO: 456077 - DNA, 20 bp, Artificial Sequence
  chemically synthesized
gaggctctttcacttttgcg

SEQ ID NO: 456078 - DNA, 20 bp, Artificial Sequence
  chemically synthesized
ggaggctctttcacttttgc

SEQ ID NO: 456079 - DNA, 20 bp, Artificial Sequence
  chemically synthesized
aggaggctctttcacttttg

SEQ ID NO: 456080 - DNA, 20 bp, Artificial Sequence
  chemically synthesized
aagccaccccgcaaaagtga

SEQ ID NO: 456081 - DNA, 20 bp, Artificial Sequence
  chemically synthesized
gccaccccgcaaaagtgaaa

SEQ ID NO: 456082 - DNA, 20 bp, Artificial Sequence
  chemically synthesized
aaaagtgaaagagcctcctc

SEQ ID NO: 456083 - DNA, 20 bp, Artificial Sequence
  chemically synthesized
aaagtgaaagagcctcctcg

SEQ ID NO: 456084 - DNA, 20 bp, Artificial Sequence
  chemically synthesized
gaaagccattcacctcgagg

SEQ ID NO: 456085 - DNA, 20 bp, Artificial Sequence
  chemically synthesized
ggaaagccattcacctcgag

SEQ ID NO: 456086 - DNA, 20 bp, Artificial Sequence
  chemically synthesized
ctggaaagccattcacctcg

SEQ ID NO: 456087 - DNA, 20 bp, Artificial Sequence
  chemically synthesized
gctggaaagccattcacctc

SEQ ID NO: 456088 - DNA, 20 bp, Artificial Sequence
  chemically synthesized
aagagcctcctcgaggtgaa

SEQ ID NO: 456089 - DNA, 20 bp, Artificial Sequence
  chemically synthesized
cctcgaggtgaatggctttc

SEQ ID NO: 456090 - DNA, 20 bp, Artificial Sequence
  chemically synthesized
cagctttccagaaggctgga

SEQ ID NO: 456091 - DNA, 20 bp, Artificial Sequence
  chemically synthesized
tgaatggctttccagccttc

SEQ ID NO: 456092 - DNA, 20 bp, Artificial Sequence
  chemically synthesized
cagccagctttccagaaggc

SEQ ID NO: 456093 - DNA, 20 bp, Artificial Sequence
  chemically synthesized
tggctttccagccttctgga

SEQ ID NO: 456094 - DNA, 20 bp, Artificial Sequence
  chemically synthesized
ggctcagccagctttccaga

SEQ ID NO: 456095 - DNA, 20 bp, Artificial Sequence
  chemically synthesized
tggctcagccagctttccag

SEQ ID NO: 456096 - DNA, 20 bp, Artificial Sequence
  chemically synthesized
tttccagccttctggaaagc

SEQ ID NO: 456097 - DNA, 20 bp, Artificial Sequence
  chemically synthesized
cagtggctcagccagctttc

SEQ ID NO: 456098 - DNA, 20 bp, Artificial Sequence
  chemically synthesized
agccttctggaaagctggct

SEQ ID NO: 456099 - DNA, 20 bp, Artificial Sequence
  chemically synthesized
atcatcatcagtggctcagc

SEQ ID NO: 456100 - DNA, 20 bp, Artificial Sequence
  chemically synthesized
ccacatcatcatcagtggct

SEQ ID NO: 456101 - DNA, 20 bp, Artificial Sequence
  chemically synthesized
aaaggccacatcatcatcag

SEQ ID NO: 456102 - DNA, 20 bp, Artificial Sequence
  chemically synthesized
taaaaaggccacatcatcat

SEQ ID NO: 456103 - DNA, 20 bp, Artificial Sequence
  chemically synthesized
ctgagccactgatgatgatg

SEQ ID NO: 456104 - DNA, 20 bp, Artificial Sequence
  chemically synthesized
aaactaaacctagaataaaa

SEQ ID NO: 456105 - DNA, 20 bp, Artificial Sequence
  chemically synthesized
atgatgtggcctttttattc

SEQ ID NO: 456106 - DNA, 20 bp, Artificial Sequence
  chemically synthesized
taaactaaacctagaataaa

SEQ ID NO: 456107 - DNA, 20 bp, Artificial Sequence
  chemically synthesized
tgatgtggcctttttattct

SEQ ID NO: 456108 - DNA, 20 bp, Artificial Sequence
  chemically synthesized
tggcctttttattctaggtt

SEQ ID NO: 456109 - DNA, 20 bp, Artificial Sequence
  chemically synthesized
tataatccttaaactaaacc

SEQ ID NO: 456110 - DNA, 20 bp, Artificial Sequence
  chemically synthesized
ttttattctaggtttagttt

SEQ ID NO: 456111 - DNA, 20 bp, Artificial Sequence
  chemically synthesized
tttattctaggtttagttta

SEQ ID NO: 456112 - DNA, 20 bp, Artificial Sequence
  chemically synthesized
gtttaaggattataaaaaac

SEQ ID NO: 456113 - DNA, 20 bp, Artificial Sequence
  chemically synthesized
agaatatttatataaatatc

SEQ ID NO: 456114 - DNA, 20 bp, Artificial Sequence
  chemically synthesized
tatataaatattctcttgaa

SEQ ID NO: 456115 - DNA, 20 bp, Artificial Sequence
  chemically synthesized
atctatgtgcttccattcaa

SEQ ID NO: 456116 - DNA, 20 bp, Artificial Sequence
  chemically synthesized
ataaatattctcttgaatgg

SEQ ID NO: 456117 - DNA, 20 bp, Artificial Sequence
  chemically synthesized
tcatctatgtgcttccattc

SEQ ID NO: 456118 - DNA, 20 bp, Artificial Sequence
  chemically synthesized
ttctcttgaatggaagcaca

SEQ ID NO: 456119 - DNA, 20 bp, Artificial Sequence
  chemically synthesized
aatggaagcacatagatgat

SEQ ID NO: 456120 - DNA, 20 bp, Artificial Sequence
  chemically synthesized
gattagttcaaattctttcg

SEQ ID NO: 456121 - DNA, 20 bp, Artificial Sequence
  chemically synthesized
tagttcaaattctttcgaag

SEQ ID NO: 456122 - DNA, 20 bp, Artificial Sequence
  chemically synthesized
atattacatcaccacttcga

SEQ ID NO: 456123 - DNA, 20 bp, Artificial Sequence
  chemically synthesized
gaagtggtgatgtaatatcc

SEQ ID NO: 456124 - DNA, 20 bp, Artificial Sequence
  chemically synthesized
gatgtaatatcccagttgaa

SEQ ID NO: 456125 - DNA, 20 bp, Artificial Sequence
  chemically synthesized
ttaccttaccctgttcaact

SEQ ID NO: 456126 - DNA, 20 bp, Artificial Sequence
  chemically synthesized
atgtaatatcccagttgaac

SEQ ID NO: 456127 - DNA, 20 bp, Artificial Sequence
  chemically synthesized
tttaccttaccctgttcaac

SEQ ID NO: 456128 - DNA, 20 bp, Artificial Sequence
  chemically synthesized
tgtaatatcccagttgaaca

SEQ ID NO: 456129 - DNA, 20 bp, Artificial Sequence
  chemically synthesized
atatcccagttgaacagggt

SEQ ID NO: 456130 - DNA, 20 bp, Artificial Sequence
  chemically synthesized
tatcccagttgaacagggta

SEQ ID NO: 456131 - DNA, 20 bp, Artificial Sequence
  chemically synthesized
aacagggtaaggtaaaaata

SEQ ID NO: 456132 - DNA, 20 bp, Artificial Sequence
  chemically synthesized
gagatctgcctagttataga

SEQ ID NO: 456133 - DNA, 20 bp, Artificial Sequence
  chemically synthesized
aagattttactttctataac

SEQ ID NO: 456134 - DNA, 20 bp, Artificial Sequence
  chemically synthesized
agattttactttctataact

SEQ ID NO: 456135 - DNA, 20 bp, Artificial Sequence
  chemically synthesized
atgtgagatctgcctagtta

SEQ ID NO: 456136 - DNA, 20 bp, Artificial Sequence
  chemically synthesized
ttttactttctataactagg

SEQ ID NO: 456137 - DNA, 20 bp, Artificial Sequence
  chemically synthesized
ggcccaatgtgagatctgcc

SEQ ID NO: 456138 - DNA, 20 bp, Artificial Sequence
  chemically synthesized
taactaggcagatctcacat

SEQ ID NO: 456139 - DNA, 20 bp, Artificial Sequence
  chemically synthesized
aactaggcagatctcacatt

SEQ ID NO: 456140 - DNA, 20 bp, Artificial Sequence
  chemically synthesized
tgacactaaaggcccaatgt

SEQ ID NO: 456141 - DNA, 20 bp, Artificial Sequence
  chemically synthesized
cagatctcacattgggcctt

SEQ ID NO: 456142 - DNA, 20 bp, Artificial Sequence
  chemically synthesized
aatggcacccatgacactaa

SEQ ID NO: 456143 - DNA, 20 bp, Artificial Sequence
  chemically synthesized
gaatggcacccatgacacta

SEQ ID NO: 456144 - DNA, 20 bp, Artificial Sequence
  chemically synthesized
acattgggcctttagtgtca

SEQ ID NO: 456145 - DNA, 20 bp, Artificial Sequence
  chemically synthesized
cattgggcctttagtgtcat

SEQ ID NO: 456146 - DNA, 20 bp, Artificial Sequence
  chemically synthesized
tgtcatgggtgccattccac

SEQ ID NO: 456147 - DNA, 20 bp, Artificial Sequence
  chemically synthesized
gtcatgggtgccattccact

SEQ ID NO: 456148 - DNA, 20 bp, Artificial Sequence
  chemically synthesized
catcagatttcccagtggaa

SEQ ID NO: 456149 - DNA, 20 bp, Artificial Sequence
  chemically synthesized
cggtccatcagatttcccag

SEQ ID NO: 456150 - DNA, 20 bp, Artificial Sequence
  chemically synthesized
ccccggtccatcagatttcc

SEQ ID NO: 456151 - DNA, 20 bp, Artificial Sequence
  chemically synthesized
cattccactgggaaatctga

SEQ ID NO: 456152 - DNA, 20 bp, Artificial Sequence
  chemically synthesized
cactgggaaatctgatggac

SEQ ID NO: 456153 - DNA, 20 bp, Artificial Sequence
  chemically synthesized
actgggaaatctgatggacc

SEQ ID NO: 456154 - DNA, 20 bp, Artificial Sequence
  chemically synthesized
atatggcttccccggtccat

SEQ ID NO: 456155 - DNA, 20 bp, Artificial Sequence
  chemically synthesized
ctgggaaatctgatggaccg

SEQ ID NO: 456156 - DNA, 20 bp, Artificial Sequence
  chemically synthesized
ggaaatctgatggaccgggg

SEQ ID NO: 456157 - DNA, 20 bp, Artificial Sequence
  chemically synthesized
attcggaaatatggcttccc

SEQ ID NO: 456158 - DNA, 20 bp, Artificial Sequence
  chemically synthesized
agataacctattcggaaata

SEQ ID NO: 456159 - DNA, 20 bp, Artificial Sequence
  chemically synthesized
ggggaagccatatttccgaa

SEQ ID NO: 456160 - DNA, 20 bp, Artificial Sequence
  chemically synthesized
gggaagccatatttccgaat

SEQ ID NO: 456161 - DNA, 20 bp, Artificial Sequence
  chemically synthesized
ataggaacagataacctatt

SEQ ID NO: 456162 - DNA, 20 bp, Artificial Sequence
  chemically synthesized
gatgaccacataaataggaa

SEQ ID NO: 456163 - DNA, 20 bp, Artificial Sequence
  chemically synthesized
gttatctgttcctatttatg

SEQ ID NO: 456164 - DNA, 20 bp, Artificial Sequence
  chemically synthesized
aactggatgaccacataaat

SEQ ID NO: 456165 - DNA, 20 bp, Artificial Sequence
  chemically synthesized
aaactggatgaccacataaa

SEQ ID NO: 456166 - DNA, 20 bp, Artificial Sequence
  chemically synthesized
ttcctatttatgtggtcatc

SEQ ID NO: 456167 - DNA, 20 bp, Artificial Sequence
  chemically synthesized
agttaaaaaatttcaaaaac

SEQ ID NO: 456168 - DNA, 20 bp, Artificial Sequence
  chemically synthesized
gatgaagtttgcaattgatt

SEQ ID NO: 456169 - DNA, 20 bp, Artificial Sequence
  chemically synthesized
ctatacaataaggttagatg

SEQ ID NO: 456170 - DNA, 20 bp, Artificial Sequence
  chemically synthesized
gtttatctatacaataaggt

SEQ ID NO: 456171 - DNA, 20 bp, Artificial Sequence
  chemically synthesized
cttcatctaaccttattgta

SEQ ID NO: 456172 - DNA, 20 bp, Artificial Sequence
  chemically synthesized
ttgtgtttatctatacaata

SEQ ID NO: 456173 - DNA, 20 bp, Artificial Sequence
  chemically synthesized
attgtgtttatctatacaat

SEQ ID NO: 456174 - DNA, 20 bp, Artificial Sequence
  chemically synthesized
tagataaacacaatttactt

SEQ ID NO: 456175 - DNA, 20 bp, Artificial Sequence
  chemically synthesized
tgttgggtacaggttggccg

SEQ ID NO: 456176 - DNA, 20 bp, Artificial Sequence
  chemically synthesized
gttttatgttgggtacaggt

SEQ ID NO: 456177 - DNA, 20 bp, Artificial Sequence
  chemically synthesized
cagagttttatgttgggtac

SEQ ID NO: 456178 - DNA, 20 bp, Artificial Sequence
  chemically synthesized
acagagttttatgttgggta

SEQ ID NO: 456179 - DNA, 20 bp, Artificial Sequence
  chemically synthesized
gagatacagagttttatgtt

SEQ ID NO: 456180 - DNA, 20 bp, Artificial Sequence
  chemically synthesized
ggagatacagagttttatgt

SEQ ID NO: 456181 - DNA, 20 bp, Artificial Sequence
  chemically synthesized
gcaagatctcaggagataca

SEQ ID NO: 456182 - DNA, 20 bp, Artificial Sequence
  chemically synthesized
gggcaagatctcaggagata

SEQ ID NO: 456183 - DNA, 20 bp, Artificial Sequence
  chemically synthesized
cataaaactctgtatctcct

SEQ ID NO: 456184 - DNA, 20 bp, Artificial Sequence
  chemically synthesized
tagagagggcaagatctcag

SEQ ID NO: 456185 - DNA, 20 bp, Artificial Sequence
  chemically synthesized
tatagagagggcaagatctc

SEQ ID NO: 456186 - DNA, 20 bp, Artificial Sequence
  chemically synthesized
atatagagagggcaagatct

SEQ ID NO: 456187 - DNA, 20 bp, Artificial Sequence
  chemically synthesized
gagaagaatatagagagggc

SEQ ID NO: 456188 - DNA, 20 bp, Artificial Sequence
  chemically synthesized
cagtgagaagaatatagaga

SEQ ID NO: 456189 - DNA, 20 bp, Artificial Sequence
  chemically synthesized
gcagtgagaagaatatagag

SEQ ID NO: 456190 - DNA, 20 bp, Artificial Sequence
  chemically synthesized
tgcagtgagaagaatataga

SEQ ID NO: 456191 - DNA, 20 bp, Artificial Sequence
  chemically synthesized
tttgcagtgagaagaatata

SEQ ID NO: 456192 - DNA, 20 bp, Artificial Sequence
  chemically synthesized
tgtttgcagtgagaagaata

SEQ ID NO: 456193 - DNA, 20 bp, Artificial Sequence
  chemically synthesized
ctgatgctgtttgcagtgag

SEQ ID NO: 456194 - DNA, 20 bp, Artificial Sequence
  chemically synthesized
actctgatgctgtttgcagt

SEQ ID NO: 456195 - DNA, 20 bp, Artificial Sequence
  chemically synthesized
tatattcttctcactgcaaa

SEQ ID NO: 456196 - DNA, 20 bp, Artificial Sequence
  chemically synthesized
cattactctgatgctgtttg

SEQ ID NO: 456197 - DNA, 20 bp, Artificial Sequence
  chemically synthesized
cttctcactgcaaacagcat

SEQ ID NO: 456198 - DNA, 20 bp, Artificial Sequence
  chemically synthesized
tctcactgcaaacagcatca

SEQ ID NO: 456199 - DNA, 20 bp, Artificial Sequence
  chemically synthesized
acagcatcagagtaatgccc

SEQ ID NO: 456200 - DNA, 20 bp, Artificial Sequence
  chemically synthesized
tcacaatgggatgtacactt

SEQ ID NO: 456201 - DNA, 20 bp, Artificial Sequence
  chemically synthesized
gtcacaatgggatgtacact

SEQ ID NO: 456202 - DNA, 20 bp, Artificial Sequence
  chemically synthesized
atttgaggggatgtcacaat

SEQ ID NO: 456203 - DNA, 20 bp, Artificial Sequence
  chemically synthesized
aatttgaggggatgtcacaa

SEQ ID NO: 456204 - DNA, 20 bp, Artificial Sequence
  chemically synthesized
aggccattgaacaatttgag

SEQ ID NO: 456205 - DNA, 20 bp, Artificial Sequence
  chemically synthesized
gaggccattgaacaatttga

SEQ ID NO: 456206 - DNA, 20 bp, Artificial Sequence
  chemically synthesized
ggaggccattgaacaatttg

SEQ ID NO: 456207 - DNA, 20 bp, Artificial Sequence
  chemically synthesized
aggaggccattgaacaattt

SEQ ID NO: 456208 - DNA, 20 bp, Artificial Sequence
  chemically synthesized
catcccctcaaattgttcaa

SEQ ID NO: 456209 - DNA, 20 bp, Artificial Sequence
  chemically synthesized
ttcatcctaaggtcaatagg

SEQ ID NO: 456210 - DNA, 20 bp, Artificial Sequence
  chemically synthesized
cttcatcctaaggtcaatag

SEQ ID NO: 456211 - DNA, 20 bp, Artificial Sequence
  chemically synthesized
aacttcatcctaaggtcaat

SEQ ID NO: 456212 - DNA, 20 bp, Artificial Sequence
  chemically synthesized
caatggcctcctattgacct

SEQ ID NO: 456213 - DNA, 20 bp, Artificial Sequence
  chemically synthesized
taacttcatcctaaggtcaa

SEQ ID NO: 456214 - DNA, 20 bp, Artificial Sequence
  chemically synthesized
aatggcctcctattgacctt

SEQ ID NO: 456215 - DNA, 20 bp, Artificial Sequence
  chemically synthesized
ctcctattgaccttaggatg

SEQ ID NO: 456216 - DNA, 20 bp, Artificial Sequence
  chemically synthesized
agtgttttaacttcatccta

SEQ ID NO: 456217 - DNA, 20 bp, Artificial Sequence
  chemically synthesized
gagtgttttaacttcatcct

SEQ ID NO: 456218 - DNA, 20 bp, Artificial Sequence
  chemically synthesized
aggatgaagttaaaacactc

SEQ ID NO: 456219 - DNA, 20 bp, Artificial Sequence
  chemically synthesized
acgggacacctgtgaatcta

SEQ ID NO: 456220 - DNA, 20 bp, Artificial Sequence
  chemically synthesized
gttaaaacactctagattca

SEQ ID NO: 456221 - DNA, 20 bp, Artificial Sequence
  chemically synthesized
ttaaaacactctagattcac

SEQ ID NO: 456222 - DNA, 20 bp, Artificial Sequence
  chemically synthesized
tgacgggacacctgtgaatc

SEQ ID NO: 456223 - DNA, 20 bp, Artificial Sequence
  chemically synthesized
atgaggcaggaaagtttgac

SEQ ID NO: 456224 - DNA, 20 bp, Artificial Sequence
  chemically synthesized
aatgaggcaggaaagtttga

SEQ ID NO: 456225 - DNA, 20 bp, Artificial Sequence
  chemically synthesized
agccatgaaatgaggcagga

SEQ ID NO: 456226 - DNA, 20 bp, Artificial Sequence
  chemically synthesized
gtggagccatgaaatgaggc

SEQ ID NO: 456227 - DNA, 20 bp, Artificial Sequence
  chemically synthesized
tgtggagccatgaaatgagg

SEQ ID NO: 456228 - DNA, 20 bp, Artificial Sequence
  chemically synthesized
aactttcctgcctcatttca

SEQ ID NO: 456229 - DNA, 20 bp, Artificial Sequence
  chemically synthesized
atctgtggagccatgaaatg

SEQ ID NO: 456230 - DNA, 20 bp, Artificial Sequence
  chemically synthesized
catctgtggagccatgaaat

SEQ ID NO: 456231 - DNA, 20 bp, Artificial Sequence
  chemically synthesized
tgcctcatttcatggctcca

SEQ ID NO: 456232 - DNA, 20 bp, Artificial Sequence
  chemically synthesized
gatagaggccagcatctgtg

SEQ ID NO: 456233 - DNA, 20 bp, Artificial Sequence
  chemically synthesized
tttcatggctccacagatgc

SEQ ID NO: 456234 - DNA, 20 bp, Artificial Sequence
  chemically synthesized
atgatagaggccagcatctg

SEQ ID NO: 456235 - DNA, 20 bp, Artificial Sequence
  chemically synthesized
cttagggaaatgatagaggc

SEQ ID NO: 456236 - DNA, 20 bp, Artificial Sequence
  chemically synthesized
cgaacttagggaaatgatag

SEQ ID NO: 456237 - DNA, 20 bp, Artificial Sequence
  chemically synthesized
gcgaacttagggaaatgata

SEQ ID NO: 456238 - DNA, 20 bp, Artificial Sequence
  chemically synthesized
tagcgaacttagggaaatga

SEQ ID NO: 456239 - DNA, 20 bp, Artificial Sequence
  chemically synthesized
ctggcctctatcatttccct

SEQ ID NO: 456240 - DNA, 20 bp, Artificial Sequence
  chemically synthesized
tcgaagaattagcgaactta

SEQ ID NO: 456241 - DNA, 20 bp, Artificial Sequence
  chemically synthesized
ttcgaagaattagcgaactt

SEQ ID NO: 456242 - DNA, 20 bp, Artificial Sequence
  chemically synthesized
cttcgaagaattagcgaact

SEQ ID NO: 456243 - DNA, 20 bp, Artificial Sequence
  chemically synthesized
gctcttaagcttcgaagaat

SEQ ID NO: 456244 - DNA, 20 bp, Artificial Sequence
  chemically synthesized
ctaagttcgctaattcttcg

SEQ ID NO: 456245 - DNA, 20 bp, Artificial Sequence
  chemically synthesized
acaatggctcttaagcttcg

SEQ ID NO: 456246 - DNA, 20 bp, Artificial Sequence
  chemically synthesized
tcgctaattcttcgaagctt

SEQ ID NO: 456247 - DNA, 20 bp, Artificial Sequence
  chemically synthesized
gctaattcttcgaagcttaa

SEQ ID NO: 456248 - DNA, 20 bp, Artificial Sequence
  chemically synthesized
taacatgtacaatggctctt

SEQ ID NO: 456249 - DNA, 20 bp, Artificial Sequence
  chemically synthesized
cagagaaataacatgtacaa

SEQ ID NO: 456250 - DNA, 20 bp, Artificial Sequence
  chemically synthesized
aggggaagacattcagtaca

SEQ ID NO: 456251 - DNA, 20 bp, Artificial Sequence
  chemically synthesized
gaaggggaagacattcagta

SEQ ID NO: 456252 - DNA, 20 bp, Artificial Sequence
  chemically synthesized
agagagaaggggaagacatt

SEQ ID NO: 456253 - DNA, 20 bp, Artificial Sequence
  chemically synthesized
ttggagggagagagaagggg

SEQ ID NO: 456254 - DNA, 20 bp, Artificial Sequence
  chemically synthesized
aaattggagggagagagaag

SEQ ID NO: 456255 - DNA, 20 bp, Artificial Sequence
  chemically synthesized
aaaattggagggagagagaa

SEQ ID NO: 456256 - DNA, 20 bp, Artificial Sequence
  chemically synthesized
aaaaattggagggagagaga

SEQ ID NO: 456257 - DNA, 20 bp, Artificial Sequence
  chemically synthesized
taaaaattggagggagagag

SEQ ID NO: 456258 - DNA, 20 bp, Artificial Sequence
  chemically synthesized
ctataaaaattggagggaga

SEQ ID NO: 456259 - DNA, 20 bp, Artificial Sequence
  chemically synthesized
aactataaaaattggaggga

SEQ ID NO: 456260 - DNA, 20 bp, Artificial Sequence
  chemically synthesized
tgaactataaaaattggagg

SEQ ID NO: 456261 - DNA, 20 bp, Artificial Sequence
  chemically synthesized
tctgaactataaaaattgga

SEQ ID NO: 456262 - DNA, 20 bp, Artificial Sequence
  chemically synthesized
ctctgaactataaaaattgg

SEQ ID NO: 456263 - DNA, 20 bp, Artificial Sequence
  chemically synthesized
cctctgaactataaaaattg

SEQ ID NO: 456264 - DNA, 20 bp, Artificial Sequence
  chemically synthesized
ctctctccctccaattttta

SEQ ID NO: 456265 - DNA, 20 bp, Artificial Sequence
  chemically synthesized
atcctctgaactataaaaat

SEQ ID NO: 456266 - DNA, 20 bp, Artificial Sequence
  chemically synthesized
tccctccaatttttatagtt

SEQ ID NO: 456267 - DNA, 20 bp, Artificial Sequence
  chemically synthesized
cctccaatttttatagttca

SEQ ID NO: 456268 - DNA, 20 bp, Artificial Sequence
  chemically synthesized
ctccaatttttatagttcag

SEQ ID NO: 456269 - DNA, 20 bp, Artificial Sequence
  chemically synthesized
ttttatagttcagaggatct

SEQ ID NO: 456270 - DNA, 20 bp, Artificial Sequence
  chemically synthesized
ggaaaggtgatatttacgct

SEQ ID NO: 456271 - DNA, 20 bp, Artificial Sequence
  chemically synthesized
cagcgtaaatatcacctttc

SEQ ID NO: 456272 - DNA, 20 bp, Artificial Sequence
  chemically synthesized
gtaaatatcacctttccaga

SEQ ID NO: 456273 - DNA, 20 bp, Artificial Sequence
  chemically synthesized
ttctaatgacctttctggaa

SEQ ID NO: 456274 - DNA, 20 bp, Artificial Sequence
  chemically synthesized
taaatatcacctttccagaa

SEQ ID NO: 456275 - DNA, 20 bp, Artificial Sequence
  chemically synthesized
gttctaatgacctttctgga

SEQ ID NO: 456276 - DNA, 20 bp, Artificial Sequence
  chemically synthesized
taatgttctaatgacctttc

SEQ ID NO: 456277 - DNA, 20 bp, Artificial Sequence
  chemically synthesized
cacctttccagaaaggtcat

SEQ ID NO: 456278 - DNA, 20 bp, Artificial Sequence
  chemically synthesized
agaaaggtcattagaacatt

SEQ ID NO: 456279 - DNA, 20 bp, Artificial Sequence
  chemically synthesized
gaaaggtcattagaacatta

SEQ ID NO: 456280 - DNA, 20 bp, Artificial Sequence
  chemically synthesized
gaacattaaggattgtaacc

SEQ ID NO: 456281 - DNA, 20 bp, Artificial Sequence
  chemically synthesized
acattaaggattgtaaccaa

SEQ ID NO: 456282 - DNA, 20 bp, Artificial Sequence
  chemically synthesized
aaccaacagctattgtctct

SEQ ID NO: 456283 - DNA, 20 bp, Artificial Sequence
  chemically synthesized
ggattgtaaccaagagacaa

SEQ ID NO: 456284 - DNA, 20 bp, Artificial Sequence
  chemically synthesized
aaccaagagacaatagctgt

SEQ ID NO: 456285 - DNA, 20 bp, Artificial Sequence
  chemically synthesized
agaataaaaaataaaaccaa

SEQ ID NO: 456286 - DNA, 20 bp, Artificial Sequence
  chemically synthesized
ggttttattttttattcttg

SEQ ID NO: 456287 - DNA, 20 bp, Artificial Sequence
  chemically synthesized
agttagttggcatatgccac

SEQ ID NO: 456288 - DNA, 20 bp, Artificial Sequence
  chemically synthesized
taggcactgtgcaagttagt

SEQ ID NO: 456289 - DNA, 20 bp, Artificial Sequence
  chemically synthesized
catatgccaactaacttgca

SEQ ID NO: 456290 - DNA, 20 bp, Artificial Sequence
  chemically synthesized
actttaggcactgtgcaagt

SEQ ID NO: 456291 - DNA, 20 bp, Artificial Sequence
  chemically synthesized
ttcgactttaggcactgtgc

SEQ ID NO: 456292 - DNA, 20 bp, Artificial Sequence
  chemically synthesized
actaacttgcacagtgccta

SEQ ID NO: 456293 - DNA, 20 bp, Artificial Sequence
  chemically synthesized
actgagcccttttcgacttt

SEQ ID NO: 456294 - DNA, 20 bp, Artificial Sequence
  chemically synthesized
aactgagcccttttcgactt

SEQ ID NO: 456295 - DNA, 20 bp, Artificial Sequence
  chemically synthesized
gcacagtgcctaaagtcgaa

SEQ ID NO: 456296 - DNA, 20 bp, Artificial Sequence
  chemically synthesized
cacagtgcctaaagtcgaaa

SEQ ID NO: 456297 - DNA, 20 bp, Artificial Sequence
  chemically synthesized
acagtgcctaaagtcgaaaa

SEQ ID NO: 456298 - DNA, 20 bp, Artificial Sequence
  chemically synthesized
gcctaaagtcgaaaagggct

SEQ ID NO: 456299 - DNA, 20 bp, Artificial Sequence
  chemically synthesized
tgcttgtgtctatagtaact

SEQ ID NO: 456300 - DNA, 20 bp, Artificial Sequence
  chemically synthesized
cgaaaagggctcagttacta

SEQ ID NO: 456301 - DNA, 20 bp, Artificial Sequence
  chemically synthesized
ggctcagttactatagacac

SEQ ID NO: 456302 - DNA, 20 bp, Artificial Sequence
  chemically synthesized
gtcatatttgcttgtgtcta

SEQ ID NO: 456303 - DNA, 20 bp, Artificial Sequence
  chemically synthesized
gacacaagcaaatatgacct

SEQ ID NO: 456304 - DNA, 20 bp, Artificial Sequence
  chemically synthesized
tgtaattttgttggtagctc

SEQ ID NO: 456305 - DNA, 20 bp, Artificial Sequence
  chemically synthesized
atgtaattttgttggtagct

SEQ ID NO: 456306 - DNA, 20 bp, Artificial Sequence
  chemically synthesized
ttcggatgtaattttgttgg

SEQ ID NO: 456307 - DNA, 20 bp, Artificial Sequence
  chemically synthesized
gtcttcggatgtaattttgt

SEQ ID NO: 456308 - DNA, 20 bp, Artificial Sequence
  chemically synthesized
taccaacaaaattacatccg

SEQ ID NO: 456309 - DNA, 20 bp, Artificial Sequence
  chemically synthesized
aaaattacatccgaagacaa

SEQ ID NO: 456310 - DNA, 20 bp, Artificial Sequence
  chemically synthesized
tctcgtcttcctgttgtctt

SEQ ID NO: 456311 - DNA, 20 bp, Artificial Sequence
  chemically synthesized
aaattacatccgaagacaac

SEQ ID NO: 456312 - DNA, 20 bp, Artificial Sequence
  chemically synthesized
ttacatccgaagacaacagg

SEQ ID NO: 456313 - DNA, 20 bp, Artificial Sequence
  chemically synthesized
tccgaagacaacaggaagac

SEQ ID NO: 456314 - DNA, 20 bp, Artificial Sequence
  chemically synthesized
caacaggaagacgagactgt

SEQ ID NO: 456315 - DNA, 20 bp, Artificial Sequence
  chemically synthesized
aacaggaagacgagactgtg

SEQ ID NO: 456316 - DNA, 20 bp, Artificial Sequence
  chemically synthesized
ctataaacttggaaacctca

SEQ ID NO: 456317 - DNA, 20 bp, Artificial Sequence
  chemically synthesized
gacgagactgtgaggtttcc

SEQ ID NO: 456318 - DNA, 20 bp, Artificial Sequence
  chemically synthesized
ctgtgaggtttccaagttta

SEQ ID NO: 456319 - DNA, 20 bp, Artificial Sequence
  chemically synthesized
tctgaccttgtctataaact

SEQ ID NO: 456320 - DNA, 20 bp, Artificial Sequence
  chemically synthesized
aggtttccaagtttatagac

SEQ ID NO: 456321 - DNA, 20 bp, Artificial Sequence
  chemically synthesized
ggtttccaagtttatagaca

SEQ ID NO: 456322 - DNA, 20 bp, Artificial Sequence
  chemically synthesized
tccaagtttatagacaaggt

SEQ ID NO: 456323 - DNA, 20 bp, Artificial Sequence
  chemically synthesized
gtttatagacaaggtcagac

SEQ ID NO: 456324 - DNA, 20 bp, Artificial Sequence
  chemically synthesized
tttatagacaaggtcagaca

SEQ ID NO: 456325 - DNA, 20 bp, Artificial Sequence
  chemically synthesized
atagacaaggtcagacaagg

SEQ ID NO: 456326 - DNA, 20 bp, Artificial Sequence
  chemically synthesized
aggtcagacaaggaagtcat

SEQ ID NO: 456327 - DNA, 20 bp, Artificial Sequence
  chemically synthesized
ggtcagacaaggaagtcatt

SEQ ID NO: 456328 - DNA, 20 bp, Artificial Sequence
  chemically synthesized
tgttcaaaattgacagagac

SEQ ID NO: 456329 - DNA, 20 bp, Artificial Sequence
  chemically synthesized
tttgttgttcaaaattgaca

SEQ ID NO: 456330 - DNA, 20 bp, Artificial Sequence
  chemically synthesized
actttgttgttcaaaattga

SEQ ID NO: 456331 - DNA, 20 bp, Artificial Sequence
  chemically synthesized
tctgtcaattttgaacaaca

SEQ ID NO: 456332 - DNA, 20 bp, Artificial Sequence
  chemically synthesized
tatattttgttgttgcaaga

SEQ ID NO: 456333 - DNA, 20 bp, Artificial Sequence
  chemically synthesized
aaactatattttgttgttgc

SEQ ID NO: 456334 - DNA, 20 bp, Artificial Sequence
  chemically synthesized
tatcttgcaacaacaaaata

SEQ ID NO: 456335 - DNA, 20 bp, Artificial Sequence
  chemically synthesized
aattaaaaaaatcttcattt

SEQ ID NO: 456336 - DNA, 20 bp, Artificial Sequence
  chemically synthesized
ctgcagcaatttcttaaatg

SEQ ID NO: 456337 - DNA, 20 bp, Artificial Sequence
  chemically synthesized
cttcatttaagaaattgctg

SEQ ID NO: 456338 - DNA, 20 bp, Artificial Sequence
  chemically synthesized
ttcatttaagaaattgctgc

SEQ ID NO: 456339 - DNA, 20 bp, Artificial Sequence
  chemically synthesized
aattcaaagttattttcctg

SEQ ID NO: 456340 - DNA, 20 bp, Artificial Sequence
  chemically synthesized
ttctttatacttgcaattca

SEQ ID NO: 456341 - DNA, 20 bp, Artificial Sequence
  chemically synthesized
ggaaaataactttgaattgc

SEQ ID NO: 456342 - DNA, 20 bp, Artificial Sequence
  chemically synthesized
aactttgaattgcaagtata

SEQ ID NO: 456343 - DNA, 20 bp, Artificial Sequence
  chemically synthesized
aagtataaagaaaattttct

SEQ ID NO: 456344 - DNA, 20 bp, Artificial Sequence
  chemically synthesized
aaagaaaattttctgagccc

SEQ ID NO: 456345 - DNA, 20 bp, Artificial Sequence
  chemically synthesized
aaaaaagagcatctagggct

SEQ ID NO: 456346 - DNA, 20 bp, Artificial Sequence
  chemically synthesized
aaggaaaaaaagagcatcta

SEQ ID NO: 456347 - DNA, 20 bp, Artificial Sequence
  chemically synthesized
aaaggaaaaaaagagcatct

SEQ ID NO: 456348 - DNA, 20 bp, Artificial Sequence
  chemically synthesized
caaaggaaaaaaagagcatc

SEQ ID NO: 456349 - DNA, 20 bp, Artificial Sequence
  chemically synthesized
tggttttcaaaggaaaaaaa

SEQ ID NO: 456350 - DNA, 20 bp, Artificial Sequence
  chemically synthesized
aatggttttcaaaggaaaaa

SEQ ID NO: 456351 - DNA, 20 bp, Artificial Sequence
  chemically synthesized
ttgaaaataatggttttcaa

SEQ ID NO: 456352 - DNA, 20 bp, Artificial Sequence
  chemically synthesized
tttgaaaataatggttttca

SEQ ID NO: 456353 - DNA, 20 bp, Artificial Sequence
  chemically synthesized
acaatttcctttgaaaataa

SEQ ID NO: 456354 - DNA, 20 bp, Artificial Sequence
  chemically synthesized
tttgaaaaccattattttca

SEQ ID NO: 456355 - DNA, 20 bp, Artificial Sequence
  chemically synthesized
ttgaaaaccattattttcaa

SEQ ID NO: 456356 - DNA, 20 bp, Artificial Sequence
  chemically synthesized
aaaacataattttttaaaat

SEQ ID NO: 456357 - DNA, 20 bp, Artificial Sequence
  chemically synthesized
aaacataattttttaaaata

SEQ ID NO: 456358 - DNA, 20 bp, Artificial Sequence
  chemically synthesized
aaggtgtaaacgctcattca

SEQ ID NO: 456359 - DNA, 20 bp, Artificial Sequence
  chemically synthesized
cttagggctcttctgtgaat

SEQ ID NO: 456360 - DNA, 20 bp, Artificial Sequence
  chemically synthesized
gtgtaaacgctcattcacag

SEQ ID NO: 456361 - DNA, 20 bp, Artificial Sequence
  chemically synthesized
gtaaacgctcattcacagaa

SEQ ID NO: 456362 - DNA, 20 bp, Artificial Sequence
  chemically synthesized
ctcattcacagaagagccct

SEQ ID NO: 456363 - DNA, 20 bp, Artificial Sequence
  chemically synthesized
ctttattgtagcatgactta

SEQ ID NO: 456364 - DNA, 20 bp, Artificial Sequence
  chemically synthesized
tctttattgtagcatgactt

SEQ ID NO: 456365 - DNA, 20 bp, Artificial Sequence
  chemically synthesized
atctttattgtagcatgact

SEQ ID NO: 456366 - DNA, 20 bp, Artificial Sequence
  chemically synthesized
ccctaagtcatgctacaata

SEQ ID NO: 456367 - DNA, 20 bp, Artificial Sequence
  chemically synthesized
ttctacttacatctttattg

SEQ ID NO: 456368 - DNA, 20 bp, Artificial Sequence
  chemically synthesized
tcatgctacaataaagatgt

SEQ ID NO: 456369 - DNA, 20 bp, Artificial Sequence
  chemically synthesized
tgctacaataaagatgtaag

SEQ ID NO: 456370 - DNA, 20 bp, Artificial Sequence
  chemically synthesized
ataaagatgtaagtagaata

SEQ ID NO: 456371 - DNA, 20 bp, Artificial Sequence
  chemically synthesized
taaagatgtaagtagaatat

SEQ ID NO: 456372 - DNA, 20 bp, Artificial Sequence
  chemically synthesized
gtaagtagaatatgggattt

SEQ ID NO: 456373 - DNA, 20 bp, Artificial Sequence
  chemically synthesized
ttgagtcattttttcaatcc

SEQ ID NO: 456374 - DNA, 20 bp, Artificial Sequence
  chemically synthesized
tgagtcattttttcaatcca

SEQ ID NO: 456375 - DNA, 20 bp, Artificial Sequence
  chemically synthesized
ttttgttctgaaattttcct

SEQ ID NO: 456376 - DNA, 20 bp, Artificial Sequence
  chemically synthesized
tttcaatccaaggaaaattt

SEQ ID NO: 456377 - DNA, 20 bp, Artificial Sequence
  chemically synthesized
atttcagaacaaaatatttt

SEQ ID NO: 456378 - DNA, 20 bp, Artificial Sequence
  chemically synthesized
ttcagaacaaaatatttttg

SEQ ID NO: 456379 - DNA, 20 bp, Artificial Sequence
  chemically synthesized
tcagaacaaaatatttttgg

SEQ ID NO: 456380 - DNA, 20 bp, Artificial Sequence
  chemically synthesized
gtgtgaaactaaacaaatat

SEQ ID NO: 456381 - DNA, 20 bp, Artificial Sequence
  chemically synthesized
ggaggtgtccaatatttgtt

SEQ ID NO: 456382 - DNA, 20 bp, Artificial Sequence
  chemically synthesized
aatatttgtttagtttcaca

SEQ ID NO: 456383 - DNA, 20 bp, Artificial Sequence
  chemically synthesized
tttgtttagtttcacacaga

SEQ ID NO: 456384 - DNA, 20 bp, Artificial Sequence
  chemically synthesized
taaaatatattgaatgtaaa

SEQ ID NO: 456385 - DNA, 20 bp, Artificial Sequence
  chemically synthesized
aatcttatagaacatgtgta

SEQ ID NO: 456386 - DNA, 20 bp, Artificial Sequence
  chemically synthesized
aaactgtacacatgttctat

SEQ ID NO: 456387 - DNA, 20 bp, Artificial Sequence
  chemically synthesized
aattggtattgataatctta

SEQ ID NO: 456388 - DNA, 20 bp, Artificial Sequence
  chemically synthesized
tttttgaaaaatgagtaaat

SEQ ID NO: 456389 - DNA, 20 bp, Artificial Sequence
  chemically synthesized
aaaaatagtttttgaaaaat

SEQ ID NO: 456390 - DNA, 20 bp, Artificial Sequence
  chemically synthesized
tttttcaaaaactatttttt

SEQ ID NO: 456391 - DNA, 20 bp, Artificial Sequence
  chemically synthesized
tcaaacaaacacttaaaaaa

SEQ ID NO: 456392 - DNA, 20 bp, Artificial Sequence
  chemically synthesized
ttaagtgtttgtttgacaat

SEQ ID NO: 456393 - DNA, 20 bp, Artificial Sequence
  chemically synthesized
tgacaataagaaaattcttt

SEQ ID NO: 456394 - DNA, 20 bp, Artificial Sequence
  chemically synthesized
gacaataagaaaattctttt

SEQ ID NO: 456395 - DNA, 20 bp, Artificial Sequence
  chemically synthesized
aataagaaaattcttttagg

SEQ ID NO: 456396 - DNA, 20 bp, Artificial Sequence
  chemically synthesized
ttccttgaaacaccacctaa

SEQ ID NO: 456397 - DNA, 20 bp, Artificial Sequence
  chemically synthesized
attcttttaggtggtgtttc

SEQ ID NO: 456398 - DNA, 20 bp, Artificial Sequence
  chemically synthesized
ttcttttaggtggtgtttca

SEQ ID NO: 456399 - DNA, 20 bp, Artificial Sequence
  chemically synthesized
ttttaggtggtgtttcaagg

SEQ ID NO: 456400 - DNA, 20 bp, Artificial Sequence
  chemically synthesized
tttaggtggtgtttcaagga

SEQ ID NO: 456401 - DNA, 20 bp, Artificial Sequence
  chemically synthesized
tagaattatgttaaaatgtg

SEQ ID NO: 456402 - DNA, 20 bp, Artificial Sequence
  chemically synthesized
acacattttaacataattct

SEQ ID NO: 456403 - DNA, 20 bp, Artificial Sequence
  chemically synthesized
ttttaacataattctaagtt

SEQ ID NO: 456404 - DNA, 20 bp, Artificial Sequence
  chemically synthesized
tttaacataattctaagttg

SEQ ID NO: 456405 - DNA, 20 bp, Artificial Sequence
  chemically synthesized
attatgaattcacctcaact

SEQ ID NO: 456406 - DNA, 20 bp, Artificial Sequence
  chemically synthesized
ttgaggtgaattcataatat

SEQ ID NO: 456407 - DNA, 20 bp, Artificial Sequence
  chemically synthesized
cattttgatatctgtcaaca

SEQ ID NO: 456408 - DNA, 20 bp, Artificial Sequence
  chemically synthesized
aagtaaagagtctttgttga

SEQ ID NO: 456409 - DNA, 20 bp, Artificial Sequence
  chemically synthesized
atgactgttcttcaagtaaa

SEQ ID NO: 456410 - DNA, 20 bp, Artificial Sequence
  chemically synthesized
caacaaagactctttacttg

SEQ ID NO: 456411 - DNA, 20 bp, Artificial Sequence
  chemically synthesized
gaatgactgttcttcaagta

SEQ ID NO: 456412 - DNA, 20 bp, Artificial Sequence
  chemically synthesized
aagactctttacttgaagaa

SEQ ID NO: 456413 - DNA, 20 bp, Artificial Sequence
  chemically synthesized
accttgaatgactgttcttc

SEQ ID NO: 456414 - DNA, 20 bp, Artificial Sequence
  chemically synthesized
tacttgaagaacagtcattc

SEQ ID NO: 456415 - DNA, 20 bp, Artificial Sequence
  chemically synthesized
acttgaagaacagtcattca

SEQ ID NO: 456416 - DNA, 20 bp, Artificial Sequence
  chemically synthesized
gaatgttatatttaaggaca

SEQ ID NO: 456417 - DNA, 20 bp, Artificial Sequence
  chemically synthesized
tatctggaatgttatattta

SEQ ID NO: 456418 - DNA, 20 bp, Artificial Sequence
  chemically synthesized
ctatctggaatgttatattt

SEQ ID NO: 456419 - DNA, 20 bp, Artificial Sequence
  chemically synthesized
tgtccttaaatataacattc

SEQ ID NO: 456420 - DNA, 20 bp, Artificial Sequence
  chemically synthesized
cttaaatataacattccaga

SEQ ID NO: 456421 - DNA, 20 bp, Artificial Sequence
  chemically synthesized
acttgaaattaaaagctatc

SEQ ID NO: 456422 - DNA, 20 bp, Artificial Sequence
  chemically synthesized
aataaaagacttgaaattaa

SEQ ID NO: 456423 - DNA, 20 bp, Artificial Sequence
  chemically synthesized
tccagatagcttttaatttc

SEQ ID NO: 456424 - DNA, 20 bp, Artificial Sequence
  chemically synthesized
agaaaatcttttggaaataa

SEQ ID NO: 456425 - DNA, 20 bp, Artificial Sequence
  chemically synthesized
ttcaagtcttttatttccaa

SEQ ID NO: 456426 - DNA, 20 bp, Artificial Sequence
  chemically synthesized
ataatccacagaaaatcttt

SEQ ID NO: 456427 - DNA, 20 bp, Artificial Sequence
  chemically synthesized
tatttccaaaagattttctg

SEQ ID NO: 456428 - DNA, 20 bp, Artificial Sequence
  chemically synthesized
taactataatagataatcca

SEQ ID NO: 456429 - DNA, 20 bp, Artificial Sequence
  chemically synthesized
tttctgtggattatctatta

SEQ ID NO: 456430 - DNA, 20 bp, Artificial Sequence
  chemically synthesized
tattttgttagtaactataa

SEQ ID NO: 456431 - DNA, 20 bp, Artificial Sequence
  chemically synthesized
ggtgtgaattattattttgt

SEQ ID NO: 456432 - DNA, 20 bp, Artificial Sequence
  chemically synthesized
aacaaaataataattcacac

SEQ ID NO: 456433 - DNA, 20 bp, Artificial Sequence
  chemically synthesized
acaaaataataattcacacc

SEQ ID NO: 456434 - DNA, 20 bp, Artificial Sequence
  chemically synthesized
aataccaggatataattgcc

SEQ ID NO: 456435 - DNA, 20 bp, Artificial Sequence
  chemically synthesized
cacaccaggcaattatatcc

SEQ ID NO: 456436 - DNA, 20 bp, Artificial Sequence
  chemically synthesized
tccaagttttatcaaatacc

SEQ ID NO: 456437 - DNA, 20 bp, Artificial Sequence
  chemically synthesized
atccaagttttatcaaatac

SEQ ID NO: 456438 - DNA, 20 bp, Artificial Sequence
  chemically synthesized
tcctggtatttgataaaact

SEQ ID NO: 456439 - DNA, 20 bp, Artificial Sequence
  chemically synthesized
tcttgaaatggtaaacatcc

SEQ ID NO: 456440 - DNA, 20 bp, Artificial Sequence
  chemically synthesized
acttggatgtttaccatttc

SEQ ID NO: 456441 - DNA, 20 bp, Artificial Sequence
  chemically synthesized
tcaggaaatcattcttgaaa

SEQ ID NO: 456442 - DNA, 20 bp, Artificial Sequence
  chemically synthesized
tcaagaatgatttcctgaaa

SEQ ID NO: 456443 - DNA, 20 bp, Artificial Sequence
  chemically synthesized
ctgttttctttttctttttc

SEQ ID NO: 456444 - DNA, 20 bp, Artificial Sequence
  chemically synthesized
gctgttttctttttcttttt

SEQ ID NO: 456445 - DNA, 20 bp, Artificial Sequence
  chemically synthesized
atgatttcctgaaaaagaaa

SEQ ID NO: 456446 - DNA, 20 bp, Artificial Sequence
  chemically synthesized
cctgaaaaagaaaaagaaaa

SEQ ID NO: 456447 - DNA, 20 bp, Artificial Sequence
  chemically synthesized
aagaaaacagctgatattca

SEQ ID NO: 456448 - DNA, 20 bp, Artificial Sequence
  chemically synthesized
aaatggctgactttgaatat

SEQ ID NO: 456449 - DNA, 20 bp, Artificial Sequence
  chemically synthesized
aaacagctgatattcaaagt

SEQ ID NO: 456450 - DNA, 20 bp, Artificial Sequence
  chemically synthesized
tcaaagtcagccattttctg

SEQ ID NO: 456451 - DNA, 20 bp, Artificial Sequence
  chemically synthesized
attgctcattctgcagaaaa

SEQ ID NO: 456452 - DNA, 20 bp, Artificial Sequence
  chemically synthesized
tcagccattttctgcagaat

SEQ ID NO: 456453 - DNA, 20 bp, Artificial Sequence
  chemically synthesized
ttaaataattgctcattctg

SEQ ID NO: 456454 - DNA, 20 bp, Artificial Sequence
  chemically synthesized
cagaatgagcaattatttaa

SEQ ID NO: 456455 - DNA, 20 bp, Artificial Sequence
  chemically synthesized
agaatgagcaattatttaaa

SEQ ID NO: 456456 - DNA, 20 bp, Artificial Sequence
  chemically synthesized
aaaggaaataacttttaaat

SEQ ID NO: 456457 - DNA, 20 bp, Artificial Sequence
  chemically synthesized
gaatatatgcgctcatttaa

SEQ ID NO: 456458 - DNA, 20 bp, Artificial Sequence
  chemically synthesized
ttaaatgagcgcatatattc

SEQ ID NO: 456459 - DNA, 20 bp, Artificial Sequence
  chemically synthesized
taaatgagcgcatatattcc

SEQ ID NO: 456460 - DNA, 20 bp, Artificial Sequence
  chemically synthesized
agcagcagaaaatatgtgcc

SEQ ID NO: 456461 - DNA, 20 bp, Artificial Sequence
  chemically synthesized
tggacttgttcagtaagcag

SEQ ID NO: 456462 - DNA, 20 bp, Artificial Sequence
  chemically synthesized
aagtggacttgttcagtaag

SEQ ID NO: 456463 - DNA, 20 bp, Artificial Sequence
  chemically synthesized
ttttctgctgcttactgaac

SEQ ID NO: 456464 - DNA, 20 bp, Artificial Sequence
  chemically synthesized
ttgaagtggacttgttcagt

SEQ ID NO: 456465 - DNA, 20 bp, Artificial Sequence
  chemically synthesized
atgtttgaagtggacttgtt

SEQ ID NO: 456466 - DNA, 20 bp, Artificial Sequence
  chemically synthesized
atgtcatgttatgtttgaag

SEQ ID NO: 456467 - DNA, 20 bp, Artificial Sequence
  chemically synthesized
ttcatgtcatgttatgtttg

SEQ ID NO: 456468 - DNA, 20 bp, Artificial Sequence
  chemically synthesized
atgacatgaataaaaaacaa

SEQ ID NO: 456469 - DNA, 20 bp, Artificial Sequence
  chemically synthesized
aaggaggagcacatttgggg

SEQ ID NO: 456470 - DNA, 20 bp, Artificial Sequence
  chemically synthesized
tataaggaggagcacatttg

SEQ ID NO: 456471 - DNA, 20 bp, Artificial Sequence
  chemically synthesized
atataaggaggagcacattt

SEQ ID NO: 456472 - DNA, 20 bp, Artificial Sequence
  chemically synthesized
tatataaggaggagcacatt

SEQ ID NO: 456473 - DNA, 20 bp, Artificial Sequence
  chemically synthesized
ggtgagaaatatataaggag

SEQ ID NO: 456474 - DNA, 20 bp, Artificial Sequence
  chemically synthesized
aaggtgagaaatatataagg

SEQ ID NO: 456475 - DNA, 20 bp, Artificial Sequence
  chemically synthesized
caaggtgagaaatatataag

SEQ ID NO: 456476 - DNA, 20 bp, Artificial Sequence
  chemically synthesized
accaaggtgagaaatatata

SEQ ID NO: 456477 - DNA, 20 bp, Artificial Sequence
  chemically synthesized
taccaaggtgagaaatatat

SEQ ID NO: 456478 - DNA, 20 bp, Artificial Sequence
  chemically synthesized
tccttatatatttctcacct

SEQ ID NO: 456479 - DNA, 20 bp, Artificial Sequence
  chemically synthesized
gtagttccatttaccaaggt

SEQ ID NO: 456480 - DNA, 20 bp, Artificial Sequence
  chemically synthesized
atatttctcaccttggtaaa

SEQ ID NO: 456481 - DNA, 20 bp, Artificial Sequence
  chemically synthesized
aatagtagttccatttacca

SEQ ID NO: 456482 - DNA, 20 bp, Artificial Sequence
  chemically synthesized
aaatagtagttccatttacc

SEQ ID NO: 456483 - DNA, 20 bp, Artificial Sequence
  chemically synthesized
aagagaagtttaataaatag

SEQ ID NO: 456484 - DNA, 20 bp, Artificial Sequence
  chemically synthesized
gacaagagaagtttaataaa

SEQ ID NO: 456485 - DNA, 20 bp, Artificial Sequence
  chemically synthesized
atttattaaacttctcttgt

SEQ ID NO: 456486 - DNA, 20 bp, Artificial Sequence
  chemically synthesized
atacaaagttctgacaagag

SEQ ID NO: 456487 - DNA, 20 bp, Artificial Sequence
  chemically synthesized
atgatacaaagttctgacaa

SEQ ID NO: 456488 - DNA, 20 bp, Artificial Sequence
  chemically synthesized
aaatgatacaaagttctgac

SEQ ID NO: 456489 - DNA, 20 bp, Artificial Sequence
  chemically synthesized
cagaaatcttaaatgataca

SEQ ID NO: 456490 - DNA, 20 bp, Artificial Sequence
  chemically synthesized
gtcagaactttgtatcattt

SEQ ID NO: 456491 - DNA, 20 bp, Artificial Sequence
  chemically synthesized
ttaaatgaaggtgaggaaga

SEQ ID NO: 456492 - DNA, 20 bp, Artificial Sequence
  chemically synthesized
ttgattaaatgaaggtgagg

SEQ ID NO: 456493 - DNA, 20 bp, Artificial Sequence
  chemically synthesized
agcttgattaaatgaaggtg

SEQ ID NO: 456494 - DNA, 20 bp, Artificial Sequence
  chemically synthesized
aagcttgattaaatgaaggt

SEQ ID NO: 456495 - DNA, 20 bp, Artificial Sequence
  chemically synthesized
cttgaagcttgattaaatga

SEQ ID NO: 456496 - DNA, 20 bp, Artificial Sequence
  chemically synthesized
tcttgaagcttgattaaatg

SEQ ID NO: 456497 - DNA, 20 bp, Artificial Sequence
  chemically synthesized
ttcctcaccttcatttaatc

SEQ ID NO: 456498 - DNA, 20 bp, Artificial Sequence
  chemically synthesized
ccttcatttaatcaagcttc

SEQ ID NO: 456499 - DNA, 20 bp, Artificial Sequence
  chemically synthesized
ggtagaatctacgtgtcttg

SEQ ID NO: 456500 - DNA, 20 bp, Artificial Sequence
  chemically synthesized
taatcaagcttcaagacacg

SEQ ID NO: 456501 - DNA, 20 bp, Artificial Sequence
  chemically synthesized
ttaaaaacactttttagtgg

SEQ ID NO: 456502 - DNA, 20 bp, Artificial Sequence
  chemically synthesized
acgtagattctaccactaaa

SEQ ID NO: 456503 - DNA, 20 bp, Artificial Sequence
  chemically synthesized
tgtttaaaaacactttttag

SEQ ID NO: 456504 - DNA, 20 bp, Artificial Sequence
  chemically synthesized
cactgtttaaaaacactttt

SEQ ID NO: 456505 - DNA, 20 bp, Artificial Sequence
  chemically synthesized
cactaaaaagtgtttttaaa

SEQ ID NO: 456506 - DNA, 20 bp, Artificial Sequence
  chemically synthesized
tttgattagaatagtaacaa

SEQ ID NO: 456507 - DNA, 20 bp, Artificial Sequence
  chemically synthesized
taatatgattttgattagaa

SEQ ID NO: 456508 - DNA, 20 bp, Artificial Sequence
  chemically synthesized
aagtgtaatatgattttgat

SEQ ID NO: 456509 - DNA, 20 bp, Artificial Sequence
  chemically synthesized
cgtagtacttataaagtcat

SEQ ID NO: 456510 - DNA, 20 bp, Artificial Sequence
  chemically synthesized
tattacacttatgactttat

SEQ ID NO: 456511 - DNA, 20 bp, Artificial Sequence
  chemically synthesized
aggaggtcgtagtacttata

SEQ ID NO: 456512 - DNA, 20 bp, Artificial Sequence
  chemically synthesized
gaaagaccagtaggaggtcg

SEQ ID NO: 456513 - DNA, 20 bp, Artificial Sequence
  chemically synthesized
taagtactacgacctcctac

SEQ ID NO: 456514 - DNA, 20 bp, Artificial Sequence
  chemically synthesized
aaagatgaaagaccagtagg

SEQ ID NO: 456515 - DNA, 20 bp, Artificial Sequence
  chemically synthesized
gaaagatgaaagaccagtag

SEQ ID NO: 456516 - DNA, 20 bp, Artificial Sequence
  chemically synthesized
aggaaagatgaaagaccagt

SEQ ID NO: 456517 - DNA, 20 bp, Artificial Sequence
  chemically synthesized
gaggaaagatgaaagaccag

SEQ ID NO: 456518 - DNA, 20 bp, Artificial Sequence
  chemically synthesized
gctgaggaaagatgaaagac

SEQ ID NO: 456519 - DNA, 20 bp, Artificial Sequence
  chemically synthesized
aacaggctgaggaaagatga

SEQ ID NO: 456520 - DNA, 20 bp, Artificial Sequence
  chemically synthesized
actggtctttcatctttcct

SEQ ID NO: 456521 - DNA, 20 bp, Artificial Sequence
  chemically synthesized
gaggatcaacaggctgagga

SEQ ID NO: 456522 - DNA, 20 bp, Artificial Sequence
  chemically synthesized
attggaggatcaacaggctg

SEQ ID NO: 456523 - DNA, 20 bp, Artificial Sequence
  chemically synthesized
gattggaggatcaacaggct

SEQ ID NO: 456524 - DNA, 20 bp, Artificial Sequence
  chemically synthesized
atagggattggaggatcaac

SEQ ID NO: 456525 - DNA, 20 bp, Artificial Sequence
  chemically synthesized
tatagggattggaggatcaa

SEQ ID NO: 456526 - DNA, 20 bp, Artificial Sequence
  chemically synthesized
ggtacttatatagggattgg

SEQ ID NO: 456527 - DNA, 20 bp, Artificial Sequence
  chemically synthesized
aggtacttatatagggattg

SEQ ID NO: 456528 - DNA, 20 bp, Artificial Sequence
  chemically synthesized
agaggtacttatatagggat

SEQ ID NO: 456529 - DNA, 20 bp, Artificial Sequence
  chemically synthesized
tgatcctccaatccctatat

SEQ ID NO: 456530 - DNA, 20 bp, Artificial Sequence
  chemically synthesized
ggaatagaggtacttatata

SEQ ID NO: 456531 - DNA, 20 bp, Artificial Sequence
  chemically synthesized
gggaatagaggtacttatat

SEQ ID NO: 456532 - DNA, 20 bp, Artificial Sequence
  chemically synthesized
tgggaatagaggtacttata

SEQ ID NO: 456533 - DNA, 20 bp, Artificial Sequence
  chemically synthesized
agagactttattgggaatag

SEQ ID NO: 456534 - DNA, 20 bp, Artificial Sequence
  chemically synthesized
gagagactttattgggaata

SEQ ID NO: 456535 - DNA, 20 bp, Artificial Sequence
  chemically synthesized
cagagagactttattgggaa

SEQ ID NO: 456536 - DNA, 20 bp, Artificial Sequence
  chemically synthesized
aagtacctctattcccaata

SEQ ID NO: 456537 - DNA, 20 bp, Artificial Sequence
  chemically synthesized
tgtggcagagagactttatt

SEQ ID NO: 456538 - DNA, 20 bp, Artificial Sequence
  chemically synthesized
atgtggcagagagactttat

SEQ ID NO: 456539 - DNA, 20 bp, Artificial Sequence
  chemically synthesized
ttgtgagttcatgtggcaga

SEQ ID NO: 456540 - DNA, 20 bp, Artificial Sequence
  chemically synthesized
cattgtgagttcatgtggca

SEQ ID NO: 456541 - DNA, 20 bp, Artificial Sequence
  chemically synthesized
ctcattgtgagttcatgtgg

SEQ ID NO: 456542 - DNA, 20 bp, Artificial Sequence
  chemically synthesized
aagctcattgtgagttcatg

SEQ ID NO: 456543 - DNA, 20 bp, Artificial Sequence
  chemically synthesized
ctgccacatgaactcacaat

SEQ ID NO: 456544 - DNA, 20 bp, Artificial Sequence
  chemically synthesized
atctttttaaagctcattgt

SEQ ID NO: 456545 - DNA, 20 bp, Artificial Sequence
  chemically synthesized
aactcacaatgagctttaaa

SEQ ID NO: 456546 - DNA, 20 bp, Artificial Sequence
  chemically synthesized
tcatcatctttatcttttta

SEQ ID NO: 456547 - DNA, 20 bp, Artificial Sequence
  chemically synthesized
caatgagctttaaaaagata

SEQ ID NO: 456548 - DNA, 20 bp, Artificial Sequence
  chemically synthesized
gcttatgagatttagtcaaa

SEQ ID NO: 456549 - DNA, 20 bp, Artificial Sequence
  chemically synthesized
aaggagccgcttatgagatt

SEQ ID NO: 456550 - DNA, 20 bp, Artificial Sequence
  chemically synthesized
tccgtttgactaaatctcat

SEQ ID NO: 456551 - DNA, 20 bp, Artificial Sequence
  chemically synthesized
gtttgactaaatctcataag

SEQ ID NO: 456552 - DNA, 20 bp, Artificial Sequence
  chemically synthesized
aaaaataaggagccgcttat

SEQ ID NO: 456553 - DNA, 20 bp, Artificial Sequence
  chemically synthesized
tttataaccaaaaaaataag

SEQ ID NO: 456554 - DNA, 20 bp, Artificial Sequence
  chemically synthesized
attttataaccaaaaaaata

SEQ ID NO: 456555 - DNA, 20 bp, Artificial Sequence
  chemically synthesized
taagcggctccttatttttt

SEQ ID NO: 456556 - DNA, 20 bp, Artificial Sequence
  chemically synthesized
gattttataaccaaaaaaat

SEQ ID NO: 456557 - DNA, 20 bp, Artificial Sequence
  chemically synthesized
atttttttggttataaaatc

SEQ ID NO: 456558 - DNA, 20 bp, Artificial Sequence
  chemically synthesized
atagttcgtgtttagcattc

SEQ ID NO: 456559 - DNA, 20 bp, Artificial Sequence
  chemically synthesized
agcatcctatagttcgtgtt

SEQ ID NO: 456560 - DNA, 20 bp, Artificial Sequence
  chemically synthesized
agaatgctaaacacgaacta

SEQ ID NO: 456561 - DNA, 20 bp, Artificial Sequence
  chemically synthesized
gaatgctaaacacgaactat

SEQ ID NO: 456562 - DNA, 20 bp, Artificial Sequence
  chemically synthesized
ttacctcatgcagcatccta

SEQ ID NO: 456563 - DNA, 20 bp, Artificial Sequence
  chemically synthesized
cgaactataggatgctgcat

SEQ ID NO: 456564 - DNA, 20 bp, Artificial Sequence
  chemically synthesized
gaactataggatgctgcatg

SEQ ID NO: 456565 - DNA, 20 bp, Artificial Sequence
  chemically synthesized
taaacagggattacctcatg

SEQ ID NO: 456566 - DNA, 20 bp, Artificial Sequence
  chemically synthesized
ttgggggagatatgtaaaca

SEQ ID NO: 456567 - DNA, 20 bp, Artificial Sequence
  chemically synthesized
gttgggggagatatgtaaac

SEQ ID NO: 456568 - DNA, 20 bp, Artificial Sequence
  chemically synthesized
ggttgggggagatatgtaaa

SEQ ID NO: 456569 - DNA, 20 bp, Artificial Sequence
  chemically synthesized
tgaatcaacatgggttgggg

SEQ ID NO: 456570 - DNA, 20 bp, Artificial Sequence
  chemically synthesized
aatgaatcaacatgggttgg

SEQ ID NO: 456571 - DNA, 20 bp, Artificial Sequence
  chemically synthesized
gaatgaatcaacatgggttg

SEQ ID NO: 456572 - DNA, 20 bp, Artificial Sequence
  chemically synthesized
tgaatgaatcaacatgggtt

SEQ ID NO: 456573 - DNA, 20 bp, Artificial Sequence
  chemically synthesized
atgaatgaatcaacatgggt

SEQ ID NO: 456574 - DNA, 20 bp, Artificial Sequence
  chemically synthesized
aaagatgaatgaatcaacat

SEQ ID NO: 456575 - DNA, 20 bp, Artificial Sequence
  chemically synthesized
gaaagatgaatgaatcaaca

SEQ ID NO: 456576 - DNA, 20 bp, Artificial Sequence
  chemically synthesized
aagcacagctagaatgagga

SEQ ID NO: 456577 - DNA, 20 bp, Artificial Sequence
  chemically synthesized
tcattcatctttcctcattc

SEQ ID NO: 456578 - DNA, 20 bp, Artificial Sequence
  chemically synthesized
agtcaagcacagctagaatg

SEQ ID NO: 456579 - DNA, 20 bp, Artificial Sequence
  chemically synthesized
aagtcaagcacagctagaat

SEQ ID NO: 456580 - DNA, 20 bp, Artificial Sequence
  chemically synthesized
gaactaaagtcaagcacagc

SEQ ID NO: 456581 - DNA, 20 bp, Artificial Sequence
  chemically synthesized
tgaggaactaaagtcaagca

SEQ ID NO: 456582 - DNA, 20 bp, Artificial Sequence
  chemically synthesized
attctagctgtgcttgactt

SEQ ID NO: 456583 - DNA, 20 bp, Artificial Sequence
  chemically synthesized
atatttgaggaactaaagtc

SEQ ID NO: 456584 - DNA, 20 bp, Artificial Sequence
  chemically synthesized
caagtatatttgaggaacta

SEQ ID NO: 456585 - DNA, 20 bp, Artificial Sequence
  chemically synthesized
taaagaagcaagtatatttg

SEQ ID NO: 456586 - DNA, 20 bp, Artificial Sequence
  chemically synthesized
ataaagaagcaagtatattt

SEQ ID NO: 456587 - DNA, 20 bp, Artificial Sequence
  chemically synthesized
gacctgagacataaagaagc

SEQ ID NO: 456588 - DNA, 20 bp, Artificial Sequence
  chemically synthesized
taaagacctgagacataaag

SEQ ID NO: 456589 - DNA, 20 bp, Artificial Sequence
  chemically synthesized
atacttgcttctttatgtct

SEQ ID NO: 456590 - DNA, 20 bp, Artificial Sequence
  chemically synthesized
tattaaagacctgagacata

SEQ ID NO: 456591 - DNA, 20 bp, Artificial Sequence
  chemically synthesized
tacttgcttctttatgtctc

SEQ ID NO: 456592 - DNA, 20 bp, Artificial Sequence
  chemically synthesized
catgcatgtattaaagacct

SEQ ID NO: 456593 - DNA, 20 bp, Artificial Sequence
  chemically synthesized
tgtatagcatgcatgtatta

SEQ ID NO: 456594 - DNA, 20 bp, Artificial Sequence
  chemically synthesized
ttaatacatgcatgctatac

SEQ ID NO: 456595 - DNA, 20 bp, Artificial Sequence
  chemically synthesized
tacatgcatgctatacaagc

SEQ ID NO: 456596 - DNA, 20 bp, Artificial Sequence
  chemically synthesized
aagatgttttctggcttgta

SEQ ID NO: 456597 - DNA, 20 bp, Artificial Sequence
  chemically synthesized
ggtggtggtaagatgttttc

SEQ ID NO: 456598 - DNA, 20 bp, Artificial Sequence
  chemically synthesized
tattacttgagggtggtggt

SEQ ID NO: 456599 - DNA, 20 bp, Artificial Sequence
  chemically synthesized
tttatattacttgagggtgg

SEQ ID NO: 456600 - DNA, 20 bp, Artificial Sequence
  chemically synthesized
aacatcttaccaccaccctc

SEQ ID NO: 456601 - DNA, 20 bp, Artificial Sequence
  chemically synthesized
tagtttatattacttgaggg

SEQ ID NO: 456602 - DNA, 20 bp, Artificial Sequence
  chemically synthesized
gtctagtttatattacttga

SEQ ID NO: 456603 - DNA, 20 bp, Artificial Sequence
  chemically synthesized
tgtctagtttatattacttg

SEQ ID NO: 456604 - DNA, 20 bp, Artificial Sequence
  chemically synthesized
ttgtctagtttatattactt

SEQ ID NO: 456605 - DNA, 20 bp, Artificial Sequence
  chemically synthesized
caccctcaagtaatataaac

SEQ ID NO: 456606 - DNA, 20 bp, Artificial Sequence
  chemically synthesized
tcaagtaatataaactagac

SEQ ID NO: 456607 - DNA, 20 bp, Artificial Sequence
  chemically synthesized
agacattgtatgcacttgtc

SEQ ID NO: 456608 - DNA, 20 bp, Artificial Sequence
  chemically synthesized
catacaatgtctttaattcc

SEQ ID NO: 456609 - DNA, 20 bp, Artificial Sequence
  chemically synthesized
taaaaattgaccaggaatta

SEQ ID NO: 456610 - DNA, 20 bp, Artificial Sequence
  chemically synthesized
cttgaagataaaaattgacc

SEQ ID NO: 456611 - DNA, 20 bp, Artificial Sequence
  chemically synthesized
acttgaagataaaaattgac

SEQ ID NO: 456612 - DNA, 20 bp, Artificial Sequence
  chemically synthesized
cctggtcaatttttatcttc

SEQ ID NO: 456613 - DNA, 20 bp, Artificial Sequence
  chemically synthesized
cttatagtaaagttcacttg

SEQ ID NO: 456614 - DNA, 20 bp, Artificial Sequence
  chemically synthesized
cttcaagtgaactttactat

SEQ ID NO: 456615 - DNA, 20 bp, Artificial Sequence
  chemically synthesized
aaaagctttcacttatagta

SEQ ID NO: 456616 - DNA, 20 bp, Artificial Sequence
  chemically synthesized
gtgaactttactataagtga

SEQ ID NO: 456617 - DNA, 20 bp, Artificial Sequence
  chemically synthesized
caaacaaaagctttcactta

SEQ ID NO: 456618 - DNA, 20 bp, Artificial Sequence
  chemically synthesized
tgtataaatcaagcaaacaa

SEQ ID NO: 456619 - DNA, 20 bp, Artificial Sequence
  chemically synthesized
tttgtgaccatgtataaatc

SEQ ID NO: 456620 - DNA, 20 bp, Artificial Sequence
  chemically synthesized
ttgtttgcttgatttataca

SEQ ID NO: 456621 - DNA, 20 bp, Artificial Sequence
  chemically synthesized
tttatacatggtcacaaaat

SEQ ID NO: 456622 - DNA, 20 bp, Artificial Sequence
  chemically synthesized
atggtcacaaaataagctgc

SEQ ID NO: 456623 - DNA, 20 bp, Artificial Sequence
  chemically synthesized
tcacaaaataagctgccaga

SEQ ID NO: 456624 - DNA, 20 bp, Artificial Sequence
  chemically synthesized
aaagaaattcgactttctgg

SEQ ID NO: 456625 - DNA, 20 bp, Artificial Sequence
  chemically synthesized
aggaaagaaattcgactttc

SEQ ID NO: 456626 - DNA, 20 bp, Artificial Sequence
  chemically synthesized
aagtcgaatttctttcctcc

SEQ ID NO: 456627 - DNA, 20 bp, Artificial Sequence
  chemically synthesized
gtatttttaagctaggagga

SEQ ID NO: 456628 - DNA, 20 bp, Artificial Sequence
  chemically synthesized
agatgtatttttaagctagg

SEQ ID NO: 456629 - DNA, 20 bp, Artificial Sequence
  chemically synthesized
tagatgtatttttaagctag

SEQ ID NO: 456630 - DNA, 20 bp, Artificial Sequence
  chemically synthesized
ggtagatgtatttttaagct

SEQ ID NO: 456631 - DNA, 20 bp, Artificial Sequence
  chemically synthesized
gggtagatgtatttttaagc

SEQ ID NO: 456632 - DNA, 20 bp, Artificial Sequence
  chemically synthesized
ggaggggtagatgtattttt

SEQ ID NO: 456633 - DNA, 20 bp, Artificial Sequence
  chemically synthesized
ttttaaggatgaaggagggg

SEQ ID NO: 456634 - DNA, 20 bp, Artificial Sequence
  chemically synthesized
cttttttaaggatgaaggag

SEQ ID NO: 456635 - DNA, 20 bp, Artificial Sequence
  chemically synthesized
tcttttttaaggatgaagga

SEQ ID NO: 456636 - DNA, 20 bp, Artificial Sequence
  chemically synthesized
ttcttttttaaggatgaagg

SEQ ID NO: 456637 - DNA, 20 bp, Artificial Sequence
  chemically synthesized
tttcttttttaaggatgaag

SEQ ID NO: 456638 - DNA, 20 bp, Artificial Sequence
  chemically synthesized
attttcttttttaaggatga

SEQ ID NO: 456639 - DNA, 20 bp, Artificial Sequence
  chemically synthesized
cattttcttttttaaggatg

SEQ ID NO: 456640 - DNA, 20 bp, Artificial Sequence
  chemically synthesized
cccctccttcatccttaaaa

SEQ ID NO: 456641 - DNA, 20 bp, Artificial Sequence
  chemically synthesized
aagatgcattttctttttta

SEQ ID NO: 456642 - DNA, 20 bp, Artificial Sequence
  chemically synthesized
gaagatgcattttctttttt

SEQ ID NO: 456643 - DNA, 20 bp, Artificial Sequence
  chemically synthesized
agaaaatgcatcttcataaa

SEQ ID NO: 456644 - DNA, 20 bp, Artificial Sequence
  chemically synthesized
aaagttgtaatctttttatg

SEQ ID NO: 456645 - DNA, 20 bp, Artificial Sequence
  chemically synthesized
aacatgacttttatattcaa

SEQ ID NO: 456646 - DNA, 20 bp, Artificial Sequence
  chemically synthesized
attacaacttttgaatataa

SEQ ID NO: 456647 - DNA, 20 bp, Artificial Sequence
  chemically synthesized
aagtcatgtttttcaaacaa

SEQ ID NO: 456648 - DNA, 20 bp, Artificial Sequence
  chemically synthesized
gtgggaaatacatatatgtt

SEQ ID NO: 456649 - DNA, 20 bp, Artificial Sequence
  chemically synthesized
tgttgtgtctcataattggt

SEQ ID NO: 456650 - DNA, 20 bp, Artificial Sequence
  chemically synthesized
ttgttgtgtctcataattgg

SEQ ID NO: 456651 - DNA, 20 bp, Artificial Sequence
  chemically synthesized
atgtatttcccaccaattat

SEQ ID NO: 456652 - DNA, 20 bp, Artificial Sequence
  chemically synthesized
tttttgttgtgtctcataat

SEQ ID NO: 456653 - DNA, 20 bp, Artificial Sequence
  chemically synthesized
attatgagacacaacaaaaa

SEQ ID NO: 456654 - DNA, 20 bp, Artificial Sequence
  chemically synthesized
acaacaaaaaaagaaaattt

SEQ ID NO: 456655 - DNA, 20 bp, Artificial Sequence
  chemically synthesized
caacaaaaaaagaaaatttc

SEQ ID NO: 456656 - DNA, 20 bp, Artificial Sequence
  chemically synthesized
ttgatgttcatcagggatat

SEQ ID NO: 456657 - DNA, 20 bp, Artificial Sequence
  chemically synthesized
ttttgcattgatgttcatca

SEQ ID NO: 456658 - DNA, 20 bp, Artificial Sequence
  chemically synthesized
tttttgcattgatgttcatc

SEQ ID NO: 456659 - DNA, 20 bp, Artificial Sequence
  chemically synthesized
atttttgcattgatgttcat

SEQ ID NO: 456660 - DNA, 20 bp, Artificial Sequence
  chemically synthesized
agtttgccagtattttattg

SEQ ID NO: 456661 - DNA, 20 bp, Artificial Sequence
  chemically synthesized
cagtttgccagtattttatt

SEQ ID NO: 456662 - DNA, 20 bp, Artificial Sequence
  chemically synthesized
aaaaatcctcaataaaatac

SEQ ID NO: 456663 - DNA, 20 bp, Artificial Sequence
  chemically synthesized
tgctgctggattcagtttgc

SEQ ID NO: 456664 - DNA, 20 bp, Artificial Sequence
  chemically synthesized
aaatactggcaaactgaatc

SEQ ID NO: 456665 - DNA, 20 bp, Artificial Sequence
  chemically synthesized
tactggcaaactgaatccag

SEQ ID NO: 456666 - DNA, 20 bp, Artificial Sequence
  chemically synthesized
ttttgatgtgctgctggatt

SEQ ID NO: 456667 - DNA, 20 bp, Artificial Sequence
  chemically synthesized
taagctttttgatgtgctgc

SEQ ID NO: 456668 - DNA, 20 bp, Artificial Sequence
  chemically synthesized
gaatccagcagcacatcaaa

SEQ ID NO: 456669 - DNA, 20 bp, Artificial Sequence
  chemically synthesized
tcgacttaatcgtggtgggt

SEQ ID NO: 456670 - DNA, 20 bp, Artificial Sequence
  chemically synthesized
gaagtcgacttaatcgtggt

SEQ ID NO: 456671 - DNA, 20 bp, Artificial Sequence
  chemically synthesized
tgaagtcgacttaatcgtgg

SEQ ID NO: 456672 - DNA, 20 bp, Artificial Sequence
  chemically synthesized
aaagcttacccaccacgatt

SEQ ID NO: 456673 - DNA, 20 bp, Artificial Sequence
  chemically synthesized
ggatgaagtcgacttaatcg

SEQ ID NO: 456674 - DNA, 20 bp, Artificial Sequence
  chemically synthesized
gattaagtcgacttcatccc

SEQ ID NO: 456675 - DNA, 20 bp, Artificial Sequence
  chemically synthesized
attaagtcgacttcatccct

SEQ ID NO: 456676 - DNA, 20 bp, Artificial Sequence
  chemically synthesized
agccttgcttcccagggatg

SEQ ID NO: 456677 - DNA, 20 bp, Artificial Sequence
  chemically synthesized
aagtcgacttcatccctggg

SEQ ID NO: 456678 - DNA, 20 bp, Artificial Sequence
  chemically synthesized
tgaaccagccttgcttccca

SEQ ID NO: 456679 - DNA, 20 bp, Artificial Sequence
  chemically synthesized
cgacttcatccctgggaagc

SEQ ID NO: 456680 - DNA, 20 bp, Artificial Sequence
  chemically synthesized
ttgaaccagccttgcttccc

SEQ ID NO: 456681 - DNA, 20 bp, Artificial Sequence
  chemically synthesized
gacttcatccctgggaagca

SEQ ID NO: 456682 - DNA, 20 bp, Artificial Sequence
  chemically synthesized
gttgaaccagccttgcttcc

SEQ ID NO: 456683 - DNA, 20 bp, Artificial Sequence
  chemically synthesized
tcatccctgggaagcaaggc

SEQ ID NO: 456684 - DNA, 20 bp, Artificial Sequence
  chemically synthesized
ttgatttgcatgtgttgaac

SEQ ID NO: 456685 - DNA, 20 bp, Artificial Sequence
  chemically synthesized
gcaaatcaataaacataatc

SEQ ID NO: 456686 - DNA, 20 bp, Artificial Sequence
  chemically synthesized
cattggtgctgtttatgtgc

SEQ ID NO: 456687 - DNA, 20 bp, Artificial Sequence
  chemically synthesized
aacataatccagcacataaa

SEQ ID NO: 456688 - DNA, 20 bp, Artificial Sequence
  chemically synthesized
ataatcgtagtttttgtcat

SEQ ID NO: 456689 - DNA, 20 bp, Artificial Sequence
  chemically synthesized
tgcatctattgagataatcg

SEQ ID NO: 456690 - DNA, 20 bp, Artificial Sequence
  chemically synthesized
aaaaactacgattatctcaa

SEQ ID NO: 456691 - DNA, 20 bp, Artificial Sequence
  chemically synthesized
aggccttttctgcatctatt

SEQ ID NO: 456692 - DNA, 20 bp, Artificial Sequence
  chemically synthesized
tacgattatctcaatagatg

SEQ ID NO: 456693 - DNA, 20 bp, Artificial Sequence
  chemically synthesized
ttatctcaatagatgcagaa

SEQ ID NO: 456694 - DNA, 20 bp, Artificial Sequence
  chemically synthesized
tatctcaatagatgcagaaa

SEQ ID NO: 456695 - DNA, 20 bp, Artificial Sequence
  chemically synthesized
ggggtgttgaattttatcga

SEQ ID NO: 456696 - DNA, 20 bp, Artificial Sequence
  chemically synthesized
aggggtgttgaattttatcg

SEQ ID NO: 456697 - DNA, 20 bp, Artificial Sequence
  chemically synthesized
taagagtttttagcatgaag

SEQ ID NO: 456698 - DNA, 20 bp, Artificial Sequence
  chemically synthesized
ttaagagtttttagcatgaa

SEQ ID NO: 456699 - DNA, 20 bp, Artificial Sequence
  chemically synthesized
attaagagtttttagcatga

SEQ ID NO: 456700 - DNA, 20 bp, Artificial Sequence
  chemically synthesized
tattaagagtttttagcatg

SEQ ID NO: 456701 - DNA, 20 bp, Artificial Sequence
  chemically synthesized
cctagtttattaagagtttt

SEQ ID NO: 456702 - DNA, 20 bp, Artificial Sequence
  chemically synthesized
aacaatacctagtttattaa

SEQ ID NO: 456703 - DNA, 20 bp, Artificial Sequence
  chemically synthesized
gctaaaaactcttaataaac

SEQ ID NO: 456704 - DNA, 20 bp, Artificial Sequence
  chemically synthesized
ccaacaatacctagtttatt

SEQ ID NO: 456705 - DNA, 20 bp, Artificial Sequence
  chemically synthesized
ctaaaaactcttaataaact

SEQ ID NO: 456706 - DNA, 20 bp, Artificial Sequence
  chemically synthesized
agatatactccaacaatacc

SEQ ID NO: 456707 - DNA, 20 bp, Artificial Sequence
  chemically synthesized
cttaataaactaggtattgt

SEQ ID NO: 456708 - DNA, 20 bp, Artificial Sequence
  chemically synthesized
taataaactaggtattgttg

SEQ ID NO: 456709 - DNA, 20 bp, Artificial Sequence
  chemically synthesized
taaatagctcttattgtttt

SEQ ID NO: 456710 - DNA, 20 bp, Artificial Sequence
  chemically synthesized
ggagtatatcttaaaacaat

SEQ ID NO: 456711 - DNA, 20 bp, Artificial Sequence
  chemically synthesized
agtatatcttaaaacaataa

SEQ ID NO: 456712 - DNA, 20 bp, Artificial Sequence
  chemically synthesized
gtctgtgggtttgtcataaa

SEQ ID NO: 456713 - DNA, 20 bp, Artificial Sequence
  chemically synthesized
agctatttatgacaaaccca

SEQ ID NO: 456714 - DNA, 20 bp, Artificial Sequence
  chemically synthesized
ttcactatgatattgtctgt

SEQ ID NO: 456715 - DNA, 20 bp, Artificial Sequence
  chemically synthesized
attcactatgatattgtctg

SEQ ID NO: 456716 - DNA, 20 bp, Artificial Sequence
  chemically synthesized
caaacccacagacaatatca

SEQ ID NO: 456717 - DNA, 20 bp, Artificial Sequence
  chemically synthesized
acagacaatatcatagtgaa

SEQ ID NO: 456718 - DNA, 20 bp, Artificial Sequence
  chemically synthesized
cagacaatatcatagtgaat

SEQ ID NO: 456719 - DNA, 20 bp, Artificial Sequence
  chemically synthesized
atatcatagtgaatgggcaa

SEQ ID NO: 456720 - DNA, 20 bp, Artificial Sequence
  chemically synthesized
catagtgaatgggcaaaagc

SEQ ID NO: 456721 - DNA, 20 bp, Artificial Sequence
  chemically synthesized
agtgaatgggcaaaagctgg

SEQ ID NO: 456722 - DNA, 20 bp, Artificial Sequence
  chemically synthesized
gttttcaaagtgaatgcttc

SEQ ID NO: 456723 - DNA, 20 bp, Artificial Sequence
  chemically synthesized
ttgtcttgtgcgggttttca

SEQ ID NO: 456724 - DNA, 20 bp, Artificial Sequence
  chemically synthesized
ttcactttgaaaacccgcac

SEQ ID NO: 456725 - DNA, 20 bp, Artificial Sequence
  chemically synthesized
agggcatccttgtcttgtgc

SEQ ID NO: 456726 - DNA, 20 bp, Artificial Sequence
  chemically synthesized
gagggcatccttgtcttgtg

SEQ ID NO: 456727 - DNA, 20 bp, Artificial Sequence
  chemically synthesized
tttgaaaacccgcacaagac

SEQ ID NO: 456728 - DNA, 20 bp, Artificial Sequence
  chemically synthesized
ttgaaaacccgcacaagaca

SEQ ID NO: 456729 - DNA, 20 bp, Artificial Sequence
  chemically synthesized
tgaataggagtggtgagcga

SEQ ID NO: 456730 - DNA, 20 bp, Artificial Sequence
  chemically synthesized
ttgaataggagtggtgagcg

SEQ ID NO: 456731 - DNA, 20 bp, Artificial Sequence
  chemically synthesized
gttgaataggagtggtgagc

SEQ ID NO: 456732 - DNA, 20 bp, Artificial Sequence
  chemically synthesized
ctatgttgaataggagtggt

SEQ ID NO: 456733 - DNA, 20 bp, Artificial Sequence
  chemically synthesized
aatactatgttgaataggag

SEQ ID NO: 456734 - DNA, 20 bp, Artificial Sequence
  chemically synthesized
tccaatactatgttgaatag

SEQ ID NO: 456735 - DNA, 20 bp, Artificial Sequence
  chemically synthesized
cttccaatactatgttgaat

SEQ ID NO: 456736 - DNA, 20 bp, Artificial Sequence
  chemically synthesized
ctcaccactcctattcaaca

SEQ ID NO: 456737 - DNA, 20 bp, Artificial Sequence
  chemically synthesized
acttccaatactatgttgaa

SEQ ID NO: 456738 - DNA, 20 bp, Artificial Sequence
  chemically synthesized
actcctattcaacatagtat

SEQ ID NO: 456739 - DNA, 20 bp, Artificial Sequence
  chemically synthesized
cctattcaacatagtattgg

SEQ ID NO: 456740 - DNA, 20 bp, Artificial Sequence
  chemically synthesized
caacatagtattggaagttc

SEQ ID NO: 456741 - DNA, 20 bp, Artificial Sequence
  chemically synthesized
atagtattggaagttctggc

SEQ ID NO: 456742 - DNA, 20 bp, Artificial Sequence
  chemically synthesized
tagtattggaagttctggcc

SEQ ID NO: 456743 - DNA, 20 bp, Artificial Sequence
  chemically synthesized
agtattggaagttctggcca

SEQ ID NO: 456744 - DNA, 20 bp, Artificial Sequence
  chemically synthesized
tcttgcctgattgccctggc

SEQ ID NO: 456745 - DNA, 20 bp, Artificial Sequence
  chemically synthesized
gaagttctggccagggcaat

SEQ ID NO: 456746 - DNA, 20 bp, Artificial Sequence
  chemically synthesized
tttctcttgcctgattgccc

SEQ ID NO: 456747 - DNA, 20 bp, Artificial Sequence
  chemically synthesized
aagttctggccagggcaatc

SEQ ID NO: 456748 - DNA, 20 bp, Artificial Sequence
  chemically synthesized
tctggccagggcaatcaggc

SEQ ID NO: 456749 - DNA, 20 bp, Artificial Sequence
  chemically synthesized
tggccagggcaatcaggcaa

SEQ ID NO: 456750 - DNA, 20 bp, Artificial Sequence
  chemically synthesized
cagggcaatcaggcaagaga

SEQ ID NO: 456751 - DNA, 20 bp, Artificial Sequence
  chemically synthesized
tcaggcaagagaaagaaata

SEQ ID NO: 456752 - DNA, 20 bp, Artificial Sequence
  chemically synthesized
caggcaagagaaagaaataa

SEQ ID NO: 456753 - DNA, 20 bp, Artificial Sequence
  chemically synthesized
aggcaagagaaagaaataaa

SEQ ID NO: 456754 - DNA, 20 bp, Artificial Sequence
  chemically synthesized
agaaataaagggtattcaaa

SEQ ID NO: 456755 - DNA, 20 bp, Artificial Sequence
  chemically synthesized
gaaataaagggtattcaaat

SEQ ID NO: 456756 - DNA, 20 bp, Artificial Sequence
  chemically synthesized
ataaagggtattcaaatagg

SEQ ID NO: 456757 - DNA, 20 bp, Artificial Sequence
  chemically synthesized
agtcaaattgtctctgtttg

SEQ ID NO: 456758 - DNA, 20 bp, Artificial Sequence
  chemically synthesized
agccatgtcatctgcaaaca

SEQ ID NO: 456759 - DNA, 20 bp, Artificial Sequence
  chemically synthesized
gcagccatgtcatctgcaaa

SEQ ID NO: 456760 - DNA, 20 bp, Artificial Sequence
  chemically synthesized
gtctctgtttgcagatgaca

SEQ ID NO: 456761 - DNA, 20 bp, Artificial Sequence
  chemically synthesized
cattacatggggataaatgg

SEQ ID NO: 456762 - DNA, 20 bp, Artificial Sequence
  chemically synthesized
aggcattacatggggataaa

SEQ ID NO: 456763 - DNA, 20 bp, Artificial Sequence
  chemically synthesized
tgattagaaggcattacatg

SEQ ID NO: 456764 - DNA, 20 bp, Artificial Sequence
  chemically synthesized
gtgattagaaggcattacat

SEQ ID NO: 456765 - DNA, 20 bp, Artificial Sequence
  chemically synthesized
tgtgattagaaggcattaca

SEQ ID NO: 456766 - DNA, 20 bp, Artificial Sequence
  chemically synthesized
agaacatcagtgtgattaga

SEQ ID NO: 456767 - DNA, 20 bp, Artificial Sequence
  chemically synthesized
gagaacatcagtgtgattag

SEQ ID NO: 456768 - DNA, 20 bp, Artificial Sequence
  chemically synthesized
aacgagaacatcagtgtgat

SEQ ID NO: 456769 - DNA, 20 bp, Artificial Sequence
  chemically synthesized
agacaaaataacgagaacat

SEQ ID NO: 456770 - DNA, 20 bp, Artificial Sequence
  chemically synthesized
ttaattcaagacaaaataac

SEQ ID NO: 456771 - DNA, 20 bp, Artificial Sequence
  chemically synthesized
ataaaaagactttttaattc

SEQ ID NO: 456772 - DNA, 20 bp, Artificial Sequence
  chemically synthesized
ttattttgtcttgaattaaa

SEQ ID NO: 456773 - DNA, 20 bp, Artificial Sequence
  chemically synthesized
ataataattattataataaa

SEQ ID NO: 456774 - DNA, 20 bp, Artificial Sequence
  chemically synthesized
tataataattattatttcac

SEQ ID NO: 456775 - DNA, 20 bp, Artificial Sequence
  chemically synthesized
aattattatttcactggaaa

SEQ ID NO: 456776 - DNA, 20 bp, Artificial Sequence
  chemically synthesized
tatttatatgtagctttttc

SEQ ID NO: 456777 - DNA, 20 bp, Artificial Sequence
  chemically synthesized
tttctctttttatttatatg

SEQ ID NO: 456778 - DNA, 20 bp, Artificial Sequence
  chemically synthesized
aaaagctacatataaataaa

SEQ ID NO: 456779 - DNA, 20 bp, Artificial Sequence
  chemically synthesized
aagctacatataaataaaaa

SEQ ID NO: 456780 - DNA, 20 bp, Artificial Sequence
  chemically synthesized
tctcttggcaataaaattat

SEQ ID NO: 456781 - DNA, 20 bp, Artificial Sequence
  chemically synthesized
atacttataattttattgcc

SEQ ID NO: 456782 - DNA, 20 bp, Artificial Sequence
  chemically synthesized
acttataattttattgccaa

SEQ ID NO: 456783 - DNA, 20 bp, Artificial Sequence
  chemically synthesized
ataattttattgccaagaga

SEQ ID NO: 456784 - DNA, 20 bp, Artificial Sequence
  chemically synthesized
taaattgggtgtctatctct

SEQ ID NO: 456785 - DNA, 20 bp, Artificial Sequence
  chemically synthesized
aaatagtcttcaaataaatt

SEQ ID NO: 456786 - DNA, 20 bp, Artificial Sequence
  chemically synthesized
gaaatagtcttcaaataaat

SEQ ID NO: 456787 - DNA, 20 bp, Artificial Sequence
  chemically synthesized
atagacacccaatttatttg

SEQ ID NO: 456788 - DNA, 20 bp, Artificial Sequence
  chemically synthesized
aaaaaactgtcgtttggaaa

SEQ ID NO: 456789 - DNA, 20 bp, Artificial Sequence
  chemically synthesized
tgaagactatttccaaacga

SEQ ID NO: 456790 - DNA, 20 bp, Artificial Sequence
  chemically synthesized
acacagaaaaaactgtcgtt

SEQ ID NO: 456791 - DNA, 20 bp, Artificial Sequence
  chemically synthesized
gaaagatgaagacggagaca

SEQ ID NO: 456792 - DNA, 20 bp, Artificial Sequence
  chemically synthesized
atgtgggaaagatgaagacg

SEQ ID NO: 456793 - DNA, 20 bp, Artificial Sequence
  chemically synthesized
gaatgtgggaaagatgaaga

SEQ ID NO: 456794 - DNA, 20 bp, Artificial Sequence
  chemically synthesized
agcagaatgtgggaaagatg

SEQ ID NO: 456795 - DNA, 20 bp, Artificial Sequence
  chemically synthesized
tatcgaagcagaatgtggga

SEQ ID NO: 456796 - DNA, 20 bp, Artificial Sequence
  chemically synthesized
catatatcgaagcagaatgt

SEQ ID NO: 456797 - DNA, 20 bp, Artificial Sequence
  chemically synthesized
acatatatcgaagcagaatg

SEQ ID NO: 456798 - DNA, 20 bp, Artificial Sequence
  chemically synthesized
tagggtaacatatatcgaag

SEQ ID NO: 456799 - DNA, 20 bp, Artificial Sequence
  chemically synthesized
ttttagggtaacatatatcg

SEQ ID NO: 456800 - DNA, 20 bp, Artificial Sequence
  chemically synthesized
tatatgtagtaggattttta

SEQ ID NO: 456801 - DNA, 20 bp, Artificial Sequence
  chemically synthesized
atatatgtagtaggattttt

SEQ ID NO: 456802 - DNA, 20 bp, Artificial Sequence
  chemically synthesized
aatatatgtagtaggatttt

SEQ ID NO: 456803 - DNA, 20 bp, Artificial Sequence
  chemically synthesized
tacaaaacaatatatgtagt

SEQ ID NO: 456804 - DNA, 20 bp, Artificial Sequence
  chemically synthesized
ttacaaaacaatatatgtag

SEQ ID NO: 456805 - DNA, 20 bp, Artificial Sequence
  chemically synthesized
gagttacaaaacaatatatg

SEQ ID NO: 456806 - DNA, 20 bp, Artificial Sequence
  chemically synthesized
tattgaaaaatattacaagt

SEQ ID NO: 456807 - DNA, 20 bp, Artificial Sequence
  chemically synthesized
aaactattgaaaaatattac

SEQ ID NO: 456808 - DNA, 20 bp, Artificial Sequence
  chemically synthesized
tcacttgtaatatttttcaa

SEQ ID NO: 456809 - DNA, 20 bp, Artificial Sequence
  chemically synthesized
taatatttttcaatagtttc

SEQ ID NO: 456810 - DNA, 20 bp, Artificial Sequence
  chemically synthesized
tataaaagtagaaacatggc

SEQ ID NO: 456811 - DNA, 20 bp, Artificial Sequence
  chemically synthesized
agtatataaaagtagaaaca

SEQ ID NO: 456812 - DNA, 20 bp, Artificial Sequence
  chemically synthesized
attgtttcagtatataaaag

SEQ ID NO: 456813 - DNA, 20 bp, Artificial Sequence
  chemically synthesized
tgaattgtttcagtatataa

SEQ ID NO: 456814 - DNA, 20 bp, Artificial Sequence
  chemically synthesized
atcaaattattgaattgttt

SEQ ID NO: 456815 - DNA, 20 bp, Artificial Sequence
  chemically synthesized
gaaacaattcaataatttga

SEQ ID NO: 456816 - DNA, 20 bp, Artificial Sequence
  chemically synthesized
ttataaaatagcaaattatg

SEQ ID NO: 456817 - DNA, 20 bp, Artificial Sequence
  chemically synthesized
attatataagatttataaaa

SEQ ID NO: 456818 - DNA, 20 bp, Artificial Sequence
  chemically synthesized
tgtggtcaaataaattatat

SEQ ID NO: 456819 - DNA, 20 bp, Artificial Sequence
  chemically synthesized
cttattccctaatacaagtg

SEQ ID NO: 456820 - DNA, 20 bp, Artificial Sequence
  chemically synthesized
ttatttgaccacacttgtat

SEQ ID NO: 456821 - DNA, 20 bp, Artificial Sequence
  chemically synthesized
tatttgaccacacttgtatt

SEQ ID NO: 456822 - DNA, 20 bp, Artificial Sequence
  chemically synthesized
atttgaccacacttgtatta

SEQ ID NO: 456823 - DNA, 20 bp, Artificial Sequence
  chemically synthesized
tacatcttattccctaatac

SEQ ID NO: 456824 - DNA, 20 bp, Artificial Sequence
  chemically synthesized
ccacacttgtattagggaat

SEQ ID NO: 456825 - DNA, 20 bp, Artificial Sequence
  chemically synthesized
atttgcatgaatatacaaat

SEQ ID NO: 456826 - DNA, 20 bp, Artificial Sequence
  chemically synthesized
aatttgcatgaatatacaaa

SEQ ID NO: 456827 - DNA, 20 bp, Artificial Sequence
  chemically synthesized
tgtgtattaaatgttaaaat

SEQ ID NO: 456828 - DNA, 20 bp, Artificial Sequence
  chemically synthesized
taaatttgcttgagataatg

SEQ ID NO: 456829 - DNA, 20 bp, Artificial Sequence
  chemically synthesized
cacattgtccacattatctc

SEQ ID NO: 456830 - DNA, 20 bp, Artificial Sequence
  chemically synthesized
acattcttataaatttgctt

SEQ ID NO: 456831 - DNA, 20 bp, Artificial Sequence
  chemically synthesized
attatctcaagcaaatttat

SEQ ID NO: 456832 - DNA, 20 bp, Artificial Sequence
  chemically synthesized
gtcttgtgcagtattagtag

SEQ ID NO: 456833 - DNA, 20 bp, Artificial Sequence
  chemically synthesized
aaagtcttgtgcagtattag

SEQ ID NO: 456834 - DNA, 20 bp, Artificial Sequence
  chemically synthesized
tagaaagtcttgtgcagtat

SEQ ID NO: 456835 - DNA, 20 bp, Artificial Sequence
  chemically synthesized
ttccactactaatactgcac

SEQ ID NO: 456836 - DNA, 20 bp, Artificial Sequence
  chemically synthesized
tgaaaatagaaagtcttgtg

SEQ ID NO: 456837 - DNA, 20 bp, Artificial Sequence
  chemically synthesized
ctaagattgatgaaaataga

SEQ ID NO: 456838 - DNA, 20 bp, Artificial Sequence
  chemically synthesized
actcctaagattgatgaaaa

SEQ ID NO: 456839 - DNA, 20 bp, Artificial Sequence
  chemically synthesized
ctttctattttcatcaatct

SEQ ID NO: 456840 - DNA, 20 bp, Artificial Sequence
  chemically synthesized
tttctattttcatcaatctt

SEQ ID NO: 456841 - DNA, 20 bp, Artificial Sequence
  chemically synthesized
tctattttcatcaatcttag

SEQ ID NO: 456842 - DNA, 20 bp, Artificial Sequence
  chemically synthesized
ccaccgtggtaattactcct

SEQ ID NO: 456843 - DNA, 20 bp, Artificial Sequence
  chemically synthesized
aatcttaggagtaattacca

SEQ ID NO: 456844 - DNA, 20 bp, Artificial Sequence
  chemically synthesized
cttaggagtaattaccacgg

SEQ ID NO: 456845 - DNA, 20 bp, Artificial Sequence
  chemically synthesized
ttaggagtaattaccacggt

SEQ ID NO: 456846 - DNA, 20 bp, Artificial Sequence
  chemically synthesized
gaatgaaaacaaacccaccg

SEQ ID NO: 456847 - DNA, 20 bp, Artificial Sequence
  chemically synthesized
gttacggaagttttggggaa

SEQ ID NO: 456848 - DNA, 20 bp, Artificial Sequence
  chemically synthesized
tgttacggaagttttgggga

SEQ ID NO: 456849 - DNA, 20 bp, Artificial Sequence
  chemically synthesized
ttgttacggaagttttgggg

SEQ ID NO: 456850 - DNA, 20 bp, Artificial Sequence
  chemically synthesized
agattgttacggaagttttg

SEQ ID NO: 456851 - DNA, 20 bp, Artificial Sequence
  chemically synthesized
aagattgttacggaagtttt

SEQ ID NO: 456852 - DNA, 20 bp, Artificial Sequence
  chemically synthesized
aaagattgttacggaagttt

SEQ ID NO: 456853 - DNA, 20 bp, Artificial Sequence
  chemically synthesized
aaccccaaagattgttacgg

SEQ ID NO: 456854 - DNA, 20 bp, Artificial Sequence
  chemically synthesized
caaaaccccaaagattgtta

SEQ ID NO: 456855 - DNA, 20 bp, Artificial Sequence
  chemically synthesized
aaaacttccgtaacaatctt

SEQ ID NO: 456856 - DNA, 20 bp, Artificial Sequence
  chemically synthesized
aaacttccgtaacaatcttt

SEQ ID NO: 456857 - DNA, 20 bp, Artificial Sequence
  chemically synthesized
aacttccgtaacaatctttg

SEQ ID NO: 456858 - DNA, 20 bp, Artificial Sequence
  chemically synthesized
ggagatgtgacaaaacccca

SEQ ID NO: 456859 - DNA, 20 bp, Artificial Sequence
  chemically synthesized
aggtgatgtaggtgtgaagg

SEQ ID NO: 456860 - DNA, 20 bp, Artificial Sequence
  chemically synthesized
aaaggtgatgtaggtgtgaa

SEQ ID NO: 456861 - DNA, 20 bp, Artificial Sequence
  chemically synthesized
taaaggtgatgtaggtgtga

SEQ ID NO: 456862 - DNA, 20 bp, Artificial Sequence
  chemically synthesized
ttaaaggtgatgtaggtgtg

SEQ ID NO: 456863 - DNA, 20 bp, Artificial Sequence
  chemically synthesized
cttggttttaaaggtgatgt

SEQ ID NO: 456864 - DNA, 20 bp, Artificial Sequence
  chemically synthesized
tcttggttttaaaggtgatg

SEQ ID NO: 456865 - DNA, 20 bp, Artificial Sequence
  chemically synthesized
gtcctaactcttggttttaa

SEQ ID NO: 456866 - DNA, 20 bp, Artificial Sequence
  chemically synthesized
cctacatcacctttaaaacc

SEQ ID NO: 456867 - DNA, 20 bp, Artificial Sequence
  chemically synthesized
agtcctaactcttggtttta

SEQ ID NO: 456868 - DNA, 20 bp, Artificial Sequence
  chemically synthesized
tacatcacctttaaaaccaa

SEQ ID NO: 456869 - DNA, 20 bp, Artificial Sequence
  chemically synthesized
tcacctttaaaaccaagagt

SEQ ID NO: 456870 - DNA, 20 bp, Artificial Sequence
  chemically synthesized
cacctttaaaaccaagagtt

SEQ ID NO: 456871 - DNA, 20 bp, Artificial Sequence
  chemically synthesized
ccaaaatgagtcctaactct

SEQ ID NO: 456872 - DNA, 20 bp, Artificial Sequence
  chemically synthesized
ccaagagttaggactcattt

SEQ ID NO: 456873 - DNA, 20 bp, Artificial Sequence
  chemically synthesized
taaaaaaatgattccaaaat

SEQ ID NO: 456874 - DNA, 20 bp, Artificial Sequence
  chemically synthesized
tttggaatcatttttttata

SEQ ID NO: 456875 - DNA, 20 bp, Artificial Sequence
  chemically synthesized
tcatttttttatacagctca

SEQ ID NO: 456876 - DNA, 20 bp, Artificial Sequence
  chemically synthesized
ttttttatacagctcaaagt

SEQ ID NO: 456877 - DNA, 20 bp, Artificial Sequence
  chemically synthesized
aatataatgtaactgacttt

SEQ ID NO: 456878 - DNA, 20 bp, Artificial Sequence
  chemically synthesized
aaagtcagttacattatatt

SEQ ID NO: 456879 - DNA, 20 bp, Artificial Sequence
  chemically synthesized
tacattatatttagtaccat

SEQ ID NO: 456880 - DNA, 20 bp, Artificial Sequence
  chemically synthesized
attatatttagtaccattag

SEQ ID NO: 456881 - DNA, 20 bp, Artificial Sequence
  chemically synthesized
ggaaaatttgtatcttctaa

SEQ ID NO: 456882 - DNA, 20 bp, Artificial Sequence
  chemically synthesized
ccaacacccagaaagtgttg

SEQ ID NO: 456883 - DNA, 20 bp, Artificial Sequence
  chemically synthesized
tccaacacccagaaagtgtt

SEQ ID NO: 456884 - DNA, 20 bp, Artificial Sequence
  chemically synthesized
aaattttcctcaacactttc

SEQ ID NO: 456885 - DNA, 20 bp, Artificial Sequence
  chemically synthesized
aattttcctcaacactttct

SEQ ID NO: 456886 - DNA, 20 bp, Artificial Sequence
  chemically synthesized
ttgaggttccaacacccaga

SEQ ID NO: 456887 - DNA, 20 bp, Artificial Sequence
  chemically synthesized
cctcaacactttctgggtgt

SEQ ID NO: 456888 - DNA, 20 bp, Artificial Sequence
  chemically synthesized
agttttgaggttccaacacc

SEQ ID NO: 456889 - DNA, 20 bp, Artificial Sequence
  chemically synthesized
actcttttaaaatagttttg

SEQ ID NO: 456890 - DNA, 20 bp, Artificial Sequence
  chemically synthesized
tactcttttaaaatagtttt

SEQ ID NO: 456891 - DNA, 20 bp, Artificial Sequence
  chemically synthesized
gaacctcaaaactattttaa

SEQ ID NO: 456892 - DNA, 20 bp, Artificial Sequence
  chemically synthesized
tcttcgctactcttttaaaa

SEQ ID NO: 456893 - DNA, 20 bp, Artificial Sequence
  chemically synthesized
acctcaaaactattttaaaa

SEQ ID NO: 456894 - DNA, 20 bp, Artificial Sequence
  chemically synthesized
tcaaaactattttaaaagag

SEQ ID NO: 456895 - DNA, 20 bp, Artificial Sequence
  chemically synthesized
actattttaaaagagtagcg

SEQ ID NO: 456896 - DNA, 20 bp, Artificial Sequence
  chemically synthesized
ctattttattcatttcaaca

SEQ ID NO: 456897 - DNA, 20 bp, Artificial Sequence
  chemically synthesized
ctatgttgaaatgaataaaa

SEQ ID NO: 456898 - DNA, 20 bp, Artificial Sequence
  chemically synthesized
ataaaacatgatattcatga

SEQ ID NO: 456899 - DNA, 20 bp, Artificial Sequence
  chemically synthesized
gaatatcatgttttataaaa

SEQ ID NO: 456900 - DNA, 20 bp, Artificial Sequence
  chemically synthesized
aaacagaaatgtatcaatga

SEQ ID NO: 456901 - DNA, 20 bp, Artificial Sequence
  chemically synthesized
atgtatcaatgaaagatcat

SEQ ID NO: 456902 - DNA, 20 bp, Artificial Sequence
  chemically synthesized
tataaataacatatatttta

SEQ ID NO: 456903 - DNA, 20 bp, Artificial Sequence
  chemically synthesized
aaatatatgttatttataaa

SEQ ID NO: 456904 - DNA, 20 bp, Artificial Sequence
  chemically synthesized
tataaacagatatacatatt

SEQ ID NO: 456905 - DNA, 20 bp, Artificial Sequence
  chemically synthesized
aaacagatatacatattcgg

SEQ ID NO: 456906 - DNA, 20 bp, Artificial Sequence
  chemically synthesized
acatattcggaagatcttca

SEQ ID NO: 456907 - DNA, 20 bp, Artificial Sequence
  chemically synthesized
tattcggaagatcttcaaag

SEQ ID NO: 456908 - DNA, 20 bp, Artificial Sequence
  chemically synthesized
agaatcaatgtactactttg

SEQ ID NO: 456909 - DNA, 20 bp, Artificial Sequence
  chemically synthesized
ctctcaaatcaaatttggat

SEQ ID NO: 456910 - DNA, 20 bp, Artificial Sequence
  chemically synthesized
agtagctctcaaatcaaatt

SEQ ID NO: 456911 - DNA, 20 bp, Artificial Sequence
  chemically synthesized
ttcttatccaaatttgattt

SEQ ID NO: 456912 - DNA, 20 bp, Artificial Sequence
  chemically synthesized
cttatccaaatttgatttga

SEQ ID NO: 456913 - DNA, 20 bp, Artificial Sequence
  chemically synthesized
aaatttgatttgagagctac

SEQ ID NO: 456914 - DNA, 20 bp, Artificial Sequence
  chemically synthesized
tattacaaatttaaaaccag

SEQ ID NO: 456915 - DNA, 20 bp, Artificial Sequence
  chemically synthesized
ttgtattacaaatttaaaac

SEQ ID NO: 456916 - DNA, 20 bp, Artificial Sequence
  chemically synthesized
atttgtaatacaaattacga

SEQ ID NO: 456917 - DNA, 20 bp, Artificial Sequence
  chemically synthesized
tttgtaatacaaattacgat

SEQ ID NO: 456918 - DNA, 20 bp, Artificial Sequence
  chemically synthesized
ttgtaatacaaattacgatg

SEQ ID NO: 456919 - DNA, 20 bp, Artificial Sequence
  chemically synthesized
atacaaattacgatggggtg

SEQ ID NO: 456920 - DNA, 20 bp, Artificial Sequence
  chemically synthesized
acgatggggtgcggatttcc

SEQ ID NO: 456921 - DNA, 20 bp, Artificial Sequence
  chemically synthesized
cgatggggtgcggatttcct

SEQ ID NO: 456922 - DNA, 20 bp, Artificial Sequence
  chemically synthesized
ggggtgcggatttcctaggc

SEQ ID NO: 456923 - DNA, 20 bp, Artificial Sequence
  chemically synthesized
tgtacataaaaaactggcct

SEQ ID NO: 456924 - DNA, 20 bp, Artificial Sequence
  chemically synthesized
ttgtacataaaaaactggcc

SEQ ID NO: 456925 - DNA, 20 bp, Artificial Sequence
  chemically synthesized
ttcaattgtacataaaaaac

SEQ ID NO: 456926 - DNA, 20 bp, Artificial Sequence
  chemically synthesized
tttttatgtacaattgaatg

SEQ ID NO: 456927 - DNA, 20 bp, Artificial Sequence
  chemically synthesized
tgtatcctactatttttttg

SEQ ID NO: 456928 - DNA, 20 bp, Artificial Sequence
  chemically synthesized
gtagaaaatctacaaaaaaa

SEQ ID NO: 456929 - DNA, 20 bp, Artificial Sequence
  chemically synthesized
gaaaatctacaaaaaaatag

SEQ ID NO: 456930 - DNA, 20 bp, Artificial Sequence
  chemically synthesized
aaaatctacaaaaaaatagt

SEQ ID NO: 456931 - DNA, 20 bp, Artificial Sequence
  chemically synthesized
aaaatagtaggatacaatcc

SEQ ID NO: 456932 - DNA, 20 bp, Artificial Sequence
  chemically synthesized
taggatacaatcctggattt

SEQ ID NO: 456933 - DNA, 20 bp, Artificial Sequence
  chemically synthesized
gtctccagaatccaaaatcc

SEQ ID NO: 456934 - DNA, 20 bp, Artificial Sequence
  chemically synthesized
tgtctccagaatccaaaatc

SEQ ID NO: 456935 - DNA, 20 bp, Artificial Sequence
  chemically synthesized
caatcctggattttggattc

SEQ ID NO: 456936 - DNA, 20 bp, Artificial Sequence
  chemically synthesized
atcctggattttggattctg

SEQ ID NO: 456937 - DNA, 20 bp, Artificial Sequence
  chemically synthesized
tggattttggattctggaga

SEQ ID NO: 456938 - DNA, 20 bp, Artificial Sequence
  chemically synthesized
attttggattctggagacag

SEQ ID NO: 456939 - DNA, 20 bp, Artificial Sequence
  chemically synthesized
acaatgtggtccactgtctc

SEQ ID NO: 456940 - DNA, 20 bp, Artificial Sequence
  chemically synthesized
agacagtggaccacattgta

SEQ ID NO: 456941 - DNA, 20 bp, Artificial Sequence
  chemically synthesized
attcaatcacctatacaatg

SEQ ID NO: 456942 - DNA, 20 bp, Artificial Sequence
  chemically synthesized
gacagtggaccacattgtat

SEQ ID NO: 456943 - DNA, 20 bp, Artificial Sequence
  chemically synthesized
ggtgattgaatgaatgaaat

SEQ ID NO: 456944 - DNA, 20 bp, Artificial Sequence
  chemically synthesized
gattgaatgaatgaaatgag

SEQ ID NO: 456945 - DNA, 20 bp, Artificial Sequence
  chemically synthesized
gaatgaaatgagaagatata

SEQ ID NO: 456946 - DNA, 20 bp, Artificial Sequence
  chemically synthesized
aatgagaagatatatagatg

SEQ ID NO: 456947 - DNA, 20 bp, Artificial Sequence
  chemically synthesized
atatatagatgaagaaaaaa

SEQ ID NO: 456948 - DNA, 20 bp, Artificial Sequence
  chemically synthesized
atagatgaagaaaaaaaaga

SEQ ID NO: 456949 - DNA, 20 bp, Artificial Sequence
  chemically synthesized
aaaaagaaagaaaatataca

SEQ ID NO: 456950 - DNA, 20 bp, Artificial Sequence
  chemically synthesized
aaaagaaagaaaatatacaa

SEQ ID NO: 456951 - DNA, 20 bp, Artificial Sequence
  chemically synthesized
aagaaagaaaatatacaaag

SEQ ID NO: 456952 - DNA, 20 bp, Artificial Sequence
  chemically synthesized
agaaagaaaatatacaaagg

SEQ ID NO: 456953 - DNA, 20 bp, Artificial Sequence
  chemically synthesized
aaagaaaatatacaaaggag

SEQ ID NO: 456954 - DNA, 20 bp, Artificial Sequence
  chemically synthesized
tatacaaaggaggagatgat

SEQ ID NO: 456955 - DNA, 20 bp, Artificial Sequence
  chemically synthesized
tacaaaggaggagatgattg

SEQ ID NO: 456956 - DNA, 20 bp, Artificial Sequence
  chemically synthesized
acaaaggaggagatgattgg

SEQ ID NO: 456957 - DNA, 20 bp, Artificial Sequence
  chemically synthesized
ggagatgattggaggaaaaa

SEQ ID NO: 456958 - DNA, 20 bp, Artificial Sequence
  chemically synthesized
attggaggaaaaacagatgc

SEQ ID NO: 456959 - DNA, 20 bp, Artificial Sequence
  chemically synthesized
ttggaggaaaaacagatgcc

SEQ ID NO: 456960 - DNA, 20 bp, Artificial Sequence
  chemically synthesized
ggaaaaacagatgccaggac

SEQ ID NO: 456961 - DNA, 20 bp, Artificial Sequence
  chemically synthesized
tatacttcagaatcttgtcc

SEQ ID NO: 456962 - DNA, 20 bp, Artificial Sequence
  chemically synthesized
gatgccaggacaagattctg

SEQ ID NO: 456963 - DNA, 20 bp, Artificial Sequence
  chemically synthesized
aaaaccaaaaatatatactt

SEQ ID NO: 456964 - DNA, 20 bp, Artificial Sequence
  chemically synthesized
gattctgaagtatatatttt

SEQ ID NO: 456965 - DNA, 20 bp, Artificial Sequence
  chemically synthesized
gtttaataggtgagggataa

SEQ ID NO: 456966 - DNA, 20 bp, Artificial Sequence
  chemically synthesized
aaacagggtttaataggtga

SEQ ID NO: 456967 - DNA, 20 bp, Artificial Sequence
  chemically synthesized
gaaacagggtttaataggtg

SEQ ID NO: 456968 - DNA, 20 bp, Artificial Sequence
  chemically synthesized
tgaaacagggtttaataggt

SEQ ID NO: 456969 - DNA, 20 bp, Artificial Sequence
  chemically synthesized
caaatgaaacagggtttaat

SEQ ID NO: 456970 - DNA, 20 bp, Artificial Sequence
  chemically synthesized
tcaaatgaaacagggtttaa

SEQ ID NO: 456971 - DNA, 20 bp, Artificial Sequence
  chemically synthesized
agtaggagtcaaatgaaaca

SEQ ID NO: 456972 - DNA, 20 bp, Artificial Sequence
  chemically synthesized
gagtaggagtcaaatgaaac

SEQ ID NO: 456973 - DNA, 20 bp, Artificial Sequence
  chemically synthesized
agagtaggagtcaaatgaaa

SEQ ID NO: 456974 - DNA, 20 bp, Artificial Sequence
  chemically synthesized
gaggttagaaaatagagtag

SEQ ID NO: 456975 - DNA, 20 bp, Artificial Sequence
  chemically synthesized
atgaggttagaaaatagagt

SEQ ID NO: 456976 - DNA, 20 bp, Artificial Sequence
  chemically synthesized
gatgaggttagaaaatagag

SEQ ID NO: 456977 - DNA, 20 bp, Artificial Sequence
  chemically synthesized
ggagatgaggttagaaaata

SEQ ID NO: 456978 - DNA, 20 bp, Artificial Sequence
  chemically synthesized
tgggagatgaggttagaaaa

SEQ ID NO: 456979 - DNA, 20 bp, Artificial Sequence
  chemically synthesized
gcaacaatgggagatgaggt

SEQ ID NO: 456980 - DNA, 20 bp, Artificial Sequence
  chemically synthesized
aagagcaacaatgggagatg

SEQ ID NO: 456981 - DNA, 20 bp, Artificial Sequence
  chemically synthesized
taagagcaacaatgggagat

SEQ ID NO: 456982 - DNA, 20 bp, Artificial Sequence
  chemically synthesized
aatggtaagagcaacaatgg

SEQ ID NO: 456983 - DNA, 20 bp, Artificial Sequence
  chemically synthesized
gcaatggtaagagcaacaat

SEQ ID NO: 456984 - DNA, 20 bp, Artificial Sequence
  chemically synthesized
ggcaatggtaagagcaacaa

SEQ ID NO: 456985 - DNA, 20 bp, Artificial Sequence
  chemically synthesized
agtagagagggcaatggtaa

SEQ ID NO: 456986 - DNA, 20 bp, Artificial Sequence
  chemically synthesized
ggagtagagagggcaatggt

SEQ ID NO: 456987 - DNA, 20 bp, Artificial Sequence
  chemically synthesized
ggttggagtagagagggcaa

SEQ ID NO: 456988 - DNA, 20 bp, Artificial Sequence
  chemically synthesized
ttgtgtggttggagtagaga

SEQ ID NO: 456989 - DNA, 20 bp, Artificial Sequence
  chemically synthesized
cttgtgtggttggagtagag

SEQ ID NO: 456990 - DNA, 20 bp, Artificial Sequence
  chemically synthesized
acttgtgtggttggagtaga

SEQ ID NO: 456991 - DNA, 20 bp, Artificial Sequence
  chemically synthesized
tgacttgtgtggttggagta

SEQ ID NO: 456992 - DNA, 20 bp, Artificial Sequence
  chemically synthesized
attgacttgtgtggttggag

SEQ ID NO: 456993 - DNA, 20 bp, Artificial Sequence
  chemically synthesized
aaaattgacttgtgtggttg

SEQ ID NO: 456994 - DNA, 20 bp, Artificial Sequence
  chemically synthesized
cctctctactccaaccacac

SEQ ID NO: 456995 - DNA, 20 bp, Artificial Sequence
  chemically synthesized
gaaaaattgacttgtgtggt

SEQ ID NO: 456996 - DNA, 20 bp, Artificial Sequence
  chemically synthesized
agcagaaaaattgacttgtg

SEQ ID NO: 456997 - DNA, 20 bp, Artificial Sequence
  chemically synthesized
atggactaaaaaaagagaag

SEQ ID NO: 456998 - DNA, 20 bp, Artificial Sequence
  chemically synthesized
ggaatggactaaaaaaagag

SEQ ID NO: 456999 - DNA, 20 bp, Artificial Sequence
  chemically synthesized
tttttctgcttctctttttt

SEQ ID NO: 457000 - DNA, 20 bp, Artificial Sequence
  chemically synthesized
ggaggaatggactaaaaaaa

SEQ ID NO: 457001 - DNA, 20 bp, Artificial Sequence
  chemically synthesized
agggaggaatggactaaaaa

SEQ ID NO: 457002 - DNA, 20 bp, Artificial Sequence
  chemically synthesized
aggaagcacaaagggaggaa

SEQ ID NO: 457003 - DNA, 20 bp, Artificial Sequence
  chemically synthesized
gaaacaggaagcacaaaggg

SEQ ID NO: 457004 - DNA, 20 bp, Artificial Sequence
  chemically synthesized
ggaaacaggaagcacaaagg

SEQ ID NO: 457005 - DNA, 20 bp, Artificial Sequence
  chemically synthesized
agggaaacaggaagcacaaa

SEQ ID NO: 457006 - DNA, 20 bp, Artificial Sequence
  chemically synthesized
tagggaaacaggaagcacaa

SEQ ID NO: 457007 - DNA, 20 bp, Artificial Sequence
  chemically synthesized
atagggaaacaggaagcaca

SEQ ID NO: 457008 - DNA, 20 bp, Artificial Sequence
  chemically synthesized
attctatatagggaaacagg

SEQ ID NO: 457009 - DNA, 20 bp, Artificial Sequence
  chemically synthesized
agaattctatatagggaaac

SEQ ID NO: 457010 - DNA, 20 bp, Artificial Sequence
  chemically synthesized
cagaattctatatagggaaa

SEQ ID NO: 457011 - DNA, 20 bp, Artificial Sequence
  chemically synthesized
gtgcttcctgtttccctata

SEQ ID NO: 457012 - DNA, 20 bp, Artificial Sequence
  chemically synthesized
ggataacagaattctatata

SEQ ID NO: 457013 - DNA, 20 bp, Artificial Sequence
  chemically synthesized
tggataacagaattctatat

SEQ ID NO: 457014 - DNA, 20 bp, Artificial Sequence
  chemically synthesized
ctggataacagaattctata

SEQ ID NO: 457015 - DNA, 20 bp, Artificial Sequence
  chemically synthesized
ctatatagaattctgttatc

SEQ ID NO: 457016 - DNA, 20 bp, Artificial Sequence
  chemically synthesized
acatgtgatgatctggataa

SEQ ID NO: 457017 - DNA, 20 bp, Artificial Sequence
  chemically synthesized
gacctatacatgtgatgatc

SEQ ID NO: 457018 - DNA, 20 bp, Artificial Sequence
  chemically synthesized
tatccagatcatcacatgta

SEQ ID NO: 457019 - DNA, 20 bp, Artificial Sequence
  chemically synthesized
atccagatcatcacatgtat

SEQ ID NO: 457020 - DNA, 20 bp, Artificial Sequence
  chemically synthesized
ctgatacatgagataataga

SEQ ID NO: 457021 - DNA, 20 bp, Artificial Sequence
  chemically synthesized
tgagctgatacatgagataa

SEQ ID NO: 457022 - DNA, 20 bp, Artificial Sequence
  chemically synthesized
ctgtctattatctcatgtat

SEQ ID NO: 457023 - DNA, 20 bp, Artificial Sequence
  chemically synthesized
tgatagctgagctgatacat

SEQ ID NO: 457024 - DNA, 20 bp, Artificial Sequence
  chemically synthesized
tattatctcatgtatcagct

SEQ ID NO: 457025 - DNA, 20 bp, Artificial Sequence
  chemically synthesized
actatgaagcagtgatagct

SEQ ID NO: 457026 - DNA, 20 bp, Artificial Sequence
  chemically synthesized
aggccactatgaagcagtga

SEQ ID NO: 457027 - DNA, 20 bp, Artificial Sequence
  chemically synthesized
gctcagctatcactgcttca

SEQ ID NO: 457028 - DNA, 20 bp, Artificial Sequence
  chemically synthesized
aagggaaggccactatgaag

SEQ ID NO: 457029 - DNA, 20 bp, Artificial Sequence
  chemically synthesized
cagctatcactgcttcatag

SEQ ID NO: 457030 - DNA, 20 bp, Artificial Sequence
  chemically synthesized
gaaaagggaaggccactatg

SEQ ID NO: 457031 - DNA, 20 bp, Artificial Sequence
  chemically synthesized
ctcaattcaaagaaaaggga

SEQ ID NO: 457032 - DNA, 20 bp, Artificial Sequence
  chemically synthesized
tctcaattcaaagaaaaggg

SEQ ID NO: 457033 - DNA, 20 bp, Artificial Sequence
  chemically synthesized
gcttctcaattcaaagaaaa

SEQ ID NO: 457034 - DNA, 20 bp, Artificial Sequence
  chemically synthesized
ggcttctcaattcaaagaaa

SEQ ID NO: 457035 - DNA, 20 bp, Artificial Sequence
  chemically synthesized
gggcttctcaattcaaagaa

SEQ ID NO: 457036 - DNA, 20 bp, Artificial Sequence
  chemically synthesized
ccttcccttttctttgaatt

SEQ ID NO: 457037 - DNA, 20 bp, Artificial Sequence
  chemically synthesized
tttaagggcttctcaattca

SEQ ID NO: 457038 - DNA, 20 bp, Artificial Sequence
  chemically synthesized
tcccttttctttgaattgag

SEQ ID NO: 457039 - DNA, 20 bp, Artificial Sequence
  chemically synthesized
aattgagaagcccttaaatc

SEQ ID NO: 457040 - DNA, 20 bp, Artificial Sequence
  chemically synthesized
gtgagtgaatctggatttaa

SEQ ID NO: 457041 - DNA, 20 bp, Artificial Sequence
  chemically synthesized
agtgagtgaatctggattta

SEQ ID NO: 457042 - DNA, 20 bp, Artificial Sequence
  chemically synthesized
tagtgagtgaatctggattt

SEQ ID NO: 457043 - DNA, 20 bp, Artificial Sequence
  chemically synthesized
taacctatagtgagtgaatc

SEQ ID NO: 457044 - DNA, 20 bp, Artificial Sequence
  chemically synthesized
aaatccagattcactcacta

SEQ ID NO: 457045 - DNA, 20 bp, Artificial Sequence
  chemically synthesized
aatccagattcactcactat

SEQ ID NO: 457046 - DNA, 20 bp, Artificial Sequence
  chemically synthesized
ataatcacataacctatagt

SEQ ID NO: 457047 - DNA, 20 bp, Artificial Sequence
  chemically synthesized
agggataatcacataaccta

SEQ ID NO: 457048 - DNA, 20 bp, Artificial Sequence
  chemically synthesized
tttaaagaatatgattttga

SEQ ID NO: 457049 - DNA, 20 bp, Artificial Sequence
  chemically synthesized
atttaaagaatatgattttg

SEQ ID NO: 457050 - DNA, 20 bp, Artificial Sequence
  chemically synthesized
tatttaaagaatatgatttt

SEQ ID NO: 457051 - DNA, 20 bp, Artificial Sequence
  chemically synthesized
agataaaaatcaaatattta

SEQ ID NO: 457052 - DNA, 20 bp, Artificial Sequence
  chemically synthesized
tgatttttatcttttctcac

SEQ ID NO: 457053 - DNA, 20 bp, Artificial Sequence
  chemically synthesized
agcatacttactagtgagaa

SEQ ID NO: 457054 - DNA, 20 bp, Artificial Sequence
  chemically synthesized
ttttatcttttctcactagt

SEQ ID NO: 457055 - DNA, 20 bp, Artificial Sequence
  chemically synthesized
cacagagcatacttactagt

SEQ ID NO: 457056 - DNA, 20 bp, Artificial Sequence
  chemically synthesized
ttttcacagagcatacttac

SEQ ID NO: 457057 - DNA, 20 bp, Artificial Sequence
  chemically synthesized
gacatcgcctggttttcaca

SEQ ID NO: 457058 - DNA, 20 bp, Artificial Sequence
  chemically synthesized
taagtatgctctgtgaaaac

SEQ ID NO: 457059 - DNA, 20 bp, Artificial Sequence
  chemically synthesized
gagacatcgcctggttttca

SEQ ID NO: 457060 - DNA, 20 bp, Artificial Sequence
  chemically synthesized
aagtatgctctgtgaaaacc

SEQ ID NO: 457061 - DNA, 20 bp, Artificial Sequence
  chemically synthesized
ggtgaaaaagagacatcgcc

SEQ ID NO: 457062 - DNA, 20 bp, Artificial Sequence
  chemically synthesized
gacaggtctagggtgaaaaa

SEQ ID NO: 457063 - DNA, 20 bp, Artificial Sequence
  chemically synthesized
ctgacaggtctagggtgaaa

SEQ ID NO: 457064 - DNA, 20 bp, Artificial Sequence
  chemically synthesized
gcgatgtctctttttcaccc

SEQ ID NO: 457065 - DNA, 20 bp, Artificial Sequence
  chemically synthesized
attaggcactgacaggtcta

SEQ ID NO: 457066 - DNA, 20 bp, Artificial Sequence
  chemically synthesized
tattaggcactgacaggtct

SEQ ID NO: 457067 - DNA, 20 bp, Artificial Sequence
  chemically synthesized
ctttttcaccctagacctgt

SEQ ID NO: 457068 - DNA, 20 bp, Artificial Sequence
  chemically synthesized
atattaggcactgacaggtc

SEQ ID NO: 457069 - DNA, 20 bp, Artificial Sequence
  chemically synthesized
gtactatattaggcactgac

SEQ ID NO: 457070 - DNA, 20 bp, Artificial Sequence
  chemically synthesized
ggtactatattaggcactga

SEQ ID NO: 457071 - DNA, 20 bp, Artificial Sequence
  chemically synthesized
agacctgtcagtgcctaata

SEQ ID NO: 457072 - DNA, 20 bp, Artificial Sequence
  chemically synthesized
tatagccaaggtactatatt

SEQ ID NO: 457073 - DNA, 20 bp, Artificial Sequence
  chemically synthesized
ctatagccaaggtactatat

SEQ ID NO: 457074 - DNA, 20 bp, Artificial Sequence
  chemically synthesized
cagtgcctaatatagtacct

SEQ ID NO: 457075 - DNA, 20 bp, Artificial Sequence
  chemically synthesized
ctaatatagtaccttggcta

SEQ ID NO: 457076 - DNA, 20 bp, Artificial Sequence
  chemically synthesized
ctgacaacctgctatagcca

SEQ ID NO: 457077 - DNA, 20 bp, Artificial Sequence
  chemically synthesized
actgacaacctgctatagcc

SEQ ID NO: 457078 - DNA, 20 bp, Artificial Sequence
  chemically synthesized
atatagtaccttggctatag

SEQ ID NO: 457079 - DNA, 20 bp, Artificial Sequence
  chemically synthesized
tatagtaccttggctatagc

SEQ ID NO: 457080 - DNA, 20 bp, Artificial Sequence
  chemically synthesized
gagtcactgacaacctgcta

SEQ ID NO: 457081 - DNA, 20 bp, Artificial Sequence
  chemically synthesized
ccttggctatagcaggttgt

SEQ ID NO: 457082 - DNA, 20 bp, Artificial Sequence
  chemically synthesized
tctaatctcaatgaatgcaa

SEQ ID NO: 457083 - DNA, 20 bp, Artificial Sequence
  chemically synthesized
gttctaatctcaatgaatgc

SEQ ID NO: 457084 - DNA, 20 bp, Artificial Sequence
  chemically synthesized
cagtgactcttgcattcatt

SEQ ID NO: 457085 - DNA, 20 bp, Artificial Sequence
  chemically synthesized
actcttgcattcattgagat

SEQ ID NO: 457086 - DNA, 20 bp, Artificial Sequence
  chemically synthesized
cattcattgagattagaact

SEQ ID NO: 457087 - DNA, 20 bp, Artificial Sequence
  chemically synthesized
tgagattagaactgagctac

SEQ ID NO: 457088 - DNA, 20 bp, Artificial Sequence
  chemically synthesized
attttctgtcacttgtagct

SEQ ID NO: 457089 - DNA, 20 bp, Artificial Sequence
  chemically synthesized
tagaactgagctacaagtga

SEQ ID NO: 457090 - DNA, 20 bp, Artificial Sequence
  chemically synthesized
tttggattttctgtcacttg

SEQ ID NO: 457091 - DNA, 20 bp, Artificial Sequence
  chemically synthesized
gttcctgatattggttattt

SEQ ID NO: 457092 - DNA, 20 bp, Artificial Sequence
  chemically synthesized
aaatccaaaataaccaatat

SEQ ID NO: 457093 - DNA, 20 bp, Artificial Sequence
  chemically synthesized
aatccaaaataaccaatatc

SEQ ID NO: 457094 - DNA, 20 bp, Artificial Sequence
  chemically synthesized
acttccattgttcctgatat

SEQ ID NO: 457095 - DNA, 20 bp, Artificial Sequence
  chemically synthesized
ataaccaatatcaggaacaa

SEQ ID NO: 457096 - DNA, 20 bp, Artificial Sequence
  chemically synthesized
accaatatcaggaacaatgg

SEQ ID NO: 457097 - DNA, 20 bp, Artificial Sequence
  chemically synthesized
ctgtctcttcttatttcaga

SEQ ID NO: 457098 - DNA, 20 bp, Artificial Sequence
  chemically synthesized
agtttgcatctttctgaaat

SEQ ID NO: 457099 - DNA, 20 bp, Artificial Sequence
  chemically synthesized
ttgcatctttctgaaataag

SEQ ID NO: 457100 - DNA, 20 bp, Artificial Sequence
  chemically synthesized
tcaactgtctcttcttattt

SEQ ID NO: 457101 - DNA, 20 bp, Artificial Sequence
  chemically synthesized
gcatctttctgaaataagaa

SEQ ID NO: 457102 - DNA, 20 bp, Artificial Sequence
  chemically synthesized
ctttctgaaataagaagaga

SEQ ID NO: 457103 - DNA, 20 bp, Artificial Sequence
  chemically synthesized
tgaaataagaagagacagtt

SEQ ID NO: 457104 - DNA, 20 bp, Artificial Sequence
  chemically synthesized
aaataagaagagacagttga

SEQ ID NO: 457105 - DNA, 20 bp, Artificial Sequence
  chemically synthesized
aataagaagagacagttgag

SEQ ID NO: 457106 - DNA, 20 bp, Artificial Sequence
  chemically synthesized
aagaagagacagttgagagg

SEQ ID NO: 457107 - DNA, 20 bp, Artificial Sequence
  chemically synthesized
gagacagttgagaggcagta

SEQ ID NO: 457108 - DNA, 20 bp, Artificial Sequence
  chemically synthesized
acagttgagaggcagtacag

SEQ ID NO: 457109 - DNA, 20 bp, Artificial Sequence
  chemically synthesized
caatgtccctgatgatcatg

SEQ ID NO: 457110 - DNA, 20 bp, Artificial Sequence
  chemically synthesized
tacagtggctccatgatcat

SEQ ID NO: 457111 - DNA, 20 bp, Artificial Sequence
  chemically synthesized
tccaatgtccctgatgatca

SEQ ID NO: 457112 - DNA, 20 bp, Artificial Sequence
  chemically synthesized
acagtggctccatgatcatc

SEQ ID NO: 457113 - DNA, 20 bp, Artificial Sequence
  chemically synthesized
cagtggctccatgatcatca

SEQ ID NO: 457114 - DNA, 20 bp, Artificial Sequence
  chemically synthesized
tccatgatcatcagggacat

SEQ ID NO: 457115 - DNA, 20 bp, Artificial Sequence
  chemically synthesized
cattggacaatttatattat

SEQ ID NO: 457116 - DNA, 20 bp, Artificial Sequence
  chemically synthesized
atggaagttgtatgttgaag

SEQ ID NO: 457117 - DNA, 20 bp, Artificial Sequence
  chemically synthesized
aaaatggaagttgtatgttg

SEQ ID NO: 457118 - DNA, 20 bp, Artificial Sequence
  chemically synthesized
ccatctggactacaaaatgg

SEQ ID NO: 457119 - DNA, 20 bp, Artificial Sequence
  chemically synthesized
aacatacaacttccattttg

SEQ ID NO: 457120 - DNA, 20 bp, Artificial Sequence
  chemically synthesized
tagccatctggactacaaaa

SEQ ID NO: 457121 - DNA, 20 bp, Artificial Sequence
  chemically synthesized
acaacttccattttgtagtc

SEQ ID NO: 457122 - DNA, 20 bp, Artificial Sequence
  chemically synthesized
cttccattttgtagtccaga

SEQ ID NO: 457123 - DNA, 20 bp, Artificial Sequence
  chemically synthesized
ttggagcttgaatagccatc

SEQ ID NO: 457124 - DNA, 20 bp, Artificial Sequence
  chemically synthesized
tgtagtccagatggctattc

SEQ ID NO: 457125 - DNA, 20 bp, Artificial Sequence
  chemically synthesized
tgtgatgattggagcttgaa

SEQ ID NO: 457126 - DNA, 20 bp, Artificial Sequence
  chemically synthesized
ggatggcaatgtgatgattg

SEQ ID NO: 457127 - DNA, 20 bp, Artificial Sequence
  chemically synthesized
ttggatggcaatgtgatgat

SEQ ID NO: 457128 - DNA, 20 bp, Artificial Sequence
  chemically synthesized
caatcatcacattgccatcc

SEQ ID NO: 457129 - DNA, 20 bp, Artificial Sequence
  chemically synthesized
atttctcactgttacttgga

SEQ ID NO: 457130 - DNA, 20 bp, Artificial Sequence
  chemically synthesized
tcacattgccatccaagtaa

SEQ ID NO: 457131 - DNA, 20 bp, Artificial Sequence
  chemically synthesized
tgttatttctcactgttact

SEQ ID NO: 457132 - DNA, 20 bp, Artificial Sequence
  chemically synthesized
attgccatccaagtaacagt

SEQ ID NO: 457133 - DNA, 20 bp, Artificial Sequence
  chemically synthesized
aagtaacagtgagaaataac

SEQ ID NO: 457134 - DNA, 20 bp, Artificial Sequence
  chemically synthesized
agtaacagtgagaaataaca

SEQ ID NO: 457135 - DNA, 20 bp, Artificial Sequence
  chemically synthesized
aacagtgagaaataacaagg

SEQ ID NO: 457136 - DNA, 20 bp, Artificial Sequence
  chemically synthesized
gtgagaaataacaaggaaga

SEQ ID NO: 457137 - DNA, 20 bp, Artificial Sequence
  chemically synthesized
tgagaaataacaaggaagat

SEQ ID NO: 457138 - DNA, 20 bp, Artificial Sequence
  chemically synthesized
gagaaataacaaggaagata

SEQ ID NO: 457139 - DNA, 20 bp, Artificial Sequence
  chemically synthesized
agaaataacaaggaagatag

SEQ ID NO: 457140 - DNA, 20 bp, Artificial Sequence
  chemically synthesized
aataacaaggaagatagggg

SEQ ID NO: 457141 - DNA, 20 bp, Artificial Sequence
  chemically synthesized
acaaggaagataggggaaga

SEQ ID NO: 457142 - DNA, 20 bp, Artificial Sequence
  chemically synthesized
ggaagatggacttctcttcc

SEQ ID NO: 457143 - DNA, 20 bp, Artificial Sequence
  chemically synthesized
tgtgaaacttctaggaagag

SEQ ID NO: 457144 - DNA, 20 bp, Artificial Sequence
  chemically synthesized
agatggacttctcttcctag

SEQ ID NO: 457145 - DNA, 20 bp, Artificial Sequence
  chemically synthesized
atgtgtgaaacttctaggaa

SEQ ID NO: 457146 - DNA, 20 bp, Artificial Sequence
  chemically synthesized
taatgtgtgaaacttctagg

SEQ ID NO: 457147 - DNA, 20 bp, Artificial Sequence
  chemically synthesized
aattaatgtgtgaaacttct

SEQ ID NO: 457148 - DNA, 20 bp, Artificial Sequence
  chemically synthesized
gaattaatgtgtgaaacttc

SEQ ID NO: 457149 - DNA, 20 bp, Artificial Sequence
  chemically synthesized
tggttctgataggacataat

SEQ ID NO: 457150 - DNA, 20 bp, Artificial Sequence
  chemically synthesized
taattcttattatgtcctat

SEQ ID NO: 457151 - DNA, 20 bp, Artificial Sequence
  chemically synthesized
tcatgtgacctggttctgat

SEQ ID NO: 457152 - DNA, 20 bp, Artificial Sequence
  chemically synthesized
ttattatgtcctatcagaac

SEQ ID NO: 457153 - DNA, 20 bp, Artificial Sequence
  chemically synthesized
atcatgtgacctggttctga

SEQ ID NO: 457154 - DNA, 20 bp, Artificial Sequence
  chemically synthesized
tattatgtcctatcagaacc

SEQ ID NO: 457155 - DNA, 20 bp, Artificial Sequence
  chemically synthesized
ctaggtatgatcatgtgacc

SEQ ID NO: 457156 - DNA, 20 bp, Artificial Sequence
  chemically synthesized
ccaggtcacatgatcatacc

SEQ ID NO: 457157 - DNA, 20 bp, Artificial Sequence
  chemically synthesized
tttcatcctccattgcagct

SEQ ID NO: 457158 - DNA, 20 bp, Artificial Sequence
  chemically synthesized
atgatcatacctagctgcaa

SEQ ID NO: 457159 - DNA, 20 bp, Artificial Sequence
  chemically synthesized
ttttcatcctccattgcagc

SEQ ID NO: 457160 - DNA, 20 bp, Artificial Sequence
  chemically synthesized
gatcatacctagctgcaatg

SEQ ID NO: 457161 - DNA, 20 bp, Artificial Sequence
  chemically synthesized
atcatacctagctgcaatgg

SEQ ID NO: 457162 - DNA, 20 bp, Artificial Sequence
  chemically synthesized
aaatttttcatcctccattg

SEQ ID NO: 457163 - DNA, 20 bp, Artificial Sequence
  chemically synthesized
gaaaaatttaaactttattg

SEQ ID NO: 457164 - DNA, 20 bp, Artificial Sequence
  chemically synthesized
aaaaatttaaactttattgt

SEQ ID NO: 457165 - DNA, 20 bp, Artificial Sequence
  chemically synthesized
taaatgaacatcctacaata

SEQ ID NO: 457166 - DNA, 20 bp, Artificial Sequence
  chemically synthesized
ttattgtaggatgttcattt

SEQ ID NO: 457167 - DNA, 20 bp, Artificial Sequence
  chemically synthesized
tagaggcaggtatcgagaga

SEQ ID NO: 457168 - DNA, 20 bp, Artificial Sequence
  chemically synthesized
ctagaggcaggtatcgagag

SEQ ID NO: 457169 - DNA, 20 bp, Artificial Sequence
  chemically synthesized
cctagaggcaggtatcgaga

SEQ ID NO: 457170 - DNA, 20 bp, Artificial Sequence
  chemically synthesized
agcctagaggcaggtatcga

SEQ ID NO: 457171 - DNA, 20 bp, Artificial Sequence
  chemically synthesized
ttagcctagaggcaggtatc

SEQ ID NO: 457172 - DNA, 20 bp, Artificial Sequence
  chemically synthesized
cctctctcgatacctgcctc

SEQ ID NO: 457173 - DNA, 20 bp, Artificial Sequence
  chemically synthesized
ctctctcgatacctgcctct

SEQ ID NO: 457174 - DNA, 20 bp, Artificial Sequence
  chemically synthesized
tatatgtttagcctagaggc

SEQ ID NO: 457175 - DNA, 20 bp, Artificial Sequence
  chemically synthesized
ttatatgtttagcctagagg

SEQ ID NO: 457176 - DNA, 20 bp, Artificial Sequence
  chemically synthesized
cttttatatgtttagcctag

SEQ ID NO: 457177 - DNA, 20 bp, Artificial Sequence
  chemically synthesized
ccttttatatgtttagccta

SEQ ID NO: 457178 - DNA, 20 bp, Artificial Sequence
  chemically synthesized
ttccttttatatgtttagcc

SEQ ID NO: 457179 - DNA, 20 bp, Artificial Sequence
  chemically synthesized
acgggttccttttatatgtt

SEQ ID NO: 457180 - DNA, 20 bp, Artificial Sequence
  chemically synthesized
cctctaggctaaacatataa

SEQ ID NO: 457181 - DNA, 20 bp, Artificial Sequence
  chemically synthesized
ctctaggctaaacatataaa

SEQ ID NO: 457182 - DNA, 20 bp, Artificial Sequence
  chemically synthesized
ggggtgagttagtgagaaac

SEQ ID NO: 457183 - DNA, 20 bp, Artificial Sequence
  chemically synthesized
tggggtgagttagtgagaaa

SEQ ID NO: 457184 - DNA, 20 bp, Artificial Sequence
  chemically synthesized
ttggtttggggtgagttagt

SEQ ID NO: 457185 - DNA, 20 bp, Artificial Sequence
  chemically synthesized
attattggtttggggtgagt

SEQ ID NO: 457186 - DNA, 20 bp, Artificial Sequence
  chemically synthesized
atgaattattggtttggggt

SEQ ID NO: 457187 - DNA, 20 bp, Artificial Sequence
  chemically synthesized
cactatgaattattggtttg

SEQ ID NO: 457188 - DNA, 20 bp, Artificial Sequence
  chemically synthesized
acactatgaattattggttt

SEQ ID NO: 457189 - DNA, 20 bp, Artificial Sequence
  chemically synthesized
tacactatgaattattggtt

SEQ ID NO: 457190 - DNA, 20 bp, Artificial Sequence
  chemically synthesized
ttagctacactatgaattat

SEQ ID NO: 457191 - DNA, 20 bp, Artificial Sequence
  chemically synthesized
caccccaaaccaataattca

SEQ ID NO: 457192 - DNA, 20 bp, Artificial Sequence
  chemically synthesized
caaaccaataattcatagtg

SEQ ID NO: 457193 - DNA, 20 bp, Artificial Sequence
  chemically synthesized
ttcatagtgtagctaatatt

SEQ ID NO: 457194 - DNA, 20 bp, Artificial Sequence
  chemically synthesized
tttggacacatacttaatat

SEQ ID NO: 457195 - DNA, 20 bp, Artificial Sequence
  chemically synthesized
aatattaagtatgtgtccaa

SEQ ID NO: 457196 - DNA, 20 bp, Artificial Sequence
  chemically synthesized
atattaagtatgtgtccaaa

SEQ ID NO: 457197 - DNA, 20 bp, Artificial Sequence
  chemically synthesized
ttaagtatgtgtccaaaagg

SEQ ID NO: 457198 - DNA, 20 bp, Artificial Sequence
  chemically synthesized
ttgggcagttatctaccttt

SEQ ID NO: 457199 - DNA, 20 bp, Artificial Sequence
  chemically synthesized
aagaatataaaacgtttggg

SEQ ID NO: 457200 - DNA, 20 bp, Artificial Sequence
  chemically synthesized
aggaagaatataaaacgttt

SEQ ID NO: 457201 - DNA, 20 bp, Artificial Sequence
  chemically synthesized
gaggaagaatataaaacgtt

SEQ ID NO: 457202 - DNA, 20 bp, Artificial Sequence
  chemically synthesized
gttttatattcttcctcacc

SEQ ID NO: 457203 - DNA, 20 bp, Artificial Sequence
  chemically synthesized
ccctttacctcttggtgagg

SEQ ID NO: 457204 - DNA, 20 bp, Artificial Sequence
  chemically synthesized
tttatattcttcctcaccaa

SEQ ID NO: 457205 - DNA, 20 bp, Artificial Sequence
  chemically synthesized
ttatattcttcctcaccaag

SEQ ID NO: 457206 - DNA, 20 bp, Artificial Sequence
  chemically synthesized
tgaccctttacctcttggtg

SEQ ID NO: 457207 - DNA, 20 bp, Artificial Sequence
  chemically synthesized
ttgaccctttacctcttggt

SEQ ID NO: 457208 - DNA, 20 bp, Artificial Sequence
  chemically synthesized
ttcttcctcaccaagaggta

SEQ ID NO: 457209 - DNA, 20 bp, Artificial Sequence
  chemically synthesized
gaagttgaccctttacctct

SEQ ID NO: 457210 - DNA, 20 bp, Artificial Sequence
  chemically synthesized
tcttcctcaccaagaggtaa

SEQ ID NO: 457211 - DNA, 20 bp, Artificial Sequence
  chemically synthesized
cttcctcaccaagaggtaaa

SEQ ID NO: 457212 - DNA, 20 bp, Artificial Sequence
  chemically synthesized
gattcacatgcagaagaatg

SEQ ID NO: 457213 - DNA, 20 bp, Artificial Sequence
  chemically synthesized
aacttgagattcacatgcag

SEQ ID NO: 457214 - DNA, 20 bp, Artificial Sequence
  chemically synthesized
gaaaacttgagattcacatg

SEQ ID NO: 457215 - DNA, 20 bp, Artificial Sequence
  chemically synthesized
ttcttctgcatgtgaatctc

SEQ ID NO: 457216 - DNA, 20 bp, Artificial Sequence
  chemically synthesized
aaacggtgctgagaaaactt

SEQ ID NO: 457217 - DNA, 20 bp, Artificial Sequence
  chemically synthesized
atgtgaatctcaagttttct

SEQ ID NO: 457218 - DNA, 20 bp, Artificial Sequence
  chemically synthesized
tcttttaaacaaacggtgct

SEQ ID NO: 457219 - DNA, 20 bp, Artificial Sequence
  chemically synthesized
agaatcatcttttaaacaaa

SEQ ID NO: 457220 - DNA, 20 bp, Artificial Sequence
  chemically synthesized
tctcagcaccgtttgtttaa

SEQ ID NO: 457221 - DNA, 20 bp, Artificial Sequence
  chemically synthesized
ctaagaccatgaaaatgaga

SEQ ID NO: 457222 - DNA, 20 bp, Artificial Sequence
  chemically synthesized
atgattctttctcattttca

SEQ ID NO: 457223 - DNA, 20 bp, Artificial Sequence
  chemically synthesized
gaggctaagaccatgaaaat

SEQ ID NO: 457224 - DNA, 20 bp, Artificial Sequence
  chemically synthesized
ctttctcattttcatggtct

SEQ ID NO: 457225 - DNA, 20 bp, Artificial Sequence
  chemically synthesized
tcataaatgagggagaggct

SEQ ID NO: 457226 - DNA, 20 bp, Artificial Sequence
  chemically synthesized
tcctctcataaatgagggag

SEQ ID NO: 457227 - DNA, 20 bp, Artificial Sequence
  chemically synthesized
ttcctctcataaatgaggga

SEQ ID NO: 457228 - DNA, 20 bp, Artificial Sequence
  chemically synthesized
ccttcctctcataaatgagg

SEQ ID NO: 457229 - DNA, 20 bp, Artificial Sequence
  chemically synthesized
atccttcctctcataaatga

SEQ ID NO: 457230 - DNA, 20 bp, Artificial Sequence
  chemically synthesized
ttagcctctccctcatttat

SEQ ID NO: 457231 - DNA, 20 bp, Artificial Sequence
  chemically synthesized
gatccttcctctcataaatg

SEQ ID NO: 457232 - DNA, 20 bp, Artificial Sequence
  chemically synthesized
agatccttcctctcataaat

SEQ ID NO: 457233 - DNA, 20 bp, Artificial Sequence
  chemically synthesized
agcctctccctcatttatga

SEQ ID NO: 457234 - DNA, 20 bp, Artificial Sequence
  chemically synthesized
gcctctccctcatttatgag

SEQ ID NO: 457235 - DNA, 20 bp, Artificial Sequence
  chemically synthesized
tctccctcatttatgagagg

SEQ ID NO: 457236 - DNA, 20 bp, Artificial Sequence
  chemically synthesized
ctccctcatttatgagagga

SEQ ID NO: 457237 - DNA, 20 bp, Artificial Sequence
  chemically synthesized
atgagaggaaggatctgcgc

SEQ ID NO: 457238 - DNA, 20 bp, Artificial Sequence
  chemically synthesized
tgagaggaaggatctgcgct

SEQ ID NO: 457239 - DNA, 20 bp, Artificial Sequence
  chemically synthesized
ctgagctaccacacctagcg

SEQ ID NO: 457240 - DNA, 20 bp, Artificial Sequence
  chemically synthesized
ggaaggatctgcgctaggtg

SEQ ID NO: 457241 - DNA, 20 bp, Artificial Sequence
  chemically synthesized
aggatctgcgctaggtgtgg

SEQ ID NO: 457242 - DNA, 20 bp, Artificial Sequence
  chemically synthesized
atctcctgagctaccacacc

SEQ ID NO: 457243 - DNA, 20 bp, Artificial Sequence
  chemically synthesized
ctgcgctaggtgtggtagct

SEQ ID NO: 457244 - DNA, 20 bp, Artificial Sequence
  chemically synthesized
tgcgctaggtgtggtagctc

SEQ ID NO: 457245 - DNA, 20 bp, Artificial Sequence
  chemically synthesized
cgctaggtgtggtagctcag

SEQ ID NO: 457246 - DNA, 20 bp, Artificial Sequence
  chemically synthesized
tggctgcttctgtatctcct

SEQ ID NO: 457247 - DNA, 20 bp, Artificial Sequence
  chemically synthesized
gtgtggtagctcaggagata

SEQ ID NO: 457248 - DNA, 20 bp, Artificial Sequence
  chemically synthesized
tggtagctcaggagatacag

SEQ ID NO: 457249 - DNA, 20 bp, Artificial Sequence
  chemically synthesized
tagctcaggagatacagaag

SEQ ID NO: 457250 - DNA, 20 bp, Artificial Sequence
  chemically synthesized
tggtcatagctgaagagatg

SEQ ID NO: 457251 - DNA, 20 bp, Artificial Sequence
  chemically synthesized
cagaagcagccacatctctt

SEQ ID NO: 457252 - DNA, 20 bp, Artificial Sequence
  chemically synthesized
cacgtctggtcatagctgaa

SEQ ID NO: 457253 - DNA, 20 bp, Artificial Sequence
  chemically synthesized
accacgtctggtcatagctg

SEQ ID NO: 457254 - DNA, 20 bp, Artificial Sequence
  chemically synthesized
cacatctcttcagctatgac

SEQ ID NO: 457255 - DNA, 20 bp, Artificial Sequence
  chemically synthesized
cttatcaccacgtctggtca

SEQ ID NO: 457256 - DNA, 20 bp, Artificial Sequence
  chemically synthesized
tcttcagctatgaccagacg

SEQ ID NO: 457257 - DNA, 20 bp, Artificial Sequence
  chemically synthesized
ctgtggcttatcaccacgtc

SEQ ID NO: 457258 - DNA, 20 bp, Artificial Sequence
  chemically synthesized
ctatgaccagacgtggtgat

SEQ ID NO: 457259 - DNA, 20 bp, Artificial Sequence
  chemically synthesized
ccagacgtggtgataagcca

SEQ ID NO: 457260 - DNA, 20 bp, Artificial Sequence
  chemically synthesized
gacgtggtgataagccacag

SEQ ID NO: 457261 - DNA, 20 bp, Artificial Sequence
  chemically synthesized
cttatcagcagaagctgctg

SEQ ID NO: 457262 - DNA, 20 bp, Artificial Sequence
  chemically synthesized
ttctttttacttatcagcag

SEQ ID NO: 457263 - DNA, 20 bp, Artificial Sequence
  chemically synthesized
ccacagcagcttctgctgat

SEQ ID NO: 457264 - DNA, 20 bp, Artificial Sequence
  chemically synthesized
ttcttctttttacttatcag

SEQ ID NO: 457265 - DNA, 20 bp, Artificial Sequence
  chemically synthesized
ctcttcttctttttacttat

SEQ ID NO: 457266 - DNA, 20 bp, Artificial Sequence
  chemically synthesized
agcttctgctgataagtaaa

SEQ ID NO: 457267 - DNA, 20 bp, Artificial Sequence
  chemically synthesized
ttctgctgataagtaaaaag

SEQ ID NO: 457268 - DNA, 20 bp, Artificial Sequence
  chemically synthesized
tgctgataagtaaaaagaag

SEQ ID NO: 457269 - DNA, 20 bp, Artificial Sequence
  chemically synthesized
ctgataagtaaaaagaagaa

SEQ ID NO: 457270 - DNA, 20 bp, Artificial Sequence
  chemically synthesized
aaaagaagaagagaatcacg

SEQ ID NO: 457271 - DNA, 20 bp, Artificial Sequence
  chemically synthesized
agaagaagagaatcacgtag

SEQ ID NO: 457272 - DNA, 20 bp, Artificial Sequence
  chemically synthesized
agaagagaatcacgtagaag

SEQ ID NO: 457273 - DNA, 20 bp, Artificial Sequence
  chemically synthesized
tagaagaagcaccctgtttt

SEQ ID NO: 457274 - DNA, 20 bp, Artificial Sequence
  chemically synthesized
gatagacatggccaaaaaca

SEQ ID NO: 457275 - DNA, 20 bp, Artificial Sequence
  chemically synthesized
ggatagacatggccaaaaac

SEQ ID NO: 457276 - DNA, 20 bp, Artificial Sequence
  chemically synthesized
tggatagacatggccaaaaa

SEQ ID NO: 457277 - DNA, 20 bp, Artificial Sequence
  chemically synthesized
aactttactctggatagaca

SEQ ID NO: 457278 - DNA, 20 bp, Artificial Sequence
  chemically synthesized
tgtttttggccatgtctatc

SEQ ID NO: 457279 - DNA, 20 bp, Artificial Sequence
  chemically synthesized
tttttggccatgtctatcca

SEQ ID NO: 457280 - DNA, 20 bp, Artificial Sequence
  chemically synthesized
gacagaaactttactctgga

SEQ ID NO: 457281 - DNA, 20 bp, Artificial Sequence
  chemically synthesized
ggccatgtctatccagagta

SEQ ID NO: 457282 - DNA, 20 bp, Artificial Sequence
  chemically synthesized
gtgtgacagaaactttactc

SEQ ID NO: 457283 - DNA, 20 bp, Artificial Sequence
  chemically synthesized
agagtaaagtttctgtcaca

SEQ ID NO: 457284 - DNA, 20 bp, Artificial Sequence
  chemically synthesized
agtaaagtttctgtcacaca

SEQ ID NO: 457285 - DNA, 20 bp, Artificial Sequence
  chemically synthesized
ctctctctagctctgtgtga

SEQ ID NO: 457286 - DNA, 20 bp, Artificial Sequence
  chemically synthesized
aagtttctgtcacacagagc

SEQ ID NO: 457287 - DNA, 20 bp, Artificial Sequence
  chemically synthesized
gtttctgtcacacagagcta

SEQ ID NO: 457288 - DNA, 20 bp, Artificial Sequence
  chemically synthesized
ttctgtcacacagagctaga

SEQ ID NO: 457289 - DNA, 20 bp, Artificial Sequence
  chemically synthesized
ctgtcacacagagctagaga

SEQ ID NO: 457290 - DNA, 20 bp, Artificial Sequence
  chemically synthesized
tcacacagagctagagagag

SEQ ID NO: 457291 - DNA, 20 bp, Artificial Sequence
  chemically synthesized
caccccaaccccactctctc

SEQ ID NO: 457292 - DNA, 20 bp, Artificial Sequence
  chemically synthesized
cacacagagctagagagagt

SEQ ID NO: 457293 - DNA, 20 bp, Artificial Sequence
  chemically synthesized
acacagagctagagagagtg

SEQ ID NO: 457294 - DNA, 20 bp, Artificial Sequence
  chemically synthesized
agagctagagagagtggggt

SEQ ID NO: 457295 - DNA, 20 bp, Artificial Sequence
  chemically synthesized
gagctagagagagtggggtt

SEQ ID NO: 457296 - DNA, 20 bp, Artificial Sequence
  chemically synthesized
agctagagagagtggggttg

SEQ ID NO: 457297 - DNA, 20 bp, Artificial Sequence
  chemically synthesized
tagagagagtggggttgggg

SEQ ID NO: 457298 - DNA, 20 bp, Artificial Sequence
  chemically synthesized
agagagagtggggttggggt

SEQ ID NO: 457299 - DNA, 20 bp, Artificial Sequence
  chemically synthesized
gagagagtggggttggggtg

SEQ ID NO: 457300 - DNA, 20 bp, Artificial Sequence
  chemically synthesized
agtgaaagttaatgacattt

SEQ ID NO: 457301 - DNA, 20 bp, Artificial Sequence
  chemically synthesized
aatctcagtcagaacagtga

SEQ ID NO: 457302 - DNA, 20 bp, Artificial Sequence
  chemically synthesized
ctgcaaaatctcagtcagaa

SEQ ID NO: 457303 - DNA, 20 bp, Artificial Sequence
  chemically synthesized
taactttcactgttctgact

SEQ ID NO: 457304 - DNA, 20 bp, Artificial Sequence
  chemically synthesized
aaaacctgcaaaatctcagt

SEQ ID NO: 457305 - DNA, 20 bp, Artificial Sequence
  chemically synthesized
caaaaaaacctgcaaaatct

SEQ ID NO: 457306 - DNA, 20 bp, Artificial Sequence
  chemically synthesized
ctgttctgactgagattttg

SEQ ID NO: 457307 - DNA, 20 bp, Artificial Sequence
  chemically synthesized
tgttctgactgagattttgc

SEQ ID NO: 457308 - DNA, 20 bp, Artificial Sequence
  chemically synthesized
ttaagagcatatagcaaatg

SEQ ID NO: 457309 - DNA, 20 bp, Artificial Sequence
  chemically synthesized
tcttaagagcatatagcaaa

SEQ ID NO: 457310 - DNA, 20 bp, Artificial Sequence
  chemically synthesized
gaaatggtcttaagagcata

SEQ ID NO: 457311 - DNA, 20 bp, Artificial Sequence
  chemically synthesized
tccatttgctatatgctctt

SEQ ID NO: 457312 - DNA, 20 bp, Artificial Sequence
  chemically synthesized
gtctctggaaatggtcttaa

SEQ ID NO: 457313 - DNA, 20 bp, Artificial Sequence
  chemically synthesized
aagtctctggaaatggtctt

SEQ ID NO: 457314 - DNA, 20 bp, Artificial Sequence
  chemically synthesized
tatgctcttaagaccatttc

SEQ ID NO: 457315 - DNA, 20 bp, Artificial Sequence
  chemically synthesized
tgctcttaagaccatttcca

SEQ ID NO: 457316 - DNA, 20 bp, Artificial Sequence
  chemically synthesized
ccatggaaagtctctggaaa

SEQ ID NO: 457317 - DNA, 20 bp, Artificial Sequence
  chemically synthesized
aaataaccatggaaagtctc

SEQ ID NO: 457318 - DNA, 20 bp, Artificial Sequence
  chemically synthesized
ccatttccagagactttcca

SEQ ID NO: 457319 - DNA, 20 bp, Artificial Sequence
  chemically synthesized
tgtaataaaataaccatgga

SEQ ID NO: 457320 - DNA, 20 bp, Artificial Sequence
  chemically synthesized
aaattgtaataaaataacca

SEQ ID NO: 457321 - DNA, 20 bp, Artificial Sequence
  chemically synthesized
tattttattacaattttcac

SEQ ID NO: 457322 - DNA, 20 bp, Artificial Sequence
  chemically synthesized
attacaattttcaccagtta

SEQ ID NO: 457323 - DNA, 20 bp, Artificial Sequence
  chemically synthesized
ccgagtaaaacaactgtaac

SEQ ID NO: 457324 - DNA, 20 bp, Artificial Sequence
  chemically synthesized
ccagttacagttgttttact

SEQ ID NO: 457325 - DNA, 20 bp, Artificial Sequence
  chemically synthesized
cagttacagttgttttactc

SEQ ID NO: 457326 - DNA, 20 bp, Artificial Sequence
  chemically synthesized
tacagttgttttactcggga

SEQ ID NO: 457327 - DNA, 20 bp, Artificial Sequence
  chemically synthesized
ggctccatggatgctgtccc

SEQ ID NO: 457328 - DNA, 20 bp, Artificial Sequence
  chemically synthesized
tttactcgggacagcatcca

SEQ ID NO: 457329 - DNA, 20 bp, Artificial Sequence
  chemically synthesized
tactcgggacagcatccatg

SEQ ID NO: 457330 - DNA, 20 bp, Artificial Sequence
  chemically synthesized
gtgtagtgtcaggggctcca

SEQ ID NO: 457331 - DNA, 20 bp, Artificial Sequence
  chemically synthesized
atggtagtgtgtagtgtcag

SEQ ID NO: 457332 - DNA, 20 bp, Artificial Sequence
  chemically synthesized
aatggtagtgtgtagtgtca

SEQ ID NO: 457333 - DNA, 20 bp, Artificial Sequence
  chemically synthesized
aaatggtagtgtgtagtgtc

SEQ ID NO: 457334 - DNA, 20 bp, Artificial Sequence
  chemically synthesized
gaaatggtagtgtgtagtgt

SEQ ID NO: 457335 - DNA, 20 bp, Artificial Sequence
  chemically synthesized
acttctgaaatggtagtgtg

SEQ ID NO: 457336 - DNA, 20 bp, Artificial Sequence
  chemically synthesized
gacactacacactaccattt

SEQ ID NO: 457337 - DNA, 20 bp, Artificial Sequence
  chemically synthesized
gagaaacacttctgaaatgg

SEQ ID NO: 457338 - DNA, 20 bp, Artificial Sequence
  chemically synthesized
actacacactaccatttcag

SEQ ID NO: 457339 - DNA, 20 bp, Artificial Sequence
  chemically synthesized
ggagagaaacacttctgaaa

SEQ ID NO: 457340 - DNA, 20 bp, Artificial Sequence
  chemically synthesized
ataaacatgaacattttgga

SEQ ID NO: 457341 - DNA, 20 bp, Artificial Sequence
  chemically synthesized
atataaacatgaacattttg

SEQ ID NO: 457342 - DNA, 20 bp, Artificial Sequence
  chemically synthesized
aaatataaacatgaacattt

SEQ ID NO: 457343 - DNA, 20 bp, Artificial Sequence
  chemically synthesized
ttcatgtttatatttcgcca

SEQ ID NO: 457344 - DNA, 20 bp, Artificial Sequence
  chemically synthesized
aaatattaactaaaaaacta

SEQ ID NO: 457345 - DNA, 20 bp, Artificial Sequence
  chemically synthesized
tatatttcgccatagttttt

SEQ ID NO: 457346 - DNA, 20 bp, Artificial Sequence
  chemically synthesized
tgaagatactcacattttac

SEQ ID NO: 457347 - DNA, 20 bp, Artificial Sequence
  chemically synthesized
ttcacaaacttgtaaaatgt

SEQ ID NO: 457348 - DNA, 20 bp, Artificial Sequence
  chemically synthesized
cagtcctgaaggttggggtg

SEQ ID NO: 457349 - DNA, 20 bp, Artificial Sequence
  chemically synthesized
agtatcttcaccccaacctt

SEQ ID NO: 457350 - DNA, 20 bp, Artificial Sequence
  chemically synthesized
cactgcagtcctgaaggttg

SEQ ID NO: 457351 - DNA, 20 bp, Artificial Sequence
  chemically synthesized
gtatcttcaccccaaccttc

SEQ ID NO: 457352 - DNA, 20 bp, Artificial Sequence
  chemically synthesized
ccactgcagtcctgaaggtt

SEQ ID NO: 457353 - DNA, 20 bp, Artificial Sequence
  chemically synthesized
gccactgcagtcctgaaggt

SEQ ID NO: 457354 - DNA, 20 bp, Artificial Sequence
  chemically synthesized
ctctgccactgcagtcctga

SEQ ID NO: 457355 - DNA, 20 bp, Artificial Sequence
  chemically synthesized
cctctgccactgcagtcctg

SEQ ID NO: 457356 - DNA, 20 bp, Artificial Sequence
  chemically synthesized
caccccaaccttcaggactg

SEQ ID NO: 457357 - DNA, 20 bp, Artificial Sequence
  chemically synthesized
cccaaccttcaggactgcag

SEQ ID NO: 457358 - DNA, 20 bp, Artificial Sequence
  chemically synthesized
aaccttcaggactgcagtgg

SEQ ID NO: 457359 - DNA, 20 bp, Artificial Sequence
  chemically synthesized
attcatggcctctgccactg

SEQ ID NO: 457360 - DNA, 20 bp, Artificial Sequence
  chemically synthesized
ccttcaggactgcagtggca

SEQ ID NO: 457361 - DNA, 20 bp, Artificial Sequence
  chemically synthesized
cttcaggactgcagtggcag

SEQ ID NO: 457362 - DNA, 20 bp, Artificial Sequence
  chemically synthesized
gcagtggcagaggccatgaa

SEQ ID NO: 457363 - DNA, 20 bp, Artificial Sequence
  chemically synthesized
cagtggcagaggccatgaat

SEQ ID NO: 457364 - DNA, 20 bp, Artificial Sequence
  chemically synthesized
gtggcagaggccatgaatag

SEQ ID NO: 457365 - DNA, 20 bp, Artificial Sequence
  chemically synthesized
tctactctacctcctattca

SEQ ID NO: 457366 - DNA, 20 bp, Artificial Sequence
  chemically synthesized
tggcagaggccatgaatagg

SEQ ID NO: 457367 - DNA, 20 bp, Artificial Sequence
  chemically synthesized
cagaggccatgaataggagg

SEQ ID NO: 457368 - DNA, 20 bp, Artificial Sequence
  chemically synthesized
gaggccatgaataggaggta

SEQ ID NO: 457369 - DNA, 20 bp, Artificial Sequence
  chemically synthesized
gccatgaataggaggtagag

SEQ ID NO: 457370 - DNA, 20 bp, Artificial Sequence
  chemically synthesized
ggaggtagagtagattgatt

SEQ ID NO: 457371 - DNA, 20 bp, Artificial Sequence
  chemically synthesized
agattgatttagttttaatt

SEQ ID NO: 457372 - DNA, 20 bp, Artificial Sequence
  chemically synthesized
ttagaaaaatgaactcatat

SEQ ID NO: 457373 - DNA, 20 bp, Artificial Sequence
  chemically synthesized
cctgcaattgttacttatat

SEQ ID NO: 457374 - DNA, 20 bp, Artificial Sequence
  chemically synthesized
actcatataagtaacaattg

SEQ ID NO: 457375 - DNA, 20 bp, Artificial Sequence
  chemically synthesized
ctcatataagtaacaattgc

SEQ ID NO: 457376 - DNA, 20 bp, Artificial Sequence
  chemically synthesized
taacaattgcaggtaaaaat

SEQ ID NO: 457377 - DNA, 20 bp, Artificial Sequence
  chemically synthesized
aacaattgcaggtaaaaatt

SEQ ID NO: 457378 - DNA, 20 bp, Artificial Sequence
  chemically synthesized
tgcaggtaaaaattaggatt

SEQ ID NO: 457379 - DNA, 20 bp, Artificial Sequence
  chemically synthesized
aaacagagcctacaaatgca

SEQ ID NO: 457380 - DNA, 20 bp, Artificial Sequence
  chemically synthesized
ggatttagactttgcatttg

SEQ ID NO: 457381 - DNA, 20 bp, Artificial Sequence
  chemically synthesized
gatttagactttgcatttgt

SEQ ID NO: 457382 - DNA, 20 bp, Artificial Sequence
  chemically synthesized
ttaataaatataagaaaaca

SEQ ID NO: 457383 - DNA, 20 bp, Artificial Sequence
  chemically synthesized
acttaataaatataagaaaa

SEQ ID NO: 457384 - DNA, 20 bp, Artificial Sequence
  chemically synthesized
atattaaacttaataaatat

SEQ ID NO: 457385 - DNA, 20 bp, Artificial Sequence
  chemically synthesized
tctgttttcttatatttatt

SEQ ID NO: 457386 - DNA, 20 bp, Artificial Sequence
  chemically synthesized
aagtttaatatatttgatac

SEQ ID NO: 457387 - DNA, 20 bp, Artificial Sequence
  chemically synthesized
agtttaatatatttgatact

SEQ ID NO: 457388 - DNA, 20 bp, Artificial Sequence
  chemically synthesized
ttaatatatttgatactagg

SEQ ID NO: 457389 - DNA, 20 bp, Artificial Sequence
  chemically synthesized
gtagtaaacattttactacc

SEQ ID NO: 457390 - DNA, 20 bp, Artificial Sequence
  chemically synthesized
gcaaaagttttttttttcgg

SEQ ID NO: 457391 - DNA, 20 bp, Artificial Sequence
  chemically synthesized
ttggcaaaagtttttttttt

SEQ ID NO: 457392 - DNA, 20 bp, Artificial Sequence
  chemically synthesized
aatttgacacattttggcaa

SEQ ID NO: 457393 - DNA, 20 bp, Artificial Sequence
  chemically synthesized
ataaaaaatttgacacattt

SEQ ID NO: 457394 - DNA, 20 bp, Artificial Sequence
  chemically synthesized
gtgtcaaattttttatttta

SEQ ID NO: 457395 - DNA, 20 bp, Artificial Sequence
  chemically synthesized
ttttatagcaaatactcttc

SEQ ID NO: 457396 - DNA, 20 bp, Artificial Sequence
  chemically synthesized
aaaatatatgttaactagaa

SEQ ID NO: 457397 - DNA, 20 bp, Artificial Sequence
  chemically synthesized
ataaaatatatgttaactag

SEQ ID NO: 457398 - DNA, 20 bp, Artificial Sequence
  chemically synthesized
aagataaaatatatgttaac

SEQ ID NO: 457399 - DNA, 20 bp, Artificial Sequence
  chemically synthesized
gttaacatatattttatctt

SEQ ID NO: 457400 - DNA, 20 bp, Artificial Sequence
  chemically synthesized
tatattttatcttcagtgcc

SEQ ID NO: 457401 - DNA, 20 bp, Artificial Sequence
  chemically synthesized
gctgaaataactgggcactg

SEQ ID NO: 457402 - DNA, 20 bp, Artificial Sequence
  chemically synthesized
ttaatgaagctgaaataact

SEQ ID NO: 457403 - DNA, 20 bp, Artificial Sequence
  chemically synthesized
tcttcagtgcccagttattt

SEQ ID NO: 457404 - DNA, 20 bp, Artificial Sequence
  chemically synthesized
cttaatgaagctgaaataac

SEQ ID NO: 457405 - DNA, 20 bp, Artificial Sequence
  chemically synthesized
ccagttatttcagcttcatt

SEQ ID NO: 457406 - DNA, 20 bp, Artificial Sequence
  chemically synthesized
agttatttcagcttcattaa

SEQ ID NO: 457407 - DNA, 20 bp, Artificial Sequence
  chemically synthesized
cttttttttttctcttaatg

SEQ ID NO: 457408 - DNA, 20 bp, Artificial Sequence
  chemically synthesized
cttcattaagagaaaaaaaa

SEQ ID NO: 457409 - DNA, 20 bp, Artificial Sequence
  chemically synthesized
ttcattaagagaaaaaaaaa

SEQ ID NO: 457410 - DNA, 20 bp, Artificial Sequence
  chemically synthesized
tcattaagagaaaaaaaaaa

SEQ ID NO: 457411 - DNA, 20 bp, Artificial Sequence
  chemically synthesized
agaaaaaaaaaagggaatca

SEQ ID NO: 457412 - DNA, 20 bp, Artificial Sequence
  chemically synthesized
aaaaaaaaaagggaatcaaa

SEQ ID NO: 457413 - DNA, 20 bp, Artificial Sequence
  chemically synthesized
aagggaatcaaagagtaata

SEQ ID NO: 457414 - DNA, 20 bp, Artificial Sequence
  chemically synthesized
agctagtcttaaaatcaaaa

SEQ ID NO: 457415 - DNA, 20 bp, Artificial Sequence
  chemically synthesized
gagctagtcttaaaatcaaa

SEQ ID NO: 457416 - DNA, 20 bp, Artificial Sequence
  chemically synthesized
tatagtgcctttttgatttt

SEQ ID NO: 457417 - DNA, 20 bp, Artificial Sequence
  chemically synthesized
tgcctttttgattttaagac

SEQ ID NO: 457418 - DNA, 20 bp, Artificial Sequence
  chemically synthesized
ttgccaagggtaataagagc

SEQ ID NO: 457419 - DNA, 20 bp, Artificial Sequence
  chemically synthesized
tctattgccaagggtaataa

SEQ ID NO: 457420 - DNA, 20 bp, Artificial Sequence
  chemically synthesized
aatctattgccaagggtaat

SEQ ID NO: 457421 - DNA, 20 bp, Artificial Sequence
  chemically synthesized
agactagctcttattaccct

SEQ ID NO: 457422 - DNA, 20 bp, Artificial Sequence
  chemically synthesized
gctcttattacccttggcaa

SEQ ID NO: 457423 - DNA, 20 bp, Artificial Sequence
  chemically synthesized
tttctataatctattgccaa

SEQ ID NO: 457424 - DNA, 20 bp, Artificial Sequence
  chemically synthesized
atttctataatctattgcca

SEQ ID NO: 457425 - DNA, 20 bp, Artificial Sequence
  chemically synthesized
gatttctataatctattgcc

SEQ ID NO: 457426 - DNA, 20 bp, Artificial Sequence
  chemically synthesized
ttacccttggcaatagatta

SEQ ID NO: 457427 - DNA, 20 bp, Artificial Sequence
  chemically synthesized
atagattatagaaatcatac

SEQ ID NO: 457428 - DNA, 20 bp, Artificial Sequence
  chemically synthesized
gattatagaaatcatacaag

SEQ ID NO: 457429 - DNA, 20 bp, Artificial Sequence
  chemically synthesized
aagcagtatatacaatttca

SEQ ID NO: 457430 - DNA, 20 bp, Artificial Sequence
  chemically synthesized
aatttcaaagtcacacacaa

SEQ ID NO: 457431 - DNA, 20 bp, Artificial Sequence
  chemically synthesized
tgaaactttttaaataattc

SEQ ID NO: 457432 - DNA, 20 bp, Artificial Sequence
  chemically synthesized
atattcttgaattatttaaa

SEQ ID NO: 457433 - DNA, 20 bp, Artificial Sequence
  chemically synthesized
tttctacagtgaatatttgt

SEQ ID NO: 457434 - DNA, 20 bp, Artificial Sequence
  chemically synthesized
caactcacaaatattcactg

SEQ ID NO: 457435 - DNA, 20 bp, Artificial Sequence
  chemically synthesized
cgatgttttgtatgtttcta

SEQ ID NO: 457436 - DNA, 20 bp, Artificial Sequence
  chemically synthesized
gtagaaacatacaaaacatc

SEQ ID NO: 457437 - DNA, 20 bp, Artificial Sequence
  chemically synthesized
tacaaaacatcgagaattta

SEQ ID NO: 457438 - DNA, 20 bp, Artificial Sequence
  chemically synthesized
acaaaacatcgagaatttaa

SEQ ID NO: 457439 - DNA, 20 bp, Artificial Sequence
  chemically synthesized
aaaggacatatgaaaacaac

SEQ ID NO: 457440 - DNA, 20 bp, Artificial Sequence
  chemically synthesized
acatatgaaaacaaccagaa

SEQ ID NO: 457441 - DNA, 20 bp, Artificial Sequence
  chemically synthesized
atatgaaaacaaccagaaaa

SEQ ID NO: 457442 - DNA, 20 bp, Artificial Sequence
  chemically synthesized
tccatgctttaactcttttc

SEQ ID NO: 457443 - DNA, 20 bp, Artificial Sequence
  chemically synthesized
aaacaaccagaaaagagtta

SEQ ID NO: 457444 - DNA, 20 bp, Artificial Sequence
  chemically synthesized
accagaaaagagttaaagca

SEQ ID NO: 457445 - DNA, 20 bp, Artificial Sequence
  chemically synthesized
gttaaagcatggattacgtt

SEQ ID NO: 457446 - DNA, 20 bp, Artificial Sequence
  chemically synthesized
acgtttagttttacaatgaa

SEQ ID NO: 457447 - DNA, 20 bp, Artificial Sequence
  chemically synthesized
agttttacaatgaaaagcaa

SEQ ID NO: 457448 - DNA, 20 bp, Artificial Sequence
  chemically synthesized
ttttacaatgaaaagcaaca

SEQ ID NO: 457449 - DNA, 20 bp, Artificial Sequence
  chemically synthesized
atagtaaatctttaatttca

SEQ ID NO: 457450 - DNA, 20 bp, Artificial Sequence
  chemically synthesized
caacagagactttgaaatta

SEQ ID NO: 457451 - DNA, 20 bp, Artificial Sequence
  chemically synthesized
ttgaaattaaagatttacta

SEQ ID NO: 457452 - DNA, 20 bp, Artificial Sequence
  chemically synthesized
cattcagctttcacaatcca

SEQ ID NO: 457453 - DNA, 20 bp, Artificial Sequence
  chemically synthesized
agatttactatggattgtga

SEQ ID NO: 457454 - DNA, 20 bp, Artificial Sequence
  chemically synthesized
attccttaagatttagcatt

SEQ ID NO: 457455 - DNA, 20 bp, Artificial Sequence
  chemically synthesized
aaagctgaatgctaaatctt

SEQ ID NO: 457456 - DNA, 20 bp, Artificial Sequence
  chemically synthesized
aagctgaatgctaaatctta

SEQ ID NO: 457457 - DNA, 20 bp, Artificial Sequence
  chemically synthesized
cctcaaaattccttaagatt

SEQ ID NO: 457458 - DNA, 20 bp, Artificial Sequence
  chemically synthesized
gtatgccctcaaaattcctt

SEQ ID NO: 457459 - DNA, 20 bp, Artificial Sequence
  chemically synthesized
gctaaatcttaaggaatttt

SEQ ID NO: 457460 - DNA, 20 bp, Artificial Sequence
  chemically synthesized
ctaaatcttaaggaattttg

SEQ ID NO: 457461 - DNA, 20 bp, Artificial Sequence
  chemically synthesized
taaatcttaaggaattttga

SEQ ID NO: 457462 - DNA, 20 bp, Artificial Sequence
  chemically synthesized
tgagggcatactattaaaca

SEQ ID NO: 457463 - DNA, 20 bp, Artificial Sequence
  chemically synthesized
ttaacaagggctatgtttaa

SEQ ID NO: 457464 - DNA, 20 bp, Artificial Sequence
  chemically synthesized
agtttatttaattttaacaa

SEQ ID NO: 457465 - DNA, 20 bp, Artificial Sequence
  chemically synthesized
aagtttatttaattttaaca

SEQ ID NO: 457466 - DNA, 20 bp, Artificial Sequence
  chemically synthesized
taagtttatttaattttaac

SEQ ID NO: 457467 - DNA, 20 bp, Artificial Sequence
  chemically synthesized
aatataatttatttaatcat

SEQ ID NO: 457468 - DNA, 20 bp, Artificial Sequence
  chemically synthesized
tgattaaataaattatatta

SEQ ID NO: 457469 - DNA, 20 bp, Artificial Sequence
  chemically synthesized
tgagttttgaacatttatta

SEQ ID NO: 457470 - DNA, 20 bp, Artificial Sequence
  chemically synthesized
taaaataattaagaagtgat

SEQ ID NO: 457471 - DNA, 20 bp, Artificial Sequence
  chemically synthesized
aatgtagtaaaataattaag

SEQ ID NO: 457472 - DNA, 20 bp, Artificial Sequence
  chemically synthesized
tgaaatgtagtaaaataatt

SEQ ID NO: 457473 - DNA, 20 bp, Artificial Sequence
  chemically synthesized
gtgtagacgacagtgaaatg

SEQ ID NO: 457474 - DNA, 20 bp, Artificial Sequence
  chemically synthesized
aacctcacaagtgtagacga

SEQ ID NO: 457475 - DNA, 20 bp, Artificial Sequence
  chemically synthesized
tcactgtcgtctacacttgt

SEQ ID NO: 457476 - DNA, 20 bp, Artificial Sequence
  chemically synthesized
tacaaataacctcacaagtg

SEQ ID NO: 457477 - DNA, 20 bp, Artificial Sequence
  chemically synthesized
cactgtcgtctacacttgtg

SEQ ID NO: 457478 - DNA, 20 bp, Artificial Sequence
  chemically synthesized
aaggatacaaataacctcac

SEQ ID NO: 457479 - DNA, 20 bp, Artificial Sequence
  chemically synthesized
attttcaccatacagataaa

SEQ ID NO: 457480 - DNA, 20 bp, Artificial Sequence
  chemically synthesized
cattttcaccatacagataa

SEQ ID NO: 457481 - DNA, 20 bp, Artificial Sequence
  chemically synthesized
tttgtatccttttatctgta

SEQ ID NO: 457482 - DNA, 20 bp, Artificial Sequence
  chemically synthesized
tatatagcattttcaccata

SEQ ID NO: 457483 - DNA, 20 bp, Artificial Sequence
  chemically synthesized
ggtagtggccaattattata

SEQ ID NO: 457484 - DNA, 20 bp, Artificial Sequence
  chemically synthesized
tgaaaatgctatataataat

SEQ ID NO: 457485 - DNA, 20 bp, Artificial Sequence
  chemically synthesized
agctgggatgagataggtag

SEQ ID NO: 457486 - DNA, 20 bp, Artificial Sequence
  chemically synthesized
tggagctgggatgagatagg

SEQ ID NO: 457487 - DNA, 20 bp, Artificial Sequence
  chemically synthesized
gtgtggagctgggatgagat

SEQ ID NO: 457488 - DNA, 20 bp, Artificial Sequence
  chemically synthesized
agtgtggagctgggatgaga

SEQ ID NO: 457489 - DNA, 20 bp, Artificial Sequence
  chemically synthesized
ggccactacctatctcatcc

SEQ ID NO: 457490 - DNA, 20 bp, Artificial Sequence
  chemically synthesized
gctgagtgtggagctgggat

SEQ ID NO: 457491 - DNA, 20 bp, Artificial Sequence
  chemically synthesized
atgttgctgagtgtggagct

SEQ ID NO: 457492 - DNA, 20 bp, Artificial Sequence
  chemically synthesized
gatgttgctgagtgtggagc

SEQ ID NO: 457493 - DNA, 20 bp, Artificial Sequence
  chemically synthesized
tctcatcccagctccacact

SEQ ID NO: 457494 - DNA, 20 bp, Artificial Sequence
  chemically synthesized
acatgatgttgctgagtgtg

SEQ ID NO: 457495 - DNA, 20 bp, Artificial Sequence
  chemically synthesized
caacatgatgttgctgagtg

SEQ ID NO: 457496 - DNA, 20 bp, Artificial Sequence
  chemically synthesized
gctatcaacatgatgttgct

SEQ ID NO: 457497 - DNA, 20 bp, Artificial Sequence
  chemically synthesized
actcagcaacatcatgttga

SEQ ID NO: 457498 - DNA, 20 bp, Artificial Sequence
  chemically synthesized
tcatgttgatagcttgaaac

SEQ ID NO: 457499 - DNA, 20 bp, Artificial Sequence
  chemically synthesized
cttcaaccacatccagtttc

SEQ ID NO: 457500 - DNA, 20 bp, Artificial Sequence
  chemically synthesized
tgatagcttgaaactggatg

SEQ ID NO: 457501 - DNA, 20 bp, Artificial Sequence
  chemically synthesized
gtaaatacttcaaccacatc

SEQ ID NO: 457502 - DNA, 20 bp, Artificial Sequence
  chemically synthesized
cttgaaactggatgtggttg

SEQ ID NO: 457503 - DNA, 20 bp, Artificial Sequence
  chemically synthesized
tggttgaagtatttacacca

SEQ ID NO: 457504 - DNA, 20 bp, Artificial Sequence
  chemically synthesized
agtatttacaccacagaaat

SEQ ID NO: 457505 - DNA, 20 bp, Artificial Sequence
  chemically synthesized
ttagtgtttgcttatttctg

SEQ ID NO: 457506 - DNA, 20 bp, Artificial Sequence
  chemically synthesized
cacagaaataagcaaacact

SEQ ID NO: 457507 - DNA, 20 bp, Artificial Sequence
  chemically synthesized
taagcaaacactaagaatca

SEQ ID NO: 457508 - DNA, 20 bp, Artificial Sequence
  chemically synthesized
agaactcaagctatgattct

SEQ ID NO: 457509 - DNA, 20 bp, Artificial Sequence
  chemically synthesized
aacactaagaatcatagctt

SEQ ID NO: 457510 - DNA, 20 bp, Artificial Sequence
  chemically synthesized
agctcagtgagaaagaactc

SEQ ID NO: 457511 - DNA, 20 bp, Artificial Sequence
  chemically synthesized
agcttgagttctttctcact

SEQ ID NO: 457512 - DNA, 20 bp, Artificial Sequence
  chemically synthesized
taaccaccagctcagtgaga

SEQ ID NO: 457513 - DNA, 20 bp, Artificial Sequence
  chemically synthesized
tgagttctttctcactgagc

SEQ ID NO: 457514 - DNA, 20 bp, Artificial Sequence
  chemically synthesized
attttaaccaccagctcagt

SEQ ID NO: 457515 - DNA, 20 bp, Artificial Sequence
  chemically synthesized
gttctttctcactgagctgg

SEQ ID NO: 457516 - DNA, 20 bp, Artificial Sequence
  chemically synthesized
gtatattttaaccaccagct

SEQ ID NO: 457517 - DNA, 20 bp, Artificial Sequence
  chemically synthesized
tgtaggtatattttaaccac

SEQ ID NO: 457518 - DNA, 20 bp, Artificial Sequence
  chemically synthesized
gtggttaaaatatacctaca

SEQ ID NO: 457519 - DNA, 20 bp, Artificial Sequence
  chemically synthesized
tttggggatgtgtactgtgt

SEQ ID NO: 457520 - DNA, 20 bp, Artificial Sequence
  chemically synthesized
ctttggggatgtgtactgtg

SEQ ID NO: 457521 - DNA, 20 bp, Artificial Sequence
  chemically synthesized
ctacacagtacacatcccca

SEQ ID NO: 457522 - DNA, 20 bp, Artificial Sequence
  chemically synthesized
acacagtacacatccccaaa

SEQ ID NO: 457523 - DNA, 20 bp, Artificial Sequence
  chemically synthesized
tctctatatatgtctctttg

SEQ ID NO: 457524 - DNA, 20 bp, Artificial Sequence
  chemically synthesized
ctctctatatatgtctcttt

SEQ ID NO: 457525 - DNA, 20 bp, Artificial Sequence
  chemically synthesized
tctctctatatatgtctctt

SEQ ID NO: 457526 - DNA, 20 bp, Artificial Sequence
  chemically synthesized
catccccaaagagacatata

SEQ ID NO: 457527 - DNA, 20 bp, Artificial Sequence
  chemically synthesized
tccccaaagagacatatata

SEQ ID NO: 457528 - DNA, 20 bp, Artificial Sequence
  chemically synthesized
cccaaagagacatatataga

SEQ ID NO: 457529 - DNA, 20 bp, Artificial Sequence
  chemically synthesized
gagacatatatagagagata

SEQ ID NO: 457530 - DNA, 20 bp, Artificial Sequence
  chemically synthesized
atatagagagatacagacat

SEQ ID NO: 457531 - DNA, 20 bp, Artificial Sequence
  chemically synthesized
gtatatataatataaatata

SEQ ID NO: 457532 - DNA, 20 bp, Artificial Sequence
  chemically synthesized
atatataatataaatatatg

SEQ ID NO: 457533 - DNA, 20 bp, Artificial Sequence
  chemically synthesized
aatataaatatatggagata

SEQ ID NO: 457534 - DNA, 20 bp, Artificial Sequence
  chemically synthesized
gagataaagataaatacaaa

SEQ ID NO: 457535 - DNA, 20 bp, Artificial Sequence
  chemically synthesized
gataaatacaaatagtgaca

SEQ ID NO: 457536 - DNA, 20 bp, Artificial Sequence
  chemically synthesized
gtgacatagatatgtaaatt

SEQ ID NO: 457537 - DNA, 20 bp, Artificial Sequence
  chemically synthesized
catagatatgtaaattcagc

SEQ ID NO: 457538 - DNA, 20 bp, Artificial Sequence
  chemically synthesized
gtaaattcagctagctatat

SEQ ID NO: 457539 - DNA, 20 bp, Artificial Sequence
  chemically synthesized
atttaccttgctgatatagc

SEQ ID NO: 457540 - DNA, 20 bp, Artificial Sequence
  chemically synthesized
attcagctagctatatcagc

SEQ ID NO: 457541 - DNA, 20 bp, Artificial Sequence
  chemically synthesized
actcatttaccttgctgata

SEQ ID NO: 457542 - DNA, 20 bp, Artificial Sequence
  chemically synthesized
ttcagctagctatatcagca

SEQ ID NO: 457543 - DNA, 20 bp, Artificial Sequence
  chemically synthesized
gctatatcagcaaggtaaat

SEQ ID NO: 457544 - DNA, 20 bp, Artificial Sequence
  chemically synthesized
ttgagttgctgacgaatttt

SEQ ID NO: 457545 - DNA, 20 bp, Artificial Sequence
  chemically synthesized
agtaaaaactgaaaattcgt

SEQ ID NO: 457546 - DNA, 20 bp, Artificial Sequence
  chemically synthesized
tgaaaattcgtcagcaactc

SEQ ID NO: 457547 - DNA, 20 bp, Artificial Sequence
  chemically synthesized
ttttactaaaaatataactt

SEQ ID NO: 457548 - DNA, 20 bp, Artificial Sequence
  chemically synthesized
agcaactcaagttatatttt

SEQ ID NO: 457549 - DNA, 20 bp, Artificial Sequence
  chemically synthesized
ttatatttttagtaaaaata

SEQ ID NO: 457550 - DNA, 20 bp, Artificial Sequence
  chemically synthesized
ttctgaatttgtttagaaca

SEQ ID NO: 457551 - DNA, 20 bp, Artificial Sequence
  chemically synthesized
tttctgaatttgtttagaac

SEQ ID NO: 457552 - DNA, 20 bp, Artificial Sequence
  chemically synthesized
tgtttgtttctgaatttgtt

SEQ ID NO: 457553 - DNA, 20 bp, Artificial Sequence
  chemically synthesized
agccttgttctaaacaaatt

SEQ ID NO: 457554 - DNA, 20 bp, Artificial Sequence
  chemically synthesized
aacaaattcagaaacaaaca

SEQ ID NO: 457555 - DNA, 20 bp, Artificial Sequence
  chemically synthesized
caaattcagaaacaaacaca

SEQ ID NO: 457556 - DNA, 20 bp, Artificial Sequence
  chemically synthesized
aaacaaacacagagactaac

SEQ ID NO: 457557 - DNA, 20 bp, Artificial Sequence
  chemically synthesized
cataaccagttgtcactggt

SEQ ID NO: 457558 - DNA, 20 bp, Artificial Sequence
  chemically synthesized
attgcataaccagttgtcac

SEQ ID NO: 457559 - DNA, 20 bp, Artificial Sequence
  chemically synthesized
agagactaaccagtgacaac

SEQ ID NO: 457560 - DNA, 20 bp, Artificial Sequence
  chemically synthesized
caggatgtttattgcataac

SEQ ID NO: 457561 - DNA, 20 bp, Artificial Sequence
  chemically synthesized
tattgcacaccgcaattgtc

SEQ ID NO: 457562 - DNA, 20 bp, Artificial Sequence
  chemically synthesized
aataaacatcctgacaattg

SEQ ID NO: 457563 - DNA, 20 bp, Artificial Sequence
  chemically synthesized
ttattgcacaccgcaattgt

SEQ ID NO: 457564 - DNA, 20 bp, Artificial Sequence
  chemically synthesized
caattgcggtgtgcaataaa

SEQ ID NO: 457565 - DNA, 20 bp, Artificial Sequence
  chemically synthesized
gtggaaataatggtagatgt

SEQ ID NO: 457566 - DNA, 20 bp, Artificial Sequence
  chemically synthesized
tgtggaaataatggtagatg

SEQ ID NO: 457567 - DNA, 20 bp, Artificial Sequence
  chemically synthesized
catccctgtggaaataatgg

SEQ ID NO: 457568 - DNA, 20 bp, Artificial Sequence
  chemically synthesized
caacatccctgtggaaataa

SEQ ID NO: 457569 - DNA, 20 bp, Artificial Sequence
  chemically synthesized
cacatctaccattatttcca

SEQ ID NO: 457570 - DNA, 20 bp, Artificial Sequence
  chemically synthesized
acatctaccattatttccac

SEQ ID NO: 457571 - DNA, 20 bp, Artificial Sequence
  chemically synthesized
catctaccattatttccaca

SEQ ID NO: 457572 - DNA, 20 bp, Artificial Sequence
  chemically synthesized
atggatttacaacatccctg

SEQ ID NO: 457573 - DNA, 20 bp, Artificial Sequence
  chemically synthesized
gatgttgtaaatccattcac

SEQ ID NO: 457574 - DNA, 20 bp, Artificial Sequence
  chemically synthesized
gtaaatgtttggccagtgaa

SEQ ID NO: 457575 - DNA, 20 bp, Artificial Sequence
  chemically synthesized
taactcagtaaatgtttggc

SEQ ID NO: 457576 - DNA, 20 bp, Artificial Sequence
  chemically synthesized
tcaataactcagtaaatgtt

SEQ ID NO: 457577 - DNA, 20 bp, Artificial Sequence
  chemically synthesized
tcactggccaaacatttact

SEQ ID NO: 457578 - DNA, 20 bp, Artificial Sequence
  chemically synthesized
atagggagtagtcaataact

SEQ ID NO: 457579 - DNA, 20 bp, Artificial Sequence
  chemically synthesized
gcacagaaactgatagggag

SEQ ID NO: 457580 - DNA, 20 bp, Artificial Sequence
  chemically synthesized
agttattgactactccctat

SEQ ID NO: 457581 - DNA, 20 bp, Artificial Sequence
  chemically synthesized
atagcacagaaactgatagg

SEQ ID NO: 457582 - DNA, 20 bp, Artificial Sequence
  chemically synthesized
agatagcacagaaactgata

SEQ ID NO: 457583 - DNA, 20 bp, Artificial Sequence
  chemically synthesized
tagatagcacagaaactgat

SEQ ID NO: 457584 - DNA, 20 bp, Artificial Sequence
  chemically synthesized
ctagatagcacagaaactga

SEQ ID NO: 457585 - DNA, 20 bp, Artificial Sequence
  chemically synthesized
ctatcagtttctgtgctatc

SEQ ID NO: 457586 - DNA, 20 bp, Artificial Sequence
  chemically synthesized
actgttttatctagatagca

SEQ ID NO: 457587 - DNA, 20 bp, Artificial Sequence
  chemically synthesized
cactcactgttttatctaga

SEQ ID NO: 457588 - DNA, 20 bp, Artificial Sequence
  chemically synthesized
tctgtgctatctagataaaa

SEQ ID NO: 457589 - DNA, 20 bp, Artificial Sequence
  chemically synthesized
ttgtcactcactgttttatc

SEQ ID NO: 457590 - DNA, 20 bp, Artificial Sequence
  chemically synthesized
tgctatctagataaaacagt

SEQ ID NO: 457591 - DNA, 20 bp, Artificial Sequence
  chemically synthesized
ataaaacagtgagtgacaaa

SEQ ID NO: 457592 - DNA, 20 bp, Artificial Sequence
  chemically synthesized
aaacagtgagtgacaaatag

SEQ ID NO: 457593 - DNA, 20 bp, Artificial Sequence
  chemically synthesized
tgacaaatagtggctatcct

SEQ ID NO: 457594 - DNA, 20 bp, Artificial Sequence
  chemically synthesized
gacaaatagtggctatcctt

SEQ ID NO: 457595 - DNA, 20 bp, Artificial Sequence
  chemically synthesized
acaaatagtggctatcctta

SEQ ID NO: 457596 - DNA, 20 bp, Artificial Sequence
  chemically synthesized
taattttagctccctaagga

SEQ ID NO: 457597 - DNA, 20 bp, Artificial Sequence
  chemically synthesized
aaatagtggctatccttagg

SEQ ID NO: 457598 - DNA, 20 bp, Artificial Sequence
  chemically synthesized
tgtgtaattttagctcccta

SEQ ID NO: 457599 - DNA, 20 bp, Artificial Sequence
  chemically synthesized
ttgtgtaattttagctccct

SEQ ID NO: 457600 - DNA, 20 bp, Artificial Sequence
  chemically synthesized
tgtgtccatttgtgtaattt

SEQ ID NO: 457601 - DNA, 20 bp, Artificial Sequence
  chemically synthesized
gggagctaaaattacacaaa

SEQ ID NO: 457602 - DNA, 20 bp, Artificial Sequence
  chemically synthesized
taaaattacacaaatggaca

SEQ ID NO: 457603 - DNA, 20 bp, Artificial Sequence
  chemically synthesized
gtctcttgtcatacggttga

SEQ ID NO: 457604 - DNA, 20 bp, Artificial Sequence
  chemically synthesized
aattctatcaaccgtatgac

SEQ ID NO: 457605 - DNA, 20 bp, Artificial Sequence
  chemically synthesized
catggatgtctcttgtcata

SEQ ID NO: 457606 - DNA, 20 bp, Artificial Sequence
  chemically synthesized
ttctatcaaccgtatgacaa

SEQ ID NO: 457607 - DNA, 20 bp, Artificial Sequence
  chemically synthesized
cgtatgacaagagacatcca

SEQ ID NO: 457608 - DNA, 20 bp, Artificial Sequence
  chemically synthesized
gtatgacaagagacatccat

SEQ ID NO: 457609 - DNA, 20 bp, Artificial Sequence
  chemically synthesized
tatgacaagagacatccatg

SEQ ID NO: 457610 - DNA, 20 bp, Artificial Sequence
  chemically synthesized
atgacaagagacatccatgg

SEQ ID NO: 457611 - DNA, 20 bp, Artificial Sequence
  chemically synthesized
acatattagctcatccccca

SEQ ID NO: 457612 - DNA, 20 bp, Artificial Sequence
  chemically synthesized
aagagacatccatgggggat

SEQ ID NO: 457613 - DNA, 20 bp, Artificial Sequence
  chemically synthesized
aatagtttgtcatcacatat

SEQ ID NO: 457614 - DNA, 20 bp, Artificial Sequence
  chemically synthesized
gtatcatatttgtcacaaaa

SEQ ID NO: 457615 - DNA, 20 bp, Artificial Sequence
  chemically synthesized
gataatgcaaataaatattt

SEQ ID NO: 457616 - DNA, 20 bp, Artificial Sequence
  chemically synthesized
aattcatatagaatatatgt

SEQ ID NO: 457617 - DNA, 20 bp, Artificial Sequence
  chemically synthesized
gttacatatcagaattcata

SEQ ID NO: 457618 - DNA, 20 bp, Artificial Sequence
  chemically synthesized
aagaaatgatagttacatat

SEQ ID NO: 457619 - DNA, 20 bp, Artificial Sequence
  chemically synthesized
taggtaaaatgaagaaatga

SEQ ID NO: 457620 - DNA, 20 bp, Artificial Sequence
  chemically synthesized
tggatctcataggtaaaatg

SEQ ID NO: 457621 - DNA, 20 bp, Artificial Sequence
  chemically synthesized
catttcttcattttacctat

SEQ ID NO: 457622 - DNA, 20 bp, Artificial Sequence
  chemically synthesized
ttaacttacctggatctcat

SEQ ID NO: 457623 - DNA, 20 bp, Artificial Sequence
  chemically synthesized
ttcattttacctatgagatc

SEQ ID NO: 457624 - DNA, 20 bp, Artificial Sequence
  chemically synthesized
tttaacttacctggatctca

SEQ ID NO: 457625 - DNA, 20 bp, Artificial Sequence
  chemically synthesized
tcattttacctatgagatcc

SEQ ID NO: 457626 - DNA, 20 bp, Artificial Sequence
  chemically synthesized
tttacctatgagatccaggt

SEQ ID NO: 457627 - DNA, 20 bp, Artificial Sequence
  chemically synthesized
gtgatatgatttaacttacc

SEQ ID NO: 457628 - DNA, 20 bp, Artificial Sequence
  chemically synthesized
ttaaatcatatcacattatt

SEQ ID NO: 457629 - DNA, 20 bp, Artificial Sequence
  chemically synthesized
agtcaacagctgattggata

SEQ ID NO: 457630 - DNA, 20 bp, Artificial Sequence
  chemically synthesized
atttagattctatatccaat

SEQ ID NO: 457631 - DNA, 20 bp, Artificial Sequence
  chemically synthesized
gataaaagtcaacagctgat

SEQ ID NO: 457632 - DNA, 20 bp, Artificial Sequence
  chemically synthesized
aagacatggataaaagtcaa

SEQ ID NO: 457633 - DNA, 20 bp, Artificial Sequence
  chemically synthesized
gctatgaaagacatggataa

SEQ ID NO: 457634 - DNA, 20 bp, Artificial Sequence
  chemically synthesized
caataaagctatgaaagaca

SEQ ID NO: 457635 - DNA, 20 bp, Artificial Sequence
  chemically synthesized
acttttatccatgtctttca

SEQ ID NO: 457636 - DNA, 20 bp, Artificial Sequence
  chemically synthesized
aaaagccaataaagctatga

SEQ ID NO: 457637 - DNA, 20 bp, Artificial Sequence
  chemically synthesized
catgtctttcatagctttat

SEQ ID NO: 457638 - DNA, 20 bp, Artificial Sequence
  chemically synthesized
tactaggagaaaagccaata

SEQ ID NO: 457639 - DNA, 20 bp, Artificial Sequence
  chemically synthesized
agctttattggcttttctcc

SEQ ID NO: 457640 - DNA, 20 bp, Artificial Sequence
  chemically synthesized
agaaagcattactaggagaa

SEQ ID NO: 457641 - DNA, 20 bp, Artificial Sequence
  chemically synthesized
acaagagaaagcattactag

SEQ ID NO: 457642 - DNA, 20 bp, Artificial Sequence
  chemically synthesized
tcacaagagaaagcattact

SEQ ID NO: 457643 - DNA, 20 bp, Artificial Sequence
  chemically synthesized
ttcacaagagaaagcattac

SEQ ID NO: 457644 - DNA, 20 bp, Artificial Sequence
  chemically synthesized
ggaatacctttcacaagaga

SEQ ID NO: 457645 - DNA, 20 bp, Artificial Sequence
  chemically synthesized
agtaatgctttctcttgtga

SEQ ID NO: 457646 - DNA, 20 bp, Artificial Sequence
  chemically synthesized
gtaatgctttctcttgtgaa

SEQ ID NO: 457647 - DNA, 20 bp, Artificial Sequence
  chemically synthesized
atatggaatacctttcacaa

SEQ ID NO: 457648 - DNA, 20 bp, Artificial Sequence
  chemically synthesized
ttatatggaatacctttcac

SEQ ID NO: 457649 - DNA, 20 bp, Artificial Sequence
  chemically synthesized
accttgctttaataattata

SEQ ID NO: 457650 - DNA, 20 bp, Artificial Sequence
  chemically synthesized
ggtattccatataattatta

SEQ ID NO: 457651 - DNA, 20 bp, Artificial Sequence
  chemically synthesized
ttccatataattattaaagc

SEQ ID NO: 457652 - DNA, 20 bp, Artificial Sequence
  chemically synthesized
tccatataattattaaagca

SEQ ID NO: 457653 - DNA, 20 bp, Artificial Sequence
  chemically synthesized
tattaaagcaaggttattcc

SEQ ID NO: 457654 - DNA, 20 bp, Artificial Sequence
  chemically synthesized
agcaaggttattccaagtta

SEQ ID NO: 457655 - DNA, 20 bp, Artificial Sequence
  chemically synthesized
cacaatggattactttaact

SEQ ID NO: 457656 - DNA, 20 bp, Artificial Sequence
  chemically synthesized
caagttaaagtaatccattg

SEQ ID NO: 457657 - DNA, 20 bp, Artificial Sequence
  chemically synthesized
tgtgggagacatcaccacaa

SEQ ID NO: 457658 - DNA, 20 bp, Artificial Sequence
  chemically synthesized
gacagtgatgtttcatgtgg

SEQ ID NO: 457659 - DNA, 20 bp, Artificial Sequence
  chemically synthesized
cagacagtgatgtttcatgt

SEQ ID NO: 457660 - DNA, 20 bp, Artificial Sequence
  chemically synthesized
tcagacagtgatgtttcatg

SEQ ID NO: 457661 - DNA, 20 bp, Artificial Sequence
  chemically synthesized
atgaaacatcactgtctgaa

SEQ ID NO: 457662 - DNA, 20 bp, Artificial Sequence
  chemically synthesized
tttagtttgctccattcaga

SEQ ID NO: 457663 - DNA, 20 bp, Artificial Sequence
  chemically synthesized
gaaacatcactgtctgaatg

SEQ ID NO: 457664 - DNA, 20 bp, Artificial Sequence
  chemically synthesized
attttttagtttgctccatt

SEQ ID NO: 457665 - DNA, 20 bp, Artificial Sequence
  chemically synthesized
gccttttattatttattttt

SEQ ID NO: 457666 - DNA, 20 bp, Artificial Sequence
  chemically synthesized
aactaaaaaataaataataa

SEQ ID NO: 457667 - DNA, 20 bp, Artificial Sequence
  chemically synthesized
actaaaaaataaataataaa

SEQ ID NO: 457668 - DNA, 20 bp, Artificial Sequence
  chemically synthesized
aaaaaataaataataaaagg

SEQ ID NO: 457669 - DNA, 20 bp, Artificial Sequence
  chemically synthesized
ctctgtcacctaaatttaaa

SEQ ID NO: 457670 - DNA, 20 bp, Artificial Sequence
  chemically synthesized
aaaaggcagctttttaaatt

SEQ ID NO: 457671 - DNA, 20 bp, Artificial Sequence
  chemically synthesized
aaaggcagctttttaaattt

SEQ ID NO: 457672 - DNA, 20 bp, Artificial Sequence
  chemically synthesized
agctttttaaatttaggtga

SEQ ID NO: 457673 - DNA, 20 bp, Artificial Sequence
  chemically synthesized
ctttttaaatttaggtgaca

SEQ ID NO: 457674 - DNA, 20 bp, Artificial Sequence
  chemically synthesized
aaatttaggtgacagagcac

SEQ ID NO: 457675 - DNA, 20 bp, Artificial Sequence
  chemically synthesized
tttaggtgacagagcacaag

SEQ ID NO: 457676 - DNA, 20 bp, Artificial Sequence
  chemically synthesized
caagcagattctataaatta

SEQ ID NO: 457677 - DNA, 20 bp, Artificial Sequence
  chemically synthesized
tatgaaactgctataattta

SEQ ID NO: 457678 - DNA, 20 bp, Artificial Sequence
  chemically synthesized
gcagattctataaattatag

SEQ ID NO: 457679 - DNA, 20 bp, Artificial Sequence
  chemically synthesized
aaattatagcagtttcataa

SEQ ID NO: 457680 - DNA, 20 bp, Artificial Sequence
  chemically synthesized
aattatagcagtttcataaa

SEQ ID NO: 457681 - DNA, 20 bp, Artificial Sequence
  chemically synthesized
ttcataaaaggtaaaatccc

SEQ ID NO: 457682 - DNA, 20 bp, Artificial Sequence
  chemically synthesized
tagttctgagaggttttctt

SEQ ID NO: 457683 - DNA, 20 bp, Artificial Sequence
  chemically synthesized
atagttctgagaggttttct

SEQ ID NO: 457684 - DNA, 20 bp, Artificial Sequence
  chemically synthesized
aaaatcccaagaaaacctct

SEQ ID NO: 457685 - DNA, 20 bp, Artificial Sequence
  chemically synthesized
aaaatgtgaatagttctgag

SEQ ID NO: 457686 - DNA, 20 bp, Artificial Sequence
  chemically synthesized
aaaaatgtgaatagttctga

SEQ ID NO: 457687 - DNA, 20 bp, Artificial Sequence
  chemically synthesized
tcaaaaatgtgaatagttct

SEQ ID NO: 457688 - DNA, 20 bp, Artificial Sequence
  chemically synthesized
cataaattcaaaaatgtgaa

SEQ ID NO: 457689 - DNA, 20 bp, Artificial Sequence
  chemically synthesized
atttttgaatttatgtcttc

SEQ ID NO: 457690 - DNA, 20 bp, Artificial Sequence
  chemically synthesized
tttttgaatttatgtcttct

SEQ ID NO: 457691 - DNA, 20 bp, Artificial Sequence
  chemically synthesized
ttttgaatttatgtcttcta

SEQ ID NO: 457692 - DNA, 20 bp, Artificial Sequence
  chemically synthesized
catcctacagtgtaccctag

SEQ ID NO: 457693 - DNA, 20 bp, Artificial Sequence
  chemically synthesized
ctacatcctacagtgtaccc

SEQ ID NO: 457694 - DNA, 20 bp, Artificial Sequence
  chemically synthesized
atgtcttctagggtacactg

SEQ ID NO: 457695 - DNA, 20 bp, Artificial Sequence
  chemically synthesized
tgtcttctagggtacactgt

SEQ ID NO: 457696 - DNA, 20 bp, Artificial Sequence
  chemically synthesized
ctagggtacactgtaggatg

SEQ ID NO: 457697 - DNA, 20 bp, Artificial Sequence
  chemically synthesized
tcttctttaactacatccta

SEQ ID NO: 457698 - DNA, 20 bp, Artificial Sequence
  chemically synthesized
tacactgtaggatgtagtta

SEQ ID NO: 457699 - DNA, 20 bp, Artificial Sequence
  chemically synthesized
actgtaggatgtagttaaag

SEQ ID NO: 457700 - DNA, 20 bp, Artificial Sequence
  chemically synthesized
gatgtagttaaagaagaaaa

SEQ ID NO: 457701 - DNA, 20 bp, Artificial Sequence
  chemically synthesized
agaagaaaaaagaaaaaaat

SEQ ID NO: 457702 - DNA, 20 bp, Artificial Sequence
  chemically synthesized
aagaaaaaagaaaaaaataa

SEQ ID NO: 457703 - DNA, 20 bp, Artificial Sequence
  chemically synthesized
agaaaaaagaaaaaaataag

SEQ ID NO: 457704 - DNA, 20 bp, Artificial Sequence
  chemically synthesized
tttcaatataatatgaattc

SEQ ID NO: 457705 - DNA, 20 bp, Artificial Sequence
  chemically synthesized
ttctcctatcatgataaaac

SEQ ID NO: 457706 - DNA, 20 bp, Artificial Sequence
  chemically synthesized
gaattccagttttatcatga

SEQ ID NO: 457707 - DNA, 20 bp, Artificial Sequence
  chemically synthesized
aattccagttttatcatgat

SEQ ID NO: 457708 - DNA, 20 bp, Artificial Sequence
  chemically synthesized
ttccagttttatcatgatag

SEQ ID NO: 457709 - DNA, 20 bp, Artificial Sequence
  chemically synthesized
tttatcatgataggagaata

SEQ ID NO: 457710 - DNA, 20 bp, Artificial Sequence
  chemically synthesized
tgataggagaatatagactg

SEQ ID NO: 457711 - DNA, 20 bp, Artificial Sequence
  chemically synthesized
gataggagaatatagactgt

SEQ ID NO: 457712 - DNA, 20 bp, Artificial Sequence
  chemically synthesized
aggagaatatagactgtagg

SEQ ID NO: 457713 - DNA, 20 bp, Artificial Sequence
  chemically synthesized
tggtaccattatacttccta

SEQ ID NO: 457714 - DNA, 20 bp, Artificial Sequence
  chemically synthesized
atagactgtaggaagtataa

SEQ ID NO: 457715 - DNA, 20 bp, Artificial Sequence
  chemically synthesized
tgtaggaagtataatggtac

SEQ ID NO: 457716 - DNA, 20 bp, Artificial Sequence
  chemically synthesized
aattgacaaataaaagcatc

SEQ ID NO: 457717 - DNA, 20 bp, Artificial Sequence
  chemically synthesized
tagtaataattgacaaataa

SEQ ID NO: 457718 - DNA, 20 bp, Artificial Sequence
  chemically synthesized
tgtcaattattactaaattt

SEQ ID NO: 457719 - DNA, 20 bp, Artificial Sequence
  chemically synthesized
tttttcttttttctaaaatt

SEQ ID NO: 457720 - DNA, 20 bp, Artificial Sequence
  chemically synthesized
tattactaaattttagaaaa

SEQ ID NO: 457721 - DNA, 20 bp, Artificial Sequence
  chemically synthesized
tttagaaaaaagaaaaattc

SEQ ID NO: 457722 - DNA, 20 bp, Artificial Sequence
  chemically synthesized
aaagaaaaattctagttttt

SEQ ID NO: 457723 - DNA, 20 bp, Artificial Sequence
  chemically synthesized
agtctggaagactcaaaaac

SEQ ID NO: 457724 - DNA, 20 bp, Artificial Sequence
  chemically synthesized
attctagtttttgagtcttc

SEQ ID NO: 457725 - DNA, 20 bp, Artificial Sequence
  chemically synthesized
gtttttgagtcttccagact

SEQ ID NO: 457726 - DNA, 20 bp, Artificial Sequence
  chemically synthesized
caaatgggtgctcagtctgg

SEQ ID NO: 457727 - DNA, 20 bp, Artificial Sequence
  chemically synthesized
tgtcaaatgggtgctcagtc

SEQ ID NO: 457728 - DNA, 20 bp, Artificial Sequence
  chemically synthesized
ttgtatgtcaaatgggtgct

SEQ ID NO: 457729 - DNA, 20 bp, Artificial Sequence
  chemically synthesized
agttaaattgtatgtcaaat

SEQ ID NO: 457730 - DNA, 20 bp, Artificial Sequence
  chemically synthesized
aagttaaattgtatgtcaaa

SEQ ID NO: 457731 - DNA, 20 bp, Artificial Sequence
  chemically synthesized
cgtagctatcatattttggt

SEQ ID NO: 457732 - DNA, 20 bp, Artificial Sequence
  chemically synthesized
ataacgtagctatcatattt

SEQ ID NO: 457733 - DNA, 20 bp, Artificial Sequence
  chemically synthesized
tttaacttaccaaaatatga

SEQ ID NO: 457734 - DNA, 20 bp, Artificial Sequence
  chemically synthesized
aatatgatagctacgttatg

SEQ ID NO: 457735 - DNA, 20 bp, Artificial Sequence
  chemically synthesized
ttgtgtctagcttcataacg

SEQ ID NO: 457736 - DNA, 20 bp, Artificial Sequence
  chemically synthesized
tgatagctacgttatgaagc

SEQ ID NO: 457737 - DNA, 20 bp, Artificial Sequence
  chemically synthesized
ttgaaacatatcattgtgtc

SEQ ID NO: 457738 - DNA, 20 bp, Artificial Sequence
  chemically synthesized
tgtttcaaatgtataataat

SEQ ID NO: 457739 - DNA, 20 bp, Artificial Sequence
  chemically synthesized
atcagaaatatcccattatt

SEQ ID NO: 457740 - DNA, 20 bp, Artificial Sequence
  chemically synthesized
gttatataaaaccaaataat

SEQ ID NO: 457741 - DNA, 20 bp, Artificial Sequence
  chemically synthesized
tgttatataaaaccaaataa

SEQ ID NO: 457742 - DNA, 20 bp, Artificial Sequence
  chemically synthesized
ggttttatataacatataca

SEQ ID NO: 457743 - DNA, 20 bp, Artificial Sequence
  chemically synthesized
tgtgtcttcctttgacatat

SEQ ID NO: 457744 - DNA, 20 bp, Artificial Sequence
  chemically synthesized
tatacatagcccatatgtca

SEQ ID NO: 457745 - DNA, 20 bp, Artificial Sequence
  chemically synthesized
ttgtgtcttcctttgacata

SEQ ID NO: 457746 - DNA, 20 bp, Artificial Sequence
  chemically synthesized
atacatagcccatatgtcaa

SEQ ID NO: 457747 - DNA, 20 bp, Artificial Sequence
  chemically synthesized
catagcccatatgtcaaagg

SEQ ID NO: 457748 - DNA, 20 bp, Artificial Sequence
  chemically synthesized
tcaaaggaagacacaaaaaa

SEQ ID NO: 457749 - DNA, 20 bp, Artificial Sequence
  chemically synthesized
gaagacacaaaaaatagttt

SEQ ID NO: 457750 - DNA, 20 bp, Artificial Sequence
  chemically synthesized
caaaaaatagttttagtacc

SEQ ID NO: 457751 - DNA, 20 bp, Artificial Sequence
  chemically synthesized
tttaatcaaaaatttcaacc

SEQ ID NO: 457752 - DNA, 20 bp, Artificial Sequence
  chemically synthesized
ttttaatcaaaaatttcaac

SEQ ID NO: 457753 - DNA, 20 bp, Artificial Sequence
  chemically synthesized
aaatttttgattaaaaaatt

SEQ ID NO: 457754 - DNA, 20 bp, Artificial Sequence
  chemically synthesized
aaaaaatttagctgatcctt

SEQ ID NO: 457755 - DNA, 20 bp, Artificial Sequence
  chemically synthesized
cagttaaatttctcaaggat

SEQ ID NO: 457756 - DNA, 20 bp, Artificial Sequence
  chemically synthesized
agattcagttaaatttctca

SEQ ID NO: 457757 - DNA, 20 bp, Artificial Sequence
  chemically synthesized
tagattcagttaaatttctc

SEQ ID NO: 457758 - DNA, 20 bp, Artificial Sequence
  chemically synthesized
tttgtgaataagtttagatt

SEQ ID NO: 457759 - DNA, 20 bp, Artificial Sequence
  chemically synthesized
taagcttttgtgaataagtt

SEQ ID NO: 457760 - DNA, 20 bp, Artificial Sequence
  chemically synthesized
gaatgtaagcttttgtgaat

SEQ ID NO: 457761 - DNA, 20 bp, Artificial Sequence
  chemically synthesized
gaatctaaacttattcacaa

SEQ ID NO: 457762 - DNA, 20 bp, Artificial Sequence
  chemically synthesized
aaataagccaaagtgaatgt

SEQ ID NO: 457763 - DNA, 20 bp, Artificial Sequence
  chemically synthesized
acaaaagcttacattcactt

SEQ ID NO: 457764 - DNA, 20 bp, Artificial Sequence
  chemically synthesized
tctaaacatcaaataagcca

SEQ ID NO: 457765 - DNA, 20 bp, Artificial Sequence
  chemically synthesized
taattttctaaacatcaaat

SEQ ID NO: 457766 - DNA, 20 bp, Artificial Sequence
  chemically synthesized
actttggcttatttgatgtt

SEQ ID NO: 457767 - DNA, 20 bp, Artificial Sequence
  chemically synthesized
ttttaatgattttattcttg

SEQ ID NO: 457768 - DNA, 20 bp, Artificial Sequence
  chemically synthesized
cactattcagcaaatgctgc

SEQ ID NO: 457769 - DNA, 20 bp, Artificial Sequence
  chemically synthesized
ttcttgcagcatttgctgaa

SEQ ID NO: 457770 - DNA, 20 bp, Artificial Sequence
  chemically synthesized
ttcttaacaataacactatt

SEQ ID NO: 457771 - DNA, 20 bp, Artificial Sequence
  chemically synthesized
tgctgaatagtgttattgtt

SEQ ID NO: 457772 - DNA, 20 bp, Artificial Sequence
  chemically synthesized
tgttaagaataacacctctg

SEQ ID NO: 457773 - DNA, 20 bp, Artificial Sequence
  chemically synthesized
ctcaggaagtatcacttcag

SEQ ID NO: 457774 - DNA, 20 bp, Artificial Sequence
  chemically synthesized
tctcaggaagtatcacttca

SEQ ID NO: 457775 - DNA, 20 bp, Artificial Sequence
  chemically synthesized
gatctcaggaagtatcactt

SEQ ID NO: 457776 - DNA, 20 bp, Artificial Sequence
  chemically synthesized
cctctgaagtgatacttcct

SEQ ID NO: 457777 - DNA, 20 bp, Artificial Sequence
  chemically synthesized
taagtgtattggatctcagg

SEQ ID NO: 457778 - DNA, 20 bp, Artificial Sequence
  chemically synthesized
cagtaagtgtattggatctc

SEQ ID NO: 457779 - DNA, 20 bp, Artificial Sequence
  chemically synthesized
acagtaagtgtattggatct

SEQ ID NO: 457780 - DNA, 20 bp, Artificial Sequence
  chemically synthesized
atctaaaacagtaagtgtat

SEQ ID NO: 457781 - DNA, 20 bp, Artificial Sequence
  chemically synthesized
atccaatacacttactgttt

SEQ ID NO: 457782 - DNA, 20 bp, Artificial Sequence
  chemically synthesized
cgtaagttatctaaaacagt

SEQ ID NO: 457783 - DNA, 20 bp, Artificial Sequence
  chemically synthesized
acagcgtaagttatctaaaa

SEQ ID NO: 457784 - DNA, 20 bp, Artificial Sequence
  chemically synthesized
gttttagataacttacgctg

SEQ ID NO: 457785 - DNA, 20 bp, Artificial Sequence
  chemically synthesized
agagatgaaaactacagcgt

SEQ ID NO: 457786 - DNA, 20 bp, Artificial Sequence
  chemically synthesized
atctacagagatgaaaacta

SEQ ID NO: 457787 - DNA, 20 bp, Artificial Sequence
  chemically synthesized
cgctgtagttttcatctctg

SEQ ID NO: 457788 - DNA, 20 bp, Artificial Sequence
  chemically synthesized
tagttttcatctctgtagat

SEQ ID NO: 457789 - DNA, 20 bp, Artificial Sequence
  chemically synthesized
tgtatcccacctcatctaca

SEQ ID NO: 457790 - DNA, 20 bp, Artificial Sequence
  chemically synthesized
agttttcatctctgtagatg

SEQ ID NO: 457791 - DNA, 20 bp, Artificial Sequence
  chemically synthesized
agtgtatcccacctcatcta

SEQ ID NO: 457792 - DNA, 20 bp, Artificial Sequence
  chemically synthesized
tttcatctctgtagatgagg

SEQ ID NO: 457793 - DNA, 20 bp, Artificial Sequence
  chemically synthesized
ttcatctctgtagatgaggt

SEQ ID NO: 457794 - DNA, 20 bp, Artificial Sequence
  chemically synthesized
actgcttgataagtaggtat

SEQ ID NO: 457795 - DNA, 20 bp, Artificial Sequence
  chemically synthesized
tacactaatacctacttatc

SEQ ID NO: 457796 - DNA, 20 bp, Artificial Sequence
  chemically synthesized
tgtcagactgcttgataagt

SEQ ID NO: 457797 - DNA, 20 bp, Artificial Sequence
  chemically synthesized
ttgtcagactgcttgataag

SEQ ID NO: 457798 - DNA, 20 bp, Artificial Sequence
  chemically synthesized
actaatacctacttatcaag

SEQ ID NO: 457799 - DNA, 20 bp, Artificial Sequence
  chemically synthesized
aacttgtcagactgcttgat

SEQ ID NO: 457800 - DNA, 20 bp, Artificial Sequence
  chemically synthesized
tacttatcaagcagtctgac

SEQ ID NO: 457801 - DNA, 20 bp, Artificial Sequence
  chemically synthesized
taataattcttaaaacttgt

SEQ ID NO: 457802 - DNA, 20 bp, Artificial Sequence
  chemically synthesized
caagcagtctgacaagtttt

SEQ ID NO: 457803 - DNA, 20 bp, Artificial Sequence
  chemically synthesized
aatttggtttaaatttaatt

SEQ ID NO: 457804 - DNA, 20 bp, Artificial Sequence
  chemically synthesized
ttaaatttaaaccaaattaa

SEQ ID NO: 457805 - DNA, 20 bp, Artificial Sequence
  chemically synthesized
tttggcatatactattaatt

SEQ ID NO: 457806 - DNA, 20 bp, Artificial Sequence
  chemically synthesized
gtgtgtgtacattcacaatt

SEQ ID NO: 457807 - DNA, 20 bp, Artificial Sequence
  chemically synthesized
gtgaatgtacacacacacat

SEQ ID NO: 457808 - DNA, 20 bp, Artificial Sequence
  chemically synthesized
cttaaatatttttggaaaaa

SEQ ID NO: 457809 - DNA, 20 bp, Artificial Sequence
  chemically synthesized
ttcttttacttaaatatttt

SEQ ID NO: 457810 - DNA, 20 bp, Artificial Sequence
  chemically synthesized
ctttttttccaaaaatattt

SEQ ID NO: 457811 - DNA, 20 bp, Artificial Sequence
  chemically synthesized
ttccaaaaatatttaagtaa

SEQ ID NO: 457812 - DNA, 20 bp, Artificial Sequence
  chemically synthesized
tatttaagtaaaagaacata

SEQ ID NO: 457813 - DNA, 20 bp, Artificial Sequence
  chemically synthesized
aagaacataaagtttaaaaa

SEQ ID NO: 457814 - DNA, 20 bp, Artificial Sequence
  chemically synthesized
agtttaaaaatagactttga

SEQ ID NO: 457815 - DNA, 20 bp, Artificial Sequence
  chemically synthesized
ttaaaaatagactttgatag

SEQ ID NO: 457816 - DNA, 20 bp, Artificial Sequence
  chemically synthesized
aaaaagtctgtctactatca

SEQ ID NO: 457817 - DNA, 20 bp, Artificial Sequence
  chemically synthesized
aaatagactttgatagtaga

SEQ ID NO: 457818 - DNA, 20 bp, Artificial Sequence
  chemically synthesized
ttaccaattcatcaaaaaaa

SEQ ID NO: 457819 - DNA, 20 bp, Artificial Sequence
  chemically synthesized
agactttttttttgatgaat

SEQ ID NO: 457820 - DNA, 20 bp, Artificial Sequence
  chemically synthesized
tttatttaaaattatagaac

SEQ ID NO: 457821 - DNA, 20 bp, Artificial Sequence
  chemically synthesized
aaactttttatttaaaatta

SEQ ID NO: 457822 - DNA, 20 bp, Artificial Sequence
  chemically synthesized
gttctataattttaaataaa

SEQ ID NO: 457823 - DNA, 20 bp, Artificial Sequence
  chemically synthesized
cgtatttttaaagatacaat

SEQ ID NO: 457824 - DNA, 20 bp, Artificial Sequence
  chemically synthesized
ctcaccaacacgtattttta

SEQ ID NO: 457825 - DNA, 20 bp, Artificial Sequence
  chemically synthesized
gtatctttaaaaatacgtgt

SEQ ID NO: 457826 - DNA, 20 bp, Artificial Sequence
  chemically synthesized
ctttaaaaatacgtgttggt

SEQ ID NO: 457827 - DNA, 20 bp, Artificial Sequence
  chemically synthesized
tttaaaaatacgtgttggtg

SEQ ID NO: 457828 - DNA, 20 bp, Artificial Sequence
  chemically synthesized
aatacgtgttggtgaggatt

SEQ ID NO: 457829 - DNA, 20 bp, Artificial Sequence
  chemically synthesized
tacgtgttggtgaggatttg

SEQ ID NO: 457830 - DNA, 20 bp, Artificial Sequence
  chemically synthesized
gttggtgaggatttggagaa

SEQ ID NO: 457831 - DNA, 20 bp, Artificial Sequence
  chemically synthesized
ttggtgaggatttggagaaa

SEQ ID NO: 457832 - DNA, 20 bp, Artificial Sequence
  chemically synthesized
ttcccacaaacagtgcatga

SEQ ID NO: 457833 - DNA, 20 bp, Artificial Sequence
  chemically synthesized
attcccacaaacagtgcatg

SEQ ID NO: 457834 - DNA, 20 bp, Artificial Sequence
  chemically synthesized
cattcccacaaacagtgcat

SEQ ID NO: 457835 - DNA, 20 bp, Artificial Sequence
  chemically synthesized
aaaccctcatgcactgtttg

SEQ ID NO: 457836 - DNA, 20 bp, Artificial Sequence
  chemically synthesized
aaccctcatgcactgtttgt

SEQ ID NO: 457837 - DNA, 20 bp, Artificial Sequence
  chemically synthesized
ccaatttacattcccacaaa

SEQ ID NO: 457838 - DNA, 20 bp, Artificial Sequence
  chemically synthesized
ctgtttgtgggaatgtaaat

SEQ ID NO: 457839 - DNA, 20 bp, Artificial Sequence
  chemically synthesized
tgtgggaatgtaaattggta

SEQ ID NO: 457840 - DNA, 20 bp, Artificial Sequence
  chemically synthesized
ccctactattttttttgtaa

SEQ ID NO: 457841 - DNA, 20 bp, Artificial Sequence
  chemically synthesized
tacagccattacaaaaaaaa

SEQ ID NO: 457842 - DNA, 20 bp, Artificial Sequence
  chemically synthesized
agccattacaaaaaaaatag

SEQ ID NO: 457843 - DNA, 20 bp, Artificial Sequence
  chemically synthesized
gccattacaaaaaaaatagt

SEQ ID NO: 457844 - DNA, 20 bp, Artificial Sequence
  chemically synthesized
ccattacaaaaaaaatagta

SEQ ID NO: 457845 - DNA, 20 bp, Artificial Sequence
  chemically synthesized
attacaaaaaaaatagtagg

SEQ ID NO: 457846 - DNA, 20 bp, Artificial Sequence
  chemically synthesized
ttacaaaaaaaatagtaggg

SEQ ID NO: 457847 - DNA, 20 bp, Artificial Sequence
  chemically synthesized
aattctatttttaatagttt

SEQ ID NO: 457848 - DNA, 20 bp, Artificial Sequence
  chemically synthesized
gtttctcaaactattaaaaa

SEQ ID NO: 457849 - DNA, 20 bp, Artificial Sequence
  chemically synthesized
catggtaattctatttttaa

SEQ ID NO: 457850 - DNA, 20 bp, Artificial Sequence
  chemically synthesized
attaaaaatagaattaccat

SEQ ID NO: 457851 - DNA, 20 bp, Artificial Sequence
  chemically synthesized
aatagaattaccatgagatc

SEQ ID NO: 457852 - DNA, 20 bp, Artificial Sequence
  chemically synthesized
agtgaaattgctagatctca

SEQ ID NO: 457853 - DNA, 20 bp, Artificial Sequence
  chemically synthesized
ataatcaacagtgaaattgc

SEQ ID NO: 457854 - DNA, 20 bp, Artificial Sequence
  chemically synthesized
ttcttcaggtaaataatcaa

SEQ ID NO: 457855 - DNA, 20 bp, Artificial Sequence
  chemically synthesized
cactgttgattatttacctg

SEQ ID NO: 457856 - DNA, 20 bp, Artificial Sequence
  chemically synthesized
atactaatttcatgttcttc

SEQ ID NO: 457857 - DNA, 20 bp, Artificial Sequence
  chemically synthesized
gatactaatttcatgttctt

SEQ ID NO: 457858 - DNA, 20 bp, Artificial Sequence
  chemically synthesized
ttacctgaagaacatgaaat

SEQ ID NO: 457859 - DNA, 20 bp, Artificial Sequence
  chemically synthesized
cagagtacagatatattttt

SEQ ID NO: 457860 - DNA, 20 bp, Artificial Sequence
  chemically synthesized
cagcaataaatgtcagagta

SEQ ID NO: 457861 - DNA, 20 bp, Artificial Sequence
  chemically synthesized
taatgcagcaataaatgtca

SEQ ID NO: 457862 - DNA, 20 bp, Artificial Sequence
  chemically synthesized
aataatgcagcaataaatgt

SEQ ID NO: 457863 - DNA, 20 bp, Artificial Sequence
  chemically synthesized
cttggctattgtgaataatg

SEQ ID NO: 457864 - DNA, 20 bp, Artificial Sequence
  chemically synthesized
tattgctgcattattcacaa

SEQ ID NO: 457865 - DNA, 20 bp, Artificial Sequence
  chemically synthesized
ctgcattattcacaatagcc

SEQ ID NO: 457866 - DNA, 20 bp, Artificial Sequence
  chemically synthesized
tattcacaatagccaagata

SEQ ID NO: 457867 - DNA, 20 bp, Artificial Sequence
  chemically synthesized
cacaggttgtggctatatct

SEQ ID NO: 457868 - DNA, 20 bp, Artificial Sequence
  chemically synthesized
acatccacaaacacaggttg

SEQ ID NO: 457869 - DNA, 20 bp, Artificial Sequence
  chemically synthesized
atagccacaacctgtgtttg

SEQ ID NO: 457870 - DNA, 20 bp, Artificial Sequence
  chemically synthesized
atccatacatccacaaacac

SEQ ID NO: 457871 - DNA, 20 bp, Artificial Sequence
  chemically synthesized
catccatacatccacaaaca

SEQ ID NO: 457872 - DNA, 20 bp, Artificial Sequence
  chemically synthesized
aacctgtgtttgtggatgta

SEQ ID NO: 457873 - DNA, 20 bp, Artificial Sequence
  chemically synthesized
tgtggatgtatggatgaata

SEQ ID NO: 457874 - DNA, 20 bp, Artificial Sequence
  chemically synthesized
atggatgaataaagaaatta

SEQ ID NO: 457875 - DNA, 20 bp, Artificial Sequence
  chemically synthesized
gtatacaatgaaatattatt

SEQ ID NO: 457876 - DNA, 20 bp, Artificial Sequence
  chemically synthesized
aaatattattcagccataaa

SEQ ID NO: 457877 - DNA, 20 bp, Artificial Sequence
  chemically synthesized
tattattcagccataaaaag

SEQ ID NO: 457878 - DNA, 20 bp, Artificial Sequence
  chemically synthesized
gcaagatttccttcttttta

SEQ ID NO: 457879 - DNA, 20 bp, Artificial Sequence
  chemically synthesized
attattcagccataaaaaga

SEQ ID NO: 457880 - DNA, 20 bp, Artificial Sequence
  chemically synthesized
ttcaccttgttgcaaatcgc

SEQ ID NO: 457881 - DNA, 20 bp, Artificial Sequence
  chemically synthesized
gaaatcttgcgatttgcaac

SEQ ID NO: 457882 - DNA, 20 bp, Artificial Sequence
  chemically synthesized
aaatcttgcgatttgcaaca

SEQ ID NO: 457883 - DNA, 20 bp, Artificial Sequence
  chemically synthesized
gatttgcaacaaggtgaact

SEQ ID NO: 457884 - DNA, 20 bp, Artificial Sequence
  chemically synthesized
tttgcaacaaggtgaacttg

SEQ ID NO: 457885 - DNA, 20 bp, Artificial Sequence
  chemically synthesized
ttgcaacaaggtgaacttgg

SEQ ID NO: 457886 - DNA, 20 bp, Artificial Sequence
  chemically synthesized
tcacatagcatatgtcctcc

SEQ ID NO: 457887 - DNA, 20 bp, Artificial Sequence
  chemically synthesized
ttttctgcccttatttcaca

SEQ ID NO: 457888 - DNA, 20 bp, Artificial Sequence
  chemically synthesized
ggacatatgctatgtgaaat

SEQ ID NO: 457889 - DNA, 20 bp, Artificial Sequence
  chemically synthesized
gacatatgctatgtgaaata

SEQ ID NO: 457890 - DNA, 20 bp, Artificial Sequence
  chemically synthesized
acatatgctatgtgaaataa

SEQ ID NO: 457891 - DNA, 20 bp, Artificial Sequence
  chemically synthesized
tatgctatgtgaaataaggg

SEQ ID NO: 457892 - DNA, 20 bp, Artificial Sequence
  chemically synthesized
ataagggcagaaaaaaatga

SEQ ID NO: 457893 - DNA, 20 bp, Artificial Sequence
  chemically synthesized
atgttgcatgatattatgtg

SEQ ID NO: 457894 - DNA, 20 bp, Artificial Sequence
  chemically synthesized
aatataaaatgttgaactta

SEQ ID NO: 457895 - DNA, 20 bp, Artificial Sequence
  chemically synthesized
ataaaatgttgaacttatag

SEQ ID NO: 457896 - DNA, 20 bp, Artificial Sequence
  chemically synthesized
aaatgttgaacttatagaag

SEQ ID NO: 457897 - DNA, 20 bp, Artificial Sequence
  chemically synthesized
attctactccctacttctat

SEQ ID NO: 457898 - DNA, 20 bp, Artificial Sequence
  chemically synthesized
aatgttgaacttatagaagt

SEQ ID NO: 457899 - DNA, 20 bp, Artificial Sequence
  chemically synthesized
atgttgaacttatagaagta

SEQ ID NO: 457900 - DNA, 20 bp, Artificial Sequence
  chemically synthesized
gttgaacttatagaagtagg

SEQ ID NO: 457901 - DNA, 20 bp, Artificial Sequence
  chemically synthesized
gaacttatagaagtagggag

SEQ ID NO: 457902 - DNA, 20 bp, Artificial Sequence
  chemically synthesized
tatagaagtagggagtagaa

SEQ ID NO: 457903 - DNA, 20 bp, Artificial Sequence
  chemically synthesized
agaagtagggagtagaatag

SEQ ID NO: 457904 - DNA, 20 bp, Artificial Sequence
  chemically synthesized
gggagtagaatagcggttgc

SEQ ID NO: 457905 - DNA, 20 bp, Artificial Sequence
  chemically synthesized
ggagtagaatagcggttgcc

SEQ ID NO: 457906 - DNA, 20 bp, Artificial Sequence
  chemically synthesized
agtagaatagcggttgccag

SEQ ID NO: 457907 - DNA, 20 bp, Artificial Sequence
  chemically synthesized
agaatagcggttgccaggag

SEQ ID NO: 457908 - DNA, 20 bp, Artificial Sequence
  chemically synthesized
ctccccatttataccactcc

SEQ ID NO: 457909 - DNA, 20 bp, Artificial Sequence
  chemically synthesized
gttgccaggagtggtataaa

SEQ ID NO: 457910 - DNA, 20 bp, Artificial Sequence
  chemically synthesized
ttgccaggagtggtataaat

SEQ ID NO: 457911 - DNA, 20 bp, Artificial Sequence
  chemically synthesized
tgccaggagtggtataaatg

SEQ ID NO: 457912 - DNA, 20 bp, Artificial Sequence
  chemically synthesized
ccaggagtggtataaatggg

SEQ ID NO: 457913 - DNA, 20 bp, Artificial Sequence
  chemically synthesized
tggtataaatggggagttgt

SEQ ID NO: 457914 - DNA, 20 bp, Artificial Sequence
  chemically synthesized
ataaatggggagttgttggt

SEQ ID NO: 457915 - DNA, 20 bp, Artificial Sequence
  chemically synthesized
aaatggggagttgttggtca

SEQ ID NO: 457916 - DNA, 20 bp, Artificial Sequence
  chemically synthesized
atggggagttgttggtcaga

SEQ ID NO: 457917 - DNA, 20 bp, Artificial Sequence
  chemically synthesized
gggagttgttggtcagagag

SEQ ID NO: 457918 - DNA, 20 bp, Artificial Sequence
  chemically synthesized
ggagttgttggtcagagagt

SEQ ID NO: 457919 - DNA, 20 bp, Artificial Sequence
  chemically synthesized
ggtcagagagtaggaacctt

SEQ ID NO: 457920 - DNA, 20 bp, Artificial Sequence
  chemically synthesized
agagtaggaaccttcagtta

SEQ ID NO: 457921 - DNA, 20 bp, Artificial Sequence
  chemically synthesized
cgttagatctctataactga

SEQ ID NO: 457922 - DNA, 20 bp, Artificial Sequence
  chemically synthesized
acgttagatctctataactg

SEQ ID NO: 457923 - DNA, 20 bp, Artificial Sequence
  chemically synthesized
agtaggaaccttcagttata

SEQ ID NO: 457924 - DNA, 20 bp, Artificial Sequence
  chemically synthesized
agttatagagatctaacgta

SEQ ID NO: 457925 - DNA, 20 bp, Artificial Sequence
  chemically synthesized
acagttaccatgctgtacgt

SEQ ID NO: 457926 - DNA, 20 bp, Artificial Sequence
  chemically synthesized
tagagatctaacgtacagca

SEQ ID NO: 457927 - DNA, 20 bp, Artificial Sequence
  chemically synthesized
aacgtacagcatggtaactg

SEQ ID NO: 457928 - DNA, 20 bp, Artificial Sequence
  chemically synthesized
aaggacattaatattaacta

SEQ ID NO: 457929 - DNA, 20 bp, Artificial Sequence
  chemically synthesized
tcagcaagtttcaagtataa

SEQ ID NO: 457930 - DNA, 20 bp, Artificial Sequence
  chemically synthesized
ctcagcaagtttcaagtata

SEQ ID NO: 457931 - DNA, 20 bp, Artificial Sequence
  chemically synthesized
ctactccctcagcaagtttc

SEQ ID NO: 457932 - DNA, 20 bp, Artificial Sequence
  chemically synthesized
ctttatacttgaaacttgct

SEQ ID NO: 457933 - DNA, 20 bp, Artificial Sequence
  chemically synthesized
tttatacttgaaacttgctg

SEQ ID NO: 457934 - DNA, 20 bp, Artificial Sequence
  chemically synthesized
ttatacttgaaacttgctga

SEQ ID NO: 457935 - DNA, 20 bp, Artificial Sequence
  chemically synthesized
atacttgaaacttgctgagg

SEQ ID NO: 457936 - DNA, 20 bp, Artificial Sequence
  chemically synthesized
ttatgatctactccctcagc

SEQ ID NO: 457937 - DNA, 20 bp, Artificial Sequence
  chemically synthesized
cttgaaacttgctgagggag

SEQ ID NO: 457938 - DNA, 20 bp, Artificial Sequence
  chemically synthesized
acacttatgatctactccct

SEQ ID NO: 457939 - DNA, 20 bp, Artificial Sequence
  chemically synthesized
ttgctgagggagtagatcat

SEQ ID NO: 457940 - DNA, 20 bp, Artificial Sequence
  chemically synthesized
tagtctcttttttttgtgat

SEQ ID NO: 457941 - DNA, 20 bp, Artificial Sequence
  chemically synthesized
agtgttctcatcacaaaaaa

SEQ ID NO: 457942 - DNA, 20 bp, Artificial Sequence
  chemically synthesized
tgttctcatcacaaaaaaaa

SEQ ID NO: 457943 - DNA, 20 bp, Artificial Sequence
  chemically synthesized
aaaaaagagactactatgcc

SEQ ID NO: 457944 - DNA, 20 bp, Artificial Sequence
  chemically synthesized
atatccatcaccgggcatag

SEQ ID NO: 457945 - DNA, 20 bp, Artificial Sequence
  chemically synthesized
aacatatccatcaccgggca

SEQ ID NO: 457946 - DNA, 20 bp, Artificial Sequence
  chemically synthesized
gagactactatgcccggtga

SEQ ID NO: 457947 - DNA, 20 bp, Artificial Sequence
  chemically synthesized
taattaacatatccatcacc

SEQ ID NO: 457948 - DNA, 20 bp, Artificial Sequence
  chemically synthesized
ataattaacatatccatcac

SEQ ID NO: 457949 - DNA, 20 bp, Artificial Sequence
  chemically synthesized
tatatttaagatatacaaca

SEQ ID NO: 457950 - DNA, 20 bp, Artificial Sequence
  chemically synthesized
tgttgtatatcttaaatata

SEQ ID NO: 457951 - DNA, 20 bp, Artificial Sequence
  chemically synthesized
taaaaacattctatatattt

SEQ ID NO: 457952 - DNA, 20 bp, Artificial Sequence
  chemically synthesized
atttttatggaggtattatt

SEQ ID NO: 457953 - DNA, 20 bp, Artificial Sequence
  chemically synthesized
tttgttgttaatttttatgg

SEQ ID NO: 457954 - DNA, 20 bp, Artificial Sequence
  chemically synthesized
ttttgttgttaatttttatg

SEQ ID NO: 457955 - DNA, 20 bp, Artificial Sequence
  chemically synthesized
ttttttgttgttaattttta

SEQ ID NO: 457956 - DNA, 20 bp, Artificial Sequence
  chemically synthesized
cataaaaattaacaacaaaa

SEQ ID NO: 457957 - DNA, 20 bp, Artificial Sequence
  chemically synthesized
tatgttattgaaatcattta

SEQ ID NO: 457958 - DNA, 20 bp, Artificial Sequence
  chemically synthesized
atatgttattgaaatcattt

SEQ ID NO: 457959 - DNA, 20 bp, Artificial Sequence
  chemically synthesized
gatatgttattgaaatcatt

SEQ ID NO: 457960 - DNA, 20 bp, Artificial Sequence
  chemically synthesized
atttcaataacatatcatta

SEQ ID NO: 457961 - DNA, 20 bp, Artificial Sequence
  chemically synthesized
tcaataacatatcattacag

SEQ ID NO: 457962 - DNA, 20 bp, Artificial Sequence
  chemically synthesized
atcattacagcagctacaaa

SEQ ID NO: 457963 - DNA, 20 bp, Artificial Sequence
  chemically synthesized
tcattacagcagctacaaaa

SEQ ID NO: 457964 - DNA, 20 bp, Artificial Sequence
  chemically synthesized
atatcagtttgtcctttttg

SEQ ID NO: 457965 - DNA, 20 bp, Artificial Sequence
  chemically synthesized
aaaaaggacaaactgatatt

SEQ ID NO: 457966 - DNA, 20 bp, Artificial Sequence
  chemically synthesized
acatgcttgtggctaaatat

SEQ ID NO: 457967 - DNA, 20 bp, Artificial Sequence
  chemically synthesized
acaaactgatatttagccac

SEQ ID NO: 457968 - DNA, 20 bp, Artificial Sequence
  chemically synthesized
agttgatcatcacatgcttg

SEQ ID NO: 457969 - DNA, 20 bp, Artificial Sequence
  chemically synthesized
agtaacttaatagtgaaaat

SEQ ID NO: 457970 - DNA, 20 bp, Artificial Sequence
  chemically synthesized
atcaactgattttcactatt

SEQ ID NO: 457971 - DNA, 20 bp, Artificial Sequence
  chemically synthesized
gtaagagaacagtaacttaa

SEQ ID NO: 457972 - DNA, 20 bp, Artificial Sequence
  chemically synthesized
ttcctcttacggtaagagaa

SEQ ID NO: 457973 - DNA, 20 bp, Artificial Sequence
  chemically synthesized
agttactgttctcttaccgt

SEQ ID NO: 457974 - DNA, 20 bp, Artificial Sequence
  chemically synthesized
ctattttcctcttacggtaa

SEQ ID NO: 457975 - DNA, 20 bp, Artificial Sequence
  chemically synthesized
ttactgttctcttaccgtaa

SEQ ID NO: 457976 - DNA, 20 bp, Artificial Sequence
  chemically synthesized
aactattttcctcttacggt

SEQ ID NO: 457977 - DNA, 20 bp, Artificial Sequence
  chemically synthesized
tactgttctcttaccgtaag

SEQ ID NO: 457978 - DNA, 20 bp, Artificial Sequence
  chemically synthesized
aaggaactattttcctctta

SEQ ID NO: 457979 - DNA, 20 bp, Artificial Sequence
  chemically synthesized
ctcttaccgtaagaggaaaa

SEQ ID NO: 457980 - DNA, 20 bp, Artificial Sequence
  chemically synthesized
atgggattattaaaacatga

SEQ ID NO: 457981 - DNA, 20 bp, Artificial Sequence
  chemically synthesized
aatgggattattaaaacatg

SEQ ID NO: 457982 - DNA, 20 bp, Artificial Sequence
  chemically synthesized
tctgtgtttctggatgaaat

SEQ ID NO: 457983 - DNA, 20 bp, Artificial Sequence
  chemically synthesized
tttaataatcccatttcatc

SEQ ID NO: 457984 - DNA, 20 bp, Artificial Sequence
  chemically synthesized
ctctgtgtttctggatgaaa

SEQ ID NO: 457985 - DNA, 20 bp, Artificial Sequence
  chemically synthesized
tcccatttcatccagaaaca

SEQ ID NO: 457986 - DNA, 20 bp, Artificial Sequence
  chemically synthesized
gggaattatctctgtgtttc

SEQ ID NO: 457987 - DNA, 20 bp, Artificial Sequence
  chemically synthesized
ccatttcatccagaaacaca

SEQ ID NO: 457988 - DNA, 20 bp, Artificial Sequence
  chemically synthesized
acagagataattccctgtgt

SEQ ID NO: 457989 - DNA, 20 bp, Artificial Sequence
  chemically synthesized
agatatgtgcggctaacaca

SEQ ID NO: 457990 - DNA, 20 bp, Artificial Sequence
  chemically synthesized
gagatatgtgcggctaacac

SEQ ID NO: 457991 - DNA, 20 bp, Artificial Sequence
  chemically synthesized
tgagatatgtgcggctaaca

SEQ ID NO: 457992 - DNA, 20 bp, Artificial Sequence
  chemically synthesized
agtaagaattgagatatgtg

SEQ ID NO: 457993 - DNA, 20 bp, Artificial Sequence
  chemically synthesized
ttaaattttgagtaagaatt

SEQ ID NO: 457994 - DNA, 20 bp, Artificial Sequence
  chemically synthesized
agattaattaaattttgagt

SEQ ID NO: 457995 - DNA, 20 bp, Artificial Sequence
  chemically synthesized
ctgaagattaattaaatttt

SEQ ID NO: 457996 - DNA, 20 bp, Artificial Sequence
  chemically synthesized
ctcaaaatttaattaatctt

SEQ ID NO: 457997 - DNA, 20 bp, Artificial Sequence
  chemically synthesized
atttaattaatcttcagtga

SEQ ID NO: 457998 - DNA, 20 bp, Artificial Sequence
  chemically synthesized
gaaattgttttccatcactg

SEQ ID NO: 457999 - DNA, 20 bp, Artificial Sequence
  chemically synthesized
gaaaacaatttccttctatt

SEQ ID NO: 458000 - DNA, 20 bp, Artificial Sequence
  chemically synthesized
aatgatatggtcttaataga

SEQ ID NO: 458001 - DNA, 20 bp, Artificial Sequence
  chemically synthesized
caatgatatggtcttaatag

SEQ ID NO: 458002 - DNA, 20 bp, Artificial Sequence
  chemically synthesized
cagcaatgatatggtcttaa

SEQ ID NO: 458003 - DNA, 20 bp, Artificial Sequence
  chemically synthesized
aaagacgttcagcaatgata

SEQ ID NO: 458004 - DNA, 20 bp, Artificial Sequence
  chemically synthesized
ttcttgaaattaaagacgtt

SEQ ID NO: 458005 - DNA, 20 bp, Artificial Sequence
  chemically synthesized
tgctgaacgtctttaatttc

SEQ ID NO: 458006 - DNA, 20 bp, Artificial Sequence
  chemically synthesized
gttaatggttcttgaaatta

SEQ ID NO: 458007 - DNA, 20 bp, Artificial Sequence
  chemically synthesized
attgtttgaaattttgttaa

SEQ ID NO: 458008 - DNA, 20 bp, Artificial Sequence
  chemically synthesized
acaatttatgttatttaaaa

SEQ ID NO: 458009 - DNA, 20 bp, Artificial Sequence
  chemically synthesized
atttatgttatttaaaatag

SEQ ID NO: 458010 - DNA, 20 bp, Artificial Sequence
  chemically synthesized
tttaaaatagaagctgaaaa

SEQ ID NO: 458011 - DNA, 20 bp, Artificial Sequence
  chemically synthesized
ttaaaatagaagctgaaaaa

SEQ ID NO: 458012 - DNA, 20 bp, Artificial Sequence
  chemically synthesized
aaaatagaagctgaaaaaag

SEQ ID NO: 458013 - DNA, 20 bp, Artificial Sequence
  chemically synthesized
gtgtagttttctcctttttt

SEQ ID NO: 458014 - DNA, 20 bp, Artificial Sequence
  chemically synthesized
gtgatggtaaaatatttgtg

SEQ ID NO: 458015 - DNA, 20 bp, Artificial Sequence
  chemically synthesized
gtgattcacatttgttgtga

SEQ ID NO: 458016 - DNA, 20 bp, Artificial Sequence
  chemically synthesized
atcacaacaaatgtgaatca

SEQ ID NO: 458017 - DNA, 20 bp, Artificial Sequence
  chemically synthesized
catatttaagaaatgtgttt

SEQ ID NO: 458018 - DNA, 20 bp, Artificial Sequence
  chemically synthesized
ccaaaacagcaaacatattt

SEQ ID NO: 458019 - DNA, 20 bp, Artificial Sequence
  chemically synthesized
cttaaatatgtttgctgttt

SEQ ID NO: 458020 - DNA, 20 bp, Artificial Sequence
  chemically synthesized
cgattgttttgcagccaaaa

SEQ ID NO: 458021 - DNA, 20 bp, Artificial Sequence
  chemically synthesized
caacattgacgattgttttg

SEQ ID NO: 458022 - DNA, 20 bp, Artificial Sequence
  chemically synthesized
gcaaaacaatcgtcaatgtt

SEQ ID NO: 458023 - DNA, 20 bp, Artificial Sequence
  chemically synthesized
atcgtcaatgttgagcgtat

SEQ ID NO: 458024 - DNA, 20 bp, Artificial Sequence
  chemically synthesized
gttgagcgtatcggacactt

SEQ ID NO: 458025 - DNA, 20 bp, Artificial Sequence
  chemically synthesized
ttgagcgtatcggacacttt

SEQ ID NO: 458026 - DNA, 20 bp, Artificial Sequence
  chemically synthesized
tattactaaagattttccta

SEQ ID NO: 458027 - DNA, 20 bp, Artificial Sequence
  chemically synthesized
ggacactttaggaaaatctt

SEQ ID NO: 458028 - DNA, 20 bp, Artificial Sequence
  chemically synthesized
aatagaatttgttattacta

SEQ ID NO: 458029 - DNA, 20 bp, Artificial Sequence
  chemically synthesized
aataacaaattctattctct

SEQ ID NO: 458030 - DNA, 20 bp, Artificial Sequence
  chemically synthesized
gaaataagatactaagagaa

SEQ ID NO: 458031 - DNA, 20 bp, Artificial Sequence
  chemically synthesized
agcaagaaataagatactaa

SEQ ID NO: 458032 - DNA, 20 bp, Artificial Sequence
  chemically synthesized
tcagcaagaaataagatact

SEQ ID NO: 458033 - DNA, 20 bp, Artificial Sequence
  chemically synthesized
acagagtatcagcaagaaat

SEQ ID NO: 458034 - DNA, 20 bp, Artificial Sequence
  chemically synthesized
gataggcacagagtatcagc

SEQ ID NO: 458035 - DNA, 20 bp, Artificial Sequence
  chemically synthesized
ttaggataggcacagagtat

SEQ ID NO: 458036 - DNA, 20 bp, Artificial Sequence
  chemically synthesized
tgcttattaggataggcaca

SEQ ID NO: 458037 - DNA, 20 bp, Artificial Sequence
  chemically synthesized
cctgcttattaggataggca

SEQ ID NO: 458038 - DNA, 20 bp, Artificial Sequence
  chemically synthesized
catcccctgcttattaggat

SEQ ID NO: 458039 - DNA, 20 bp, Artificial Sequence
  chemically synthesized
tactctgtgcctatcctaat

SEQ ID NO: 458040 - DNA, 20 bp, Artificial Sequence
  chemically synthesized
ccatcccctgcttattagga

SEQ ID NO: 458041 - DNA, 20 bp, Artificial Sequence
  chemically synthesized
tctgtgcctatcctaataag

SEQ ID NO: 458042 - DNA, 20 bp, Artificial Sequence
  chemically synthesized
ctgtgcctatcctaataagc

SEQ ID NO: 458043 - DNA, 20 bp, Artificial Sequence
  chemically synthesized
gtagccatcccctgcttatt

SEQ ID NO: 458044 - DNA, 20 bp, Artificial Sequence
  chemically synthesized
tgtgcctatcctaataagca

SEQ ID NO: 458045 - DNA, 20 bp, Artificial Sequence
  chemically synthesized
tgtagccatcccctgcttat

SEQ ID NO: 458046 - DNA, 20 bp, Artificial Sequence
  chemically synthesized
gtgcctatcctaataagcag

SEQ ID NO: 458047 - DNA, 20 bp, Artificial Sequence
  chemically synthesized
ctatcctaataagcagggga

SEQ ID NO: 458048 - DNA, 20 bp, Artificial Sequence
  chemically synthesized
tcctgagtgattacagtatg

SEQ ID NO: 458049 - DNA, 20 bp, Artificial Sequence
  chemically synthesized
tttatcttcctgagtgatta

SEQ ID NO: 458050 - DNA, 20 bp, Artificial Sequence
  chemically synthesized
ggctacatactgtaatcact

SEQ ID NO: 458051 - DNA, 20 bp, Artificial Sequence
  chemically synthesized
gctacatactgtaatcactc

SEQ ID NO: 458052 - DNA, 20 bp, Artificial Sequence
  chemically synthesized
acatactgtaatcactcagg

SEQ ID NO: 458053 - DNA, 20 bp, Artificial Sequence
  chemically synthesized
gttggctgttttatcttcct

SEQ ID NO: 458054 - DNA, 20 bp, Artificial Sequence
  chemically synthesized
aatcactcaggaagataaaa

SEQ ID NO: 458055 - DNA, 20 bp, Artificial Sequence
  chemically synthesized
gataaaacagccaacatttt

SEQ ID NO: 458056 - DNA, 20 bp, Artificial Sequence
  chemically synthesized
accaacaacactcaaaatgt

SEQ ID NO: 458057 - DNA, 20 bp, Artificial Sequence
  chemically synthesized
gccaacattttgagtgttgt

SEQ ID NO: 458058 - DNA, 20 bp, Artificial Sequence
  chemically synthesized
attttgagtgttgttggtct

SEQ ID NO: 458059 - DNA, 20 bp, Artificial Sequence
  chemically synthesized
ttttgagtgttgttggtctc

SEQ ID NO: 458060 - DNA, 20 bp, Artificial Sequence
  chemically synthesized
tgagtgttgttggtctcagg

SEQ ID NO: 458061 - DNA, 20 bp, Artificial Sequence
  chemically synthesized
gttggctgctttatcttcct

SEQ ID NO: 458062 - DNA, 20 bp, Artificial Sequence
  chemically synthesized
ttgttggtctcaggaagata

SEQ ID NO: 458063 - DNA, 20 bp, Artificial Sequence
  chemically synthesized
ttggtctcaggaagataaag

SEQ ID NO: 458064 - DNA, 20 bp, Artificial Sequence
  chemically synthesized
agataaagcagccaactttt

SEQ ID NO: 458065 - DNA, 20 bp, Artificial Sequence
  chemically synthesized
aaccaacaacactcaaaagt

SEQ ID NO: 458066 - DNA, 20 bp, Artificial Sequence
  chemically synthesized
tatcaaccaacaacactcaa

SEQ ID NO: 458067 - DNA, 20 bp, Artificial Sequence
  chemically synthesized
agccaacttttgagtgttgt

SEQ ID NO: 458068 - DNA, 20 bp, Artificial Sequence
  chemically synthesized
ttttgagtgttgttggttga

SEQ ID NO: 458069 - DNA, 20 bp, Artificial Sequence
  chemically synthesized
tttgagtgttgttggttgat

SEQ ID NO: 458070 - DNA, 20 bp, Artificial Sequence
  chemically synthesized
tgttgttggttgataggtct

SEQ ID NO: 458071 - DNA, 20 bp, Artificial Sequence
  chemically synthesized
ttgttggttgataggtctga

SEQ ID NO: 458072 - DNA, 20 bp, Artificial Sequence
  chemically synthesized
tactgtgttctgttttctct

SEQ ID NO: 458073 - DNA, 20 bp, Artificial Sequence
  chemically synthesized
ttgataggtctgagagaaaa

SEQ ID NO: 458074 - DNA, 20 bp, Artificial Sequence
  chemically synthesized
gtctgagagaaaacagaaca

SEQ ID NO: 458075 - DNA, 20 bp, Artificial Sequence
  chemically synthesized
gaacacagtaaaacattcaa

SEQ ID NO: 458076 - DNA, 20 bp, Artificial Sequence
  chemically synthesized
gtaaaacattcaatggctct

SEQ ID NO: 458077 - DNA, 20 bp, Artificial Sequence
  chemically synthesized
cttttggacagatgttctaa

SEQ ID NO: 458078 - DNA, 20 bp, Artificial Sequence
  chemically synthesized
cacttttggacagatgttct

SEQ ID NO: 458079 - DNA, 20 bp, Artificial Sequence
  chemically synthesized
ctcttagaacatctgtccaa

SEQ ID NO: 458080 - DNA, 20 bp, Artificial Sequence
  chemically synthesized
tgaactgtgtcacttttgga

SEQ ID NO: 458081 - DNA, 20 bp, Artificial Sequence
  chemically synthesized
gaagtgaactgtgtcacttt

SEQ ID NO: 458082 - DNA, 20 bp, Artificial Sequence
  chemically synthesized
acatctgtccaaaagtgaca

SEQ ID NO: 458083 - DNA, 20 bp, Artificial Sequence
  chemically synthesized
gatcaatgaaatgtgcgaag

SEQ ID NO: 458084 - DNA, 20 bp, Artificial Sequence
  chemically synthesized
ccggatcaatgaaatgtgcg

SEQ ID NO: 458085 - DNA, 20 bp, Artificial Sequence
  chemically synthesized
cttcgcacatttcattgatc

SEQ ID NO: 458086 - DNA, 20 bp, Artificial Sequence
  chemically synthesized
agtctggctgtgtgacatgc

SEQ ID NO: 458087 - DNA, 20 bp, Artificial Sequence
  chemically synthesized
cattgatccggcatgtcaca

SEQ ID NO: 458088 - DNA, 20 bp, Artificial Sequence
  chemically synthesized
gatccggcatgtcacacagc

SEQ ID NO: 458089 - DNA, 20 bp, Artificial Sequence
  chemically synthesized
cactcacttgaagttgagtc

SEQ ID NO: 458090 - DNA, 20 bp, Artificial Sequence
  chemically synthesized
acacagccagactcaacttc

SEQ ID NO: 458091 - DNA, 20 bp, Artificial Sequence
  chemically synthesized
ttccgcactcacttgaagtt

SEQ ID NO: 458092 - DNA, 20 bp, Artificial Sequence
  chemically synthesized
agccagactcaacttcaagt

SEQ ID NO: 458093 - DNA, 20 bp, Artificial Sequence
  chemically synthesized
atcacttccgcactcacttg

SEQ ID NO: 458094 - DNA, 20 bp, Artificial Sequence
  chemically synthesized
gactcaacttcaagtgagtg

SEQ ID NO: 458095 - DNA, 20 bp, Artificial Sequence
  chemically synthesized
tcaacttcaagtgagtgcgg

SEQ ID NO: 458096 - DNA, 20 bp, Artificial Sequence
  chemically synthesized
gcggaagtgattccacgtac

SEQ ID NO: 458097 - DNA, 20 bp, Artificial Sequence
  chemically synthesized
tctgtcccctttctggtacg

SEQ ID NO: 458098 - DNA, 20 bp, Artificial Sequence
  chemically synthesized
aagtgattccacgtaccaga

SEQ ID NO: 458099 - DNA, 20 bp, Artificial Sequence
  chemically synthesized
agtgattccacgtaccagaa

SEQ ID NO: 458100 - DNA, 20 bp, Artificial Sequence
  chemically synthesized
gtgattccacgtaccagaaa

SEQ ID NO: 458101 - DNA, 20 bp, Artificial Sequence
  chemically synthesized
tgattccacgtaccagaaag

SEQ ID NO: 458102 - DNA, 20 bp, Artificial Sequence
  chemically synthesized
ttccgcttctgtcccctttc

SEQ ID NO: 458103 - DNA, 20 bp, Artificial Sequence
  chemically synthesized
tccacgtaccagaaagggga

SEQ ID NO: 458104 - DNA, 20 bp, Artificial Sequence
  chemically synthesized
acgtaccagaaaggggacag

SEQ ID NO: 458105 - DNA, 20 bp, Artificial Sequence
  chemically synthesized
taccagaaaggggacagaag

SEQ ID NO: 458106 - DNA, 20 bp, Artificial Sequence
  chemically synthesized
gaaaggggacagaagcggaa

SEQ ID NO: 458107 - DNA, 20 bp, Artificial Sequence
  chemically synthesized
acagaagcggaacagctatc

SEQ ID NO: 458108 - DNA, 20 bp, Artificial Sequence
  chemically synthesized
agaagcggaacagctatcaa

SEQ ID NO: 458109 - DNA, 20 bp, Artificial Sequence
  chemically synthesized
gtagacattaagactcttga

SEQ ID NO: 458110 - DNA, 20 bp, Artificial Sequence
  chemically synthesized
aggtggaggtggtagacatt

SEQ ID NO: 458111 - DNA, 20 bp, Artificial Sequence
  chemically synthesized
tctgatacaggtggaggtgg

SEQ ID NO: 458112 - DNA, 20 bp, Artificial Sequence
  chemically synthesized
ttatctgatacaggtggagg

SEQ ID NO: 458113 - DNA, 20 bp, Artificial Sequence
  chemically synthesized
tggttatctgatacaggtgg

SEQ ID NO: 458114 - DNA, 20 bp, Artificial Sequence
  chemically synthesized
gtggttatctgatacaggtg

SEQ ID NO: 458115 - DNA, 20 bp, Artificial Sequence
  chemically synthesized
tctaccacctccacctgtat

SEQ ID NO: 458116 - DNA, 20 bp, Artificial Sequence
  chemically synthesized
ttgtggttatctgatacagg

SEQ ID NO: 458117 - DNA, 20 bp, Artificial Sequence
  chemically synthesized
aagttgtggttatctgatac

SEQ ID NO: 458118 - DNA, 20 bp, Artificial Sequence
  chemically synthesized
gaagttgtggttatctgata

SEQ ID NO: 458119 - DNA, 20 bp, Artificial Sequence
  chemically synthesized
aaatatattctgtgaagttg

SEQ ID NO: 458120 - DNA, 20 bp, Artificial Sequence
  chemically synthesized
atcagataaccacaacttca

SEQ ID NO: 458121 - DNA, 20 bp, Artificial Sequence
  chemically synthesized
attatgaaatatattctgtg

SEQ ID NO: 458122 - DNA, 20 bp, Artificial Sequence
  chemically synthesized
tcacagaatatatttcataa

SEQ ID NO: 458123 - DNA, 20 bp, Artificial Sequence
  chemically synthesized
cacagaatatatttcataat

SEQ ID NO: 458124 - DNA, 20 bp, Artificial Sequence
  chemically synthesized
aatatatttcataataggta

SEQ ID NO: 458125 - DNA, 20 bp, Artificial Sequence
  chemically synthesized
tatatttcataataggtaca

SEQ ID NO: 458126 - DNA, 20 bp, Artificial Sequence
  chemically synthesized
aataatgatgagtttcattt

SEQ ID NO: 458127 - DNA, 20 bp, Artificial Sequence
  chemically synthesized
agtttatttttaataatgat

SEQ ID NO: 458128 - DNA, 20 bp, Artificial Sequence
  chemically synthesized
aaatagagaaaatatttgga

SEQ ID NO: 458129 - DNA, 20 bp, Artificial Sequence
  chemically synthesized
aaataaatagagaaaatatt

SEQ ID NO: 458130 - DNA, 20 bp, Artificial Sequence
  chemically synthesized
aattacatttaaaataaata

SEQ ID NO: 458131 - DNA, 20 bp, Artificial Sequence
  chemically synthesized
ttaattacatttaaaataaa

SEQ ID NO: 458132 - DNA, 20 bp, Artificial Sequence
  chemically synthesized
aaatgtaattaaatctttat

SEQ ID NO: 458133 - DNA, 20 bp, Artificial Sequence
  chemically synthesized
gtaattaaatctttataagc

SEQ ID NO: 458134 - DNA, 20 bp, Artificial Sequence
  chemically synthesized
atttgcagaccttgcttata

SEQ ID NO: 458135 - DNA, 20 bp, Artificial Sequence
  chemically synthesized
taattaaatctttataagca

SEQ ID NO: 458136 - DNA, 20 bp, Artificial Sequence
  chemically synthesized
aaaattagaataaaaatttg

SEQ ID NO: 458137 - DNA, 20 bp, Artificial Sequence
  chemically synthesized
tactctcaggaaaaaaaaat

SEQ ID NO: 458138 - DNA, 20 bp, Artificial Sequence
  chemically synthesized
tattctaatttttttttcct

SEQ ID NO: 458139 - DNA, 20 bp, Artificial Sequence
  chemically synthesized
ttctaatttttttttcctga

SEQ ID NO: 458140 - DNA, 20 bp, Artificial Sequence
  chemically synthesized
aatttttttttcctgagagt

SEQ ID NO: 458141 - DNA, 20 bp, Artificial Sequence
  chemically synthesized
cataataaccacttactctc

SEQ ID NO: 458142 - DNA, 20 bp, Artificial Sequence
  chemically synthesized
acataataaccacttactct

SEQ ID NO: 458143 - DNA, 20 bp, Artificial Sequence
  chemically synthesized
ttttttttcctgagagtaag

SEQ ID NO: 458144 - DNA, 20 bp, Artificial Sequence
  chemically synthesized
gtggttattatgttactcta

SEQ ID NO: 458145 - DNA, 20 bp, Artificial Sequence
  chemically synthesized
cattttggttttcaactata

SEQ ID NO: 458146 - DNA, 20 bp, Artificial Sequence
  chemically synthesized
ctcattttggttttcaacta

SEQ ID NO: 458147 - DNA, 20 bp, Artificial Sequence
  chemically synthesized
ctatagttgaaaaccaaaat

SEQ ID NO: 458148 - DNA, 20 bp, Artificial Sequence
  chemically synthesized
atagttgaaaaccaaaatga

SEQ ID NO: 458149 - DNA, 20 bp, Artificial Sequence
  chemically synthesized
atttttcttttctctcattt

SEQ ID NO: 458150 - DNA, 20 bp, Artificial Sequence
  chemically synthesized
tgaaaaccaaaatgagagaa

SEQ ID NO: 458151 - DNA, 20 bp, Artificial Sequence
  chemically synthesized
gaaaagaaaaatgacataat

SEQ ID NO: 458152 - DNA, 20 bp, Artificial Sequence
  chemically synthesized
aaagaaaaatgacataatca

SEQ ID NO: 458153 - DNA, 20 bp, Artificial Sequence
  chemically synthesized
aaaaatgacataatcagagt

SEQ ID NO: 458154 - DNA, 20 bp, Artificial Sequence
  chemically synthesized
aaatgacataatcagagtta

SEQ ID NO: 458155 - DNA, 20 bp, Artificial Sequence
  chemically synthesized
atgacataatcagagttaga

SEQ ID NO: 458156 - DNA, 20 bp, Artificial Sequence
  chemically synthesized
taatcagagttagagagata

SEQ ID NO: 458157 - DNA, 20 bp, Artificial Sequence
  chemically synthesized
aatcagagttagagagatat

SEQ ID NO: 458158 - DNA, 20 bp, Artificial Sequence
  chemically synthesized
agtaccaaaagaaaaagtca

SEQ ID NO: 458159 - DNA, 20 bp, Artificial Sequence
  chemically synthesized
aagtaccaaaagaaaaagtc

SEQ ID NO: 458160 - DNA, 20 bp, Artificial Sequence
  chemically synthesized
caagtaccaaaagaaaaagt

SEQ ID NO: 458161 - DNA, 20 bp, Artificial Sequence
  chemically synthesized
aaaaccctgactttttcttt

SEQ ID NO: 458162 - DNA, 20 bp, Artificial Sequence
  chemically synthesized
cctacaagtaccaaaagaaa

SEQ ID NO: 458163 - DNA, 20 bp, Artificial Sequence
  chemically synthesized
caaagtcctacaagtaccaa

SEQ ID NO: 458164 - DNA, 20 bp, Artificial Sequence
  chemically synthesized
actttttcttttggtacttg

SEQ ID NO: 458165 - DNA, 20 bp, Artificial Sequence
  chemically synthesized
ctttttcttttggtacttgt

SEQ ID NO: 458166 - DNA, 20 bp, Artificial Sequence
  chemically synthesized
agtcttctgcaaagtcctac

SEQ ID NO: 458167 - DNA, 20 bp, Artificial Sequence
  chemically synthesized
ttggtacttgtaggactttg

SEQ ID NO: 458168 - DNA, 20 bp, Artificial Sequence
  chemically synthesized
gtacttgtaggactttgcag

SEQ ID NO: 458169 - DNA, 20 bp, Artificial Sequence
  chemically synthesized
cagatcaaaagtcttctgca

SEQ ID NO: 458170 - DNA, 20 bp, Artificial Sequence
  chemically synthesized
cttactgccattcagatcaa

SEQ ID NO: 458171 - DNA, 20 bp, Artificial Sequence
  chemically synthesized
cagaagacttttgatctgaa

SEQ ID NO: 458172 - DNA, 20 bp, Artificial Sequence
  chemically synthesized
aagacttttgatctgaatgg

SEQ ID NO: 458173 - DNA, 20 bp, Artificial Sequence
  chemically synthesized
tgaggaaacttactgccatt

SEQ ID NO: 458174 - DNA, 20 bp, Artificial Sequence
  chemically synthesized
cttttgatctgaatggcagt

SEQ ID NO: 458175 - DNA, 20 bp, Artificial Sequence
  chemically synthesized
tgaatggcagtaagtttcct

SEQ ID NO: 458176 - DNA, 20 bp, Artificial Sequence
  chemically synthesized
gaatggcagtaagtttcctc

SEQ ID NO: 458177 - DNA, 20 bp, Artificial Sequence
  chemically synthesized
atattaatttcattttcctg

SEQ ID NO: 458178 - DNA, 20 bp, Artificial Sequence
  chemically synthesized
gatattaatttcattttcct

SEQ ID NO: 458179 - DNA, 20 bp, Artificial Sequence
  chemically synthesized
ttaatatcatctaccttaaa

SEQ ID NO: 458180 - DNA, 20 bp, Artificial Sequence
  chemically synthesized
ctataaccacctatttaagg

SEQ ID NO: 458181 - DNA, 20 bp, Artificial Sequence
  chemically synthesized
taatatcatctaccttaaat

SEQ ID NO: 458182 - DNA, 20 bp, Artificial Sequence
  chemically synthesized
tcactataaccacctattta

SEQ ID NO: 458183 - DNA, 20 bp, Artificial Sequence
  chemically synthesized
tatcatctaccttaaatagg

SEQ ID NO: 458184 - DNA, 20 bp, Artificial Sequence
  chemically synthesized
atcactataaccacctattt

SEQ ID NO: 458185 - DNA, 20 bp, Artificial Sequence
  chemically synthesized
ctaccttaaataggtggtta

SEQ ID NO: 458186 - DNA, 20 bp, Artificial Sequence
  chemically synthesized
ggtggttatagtgattacat

SEQ ID NO: 458187 - DNA, 20 bp, Artificial Sequence
  chemically synthesized
gacagcatttgtataaacat

SEQ ID NO: 458188 - DNA, 20 bp, Artificial Sequence
  chemically synthesized
agaagggaaggagtaaaaga

SEQ ID NO: 458189 - DNA, 20 bp, Artificial Sequence
  chemically synthesized
gctaagaagggaaggagtaa

SEQ ID NO: 458190 - DNA, 20 bp, Artificial Sequence
  chemically synthesized
atagaagctaagaagggaag

SEQ ID NO: 458191 - DNA, 20 bp, Artificial Sequence
  chemically synthesized
aaatagaagctaagaaggga

SEQ ID NO: 458192 - DNA, 20 bp, Artificial Sequence
  chemically synthesized
tcttttactccttcccttct

SEQ ID NO: 458193 - DNA, 20 bp, Artificial Sequence
  chemically synthesized
caaatagaagctaagaaggg

SEQ ID NO: 458194 - DNA, 20 bp, Artificial Sequence
  chemically synthesized
tttcaaatagaagctaagaa

SEQ ID NO: 458195 - DNA, 20 bp, Artificial Sequence
  chemically synthesized
ttttcaaatagaagctaaga

SEQ ID NO: 458196 - DNA, 20 bp, Artificial Sequence
  chemically synthesized
tttttcaaatagaagctaag

SEQ ID NO: 458197 - DNA, 20 bp, Artificial Sequence
  chemically synthesized
agttttttcaaatagaagct

SEQ ID NO: 458198 - DNA, 20 bp, Artificial Sequence
  chemically synthesized
accaaagttttttcaaatag

SEQ ID NO: 458199 - DNA, 20 bp, Artificial Sequence
  chemically synthesized
cttaccaaagttttttcaaa

SEQ ID NO: 458200 - DNA, 20 bp, Artificial Sequence
  chemically synthesized
gcttctatttgaaaaaactt

SEQ ID NO: 458201 - DNA, 20 bp, Artificial Sequence
  chemically synthesized
ctatttgaaaaaactttggt

SEQ ID NO: 458202 - DNA, 20 bp, Artificial Sequence
  chemically synthesized
tatttgaaaaaactttggta

SEQ ID NO: 458203 - DNA, 20 bp, Artificial Sequence
  chemically synthesized
tttgaaaaaactttggtaag

SEQ ID NO: 458204 - DNA, 20 bp, Artificial Sequence
  chemically synthesized
aaagctgcagctccttacca

SEQ ID NO: 458205 - DNA, 20 bp, Artificial Sequence
  chemically synthesized
aaaactttggtaaggagctg

SEQ ID NO: 458206 - DNA, 20 bp, Artificial Sequence
  chemically synthesized
atggcccctttgaaaagctg

SEQ ID NO: 458207 - DNA, 20 bp, Artificial Sequence
  chemically synthesized
taaggagctgcagcttttca

SEQ ID NO: 458208 - DNA, 20 bp, Artificial Sequence
  chemically synthesized
aaggagctgcagcttttcaa

SEQ ID NO: 458209 - DNA, 20 bp, Artificial Sequence
  chemically synthesized
aggagctgcagcttttcaaa

SEQ ID NO: 458210 - DNA, 20 bp, Artificial Sequence
  chemically synthesized
ggagctgcagcttttcaaag

SEQ ID NO: 458211 - DNA, 20 bp, Artificial Sequence
  chemically synthesized
aagtttatggcccctttgaa

SEQ ID NO: 458212 - DNA, 20 bp, Artificial Sequence
  chemically synthesized
tctgcacggagtcaagttta

SEQ ID NO: 458213 - DNA, 20 bp, Artificial Sequence
  chemically synthesized
cttagaatctgcacggagtc

SEQ ID NO: 458214 - DNA, 20 bp, Artificial Sequence
  chemically synthesized
gccataaacttgactccgtg

SEQ ID NO: 458215 - DNA, 20 bp, Artificial Sequence
  chemically synthesized
ccttccttagaatctgcacg

SEQ ID NO: 458216 - DNA, 20 bp, Artificial Sequence
  chemically synthesized
ggccttccttagaatctgca

SEQ ID NO: 458217 - DNA, 20 bp, Artificial Sequence
  chemically synthesized
cttgactccgtgcagattct

SEQ ID NO: 458218 - DNA, 20 bp, Artificial Sequence
  chemically synthesized
ttgactccgtgcagattcta

SEQ ID NO: 458219 - DNA, 20 bp, Artificial Sequence
  chemically synthesized
actccgtgcagattctaagg

SEQ ID NO: 458220 - DNA, 20 bp, Artificial Sequence
  chemically synthesized
ctccgtgcagattctaagga

SEQ ID NO: 458221 - DNA, 20 bp, Artificial Sequence
  chemically synthesized
tttcctcactaggccttcct

SEQ ID NO: 458222 - DNA, 20 bp, Artificial Sequence
  chemically synthesized
tgcagattctaaggaaggcc

SEQ ID NO: 458223 - DNA, 20 bp, Artificial Sequence
  chemically synthesized
gattctaaggaaggcctagt

SEQ ID NO: 458224 - DNA, 20 bp, Artificial Sequence
  chemically synthesized
attctaaggaaggcctagtg

SEQ ID NO: 458225 - DNA, 20 bp, Artificial Sequence
  chemically synthesized
ctagcccatctttcctcact

SEQ ID NO: 458226 - DNA, 20 bp, Artificial Sequence
  chemically synthesized
taaggaaggcctagtgagga

SEQ ID NO: 458227 - DNA, 20 bp, Artificial Sequence
  chemically synthesized
cctagcccatctttcctcac

SEQ ID NO: 458228 - DNA, 20 bp, Artificial Sequence
  chemically synthesized
gaaggcctagtgaggaaaga

SEQ ID NO: 458229 - DNA, 20 bp, Artificial Sequence
  chemically synthesized
aaggcctagtgaggaaagat

SEQ ID NO: 458230 - DNA, 20 bp, Artificial Sequence
  chemically synthesized
cctagtgaggaaagatgggc

SEQ ID NO: 458231 - DNA, 20 bp, Artificial Sequence
  chemically synthesized
ctagtgaggaaagatgggct

SEQ ID NO: 458232 - DNA, 20 bp, Artificial Sequence
  chemically synthesized
gtgaggaaagatgggctagg

SEQ ID NO: 458233 - DNA, 20 bp, Artificial Sequence
  chemically synthesized
agagaactgaagcaactacc

SEQ ID NO: 458234 - DNA, 20 bp, Artificial Sequence
  chemically synthesized
gatgggctaggtagttgctt

SEQ ID NO: 458235 - DNA, 20 bp, Artificial Sequence
  chemically synthesized
gcacataatttagagaactg

SEQ ID NO: 458236 - DNA, 20 bp, Artificial Sequence
  chemically synthesized
agattcttgcacataattta

SEQ ID NO: 458237 - DNA, 20 bp, Artificial Sequence
  chemically synthesized
taagattcttgcacataatt

SEQ ID NO: 458238 - DNA, 20 bp, Artificial Sequence
  chemically synthesized
cagttctctaaattatgtgc

SEQ ID NO: 458239 - DNA, 20 bp, Artificial Sequence
  chemically synthesized
tttcttgcatatttcatttt

SEQ ID NO: 458240 - DNA, 20 bp, Artificial Sequence
  chemically synthesized
aatcttaaaatgaaatatgc

SEQ ID NO: 458241 - DNA, 20 bp, Artificial Sequence
  chemically synthesized
ttaaaatgaaatatgcaaga

SEQ ID NO: 458242 - DNA, 20 bp, Artificial Sequence
  chemically synthesized
tgaaatatgcaagaaagata

SEQ ID NO: 458243 - DNA, 20 bp, Artificial Sequence
  chemically synthesized
tatgcaagaaagatacagtc

SEQ ID NO: 458244 - DNA, 20 bp, Artificial Sequence
  chemically synthesized
atgcaagaaagatacagtct

SEQ ID NO: 458245 - DNA, 20 bp, Artificial Sequence
  chemically synthesized
tgcaagaaagatacagtcta

SEQ ID NO: 458246 - DNA, 20 bp, Artificial Sequence
  chemically synthesized
gcaagaaagatacagtctag

SEQ ID NO: 458247 - DNA, 20 bp, Artificial Sequence
  chemically synthesized
agaaagatacagtctagggg

SEQ ID NO: 458248 - DNA, 20 bp, Artificial Sequence
  chemically synthesized
gttctttacctgtccacccc

SEQ ID NO: 458249 - DNA, 20 bp, Artificial Sequence
  chemically synthesized
agatacagtctaggggtgga

SEQ ID NO: 458250 - DNA, 20 bp, Artificial Sequence
  chemically synthesized
gatacagtctaggggtggac

SEQ ID NO: 458251 - DNA, 20 bp, Artificial Sequence
  chemically synthesized
agtctaggggtggacaggta

SEQ ID NO: 458252 - DNA, 20 bp, Artificial Sequence
  chemically synthesized
aggggtggacaggtaaagaa

SEQ ID NO: 458253 - DNA, 20 bp, Artificial Sequence
  chemically synthesized
ggggtggacaggtaaagaac

SEQ ID NO: 458254 - DNA, 20 bp, Artificial Sequence
  chemically synthesized
gggtggacaggtaaagaaca

SEQ ID NO: 458255 - DNA, 20 bp, Artificial Sequence
  chemically synthesized
gtggacaggtaaagaacagg

SEQ ID NO: 458256 - DNA, 20 bp, Artificial Sequence
  chemically synthesized
ggacaggtaaagaacaggga

SEQ ID NO: 458257 - DNA, 20 bp, Artificial Sequence
  chemically synthesized
gacaggtaaagaacagggag

SEQ ID NO: 458258 - DNA, 20 bp, Artificial Sequence
  chemically synthesized
gtaaagaacagggagaggta

SEQ ID NO: 458259 - DNA, 20 bp, Artificial Sequence
  chemically synthesized
taaagaacagggagaggtaa

SEQ ID NO: 458260 - DNA, 20 bp, Artificial Sequence
  chemically synthesized
gaacagggagaggtaaaggc

SEQ ID NO: 458261 - DNA, 20 bp, Artificial Sequence
  chemically synthesized
gaggtaaaggcaagaatatt

SEQ ID NO: 458262 - DNA, 20 bp, Artificial Sequence
  chemically synthesized
aagaatatttggctgaataa

SEQ ID NO: 458263 - DNA, 20 bp, Artificial Sequence
  chemically synthesized
gaaaaacatattccattatt

SEQ ID NO: 458264 - DNA, 20 bp, Artificial Sequence
  chemically synthesized
aataatggaatatgtttttc

SEQ ID NO: 458265 - DNA, 20 bp, Artificial Sequence
  chemically synthesized
ctaccaattgtcagaatggc

SEQ ID NO: 458266 - DNA, 20 bp, Artificial Sequence
  chemically synthesized
acatctaccaattgtcagaa

SEQ ID NO: 458267 - DNA, 20 bp, Artificial Sequence
  chemically synthesized
tttctagccattctgacaat

SEQ ID NO: 458268 - DNA, 20 bp, Artificial Sequence
  chemically synthesized
gtaaaacatctaccaattgt

SEQ ID NO: 458269 - DNA, 20 bp, Artificial Sequence
  chemically synthesized
ctagccattctgacaattgg

SEQ ID NO: 458270 - DNA, 20 bp, Artificial Sequence
  chemically synthesized
atatcagcagtatgtaaaaa

SEQ ID NO: 458271 - DNA, 20 bp, Artificial Sequence
  chemically synthesized
aatatcagcagtatgtaaaa

SEQ ID NO: 458272 - DNA, 20 bp, Artificial Sequence
  chemically synthesized
gttaaagtcgaaaatatcag

SEQ ID NO: 458273 - DNA, 20 bp, Artificial Sequence
  chemically synthesized
aaagttaaagtcgaaaatat

SEQ ID NO: 458274 - DNA, 20 bp, Artificial Sequence
  chemically synthesized
atggcatggaggaaaagtta

SEQ ID NO: 458275 - DNA, 20 bp, Artificial Sequence
  chemically synthesized
gtaaaaatggcatggaggaa

SEQ ID NO: 458276 - DNA, 20 bp, Artificial Sequence
  chemically synthesized
taattgtaaaaatggcatgg

SEQ ID NO: 458277 - DNA, 20 bp, Artificial Sequence
  chemically synthesized
gtaattgtaaaaatggcatg

SEQ ID NO: 458278 - DNA, 20 bp, Artificial Sequence
  chemically synthesized
ctgtaattgtaaaaatggca

SEQ ID NO: 458279 - DNA, 20 bp, Artificial Sequence
  chemically synthesized
tcaaactgtaattgtaaaaa

SEQ ID NO: 458280 - DNA, 20 bp, Artificial Sequence
  chemically synthesized
ccatgccatttttacaatta

SEQ ID NO: 458281 - DNA, 20 bp, Artificial Sequence
  chemically synthesized
aataaattttaataatataa

SEQ ID NO: 458282 - DNA, 20 bp, Artificial Sequence
  chemically synthesized
agagagtcaaaattcaagaa

SEQ ID NO: 458283 - DNA, 20 bp, Artificial Sequence
  chemically synthesized
ggagagagtcaaaattcaag

SEQ ID NO: 458284 - DNA, 20 bp, Artificial Sequence
  chemically synthesized
agtggagagagtcaaaattc

SEQ ID NO: 458285 - DNA, 20 bp, Artificial Sequence
  chemically synthesized
ggtgaatgggaaagtggaga

SEQ ID NO: 458286 - DNA, 20 bp, Artificial Sequence
  chemically synthesized
aaggtgaatgggaaagtgga

SEQ ID NO: 458287 - DNA, 20 bp, Artificial Sequence
  chemically synthesized
tcaaggtgaatgggaaagtg

SEQ ID NO: 458288 - DNA, 20 bp, Artificial Sequence
  chemically synthesized
catcaaggtgaatgggaaag

SEQ ID NO: 458289 - DNA, 20 bp, Artificial Sequence
  chemically synthesized
aaacatcaaggtgaatggga

SEQ ID NO: 458290 - DNA, 20 bp, Artificial Sequence
  chemically synthesized
tcggaaacatcaaggtgaat

SEQ ID NO: 458291 - DNA, 20 bp, Artificial Sequence
  chemically synthesized
atcggaaacatcaaggtgaa

SEQ ID NO: 458292 - DNA, 20 bp, Artificial Sequence
  chemically synthesized
aaggatcatcggaaacatca

SEQ ID NO: 458293 - DNA, 20 bp, Artificial Sequence
  chemically synthesized
aaaggatcatcggaaacatc

SEQ ID NO: 458294 - DNA, 20 bp, Artificial Sequence
  chemically synthesized
taccacagttaaaggatcat

SEQ ID NO: 458295 - DNA, 20 bp, Artificial Sequence
  chemically synthesized
ttccgatgatcctttaactg

SEQ ID NO: 458296 - DNA, 20 bp, Artificial Sequence
  chemically synthesized
gcaactgctaccacagttaa

SEQ ID NO: 458297 - DNA, 20 bp, Artificial Sequence
  chemically synthesized
tgcaactgctaccacagtta

SEQ ID NO: 458298 - DNA, 20 bp, Artificial Sequence
  chemically synthesized
cgatgatcctttaactgtgg

SEQ ID NO: 458299 - DNA, 20 bp, Artificial Sequence
  chemically synthesized
tgatcctttaactgtggtag

SEQ ID NO: 458300 - DNA, 20 bp, Artificial Sequence
  chemically synthesized
tttaagtgcaactgctacca

SEQ ID NO: 458301 - DNA, 20 bp, Artificial Sequence
  chemically synthesized
tggtagcagttgcacttaaa

SEQ ID NO: 458302 - DNA, 20 bp, Artificial Sequence
  chemically synthesized
ggatttgcagcatgctattt

SEQ ID NO: 458303 - DNA, 20 bp, Artificial Sequence
  chemically synthesized
ctctcacactgtaggatttg

SEQ ID NO: 458304 - DNA, 20 bp, Artificial Sequence
  chemically synthesized
atagcatgctgcaaatccta

SEQ ID NO: 458305 - DNA, 20 bp, Artificial Sequence
  chemically synthesized
tgctgcaaatcctacagtgt

SEQ ID NO: 458306 - DNA, 20 bp, Artificial Sequence
  chemically synthesized
agaaagagctctcacactgt

SEQ ID NO: 458307 - DNA, 20 bp, Artificial Sequence
  chemically synthesized
aagaaagagctctcacactg

SEQ ID NO: 458308 - DNA, 20 bp, Artificial Sequence
  chemically synthesized
ctgcaaatcctacagtgtga

SEQ ID NO: 458309 - DNA, 20 bp, Artificial Sequence
  chemically synthesized
atttaacataaagaaagaaa

SEQ ID NO: 458310 - DNA, 20 bp, Artificial Sequence
  chemically synthesized
aaatttaacataaagaaaga

SEQ ID NO: 458311 - DNA, 20 bp, Artificial Sequence
  chemically synthesized
ttagaaatttaacataaaga

SEQ ID NO: 458312 - DNA, 20 bp, Artificial Sequence
  chemically synthesized
cagtttagaaatttaacata

SEQ ID NO: 458313 - DNA, 20 bp, Artificial Sequence
  chemically synthesized
tgtctctagtggatacagtt

SEQ ID NO: 458314 - DNA, 20 bp, Artificial Sequence
  chemically synthesized
aatttctaaactgtatccac

SEQ ID NO: 458315 - DNA, 20 bp, Artificial Sequence
  chemically synthesized
tgagctgtctctagtggata

SEQ ID NO: 458316 - DNA, 20 bp, Artificial Sequence
  chemically synthesized
tttctaaactgtatccacta

SEQ ID NO: 458317 - DNA, 20 bp, Artificial Sequence
  chemically synthesized
taaactgtatccactagaga

SEQ ID NO: 458318 - DNA, 20 bp, Artificial Sequence
  chemically synthesized
ctcttctgagctgtctctag

SEQ ID NO: 458319 - DNA, 20 bp, Artificial Sequence
  chemically synthesized
tgtctcttctgagctgtctc

SEQ ID NO: 458320 - DNA, 20 bp, Artificial Sequence
  chemically synthesized
tgtatccactagagacagct

SEQ ID NO: 458321 - DNA, 20 bp, Artificial Sequence
  chemically synthesized
atccactagagacagctcag

SEQ ID NO: 458322 - DNA, 20 bp, Artificial Sequence
  chemically synthesized
ccactagagacagctcagaa

SEQ ID NO: 458323 - DNA, 20 bp, Artificial Sequence
  chemically synthesized
tagtattcattgtctcttct

SEQ ID NO: 458324 - DNA, 20 bp, Artificial Sequence
  chemically synthesized
agacaatgaatactaatcaa

SEQ ID NO: 458325 - DNA, 20 bp, Artificial Sequence
  chemically synthesized
acaatgaatactaatcaaaa

SEQ ID NO: 458326 - DNA, 20 bp, Artificial Sequence
  chemically synthesized
gtgattctttctcttttgat

SEQ ID NO: 458327 - DNA, 20 bp, Artificial Sequence
  chemically synthesized
tgaatactaatcaaaagaga

SEQ ID NO: 458328 - DNA, 20 bp, Artificial Sequence
  chemically synthesized
tcaaaagagaaagaatcact

SEQ ID NO: 458329 - DNA, 20 bp, Artificial Sequence
  chemically synthesized
gagaaagaatcacttggttg

SEQ ID NO: 458330 - DNA, 20 bp, Artificial Sequence
  chemically synthesized
gctaaggcgtgaccacaacc

SEQ ID NO: 458331 - DNA, 20 bp, Artificial Sequence
  chemically synthesized
acttggttgtggtcacgcct

SEQ ID NO: 458332 - DNA, 20 bp, Artificial Sequence
  chemically synthesized
ggttgtggtcacgccttagc

SEQ ID NO: 458333 - DNA, 20 bp, Artificial Sequence
  chemically synthesized
ggtaaaggggtttcttgcta

SEQ ID NO: 458334 - DNA, 20 bp, Artificial Sequence
  chemically synthesized
tggtaaaggggtttcttgct

SEQ ID NO: 458335 - DNA, 20 bp, Artificial Sequence
  chemically synthesized
ttagcaagaaacccctttac

SEQ ID NO: 458336 - DNA, 20 bp, Artificial Sequence
  chemically synthesized
agttgtcttttctggtaaag

SEQ ID NO: 458337 - DNA, 20 bp, Artificial Sequence
  chemically synthesized
cagttgtcttttctggtaaa

SEQ ID NO: 458338 - DNA, 20 bp, Artificial Sequence
  chemically synthesized
acagttgtcttttctggtaa

SEQ ID NO: 458339 - DNA, 20 bp, Artificial Sequence
  chemically synthesized
aacagttgtcttttctggta

SEQ ID NO: 458340 - DNA, 20 bp, Artificial Sequence
  chemically synthesized
aagaaacccctttaccagaa

SEQ ID NO: 458341 - DNA, 20 bp, Artificial Sequence
  chemically synthesized
tgtaaaacagttgtcttttc

SEQ ID NO: 458342 - DNA, 20 bp, Artificial Sequence
  chemically synthesized
tatataggtagcatgtaaaa

SEQ ID NO: 458343 - DNA, 20 bp, Artificial Sequence
  chemically synthesized
ttccactgggaatatatagg

SEQ ID NO: 458344 - DNA, 20 bp, Artificial Sequence
  chemically synthesized
tgtttccactgggaatatat

SEQ ID NO: 458345 - DNA, 20 bp, Artificial Sequence
  chemically synthesized
ctgtttccactgggaatata

SEQ ID NO: 458346 - DNA, 20 bp, Artificial Sequence
  chemically synthesized
acatgctacctatatattcc

SEQ ID NO: 458347 - DNA, 20 bp, Artificial Sequence
  chemically synthesized
tgctacctatatattcccag

SEQ ID NO: 458348 - DNA, 20 bp, Artificial Sequence
  chemically synthesized
gtgaagtggctgtttccact

SEQ ID NO: 458349 - DNA, 20 bp, Artificial Sequence
  chemically synthesized
ctatatattcccagtggaaa

SEQ ID NO: 458350 - DNA, 20 bp, Artificial Sequence
  chemically synthesized
tgtgaagtggctgtttccac

SEQ ID NO: 458351 - DNA, 20 bp, Artificial Sequence
  chemically synthesized
actttaaagtcgttgtgaag

SEQ ID NO: 458352 - DNA, 20 bp, Artificial Sequence
  chemically synthesized
ttcactttaaagtcgttgtg

SEQ ID NO: 458353 - DNA, 20 bp, Artificial Sequence
  chemically synthesized
gccacttcacaacgacttta

SEQ ID NO: 458354 - DNA, 20 bp, Artificial Sequence
  chemically synthesized
ttcacaacgactttaaagtg

SEQ ID NO: 458355 - DNA, 20 bp, Artificial Sequence
  chemically synthesized
actcattcatcttcacttta

SEQ ID NO: 458356 - DNA, 20 bp, Artificial Sequence
  chemically synthesized
actttaaagtgaagatgaat

SEQ ID NO: 458357 - DNA, 20 bp, Artificial Sequence
  chemically synthesized
gttttatcattgcttttttg

SEQ ID NO: 458358 - DNA, 20 bp, Artificial Sequence
  chemically synthesized
ctagtttatgcaccacaaaa

SEQ ID NO: 458359 - DNA, 20 bp, Artificial Sequence
  chemically synthesized
cttttttgtggtgcataaac

SEQ ID NO: 458360 - DNA, 20 bp, Artificial Sequence
  chemically synthesized
atactggatagtttcaggtc

SEQ ID NO: 458361 - DNA, 20 bp, Artificial Sequence
  chemically synthesized
ataaaatactggatagtttc

SEQ ID NO: 458362 - DNA, 20 bp, Artificial Sequence
  chemically synthesized
cataaaatactggatagttt

SEQ ID NO: 458363 - DNA, 20 bp, Artificial Sequence
  chemically synthesized
aaactagacctgaaactatc

SEQ ID NO: 458364 - DNA, 20 bp, Artificial Sequence
  chemically synthesized
aacaatcataaaatactgga

SEQ ID NO: 458365 - DNA, 20 bp, Artificial Sequence
  chemically synthesized
atgcaacaatcataaaatac

SEQ ID NO: 458366 - DNA, 20 bp, Artificial Sequence
  chemically synthesized
gttgcattgaacatgcaaat

SEQ ID NO: 458367 - DNA, 20 bp, Artificial Sequence
  chemically synthesized
acatgcaaattagcaaatat

SEQ ID NO: 458368 - DNA, 20 bp, Artificial Sequence
  chemically synthesized
gtggctgtggtatttgatca

SEQ ID NO: 458369 - DNA, 20 bp, Artificial Sequence
  chemically synthesized
ttagctttgatcaaatacca

SEQ ID NO: 458370 - DNA, 20 bp, Artificial Sequence
  chemically synthesized
aagcattctgggtgtggctg

SEQ ID NO: 458371 - DNA, 20 bp, Artificial Sequence
  chemically synthesized
tcaaataccacagccacacc

SEQ ID NO: 458372 - DNA, 20 bp, Artificial Sequence
  chemically synthesized
tagtacaagcattctgggtg

SEQ ID NO: 458373 - DNA, 20 bp, Artificial Sequence
  chemically synthesized
taaactagtacaagcattct

SEQ ID NO: 458374 - DNA, 20 bp, Artificial Sequence
  chemically synthesized
ttaaactagtacaagcattc

SEQ ID NO: 458375 - DNA, 20 bp, Artificial Sequence
  chemically synthesized
cacacccagaatgcttgtac

SEQ ID NO: 458376 - DNA, 20 bp, Artificial Sequence
  chemically synthesized
tgatggctttaaactagtac

SEQ ID NO: 458377 - DNA, 20 bp, Artificial Sequence
  chemically synthesized
agaatgcttgtactagttta

SEQ ID NO: 458378 - DNA, 20 bp, Artificial Sequence
  chemically synthesized
tgccaatgatggctttaaac

SEQ ID NO: 458379 - DNA, 20 bp, Artificial Sequence
  chemically synthesized
tactagtttaaagccatcat

SEQ ID NO: 458380 - DNA, 20 bp, Artificial Sequence
  chemically synthesized
attctggcctttgccaatga

SEQ ID NO: 458381 - DNA, 20 bp, Artificial Sequence
  chemically synthesized
gtttaaagccatcattggca

SEQ ID NO: 458382 - DNA, 20 bp, Artificial Sequence
  chemically synthesized
tttaaagccatcattggcaa

SEQ ID NO: 458383 - DNA, 20 bp, Artificial Sequence
  chemically synthesized
aagccatcattggcaaaggc

SEQ ID NO: 458384 - DNA, 20 bp, Artificial Sequence
  chemically synthesized
tcattaaaaacaaagaattc

SEQ ID NO: 458385 - DNA, 20 bp, Artificial Sequence
  chemically synthesized
tatgttcttcattaaaaaca

SEQ ID NO: 458386 - DNA, 20 bp, Artificial Sequence
  chemically synthesized
agaattctttgtttttaatg

SEQ ID NO: 458387 - DNA, 20 bp, Artificial Sequence
  chemically synthesized
aagaacatataattcccata

SEQ ID NO: 458388 - DNA, 20 bp, Artificial Sequence
  chemically synthesized
agaacatataattcccataa

SEQ ID NO: 458389 - DNA, 20 bp, Artificial Sequence
  chemically synthesized
tgataatctcatgcctttat

SEQ ID NO: 458390 - DNA, 20 bp, Artificial Sequence
  chemically synthesized
ctgataatctcatgccttta

SEQ ID NO: 458391 - DNA, 20 bp, Artificial Sequence
  chemically synthesized
tataattcccataaaggcat

SEQ ID NO: 458392 - DNA, 20 bp, Artificial Sequence
  chemically synthesized
ccataaaggcatgagattat

SEQ ID NO: 458393 - DNA, 20 bp, Artificial Sequence
  chemically synthesized
cataaaggcatgagattatc

SEQ ID NO: 458394 - DNA, 20 bp, Artificial Sequence
  chemically synthesized
tcacctgatcatattgacat

SEQ ID NO: 458395 - DNA, 20 bp, Artificial Sequence
  chemically synthesized
ttcacctgatcatattgaca

SEQ ID NO: 458396 - DNA, 20 bp, Artificial Sequence
  chemically synthesized
ggcacccatgtcaatatgat

SEQ ID NO: 458397 - DNA, 20 bp, Artificial Sequence
  chemically synthesized
gcacccatgtcaatatgatc

SEQ ID NO: 458398 - DNA, 20 bp, Artificial Sequence
  chemically synthesized
tatgatcaggtgaaaacttc

SEQ ID NO: 458399 - DNA, 20 bp, Artificial Sequence
  chemically synthesized
gttagttgaggatgaaccag

SEQ ID NO: 458400 - DNA, 20 bp, Artificial Sequence
  chemically synthesized
aaggttagttgaggatgaac

SEQ ID NO: 458401 - DNA, 20 bp, Artificial Sequence
  chemically synthesized
agataggaaaaggttagttg

SEQ ID NO: 458402 - DNA, 20 bp, Artificial Sequence
  chemically synthesized
aagataggaaaaggttagtt

SEQ ID NO: 458403 - DNA, 20 bp, Artificial Sequence
  chemically synthesized
tcagcaagataggaaaaggt

SEQ ID NO: 458404 - DNA, 20 bp, Artificial Sequence
  chemically synthesized
ctcatcagcaagataggaaa

SEQ ID NO: 458405 - DNA, 20 bp, Artificial Sequence
  chemically synthesized
cctcatcagcaagataggaa

SEQ ID NO: 458406 - DNA, 20 bp, Artificial Sequence
  chemically synthesized
attttcctcatcagcaagat

SEQ ID NO: 458407 - DNA, 20 bp, Artificial Sequence
  chemically synthesized
aattttcctcatcagcaaga

SEQ ID NO: 458408 - DNA, 20 bp, Artificial Sequence
  chemically synthesized
ccttttcctatcttgctgat

SEQ ID NO: 458409 - DNA, 20 bp, Artificial Sequence
  chemically synthesized
cttttcctatcttgctgatg

SEQ ID NO: 458410 - DNA, 20 bp, Artificial Sequence
  chemically synthesized
attaaattttcctcatcagc

SEQ ID NO: 458411 - DNA, 20 bp, Artificial Sequence
  chemically synthesized
tagtattaaattttcctcat

SEQ ID NO: 458412 - DNA, 20 bp, Artificial Sequence
  chemically synthesized
gatgaggaaaatttaatact

SEQ ID NO: 458413 - DNA, 20 bp, Artificial Sequence
  chemically synthesized
gtttgtctccacagttagct

SEQ ID NO: 458414 - DNA, 20 bp, Artificial Sequence
  chemically synthesized
atttaatactaagctaactg

SEQ ID NO: 458415 - DNA, 20 bp, Artificial Sequence
  chemically synthesized
ttaatactaagctaactgtg

SEQ ID NO: 458416 - DNA, 20 bp, Artificial Sequence
  chemically synthesized
ttatagtttgtctccacagt

SEQ ID NO: 458417 - DNA, 20 bp, Artificial Sequence
  chemically synthesized
agagttatagtttgtctcca

SEQ ID NO: 458418 - DNA, 20 bp, Artificial Sequence
  chemically synthesized
ccaaacattacaaagagtta

SEQ ID NO: 458419 - DNA, 20 bp, Artificial Sequence
  chemically synthesized
tggcatccaaacattacaaa

SEQ ID NO: 458420 - DNA, 20 bp, Artificial Sequence
  chemically synthesized
tatggcatccaaacattaca

SEQ ID NO: 458421 - DNA, 20 bp, Artificial Sequence
  chemically synthesized
ctataactctttgtaatgtt

SEQ ID NO: 458422 - DNA, 20 bp, Artificial Sequence
  chemically synthesized
agacacaaacaatcacagta

SEQ ID NO: 458423 - DNA, 20 bp, Artificial Sequence
  chemically synthesized
tgagaagacacaaacaatca

SEQ ID NO: 458424 - DNA, 20 bp, Artificial Sequence
  chemically synthesized
ttcaacatatgaagtttgag

SEQ ID NO: 458425 - DNA, 20 bp, Artificial Sequence
  chemically synthesized
gaattcaacatatgaagttt

SEQ ID NO: 458426 - DNA, 20 bp, Artificial Sequence
  chemically synthesized
tgattagaattcaacatatg

SEQ ID NO: 458427 - DNA, 20 bp, Artificial Sequence
  chemically synthesized
tatgttgaattctaatcacc

SEQ ID NO: 458428 - DNA, 20 bp, Artificial Sequence
  chemically synthesized
aatatagtcatcttggtgat

SEQ ID NO: 458429 - DNA, 20 bp, Artificial Sequence
  chemically synthesized
accttataatatagtcatct

SEQ ID NO: 458430 - DNA, 20 bp, Artificial Sequence
  chemically synthesized
caccaagatgactatattat

SEQ ID NO: 458431 - DNA, 20 bp, Artificial Sequence
  chemically synthesized
accaagatgactatattata

SEQ ID NO: 458432 - DNA, 20 bp, Artificial Sequence
  chemically synthesized
aaaggcactaccttataata

SEQ ID NO: 458433 - DNA, 20 bp, Artificial Sequence
  chemically synthesized
aagatgactatattataagg

SEQ ID NO: 458434 - DNA, 20 bp, Artificial Sequence
  chemically synthesized
atattataaggtagtgcctt

SEQ ID NO: 458435 - DNA, 20 bp, Artificial Sequence
  chemically synthesized
tattataaggtagtgccttt

SEQ ID NO: 458436 - DNA, 20 bp, Artificial Sequence
  chemically synthesized
atgacccaataaattcccaa

SEQ ID NO: 458437 - DNA, 20 bp, Artificial Sequence
  chemically synthesized
catgacccaataaattccca

SEQ ID NO: 458438 - DNA, 20 bp, Artificial Sequence
  chemically synthesized
tagtgcctttgggaatttat

SEQ ID NO: 458439 - DNA, 20 bp, Artificial Sequence
  chemically synthesized
agtgcctttgggaatttatt

SEQ ID NO: 458440 - DNA, 20 bp, Artificial Sequence
  chemically synthesized
ttgggaatttattgggtcat

SEQ ID NO: 458441 - DNA, 20 bp, Artificial Sequence
  chemically synthesized
tgggaatttattgggtcatg

SEQ ID NO: 458442 - DNA, 20 bp, Artificial Sequence
  chemically synthesized
gggaatttattgggtcatga

SEQ ID NO: 458443 - DNA, 20 bp, Artificial Sequence
  chemically synthesized
taatcccattcatgaaggta

SEQ ID NO: 458444 - DNA, 20 bp, Artificial Sequence
  chemically synthesized
attaatcccattcatgaagg

SEQ ID NO: 458445 - DNA, 20 bp, Artificial Sequence
  chemically synthesized
gagggctctaccttcatgaa

SEQ ID NO: 458446 - DNA, 20 bp, Artificial Sequence
  chemically synthesized
ggcattaatcccattcatga

SEQ ID NO: 458447 - DNA, 20 bp, Artificial Sequence
  chemically synthesized
agggctctaccttcatgaat

SEQ ID NO: 458448 - DNA, 20 bp, Artificial Sequence
  chemically synthesized
gggcattaatcccattcatg

SEQ ID NO: 458449 - DNA, 20 bp, Artificial Sequence
  chemically synthesized
aatgggattaatgcccttat

SEQ ID NO: 458450 - DNA, 20 bp, Artificial Sequence
  chemically synthesized
tgggattaatgcccttataa

SEQ ID NO: 458451 - DNA, 20 bp, Artificial Sequence
  chemically synthesized
ctcttgggcctctcttataa

SEQ ID NO: 458452 - DNA, 20 bp, Artificial Sequence
  chemically synthesized
ggattaatgcccttataaga

SEQ ID NO: 458453 - DNA, 20 bp, Artificial Sequence
  chemically synthesized
cctcttgggcctctcttata

SEQ ID NO: 458454 - DNA, 20 bp, Artificial Sequence
  chemically synthesized
gattaatgcccttataagag

SEQ ID NO: 458455 - DNA, 20 bp, Artificial Sequence
  chemically synthesized
gcctcttgggcctctcttat

SEQ ID NO: 458456 - DNA, 20 bp, Artificial Sequence
  chemically synthesized
tgcccttataagagaggccc

SEQ ID NO: 458457 - DNA, 20 bp, Artificial Sequence
  chemically synthesized
cccttataagagaggcccaa

SEQ ID NO: 458458 - DNA, 20 bp, Artificial Sequence
  chemically synthesized
ccttataagagaggcccaag

SEQ ID NO: 458459 - DNA, 20 bp, Artificial Sequence
  chemically synthesized
ctgagcttccaaggcctctt

SEQ ID NO: 458460 - DNA, 20 bp, Artificial Sequence
  chemically synthesized
actgagcttccaaggcctct

SEQ ID NO: 458461 - DNA, 20 bp, Artificial Sequence
  chemically synthesized
aagagaggcccaagaggcct

SEQ ID NO: 458462 - DNA, 20 bp, Artificial Sequence
  chemically synthesized
agaggcccaagaggccttgg

SEQ ID NO: 458463 - DNA, 20 bp, Artificial Sequence
  chemically synthesized
gcacgctcactgagcttcca

SEQ ID NO: 458464 - DNA, 20 bp, Artificial Sequence
  chemically synthesized
cccaagaggccttggaagct

SEQ ID NO: 458465 - DNA, 20 bp, Artificial Sequence
  chemically synthesized
ggcacgctcactgagcttcc

SEQ ID NO: 458466 - DNA, 20 bp, Artificial Sequence
  chemically synthesized
agaggccttggaagctcagt

SEQ ID NO: 458467 - DNA, 20 bp, Artificial Sequence
  chemically synthesized
aaggtgcaggcacgctcact

SEQ ID NO: 458468 - DNA, 20 bp, Artificial Sequence
  chemically synthesized
gaagttcaaggtcaaggtgc

SEQ ID NO: 458469 - DNA, 20 bp, Artificial Sequence
  chemically synthesized
ggaagttcaaggtcaaggtg

SEQ ID NO: 458470 - DNA, 20 bp, Artificial Sequence
  chemically synthesized
ggcggggaagttcaaggtca

SEQ ID NO: 458471 - DNA, 20 bp, Artificial Sequence
  chemically synthesized
aggcggggaagttcaaggtc

SEQ ID NO: 458472 - DNA, 20 bp, Artificial Sequence
  chemically synthesized
tatggaggcggggaagttca

SEQ ID NO: 458473 - DNA, 20 bp, Artificial Sequence
  chemically synthesized
ttatggaggcggggaagttc

SEQ ID NO: 458474 - DNA, 20 bp, Artificial Sequence
  chemically synthesized
tcccagttatggaggcgggg

SEQ ID NO: 458475 - DNA, 20 bp, Artificial Sequence
  chemically synthesized
ttctcccagttatggaggcg

SEQ ID NO: 458476 - DNA, 20 bp, Artificial Sequence
  chemically synthesized
tttctcccagttatggaggc

SEQ ID NO: 458477 - DNA, 20 bp, Artificial Sequence
  chemically synthesized
atttctcccagttatggagg

SEQ ID NO: 458478 - DNA, 20 bp, Artificial Sequence
  chemically synthesized
aacttccccgcctccataac

SEQ ID NO: 458479 - DNA, 20 bp, Artificial Sequence
  chemically synthesized
tttatttctcccagttatgg

SEQ ID NO: 458480 - DNA, 20 bp, Artificial Sequence
  chemically synthesized
acttccccgcctccataact

SEQ ID NO: 458481 - DNA, 20 bp, Artificial Sequence
  chemically synthesized
atttatttctcccagttatg

SEQ ID NO: 458482 - DNA, 20 bp, Artificial Sequence
  chemically synthesized
ttccccgcctccataactgg

SEQ ID NO: 458483 - DNA, 20 bp, Artificial Sequence
  chemically synthesized
aaatttatttctcccagtta

SEQ ID NO: 458484 - DNA, 20 bp, Artificial Sequence
  chemically synthesized
gaacagaaatttatttctcc

SEQ ID NO: 458485 - DNA, 20 bp, Artificial Sequence
  chemically synthesized
acagggtggcttataaagaa

SEQ ID NO: 458486 - DNA, 20 bp, Artificial Sequence
  chemically synthesized
aataaatttctgttctttat

SEQ ID NO: 458487 - DNA, 20 bp, Artificial Sequence
  chemically synthesized
cataaacagggtggcttata

SEQ ID NO: 458488 - DNA, 20 bp, Artificial Sequence
  chemically synthesized
caaaaataccataaacaggg

SEQ ID NO: 458489 - DNA, 20 bp, Artificial Sequence
  chemically synthesized
tttataagccaccctgttta

SEQ ID NO: 458490 - DNA, 20 bp, Artificial Sequence
  chemically synthesized
taacaaaaataccataaaca

SEQ ID NO: 458491 - DNA, 20 bp, Artificial Sequence
  chemically synthesized
gtaacaaaaataccataaac

SEQ ID NO: 458492 - DNA, 20 bp, Artificial Sequence
  chemically synthesized
tgtaacaaaaataccataaa

SEQ ID NO: 458493 - DNA, 20 bp, Artificial Sequence
  chemically synthesized
ttatggtatttttgttacac

SEQ ID NO: 458494 - DNA, 20 bp, Artificial Sequence
  chemically synthesized
tttttgttacaccagtctaa

SEQ ID NO: 458495 - DNA, 20 bp, Artificial Sequence
  chemically synthesized
ttttgttacaccagtctaaa

SEQ ID NO: 458496 - DNA, 20 bp, Artificial Sequence
  chemically synthesized
gtgtcttagtccttttagac

SEQ ID NO: 458497 - DNA, 20 bp, Artificial Sequence
  chemically synthesized
aatcagtgtcttagtccttt

SEQ ID NO: 458498 - DNA, 20 bp, Artificial Sequence
  chemically synthesized
tacaccagtctaaaaggact

SEQ ID NO: 458499 - DNA, 20 bp, Artificial Sequence
  chemically synthesized
tcttccccaaatcagtgtct

SEQ ID NO: 458500 - DNA, 20 bp, Artificial Sequence
  chemically synthesized
aaaggactaagacactgatt

SEQ ID NO: 458501 - DNA, 20 bp, Artificial Sequence
  chemically synthesized
aaggactaagacactgattt

SEQ ID NO: 458502 - DNA, 20 bp, Artificial Sequence
  chemically synthesized
aggactaagacactgatttg

SEQ ID NO: 458503 - DNA, 20 bp, Artificial Sequence
  chemically synthesized
tgccaaaatcttccccaaat

SEQ ID NO: 458504 - DNA, 20 bp, Artificial Sequence
  chemically synthesized
actaagacactgatttgggg

SEQ ID NO: 458505 - DNA, 20 bp, Artificial Sequence
  chemically synthesized
cactgatttggggaagattt

SEQ ID NO: 458506 - DNA, 20 bp, Artificial Sequence
  chemically synthesized
tgatttggggaagattttgg

SEQ ID NO: 458507 - DNA, 20 bp, Artificial Sequence
  chemically synthesized
ggaagagtatgtaaaagaga

SEQ ID NO: 458508 - DNA, 20 bp, Artificial Sequence
  chemically synthesized
ttggggaagagtatgtaaaa

SEQ ID NO: 458509 - DNA, 20 bp, Artificial Sequence
  chemically synthesized
cattggggaagagtatgtaa

SEQ ID NO: 458510 - DNA, 20 bp, Artificial Sequence
  chemically synthesized
tagaagtttacattggggaa

SEQ ID NO: 458511 - DNA, 20 bp, Artificial Sequence
  chemically synthesized
tatagaagtttacattgggg

SEQ ID NO: 458512 - DNA, 20 bp, Artificial Sequence
  chemically synthesized
gattatagaagtttacattg

SEQ ID NO: 458513 - DNA, 20 bp, Artificial Sequence
  chemically synthesized
agattatagaagtttacatt

SEQ ID NO: 458514 - DNA, 20 bp, Artificial Sequence
  chemically synthesized
tagattatagaagtttacat

SEQ ID NO: 458515 - DNA, 20 bp, Artificial Sequence
  chemically synthesized
ctcccttgattagattatag

SEQ ID NO: 458516 - DNA, 20 bp, Artificial Sequence
  chemically synthesized
aaactcccttgattagatta

SEQ ID NO: 458517 - DNA, 20 bp, Artificial Sequence
  chemically synthesized
taaacttctataatctaatc

SEQ ID NO: 458518 - DNA, 20 bp, Artificial Sequence
  chemically synthesized
aaacttctataatctaatca

SEQ ID NO: 458519 - DNA, 20 bp, Artificial Sequence
  chemically synthesized
aacttctataatctaatcaa

SEQ ID NO: 458520 - DNA, 20 bp, Artificial Sequence
  chemically synthesized
cttctataatctaatcaagg

SEQ ID NO: 458521 - DNA, 20 bp, Artificial Sequence
  chemically synthesized
tatgtttaaactcccttgat

SEQ ID NO: 458522 - DNA, 20 bp, Artificial Sequence
  chemically synthesized
tcaagggagtttaaacataa

SEQ ID NO: 458523 - DNA, 20 bp, Artificial Sequence
  chemically synthesized
taaacataatagccatgtaa

SEQ ID NO: 458524 - DNA, 20 bp, Artificial Sequence
  chemically synthesized
tttacactgtgtctgttaca

SEQ ID NO: 458525 - DNA, 20 bp, Artificial Sequence
  chemically synthesized
taatagccatgtaacagaca

SEQ ID NO: 458526 - DNA, 20 bp, Artificial Sequence
  chemically synthesized
agacacagtgtaaaatatca

SEQ ID NO: 458527 - DNA, 20 bp, Artificial Sequence
  chemically synthesized
taaaatatcaaagatttttt

SEQ ID NO: 458528 - DNA, 20 bp, Artificial Sequence
  chemically synthesized
atcaaagattttttaagatg

SEQ ID NO: 458529 - DNA, 20 bp, Artificial Sequence
  chemically synthesized
gattttttaagatgtagaac

SEQ ID NO: 458530 - DNA, 20 bp, Artificial Sequence
  chemically synthesized
agatgtagaaccagtcgcgt

SEQ ID NO: 458531 - DNA, 20 bp, Artificial Sequence
  chemically synthesized
agccacaatactaacgcgac

SEQ ID NO: 458532 - DNA, 20 bp, Artificial Sequence
  chemically synthesized
aaccagtcgcgttagtattg

SEQ ID NO: 458533 - DNA, 20 bp, Artificial Sequence
  chemically synthesized
tcgcgttagtattgtggctt

SEQ ID NO: 458534 - DNA, 20 bp, Artificial Sequence
  chemically synthesized
cgcgttagtattgtggcttc

SEQ ID NO: 458535 - DNA, 20 bp, Artificial Sequence
  chemically synthesized
gcgttagtattgtggcttca

SEQ ID NO: 458536 - DNA, 20 bp, Artificial Sequence
  chemically synthesized
taagaaatacattgtccctg

SEQ ID NO: 458537 - DNA, 20 bp, Artificial Sequence
  chemically synthesized
cagggacaatgtatttctta

SEQ ID NO: 458538 - DNA, 20 bp, Artificial Sequence
  chemically synthesized
acaatgtatttcttatagca

SEQ ID NO: 458539 - DNA, 20 bp, Artificial Sequence
  chemically synthesized
ttaattggtctctttgctat

SEQ ID NO: 458540 - DNA, 20 bp, Artificial Sequence
  chemically synthesized
aatgtatttcttatagcaaa

SEQ ID NO: 458541 - DNA, 20 bp, Artificial Sequence
  chemically synthesized
tagcaaagagaccaattaac

SEQ ID NO: 458542 - DNA, 20 bp, Artificial Sequence
  chemically synthesized
agcaaagagaccaattaaca

SEQ ID NO: 458543 - DNA, 20 bp, Artificial Sequence
  chemically synthesized
ctttatcgaaccttgttaat

SEQ ID NO: 458544 - DNA, 20 bp, Artificial Sequence
  chemically synthesized
ccaattaacaaggttcgata

SEQ ID NO: 458545 - DNA, 20 bp, Artificial Sequence
  chemically synthesized
attaacaaggttcgataaag

SEQ ID NO: 458546 - DNA, 20 bp, Artificial Sequence
  chemically synthesized
actgaaggacagcgagtgca

SEQ ID NO: 458547 - DNA, 20 bp, Artificial Sequence
  chemically synthesized
gcaaaatactgaaggacagc

SEQ ID NO: 458548 - DNA, 20 bp, Artificial Sequence
  chemically synthesized
tccatgcactcgctgtcctt

SEQ ID NO: 458549 - DNA, 20 bp, Artificial Sequence
  chemically synthesized
tcatgcaaaatactgaagga

SEQ ID NO: 458550 - DNA, 20 bp, Artificial Sequence
  chemically synthesized
ggcttcatgcaaaatactga

SEQ ID NO: 458551 - DNA, 20 bp, Artificial Sequence
  chemically synthesized
tggcttcatgcaaaatactg

SEQ ID NO: 458552 - DNA, 20 bp, Artificial Sequence
  chemically synthesized
gtccttcagtattttgcatg

SEQ ID NO: 458553 - DNA, 20 bp, Artificial Sequence
  chemically synthesized
cagtattttgcatgaagcca

SEQ ID NO: 458554 - DNA, 20 bp, Artificial Sequence
  chemically synthesized
agtattttgcatgaagccaa

SEQ ID NO: 458555 - DNA, 20 bp, Artificial Sequence
  chemically synthesized
attttgcatgaagccaaagg

SEQ ID NO: 458556 - DNA, 20 bp, Artificial Sequence
  chemically synthesized
cttctagcatattctgcctt

SEQ ID NO: 458557 - DNA, 20 bp, Artificial Sequence
  chemically synthesized
aagccaaaggcagaatatgc

SEQ ID NO: 458558 - DNA, 20 bp, Artificial Sequence
  chemically synthesized
ccaaaggcagaatatgctag

SEQ ID NO: 458559 - DNA, 20 bp, Artificial Sequence
  chemically synthesized
aaggcagaatatgctagaag

SEQ ID NO: 458560 - DNA, 20 bp, Artificial Sequence
  chemically synthesized
acctcctgcttttctacttc

SEQ ID NO: 458561 - DNA, 20 bp, Artificial Sequence
  chemically synthesized
agaatatgctagaagtagaa

SEQ ID NO: 458562 - DNA, 20 bp, Artificial Sequence
  chemically synthesized
atatgctagaagtagaaaag

SEQ ID NO: 458563 - DNA, 20 bp, Artificial Sequence
  chemically synthesized
tatgctagaagtagaaaagc

SEQ ID NO: 458564 - DNA, 20 bp, Artificial Sequence
  chemically synthesized
tgctagaagtagaaaagcag

SEQ ID NO: 458565 - DNA, 20 bp, Artificial Sequence
  chemically synthesized
gctagaagtagaaaagcagg

SEQ ID NO: 458566 - DNA, 20 bp, Artificial Sequence
  chemically synthesized
gttaaaataaccattatcac

SEQ ID NO: 458567 - DNA, 20 bp, Artificial Sequence
  chemically synthesized
tgtcagggtcctggtgataa

SEQ ID NO: 458568 - DNA, 20 bp, Artificial Sequence
  chemically synthesized
ttaaaataaccattatcacc

SEQ ID NO: 458569 - DNA, 20 bp, Artificial Sequence
  chemically synthesized
cttgagtggtgtcagggtcc

SEQ ID NO: 458570 - DNA, 20 bp, Artificial Sequence
  chemically synthesized
cctggccttgagtggtgtca

SEQ ID NO: 458571 - DNA, 20 bp, Artificial Sequence
  chemically synthesized
gcctggccttgagtggtgtc

SEQ ID NO: 458572 - DNA, 20 bp, Artificial Sequence
  chemically synthesized
tgcctggccttgagtggtgt

SEQ ID NO: 458573 - DNA, 20 bp, Artificial Sequence
  chemically synthesized
ccaggaccctgacaccactc

SEQ ID NO: 458574 - DNA, 20 bp, Artificial Sequence
  chemically synthesized
caggaccctgacaccactca

SEQ ID NO: 458575 - DNA, 20 bp, Artificial Sequence
  chemically synthesized
agacaatgcctggccttgag

SEQ ID NO: 458576 - DNA, 20 bp, Artificial Sequence
  chemically synthesized
accctgacaccactcaaggc

SEQ ID NO: 458577 - DNA, 20 bp, Artificial Sequence
  chemically synthesized
ccctgacaccactcaaggcc

SEQ ID NO: 458578 - DNA, 20 bp, Artificial Sequence
  chemically synthesized
atcagacaatgcctggcctt

SEQ ID NO: 458579 - DNA, 20 bp, Artificial Sequence
  chemically synthesized
tccctaaatcagacaatgcc

SEQ ID NO: 458580 - DNA, 20 bp, Artificial Sequence
  chemically synthesized
aggccaggcattgtctgatt

SEQ ID NO: 458581 - DNA, 20 bp, Artificial Sequence
  chemically synthesized
ggccaggcattgtctgattt

SEQ ID NO: 458582 - DNA, 20 bp, Artificial Sequence
  chemically synthesized
gccaggcattgtctgattta

SEQ ID NO: 458583 - DNA, 20 bp, Artificial Sequence
  chemically synthesized
caggcattgtctgatttagg

SEQ ID NO: 458584 - DNA, 20 bp, Artificial Sequence
  chemically synthesized
actcatgcttctccctaaat

SEQ ID NO: 458585 - DNA, 20 bp, Artificial Sequence
  chemically synthesized
gcattgtctgatttagggag

SEQ ID NO: 458586 - DNA, 20 bp, Artificial Sequence
  chemically synthesized
tctgatttagggagaagcat

SEQ ID NO: 458587 - DNA, 20 bp, Artificial Sequence
  chemically synthesized
agaagcatgagtttccttcc

SEQ ID NO: 458588 - DNA, 20 bp, Artificial Sequence
  chemically synthesized
agcatgagtttccttccaag

SEQ ID NO: 458589 - DNA, 20 bp, Artificial Sequence
  chemically synthesized
tacaggtaataccacttgga

SEQ ID NO: 458590 - DNA, 20 bp, Artificial Sequence
  chemically synthesized
ttacaggtaataccacttgg

SEQ ID NO: 458591 - DNA, 20 bp, Artificial Sequence
  chemically synthesized
tttttacaggtaataccact

SEQ ID NO: 458592 - DNA, 20 bp, Artificial Sequence
  chemically synthesized
tgaattgccctggtttttac

SEQ ID NO: 458593 - DNA, 20 bp, Artificial Sequence
  chemically synthesized
gtggtattacctgtaaaaac

SEQ ID NO: 458594 - DNA, 20 bp, Artificial Sequence
  chemically synthesized
gtgaattgccctggttttta

SEQ ID NO: 458595 - DNA, 20 bp, Artificial Sequence
  chemically synthesized
tggtattacctgtaaaaacc

SEQ ID NO: 458596 - DNA, 20 bp, Artificial Sequence
  chemically synthesized
ggtattacctgtaaaaacca

SEQ ID NO: 458597 - DNA, 20 bp, Artificial Sequence
  chemically synthesized
acctggagagtgaattgccc

SEQ ID NO: 458598 - DNA, 20 bp, Artificial Sequence
  chemically synthesized
aaccagggcaattcactctc

SEQ ID NO: 458599 - DNA, 20 bp, Artificial Sequence
  chemically synthesized
accagggcaattcactctcc

SEQ ID NO: 458600 - DNA, 20 bp, Artificial Sequence
  chemically synthesized
gggcaattcactctccaggt

SEQ ID NO: 458601 - DNA, 20 bp, Artificial Sequence
  chemically synthesized
ttcctaaggccttacctgga

SEQ ID NO: 458602 - DNA, 20 bp, Artificial Sequence
  chemically synthesized
ggcaattcactctccaggta

SEQ ID NO: 458603 - DNA, 20 bp, Artificial Sequence
  chemically synthesized
agttcctaaggccttacctg

SEQ ID NO: 458604 - DNA, 20 bp, Artificial Sequence
  chemically synthesized
acagttcctaaggccttacc

SEQ ID NO: 458605 - DNA, 20 bp, Artificial Sequence
  chemically synthesized
tcactctccaggtaaggcct

SEQ ID NO: 458606 - DNA, 20 bp, Artificial Sequence
  chemically synthesized
cactctccaggtaaggcctt

SEQ ID NO: 458607 - DNA, 20 bp, Artificial Sequence
  chemically synthesized
atgtgtacgtacagttccta

SEQ ID NO: 458608 - DNA, 20 bp, Artificial Sequence
  chemically synthesized
aatgtgtacgtacagttcct

SEQ ID NO: 458609 - DNA, 20 bp, Artificial Sequence
  chemically synthesized
gatggaaaaatgtgtacgta

SEQ ID NO: 458610 - DNA, 20 bp, Artificial Sequence
  chemically synthesized
aggtgcttgcaaaattgaga

SEQ ID NO: 458611 - DNA, 20 bp, Artificial Sequence
  chemically synthesized
gaagaggtgcttgcaaaatt

SEQ ID NO: 458612 - DNA, 20 bp, Artificial Sequence
  chemically synthesized
tttttccatctcaattttgc

SEQ ID NO: 458613 - DNA, 20 bp, Artificial Sequence
  chemically synthesized
atccacacactattttgaag

SEQ ID NO: 458614 - DNA, 20 bp, Artificial Sequence
  chemically synthesized
ttgcaagcacctcttcaaaa

SEQ ID NO: 458615 - DNA, 20 bp, Artificial Sequence
  chemically synthesized
tatccacacactattttgaa

SEQ ID NO: 458616 - DNA, 20 bp, Artificial Sequence
  chemically synthesized
ggtatccacacactattttg

SEQ ID NO: 458617 - DNA, 20 bp, Artificial Sequence
  chemically synthesized
cacctcttcaaaatagtgtg

SEQ ID NO: 458618 - DNA, 20 bp, Artificial Sequence
  chemically synthesized
ctgtctgtttggagtgggca

SEQ ID NO: 458619 - DNA, 20 bp, Artificial Sequence
  chemically synthesized
tctgtctgtttggagtgggc

SEQ ID NO: 458620 - DNA, 20 bp, Artificial Sequence
  chemically synthesized
ttctgtctgtttggagtggg

SEQ ID NO: 458621 - DNA, 20 bp, Artificial Sequence
  chemically synthesized
tatttctgtctgtttggagt

SEQ ID NO: 458622 - DNA, 20 bp, Artificial Sequence
  chemically synthesized
gataccctgcccactccaaa

SEQ ID NO: 458623 - DNA, 20 bp, Artificial Sequence
  chemically synthesized
ctatttctgtctgtttggag

SEQ ID NO: 458624 - DNA, 20 bp, Artificial Sequence
  chemically synthesized
cacctatttctgtctgtttg

SEQ ID NO: 458625 - DNA, 20 bp, Artificial Sequence
  chemically synthesized
ccctgcccactccaaacaga

SEQ ID NO: 458626 - DNA, 20 bp, Artificial Sequence
  chemically synthesized
gccacctatttctgtctgtt

SEQ ID NO: 458627 - DNA, 20 bp, Artificial Sequence
  chemically synthesized
ccactccaaacagacagaaa

SEQ ID NO: 458628 - DNA, 20 bp, Artificial Sequence
  chemically synthesized
cactccaaacagacagaaat

SEQ ID NO: 458629 - DNA, 20 bp, Artificial Sequence
  chemically synthesized
tccaaacagacagaaatagg

SEQ ID NO: 458630 - DNA, 20 bp, Artificial Sequence
  chemically synthesized
atttctaagcattatgtaga

SEQ ID NO: 458631 - DNA, 20 bp, Artificial Sequence
  chemically synthesized
taatttctaagcattatgta

SEQ ID NO: 458632 - DNA, 20 bp, Artificial Sequence
  chemically synthesized
tataatttctaagcattatg

SEQ ID NO: 458633 - DNA, 20 bp, Artificial Sequence
  chemically synthesized
gtggctctctacataatgct

SEQ ID NO: 458634 - DNA, 20 bp, Artificial Sequence
  chemically synthesized
taccatgaagtataatttct

SEQ ID NO: 458635 - DNA, 20 bp, Artificial Sequence
  chemically synthesized
tgcttagaaattatacttca

SEQ ID NO: 458636 - DNA, 20 bp, Artificial Sequence
  chemically synthesized
ttaaaaaaaaatataccatg

SEQ ID NO: 458637 - DNA, 20 bp, Artificial Sequence
  chemically synthesized
ttcatggtatattttttttt

SEQ ID NO: 458638 - DNA, 20 bp, Artificial Sequence
  chemically synthesized
tcatggtatattttttttta

SEQ ID NO: 458639 - DNA, 20 bp, Artificial Sequence
  chemically synthesized
tggtatatttttttttaagg

SEQ ID NO: 458640 - DNA, 20 bp, Artificial Sequence
  chemically synthesized
ttttttaaggaagacatgcc

SEQ ID NO: 458641 - DNA, 20 bp, Artificial Sequence
  chemically synthesized
gggcataagatcattatgct

SEQ ID NO: 458642 - DNA, 20 bp, Artificial Sequence
  chemically synthesized
aaaaagtttcacaagggcat

SEQ ID NO: 458643 - DNA, 20 bp, Artificial Sequence
  chemically synthesized
aattttaaaaagtttcacaa

SEQ ID NO: 458644 - DNA, 20 bp, Artificial Sequence
  chemically synthesized
caattttaaaaagtttcaca

SEQ ID NO: 458645 - DNA, 20 bp, Artificial Sequence
  chemically synthesized
acaattttaaaaagtttcac

SEQ ID NO: 458646 - DNA, 20 bp, Artificial Sequence
  chemically synthesized
actgtgttcacaattttaaa

SEQ ID NO: 458647 - DNA, 20 bp, Artificial Sequence
  chemically synthesized
actttttaaaattgtgaaca

SEQ ID NO: 458648 - DNA, 20 bp, Artificial Sequence
  chemically synthesized
ttgtaaaatcgaattggaat

SEQ ID NO: 458649 - DNA, 20 bp, Artificial Sequence
  chemically synthesized
ataattttgtaaaatcgaat

SEQ ID NO: 458650 - DNA, 20 bp, Artificial Sequence
  chemically synthesized
ttcgattttacaaaattatg

SEQ ID NO: 458651 - DNA, 20 bp, Artificial Sequence
  chemically synthesized
attttacaaaattatgcagt

SEQ ID NO: 458652 - DNA, 20 bp, Artificial Sequence
  chemically synthesized
aaatattttcttacaacaaa

SEQ ID NO: 458653 - DNA, 20 bp, Artificial Sequence
  chemically synthesized
aagttttttccctttgttgt

SEQ ID NO: 458654 - DNA, 20 bp, Artificial Sequence
  chemically synthesized
caaatattttcttacaacaa

SEQ ID NO: 458655 - DNA, 20 bp, Artificial Sequence
  chemically synthesized
acaaatattttcttacaaca

SEQ ID NO: 458656 - DNA, 20 bp, Artificial Sequence
  chemically synthesized
gtaagaaaatatttgtgtct

SEQ ID NO: 458657 - DNA, 20 bp, Artificial Sequence
  chemically synthesized
atatttgtgtcttagtccac

SEQ ID NO: 458658 - DNA, 20 bp, Artificial Sequence
  chemically synthesized
tataatggcgccagtggact

SEQ ID NO: 458659 - DNA, 20 bp, Artificial Sequence
  chemically synthesized
ttttgttataatggcgccag

SEQ ID NO: 458660 - DNA, 20 bp, Artificial Sequence
  chemically synthesized
atattttgttataatggcgc

SEQ ID NO: 458661 - DNA, 20 bp, Artificial Sequence
  chemically synthesized
tctcagatattttgttataa

SEQ ID NO: 458662 - DNA, 20 bp, Artificial Sequence
  chemically synthesized
gccattataacaaaatatct

SEQ ID NO: 458663 - DNA, 20 bp, Artificial Sequence
  chemically synthesized
ttataacaaaatatctgaga

SEQ ID NO: 458664 - DNA, 20 bp, Artificial Sequence
  chemically synthesized
tataacaaaatatctgagac

SEQ ID NO: 458665 - DNA, 20 bp, Artificial Sequence
  chemically synthesized
tgtttataaattacctgtct

SEQ ID NO: 458666 - DNA, 20 bp, Artificial Sequence
  chemically synthesized
gacaggtaatttataaacaa

SEQ ID NO: 458667 - DNA, 20 bp, Artificial Sequence
  chemically synthesized
caacagaaattaattgttcg

SEQ ID NO: 458668 - DNA, 20 bp, Artificial Sequence
  chemically synthesized
attaattgttcgcagttctg

SEQ ID NO: 458669 - DNA, 20 bp, Artificial Sequence
  chemically synthesized
ttaattgttcgcagttctgt

SEQ ID NO: 458670 - DNA, 20 bp, Artificial Sequence
  chemically synthesized
ttgttcgcagttctgtaggc

SEQ ID NO: 458671 - DNA, 20 bp, Artificial Sequence
  chemically synthesized
ccagacacctcaccagccta

SEQ ID NO: 458672 - DNA, 20 bp, Artificial Sequence
  chemically synthesized
tcgcagttctgtaggctggt

SEQ ID NO: 458673 - DNA, 20 bp, Artificial Sequence
  chemically synthesized
cgcagttctgtaggctggtg

SEQ ID NO: 458674 - DNA, 20 bp, Artificial Sequence
  chemically synthesized
gtcctcaccagacacctcac

SEQ ID NO: 458675 - DNA, 20 bp, Artificial Sequence
  chemically synthesized
ctgtaggctggtgaggtgtc

SEQ ID NO: 458676 - DNA, 20 bp, Artificial Sequence
  chemically synthesized
aggctggtgaggtgtctggt

SEQ ID NO: 458677 - DNA, 20 bp, Artificial Sequence
  chemically synthesized
ggctggtgaggtgtctggtg

SEQ ID NO: 458678 - DNA, 20 bp, Artificial Sequence
  chemically synthesized
agcagagactgggtcctcac

SEQ ID NO: 458679 - DNA, 20 bp, Artificial Sequence
  chemically synthesized
tgaggtgtctggtgaggacc

SEQ ID NO: 458680 - DNA, 20 bp, Artificial Sequence
  chemically synthesized
tcatcttcgaagcagagact

SEQ ID NO: 458681 - DNA, 20 bp, Artificial Sequence
  chemically synthesized
atcatcttcgaagcagagac

SEQ ID NO: 458682 - DNA, 20 bp, Artificial Sequence
  chemically synthesized
aggacccagtctctgcttcg

SEQ ID NO: 458683 - DNA, 20 bp, Artificial Sequence
  chemically synthesized
aaggcatcatcttcgaagca

SEQ ID NO: 458684 - DNA, 20 bp, Artificial Sequence
  chemically synthesized
tcaaggcatcatcttcgaag

SEQ ID NO: 458685 - DNA, 20 bp, Artificial Sequence
  chemically synthesized
cgttcaaggcatcatcttcg

SEQ ID NO: 458686 - DNA, 20 bp, Artificial Sequence
  chemically synthesized
tctggaggatgcaacgttca

SEQ ID NO: 458687 - DNA, 20 bp, Artificial Sequence
  chemically synthesized
ctctggaggatgcaacgttc

SEQ ID NO: 458688 - DNA, 20 bp, Artificial Sequence
  chemically synthesized
gccttgaacgttgcatcctc

SEQ ID NO: 458689 - DNA, 20 bp, Artificial Sequence
  chemically synthesized
cttgaacgttgcatcctcca

SEQ ID NO: 458690 - DNA, 20 bp, Artificial Sequence
  chemically synthesized
tgaacgttgcatcctccaga

SEQ ID NO: 458691 - DNA, 20 bp, Artificial Sequence
  chemically synthesized
acagcatcccttctctctgg

SEQ ID NO: 458692 - DNA, 20 bp, Artificial Sequence
  chemically synthesized
acgttgcatcctccagagag

SEQ ID NO: 458693 - DNA, 20 bp, Artificial Sequence
  chemically synthesized
cacagcatcccttctctctg

SEQ ID NO: 458694 - DNA, 20 bp, Artificial Sequence
  chemically synthesized
cgttgcatcctccagagaga

SEQ ID NO: 458695 - DNA, 20 bp, Artificial Sequence
  chemically synthesized
gttgcatcctccagagagaa

SEQ ID NO: 458696 - DNA, 20 bp, Artificial Sequence
  chemically synthesized
gacacagcatcccttctctc

SEQ ID NO: 458697 - DNA, 20 bp, Artificial Sequence
  chemically synthesized
acttccactatgggaggaca

SEQ ID NO: 458698 - DNA, 20 bp, Artificial Sequence
  chemically synthesized
agggatgctgtgtcctccca

SEQ ID NO: 458699 - DNA, 20 bp, Artificial Sequence
  chemically synthesized
gatgctgtgtcctcccatag

SEQ ID NO: 458700 - DNA, 20 bp, Artificial Sequence
  chemically synthesized
tccatcacttccactatggg

SEQ ID NO: 458701 - DNA, 20 bp, Artificial Sequence
  chemically synthesized
ttccatcacttccactatgg

SEQ ID NO: 458702 - DNA, 20 bp, Artificial Sequence
  chemically synthesized
gctgtgtcctcccatagtgg

SEQ ID NO: 458703 - DNA, 20 bp, Artificial Sequence
  chemically synthesized
ttttccatcacttccactat

SEQ ID NO: 458704 - DNA, 20 bp, Artificial Sequence
  chemically synthesized
tttttccatcacttccacta

SEQ ID NO: 458705 - DNA, 20 bp, Artificial Sequence
  chemically synthesized
tcctcccatagtggaagtga

SEQ ID NO: 458706 - DNA, 20 bp, Artificial Sequence
  chemically synthesized
tggaagtgatggaaaaatat

SEQ ID NO: 458707 - DNA, 20 bp, Artificial Sequence
  chemically synthesized
gaagtgatggaaaaatataa

SEQ ID NO: 458708 - DNA, 20 bp, Artificial Sequence
  chemically synthesized
gatggaaaaatataagagcc

SEQ ID NO: 458709 - DNA, 20 bp, Artificial Sequence
  chemically synthesized
gaaaaatataagagcctagt

SEQ ID NO: 458710 - DNA, 20 bp, Artificial Sequence
  chemically synthesized
gtgagaaccgagaactaact

SEQ ID NO: 458711 - DNA, 20 bp, Artificial Sequence
  chemically synthesized
ggtgagaaccgagaactaac

SEQ ID NO: 458712 - DNA, 20 bp, Artificial Sequence
  chemically synthesized
ataagagcctagttagttct

SEQ ID NO: 458713 - DNA, 20 bp, Artificial Sequence
  chemically synthesized
taaaaaggctggtgagaacc

SEQ ID NO: 458714 - DNA, 20 bp, Artificial Sequence
  chemically synthesized
agttagttctcggttctcac

SEQ ID NO: 458715 - DNA, 20 bp, Artificial Sequence
  chemically synthesized
gaccttataaaaaggctggt

SEQ ID NO: 458716 - DNA, 20 bp, Artificial Sequence
  chemically synthesized
taatgaccttataaaaaggc

SEQ ID NO: 458717 - DNA, 20 bp, Artificial Sequence
  chemically synthesized
gttctcaccagcctttttat

SEQ ID NO: 458718 - DNA, 20 bp, Artificial Sequence
  chemically synthesized
ttctcaccagcctttttata

SEQ ID NO: 458719 - DNA, 20 bp, Artificial Sequence
  chemically synthesized
ggattaatgaccttataaaa

SEQ ID NO: 458720 - DNA, 20 bp, Artificial Sequence
  chemically synthesized
gggattaatgaccttataaa

SEQ ID NO: 458721 - DNA, 20 bp, Artificial Sequence
  chemically synthesized
aggtcattaatcccattcat

SEQ ID NO: 458722 - DNA, 20 bp, Artificial Sequence
  chemically synthesized
ggtcattaatcccattcatt

SEQ ID NO: 458723 - DNA, 20 bp, Artificial Sequence
  chemically synthesized
agggcagagccctaatgaat

SEQ ID NO: 458724 - DNA, 20 bp, Artificial Sequence
  chemically synthesized
gtcattaatcccattcatta

SEQ ID NO: 458725 - DNA, 20 bp, Artificial Sequence
  chemically synthesized
gagggcagagccctaatgaa

SEQ ID NO: 458726 - DNA, 20 bp, Artificial Sequence
  chemically synthesized
gtgattaaatcatgagggca

SEQ ID NO: 458727 - DNA, 20 bp, Artificial Sequence
  chemically synthesized
aggtgattaaatcatgaggg

SEQ ID NO: 458728 - DNA, 20 bp, Artificial Sequence
  chemically synthesized
aggaggtgattaaatcatga

SEQ ID NO: 458729 - DNA, 20 bp, Artificial Sequence
  chemically synthesized
taggaggtgattaaatcatg

SEQ ID NO: 458730 - DNA, 20 bp, Artificial Sequence
  chemically synthesized
ttaggaggtgattaaatcat

SEQ ID NO: 458731 - DNA, 20 bp, Artificial Sequence
  chemically synthesized
aaaaggtggaggacattagg

SEQ ID NO: 458732 - DNA, 20 bp, Artificial Sequence
  chemically synthesized
taaaaggtggaggacattag

SEQ ID NO: 458733 - DNA, 20 bp, Artificial Sequence
  chemically synthesized
actaaaaggtggaggacatt

SEQ ID NO: 458734 - DNA, 20 bp, Artificial Sequence
  chemically synthesized
tactaaaaggtggaggacat

SEQ ID NO: 458735 - DNA, 20 bp, Artificial Sequence
  chemically synthesized
atgatagtactaaaaggtgg

SEQ ID NO: 458736 - DNA, 20 bp, Artificial Sequence
  chemically synthesized
tcctaatgtcctccaccttt

SEQ ID NO: 458737 - DNA, 20 bp, Artificial Sequence
  chemically synthesized
tatgatagtactaaaaggtg

SEQ ID NO: 458738 - DNA, 20 bp, Artificial Sequence
  chemically synthesized
aatatgatagtactaaaagg

SEQ ID NO: 458739 - DNA, 20 bp, Artificial Sequence
  chemically synthesized
gccaatatgatagtactaaa

SEQ ID NO: 458740 - DNA, 20 bp, Artificial Sequence
  chemically synthesized
tgccaatatgatagtactaa

SEQ ID NO: 458741 - DNA, 20 bp, Artificial Sequence
  chemically synthesized
accttttagtactatcatat

SEQ ID NO: 458742 - DNA, 20 bp, Artificial Sequence
  chemically synthesized
aaacttaattgccaatatga

SEQ ID NO: 458743 - DNA, 20 bp, Artificial Sequence
  chemically synthesized
gtactatcatattggcaatt

SEQ ID NO: 458744 - DNA, 20 bp, Artificial Sequence
  chemically synthesized
gtttcaacatatgaattatg

SEQ ID NO: 458745 - DNA, 20 bp, Artificial Sequence
  chemically synthesized
tttcaacatatgaattatgt

SEQ ID NO: 458746 - DNA, 20 bp, Artificial Sequence
  chemically synthesized
tgaattatgtaggacacatt

SEQ ID NO: 458747 - DNA, 20 bp, Artificial Sequence
  chemically synthesized
tgtaggacacattcagatca

SEQ ID NO: 458748 - DNA, 20 bp, Artificial Sequence
  chemically synthesized
aggacacattcagatcatag

SEQ ID NO: 458749 - DNA, 20 bp, Artificial Sequence
  chemically synthesized
ttcagatcatagcagtttgt

SEQ ID NO: 458750 - DNA, 20 bp, Artificial Sequence
  chemically synthesized
catgacacatttcatcatgt

SEQ ID NO: 458751 - DNA, 20 bp, Artificial Sequence
  chemically synthesized
atttcatcatgtaagatatt

SEQ ID NO: 458752 - DNA, 20 bp, Artificial Sequence
  chemically synthesized
aatactatgaaatatgtgtg

SEQ ID NO: 458753 - DNA, 20 bp, Artificial Sequence
  chemically synthesized
ttttctacacacatatttca

SEQ ID NO: 458754 - DNA, 20 bp, Artificial Sequence
  chemically synthesized
tttcatagtattaaacatat

SEQ ID NO: 458755 - DNA, 20 bp, Artificial Sequence
  chemically synthesized
gatcacattataaaaatata

SEQ ID NO: 458756 - DNA, 20 bp, Artificial Sequence
  chemically synthesized
tgttttcaagaatatttagt

SEQ ID NO: 458757 - DNA, 20 bp, Artificial Sequence
  chemically synthesized
attatgttttcaagaatatt

SEQ ID NO: 458758 - DNA, 20 bp, Artificial Sequence
  chemically synthesized
cttattaaaattatgttttc

SEQ ID NO: 458759 - DNA, 20 bp, Artificial Sequence
  chemically synthesized
cttgaaaacataattttaat

SEQ ID NO: 458760 - DNA, 20 bp, Artificial Sequence
  chemically synthesized
atctgttgcaacggaacatt

SEQ ID NO: 458761 - DNA, 20 bp, Artificial Sequence
  chemically synthesized
tgcttaatgttccgttgcaa

SEQ ID NO: 458762 - DNA, 20 bp, Artificial Sequence
  chemically synthesized
tcttggcatatctgttgcaa

SEQ ID NO: 458763 - DNA, 20 bp, Artificial Sequence
  chemically synthesized
tccgttgcaacagatatgcc

SEQ ID NO: 458764 - DNA, 20 bp, Artificial Sequence
  chemically synthesized
agggtcagataaacaaatct

SEQ ID NO: 458765 - DNA, 20 bp, Artificial Sequence
  chemically synthesized
agtagctgaaaaataagggt

SEQ ID NO: 458766 - DNA, 20 bp, Artificial Sequence
  chemically synthesized
cctaagtagctgaaaaataa

SEQ ID NO: 458767 - DNA, 20 bp, Artificial Sequence
  chemically synthesized
tttatctgacccttattttt

SEQ ID NO: 458768 - DNA, 20 bp, Artificial Sequence
  chemically synthesized
acctaagtagctgaaaaata

SEQ ID NO: 458769 - DNA, 20 bp, Artificial Sequence
  chemically synthesized
aacctaagtagctgaaaaat

SEQ ID NO: 458770 - DNA, 20 bp, Artificial Sequence
  chemically synthesized
acccttatttttcagctact

SEQ ID NO: 458771 - DNA, 20 bp, Artificial Sequence
  chemically synthesized
cccttatttttcagctactt

SEQ ID NO: 458772 - DNA, 20 bp, Artificial Sequence
  chemically synthesized
gaaatgaccagcaacctaag

SEQ ID NO: 458773 - DNA, 20 bp, Artificial Sequence
  chemically synthesized
ttttcagctacttaggttgc

SEQ ID NO: 458774 - DNA, 20 bp, Artificial Sequence
  chemically synthesized
gtggaaatgaccagcaacct

SEQ ID NO: 458775 - DNA, 20 bp, Artificial Sequence
  chemically synthesized
ttaagaaaagtggaaatgac

SEQ ID NO: 458776 - DNA, 20 bp, Artificial Sequence
  chemically synthesized
tatgttacttttaagaaaag

SEQ ID NO: 458777 - DNA, 20 bp, Artificial Sequence
  chemically synthesized
gtcatttccacttttcttaa

SEQ ID NO: 458778 - DNA, 20 bp, Artificial Sequence
  chemically synthesized
tgctatgttacttttaagaa

SEQ ID NO: 458779 - DNA, 20 bp, Artificial Sequence
  chemically synthesized
ttctttgctatgttactttt

SEQ ID NO: 458780 - DNA, 20 bp, Artificial Sequence
  chemically synthesized
cacttttcttaaaagtaaca

SEQ ID NO: 458781 - DNA, 20 bp, Artificial Sequence
  chemically synthesized
ttcttaaaagtaacatagca

SEQ ID NO: 458782 - DNA, 20 bp, Artificial Sequence
  chemically synthesized
atgattaaatagtatggaca

SEQ ID NO: 458783 - DNA, 20 bp, Artificial Sequence
  chemically synthesized
catgattaaatagtatggac

SEQ ID NO: 458784 - DNA, 20 bp, Artificial Sequence
  chemically synthesized
aaagacatgattaaatagta

SEQ ID NO: 458785 - DNA, 20 bp, Artificial Sequence
  chemically synthesized
tccctaaagacatgattaaa

SEQ ID NO: 458786 - DNA, 20 bp, Artificial Sequence
  chemically synthesized
atactatttaatcatgtctt

SEQ ID NO: 458787 - DNA, 20 bp, Artificial Sequence
  chemically synthesized
tactatttaatcatgtcttt

SEQ ID NO: 458788 - DNA, 20 bp, Artificial Sequence
  chemically synthesized
actatttaatcatgtcttta

SEQ ID NO: 458789 - DNA, 20 bp, Artificial Sequence
  chemically synthesized
atttaatcatgtctttaggg

SEQ ID NO: 458790 - DNA, 20 bp, Artificial Sequence
  chemically synthesized
ttaatcatgtctttagggaa

SEQ ID NO: 458791 - DNA, 20 bp, Artificial Sequence
  chemically synthesized
tcttctgagactcttcccta

SEQ ID NO: 458792 - DNA, 20 bp, Artificial Sequence
  chemically synthesized
atgtctttagggaagagtct

SEQ ID NO: 458793 - DNA, 20 bp, Artificial Sequence
  chemically synthesized
tctttagggaagagtctcag

SEQ ID NO: 458794 - DNA, 20 bp, Artificial Sequence
  chemically synthesized
gacccagcaatttgtcttct

SEQ ID NO: 458795 - DNA, 20 bp, Artificial Sequence
  chemically synthesized
agtctcagaagacaaattgc

SEQ ID NO: 458796 - DNA, 20 bp, Artificial Sequence
  chemically synthesized
gtctcagaagacaaattgct

SEQ ID NO: 458797 - DNA, 20 bp, Artificial Sequence
  chemically synthesized
gaagacaaattgctgggtca

SEQ ID NO: 458798 - DNA, 20 bp, Artificial Sequence
  chemically synthesized
aagacaaattgctgggtcat

SEQ ID NO: 458799 - DNA, 20 bp, Artificial Sequence
  chemically synthesized
agacaaattgctgggtcata

SEQ ID NO: 458800 - DNA, 20 bp, Artificial Sequence
  chemically synthesized
gtgtatttgaccctatgacc

SEQ ID NO: 458801 - DNA, 20 bp, Artificial Sequence
  chemically synthesized
attttggcaatatgcataaa

SEQ ID NO: 458802 - DNA, 20 bp, Artificial Sequence
  chemically synthesized
gcattttggcaatatgcata

SEQ ID NO: 458803 - DNA, 20 bp, Artificial Sequence
  chemically synthesized
aatggtttttgaaagcattt

SEQ ID NO: 458804 - DNA, 20 bp, Artificial Sequence
  chemically synthesized
atcagtctaatggtttttga

SEQ ID NO: 458805 - DNA, 20 bp, Artificial Sequence
  chemically synthesized
aaaatgctttcaaaaaccat

SEQ ID NO: 458806 - DNA, 20 bp, Artificial Sequence
  chemically synthesized
gaggttataaatcagtctaa

SEQ ID NO: 458807 - DNA, 20 bp, Artificial Sequence
  chemically synthesized
ttgttggtgaggttataaat

SEQ ID NO: 458808 - DNA, 20 bp, Artificial Sequence
  chemically synthesized
tgatttataacctcaccaac

SEQ ID NO: 458809 - DNA, 20 bp, Artificial Sequence
  chemically synthesized
catgccctttcttgttggtg

SEQ ID NO: 458810 - DNA, 20 bp, Artificial Sequence
  chemically synthesized
gcatgccctttcttgttggt

SEQ ID NO: 458811 - DNA, 20 bp, Artificial Sequence
  chemically synthesized
ttataacctcaccaacaaga

SEQ ID NO: 458812 - DNA, 20 bp, Artificial Sequence
  chemically synthesized
tataacctcaccaacaagaa

SEQ ID NO: 458813 - DNA, 20 bp, Artificial Sequence
  chemically synthesized
gtgggcatgccctttcttgt

SEQ ID NO: 458814 - DNA, 20 bp, Artificial Sequence
  chemically synthesized
ataacctcaccaacaagaaa

SEQ ID NO: 458815 - DNA, 20 bp, Artificial Sequence
  chemically synthesized
agtagaagagtcagtgaagt

SEQ ID NO: 458816 - DNA, 20 bp, Artificial Sequence
  chemically synthesized
cagtagaagagtcagtgaag

SEQ ID NO: 458817 - DNA, 20 bp, Artificial Sequence
  chemically synthesized
atacagtagaagagtcagtg

SEQ ID NO: 458818 - DNA, 20 bp, Artificial Sequence
  chemically synthesized
ggtgaatacagtagaagagt

SEQ ID NO: 458819 - DNA, 20 bp, Artificial Sequence
  chemically synthesized
aaatggtgaatacagtagaa

SEQ ID NO: 458820 - DNA, 20 bp, Artificial Sequence
  chemically synthesized
agaaatggtgaatacagtag

SEQ ID NO: 458821 - DNA, 20 bp, Artificial Sequence
  chemically synthesized
cctagaaatggtgaatacag

SEQ ID NO: 458822 - DNA, 20 bp, Artificial Sequence
  chemically synthesized
caacctagaaatggtgaata

SEQ ID NO: 458823 - DNA, 20 bp, Artificial Sequence
  chemically synthesized
tctactgtattcaccatttc

SEQ ID NO: 458824 - DNA, 20 bp, Artificial Sequence
  chemically synthesized
ctactgtattcaccatttct

SEQ ID NO: 458825 - DNA, 20 bp, Artificial Sequence
  chemically synthesized
tttacctatcaacctagaaa

SEQ ID NO: 458826 - DNA, 20 bp, Artificial Sequence
  chemically synthesized
attcaccatttctaggttga

SEQ ID NO: 458827 - DNA, 20 bp, Artificial Sequence
  chemically synthesized
ttcaccatttctaggttgat

SEQ ID NO: 458828 - DNA, 20 bp, Artificial Sequence
  chemically synthesized
gtaaattttacctatcaacc

SEQ ID NO: 458829 - DNA, 20 bp, Artificial Sequence
  chemically synthesized
aaaattaaaaactactgatt

SEQ ID NO: 458830 - DNA, 20 bp, Artificial Sequence
  chemically synthesized
tagtagaataactaaatcag

SEQ ID NO: 458831 - DNA, 20 bp, Artificial Sequence
  chemically synthesized
aattagtagaataactaaat

SEQ ID NO: 458832 - DNA, 20 bp, Artificial Sequence
  chemically synthesized
agatatgctcacggaattag

SEQ ID NO: 458833 - DNA, 20 bp, Artificial Sequence
  chemically synthesized
agttattctactaattccgt

SEQ ID NO: 458834 - DNA, 20 bp, Artificial Sequence
  chemically synthesized
tgaagatatgctcacggaat

SEQ ID NO: 458835 - DNA, 20 bp, Artificial Sequence
  chemically synthesized
gaaatatgaagatatgctca

SEQ ID NO: 458836 - DNA, 20 bp, Artificial Sequence
  chemically synthesized
ataaatgcccaagaaatatg

SEQ ID NO: 458837 - DNA, 20 bp, Artificial Sequence
  chemically synthesized
gagcatatcttcatatttct

SEQ ID NO: 458838 - DNA, 20 bp, Artificial Sequence
  chemically synthesized
agcatatcttcatatttctt

SEQ ID NO: 458839 - DNA, 20 bp, Artificial Sequence
  chemically synthesized
caaaagaaatataaatgccc

SEQ ID NO: 458840 - DNA, 20 bp, Artificial Sequence
  chemically synthesized
gggcatttatatttcttttg

SEQ ID NO: 458841 - DNA, 20 bp, Artificial Sequence
  chemically synthesized
atttatatttcttttgcggt

SEQ ID NO: 458842 - DNA, 20 bp, Artificial Sequence
  chemically synthesized
gaacaaatagcttaccgcaa

SEQ ID NO: 458843 - DNA, 20 bp, Artificial Sequence
  chemically synthesized
gaaagagtaaagagaacaaa

SEQ ID NO: 458844 - DNA, 20 bp, Artificial Sequence
  chemically synthesized
agaaaaatggaaagagtaaa

SEQ ID NO: 458845 - DNA, 20 bp, Artificial Sequence
  chemically synthesized
atagaaaaatggaaagagta

SEQ ID NO: 458846 - DNA, 20 bp, Artificial Sequence
  chemically synthesized
ccactatagaaaaatggaaa

SEQ ID NO: 458847 - DNA, 20 bp, Artificial Sequence
  chemically synthesized
taccactatagaaaaatgga

SEQ ID NO: 458848 - DNA, 20 bp, Artificial Sequence
  chemically synthesized
ctaataccactatagaaaaa

SEQ ID NO: 458849 - DNA, 20 bp, Artificial Sequence
  chemically synthesized
ttactctttccatttttcta

SEQ ID NO: 458850 - DNA, 20 bp, Artificial Sequence
  chemically synthesized
ctctttccatttttctatag

SEQ ID NO: 458851 - DNA, 20 bp, Artificial Sequence
  chemically synthesized
caacactactaataccacta

SEQ ID NO: 458852 - DNA, 20 bp, Artificial Sequence
  chemically synthesized
ccatttttctatagtggtat

SEQ ID NO: 458853 - DNA, 20 bp, Artificial Sequence
  chemically synthesized
tttttctatagtggtattag

SEQ ID NO: 458854 - DNA, 20 bp, Artificial Sequence
  chemically synthesized
gtagtgttgcacatttttta

SEQ ID NO: 458855 - DNA, 20 bp, Artificial Sequence
  chemically synthesized
aatactactctagaaaaatt

SEQ ID NO: 458856 - DNA, 20 bp, Artificial Sequence
  chemically synthesized
tttaaagaacttaatttttc

SEQ ID NO: 458857 - DNA, 20 bp, Artificial Sequence
  chemically synthesized
taaagaacttaatttttcta

SEQ ID NO: 458858 - DNA, 20 bp, Artificial Sequence
  chemically synthesized
agaacttaatttttctagag

SEQ ID NO: 458859 - DNA, 20 bp, Artificial Sequence
  chemically synthesized
ctgtgacgctaatactactc

SEQ ID NO: 458860 - DNA, 20 bp, Artificial Sequence
  chemically synthesized
taatttttctagagtagtat

SEQ ID NO: 458861 - DNA, 20 bp, Artificial Sequence
  chemically synthesized
ctagagtagtattagcgtca

SEQ ID NO: 458862 - DNA, 20 bp, Artificial Sequence
  chemically synthesized
attagcgtcacagcaaaatt

SEQ ID NO: 458863 - DNA, 20 bp, Artificial Sequence
  chemically synthesized
tagcgtcacagcaaaattga

SEQ ID NO: 458864 - DNA, 20 bp, Artificial Sequence
  chemically synthesized
agcgtcacagcaaaattgag

SEQ ID NO: 458865 - DNA, 20 bp, Artificial Sequence
  chemically synthesized
gtcacagcaaaattgagagg

SEQ ID NO: 458866 - DNA, 20 bp, Artificial Sequence
  chemically synthesized
tcacagcaaaattgagagga

SEQ ID NO: 458867 - DNA, 20 bp, Artificial Sequence
  chemically synthesized
gcaaaattgagaggaaggta

SEQ ID NO: 458868 - DNA, 20 bp, Artificial Sequence
  chemically synthesized
aaaattgagaggaaggtaca

SEQ ID NO: 458869 - DNA, 20 bp, Artificial Sequence
  chemically synthesized
tgtggaggcaggggatatat

SEQ ID NO: 458870 - DNA, 20 bp, Artificial Sequence
  chemically synthesized
ctgtacgtgtgtggaggcag

SEQ ID NO: 458871 - DNA, 20 bp, Artificial Sequence
  chemically synthesized
gctgtacgtgtgtggaggca

SEQ ID NO: 458872 - DNA, 20 bp, Artificial Sequence
  chemically synthesized
ggctgtacgtgtgtggaggc

SEQ ID NO: 458873 - DNA, 20 bp, Artificial Sequence
  chemically synthesized
tggctgtacgtgtgtggagg

SEQ ID NO: 458874 - DNA, 20 bp, Artificial Sequence
  chemically synthesized
gggtggctgtacgtgtgtgg

SEQ ID NO: 458875 - DNA, 20 bp, Artificial Sequence
  chemically synthesized
tgggtggctgtacgtgtgtg

SEQ ID NO: 458876 - DNA, 20 bp, Artificial Sequence
  chemically synthesized
cgtgggtggctgtacgtgtg

SEQ ID NO: 458877 - DNA, 20 bp, Artificial Sequence
  chemically synthesized
cccctgcctccacacacgta

SEQ ID NO: 458878 - DNA, 20 bp, Artificial Sequence
  chemically synthesized
ggagatgtagatagcgtggg

SEQ ID NO: 458879 - DNA, 20 bp, Artificial Sequence
  chemically synthesized
gtgggagatgtagatagcgt

SEQ ID NO: 458880 - DNA, 20 bp, Artificial Sequence
  chemically synthesized
ggtgggagatgtagatagcg

SEQ ID NO: 458881 - DNA, 20 bp, Artificial Sequence
  chemically synthesized
cgtctggtgggagatgtaga

SEQ ID NO: 458882 - DNA, 20 bp, Artificial Sequence
  chemically synthesized
tacccgtctggtgggagatg

SEQ ID NO: 458883 - DNA, 20 bp, Artificial Sequence
  chemically synthesized
acgctatctacatctcccac

SEQ ID NO: 458884 - DNA, 20 bp, Artificial Sequence
  chemically synthesized
caaatgtacccgtctggtgg

SEQ ID NO: 458885 - DNA, 20 bp, Artificial Sequence
  chemically synthesized
tatctacatctcccaccaga

SEQ ID NO: 458886 - DNA, 20 bp, Artificial Sequence
  chemically synthesized
atctacatctcccaccagac

SEQ ID NO: 458887 - DNA, 20 bp, Artificial Sequence
  chemically synthesized
aacaaatgtacccgtctggt

SEQ ID NO: 458888 - DNA, 20 bp, Artificial Sequence
  chemically synthesized
taacaaatgtacccgtctgg

SEQ ID NO: 458889 - DNA, 20 bp, Artificial Sequence
  chemically synthesized
ttgtaacaaatgtacccgtc

SEQ ID NO: 458890 - DNA, 20 bp, Artificial Sequence
  chemically synthesized
tgataatgatttgtcaatat

SEQ ID NO: 458891 - DNA, 20 bp, Artificial Sequence
  chemically synthesized
gtgataatgatttgtcaata

SEQ ID NO: 458892 - DNA, 20 bp, Artificial Sequence
  chemically synthesized
tactcttaactatggaattt

SEQ ID NO: 458893 - DNA, 20 bp, Artificial Sequence
  chemically synthesized
tcattatcaccaaaattcca

SEQ ID NO: 458894 - DNA, 20 bp, Artificial Sequence
  chemically synthesized
atcaccaaaattccatagtt

SEQ ID NO: 458895 - DNA, 20 bp, Artificial Sequence
  chemically synthesized
caccaaaattccatagttaa

SEQ ID NO: 458896 - DNA, 20 bp, Artificial Sequence
  chemically synthesized
tgaacctttactcttaacta

SEQ ID NO: 458897 - DNA, 20 bp, Artificial Sequence
  chemically synthesized
aaattccatagttaagagta

SEQ ID NO: 458898 - DNA, 20 bp, Artificial Sequence
  chemically synthesized
aattccatagttaagagtaa

SEQ ID NO: 458899 - DNA, 20 bp, Artificial Sequence
  chemically synthesized
taagagtaaaggttcattct

SEQ ID NO: 458900 - DNA, 20 bp, Artificial Sequence
  chemically synthesized
aagagtaaaggttcattctt

SEQ ID NO: 458901 - DNA, 20 bp, Artificial Sequence
  chemically synthesized
ccatagaatgcacaacaccc

SEQ ID NO: 458902 - DNA, 20 bp, Artificial Sequence
  chemically synthesized
cttgggtgttgtgcattcta

SEQ ID NO: 458903 - DNA, 20 bp, Artificial Sequence
  chemically synthesized
tgttgtgcattctatggatt

SEQ ID NO: 458904 - DNA, 20 bp, Artificial Sequence
  chemically synthesized
tatatatttgtccaaatcca

SEQ ID NO: 458905 - DNA, 20 bp, Artificial Sequence
  chemically synthesized
atgaaatgtattcacaatta

SEQ ID NO: 458906 - DNA, 20 bp, Artificial Sequence
  chemically synthesized
tcacaattatagcatcatta

SEQ ID NO: 458907 - DNA, 20 bp, Artificial Sequence
  chemically synthesized
acaattatagcatcattaca

SEQ ID NO: 458908 - DNA, 20 bp, Artificial Sequence
  chemically synthesized
tccagaggaattttaggaca

SEQ ID NO: 458909 - DNA, 20 bp, Artificial Sequence
  chemically synthesized
gtccagaggaattttaggac

SEQ ID NO: 458910 - DNA, 20 bp, Artificial Sequence
  chemically synthesized
agtccagaggaattttagga

SEQ ID NO: 458911 - DNA, 20 bp, Artificial Sequence
  chemically synthesized
gtagagtccagaggaatttt

SEQ ID NO: 458912 - DNA, 20 bp, Artificial Sequence
  chemically synthesized
cgtagagtccagaggaattt

SEQ ID NO: 458913 - DNA, 20 bp, Artificial Sequence
  chemically synthesized
tccctgtcctaaaattcctc

SEQ ID NO: 458914 - DNA, 20 bp, Artificial Sequence
  chemically synthesized
tatgaatacgtagagtccag

SEQ ID NO: 458915 - DNA, 20 bp, Artificial Sequence
  chemically synthesized
gtatgaatacgtagagtcca

SEQ ID NO: 458916 - DNA, 20 bp, Artificial Sequence
  chemically synthesized
atgtatgaatacgtagagtc

SEQ ID NO: 458917 - DNA, 20 bp, Artificial Sequence
  chemically synthesized
gggaaatgtatgaatacgta

SEQ ID NO: 458918 - DNA, 20 bp, Artificial Sequence
  chemically synthesized
gagggaaatgtatgaatacg

SEQ ID NO: 458919 - DNA, 20 bp, Artificial Sequence
  chemically synthesized
gtattcatacatttccctca

SEQ ID NO: 458920 - DNA, 20 bp, Artificial Sequence
  chemically synthesized
gtgttttccaggggctgtga

SEQ ID NO: 458921 - DNA, 20 bp, Artificial Sequence
  chemically synthesized
agtgttttccaggggctgtg

SEQ ID NO: 458922 - DNA, 20 bp, Artificial Sequence
  chemically synthesized
cagtgttttccaggggctgt

SEQ ID NO: 458923 - DNA, 20 bp, Artificial Sequence
  chemically synthesized
tacatttccctcacagcccc

SEQ ID NO: 458924 - DNA, 20 bp, Artificial Sequence
  chemically synthesized
aaaagatcagtgttttccag

SEQ ID NO: 458925 - DNA, 20 bp, Artificial Sequence
  chemically synthesized
taaaagatcagtgttttcca

SEQ ID NO: 458926 - DNA, 20 bp, Artificial Sequence
  chemically synthesized
ttaaaagatcagtgttttcc

SEQ ID NO: 458927 - DNA, 20 bp, Artificial Sequence
  chemically synthesized
gttaaaagatcagtgttttc

SEQ ID NO: 458928 - DNA, 20 bp, Artificial Sequence
  chemically synthesized
tatgtagacagttaaaagat

SEQ ID NO: 458929 - DNA, 20 bp, Artificial Sequence
  chemically synthesized
aaaactatgtagacagttaa

SEQ ID NO: 458930 - DNA, 20 bp, Artificial Sequence
  chemically synthesized
tgatcttttaactgtctaca

SEQ ID NO: 458931 - DNA, 20 bp, Artificial Sequence
  chemically synthesized
gaaagcaaaaactatgtaga

SEQ ID NO: 458932 - DNA, 20 bp, Artificial Sequence
  chemically synthesized
ctgggaaagcaaaaactatg

SEQ ID NO: 458933 - DNA, 20 bp, Artificial Sequence
  chemically synthesized
ctacatagtttttgctttcc

SEQ ID NO: 458934 - DNA, 20 bp, Artificial Sequence
  chemically synthesized
aacaatacgacattctggga

SEQ ID NO: 458935 - DNA, 20 bp, Artificial Sequence
  chemically synthesized
tttcaacaatacgacattct

SEQ ID NO: 458936 - DNA, 20 bp, Artificial Sequence
  chemically synthesized
atttcaacaatacgacattc

SEQ ID NO: 458937 - DNA, 20 bp, Artificial Sequence
  chemically synthesized
gtcgtattgttgaaatcata

SEQ ID NO: 458938 - DNA, 20 bp, Artificial Sequence
  chemically synthesized
tgttgaaatcatatagtatg

SEQ ID NO: 458939 - DNA, 20 bp, Artificial Sequence
  chemically synthesized
atatagtatgtagatttttt

SEQ ID NO: 458940 - DNA, 20 bp, Artificial Sequence
  chemically synthesized
tttcagatttgcttgttcac

SEQ ID NO: 458941 - DNA, 20 bp, Artificial Sequence
  chemically synthesized
catagaggaaaccagtgaac

SEQ ID NO: 458942 - DNA, 20 bp, Artificial Sequence
  chemically synthesized
gaaaaacacatagaggaaac

SEQ ID NO: 458943 - DNA, 20 bp, Artificial Sequence
  chemically synthesized
gagccatgaaaaacacatag

SEQ ID NO: 458944 - DNA, 20 bp, Artificial Sequence
  chemically synthesized
tgagccatgaaaaacacata

SEQ ID NO: 458945 - DNA, 20 bp, Artificial Sequence
  chemically synthesized
actgagccatgaaaaacaca

SEQ ID NO: 458946 - DNA, 20 bp, Artificial Sequence
  chemically synthesized
tttcctctatgtgtttttca

SEQ ID NO: 458947 - DNA, 20 bp, Artificial Sequence
  chemically synthesized
tctatgtgtttttcatggct

SEQ ID NO: 458948 - DNA, 20 bp, Artificial Sequence
  chemically synthesized
atgtgtttttcatggctcag

SEQ ID NO: 458949 - DNA, 20 bp, Artificial Sequence
  chemically synthesized
ctaaaaagaaatgagctact

SEQ ID NO: 458950 - DNA, 20 bp, Artificial Sequence
  chemically synthesized
attcattgctaaaaagaaat

SEQ ID NO: 458951 - DNA, 20 bp, Artificial Sequence
  chemically synthesized
ctcagtagctcatttctttt

SEQ ID NO: 458952 - DNA, 20 bp, Artificial Sequence
  chemically synthesized
agatgttattcattgctaaa

SEQ ID NO: 458953 - DNA, 20 bp, Artificial Sequence
  chemically synthesized
atgtagaacattcagacaat

SEQ ID NO: 458954 - DNA, 20 bp, Artificial Sequence
  chemically synthesized
taaataagatgtagaacatt

SEQ ID NO: 458955 - DNA, 20 bp, Artificial Sequence
  chemically synthesized
gtgaatggataaataagatg

SEQ ID NO: 458956 - DNA, 20 bp, Artificial Sequence
  chemically synthesized
cagtaggtgaatggataaat

SEQ ID NO: 458957 - DNA, 20 bp, Artificial Sequence
  chemically synthesized
gatgtccttcagtaggtgaa

SEQ ID NO: 458958 - DNA, 20 bp, Artificial Sequence
  chemically synthesized
atttatccattcacctactg

SEQ ID NO: 458959 - DNA, 20 bp, Artificial Sequence
  chemically synthesized
tttatccattcacctactga

SEQ ID NO: 458960 - DNA, 20 bp, Artificial Sequence
  chemically synthesized
caaccaagatgtccttcagt

SEQ ID NO: 458961 - DNA, 20 bp, Artificial Sequence
  chemically synthesized
gcaaccaagatgtccttcag

SEQ ID NO: 458962 - DNA, 20 bp, Artificial Sequence
  chemically synthesized
gaagcaaccaagatgtcctt

SEQ ID NO: 458963 - DNA, 20 bp, Artificial Sequence
  chemically synthesized
tcacctactgaaggacatct

SEQ ID NO: 458964 - DNA, 20 bp, Artificial Sequence
  chemically synthesized
gccaaaatttggaagcaacc

SEQ ID NO: 458965 - DNA, 20 bp, Artificial Sequence
  chemically synthesized
tcatcattgccaaaatttgg

SEQ ID NO: 458966 - DNA, 20 bp, Artificial Sequence
  chemically synthesized
tcttggttgcttccaaattt

SEQ ID NO: 458967 - DNA, 20 bp, Artificial Sequence
  chemically synthesized
tattcatcattgccaaaatt

SEQ ID NO: 458968 - DNA, 20 bp, Artificial Sequence
  chemically synthesized
aattttggcaatgatgaata

SEQ ID NO: 458969 - DNA, 20 bp, Artificial Sequence
  chemically synthesized
ctgcacatggatgtttatga

SEQ ID NO: 458970 - DNA, 20 bp, Artificial Sequence
  chemically synthesized
ctgtcataaacatccatgtg

SEQ ID NO: 458971 - DNA, 20 bp, Artificial Sequence
  chemically synthesized
tgtcataaacatccatgtgc

SEQ ID NO: 458972 - DNA, 20 bp, Artificial Sequence
  chemically synthesized
gtcataaacatccatgtgca

SEQ ID NO: 458973 - DNA, 20 bp, Artificial Sequence
  chemically synthesized
tccacacaaaaccctgcaca

SEQ ID NO: 458974 - DNA, 20 bp, Artificial Sequence
  chemically synthesized
tccatgtgcagggttttgtg

SEQ ID NO: 458975 - DNA, 20 bp, Artificial Sequence
  chemically synthesized
gacataattttcaactcctt

SEQ ID NO: 458976 - DNA, 20 bp, Artificial Sequence
  chemically synthesized
taaaatgtaaaataccaaag

SEQ ID NO: 458977 - DNA, 20 bp, Artificial Sequence
  chemically synthesized
tttaaaatgtaaaataccaa

SEQ ID NO: 458978 - DNA, 20 bp, Artificial Sequence
  chemically synthesized
ttttaaaatgtaaaatacca

SEQ ID NO: 458979 - DNA, 20 bp, Artificial Sequence
  chemically synthesized
attttacattttaaaatttt

SEQ ID NO: 458980 - DNA, 20 bp, Artificial Sequence
  chemically synthesized
ttttaaaattttaagttatg

SEQ ID NO: 458981 - DNA, 20 bp, Artificial Sequence
  chemically synthesized
agttatgtggtatatataac

SEQ ID NO: 458982 - DNA, 20 bp, Artificial Sequence
  chemically synthesized
tatatataacaagccaaaat

SEQ ID NO: 458983 - DNA, 20 bp, Artificial Sequence
  chemically synthesized
aactgaaactaagcttattt

SEQ ID NO: 458984 - DNA, 20 bp, Artificial Sequence
  chemically synthesized
ataacaagccaaaataagct

SEQ ID NO: 458985 - DNA, 20 bp, Artificial Sequence
  chemically synthesized
agccaaaataagcttagttt

SEQ ID NO: 458986 - DNA, 20 bp, Artificial Sequence
  chemically synthesized
cataattcttaactgaaact

SEQ ID NO: 458987 - DNA, 20 bp, Artificial Sequence
  chemically synthesized
aaataagcttagtttcagtt

SEQ ID NO: 458988 - DNA, 20 bp, Artificial Sequence
  chemically synthesized
ttagtttcagttaagaatta

SEQ ID NO: 458989 - DNA, 20 bp, Artificial Sequence
  chemically synthesized
ttatggttttaaaatcttct

SEQ ID NO: 458990 - DNA, 20 bp, Artificial Sequence
  chemically synthesized
ttttatcattttaatcttag

SEQ ID NO: 458991 - DNA, 20 bp, Artificial Sequence
  chemically synthesized
ttattttatcattttaatct

SEQ ID NO: 458992 - DNA, 20 bp, Artificial Sequence
  chemically synthesized
aagattaaaatgataaaata

SEQ ID NO: 458993 - DNA, 20 bp, Artificial Sequence
  chemically synthesized
ttcggtggaaagaagaatgt

SEQ ID NO: 458994 - DNA, 20 bp, Artificial Sequence
  chemically synthesized
taagtctcttcggtggaaag

SEQ ID NO: 458995 - DNA, 20 bp, Artificial Sequence
  chemically synthesized
caacattcttctttccaccg

SEQ ID NO: 458996 - DNA, 20 bp, Artificial Sequence
  chemically synthesized
atgtaagtctcttcggtgga

SEQ ID NO: 458997 - DNA, 20 bp, Artificial Sequence
  chemically synthesized
acattcttctttccaccgaa

SEQ ID NO: 458998 - DNA, 20 bp, Artificial Sequence
  chemically synthesized
ttatatgtaagtctcttcgg

SEQ ID NO: 458999 - DNA, 20 bp, Artificial Sequence
  chemically synthesized
gtattatatgtaagtctctt

SEQ ID NO: 459000 - DNA, 20 bp, Artificial Sequence
  chemically synthesized
tctgaatttgtattatatgt

SEQ ID NO: 459001 - DNA, 20 bp, Artificial Sequence
  chemically synthesized
acttacatataatacaaatt

SEQ ID NO: 459002 - DNA, 20 bp, Artificial Sequence
  chemically synthesized
tacatataatacaaattcag

SEQ ID NO: 459003 - DNA, 20 bp, Artificial Sequence
  chemically synthesized
ttcagaagttttatgtctcc

SEQ ID NO: 459004 - DNA, 20 bp, Artificial Sequence
  chemically synthesized
ccaggatttgtgtaatctag

SEQ ID NO: 459005 - DNA, 20 bp, Artificial Sequence
  chemically synthesized
acccaggatttgtgtaatct

SEQ ID NO: 459006 - DNA, 20 bp, Artificial Sequence
  chemically synthesized
tacccaggatttgtgtaatc

SEQ ID NO: 459007 - DNA, 20 bp, Artificial Sequence
  chemically synthesized
ctcctagattacacaaatcc

SEQ ID NO: 459008 - DNA, 20 bp, Artificial Sequence
  chemically synthesized
tcctagattacacaaatcct

SEQ ID NO: 459009 - DNA, 20 bp, Artificial Sequence
  chemically synthesized
attacacaaatcctgggtaa

SEQ ID NO: 459010 - DNA, 20 bp, Artificial Sequence
  chemically synthesized
ttacacaaatcctgggtaat

SEQ ID NO: 459011 - DNA, 20 bp, Artificial Sequence
  chemically synthesized
atcccatattcctattaccc

SEQ ID NO: 459012 - DNA, 20 bp, Artificial Sequence
  chemically synthesized
catcccatattcctattacc

SEQ ID NO: 459013 - DNA, 20 bp, Artificial Sequence
  chemically synthesized
aatcctgggtaataggaata

SEQ ID NO: 459014 - DNA, 20 bp, Artificial Sequence
  chemically synthesized
atcctgggtaataggaatat

SEQ ID NO: 459015 - DNA, 20 bp, Artificial Sequence
  chemically synthesized
tgggtaataggaatatggga

SEQ ID NO: 459016 - DNA, 20 bp, Artificial Sequence
  chemically synthesized
gggtaataggaatatgggat

SEQ ID NO: 459017 - DNA, 20 bp, Artificial Sequence
  chemically synthesized
taataggaatatgggatggg

SEQ ID NO: 459018 - DNA, 20 bp, Artificial Sequence
  chemically synthesized
gggatgggaagaattacaaa

SEQ ID NO: 459019 - DNA, 20 bp, Artificial Sequence
  chemically synthesized
agaattacaaatggattatg

SEQ ID NO: 459020 - DNA, 20 bp, Artificial Sequence
  chemically synthesized
tatgtagatacttactgata

SEQ ID NO: 459021 - DNA, 20 bp, Artificial Sequence
  chemically synthesized
cacagacaaaccatatcagt

SEQ ID NO: 459022 - DNA, 20 bp, Artificial Sequence
  chemically synthesized
gggacacagacaaaccatat

SEQ ID NO: 459023 - DNA, 20 bp, Artificial Sequence
  chemically synthesized
atgaaatttgggtggggaca

SEQ ID NO: 459024 - DNA, 20 bp, Artificial Sequence
  chemically synthesized
tacaagatgaaatttgggtg

SEQ ID NO: 459025 - DNA, 20 bp, Artificial Sequence
  chemically synthesized
ctacaagatgaaatttgggt

SEQ ID NO: 459026 - DNA, 20 bp, Artificial Sequence
  chemically synthesized
actacaagatgaaatttggg

SEQ ID NO: 459027 - DNA, 20 bp, Artificial Sequence
  chemically synthesized
ggaactacaagatgaaattt

SEQ ID NO: 459028 - DNA, 20 bp, Artificial Sequence
  chemically synthesized
gggaactacaagatgaaatt

SEQ ID NO: 459029 - DNA, 20 bp, Artificial Sequence
  chemically synthesized
cccacccaaatttcatcttg

SEQ ID NO: 459030 - DNA, 20 bp, Artificial Sequence
  chemically synthesized
agggggattatgggaactac

SEQ ID NO: 459031 - DNA, 20 bp, Artificial Sequence
  chemically synthesized
ccaccacacagggggattat

SEQ ID NO: 459032 - DNA, 20 bp, Artificial Sequence
  chemically synthesized
cccaccacacagggggatta

SEQ ID NO: 459033 - DNA, 20 bp, Artificial Sequence
  chemically synthesized
gttcccataatccccctgtg

SEQ ID NO: 459034 - DNA, 20 bp, Artificial Sequence
  chemically synthesized
ggtctctcccaccacacagg

SEQ ID NO: 459035 - DNA, 20 bp, Artificial Sequence
  chemically synthesized
gggtctctcccaccacacag

SEQ ID NO: 459036 - DNA, 20 bp, Artificial Sequence
  chemically synthesized
cccataatccccctgtgtgg

SEQ ID NO: 459037 - DNA, 20 bp, Artificial Sequence
  chemically synthesized
tgggtctctcccaccacaca

SEQ ID NO: 459038 - DNA, 20 bp, Artificial Sequence
  chemically synthesized
ccataatccccctgtgtggt

SEQ ID NO: 459039 - DNA, 20 bp, Artificial Sequence
  chemically synthesized
ctgggtctctcccaccacac

SEQ ID NO: 459040 - DNA, 20 bp, Artificial Sequence
  chemically synthesized
actgggtctctcccaccaca

SEQ ID NO: 459041 - DNA, 20 bp, Artificial Sequence
  chemically synthesized
ataatccccctgtgtggtgg

SEQ ID NO: 459042 - DNA, 20 bp, Artificial Sequence
  chemically synthesized
aatccccctgtgtggtggga

SEQ ID NO: 459043 - DNA, 20 bp, Artificial Sequence
  chemically synthesized
cctgtgtggtgggagagacc

SEQ ID NO: 459044 - DNA, 20 bp, Artificial Sequence
  chemically synthesized
gtgtggtgggagagacccag

SEQ ID NO: 459045 - DNA, 20 bp, Artificial Sequence
  chemically synthesized
tgtggtgggagagacccagt

SEQ ID NO: 459046 - DNA, 20 bp, Artificial Sequence
  chemically synthesized
tggtgggagagacccagtgg

SEQ ID NO: 459047 - DNA, 20 bp, Artificial Sequence
  chemically synthesized
tgattcagttatctcccact

SEQ ID NO: 459048 - DNA, 20 bp, Artificial Sequence
  chemically synthesized
atgattcagttatctcccac

SEQ ID NO: 459049 - DNA, 20 bp, Artificial Sequence
  chemically synthesized
agtgggagataactgaatca

SEQ ID NO: 459050 - DNA, 20 bp, Artificial Sequence
  chemically synthesized
gtgggagataactgaatcat

SEQ ID NO: 459051 - DNA, 20 bp, Artificial Sequence
  chemically synthesized
tgggagataactgaatcatg

SEQ ID NO: 459052 - DNA, 20 bp, Artificial Sequence
  chemically synthesized
gggaaaccacccccatgatt

SEQ ID NO: 459053 - DNA, 20 bp, Artificial Sequence
  chemically synthesized
gggagataactgaatcatgg

SEQ ID NO: 459054 - DNA, 20 bp, Artificial Sequence
  chemically synthesized
agataactgaatcatggggg

SEQ ID NO: 459055 - DNA, 20 bp, Artificial Sequence
  chemically synthesized
gctatcacaagaatagcatg

SEQ ID NO: 459056 - DNA, 20 bp, Artificial Sequence
  chemically synthesized
tgctatcacaagaatagcat

SEQ ID NO: 459057 - DNA, 20 bp, Artificial Sequence
  chemically synthesized
ttgctatcacaagaatagca

SEQ ID NO: 459058 - DNA, 20 bp, Artificial Sequence
  chemically synthesized
cttacttgctatcacaagaa

SEQ ID NO: 459059 - DNA, 20 bp, Artificial Sequence
  chemically synthesized
tccccatgctattcttgtga

SEQ ID NO: 459060 - DNA, 20 bp, Artificial Sequence
  chemically synthesized
gagaacttacttgctatcac

SEQ ID NO: 459061 - DNA, 20 bp, Artificial Sequence
  chemically synthesized
catgctattcttgtgatagc

SEQ ID NO: 459062 - DNA, 20 bp, Artificial Sequence
  chemically synthesized
ctattcttgtgatagcaagt

SEQ ID NO: 459063 - DNA, 20 bp, Artificial Sequence
  chemically synthesized
gatagcaagtaagttctcat

SEQ ID NO: 459064 - DNA, 20 bp, Artificial Sequence
  chemically synthesized
ataaaaccatcagatctcat

SEQ ID NO: 459065 - DNA, 20 bp, Artificial Sequence
  chemically synthesized
taagttctcatgagatctga

SEQ ID NO: 459066 - DNA, 20 bp, Artificial Sequence
  chemically synthesized
gaagtcccttataaaaccat

SEQ ID NO: 459067 - DNA, 20 bp, Artificial Sequence
  chemically synthesized
atgagatctgatggttttat

SEQ ID NO: 459068 - DNA, 20 bp, Artificial Sequence
  chemically synthesized
tgagatctgatggttttata

SEQ ID NO: 459069 - DNA, 20 bp, Artificial Sequence
  chemically synthesized
gagatctgatggttttataa

SEQ ID NO: 459070 - DNA, 20 bp, Artificial Sequence
  chemically synthesized
tgagagccaagcaaaggggg

SEQ ID NO: 459071 - DNA, 20 bp, Artificial Sequence
  chemically synthesized
gaatgagagccaagcaaagg

SEQ ID NO: 459072 - DNA, 20 bp, Artificial Sequence
  chemically synthesized
aagggacttccccctttgct

SEQ ID NO: 459073 - DNA, 20 bp, Artificial Sequence
  chemically synthesized
agaatgagagccaagcaaag

SEQ ID NO: 459074 - DNA, 20 bp, Artificial Sequence
  chemically synthesized
aagaatgagagccaagcaaa

SEQ ID NO: 459075 - DNA, 20 bp, Artificial Sequence
  chemically synthesized
gaagaatgagagccaagcaa

SEQ ID NO: 459076 - DNA, 20 bp, Artificial Sequence
  chemically synthesized
agaagaatgagagccaagca

SEQ ID NO: 459077 - DNA, 20 bp, Artificial Sequence
  chemically synthesized
caaggagaagaatgagagcc

SEQ ID NO: 459078 - DNA, 20 bp, Artificial Sequence
  chemically synthesized
ggcagcaaggagaagaatga

SEQ ID NO: 459079 - DNA, 20 bp, Artificial Sequence
  chemically synthesized
gcggcagcaaggagaagaat

SEQ ID NO: 459080 - DNA, 20 bp, Artificial Sequence
  chemically synthesized
cacatggcggcagcaaggag

SEQ ID NO: 459081 - DNA, 20 bp, Artificial Sequence
  chemically synthesized
catcacatggcggcagcaag

SEQ ID NO: 459082 - DNA, 20 bp, Artificial Sequence
  chemically synthesized
ctcatcacatggcggcagca

SEQ ID NO: 459083 - DNA, 20 bp, Artificial Sequence
  chemically synthesized
cctcatcacatggcggcagc

SEQ ID NO: 459084 - DNA, 20 bp, Artificial Sequence
  chemically synthesized
acatcctcatcacatggcgg

SEQ ID NO: 459085 - DNA, 20 bp, Artificial Sequence
  chemically synthesized
aacacatcctcatcacatgg

SEQ ID NO: 459086 - DNA, 20 bp, Artificial Sequence
  chemically synthesized
ccttgctgccgccatgtgat

SEQ ID NO: 459087 - DNA, 20 bp, Artificial Sequence
  chemically synthesized
cttgctgccgccatgtgatg

SEQ ID NO: 459088 - DNA, 20 bp, Artificial Sequence
  chemically synthesized
gcaaacacatcctcatcaca

SEQ ID NO: 459089 - DNA, 20 bp, Artificial Sequence
  chemically synthesized
tacaatcatggcagaagggg

SEQ ID NO: 459090 - DNA, 20 bp, Artificial Sequence
  chemically synthesized
acttacaatcatggcagaag

SEQ ID NO: 459091 - DNA, 20 bp, Artificial Sequence
  chemically synthesized
aacttacaatcatggcagaa

SEQ ID NO: 459092 - DNA, 20 bp, Artificial Sequence
  chemically synthesized
aaacttacaatcatggcaga

SEQ ID NO: 459093 - DNA, 20 bp, Artificial Sequence
  chemically synthesized
gaaacttacaatcatggcag

SEQ ID NO: 459094 - DNA, 20 bp, Artificial Sequence
  chemically synthesized
caggaaacttacaatcatgg

SEQ ID NO: 459095 - DNA, 20 bp, Artificial Sequence
  chemically synthesized
tccccttctgccatgattgt

SEQ ID NO: 459096 - DNA, 20 bp, Artificial Sequence
  chemically synthesized
cctcaggaaacttacaatca

SEQ ID NO: 459097 - DNA, 20 bp, Artificial Sequence
  chemically synthesized
gccatgattgtaagtttcct

SEQ ID NO: 459098 - DNA, 20 bp, Artificial Sequence
  chemically synthesized
ccatgattgtaagtttcctg

SEQ ID NO: 459099 - DNA, 20 bp, Artificial Sequence
  chemically synthesized
agcctggctggggaggcctc

SEQ ID NO: 459100 - DNA, 20 bp, Artificial Sequence
  chemically synthesized
cagcctggctggggaggcct

SEQ ID NO: 459101 - DNA, 20 bp, Artificial Sequence
  chemically synthesized
taagtttcctgaggcctccc

SEQ ID NO: 459102 - DNA, 20 bp, Artificial Sequence
  chemically synthesized
tttcctgaggcctccccagc

SEQ ID NO: 459103 - DNA, 20 bp, Artificial Sequence
  chemically synthesized
acagttcagcctggctgggg

SEQ ID NO: 459104 - DNA, 20 bp, Artificial Sequence
  chemically synthesized
ttcctgaggcctccccagcc

SEQ ID NO: 459105 - DNA, 20 bp, Artificial Sequence
  chemically synthesized
cacagttcagcctggctggg

SEQ ID NO: 459106 - DNA, 20 bp, Artificial Sequence
  chemically synthesized
ctcacagttcagcctggctg

SEQ ID NO: 459107 - DNA, 20 bp, Artificial Sequence
  chemically synthesized
actcacagttcagcctggct

SEQ ID NO: 459108 - DNA, 20 bp, Artificial Sequence
  chemically synthesized
gactcacagttcagcctggc

SEQ ID NO: 459109 - DNA, 20 bp, Artificial Sequence
  chemically synthesized
aattgactcacagttcagcc

SEQ ID NO: 459110 - DNA, 20 bp, Artificial Sequence
  chemically synthesized
ccccagccaggctgaactgt

SEQ ID NO: 459111 - DNA, 20 bp, Artificial Sequence
  chemically synthesized
ggtttaattgactcacagtt

SEQ ID NO: 459112 - DNA, 20 bp, Artificial Sequence
  chemically synthesized
aaagaggtttaattgactca

SEQ ID NO: 459113 - DNA, 20 bp, Artificial Sequence
  chemically synthesized
gcataattcataaaggaaag

SEQ ID NO: 459114 - DNA, 20 bp, Artificial Sequence
  chemically synthesized
tgcataattcataaaggaaa

SEQ ID NO: 459115 - DNA, 20 bp, Artificial Sequence
  chemically synthesized
aatgcataattcataaagga

SEQ ID NO: 459116 - DNA, 20 bp, Artificial Sequence
  chemically synthesized
caataatgcataattcataa

SEQ ID NO: 459117 - DNA, 20 bp, Artificial Sequence
  chemically synthesized
ccaataatgcataattcata

SEQ ID NO: 459118 - DNA, 20 bp, Artificial Sequence
  chemically synthesized
ctttatgaattatgcattat

SEQ ID NO: 459119 - DNA, 20 bp, Artificial Sequence
  chemically synthesized
tttatgaattatgcattatt

SEQ ID NO: 459120 - DNA, 20 bp, Artificial Sequence
  chemically synthesized
cattattgggtatttcttta

SEQ ID NO: 459121 - DNA, 20 bp, Artificial Sequence
  chemically synthesized
tattgggtatttctttatag

SEQ ID NO: 459122 - DNA, 20 bp, Artificial Sequence
  chemically synthesized
ttcattctcacactgctata

SEQ ID NO: 459123 - DNA, 20 bp, Artificial Sequence
  chemically synthesized
gtatttctttatagcagtgt

SEQ ID NO: 459124 - DNA, 20 bp, Artificial Sequence
  chemically synthesized
atttaaaaaattaagtgtat

SEQ ID NO: 459125 - DNA, 20 bp, Artificial Sequence
  chemically synthesized
attcagacatttaaaaaatt

SEQ ID NO: 459126 - DNA, 20 bp, Artificial Sequence
  chemically synthesized
aatttgaaatgataaatatt

SEQ ID NO: 459127 - DNA, 20 bp, Artificial Sequence
  chemically synthesized
tatattaagagaggaaacaa

SEQ ID NO: 459128 - DNA, 20 bp, Artificial Sequence
  chemically synthesized
tgataaaattatattaagag

SEQ ID NO: 459129 - DNA, 20 bp, Artificial Sequence
  chemically synthesized
ttgataaaattatattaaga

SEQ ID NO: 459130 - DNA, 20 bp, Artificial Sequence
  chemically synthesized
tgttgataaaattatattaa

SEQ ID NO: 459131 - DNA, 20 bp, Artificial Sequence
  chemically synthesized
tttgttgataaaattatatt

SEQ ID NO: 459132 - DNA, 20 bp, Artificial Sequence
  chemically synthesized
aacaaatttttccattaaat

SEQ ID NO: 459133 - DNA, 20 bp, Artificial Sequence
  chemically synthesized
cagaagattcactgatttaa

SEQ ID NO: 459134 - DNA, 20 bp, Artificial Sequence
  chemically synthesized
ttaaatcagtgaatcttctg

SEQ ID NO: 459135 - DNA, 20 bp, Artificial Sequence
  chemically synthesized
tttataataaataacttcag

SEQ ID NO: 459136 - DNA, 20 bp, Artificial Sequence
  chemically synthesized
atatttataataaataactt

SEQ ID NO: 459137 - DNA, 20 bp, Artificial Sequence
  chemically synthesized
aattcattaataaatttgaa

SEQ ID NO: 459138 - DNA, 20 bp, Artificial Sequence
  chemically synthesized
aaattcattaataaatttga

SEQ ID NO: 459139 - DNA, 20 bp, Artificial Sequence
  chemically synthesized
tgtaaaatgatgttatattt

SEQ ID NO: 459140 - DNA, 20 bp, Artificial Sequence
  chemically synthesized
tattttagatttgcttgtaa

SEQ ID NO: 459141 - DNA, 20 bp, Artificial Sequence
  chemically synthesized
tacatattggtgaccgttac

SEQ ID NO: 459142 - DNA, 20 bp, Artificial Sequence
  chemically synthesized
gagagaatctgtttacatat

SEQ ID NO: 459143 - DNA, 20 bp, Artificial Sequence
  chemically synthesized
aacggtcaccaatatgtaaa

SEQ ID NO: 459144 - DNA, 20 bp, Artificial Sequence
  chemically synthesized
agatttctaattgttggaga

SEQ ID NO: 459145 - DNA, 20 bp, Artificial Sequence
  chemically synthesized
ttagatttctaattgttgga

SEQ ID NO: 459146 - DNA, 20 bp, Artificial Sequence
  chemically synthesized
cagattctctctccaacaat

SEQ ID NO: 459147 - DNA, 20 bp, Artificial Sequence
  chemically synthesized
gtttagatttctaattgttg

SEQ ID NO: 459148 - DNA, 20 bp, Artificial Sequence
  chemically synthesized
tagtttagatttctaattgt

SEQ ID NO: 459149 - DNA, 20 bp, Artificial Sequence
  chemically synthesized
tgtagccttgtagtatagtt

SEQ ID NO: 459150 - DNA, 20 bp, Artificial Sequence
  chemically synthesized
agaaatctaaactatactac

SEQ ID NO: 459151 - DNA, 20 bp, Artificial Sequence
  chemically synthesized
gaaatctaaactatactaca

SEQ ID NO: 459152 - DNA, 20 bp, Artificial Sequence
  chemically synthesized
gttactgtagccttgtagta

SEQ ID NO: 459153 - DNA, 20 bp, Artificial Sequence
  chemically synthesized
ttttggttactgtagccttg

SEQ ID NO: 459154 - DNA, 20 bp, Artificial Sequence
  chemically synthesized
taaactatactacaaggcta

SEQ ID NO: 459155 - DNA, 20 bp, Artificial Sequence
  chemically synthesized
ccatgctgttttggttactg

SEQ ID NO: 459156 - DNA, 20 bp, Artificial Sequence
  chemically synthesized
caaggctacagtaaccaaaa

SEQ ID NO: 459157 - DNA, 20 bp, Artificial Sequence
  chemically synthesized
gtaccagtaccatgctgttt

SEQ ID NO: 459158 - DNA, 20 bp, Artificial Sequence
  chemically synthesized
ctacagtaaccaaaacagca

SEQ ID NO: 459159 - DNA, 20 bp, Artificial Sequence
  chemically synthesized
taaccaaaacagcatggtac

SEQ ID NO: 459160 - DNA, 20 bp, Artificial Sequence
  chemically synthesized
ctgtatctctgttttggtac

SEQ ID NO: 459161 - DNA, 20 bp, Artificial Sequence
  chemically synthesized
gcatggtactggtaccaaaa

SEQ ID NO: 459162 - DNA, 20 bp, Artificial Sequence
  chemically synthesized
atggtactggtaccaaaaca

SEQ ID NO: 459163 - DNA, 20 bp, Artificial Sequence
  chemically synthesized
attgatctgtatctctgttt

SEQ ID NO: 459164 - DNA, 20 bp, Artificial Sequence
  chemically synthesized
ctggtaccaaaacagagata

SEQ ID NO: 459165 - DNA, 20 bp, Artificial Sequence
  chemically synthesized
aaaacagagatacagatcaa

SEQ ID NO: 459166 - DNA, 20 bp, Artificial Sequence
  chemically synthesized
agagatacagatcaatggaa

SEQ ID NO: 459167 - DNA, 20 bp, Artificial Sequence
  chemically synthesized
tacagatcaatggaacagaa

SEQ ID NO: 459168 - DNA, 20 bp, Artificial Sequence
  chemically synthesized
cagatcaatggaacagaaca

SEQ ID NO: 459169 - DNA, 20 bp, Artificial Sequence
  chemically synthesized
atggaacagaacagagccct

SEQ ID NO: 459170 - DNA, 20 bp, Artificial Sequence
  chemically synthesized
atatgcagcattatttctga

SEQ ID NO: 459171 - DNA, 20 bp, Artificial Sequence
  chemically synthesized
gatatgcagcattatttctg

SEQ ID NO: 459172 - DNA, 20 bp, Artificial Sequence
  chemically synthesized
agatatgcagcattatttct

SEQ ID NO: 459173 - DNA, 20 bp, Artificial Sequence
  chemically synthesized
atcagatagttgtagatatg

SEQ ID NO: 459174 - DNA, 20 bp, Artificial Sequence
  chemically synthesized
tgtcaaagatcagatagttg

SEQ ID NO: 459175 - DNA, 20 bp, Artificial Sequence
  chemically synthesized
caggtttgtcaaagatcaga

SEQ ID NO: 459176 - DNA, 20 bp, Artificial Sequence
  chemically synthesized
ttctcaggtttgtcaaagat

SEQ ID NO: 459177 - DNA, 20 bp, Artificial Sequence
  chemically synthesized
tgtttttctcaggtttgtca

SEQ ID NO: 459178 - DNA, 20 bp, Artificial Sequence
  chemically synthesized
atctgatctttgacaaacct

SEQ ID NO: 459179 - DNA, 20 bp, Artificial Sequence
  chemically synthesized
ccccattgcttgtttttctc

SEQ ID NO: 459180 - DNA, 20 bp, Artificial Sequence
  chemically synthesized
tccccattgcttgtttttct

SEQ ID NO: 459181 - DNA, 20 bp, Artificial Sequence
  chemically synthesized
ttgacaaacctgagaaaaac

SEQ ID NO: 459182 - DNA, 20 bp, Artificial Sequence
  chemically synthesized
aacctgagaaaaacaagcaa

SEQ ID NO: 459183 - DNA, 20 bp, Artificial Sequence
  chemically synthesized
acctgagaaaaacaagcaat

SEQ ID NO: 459184 - DNA, 20 bp, Artificial Sequence
  chemically synthesized
cctgagaaaaacaagcaatg

SEQ ID NO: 459185 - DNA, 20 bp, Artificial Sequence
  chemically synthesized
agaaaaacaagcaatgggga

SEQ ID NO: 459186 - DNA, 20 bp, Artificial Sequence
  chemically synthesized
gaaaaacaagcaatggggaa

SEQ ID NO: 459187 - DNA, 20 bp, Artificial Sequence
  chemically synthesized
ccagcaccatttattaaata

SEQ ID NO: 459188 - DNA, 20 bp, Artificial Sequence
  chemically synthesized
cccagcaccatttattaaat

SEQ ID NO: 459189 - DNA, 20 bp, Artificial Sequence
  chemically synthesized
tcccagcaccatttattaaa

SEQ ID NO: 459190 - DNA, 20 bp, Artificial Sequence
  chemically synthesized
aggattccctatttaataaa

SEQ ID NO: 459191 - DNA, 20 bp, Artificial Sequence
  chemically synthesized
ccctatttaataaatggtgc

SEQ ID NO: 459192 - DNA, 20 bp, Artificial Sequence
  chemically synthesized
cctatttaataaatggtgct

SEQ ID NO: 459193 - DNA, 20 bp, Artificial Sequence
  chemically synthesized
ataaatggtgctgggaaaac

SEQ ID NO: 459194 - DNA, 20 bp, Artificial Sequence
  chemically synthesized
atatggctagccagttttcc

SEQ ID NO: 459195 - DNA, 20 bp, Artificial Sequence
  chemically synthesized
atggtgctgggaaaactggc

SEQ ID NO: 459196 - DNA, 20 bp, Artificial Sequence
  chemically synthesized
gctttctccatatggctagc

SEQ ID NO: 459197 - DNA, 20 bp, Artificial Sequence
  chemically synthesized
gggaaaactggctagccata

SEQ ID NO: 459198 - DNA, 20 bp, Artificial Sequence
  chemically synthesized
ttcagctttctccatatggc

SEQ ID NO: 459199 - DNA, 20 bp, Artificial Sequence
  chemically synthesized
gaaaactggctagccatatg

SEQ ID NO: 459200 - DNA, 20 bp, Artificial Sequence
  chemically synthesized
cagtttcagctttctccata

SEQ ID NO: 459201 - DNA, 20 bp, Artificial Sequence
  chemically synthesized
actggctagccatatggaga

SEQ ID NO: 459202 - DNA, 20 bp, Artificial Sequence
  chemically synthesized
catatggagaaagctgaaac

SEQ ID NO: 459203 - DNA, 20 bp, Artificial Sequence
  chemically synthesized
gtgaggaagggatccagttt

SEQ ID NO: 459204 - DNA, 20 bp, Artificial Sequence
  chemically synthesized
taaggtgtgaggaagggatc

SEQ ID NO: 459205 - DNA, 20 bp, Artificial Sequence
  chemically synthesized
tttgtataaggtgtgaggaa

SEQ ID NO: 459206 - DNA, 20 bp, Artificial Sequence
  chemically synthesized
ttttgtataaggtgtgagga

SEQ ID NO: 459207 - DNA, 20 bp, Artificial Sequence
  chemically synthesized
tttttgtataaggtgtgagg

SEQ ID NO: 459208 - DNA, 20 bp, Artificial Sequence
  chemically synthesized
taatttttgtataaggtgtg

SEQ ID NO: 459209 - DNA, 20 bp, Artificial Sequence
  chemically synthesized
ttaatttttgtataaggtgt

SEQ ID NO: 459210 - DNA, 20 bp, Artificial Sequence
  chemically synthesized
cttgaattaatttttgtata

SEQ ID NO: 459211 - DNA, 20 bp, Artificial Sequence
  chemically synthesized
tcttgaattaatttttgtat

SEQ ID NO: 459212 - DNA, 20 bp, Artificial Sequence
  chemically synthesized
ccttatacaaaaattaattc

SEQ ID NO: 459213 - DNA, 20 bp, Artificial Sequence
  chemically synthesized
atacaaaaattaattcaaga

SEQ ID NO: 459214 - DNA, 20 bp, Artificial Sequence
  chemically synthesized
aattaattcaagatggatta

SEQ ID NO: 459215 - DNA, 20 bp, Artificial Sequence
  chemically synthesized
tggattaaagacttaaacgt

SEQ ID NO: 459216 - DNA, 20 bp, Artificial Sequence
  chemically synthesized
tggttttaggtctaacgttt

SEQ ID NO: 459217 - DNA, 20 bp, Artificial Sequence
  chemically synthesized
tctagggtttttatggtttt

SEQ ID NO: 459218 - DNA, 20 bp, Artificial Sequence
  chemically synthesized
ttctagggtttttatggttt

SEQ ID NO: 459219 - DNA, 20 bp, Artificial Sequence
  chemically synthesized
gttttcttctagggttttta

SEQ ID NO: 459220 - DNA, 20 bp, Artificial Sequence
  chemically synthesized
acctaaaaccataaaaaccc

SEQ ID NO: 459221 - DNA, 20 bp, Artificial Sequence
  chemically synthesized
taaaaccataaaaaccctag

SEQ ID NO: 459222 - DNA, 20 bp, Artificial Sequence
  chemically synthesized
aatgcctaggttttcttcta

SEQ ID NO: 459223 - DNA, 20 bp, Artificial Sequence
  chemically synthesized
taatgcctaggttttcttct

SEQ ID NO: 459224 - DNA, 20 bp, Artificial Sequence
  chemically synthesized
gtaatgcctaggttttcttc

SEQ ID NO: 459225 - DNA, 20 bp, Artificial Sequence
  chemically synthesized
aaaaaccctagaagaaaacc

SEQ ID NO: 459226 - DNA, 20 bp, Artificial Sequence
  chemically synthesized
aaaaccctagaagaaaacct

SEQ ID NO: 459227 - DNA, 20 bp, Artificial Sequence
  chemically synthesized
tgtcctgaatggtaatgcct

SEQ ID NO: 459228 - DNA, 20 bp, Artificial Sequence
  chemically synthesized
atgtcctgaatggtaatgcc

SEQ ID NO: 459229 - DNA, 20 bp, Artificial Sequence
  chemically synthesized
aaaacctaggcattaccatt

SEQ ID NO: 459230 - DNA, 20 bp, Artificial Sequence
  chemically synthesized
aaacctaggcattaccattc

SEQ ID NO: 459231 - DNA, 20 bp, Artificial Sequence
  chemically synthesized
gcctatgcctatgtcctgaa

SEQ ID NO: 459232 - DNA, 20 bp, Artificial Sequence
  chemically synthesized
aggcattaccattcaggaca

SEQ ID NO: 459233 - DNA, 20 bp, Artificial Sequence
  chemically synthesized
ggcattaccattcaggacat

SEQ ID NO: 459234 - DNA, 20 bp, Artificial Sequence
  chemically synthesized
taccattcaggacataggca

SEQ ID NO: 459235 - DNA, 20 bp, Artificial Sequence
  chemically synthesized
accattcaggacataggcat

SEQ ID NO: 459236 - DNA, 20 bp, Artificial Sequence
  chemically synthesized
ttcaggacataggcataggc

SEQ ID NO: 459237 - DNA, 20 bp, Artificial Sequence
  chemically synthesized
tcaggacataggcataggca

SEQ ID NO: 459238 - DNA, 20 bp, Artificial Sequence
  chemically synthesized
cttttggtgttttagacatg

SEQ ID NO: 459239 - DNA, 20 bp, Artificial Sequence
  chemically synthesized
tgccattgcttttggtgttt

SEQ ID NO: 459240 - DNA, 20 bp, Artificial Sequence
  chemically synthesized
cttcatgtctaaaacaccaa

SEQ ID NO: 459241 - DNA, 20 bp, Artificial Sequence
  chemically synthesized
gtctaaaacaccaaaagcaa

SEQ ID NO: 459242 - DNA, 20 bp, Artificial Sequence
  chemically synthesized
gcttttgttgccattgcttt

SEQ ID NO: 459243 - DNA, 20 bp, Artificial Sequence
  chemically synthesized
accaaaagcaatggcaacaa

SEQ ID NO: 459244 - DNA, 20 bp, Artificial Sequence
  chemically synthesized
gagatcccatttgtcaattt

SEQ ID NO: 459245 - DNA, 20 bp, Artificial Sequence
  chemically synthesized
caaaagccaaaattgacaaa

SEQ ID NO: 459246 - DNA, 20 bp, Artificial Sequence
  chemically synthesized
aaaagccaaaattgacaaat

SEQ ID NO: 459247 - DNA, 20 bp, Artificial Sequence
  chemically synthesized
cagaagctctttagtttgat

SEQ ID NO: 459248 - DNA, 20 bp, Artificial Sequence
  chemically synthesized
aatgggatctcatcaaacta

SEQ ID NO: 459249 - DNA, 20 bp, Artificial Sequence
  chemically synthesized
tgggatctcatcaaactaaa

SEQ ID NO: 459250 - DNA, 20 bp, Artificial Sequence
  chemically synthesized
tttgctgtgcagaagctctt

SEQ ID NO: 459251 - DNA, 20 bp, Artificial Sequence
  chemically synthesized
caaactaaagagcttctgca

SEQ ID NO: 459252 - DNA, 20 bp, Artificial Sequence
  chemically synthesized
tagtttcttttgctgtgcag

SEQ ID NO: 459253 - DNA, 20 bp, Artificial Sequence
  chemically synthesized
tggtagtttcttttgctgtg

SEQ ID NO: 459254 - DNA, 20 bp, Artificial Sequence
  chemically synthesized
aaagagcttctgcacagcaa

SEQ ID NO: 459255 - DNA, 20 bp, Artificial Sequence
  chemically synthesized
acagcaaaagaaactaccat

SEQ ID NO: 459256 - DNA, 20 bp, Artificial Sequence
  chemically synthesized
agcaaaagaaactaccatca

SEQ ID NO: 459257 - DNA, 20 bp, Artificial Sequence
  chemically synthesized
ttgcctgttcactctgatgg

SEQ ID NO: 459258 - DNA, 20 bp, Artificial Sequence
  chemically synthesized
aggttgcctgttcactctga

SEQ ID NO: 459259 - DNA, 20 bp, Artificial Sequence
  chemically synthesized
gaaactaccatcagagtgaa

SEQ ID NO: 459260 - DNA, 20 bp, Artificial Sequence
  chemically synthesized
aaactaccatcagagtgaac

SEQ ID NO: 459261 - DNA, 20 bp, Artificial Sequence
  chemically synthesized
tgaacaggcaacctacaaaa

SEQ ID NO: 459262 - DNA, 20 bp, Artificial Sequence
  chemically synthesized
gaacaggcaacctacaaaat

SEQ ID NO: 459263 - DNA, 20 bp, Artificial Sequence
  chemically synthesized
aaaattttctcccattttgt

SEQ ID NO: 459264 - DNA, 20 bp, Artificial Sequence
  chemically synthesized
gaaaattttctcccattttg

SEQ ID NO: 459265 - DNA, 20 bp, Artificial Sequence
  chemically synthesized
acaggcaacctacaaaatgg

SEQ ID NO: 459266 - DNA, 20 bp, Artificial Sequence
  chemically synthesized
tagccctttgtcagatgagt

SEQ ID NO: 459267 - DNA, 20 bp, Artificial Sequence
  chemically synthesized
ttagccctttgtcagatgag

SEQ ID NO: 459268 - DNA, 20 bp, Artificial Sequence
  chemically synthesized
atattagccctttgtcagat

SEQ ID NO: 459269 - DNA, 20 bp, Artificial Sequence
  chemically synthesized
cgcaacctactcatctgaca

SEQ ID NO: 459270 - DNA, 20 bp, Artificial Sequence
  chemically synthesized
gcaacctactcatctgacaa

SEQ ID NO: 459271 - DNA, 20 bp, Artificial Sequence
  chemically synthesized
caacctactcatctgacaaa

SEQ ID NO: 459272 - DNA, 20 bp, Artificial Sequence
  chemically synthesized
tctggatattagccctttgt

SEQ ID NO: 459273 - DNA, 20 bp, Artificial Sequence
  chemically synthesized
tctgacaaagggctaatatc

SEQ ID NO: 459274 - DNA, 20 bp, Artificial Sequence
  chemically synthesized
tcattgtagattctggatat

SEQ ID NO: 459275 - DNA, 20 bp, Artificial Sequence
  chemically synthesized
tttgagttcattgtagattc

SEQ ID NO: 459276 - DNA, 20 bp, Artificial Sequence
  chemically synthesized
aaatttgtttgagttcattg

SEQ ID NO: 459277 - DNA, 20 bp, Artificial Sequence
  chemically synthesized
tttttcttgtaaatttgttt

SEQ ID NO: 459278 - DNA, 20 bp, Artificial Sequence
  chemically synthesized
atgaactcaaacaaatttac

SEQ ID NO: 459279 - DNA, 20 bp, Artificial Sequence
  chemically synthesized
aaacaaacaaccccatcaaa

SEQ ID NO: 459280 - DNA, 20 bp, Artificial Sequence
  chemically synthesized
ccttcgcccactttttgatg

SEQ ID NO: 459281 - DNA, 20 bp, Artificial Sequence
  chemically synthesized
tccttcgcccactttttgat

SEQ ID NO: 459282 - DNA, 20 bp, Artificial Sequence
  chemically synthesized
gtccttcgcccactttttga

SEQ ID NO: 459283 - DNA, 20 bp, Artificial Sequence
  chemically synthesized
caaacaaccccatcaaaaag

SEQ ID NO: 459284 - DNA, 20 bp, Artificial Sequence
  chemically synthesized
aaacaaccccatcaaaaagt

SEQ ID NO: 459285 - DNA, 20 bp, Artificial Sequence
  chemically synthesized
accccatcaaaaagtgggcg

SEQ ID NO: 459286 - DNA, 20 bp, Artificial Sequence
  chemically synthesized
ccccatcaaaaagtgggcga

SEQ ID NO: 459287 - DNA, 20 bp, Artificial Sequence
  chemically synthesized
aagtgggcgaaggacatgaa

SEQ ID NO: 459288 - DNA, 20 bp, Artificial Sequence
  chemically synthesized
catgaacagacacttctcaa

SEQ ID NO: 459289 - DNA, 20 bp, Artificial Sequence
  chemically synthesized
cataaatgtcttcttttgag

SEQ ID NO: 459290 - DNA, 20 bp, Artificial Sequence
  chemically synthesized
gaacagacacttctcaaaag

SEQ ID NO: 459291 - DNA, 20 bp, Artificial Sequence
  chemically synthesized
ctgcataaatgtcttctttt

SEQ ID NO: 459292 - DNA, 20 bp, Artificial Sequence
  chemically synthesized
ctcaaaagaagacatttatg

SEQ ID NO: 459293 - DNA, 20 bp, Artificial Sequence
  chemically synthesized
gaagacatttatgcagccaa

SEQ ID NO: 459294 - DNA, 20 bp, Artificial Sequence
  chemically synthesized
gcattttttcatgtgtcttt

SEQ ID NO: 459295 - DNA, 20 bp, Artificial Sequence
  chemically synthesized
ctctgatggccagtgatgat

SEQ ID NO: 459296 - DNA, 20 bp, Artificial Sequence
  chemically synthesized
gaaaaaatgctcatcatcac

SEQ ID NO: 459297 - DNA, 20 bp, Artificial Sequence
  chemically synthesized
tgctcatcatcactggccat

SEQ ID NO: 459298 - DNA, 20 bp, Artificial Sequence
  chemically synthesized
ctcatcatcactggccatca

SEQ ID NO: 459299 - DNA, 20 bp, Artificial Sequence
  chemically synthesized
atttgcatttctctgatggc

SEQ ID NO: 459300 - DNA, 20 bp, Artificial Sequence
  chemically synthesized
tttgatttgcatttctctga

SEQ ID NO: 459301 - DNA, 20 bp, Artificial Sequence
  chemically synthesized
atgcaaatcaaaaccacaat

SEQ ID NO: 459302 - DNA, 20 bp, Artificial Sequence
  chemically synthesized
tgtgagatggtatctcattg

SEQ ID NO: 459303 - DNA, 20 bp, Artificial Sequence
  chemically synthesized
ccattctaactggtgtgaga

SEQ ID NO: 459304 - DNA, 20 bp, Artificial Sequence
  chemically synthesized
aatgagataccatctcacac

SEQ ID NO: 459305 - DNA, 20 bp, Artificial Sequence
  chemically synthesized
atcgccattctaactggtgt

SEQ ID NO: 459306 - DNA, 20 bp, Artificial Sequence
  chemically synthesized
agataccatctcacaccagt

SEQ ID NO: 459307 - DNA, 20 bp, Artificial Sequence
  chemically synthesized
ccatctcacaccagttagaa

SEQ ID NO: 459308 - DNA, 20 bp, Artificial Sequence
  chemically synthesized
ttaatgatcgccattctaac

SEQ ID NO: 459309 - DNA, 20 bp, Artificial Sequence
  chemically synthesized
ttagaatggcgatcattaaa

SEQ ID NO: 459310 - DNA, 20 bp, Artificial Sequence
  chemically synthesized
aatggcgatcattaaaaagt

SEQ ID NO: 459311 - DNA, 20 bp, Artificial Sequence
  chemically synthesized
atggcgatcattaaaaagtc

SEQ ID NO: 459312 - DNA, 20 bp, Artificial Sequence
  chemically synthesized
attaaaaagtcaggaaacaa

SEQ ID NO: 459313 - DNA, 20 bp, Artificial Sequence
  chemically synthesized
ttaaaaagtcaggaaacaac

SEQ ID NO: 459314 - DNA, 20 bp, Artificial Sequence
  chemically synthesized
agtcaggaaacaacaggtgc

SEQ ID NO: 459315 - DNA, 20 bp, Artificial Sequence
  chemically synthesized
tcaggaaacaacaggtgctg

SEQ ID NO: 459316 - DNA, 20 bp, Artificial Sequence
  chemically synthesized
aggaaacaacaggtgctgga

SEQ ID NO: 459317 - DNA, 20 bp, Artificial Sequence
  chemically synthesized
ggaaacaacaggtgctggag

SEQ ID NO: 459318 - DNA, 20 bp, Artificial Sequence
  chemically synthesized
ctatttctccacatcctctc

SEQ ID NO: 459319 - DNA, 20 bp, Artificial Sequence
  chemically synthesized
aacaggtgctggagaggatg

SEQ ID NO: 459320 - DNA, 20 bp, Artificial Sequence
  chemically synthesized
caggtgctggagaggatgtg

SEQ ID NO: 459321 - DNA, 20 bp, Artificial Sequence
  chemically synthesized
ctggagaggatgtggagaaa

SEQ ID NO: 459322 - DNA, 20 bp, Artificial Sequence
  chemically synthesized
tggagaggatgtggagaaat

SEQ ID NO: 459323 - DNA, 20 bp, Artificial Sequence
  chemically synthesized
cagtcccgccaacagtgtaa

SEQ ID NO: 459324 - DNA, 20 bp, Artificial Sequence
  chemically synthesized
taggaacacttttacactgt

SEQ ID NO: 459325 - DNA, 20 bp, Artificial Sequence
  chemically synthesized
gaacacttttacactgttgg

SEQ ID NO: 459326 - DNA, 20 bp, Artificial Sequence
  chemically synthesized
aacacttttacactgttggc

SEQ ID NO: 459327 - DNA, 20 bp, Artificial Sequence
  chemically synthesized
ctagtttacagtcccgccaa

SEQ ID NO: 459328 - DNA, 20 bp, Artificial Sequence
  chemically synthesized
ctgttggcgggactgtaaac

SEQ ID NO: 459329 - DNA, 20 bp, Artificial Sequence
  chemically synthesized
acaatggttgaactagttta

SEQ ID NO: 459330 - DNA, 20 bp, Artificial Sequence
  chemically synthesized
gacttccacaatggttgaac

SEQ ID NO: 459331 - DNA, 20 bp, Artificial Sequence
  chemically synthesized
gtaaactagttcaaccattg

SEQ ID NO: 459332 - DNA, 20 bp, Artificial Sequence
  chemically synthesized
aactagttcaaccattgtgg

SEQ ID NO: 459333 - DNA, 20 bp, Artificial Sequence
  chemically synthesized
cgccacactgacttccacaa

SEQ ID NO: 459334 - DNA, 20 bp, Artificial Sequence
  chemically synthesized
agttcaaccattgtggaagt

SEQ ID NO: 459335 - DNA, 20 bp, Artificial Sequence
  chemically synthesized
aaccattgtggaagtcagtg

SEQ ID NO: 459336 - DNA, 20 bp, Artificial Sequence
  chemically synthesized
aagtcagtgtggcgattcct

SEQ ID NO: 459337 - DNA, 20 bp, Artificial Sequence
  chemically synthesized
agtcagtgtggcgattcctc

SEQ ID NO: 459338 - DNA, 20 bp, Artificial Sequence
  chemically synthesized
gtcagtgtggcgattcctca

SEQ ID NO: 459339 - DNA, 20 bp, Artificial Sequence
  chemically synthesized
tttctagttctagatccctg

SEQ ID NO: 459340 - DNA, 20 bp, Artificial Sequence
  chemically synthesized
gtggcgattcctcagggatc

SEQ ID NO: 459341 - DNA, 20 bp, Artificial Sequence
  chemically synthesized
atttctagttctagatccct

SEQ ID NO: 459342 - DNA, 20 bp, Artificial Sequence
  chemically synthesized
attcctcagggatctagaac

SEQ ID NO: 459343 - DNA, 20 bp, Artificial Sequence
  chemically synthesized
tcaaatggtatttctagttc

SEQ ID NO: 459344 - DNA, 20 bp, Artificial Sequence
  chemically synthesized
gctgtgtcaaatggtatttc

SEQ ID NO: 459345 - DNA, 20 bp, Artificial Sequence
  chemically synthesized
actagaaataccatttgaca

SEQ ID NO: 459346 - DNA, 20 bp, Artificial Sequence
  chemically synthesized
aatgggatggctgtgtcaaa

SEQ ID NO: 459347 - DNA, 20 bp, Artificial Sequence
  chemically synthesized
gtatatacccagtaatggga

SEQ ID NO: 459348 - DNA, 20 bp, Artificial Sequence
  chemically synthesized
tgacacagccatcccattac

SEQ ID NO: 459349 - DNA, 20 bp, Artificial Sequence
  chemically synthesized
gacacagccatcccattact

SEQ ID NO: 459350 - DNA, 20 bp, Artificial Sequence
  chemically synthesized
ttgggtatatacccagtaat

SEQ ID NO: 459351 - DNA, 20 bp, Artificial Sequence
  chemically synthesized
tttgggtatatacccagtaa

SEQ ID NO: 459352 - DNA, 20 bp, Artificial Sequence
  chemically synthesized
tagtcctttgggtatatacc

SEQ ID NO: 459353 - DNA, 20 bp, Artificial Sequence
  chemically synthesized
cattactgggtatataccca

SEQ ID NO: 459354 - DNA, 20 bp, Artificial Sequence
  chemically synthesized
attactgggtatatacccaa

SEQ ID NO: 459355 - DNA, 20 bp, Artificial Sequence
  chemically synthesized
agcatgatttatagtccttt

SEQ ID NO: 459356 - DNA, 20 bp, Artificial Sequence
  chemically synthesized
cagcatgatttatagtcctt

SEQ ID NO: 459357 - DNA, 20 bp, Artificial Sequence
  chemically synthesized
ctttatagcagcatgattta

SEQ ID NO: 459358 - DNA, 20 bp, Artificial Sequence
  chemically synthesized
ctataaatcatgctgctata

SEQ ID NO: 459359 - DNA, 20 bp, Artificial Sequence
  chemically synthesized
gtgtgcatgtgtctttatag

SEQ ID NO: 459360 - DNA, 20 bp, Artificial Sequence
  chemically synthesized
tacgtgtgcatgtgtcttta

SEQ ID NO: 459361 - DNA, 20 bp, Artificial Sequence
  chemically synthesized
atgcacacgtatgttcattg

SEQ ID NO: 459362 - DNA, 20 bp, Artificial Sequence
  chemically synthesized
cattgcggcactattcacaa

SEQ ID NO: 459363 - DNA, 20 bp, Artificial Sequence
  chemically synthesized
caagtctttgctattgtgaa

SEQ ID NO: 459364 - DNA, 20 bp, Artificial Sequence
  chemically synthesized
cggcactattcacaatagca

SEQ ID NO: 459365 - DNA, 20 bp, Artificial Sequence
  chemically synthesized
tattcacaatagcaaagact

SEQ ID NO: 459366 - DNA, 20 bp, Artificial Sequence
  chemically synthesized
tggacatttgggttggttcc

SEQ ID NO: 459367 - DNA, 20 bp, Artificial Sequence
  chemically synthesized
tcattgttggacatttgggt

SEQ ID NO: 459368 - DNA, 20 bp, Artificial Sequence
  chemically synthesized
tctatcattgttggacattt

SEQ ID NO: 459369 - DNA, 20 bp, Artificial Sequence
  chemically synthesized
gtctatcattgttggacatt

SEQ ID NO: 459370 - DNA, 20 bp, Artificial Sequence
  chemically synthesized
acccaaatgtccaacaatga

SEQ ID NO: 459371 - DNA, 20 bp, Artificial Sequence
  chemically synthesized
ttaatccagtctatcattgt

SEQ ID NO: 459372 - DNA, 20 bp, Artificial Sequence
  chemically synthesized
aatgtccaacaatgatagac

SEQ ID NO: 459373 - DNA, 20 bp, Artificial Sequence
  chemically synthesized
caacaatgatagactggatt

SEQ ID NO: 459374 - DNA, 20 bp, Artificial Sequence
  chemically synthesized
tgtgccacattttcttaatc

SEQ ID NO: 459375 - DNA, 20 bp, Artificial Sequence
  chemically synthesized
tagactggattaagaaaatg

SEQ ID NO: 459376 - DNA, 20 bp, Artificial Sequence
  chemically synthesized
aatgtggcacatatacacca

SEQ ID NO: 459377 - DNA, 20 bp, Artificial Sequence
  chemically synthesized
tatggctgcatagtattcca

SEQ ID NO: 459378 - DNA, 20 bp, Artificial Sequence
  chemically synthesized
atacaccatggaatactatg

SEQ ID NO: 459379 - DNA, 20 bp, Artificial Sequence
  chemically synthesized
catcattttttatggctgca

SEQ ID NO: 459380 - DNA, 20 bp, Artificial Sequence
  chemically synthesized
catgaactcatcatttttta

SEQ ID NO: 459381 - DNA, 20 bp, Artificial Sequence
  chemically synthesized
atgcagccataaaaaatgat

SEQ ID NO: 459382 - DNA, 20 bp, Artificial Sequence
  chemically synthesized
tgatgagttcatgtcctttg

SEQ ID NO: 459383 - DNA, 20 bp, Artificial Sequence
  chemically synthesized
gatgagttcatgtcctttgt

SEQ ID NO: 459384 - DNA, 20 bp, Artificial Sequence
  chemically synthesized
atgagttcatgtcctttgta

SEQ ID NO: 459385 - DNA, 20 bp, Artificial Sequence
  chemically synthesized
tttcatccatgtccctacaa

SEQ ID NO: 459386 - DNA, 20 bp, Artificial Sequence
  chemically synthesized
atttcatccatgtccctaca

SEQ ID NO: 459387 - DNA, 20 bp, Artificial Sequence
  chemically synthesized
tcatgtcctttgtagggaca

SEQ ID NO: 459388 - DNA, 20 bp, Artificial Sequence
  chemically synthesized
tgtagggacatggatgaaat

SEQ ID NO: 459389 - DNA, 20 bp, Artificial Sequence
  chemically synthesized
aaattggaaatcatcattct

SEQ ID NO: 459390 - DNA, 20 bp, Artificial Sequence
  chemically synthesized
tgtccttgcaatggtttgct

SEQ ID NO: 459391 - DNA, 20 bp, Artificial Sequence
  chemically synthesized
cattctcagcaaaccattgc

SEQ ID NO: 459392 - DNA, 20 bp, Artificial Sequence
  chemically synthesized
attctcagcaaaccattgca

SEQ ID NO: 459393 - DNA, 20 bp, Artificial Sequence
  chemically synthesized
ttggttttttgtccttgcaa

SEQ ID NO: 459394 - DNA, 20 bp, Artificial Sequence
  chemically synthesized
gagtgagaacatgcggtgtt

SEQ ID NO: 459395 - DNA, 20 bp, Artificial Sequence
  chemically synthesized
cacctatgagtgagaacatg

SEQ ID NO: 459396 - DNA, 20 bp, Artificial Sequence
  chemically synthesized
acaccgcatgttctcactca

SEQ ID NO: 459397 - DNA, 20 bp, Artificial Sequence
  chemically synthesized
caccgcatgttctcactcat

SEQ ID NO: 459398 - DNA, 20 bp, Artificial Sequence
  chemically synthesized
ttcagttcccacctatgagt

SEQ ID NO: 459399 - DNA, 20 bp, Artificial Sequence
  chemically synthesized
cgcatgttctcactcatagg

SEQ ID NO: 459400 - DNA, 20 bp, Artificial Sequence
  chemically synthesized
gcatgttctcactcataggt

SEQ ID NO: 459401 - DNA, 20 bp, Artificial Sequence
  chemically synthesized
attgttcagttcccacctat

SEQ ID NO: 459402 - DNA, 20 bp, Artificial Sequence
  chemically synthesized
ataggtgggaactgaacaat

SEQ ID NO: 459403 - DNA, 20 bp, Artificial Sequence
  chemically synthesized
gtccatgtgttctcattgtt

SEQ ID NO: 459404 - DNA, 20 bp, Artificial Sequence
  chemically synthesized
aactgaacaatgagaacaca

SEQ ID NO: 459405 - DNA, 20 bp, Artificial Sequence
  chemically synthesized
acaatgagaacacatggacg

SEQ ID NO: 459406 - DNA, 20 bp, Artificial Sequence
  chemically synthesized
caatgagaacacatggacgc

SEQ ID NO: 459407 - DNA, 20 bp, Artificial Sequence
  chemically synthesized
tgagaacacatggacgcagg

SEQ ID NO: 459408 - DNA, 20 bp, Artificial Sequence
  chemically synthesized
gagaacacatggacgcagga

SEQ ID NO: 459409 - DNA, 20 bp, Artificial Sequence
  chemically synthesized
agaacacatggacgcaggaa

SEQ ID NO: 459410 - DNA, 20 bp, Artificial Sequence
  chemically synthesized
gaacacatggacgcaggaag

SEQ ID NO: 459411 - DNA, 20 bp, Artificial Sequence
  chemically synthesized
ggaaggggaacatcacactc

SEQ ID NO: 459412 - DNA, 20 bp, Artificial Sequence
  chemically synthesized
gaaggggaacatcacactcc

SEQ ID NO: 459413 - DNA, 20 bp, Artificial Sequence
  chemically synthesized
aaggggaacatcacactccg

SEQ ID NO: 459414 - DNA, 20 bp, Artificial Sequence
  chemically synthesized
ccaccccacaacagtccccg

SEQ ID NO: 459415 - DNA, 20 bp, Artificial Sequence
  chemically synthesized
ccccaccccacaacagtccc

SEQ ID NO: 459416 - DNA, 20 bp, Artificial Sequence
  chemically synthesized
tcacactccggggactgttg

SEQ ID NO: 459417 - DNA, 20 bp, Artificial Sequence
  chemically synthesized
cacactccggggactgttgt

SEQ ID NO: 459418 - DNA, 20 bp, Artificial Sequence
  chemically synthesized
acactccggggactgttgtg

SEQ ID NO: 459419 - DNA, 20 bp, Artificial Sequence
  chemically synthesized
cccctccccccaccccacaa

SEQ ID NO: 459420 - DNA, 20 bp, Artificial Sequence
  chemically synthesized
ctccggggactgttgtgggg

SEQ ID NO: 459421 - DNA, 20 bp, Artificial Sequence
  chemically synthesized
tccggggactgttgtggggt

SEQ ID NO: 459422 - DNA, 20 bp, Artificial Sequence
  chemically synthesized
ccggggactgttgtggggtg

SEQ ID NO: 459423 - DNA, 20 bp, Artificial Sequence
  chemically synthesized
cggggactgttgtggggtgg

SEQ ID NO: 459424 - DNA, 20 bp, Artificial Sequence
  chemically synthesized
ggggactgttgtggggtggg

SEQ ID NO: 459425 - DNA, 20 bp, Artificial Sequence
  chemically synthesized
ggactgttgtggggtggggg

SEQ ID NO: 459426 - DNA, 20 bp, Artificial Sequence
  chemically synthesized
gactgttgtggggtgggggg

SEQ ID NO: 459427 - DNA, 20 bp, Artificial Sequence
  chemically synthesized
actgttgtggggtgggggga

SEQ ID NO: 459428 - DNA, 20 bp, Artificial Sequence
  chemically synthesized
ctgttgtggggtggggggag

SEQ ID NO: 459429 - DNA, 20 bp, Artificial Sequence
  chemically synthesized
tgttgtggggtggggggagg

SEQ ID NO: 459430 - DNA, 20 bp, Artificial Sequence
  chemically synthesized
gttgtggggtggggggaggg

SEQ ID NO: 459431 - DNA, 20 bp, Artificial Sequence
  chemically synthesized
tgtggggtggggggaggggg

SEQ ID NO: 459432 - DNA, 20 bp, Artificial Sequence
  chemically synthesized
gtggggtggggggagggggg

SEQ ID NO: 459433 - DNA, 20 bp, Artificial Sequence
  chemically synthesized
tggggtggggggagggggga

SEQ ID NO: 459434 - DNA, 20 bp, Artificial Sequence
  chemically synthesized
gtggggggaggggggaggga

SEQ ID NO: 459435 - DNA, 20 bp, Artificial Sequence
  chemically synthesized
ggaggggggagggatagcat

SEQ ID NO: 459436 - DNA, 20 bp, Artificial Sequence
  chemically synthesized
gaggggggagggatagcatt

SEQ ID NO: 459437 - DNA, 20 bp, Artificial Sequence
  chemically synthesized
ggggggagggatagcattag

SEQ ID NO: 459438 - DNA, 20 bp, Artificial Sequence
  chemically synthesized
ttaactcgtcatttagcatt

SEQ ID NO: 459439 - DNA, 20 bp, Artificial Sequence
  chemically synthesized
attaactcgtcatttagcat

SEQ ID NO: 459440 - DNA, 20 bp, Artificial Sequence
  chemically synthesized
tatacctaatgctaaatgac

SEQ ID NO: 459441 - DNA, 20 bp, Artificial Sequence
  chemically synthesized
gcacccattaactcgtcatt

SEQ ID NO: 459442 - DNA, 20 bp, Artificial Sequence
  chemically synthesized
aatgctaaatgacgagttaa

SEQ ID NO: 459443 - DNA, 20 bp, Artificial Sequence
  chemically synthesized
atgctaaatgacgagttaat

SEQ ID NO: 459444 - DNA, 20 bp, Artificial Sequence
  chemically synthesized
aaatgacgagttaatgggtg

SEQ ID NO: 459445 - DNA, 20 bp, Artificial Sequence
  chemically synthesized
agttaatgggtgcagcacac

SEQ ID NO: 459446 - DNA, 20 bp, Artificial Sequence
  chemically synthesized
atgggtgcagcacaccagca

SEQ ID NO: 459447 - DNA, 20 bp, Artificial Sequence
  chemically synthesized
tatgtatacatgtgccatgc

SEQ ID NO: 459448 - DNA, 20 bp, Artificial Sequence
  chemically synthesized
catgtgcacaatgtgcaggt

SEQ ID NO: 459449 - DNA, 20 bp, Artificial Sequence
  chemically synthesized
ggtacatgtgcacaatgtgc

SEQ ID NO: 459450 - DNA, 20 bp, Artificial Sequence
  chemically synthesized
gggtacatgtgcacaatgtg

SEQ ID NO: 459451 - DNA, 20 bp, Artificial Sequence
  chemically synthesized
tgcacatgtaccctaaaact

SEQ ID NO: 459452 - DNA, 20 bp, Artificial Sequence
  chemically synthesized
ttattatactctaagtttta

SEQ ID NO: 459453 - DNA, 20 bp, Artificial Sequence
  chemically synthesized
attattatactctaagtttt

SEQ ID NO: 459454 - DNA, 20 bp, Artificial Sequence
  chemically synthesized
cacatgtaccctaaaactta

SEQ ID NO: 459455 - DNA, 20 bp, Artificial Sequence
  chemically synthesized
tattattatactctaagttt

SEQ ID NO: 459456 - DNA, 20 bp, Artificial Sequence
  chemically synthesized
ttttattattattatactct

SEQ ID NO: 459457 - DNA, 20 bp, Artificial Sequence
  chemically synthesized
tttttttttgaagttatatt

SEQ ID NO: 459458 - DNA, 20 bp, Artificial Sequence
  chemically synthesized
atttcttttttttttttttg

SEQ ID NO: 459459 - DNA, 20 bp, Artificial Sequence
  chemically synthesized
ataacttcaaaaaaaaaaaa

SEQ ID NO: 459460 - DNA, 20 bp, Artificial Sequence
  chemically synthesized
tttgtctcctaaattaggta

SEQ ID NO: 459461 - DNA, 20 bp, Artificial Sequence
  chemically synthesized
aaagaaatctatacctaatt

SEQ ID NO: 459462 - DNA, 20 bp, Artificial Sequence
  chemically synthesized
aagaaatctatacctaattt

SEQ ID NO: 459463 - DNA, 20 bp, Artificial Sequence
  chemically synthesized
gaaatctatacctaatttag

SEQ ID NO: 459464 - DNA, 20 bp, Artificial Sequence
  chemically synthesized
tttgttttgtctcctaaatt

SEQ ID NO: 459465 - DNA, 20 bp, Artificial Sequence
  chemically synthesized
gtttgttttgtctcctaaat

SEQ ID NO: 459466 - DNA, 20 bp, Artificial Sequence
  chemically synthesized
gagacaaaacaaactaatgt

SEQ ID NO: 459467 - DNA, 20 bp, Artificial Sequence
  chemically synthesized
acaaaacaaactaatgtcag

SEQ ID NO: 459468 - DNA, 20 bp, Artificial Sequence
  chemically synthesized
tgcaaacaaacttctgacat

SEQ ID NO: 459469 - DNA, 20 bp, Artificial Sequence
  chemically synthesized
atgtttgtagttaattacag

SEQ ID NO: 459470 - DNA, 20 bp, Artificial Sequence
  chemically synthesized
tatatgtttgtagttaatta

SEQ ID NO: 459471 - DNA, 20 bp, Artificial Sequence
  chemically synthesized
tactcttgaatatatgtttg

SEQ ID NO: 459472 - DNA, 20 bp, Artificial Sequence
  chemically synthesized
ttaactacaaacatatattc

SEQ ID NO: 459473 - DNA, 20 bp, Artificial Sequence
  chemically synthesized
aactacaaacatatattcaa

SEQ ID NO: 459474 - DNA, 20 bp, Artificial Sequence
  chemically synthesized
aacatagaatgaaatgataa

SEQ ID NO: 459475 - DNA, 20 bp, Artificial Sequence
  chemically synthesized
ataacatagaatgaaatgat

SEQ ID NO: 459476 - DNA, 20 bp, Artificial Sequence
  chemically synthesized
actgaaggttttttataaca

SEQ ID NO: 459477 - DNA, 20 bp, Artificial Sequence
  chemically synthesized
tctatgttataaaaaacctt

SEQ ID NO: 459478 - DNA, 20 bp, Artificial Sequence
  chemically synthesized
aatgtgacttatgagactga

SEQ ID NO: 459479 - DNA, 20 bp, Artificial Sequence
  chemically synthesized
taatgtgacttatgagactg

SEQ ID NO: 459480 - DNA, 20 bp, Artificial Sequence
  chemically synthesized
taaaaaaccttcagtctcat

SEQ ID NO: 459481 - DNA, 20 bp, Artificial Sequence
  chemically synthesized
tgctctataatgtgacttat

SEQ ID NO: 459482 - DNA, 20 bp, Artificial Sequence
  chemically synthesized
cagtctcataagtcacatta

SEQ ID NO: 459483 - DNA, 20 bp, Artificial Sequence
  chemically synthesized
gtctcataagtcacattata

SEQ ID NO: 459484 - DNA, 20 bp, Artificial Sequence
  chemically synthesized
agcattacgttttcctccca

SEQ ID NO: 459485 - DNA, 20 bp, Artificial Sequence
  chemically synthesized
ctaatccttttcaccatggg

SEQ ID NO: 459486 - DNA, 20 bp, Artificial Sequence
  chemically synthesized
actaatccttttcaccatgg

SEQ ID NO: 459487 - DNA, 20 bp, Artificial Sequence
  chemically synthesized
gaactaatccttttcaccat

SEQ ID NO: 459488 - DNA, 20 bp, Artificial Sequence
  chemically synthesized
cgttttcctcccatggtgaa

SEQ ID NO: 459489 - DNA, 20 bp, Artificial Sequence
  chemically synthesized
agaactaatccttttcacca

SEQ ID NO: 459490 - DNA, 20 bp, Artificial Sequence
  chemically synthesized
gttttcctcccatggtgaaa

SEQ ID NO: 459491 - DNA, 20 bp, Artificial Sequence
  chemically synthesized
cctcccatggtgaaaaggat

SEQ ID NO: 459492 - DNA, 20 bp, Artificial Sequence
  chemically synthesized
tggtgaaaaggattagttct

SEQ ID NO: 459493 - DNA, 20 bp, Artificial Sequence
  chemically synthesized
tgtgttcttaagttattgct

SEQ ID NO: 459494 - DNA, 20 bp, Artificial Sequence
  chemically synthesized
ttagttcttagcaataactt

SEQ ID NO: 459495 - DNA, 20 bp, Artificial Sequence
  chemically synthesized
ctgacaaaagatgtgttctt

SEQ ID NO: 459496 - DNA, 20 bp, Artificial Sequence
  chemically synthesized
cttaagaacacatcttttgt

SEQ ID NO: 459497 - DNA, 20 bp, Artificial Sequence
  chemically synthesized
tccctcagagacactgacaa

SEQ ID NO: 459498 - DNA, 20 bp, Artificial Sequence
  chemically synthesized
catcttttgtcagtgtctct

SEQ ID NO: 459499 - DNA, 20 bp, Artificial Sequence
  chemically synthesized
atcttttgtcagtgtctctg

SEQ ID NO: 459500 - DNA, 20 bp, Artificial Sequence
  chemically synthesized
tcttttgtcagtgtctctga

SEQ ID NO: 459501 - DNA, 20 bp, Artificial Sequence
  chemically synthesized
caggaaatatttatccctca

SEQ ID NO: 459502 - DNA, 20 bp, Artificial Sequence
  chemically synthesized
accaggaaatatttatccct

SEQ ID NO: 459503 - DNA, 20 bp, Artificial Sequence
  chemically synthesized
tctgagggataaatatttcc

SEQ ID NO: 459504 - DNA, 20 bp, Artificial Sequence
  chemically synthesized
gggataaatatttcctggtt

SEQ ID NO: 459505 - DNA, 20 bp, Artificial Sequence
  chemically synthesized
ctgtgcataaacactcaacc

SEQ ID NO: 459506 - DNA, 20 bp, Artificial Sequence
  chemically synthesized
tctgtgcataaacactcaac

SEQ ID NO: 459507 - DNA, 20 bp, Artificial Sequence
  chemically synthesized
cctggttgagtgtttatgca

SEQ ID NO: 459508 - DNA, 20 bp, Artificial Sequence
  chemically synthesized
tggttgagtgtttatgcaca

SEQ ID NO: 459509 - DNA, 20 bp, Artificial Sequence
  chemically synthesized
ggttgagtgtttatgcacag

SEQ ID NO: 459510 - DNA, 20 bp, Artificial Sequence
  chemically synthesized
gcacagaggaaaaattactg

SEQ ID NO: 459511 - DNA, 20 bp, Artificial Sequence
  chemically synthesized
ctatatttgggcacagactt

SEQ ID NO: 459512 - DNA, 20 bp, Artificial Sequence
  chemically synthesized
acagaagctatatttgggca

SEQ ID NO: 459513 - DNA, 20 bp, Artificial Sequence
  chemically synthesized
ctgaagtctgtgcccaaata

SEQ ID NO: 459514 - DNA, 20 bp, Artificial Sequence
  chemically synthesized
agtttacagaagctatattt

SEQ ID NO: 459515 - DNA, 20 bp, Artificial Sequence
  chemically synthesized
aagtttacagaagctatatt

SEQ ID NO: 459516 - DNA, 20 bp, Artificial Sequence
  chemically synthesized
tatatttttcaagtttacag

SEQ ID NO: 459517 - DNA, 20 bp, Artificial Sequence
  chemically synthesized
ttttatatttttcaagttta

SEQ ID NO: 459518 - DNA, 20 bp, Artificial Sequence
  chemically synthesized
aattctcttttatatttttc

SEQ ID NO: 459519 - DNA, 20 bp, Artificial Sequence
  chemically synthesized
tgtaaacttgaaaaatataa

SEQ ID NO: 459520 - DNA, 20 bp, Artificial Sequence
  chemically synthesized
taaacttgaaaaatataaaa

SEQ ID NO: 459521 - DNA, 20 bp, Artificial Sequence
  chemically synthesized
gaaaaatataaaagagaatt

SEQ ID NO: 459522 - DNA, 20 bp, Artificial Sequence
  chemically synthesized
aatataaaagagaatttagt

SEQ ID NO: 459523 - DNA, 20 bp, Artificial Sequence
  chemically synthesized
atataaaagagaatttagtg

SEQ ID NO: 459524 - DNA, 20 bp, Artificial Sequence
  chemically synthesized
aaaagagaatttagtgagga

SEQ ID NO: 459525 - DNA, 20 bp, Artificial Sequence
  chemically synthesized
aaagagaatttagtgaggaa

SEQ ID NO: 459526 - DNA, 20 bp, Artificial Sequence
  chemically synthesized
agagaatttagtgaggaaag

SEQ ID NO: 459527 - DNA, 20 bp, Artificial Sequence
  chemically synthesized
aatttagtgaggaaaggaga

SEQ ID NO: 459528 - DNA, 20 bp, Artificial Sequence
  chemically synthesized
tttagtgaggaaaggagaca

SEQ ID NO: 459529 - DNA, 20 bp, Artificial Sequence
  chemically synthesized
tagtgaggaaaggagacaga

SEQ ID NO: 459530 - DNA, 20 bp, Artificial Sequence
  chemically synthesized
tgaggaaaggagacagagag

SEQ ID NO: 459531 - DNA, 20 bp, Artificial Sequence
  chemically synthesized
agacagagagtagctccttt

SEQ ID NO: 459532 - DNA, 20 bp, Artificial Sequence
  chemically synthesized
tttgtattatagtccaaaag

SEQ ID NO: 459533 - DNA, 20 bp, Artificial Sequence
  chemically synthesized
tgtttgtattatagtccaaa

SEQ ID NO: 459534 - DNA, 20 bp, Artificial Sequence
  chemically synthesized
gtgtttgtattatagtccaa

SEQ ID NO: 459535 - DNA, 20 bp, Artificial Sequence
  chemically synthesized
tagaaaatgtgtttgtatta

SEQ ID NO: 459536 - DNA, 20 bp, Artificial Sequence
  chemically synthesized
ataatacaaacacattttct

SEQ ID NO: 459537 - DNA, 20 bp, Artificial Sequence
  chemically synthesized
caaacacattttctaagaac

SEQ ID NO: 459538 - DNA, 20 bp, Artificial Sequence
  chemically synthesized
aaacacattttctaagaact

SEQ ID NO: 459539 - DNA, 20 bp, Artificial Sequence
  chemically synthesized
gatccccaaggcctagttct

SEQ ID NO: 459540 - DNA, 20 bp, Artificial Sequence
  chemically synthesized
attttctaagaactaggcct

SEQ ID NO: 459541 - DNA, 20 bp, Artificial Sequence
  chemically synthesized
ttttctaagaactaggcctt

SEQ ID NO: 459542 - DNA, 20 bp, Artificial Sequence
  chemically synthesized
tttctaagaactaggccttg

SEQ ID NO: 459543 - DNA, 20 bp, Artificial Sequence
  chemically synthesized
tgattatgatccccaaggcc

SEQ ID NO: 459544 - DNA, 20 bp, Artificial Sequence
  chemically synthesized
ctagttgattatgatcccca

SEQ ID NO: 459545 - DNA, 20 bp, Artificial Sequence
  chemically synthesized
gctagttgattatgatcccc

SEQ ID NO: 459546 - DNA, 20 bp, Artificial Sequence
  chemically synthesized
ccttggggatcataatcaac

SEQ ID NO: 459547 - DNA, 20 bp, Artificial Sequence
  chemically synthesized
ggatcataatcaactagcct

SEQ ID NO: 459548 - DNA, 20 bp, Artificial Sequence
  chemically synthesized
ccattgtgtgtggctcaggc

SEQ ID NO: 459549 - DNA, 20 bp, Artificial Sequence
  chemically synthesized
ctatccattgtgtgtggctc

SEQ ID NO: 459550 - DNA, 20 bp, Artificial Sequence
  chemically synthesized
cctatccattgtgtgtggct

SEQ ID NO: 459551 - DNA, 20 bp, Artificial Sequence
  chemically synthesized
ctagcctgagccacacacaa

SEQ ID NO: 459552 - DNA, 20 bp, Artificial Sequence
  chemically synthesized
aaatacctatccattgtgtg

SEQ ID NO: 459553 - DNA, 20 bp, Artificial Sequence
  chemically synthesized
cctgagccacacacaatgga

SEQ ID NO: 459554 - DNA, 20 bp, Artificial Sequence
  chemically synthesized
ctgagccacacacaatggat

SEQ ID NO: 459555 - DNA, 20 bp, Artificial Sequence
  chemically synthesized
aatggataggtatttctgac

SEQ ID NO: 459556 - DNA, 20 bp, Artificial Sequence
  chemically synthesized
tacagctaaaaagtgccagt

SEQ ID NO: 459557 - DNA, 20 bp, Artificial Sequence
  chemically synthesized
gccttacagctaaaaagtgc

SEQ ID NO: 459558 - DNA, 20 bp, Artificial Sequence
  chemically synthesized
tatttctgactggcactttt

SEQ ID NO: 459559 - DNA, 20 bp, Artificial Sequence
  chemically synthesized
tgtcatgccttacagctaaa

SEQ ID NO: 459560 - DNA, 20 bp, Artificial Sequence
  chemically synthesized
gactggcactttttagctgt

SEQ ID NO: 459561 - DNA, 20 bp, Artificial Sequence
  chemically synthesized
actggcactttttagctgta

SEQ ID NO: 459562 - DNA, 20 bp, Artificial Sequence
  chemically synthesized
caatttcatgtcatgcctta

SEQ ID NO: 459563 - DNA, 20 bp, Artificial Sequence
  chemically synthesized
gcatgacatgaaattgcaat

SEQ ID NO: 459564 - DNA, 20 bp, Artificial Sequence
  chemically synthesized
atgacatgaaattgcaatga

SEQ ID NO: 459565 - DNA, 20 bp, Artificial Sequence
  chemically synthesized
gacatgaaattgcaatgaga

SEQ ID NO: 459566 - DNA, 20 bp, Artificial Sequence
  chemically synthesized
tgcaatgagagagctacaaa

SEQ ID NO: 459567 - DNA, 20 bp, Artificial Sequence
  chemically synthesized
gcaatgagagagctacaaaa

SEQ ID NO: 459568 - DNA, 20 bp, Artificial Sequence
  chemically synthesized
ttgtctctatggcctttttg

SEQ ID NO: 459569 - DNA, 20 bp, Artificial Sequence
  chemically synthesized
agagagctacaaaaaggcca

SEQ ID NO: 459570 - DNA, 20 bp, Artificial Sequence
  chemically synthesized
agagctacaaaaaggccata

SEQ ID NO: 459571 - DNA, 20 bp, Artificial Sequence
  chemically synthesized
tacaaaaaggccatagagac

SEQ ID NO: 459572 - DNA, 20 bp, Artificial Sequence
  chemically synthesized
aagctggatacttgtctcta

SEQ ID NO: 459573 - DNA, 20 bp, Artificial Sequence
  chemically synthesized
aggccatagagacaagtatc

SEQ ID NO: 459574 - DNA, 20 bp, Artificial Sequence
  chemically synthesized
catagggagaaaggttaagc

SEQ ID NO: 459575 - DNA, 20 bp, Artificial Sequence
  chemically synthesized
actgcatagggagaaaggtt

SEQ ID NO: 459576 - DNA, 20 bp, Artificial Sequence
  chemically synthesized
agacaactgcatagggagaa

SEQ ID NO: 459577 - DNA, 20 bp, Artificial Sequence
  chemically synthesized
aagacaactgcatagggaga

SEQ ID NO: 459578 - DNA, 20 bp, Artificial Sequence
  chemically synthesized
gcttaacctttctccctatg

SEQ ID NO: 459579 - DNA, 20 bp, Artificial Sequence
  chemically synthesized
aaagaagacaactgcatagg

SEQ ID NO: 459580 - DNA, 20 bp, Artificial Sequence
  chemically synthesized
gtaaagaagacaactgcata

SEQ ID NO: 459581 - DNA, 20 bp, Artificial Sequence
  chemically synthesized
ggtaaagaagacaactgcat

SEQ ID NO: 459582 - DNA, 20 bp, Artificial Sequence
  chemically synthesized
tggtaaagaagacaactgca

SEQ ID NO: 459583 - DNA, 20 bp, Artificial Sequence
  chemically synthesized
ccagcatcactgtggtaaag

SEQ ID NO: 459584 - DNA, 20 bp, Artificial Sequence
  chemically synthesized
tgcagttgtcttctttacca

SEQ ID NO: 459585 - DNA, 20 bp, Artificial Sequence
  chemically synthesized
cagccagcatcactgtggta

SEQ ID NO: 459586 - DNA, 20 bp, Artificial Sequence
  chemically synthesized
ttgaccagccagcatcactg

SEQ ID NO: 459587 - DNA, 20 bp, Artificial Sequence
  chemically synthesized
cttctttaccacagtgatgc

SEQ ID NO: 459588 - DNA, 20 bp, Artificial Sequence
  chemically synthesized
tttaccacagtgatgctggc

SEQ ID NO: 459589 - DNA, 20 bp, Artificial Sequence
  chemically synthesized
caggagctaaattgaccagc

SEQ ID NO: 459590 - DNA, 20 bp, Artificial Sequence
  chemically synthesized
gtgatgctggctggtcaatt

SEQ ID NO: 459591 - DNA, 20 bp, Artificial Sequence
  chemically synthesized
caagcaggagctaaattgac

SEQ ID NO: 459592 - DNA, 20 bp, Artificial Sequence
  chemically synthesized
catagtaagtattcaagcag

SEQ ID NO: 459593 - DNA, 20 bp, Artificial Sequence
  chemically synthesized
ttcatagtaagtattcaagc

SEQ ID NO: 459594 - DNA, 20 bp, Artificial Sequence
  chemically synthesized
tttcatagtaagtattcaag

SEQ ID NO: 459595 - DNA, 20 bp, Artificial Sequence
  chemically synthesized
tcttttcatagtaagtattc

SEQ ID NO: 459596 - DNA, 20 bp, Artificial Sequence
  chemically synthesized
caagagtttcttttcatagt

SEQ ID NO: 459597 - DNA, 20 bp, Artificial Sequence
  chemically synthesized
gcttgaatacttactatgaa

SEQ ID NO: 459598 - DNA, 20 bp, Artificial Sequence
  chemically synthesized
aaagcaagagtttcttttca

SEQ ID NO: 459599 - DNA, 20 bp, Artificial Sequence
  chemically synthesized
gcacatgtaacataaagcaa

SEQ ID NO: 459600 - DNA, 20 bp, Artificial Sequence
  chemically synthesized
atgcacatgtaacataaagc

SEQ ID NO: 459601 - DNA, 20 bp, Artificial Sequence
  chemically synthesized
aatgatgcacatgtaacata

SEQ ID NO: 459602 - DNA, 20 bp, Artificial Sequence
  chemically synthesized
ttacatgtgcatcattcatt

SEQ ID NO: 459603 - DNA, 20 bp, Artificial Sequence
  chemically synthesized
tttaatgcatttacttattg

SEQ ID NO: 459604 - DNA, 20 bp, Artificial Sequence
  chemically synthesized
gtgtacctttagacttcaat

SEQ ID NO: 459605 - DNA, 20 bp, Artificial Sequence
  chemically synthesized
catttacttattgaagtcta

SEQ ID NO: 459606 - DNA, 20 bp, Artificial Sequence
  chemically synthesized
atttacttattgaagtctaa

SEQ ID NO: 459607 - DNA, 20 bp, Artificial Sequence
  chemically synthesized
cttcttcatttgtgtacctt

SEQ ID NO: 459608 - DNA, 20 bp, Artificial Sequence
  chemically synthesized
agtctaaaggtacacaaatg

SEQ ID NO: 459609 - DNA, 20 bp, Artificial Sequence
  chemically synthesized
ctaaaggtacacaaatgaag

SEQ ID NO: 459610 - DNA, 20 bp, Artificial Sequence
  chemically synthesized
gtacacaaatgaagaagatg

SEQ ID NO: 459611 - DNA, 20 bp, Artificial Sequence
  chemically synthesized
agatgtggttcctgatcttg

SEQ ID NO: 459612 - DNA, 20 bp, Artificial Sequence
  chemically synthesized
aaactggaaactgcaagatc

SEQ ID NO: 459613 - DNA, 20 bp, Artificial Sequence
  chemically synthesized
taaactggaaactgcaagat

SEQ ID NO: 459614 - DNA, 20 bp, Artificial Sequence
  chemically synthesized
tgttataaactggaaactgc

SEQ ID NO: 459615 - DNA, 20 bp, Artificial Sequence
  chemically synthesized
gttcctgatcttgcagtttc

SEQ ID NO: 459616 - DNA, 20 bp, Artificial Sequence
  chemically synthesized
ttctgttccttgttataaac

SEQ ID NO: 459617 - DNA, 20 bp, Artificial Sequence
  chemically synthesized
tgcagtttccagtttataac

SEQ ID NO: 459618 - DNA, 20 bp, Artificial Sequence
  chemically synthesized
gcagtttccagtttataaca

SEQ ID NO: 459619 - DNA, 20 bp, Artificial Sequence
  chemically synthesized
ttccagtttataacaaggaa

SEQ ID NO: 459620 - DNA, 20 bp, Artificial Sequence
  chemically synthesized
acatgatttaatataacgta

SEQ ID NO: 459621 - DNA, 20 bp, Artificial Sequence
  chemically synthesized
tttaatataacgtatggtca

SEQ ID NO: 459622 - DNA, 20 bp, Artificial Sequence
  chemically synthesized
aatataacgtatggtcatag

SEQ ID NO: 459623 - DNA, 20 bp, Artificial Sequence
  chemically synthesized
tataacgtatggtcatagta

SEQ ID NO: 459624 - DNA, 20 bp, Artificial Sequence
  chemically synthesized
tagccaaagcttcagatttt

SEQ ID NO: 459625 - DNA, 20 bp, Artificial Sequence
  chemically synthesized
atagtagagctgaaaatctg

SEQ ID NO: 459626 - DNA, 20 bp, Artificial Sequence
  chemically synthesized
gagctgaaaatctgaagctt

SEQ ID NO: 459627 - DNA, 20 bp, Artificial Sequence
  chemically synthesized
cctcattttagccaaagctt

SEQ ID NO: 459628 - DNA, 20 bp, Artificial Sequence
  chemically synthesized
ctccttcctcattttagcca

SEQ ID NO: 459629 - DNA, 20 bp, Artificial Sequence
  chemically synthesized
tctgaagctttggctaaaat

SEQ ID NO: 459630 - DNA, 20 bp, Artificial Sequence
  chemically synthesized
ctgaagctttggctaaaatg

SEQ ID NO: 459631 - DNA, 20 bp, Artificial Sequence
  chemically synthesized
taggtactccttcctcattt

SEQ ID NO: 459632 - DNA, 20 bp, Artificial Sequence
  chemically synthesized
aagctttggctaaaatgagg

SEQ ID NO: 459633 - DNA, 20 bp, Artificial Sequence
  chemically synthesized
agctttggctaaaatgagga

SEQ ID NO: 459634 - DNA, 20 bp, Artificial Sequence
  chemically synthesized
ctttggctaaaatgaggaag

SEQ ID NO: 459635 - DNA, 20 bp, Artificial Sequence
  chemically synthesized
atgaggaaggagtacctaaa

SEQ ID NO: 459636 - DNA, 20 bp, Artificial Sequence
  chemically synthesized
tgaggaaggagtacctaaat

SEQ ID NO: 459637 - DNA, 20 bp, Artificial Sequence
  chemically synthesized
agcaaataccaggcccattt

SEQ ID NO: 459638 - DNA, 20 bp, Artificial Sequence
  chemically synthesized
tagcaaataccaggcccatt

SEQ ID NO: 459639 - DNA, 20 bp, Artificial Sequence
  chemically synthesized
aaggagtacctaaatgggcc

SEQ ID NO: 459640 - DNA, 20 bp, Artificial Sequence
  chemically synthesized
ctatacatttagcaaatacc

SEQ ID NO: 459641 - DNA, 20 bp, Artificial Sequence
  chemically synthesized
tctatacatttagcaaatac

SEQ ID NO: 459642 - DNA, 20 bp, Artificial Sequence
  chemically synthesized
cctggtatttgctaaatgta

SEQ ID NO: 459643 - DNA, 20 bp, Artificial Sequence
  chemically synthesized
tgttgttccctctatacatt

SEQ ID NO: 459644 - DNA, 20 bp, Artificial Sequence
  chemically synthesized
tggtatttgctaaatgtata

SEQ ID NO: 459645 - DNA, 20 bp, Artificial Sequence
  chemically synthesized
ggtatttgctaaatgtatag

SEQ ID NO: 459646 - DNA, 20 bp, Artificial Sequence
  chemically synthesized
gtatttgctaaatgtataga

SEQ ID NO: 459647 - DNA, 20 bp, Artificial Sequence
  chemically synthesized
agagggaacaacatttaatt

SEQ ID NO: 459648 - DNA, 20 bp, Artificial Sequence
  chemically synthesized
gagggaacaacatttaattg

SEQ ID NO: 459649 - DNA, 20 bp, Artificial Sequence
  chemically synthesized
caacatttaattgaggaaat

SEQ ID NO: 459650 - DNA, 20 bp, Artificial Sequence
  chemically synthesized
catttaattgaggaaataag

SEQ ID NO: 459651 - DNA, 20 bp, Artificial Sequence
  chemically synthesized
atttaattgaggaaataagt

SEQ ID NO: 459652 - DNA, 20 bp, Artificial Sequence
  chemically synthesized
ttaattgaggaaataagtag

SEQ ID NO: 459653 - DNA, 20 bp, Artificial Sequence
  chemically synthesized
aagtaggagatttccactga

SEQ ID NO: 459654 - DNA, 20 bp, Artificial Sequence
  chemically synthesized
tacttctaccattctatcag

SEQ ID NO: 459655 - DNA, 20 bp, Artificial Sequence
  chemically synthesized
ggagatttccactgatagaa

SEQ ID NO: 459656 - DNA, 20 bp, Artificial Sequence
  chemically synthesized
ccctacttctaccattctat

SEQ ID NO: 459657 - DNA, 20 bp, Artificial Sequence
  chemically synthesized
gatttccactgatagaatgg

SEQ ID NO: 459658 - DNA, 20 bp, Artificial Sequence
  chemically synthesized
ttccactgatagaatggtag

SEQ ID NO: 459659 - DNA, 20 bp, Artificial Sequence
  chemically synthesized
cactgatagaatggtagaag

SEQ ID NO: 459660 - DNA, 20 bp, Artificial Sequence
  chemically synthesized
actgatagaatggtagaagt

SEQ ID NO: 459661 - DNA, 20 bp, Artificial Sequence
  chemically synthesized
ctgatagaatggtagaagta

SEQ ID NO: 459662 - DNA, 20 bp, Artificial Sequence
  chemically synthesized
tggtagaagtagggctgtga

SEQ ID NO: 459663 - DNA, 20 bp, Artificial Sequence
  chemically synthesized
ggtagaagtagggctgtgat

SEQ ID NO: 459664 - DNA, 20 bp, Artificial Sequence
  chemically synthesized
catgtcccccacacccatca

SEQ ID NO: 459665 - DNA, 20 bp, Artificial Sequence
  chemically synthesized
aagtagggctgtgatgggtg

SEQ ID NO: 459666 - DNA, 20 bp, Artificial Sequence
  chemically synthesized
agtagggctgtgatgggtgt

SEQ ID NO: 459667 - DNA, 20 bp, Artificial Sequence
  chemically synthesized
gtagggctgtgatgggtgtg

SEQ ID NO: 459668 - DNA, 20 bp, Artificial Sequence
  chemically synthesized
tagggctgtgatgggtgtgg

SEQ ID NO: 459669 - DNA, 20 bp, Artificial Sequence
  chemically synthesized
tgtgatgggtgtgggggaca

SEQ ID NO: 459670 - DNA, 20 bp, Artificial Sequence
  chemically synthesized
tgatgggtgtgggggacatg

SEQ ID NO: 459671 - DNA, 20 bp, Artificial Sequence
  chemically synthesized
gatgggtgtgggggacatgg

SEQ ID NO: 459672 - DNA, 20 bp, Artificial Sequence
  chemically synthesized
atgggtgtgggggacatgga

SEQ ID NO: 459673 - DNA, 20 bp, Artificial Sequence
  chemically synthesized
tgggtgtgggggacatggag

SEQ ID NO: 459674 - DNA, 20 bp, Artificial Sequence
  chemically synthesized
tgtgggggacatggagggga

SEQ ID NO: 459675 - DNA, 20 bp, Artificial Sequence
  chemically synthesized
gtgggggacatggaggggaa

SEQ ID NO: 459676 - DNA, 20 bp, Artificial Sequence
  chemically synthesized
acatggaggggaaaggcaaa

SEQ ID NO: 459677 - DNA, 20 bp, Artificial Sequence
  chemically synthesized
gaggggaaaggcaaatggca

SEQ ID NO: 459678 - DNA, 20 bp, Artificial Sequence
  chemically synthesized
ggggaaaggcaaatggcaca

SEQ ID NO: 459679 - DNA, 20 bp, Artificial Sequence
  chemically synthesized
gggaaaggcaaatggcacag

SEQ ID NO: 459680 - DNA, 20 bp, Artificial Sequence
  chemically synthesized
caaacatgccaggagttttc

SEQ ID NO: 459681 - DNA, 20 bp, Artificial Sequence
  chemically synthesized
cacagaggcttgaaaactcc

SEQ ID NO: 459682 - DNA, 20 bp, Artificial Sequence
  chemically synthesized
ctctcacccaaacatgccag

SEQ ID NO: 459683 - DNA, 20 bp, Artificial Sequence
  chemically synthesized
acctctcacccaaacatgcc

SEQ ID NO: 459684 - DNA, 20 bp, Artificial Sequence
  chemically synthesized
ttgaaaactcctggcatgtt

SEQ ID NO: 459685 - DNA, 20 bp, Artificial Sequence
  chemically synthesized
cacctctcacccaaacatgc

SEQ ID NO: 459686 - DNA, 20 bp, Artificial Sequence
  chemically synthesized
tgaaaactcctggcatgttt

SEQ ID NO: 459687 - DNA, 20 bp, Artificial Sequence
  chemically synthesized
aactcctggcatgtttgggt

SEQ ID NO: 459688 - DNA, 20 bp, Artificial Sequence
  chemically synthesized
ctcctggcatgtttgggtga

SEQ ID NO: 459689 - DNA, 20 bp, Artificial Sequence
  chemically synthesized
tcctggcatgtttgggtgag

SEQ ID NO: 459690 - DNA, 20 bp, Artificial Sequence
  chemically synthesized
ggcatgtttgggtgagaggt

SEQ ID NO: 459691 - DNA, 20 bp, Artificial Sequence
  chemically synthesized
catgtttgggtgagaggtga

SEQ ID NO: 459692 - DNA, 20 bp, Artificial Sequence
  chemically synthesized
gagaggtgagagattctatg

SEQ ID NO: 459693 - DNA, 20 bp, Artificial Sequence
  chemically synthesized
attgctgtgatgtagccaca

SEQ ID NO: 459694 - DNA, 20 bp, Artificial Sequence
  chemically synthesized
gattctatgtggctacatca

SEQ ID NO: 459695 - DNA, 20 bp, Artificial Sequence
  chemically synthesized
acatttatattgctgtgatg

SEQ ID NO: 459696 - DNA, 20 bp, Artificial Sequence
  chemically synthesized
cagcaatataaatgtcatgt

SEQ ID NO: 459697 - DNA, 20 bp, Artificial Sequence
  chemically synthesized
aatataaatgtcatgttgga

SEQ ID NO: 459698 - DNA, 20 bp, Artificial Sequence
  chemically synthesized
taaatgtcatgttggaaagt

SEQ ID NO: 459699 - DNA, 20 bp, Artificial Sequence
  chemically synthesized
gtcatgttggaaagtgagtc

SEQ ID NO: 459700 - DNA, 20 bp, Artificial Sequence
  chemically synthesized
catgttggaaagtgagtctg

SEQ ID NO: 459701 - DNA, 20 bp, Artificial Sequence
  chemically synthesized
gttggaaagtgagtctggag

SEQ ID NO: 459702 - DNA, 20 bp, Artificial Sequence
  chemically synthesized
tttgccccaattttcttctc

SEQ ID NO: 459703 - DNA, 20 bp, Artificial Sequence
  chemically synthesized
gtgagtctggagaagaaaat

SEQ ID NO: 459704 - DNA, 20 bp, Artificial Sequence
  chemically synthesized
tgagtctggagaagaaaatt

SEQ ID NO: 459705 - DNA, 20 bp, Artificial Sequence
  chemically synthesized
gagtctggagaagaaaattg

SEQ ID NO: 459706 - DNA, 20 bp, Artificial Sequence
  chemically synthesized
aaattggggcaaacaatcca

SEQ ID NO: 459707 - DNA, 20 bp, Artificial Sequence
  chemically synthesized
ctttgtactaattgagactt

SEQ ID NO: 459708 - DNA, 20 bp, Artificial Sequence
  chemically synthesized
aaacaatccaaagtctcaat

SEQ ID NO: 459709 - DNA, 20 bp, Artificial Sequence
  chemically synthesized
cccatggctttgtactaatt

SEQ ID NO: 459710 - DNA, 20 bp, Artificial Sequence
  chemically synthesized
ccaaagtctcaattagtaca

SEQ ID NO: 459711 - DNA, 20 bp, Artificial Sequence
  chemically synthesized
tctcaattagtacaaagcca

SEQ ID NO: 459712 - DNA, 20 bp, Artificial Sequence
  chemically synthesized
ctcaattagtacaaagccat

SEQ ID NO: 459713 - DNA, 20 bp, Artificial Sequence
  chemically synthesized
tcaattagtacaaagccatg

SEQ ID NO: 459714 - DNA, 20 bp, Artificial Sequence
  chemically synthesized
agacagagtctgggtcccca

SEQ ID NO: 459715 - DNA, 20 bp, Artificial Sequence
  chemically synthesized
agtacaaagccatggggacc

SEQ ID NO: 459716 - DNA, 20 bp, Artificial Sequence
  chemically synthesized
gtattacagagacagagtct

SEQ ID NO: 459717 - DNA, 20 bp, Artificial Sequence
  chemically synthesized
agtattacagagacagagtc

SEQ ID NO: 459718 - DNA, 20 bp, Artificial Sequence
  chemically synthesized
tcctcagtattacagagaca

SEQ ID NO: 459719 - DNA, 20 bp, Artificial Sequence
  chemically synthesized
tgtcctcagtattacagaga

SEQ ID NO: 459720 - DNA, 20 bp, Artificial Sequence
  chemically synthesized
catctgtcctcagtattaca

SEQ ID NO: 459721 - DNA, 20 bp, Artificial Sequence
  chemically synthesized
gactctgtctctgtaatact

SEQ ID NO: 459722 - DNA, 20 bp, Artificial Sequence
  chemically synthesized
tgcatctgtcctcagtatta

SEQ ID NO: 459723 - DNA, 20 bp, Artificial Sequence
  chemically synthesized
actctgtctctgtaatactg

SEQ ID NO: 459724 - DNA, 20 bp, Artificial Sequence
  chemically synthesized
tgtctctgtaatactgagga

SEQ ID NO: 459725 - DNA, 20 bp, Artificial Sequence
  chemically synthesized
ctctatgctgcatctgtcct

SEQ ID NO: 459726 - DNA, 20 bp, Artificial Sequence
  chemically synthesized
tgtaatactgaggacagatg

SEQ ID NO: 459727 - DNA, 20 bp, Artificial Sequence
  chemically synthesized
tactgaggacagatgcagca

SEQ ID NO: 459728 - DNA, 20 bp, Artificial Sequence
  chemically synthesized
ctgaggacagatgcagcata

SEQ ID NO: 459729 - DNA, 20 bp, Artificial Sequence
  chemically synthesized
aggacagatgcagcatagag

SEQ ID NO: 459730 - DNA, 20 bp, Artificial Sequence
  chemically synthesized
catagagtagatattacaac

SEQ ID NO: 459731 - DNA, 20 bp, Artificial Sequence
  chemically synthesized
gatattacaacaagatacta

SEQ ID NO: 459732 - DNA, 20 bp, Artificial Sequence
  chemically synthesized
acttaggcagggtagcgcca

SEQ ID NO: 459733 - DNA, 20 bp, Artificial Sequence
  chemically synthesized
acattgaaacttaggcaggg

SEQ ID NO: 459734 - DNA, 20 bp, Artificial Sequence
  chemically synthesized
actatggcgctaccctgcct

SEQ ID NO: 459735 - DNA, 20 bp, Artificial Sequence
  chemically synthesized
agcacattgaaacttaggca

SEQ ID NO: 459736 - DNA, 20 bp, Artificial Sequence
  chemically synthesized
gagcacattgaaacttaggc

SEQ ID NO: 459737 - DNA, 20 bp, Artificial Sequence
  chemically synthesized
agagcacattgaaacttagg

SEQ ID NO: 459738 - DNA, 20 bp, Artificial Sequence
  chemically synthesized
ttgagagcacattgaaactt

SEQ ID NO: 459739 - DNA, 20 bp, Artificial Sequence
  chemically synthesized
tttgagagcacattgaaact

SEQ ID NO: 459740 - DNA, 20 bp, Artificial Sequence
  chemically synthesized
agtttcaatgtgctctcaaa

SEQ ID NO: 459741 - DNA, 20 bp, Artificial Sequence
  chemically synthesized
caaagtcaccaactatttga

SEQ ID NO: 459742 - DNA, 20 bp, Artificial Sequence
  chemically synthesized
tcaatgtgctctcaaatagt

SEQ ID NO: 459743 - DNA, 20 bp, Artificial Sequence
  chemically synthesized
tccaaagtcaccaactattt

SEQ ID NO: 459744 - DNA, 20 bp, Artificial Sequence
  chemically synthesized
tctcaaatagttggtgactt

SEQ ID NO: 459745 - DNA, 20 bp, Artificial Sequence
  chemically synthesized
aatagttggtgactttggac

SEQ ID NO: 459746 - DNA, 20 bp, Artificial Sequence
  chemically synthesized
ggggataaacaacttgtcca

SEQ ID NO: 459747 - DNA, 20 bp, Artificial Sequence
  chemically synthesized
agcatgtattagtcagggtg

SEQ ID NO: 459748 - DNA, 20 bp, Artificial Sequence
  chemically synthesized
gagcatgtattagtcagggt

SEQ ID NO: 459749 - DNA, 20 bp, Artificial Sequence
  chemically synthesized
agagcatgtattagtcaggg

SEQ ID NO: 459750 - DNA, 20 bp, Artificial Sequence
  chemically synthesized
catagagcatgtattagtca

SEQ ID NO: 459751 - DNA, 20 bp, Artificial Sequence
  chemically synthesized
gcatagagcatgtattagtc

SEQ ID NO: 459752 - DNA, 20 bp, Artificial Sequence
  chemically synthesized
ggcatagagcatgtattagt

SEQ ID NO: 459753 - DNA, 20 bp, Artificial Sequence
  chemically synthesized
ctgaggcatagagcatgtat

SEQ ID NO: 459754 - DNA, 20 bp, Artificial Sequence
  chemically synthesized
ctaatacatgctctatgcct

SEQ ID NO: 459755 - DNA, 20 bp, Artificial Sequence
  chemically synthesized
gataagtaaactgaggcata

SEQ ID NO: 459756 - DNA, 20 bp, Artificial Sequence
  chemically synthesized
cagataagtaaactgaggca

SEQ ID NO: 459757 - DNA, 20 bp, Artificial Sequence
  chemically synthesized
ttttgcagataagtaaactg

SEQ ID NO: 459758 - DNA, 20 bp, Artificial Sequence
  chemically synthesized
attttgcagataagtaaact

SEQ ID NO: 459759 - DNA, 20 bp, Artificial Sequence
  chemically synthesized
aatatcctcattttgcagat

SEQ ID NO: 459760 - DNA, 20 bp, Artificial Sequence
  chemically synthesized
agtttacttatctgcaaaat

SEQ ID NO: 459761 - DNA, 20 bp, Artificial Sequence
  chemically synthesized
gtttacttatctgcaaaatg

SEQ ID NO: 459762 - DNA, 20 bp, Artificial Sequence
  chemically synthesized
atattaatatcctcattttg

SEQ ID NO: 459763 - DNA, 20 bp, Artificial Sequence
  chemically synthesized
aaaatgaggatattaatatt

SEQ ID NO: 459764 - DNA, 20 bp, Artificial Sequence
  chemically synthesized
gatattaatatttagctcat

SEQ ID NO: 459765 - DNA, 20 bp, Artificial Sequence
  chemically synthesized
actcctcaaaacaatccaat

SEQ ID NO: 459766 - DNA, 20 bp, Artificial Sequence
  chemically synthesized
ttagctcattggattgtttt

SEQ ID NO: 459767 - DNA, 20 bp, Artificial Sequence
  chemically synthesized
tagctcattggattgttttg

SEQ ID NO: 459768 - DNA, 20 bp, Artificial Sequence
  chemically synthesized
gctcattggattgttttgag

SEQ ID NO: 459769 - DNA, 20 bp, Artificial Sequence
  chemically synthesized
tggattgttttgaggagtat

SEQ ID NO: 459770 - DNA, 20 bp, Artificial Sequence
  chemically synthesized
tattggacaaaattctttta

SEQ ID NO: 459771 - DNA, 20 bp, Artificial Sequence
  chemically synthesized
tataattttacatactttaa

SEQ ID NO: 459772 - DNA, 20 bp, Artificial Sequence
  chemically synthesized
taatcaatgttgttattaaa

SEQ ID NO: 459773 - DNA, 20 bp, Artificial Sequence
  chemically synthesized
ttaatcaatgttgttattaa

SEQ ID NO: 459774 - DNA, 20 bp, Artificial Sequence
  chemically synthesized
taataacaacattgattaaa

SEQ ID NO: 459775 - DNA, 20 bp, Artificial Sequence
  chemically synthesized
acattgattaaatagattcc

SEQ ID NO: 459776 - DNA, 20 bp, Artificial Sequence
  chemically synthesized
tctctgctccaatacatact

SEQ ID NO: 459777 - DNA, 20 bp, Artificial Sequence
  chemically synthesized
aatagattccaagtatgtat

SEQ ID NO: 459778 - DNA, 20 bp, Artificial Sequence
  chemically synthesized
tagattccaagtatgtattg

SEQ ID NO: 459779 - DNA, 20 bp, Artificial Sequence
  chemically synthesized
attccaagtatgtattggag

SEQ ID NO: 459780 - DNA, 20 bp, Artificial Sequence
  chemically synthesized
tccaagtatgtattggagca

SEQ ID NO: 459781 - DNA, 20 bp, Artificial Sequence
  chemically synthesized
caagtatgtattggagcaga

SEQ ID NO: 459782 - DNA, 20 bp, Artificial Sequence
  chemically synthesized
agtatgtattggagcagaga

SEQ ID NO: 459783 - DNA, 20 bp, Artificial Sequence
  chemically synthesized
gtattggagcagagagagtc

SEQ ID NO: 459784 - DNA, 20 bp, Artificial Sequence
  chemically synthesized
ggatttcagggatcatcatc

SEQ ID NO: 459785 - DNA, 20 bp, Artificial Sequence
  chemically synthesized
agatgatgatccctgaaatc

SEQ ID NO: 459786 - DNA, 20 bp, Artificial Sequence
  chemically synthesized
ttggccactgctggatttca

SEQ ID NO: 459787 - DNA, 20 bp, Artificial Sequence
  chemically synthesized
tttggccactgctggatttc

SEQ ID NO: 459788 - DNA, 20 bp, Artificial Sequence
  chemically synthesized
ttttggccactgctggattt

SEQ ID NO: 459789 - DNA, 20 bp, Artificial Sequence
  chemically synthesized
tgatgatccctgaaatccag

SEQ ID NO: 459790 - DNA, 20 bp, Artificial Sequence
  chemically synthesized
tgatccctgaaatccagcag

SEQ ID NO: 459791 - DNA, 20 bp, Artificial Sequence
  chemically synthesized
cttttatttttggccactgc

SEQ ID NO: 459792 - DNA, 20 bp, Artificial Sequence
  chemically synthesized
ccagcagtggccaaaaataa

SEQ ID NO: 459793 - DNA, 20 bp, Artificial Sequence
  chemically synthesized
cttctctcctcttttatttt

SEQ ID NO: 459794 - DNA, 20 bp, Artificial Sequence
  chemically synthesized
agcagtggccaaaaataaaa

SEQ ID NO: 459795 - DNA, 20 bp, Artificial Sequence
  chemically synthesized
gcagtggccaaaaataaaag

SEQ ID NO: 459796 - DNA, 20 bp, Artificial Sequence
  chemically synthesized
agtggccaaaaataaaagag

SEQ ID NO: 459797 - DNA, 20 bp, Artificial Sequence
  chemically synthesized
tggccaaaaataaaagagga

SEQ ID NO: 459798 - DNA, 20 bp, Artificial Sequence
  chemically synthesized
ccaaaaataaaagaggagag

SEQ ID NO: 459799 - DNA, 20 bp, Artificial Sequence
  chemically synthesized
atgcatgatcattgcaactc

SEQ ID NO: 459800 - DNA, 20 bp, Artificial Sequence
  chemically synthesized
atgatcattgcaactcgaga

SEQ ID NO: 459801 - DNA, 20 bp, Artificial Sequence
  chemically synthesized
ctaatagctaaatctgtctc

SEQ ID NO: 459802 - DNA, 20 bp, Artificial Sequence
  chemically synthesized
attgcaactcgagacagatt

SEQ ID NO: 459803 - DNA, 20 bp, Artificial Sequence
  chemically synthesized
ctcgagacagatttagctat

SEQ ID NO: 459804 - DNA, 20 bp, Artificial Sequence
  chemically synthesized
agacagatttagctattaga

SEQ ID NO: 459805 - DNA, 20 bp, Artificial Sequence
  chemically synthesized
tataagaaagaactttctaa

SEQ ID NO: 459806 - DNA, 20 bp, Artificial Sequence
  chemically synthesized
aatttaggtgtaatataaga

SEQ ID NO: 459807 - DNA, 20 bp, Artificial Sequence
  chemically synthesized
agcaaatttaggtgtaatat

SEQ ID NO: 459808 - DNA, 20 bp, Artificial Sequence
  chemically synthesized
gcatgaaggagagcaaattt

SEQ ID NO: 459809 - DNA, 20 bp, Artificial Sequence
  chemically synthesized
tgcatgaaggagagcaaatt

SEQ ID NO: 459810 - DNA, 20 bp, Artificial Sequence
  chemically synthesized
tgaattctttgcatgaagga

SEQ ID NO: 459811 - DNA, 20 bp, Artificial Sequence
  chemically synthesized
attgaattctttgcatgaag

SEQ ID NO: 459812 - DNA, 20 bp, Artificial Sequence
  chemically synthesized
aatttgctctccttcatgca

SEQ ID NO: 459813 - DNA, 20 bp, Artificial Sequence
  chemically synthesized
aaattgaattctttgcatga

SEQ ID NO: 459814 - DNA, 20 bp, Artificial Sequence
  chemically synthesized
gaaattgaattctttgcatg

SEQ ID NO: 459815 - DNA, 20 bp, Artificial Sequence
  chemically synthesized
gcaaagaattcaatttctac

SEQ ID NO: 459816 - DNA, 20 bp, Artificial Sequence
  chemically synthesized
agaattcaatttctactggc

SEQ ID NO: 459817 - DNA, 20 bp, Artificial Sequence
  chemically synthesized
gtagaaatagggccagccag

SEQ ID NO: 459818 - DNA, 20 bp, Artificial Sequence
  chemically synthesized
aaggtagaaatagggccagc

SEQ ID NO: 459819 - DNA, 20 bp, Artificial Sequence
  chemically synthesized
gtggaaggtagaaatagggc

SEQ ID NO: 459820 - DNA, 20 bp, Artificial Sequence
  chemically synthesized
ttaggtggaaggtagaaata

SEQ ID NO: 459821 - DNA, 20 bp, Artificial Sequence
  chemically synthesized
attaggtggaaggtagaaat

SEQ ID NO: 459822 - DNA, 20 bp, Artificial Sequence
  chemically synthesized
tattaggtggaaggtagaaa

SEQ ID NO: 459823 - DNA, 20 bp, Artificial Sequence
  chemically synthesized
taagtctattaggtggaagg

SEQ ID NO: 459824 - DNA, 20 bp, Artificial Sequence
  chemically synthesized
atgtaagtctattaggtgga

SEQ ID NO: 459825 - DNA, 20 bp, Artificial Sequence
  chemically synthesized
tatgtaagtctattaggtgg

SEQ ID NO: 459826 - DNA, 20 bp, Artificial Sequence
  chemically synthesized
tatttctaccttccacctaa

SEQ ID NO: 459827 - DNA, 20 bp, Artificial Sequence
  chemically synthesized
ttatatgtaagtctattagg

SEQ ID NO: 459828 - DNA, 20 bp, Artificial Sequence
  chemically synthesized
ttattatatgtaagtctatt

SEQ ID NO: 459829 - DNA, 20 bp, Artificial Sequence
  chemically synthesized
tttattatatgtaagtctat

SEQ ID NO: 459830 - DNA, 20 bp, Artificial Sequence
  chemically synthesized
tctgaatttttattatatgt

SEQ ID NO: 459831 - DNA, 20 bp, Artificial Sequence
  chemically synthesized
acttacatataataaaaatt

SEQ ID NO: 459832 - DNA, 20 bp, Artificial Sequence
  chemically synthesized
ttcagatgttatatttttcc

SEQ ID NO: 459833 - DNA, 20 bp, Artificial Sequence
  chemically synthesized
aattaaaaaagatataatct

SEQ ID NO: 459834 - DNA, 20 bp, Artificial Sequence
  chemically synthesized
aaattaaaaaagatataatc

SEQ ID NO: 459835 - DNA, 20 bp, Artificial Sequence
  chemically synthesized
ttatttttacaaaattaaaa

SEQ ID NO: 459836 - DNA, 20 bp, Artificial Sequence
  chemically synthesized
aaaaataaataaataaataa

SEQ ID NO: 459837 - DNA, 20 bp, Artificial Sequence
  chemically synthesized
aaataaataaataaataaaa

SEQ ID NO: 459838 - DNA, 20 bp, Artificial Sequence
  chemically synthesized
gagtttgacatttcactcac

SEQ ID NO: 459839 - DNA, 20 bp, Artificial Sequence
  chemically synthesized
tctttctaaggatgactcgt

SEQ ID NO: 459840 - DNA, 20 bp, Artificial Sequence
  chemically synthesized
tttcactcacgagtcatcct

SEQ ID NO: 459841 - DNA, 20 bp, Artificial Sequence
  chemically synthesized
actcacgagtcatccttaga

SEQ ID NO: 459842 - DNA, 20 bp, Artificial Sequence
  chemically synthesized
tcacgagtcatccttagaaa

SEQ ID NO: 459843 - DNA, 20 bp, Artificial Sequence
  chemically synthesized
ctgatcttttactctttcta

SEQ ID NO: 459844 - DNA, 20 bp, Artificial Sequence
  chemically synthesized
tctgatcttttactctttct

SEQ ID NO: 459845 - DNA, 20 bp, Artificial Sequence
  chemically synthesized
gtcatccttagaaagagtaa

SEQ ID NO: 459846 - DNA, 20 bp, Artificial Sequence
  chemically synthesized
ccttagaaagagtaaaagat

SEQ ID NO: 459847 - DNA, 20 bp, Artificial Sequence
  chemically synthesized
ttagaaagagtaaaagatca

SEQ ID NO: 459848 - DNA, 20 bp, Artificial Sequence
  chemically synthesized
tagaaagagtaaaagatcag

SEQ ID NO: 459849 - DNA, 20 bp, Artificial Sequence
  chemically synthesized
aagagtaaaagatcagaggc

SEQ ID NO: 459850 - DNA, 20 bp, Artificial Sequence
  chemically synthesized
agagtaaaagatcagaggct

SEQ ID NO: 459851 - DNA, 20 bp, Artificial Sequence
  chemically synthesized
aaaagatcagaggctgggca

SEQ ID NO: 459852 - DNA, 20 bp, Artificial Sequence
  chemically synthesized
agatcagaggctgggcacgg

SEQ ID NO: 459853 - DNA, 20 bp, Artificial Sequence
  chemically synthesized
caggcgtgagccaccgtgcc

SEQ ID NO: 459854 - DNA, 20 bp, Artificial Sequence
  chemically synthesized
agttctgggattacaggcgt

SEQ ID NO: 459855 - DNA, 20 bp, Artificial Sequence
  chemically synthesized
gtggctcacgcctgtaatcc

SEQ ID NO: 459856 - DNA, 20 bp, Artificial Sequence
  chemically synthesized
tcccaaagttctgggattac

SEQ ID NO: 459857 - DNA, 20 bp, Artificial Sequence
  chemically synthesized
ctcccaaagttctgggatta

SEQ ID NO: 459858 - DNA, 20 bp, Artificial Sequence
  chemically synthesized
cgcctgtaatcccagaactt

SEQ ID NO: 459859 - DNA, 20 bp, Artificial Sequence
  chemically synthesized
ccttggcctcccaaagttct

SEQ ID NO: 459860 - DNA, 20 bp, Artificial Sequence
  chemically synthesized
gcctgtaatcccagaacttt

SEQ ID NO: 459861 - DNA, 20 bp, Artificial Sequence
  chemically synthesized
gccttggcctcccaaagttc

SEQ ID NO: 459862 - DNA, 20 bp, Artificial Sequence
  chemically synthesized
ctgtaatcccagaactttgg

SEQ ID NO: 459863 - DNA, 20 bp, Artificial Sequence
  chemically synthesized
tgtaatcccagaactttggg

SEQ ID NO: 459864 - DNA, 20 bp, Artificial Sequence
  chemically synthesized
ccgcccgccttggcctccca

SEQ ID NO: 459865 - DNA, 20 bp, Artificial Sequence
  chemically synthesized
tcccagaactttgggaggcc

SEQ ID NO: 459866 - DNA, 20 bp, Artificial Sequence
  chemically synthesized
cccagaactttgggaggcca

SEQ ID NO: 459867 - DNA, 20 bp, Artificial Sequence
  chemically synthesized
agaactttgggaggccaagg

SEQ ID NO: 459868 - DNA, 20 bp, Artificial Sequence
  chemically synthesized
gaactttgggaggccaaggc

SEQ ID NO: 459869 - DNA, 20 bp, Artificial Sequence
  chemically synthesized
ctttgggaggccaaggcggg

SEQ ID NO: 459870 - DNA, 20 bp, Artificial Sequence
  chemically synthesized
ctcaggtgatccgcccgcct

SEQ ID NO: 459871 - DNA, 20 bp, Artificial Sequence
  chemically synthesized
ccaaggcgggcggatcacct

SEQ ID NO: 459872 - DNA, 20 bp, Artificial Sequence
  chemically synthesized
caaggcgggcggatcacctg

SEQ ID NO: 459873 - DNA, 20 bp, Artificial Sequence
  chemically synthesized
gcgggcggatcacctgaggt

SEQ ID NO: 459874 - DNA, 20 bp, Artificial Sequence
  chemically synthesized
cgggcggatcacctgaggtc

SEQ ID NO: 459875 - DNA, 20 bp, Artificial Sequence
  chemically synthesized
ggtctcgaactcctgacctc

SEQ ID NO: 459876 - DNA, 20 bp, Artificial Sequence
  chemically synthesized
ggcggatcacctgaggtcag

SEQ ID NO: 459877 - DNA, 20 bp, Artificial Sequence
  chemically synthesized
tggtctcgaactcctgacct

SEQ ID NO: 459878 - DNA, 20 bp, Artificial Sequence
  chemically synthesized
tcacctgaggtcaggagttc

SEQ ID NO: 459879 - DNA, 20 bp, Artificial Sequence
  chemically synthesized
tcaggagttcgagaccatcc

SEQ ID NO: 459880 - DNA, 20 bp, Artificial Sequence
  chemically synthesized
tttcactgtgttagccagga

SEQ ID NO: 459881 - DNA, 20 bp, Artificial Sequence
  chemically synthesized
ggggtttcactgtgttagcc

SEQ ID NO: 459882 - DNA, 20 bp, Artificial Sequence
  chemically synthesized
cgagaccatcctggctaaca

SEQ ID NO: 459883 - DNA, 20 bp, Artificial Sequence
  chemically synthesized
cggggtttcactgtgttagc

SEQ ID NO: 459884 - DNA, 20 bp, Artificial Sequence
  chemically synthesized
gagacggggtttcactgtgt

SEQ ID NO: 459885 - DNA, 20 bp, Artificial Sequence
  chemically synthesized
ttgtatttttagtagagacg

SEQ ID NO: 459886 - DNA, 20 bp, Artificial Sequence
  chemically synthesized
tttgtatttttagtagagac

SEQ ID NO: 459887 - DNA, 20 bp, Artificial Sequence
  chemically synthesized
ttttgtatttttagtagaga

SEQ ID NO: 459888 - DNA, 20 bp, Artificial Sequence
  chemically synthesized
aattttttgtatttttagta

SEQ ID NO: 459889 - DNA, 20 bp, Artificial Sequence
  chemically synthesized
ctaattttttgtatttttag

SEQ ID NO: 459890 - DNA, 20 bp, Artificial Sequence
  chemically synthesized
cagctaattttttgtatttt

SEQ ID NO: 459891 - DNA, 20 bp, Artificial Sequence
  chemically synthesized
ctactaaaaatacaaaaaat

SEQ ID NO: 459892 - DNA, 20 bp, Artificial Sequence
  chemically synthesized
taaaaatacaaaaaattagc

SEQ ID NO: 459893 - DNA, 20 bp, Artificial Sequence
  chemically synthesized
aaaaatacaaaaaattagct

SEQ ID NO: 459894 - DNA, 20 bp, Artificial Sequence
  chemically synthesized
aaaaaattagctgggtgtcg

SEQ ID NO: 459895 - DNA, 20 bp, Artificial Sequence
  chemically synthesized
caggcgtatgccacgacacc

SEQ ID NO: 459896 - DNA, 20 bp, Artificial Sequence
  chemically synthesized
ggtgtcgtggcatacgcctg

SEQ ID NO: 459897 - DNA, 20 bp, Artificial Sequence
  chemically synthesized
gtggcatacgcctgtagtcc

SEQ ID NO: 459898 - DNA, 20 bp, Artificial Sequence
  chemically synthesized
tcccaagtagctgggactac

SEQ ID NO: 459899 - DNA, 20 bp, Artificial Sequence
  chemically synthesized
ctcccaagtagctgggacta

SEQ ID NO: 459900 - DNA, 20 bp, Artificial Sequence
  chemically synthesized
cgcctgtagtcccagctact

SEQ ID NO: 459901 - DNA, 20 bp, Artificial Sequence
  chemically synthesized
cctcagcctcccaagtagct

SEQ ID NO: 459902 - DNA, 20 bp, Artificial Sequence
  chemically synthesized
gcctgtagtcccagctactt

SEQ ID NO: 459903 - DNA, 20 bp, Artificial Sequence
  chemically synthesized
gcctcagcctcccaagtagc

SEQ ID NO: 459904 - DNA, 20 bp, Artificial Sequence
  chemically synthesized
ctgtagtcccagctacttgg

SEQ ID NO: 459905 - DNA, 20 bp, Artificial Sequence
  chemically synthesized
tgtagtcccagctacttggg

SEQ ID NO: 459906 - DNA, 20 bp, Artificial Sequence
  chemically synthesized
tcctgcctcagcctcccaag

SEQ ID NO: 459907 - DNA, 20 bp, Artificial Sequence
  chemically synthesized
ttctcctgcctcagcctccc

SEQ ID NO: 459908 - DNA, 20 bp, Artificial Sequence
  chemically synthesized
tcccagctacttgggaggct

SEQ ID NO: 459909 - DNA, 20 bp, Artificial Sequence
  chemically synthesized
cccagctacttgggaggctg

SEQ ID NO: 459910 - DNA, 20 bp, Artificial Sequence
  chemically synthesized
agctacttgggaggctgagg

SEQ ID NO: 459911 - DNA, 20 bp, Artificial Sequence
  chemically synthesized
gctacttgggaggctgaggc

SEQ ID NO: 459912 - DNA, 20 bp, Artificial Sequence
  chemically synthesized
tacttgggaggctgaggcag

SEQ ID NO: 459913 - DNA, 20 bp, Artificial Sequence
  chemically synthesized
ttcaagtgattctcctgcct

SEQ ID NO: 459914 - DNA, 20 bp, Artificial Sequence
  chemically synthesized
gcaggagaatcacttgaacc

SEQ ID NO: 459915 - DNA, 20 bp, Artificial Sequence
  chemically synthesized
caggagaatcacttgaaccc

SEQ ID NO: 459916 - DNA, 20 bp, Artificial Sequence
  chemically synthesized
aacttctgcctcccgggttc

SEQ ID NO: 459917 - DNA, 20 bp, Artificial Sequence
  chemically synthesized
ggagaatcacttgaacccgg

SEQ ID NO: 459918 - DNA, 20 bp, Artificial Sequence
  chemically synthesized
gagaatcacttgaacccggg

SEQ ID NO: 459919 - DNA, 20 bp, Artificial Sequence
  chemically synthesized
aatcacttgaacccgggagg

SEQ ID NO: 459920 - DNA, 20 bp, Artificial Sequence
  chemically synthesized
cactgtaacttctgcctccc

SEQ ID NO: 459921 - DNA, 20 bp, Artificial Sequence
  chemically synthesized
tcactgtaacttctgcctcc

SEQ ID NO: 459922 - DNA, 20 bp, Artificial Sequence
  chemically synthesized
cacttgaacccgggaggcag

SEQ ID NO: 459923 - DNA, 20 bp, Artificial Sequence
  chemically synthesized
aacccgggaggcagaagtta

SEQ ID NO: 459924 - DNA, 20 bp, Artificial Sequence
  chemically synthesized
cgggaggcagaagttacagt

SEQ ID NO: 459925 - DNA, 20 bp, Artificial Sequence
  chemically synthesized
ggccggagtgcagtggcgca

SEQ ID NO: 459926 - DNA, 20 bp, Artificial Sequence
  chemically synthesized
tcacccaggccggagtgcag

SEQ ID NO: 459927 - DNA, 20 bp, Artificial Sequence
  chemically synthesized
agccatgcgccactgcactc

SEQ ID NO: 459928 - DNA, 20 bp, Artificial Sequence
  chemically synthesized
ctgtcacccaggccggagtg

SEQ ID NO: 459929 - DNA, 20 bp, Artificial Sequence
  chemically synthesized
tgcgccactgcactccggcc

SEQ ID NO: 459930 - DNA, 20 bp, Artificial Sequence
  chemically synthesized
gcgccactgcactccggcct

SEQ ID NO: 459931 - DNA, 20 bp, Artificial Sequence
  chemically synthesized
tcgctctgtcacccaggccg

SEQ ID NO: 459932 - DNA, 20 bp, Artificial Sequence
  chemically synthesized
tctcgctctgtcacccaggc

SEQ ID NO: 459933 - DNA, 20 bp, Artificial Sequence
  chemically synthesized
ctgcactccggcctgggtga

SEQ ID NO: 459934 - DNA, 20 bp, Artificial Sequence
  chemically synthesized
ggagtctcgctctgtcaccc

SEQ ID NO: 459935 - DNA, 20 bp, Artificial Sequence
  chemically synthesized
gcactccggcctgggtgaca

SEQ ID NO: 459936 - DNA, 20 bp, Artificial Sequence
  chemically synthesized
tggagtctcgctctgtcacc

SEQ ID NO: 459937 - DNA, 20 bp, Artificial Sequence
  chemically synthesized
tccggcctgggtgacagagc

SEQ ID NO: 459938 - DNA, 20 bp, Artificial Sequence
  chemically synthesized
gacagagcgagactccatct

SEQ ID NO: 459939 - DNA, 20 bp, Artificial Sequence
  chemically synthesized
tttatattttttctgagatg

SEQ ID NO: 459940 - DNA, 20 bp, Artificial Sequence
  chemically synthesized
tatttatattttttctgaga

SEQ ID NO: 459941 - DNA, 20 bp, Artificial Sequence
  chemically synthesized
tatatatttatattttttct

SEQ ID NO: 459942 - DNA, 20 bp, Artificial Sequence
  chemically synthesized
tcagaaaaaatataaatata

SEQ ID NO: 459943 - DNA, 20 bp, Artificial Sequence
  chemically synthesized
aatataaatatatagaaata

SEQ ID NO: 459944 - DNA, 20 bp, Artificial Sequence
  chemically synthesized
aaatatatagaaataaagat

SEQ ID NO: 459945 - DNA, 20 bp, Artificial Sequence
  chemically synthesized
atatagaaataaagatcaga

SEQ ID NO: 459946 - DNA, 20 bp, Artificial Sequence
  chemically synthesized
tatagaaataaagatcagaa

SEQ ID NO: 459947 - DNA, 20 bp, Artificial Sequence
  chemically synthesized
agatcagaaaggcccattgt

SEQ ID NO: 459948 - DNA, 20 bp, Artificial Sequence
  chemically synthesized
gaaccattagtacttacaat

SEQ ID NO: 459949 - DNA, 20 bp, Artificial Sequence
  chemically synthesized
ggaaccattagtacttacaa

SEQ ID NO: 459950 - DNA, 20 bp, Artificial Sequence
  chemically synthesized
aggcccattgtaagtactaa

SEQ ID NO: 459951 - DNA, 20 bp, Artificial Sequence
  chemically synthesized
attgtaagtactaatggttc

SEQ ID NO: 459952 - DNA, 20 bp, Artificial Sequence
  chemically synthesized
ctgtatctcactggaaccat

SEQ ID NO: 459953 - DNA, 20 bp, Artificial Sequence
  chemically synthesized
taagtactaatggttccagt

SEQ ID NO: 459954 - DNA, 20 bp, Artificial Sequence
  chemically synthesized
tgctgcctgctgtatctcac

SEQ ID NO: 459955 - DNA, 20 bp, Artificial Sequence
  chemically synthesized
ctaatggttccagtgagata

SEQ ID NO: 459956 - DNA, 20 bp, Artificial Sequence
  chemically synthesized
atggttccagtgagatacag

SEQ ID NO: 459957 - DNA, 20 bp, Artificial Sequence
  chemically synthesized
tggttccagtgagatacagc

SEQ ID NO: 459958 - DNA, 20 bp, Artificial Sequence
  chemically synthesized
ttccagtgagatacagcagg

SEQ ID NO: 459959 - DNA, 20 bp, Artificial Sequence
  chemically synthesized
gtgagatacagcaggcagca

SEQ ID NO: 459960 - DNA, 20 bp, Artificial Sequence
  chemically synthesized
gatacagcaggcagcacagt

SEQ ID NO: 459961 - DNA, 20 bp, Artificial Sequence
  chemically synthesized
acagcaggcagcacagtaag

SEQ ID NO: 459962 - DNA, 20 bp, Artificial Sequence
  chemically synthesized
gtaagcagcgcctctattgt

SEQ ID NO: 459963 - DNA, 20 bp, Artificial Sequence
  chemically synthesized
gctttctaccctaacaatag

SEQ ID NO: 459964 - DNA, 20 bp, Artificial Sequence
  chemically synthesized
taagcagcgcctctattgtt

SEQ ID NO: 459965 - DNA, 20 bp, Artificial Sequence
  chemically synthesized
tgctttctaccctaacaata

SEQ ID NO: 459966 - DNA, 20 bp, Artificial Sequence
  chemically synthesized
aagcagcgcctctattgtta

SEQ ID NO: 459967 - DNA, 20 bp, Artificial Sequence
  chemically synthesized
actgctttctaccctaacaa

SEQ ID NO: 459968 - DNA, 20 bp, Artificial Sequence
  chemically synthesized
cagcgcctctattgttaggg

SEQ ID NO: 459969 - DNA, 20 bp, Artificial Sequence
  chemically synthesized
gcctctattgttagggtaga

SEQ ID NO: 459970 - DNA, 20 bp, Artificial Sequence
  chemically synthesized
tctattgttagggtagaaag

SEQ ID NO: 459971 - DNA, 20 bp, Artificial Sequence
  chemically synthesized
gttagggtagaaagcagtca

SEQ ID NO: 459972 - DNA, 20 bp, Artificial Sequence
  chemically synthesized
ttagggtagaaagcagtcac

SEQ ID NO: 459973 - DNA, 20 bp, Artificial Sequence
  chemically synthesized
gggtagaaagcagtcacagg

SEQ ID NO: 459974 - DNA, 20 bp, Artificial Sequence
  chemically synthesized
ggcagaaattcaataaaaat

SEQ ID NO: 459975 - DNA, 20 bp, Artificial Sequence
  chemically synthesized
agaaattcaataaaaataag

SEQ ID NO: 459976 - DNA, 20 bp, Artificial Sequence
  chemically synthesized
aaataagaagaaaaatattt

SEQ ID NO: 459977 - DNA, 20 bp, Artificial Sequence
  chemically synthesized
ataagaagaaaaatatttta

SEQ ID NO: 459978 - DNA, 20 bp, Artificial Sequence
  chemically synthesized
tttgaaggaggtaggatttg

SEQ ID NO: 459979 - DNA, 20 bp, Artificial Sequence
  chemically synthesized
ttttgaaggaggtaggattt

SEQ ID NO: 459980 - DNA, 20 bp, Artificial Sequence
  chemically synthesized
cttttgaaggaggtaggatt

SEQ ID NO: 459981 - DNA, 20 bp, Artificial Sequence
  chemically synthesized
gagtaacttttgaaggaggt

SEQ ID NO: 459982 - DNA, 20 bp, Artificial Sequence
  chemically synthesized
tgagtaacttttgaaggagg

SEQ ID NO: 459983 - DNA, 20 bp, Artificial Sequence
  chemically synthesized
ccaaatcctacctccttcaa

SEQ ID NO: 459984 - DNA, 20 bp, Artificial Sequence
  chemically synthesized
ggatgagtaacttttgaagg

SEQ ID NO: 459985 - DNA, 20 bp, Artificial Sequence
  chemically synthesized
tggatgagtaacttttgaag

SEQ ID NO: 459986 - DNA, 20 bp, Artificial Sequence
  chemically synthesized
tttggatgagtaacttttga

SEQ ID NO: 459987 - DNA, 20 bp, Artificial Sequence
  chemically synthesized
ttttggatgagtaacttttg

SEQ ID NO: 459988 - DNA, 20 bp, Artificial Sequence
  chemically synthesized
gtttaaaaaggattttggat

SEQ ID NO: 459989 - DNA, 20 bp, Artificial Sequence
  chemically synthesized
ttacagtttaaaaaggattt

SEQ ID NO: 459990 - DNA, 20 bp, Artificial Sequence
  chemically synthesized
cagaatgttacagtttaaaa

SEQ ID NO: 459991 - DNA, 20 bp, Artificial Sequence
  chemically synthesized
acagaatgttacagtttaaa

SEQ ID NO: 459992 - DNA, 20 bp, Artificial Sequence
  chemically synthesized
ggtgtctgtacagaatgtta

SEQ ID NO: 459993 - DNA, 20 bp, Artificial Sequence
  chemically synthesized
ttaaactgtaacattctgta

SEQ ID NO: 459994 - DNA, 20 bp, Artificial Sequence
  chemically synthesized
ttgaaaaactggtgtctgta

SEQ ID NO: 459995 - DNA, 20 bp, Artificial Sequence
  chemically synthesized
gtaacattctgtacagacac

SEQ ID NO: 459996 - DNA, 20 bp, Artificial Sequence
  chemically synthesized
agcaattatatttgaaaaac

SEQ ID NO: 459997 - DNA, 20 bp, Artificial Sequence
  chemically synthesized
gtttttcaaatataattgct

SEQ ID NO: 459998 - DNA, 20 bp, Artificial Sequence
  chemically synthesized
aaatataattgctaagatgt

SEQ ID NO: 459999 - DNA, 20 bp, Artificial Sequence
  chemically synthesized
aatataattgctaagatgtg

SEQ ID NO: 460000 - DNA, 20 bp, Artificial Sequence
  chemically synthesized
tatgtttatgcctcacatct

SEQ ID NO: 460001 - DNA, 20 bp, Artificial Sequence
  chemically synthesized
acgtggtactcaatgaaatt

SEQ ID NO: 460002 - DNA, 20 bp, Artificial Sequence
  chemically synthesized
acataaatctaaatttcatt

SEQ ID NO: 460003 - DNA, 20 bp, Artificial Sequence
  chemically synthesized
gataatagctgaacattacg

SEQ ID NO: 460004 - DNA, 20 bp, Artificial Sequence
  chemically synthesized
attgagtaccacgtaatgtt

SEQ ID NO: 460005 - DNA, 20 bp, Artificial Sequence
  chemically synthesized
tgtgtttccaagtatgataa

SEQ ID NO: 460006 - DNA, 20 bp, Artificial Sequence
  chemically synthesized
tgttcagctattatcatact

SEQ ID NO: 460007 - DNA, 20 bp, Artificial Sequence
  chemically synthesized
cattttatccatgtgtttcc

SEQ ID NO: 460008 - DNA, 20 bp, Artificial Sequence
  chemically synthesized
ttatcatacttggaaacaca

SEQ ID NO: 460009 - DNA, 20 bp, Artificial Sequence
  chemically synthesized
ggataaaatgaatgttgaaa

SEQ ID NO: 460010 - DNA, 20 bp, Artificial Sequence
  chemically synthesized
tgttgaaatagtcatgactc

SEQ ID NO: 460011 - DNA, 20 bp, Artificial Sequence
  chemically synthesized
gcgcattggtagacatacca

SEQ ID NO: 460012 - DNA, 20 bp, Artificial Sequence
  chemically synthesized
ctgcgcattggtagacatac

SEQ ID NO: 460013 - DNA, 20 bp, Artificial Sequence
  chemically synthesized
ataaatcaactgcgcattgg

SEQ ID NO: 460014 - DNA, 20 bp, Artificial Sequence
  chemically synthesized
ctggtatgtctaccaatgcg

SEQ ID NO: 460015 - DNA, 20 bp, Artificial Sequence
  chemically synthesized
agtataaatcaactgcgcat

SEQ ID NO: 460016 - DNA, 20 bp, Artificial Sequence
  chemically synthesized
ggcacattcacaataaatga

SEQ ID NO: 460017 - DNA, 20 bp, Artificial Sequence
  chemically synthesized
cataagtagcttgtcattta

SEQ ID NO: 460018 - DNA, 20 bp, Artificial Sequence
  chemically synthesized
gtgaatgtgccataaatgac

SEQ ID NO: 460019 - DNA, 20 bp, Artificial Sequence
  chemically synthesized
gttcaattcaatgtcataag

SEQ ID NO: 460020 - DNA, 20 bp, Artificial Sequence
  chemically synthesized
atggttcaattcaatgtcat

SEQ ID NO: 460021 - DNA, 20 bp, Artificial Sequence
  chemically synthesized
ttgaattgaaccattctttt

SEQ ID NO: 460022 - DNA, 20 bp, Artificial Sequence
  chemically synthesized
atagagacttccaaaaagaa

SEQ ID NO: 460023 - DNA, 20 bp, Artificial Sequence
  chemically synthesized
aattgaaccattctttttgg

SEQ ID NO: 460024 - DNA, 20 bp, Artificial Sequence
  chemically synthesized
ctggcatagagacttccaaa

SEQ ID NO: 460025 - DNA, 20 bp, Artificial Sequence
  chemically synthesized
ctttttggaagtctctatgc

SEQ ID NO: 460026 - DNA, 20 bp, Artificial Sequence
  chemically synthesized
ttagaacaatgtctggcata

SEQ ID NO: 460027 - DNA, 20 bp, Artificial Sequence
  chemically synthesized
ctttagaacaatgtctggca

SEQ ID NO: 460028 - DNA, 20 bp, Artificial Sequence
  chemically synthesized
ttagcctttagaacaatgtc

SEQ ID NO: 460029 - DNA, 20 bp, Artificial Sequence
  chemically synthesized
ctatgccagacattgttcta

SEQ ID NO: 460030 - DNA, 20 bp, Artificial Sequence
  chemically synthesized
tatgccagacattgttctaa

SEQ ID NO: 460031 - DNA, 20 bp, Artificial Sequence
  chemically synthesized
cagacattgttctaaaggct

SEQ ID NO: 460032 - DNA, 20 bp, Artificial Sequence
  chemically synthesized
tcttttaaactcttagcctt

SEQ ID NO: 460033 - DNA, 20 bp, Artificial Sequence
  chemically synthesized
gacattgttctaaaggctaa

SEQ ID NO: 460034 - DNA, 20 bp, Artificial Sequence
  chemically synthesized
ttttgaatcttttaaactct

SEQ ID NO: 460035 - DNA, 20 bp, Artificial Sequence
  chemically synthesized
tctaaaggctaagagtttaa

SEQ ID NO: 460036 - DNA, 20 bp, Artificial Sequence
  chemically synthesized
taaaagattcaaaaacacaa

SEQ ID NO: 460037 - DNA, 20 bp, Artificial Sequence
  chemically synthesized
tcaaaaacacaatagttccc

SEQ ID NO: 460038 - DNA, 20 bp, Artificial Sequence
  chemically synthesized
gtaggaaggaaggcaaacta

SEQ ID NO: 460039 - DNA, 20 bp, Artificial Sequence
  chemically synthesized
tgtaggaaggaaggcaaact

SEQ ID NO: 460040 - DNA, 20 bp, Artificial Sequence
  chemically synthesized
atgtaggaaggaaggcaaac

SEQ ID NO: 460041 - DNA, 20 bp, Artificial Sequence
  chemically synthesized
gcaaggacatgtaggaagga

SEQ ID NO: 460042 - DNA, 20 bp, Artificial Sequence
  chemically synthesized
ggcaaggacatgtaggaagg

SEQ ID NO: 460043 - DNA, 20 bp, Artificial Sequence
  chemically synthesized
gcaggcaaggacatgtagga

SEQ ID NO: 460044 - DNA, 20 bp, Artificial Sequence
  chemically synthesized
agcaggcaaggacatgtagg

SEQ ID NO: 460045 - DNA, 20 bp, Artificial Sequence
  chemically synthesized
gagagcaggcaaggacatgt

SEQ ID NO: 460046 - DNA, 20 bp, Artificial Sequence
  chemically synthesized
ggagagcaggcaaggacatg

SEQ ID NO: 460047 - DNA, 20 bp, Artificial Sequence
  chemically synthesized
aggagttaggagagcaggca

SEQ ID NO: 460048 - DNA, 20 bp, Artificial Sequence
  chemically synthesized
taggagttaggagagcaggc

SEQ ID NO: 460049 - DNA, 20 bp, Artificial Sequence
  chemically synthesized
ggggtaggagttaggagagc

SEQ ID NO: 460050 - DNA, 20 bp, Artificial Sequence
  chemically synthesized
tggggtaggagttaggagag

SEQ ID NO: 460051 - DNA, 20 bp, Artificial Sequence
  chemically synthesized
gactggggtaggagttagga

SEQ ID NO: 460052 - DNA, 20 bp, Artificial Sequence
  chemically synthesized
aagactggggtaggagttag

SEQ ID NO: 460053 - DNA, 20 bp, Artificial Sequence
  chemically synthesized
caaagactggggtaggagtt

SEQ ID NO: 460054 - DNA, 20 bp, Artificial Sequence
  chemically synthesized
gcaaagactggggtaggagt

SEQ ID NO: 460055 - DNA, 20 bp, Artificial Sequence
  chemically synthesized
tgctctcctaactcctaccc

SEQ ID NO: 460056 - DNA, 20 bp, Artificial Sequence
  chemically synthesized
ttgggcaaagactggggtag

SEQ ID NO: 460057 - DNA, 20 bp, Artificial Sequence
  chemically synthesized
agttgggcaaagactggggt

SEQ ID NO: 460058 - DNA, 20 bp, Artificial Sequence
  chemically synthesized
aagttgggcaaagactgggg

SEQ ID NO: 460059 - DNA, 20 bp, Artificial Sequence
  chemically synthesized
ccaaagttgggcaaagactg

SEQ ID NO: 460060 - DNA, 20 bp, Artificial Sequence
  chemically synthesized
gccaaagttgggcaaagact

SEQ ID NO: 460061 - DNA, 20 bp, Artificial Sequence
  chemically synthesized
tgccaaagttgggcaaagac

SEQ ID NO: 460062 - DNA, 20 bp, Artificial Sequence
  chemically synthesized
gaaaatgccaaagttgggca

SEQ ID NO: 460063 - DNA, 20 bp, Artificial Sequence
  chemically synthesized
ccccagtctttgcccaactt

SEQ ID NO: 460064 - DNA, 20 bp, Artificial Sequence
  chemically synthesized
cttgggaaaatgccaaagtt

SEQ ID NO: 460065 - DNA, 20 bp, Artificial Sequence
  chemically synthesized
tcttgggaaaatgccaaagt

SEQ ID NO: 460066 - DNA, 20 bp, Artificial Sequence
  chemically synthesized
tctttcttgggaaaatgcca

SEQ ID NO: 460067 - DNA, 20 bp, Artificial Sequence
  chemically synthesized
cccaactttggcattttccc

SEQ ID NO: 460068 - DNA, 20 bp, Artificial Sequence
  chemically synthesized
actttggcattttcccaaga

SEQ ID NO: 460069 - DNA, 20 bp, Artificial Sequence
  chemically synthesized
cttggaatgcaatctttctt

SEQ ID NO: 460070 - DNA, 20 bp, Artificial Sequence
  chemically synthesized
tcttggaatgcaatctttct

SEQ ID NO: 460071 - DNA, 20 bp, Artificial Sequence
  chemically synthesized
cccaagaaagattgcattcc

SEQ ID NO: 460072 - DNA, 20 bp, Artificial Sequence
  chemically synthesized
agattgcattccaagaatca

SEQ ID NO: 460073 - DNA, 20 bp, Artificial Sequence
  chemically synthesized
ccaaataccactgtgattct

SEQ ID NO: 460074 - DNA, 20 bp, Artificial Sequence
  chemically synthesized
ttgcattccaagaatcacag

SEQ ID NO: 460075 - DNA, 20 bp, Artificial Sequence
  chemically synthesized
ccaagaatcacagtggtatt

SEQ ID NO: 460076 - DNA, 20 bp, Artificial Sequence
  chemically synthesized
gtggtatttggaaatatttt

SEQ ID NO: 460077 - DNA, 20 bp, Artificial Sequence
  chemically synthesized
aaattatttgttttaaaagg

SEQ ID NO: 460078 - DNA, 20 bp, Artificial Sequence
  chemically synthesized
gaaaaattatttgttttaaa

SEQ ID NO: 460079 - DNA, 20 bp, Artificial Sequence
  chemically synthesized
agaaaaattatttgttttaa

SEQ ID NO: 460080 - DNA, 20 bp, Artificial Sequence
  chemically synthesized
ttaaaacaaataatttttct

SEQ ID NO: 460081 - DNA, 20 bp, Artificial Sequence
  chemically synthesized
ttagacgattaattgattct

SEQ ID NO: 460082 - DNA, 20 bp, Artificial Sequence
  chemically synthesized
atttttactttatttaaagt

SEQ ID NO: 460083 - DNA, 20 bp, Artificial Sequence
  chemically synthesized
taatcgtctaactttaaata

SEQ ID NO: 460084 - DNA, 20 bp, Artificial Sequence
  chemically synthesized
atccatttttactttattta

SEQ ID NO: 460085 - DNA, 20 bp, Artificial Sequence
  chemically synthesized
aactttaaataaagtaaaaa

SEQ ID NO: 460086 - DNA, 20 bp, Artificial Sequence
  chemically synthesized
ttaaataaagtaaaaatgga

SEQ ID NO: 460087 - DNA, 20 bp, Artificial Sequence
  chemically synthesized
taaataaagtaaaaatggat

SEQ ID NO: 460088 - DNA, 20 bp, Artificial Sequence
  chemically synthesized
ctgtttgcctcaatatattg

SEQ ID NO: 460089 - DNA, 20 bp, Artificial Sequence
  chemically synthesized
gaattaaactccaatatatt

SEQ ID NO: 460090 - DNA, 20 bp, Artificial Sequence
  chemically synthesized
gactgtttgcctcaatatat

SEQ ID NO: 460091 - DNA, 20 bp, Artificial Sequence
  chemically synthesized
aattaaactccaatatattg

SEQ ID NO: 460092 - DNA, 20 bp, Artificial Sequence
  chemically synthesized
ctccaatatattgaggcaaa

SEQ ID NO: 460093 - DNA, 20 bp, Artificial Sequence
  chemically synthesized
taaaaaggattttcaaaata

SEQ ID NO: 460094 - DNA, 20 bp, Artificial Sequence
  chemically synthesized
tattttgaaaatccttttta

SEQ ID NO: 460095 - DNA, 20 bp, Artificial Sequence
  chemically synthesized
attttgaaaatcctttttaa

SEQ ID NO: 460096 - DNA, 20 bp, Artificial Sequence
  chemically synthesized
atttgtggaaacctttaaaa

SEQ ID NO: 460097 - DNA, 20 bp, Artificial Sequence
  chemically synthesized
tatttgtggaaacctttaaa

SEQ ID NO: 460098 - DNA, 20 bp, Artificial Sequence
  chemically synthesized
ttcctttaaagagttatttg

SEQ ID NO: 460099 - DNA, 20 bp, Artificial Sequence
  chemically synthesized
tttccacaaataactcttta

SEQ ID NO: 460100 - DNA, 20 bp, Artificial Sequence
  chemically synthesized
ttccacaaataactctttaa

SEQ ID NO: 460101 - DNA, 20 bp, Artificial Sequence
  chemically synthesized
tattagccctttcctttaaa

SEQ ID NO: 460102 - DNA, 20 bp, Artificial Sequence
  chemically synthesized
acaaataactctttaaagga

SEQ ID NO: 460103 - DNA, 20 bp, Artificial Sequence
  chemically synthesized
aatattagccctttccttta

SEQ ID NO: 460104 - DNA, 20 bp, Artificial Sequence
  chemically synthesized
caaataactctttaaaggaa

SEQ ID NO: 460105 - DNA, 20 bp, Artificial Sequence
  chemically synthesized
aaataactctttaaaggaaa

SEQ ID NO: 460106 - DNA, 20 bp, Artificial Sequence
  chemically synthesized
aattttcctgaaggaaatat

SEQ ID NO: 460107 - DNA, 20 bp, Artificial Sequence
  chemically synthesized
gaaagggctaatatttcctt

SEQ ID NO: 460108 - DNA, 20 bp, Artificial Sequence
  chemically synthesized
aaagggctaatatttccttc

SEQ ID NO: 460109 - DNA, 20 bp, Artificial Sequence
  chemically synthesized
attgttgtaaattttcctga

SEQ ID NO: 460110 - DNA, 20 bp, Artificial Sequence
  chemically synthesized
gattgttgtaaattttcctg

SEQ ID NO: 460111 - DNA, 20 bp, Artificial Sequence
  chemically synthesized
tgaagatctagtttggttaa

SEQ ID NO: 460112 - DNA, 20 bp, Artificial Sequence
  chemically synthesized
caacaatctgttaaccaaac

SEQ ID NO: 460113 - DNA, 20 bp, Artificial Sequence
  chemically synthesized
aggggcttgaagatctagtt

SEQ ID NO: 460114 - DNA, 20 bp, Artificial Sequence
  chemically synthesized
gttaaccaaactagatcttc

SEQ ID NO: 460115 - DNA, 20 bp, Artificial Sequence
  chemically synthesized
tggtaaggggcttgaagatc

SEQ ID NO: 460116 - DNA, 20 bp, Artificial Sequence
  chemically synthesized
aggaattggtaaggggcttg

SEQ ID NO: 460117 - DNA, 20 bp, Artificial Sequence
  chemically synthesized
tggggagaggaattggtaag

SEQ ID NO: 460118 - DNA, 20 bp, Artificial Sequence
  chemically synthesized
ttggggagaggaattggtaa

SEQ ID NO: 460119 - DNA, 20 bp, Artificial Sequence
  chemically synthesized
attggggagaggaattggta

SEQ ID NO: 460120 - DNA, 20 bp, Artificial Sequence
  chemically synthesized
aattggggagaggaattggt

SEQ ID NO: 460121 - DNA, 20 bp, Artificial Sequence
  chemically synthesized
actcaattggggagaggaat

SEQ ID NO: 460122 - DNA, 20 bp, Artificial Sequence
  chemically synthesized
gaaaacactcaattggggag

SEQ ID NO: 460123 - DNA, 20 bp, Artificial Sequence
  chemically synthesized
ggaaaacactcaattgggga

SEQ ID NO: 460124 - DNA, 20 bp, Artificial Sequence
  chemically synthesized
accaattcctctccccaatt

SEQ ID NO: 460125 - DNA, 20 bp, Artificial Sequence
  chemically synthesized
ttggaaaacactcaattggg

SEQ ID NO: 460126 - DNA, 20 bp, Artificial Sequence
  chemically synthesized
ctttggaaaacactcaattg

SEQ ID NO: 460127 - DNA, 20 bp, Artificial Sequence
  chemically synthesized
cctttggaaaacactcaatt

SEQ ID NO: 460128 - DNA, 20 bp, Artificial Sequence
  chemically synthesized
acctttggaaaacactcaat

SEQ ID NO: 460129 - DNA, 20 bp, Artificial Sequence
  chemically synthesized
ccccaattgagtgttttcca

SEQ ID NO: 460130 - DNA, 20 bp, Artificial Sequence
  chemically synthesized
cccaattgagtgttttccaa

SEQ ID NO: 460131 - DNA, 20 bp, Artificial Sequence
  chemically synthesized
ggaattccaaattggacctt

SEQ ID NO: 460132 - DNA, 20 bp, Artificial Sequence
  chemically synthesized
tgttttccaaaggtccaatt

SEQ ID NO: 460133 - DNA, 20 bp, Artificial Sequence
  chemically synthesized
aaagaaaaggaattccaaat

SEQ ID NO: 460134 - DNA, 20 bp, Artificial Sequence
  chemically synthesized
aggaaaaaaagaaaaagaaa

SEQ ID NO: 460135 - DNA, 20 bp, Artificial Sequence
  chemically synthesized
aaggaaaaaaagaaaaagaa

SEQ ID NO: 460136 - DNA, 20 bp, Artificial Sequence
  chemically synthesized
acagaaaggaaaaaaagaaa

SEQ ID NO: 460137 - DNA, 20 bp, Artificial Sequence
  chemically synthesized
ccctttacagaaaggaaaaa

SEQ ID NO: 460138 - DNA, 20 bp, Artificial Sequence
  chemically synthesized
ttctttttttcctttctgta

SEQ ID NO: 460139 - DNA, 20 bp, Artificial Sequence
  chemically synthesized
tatgctcaccctttacagaa

SEQ ID NO: 460140 - DNA, 20 bp, Artificial Sequence
  chemically synthesized
tctttttttcctttctgtaa

SEQ ID NO: 460141 - DNA, 20 bp, Artificial Sequence
  chemically synthesized
gtatgctcaccctttacaga

SEQ ID NO: 460142 - DNA, 20 bp, Artificial Sequence
  chemically synthesized
ctttttttcctttctgtaaa

SEQ ID NO: 460143 - DNA, 20 bp, Artificial Sequence
  chemically synthesized
ctaagtatgctcacccttta

SEQ ID NO: 460144 - DNA, 20 bp, Artificial Sequence
  chemically synthesized
ttttcctttctgtaaagggt

SEQ ID NO: 460145 - DNA, 20 bp, Artificial Sequence
  chemically synthesized
ctgtaaagggtgagcatact

SEQ ID NO: 460146 - DNA, 20 bp, Artificial Sequence
  chemically synthesized
tgtaaagggtgagcatactt

SEQ ID NO: 460147 - DNA, 20 bp, Artificial Sequence
  chemically synthesized
ggtgagcatacttaggaaat

SEQ ID NO: 460148 - DNA, 20 bp, Artificial Sequence
  chemically synthesized
gtaattttaactaatttcct

SEQ ID NO: 460149 - DNA, 20 bp, Artificial Sequence
  chemically synthesized
gaacaacagagcattcaatg

SEQ ID NO: 460150 - DNA, 20 bp, Artificial Sequence
  chemically synthesized
aggaacaacagagcattcaa

SEQ ID NO: 460151 - DNA, 20 bp, Artificial Sequence
  chemically synthesized
ctcaatactaaggaacaaca

SEQ ID NO: 460152 - DNA, 20 bp, Artificial Sequence
  chemically synthesized
ccctcaatactaaggaacaa

SEQ ID NO: 460153 - DNA, 20 bp, Artificial Sequence
  chemically synthesized
ttgaatgctctgttgttcct

SEQ ID NO: 460154 - DNA, 20 bp, Artificial Sequence
  chemically synthesized
ctctgttgttccttagtatt

SEQ ID NO: 460155 - DNA, 20 bp, Artificial Sequence
  chemically synthesized
tgaaccttccctcaatacta

SEQ ID NO: 460156 - DNA, 20 bp, Artificial Sequence
  chemically synthesized
tctgttgttccttagtattg

SEQ ID NO: 460157 - DNA, 20 bp, Artificial Sequence
  chemically synthesized
ttgaaccttccctcaatact

SEQ ID NO: 460158 - DNA, 20 bp, Artificial Sequence
  chemically synthesized
ctgttgttccttagtattga

SEQ ID NO: 460159 - DNA, 20 bp, Artificial Sequence
  chemically synthesized
ttgttccttagtattgaggg

SEQ ID NO: 460160 - DNA, 20 bp, Artificial Sequence
  chemically synthesized
tgttccttagtattgaggga

SEQ ID NO: 460161 - DNA, 20 bp, Artificial Sequence
  chemically synthesized
ggttcaacatatgttaattt

SEQ ID NO: 460162 - DNA, 20 bp, Artificial Sequence
  chemically synthesized
gttcaacatatgttaatttt

SEQ ID NO: 460163 - DNA, 20 bp, Artificial Sequence
  chemically synthesized
gttaattttgggaatttttt

SEQ ID NO: 460164 - DNA, 20 bp, Artificial Sequence
  chemically synthesized
ggaatttttttagatactgc

SEQ ID NO: 460165 - DNA, 20 bp, Artificial Sequence
  chemically synthesized
agctacatgtgatagtcttg

SEQ ID NO: 460166 - DNA, 20 bp, Artificial Sequence
  chemically synthesized
tactgcaagactatcacatg

SEQ ID NO: 460167 - DNA, 20 bp, Artificial Sequence
  chemically synthesized
tgagactaagctacatgtga

SEQ ID NO: 460168 - DNA, 20 bp, Artificial Sequence
  chemically synthesized
caagactatcacatgtagct

SEQ ID NO: 460169 - DNA, 20 bp, Artificial Sequence
  chemically synthesized
tcacatgtagcttagtctca

SEQ ID NO: 460170 - DNA, 20 bp, Artificial Sequence
  chemically synthesized
gatatccttgctgtgagact

SEQ ID NO: 460171 - DNA, 20 bp, Artificial Sequence
  chemically synthesized
atgtagcttagtctcacagc

SEQ ID NO: 460172 - DNA, 20 bp, Artificial Sequence
  chemically synthesized
tgtagcttagtctcacagca

SEQ ID NO: 460173 - DNA, 20 bp, Artificial Sequence
  chemically synthesized
tgtgtggatatccttgctgt

SEQ ID NO: 460174 - DNA, 20 bp, Artificial Sequence
  chemically synthesized
cttgctaatagcacgttgtg

SEQ ID NO: 460175 - DNA, 20 bp, Artificial Sequence
  chemically synthesized
atatccacacaacgtgctat

SEQ ID NO: 460176 - DNA, 20 bp, Artificial Sequence
  chemically synthesized
ccacacaacgtgctattagc

SEQ ID NO: 460177 - DNA, 20 bp, Artificial Sequence
  chemically synthesized
gctggcatcctacttgctaa

SEQ ID NO: 460178 - DNA, 20 bp, Artificial Sequence
  chemically synthesized
cacaacgtgctattagcaag

SEQ ID NO: 460179 - DNA, 20 bp, Artificial Sequence
  chemically synthesized
acaacgtgctattagcaagt

SEQ ID NO: 460180 - DNA, 20 bp, Artificial Sequence
  chemically synthesized
gctattagcaagtaggatgc

SEQ ID NO: 460181 - DNA, 20 bp, Artificial Sequence
  chemically synthesized
aagtaggatgccagccgcca

SEQ ID NO: 460182 - DNA, 20 bp, Artificial Sequence
  chemically synthesized
taatactggtctgtggcggc

SEQ ID NO: 460183 - DNA, 20 bp, Artificial Sequence
  chemically synthesized
aggctaatactggtctgtgg

SEQ ID NO: 460184 - DNA, 20 bp, Artificial Sequence
  chemically synthesized
ggatgccagccgccacagac

SEQ ID NO: 460185 - DNA, 20 bp, Artificial Sequence
  chemically synthesized
attaggctaatactggtctg

SEQ ID NO: 460186 - DNA, 20 bp, Artificial Sequence
  chemically synthesized
cagccgccacagaccagtat

SEQ ID NO: 460187 - DNA, 20 bp, Artificial Sequence
  chemically synthesized
tcatcctattaggctaatac

SEQ ID NO: 460188 - DNA, 20 bp, Artificial Sequence
  chemically synthesized
acagaccagtattagcctaa

SEQ ID NO: 460189 - DNA, 20 bp, Artificial Sequence
  chemically synthesized
cagaccagtattagcctaat

SEQ ID NO: 460190 - DNA, 20 bp, Artificial Sequence
  chemically synthesized
aaaatatctttcatcctatt

SEQ ID NO: 460191 - DNA, 20 bp, Artificial Sequence
  chemically synthesized
caaaatatctttcatcctat

SEQ ID NO: 460192 - DNA, 20 bp, Artificial Sequence
  chemically synthesized
gtattagcctaataggatga

SEQ ID NO: 460193 - DNA, 20 bp, Artificial Sequence
  chemically synthesized
tttgatataaacaaacatgc

SEQ ID NO: 460194 - DNA, 20 bp, Artificial Sequence
  chemically synthesized
aacaaacatgcgagaccaca

SEQ ID NO: 460195 - DNA, 20 bp, Artificial Sequence
  chemically synthesized
aacatgcgagaccacacagt

SEQ ID NO: 460196 - DNA, 20 bp, Artificial Sequence
  chemically synthesized
taaaatgtttactgactgtg

SEQ ID NO: 460197 - DNA, 20 bp, Artificial Sequence
  chemically synthesized
cacagtcagtaaacatttta

SEQ ID NO: 460198 - DNA, 20 bp, Artificial Sequence
  chemically synthesized
agtaaacattttatagacaa

SEQ ID NO: 460199 - DNA, 20 bp, Artificial Sequence
  chemically synthesized
gtaaacattttatagacaaa

SEQ ID NO: 460200 - DNA, 20 bp, Artificial Sequence
  chemically synthesized
aaacattttatagacaaaag

SEQ ID NO: 460201 - DNA, 20 bp, Artificial Sequence
  chemically synthesized
aggccaaatgaatgtcatta

SEQ ID NO: 460202 - DNA, 20 bp, Artificial Sequence
  chemically synthesized
aaaggccaaatgaatgtcat

SEQ ID NO: 460203 - DNA, 20 bp, Artificial Sequence
  chemically synthesized
gaactctaatgacattcatt

SEQ ID NO: 460204 - DNA, 20 bp, Artificial Sequence
  chemically synthesized
aatgacattcatttggcctt

SEQ ID NO: 460205 - DNA, 20 bp, Artificial Sequence
  chemically synthesized
tgacattcatttggcctttg

SEQ ID NO: 460206 - DNA, 20 bp, Artificial Sequence
  chemically synthesized
acattcatttggcctttgga

SEQ ID NO: 460207 - DNA, 20 bp, Artificial Sequence
  chemically synthesized
cattcatttggcctttggag

SEQ ID NO: 460208 - DNA, 20 bp, Artificial Sequence
  chemically synthesized
cccgaatgcatcctctccaa

SEQ ID NO: 460209 - DNA, 20 bp, Artificial Sequence
  chemically synthesized
ccccgaatgcatcctctcca

SEQ ID NO: 460210 - DNA, 20 bp, Artificial Sequence
  chemically synthesized
gcctttggagaggatgcatt

SEQ ID NO: 460211 - DNA, 20 bp, Artificial Sequence
  chemically synthesized
cctttggagaggatgcattc

SEQ ID NO: 460212 - DNA, 20 bp, Artificial Sequence
  chemically synthesized
ctttggagaggatgcattcg

SEQ ID NO: 460213 - DNA, 20 bp, Artificial Sequence
  chemically synthesized
ggggcatttttcatgttata

SEQ ID NO: 460214 - DNA, 20 bp, Artificial Sequence
  chemically synthesized
gggcatttttcatgttataa

SEQ ID NO: 460215 - DNA, 20 bp, Artificial Sequence
  chemically synthesized
aaaggataattgaatccaaa

SEQ ID NO: 460216 - DNA, 20 bp, Artificial Sequence
  chemically synthesized
gttcccatatgaacactgtt

SEQ ID NO: 460217 - DNA, 20 bp, Artificial Sequence
  chemically synthesized
gaatccaaacagtgttcata

SEQ ID NO: 460218 - DNA, 20 bp, Artificial Sequence
  chemically synthesized
aatccaaacagtgttcatat

SEQ ID NO: 460219 - DNA, 20 bp, Artificial Sequence
  chemically synthesized
gtgttcatatgggaacacta

SEQ ID NO: 460220 - DNA, 20 bp, Artificial Sequence
  chemically synthesized
gttatgtactgttagagctt

SEQ ID NO: 460221 - DNA, 20 bp, Artificial Sequence
  chemically synthesized
tgggaacactaaagctctaa

SEQ ID NO: 460222 - DNA, 20 bp, Artificial Sequence
  chemically synthesized
ggctctgttatgtactgtta

SEQ ID NO: 460223 - DNA, 20 bp, Artificial Sequence
  chemically synthesized
ttggctctgttatgtactgt

SEQ ID NO: 460224 - DNA, 20 bp, Artificial Sequence
  chemically synthesized
aaagctctaacagtacataa

SEQ ID NO: 460225 - DNA, 20 bp, Artificial Sequence
  chemically synthesized
agctctaacagtacataaca

SEQ ID NO: 460226 - DNA, 20 bp, Artificial Sequence
  chemically synthesized
taacagtacataacagagcc

SEQ ID NO: 460227 - DNA, 20 bp, Artificial Sequence
  chemically synthesized
agtacataacagagccaagt

SEQ ID NO: 460228 - DNA, 20 bp, Artificial Sequence
  chemically synthesized
aaatattaaaaagtctgact

SEQ ID NO: 460229 - DNA, 20 bp, Artificial Sequence
  chemically synthesized
aagaacatataaatattaaa

SEQ ID NO: 460230 - DNA, 20 bp, Artificial Sequence
  chemically synthesized
ttaatatttatatgttcttt

SEQ ID NO: 460231 - DNA, 20 bp, Artificial Sequence
  chemically synthesized
taatatttatatgttctttt

SEQ ID NO: 460232 - DNA, 20 bp, Artificial Sequence
  chemically synthesized
aatatttatatgttctttta

SEQ ID NO: 460233 - DNA, 20 bp, Artificial Sequence
  chemically synthesized
aaccagaacaatttccctaa

SEQ ID NO: 460234 - DNA, 20 bp, Artificial Sequence
  chemically synthesized
ttcttttagggaaattgttc

SEQ ID NO: 460235 - DNA, 20 bp, Artificial Sequence
  chemically synthesized
ggaaattgttctggttcctg

SEQ ID NO: 460236 - DNA, 20 bp, Artificial Sequence
  chemically synthesized
tattaatcatctgcaggaac

SEQ ID NO: 460237 - DNA, 20 bp, Artificial Sequence
  chemically synthesized
aggtattattaatcatctgc

SEQ ID NO: 460238 - DNA, 20 bp, Artificial Sequence
  chemically synthesized
caggtattattaatcatctg

SEQ ID NO: 460239 - DNA, 20 bp, Artificial Sequence
  chemically synthesized
gtgaattatgcaaatgcagc

SEQ ID NO: 460240 - DNA, 20 bp, Artificial Sequence
  chemically synthesized
cgtgaattatgcaaatgcag

SEQ ID NO: 460241 - DNA, 20 bp, Artificial Sequence
  chemically synthesized
caccgtgaattatgcaaatg

SEQ ID NO: 460242 - DNA, 20 bp, Artificial Sequence
  chemically synthesized
tgctgcatttgcataattca

SEQ ID NO: 460243 - DNA, 20 bp, Artificial Sequence
  chemically synthesized
tcacggtgttaaataattaa

SEQ ID NO: 460244 - DNA, 20 bp, Artificial Sequence
  chemically synthesized
cacggtgttaaataattaac

SEQ ID NO: 460245 - DNA, 20 bp, Artificial Sequence
  chemically synthesized
gttattaacttcaattgata

SEQ ID NO: 460246 - DNA, 20 bp, Artificial Sequence
  chemically synthesized
tcataattctttatcaattg

SEQ ID NO: 460247 - DNA, 20 bp, Artificial Sequence
  chemically synthesized
tcaattgaagttaataactt

SEQ ID NO: 460248 - DNA, 20 bp, Artificial Sequence
  chemically synthesized
tagcgcgctagagcagacca

SEQ ID NO: 460249 - DNA, 20 bp, Artificial Sequence
  chemically synthesized
ttaataactttggtctgctc

SEQ ID NO: 460250 - DNA, 20 bp, Artificial Sequence
  chemically synthesized
aataacatagcgcgctagag

SEQ ID NO: 460251 - DNA, 20 bp, Artificial Sequence
  chemically synthesized
ttcaataacatagcgcgcta

SEQ ID NO: 460252 - DNA, 20 bp, Artificial Sequence
  chemically synthesized
agttcaataacatagcgcgc

SEQ ID NO: 460253 - DNA, 20 bp, Artificial Sequence
  chemically synthesized
cagatcttagttcaataaca

SEQ ID NO: 460254 - DNA, 20 bp, Artificial Sequence
  chemically synthesized
gcgcgctatgttattgaact

SEQ ID NO: 460255 - DNA, 20 bp, Artificial Sequence
  chemically synthesized
ttattttgaagtacagatct

SEQ ID NO: 460256 - DNA, 20 bp, Artificial Sequence
  chemically synthesized
agaatcattattttgaagta

SEQ ID NO: 460257 - DNA, 20 bp, Artificial Sequence
  chemically synthesized
taactagaatcattattttg

SEQ ID NO: 460258 - DNA, 20 bp, Artificial Sequence
  chemically synthesized
gtacttcaaaataatgattc

SEQ ID NO: 460259 - DNA, 20 bp, Artificial Sequence
  chemically synthesized
tatgtgttgctaatattaac

SEQ ID NO: 460260 - DNA, 20 bp, Artificial Sequence
  chemically synthesized
ataatgattctagttaatat

SEQ ID NO: 460261 - DNA, 20 bp, Artificial Sequence
  chemically synthesized
agcaacacatattacatatc

SEQ ID NO: 460262 - DNA, 20 bp, Artificial Sequence
  chemically synthesized
ggggaatataaagaaagggc

SEQ ID NO: 460263 - DNA, 20 bp, Artificial Sequence
  chemically synthesized
gactggggaatataaagaaa

SEQ ID NO: 460264 - DNA, 20 bp, Artificial Sequence
  chemically synthesized
tgactggggaatataaagaa

SEQ ID NO: 460265 - DNA, 20 bp, Artificial Sequence
  chemically synthesized
ctgactggggaatataaaga

SEQ ID NO: 460266 - DNA, 20 bp, Artificial Sequence
  chemically synthesized
aaagctgactggggaatata

SEQ ID NO: 460267 - DNA, 20 bp, Artificial Sequence
  chemically synthesized
agccctttctttatattccc

SEQ ID NO: 460268 - DNA, 20 bp, Artificial Sequence
  chemically synthesized
ctttctttatattccccagt

SEQ ID NO: 460269 - DNA, 20 bp, Artificial Sequence
  chemically synthesized
caatttgtcaaagctgactg

SEQ ID NO: 460270 - DNA, 20 bp, Artificial Sequence
  chemically synthesized
tcaatttgtcaaagctgact

SEQ ID NO: 460271 - DNA, 20 bp, Artificial Sequence
  chemically synthesized
ctcaatttgtcaaagctgac

SEQ ID NO: 460272 - DNA, 20 bp, Artificial Sequence
  chemically synthesized
accatatactcaatttgtca

SEQ ID NO: 460273 - DNA, 20 bp, Artificial Sequence
  chemically synthesized
ccagtcagctttgacaaatt

SEQ ID NO: 460274 - DNA, 20 bp, Artificial Sequence
  chemically synthesized
gctttgacaaattgagtata

SEQ ID NO: 460275 - DNA, 20 bp, Artificial Sequence
  chemically synthesized
acaaattgagtatatggttt

SEQ ID NO: 460276 - DNA, 20 bp, Artificial Sequence
  chemically synthesized
ttcttctcactgaatattaa

SEQ ID NO: 460277 - DNA, 20 bp, Artificial Sequence
  chemically synthesized
ggtttaagtcccttaatatt

SEQ ID NO: 460278 - DNA, 20 bp, Artificial Sequence
  chemically synthesized
tttcttctcactgaatatta

SEQ ID NO: 460279 - DNA, 20 bp, Artificial Sequence
  chemically synthesized
atttcttctcactgaatatt

SEQ ID NO: 460280 - DNA, 20 bp, Artificial Sequence
  chemically synthesized
taagtcccttaatattcagt

SEQ ID NO: 460281 - DNA, 20 bp, Artificial Sequence
  chemically synthesized
gtcccttaatattcagtgag

SEQ ID NO: 460282 - DNA, 20 bp, Artificial Sequence
  chemically synthesized
aagaaatgcattttaaaatc

SEQ ID NO: 460283 - DNA, 20 bp, Artificial Sequence
  chemically synthesized
tttaaatacagacagatttc

SEQ ID NO: 460284 - DNA, 20 bp, Artificial Sequence
  chemically synthesized
tatttatgtttaaatacaga

SEQ ID NO: 460285 - DNA, 20 bp, Artificial Sequence
  chemically synthesized
tttatatttatgtttaaata

SEQ ID NO: 460286 - DNA, 20 bp, Artificial Sequence
  chemically synthesized
aatgaacaaataaataaata

SEQ ID NO: 460287 - DNA, 20 bp, Artificial Sequence
  chemically synthesized
tgaacaaataaataaataaa

SEQ ID NO: 460288 - DNA, 20 bp, Artificial Sequence
  chemically synthesized
tacacctcagtatagatata

SEQ ID NO: 460289 - DNA, 20 bp, Artificial Sequence
  chemically synthesized
aagagctttatatctatact

SEQ ID NO: 460290 - DNA, 20 bp, Artificial Sequence
  chemically synthesized
agagctttatatctatactg

SEQ ID NO: 460291 - DNA, 20 bp, Artificial Sequence
  chemically synthesized
atatggtatacacctcagta

SEQ ID NO: 460292 - DNA, 20 bp, Artificial Sequence
  chemically synthesized
gatagatatggtatacacct

SEQ ID NO: 460293 - DNA, 20 bp, Artificial Sequence
  chemically synthesized
tatatatataaagatagata

SEQ ID NO: 460294 - DNA, 20 bp, Artificial Sequence
  chemically synthesized
catatctatatatataaaga

SEQ ID NO: 460295 - DNA, 20 bp, Artificial Sequence
  chemically synthesized
atcacatatctatatatata

SEQ ID NO: 460296 - DNA, 20 bp, Artificial Sequence
  chemically synthesized
catatctatctttatatata

SEQ ID NO: 460297 - DNA, 20 bp, Artificial Sequence
  chemically synthesized
tgatatttatttttactgca

SEQ ID NO: 460298 - DNA, 20 bp, Artificial Sequence
  chemically synthesized
atatttatttttactgcaaa

SEQ ID NO: 460299 - DNA, 20 bp, Artificial Sequence
  chemically synthesized
aaaagtttactatctctttg

SEQ ID NO: 460300 - DNA, 20 bp, Artificial Sequence
  chemically synthesized
ttatttttactgcaaagaga

SEQ ID NO: 460301 - DNA, 20 bp, Artificial Sequence
  chemically synthesized
agatagtaaactttttattt

SEQ ID NO: 460302 - DNA, 20 bp, Artificial Sequence
  chemically synthesized
gtaacctattctaaaataaa

SEQ ID NO: 460303 - DNA, 20 bp, Artificial Sequence
  chemically synthesized
gtaaactttttattttagaa

SEQ ID NO: 460304 - DNA, 20 bp, Artificial Sequence
  chemically synthesized
taaactttttattttagaat

SEQ ID NO: 460305 - DNA, 20 bp, Artificial Sequence
  chemically synthesized
tttattttagaataggttac

SEQ ID NO: 460306 - DNA, 20 bp, Artificial Sequence
  chemically synthesized
attttagaataggttacaag

SEQ ID NO: 460307 - DNA, 20 bp, Artificial Sequence
  chemically synthesized
ttttagaataggttacaagt

SEQ ID NO: 460308 - DNA, 20 bp, Artificial Sequence
  chemically synthesized
gtacacctttattatttttt

SEQ ID NO: 460309 - DNA, 20 bp, Artificial Sequence
  chemically synthesized
aatatacttaaaaaataata

SEQ ID NO: 460310 - DNA, 20 bp, Artificial Sequence
  chemically synthesized
atatacttaaaaaataataa

SEQ ID NO: 460311 - DNA, 20 bp, Artificial Sequence
  chemically synthesized
aaaaaataataaaggtgtac

SEQ ID NO: 460312 - DNA, 20 bp, Artificial Sequence
  chemically synthesized
actggtagattttatgcaaa

SEQ ID NO: 460313 - DNA, 20 bp, Artificial Sequence
  chemically synthesized
accatttgcataaaatctac

SEQ ID NO: 460314 - DNA, 20 bp, Artificial Sequence
  chemically synthesized
atttgcataaaatctaccag

SEQ ID NO: 460315 - DNA, 20 bp, Artificial Sequence
  chemically synthesized
tttgcataaaatctaccagt

SEQ ID NO: 460316 - DNA, 20 bp, Artificial Sequence
  chemically synthesized
atgagtgacccacctactgg

SEQ ID NO: 460317 - DNA, 20 bp, Artificial Sequence
  chemically synthesized
gcataaaatctaccagtagg

SEQ ID NO: 460318 - DNA, 20 bp, Artificial Sequence
  chemically synthesized
cataaaatctaccagtaggt

SEQ ID NO: 460319 - DNA, 20 bp, Artificial Sequence
  chemically synthesized
ccaatgagtgacccacctac

SEQ ID NO: 460320 - DNA, 20 bp, Artificial Sequence
  chemically synthesized
ccagtaggtgggtcactcat

SEQ ID NO: 460321 - DNA, 20 bp, Artificial Sequence
  chemically synthesized
tctcttcacaaaaggccaat

SEQ ID NO: 460322 - DNA, 20 bp, Artificial Sequence
  chemically synthesized
tcactcattggccttttgtg

SEQ ID NO: 460323 - DNA, 20 bp, Artificial Sequence
  chemically synthesized
taaatatatctcttcacaaa

SEQ ID NO: 460324 - DNA, 20 bp, Artificial Sequence
  chemically synthesized
actcattggccttttgtgaa

SEQ ID NO: 460325 - DNA, 20 bp, Artificial Sequence
  chemically synthesized
gtaaatatatctcttcacaa

SEQ ID NO: 460326 - DNA, 20 bp, Artificial Sequence
  chemically synthesized
gtgaagagatatatttactt

SEQ ID NO: 460327 - DNA, 20 bp, Artificial Sequence
  chemically synthesized
tgaagagatatatttacttc

SEQ ID NO: 460328 - DNA, 20 bp, Artificial Sequence
  chemically synthesized
ggctaattggtcaggtcctg

SEQ ID NO: 460329 - DNA, 20 bp, Artificial Sequence
  chemically synthesized
tacttcaggacctgaccaat

SEQ ID NO: 460330 - DNA, 20 bp, Artificial Sequence
  chemically synthesized
ttcatctaggctaattggtc

SEQ ID NO: 460331 - DNA, 20 bp, Artificial Sequence
  chemically synthesized
attcatctaggctaattggt

SEQ ID NO: 460332 - DNA, 20 bp, Artificial Sequence
  chemically synthesized
caggacctgaccaattagcc

SEQ ID NO: 460333 - DNA, 20 bp, Artificial Sequence
  chemically synthesized
taatattcatctaggctaat

SEQ ID NO: 460334 - DNA, 20 bp, Artificial Sequence
  chemically synthesized
taaaaatataatattcatct

SEQ ID NO: 460335 - DNA, 20 bp, Artificial Sequence
  chemically synthesized
ataaaaatataatattcatc

SEQ ID NO: 460336 - DNA, 20 bp, Artificial Sequence
  chemically synthesized
gaatattatatttttattac

SEQ ID NO: 460337 - DNA, 20 bp, Artificial Sequence
  chemically synthesized
atatttttattacaagtatg

SEQ ID NO: 460338 - DNA, 20 bp, Artificial Sequence
  chemically synthesized
ttacaaaattataacaaaaa

SEQ ID NO: 460339 - DNA, 20 bp, Artificial Sequence
  chemically synthesized
ttataacaaaaaaagtaatg

SEQ ID NO: 460340 - DNA, 20 bp, Artificial Sequence
  chemically synthesized
taacaaaaaaagtaatgtag

SEQ ID NO: 460341 - DNA, 20 bp, Artificial Sequence
  chemically synthesized
taatgtagaagtactatata

SEQ ID NO: 460342 - DNA, 20 bp, Artificial Sequence
  chemically synthesized
aatgtagaagtactatatat

SEQ ID NO: 460343 - DNA, 20 bp, Artificial Sequence
  chemically synthesized
tgtagaagtactatatatag

SEQ ID NO: 460344 - DNA, 20 bp, Artificial Sequence
  chemically synthesized
agctgaaggcctcctatata

SEQ ID NO: 460345 - DNA, 20 bp, Artificial Sequence
  chemically synthesized
gtagaagtactatatatagg

SEQ ID NO: 460346 - DNA, 20 bp, Artificial Sequence
  chemically synthesized
tactatatataggaggcctt

SEQ ID NO: 460347 - DNA, 20 bp, Artificial Sequence
  chemically synthesized
gagtaagggatacaagctga

SEQ ID NO: 460348 - DNA, 20 bp, Artificial Sequence
  chemically synthesized
tgagtaagggatacaagctg

SEQ ID NO: 460349 - DNA, 20 bp, Artificial Sequence
  chemically synthesized
gaagtatgagtaagggatac

SEQ ID NO: 460350 - DNA, 20 bp, Artificial Sequence
  chemically synthesized
tttgatggaagtatgagtaa

SEQ ID NO: 460351 - DNA, 20 bp, Artificial Sequence
  chemically synthesized
ttttgatggaagtatgagta

SEQ ID NO: 460352 - DNA, 20 bp, Artificial Sequence
  chemically synthesized
tttttgatggaagtatgagt

SEQ ID NO: 460353 - DNA, 20 bp, Artificial Sequence
  chemically synthesized
ttcatttttgatggaagtat

SEQ ID NO: 460354 - DNA, 20 bp, Artificial Sequence
  chemically synthesized
ctatgcttcatttttgatgg

SEQ ID NO: 460355 - DNA, 20 bp, Artificial Sequence
  chemically synthesized
cttctatgcttcatttttga

SEQ ID NO: 460356 - DNA, 20 bp, Artificial Sequence
  chemically synthesized
tcatacttccatcaaaaatg

SEQ ID NO: 460357 - DNA, 20 bp, Artificial Sequence
  chemically synthesized
cttccatcaaaaatgaagca

SEQ ID NO: 460358 - DNA, 20 bp, Artificial Sequence
  chemically synthesized
ccatcaaaaatgaagcatag

SEQ ID NO: 460359 - DNA, 20 bp, Artificial Sequence
  chemically synthesized
aaatgaagcatagaagtatt

SEQ ID NO: 460360 - DNA, 20 bp, Artificial Sequence
  chemically synthesized
atgaagcatagaagtatttg

SEQ ID NO: 460361 - DNA, 20 bp, Artificial Sequence
  chemically synthesized
tttggagtattgatttattt

SEQ ID NO: 460362 - DNA, 20 bp, Artificial Sequence
  chemically synthesized
gatttattttagtcattcat

SEQ ID NO: 460363 - DNA, 20 bp, Artificial Sequence
  chemically synthesized
tagtcattcattagctatca

SEQ ID NO: 460364 - DNA, 20 bp, Artificial Sequence
  chemically synthesized
agacatggataagaccatga

SEQ ID NO: 460365 - DNA, 20 bp, Artificial Sequence
  chemically synthesized
tttgattttcagacatggat

SEQ ID NO: 460366 - DNA, 20 bp, Artificial Sequence
  chemically synthesized
ttgcatttgattttcagaca

SEQ ID NO: 460367 - DNA, 20 bp, Artificial Sequence
  chemically synthesized
tacatcttgcatttgatttt

SEQ ID NO: 460368 - DNA, 20 bp, Artificial Sequence
  chemically synthesized
catgtctgaaaatcaaatgc

SEQ ID NO: 460369 - DNA, 20 bp, Artificial Sequence
  chemically synthesized
atcaaatgcaagatgtactt

SEQ ID NO: 460370 - DNA, 20 bp, Artificial Sequence
  chemically synthesized
atgcaagatgtactttagtg

SEQ ID NO: 460371 - DNA, 20 bp, Artificial Sequence
  chemically synthesized
ttttattgcattcttcacta

SEQ ID NO: 460372 - DNA, 20 bp, Artificial Sequence
  chemically synthesized
aaaattaatatctgtgcttg

SEQ ID NO: 460373 - DNA, 20 bp, Artificial Sequence
  chemically synthesized
aaattaatatctgtgcttgt

SEQ ID NO: 460374 - DNA, 20 bp, Artificial Sequence
  chemically synthesized
actttgttaccccacaagca

SEQ ID NO: 460375 - DNA, 20 bp, Artificial Sequence
  chemically synthesized
aattaatatctgtgcttgtg

SEQ ID NO: 460376 - DNA, 20 bp, Artificial Sequence
  chemically synthesized
ttttaactttgttaccccac

SEQ ID NO: 460377 - DNA, 20 bp, Artificial Sequence
  chemically synthesized
tctgtgcttgtggggtaaca

SEQ ID NO: 460378 - DNA, 20 bp, Artificial Sequence
  chemically synthesized
ggggtaacaaagttaaaacc

SEQ ID NO: 460379 - DNA, 20 bp, Artificial Sequence
  chemically synthesized
gggtaacaaagttaaaacca

SEQ ID NO: 460380 - DNA, 20 bp, Artificial Sequence
  chemically synthesized
ttcagtagaaaaaggtgcct

SEQ ID NO: 460381 - DNA, 20 bp, Artificial Sequence
  chemically synthesized
tacaccttttcagtagaaaa

SEQ ID NO: 460382 - DNA, 20 bp, Artificial Sequence
  chemically synthesized
atacaccttttcagtagaaa

SEQ ID NO: 460383 - DNA, 20 bp, Artificial Sequence
  chemically synthesized
aggcacctttttctactgaa

SEQ ID NO: 460384 - DNA, 20 bp, Artificial Sequence
  chemically synthesized
ggcacctttttctactgaaa

SEQ ID NO: 460385 - DNA, 20 bp, Artificial Sequence
  chemically synthesized
taattcatacaccttttcag

SEQ ID NO: 460386 - DNA, 20 bp, Artificial Sequence
  chemically synthesized
ttttaattcatacacctttt

SEQ ID NO: 460387 - DNA, 20 bp, Artificial Sequence
  chemically synthesized
atggagactgaattatatag

SEQ ID NO: 460388 - DNA, 20 bp, Artificial Sequence
  chemically synthesized
caaaaaactactatataatt

SEQ ID NO: 460389 - DNA, 20 bp, Artificial Sequence
  chemically synthesized
tgaatggagactgaattata

SEQ ID NO: 460390 - DNA, 20 bp, Artificial Sequence
  chemically synthesized
ttttataagttatttgaatg

SEQ ID NO: 460391 - DNA, 20 bp, Artificial Sequence
  chemically synthesized
tattttataagttatttgaa

SEQ ID NO: 460392 - DNA, 20 bp, Artificial Sequence
  chemically synthesized
cattcaaataacttataaaa

SEQ ID NO: 460393 - DNA, 20 bp, Artificial Sequence
  chemically synthesized
aaacatccaagctattttat

SEQ ID NO: 460394 - DNA, 20 bp, Artificial Sequence
  chemically synthesized
aaataacttataaaatagct

SEQ ID NO: 460395 - DNA, 20 bp, Artificial Sequence
  chemically synthesized
gatgtttcaagaaaacatcc

SEQ ID NO: 460396 - DNA, 20 bp, Artificial Sequence
  chemically synthesized
cttaataatattgatgtttc

SEQ ID NO: 460397 - DNA, 20 bp, Artificial Sequence
  chemically synthesized
cttgaaacatcaatattatt

SEQ ID NO: 460398 - DNA, 20 bp, Artificial Sequence
  chemically synthesized
gaaacatcaatattattaag

SEQ ID NO: 460399 - DNA, 20 bp, Artificial Sequence
  chemically synthesized
attaagaagatattccaata

SEQ ID NO: 460400 - DNA, 20 bp, Artificial Sequence
  chemically synthesized
agaataaattatttctgtat

SEQ ID NO: 460401 - DNA, 20 bp, Artificial Sequence
  chemically synthesized
atttttaagtacggtttata

SEQ ID NO: 460402 - DNA, 20 bp, Artificial Sequence
  chemically synthesized
gctccatgcatttttaagta

SEQ ID NO: 460403 - DNA, 20 bp, Artificial Sequence
  chemically synthesized
aataggctccatgcattttt

SEQ ID NO: 460404 - DNA, 20 bp, Artificial Sequence
  chemically synthesized
aaaccgtacttaaaaatgca

SEQ ID NO: 460405 - DNA, 20 bp, Artificial Sequence
  chemically synthesized
accgtacttaaaaatgcatg

SEQ ID NO: 460406 - DNA, 20 bp, Artificial Sequence
  chemically synthesized
aaaatgcatggagcctattg

SEQ ID NO: 460407 - DNA, 20 bp, Artificial Sequence
  chemically synthesized
aaccattaggcagctacaat

SEQ ID NO: 460408 - DNA, 20 bp, Artificial Sequence
  chemically synthesized
aaaccattaggcagctacaa

SEQ ID NO: 460409 - DNA, 20 bp, Artificial Sequence
  chemically synthesized
agcctattgtagctgcctaa

SEQ ID NO: 460410 - DNA, 20 bp, Artificial Sequence
  chemically synthesized
aatattacaaaaccattagg

SEQ ID NO: 460411 - DNA, 20 bp, Artificial Sequence
  chemically synthesized
aaaaatattacaaaaccatt

SEQ ID NO: 460412 - DNA, 20 bp, Artificial Sequence
  chemically synthesized
caaaaatattacaaaaccat

SEQ ID NO: 460413 - DNA, 20 bp, Artificial Sequence
  chemically synthesized
gttttgtaatatttttgttg

SEQ ID NO: 460414 - DNA, 20 bp, Artificial Sequence
  chemically synthesized
ttgtaatatttttgttgaag

SEQ ID NO: 460415 - DNA, 20 bp, Artificial Sequence
  chemically synthesized
tatttttgttgaagtggctt

SEQ ID NO: 460416 - DNA, 20 bp, Artificial Sequence
  chemically synthesized
gttgaagtggcttaagtaca

SEQ ID NO: 460417 - DNA, 20 bp, Artificial Sequence
  chemically synthesized
gcaattaaacctttgtactt

SEQ ID NO: 460418 - DNA, 20 bp, Artificial Sequence
  chemically synthesized
ttgaagtggcttaagtacaa

SEQ ID NO: 460419 - DNA, 20 bp, Artificial Sequence
  chemically synthesized
ggtttaattgcttattataa

SEQ ID NO: 460420 - DNA, 20 bp, Artificial Sequence
  chemically synthesized
aatatttagtcttttataat

SEQ ID NO: 460421 - DNA, 20 bp, Artificial Sequence
  chemically synthesized
attcattgatataaaatatt

SEQ ID NO: 460422 - DNA, 20 bp, Artificial Sequence
  chemically synthesized
ctggactattgtggtaatgg

SEQ ID NO: 460423 - DNA, 20 bp, Artificial Sequence
  chemically synthesized
ccactggactattgtggtaa

SEQ ID NO: 460424 - DNA, 20 bp, Artificial Sequence
  chemically synthesized
aatatctgccattaccacaa

SEQ ID NO: 460425 - DNA, 20 bp, Artificial Sequence
  chemically synthesized
tgcaacccactggactattg

SEQ ID NO: 460426 - DNA, 20 bp, Artificial Sequence
  chemically synthesized
ctgccattaccacaatagtc

SEQ ID NO: 460427 - DNA, 20 bp, Artificial Sequence
  chemically synthesized
ccattaccacaatagtccag

SEQ ID NO: 460428 - DNA, 20 bp, Artificial Sequence
  chemically synthesized
cattaccacaatagtccagt

SEQ ID NO: 460429 - DNA, 20 bp, Artificial Sequence
  chemically synthesized
tcagattatctgcaacccac

SEQ ID NO: 460430 - DNA, 20 bp, Artificial Sequence
  chemically synthesized
cacaatagtccagtgggttg

SEQ ID NO: 460431 - DNA, 20 bp, Artificial Sequence
  chemically synthesized
cagtgggttgcagataatct

SEQ ID NO: 460432 - DNA, 20 bp, Artificial Sequence
  chemically synthesized
ataagagagttaaattgact

SEQ ID NO: 460433 - DNA, 20 bp, Artificial Sequence
  chemically synthesized
gtcaatttaactctcttatc

SEQ ID NO: 460434 - DNA, 20 bp, Artificial Sequence
  chemically synthesized
ggcagaatctcttgataaga

SEQ ID NO: 460435 - DNA, 20 bp, Artificial Sequence
  chemically synthesized
caatttaactctcttatcaa

SEQ ID NO: 460436 - DNA, 20 bp, Artificial Sequence
  chemically synthesized
tgggcagaatctcttgataa

SEQ ID NO: 460437 - DNA, 20 bp, Artificial Sequence
  chemically synthesized
tctgggcagaatctcttgat

SEQ ID NO: 460438 - DNA, 20 bp, Artificial Sequence
  chemically synthesized
tcttatcaagagattctgcc

SEQ ID NO: 460439 - DNA, 20 bp, Artificial Sequence
  chemically synthesized
atggttgctaattttctggg

SEQ ID NO: 460440 - DNA, 20 bp, Artificial Sequence
  chemically synthesized
agagattctgcccagaaaat

SEQ ID NO: 460441 - DNA, 20 bp, Artificial Sequence
  chemically synthesized
ataatggttgctaattttct

SEQ ID NO: 460442 - DNA, 20 bp, Artificial Sequence
  chemically synthesized
aataatggttgctaattttc

SEQ ID NO: 460443 - DNA, 20 bp, Artificial Sequence
  chemically synthesized
gttctttcagaacataataa

SEQ ID NO: 460444 - DNA, 20 bp, Artificial Sequence
  chemically synthesized
caaccattattatgttctga

SEQ ID NO: 460445 - DNA, 20 bp, Artificial Sequence
  chemically synthesized
atagaccttttgtgttcttt

SEQ ID NO: 460446 - DNA, 20 bp, Artificial Sequence
  chemically synthesized
tatgttctgaaagaacacaa

SEQ ID NO: 460447 - DNA, 20 bp, Artificial Sequence
  chemically synthesized
atgttctgaaagaacacaaa

SEQ ID NO: 460448 - DNA, 20 bp, Artificial Sequence
  chemically synthesized
taattggttcaatgttatta

SEQ ID NO: 460449 - DNA, 20 bp, Artificial Sequence
  chemically synthesized
aaaaatatacatttaataat

SEQ ID NO: 460450 - DNA, 20 bp, Artificial Sequence
  chemically synthesized
taaatgtatatttttcttct

SEQ ID NO: 460451 - DNA, 20 bp, Artificial Sequence
  chemically synthesized
aatgtatatttttcttctaa

SEQ ID NO: 460452 - DNA, 20 bp, Artificial Sequence
  chemically synthesized
gtatatttttcttctaagag

SEQ ID NO: 460453 - DNA, 20 bp, Artificial Sequence
  chemically synthesized
aagaagcgaacttctcttag

SEQ ID NO: 460454 - DNA, 20 bp, Artificial Sequence
  chemically synthesized
ttaaagaagcgaacttctct

SEQ ID NO: 460455 - DNA, 20 bp, Artificial Sequence
  chemically synthesized
ttgtaatccaaattttaaag

SEQ ID NO: 460456 - DNA, 20 bp, Artificial Sequence
  chemically synthesized
aagttcgcttctttaaaatt

SEQ ID NO: 460457 - DNA, 20 bp, Artificial Sequence
  chemically synthesized
atattgtaatccaaatttta

SEQ ID NO: 460458 - DNA, 20 bp, Artificial Sequence
  chemically synthesized
ttaaaatttggattacaata

SEQ ID NO: 460459 - DNA, 20 bp, Artificial Sequence
  chemically synthesized
aaaatttggattacaatata

SEQ ID NO: 460460 - DNA, 20 bp, Artificial Sequence
  chemically synthesized
ttaattaaaatgaataattt

SEQ ID NO: 460461 - DNA, 20 bp, Artificial Sequence
  chemically synthesized
cttaattaaaatgaataatt

SEQ ID NO: 460462 - DNA, 20 bp, Artificial Sequence
  chemically synthesized
ctaaattattcattttaatt

SEQ ID NO: 460463 - DNA, 20 bp, Artificial Sequence
  chemically synthesized
gtatctgctaagacaaaatc

SEQ ID NO: 460464 - DNA, 20 bp, Artificial Sequence
  chemically synthesized
tgtatctgctaagacaaaat

SEQ ID NO: 460465 - DNA, 20 bp, Artificial Sequence
  chemically synthesized
gtcatttcctgattttgtct

SEQ ID NO: 460466 - DNA, 20 bp, Artificial Sequence
  chemically synthesized
atttcctgattttgtcttag

SEQ ID NO: 460467 - DNA, 20 bp, Artificial Sequence
  chemically synthesized
cttaattgactgtatctgct

SEQ ID NO: 460468 - DNA, 20 bp, Artificial Sequence
  chemically synthesized
tgattttgtcttagcagata

SEQ ID NO: 460469 - DNA, 20 bp, Artificial Sequence
  chemically synthesized
cttagcagatacagtcaatt

SEQ ID NO: 460470 - DNA, 20 bp, Artificial Sequence
  chemically synthesized
aattaagaaattatccatat

SEQ ID NO: 460471 - DNA, 20 bp, Artificial Sequence
  chemically synthesized
cttatgatgcaaggctaata

SEQ ID NO: 460472 - DNA, 20 bp, Artificial Sequence
  chemically synthesized
tagggcttacttatgatgca

SEQ ID NO: 460473 - DNA, 20 bp, Artificial Sequence
  chemically synthesized
ccatattagccttgcatcat

SEQ ID NO: 460474 - DNA, 20 bp, Artificial Sequence
  chemically synthesized
ttagggcttacttatgatgc

SEQ ID NO: 460475 - DNA, 20 bp, Artificial Sequence
  chemically synthesized
attagccttgcatcataagt

SEQ ID NO: 460476 - DNA, 20 bp, Artificial Sequence
  chemically synthesized
actcaatttttgcagaatta

SEQ ID NO: 460477 - DNA, 20 bp, Artificial Sequence
  chemically synthesized
tactcaatttttgcagaatt

SEQ ID NO: 460478 - DNA, 20 bp, Artificial Sequence
  chemically synthesized
atactcaatttttgcagaat

SEQ ID NO: 460479 - DNA, 20 bp, Artificial Sequence
  chemically synthesized
gaaacaatactcaatttttg

SEQ ID NO: 460480 - DNA, 20 bp, Artificial Sequence
  chemically synthesized
gccctaattctgcaaaaatt

SEQ ID NO: 460481 - DNA, 20 bp, Artificial Sequence
  chemically synthesized
tggcttgcaaatttagaatc

SEQ ID NO: 460482 - DNA, 20 bp, Artificial Sequence
  chemically synthesized
gtggcttgcaaatttagaat

SEQ ID NO: 460483 - DNA, 20 bp, Artificial Sequence
  chemically synthesized
tttcctgattctaaatttgc

SEQ ID NO: 460484 - DNA, 20 bp, Artificial Sequence
  chemically synthesized
ctttctgtggcttgcaaatt

SEQ ID NO: 460485 - DNA, 20 bp, Artificial Sequence
  chemically synthesized
gattctaaatttgcaagcca

SEQ ID NO: 460486 - DNA, 20 bp, Artificial Sequence
  chemically synthesized
ctaaatttgcaagccacaga

SEQ ID NO: 460487 - DNA, 20 bp, Artificial Sequence
  chemically synthesized
atttttgatctgactttctg

SEQ ID NO: 460488 - DNA, 20 bp, Artificial Sequence
  chemically synthesized
atttgcaagccacagaaagt

SEQ ID NO: 460489 - DNA, 20 bp, Artificial Sequence
  chemically synthesized
agaaagtcagatcaaaaata

SEQ ID NO: 460490 - DNA, 20 bp, Artificial Sequence
  chemically synthesized
agatcaaaaataaagattac

SEQ ID NO: 460491 - DNA, 20 bp, Artificial Sequence
  chemically synthesized
aaaaataaagattacgagtc

SEQ ID NO: 460492 - DNA, 20 bp, Artificial Sequence
  chemically synthesized
aaaataaagattacgagtct

SEQ ID NO: 460493 - DNA, 20 bp, Artificial Sequence
  chemically synthesized
ctaaattaacatcataagcc

SEQ ID NO: 460494 - DNA, 20 bp, Artificial Sequence
  chemically synthesized
atccactaaattaacatcat

SEQ ID NO: 460495 - DNA, 20 bp, Artificial Sequence
  chemically synthesized
ctaggcttatgatgttaatt

SEQ ID NO: 460496 - DNA, 20 bp, Artificial Sequence
  chemically synthesized
ggcttatgatgttaatttag

SEQ ID NO: 460497 - DNA, 20 bp, Artificial Sequence
  chemically synthesized
ttagtggatattttaattta

SEQ ID NO: 460498 - DNA, 20 bp, Artificial Sequence
  chemically synthesized
tattttaatttaaagatctc

SEQ ID NO: 460499 - DNA, 20 bp, Artificial Sequence
  chemically synthesized
gaatgttttagggacatctt

SEQ ID NO: 460500 - DNA, 20 bp, Artificial Sequence
  chemically synthesized
aaaaattttagaatgtttta

SEQ ID NO: 460501 - DNA, 20 bp, Artificial Sequence
  chemically synthesized
taaaaattttagaatgtttt

SEQ ID NO: 460502 - DNA, 20 bp, Artificial Sequence
  chemically synthesized
ataaaaattttagaatgttt

SEQ ID NO: 460503 - DNA, 20 bp, Artificial Sequence
  chemically synthesized
cattacagctataaaaattt

SEQ ID NO: 460504 - DNA, 20 bp, Artificial Sequence
  chemically synthesized
aaaacattctaaaattttta

SEQ ID NO: 460505 - DNA, 20 bp, Artificial Sequence
  chemically synthesized
gccagatattgtcaacatta

SEQ ID NO: 460506 - DNA, 20 bp, Artificial Sequence
  chemically synthesized
gctgtaatgttgacaatatc

SEQ ID NO: 460507 - DNA, 20 bp, Artificial Sequence
  chemically synthesized
aatgttgacaatatctggca

SEQ ID NO: 460508 - DNA, 20 bp, Artificial Sequence
  chemically synthesized
atgttgacaatatctggcat

SEQ ID NO: 460509 - DNA, 20 bp, Artificial Sequence
  chemically synthesized
aatctcttcaaatcccatgc

SEQ ID NO: 460510 - DNA, 20 bp, Artificial Sequence
  chemically synthesized
aatatctggcatgggatttg

SEQ ID NO: 460511 - DNA, 20 bp, Artificial Sequence
  chemically synthesized
tatctggcatgggatttgaa

SEQ ID NO: 460512 - DNA, 20 bp, Artificial Sequence
  chemically synthesized
atgggatttgaagagattaa

SEQ ID NO: 460513 - DNA, 20 bp, Artificial Sequence
  chemically synthesized
gatttgaagagattaatggc

SEQ ID NO: 460514 - DNA, 20 bp, Artificial Sequence
  chemically synthesized
ttgaagagattaatggcaag

SEQ ID NO: 460515 - DNA, 20 bp, Artificial Sequence
  chemically synthesized
gaagagattaatggcaagaa

SEQ ID NO: 460516 - DNA, 20 bp, Artificial Sequence
  chemically synthesized
aagagattaatggcaagaag

SEQ ID NO: 460517 - DNA, 20 bp, Artificial Sequence
  chemically synthesized
agagattaatggcaagaaga

SEQ ID NO: 460518 - DNA, 20 bp, Artificial Sequence
  chemically synthesized
ttttatgttgtttcatgcac

SEQ ID NO: 460519 - DNA, 20 bp, Artificial Sequence
  chemically synthesized
ttatgttgtttcatgcacca

SEQ ID NO: 460520 - DNA, 20 bp, Artificial Sequence
  chemically synthesized
ccctttagcttcattttctc

SEQ ID NO: 460521 - DNA, 20 bp, Artificial Sequence
  chemically synthesized
ttcatgcaccagagaaaatg

SEQ ID NO: 460522 - DNA, 20 bp, Artificial Sequence
  chemically synthesized
caccagagaaaatgaagcta

SEQ ID NO: 460523 - DNA, 20 bp, Artificial Sequence
  chemically synthesized
accagagaaaatgaagctaa

SEQ ID NO: 460524 - DNA, 20 bp, Artificial Sequence
  chemically synthesized
ccagagaaaatgaagctaaa

SEQ ID NO: 460525 - DNA, 20 bp, Artificial Sequence
  chemically synthesized
tcttgttttcaaaatccctt

SEQ ID NO: 460526 - DNA, 20 bp, Artificial Sequence
  chemically synthesized
gctaaagggattttgaaaac

SEQ ID NO: 460527 - DNA, 20 bp, Artificial Sequence
  chemically synthesized
tttgaaaacaagaatgaatc

SEQ ID NO: 460528 - DNA, 20 bp, Artificial Sequence
  chemically synthesized
tgaaaacaagaatgaatcga

SEQ ID NO: 460529 - DNA, 20 bp, Artificial Sequence
  chemically synthesized
atcgagagttttgctgttct

SEQ ID NO: 460530 - DNA, 20 bp, Artificial Sequence
  chemically synthesized
tatctttacataacttagaa

SEQ ID NO: 460531 - DNA, 20 bp, Artificial Sequence
  chemically synthesized
catgatatctttacataact

SEQ ID NO: 460532 - DNA, 20 bp, Artificial Sequence
  chemically synthesized
ttgctgttctaagttatgta

SEQ ID NO: 460533 - DNA, 20 bp, Artificial Sequence
  chemically synthesized
taagttatgtaaagatatca

SEQ ID NO: 460534 - DNA, 20 bp, Artificial Sequence
  chemically synthesized
atatcatggactttatatcc

SEQ ID NO: 460535 - DNA, 20 bp, Artificial Sequence
  chemically synthesized
ctacattgaactgggatata

SEQ ID NO: 460536 - DNA, 20 bp, Artificial Sequence
  chemically synthesized
atgaagttctacattgaact

SEQ ID NO: 460537 - DNA, 20 bp, Artificial Sequence
  chemically synthesized
tatgaagttctacattgaac

SEQ ID NO: 460538 - DNA, 20 bp, Artificial Sequence
  chemically synthesized
ctttatatcccagttcaatg

SEQ ID NO: 460539 - DNA, 20 bp, Artificial Sequence
  chemically synthesized
tgtatatttataaaattatg

SEQ ID NO: 460540 - DNA, 20 bp, Artificial Sequence
  chemically synthesized
ttaagtatatgtatatgtgt

SEQ ID NO: 460541 - DNA, 20 bp, Artificial Sequence
  chemically synthesized
atatatgcatgaattatatt

SEQ ID NO: 460542 - DNA, 20 bp, Artificial Sequence
  chemically synthesized
aagtaggtatatacagtatg

SEQ ID NO: 460543 - DNA, 20 bp, Artificial Sequence
  chemically synthesized
tatattaaagtaggtatata

SEQ ID NO: 460544 - DNA, 20 bp, Artificial Sequence
  chemically synthesized
gtgtatctatatattaaagt

SEQ ID NO: 460545 - DNA, 20 bp, Artificial Sequence
  chemically synthesized
tgtgtatctatatattaaag

SEQ ID NO: 460546 - DNA, 20 bp, Artificial Sequence
  chemically synthesized
tatatacctactttaatata

SEQ ID NO: 460547 - DNA, 20 bp, Artificial Sequence
  chemically synthesized
atatgtgtatctatatatta

SEQ ID NO: 460548 - DNA, 20 bp, Artificial Sequence
  chemically synthesized
tgtatatatatattatagtt

SEQ ID NO: 460549 - DNA, 20 bp, Artificial Sequence
  chemically synthesized
gcatatgtatatatatatta

SEQ ID NO: 460550 - DNA, 20 bp, Artificial Sequence
  chemically synthesized
atatatgcatgaattatatt

SEQ ID NO: 460551 - DNA, 20 bp, Artificial Sequence
  chemically synthesized
agtatgtatatgcaatatga

SEQ ID NO: 460552 - DNA, 20 bp, Artificial Sequence
  chemically synthesized
aagtatgtatatgcaatatg

SEQ ID NO: 460553 - DNA, 20 bp, Artificial Sequence
  chemically synthesized
catatacatactttaatata

SEQ ID NO: 460554 - DNA, 20 bp, Artificial Sequence
  chemically synthesized
atgtgtgtatctatatatta

SEQ ID NO: 460555 - DNA, 20 bp, Artificial Sequence
  chemically synthesized
cacatatgtatgcatacaca

SEQ ID NO: 460556 - DNA, 20 bp, Artificial Sequence
  chemically synthesized
tatgtatgcatacacacaga

SEQ ID NO: 460557 - DNA, 20 bp, Artificial Sequence
  chemically synthesized
ggtgtatatatattatagat

SEQ ID NO: 460558 - DNA, 20 bp, Artificial Sequence
  chemically synthesized
agacaggtgtatatatatta

SEQ ID NO: 460559 - DNA, 20 bp, Artificial Sequence
  chemically synthesized
tatctgtggtaagaacagac

SEQ ID NO: 460560 - DNA, 20 bp, Artificial Sequence
  chemically synthesized
atatctgtggtaagaacaga

SEQ ID NO: 460561 - DNA, 20 bp, Artificial Sequence
  chemically synthesized
gaatatatctgtggtaagaa

SEQ ID NO: 460562 - DNA, 20 bp, Artificial Sequence
  chemically synthesized
acacctgtctgttcttacca

SEQ ID NO: 460563 - DNA, 20 bp, Artificial Sequence
  chemically synthesized
cctaggaatatatctgtggt

SEQ ID NO: 460564 - DNA, 20 bp, Artificial Sequence
  chemically synthesized
ccctcctaggaatatatctg

SEQ ID NO: 460565 - DNA, 20 bp, Artificial Sequence
  chemically synthesized
tcttaccacagatatattcc

SEQ ID NO: 460566 - DNA, 20 bp, Artificial Sequence
  chemically synthesized
cttaccacagatatattcct

SEQ ID NO: 460567 - DNA, 20 bp, Artificial Sequence
  chemically synthesized
taccacagatatattcctag

SEQ ID NO: 460568 - DNA, 20 bp, Artificial Sequence
  chemically synthesized
accacagatatattcctagg

SEQ ID NO: 460569 - DNA, 20 bp, Artificial Sequence
  chemically synthesized
ccacagatatattcctagga

SEQ ID NO: 460570 - DNA, 20 bp, Artificial Sequence
  chemically synthesized
cagatatattcctaggaggg

SEQ ID NO: 460571 - DNA, 20 bp, Artificial Sequence
  chemically synthesized
accttaactaccaccctcct

SEQ ID NO: 460572 - DNA, 20 bp, Artificial Sequence
  chemically synthesized
taccttaactaccaccctcc

SEQ ID NO: 460573 - DNA, 20 bp, Artificial Sequence
  chemically synthesized
atatattcctaggagggtgg

SEQ ID NO: 460574 - DNA, 20 bp, Artificial Sequence
  chemically synthesized
ttcctaggagggtggtagtt

SEQ ID NO: 460575 - DNA, 20 bp, Artificial Sequence
  chemically synthesized
tcctaggagggtggtagtta

SEQ ID NO: 460576 - DNA, 20 bp, Artificial Sequence
  chemically synthesized
gggtggtagttaaggtacta

SEQ ID NO: 460577 - DNA, 20 bp, Artificial Sequence
  chemically synthesized
tggtagttaaggtactaaag

SEQ ID NO: 460578 - DNA, 20 bp, Artificial Sequence
  chemically synthesized
ggtagttaaggtactaaagt

SEQ ID NO: 460579 - DNA, 20 bp, Artificial Sequence
  chemically synthesized
gtagttaaggtactaaagta

SEQ ID NO: 460580 - DNA, 20 bp, Artificial Sequence
  chemically synthesized
cattttacatgaccctactt

SEQ ID NO: 460581 - DNA, 20 bp, Artificial Sequence
  chemically synthesized
aaagtagggtcatgtaaaat

SEQ ID NO: 460582 - DNA, 20 bp, Artificial Sequence
  chemically synthesized
ggtcatgtaaaatgagattt

SEQ ID NO: 460583 - DNA, 20 bp, Artificial Sequence
  chemically synthesized
aaatgagattttagtaaatt

SEQ ID NO: 460584 - DNA, 20 bp, Artificial Sequence
  chemically synthesized
gagattttagtaaattcaga

SEQ ID NO: 460585 - DNA, 20 bp, Artificial Sequence
  chemically synthesized
tagtaaattcagaaagactt

SEQ ID NO: 460586 - DNA, 20 bp, Artificial Sequence
  chemically synthesized
aataaggtagattatttcca

SEQ ID NO: 460587 - DNA, 20 bp, Artificial Sequence
  chemically synthesized
tattttttatgtaaataagg

SEQ ID NO: 460588 - DNA, 20 bp, Artificial Sequence
  chemically synthesized
tattattttttatgtaaata

SEQ ID NO: 460589 - DNA, 20 bp, Artificial Sequence
  chemically synthesized
atattattttttatgtaaat

SEQ ID NO: 460590 - DNA, 20 bp, Artificial Sequence
  chemically synthesized
tatttacataaaaaataata

SEQ ID NO: 460591 - DNA, 20 bp, Artificial Sequence
  chemically synthesized
taaaaaataatatggtgaaa

SEQ ID NO: 460592 - DNA, 20 bp, Artificial Sequence
  chemically synthesized
caatacaatatttggtttaa

SEQ ID NO: 460593 - DNA, 20 bp, Artificial Sequence
  chemically synthesized
agtaatgtcaatacaatatt

SEQ ID NO: 460594 - DNA, 20 bp, Artificial Sequence
  chemically synthesized
attcagactttagtattcgt

SEQ ID NO: 460595 - DNA, 20 bp, Artificial Sequence
  chemically synthesized
gacattacttacgaatacta

SEQ ID NO: 460596 - DNA, 20 bp, Artificial Sequence
  chemically synthesized
caagaaaaaaattcagactt

SEQ ID NO: 460597 - DNA, 20 bp, Artificial Sequence
  chemically synthesized
caaaaaacaagaaaaaaatt

SEQ ID NO: 460598 - DNA, 20 bp, Artificial Sequence
  chemically synthesized
tgaacacagcagcaaaaaac

SEQ ID NO: 460599 - DNA, 20 bp, Artificial Sequence
  chemically synthesized
tcataacattatgaacacag

SEQ ID NO: 460600 - DNA, 20 bp, Artificial Sequence
  chemically synthesized
gtatcataacattatgaaca

SEQ ID NO: 460601 - DNA, 20 bp, Artificial Sequence
  chemically synthesized
tgttatgatacacgatgatc

SEQ ID NO: 460602 - DNA, 20 bp, Artificial Sequence
  chemically synthesized
gatacacgatgatctagtac

SEQ ID NO: 460603 - DNA, 20 bp, Artificial Sequence
  chemically synthesized
atacacgatgatctagtaca

SEQ ID NO: 460604 - DNA, 20 bp, Artificial Sequence
  chemically synthesized
tttcaagaaattccttgtac

SEQ ID NO: 460605 - DNA, 20 bp, Artificial Sequence
  chemically synthesized
tagtacaaggaatttcttga

SEQ ID NO: 460606 - DNA, 20 bp, Artificial Sequence
  chemically synthesized
ttttcttgaaatatgctttc

SEQ ID NO: 460607 - DNA, 20 bp, Artificial Sequence
  chemically synthesized
atttcttgaaagcatatttc

SEQ ID NO: 460608 - DNA, 20 bp, Artificial Sequence
  chemically synthesized
gaaagcatatttcaagaaaa

SEQ ID NO: 460609 - DNA, 20 bp, Artificial Sequence
  chemically synthesized
aagcatatttcaagaaaata

SEQ ID NO: 460610 - DNA, 20 bp, Artificial Sequence
  chemically synthesized
agcatatttcaagaaaatag

SEQ ID NO: 460611 - DNA, 20 bp, Artificial Sequence
  chemically synthesized
atttcaagaaaatagaggta

SEQ ID NO: 460612 - DNA, 20 bp, Artificial Sequence
  chemically synthesized
tttcaagaaaatagaggtaa

SEQ ID NO: 460613 - DNA, 20 bp, Artificial Sequence
  chemically synthesized
ttcaagaaaatagaggtaaa

SEQ ID NO: 460614 - DNA, 20 bp, Artificial Sequence
  chemically synthesized
ctaatggcattgataaaata

SEQ ID NO: 460615 - DNA, 20 bp, Artificial Sequence
  chemically synthesized
aactaatggcattgataaaa

SEQ ID NO: 460616 - DNA, 20 bp, Artificial Sequence
  chemically synthesized
ctctattttatcaatgccat

SEQ ID NO: 460617 - DNA, 20 bp, Artificial Sequence
  chemically synthesized
agcaggtggccagtaactaa

SEQ ID NO: 460618 - DNA, 20 bp, Artificial Sequence
  chemically synthesized
ttatcaatgccattagttac

SEQ ID NO: 460619 - DNA, 20 bp, Artificial Sequence
  chemically synthesized
tacgcataagagcaggtggc

SEQ ID NO: 460620 - DNA, 20 bp, Artificial Sequence
  chemically synthesized
accctacgcataagagcagg

SEQ ID NO: 460621 - DNA, 20 bp, Artificial Sequence
  chemically synthesized
agaaccctacgcataagagc

SEQ ID NO: 460622 - DNA, 20 bp, Artificial Sequence
  chemically synthesized
cagaaccctacgcataagag

SEQ ID NO: 460623 - DNA, 20 bp, Artificial Sequence
  chemically synthesized
tggccacctgctcttatgcg

SEQ ID NO: 460624 - DNA, 20 bp, Artificial Sequence
  chemically synthesized
aaacagaaccctacgcataa

SEQ ID NO: 460625 - DNA, 20 bp, Artificial Sequence
  chemically synthesized
ggccacctgctcttatgcgt

SEQ ID NO: 460626 - DNA, 20 bp, Artificial Sequence
  chemically synthesized
gccacctgctcttatgcgta

SEQ ID NO: 460627 - DNA, 20 bp, Artificial Sequence
  chemically synthesized
ctaaacagaaccctacgcat

SEQ ID NO: 460628 - DNA, 20 bp, Artificial Sequence
  chemically synthesized
cttatgcgtagggttctgtt

SEQ ID NO: 460629 - DNA, 20 bp, Artificial Sequence
  chemically synthesized
ttatgcgtagggttctgttt

SEQ ID NO: 460630 - DNA, 20 bp, Artificial Sequence
  chemically synthesized
ttatatgtctatatcctaaa

SEQ ID NO: 460631 - DNA, 20 bp, Artificial Sequence
  chemically synthesized
gtagggttctgtttaggata

SEQ ID NO: 460632 - DNA, 20 bp, Artificial Sequence
  chemically synthesized
aaaaatataaatacataaaa

SEQ ID NO: 460633 - DNA, 20 bp, Artificial Sequence
  chemically synthesized
acataaaaaagccatttgcc

SEQ ID NO: 460634 - DNA, 20 bp, Artificial Sequence
  chemically synthesized
accatttggcacttggcaaa

SEQ ID NO: 460635 - DNA, 20 bp, Artificial Sequence
  chemically synthesized
tccctgcaccatttggcact

SEQ ID NO: 460636 - DNA, 20 bp, Artificial Sequence
  chemically synthesized
gccatttgccaagtgccaaa

SEQ ID NO: 460637 - DNA, 20 bp, Artificial Sequence
  chemically synthesized
ttgccaagtgccaaatggtg

SEQ ID NO: 460638 - DNA, 20 bp, Artificial Sequence
  chemically synthesized
ttccaactccctgcaccatt

SEQ ID NO: 460639 - DNA, 20 bp, Artificial Sequence
  chemically synthesized
tgccaagtgccaaatggtgc

SEQ ID NO: 460640 - DNA, 20 bp, Artificial Sequence
  chemically synthesized
gccaagtgccaaatggtgca

SEQ ID NO: 460641 - DNA, 20 bp, Artificial Sequence
  chemically synthesized
caagtgccaaatggtgcagg

SEQ ID NO: 460642 - DNA, 20 bp, Artificial Sequence
  chemically synthesized
tgccaaatggtgcagggagt

SEQ ID NO: 460643 - DNA, 20 bp, Artificial Sequence
  chemically synthesized
caaatggtgcagggagttgg

SEQ ID NO: 460644 - DNA, 20 bp, Artificial Sequence
  chemically synthesized
tggtgcagggagttggaagt

SEQ ID NO: 460645 - DNA, 20 bp, Artificial Sequence
  chemically synthesized
gtgcagggagttggaagtcg

SEQ ID NO: 460646 - DNA, 20 bp, Artificial Sequence
  chemically synthesized
cggagattttatcattacca

SEQ ID NO: 460647 - DNA, 20 bp, Artificial Sequence
  chemically synthesized
gattttatcattaccatggc

SEQ ID NO: 460648 - DNA, 20 bp, Artificial Sequence
  chemically synthesized
tgtttttattatgctagcca

SEQ ID NO: 460649 - DNA, 20 bp, Artificial Sequence
  chemically synthesized
tctttctgtttttattatgc

SEQ ID NO: 460650 - DNA, 20 bp, Artificial Sequence
  chemically synthesized
catggctagcataataaaaa

SEQ ID NO: 460651 - DNA, 20 bp, Artificial Sequence
  chemically synthesized
gctagcataataaaaacaga

SEQ ID NO: 460652 - DNA, 20 bp, Artificial Sequence
  chemically synthesized
aaaaacagaaagaaaataat

SEQ ID NO: 460653 - DNA, 20 bp, Artificial Sequence
  chemically synthesized
aaaacagaaagaaaataata

SEQ ID NO: 460654 - DNA, 20 bp, Artificial Sequence
  chemically synthesized
aacagaaagaaaataataag

SEQ ID NO: 460655 - DNA, 20 bp, Artificial Sequence
  chemically synthesized
aataataaggagatacaaaa

SEQ ID NO: 460656 - DNA, 20 bp, Artificial Sequence
  chemically synthesized
ataaggagatacaaaacaga

SEQ ID NO: 460657 - DNA, 20 bp, Artificial Sequence
  chemically synthesized
taaggagatacaaaacagat

SEQ ID NO: 460658 - DNA, 20 bp, Artificial Sequence
  chemically synthesized
gagatacaaaacagatgggc

SEQ ID NO: 460659 - DNA, 20 bp, Artificial Sequence
  chemically synthesized
caaaacagatgggcaagaaa

SEQ ID NO: 460660 - DNA, 20 bp, Artificial Sequence
  chemically synthesized
gggcaagaaaaagaattttc

SEQ ID NO: 460661 - DNA, 20 bp, Artificial Sequence
  chemically synthesized
aagaattttcaagaaatgtg

SEQ ID NO: 460662 - DNA, 20 bp, Artificial Sequence
  chemically synthesized
agaattttcaagaaatgtga

SEQ ID NO: 460663 - DNA, 20 bp, Artificial Sequence
  chemically synthesized
gaattttcaagaaatgtgaa

SEQ ID NO: 460664 - DNA, 20 bp, Artificial Sequence
  chemically synthesized
tcaagaaatgtgaagggaaa

SEQ ID NO: 460665 - DNA, 20 bp, Artificial Sequence
  chemically synthesized
aaatgtgaagggaaatagta

SEQ ID NO: 460666 - DNA, 20 bp, Artificial Sequence
  chemically synthesized
atgtgaagggaaatagtaaa

SEQ ID NO: 460667 - DNA, 20 bp, Artificial Sequence
  chemically synthesized
gaagggaaatagtaaagaga

SEQ ID NO: 460668 - DNA, 20 bp, Artificial Sequence
  chemically synthesized
agtaaagagaaagactattt

SEQ ID NO: 460669 - DNA, 20 bp, Artificial Sequence
  chemically synthesized
ttaacatttttcatcttaaa

SEQ ID NO: 460670 - DNA, 20 bp, Artificial Sequence
  chemically synthesized
aagatgaaaaatgttaatat

SEQ ID NO: 460671 - DNA, 20 bp, Artificial Sequence
  chemically synthesized
gaaaatcaaatgatgaaaaa

SEQ ID NO: 460672 - DNA, 20 bp, Artificial Sequence
  chemically synthesized
atcaaatgatgaaaaatagc

SEQ ID NO: 460673 - DNA, 20 bp, Artificial Sequence
  chemically synthesized
aaatagcaagtttttttttt

SEQ ID NO: 460674 - DNA, 20 bp, Artificial Sequence
  chemically synthesized
agcaagtttttttttttagc

SEQ ID NO: 460675 - DNA, 20 bp, Artificial Sequence
  chemically synthesized
caagtttttttttttagcaa

SEQ ID NO: 460676 - DNA, 20 bp, Artificial Sequence
  chemically synthesized
gcaagagaatttattcttca

SEQ ID NO: 460677 - DNA, 20 bp, Artificial Sequence
  chemically synthesized
aatgtcatacaggttctatg

SEQ ID NO: 460678 - DNA, 20 bp, Artificial Sequence
  chemically synthesized
ttcttaaataaatgtcatac

SEQ ID NO: 460679 - DNA, 20 bp, Artificial Sequence
  chemically synthesized
tttcttaaataaatgtcata

SEQ ID NO: 460680 - DNA, 20 bp, Artificial Sequence
  chemically synthesized
aacctgtatgacatttattt

SEQ ID NO: 460681 - DNA, 20 bp, Artificial Sequence
  chemically synthesized
tgacatttatttaagaaaca

SEQ ID NO: 460682 - DNA, 20 bp, Artificial Sequence
  chemically synthesized
tttatttaagaaacacagaa

SEQ ID NO: 460683 - DNA, 20 bp, Artificial Sequence
  chemically synthesized
tttcatgacattccttgtac

SEQ ID NO: 460684 - DNA, 20 bp, Artificial Sequence
  chemically synthesized
aaaattgtaccaccagtaca

SEQ ID NO: 460685 - DNA, 20 bp, Artificial Sequence
  chemically synthesized
catgacattccttgtactgg

SEQ ID NO: 460686 - DNA, 20 bp, Artificial Sequence
  chemically synthesized
aaaaattgtaccaccagtac

SEQ ID NO: 460687 - DNA, 20 bp, Artificial Sequence
  chemically synthesized
tgtataaaaaattgtaccac

SEQ ID NO: 460688 - DNA, 20 bp, Artificial Sequence
  chemically synthesized
gtggtacaattttttataca

SEQ ID NO: 460689 - DNA, 20 bp, Artificial Sequence
  chemically synthesized
tggtacaattttttatacac

SEQ ID NO: 460690 - DNA, 20 bp, Artificial Sequence
  chemically synthesized
ttttatacacaggaataaaa

SEQ ID NO: 460691 - DNA, 20 bp, Artificial Sequence
  chemically synthesized
tttatacacaggaataaaaa

SEQ ID NO: 460692 - DNA, 20 bp, Artificial Sequence
  chemically synthesized
ggaataaaaaaggaataaaa

SEQ ID NO: 460693 - DNA, 20 bp, Artificial Sequence
  chemically synthesized
aaaaaggaataaaaaagtaa

SEQ ID NO: 460694 - DNA, 20 bp, Artificial Sequence
  chemically synthesized
aaaaggaataaaaaagtaaa

SEQ ID NO: 460695 - DNA, 20 bp, Artificial Sequence
  chemically synthesized
aagtaaaaggataaataaca

SEQ ID NO: 460696 - DNA, 20 bp, Artificial Sequence
  chemically synthesized
aaaggataaataacatagtt

SEQ ID NO: 460697 - DNA, 20 bp, Artificial Sequence
  chemically synthesized
aaataacatagttgagtcct

SEQ ID NO: 460698 - DNA, 20 bp, Artificial Sequence
  chemically synthesized
gttcaaacccgtgttttctc

SEQ ID NO: 460699 - DNA, 20 bp, Artificial Sequence
  chemically synthesized
agttcaaacccgtgttttct

SEQ ID NO: 460700 - DNA, 20 bp, Artificial Sequence
  chemically synthesized
agttgagtcctgagaaaaca

SEQ ID NO: 460701 - DNA, 20 bp, Artificial Sequence
  chemically synthesized
gttgagtcctgagaaaacac

SEQ ID NO: 460702 - DNA, 20 bp, Artificial Sequence
  chemically synthesized
aaacacgggtttgaactgca

SEQ ID NO: 460703 - DNA, 20 bp, Artificial Sequence
  chemically synthesized
aacacgggtttgaactgcat

SEQ ID NO: 460704 - DNA, 20 bp, Artificial Sequence
  chemically synthesized
ggcatgtaagtggacccatg

SEQ ID NO: 460705 - DNA, 20 bp, Artificial Sequence
  chemically synthesized
tgaaaaaaatggcatgtaag

SEQ ID NO: 460706 - DNA, 20 bp, Artificial Sequence
  chemically synthesized
ggttgaaaaaaatggcatgt

SEQ ID NO: 460707 - DNA, 20 bp, Artificial Sequence
  chemically synthesized
ctgagtctggttgaaaaaaa

SEQ ID NO: 460708 - DNA, 20 bp, Artificial Sequence
  chemically synthesized
tacatgccatttttttcaac

SEQ ID NO: 460709 - DNA, 20 bp, Artificial Sequence
  chemically synthesized
ccatttttttcaaccagact

SEQ ID NO: 460710 - DNA, 20 bp, Artificial Sequence
  chemically synthesized
ctgtatttttgatctgagtc

SEQ ID NO: 460711 - DNA, 20 bp, Artificial Sequence
  chemically synthesized
gaatactgtatttttgatct

SEQ ID NO: 460712 - DNA, 20 bp, Artificial Sequence
  chemically synthesized
ccagactcagatcaaaaata

SEQ ID NO: 460713 - DNA, 20 bp, Artificial Sequence
  chemically synthesized
gatcaaaaatacagtattcg

SEQ ID NO: 460714 - DNA, 20 bp, Artificial Sequence
  chemically synthesized
gaatgtgaaacctacgtata

SEQ ID NO: 460715 - DNA, 20 bp, Artificial Sequence
  chemically synthesized
aattggccctctatatacgt

SEQ ID NO: 460716 - DNA, 20 bp, Artificial Sequence
  chemically synthesized
aaattggccctctatatacg

SEQ ID NO: 460717 - DNA, 20 bp, Artificial Sequence
  chemically synthesized
atgtgaaacctacgtatata

SEQ ID NO: 460718 - DNA, 20 bp, Artificial Sequence
  chemically synthesized
tgtgaaacctacgtatatag

SEQ ID NO: 460719 - DNA, 20 bp, Artificial Sequence
  chemically synthesized
gtgaaacctacgtatataga

SEQ ID NO: 460720 - DNA, 20 bp, Artificial Sequence
  chemically synthesized
aacccgcacacaggcaaaat

SEQ ID NO: 460721 - DNA, 20 bp, Artificial Sequence
  chemically synthesized
gggccaattttgcctgtgtg

SEQ ID NO: 460722 - DNA, 20 bp, Artificial Sequence
  chemically synthesized
ggccaattttgcctgtgtgc

SEQ ID NO: 460723 - DNA, 20 bp, Artificial Sequence
  chemically synthesized
actctgcagaacccgcacac

SEQ ID NO: 460724 - DNA, 20 bp, Artificial Sequence
  chemically synthesized
aactctgcagaacccgcaca

SEQ ID NO: 460725 - DNA, 20 bp, Artificial Sequence
  chemically synthesized
ttgcctgtgtgcgggttctg

SEQ ID NO: 460726 - DNA, 20 bp, Artificial Sequence
  chemically synthesized
gcctgtgtgcgggttctgca

SEQ ID NO: 460727 - DNA, 20 bp, Artificial Sequence
  chemically synthesized
gtgtgcgggttctgcagagt

SEQ ID NO: 460728 - DNA, 20 bp, Artificial Sequence
  chemically synthesized
acatttcacagccaactctg

SEQ ID NO: 460729 - DNA, 20 bp, Artificial Sequence
  chemically synthesized
ctgaacatactcacatttca

SEQ ID NO: 460730 - DNA, 20 bp, Artificial Sequence
  chemically synthesized
cagagttggctgtgaaatgt

SEQ ID NO: 460731 - DNA, 20 bp, Artificial Sequence
  chemically synthesized
ctgtgaaatgtgagtatgtt

SEQ ID NO: 460732 - DNA, 20 bp, Artificial Sequence
  chemically synthesized
atgtgagtatgttcagattt

SEQ ID NO: 460733 - DNA, 20 bp, Artificial Sequence
  chemically synthesized
gttcagattttggtatacat

SEQ ID NO: 460734 - DNA, 20 bp, Artificial Sequence
  chemically synthesized
tcagattttggtatacatga

SEQ ID NO: 460735 - DNA, 20 bp, Artificial Sequence
  chemically synthesized
tttggtatacatgagagtac

SEQ ID NO: 460736 - DNA, 20 bp, Artificial Sequence
  chemically synthesized
catgcacgtggtattggttc

SEQ ID NO: 460737 - DNA, 20 bp, Artificial Sequence
  chemically synthesized
cctcagcatgcacgtggtat

SEQ ID NO: 460738 - DNA, 20 bp, Artificial Sequence
  chemically synthesized
gttgtccctcagcatgcacg

SEQ ID NO: 460739 - DNA, 20 bp, Artificial Sequence
  chemically synthesized
accaataccacgtgcatgct

SEQ ID NO: 460740 - DNA, 20 bp, Artificial Sequence
  chemically synthesized
ccaataccacgtgcatgctg

SEQ ID NO: 460741 - DNA, 20 bp, Artificial Sequence
  chemically synthesized
caataccacgtgcatgctga

SEQ ID NO: 460742 - DNA, 20 bp, Artificial Sequence
  chemically synthesized
aactatatacagttgtccct

SEQ ID NO: 460743 - DNA, 20 bp, Artificial Sequence
  chemically synthesized
tgctgagggacaactgtata

SEQ ID NO: 460744 - DNA, 20 bp, Artificial Sequence
  chemically synthesized
gtacagctcccaactatata

SEQ ID NO: 460745 - DNA, 20 bp, Artificial Sequence
  chemically synthesized
gagggacaactgtatatagt

SEQ ID NO: 460746 - DNA, 20 bp, Artificial Sequence
  chemically synthesized
agggacaactgtatatagtt

SEQ ID NO: 460747 - DNA, 20 bp, Artificial Sequence
  chemically synthesized
ggacaactgtatatagttgg

SEQ ID NO: 460748 - DNA, 20 bp, Artificial Sequence
  chemically synthesized
agtaaagttatatatttgta

SEQ ID NO: 460749 - DNA, 20 bp, Artificial Sequence
  chemically synthesized
tgggttctaagacatgagta

SEQ ID NO: 460750 - DNA, 20 bp, Artificial Sequence
  chemically synthesized
atataactttactcatgtct

SEQ ID NO: 460751 - DNA, 20 bp, Artificial Sequence
  chemically synthesized
gtatttgggttctaagacat

SEQ ID NO: 460752 - DNA, 20 bp, Artificial Sequence
  chemically synthesized
tttagctgtatttgggttct

SEQ ID NO: 460753 - DNA, 20 bp, Artificial Sequence
  chemically synthesized
catgtcttagaacccaaata

SEQ ID NO: 460754 - DNA, 20 bp, Artificial Sequence
  chemically synthesized
tgtattatttagctgtattt

SEQ ID NO: 460755 - DNA, 20 bp, Artificial Sequence
  chemically synthesized
gtgtattatttagctgtatt

SEQ ID NO: 460756 - DNA, 20 bp, Artificial Sequence
  chemically synthesized
agttatgcaggtgtattatt

SEQ ID NO: 460757 - DNA, 20 bp, Artificial Sequence
  chemically synthesized
gaacgacattcaagttatgc

SEQ ID NO: 460758 - DNA, 20 bp, Artificial Sequence
  chemically synthesized
agaacgacattcaagttatg

SEQ ID NO: 460759 - DNA, 20 bp, Artificial Sequence
  chemically synthesized
aaaaacccagaacgacattc

SEQ ID NO: 460760 - DNA, 20 bp, Artificial Sequence
  chemically synthesized
gcataacttgaatgtcgttc

SEQ ID NO: 460761 - DNA, 20 bp, Artificial Sequence
  chemically synthesized
cataacttgaatgtcgttct

SEQ ID NO: 460762 - DNA, 20 bp, Artificial Sequence
  chemically synthesized
tgaatgtcgttctgggtttt

SEQ ID NO: 460763 - DNA, 20 bp, Artificial Sequence
  chemically synthesized
ttccaacagtactaaaaacc

SEQ ID NO: 460764 - DNA, 20 bp, Artificial Sequence
  chemically synthesized
ttctgggtttttagtactgt

SEQ ID NO: 460765 - DNA, 20 bp, Artificial Sequence
  chemically synthesized
gggtttttagtactgttgga

SEQ ID NO: 460766 - DNA, 20 bp, Artificial Sequence
  chemically synthesized
gtagggtctacactttccaa

SEQ ID NO: 460767 - DNA, 20 bp, Artificial Sequence
  chemically synthesized
tttagtactgttggaaagtg

SEQ ID NO: 460768 - DNA, 20 bp, Artificial Sequence
  chemically synthesized
caacccacttgcatagtgta

SEQ ID NO: 460769 - DNA, 20 bp, Artificial Sequence
  chemically synthesized
ccaacccacttgcatagtgt

SEQ ID NO: 460770 - DNA, 20 bp, Artificial Sequence
  chemically synthesized
tccaacccacttgcatagtg

SEQ ID NO: 460771 - DNA, 20 bp, Artificial Sequence
  chemically synthesized
gtgtagaccctacactatgc

SEQ ID NO: 460772 - DNA, 20 bp, Artificial Sequence
  chemically synthesized
tagaccctacactatgcaag

SEQ ID NO: 460773 - DNA, 20 bp, Artificial Sequence
  chemically synthesized
agaccctacactatgcaagt

SEQ ID NO: 460774 - DNA, 20 bp, Artificial Sequence
  chemically synthesized
cttcatccaacccacttgca

SEQ ID NO: 460775 - DNA, 20 bp, Artificial Sequence
  chemically synthesized
cctacactatgcaagtgggt

SEQ ID NO: 460776 - DNA, 20 bp, Artificial Sequence
  chemically synthesized
ctatgcaagtgggttggatg

SEQ ID NO: 460777 - DNA, 20 bp, Artificial Sequence
  chemically synthesized
tatgcaagtgggttggatga

SEQ ID NO: 460778 - DNA, 20 bp, Artificial Sequence
  chemically synthesized
ggatgaaggatgacaatgtg

SEQ ID NO: 460779 - DNA, 20 bp, Artificial Sequence
  chemically synthesized
aaggatgacaatgtgcagtc

SEQ ID NO: 460780 - DNA, 20 bp, Artificial Sequence
  chemically synthesized
atagaaacacagtgaataac

SEQ ID NO: 460781 - DNA, 20 bp, Artificial Sequence
  chemically synthesized
acagtgactttatagaaaca

SEQ ID NO: 460782 - DNA, 20 bp, Artificial Sequence
  chemically synthesized
ttattcactgtgtttctata

SEQ ID NO: 460783 - DNA, 20 bp, Artificial Sequence
  chemically synthesized
cagtgttcacagtgacttta

SEQ ID NO: 460784 - DNA, 20 bp, Artificial Sequence
  chemically synthesized
attcactaattcagtgttca

SEQ ID NO: 460785 - DNA, 20 bp, Artificial Sequence
  chemically synthesized
agtcactgtgaacactgaat

SEQ ID NO: 460786 - DNA, 20 bp, Artificial Sequence
  chemically synthesized
tgcttcagtattcactaatt

SEQ ID NO: 460787 - DNA, 20 bp, Artificial Sequence
  chemically synthesized
cactgaattagtgaatactg

SEQ ID NO: 460788 - DNA, 20 bp, Artificial Sequence
  chemically synthesized
ttctcctgggaggaatgctt

SEQ ID NO: 460789 - DNA, 20 bp, Artificial Sequence
  chemically synthesized
gaatactgaagcattcctcc

SEQ ID NO: 460790 - DNA, 20 bp, Artificial Sequence
  chemically synthesized
aatactgaagcattcctccc

SEQ ID NO: 460791 - DNA, 20 bp, Artificial Sequence
  chemically synthesized
tactgaagcattcctcccag

SEQ ID NO: 460792 - DNA, 20 bp, Artificial Sequence
  chemically synthesized
atcattgtatttctcctggg

SEQ ID NO: 460793 - DNA, 20 bp, Artificial Sequence
  chemically synthesized
tatcattgtatttctcctgg

SEQ ID NO: 460794 - DNA, 20 bp, Artificial Sequence
  chemically synthesized
tctatcattgtatttctcct

SEQ ID NO: 460795 - DNA, 20 bp, Artificial Sequence
  chemically synthesized
atctatcattgtatttctcc

SEQ ID NO: 460796 - DNA, 20 bp, Artificial Sequence
  chemically synthesized
tcccaggagaaatacaatga

SEQ ID NO: 460797 - DNA, 20 bp, Artificial Sequence
  chemically synthesized
gaaatacaatgatagatttc

SEQ ID NO: 460798 - DNA, 20 bp, Artificial Sequence
  chemically synthesized
aaatacaatgatagatttct

SEQ ID NO: 460799 - DNA, 20 bp, Artificial Sequence
  chemically synthesized
atacaatgatagatttctgg

SEQ ID NO: 460800 - DNA, 20 bp, Artificial Sequence
  chemically synthesized
atgttatgagcagaggctcc

SEQ ID NO: 460801 - DNA, 20 bp, Artificial Sequence
  chemically synthesized
cacaaaaatgttatgagcag

SEQ ID NO: 460802 - DNA, 20 bp, Artificial Sequence
  chemically synthesized
tcacaaaaatgttatgagca

SEQ ID NO: 460803 - DNA, 20 bp, Artificial Sequence
  chemically synthesized
gttcacaaaaatgttatgag

SEQ ID NO: 460804 - DNA, 20 bp, Artificial Sequence
  chemically synthesized
ctggttcacaaaaatgttat

SEQ ID NO: 460805 - DNA, 20 bp, Artificial Sequence
  chemically synthesized
ctcataacatttttgtgaac

SEQ ID NO: 460806 - DNA, 20 bp, Artificial Sequence
  chemically synthesized
aaaatgggattatacattgc

SEQ ID NO: 460807 - DNA, 20 bp, Artificial Sequence
  chemically synthesized
aacagaaaaacaggcaaaat

SEQ ID NO: 460808 - DNA, 20 bp, Artificial Sequence
  chemically synthesized
aaacagaaaaacaggcaaaa

SEQ ID NO: 460809 - DNA, 20 bp, Artificial Sequence
  chemically synthesized
atgtttttaaacagaaaaac

SEQ ID NO: 460810 - DNA, 20 bp, Artificial Sequence
  chemically synthesized
gatgtttttaaacagaaaaa

SEQ ID NO: 460811 - DNA, 20 bp, Artificial Sequence
  chemically synthesized
ttcaataagatgtttttaaa

SEQ ID NO: 460812 - DNA, 20 bp, Artificial Sequence
  chemically synthesized
atcaataatatatattcaat

SEQ ID NO: 460813 - DNA, 20 bp, Artificial Sequence
  chemically synthesized
ggctgtgtattgaatgttaa

SEQ ID NO: 460814 - DNA, 20 bp, Artificial Sequence
  chemically synthesized
atccattaacattcaataca

SEQ ID NO: 460815 - DNA, 20 bp, Artificial Sequence
  chemically synthesized
aacattcaatacacagccaa

SEQ ID NO: 460816 - DNA, 20 bp, Artificial Sequence
  chemically synthesized
ggcttgagttacagtgctgt

SEQ ID NO: 460817 - DNA, 20 bp, Artificial Sequence
  chemically synthesized
agccaacagcactgtaactc

SEQ ID NO: 460818 - DNA, 20 bp, Artificial Sequence
  chemically synthesized
tttccttcaggcttgagtta

SEQ ID NO: 460819 - DNA, 20 bp, Artificial Sequence
  chemically synthesized
agcactgtaactcaagcctg

SEQ ID NO: 460820 - DNA, 20 bp, Artificial Sequence
  chemically synthesized
ggtaagtttccttcaggctt

SEQ ID NO: 460821 - DNA, 20 bp, Artificial Sequence
  chemically synthesized
gcactgtaactcaagcctga

SEQ ID NO: 460822 - DNA, 20 bp, Artificial Sequence
  chemically synthesized
tccttaggtaagtttccttc

SEQ ID NO: 460823 - DNA, 20 bp, Artificial Sequence
  chemically synthesized
ttccttaggtaagtttcctt

SEQ ID NO: 460824 - DNA, 20 bp, Artificial Sequence
  chemically synthesized
agcctgaaggaaacttacct

SEQ ID NO: 460825 - DNA, 20 bp, Artificial Sequence
  chemically synthesized
gcctgaaggaaacttaccta

SEQ ID NO: 460826 - DNA, 20 bp, Artificial Sequence
  chemically synthesized
agaaaataggttccttaggt

SEQ ID NO: 460827 - DNA, 20 bp, Artificial Sequence
  chemically synthesized
agaaagaaaataggttcctt

SEQ ID NO: 460828 - DNA, 20 bp, Artificial Sequence
  chemically synthesized
tagaaagaaaataggttcct

SEQ ID NO: 460829 - DNA, 20 bp, Artificial Sequence
  chemically synthesized
aagtaccttagaaagaaaat

SEQ ID NO: 460830 - DNA, 20 bp, Artificial Sequence
  chemically synthesized
gaagtaccttagaaagaaaa

SEQ ID NO: 460831 - DNA, 20 bp, Artificial Sequence
  chemically synthesized
aaggaacctattttctttct

SEQ ID NO: 460832 - DNA, 20 bp, Artificial Sequence
  chemically synthesized
aggaacctattttctttcta

SEQ ID NO: 460833 - DNA, 20 bp, Artificial Sequence
  chemically synthesized
aggctgtgaagtaccttaga

SEQ ID NO: 460834 - DNA, 20 bp, Artificial Sequence
  chemically synthesized
aagaaggctgtgaagtacct

SEQ ID NO: 460835 - DNA, 20 bp, Artificial Sequence
  chemically synthesized
tttctttctaaggtacttca

SEQ ID NO: 460836 - DNA, 20 bp, Artificial Sequence
  chemically synthesized
ctaagcttaagaaggctgtg

SEQ ID NO: 460837 - DNA, 20 bp, Artificial Sequence
  chemically synthesized
aggtacttcacagccttctt

SEQ ID NO: 460838 - DNA, 20 bp, Artificial Sequence
  chemically synthesized
tagtgttcctaagcttaaga

SEQ ID NO: 460839 - DNA, 20 bp, Artificial Sequence
  chemically synthesized
ctagtgttcctaagcttaag

SEQ ID NO: 460840 - DNA, 20 bp, Artificial Sequence
  chemically synthesized
cttcacagccttcttaagct

SEQ ID NO: 460841 - DNA, 20 bp, Artificial Sequence
  chemically synthesized
ttcacagccttcttaagctt

SEQ ID NO: 460842 - DNA, 20 bp, Artificial Sequence
  chemically synthesized
tgtctagtgttcctaagctt

SEQ ID NO: 460843 - DNA, 20 bp, Artificial Sequence
  chemically synthesized
aatttctgtctagtgttcct

SEQ ID NO: 460844 - DNA, 20 bp, Artificial Sequence
  chemically synthesized
cttcttaagcttaggaacac

SEQ ID NO: 460845 - DNA, 20 bp, Artificial Sequence
  chemically synthesized
ttaagcttaggaacactaga

SEQ ID NO: 460846 - DNA, 20 bp, Artificial Sequence
  chemically synthesized
catgatggtgaatttctgtc

SEQ ID NO: 460847 - DNA, 20 bp, Artificial Sequence
  chemically synthesized
cagaaattcaccatcatgct

SEQ ID NO: 460848 - DNA, 20 bp, Artificial Sequence
  chemically synthesized
ttaaatggccccaagcatga

SEQ ID NO: 460849 - DNA, 20 bp, Artificial Sequence
  chemically synthesized
agaaattcaccatcatgctt

SEQ ID NO: 460850 - DNA, 20 bp, Artificial Sequence
  chemically synthesized
gaaattcaccatcatgcttg

SEQ ID NO: 460851 - DNA, 20 bp, Artificial Sequence
  chemically synthesized
ttgctgctttaaatggcccc

SEQ ID NO: 460852 - DNA, 20 bp, Artificial Sequence
  chemically synthesized
atcatgcttggggccattta

SEQ ID NO: 460853 - DNA, 20 bp, Artificial Sequence
  chemically synthesized
atgcttggggccatttaaag

SEQ ID NO: 460854 - DNA, 20 bp, Artificial Sequence
  chemically synthesized
ggtgattttgctgctttaaa

SEQ ID NO: 460855 - DNA, 20 bp, Artificial Sequence
  chemically synthesized
tttaaagcagcaaaatcacc

SEQ ID NO: 460856 - DNA, 20 bp, Artificial Sequence
  chemically synthesized
gcagcaaaatcaccaagaaa

SEQ ID NO: 460857 - DNA, 20 bp, Artificial Sequence
  chemically synthesized
catatttttatgctttttct

SEQ ID NO: 460858 - DNA, 20 bp, Artificial Sequence
  chemically synthesized
gcataaaaatatgaaaaaca

SEQ ID NO: 460859 - DNA, 20 bp, Artificial Sequence
  chemically synthesized
agcattaaatacaccgctga

SEQ ID NO: 460860 - DNA, 20 bp, Artificial Sequence
  chemically synthesized
gcattaaatacaccgctgaa

SEQ ID NO: 460861 - DNA, 20 bp, Artificial Sequence
  chemically synthesized
gtaaacaagtgtcctttcag

SEQ ID NO: 460862 - DNA, 20 bp, Artificial Sequence
  chemically synthesized
acggtaaacaagtgtccttt

SEQ ID NO: 460863 - DNA, 20 bp, Artificial Sequence
  chemically synthesized
tcaggtctcatacggtaaac

SEQ ID NO: 460864 - DNA, 20 bp, Artificial Sequence
  chemically synthesized
aggacacttgtttaccgtat

SEQ ID NO: 460865 - DNA, 20 bp, Artificial Sequence
  chemically synthesized
ttcttgcttcaggtctcata

SEQ ID NO: 460866 - DNA, 20 bp, Artificial Sequence
  chemically synthesized
tgtttaccgtatgagacctg

SEQ ID NO: 460867 - DNA, 20 bp, Artificial Sequence
  chemically synthesized
taccgtatgagacctgaagc

SEQ ID NO: 460868 - DNA, 20 bp, Artificial Sequence
  chemically synthesized
acactctgcattcttgcttc

SEQ ID NO: 460869 - DNA, 20 bp, Artificial Sequence
  chemically synthesized
aacactctgcattcttgctt

SEQ ID NO: 460870 - DNA, 20 bp, Artificial Sequence
  chemically synthesized
tgagacctgaagcaagaatg

SEQ ID NO: 460871 - DNA, 20 bp, Artificial Sequence
  chemically synthesized
agacctgaagcaagaatgca

SEQ ID NO: 460872 - DNA, 20 bp, Artificial Sequence
  chemically synthesized
ttcccagctgagatcaaaaa

SEQ ID NO: 460873 - DNA, 20 bp, Artificial Sequence
  chemically synthesized
gttcccagctgagatcaaaa

SEQ ID NO: 460874 - DNA, 20 bp, Artificial Sequence
  chemically synthesized
gagtgttccttttttgatct

SEQ ID NO: 460875 - DNA, 20 bp, Artificial Sequence
  chemically synthesized
gttccttttttgatctcagc

SEQ ID NO: 460876 - DNA, 20 bp, Artificial Sequence
  chemically synthesized
ttccttttttgatctcagct

SEQ ID NO: 460877 - DNA, 20 bp, Artificial Sequence
  chemically synthesized
caccacacatgttcccagct

SEQ ID NO: 460878 - DNA, 20 bp, Artificial Sequence
  chemically synthesized
tcacccaccacacatgttcc

SEQ ID NO: 460879 - DNA, 20 bp, Artificial Sequence
  chemically synthesized
atctcagctgggaacatgtg

SEQ ID NO: 460880 - DNA, 20 bp, Artificial Sequence
  chemically synthesized
tcagctgggaacatgtgtgg

SEQ ID NO: 460881 - DNA, 20 bp, Artificial Sequence
  chemically synthesized
cagctgggaacatgtgtggt

SEQ ID NO: 460882 - DNA, 20 bp, Artificial Sequence
  chemically synthesized
catagagtggtgaaaaattt

SEQ ID NO: 460883 - DNA, 20 bp, Artificial Sequence
  chemically synthesized
atttgtgtgtatgcatagag

SEQ ID NO: 460884 - DNA, 20 bp, Artificial Sequence
  chemically synthesized
gccatttgtgtgtatgcata

SEQ ID NO: 460885 - DNA, 20 bp, Artificial Sequence
  chemically synthesized
cagccatttgtgtgtatgca

SEQ ID NO: 460886 - DNA, 20 bp, Artificial Sequence
  chemically synthesized
actctatgcatacacacaaa

SEQ ID NO: 460887 - DNA, 20 bp, Artificial Sequence
  chemically synthesized
caatgctcatagcattttca

SEQ ID NO: 460888 - DNA, 20 bp, Artificial Sequence
  chemically synthesized
aatggctgtgaaaatgctat

SEQ ID NO: 460889 - DNA, 20 bp, Artificial Sequence
  chemically synthesized
atccctaaaatcaatgctca

SEQ ID NO: 460890 - DNA, 20 bp, Artificial Sequence
  chemically synthesized
aatgctatgagcattgattt

SEQ ID NO: 460891 - DNA, 20 bp, Artificial Sequence
  chemically synthesized
atgctatgagcattgatttt

SEQ ID NO: 460892 - DNA, 20 bp, Artificial Sequence
  chemically synthesized
tgctatgagcattgatttta

SEQ ID NO: 460893 - DNA, 20 bp, Artificial Sequence
  chemically synthesized
ttagggatacaaattaaatt

SEQ ID NO: 460894 - DNA, 20 bp, Artificial Sequence
  chemically synthesized
ggatacaaattaaatttagc

SEQ ID NO: 460895 - DNA, 20 bp, Artificial Sequence
  chemically synthesized
aattaaatttagcaagtttt

SEQ ID NO: 460896 - DNA, 20 bp, Artificial Sequence
  chemically synthesized
gttttgagaactcccaaaca

SEQ ID NO: 460897 - DNA, 20 bp, Artificial Sequence
  chemically synthesized
ttcacacattctgtgtttgg

SEQ ID NO: 460898 - DNA, 20 bp, Artificial Sequence
  chemically synthesized
tattcacacattctgtgttt

SEQ ID NO: 460899 - DNA, 20 bp, Artificial Sequence
  chemically synthesized
ttattcacacattctgtgtt

SEQ ID NO: 460900 - DNA, 20 bp, Artificial Sequence
  chemically synthesized
acacagaatgtgtgaataat

SEQ ID NO: 460901 - DNA, 20 bp, Artificial Sequence
  chemically synthesized
tgattgaaactttgtacaga

SEQ ID NO: 460902 - DNA, 20 bp, Artificial Sequence
  chemically synthesized
taatgagaaccatctgtaca

SEQ ID NO: 460903 - DNA, 20 bp, Artificial Sequence
  chemically synthesized
atattgattgaaactttgta

SEQ ID NO: 460904 - DNA, 20 bp, Artificial Sequence
  chemically synthesized
caatcaatatactgcttgat

SEQ ID NO: 460905 - DNA, 20 bp, Artificial Sequence
  chemically synthesized
aatcaatatactgcttgatt

SEQ ID NO: 460906 - DNA, 20 bp, Artificial Sequence
  chemically synthesized
ataaaaagggcctaatcaag

SEQ ID NO: 460907 - DNA, 20 bp, Artificial Sequence
  chemically synthesized
tttataaaaagggcctaatc

SEQ ID NO: 460908 - DNA, 20 bp, Artificial Sequence
  chemically synthesized
agtatagtgctttataaaaa

SEQ ID NO: 460909 - DNA, 20 bp, Artificial Sequence
  chemically synthesized
ttgattaggccctttttata

SEQ ID NO: 460910 - DNA, 20 bp, Artificial Sequence
  chemically synthesized
cagtatagtgctttataaaa

SEQ ID NO: 460911 - DNA, 20 bp, Artificial Sequence
  chemically synthesized
acagtatagtgctttataaa

SEQ ID NO: 460912 - DNA, 20 bp, Artificial Sequence
  chemically synthesized
atttgcaactaaaaacagta

SEQ ID NO: 460913 - DNA, 20 bp, Artificial Sequence
  chemically synthesized
ataaagcactatactgtttt

SEQ ID NO: 460914 - DNA, 20 bp, Artificial Sequence
  chemically synthesized
taaccatttgcaactaaaaa

SEQ ID NO: 460915 - DNA, 20 bp, Artificial Sequence
  chemically synthesized
atactgtttttagttgcaaa

SEQ ID NO: 460916 - DNA, 20 bp, Artificial Sequence
  chemically synthesized
ccataaccaaatgggatgaa

SEQ ID NO: 460917 - DNA, 20 bp, Artificial Sequence
  chemically synthesized
accataaccaaatgggatga

SEQ ID NO: 460918 - DNA, 20 bp, Artificial Sequence
  chemically synthesized
ttaaatcctttcatcccatt

SEQ ID NO: 460919 - DNA, 20 bp, Artificial Sequence
  chemically synthesized
tacaaacaccataaccaaat

SEQ ID NO: 460920 - DNA, 20 bp, Artificial Sequence
  chemically synthesized
gtacaaacaccataaccaaa

SEQ ID NO: 460921 - DNA, 20 bp, Artificial Sequence
  chemically synthesized
cctttcatcccatttggtta

SEQ ID NO: 460922 - DNA, 20 bp, Artificial Sequence
  chemically synthesized
atttggttatggtgtttgta

SEQ ID NO: 460923 - DNA, 20 bp, Artificial Sequence
  chemically synthesized
ttgtacagaaaactaaatta

SEQ ID NO: 460924 - DNA, 20 bp, Artificial Sequence
  chemically synthesized
caatacacatgtctgtaatt

SEQ ID NO: 460925 - DNA, 20 bp, Artificial Sequence
  chemically synthesized
ttcaaaagggcaattagaga

SEQ ID NO: 460926 - DNA, 20 bp, Artificial Sequence
  chemically synthesized
atcattcaaaagggcaatta

SEQ ID NO: 460927 - DNA, 20 bp, Artificial Sequence
  chemically synthesized
agatcattcaaaagggcaat

SEQ ID NO: 460928 - DNA, 20 bp, Artificial Sequence
  chemically synthesized
tctgctcagatcattcaaaa

SEQ ID NO: 460929 - DNA, 20 bp, Artificial Sequence
  chemically synthesized
ctctgctcagatcattcaaa

SEQ ID NO: 460930 - DNA, 20 bp, Artificial Sequence
  chemically synthesized
tctctgctcagatcattcaa

SEQ ID NO: 460931 - DNA, 20 bp, Artificial Sequence
  chemically synthesized
attgcccttttgaatgatct

SEQ ID NO: 460932 - DNA, 20 bp, Artificial Sequence
  chemically synthesized
gcccttttgaatgatctgag

SEQ ID NO: 460933 - DNA, 20 bp, Artificial Sequence
  chemically synthesized
ccttttgaatgatctgagca

SEQ ID NO: 460934 - DNA, 20 bp, Artificial Sequence
  chemically synthesized
tccagcagttgatctctgct

SEQ ID NO: 460935 - DNA, 20 bp, Artificial Sequence
  chemically synthesized
tctgagcagagatcaactgc

SEQ ID NO: 460936 - DNA, 20 bp, Artificial Sequence
  chemically synthesized
cgacgtacaatttggtccag

SEQ ID NO: 460937 - DNA, 20 bp, Artificial Sequence
  chemically synthesized
tctcgacgtacaatttggtc

SEQ ID NO: 460938 - DNA, 20 bp, Artificial Sequence
  chemically synthesized
tataatctcgacgtacaatt

SEQ ID NO: 460939 - DNA, 20 bp, Artificial Sequence
  chemically synthesized
gctggaccaaattgtacgtc

SEQ ID NO: 460940 - DNA, 20 bp, Artificial Sequence
  chemically synthesized
tacgtcgagattataatatc

SEQ ID NO: 460941 - DNA, 20 bp, Artificial Sequence
  chemically synthesized
acgtcgagattataatatcc

SEQ ID NO: 460942 - DNA, 20 bp, Artificial Sequence
  chemically synthesized
ccatagtgcctgacaaaacc

SEQ ID NO: 460943 - DNA, 20 bp, Artificial Sequence
  chemically synthesized
ttataatatccaggttttgt

SEQ ID NO: 460944 - DNA, 20 bp, Artificial Sequence
  chemically synthesized
tataatatccaggttttgtc

SEQ ID NO: 460945 - DNA, 20 bp, Artificial Sequence
  chemically synthesized
ccaggttttgtcaggcacta

SEQ ID NO: 460946 - DNA, 20 bp, Artificial Sequence
  chemically synthesized
ttttgtcaggcactatggtt

SEQ ID NO: 460947 - DNA, 20 bp, Artificial Sequence
  chemically synthesized
ctgacaatacttcttaacca

SEQ ID NO: 460948 - DNA, 20 bp, Artificial Sequence
  chemically synthesized
tgtcaggcactatggttaag

SEQ ID NO: 460949 - DNA, 20 bp, Artificial Sequence
  chemically synthesized
ctatggttaagaagtattgt

SEQ ID NO: 460950 - DNA, 20 bp, Artificial Sequence
  chemically synthesized
gttaagaagtattgtcagtt

SEQ ID NO: 460951 - DNA, 20 bp, Artificial Sequence
  chemically synthesized
ttaagatgtactgcaatttt

SEQ ID NO: 460952 - DNA, 20 bp, Artificial Sequence
  chemically synthesized
aaatcttttgcttaaaattg

SEQ ID NO: 460953 - DNA, 20 bp, Artificial Sequence
  chemically synthesized
tgtactgcaattttaagcaa

SEQ ID NO: 460954 - DNA, 20 bp, Artificial Sequence
  chemically synthesized
tcctggttacttagtagatt

SEQ ID NO: 460955 - DNA, 20 bp, Artificial Sequence
  chemically synthesized
ttttacatgctcaatctact

SEQ ID NO: 460956 - DNA, 20 bp, Artificial Sequence
  chemically synthesized
gtcttctcctggttacttag

SEQ ID NO: 460957 - DNA, 20 bp, Artificial Sequence
  chemically synthesized
tgctcaatctactaagtaac

SEQ ID NO: 460958 - DNA, 20 bp, Artificial Sequence
  chemically synthesized
gctcaatctactaagtaacc

SEQ ID NO: 460959 - DNA, 20 bp, Artificial Sequence
  chemically synthesized
tttgtcttctcctggttact

SEQ ID NO: 460960 - DNA, 20 bp, Artificial Sequence
  chemically synthesized
tcaatctactaagtaaccag

SEQ ID NO: 460961 - DNA, 20 bp, Artificial Sequence
  chemically synthesized
atctactaagtaaccaggag

SEQ ID NO: 460962 - DNA, 20 bp, Artificial Sequence
  chemically synthesized
cttgtacatttgtcttctcc

SEQ ID NO: 460963 - DNA, 20 bp, Artificial Sequence
  chemically synthesized
ccaggagaagacaaatgtac

SEQ ID NO: 460964 - DNA, 20 bp, Artificial Sequence
  chemically synthesized
caaatgtacaagatatttcc

SEQ ID NO: 460965 - DNA, 20 bp, Artificial Sequence
  chemically synthesized
aatgtacaagatatttccaa

SEQ ID NO: 460966 - DNA, 20 bp, Artificial Sequence
  chemically synthesized
gttggtaacaagaatgctct

SEQ ID NO: 460967 - DNA, 20 bp, Artificial Sequence
  chemically synthesized
acagttcttcagttggtaac

SEQ ID NO: 460968 - DNA, 20 bp, Artificial Sequence
  chemically synthesized
agcattcttgttaccaactg

SEQ ID NO: 460969 - DNA, 20 bp, Artificial Sequence
  chemically synthesized
tattaatacagttcttcagt

SEQ ID NO: 460970 - DNA, 20 bp, Artificial Sequence
  chemically synthesized
gaattattaatacagttctt

SEQ ID NO: 460971 - DNA, 20 bp, Artificial Sequence
  chemically synthesized
ataggactgaattattaata

SEQ ID NO: 460972 - DNA, 20 bp, Artificial Sequence
  chemically synthesized
gaagaactgtattaataatt

SEQ ID NO: 460973 - DNA, 20 bp, Artificial Sequence
  chemically synthesized
attaataattcagtcctata

SEQ ID NO: 460974 - DNA, 20 bp, Artificial Sequence
  chemically synthesized
agttctaagtagcactgtat

SEQ ID NO: 460975 - DNA, 20 bp, Artificial Sequence
  chemically synthesized
aagttctaagtagcactgta

SEQ ID NO: 460976 - DNA, 20 bp, Artificial Sequence
  chemically synthesized
cagtcctatacagtgctact

SEQ ID NO: 460977 - DNA, 20 bp, Artificial Sequence
  chemically synthesized
gaagacactgaagttctaag

SEQ ID NO: 460978 - DNA, 20 bp, Artificial Sequence
  chemically synthesized
tacagtgctacttagaactt

SEQ ID NO: 460979 - DNA, 20 bp, Artificial Sequence
  chemically synthesized
caagaagacactgaagttct

SEQ ID NO: 460980 - DNA, 20 bp, Artificial Sequence
  chemically synthesized
cgcttaacaagaagacactg

SEQ ID NO: 460981 - DNA, 20 bp, Artificial Sequence
  chemically synthesized
aacttcagtgtcttcttgtt

SEQ ID NO: 460982 - DNA, 20 bp, Artificial Sequence
  chemically synthesized
catccacttcgcttaacaag

SEQ ID NO: 460983 - DNA, 20 bp, Artificial Sequence
  chemically synthesized
ttacatccacttcgcttaac

SEQ ID NO: 460984 - DNA, 20 bp, Artificial Sequence
  chemically synthesized
cagtgtcttcttgttaagcg

SEQ ID NO: 460985 - DNA, 20 bp, Artificial Sequence
  chemically synthesized
tgtcttcttgttaagcgaag

SEQ ID NO: 460986 - DNA, 20 bp, Artificial Sequence
  chemically synthesized
gtaaaaaaaaaaaaaatgca

SEQ ID NO: 460987 - DNA, 20 bp, Artificial Sequence
  chemically synthesized
taaaaaaaaaaaaaatgcaa

SEQ ID NO: 460988 - DNA, 20 bp, Artificial Sequence
  chemically synthesized
gcaaaggaatgtcataaatg

SEQ ID NO: 460989 - DNA, 20 bp, Artificial Sequence
  chemically synthesized
tcataaatgcagtgaataca

SEQ ID NO: 460990 - DNA, 20 bp, Artificial Sequence
  chemically synthesized
agctccactttttagaaatt

SEQ ID NO: 460991 - DNA, 20 bp, Artificial Sequence
  chemically synthesized
tacaaagctgaatttctaaa

SEQ ID NO: 460992 - DNA, 20 bp, Artificial Sequence
  chemically synthesized
aaagctgaatttctaaaaag

SEQ ID NO: 460993 - DNA, 20 bp, Artificial Sequence
  chemically synthesized
agctgaatttctaaaaagtg

SEQ ID NO: 460994 - DNA, 20 bp, Artificial Sequence
  chemically synthesized
cctttgcaagctccactttt

SEQ ID NO: 460995 - DNA, 20 bp, Artificial Sequence
  chemically synthesized
tctaaaaagtggagcttgca

SEQ ID NO: 460996 - DNA, 20 bp, Artificial Sequence
  chemically synthesized
ctaaaaagtggagcttgcaa

SEQ ID NO: 460997 - DNA, 20 bp, Artificial Sequence
  chemically synthesized
taaaaagtggagcttgcaaa

SEQ ID NO: 460998 - DNA, 20 bp, Artificial Sequence
  chemically synthesized
tgcacctacagtccctttgc

SEQ ID NO: 460999 - DNA, 20 bp, Artificial Sequence
  chemically synthesized
tggagcttgcaaagggactg

SEQ ID NO: 461000 - DNA, 20 bp, Artificial Sequence
  chemically synthesized
ggagcttgcaaagggactgt

SEQ ID NO: 461001 - DNA, 20 bp, Artificial Sequence
  chemically synthesized
ttcaaactaaattgcaccta

SEQ ID NO: 461002 - DNA, 20 bp, Artificial Sequence
  chemically synthesized
aagggactgtaggtgcaatt

SEQ ID NO: 461003 - DNA, 20 bp, Artificial Sequence
  chemically synthesized
aggtgcaatttagtttgaaa

SEQ ID NO: 461004 - DNA, 20 bp, Artificial Sequence
  chemically synthesized
ggtgcaatttagtttgaaat

SEQ ID NO: 461005 - DNA, 20 bp, Artificial Sequence
  chemically synthesized
gaaatcaaaattttaataac

SEQ ID NO: 461006 - DNA, 20 bp, Artificial Sequence
  chemically synthesized
tgaacaggttttggtataca

SEQ ID NO: 461007 - DNA, 20 bp, Artificial Sequence
  chemically synthesized
ttatattgatgaacaggttt

SEQ ID NO: 461008 - DNA, 20 bp, Artificial Sequence
  chemically synthesized
gtttgattatattgatgaac

SEQ ID NO: 461009 - DNA, 20 bp, Artificial Sequence
  chemically synthesized
tgtttgattatattgatgaa

SEQ ID NO: 461010 - DNA, 20 bp, Artificial Sequence
  chemically synthesized
catcaatataatcaaacacc

SEQ ID NO: 461011 - DNA, 20 bp, Artificial Sequence
  chemically synthesized
atcaaggcagatggatatct

SEQ ID NO: 461012 - DNA, 20 bp, Artificial Sequence
  chemically synthesized
catcaaggcagatggatatc

SEQ ID NO: 461013 - DNA, 20 bp, Artificial Sequence
  chemically synthesized
gtaaacatcatcaaggcaga

SEQ ID NO: 461014 - DNA, 20 bp, Artificial Sequence
  chemically synthesized
catggtaaacatcatcaagg

SEQ ID NO: 461015 - DNA, 20 bp, Artificial Sequence
  chemically synthesized
attcatggtaaacatcatca

SEQ ID NO: 461016 - DNA, 20 bp, Artificial Sequence
  chemically synthesized
aattcatggtaaacatcatc

SEQ ID NO: 461017 - DNA, 20 bp, Artificial Sequence
  chemically synthesized
acttgggattatgaaattca

SEQ ID NO: 461018 - DNA, 20 bp, Artificial Sequence
  chemically synthesized
accatgaatttcataatccc

SEQ ID NO: 461019 - DNA, 20 bp, Artificial Sequence
  chemically synthesized
gaatacactgggtttgactt

SEQ ID NO: 461020 - DNA, 20 bp, Artificial Sequence
  chemically synthesized
agaatacactgggtttgact

SEQ ID NO: 461021 - DNA, 20 bp, Artificial Sequence
  chemically synthesized
tcataatcccaagtcaaacc

SEQ ID NO: 461022 - DNA, 20 bp, Artificial Sequence
  chemically synthesized
atatgtgagtagaatacact

SEQ ID NO: 461023 - DNA, 20 bp, Artificial Sequence
  chemically synthesized
aatatgtgagtagaatacac

SEQ ID NO: 461024 - DNA, 20 bp, Artificial Sequence
  chemically synthesized
acagctcacaaatatgtgag

SEQ ID NO: 461025 - DNA, 20 bp, Artificial Sequence
  chemically synthesized
atgacagctcacaaatatgt

SEQ ID NO: 461026 - DNA, 20 bp, Artificial Sequence
  chemically synthesized
tattctactcacatatttgt

SEQ ID NO: 461027 - DNA, 20 bp, Artificial Sequence
  chemically synthesized
atatttgtgagctgtcatta

SEQ ID NO: 461028 - DNA, 20 bp, Artificial Sequence
  chemically synthesized
tatttgtgagctgtcattaa

SEQ ID NO: 461029 - DNA, 20 bp, Artificial Sequence
  chemically synthesized
gttctagcttcctttaatga

SEQ ID NO: 461030 - DNA, 20 bp, Artificial Sequence
  chemically synthesized
ttgtgagctgtcattaaagg

SEQ ID NO: 461031 - DNA, 20 bp, Artificial Sequence
  chemically synthesized
gagctgtcattaaaggaagc

SEQ ID NO: 461032 - DNA, 20 bp, Artificial Sequence
  chemically synthesized
gtcattaaaggaagctagaa

SEQ ID NO: 461033 - DNA, 20 bp, Artificial Sequence
  chemically synthesized
tgacatactacattctgttc

SEQ ID NO: 461034 - DNA, 20 bp, Artificial Sequence
  chemically synthesized
aaggaagctagaacagaatg

SEQ ID NO: 461035 - DNA, 20 bp, Artificial Sequence
  chemically synthesized
tgtgtgtgtgtgtgtaatgt

SEQ ID NO: 461036 - DNA, 20 bp, Artificial Sequence
  chemically synthesized
gaatgtgcatttatgcaact

SEQ ID NO: 461037 - DNA, 20 bp, Artificial Sequence
  chemically synthesized
aaggcacacaaacacacact

SEQ ID NO: 461038 - DNA, 20 bp, Artificial Sequence
  chemically synthesized
agtgtgtgtttgtgtgcctt

SEQ ID NO: 461039 - DNA, 20 bp, Artificial Sequence
  chemically synthesized
gtgtgtgtttgtgtgccttg

SEQ ID NO: 461040 - DNA, 20 bp, Artificial Sequence
  chemically synthesized
tgtttgtgtgccttgaggtt

SEQ ID NO: 461041 - DNA, 20 bp, Artificial Sequence
  chemically synthesized
tcttgtacatcttaacctca

SEQ ID NO: 461042 - DNA, 20 bp, Artificial Sequence
  chemically synthesized
ttcttgtacatcttaacctc

SEQ ID NO: 461043 - DNA, 20 bp, Artificial Sequence
  chemically synthesized
gccttgaggttaagatgtac

SEQ ID NO: 461044 - DNA, 20 bp, Artificial Sequence
  chemically synthesized
ttgaggttaagatgtacaag

SEQ ID NO: 461045 - DNA, 20 bp, Artificial Sequence
  chemically synthesized
ggttaagatgtacaagaagt

SEQ ID NO: 461046 - DNA, 20 bp, Artificial Sequence
  chemically synthesized
atgtacaagaagtaagcatt

SEQ ID NO: 461047 - DNA, 20 bp, Artificial Sequence
  chemically synthesized
acaagaagtaagcatttgga

SEQ ID NO: 461048 - DNA, 20 bp, Artificial Sequence
  chemically synthesized
tgtgtgcgtgtgtaatgtca

SEQ ID NO: 461049 - DNA, 20 bp, Artificial Sequence
  chemically synthesized
gtagatatatacataaatgg

SEQ ID NO: 461050 - DNA, 20 bp, Artificial Sequence
  chemically synthesized
tgtagatatatacataaatg

SEQ ID NO: 461051 - DNA, 20 bp, Artificial Sequence
  chemically synthesized
gtgtagatatatacataaat

SEQ ID NO: 461052 - DNA, 20 bp, Artificial Sequence
  chemically synthesized
tgtgtagatatatacataaa

SEQ ID NO: 461053 - DNA, 20 bp, Artificial Sequence
  chemically synthesized
ttattatgtctatgtttgtg

SEQ ID NO: 461054 - DNA, 20 bp, Artificial Sequence
  chemically synthesized
tgtatatatctacacaaaca

SEQ ID NO: 461055 - DNA, 20 bp, Artificial Sequence
  chemically synthesized
ataattatattaaactctac

SEQ ID NO: 461056 - DNA, 20 bp, Artificial Sequence
  chemically synthesized
tgagcaataggaaactagta

SEQ ID NO: 461057 - DNA, 20 bp, Artificial Sequence
  chemically synthesized
tatgagcaataggaaactag

SEQ ID NO: 461058 - DNA, 20 bp, Artificial Sequence
  chemically synthesized
ttatatgagcaataggaaac

SEQ ID NO: 461059 - DNA, 20 bp, Artificial Sequence
  chemically synthesized
taatttattatatgagcaat

SEQ ID NO: 461060 - DNA, 20 bp, Artificial Sequence
  chemically synthesized
gtaatttattatatgagcaa

SEQ ID NO: 461061 - DNA, 20 bp, Artificial Sequence
  chemically synthesized
ttcatggtaatttattatat

SEQ ID NO: 461062 - DNA, 20 bp, Artificial Sequence
  chemically synthesized
ataataaattaccatgaact

SEQ ID NO: 461063 - DNA, 20 bp, Artificial Sequence
  chemically synthesized
catttaaatcactaagttca

SEQ ID NO: 461064 - DNA, 20 bp, Artificial Sequence
  chemically synthesized
atatgtacatttaaatcact

SEQ ID NO: 461065 - DNA, 20 bp, Artificial Sequence
  chemically synthesized
actctgtctcaaaaaaataa

SEQ ID NO: 461066 - DNA, 20 bp, Artificial Sequence
  chemically synthesized
tttttatcttttattttttt

SEQ ID NO: 461067 - DNA, 20 bp, Artificial Sequence
  chemically synthesized
tatcttttatttttttgaga

SEQ ID NO: 461068 - DNA, 20 bp, Artificial Sequence
  chemically synthesized
tcttttatttttttgagaca

SEQ ID NO: 461069 - DNA, 20 bp, Artificial Sequence
  chemically synthesized
atttttttgagacagagtct

SEQ ID NO: 461070 - DNA, 20 bp, Artificial Sequence
  chemically synthesized
gcctgggcgacagagtgact

SEQ ID NO: 461071 - DNA, 20 bp, Artificial Sequence
  chemically synthesized
gtctcagtcactctgtcgcc

SEQ ID NO: 461072 - DNA, 20 bp, Artificial Sequence
  chemically synthesized
acactccagcctgggcgaca

SEQ ID NO: 461073 - DNA, 20 bp, Artificial Sequence
  chemically synthesized
tctcagtcactctgtcgccc

SEQ ID NO: 461074 - DNA, 20 bp, Artificial Sequence
  chemically synthesized
ccacactccagcctgggcga

SEQ ID NO: 461075 - DNA, 20 bp, Artificial Sequence
  chemically synthesized
agtcactctgtcgcccaggc

SEQ ID NO: 461076 - DNA, 20 bp, Artificial Sequence
  chemically synthesized
tcactctgtcgcccaggctg

SEQ ID NO: 461077 - DNA, 20 bp, Artificial Sequence
  chemically synthesized
gtgccaccacactccagcct

SEQ ID NO: 461078 - DNA, 20 bp, Artificial Sequence
  chemically synthesized
cgtgccaccacactccagcc

SEQ ID NO: 461079 - DNA, 20 bp, Artificial Sequence
  chemically synthesized
ctgtcgcccaggctggagtg

SEQ ID NO: 461080 - DNA, 20 bp, Artificial Sequence
  chemically synthesized
gagatcgtgccaccacactc

SEQ ID NO: 461081 - DNA, 20 bp, Artificial Sequence
  chemically synthesized
tcgcccaggctggagtgtgg

SEQ ID NO: 461082 - DNA, 20 bp, Artificial Sequence
  chemically synthesized
ggagtgtggtggcacgatct

SEQ ID NO: 461083 - DNA, 20 bp, Artificial Sequence
  chemically synthesized
gatagaggttgcagtgagcc

SEQ ID NO: 461084 - DNA, 20 bp, Artificial Sequence
  chemically synthesized
tgggagatagaggttgcagt

SEQ ID NO: 461085 - DNA, 20 bp, Artificial Sequence
  chemically synthesized
ggcctgggagatagaggttg

SEQ ID NO: 461086 - DNA, 20 bp, Artificial Sequence
  chemically synthesized
tgcttgggcctgggagatag

SEQ ID NO: 461087 - DNA, 20 bp, Artificial Sequence
  chemically synthesized
tcactgcaacctctatctcc

SEQ ID NO: 461088 - DNA, 20 bp, Artificial Sequence
  chemically synthesized
ttgcttgggcctgggagata

SEQ ID NO: 461089 - DNA, 20 bp, Artificial Sequence
  chemically synthesized
cactgcaacctctatctccc

SEQ ID NO: 461090 - DNA, 20 bp, Artificial Sequence
  chemically synthesized
aattgcttgggcctgggaga

SEQ ID NO: 461091 - DNA, 20 bp, Artificial Sequence
  chemically synthesized
tcagaattgcttgggcctgg

SEQ ID NO: 461092 - DNA, 20 bp, Artificial Sequence
  chemically synthesized
aacctctatctcccaggccc

SEQ ID NO: 461093 - DNA, 20 bp, Artificial Sequence
  chemically synthesized
catcagaattgcttgggcct

SEQ ID NO: 461094 - DNA, 20 bp, Artificial Sequence
  chemically synthesized
gcatcagaattgcttgggcc

SEQ ID NO: 461095 - DNA, 20 bp, Artificial Sequence
  chemically synthesized
ctgaggcatcagaattgctt

SEQ ID NO: 461096 - DNA, 20 bp, Artificial Sequence
  chemically synthesized
gctgaggcatcagaattgct

SEQ ID NO: 461097 - DNA, 20 bp, Artificial Sequence
  chemically synthesized
cccaagcaattctgatgcct

SEQ ID NO: 461098 - DNA, 20 bp, Artificial Sequence
  chemically synthesized
gacttgggaagctgaggcat

SEQ ID NO: 461099 - DNA, 20 bp, Artificial Sequence
  chemically synthesized
cccagcgacttgggaagctg

SEQ ID NO: 461100 - DNA, 20 bp, Artificial Sequence
  chemically synthesized
tcccagcgacttgggaagct

SEQ ID NO: 461101 - DNA, 20 bp, Artificial Sequence
  chemically synthesized
ttctgatgcctcagcttccc

SEQ ID NO: 461102 - DNA, 20 bp, Artificial Sequence
  chemically synthesized
tgtagtcccagcgacttggg

SEQ ID NO: 461103 - DNA, 20 bp, Artificial Sequence
  chemically synthesized
gcctcagcttcccaagtcgc

SEQ ID NO: 461104 - DNA, 20 bp, Artificial Sequence
  chemically synthesized
gcctgtagtcccagcgactt

SEQ ID NO: 461105 - DNA, 20 bp, Artificial Sequence
  chemically synthesized
cctcagcttcccaagtcgct

SEQ ID NO: 461106 - DNA, 20 bp, Artificial Sequence
  chemically synthesized
cgcctgtagtcccagcgact

SEQ ID NO: 461107 - DNA, 20 bp, Artificial Sequence
  chemically synthesized
ttcccaagtcgctgggacta

SEQ ID NO: 461108 - DNA, 20 bp, Artificial Sequence
  chemically synthesized
tcccaagtcgctgggactac

SEQ ID NO: 461109 - DNA, 20 bp, Artificial Sequence
  chemically synthesized
gtgatgcacgcctgtagtcc

SEQ ID NO: 461110 - DNA, 20 bp, Artificial Sequence
  chemically synthesized
ggggtggtgatgcacgcctg

SEQ ID NO: 461111 - DNA, 20 bp, Artificial Sequence
  chemically synthesized
caggcgtgcatcaccacccc

SEQ ID NO: 461112 - DNA, 20 bp, Artificial Sequence
  chemically synthesized
atacaaaaatttgcttgggg

SEQ ID NO: 461113 - DNA, 20 bp, Artificial Sequence
  chemically synthesized
aaaatacaaaaatttgcttg

SEQ ID NO: 461114 - DNA, 20 bp, Artificial Sequence
  chemically synthesized
aaaaatacaaaaatttgctt

SEQ ID NO: 461115 - DNA, 20 bp, Artificial Sequence
  chemically synthesized
taaaaatacaaaaatttgct

SEQ ID NO: 461116 - DNA, 20 bp, Artificial Sequence
  chemically synthesized
caagcaaatttttgtatttt

SEQ ID NO: 461117 - DNA, 20 bp, Artificial Sequence
  chemically synthesized
gcaaatttttgtatttttag

SEQ ID NO: 461118 - DNA, 20 bp, Artificial Sequence
  chemically synthesized
aaatttttgtatttttagta

SEQ ID NO: 461119 - DNA, 20 bp, Artificial Sequence
  chemically synthesized
ttttgtatttttagtagaga

SEQ ID NO: 461120 - DNA, 20 bp, Artificial Sequence
  chemically synthesized
tttgtatttttagtagagat

SEQ ID NO: 461121 - DNA, 20 bp, Artificial Sequence
  chemically synthesized
ctgcctggccaaaatggtaa

SEQ ID NO: 461122 - DNA, 20 bp, Artificial Sequence
  chemically synthesized
gagatgggcttttaccattt

SEQ ID NO: 461123 - DNA, 20 bp, Artificial Sequence
  chemically synthesized
tgggcttttaccattttggc

SEQ ID NO: 461124 - DNA, 20 bp, Artificial Sequence
  chemically synthesized
tgagacctgcctggccaaaa

SEQ ID NO: 461125 - DNA, 20 bp, Artificial Sequence
  chemically synthesized
gggcttttaccattttggcc

SEQ ID NO: 461126 - DNA, 20 bp, Artificial Sequence
  chemically synthesized
cttttaccattttggccagg

SEQ ID NO: 461127 - DNA, 20 bp, Artificial Sequence
  chemically synthesized
ttttaccattttggccaggc

SEQ ID NO: 461128 - DNA, 20 bp, Artificial Sequence
  chemically synthesized
tcaggagtttgagacctgcc

SEQ ID NO: 461129 - DNA, 20 bp, Artificial Sequence
  chemically synthesized
tcacatgaggtcaggagttt

SEQ ID NO: 461130 - DNA, 20 bp, Artificial Sequence
  chemically synthesized
gacggatcacatgaggtcag

SEQ ID NO: 461131 - DNA, 20 bp, Artificial Sequence
  chemically synthesized
tggacggatcacatgaggtc

SEQ ID NO: 461132 - DNA, 20 bp, Artificial Sequence
  chemically synthesized
gtggacggatcacatgaggt

SEQ ID NO: 461133 - DNA, 20 bp, Artificial Sequence
  chemically synthesized
caaggtggacggatcacatg

SEQ ID NO: 461134 - DNA, 20 bp, Artificial Sequence
  chemically synthesized
ccaaggtggacggatcacat

SEQ ID NO: 461135 - DNA, 20 bp, Artificial Sequence
  chemically synthesized
ctcatgtgatccgtccacct

SEQ ID NO: 461136 - DNA, 20 bp, Artificial Sequence
  chemically synthesized
ctttgcgaggccaaggtgga

SEQ ID NO: 461137 - DNA, 20 bp, Artificial Sequence
  chemically synthesized
aacactttgcgaggccaagg

SEQ ID NO: 461138 - DNA, 20 bp, Artificial Sequence
  chemically synthesized
cccaacactttgcgaggcca

SEQ ID NO: 461139 - DNA, 20 bp, Artificial Sequence
  chemically synthesized
tcccaacactttgcgaggcc

SEQ ID NO: 461140 - DNA, 20 bp, Artificial Sequence
  chemically synthesized
ccgtccaccttggcctcgca

SEQ ID NO: 461141 - DNA, 20 bp, Artificial Sequence
  chemically synthesized
tgtaatcccaacactttgcg

SEQ ID NO: 461142 - DNA, 20 bp, Artificial Sequence
  chemically synthesized
atgtaatcccaacactttgc

SEQ ID NO: 461143 - DNA, 20 bp, Artificial Sequence
  chemically synthesized
accttggcctcgcaaagtgt

SEQ ID NO: 461144 - DNA, 20 bp, Artificial Sequence
  chemically synthesized
ccttggcctcgcaaagtgtt

SEQ ID NO: 461145 - DNA, 20 bp, Artificial Sequence
  chemically synthesized
catgcgtgatccactgtgcc

SEQ ID NO: 461146 - DNA, 20 bp, Artificial Sequence
  chemically synthesized
aaaaaacaggctgggcacag

SEQ ID NO: 461147 - DNA, 20 bp, Artificial Sequence
  chemically synthesized
aaaaaaaaacaggctgggca

SEQ ID NO: 461148 - DNA, 20 bp, Artificial Sequence
  chemically synthesized
aaacaaaaaaaaaacaggct

SEQ ID NO: 461149 - DNA, 20 bp, Artificial Sequence
  chemically synthesized
aaaacaaaaaaaaaacaggc

SEQ ID NO: 461150 - DNA, 20 bp, Artificial Sequence
  chemically synthesized
aaaaaaaacaaaaaaaaaac

SEQ ID NO: 461151 - DNA, 20 bp, Artificial Sequence
  chemically synthesized
aaaaaaaaacaaaaaaaaaa

SEQ ID NO: 461152 - DNA, 20 bp, Artificial Sequence
  chemically synthesized
ttttttttttttatctttct

SEQ ID NO: 461153 - DNA, 20 bp, Artificial Sequence
  chemically synthesized
ttttttttttatctttctta

SEQ ID NO: 461154 - DNA, 20 bp, Artificial Sequence
  chemically synthesized
tttagtccagaactctaaga

SEQ ID NO: 461155 - DNA, 20 bp, Artificial Sequence
  chemically synthesized
ttttatctttcttagagttc

SEQ ID NO: 461156 - DNA, 20 bp, Artificial Sequence
  chemically synthesized
tggttttagtccagaactct

SEQ ID NO: 461157 - DNA, 20 bp, Artificial Sequence
  chemically synthesized
ttgacaccttggttttagtc

SEQ ID NO: 461158 - DNA, 20 bp, Artificial Sequence
  chemically synthesized
tagagttctggactaaaacc

SEQ ID NO: 461159 - DNA, 20 bp, Artificial Sequence
  chemically synthesized
agagttctggactaaaacca

SEQ ID NO: 461160 - DNA, 20 bp, Artificial Sequence
  chemically synthesized
ccccattgacaccttggttt

SEQ ID NO: 461161 - DNA, 20 bp, Artificial Sequence
  chemically synthesized
acagcgccccattgacacct

SEQ ID NO: 461162 - DNA, 20 bp, Artificial Sequence
  chemically synthesized
gactaaaaccaaggtgtcaa

SEQ ID NO: 461163 - DNA, 20 bp, Artificial Sequence
  chemically synthesized
actaaaaccaaggtgtcaat

SEQ ID NO: 461164 - DNA, 20 bp, Artificial Sequence
  chemically synthesized
ctaaaaccaaggtgtcaatg

SEQ ID NO: 461165 - DNA, 20 bp, Artificial Sequence
  chemically synthesized
caatggggcgctgttcattc

SEQ ID NO: 461166 - DNA, 20 bp, Artificial Sequence
  chemically synthesized
cctagagtctccagaatgaa

SEQ ID NO: 461167 - DNA, 20 bp, Artificial Sequence
  chemically synthesized
atggggcgctgttcattctg

SEQ ID NO: 461168 - DNA, 20 bp, Artificial Sequence
  chemically synthesized
gctgttcattctggagactc

SEQ ID NO: 461169 - DNA, 20 bp, Artificial Sequence
  chemically synthesized
ggattctcccctagagtctc

SEQ ID NO: 461170 - DNA, 20 bp, Artificial Sequence
  chemically synthesized
ctgttcattctggagactct

SEQ ID NO: 461171 - DNA, 20 bp, Artificial Sequence
  chemically synthesized
tgttcattctggagactcta

SEQ ID NO: 461172 - DNA, 20 bp, Artificial Sequence
  chemically synthesized
gttcattctggagactctag

SEQ ID NO: 461173 - DNA, 20 bp, Artificial Sequence
  chemically synthesized
tcattctggagactctaggg

SEQ ID NO: 461174 - DNA, 20 bp, Artificial Sequence
  chemically synthesized
aggaaatggattctccccta

SEQ ID NO: 461175 - DNA, 20 bp, Artificial Sequence
  chemically synthesized
ctaggaaatggattctcccc

SEQ ID NO: 461176 - DNA, 20 bp, Artificial Sequence
  chemically synthesized
ctaggggagaatccatttcc

SEQ ID NO: 461177 - DNA, 20 bp, Artificial Sequence
  chemically synthesized
agcctctagaagctaggaaa

SEQ ID NO: 461178 - DNA, 20 bp, Artificial Sequence
  chemically synthesized
agaatccatttcctagcttc

SEQ ID NO: 461179 - DNA, 20 bp, Artificial Sequence
  chemically synthesized
gtaggcagcctctagaagct

SEQ ID NO: 461180 - DNA, 20 bp, Artificial Sequence
  chemically synthesized
aatccatttcctagcttcta

SEQ ID NO: 461181 - DNA, 20 bp, Artificial Sequence
  chemically synthesized
tgtaggcagcctctagaagc

SEQ ID NO: 461182 - DNA, 20 bp, Artificial Sequence
  chemically synthesized
atccatttcctagcttctag

SEQ ID NO: 461183 - DNA, 20 bp, Artificial Sequence
  chemically synthesized
ggaatgtaggcagcctctag

SEQ ID NO: 461184 - DNA, 20 bp, Artificial Sequence
  chemically synthesized
caaggaatgtaggcagcctc

SEQ ID NO: 461185 - DNA, 20 bp, Artificial Sequence
  chemically synthesized
catgaatcaaggaatgtagg

SEQ ID NO: 461186 - DNA, 20 bp, Artificial Sequence
  chemically synthesized
ggccatgaatcaaggaatgt

SEQ ID NO: 461187 - DNA, 20 bp, Artificial Sequence
  chemically synthesized
gggccatgaatcaaggaatg

SEQ ID NO: 461188 - DNA, 20 bp, Artificial Sequence
  chemically synthesized
tgcctacattccttgattca

SEQ ID NO: 461189 - DNA, 20 bp, Artificial Sequence
  chemically synthesized
aggaaaggggccatgaatca

SEQ ID NO: 461190 - DNA, 20 bp, Artificial Sequence
  chemically synthesized
gaggaaaggggccatgaatc

SEQ ID NO: 461191 - DNA, 20 bp, Artificial Sequence
  chemically synthesized
gctttgaaaatggaggaaag

SEQ ID NO: 461192 - DNA, 20 bp, Artificial Sequence
  chemically synthesized
tgctttgaaaatggaggaaa

SEQ ID NO: 461193 - DNA, 20 bp, Artificial Sequence
  chemically synthesized
ttgctttgaaaatggaggaa

SEQ ID NO: 461194 - DNA, 20 bp, Artificial Sequence
  chemically synthesized
cttgctttgaaaatggagga

SEQ ID NO: 461195 - DNA, 20 bp, Artificial Sequence
  chemically synthesized
actgcttgctttgaaaatgg

SEQ ID NO: 461196 - DNA, 20 bp, Artificial Sequence
  chemically synthesized
tactgcttgctttgaaaatg

SEQ ID NO: 461197 - DNA, 20 bp, Artificial Sequence
  chemically synthesized
gcccctttcctccattttca

SEQ ID NO: 461198 - DNA, 20 bp, Artificial Sequence
  chemically synthesized
tatactgcttgctttgaaaa

SEQ ID NO: 461199 - DNA, 20 bp, Artificial Sequence
  chemically synthesized
ctttcctccattttcaaagc

SEQ ID NO: 461200 - DNA, 20 bp, Artificial Sequence
  chemically synthesized
tcctccattttcaaagcaag

SEQ ID NO: 461201 - DNA, 20 bp, Artificial Sequence
  chemically synthesized
cattttcaaagcaagcagta

SEQ ID NO: 461202 - DNA, 20 bp, Artificial Sequence
  chemically synthesized
gcaagcagtatagcatcttc

SEQ ID NO: 461203 - DNA, 20 bp, Artificial Sequence
  chemically synthesized
agtaatgtgatgtagactgg

SEQ ID NO: 461204 - DNA, 20 bp, Artificial Sequence
  chemically synthesized
cagagtaatgtgatgtagac

SEQ ID NO: 461205 - DNA, 20 bp, Artificial Sequence
  chemically synthesized
tgtgtcagagtaatgtgatg

SEQ ID NO: 461206 - DNA, 20 bp, Artificial Sequence
  chemically synthesized
gaatgaaaagcagtgtgtca

SEQ ID NO: 461207 - DNA, 20 bp, Artificial Sequence
  chemically synthesized
tggaatgaaaagcagtgtgt

SEQ ID NO: 461208 - DNA, 20 bp, Artificial Sequence
  chemically synthesized
ggagatgttggaatgaaaag

SEQ ID NO: 461209 - DNA, 20 bp, Artificial Sequence
  chemically synthesized
aaaggagatgttggaatgaa

SEQ ID NO: 461210 - DNA, 20 bp, Artificial Sequence
  chemically synthesized
caaggagtcaaaggagatgt

SEQ ID NO: 461211 - DNA, 20 bp, Artificial Sequence
  chemically synthesized
aatccttcaaggagtcaaag

SEQ ID NO: 461212 - DNA, 20 bp, Artificial Sequence
  chemically synthesized
aaaatccttcaaggagtcaa

SEQ ID NO: 461213 - DNA, 20 bp, Artificial Sequence
  chemically synthesized
aaaaatccttcaaggagtca

SEQ ID NO: 461214 - DNA, 20 bp, Artificial Sequence
  chemically synthesized
acatctcctttgactccttg

SEQ ID NO: 461215 - DNA, 20 bp, Artificial Sequence
  chemically synthesized
catctcctttgactccttga

SEQ ID NO: 461216 - DNA, 20 bp, Artificial Sequence
  chemically synthesized
gaagaaaaaaatccttcaag

SEQ ID NO: 461217 - DNA, 20 bp, Artificial Sequence
  chemically synthesized
aggaagaaaaaaatccttca

SEQ ID NO: 461218 - DNA, 20 bp, Artificial Sequence
  chemically synthesized
aaggaagaaaaaaatccttc

SEQ ID NO: 461219 - DNA, 20 bp, Artificial Sequence
  chemically synthesized
actccgtatcaaaaaaaagg

SEQ ID NO: 461220 - DNA, 20 bp, Artificial Sequence
  chemically synthesized
gaaactccgtatcaaaaaaa

SEQ ID NO: 461221 - DNA, 20 bp, Artificial Sequence
  chemically synthesized
tgaaactccgtatcaaaaaa

SEQ ID NO: 461222 - DNA, 20 bp, Artificial Sequence
  chemically synthesized
tttcttccttttttttgata

SEQ ID NO: 461223 - DNA, 20 bp, Artificial Sequence
  chemically synthesized
tcttccttttttttgatacg

SEQ ID NO: 461224 - DNA, 20 bp, Artificial Sequence
  chemically synthesized
cactccagcctgggcaacaa

SEQ ID NO: 461225 - DNA, 20 bp, Artificial Sequence
  chemically synthesized
ggagtttcactcttgttgcc

SEQ ID NO: 461226 - DNA, 20 bp, Artificial Sequence
  chemically synthesized
gagtttcactcttgttgccc

SEQ ID NO: 461227 - DNA, 20 bp, Artificial Sequence
  chemically synthesized
tgcactccagcctgggcaac

SEQ ID NO: 461228 - DNA, 20 bp, Artificial Sequence
  chemically synthesized
ttcactcttgttgcccaggc

SEQ ID NO: 461229 - DNA, 20 bp, Artificial Sequence
  chemically synthesized
cactcttgttgcccaggctg

SEQ ID NO: 461230 - DNA, 20 bp, Artificial Sequence
  chemically synthesized
acgccattgcactccagcct

SEQ ID NO: 461231 - DNA, 20 bp, Artificial Sequence
  chemically synthesized
cacgccattgcactccagcc

SEQ ID NO: 461232 - DNA, 20 bp, Artificial Sequence
  chemically synthesized
aagatcacgccattgcactc

SEQ ID NO: 461233 - DNA, 20 bp, Artificial Sequence
  chemically synthesized
ttgcccaggctggagtgcaa

SEQ ID NO: 461234 - DNA, 20 bp, Artificial Sequence
  chemically synthesized
ggagtgcaatggcgtgatct

SEQ ID NO: 461235 - DNA, 20 bp, Artificial Sequence
  chemically synthesized
ggcggaagttgtagtgagcc

SEQ ID NO: 461236 - DNA, 20 bp, Artificial Sequence
  chemically synthesized
caggaggcggaagttgtagt

SEQ ID NO: 461237 - DNA, 20 bp, Artificial Sequence
  chemically synthesized
aacccaggaggcggaagttg

SEQ ID NO: 461238 - DNA, 20 bp, Artificial Sequence
  chemically synthesized
tgcttgaacccaggaggcgg

SEQ ID NO: 461239 - DNA, 20 bp, Artificial Sequence
  chemically synthesized
tcactacaacttccgcctcc

SEQ ID NO: 461240 - DNA, 20 bp, Artificial Sequence
  chemically synthesized
cactacaacttccgcctcct

SEQ ID NO: 461241 - DNA, 20 bp, Artificial Sequence
  chemically synthesized
aattgcttgaacccaggagg

SEQ ID NO: 461242 - DNA, 20 bp, Artificial Sequence
  chemically synthesized
gagaattgcttgaacccagg

SEQ ID NO: 461243 - DNA, 20 bp, Artificial Sequence
  chemically synthesized
ggagaattgcttgaacccag

SEQ ID NO: 461244 - DNA, 20 bp, Artificial Sequence
  chemically synthesized
aacttccgcctcctgggttc

SEQ ID NO: 461245 - DNA, 20 bp, Artificial Sequence
  chemically synthesized
caggagaattgcttgaaccc

SEQ ID NO: 461246 - DNA, 20 bp, Artificial Sequence
  chemically synthesized
gcaggagaattgcttgaacc

SEQ ID NO: 461247 - DNA, 20 bp, Artificial Sequence
  chemically synthesized
ttcaagcaattctcctgcct

SEQ ID NO: 461248 - DNA, 20 bp, Artificial Sequence
  chemically synthesized
tacttgggaggctgaggcag

SEQ ID NO: 461249 - DNA, 20 bp, Artificial Sequence
  chemically synthesized
gctacttgggaggctgaggc

SEQ ID NO: 461250 - DNA, 20 bp, Artificial Sequence
  chemically synthesized
agctacttgggaggctgagg

SEQ ID NO: 461251 - DNA, 20 bp, Artificial Sequence
  chemically synthesized
cccagctacttgggaggctg

SEQ ID NO: 461252 - DNA, 20 bp, Artificial Sequence
  chemically synthesized
tcccagctacttgggaggct

SEQ ID NO: 461253 - DNA, 20 bp, Artificial Sequence
  chemically synthesized
ttctcctgcctcagcctccc

SEQ ID NO: 461254 - DNA, 20 bp, Artificial Sequence
  chemically synthesized
tcctgcctcagcctcccaag

SEQ ID NO: 461255 - DNA, 20 bp, Artificial Sequence
  chemically synthesized
tgtaatcccagctacttggg

SEQ ID NO: 461256 - DNA, 20 bp, Artificial Sequence
  chemically synthesized
ctgtaatcccagctacttgg

SEQ ID NO: 461257 - DNA, 20 bp, Artificial Sequence
  chemically synthesized
gcctcagcctcccaagtagc

SEQ ID NO: 461258 - DNA, 20 bp, Artificial Sequence
  chemically synthesized
gcctgtaatcccagctactt

SEQ ID NO: 461259 - DNA, 20 bp, Artificial Sequence
  chemically synthesized
cctcagcctcccaagtagct

SEQ ID NO: 461260 - DNA, 20 bp, Artificial Sequence
  chemically synthesized
tgcctgtaatcccagctact

SEQ ID NO: 461261 - DNA, 20 bp, Artificial Sequence
  chemically synthesized
ctcccaagtagctgggatta

SEQ ID NO: 461262 - DNA, 20 bp, Artificial Sequence
  chemically synthesized
tcccaagtagctgggattac

SEQ ID NO: 461263 - DNA, 20 bp, Artificial Sequence
  chemically synthesized
gtggtgcatgcctgtaatcc

SEQ ID NO: 461264 - DNA, 20 bp, Artificial Sequence
  chemically synthesized
caggcatgcaccaccatgcc

SEQ ID NO: 461265 - DNA, 20 bp, Artificial Sequence
  chemically synthesized
acaaaattagccaggcatgg

SEQ ID NO: 461266 - DNA, 20 bp, Artificial Sequence
  chemically synthesized
aatacaaaattagccaggca

SEQ ID NO: 461267 - DNA, 20 bp, Artificial Sequence
  chemically synthesized
tacaaaatacaaaattagcc

SEQ ID NO: 461268 - DNA, 20 bp, Artificial Sequence
  chemically synthesized
ctacaaaatacaaaattagc

SEQ ID NO: 461269 - DNA, 20 bp, Artificial Sequence
  chemically synthesized
tctactacaaaatacaaaat

SEQ ID NO: 461270 - DNA, 20 bp, Artificial Sequence
  chemically synthesized
ctggctaattttgtattttg

SEQ ID NO: 461271 - DNA, 20 bp, Artificial Sequence
  chemically synthesized
gctaattttgtattttgtag

SEQ ID NO: 461272 - DNA, 20 bp, Artificial Sequence
  chemically synthesized
taattttgtattttgtagta

SEQ ID NO: 461273 - DNA, 20 bp, Artificial Sequence
  chemically synthesized
ttttgtattttgtagtagag

SEQ ID NO: 461274 - DNA, 20 bp, Artificial Sequence
  chemically synthesized
tttgtattttgtagtagaga

SEQ ID NO: 461275 - DNA, 20 bp, Artificial Sequence
  chemically synthesized
ttgtattttgtagtagagaa

SEQ ID NO: 461276 - DNA, 20 bp, Artificial Sequence
  chemically synthesized
tgtattttgtagtagagaag

SEQ ID NO: 461277 - DNA, 20 bp, Artificial Sequence
  chemically synthesized
gagaaggggtttcaccatgt

SEQ ID NO: 461278 - DNA, 20 bp, Artificial Sequence
  chemically synthesized
caagaccagcttggccaaca

SEQ ID NO: 461279 - DNA, 20 bp, Artificial Sequence
  chemically synthesized
ggggtttcaccatgttggcc

SEQ ID NO: 461280 - DNA, 20 bp, Artificial Sequence
  chemically synthesized
tttcaccatgttggccaagc

SEQ ID NO: 461281 - DNA, 20 bp, Artificial Sequence
  chemically synthesized
tcaggagttcaagaccagct

SEQ ID NO: 461282 - DNA, 20 bp, Artificial Sequence
  chemically synthesized
tgaggtcaggagttcaagac

SEQ ID NO: 461283 - DNA, 20 bp, Artificial Sequence
  chemically synthesized
tcacctgaggtcaggagttc

SEQ ID NO: 461284 - DNA, 20 bp, Artificial Sequence
  chemically synthesized
tggtcttgaactcctgacct

SEQ ID NO: 461285 - DNA, 20 bp, Artificial Sequence
  chemically synthesized
ggtggatcacctgaggtcag

SEQ ID NO: 461286 - DNA, 20 bp, Artificial Sequence
  chemically synthesized
ggtcttgaactcctgacctc

SEQ ID NO: 461287 - DNA, 20 bp, Artificial Sequence
  chemically synthesized
cgggtggatcacctgaggtc

SEQ ID NO: 461288 - DNA, 20 bp, Artificial Sequence
  chemically synthesized
gcgggtggatcacctgaggt

SEQ ID NO: 461289 - DNA, 20 bp, Artificial Sequence
  chemically synthesized
tgaggcgggtggatcacctg

SEQ ID NO: 461290 - DNA, 20 bp, Artificial Sequence
  chemically synthesized
ctgaggcgggtggatcacct

SEQ ID NO: 461291 - DNA, 20 bp, Artificial Sequence
  chemically synthesized
ctcaggtgatccacccgcct

SEQ ID NO: 461292 - DNA, 20 bp, Artificial Sequence
  chemically synthesized
ctttgggaggctgaggcggg

SEQ ID NO: 461293 - DNA, 20 bp, Artificial Sequence
  chemically synthesized
gcactttgggaggctgaggc

SEQ ID NO: 461294 - DNA, 20 bp, Artificial Sequence
  chemically synthesized
agcactttgggaggctgagg

SEQ ID NO: 461295 - DNA, 20 bp, Artificial Sequence
  chemically synthesized
cccagcactttgggaggctg

SEQ ID NO: 461296 - DNA, 20 bp, Artificial Sequence
  chemically synthesized
tcccagcactttgggaggct

SEQ ID NO: 461297 - DNA, 20 bp, Artificial Sequence
  chemically synthesized
ccacccgcctcagcctccca

SEQ ID NO: 461298 - DNA, 20 bp, Artificial Sequence
  chemically synthesized
tgtaatcccagcactttggg

SEQ ID NO: 461299 - DNA, 20 bp, Artificial Sequence
  chemically synthesized
ctgtaatcccagcactttgg

SEQ ID NO: 461300 - DNA, 20 bp, Artificial Sequence
  chemically synthesized
gcctcagcctcccaaagtgc

SEQ ID NO: 461301 - DNA, 20 bp, Artificial Sequence
  chemically synthesized
gcctgtaatcccagcacttt

SEQ ID NO: 461302 - DNA, 20 bp, Artificial Sequence
  chemically synthesized
cctcagcctcccaaagtgct

SEQ ID NO: 461303 - DNA, 20 bp, Artificial Sequence
  chemically synthesized
tgcctgtaatcccagcactt

SEQ ID NO: 461304 - DNA, 20 bp, Artificial Sequence
  chemically synthesized
ctcccaaagtgctgggatta

SEQ ID NO: 461305 - DNA, 20 bp, Artificial Sequence
  chemically synthesized
tcccaaagtgctgggattac

SEQ ID NO: 461306 - DNA, 20 bp, Artificial Sequence
  chemically synthesized
gtggctcatgcctgtaatcc

SEQ ID NO: 461307 - DNA, 20 bp, Artificial Sequence
  chemically synthesized
agtgctgggattacaggcat

SEQ ID NO: 461308 - DNA, 20 bp, Artificial Sequence
  chemically synthesized
caggcatgagccaccgcacc

SEQ ID NO: 461309 - DNA, 20 bp, Artificial Sequence
  chemically synthesized
ttcaaggtggctaggtgcgg

SEQ ID NO: 461310 - DNA, 20 bp, Artificial Sequence
  chemically synthesized
tccttcaaggtggctaggtg

SEQ ID NO: 461311 - DNA, 20 bp, Artificial Sequence
  chemically synthesized
aaagatccttcaaggtggct

SEQ ID NO: 461312 - DNA, 20 bp, Artificial Sequence
  chemically synthesized
caaagatccttcaaggtggc

SEQ ID NO: 461313 - DNA, 20 bp, Artificial Sequence
  chemically synthesized
caccgcacctagccaccttg

SEQ ID NO: 461314 - DNA, 20 bp, Artificial Sequence
  chemically synthesized
accgcacctagccaccttga

SEQ ID NO: 461315 - DNA, 20 bp, Artificial Sequence
  chemically synthesized
cacacaaagatccttcaagg

SEQ ID NO: 461316 - DNA, 20 bp, Artificial Sequence
  chemically synthesized
aaacacacaaagatccttca

SEQ ID NO: 461317 - DNA, 20 bp, Artificial Sequence
  chemically synthesized
caaacacacaaagatccttc

SEQ ID NO: 461318 - DNA, 20 bp, Artificial Sequence
  chemically synthesized
aaaataagcacaaacacaca

SEQ ID NO: 461319 - DNA, 20 bp, Artificial Sequence
  chemically synthesized
ggatggaaccaattaaaaat

SEQ ID NO: 461320 - DNA, 20 bp, Artificial Sequence
  chemically synthesized
tgtttgtgcttatttttaat

SEQ ID NO: 461321 - DNA, 20 bp, Artificial Sequence
  chemically synthesized
attatcctggattatgtgga

SEQ ID NO: 461322 - DNA, 20 bp, Artificial Sequence
  chemically synthesized
ttggttccatccacataatc

SEQ ID NO: 461323 - DNA, 20 bp, Artificial Sequence
  chemically synthesized
taagattatcctggattatg

SEQ ID NO: 461324 - DNA, 20 bp, Artificial Sequence
  chemically synthesized
tggttccatccacataatcc

SEQ ID NO: 461325 - DNA, 20 bp, Artificial Sequence
  chemically synthesized
ttgagatggtaagattatcc

SEQ ID NO: 461326 - DNA, 20 bp, Artificial Sequence
  chemically synthesized
attagggactttgagatggt

SEQ ID NO: 461327 - DNA, 20 bp, Artificial Sequence
  chemically synthesized
aggataatcttaccatctca

SEQ ID NO: 461328 - DNA, 20 bp, Artificial Sequence
  chemically synthesized
ttaaattagggactttgaga

SEQ ID NO: 461329 - DNA, 20 bp, Artificial Sequence
  chemically synthesized
ttgattaaattagggacttt

SEQ ID NO: 461330 - DNA, 20 bp, Artificial Sequence
  chemically synthesized
ttgcagatttgattaaatta

SEQ ID NO: 461331 - DNA, 20 bp, Artificial Sequence
  chemically synthesized
tttgcagatttgattaaatt

SEQ ID NO: 461332 - DNA, 20 bp, Artificial Sequence
  chemically synthesized
ctttgcagatttgattaaat

SEQ ID NO: 461333 - DNA, 20 bp, Artificial Sequence
  chemically synthesized
ctaatttaatcaaatctgca

SEQ ID NO: 461334 - DNA, 20 bp, Artificial Sequence
  chemically synthesized
aaaaggcaaagtttactttg

SEQ ID NO: 461335 - DNA, 20 bp, Artificial Sequence
  chemically synthesized
tattttaccataaaaaggca

SEQ ID NO: 461336 - DNA, 20 bp, Artificial Sequence
  chemically synthesized
aagtaaactttgccttttta

SEQ ID NO: 461337 - DNA, 20 bp, Artificial Sequence
  chemically synthesized
gttaatattttaccataaaa

SEQ ID NO: 461338 - DNA, 20 bp, Artificial Sequence
  chemically synthesized
agttaatattttaccataaa

SEQ ID NO: 461339 - DNA, 20 bp, Artificial Sequence
  chemically synthesized
atggtaaaatattaacttaa

SEQ ID NO: 461340 - DNA, 20 bp, Artificial Sequence
  chemically synthesized
tggtaaaatattaacttaac

SEQ ID NO: 461341 - DNA, 20 bp, Artificial Sequence
  chemically synthesized
ttgaacaacccagtcccgtt

SEQ ID NO: 461342 - DNA, 20 bp, Artificial Sequence
  chemically synthesized
aaatattaacttaacgggac

SEQ ID NO: 461343 - DNA, 20 bp, Artificial Sequence
  chemically synthesized
aatattaacttaacgggact

SEQ ID NO: 461344 - DNA, 20 bp, Artificial Sequence
  chemically synthesized
tgtacagagtttgaacaacc

SEQ ID NO: 461345 - DNA, 20 bp, Artificial Sequence
  chemically synthesized
atatttctttggaatgtaca

SEQ ID NO: 461346 - DNA, 20 bp, Artificial Sequence
  chemically synthesized
agatatttctttggaatgta

SEQ ID NO: 461347 - DNA, 20 bp, Artificial Sequence
  chemically synthesized
ttcaaactctgtacattcca

SEQ ID NO: 461348 - DNA, 20 bp, Artificial Sequence
  chemically synthesized
tcaagagccagatatttctt

SEQ ID NO: 461349 - DNA, 20 bp, Artificial Sequence
  chemically synthesized
gtacattccaaagaaatatc

SEQ ID NO: 461350 - DNA, 20 bp, Artificial Sequence
  chemically synthesized
cccagaagccagtcaagagc

SEQ ID NO: 461351 - DNA, 20 bp, Artificial Sequence
  chemically synthesized
agaaatatctggctcttgac

SEQ ID NO: 461352 - DNA, 20 bp, Artificial Sequence
  chemically synthesized
attgcccagaagccagtcaa

SEQ ID NO: 461353 - DNA, 20 bp, Artificial Sequence
  chemically synthesized
gtattgcccagaagccagtc

SEQ ID NO: 461354 - DNA, 20 bp, Artificial Sequence
  chemically synthesized
tctggctcttgactggcttc

SEQ ID NO: 461355 - DNA, 20 bp, Artificial Sequence
  chemically synthesized
ctggctcttgactggcttct

SEQ ID NO: 461356 - DNA, 20 bp, Artificial Sequence
  chemically synthesized
atctggtattgcccagaagc

SEQ ID NO: 461357 - DNA, 20 bp, Artificial Sequence
  chemically synthesized
aactatctggtattgcccag

SEQ ID NO: 461358 - DNA, 20 bp, Artificial Sequence
  chemically synthesized
ataaactatctggtattgcc

SEQ ID NO: 461359 - DNA, 20 bp, Artificial Sequence
  chemically synthesized
gactggcttctgggcaatac

SEQ ID NO: 461360 - DNA, 20 bp, Artificial Sequence
  chemically synthesized
ggcttctgggcaataccaga

SEQ ID NO: 461361 - DNA, 20 bp, Artificial Sequence
  chemically synthesized
cattattaaaataaactatc

SEQ ID NO: 461362 - DNA, 20 bp, Artificial Sequence
  chemically synthesized
tagtttattttaataatgta

SEQ ID NO: 461363 - DNA, 20 bp, Artificial Sequence
  chemically synthesized
tattttaataatgtatggtg

SEQ ID NO: 461364 - DNA, 20 bp, Artificial Sequence
  chemically synthesized
ataatgtatggtgcagcttt

SEQ ID NO: 461365 - DNA, 20 bp, Artificial Sequence
  chemically synthesized
taatgtatggtgcagctttt

SEQ ID NO: 461366 - DNA, 20 bp, Artificial Sequence
  chemically synthesized
actgatacagtgtaacctaa

SEQ ID NO: 461367 - DNA, 20 bp, Artificial Sequence
  chemically synthesized
gcttttaggttacactgtat

SEQ ID NO: 461368 - DNA, 20 bp, Artificial Sequence
  chemically synthesized
ctccagagttcaaactgata

SEQ ID NO: 461369 - DNA, 20 bp, Artificial Sequence
  chemically synthesized
cactgtatcagtttgaactc

SEQ ID NO: 461370 - DNA, 20 bp, Artificial Sequence
  chemically synthesized
ctgtatcagtttgaactctg

SEQ ID NO: 461371 - DNA, 20 bp, Artificial Sequence
  chemically synthesized
gtatcagtttgaactctgga

SEQ ID NO: 461372 - DNA, 20 bp, Artificial Sequence
  chemically synthesized
tatcagtttgaactctggag

SEQ ID NO: 461373 - DNA, 20 bp, Artificial Sequence
  chemically synthesized
agtcatctccagcctctcca

SEQ ID NO: 461374 - DNA, 20 bp, Artificial Sequence
  chemically synthesized
agtttgaactctggagaggc

SEQ ID NO: 461375 - DNA, 20 bp, Artificial Sequence
  chemically synthesized
ttagtcatctccagcctctc

SEQ ID NO: 461376 - DNA, 20 bp, Artificial Sequence
  chemically synthesized
tttgaactctggagaggctg

SEQ ID NO: 461377 - DNA, 20 bp, Artificial Sequence
  chemically synthesized
tggctgactttagtcatctc

SEQ ID NO: 461378 - DNA, 20 bp, Artificial Sequence
  chemically synthesized
ggagaggctggagatgacta

SEQ ID NO: 461379 - DNA, 20 bp, Artificial Sequence
  chemically synthesized
aggctggagatgactaaagt

SEQ ID NO: 461380 - DNA, 20 bp, Artificial Sequence
  chemically synthesized
aacactcacatggctgactt

SEQ ID NO: 461381 - DNA, 20 bp, Artificial Sequence
  chemically synthesized
atgactaaagtcagccatgt

SEQ ID NO: 461382 - DNA, 20 bp, Artificial Sequence
  chemically synthesized
gtaggcatggaacactcaca

SEQ ID NO: 461383 - DNA, 20 bp, Artificial Sequence
  chemically synthesized
attggagtttgtagtaggca

SEQ ID NO: 461384 - DNA, 20 bp, Artificial Sequence
  chemically synthesized
attgtattggagtttgtagt

SEQ ID NO: 461385 - DNA, 20 bp, Artificial Sequence
  chemically synthesized
aattgtattggagtttgtag

SEQ ID NO: 461386 - DNA, 20 bp, Artificial Sequence
  chemically synthesized
tagaattgtattggagtttg

SEQ ID NO: 461387 - DNA, 20 bp, Artificial Sequence
  chemically synthesized
tggtgtctagaattgtattg

SEQ ID NO: 461388 - DNA, 20 bp, Artificial Sequence
  chemically synthesized
cttggtgtctagaattgtat

SEQ ID NO: 461389 - DNA, 20 bp, Artificial Sequence
  chemically synthesized
tacaaactccaatacaattc

SEQ ID NO: 461390 - DNA, 20 bp, Artificial Sequence
  chemically synthesized
ccaatacaattctagacacc

SEQ ID NO: 461391 - DNA, 20 bp, Artificial Sequence
  chemically synthesized
gttgcctaagtcttggtgtc

SEQ ID NO: 461392 - DNA, 20 bp, Artificial Sequence
  chemically synthesized
caattctagacaccaagact

SEQ ID NO: 461393 - DNA, 20 bp, Artificial Sequence
  chemically synthesized
aattctagacaccaagactt

SEQ ID NO: 461394 - DNA, 20 bp, Artificial Sequence
  chemically synthesized
acgaaaagttgcctaagtct

SEQ ID NO: 461395 - DNA, 20 bp, Artificial Sequence
  chemically synthesized
ttgccaacgaaaagttgcct

SEQ ID NO: 461396 - DNA, 20 bp, Artificial Sequence
  chemically synthesized
agacttaggcaacttttcgt

SEQ ID NO: 461397 - DNA, 20 bp, Artificial Sequence
  chemically synthesized
cacatcgtattgccaacgaa

SEQ ID NO: 461398 - DNA, 20 bp, Artificial Sequence
  chemically synthesized
gtgttgtcacacatcactgt

SEQ ID NO: 461399 - DNA, 20 bp, Artificial Sequence
  chemically synthesized
tgttgtcacacatcactgtt

SEQ ID NO: 461400 - DNA, 20 bp, Artificial Sequence
  chemically synthesized
acagcatttaattatcccaa

SEQ ID NO: 461401 - DNA, 20 bp, Artificial Sequence
  chemically synthesized
tgggataattaaatgctgtc

SEQ ID NO: 461402 - DNA, 20 bp, Artificial Sequence
  chemically synthesized
tcctcatgaagtcatctgga

SEQ ID NO: 461403 - DNA, 20 bp, Artificial Sequence
  chemically synthesized
cctctcctcatgaagtcatc

SEQ ID NO: 461404 - DNA, 20 bp, Artificial Sequence
  chemically synthesized
tgctgtccagatgacttcat

SEQ ID NO: 461405 - DNA, 20 bp, Artificial Sequence
  chemically synthesized
gctgtccagatgacttcatg

SEQ ID NO: 461406 - DNA, 20 bp, Artificial Sequence
  chemically synthesized
tgtccagatgacttcatgag

SEQ ID NO: 461407 - DNA, 20 bp, Artificial Sequence
  chemically synthesized
ccagttttcctctcctcatg

SEQ ID NO: 461408 - DNA, 20 bp, Artificial Sequence
  chemically synthesized
tccagatgacttcatgagga

SEQ ID NO: 461409 - DNA, 20 bp, Artificial Sequence
  chemically synthesized
ccagatgacttcatgaggag

SEQ ID NO: 461410 - DNA, 20 bp, Artificial Sequence
  chemically synthesized
cttcatgaggagaggaaaac

SEQ ID NO: 461411 - DNA, 20 bp, Artificial Sequence
  chemically synthesized
catgaggagaggaaaactgg

SEQ ID NO: 461412 - DNA, 20 bp, Artificial Sequence
  chemically synthesized
atgaggagaggaaaactgga

SEQ ID NO: 461413 - DNA, 20 bp, Artificial Sequence
  chemically synthesized
aggagaggaaaactggaagg

SEQ ID NO: 461414 - DNA, 20 bp, Artificial Sequence
  chemically synthesized
aaagaccaggtgccaccttc

SEQ ID NO: 461415 - DNA, 20 bp, Artificial Sequence
  chemically synthesized
gaaaactggaaggtggcacc

SEQ ID NO: 461416 - DNA, 20 bp, Artificial Sequence
  chemically synthesized
aaccgggttcaggaaagacc

SEQ ID NO: 461417 - DNA, 20 bp, Artificial Sequence
  chemically synthesized
caaccgggttcaggaaagac

SEQ ID NO: 461418 - DNA, 20 bp, Artificial Sequence
  chemically synthesized
gcatacaaccgggttcagga

SEQ ID NO: 461419 - DNA, 20 bp, Artificial Sequence
  chemically synthesized
cacctggtctttcctgaacc

SEQ ID NO: 461420 - DNA, 20 bp, Artificial Sequence
  chemically synthesized
agttgcatacaaccgggttc

SEQ ID NO: 461421 - DNA, 20 bp, Artificial Sequence
  chemically synthesized
aagttgcatacaaccgggtt

SEQ ID NO: 461422 - DNA, 20 bp, Artificial Sequence
  chemically synthesized
gaaaaaagttgcatacaacc

SEQ ID NO: 461423 - DNA, 20 bp, Artificial Sequence
  chemically synthesized
agaaaaaagttgcatacaac

SEQ ID NO: 461424 - DNA, 20 bp, Artificial Sequence
  chemically synthesized
actgaagtgaacaaagaaaa

SEQ ID NO: 461425 - DNA, 20 bp, Artificial Sequence
  chemically synthesized
gataaagactgaagtgaaca

SEQ ID NO: 461426 - DNA, 20 bp, Artificial Sequence
  chemically synthesized
acttttttctttgttcactt

SEQ ID NO: 461427 - DNA, 20 bp, Artificial Sequence
  chemically synthesized
caacaaaaagataaagactg

SEQ ID NO: 461428 - DNA, 20 bp, Artificial Sequence
  chemically synthesized
tttattacaacaaaaagata

SEQ ID NO: 461429 - DNA, 20 bp, Artificial Sequence
  chemically synthesized
ttacagtttattacaacaaa

SEQ ID NO: 461430 - DNA, 20 bp, Artificial Sequence
  chemically synthesized
ttgtaataaactgtaatcat

SEQ ID NO: 461431 - DNA, 20 bp, Artificial Sequence
  chemically synthesized
agcagttacactcatgatta

SEQ ID NO: 461432 - DNA, 20 bp, Artificial Sequence
  chemically synthesized
tcatgagtgtaactgctttt

SEQ ID NO: 461433 - DNA, 20 bp, Artificial Sequence
  chemically synthesized
actcatataattcttaaaag

SEQ ID NO: 461434 - DNA, 20 bp, Artificial Sequence
  chemically synthesized
aggactcatataattcttaa

SEQ ID NO: 461435 - DNA, 20 bp, Artificial Sequence
  chemically synthesized
actgcttttaagaattatat

SEQ ID NO: 461436 - DNA, 20 bp, Artificial Sequence
  chemically synthesized
agaattatatgagtcctcct

SEQ ID NO: 461437 - DNA, 20 bp, Artificial Sequence
  chemically synthesized
gaattatatgagtcctccta

SEQ ID NO: 461438 - DNA, 20 bp, Artificial Sequence
  chemically synthesized
aggttcaattattccttagg

SEQ ID NO: 461439 - DNA, 20 bp, Artificial Sequence
  chemically synthesized
caggttcaattattccttag

SEQ ID NO: 461440 - DNA, 20 bp, Artificial Sequence
  chemically synthesized
ctcaggttcaattattcctt

SEQ ID NO: 461441 - DNA, 20 bp, Artificial Sequence
  chemically synthesized
tctcaggttcaattattcct

SEQ ID NO: 461442 - DNA, 20 bp, Artificial Sequence
  chemically synthesized
cctaaggaataattgaacct

SEQ ID NO: 461443 - DNA, 20 bp, Artificial Sequence
  chemically synthesized
taaggaataattgaacctga

SEQ ID NO: 461444 - DNA, 20 bp, Artificial Sequence
  chemically synthesized
ggaataattgaacctgagag

SEQ ID NO: 461445 - DNA, 20 bp, Artificial Sequence
  chemically synthesized
gagtcctcaagtctactctc

SEQ ID NO: 461446 - DNA, 20 bp, Artificial Sequence
  chemically synthesized
ggagtcctcaagtctactct

SEQ ID NO: 461447 - DNA, 20 bp, Artificial Sequence
  chemically synthesized
ttgaacctgagagtagactt

SEQ ID NO: 461448 - DNA, 20 bp, Artificial Sequence
  chemically synthesized
tgaacctgagagtagacttg

SEQ ID NO: 461449 - DNA, 20 bp, Artificial Sequence
  chemically synthesized
ggcgaaatttaggagtcctc

SEQ ID NO: 461450 - DNA, 20 bp, Artificial Sequence
  chemically synthesized
ccttatatggcgaaatttag

SEQ ID NO: 461451 - DNA, 20 bp, Artificial Sequence
  chemically synthesized
tgccttatatggcgaaattt

SEQ ID NO: 461452 - DNA, 20 bp, Artificial Sequence
  chemically synthesized
ttgccttatatggcgaaatt

SEQ ID NO: 461453 - DNA, 20 bp, Artificial Sequence
  chemically synthesized
actcctaaatttcgccatat

SEQ ID NO: 461454 - DNA, 20 bp, Artificial Sequence
  chemically synthesized
ctcctaaatttcgccatata

SEQ ID NO: 461455 - DNA, 20 bp, Artificial Sequence
  chemically synthesized
tatgaatatgttgccttata

SEQ ID NO: 461456 - DNA, 20 bp, Artificial Sequence
  chemically synthesized
catataaggcaacatattca

SEQ ID NO: 461457 - DNA, 20 bp, Artificial Sequence
  chemically synthesized
caacatattcatagcttcct

SEQ ID NO: 461458 - DNA, 20 bp, Artificial Sequence
  chemically synthesized
atacatgttctaatcttagg

SEQ ID NO: 461459 - DNA, 20 bp, Artificial Sequence
  chemically synthesized
tattcatagcttcctaagat

SEQ ID NO: 461460 - DNA, 20 bp, Artificial Sequence
  chemically synthesized
gacatacatgttctaatctt

SEQ ID NO: 461461 - DNA, 20 bp, Artificial Sequence
  chemically synthesized
agacatacatgttctaatct

SEQ ID NO: 461462 - DNA, 20 bp, Artificial Sequence
  chemically synthesized
gattagaacatgtatgtctt

SEQ ID NO: 461463 - DNA, 20 bp, Artificial Sequence
  chemically synthesized
attagaacatgtatgtcttt

SEQ ID NO: 461464 - DNA, 20 bp, Artificial Sequence
  chemically synthesized
ttagaacatgtatgtctttg

SEQ ID NO: 461465 - DNA, 20 bp, Artificial Sequence
  chemically synthesized
tagaacatgtatgtctttgg

SEQ ID NO: 461466 - DNA, 20 bp, Artificial Sequence
  chemically synthesized
ggcatagtaatgatccccca

SEQ ID NO: 461467 - DNA, 20 bp, Artificial Sequence
  chemically synthesized
tttatgtactgttgtaggca

SEQ ID NO: 461468 - DNA, 20 bp, Artificial Sequence
  chemically synthesized
gatcattactatgcctacaa

SEQ ID NO: 461469 - DNA, 20 bp, Artificial Sequence
  chemically synthesized
tgtattttatgtactgttgt

SEQ ID NO: 461470 - DNA, 20 bp, Artificial Sequence
  chemically synthesized
atgtattttatgtactgttg

SEQ ID NO: 461471 - DNA, 20 bp, Artificial Sequence
  chemically synthesized
taaaatacatgactcttgtg

SEQ ID NO: 461472 - DNA, 20 bp, Artificial Sequence
  chemically synthesized
ttgaagaagtttctacacaa

SEQ ID NO: 461473 - DNA, 20 bp, Artificial Sequence
  chemically synthesized
aattgaagaagtttctacac

SEQ ID NO: 461474 - DNA, 20 bp, Artificial Sequence
  chemically synthesized
tctggtcaaataaattgaag

SEQ ID NO: 461475 - DNA, 20 bp, Artificial Sequence
  chemically synthesized
tcctctggtcaaataaattg

SEQ ID NO: 461476 - DNA, 20 bp, Artificial Sequence
  chemically synthesized
acttcttcaatttatttgac

SEQ ID NO: 461477 - DNA, 20 bp, Artificial Sequence
  chemically synthesized
ttcttcaatttatttgacca

SEQ ID NO: 461478 - DNA, 20 bp, Artificial Sequence
  chemically synthesized
tcttcaatttatttgaccag

SEQ ID NO: 461479 - DNA, 20 bp, Artificial Sequence
  chemically synthesized
aatttatttgaccagaggac

SEQ ID NO: 461480 - DNA, 20 bp, Artificial Sequence
  chemically synthesized
taaaaaaaaaactagtcctc

SEQ ID NO: 461481 - DNA, 20 bp, Artificial Sequence
  chemically synthesized
gacaatattaaaaaaaaaac

SEQ ID NO: 461482 - DNA, 20 bp, Artificial Sequence
  chemically synthesized
tttttttaatattgtcaaaa

SEQ ID NO: 461483 - DNA, 20 bp, Artificial Sequence
  chemically synthesized
ttaatattgtcaaaaaagct

SEQ ID NO: 461484 - DNA, 20 bp, Artificial Sequence
  chemically synthesized
ataaaggaacatatgtttcc

SEQ ID NO: 461485 - DNA, 20 bp, Artificial Sequence
  chemically synthesized
gaaacatatgttcctttatt

SEQ ID NO: 461486 - DNA, 20 bp, Artificial Sequence
  chemically synthesized
actgaatcttgactcaataa

SEQ ID NO: 461487 - DNA, 20 bp, Artificial Sequence
  chemically synthesized
aactgaatcttgactcaata

SEQ ID NO: 461488 - DNA, 20 bp, Artificial Sequence
  chemically synthesized
atatgttcctttattgagtc

SEQ ID NO: 461489 - DNA, 20 bp, Artificial Sequence
  chemically synthesized
tcctttattgagtcaagatt

SEQ ID NO: 461490 - DNA, 20 bp, Artificial Sequence
  chemically synthesized
agtcaagattcagttttctt

SEQ ID NO: 461491 - DNA, 20 bp, Artificial Sequence
  chemically synthesized
tcaagattcagttttcttaa

SEQ ID NO: 461492 - DNA, 20 bp, Artificial Sequence
  chemically synthesized
acatttgataaaaatctctt

SEQ ID NO: 461493 - DNA, 20 bp, Artificial Sequence
  chemically synthesized
aggaaagggtagttttcaag

SEQ ID NO: 461494 - DNA, 20 bp, Artificial Sequence
  chemically synthesized
taggaaagggtagttttcaa

SEQ ID NO: 461495 - DNA, 20 bp, Artificial Sequence
  chemically synthesized
tataggaaagggtagttttc

SEQ ID NO: 461496 - DNA, 20 bp, Artificial Sequence
  chemically synthesized
attctacatataggaaaggg

SEQ ID NO: 461497 - DNA, 20 bp, Artificial Sequence
  chemically synthesized
tttattctacatataggaaa

SEQ ID NO: 461498 - DNA, 20 bp, Artificial Sequence
  chemically synthesized
ttttattctacatataggaa

SEQ ID NO: 461499 - DNA, 20 bp, Artificial Sequence
  chemically synthesized
tttttattctacatatagga

SEQ ID NO: 461500 - DNA, 20 bp, Artificial Sequence
  chemically synthesized
aaactaccctttcctatatg

SEQ ID NO: 461501 - DNA, 20 bp, Artificial Sequence
  chemically synthesized
ttaatttttattctacatat

SEQ ID NO: 461502 - DNA, 20 bp, Artificial Sequence
  chemically synthesized
tttaatttttattctacata

SEQ ID NO: 461503 - DNA, 20 bp, Artificial Sequence
  chemically synthesized
atatgtagaataaaaattaa

SEQ ID NO: 461504 - DNA, 20 bp, Artificial Sequence
  chemically synthesized
aaaattaaaagcacaattaa

SEQ ID NO: 461505 - DNA, 20 bp, Artificial Sequence
  chemically synthesized
aacatggaaagtaatatgac

SEQ ID NO: 461506 - DNA, 20 bp, Artificial Sequence
  chemically synthesized
aaacatggaaagtaatatga

SEQ ID NO: 461507 - DNA, 20 bp, Artificial Sequence
  chemically synthesized
tactagataacaaacatgga

SEQ ID NO: 461508 - DNA, 20 bp, Artificial Sequence
  chemically synthesized
catttactagataacaaaca

SEQ ID NO: 461509 - DNA, 20 bp, Artificial Sequence
  chemically synthesized
tactttccatgtttgttatc

SEQ ID NO: 461510 - DNA, 20 bp, Artificial Sequence
  chemically synthesized
ttgattacagagtcatttac

SEQ ID NO: 461511 - DNA, 20 bp, Artificial Sequence
  chemically synthesized
ctaggaaatagttgattaca

SEQ ID NO: 461512 - DNA, 20 bp, Artificial Sequence
  chemically synthesized
tgctaggaaatagttgatta

SEQ ID NO: 461513 - DNA, 20 bp, Artificial Sequence
  chemically synthesized
ctctgtaatcaactatttcc

SEQ ID NO: 461514 - DNA, 20 bp, Artificial Sequence
  chemically synthesized
cagtgtttattgctaggaaa

SEQ ID NO: 461515 - DNA, 20 bp, Artificial Sequence
  chemically synthesized
gtttttcagtgtttattgct

SEQ ID NO: 461516 - DNA, 20 bp, Artificial Sequence
  chemically synthesized
tgtttttcagtgtttattgc

SEQ ID NO: 461517 - DNA, 20 bp, Artificial Sequence
  chemically synthesized
tgaaagttgagtatgttttt

SEQ ID NO: 461518 - DNA, 20 bp, Artificial Sequence
  chemically synthesized
tgtactcttagatgaaagtt

SEQ ID NO: 461519 - DNA, 20 bp, Artificial Sequence
  chemically synthesized
aacatactcaactttcatct

SEQ ID NO: 461520 - DNA, 20 bp, Artificial Sequence
  chemically synthesized
cttcttgtactcttagatga

SEQ ID NO: 461521 - DNA, 20 bp, Artificial Sequence
  chemically synthesized
catactcaactttcatctaa

SEQ ID NO: 461522 - DNA, 20 bp, Artificial Sequence
  chemically synthesized
caactttcatctaagagtac

SEQ ID NO: 461523 - DNA, 20 bp, Artificial Sequence
  chemically synthesized
ttgattacttcttgtactct

SEQ ID NO: 461524 - DNA, 20 bp, Artificial Sequence
  chemically synthesized
ctttcatctaagagtacaag

SEQ ID NO: 461525 - DNA, 20 bp, Artificial Sequence
  chemically synthesized
taagagtacaagaagtaatc

SEQ ID NO: 461526 - DNA, 20 bp, Artificial Sequence
  chemically synthesized
aagagtacaagaagtaatca

SEQ ID NO: 461527 - DNA, 20 bp, Artificial Sequence
  chemically synthesized
agagtacaagaagtaatcaa

SEQ ID NO: 461528 - DNA, 20 bp, Artificial Sequence
  chemically synthesized
acaagaagtaatcaagggaa

SEQ ID NO: 461529 - DNA, 20 bp, Artificial Sequence
  chemically synthesized
caagaagtaatcaagggaat

SEQ ID NO: 461530 - DNA, 20 bp, Artificial Sequence
  chemically synthesized
agggaatgggaaaactcaat

SEQ ID NO: 461531 - DNA, 20 bp, Artificial Sequence
  chemically synthesized
acagtctctggtagctaatt

SEQ ID NO: 461532 - DNA, 20 bp, Artificial Sequence
  chemically synthesized
gggaaaactcaattagctac

SEQ ID NO: 461533 - DNA, 20 bp, Artificial Sequence
  chemically synthesized
gaaaactcaattagctacca

SEQ ID NO: 461534 - DNA, 20 bp, Artificial Sequence
  chemically synthesized
agatgttttacagtctctgg

SEQ ID NO: 461535 - DNA, 20 bp, Artificial Sequence
  chemically synthesized
aacagatgttttacagtctc

SEQ ID NO: 461536 - DNA, 20 bp, Artificial Sequence
  chemically synthesized
ttttcagaacagatgtttta

SEQ ID NO: 461537 - DNA, 20 bp, Artificial Sequence
  chemically synthesized
ttggagtttggttttcagaa

SEQ ID NO: 461538 - DNA, 20 bp, Artificial Sequence
  chemically synthesized
aattgttggagtttggtttt

SEQ ID NO: 461539 - DNA, 20 bp, Artificial Sequence
  chemically synthesized
gatattgaattgttggagtt

SEQ ID NO: 461540 - DNA, 20 bp, Artificial Sequence
  chemically synthesized
atattgatattgaattgttg

SEQ ID NO: 461541 - DNA, 20 bp, Artificial Sequence
  chemically synthesized
agatattgatattgaattgt

SEQ ID NO: 461542 - DNA, 20 bp, Artificial Sequence
  chemically synthesized
attcaatatcaatatcttta

SEQ ID NO: 461543 - DNA, 20 bp, Artificial Sequence
  chemically synthesized
ttcaatatcaatatctttaa

SEQ ID NO: 461544 - DNA, 20 bp, Artificial Sequence
  chemically synthesized
tcaatatcaatatctttaaa

SEQ ID NO: 461545 - DNA, 20 bp, Artificial Sequence
  chemically synthesized
taataatctttatcccttta

SEQ ID NO: 461546 - DNA, 20 bp, Artificial Sequence
  chemically synthesized
tcaatatctttaaagggata

SEQ ID NO: 461547 - DNA, 20 bp, Artificial Sequence
  chemically synthesized
ttattaatgtaaaattgaac

SEQ ID NO: 461548 - DNA, 20 bp, Artificial Sequence
  chemically synthesized
tattaatgtaaaattgaact

SEQ ID NO: 461549 - DNA, 20 bp, Artificial Sequence
  chemically synthesized
aatgtaaaattgaactagga

SEQ ID NO: 461550 - DNA, 20 bp, Artificial Sequence
  chemically synthesized
caggggtttttcatctttcc

SEQ ID NO: 461551 - DNA, 20 bp, Artificial Sequence
  chemically synthesized
ataattgagaattagtgcag

SEQ ID NO: 461552 - DNA, 20 bp, Artificial Sequence
  chemically synthesized
tataattgagaattagtgca

SEQ ID NO: 461553 - DNA, 20 bp, Artificial Sequence
  chemically synthesized
atataattgagaattagtgc

SEQ ID NO: 461554 - DNA, 20 bp, Artificial Sequence
  chemically synthesized
aatataattgagaattagtg

SEQ ID NO: 461555 - DNA, 20 bp, Artificial Sequence
  chemically synthesized
aacccaatataattgagaat

SEQ ID NO: 461556 - DNA, 20 bp, Artificial Sequence
  chemically synthesized
cctttaaacccaatataatt

SEQ ID NO: 461557 - DNA, 20 bp, Artificial Sequence
  chemically synthesized
gcactaattctcaattatat

SEQ ID NO: 461558 - DNA, 20 bp, Artificial Sequence
  chemically synthesized
cactaattctcaattatatt

SEQ ID NO: 461559 - DNA, 20 bp, Artificial Sequence
  chemically synthesized
tctcaattatattgggttta

SEQ ID NO: 461560 - DNA, 20 bp, Artificial Sequence
  chemically synthesized
ctcaattatattgggtttaa

SEQ ID NO: 461561 - DNA, 20 bp, Artificial Sequence
  chemically synthesized
attatattgggtttaaagga

SEQ ID NO: 461562 - DNA, 20 bp, Artificial Sequence
  chemically synthesized
ttatattgggtttaaaggaa

SEQ ID NO: 461563 - DNA, 20 bp, Artificial Sequence
  chemically synthesized
tattgggtttaaaggaaagg

SEQ ID NO: 461564 - DNA, 20 bp, Artificial Sequence
  chemically synthesized
attgggtttaaaggaaaggc

SEQ ID NO: 461565 - DNA, 20 bp, Artificial Sequence
  chemically synthesized
gaataaatcatatataccca

SEQ ID NO: 461566 - DNA, 20 bp, Artificial Sequence
  chemically synthesized
aaatcatatatacccataga

SEQ ID NO: 461567 - DNA, 20 bp, Artificial Sequence
  chemically synthesized
cctggattatttccatctat

SEQ ID NO: 461568 - DNA, 20 bp, Artificial Sequence
  chemically synthesized
acctggattatttccatcta

SEQ ID NO: 461569 - DNA, 20 bp, Artificial Sequence
  chemically synthesized
acccatagatggaaataatc

SEQ ID NO: 461570 - DNA, 20 bp, Artificial Sequence
  chemically synthesized
cccatagatggaaataatcc

SEQ ID NO: 461571 - DNA, 20 bp, Artificial Sequence
  chemically synthesized
tgtgtgtgtgtatgtatacc

SEQ ID NO: 461572 - DNA, 20 bp, Artificial Sequence
  chemically synthesized
tacatatatgaaaaatctat

SEQ ID NO: 461573 - DNA, 20 bp, Artificial Sequence
  chemically synthesized
tatgaaaaatctataagcgt

SEQ ID NO: 461574 - DNA, 20 bp, Artificial Sequence
  chemically synthesized
aatataaaacctaacgctta

SEQ ID NO: 461575 - DNA, 20 bp, Artificial Sequence
  chemically synthesized
atgaaaaatctataagcgtt

SEQ ID NO: 461576 - DNA, 20 bp, Artificial Sequence
  chemically synthesized
ataagcgttaggttttatat

SEQ ID NO: 461577 - DNA, 20 bp, Artificial Sequence
  chemically synthesized
cattaactcaaaatagatca

SEQ ID NO: 461578 - DNA, 20 bp, Artificial Sequence
  chemically synthesized
tagtatccatgatctatttt

SEQ ID NO: 461579 - DNA, 20 bp, Artificial Sequence
  chemically synthesized
attcaaacattaactcaaaa

SEQ ID NO: 461580 - DNA, 20 bp, Artificial Sequence
  chemically synthesized
tttgagttaatgtttgaata

SEQ ID NO: 461581 - DNA, 20 bp, Artificial Sequence
  chemically synthesized
ttaatgtttgaataaagtat

SEQ ID NO: 461582 - DNA, 20 bp, Artificial Sequence
  chemically synthesized
taatgtttgaataaagtatg

SEQ ID NO: 461583 - DNA, 20 bp, Artificial Sequence
  chemically synthesized
tgaataaagtatgaggtgtt

SEQ ID NO: 461584 - DNA, 20 bp, Artificial Sequence
  chemically synthesized
gaataaagtatgaggtgttc

SEQ ID NO: 461585 - DNA, 20 bp, Artificial Sequence
  chemically synthesized
aagtatgaggtgttcaggtc

SEQ ID NO: 461586 - DNA, 20 bp, Artificial Sequence
  chemically synthesized
tatttggatacacataggca

SEQ ID NO: 461587 - DNA, 20 bp, Artificial Sequence
  chemically synthesized
ggtatttggatacacatagg

SEQ ID NO: 461588 - DNA, 20 bp, Artificial Sequence
  chemically synthesized
tagggtatttggatacacat

SEQ ID NO: 461589 - DNA, 20 bp, Artificial Sequence
  chemically synthesized
ctagggtatttggatacaca

SEQ ID NO: 461590 - DNA, 20 bp, Artificial Sequence
  chemically synthesized
ctatgtgtatccaaataccc

SEQ ID NO: 461591 - DNA, 20 bp, Artificial Sequence
  chemically synthesized
acaaatgatgctagggtatt

SEQ ID NO: 461592 - DNA, 20 bp, Artificial Sequence
  chemically synthesized
attttcaacaaatgatgcta

SEQ ID NO: 461593 - DNA, 20 bp, Artificial Sequence
  chemically synthesized
cattttcaacaaatgatgct

SEQ ID NO: 461594 - DNA, 20 bp, Artificial Sequence
  chemically synthesized
tcattttcaacaaatgatgc

SEQ ID NO: 461595 - DNA, 20 bp, Artificial Sequence
  chemically synthesized
gcatcatttgttgaaaatga

SEQ ID NO: 461596 - DNA, 20 bp, Artificial Sequence
  chemically synthesized
gtgtaaaagcaattcaatga

SEQ ID NO: 461597 - DNA, 20 bp, Artificial Sequence
  chemically synthesized
ggtgtaaaagcaattcaatg

SEQ ID NO: 461598 - DNA, 20 bp, Artificial Sequence
  chemically synthesized
gattctttgcaaaggtgtaa

SEQ ID NO: 461599 - DNA, 20 bp, Artificial Sequence
  chemically synthesized
attgcttttacacctttgca

SEQ ID NO: 461600 - DNA, 20 bp, Artificial Sequence
  chemically synthesized
gccaaactgattctttgcaa

SEQ ID NO: 461601 - DNA, 20 bp, Artificial Sequence
  chemically synthesized
tgccaaactgattctttgca

SEQ ID NO: 461602 - DNA, 20 bp, Artificial Sequence
  chemically synthesized
tttacacctttgcaaagaat

SEQ ID NO: 461603 - DNA, 20 bp, Artificial Sequence
  chemically synthesized
acctttgcaaagaatcagtt

SEQ ID NO: 461604 - DNA, 20 bp, Artificial Sequence
  chemically synthesized
atacagaacccagaaataga

SEQ ID NO: 461605 - DNA, 20 bp, Artificial Sequence
  chemically synthesized
taataatttccttctatttc

SEQ ID NO: 461606 - DNA, 20 bp, Artificial Sequence
  chemically synthesized
aatacagaacccagaaatag

SEQ ID NO: 461607 - DNA, 20 bp, Artificial Sequence
  chemically synthesized
aataatttccttctatttct

SEQ ID NO: 461608 - DNA, 20 bp, Artificial Sequence
  chemically synthesized
taaaatacagaacccagaaa

SEQ ID NO: 461609 - DNA, 20 bp, Artificial Sequence
  chemically synthesized
atgtaataaaatacagaacc

SEQ ID NO: 461610 - DNA, 20 bp, Artificial Sequence
  chemically synthesized
tggagcaatgtaataaaata

SEQ ID NO: 461611 - DNA, 20 bp, Artificial Sequence
  chemically synthesized
ggtggtgagacagaaacatg

SEQ ID NO: 461612 - DNA, 20 bp, Artificial Sequence
  chemically synthesized
ttggtggtgagacagaaaca

SEQ ID NO: 461613 - DNA, 20 bp, Artificial Sequence
  chemically synthesized
atgtgatattggtggtgaga

SEQ ID NO: 461614 - DNA, 20 bp, Artificial Sequence
  chemically synthesized
gacaatgtgatattggtggt

SEQ ID NO: 461615 - DNA, 20 bp, Artificial Sequence
  chemically synthesized
tgaagacaatgtgatattgg

SEQ ID NO: 461616 - DNA, 20 bp, Artificial Sequence
  chemically synthesized
taatgaagacaatgtgatat

SEQ ID NO: 461617 - DNA, 20 bp, Artificial Sequence
  chemically synthesized
agtatatagctacagtaatg

SEQ ID NO: 461618 - DNA, 20 bp, Artificial Sequence
  chemically synthesized
tcacattgtcttcattactg

SEQ ID NO: 461619 - DNA, 20 bp, Artificial Sequence
  chemically synthesized
aagaccttagtatatagcta

SEQ ID NO: 461620 - DNA, 20 bp, Artificial Sequence
  chemically synthesized
cattactgtagctatatact

SEQ ID NO: 461621 - DNA, 20 bp, Artificial Sequence
  chemically synthesized
attactgtagctatatacta

SEQ ID NO: 461622 - DNA, 20 bp, Artificial Sequence
  chemically synthesized
aacatgaagaccttagtata

SEQ ID NO: 461623 - DNA, 20 bp, Artificial Sequence
  chemically synthesized
tctactcaacatgaagacct

SEQ ID NO: 461624 - DNA, 20 bp, Artificial Sequence
  chemically synthesized
tatactaaggtcttcatgtt

SEQ ID NO: 461625 - DNA, 20 bp, Artificial Sequence
  chemically synthesized
gaattgctctactcaacatg

SEQ ID NO: 461626 - DNA, 20 bp, Artificial Sequence
  chemically synthesized
actaaggtcttcatgttgag

SEQ ID NO: 461627 - DNA, 20 bp, Artificial Sequence
  chemically synthesized
taaggtcttcatgttgagta

SEQ ID NO: 461628 - DNA, 20 bp, Artificial Sequence
  chemically synthesized
ctgaaaacgattaatgtggg

SEQ ID NO: 461629 - DNA, 20 bp, Artificial Sequence
  chemically synthesized
actgaaaacgattaatgtgg

SEQ ID NO: 461630 - DNA, 20 bp, Artificial Sequence
  chemically synthesized
tgactgaaaacgattaatgt

SEQ ID NO: 461631 - DNA, 20 bp, Artificial Sequence
  chemically synthesized
atgactgaaaacgattaatg

SEQ ID NO: 461632 - DNA, 20 bp, Artificial Sequence
  chemically synthesized
cctcccacattaatcgtttt

SEQ ID NO: 461633 - DNA, 20 bp, Artificial Sequence
  chemically synthesized
gttttcagtcatgaaatcta

SEQ ID NO: 461634 - DNA, 20 bp, Artificial Sequence
  chemically synthesized
attcttcccaaatcgatcta

SEQ ID NO: 461635 - DNA, 20 bp, Artificial Sequence
  chemically synthesized
atgaaatctatagatcgatt

SEQ ID NO: 461636 - DNA, 20 bp, Artificial Sequence
  chemically synthesized
tgaaatctatagatcgattt

SEQ ID NO: 461637 - DNA, 20 bp, Artificial Sequence
  chemically synthesized
aatctatagatcgatttggg

SEQ ID NO: 461638 - DNA, 20 bp, Artificial Sequence
  chemically synthesized
ttggaagactcagcatagta

SEQ ID NO: 461639 - DNA, 20 bp, Artificial Sequence
  chemically synthesized
attgacatctttactatgct

SEQ ID NO: 461640 - DNA, 20 bp, Artificial Sequence
  chemically synthesized
atggattggaagactcagca

SEQ ID NO: 461641 - DNA, 20 bp, Artificial Sequence
  chemically synthesized
cattcatggattggaagact

SEQ ID NO: 461642 - DNA, 20 bp, Artificial Sequence
  chemically synthesized
atattgcattcatggattgg

SEQ ID NO: 461643 - DNA, 20 bp, Artificial Sequence
  chemically synthesized
gatatattgcattcatggat

SEQ ID NO: 461644 - DNA, 20 bp, Artificial Sequence
  chemically synthesized
tcagggatatattgcattca

SEQ ID NO: 461645 - DNA, 20 bp, Artificial Sequence
  chemically synthesized
tcaagacctaaataatttca

SEQ ID NO: 461646 - DNA, 20 bp, Artificial Sequence
  chemically synthesized
atcaagacctaaataatttc

SEQ ID NO: 461647 - DNA, 20 bp, Artificial Sequence
  chemically synthesized
aatcaagacctaaataattt

SEQ ID NO: 461648 - DNA, 20 bp, Artificial Sequence
  chemically synthesized
aatatatccctgaaattatt

SEQ ID NO: 461649 - DNA, 20 bp, Artificial Sequence
  chemically synthesized
atatatccctgaaattattt

SEQ ID NO: 461650 - DNA, 20 bp, Artificial Sequence
  chemically synthesized
aaatgctgataaaagaaatc

SEQ ID NO: 461651 - DNA, 20 bp, Artificial Sequence
  chemically synthesized
taggtcttgatttcttttat

SEQ ID NO: 461652 - DNA, 20 bp, Artificial Sequence
  chemically synthesized
aaattacaaaatgctgataa

SEQ ID NO: 461653 - DNA, 20 bp, Artificial Sequence
  chemically synthesized
tatcagcattttgtaatttt

SEQ ID NO: 461654 - DNA, 20 bp, Artificial Sequence
  chemically synthesized
atcagcattttgtaattttc

SEQ ID NO: 461655 - DNA, 20 bp, Artificial Sequence
  chemically synthesized
gatattaacaatatatatat

SEQ ID NO: 461656 - DNA, 20 bp, Artificial Sequence
  chemically synthesized
ttccccaaaaatgaaatagt

SEQ ID NO: 461657 - DNA, 20 bp, Artificial Sequence
  chemically synthesized
attattccccaaaaatgaaa

SEQ ID NO: 461658 - DNA, 20 bp, Artificial Sequence
  chemically synthesized
atatcttactatttcatttt

SEQ ID NO: 461659 - DNA, 20 bp, Artificial Sequence
  chemically synthesized
tatcttactatttcattttt

SEQ ID NO: 461660 - DNA, 20 bp, Artificial Sequence
  chemically synthesized
atcttactatttcatttttg

SEQ ID NO: 461661 - DNA, 20 bp, Artificial Sequence
  chemically synthesized
atttcatttttggggaataa

SEQ ID NO: 461662 - DNA, 20 bp, Artificial Sequence
  chemically synthesized
aaaaagaaaaaagaaaaaaa

SEQ ID NO: 461663 - DNA, 20 bp, Artificial Sequence
  chemically synthesized
ttaaaaacacaaaaagaaaa

SEQ ID NO: 461664 - DNA, 20 bp, Artificial Sequence
  chemically synthesized
tttagaattaaaaacacaaa

SEQ ID NO: 461665 - DNA, 20 bp, Artificial Sequence
  chemically synthesized
aaaatttctttttaaaaatt

SEQ ID NO: 461666 - DNA, 20 bp, Artificial Sequence
  chemically synthesized
tttaattctaaatttttaaa

SEQ ID NO: 461667 - DNA, 20 bp, Artificial Sequence
  chemically synthesized
aatttttaaaaagaaatttt

SEQ ID NO: 461668 - DNA, 20 bp, Artificial Sequence
  chemically synthesized
gaacttggcgtttgaaattt

SEQ ID NO: 461669 - DNA, 20 bp, Artificial Sequence
  chemically synthesized
tatctaaaatttcaaacgcc

SEQ ID NO: 461670 - DNA, 20 bp, Artificial Sequence
  chemically synthesized
cattattgctagaaggaact

SEQ ID NO: 461671 - DNA, 20 bp, Artificial Sequence
  chemically synthesized
ttcaaacgccaagttccttc

SEQ ID NO: 461672 - DNA, 20 bp, Artificial Sequence
  chemically synthesized
tttttcccattattgctaga

SEQ ID NO: 461673 - DNA, 20 bp, Artificial Sequence
  chemically synthesized
atttttcccattattgctag

SEQ ID NO: 461674 - DNA, 20 bp, Artificial Sequence
  chemically synthesized
caagttccttctagcaataa

SEQ ID NO: 461675 - DNA, 20 bp, Artificial Sequence
  chemically synthesized
ttaatttttcccattattgc

SEQ ID NO: 461676 - DNA, 20 bp, Artificial Sequence
  chemically synthesized
aagttccttctagcaataat

SEQ ID NO: 461677 - DNA, 20 bp, Artificial Sequence
  chemically synthesized
aaaaattaacgtttattttg

SEQ ID NO: 461678 - DNA, 20 bp, Artificial Sequence
  chemically synthesized
aaaattaacgtttattttga

SEQ ID NO: 461679 - DNA, 20 bp, Artificial Sequence
  chemically synthesized
ggttttttttcttatctgac

SEQ ID NO: 461680 - DNA, 20 bp, Artificial Sequence
  chemically synthesized
ttcaacatcacttgtcagat

SEQ ID NO: 461681 - DNA, 20 bp, Artificial Sequence
  chemically synthesized
tgagattcaacatcacttgt

SEQ ID NO: 461682 - DNA, 20 bp, Artificial Sequence
  chemically synthesized
ttctttttaattgtgtaagt

SEQ ID NO: 461683 - DNA, 20 bp, Artificial Sequence
  chemically synthesized
ttgtttctttttaattgtgt

SEQ ID NO: 461684 - DNA, 20 bp, Artificial Sequence
  chemically synthesized
atctcacttacacaattaaa

SEQ ID NO: 461685 - DNA, 20 bp, Artificial Sequence
  chemically synthesized
gtctgttcattttgttgtaa

SEQ ID NO: 461686 - DNA, 20 bp, Artificial Sequence
  chemically synthesized
aactattacaacaaaatgaa

SEQ ID NO: 461687 - DNA, 20 bp, Artificial Sequence
  chemically synthesized
acaacaaaatgaacagactt

SEQ ID NO: 461688 - DNA, 20 bp, Artificial Sequence
  chemically synthesized
aaatgaacagactttggtac

SEQ ID NO: 461689 - DNA, 20 bp, Artificial Sequence
  chemically synthesized
atctcttcaaaccagtacca

SEQ ID NO: 461690 - DNA, 20 bp, Artificial Sequence
  chemically synthesized
cagactttggtactggtttg

SEQ ID NO: 461691 - DNA, 20 bp, Artificial Sequence
  chemically synthesized
gactttggtactggtttgaa

SEQ ID NO: 461692 - DNA, 20 bp, Artificial Sequence
  chemically synthesized
agctcttaatctcttcaaac

SEQ ID NO: 461693 - DNA, 20 bp, Artificial Sequence
  chemically synthesized
ggtactggtttgaagagatt

SEQ ID NO: 461694 - DNA, 20 bp, Artificial Sequence
  chemically synthesized
tactggtttgaagagattaa

SEQ ID NO: 461695 - DNA, 20 bp, Artificial Sequence
  chemically synthesized
gaagagattaagagcttaaa

SEQ ID NO: 461696 - DNA, 20 bp, Artificial Sequence
  chemically synthesized
taatctctttaagaccattt

SEQ ID NO: 461697 - DNA, 20 bp, Artificial Sequence
  chemically synthesized
taagagcttaaatggtctta

SEQ ID NO: 461698 - DNA, 20 bp, Artificial Sequence
  chemically synthesized
agagcttaaatggtcttaaa

SEQ ID NO: 461699 - DNA, 20 bp, Artificial Sequence
  chemically synthesized
atgagcaatataatctcttt

SEQ ID NO: 461700 - DNA, 20 bp, Artificial Sequence
  chemically synthesized
agattatattgctcatttgc

SEQ ID NO: 461701 - DNA, 20 bp, Artificial Sequence
  chemically synthesized
aagcatggattctggcaaat

SEQ ID NO: 461702 - DNA, 20 bp, Artificial Sequence
  chemically synthesized
ttctttgaaagcatggattc

SEQ ID NO: 461703 - DNA, 20 bp, Artificial Sequence
  chemically synthesized
gtcagccttctttgaaagca

SEQ ID NO: 461704 - DNA, 20 bp, Artificial Sequence
  chemically synthesized
tgccagaatccatgctttca

SEQ ID NO: 461705 - DNA, 20 bp, Artificial Sequence
  chemically synthesized
cagaatccatgctttcaaag

SEQ ID NO: 461706 - DNA, 20 bp, Artificial Sequence
  chemically synthesized
agaatccatgctttcaaaga

SEQ ID NO: 461707 - DNA, 20 bp, Artificial Sequence
  chemically synthesized
ctgtggtcagccttctttga

SEQ ID NO: 461708 - DNA, 20 bp, Artificial Sequence
  chemically synthesized
ctttcaaagaaggctgacca

SEQ ID NO: 461709 - DNA, 20 bp, Artificial Sequence
  chemically synthesized
tttcaaagaaggctgaccac

SEQ ID NO: 461710 - DNA, 20 bp, Artificial Sequence
  chemically synthesized
ttccaaaggctgcctgtggt

SEQ ID NO: 461711 - DNA, 20 bp, Artificial Sequence
  chemically synthesized
caaagaaggctgaccacagg

SEQ ID NO: 461712 - DNA, 20 bp, Artificial Sequence
  chemically synthesized
taatttccaaaggctgcctg

SEQ ID NO: 461713 - DNA, 20 bp, Artificial Sequence
  chemically synthesized
ggctgaccacaggcagcctt

SEQ ID NO: 461714 - DNA, 20 bp, Artificial Sequence
  chemically synthesized
acttaataattaatttccaa

SEQ ID NO: 461715 - DNA, 20 bp, Artificial Sequence
  chemically synthesized
cacttaataattaatttcca

SEQ ID NO: 461716 - DNA, 20 bp, Artificial Sequence
  chemically synthesized
gcctttggaaattaattatt

SEQ ID NO: 461717 - DNA, 20 bp, Artificial Sequence
  chemically synthesized
gtagtgtttgcagcatgaaa

SEQ ID NO: 461718 - DNA, 20 bp, Artificial Sequence
  chemically synthesized
tgtagtgtttgcagcatgaa

SEQ ID NO: 461719 - DNA, 20 bp, Artificial Sequence
  chemically synthesized
gaaatatattgtagtgtttg

SEQ ID NO: 461720 - DNA, 20 bp, Artificial Sequence
  chemically synthesized
gatattgcagaaatatattg

SEQ ID NO: 461721 - DNA, 20 bp, Artificial Sequence
  chemically synthesized
aaaattcttagttgatattg

SEQ ID NO: 461722 - DNA, 20 bp, Artificial Sequence
  chemically synthesized
atatttctgcaatatcaact

SEQ ID NO: 461723 - DNA, 20 bp, Artificial Sequence
  chemically synthesized
tagaaaaagaataaaattct

SEQ ID NO: 461724 - DNA, 20 bp, Artificial Sequence
  chemically synthesized
ctaaaatgtaagcatagaaa

SEQ ID NO: 461725 - DNA, 20 bp, Artificial Sequence
  chemically synthesized
tattttctaaaatgtaagca

SEQ ID NO: 461726 - DNA, 20 bp, Artificial Sequence
  chemically synthesized
ctttttctatgcttacattt

SEQ ID NO: 461727 - DNA, 20 bp, Artificial Sequence
  chemically synthesized
actgttattttctaaaatgt

SEQ ID NO: 461728 - DNA, 20 bp, Artificial Sequence
  chemically synthesized
gcttacattttagaaaataa

SEQ ID NO: 461729 - DNA, 20 bp, Artificial Sequence
  chemically synthesized
ttagaaaataacagtgtttt

SEQ ID NO: 461730 - DNA, 20 bp, Artificial Sequence
  chemically synthesized
ttttaagtcaacaacataca

SEQ ID NO: 461731 - DNA, 20 bp, Artificial Sequence
  chemically synthesized
aagtcaacaacatacatgga

SEQ ID NO: 461732 - DNA, 20 bp, Artificial Sequence
  chemically synthesized
ggtaatatttatgctaaata

SEQ ID NO: 461733 - DNA, 20 bp, Artificial Sequence
  chemically synthesized
tttggttgttatgccatatt

SEQ ID NO: 461734 - DNA, 20 bp, Artificial Sequence
  chemically synthesized
tctaaataaaaggagttatt

SEQ ID NO: 461735 - DNA, 20 bp, Artificial Sequence
  chemically synthesized
tatgggaatctaaataaaag

SEQ ID NO: 461736 - DNA, 20 bp, Artificial Sequence
  chemically synthesized
accaaataactccttttatt

SEQ ID NO: 461737 - DNA, 20 bp, Artificial Sequence
  chemically synthesized
tatatgggaatctaaataaa

SEQ ID NO: 461738 - DNA, 20 bp, Artificial Sequence
  chemically synthesized
gtatatgggaatctaaataa

SEQ ID NO: 461739 - DNA, 20 bp, Artificial Sequence
  chemically synthesized
tgtaagtttttatagtatat

SEQ ID NO: 461740 - DNA, 20 bp, Artificial Sequence
  chemically synthesized
ttgtaagtttttatagtata

SEQ ID NO: 461741 - DNA, 20 bp, Artificial Sequence
  chemically synthesized
agatgcattgtaagttttta

SEQ ID NO: 461742 - DNA, 20 bp, Artificial Sequence
  chemically synthesized
ttaaattgtagatgcattgt

SEQ ID NO: 461743 - DNA, 20 bp, Artificial Sequence
  chemically synthesized
acacatactttattaaattg

SEQ ID NO: 461744 - DNA, 20 bp, Artificial Sequence
  chemically synthesized
aatgcatctacaatttaata

SEQ ID NO: 461745 - DNA, 20 bp, Artificial Sequence
  chemically synthesized
tactacaattattcatttta

SEQ ID NO: 461746 - DNA, 20 bp, Artificial Sequence
  chemically synthesized
tactataaaatgaataattg

SEQ ID NO: 461747 - DNA, 20 bp, Artificial Sequence
  chemically synthesized
tataaaatgaataattgtag

SEQ ID NO: 461748 - DNA, 20 bp, Artificial Sequence
  chemically synthesized
gaataattgtagtagaaacc

SEQ ID NO: 461749 - DNA, 20 bp, Artificial Sequence
  chemically synthesized
aataattgtagtagaaacca

SEQ ID NO: 461750 - DNA, 20 bp, Artificial Sequence
  chemically synthesized
aaaagaggggggtaaaacct

SEQ ID NO: 461751 - DNA, 20 bp, Artificial Sequence
  chemically synthesized
cataattctcaaaaagaggg

SEQ ID NO: 461752 - DNA, 20 bp, Artificial Sequence
  chemically synthesized
gcataattctcaaaaagagg

SEQ ID NO: 461753 - DNA, 20 bp, Artificial Sequence
  chemically synthesized
agcataattctcaaaaagag

SEQ ID NO: 461754 - DNA, 20 bp, Artificial Sequence
  chemically synthesized
ggttttacccccctcttttt

SEQ ID NO: 461755 - DNA, 20 bp, Artificial Sequence
  chemically synthesized
aagcataattctcaaaaaga

SEQ ID NO: 461756 - DNA, 20 bp, Artificial Sequence
  chemically synthesized
aaagcataattctcaaaaag

SEQ ID NO: 461757 - DNA, 20 bp, Artificial Sequence
  chemically synthesized
taaagcataattctcaaaaa

SEQ ID NO: 461758 - DNA, 20 bp, Artificial Sequence
  chemically synthesized
tgtaaagcataattctcaaa

SEQ ID NO: 461759 - DNA, 20 bp, Artificial Sequence
  chemically synthesized
ttgagaattatgctttacat

SEQ ID NO: 461760 - DNA, 20 bp, Artificial Sequence
  chemically synthesized
atggaaggaggactgatgta

SEQ ID NO: 461761 - DNA, 20 bp, Artificial Sequence
  chemically synthesized
actaacagactaatggaagg

SEQ ID NO: 461762 - DNA, 20 bp, Artificial Sequence
  chemically synthesized
tacatcagtcctccttccat

SEQ ID NO: 461763 - DNA, 20 bp, Artificial Sequence
  chemically synthesized
aactaacagactaatggaag

SEQ ID NO: 461764 - DNA, 20 bp, Artificial Sequence
  chemically synthesized
ttaactaacagactaatgga

SEQ ID NO: 461765 - DNA, 20 bp, Artificial Sequence
  chemically synthesized
tttaactaacagactaatgg

SEQ ID NO: 461766 - DNA, 20 bp, Artificial Sequence
  chemically synthesized
ctttttaactaacagactaa

SEQ ID NO: 461767 - DNA, 20 bp, Artificial Sequence
  chemically synthesized
tcctccttccattagtctgt

SEQ ID NO: 461768 - DNA, 20 bp, Artificial Sequence
  chemically synthesized
acaatatgctttttaactaa

SEQ ID NO: 461769 - DNA, 20 bp, Artificial Sequence
  chemically synthesized
ccattagtctgttagttaaa

SEQ ID NO: 461770 - DNA, 20 bp, Artificial Sequence
  chemically synthesized
aaacattacaattaattttg

SEQ ID NO: 461771 - DNA, 20 bp, Artificial Sequence
  chemically synthesized
taattgtaatgtttcctatg

SEQ ID NO: 461772 - DNA, 20 bp, Artificial Sequence
  chemically synthesized
attaagcactatgtctgcat

SEQ ID NO: 461773 - DNA, 20 bp, Artificial Sequence
  chemically synthesized
tattaagcactatgtctgca

SEQ ID NO: 461774 - DNA, 20 bp, Artificial Sequence
  chemically synthesized
taatgtttcctatgcagaca

SEQ ID NO: 461775 - DNA, 20 bp, Artificial Sequence
  chemically synthesized
tatgcagacatagtgcttaa

SEQ ID NO: 461776 - DNA, 20 bp, Artificial Sequence
  chemically synthesized
tgcagacatagtgcttaata

SEQ ID NO: 461777 - DNA, 20 bp, Artificial Sequence
  chemically synthesized
ttgagacagtgggctctatt

SEQ ID NO: 461778 - DNA, 20 bp, Artificial Sequence
  chemically synthesized
tccttttctattgagacagt

SEQ ID NO: 461779 - DNA, 20 bp, Artificial Sequence
  chemically synthesized
ttccttttctattgagacag

SEQ ID NO: 461780 - DNA, 20 bp, Artificial Sequence
  chemically synthesized
aatagagcccactgtctcaa

SEQ ID NO: 461781 - DNA, 20 bp, Artificial Sequence
  chemically synthesized
agattccttttctattgaga

SEQ ID NO: 461782 - DNA, 20 bp, Artificial Sequence
  chemically synthesized
agcccactgtctcaatagaa

SEQ ID NO: 461783 - DNA, 20 bp, Artificial Sequence
  chemically synthesized
agacagattccttttctatt

SEQ ID NO: 461784 - DNA, 20 bp, Artificial Sequence
  chemically synthesized
gcccactgtctcaatagaaa

SEQ ID NO: 461785 - DNA, 20 bp, Artificial Sequence
  chemically synthesized
caatagaaaaggaatctgtc

SEQ ID NO: 461786 - DNA, 20 bp, Artificial Sequence
  chemically synthesized
taaatttggctgaaactaga

SEQ ID NO: 461787 - DNA, 20 bp, Artificial Sequence
  chemically synthesized
aaaaggaatctgtctagttt

SEQ ID NO: 461788 - DNA, 20 bp, Artificial Sequence
  chemically synthesized
taaataaatttggctgaaac

SEQ ID NO: 461789 - DNA, 20 bp, Artificial Sequence
  chemically synthesized
tatctgactctaaataaatt

SEQ ID NO: 461790 - DNA, 20 bp, Artificial Sequence
  chemically synthesized
tagtttcagccaaatttatt

SEQ ID NO: 461791 - DNA, 20 bp, Artificial Sequence
  chemically synthesized
gtttcagccaaatttattta

SEQ ID NO: 461792 - DNA, 20 bp, Artificial Sequence
  chemically synthesized
cagccaaatttatttagagt

SEQ ID NO: 461793 - DNA, 20 bp, Artificial Sequence
  chemically synthesized
aatttgattaaacataaaac

SEQ ID NO: 461794 - DNA, 20 bp, Artificial Sequence
  chemically synthesized
ggtaactgaggtgttcaata

SEQ ID NO: 461795 - DNA, 20 bp, Artificial Sequence
  chemically synthesized
agtatccatattgaacacct

SEQ ID NO: 461796 - DNA, 20 bp, Artificial Sequence
  chemically synthesized
tgtaaaggattaggtaactg

SEQ ID NO: 461797 - DNA, 20 bp, Artificial Sequence
  chemically synthesized
ctgtaaaggattaggtaact

SEQ ID NO: 461798 - DNA, 20 bp, Artificial Sequence
  chemically synthesized
ggactagactgtaaaggatt

SEQ ID NO: 461799 - DNA, 20 bp, Artificial Sequence
  chemically synthesized
tggactagactgtaaaggat

SEQ ID NO: 461800 - DNA, 20 bp, Artificial Sequence
  chemically synthesized
ctcagttacctaatccttta

SEQ ID NO: 461801 - DNA, 20 bp, Artificial Sequence
  chemically synthesized
aataatggactagactgtaa

SEQ ID NO: 461802 - DNA, 20 bp, Artificial Sequence
  chemically synthesized
ttacctaatcctttacagtc

SEQ ID NO: 461803 - DNA, 20 bp, Artificial Sequence
  chemically synthesized
taataatggactagactgta

SEQ ID NO: 461804 - DNA, 20 bp, Artificial Sequence
  chemically synthesized
taatactgttaataatggac

SEQ ID NO: 461805 - DNA, 20 bp, Artificial Sequence
  chemically synthesized
acagtctagtccattattaa

SEQ ID NO: 461806 - DNA, 20 bp, Artificial Sequence
  chemically synthesized
gatcttaatactgttaataa

SEQ ID NO: 461807 - DNA, 20 bp, Artificial Sequence
  chemically synthesized
agtccattattaacagtatt

SEQ ID NO: 461808 - DNA, 20 bp, Artificial Sequence
  chemically synthesized
attaacagtattaagatcat

SEQ ID NO: 461809 - DNA, 20 bp, Artificial Sequence
  chemically synthesized
ttaacagtattaagatcata

SEQ ID NO: 461810 - DNA, 20 bp, Artificial Sequence
  chemically synthesized
taacagtattaagatcataa

SEQ ID NO: 461811 - DNA, 20 bp, Artificial Sequence
  chemically synthesized
aagatcataagggattaata

SEQ ID NO: 461812 - DNA, 20 bp, Artificial Sequence
  chemically synthesized
agggattaataaagtttcta

SEQ ID NO: 461813 - DNA, 20 bp, Artificial Sequence
  chemically synthesized
gattaataaagtttctacag

SEQ ID NO: 461814 - DNA, 20 bp, Artificial Sequence
  chemically synthesized
attaataaagtttctacaga

SEQ ID NO: 461815 - DNA, 20 bp, Artificial Sequence
  chemically synthesized
ttaataaagtttctacagaa

SEQ ID NO: 461816 - DNA, 20 bp, Artificial Sequence
  chemically synthesized
agggaaaatgttcccttctg

SEQ ID NO: 461817 - DNA, 20 bp, Artificial Sequence
  chemically synthesized
cctttactgaaatcagacaa

SEQ ID NO: 461818 - DNA, 20 bp, Artificial Sequence
  chemically synthesized
tcctttactgaaatcagaca

SEQ ID NO: 461819 - DNA, 20 bp, Artificial Sequence
  chemically synthesized
ctcctttactgaaatcagac

SEQ ID NO: 461820 - DNA, 20 bp, Artificial Sequence
  chemically synthesized
cattttcccttgtctgattt

SEQ ID NO: 461821 - DNA, 20 bp, Artificial Sequence
  chemically synthesized
atatgctcctttactgaaat

SEQ ID NO: 461822 - DNA, 20 bp, Artificial Sequence
  chemically synthesized
tcccttgtctgatttcagta

SEQ ID NO: 461823 - DNA, 20 bp, Artificial Sequence
  chemically synthesized
cccttgtctgatttcagtaa

SEQ ID NO: 461824 - DNA, 20 bp, Artificial Sequence
  chemically synthesized
cttgtctgatttcagtaaag

SEQ ID NO: 461825 - DNA, 20 bp, Artificial Sequence
  chemically synthesized
gatttcagtaaaggagcata

SEQ ID NO: 461826 - DNA, 20 bp, Artificial Sequence
  chemically synthesized
atgatgatttcattttatca

SEQ ID NO: 461827 - DNA, 20 bp, Artificial Sequence
  chemically synthesized
ataaaacataaagaatattt

SEQ ID NO: 461828 - DNA, 20 bp, Artificial Sequence
  chemically synthesized
cccaagaaacataaaacata

SEQ ID NO: 461829 - DNA, 20 bp, Artificial Sequence
  chemically synthesized
tctttatgttttatgtttct

SEQ ID NO: 461830 - DNA, 20 bp, Artificial Sequence
  chemically synthesized
ctttatgttttatgtttctt

SEQ ID NO: 461831 - DNA, 20 bp, Artificial Sequence
  chemically synthesized
ttaatcagcacagtaagccc

SEQ ID NO: 461832 - DNA, 20 bp, Artificial Sequence
  chemically synthesized
ctccacttaatcagcacagt

SEQ ID NO: 461833 - DNA, 20 bp, Artificial Sequence
  chemically synthesized
atcactccacttaatcagca

SEQ ID NO: 461834 - DNA, 20 bp, Artificial Sequence
  chemically synthesized
ttgggcttactgtgctgatt

SEQ ID NO: 461835 - DNA, 20 bp, Artificial Sequence
  chemically synthesized
ggcttactgtgctgattaag

SEQ ID NO: 461836 - DNA, 20 bp, Artificial Sequence
  chemically synthesized
atgttatcactccacttaat

SEQ ID NO: 461837 - DNA, 20 bp, Artificial Sequence
  chemically synthesized
cttactgtgctgattaagtg

SEQ ID NO: 461838 - DNA, 20 bp, Artificial Sequence
  chemically synthesized
ggagtgataacatattgcac

SEQ ID NO: 461839 - DNA, 20 bp, Artificial Sequence
  chemically synthesized
taagtggagtgataaggtac

SEQ ID NO: 461840 - DNA, 20 bp, Artificial Sequence
  chemically synthesized
attgattaagtggagtgata

SEQ ID NO: 461841 - DNA, 20 bp, Artificial Sequence
  chemically synthesized
tattgattaagtggagtgat

SEQ ID NO: 461842 - DNA, 20 bp, Artificial Sequence
  chemically synthesized
attactgtattgattaagtg

SEQ ID NO: 461843 - DNA, 20 bp, Artificial Sequence
  chemically synthesized
ctattactgtattgattaag

SEQ ID NO: 461844 - DNA, 20 bp, Artificial Sequence
  chemically synthesized
gctctattactgtattgatt

SEQ ID NO: 461845 - DNA, 20 bp, Artificial Sequence
  chemically synthesized
atcactccacttaatcaata

SEQ ID NO: 461846 - DNA, 20 bp, Artificial Sequence
  chemically synthesized
ccacttaatcaatacagtaa

SEQ ID NO: 461847 - DNA, 20 bp, Artificial Sequence
  chemically synthesized
acttaatcaatacagtaata

SEQ ID NO: 461848 - DNA, 20 bp, Artificial Sequence
  chemically synthesized
caatacagtaatagagctat

SEQ ID NO: 461849 - DNA, 20 bp, Artificial Sequence
  chemically synthesized
gtttttaggattcaaactaa

SEQ ID NO: 461850 - DNA, 20 bp, Artificial Sequence
  chemically synthesized
ccaaaaaatgataagttttt

SEQ ID NO: 461851 - DNA, 20 bp, Artificial Sequence
  chemically synthesized
accaaaaaatgataagtttt

SEQ ID NO: 461852 - DNA, 20 bp, Artificial Sequence
  chemically synthesized
cattttgaccaaaaaatgat

SEQ ID NO: 461853 - DNA, 20 bp, Artificial Sequence
  chemically synthesized
cctaaaaacttatcattttt

SEQ ID NO: 461854 - DNA, 20 bp, Artificial Sequence
  chemically synthesized
ttatcattttttggtcaaaa

SEQ ID NO: 461855 - DNA, 20 bp, Artificial Sequence
  chemically synthesized
tggtcaaaatggaccaatat

SEQ ID NO: 461856 - DNA, 20 bp, Artificial Sequence
  chemically synthesized
tcatatgaatttgctgatat

SEQ ID NO: 461857 - DNA, 20 bp, Artificial Sequence
  chemically synthesized
atatacctaagatagataca

SEQ ID NO: 461858 - DNA, 20 bp, Artificial Sequence
  chemically synthesized
ttcaatctatgtatctatct

SEQ ID NO: 461859 - DNA, 20 bp, Artificial Sequence
  chemically synthesized
tcaatctatgtatctatctt

SEQ ID NO: 461860 - DNA, 20 bp, Artificial Sequence
  chemically synthesized
cactccatatatacctaaga

SEQ ID NO: 461861 - DNA, 20 bp, Artificial Sequence
  chemically synthesized
acgccactccatatatacct

SEQ ID NO: 461862 - DNA, 20 bp, Artificial Sequence
  chemically synthesized
gtatctatcttaggtatata

SEQ ID NO: 461863 - DNA, 20 bp, Artificial Sequence
  chemically synthesized
atctatcttaggtatatatg

SEQ ID NO: 461864 - DNA, 20 bp, Artificial Sequence
  chemically synthesized
tatcttaggtatatatggag

SEQ ID NO: 461865 - DNA, 20 bp, Artificial Sequence
  chemically synthesized
tggagtggcgtatgaataaa

SEQ ID NO: 461866 - DNA, 20 bp, Artificial Sequence
  chemically synthesized
agatatatatatgatttgat

SEQ ID NO: 461867 - DNA, 20 bp, Artificial Sequence
  chemically synthesized
tatatatgatttgatgagtt

SEQ ID NO: 461868 - DNA, 20 bp, Artificial Sequence
  chemically synthesized
tttgatgagttaagaataat

SEQ ID NO: 461869 - DNA, 20 bp, Artificial Sequence
  chemically synthesized
ttgatgagttaagaataatt

SEQ ID NO: 461870 - DNA, 20 bp, Artificial Sequence
  chemically synthesized
gagttaagaataattgggtc

SEQ ID NO: 461871 - DNA, 20 bp, Artificial Sequence
  chemically synthesized
gttaagaataattgggtcca

SEQ ID NO: 461872 - DNA, 20 bp, Artificial Sequence
  chemically synthesized
cctagagaactttatttctc

SEQ ID NO: 461873 - DNA, 20 bp, Artificial Sequence
  chemically synthesized
taattgggtccagagaaata

SEQ ID NO: 461874 - DNA, 20 bp, Artificial Sequence
  chemically synthesized
tccagagaaataaagttctc

SEQ ID NO: 461875 - DNA, 20 bp, Artificial Sequence
  chemically synthesized
ccagagaaataaagttctct

SEQ ID NO: 461876 - DNA, 20 bp, Artificial Sequence
  chemically synthesized
cagtagaacagtggtgccta

SEQ ID NO: 461877 - DNA, 20 bp, Artificial Sequence
  chemically synthesized
ttcagtagaacagtggtgcc

SEQ ID NO: 461878 - DNA, 20 bp, Artificial Sequence
  chemically synthesized
taattgtttcagtagaacag

SEQ ID NO: 461879 - DNA, 20 bp, Artificial Sequence
  chemically synthesized
aattaattgtttcagtagaa

SEQ ID NO: 461880 - DNA, 20 bp, Artificial Sequence
  chemically synthesized
aaacaaattaattgtttcag

SEQ ID NO: 461881 - DNA, 20 bp, Artificial Sequence
  chemically synthesized
tcaaaacaaattaattgttt

SEQ ID NO: 461882 - DNA, 20 bp, Artificial Sequence
  chemically synthesized
tctaatcgaacatgtatata

SEQ ID NO: 461883 - DNA, 20 bp, Artificial Sequence
  chemically synthesized
tctttatatacatgttcgat

SEQ ID NO: 461884 - DNA, 20 bp, Artificial Sequence
  chemically synthesized
ttagatgatttaaaatttta

SEQ ID NO: 461885 - DNA, 20 bp, Artificial Sequence
  chemically synthesized
ttaaaattttaaagtattaa

SEQ ID NO: 461886 - DNA, 20 bp, Artificial Sequence
  chemically synthesized
agtattaaaagtttaaaaac

SEQ ID NO: 461887 - DNA, 20 bp, Artificial Sequence
  chemically synthesized
agtttaaaaactagttttaa

SEQ ID NO: 461888 - DNA, 20 bp, Artificial Sequence
  chemically synthesized
tttaaaaaaacttttaaaac

SEQ ID NO: 461889 - DNA, 20 bp, Artificial Sequence
  chemically synthesized
tgtttacacatttaattact

SEQ ID NO: 461890 - DNA, 20 bp, Artificial Sequence
  chemically synthesized
aaaaaaaaaaaaaatacact

SEQ ID NO: 461891 - DNA, 20 bp, Artificial Sequence
  chemically synthesized
gtgtattttttttttttttc

SEQ ID NO: 461892 - DNA, 20 bp, Artificial Sequence
  chemically synthesized
attttttttttttttcgaga

SEQ ID NO: 461893 - DNA, 20 bp, Artificial Sequence
  chemically synthesized
tttttttttttttcgagaca

SEQ ID NO: 461894 - DNA, 20 bp, Artificial Sequence
  chemically synthesized
ttcaccctgggtgacagagc

SEQ ID NO: 461895 - DNA, 20 bp, Artificial Sequence
  chemically synthesized
cagagtcttgctctgtcacc

SEQ ID NO: 461896 - DNA, 20 bp, Artificial Sequence
  chemically synthesized
gcacttcaccctgggtgaca

SEQ ID NO: 461897 - DNA, 20 bp, Artificial Sequence
  chemically synthesized
agagtcttgctctgtcaccc

SEQ ID NO: 461898 - DNA, 20 bp, Artificial Sequence
  chemically synthesized
gagtcttgctctgtcaccca

SEQ ID NO: 461899 - DNA, 20 bp, Artificial Sequence
  chemically synthesized
ctgcacttcaccctgggtga

SEQ ID NO: 461900 - DNA, 20 bp, Artificial Sequence
  chemically synthesized
ttgctctgtcacccagggtg

SEQ ID NO: 461901 - DNA, 20 bp, Artificial Sequence
  chemically synthesized
gtgtcactgcacttcaccct

SEQ ID NO: 461902 - DNA, 20 bp, Artificial Sequence
  chemically synthesized
ggtgtcactgcacttcaccc

SEQ ID NO: 461903 - DNA, 20 bp, Artificial Sequence
  chemically synthesized
ctgtcacccagggtgaagtg

SEQ ID NO: 461904 - DNA, 20 bp, Artificial Sequence
  chemically synthesized
ggggttgcagtgagcggaaa

SEQ ID NO: 461905 - DNA, 20 bp, Artificial Sequence
  chemically synthesized
gaggtgggggttgcagtgag

SEQ ID NO: 461906 - DNA, 20 bp, Artificial Sequence
  chemically synthesized
tgggaggtgggggttgcagt

SEQ ID NO: 461907 - DNA, 20 bp, Artificial Sequence
  chemically synthesized
aacctgggaggtgggggttg

SEQ ID NO: 461908 - DNA, 20 bp, Artificial Sequence
  chemically synthesized
cactcgaacctgggaggtgg

SEQ ID NO: 461909 - DNA, 20 bp, Artificial Sequence
  chemically synthesized
tcactgcaacccccacctcc

SEQ ID NO: 461910 - DNA, 20 bp, Artificial Sequence
  chemically synthesized
tcactcgaacctgggaggtg

SEQ ID NO: 461911 - DNA, 20 bp, Artificial Sequence
  chemically synthesized
cactgcaacccccacctccc

SEQ ID NO: 461912 - DNA, 20 bp, Artificial Sequence
  chemically synthesized
atcactcgaacctgggaggt

SEQ ID NO: 461913 - DNA, 20 bp, Artificial Sequence
  chemically synthesized
aatcactcgaacctgggagg

SEQ ID NO: 461914 - DNA, 20 bp, Artificial Sequence
  chemically synthesized
gagaatcactcgaacctggg

SEQ ID NO: 461915 - DNA, 20 bp, Artificial Sequence
  chemically synthesized
ggagaatcactcgaacctgg

SEQ ID NO: 461916 - DNA, 20 bp, Artificial Sequence
  chemically synthesized
aacccccacctcccaggttc

SEQ ID NO: 461917 - DNA, 20 bp, Artificial Sequence
  chemically synthesized
ctggagaatcactcgaacct

SEQ ID NO: 461918 - DNA, 20 bp, Artificial Sequence
  chemically synthesized
gctggagaatcactcgaacc

SEQ ID NO: 461919 - DNA, 20 bp, Artificial Sequence
  chemically synthesized
cccaggttcgagtgattctc

SEQ ID NO: 461920 - DNA, 20 bp, Artificial Sequence
  chemically synthesized
ttcgagtgattctccagcct

SEQ ID NO: 461921 - DNA, 20 bp, Artificial Sequence
  chemically synthesized
ctttagggtggctgaggctg

SEQ ID NO: 461922 - DNA, 20 bp, Artificial Sequence
  chemically synthesized
cactttagggtggctgaggc

SEQ ID NO: 461923 - DNA, 20 bp, Artificial Sequence
  chemically synthesized
ggcacactttagggtggctg

SEQ ID NO: 461924 - DNA, 20 bp, Artificial Sequence
  chemically synthesized
tggcacactttagggtggct

SEQ ID NO: 461925 - DNA, 20 bp, Artificial Sequence
  chemically synthesized
ctccagcctcagccacccta

SEQ ID NO: 461926 - DNA, 20 bp, Artificial Sequence
  chemically synthesized
catggtggcacactttaggg

SEQ ID NO: 461927 - DNA, 20 bp, Artificial Sequence
  chemically synthesized
gggcatggtggcacacttta

SEQ ID NO: 461928 - DNA, 20 bp, Artificial Sequence
  chemically synthesized
tgggcatggtggcacacttt

SEQ ID NO: 461929 - DNA, 20 bp, Artificial Sequence
  chemically synthesized
ctgggcatggtggcacactt

SEQ ID NO: 461930 - DNA, 20 bp, Artificial Sequence
  chemically synthesized
ctaaagtgtgccaccatgcc

SEQ ID NO: 461931 - DNA, 20 bp, Artificial Sequence
  chemically synthesized
aaaaattttgctgggcatgg

SEQ ID NO: 461932 - DNA, 20 bp, Artificial Sequence
  chemically synthesized
aaaaaaaattttgctgggca

SEQ ID NO: 461933 - DNA, 20 bp, Artificial Sequence
  chemically synthesized
aacaaaaaaaaaattttgct

SEQ ID NO: 461934 - DNA, 20 bp, Artificial Sequence
  chemically synthesized
aaacaaaaaaaaaattttgc

SEQ ID NO: 461935 - DNA, 20 bp, Artificial Sequence
  chemically synthesized
ttttgtttgtttgtatttct

SEQ ID NO: 461936 - DNA, 20 bp, Artificial Sequence
  chemically synthesized
tgtttgtttgtatttcttag

SEQ ID NO: 461937 - DNA, 20 bp, Artificial Sequence
  chemically synthesized
tttgtttgtatttcttagta

SEQ ID NO: 461938 - DNA, 20 bp, Artificial Sequence
  chemically synthesized
ggtgaaaccctgtctctact

SEQ ID NO: 461939 - DNA, 20 bp, Artificial Sequence
  chemically synthesized
tttgtatttcttagtagaga

SEQ ID NO: 461940 - DNA, 20 bp, Artificial Sequence
  chemically synthesized
ttgtatttcttagtagagac

SEQ ID NO: 461941 - DNA, 20 bp, Artificial Sequence
  chemically synthesized
tgtatttcttagtagagaca

SEQ ID NO: 461942 - DNA, 20 bp, Artificial Sequence
  chemically synthesized
gagacagggtttcaccatgt

SEQ ID NO: 461943 - DNA, 20 bp, Artificial Sequence
  chemically synthesized
cgagaccagcttggccaaca

SEQ ID NO: 461944 - DNA, 20 bp, Artificial Sequence
  chemically synthesized
agggtttcaccatgttggcc

SEQ ID NO: 461945 - DNA, 20 bp, Artificial Sequence
  chemically synthesized
tttcaccatgttggccaagc

SEQ ID NO: 461946 - DNA, 20 bp, Artificial Sequence
  chemically synthesized
tcaggagttcgagaccagct

SEQ ID NO: 461947 - DNA, 20 bp, Artificial Sequence
  chemically synthesized
tgaggtcaggagttcgagac

SEQ ID NO: 461948 - DNA, 20 bp, Artificial Sequence
  chemically synthesized
tcatttgaggtcaggagttc

SEQ ID NO: 461949 - DNA, 20 bp, Artificial Sequence
  chemically synthesized
ggtggatcatttgaggtcag

SEQ ID NO: 461950 - DNA, 20 bp, Artificial Sequence
  chemically synthesized
caggtggatcatttgaggtc

SEQ ID NO: 461951 - DNA, 20 bp, Artificial Sequence
  chemically synthesized
gcaggtggatcatttgaggt

SEQ ID NO: 461952 - DNA, 20 bp, Artificial Sequence
  chemically synthesized
tgaggcaggtggatcatttg

SEQ ID NO: 461953 - DNA, 20 bp, Artificial Sequence
  chemically synthesized
ctgaggcaggtggatcattt

SEQ ID NO: 461954 - DNA, 20 bp, Artificial Sequence
  chemically synthesized
ctcaaatgatccacctgcct

SEQ ID NO: 461955 - DNA, 20 bp, Artificial Sequence
  chemically synthesized
ctttgggaggctgaggcagg

SEQ ID NO: 461956 - DNA, 20 bp, Artificial Sequence
  chemically synthesized
gcactttgggaggctgaggc

SEQ ID NO: 461957 - DNA, 20 bp, Artificial Sequence
  chemically synthesized
agcactttgggaggctgagg

SEQ ID NO: 461958 - DNA, 20 bp, Artificial Sequence
  chemically synthesized
cccagcactttgggaggctg

SEQ ID NO: 461959 - DNA, 20 bp, Artificial Sequence
  chemically synthesized
ccccagcactttgggaggct

SEQ ID NO: 461960 - DNA, 20 bp, Artificial Sequence
  chemically synthesized
ccacctgcctcagcctccca

SEQ ID NO: 461961 - DNA, 20 bp, Artificial Sequence
  chemically synthesized
tgtaaccccagcactttggg

SEQ ID NO: 461962 - DNA, 20 bp, Artificial Sequence
  chemically synthesized
ctgtaaccccagcactttgg

SEQ ID NO: 461963 - DNA, 20 bp, Artificial Sequence
  chemically synthesized
gcctcagcctcccaaagtgc

SEQ ID NO: 461964 - DNA, 20 bp, Artificial Sequence
  chemically synthesized
gcctgtaaccccagcacttt

SEQ ID NO: 461965 - DNA, 20 bp, Artificial Sequence
  chemically synthesized
cctcagcctcccaaagtgct

SEQ ID NO: 461966 - DNA, 20 bp, Artificial Sequence
  chemically synthesized
tgcctgtaaccccagcactt

SEQ ID NO: 461967 - DNA, 20 bp, Artificial Sequence
  chemically synthesized
ctcagcctcccaaagtgctg

SEQ ID NO: 461968 - DNA, 20 bp, Artificial Sequence
  chemically synthesized
ctcccaaagtgctggggtta

SEQ ID NO: 461969 - DNA, 20 bp, Artificial Sequence
  chemically synthesized
tcccaaagtgctggggttac

SEQ ID NO: 461970 - DNA, 20 bp, Artificial Sequence
  chemically synthesized
gtgactcatgcctgtaaccc

SEQ ID NO: 461971 - DNA, 20 bp, Artificial Sequence
  chemically synthesized
agtgctggggttacaggcat

SEQ ID NO: 461972 - DNA, 20 bp, Artificial Sequence
  chemically synthesized
caggcatgagtcaccttgcc

SEQ ID NO: 461973 - DNA, 20 bp, Artificial Sequence
  chemically synthesized
ctgaggaagtaggccaggca

SEQ ID NO: 461974 - DNA, 20 bp, Artificial Sequence
  chemically synthesized
actgaggaagtaggccaggc

SEQ ID NO: 461975 - DNA, 20 bp, Artificial Sequence
  chemically synthesized
taagactgaggaagtaggcc

SEQ ID NO: 461976 - DNA, 20 bp, Artificial Sequence
  chemically synthesized
gtaagactgaggaagtaggc

SEQ ID NO: 461977 - DNA, 20 bp, Artificial Sequence
  chemically synthesized
ccttgcctggcctacttcct

SEQ ID NO: 461978 - DNA, 20 bp, Artificial Sequence
  chemically synthesized
ctcagtaagactgaggaagt

SEQ ID NO: 461979 - DNA, 20 bp, Artificial Sequence
  chemically synthesized
actcagtaagactgaggaag

SEQ ID NO: 461980 - DNA, 20 bp, Artificial Sequence
  chemically synthesized
aatactcagtaagactgagg

SEQ ID NO: 461981 - DNA, 20 bp, Artificial Sequence
  chemically synthesized
gaaaatactcagtaagactg

SEQ ID NO: 461982 - DNA, 20 bp, Artificial Sequence
  chemically synthesized
ggaaaatactcagtaagact

SEQ ID NO: 461983 - DNA, 20 bp, Artificial Sequence
  chemically synthesized
cctacttcctcagtcttact

SEQ ID NO: 461984 - DNA, 20 bp, Artificial Sequence
  chemically synthesized
ctcaggggaaaatactcagt

SEQ ID NO: 461985 - DNA, 20 bp, Artificial Sequence
  chemically synthesized
aattctcaggggaaaatact

SEQ ID NO: 461986 - DNA, 20 bp, Artificial Sequence
  chemically synthesized
cttactgagtattttcccct

SEQ ID NO: 461987 - DNA, 20 bp, Artificial Sequence
  chemically synthesized
gccaattatctaattctcag

SEQ ID NO: 461988 - DNA, 20 bp, Artificial Sequence
  chemically synthesized
gagtattttcccctgagaat

SEQ ID NO: 461989 - DNA, 20 bp, Artificial Sequence
  chemically synthesized
ggccaattatctaattctca

SEQ ID NO: 461990 - DNA, 20 bp, Artificial Sequence
  chemically synthesized
aggccaattatctaattctc

SEQ ID NO: 461991 - DNA, 20 bp, Artificial Sequence
  chemically synthesized
aaggccaattatctaattct

SEQ ID NO: 461992 - DNA, 20 bp, Artificial Sequence
  chemically synthesized
tcccctgagaattagataat

SEQ ID NO: 461993 - DNA, 20 bp, Artificial Sequence
  chemically synthesized
ctggattttggaatgtggta

SEQ ID NO: 461994 - DNA, 20 bp, Artificial Sequence
  chemically synthesized
actggattttggaatgtggt

SEQ ID NO: 461995 - DNA, 20 bp, Artificial Sequence
  chemically synthesized
aatcactggattttggaatg

SEQ ID NO: 461996 - DNA, 20 bp, Artificial Sequence
  chemically synthesized
ccttaccacattccaaaatc

SEQ ID NO: 461997 - DNA, 20 bp, Artificial Sequence
  chemically synthesized
agaagagaatcactggattt

SEQ ID NO: 461998 - DNA, 20 bp, Artificial Sequence
  chemically synthesized
catgttaagaagagaatcac

SEQ ID NO: 461999 - DNA, 20 bp, Artificial Sequence
  chemically synthesized
taacatgagcatgttaagaa

SEQ ID NO: 462000 - DNA, 20 bp, Artificial Sequence
  chemically synthesized
tataacatgagcatgttaag

SEQ ID NO: 462001 - DNA, 20 bp, Artificial Sequence
  chemically synthesized
ggatataacatgagcatgtt

SEQ ID NO: 462002 - DNA, 20 bp, Artificial Sequence
  chemically synthesized
tgttgtgtgggatataacat

SEQ ID NO: 462003 - DNA, 20 bp, Artificial Sequence
  chemically synthesized
tcatgttatatcccacacaa

SEQ ID NO: 462004 - DNA, 20 bp, Artificial Sequence
  chemically synthesized
atgtattagtactgttgtgt

SEQ ID NO: 462005 - DNA, 20 bp, Artificial Sequence
  chemically synthesized
aatgtattagtactgttgtg

SEQ ID NO: 462006 - DNA, 20 bp, Artificial Sequence
  chemically synthesized
gcaaaattagaataatgtat

SEQ ID NO: 462007 - DNA, 20 bp, Artificial Sequence
  chemically synthesized
agcaacattgcaagcaaaat

SEQ ID NO: 462008 - DNA, 20 bp, Artificial Sequence
  chemically synthesized
tcatactatagcaacattgc

SEQ ID NO: 462009 - DNA, 20 bp, Artificial Sequence
  chemically synthesized
ttttgcttgcaatgttgcta

SEQ ID NO: 462010 - DNA, 20 bp, Artificial Sequence
  chemically synthesized
gaacacaaatattcatacta

SEQ ID NO: 462011 - DNA, 20 bp, Artificial Sequence
  chemically synthesized
tttcaacatttaaattttgg

SEQ ID NO: 462012 - DNA, 20 bp, Artificial Sequence
  chemically synthesized
ctttcaacatttaaattttg

SEQ ID NO: 462013 - DNA, 20 bp, Artificial Sequence
  chemically synthesized
agctttcaacatttaaattt

SEQ ID NO: 462014 - DNA, 20 bp, Artificial Sequence
  chemically synthesized
ctccaaaatttaaatgttga

SEQ ID NO: 462015 - DNA, 20 bp, Artificial Sequence
  chemically synthesized
aatgttgaaagctaatcccc

SEQ ID NO: 462016 - DNA, 20 bp, Artificial Sequence
  chemically synthesized
aataccaacctcttggggat

SEQ ID NO: 462017 - DNA, 20 bp, Artificial Sequence
  chemically synthesized
tgttgaaagctaatccccaa

SEQ ID NO: 462018 - DNA, 20 bp, Artificial Sequence
  chemically synthesized
gttgaaagctaatccccaag

SEQ ID NO: 462019 - DNA, 20 bp, Artificial Sequence
  chemically synthesized
cccctaataccaacctcttg

SEQ ID NO: 462020 - DNA, 20 bp, Artificial Sequence
  chemically synthesized
aaagctaatccccaagaggt

SEQ ID NO: 462021 - DNA, 20 bp, Artificial Sequence
  chemically synthesized
ccccctaataccaacctctt

SEQ ID NO: 462022 - DNA, 20 bp, Artificial Sequence
  chemically synthesized
accccctaataccaacctct

SEQ ID NO: 462023 - DNA, 20 bp, Artificial Sequence
  chemically synthesized
aatccccaagaggttggtat

SEQ ID NO: 462024 - DNA, 20 bp, Artificial Sequence
  chemically synthesized
atccccaagaggttggtatt

SEQ ID NO: 462025 - DNA, 20 bp, Artificial Sequence
  chemically synthesized
tccccaagaggttggtatta

SEQ ID NO: 462026 - DNA, 20 bp, Artificial Sequence
  chemically synthesized
ccccaagaggttggtattag

SEQ ID NO: 462027 - DNA, 20 bp, Artificial Sequence
  chemically synthesized
cccaagaggttggtattagg

SEQ ID NO: 462028 - DNA, 20 bp, Artificial Sequence
  chemically synthesized
agaggttggtattagggggt

SEQ ID NO: 462029 - DNA, 20 bp, Artificial Sequence
  chemically synthesized
gaggttggtattagggggtg

SEQ ID NO: 462030 - DNA, 20 bp, Artificial Sequence
  chemically synthesized
gtattagggggtgaggtctt

SEQ ID NO: 462031 - DNA, 20 bp, Artificial Sequence
  chemically synthesized
tattagggggtgaggtcttt

SEQ ID NO: 462032 - DNA, 20 bp, Artificial Sequence
  chemically synthesized
cataacctaatcacaaccta

SEQ ID NO: 462033 - DNA, 20 bp, Artificial Sequence
  chemically synthesized
tgaggtctttaggttgtgat

SEQ ID NO: 462034 - DNA, 20 bp, Artificial Sequence
  chemically synthesized
gaggtctttaggttgtgatt

SEQ ID NO: 462035 - DNA, 20 bp, Artificial Sequence
  chemically synthesized
ttaggttgtgattaggttat

SEQ ID NO: 462036 - DNA, 20 bp, Artificial Sequence
  chemically synthesized
ttgtgattaggttatgagta

SEQ ID NO: 462037 - DNA, 20 bp, Artificial Sequence
  chemically synthesized
gtgattaggttatgagtaca

SEQ ID NO: 462038 - DNA, 20 bp, Artificial Sequence
  chemically synthesized
gagtacagagccttcttgtt

SEQ ID NO: 462039 - DNA, 20 bp, Artificial Sequence
  chemically synthesized
ggtactaatcccaaacaaga

SEQ ID NO: 462040 - DNA, 20 bp, Artificial Sequence
  chemically synthesized
agtacagagccttcttgttt

SEQ ID NO: 462041 - DNA, 20 bp, Artificial Sequence
  chemically synthesized
gggtactaatcccaaacaag

SEQ ID NO: 462042 - DNA, 20 bp, Artificial Sequence
  chemically synthesized
taagggtactaatcccaaac

SEQ ID NO: 462043 - DNA, 20 bp, Artificial Sequence
  chemically synthesized
agagccttcttgtttgggat

SEQ ID NO: 462044 - DNA, 20 bp, Artificial Sequence
  chemically synthesized
tgggattagtacccttataa

SEQ ID NO: 462045 - DNA, 20 bp, Artificial Sequence
  chemically synthesized
ctctagggtctcttttataa

SEQ ID NO: 462046 - DNA, 20 bp, Artificial Sequence
  chemically synthesized
ggattagtacccttataaaa

SEQ ID NO: 462047 - DNA, 20 bp, Artificial Sequence
  chemically synthesized
tctctagggtctcttttata

SEQ ID NO: 462048 - DNA, 20 bp, Artificial Sequence
  chemically synthesized
ctctctagggtctcttttat

SEQ ID NO: 462049 - DNA, 20 bp, Artificial Sequence
  chemically synthesized
tacccttataaaagagaccc

SEQ ID NO: 462050 - DNA, 20 bp, Artificial Sequence
  chemically synthesized
cccttataaaagagacccta

SEQ ID NO: 462051 - DNA, 20 bp, Artificial Sequence
  chemically synthesized
cttataaaagagaccctaga

SEQ ID NO: 462052 - DNA, 20 bp, Artificial Sequence
  chemically synthesized
agaggcgagctggctctcta

SEQ ID NO: 462053 - DNA, 20 bp, Artificial Sequence
  chemically synthesized
taaaagagaccctagagagc

SEQ ID NO: 462054 - DNA, 20 bp, Artificial Sequence
  chemically synthesized
aagaggcgagctggctctct

SEQ ID NO: 462055 - DNA, 20 bp, Artificial Sequence
  chemically synthesized
gaagaggcgagctggctctc

SEQ ID NO: 462056 - DNA, 20 bp, Artificial Sequence
  chemically synthesized
tatatgatgaagaggcgagc

SEQ ID NO: 462057 - DNA, 20 bp, Artificial Sequence
  chemically synthesized
tccttatatgatgaagaggc

SEQ ID NO: 462058 - DNA, 20 bp, Artificial Sequence
  chemically synthesized
tgtgtccttatatgatgaag

SEQ ID NO: 462059 - DNA, 20 bp, Artificial Sequence
  chemically synthesized
ctgtgtccttatatgatgaa

SEQ ID NO: 462060 - DNA, 20 bp, Artificial Sequence
  chemically synthesized
tgctgtgtccttatatgatg

SEQ ID NO: 462061 - DNA, 20 bp, Artificial Sequence
  chemically synthesized
agctcgcctcttcatcatat

SEQ ID NO: 462062 - DNA, 20 bp, Artificial Sequence
  chemically synthesized
gctcgcctcttcatcatata

SEQ ID NO: 462063 - DNA, 20 bp, Artificial Sequence
  chemically synthesized
ctcttcatcatataaggaca

SEQ ID NO: 462064 - DNA, 20 bp, Artificial Sequence
  chemically synthesized
tcatataaggacacagcaac

SEQ ID NO: 462065 - DNA, 20 bp, Artificial Sequence
  chemically synthesized
catataaggacacagcaaca

SEQ ID NO: 462066 - DNA, 20 bp, Artificial Sequence
  chemically synthesized
cacagcaacaaggtaccatc

SEQ ID NO: 462067 - DNA, 20 bp, Artificial Sequence
  chemically synthesized
agcaacaaggtaccatctag

SEQ ID NO: 462068 - DNA, 20 bp, Artificial Sequence
  chemically synthesized
accgtttcctagctactaga

SEQ ID NO: 462069 - DNA, 20 bp, Artificial Sequence
  chemically synthesized
acaaggtaccatctagtagc

SEQ ID NO: 462070 - DNA, 20 bp, Artificial Sequence
  chemically synthesized
caaggtaccatctagtagct

SEQ ID NO: 462071 - DNA, 20 bp, Artificial Sequence
  chemically synthesized
acagaccgtttcctagctac

SEQ ID NO: 462072 - DNA, 20 bp, Artificial Sequence
  chemically synthesized
accatctagtagctaggaaa

SEQ ID NO: 462073 - DNA, 20 bp, Artificial Sequence
  chemically synthesized
cctgatgacagaccgtttcc

SEQ ID NO: 462074 - DNA, 20 bp, Artificial Sequence
  chemically synthesized
gctaggaaacggtctgtcat

SEQ ID NO: 462075 - DNA, 20 bp, Artificial Sequence
  chemically synthesized
ctaggaaacggtctgtcatc

SEQ ID NO: 462076 - DNA, 20 bp, Artificial Sequence
  chemically synthesized
gcacactctgtgcctgatga

SEQ ID NO: 462077 - DNA, 20 bp, Artificial Sequence
  chemically synthesized
aaacggtctgtcatcaggca

SEQ ID NO: 462078 - DNA, 20 bp, Artificial Sequence
  chemically synthesized
acggtctgtcatcaggcaca

SEQ ID NO: 462079 - DNA, 20 bp, Artificial Sequence
  chemically synthesized
gaagtccaagatcaagatga

SEQ ID NO: 462080 - DNA, 20 bp, Artificial Sequence
  chemically synthesized
ggaagtccaagatcaagatg

SEQ ID NO: 462081 - DNA, 20 bp, Artificial Sequence
  chemically synthesized
gtgtgccttcatcttgatct

SEQ ID NO: 462082 - DNA, 20 bp, Artificial Sequence
  chemically synthesized
aggctgggaagtccaagatc

SEQ ID NO: 462083 - DNA, 20 bp, Artificial Sequence
  chemically synthesized
ttctggaggctgggaagtcc

SEQ ID NO: 462084 - DNA, 20 bp, Artificial Sequence
  chemically synthesized
catcttgatcttggacttcc

SEQ ID NO: 462085 - DNA, 20 bp, Artificial Sequence
  chemically synthesized
tcaaagttctggaggctggg

SEQ ID NO: 462086 - DNA, 20 bp, Artificial Sequence
  chemically synthesized
atcttggacttcccagcctc

SEQ ID NO: 462087 - DNA, 20 bp, Artificial Sequence
  chemically synthesized
tgctcaaagttctggaggct

SEQ ID NO: 462088 - DNA, 20 bp, Artificial Sequence
  chemically synthesized
ttgctcaaagttctggaggc

SEQ ID NO: 462089 - DNA, 20 bp, Artificial Sequence
  chemically synthesized
ttcattgctcaaagttctgg

SEQ ID NO: 462090 - DNA, 20 bp, Artificial Sequence
  chemically synthesized
attcattgctcaaagttctg

SEQ ID NO: 462091 - DNA, 20 bp, Artificial Sequence
  chemically synthesized
ttcccagcctccagaacttt

SEQ ID NO: 462092 - DNA, 20 bp, Artificial Sequence
  chemically synthesized
agattcattgctcaaagttc

SEQ ID NO: 462093 - DNA, 20 bp, Artificial Sequence
  chemically synthesized
caacagagattcattgctca

SEQ ID NO: 462094 - DNA, 20 bp, Artificial Sequence
  chemically synthesized
tgggtggcgtagaaacaaca

SEQ ID NO: 462095 - DNA, 20 bp, Artificial Sequence
  chemically synthesized
actgggtggcgtagaaacaa

SEQ ID NO: 462096 - DNA, 20 bp, Artificial Sequence
  chemically synthesized
tctgttgtttctacgccacc

SEQ ID NO: 462097 - DNA, 20 bp, Artificial Sequence
  chemically synthesized
aaataataaactgggtggcg

SEQ ID NO: 462098 - DNA, 20 bp, Artificial Sequence
  chemically synthesized
taaaaaaataataaactggg

SEQ ID NO: 462099 - DNA, 20 bp, Artificial Sequence
  chemically synthesized
aactaaaaaaataataaact

SEQ ID NO: 462100 - DNA, 20 bp, Artificial Sequence
  chemically synthesized
aaactaaaaaaataataaac

SEQ ID NO: 462101 - DNA, 20 bp, Artificial Sequence
  chemically synthesized
cacccagtttattatttttt

SEQ ID NO: 462102 - DNA, 20 bp, Artificial Sequence
  chemically synthesized
tttttttagtttacgccacc

SEQ ID NO: 462103 - DNA, 20 bp, Artificial Sequence
  chemically synthesized
aaaataaataataaactggg

SEQ ID NO: 462104 - DNA, 20 bp, Artificial Sequence
  chemically synthesized
aaaaaaataaataataaact

SEQ ID NO: 462105 - DNA, 20 bp, Artificial Sequence
  chemically synthesized
aaaaaaaataaataataaac

SEQ ID NO: 462106 - DNA, 20 bp, Artificial Sequence
  chemically synthesized
ttattatttattttttttta

SEQ ID NO: 462107 - DNA, 20 bp, Artificial Sequence
  chemically synthesized
ttatttatttttttttatag

SEQ ID NO: 462108 - DNA, 20 bp, Artificial Sequence
  chemically synthesized
tttttttatagaagcccaaa

SEQ ID NO: 462109 - DNA, 20 bp, Artificial Sequence
  chemically synthesized
ctatcattcttcatccattt

SEQ ID NO: 462110 - DNA, 20 bp, Artificial Sequence
  chemically synthesized
actatcattcttcatccatt

SEQ ID NO: 462111 - DNA, 20 bp, Artificial Sequence
  chemically synthesized
tatagaagcccaaatggatg

SEQ ID NO: 462112 - DNA, 20 bp, Artificial Sequence
  chemically synthesized
cccaaatggatgaagaatga

SEQ ID NO: 462113 - DNA, 20 bp, Artificial Sequence
  chemically synthesized
gaagaatgatagttatttca

SEQ ID NO: 462114 - DNA, 20 bp, Artificial Sequence
  chemically synthesized
atgatagttatttcatagtg

SEQ ID NO: 462115 - DNA, 20 bp, Artificial Sequence
  chemically synthesized
gtgaagaatataaaaataat

SEQ ID NO: 462116 - DNA, 20 bp, Artificial Sequence
  chemically synthesized
cccttctctgattatggatg

SEQ ID NO: 462117 - DNA, 20 bp, Artificial Sequence
  chemically synthesized
agcatcactacatccataat

SEQ ID NO: 462118 - DNA, 20 bp, Artificial Sequence
  chemically synthesized
catcactacatccataatca

SEQ ID NO: 462119 - DNA, 20 bp, Artificial Sequence
  chemically synthesized
acccctcccttctctgatta

SEQ ID NO: 462120 - DNA, 20 bp, Artificial Sequence
  chemically synthesized
cactacatccataatcagag

SEQ ID NO: 462121 - DNA, 20 bp, Artificial Sequence
  chemically synthesized
actacatccataatcagaga

SEQ ID NO: 462122 - DNA, 20 bp, Artificial Sequence
  chemically synthesized
ctacatccataatcagagaa

SEQ ID NO: 462123 - DNA, 20 bp, Artificial Sequence
  chemically synthesized
acatccataatcagagaagg

SEQ ID NO: 462124 - DNA, 20 bp, Artificial Sequence
  chemically synthesized
catccataatcagagaaggg

SEQ ID NO: 462125 - DNA, 20 bp, Artificial Sequence
  chemically synthesized
atccataatcagagaaggga

SEQ ID NO: 462126 - DNA, 20 bp, Artificial Sequence
  chemically synthesized
tccataatcagagaagggag

SEQ ID NO: 462127 - DNA, 20 bp, Artificial Sequence
  chemically synthesized
ataatcagagaagggagggg

SEQ ID NO: 462128 - DNA, 20 bp, Artificial Sequence
  chemically synthesized
taatcagagaagggaggggt

SEQ ID NO: 462129 - DNA, 20 bp, Artificial Sequence
  chemically synthesized
gggaggggtgggataatgaa

SEQ ID NO: 462130 - DNA, 20 bp, Artificial Sequence
  chemically synthesized
gaggggtgggataatgaaca

SEQ ID NO: 462131 - DNA, 20 bp, Artificial Sequence
  chemically synthesized
gggataatgaacagagtcat

SEQ ID NO: 462132 - DNA, 20 bp, Artificial Sequence
  chemically synthesized
agtcataagtataatgtatt

SEQ ID NO: 462133 - DNA, 20 bp, Artificial Sequence
  chemically synthesized
gtataatgtatttagaaatc

SEQ ID NO: 462134 - DNA, 20 bp, Artificial Sequence
  chemically synthesized
tataatgtatttagaaatct

SEQ ID NO: 462135 - DNA, 20 bp, Artificial Sequence
  chemically synthesized
cagtttatgggatttcatcc

SEQ ID NO: 462136 - DNA, 20 bp, Artificial Sequence
  chemically synthesized
ctcaactcaattcagtttat

SEQ ID NO: 462137 - DNA, 20 bp, Artificial Sequence
  chemically synthesized
actcaactcaattcagttta

SEQ ID NO: 462138 - DNA, 20 bp, Artificial Sequence
  chemically synthesized
gaaatcccataaactgaatt

SEQ ID NO: 462139 - DNA, 20 bp, Artificial Sequence
  chemically synthesized
ggagggcactcaactcaatt

SEQ ID NO: 462140 - DNA, 20 bp, Artificial Sequence
  chemically synthesized
cccataaactgaattgagtt

SEQ ID NO: 462141 - DNA, 20 bp, Artificial Sequence
  chemically synthesized
acactcatcatgggggagga

SEQ ID NO: 462142 - DNA, 20 bp, Artificial Sequence
  chemically synthesized
cacactcatcatgggggagg

SEQ ID NO: 462143 - DNA, 20 bp, Artificial Sequence
  chemically synthesized
acacactcatcatgggggag

SEQ ID NO: 462144 - DNA, 20 bp, Artificial Sequence
  chemically synthesized
atacacactcatcatggggg

SEQ ID NO: 462145 - DNA, 20 bp, Artificial Sequence
  chemically synthesized
catacacactcatcatgggg

SEQ ID NO: 462146 - DNA, 20 bp, Artificial Sequence
  chemically synthesized
gtgccctcctcccccatgat

SEQ ID NO: 462147 - DNA, 20 bp, Artificial Sequence
  chemically synthesized
ttcatacacactcatcatgg

SEQ ID NO: 462148 - DNA, 20 bp, Artificial Sequence
  chemically synthesized
tttcatacacactcatcatg

SEQ ID NO: 462149 - DNA, 20 bp, Artificial Sequence
  chemically synthesized
ttttcatacacactcatcat

SEQ ID NO: 462150 - DNA, 20 bp, Artificial Sequence
  chemically synthesized
attttcatacacactcatca

SEQ ID NO: 462151 - DNA, 20 bp, Artificial Sequence
  chemically synthesized
gagtgtgtatgaaaatgcac

SEQ ID NO: 462152 - DNA, 20 bp, Artificial Sequence
  chemically synthesized
gtgtgtatgaaaatgcacta

SEQ ID NO: 462153 - DNA, 20 bp, Artificial Sequence
  chemically synthesized
gtgtatgaaaatgcactaga

SEQ ID NO: 462154 - DNA, 20 bp, Artificial Sequence
  chemically synthesized
atgaaaatgcactagagaga

SEQ ID NO: 462155 - DNA, 20 bp, Artificial Sequence
  chemically synthesized
atttttcatttctgtctctc

SEQ ID NO: 462156 - DNA, 20 bp, Artificial Sequence
  chemically synthesized
gagagacagaaatgaaaaat

SEQ ID NO: 462157 - DNA, 20 bp, Artificial Sequence
  chemically synthesized
agagacagaaatgaaaaatc

SEQ ID NO: 462158 - DNA, 20 bp, Artificial Sequence
  chemically synthesized
gagacagaaatgaaaaatca

SEQ ID NO: 462159 - DNA, 20 bp, Artificial Sequence
  chemically synthesized
agttcagagcatggtgagga

SEQ ID NO: 462160 - DNA, 20 bp, Artificial Sequence
  chemically synthesized
taggagttcagagcatggtg

SEQ ID NO: 462161 - DNA, 20 bp, Artificial Sequence
  chemically synthesized
ataggagttcagagcatggt

SEQ ID NO: 462162 - DNA, 20 bp, Artificial Sequence
  chemically synthesized
tctcataggagttcagagca

SEQ ID NO: 462163 - DNA, 20 bp, Artificial Sequence
  chemically synthesized
gtgaatctcataggagttca

SEQ ID NO: 462164 - DNA, 20 bp, Artificial Sequence
  chemically synthesized
aagtgaatctcataggagtt

SEQ ID NO: 462165 - DNA, 20 bp, Artificial Sequence
  chemically synthesized
accatgctctgaactcctat

SEQ ID NO: 462166 - DNA, 20 bp, Artificial Sequence
  chemically synthesized
atgacaagtgaatctcatag

SEQ ID NO: 462167 - DNA, 20 bp, Artificial Sequence
  chemically synthesized
agatgacaagtgaatctcat

SEQ ID NO: 462168 - DNA, 20 bp, Artificial Sequence
  chemically synthesized
aagatgacaagtgaatctca

SEQ ID NO: 462169 - DNA, 20 bp, Artificial Sequence
  chemically synthesized
atctttaaaagaaagatgac

SEQ ID NO: 462170 - DNA, 20 bp, Artificial Sequence
  chemically synthesized
cacttgtcatctttctttta

SEQ ID NO: 462171 - DNA, 20 bp, Artificial Sequence
  chemically synthesized
acgataagatctttaaaaga

SEQ ID NO: 462172 - DNA, 20 bp, Artificial Sequence
  chemically synthesized
atacacgataagatctttaa

SEQ ID NO: 462173 - DNA, 20 bp, Artificial Sequence
  chemically synthesized
aatatcagataatacacgat

SEQ ID NO: 462174 - DNA, 20 bp, Artificial Sequence
  chemically synthesized
tcgtgtattatctgatatta

SEQ ID NO: 462175 - DNA, 20 bp, Artificial Sequence
  chemically synthesized
ataatgggtaactgtaatat

SEQ ID NO: 462176 - DNA, 20 bp, Artificial Sequence
  chemically synthesized
atattacagttacccattat

SEQ ID NO: 462177 - DNA, 20 bp, Artificial Sequence
  chemically synthesized
tattacagttacccattatg

SEQ ID NO: 462178 - DNA, 20 bp, Artificial Sequence
  chemically synthesized
ttatgataattcctcataat

SEQ ID NO: 462179 - DNA, 20 bp, Artificial Sequence
  chemically synthesized
cttatgataattcctcataa

SEQ ID NO: 462180 - DNA, 20 bp, Artificial Sequence
  chemically synthesized
ccattatgaggaattatcat

SEQ ID NO: 462181 - DNA, 20 bp, Artificial Sequence
  chemically synthesized
aaaggtgataatgatgataa

SEQ ID NO: 462182 - DNA, 20 bp, Artificial Sequence
  chemically synthesized
taaaggtgataatgatgata

SEQ ID NO: 462183 - DNA, 20 bp, Artificial Sequence
  chemically synthesized
gtctatgacgatgatagtaa

SEQ ID NO: 462184 - DNA, 20 bp, Artificial Sequence
  chemically synthesized
tgtctatgacgatgatagta

SEQ ID NO: 462185 - DNA, 20 bp, Artificial Sequence
  chemically synthesized
acatctgtctatgacgatga

SEQ ID NO: 462186 - DNA, 20 bp, Artificial Sequence
  chemically synthesized
cacctttactatcatcgtca

SEQ ID NO: 462187 - DNA, 20 bp, Artificial Sequence
  chemically synthesized
tttactatcatcgtcataga

SEQ ID NO: 462188 - DNA, 20 bp, Artificial Sequence
  chemically synthesized
gtcatagacagatgtaaatc

SEQ ID NO: 462189 - DNA, 20 bp, Artificial Sequence
  chemically synthesized
atagacagatgtaaatctag

SEQ ID NO: 462190 - DNA, 20 bp, Artificial Sequence
  chemically synthesized
ttcttatatttgcattctgc

SEQ ID NO: 462191 - DNA, 20 bp, Artificial Sequence
  chemically synthesized
atctagcagaatgcaaatat

SEQ ID NO: 462192 - DNA, 20 bp, Artificial Sequence
  chemically synthesized
agaatgcaaatataagaaaa

SEQ ID NO: 462193 - DNA, 20 bp, Artificial Sequence
  chemically synthesized
gaatgcaaatataagaaaat

SEQ ID NO: 462194 - DNA, 20 bp, Artificial Sequence
  chemically synthesized
aaagtcttcttacgtgagtc

SEQ ID NO: 462195 - DNA, 20 bp, Artificial Sequence
  chemically synthesized
caaagtcttcttacgtgagt

SEQ ID NO: 462196 - DNA, 20 bp, Artificial Sequence
  chemically synthesized
aaatgggacctgactcacgt

SEQ ID NO: 462197 - DNA, 20 bp, Artificial Sequence
  chemically synthesized
tgggacctgactcacgtaag

SEQ ID NO: 462198 - DNA, 20 bp, Artificial Sequence
  chemically synthesized
ctttcaaagtcttcttacgt

SEQ ID NO: 462199 - DNA, 20 bp, Artificial Sequence
  chemically synthesized
ctcacgtaagaagactttga

SEQ ID NO: 462200 - DNA, 20 bp, Artificial Sequence
  chemically synthesized
tgatagaagaaaaactttca

SEQ ID NO: 462201 - DNA, 20 bp, Artificial Sequence
  chemically synthesized
aacttgtcagattttgatag

SEQ ID NO: 462202 - DNA, 20 bp, Artificial Sequence
  chemically synthesized
gccaacttgtcagattttga

SEQ ID NO: 462203 - DNA, 20 bp, Artificial Sequence
  chemically synthesized
ttcttctatcaaaatctgac

SEQ ID NO: 462204 - DNA, 20 bp, Artificial Sequence
  chemically synthesized
tctatcaaaatctgacaagt

SEQ ID NO: 462205 - DNA, 20 bp, Artificial Sequence
  chemically synthesized
tcccttttaagccaacttgt

SEQ ID NO: 462206 - DNA, 20 bp, Artificial Sequence
  chemically synthesized
aatctgacaagttggcttaa

SEQ ID NO: 462207 - DNA, 20 bp, Artificial Sequence
  chemically synthesized
atctgacaagttggcttaaa

SEQ ID NO: 462208 - DNA, 20 bp, Artificial Sequence
  chemically synthesized
tctgacaagttggcttaaaa

SEQ ID NO: 462209 - DNA, 20 bp, Artificial Sequence
  chemically synthesized
gacaagttggcttaaaaggg

SEQ ID NO: 462210 - DNA, 20 bp, Artificial Sequence
  chemically synthesized
atgaacacatcttccctttt

SEQ ID NO: 462211 - DNA, 20 bp, Artificial Sequence
  chemically synthesized
aagggaagatgtgttcataa

SEQ ID NO: 462212 - DNA, 20 bp, Artificial Sequence
  chemically synthesized
catggaaatggaaaaaatga

SEQ ID NO: 462213 - DNA, 20 bp, Artificial Sequence
  chemically synthesized
tttcattttttccatttcca

SEQ ID NO: 462214 - DNA, 20 bp, Artificial Sequence
  chemically synthesized
aatgtaattagccatggaaa

SEQ ID NO: 462215 - DNA, 20 bp, Artificial Sequence
  chemically synthesized
tattacaatgtaattagcca

SEQ ID NO: 462216 - DNA, 20 bp, Artificial Sequence
  chemically synthesized
atggagtattacaatgtaat

SEQ ID NO: 462217 - DNA, 20 bp, Artificial Sequence
  chemically synthesized
ttacattgtaatactccatt

SEQ ID NO: 462218 - DNA, 20 bp, Artificial Sequence
  chemically synthesized
tacattgtaatactccatta

SEQ ID NO: 462219 - DNA, 20 bp, Artificial Sequence
  chemically synthesized
gctatatccttaccttaatg

SEQ ID NO: 462220 - DNA, 20 bp, Artificial Sequence
  chemically synthesized
ttgtaatactccattaaggt

SEQ ID NO: 462221 - DNA, 20 bp, Artificial Sequence
  chemically synthesized
atgctatatccttaccttaa

SEQ ID NO: 462222 - DNA, 20 bp, Artificial Sequence
  chemically synthesized
tgtaatactccattaaggta

SEQ ID NO: 462223 - DNA, 20 bp, Artificial Sequence
  chemically synthesized
actccattaaggtaaggata

SEQ ID NO: 462224 - DNA, 20 bp, Artificial Sequence
  chemically synthesized
taaggatatagcattgtttg

SEQ ID NO: 462225 - DNA, 20 bp, Artificial Sequence
  chemically synthesized
tagcattgtttgtggtgaaa

SEQ ID NO: 462226 - DNA, 20 bp, Artificial Sequence
  chemically synthesized
tggtgaaatagactctccat

SEQ ID NO: 462227 - DNA, 20 bp, Artificial Sequence
  chemically synthesized
tctaaattattgctcatgga

SEQ ID NO: 462228 - DNA, 20 bp, Artificial Sequence
  chemically synthesized
aatctaaattattgctcatg

SEQ ID NO: 462229 - DNA, 20 bp, Artificial Sequence
  chemically synthesized
tcaatctaaattattgctca

SEQ ID NO: 462230 - DNA, 20 bp, Artificial Sequence
  chemically synthesized
actctccatgagcaataatt

SEQ ID NO: 462231 - DNA, 20 bp, Artificial Sequence
  chemically synthesized
agcaataatttagattgaaa

SEQ ID NO: 462232 - DNA, 20 bp, Artificial Sequence
  chemically synthesized
gcaataatttagattgaaaa

SEQ ID NO: 462233 - DNA, 20 bp, Artificial Sequence
  chemically synthesized
gtaaaatatatatatttcca

SEQ ID NO: 462234 - DNA, 20 bp, Artificial Sequence
  chemically synthesized
catttgcataaagtaaactg

SEQ ID NO: 462235 - DNA, 20 bp, Artificial Sequence
  chemically synthesized
caactcactccatttgcata

SEQ ID NO: 462236 - DNA, 20 bp, Artificial Sequence
  chemically synthesized
cacagtttactttatgcaaa

SEQ ID NO: 462237 - DNA, 20 bp, Artificial Sequence
  chemically synthesized
cagtttactttatgcaaatg

SEQ ID NO: 462238 - DNA, 20 bp, Artificial Sequence
  chemically synthesized
ttactttatgcaaatggagt

SEQ ID NO: 462239 - DNA, 20 bp, Artificial Sequence
  chemically synthesized
atggagtgagttgtaatttt

SEQ ID NO: 462240 - DNA, 20 bp, Artificial Sequence
  chemically synthesized
agtgagttgtaatttttggt

SEQ ID NO: 462241 - DNA, 20 bp, Artificial Sequence
  chemically synthesized
gagttgtaatttttggtgag

SEQ ID NO: 462242 - DNA, 20 bp, Artificial Sequence
  chemically synthesized
agttgtaatttttggtgagt

SEQ ID NO: 462243 - DNA, 20 bp, Artificial Sequence
  chemically synthesized
gtaatttttggtgagtgggt

SEQ ID NO: 462244 - DNA, 20 bp, Artificial Sequence
  chemically synthesized
aatttttggtgagtgggtga

SEQ ID NO: 462245 - DNA, 20 bp, Artificial Sequence
  chemically synthesized
atttttggtgagtgggtgag

SEQ ID NO: 462246 - DNA, 20 bp, Artificial Sequence
  chemically synthesized
ttggtgagtgggtgagaggt

SEQ ID NO: 462247 - DNA, 20 bp, Artificial Sequence
  chemically synthesized
tgagtgggtgagaggtcagt

SEQ ID NO: 462248 - DNA, 20 bp, Artificial Sequence
  chemically synthesized
aggtcagttagatgactgta

SEQ ID NO: 462249 - DNA, 20 bp, Artificial Sequence
  chemically synthesized
ggatatttttaaattccata

SEQ ID NO: 462250 - DNA, 20 bp, Artificial Sequence
  chemically synthesized
gatgctgccatatatgtaat

SEQ ID NO: 462251 - DNA, 20 bp, Artificial Sequence
  chemically synthesized
aaaatatccaattacatata

SEQ ID NO: 462252 - DNA, 20 bp, Artificial Sequence
  chemically synthesized
atatccaattacatatatgg

SEQ ID NO: 462253 - DNA, 20 bp, Artificial Sequence
  chemically synthesized
aattacatatatggcagcat

SEQ ID NO: 462254 - DNA, 20 bp, Artificial Sequence
  chemically synthesized
tacatatatggcagcatcag

SEQ ID NO: 462255 - DNA, 20 bp, Artificial Sequence
  chemically synthesized
ggcagcatcagaagtctctt

SEQ ID NO: 462256 - DNA, 20 bp, Artificial Sequence
  chemically synthesized
atattgtgagagttgctaaa

SEQ ID NO: 462257 - DNA, 20 bp, Artificial Sequence
  chemically synthesized
caatattgtgagagttgcta

SEQ ID NO: 462258 - DNA, 20 bp, Artificial Sequence
  chemically synthesized
atctctatacaatattgtga

SEQ ID NO: 462259 - DNA, 20 bp, Artificial Sequence
  chemically synthesized
ttatctctatacaatattgt

SEQ ID NO: 462260 - DNA, 20 bp, Artificial Sequence
  chemically synthesized
gcaactctcacaatattgta

SEQ ID NO: 462261 - DNA, 20 bp, Artificial Sequence
  chemically synthesized
aactctcacaatattgtata

SEQ ID NO: 462262 - DNA, 20 bp, Artificial Sequence
  chemically synthesized
acaatattgtatagagataa

SEQ ID NO: 462263 - DNA, 20 bp, Artificial Sequence
  chemically synthesized
atattgtatagagataaaag

SEQ ID NO: 462264 - DNA, 20 bp, Artificial Sequence
  chemically synthesized
tgtatagagataaaagcagt

SEQ ID NO: 462265 - DNA, 20 bp, Artificial Sequence
  chemically synthesized
tagagataaaagcagtcaga

SEQ ID NO: 462266 - DNA, 20 bp, Artificial Sequence
  chemically synthesized
agagataaaagcagtcagac

SEQ ID NO: 462267 - DNA, 20 bp, Artificial Sequence
  chemically synthesized
gagataaaagcagtcagaca

SEQ ID NO: 462268 - DNA, 20 bp, Artificial Sequence
  chemically synthesized
cagtcagacagggcaataat

SEQ ID NO: 462269 - DNA, 20 bp, Artificial Sequence
  chemically synthesized
gtcagacagggcaataatca

SEQ ID NO: 462270 - DNA, 20 bp, Artificial Sequence
  chemically synthesized
gattttataaatgagtaata

SEQ ID NO: 462271 - DNA, 20 bp, Artificial Sequence
  chemically synthesized
ttcattgagattttataaat

SEQ ID NO: 462272 - DNA, 20 bp, Artificial Sequence
  chemically synthesized
attcagagaaaattttcatt

SEQ ID NO: 462273 - DNA, 20 bp, Artificial Sequence
  chemically synthesized
atgaaaattttctctgaatt

SEQ ID NO: 462274 - DNA, 20 bp, Artificial Sequence
  chemically synthesized
ctttgttaacgcttaattca

SEQ ID NO: 462275 - DNA, 20 bp, Artificial Sequence
  chemically synthesized
ttctttgttaacgcttaatt

SEQ ID NO: 462276 - DNA, 20 bp, Artificial Sequence
  chemically synthesized
ctctgaattaagcgttaaca

SEQ ID NO: 462277 - DNA, 20 bp, Artificial Sequence
  chemically synthesized
tgaattaagcgttaacaaag

SEQ ID NO: 462278 - DNA, 20 bp, Artificial Sequence
  chemically synthesized
gaattaagcgttaacaaaga

SEQ ID NO: 462279 - DNA, 20 bp, Artificial Sequence
  chemically synthesized
aagcgttaacaaagaaggat

SEQ ID NO: 462280 - DNA, 20 bp, Artificial Sequence
  chemically synthesized
agcgttaacaaagaaggatg

SEQ ID NO: 462281 - DNA, 20 bp, Artificial Sequence
  chemically synthesized
tctgtcgtaccatcacaatt

SEQ ID NO: 462282 - DNA, 20 bp, Artificial Sequence
  chemically synthesized
aggatgaggctcaattgtga

SEQ ID NO: 462283 - DNA, 20 bp, Artificial Sequence
  chemically synthesized
gctcaattgtgatggtacga

SEQ ID NO: 462284 - DNA, 20 bp, Artificial Sequence
  chemically synthesized
cgtattgtaccattggcatt

SEQ ID NO: 462285 - DNA, 20 bp, Artificial Sequence
  chemically synthesized
cgacagacaccaaatgccaa

SEQ ID NO: 462286 - DNA, 20 bp, Artificial Sequence
  chemically synthesized
tactaaacgtattgtaccat

SEQ ID NO: 462287 - DNA, 20 bp, Artificial Sequence
  chemically synthesized
tgccaatggtacaatacgtt

SEQ ID NO: 462288 - DNA, 20 bp, Artificial Sequence
  chemically synthesized
caaaacatcacatagaagta

SEQ ID NO: 462289 - DNA, 20 bp, Artificial Sequence
  chemically synthesized
aaaaacaaaacatcacatag

SEQ ID NO: 462290 - DNA, 20 bp, Artificial Sequence
  chemically synthesized
gataaaaacaaaacatcaca

SEQ ID NO: 462291 - DNA, 20 bp, Artificial Sequence
  chemically synthesized
ttttgtttttatcatgatgt

SEQ ID NO: 462292 - DNA, 20 bp, Artificial Sequence
  chemically synthesized
ttgtttttatcatgatgttg

SEQ ID NO: 462293 - DNA, 20 bp, Artificial Sequence
  chemically synthesized
ttatcatgatgttggagcaa

SEQ ID NO: 462294 - DNA, 20 bp, Artificial Sequence
  chemically synthesized
tgatgttggagcaatagcca

SEQ ID NO: 462295 - DNA, 20 bp, Artificial Sequence
  chemically synthesized
gatgttggagcaatagccac

SEQ ID NO: 462296 - DNA, 20 bp, Artificial Sequence
  chemically synthesized
atgttggagcaatagccaca

SEQ ID NO: 462297 - DNA, 20 bp, Artificial Sequence
  chemically synthesized
tggagcaatagccacaggga

SEQ ID NO: 462298 - DNA, 20 bp, Artificial Sequence
  chemically synthesized
cccgcttacttctgtccctg

SEQ ID NO: 462299 - DNA, 20 bp, Artificial Sequence
  chemically synthesized
agcaatagccacagggacag

SEQ ID NO: 462300 - DNA, 20 bp, Artificial Sequence
  chemically synthesized
atagccacagggacagaagt

SEQ ID NO: 462301 - DNA, 20 bp, Artificial Sequence
  chemically synthesized
gccacagggacagaagtaag

SEQ ID NO: 462302 - DNA, 20 bp, Artificial Sequence
  chemically synthesized
ccacagggacagaagtaagc

SEQ ID NO: 462303 - DNA, 20 bp, Artificial Sequence
  chemically synthesized
agggacagaagtaagcgggt

SEQ ID NO: 462304 - DNA, 20 bp, Artificial Sequence
  chemically synthesized
ggacagaagtaagcgggtta

SEQ ID NO: 462305 - DNA, 20 bp, Artificial Sequence
  chemically synthesized
gacagaagtaagcgggttag

SEQ ID NO: 462306 - DNA, 20 bp, Artificial Sequence
  chemically synthesized
acagaagtaagcgggttaga

SEQ ID NO: 462307 - DNA, 20 bp, Artificial Sequence
  chemically synthesized
gtaagcgggttagagggtaa

SEQ ID NO: 462308 - DNA, 20 bp, Artificial Sequence
  chemically synthesized
aaaagttgaatgaatatgta

SEQ ID NO: 462309 - DNA, 20 bp, Artificial Sequence
  chemically synthesized
aaagttgaatgaatatgtac

SEQ ID NO: 462310 - DNA, 20 bp, Artificial Sequence
  chemically synthesized
gaatatgtacaggtatacct

SEQ ID NO: 462311 - DNA, 20 bp, Artificial Sequence
  chemically synthesized
atatgtacaggtataccttg

SEQ ID NO: 462312 - DNA, 20 bp, Artificial Sequence
  chemically synthesized
ctgaacctgcagtatctcca

SEQ ID NO: 462313 - DNA, 20 bp, Artificial Sequence
  chemically synthesized
actgaacctgcagtatctcc

SEQ ID NO: 462314 - DNA, 20 bp, Artificial Sequence
  chemically synthesized
ggtataccttggagatactg

SEQ ID NO: 462315 - DNA, 20 bp, Artificial Sequence
  chemically synthesized
gtataccttggagatactgc

SEQ ID NO: 462316 - DNA, 20 bp, Artificial Sequence
  chemically synthesized
ccttggagatactgcaggtt

SEQ ID NO: 462317 - DNA, 20 bp, Artificial Sequence
  chemically synthesized
gtgatctggaactgaacctg

SEQ ID NO: 462318 - DNA, 20 bp, Artificial Sequence
  chemically synthesized
agatactgcaggttcagttc

SEQ ID NO: 462319 - DNA, 20 bp, Artificial Sequence
  chemically synthesized
ctcactttattttggtgatc

SEQ ID NO: 462320 - DNA, 20 bp, Artificial Sequence
  chemically synthesized
agttccagatcaccaaaata

SEQ ID NO: 462321 - DNA, 20 bp, Artificial Sequence
  chemically synthesized
tcatgtgactcactttattt

SEQ ID NO: 462322 - DNA, 20 bp, Artificial Sequence
  chemically synthesized
ccagatcaccaaaataaagt

SEQ ID NO: 462323 - DNA, 20 bp, Artificial Sequence
  chemically synthesized
agtgagtcacatgaattatt

SEQ ID NO: 462324 - DNA, 20 bp, Artificial Sequence
  chemically synthesized
acatgaattattcggtttcc

SEQ ID NO: 462325 - DNA, 20 bp, Artificial Sequence
  chemically synthesized
atataacttttatatacact

SEQ ID NO: 462326 - DNA, 20 bp, Artificial Sequence
  chemically synthesized
aatataacttttatatacac

SEQ ID NO: 462327 - DNA, 20 bp, Artificial Sequence
  chemically synthesized
cggtttcccagtgtatataa

SEQ ID NO: 462328 - DNA, 20 bp, Artificial Sequence
  chemically synthesized
gttatatttacattattttg

SEQ ID NO: 462329 - DNA, 20 bp, Artificial Sequence
  chemically synthesized
tttacattattttgtagcct

SEQ ID NO: 462330 - DNA, 20 bp, Artificial Sequence
  chemically synthesized
acataatgctttgcacactt

SEQ ID NO: 462331 - DNA, 20 bp, Artificial Sequence
  chemically synthesized
aacataatgctttgcacact

SEQ ID NO: 462332 - DNA, 20 bp, Artificial Sequence
  chemically synthesized
ttttgtagcctaagtgtgca

SEQ ID NO: 462333 - DNA, 20 bp, Artificial Sequence
  chemically synthesized
aataaattatgtttttgtta

SEQ ID NO: 462334 - DNA, 20 bp, Artificial Sequence
  chemically synthesized
caataaattatgtttttgtt

SEQ ID NO: 462335 - DNA, 20 bp, Artificial Sequence
  chemically synthesized
aacataatttattgctaaaa

SEQ ID NO: 462336 - DNA, 20 bp, Artificial Sequence
  chemically synthesized
taatttattgctaaaaaagc

SEQ ID NO: 462337 - DNA, 20 bp, Artificial Sequence
  chemically synthesized
cagatgattgctagcttttt

SEQ ID NO: 462338 - DNA, 20 bp, Artificial Sequence
  chemically synthesized
ctaaaggctcagatgattgc

SEQ ID NO: 462339 - DNA, 20 bp, Artificial Sequence
  chemically synthesized
aaaaaagctagcaatcatct

SEQ ID NO: 462340 - DNA, 20 bp, Artificial Sequence
  chemically synthesized
ctagcaatcatctgagcctt

SEQ ID NO: 462341 - DNA, 20 bp, Artificial Sequence
  chemically synthesized
attacaactcactaaaggct

SEQ ID NO: 462342 - DNA, 20 bp, Artificial Sequence
  chemically synthesized
caatcatctgagcctttagt

SEQ ID NO: 462343 - DNA, 20 bp, Artificial Sequence
  chemically synthesized
aaaagattacaactcactaa

SEQ ID NO: 462344 - DNA, 20 bp, Artificial Sequence
  chemically synthesized
aaaaagattacaactcacta

SEQ ID NO: 462345 - DNA, 20 bp, Artificial Sequence
  chemically synthesized
gtgagttgtaatctttttgc

SEQ ID NO: 462346 - DNA, 20 bp, Artificial Sequence
  chemically synthesized
caagagcctccactagcaaa

SEQ ID NO: 462347 - DNA, 20 bp, Artificial Sequence
  chemically synthesized
agttgtaatctttttgctag

SEQ ID NO: 462348 - DNA, 20 bp, Artificial Sequence
  chemically synthesized
ttgtaatctttttgctagtg

SEQ ID NO: 462349 - DNA, 20 bp, Artificial Sequence
  chemically synthesized
tgtaatctttttgctagtgg

SEQ ID NO: 462350 - DNA, 20 bp, Artificial Sequence
  chemically synthesized
attgaggcaagagcctccac

SEQ ID NO: 462351 - DNA, 20 bp, Artificial Sequence
  chemically synthesized
agccatccacattgaggcaa

SEQ ID NO: 462352 - DNA, 20 bp, Artificial Sequence
  chemically synthesized
gcagccatccacattgaggc

SEQ ID NO: 462353 - DNA, 20 bp, Artificial Sequence
  chemically synthesized
tggaggctcttgcctcaatg

SEQ ID NO: 462354 - DNA, 20 bp, Artificial Sequence
  chemically synthesized
atcagcagccatccacattg

SEQ ID NO: 462355 - DNA, 20 bp, Artificial Sequence
  chemically synthesized
aatcagcagccatccacatt

SEQ ID NO: 462356 - DNA, 20 bp, Artificial Sequence
  chemically synthesized
ggctcttgcctcaatgtgga

SEQ ID NO: 462357 - DNA, 20 bp, Artificial Sequence
  chemically synthesized
accccaccctgatcaatcag

SEQ ID NO: 462358 - DNA, 20 bp, Artificial Sequence
  chemically synthesized
gtggatggctgctgattgat

SEQ ID NO: 462359 - DNA, 20 bp, Artificial Sequence
  chemically synthesized
tggatggctgctgattgatc

SEQ ID NO: 462360 - DNA, 20 bp, Artificial Sequence
  chemically synthesized
gcaaccccaccctgatcaat

SEQ ID NO: 462361 - DNA, 20 bp, Artificial Sequence
  chemically synthesized
ggatggctgctgattgatca

SEQ ID NO: 462362 - DNA, 20 bp, Artificial Sequence
  chemically synthesized
tggctgctgattgatcaggg

SEQ ID NO: 462363 - DNA, 20 bp, Artificial Sequence
  chemically synthesized
ggctgctgattgatcagggt

SEQ ID NO: 462364 - DNA, 20 bp, Artificial Sequence
  chemically synthesized
gctgctgattgatcagggtg

SEQ ID NO: 462365 - DNA, 20 bp, Artificial Sequence
  chemically synthesized
tgatcagggtggggttgctg

SEQ ID NO: 462366 - DNA, 20 bp, Artificial Sequence
  chemically synthesized
gatcagggtggggttgctga

SEQ ID NO: 462367 - DNA, 20 bp, Artificial Sequence
  chemically synthesized
cagggtggggttgctgaagg

SEQ ID NO: 462368 - DNA, 20 bp, Artificial Sequence
  chemically synthesized
agggtggggttgctgaaggt

SEQ ID NO: 462369 - DNA, 20 bp, Artificial Sequence
  chemically synthesized
ggtggggttgctgaaggtgg

SEQ ID NO: 462370 - DNA, 20 bp, Artificial Sequence
  chemically synthesized
gtcacagtcactcccacctt

SEQ ID NO: 462371 - DNA, 20 bp, Artificial Sequence
  chemically synthesized
cttattttacaaagttgtca

SEQ ID NO: 462372 - DNA, 20 bp, Artificial Sequence
  chemically synthesized
cattgttgtcttattttaca

SEQ ID NO: 462373 - DNA, 20 bp, Artificial Sequence
  chemically synthesized
ctgtgacaactttgtaaaat

SEQ ID NO: 462374 - DNA, 20 bp, Artificial Sequence
  chemically synthesized
aaagaaagagtcaattgatg

SEQ ID NO: 462375 - DNA, 20 bp, Artificial Sequence
  chemically synthesized
gaaatgttttgtgaaagaaa

SEQ ID NO: 462376 - DNA, 20 bp, Artificial Sequence
  chemically synthesized
aagaaatgttttgtgaaaga

SEQ ID NO: 462377 - DNA, 20 bp, Artificial Sequence
  chemically synthesized
tacaaagaaatgttttgtga

SEQ ID NO: 462378 - DNA, 20 bp, Artificial Sequence
  chemically synthesized
tttcacaaaacatttctttg

SEQ ID NO: 462379 - DNA, 20 bp, Artificial Sequence
  chemically synthesized
aaacagcagcacatgctaca

SEQ ID NO: 462380 - DNA, 20 bp, Artificial Sequence
  chemically synthesized
agtaaagtgctatcaaacag

SEQ ID NO: 462381 - DNA, 20 bp, Artificial Sequence
  chemically synthesized
tagcatgtgctgctgtttga

SEQ ID NO: 462382 - DNA, 20 bp, Artificial Sequence
  chemically synthesized
gtgagtaaagtgctatcaaa

SEQ ID NO: 462383 - DNA, 20 bp, Artificial Sequence
  chemically synthesized
gtttgatagcactttactca

SEQ ID NO: 462384 - DNA, 20 bp, Artificial Sequence
  chemically synthesized
aagaagttctactgtgagta

SEQ ID NO: 462385 - DNA, 20 bp, Artificial Sequence
  chemically synthesized
tgatagcactttactcacag

SEQ ID NO: 462386 - DNA, 20 bp, Artificial Sequence
  chemically synthesized
tttgaaagaagttctactgt

SEQ ID NO: 462387 - DNA, 20 bp, Artificial Sequence
  chemically synthesized
actgactccaattttgaaag

SEQ ID NO: 462388 - DNA, 20 bp, Artificial Sequence
  chemically synthesized
agtagaacttctttcaaaat

SEQ ID NO: 462389 - DNA, 20 bp, Artificial Sequence
  chemically synthesized
aagactgactccaattttga

SEQ ID NO: 462390 - DNA, 20 bp, Artificial Sequence
  chemically synthesized
tagaacttctttcaaaattg

SEQ ID NO: 462391 - DNA, 20 bp, Artificial Sequence
  chemically synthesized
acttctttcaaaattggagt

SEQ ID NO: 462392 - DNA, 20 bp, Artificial Sequence
  chemically synthesized
aagtagtggcagaatttgag

SEQ ID NO: 462393 - DNA, 20 bp, Artificial Sequence
  chemically synthesized
ataaagtagtggcagaattt

SEQ ID NO: 462394 - DNA, 20 bp, Artificial Sequence
  chemically synthesized
cttagctgataaagtagtgg

SEQ ID NO: 462395 - DNA, 20 bp, Artificial Sequence
  chemically synthesized
atacttagctgataaagtag

SEQ ID NO: 462396 - DNA, 20 bp, Artificial Sequence
  chemically synthesized
aaattctgccactactttat

SEQ ID NO: 462397 - DNA, 20 bp, Artificial Sequence
  chemically synthesized
cacatacttagctgataaag

SEQ ID NO: 462398 - DNA, 20 bp, Artificial Sequence
  chemically synthesized
ttacacatacttagctgata

SEQ ID NO: 462399 - DNA, 20 bp, Artificial Sequence
  chemically synthesized
ctgccactactttatcagct

SEQ ID NO: 462400 - DNA, 20 bp, Artificial Sequence
  chemically synthesized
tttagaatattacacatact

SEQ ID NO: 462401 - DNA, 20 bp, Artificial Sequence
  chemically synthesized
tgagatgacaacaaaggatt

SEQ ID NO: 462402 - DNA, 20 bp, Artificial Sequence
  chemically synthesized
cattgttgagatgacaacaa

SEQ ID NO: 462403 - DNA, 20 bp, Artificial Sequence
  chemically synthesized
acattgttgagatgacaaca

SEQ ID NO: 462404 - DNA, 20 bp, Artificial Sequence
  chemically synthesized
aagatgctgagaacattgtt

SEQ ID NO: 462405 - DNA, 20 bp, Artificial Sequence
  chemically synthesized
tgtcatctcaacaatgttct

SEQ ID NO: 462406 - DNA, 20 bp, Artificial Sequence
  chemically synthesized
ttacttctggtgaagatgct

SEQ ID NO: 462407 - DNA, 20 bp, Artificial Sequence
  chemically synthesized
aatgttctcagcatcttcac

SEQ ID NO: 462408 - DNA, 20 bp, Artificial Sequence
  chemically synthesized
gttctcagcatcttcaccag

SEQ ID NO: 462409 - DNA, 20 bp, Artificial Sequence
  chemically synthesized
gataaaatttacttctggtg

SEQ ID NO: 462410 - DNA, 20 bp, Artificial Sequence
  chemically synthesized
cttgagataaaatttacttc

SEQ ID NO: 462411 - DNA, 20 bp, Artificial Sequence
  chemically synthesized
ccagaagtaaattttatctc

SEQ ID NO: 462412 - DNA, 20 bp, Artificial Sequence
  chemically synthesized
aagtaaattttatctcaaga

SEQ ID NO: 462413 - DNA, 20 bp, Artificial Sequence
  chemically synthesized
agcaaagaaagtgctttctt

SEQ ID NO: 462414 - DNA, 20 bp, Artificial Sequence
  chemically synthesized
atctgatggatgagcaaaga

SEQ ID NO: 462415 - DNA, 20 bp, Artificial Sequence
  chemically synthesized
ttgcatctgatggatgagca

SEQ ID NO: 462416 - DNA, 20 bp, Artificial Sequence
  chemically synthesized
cactttctttgctcatccat

SEQ ID NO: 462417 - DNA, 20 bp, Artificial Sequence
  chemically synthesized
aggaattgcatctgatggat

SEQ ID NO: 462418 - DNA, 20 bp, Artificial Sequence
  chemically synthesized
ggatgaggaattgcatctga

SEQ ID NO: 462419 - DNA, 20 bp, Artificial Sequence
  chemically synthesized
taataaagcgtgaatggatg

SEQ ID NO: 462420 - DNA, 20 bp, Artificial Sequence
  chemically synthesized
ataataaagcgtgaatggat

SEQ ID NO: 462421 - DNA, 20 bp, Artificial Sequence
  chemically synthesized
atctcataataaagcgtgaa

SEQ ID NO: 462422 - DNA, 20 bp, Artificial Sequence
  chemically synthesized
atccattcacgctttattat

SEQ ID NO: 462423 - DNA, 20 bp, Artificial Sequence
  chemically synthesized
attcctaaaatctcataata

SEQ ID NO: 462424 - DNA, 20 bp, Artificial Sequence
  chemically synthesized
cacgctttattatgagattt

SEQ ID NO: 462425 - DNA, 20 bp, Artificial Sequence
  chemically synthesized
acgctttattatgagatttt

SEQ ID NO: 462426 - DNA, 20 bp, Artificial Sequence
  chemically synthesized
attatgagattttaggaatt

SEQ ID NO: 462427 - DNA, 20 bp, Artificial Sequence
  chemically synthesized
taggaattcagcaacatctt

SEQ ID NO: 462428 - DNA, 20 bp, Artificial Sequence
  chemically synthesized
aggaattcagcaacatcttc

SEQ ID NO: 462429 - DNA, 20 bp, Artificial Sequence
  chemically synthesized
aaaatgagaagtggagcctg

SEQ ID NO: 462430 - DNA, 20 bp, Artificial Sequence
  chemically synthesized
gagaattaaaatgagaagtg

SEQ ID NO: 462431 - DNA, 20 bp, Artificial Sequence
  chemically synthesized
aagagaattaaaatgagaag

SEQ ID NO: 462432 - DNA, 20 bp, Artificial Sequence
  chemically synthesized
agcaagagaattaaaatgag

SEQ ID NO: 462433 - DNA, 20 bp, Artificial Sequence
  chemically synthesized
aatagcaagagaattaaaat

SEQ ID NO: 462434 - DNA, 20 bp, Artificial Sequence
  chemically synthesized
agatatggtgacaatagcaa

SEQ ID NO: 462435 - DNA, 20 bp, Artificial Sequence
  chemically synthesized
ggagatatggtgacaatagc

SEQ ID NO: 462436 - DNA, 20 bp, Artificial Sequence
  chemically synthesized
cactggagatatggtgacaa

SEQ ID NO: 462437 - DNA, 20 bp, Artificial Sequence
  chemically synthesized
tgctattgtcaccatatctc

SEQ ID NO: 462438 - DNA, 20 bp, Artificial Sequence
  chemically synthesized
ggaagaagtcactggagata

SEQ ID NO: 462439 - DNA, 20 bp, Artificial Sequence
  chemically synthesized
gtcactggaagaagtcactg

SEQ ID NO: 462440 - DNA, 20 bp, Artificial Sequence
  chemically synthesized
ttgtcactggaagaagtcac

SEQ ID NO: 462441 - DNA, 20 bp, Artificial Sequence
  chemically synthesized
atatctccagtgacttcttc

SEQ ID NO: 462442 - DNA, 20 bp, Artificial Sequence
  chemically synthesized
gctcaagttgtcactggaag

SEQ ID NO: 462443 - DNA, 20 bp, Artificial Sequence
  chemically synthesized
ggagctcaagttgtcactgg

SEQ ID NO: 462444 - DNA, 20 bp, Artificial Sequence
  chemically synthesized
taaggagctcaagttgtcac

SEQ ID NO: 462445 - DNA, 20 bp, Artificial Sequence
  chemically synthesized
acttcttccagtgacaactt

SEQ ID NO: 462446 - DNA, 20 bp, Artificial Sequence
  chemically synthesized
tggatgactttaaggagctc

SEQ ID NO: 462447 - DNA, 20 bp, Artificial Sequence
  chemically synthesized
gtgacaacttgagctcctta

SEQ ID NO: 462448 - DNA, 20 bp, Artificial Sequence
  chemically synthesized
ccctcatggatgactttaag

SEQ ID NO: 462449 - DNA, 20 bp, Artificial Sequence
  chemically synthesized
aaccctcatggatgacttta

SEQ ID NO: 462450 - DNA, 20 bp, Artificial Sequence
  chemically synthesized
caaccctcatggatgacttt

SEQ ID NO: 462451 - DNA, 20 bp, Artificial Sequence
  chemically synthesized
agctccttaaagtcatccat

SEQ ID NO: 462452 - DNA, 20 bp, Artificial Sequence
  chemically synthesized
gctccttaaagtcatccatg

SEQ ID NO: 462453 - DNA, 20 bp, Artificial Sequence
  chemically synthesized
ctccttaaagtcatccatga

SEQ ID NO: 462454 - DNA, 20 bp, Artificial Sequence
  chemically synthesized
gaagctgatttcaaccctca

SEQ ID NO: 462455 - DNA, 20 bp, Artificial Sequence
  chemically synthesized
tcatccatgagggttgaaat

SEQ ID NO: 462456 - DNA, 20 bp, Artificial Sequence
  chemically synthesized
atttaacaggagtttagaag

SEQ ID NO: 462457 - DNA, 20 bp, Artificial Sequence
  chemically synthesized
cacatttaacaggagtttag

SEQ ID NO: 462458 - DNA, 20 bp, Artificial Sequence
  chemically synthesized
tatcacatttaacaggagtt

SEQ ID NO: 462459 - DNA, 20 bp, Artificial Sequence
  chemically synthesized
caaaatatcacatttaacag

SEQ ID NO: 462460 - DNA, 20 bp, Artificial Sequence
  chemically synthesized
gtcaaaatatcacatttaac

SEQ ID NO: 462461 - DNA, 20 bp, Artificial Sequence
  chemically synthesized
ggtcaaaatatcacatttaa

SEQ ID NO: 462462 - DNA, 20 bp, Artificial Sequence
  chemically synthesized
cattcatgattcatcggagg

SEQ ID NO: 462463 - DNA, 20 bp, Artificial Sequence
  chemically synthesized
acattcatgattcatcggag

SEQ ID NO: 462464 - DNA, 20 bp, Artificial Sequence
  chemically synthesized
taacattcatgattcatcgg

SEQ ID NO: 462465 - DNA, 20 bp, Artificial Sequence
  chemically synthesized
ataacattcatgattcatcg

SEQ ID NO: 462466 - DNA, 20 bp, Artificial Sequence
  chemically synthesized
taataacattcatgattcat

SEQ ID NO: 462467 - DNA, 20 bp, Artificial Sequence
  chemically synthesized
tgaatcatgaatgttattaa

SEQ ID NO: 462468 - DNA, 20 bp, Artificial Sequence
  chemically synthesized
tgaatgttattaatggcatc

SEQ ID NO: 462469 - DNA, 20 bp, Artificial Sequence
  chemically synthesized
gttattaatggcatctagaa

SEQ ID NO: 462470 - DNA, 20 bp, Artificial Sequence
  chemically synthesized
ctgtaaggaattcaccattc

SEQ ID NO: 462471 - DNA, 20 bp, Artificial Sequence
  chemically synthesized
ctagaatggtgaattcctta

SEQ ID NO: 462472 - DNA, 20 bp, Artificial Sequence
  chemically synthesized
gaatggtgaattccttacag

SEQ ID NO: 462473 - DNA, 20 bp, Artificial Sequence
  chemically synthesized
aatggtgaattccttacaga

SEQ ID NO: 462474 - DNA, 20 bp, Artificial Sequence
  chemically synthesized
gaaattgaaagccttctgta

SEQ ID NO: 462475 - DNA, 20 bp, Artificial Sequence
  chemically synthesized
ggaaattgaaagccttctgt

SEQ ID NO: 462476 - DNA, 20 bp, Artificial Sequence
  chemically synthesized
atatgagcaaaggaaattga

SEQ ID NO: 462477 - DNA, 20 bp, Artificial Sequence
  chemically synthesized
cttctgatggatatgagcaa

SEQ ID NO: 462478 - DNA, 20 bp, Artificial Sequence
  chemically synthesized
tcttctgatggatatgagca

SEQ ID NO: 462479 - DNA, 20 bp, Artificial Sequence
  chemically synthesized
ataaatcttctgatggatat

SEQ ID NO: 462480 - DNA, 20 bp, Artificial Sequence
  chemically synthesized
tttcctttgctcatatccat

SEQ ID NO: 462481 - DNA, 20 bp, Artificial Sequence
  chemically synthesized
cctttgctcatatccatcag

SEQ ID NO: 462482 - DNA, 20 bp, Artificial Sequence
  chemically synthesized
gtaaataataaatcttctga

SEQ ID NO: 462483 - DNA, 20 bp, Artificial Sequence
  chemically synthesized
atcagaagatttattattta

SEQ ID NO: 462484 - DNA, 20 bp, Artificial Sequence
  chemically synthesized
agaagatttattatttacag

SEQ ID NO: 462485 - DNA, 20 bp, Artificial Sequence
  chemically synthesized
aaatacatttagtaaggtta

SEQ ID NO: 462486 - DNA, 20 bp, Artificial Sequence
  chemically synthesized
tttaagaaatacatttagta

SEQ ID NO: 462487 - DNA, 20 bp, Artificial Sequence
  chemically synthesized
atttaagaaatacatttagt

SEQ ID NO: 462488 - DNA, 20 bp, Artificial Sequence
  chemically synthesized
cattatttaagaaatacatt

SEQ ID NO: 462489 - DNA, 20 bp, Artificial Sequence
  chemically synthesized
aaatgtatttcttaaataat

SEQ ID NO: 462490 - DNA, 20 bp, Artificial Sequence
  chemically synthesized
acatttatgtctcattattt

SEQ ID NO: 462491 - DNA, 20 bp, Artificial Sequence
  chemically synthesized
tagcccatgggtcaaagagt

SEQ ID NO: 462492 - DNA, 20 bp, Artificial Sequence
  chemically synthesized
tctgtagcccatgggtcaaa

SEQ ID NO: 462493 - DNA, 20 bp, Artificial Sequence
  chemically synthesized
tgaacttactctttgaccca

SEQ ID NO: 462494 - DNA, 20 bp, Artificial Sequence
  chemically synthesized
attctgtagcccatgggtca

SEQ ID NO: 462495 - DNA, 20 bp, Artificial Sequence
  chemically synthesized
gaacttactctttgacccat

SEQ ID NO: 462496 - DNA, 20 bp, Artificial Sequence
  chemically synthesized
acatccattctgtagcccat

SEQ ID NO: 462497 - DNA, 20 bp, Artificial Sequence
  chemically synthesized
actctttgacccatgggcta

SEQ ID NO: 462498 - DNA, 20 bp, Artificial Sequence
  chemically synthesized
aacatccattctgtagccca

SEQ ID NO: 462499 - DNA, 20 bp, Artificial Sequence
  chemically synthesized
ttgacccatgggctacagaa

SEQ ID NO: 462500 - DNA, 20 bp, Artificial Sequence
  chemically synthesized
ctaatataacatccattctg

SEQ ID NO: 462501 - DNA, 20 bp, Artificial Sequence
  chemically synthesized
ctacagaatggatgttatat

SEQ ID NO: 462502 - DNA, 20 bp, Artificial Sequence
  chemically synthesized
cagaatggatgttatattag

SEQ ID NO: 462503 - DNA, 20 bp, Artificial Sequence
  chemically synthesized
agaatggatgttatattagc

SEQ ID NO: 462504 - DNA, 20 bp, Artificial Sequence
  chemically synthesized
agcaggtatgaaaacaacat

SEQ ID NO: 462505 - DNA, 20 bp, Artificial Sequence
  chemically synthesized
ctcatttggagatgtacaag

SEQ ID NO: 462506 - DNA, 20 bp, Artificial Sequence
  chemically synthesized
agctcatttggagatgtaca

SEQ ID NO: 462507 - DNA, 20 bp, Artificial Sequence
  chemically synthesized
gagctcatttggagatgtac

SEQ ID NO: 462508 - DNA, 20 bp, Artificial Sequence
  chemically synthesized
ctccttgtacatctccaaat

SEQ ID NO: 462509 - DNA, 20 bp, Artificial Sequence
  chemically synthesized
gtcatccaagagctcatttg

SEQ ID NO: 462510 - DNA, 20 bp, Artificial Sequence
  chemically synthesized
tggtcatccaagagctcatt

SEQ ID NO: 462511 - DNA, 20 bp, Artificial Sequence
  chemically synthesized
tacatctccaaatgagctct

SEQ ID NO: 462512 - DNA, 20 bp, Artificial Sequence
  chemically synthesized
taatgtagctggtcatccaa

SEQ ID NO: 462513 - DNA, 20 bp, Artificial Sequence
  chemically synthesized
caaatgagctcttggatgac

SEQ ID NO: 462514 - DNA, 20 bp, Artificial Sequence
  chemically synthesized
aataatgtagctggtcatcc

SEQ ID NO: 462515 - DNA, 20 bp, Artificial Sequence
  chemically synthesized
ctgctcattaataatgtagc

SEQ ID NO: 462516 - DNA, 20 bp, Artificial Sequence
  chemically synthesized
attactgctcattaataatg

SEQ ID NO: 462517 - DNA, 20 bp, Artificial Sequence
  chemically synthesized
tgaccagctacattattaat

SEQ ID NO: 462518 - DNA, 20 bp, Artificial Sequence
  chemically synthesized
ccagctacattattaatgag

SEQ ID NO: 462519 - DNA, 20 bp, Artificial Sequence
  chemically synthesized
aaaaaaaaatatatttttct

SEQ ID NO: 462520 - DNA, 20 bp, Artificial Sequence
  chemically synthesized
aaatatatttttctgagcac

SEQ ID NO: 462521 - DNA, 20 bp, Artificial Sequence
  chemically synthesized
aatatatttttctgagcaca

SEQ ID NO: 462522 - DNA, 20 bp, Artificial Sequence
  chemically synthesized
cggggttgagaccttgtgct

SEQ ID NO: 462523 - DNA, 20 bp, Artificial Sequence
  chemically synthesized
tgagcacaaggtctcaaccc

SEQ ID NO: 462524 - DNA, 20 bp, Artificial Sequence
  chemically synthesized
gagcacaaggtctcaacccc

SEQ ID NO: 462525 - DNA, 20 bp, Artificial Sequence
  chemically synthesized
aatattttaagcccggggtt

SEQ ID NO: 462526 - DNA, 20 bp, Artificial Sequence
  chemically synthesized
tactgaatattttaagcccg

SEQ ID NO: 462527 - DNA, 20 bp, Artificial Sequence
  chemically synthesized
ttactgaatattttaagccc

SEQ ID NO: 462528 - DNA, 20 bp, Artificial Sequence
  chemically synthesized
tttactgaatattttaagcc

SEQ ID NO: 462529 - DNA, 20 bp, Artificial Sequence
  chemically synthesized
catgatttactgaatatttt

SEQ ID NO: 462530 - DNA, 20 bp, Artificial Sequence
  chemically synthesized
aaccccgggcttaaaatatt

SEQ ID NO: 462531 - DNA, 20 bp, Artificial Sequence
  chemically synthesized
tcagtaaatcatgctgtaaa

SEQ ID NO: 462532 - DNA, 20 bp, Artificial Sequence
  chemically synthesized
gatgagagcacatctgttta

SEQ ID NO: 462533 - DNA, 20 bp, Artificial Sequence
  chemically synthesized
taaacagatgtgctctcatc

SEQ ID NO: 462534 - DNA, 20 bp, Artificial Sequence
  chemically synthesized
aaacagatgtgctctcatcc

SEQ ID NO: 462535 - DNA, 20 bp, Artificial Sequence
  chemically synthesized
taacaataaagcctggatga

SEQ ID NO: 462536 - DNA, 20 bp, Artificial Sequence
  chemically synthesized
agtaacaataaagcctggat

SEQ ID NO: 462537 - DNA, 20 bp, Artificial Sequence
  chemically synthesized
ataaaagtaacaataaagcc

SEQ ID NO: 462538 - DNA, 20 bp, Artificial Sequence
  chemically synthesized
gctctataaaagtaacaata

SEQ ID NO: 462539 - DNA, 20 bp, Artificial Sequence
  chemically synthesized
aggctttattgttactttta

SEQ ID NO: 462540 - DNA, 20 bp, Artificial Sequence
  chemically synthesized
gctttattgttacttttata

SEQ ID NO: 462541 - DNA, 20 bp, Artificial Sequence
  chemically synthesized
acttagcctttgctctataa

SEQ ID NO: 462542 - DNA, 20 bp, Artificial Sequence
  chemically synthesized
attgttacttttatagagca

SEQ ID NO: 462543 - DNA, 20 bp, Artificial Sequence
  chemically synthesized
ttgttacttttatagagcaa

SEQ ID NO: 462544 - DNA, 20 bp, Artificial Sequence
  chemically synthesized
acttttatagagcaaaggct

SEQ ID NO: 462545 - DNA, 20 bp, Artificial Sequence
  chemically synthesized
agaattatgctaaatagact

SEQ ID NO: 462546 - DNA, 20 bp, Artificial Sequence
  chemically synthesized
gagcaaaggctaagtctatt

SEQ ID NO: 462547 - DNA, 20 bp, Artificial Sequence
  chemically synthesized
cccttaagaattatgctaaa

SEQ ID NO: 462548 - DNA, 20 bp, Artificial Sequence
  chemically synthesized
gtctatttagcataattctt

SEQ ID NO: 462549 - DNA, 20 bp, Artificial Sequence
  chemically synthesized
tctatttagcataattctta

SEQ ID NO: 462550 - DNA, 20 bp, Artificial Sequence
  chemically synthesized
ctatttagcataattcttaa

SEQ ID NO: 462551 - DNA, 20 bp, Artificial Sequence
  chemically synthesized
ctgaaaatcctagggccctt

SEQ ID NO: 462552 - DNA, 20 bp, Artificial Sequence
  chemically synthesized
agcataattcttaagggccc

SEQ ID NO: 462553 - DNA, 20 bp, Artificial Sequence
  chemically synthesized
gcataattcttaagggccct

SEQ ID NO: 462554 - DNA, 20 bp, Artificial Sequence
  chemically synthesized
ttaccattctgaaaatccta

SEQ ID NO: 462555 - DNA, 20 bp, Artificial Sequence
  chemically synthesized
tttaccattctgaaaatcct

SEQ ID NO: 462556 - DNA, 20 bp, Artificial Sequence
  chemically synthesized
cttaagggccctaggatttt

SEQ ID NO: 462557 - DNA, 20 bp, Artificial Sequence
  chemically synthesized
atttaccattctgaaaatcc

SEQ ID NO: 462558 - DNA, 20 bp, Artificial Sequence
  chemically synthesized
gggccctaggattttcagaa

SEQ ID NO: 462559 - DNA, 20 bp, Artificial Sequence
  chemically synthesized
ggattttcagaatggtaaat

SEQ ID NO: 462560 - DNA, 20 bp, Artificial Sequence
  chemically synthesized
atgagcattgcttcaactta

SEQ ID NO: 462561 - DNA, 20 bp, Artificial Sequence
  chemically synthesized
cagctggtgactttaagttg

SEQ ID NO: 462562 - DNA, 20 bp, Artificial Sequence
  chemically synthesized
ctaatgcagctggtgacttt

SEQ ID NO: 462563 - DNA, 20 bp, Artificial Sequence
  chemically synthesized
ttgcttcaacttaaagtcac

SEQ ID NO: 462564 - DNA, 20 bp, Artificial Sequence
  chemically synthesized
cttaaagtcaccagctgcat

SEQ ID NO: 462565 - DNA, 20 bp, Artificial Sequence
  chemically synthesized
ttgctagagtctaatgcagc

SEQ ID NO: 462566 - DNA, 20 bp, Artificial Sequence
  chemically synthesized
tcttttgctagagtctaatg

SEQ ID NO: 462567 - DNA, 20 bp, Artificial Sequence
  chemically synthesized
tcaccagctgcattagactc

SEQ ID NO: 462568 - DNA, 20 bp, Artificial Sequence
  chemically synthesized
gctgcattagactctagcaa

SEQ ID NO: 462569 - DNA, 20 bp, Artificial Sequence
  chemically synthesized
acagggtgattcttttgcta

SEQ ID NO: 462570 - DNA, 20 bp, Artificial Sequence
  chemically synthesized
ggacagggtgattcttttgc

SEQ ID NO: 462571 - DNA, 20 bp, Artificial Sequence
  chemically synthesized
cttcaaagcttcaaaggaca

SEQ ID NO: 462572 - DNA, 20 bp, Artificial Sequence
  chemically synthesized
gcttcaaagcttcaaaggac

SEQ ID NO: 462573 - DNA, 20 bp, Artificial Sequence
  chemically synthesized
aagaatcaccctgtcctttg

SEQ ID NO: 462574 - DNA, 20 bp, Artificial Sequence
  chemically synthesized
ggcttcaaagcttcaaagga

SEQ ID NO: 462575 - DNA, 20 bp, Artificial Sequence
  chemically synthesized
gcctggcttcaaagcttcaa

SEQ ID NO: 462576 - DNA, 20 bp, Artificial Sequence
  chemically synthesized
tgcctggcttcaaagcttca

SEQ ID NO: 462577 - DNA, 20 bp, Artificial Sequence
  chemically synthesized
ccctgtcctttgaagctttg

SEQ ID NO: 462578 - DNA, 20 bp, Artificial Sequence
  chemically synthesized
gtcctttgaagctttgaagc

SEQ ID NO: 462579 - DNA, 20 bp, Artificial Sequence
  chemically synthesized
tcctttgaagctttgaagcc

SEQ ID NO: 462580 - DNA, 20 bp, Artificial Sequence
  chemically synthesized
gaagtcaatgcctggcttca

SEQ ID NO: 462581 - DNA, 20 bp, Artificial Sequence
  chemically synthesized
agaaaggagaagtcaatgcc

SEQ ID NO: 462582 - DNA, 20 bp, Artificial Sequence
  chemically synthesized
ttttcatagctagaaaggag

SEQ ID NO: 462583 - DNA, 20 bp, Artificial Sequence
  chemically synthesized
aggcattgacttctcctttc

SEQ ID NO: 462584 - DNA, 20 bp, Artificial Sequence
  chemically synthesized
ggattttcatagctagaaag

SEQ ID NO: 462585 - DNA, 20 bp, Artificial Sequence
  chemically synthesized
taggattttcatagctagaa

SEQ ID NO: 462586 - DNA, 20 bp, Artificial Sequence
  chemically synthesized
ctaggattttcatagctaga

SEQ ID NO: 462587 - DNA, 20 bp, Artificial Sequence
  chemically synthesized
ccatctaggattttcatagc

SEQ ID NO: 462588 - DNA, 20 bp, Artificial Sequence
  chemically synthesized
gatgccatctaggattttca

SEQ ID NO: 462589 - DNA, 20 bp, Artificial Sequence
  chemically synthesized
ctttctagctatgaaaatcc

SEQ ID NO: 462590 - DNA, 20 bp, Artificial Sequence
  chemically synthesized
ctagctatgaaaatcctaga

SEQ ID NO: 462591 - DNA, 20 bp, Artificial Sequence
  chemically synthesized
atttgaagaagatgccatct

SEQ ID NO: 462592 - DNA, 20 bp, Artificial Sequence
  chemically synthesized
tatttgaagaagatgccatc

SEQ ID NO: 462593 - DNA, 20 bp, Artificial Sequence
  chemically synthesized
tagatggcatcttcttcaaa

SEQ ID NO: 462594 - DNA, 20 bp, Artificial Sequence
  chemically synthesized
aaatagccttctatttgaag

SEQ ID NO: 462595 - DNA, 20 bp, Artificial Sequence
  chemically synthesized
atggcatcttcttcaaatag

SEQ ID NO: 462596 - DNA, 20 bp, Artificial Sequence
  chemically synthesized
atgaaatagccttctatttg

SEQ ID NO: 462597 - DNA, 20 bp, Artificial Sequence
  chemically synthesized
tggcatcttcttcaaataga

SEQ ID NO: 462598 - DNA, 20 bp, Artificial Sequence
  chemically synthesized
gattttttatgtagatgaaa

SEQ ID NO: 462599 - DNA, 20 bp, Artificial Sequence
  chemically synthesized
taaatgacagattttttatg

SEQ ID NO: 462600 - DNA, 20 bp, Artificial Sequence
  chemically synthesized
tacataaaaaatctgtcatt

SEQ ID NO: 462601 - DNA, 20 bp, Artificial Sequence
  chemically synthesized
aaagtggttatactaaatga

SEQ ID NO: 462602 - DNA, 20 bp, Artificial Sequence
  chemically synthesized
gctaagatcattgataaaag

SEQ ID NO: 462603 - DNA, 20 bp, Artificial Sequence
  chemically synthesized
ctagctaagatcattgataa

SEQ ID NO: 462604 - DNA, 20 bp, Artificial Sequence
  chemically synthesized
accacttttatcaatgatct

SEQ ID NO: 462605 - DNA, 20 bp, Artificial Sequence
  chemically synthesized
cttttatcaatgatcttagc

SEQ ID NO: 462606 - DNA, 20 bp, Artificial Sequence
  chemically synthesized
gttatccagaagttctagct

SEQ ID NO: 462607 - DNA, 20 bp, Artificial Sequence
  chemically synthesized
atgatcttagctagaacttc

SEQ ID NO: 462608 - DNA, 20 bp, Artificial Sequence
  chemically synthesized
agcaagttatccagaagttc

SEQ ID NO: 462609 - DNA, 20 bp, Artificial Sequence
  chemically synthesized
agctgcagcaagttatccag

SEQ ID NO: 462610 - DNA, 20 bp, Artificial Sequence
  chemically synthesized
agaagctgcagcaagttatc

SEQ ID NO: 462611 - DNA, 20 bp, Artificial Sequence
  chemically synthesized
aacttctggataacttgctg

SEQ ID NO: 462612 - DNA, 20 bp, Artificial Sequence
  chemically synthesized
gcagttggagaagctgcagc

SEQ ID NO: 462613 - DNA, 20 bp, Artificial Sequence
  chemically synthesized
aagtgcagttggagaagctg

SEQ ID NO: 462614 - DNA, 20 bp, Artificial Sequence
  chemically synthesized
ggcagcaagtgcagttggag

SEQ ID NO: 462615 - DNA, 20 bp, Artificial Sequence
  chemically synthesized
tgaggcagcaagtgcagttg

SEQ ID NO: 462616 - DNA, 20 bp, Artificial Sequence
  chemically synthesized
ggtgaggcagcaagtgcagt

SEQ ID NO: 462617 - DNA, 20 bp, Artificial Sequence
  chemically synthesized
gcaaggtgaggcagcaagtg

SEQ ID NO: 462618 - DNA, 20 bp, Artificial Sequence
  chemically synthesized
aaagtgcaaggtgaggcagc

SEQ ID NO: 462619 - DNA, 20 bp, Artificial Sequence
  chemically synthesized
cataaaagtgcaaggtgagg

SEQ ID NO: 462620 - DNA, 20 bp, Artificial Sequence
  chemically synthesized
aaacataaaagtgcaaggtg

SEQ ID NO: 462621 - DNA, 20 bp, Artificial Sequence
  chemically synthesized
caaacataaaagtgcaaggt

SEQ ID NO: 462622 - DNA, 20 bp, Artificial Sequence
  chemically synthesized
cctccaaacataaaagtgca

SEQ ID NO: 462623 - DNA, 20 bp, Artificial Sequence
  chemically synthesized
acctccaaacataaaagtgc

SEQ ID NO: 462624 - DNA, 20 bp, Artificial Sequence
  chemically synthesized
tcaccttgcacttttatgtt

SEQ ID NO: 462625 - DNA, 20 bp, Artificial Sequence
  chemically synthesized
gaagccacctccaaacataa

SEQ ID NO: 462626 - DNA, 20 bp, Artificial Sequence
  chemically synthesized
accttgcacttttatgtttg

SEQ ID NO: 462627 - DNA, 20 bp, Artificial Sequence
  chemically synthesized
ccttgcacttttatgtttgg

SEQ ID NO: 462628 - DNA, 20 bp, Artificial Sequence
  chemically synthesized
tgcacttttatgtttggagg

SEQ ID NO: 462629 - DNA, 20 bp, Artificial Sequence
  chemically synthesized
tttatgaagtttaaggaaag

SEQ ID NO: 462630 - DNA, 20 bp, Artificial Sequence
  chemically synthesized
tggtttatgaagtttaagga

SEQ ID NO: 462631 - DNA, 20 bp, Artificial Sequence
  chemically synthesized
aagttggtttatgaagttta

SEQ ID NO: 462632 - DNA, 20 bp, Artificial Sequence
  chemically synthesized
gaagttggtttatgaagttt

SEQ ID NO: 462633 - DNA, 20 bp, Artificial Sequence
  chemically synthesized
ctagcagaagttggtttatg

SEQ ID NO: 462634 - DNA, 20 bp, Artificial Sequence
  chemically synthesized
agttggaagctagcagaagt

SEQ ID NO: 462635 - DNA, 20 bp, Artificial Sequence
  chemically synthesized
cttcataaaccaacttctgc

SEQ ID NO: 462636 - DNA, 20 bp, Artificial Sequence
  chemically synthesized
gaaaagttggaagctagcag

SEQ ID NO: 462637 - DNA, 20 bp, Artificial Sequence
  chemically synthesized
gaagaaaagttggaagctag

SEQ ID NO: 462638 - DNA, 20 bp, Artificial Sequence
  chemically synthesized
gcagaagaaaagttggaagc

SEQ ID NO: 462639 - DNA, 20 bp, Artificial Sequence
  chemically synthesized
agctgcagaagaaaagttgg

SEQ ID NO: 462640 - DNA, 20 bp, Artificial Sequence
  chemically synthesized
ggaagctgcagaagaaaagt

SEQ ID NO: 462641 - DNA, 20 bp, Artificial Sequence
  chemically synthesized
gtaaggaagctgcagaagaa

SEQ ID NO: 462642 - DNA, 20 bp, Artificial Sequence
  chemically synthesized
agcttccaacttttcttctg

SEQ ID NO: 462643 - DNA, 20 bp, Artificial Sequence
  chemically synthesized
gagaggtaaggaagctgcag

SEQ ID NO: 462644 - DNA, 20 bp, Artificial Sequence
  chemically synthesized
gctgagaggtaaggaagctg

SEQ ID NO: 462645 - DNA, 20 bp, Artificial Sequence
  chemically synthesized
acgaaggctgagaggtaagg

SEQ ID NO: 462646 - DNA, 20 bp, Artificial Sequence
  chemically synthesized
tctgcagcttccttacctct

SEQ ID NO: 462647 - DNA, 20 bp, Artificial Sequence
  chemically synthesized
tctacgaaggctgagaggta

SEQ ID NO: 462648 - DNA, 20 bp, Artificial Sequence
  chemically synthesized
ttctacgaaggctgagaggt

SEQ ID NO: 462649 - DNA, 20 bp, Artificial Sequence
  chemically synthesized
tcaattctacgaaggctgag

SEQ ID NO: 462650 - DNA, 20 bp, Artificial Sequence
  chemically synthesized
ttcaattctacgaaggctga

SEQ ID NO: 462651 - DNA, 20 bp, Artificial Sequence
  chemically synthesized
tcttcaattctacgaaggct

SEQ ID NO: 462652 - DNA, 20 bp, Artificial Sequence
  chemically synthesized
tccttacctctcagccttcg

SEQ ID NO: 462653 - DNA, 20 bp, Artificial Sequence
  chemically synthesized
aactctcttcaattctacga

SEQ ID NO: 462654 - DNA, 20 bp, Artificial Sequence
  chemically synthesized
caactctcttcaattctacg

SEQ ID NO: 462655 - DNA, 20 bp, Artificial Sequence
  chemically synthesized
tctcagccttcgtagaattg

SEQ ID NO: 462656 - DNA, 20 bp, Artificial Sequence
  chemically synthesized
tcagccttcgtagaattgaa

SEQ ID NO: 462657 - DNA, 20 bp, Artificial Sequence
  chemically synthesized
agccttcgtagaattgaaga

SEQ ID NO: 462658 - DNA, 20 bp, Artificial Sequence
  chemically synthesized
ttcgtagaattgaagagagt

SEQ ID NO: 462659 - DNA, 20 bp, Artificial Sequence
  chemically synthesized
tcgtagaattgaagagagtt

SEQ ID NO: 462660 - DNA, 20 bp, Artificial Sequence
  chemically synthesized
agagagttgggatcttcctc

SEQ ID NO: 462661 - DNA, 20 bp, Artificial Sequence
  chemically synthesized
accaagagctaatccagagg

SEQ ID NO: 462662 - DNA, 20 bp, Artificial Sequence
  chemically synthesized
gttgggatcttcctctggat

SEQ ID NO: 462663 - DNA, 20 bp, Artificial Sequence
  chemically synthesized
ttaaccaagagctaatccag

SEQ ID NO: 462664 - DNA, 20 bp, Artificial Sequence
  chemically synthesized
cttaaccaagagctaatcca

SEQ ID NO: 462665 - DNA, 20 bp, Artificial Sequence
  chemically synthesized
cccttaaccaagagctaatc

SEQ ID NO: 462666 - DNA, 20 bp, Artificial Sequence
  chemically synthesized
tcttcctctggattagctct

SEQ ID NO: 462667 - DNA, 20 bp, Artificial Sequence
  chemically synthesized
ctctggattagctcttggtt

SEQ ID NO: 462668 - DNA, 20 bp, Artificial Sequence
  chemically synthesized
tctggattagctcttggtta

SEQ ID NO: 462669 - DNA, 20 bp, Artificial Sequence
  chemically synthesized
cacaatattcccttaaccaa

SEQ ID NO: 462670 - DNA, 20 bp, Artificial Sequence
  chemically synthesized
ctggattagctcttggttaa

SEQ ID NO: 462671 - DNA, 20 bp, Artificial Sequence
  chemically synthesized
gccacaatattcccttaacc

SEQ ID NO: 462672 - DNA, 20 bp, Artificial Sequence
  chemically synthesized
tcttggttaagggaatattg

SEQ ID NO: 462673 - DNA, 20 bp, Artificial Sequence
  chemically synthesized
ggttaagggaatattgtggc

SEQ ID NO: 462674 - DNA, 20 bp, Artificial Sequence
  chemically synthesized
atggtctagacagatcaaac

SEQ ID NO: 462675 - DNA, 20 bp, Artificial Sequence
  chemically synthesized
tgtggctggtttgatctgtc

SEQ ID NO: 462676 - DNA, 20 bp, Artificial Sequence
  chemically synthesized
taaaatttaaatggtctaga

SEQ ID NO: 462677 - DNA, 20 bp, Artificial Sequence
  chemically synthesized
tggataaaatttaaatggtc

SEQ ID NO: 462678 - DNA, 20 bp, Artificial Sequence
  chemically synthesized
tgatatggataaaatttaaa

SEQ ID NO: 462679 - DNA, 20 bp, Artificial Sequence
  chemically synthesized
catttaaattttatccatat

SEQ ID NO: 462680 - DNA, 20 bp, Artificial Sequence
  chemically synthesized
ttaaattttatccatatcag

SEQ ID NO: 462681 - DNA, 20 bp, Artificial Sequence
  chemically synthesized
aagcagtcttactgctgata

SEQ ID NO: 462682 - DNA, 20 bp, Artificial Sequence
  chemically synthesized
attttatccatatcagcagt

SEQ ID NO: 462683 - DNA, 20 bp, Artificial Sequence
  chemically synthesized
tgaatgaaaagaaagcaaag

SEQ ID NO: 462684 - DNA, 20 bp, Artificial Sequence
  chemically synthesized
acatgaatgaaaagaaagca

SEQ ID NO: 462685 - DNA, 20 bp, Artificial Sequence
  chemically synthesized
tgcacacatgaatgaaaaga

SEQ ID NO: 462686 - DNA, 20 bp, Artificial Sequence
  chemically synthesized
cccatgcacacatgaatgaa

SEQ ID NO: 462687 - DNA, 20 bp, Artificial Sequence
  chemically synthesized
tcttttcattcatgtgtgca

SEQ ID NO: 462688 - DNA, 20 bp, Artificial Sequence
  chemically synthesized
cttttcattcatgtgtgcat

SEQ ID NO: 462689 - DNA, 20 bp, Artificial Sequence
  chemically synthesized
ttttcattcatgtgtgcatg

SEQ ID NO: 462690 - DNA, 20 bp, Artificial Sequence
  chemically synthesized
tttcattcatgtgtgcatgg

SEQ ID NO: 462691 - DNA, 20 bp, Artificial Sequence
  chemically synthesized
aaattattgaaggaaattaa

SEQ ID NO: 462692 - DNA, 20 bp, Artificial Sequence
  chemically synthesized
tgcaaaggaaaaattattga

SEQ ID NO: 462693 - DNA, 20 bp, Artificial Sequence
  chemically synthesized
atgcaaaggaaaaattattg

SEQ ID NO: 462694 - DNA, 20 bp, Artificial Sequence
  chemically synthesized
tagtcaaggtgtgaatgcaa

SEQ ID NO: 462695 - DNA, 20 bp, Artificial Sequence
  chemically synthesized
ttagtcaaggtgtgaatgca

SEQ ID NO: 462696 - DNA, 20 bp, Artificial Sequence
  chemically synthesized
ttgcaccagacagttagtca

SEQ ID NO: 462697 - DNA, 20 bp, Artificial Sequence
  chemically synthesized
cttgcaccagacagttagtc

SEQ ID NO: 462698 - DNA, 20 bp, Artificial Sequence
  chemically synthesized
tcacaccttgactaactgtc

SEQ ID NO: 462699 - DNA, 20 bp, Artificial Sequence
  chemically synthesized
ggcgtcttgcaccagacagt

SEQ ID NO: 462700 - DNA, 20 bp, Artificial Sequence
  chemically synthesized
tctaggcgtcttgcaccaga

SEQ ID NO: 462701 - DNA, 20 bp, Artificial Sequence
  chemically synthesized
cttgactaactgtctggtgc

SEQ ID NO: 462702 - DNA, 20 bp, Artificial Sequence
  chemically synthesized
gaaatctaggcgtcttgcac

SEQ ID NO: 462703 - DNA, 20 bp, Artificial Sequence
  chemically synthesized
actgtctggtgcaagacgcc

SEQ ID NO: 462704 - DNA, 20 bp, Artificial Sequence
  chemically synthesized
ggtgcaagacgcctagattt

SEQ ID NO: 462705 - DNA, 20 bp, Artificial Sequence
  chemically synthesized
gctgagttaggctgaaatct

SEQ ID NO: 462706 - DNA, 20 bp, Artificial Sequence
  chemically synthesized
agctgagttaggctgaaatc

SEQ ID NO: 462707 - DNA, 20 bp, Artificial Sequence
  chemically synthesized
gcctagatttcagcctaact

SEQ ID NO: 462708 - DNA, 20 bp, Artificial Sequence
  chemically synthesized
ggcatgtcaaaagctgagtt

SEQ ID NO: 462709 - DNA, 20 bp, Artificial Sequence
  chemically synthesized
gggcatgtcaaaagctgagt

SEQ ID NO: 462710 - DNA, 20 bp, Artificial Sequence
  chemically synthesized
aggagggcatgtcaaaagct

SEQ ID NO: 462711 - DNA, 20 bp, Artificial Sequence
  chemically synthesized
tagtgaggagggcatgtcaa

SEQ ID NO: 462712 - DNA, 20 bp, Artificial Sequence
  chemically synthesized
atgattatgtttagtgagga

SEQ ID NO: 462713 - DNA, 20 bp, Artificial Sequence
  chemically synthesized
gatgattatgtttagtgagg

SEQ ID NO: 462714 - DNA, 20 bp, Artificial Sequence
  chemically synthesized
agatgattatgtttagtgag

SEQ ID NO: 462715 - DNA, 20 bp, Artificial Sequence
  chemically synthesized
agagatgattatgtttagtg

SEQ ID NO: 462716 - DNA, 20 bp, Artificial Sequence
  chemically synthesized
tagagatgattatgtttagt

SEQ ID NO: 462717 - DNA, 20 bp, Artificial Sequence
  chemically synthesized
aagctagagatgattatgtt

SEQ ID NO: 462718 - DNA, 20 bp, Artificial Sequence
  chemically synthesized
tcactaaacataatcatctc

SEQ ID NO: 462719 - DNA, 20 bp, Artificial Sequence
  chemically synthesized
tcatcttaaatgaaaagcta

SEQ ID NO: 462720 - DNA, 20 bp, Artificial Sequence
  chemically synthesized
tctcatcttaaatgaaaagc

SEQ ID NO: 462721 - DNA, 20 bp, Artificial Sequence
  chemically synthesized
tcatctctagcttttcattt

SEQ ID NO: 462722 - DNA, 20 bp, Artificial Sequence
  chemically synthesized
catgtctcatcttaaatgaa

SEQ ID NO: 462723 - DNA, 20 bp, Artificial Sequence
  chemically synthesized
tctagcttttcatttaagat

SEQ ID NO: 462724 - DNA, 20 bp, Artificial Sequence
  chemically synthesized
tcatttaagatgagacatgt

SEQ ID NO: 462725 - DNA, 20 bp, Artificial Sequence
  chemically synthesized
aagtgttcaagtgaaaggaa

SEQ ID NO: 462726 - DNA, 20 bp, Artificial Sequence
  chemically synthesized
ctaagtgttcaagtgaaagg

SEQ ID NO: 462727 - DNA, 20 bp, Artificial Sequence
  chemically synthesized
tctctaagtgttcaagtgaa

SEQ ID NO: 462728 - DNA, 20 bp, Artificial Sequence
  chemically synthesized
gtctctaagtgttcaagtga

SEQ ID NO: 462729 - DNA, 20 bp, Artificial Sequence
  chemically synthesized
cttcctttcacttgaacact

SEQ ID NO: 462730 - DNA, 20 bp, Artificial Sequence
  chemically synthesized
acagtggtctctaagtgttc

SEQ ID NO: 462731 - DNA, 20 bp, Artificial Sequence
  chemically synthesized
tcctttcacttgaacactta

SEQ ID NO: 462732 - DNA, 20 bp, Artificial Sequence
  chemically synthesized
acaaccccacagtggtctct

SEQ ID NO: 462733 - DNA, 20 bp, Artificial Sequence
  chemically synthesized
tgaacacttagagaccactg

SEQ ID NO: 462734 - DNA, 20 bp, Artificial Sequence
  chemically synthesized
gaacacttagagaccactgt

SEQ ID NO: 462735 - DNA, 20 bp, Artificial Sequence
  chemically synthesized
aacacttagagaccactgtg

SEQ ID NO: 462736 - DNA, 20 bp, Artificial Sequence
  chemically synthesized
gccagttaacaaccccacag

SEQ ID NO: 462737 - DNA, 20 bp, Artificial Sequence
  chemically synthesized
gaagccagttaacaacccca

SEQ ID NO: 462738 - DNA, 20 bp, Artificial Sequence
  chemically synthesized
accactgtggggttgttaac

SEQ ID NO: 462739 - DNA, 20 bp, Artificial Sequence
  chemically synthesized
aaccaatattgaaatgaagc

SEQ ID NO: 462740 - DNA, 20 bp, Artificial Sequence
  chemically synthesized
gacaaaccaatattgaaatg

SEQ ID NO: 462741 - DNA, 20 bp, Artificial Sequence
  chemically synthesized
aactggcttcatttcaatat

SEQ ID NO: 462742 - DNA, 20 bp, Artificial Sequence
  chemically synthesized
atttcaatattggtttgtct

SEQ ID NO: 462743 - DNA, 20 bp, Artificial Sequence
  chemically synthesized
aatattggtttgtctcagaa

SEQ ID NO: 462744 - DNA, 20 bp, Artificial Sequence
  chemically synthesized
tccttggacctttctattct

SEQ ID NO: 462745 - DNA, 20 bp, Artificial Sequence
  chemically synthesized
ttggtttgtctcagaataga

SEQ ID NO: 462746 - DNA, 20 bp, Artificial Sequence
  chemically synthesized
tggtttgtctcagaatagaa

SEQ ID NO: 462747 - DNA, 20 bp, Artificial Sequence
  chemically synthesized
gtctcagaatagaaaggtcc

SEQ ID NO: 462748 - DNA, 20 bp, Artificial Sequence
  chemically synthesized
tctcagaatagaaaggtcca

SEQ ID NO: 462749 - DNA, 20 bp, Artificial Sequence
  chemically synthesized
tcagaatagaaaggtccaag

SEQ ID NO: 462750 - DNA, 20 bp, Artificial Sequence
  chemically synthesized
agaatagaaaggtccaagga

SEQ ID NO: 462751 - DNA, 20 bp, Artificial Sequence
  chemically synthesized
gaatagaaaggtccaaggag

SEQ ID NO: 462752 - DNA, 20 bp, Artificial Sequence
  chemically synthesized
aatagaaaggtccaaggaga

SEQ ID NO: 462753 - DNA, 20 bp, Artificial Sequence
  chemically synthesized
cacatctgtctccctctcct

SEQ ID NO: 462754 - DNA, 20 bp, Artificial Sequence
  chemically synthesized
tagaaaggtccaaggagagg

SEQ ID NO: 462755 - DNA, 20 bp, Artificial Sequence
  chemically synthesized
aaggtccaaggagagggaga

SEQ ID NO: 462756 - DNA, 20 bp, Artificial Sequence
  chemically synthesized
caaggagagggagacagatg

SEQ ID NO: 462757 - DNA, 20 bp, Artificial Sequence
  chemically synthesized
aaggagagggagacagatgt

SEQ ID NO: 462758 - DNA, 20 bp, Artificial Sequence
  chemically synthesized
aggagagggagacagatgtg

SEQ ID NO: 462759 - DNA, 20 bp, Artificial Sequence
  chemically synthesized
ggagagggagacagatgtgg

SEQ ID NO: 462760 - DNA, 20 bp, Artificial Sequence
  chemically synthesized
gagagggagacagatgtggg

SEQ ID NO: 462761 - DNA, 20 bp, Artificial Sequence
  chemically synthesized
agagggagacagatgtgggg

SEQ ID NO: 462762 - DNA, 20 bp, Artificial Sequence
  chemically synthesized
gggagacagatgtggggggg

SEQ ID NO: 462763 - DNA, 20 bp, Artificial Sequence
  chemically synthesized
ggagacagatgtgggggggt

SEQ ID NO: 462764 - DNA, 20 bp, Artificial Sequence
  chemically synthesized
gagacagatgtgggggggtg

SEQ ID NO: 462765 - DNA, 20 bp, Artificial Sequence
  chemically synthesized
agacagatgtgggggggtgg

SEQ ID NO: 462766 - DNA, 20 bp, Artificial Sequence
  chemically synthesized
cagatgtgggggggtggggg

SEQ ID NO: 462767 - DNA, 20 bp, Artificial Sequence
  chemically synthesized
tgtgggggggtgggggtggc

SEQ ID NO: 462768 - DNA, 20 bp, Artificial Sequence
  chemically synthesized
ggggggtgggggtggccggt

SEQ ID NO: 462769 - DNA, 20 bp, Artificial Sequence
  chemically synthesized
gggtgggggtggccggttgg

SEQ ID NO: 462770 - DNA, 20 bp, Artificial Sequence
  chemically synthesized
gtgggggtggccggttggta

SEQ ID NO: 462771 - DNA, 20 bp, Artificial Sequence
  chemically synthesized
gttctgagtgctctaccaac

SEQ ID NO: 462772 - DNA, 20 bp, Artificial Sequence
  chemically synthesized
tggccggttggtagagcact

SEQ ID NO: 462773 - DNA, 20 bp, Artificial Sequence
  chemically synthesized
atcaatgttgtgtgtgttct

SEQ ID NO: 462774 - DNA, 20 bp, Artificial Sequence
  chemically synthesized
gaacacacacaacattgatt

SEQ ID NO: 462775 - DNA, 20 bp, Artificial Sequence
  chemically synthesized
attaagtttgttatttcata

SEQ ID NO: 462776 - DNA, 20 bp, Artificial Sequence
  chemically synthesized
ttaagtttgttatttcatat

SEQ ID NO: 462777 - DNA, 20 bp, Artificial Sequence
  chemically synthesized
gtcatttttgggggcaacat

SEQ ID NO: 462778 - DNA, 20 bp, Artificial Sequence
  chemically synthesized
gttactattgtcatttttgg

SEQ ID NO: 462779 - DNA, 20 bp, Artificial Sequence
  chemically synthesized
agttactattgtcatttttg

SEQ ID NO: 462780 - DNA, 20 bp, Artificial Sequence
  chemically synthesized
aagttactattgtcattttt

SEQ ID NO: 462781 - DNA, 20 bp, Artificial Sequence
  chemically synthesized
gaagttactattgtcatttt

SEQ ID NO: 462782 - DNA, 20 bp, Artificial Sequence
  chemically synthesized
gttgcccccaaaaatgacaa

SEQ ID NO: 462783 - DNA, 20 bp, Artificial Sequence
  chemically synthesized
aaatgacaatagtaacttca

SEQ ID NO: 462784 - DNA, 20 bp, Artificial Sequence
  chemically synthesized
tctatgatcaatgatctttg

SEQ ID NO: 462785 - DNA, 20 bp, Artificial Sequence
  chemically synthesized
acttcaaagatcattgatca

SEQ ID NO: 462786 - DNA, 20 bp, Artificial Sequence
  chemically synthesized
agatcattgatcatagatca

SEQ ID NO: 462787 - DNA, 20 bp, Artificial Sequence
  chemically synthesized
ccacactgaaagaatatatg

SEQ ID NO: 462788 - DNA, 20 bp, Artificial Sequence
  chemically synthesized
agccacactgaaagaatata

SEQ ID NO: 462789 - DNA, 20 bp, Artificial Sequence
  chemically synthesized
tagatctccatatattcttt

SEQ ID NO: 462790 - DNA, 20 bp, Artificial Sequence
  chemically synthesized
ctccatatattctttcagtg

SEQ ID NO: 462791 - DNA, 20 bp, Artificial Sequence
  chemically synthesized
gagtacaaaagccacactga

SEQ ID NO: 462792 - DNA, 20 bp, Artificial Sequence
  chemically synthesized
tgacactggttagagtacaa

SEQ ID NO: 462793 - DNA, 20 bp, Artificial Sequence
  chemically synthesized
tgtggcttttgtactctaac

SEQ ID NO: 462794 - DNA, 20 bp, Artificial Sequence
  chemically synthesized
caacaagctgacactggtta

SEQ ID NO: 462795 - DNA, 20 bp, Artificial Sequence
  chemically synthesized
ctcaacaagctgacactggt

SEQ ID NO: 462796 - DNA, 20 bp, Artificial Sequence
  chemically synthesized
ttttgtactctaaccagtgt

SEQ ID NO: 462797 - DNA, 20 bp, Artificial Sequence
  chemically synthesized
tgccctcaacaagctgacac

SEQ ID NO: 462798 - DNA, 20 bp, Artificial Sequence
  chemically synthesized
ctaaccagtgtcagcttgtt

SEQ ID NO: 462799 - DNA, 20 bp, Artificial Sequence
  chemically synthesized
taaccagtgtcagcttgttg

SEQ ID NO: 462800 - DNA, 20 bp, Artificial Sequence
  chemically synthesized
aaccagtgtcagcttgttga

SEQ ID NO: 462801 - DNA, 20 bp, Artificial Sequence
  chemically synthesized
aaatgatttctgccctcaac

SEQ ID NO: 462802 - DNA, 20 bp, Artificial Sequence
  chemically synthesized
cagtgtcagcttgttgaggg

SEQ ID NO: 462803 - DNA, 20 bp, Artificial Sequence
  chemically synthesized
gaaagcatagaaagattaat

SEQ ID NO: 462804 - DNA, 20 bp, Artificial Sequence
  chemically synthesized
agtaacactgaaagcataga

SEQ ID NO: 462805 - DNA, 20 bp, Artificial Sequence
  chemically synthesized
gattaatctttctatgcttt

SEQ ID NO: 462806 - DNA, 20 bp, Artificial Sequence
  chemically synthesized
acttagtaacactgaaagca

SEQ ID NO: 462807 - DNA, 20 bp, Artificial Sequence
  chemically synthesized
cattcacttagtaacactga

SEQ ID NO: 462808 - DNA, 20 bp, Artificial Sequence
  chemically synthesized
tctatgctttcagtgttact

SEQ ID NO: 462809 - DNA, 20 bp, Artificial Sequence
  chemically synthesized
cagttcaaatatcattcact

SEQ ID NO: 462810 - DNA, 20 bp, Artificial Sequence
  chemically synthesized
cacatttcatcacatttttg

SEQ ID NO: 462811 - DNA, 20 bp, Artificial Sequence
  chemically synthesized
caaaaatgtgatgaaatgtg

SEQ ID NO: 462812 - DNA, 20 bp, Artificial Sequence
  chemically synthesized
gatgaaatgtgaagatatga

SEQ ID NO: 462813 - DNA, 20 bp, Artificial Sequence
  chemically synthesized
aaatgtgaagatatgacagt

SEQ ID NO: 462814 - DNA, 20 bp, Artificial Sequence
  chemically synthesized
tgaagatatgacagtgagtc

SEQ ID NO: 462815 - DNA, 20 bp, Artificial Sequence
  chemically synthesized
gatatgacagtgagtcaaga

SEQ ID NO: 462816 - DNA, 20 bp, Artificial Sequence
  chemically synthesized
atgacagtgagtcaagaaag

SEQ ID NO: 462817 - DNA, 20 bp, Artificial Sequence
  chemically synthesized
gtcaagaaagaagatacctc

SEQ ID NO: 462818 - DNA, 20 bp, Artificial Sequence
  chemically synthesized
tcaagaaagaagatacctct

SEQ ID NO: 462819 - DNA, 20 bp, Artificial Sequence
  chemically synthesized
gtttcatgaataaagcccag

SEQ ID NO: 462820 - DNA, 20 bp, Artificial Sequence
  chemically synthesized
tgtttcatgaataaagccca

SEQ ID NO: 462821 - DNA, 20 bp, Artificial Sequence
  chemically synthesized
gctgtttcatgaataaagcc

SEQ ID NO: 462822 - DNA, 20 bp, Artificial Sequence
  chemically synthesized
tctctgctgtttcatgaata

SEQ ID NO: 462823 - DNA, 20 bp, Artificial Sequence
  chemically synthesized
tctgggctttattcatgaaa

SEQ ID NO: 462824 - DNA, 20 bp, Artificial Sequence
  chemically synthesized
gggctttattcatgaaacag

SEQ ID NO: 462825 - DNA, 20 bp, Artificial Sequence
  chemically synthesized
gctttattcatgaaacagca

SEQ ID NO: 462826 - DNA, 20 bp, Artificial Sequence
  chemically synthesized
tgaaacagcagagatataaa

SEQ ID NO: 462827 - DNA, 20 bp, Artificial Sequence
  chemically synthesized
ttcaaccaatttatatgtta

SEQ ID NO: 462828 - DNA, 20 bp, Artificial Sequence
  chemically synthesized
aatagctttaacatataaat

SEQ ID NO: 462829 - DNA, 20 bp, Artificial Sequence
  chemically synthesized
ttaacatataaattggttga

SEQ ID NO: 462830 - DNA, 20 bp, Artificial Sequence
  chemically synthesized
catataaattggttgaaagt

SEQ ID NO: 462831 - DNA, 20 bp, Artificial Sequence
  chemically synthesized
aattggttgaaagtaagtta

SEQ ID NO: 462832 - DNA, 20 bp, Artificial Sequence
  chemically synthesized
aaagcaaaatccctatgcta

SEQ ID NO: 462833 - DNA, 20 bp, Artificial Sequence
  chemically synthesized
tattataactctttagcata

SEQ ID NO: 462834 - DNA, 20 bp, Artificial Sequence
  chemically synthesized
gtattataactctttagcat

SEQ ID NO: 462835 - DNA, 20 bp, Artificial Sequence
  chemically synthesized
agcaaaatccctatgctaaa

SEQ ID NO: 462836 - DNA, 20 bp, Artificial Sequence
  chemically synthesized
agtattataactctttagca

SEQ ID NO: 462837 - DNA, 20 bp, Artificial Sequence
  chemically synthesized
tagacagtattataactctt

SEQ ID NO: 462838 - DNA, 20 bp, Artificial Sequence
  chemically synthesized
catatttacatcacaataga

SEQ ID NO: 462839 - DNA, 20 bp, Artificial Sequence
  chemically synthesized
ctatcatatttacatcacaa

SEQ ID NO: 462840 - DNA, 20 bp, Artificial Sequence
  chemically synthesized
ctattgtgatgtaaatatga

SEQ ID NO: 462841 - DNA, 20 bp, Artificial Sequence
  chemically synthesized
aatatgatagttgaattcat

SEQ ID NO: 462842 - DNA, 20 bp, Artificial Sequence
  chemically synthesized
attcataagaaatttttcaa

SEQ ID NO: 462843 - DNA, 20 bp, Artificial Sequence
  chemically synthesized
aaatttttcaatggcaaaat

SEQ ID NO: 462844 - DNA, 20 bp, Artificial Sequence
  chemically synthesized
aatttttcaatggcaaaatg

SEQ ID NO: 462845 - DNA, 20 bp, Artificial Sequence
  chemically synthesized
ttcaatggcaaaatgaggct

SEQ ID NO: 462846 - DNA, 20 bp, Artificial Sequence
  chemically synthesized
gcaaaatgaggcttggtgat

SEQ ID NO: 462847 - DNA, 20 bp, Artificial Sequence
  chemically synthesized
gagatgataatctcatcacc

SEQ ID NO: 462848 - DNA, 20 bp, Artificial Sequence
  chemically synthesized
gtgatgagattatcatctct

SEQ ID NO: 462849 - DNA, 20 bp, Artificial Sequence
  chemically synthesized
cttaagactgaattttctta

SEQ ID NO: 462850 - DNA, 20 bp, Artificial Sequence
  chemically synthesized
tacttaagactgaattttct

SEQ ID NO: 462851 - DNA, 20 bp, Artificial Sequence
  chemically synthesized
ttatcatctctaagaaaatt

SEQ ID NO: 462852 - DNA, 20 bp, Artificial Sequence
  chemically synthesized
ctctaagaaaattcagtctt

SEQ ID NO: 462853 - DNA, 20 bp, Artificial Sequence
  chemically synthesized
aacgacataaagtaatactt

SEQ ID NO: 462854 - DNA, 20 bp, Artificial Sequence
  chemically synthesized
gggagaataaaaacgacata

SEQ ID NO: 462855 - DNA, 20 bp, Artificial Sequence
  chemically synthesized
gtcgtttttattctccctga

SEQ ID NO: 462856 - DNA, 20 bp, Artificial Sequence
  chemically synthesized
tgtttgaggccactttcagg

SEQ ID NO: 462857 - DNA, 20 bp, Artificial Sequence
  chemically synthesized
gtttttattctccctgaaag

SEQ ID NO: 462858 - DNA, 20 bp, Artificial Sequence
  chemically synthesized
aatgtttgaggccactttca

SEQ ID NO: 462859 - DNA, 20 bp, Artificial Sequence
  chemically synthesized
gaatgtttgaggccactttc

SEQ ID NO: 462860 - DNA, 20 bp, Artificial Sequence
  chemically synthesized
agaatgtttgaggccacttt

SEQ ID NO: 462861 - DNA, 20 bp, Artificial Sequence
  chemically synthesized
tgatgaagatagaatgtttg

SEQ ID NO: 462862 - DNA, 20 bp, Artificial Sequence
  chemically synthesized
ttgatgaagatagaatgttt

SEQ ID NO: 462863 - DNA, 20 bp, Artificial Sequence
  chemically synthesized
aaggataatgttgatgaaga

SEQ ID NO: 462864 - DNA, 20 bp, Artificial Sequence
  chemically synthesized
tggtaaggataatgttgatg

SEQ ID NO: 462865 - DNA, 20 bp, Artificial Sequence
  chemically synthesized
catcaacattatccttacca

SEQ ID NO: 462866 - DNA, 20 bp, Artificial Sequence
  chemically synthesized
gtgtaagtagcactgtggta

SEQ ID NO: 462867 - DNA, 20 bp, Artificial Sequence
  chemically synthesized
tgtgtaagtagcactgtggt

SEQ ID NO: 462868 - DNA, 20 bp, Artificial Sequence
  chemically synthesized
aaaatgtgtaagtagcactg

SEQ ID NO: 462869 - DNA, 20 bp, Artificial Sequence
  chemically synthesized
aaattgggaaaatgtgtaag

SEQ ID NO: 462870 - DNA, 20 bp, Artificial Sequence
  chemically synthesized
gataaattgggaaaatgtgt

SEQ ID NO: 462871 - DNA, 20 bp, Artificial Sequence
  chemically synthesized
atgacagctggtgataaatt

SEQ ID NO: 462872 - DNA, 20 bp, Artificial Sequence
  chemically synthesized
catgacagctggtgataaat

SEQ ID NO: 462873 - DNA, 20 bp, Artificial Sequence
  chemically synthesized
acattttcccaatttatcac

SEQ ID NO: 462874 - DNA, 20 bp, Artificial Sequence
  chemically synthesized
tctgggttttgcatgacagc

SEQ ID NO: 462875 - DNA, 20 bp, Artificial Sequence
  chemically synthesized
ttgttctgggttttgcatga

SEQ ID NO: 462876 - DNA, 20 bp, Artificial Sequence
  chemically synthesized
accagctgtcatgcaaaacc

SEQ ID NO: 462877 - DNA, 20 bp, Artificial Sequence
  chemically synthesized
gtcatgcaaaacccagaaca

SEQ ID NO: 462878 - DNA, 20 bp, Artificial Sequence
  chemically synthesized
tggctaagtggctttgttct

SEQ ID NO: 462879 - DNA, 20 bp, Artificial Sequence
  chemically synthesized
ttggctaagtggctttgttc

SEQ ID NO: 462880 - DNA, 20 bp, Artificial Sequence
  chemically synthesized
aaacccagaacaaagccact

SEQ ID NO: 462881 - DNA, 20 bp, Artificial Sequence
  chemically synthesized
aaacatgtgctttggctaag

SEQ ID NO: 462882 - DNA, 20 bp, Artificial Sequence
  chemically synthesized
agaacaaagccacttagcca

SEQ ID NO: 462883 - DNA, 20 bp, Artificial Sequence
  chemically synthesized
gtcaaacatgtgctttggct

SEQ ID NO: 462884 - DNA, 20 bp, Artificial Sequence
  chemically synthesized
tcatagtcaaacatgtgctt

SEQ ID NO: 462885 - DNA, 20 bp, Artificial Sequence
  chemically synthesized
gcacatgtttgactatgaat

SEQ ID NO: 462886 - DNA, 20 bp, Artificial Sequence
  chemically synthesized
aaaagaagaagtctaattca

SEQ ID NO: 462887 - DNA, 20 bp, Artificial Sequence
  chemically synthesized
acctttgttttaaaaagaag

SEQ ID NO: 462888 - DNA, 20 bp, Artificial Sequence
  chemically synthesized
aatacctttgttttaaaaag

SEQ ID NO: 462889 - DNA, 20 bp, Artificial Sequence
  chemically synthesized
aataatacctttgttttaaa

SEQ ID NO: 462890 - DNA, 20 bp, Artificial Sequence
  chemically synthesized
gacttcttctttttaaaaca

SEQ ID NO: 462891 - DNA, 20 bp, Artificial Sequence
  chemically synthesized
acttcttctttttaaaacaa

SEQ ID NO: 462892 - DNA, 20 bp, Artificial Sequence
  chemically synthesized
agatggaagccagcatcaat

SEQ ID NO: 462893 - DNA, 20 bp, Artificial Sequence
  chemically synthesized
ttatttaaacctattgatgc

SEQ ID NO: 462894 - DNA, 20 bp, Artificial Sequence
  chemically synthesized
aagatggaagccagcatcaa

SEQ ID NO: 462895 - DNA, 20 bp, Artificial Sequence
  chemically synthesized
tatgggcttaagatggaagc

SEQ ID NO: 462896 - DNA, 20 bp, Artificial Sequence
  chemically synthesized
ttgatgctggcttccatctt

SEQ ID NO: 462897 - DNA, 20 bp, Artificial Sequence
  chemically synthesized
cagttatgggcttaagatgg

SEQ ID NO: 462898 - DNA, 20 bp, Artificial Sequence
  chemically synthesized
tgccagttatgggcttaaga

SEQ ID NO: 462899 - DNA, 20 bp, Artificial Sequence
  chemically synthesized
tggttgccagttatgggctt

SEQ ID NO: 462900 - DNA, 20 bp, Artificial Sequence
  chemically synthesized
ttccatcttaagcccataac

SEQ ID NO: 462901 - DNA, 20 bp, Artificial Sequence
  chemically synthesized
acctgttggttgccagttat

SEQ ID NO: 462902 - DNA, 20 bp, Artificial Sequence
  chemically synthesized
aacctgttggttgccagtta

SEQ ID NO: 462903 - DNA, 20 bp, Artificial Sequence
  chemically synthesized
ttttctaacctgttggttgc

SEQ ID NO: 462904 - DNA, 20 bp, Artificial Sequence
  chemically synthesized
agcccataactggcaaccaa

SEQ ID NO: 462905 - DNA, 20 bp, Artificial Sequence
  chemically synthesized
gcccataactggcaaccaac

SEQ ID NO: 462906 - DNA, 20 bp, Artificial Sequence
  chemically synthesized
ataactggcaaccaacaggt

SEQ ID NO: 462907 - DNA, 20 bp, Artificial Sequence
  chemically synthesized
aattttattttctaacctgt

SEQ ID NO: 462908 - DNA, 20 bp, Artificial Sequence
  chemically synthesized
aatttcctaatcaattaatt

SEQ ID NO: 462909 - DNA, 20 bp, Artificial Sequence
  chemically synthesized
taatttcctaatcaattaat

SEQ ID NO: 462910 - DNA, 20 bp, Artificial Sequence
  chemically synthesized
aaatttcctaattaattgat

SEQ ID NO: 462911 - DNA, 20 bp, Artificial Sequence
  chemically synthesized
aatttcctaattaattgatt

SEQ ID NO: 462912 - DNA, 20 bp, Artificial Sequence
  chemically synthesized
gtattagatgtaacaaaaat

SEQ ID NO: 462913 - DNA, 20 bp, Artificial Sequence
  chemically synthesized
atttttgttacatctaatac

SEQ ID NO: 462914 - DNA, 20 bp, Artificial Sequence
  chemically synthesized
acaatacatccaaccagtat

SEQ ID NO: 462915 - DNA, 20 bp, Artificial Sequence
  chemically synthesized
ttgttacatctaatactggt

SEQ ID NO: 462916 - DNA, 20 bp, Artificial Sequence
  chemically synthesized
gatgtaacaatacatccaac

SEQ ID NO: 462917 - DNA, 20 bp, Artificial Sequence
  chemically synthesized
caagttttcacaaacagtat

SEQ ID NO: 462918 - DNA, 20 bp, Artificial Sequence
  chemically synthesized
acagcacaagttttcacaaa

SEQ ID NO: 462919 - DNA, 20 bp, Artificial Sequence
  chemically synthesized
tttgtgaaaacttgtgctgt

SEQ ID NO: 462920 - DNA, 20 bp, Artificial Sequence
  chemically synthesized
cacaacaagtccaacagcac

SEQ ID NO: 462921 - DNA, 20 bp, Artificial Sequence
  chemically synthesized
aacaagcacaacaagtccaa

SEQ ID NO: 462922 - DNA, 20 bp, Artificial Sequence
  chemically synthesized
ctgagtacaacaagcacaac

SEQ ID NO: 462923 - DNA, 20 bp, Artificial Sequence
  chemically synthesized
taagcaagactgagtacaac

SEQ ID NO: 462924 - DNA, 20 bp, Artificial Sequence
  chemically synthesized
cttgttgtgcttgttgtact

SEQ ID NO: 462925 - DNA, 20 bp, Artificial Sequence
  chemically synthesized
ttcacaaattaagcaagact

SEQ ID NO: 462926 - DNA, 20 bp, Artificial Sequence
  chemically synthesized
gatgctttcacaaattaagc

SEQ ID NO: 462927 - DNA, 20 bp, Artificial Sequence
  chemically synthesized
gtgtgatgctttcacaaatt

SEQ ID NO: 462928 - DNA, 20 bp, Artificial Sequence
  chemically synthesized
cagtcttgcttaatttgtga

SEQ ID NO: 462929 - DNA, 20 bp, Artificial Sequence
  chemically synthesized
gtgaaagcatcacacattta

SEQ ID NO: 462930 - DNA, 20 bp, Artificial Sequence
  chemically synthesized
aaagcatcacacatttaaag

SEQ ID NO: 462931 - DNA, 20 bp, Artificial Sequence
  chemically synthesized
acacatttaaagtagcccat

SEQ ID NO: 462932 - DNA, 20 bp, Artificial Sequence
  chemically synthesized
tcagctagaaagcagctaat

SEQ ID NO: 462933 - DNA, 20 bp, Artificial Sequence
  chemically synthesized
ctcagctagaaagcagctaa

SEQ ID NO: 462934 - DNA, 20 bp, Artificial Sequence
  chemically synthesized
gtagcccattagctgctttc

SEQ ID NO: 462935 - DNA, 20 bp, Artificial Sequence
  chemically synthesized
actcatcctcagctagaaag

SEQ ID NO: 462936 - DNA, 20 bp, Artificial Sequence
  chemically synthesized
ccattagctgctttctagct

SEQ ID NO: 462937 - DNA, 20 bp, Artificial Sequence
  chemically synthesized
cctactcatcctcagctaga

SEQ ID NO: 462938 - DNA, 20 bp, Artificial Sequence
  chemically synthesized
cattagctgctttctagctg

SEQ ID NO: 462939 - DNA, 20 bp, Artificial Sequence
  chemically synthesized
tttacctactcatcctcagc

SEQ ID NO: 462940 - DNA, 20 bp, Artificial Sequence
  chemically synthesized
gctgctttctagctgaggat

SEQ ID NO: 462941 - DNA, 20 bp, Artificial Sequence
  chemically synthesized
tgtctttacctactcatcct

SEQ ID NO: 462942 - DNA, 20 bp, Artificial Sequence
  chemically synthesized
gctttctagctgaggatgag

SEQ ID NO: 462943 - DNA, 20 bp, Artificial Sequence
  chemically synthesized
ctttctagctgaggatgagt

SEQ ID NO: 462944 - DNA, 20 bp, Artificial Sequence
  chemically synthesized
tagctgaggatgagtaggta

SEQ ID NO: 462945 - DNA, 20 bp, Artificial Sequence
  chemically synthesized
gacaattatttctacatttg

SEQ ID NO: 462946 - DNA, 20 bp, Artificial Sequence
  chemically synthesized
actacttccaactacaaatg

SEQ ID NO: 462947 - DNA, 20 bp, Artificial Sequence
  chemically synthesized
attatttctacatttgtagt

SEQ ID NO: 462948 - DNA, 20 bp, Artificial Sequence
  chemically synthesized
atttctacatttgtagttgg

SEQ ID NO: 462949 - DNA, 20 bp, Artificial Sequence
  chemically synthesized
tctacatttgtagttggaag

SEQ ID NO: 462950 - DNA, 20 bp, Artificial Sequence
  chemically synthesized
tttgtagttggaagtagtcg

SEQ ID NO: 462951 - DNA, 20 bp, Artificial Sequence
  chemically synthesized
gtcgtagatattatctaatt

SEQ ID NO: 462952 - DNA, 20 bp, Artificial Sequence
  chemically synthesized
gtagatattatctaattcag

SEQ ID NO: 462953 - DNA, 20 bp, Artificial Sequence
  chemically synthesized
cttgaagaaagccactgaat

SEQ ID NO: 462954 - DNA, 20 bp, Artificial Sequence
  chemically synthesized
ctaattcagtggctttcttc

SEQ ID NO: 462955 - DNA, 20 bp, Artificial Sequence
  chemically synthesized
gaaaactgagatcttgaaga

SEQ ID NO: 462956 - DNA, 20 bp, Artificial Sequence
  chemically synthesized
tgtagaaaactgagatcttg

SEQ ID NO: 462957 - DNA, 20 bp, Artificial Sequence
  chemically synthesized
agtggctttcttcaagatct

SEQ ID NO: 462958 - DNA, 20 bp, Artificial Sequence
  chemically synthesized
agacacagctgtagaaaact

SEQ ID NO: 462959 - DNA, 20 bp, Artificial Sequence
  chemically synthesized
ttcaagatctcagttttcta

SEQ ID NO: 462960 - DNA, 20 bp, Artificial Sequence
  chemically synthesized
taaccccatagacacagctg

SEQ ID NO: 462961 - DNA, 20 bp, Artificial Sequence
  chemically synthesized
gttttctacagctgtgtcta

SEQ ID NO: 462962 - DNA, 20 bp, Artificial Sequence
  chemically synthesized
ttttctacagctgtgtctat

SEQ ID NO: 462963 - DNA, 20 bp, Artificial Sequence
  chemically synthesized
accctataaccccatagaca

SEQ ID NO: 462964 - DNA, 20 bp, Artificial Sequence
  chemically synthesized
tttctacagctgtgtctatg

SEQ ID NO: 462965 - DNA, 20 bp, Artificial Sequence
  chemically synthesized
actttcaccctataacccca

SEQ ID NO: 462966 - DNA, 20 bp, Artificial Sequence
  chemically synthesized
cagctgtgtctatggggtta

SEQ ID NO: 462967 - DNA, 20 bp, Artificial Sequence
  chemically synthesized
agctgtgtctatggggttat

SEQ ID NO: 462968 - DNA, 20 bp, Artificial Sequence
  chemically synthesized
gctgtgtctatggggttata

SEQ ID NO: 462969 - DNA, 20 bp, Artificial Sequence
  chemically synthesized
tctatggggttatagggtga

SEQ ID NO: 462970 - DNA, 20 bp, Artificial Sequence
  chemically synthesized
tggggttatagggtgaaagt

SEQ ID NO: 462971 - DNA, 20 bp, Artificial Sequence
  chemically synthesized
agggtgaaagttggaataaa

SEQ ID NO: 462972 - DNA, 20 bp, Artificial Sequence
  chemically synthesized
gtgaaagttggaataaatgg

SEQ ID NO: 462973 - DNA, 20 bp, Artificial Sequence
  chemically synthesized
acatcttgaatgaaaacaag

SEQ ID NO: 462974 - DNA, 20 bp, Artificial Sequence
  chemically synthesized
gacatcttgaatgaaaacaa

SEQ ID NO: 462975 - DNA, 20 bp, Artificial Sequence
  chemically synthesized
tagacatcttgaatgaaaac

SEQ ID NO: 462976 - DNA, 20 bp, Artificial Sequence
  chemically synthesized
tcgtcctcttgttttcattc

SEQ ID NO: 462977 - DNA, 20 bp, Artificial Sequence
  chemically synthesized
gaaaagaagaattgaaggtg

SEQ ID NO: 462978 - DNA, 20 bp, Artificial Sequence
  chemically synthesized
gcaaagaaaagaagaattga

SEQ ID NO: 462979 - DNA, 20 bp, Artificial Sequence
  chemically synthesized
agcaaagaaaagaagaattg

SEQ ID NO: 462980 - DNA, 20 bp, Artificial Sequence
  chemically synthesized
gaaagcccagcaaagaaaag

SEQ ID NO: 462981 - DNA, 20 bp, Artificial Sequence
  chemically synthesized
tatgaaagcccagcaaagaa

SEQ ID NO: 462982 - DNA, 20 bp, Artificial Sequence
  chemically synthesized
tcaattcttcttttctttgc

SEQ ID NO: 462983 - DNA, 20 bp, Artificial Sequence
  chemically synthesized
caattcttcttttctttgct

SEQ ID NO: 462984 - DNA, 20 bp, Artificial Sequence
  chemically synthesized
tctcatatgaaagcccagca

SEQ ID NO: 462985 - DNA, 20 bp, Artificial Sequence
  chemically synthesized
aaaaatctcatatgaaagcc

SEQ ID NO: 462986 - DNA, 20 bp, Artificial Sequence
  chemically synthesized
tctttgctgggctttcatat

SEQ ID NO: 462987 - DNA, 20 bp, Artificial Sequence
  chemically synthesized
tttttaaaaatctcatatga

SEQ ID NO: 462988 - DNA, 20 bp, Artificial Sequence
  chemically synthesized
gtttcattttaaaaatacac

SEQ ID NO: 462989 - DNA, 20 bp, Artificial Sequence
  chemically synthesized
agtttcattttaaaaataca

SEQ ID NO: 462990 - DNA, 20 bp, Artificial Sequence
  chemically synthesized
agaatatactgtaatagatc

SEQ ID NO: 462991 - DNA, 20 bp, Artificial Sequence
  chemically synthesized
aaatgaaacttgatctatta

SEQ ID NO: 462992 - DNA, 20 bp, Artificial Sequence
  chemically synthesized
aactgtagaatatactgtaa

SEQ ID NO: 462993 - DNA, 20 bp, Artificial Sequence
  chemically synthesized
atctattacagtatattcta

SEQ ID NO: 462994 - DNA, 20 bp, Artificial Sequence
  chemically synthesized
attacagtatattctacagt

SEQ ID NO: 462995 - DNA, 20 bp, Artificial Sequence
  chemically synthesized
tttcatatatttgccaactg

SEQ ID NO: 462996 - DNA, 20 bp, Artificial Sequence
  chemically synthesized
catgaatgcagtgggaagga

SEQ ID NO: 462997 - DNA, 20 bp, Artificial Sequence
  chemically synthesized
tcggcatgaatgcagtggga

SEQ ID NO: 462998 - DNA, 20 bp, Artificial Sequence
  chemically synthesized
ctcggcatgaatgcagtggg

SEQ ID NO: 462999 - DNA, 20 bp, Artificial Sequence
  chemically synthesized
gtgctcggcatgaatgcagt

SEQ ID NO: 463000 - DNA, 20 bp, Artificial Sequence
  chemically synthesized
tgtgctcggcatgaatgcag

SEQ ID NO: 463001 - DNA, 20 bp, Artificial Sequence
  chemically synthesized
gtatgtgctcggcatgaatg

SEQ ID NO: 463002 - DNA, 20 bp, Artificial Sequence
  chemically synthesized
cttcccactgcattcatgcc

SEQ ID NO: 463003 - DNA, 20 bp, Artificial Sequence
  chemically synthesized
tatttgatgccgtatgtgct

SEQ ID NO: 463004 - DNA, 20 bp, Artificial Sequence
  chemically synthesized
gcattcatgccgagcacata

SEQ ID NO: 463005 - DNA, 20 bp, Artificial Sequence
  chemically synthesized
gcacatacggcatcaaataa

SEQ ID NO: 463006 - DNA, 20 bp, Artificial Sequence
  chemically synthesized
ataatggtattttatcccac

SEQ ID NO: 463007 - DNA, 20 bp, Artificial Sequence
  chemically synthesized
tgtatctacttggaactcgt

SEQ ID NO: 463008 - DNA, 20 bp, Artificial Sequence
  chemically synthesized
ctgtatctacttggaactcg

SEQ ID NO: 463009 - DNA, 20 bp, Artificial Sequence
  chemically synthesized
tattttatcccacgagttcc

SEQ ID NO: 463010 - DNA, 20 bp, Artificial Sequence
  chemically synthesized
tttatcccacgagttccaag

SEQ ID NO: 463011 - DNA, 20 bp, Artificial Sequence
  chemically synthesized
agactgagactgtatctact

SEQ ID NO: 463012 - DNA, 20 bp, Artificial Sequence
  chemically synthesized
ccacgagttccaagtagata

SEQ ID NO: 463013 - DNA, 20 bp, Artificial Sequence
  chemically synthesized
gttccaagtagatacagtct

SEQ ID NO: 463014 - DNA, 20 bp, Artificial Sequence
  chemically synthesized
caggagtactataacagact

SEQ ID NO: 463015 - DNA, 20 bp, Artificial Sequence
  chemically synthesized
gatacagtctcagtctgtta

SEQ ID NO: 463016 - DNA, 20 bp, Artificial Sequence
  chemically synthesized
agtttccaggagtactataa

SEQ ID NO: 463017 - DNA, 20 bp, Artificial Sequence
  chemically synthesized
tcagtctgttatagtactcc

SEQ ID NO: 463018 - DNA, 20 bp, Artificial Sequence
  chemically synthesized
tgcttgatagtagtttccag

SEQ ID NO: 463019 - DNA, 20 bp, Artificial Sequence
  chemically synthesized
attgcttgatagtagtttcc

SEQ ID NO: 463020 - DNA, 20 bp, Artificial Sequence
  chemically synthesized
aattgcttgatagtagtttc

SEQ ID NO: 463021 - DNA, 20 bp, Artificial Sequence
  chemically synthesized
tactcctggaaactactatc

SEQ ID NO: 463022 - DNA, 20 bp, Artificial Sequence
  chemically synthesized
catgtgcaattgcttgatag

SEQ ID NO: 463023 - DNA, 20 bp, Artificial Sequence
  chemically synthesized
caccatgtgcaattgcttga

SEQ ID NO: 463024 - DNA, 20 bp, Artificial Sequence
  chemically synthesized
tactatcaagcaattgcaca

SEQ ID NO: 463025 - DNA, 20 bp, Artificial Sequence
  chemically synthesized
gaagatagaaagtgatagaa

SEQ ID NO: 463026 - DNA, 20 bp, Artificial Sequence
  chemically synthesized
ataaagaagatagaaagtga

SEQ ID NO: 463027 - DNA, 20 bp, Artificial Sequence
  chemically synthesized
taaagaataaagaagataga

SEQ ID NO: 463028 - DNA, 20 bp, Artificial Sequence
  chemically synthesized
tcattaaagaataaagaaga

SEQ ID NO: 463029 - DNA, 20 bp, Artificial Sequence
  chemically synthesized
caaatcattaaagaataaag

SEQ ID NO: 463030 - DNA, 20 bp, Artificial Sequence
  chemically synthesized
ttacaaatcattaaagaata

SEQ ID NO: 463031 - DNA, 20 bp, Artificial Sequence
  chemically synthesized
cattcgattacaaatcatta

SEQ ID NO: 463032 - DNA, 20 bp, Artificial Sequence
  chemically synthesized
attctcttctgaaaaaatgg

SEQ ID NO: 463033 - DNA, 20 bp, Artificial Sequence
  chemically synthesized
atcgaatgcttccatttttt

SEQ ID NO: 463034 - DNA, 20 bp, Artificial Sequence
  chemically synthesized
tttattctcttctgaaaaaa

SEQ ID NO: 463035 - DNA, 20 bp, Artificial Sequence
  chemically synthesized
gaatgcttccattttttcag

SEQ ID NO: 463036 - DNA, 20 bp, Artificial Sequence
  chemically synthesized
atgcttccattttttcagaa

SEQ ID NO: 463037 - DNA, 20 bp, Artificial Sequence
  chemically synthesized
attttttcagaagagaataa

SEQ ID NO: 463038 - DNA, 20 bp, Artificial Sequence
  chemically synthesized
ttttttcagaagagaataaa

SEQ ID NO: 463039 - DNA, 20 bp, Artificial Sequence
  chemically synthesized
tcagaagagaataaaaggcc

SEQ ID NO: 463040 - DNA, 20 bp, Artificial Sequence
  chemically synthesized
agagaataaaaggcccagaa

SEQ ID NO: 463041 - DNA, 20 bp, Artificial Sequence
  chemically synthesized
gtaacagtcattaccattct

SEQ ID NO: 463042 - DNA, 20 bp, Artificial Sequence
  chemically synthesized
ggtaacagtcattaccattc

SEQ ID NO: 463043 - DNA, 20 bp, Artificial Sequence
  chemically synthesized
gaatggtaatgactgttacc

SEQ ID NO: 463044 - DNA, 20 bp, Artificial Sequence
  chemically synthesized
gctacatcgtgacttggtaa

SEQ ID NO: 463045 - DNA, 20 bp, Artificial Sequence
  chemically synthesized
aattttgctacatcgtgact

SEQ ID NO: 463046 - DNA, 20 bp, Artificial Sequence
  chemically synthesized
actgttaccaagtcacgatg

SEQ ID NO: 463047 - DNA, 20 bp, Artificial Sequence
  chemically synthesized
aagtcacgatgtagcaaaat

SEQ ID NO: 463048 - DNA, 20 bp, Artificial Sequence
  chemically synthesized
aattggtgtgtcacttctga

SEQ ID NO: 463049 - DNA, 20 bp, Artificial Sequence
  chemically synthesized
ggagttagagaaactgtcag

SEQ ID NO: 463050 - DNA, 20 bp, Artificial Sequence
  chemically synthesized
ttgggagttagagaaactgt

SEQ ID NO: 463051 - DNA, 20 bp, Artificial Sequence
  chemically synthesized
atgcattggtttgggagtta

SEQ ID NO: 463052 - DNA, 20 bp, Artificial Sequence
  chemically synthesized
atatgcattggtttgggagt

SEQ ID NO: 463053 - DNA, 20 bp, Artificial Sequence
  chemically synthesized
caaaatatgcattggtttgg

SEQ ID NO: 463054 - DNA, 20 bp, Artificial Sequence
  chemically synthesized
atcaaaatatgcattggttt

SEQ ID NO: 463055 - DNA, 20 bp, Artificial Sequence
  chemically synthesized
tatcaaaatatgcattggtt

SEQ ID NO: 463056 - DNA, 20 bp, Artificial Sequence
  chemically synthesized
gcaattatcaaaatatgcat

SEQ ID NO: 463057 - DNA, 20 bp, Artificial Sequence
  chemically synthesized
tatatttgaggaaataatga

SEQ ID NO: 463058 - DNA, 20 bp, Artificial Sequence
  chemically synthesized
gtatatttgaggaaataatg

SEQ ID NO: 463059 - DNA, 20 bp, Artificial Sequence
  chemically synthesized
agtatatttgaggaaataat

SEQ ID NO: 463060 - DNA, 20 bp, Artificial Sequence
  chemically synthesized
ctgacagggaagtatatttg

SEQ ID NO: 463061 - DNA, 20 bp, Artificial Sequence
  chemically synthesized
tctgacagggaagtatattt

SEQ ID NO: 463062 - DNA, 20 bp, Artificial Sequence
  chemically synthesized
cctcaaatatacttccctgt

SEQ ID NO: 463063 - DNA, 20 bp, Artificial Sequence
  chemically synthesized
atcatttttttctgacaggg

SEQ ID NO: 463064 - DNA, 20 bp, Artificial Sequence
  chemically synthesized
ataatcatttttttctgaca

SEQ ID NO: 463065 - DNA, 20 bp, Artificial Sequence
  chemically synthesized
tataatcatttttttctgac

SEQ ID NO: 463066 - DNA, 20 bp, Artificial Sequence
  chemically synthesized
atataatcatttttttctga

SEQ ID NO: 463067 - DNA, 20 bp, Artificial Sequence
  chemically synthesized
gattatatataaaattaaat

SEQ ID NO: 463068 - DNA, 20 bp, Artificial Sequence
  chemically synthesized
attatatataaaattaaatg

SEQ ID NO: 463069 - DNA, 20 bp, Artificial Sequence
  chemically synthesized
acatgatattttattattaa

SEQ ID NO: 463070 - DNA, 20 bp, Artificial Sequence
  chemically synthesized
aataaaatatcatgttgtct

SEQ ID NO: 463071 - DNA, 20 bp, Artificial Sequence
  chemically synthesized
ataaaatatcatgttgtctt

SEQ ID NO: 463072 - DNA, 20 bp, Artificial Sequence
  chemically synthesized
cttctggtaaaaggcaaccc

SEQ ID NO: 463073 - DNA, 20 bp, Artificial Sequence
  chemically synthesized
tgtcttgggttgccttttac

SEQ ID NO: 463074 - DNA, 20 bp, Artificial Sequence
  chemically synthesized
cagggtctacttctggtaaa

SEQ ID NO: 463075 - DNA, 20 bp, Artificial Sequence
  chemically synthesized
cttgggttgccttttaccag

SEQ ID NO: 463076 - DNA, 20 bp, Artificial Sequence
  chemically synthesized
tcagggtctacttctggtaa

SEQ ID NO: 463077 - DNA, 20 bp, Artificial Sequence
  chemically synthesized
gggttgccttttaccagaag

SEQ ID NO: 463078 - DNA, 20 bp, Artificial Sequence
  chemically synthesized
atttgctcagggtctacttc

SEQ ID NO: 463079 - DNA, 20 bp, Artificial Sequence
  chemically synthesized
ttttaccagaagtagaccct

SEQ ID NO: 463080 - DNA, 20 bp, Artificial Sequence
  chemically synthesized
gcactcaaataatttgctca

SEQ ID NO: 463081 - DNA, 20 bp, Artificial Sequence
  chemically synthesized
ggcactcaaataatttgctc

SEQ ID NO: 463082 - DNA, 20 bp, Artificial Sequence
  chemically synthesized
tggcactcaaataatttgct

SEQ ID NO: 463083 - DNA, 20 bp, Artificial Sequence
  chemically synthesized
agaccctgagcaaattattt

SEQ ID NO: 463084 - DNA, 20 bp, Artificial Sequence
  chemically synthesized
tgagcaaattatttgagtgc

SEQ ID NO: 463085 - DNA, 20 bp, Artificial Sequence
  chemically synthesized
tcacctccgaaataagttgc

SEQ ID NO: 463086 - DNA, 20 bp, Artificial Sequence
  chemically synthesized
tgagtgccagcaacttattt

SEQ ID NO: 463087 - DNA, 20 bp, Artificial Sequence
  chemically synthesized
agtgccagcaacttatttcg

SEQ ID NO: 463088 - DNA, 20 bp, Artificial Sequence
  chemically synthesized
gtgccagcaacttatttcgg

SEQ ID NO: 463089 - DNA, 20 bp, Artificial Sequence
  chemically synthesized
cctgggatcacctccgaaat

SEQ ID NO: 463090 - DNA, 20 bp, Artificial Sequence
  chemically synthesized
acttatttcggaggtgatcc

SEQ ID NO: 463091 - DNA, 20 bp, Artificial Sequence
  chemically synthesized
cttatttcggaggtgatccc

SEQ ID NO: 463092 - DNA, 20 bp, Artificial Sequence
  chemically synthesized
atttcggaggtgatcccagg

SEQ ID NO: 463093 - DNA, 20 bp, Artificial Sequence
  chemically synthesized
acttctttgctgtgcttcct

SEQ ID NO: 463094 - DNA, 20 bp, Artificial Sequence
  chemically synthesized
ggaggtgatcccaggaagca

SEQ ID NO: 463095 - DNA, 20 bp, Artificial Sequence
  chemically synthesized
cacttctttgctgtgcttcc

SEQ ID NO: 463096 - DNA, 20 bp, Artificial Sequence
  chemically synthesized
tgatcccaggaagcacagca

SEQ ID NO: 463097 - DNA, 20 bp, Artificial Sequence
  chemically synthesized
tcccaggaagcacagcaaag

SEQ ID NO: 463098 - DNA, 20 bp, Artificial Sequence
  chemically synthesized
aggaagcacagcaaagaagt

SEQ ID NO: 463099 - DNA, 20 bp, Artificial Sequence
  chemically synthesized
agcacagcaaagaagtgagt

SEQ ID NO: 463100 - DNA, 20 bp, Artificial Sequence
  chemically synthesized
cagcaaagaagtgagtgaga

SEQ ID NO: 463101 - DNA, 20 bp, Artificial Sequence
  chemically synthesized
gcaaagaagtgagtgagacg

SEQ ID NO: 463102 - DNA, 20 bp, Artificial Sequence
  chemically synthesized
gaagtgagtgagacggagaa

SEQ ID NO: 463103 - DNA, 20 bp, Artificial Sequence
  chemically synthesized
tgagacggagaaaagaacac

SEQ ID NO: 463104 - DNA, 20 bp, Artificial Sequence
  chemically synthesized
cggagaaaagaacaccagta

SEQ ID NO: 463105 - DNA, 20 bp, Artificial Sequence
  chemically synthesized
tcatgaaactcacactgtac

SEQ ID NO: 463106 - DNA, 20 bp, Artificial Sequence
  chemically synthesized
aaagaacaccagtacagtgt

SEQ ID NO: 463107 - DNA, 20 bp, Artificial Sequence
  chemically synthesized
cagtacagtgtgagtttcat

SEQ ID NO: 463108 - DNA, 20 bp, Artificial Sequence
  chemically synthesized
gagtttcatgagcatgtcat

SEQ ID NO: 463109 - DNA, 20 bp, Artificial Sequence
  chemically synthesized
catgtcatcagtgataaaat

SEQ ID NO: 463110 - DNA, 20 bp, Artificial Sequence
  chemically synthesized
atgtcatcagtgataaaatg

SEQ ID NO: 463111 - DNA, 20 bp, Artificial Sequence
  chemically synthesized
atcagtgataaaatgaggtt

SEQ ID NO: 463112 - DNA, 20 bp, Artificial Sequence
  chemically synthesized
aatgaggttcagtaccactt

SEQ ID NO: 463113 - DNA, 20 bp, Artificial Sequence
  chemically synthesized
attctcctagtggtctcaag

SEQ ID NO: 463114 - DNA, 20 bp, Artificial Sequence
  chemically synthesized
atcattctcctagtggtctc

SEQ ID NO: 463115 - DNA, 20 bp, Artificial Sequence
  chemically synthesized
tcagtaccacttgagaccac

SEQ ID NO: 463116 - DNA, 20 bp, Artificial Sequence
  chemically synthesized
cagtaccacttgagaccact

SEQ ID NO: 463117 - DNA, 20 bp, Artificial Sequence
  chemically synthesized
gtaccacttgagaccactag

SEQ ID NO: 463118 - DNA, 20 bp, Artificial Sequence
  chemically synthesized
gagacaaatcattctcctag

SEQ ID NO: 463119 - DNA, 20 bp, Artificial Sequence
  chemically synthesized
ggtgagacaaatcattctcc

SEQ ID NO: 463120 - DNA, 20 bp, Artificial Sequence
  chemically synthesized
gagaatgatttgtctcacct

SEQ ID NO: 463121 - DNA, 20 bp, Artificial Sequence
  chemically synthesized
aatgatttgtctcacctgag

SEQ ID NO: 463122 - DNA, 20 bp, Artificial Sequence
  chemically synthesized
acctttcttgcttctcaggt

SEQ ID NO: 463123 - DNA, 20 bp, Artificial Sequence
  chemically synthesized
atttgtctcacctgagaagc

SEQ ID NO: 463124 - DNA, 20 bp, Artificial Sequence
  chemically synthesized
ccctacctttcttgcttctc

SEQ ID NO: 463125 - DNA, 20 bp, Artificial Sequence
  chemically synthesized
accctacctttcttgcttct

SEQ ID NO: 463126 - DNA, 20 bp, Artificial Sequence
  chemically synthesized
gtctcacctgagaagcaaga

SEQ ID NO: 463127 - DNA, 20 bp, Artificial Sequence
  chemically synthesized
tctcacctgagaagcaagaa

SEQ ID NO: 463128 - DNA, 20 bp, Artificial Sequence
  chemically synthesized
cacctgagaagcaagaaagg

SEQ ID NO: 463129 - DNA, 20 bp, Artificial Sequence
  chemically synthesized
acctgagaagcaagaaaggt

SEQ ID NO: 463130 - DNA, 20 bp, Artificial Sequence
  chemically synthesized
cctgagaagcaagaaaggta

SEQ ID NO: 463131 - DNA, 20 bp, Artificial Sequence
  chemically synthesized
gagaagcaagaaaggtaggg

SEQ ID NO: 463132 - DNA, 20 bp, Artificial Sequence
  chemically synthesized
cattacacatgggagtttgt

SEQ ID NO: 463133 - DNA, 20 bp, Artificial Sequence
  chemically synthesized
acattacacatgggagtttg

SEQ ID NO: 463134 - DNA, 20 bp, Artificial Sequence
  chemically synthesized
tcttaacacattacacatgg

SEQ ID NO: 463135 - DNA, 20 bp, Artificial Sequence
  chemically synthesized
gttcttaacacattacacat

SEQ ID NO: 463136 - DNA, 20 bp, Artificial Sequence
  chemically synthesized
tgttcttaacacattacaca

SEQ ID NO: 463137 - DNA, 20 bp, Artificial Sequence
  chemically synthesized
actcccatgtgtaatgtgtt

SEQ ID NO: 463138 - DNA, 20 bp, Artificial Sequence
  chemically synthesized
taatcattataattaaataa

SEQ ID NO: 463139 - DNA, 20 bp, Artificial Sequence
  chemically synthesized
atagaactacaatgttgtga

SEQ ID NO: 463140 - DNA, 20 bp, Artificial Sequence
  chemically synthesized
tattaactatcacaacattg

SEQ ID NO: 463141 - DNA, 20 bp, Artificial Sequence
  chemically synthesized
tcacaacattgtagttctat

SEQ ID NO: 463142 - DNA, 20 bp, Artificial Sequence
  chemically synthesized
cattgtagttctattagtct

SEQ ID NO: 463143 - DNA, 20 bp, Artificial Sequence
  chemically synthesized
tgcattaaggctcagactaa

SEQ ID NO: 463144 - DNA, 20 bp, Artificial Sequence
  chemically synthesized
aatctgtatgcattaaggct

SEQ ID NO: 463145 - DNA, 20 bp, Artificial Sequence
  chemically synthesized
gcaaaaatctgtatgcatta

SEQ ID NO: 463146 - DNA, 20 bp, Artificial Sequence
  chemically synthesized
tgcaaaaatctgtatgcatt

SEQ ID NO: 463147 - DNA, 20 bp, Artificial Sequence
  chemically synthesized
agtctgagccttaatgcata

SEQ ID NO: 463148 - DNA, 20 bp, Artificial Sequence
  chemically synthesized
acagatttttgcaaacttca

SEQ ID NO: 463149 - DNA, 20 bp, Artificial Sequence
  chemically synthesized
gatttttgcaaacttcatgg

SEQ ID NO: 463150 - DNA, 20 bp, Artificial Sequence
  chemically synthesized
ataaaatggaaacttccatg

SEQ ID NO: 463151 - DNA, 20 bp, Artificial Sequence
  chemically synthesized
aaaactaatttcaaataaaa

SEQ ID NO: 463152 - DNA, 20 bp, Artificial Sequence
  chemically synthesized
gtttccattttatttgaaat

SEQ ID NO: 463153 - DNA, 20 bp, Artificial Sequence
  chemically synthesized
tagtttttgattaaaaataa

SEQ ID NO: 463154 - DNA, 20 bp, Artificial Sequence
  chemically synthesized
atatttttaattgattgaag

SEQ ID NO: 463155 - DNA, 20 bp, Artificial Sequence
  chemically synthesized
tgatatttttaattgattga

SEQ ID NO: 463156 - DNA, 20 bp, Artificial Sequence
  chemically synthesized
ctgatatttttaattgattg

SEQ ID NO: 463157 - DNA, 20 bp, Artificial Sequence
  chemically synthesized
cttcaatcaattaaaaatat

SEQ ID NO: 463158 - DNA, 20 bp, Artificial Sequence
  chemically synthesized
caatcaattaaaaatatcag

SEQ ID NO: 463159 - DNA, 20 bp, Artificial Sequence
  chemically synthesized
tatcagcagatccatctgct

SEQ ID NO: 463160 - DNA, 20 bp, Artificial Sequence
  chemically synthesized
agaatcattttccaagcaga

SEQ ID NO: 463161 - DNA, 20 bp, Artificial Sequence
  chemically synthesized
aggaagaatcattttccaag

SEQ ID NO: 463162 - DNA, 20 bp, Artificial Sequence
  chemically synthesized
atcaggaagaatcattttcc

SEQ ID NO: 463163 - DNA, 20 bp, Artificial Sequence
  chemically synthesized
ggatggaagccagcatcagg

SEQ ID NO: 463164 - DNA, 20 bp, Artificial Sequence
  chemically synthesized
aaaatgattcttcctgatgc

SEQ ID NO: 463165 - DNA, 20 bp, Artificial Sequence
  chemically synthesized
gtaggatggaagccagcatc

SEQ ID NO: 463166 - DNA, 20 bp, Artificial Sequence
  chemically synthesized
agtaggatggaagccagcat

SEQ ID NO: 463167 - DNA, 20 bp, Artificial Sequence
  chemically synthesized
tcaaccagtaggatggaagc

SEQ ID NO: 463168 - DNA, 20 bp, Artificial Sequence
  chemically synthesized
gatgtcaaccagtaggatgg

SEQ ID NO: 463169 - DNA, 20 bp, Artificial Sequence
  chemically synthesized
gatgctggcttccatcctac

SEQ ID NO: 463170 - DNA, 20 bp, Artificial Sequence
  chemically synthesized
aatgatgtcaaccagtagga

SEQ ID NO: 463171 - DNA, 20 bp, Artificial Sequence
  chemically synthesized
acgtaatgatgtcaaccagt

SEQ ID NO: 463172 - DNA, 20 bp, Artificial Sequence
  chemically synthesized
aacgtaatgatgtcaaccag

SEQ ID NO: 463173 - DNA, 20 bp, Artificial Sequence
  chemically synthesized
cccaacgtaatgatgtcaac

SEQ ID NO: 463174 - DNA, 20 bp, Artificial Sequence
  chemically synthesized
actggttgacatcattacgt

SEQ ID NO: 463175 - DNA, 20 bp, Artificial Sequence
  chemically synthesized
ctggttgacatcattacgtt

SEQ ID NO: 463176 - DNA, 20 bp, Artificial Sequence
  chemically synthesized
tgacatcattacgttgggtt

SEQ ID NO: 463177 - DNA, 20 bp, Artificial Sequence
  chemically synthesized
catcattacgttgggttaag

SEQ ID NO: 463178 - DNA, 20 bp, Artificial Sequence
  chemically synthesized
cgttgggttaagcagtgaca

SEQ ID NO: 463179 - DNA, 20 bp, Artificial Sequence
  chemically synthesized
gttgggttaagcagtgacat

SEQ ID NO: 463180 - DNA, 20 bp, Artificial Sequence
  chemically synthesized
aagagaattgatcacatttt

SEQ ID NO: 463181 - DNA, 20 bp, Artificial Sequence
  chemically synthesized
aaaagtgtgtgggagaataa

SEQ ID NO: 463182 - DNA, 20 bp, Artificial Sequence
  chemically synthesized
tcaaaagtgtgtgggagaat

SEQ ID NO: 463183 - DNA, 20 bp, Artificial Sequence
  chemically synthesized
tgcaggtcaaaagtgtgtgg

SEQ ID NO: 463184 - DNA, 20 bp, Artificial Sequence
  chemically synthesized
aatgcaggtcaaaagtgtgt

SEQ ID NO: 463185 - DNA, 20 bp, Artificial Sequence
  chemically synthesized
aaatgcaggtcaaaagtgtg

SEQ ID NO: 463186 - DNA, 20 bp, Artificial Sequence
  chemically synthesized
agagaataaatgcaggtcaa

SEQ ID NO: 463187 - DNA, 20 bp, Artificial Sequence
  chemically synthesized
caaagatagagaataaatgc

SEQ ID NO: 463188 - DNA, 20 bp, Artificial Sequence
  chemically synthesized
acaaagatagagaataaatg

SEQ ID NO: 463189 - DNA, 20 bp, Artificial Sequence
  chemically synthesized
tctttaatataacaaagata

SEQ ID NO: 463190 - DNA, 20 bp, Artificial Sequence
  chemically synthesized
aatctttaatataacaaaga

SEQ ID NO: 463191 - DNA, 20 bp, Artificial Sequence
  chemically synthesized
tgacaatctttaatataaca

SEQ ID NO: 463192 - DNA, 20 bp, Artificial Sequence
  chemically synthesized
tctctatctttgttatatta

SEQ ID NO: 463193 - DNA, 20 bp, Artificial Sequence
  chemically synthesized
catttgtgctgtcaaattaa

SEQ ID NO: 463194 - DNA, 20 bp, Artificial Sequence
  chemically synthesized
tcatttgtgctgtcaaatta

SEQ ID NO: 463195 - DNA, 20 bp, Artificial Sequence
  chemically synthesized
aatgttttcccttaatttga

SEQ ID NO: 463196 - DNA, 20 bp, Artificial Sequence
  chemically synthesized
ttcatttgtgctgtcaaatt

SEQ ID NO: 463197 - DNA, 20 bp, Artificial Sequence
  chemically synthesized
agcacaaatgaatatcaaca

SEQ ID NO: 463198 - DNA, 20 bp, Artificial Sequence
  chemically synthesized
ccttttccattttgaggcaa

SEQ ID NO: 463199 - DNA, 20 bp, Artificial Sequence
  chemically synthesized
atggcactattgcctcaaaa

SEQ ID NO: 463200 - DNA, 20 bp, Artificial Sequence
  chemically synthesized
tttttgccttttccattttg

SEQ ID NO: 463201 - DNA, 20 bp, Artificial Sequence
  chemically synthesized
ttttttgccttttccatttt

SEQ ID NO: 463202 - DNA, 20 bp, Artificial Sequence
  chemically synthesized
actattgcctcaaaatggaa

SEQ ID NO: 463203 - DNA, 20 bp, Artificial Sequence
  chemically synthesized
ctattgcctcaaaatggaaa

SEQ ID NO: 463204 - DNA, 20 bp, Artificial Sequence
  chemically synthesized
tcaaaatggaaaaggcaaaa

SEQ ID NO: 463205 - DNA, 20 bp, Artificial Sequence
  chemically synthesized
tcacatgtttctttaatata

SEQ ID NO: 463206 - DNA, 20 bp, Artificial Sequence
  chemically synthesized
aaatctgtaactgtatatta

SEQ ID NO: 463207 - DNA, 20 bp, Artificial Sequence
  chemically synthesized
gtttctttaatatacagtta

SEQ ID NO: 463208 - DNA, 20 bp, Artificial Sequence
  chemically synthesized
aatatacagttacagatttt

SEQ ID NO: 463209 - DNA, 20 bp, Artificial Sequence
  chemically synthesized
gatataaccacaatcagaag

SEQ ID NO: 463210 - DNA, 20 bp, Artificial Sequence
  chemically synthesized
ttcatttccacttctgattg

SEQ ID NO: 463211 - DNA, 20 bp, Artificial Sequence
  chemically synthesized
gaagatataaccacaatcag

SEQ ID NO: 463212 - DNA, 20 bp, Artificial Sequence
  chemically synthesized
gtggaagatataaccacaat

SEQ ID NO: 463213 - DNA, 20 bp, Artificial Sequence
  chemically synthesized
tgaaaggaaagggaaggtgg

SEQ ID NO: 463214 - DNA, 20 bp, Artificial Sequence
  chemically synthesized
gcatgaaaggaaagggaagg

SEQ ID NO: 463215 - DNA, 20 bp, Artificial Sequence
  chemically synthesized
acggcatgaaaggaaaggga

SEQ ID NO: 463216 - DNA, 20 bp, Artificial Sequence
  chemically synthesized
aacggcatgaaaggaaaggg

SEQ ID NO: 463217 - DNA, 20 bp, Artificial Sequence
  chemically synthesized
taaaacggcatgaaaggaaa

SEQ ID NO: 463218 - DNA, 20 bp, Artificial Sequence
  chemically synthesized
ataaaacggcatgaaaggaa

SEQ ID NO: 463219 - DNA, 20 bp, Artificial Sequence
  chemically synthesized
tataaaacggcatgaaagga

SEQ ID NO: 463220 - DNA, 20 bp, Artificial Sequence
  chemically synthesized
ttaatataaaacggcatgaa

SEQ ID NO: 463221 - DNA, 20 bp, Artificial Sequence
  chemically synthesized
tttaatataaaacggcatga

SEQ ID NO: 463222 - DNA, 20 bp, Artificial Sequence
  chemically synthesized
tattgacctttaatataaaa

SEQ ID NO: 463223 - DNA, 20 bp, Artificial Sequence
  chemically synthesized
tttcatgccgttttatatta

SEQ ID NO: 463224 - DNA, 20 bp, Artificial Sequence
  chemically synthesized
ttcatgccgttttatattaa

SEQ ID NO: 463225 - DNA, 20 bp, Artificial Sequence
  chemically synthesized
tcatttattaattatgcaac

SEQ ID NO: 463226 - DNA, 20 bp, Artificial Sequence
  chemically synthesized
gtttacaatgtttgtaaatg

SEQ ID NO: 463227 - DNA, 20 bp, Artificial Sequence
  chemically synthesized
aatgtttgtaaatgtagtca

SEQ ID NO: 463228 - DNA, 20 bp, Artificial Sequence
  chemically synthesized
aggataaattttattatatt

SEQ ID NO: 463229 - DNA, 20 bp, Artificial Sequence
  chemically synthesized
ataaaatttatcctctgctt

SEQ ID NO: 463230 - DNA, 20 bp, Artificial Sequence
  chemically synthesized
gcttatattagccaaagcag

SEQ ID NO: 463231 - DNA, 20 bp, Artificial Sequence
  chemically synthesized
ggcttatattagccaaagca

SEQ ID NO: 463232 - DNA, 20 bp, Artificial Sequence
  chemically synthesized
tgggcttatattagccaaag

SEQ ID NO: 463233 - DNA, 20 bp, Artificial Sequence
  chemically synthesized
ttgtgggcttatattagcca

SEQ ID NO: 463234 - DNA, 20 bp, Artificial Sequence
  chemically synthesized
tcctctgctttggctaatat

SEQ ID NO: 463235 - DNA, 20 bp, Artificial Sequence
  chemically synthesized
gatcatttgtgggcttatat

SEQ ID NO: 463236 - DNA, 20 bp, Artificial Sequence
  chemically synthesized
aaaatgaaatgatcatttgt

SEQ ID NO: 463237 - DNA, 20 bp, Artificial Sequence
  chemically synthesized
gaaaatgaaatgatcatttg

SEQ ID NO: 463238 - DNA, 20 bp, Artificial Sequence
  chemically synthesized
acattatacttttaatttat

SEQ ID NO: 463239 - DNA, 20 bp, Artificial Sequence
  chemically synthesized
ttcattttctaataaattaa

SEQ ID NO: 463240 - DNA, 20 bp, Artificial Sequence
  chemically synthesized
aaaagtataatgtatacaat

SEQ ID NO: 463241 - DNA, 20 bp, Artificial Sequence
  chemically synthesized
tgtatacaattggattctgt

SEQ ID NO: 463242 - DNA, 20 bp, Artificial Sequence
  chemically synthesized
gtatacaattggattctgtc

SEQ ID NO: 463243 - DNA, 20 bp, Artificial Sequence
  chemically synthesized
aaaagacacatcaagcctga

SEQ ID NO: 463244 - DNA, 20 bp, Artificial Sequence
  chemically synthesized
ctgtgtttaaaagacacatc

SEQ ID NO: 463245 - DNA, 20 bp, Artificial Sequence
  chemically synthesized
cttgatgtgtcttttaaaca

SEQ ID NO: 463246 - DNA, 20 bp, Artificial Sequence
  chemically synthesized
atttaatgtgctgtgtttaa

SEQ ID NO: 463247 - DNA, 20 bp, Artificial Sequence
  chemically synthesized
acagtcctttttatacatag

SEQ ID NO: 463248 - DNA, 20 bp, Artificial Sequence
  chemically synthesized
tatacagtcctttttataca

SEQ ID NO: 463249 - DNA, 20 bp, Artificial Sequence
  chemically synthesized
taaattccactatgtataaa

SEQ ID NO: 463250 - DNA, 20 bp, Artificial Sequence
  chemically synthesized
aaattccactatgtataaaa

SEQ ID NO: 463251 - DNA, 20 bp, Artificial Sequence
  chemically synthesized
ttctctattgacattatata

SEQ ID NO: 463252 - DNA, 20 bp, Artificial Sequence
  chemically synthesized
aggactgtatataatgtcaa

SEQ ID NO: 463253 - DNA, 20 bp, Artificial Sequence
  chemically synthesized
gactgtatataatgtcaata

SEQ ID NO: 463254 - DNA, 20 bp, Artificial Sequence
  chemically synthesized
taatgtcaatagagaataaa

SEQ ID NO: 463255 - DNA, 20 bp, Artificial Sequence
  chemically synthesized
ataaacagaattgctacaaa

SEQ ID NO: 463256 - DNA, 20 bp, Artificial Sequence
  chemically synthesized
atttatgtcgatgctttttg

SEQ ID NO: 463257 - DNA, 20 bp, Artificial Sequence
  chemically synthesized
cataaatgattaaatataca

SEQ ID NO: 463258 - DNA, 20 bp, Artificial Sequence
  chemically synthesized
gattaaatatacatagctct

SEQ ID NO: 463259 - DNA, 20 bp, Artificial Sequence
  chemically synthesized
aacaggaagccacatgccaa

SEQ ID NO: 463260 - DNA, 20 bp, Artificial Sequence
  chemically synthesized
tatacatagctcttggcatg

SEQ ID NO: 463261 - DNA, 20 bp, Artificial Sequence
  chemically synthesized
gtaacaggaagccacatgcc

SEQ ID NO: 463262 - DNA, 20 bp, Artificial Sequence
  chemically synthesized
gcacaattctgtgtaacagg

SEQ ID NO: 463263 - DNA, 20 bp, Artificial Sequence
  chemically synthesized
gcatgtggcttcctgttaca

SEQ ID NO: 463264 - DNA, 20 bp, Artificial Sequence
  chemically synthesized
aaagcacaattctgtgtaac

SEQ ID NO: 463265 - DNA, 20 bp, Artificial Sequence
  chemically synthesized
aaaagcacaattctgtgtaa

SEQ ID NO: 463266 - DNA, 20 bp, Artificial Sequence
  chemically synthesized
tgaaattatccattattaaa

SEQ ID NO: 463267 - DNA, 20 bp, Artificial Sequence
  chemically synthesized
agaattgtgctttttaataa

SEQ ID NO: 463268 - DNA, 20 bp, Artificial Sequence
  chemically synthesized
taatttcaaaaccaatttgc

SEQ ID NO: 463269 - DNA, 20 bp, Artificial Sequence
  chemically synthesized
gcattaagtatccagcaaat

SEQ ID NO: 463270 - DNA, 20 bp, Artificial Sequence
  chemically synthesized
tcaaagatgcattaagtatc

SEQ ID NO: 463271 - DNA, 20 bp, Artificial Sequence
  chemically synthesized
gaaaatctcaaagatgcatt

SEQ ID NO: 463272 - DNA, 20 bp, Artificial Sequence
  chemically synthesized
tggatacttaatgcatcttt

SEQ ID NO: 463273 - DNA, 20 bp, Artificial Sequence
  chemically synthesized
tctgtggaaggaaaatctca

SEQ ID NO: 463274 - DNA, 20 bp, Artificial Sequence
  chemically synthesized
tctttgagattttccttcca

SEQ ID NO: 463275 - DNA, 20 bp, Artificial Sequence
  chemically synthesized
tttgagattttccttccaca

SEQ ID NO: 463276 - DNA, 20 bp, Artificial Sequence
  chemically synthesized
tcctaaatcttctctgtgga

SEQ ID NO: 463277 - DNA, 20 bp, Artificial Sequence
  chemically synthesized
ctcctaaatcttctctgtgg

SEQ ID NO: 463278 - DNA, 20 bp, Artificial Sequence
  chemically synthesized
gagattttccttccacagag

SEQ ID NO: 463279 - DNA, 20 bp, Artificial Sequence
  chemically synthesized
aatctcctaaatcttctctg

SEQ ID NO: 463280 - DNA, 20 bp, Artificial Sequence
  chemically synthesized
ttccttccacagagaagatt

SEQ ID NO: 463281 - DNA, 20 bp, Artificial Sequence
  chemically synthesized
tccttccacagagaagattt

SEQ ID NO: 463282 - DNA, 20 bp, Artificial Sequence
  chemically synthesized
cttccacagagaagatttag

SEQ ID NO: 463283 - DNA, 20 bp, Artificial Sequence
  chemically synthesized
agaagatttaggagattata

SEQ ID NO: 463284 - DNA, 20 bp, Artificial Sequence
  chemically synthesized
atattagaaaattaataaag

SEQ ID NO: 463285 - DNA, 20 bp, Artificial Sequence
  chemically synthesized
gtgatattagaaaattaata

SEQ ID NO: 463286 - DNA, 20 bp, Artificial Sequence
  chemically synthesized
aatgcatagctttgtgatat

SEQ ID NO: 463287 - DNA, 20 bp, Artificial Sequence
  chemically synthesized
attaattttctaatatcaca

SEQ ID NO: 463288 - DNA, 20 bp, Artificial Sequence
  chemically synthesized
aatatcacaaagctatgcat

SEQ ID NO: 463289 - DNA, 20 bp, Artificial Sequence
  chemically synthesized
acctacttccttctaatgca

SEQ ID NO: 463290 - DNA, 20 bp, Artificial Sequence
  chemically synthesized
atcacaaagctatgcattag

SEQ ID NO: 463291 - DNA, 20 bp, Artificial Sequence
  chemically synthesized
tcacaaagctatgcattaga

SEQ ID NO: 463292 - DNA, 20 bp, Artificial Sequence
  chemically synthesized
caaagctatgcattagaagg

SEQ ID NO: 463293 - DNA, 20 bp, Artificial Sequence
  chemically synthesized
agctatgcattagaaggaag

SEQ ID NO: 463294 - DNA, 20 bp, Artificial Sequence
  chemically synthesized
gctatgcattagaaggaagt

SEQ ID NO: 463295 - DNA, 20 bp, Artificial Sequence
  chemically synthesized
gtggatgtatcaaatgatat

SEQ ID NO: 463296 - DNA, 20 bp, Artificial Sequence
  chemically synthesized
caaagagcgtaggaattcag

SEQ ID NO: 463297 - DNA, 20 bp, Artificial Sequence
  chemically synthesized
ctgcaaagagcgtaggaatt

SEQ ID NO: 463298 - DNA, 20 bp, Artificial Sequence
  chemically synthesized
cttgaggctgcaaagagcgt

SEQ ID NO: 463299 - DNA, 20 bp, Artificial Sequence
  chemically synthesized
ccttgaggctgcaaagagcg

SEQ ID NO: 463300 - DNA, 20 bp, Artificial Sequence
  chemically synthesized
ctgaattcctacgctctttg

SEQ ID NO: 463301 - DNA, 20 bp, Artificial Sequence
  chemically synthesized
aggtgccttgaggctgcaaa

SEQ ID NO: 463302 - DNA, 20 bp, Artificial Sequence
  chemically synthesized
acaggtgccttgaggctgca

SEQ ID NO: 463303 - DNA, 20 bp, Artificial Sequence
  chemically synthesized
cctacgctctttgcagcctc

SEQ ID NO: 463304 - DNA, 20 bp, Artificial Sequence
  chemically synthesized
ctacgctctttgcagcctca

SEQ ID NO: 463305 - DNA, 20 bp, Artificial Sequence
  chemically synthesized
gccagcacacaggtgccttg

SEQ ID NO: 463306 - DNA, 20 bp, Artificial Sequence
  chemically synthesized
tgccagcacacaggtgcctt

SEQ ID NO: 463307 - DNA, 20 bp, Artificial Sequence
  chemically synthesized
gcctcaaggcacctgtgtgc

SEQ ID NO: 463308 - DNA, 20 bp, Artificial Sequence
  chemically synthesized
tgcaaagtctgccagcacac

SEQ ID NO: 463309 - DNA, 20 bp, Artificial Sequence
  chemically synthesized
ctgcaaagtctgccagcaca

SEQ ID NO: 463310 - DNA, 20 bp, Artificial Sequence
  chemically synthesized
tcaaggcacctgtgtgctgg

SEQ ID NO: 463311 - DNA, 20 bp, Artificial Sequence
  chemically synthesized
tagtactctgcaaagtctgc

SEQ ID NO: 463312 - DNA, 20 bp, Artificial Sequence
  chemically synthesized
ctgtgtgctggcagactttg

SEQ ID NO: 463313 - DNA, 20 bp, Artificial Sequence
  chemically synthesized
gtgtgctggcagactttgca

SEQ ID NO: 463314 - DNA, 20 bp, Artificial Sequence
  chemically synthesized
aacttcagtagtactctgca

SEQ ID NO: 463315 - DNA, 20 bp, Artificial Sequence
  chemically synthesized
gactttgcagagtactactg

SEQ ID NO: 463316 - DNA, 20 bp, Artificial Sequence
  chemically synthesized
gtttacagcctcaacttcag

SEQ ID NO: 463317 - DNA, 20 bp, Artificial Sequence
  chemically synthesized
tgcagagtactactgaagtt

SEQ ID NO: 463318 - DNA, 20 bp, Artificial Sequence
  chemically synthesized
gcagagtactactgaagttg

SEQ ID NO: 463319 - DNA, 20 bp, Artificial Sequence
  chemically synthesized
ttggtttacagcctcaactt

SEQ ID NO: 463320 - DNA, 20 bp, Artificial Sequence
  chemically synthesized
gcaaatgcgtgattggttta

SEQ ID NO: 463321 - DNA, 20 bp, Artificial Sequence
  chemically synthesized
aagcagagcaaatgcgtgat

SEQ ID NO: 463322 - DNA, 20 bp, Artificial Sequence
  chemically synthesized
atgccagcaatatgaaagca

SEQ ID NO: 463323 - DNA, 20 bp, Artificial Sequence
  chemically synthesized
taatgccagcaatatgaaag

SEQ ID NO: 463324 - DNA, 20 bp, Artificial Sequence
  chemically synthesized
gtataatgccagcaatatga

SEQ ID NO: 463325 - DNA, 20 bp, Artificial Sequence
  chemically synthesized
ttgctctgctttcatattgc

SEQ ID NO: 463326 - DNA, 20 bp, Artificial Sequence
  chemically synthesized
gaatagcagatgtataatgc

SEQ ID NO: 463327 - DNA, 20 bp, Artificial Sequence
  chemically synthesized
gatttggggttggcgaatag

SEQ ID NO: 463328 - DNA, 20 bp, Artificial Sequence
  chemically synthesized
aaggatttggggttggcgaa

SEQ ID NO: 463329 - DNA, 20 bp, Artificial Sequence
  chemically synthesized
catactgaaggatttggggt

SEQ ID NO: 463330 - DNA, 20 bp, Artificial Sequence
  chemically synthesized
actacatactgaaggatttg

SEQ ID NO: 463331 - DNA, 20 bp, Artificial Sequence
  chemically synthesized
aactacatactgaaggattt

SEQ ID NO: 463332 - DNA, 20 bp, Artificial Sequence
  chemically synthesized
ttcgccaaccccaaatcctt

SEQ ID NO: 463333 - DNA, 20 bp, Artificial Sequence
  chemically synthesized
gaactacatactgaaggatt

SEQ ID NO: 463334 - DNA, 20 bp, Artificial Sequence
  chemically synthesized
aaatgagaactacatactga

SEQ ID NO: 463335 - DNA, 20 bp, Artificial Sequence
  chemically synthesized
accccaaatccttcagtatg

SEQ ID NO: 463336 - DNA, 20 bp, Artificial Sequence
  chemically synthesized
aaaatgagaactacatactg

SEQ ID NO: 463337 - DNA, 20 bp, Artificial Sequence
  chemically synthesized
ctgaattttcatcagaaaat

SEQ ID NO: 463338 - DNA, 20 bp, Artificial Sequence
  chemically synthesized
tttttccactgaattttcat

SEQ ID NO: 463339 - DNA, 20 bp, Artificial Sequence
  chemically synthesized
ctcattttctgatgaaaatt

SEQ ID NO: 463340 - DNA, 20 bp, Artificial Sequence
  chemically synthesized
attttctgatgaaaattcag

SEQ ID NO: 463341 - DNA, 20 bp, Artificial Sequence
  chemically synthesized
tgaaaattcagtggaaaaaa

SEQ ID NO: 463342 - DNA, 20 bp, Artificial Sequence
  chemically synthesized
aaattcagtggaaaaaatgg

SEQ ID NO: 463343 - DNA, 20 bp, Artificial Sequence
  chemically synthesized
ttcagtggaaaaaatggaag

SEQ ID NO: 463344 - DNA, 20 bp, Artificial Sequence
  chemically synthesized
tagatatttgcttttaattt

SEQ ID NO: 463345 - DNA, 20 bp, Artificial Sequence
  chemically synthesized
taaagtatacctgaaattaa

SEQ ID NO: 463346 - DNA, 20 bp, Artificial Sequence
  chemically synthesized
agatatttgcttttaatttc

SEQ ID NO: 463347 - DNA, 20 bp, Artificial Sequence
  chemically synthesized
tgtgcagcatggttattgta

SEQ ID NO: 463348 - DNA, 20 bp, Artificial Sequence
  chemically synthesized
tttacaataaccatgctgca

SEQ ID NO: 463349 - DNA, 20 bp, Artificial Sequence
  chemically synthesized
cccaattgtactgtgcagca

SEQ ID NO: 463350 - DNA, 20 bp, Artificial Sequence
  chemically synthesized
aatcacccaattgtactgtg

SEQ ID NO: 463351 - DNA, 20 bp, Artificial Sequence
  chemically synthesized
accatgctgcacagtacaat

SEQ ID NO: 463352 - DNA, 20 bp, Artificial Sequence
  chemically synthesized
ccatgctgcacagtacaatt

SEQ ID NO: 463353 - DNA, 20 bp, Artificial Sequence
  chemically synthesized
gcacagtacaattgggtgat

SEQ ID NO: 463354 - DNA, 20 bp, Artificial Sequence
  chemically synthesized
atcactaatagaaaatgatg

SEQ ID NO: 463355 - DNA, 20 bp, Artificial Sequence
  chemically synthesized
tcatcactaatagaaaatga

SEQ ID NO: 463356 - DNA, 20 bp, Artificial Sequence
  chemically synthesized
tgaactccatcattttctat

SEQ ID NO: 463357 - DNA, 20 bp, Artificial Sequence
  chemically synthesized
ttgtcttgtttcatcactaa

SEQ ID NO: 463358 - DNA, 20 bp, Artificial Sequence
  chemically synthesized
ttttctattagtgatgaaac

SEQ ID NO: 463359 - DNA, 20 bp, Artificial Sequence
  chemically synthesized
gtgatgaaacaagacaaatg

SEQ ID NO: 463360 - DNA, 20 bp, Artificial Sequence
  chemically synthesized
agtaacacaaagcaaaaatg

SEQ ID NO: 463361 - DNA, 20 bp, Artificial Sequence
  chemically synthesized
catattggtaaagtaacaca

SEQ ID NO: 463362 - DNA, 20 bp, Artificial Sequence
  chemically synthesized
tggattcaggcatattggta

SEQ ID NO: 463363 - DNA, 20 bp, Artificial Sequence
  chemically synthesized
gtacatggattcaggcatat

SEQ ID NO: 463364 - DNA, 20 bp, Artificial Sequence
  chemically synthesized
tttataaggtacatggattc

SEQ ID NO: 463365 - DNA, 20 bp, Artificial Sequence
  chemically synthesized
gtttataaggtacatggatt

SEQ ID NO: 463366 - DNA, 20 bp, Artificial Sequence
  chemically synthesized
agtttcgtttataaggtaca

SEQ ID NO: 463367 - DNA, 20 bp, Artificial Sequence
  chemically synthesized
aattgacagtttcgtttata

SEQ ID NO: 463368 - DNA, 20 bp, Artificial Sequence
  chemically synthesized
aaattgacagtttcgtttat

SEQ ID NO: 463369 - DNA, 20 bp, Artificial Sequence
  chemically synthesized
ataatagaagagtaaattga

SEQ ID NO: 463370 - DNA, 20 bp, Artificial Sequence
  chemically synthesized
catcacctaaaataatagaa

SEQ ID NO: 463371 - DNA, 20 bp, Artificial Sequence
  chemically synthesized
atcatcacctaaaataatag

SEQ ID NO: 463372 - DNA, 20 bp, Artificial Sequence
  chemically synthesized
aatttactcttctattattt

SEQ ID NO: 463373 - DNA, 20 bp, Artificial Sequence
  chemically synthesized
atttactcttctattatttt

SEQ ID NO: 463374 - DNA, 20 bp, Artificial Sequence
  chemically synthesized
ggaatcatcacctaaaataa

SEQ ID NO: 463375 - DNA, 20 bp, Artificial Sequence
  chemically synthesized
ggtgatgattccattaaatt

SEQ ID NO: 463376 - DNA, 20 bp, Artificial Sequence
  chemically synthesized
ccccagaggtcttaatttaa

SEQ ID NO: 463377 - DNA, 20 bp, Artificial Sequence
  chemically synthesized
ttccattaaattaagacctc

SEQ ID NO: 463378 - DNA, 20 bp, Artificial Sequence
  chemically synthesized
tccattaaattaagacctct

SEQ ID NO: 463379 - DNA, 20 bp, Artificial Sequence
  chemically synthesized
ccattaaattaagacctctg

SEQ ID NO: 463380 - DNA, 20 bp, Artificial Sequence
  chemically synthesized
attaaattaagacctctggg

SEQ ID NO: 463381 - DNA, 20 bp, Artificial Sequence
  chemically synthesized
ttaaattaagacctctgggg

SEQ ID NO: 463382 - DNA, 20 bp, Artificial Sequence
  chemically synthesized
cttacacatgacctccccag

SEQ ID NO: 463383 - DNA, 20 bp, Artificial Sequence
  chemically synthesized
acttacacatgacctcccca

SEQ ID NO: 463384 - DNA, 20 bp, Artificial Sequence
  chemically synthesized
tgacttacacatgacctccc

SEQ ID NO: 463385 - DNA, 20 bp, Artificial Sequence
  chemically synthesized
cctctggggaggtcatgtgt

SEQ ID NO: 463386 - DNA, 20 bp, Artificial Sequence
  chemically synthesized
gaggtcatgtgtaagtcaca

SEQ ID NO: 463387 - DNA, 20 bp, Artificial Sequence
  chemically synthesized
aggtcatgtgtaagtcacaa

SEQ ID NO: 463388 - DNA, 20 bp, Artificial Sequence
  chemically synthesized
tgtgtaagtcacaaaggaaa

SEQ ID NO: 463389 - DNA, 20 bp, Artificial Sequence
  chemically synthesized
tgtaagtcacaaaggaaata

SEQ ID NO: 463390 - DNA, 20 bp, Artificial Sequence
  chemically synthesized
taccctacatggtattttaa

SEQ ID NO: 463391 - DNA, 20 bp, Artificial Sequence
  chemically synthesized
ttaccctacatggtatttta

SEQ ID NO: 463392 - DNA, 20 bp, Artificial Sequence
  chemically synthesized
agagcctttaaaataccatg

SEQ ID NO: 463393 - DNA, 20 bp, Artificial Sequence
  chemically synthesized
gagcctttaaaataccatgt

SEQ ID NO: 463394 - DNA, 20 bp, Artificial Sequence
  chemically synthesized
agcctttaaaataccatgta

SEQ ID NO: 463395 - DNA, 20 bp, Artificial Sequence
  chemically synthesized
ggtatgatagttaccctaca

SEQ ID NO: 463396 - DNA, 20 bp, Artificial Sequence
  chemically synthesized
atttagttatgatggtatga

SEQ ID NO: 463397 - DNA, 20 bp, Artificial Sequence
  chemically synthesized
gtcgggatatttagttatga

SEQ ID NO: 463398 - DNA, 20 bp, Artificial Sequence
  chemically synthesized
accgtaaaagtcgggatatt

SEQ ID NO: 463399 - DNA, 20 bp, Artificial Sequence
  chemically synthesized
tatttcacaccgtaaaagtc

SEQ ID NO: 463400 - DNA, 20 bp, Artificial Sequence
  chemically synthesized
actaaatatcccgactttta

SEQ ID NO: 463401 - DNA, 20 bp, Artificial Sequence
  chemically synthesized
ctatttcacaccgtaaaagt

SEQ ID NO: 463402 - DNA, 20 bp, Artificial Sequence
  chemically synthesized
ttgtctatttcacaccgtaa

SEQ ID NO: 463403 - DNA, 20 bp, Artificial Sequence
  chemically synthesized
ccgacttttacggtgtgaaa

SEQ ID NO: 463404 - DNA, 20 bp, Artificial Sequence
  chemically synthesized
cggtgtgaaatagacaaaaa

SEQ ID NO: 463405 - DNA, 20 bp, Artificial Sequence
  chemically synthesized
aatagacaaaaatggtaact

SEQ ID NO: 463406 - DNA, 20 bp, Artificial Sequence
  chemically synthesized
atagacaaaaatggtaactt

SEQ ID NO: 463407 - DNA, 20 bp, Artificial Sequence
  chemically synthesized
ttagggaaatgcgttgaccc

SEQ ID NO: 463408 - DNA, 20 bp, Artificial Sequence
  chemically synthesized
attcctcctcattcagttta

SEQ ID NO: 463409 - DNA, 20 bp, Artificial Sequence
  chemically synthesized
gattcctcctcattcagttt

SEQ ID NO: 463410 - DNA, 20 bp, Artificial Sequence
  chemically synthesized
agattcctcctcattcagtt

SEQ ID NO: 463411 - DNA, 20 bp, Artificial Sequence
  chemically synthesized
cgcatttccctaaactgaat

SEQ ID NO: 463412 - DNA, 20 bp, Artificial Sequence
  chemically synthesized
gcatttccctaaactgaatg

SEQ ID NO: 463413 - DNA, 20 bp, Artificial Sequence
  chemically synthesized
atttccctaaactgaatgag

SEQ ID NO: 463414 - DNA, 20 bp, Artificial Sequence
  chemically synthesized
tttccctaaactgaatgagg

SEQ ID NO: 463415 - DNA, 20 bp, Artificial Sequence
  chemically synthesized
tgtcaagattcctcctcatt

SEQ ID NO: 463416 - DNA, 20 bp, Artificial Sequence
  chemically synthesized
atgaggaggaatcttgacaa

SEQ ID NO: 463417 - DNA, 20 bp, Artificial Sequence
  chemically synthesized
acacgagcagtactattgtc

SEQ ID NO: 463418 - DNA, 20 bp, Artificial Sequence
  chemically synthesized
tactaaccatagtacacgag

SEQ ID NO: 463419 - DNA, 20 bp, Artificial Sequence
  chemically synthesized
tattactaaccatagtacac

SEQ ID NO: 463420 - DNA, 20 bp, Artificial Sequence
  chemically synthesized
atagtactgctcgtgtacta

SEQ ID NO: 463421 - DNA, 20 bp, Artificial Sequence
  chemically synthesized
tactgctcgtgtactatggt

SEQ ID NO: 463422 - DNA, 20 bp, Artificial Sequence
  chemically synthesized
ccctctaatattactaacca

SEQ ID NO: 463423 - DNA, 20 bp, Artificial Sequence
  chemically synthesized
tgtactatggttagtaatat

SEQ ID NO: 463424 - DNA, 20 bp, Artificial Sequence
  chemically synthesized
tactatggttagtaatatta

SEQ ID NO: 463425 - DNA, 20 bp, Artificial Sequence
  chemically synthesized
actatggttagtaatattag

SEQ ID NO: 463426 - DNA, 20 bp, Artificial Sequence
  chemically synthesized
ctatggttagtaatattaga

SEQ ID NO: 463427 - DNA, 20 bp, Artificial Sequence
  chemically synthesized
tggttagtaatattagaggg

SEQ ID NO: 463428 - DNA, 20 bp, Artificial Sequence
  chemically synthesized
ttagtaatattagagggaag

SEQ ID NO: 463429 - DNA, 20 bp, Artificial Sequence
  chemically synthesized
tagtaatattagagggaaga

SEQ ID NO: 463430 - DNA, 20 bp, Artificial Sequence
  chemically synthesized
tagagggaagaaggatgcaa

SEQ ID NO: 463431 - DNA, 20 bp, Artificial Sequence
  chemically synthesized
caatggaaatgatgtcacct

SEQ ID NO: 463432 - DNA, 20 bp, Artificial Sequence
  chemically synthesized
aatggaaatgatgtcacctt

SEQ ID NO: 463433 - DNA, 20 bp, Artificial Sequence
  chemically synthesized
agacatttgtttgagtccta

SEQ ID NO: 463434 - DNA, 20 bp, Artificial Sequence
  chemically synthesized
aagacatttgtttgagtcct

SEQ ID NO: 463435 - DNA, 20 bp, Artificial Sequence
  chemically synthesized
agccagtaagacatttgttt

SEQ ID NO: 463436 - DNA, 20 bp, Artificial Sequence
  chemically synthesized
gactcaaacaaatgtcttac

SEQ ID NO: 463437 - DNA, 20 bp, Artificial Sequence
  chemically synthesized
taatgagttacacagccagt

SEQ ID NO: 463438 - DNA, 20 bp, Artificial Sequence
  chemically synthesized
gtagtaatgagttacacagc

SEQ ID NO: 463439 - DNA, 20 bp, Artificial Sequence
  chemically synthesized
taaagtagtaatgagttaca

SEQ ID NO: 463440 - DNA, 20 bp, Artificial Sequence
  chemically synthesized
gtttaacttaaagtagtaat

SEQ ID NO: 463441 - DNA, 20 bp, Artificial Sequence
  chemically synthesized
gtgtaactcattactacttt

SEQ ID NO: 463442 - DNA, 20 bp, Artificial Sequence
  chemically synthesized
tactcaagtttaacttaaag

SEQ ID NO: 463443 - DNA, 20 bp, Artificial Sequence
  chemically synthesized
agctactcaagtttaactta

SEQ ID NO: 463444 - DNA, 20 bp, Artificial Sequence
  chemically synthesized
tactactttaagttaaactt

SEQ ID NO: 463445 - DNA, 20 bp, Artificial Sequence
  chemically synthesized
tactttaagttaaacttgag

SEQ ID NO: 463446 - DNA, 20 bp, Artificial Sequence
  chemically synthesized
tcttctggagggagctactc

SEQ ID NO: 463447 - DNA, 20 bp, Artificial Sequence
  chemically synthesized
taaacttgagtagctccctc

SEQ ID NO: 463448 - DNA, 20 bp, Artificial Sequence
  chemically synthesized
acttgagtagctccctccag

SEQ ID NO: 463449 - DNA, 20 bp, Artificial Sequence
  chemically synthesized
ttgcttagctcttctggagg

SEQ ID NO: 463450 - DNA, 20 bp, Artificial Sequence
  chemically synthesized
ttgagtagctccctccagaa

SEQ ID NO: 463451 - DNA, 20 bp, Artificial Sequence
  chemically synthesized
ctttgcttagctcttctgga

SEQ ID NO: 463452 - DNA, 20 bp, Artificial Sequence
  chemically synthesized
cctttgcttagctcttctgg

SEQ ID NO: 463453 - DNA, 20 bp, Artificial Sequence
  chemically synthesized
ccctttgcttagctcttctg

SEQ ID NO: 463454 - DNA, 20 bp, Artificial Sequence
  chemically synthesized
taccctttgcttagctcttc

SEQ ID NO: 463455 - DNA, 20 bp, Artificial Sequence
  chemically synthesized
tagctccctccagaagagct

SEQ ID NO: 463456 - DNA, 20 bp, Artificial Sequence
  chemically synthesized
ccctccagaagagctaagca

SEQ ID NO: 463457 - DNA, 20 bp, Artificial Sequence
  chemically synthesized
cctccagaagagctaagcaa

SEQ ID NO: 463458 - DNA, 20 bp, Artificial Sequence
  chemically synthesized
ctccagaagagctaagcaaa

SEQ ID NO: 463459 - DNA, 20 bp, Artificial Sequence
  chemically synthesized
ttttttttttaccctttgct

SEQ ID NO: 463460 - DNA, 20 bp, Artificial Sequence
  chemically synthesized
gcaaagggtaaaaaaaaaaa

SEQ ID NO: 463461 - DNA, 20 bp, Artificial Sequence
  chemically synthesized
gggtaaaaaaaaaaaaagaa

SEQ ID NO: 463462 - DNA, 20 bp, Artificial Sequence
  chemically synthesized
gtaaaaaaaaaaaaagaata

SEQ ID NO: 463463 - DNA, 20 bp, Artificial Sequence
  chemically synthesized
aaaaaagaatagagaattca

SEQ ID NO: 463464 - DNA, 20 bp, Artificial Sequence
  chemically synthesized
aatagagaattcatggccct

SEQ ID NO: 463465 - DNA, 20 bp, Artificial Sequence
  chemically synthesized
atagagaattcatggccctc

SEQ ID NO: 463466 - DNA, 20 bp, Artificial Sequence
  chemically synthesized
cataaactattagtgcctga

SEQ ID NO: 463467 - DNA, 20 bp, Artificial Sequence
  chemically synthesized
tcataaactattagtgcctg

SEQ ID NO: 463468 - DNA, 20 bp, Artificial Sequence
  chemically synthesized
ttcataaactattagtgcct

SEQ ID NO: 463469 - DNA, 20 bp, Artificial Sequence
  chemically synthesized
tcatggccctcaggcactaa

SEQ ID NO: 463470 - DNA, 20 bp, Artificial Sequence
  chemically synthesized
ttgatttattcataaactat

SEQ ID NO: 463471 - DNA, 20 bp, Artificial Sequence
  chemically synthesized
gaataaatcaataacctgaa

SEQ ID NO: 463472 - DNA, 20 bp, Artificial Sequence
  chemically synthesized
tttgctgtgatgtacttttc

SEQ ID NO: 463473 - DNA, 20 bp, Artificial Sequence
  chemically synthesized
ttttgctgtgatgtactttt

SEQ ID NO: 463474 - DNA, 20 bp, Artificial Sequence
  chemically synthesized
ataacctgaaaagtacatca

SEQ ID NO: 463475 - DNA, 20 bp, Artificial Sequence
  chemically synthesized
aaagtacatcacagcaaaat

SEQ ID NO: 463476 - DNA, 20 bp, Artificial Sequence
  chemically synthesized
gtacatcacagcaaaataag

SEQ ID NO: 463477 - DNA, 20 bp, Artificial Sequence
  chemically synthesized
agcaaaataagtggtgaaac

SEQ ID NO: 463478 - DNA, 20 bp, Artificial Sequence
  chemically synthesized
ataagtggtgaaacaagtat

SEQ ID NO: 463479 - DNA, 20 bp, Artificial Sequence
  chemically synthesized
taagtggtgaaacaagtatt

SEQ ID NO: 463480 - DNA, 20 bp, Artificial Sequence
  chemically synthesized
gtggtgaaacaagtattagg

SEQ ID NO: 463481 - DNA, 20 bp, Artificial Sequence
  chemically synthesized
tattaggaagattctatgca

SEQ ID NO: 463482 - DNA, 20 bp, Artificial Sequence
  chemically synthesized
attaggaagattctatgcac

SEQ ID NO: 463483 - DNA, 20 bp, Artificial Sequence
  chemically synthesized
ttaggaagattctatgcaca

SEQ ID NO: 463484 - DNA, 20 bp, Artificial Sequence
  chemically synthesized
taggaagattctatgcacag

SEQ ID NO: 463485 - DNA, 20 bp, Artificial Sequence
  chemically synthesized
gaatcatgcacccctgtgca

SEQ ID NO: 463486 - DNA, 20 bp, Artificial Sequence
  chemically synthesized
atgcacaggggtgcatgatt

SEQ ID NO: 463487 - DNA, 20 bp, Artificial Sequence
  chemically synthesized
ggggtgcatgattcagccaa

SEQ ID NO: 463488 - DNA, 20 bp, Artificial Sequence
  chemically synthesized
gcatgattcagccaaaagta

SEQ ID NO: 463489 - DNA, 20 bp, Artificial Sequence
  chemically synthesized
tagtgcctcttctttacttt

SEQ ID NO: 463490 - DNA, 20 bp, Artificial Sequence
  chemically synthesized
tgattcagccaaaagtaaag

SEQ ID NO: 463491 - DNA, 20 bp, Artificial Sequence
  chemically synthesized
attcagccaaaagtaaagaa

SEQ ID NO: 463492 - DNA, 20 bp, Artificial Sequence
  chemically synthesized
ttcagccaaaagtaaagaag

SEQ ID NO: 463493 - DNA, 20 bp, Artificial Sequence
  chemically synthesized
caaaagtaaagaagaggcac

SEQ ID NO: 463494 - DNA, 20 bp, Artificial Sequence
  chemically synthesized
atcctccaaaatagtgtagc

SEQ ID NO: 463495 - DNA, 20 bp, Artificial Sequence
  chemically synthesized
tataatcctccaaaatagtg

SEQ ID NO: 463496 - DNA, 20 bp, Artificial Sequence
  chemically synthesized
aggcactagctacactattt

SEQ ID NO: 463497 - DNA, 20 bp, Artificial Sequence
  chemically synthesized
gcactagctacactattttg

SEQ ID NO: 463498 - DNA, 20 bp, Artificial Sequence
  chemically synthesized
cactagctacactattttgg

SEQ ID NO: 463499 - DNA, 20 bp, Artificial Sequence
  chemically synthesized
tgctttataatcctccaaaa

SEQ ID NO: 463500 - DNA, 20 bp, Artificial Sequence
  chemically synthesized
cactattttggaggattata

SEQ ID NO: 463501 - DNA, 20 bp, Artificial Sequence
  chemically synthesized
aggattataaagcatgtacc

SEQ ID NO: 463502 - DNA, 20 bp, Artificial Sequence
  chemically synthesized
cttattcacatatatttact

SEQ ID NO: 463503 - DNA, 20 bp, Artificial Sequence
  chemically synthesized
ccaagtaaatatatgtgaat

SEQ ID NO: 463504 - DNA, 20 bp, Artificial Sequence
  chemically synthesized
ataagaattgtttatgactg

SEQ ID NO: 463505 - DNA, 20 bp, Artificial Sequence
  chemically synthesized
taagaattgtttatgactgt

SEQ ID NO: 463506 - DNA, 20 bp, Artificial Sequence
  chemically synthesized
aattgtttatgactgtggga

SEQ ID NO: 463507 - DNA, 20 bp, Artificial Sequence
  chemically synthesized
ttgtttatgactgtgggatg

SEQ ID NO: 463508 - DNA, 20 bp, Artificial Sequence
  chemically synthesized
gaaatgttgactccatccca

SEQ ID NO: 463509 - DNA, 20 bp, Artificial Sequence
  chemically synthesized
ggatggagtcaacatttcca

SEQ ID NO: 463510 - DNA, 20 bp, Artificial Sequence
  chemically synthesized
gatggagtcaacatttccaa

SEQ ID NO: 463511 - DNA, 20 bp, Artificial Sequence
  chemically synthesized
acttccttttcatgtgcctt

SEQ ID NO: 463512 - DNA, 20 bp, Artificial Sequence
  chemically synthesized
catttccaaaggcacatgaa

SEQ ID NO: 463513 - DNA, 20 bp, Artificial Sequence
  chemically synthesized
atttccaaaggcacatgaaa

SEQ ID NO: 463514 - DNA, 20 bp, Artificial Sequence
  chemically synthesized
tccaaaggcacatgaaaagg

SEQ ID NO: 463515 - DNA, 20 bp, Artificial Sequence
  chemically synthesized
catgaaaaggaagtgtgtta

SEQ ID NO: 463516 - DNA, 20 bp, Artificial Sequence
  chemically synthesized
aaaaggaagtgtgttacagt

SEQ ID NO: 463517 - DNA, 20 bp, Artificial Sequence
  chemically synthesized
aaggaagtgtgttacagtca

SEQ ID NO: 463518 - DNA, 20 bp, Artificial Sequence
  chemically synthesized
cagtcagagaactgtttgta

SEQ ID NO: 463519 - DNA, 20 bp, Artificial Sequence
  chemically synthesized
cctcaccctagccatacaaa

SEQ ID NO: 463520 - DNA, 20 bp, Artificial Sequence
  chemically synthesized
cagagaactgtttgtatggc

SEQ ID NO: 463521 - DNA, 20 bp, Artificial Sequence
  chemically synthesized
agagaactgtttgtatggct

SEQ ID NO: 463522 - DNA, 20 bp, Artificial Sequence
  chemically synthesized
gagaactgtttgtatggcta

SEQ ID NO: 463523 - DNA, 20 bp, Artificial Sequence
  chemically synthesized
actgtttgtatggctagggt

SEQ ID NO: 463524 - DNA, 20 bp, Artificial Sequence
  chemically synthesized
ctgtttgtatggctagggtg

SEQ ID NO: 463525 - DNA, 20 bp, Artificial Sequence
  chemically synthesized
accatgtgaatgcctcaccc

SEQ ID NO: 463526 - DNA, 20 bp, Artificial Sequence
  chemically synthesized
gctagggtgaggcattcaca

SEQ ID NO: 463527 - DNA, 20 bp, Artificial Sequence
  chemically synthesized
agggtgaggcattcacatgg

SEQ ID NO: 463528 - DNA, 20 bp, Artificial Sequence
  chemically synthesized
ggcattcacatggtggatat

SEQ ID NO: 463529 - DNA, 20 bp, Artificial Sequence
  chemically synthesized
tcacatggtggatataagat

SEQ ID NO: 463530 - DNA, 20 bp, Artificial Sequence
  chemically synthesized
ggtggatataagattagact

SEQ ID NO: 463531 - DNA, 20 bp, Artificial Sequence
  chemically synthesized
ataagattagactgagcaca

SEQ ID NO: 463532 - DNA, 20 bp, Artificial Sequence
  chemically synthesized
caatttccctgccatgtgct

SEQ ID NO: 463533 - DNA, 20 bp, Artificial Sequence
  chemically synthesized
agattagactgagcacatgg

SEQ ID NO: 463534 - DNA, 20 bp, Artificial Sequence
  chemically synthesized
gattagactgagcacatggc

SEQ ID NO: 463535 - DNA, 20 bp, Artificial Sequence
  chemically synthesized
attagactgagcacatggca

SEQ ID NO: 463536 - DNA, 20 bp, Artificial Sequence
  chemically synthesized
atggcagggaaattgttgta

SEQ ID NO: 463537 - DNA, 20 bp, Artificial Sequence
  chemically synthesized
aaataacttgcatgaagaga

SEQ ID NO: 463538 - DNA, 20 bp, Artificial Sequence
  chemically synthesized
caaataacttgcatgaagag

SEQ ID NO: 463539 - DNA, 20 bp, Artificial Sequence
  chemically synthesized
aaagtaccttctcttcatgc

SEQ ID NO: 463540 - DNA, 20 bp, Artificial Sequence
  chemically synthesized
attcaaataacttgcatgaa

SEQ ID NO: 463541 - DNA, 20 bp, Artificial Sequence
  chemically synthesized
taattcaaataacttgcatg

SEQ ID NO: 463542 - DNA, 20 bp, Artificial Sequence
  chemically synthesized
aggtggctttatattattta

SEQ ID NO: 463543 - DNA, 20 bp, Artificial Sequence
  chemically synthesized
tataatctataaataatata

SEQ ID NO: 463544 - DNA, 20 bp, Artificial Sequence
  chemically synthesized
aaataatataaagccacctg

SEQ ID NO: 463545 - DNA, 20 bp, Artificial Sequence
  chemically synthesized
cactgcttaaagtccacagg

SEQ ID NO: 463546 - DNA, 20 bp, Artificial Sequence
  chemically synthesized
ttccactgcttaaagtccac

SEQ ID NO: 463547 - DNA, 20 bp, Artificial Sequence
  chemically synthesized
attccactgcttaaagtcca

SEQ ID NO: 463548 - DNA, 20 bp, Artificial Sequence
  chemically synthesized
taaagccacctgtggacttt

SEQ ID NO: 463549 - DNA, 20 bp, Artificial Sequence
  chemically synthesized
agccacctgtggactttaag

SEQ ID NO: 463550 - DNA, 20 bp, Artificial Sequence
  chemically synthesized
cacctgtggactttaagcag

SEQ ID NO: 463551 - DNA, 20 bp, Artificial Sequence
  chemically synthesized
ataagttattccactgctta

SEQ ID NO: 463552 - DNA, 20 bp, Artificial Sequence
  chemically synthesized
aagcagtggaataacttatt

SEQ ID NO: 463553 - DNA, 20 bp, Artificial Sequence
  chemically synthesized
tctcaaagacaaaacttaat

SEQ ID NO: 463554 - DNA, 20 bp, Artificial Sequence
  chemically synthesized
acttattaagttttgtcttt

SEQ ID NO: 463555 - DNA, 20 bp, Artificial Sequence
  chemically synthesized
ttattaagttttgtctttga

SEQ ID NO: 463556 - DNA, 20 bp, Artificial Sequence
  chemically synthesized
attaagttttgtctttgaga

SEQ ID NO: 463557 - DNA, 20 bp, Artificial Sequence
  chemically synthesized
tgctaggcttatctctctca

SEQ ID NO: 463558 - DNA, 20 bp, Artificial Sequence
  chemically synthesized
gttttgtctttgagagagat

SEQ ID NO: 463559 - DNA, 20 bp, Artificial Sequence
  chemically synthesized
gtctttgagagagataagcc

SEQ ID NO: 463560 - DNA, 20 bp, Artificial Sequence
  chemically synthesized
tttgagagagataagcctag

SEQ ID NO: 463561 - DNA, 20 bp, Artificial Sequence
  chemically synthesized
ttacccttcacaaggctgct

SEQ ID NO: 463562 - DNA, 20 bp, Artificial Sequence
  chemically synthesized
tttacccttcacaaggctgc

SEQ ID NO: 463563 - DNA, 20 bp, Artificial Sequence
  chemically synthesized
ataagcctagcagccttgtg

SEQ ID NO: 463564 - DNA, 20 bp, Artificial Sequence
  chemically synthesized
taagcctagcagccttgtga

SEQ ID NO: 463565 - DNA, 20 bp, Artificial Sequence
  chemically synthesized
aagcctagcagccttgtgaa

SEQ ID NO: 463566 - DNA, 20 bp, Artificial Sequence
  chemically synthesized
tctccagtttacccttcaca

SEQ ID NO: 463567 - DNA, 20 bp, Artificial Sequence
  chemically synthesized
ctctccagtttacccttcac

SEQ ID NO: 463568 - DNA, 20 bp, Artificial Sequence
  chemically synthesized
cagccttgtgaagggtaaac

SEQ ID NO: 463569 - DNA, 20 bp, Artificial Sequence
  chemically synthesized
gccttgtgaagggtaaactg

SEQ ID NO: 463570 - DNA, 20 bp, Artificial Sequence
  chemically synthesized
cttgtgaagggtaaactgga

SEQ ID NO: 463571 - DNA, 20 bp, Artificial Sequence
  chemically synthesized
gtgaagggtaaactggagag

SEQ ID NO: 463572 - DNA, 20 bp, Artificial Sequence
  chemically synthesized
ccttccttcttgcttctctc

SEQ ID NO: 463573 - DNA, 20 bp, Artificial Sequence
  chemically synthesized
agggtaaactggagagaagc

SEQ ID NO: 463574 - DNA, 20 bp, Artificial Sequence
  chemically synthesized
gtaaactggagagaagcaag

SEQ ID NO: 463575 - DNA, 20 bp, Artificial Sequence
  chemically synthesized
taaactggagagaagcaaga

SEQ ID NO: 463576 - DNA, 20 bp, Artificial Sequence
  chemically synthesized
actggagagaagcaagaagg

SEQ ID NO: 463577 - DNA, 20 bp, Artificial Sequence
  chemically synthesized
ctggagagaagcaagaagga

SEQ ID NO: 463578 - DNA, 20 bp, Artificial Sequence
  chemically synthesized
aagcaagaaggaaggtacat

SEQ ID NO: 463579 - DNA, 20 bp, Artificial Sequence
  chemically synthesized
agcaagaaggaaggtacatt

SEQ ID NO: 463580 - DNA, 20 bp, Artificial Sequence
  chemically synthesized
aagaaggaaggtacattagg

SEQ ID NO: 463581 - DNA, 20 bp, Artificial Sequence
  chemically synthesized
aaggtacattaggaagctat

SEQ ID NO: 463582 - DNA, 20 bp, Artificial Sequence
  chemically synthesized
tctgacttcgaatacactga

SEQ ID NO: 463583 - DNA, 20 bp, Artificial Sequence
  chemically synthesized
ggaagctatcagtgtattcg

SEQ ID NO: 463584 - DNA, 20 bp, Artificial Sequence
  chemically synthesized
gctatcagtgtattcgaagt

SEQ ID NO: 463585 - DNA, 20 bp, Artificial Sequence
  chemically synthesized
agtgtattcgaagtcagata

SEQ ID NO: 463586 - DNA, 20 bp, Artificial Sequence
  chemically synthesized
gtgtattcgaagtcagatat

SEQ ID NO: 463587 - DNA, 20 bp, Artificial Sequence
  chemically synthesized
tgtattcgaagtcagatatg

SEQ ID NO: 463588 - DNA, 20 bp, Artificial Sequence
  chemically synthesized
cagatatggggatctaaact

SEQ ID NO: 463589 - DNA, 20 bp, Artificial Sequence
  chemically synthesized
agatatggggatctaaacta

SEQ ID NO: 463590 - DNA, 20 bp, Artificial Sequence
  chemically synthesized
tgacagtcaccaccttagtt

SEQ ID NO: 463591 - DNA, 20 bp, Artificial Sequence
  chemically synthesized
tatggggatctaaactaagg

SEQ ID NO: 463592 - DNA, 20 bp, Artificial Sequence
  chemically synthesized
tctcctgacagtcaccacct

SEQ ID NO: 463593 - DNA, 20 bp, Artificial Sequence
  chemically synthesized
taaactaaggtggtgactgt

SEQ ID NO: 463594 - DNA, 20 bp, Artificial Sequence
  chemically synthesized
aaactaaggtggtgactgtc

SEQ ID NO: 463595 - DNA, 20 bp, Artificial Sequence
  chemically synthesized
actaaggtggtgactgtcag

SEQ ID NO: 463596 - DNA, 20 bp, Artificial Sequence
  chemically synthesized
cccccctccatatctcctga

SEQ ID NO: 463597 - DNA, 20 bp, Artificial Sequence
  chemically synthesized
gtggtgactgtcaggagata

SEQ ID NO: 463598 - DNA, 20 bp, Artificial Sequence
  chemically synthesized
ggtgactgtcaggagatatg

SEQ ID NO: 463599 - DNA, 20 bp, Artificial Sequence
  chemically synthesized
gtgactgtcaggagatatgg

SEQ ID NO: 463600 - DNA, 20 bp, Artificial Sequence
  chemically synthesized
tgactgtcaggagatatgga

SEQ ID NO: 463601 - DNA, 20 bp, Artificial Sequence
  chemically synthesized
gactgtcaggagatatggag

SEQ ID NO: 463602 - DNA, 20 bp, Artificial Sequence
  chemically synthesized
actgtcaggagatatggagg

SEQ ID NO: 463603 - DNA, 20 bp, Artificial Sequence
  chemically synthesized
ctgtcaggagatatggaggg

SEQ ID NO: 463604 - DNA, 20 bp, Artificial Sequence
  chemically synthesized
caggagatatggagggggga

SEQ ID NO: 463605 - DNA, 20 bp, Artificial Sequence
  chemically synthesized
gagatatggaggggggatgg

SEQ ID NO: 463606 - DNA, 20 bp, Artificial Sequence
  chemically synthesized
gatatggaggggggatggca

SEQ ID NO: 463607 - DNA, 20 bp, Artificial Sequence
  chemically synthesized
aggggggatggcagagctaa

SEQ ID NO: 463608 - DNA, 20 bp, Artificial Sequence
  chemically synthesized
tttgtatcctaaatttcttt

SEQ ID NO: 463609 - DNA, 20 bp, Artificial Sequence
  chemically synthesized
tggcagagctaaaagaaatt

SEQ ID NO: 463610 - DNA, 20 bp, Artificial Sequence
  chemically synthesized
ggcagagctaaaagaaattt

SEQ ID NO: 463611 - DNA, 20 bp, Artificial Sequence
  chemically synthesized
aaagaaatttaggatacaaa

SEQ ID NO: 463612 - DNA, 20 bp, Artificial Sequence
  chemically synthesized
aagaaatttaggatacaaat

SEQ ID NO: 463613 - DNA, 20 bp, Artificial Sequence
  chemically synthesized
gaaatttaggatacaaatag

SEQ ID NO: 463614 - DNA, 20 bp, Artificial Sequence
  chemically synthesized
aggatacaaataggagaaat

SEQ ID NO: 463615 - DNA, 20 bp, Artificial Sequence
  chemically synthesized
aataggagaaattagttaca

SEQ ID NO: 463616 - DNA, 20 bp, Artificial Sequence
  chemically synthesized
tagttacatggctctctata

SEQ ID NO: 463617 - DNA, 20 bp, Artificial Sequence
  chemically synthesized
tcttatttcctctttataga

SEQ ID NO: 463618 - DNA, 20 bp, Artificial Sequence
  chemically synthesized
gttacatggctctctataaa

SEQ ID NO: 463619 - DNA, 20 bp, Artificial Sequence
  chemically synthesized
ttacatggctctctataaag

SEQ ID NO: 463620 - DNA, 20 bp, Artificial Sequence
  chemically synthesized
agtcttatttcctctttata

SEQ ID NO: 463621 - DNA, 20 bp, Artificial Sequence
  chemically synthesized
gaagtcttatttcctcttta

SEQ ID NO: 463622 - DNA, 20 bp, Artificial Sequence
  chemically synthesized
gctctctataaagaggaaat

SEQ ID NO: 463623 - DNA, 20 bp, Artificial Sequence
  chemically synthesized
tatgaggtaagcaaggtagg

SEQ ID NO: 463624 - DNA, 20 bp, Artificial Sequence
  chemically synthesized
ccatatgaggtaagcaaggt

SEQ ID NO: 463625 - DNA, 20 bp, Artificial Sequence
  chemically synthesized
accatatgaggtaagcaagg

SEQ ID NO: 463626 - DNA, 20 bp, Artificial Sequence
  chemically synthesized
ggaaccatatgaggtaagca

SEQ ID NO: 463627 - DNA, 20 bp, Artificial Sequence
  chemically synthesized
aggaaccatatgaggtaagc

SEQ ID NO: 463628 - DNA, 20 bp, Artificial Sequence
  chemically synthesized
acataggaaccatatgaggt

SEQ ID NO: 463629 - DNA, 20 bp, Artificial Sequence
  chemically synthesized
cctaccttgcttacctcata

SEQ ID NO: 463630 - DNA, 20 bp, Artificial Sequence
  chemically synthesized
attcacataggaaccatatg

SEQ ID NO: 463631 - DNA, 20 bp, Artificial Sequence
  chemically synthesized
tattcacataggaaccatat

SEQ ID NO: 463632 - DNA, 20 bp, Artificial Sequence
  chemically synthesized
caagtttaatttattcacat

SEQ ID NO: 463633 - DNA, 20 bp, Artificial Sequence
  chemically synthesized
tcaagtttaatttattcaca

SEQ ID NO: 463634 - DNA, 20 bp, Artificial Sequence
  chemically synthesized
tgtgaataaattaaacttga

SEQ ID NO: 463635 - DNA, 20 bp, Artificial Sequence
  chemically synthesized
aaaattaacaaaatactttc

SEQ ID NO: 463636 - DNA, 20 bp, Artificial Sequence
  chemically synthesized
aaagtattttgttaatttta

SEQ ID NO: 463637 - DNA, 20 bp, Artificial Sequence
  chemically synthesized
cttaattccttaaatgtata

SEQ ID NO: 463638 - DNA, 20 bp, Artificial Sequence
  chemically synthesized
ttttaaagctttatacattt

SEQ ID NO: 463639 - DNA, 20 bp, Artificial Sequence
  chemically synthesized
tttaaagctttatacattta

SEQ ID NO: 463640 - DNA, 20 bp, Artificial Sequence
  chemically synthesized
ctttatacatttaaggaatt

SEQ ID NO: 463641 - DNA, 20 bp, Artificial Sequence
  chemically synthesized
tttaaggaattaagattatc

SEQ ID NO: 463642 - DNA, 20 bp, Artificial Sequence
  chemically synthesized
aacaagtacatttaattcat

SEQ ID NO: 463643 - DNA, 20 bp, Artificial Sequence
  chemically synthesized
aataggaatgtcaataaaac

SEQ ID NO: 463644 - DNA, 20 bp, Artificial Sequence
  chemically synthesized
ttcactgtatgtgaacaaat

SEQ ID NO: 463645 - DNA, 20 bp, Artificial Sequence
  chemically synthesized
tttcactgtatgtgaacaaa

SEQ ID NO: 463646 - DNA, 20 bp, Artificial Sequence
  chemically synthesized
cattcctatttgttcacata

SEQ ID NO: 463647 - DNA, 20 bp, Artificial Sequence
  chemically synthesized
gtaagtgaagcaaatgttta

SEQ ID NO: 463648 - DNA, 20 bp, Artificial Sequence
  chemically synthesized
ttcctcttaaggagtaagtg

SEQ ID NO: 463649 - DNA, 20 bp, Artificial Sequence
  chemically synthesized
atttgcttcacttactcctt

SEQ ID NO: 463650 - DNA, 20 bp, Artificial Sequence
  chemically synthesized
ctactttcctcttaaggagt

SEQ ID NO: 463651 - DNA, 20 bp, Artificial Sequence
  chemically synthesized
ttgcttcacttactccttaa

SEQ ID NO: 463652 - DNA, 20 bp, Artificial Sequence
  chemically synthesized
tgcttcacttactccttaag

SEQ ID NO: 463653 - DNA, 20 bp, Artificial Sequence
  chemically synthesized
catgctactttcctcttaag

SEQ ID NO: 463654 - DNA, 20 bp, Artificial Sequence
  chemically synthesized
agcatgctactttcctctta

SEQ ID NO: 463655 - DNA, 20 bp, Artificial Sequence
  chemically synthesized
tcacttactccttaagagga

SEQ ID NO: 463656 - DNA, 20 bp, Artificial Sequence
  chemically synthesized
tagcatgctactttcctctt

SEQ ID NO: 463657 - DNA, 20 bp, Artificial Sequence
  chemically synthesized
cttactccttaagaggaaag

SEQ ID NO: 463658 - DNA, 20 bp, Artificial Sequence
  chemically synthesized
ttaagaggaaagtagcatgc

SEQ ID NO: 463659 - DNA, 20 bp, Artificial Sequence
  chemically synthesized
taagaggaaagtagcatgct

SEQ ID NO: 463660 - DNA, 20 bp, Artificial Sequence
  chemically synthesized
ttaaatccagatgagttacc

SEQ ID NO: 463661 - DNA, 20 bp, Artificial Sequence
  chemically synthesized
agcatgctaggtaactcatc

SEQ ID NO: 463662 - DNA, 20 bp, Artificial Sequence
  chemically synthesized
ttagaaatttaaatccagat

SEQ ID NO: 463663 - DNA, 20 bp, Artificial Sequence
  chemically synthesized
tccacttagaaatttaaatc

SEQ ID NO: 463664 - DNA, 20 bp, Artificial Sequence
  chemically synthesized
tcatctggatttaaatttct

SEQ ID NO: 463665 - DNA, 20 bp, Artificial Sequence
  chemically synthesized
tctggatttaaatttctaag

SEQ ID NO: 463666 - DNA, 20 bp, Artificial Sequence
  chemically synthesized
ggatttaaatttctaagtgg

SEQ ID NO: 463667 - DNA, 20 bp, Artificial Sequence
  chemically synthesized
tactcaatagtacttccact

SEQ ID NO: 463668 - DNA, 20 bp, Artificial Sequence
  chemically synthesized
ttctaagtggaagtactatt

SEQ ID NO: 463669 - DNA, 20 bp, Artificial Sequence
  chemically synthesized
catgcagagtagatactcaa

SEQ ID NO: 463670 - DNA, 20 bp, Artificial Sequence
  chemically synthesized
ttccctagcttcatgcagag

SEQ ID NO: 463671 - DNA, 20 bp, Artificial Sequence
  chemically synthesized
ttgagtatctactctgcatg

SEQ ID NO: 463672 - DNA, 20 bp, Artificial Sequence
  chemically synthesized
cacttccctagcttcatgca

SEQ ID NO: 463673 - DNA, 20 bp, Artificial Sequence
  chemically synthesized
cacacttccctagcttcatg

SEQ ID NO: 463674 - DNA, 20 bp, Artificial Sequence
  chemically synthesized
gtatctactctgcatgaagc

SEQ ID NO: 463675 - DNA, 20 bp, Artificial Sequence
  chemically synthesized
tatctactctgcatgaagct

SEQ ID NO: 463676 - DNA, 20 bp, Artificial Sequence
  chemically synthesized
atctactctgcatgaagcta

SEQ ID NO: 463677 - DNA, 20 bp, Artificial Sequence
  chemically synthesized
tactctgcatgaagctaggg

SEQ ID NO: 463678 - DNA, 20 bp, Artificial Sequence
  chemically synthesized
gtccccttgccacacttccc

SEQ ID NO: 463679 - DNA, 20 bp, Artificial Sequence
  chemically synthesized
tgcatgaagctagggaagtg

SEQ ID NO: 463680 - DNA, 20 bp, Artificial Sequence
  chemically synthesized
tgaagctagggaagtgtggc

SEQ ID NO: 463681 - DNA, 20 bp, Artificial Sequence
  chemically synthesized
gaagctagggaagtgtggca

SEQ ID NO: 463682 - DNA, 20 bp, Artificial Sequence
  chemically synthesized
aagctagggaagtgtggcaa

SEQ ID NO: 463683 - DNA, 20 bp, Artificial Sequence
  chemically synthesized
agctagggaagtgtggcaag

SEQ ID NO: 463684 - DNA, 20 bp, Artificial Sequence
  chemically synthesized
gaagtgtggcaaggggactc

SEQ ID NO: 463685 - DNA, 20 bp, Artificial Sequence
  chemically synthesized
gtggcaaggggactctagcc

SEQ ID NO: 463686 - DNA, 20 bp, Artificial Sequence
  chemically synthesized
tggcaaggggactctagcca

SEQ ID NO: 463687 - DNA, 20 bp, Artificial Sequence
  chemically synthesized
tatcttctagtccttggcta

SEQ ID NO: 463688 - DNA, 20 bp, Artificial Sequence
  chemically synthesized
tctatcttctagtccttggc

SEQ ID NO: 463689 - DNA, 20 bp, Artificial Sequence
  chemically synthesized
aggggactctagccaaggac

SEQ ID NO: 463690 - DNA, 20 bp, Artificial Sequence
  chemically synthesized
tctctctatcttctagtcct

SEQ ID NO: 463691 - DNA, 20 bp, Artificial Sequence
  chemically synthesized
ggactctagccaaggactag

SEQ ID NO: 463692 - DNA, 20 bp, Artificial Sequence
  chemically synthesized
tctagccaaggactagaaga

SEQ ID NO: 463693 - DNA, 20 bp, Artificial Sequence
  chemically synthesized
tagccaaggactagaagata

SEQ ID NO: 463694 - DNA, 20 bp, Artificial Sequence
  chemically synthesized
ctctcagtctctctatcttc

SEQ ID NO: 463695 - DNA, 20 bp, Artificial Sequence
  chemically synthesized
gccaaggactagaagataga

SEQ ID NO: 463696 - DNA, 20 bp, Artificial Sequence
  chemically synthesized
gactagaagatagagagact

SEQ ID NO: 463697 - DNA, 20 bp, Artificial Sequence
  chemically synthesized
ctagaagatagagagactga

SEQ ID NO: 463698 - DNA, 20 bp, Artificial Sequence
  chemically synthesized
aagatagagagactgagagc

SEQ ID NO: 463699 - DNA, 20 bp, Artificial Sequence
  chemically synthesized
cctgagaaacaacttgctct

SEQ ID NO: 463700 - DNA, 20 bp, Artificial Sequence
  chemically synthesized
actgagagcaagttgtttct

SEQ ID NO: 463701 - DNA, 20 bp, Artificial Sequence
  chemically synthesized
ctgagagcaagttgtttctc

SEQ ID NO: 463702 - DNA, 20 bp, Artificial Sequence
  chemically synthesized
gaagcattccacagatgcct

SEQ ID NO: 463703 - DNA, 20 bp, Artificial Sequence
  chemically synthesized
agttgtttctcaggcatctg

SEQ ID NO: 463704 - DNA, 20 bp, Artificial Sequence
  chemically synthesized
ttcattggagaagcattcca

SEQ ID NO: 463705 - DNA, 20 bp, Artificial Sequence
  chemically synthesized
ctctttcttgttcattggag

SEQ ID NO: 463706 - DNA, 20 bp, Artificial Sequence
  chemically synthesized
tttctctttcttgttcattg

SEQ ID NO: 463707 - DNA, 20 bp, Artificial Sequence
  chemically synthesized
ggaatgcttctccaatgaac

SEQ ID NO: 463708 - DNA, 20 bp, Artificial Sequence
  chemically synthesized
tctttctctttcttgttcat

SEQ ID NO: 463709 - DNA, 20 bp, Artificial Sequence
  chemically synthesized
tgcttctccaatgaacaaga

SEQ ID NO: 463710 - DNA, 20 bp, Artificial Sequence
  chemically synthesized
cttctccaatgaacaagaaa

SEQ ID NO: 463711 - DNA, 20 bp, Artificial Sequence
  chemically synthesized
tccaatgaacaagaaagaga

SEQ ID NO: 463712 - DNA, 20 bp, Artificial Sequence
  chemically synthesized
aagaaagagaaagaaatatt

SEQ ID NO: 463713 - DNA, 20 bp, Artificial Sequence
  chemically synthesized
attacttctcatgcatattt

SEQ ID NO: 463714 - DNA, 20 bp, Artificial Sequence
  chemically synthesized
tttggaactaaaatatgcat

SEQ ID NO: 463715 - DNA, 20 bp, Artificial Sequence
  chemically synthesized
ggaactaaaatatgcatgag

SEQ ID NO: 463716 - DNA, 20 bp, Artificial Sequence
  chemically synthesized
gcatgagaagtaatcaacct

SEQ ID NO: 463717 - DNA, 20 bp, Artificial Sequence
  chemically synthesized
agaagtaatcaaccttggaa

SEQ ID NO: 463718 - DNA, 20 bp, Artificial Sequence
  chemically synthesized
gaagtaatcaaccttggaat

SEQ ID NO: 463719 - DNA, 20 bp, Artificial Sequence
  chemically synthesized
ctttttagcaacctattcca

SEQ ID NO: 463720 - DNA, 20 bp, Artificial Sequence
  chemically synthesized
tctttttagcaacctattcc

SEQ ID NO: 463721 - DNA, 20 bp, Artificial Sequence
  chemically synthesized
ccttggaataggttgctaaa

SEQ ID NO: 463722 - DNA, 20 bp, Artificial Sequence
  chemically synthesized
aagaatcttttaattctttt

SEQ ID NO: 463723 - DNA, 20 bp, Artificial Sequence
  chemically synthesized
aggttgctaaaaagaattaa

SEQ ID NO: 463724 - DNA, 20 bp, Artificial Sequence
  chemically synthesized
aattaaaagattcttataat

SEQ ID NO: 463725 - DNA, 20 bp, Artificial Sequence
  chemically synthesized
ttagagactgaacttattat

SEQ ID NO: 463726 - DNA, 20 bp, Artificial Sequence
  chemically synthesized
aaagattcttataataagtt

SEQ ID NO: 463727 - DNA, 20 bp, Artificial Sequence
  chemically synthesized
taagttcagtctctaaatgc

SEQ ID NO: 463728 - DNA, 20 bp, Artificial Sequence
  chemically synthesized
ctaaacttttcttgcattta

SEQ ID NO: 463729 - DNA, 20 bp, Artificial Sequence
  chemically synthesized
tactaaacttttcttgcatt

SEQ ID NO: 463730 - DNA, 20 bp, Artificial Sequence
  chemically synthesized
tcagtctctaaatgcaagaa

SEQ ID NO: 463731 - DNA, 20 bp, Artificial Sequence
  chemically synthesized
ctctaaatgcaagaaaagtt

SEQ ID NO: 463732 - DNA, 20 bp, Artificial Sequence
  chemically synthesized
agaaaagtttagtaataatc

SEQ ID NO: 463733 - DNA, 20 bp, Artificial Sequence
  chemically synthesized
tttagtaataatctggtctc

SEQ ID NO: 463734 - DNA, 20 bp, Artificial Sequence
  chemically synthesized
gtgagttaatatccagagac

SEQ ID NO: 463735 - DNA, 20 bp, Artificial Sequence
  chemically synthesized
attaggtgagttaatatcca

SEQ ID NO: 463736 - DNA, 20 bp, Artificial Sequence
  chemically synthesized
ggattaggtgagttaatatc

SEQ ID NO: 463737 - DNA, 20 bp, Artificial Sequence
  chemically synthesized
aacctaaatacggattaggt

SEQ ID NO: 463738 - DNA, 20 bp, Artificial Sequence
  chemically synthesized
gtgcaacctaaatacggatt

SEQ ID NO: 463739 - DNA, 20 bp, Artificial Sequence
  chemically synthesized
tgtgcaacctaaatacggat

SEQ ID NO: 463740 - DNA, 20 bp, Artificial Sequence
  chemically synthesized
taactcacctaatccgtatt

SEQ ID NO: 463741 - DNA, 20 bp, Artificial Sequence
  chemically synthesized
aactcacctaatccgtattt

SEQ ID NO: 463742 - DNA, 20 bp, Artificial Sequence
  chemically synthesized
attcatgtgcaacctaaata

SEQ ID NO: 463743 - DNA, 20 bp, Artificial Sequence
  chemically synthesized
tatttaggttgcacatgaat

SEQ ID NO: 463744 - DNA, 20 bp, Artificial Sequence
  chemically synthesized
tttaggttgcacatgaataa

SEQ ID NO: 463745 - DNA, 20 bp, Artificial Sequence
  chemically synthesized
atgaataagagttccgtatt

SEQ ID NO: 463746 - DNA, 20 bp, Artificial Sequence
  chemically synthesized
taaatacaattttctaaata

SEQ ID NO: 463747 - DNA, 20 bp, Artificial Sequence
  chemically synthesized
tcaatacaatgaataaaatc

SEQ ID NO: 463748 - DNA, 20 bp, Artificial Sequence
  chemically synthesized
caatacaatgaataaaatca

SEQ ID NO: 463749 - DNA, 20 bp, Artificial Sequence
  chemically synthesized
gaataaaatcaaggccaacg

SEQ ID NO: 463750 - DNA, 20 bp, Artificial Sequence
  chemically synthesized
aattagagaagtcacttcgt

SEQ ID NO: 463751 - DNA, 20 bp, Artificial Sequence
  chemically synthesized
ttccaaaacggtaattagag

SEQ ID NO: 463752 - DNA, 20 bp, Artificial Sequence
  chemically synthesized
tttttccaaaacggtaatta

SEQ ID NO: 463753 - DNA, 20 bp, Artificial Sequence
  chemically synthesized
tttttttccaaaacggtaat

SEQ ID NO: 463754 - DNA, 20 bp, Artificial Sequence
  chemically synthesized
gacttctctaattaccgttt

SEQ ID NO: 463755 - DNA, 20 bp, Artificial Sequence
  chemically synthesized
tgtatcttttttttccaaaa

SEQ ID NO: 463756 - DNA, 20 bp, Artificial Sequence
  chemically synthesized
aattaccgttttggaaaaaa

SEQ ID NO: 463757 - DNA, 20 bp, Artificial Sequence
  chemically synthesized
cgttttggaaaaaaaagata

SEQ ID NO: 463758 - DNA, 20 bp, Artificial Sequence
  chemically synthesized
aatgaattatttaatgatat

SEQ ID NO: 463759 - DNA, 20 bp, Artificial Sequence
  chemically synthesized
ttatttaatgatattggaaa

SEQ ID NO: 463760 - DNA, 20 bp, Artificial Sequence
  chemically synthesized
atttaatgatattggaaaaa

SEQ ID NO: 463761 - DNA, 20 bp, Artificial Sequence
  chemically synthesized
tttaatgatattggaaaaag

SEQ ID NO: 463762 - DNA, 20 bp, Artificial Sequence
  chemically synthesized
tggaaaaagaggttatccct

SEQ ID NO: 463763 - DNA, 20 bp, Artificial Sequence
  chemically synthesized
tctgccatacataggtctta

SEQ ID NO: 463764 - DNA, 20 bp, Artificial Sequence
  chemically synthesized
ttctgccatacataggtctt

SEQ ID NO: 463765 - DNA, 20 bp, Artificial Sequence
  chemically synthesized
cttctgccatacataggtct

SEQ ID NO: 463766 - DNA, 20 bp, Artificial Sequence
  chemically synthesized
ttatccctaagacctatgta

SEQ ID NO: 463767 - DNA, 20 bp, Artificial Sequence
  chemically synthesized
ttagttcttctgccatacat

SEQ ID NO: 463768 - DNA, 20 bp, Artificial Sequence
  chemically synthesized
tccctaagacctatgtatgg

SEQ ID NO: 463769 - DNA, 20 bp, Artificial Sequence
  chemically synthesized
tttagttcttctgccataca

SEQ ID NO: 463770 - DNA, 20 bp, Artificial Sequence
  chemically synthesized
ctaagacctatgtatggcag

SEQ ID NO: 463771 - DNA, 20 bp, Artificial Sequence
  chemically synthesized
tatgtatggcagaagaacta

SEQ ID NO: 463772 - DNA, 20 bp, Artificial Sequence
  chemically synthesized
atgtatggcagaagaactaa

SEQ ID NO: 463773 - DNA, 20 bp, Artificial Sequence
  chemically synthesized
tatggcagaagaactaaagg

SEQ ID NO: 463774 - DNA, 20 bp, Artificial Sequence
  chemically synthesized
atggcagaagaactaaaggc

SEQ ID NO: 463775 - DNA, 20 bp, Artificial Sequence
  chemically synthesized
tttgggtcactacctgcctt

SEQ ID NO: 463776 - DNA, 20 bp, Artificial Sequence
  chemically synthesized
gcagaagaactaaaggcagg

SEQ ID NO: 463777 - DNA, 20 bp, Artificial Sequence
  chemically synthesized
tgagttagtgatacagattt

SEQ ID NO: 463778 - DNA, 20 bp, Artificial Sequence
  chemically synthesized
ttgagttagtgatacagatt

SEQ ID NO: 463779 - DNA, 20 bp, Artificial Sequence
  chemically synthesized
aggaaattgagttagtgata

SEQ ID NO: 463780 - DNA, 20 bp, Artificial Sequence
  chemically synthesized
tgcttggaaggaaattgagt

SEQ ID NO: 463781 - DNA, 20 bp, Artificial Sequence
  chemically synthesized
tacctgcttggaaggaaatt

SEQ ID NO: 463782 - DNA, 20 bp, Artificial Sequence
  chemically synthesized
cactaactcaatttccttcc

SEQ ID NO: 463783 - DNA, 20 bp, Artificial Sequence
  chemically synthesized
taactcaatttccttccaag

SEQ ID NO: 463784 - DNA, 20 bp, Artificial Sequence
  chemically synthesized
aactcaatttccttccaagc

SEQ ID NO: 463785 - DNA, 20 bp, Artificial Sequence
  chemically synthesized
tacttctgtacctgcttgga

SEQ ID NO: 463786 - DNA, 20 bp, Artificial Sequence
  chemically synthesized
ctacttctgtacctgcttgg

SEQ ID NO: 463787 - DNA, 20 bp, Artificial Sequence
  chemically synthesized
gatctacttctgtacctgct

SEQ ID NO: 463788 - DNA, 20 bp, Artificial Sequence
  chemically synthesized
aatttccttccaagcaggta

SEQ ID NO: 463789 - DNA, 20 bp, Artificial Sequence
  chemically synthesized
ttccttccaagcaggtacag

SEQ ID NO: 463790 - DNA, 20 bp, Artificial Sequence
  chemically synthesized
cttccaagcaggtacagaag

SEQ ID NO: 463791 - DNA, 20 bp, Artificial Sequence
  chemically synthesized
gcaggtacagaagtagatca

SEQ ID NO: 463792 - DNA, 20 bp, Artificial Sequence
  chemically synthesized
ggtacagaagtagatcatgg

SEQ ID NO: 463793 - DNA, 20 bp, Artificial Sequence
  chemically synthesized
gtacagaagtagatcatgga

SEQ ID NO: 463794 - DNA, 20 bp, Artificial Sequence
  chemically synthesized
acagaagtagatcatggaag

SEQ ID NO: 463795 - DNA, 20 bp, Artificial Sequence
  chemically synthesized
catggaaggagtgaaatgca

SEQ ID NO: 463796 - DNA, 20 bp, Artificial Sequence
  chemically synthesized
gaaatgcatagaatcttata

SEQ ID NO: 463797 - DNA, 20 bp, Artificial Sequence
  chemically synthesized
aatcagaaccagatctttat

SEQ ID NO: 463798 - DNA, 20 bp, Artificial Sequence
  chemically synthesized
catagaatcttataaagatc

SEQ ID NO: 463799 - DNA, 20 bp, Artificial Sequence
  chemically synthesized
gaaacagctctaatcagaac

SEQ ID NO: 463800 - DNA, 20 bp, Artificial Sequence
  chemically synthesized
tataaagatctggttctgat

SEQ ID NO: 463801 - DNA, 20 bp, Artificial Sequence
  chemically synthesized
taaagatctggttctgatta

SEQ ID NO: 463802 - DNA, 20 bp, Artificial Sequence
  chemically synthesized
acttgtgaaacagctctaat

SEQ ID NO: 463803 - DNA, 20 bp, Artificial Sequence
  chemically synthesized
tctgattagagctgtttcac

SEQ ID NO: 463804 - DNA, 20 bp, Artificial Sequence
  chemically synthesized
agattaagctacttgtgaaa

SEQ ID NO: 463805 - DNA, 20 bp, Artificial Sequence
  chemically synthesized
gattagagctgtttcacaag

SEQ ID NO: 463806 - DNA, 20 bp, Artificial Sequence
  chemically synthesized
agctgagcctaagtgagatt

SEQ ID NO: 463807 - DNA, 20 bp, Artificial Sequence
  chemically synthesized
acaagtagcttaatctcact

SEQ ID NO: 463808 - DNA, 20 bp, Artificial Sequence
  chemically synthesized
caagtagcttaatctcactt

SEQ ID NO: 463809 - DNA, 20 bp, Artificial Sequence
  chemically synthesized
tctagaagctgagcctaagt

SEQ ID NO: 463810 - DNA, 20 bp, Artificial Sequence
  chemically synthesized
agcttaatctcacttaggct

SEQ ID NO: 463811 - DNA, 20 bp, Artificial Sequence
  chemically synthesized
tagatctagaagctgagcct

SEQ ID NO: 463812 - DNA, 20 bp, Artificial Sequence
  chemically synthesized
tctcacttaggctcagcttc

SEQ ID NO: 463813 - DNA, 20 bp, Artificial Sequence
  chemically synthesized
agtttatagatctagaagct

SEQ ID NO: 463814 - DNA, 20 bp, Artificial Sequence
  chemically synthesized
tgcctagtttatagatctag

SEQ ID NO: 463815 - DNA, 20 bp, Artificial Sequence
  chemically synthesized
ttatgcctagtttatagatc

SEQ ID NO: 463816 - DNA, 20 bp, Artificial Sequence
  chemically synthesized
cagcttctagatctataaac

SEQ ID NO: 463817 - DNA, 20 bp, Artificial Sequence
  chemically synthesized
agcttctagatctataaact

SEQ ID NO: 463818 - DNA, 20 bp, Artificial Sequence
  chemically synthesized
gttttattatgcctagttta

SEQ ID NO: 463819 - DNA, 20 bp, Artificial Sequence
  chemically synthesized
ccaaaatgttttattatgcc

SEQ ID NO: 463820 - DNA, 20 bp, Artificial Sequence
  chemically synthesized
ctaggcataataaaacattt

SEQ ID NO: 463821 - DNA, 20 bp, Artificial Sequence
  chemically synthesized
ggcataataaaacattttgg

SEQ ID NO: 463822 - DNA, 20 bp, Artificial Sequence
  chemically synthesized
gcataataaaacattttggc

SEQ ID NO: 463823 - DNA, 20 bp, Artificial Sequence
  chemically synthesized
cataataaaacattttggcg

SEQ ID NO: 463824 - DNA, 20 bp, Artificial Sequence
  chemically synthesized
ataataaaacattttggcgg

SEQ ID NO: 463825 - DNA, 20 bp, Artificial Sequence
  chemically synthesized
ttttggcgggggttgttcca

SEQ ID NO: 463826 - DNA, 20 bp, Artificial Sequence
  chemically synthesized
gcgggggttgttccaaagat

SEQ ID NO: 463827 - DNA, 20 bp, Artificial Sequence
  chemically synthesized
gcgttattttagctaatctt

SEQ ID NO: 463828 - DNA, 20 bp, Artificial Sequence
  chemically synthesized
gtgcagttcatgcgttattt

SEQ ID NO: 463829 - DNA, 20 bp, Artificial Sequence
  chemically synthesized
aataacgcatgaactgcacc

SEQ ID NO: 463830 - DNA, 20 bp, Artificial Sequence
  chemically synthesized
tatttttaacatgctaggtg

SEQ ID NO: 463831 - DNA, 20 bp, Artificial Sequence
  chemically synthesized
ctatttatttttaacatgct

SEQ ID NO: 463832 - DNA, 20 bp, Artificial Sequence
  chemically synthesized
actatttatttttaacatgc

SEQ ID NO: 463833 - DNA, 20 bp, Artificial Sequence
  chemically synthesized
cctagcatgttaaaaataaa

SEQ ID NO: 463834 - DNA, 20 bp, Artificial Sequence
  chemically synthesized
aatagtaaatattaatgtac

SEQ ID NO: 463835 - DNA, 20 bp, Artificial Sequence
  chemically synthesized
agtttacaaaacataattac

SEQ ID NO: 463836 - DNA, 20 bp, Artificial Sequence
  chemically synthesized
tcttttagtgagataaaatt

SEQ ID NO: 463837 - DNA, 20 bp, Artificial Sequence
  chemically synthesized
actaaattttatctcactaa

SEQ ID NO: 463838 - DNA, 20 bp, Artificial Sequence
  chemically synthesized
ttacaatactttcttttagt

SEQ ID NO: 463839 - DNA, 20 bp, Artificial Sequence
  chemically synthesized
aattttatctcactaaaaga

SEQ ID NO: 463840 - DNA, 20 bp, Artificial Sequence
  chemically synthesized
aattttacaatactttcttt

SEQ ID NO: 463841 - DNA, 20 bp, Artificial Sequence
  chemically synthesized
ttcattttctatagtggatg

SEQ ID NO: 463842 - DNA, 20 bp, Artificial Sequence
  chemically synthesized
atgttgttcttcatccacta

SEQ ID NO: 463843 - DNA, 20 bp, Artificial Sequence
  chemically synthesized
aaagttttcattttctatag

SEQ ID NO: 463844 - DNA, 20 bp, Artificial Sequence
  chemically synthesized
caaaaagttttcattttcta

SEQ ID NO: 463845 - DNA, 20 bp, Artificial Sequence
  chemically synthesized
aaaatgaaaactttttgaat

SEQ ID NO: 463846 - DNA, 20 bp, Artificial Sequence
  chemically synthesized
aaatttggttctaattcaaa

SEQ ID NO: 463847 - DNA, 20 bp, Artificial Sequence
  chemically synthesized
ttttgaattagaaccaaatt

SEQ ID NO: 463848 - DNA, 20 bp, Artificial Sequence
  chemically synthesized
ggatgttcccattccaaatt

SEQ ID NO: 463849 - DNA, 20 bp, Artificial Sequence
  chemically synthesized
aattagaaccaaatttggaa

SEQ ID NO: 463850 - DNA, 20 bp, Artificial Sequence
  chemically synthesized
attagaaccaaatttggaat

SEQ ID NO: 463851 - DNA, 20 bp, Artificial Sequence
  chemically synthesized
aatttggaatgggaacatcc

SEQ ID NO: 463852 - DNA, 20 bp, Artificial Sequence
  chemically synthesized
aatgggaacatccaagtaat

SEQ ID NO: 463853 - DNA, 20 bp, Artificial Sequence
  chemically synthesized
tcacatttattcttattact

SEQ ID NO: 463854 - DNA, 20 bp, Artificial Sequence
  chemically synthesized
gtaataagaataaatgtgaa

SEQ ID NO: 463855 - DNA, 20 bp, Artificial Sequence
  chemically synthesized
cataactttattattatatt

SEQ ID NO: 463856 - DNA, 20 bp, Artificial Sequence
  chemically synthesized
agaaactgaatataataata

SEQ ID NO: 463857 - DNA, 20 bp, Artificial Sequence
  chemically synthesized
atataataataaagttatga

SEQ ID NO: 463858 - DNA, 20 bp, Artificial Sequence
  chemically synthesized
ataataataaagttatgaaa

SEQ ID NO: 463859 - DNA, 20 bp, Artificial Sequence
  chemically synthesized
taataataaagttatgaaag

SEQ ID NO: 463860 - DNA, 20 bp, Artificial Sequence
  chemically synthesized
ctatatgttcttttcggcat

SEQ ID NO: 463861 - DNA, 20 bp, Artificial Sequence
  chemically synthesized
aaataaaatctgatgccgaa

SEQ ID NO: 463862 - DNA, 20 bp, Artificial Sequence
  chemically synthesized
aaaaacctatatgttctttt

SEQ ID NO: 463863 - DNA, 20 bp, Artificial Sequence
  chemically synthesized
ctgatgccgaaaagaacata

SEQ ID NO: 463864 - DNA, 20 bp, Artificial Sequence
  chemically synthesized
tgatgccgaaaagaacatat

SEQ ID NO: 463865 - DNA, 20 bp, Artificial Sequence
  chemically synthesized
gattctgtctcaaaaaacaa

SEQ ID NO: 463866 - DNA, 20 bp, Artificial Sequence
  chemically synthesized
agattctgtctcaaaaaaca

SEQ ID NO: 463867 - DNA, 20 bp, Artificial Sequence
  chemically synthesized
tttgttttcctttgtttttt

SEQ ID NO: 463868 - DNA, 20 bp, Artificial Sequence
  chemically synthesized
ttttcctttgttttttgaga

SEQ ID NO: 463869 - DNA, 20 bp, Artificial Sequence
  chemically synthesized
tccaacctgggtgacagagt

SEQ ID NO: 463870 - DNA, 20 bp, Artificial Sequence
  chemically synthesized
cagaatctcactctgtcacc

SEQ ID NO: 463871 - DNA, 20 bp, Artificial Sequence
  chemically synthesized
gcactccaacctgggtgaca

SEQ ID NO: 463872 - DNA, 20 bp, Artificial Sequence
  chemically synthesized
agaatctcactctgtcaccc

SEQ ID NO: 463873 - DNA, 20 bp, Artificial Sequence
  chemically synthesized
gtgcactccaacctgggtga

SEQ ID NO: 463874 - DNA, 20 bp, Artificial Sequence
  chemically synthesized
tctcactctgtcacccaggt

SEQ ID NO: 463875 - DNA, 20 bp, Artificial Sequence
  chemically synthesized
tcactctgtcacccaggttg

SEQ ID NO: 463876 - DNA, 20 bp, Artificial Sequence
  chemically synthesized
gtgccagtgcactccaacct

SEQ ID NO: 463877 - DNA, 20 bp, Artificial Sequence
  chemically synthesized
cgtgccagtgcactccaacc

SEQ ID NO: 463878 - DNA, 20 bp, Artificial Sequence
  chemically synthesized
tcacccaggttggagtgcac

SEQ ID NO: 463879 - DNA, 20 bp, Artificial Sequence
  chemically synthesized
gcaatgagtcaagatcgtgc

SEQ ID NO: 463880 - DNA, 20 bp, Artificial Sequence
  chemically synthesized
ggctgaggttgcaatgagtc

SEQ ID NO: 463881 - DNA, 20 bp, Artificial Sequence
  chemically synthesized
caggaggctgaggttgcaat

SEQ ID NO: 463882 - DNA, 20 bp, Artificial Sequence
  chemically synthesized
atcttgactcattgcaacct

SEQ ID NO: 463883 - DNA, 20 bp, Artificial Sequence
  chemically synthesized
cgcttgaacccaggaggctg

SEQ ID NO: 463884 - DNA, 20 bp, Artificial Sequence
  chemically synthesized
tcattgcaacctcagcctcc

SEQ ID NO: 463885 - DNA, 20 bp, Artificial Sequence
  chemically synthesized
tcgcttgaacccaggaggct

SEQ ID NO: 463886 - DNA, 20 bp, Artificial Sequence
  chemically synthesized
cattgcaacctcagcctcct

SEQ ID NO: 463887 - DNA, 20 bp, Artificial Sequence
  chemically synthesized
aagaatcgcttgaacccagg

SEQ ID NO: 463888 - DNA, 20 bp, Artificial Sequence
  chemically synthesized
gaagaatcgcttgaacccag

SEQ ID NO: 463889 - DNA, 20 bp, Artificial Sequence
  chemically synthesized
aacctcagcctcctgggttc

SEQ ID NO: 463890 - DNA, 20 bp, Artificial Sequence
  chemically synthesized
cagaagaatcgcttgaaccc

SEQ ID NO: 463891 - DNA, 20 bp, Artificial Sequence
  chemically synthesized
gcagaagaatcgcttgaacc

SEQ ID NO: 463892 - DNA, 20 bp, Artificial Sequence
  chemically synthesized
ttcaagcgattcttctgcct

SEQ ID NO: 463893 - DNA, 20 bp, Artificial Sequence
  chemically synthesized
tactcgggaggctgaggcag

SEQ ID NO: 463894 - DNA, 20 bp, Artificial Sequence
  chemically synthesized
agctactcgggaggctgagg

SEQ ID NO: 463895 - DNA, 20 bp, Artificial Sequence
  chemically synthesized
cccagctactcgggaggctg

SEQ ID NO: 463896 - DNA, 20 bp, Artificial Sequence
  chemically synthesized
tcccagctactcgggaggct

SEQ ID NO: 463897 - DNA, 20 bp, Artificial Sequence
  chemically synthesized
ttcttctgcctcagcctccc

SEQ ID NO: 463898 - DNA, 20 bp, Artificial Sequence
  chemically synthesized
ttctgcctcagcctcccgag

SEQ ID NO: 463899 - DNA, 20 bp, Artificial Sequence
  chemically synthesized
tgtagtcccagctactcggg

SEQ ID NO: 463900 - DNA, 20 bp, Artificial Sequence
  chemically synthesized
ctgtagtcccagctactcgg

SEQ ID NO: 463901 - DNA, 20 bp, Artificial Sequence
  chemically synthesized
gcctcagcctcccgagtagc

SEQ ID NO: 463902 - DNA, 20 bp, Artificial Sequence
  chemically synthesized
gcctgtagtcccagctactc

SEQ ID NO: 463903 - DNA, 20 bp, Artificial Sequence
  chemically synthesized
cctcagcctcccgagtagct

SEQ ID NO: 463904 - DNA, 20 bp, Artificial Sequence
  chemically synthesized
tgcctgtagtcccagctact

SEQ ID NO: 463905 - DNA, 20 bp, Artificial Sequence
  chemically synthesized
ctcccgagtagctgggacta

SEQ ID NO: 463906 - DNA, 20 bp, Artificial Sequence
  chemically synthesized
tcccgagtagctgggactac

SEQ ID NO: 463907 - DNA, 20 bp, Artificial Sequence
  chemically synthesized
ggctcacgtgcctgtagtcc

SEQ ID NO: 463908 - DNA, 20 bp, Artificial Sequence
  chemically synthesized
taggtgggctcacgtgcctg

SEQ ID NO: 463909 - DNA, 20 bp, Artificial Sequence
  chemically synthesized
agctgggactacaggcacgt

SEQ ID NO: 463910 - DNA, 20 bp, Artificial Sequence
  chemically synthesized
taaaaacacaaaaattaggt

SEQ ID NO: 463911 - DNA, 20 bp, Artificial Sequence
  chemically synthesized
ctaaaaacacaaaaattagg

SEQ ID NO: 463912 - DNA, 20 bp, Artificial Sequence
  chemically synthesized
ctactaaaaacacaaaaatt

SEQ ID NO: 463913 - DNA, 20 bp, Artificial Sequence
  chemically synthesized
tctactaaaaacacaaaaat

SEQ ID NO: 463914 - DNA, 20 bp, Artificial Sequence
  chemically synthesized
ccacctaatttttgtgtttt

SEQ ID NO: 463915 - DNA, 20 bp, Artificial Sequence
  chemically synthesized
cctaatttttgtgtttttag

SEQ ID NO: 463916 - DNA, 20 bp, Artificial Sequence
  chemically synthesized
taatttttgtgtttttagta

SEQ ID NO: 463917 - DNA, 20 bp, Artificial Sequence
  chemically synthesized
ttttgtgtttttagtagaga

SEQ ID NO: 463918 - DNA, 20 bp, Artificial Sequence
  chemically synthesized
tttgtgtttttagtagagat

SEQ ID NO: 463919 - DNA, 20 bp, Artificial Sequence
  chemically synthesized
ttgtgtttttagtagagatg

SEQ ID NO: 463920 - DNA, 20 bp, Artificial Sequence
  chemically synthesized
gagatggggtttcaccatat

SEQ ID NO: 463921 - DNA, 20 bp, Artificial Sequence
  chemically synthesized
tggggtttcaccatattggc

SEQ ID NO: 463922 - DNA, 20 bp, Artificial Sequence
  chemically synthesized
cgagaccagcctggccaata

SEQ ID NO: 463923 - DNA, 20 bp, Artificial Sequence
  chemically synthesized
ggggtttcaccatattggcc

SEQ ID NO: 463924 - DNA, 20 bp, Artificial Sequence
  chemically synthesized
tttcaccatattggccaggc

SEQ ID NO: 463925 - DNA, 20 bp, Artificial Sequence
  chemically synthesized
tcaggagttcgagaccagcc

SEQ ID NO: 463926 - DNA, 20 bp, Artificial Sequence
  chemically synthesized
tgaggtcaggagttcgagac

SEQ ID NO: 463927 - DNA, 20 bp, Artificial Sequence
  chemically synthesized
tatcatgaggtcaggagttc

SEQ ID NO: 463928 - DNA, 20 bp, Artificial Sequence
  chemically synthesized
tgggtgtatcatgaggtcag

SEQ ID NO: 463929 - DNA, 20 bp, Artificial Sequence
  chemically synthesized
ggtgggtgtatcatgaggtc

SEQ ID NO: 463930 - DNA, 20 bp, Artificial Sequence
  chemically synthesized
aggtgggtgtatcatgaggt

SEQ ID NO: 463931 - DNA, 20 bp, Artificial Sequence
  chemically synthesized
gtcgaggtgggtgtatcatg

SEQ ID NO: 463932 - DNA, 20 bp, Artificial Sequence
  chemically synthesized
ggtcgaggtgggtgtatcat

SEQ ID NO: 463933 - DNA, 20 bp, Artificial Sequence
  chemically synthesized
gcattttgggaggtcgaggt

SEQ ID NO: 463934 - DNA, 20 bp, Artificial Sequence
  chemically synthesized
agcattttgggaggtcgagg

SEQ ID NO: 463935 - DNA, 20 bp, Artificial Sequence
  chemically synthesized
cccagcattttgggaggtcg

SEQ ID NO: 463936 - DNA, 20 bp, Artificial Sequence
  chemically synthesized
tcccagcattttgggaggtc

SEQ ID NO: 463937 - DNA, 20 bp, Artificial Sequence
  chemically synthesized
tgtaatcccagcattttggg

SEQ ID NO: 463938 - DNA, 20 bp, Artificial Sequence
  chemically synthesized
ctgtaatcccagcattttgg

SEQ ID NO: 463939 - DNA, 20 bp, Artificial Sequence
  chemically synthesized
acctcgacctcccaaaatgc

SEQ ID NO: 463940 - DNA, 20 bp, Artificial Sequence
  chemically synthesized
gcctgtaatcccagcatttt

SEQ ID NO: 463941 - DNA, 20 bp, Artificial Sequence
  chemically synthesized
cctcgacctcccaaaatgct

SEQ ID NO: 463942 - DNA, 20 bp, Artificial Sequence
  chemically synthesized
tgcctgtaatcccagcattt

SEQ ID NO: 463943 - DNA, 20 bp, Artificial Sequence
  chemically synthesized
ctcccaaaatgctgggatta

SEQ ID NO: 463944 - DNA, 20 bp, Artificial Sequence
  chemically synthesized
tcccaaaatgctgggattac

SEQ ID NO: 463945 - DNA, 20 bp, Artificial Sequence
  chemically synthesized
gtggctcatgcctgtaatcc

SEQ ID NO: 463946 - DNA, 20 bp, Artificial Sequence
  chemically synthesized
aatgctgggattacaggcat

SEQ ID NO: 463947 - DNA, 20 bp, Artificial Sequence
  chemically synthesized
caggcatgagccaccacgcc

SEQ ID NO: 463948 - DNA, 20 bp, Artificial Sequence
  chemically synthesized
cctgtatgggccgggcgtgg

SEQ ID NO: 463949 - DNA, 20 bp, Artificial Sequence
  chemically synthesized
aaacctgtatgggccgggcg

SEQ ID NO: 463950 - DNA, 20 bp, Artificial Sequence
  chemically synthesized
tatttaaacctgtatgggcc

SEQ ID NO: 463951 - DNA, 20 bp, Artificial Sequence
  chemically synthesized
gccaccacgcccggcccata

SEQ ID NO: 463952 - DNA, 20 bp, Artificial Sequence
  chemically synthesized
atatttaaacctgtatgggc

SEQ ID NO: 463953 - DNA, 20 bp, Artificial Sequence
  chemically synthesized
ccaccacgcccggcccatac

SEQ ID NO: 463954 - DNA, 20 bp, Artificial Sequence
  chemically synthesized
tgcaatatttaaacctgtat

SEQ ID NO: 463955 - DNA, 20 bp, Artificial Sequence
  chemically synthesized
atgcaatatttaaacctgta

SEQ ID NO: 463956 - DNA, 20 bp, Artificial Sequence
  chemically synthesized
atacaggtttaaatattgca

SEQ ID NO: 463957 - DNA, 20 bp, Artificial Sequence
  chemically synthesized
taacaaactgttgtatagca

SEQ ID NO: 463958 - DNA, 20 bp, Artificial Sequence
  chemically synthesized
tgcatggccatgctatacaa

SEQ ID NO: 463959 - DNA, 20 bp, Artificial Sequence
  chemically synthesized
tcagctaacaaactgttgta

SEQ ID NO: 463960 - DNA, 20 bp, Artificial Sequence
  chemically synthesized
catgctatacaacagtttgt

SEQ ID NO: 463961 - DNA, 20 bp, Artificial Sequence
  chemically synthesized
atacaacagtttgttagctg

SEQ ID NO: 463962 - DNA, 20 bp, Artificial Sequence
  chemically synthesized
tttgtgaacaaaaatatctt

SEQ ID NO: 463963 - DNA, 20 bp, Artificial Sequence
  chemically synthesized
tttttgttcacaaaatcaat

SEQ ID NO: 463964 - DNA, 20 bp, Artificial Sequence
  chemically synthesized
taattttaatagcaagtata

SEQ ID NO: 463965 - DNA, 20 bp, Artificial Sequence
  chemically synthesized
agtaattttaatagcaagta

SEQ ID NO: 463966 - DNA, 20 bp, Artificial Sequence
  chemically synthesized
gacatagtaattttaatagc

SEQ ID NO: 463967 - DNA, 20 bp, Artificial Sequence
  chemically synthesized
gcgtgacatagtaattttaa

SEQ ID NO: 463968 - DNA, 20 bp, Artificial Sequence
  chemically synthesized
aggccacaaaatgcgtgaca

SEQ ID NO: 463969 - DNA, 20 bp, Artificial Sequence
  chemically synthesized
ttactatgtcacgcattttg

SEQ ID NO: 463970 - DNA, 20 bp, Artificial Sequence
  chemically synthesized
cgcattttgtggccttccaa

SEQ ID NO: 463971 - DNA, 20 bp, Artificial Sequence
  chemically synthesized
cattttgtggccttccaaaa

SEQ ID NO: 463972 - DNA, 20 bp, Artificial Sequence
  chemically synthesized
aactccttgtctcttttgga

SEQ ID NO: 463973 - DNA, 20 bp, Artificial Sequence
  chemically synthesized
aaactccttgtctcttttgg

SEQ ID NO: 463974 - DNA, 20 bp, Artificial Sequence
  chemically synthesized
ctcaaactccttgtctcttt

SEQ ID NO: 463975 - DNA, 20 bp, Artificial Sequence
  chemically synthesized
tgtggccttccaaaagagac

SEQ ID NO: 463976 - DNA, 20 bp, Artificial Sequence
  chemically synthesized
gtggccttccaaaagagaca

SEQ ID NO: 463977 - DNA, 20 bp, Artificial Sequence
  chemically synthesized
ggccttccaaaagagacaag

SEQ ID NO: 463978 - DNA, 20 bp, Artificial Sequence
  chemically synthesized
ccaaaagagacaaggagttt

SEQ ID NO: 463979 - DNA, 20 bp, Artificial Sequence
  chemically synthesized
gagacaaggagtttgagtca

SEQ ID NO: 463980 - DNA, 20 bp, Artificial Sequence
  chemically synthesized
aggagtttgagtcacagtat

SEQ ID NO: 463981 - DNA, 20 bp, Artificial Sequence
  chemically synthesized
tttgagtcacagtattagac

SEQ ID NO: 463982 - DNA, 20 bp, Artificial Sequence
  chemically synthesized
cacagtattagacaagacta

SEQ ID NO: 463983 - DNA, 20 bp, Artificial Sequence
  chemically synthesized
agtaaaccatgtagggtctt

SEQ ID NO: 463984 - DNA, 20 bp, Artificial Sequence
  chemically synthesized
acaagactaaagaccctaca

SEQ ID NO: 463985 - DNA, 20 bp, Artificial Sequence
  chemically synthesized
tttttctagtaaaccatgta

SEQ ID NO: 463986 - DNA, 20 bp, Artificial Sequence
  chemically synthesized
ttttttctagtaaaccatgt

SEQ ID NO: 463987 - DNA, 20 bp, Artificial Sequence
  chemically synthesized
tttttttctagtaaaccatg

SEQ ID NO: 463988 - DNA, 20 bp, Artificial Sequence
  chemically synthesized
aaagaccctacatggtttac

SEQ ID NO: 463989 - DNA, 20 bp, Artificial Sequence
  chemically synthesized
tgaagtaaagggtttttttc

SEQ ID NO: 463990 - DNA, 20 bp, Artificial Sequence
  chemically synthesized
tagaaaaaaaccctttactt

SEQ ID NO: 463991 - DNA, 20 bp, Artificial Sequence
  chemically synthesized
tctcctgacactgaagtaaa

SEQ ID NO: 463992 - DNA, 20 bp, Artificial Sequence
  chemically synthesized
gtctcctgacactgaagtaa

SEQ ID NO: 463993 - DNA, 20 bp, Artificial Sequence
  chemically synthesized
agtctcctgacactgaagta

SEQ ID NO: 463994 - DNA, 20 bp, Artificial Sequence
  chemically synthesized
aaaaccctttacttcagtgt

SEQ ID NO: 463995 - DNA, 20 bp, Artificial Sequence
  chemically synthesized
aaaccctttacttcagtgtc

SEQ ID NO: 463996 - DNA, 20 bp, Artificial Sequence
  chemically synthesized
ataaaagtctcctgacactg

SEQ ID NO: 463997 - DNA, 20 bp, Artificial Sequence
  chemically synthesized
accctttacttcagtgtcag

SEQ ID NO: 463998 - DNA, 20 bp, Artificial Sequence
  chemically synthesized
taaggccagatacgtaataa

SEQ ID NO: 463999 - DNA, 20 bp, Artificial Sequence
  chemically synthesized
ggagacttttattacgtatc

SEQ ID NO: 464000 - DNA, 20 bp, Artificial Sequence
  chemically synthesized
cttccagttagtagtaaggc

SEQ ID NO: 464001 - DNA, 20 bp, Artificial Sequence
  chemically synthesized
gtttcttccagttagtagta

SEQ ID NO: 464002 - DNA, 20 bp, Artificial Sequence
  chemically synthesized
agtttcttccagttagtagt

SEQ ID NO: 464003 - DNA, 20 bp, Artificial Sequence
  chemically synthesized
tatctggccttactactaac

SEQ ID NO: 464004 - DNA, 20 bp, Artificial Sequence
  chemically synthesized
tttaagtttcttccagttag

SEQ ID NO: 464005 - DNA, 20 bp, Artificial Sequence
  chemically synthesized
ctggccttactactaactgg

SEQ ID NO: 464006 - DNA, 20 bp, Artificial Sequence
  chemically synthesized
tcttttaagtttcttccagt

SEQ ID NO: 464007 - DNA, 20 bp, Artificial Sequence
  chemically synthesized
catttcttttaagtttcttc

SEQ ID NO: 464008 - DNA, 20 bp, Artificial Sequence
  chemically synthesized
actaactggaagaaacttaa

SEQ ID NO: 464009 - DNA, 20 bp, Artificial Sequence
  chemically synthesized
gagaaattgtcatttctttt

SEQ ID NO: 464010 - DNA, 20 bp, Artificial Sequence
  chemically synthesized
agaaatgacaatttctctat

SEQ ID NO: 464011 - DNA, 20 bp, Artificial Sequence
  chemically synthesized
tgaggaaagtgtgacttata

SEQ ID NO: 464012 - DNA, 20 bp, Artificial Sequence
  chemically synthesized
gatgaggaaagtgtgactta

SEQ ID NO: 464013 - DNA, 20 bp, Artificial Sequence
  chemically synthesized
cttagtttgaaagatgagga

SEQ ID NO: 464014 - DNA, 20 bp, Artificial Sequence
  chemically synthesized
atatcttagtttgaaagatg

SEQ ID NO: 464015 - DNA, 20 bp, Artificial Sequence
  chemically synthesized
catatcttagtttgaaagat

SEQ ID NO: 464016 - DNA, 20 bp, Artificial Sequence
  chemically synthesized
ctttcctcatctttcaaact

SEQ ID NO: 464017 - DNA, 20 bp, Artificial Sequence
  chemically synthesized
agtcccatatcttagtttga

SEQ ID NO: 464018 - DNA, 20 bp, Artificial Sequence
  chemically synthesized
tcatctttcaaactaagata

SEQ ID NO: 464019 - DNA, 20 bp, Artificial Sequence
  chemically synthesized
catctttcaaactaagatat

SEQ ID NO: 464020 - DNA, 20 bp, Artificial Sequence
  chemically synthesized
gaatatttagtcccatatct

SEQ ID NO: 464021 - DNA, 20 bp, Artificial Sequence
  chemically synthesized
ggagaccattaaagaatatt

SEQ ID NO: 464022 - DNA, 20 bp, Artificial Sequence
  chemically synthesized
tgggactaaatattctttaa

SEQ ID NO: 464023 - DNA, 20 bp, Artificial Sequence
  chemically synthesized
tcaaaacccggagaccatta

SEQ ID NO: 464024 - DNA, 20 bp, Artificial Sequence
  chemically synthesized
aaatattctttaatggtctc

SEQ ID NO: 464025 - DNA, 20 bp, Artificial Sequence
  chemically synthesized
aatattctttaatggtctcc

SEQ ID NO: 464026 - DNA, 20 bp, Artificial Sequence
  chemically synthesized
acttagaatttcaaaacccg

SEQ ID NO: 464027 - DNA, 20 bp, Artificial Sequence
  chemically synthesized
gaacttagaatttcaaaacc

SEQ ID NO: 464028 - DNA, 20 bp, Artificial Sequence
  chemically synthesized
tctccgggttttgaaattct

SEQ ID NO: 464029 - DNA, 20 bp, Artificial Sequence
  chemically synthesized
agatatcttttataggaact

SEQ ID NO: 464030 - DNA, 20 bp, Artificial Sequence
  chemically synthesized
gaaattctaagttcctataa

SEQ ID NO: 464031 - DNA, 20 bp, Artificial Sequence
  chemically synthesized
tctagacagatatcttttat

SEQ ID NO: 464032 - DNA, 20 bp, Artificial Sequence
  chemically synthesized
atctagacagatatctttta

SEQ ID NO: 464033 - DNA, 20 bp, Artificial Sequence
  chemically synthesized
tcctataaaagatatctgtc

SEQ ID NO: 464034 - DNA, 20 bp, Artificial Sequence
  chemically synthesized
atgtgttgcaaacatctaga

SEQ ID NO: 464035 - DNA, 20 bp, Artificial Sequence
  chemically synthesized
ttgtatgtgttgcaaacatc

SEQ ID NO: 464036 - DNA, 20 bp, Artificial Sequence
  chemically synthesized
tgcaacacatacaataaatg

SEQ ID NO: 464037 - DNA, 20 bp, Artificial Sequence
  chemically synthesized
gcaacacatacaataaatgt

SEQ ID NO: 464038 - DNA, 20 bp, Artificial Sequence
  chemically synthesized
caacacatacaataaatgta

SEQ ID NO: 464039 - DNA, 20 bp, Artificial Sequence
  chemically synthesized
gagatctttacatttttata

SEQ ID NO: 464040 - DNA, 20 bp, Artificial Sequence
  chemically synthesized
agggaccatataaaaatgta

SEQ ID NO: 464041 - DNA, 20 bp, Artificial Sequence
  chemically synthesized
attttggtttttataggtat

SEQ ID NO: 464042 - DNA, 20 bp, Artificial Sequence
  chemically synthesized
tttacaattttggtttttat

SEQ ID NO: 464043 - DNA, 20 bp, Artificial Sequence
  chemically synthesized
atttacaattttggttttta

SEQ ID NO: 464044 - DNA, 20 bp, Artificial Sequence
  chemically synthesized
tttctattgatttacaattt

SEQ ID NO: 464045 - DNA, 20 bp, Artificial Sequence
  chemically synthesized
aaaccaaaattgtaaatcaa

SEQ ID NO: 464046 - DNA, 20 bp, Artificial Sequence
  chemically synthesized
ttgtaaatcaatagaaaaat

SEQ ID NO: 464047 - DNA, 20 bp, Artificial Sequence
  chemically synthesized
atcaatagaaaaatgagcat

SEQ ID NO: 464048 - DNA, 20 bp, Artificial Sequence
  chemically synthesized
tagaaaaatgagcatgagat

SEQ ID NO: 464049 - DNA, 20 bp, Artificial Sequence
  chemically synthesized
aaatgagcatgagattagaa

SEQ ID NO: 464050 - DNA, 20 bp, Artificial Sequence
  chemically synthesized
actataacacaaatatataa

SEQ ID NO: 464051 - DNA, 20 bp, Artificial Sequence
  chemically synthesized
acttttatatatttgtgtta

SEQ ID NO: 464052 - DNA, 20 bp, Artificial Sequence
  chemically synthesized
tatatatttgtgttatagtt

SEQ ID NO: 464053 - DNA, 20 bp, Artificial Sequence
  chemically synthesized
agtaaaacattttaaaaatc

SEQ ID NO: 464054 - DNA, 20 bp, Artificial Sequence
  chemically synthesized
cattttaaaaatcaagttga

SEQ ID NO: 464055 - DNA, 20 bp, Artificial Sequence
  chemically synthesized
ttccctttgtagattaaaga

SEQ ID NO: 464056 - DNA, 20 bp, Artificial Sequence
  chemically synthesized
taatttccctttgtagatta

SEQ ID NO: 464057 - DNA, 20 bp, Artificial Sequence
  chemically synthesized
attactttctttaatctaca

SEQ ID NO: 464058 - DNA, 20 bp, Artificial Sequence
  chemically synthesized
ttactttctttaatctacaa

SEQ ID NO: 464059 - DNA, 20 bp, Artificial Sequence
  chemically synthesized
tactttctttaatctacaaa

SEQ ID NO: 464060 - DNA, 20 bp, Artificial Sequence
  chemically synthesized
tcattagtaatttccctttg

SEQ ID NO: 464061 - DNA, 20 bp, Artificial Sequence
  chemically synthesized
caaagggaaattactaatga

SEQ ID NO: 464062 - DNA, 20 bp, Artificial Sequence
  chemically synthesized
catttcctcccaactttcat

SEQ ID NO: 464063 - DNA, 20 bp, Artificial Sequence
  chemically synthesized
gggaaattactaatgaaagt

SEQ ID NO: 464064 - DNA, 20 bp, Artificial Sequence
  chemically synthesized
ggaaattactaatgaaagtt

SEQ ID NO: 464065 - DNA, 20 bp, Artificial Sequence
  chemically synthesized
aaattactaatgaaagttgg

SEQ ID NO: 464066 - DNA, 20 bp, Artificial Sequence
  chemically synthesized
aattactaatgaaagttggg

SEQ ID NO: 464067 - DNA, 20 bp, Artificial Sequence
  chemically synthesized
aggaaatgttatccttacta

SEQ ID NO: 464068 - DNA, 20 bp, Artificial Sequence
  chemically synthesized
tgtggatgttatctatagta

SEQ ID NO: 464069 - DNA, 20 bp, Artificial Sequence
  chemically synthesized
atgtggatgttatctatagt

SEQ ID NO: 464070 - DNA, 20 bp, Artificial Sequence
  chemically synthesized
gctcatgtggatgttatcta

SEQ ID NO: 464071 - DNA, 20 bp, Artificial Sequence
  chemically synthesized
actatagataacatccacat

SEQ ID NO: 464072 - DNA, 20 bp, Artificial Sequence
  chemically synthesized
ttttgtgtttattgctcatg

SEQ ID NO: 464073 - DNA, 20 bp, Artificial Sequence
  chemically synthesized
tgagcaataaacacaaaaaa

SEQ ID NO: 464074 - DNA, 20 bp, Artificial Sequence
  chemically synthesized
ttctagtgactaattaattt

SEQ ID NO: 464075 - DNA, 20 bp, Artificial Sequence
  chemically synthesized
aaaatggttctcaaattaat

SEQ ID NO: 464076 - DNA, 20 bp, Artificial Sequence
  chemically synthesized
ttctcaaattaattagtcac

SEQ ID NO: 464077 - DNA, 20 bp, Artificial Sequence
  chemically synthesized
ttctcatttccatttttttc

SEQ ID NO: 464078 - DNA, 20 bp, Artificial Sequence
  chemically synthesized
aattagtcactagaaaaaaa

SEQ ID NO: 464079 - DNA, 20 bp, Artificial Sequence
  chemically synthesized
cactagaaaaaaatggaaat

SEQ ID NO: 464080 - DNA, 20 bp, Artificial Sequence
  chemically synthesized
atggaaatgagaaacacaat

SEQ ID NO: 464081 - DNA, 20 bp, Artificial Sequence
  chemically synthesized
agaaacacaatgagatacta

SEQ ID NO: 464082 - DNA, 20 bp, Artificial Sequence
  chemically synthesized
cctttctggctgttatacta

SEQ ID NO: 464083 - DNA, 20 bp, Artificial Sequence
  chemically synthesized
aatgagatactatagtataa

SEQ ID NO: 464084 - DNA, 20 bp, Artificial Sequence
  chemically synthesized
agatactatagtataacagc

SEQ ID NO: 464085 - DNA, 20 bp, Artificial Sequence
  chemically synthesized
actatagtataacagccaga

SEQ ID NO: 464086 - DNA, 20 bp, Artificial Sequence
  chemically synthesized
ctatagtataacagccagaa

SEQ ID NO: 464087 - DNA, 20 bp, Artificial Sequence
  chemically synthesized
gtctttaatttcagcctttc

SEQ ID NO: 464088 - DNA, 20 bp, Artificial Sequence
  chemically synthesized
agccagaaaggctgaaatta

SEQ ID NO: 464089 - DNA, 20 bp, Artificial Sequence
  chemically synthesized
gcattattagtctttaattt

SEQ ID NO: 464090 - DNA, 20 bp, Artificial Sequence
  chemically synthesized
atgtcaatgcttagcattat

SEQ ID NO: 464091 - DNA, 20 bp, Artificial Sequence
  chemically synthesized
aattaaagactaataatgct

SEQ ID NO: 464092 - DNA, 20 bp, Artificial Sequence
  chemically synthesized
gttctggacatgtcaatgct

SEQ ID NO: 464093 - DNA, 20 bp, Artificial Sequence
  chemically synthesized
atgctaagcattgacatgtc

SEQ ID NO: 464094 - DNA, 20 bp, Artificial Sequence
  chemically synthesized
tcattactttatagaagttc

SEQ ID NO: 464095 - DNA, 20 bp, Artificial Sequence
  chemically synthesized
acatgtccagaacttctata

SEQ ID NO: 464096 - DNA, 20 bp, Artificial Sequence
  chemically synthesized
gaaccatcattactttatag

SEQ ID NO: 464097 - DNA, 20 bp, Artificial Sequence
  chemically synthesized
aaagaaccatcattacttta

SEQ ID NO: 464098 - DNA, 20 bp, Artificial Sequence
  chemically synthesized
gaacttctataaagtaatga

SEQ ID NO: 464099 - DNA, 20 bp, Artificial Sequence
  chemically synthesized
tttttcaaggtaggtaaaca

SEQ ID NO: 464100 - DNA, 20 bp, Artificial Sequence
  chemically synthesized
gccacgtagtttttcaaggt

SEQ ID NO: 464101 - DNA, 20 bp, Artificial Sequence
  chemically synthesized
tgccacgtagtttttcaagg

SEQ ID NO: 464102 - DNA, 20 bp, Artificial Sequence
  chemically synthesized
aaatgccacgtagtttttca

SEQ ID NO: 464103 - DNA, 20 bp, Artificial Sequence
  chemically synthesized
aaaatgccacgtagtttttc

SEQ ID NO: 464104 - DNA, 20 bp, Artificial Sequence
  chemically synthesized
acctaccttgaaaaactacg

SEQ ID NO: 464105 - DNA, 20 bp, Artificial Sequence
  chemically synthesized
ctttagttgaaaatgccacg

SEQ ID NO: 464106 - DNA, 20 bp, Artificial Sequence
  chemically synthesized
ctacgtggcattttcaacta

SEQ ID NO: 464107 - DNA, 20 bp, Artificial Sequence
  chemically synthesized
tggcattttcaactaaagat

SEQ ID NO: 464108 - DNA, 20 bp, Artificial Sequence
  chemically synthesized
aatagtgaaatactcatctt

SEQ ID NO: 464109 - DNA, 20 bp, Artificial Sequence
  chemically synthesized
agaattattaggtcatagaa

SEQ ID NO: 464110 - DNA, 20 bp, Artificial Sequence
  chemically synthesized
gaagtagaattattaggtca

SEQ ID NO: 464111 - DNA, 20 bp, Artificial Sequence
  chemically synthesized
tgccaagaagtagaattatt

SEQ ID NO: 464112 - DNA, 20 bp, Artificial Sequence
  chemically synthesized
gtgccaagaagtagaattat

SEQ ID NO: 464113 - DNA, 20 bp, Artificial Sequence
  chemically synthesized
gacctaataattctacttct

SEQ ID NO: 464114 - DNA, 20 bp, Artificial Sequence
  chemically synthesized
ttctgttatgtgccaagaag

SEQ ID NO: 464115 - DNA, 20 bp, Artificial Sequence
  chemically synthesized
tagttctgttatgtgccaag

SEQ ID NO: 464116 - DNA, 20 bp, Artificial Sequence
  chemically synthesized
atgtagttctgttatgtgcc

SEQ ID NO: 464117 - DNA, 20 bp, Artificial Sequence
  chemically synthesized
ttctacttcttggcacataa

SEQ ID NO: 464118 - DNA, 20 bp, Artificial Sequence
  chemically synthesized
atttactgcacatatgcatg

SEQ ID NO: 464119 - DNA, 20 bp, Artificial Sequence
  chemically synthesized
cagaactacatgcatatgtg

SEQ ID NO: 464120 - DNA, 20 bp, Artificial Sequence
  chemically synthesized
catatgtgcagtaaatttgc

SEQ ID NO: 464121 - DNA, 20 bp, Artificial Sequence
  chemically synthesized
taaatttgcaagaatattca

SEQ ID NO: 464122 - DNA, 20 bp, Artificial Sequence
  chemically synthesized
atttgcaagaatattcaaag

SEQ ID NO: 464123 - DNA, 20 bp, Artificial Sequence
  chemically synthesized
ttcaaagtggaattattttt

SEQ ID NO: 464124 - DNA, 20 bp, Artificial Sequence
  chemically synthesized
caaagtggaattatttttaa

SEQ ID NO: 464125 - DNA, 20 bp, Artificial Sequence
  chemically synthesized
tatttttaagagttcacaaa

SEQ ID NO: 464126 - DNA, 20 bp, Artificial Sequence
  chemically synthesized
aatcaatttaaatgttcatc

SEQ ID NO: 464127 - DNA, 20 bp, Artificial Sequence
  chemically synthesized
tcaatttaaatgttcatcca

SEQ ID NO: 464128 - DNA, 20 bp, Artificial Sequence
  chemically synthesized
atttaaatgttcatccagag

SEQ ID NO: 464129 - DNA, 20 bp, Artificial Sequence
  chemically synthesized
aaatgttcatccagagtaga

SEQ ID NO: 464130 - DNA, 20 bp, Artificial Sequence
  chemically synthesized
tttacttattccatctactc

SEQ ID NO: 464131 - DNA, 20 bp, Artificial Sequence
  chemically synthesized
tcatccagagtagatggaat

SEQ ID NO: 464132 - DNA, 20 bp, Artificial Sequence
  chemically synthesized
tagatggaataagtaaatta

SEQ ID NO: 464133 - DNA, 20 bp, Artificial Sequence
  chemically synthesized
agatggaataagtaaattat

SEQ ID NO: 464134 - DNA, 20 bp, Artificial Sequence
  chemically synthesized
attataggacatttatatga

SEQ ID NO: 464135 - DNA, 20 bp, Artificial Sequence
  chemically synthesized
ccataattttcagtgttgtg

SEQ ID NO: 464136 - DNA, 20 bp, Artificial Sequence
  chemically synthesized
ctacacaacactgaaaatta

SEQ ID NO: 464137 - DNA, 20 bp, Artificial Sequence
  chemically synthesized
agttgtggtcccataatttt

SEQ ID NO: 464138 - DNA, 20 bp, Artificial Sequence
  chemically synthesized
tacacaacactgaaaattat

SEQ ID NO: 464139 - DNA, 20 bp, Artificial Sequence
  chemically synthesized
aattatgggaccacaactac

SEQ ID NO: 464140 - DNA, 20 bp, Artificial Sequence
  chemically synthesized
taatttgtttcttgtagttg

SEQ ID NO: 464141 - DNA, 20 bp, Artificial Sequence
  chemically synthesized
tctatctaatttgtttcttg

SEQ ID NO: 464142 - DNA, 20 bp, Artificial Sequence
  chemically synthesized
cacaactacaagaaacaaat

SEQ ID NO: 464143 - DNA, 20 bp, Artificial Sequence
  chemically synthesized
actacaagaaacaaattaga

SEQ ID NO: 464144 - DNA, 20 bp, Artificial Sequence
  chemically synthesized
aattagatagatctcacaaa

SEQ ID NO: 464145 - DNA, 20 bp, Artificial Sequence
  chemically synthesized
aatctcaacattctgtttgt

SEQ ID NO: 464146 - DNA, 20 bp, Artificial Sequence
  chemically synthesized
gatctcacaaacagaatgtt

SEQ ID NO: 464147 - DNA, 20 bp, Artificial Sequence
  chemically synthesized
acaaacagaatgttgagatt

SEQ ID NO: 464148 - DNA, 20 bp, Artificial Sequence
  chemically synthesized
caaacagaatgttgagattt

SEQ ID NO: 464149 - DNA, 20 bp, Artificial Sequence
  chemically synthesized
aacagaatgttgagatttag

SEQ ID NO: 464150 - DNA, 20 bp, Artificial Sequence
  chemically synthesized
gaatgttgagatttaggagc

SEQ ID NO: 464151 - DNA, 20 bp, Artificial Sequence
  chemically synthesized
gatttaggagccagaaacaa

SEQ ID NO: 464152 - DNA, 20 bp, Artificial Sequence
  chemically synthesized
cagctgtactcttttgtttc

SEQ ID NO: 464153 - DNA, 20 bp, Artificial Sequence
  chemically synthesized
tttaggagccagaaacaaaa

SEQ ID NO: 464154 - DNA, 20 bp, Artificial Sequence
  chemically synthesized
gagccagaaacaaaagagta

SEQ ID NO: 464155 - DNA, 20 bp, Artificial Sequence
  chemically synthesized
aacaaaagagtacagctgta

SEQ ID NO: 464156 - DNA, 20 bp, Artificial Sequence
  chemically synthesized
tgtatgtacttgaagccata

SEQ ID NO: 464157 - DNA, 20 bp, Artificial Sequence
  chemically synthesized
gagtacagctgtatggcttc

SEQ ID NO: 464158 - DNA, 20 bp, Artificial Sequence
  chemically synthesized
tcctgaaatgtatgtacttg

SEQ ID NO: 464159 - DNA, 20 bp, Artificial Sequence
  chemically synthesized
ggcttcaagtacatacattt

SEQ ID NO: 464160 - DNA, 20 bp, Artificial Sequence
  chemically synthesized
gcttcaagtacatacatttc

SEQ ID NO: 464161 - DNA, 20 bp, Artificial Sequence
  chemically synthesized
acaccattgattaggacaga

SEQ ID NO: 464162 - DNA, 20 bp, Artificial Sequence
  chemically synthesized
taacacaccattgattagga

SEQ ID NO: 464163 - DNA, 20 bp, Artificial Sequence
  chemically synthesized
gaactgtctgtcctaatcaa

SEQ ID NO: 464164 - DNA, 20 bp, Artificial Sequence
  chemically synthesized
catctaacacaccattgatt

SEQ ID NO: 464165 - DNA, 20 bp, Artificial Sequence
  chemically synthesized
acatctaacacaccattgat

SEQ ID NO: 464166 - DNA, 20 bp, Artificial Sequence
  chemically synthesized
tgtcctaatcaatggtgtgt

SEQ ID NO: 464167 - DNA, 20 bp, Artificial Sequence
  chemically synthesized
atcaatggtgtgttagatgt

SEQ ID NO: 464168 - DNA, 20 bp, Artificial Sequence
  chemically synthesized
aatactctcccagaggtaag

SEQ ID NO: 464169 - DNA, 20 bp, Artificial Sequence
  chemically synthesized
gtcagtattccacttacctc

SEQ ID NO: 464170 - DNA, 20 bp, Artificial Sequence
  chemically synthesized
tcagtattccacttacctct

SEQ ID NO: 464171 - DNA, 20 bp, Artificial Sequence
  chemically synthesized
gtcaatactctcccagaggt

SEQ ID NO: 464172 - DNA, 20 bp, Artificial Sequence
  chemically synthesized
agtattccacttacctctgg

SEQ ID NO: 464173 - DNA, 20 bp, Artificial Sequence
  chemically synthesized
tattccacttacctctggga

SEQ ID NO: 464174 - DNA, 20 bp, Artificial Sequence
  chemically synthesized
cctagtcaatactctcccag

SEQ ID NO: 464175 - DNA, 20 bp, Artificial Sequence
  chemically synthesized
tcctagtcaatactctccca

SEQ ID NO: 464176 - DNA, 20 bp, Artificial Sequence
  chemically synthesized
cttcctagtcaatactctcc

SEQ ID NO: 464177 - DNA, 20 bp, Artificial Sequence
  chemically synthesized
acctctgggagagtattgac

SEQ ID NO: 464178 - DNA, 20 bp, Artificial Sequence
  chemically synthesized
cctctgggagagtattgact

SEQ ID NO: 464179 - DNA, 20 bp, Artificial Sequence
  chemically synthesized
ctgggagagtattgactagg

SEQ ID NO: 464180 - DNA, 20 bp, Artificial Sequence
  chemically synthesized
ggagagtattgactaggaag

SEQ ID NO: 464181 - DNA, 20 bp, Artificial Sequence
  chemically synthesized
aactttgtcttaccacttcc

SEQ ID NO: 464182 - DNA, 20 bp, Artificial Sequence
  chemically synthesized
agtattgactaggaagtggt

SEQ ID NO: 464183 - DNA, 20 bp, Artificial Sequence
  chemically synthesized
gactaggaagtggtaagaca

SEQ ID NO: 464184 - DNA, 20 bp, Artificial Sequence
  chemically synthesized
aagtggtaagacaaagtttt

SEQ ID NO: 464185 - DNA, 20 bp, Artificial Sequence
  chemically synthesized
aagacaaagtttttggatgc

SEQ ID NO: 464186 - DNA, 20 bp, Artificial Sequence
  chemically synthesized
aggcaagaaaagaatattac

SEQ ID NO: 464187 - DNA, 20 bp, Artificial Sequence
  chemically synthesized
gtaattactcaaggcaagaa

SEQ ID NO: 464188 - DNA, 20 bp, Artificial Sequence
  chemically synthesized
taatattcttttcttgcctt

SEQ ID NO: 464189 - DNA, 20 bp, Artificial Sequence
  chemically synthesized
ccccagtaattactcaaggc

SEQ ID NO: 464190 - DNA, 20 bp, Artificial Sequence
  chemically synthesized
cacaccccagtaattactca

SEQ ID NO: 464191 - DNA, 20 bp, Artificial Sequence
  chemically synthesized
gcacaccccagtaattactc

SEQ ID NO: 464192 - DNA, 20 bp, Artificial Sequence
  chemically synthesized
ttcttgccttgagtaattac

SEQ ID NO: 464193 - DNA, 20 bp, Artificial Sequence
  chemically synthesized
tcttgccttgagtaattact

SEQ ID NO: 464194 - DNA, 20 bp, Artificial Sequence
  chemically synthesized
cttgccttgagtaattactg

SEQ ID NO: 464195 - DNA, 20 bp, Artificial Sequence
  chemically synthesized
ttcacagattgggcacaccc

SEQ ID NO: 464196 - DNA, 20 bp, Artificial Sequence
  chemically synthesized
ttcatgaattttcacagatt

SEQ ID NO: 464197 - DNA, 20 bp, Artificial Sequence
  chemically synthesized
cttcatgaattttcacagat

SEQ ID NO: 464198 - DNA, 20 bp, Artificial Sequence
  chemically synthesized
tccagcttcatgaattttca

SEQ ID NO: 464199 - DNA, 20 bp, Artificial Sequence
  chemically synthesized
ccaatctgtgaaaattcatg

SEQ ID NO: 464200 - DNA, 20 bp, Artificial Sequence
  chemically synthesized
tctgtgaaaattcatgaagc

SEQ ID NO: 464201 - DNA, 20 bp, Artificial Sequence
  chemically synthesized
ttcacaaatcaataggtgtc

SEQ ID NO: 464202 - DNA, 20 bp, Artificial Sequence
  chemically synthesized
ataaaagttcacaaatcaat

SEQ ID NO: 464203 - DNA, 20 bp, Artificial Sequence
  chemically synthesized
tataaaagttcacaaatcaa

SEQ ID NO: 464204 - DNA, 20 bp, Artificial Sequence
  chemically synthesized
actataacacgaatatataa

SEQ ID NO: 464205 - DNA, 20 bp, Artificial Sequence
  chemically synthesized
acttttatatattcgtgtta

SEQ ID NO: 464206 - DNA, 20 bp, Artificial Sequence
  chemically synthesized
tatatattcgtgttatagtt

SEQ ID NO: 464207 - DNA, 20 bp, Artificial Sequence
  chemically synthesized
agtaaaatgttttaaaaatc

SEQ ID NO: 464208 - DNA, 20 bp, Artificial Sequence
  chemically synthesized
gtaaaatgttttaaaaatca

SEQ ID NO: 464209 - DNA, 20 bp, Artificial Sequence
  chemically synthesized
aaaatgttttaaaaatcaag

SEQ ID NO: 464210 - DNA, 20 bp, Artificial Sequence
  chemically synthesized
aaatgttttaaaaatcaagg

SEQ ID NO: 464211 - DNA, 20 bp, Artificial Sequence
  chemically synthesized
gttttaaaaatcaaggagga

SEQ ID NO: 464212 - DNA, 20 bp, Artificial Sequence
  chemically synthesized
ttccctttatagattaagga

SEQ ID NO: 464213 - DNA, 20 bp, Artificial Sequence
  chemically synthesized
taatttccctttatagatta

SEQ ID NO: 464214 - DNA, 20 bp, Artificial Sequence
  chemically synthesized
gtaatttccctttatagatt

SEQ ID NO: 464215 - DNA, 20 bp, Artificial Sequence
  chemically synthesized
aatactttccttaatctata

SEQ ID NO: 464216 - DNA, 20 bp, Artificial Sequence
  chemically synthesized
atactttccttaatctataa

SEQ ID NO: 464217 - DNA, 20 bp, Artificial Sequence
  chemically synthesized
tactttccttaatctataaa

SEQ ID NO: 464218 - DNA, 20 bp, Artificial Sequence
  chemically synthesized
tcattagtaatttcccttta

SEQ ID NO: 464219 - DNA, 20 bp, Artificial Sequence
  chemically synthesized
aaattcctcccaacattcat

SEQ ID NO: 464220 - DNA, 20 bp, Artificial Sequence
  chemically synthesized
gggaaattactaatgaatgt

SEQ ID NO: 464221 - DNA, 20 bp, Artificial Sequence
  chemically synthesized
ggaaattactaatgaatgtt

SEQ ID NO: 464222 - DNA, 20 bp, Artificial Sequence
  chemically synthesized
aaattactaatgaatgttgg

SEQ ID NO: 464223 - DNA, 20 bp, Artificial Sequence
  chemically synthesized
aattactaatgaatgttggg

SEQ ID NO: 464224 - DNA, 20 bp, Artificial Sequence
  chemically synthesized
gaggaatttttctttgcctt

SEQ ID NO: 464225 - DNA, 20 bp, Artificial Sequence
  chemically synthesized
agatatataggctaaaggca

SEQ ID NO: 464226 - DNA, 20 bp, Artificial Sequence
  chemically synthesized
aacttagatatataggctaa

SEQ ID NO: 464227 - DNA, 20 bp, Artificial Sequence
  chemically synthesized
taacttagatatataggcta

SEQ ID NO: 464228 - DNA, 20 bp, Artificial Sequence
  chemically synthesized
ctgaagtaacttagatatat

SEQ ID NO: 464229 - DNA, 20 bp, Artificial Sequence
  chemically synthesized
tgcctttagcctatatatct

SEQ ID NO: 464230 - DNA, 20 bp, Artificial Sequence
  chemically synthesized
gctgaagtaacttagatata

SEQ ID NO: 464231 - DNA, 20 bp, Artificial Sequence
  chemically synthesized
tctgactcgctgaagtaact

SEQ ID NO: 464232 - DNA, 20 bp, Artificial Sequence
  chemically synthesized
cctatatatctaagttactt

SEQ ID NO: 464233 - DNA, 20 bp, Artificial Sequence
  chemically synthesized
tatatctaagttacttcagc

SEQ ID NO: 464234 - DNA, 20 bp, Artificial Sequence
  chemically synthesized
tttatatctctgactcgctg

SEQ ID NO: 464235 - DNA, 20 bp, Artificial Sequence
  chemically synthesized
tctaagttacttcagcgagt

SEQ ID NO: 464236 - DNA, 20 bp, Artificial Sequence
  chemically synthesized
taagttacttcagcgagtca

SEQ ID NO: 464237 - DNA, 20 bp, Artificial Sequence
  chemically synthesized
cagcgagtcagagatataaa

SEQ ID NO: 464238 - DNA, 20 bp, Artificial Sequence
  chemically synthesized
cagagatataaatagatata

SEQ ID NO: 464239 - DNA, 20 bp, Artificial Sequence
  chemically synthesized
atatgcatatctatatatgt

SEQ ID NO: 464240 - DNA, 20 bp, Artificial Sequence
  chemically synthesized
ctcccttcttctgacatata

SEQ ID NO: 464241 - DNA, 20 bp, Artificial Sequence
  chemically synthesized
tgcatatctatatatgtcag

SEQ ID NO: 464242 - DNA, 20 bp, Artificial Sequence
  chemically synthesized
atatctatatatgtcagaag

SEQ ID NO: 464243 - DNA, 20 bp, Artificial Sequence
  chemically synthesized
tatctatatatgtcagaaga

SEQ ID NO: 464244 - DNA, 20 bp, Artificial Sequence
  chemically synthesized
atctatatatgtcagaagaa

SEQ ID NO: 464245 - DNA, 20 bp, Artificial Sequence
  chemically synthesized
ctatatatgtcagaagaagg

SEQ ID NO: 464246 - DNA, 20 bp, Artificial Sequence
  chemically synthesized
atatatgtcagaagaaggga

SEQ ID NO: 464247 - DNA, 20 bp, Artificial Sequence
  chemically synthesized
atatgtcagaagaagggaga

SEQ ID NO: 464248 - DNA, 20 bp, Artificial Sequence
  chemically synthesized
gtcagaagaagggagagaga

SEQ ID NO: 464249 - DNA, 20 bp, Artificial Sequence
  chemically synthesized
cagaagaagggagagagaaa

SEQ ID NO: 464250 - DNA, 20 bp, Artificial Sequence
  chemically synthesized
agaagaagggagagagaaag

SEQ ID NO: 464251 - DNA, 20 bp, Artificial Sequence
  chemically synthesized
aagaagggagagagaaagag

SEQ ID NO: 464252 - DNA, 20 bp, Artificial Sequence
  chemically synthesized
gaagggagagagaaagagga

SEQ ID NO: 464253 - DNA, 20 bp, Artificial Sequence
  chemically synthesized
agggagagagaaagaggaga

SEQ ID NO: 464254 - DNA, 20 bp, Artificial Sequence
  chemically synthesized
ggagagagaaagaggagaga

SEQ ID NO: 464255 - DNA, 20 bp, Artificial Sequence
  chemically synthesized
agagagaaagaggagagaga

SEQ ID NO: 464256 - DNA, 20 bp, Artificial Sequence
  chemically synthesized
aagaatttaattatcgaaaa

SEQ ID NO: 464257 - DNA, 20 bp, Artificial Sequence
  chemically synthesized
ttttcgataattaaattctt

SEQ ID NO: 464258 - DNA, 20 bp, Artificial Sequence
  chemically synthesized
ctcaagcagtacattttcta

SEQ ID NO: 464259 - DNA, 20 bp, Artificial Sequence
  chemically synthesized
ctttagaaaatgtactgctt

SEQ ID NO: 464260 - DNA, 20 bp, Artificial Sequence
  chemically synthesized
ttagaaaatgtactgcttga

SEQ ID NO: 464261 - DNA, 20 bp, Artificial Sequence
  chemically synthesized
agaaaatgtactgcttgaga

SEQ ID NO: 464262 - DNA, 20 bp, Artificial Sequence
  chemically synthesized
gaaagtcattctctctcaag

SEQ ID NO: 464263 - DNA, 20 bp, Artificial Sequence
  chemically synthesized
ccagaaagtcattctctctc

SEQ ID NO: 464264 - DNA, 20 bp, Artificial Sequence
  chemically synthesized
cttgagagagaatgactttc

SEQ ID NO: 464265 - DNA, 20 bp, Artificial Sequence
  chemically synthesized
gaagaatcgaatcatccaga

SEQ ID NO: 464266 - DNA, 20 bp, Artificial Sequence
  chemically synthesized
ttctgaagaatcgaatcatc

SEQ ID NO: 464267 - DNA, 20 bp, Artificial Sequence
  chemically synthesized
ttctggatgattcgattctt

SEQ ID NO: 464268 - DNA, 20 bp, Artificial Sequence
  chemically synthesized
ggtaaacaagatattttctg

SEQ ID NO: 464269 - DNA, 20 bp, Artificial Sequence
  chemically synthesized
ttaaaaagagacaggtaaac

SEQ ID NO: 464270 - DNA, 20 bp, Artificial Sequence
  chemically synthesized
ctaggaaattaaaaagagac

SEQ ID NO: 464271 - DNA, 20 bp, Artificial Sequence
  chemically synthesized
cctaggaaattaaaaagaga

SEQ ID NO: 464272 - DNA, 20 bp, Artificial Sequence
  chemically synthesized
tcctcctaggaaattaaaaa

SEQ ID NO: 464273 - DNA, 20 bp, Artificial Sequence
  chemically synthesized
actcctcctaggaaattaaa

SEQ ID NO: 464274 - DNA, 20 bp, Artificial Sequence
  chemically synthesized
cctgtctctttttaatttcc

SEQ ID NO: 464275 - DNA, 20 bp, Artificial Sequence
  chemically synthesized
ctgtctctttttaatttcct

SEQ ID NO: 464276 - DNA, 20 bp, Artificial Sequence
  chemically synthesized
gtctctttttaatttcctag

SEQ ID NO: 464277 - DNA, 20 bp, Artificial Sequence
  chemically synthesized
tctctttttaatttcctagg

SEQ ID NO: 464278 - DNA, 20 bp, Artificial Sequence
  chemically synthesized
tctttttaatttcctaggag

SEQ ID NO: 464279 - DNA, 20 bp, Artificial Sequence
  chemically synthesized
cctcacacccaactcctcct

SEQ ID NO: 464280 - DNA, 20 bp, Artificial Sequence
  chemically synthesized
gcctcacacccaactcctcc

SEQ ID NO: 464281 - DNA, 20 bp, Artificial Sequence
  chemically synthesized
tttaatttcctaggaggagt

SEQ ID NO: 464282 - DNA, 20 bp, Artificial Sequence
  chemically synthesized
ttaatttcctaggaggagtt

SEQ ID NO: 464283 - DNA, 20 bp, Artificial Sequence
  chemically synthesized
tcctaggaggagttgggtgt

SEQ ID NO: 464284 - DNA, 20 bp, Artificial Sequence
  chemically synthesized
cctaggaggagttgggtgtg

SEQ ID NO: 464285 - DNA, 20 bp, Artificial Sequence
  chemically synthesized
ggaggagttgggtgtgaggc

SEQ ID NO: 464286 - DNA, 20 bp, Artificial Sequence
  chemically synthesized
aggagttgggtgtgaggctg

SEQ ID NO: 464287 - DNA, 20 bp, Artificial Sequence
  chemically synthesized
cttccaatttaattgatctc

SEQ ID NO: 464288 - DNA, 20 bp, Artificial Sequence
  chemically synthesized
aggctggagatcaattaaat

SEQ ID NO: 464289 - DNA, 20 bp, Artificial Sequence
  chemically synthesized
ctggagatcaattaaattgg

SEQ ID NO: 464290 - DNA, 20 bp, Artificial Sequence
  chemically synthesized
aaattggaagatgttgaaat

SEQ ID NO: 464291 - DNA, 20 bp, Artificial Sequence
  chemically synthesized
tgaaattggataaaacctta

SEQ ID NO: 464292 - DNA, 20 bp, Artificial Sequence
  chemically synthesized
attgtgttagataatccgta

SEQ ID NO: 464293 - DNA, 20 bp, Artificial Sequence
  chemically synthesized
aattgtgttagataatccgt

SEQ ID NO: 464294 - DNA, 20 bp, Artificial Sequence
  chemically synthesized
gtaacaataagaaattgtgt

SEQ ID NO: 464295 - DNA, 20 bp, Artificial Sequence
  chemically synthesized
aacacaatttcttattgtta

SEQ ID NO: 464296 - DNA, 20 bp, Artificial Sequence
  chemically synthesized
ccaaataaacctgtaacaat

SEQ ID NO: 464297 - DNA, 20 bp, Artificial Sequence
  chemically synthesized
acacaatttcttattgttac

SEQ ID NO: 464298 - DNA, 20 bp, Artificial Sequence
  chemically synthesized
cttattgttacaggtttatt

SEQ ID NO: 464299 - DNA, 20 bp, Artificial Sequence
  chemically synthesized
gttacaggtttatttggcaa

SEQ ID NO: 464300 - DNA, 20 bp, Artificial Sequence
  chemically synthesized
ggataacatctcagatagaa

SEQ ID NO: 464301 - DNA, 20 bp, Artificial Sequence
  chemically synthesized
gcaatagatctattctatct

SEQ ID NO: 464302 - DNA, 20 bp, Artificial Sequence
  chemically synthesized
tgaaaggataacatctcaga

SEQ ID NO: 464303 - DNA, 20 bp, Artificial Sequence
  chemically synthesized
gggctgaaaggataacatct

SEQ ID NO: 464304 - DNA, 20 bp, Artificial Sequence
  chemically synthesized
tatctgagatgttatccttt

SEQ ID NO: 464305 - DNA, 20 bp, Artificial Sequence
  chemically synthesized
ggttacaaaggagggctgaa

SEQ ID NO: 464306 - DNA, 20 bp, Artificial Sequence
  chemically synthesized
aggttacaaaggagggctga

SEQ ID NO: 464307 - DNA, 20 bp, Artificial Sequence
  chemically synthesized
acctcagaggttacaaagga

SEQ ID NO: 464308 - DNA, 20 bp, Artificial Sequence
  chemically synthesized
gacctcagaggttacaaagg

SEQ ID NO: 464309 - DNA, 20 bp, Artificial Sequence
  chemically synthesized
agacctcagaggttacaaag

SEQ ID NO: 464310 - DNA, 20 bp, Artificial Sequence
  chemically synthesized
tcagacctcagaggttacaa

SEQ ID NO: 464311 - DNA, 20 bp, Artificial Sequence
  chemically synthesized
atcagacctcagaggttaca

SEQ ID NO: 464312 - DNA, 20 bp, Artificial Sequence
  chemically synthesized
agccctcctttgtaacctct

SEQ ID NO: 464313 - DNA, 20 bp, Artificial Sequence
  chemically synthesized
gccctcctttgtaacctctg

SEQ ID NO: 464314 - DNA, 20 bp, Artificial Sequence
  chemically synthesized
atcacagaatcagacctcag

SEQ ID NO: 464315 - DNA, 20 bp, Artificial Sequence
  chemically synthesized
aatcacagaatcagacctca

SEQ ID NO: 464316 - DNA, 20 bp, Artificial Sequence
  chemically synthesized
ttaatcacagaatcagacct

SEQ ID NO: 464317 - DNA, 20 bp, Artificial Sequence
  chemically synthesized
agttaaattaatcacagaat

SEQ ID NO: 464318 - DNA, 20 bp, Artificial Sequence
  chemically synthesized
gtataaagttaaattaatca

SEQ ID NO: 464319 - DNA, 20 bp, Artificial Sequence
  chemically synthesized
attaatttaactttatacat

SEQ ID NO: 464320 - DNA, 20 bp, Artificial Sequence
  chemically synthesized
aaatgtttcactcatgtata

SEQ ID NO: 464321 - DNA, 20 bp, Artificial Sequence
  chemically synthesized
atacatgagtgaaacatttt

SEQ ID NO: 464322 - DNA, 20 bp, Artificial Sequence
  chemically synthesized
tacatgagtgaaacattttc

SEQ ID NO: 464323 - DNA, 20 bp, Artificial Sequence
  chemically synthesized
atgagtgaaacattttcagg

SEQ ID NO: 464324 - DNA, 20 bp, Artificial Sequence
  chemically synthesized
tttcaggtagcttctaatta

SEQ ID NO: 464325 - DNA, 20 bp, Artificial Sequence
  chemically synthesized
gtctaacactctttaattag

SEQ ID NO: 464326 - DNA, 20 bp, Artificial Sequence
  chemically synthesized
tcaggtagcttctaattaaa

SEQ ID NO: 464327 - DNA, 20 bp, Artificial Sequence
  chemically synthesized
aatgtctaacactctttaat

SEQ ID NO: 464328 - DNA, 20 bp, Artificial Sequence
  chemically synthesized
agcttctaattaaagagtgt

SEQ ID NO: 464329 - DNA, 20 bp, Artificial Sequence
  chemically synthesized
attaaagagtgttagacatt

SEQ ID NO: 464330 - DNA, 20 bp, Artificial Sequence
  chemically synthesized
acattgagataaaatatgac

SEQ ID NO: 464331 - DNA, 20 bp, Artificial Sequence
  chemically synthesized
cattgagataaaatatgaca

SEQ ID NO: 464332 - DNA, 20 bp, Artificial Sequence
  chemically synthesized
aaaatatgacaaggtctcta

SEQ ID NO: 464333 - DNA, 20 bp, Artificial Sequence
  chemically synthesized
tatgacaaggtctctaaaga

SEQ ID NO: 464334 - DNA, 20 bp, Artificial Sequence
  chemically synthesized
tttttcctatgctatcttta

SEQ ID NO: 464335 - DNA, 20 bp, Artificial Sequence
  chemically synthesized
actttttcctatgctatctt

SEQ ID NO: 464336 - DNA, 20 bp, Artificial Sequence
  chemically synthesized
caaggtctctaaagatagca

SEQ ID NO: 464337 - DNA, 20 bp, Artificial Sequence
  chemically synthesized
aaggtctctaaagatagcat

SEQ ID NO: 464338 - DNA, 20 bp, Artificial Sequence
  chemically synthesized
tctaaagatagcataggaaa

SEQ ID NO: 464339 - DNA, 20 bp, Artificial Sequence
  chemically synthesized
atagcataggaaaaagtttc

SEQ ID NO: 464340 - DNA, 20 bp, Artificial Sequence
  chemically synthesized
tagcataggaaaaagtttcc

SEQ ID NO: 464341 - DNA, 20 bp, Artificial Sequence
  chemically synthesized
agcataggaaaaagtttcca

SEQ ID NO: 464342 - DNA, 20 bp, Artificial Sequence
  chemically synthesized
taggaaaaagtttccaggga

SEQ ID NO: 464343 - DNA, 20 bp, Artificial Sequence
  chemically synthesized
agtttatgtacgtctatccc

SEQ ID NO: 464344 - DNA, 20 bp, Artificial Sequence
  chemically synthesized
agacgtacataaactaccaa

SEQ ID NO: 464345 - DNA, 20 bp, Artificial Sequence
  chemically synthesized
gacgtacataaactaccaat

SEQ ID NO: 464346 - DNA, 20 bp, Artificial Sequence
  chemically synthesized
cgtacataaactaccaatgg

SEQ ID NO: 464347 - DNA, 20 bp, Artificial Sequence
  chemically synthesized
aaacagttacctcccattgg

SEQ ID NO: 464348 - DNA, 20 bp, Artificial Sequence
  chemically synthesized
gtacataaactaccaatggg

SEQ ID NO: 464349 - DNA, 20 bp, Artificial Sequence
  chemically synthesized
tgaaaacagttacctcccat

SEQ ID NO: 464350 - DNA, 20 bp, Artificial Sequence
  chemically synthesized
ctttcaggaggatttgaaaa

SEQ ID NO: 464351 - DNA, 20 bp, Artificial Sequence
  chemically synthesized
ctgttttcaaatcctcctga

SEQ ID NO: 464352 - DNA, 20 bp, Artificial Sequence
  chemically synthesized
tgaccatgcaaactttcagg

SEQ ID NO: 464353 - DNA, 20 bp, Artificial Sequence
  chemically synthesized
atgaccatgcaaactttcag

SEQ ID NO: 464354 - DNA, 20 bp, Artificial Sequence
  chemically synthesized
gcatgaccatgcaaactttc

SEQ ID NO: 464355 - DNA, 20 bp, Artificial Sequence
  chemically synthesized
agcatgaccatgcaaacttt

SEQ ID NO: 464356 - DNA, 20 bp, Artificial Sequence
  chemically synthesized
aatcctcctgaaagtttgca

SEQ ID NO: 464357 - DNA, 20 bp, Artificial Sequence
  chemically synthesized
ttgcatggtcatgctcatgc

SEQ ID NO: 464358 - DNA, 20 bp, Artificial Sequence
  chemically synthesized
aatatgattaaagctagcat

SEQ ID NO: 464359 - DNA, 20 bp, Artificial Sequence
  chemically synthesized
atattaaatatgattaaagc

SEQ ID NO: 464360 - DNA, 20 bp, Artificial Sequence
  chemically synthesized
aatgatattaaatatgatta

SEQ ID NO: 464361 - DNA, 20 bp, Artificial Sequence
  chemically synthesized
ttaatatcattgtatgcaac

SEQ ID NO: 464362 - DNA, 20 bp, Artificial Sequence
  chemically synthesized
cattgtatgcaactggcttt

SEQ ID NO: 464363 - DNA, 20 bp, Artificial Sequence
  chemically synthesized
gtctaggctggtctaaaagc

SEQ ID NO: 464364 - DNA, 20 bp, Artificial Sequence
  chemically synthesized
tatgcaactggcttttagac

SEQ ID NO: 464365 - DNA, 20 bp, Artificial Sequence
  chemically synthesized
aaatgtctaggctggtctaa

SEQ ID NO: 464366 - DNA, 20 bp, Artificial Sequence
  chemically synthesized
aactggcttttagaccagcc

SEQ ID NO: 464367 - DNA, 20 bp, Artificial Sequence
  chemically synthesized
tagaaggaaaatgtctaggc

SEQ ID NO: 464368 - DNA, 20 bp, Artificial Sequence
  chemically synthesized
aacctagaaggaaaatgtct

SEQ ID NO: 464369 - DNA, 20 bp, Artificial Sequence
  chemically synthesized
aaacctagaaggaaaatgtc

SEQ ID NO: 464370 - DNA, 20 bp, Artificial Sequence
  chemically synthesized
cagcctagacattttccttc

SEQ ID NO: 464371 - DNA, 20 bp, Artificial Sequence
  chemically synthesized
agcctagacattttccttct

SEQ ID NO: 464372 - DNA, 20 bp, Artificial Sequence
  chemically synthesized
tcactggaatcaaacctaga

SEQ ID NO: 464373 - DNA, 20 bp, Artificial Sequence
  chemically synthesized
ttcactggaatcaaacctag

SEQ ID NO: 464374 - DNA, 20 bp, Artificial Sequence
  chemically synthesized
atcttcactggaatcaaacc

SEQ ID NO: 464375 - DNA, 20 bp, Artificial Sequence
  chemically synthesized
tttccttctaggtttgattc

SEQ ID NO: 464376 - DNA, 20 bp, Artificial Sequence
  chemically synthesized
ttctaggtttgattccagtg

SEQ ID NO: 464377 - DNA, 20 bp, Artificial Sequence
  chemically synthesized
cacctgttgctcatcttcac

SEQ ID NO: 464378 - DNA, 20 bp, Artificial Sequence
  chemically synthesized
ggtttgattccagtgaagat

SEQ ID NO: 464379 - DNA, 20 bp, Artificial Sequence
  chemically synthesized
attccagtgaagatgagcaa

SEQ ID NO: 464380 - DNA, 20 bp, Artificial Sequence
  chemically synthesized
ttccagtgaagatgagcaac

SEQ ID NO: 464381 - DNA, 20 bp, Artificial Sequence
  chemically synthesized
cagtgaagatgagcaacagg

SEQ ID NO: 464382 - DNA, 20 bp, Artificial Sequence
  chemically synthesized
tgaagatgagcaacaggtgg

SEQ ID NO: 464383 - DNA, 20 bp, Artificial Sequence
  chemically synthesized
gaagatgagcaacaggtgga

SEQ ID NO: 464384 - DNA, 20 bp, Artificial Sequence
  chemically synthesized
gtgtcacttgaaataaaaag

SEQ ID NO: 464385 - DNA, 20 bp, Artificial Sequence
  chemically synthesized
aagtgtcacttgaaataaaa

SEQ ID NO: 464386 - DNA, 20 bp, Artificial Sequence
  chemically synthesized
gaagtgtcacttgaaataaa

SEQ ID NO: 464387 - DNA, 20 bp, Artificial Sequence
  chemically synthesized
ggcatgctcctttttatttc

SEQ ID NO: 464388 - DNA, 20 bp, Artificial Sequence
  chemically synthesized
agggtaaagcgacatatttg

SEQ ID NO: 464389 - DNA, 20 bp, Artificial Sequence
  chemically synthesized
gtaattcaaagtaaagggta

SEQ ID NO: 464390 - DNA, 20 bp, Artificial Sequence
  chemically synthesized
aaatagtaattcaaagtaaa

SEQ ID NO: 464391 - DNA, 20 bp, Artificial Sequence
  chemically synthesized
aaaatagtaattcaaagtaa

SEQ ID NO: 464392 - DNA, 20 bp, Artificial Sequence
  chemically synthesized
aaaaatagtaattcaaagta

SEQ ID NO: 464393 - DNA, 20 bp, Artificial Sequence
  chemically synthesized
cagtgaaaaatagtaattca

SEQ ID NO: 464394 - DNA, 20 bp, Artificial Sequence
  chemically synthesized
aaagcaaatccagtgaaaaa

SEQ ID NO: 464395 - DNA, 20 bp, Artificial Sequence
  chemically synthesized
tttgaattactatttttcac

SEQ ID NO: 464396 - DNA, 20 bp, Artificial Sequence
  chemically synthesized
gaacagaaagaaagcaaatc

SEQ ID NO: 464397 - DNA, 20 bp, Artificial Sequence
  chemically synthesized
atgataactgaacagaaaga

SEQ ID NO: 464398 - DNA, 20 bp, Artificial Sequence
  chemically synthesized
ggatttgctttctttctgtt

SEQ ID NO: 464399 - DNA, 20 bp, Artificial Sequence
  chemically synthesized
caaaatgataactgaacaga

SEQ ID NO: 464400 - DNA, 20 bp, Artificial Sequence
  chemically synthesized
agagcaaaatgataactgaa

SEQ ID NO: 464401 - DNA, 20 bp, Artificial Sequence
  chemically synthesized
gttatcattttgctctttga

SEQ ID NO: 464402 - DNA, 20 bp, Artificial Sequence
  chemically synthesized
aaactggcaagtccatcaaa

SEQ ID NO: 464403 - DNA, 20 bp, Artificial Sequence
  chemically synthesized
aaaaactggcaagtccatca

SEQ ID NO: 464404 - DNA, 20 bp, Artificial Sequence
  chemically synthesized
ttgctctttgatggacttgc

SEQ ID NO: 464405 - DNA, 20 bp, Artificial Sequence
  chemically synthesized
agtgatgtggaaaaactggc

SEQ ID NO: 464406 - DNA, 20 bp, Artificial Sequence
  chemically synthesized
tgtgagtgatgtggaaaaac

SEQ ID NO: 464407 - DNA, 20 bp, Artificial Sequence
  chemically synthesized
agttcctagtgtgagtgatg

SEQ ID NO: 464408 - DNA, 20 bp, Artificial Sequence
  chemically synthesized
tttttccacatcactcacac

SEQ ID NO: 464409 - DNA, 20 bp, Artificial Sequence
  chemically synthesized
ttttccacatcactcacact

SEQ ID NO: 464410 - DNA, 20 bp, Artificial Sequence
  chemically synthesized
gtttccggagttcctagtgt

SEQ ID NO: 464411 - DNA, 20 bp, Artificial Sequence
  chemically synthesized
atcactcacactaggaactc

SEQ ID NO: 464412 - DNA, 20 bp, Artificial Sequence
  chemically synthesized
ctagaggtttccggagttcc

SEQ ID NO: 464413 - DNA, 20 bp, Artificial Sequence
  chemically synthesized
gactgagctagaggtttccg

SEQ ID NO: 464414 - DNA, 20 bp, Artificial Sequence
  chemically synthesized
aggactgagctagaggtttc

SEQ ID NO: 464415 - DNA, 20 bp, Artificial Sequence
  chemically synthesized
ctaggaactccggaaacctc

SEQ ID NO: 464416 - DNA, 20 bp, Artificial Sequence
  chemically synthesized
aactccggaaacctctagct

SEQ ID NO: 464417 - DNA, 20 bp, Artificial Sequence
  chemically synthesized
ctgacttaggactgagctag

SEQ ID NO: 464418 - DNA, 20 bp, Artificial Sequence
  chemically synthesized
gctgacttaggactgagcta

SEQ ID NO: 464419 - DNA, 20 bp, Artificial Sequence
  chemically synthesized
aagctgacttaggactgagc

SEQ ID NO: 464420 - DNA, 20 bp, Artificial Sequence
  chemically synthesized
gaaacctctagctcagtcct

SEQ ID NO: 464421 - DNA, 20 bp, Artificial Sequence
  chemically synthesized
agtaaagctgacttaggact

SEQ ID NO: 464422 - DNA, 20 bp, Artificial Sequence
  chemically synthesized
cctctagctcagtcctaagt

SEQ ID NO: 464423 - DNA, 20 bp, Artificial Sequence
  chemically synthesized
ccagacagtaaagctgactt

SEQ ID NO: 464424 - DNA, 20 bp, Artificial Sequence
  chemically synthesized
cccagacagtaaagctgact

SEQ ID NO: 464425 - DNA, 20 bp, Artificial Sequence
  chemically synthesized
cctaagtcagctttactgtc

SEQ ID NO: 464426 - DNA, 20 bp, Artificial Sequence
  chemically synthesized
aactgtgaacccagacagta

SEQ ID NO: 464427 - DNA, 20 bp, Artificial Sequence
  chemically synthesized
ctaagtcagctttactgtct

SEQ ID NO: 464428 - DNA, 20 bp, Artificial Sequence
  chemically synthesized
acagcaactgtgaacccaga

SEQ ID NO: 464429 - DNA, 20 bp, Artificial Sequence
  chemically synthesized
agctttactgtctgggttca

SEQ ID NO: 464430 - DNA, 20 bp, Artificial Sequence
  chemically synthesized
agcaacagcaactgtgaacc

SEQ ID NO: 464431 - DNA, 20 bp, Artificial Sequence
  chemically synthesized
aatagctaagcagagagcaa

SEQ ID NO: 464432 - DNA, 20 bp, Artificial Sequence
  chemically synthesized
agttgctgttgctctctgct

SEQ ID NO: 464433 - DNA, 20 bp, Artificial Sequence
  chemically synthesized
acagtgaatagctaagcaga

SEQ ID NO: 464434 - DNA, 20 bp, Artificial Sequence
  chemically synthesized
ttacagtgaatagctaagca

SEQ ID NO: 464435 - DNA, 20 bp, Artificial Sequence
  chemically synthesized
atttacagtgaatagctaag

SEQ ID NO: 464436 - DNA, 20 bp, Artificial Sequence
  chemically synthesized
aatatttacagtgaatagct

SEQ ID NO: 464437 - DNA, 20 bp, Artificial Sequence
  chemically synthesized
agaaaaatatttacagtgaa

SEQ ID NO: 464438 - DNA, 20 bp, Artificial Sequence
  chemically synthesized
tgagaagagaaaaatattta

SEQ ID NO: 464439 - DNA, 20 bp, Artificial Sequence
  chemically synthesized
gtggtttatgtggatgagaa

SEQ ID NO: 464440 - DNA, 20 bp, Artificial Sequence
  chemically synthesized
acgtggtttatgtggatgag

SEQ ID NO: 464441 - DNA, 20 bp, Artificial Sequence
  chemically synthesized
cgaacgtggtttatgtggat

SEQ ID NO: 464442 - DNA, 20 bp, Artificial Sequence
  chemically synthesized
agagacgaacgtggtttatg

SEQ ID NO: 464443 - DNA, 20 bp, Artificial Sequence
  chemically synthesized
gaggaatttagagacgaacg

SEQ ID NO: 464444 - DNA, 20 bp, Artificial Sequence
  chemically synthesized
tacagtccctgaggaattta

SEQ ID NO: 464445 - DNA, 20 bp, Artificial Sequence
  chemically synthesized
acgttcgtctctaaattcct

SEQ ID NO: 464446 - DNA, 20 bp, Artificial Sequence
  chemically synthesized
gatacagtccctgaggaatt

SEQ ID NO: 464447 - DNA, 20 bp, Artificial Sequence
  chemically synthesized
cgttcgtctctaaattcctc

SEQ ID NO: 464448 - DNA, 20 bp, Artificial Sequence
  chemically synthesized
gttcgtctctaaattcctca

SEQ ID NO: 464449 - DNA, 20 bp, Artificial Sequence
  chemically synthesized
tgactaagatacagtccctg

SEQ ID NO: 464450 - DNA, 20 bp, Artificial Sequence
  chemically synthesized
atgactaagatacagtccct

SEQ ID NO: 464451 - DNA, 20 bp, Artificial Sequence
  chemically synthesized
attcctcagggactgtatct

SEQ ID NO: 464452 - DNA, 20 bp, Artificial Sequence
  chemically synthesized
agagcaagatgactaagata

SEQ ID NO: 464453 - DNA, 20 bp, Artificial Sequence
  chemically synthesized
tgtgctagagcaagatgact

SEQ ID NO: 464454 - DNA, 20 bp, Artificial Sequence
  chemically synthesized
gtatcttagtcatcttgctc

SEQ ID NO: 464455 - DNA, 20 bp, Artificial Sequence
  chemically synthesized
gccaggctctgtgctagagc

SEQ ID NO: 464456 - DNA, 20 bp, Artificial Sequence
  chemically synthesized
ttagtcatcttgctctagca

SEQ ID NO: 464457 - DNA, 20 bp, Artificial Sequence
  chemically synthesized
agtcatcttgctctagcaca

SEQ ID NO: 464458 - DNA, 20 bp, Artificial Sequence
  chemically synthesized
aactgccaggctctgtgcta

SEQ ID NO: 464459 - DNA, 20 bp, Artificial Sequence
  chemically synthesized
ctaactgccaggctctgtgc

SEQ ID NO: 464460 - DNA, 20 bp, Artificial Sequence
  chemically synthesized
tcttgctctagcacagagcc

SEQ ID NO: 464461 - DNA, 20 bp, Artificial Sequence
  chemically synthesized
tgctctagcacagagcctgg

SEQ ID NO: 464462 - DNA, 20 bp, Artificial Sequence
  chemically synthesized
ctagcacagagcctggcagt

SEQ ID NO: 464463 - DNA, 20 bp, Artificial Sequence
  chemically synthesized
attgataaattctaactgcc

SEQ ID NO: 464464 - DNA, 20 bp, Artificial Sequence
  chemically synthesized
tattgataaattctaactgc

SEQ ID NO: 464465 - DNA, 20 bp, Artificial Sequence
  chemically synthesized
atttatcaataaatatttgt

SEQ ID NO: 464466 - DNA, 20 bp, Artificial Sequence
  chemically synthesized
atatttgttggatgaatgaa

SEQ ID NO: 464467 - DNA, 20 bp, Artificial Sequence
  chemically synthesized
tttgttggatgaatgaaaag

SEQ ID NO: 464468 - DNA, 20 bp, Artificial Sequence
  chemically synthesized
gttggatgaatgaaaagcag

SEQ ID NO: 464469 - DNA, 20 bp, Artificial Sequence
  chemically synthesized
gcagaaacaacctttcattt

SEQ ID NO: 464470 - DNA, 20 bp, Artificial Sequence
  chemically synthesized
agcccaccaactgaaatgaa

SEQ ID NO: 464471 - DNA, 20 bp, Artificial Sequence
  chemically synthesized
gagcccaccaactgaaatga

SEQ ID NO: 464472 - DNA, 20 bp, Artificial Sequence
  chemically synthesized
aaacaacctttcatttcagt

SEQ ID NO: 464473 - DNA, 20 bp, Artificial Sequence
  chemically synthesized
caacctttcatttcagttgg

SEQ ID NO: 464474 - DNA, 20 bp, Artificial Sequence
  chemically synthesized
aacctttcatttcagttggt

SEQ ID NO: 464475 - DNA, 20 bp, Artificial Sequence
  chemically synthesized
aggtcatccagacaggatta

SEQ ID NO: 464476 - DNA, 20 bp, Artificial Sequence
  chemically synthesized
ttaggtcatccagacaggat

SEQ ID NO: 464477 - DNA, 20 bp, Artificial Sequence
  chemically synthesized
tggtgggctctaatcctgtc

SEQ ID NO: 464478 - DNA, 20 bp, Artificial Sequence
  chemically synthesized
ctccattaggtcatccagac

SEQ ID NO: 464479 - DNA, 20 bp, Artificial Sequence
  chemically synthesized
tctccattaggtcatccaga

SEQ ID NO: 464480 - DNA, 20 bp, Artificial Sequence
  chemically synthesized
tatttctccattaggtcatc

SEQ ID NO: 464481 - DNA, 20 bp, Artificial Sequence
  chemically synthesized
atcctgtctggatgacctaa

SEQ ID NO: 464482 - DNA, 20 bp, Artificial Sequence
  chemically synthesized
cctgtctggatgacctaatg

SEQ ID NO: 464483 - DNA, 20 bp, Artificial Sequence
  chemically synthesized
acagagtctatttctccatt

SEQ ID NO: 464484 - DNA, 20 bp, Artificial Sequence
  chemically synthesized
aacagagtctatttctccat

SEQ ID NO: 464485 - DNA, 20 bp, Artificial Sequence
  chemically synthesized
tggatgacctaatggagaaa

SEQ ID NO: 464486 - DNA, 20 bp, Artificial Sequence
  chemically synthesized
ggccacagtggcaggaaaca

SEQ ID NO: 464487 - DNA, 20 bp, Artificial Sequence
  chemically synthesized
gtggccacagtggcaggaaa

SEQ ID NO: 464488 - DNA, 20 bp, Artificial Sequence
  chemically synthesized
gactctgtttcctgccactg

SEQ ID NO: 464489 - DNA, 20 bp, Artificial Sequence
  chemically synthesized
gttttggtggccacagtggc

SEQ ID NO: 464490 - DNA, 20 bp, Artificial Sequence
  chemically synthesized
ggttttggtggccacagtgg

SEQ ID NO: 464491 - DNA, 20 bp, Artificial Sequence
  chemically synthesized
gctggttttggtggccacag

SEQ ID NO: 464492 - DNA, 20 bp, Artificial Sequence
  chemically synthesized
tgggctggttttggtggcca

SEQ ID NO: 464493 - DNA, 20 bp, Artificial Sequence
  chemically synthesized
gccactgtggccaccaaaac

SEQ ID NO: 464494 - DNA, 20 bp, Artificial Sequence
  chemically synthesized
cattcatgggctggttttgg

SEQ ID NO: 464495 - DNA, 20 bp, Artificial Sequence
  chemically synthesized
acccattcatgggctggttt

SEQ ID NO: 464496 - DNA, 20 bp, Artificial Sequence
  chemically synthesized
ctgctgacccattcatgggc

SEQ ID NO: 464497 - DNA, 20 bp, Artificial Sequence
  chemically synthesized
caccaaaaccagcccatgaa

SEQ ID NO: 464498 - DNA, 20 bp, Artificial Sequence
  chemically synthesized
accaaaaccagcccatgaat

SEQ ID NO: 464499 - DNA, 20 bp, Artificial Sequence
  chemically synthesized
ttggctgctgacccattcat

SEQ ID NO: 464500 - DNA, 20 bp, Artificial Sequence
  chemically synthesized
tttggctgctgacccattca

SEQ ID NO: 464501 - DNA, 20 bp, Artificial Sequence
  chemically synthesized
aaaccagcccatgaatgggt

SEQ ID NO: 464502 - DNA, 20 bp, Artificial Sequence
  chemically synthesized
ccagcccatgaatgggtcag

SEQ ID NO: 464503 - DNA, 20 bp, Artificial Sequence
  chemically synthesized
catgaatgggtcagcagcca

SEQ ID NO: 464504 - DNA, 20 bp, Artificial Sequence
  chemically synthesized
atgaatgggtcagcagccaa

SEQ ID NO: 464505 - DNA, 20 bp, Artificial Sequence
  chemically synthesized
tgaatgggtcagcagccaaa

SEQ ID NO: 464506 - DNA, 20 bp, Artificial Sequence
  chemically synthesized
aatgggtcagcagccaaagg

SEQ ID NO: 464507 - DNA, 20 bp, Artificial Sequence
  chemically synthesized
tgggtcagcagccaaaggga

SEQ ID NO: 464508 - DNA, 20 bp, Artificial Sequence
  chemically synthesized
gggtcagcagccaaagggag

SEQ ID NO: 464509 - DNA, 20 bp, Artificial Sequence
  chemically synthesized
atctcaggttcctctccctt

SEQ ID NO: 464510 - DNA, 20 bp, Artificial Sequence
  chemically synthesized
agccaaagggagaggaacct

SEQ ID NO: 464511 - DNA, 20 bp, Artificial Sequence
  chemically synthesized
cattagtgagtaggaatctc

SEQ ID NO: 464512 - DNA, 20 bp, Artificial Sequence
  chemically synthesized
acattagtgagtaggaatct

SEQ ID NO: 464513 - DNA, 20 bp, Artificial Sequence
  chemically synthesized
tgatggacacattagtgagt

SEQ ID NO: 464514 - DNA, 20 bp, Artificial Sequence
  chemically synthesized
gtgatggacacattagtgag

SEQ ID NO: 464515 - DNA, 20 bp, Artificial Sequence
  chemically synthesized
catgtgatggacacattagt

SEQ ID NO: 464516 - DNA, 20 bp, Artificial Sequence
  chemically synthesized
cctgcatgtgatggacacat

SEQ ID NO: 464517 - DNA, 20 bp, Artificial Sequence
  chemically synthesized
actaatgtgtccatcacatg

SEQ ID NO: 464518 - DNA, 20 bp, Artificial Sequence
  chemically synthesized
aagtaaaagcctgcatgtga

SEQ ID NO: 464519 - DNA, 20 bp, Artificial Sequence
  chemically synthesized
ctaatgtgtccatcacatgc

SEQ ID NO: 464520 - DNA, 20 bp, Artificial Sequence
  chemically synthesized
gtaaaaaggagattaagtaa

SEQ ID NO: 464521 - DNA, 20 bp, Artificial Sequence
  chemically synthesized
acaagtgtaaaaaggagatt

SEQ ID NO: 464522 - DNA, 20 bp, Artificial Sequence
  chemically synthesized
tctatgacaagtgtaaaaag

SEQ ID NO: 464523 - DNA, 20 bp, Artificial Sequence
  chemically synthesized
gttctatgacaagtgtaaaa

SEQ ID NO: 464524 - DNA, 20 bp, Artificial Sequence
  chemically synthesized
tgttctatgacaagtgtaaa

SEQ ID NO: 464525 - DNA, 20 bp, Artificial Sequence
  chemically synthesized
tctcctttttacacttgtca

SEQ ID NO: 464526 - DNA, 20 bp, Artificial Sequence
  chemically synthesized
actcatttatgttctatgac

SEQ ID NO: 464527 - DNA, 20 bp, Artificial Sequence
  chemically synthesized
acttgtcatagaacataaat

SEQ ID NO: 464528 - DNA, 20 bp, Artificial Sequence
  chemically synthesized
atgggttttaggggagatgt

SEQ ID NO: 464529 - DNA, 20 bp, Artificial Sequence
  chemically synthesized
tatgggttttaggggagatg

SEQ ID NO: 464530 - DNA, 20 bp, Artificial Sequence
  chemically synthesized
aaattgtatgggttttaggg

SEQ ID NO: 464531 - DNA, 20 bp, Artificial Sequence
  chemically synthesized
tgaaattgtatgggttttag

SEQ ID NO: 464532 - DNA, 20 bp, Artificial Sequence
  chemically synthesized
ctgaaattgtatgggtttta

SEQ ID NO: 464533 - DNA, 20 bp, Artificial Sequence
  chemically synthesized
cctgaaattgtatgggtttt

SEQ ID NO: 464534 - DNA, 20 bp, Artificial Sequence
  chemically synthesized
acctgaaattgtatgggttt

SEQ ID NO: 464535 - DNA, 20 bp, Artificial Sequence
  chemically synthesized
atgctaacctgaaattgtat

SEQ ID NO: 464536 - DNA, 20 bp, Artificial Sequence
  chemically synthesized
aatgctaacctgaaattgta

SEQ ID NO: 464537 - DNA, 20 bp, Artificial Sequence
  chemically synthesized
ccctaaaacccatacaattt

SEQ ID NO: 464538 - DNA, 20 bp, Artificial Sequence
  chemically synthesized
cctaaaacccatacaatttc

SEQ ID NO: 464539 - DNA, 20 bp, Artificial Sequence
  chemically synthesized
aaacccatacaatttcaggt

SEQ ID NO: 464540 - DNA, 20 bp, Artificial Sequence
  chemically synthesized
atacaatttcaggttagcat

SEQ ID NO: 464541 - DNA, 20 bp, Artificial Sequence
  chemically synthesized
acaataagctggattattga

SEQ ID NO: 464542 - DNA, 20 bp, Artificial Sequence
  chemically synthesized
tagtgtcactttcaataatc

SEQ ID NO: 464543 - DNA, 20 bp, Artificial Sequence
  chemically synthesized
tcggtccagcaacaataagc

SEQ ID NO: 464544 - DNA, 20 bp, Artificial Sequence
  chemically synthesized
ttgttcggtccagcaacaat

SEQ ID NO: 464545 - DNA, 20 bp, Artificial Sequence
  chemically synthesized
ataatccagcttattgttgc

SEQ ID NO: 464546 - DNA, 20 bp, Artificial Sequence
  chemically synthesized
ataagtagaattgttcggtc

SEQ ID NO: 464547 - DNA, 20 bp, Artificial Sequence
  chemically synthesized
atgctataagtagaattgtt

SEQ ID NO: 464548 - DNA, 20 bp, Artificial Sequence
  chemically synthesized
ggaccgaacaattctactta

SEQ ID NO: 464549 - DNA, 20 bp, Artificial Sequence
  chemically synthesized
tcttttatacatgctataag

SEQ ID NO: 464550 - DNA, 20 bp, Artificial Sequence
  chemically synthesized
atttcttttatacatgctat

SEQ ID NO: 464551 - DNA, 20 bp, Artificial Sequence
  chemically synthesized
tctacttatagcatgtataa

SEQ ID NO: 464552 - DNA, 20 bp, Artificial Sequence
  chemically synthesized
tgtataaaagaaatctgtac

SEQ ID NO: 464553 - DNA, 20 bp, Artificial Sequence
  chemically synthesized
atagtctgtttttactagta

SEQ ID NO: 464554 - DNA, 20 bp, Artificial Sequence
  chemically synthesized
gaaatctgtactagtaaaaa

SEQ ID NO: 464555 - DNA, 20 bp, Artificial Sequence
  chemically synthesized
ccatcatagtctgtttttac

SEQ ID NO: 464556 - DNA, 20 bp, Artificial Sequence
  chemically synthesized
ctagtaaaaacagactatga

SEQ ID NO: 464557 - DNA, 20 bp, Artificial Sequence
  chemically synthesized
aaatgtgataaggaccatca

SEQ ID NO: 464558 - DNA, 20 bp, Artificial Sequence
  chemically synthesized
tcccaggataaaatgtgata

SEQ ID NO: 464559 - DNA, 20 bp, Artificial Sequence
  chemically synthesized
ctcccaggataaaatgtgat

SEQ ID NO: 464560 - DNA, 20 bp, Artificial Sequence
  chemically synthesized
gtccttatcacattttatcc

SEQ ID NO: 464561 - DNA, 20 bp, Artificial Sequence
  chemically synthesized
tccttatcacattttatcct

SEQ ID NO: 464562 - DNA, 20 bp, Artificial Sequence
  chemically synthesized
cttatcacattttatcctgg

SEQ ID NO: 464563 - DNA, 20 bp, Artificial Sequence
  chemically synthesized
caactgattataacactccc

SEQ ID NO: 464564 - DNA, 20 bp, Artificial Sequence
  chemically synthesized
acaactgattataacactcc

SEQ ID NO: 464565 - DNA, 20 bp, Artificial Sequence
  chemically synthesized
tatcctgggagtgttataat

SEQ ID NO: 464566 - DNA, 20 bp, Artificial Sequence
  chemically synthesized
agttgtaacaatgtcatgac

SEQ ID NO: 464567 - DNA, 20 bp, Artificial Sequence
  chemically synthesized
ttgtaacaatgtcatgacca

SEQ ID NO: 464568 - DNA, 20 bp, Artificial Sequence
  chemically synthesized
ttatcagcatcattcagctc

SEQ ID NO: 464569 - DNA, 20 bp, Artificial Sequence
  chemically synthesized
ataaacttatcagcatcatt

SEQ ID NO: 464570 - DNA, 20 bp, Artificial Sequence
  chemically synthesized
cagagctgaatgatgctgat

SEQ ID NO: 464571 - DNA, 20 bp, Artificial Sequence
  chemically synthesized
ctaagggaaaataaacttat

SEQ ID NO: 464572 - DNA, 20 bp, Artificial Sequence
  chemically synthesized
ctgataagtttattttccct

SEQ ID NO: 464573 - DNA, 20 bp, Artificial Sequence
  chemically synthesized
ttatgaatacaaagagctaa

SEQ ID NO: 464574 - DNA, 20 bp, Artificial Sequence
  chemically synthesized
gttatgaatacaaagagcta

SEQ ID NO: 464575 - DNA, 20 bp, Artificial Sequence
  chemically synthesized
ggttatgaatacaaagagct

SEQ ID NO: 464576 - DNA, 20 bp, Artificial Sequence
  chemically synthesized
gacagggttatgaatacaaa

SEQ ID NO: 464577 - DNA, 20 bp, Artificial Sequence
  chemically synthesized
aagacagggttatgaataca

SEQ ID NO: 464578 - DNA, 20 bp, Artificial Sequence
  chemically synthesized
tatgttgcaatttgaagaca

SEQ ID NO: 464579 - DNA, 20 bp, Artificial Sequence
  chemically synthesized
ttatgttgcaatttgaagac

SEQ ID NO: 464580 - DNA, 20 bp, Artificial Sequence
  chemically synthesized
attatgttgcaatttgaaga

SEQ ID NO: 464581 - DNA, 20 bp, Artificial Sequence
  chemically synthesized
tgacattatgttgcaatttg

SEQ ID NO: 464582 - DNA, 20 bp, Artificial Sequence
  chemically synthesized
cataatgtcaatatttcttc

SEQ ID NO: 464583 - DNA, 20 bp, Artificial Sequence
  chemically synthesized
ggtgcttatcaaatttccag

SEQ ID NO: 464584 - DNA, 20 bp, Artificial Sequence
  chemically synthesized
gatggtgcttatcaaatttc

SEQ ID NO: 464585 - DNA, 20 bp, Artificial Sequence
  chemically synthesized
atttcttctggaaatttgat

SEQ ID NO: 464586 - DNA, 20 bp, Artificial Sequence
  chemically synthesized
tacacctgaaggtaaatgga

SEQ ID NO: 464587 - DNA, 20 bp, Artificial Sequence
  chemically synthesized
aatgtacacctgaaggtaaa

SEQ ID NO: 464588 - DNA, 20 bp, Artificial Sequence
  chemically synthesized
aagcaccatccatttacctt

SEQ ID NO: 464589 - DNA, 20 bp, Artificial Sequence
  chemically synthesized
agcaccatccatttaccttc

SEQ ID NO: 464590 - DNA, 20 bp, Artificial Sequence
  chemically synthesized
tgctgtcaatgtacacctga

SEQ ID NO: 464591 - DNA, 20 bp, Artificial Sequence
  chemically synthesized
ttgctgtcaatgtacacctg

SEQ ID NO: 464592 - DNA, 20 bp, Artificial Sequence
  chemically synthesized
taccttcaggtgtacattga

SEQ ID NO: 464593 - DNA, 20 bp, Artificial Sequence
  chemically synthesized
ggaaacgtaggtggtacgca

SEQ ID NO: 464594 - DNA, 20 bp, Artificial Sequence
  chemically synthesized
ctggaaacgtaggtggtacg

SEQ ID NO: 464595 - DNA, 20 bp, Artificial Sequence
  chemically synthesized
atgacaactggaaacgtagg

SEQ ID NO: 464596 - DNA, 20 bp, Artificial Sequence
  chemically synthesized
ctgcgtaccacctacgtttc

SEQ ID NO: 464597 - DNA, 20 bp, Artificial Sequence
  chemically synthesized
aggatgacaactggaaacgt

SEQ ID NO: 464598 - DNA, 20 bp, Artificial Sequence
  chemically synthesized
caggatgacaactggaaacg

SEQ ID NO: 464599 - DNA, 20 bp, Artificial Sequence
  chemically synthesized
aggaggtacaggatgacaac

SEQ ID NO: 464600 - DNA, 20 bp, Artificial Sequence
  chemically synthesized
aacgtttatagaggaggtac

SEQ ID NO: 464601 - DNA, 20 bp, Artificial Sequence
  chemically synthesized
aaacgtttatagaggaggta

SEQ ID NO: 464602 - DNA, 20 bp, Artificial Sequence
  chemically synthesized
tgagcaaacgtttatagagg

SEQ ID NO: 464603 - DNA, 20 bp, Artificial Sequence
  chemically synthesized
ttgagcaaacgtttatagag

SEQ ID NO: 464604 - DNA, 20 bp, Artificial Sequence
  chemically synthesized
ttttgagcaaacgtttatag

SEQ ID NO: 464605 - DNA, 20 bp, Artificial Sequence
  chemically synthesized
cttttgagcaaacgtttata

SEQ ID NO: 464606 - DNA, 20 bp, Artificial Sequence
  chemically synthesized
ttcttttgagcaaacgttta

SEQ ID NO: 464607 - DNA, 20 bp, Artificial Sequence
  chemically synthesized
ctctataaacgtttgctcaa

SEQ ID NO: 464608 - DNA, 20 bp, Artificial Sequence
  chemically synthesized
taaaactgagatgttctttt

SEQ ID NO: 464609 - DNA, 20 bp, Artificial Sequence
  chemically synthesized
gtttgctcaaaagaacatct

SEQ ID NO: 464610 - DNA, 20 bp, Artificial Sequence
  chemically synthesized
gtctagacaaaagtaaaact

SEQ ID NO: 464611 - DNA, 20 bp, Artificial Sequence
  chemically synthesized
atctcagttttacttttgtc

SEQ ID NO: 464612 - DNA, 20 bp, Artificial Sequence
  chemically synthesized
taaaaatattgtctagacaa

SEQ ID NO: 464613 - DNA, 20 bp, Artificial Sequence
  chemically synthesized
aaatgggtaaaaatattgtc

SEQ ID NO: 464614 - DNA, 20 bp, Artificial Sequence
  chemically synthesized
actgcagtaaataagcaaat

SEQ ID NO: 464615 - DNA, 20 bp, Artificial Sequence
  chemically synthesized
cactgcagtaaataagcaaa

SEQ ID NO: 464616 - DNA, 20 bp, Artificial Sequence
  chemically synthesized
taaagtgcactgcagtaaat

SEQ ID NO: 464617 - DNA, 20 bp, Artificial Sequence
  chemically synthesized
acccatttgcttatttactg

SEQ ID NO: 464618 - DNA, 20 bp, Artificial Sequence
  chemically synthesized
ttacagcctaaagtgcactg

SEQ ID NO: 464619 - DNA, 20 bp, Artificial Sequence
  chemically synthesized
ttatttactgcagtgcactt

SEQ ID NO: 464620 - DNA, 20 bp, Artificial Sequence
  chemically synthesized
tatttactgcagtgcacttt

SEQ ID NO: 464621 - DNA, 20 bp, Artificial Sequence
  chemically synthesized
agctttggggttacagccta

SEQ ID NO: 464622 - DNA, 20 bp, Artificial Sequence
  chemically synthesized
tttcttgagctttggggtta

SEQ ID NO: 464623 - DNA, 20 bp, Artificial Sequence
  chemically synthesized
cactttaggctgtaacccca

SEQ ID NO: 464624 - DNA, 20 bp, Artificial Sequence
  chemically synthesized
acttattttcttgagctttg

SEQ ID NO: 464625 - DNA, 20 bp, Artificial Sequence
  chemically synthesized
aggctgtaaccccaaagctc

SEQ ID NO: 464626 - DNA, 20 bp, Artificial Sequence
  chemically synthesized
aacttattttcttgagcttt

SEQ ID NO: 464627 - DNA, 20 bp, Artificial Sequence
  chemically synthesized
aaacttattttcttgagctt

SEQ ID NO: 464628 - DNA, 20 bp, Artificial Sequence
  chemically synthesized
tccaaaaaacttattttctt

SEQ ID NO: 464629 - DNA, 20 bp, Artificial Sequence
  chemically synthesized
accccaaagctcaagaaaat

SEQ ID NO: 464630 - DNA, 20 bp, Artificial Sequence
  chemically synthesized
gctcaagaaaataagttttt

SEQ ID NO: 464631 - DNA, 20 bp, Artificial Sequence
  chemically synthesized
caagaaaataagttttttgg

SEQ ID NO: 464632 - DNA, 20 bp, Artificial Sequence
  chemically synthesized
aaaataagttttttggaagc

SEQ ID NO: 464633 - DNA, 20 bp, Artificial Sequence
  chemically synthesized
tttttggaagccagtcatgt

SEQ ID NO: 464634 - DNA, 20 bp, Artificial Sequence
  chemically synthesized
aattatatgcctaacatgac

SEQ ID NO: 464635 - DNA, 20 bp, Artificial Sequence
  chemically synthesized
ttttggaagccagtcatgtt

SEQ ID NO: 464636 - DNA, 20 bp, Artificial Sequence
  chemically synthesized
aatttatatgtttataattt

SEQ ID NO: 464637 - DNA, 20 bp, Artificial Sequence
  chemically synthesized
aatttaagtcatcttttcaa

SEQ ID NO: 464638 - DNA, 20 bp, Artificial Sequence
  chemically synthesized
atatatatactacttttgaa

SEQ ID NO: 464639 - DNA, 20 bp, Artificial Sequence
  chemically synthesized
ttaagtcatcttttcaaaag

SEQ ID NO: 464640 - DNA, 20 bp, Artificial Sequence
  chemically synthesized
gtatatatattgaatattta

SEQ ID NO: 464641 - DNA, 20 bp, Artificial Sequence
  chemically synthesized
atgtgacatctgaataaaac

SEQ ID NO: 464642 - DNA, 20 bp, Artificial Sequence
  chemically synthesized
taaagtattcttgttttatt

SEQ ID NO: 464643 - DNA, 20 bp, Artificial Sequence
  chemically synthesized
gtcacattttatattgcaat

SEQ ID NO: 464644 - DNA, 20 bp, Artificial Sequence
  chemically synthesized
tatattgcaattagtatcta

SEQ ID NO: 464645 - DNA, 20 bp, Artificial Sequence
  chemically synthesized
atattgcaattagtatctat

SEQ ID NO: 464646 - DNA, 20 bp, Artificial Sequence
  chemically synthesized
actccatacattttgaccta

SEQ ID NO: 464647 - DNA, 20 bp, Artificial Sequence
  chemically synthesized
tatctataggtcaaaatgta

SEQ ID NO: 464648 - DNA, 20 bp, Artificial Sequence
  chemically synthesized
tctataggtcaaaatgtatg

SEQ ID NO: 464649 - DNA, 20 bp, Artificial Sequence
  chemically synthesized
aaatgtatggagttataaaa

SEQ ID NO: 464650 - DNA, 20 bp, Artificial Sequence
  chemically synthesized
aatgtatggagttataaaaa

SEQ ID NO: 464651 - DNA, 20 bp, Artificial Sequence
  chemically synthesized
gttggaaagcaaatttttta

SEQ ID NO: 464652 - DNA, 20 bp, Artificial Sequence
  chemically synthesized
tctcctttgatagtgttgga

SEQ ID NO: 464653 - DNA, 20 bp, Artificial Sequence
  chemically synthesized
agtgtctcctttgatagtgt

SEQ ID NO: 464654 - DNA, 20 bp, Artificial Sequence
  chemically synthesized
tttgctttccaacactatca

SEQ ID NO: 464655 - DNA, 20 bp, Artificial Sequence
  chemically synthesized
ttgctttccaacactatcaa

SEQ ID NO: 464656 - DNA, 20 bp, Artificial Sequence
  chemically synthesized
gctttccaacactatcaaag

SEQ ID NO: 464657 - DNA, 20 bp, Artificial Sequence
  chemically synthesized
tgtttcagtgtctcctttga

SEQ ID NO: 464658 - DNA, 20 bp, Artificial Sequence
  chemically synthesized
tcaagttagctgtaatgttt

SEQ ID NO: 464659 - DNA, 20 bp, Artificial Sequence
  chemically synthesized
aaggagacactgaaacatta

SEQ ID NO: 464660 - DNA, 20 bp, Artificial Sequence
  chemically synthesized
tgaaacattacagctaactt

SEQ ID NO: 464661 - DNA, 20 bp, Artificial Sequence
  chemically synthesized
ttaaatgaaaaaactcaagt

SEQ ID NO: 464662 - DNA, 20 bp, Artificial Sequence
  chemically synthesized
taaattaaatgaaaaaactc

SEQ ID NO: 464663 - DNA, 20 bp, Artificial Sequence
  chemically synthesized
gagttttttcatttaattta

SEQ ID NO: 464664 - DNA, 20 bp, Artificial Sequence
  chemically synthesized
tttttcatttaatttaaaga

SEQ ID NO: 464665 - DNA, 20 bp, Artificial Sequence
  chemically synthesized
taatttaaagatagtgtgaa

SEQ ID NO: 464666 - DNA, 20 bp, Artificial Sequence
  chemically synthesized
aatttaaagatagtgtgaac

SEQ ID NO: 464667 - DNA, 20 bp, Artificial Sequence
  chemically synthesized
gatagtgtgaacaggtactg

SEQ ID NO: 464668 - DNA, 20 bp, Artificial Sequence
  chemically synthesized
aaaatgtaagacagtgtctt

SEQ ID NO: 464669 - DNA, 20 bp, Artificial Sequence
  chemically synthesized
gatattagtaaaatgtaaga

SEQ ID NO: 464670 - DNA, 20 bp, Artificial Sequence
  chemically synthesized
tatagatattagtaaaatgt

SEQ ID NO: 464671 - DNA, 20 bp, Artificial Sequence
  chemically synthesized
aatccactctatatagatat

SEQ ID NO: 464672 - DNA, 20 bp, Artificial Sequence
  chemically synthesized
acattttactaatatctata

SEQ ID NO: 464673 - DNA, 20 bp, Artificial Sequence
  chemically synthesized
attttactaatatctatata

SEQ ID NO: 464674 - DNA, 20 bp, Artificial Sequence
  chemically synthesized
ttactaatatctatatagag

SEQ ID NO: 464675 - DNA, 20 bp, Artificial Sequence
  chemically synthesized
caaatttaatccactctata

SEQ ID NO: 464676 - DNA, 20 bp, Artificial Sequence
  chemically synthesized
tgtgaaaacatatatctgca

SEQ ID NO: 464677 - DNA, 20 bp, Artificial Sequence
  chemically synthesized
tgaaaacatatatctgcaca

SEQ ID NO: 464678 - DNA, 20 bp, Artificial Sequence
  chemically synthesized
agaaatttatagactctgtg

SEQ ID NO: 464679 - DNA, 20 bp, Artificial Sequence
  chemically synthesized
ttctgaccttgagaaattta

SEQ ID NO: 464680 - DNA, 20 bp, Artificial Sequence
  chemically synthesized
acagagtctataaatttctc

SEQ ID NO: 464681 - DNA, 20 bp, Artificial Sequence
  chemically synthesized
cagagtctataaatttctca

SEQ ID NO: 464682 - DNA, 20 bp, Artificial Sequence
  chemically synthesized
gtctataaatttctcaaggt

SEQ ID NO: 464683 - DNA, 20 bp, Artificial Sequence
  chemically synthesized
atggtttattttctgacctt

SEQ ID NO: 464684 - DNA, 20 bp, Artificial Sequence
  chemically synthesized
gtcagaaaataaaccataaa

SEQ ID NO: 464685 - DNA, 20 bp, Artificial Sequence
  chemically synthesized
agaggaattaaatcttttta

SEQ ID NO: 464686 - DNA, 20 bp, Artificial Sequence
  chemically synthesized
aaaaagatttaattcctcta

SEQ ID NO: 464687 - DNA, 20 bp, Artificial Sequence
  chemically synthesized
tagcatgcttaaagctttag

SEQ ID NO: 464688 - DNA, 20 bp, Artificial Sequence
  chemically synthesized
ttagcatgcttaaagcttta

SEQ ID NO: 464689 - DNA, 20 bp, Artificial Sequence
  chemically synthesized
tttaattcctctaaagcttt

SEQ ID NO: 464690 - DNA, 20 bp, Artificial Sequence
  chemically synthesized
tgttagcatgcttaaagctt

SEQ ID NO: 464691 - DNA, 20 bp, Artificial Sequence
  chemically synthesized
aacaaatgttagcatgctta

SEQ ID NO: 464692 - DNA, 20 bp, Artificial Sequence
  chemically synthesized
aagatcaagttaacaaatgt

SEQ ID NO: 464693 - DNA, 20 bp, Artificial Sequence
  chemically synthesized
aaatgtcattttataagatc

SEQ ID NO: 464694 - DNA, 20 bp, Artificial Sequence
  chemically synthesized
catctcaaatgtcattttat

SEQ ID NO: 464695 - DNA, 20 bp, Artificial Sequence
  chemically synthesized
gatcttataaaatgacattt

SEQ ID NO: 464696 - DNA, 20 bp, Artificial Sequence
  chemically synthesized
aaattaatattttaggttgg

SEQ ID NO: 464697 - DNA, 20 bp, Artificial Sequence
  chemically synthesized
taaaaattaatattttaggt

SEQ ID NO: 464698 - DNA, 20 bp, Artificial Sequence
  chemically synthesized
tcaataaaaattaatatttt

SEQ ID NO: 464699 - DNA, 20 bp, Artificial Sequence
  chemically synthesized
atcaataaaaattaatattt

SEQ ID NO: 464700 - DNA, 20 bp, Artificial Sequence
  chemically synthesized
aaatattaatttttattgat

SEQ ID NO: 464701 - DNA, 20 bp, Artificial Sequence
  chemically synthesized
aatattaatttttattgatc

SEQ ID NO: 464702 - DNA, 20 bp, Artificial Sequence
  chemically synthesized
atttttattgatcaggttat

SEQ ID NO: 464703 - DNA, 20 bp, Artificial Sequence
  chemically synthesized
ataataaagttattgcaagt

SEQ ID NO: 464704 - DNA, 20 bp, Artificial Sequence
  chemically synthesized
aaaaataataaagttattgc

SEQ ID NO: 464705 - DNA, 20 bp, Artificial Sequence
  chemically synthesized
ggtcaacagaaaaaataata

SEQ ID NO: 464706 - DNA, 20 bp, Artificial Sequence
  chemically synthesized
ttgttatatgttagggtcaa

SEQ ID NO: 464707 - DNA, 20 bp, Artificial Sequence
  chemically synthesized
tcttcatttgttatatgtta

SEQ ID NO: 464708 - DNA, 20 bp, Artificial Sequence
  chemically synthesized
gtcttcatttgttatatgtt

SEQ ID NO: 464709 - DNA, 20 bp, Artificial Sequence
  chemically synthesized
tgtcttcatttgttatatgt

SEQ ID NO: 464710 - DNA, 20 bp, Artificial Sequence
  chemically synthesized
accctaacatataacaaatg

SEQ ID NO: 464711 - DNA, 20 bp, Artificial Sequence
  chemically synthesized
ataacaaatgaagacatgtg

SEQ ID NO: 464712 - DNA, 20 bp, Artificial Sequence
  chemically synthesized
atgtgcagatataacatgtt

SEQ ID NO: 464713 - DNA, 20 bp, Artificial Sequence
  chemically synthesized
tgcagatataacatgttaag

SEQ ID NO: 464714 - DNA, 20 bp, Artificial Sequence
  chemically synthesized
tgtatttgcagtgttaacat

SEQ ID NO: 464715 - DNA, 20 bp, Artificial Sequence
  chemically synthesized
aaagctctcatgtgtatttg

SEQ ID NO: 464716 - DNA, 20 bp, Artificial Sequence
  chemically synthesized
ttaacactgcaaatacacat

SEQ ID NO: 464717 - DNA, 20 bp, Artificial Sequence
  chemically synthesized
aacactgcaaatacacatga

SEQ ID NO: 464718 - DNA, 20 bp, Artificial Sequence
  chemically synthesized
acacatgagagctttatact

SEQ ID NO: 464719 - DNA, 20 bp, Artificial Sequence
  chemically synthesized
gagatggccgtcttagtata

SEQ ID NO: 464720 - DNA, 20 bp, Artificial Sequence
  chemically synthesized
atgagagctttatactaaga

SEQ ID NO: 464721 - DNA, 20 bp, Artificial Sequence
  chemically synthesized
gagggaggagatggccgtct

SEQ ID NO: 464722 - DNA, 20 bp, Artificial Sequence
  chemically synthesized
tataagtcagagggaggaga

SEQ ID NO: 464723 - DNA, 20 bp, Artificial Sequence
  chemically synthesized
aaaatataagtcagagggag

SEQ ID NO: 464724 - DNA, 20 bp, Artificial Sequence
  chemically synthesized
ggaaaatataagtcagaggg

SEQ ID NO: 464725 - DNA, 20 bp, Artificial Sequence
  chemically synthesized
aggaaaatataagtcagagg

SEQ ID NO: 464726 - DNA, 20 bp, Artificial Sequence
  chemically synthesized
tcaggaaaatataagtcaga

SEQ ID NO: 464727 - DNA, 20 bp, Artificial Sequence
  chemically synthesized
ttcaggaaaatataagtcag

SEQ ID NO: 464728 - DNA, 20 bp, Artificial Sequence
  chemically synthesized
cttcaggaaaatataagtca

SEQ ID NO: 464729 - DNA, 20 bp, Artificial Sequence
  chemically synthesized
tccttcaggaaaatataagt

SEQ ID NO: 464730 - DNA, 20 bp, Artificial Sequence
  chemically synthesized
aatgtccttcaggaaaatat

SEQ ID NO: 464731 - DNA, 20 bp, Artificial Sequence
  chemically synthesized
ctctgacttatattttcctg

SEQ ID NO: 464732 - DNA, 20 bp, Artificial Sequence
  chemically synthesized
tctgacttatattttcctga

SEQ ID NO: 464733 - DNA, 20 bp, Artificial Sequence
  chemically synthesized
atgctatgtaaatgtccttc

SEQ ID NO: 464734 - DNA, 20 bp, Artificial Sequence
  chemically synthesized
tatgctatgtaaatgtcctt

SEQ ID NO: 464735 - DNA, 20 bp, Artificial Sequence
  chemically synthesized
tttcctgaaggacatttaca

SEQ ID NO: 464736 - DNA, 20 bp, Artificial Sequence
  chemically synthesized
tacatagcataaatatttta

SEQ ID NO: 464737 - DNA, 20 bp, Artificial Sequence
  chemically synthesized
ataaatattttaaagacttt

SEQ ID NO: 464738 - DNA, 20 bp, Artificial Sequence
  chemically synthesized
aggtgtcatcaaatagccaa

SEQ ID NO: 464739 - DNA, 20 bp, Artificial Sequence
  chemically synthesized
atgttcaaggtgtcatcaaa

SEQ ID NO: 464740 - DNA, 20 bp, Artificial Sequence
  chemically synthesized
agattcaaagtatatgttca

SEQ ID NO: 464741 - DNA, 20 bp, Artificial Sequence
  chemically synthesized
tagattcaaagtatatgttc

SEQ ID NO: 464742 - DNA, 20 bp, Artificial Sequence
  chemically synthesized
tgaacatatactttgaatct

SEQ ID NO: 464743 - DNA, 20 bp, Artificial Sequence
  chemically synthesized
tctcctttcccttagattca

SEQ ID NO: 464744 - DNA, 20 bp, Artificial Sequence
  chemically synthesized
gaacatatactttgaatcta

SEQ ID NO: 464745 - DNA, 20 bp, Artificial Sequence
  chemically synthesized
aacatatactttgaatctaa

SEQ ID NO: 464746 - DNA, 20 bp, Artificial Sequence
  chemically synthesized
tatactttgaatctaaggga

SEQ ID NO: 464747 - DNA, 20 bp, Artificial Sequence
  chemically synthesized
atactttgaatctaagggaa

SEQ ID NO: 464748 - DNA, 20 bp, Artificial Sequence
  chemically synthesized
aatatgactctcctttccct

SEQ ID NO: 464749 - DNA, 20 bp, Artificial Sequence
  chemically synthesized
actttgaatctaagggaaag

SEQ ID NO: 464750 - DNA, 20 bp, Artificial Sequence
  chemically synthesized
tttgaatctaagggaaagga

SEQ ID NO: 464751 - DNA, 20 bp, Artificial Sequence
  chemically synthesized
atttgaattgttttagaaag

SEQ ID NO: 464752 - DNA, 20 bp, Artificial Sequence
  chemically synthesized
acatttgaattgttttagaa

SEQ ID NO: 464753 - DNA, 20 bp, Artificial Sequence
  chemically synthesized
cacatttgaattgttttaga

SEQ ID NO: 464754 - DNA, 20 bp, Artificial Sequence
  chemically synthesized
acatcacatttgaattgttt

SEQ ID NO: 464755 - DNA, 20 bp, Artificial Sequence
  chemically synthesized
tactttcagcttagcaaata

SEQ ID NO: 464756 - DNA, 20 bp, Artificial Sequence
  chemically synthesized
gtgatgtgtccctatttgct

SEQ ID NO: 464757 - DNA, 20 bp, Artificial Sequence
  chemically synthesized
ttactttcagcttagcaaat

SEQ ID NO: 464758 - DNA, 20 bp, Artificial Sequence
  chemically synthesized
cttactttcagcttagcaaa

SEQ ID NO: 464759 - DNA, 20 bp, Artificial Sequence
  chemically synthesized
gtccctatttgctaagctga

SEQ ID NO: 464760 - DNA, 20 bp, Artificial Sequence
  chemically synthesized
acttcatcttactttcagct

SEQ ID NO: 464761 - DNA, 20 bp, Artificial Sequence
  chemically synthesized
ctatttgctaagctgaaagt

SEQ ID NO: 464762 - DNA, 20 bp, Artificial Sequence
  chemically synthesized
atttgacttcatcttacttt

SEQ ID NO: 464763 - DNA, 20 bp, Artificial Sequence
  chemically synthesized
gctaagctgaaagtaagatg

SEQ ID NO: 464764 - DNA, 20 bp, Artificial Sequence
  chemically synthesized
gtaagatgaagtcaaataaa

SEQ ID NO: 464765 - DNA, 20 bp, Artificial Sequence
  chemically synthesized
atcaaatatttttaaacttc

SEQ ID NO: 464766 - DNA, 20 bp, Artificial Sequence
  chemically synthesized
tcaaatatttttaaacttct

SEQ ID NO: 464767 - DNA, 20 bp, Artificial Sequence
  chemically synthesized
aaatatttttaaacttctag

SEQ ID NO: 464768 - DNA, 20 bp, Artificial Sequence
  chemically synthesized
agcaaacaaaaagctcctag

SEQ ID NO: 464769 - DNA, 20 bp, Artificial Sequence
  chemically synthesized
aaaagcaaacaaaaagctcc

SEQ ID NO: 464770 - DNA, 20 bp, Artificial Sequence
  chemically synthesized
ataacaaaaaagcaaacaaa

SEQ ID NO: 464771 - DNA, 20 bp, Artificial Sequence
  chemically synthesized
ctcttattaaaataacaaaa

SEQ ID NO: 464772 - DNA, 20 bp, Artificial Sequence
  chemically synthesized
tgcttttttgttattttaat

SEQ ID NO: 464773 - DNA, 20 bp, Artificial Sequence
  chemically synthesized
cttttttgttattttaataa

SEQ ID NO: 464774 - DNA, 20 bp, Artificial Sequence
  chemically synthesized
ttattttaataagagaaaca

SEQ ID NO: 464775 - DNA, 20 bp, Artificial Sequence
  chemically synthesized
taaaaacacaaactctcacc

SEQ ID NO: 464776 - DNA, 20 bp, Artificial Sequence
  chemically synthesized
cgtaagaggatgctgggtga

SEQ ID NO: 464777 - DNA, 20 bp, Artificial Sequence
  chemically synthesized
ttcgtaagaggatgctgggt

SEQ ID NO: 464778 - DNA, 20 bp, Artificial Sequence
  chemically synthesized
gtatttcgtaagaggatgct

SEQ ID NO: 464779 - DNA, 20 bp, Artificial Sequence
  chemically synthesized
ggtatttcgtaagaggatgc

SEQ ID NO: 464780 - DNA, 20 bp, Artificial Sequence
  chemically synthesized
aaaattgggtatttcgtaag

SEQ ID NO: 464781 - DNA, 20 bp, Artificial Sequence
  chemically synthesized
gaaaattgggtatttcgtaa

SEQ ID NO: 464782 - DNA, 20 bp, Artificial Sequence
  chemically synthesized
ttgaaaattgggtatttcgt

SEQ ID NO: 464783 - DNA, 20 bp, Artificial Sequence
  chemically synthesized
gtactgcttatttgaaaatt

SEQ ID NO: 464784 - DNA, 20 bp, Artificial Sequence
  chemically synthesized
agtactgcttatttgaaaat

SEQ ID NO: 464785 - DNA, 20 bp, Artificial Sequence
  chemically synthesized
gaaatacccaattttcaaat

SEQ ID NO: 464786 - DNA, 20 bp, Artificial Sequence
  chemically synthesized
atacccaattttcaaataag

SEQ ID NO: 464787 - DNA, 20 bp, Artificial Sequence
  chemically synthesized
ccagtaataaatagagcaaa

SEQ ID NO: 464788 - DNA, 20 bp, Artificial Sequence
  chemically synthesized
ttaaagaccagtaataaata

SEQ ID NO: 464789 - DNA, 20 bp, Artificial Sequence
  chemically synthesized
tcttaaagaccagtaataaa

SEQ ID NO: 464790 - DNA, 20 bp, Artificial Sequence
  chemically synthesized
ctatttgctctatttattac

SEQ ID NO: 464791 - DNA, 20 bp, Artificial Sequence
  chemically synthesized
tctatttattactggtcttt

SEQ ID NO: 464792 - DNA, 20 bp, Artificial Sequence
  chemically synthesized
ggtctatttctcttaaagac

SEQ ID NO: 464793 - DNA, 20 bp, Artificial Sequence
  chemically synthesized
tatttattactggtctttaa

SEQ ID NO: 464794 - DNA, 20 bp, Artificial Sequence
  chemically synthesized
ttttaggtctatttctctta

SEQ ID NO: 464795 - DNA, 20 bp, Artificial Sequence
  chemically synthesized
ttactggtctttaagagaaa

SEQ ID NO: 464796 - DNA, 20 bp, Artificial Sequence
  chemically synthesized
taagagaaatagacctaaaa

SEQ ID NO: 464797 - DNA, 20 bp, Artificial Sequence
  chemically synthesized
cttccaagatgttctttttt

SEQ ID NO: 464798 - DNA, 20 bp, Artificial Sequence
  chemically synthesized
ccttccaagatgttcttttt

SEQ ID NO: 464799 - DNA, 20 bp, Artificial Sequence
  chemically synthesized
agacctaaaaaagaacatct

SEQ ID NO: 464800 - DNA, 20 bp, Artificial Sequence
  chemically synthesized
cctaaaaaagaacatcttgg

SEQ ID NO: 464801 - DNA, 20 bp, Artificial Sequence
  chemically synthesized
ctaaaaaagaacatcttgga

SEQ ID NO: 464802 - DNA, 20 bp, Artificial Sequence
  chemically synthesized
aaaagaacatcttggaaggc

SEQ ID NO: 464803 - DNA, 20 bp, Artificial Sequence
  chemically synthesized
tgaaagtacactagccttcc

SEQ ID NO: 464804 - DNA, 20 bp, Artificial Sequence
  chemically synthesized
agggaattatgaaagtacac

SEQ ID NO: 464805 - DNA, 20 bp, Artificial Sequence
  chemically synthesized
agcttctcagggaattatga

SEQ ID NO: 464806 - DNA, 20 bp, Artificial Sequence
  chemically synthesized
gtgtactttcataattccct

SEQ ID NO: 464807 - DNA, 20 bp, Artificial Sequence
  chemically synthesized
tactttcataattccctgag

SEQ ID NO: 464808 - DNA, 20 bp, Artificial Sequence
  chemically synthesized
cataatcactgagcttctca

SEQ ID NO: 464809 - DNA, 20 bp, Artificial Sequence
  chemically synthesized
tcataatcactgagcttctc

SEQ ID NO: 464810 - DNA, 20 bp, Artificial Sequence
  chemically synthesized
tcataattccctgagaagct

SEQ ID NO: 464811 - DNA, 20 bp, Artificial Sequence
  chemically synthesized
ctcataatcactgagcttct

SEQ ID NO: 464812 - DNA, 20 bp, Artificial Sequence
  chemically synthesized
tcacattactcataatcact

SEQ ID NO: 464813 - DNA, 20 bp, Artificial Sequence
  chemically synthesized
ctgagaagctcagtgattat

SEQ ID NO: 464814 - DNA, 20 bp, Artificial Sequence
  chemically synthesized
tgattatgagtaatgtgaac

SEQ ID NO: 464815 - DNA, 20 bp, Artificial Sequence
  chemically synthesized
attatgagtaatgtgaacca

SEQ ID NO: 464816 - DNA, 20 bp, Artificial Sequence
  chemically synthesized
agggtaagaatattgaactc

SEQ ID NO: 464817 - DNA, 20 bp, Artificial Sequence
  chemically synthesized
gagttcaatattcttaccct

SEQ ID NO: 464818 - DNA, 20 bp, Artificial Sequence
  chemically synthesized
tttttcctgattccaagggt

SEQ ID NO: 464819 - DNA, 20 bp, Artificial Sequence
  chemically synthesized
aatattcttacccttggaat

SEQ ID NO: 464820 - DNA, 20 bp, Artificial Sequence
  chemically synthesized
tttctttttcctgattccaa

SEQ ID NO: 464821 - DNA, 20 bp, Artificial Sequence
  chemically synthesized
atattcttacccttggaatc

SEQ ID NO: 464822 - DNA, 20 bp, Artificial Sequence
  chemically synthesized
ctttctttttcctgattcca

SEQ ID NO: 464823 - DNA, 20 bp, Artificial Sequence
  chemically synthesized
actttctttttcctgattcc

SEQ ID NO: 464824 - DNA, 20 bp, Artificial Sequence
  chemically synthesized
ttacccttggaatcaggaaa

SEQ ID NO: 464825 - DNA, 20 bp, Artificial Sequence
  chemically synthesized
ccttggaatcaggaaaaaga

SEQ ID NO: 464826 - DNA, 20 bp, Artificial Sequence
  chemically synthesized
ggaaaaagaaagtcctttaa

SEQ ID NO: 464827 - DNA, 20 bp, Artificial Sequence
  chemically synthesized
caaagatcttgatcttttaa

SEQ ID NO: 464828 - DNA, 20 bp, Artificial Sequence
  chemically synthesized
tcaaagatcttgatctttta

SEQ ID NO: 464829 - DNA, 20 bp, Artificial Sequence
  chemically synthesized
agaaagtcctttaaaagatc

SEQ ID NO: 464830 - DNA, 20 bp, Artificial Sequence
  chemically synthesized
taaaagatcaagatctttga

SEQ ID NO: 464831 - DNA, 20 bp, Artificial Sequence
  chemically synthesized
aagatcaagatctttgatag

SEQ ID NO: 464832 - DNA, 20 bp, Artificial Sequence
  chemically synthesized
agttcttgttactgctatca

SEQ ID NO: 464833 - DNA, 20 bp, Artificial Sequence
  chemically synthesized
agatctttgatagcagtaac

SEQ ID NO: 464834 - DNA, 20 bp, Artificial Sequence
  chemically synthesized
gtaacaagaactaaatttgc

SEQ ID NO: 464835 - DNA, 20 bp, Artificial Sequence
  chemically synthesized
ggctctacccctggcaaatt

SEQ ID NO: 464836 - DNA, 20 bp, Artificial Sequence
  chemically synthesized
taacaagaactaaatttgcc

SEQ ID NO: 464837 - DNA, 20 bp, Artificial Sequence
  chemically synthesized
aacaagaactaaatttgcca

SEQ ID NO: 464838 - DNA, 20 bp, Artificial Sequence
  chemically synthesized
acaagaactaaatttgccag

SEQ ID NO: 464839 - DNA, 20 bp, Artificial Sequence
  chemically synthesized
agaactaaatttgccagggg

SEQ ID NO: 464840 - DNA, 20 bp, Artificial Sequence
  chemically synthesized
aactaaatttgccaggggta

SEQ ID NO: 464841 - DNA, 20 bp, Artificial Sequence
  chemically synthesized
taagaggacggctctacccc

SEQ ID NO: 464842 - DNA, 20 bp, Artificial Sequence
  chemically synthesized
gcctgaaattggtaagagga

SEQ ID NO: 464843 - DNA, 20 bp, Artificial Sequence
  chemically synthesized
tcttgcctgaaattggtaag

SEQ ID NO: 464844 - DNA, 20 bp, Artificial Sequence
  chemically synthesized
ttcttgcctgaaattggtaa

SEQ ID NO: 464845 - DNA, 20 bp, Artificial Sequence
  chemically synthesized
gcttcttgcctgaaattggt

SEQ ID NO: 464846 - DNA, 20 bp, Artificial Sequence
  chemically synthesized
agccgtcctcttaccaattt

SEQ ID NO: 464847 - DNA, 20 bp, Artificial Sequence
  chemically synthesized
gccgtcctcttaccaatttc

SEQ ID NO: 464848 - DNA, 20 bp, Artificial Sequence
  chemically synthesized
gattgcttcttgcctgaaat

SEQ ID NO: 464849 - DNA, 20 bp, Artificial Sequence
  chemically synthesized
tcctcttaccaatttcaggc

SEQ ID NO: 464850 - DNA, 20 bp, Artificial Sequence
  chemically synthesized
tcttaccaatttcaggcaag

SEQ ID NO: 464851 - DNA, 20 bp, Artificial Sequence
  chemically synthesized
gcaagaagcaatcttttctt

SEQ ID NO: 464852 - DNA, 20 bp, Artificial Sequence
  chemically synthesized
tgcctttcgctactcaagaa

SEQ ID NO: 464853 - DNA, 20 bp, Artificial Sequence
  chemically synthesized
agaagcaatcttttcttgag

SEQ ID NO: 464854 - DNA, 20 bp, Artificial Sequence
  chemically synthesized
tggcttgcctttcgctactc

SEQ ID NO: 464855 - DNA, 20 bp, Artificial Sequence
  chemically synthesized
aatcttttcttgagtagcga

SEQ ID NO: 464856 - DNA, 20 bp, Artificial Sequence
  chemically synthesized
atcttttcttgagtagcgaa

SEQ ID NO: 464857 - DNA, 20 bp, Artificial Sequence
  chemically synthesized
tttcttgagtagcgaaaggc

SEQ ID NO: 464858 - DNA, 20 bp, Artificial Sequence
  chemically synthesized
agcgaaaggcaagccaacta

SEQ ID NO: 464859 - DNA, 20 bp, Artificial Sequence
  chemically synthesized
acacagattttttctttagt

SEQ ID NO: 464860 - DNA, 20 bp, Artificial Sequence
  chemically synthesized
agtcacacagattttttctt

SEQ ID NO: 464861 - DNA, 20 bp, Artificial Sequence
  chemically synthesized
tttatgtaattgaagtcaca

SEQ ID NO: 464862 - DNA, 20 bp, Artificial Sequence
  chemically synthesized
tagtcaattttatgtaattg

SEQ ID NO: 464863 - DNA, 20 bp, Artificial Sequence
  chemically synthesized
ttcaattacataaaattgac

SEQ ID NO: 464864 - DNA, 20 bp, Artificial Sequence
  chemically synthesized
attacataaaattgactaga

SEQ ID NO: 464865 - DNA, 20 bp, Artificial Sequence
  chemically synthesized
agtattgttttttaaccatc

SEQ ID NO: 464866 - DNA, 20 bp, Artificial Sequence
  chemically synthesized
gttaaaaaacaatactttca

SEQ ID NO: 464867 - DNA, 20 bp, Artificial Sequence
  chemically synthesized
agaaagaaaaaattctgtga

SEQ ID NO: 464868 - DNA, 20 bp, Artificial Sequence
  chemically synthesized
tacaagtaaagttttacaga

SEQ ID NO: 464869 - DNA, 20 bp, Artificial Sequence
  chemically synthesized
aacatacaagtaaagtttta

SEQ ID NO: 464870 - DNA, 20 bp, Artificial Sequence
  chemically synthesized
taagaaccaacatacaagta

SEQ ID NO: 464871 - DNA, 20 bp, Artificial Sequence
  chemically synthesized
gtaaaactttacttgtatgt

SEQ ID NO: 464872 - DNA, 20 bp, Artificial Sequence
  chemically synthesized
tgaaataagaaccaacatac

SEQ ID NO: 464873 - DNA, 20 bp, Artificial Sequence
  chemically synthesized
aatatatctctgaatgaaat

SEQ ID NO: 464874 - DNA, 20 bp, Artificial Sequence
  chemically synthesized
atgttggttcttatttcatt

SEQ ID NO: 464875 - DNA, 20 bp, Artificial Sequence
  chemically synthesized
gttggttcttatttcattca

SEQ ID NO: 464876 - DNA, 20 bp, Artificial Sequence
  chemically synthesized
atttcattcagagatatatt

SEQ ID NO: 464877 - DNA, 20 bp, Artificial Sequence
  chemically synthesized
ttcattcagagatatattaa

SEQ ID NO: 464878 - DNA, 20 bp, Artificial Sequence
  chemically synthesized
tattttcaaatacacaaaaa

SEQ ID NO: 464879 - DNA, 20 bp, Artificial Sequence
  chemically synthesized
gagaaaaagttgtcgtgggg

SEQ ID NO: 464880 - DNA, 20 bp, Artificial Sequence
  chemically synthesized
ttgagaaaaagttgtcgtgg

SEQ ID NO: 464881 - DNA, 20 bp, Artificial Sequence
  chemically synthesized
attgagaaaaagttgtcgtg

SEQ ID NO: 464882 - DNA, 20 bp, Artificial Sequence
  chemically synthesized
aattgagaaaaagttgtcgt

SEQ ID NO: 464883 - DNA, 20 bp, Artificial Sequence
  chemically synthesized
caattgagaaaaagttgtcg

SEQ ID NO: 464884 - DNA, 20 bp, Artificial Sequence
  chemically synthesized
caaaagaggcaattgagaaa

SEQ ID NO: 464885 - DNA, 20 bp, Artificial Sequence
  chemically synthesized
gaaaggcaaaagaggcaatt

SEQ ID NO: 464886 - DNA, 20 bp, Artificial Sequence
  chemically synthesized
aaactgaggaaaggcaaaag

SEQ ID NO: 464887 - DNA, 20 bp, Artificial Sequence
  chemically synthesized
aaaactgaggaaaggcaaaa

SEQ ID NO: 464888 - DNA, 20 bp, Artificial Sequence
  chemically synthesized
ataaaactgaggaaaggcaa

SEQ ID NO: 464889 - DNA, 20 bp, Artificial Sequence
  chemically synthesized
ttgcctcttttgcctttcct

SEQ ID NO: 464890 - DNA, 20 bp, Artificial Sequence
  chemically synthesized
aagactataaaactgaggaa

SEQ ID NO: 464891 - DNA, 20 bp, Artificial Sequence
  chemically synthesized
gaagactataaaactgagga

SEQ ID NO: 464892 - DNA, 20 bp, Artificial Sequence
  chemically synthesized
cactgaagactataaaactg

SEQ ID NO: 464893 - DNA, 20 bp, Artificial Sequence
  chemically synthesized
tttgcctttcctcagtttta

SEQ ID NO: 464894 - DNA, 20 bp, Artificial Sequence
  chemically synthesized
ccactgaagactataaaact

SEQ ID NO: 464895 - DNA, 20 bp, Artificial Sequence
  chemically synthesized
ttcctcagttttatagtctt

SEQ ID NO: 464896 - DNA, 20 bp, Artificial Sequence
  chemically synthesized
ctcagttttatagtcttcag

SEQ ID NO: 464897 - DNA, 20 bp, Artificial Sequence
  chemically synthesized
tcagttttatagtcttcagt

SEQ ID NO: 464898 - DNA, 20 bp, Artificial Sequence
  chemically synthesized
gcaatgagggagacccactg

SEQ ID NO: 464899 - DNA, 20 bp, Artificial Sequence
  chemically synthesized
aggaatatggagcaatgagg

SEQ ID NO: 464900 - DNA, 20 bp, Artificial Sequence
  chemically synthesized
ttaggaatatggagcaatga

SEQ ID NO: 464901 - DNA, 20 bp, Artificial Sequence
  chemically synthesized
cttaggaatatggagcaatg

SEQ ID NO: 464902 - DNA, 20 bp, Artificial Sequence
  chemically synthesized
gcttaggaatatggagcaat

SEQ ID NO: 464903 - DNA, 20 bp, Artificial Sequence
  chemically synthesized
cctgttggcttaggaatatg

SEQ ID NO: 464904 - DNA, 20 bp, Artificial Sequence
  chemically synthesized
cctcattgctccatattcct

SEQ ID NO: 464905 - DNA, 20 bp, Artificial Sequence
  chemically synthesized
ttcctgttggcttaggaata

SEQ ID NO: 464906 - DNA, 20 bp, Artificial Sequence
  chemically synthesized
gctccatattcctaagccaa

SEQ ID NO: 464907 - DNA, 20 bp, Artificial Sequence
  chemically synthesized
gaaattcttcctgttggctt

SEQ ID NO: 464908 - DNA, 20 bp, Artificial Sequence
  chemically synthesized
ctccatattcctaagccaac

SEQ ID NO: 464909 - DNA, 20 bp, Artificial Sequence
  chemically synthesized
agaaattcttcctgttggct

SEQ ID NO: 464910 - DNA, 20 bp, Artificial Sequence
  chemically synthesized
catattcctaagccaacagg

SEQ ID NO: 464911 - DNA, 20 bp, Artificial Sequence
  chemically synthesized
ctgaaagaaattcttcctgt

SEQ ID NO: 464912 - DNA, 20 bp, Artificial Sequence
  chemically synthesized
ccaacaggaagaatttcttt

SEQ ID NO: 464913 - DNA, 20 bp, Artificial Sequence
  chemically synthesized
cacaaggcttaagggtctga

SEQ ID NO: 464914 - DNA, 20 bp, Artificial Sequence
  chemically synthesized
agaatttctttcagaccctt

SEQ ID NO: 464915 - DNA, 20 bp, Artificial Sequence
  chemically synthesized
gtaacagacacaaggcttaa

SEQ ID NO: 464916 - DNA, 20 bp, Artificial Sequence
  chemically synthesized
ggtaacagacacaaggctta

SEQ ID NO: 464917 - DNA, 20 bp, Artificial Sequence
  chemically synthesized
tggtaacagacacaaggctt

SEQ ID NO: 464918 - DNA, 20 bp, Artificial Sequence
  chemically synthesized
tctctatggtaacagacaca

SEQ ID NO: 464919 - DNA, 20 bp, Artificial Sequence
  chemically synthesized
gtctctatggtaacagacac

SEQ ID NO: 464920 - DNA, 20 bp, Artificial Sequence
  chemically synthesized
aagccttgtgtctgttacca

SEQ ID NO: 464921 - DNA, 20 bp, Artificial Sequence
  chemically synthesized
gatgcctgtctctatggtaa

SEQ ID NO: 464922 - DNA, 20 bp, Artificial Sequence
  chemically synthesized
gccttgtgtctgttaccata

SEQ ID NO: 464923 - DNA, 20 bp, Artificial Sequence
  chemically synthesized
tgtgtctgttaccatagaga

SEQ ID NO: 464924 - DNA, 20 bp, Artificial Sequence
  chemically synthesized
gtgtctgttaccatagagac

SEQ ID NO: 464925 - DNA, 20 bp, Artificial Sequence
  chemically synthesized
ctttgtgatgcctgtctcta

SEQ ID NO: 464926 - DNA, 20 bp, Artificial Sequence
  chemically synthesized
ccatagagacaggcatcaca

SEQ ID NO: 464927 - DNA, 20 bp, Artificial Sequence
  chemically synthesized
tagagacaggcatcacaaag

SEQ ID NO: 464928 - DNA, 20 bp, Artificial Sequence
  chemically synthesized
ggcatcacaaagtagctgct

SEQ ID NO: 464929 - DNA, 20 bp, Artificial Sequence
  chemically synthesized
gcatcacaaagtagctgctc

SEQ ID NO: 464930 - DNA, 20 bp, Artificial Sequence
  chemically synthesized
tccatgaggatgttcctgag

SEQ ID NO: 464931 - DNA, 20 bp, Artificial Sequence
  chemically synthesized
atttccatgaggatgttcct

SEQ ID NO: 464932 - DNA, 20 bp, Artificial Sequence
  chemically synthesized
gctgctcaggaacatcctca

SEQ ID NO: 464933 - DNA, 20 bp, Artificial Sequence
  chemically synthesized
attcttattgtatttccatg

SEQ ID NO: 464934 - DNA, 20 bp, Artificial Sequence
  chemically synthesized
gattcttattgtatttccat

SEQ ID NO: 464935 - DNA, 20 bp, Artificial Sequence
  chemically synthesized
catcctcatggaaatacaat

SEQ ID NO: 464936 - DNA, 20 bp, Artificial Sequence
  chemically synthesized
gaaatacaataagaatccta

SEQ ID NO: 464937 - DNA, 20 bp, Artificial Sequence
  chemically synthesized
aaatacaataagaatcctat

SEQ ID NO: 464938 - DNA, 20 bp, Artificial Sequence
  chemically synthesized
gaaattcctgtaaaacccat

SEQ ID NO: 464939 - DNA, 20 bp, Artificial Sequence
  chemically synthesized
ggaaattcctgtaaaaccca

SEQ ID NO: 464940 - DNA, 20 bp, Artificial Sequence
  chemically synthesized
taagaatcctatgggtttta

SEQ ID NO: 464941 - DNA, 20 bp, Artificial Sequence
  chemically synthesized
aagaatcctatgggttttac

SEQ ID NO: 464942 - DNA, 20 bp, Artificial Sequence
  chemically synthesized
atgggttttacaggaatttc

SEQ ID NO: 464943 - DNA, 20 bp, Artificial Sequence
  chemically synthesized
acaggaatttccagcgctac

SEQ ID NO: 464944 - DNA, 20 bp, Artificial Sequence
  chemically synthesized
tttctgctcactggtagcgc

SEQ ID NO: 464945 - DNA, 20 bp, Artificial Sequence
  chemically synthesized
gaatttccagcgctaccagt

SEQ ID NO: 464946 - DNA, 20 bp, Artificial Sequence
  chemically synthesized
atataatttctgctcactgg

SEQ ID NO: 464947 - DNA, 20 bp, Artificial Sequence
  chemically synthesized
tttccagcgctaccagtgag

SEQ ID NO: 464948 - DNA, 20 bp, Artificial Sequence
  chemically synthesized
aagatataatttctgctcac

SEQ ID NO: 464949 - DNA, 20 bp, Artificial Sequence
  chemically synthesized
gcagaaattatatctttccc

SEQ ID NO: 464950 - DNA, 20 bp, Artificial Sequence
  chemically synthesized
ccacattttttttctaggga

SEQ ID NO: 464951 - DNA, 20 bp, Artificial Sequence
  chemically synthesized
atccccacattttttttcta

SEQ ID NO: 464952 - DNA, 20 bp, Artificial Sequence
  chemically synthesized
aatccccacattttttttct

SEQ ID NO: 464953 - DNA, 20 bp, Artificial Sequence
  chemically synthesized
aaatccccacattttttttc

SEQ ID NO: 464954 - DNA, 20 bp, Artificial Sequence
  chemically synthesized
ctttccctagaaaaaaaatg

SEQ ID NO: 464955 - DNA, 20 bp, Artificial Sequence
  chemically synthesized
tttccctagaaaaaaaatgt

SEQ ID NO: 464956 - DNA, 20 bp, Artificial Sequence
  chemically synthesized
ttccctagaaaaaaaatgtg

SEQ ID NO: 464957 - DNA, 20 bp, Artificial Sequence
  chemically synthesized
gaaaaaaaatgtggggattt

SEQ ID NO: 464958 - DNA, 20 bp, Artificial Sequence
  chemically synthesized
gggattttagttgcacatta

SEQ ID NO: 464959 - DNA, 20 bp, Artificial Sequence
  chemically synthesized
agttgcacattatggaacta

SEQ ID NO: 464960 - DNA, 20 bp, Artificial Sequence
  chemically synthesized
ttgcacattatggaactatg

SEQ ID NO: 464961 - DNA, 20 bp, Artificial Sequence
  chemically synthesized
accaaatattacaatctcca

SEQ ID NO: 464962 - DNA, 20 bp, Artificial Sequence
  chemically synthesized
actatggagattgtaatatt

SEQ ID NO: 464963 - DNA, 20 bp, Artificial Sequence
  chemically synthesized
atggagattgtaatatttgg

SEQ ID NO: 464964 - DNA, 20 bp, Artificial Sequence
  chemically synthesized
gtaatatttggtggtaaatt

SEQ ID NO: 464965 - DNA, 20 bp, Artificial Sequence
  chemically synthesized
gtggtaaattcagaatccct

SEQ ID NO: 464966 - DNA, 20 bp, Artificial Sequence
  chemically synthesized
aattctaagcataaagctga

SEQ ID NO: 464967 - DNA, 20 bp, Artificial Sequence
  chemically synthesized
aaattctaagcataaagctg

SEQ ID NO: 464968 - DNA, 20 bp, Artificial Sequence
  chemically synthesized
caaattctaagcataaagct

SEQ ID NO: 464969 - DNA, 20 bp, Artificial Sequence
  chemically synthesized
gaatccctcagctttatgct

SEQ ID NO: 464970 - DNA, 20 bp, Artificial Sequence
  chemically synthesized
ataatcaaattctaagcata

SEQ ID NO: 464971 - DNA, 20 bp, Artificial Sequence
  chemically synthesized
agaaactataatcaaattct

SEQ ID NO: 464972 - DNA, 20 bp, Artificial Sequence
  chemically synthesized
ttatgcttagaatttgatta

SEQ ID NO: 464973 - DNA, 20 bp, Artificial Sequence
  chemically synthesized
gattttttttcatgtcatag

SEQ ID NO: 464974 - DNA, 20 bp, Artificial Sequence
  chemically synthesized
gggattttttttcatgtcat

SEQ ID NO: 464975 - DNA, 20 bp, Artificial Sequence
  chemically synthesized
agggattttttttcatgtca

SEQ ID NO: 464976 - DNA, 20 bp, Artificial Sequence
  chemically synthesized
tgaacatagggatatgagaa

SEQ ID NO: 464977 - DNA, 20 bp, Artificial Sequence
  chemically synthesized
ctgaacatagggatatgaga

SEQ ID NO: 464978 - DNA, 20 bp, Artificial Sequence
  chemically synthesized
cctgaacatagggatatgag

SEQ ID NO: 464979 - DNA, 20 bp, Artificial Sequence
  chemically synthesized
tttcctgaacatagggatat

SEQ ID NO: 464980 - DNA, 20 bp, Artificial Sequence
  chemically synthesized
ccttctcatatccctatgtt

SEQ ID NO: 464981 - DNA, 20 bp, Artificial Sequence
  chemically synthesized
cttctcatatccctatgttc

SEQ ID NO: 464982 - DNA, 20 bp, Artificial Sequence
  chemically synthesized
tttatattttcctgaacata

SEQ ID NO: 464983 - DNA, 20 bp, Artificial Sequence
  chemically synthesized
atttatattttcctgaacat

SEQ ID NO: 464984 - DNA, 20 bp, Artificial Sequence
  chemically synthesized
tatttatattttcctgaaca

SEQ ID NO: 464985 - DNA, 20 bp, Artificial Sequence
  chemically synthesized
taaatttaagaattagcaat

SEQ ID NO: 464986 - DNA, 20 bp, Artificial Sequence
  chemically synthesized
gacatgctaaatttaagaat

SEQ ID NO: 464987 - DNA, 20 bp, Artificial Sequence
  chemically synthesized
tcattgctaattcttaaatt

SEQ ID NO: 464988 - DNA, 20 bp, Artificial Sequence
  chemically synthesized
tgataagacatgctaaattt

SEQ ID NO: 464989 - DNA, 20 bp, Artificial Sequence
  chemically synthesized
ggttttagtaaatgattgat

SEQ ID NO: 464990 - DNA, 20 bp, Artificial Sequence
  chemically synthesized
aaaagaacagttaagggttt

SEQ ID NO: 464991 - DNA, 20 bp, Artificial Sequence
  chemically synthesized
cactataaaagaacagttaa

SEQ ID NO: 464992 - DNA, 20 bp, Artificial Sequence
  chemically synthesized
gcactataaaagaacagtta

SEQ ID NO: 464993 - DNA, 20 bp, Artificial Sequence
  chemically synthesized
tgcactataaaagaacagtt

SEQ ID NO: 464994 - DNA, 20 bp, Artificial Sequence
  chemically synthesized
tgcactgcactataaaagaa

SEQ ID NO: 464995 - DNA, 20 bp, Artificial Sequence
  chemically synthesized
aacccttaactgttctttta

SEQ ID NO: 464996 - DNA, 20 bp, Artificial Sequence
  chemically synthesized
acaaatgcactgcactataa

SEQ ID NO: 464997 - DNA, 20 bp, Artificial Sequence
  chemically synthesized
ttaactgttcttttatagtg

SEQ ID NO: 464998 - DNA, 20 bp, Artificial Sequence
  chemically synthesized
aatatgttctagaagggatc

SEQ ID NO: 464999 - DNA, 20 bp, Artificial Sequence
  chemically synthesized
tgttttatcttgatcccttc

SEQ ID NO: 465000 - DNA, 20 bp, Artificial Sequence
  chemically synthesized
tgatcaaatatgttctagaa

SEQ ID NO: 465001 - DNA, 20 bp, Artificial Sequence
  chemically synthesized
ttgatcaaatatgttctaga

SEQ ID NO: 465002 - DNA, 20 bp, Artificial Sequence
  chemically synthesized
cttgatcaaatatgttctag

SEQ ID NO: 465003 - DNA, 20 bp, Artificial Sequence
  chemically synthesized
gttcttgatcaaatatgttc

SEQ ID NO: 465004 - DNA, 20 bp, Artificial Sequence
  chemically synthesized
cttctagaacatatttgatc

SEQ ID NO: 465005 - DNA, 20 bp, Artificial Sequence
  chemically synthesized
acttacttttataacattat

SEQ ID NO: 465006 - DNA, 20 bp, Artificial Sequence
  chemically synthesized
acacactcataatgttataa

SEQ ID NO: 465007 - DNA, 20 bp, Artificial Sequence
  chemically synthesized
actcataatgttataaaagt

SEQ ID NO: 465008 - DNA, 20 bp, Artificial Sequence
  chemically synthesized
gctttggaattgcagtttta

SEQ ID NO: 465009 - DNA, 20 bp, Artificial Sequence
  chemically synthesized
cagctttggaattgcagttt

SEQ ID NO: 465010 - DNA, 20 bp, Artificial Sequence
  chemically synthesized
tctcagcagctttggaattg

SEQ ID NO: 465011 - DNA, 20 bp, Artificial Sequence
  chemically synthesized
tctctaaaactgcaattcca

SEQ ID NO: 465012 - DNA, 20 bp, Artificial Sequence
  chemically synthesized
atagactctctcagcagctt

SEQ ID NO: 465013 - DNA, 20 bp, Artificial Sequence
  chemically synthesized
actgcaattccaaagctgct

SEQ ID NO: 465014 - DNA, 20 bp, Artificial Sequence
  chemically synthesized
tgcaattccaaagctgctga

SEQ ID NO: 465015 - DNA, 20 bp, Artificial Sequence
  chemically synthesized
caattccaaagctgctgaga

SEQ ID NO: 465016 - DNA, 20 bp, Artificial Sequence
  chemically synthesized
gggtttatagactctctcag

SEQ ID NO: 465017 - DNA, 20 bp, Artificial Sequence
  chemically synthesized
cgtgggtttatagactctct

SEQ ID NO: 465018 - DNA, 20 bp, Artificial Sequence
  chemically synthesized
cttctctcttcgtgggttta

SEQ ID NO: 465019 - DNA, 20 bp, Artificial Sequence
  chemically synthesized
agagagtctataaacccacg

SEQ ID NO: 465020 - DNA, 20 bp, Artificial Sequence
  chemically synthesized
agagtctataaacccacgaa

SEQ ID NO: 465021 - DNA, 20 bp, Artificial Sequence
  chemically synthesized
agtctataaacccacgaaga

SEQ ID NO: 465022 - DNA, 20 bp, Artificial Sequence
  chemically synthesized
ctaccctcttctctcttcgt

SEQ ID NO: 465023 - DNA, 20 bp, Artificial Sequence
  chemically synthesized
gctaccctcttctctcttcg

SEQ ID NO: 465024 - DNA, 20 bp, Artificial Sequence
  chemically synthesized
ctataaacccacgaagagag

SEQ ID NO: 465025 - DNA, 20 bp, Artificial Sequence
  chemically synthesized
ataaacccacgaagagagaa

SEQ ID NO: 465026 - DNA, 20 bp, Artificial Sequence
  chemically synthesized
taaacccacgaagagagaag

SEQ ID NO: 465027 - DNA, 20 bp, Artificial Sequence
  chemically synthesized
aaacccacgaagagagaaga

SEQ ID NO: 465028 - DNA, 20 bp, Artificial Sequence
  chemically synthesized
cccacgaagagagaagaggg

SEQ ID NO: 465029 - DNA, 20 bp, Artificial Sequence
  chemically synthesized
agagagaagagggtagctgc

SEQ ID NO: 465030 - DNA, 20 bp, Artificial Sequence
  chemically synthesized
gagaagagggtagctgcaag

SEQ ID NO: 465031 - DNA, 20 bp, Artificial Sequence
  chemically synthesized
tgagtggaattttcttcttg

SEQ ID NO: 465032 - DNA, 20 bp, Artificial Sequence
  chemically synthesized
ggaaaacaaggtaaagtgag

SEQ ID NO: 465033 - DNA, 20 bp, Artificial Sequence
  chemically synthesized
aatggaaaacaaggtaaagt

SEQ ID NO: 465034 - DNA, 20 bp, Artificial Sequence
  chemically synthesized
agtcaatggaaaacaaggta

SEQ ID NO: 465035 - DNA, 20 bp, Artificial Sequence
  chemically synthesized
gtgaaagtcaatggaaaaca

SEQ ID NO: 465036 - DNA, 20 bp, Artificial Sequence
  chemically synthesized
ggtgaaagtcaatggaaaac

SEQ ID NO: 465037 - DNA, 20 bp, Artificial Sequence
  chemically synthesized
acagaaagggtgaaagtcaa

SEQ ID NO: 465038 - DNA, 20 bp, Artificial Sequence
  chemically synthesized
tagacttacagaaagggtga

SEQ ID NO: 465039 - DNA, 20 bp, Artificial Sequence
  chemically synthesized
ttgactttcaccctttctgt

SEQ ID NO: 465040 - DNA, 20 bp, Artificial Sequence
  chemically synthesized
tttcagtagacttacagaaa

SEQ ID NO: 465041 - DNA, 20 bp, Artificial Sequence
  chemically synthesized
atttcagtagacttacagaa

SEQ ID NO: 465042 - DNA, 20 bp, Artificial Sequence
  chemically synthesized
gatttcagtagacttacaga

SEQ ID NO: 465043 - DNA, 20 bp, Artificial Sequence
  chemically synthesized
gtatgatttcagtagactta

SEQ ID NO: 465044 - DNA, 20 bp, Artificial Sequence
  chemically synthesized
ccgttagtgtatgatttcag

SEQ ID NO: 465045 - DNA, 20 bp, Artificial Sequence
  chemically synthesized
tttccgttagtgtatgattt

SEQ ID NO: 465046 - DNA, 20 bp, Artificial Sequence
  chemically synthesized
ctactgaaatcatacactaa

SEQ ID NO: 465047 - DNA, 20 bp, Artificial Sequence
  chemically synthesized
gaaatcatacactaacggaa

SEQ ID NO: 465048 - DNA, 20 bp, Artificial Sequence
  chemically synthesized
ttttattgctgcttttccgt

SEQ ID NO: 465049 - DNA, 20 bp, Artificial Sequence
  chemically synthesized
atcatacactaacggaaaag

SEQ ID NO: 465050 - DNA, 20 bp, Artificial Sequence
  chemically synthesized
aaaagcagcaataaaaataa

SEQ ID NO: 465051 - DNA, 20 bp, Artificial Sequence
  chemically synthesized
aataacagaatcctaccaaa

SEQ ID NO: 465052 - DNA, 20 bp, Artificial Sequence
  chemically synthesized
ataacagaatcctaccaaat

SEQ ID NO: 465053 - DNA, 20 bp, Artificial Sequence
  chemically synthesized
gctgaatttacctatttggt

SEQ ID NO: 465054 - DNA, 20 bp, Artificial Sequence
  chemically synthesized
tgctgaatttacctatttgg

SEQ ID NO: 465055 - DNA, 20 bp, Artificial Sequence
  chemically synthesized
tcttgctgaatttacctatt

SEQ ID NO: 465056 - DNA, 20 bp, Artificial Sequence
  chemically synthesized
tcctaccaaataggtaaatt

SEQ ID NO: 465057 - DNA, 20 bp, Artificial Sequence
  chemically synthesized
accaaataggtaaattcagc

SEQ ID NO: 465058 - DNA, 20 bp, Artificial Sequence
  chemically synthesized
ggtaaattcagcaagattaa

SEQ ID NO: 465059 - DNA, 20 bp, Artificial Sequence
  chemically synthesized
taaattcagcaagattaatg

SEQ ID NO: 465060 - DNA, 20 bp, Artificial Sequence
  chemically synthesized
caagattaatggagtcaaac

SEQ ID NO: 465061 - DNA, 20 bp, Artificial Sequence
  chemically synthesized
aagattaatggagtcaaact

SEQ ID NO: 465062 - DNA, 20 bp, Artificial Sequence
  chemically synthesized
attaatggagtcaaactagg

SEQ ID NO: 465063 - DNA, 20 bp, Artificial Sequence
  chemically synthesized
acttatatataatatctgcc

SEQ ID NO: 465064 - DNA, 20 bp, Artificial Sequence
  chemically synthesized
actaggcagatattatatat

SEQ ID NO: 465065 - DNA, 20 bp, Artificial Sequence
  chemically synthesized
tatatataagtcaatgattg

SEQ ID NO: 465066 - DNA, 20 bp, Artificial Sequence
  chemically synthesized
tatataagtcaatgattgca

SEQ ID NO: 465067 - DNA, 20 bp, Artificial Sequence
  chemically synthesized
aatgtttccataaaaaattg

SEQ ID NO: 465068 - DNA, 20 bp, Artificial Sequence
  chemically synthesized
gcagagacttcaatttttta

SEQ ID NO: 465069 - DNA, 20 bp, Artificial Sequence
  chemically synthesized
ttaaataaacattcctcaac

SEQ ID NO: 465070 - DNA, 20 bp, Artificial Sequence
  chemically synthesized
ttgagataatttacttgttg

SEQ ID NO: 465071 - DNA, 20 bp, Artificial Sequence
  chemically synthesized
attgagataatttacttgtt

SEQ ID NO: 465072 - DNA, 20 bp, Artificial Sequence
  chemically synthesized
caacaagtaaattatctcaa

SEQ ID NO: 465073 - DNA, 20 bp, Artificial Sequence
  chemically synthesized
catttggctgttagtctatt

SEQ ID NO: 465074 - DNA, 20 bp, Artificial Sequence
  chemically synthesized
aaattatctcaatagactaa

SEQ ID NO: 465075 - DNA, 20 bp, Artificial Sequence
  chemically synthesized
agatggtttcatttggctgt

SEQ ID NO: 465076 - DNA, 20 bp, Artificial Sequence
  chemically synthesized
cagataaagatggtttcatt

SEQ ID NO: 465077 - DNA, 20 bp, Artificial Sequence
  chemically synthesized
tgcagcctaacagataaaga

SEQ ID NO: 465078 - DNA, 20 bp, Artificial Sequence
  chemically synthesized
atgaaaccatctttatctgt

SEQ ID NO: 465079 - DNA, 20 bp, Artificial Sequence
  chemically synthesized
aatatgcagcctaacagata

SEQ ID NO: 465080 - DNA, 20 bp, Artificial Sequence
  chemically synthesized
tgaaaccatctttatctgtt

SEQ ID NO: 465081 - DNA, 20 bp, Artificial Sequence
  chemically synthesized
agttcaaatatgcagcctaa

SEQ ID NO: 465082 - DNA, 20 bp, Artificial Sequence
  chemically synthesized
ggaaaagtagttcaaatatg

SEQ ID NO: 465083 - DNA, 20 bp, Artificial Sequence
  chemically synthesized
catatttgaactacttttcc

SEQ ID NO: 465084 - DNA, 20 bp, Artificial Sequence
  chemically synthesized
gtactagagacttggaaaag

SEQ ID NO: 465085 - DNA, 20 bp, Artificial Sequence
  chemically synthesized
taagtactagagacttggaa

SEQ ID NO: 465086 - DNA, 20 bp, Artificial Sequence
  chemically synthesized
gaactacttttccaagtctc

SEQ ID NO: 465087 - DNA, 20 bp, Artificial Sequence
  chemically synthesized
ctacttaagtactagagact

SEQ ID NO: 465088 - DNA, 20 bp, Artificial Sequence
  chemically synthesized
cccatactacttaagtacta

SEQ ID NO: 465089 - DNA, 20 bp, Artificial Sequence
  chemically synthesized
tttccaagtctctagtactt

SEQ ID NO: 465090 - DNA, 20 bp, Artificial Sequence
  chemically synthesized
cacccatactacttaagtac

SEQ ID NO: 465091 - DNA, 20 bp, Artificial Sequence
  chemically synthesized
ccaagtctctagtacttaag

SEQ ID NO: 465092 - DNA, 20 bp, Artificial Sequence
  chemically synthesized
tgtaaccacccatactactt

SEQ ID NO: 465093 - DNA, 20 bp, Artificial Sequence
  chemically synthesized
tctctagtacttaagtagta

SEQ ID NO: 465094 - DNA, 20 bp, Artificial Sequence
  chemically synthesized
ctctagtacttaagtagtat

SEQ ID NO: 465095 - DNA, 20 bp, Artificial Sequence
  chemically synthesized
tagtacttaagtagtatggg

SEQ ID NO: 465096 - DNA, 20 bp, Artificial Sequence
  chemically synthesized
gtggttacaatttctgttta

SEQ ID NO: 465097 - DNA, 20 bp, Artificial Sequence
  chemically synthesized
taacagttctataccataaa

SEQ ID NO: 465098 - DNA, 20 bp, Artificial Sequence
  chemically synthesized
tacaatttctgtttatggta

SEQ ID NO: 465099 - DNA, 20 bp, Artificial Sequence
  chemically synthesized
gcaatgtaacagttaaataa

SEQ ID NO: 465100 - DNA, 20 bp, Artificial Sequence
  chemically synthesized
tatctaaacaagcaatgtaa

SEQ ID NO: 465101 - DNA, 20 bp, Artificial Sequence
  chemically synthesized
taactgttacattgcttgtt

SEQ ID NO: 465102 - DNA, 20 bp, Artificial Sequence
  chemically synthesized
attgactcaagtatctaaac

SEQ ID NO: 465103 - DNA, 20 bp, Artificial Sequence
  chemically synthesized
cattgcttgtttagatactt

SEQ ID NO: 465104 - DNA, 20 bp, Artificial Sequence
  chemically synthesized
tgttttttgcttattgactc

SEQ ID NO: 465105 - DNA, 20 bp, Artificial Sequence
  chemically synthesized
gtttagatacttgagtcaat

SEQ ID NO: 465106 - DNA, 20 bp, Artificial Sequence
  chemically synthesized
caaaaaacaaaatttcttta

SEQ ID NO: 465107 - DNA, 20 bp, Artificial Sequence
  chemically synthesized
aacaaaatttctttatagtc

SEQ ID NO: 465108 - DNA, 20 bp, Artificial Sequence
  chemically synthesized
cacctcatctctagactata

SEQ ID NO: 465109 - DNA, 20 bp, Artificial Sequence
  chemically synthesized
caaaatttctttatagtcta

SEQ ID NO: 465110 - DNA, 20 bp, Artificial Sequence
  chemically synthesized
tttctttatagtctagagat

SEQ ID NO: 465111 - DNA, 20 bp, Artificial Sequence
  chemically synthesized
ttctttatagtctagagatg

SEQ ID NO: 465112 - DNA, 20 bp, Artificial Sequence
  chemically synthesized
aagtttgctcacctcatctc

SEQ ID NO: 465113 - DNA, 20 bp, Artificial Sequence
  chemically synthesized
ttatagtctagagatgaggt

SEQ ID NO: 465114 - DNA, 20 bp, Artificial Sequence
  chemically synthesized
tatctggccctcgataggaa

SEQ ID NO: 465115 - DNA, 20 bp, Artificial Sequence
  chemically synthesized
gtgagcaaacttttcctatc

SEQ ID NO: 465116 - DNA, 20 bp, Artificial Sequence
  chemically synthesized
tgagcaaacttttcctatcg

SEQ ID NO: 465117 - DNA, 20 bp, Artificial Sequence
  chemically synthesized
gagcaaacttttcctatcga

SEQ ID NO: 465118 - DNA, 20 bp, Artificial Sequence
  chemically synthesized
tttactatctggccctcgat

SEQ ID NO: 465119 - DNA, 20 bp, Artificial Sequence
  chemically synthesized
atttactatctggccctcga

SEQ ID NO: 465120 - DNA, 20 bp, Artificial Sequence
  chemically synthesized
aaacttttcctatcgagggc

SEQ ID NO: 465121 - DNA, 20 bp, Artificial Sequence
  chemically synthesized
ttttcctatcgagggccaga

SEQ ID NO: 465122 - DNA, 20 bp, Artificial Sequence
  chemically synthesized
aagcaggaatatttactatc

SEQ ID NO: 465123 - DNA, 20 bp, Artificial Sequence
  chemically synthesized
tagtaaatattcctgctttg

SEQ ID NO: 465124 - DNA, 20 bp, Artificial Sequence
  chemically synthesized
gaccatgtgggccacaaagc

SEQ ID NO: 465125 - DNA, 20 bp, Artificial Sequence
  chemically synthesized
agaccatgtgggccacaaag

SEQ ID NO: 465126 - DNA, 20 bp, Artificial Sequence
  chemically synthesized
cagagaccatgtgggccaca

SEQ ID NO: 465127 - DNA, 20 bp, Artificial Sequence
  chemically synthesized
ttcctgctttgtggcccaca

SEQ ID NO: 465128 - DNA, 20 bp, Artificial Sequence
  chemically synthesized
acttatgacagagaccatgt

SEQ ID NO: 465129 - DNA, 20 bp, Artificial Sequence
  chemically synthesized
tacttatgacagagaccatg

SEQ ID NO: 465130 - DNA, 20 bp, Artificial Sequence
  chemically synthesized
gcccacatggtctctgtcat

SEQ ID NO: 465131 - DNA, 20 bp, Artificial Sequence
  chemically synthesized
acagttgagtacttatgaca

SEQ ID NO: 465132 - DNA, 20 bp, Artificial Sequence
  chemically synthesized
acacagttgagtacttatga

SEQ ID NO: 465133 - DNA, 20 bp, Artificial Sequence
  chemically synthesized
tttcatgctaaaacacagtt

SEQ ID NO: 465134 - DNA, 20 bp, Artificial Sequence
  chemically synthesized
ataagtactcaactgtgttt

SEQ ID NO: 465135 - DNA, 20 bp, Artificial Sequence
  chemically synthesized
actcctttcatgctaaaaca

SEQ ID NO: 465136 - DNA, 20 bp, Artificial Sequence
  chemically synthesized
tcaactgtgttttagcatga

SEQ ID NO: 465137 - DNA, 20 bp, Artificial Sequence
  chemically synthesized
caactgtgttttagcatgaa

SEQ ID NO: 465138 - DNA, 20 bp, Artificial Sequence
  chemically synthesized
actgtgttttagcatgaaag

SEQ ID NO: 465139 - DNA, 20 bp, Artificial Sequence
  chemically synthesized
agcatgaaaggagtcctata

SEQ ID NO: 465140 - DNA, 20 bp, Artificial Sequence
  chemically synthesized
tatttgtttatatgctatat

SEQ ID NO: 465141 - DNA, 20 bp, Artificial Sequence
  chemically synthesized
ttatttgtttatatgctata

SEQ ID NO: 465142 - DNA, 20 bp, Artificial Sequence
  chemically synthesized
atagcatataaacaaataaa

SEQ ID NO: 465143 - DNA, 20 bp, Artificial Sequence
  chemically synthesized
tagcatataaacaaataaat

SEQ ID NO: 465144 - DNA, 20 bp, Artificial Sequence
  chemically synthesized
tataaacaaataaatgggtg

SEQ ID NO: 465145 - DNA, 20 bp, Artificial Sequence
  chemically synthesized
tctatagtttatttggaaga

SEQ ID NO: 465146 - DNA, 20 bp, Artificial Sequence
  chemically synthesized
agagtctatagtttatttgg

SEQ ID NO: 465147 - DNA, 20 bp, Artificial Sequence
  chemically synthesized
ttaagagtctatagtttatt

SEQ ID NO: 465148 - DNA, 20 bp, Artificial Sequence
  chemically synthesized
gctgtcttccaaataaacta

SEQ ID NO: 465149 - DNA, 20 bp, Artificial Sequence
  chemically synthesized
aatttcaatttaagagtcta

SEQ ID NO: 465150 - DNA, 20 bp, Artificial Sequence
  chemically synthesized
tatataaaatttcaatttaa

SEQ ID NO: 465151 - DNA, 20 bp, Artificial Sequence
  chemically synthesized
attatataaaatttcaattt

SEQ ID NO: 465152 - DNA, 20 bp, Artificial Sequence
  chemically synthesized
ttttatataatctcatgtgt

SEQ ID NO: 465153 - DNA, 20 bp, Artificial Sequence
  chemically synthesized
caagaatatttctgacacat

SEQ ID NO: 465154 - DNA, 20 bp, Artificial Sequence
  chemically synthesized
tttctgaattgtttcatttc

SEQ ID NO: 465155 - DNA, 20 bp, Artificial Sequence
  chemically synthesized
attcttgaaatgaaacaatt

SEQ ID NO: 465156 - DNA, 20 bp, Artificial Sequence
  chemically synthesized
gtttgaccagtcatttaaaa

SEQ ID NO: 465157 - DNA, 20 bp, Artificial Sequence
  chemically synthesized
tgaaaaccattttaaatgac

SEQ ID NO: 465158 - DNA, 20 bp, Artificial Sequence
  chemically synthesized
attttaaatgactggtcaaa

SEQ ID NO: 465159 - DNA, 20 bp, Artificial Sequence
  chemically synthesized
cacatctattactgtttgac

SEQ ID NO: 465160 - DNA, 20 bp, Artificial Sequence
  chemically synthesized
aatgactggtcaaacagtaa

SEQ ID NO: 465161 - DNA, 20 bp, Artificial Sequence
  chemically synthesized
cagtaatagatgtgacaatg

SEQ ID NO: 465162 - DNA, 20 bp, Artificial Sequence
  chemically synthesized
ggctaggggtcagtaaatga

SEQ ID NO: 465163 - DNA, 20 bp, Artificial Sequence
  chemically synthesized
gactatcatttactgacccc

SEQ ID NO: 465164 - DNA, 20 bp, Artificial Sequence
  chemically synthesized
gcatcatccaggctaggggt

SEQ ID NO: 465165 - DNA, 20 bp, Artificial Sequence
  chemically synthesized
tcatttactgacccctagcc

SEQ ID NO: 465166 - DNA, 20 bp, Artificial Sequence
  chemically synthesized
actcgcatcatccaggctag

SEQ ID NO: 465167 - DNA, 20 bp, Artificial Sequence
  chemically synthesized
cactcgcatcatccaggcta

SEQ ID NO: 465168 - DNA, 20 bp, Artificial Sequence
  chemically synthesized
ccactcgcatcatccaggct

SEQ ID NO: 465169 - DNA, 20 bp, Artificial Sequence
  chemically synthesized
tccactcgcatcatccaggc

SEQ ID NO: 465170 - DNA, 20 bp, Artificial Sequence
  chemically synthesized
ctactccactcgcatcatcc

SEQ ID NO: 465171 - DNA, 20 bp, Artificial Sequence
  chemically synthesized
actactccactcgcatcatc

SEQ ID NO: 465172 - DNA, 20 bp, Artificial Sequence
  chemically synthesized
acccctagcctggatgatgc

SEQ ID NO: 465173 - DNA, 20 bp, Artificial Sequence
  chemically synthesized
cctagcctggatgatgcgag

SEQ ID NO: 465174 - DNA, 20 bp, Artificial Sequence
  chemically synthesized
tagcctggatgatgcgagtg

SEQ ID NO: 465175 - DNA, 20 bp, Artificial Sequence
  chemically synthesized
cctggatgatgcgagtggag

SEQ ID NO: 465176 - DNA, 20 bp, Artificial Sequence
  chemically synthesized
ggatgatgcgagtggagtag

SEQ ID NO: 465177 - DNA, 20 bp, Artificial Sequence
  chemically synthesized
atgatgcgagtggagtagta

SEQ ID NO: 465178 - DNA, 20 bp, Artificial Sequence
  chemically synthesized
agtggagtagtagagaccct

SEQ ID NO: 465179 - DNA, 20 bp, Artificial Sequence
  chemically synthesized
tggagtagtagagaccctca

SEQ ID NO: 465180 - DNA, 20 bp, Artificial Sequence
  chemically synthesized
ttagacatttatttctctga

SEQ ID NO: 465181 - DNA, 20 bp, Artificial Sequence
  chemically synthesized
tttagacatttatttctctg

SEQ ID NO: 465182 - DNA, 20 bp, Artificial Sequence
  chemically synthesized
ttttagacatttatttctct

SEQ ID NO: 465183 - DNA, 20 bp, Artificial Sequence
  chemically synthesized
agaaataaatgtctaaaaaa

SEQ ID NO: 465184 - DNA, 20 bp, Artificial Sequence
  chemically synthesized
taaaaacatgttcttttttt

SEQ ID NO: 465185 - DNA, 20 bp, Artificial Sequence
  chemically synthesized
aaaaaagaacatgtttttaa

SEQ ID NO: 465186 - DNA, 20 bp, Artificial Sequence
  chemically synthesized
atgtttttaaaagaaatgat

SEQ ID NO: 465187 - DNA, 20 bp, Artificial Sequence
  chemically synthesized
aaaagaaatgattggactca

SEQ ID NO: 465188 - DNA, 20 bp, Artificial Sequence
  chemically synthesized
atttttaactaagaatctgt

SEQ ID NO: 465189 - DNA, 20 bp, Artificial Sequence
  chemically synthesized
tgattggactcacagattct

SEQ ID NO: 465190 - DNA, 20 bp, Artificial Sequence
  chemically synthesized
gtctgagataatttttaact

SEQ ID NO: 465191 - DNA, 20 bp, Artificial Sequence
  chemically synthesized
ttcttagttaaaaattatct

SEQ ID NO: 465192 - DNA, 20 bp, Artificial Sequence
  chemically synthesized
ggaaattgaagaagatgtct

SEQ ID NO: 465193 - DNA, 20 bp, Artificial Sequence
  chemically synthesized
gcactaaatggaaattgaag

SEQ ID NO: 465194 - DNA, 20 bp, Artificial Sequence
  chemically synthesized
tctgcactaaatggaaattg

SEQ ID NO: 465195 - DNA, 20 bp, Artificial Sequence
  chemically synthesized
catcttcttcaatttccatt

SEQ ID NO: 465196 - DNA, 20 bp, Artificial Sequence
  chemically synthesized
tcttcaatttccatttagtg

SEQ ID NO: 465197 - DNA, 20 bp, Artificial Sequence
  chemically synthesized
aatggagtttctgcactaaa

SEQ ID NO: 465198 - DNA, 20 bp, Artificial Sequence
  chemically synthesized
tagtgcagaaactccattct

SEQ ID NO: 465199 - DNA, 20 bp, Artificial Sequence
  chemically synthesized
agtgttcagtgctaagaatg

SEQ ID NO: 465200 - DNA, 20 bp, Artificial Sequence
  chemically synthesized
aaagtgttcagtgctaagaa

SEQ ID NO: 465201 - DNA, 20 bp, Artificial Sequence
  chemically synthesized
ttcctaaagtgttcagtgct

SEQ ID NO: 465202 - DNA, 20 bp, Artificial Sequence
  chemically synthesized
attcttagcactgaacactt

SEQ ID NO: 465203 - DNA, 20 bp, Artificial Sequence
  chemically synthesized
ctccttattcctaaagtgtt

SEQ ID NO: 465204 - DNA, 20 bp, Artificial Sequence
  chemically synthesized
ttcttagcactgaacacttt

SEQ ID NO: 465205 - DNA, 20 bp, Artificial Sequence
  chemically synthesized
gcactgaacactttaggaat

SEQ ID NO: 465206 - DNA, 20 bp, Artificial Sequence
  chemically synthesized
cactgcactccttattccta

SEQ ID NO: 465207 - DNA, 20 bp, Artificial Sequence
  chemically synthesized
cactgaacactttaggaata

SEQ ID NO: 465208 - DNA, 20 bp, Artificial Sequence
  chemically synthesized
ctgaacactttaggaataag

SEQ ID NO: 465209 - DNA, 20 bp, Artificial Sequence
  chemically synthesized
cactttaggaataaggagtg

SEQ ID NO: 465210 - DNA, 20 bp, Artificial Sequence
  chemically synthesized
aaggagtgcagtgtctcaca

SEQ ID NO: 465211 - DNA, 20 bp, Artificial Sequence
  chemically synthesized
cagagaattgattactttgt

SEQ ID NO: 465212 - DNA, 20 bp, Artificial Sequence
  chemically synthesized
tccagttaatgttgtgagca

SEQ ID NO: 465213 - DNA, 20 bp, Artificial Sequence
  chemically synthesized
cttccagttaatgttgtgag

SEQ ID NO: 465214 - DNA, 20 bp, Artificial Sequence
  chemically synthesized
attcttccagttaatgttgt

SEQ ID NO: 465215 - DNA, 20 bp, Artificial Sequence
  chemically synthesized
tctctgctcacaacattaac

SEQ ID NO: 465216 - DNA, 20 bp, Artificial Sequence
  chemically synthesized
ctgctcacaacattaactgg

SEQ ID NO: 465217 - DNA, 20 bp, Artificial Sequence
  chemically synthesized
gcaatggaaaagtattcttc

SEQ ID NO: 465218 - DNA, 20 bp, Artificial Sequence
  chemically synthesized
cctctttggtagcaatggaa

SEQ ID NO: 465219 - DNA, 20 bp, Artificial Sequence
  chemically synthesized
ttgcacctctttggtagcaa

SEQ ID NO: 465220 - DNA, 20 bp, Artificial Sequence
  chemically synthesized
atacttttccattgctacca

SEQ ID NO: 465221 - DNA, 20 bp, Artificial Sequence
  chemically synthesized
acttttccattgctaccaaa

SEQ ID NO: 465222 - DNA, 20 bp, Artificial Sequence
  chemically synthesized
cttttccattgctaccaaag

SEQ ID NO: 465223 - DNA, 20 bp, Artificial Sequence
  chemically synthesized
actcacttgcacctctttgg

SEQ ID NO: 465224 - DNA, 20 bp, Artificial Sequence
  chemically synthesized
tagactcacttgcacctctt

SEQ ID NO: 465225 - DNA, 20 bp, Artificial Sequence
  chemically synthesized
cattgctaccaaagaggtgc

SEQ ID NO: 465226 - DNA, 20 bp, Artificial Sequence
  chemically synthesized
gctaccaaagaggtgcaagt

SEQ ID NO: 465227 - DNA, 20 bp, Artificial Sequence
  chemically synthesized
ctataatgcagaagagggtt

SEQ ID NO: 465228 - DNA, 20 bp, Artificial Sequence
  chemically synthesized
atgtgctataatgcagaaga

SEQ ID NO: 465229 - DNA, 20 bp, Artificial Sequence
  chemically synthesized
gatgtgctataatgcagaag

SEQ ID NO: 465230 - DNA, 20 bp, Artificial Sequence
  chemically synthesized
cgatgtgctataatgcagaa

SEQ ID NO: 465231 - DNA, 20 bp, Artificial Sequence
  chemically synthesized
ttcgatgtgctataatgcag

SEQ ID NO: 465232 - DNA, 20 bp, Artificial Sequence
  chemically synthesized
ctaaaccctcttctgcatta

SEQ ID NO: 465233 - DNA, 20 bp, Artificial Sequence
  chemically synthesized
atattcgatgtgctataatg

SEQ ID NO: 465234 - DNA, 20 bp, Artificial Sequence
  chemically synthesized
gcacatcgaatatttgaaat

SEQ ID NO: 465235 - DNA, 20 bp, Artificial Sequence
  chemically synthesized
ggaaaaaagtagagaaaatt

SEQ ID NO: 465236 - DNA, 20 bp, Artificial Sequence
  chemically synthesized
atacttgaaggaaaaaagta

SEQ ID NO: 465237 - DNA, 20 bp, Artificial Sequence
  chemically synthesized
gaatacttgaaggaaaaaag

SEQ ID NO: 465238 - DNA, 20 bp, Artificial Sequence
  chemically synthesized
gaagaatacttgaaggaaaa

SEQ ID NO: 465239 - DNA, 20 bp, Artificial Sequence
  chemically synthesized
tttctctacttttttccttc

SEQ ID NO: 465240 - DNA, 20 bp, Artificial Sequence
  chemically synthesized
aaaagttgaagaatacttga

SEQ ID NO: 465241 - DNA, 20 bp, Artificial Sequence
  chemically synthesized
gaaaagttgaagaatacttg

SEQ ID NO: 465242 - DNA, 20 bp, Artificial Sequence
  chemically synthesized
actagaaaagtgaaaagttg

SEQ ID NO: 465243 - DNA, 20 bp, Artificial Sequence
  chemically synthesized
gaaagtactagaaaagtgaa

SEQ ID NO: 465244 - DNA, 20 bp, Artificial Sequence
  chemically synthesized
tcttcaacttttcacttttc

SEQ ID NO: 465245 - DNA, 20 bp, Artificial Sequence
  chemically synthesized
gggcatggaaagtactagaa

SEQ ID NO: 465246 - DNA, 20 bp, Artificial Sequence
  chemically synthesized
ttgaggggcatggaaagtac

SEQ ID NO: 465247 - DNA, 20 bp, Artificial Sequence
  chemically synthesized
taacatttgaggggcatgga

SEQ ID NO: 465248 - DNA, 20 bp, Artificial Sequence
  chemically synthesized
actataacatttgaggggca

SEQ ID NO: 465249 - DNA, 20 bp, Artificial Sequence
  chemically synthesized
tacaaactataacatttgag

SEQ ID NO: 465250 - DNA, 20 bp, Artificial Sequence
  chemically synthesized
ctacaaactataacatttga

SEQ ID NO: 465251 - DNA, 20 bp, Artificial Sequence
  chemically synthesized
cctacaaactataacatttg

SEQ ID NO: 465252 - DNA, 20 bp, Artificial Sequence
  chemically synthesized
tcctacaaactataacattt

SEQ ID NO: 465253 - DNA, 20 bp, Artificial Sequence
  chemically synthesized
tccatgcccctcaaatgtta

SEQ ID NO: 465254 - DNA, 20 bp, Artificial Sequence
  chemically synthesized
ccctcaaatgttatagtttg

SEQ ID NO: 465255 - DNA, 20 bp, Artificial Sequence
  chemically synthesized
cctcaaatgttatagtttgt

SEQ ID NO: 465256 - DNA, 20 bp, Artificial Sequence
  chemically synthesized
ttatagtttgtaggaccttt

SEQ ID NO: 465257 - DNA, 20 bp, Artificial Sequence
  chemically synthesized
aaaagtgtctgaatgctaaa

SEQ ID NO: 465258 - DNA, 20 bp, Artificial Sequence
  chemically synthesized
gaaaagtgtctgaatgctaa

SEQ ID NO: 465259 - DNA, 20 bp, Artificial Sequence
  chemically synthesized
ttgtaggaccttttagcatt

SEQ ID NO: 465260 - DNA, 20 bp, Artificial Sequence
  chemically synthesized
ttgggggtatgttcagtgaa

SEQ ID NO: 465261 - DNA, 20 bp, Artificial Sequence
  chemically synthesized
ttaacatttgggggtatgtt

SEQ ID NO: 465262 - DNA, 20 bp, Artificial Sequence
  chemically synthesized
agaggaaccttaacatttgg

SEQ ID NO: 465263 - DNA, 20 bp, Artificial Sequence
  chemically synthesized
aagaggaaccttaacatttg

SEQ ID NO: 465264 - DNA, 20 bp, Artificial Sequence
  chemically synthesized
tgaacatacccccaaatgtt

SEQ ID NO: 465265 - DNA, 20 bp, Artificial Sequence
  chemically synthesized
taagaggaaccttaacattt

SEQ ID NO: 465266 - DNA, 20 bp, Artificial Sequence
  chemically synthesized
gaacatacccccaaatgtta

SEQ ID NO: 465267 - DNA, 20 bp, Artificial Sequence
  chemically synthesized
ctaagaggaaccttaacatt

SEQ ID NO: 465268 - DNA, 20 bp, Artificial Sequence
  chemically synthesized
ccaaatgttaaggttcctct

SEQ ID NO: 465269 - DNA, 20 bp, Artificial Sequence
  chemically synthesized
gaaggacaccatgatctaag

SEQ ID NO: 465270 - DNA, 20 bp, Artificial Sequence
  chemically synthesized
agaaggacaccatgatctaa

SEQ ID NO: 465271 - DNA, 20 bp, Artificial Sequence
  chemically synthesized
ttaaggttcctcttagatca

SEQ ID NO: 465272 - DNA, 20 bp, Artificial Sequence
  chemically synthesized
ttagaaggacaccatgatct

SEQ ID NO: 465273 - DNA, 20 bp, Artificial Sequence
  chemically synthesized
taatatatacatattttaga

SEQ ID NO: 465274 - DNA, 20 bp, Artificial Sequence
  chemically synthesized
gtaatatatacatattttag

SEQ ID NO: 465275 - DNA, 20 bp, Artificial Sequence
  chemically synthesized
gtggtaatatatacatattt

SEQ ID NO: 465276 - DNA, 20 bp, Artificial Sequence
  chemically synthesized
gtatatgtatatattatatg

SEQ ID NO: 465277 - DNA, 20 bp, Artificial Sequence
  chemically synthesized
gtgtatatatatgataggta

SEQ ID NO: 465278 - DNA, 20 bp, Artificial Sequence
  chemically synthesized
tgtgtgtgtatatatatgat

SEQ ID NO: 465279 - DNA, 20 bp, Artificial Sequence
  chemically synthesized
gtgtgtgtgtatatatatga

SEQ ID NO: 465280 - DNA, 20 bp, Artificial Sequence
  chemically synthesized
gaaggatatatatgatataa

SEQ ID NO: 465281 - DNA, 20 bp, Artificial Sequence
  chemically synthesized
aaatgagaacgaattttaga

SEQ ID NO: 465282 - DNA, 20 bp, Artificial Sequence
  chemically synthesized
aaaatgagaacgaattttag

SEQ ID NO: 465283 - DNA, 20 bp, Artificial Sequence
  chemically synthesized
aaaaaaatgagaacgaattt

SEQ ID NO: 465284 - DNA, 20 bp, Artificial Sequence
  chemically synthesized
aaaaaggaaatgaaaaaaat

SEQ ID NO: 465285 - DNA, 20 bp, Artificial Sequence
  chemically synthesized
atttttttcatttccttttt

SEQ ID NO: 465286 - DNA, 20 bp, Artificial Sequence
  chemically synthesized
tttttttcatttcctttttc

SEQ ID NO: 465287 - DNA, 20 bp, Artificial Sequence
  chemically synthesized
ttagacatgtatcctgaaaa

SEQ ID NO: 465288 - DNA, 20 bp, Artificial Sequence
  chemically synthesized
gttagacatgtatcctgaaa

SEQ ID NO: 465289 - DNA, 20 bp, Artificial Sequence
  chemically synthesized
atgaaacaaagtaatattgt

SEQ ID NO: 465290 - DNA, 20 bp, Artificial Sequence
  chemically synthesized
catcaaaatacaatgaaaca

SEQ ID NO: 465291 - DNA, 20 bp, Artificial Sequence
  chemically synthesized
ttgttggtcatcattattat

SEQ ID NO: 465292 - DNA, 20 bp, Artificial Sequence
  chemically synthesized
ataatgatgaccaacaaaat

SEQ ID NO: 465293 - DNA, 20 bp, Artificial Sequence
  chemically synthesized
ataaatcttactgattttgt

SEQ ID NO: 465294 - DNA, 20 bp, Artificial Sequence
  chemically synthesized
tgatgaccaacaaaatcagt

SEQ ID NO: 465295 - DNA, 20 bp, Artificial Sequence
  chemically synthesized
ttattcaattaattattact

SEQ ID NO: 465296 - DNA, 20 bp, Artificial Sequence
  chemically synthesized
gacatgagagagttaaagct

SEQ ID NO: 465297 - DNA, 20 bp, Artificial Sequence
  chemically synthesized
tacaggacatgagagagtta

SEQ ID NO: 465298 - DNA, 20 bp, Artificial Sequence
  chemically synthesized
ggcaagtacaggacatgaga

SEQ ID NO: 465299 - DNA, 20 bp, Artificial Sequence
  chemically synthesized
ctggcaagtacaggacatga

SEQ ID NO: 465300 - DNA, 20 bp, Artificial Sequence
  chemically synthesized
atctggcaagtacaggacat

SEQ ID NO: 465301 - DNA, 20 bp, Artificial Sequence
  chemically synthesized
aaaatcaatctggcaagtac

SEQ ID NO: 465302 - DNA, 20 bp, Artificial Sequence
  chemically synthesized
ctctcatgtcctgtacttgc

SEQ ID NO: 465303 - DNA, 20 bp, Artificial Sequence
  chemically synthesized
taaaatcaatctggcaagta

SEQ ID NO: 465304 - DNA, 20 bp, Artificial Sequence
  chemically synthesized
gttcataaaatcaatctggc

SEQ ID NO: 465305 - DNA, 20 bp, Artificial Sequence
  chemically synthesized
taaggttcataaaatcaatc

SEQ ID NO: 465306 - DNA, 20 bp, Artificial Sequence
  chemically synthesized
cagattgattttatgaacct

SEQ ID NO: 465307 - DNA, 20 bp, Artificial Sequence
  chemically synthesized
tgattttatgaaccttagct

SEQ ID NO: 465308 - DNA, 20 bp, Artificial Sequence
  chemically synthesized
gattttatgaaccttagctt

SEQ ID NO: 465309 - DNA, 20 bp, Artificial Sequence
  chemically synthesized
aagtataacatcctaagcta

SEQ ID NO: 465310 - DNA, 20 bp, Artificial Sequence
  chemically synthesized
taagtataacatcctaagct

SEQ ID NO: 465311 - DNA, 20 bp, Artificial Sequence
  chemically synthesized
aggaataagtataacatcct

SEQ ID NO: 465312 - DNA, 20 bp, Artificial Sequence
  chemically synthesized
agaataattgtaataggaat

SEQ ID NO: 465313 - DNA, 20 bp, Artificial Sequence
  chemically synthesized
tcaaagagaataattgtaat

SEQ ID NO: 465314 - DNA, 20 bp, Artificial Sequence
  chemically synthesized
gtcaaagagaataattgtaa

SEQ ID NO: 465315 - DNA, 20 bp, Artificial Sequence
  chemically synthesized
aaaactgtggtgaggtcaaa

SEQ ID NO: 465316 - DNA, 20 bp, Artificial Sequence
  chemically synthesized
taaaaactgtggtgaggtca

SEQ ID NO: 465317 - DNA, 20 bp, Artificial Sequence
  chemically synthesized
tattctctttgacctcacca

SEQ ID NO: 465318 - DNA, 20 bp, Artificial Sequence
  chemically synthesized
accacctaaaaactgtggtg

SEQ ID NO: 465319 - DNA, 20 bp, Artificial Sequence
  chemically synthesized
gaccacctaaaaactgtggt

SEQ ID NO: 465320 - DNA, 20 bp, Artificial Sequence
  chemically synthesized
tttgacctcaccacagtttt

SEQ ID NO: 465321 - DNA, 20 bp, Artificial Sequence
  chemically synthesized
ttatgaccacctaaaaactg

SEQ ID NO: 465322 - DNA, 20 bp, Artificial Sequence
  chemically synthesized
ttgacctcaccacagttttt

SEQ ID NO: 465323 - DNA, 20 bp, Artificial Sequence
  chemically synthesized
acctcaccacagtttttagg

SEQ ID NO: 465324 - DNA, 20 bp, Artificial Sequence
  chemically synthesized
tttaggtggtcataatcctt

SEQ ID NO: 465325 - DNA, 20 bp, Artificial Sequence
  chemically synthesized
ttgaactattagggtaccaa

SEQ ID NO: 465326 - DNA, 20 bp, Artificial Sequence
  chemically synthesized
attgaactattagggtacca

SEQ ID NO: 465327 - DNA, 20 bp, Artificial Sequence
  chemically synthesized
ataatcctttggtaccctaa

SEQ ID NO: 465328 - DNA, 20 bp, Artificial Sequence
  chemically synthesized
acaaatacattgaactatta

SEQ ID NO: 465329 - DNA, 20 bp, Artificial Sequence
  chemically synthesized
aacaaatacattgaactatt

SEQ ID NO: 465330 - DNA, 20 bp, Artificial Sequence
  chemically synthesized
gaacaaatacattgaactat

SEQ ID NO: 465331 - DNA, 20 bp, Artificial Sequence
  chemically synthesized
aatgtatttgttctgcttcc

SEQ ID NO: 465332 - DNA, 20 bp, Artificial Sequence
  chemically synthesized
tagcctgtctatctgggaag

SEQ ID NO: 465333 - DNA, 20 bp, Artificial Sequence
  chemically synthesized
tatttgttctgcttcccaga

SEQ ID NO: 465334 - DNA, 20 bp, Artificial Sequence
  chemically synthesized
agatagcctgtctatctggg

SEQ ID NO: 465335 - DNA, 20 bp, Artificial Sequence
  chemically synthesized
tgttctgcttcccagataga

SEQ ID NO: 465336 - DNA, 20 bp, Artificial Sequence
  chemically synthesized
tccagatagcctgtctatct

SEQ ID NO: 465337 - DNA, 20 bp, Artificial Sequence
  chemically synthesized
gttctgcttcccagatagac

SEQ ID NO: 465338 - DNA, 20 bp, Artificial Sequence
  chemically synthesized
atccagatagcctgtctatc

SEQ ID NO: 465339 - DNA, 20 bp, Artificial Sequence
  chemically synthesized
tcccagatagacaggctatc

SEQ ID NO: 465340 - DNA, 20 bp, Artificial Sequence
  chemically synthesized
aaactgaaggacgatccaga

SEQ ID NO: 465341 - DNA, 20 bp, Artificial Sequence
  chemically synthesized
ccaaaaactgaaggacgatc

SEQ ID NO: 465342 - DNA, 20 bp, Artificial Sequence
  chemically synthesized
aggctatctggatcgtcctt

SEQ ID NO: 465343 - DNA, 20 bp, Artificial Sequence
  chemically synthesized
tattaatgtccaaaaactga

SEQ ID NO: 465344 - DNA, 20 bp, Artificial Sequence
  chemically synthesized
ctggatcgtccttcagtttt

SEQ ID NO: 465345 - DNA, 20 bp, Artificial Sequence
  chemically synthesized
atattaatgtccaaaaactg

SEQ ID NO: 465346 - DNA, 20 bp, Artificial Sequence
  chemically synthesized
ttttggacattaatatttca

SEQ ID NO: 465347 - DNA, 20 bp, Artificial Sequence
  chemically synthesized
tttggacattaatatttcac

SEQ ID NO: 465348 - DNA, 20 bp, Artificial Sequence
  chemically synthesized
acattaatatttcacaggcc

SEQ ID NO: 465349 - DNA, 20 bp, Artificial Sequence
  chemically synthesized
ttaatatttcacaggccaag

SEQ ID NO: 465350 - DNA, 20 bp, Artificial Sequence
  chemically synthesized
taatatttcacaggccaagt

SEQ ID NO: 465351 - DNA, 20 bp, Artificial Sequence
  chemically synthesized
tctctgttcttgaacctact

SEQ ID NO: 465352 - DNA, 20 bp, Artificial Sequence
  chemically synthesized
ttcacaggccaagtaggttc

SEQ ID NO: 465353 - DNA, 20 bp, Artificial Sequence
  chemically synthesized
aggccaagtaggttcaagaa

SEQ ID NO: 465354 - DNA, 20 bp, Artificial Sequence
  chemically synthesized
gccaagtaggttcaagaaca

SEQ ID NO: 465355 - DNA, 20 bp, Artificial Sequence
  chemically synthesized
aggttcaagaacagagacat

SEQ ID NO: 465356 - DNA, 20 bp, Artificial Sequence
  chemically synthesized
ggttcaagaacagagacata

SEQ ID NO: 465357 - DNA, 20 bp, Artificial Sequence
  chemically synthesized
cagagacataaggcacatta

SEQ ID NO: 465358 - DNA, 20 bp, Artificial Sequence
  chemically synthesized
agacataaggcacattacag

SEQ ID NO: 465359 - DNA, 20 bp, Artificial Sequence
  chemically synthesized
taaggcacattacagaagat

SEQ ID NO: 465360 - DNA, 20 bp, Artificial Sequence
  chemically synthesized
aaggcacattacagaagatt

SEQ ID NO: 465361 - DNA, 20 bp, Artificial Sequence
  chemically synthesized
cattacagaagattaggttc

SEQ ID NO: 465362 - DNA, 20 bp, Artificial Sequence
  chemically synthesized
acagaagattaggttcaagt

SEQ ID NO: 465363 - DNA, 20 bp, Artificial Sequence
  chemically synthesized
aagattaggttcaagtcaga

SEQ ID NO: 465364 - DNA, 20 bp, Artificial Sequence
  chemically synthesized
gtcagatggaaccaatttta

SEQ ID NO: 465365 - DNA, 20 bp, Artificial Sequence
  chemically synthesized
atagcatagttctataaaat

SEQ ID NO: 465366 - DNA, 20 bp, Artificial Sequence
  chemically synthesized
aattttatagaactatgcta

SEQ ID NO: 465367 - DNA, 20 bp, Artificial Sequence
  chemically synthesized
cctttcacaggactatagca

SEQ ID NO: 465368 - DNA, 20 bp, Artificial Sequence
  chemically synthesized
gagggcctttcacaggacta

SEQ ID NO: 465369 - DNA, 20 bp, Artificial Sequence
  chemically synthesized
actatgctatagtcctgtga

SEQ ID NO: 465370 - DNA, 20 bp, Artificial Sequence
  chemically synthesized
ctatgctatagtcctgtgaa

SEQ ID NO: 465371 - DNA, 20 bp, Artificial Sequence
  chemically synthesized
ccaggaagagggcctttcac

SEQ ID NO: 465372 - DNA, 20 bp, Artificial Sequence
  chemically synthesized
accaggaagagggcctttca

SEQ ID NO: 465373 - DNA, 20 bp, Artificial Sequence
  chemically synthesized
cctgtgaaaggccctcttcc

SEQ ID NO: 465374 - DNA, 20 bp, Artificial Sequence
  chemically synthesized
atcacagtaaaccaggaaga

SEQ ID NO: 465375 - DNA, 20 bp, Artificial Sequence
  chemically synthesized
aatcacagtaaaccaggaag

SEQ ID NO: 465376 - DNA, 20 bp, Artificial Sequence
  chemically synthesized
gaatcacagtaaaccaggaa

SEQ ID NO: 465377 - DNA, 20 bp, Artificial Sequence
  chemically synthesized
atgaatcacagtaaaccagg

SEQ ID NO: 465378 - DNA, 20 bp, Artificial Sequence
  chemically synthesized
ttaatgaatcacagtaaacc

SEQ ID NO: 465379 - DNA, 20 bp, Artificial Sequence
  chemically synthesized
attaatgaatcacagtaaac

SEQ ID NO: 465380 - DNA, 20 bp, Artificial Sequence
  chemically synthesized
atgtatcaattaatgaatca

SEQ ID NO: 465381 - DNA, 20 bp, Artificial Sequence
  chemically synthesized
attcattaattgatacatca

SEQ ID NO: 465382 - DNA, 20 bp, Artificial Sequence
  chemically synthesized
ttcattaattgatacatcac

SEQ ID NO: 465383 - DNA, 20 bp, Artificial Sequence
  chemically synthesized
attaattgatacatcacagg

SEQ ID NO: 465384 - DNA, 20 bp, Artificial Sequence
  chemically synthesized
ttaattgatacatcacaggc

SEQ ID NO: 465385 - DNA, 20 bp, Artificial Sequence
  chemically synthesized
taattgatacatcacaggca

SEQ ID NO: 465386 - DNA, 20 bp, Artificial Sequence
  chemically synthesized
acatcacaggcagggtcatt

SEQ ID NO: 465387 - DNA, 20 bp, Artificial Sequence
  chemically synthesized
cacaggcagggtcatttagc

SEQ ID NO: 465388 - DNA, 20 bp, Artificial Sequence
  chemically synthesized
agtctggtcaataaatcagc

SEQ ID NO: 465389 - DNA, 20 bp, Artificial Sequence
  chemically synthesized
taagagtctggtcaataaat

SEQ ID NO: 465390 - DNA, 20 bp, Artificial Sequence
  chemically synthesized
tagccagctgatttattgac

SEQ ID NO: 465391 - DNA, 20 bp, Artificial Sequence
  chemically synthesized
tgctgtttgacataagagtc

SEQ ID NO: 465392 - DNA, 20 bp, Artificial Sequence
  chemically synthesized
atatttgctgtttgacataa

SEQ ID NO: 465393 - DNA, 20 bp, Artificial Sequence
  chemically synthesized
aaatatttgctgtttgacat

SEQ ID NO: 465394 - DNA, 20 bp, Artificial Sequence
  chemically synthesized
gaccagactcttatgtcaaa

SEQ ID NO: 465395 - DNA, 20 bp, Artificial Sequence
  chemically synthesized
atgcccatatggtgaaaatg

SEQ ID NO: 465396 - DNA, 20 bp, Artificial Sequence
  chemically synthesized
tgatgcccatatggtgaaaa

SEQ ID NO: 465397 - DNA, 20 bp, Artificial Sequence
  chemically synthesized
atttctccattttcaccata

SEQ ID NO: 465398 - DNA, 20 bp, Artificial Sequence
  chemically synthesized
tttctccattttcaccatat

SEQ ID NO: 465399 - DNA, 20 bp, Artificial Sequence
  chemically synthesized
agatttttatgatgcccata

SEQ ID NO: 465400 - DNA, 20 bp, Artificial Sequence
  chemically synthesized
catcataaaaatctttacca

SEQ ID NO: 465401 - DNA, 20 bp, Artificial Sequence
  chemically synthesized
ttatagcatggactttggta

SEQ ID NO: 465402 - DNA, 20 bp, Artificial Sequence
  chemically synthesized
cttgattatagcatggactt

SEQ ID NO: 465403 - DNA, 20 bp, Artificial Sequence
  chemically synthesized
tagttatcttgattatagca

SEQ ID NO: 465404 - DNA, 20 bp, Artificial Sequence
  chemically synthesized
ccaaagtccatgctataatc

SEQ ID NO: 465405 - DNA, 20 bp, Artificial Sequence
  chemically synthesized
atggctagttatcttgatta

SEQ ID NO: 465406 - DNA, 20 bp, Artificial Sequence
  chemically synthesized
catgctataatcaagataac

SEQ ID NO: 465407 - DNA, 20 bp, Artificial Sequence
  chemically synthesized
tgaaaagtatgtaatatggc

SEQ ID NO: 465408 - DNA, 20 bp, Artificial Sequence
  chemically synthesized
tatctgaaaagtatgtaata

SEQ ID NO: 465409 - DNA, 20 bp, Artificial Sequence
  chemically synthesized
tagccatattacatactttt

SEQ ID NO: 465410 - DNA, 20 bp, Artificial Sequence
  chemically synthesized
attctccaatgttatctgaa

SEQ ID NO: 465411 - DNA, 20 bp, Artificial Sequence
  chemically synthesized
acatacttttcagataacat

SEQ ID NO: 465412 - DNA, 20 bp, Artificial Sequence
  chemically synthesized
atacttttcagataacattg

SEQ ID NO: 465413 - DNA, 20 bp, Artificial Sequence
  chemically synthesized
cagataacattggagaatca

SEQ ID NO: 465414 - DNA, 20 bp, Artificial Sequence
  chemically synthesized
gatggtttagaaagagtgca

SEQ ID NO: 465415 - DNA, 20 bp, Artificial Sequence
  chemically synthesized
aaggtgagatggtttagaaa

SEQ ID NO: 465416 - DNA, 20 bp, Artificial Sequence
  chemically synthesized
agaaggtgagatggtttaga

SEQ ID NO: 465417 - DNA, 20 bp, Artificial Sequence
  chemically synthesized
ctgaagaaggtgagatggtt

SEQ ID NO: 465418 - DNA, 20 bp, Artificial Sequence
  chemically synthesized
aattcctgaagaaggtgaga

SEQ ID NO: 465419 - DNA, 20 bp, Artificial Sequence
  chemically synthesized
tgacaattcctgaagaaggt

SEQ ID NO: 465420 - DNA, 20 bp, Artificial Sequence
  chemically synthesized
ctaaaccatctcaccttctt

SEQ ID NO: 465421 - DNA, 20 bp, Artificial Sequence
  chemically synthesized
taaaccatctcaccttcttc

SEQ ID NO: 465422 - DNA, 20 bp, Artificial Sequence
  chemically synthesized
taactgacaattcctgaaga

SEQ ID NO: 465423 - DNA, 20 bp, Artificial Sequence
  chemically synthesized
gtaactgacaattcctgaag

SEQ ID NO: 465424 - DNA, 20 bp, Artificial Sequence
  chemically synthesized
ggagtaactgacaattcctg

SEQ ID NO: 465425 - DNA, 20 bp, Artificial Sequence
  chemically synthesized
tcaccttcttcaggaattgt

SEQ ID NO: 465426 - DNA, 20 bp, Artificial Sequence
  chemically synthesized
caggaattgtcagttactcc

SEQ ID NO: 465427 - DNA, 20 bp, Artificial Sequence
  chemically synthesized
attgtcagttactcccagtg

SEQ ID NO: 465428 - DNA, 20 bp, Artificial Sequence
  chemically synthesized
caatattttttcttcactgg

SEQ ID NO: 465429 - DNA, 20 bp, Artificial Sequence
  chemically synthesized
tgcaatattttttcttcact

SEQ ID NO: 465430 - DNA, 20 bp, Artificial Sequence
  chemically synthesized
atgcaatattttttcttcac

SEQ ID NO: 465431 - DNA, 20 bp, Artificial Sequence
  chemically synthesized
aaaaatattgcatatttttc

SEQ ID NO: 465432 - DNA, 20 bp, Artificial Sequence
  chemically synthesized
taaaactggaaatatttttc

SEQ ID NO: 465433 - DNA, 20 bp, Artificial Sequence
  chemically synthesized
tttttctggaaaaatatttc

SEQ ID NO: 465434 - DNA, 20 bp, Artificial Sequence
  chemically synthesized
ggaaaaatatttccagtttt

SEQ ID NO: 465435 - DNA, 20 bp, Artificial Sequence
  chemically synthesized
agtaaataattacttaaaac

SEQ ID NO: 465436 - DNA, 20 bp, Artificial Sequence
  chemically synthesized
gtccataattagattgtgga

SEQ ID NO: 465437 - DNA, 20 bp, Artificial Sequence
  chemically synthesized
aagtccataattagattgtg

SEQ ID NO: 465438 - DNA, 20 bp, Artificial Sequence
  chemically synthesized
gaaagtccataattagattg

SEQ ID NO: 465439 - DNA, 20 bp, Artificial Sequence
  chemically synthesized
tactctccacaatctaatta

SEQ ID NO: 465440 - DNA, 20 bp, Artificial Sequence
  chemically synthesized
taggaaggaaagtccataat

SEQ ID NO: 465441 - DNA, 20 bp, Artificial Sequence
  chemically synthesized
aaagtgaaaaataggaagga

SEQ ID NO: 465442 - DNA, 20 bp, Artificial Sequence
  chemically synthesized
aactaaagtgaaaaatagga

SEQ ID NO: 465443 - DNA, 20 bp, Artificial Sequence
  chemically synthesized
aaactaaagtgaaaaatagg

SEQ ID NO: 465444 - DNA, 20 bp, Artificial Sequence
  chemically synthesized
aataaactaaagtgaaaaat

SEQ ID NO: 465445 - DNA, 20 bp, Artificial Sequence
  chemically synthesized
taataaactaaagtgaaaaa

SEQ ID NO: 465446 - DNA, 20 bp, Artificial Sequence
  chemically synthesized
ttccttcctatttttcactt

SEQ ID NO: 465447 - DNA, 20 bp, Artificial Sequence
  chemically synthesized
gtcctggagttaataaacta

SEQ ID NO: 465448 - DNA, 20 bp, Artificial Sequence
  chemically synthesized
tcactttagtttattaactc

SEQ ID NO: 465449 - DNA, 20 bp, Artificial Sequence
  chemically synthesized
cactttagtttattaactcc

SEQ ID NO: 465450 - DNA, 20 bp, Artificial Sequence
  chemically synthesized
caatattttagttggtcctg

SEQ ID NO: 465451 - DNA, 20 bp, Artificial Sequence
  chemically synthesized
gacaatattttagttggtcc

SEQ ID NO: 465452 - DNA, 20 bp, Artificial Sequence
  chemically synthesized
agccacgacaatattttagt

SEQ ID NO: 465453 - DNA, 20 bp, Artificial Sequence
  chemically synthesized
agaaagccacgacaatattt

SEQ ID NO: 465454 - DNA, 20 bp, Artificial Sequence
  chemically synthesized
gaccaactaaaatattgtcg

SEQ ID NO: 465455 - DNA, 20 bp, Artificial Sequence
  chemically synthesized
cagaactgtttaaaaagaga

SEQ ID NO: 465456 - DNA, 20 bp, Artificial Sequence
  chemically synthesized
aagtcagaactgtttaaaaa

SEQ ID NO: 465457 - DNA, 20 bp, Artificial Sequence
  chemically synthesized
cgtggctttctctttttaaa

SEQ ID NO: 465458 - DNA, 20 bp, Artificial Sequence
  chemically synthesized
aaaagtcagaactgtttaaa

SEQ ID NO: 465459 - DNA, 20 bp, Artificial Sequence
  chemically synthesized
ctttggaaaaaaaaaaaagt

SEQ ID NO: 465460 - DNA, 20 bp, Artificial Sequence
  chemically synthesized
cacgctttggaaaaaaaaaa

SEQ ID NO: 465461 - DNA, 20 bp, Artificial Sequence
  chemically synthesized
ctgacttttttttttttcca

SEQ ID NO: 465462 - DNA, 20 bp, Artificial Sequence
  chemically synthesized
acacacacacacacacgctt

SEQ ID NO: 465463 - DNA, 20 bp, Artificial Sequence
  chemically synthesized
gtgtgtgtatgcacatgctt

SEQ ID NO: 465464 - DNA, 20 bp, Artificial Sequence
  chemically synthesized
tgtgtatgcacatgcttaag

SEQ ID NO: 465465 - DNA, 20 bp, Artificial Sequence
  chemically synthesized
caaataaaaacaaaccactt

SEQ ID NO: 465466 - DNA, 20 bp, Artificial Sequence
  chemically synthesized
tccatcttttaagaaggaaa

SEQ ID NO: 465467 - DNA, 20 bp, Artificial Sequence
  chemically synthesized
atttgctttttccttcttaa

SEQ ID NO: 465468 - DNA, 20 bp, Artificial Sequence
  chemically synthesized
atataatccatcttttaaga

SEQ ID NO: 465469 - DNA, 20 bp, Artificial Sequence
  chemically synthesized
catataatccatcttttaag

SEQ ID NO: 465470 - DNA, 20 bp, Artificial Sequence
  chemically synthesized
gctttttccttcttaaaaga

SEQ ID NO: 465471 - DNA, 20 bp, Artificial Sequence
  chemically synthesized
tctcatataatccatctttt

SEQ ID NO: 465472 - DNA, 20 bp, Artificial Sequence
  chemically synthesized
tcttaaaagatggattatat

SEQ ID NO: 465473 - DNA, 20 bp, Artificial Sequence
  chemically synthesized
aaagatggattatatgagaa

SEQ ID NO: 465474 - DNA, 20 bp, Artificial Sequence
  chemically synthesized
aagatggattatatgagaat

SEQ ID NO: 465475 - DNA, 20 bp, Artificial Sequence
  chemically synthesized
gatggattatatgagaatgg

SEQ ID NO: 465476 - DNA, 20 bp, Artificial Sequence
  chemically synthesized
atggattatatgagaatggg

SEQ ID NO: 465477 - DNA, 20 bp, Artificial Sequence
  chemically synthesized
atatgagaatgggaggataa

SEQ ID NO: 465478 - DNA, 20 bp, Artificial Sequence
  chemically synthesized
tatgagaatgggaggataat

SEQ ID NO: 465479 - DNA, 20 bp, Artificial Sequence
  chemically synthesized
agaatgggaggataatagga

SEQ ID NO: 465480 - DNA, 20 bp, Artificial Sequence
  chemically synthesized
aatgggaggataataggatg

SEQ ID NO: 465481 - DNA, 20 bp, Artificial Sequence
  chemically synthesized
ggaggataataggatggagc

SEQ ID NO: 465482 - DNA, 20 bp, Artificial Sequence
  chemically synthesized
ataggatggagcaagcttct

SEQ ID NO: 465483 - DNA, 20 bp, Artificial Sequence
  chemically synthesized
taggatggagcaagcttctc

SEQ ID NO: 465484 - DNA, 20 bp, Artificial Sequence
  chemically synthesized
tttgaaatgttttgcctgag

SEQ ID NO: 465485 - DNA, 20 bp, Artificial Sequence
  chemically synthesized
tgctttgaaatgttttgcct

SEQ ID NO: 465486 - DNA, 20 bp, Artificial Sequence
  chemically synthesized
ttctcaggcaaaacatttca

SEQ ID NO: 465487 - DNA, 20 bp, Artificial Sequence
  chemically synthesized
aaagcatatttcttaaccga

SEQ ID NO: 465488 - DNA, 20 bp, Artificial Sequence
  chemically synthesized
aggggaagacactatcggtt

SEQ ID NO: 465489 - DNA, 20 bp, Artificial Sequence
  chemically synthesized
tgagcaggggaagacactat

SEQ ID NO: 465490 - DNA, 20 bp, Artificial Sequence
  chemically synthesized
ttcagaaagatgagcagggg

SEQ ID NO: 465491 - DNA, 20 bp, Artificial Sequence
  chemically synthesized
ctcttcagaaagatgagcag

SEQ ID NO: 465492 - DNA, 20 bp, Artificial Sequence
  chemically synthesized
gctcttcagaaagatgagca

SEQ ID NO: 465493 - DNA, 20 bp, Artificial Sequence
  chemically synthesized
tgctcttcagaaagatgagc

SEQ ID NO: 465494 - DNA, 20 bp, Artificial Sequence
  chemically synthesized
ttgctcttcagaaagatgag

SEQ ID NO: 465495 - DNA, 20 bp, Artificial Sequence
  chemically synthesized
gtgttgctcttcagaaagat

SEQ ID NO: 465496 - DNA, 20 bp, Artificial Sequence
  chemically synthesized
ttcccctgctcatctttctg

SEQ ID NO: 465497 - DNA, 20 bp, Artificial Sequence
  chemically synthesized
cccctgctcatctttctgaa

SEQ ID NO: 465498 - DNA, 20 bp, Artificial Sequence
  chemically synthesized
ctcaggtgttgctcttcaga

SEQ ID NO: 465499 - DNA, 20 bp, Artificial Sequence
  chemically synthesized
gcctctcaggtgttgctctt

SEQ ID NO: 465500 - DNA, 20 bp, Artificial Sequence
  chemically synthesized
ctttctgaagagcaacacct

SEQ ID NO: 465501 - DNA, 20 bp, Artificial Sequence
  chemically synthesized
ttctgaagagcaacacctga

SEQ ID NO: 465502 - DNA, 20 bp, Artificial Sequence
  chemically synthesized
tctgaagagcaacacctgag

SEQ ID NO: 465503 - DNA, 20 bp, Artificial Sequence
  chemically synthesized
gaagagcaacacctgagagg

SEQ ID NO: 465504 - DNA, 20 bp, Artificial Sequence
  chemically synthesized
agctagagtagctgcctctc

SEQ ID NO: 465505 - DNA, 20 bp, Artificial Sequence
  chemically synthesized
gagctagagtagctgcctct

SEQ ID NO: 465506 - DNA, 20 bp, Artificial Sequence
  chemically synthesized
cacctgagaggcagctactc

SEQ ID NO: 465507 - DNA, 20 bp, Artificial Sequence
  chemically synthesized
atttcccacatgagctagag

SEQ ID NO: 465508 - DNA, 20 bp, Artificial Sequence
  chemically synthesized
gaaatttcccacatgagcta

SEQ ID NO: 465509 - DNA, 20 bp, Artificial Sequence
  chemically synthesized
ggcagctactctagctcatg

SEQ ID NO: 465510 - DNA, 20 bp, Artificial Sequence
  chemically synthesized
gtgaaatttcccacatgagc

SEQ ID NO: 465511 - DNA, 20 bp, Artificial Sequence
  chemically synthesized
gcagctactctagctcatgt

SEQ ID NO: 465512 - DNA, 20 bp, Artificial Sequence
  chemically synthesized
tcaagtgaaatttcccacat

SEQ ID NO: 465513 - DNA, 20 bp, Artificial Sequence
  chemically synthesized
atgtgggaaatttcacttga

SEQ ID NO: 465514 - DNA, 20 bp, Artificial Sequence
  chemically synthesized
ctttttgtgataagactgtc

SEQ ID NO: 465515 - DNA, 20 bp, Artificial Sequence
  chemically synthesized
cttatttctctttttgtgat

SEQ ID NO: 465516 - DNA, 20 bp, Artificial Sequence
  chemically synthesized
cttgacagtcttatcacaaa

SEQ ID NO: 465517 - DNA, 20 bp, Artificial Sequence
  chemically synthesized
tgacagtcttatcacaaaaa

SEQ ID NO: 465518 - DNA, 20 bp, Artificial Sequence
  chemically synthesized
cttatcacaaaaagagaaat

SEQ ID NO: 465519 - DNA, 20 bp, Artificial Sequence
  chemically synthesized
ttatcacaaaaagagaaata

SEQ ID NO: 465520 - DNA, 20 bp, Artificial Sequence
  chemically synthesized
tatcacaaaaagagaaataa

SEQ ID NO: 465521 - DNA, 20 bp, Artificial Sequence
  chemically synthesized
tcacaaaaagagaaataagg

SEQ ID NO: 465522 - DNA, 20 bp, Artificial Sequence
  chemically synthesized
attgagcatcattatttttt

SEQ ID NO: 465523 - DNA, 20 bp, Artificial Sequence
  chemically synthesized
ttttaggtaaaaattttatt

SEQ ID NO: 465524 - DNA, 20 bp, Artificial Sequence
  chemically synthesized
tcaataaaatttttacctaa

SEQ ID NO: 465525 - DNA, 20 bp, Artificial Sequence
  chemically synthesized
aataaaatttttacctaaaa

SEQ ID NO: 465526 - DNA, 20 bp, Artificial Sequence
  chemically synthesized
aacaattatttatctctttt

SEQ ID NO: 465527 - DNA, 20 bp, Artificial Sequence
  chemically synthesized
aaacaattatttatctcttt

SEQ ID NO: 465528 - DNA, 20 bp, Artificial Sequence
  chemically synthesized
aaagagataaataattgttt

SEQ ID NO: 465529 - DNA, 20 bp, Artificial Sequence
  chemically synthesized
gttttagaatataaatgcct

SEQ ID NO: 465530 - DNA, 20 bp, Artificial Sequence
  chemically synthesized
tttagaatataaatgcctta

SEQ ID NO: 465531 - DNA, 20 bp, Artificial Sequence
  chemically synthesized
aactcagattgttttctcta

SEQ ID NO: 465532 - DNA, 20 bp, Artificial Sequence
  chemically synthesized
aaactcagattgttttctct

SEQ ID NO: 465533 - DNA, 20 bp, Artificial Sequence
  chemically synthesized
tgccttagagaaaacaatct

SEQ ID NO: 465534 - DNA, 20 bp, Artificial Sequence
  chemically synthesized
agagaaaacaatctgagttt

SEQ ID NO: 465535 - DNA, 20 bp, Artificial Sequence
  chemically synthesized
agaaaacaatctgagtttga

SEQ ID NO: 465536 - DNA, 20 bp, Artificial Sequence
  chemically synthesized
ttccccaattctctcaaact

SEQ ID NO: 465537 - DNA, 20 bp, Artificial Sequence
  chemically synthesized
caatctgagtttgagagaat

SEQ ID NO: 465538 - DNA, 20 bp, Artificial Sequence
  chemically synthesized
aatctgagtttgagagaatt

SEQ ID NO: 465539 - DNA, 20 bp, Artificial Sequence
  chemically synthesized
atctgagtttgagagaattg

SEQ ID NO: 465540 - DNA, 20 bp, Artificial Sequence
  chemically synthesized
agaattggggaaaactcaca

SEQ ID NO: 465541 - DNA, 20 bp, Artificial Sequence
  chemically synthesized
tgacttttataaatctatgt

SEQ ID NO: 465542 - DNA, 20 bp, Artificial Sequence
  chemically synthesized
aaactcacatagatttataa

SEQ ID NO: 465543 - DNA, 20 bp, Artificial Sequence
  chemically synthesized
tttataaaagtcactaattc

SEQ ID NO: 465544 - DNA, 20 bp, Artificial Sequence
  chemically synthesized
tatatttttaaatccagaat

SEQ ID NO: 465545 - DNA, 20 bp, Artificial Sequence
  chemically synthesized
ttttaatatatttttaaatc

SEQ ID NO: 465546 - DNA, 20 bp, Artificial Sequence
  chemically synthesized
aaaatatattaaaatgtttg

SEQ ID NO: 465547 - DNA, 20 bp, Artificial Sequence
  chemically synthesized
agaagtgggacacaatgaaa

SEQ ID NO: 465548 - DNA, 20 bp, Artificial Sequence
  chemically synthesized
agaaggtgtgaaagagaagt

SEQ ID NO: 465549 - DNA, 20 bp, Artificial Sequence
  chemically synthesized
tagaaggtgtgaaagagaag

SEQ ID NO: 465550 - DNA, 20 bp, Artificial Sequence
  chemically synthesized
aaatagaaggtgtgaaagag

SEQ ID NO: 465551 - DNA, 20 bp, Artificial Sequence
  chemically synthesized
taaaaatagaaggtgtgaaa

SEQ ID NO: 465552 - DNA, 20 bp, Artificial Sequence
  chemically synthesized
cataaaaatagaaggtgtga

SEQ ID NO: 465553 - DNA, 20 bp, Artificial Sequence
  chemically synthesized
gagaaatgcataaaaataga

SEQ ID NO: 465554 - DNA, 20 bp, Artificial Sequence
  chemically synthesized
ggagaaatgcataaaaatag

SEQ ID NO: 465555 - DNA, 20 bp, Artificial Sequence
  chemically synthesized
gaaggagaaatgcataaaaa

SEQ ID NO: 465556 - DNA, 20 bp, Artificial Sequence
  chemically synthesized
aggaagaaaaaacgatgaag

SEQ ID NO: 465557 - DNA, 20 bp, Artificial Sequence
  chemically synthesized
taaggaagaaaaaacgatga

SEQ ID NO: 465558 - DNA, 20 bp, Artificial Sequence
  chemically synthesized
ttaaggaagaaaaaacgatg

SEQ ID NO: 465559 - DNA, 20 bp, Artificial Sequence
  chemically synthesized
tcatcgttttttcttcctta

SEQ ID NO: 465560 - DNA, 20 bp, Artificial Sequence
  chemically synthesized
tcttctgaagtgctttaagg

SEQ ID NO: 465561 - DNA, 20 bp, Artificial Sequence
  chemically synthesized
gtgtcttctgaagtgcttta

SEQ ID NO: 465562 - DNA, 20 bp, Artificial Sequence
  chemically synthesized
tgtgtcttctgaagtgcttt

SEQ ID NO: 465563 - DNA, 20 bp, Artificial Sequence
  chemically synthesized
ttttcttccttaaagcactt

SEQ ID NO: 465564 - DNA, 20 bp, Artificial Sequence
  chemically synthesized
tcttccttaaagcacttcag

SEQ ID NO: 465565 - DNA, 20 bp, Artificial Sequence
  chemically synthesized
gcttaatcctgtgtcttctg

SEQ ID NO: 465566 - DNA, 20 bp, Artificial Sequence
  chemically synthesized
ttaaagcacttcagaagaca

SEQ ID NO: 465567 - DNA, 20 bp, Artificial Sequence
  chemically synthesized
taaagcacttcagaagacac

SEQ ID NO: 465568 - DNA, 20 bp, Artificial Sequence
  chemically synthesized
acttcagaagacacaggatt

SEQ ID NO: 465569 - DNA, 20 bp, Artificial Sequence
  chemically synthesized
aagacacaggattaagcaat

SEQ ID NO: 465570 - DNA, 20 bp, Artificial Sequence
  chemically synthesized
agacacaggattaagcaatt

SEQ ID NO: 465571 - DNA, 20 bp, Artificial Sequence
  chemically synthesized
gattaagcaattgggatttg

SEQ ID NO: 465572 - DNA, 20 bp, Artificial Sequence
  chemically synthesized
tgggatttgaagacttcacg

SEQ ID NO: 465573 - DNA, 20 bp, Artificial Sequence
  chemically synthesized
cagagtgatgagaccacgtg

SEQ ID NO: 465574 - DNA, 20 bp, Artificial Sequence
  chemically synthesized
gggtcagcctgcagagtgat

SEQ ID NO: 465575 - DNA, 20 bp, Artificial Sequence
  chemically synthesized
cacgtggtctcatcactctg

SEQ ID NO: 465576 - DNA, 20 bp, Artificial Sequence
  chemically synthesized
acgtggtctcatcactctgc

SEQ ID NO: 465577 - DNA, 20 bp, Artificial Sequence
  chemically synthesized
taaaacagggtcagcctgca

SEQ ID NO: 465578 - DNA, 20 bp, Artificial Sequence
  chemically synthesized
tctaaaacagggtcagcctg

SEQ ID NO: 465579 - DNA, 20 bp, Artificial Sequence
  chemically synthesized
ttcttgctctaaaacagggt

SEQ ID NO: 465580 - DNA, 20 bp, Artificial Sequence
  chemically synthesized
tctgcaggctgaccctgttt

SEQ ID NO: 465581 - DNA, 20 bp, Artificial Sequence
  chemically synthesized
tgcaggctgaccctgtttta

SEQ ID NO: 465582 - DNA, 20 bp, Artificial Sequence
  chemically synthesized
atatttcttgctctaaaaca

SEQ ID NO: 465583 - DNA, 20 bp, Artificial Sequence
  chemically synthesized
aatatttcttgctctaaaac

SEQ ID NO: 465584 - DNA, 20 bp, Artificial Sequence
  chemically synthesized
caatatttcttgctctaaaa

SEQ ID NO: 465585 - DNA, 20 bp, Artificial Sequence
  chemically synthesized
ggctgaccctgttttagagc

SEQ ID NO: 465586 - DNA, 20 bp, Artificial Sequence
  chemically synthesized
tgttttagagcaagaaatat

SEQ ID NO: 465587 - DNA, 20 bp, Artificial Sequence
  chemically synthesized
tttagagcaagaaatattgg

SEQ ID NO: 465588 - DNA, 20 bp, Artificial Sequence
  chemically synthesized
gaaatattggcagacatttc

SEQ ID NO: 465589 - DNA, 20 bp, Artificial Sequence
  chemically synthesized
gataaatgcattgtaagagc

SEQ ID NO: 465590 - DNA, 20 bp, Artificial Sequence
  chemically synthesized
tattgataaatgcattgtaa

SEQ ID NO: 465591 - DNA, 20 bp, Artificial Sequence
  chemically synthesized
cttattgataaatgcattgt

SEQ ID NO: 465592 - DNA, 20 bp, Artificial Sequence
  chemically synthesized
cttacaatgcatttatcaat

SEQ ID NO: 465593 - DNA, 20 bp, Artificial Sequence
  chemically synthesized
ttacaatgcatttatcaata

SEQ ID NO: 465594 - DNA, 20 bp, Artificial Sequence
  chemically synthesized
tacaatgcatttatcaataa

SEQ ID NO: 465595 - DNA, 20 bp, Artificial Sequence
  chemically synthesized
ataagggtttgcctgctctt

SEQ ID NO: 465596 - DNA, 20 bp, Artificial Sequence
  chemically synthesized
taagggtttgcctgctcttc

SEQ ID NO: 465597 - DNA, 20 bp, Artificial Sequence
  chemically synthesized
atgccacgcacctgaagagc

SEQ ID NO: 465598 - DNA, 20 bp, Artificial Sequence
  chemically synthesized
tatgccacgcacctgaagag

SEQ ID NO: 465599 - DNA, 20 bp, Artificial Sequence
  chemically synthesized
ctatatgccacgcacctgaa

SEQ ID NO: 465600 - DNA, 20 bp, Artificial Sequence
  chemically synthesized
gtctatatgccacgcacctg

SEQ ID NO: 465601 - DNA, 20 bp, Artificial Sequence
  chemically synthesized
ttgcctgctcttcaggtgcg

SEQ ID NO: 465602 - DNA, 20 bp, Artificial Sequence
  chemically synthesized
ctcttcaggtgcgtggcata

SEQ ID NO: 465603 - DNA, 20 bp, Artificial Sequence
  chemically synthesized
tgattattaatgaaatcgta

SEQ ID NO: 465604 - DNA, 20 bp, Artificial Sequence
  chemically synthesized
acgatttcattaataatcaa

SEQ ID NO: 465605 - DNA, 20 bp, Artificial Sequence
  chemically synthesized
tttcattaataatcaacagc

SEQ ID NO: 465606 - DNA, 20 bp, Artificial Sequence
  chemically synthesized
ggacagacgctaggtggcac

SEQ ID NO: 465607 - DNA, 20 bp, Artificial Sequence
  chemically synthesized
aatcaacagctggtgccacc

SEQ ID NO: 465608 - DNA, 20 bp, Artificial Sequence
  chemically synthesized
tggattggacagacgctagg

SEQ ID NO: 465609 - DNA, 20 bp, Artificial Sequence
  chemically synthesized
gaatggattggacagacgct

SEQ ID NO: 465610 - DNA, 20 bp, Artificial Sequence
  chemically synthesized
tgaatggattggacagacgc

SEQ ID NO: 465611 - DNA, 20 bp, Artificial Sequence
  chemically synthesized
ccactgatgaatggattgga

SEQ ID NO: 465612 - DNA, 20 bp, Artificial Sequence
  chemically synthesized
ggtcccactgatgaatggat

SEQ ID NO: 465613 - DNA, 20 bp, Artificial Sequence
  chemically synthesized
cgtctgtccaatccattcat

SEQ ID NO: 465614 - DNA, 20 bp, Artificial Sequence
  chemically synthesized
tatttggtcccactgatgaa

SEQ ID NO: 465615 - DNA, 20 bp, Artificial Sequence
  chemically synthesized
ctgtccaatccattcatcag

SEQ ID NO: 465616 - DNA, 20 bp, Artificial Sequence
  chemically synthesized
tgtccaatccattcatcagt

SEQ ID NO: 465617 - DNA, 20 bp, Artificial Sequence
  chemically synthesized
ttcatcagtgggaccaaata

SEQ ID NO: 465618 - DNA, 20 bp, Artificial Sequence
  chemically synthesized
catcagtgggaccaaataca

SEQ ID NO: 465619 - DNA, 20 bp, Artificial Sequence
  chemically synthesized
gttagaaagtgctctgtatt

SEQ ID NO: 465620 - DNA, 20 bp, Artificial Sequence
  chemically synthesized
ttgcttcatttgcggttaga

SEQ ID NO: 465621 - DNA, 20 bp, Artificial Sequence
  chemically synthesized
aggcttgcttcatttgcggt

SEQ ID NO: 465622 - DNA, 20 bp, Artificial Sequence
  chemically synthesized
gcactttctaaccgcaaatg

SEQ ID NO: 465623 - DNA, 20 bp, Artificial Sequence
  chemically synthesized
gtttaggcttgcttcatttg

SEQ ID NO: 465624 - DNA, 20 bp, Artificial Sequence
  chemically synthesized
tttctaaccgcaaatgaagc

SEQ ID NO: 465625 - DNA, 20 bp, Artificial Sequence
  chemically synthesized
tattttttagtttatagttt

SEQ ID NO: 465626 - DNA, 20 bp, Artificial Sequence
  chemically synthesized
gtattttttagtttatagtt

SEQ ID NO: 465627 - DNA, 20 bp, Artificial Sequence
  chemically synthesized
tttttgtattttttagttta

SEQ ID NO: 465628 - DNA, 20 bp, Artificial Sequence
  chemically synthesized
aactgtgtttttgtattttt

SEQ ID NO: 465629 - DNA, 20 bp, Artificial Sequence
  chemically synthesized
aactaaaaaatacaaaaaca

SEQ ID NO: 465630 - DNA, 20 bp, Artificial Sequence
  chemically synthesized
aaaaatacaaaaacacagtt

SEQ ID NO: 465631 - DNA, 20 bp, Artificial Sequence
  chemically synthesized
aaaatacaaaaacacagttt

SEQ ID NO: 465632 - DNA, 20 bp, Artificial Sequence
  chemically synthesized
aaatacaaaaacacagtttg

SEQ ID NO: 465633 - DNA, 20 bp, Artificial Sequence
  chemically synthesized
aaaacacagtttggggattc

SEQ ID NO: 465634 - DNA, 20 bp, Artificial Sequence
  chemically synthesized
acacagtttggggattccag

SEQ ID NO: 465635 - DNA, 20 bp, Artificial Sequence
  chemically synthesized
gcgtactttaaatcagccac

SEQ ID NO: 465636 - DNA, 20 bp, Artificial Sequence
  chemically synthesized
ggattccagtggctgattta

SEQ ID NO: 465637 - DNA, 20 bp, Artificial Sequence
  chemically synthesized
gaagatagcgtactttaaat

SEQ ID NO: 465638 - DNA, 20 bp, Artificial Sequence
  chemically synthesized
tttttctttttcaatgaaga

SEQ ID NO: 465639 - DNA, 20 bp, Artificial Sequence
  chemically synthesized
aaggtttttctttttcaatg

SEQ ID NO: 465640 - DNA, 20 bp, Artificial Sequence
  chemically synthesized
gtacgctatcttcattgaaa

SEQ ID NO: 465641 - DNA, 20 bp, Artificial Sequence
  chemically synthesized
ccatagttacttttaaaaga

SEQ ID NO: 465642 - DNA, 20 bp, Artificial Sequence
  chemically synthesized
aaagaaaaaccttcttttaa

SEQ ID NO: 465643 - DNA, 20 bp, Artificial Sequence
  chemically synthesized
accatagttacttttaaaag

SEQ ID NO: 465644 - DNA, 20 bp, Artificial Sequence
  chemically synthesized
gttaccatagttacttttaa

SEQ ID NO: 465645 - DNA, 20 bp, Artificial Sequence
  chemically synthesized
ccttcttttaaaagtaacta

SEQ ID NO: 465646 - DNA, 20 bp, Artificial Sequence
  chemically synthesized
ttaaaagtaactatggtaac

SEQ ID NO: 465647 - DNA, 20 bp, Artificial Sequence
  chemically synthesized
gcctcactctcttgttacca

SEQ ID NO: 465648 - DNA, 20 bp, Artificial Sequence
  chemically synthesized
aaaagtaactatggtaacaa

SEQ ID NO: 465649 - DNA, 20 bp, Artificial Sequence
  chemically synthesized
aagtaactatggtaacaaga

SEQ ID NO: 465650 - DNA, 20 bp, Artificial Sequence
  chemically synthesized
aactatggtaacaagagagt

SEQ ID NO: 465651 - DNA, 20 bp, Artificial Sequence
  chemically synthesized
actatggtaacaagagagtg

SEQ ID NO: 465652 - DNA, 20 bp, Artificial Sequence
  chemically synthesized
tggtaacaagagagtgaggc

SEQ ID NO: 465653 - DNA, 20 bp, Artificial Sequence
  chemically synthesized
taacaagagagtgaggctag

SEQ ID NO: 465654 - DNA, 20 bp, Artificial Sequence
  chemically synthesized
aacaagagagtgaggctaga

SEQ ID NO: 465655 - DNA, 20 bp, Artificial Sequence
  chemically synthesized
aagagagtgaggctagaagg

SEQ ID NO: 465656 - DNA, 20 bp, Artificial Sequence
  chemically synthesized
aaaaaatgtgagcttccttc

SEQ ID NO: 465657 - DNA, 20 bp, Artificial Sequence
  chemically synthesized
tgtctccttcgaaaaaatgt

SEQ ID NO: 465658 - DNA, 20 bp, Artificial Sequence
  chemically synthesized
aggaagctcacattttttcg

SEQ ID NO: 465659 - DNA, 20 bp, Artificial Sequence
  chemically synthesized
ggaagctcacattttttcga

SEQ ID NO: 465660 - DNA, 20 bp, Artificial Sequence
  chemically synthesized
aagctcacattttttcgaag

SEQ ID NO: 465661 - DNA, 20 bp, Artificial Sequence
  chemically synthesized
tcgaaggagacaattcacaa

SEQ ID NO: 465662 - DNA, 20 bp, Artificial Sequence
  chemically synthesized
cgaaggagacaattcacaaa

SEQ ID NO: 465663 - DNA, 20 bp, Artificial Sequence
  chemically synthesized
aaggagacaattcacaaaag

SEQ ID NO: 465664 - DNA, 20 bp, Artificial Sequence
  chemically synthesized
ggagacaattcacaaaagga

SEQ ID NO: 465665 - DNA, 20 bp, Artificial Sequence
  chemically synthesized
acaaaaggagagtcctacta

SEQ ID NO: 465666 - DNA, 20 bp, Artificial Sequence
  chemically synthesized
ttttacactgcatctttagt

SEQ ID NO: 465667 - DNA, 20 bp, Artificial Sequence
  chemically synthesized
cttttacactgcatctttag

SEQ ID NO: 465668 - DNA, 20 bp, Artificial Sequence
  chemically synthesized
ggagagtcctactaaagatg

SEQ ID NO: 465669 - DNA, 20 bp, Artificial Sequence
  chemically synthesized
actcttttacactgcatctt

SEQ ID NO: 465670 - DNA, 20 bp, Artificial Sequence
  chemically synthesized
ctactaaagatgcagtgtaa

SEQ ID NO: 465671 - DNA, 20 bp, Artificial Sequence
  chemically synthesized
actaaagatgcagtgtaaaa

SEQ ID NO: 465672 - DNA, 20 bp, Artificial Sequence
  chemically synthesized
gcagtgtaaaagagttttta

SEQ ID NO: 465673 - DNA, 20 bp, Artificial Sequence
  chemically synthesized
agagtttttacagtcttgaa

SEQ ID NO: 465674 - DNA, 20 bp, Artificial Sequence
  chemically synthesized
accgttttaagtgaccattc

SEQ ID NO: 465675 - DNA, 20 bp, Artificial Sequence
  chemically synthesized
tcttgaatggtcacttaaaa

SEQ ID NO: 465676 - DNA, 20 bp, Artificial Sequence
  chemically synthesized
caactttttataaccgtttt

SEQ ID NO: 465677 - DNA, 20 bp, Artificial Sequence
  chemically synthesized
tcacttaaaacggttataaa

SEQ ID NO: 465678 - DNA, 20 bp, Artificial Sequence
  chemically synthesized
aacggttataaaaagttgaa

SEQ ID NO: 465679 - DNA, 20 bp, Artificial Sequence
  chemically synthesized
aaaaagttgaaaagtaacat

SEQ ID NO: 465680 - DNA, 20 bp, Artificial Sequence
  chemically synthesized
ttgaaaagtaacattggcca

SEQ ID NO: 465681 - DNA, 20 bp, Artificial Sequence
  chemically synthesized
gaaaagtaacattggccaaa

SEQ ID NO: 465682 - DNA, 20 bp, Artificial Sequence
  chemically synthesized
aaaagtaacattggccaaag

SEQ ID NO: 465683 - DNA, 20 bp, Artificial Sequence
  chemically synthesized
aaagtaacattggccaaaga

SEQ ID NO: 465684 - DNA, 20 bp, Artificial Sequence
  chemically synthesized
gtttaaaatacagccctctt

SEQ ID NO: 465685 - DNA, 20 bp, Artificial Sequence
  chemically synthesized
ctatactgttgtttaaaata

SEQ ID NO: 465686 - DNA, 20 bp, Artificial Sequence
  chemically synthesized
gagggctgtattttaaacaa

SEQ ID NO: 465687 - DNA, 20 bp, Artificial Sequence
  chemically synthesized
ctgtattttaaacaacagta

SEQ ID NO: 465688 - DNA, 20 bp, Artificial Sequence
  chemically synthesized
attttaaacaacagtataga

SEQ ID NO: 465689 - DNA, 20 bp, Artificial Sequence
  chemically synthesized
tttaaacaacagtatagaca

SEQ ID NO: 465690 - DNA, 20 bp, Artificial Sequence
  chemically synthesized
tgtggttggttgagaaaatt

SEQ ID NO: 465691 - DNA, 20 bp, Artificial Sequence
  chemically synthesized
gggttattttgtggttggtt

SEQ ID NO: 465692 - DNA, 20 bp, Artificial Sequence
  chemically synthesized
ctacagggttattttgtggt

SEQ ID NO: 465693 - DNA, 20 bp, Artificial Sequence
  chemically synthesized
aatgctacagggttattttg

SEQ ID NO: 465694 - DNA, 20 bp, Artificial Sequence
  chemically synthesized
ccaaccacaaaataaccctg

SEQ ID NO: 465695 - DNA, 20 bp, Artificial Sequence
  chemically synthesized
ttttgcatccaaatgctaca

SEQ ID NO: 465696 - DNA, 20 bp, Artificial Sequence
  chemically synthesized
attttgcatccaaatgctac

SEQ ID NO: 465697 - DNA, 20 bp, Artificial Sequence
  chemically synthesized
caaaataaccctgtagcatt

SEQ ID NO: 465698 - DNA, 20 bp, Artificial Sequence
  chemically synthesized
aattttgcatccaaatgcta

SEQ ID NO: 465699 - DNA, 20 bp, Artificial Sequence
  chemically synthesized
atttggatgcaaaattctgt

SEQ ID NO: 465700 - DNA, 20 bp, Artificial Sequence
  chemically synthesized
ttgggaagctcaaagactga

SEQ ID NO: 465701 - DNA, 20 bp, Artificial Sequence
  chemically synthesized
gcaaaattctgtcagtcttt

SEQ ID NO: 465702 - DNA, 20 bp, Artificial Sequence
  chemically synthesized
gttaatctttgggaagctca

SEQ ID NO: 465703 - DNA, 20 bp, Artificial Sequence
  chemically synthesized
gtcagtctttgagcttccca

SEQ ID NO: 465704 - DNA, 20 bp, Artificial Sequence
  chemically synthesized
gaacttggttaatctttggg

SEQ ID NO: 465705 - DNA, 20 bp, Artificial Sequence
  chemically synthesized
acagaacttggttaatcttt

SEQ ID NO: 465706 - DNA, 20 bp, Artificial Sequence
  chemically synthesized
tacagaacttggttaatctt

SEQ ID NO: 465707 - DNA, 20 bp, Artificial Sequence
  chemically synthesized
gagcttcccaaagattaacc

SEQ ID NO: 465708 - DNA, 20 bp, Artificial Sequence
  chemically synthesized
gtatagtgtgttacagaact

SEQ ID NO: 465709 - DNA, 20 bp, Artificial Sequence
  chemically synthesized
tgcttttgtatagtgtgtta

SEQ ID NO: 465710 - DNA, 20 bp, Artificial Sequence
  chemically synthesized
ttctgtaacacactatacaa

SEQ ID NO: 465711 - DNA, 20 bp, Artificial Sequence
  chemically synthesized
gtactgtagatgcttttgta

SEQ ID NO: 465712 - DNA, 20 bp, Artificial Sequence
  chemically synthesized
acactatacaaaagcatcta

SEQ ID NO: 465713 - DNA, 20 bp, Artificial Sequence
  chemically synthesized
tttaatacttttaagtactg

SEQ ID NO: 465714 - DNA, 20 bp, Artificial Sequence
  chemically synthesized
aaagcatctacagtacttaa

SEQ ID NO: 465715 - DNA, 20 bp, Artificial Sequence
  chemically synthesized
tatttccgtttaatactttt

SEQ ID NO: 465716 - DNA, 20 bp, Artificial Sequence
  chemically synthesized
cagtacttaaaagtattaaa

SEQ ID NO: 465717 - DNA, 20 bp, Artificial Sequence
  chemically synthesized
aagtattaaacggaaataat

SEQ ID NO: 465718 - DNA, 20 bp, Artificial Sequence
  chemically synthesized
gtattaaacggaaataatca

SEQ ID NO: 465719 - DNA, 20 bp, Artificial Sequence
  chemically synthesized
ttttttttataatgtggttc

SEQ ID NO: 465720 - DNA, 20 bp, Artificial Sequence
  chemically synthesized
tttttttttataatgtggtt

SEQ ID NO: 465721 - DNA, 20 bp, Artificial Sequence
  chemically synthesized
aagaatttttttttataatg

SEQ ID NO: 465722 - DNA, 20 bp, Artificial Sequence
  chemically synthesized
gatgtatcattttagcagca

SEQ ID NO: 465723 - DNA, 20 bp, Artificial Sequence
  chemically synthesized
ttctagatgtatcattttag

SEQ ID NO: 465724 - DNA, 20 bp, Artificial Sequence
  chemically synthesized
gttttctagatgtatcattt

SEQ ID NO: 465725 - DNA, 20 bp, Artificial Sequence
  chemically synthesized
tgctgctaaaatgatacatc

SEQ ID NO: 465726 - DNA, 20 bp, Artificial Sequence
  chemically synthesized
caggaaagaaaatagttttc

SEQ ID NO: 465727 - DNA, 20 bp, Artificial Sequence
  chemically synthesized
atatacagcaggaaagaaaa

SEQ ID NO: 465728 - DNA, 20 bp, Artificial Sequence
  chemically synthesized
aattcatatatacagcagga

SEQ ID NO: 465729 - DNA, 20 bp, Artificial Sequence
  chemically synthesized
tcataattcatatatacagc

SEQ ID NO: 465730 - DNA, 20 bp, Artificial Sequence
  chemically synthesized
ttcataattcatatatacag

SEQ ID NO: 465731 - DNA, 20 bp, Artificial Sequence
  chemically synthesized
tcattcataattcatatata

SEQ ID NO: 465732 - DNA, 20 bp, Artificial Sequence
  chemically synthesized
ttatgaatgatattcaacca

SEQ ID NO: 465733 - DNA, 20 bp, Artificial Sequence
  chemically synthesized
ccttgaagcatacattaccg

SEQ ID NO: 465734 - DNA, 20 bp, Artificial Sequence
  chemically synthesized
accacggtaatgtatgcttc

SEQ ID NO: 465735 - DNA, 20 bp, Artificial Sequence
  chemically synthesized
ccacggtaatgtatgcttca

SEQ ID NO: 465736 - DNA, 20 bp, Artificial Sequence
  chemically synthesized
atgactactttttaaccttg

SEQ ID NO: 465737 - DNA, 20 bp, Artificial Sequence
  chemically synthesized
atgtatgcttcaaggttaaa

SEQ ID NO: 465738 - DNA, 20 bp, Artificial Sequence
  chemically synthesized
tatgcttcaaggttaaaaag

SEQ ID NO: 465739 - DNA, 20 bp, Artificial Sequence
  chemically synthesized
ttgaaaaatagtcaaggatt

SEQ ID NO: 465740 - DNA, 20 bp, Artificial Sequence
  chemically synthesized
tctgttttgaaaaatagtca

SEQ ID NO: 465741 - DNA, 20 bp, Artificial Sequence
  chemically synthesized
ttctgttttgaaaaatagtc

SEQ ID NO: 465742 - DNA, 20 bp, Artificial Sequence
  chemically synthesized
ctaacttctgttttgaaaaa

SEQ ID NO: 465743 - DNA, 20 bp, Artificial Sequence
  chemically synthesized
tccttgactatttttcaaaa

SEQ ID NO: 465744 - DNA, 20 bp, Artificial Sequence
  chemically synthesized
ttgactatttttcaaaacag

SEQ ID NO: 465745 - DNA, 20 bp, Artificial Sequence
  chemically synthesized
ctatttttcaaaacagaagt

SEQ ID NO: 465746 - DNA, 20 bp, Artificial Sequence
  chemically synthesized
acagaagttagcaattattt

SEQ ID NO: 465747 - DNA, 20 bp, Artificial Sequence
  chemically synthesized
agaagttagcaattattttg

SEQ ID NO: 465748 - DNA, 20 bp, Artificial Sequence
  chemically synthesized
caattattttggagaaatcc

SEQ ID NO: 465749 - DNA, 20 bp, Artificial Sequence
  chemically synthesized
agtggtgggctaattacact

SEQ ID NO: 465750 - DNA, 20 bp, Artificial Sequence
  chemically synthesized
tggagaaatcctagtgtaat

SEQ ID NO: 465751 - DNA, 20 bp, Artificial Sequence
  chemically synthesized
aagtggtgggctaattacac

SEQ ID NO: 465752 - DNA, 20 bp, Artificial Sequence
  chemically synthesized
taaattaattagcaagtggt

SEQ ID NO: 465753 - DNA, 20 bp, Artificial Sequence
  chemically synthesized
gtaaattaattagcaagtgg

SEQ ID NO: 465754 - DNA, 20 bp, Artificial Sequence
  chemically synthesized
tcagtaaattaattagcaag

SEQ ID NO: 465755 - DNA, 20 bp, Artificial Sequence
  chemically synthesized
atatcagtaaattaattagc

SEQ ID NO: 465756 - DNA, 20 bp, Artificial Sequence
  chemically synthesized
ttaaatatcagtaaattaat

SEQ ID NO: 465757 - DNA, 20 bp, Artificial Sequence
  chemically synthesized
aacaacatgtatttaaatat

SEQ ID NO: 465758 - DNA, 20 bp, Artificial Sequence
  chemically synthesized
gtattcctcttagaaagggt

SEQ ID NO: 465759 - DNA, 20 bp, Artificial Sequence
  chemically synthesized
gtttttaactcaccctttct

SEQ ID NO: 465760 - DNA, 20 bp, Artificial Sequence
  chemically synthesized
ttttaactcaccctttctaa

SEQ ID NO: 465761 - DNA, 20 bp, Artificial Sequence
  chemically synthesized
ttacgtattcctcttagaaa

SEQ ID NO: 465762 - DNA, 20 bp, Artificial Sequence
  chemically synthesized
tttaactcaccctttctaag

SEQ ID NO: 465763 - DNA, 20 bp, Artificial Sequence
  chemically synthesized
attacgtattcctcttagaa

SEQ ID NO: 465764 - DNA, 20 bp, Artificial Sequence
  chemically synthesized
aattacgtattcctcttaga

SEQ ID NO: 465765 - DNA, 20 bp, Artificial Sequence
  chemically synthesized
tttcaattacgtattcctct

SEQ ID NO: 465766 - DNA, 20 bp, Artificial Sequence
  chemically synthesized
gaatacgtaattgaaaacca

SEQ ID NO: 465767 - DNA, 20 bp, Artificial Sequence
  chemically synthesized
tttttctgaatgttagtcca

SEQ ID NO: 465768 - DNA, 20 bp, Artificial Sequence
  chemically synthesized
gaaaaccatggactaacatt

SEQ ID NO: 465769 - DNA, 20 bp, Artificial Sequence
  chemically synthesized
gtaactttttttctgaatgt

SEQ ID NO: 465770 - DNA, 20 bp, Artificial Sequence
  chemically synthesized
tggactaacattcagaaaaa

SEQ ID NO: 465771 - DNA, 20 bp, Artificial Sequence
  chemically synthesized
tcagaaaaaaagttacataa

SEQ ID NO: 465772 - DNA, 20 bp, Artificial Sequence
  chemically synthesized
aaaagttacataacagccaa

SEQ ID NO: 465773 - DNA, 20 bp, Artificial Sequence
  chemically synthesized
gtctggttaaggaacactat

SEQ ID NO: 465774 - DNA, 20 bp, Artificial Sequence
  chemically synthesized
agccaatagtgttccttaac

SEQ ID NO: 465775 - DNA, 20 bp, Artificial Sequence
  chemically synthesized
tatcccagtcagtctggtta

SEQ ID NO: 465776 - DNA, 20 bp, Artificial Sequence
  chemically synthesized
atatcccagtcagtctggtt

SEQ ID NO: 465777 - DNA, 20 bp, Artificial Sequence
  chemically synthesized
tgttccttaaccagactgac

SEQ ID NO: 465778 - DNA, 20 bp, Artificial Sequence
  chemically synthesized
ttgtaatatcccagtcagtc

SEQ ID NO: 465779 - DNA, 20 bp, Artificial Sequence
  chemically synthesized
gttccttaaccagactgact

SEQ ID NO: 465780 - DNA, 20 bp, Artificial Sequence
  chemically synthesized
agtaattgtaatatcccagt

SEQ ID NO: 465781 - DNA, 20 bp, Artificial Sequence
  chemically synthesized
ctgtagtaattgtaatatcc

SEQ ID NO: 465782 - DNA, 20 bp, Artificial Sequence
  chemically synthesized
ctgggatattacaattacta

SEQ ID NO: 465783 - DNA, 20 bp, Artificial Sequence
  chemically synthesized
atattacaattactacagaa

SEQ ID NO: 465784 - DNA, 20 bp, Artificial Sequence
  chemically synthesized
tattacaattactacagaaa

SEQ ID NO: 465785 - DNA, 20 bp, Artificial Sequence
  chemically synthesized
tatgtgctgtgccttttctg

SEQ ID NO: 465786 - DNA, 20 bp, Artificial Sequence
  chemically synthesized
caattactacagaaaaggca

SEQ ID NO: 465787 - DNA, 20 bp, Artificial Sequence
  chemically synthesized
agaaaaggcacagcacatac

SEQ ID NO: 465788 - DNA, 20 bp, Artificial Sequence
  chemically synthesized
aaaggcacagcacatacgag

SEQ ID NO: 465789 - DNA, 20 bp, Artificial Sequence
  chemically synthesized
atatgacctttcagtgtaca

SEQ ID NO: 465790 - DNA, 20 bp, Artificial Sequence
  chemically synthesized
agtagcactgtgtacactga

SEQ ID NO: 465791 - DNA, 20 bp, Artificial Sequence
  chemically synthesized
gtagcactgtgtacactgaa

SEQ ID NO: 465792 - DNA, 20 bp, Artificial Sequence
  chemically synthesized
gtacatctaatatgaccttt

SEQ ID NO: 465793 - DNA, 20 bp, Artificial Sequence
  chemically synthesized
tgtacactgaaaggtcatat

SEQ ID NO: 465794 - DNA, 20 bp, Artificial Sequence
  chemically synthesized
tattagatgtacatatatga

SEQ ID NO: 465795 - DNA, 20 bp, Artificial Sequence
  chemically synthesized
tatatgatagtctattaact

SEQ ID NO: 465796 - DNA, 20 bp, Artificial Sequence
  chemically synthesized
agctaaatcatccaagttaa

SEQ ID NO: 465797 - DNA, 20 bp, Artificial Sequence
  chemically synthesized
cctgaggagctaaatcatcc

SEQ ID NO: 465798 - DNA, 20 bp, Artificial Sequence
  chemically synthesized
gtctattaacttggatgatt

SEQ ID NO: 465799 - DNA, 20 bp, Artificial Sequence
  chemically synthesized
acttggatgatttagctcct

SEQ ID NO: 465800 - DNA, 20 bp, Artificial Sequence
  chemically synthesized
cttggatgatttagctcctc

SEQ ID NO: 465801 - DNA, 20 bp, Artificial Sequence
  chemically synthesized
agtctcctccatagcctgag

SEQ ID NO: 465802 - DNA, 20 bp, Artificial Sequence
  chemically synthesized
tgatttagctcctcaggcta

SEQ ID NO: 465803 - DNA, 20 bp, Artificial Sequence
  chemically synthesized
ccagtctcctccatagcctg

SEQ ID NO: 465804 - DNA, 20 bp, Artificial Sequence
  chemically synthesized
cccagtctcctccatagcct

SEQ ID NO: 465805 - DNA, 20 bp, Artificial Sequence
  chemically synthesized
atttagctcctcaggctatg

SEQ ID NO: 465806 - DNA, 20 bp, Artificial Sequence
  chemically synthesized
tttagctcctcaggctatgg

SEQ ID NO: 465807 - DNA, 20 bp, Artificial Sequence
  chemically synthesized
tagctcctcaggctatggag

SEQ ID NO: 465808 - DNA, 20 bp, Artificial Sequence
  chemically synthesized
tctctacccagtctcctcca

SEQ ID NO: 465809 - DNA, 20 bp, Artificial Sequence
  chemically synthesized
cctcaggctatggaggagac

SEQ ID NO: 465810 - DNA, 20 bp, Artificial Sequence
  chemically synthesized
ctcaggctatggaggagact

SEQ ID NO: 465811 - DNA, 20 bp, Artificial Sequence
  chemically synthesized
aggctatggaggagactggg

SEQ ID NO: 465812 - DNA, 20 bp, Artificial Sequence
  chemically synthesized
gctatggaggagactgggta

SEQ ID NO: 465813 - DNA, 20 bp, Artificial Sequence
  chemically synthesized
tatggaggagactgggtaga

SEQ ID NO: 465814 - DNA, 20 bp, Artificial Sequence
  chemically synthesized
gaatctttcggctctctacc

SEQ ID NO: 465815 - DNA, 20 bp, Artificial Sequence
  chemically synthesized
gagactgggtagagagccga

SEQ ID NO: 465816 - DNA, 20 bp, Artificial Sequence
  chemically synthesized
ctatgtaatacagaatcttt

SEQ ID NO: 465817 - DNA, 20 bp, Artificial Sequence
  chemically synthesized
ccgaaagattctgtattaca

SEQ ID NO: 465818 - DNA, 20 bp, Artificial Sequence
  chemically synthesized
tattaactgtctatgtaata

SEQ ID NO: 465819 - DNA, 20 bp, Artificial Sequence
  chemically synthesized
aagattctgtattacataga

SEQ ID NO: 465820 - DNA, 20 bp, Artificial Sequence
  chemically synthesized
ttacatagacagttaataat

SEQ ID NO: 465821 - DNA, 20 bp, Artificial Sequence
  chemically synthesized
tacatagacagttaataatc

SEQ ID NO: 465822 - DNA, 20 bp, Artificial Sequence
  chemically synthesized
tagattttcctaagtgtgaa

SEQ ID NO: 465823 - DNA, 20 bp, Artificial Sequence
  chemically synthesized
ataatcaggcttttcacact

SEQ ID NO: 465824 - DNA, 20 bp, Artificial Sequence
  chemically synthesized
taatcaggcttttcacactt

SEQ ID NO: 465825 - DNA, 20 bp, Artificial Sequence
  chemically synthesized
atatagaaatagattttcct

SEQ ID NO: 465826 - DNA, 20 bp, Artificial Sequence
  chemically synthesized
gatgttaaataatatagaaa

SEQ ID NO: 465827 - DNA, 20 bp, Artificial Sequence
  chemically synthesized
aaaacagatgttaaataata

SEQ ID NO: 465828 - DNA, 20 bp, Artificial Sequence
  chemically synthesized
taacaagtgattgtttaaaa

SEQ ID NO: 465829 - DNA, 20 bp, Artificial Sequence
  chemically synthesized
aaaacattcaaacatttaac

SEQ ID NO: 465830 - DNA, 20 bp, Artificial Sequence
  chemically synthesized
gttttatttgcttgttaccc

SEQ ID NO: 465831 - DNA, 20 bp, Artificial Sequence
  chemically synthesized
tttatcaccactagggtaac

SEQ ID NO: 465832 - DNA, 20 bp, Artificial Sequence
  chemically synthesized
ttatttgcttgttaccctag

SEQ ID NO: 465833 - DNA, 20 bp, Artificial Sequence
  chemically synthesized
aataatctttatcaccacta

SEQ ID NO: 465834 - DNA, 20 bp, Artificial Sequence
  chemically synthesized
aaataatctttatcaccact

SEQ ID NO: 465835 - DNA, 20 bp, Artificial Sequence
  chemically synthesized
gaaataatctttatcaccac

SEQ ID NO: 465836 - DNA, 20 bp, Artificial Sequence
  chemically synthesized
ttgttaccctagtggtgata

SEQ ID NO: 465837 - DNA, 20 bp, Artificial Sequence
  chemically synthesized
aaagattatttcaatatgtt

SEQ ID NO: 465838 - DNA, 20 bp, Artificial Sequence
  chemically synthesized
caatatgttcagtctgatta

SEQ ID NO: 465839 - DNA, 20 bp, Artificial Sequence
  chemically synthesized
gatctgtcagtgactgtaat

SEQ ID NO: 465840 - DNA, 20 bp, Artificial Sequence
  chemically synthesized
agtctgattacagtcactga

SEQ ID NO: 465841 - DNA, 20 bp, Artificial Sequence
  chemically synthesized
atgctgtcatggggatctgt

SEQ ID NO: 465842 - DNA, 20 bp, Artificial Sequence
  chemically synthesized
tcactgacagatccccatga

SEQ ID NO: 465843 - DNA, 20 bp, Artificial Sequence
  chemically synthesized
tatcttcacatgctgtcatg

SEQ ID NO: 465844 - DNA, 20 bp, Artificial Sequence
  chemically synthesized
ctatcttcacatgctgtcat

SEQ ID NO: 465845 - DNA, 20 bp, Artificial Sequence
  chemically synthesized
cctatcttcacatgctgtca

SEQ ID NO: 465846 - DNA, 20 bp, Artificial Sequence
  chemically synthesized
gatccccatgacagcatgtg

SEQ ID NO: 465847 - DNA, 20 bp, Artificial Sequence
  chemically synthesized
cccatgacagcatgtgaaga

SEQ ID NO: 465848 - DNA, 20 bp, Artificial Sequence
  chemically synthesized
ccatgacagcatgtgaagat

SEQ ID NO: 465849 - DNA, 20 bp, Artificial Sequence
  chemically synthesized
cagcatgtgaagataggtta

SEQ ID NO: 465850 - DNA, 20 bp, Artificial Sequence
  chemically synthesized
taggttatagaaacgatgca

SEQ ID NO: 465851 - DNA, 20 bp, Artificial Sequence
  chemically synthesized
cgatgcatagtttatacaaa

SEQ ID NO: 465852 - DNA, 20 bp, Artificial Sequence
  chemically synthesized
taaagtttttggagaaaggg

SEQ ID NO: 465853 - DNA, 20 bp, Artificial Sequence
  chemically synthesized
aataaagtttttggagaaag

SEQ ID NO: 465854 - DNA, 20 bp, Artificial Sequence
  chemically synthesized
aaataaagtttttggagaaa

SEQ ID NO: 465855 - DNA, 20 bp, Artificial Sequence
  chemically synthesized
aaaataaagtttttggagaa

SEQ ID NO: 465856 - DNA, 20 bp, Artificial Sequence
  chemically synthesized
aaaaataaagtttttggaga

SEQ ID NO: 465857 - DNA, 20 bp, Artificial Sequence
  chemically synthesized
ctccaaaaataaagtttttg

SEQ ID NO: 465858 - DNA, 20 bp, Artificial Sequence
  chemically synthesized
ggctccaaaaataaagtttt

SEQ ID NO: 465859 - DNA, 20 bp, Artificial Sequence
  chemically synthesized
ttctccaaaaactttatttt

SEQ ID NO: 465860 - DNA, 20 bp, Artificial Sequence
  chemically synthesized
agtatttggctccaaaaata

SEQ ID NO: 465861 - DNA, 20 bp, Artificial Sequence
  chemically synthesized
ctccaaaaactttatttttg

SEQ ID NO: 465862 - DNA, 20 bp, Artificial Sequence
  chemically synthesized
gcatgagcatggacagtatt

SEQ ID NO: 465863 - DNA, 20 bp, Artificial Sequence
  chemically synthesized
aaatggagcatgagcatgga

SEQ ID NO: 465864 - DNA, 20 bp, Artificial Sequence
  chemically synthesized
aagcaaatggagcatgagca

SEQ ID NO: 465865 - DNA, 20 bp, Artificial Sequence
  chemically synthesized
cttttaagcaaatggagcat

SEQ ID NO: 465866 - DNA, 20 bp, Artificial Sequence
  chemically synthesized
taagtacttttaagcaaatg

SEQ ID NO: 465867 - DNA, 20 bp, Artificial Sequence
  chemically synthesized
tataagtacttttaagcaaa

SEQ ID NO: 465868 - DNA, 20 bp, Artificial Sequence
  chemically synthesized
ctcatgctccatttgcttaa

SEQ ID NO: 465869 - DNA, 20 bp, Artificial Sequence
  chemically synthesized
ttataattataagtactttt

SEQ ID NO: 465870 - DNA, 20 bp, Artificial Sequence
  chemically synthesized
aatcagtggattataattat

SEQ ID NO: 465871 - DNA, 20 bp, Artificial Sequence
  chemically synthesized
taattataatccactgattg

SEQ ID NO: 465872 - DNA, 20 bp, Artificial Sequence
  chemically synthesized
tttctttcccctacaatcag

SEQ ID NO: 465873 - DNA, 20 bp, Artificial Sequence
  chemically synthesized
aattataatccactgattgt

SEQ ID NO: 465874 - DNA, 20 bp, Artificial Sequence
  chemically synthesized
attataatccactgattgta

SEQ ID NO: 465875 - DNA, 20 bp, Artificial Sequence
  chemically synthesized
ttataatccactgattgtag

SEQ ID NO: 465876 - DNA, 20 bp, Artificial Sequence
  chemically synthesized
atatttctttcccctacaat

SEQ ID NO: 465877 - DNA, 20 bp, Artificial Sequence
  chemically synthesized
aatccactgattgtagggga

SEQ ID NO: 465878 - DNA, 20 bp, Artificial Sequence
  chemically synthesized
gggaaagaaatattgcaaaa

SEQ ID NO: 465879 - DNA, 20 bp, Artificial Sequence
  chemically synthesized
gaaagaaatattgcaaaaca

SEQ ID NO: 465880 - DNA, 20 bp, Artificial Sequence
  chemically synthesized
gaaatattgcaaaacagaga

SEQ ID NO: 465881 - DNA, 20 bp, Artificial Sequence
  chemically synthesized
aaatattgcaaaacagagaa

SEQ ID NO: 465882 - DNA, 20 bp, Artificial Sequence
  chemically synthesized
aatattgcaaaacagagaaa

SEQ ID NO: 465883 - DNA, 20 bp, Artificial Sequence
  chemically synthesized
tcttgcctgcgtacgatttt

SEQ ID NO: 465884 - DNA, 20 bp, Artificial Sequence
  chemically synthesized
agggttctaaaaatcgtacg

SEQ ID NO: 465885 - DNA, 20 bp, Artificial Sequence
  chemically synthesized
gggttctaaaaatcgtacgc

SEQ ID NO: 465886 - DNA, 20 bp, Artificial Sequence
  chemically synthesized
tctaaaaatcgtacgcaggc

SEQ ID NO: 465887 - DNA, 20 bp, Artificial Sequence
  chemically synthesized
aaaatcgtacgcaggcaaga

SEQ ID NO: 465888 - DNA, 20 bp, Artificial Sequence
  chemically synthesized
acgcaggcaagaaagaatgt

SEQ ID NO: 465889 - DNA, 20 bp, Artificial Sequence
  chemically synthesized
atgtaagacaaaactcatta

SEQ ID NO: 465890 - DNA, 20 bp, Artificial Sequence
  chemically synthesized
tgtaagacaaaactcattaa

SEQ ID NO: 465891 - DNA, 20 bp, Artificial Sequence
  chemically synthesized
gtaagacaaaactcattaaa

SEQ ID NO: 465892 - DNA, 20 bp, Artificial Sequence
  chemically synthesized
tatttattttgccctttaat

SEQ ID NO: 465893 - DNA, 20 bp, Artificial Sequence
  chemically synthesized
tgataaattattgaaaatgt

SEQ ID NO: 465894 - DNA, 20 bp, Artificial Sequence
  chemically synthesized
ctgttaatgaaaaatgacag

SEQ ID NO: 465895 - DNA, 20 bp, Artificial Sequence
  chemically synthesized
aggctgttaatgaaaaatga

SEQ ID NO: 465896 - DNA, 20 bp, Artificial Sequence
  chemically synthesized
cttctgtcatttttcattaa

SEQ ID NO: 465897 - DNA, 20 bp, Artificial Sequence
  chemically synthesized
tttttcattaacagccttca

SEQ ID NO: 465898 - DNA, 20 bp, Artificial Sequence
  chemically synthesized
tgtttcagatagggctttga

SEQ ID NO: 465899 - DNA, 20 bp, Artificial Sequence
  chemically synthesized
ttgtttcagatagggctttg

SEQ ID NO: 465900 - DNA, 20 bp, Artificial Sequence
  chemically synthesized
gtatcagcttgtttcagata

SEQ ID NO: 465901 - DNA, 20 bp, Artificial Sequence
  chemically synthesized
tgtatcagcttgtttcagat

SEQ ID NO: 465902 - DNA, 20 bp, Artificial Sequence
  chemically synthesized
ctgtatcagcttgtttcaga

SEQ ID NO: 465903 - DNA, 20 bp, Artificial Sequence
  chemically synthesized
ttcaaagccctatctgaaac

SEQ ID NO: 465904 - DNA, 20 bp, Artificial Sequence
  chemically synthesized
ttctctgtatcagcttgttt

SEQ ID NO: 465905 - DNA, 20 bp, Artificial Sequence
  chemically synthesized
ctatctgaaacaagctgata

SEQ ID NO: 465906 - DNA, 20 bp, Artificial Sequence
  chemically synthesized
atctgaaacaagctgataca

SEQ ID NO: 465907 - DNA, 20 bp, Artificial Sequence
  chemically synthesized
tgctcttaatttctctgtat

SEQ ID NO: 465908 - DNA, 20 bp, Artificial Sequence
  chemically synthesized
caagctgatacagagaaatt

SEQ ID NO: 465909 - DNA, 20 bp, Artificial Sequence
  chemically synthesized
agctgatacagagaaattaa

SEQ ID NO: 465910 - DNA, 20 bp, Artificial Sequence
  chemically synthesized
tgatacagagaaattaagag

SEQ ID NO: 465911 - DNA, 20 bp, Artificial Sequence
  chemically synthesized
agaaattaagagcagtaatc

SEQ ID NO: 465912 - DNA, 20 bp, Artificial Sequence
  chemically synthesized
attaagagcagtaatcaagc

SEQ ID NO: 465913 - DNA, 20 bp, Artificial Sequence
  chemically synthesized
agtaatcaagcgagaaatca

SEQ ID NO: 465914 - DNA, 20 bp, Artificial Sequence
  chemically synthesized
tcaagcgagaaatcatagac

SEQ ID NO: 465915 - DNA, 20 bp, Artificial Sequence
  chemically synthesized
gcgagaaatcatagaccagc

SEQ ID NO: 465916 - DNA, 20 bp, Artificial Sequence
  chemically synthesized
cgagaaatcatagaccagct

SEQ ID NO: 465917 - DNA, 20 bp, Artificial Sequence
  chemically synthesized
caagttgatgtcgacccagc

SEQ ID NO: 465918 - DNA, 20 bp, Artificial Sequence
  chemically synthesized
ttgccaagttgatgtcgacc

SEQ ID NO: 465919 - DNA, 20 bp, Artificial Sequence
  chemically synthesized
cagctgggtcgacatcaact

SEQ ID NO: 465920 - DNA, 20 bp, Artificial Sequence
  chemically synthesized
aactgtattcacgttttgcc

SEQ ID NO: 465921 - DNA, 20 bp, Artificial Sequence
  chemically synthesized
aacttggcaaaacgtgaata

SEQ ID NO: 465922 - DNA, 20 bp, Artificial Sequence
  chemically synthesized
aaaacgtgaatacagttcaa

SEQ ID NO: 465923 - DNA, 20 bp, Artificial Sequence
  chemically synthesized
atacagttcaatagctgaaa

SEQ ID NO: 465924 - DNA, 20 bp, Artificial Sequence
  chemically synthesized
aacaactctagcatctgttt

SEQ ID NO: 465925 - DNA, 20 bp, Artificial Sequence
  chemically synthesized
tcaatagctgaaacagatgc

SEQ ID NO: 465926 - DNA, 20 bp, Artificial Sequence
  chemically synthesized
aatagctgaaacagatgcta

SEQ ID NO: 465927 - DNA, 20 bp, Artificial Sequence
  chemically synthesized
gcagggtttttcaacaactc

SEQ ID NO: 465928 - DNA, 20 bp, Artificial Sequence
  chemically synthesized
agagttgttgaaaaaccctg

SEQ ID NO: 465929 - DNA, 20 bp, Artificial Sequence
  chemically synthesized
gagttgttgaaaaaccctgc

SEQ ID NO: 465930 - DNA, 20 bp, Artificial Sequence
  chemically synthesized
gttgttgaaaaaccctgcag

SEQ ID NO: 465931 - DNA, 20 bp, Artificial Sequence
  chemically synthesized
atatatcaatatctcctgca

SEQ ID NO: 465932 - DNA, 20 bp, Artificial Sequence
  chemically synthesized
aatatatcaatatctcctgc

SEQ ID NO: 465933 - DNA, 20 bp, Artificial Sequence
  chemically synthesized
aaatatatcaatatctcctg

SEQ ID NO: 465934 - DNA, 20 bp, Artificial Sequence
  chemically synthesized
cagtcattctgcattatatg

SEQ ID NO: 465935 - DNA, 20 bp, Artificial Sequence
  chemically synthesized
tatattttcttcatataatg

SEQ ID NO: 465936 - DNA, 20 bp, Artificial Sequence
  chemically synthesized
tctagcttttgacatttatt

SEQ ID NO: 465937 - DNA, 20 bp, Artificial Sequence
  chemically synthesized
aatgactgaataaatgtcaa

SEQ ID NO: 465938 - DNA, 20 bp, Artificial Sequence
  chemically synthesized
actgaataaatgtcaaaagc

SEQ ID NO: 465939 - DNA, 20 bp, Artificial Sequence
  chemically synthesized
catttctcctcatcaatttc

SEQ ID NO: 465940 - DNA, 20 bp, Artificial Sequence
  chemically synthesized
gtcaaaagctagaaattgat

SEQ ID NO: 465941 - DNA, 20 bp, Artificial Sequence
  chemically synthesized
tcaaaagctagaaattgatg

SEQ ID NO: 465942 - DNA, 20 bp, Artificial Sequence
  chemically synthesized
aaaagctagaaattgatgag

SEQ ID NO: 465943 - DNA, 20 bp, Artificial Sequence
  chemically synthesized
tgatgaggagaaatgactga

SEQ ID NO: 465944 - DNA, 20 bp, Artificial Sequence
  chemically synthesized
tttataaggagtttggctgt

SEQ ID NO: 465945 - DNA, 20 bp, Artificial Sequence
  chemically synthesized
tttctattttataaggagtt

SEQ ID NO: 465946 - DNA, 20 bp, Artificial Sequence
  chemically synthesized
cttggtttctattttataag

SEQ ID NO: 465947 - DNA, 20 bp, Artificial Sequence
  chemically synthesized
cagccaaactccttataaaa

SEQ ID NO: 465948 - DNA, 20 bp, Artificial Sequence
  chemically synthesized
tacttggtttctattttata

SEQ ID NO: 465949 - DNA, 20 bp, Artificial Sequence
  chemically synthesized
atacttggtttctattttat

SEQ ID NO: 465950 - DNA, 20 bp, Artificial Sequence
  chemically synthesized
ctccttataaaatagaaacc

SEQ ID NO: 465951 - DNA, 20 bp, Artificial Sequence
  chemically synthesized
aggttgaaaattgttatact

SEQ ID NO: 465952 - DNA, 20 bp, Artificial Sequence
  chemically synthesized
aatgtacagaatgtttggat

SEQ ID NO: 465953 - DNA, 20 bp, Artificial Sequence
  chemically synthesized
gaatgtacagaatgtttgga

SEQ ID NO: 465954 - DNA, 20 bp, Artificial Sequence
  chemically synthesized
atgagaatgtacagaatgtt

SEQ ID NO: 465955 - DNA, 20 bp, Artificial Sequence
  chemically synthesized
gtgagagaaatgagaatgta

SEQ ID NO: 465956 - DNA, 20 bp, Artificial Sequence
  chemically synthesized
attcagacagtgagagaaat

SEQ ID NO: 465957 - DNA, 20 bp, Artificial Sequence
  chemically synthesized
ttggcatattcagacagtga

SEQ ID NO: 465958 - DNA, 20 bp, Artificial Sequence
  chemically synthesized
tattggcatattcagacagt

SEQ ID NO: 465959 - DNA, 20 bp, Artificial Sequence
  chemically synthesized
gatgtattggcatattcaga

SEQ ID NO: 465960 - DNA, 20 bp, Artificial Sequence
  chemically synthesized
gattgatgtattggcatatt

SEQ ID NO: 465961 - DNA, 20 bp, Artificial Sequence
  chemically synthesized
gcaagaactgattgatgtat

SEQ ID NO: 465962 - DNA, 20 bp, Artificial Sequence
  chemically synthesized
gaatatgccaatacatcaat

SEQ ID NO: 465963 - DNA, 20 bp, Artificial Sequence
  chemically synthesized
gttatatgcaatttagttgc

SEQ ID NO: 465964 - DNA, 20 bp, Artificial Sequence
  chemically synthesized
cagattagttatatgcaatt

SEQ ID NO: 465965 - DNA, 20 bp, Artificial Sequence
  chemically synthesized
taaattgcatataactaatc

SEQ ID NO: 465966 - DNA, 20 bp, Artificial Sequence
  chemically synthesized
aaattgcatataactaatct

SEQ ID NO: 465967 - DNA, 20 bp, Artificial Sequence
  chemically synthesized
aattgcatataactaatctg

SEQ ID NO: 465968 - DNA, 20 bp, Artificial Sequence
  chemically synthesized
cggggaaatctaccccagat

SEQ ID NO: 465969 - DNA, 20 bp, Artificial Sequence
  chemically synthesized
tgcatataactaatctgggg

SEQ ID NO: 465970 - DNA, 20 bp, Artificial Sequence
  chemically synthesized
atcttcggggaaatctaccc

SEQ ID NO: 465971 - DNA, 20 bp, Artificial Sequence
  chemically synthesized
atctggggtagatttccccg

SEQ ID NO: 465972 - DNA, 20 bp, Artificial Sequence
  chemically synthesized
cagggggaaaaaaatcttcg

SEQ ID NO: 465973 - DNA, 20 bp, Artificial Sequence
  chemically synthesized
acagggggaaaaaaatcttc

SEQ ID NO: 465974 - DNA, 20 bp, Artificial Sequence
  chemically synthesized
gacagggggaaaaaaatctt

SEQ ID NO: 465975 - DNA, 20 bp, Artificial Sequence
  chemically synthesized
ttcaggtagatgatgacagg

SEQ ID NO: 465976 - DNA, 20 bp, Artificial Sequence
  chemically synthesized
cttcaggtagatgatgacag

SEQ ID NO: 465977 - DNA, 20 bp, Artificial Sequence
  chemically synthesized
tcttcaggtagatgatgaca

SEQ ID NO: 465978 - DNA, 20 bp, Artificial Sequence
  chemically synthesized
ttcttcaggtagatgatgac

SEQ ID NO: 465979 - DNA, 20 bp, Artificial Sequence
  chemically synthesized
tttcttcaggtagatgatga

SEQ ID NO: 465980 - DNA, 20 bp, Artificial Sequence
  chemically synthesized
cccctgtcatcatctacctg

SEQ ID NO: 465981 - DNA, 20 bp, Artificial Sequence
  chemically synthesized
ggagtctaggtttcttcagg

SEQ ID NO: 465982 - DNA, 20 bp, Artificial Sequence
  chemically synthesized
tcaggagtctaggtttcttc

SEQ ID NO: 465983 - DNA, 20 bp, Artificial Sequence
  chemically synthesized
ttcaggagtctaggtttctt

SEQ ID NO: 465984 - DNA, 20 bp, Artificial Sequence
  chemically synthesized
atcatctacctgaagaaacc

SEQ ID NO: 465985 - DNA, 20 bp, Artificial Sequence
  chemically synthesized
aaagtattgttcaggagtct

SEQ ID NO: 465986 - DNA, 20 bp, Artificial Sequence
  chemically synthesized
taaagtattgttcaggagtc

SEQ ID NO: 465987 - DNA, 20 bp, Artificial Sequence
  chemically synthesized
tagaataaagtattgttcag

SEQ ID NO: 465988 - DNA, 20 bp, Artificial Sequence
  chemically synthesized
tttagaataaagtattgttc

SEQ ID NO: 465989 - DNA, 20 bp, Artificial Sequence
  chemically synthesized
ttttagaataaagtattgtt

SEQ ID NO: 465990 - DNA, 20 bp, Artificial Sequence
  chemically synthesized
tgttagaagattttagaata

SEQ ID NO: 465991 - DNA, 20 bp, Artificial Sequence
  chemically synthesized
aaatcagtgttagaagattt

SEQ ID NO: 465992 - DNA, 20 bp, Artificial Sequence
  chemically synthesized
gggatagaaatcagtgttag

SEQ ID NO: 465993 - DNA, 20 bp, Artificial Sequence
  chemically synthesized
tctgggatagaaatcagtgt

SEQ ID NO: 465994 - DNA, 20 bp, Artificial Sequence
  chemically synthesized
aacacttctgggatagaaat

SEQ ID NO: 465995 - DNA, 20 bp, Artificial Sequence
  chemically synthesized
tctaacactgatttctatcc

SEQ ID NO: 465996 - DNA, 20 bp, Artificial Sequence
  chemically synthesized
aacactgatttctatcccag

SEQ ID NO: 465997 - DNA, 20 bp, Artificial Sequence
  chemically synthesized
tcaggaaaacacttctggga

SEQ ID NO: 465998 - DNA, 20 bp, Artificial Sequence
  chemically synthesized
aacctcaggaaaacacttct

SEQ ID NO: 465999 - DNA, 20 bp, Artificial Sequence
  chemically synthesized
caacctcaggaaaacacttc

SEQ ID NO: 466000 - DNA, 20 bp, Artificial Sequence
  chemically synthesized
tatcccagaagtgttttcct

SEQ ID NO: 466001 - DNA, 20 bp, Artificial Sequence
  chemically synthesized
atcccagaagtgttttcctg

SEQ ID NO: 466002 - DNA, 20 bp, Artificial Sequence
  chemically synthesized
cagaagtgttttcctgaggt

SEQ ID NO: 466003 - DNA, 20 bp, Artificial Sequence
  chemically synthesized
gaagtgttttcctgaggttg

SEQ ID NO: 466004 - DNA, 20 bp, Artificial Sequence
  chemically synthesized
gtgtgcttgcctccaacctc

SEQ ID NO: 466005 - DNA, 20 bp, Artificial Sequence
  chemically synthesized
aagtgttttcctgaggttgg

SEQ ID NO: 466006 - DNA, 20 bp, Artificial Sequence
  chemically synthesized
ggtgtgcttgcctccaacct

SEQ ID NO: 466007 - DNA, 20 bp, Artificial Sequence
  chemically synthesized
gttttcctgaggttggaggc

SEQ ID NO: 466008 - DNA, 20 bp, Artificial Sequence
  chemically synthesized
tgcgttagattttggggagg

SEQ ID NO: 466009 - DNA, 20 bp, Artificial Sequence
  chemically synthesized
ctgcgttagattttggggag

SEQ ID NO: 466010 - DNA, 20 bp, Artificial Sequence
  chemically synthesized
gctgcgttagattttgggga

SEQ ID NO: 466011 - DNA, 20 bp, Artificial Sequence
  chemically synthesized
tgctgcgttagattttgggg

SEQ ID NO: 466012 - DNA, 20 bp, Artificial Sequence
  chemically synthesized
gtgctgcgttagattttggg

SEQ ID NO: 466013 - DNA, 20 bp, Artificial Sequence
  chemically synthesized
ttgtgctgcgttagattttg

SEQ ID NO: 466014 - DNA, 20 bp, Artificial Sequence
  chemically synthesized
cttgtgctgcgttagatttt

SEQ ID NO: 466015 - DNA, 20 bp, Artificial Sequence
  chemically synthesized
ccttgtgctgcgttagattt

SEQ ID NO: 466016 - DNA, 20 bp, Artificial Sequence
  chemically synthesized
cccctccccaaaatctaacg

SEQ ID NO: 466017 - DNA, 20 bp, Artificial Sequence
  chemically synthesized
aaaattgccttgtgctgcgt

SEQ ID NO: 466018 - DNA, 20 bp, Artificial Sequence
  chemically synthesized
cccaaaatctaacgcagcac

SEQ ID NO: 466019 - DNA, 20 bp, Artificial Sequence
  chemically synthesized
ccaaaatctaacgcagcaca

SEQ ID NO: 466020 - DNA, 20 bp, Artificial Sequence
  chemically synthesized
acagtgttgcttttacagaa

SEQ ID NO: 466021 - DNA, 20 bp, Artificial Sequence
  chemically synthesized
ttttaaaatccattctgtaa

SEQ ID NO: 466022 - DNA, 20 bp, Artificial Sequence
  chemically synthesized
tgcaaacagtgttgctttta

SEQ ID NO: 466023 - DNA, 20 bp, Artificial Sequence
  chemically synthesized
tgtaaaagcaacactgtttg

SEQ ID NO: 466024 - DNA, 20 bp, Artificial Sequence
  chemically synthesized
taaaagcaacactgtttgca

SEQ ID NO: 466025 - DNA, 20 bp, Artificial Sequence
  chemically synthesized
agctcttcaaactctgcaaa

SEQ ID NO: 466026 - DNA, 20 bp, Artificial Sequence
  chemically synthesized
aacactgtttgcagagtttg

SEQ ID NO: 466027 - DNA, 20 bp, Artificial Sequence
  chemically synthesized
cactgtttgcagagtttgaa

SEQ ID NO: 466028 - DNA, 20 bp, Artificial Sequence
  chemically synthesized
tttgcagagtttgaagagct

SEQ ID NO: 466029 - DNA, 20 bp, Artificial Sequence
  chemically synthesized
ggtagctggggtttgttgcc

SEQ ID NO: 466030 - DNA, 20 bp, Artificial Sequence
  chemically synthesized
aagagctcggcaacaaaccc

SEQ ID NO: 466031 - DNA, 20 bp, Artificial Sequence
  chemically synthesized
caagcagctgttggtagctg

SEQ ID NO: 466032 - DNA, 20 bp, Artificial Sequence
  chemically synthesized
acaagcagctgttggtagct

SEQ ID NO: 466033 - DNA, 20 bp, Artificial Sequence
  chemically synthesized
aacaagcagctgttggtagc

SEQ ID NO: 466034 - DNA, 20 bp, Artificial Sequence
  chemically synthesized
caacaaaccccagctaccaa

SEQ ID NO: 466035 - DNA, 20 bp, Artificial Sequence
  chemically synthesized
tttgaacaagcagctgttgg

SEQ ID NO: 466036 - DNA, 20 bp, Artificial Sequence
  chemically synthesized
atgtttgaacaagcagctgt

SEQ ID NO: 466037 - DNA, 20 bp, Artificial Sequence
  chemically synthesized
aaagcatatgtttgaacaag

SEQ ID NO: 466038 - DNA, 20 bp, Artificial Sequence
  chemically synthesized
gacaaagcatatgtttgaac

SEQ ID NO: 466039 - DNA, 20 bp, Artificial Sequence
  chemically synthesized
ttcaaacatatgctttgtca

SEQ ID NO: 466040 - DNA, 20 bp, Artificial Sequence
  chemically synthesized
attagaagctggccatgaca

SEQ ID NO: 466041 - DNA, 20 bp, Artificial Sequence
  chemically synthesized
aacatatgctttgtcatggc

SEQ ID NO: 466042 - DNA, 20 bp, Artificial Sequence
  chemically synthesized
ttacaaatacaattagaagc

SEQ ID NO: 466043 - DNA, 20 bp, Artificial Sequence
  chemically synthesized
atcattacaaatacaattag

SEQ ID NO: 466044 - DNA, 20 bp, Artificial Sequence
  chemically synthesized
tacatcattacaaatacaat

SEQ ID NO: 466045 - DNA, 20 bp, Artificial Sequence
  chemically synthesized
ttgtatttgtaatgatgtaa

SEQ ID NO: 466046 - DNA, 20 bp, Artificial Sequence
  chemically synthesized
catggaaggtaggattatta

SEQ ID NO: 466047 - DNA, 20 bp, Artificial Sequence
  chemically synthesized
aaacagctggcatggaaggt

SEQ ID NO: 466048 - DNA, 20 bp, Artificial Sequence
  chemically synthesized
aaaacagctggcatggaagg

SEQ ID NO: 466049 - DNA, 20 bp, Artificial Sequence
  chemically synthesized
aataatcctaccttccatgc

SEQ ID NO: 466050 - DNA, 20 bp, Artificial Sequence
  chemically synthesized
ggaaaaacagctggcatgga

SEQ ID NO: 466051 - DNA, 20 bp, Artificial Sequence
  chemically synthesized
aggaaaaacagctggcatgg

SEQ ID NO: 466052 - DNA, 20 bp, Artificial Sequence
  chemically synthesized
gacaggaaaaacagctggca

SEQ ID NO: 466053 - DNA, 20 bp, Artificial Sequence
  chemically synthesized
ggagtgacaggaaaaacagc

SEQ ID NO: 466054 - DNA, 20 bp, Artificial Sequence
  chemically synthesized
tgatggagtgacaggaaaaa

SEQ ID NO: 466055 - DNA, 20 bp, Artificial Sequence
  chemically synthesized
tattggcatgatggagtgac

SEQ ID NO: 466056 - DNA, 20 bp, Artificial Sequence
  chemically synthesized
ttattggcatgatggagtga

SEQ ID NO: 466057 - DNA, 20 bp, Artificial Sequence
  chemically synthesized
gccaacttattggcatgatg

SEQ ID NO: 466058 - DNA, 20 bp, Artificial Sequence
  chemically synthesized
cagccaacttattggcatga

SEQ ID NO: 466059 - DNA, 20 bp, Artificial Sequence
  chemically synthesized
tgtcactccatcatgccaat

SEQ ID NO: 466060 - DNA, 20 bp, Artificial Sequence
  chemically synthesized
actccatcatgccaataagt

SEQ ID NO: 466061 - DNA, 20 bp, Artificial Sequence
  chemically synthesized
tgttacagcagccaacttat

SEQ ID NO: 466062 - DNA, 20 bp, Artificial Sequence
  chemically synthesized
actatcttgatttgttacag

SEQ ID NO: 466063 - DNA, 20 bp, Artificial Sequence
  chemically synthesized
tgcactatcttgatttgtta

SEQ ID NO: 466064 - DNA, 20 bp, Artificial Sequence
  chemically synthesized
gttggctgctgtaacaaatc

SEQ ID NO: 466065 - DNA, 20 bp, Artificial Sequence
  chemically synthesized
gctgctgtaacaaatcaaga

SEQ ID NO: 466066 - DNA, 20 bp, Artificial Sequence
  chemically synthesized
caaatcaagatagtgcaaaa

SEQ ID NO: 466067 - DNA, 20 bp, Artificial Sequence
  chemically synthesized
aagatgacagaatcaggaga

SEQ ID NO: 466068 - DNA, 20 bp, Artificial Sequence
  chemically synthesized
caggaagatgacagaatcag

SEQ ID NO: 466069 - DNA, 20 bp, Artificial Sequence
  chemically synthesized
ttcaggaagatgacagaatc

SEQ ID NO: 466070 - DNA, 20 bp, Artificial Sequence
  chemically synthesized
tttcaggaagatgacagaat

SEQ ID NO: 466071 - DNA, 20 bp, Artificial Sequence
  chemically synthesized
gaatgctttcaggaagatga

SEQ ID NO: 466072 - DNA, 20 bp, Artificial Sequence
  chemically synthesized
tgattctgtcatcttcctga

SEQ ID NO: 466073 - DNA, 20 bp, Artificial Sequence
  chemically synthesized
agtaatagaatgctttcagg

SEQ ID NO: 466074 - DNA, 20 bp, Artificial Sequence
  chemically synthesized
ggcagtaatagaatgctttc

SEQ ID NO: 466075 - DNA, 20 bp, Artificial Sequence
  chemically synthesized
cggcagtaatagaatgcttt

SEQ ID NO: 466076 - DNA, 20 bp, Artificial Sequence
  chemically synthesized
ttcccagcagtcggcagtaa

SEQ ID NO: 466077 - DNA, 20 bp, Artificial Sequence
  chemically synthesized
ttctggttcccagcagtcgg

SEQ ID NO: 466078 - DNA, 20 bp, Artificial Sequence
  chemically synthesized
attctattactgccgactgc

SEQ ID NO: 466079 - DNA, 20 bp, Artificial Sequence
  chemically synthesized
ttctattactgccgactgct

SEQ ID NO: 466080 - DNA, 20 bp, Artificial Sequence
  chemically synthesized
actttctggttcccagcagt

SEQ ID NO: 466081 - DNA, 20 bp, Artificial Sequence
  chemically synthesized
atagactttctggttcccag

SEQ ID NO: 466082 - DNA, 20 bp, Artificial Sequence
  chemically synthesized
tactgccgactgctgggaac

SEQ ID NO: 466083 - DNA, 20 bp, Artificial Sequence
  chemically synthesized
caaatagactttctggttcc

SEQ ID NO: 466084 - DNA, 20 bp, Artificial Sequence
  chemically synthesized
gccgactgctgggaaccaga

SEQ ID NO: 466085 - DNA, 20 bp, Artificial Sequence
  chemically synthesized
tggaattcaaatagactttc

SEQ ID NO: 466086 - DNA, 20 bp, Artificial Sequence
  chemically synthesized
gggagctgttggaattcaaa

SEQ ID NO: 466087 - DNA, 20 bp, Artificial Sequence
  chemically synthesized
aaagtctatttgaattccaa

SEQ ID NO: 466088 - DNA, 20 bp, Artificial Sequence
  chemically synthesized
tcatgcgaaaggggagctgt

SEQ ID NO: 466089 - DNA, 20 bp, Artificial Sequence
  chemically synthesized
acttgaatcatgcgaaaggg

SEQ ID NO: 466090 - DNA, 20 bp, Artificial Sequence
  chemically synthesized
taacttgaatcatgcgaaag

SEQ ID NO: 466091 - DNA, 20 bp, Artificial Sequence
  chemically synthesized
ctaacttgaatcatgcgaaa

SEQ ID NO: 466092 - DNA, 20 bp, Artificial Sequence
  chemically synthesized
cctaacttgaatcatgcgaa

SEQ ID NO: 466093 - DNA, 20 bp, Artificial Sequence
  chemically synthesized
acctaacttgaatcatgcga

SEQ ID NO: 466094 - DNA, 20 bp, Artificial Sequence
  chemically synthesized
gctcccctttcgcatgattc

SEQ ID NO: 466095 - DNA, 20 bp, Artificial Sequence
  chemically synthesized
ccctttcgcatgattcaagt

SEQ ID NO: 466096 - DNA, 20 bp, Artificial Sequence
  chemically synthesized
cctttcgcatgattcaagtt

SEQ ID NO: 466097 - DNA, 20 bp, Artificial Sequence
  chemically synthesized
tcgcatgattcaagttaggt

SEQ ID NO: 466098 - DNA, 20 bp, Artificial Sequence
  chemically synthesized
cgcatgattcaagttaggtt

SEQ ID NO: 466099 - DNA, 20 bp, Artificial Sequence
  chemically synthesized
atgattcaagttaggttagg

SEQ ID NO: 466100 - DNA, 20 bp, Artificial Sequence
  chemically synthesized
tgattcaagttaggttaggt

SEQ ID NO: 466101 - DNA, 20 bp, Artificial Sequence
  chemically synthesized
atgactgaaagaatcatgtt

SEQ ID NO: 466102 - DNA, 20 bp, Artificial Sequence
  chemically synthesized
aatgactgaaagaatcatgt

SEQ ID NO: 466103 - DNA, 20 bp, Artificial Sequence
  chemically synthesized
catgcctaacatgattcttt

SEQ ID NO: 466104 - DNA, 20 bp, Artificial Sequence
  chemically synthesized
gctgcataataaatgactga

SEQ ID NO: 466105 - DNA, 20 bp, Artificial Sequence
  chemically synthesized
tctttcagtcatttattatg

SEQ ID NO: 466106 - DNA, 20 bp, Artificial Sequence
  chemically synthesized
ttaccacaccgacgttgtag

SEQ ID NO: 466107 - DNA, 20 bp, Artificial Sequence
  chemically synthesized
ttatgcagctgctacaacgt

SEQ ID NO: 466108 - DNA, 20 bp, Artificial Sequence
  chemically synthesized
tggttaccacaccgacgttg

SEQ ID NO: 466109 - DNA, 20 bp, Artificial Sequence
  chemically synthesized
cagctgctacaacgtcggtg

SEQ ID NO: 466110 - DNA, 20 bp, Artificial Sequence
  chemically synthesized
gacgtatcagatagtcagag

SEQ ID NO: 466111 - DNA, 20 bp, Artificial Sequence
  chemically synthesized
actgacgtatcagatagtca

SEQ ID NO: 466112 - DNA, 20 bp, Artificial Sequence
  chemically synthesized
cgactgacgtatcagatagt

SEQ ID NO: 466113 - DNA, 20 bp, Artificial Sequence
  chemically synthesized
tgttcgactgacgtatcaga

SEQ ID NO: 466114 - DNA, 20 bp, Artificial Sequence
  chemically synthesized
actctgactatctgatacgt

SEQ ID NO: 466115 - DNA, 20 bp, Artificial Sequence
  chemically synthesized
gttttgttcgactgacgtat

SEQ ID NO: 466116 - DNA, 20 bp, Artificial Sequence
  chemically synthesized
gtcgaacaaaacctatacct

SEQ ID NO: 466117 - DNA, 20 bp, Artificial Sequence
  chemically synthesized
atgtgtttgctccgaggtat

SEQ ID NO: 466118 - DNA, 20 bp, Artificial Sequence
  chemically synthesized
cgaacaaaacctatacctcg

SEQ ID NO: 466119 - DNA, 20 bp, Artificial Sequence
  chemically synthesized
catgtgtttgctccgaggta

SEQ ID NO: 466120 - DNA, 20 bp, Artificial Sequence
  chemically synthesized
tggctcatgtgtttgctccg

SEQ ID NO: 466121 - DNA, 20 bp, Artificial Sequence
  chemically synthesized
ctggctcatgtgtttgctcc

SEQ ID NO: 466122 - DNA, 20 bp, Artificial Sequence
  chemically synthesized
atacctcggagcaaacacat

SEQ ID NO: 466123 - DNA, 20 bp, Artificial Sequence
  chemically synthesized
ctcggagcaaacacatgagc

SEQ ID NO: 466124 - DNA, 20 bp, Artificial Sequence
  chemically synthesized
cggagcaaacacatgagcca

SEQ ID NO: 466125 - DNA, 20 bp, Artificial Sequence
  chemically synthesized
agcaaacacatgagccagag

SEQ ID NO: 466126 - DNA, 20 bp, Artificial Sequence
  chemically synthesized
gttaaatgcaaacgctgctc

SEQ ID NO: 466127 - DNA, 20 bp, Artificial Sequence
  chemically synthesized
gagcagcgtttgcatttaac

SEQ ID NO: 466128 - DNA, 20 bp, Artificial Sequence
  chemically synthesized
tccactgttttttaggcagg

SEQ ID NO: 466129 - DNA, 20 bp, Artificial Sequence
  chemically synthesized
agatccactgttttttaggc

SEQ ID NO: 466130 - DNA, 20 bp, Artificial Sequence
  chemically synthesized
cagatccactgttttttagg

SEQ ID NO: 466131 - DNA, 20 bp, Artificial Sequence
  chemically synthesized
cattcttcctgcctaaaaaa

SEQ ID NO: 466132 - DNA, 20 bp, Artificial Sequence
  chemically synthesized
ttgcagatccactgtttttt

SEQ ID NO: 466133 - DNA, 20 bp, Artificial Sequence
  chemically synthesized
tttgcagatccactgttttt

SEQ ID NO: 466134 - DNA, 20 bp, Artificial Sequence
  chemically synthesized
tcttcctgcctaaaaaacag

SEQ ID NO: 466135 - DNA, 20 bp, Artificial Sequence
  chemically synthesized
tagatactgaaagagatttg

SEQ ID NO: 466136 - DNA, 20 bp, Artificial Sequence
  chemically synthesized
gtggatctgcaaatctcttt

SEQ ID NO: 466137 - DNA, 20 bp, Artificial Sequence
  chemically synthesized
agagcgagtagatactgaaa

SEQ ID NO: 466138 - DNA, 20 bp, Artificial Sequence
  chemically synthesized
gaagagcgagtagatactga

SEQ ID NO: 466139 - DNA, 20 bp, Artificial Sequence
  chemically synthesized
catctgtacagaagagcgag

SEQ ID NO: 466140 - DNA, 20 bp, Artificial Sequence
  chemically synthesized
ttgcatctgtacagaagagc

SEQ ID NO: 466141 - DNA, 20 bp, Artificial Sequence
  chemically synthesized
tatctactcgctcttctgta

SEQ ID NO: 466142 - DNA, 20 bp, Artificial Sequence
  chemically synthesized
ggctttgcatctgtacagaa

SEQ ID NO: 466143 - DNA, 20 bp, Artificial Sequence
  chemically synthesized
aaggctttgcatctgtacag

SEQ ID NO: 466144 - DNA, 20 bp, Artificial Sequence
  chemically synthesized
ccaaaggctttgcatctgta

SEQ ID NO: 466145 - DNA, 20 bp, Artificial Sequence
  chemically synthesized
cgctcttctgtacagatgca

SEQ ID NO: 466146 - DNA, 20 bp, Artificial Sequence
  chemically synthesized
ctgtacagatgcaaagcctt

SEQ ID NO: 466147 - DNA, 20 bp, Artificial Sequence
  chemically synthesized
cagatgcaaagcctttggat

SEQ ID NO: 466148 - DNA, 20 bp, Artificial Sequence
  chemically synthesized
aggaaaataatctaatccaa

SEQ ID NO: 466149 - DNA, 20 bp, Artificial Sequence
  chemically synthesized
taggaaaataatctaatcca

SEQ ID NO: 466150 - DNA, 20 bp, Artificial Sequence
  chemically synthesized
ttggattagattattttcct

SEQ ID NO: 466151 - DNA, 20 bp, Artificial Sequence
  chemically synthesized
actctactattgttacactt

SEQ ID NO: 466152 - DNA, 20 bp, Artificial Sequence
  chemically synthesized
aactctactattgttacact

SEQ ID NO: 466153 - DNA, 20 bp, Artificial Sequence
  chemically synthesized
tattttcctaagtgtaacaa

SEQ ID NO: 466154 - DNA, 20 bp, Artificial Sequence
  chemically synthesized
tttcctaagtgtaacaatag

SEQ ID NO: 466155 - DNA, 20 bp, Artificial Sequence
  chemically synthesized
tcctaagtgtaacaatagta

SEQ ID NO: 466156 - DNA, 20 bp, Artificial Sequence
  chemically synthesized
gaataatatgatgtttggcg

SEQ ID NO: 466157 - DNA, 20 bp, Artificial Sequence
  chemically synthesized
tgaataatatgatgtttggc

SEQ ID NO: 466158 - DNA, 20 bp, Artificial Sequence
  chemically synthesized
agtgtgaataatatgatgtt

SEQ ID NO: 466159 - DNA, 20 bp, Artificial Sequence
  chemically synthesized
tattattcacactgaaattt

SEQ ID NO: 466160 - DNA, 20 bp, Artificial Sequence
  chemically synthesized
gtaaaaatcagccaaaattt

SEQ ID NO: 466161 - DNA, 20 bp, Artificial Sequence
  chemically synthesized
ctgtgaagataagtaaaaat

SEQ ID NO: 466162 - DNA, 20 bp, Artificial Sequence
  chemically synthesized
ctgatttttacttatcttca

SEQ ID NO: 466163 - DNA, 20 bp, Artificial Sequence
  chemically synthesized
ccttaaaaggctgtgaagat

SEQ ID NO: 466164 - DNA, 20 bp, Artificial Sequence
  chemically synthesized
tttacccttaaaaggctgtg

SEQ ID NO: 466165 - DNA, 20 bp, Artificial Sequence
  chemically synthesized
acttatcttcacagcctttt

SEQ ID NO: 466166 - DNA, 20 bp, Artificial Sequence
  chemically synthesized
cttatcttcacagcctttta

SEQ ID NO: 466167 - DNA, 20 bp, Artificial Sequence
  chemically synthesized
ttatcttcacagccttttaa

SEQ ID NO: 466168 - DNA, 20 bp, Artificial Sequence
  chemically synthesized
agagagtttttacccttaaa

SEQ ID NO: 466169 - DNA, 20 bp, Artificial Sequence
  chemically synthesized
aagagagtttttacccttaa

SEQ ID NO: 466170 - DNA, 20 bp, Artificial Sequence
  chemically synthesized
caaaagtacaattcagaaga

SEQ ID NO: 466171 - DNA, 20 bp, Artificial Sequence
  chemically synthesized
tgcaaaagtacaattcagaa

SEQ ID NO: 466172 - DNA, 20 bp, Artificial Sequence
  chemically synthesized
attgcaaaagtacaattcag

SEQ ID NO: 466173 - DNA, 20 bp, Artificial Sequence
  chemically synthesized
cttattgcaaaagtacaatt

SEQ ID NO: 466174 - DNA, 20 bp, Artificial Sequence
  chemically synthesized
ctgaattgtacttttgcaat

SEQ ID NO: 466175 - DNA, 20 bp, Artificial Sequence
  chemically synthesized
cacacaacatcttattgcaa

SEQ ID NO: 466176 - DNA, 20 bp, Artificial Sequence
  chemically synthesized
gcaataagatgttgtgtgct

SEQ ID NO: 466177 - DNA, 20 bp, Artificial Sequence
  chemically synthesized
caacgcagaaatgtggagct

SEQ ID NO: 466178 - DNA, 20 bp, Artificial Sequence
  chemically synthesized
ttttacaacgcagaaatgtg

SEQ ID NO: 466179 - DNA, 20 bp, Artificial Sequence
  chemically synthesized
tattttacaacgcagaaatg

SEQ ID NO: 466180 - DNA, 20 bp, Artificial Sequence
  chemically synthesized
gcatgctatattttacaacg

SEQ ID NO: 466181 - DNA, 20 bp, Artificial Sequence
  chemically synthesized
catttctgcgttgtaaaata

SEQ ID NO: 466182 - DNA, 20 bp, Artificial Sequence
  chemically synthesized
atagcatgcactttctcaaa

SEQ ID NO: 466183 - DNA, 20 bp, Artificial Sequence
  chemically synthesized
gaggcaaattccatttgaga

SEQ ID NO: 466184 - DNA, 20 bp, Artificial Sequence
  chemically synthesized
acaagaggcaaattccattt

SEQ ID NO: 466185 - DNA, 20 bp, Artificial Sequence
  chemically synthesized
atttgctatagagtcacaag

SEQ ID NO: 466186 - DNA, 20 bp, Artificial Sequence
  chemically synthesized
aatttgctatagagtcacaa

SEQ ID NO: 466187 - DNA, 20 bp, Artificial Sequence
  chemically synthesized
aaaatttgctatagagtcac

SEQ ID NO: 466188 - DNA, 20 bp, Artificial Sequence
  chemically synthesized
atttgcctcttgtgactcta

SEQ ID NO: 466189 - DNA, 20 bp, Artificial Sequence
  chemically synthesized
ttatttgaaaatttgctata

SEQ ID NO: 466190 - DNA, 20 bp, Artificial Sequence
  chemically synthesized
tcttatttgaaaatttgcta

SEQ ID NO: 466191 - DNA, 20 bp, Artificial Sequence
  chemically synthesized
tctatagcaaattttcaaat

SEQ ID NO: 466192 - DNA, 20 bp, Artificial Sequence
  chemically synthesized
tatagcaaattttcaaataa

SEQ ID NO: 466193 - DNA, 20 bp, Artificial Sequence
  chemically synthesized
atagcaaattttcaaataag

SEQ ID NO: 466194 - DNA, 20 bp, Artificial Sequence
  chemically synthesized
ttcaaataagaggatatttc

SEQ ID NO: 466195 - DNA, 20 bp, Artificial Sequence
  chemically synthesized
atattatttattttgcacac

SEQ ID NO: 466196 - DNA, 20 bp, Artificial Sequence
  chemically synthesized
attatttattttgcacactg

SEQ ID NO: 466197 - DNA, 20 bp, Artificial Sequence
  chemically synthesized
tgccagactttaaatatctc

SEQ ID NO: 466198 - DNA, 20 bp, Artificial Sequence
  chemically synthesized
ttgcacactggagatattta

SEQ ID NO: 466199 - DNA, 20 bp, Artificial Sequence
  chemically synthesized
cactggagatatttaaagtc

SEQ ID NO: 466200 - DNA, 20 bp, Artificial Sequence
  chemically synthesized
gggagaagcatacagggtgc

SEQ ID NO: 466201 - DNA, 20 bp, Artificial Sequence
  chemically synthesized
acccttgggagaagcataca

SEQ ID NO: 466202 - DNA, 20 bp, Artificial Sequence
  chemically synthesized
tacccttgggagaagcatac

SEQ ID NO: 466203 - DNA, 20 bp, Artificial Sequence
  chemically synthesized
ctacccttgggagaagcata

SEQ ID NO: 466204 - DNA, 20 bp, Artificial Sequence
  chemically synthesized
gcaccctgtatgcttctccc

SEQ ID NO: 466205 - DNA, 20 bp, Artificial Sequence
  chemically synthesized
caccctgtatgcttctccca

SEQ ID NO: 466206 - DNA, 20 bp, Artificial Sequence
  chemically synthesized
accctgtatgcttctcccaa

SEQ ID NO: 466207 - DNA, 20 bp, Artificial Sequence
  chemically synthesized
ataaagtctacccttgggag

SEQ ID NO: 466208 - DNA, 20 bp, Artificial Sequence
  chemically synthesized
ctgtatgcttctcccaaggg

SEQ ID NO: 466209 - DNA, 20 bp, Artificial Sequence
  chemically synthesized
agtataaagtctacccttgg

SEQ ID NO: 466210 - DNA, 20 bp, Artificial Sequence
  chemically synthesized
caagtataaagtctaccctt

SEQ ID NO: 466211 - DNA, 20 bp, Artificial Sequence
  chemically synthesized
tcaagtataaagtctaccct

SEQ ID NO: 466212 - DNA, 20 bp, Artificial Sequence
  chemically synthesized
aagtcaaaatatcaagtata

SEQ ID NO: 466213 - DNA, 20 bp, Artificial Sequence
  chemically synthesized
tcatctaaagtcaaaatatc

SEQ ID NO: 466214 - DNA, 20 bp, Artificial Sequence
  chemically synthesized
tatacttgatattttgactt

SEQ ID NO: 466215 - DNA, 20 bp, Artificial Sequence
  chemically synthesized
ttgatattttgactttagat

SEQ ID NO: 466216 - DNA, 20 bp, Artificial Sequence
  chemically synthesized
gtgaagaaatcactcatcta

SEQ ID NO: 466217 - DNA, 20 bp, Artificial Sequence
  chemically synthesized
agatgagtgatttcttcaca

SEQ ID NO: 466218 - DNA, 20 bp, Artificial Sequence
  chemically synthesized
atctaatttcttactttgtg

SEQ ID NO: 466219 - DNA, 20 bp, Artificial Sequence
  chemically synthesized
gagtgatttcttcacaaagt

SEQ ID NO: 466220 - DNA, 20 bp, Artificial Sequence
  chemically synthesized
ttcttcacaaagtaagaaat

SEQ ID NO: 466221 - DNA, 20 bp, Artificial Sequence
  chemically synthesized
cacaaagtaagaaattagat

SEQ ID NO: 466222 - DNA, 20 bp, Artificial Sequence
  chemically synthesized
aagaagttgtgtaagagatt

SEQ ID NO: 466223 - DNA, 20 bp, Artificial Sequence
  chemically synthesized
ttgttaaagaagttgtgtaa

SEQ ID NO: 466224 - DNA, 20 bp, Artificial Sequence
  chemically synthesized
acttgttaaagaagttgtgt

SEQ ID NO: 466225 - DNA, 20 bp, Artificial Sequence
  chemically synthesized
tcttacacaacttctttaac

SEQ ID NO: 466226 - DNA, 20 bp, Artificial Sequence
  chemically synthesized
catttatttacttgttaaag

SEQ ID NO: 466227 - DNA, 20 bp, Artificial Sequence
  chemically synthesized
tagcatttatttacttgtta

SEQ ID NO: 466228 - DNA, 20 bp, Artificial Sequence
  chemically synthesized
acaagtaaataaatgctatt

SEQ ID NO: 466229 - DNA, 20 bp, Artificial Sequence
  chemically synthesized
caagtaaataaatgctattc

SEQ ID NO: 466230 - DNA, 20 bp, Artificial Sequence
  chemically synthesized
acaaaatgcattttcctgaa

SEQ ID NO: 466231 - DNA, 20 bp, Artificial Sequence
  chemically synthesized
aacaaatactgattcacgat

SEQ ID NO: 466232 - DNA, 20 bp, Artificial Sequence
  chemically synthesized
taaaaatactaatcgtgaat

SEQ ID NO: 466233 - DNA, 20 bp, Artificial Sequence
  chemically synthesized
cgtgaatcagtatttgttaa

SEQ ID NO: 466234 - DNA, 20 bp, Artificial Sequence
  chemically synthesized
ggtataattgataacaatta

SEQ ID NO: 466235 - DNA, 20 bp, Artificial Sequence
  chemically synthesized
aagttttagagaaaattata

SEQ ID NO: 466236 - DNA, 20 bp, Artificial Sequence
  chemically synthesized
aggcaaacttggaagtttta

SEQ ID NO: 466237 - DNA, 20 bp, Artificial Sequence
  chemically synthesized
acaggcaaacttggaagttt

SEQ ID NO: 466238 - DNA, 20 bp, Artificial Sequence
  chemically synthesized
taattttctctaaaacttcc

SEQ ID NO: 466239 - DNA, 20 bp, Artificial Sequence
  chemically synthesized
cccaagacaggcaaacttgg

SEQ ID NO: 466240 - DNA, 20 bp, Artificial Sequence
  chemically synthesized
gcccccaagacaggcaaact

SEQ ID NO: 466241 - DNA, 20 bp, Artificial Sequence
  chemically synthesized
acttccaagtttgcctgtct

SEQ ID NO: 466242 - DNA, 20 bp, Artificial Sequence
  chemically synthesized
cttccaagtttgcctgtctt

SEQ ID NO: 466243 - DNA, 20 bp, Artificial Sequence
  chemically synthesized
ttccaagtttgcctgtcttg

SEQ ID NO: 466244 - DNA, 20 bp, Artificial Sequence
  chemically synthesized
tccaagtttgcctgtcttgg

SEQ ID NO: 466245 - DNA, 20 bp, Artificial Sequence
  chemically synthesized
accataagtgcccccaagac

SEQ ID NO: 466246 - DNA, 20 bp, Artificial Sequence
  chemically synthesized
aaccataagtgcccccaaga

SEQ ID NO: 466247 - DNA, 20 bp, Artificial Sequence
  chemically synthesized
ttcaaaccataagtgccccc

SEQ ID NO: 466248 - DNA, 20 bp, Artificial Sequence
  chemically synthesized
gcctgtcttgggggcactta

SEQ ID NO: 466249 - DNA, 20 bp, Artificial Sequence
  chemically synthesized
gtgttataatttcaaaccat

SEQ ID NO: 466250 - DNA, 20 bp, Artificial Sequence
  chemically synthesized
atggtttgaaattataacac

SEQ ID NO: 466251 - DNA, 20 bp, Artificial Sequence
  chemically synthesized
tttgaaattataacacaaga

SEQ ID NO: 466252 - DNA, 20 bp, Artificial Sequence
  chemically synthesized
attataacacaagaaagttt

SEQ ID NO: 466253 - DNA, 20 bp, Artificial Sequence
  chemically synthesized
gaaagtttaagtgttttcat

SEQ ID NO: 466254 - DNA, 20 bp, Artificial Sequence
  chemically synthesized
taaaatcatatgtttcctct

SEQ ID NO: 466255 - DNA, 20 bp, Artificial Sequence
  chemically synthesized
atacctaatacaaatctgag

SEQ ID NO: 466256 - DNA, 20 bp, Artificial Sequence
  chemically synthesized
aatacctaatacaaatctga

SEQ ID NO: 466257 - DNA, 20 bp, Artificial Sequence
  chemically synthesized
taaatacctaatacaaatct

SEQ ID NO: 466258 - DNA, 20 bp, Artificial Sequence
  chemically synthesized
gtttcctctcagatttgtat

SEQ ID NO: 466259 - DNA, 20 bp, Artificial Sequence
  chemically synthesized
tttcctctcagatttgtatt

SEQ ID NO: 466260 - DNA, 20 bp, Artificial Sequence
  chemically synthesized
tcagatttgtattaggtatt

SEQ ID NO: 466261 - DNA, 20 bp, Artificial Sequence
  chemically synthesized
gtattaggtatttagtttgt

SEQ ID NO: 466262 - DNA, 20 bp, Artificial Sequence
  chemically synthesized
tattaggtatttagtttgtt

SEQ ID NO: 466263 - DNA, 20 bp, Artificial Sequence
  chemically synthesized
aggtatttagtttgttagga

SEQ ID NO: 466264 - DNA, 20 bp, Artificial Sequence
  chemically synthesized
actttttgtggtagggggga

SEQ ID NO: 466265 - DNA, 20 bp, Artificial Sequence
  chemically synthesized
gtttactttttgtggtaggg

SEQ ID NO: 466266 - DNA, 20 bp, Artificial Sequence
  chemically synthesized
tgtttactttttgtggtagg

SEQ ID NO: 466267 - DNA, 20 bp, Artificial Sequence
  chemically synthesized
ctgtttactttttgtggtag

SEQ ID NO: 466268 - DNA, 20 bp, Artificial Sequence
  chemically synthesized
tctgtttactttttgtggta

SEQ ID NO: 466269 - DNA, 20 bp, Artificial Sequence
  chemically synthesized
gtctgtttactttttgtggt

SEQ ID NO: 466270 - DNA, 20 bp, Artificial Sequence
  chemically synthesized
gctatcccccctaccacaaa

SEQ ID NO: 466271 - DNA, 20 bp, Artificial Sequence
  chemically synthesized
tgtctgtttactttttgtgg

SEQ ID NO: 466272 - DNA, 20 bp, Artificial Sequence
  chemically synthesized
agctgtctgtttactttttg

SEQ ID NO: 466273 - DNA, 20 bp, Artificial Sequence
  chemically synthesized
cccctaccacaaaaagtaaa

SEQ ID NO: 466274 - DNA, 20 bp, Artificial Sequence
  chemically synthesized
taccacaaaaagtaaacaga

SEQ ID NO: 466275 - DNA, 20 bp, Artificial Sequence
  chemically synthesized
acaaaaagtaaacagacagc

SEQ ID NO: 466276 - DNA, 20 bp, Artificial Sequence
  chemically synthesized
taaacagacagctggtttca

SEQ ID NO: 466277 - DNA, 20 bp, Artificial Sequence
  chemically synthesized
tcataatgtaactatgaaac

SEQ ID NO: 466278 - DNA, 20 bp, Artificial Sequence
  chemically synthesized
tagttacattatgaaactat

SEQ ID NO: 466279 - DNA, 20 bp, Artificial Sequence
  chemically synthesized
agttacattatgaaactata

SEQ ID NO: 466280 - DNA, 20 bp, Artificial Sequence
  chemically synthesized
gctaaatgagttattcctta

SEQ ID NO: 466281 - DNA, 20 bp, Artificial Sequence
  chemically synthesized
actataaggaataactcatt

SEQ ID NO: 466282 - DNA, 20 bp, Artificial Sequence
  chemically synthesized
atatttcacatatgctaaat

SEQ ID NO: 466283 - DNA, 20 bp, Artificial Sequence
  chemically synthesized
ctatttcagaatagcgatat

SEQ ID NO: 466284 - DNA, 20 bp, Artificial Sequence
  chemically synthesized
aggaaaacactatttcagaa

SEQ ID NO: 466285 - DNA, 20 bp, Artificial Sequence
  chemically synthesized
ccaatatcgctattctgaaa

SEQ ID NO: 466286 - DNA, 20 bp, Artificial Sequence
  chemically synthesized
cccttaggaaaacactattt

SEQ ID NO: 466287 - DNA, 20 bp, Artificial Sequence
  chemically synthesized
ttctgaaatagtgttttcct

SEQ ID NO: 466288 - DNA, 20 bp, Artificial Sequence
  chemically synthesized
tctgaaatagtgttttccta

SEQ ID NO: 466289 - DNA, 20 bp, Artificial Sequence
  chemically synthesized
ctgaaatagtgttttcctaa

SEQ ID NO: 466290 - DNA, 20 bp, Artificial Sequence
  chemically synthesized
tgaaatagtgttttcctaag

SEQ ID NO: 466291 - DNA, 20 bp, Artificial Sequence
  chemically synthesized
cacacacaccataacccctt

SEQ ID NO: 466292 - DNA, 20 bp, Artificial Sequence
  chemically synthesized
acacacacaccataacccct

SEQ ID NO: 466293 - DNA, 20 bp, Artificial Sequence
  chemically synthesized
agtgttttcctaaggggtta

SEQ ID NO: 466294 - DNA, 20 bp, Artificial Sequence
  chemically synthesized
tgtgtgtgtgctttgtgtgc

SEQ ID NO: 466295 - DNA, 20 bp, Artificial Sequence
  chemically synthesized
tgtatgagtacttgcacaca

SEQ ID NO: 466296 - DNA, 20 bp, Artificial Sequence
  chemically synthesized
gtagaatagctaaaatgtat

SEQ ID NO: 466297 - DNA, 20 bp, Artificial Sequence
  chemically synthesized
gtgcaagtactcatacattt

SEQ ID NO: 466298 - DNA, 20 bp, Artificial Sequence
  chemically synthesized
aaaatcaaatggaagtagaa

SEQ ID NO: 466299 - DNA, 20 bp, Artificial Sequence
  chemically synthesized
atacaaaaatcaaatggaag

SEQ ID NO: 466300 - DNA, 20 bp, Artificial Sequence
  chemically synthesized
gttatacaaaaatcaaatgg

SEQ ID NO: 466301 - DNA, 20 bp, Artificial Sequence
  chemically synthesized
tttgttatacaaaaatcaaa

SEQ ID NO: 466302 - DNA, 20 bp, Artificial Sequence
  chemically synthesized
tgtgtatatcttgatatata

SEQ ID NO: 466303 - DNA, 20 bp, Artificial Sequence
  chemically synthesized
acaaataatccctatatatc

SEQ ID NO: 466304 - DNA, 20 bp, Artificial Sequence
  chemically synthesized
ttgtgtatatcttgatatat

SEQ ID NO: 466305 - DNA, 20 bp, Artificial Sequence
  chemically synthesized
gttgtgtatatcttgatata

SEQ ID NO: 466306 - DNA, 20 bp, Artificial Sequence
  chemically synthesized
atcaagatatacacaacaat

SEQ ID NO: 466307 - DNA, 20 bp, Artificial Sequence
  chemically synthesized
acacaacaatcagtaactta

SEQ ID NO: 466308 - DNA, 20 bp, Artificial Sequence
  chemically synthesized
aattatatctaataaactat

SEQ ID NO: 466309 - DNA, 20 bp, Artificial Sequence
  chemically synthesized
atcagtaacttatagtttat

SEQ ID NO: 466310 - DNA, 20 bp, Artificial Sequence
  chemically synthesized
tagatataatttataaatgc

SEQ ID NO: 466311 - DNA, 20 bp, Artificial Sequence
  chemically synthesized
aatgcaagaaataaacctga

SEQ ID NO: 466312 - DNA, 20 bp, Artificial Sequence
  chemically synthesized
aagaaataaacctgaaagat

SEQ ID NO: 466313 - DNA, 20 bp, Artificial Sequence
  chemically synthesized
atggactcaacttatctttc

SEQ ID NO: 466314 - DNA, 20 bp, Artificial Sequence
  chemically synthesized
tatggactcaacttatcttt

SEQ ID NO: 466315 - DNA, 20 bp, Artificial Sequence
  chemically synthesized
ataaacctgaaagataagtt

SEQ ID NO: 466316 - DNA, 20 bp, Artificial Sequence
  chemically synthesized
gaaatcttggtggattcata

SEQ ID NO: 466317 - DNA, 20 bp, Artificial Sequence
  chemically synthesized
tgagtccatatgaatccacc

SEQ ID NO: 466318 - DNA, 20 bp, Artificial Sequence
  chemically synthesized
ttattttagagaaatcttgg

SEQ ID NO: 466319 - DNA, 20 bp, Artificial Sequence
  chemically synthesized
atattattttagagaaatct

SEQ ID NO: 466320 - DNA, 20 bp, Artificial Sequence
  chemically synthesized
atgatatgtatattatttta

SEQ ID NO: 466321 - DNA, 20 bp, Artificial Sequence
  chemically synthesized
gaatgatatgtatattattt

SEQ ID NO: 466322 - DNA, 20 bp, Artificial Sequence
  chemically synthesized
ccagtattttcagagttgtg

SEQ ID NO: 466323 - DNA, 20 bp, Artificial Sequence
  chemically synthesized
ttgatataccagtattttca

SEQ ID NO: 466324 - DNA, 20 bp, Artificial Sequence
  chemically synthesized
ccacacaactctgaaaatac

SEQ ID NO: 466325 - DNA, 20 bp, Artificial Sequence
  chemically synthesized
aattgatataccagtatttt

SEQ ID NO: 466326 - DNA, 20 bp, Artificial Sequence
  chemically synthesized
aatagcagtaattgatatac

SEQ ID NO: 466327 - DNA, 20 bp, Artificial Sequence
  chemically synthesized
agactttttatgtaaaatag

SEQ ID NO: 466328 - DNA, 20 bp, Artificial Sequence
  chemically synthesized
cgaagactttttatgtaaaa

SEQ ID NO: 466329 - DNA, 20 bp, Artificial Sequence
  chemically synthesized
ttactgctattttacataaa

SEQ ID NO: 466330 - DNA, 20 bp, Artificial Sequence
  chemically synthesized
tattttacataaaaagtctt

SEQ ID NO: 466331 - DNA, 20 bp, Artificial Sequence
  chemically synthesized
cataaaaagtcttcggtgat

SEQ ID NO: 466332 - DNA, 20 bp, Artificial Sequence
  chemically synthesized
aatagatatgctaatcaccg

SEQ ID NO: 466333 - DNA, 20 bp, Artificial Sequence
  chemically synthesized
ggtgattagcatatctattt

SEQ ID NO: 466334 - DNA, 20 bp, Artificial Sequence
  chemically synthesized
tgattagcatatctatttta

SEQ ID NO: 466335 - DNA, 20 bp, Artificial Sequence
  chemically synthesized
gctattctcaatctctaaaa

SEQ ID NO: 466336 - DNA, 20 bp, Artificial Sequence
  chemically synthesized
gcatatctattttagagatt

SEQ ID NO: 466337 - DNA, 20 bp, Artificial Sequence
  chemically synthesized
tctattttagagattgagaa

SEQ ID NO: 466338 - DNA, 20 bp, Artificial Sequence
  chemically synthesized
aatacaacaaaaaaaacaca

SEQ ID NO: 466339 - DNA, 20 bp, Artificial Sequence
  chemically synthesized
tgttttttttgttgtattct

SEQ ID NO: 466340 - DNA, 20 bp, Artificial Sequence
  chemically synthesized
tggagaggctagtagaagcc

SEQ ID NO: 466341 - DNA, 20 bp, Artificial Sequence
  chemically synthesized
gttgtattcttggcttctac

SEQ ID NO: 466342 - DNA, 20 bp, Artificial Sequence
  chemically synthesized
taagctggagaggctagtag

SEQ ID NO: 466343 - DNA, 20 bp, Artificial Sequence
  chemically synthesized
gtttaagctggagaggctag

SEQ ID NO: 466344 - DNA, 20 bp, Artificial Sequence
  chemically synthesized
ttggcttctactagcctctc

SEQ ID NO: 466345 - DNA, 20 bp, Artificial Sequence
  chemically synthesized
agagtttaagctggagaggc

SEQ ID NO: 466346 - DNA, 20 bp, Artificial Sequence
  chemically synthesized
ggcaagagtttaagctggag

SEQ ID NO: 466347 - DNA, 20 bp, Artificial Sequence
  chemically synthesized
aggcaagagtttaagctgga

SEQ ID NO: 466348 - DNA, 20 bp, Artificial Sequence
  chemically synthesized
agaggcaagagtttaagctg

SEQ ID NO: 466349 - DNA, 20 bp, Artificial Sequence
  chemically synthesized
agagaggcaagagtttaagc

SEQ ID NO: 466350 - DNA, 20 bp, Artificial Sequence
  chemically synthesized
aggaagagaggcaagagttt

SEQ ID NO: 466351 - DNA, 20 bp, Artificial Sequence
  chemically synthesized
ataaagaggaagagaggcaa

SEQ ID NO: 466352 - DNA, 20 bp, Artificial Sequence
  chemically synthesized
gtataaagaggaagagaggc

SEQ ID NO: 466353 - DNA, 20 bp, Artificial Sequence
  chemically synthesized
taaagtataaagaggaagag

SEQ ID NO: 466354 - DNA, 20 bp, Artificial Sequence
  chemically synthesized
ataaagtataaagaggaaga

SEQ ID NO: 466355 - DNA, 20 bp, Artificial Sequence
  chemically synthesized
gaataaagtataaagaggaa

SEQ ID NO: 466356 - DNA, 20 bp, Artificial Sequence
  chemically synthesized
tggaataaagtataaagagg

SEQ ID NO: 466357 - DNA, 20 bp, Artificial Sequence
  chemically synthesized
ggctggaataaagtataaag

SEQ ID NO: 466358 - DNA, 20 bp, Artificial Sequence
  chemically synthesized
tggctggaataaagtataaa

SEQ ID NO: 466359 - DNA, 20 bp, Artificial Sequence
  chemically synthesized
tgtggctggaataaagtata

SEQ ID NO: 466360 - DNA, 20 bp, Artificial Sequence
  chemically synthesized
ttcctctttatactttattc

SEQ ID NO: 466361 - DNA, 20 bp, Artificial Sequence
  chemically synthesized
agtccattgtggctggaata

SEQ ID NO: 466362 - DNA, 20 bp, Artificial Sequence
  chemically synthesized
atactttattccagccacaa

SEQ ID NO: 466363 - DNA, 20 bp, Artificial Sequence
  chemically synthesized
aaatagaagtccattgtggc

SEQ ID NO: 466364 - DNA, 20 bp, Artificial Sequence
  chemically synthesized
gaaaaaatagaagtccattg

SEQ ID NO: 466365 - DNA, 20 bp, Artificial Sequence
  chemically synthesized
cattttagaagaaaaaatag

SEQ ID NO: 466366 - DNA, 20 bp, Artificial Sequence
  chemically synthesized
cagcattttagaagaaaaaa

SEQ ID NO: 466367 - DNA, 20 bp, Artificial Sequence
  chemically synthesized
gaaggagtccagcattttag

SEQ ID NO: 466368 - DNA, 20 bp, Artificial Sequence
  chemically synthesized
tattttttcttctaaaatgc

SEQ ID NO: 466369 - DNA, 20 bp, Artificial Sequence
  chemically synthesized
caggaaggagtccagcattt

SEQ ID NO: 466370 - DNA, 20 bp, Artificial Sequence
  chemically synthesized
atctgaaacaggaaggagtc

SEQ ID NO: 466371 - DNA, 20 bp, Artificial Sequence
  chemically synthesized
aaaatatctgaaacaggaag

SEQ ID NO: 466372 - DNA, 20 bp, Artificial Sequence
  chemically synthesized
ggaaaatatctgaaacagga

SEQ ID NO: 466373 - DNA, 20 bp, Artificial Sequence
  chemically synthesized
tgctggactccttcctgttt

SEQ ID NO: 466374 - DNA, 20 bp, Artificial Sequence
  chemically synthesized
cggaaaatatctgaaacagg

SEQ ID NO: 466375 - DNA, 20 bp, Artificial Sequence
  chemically synthesized
atacggaaaatatctgaaac

SEQ ID NO: 466376 - DNA, 20 bp, Artificial Sequence
  chemically synthesized
aatacggaaaatatctgaaa

SEQ ID NO: 466377 - DNA, 20 bp, Artificial Sequence
  chemically synthesized
tgaatagatgaaacagaata

SEQ ID NO: 466378 - DNA, 20 bp, Artificial Sequence
  chemically synthesized
agacttatgaatagatgaaa

SEQ ID NO: 466379 - DNA, 20 bp, Artificial Sequence
  chemically synthesized
attctgtttcatctattcat

SEQ ID NO: 466380 - DNA, 20 bp, Artificial Sequence
  chemically synthesized
cctcaagacagacttatgaa

SEQ ID NO: 466381 - DNA, 20 bp, Artificial Sequence
  chemically synthesized
tctattcataagtctgtctt

SEQ ID NO: 466382 - DNA, 20 bp, Artificial Sequence
  chemically synthesized
ctattcataagtctgtcttg

SEQ ID NO: 466383 - DNA, 20 bp, Artificial Sequence
  chemically synthesized
aattttcacaagcctcaaga

SEQ ID NO: 466384 - DNA, 20 bp, Artificial Sequence
  chemically synthesized
aattaattttcacaagcctc

SEQ ID NO: 466385 - DNA, 20 bp, Artificial Sequence
  chemically synthesized
tacaaaaaattaattttcac

SEQ ID NO: 466386 - DNA, 20 bp, Artificial Sequence
  chemically synthesized
ttttttgtaaaaatgtatac

SEQ ID NO: 466387 - DNA, 20 bp, Artificial Sequence
  chemically synthesized
aacatgtttcaatatacata

SEQ ID NO: 466388 - DNA, 20 bp, Artificial Sequence
  chemically synthesized
atatagtgaaatgattacta

SEQ ID NO: 466389 - DNA, 20 bp, Artificial Sequence
  chemically synthesized
tgaaatgattactacagtaa

SEQ ID NO: 466390 - DNA, 20 bp, Artificial Sequence
  chemically synthesized
tatgttaattacttttactg

SEQ ID NO: 466391 - DNA, 20 bp, Artificial Sequence
  chemically synthesized
agggtaaccatgtaagagga

SEQ ID NO: 466392 - DNA, 20 bp, Artificial Sequence
  chemically synthesized
aacatatccatcctcttaca

SEQ ID NO: 466393 - DNA, 20 bp, Artificial Sequence
  chemically synthesized
aaaaagggtaaccatgtaag

SEQ ID NO: 466394 - DNA, 20 bp, Artificial Sequence
  chemically synthesized
aaaaaagggtaaccatgtaa

SEQ ID NO: 466395 - DNA, 20 bp, Artificial Sequence
  chemically synthesized
caaaaaaagggtaaccatgt

SEQ ID NO: 466396 - DNA, 20 bp, Artificial Sequence
  chemically synthesized
tcaccaaatacacaaaaaaa

SEQ ID NO: 466397 - DNA, 20 bp, Artificial Sequence
  chemically synthesized
atcaccaaatacacaaaaaa

SEQ ID NO: 466398 - DNA, 20 bp, Artificial Sequence
  chemically synthesized
tatcaccaaatacacaaaaa

SEQ ID NO: 466399 - DNA, 20 bp, Artificial Sequence
  chemically synthesized
ttaccctttttttgtgtatt

SEQ ID NO: 466400 - DNA, 20 bp, Artificial Sequence
  chemically synthesized
tgtatttggtgataacactc

SEQ ID NO: 466401 - DNA, 20 bp, Artificial Sequence
  chemically synthesized
tgcactaagagagtaatctt

SEQ ID NO: 466402 - DNA, 20 bp, Artificial Sequence
  chemically synthesized
aacactcaagattactctct

SEQ ID NO: 466403 - DNA, 20 bp, Artificial Sequence
  chemically synthesized
cactacagtatgcactaaga

SEQ ID NO: 466404 - DNA, 20 bp, Artificial Sequence
  chemically synthesized
aacactacagtatgcactaa

SEQ ID NO: 466405 - DNA, 20 bp, Artificial Sequence
  chemically synthesized
ataacactacagtatgcact

SEQ ID NO: 466406 - DNA, 20 bp, Artificial Sequence
  chemically synthesized
tactctcttagtgcatactg

SEQ ID NO: 466407 - DNA, 20 bp, Artificial Sequence
  chemically synthesized
ggctatagttaataacacta

SEQ ID NO: 466408 - DNA, 20 bp, Artificial Sequence
  chemically synthesized
tactgtagtgttattaacta

SEQ ID NO: 466409 - DNA, 20 bp, Artificial Sequence
  chemically synthesized
aatgtgcaggataggggcta

SEQ ID NO: 466410 - DNA, 20 bp, Artificial Sequence
  chemically synthesized
agatctaatgtgcaggatag

SEQ ID NO: 466411 - DNA, 20 bp, Artificial Sequence
  chemically synthesized
gagatctaatgtgcaggata

SEQ ID NO: 466412 - DNA, 20 bp, Artificial Sequence
  chemically synthesized
agagatctaatgtgcaggat

SEQ ID NO: 466413 - DNA, 20 bp, Artificial Sequence
  chemically synthesized
tagagatctaatgtgcagga

SEQ ID NO: 466414 - DNA, 20 bp, Artificial Sequence
  chemically synthesized
atagcccctatcctgcacat

SEQ ID NO: 466415 - DNA, 20 bp, Artificial Sequence
  chemically synthesized
gttctagagatctaatgtgc

SEQ ID NO: 466416 - DNA, 20 bp, Artificial Sequence
  chemically synthesized
agttctagagatctaatgtg

SEQ ID NO: 466417 - DNA, 20 bp, Artificial Sequence
  chemically synthesized
tatcctgcacattagatctc

SEQ ID NO: 466418 - DNA, 20 bp, Artificial Sequence
  chemically synthesized
atcaggatgaataagttcta

SEQ ID NO: 466419 - DNA, 20 bp, Artificial Sequence
  chemically synthesized
ttatcaggatgaataagttc

SEQ ID NO: 466420 - DNA, 20 bp, Artificial Sequence
  chemically synthesized
ttttcattatcaggatgaat

SEQ ID NO: 466421 - DNA, 20 bp, Artificial Sequence
  chemically synthesized
gacacagagttttcattatc

SEQ ID NO: 466422 - DNA, 20 bp, Artificial Sequence
  chemically synthesized
ggacacagagttttcattat

SEQ ID NO: 466423 - DNA, 20 bp, Artificial Sequence
  chemically synthesized
gatattggtcaaaggacaca

SEQ ID NO: 466424 - DNA, 20 bp, Artificial Sequence
  chemically synthesized
aagatattggtcaaaggaca

SEQ ID NO: 466425 - DNA, 20 bp, Artificial Sequence
  chemically synthesized
aatgggaagatattggtcaa

SEQ ID NO: 466426 - DNA, 20 bp, Artificial Sequence
  chemically synthesized
gaatgggaagatattggtca

SEQ ID NO: 466427 - DNA, 20 bp, Artificial Sequence
  chemically synthesized
gggggagaatgggaagatat

SEQ ID NO: 466428 - DNA, 20 bp, Artificial Sequence
  chemically synthesized
agagggagggggagaatggg

SEQ ID NO: 466429 - DNA, 20 bp, Artificial Sequence
  chemically synthesized
ggcagagggagggggagaat

SEQ ID NO: 466430 - DNA, 20 bp, Artificial Sequence
  chemically synthesized
gggcagagggagggggagaa

SEQ ID NO: 466431 - DNA, 20 bp, Artificial Sequence
  chemically synthesized
accaagggcagagggagggg

SEQ ID NO: 466432 - DNA, 20 bp, Artificial Sequence
  chemically synthesized
ttaccaagggcagagggagg

SEQ ID NO: 466433 - DNA, 20 bp, Artificial Sequence
  chemically synthesized
gttaccaagggcagagggag

SEQ ID NO: 466434 - DNA, 20 bp, Artificial Sequence
  chemically synthesized
tgttaccaagggcagaggga

SEQ ID NO: 466435 - DNA, 20 bp, Artificial Sequence
  chemically synthesized
ttgttaccaagggcagaggg

SEQ ID NO: 466436 - DNA, 20 bp, Artificial Sequence
  chemically synthesized
attgttaccaagggcagagg

SEQ ID NO: 466437 - DNA, 20 bp, Artificial Sequence
  chemically synthesized
tgattgttaccaagggcaga

SEQ ID NO: 466438 - DNA, 20 bp, Artificial Sequence
  chemically synthesized
tctccccctccctctgccct

SEQ ID NO: 466439 - DNA, 20 bp, Artificial Sequence
  chemically synthesized
ttgattgttaccaagggcag

SEQ ID NO: 466440 - DNA, 20 bp, Artificial Sequence
  chemically synthesized
attgattgttaccaagggca

SEQ ID NO: 466441 - DNA, 20 bp, Artificial Sequence
  chemically synthesized
agattgattgttaccaaggg

SEQ ID NO: 466442 - DNA, 20 bp, Artificial Sequence
  chemically synthesized
ggtagattgattgttaccaa

SEQ ID NO: 466443 - DNA, 20 bp, Artificial Sequence
  chemically synthesized
gggtagattgattgttacca

SEQ ID NO: 466444 - DNA, 20 bp, Artificial Sequence
  chemically synthesized
agggtagattgattgttacc

SEQ ID NO: 466445 - DNA, 20 bp, Artificial Sequence
  chemically synthesized
agctataaagaagcagaggg

SEQ ID NO: 466446 - DNA, 20 bp, Artificial Sequence
  chemically synthesized
gtcagctataaagaagcaga

SEQ ID NO: 466447 - DNA, 20 bp, Artificial Sequence
  chemically synthesized
agtcagctataaagaagcag

SEQ ID NO: 466448 - DNA, 20 bp, Artificial Sequence
  chemically synthesized
cagtcagctataaagaagca

SEQ ID NO: 466449 - DNA, 20 bp, Artificial Sequence
  chemically synthesized
aacagtcagctataaagaag

SEQ ID NO: 466450 - DNA, 20 bp, Artificial Sequence
  chemically synthesized
atctaccctctgcttcttta

SEQ ID NO: 466451 - DNA, 20 bp, Artificial Sequence
  chemically synthesized
ctgaacagtcagctataaag

SEQ ID NO: 466452 - DNA, 20 bp, Artificial Sequence
  chemically synthesized
aatctgaacagtcagctata

SEQ ID NO: 466453 - DNA, 20 bp, Artificial Sequence
  chemically synthesized
cttctttatagctgactgtt

SEQ ID NO: 466454 - DNA, 20 bp, Artificial Sequence
  chemically synthesized
acatgtaaaatctgaacagt

SEQ ID NO: 466455 - DNA, 20 bp, Artificial Sequence
  chemically synthesized
acttacatgtaaaatctgaa

SEQ ID NO: 466456 - DNA, 20 bp, Artificial Sequence
  chemically synthesized
actgttcagattttacatgt

SEQ ID NO: 466457 - DNA, 20 bp, Artificial Sequence
  chemically synthesized
ttcagattttacatgtaagt

SEQ ID NO: 466458 - DNA, 20 bp, Artificial Sequence
  chemically synthesized
tacatgtaagtgagatcatg

SEQ ID NO: 466459 - DNA, 20 bp, Artificial Sequence
  chemically synthesized
tgaaataagccaggcatagg

SEQ ID NO: 466460 - DNA, 20 bp, Artificial Sequence
  chemically synthesized
agtattattcttcctatgcc

SEQ ID NO: 466461 - DNA, 20 bp, Artificial Sequence
  chemically synthesized
aagtgaaataagccaggcat

SEQ ID NO: 466462 - DNA, 20 bp, Artificial Sequence
  chemically synthesized
taagtgaaataagccaggca

SEQ ID NO: 466463 - DNA, 20 bp, Artificial Sequence
  chemically synthesized
tacgctaagtgaaataagcc

SEQ ID NO: 466464 - DNA, 20 bp, Artificial Sequence
  chemically synthesized
ttacgctaagtgaaataagc

SEQ ID NO: 466465 - DNA, 20 bp, Artificial Sequence
  chemically synthesized
aacattacgctaagtgaaat

SEQ ID NO: 466466 - DNA, 20 bp, Artificial Sequence
  chemically synthesized
tatgcctggcttatttcact

SEQ ID NO: 466467 - DNA, 20 bp, Artificial Sequence
  chemically synthesized
aacctgaagaacattacgct

SEQ ID NO: 466468 - DNA, 20 bp, Artificial Sequence
  chemically synthesized
tcacttagcgtaatgttctt

SEQ ID NO: 466469 - DNA, 20 bp, Artificial Sequence
  chemically synthesized
cacttagcgtaatgttcttc

SEQ ID NO: 466470 - DNA, 20 bp, Artificial Sequence
  chemically synthesized
tgataatgtgggtgaacctg

SEQ ID NO: 466471 - DNA, 20 bp, Artificial Sequence
  chemically synthesized
cctgctatttgtgataatgt

SEQ ID NO: 466472 - DNA, 20 bp, Artificial Sequence
  chemically synthesized
tcctgctatttgtgataatg

SEQ ID NO: 466473 - DNA, 20 bp, Artificial Sequence
  chemically synthesized
ttcacccacattatcacaaa

SEQ ID NO: 466474 - DNA, 20 bp, Artificial Sequence
  chemically synthesized
acccacattatcacaaatag

SEQ ID NO: 466475 - DNA, 20 bp, Artificial Sequence
  chemically synthesized
cccacattatcacaaatagc

SEQ ID NO: 466476 - DNA, 20 bp, Artificial Sequence
  chemically synthesized
agcaggatttccttcctttg

SEQ ID NO: 466477 - DNA, 20 bp, Artificial Sequence
  chemically synthesized
aatatttagcctacaaagga

SEQ ID NO: 466478 - DNA, 20 bp, Artificial Sequence
  chemically synthesized
gcaggatttccttcctttgt

SEQ ID NO: 466479 - DNA, 20 bp, Artificial Sequence
  chemically synthesized
taatatttagcctacaaagg

SEQ ID NO: 466480 - DNA, 20 bp, Artificial Sequence
  chemically synthesized
aaataatatttagcctacaa

SEQ ID NO: 466481 - DNA, 20 bp, Artificial Sequence
  chemically synthesized
gaaataatatttagcctaca

SEQ ID NO: 466482 - DNA, 20 bp, Artificial Sequence
  chemically synthesized
aaatataatgaaataatatt

SEQ ID NO: 466483 - DNA, 20 bp, Artificial Sequence
  chemically synthesized
catcaacagataaattaata

SEQ ID NO: 466484 - DNA, 20 bp, Artificial Sequence
  chemically synthesized
acaacctgagtgtacatcaa

SEQ ID NO: 466485 - DNA, 20 bp, Artificial Sequence
  chemically synthesized
tttatctgttgatgtacact

SEQ ID NO: 466486 - DNA, 20 bp, Artificial Sequence
  chemically synthesized
ttatctgttgatgtacactc

SEQ ID NO: 466487 - DNA, 20 bp, Artificial Sequence
  chemically synthesized
ccaaggcatgaaaacaacct

SEQ ID NO: 466488 - DNA, 20 bp, Artificial Sequence
  chemically synthesized
ctcaggttgttttcatgcct

SEQ ID NO: 466489 - DNA, 20 bp, Artificial Sequence
  chemically synthesized
agagttattcacaatagcca

SEQ ID NO: 466490 - DNA, 20 bp, Artificial Sequence
  chemically synthesized
cagagttattcacaatagcc

SEQ ID NO: 466491 - DNA, 20 bp, Artificial Sequence
  chemically synthesized
cagtgcagagttattcacaa

SEQ ID NO: 466492 - DNA, 20 bp, Artificial Sequence
  chemically synthesized
gcactcccatgttcagtgca

SEQ ID NO: 466493 - DNA, 20 bp, Artificial Sequence
  chemically synthesized
ctgcactcccatgttcagtg

SEQ ID NO: 466494 - DNA, 20 bp, Artificial Sequence
  chemically synthesized
gaataactctgcactgaaca

SEQ ID NO: 466495 - DNA, 20 bp, Artificial Sequence
  chemically synthesized
aataactctgcactgaacat

SEQ ID NO: 466496 - DNA, 20 bp, Artificial Sequence
  chemically synthesized
taactctgcactgaacatgg

SEQ ID NO: 466497 - DNA, 20 bp, Artificial Sequence
  chemically synthesized
gatatctgcactcccatgtt

SEQ ID NO: 466498 - DNA, 20 bp, Artificial Sequence
  chemically synthesized
ctgcactgaacatgggagtg

SEQ ID NO: 466499 - DNA, 20 bp, Artificial Sequence
  chemically synthesized
gggagtgcagatatctcatc

SEQ ID NO: 466500 - DNA, 20 bp, Artificial Sequence
  chemically synthesized
aatgaaatcagtatctagat

SEQ ID NO: 466501 - DNA, 20 bp, Artificial Sequence
  chemically synthesized
aaggaaatgaaatcagtatc

SEQ ID NO: 466502 - DNA, 20 bp, Artificial Sequence
  chemically synthesized
atataaaaaggaaatgaaat

SEQ ID NO: 466503 - DNA, 20 bp, Artificial Sequence
  chemically synthesized
tcttttgggtatatataaaa

SEQ ID NO: 466504 - DNA, 20 bp, Artificial Sequence
  chemically synthesized
ctcttttgggtatatataaa

SEQ ID NO: 466505 - DNA, 20 bp, Artificial Sequence
  chemically synthesized
tcctttttatatatacccaa

SEQ ID NO: 466506 - DNA, 20 bp, Artificial Sequence
  chemically synthesized
ctttttatatatacccaaaa

SEQ ID NO: 466507 - DNA, 20 bp, Artificial Sequence
  chemically synthesized
tttatatatacccaaaagag

SEQ ID NO: 466508 - DNA, 20 bp, Artificial Sequence
  chemically synthesized
gatcaaattaccactctttt

SEQ ID NO: 466509 - DNA, 20 bp, Artificial Sequence
  chemically synthesized
ggatcaaattaccactcttt

SEQ ID NO: 466510 - DNA, 20 bp, Artificial Sequence
  chemically synthesized
aaagagtggtaatttgatcc

SEQ ID NO: 466511 - DNA, 20 bp, Artificial Sequence
  chemically synthesized
aagagtggtaatttgatcct

SEQ ID NO: 466512 - DNA, 20 bp, Artificial Sequence
  chemically synthesized
agagtggtaatttgatccta

SEQ ID NO: 466513 - DNA, 20 bp, Artificial Sequence
  chemically synthesized
agttaaaatacgaatgccct

SEQ ID NO: 466514 - DNA, 20 bp, Artificial Sequence
  chemically synthesized
aagttaaaatacgaatgccc

SEQ ID NO: 466515 - DNA, 20 bp, Artificial Sequence
  chemically synthesized
cattcgtattttaacttttt

SEQ ID NO: 466516 - DNA, 20 bp, Artificial Sequence
  chemically synthesized
attcgtattttaactttttg

SEQ ID NO: 466517 - DNA, 20 bp, Artificial Sequence
  chemically synthesized
cagtatggagattcctcaaa

SEQ ID NO: 466518 - DNA, 20 bp, Artificial Sequence
  chemically synthesized
ccattatggaaaacagtatg

SEQ ID NO: 466519 - DNA, 20 bp, Artificial Sequence
  chemically synthesized
agccattatggaaaacagta

SEQ ID NO: 466520 - DNA, 20 bp, Artificial Sequence
  chemically synthesized
tgtatagccattatggaaaa

SEQ ID NO: 466521 - DNA, 20 bp, Artificial Sequence
  chemically synthesized
ctccatactgttttccataa

SEQ ID NO: 466522 - DNA, 20 bp, Artificial Sequence
  chemically synthesized
gtaaatttgtatagccatta

SEQ ID NO: 466523 - DNA, 20 bp, Artificial Sequence
  chemically synthesized
ggcgggaatgtaaatttgta

SEQ ID NO: 466524 - DNA, 20 bp, Artificial Sequence
  chemically synthesized
aatccttatacattgttggc

SEQ ID NO: 466525 - DNA, 20 bp, Artificial Sequence
  chemically synthesized
gaatccttatacattgttgg

SEQ ID NO: 466526 - DNA, 20 bp, Artificial Sequence
  chemically synthesized
agggaatccttatacattgt

SEQ ID NO: 466527 - DNA, 20 bp, Artificial Sequence
  chemically synthesized
cattcccgccaacaatgtat

SEQ ID NO: 466528 - DNA, 20 bp, Artificial Sequence
  chemically synthesized
attcccgccaacaatgtata

SEQ ID NO: 466529 - DNA, 20 bp, Artificial Sequence
  chemically synthesized
tggcaagaatgtggataaaa

SEQ ID NO: 466530 - DNA, 20 bp, Artificial Sequence
  chemically synthesized
ttggcaagaatgtggataaa

SEQ ID NO: 466531 - DNA, 20 bp, Artificial Sequence
  chemically synthesized
tttggcaagaatgtggataa

SEQ ID NO: 466532 - DNA, 20 bp, Artificial Sequence
  chemically synthesized
aacaagttttggcaagaatg

SEQ ID NO: 466533 - DNA, 20 bp, Artificial Sequence
  chemically synthesized
aaaaaataacaagttttggc

SEQ ID NO: 466534 - DNA, 20 bp, Artificial Sequence
  chemically synthesized
ataaaaaaaataacaagttt

SEQ ID NO: 466535 - DNA, 20 bp, Artificial Sequence
  chemically synthesized
aaaaagataaaaaaaataac

SEQ ID NO: 466536 - DNA, 20 bp, Artificial Sequence
  chemically synthesized
ttaggatggctattatcaaa

SEQ ID NO: 466537 - DNA, 20 bp, Artificial Sequence
  chemically synthesized
tttttttatctttttgataa

SEQ ID NO: 466538 - DNA, 20 bp, Artificial Sequence
  chemically synthesized
ttgataatagccatcctaac

SEQ ID NO: 466539 - DNA, 20 bp, Artificial Sequence
  chemically synthesized
tcacctcaaacttgttagga

SEQ ID NO: 466540 - DNA, 20 bp, Artificial Sequence
  chemically synthesized
aatatcacctcaaacttgtt

SEQ ID NO: 466541 - DNA, 20 bp, Artificial Sequence
  chemically synthesized
aaatatcacctcaaacttgt

SEQ ID NO: 466542 - DNA, 20 bp, Artificial Sequence
  chemically synthesized
atagccatcctaacaagttt

SEQ ID NO: 466543 - DNA, 20 bp, Artificial Sequence
  chemically synthesized
tagccatcctaacaagtttg

SEQ ID NO: 466544 - DNA, 20 bp, Artificial Sequence
  chemically synthesized
ggaaatgcaaattaaagcaa

SEQ ID NO: 466545 - DNA, 20 bp, Artificial Sequence
  chemically synthesized
catcaaggaaatgcaaatta

SEQ ID NO: 466546 - DNA, 20 bp, Artificial Sequence
  chemically synthesized
atttgcatttccttgatgat

SEQ ID NO: 466547 - DNA, 20 bp, Artificial Sequence
  chemically synthesized
ctcaaaagcgctaatcatca

SEQ ID NO: 466548 - DNA, 20 bp, Artificial Sequence
  chemically synthesized
tctcaaaagcgctaatcatc

SEQ ID NO: 466549 - DNA, 20 bp, Artificial Sequence
  chemically synthesized
ccttgatgattagcgctttt

SEQ ID NO: 466550 - DNA, 20 bp, Artificial Sequence
  chemically synthesized
gtatatgaaaagattctcaa

SEQ ID NO: 466551 - DNA, 20 bp, Artificial Sequence
  chemically synthesized
atggccaacaggtatatgaa

SEQ ID NO: 466552 - DNA, 20 bp, Artificial Sequence
  chemically synthesized
gaatcttttcatatacctgt

SEQ ID NO: 466553 - DNA, 20 bp, Artificial Sequence
  chemically synthesized
aagacatgcaaatggccaac

SEQ ID NO: 466554 - DNA, 20 bp, Artificial Sequence
  chemically synthesized
gaagacatgcaaatggccaa

SEQ ID NO: 466555 - DNA, 20 bp, Artificial Sequence
  chemically synthesized
ctccaaagaagacatgcaaa

SEQ ID NO: 466556 - DNA, 20 bp, Artificial Sequence
  chemically synthesized
ggccatttgcatgtcttctt

SEQ ID NO: 466557 - DNA, 20 bp, Artificial Sequence
  chemically synthesized
ccatttgcatgtcttctttg

SEQ ID NO: 466558 - DNA, 20 bp, Artificial Sequence
  chemically synthesized
gaatagacagttctccaaag

SEQ ID NO: 466559 - DNA, 20 bp, Artificial Sequence
  chemically synthesized
cctgaatagacagttctcca

SEQ ID NO: 466560 - DNA, 20 bp, Artificial Sequence
  chemically synthesized
tctttggagaactgtctatt

SEQ ID NO: 466561 - DNA, 20 bp, Artificial Sequence
  chemically synthesized
ctttggagaactgtctattc

SEQ ID NO: 466562 - DNA, 20 bp, Artificial Sequence
  chemically synthesized
ggtcaaagcccctgaataga

SEQ ID NO: 466563 - DNA, 20 bp, Artificial Sequence
  chemically synthesized
tttggagaactgtctattca

SEQ ID NO: 466564 - DNA, 20 bp, Artificial Sequence
  chemically synthesized
ttggagaactgtctattcag

SEQ ID NO: 466565 - DNA, 20 bp, Artificial Sequence
  chemically synthesized
aaatggtcaaagcccctgaa

SEQ ID NO: 466566 - DNA, 20 bp, Artificial Sequence
  chemically synthesized
aatctgattaaaaatggtca

SEQ ID NO: 466567 - DNA, 20 bp, Artificial Sequence
  chemically synthesized
acaaaaaatctgattaaaaa

SEQ ID NO: 466568 - DNA, 20 bp, Artificial Sequence
  chemically synthesized
gggctttgaccatttttaat

SEQ ID NO: 466569 - DNA, 20 bp, Artificial Sequence
  chemically synthesized
tttgtttgtgtgttttgctt

SEQ ID NO: 466570 - DNA, 20 bp, Artificial Sequence
  chemically synthesized
gtgtgttttgcttgagctct

SEQ ID NO: 466571 - DNA, 20 bp, Artificial Sequence
  chemically synthesized
atatgaggaactcagagctc

SEQ ID NO: 466572 - DNA, 20 bp, Artificial Sequence
  chemically synthesized
caaaatatatgaggaactca

SEQ ID NO: 466573 - DNA, 20 bp, Artificial Sequence
  chemically synthesized
tccaaaatatatgaggaact

SEQ ID NO: 466574 - DNA, 20 bp, Artificial Sequence
  chemically synthesized
gctttcatccaaaatatatg

SEQ ID NO: 466575 - DNA, 20 bp, Artificial Sequence
  chemically synthesized
agctttcatccaaaatatat

SEQ ID NO: 466576 - DNA, 20 bp, Artificial Sequence
  chemically synthesized
tctgagttcctcatatattt

SEQ ID NO: 466577 - DNA, 20 bp, Artificial Sequence
  chemically synthesized
tcctcatatattttggatga

SEQ ID NO: 466578 - DNA, 20 bp, Artificial Sequence
  chemically synthesized
tttggatgaaagctgcatat

SEQ ID NO: 466579 - DNA, 20 bp, Artificial Sequence
  chemically synthesized
caaaccatatgaccaatatg

SEQ ID NO: 466580 - DNA, 20 bp, Artificial Sequence
  chemically synthesized
aaagctgcatattggtcata

SEQ ID NO: 466581 - DNA, 20 bp, Artificial Sequence
  chemically synthesized
tgtggaatgggagaatatat

SEQ ID NO: 466582 - DNA, 20 bp, Artificial Sequence
  chemically synthesized
aagagacaactgtggaatgg

SEQ ID NO: 466583 - DNA, 20 bp, Artificial Sequence
  chemically synthesized
taatatattctcccattcca

SEQ ID NO: 466584 - DNA, 20 bp, Artificial Sequence
  chemically synthesized
tgaagagacaactgtggaat

SEQ ID NO: 466585 - DNA, 20 bp, Artificial Sequence
  chemically synthesized
gtgaagagacaactgtggaa

SEQ ID NO: 466586 - DNA, 20 bp, Artificial Sequence
  chemically synthesized
acagagtgaagagacaactg

SEQ ID NO: 466587 - DNA, 20 bp, Artificial Sequence
  chemically synthesized
gaaacaattaacagagtgaa

SEQ ID NO: 466588 - DNA, 20 bp, Artificial Sequence
  chemically synthesized
aggaaacaattaacagagtg

SEQ ID NO: 466589 - DNA, 20 bp, Artificial Sequence
  chemically synthesized
agcataggaaacaattaaca

SEQ ID NO: 466590 - DNA, 20 bp, Artificial Sequence
  chemically synthesized
acagcataggaaacaattaa

SEQ ID NO: 466591 - DNA, 20 bp, Artificial Sequence
  chemically synthesized
ataaaccttctgtacagcat

SEQ ID NO: 466592 - DNA, 20 bp, Artificial Sequence
  chemically synthesized
taattgtttcctatgctgta

SEQ ID NO: 466593 - DNA, 20 bp, Artificial Sequence
  chemically synthesized
cataaaccttctgtacagca

SEQ ID NO: 466594 - DNA, 20 bp, Artificial Sequence
  chemically synthesized
ttgtttcctatgctgtacag

SEQ ID NO: 466595 - DNA, 20 bp, Artificial Sequence
  chemically synthesized
tgtttcctatgctgtacaga

SEQ ID NO: 466596 - DNA, 20 bp, Artificial Sequence
  chemically synthesized
caaaccataaaccttctgta

SEQ ID NO: 466597 - DNA, 20 bp, Artificial Sequence
  chemically synthesized
tatgctgtacagaaggttta

SEQ ID NO: 466598 - DNA, 20 bp, Artificial Sequence
  chemically synthesized
agaaggtttatggtttgccg

SEQ ID NO: 466599 - DNA, 20 bp, Artificial Sequence
  chemically synthesized
aaattaaacaagttgtacta

SEQ ID NO: 466600 - DNA, 20 bp, Artificial Sequence
  chemically synthesized
cagtaaaatcaaaattaaac

SEQ ID NO: 466601 - DNA, 20 bp, Artificial Sequence
  chemically synthesized
tatgacatgaaaagcacaga

SEQ ID NO: 466602 - DNA, 20 bp, Artificial Sequence
  chemically synthesized
tagatatgacatgaaaagca

SEQ ID NO: 466603 - DNA, 20 bp, Artificial Sequence
  chemically synthesized
ttttttagatatgacatgaa

SEQ ID NO: 466604 - DNA, 20 bp, Artificial Sequence
  chemically synthesized
tggtcttggcaatgattttt

SEQ ID NO: 466605 - DNA, 20 bp, Artificial Sequence
  chemically synthesized
atatctaaaaaatcattgcc

SEQ ID NO: 466606 - DNA, 20 bp, Artificial Sequence
  chemically synthesized
taaattctcgaaattggtct

SEQ ID NO: 466607 - DNA, 20 bp, Artificial Sequence
  chemically synthesized
tcattgccaagaccaatttc

SEQ ID NO: 466608 - DNA, 20 bp, Artificial Sequence
  chemically synthesized
aaaaaataaattctcgaaat

SEQ ID NO: 466609 - DNA, 20 bp, Artificial Sequence
  chemically synthesized
ttttttcatgcactttcttc

SEQ ID NO: 466610 - DNA, 20 bp, Artificial Sequence
  chemically synthesized
tttttcatgcactttcttct

SEQ ID NO: 466611 - DNA, 20 bp, Artificial Sequence
  chemically synthesized
actacaaaattcctagaaga

SEQ ID NO: 466612 - DNA, 20 bp, Artificial Sequence
  chemically synthesized
tgaaactacaaaattcctag

SEQ ID NO: 466613 - DNA, 20 bp, Artificial Sequence
  chemically synthesized
acctgaaactacaaaattcc

SEQ ID NO: 466614 - DNA, 20 bp, Artificial Sequence
  chemically synthesized
actttcttctaggaattttg

SEQ ID NO: 466615 - DNA, 20 bp, Artificial Sequence
  chemically synthesized
ttctaggaattttgtagttt

SEQ ID NO: 466616 - DNA, 20 bp, Artificial Sequence
  chemically synthesized
tctaggaattttgtagtttc

SEQ ID NO: 466617 - DNA, 20 bp, Artificial Sequence
  chemically synthesized
ttgattaaagaattaaatgt

SEQ ID NO: 466618 - DNA, 20 bp, Artificial Sequence
  chemically synthesized
agtcagctaaaaattgatta

SEQ ID NO: 466619 - DNA, 20 bp, Artificial Sequence
  chemically synthesized
ttaattctttaatcaatttt

SEQ ID NO: 466620 - DNA, 20 bp, Artificial Sequence
  chemically synthesized
ttacatcacacaacaaaagt

SEQ ID NO: 466621 - DNA, 20 bp, Artificial Sequence
  chemically synthesized
acccttacatcacacaacaa

SEQ ID NO: 466622 - DNA, 20 bp, Artificial Sequence
  chemically synthesized
tgacttttgttgtgtgatgt

SEQ ID NO: 466623 - DNA, 20 bp, Artificial Sequence
  chemically synthesized
gacttttgttgtgtgatgta

SEQ ID NO: 466624 - DNA, 20 bp, Artificial Sequence
  chemically synthesized
acttttgttgtgtgatgtaa

SEQ ID NO: 466625 - DNA, 20 bp, Artificial Sequence
  chemically synthesized
cacatgctaaagaataaaat

SEQ ID NO: 466626 - DNA, 20 bp, Artificial Sequence
  chemically synthesized
aagggtccaattttattctt

SEQ ID NO: 466627 - DNA, 20 bp, Artificial Sequence
  chemically synthesized
aactggatatacacatgcta

SEQ ID NO: 466628 - DNA, 20 bp, Artificial Sequence
  chemically synthesized
ttctttagcatgtgtatatc

SEQ ID NO: 466629 - DNA, 20 bp, Artificial Sequence
  chemically synthesized
ataaatggtgtttgaaaaac

SEQ ID NO: 466630 - DNA, 20 bp, Artificial Sequence
  chemically synthesized
ttttcaaacaccatttatta

SEQ ID NO: 466631 - DNA, 20 bp, Artificial Sequence
  chemically synthesized
aggatattctctttaataaa

SEQ ID NO: 466632 - DNA, 20 bp, Artificial Sequence
  chemically synthesized
ttcaaacaccatttattaaa

SEQ ID NO: 466633 - DNA, 20 bp, Artificial Sequence
  chemically synthesized
aagagaatatcctttcctca

SEQ ID NO: 466634 - DNA, 20 bp, Artificial Sequence
  chemically synthesized
caagagtacactatgaggaa

SEQ ID NO: 466635 - DNA, 20 bp, Artificial Sequence
  chemically synthesized
acaagagtacactatgagga

SEQ ID NO: 466636 - DNA, 20 bp, Artificial Sequence
  chemically synthesized
ggcaacaagagtacactatg

SEQ ID NO: 466637 - DNA, 20 bp, Artificial Sequence
  chemically synthesized
gggcaacaagagtacactat

SEQ ID NO: 466638 - DNA, 20 bp, Artificial Sequence
  chemically synthesized
aattttgagaagggcaacaa

SEQ ID NO: 466639 - DNA, 20 bp, Artificial Sequence
  chemically synthesized
taaattttgagaagggcaac

SEQ ID NO: 466640 - DNA, 20 bp, Artificial Sequence
  chemically synthesized
ggtcaactaaattttgagaa

SEQ ID NO: 466641 - DNA, 20 bp, Artificial Sequence
  chemically synthesized
tggtcaactaaattttgaga

SEQ ID NO: 466642 - DNA, 20 bp, Artificial Sequence
  chemically synthesized
atggtcaactaaattttgag

SEQ ID NO: 466643 - DNA, 20 bp, Artificial Sequence
  chemically synthesized
ttgttgcccttctcaaaatt

SEQ ID NO: 466644 - DNA, 20 bp, Artificial Sequence
  chemically synthesized
tatatggtcaactaaatttt

SEQ ID NO: 466645 - DNA, 20 bp, Artificial Sequence
  chemically synthesized
taaataaacccattcatata

SEQ ID NO: 466646 - DNA, 20 bp, Artificial Sequence
  chemically synthesized
tttagttgaccatatatgaa

SEQ ID NO: 466647 - DNA, 20 bp, Artificial Sequence
  chemically synthesized
ttagttgaccatatatgaat

SEQ ID NO: 466648 - DNA, 20 bp, Artificial Sequence
  chemically synthesized
tatatgaatgggtttattta

SEQ ID NO: 466649 - DNA, 20 bp, Artificial Sequence
  chemically synthesized
atatgaatgggtttatttat

SEQ ID NO: 466650 - DNA, 20 bp, Artificial Sequence
  chemically synthesized
gaccaatgcaacagaatgga

SEQ ID NO: 466651 - DNA, 20 bp, Artificial Sequence
  chemically synthesized
agaccaatgcaacagaatgg

SEQ ID NO: 466652 - DNA, 20 bp, Artificial Sequence
  chemically synthesized
tagaccaatgcaacagaatg

SEQ ID NO: 466653 - DNA, 20 bp, Artificial Sequence
  chemically synthesized
tatagaccaatgcaacagaa

SEQ ID NO: 466654 - DNA, 20 bp, Artificial Sequence
  chemically synthesized
ggccctccattctgttgcat

SEQ ID NO: 466655 - DNA, 20 bp, Artificial Sequence
  chemically synthesized
agacatatagaccaatgcaa

SEQ ID NO: 466656 - DNA, 20 bp, Artificial Sequence
  chemically synthesized
ctggcataaaagcagacata

SEQ ID NO: 466657 - DNA, 20 bp, Artificial Sequence
  chemically synthesized
atatagtactggcataaaag

SEQ ID NO: 466658 - DNA, 20 bp, Artificial Sequence
  chemically synthesized
ctatatgtctgcttttatgc

SEQ ID NO: 466659 - DNA, 20 bp, Artificial Sequence
  chemically synthesized
ataatatagtactggcataa

SEQ ID NO: 466660 - DNA, 20 bp, Artificial Sequence
  chemically synthesized
taatcaaaataatatagtac

SEQ ID NO: 466661 - DNA, 20 bp, Artificial Sequence
  chemically synthesized
ctttagtaatcaaaataata

SEQ ID NO: 466662 - DNA, 20 bp, Artificial Sequence
  chemically synthesized
ctatattattttgattacta

SEQ ID NO: 466663 - DNA, 20 bp, Artificial Sequence
  chemically synthesized
tgaattatatgacaaagctt

SEQ ID NO: 466664 - DNA, 20 bp, Artificial Sequence
  chemically synthesized
tgattttgaattatatgaca

SEQ ID NO: 466665 - DNA, 20 bp, Artificial Sequence
  chemically synthesized
tttgtcatataattcaaaat

SEQ ID NO: 466666 - DNA, 20 bp, Artificial Sequence
  chemically synthesized
ttgtcatataattcaaaatc

SEQ ID NO: 466667 - DNA, 20 bp, Artificial Sequence
  chemically synthesized
tcatataattcaaaatcagg

SEQ ID NO: 466668 - DNA, 20 bp, Artificial Sequence
  chemically synthesized
agaaggataagcaacattgg

SEQ ID NO: 466669 - DNA, 20 bp, Artificial Sequence
  chemically synthesized
gagaaggataagcaacattg

SEQ ID NO: 466670 - DNA, 20 bp, Artificial Sequence
  chemically synthesized
ttgagaaggataagcaacat

SEQ ID NO: 466671 - DNA, 20 bp, Artificial Sequence
  chemically synthesized
aaagcaatcttgagaaggat

SEQ ID NO: 466672 - DNA, 20 bp, Artificial Sequence
  chemically synthesized
caatgttgcttatccttctc

SEQ ID NO: 466673 - DNA, 20 bp, Artificial Sequence
  chemically synthesized
tagccaaagcaatcttgaga

SEQ ID NO: 466674 - DNA, 20 bp, Artificial Sequence
  chemically synthesized
atagccaaagcaatcttgag

SEQ ID NO: 466675 - DNA, 20 bp, Artificial Sequence
  chemically synthesized
agaatagccaaagcaatctt

SEQ ID NO: 466676 - DNA, 20 bp, Artificial Sequence
  chemically synthesized
tatccttctcaagattgctt

SEQ ID NO: 466677 - DNA, 20 bp, Artificial Sequence
  chemically synthesized
caaaagaaagagaatagcca

SEQ ID NO: 466678 - DNA, 20 bp, Artificial Sequence
  chemically synthesized
aaacaacaaaagaaagagaa

SEQ ID NO: 466679 - DNA, 20 bp, Artificial Sequence
  chemically synthesized
aaatgaaacaacaaaagaaa

SEQ ID NO: 466680 - DNA, 20 bp, Artificial Sequence
  chemically synthesized
tcaaatgaaacaacaaaaga

SEQ ID NO: 466681 - DNA, 20 bp, Artificial Sequence
  chemically synthesized
aaattcaaatgaaacaacaa

SEQ ID NO: 466682 - DNA, 20 bp, Artificial Sequence
  chemically synthesized
ttgttgtttcatttgaattt

SEQ ID NO: 466683 - DNA, 20 bp, Artificial Sequence
  chemically synthesized
aatgccaatagcatttttca

SEQ ID NO: 466684 - DNA, 20 bp, Artificial Sequence
  chemically synthesized
aaatctatgaaaaatgctat

SEQ ID NO: 466685 - DNA, 20 bp, Artificial Sequence
  chemically synthesized
aacctctatcaaaatgccaa

SEQ ID NO: 466686 - DNA, 20 bp, Artificial Sequence
  chemically synthesized
aaatgctattggcattttga

SEQ ID NO: 466687 - DNA, 20 bp, Artificial Sequence
  chemically synthesized
atgctattggcattttgata

SEQ ID NO: 466688 - DNA, 20 bp, Artificial Sequence
  chemically synthesized
tgctattggcattttgatag

SEQ ID NO: 466689 - DNA, 20 bp, Artificial Sequence
  chemically synthesized
ctcaaagcaatttacagatt

SEQ ID NO: 466690 - DNA, 20 bp, Artificial Sequence
  chemically synthesized
atgctactcaaagcaattta

SEQ ID NO: 466691 - DNA, 20 bp, Artificial Sequence
  chemically synthesized
ctgaatctgtaaattgcttt

SEQ ID NO: 466692 - DNA, 20 bp, Artificial Sequence
  chemically synthesized
aatctgtaaattgctttgag

SEQ ID NO: 466693 - DNA, 20 bp, Artificial Sequence
  chemically synthesized
taaaatgtccatgctactca

SEQ ID NO: 466694 - DNA, 20 bp, Artificial Sequence
  chemically synthesized
gtaaattgctttgagtagca

SEQ ID NO: 466695 - DNA, 20 bp, Artificial Sequence
  chemically synthesized
tttaacaatattaatccttc

SEQ ID NO: 466696 - DNA, 20 bp, Artificial Sequence
  chemically synthesized
ttctgtgttcatggactaga

SEQ ID NO: 466697 - DNA, 20 bp, Artificial Sequence
  chemically synthesized
gttctgtgttcatggactag

SEQ ID NO: 466698 - DNA, 20 bp, Artificial Sequence
  chemically synthesized
tatgttctgtgttcatggac

SEQ ID NO: 466699 - DNA, 20 bp, Artificial Sequence
  chemically synthesized
atccttctagtccatgaaca

SEQ ID NO: 466700 - DNA, 20 bp, Artificial Sequence
  chemically synthesized
gggtgtatgttctgtgttca

SEQ ID NO: 466701 - DNA, 20 bp, Artificial Sequence
  chemically synthesized
tttaaaagacgcaaataaat

SEQ ID NO: 466702 - DNA, 20 bp, Artificial Sequence
  chemically synthesized
ttttaaaagacgcaaataaa

SEQ ID NO: 466703 - DNA, 20 bp, Artificial Sequence
  chemically synthesized
cctgatttaagaaattttaa

SEQ ID NO: 466704 - DNA, 20 bp, Artificial Sequence
  chemically synthesized
tcttttaaaatttcttaaat

SEQ ID NO: 466705 - DNA, 20 bp, Artificial Sequence
  chemically synthesized
cttttaaaatttcttaaatc

SEQ ID NO: 466706 - DNA, 20 bp, Artificial Sequence
  chemically synthesized
caccgtgcgtggcctgattt

SEQ ID NO: 466707 - DNA, 20 bp, Artificial Sequence
  chemically synthesized
ttcttaaatcaggccacgca

SEQ ID NO: 466708 - DNA, 20 bp, Artificial Sequence
  chemically synthesized
ttaaatcaggccacgcacgg

SEQ ID NO: 466709 - DNA, 20 bp, Artificial Sequence
  chemically synthesized
caggcatgagccaccgtgcg

SEQ ID NO: 466710 - DNA, 20 bp, Artificial Sequence
  chemically synthesized
agtgctgggattacaggcat

SEQ ID NO: 466711 - DNA, 20 bp, Artificial Sequence
  chemically synthesized
gtggctcatgcctgtaatcc

SEQ ID NO: 466712 - DNA, 20 bp, Artificial Sequence
  chemically synthesized
tcacaaagtgctgggattac

SEQ ID NO: 466713 - DNA, 20 bp, Artificial Sequence
  chemically synthesized
ctcacaaagtgctgggatta

SEQ ID NO: 466714 - DNA, 20 bp, Artificial Sequence
  chemically synthesized
cctcggcctcacaaagtgct

SEQ ID NO: 466715 - DNA, 20 bp, Artificial Sequence
  chemically synthesized
gcctcggcctcacaaagtgc

SEQ ID NO: 466716 - DNA, 20 bp, Artificial Sequence
  chemically synthesized
ctgtaatcccagcactttgt

SEQ ID NO: 466717 - DNA, 20 bp, Artificial Sequence
  chemically synthesized
tgtaatcccagcactttgtg

SEQ ID NO: 466718 - DNA, 20 bp, Artificial Sequence
  chemically synthesized
tcacctgcctcggcctcaca

SEQ ID NO: 466719 - DNA, 20 bp, Artificial Sequence
  chemically synthesized
tcccagcactttgtgaggcc

SEQ ID NO: 466720 - DNA, 20 bp, Artificial Sequence
  chemically synthesized
cccagcactttgtgaggccg

SEQ ID NO: 466721 - DNA, 20 bp, Artificial Sequence
  chemically synthesized
agcactttgtgaggccgagg

SEQ ID NO: 466722 - DNA, 20 bp, Artificial Sequence
  chemically synthesized
gcactttgtgaggccgaggc

SEQ ID NO: 466723 - DNA, 20 bp, Artificial Sequence
  chemically synthesized
ctaaggtgattcacctgcct

SEQ ID NO: 466724 - DNA, 20 bp, Artificial Sequence
  chemically synthesized
ccgaggcaggtgaatcacct

SEQ ID NO: 466725 - DNA, 20 bp, Artificial Sequence
  chemically synthesized
cgaggcaggtgaatcacctt

SEQ ID NO: 466726 - DNA, 20 bp, Artificial Sequence
  chemically synthesized
gcaggtgaatcaccttaggt

SEQ ID NO: 466727 - DNA, 20 bp, Artificial Sequence
  chemically synthesized
caggtgaatcaccttaggtg

SEQ ID NO: 466728 - DNA, 20 bp, Artificial Sequence
  chemically synthesized
ggtctcaaactcctcaccta

SEQ ID NO: 466729 - DNA, 20 bp, Artificial Sequence
  chemically synthesized
ggtgaatcaccttaggtgag

SEQ ID NO: 466730 - DNA, 20 bp, Artificial Sequence
  chemically synthesized
tggtctcaaactcctcacct

SEQ ID NO: 466731 - DNA, 20 bp, Artificial Sequence
  chemically synthesized
tcaccttaggtgaggagttt

SEQ ID NO: 466732 - DNA, 20 bp, Artificial Sequence
  chemically synthesized
ttaggtgaggagtttgagac

SEQ ID NO: 466733 - DNA, 20 bp, Artificial Sequence
  chemically synthesized
tttcaccatgttagtcaggc

SEQ ID NO: 466734 - DNA, 20 bp, Artificial Sequence
  chemically synthesized
ggggtttcaccatgttagtc

SEQ ID NO: 466735 - DNA, 20 bp, Artificial Sequence
  chemically synthesized
tgagaccagcctgactaaca

SEQ ID NO: 466736 - DNA, 20 bp, Artificial Sequence
  chemically synthesized
cggggtttcaccatgttagt

SEQ ID NO: 466737 - DNA, 20 bp, Artificial Sequence
  chemically synthesized
gagacggggtttcaccatgt

SEQ ID NO: 466738 - DNA, 20 bp, Artificial Sequence
  chemically synthesized
ctgtatttttagtagagacg

SEQ ID NO: 466739 - DNA, 20 bp, Artificial Sequence
  chemically synthesized
tctgtatttttagtagagac

SEQ ID NO: 466740 - DNA, 20 bp, Artificial Sequence
  chemically synthesized
ttctgtatttttagtagaga

SEQ ID NO: 466741 - DNA, 20 bp, Artificial Sequence
  chemically synthesized
taatttctgtatttttagta

SEQ ID NO: 466742 - DNA, 20 bp, Artificial Sequence
  chemically synthesized
gctaatttctgtatttttag

SEQ ID NO: 466743 - DNA, 20 bp, Artificial Sequence
  chemically synthesized
ccccgtctctactaaaaata

SEQ ID NO: 466744 - DNA, 20 bp, Artificial Sequence
  chemically synthesized
ccggctaatttctgtatttt

SEQ ID NO: 466745 - DNA, 20 bp, Artificial Sequence
  chemically synthesized
tctactaaaaatacagaaat

SEQ ID NO: 466746 - DNA, 20 bp, Artificial Sequence
  chemically synthesized
ctaaaaatacagaaattagc

SEQ ID NO: 466747 - DNA, 20 bp, Artificial Sequence
  chemically synthesized
atacagaaattagccggacg

SEQ ID NO: 466748 - DNA, 20 bp, Artificial Sequence
  chemically synthesized
cagaaattagccggacgtag

SEQ ID NO: 466749 - DNA, 20 bp, Artificial Sequence
  chemically synthesized
caggcgcccgccactacgtc

SEQ ID NO: 466750 - DNA, 20 bp, Artificial Sequence
  chemically synthesized
aaattagccggacgtagtgg

SEQ ID NO: 466751 - DNA, 20 bp, Artificial Sequence
  chemically synthesized
aattagccggacgtagtggc

SEQ ID NO: 466752 - DNA, 20 bp, Artificial Sequence
  chemically synthesized
gtggcgggcgcctgtaatcc

SEQ ID NO: 466753 - DNA, 20 bp, Artificial Sequence
  chemically synthesized
tcccgagtagctgggattac

SEQ ID NO: 466754 - DNA, 20 bp, Artificial Sequence
  chemically synthesized
ctcccgagtagctgggatta

SEQ ID NO: 466755 - DNA, 20 bp, Artificial Sequence
  chemically synthesized
cgcctgtaatcccagctact

SEQ ID NO: 466756 - DNA, 20 bp, Artificial Sequence
  chemically synthesized
cctcagcctcccgagtagct

SEQ ID NO: 466757 - DNA, 20 bp, Artificial Sequence
  chemically synthesized
gcctgtaatcccagctactc

SEQ ID NO: 466758 - DNA, 20 bp, Artificial Sequence
  chemically synthesized
gcctcagcctcccgagtagc

SEQ ID NO: 466759 - DNA, 20 bp, Artificial Sequence
  chemically synthesized
ctgtaatcccagctactcgg

SEQ ID NO: 466760 - DNA, 20 bp, Artificial Sequence
  chemically synthesized
tgtaatcccagctactcggg

SEQ ID NO: 466761 - DNA, 20 bp, Artificial Sequence
  chemically synthesized
tcctgcctcagcctcccgag

SEQ ID NO: 466762 - DNA, 20 bp, Artificial Sequence
  chemically synthesized
ttctcctgcctcagcctccc

SEQ ID NO: 466763 - DNA, 20 bp, Artificial Sequence
  chemically synthesized
tcccagctactcgggaggct

SEQ ID NO: 466764 - DNA, 20 bp, Artificial Sequence
  chemically synthesized
cccagctactcgggaggctg

SEQ ID NO: 466765 - DNA, 20 bp, Artificial Sequence
  chemically synthesized
agctactcgggaggctgagg

SEQ ID NO: 466766 - DNA, 20 bp, Artificial Sequence
  chemically synthesized
gctactcgggaggctgaggc

SEQ ID NO: 466767 - DNA, 20 bp, Artificial Sequence
  chemically synthesized
tactcgggaggctgaggcag

SEQ ID NO: 466768 - DNA, 20 bp, Artificial Sequence
  chemically synthesized
ttcaagcgattctcctgcct

SEQ ID NO: 466769 - DNA, 20 bp, Artificial Sequence
  chemically synthesized
gcaggagaatcgcttgaacc

SEQ ID NO: 466770 - DNA, 20 bp, Artificial Sequence
  chemically synthesized
aacctccatcttccgggttc

SEQ ID NO: 466771 - DNA, 20 bp, Artificial Sequence
  chemically synthesized
ggagaatcgcttgaacccgg

SEQ ID NO: 466772 - DNA, 20 bp, Artificial Sequence
  chemically synthesized
aatcgcttgaacccggaaga

SEQ ID NO: 466773 - DNA, 20 bp, Artificial Sequence
  chemically synthesized
cactgcaacctccatcttcc

SEQ ID NO: 466774 - DNA, 20 bp, Artificial Sequence
  chemically synthesized
tcgcttgaacccggaagatg

SEQ ID NO: 466775 - DNA, 20 bp, Artificial Sequence
  chemically synthesized
tcactgcaacctccatcttc

SEQ ID NO: 466776 - DNA, 20 bp, Artificial Sequence
  chemically synthesized
cgcttgaacccggaagatgg

SEQ ID NO: 466777 - DNA, 20 bp, Artificial Sequence
  chemically synthesized
aacccggaagatggaggttg

SEQ ID NO: 466778 - DNA, 20 bp, Artificial Sequence
  chemically synthesized
cggaagatggaggttgcagt

SEQ ID NO: 466779 - DNA, 20 bp, Artificial Sequence
  chemically synthesized
aagatggaggttgcagtgag

SEQ ID NO: 466780 - DNA, 20 bp, Artificial Sequence
  chemically synthesized
gatggaggttgcagtgagca

SEQ ID NO: 466781 - DNA, 20 bp, Artificial Sequence
  chemically synthesized
ccaggctggagtgcaatgac

SEQ ID NO: 466782 - DNA, 20 bp, Artificial Sequence
  chemically synthesized
cccaggctggagtgcaatga

SEQ ID NO: 466783 - DNA, 20 bp, Artificial Sequence
  chemically synthesized
gagatcccgtcattgcactc

SEQ ID NO: 466784 - DNA, 20 bp, Artificial Sequence
  chemically synthesized
cccgtcattgcactccagcc

SEQ ID NO: 466785 - DNA, 20 bp, Artificial Sequence
  chemically synthesized
ccgtcattgcactccagcct

SEQ ID NO: 466786 - DNA, 20 bp, Artificial Sequence
  chemically synthesized
tggctctgtcgcccaggctg

SEQ ID NO: 466787 - DNA, 20 bp, Artificial Sequence
  chemically synthesized
tctggctctgtcgcccaggc

SEQ ID NO: 466788 - DNA, 20 bp, Artificial Sequence
  chemically synthesized
ttgcactccagcctgggcga

SEQ ID NO: 466789 - DNA, 20 bp, Artificial Sequence
  chemically synthesized
ggagtctggctctgtcgccc

SEQ ID NO: 466790 - DNA, 20 bp, Artificial Sequence
  chemically synthesized
gcactccagcctgggcgaca

SEQ ID NO: 466791 - DNA, 20 bp, Artificial Sequence
  chemically synthesized
cggagtctggctctgtcgcc

SEQ ID NO: 466792 - DNA, 20 bp, Artificial Sequence
  chemically synthesized
tccagcctgggcgacagagc

SEQ ID NO: 466793 - DNA, 20 bp, Artificial Sequence
  chemically synthesized
tttttttttgagacggagtc

SEQ ID NO: 466794 - DNA, 20 bp, Artificial Sequence
  chemically synthesized
ttttttttttttttgagacg

SEQ ID NO: 466795 - DNA, 20 bp, Artificial Sequence
  chemically synthesized
ttttttttttttttttgaga

SEQ ID NO: 466796 - DNA, 20 bp, Artificial Sequence
  chemically synthesized
tttttttttttttttttttt

SEQ ID NO: 466797 - DNA, 20 bp, Artificial Sequence
  chemically synthesized
aaactacaaagcattgatta

SEQ ID NO: 466798 - DNA, 20 bp, Artificial Sequence
  chemically synthesized
aatctttaatcaatgctttg

SEQ ID NO: 466799 - DNA, 20 bp, Artificial Sequence
  chemically synthesized
tttatacagtgaaaactaca

SEQ ID NO: 466800 - DNA, 20 bp, Artificial Sequence
  chemically synthesized
aaaatggtgaaatatttata

SEQ ID NO: 466801 - DNA, 20 bp, Artificial Sequence
  chemically synthesized
gtataaatatttcaccattt

SEQ ID NO: 466802 - DNA, 20 bp, Artificial Sequence
  chemically synthesized
aggaataaatttaactaaaa

SEQ ID NO: 466803 - DNA, 20 bp, Artificial Sequence
  chemically synthesized
atcatcaggaagaataaaag

SEQ ID NO: 466804 - DNA, 20 bp, Artificial Sequence
  chemically synthesized
tatcatcaggaagaataaaa

SEQ ID NO: 466805 - DNA, 20 bp, Artificial Sequence
  chemically synthesized
agtatcatcaggaagaataa

SEQ ID NO: 466806 - DNA, 20 bp, Artificial Sequence
  chemically synthesized
tcatttacagtatcatcagg

SEQ ID NO: 466807 - DNA, 20 bp, Artificial Sequence
  chemically synthesized
atttcatttacagtatcatc

SEQ ID NO: 466808 - DNA, 20 bp, Artificial Sequence
  chemically synthesized
aatttcatttacagtatcat

SEQ ID NO: 466809 - DNA, 20 bp, Artificial Sequence
  chemically synthesized
ttagaaaacaatttcattta

SEQ ID NO: 466810 - DNA, 20 bp, Artificial Sequence
  chemically synthesized
tgtaaatgaaattgttttct

SEQ ID NO: 466811 - DNA, 20 bp, Artificial Sequence
  chemically synthesized
atttatctgttaatggcact

SEQ ID NO: 466812 - DNA, 20 bp, Artificial Sequence
  chemically synthesized
tgttttctaagtgccattaa

SEQ ID NO: 466813 - DNA, 20 bp, Artificial Sequence
  chemically synthesized
tttatccatttatctgttaa

SEQ ID NO: 466814 - DNA, 20 bp, Artificial Sequence
  chemically synthesized
aagtgccattaacagataaa

SEQ ID NO: 466815 - DNA, 20 bp, Artificial Sequence
  chemically synthesized
taacagataaatggataaaa

SEQ ID NO: 466816 - DNA, 20 bp, Artificial Sequence
  chemically synthesized
cagataaatggataaaaaag

SEQ ID NO: 466817 - DNA, 20 bp, Artificial Sequence
  chemically synthesized
atatatacacacacacacaa

SEQ ID NO: 466818 - DNA, 20 bp, Artificial Sequence
  chemically synthesized
acacacaacggaacacacaa

SEQ ID NO: 466819 - DNA, 20 bp, Artificial Sequence
  chemically synthesized
tccatgttgttgcaaatggt

SEQ ID NO: 466820 - DNA, 20 bp, Artificial Sequence
  chemically synthesized
tctatccatgttgttgcaaa

SEQ ID NO: 466821 - DNA, 20 bp, Artificial Sequence
  chemically synthesized
acttaccatttgcaacaaca

SEQ ID NO: 466822 - DNA, 20 bp, Artificial Sequence
  chemically synthesized
accatttgcaacaacatgga

SEQ ID NO: 466823 - DNA, 20 bp, Artificial Sequence
  chemically synthesized
caacaacatggatagaactg

SEQ ID NO: 466824 - DNA, 20 bp, Artificial Sequence
  chemically synthesized
aacaacatggatagaactga

SEQ ID NO: 466825 - DNA, 20 bp, Artificial Sequence
  chemically synthesized
tcacttaacaaaatgtcctt

SEQ ID NO: 466826 - DNA, 20 bp, Artificial Sequence
  chemically synthesized
gaactgaaggacattttgtt

SEQ ID NO: 466827 - DNA, 20 bp, Artificial Sequence
  chemically synthesized
gacattttgttaagtgaaat

SEQ ID NO: 466828 - DNA, 20 bp, Artificial Sequence
  chemically synthesized
ttttgttaagtgaaataagc

SEQ ID NO: 466829 - DNA, 20 bp, Artificial Sequence
  chemically synthesized
tttgttaagtgaaataagcc

SEQ ID NO: 466830 - DNA, 20 bp, Artificial Sequence
  chemically synthesized
taagtgaaataagccaggca

SEQ ID NO: 466831 - DNA, 20 bp, Artificial Sequence
  chemically synthesized
aatatttgtctttctgtgcc

SEQ ID NO: 466832 - DNA, 20 bp, Artificial Sequence
  chemically synthesized
tgaaataagccaggcacaga

SEQ ID NO: 466833 - DNA, 20 bp, Artificial Sequence
  chemically synthesized
tttagctcccacatatgagt

SEQ ID NO: 466834 - DNA, 20 bp, Artificial Sequence
  chemically synthesized
tacacgttctcactcatatg

SEQ ID NO: 466835 - DNA, 20 bp, Artificial Sequence
  chemically synthesized
acacgttctcactcatatgt

SEQ ID NO: 466836 - DNA, 20 bp, Artificial Sequence
  chemically synthesized
ttattttagctcccacatat

SEQ ID NO: 466837 - DNA, 20 bp, Artificial Sequence
  chemically synthesized
acgttctcactcatatgtgg

SEQ ID NO: 466838 - DNA, 20 bp, Artificial Sequence
  chemically synthesized
ctccatgagatcaattattt

SEQ ID NO: 466839 - DNA, 20 bp, Artificial Sequence
  chemically synthesized
agctaaaataattgatctca

SEQ ID NO: 466840 - DNA, 20 bp, Artificial Sequence
  chemically synthesized
ctaaaataattgatctcatg

SEQ ID NO: 466841 - DNA, 20 bp, Artificial Sequence
  chemically synthesized
taaaataattgatctcatgg

SEQ ID NO: 466842 - DNA, 20 bp, Artificial Sequence
  chemically synthesized
aataattgatctcatggagg

SEQ ID NO: 466843 - DNA, 20 bp, Artificial Sequence
  chemically synthesized
attgtactcactacctccat

SEQ ID NO: 466844 - DNA, 20 bp, Artificial Sequence
  chemically synthesized
attgatctcatggaggtagt

SEQ ID NO: 466845 - DNA, 20 bp, Artificial Sequence
  chemically synthesized
catggaggtagtgagtacaa

SEQ ID NO: 466846 - DNA, 20 bp, Artificial Sequence
  chemically synthesized
ggaggtagtgagtacaatag

SEQ ID NO: 466847 - DNA, 20 bp, Artificial Sequence
  chemically synthesized
gtgagtacaatagtggttac

SEQ ID NO: 466848 - DNA, 20 bp, Artificial Sequence
  chemically synthesized
aatagtggttacgagcgtct

SEQ ID NO: 466849 - DNA, 20 bp, Artificial Sequence
  chemically synthesized
agtggttacgagcgtctgag

SEQ ID NO: 466850 - DNA, 20 bp, Artificial Sequence
  chemically synthesized
gtggttacgagcgtctgaga

SEQ ID NO: 466851 - DNA, 20 bp, Artificial Sequence
  chemically synthesized
tggttacgagcgtctgagaa

SEQ ID NO: 466852 - DNA, 20 bp, Artificial Sequence
  chemically synthesized
ttacgagcgtctgagaaggg

SEQ ID NO: 466853 - DNA, 20 bp, Artificial Sequence
  chemically synthesized
cttctcttcacttcccttct

SEQ ID NO: 466854 - DNA, 20 bp, Artificial Sequence
  chemically synthesized
agcgtctgagaagggaagtg

SEQ ID NO: 466855 - DNA, 20 bp, Artificial Sequence
  chemically synthesized
cgtctgagaagggaagtgaa

SEQ ID NO: 466856 - DNA, 20 bp, Artificial Sequence
  chemically synthesized
ctgagaagggaagtgaagag

SEQ ID NO: 466857 - DNA, 20 bp, Artificial Sequence
  chemically synthesized
tgagaagggaagtgaagaga

SEQ ID NO: 466858 - DNA, 20 bp, Artificial Sequence
  chemically synthesized
gagaagggaagtgaagagaa

SEQ ID NO: 466859 - DNA, 20 bp, Artificial Sequence
  chemically synthesized
agaagggaagtgaagagaag

SEQ ID NO: 466860 - DNA, 20 bp, Artificial Sequence
  chemically synthesized
gaagtgaagagaaggggatg

SEQ ID NO: 466861 - DNA, 20 bp, Artificial Sequence
  chemically synthesized
agtgaagagaaggggatgaa

SEQ ID NO: 466862 - DNA, 20 bp, Artificial Sequence
  chemically synthesized
tgaagagaaggggatgaaga

SEQ ID NO: 466863 - DNA, 20 bp, Artificial Sequence
  chemically synthesized
gaagagaaggggatgaagag

SEQ ID NO: 466864 - DNA, 20 bp, Artificial Sequence
  chemically synthesized
agaaggggatgaagagagga

SEQ ID NO: 466865 - DNA, 20 bp, Artificial Sequence
  chemically synthesized
gatgaagagaggatagttaa

SEQ ID NO: 466866 - DNA, 20 bp, Artificial Sequence
  chemically synthesized
atgaagagaggatagttaat

SEQ ID NO: 466867 - DNA, 20 bp, Artificial Sequence
  chemically synthesized
agttaatgggtacaatacaa

SEQ ID NO: 466868 - DNA, 20 bp, Artificial Sequence
  chemically synthesized
atgggtacaatacaaaagta

SEQ ID NO: 466869 - DNA, 20 bp, Artificial Sequence
  chemically synthesized
gtacaatacaaaagtacagt

SEQ ID NO: 466870 - DNA, 20 bp, Artificial Sequence
  chemically synthesized
acaaaagtacagttagataa

SEQ ID NO: 466871 - DNA, 20 bp, Artificial Sequence
  chemically synthesized
tagataaaagaaataaattc

SEQ ID NO: 466872 - DNA, 20 bp, Artificial Sequence
  chemically synthesized
agaaataaattctagtgttt

SEQ ID NO: 466873 - DNA, 20 bp, Artificial Sequence
  chemically synthesized
cctactatgctctcaaacac

SEQ ID NO: 466874 - DNA, 20 bp, Artificial Sequence
  chemically synthesized
aaataaattctagtgtttga

SEQ ID NO: 466875 - DNA, 20 bp, Artificial Sequence
  chemically synthesized
aattctagtgtttgagagca

SEQ ID NO: 466876 - DNA, 20 bp, Artificial Sequence
  chemically synthesized
tctagtgtttgagagcatag

SEQ ID NO: 466877 - DNA, 20 bp, Artificial Sequence
  chemically synthesized
ctagtgtttgagagcatagt

SEQ ID NO: 466878 - DNA, 20 bp, Artificial Sequence
  chemically synthesized
tagtgtttgagagcatagta

SEQ ID NO: 466879 - DNA, 20 bp, Artificial Sequence
  chemically synthesized
tgtttgagagcatagtaggg

SEQ ID NO: 466880 - DNA, 20 bp, Artificial Sequence
  chemically synthesized
agagcatagtagggcagcta

SEQ ID NO: 466881 - DNA, 20 bp, Artificial Sequence
  chemically synthesized
ctataaattcatgttaacta

SEQ ID NO: 466882 - DNA, 20 bp, Artificial Sequence
  chemically synthesized
ctatagttaacatgaattta

SEQ ID NO: 466883 - DNA, 20 bp, Artificial Sequence
  chemically synthesized
tatagtatatttcaaattgc

SEQ ID NO: 466884 - DNA, 20 bp, Artificial Sequence
  chemically synthesized
agtatatttcaaattgccag

SEQ ID NO: 466885 - DNA, 20 bp, Artificial Sequence
  chemically synthesized
tatatttcaaattgccagaa

SEQ ID NO: 466886 - DNA, 20 bp, Artificial Sequence
  chemically synthesized
atttcaaattgccagaagag

SEQ ID NO: 466887 - DNA, 20 bp, Artificial Sequence
  chemically synthesized
acattccaaatcttctcttc

SEQ ID NO: 466888 - DNA, 20 bp, Artificial Sequence
  chemically synthesized
aattgccagaagagaagatt

SEQ ID NO: 466889 - DNA, 20 bp, Artificial Sequence
  chemically synthesized
tttggaatgttcccattaca

SEQ ID NO: 466890 - DNA, 20 bp, Artificial Sequence
  chemically synthesized
atttatcatttctttgtaat

SEQ ID NO: 466891 - DNA, 20 bp, Artificial Sequence
  chemically synthesized
tatttatcatttctttgtaa

SEQ ID NO: 466892 - DNA, 20 bp, Artificial Sequence
  chemically synthesized
caaagaaatgataaatattt

SEQ ID NO: 466893 - DNA, 20 bp, Artificial Sequence
  chemically synthesized
atgataaatatttgagatga

SEQ ID NO: 466894 - DNA, 20 bp, Artificial Sequence
  chemically synthesized
atgatcgaatcaaggtgatt

SEQ ID NO: 466895 - DNA, 20 bp, Artificial Sequence
  chemically synthesized
aatgatcgaatcaaggtgat

SEQ ID NO: 466896 - DNA, 20 bp, Artificial Sequence
  chemically synthesized
aatgtgtaatgatcgaatca

SEQ ID NO: 466897 - DNA, 20 bp, Artificial Sequence
  chemically synthesized
caatgtgtaatgatcgaatc

SEQ ID NO: 466898 - DNA, 20 bp, Artificial Sequence
  chemically synthesized
tacacattgtatgtatatat

SEQ ID NO: 466899 - DNA, 20 bp, Artificial Sequence
  chemically synthesized
tgatacattacacatttatg

SEQ ID NO: 466900 - DNA, 20 bp, Artificial Sequence
  chemically synthesized
ttgatacattacacatttat

SEQ ID NO: 466901 - DNA, 20 bp, Artificial Sequence
  chemically synthesized
attgatacattacacattta

SEQ ID NO: 466902 - DNA, 20 bp, Artificial Sequence
  chemically synthesized
atgtgtaatgtatcaataaa

SEQ ID NO: 466903 - DNA, 20 bp, Artificial Sequence
  chemically synthesized
atcaataaaatgtttagatt

SEQ ID NO: 466904 - DNA, 20 bp, Artificial Sequence
  chemically synthesized
aaggaaatcaataaaatgtt

SEQ ID NO: 466905 - DNA, 20 bp, Artificial Sequence
  chemically synthesized
cagttgatttcattttgaaa

SEQ ID NO: 466906 - DNA, 20 bp, Artificial Sequence
  chemically synthesized
tcagttgatttcattttgaa

SEQ ID NO: 466907 - DNA, 20 bp, Artificial Sequence
  chemically synthesized
cttttctctaaaaatgaaat

SEQ ID NO: 466908 - DNA, 20 bp, Artificial Sequence
  chemically synthesized
aaatcaactgatttcatttt

SEQ ID NO: 466909 - DNA, 20 bp, Artificial Sequence
  chemically synthesized
atcaactgatttcattttta

SEQ ID NO: 466910 - DNA, 20 bp, Artificial Sequence
  chemically synthesized
ctgatttcatttttagagaa

SEQ ID NO: 466911 - DNA, 20 bp, Artificial Sequence
  chemically synthesized
aatcaacatacaaatattgg

SEQ ID NO: 466912 - DNA, 20 bp, Artificial Sequence
  chemically synthesized
caaaatcaacatacaaatat

SEQ ID NO: 466913 - DNA, 20 bp, Artificial Sequence
  chemically synthesized
ttgtatgttgattttgtatc

SEQ ID NO: 466914 - DNA, 20 bp, Artificial Sequence
  chemically synthesized
aatgaattcagtaaaattgc

SEQ ID NO: 466915 - DNA, 20 bp, Artificial Sequence
  chemically synthesized
tcagaactaatcaatgaatt

SEQ ID NO: 466916 - DNA, 20 bp, Artificial Sequence
  chemically synthesized
attttactgaattcattgat

SEQ ID NO: 466917 - DNA, 20 bp, Artificial Sequence
  chemically synthesized
tgatttcattaaaaatttgt

SEQ ID NO: 466918 - DNA, 20 bp, Artificial Sequence
  chemically synthesized
caaatttttaatgaaatcat

SEQ ID NO: 466919 - DNA, 20 bp, Artificial Sequence
  chemically synthesized
aaatttttaatgaaatcatt

SEQ ID NO: 466920 - DNA, 20 bp, Artificial Sequence
  chemically synthesized
aatttttaatgaaatcatta

SEQ ID NO: 466921 - DNA, 20 bp, Artificial Sequence
  chemically synthesized
gccacgattctatatgtaga

SEQ ID NO: 466922 - DNA, 20 bp, Artificial Sequence
  chemically synthesized
tcattagggctttctacata

SEQ ID NO: 466923 - DNA, 20 bp, Artificial Sequence
  chemically synthesized
agatgccacgattctatatg

SEQ ID NO: 466924 - DNA, 20 bp, Artificial Sequence
  chemically synthesized
gctttctacatatagaatcg

SEQ ID NO: 466925 - DNA, 20 bp, Artificial Sequence
  chemically synthesized
agaatcgtggcatctacaaa

SEQ ID NO: 466926 - DNA, 20 bp, Artificial Sequence
  chemically synthesized
gaagtaaaattatctgtttg

SEQ ID NO: 466927 - DNA, 20 bp, Artificial Sequence
  chemically synthesized
cagtggaattggaaaggaag

SEQ ID NO: 466928 - DNA, 20 bp, Artificial Sequence
  chemically synthesized
aggcagtggaattggaaagg

SEQ ID NO: 466929 - DNA, 20 bp, Artificial Sequence
  chemically synthesized
aaaaggcagtggaattggaa

SEQ ID NO: 466930 - DNA, 20 bp, Artificial Sequence
  chemically synthesized
taaaaggcagtggaattgga

SEQ ID NO: 466931 - DNA, 20 bp, Artificial Sequence
  chemically synthesized
gaaataaaaggcagtggaat

SEQ ID NO: 466932 - DNA, 20 bp, Artificial Sequence
  chemically synthesized
gagaaagaaataaaaggcag

SEQ ID NO: 466933 - DNA, 20 bp, Artificial Sequence
  chemically synthesized
caagagaaagaaataaaagg

SEQ ID NO: 466934 - DNA, 20 bp, Artificial Sequence
  chemically synthesized
aggcaagagaaagaaataaa

SEQ ID NO: 466935 - DNA, 20 bp, Artificial Sequence
  chemically synthesized
taggcaagagaaagaaataa

SEQ ID NO: 466936 - DNA, 20 bp, Artificial Sequence
  chemically synthesized
cagagcaattaggcaagaga

SEQ ID NO: 466937 - DNA, 20 bp, Artificial Sequence
  chemically synthesized
tagtcagagcaattaggcaa

SEQ ID NO: 466938 - DNA, 20 bp, Artificial Sequence
  chemically synthesized
cctagtcagagcaattaggc

SEQ ID NO: 466939 - DNA, 20 bp, Artificial Sequence
  chemically synthesized
aagtcctagtcagagcaatt

SEQ ID NO: 466940 - DNA, 20 bp, Artificial Sequence
  chemically synthesized
gaagtcctagtcagagcaat

SEQ ID NO: 466941 - DNA, 20 bp, Artificial Sequence
  chemically synthesized
tcttgcctaattgctctgac

SEQ ID NO: 466942 - DNA, 20 bp, Artificial Sequence
  chemically synthesized
cttgcctaattgctctgact

SEQ ID NO: 466943 - DNA, 20 bp, Artificial Sequence
  chemically synthesized
agtattggaagtcctagtca

SEQ ID NO: 466944 - DNA, 20 bp, Artificial Sequence
  chemically synthesized
atagtattggaagtcctagt

SEQ ID NO: 466945 - DNA, 20 bp, Artificial Sequence
  chemically synthesized
caacatagtattggaagtcc

SEQ ID NO: 466946 - DNA, 20 bp, Artificial Sequence
  chemically synthesized
tctgttcaacatagtattgg

SEQ ID NO: 466947 - DNA, 20 bp, Artificial Sequence
  chemically synthesized
acttctgttcaacatagtat

SEQ ID NO: 466948 - DNA, 20 bp, Artificial Sequence
  chemically synthesized
acttccaatactatgttgaa

SEQ ID NO: 466949 - DNA, 20 bp, Artificial Sequence
  chemically synthesized
atcaacacttctgttcaaca

SEQ ID NO: 466950 - DNA, 20 bp, Artificial Sequence
  chemically synthesized
tccaatactatgttgaacag

SEQ ID NO: 466951 - DNA, 20 bp, Artificial Sequence
  chemically synthesized
ttgaacagaagtgttgatca

SEQ ID NO: 466952 - DNA, 20 bp, Artificial Sequence
  chemically synthesized
tgaacagaagtgttgatcat

SEQ ID NO: 466953 - DNA, 20 bp, Artificial Sequence
  chemically synthesized
ctaagatctggtacaatgca

SEQ ID NO: 466954 - DNA, 20 bp, Artificial Sequence
  chemically synthesized
tctaagatctggtacaatgc

SEQ ID NO: 466955 - DNA, 20 bp, Artificial Sequence
  chemically synthesized
ctctaagatctggtacaatg

SEQ ID NO: 466956 - DNA, 20 bp, Artificial Sequence
  chemically synthesized
tgggaatccctgcattgtac

SEQ ID NO: 466957 - DNA, 20 bp, Artificial Sequence
  chemically synthesized
ccctgcattgtaccagatct

SEQ ID NO: 466958 - DNA, 20 bp, Artificial Sequence
  chemically synthesized
ctgcattgtaccagatctta

SEQ ID NO: 466959 - DNA, 20 bp, Artificial Sequence
  chemically synthesized
aaagcttttcctctaagatc

SEQ ID NO: 466960 - DNA, 20 bp, Artificial Sequence
  chemically synthesized
tgcattgtaccagatcttag

SEQ ID NO: 466961 - DNA, 20 bp, Artificial Sequence
  chemically synthesized
tgtaccagatcttagaggaa

SEQ ID NO: 466962 - DNA, 20 bp, Artificial Sequence
  chemically synthesized
aaattgaaagcttttcctct

SEQ ID NO: 466963 - DNA, 20 bp, Artificial Sequence
  chemically synthesized
accaacggggaaaaaattga

SEQ ID NO: 466964 - DNA, 20 bp, Artificial Sequence
  chemically synthesized
gctttcaattttttccccgt

SEQ ID NO: 466965 - DNA, 20 bp, Artificial Sequence
  chemically synthesized
agctaacattgtaaccaacg

SEQ ID NO: 466966 - DNA, 20 bp, Artificial Sequence
  chemically synthesized
tagctaacattgtaaccaac

SEQ ID NO: 466967 - DNA, 20 bp, Artificial Sequence
  chemically synthesized
atagctaacattgtaaccaa

SEQ ID NO: 466968 - DNA, 20 bp, Artificial Sequence
  chemically synthesized
ttccccgttggttacaatgt

SEQ ID NO: 466969 - DNA, 20 bp, Artificial Sequence
  chemically synthesized
ttggttacaatgttagctat

SEQ ID NO: 466970 - DNA, 20 bp, Artificial Sequence
  chemically synthesized
ggccatttatgaaaaactca

SEQ ID NO: 466971 - DNA, 20 bp, Artificial Sequence
  chemically synthesized
agctatgagtttttcataaa

SEQ ID NO: 466972 - DNA, 20 bp, Artificial Sequence
  chemically synthesized
atcttgcatcaacataataa

SEQ ID NO: 466973 - DNA, 20 bp, Artificial Sequence
  chemically synthesized
gatcttgcatcaacataata

SEQ ID NO: 466974 - DNA, 20 bp, Artificial Sequence
  chemically synthesized
ggcctttattatgttgatgc

SEQ ID NO: 466975 - DNA, 20 bp, Artificial Sequence
  chemically synthesized
aactgtcaacaaaataagtg

SEQ ID NO: 466976 - DNA, 20 bp, Artificial Sequence
  chemically synthesized
ttgaaaactgtcaacaaaat

SEQ ID NO: 466977 - DNA, 20 bp, Artificial Sequence
  chemically synthesized
ttctacacttattttgttga

SEQ ID NO: 466978 - DNA, 20 bp, Artificial Sequence
  chemically synthesized
aaagttcaacatgtattcat

SEQ ID NO: 466979 - DNA, 20 bp, Artificial Sequence
  chemically synthesized
aaaagttcaacatgtattca

SEQ ID NO: 466980 - DNA, 20 bp, Artificial Sequence
  chemically synthesized
acatgttgaactttttcaaa

SEQ ID NO: 466981 - DNA, 20 bp, Artificial Sequence
  chemically synthesized
gcagaaaaaaccatttgaaa

SEQ ID NO: 466982 - DNA, 20 bp, Artificial Sequence
  chemically synthesized
catgaccatcttaatagatg

SEQ ID NO: 466983 - DNA, 20 bp, Artificial Sequence
  chemically synthesized
tggttttttctgcatctatt

SEQ ID NO: 466984 - DNA, 20 bp, Artificial Sequence
  chemically synthesized
tttttctgcatctattaaga

SEQ ID NO: 466985 - DNA, 20 bp, Artificial Sequence
  chemically synthesized
gaaccacatgaccatcttaa

SEQ ID NO: 466986 - DNA, 20 bp, Artificial Sequence
  chemically synthesized
catctattaagatggtcatg

SEQ ID NO: 466987 - DNA, 20 bp, Artificial Sequence
  chemically synthesized
acataaacggagtaaaagac

SEQ ID NO: 466988 - DNA, 20 bp, Artificial Sequence
  chemically synthesized
atatcacataaacggagtaa

SEQ ID NO: 466989 - DNA, 20 bp, Artificial Sequence
  chemically synthesized
tgtgatatatcacataaacg

SEQ ID NO: 466990 - DNA, 20 bp, Artificial Sequence
  chemically synthesized
aatgtgatatatcacataaa

SEQ ID NO: 466991 - DNA, 20 bp, Artificial Sequence
  chemically synthesized
tccaagatgcaaggttggta

SEQ ID NO: 466992 - DNA, 20 bp, Artificial Sequence
  chemically synthesized
ttatctccaagatgcaaggt

SEQ ID NO: 466993 - DNA, 20 bp, Artificial Sequence
  chemically synthesized
gccataccaaccttgcatct

SEQ ID NO: 466994 - DNA, 20 bp, Artificial Sequence
  chemically synthesized
ggatttatctccaagatgca

SEQ ID NO: 466995 - DNA, 20 bp, Artificial Sequence
  chemically synthesized
gggatttatctccaagatgc

SEQ ID NO: 466996 - DNA, 20 bp, Artificial Sequence
  chemically synthesized
cataccaaccttgcatcttg

SEQ ID NO: 466997 - DNA, 20 bp, Artificial Sequence
  chemically synthesized
atcaggtgggatttatctcc

SEQ ID NO: 466998 - DNA, 20 bp, Artificial Sequence
  chemically synthesized
attatataccatgatcaggt

SEQ ID NO: 466999 - DNA, 20 bp, Artificial Sequence
  chemically synthesized
gattatataccatgatcagg

SEQ ID NO: 467000 - DNA, 20 bp, Artificial Sequence
  chemically synthesized
agataaatcccacctgatca

SEQ ID NO: 467001 - DNA, 20 bp, Artificial Sequence
  chemically synthesized
aaggattatataccatgatc

SEQ ID NO: 467002 - DNA, 20 bp, Artificial Sequence
  chemically synthesized
aaaggattatataccatgat

SEQ ID NO: 467003 - DNA, 20 bp, Artificial Sequence
  chemically synthesized
aaattcaacagtacatcaaa

SEQ ID NO: 467004 - DNA, 20 bp, Artificial Sequence
  chemically synthesized
caaattcaacagtacatcaa

SEQ ID NO: 467005 - DNA, 20 bp, Artificial Sequence
  chemically synthesized
tactagcaaaacaaattcaa

SEQ ID NO: 467006 - DNA, 20 bp, Artificial Sequence
  chemically synthesized
tactgttgaatttgttttgc

SEQ ID NO: 467007 - DNA, 20 bp, Artificial Sequence
  chemically synthesized
aaaaatcctcaataaaatac

SEQ ID NO: 467008 - DNA, 20 bp, Artificial Sequence
  chemically synthesized
tgttttgctagtattttatt

SEQ ID NO: 467009 - DNA, 20 bp, Artificial Sequence
  chemically synthesized
gttttgctagtattttattg

SEQ ID NO: 467010 - DNA, 20 bp, Artificial Sequence
  chemically synthesized
agtattttattgaggatttt

SEQ ID NO: 467011 - DNA, 20 bp, Artificial Sequence
  chemically synthesized
atttttggatctatacacat

SEQ ID NO: 467012 - DNA, 20 bp, Artificial Sequence
  chemically synthesized
gagggtaactctgatgtgta

SEQ ID NO: 467013 - DNA, 20 bp, Artificial Sequence
  chemically synthesized
ttttggatctatacacatca

SEQ ID NO: 467014 - DNA, 20 bp, Artificial Sequence
  chemically synthesized
acatcagagttaccctcctg

SEQ ID NO: 467015 - DNA, 20 bp, Artificial Sequence
  chemically synthesized
aataaaagaacactacagga

SEQ ID NO: 467016 - DNA, 20 bp, Artificial Sequence
  chemically synthesized
caataaaagaacactacagg

SEQ ID NO: 467017 - DNA, 20 bp, Artificial Sequence
  chemically synthesized
acaataaaagaacactacag

SEQ ID NO: 467018 - DNA, 20 bp, Artificial Sequence
  chemically synthesized
ccacaataaaagaacactac

SEQ ID NO: 467019 - DNA, 20 bp, Artificial Sequence
  chemically synthesized
accacaataaaagaacacta

SEQ ID NO: 467020 - DNA, 20 bp, Artificial Sequence
  chemically synthesized
cctgtagtgttcttttattg

SEQ ID NO: 467021 - DNA, 20 bp, Artificial Sequence
  chemically synthesized
aggcaaagataccacaataa

SEQ ID NO: 467022 - DNA, 20 bp, Artificial Sequence
  chemically synthesized
tttattgtggtatctttgcc

SEQ ID NO: 467023 - DNA, 20 bp, Artificial Sequence
  chemically synthesized
actggcaccaaagccaggca

SEQ ID NO: 467024 - DNA, 20 bp, Artificial Sequence
  chemically synthesized
gtggtatctttgcctggctt

SEQ ID NO: 467025 - DNA, 20 bp, Artificial Sequence
  chemically synthesized
atcacactggcaccaaagcc

SEQ ID NO: 467026 - DNA, 20 bp, Artificial Sequence
  chemically synthesized
aatcacactggcaccaaagc

SEQ ID NO: 467027 - DNA, 20 bp, Artificial Sequence
  chemically synthesized
tctttgcctggctttggtgc

SEQ ID NO: 467028 - DNA, 20 bp, Artificial Sequence
  chemically synthesized
ccagaatcacactggcacca

SEQ ID NO: 467029 - DNA, 20 bp, Artificial Sequence
  chemically synthesized
ttatgaagccagaatcacac

SEQ ID NO: 467030 - DNA, 20 bp, Artificial Sequence
  chemically synthesized
ctttggtgccagtgtgattc

SEQ ID NO: 467031 - DNA, 20 bp, Artificial Sequence
  chemically synthesized
aagtttggggatgtttgttt

SEQ ID NO: 467032 - DNA, 20 bp, Artificial Sequence
  chemically synthesized
tgtgtgaatgtgtaaagttt

SEQ ID NO: 467033 - DNA, 20 bp, Artificial Sequence
  chemically synthesized
tccataataaacaatattgt

SEQ ID NO: 467034 - DNA, 20 bp, Artificial Sequence
  chemically synthesized
tcacacaatattgtttatta

SEQ ID NO: 467035 - DNA, 20 bp, Artificial Sequence
  chemically synthesized
atggacttagctgacaacac

SEQ ID NO: 467036 - DNA, 20 bp, Artificial Sequence
  chemically synthesized
tcccacagtagcaaagccat

SEQ ID NO: 467037 - DNA, 20 bp, Artificial Sequence
  chemically synthesized
atggctttgctactgtggga

SEQ ID NO: 467038 - DNA, 20 bp, Artificial Sequence
  chemically synthesized
tgtaatgctctaatggtgga

SEQ ID NO: 467039 - DNA, 20 bp, Artificial Sequence
  chemically synthesized
aatttgtaatgctctaatgg

SEQ ID NO: 467040 - DNA, 20 bp, Artificial Sequence
  chemically synthesized
agagctgcgatgggatttcc

SEQ ID NO: 467041 - DNA, 20 bp, Artificial Sequence
  chemically synthesized
tgtgttctgtagagctgcga

SEQ ID NO: 467042 - DNA, 20 bp, Artificial Sequence
  chemically synthesized
gggagaaagcaccaagacta

SEQ ID NO: 467043 - DNA, 20 bp, Artificial Sequence
  chemically synthesized
taattcagttaaaaattaaa

SEQ ID NO: 467044 - DNA, 20 bp, Artificial Sequence
  chemically synthesized
cgattcattttaatttttaa

SEQ ID NO: 467045 - DNA, 20 bp, Artificial Sequence
  chemically synthesized
ttggcacacactagaagaga

SEQ ID NO: 467046 - DNA, 20 bp, Artificial Sequence
  chemically synthesized
cttctagtgtgtgccaagta

SEQ ID NO: 467047 - DNA, 20 bp, Artificial Sequence
  chemically synthesized
ggaaaaccaaatgccctcct

SEQ ID NO: 467048 - DNA, 20 bp, Artificial Sequence
  chemically synthesized
cacgtctaagacaactgtgt

SEQ ID NO: 467049 - DNA, 20 bp, Artificial Sequence
  chemically synthesized
gacacttaaggaggtaactg

SEQ ID NO: 467050 - DNA, 20 bp, Artificial Sequence
  chemically synthesized
gtgtcaccaaaacagccagt

SEQ ID NO: 467051 - DNA, 20 bp, Artificial Sequence
  chemically synthesized
tgtttcaaacaaaggtaggt

SEQ ID NO: 467052 - DNA, 20 bp, Artificial Sequence
  chemically synthesized
taggttcgggtaatggtggg

SEQ ID NO: 467053 - DNA, 20 bp, Artificial Sequence
  chemically synthesized
aaatgatttgtttatttaaa

SEQ ID NO: 467054 - DNA, 20 bp, Artificial Sequence
  chemically synthesized
gaaaatttttcttggtatgt

SEQ ID NO: 467055 - DNA, 20 bp, Artificial Sequence
  chemically synthesized
acttgctaattttttgaaag

SEQ ID NO: 467056 - DNA, 20 bp, Artificial Sequence
  chemically synthesized
gtagatgtggcatctctgct

SEQ ID NO: 467057 - DNA, 20 bp, Artificial Sequence
  chemically synthesized
caaacatcatttctaatgag

SEQ ID NO: 467058 - DNA, 20 bp, Artificial Sequence
  chemically synthesized
cctattatttccaaaatcac

SEQ ID NO: 467059 - DNA, 20 bp, Artificial Sequence
  chemically synthesized
ttcagatactggtgagccaa

SEQ ID NO: 467060 - DNA, 20 bp, Artificial Sequence
  chemically synthesized
aggttcatggatggggtggg

SEQ ID NO: 467061 - DNA, 20 bp, Artificial Sequence
  chemically synthesized
ctattcccaaggttcatgga

SEQ ID NO: 467062 - DNA, 20 bp, Artificial Sequence
  chemically synthesized
ccaccccatccatgaacctt

SEQ ID NO: 467063 - DNA, 20 bp, Artificial Sequence
  chemically synthesized
tttacctattcccaaggttc

SEQ ID NO: 467064 - DNA, 20 bp, Artificial Sequence
  chemically synthesized
ctgcaaaggaagctgagaaa

SEQ ID NO: 467065 - DNA, 20 bp, Artificial Sequence
  chemically synthesized
ggtggtggttgactatggta

SEQ ID NO: 467066 - DNA, 20 bp, Artificial Sequence
  chemically synthesized
cacaactggttctggggaag

SEQ ID NO: 467067 - DNA, 20 bp, Artificial Sequence
  chemically synthesized
ccatctaagaggatgcatga

SEQ ID NO: 467068 - DNA, 20 bp, Artificial Sequence
  chemically synthesized
gtcaccatctaagaggatgc

SEQ ID NO: 467069 - DNA, 20 bp, Artificial Sequence
  chemically synthesized
ttcttaatgtcaccatctaa

SEQ ID NO: 467070 - DNA, 20 bp, Artificial Sequence
  chemically synthesized
tcctcttagatggtgacatt

SEQ ID NO: 467071 - DNA, 20 bp, Artificial Sequence
  chemically synthesized
gttcatactttgcttctcaa

SEQ ID NO: 467072 - DNA, 20 bp, Artificial Sequence
  chemically synthesized
agtgagattgctggatcaaa

SEQ ID NO: 467073 - DNA, 20 bp, Artificial Sequence
  chemically synthesized
acttcctagaagtgagattg

SEQ ID NO: 467074 - DNA, 20 bp, Artificial Sequence
  chemically synthesized
tgcataaacaaacaaatctg

SEQ ID NO: 467075 - DNA, 20 bp, Artificial Sequence
  chemically synthesized
atttaagcagttccctttgg

SEQ ID NO: 467076 - DNA, 20 bp, Artificial Sequence
  chemically synthesized
aatatttcattatatgttca

SEQ ID NO: 467077 - DNA, 20 bp, Artificial Sequence
  chemically synthesized
aatattatacagctataaaa

SEQ ID NO: 467078 - DNA, 20 bp, Artificial Sequence
  chemically synthesized
tatttaaatgaaaagatttc

SEQ ID NO: 467079 - DNA, 20 bp, Artificial Sequence
  chemically synthesized
caaacaagtaaggtgcataa

SEQ ID NO: 467080 - DNA, 20 bp, Artificial Sequence
  chemically synthesized
aaggtgcataactgggtgca

SEQ ID NO: 467081 - DNA, 20 bp, Artificial Sequence
  chemically synthesized
tttttcctattattatttca

SEQ ID NO: 467082 - DNA, 20 bp, Artificial Sequence
  chemically synthesized
atttcttatttagtcttcca

SEQ ID NO: 467083 - DNA, 20 bp, Artificial Sequence
  chemically synthesized
tcaatcatcctcattgctct

SEQ ID NO: 467084 - DNA, 20 bp, Artificial Sequence
  chemically synthesized
atgtctactcatagagcaat

SEQ ID NO: 467085 - DNA, 20 bp, Artificial Sequence
  chemically synthesized
tgattgattgatatggggga

SEQ ID NO: 467086 - DNA, 20 bp, Artificial Sequence
  chemically synthesized
atatgggggaaggggtagtt

SEQ ID NO: 467087 - DNA, 20 bp, Artificial Sequence
  chemically synthesized
ggagtgttttcactgtcttt

SEQ ID NO: 467088 - DNA, 20 bp, Artificial Sequence
  chemically synthesized
taaataggtaatacatgcat

SEQ ID NO: 467089 - DNA, 20 bp, Artificial Sequence
  chemically synthesized
acaccaacactgtaacattt

SEQ ID NO: 467090 - DNA, 20 bp, Artificial Sequence
  chemically synthesized
ttcaggtactgagttcttac

SEQ ID NO: 467091 - DNA, 20 bp, Artificial Sequence
  chemically synthesized
tttgtcattgttttcaggta

SEQ ID NO: 467092 - DNA, 20 bp, Artificial Sequence
  chemically synthesized
ttagacacattagctctgga

SEQ ID NO: 467093 - DNA, 20 bp, Artificial Sequence
  chemically synthesized
tcttttagacacattagctc

SEQ ID NO: 467094 - DNA, 20 bp, Artificial Sequence
  chemically synthesized
attctaaaatcagaggtaaa

SEQ ID NO: 467095 - DNA, 20 bp, Artificial Sequence
  chemically synthesized
actctatttacctctgattt

SEQ ID NO: 467096 - DNA, 20 bp, Artificial Sequence
  chemically synthesized
tacttacttaaacttcttag

SEQ ID NO: 467097 - DNA, 20 bp, Artificial Sequence
  chemically synthesized
taaaactcagatttaaaaca

SEQ ID NO: 467098 - DNA, 20 bp, Artificial Sequence
  chemically synthesized
agtaaccccttgttttaaat

SEQ ID NO: 467099 - DNA, 20 bp, Artificial Sequence
  chemically synthesized
aatctgagttttaaaaatcc

SEQ ID NO: 467100 - DNA, 20 bp, Artificial Sequence
  chemically synthesized
gctggaccttttctttaccc

SEQ ID NO: 467101 - DNA, 20 bp, Artificial Sequence
  chemically synthesized
taatttgttaccttagagct

SEQ ID NO: 467102 - DNA, 20 bp, Artificial Sequence
  chemically synthesized
aaaattatgaaggaaaaaga

SEQ ID NO: 467103 - DNA, 20 bp, Artificial Sequence
  chemically synthesized
ttcctgataattgtgcacac

SEQ ID NO: 467104 - DNA, 20 bp, Artificial Sequence
  chemically synthesized
tttctacctcactttggttt

SEQ ID NO: 467105 - DNA, 20 bp, Artificial Sequence
  chemically synthesized
gtgtaattagcttttggaga

SEQ ID NO: 467106 - DNA, 20 bp, Artificial Sequence
  chemically synthesized
tcaagtgtaattagcttttg

SEQ ID NO: 467107 - DNA, 20 bp, Artificial Sequence
  chemically synthesized
tcaagtgtaattagcttttg

SEQ ID NO: 467108 - DNA, 20 bp, Artificial Sequence
  chemically synthesized
aggtcacacggtggtatcta

SEQ ID NO: 467109 - DNA, 20 bp, Artificial Sequence
  chemically synthesized
cacacggtggtatctattga

SEQ ID NO: 467110 - DNA, 20 bp, Artificial Sequence
  chemically synthesized
aaagaaataaaatggcatga

SEQ ID NO: 467111 - DNA, 20 bp, Artificial Sequence
  chemically synthesized
aacctgtctaatccaccaag

SEQ ID NO: 467112 - DNA, 20 bp, Artificial Sequence
  chemically synthesized
ttacaaaaaaacccttcttg

SEQ ID NO: 467113 - DNA, 20 bp, Artificial Sequence
  chemically synthesized
gaagggtttttttgtaacat

SEQ ID NO: 467114 - DNA, 20 bp, Artificial Sequence
  chemically synthesized
tccatcctttgcatttctct

SEQ ID NO: 467115 - DNA, 20 bp, Artificial Sequence
  chemically synthesized
actactcgcagagaaatgca

SEQ ID NO: 467116 - DNA, 20 bp, Artificial Sequence
  chemically synthesized
gaaacacagttcatgggctt

SEQ ID NO: 467117 - DNA, 20 bp, Artificial Sequence
  chemically synthesized
gatttattgtcccatgtggg

SEQ ID NO: 467118 - DNA, 20 bp, Artificial Sequence
  chemically synthesized
tttagatttattgtcccatg

SEQ ID NO: 467119 - DNA, 20 bp, Artificial Sequence
  chemically synthesized
cttctcacagtcaaaaggaa

SEQ ID NO: 467120 - DNA, 20 bp, Artificial Sequence
  chemically synthesized
gccactctttaagtgaagga

SEQ ID NO: 467121 - DNA, 20 bp, Artificial Sequence
  chemically synthesized
atcatccaatccttcactta

SEQ ID NO: 467122 - DNA, 20 bp, Artificial Sequence
  chemically synthesized
agtaggccactctttaagtg

SEQ ID NO: 467123 - DNA, 20 bp, Artificial Sequence
  chemically synthesized
agagtggcctactccttcac

SEQ ID NO: 467124 - DNA, 20 bp, Artificial Sequence
  chemically synthesized
ttcccagcccatccctgtga

SEQ ID NO: 467125 - DNA, 20 bp, Artificial Sequence
  chemically synthesized
ctccttcacagggatgggct

SEQ ID NO: 467126 - DNA, 20 bp, Artificial Sequence
  chemically synthesized
gatgatagggctggagggct

SEQ ID NO: 467127 - DNA, 20 bp, Artificial Sequence
  chemically synthesized
tcatcgtcctgctactgctt

SEQ ID NO: 467128 - DNA, 20 bp, Artificial Sequence
  chemically synthesized
ccttctgatgttcacaaggt

SEQ ID NO: 467129 - DNA, 20 bp, Artificial Sequence
  chemically synthesized
gcattgctagcagcaggaag

SEQ ID NO: 467130 - DNA, 20 bp, Artificial Sequence
  chemically synthesized
acaggacttattatatcaga

SEQ ID NO: 467131 - DNA, 20 bp, Artificial Sequence
  chemically synthesized
atacacaggacttattatat

SEQ ID NO: 467132 - DNA, 20 bp, Artificial Sequence
  chemically synthesized
tttttaaagggaacatgtga

SEQ ID NO: 467133 - DNA, 20 bp, Artificial Sequence
  chemically synthesized
gatttttttaaagggaacat

SEQ ID NO: 467134 - DNA, 20 bp, Artificial Sequence
  chemically synthesized
aacgaaagtaaagtaaagta

SEQ ID NO: 467135 - DNA, 20 bp, Artificial Sequence
  chemically synthesized
gcttacctgcttggtctaga

SEQ ID NO: 467136 - DNA, 20 bp, Artificial Sequence
  chemically synthesized
ccaggcttacctgcttggtc

SEQ ID NO: 467137 - DNA, 20 bp, Artificial Sequence
  chemically synthesized
tctagaccaagcaggtaagc

SEQ ID NO: 467138 - DNA, 20 bp, Artificial Sequence
  chemically synthesized
tagaagtaatttctttctat

SEQ ID NO: 467139 - DNA, 20 bp, Artificial Sequence
  chemically synthesized
agttatatagataaagagat

SEQ ID NO: 467140 - DNA, 20 bp, Artificial Sequence
  chemically synthesized
gtcagctgagtggggcaggc

SEQ ID NO: 467141 - DNA, 20 bp, Artificial Sequence
  chemically synthesized
gctcatttgagaactgtcag

SEQ ID NO: 467142 - DNA, 20 bp, Artificial Sequence
  chemically synthesized
atgcaaaaaaagaaaaagcc

SEQ ID NO: 467143 - DNA, 20 bp, Artificial Sequence
  chemically synthesized
gaaaaagccatgaatttcat

SEQ ID NO: 467144 - DNA, 20 bp, Artificial Sequence
  chemically synthesized
tcatatggatatcacgccaa

SEQ ID NO: 467145 - DNA, 20 bp, Artificial Sequence
  chemically synthesized
tgtgtgtttgttttgttttt

SEQ ID NO: 467146 - DNA, 20 bp, Artificial Sequence
  chemically synthesized
ttctttatatggaacgcatt

SEQ ID NO: 467147 - DNA, 20 bp, Artificial Sequence
  chemically synthesized
aataaatctatatttttgtg

SEQ ID NO: 467148 - DNA, 20 bp, Artificial Sequence
  chemically synthesized
aacaaagaggattagacagt

SEQ ID NO: 467149 - DNA, 20 bp, Artificial Sequence
  chemically synthesized
tataatattcatacaacaaa

SEQ ID NO: 467150 - DNA, 20 bp, Artificial Sequence
  chemically synthesized
tgtctaatcctctttgttgt

SEQ ID NO: 467151 - DNA, 20 bp, Artificial Sequence
  chemically synthesized
gaatattataaaaaccatgc

SEQ ID NO: 467152 - DNA, 20 bp, Artificial Sequence
  chemically synthesized
ataaaaaccatgcgggaatc

SEQ ID NO: 467153 - DNA, 20 bp, Artificial Sequence
  chemically synthesized
catgacagatgaagaaggag

SEQ ID NO: 467154 - DNA, 20 bp, Artificial Sequence
  chemically synthesized
agatgatttgggcagagcga

SEQ ID NO: 467155 - DNA, 20 bp, Artificial Sequence
  chemically synthesized
tttcccaaatggcaaagaaa

SEQ ID NO: 467156 - DNA, 20 bp, Artificial Sequence
  chemically synthesized
tgggaaatcattccccattt

SEQ ID NO: 467157 - DNA, 20 bp, Artificial Sequence
  chemically synthesized
gttgtcttcacccagaaatg

SEQ ID NO: 467158 - DNA, 20 bp, Artificial Sequence
  chemically synthesized
gacaacacagaagctgcatc

SEQ ID NO: 467159 - DNA, 20 bp, Artificial Sequence
  chemically synthesized
ttgttagtatcagcttaatg

SEQ ID NO: 467160 - DNA, 20 bp, Artificial Sequence
  chemically synthesized
tatatatttacattgggaac

SEQ ID NO: 467161 - DNA, 20 bp, Artificial Sequence
  chemically synthesized
ccaatgtaaatatatatcaa

SEQ ID NO: 467162 - DNA, 20 bp, Artificial Sequence
  chemically synthesized
agaaatcttgtgcttatcta

SEQ ID NO: 467163 - DNA, 20 bp, Artificial Sequence
  chemically synthesized
cacaagatttctatcagaac

SEQ ID NO: 467164 - DNA, 20 bp, Artificial Sequence
  chemically synthesized
agaacaggaatattccatga

SEQ ID NO: 467165 - DNA, 20 bp, Artificial Sequence
  chemically synthesized
ggaaaagatgtatcccatca

SEQ ID NO: 467166 - DNA, 20 bp, Artificial Sequence
  chemically synthesized
acatcttttccaccttggct

SEQ ID NO: 467167 - DNA, 20 bp, Artificial Sequence
  chemically synthesized
aatgttcgttaatacaagta

SEQ ID NO: 467168 - DNA, 20 bp, Artificial Sequence
  chemically synthesized
agtgataatggtgacgatgg

SEQ ID NO: 467169 - DNA, 20 bp, Artificial Sequence
  chemically synthesized
tattttctctctgcttttac

SEQ ID NO: 467170 - DNA, 20 bp, Artificial Sequence
  chemically synthesized
aaaataataataataaactc

SEQ ID NO: 467171 - DNA, 20 bp, Artificial Sequence
  chemically synthesized
gtgcaccaaaaggtcaattc

SEQ ID NO: 467172 - DNA, 20 bp, Artificial Sequence
  chemically synthesized
ttttggtgcactattaacat

SEQ ID NO: 467173 - DNA, 20 bp, Artificial Sequence
  chemically synthesized
acatttgaattaggaaacct

SEQ ID NO: 467174 - DNA, 20 bp, Artificial Sequence
  chemically synthesized
aattagggtctagagtaatt

SEQ ID NO: 467175 - DNA, 20 bp, Artificial Sequence
  chemically synthesized
gtcaccttataattagggtc

SEQ ID NO: 467176 - DNA, 20 bp, Artificial Sequence
  chemically synthesized
catgtgggtcaccttataat

SEQ ID NO: 467177 - DNA, 20 bp, Artificial Sequence
  chemically synthesized
cccaaatgcatacaatacat

SEQ ID NO: 467178 - DNA, 20 bp, Artificial Sequence
  chemically synthesized
cccacatgtattgtatgcat

SEQ ID NO: 467179 - DNA, 20 bp, Artificial Sequence
  chemically synthesized
tgtatgcatttgggtatttt

SEQ ID NO: 467180 - DNA, 20 bp, Artificial Sequence
  chemically synthesized
catttaggaggagctctaag

SEQ ID NO: 467181 - DNA, 20 bp, Artificial Sequence
  chemically synthesized
tcttagagctcctcctaaat

SEQ ID NO: 467182 - DNA, 20 bp, Artificial Sequence
  chemically synthesized
ataatgcagcacgacctagc

SEQ ID NO: 467183 - DNA, 20 bp, Artificial Sequence
  chemically synthesized
aaaagaacagcacaatgtcc

SEQ ID NO: 467184 - DNA, 20 bp, Artificial Sequence
  chemically synthesized
ttcgtagcaaaattcagatt

SEQ ID NO: 467185 - DNA, 20 bp, Artificial Sequence
  chemically synthesized
cagattatcttactctaaat

SEQ ID NO: 467186 - DNA, 20 bp, Artificial Sequence
  chemically synthesized
agacaatacttgaatagtgg

SEQ ID NO: 467187 - DNA, 20 bp, Artificial Sequence
  chemically synthesized
ttcagttccaaagacaatac

SEQ ID NO: 467188 - DNA, 20 bp, Artificial Sequence
  chemically synthesized
gtatttttaacaattattat

SEQ ID NO: 467189 - DNA, 20 bp, Artificial Sequence
  chemically synthesized
tctatagctttaatttttat

SEQ ID NO: 467190 - DNA, 20 bp, Artificial Sequence
  chemically synthesized
aattaaagctatagactagg

SEQ ID NO: 467191 - DNA, 20 bp, Artificial Sequence
  chemically synthesized
tagcttctctacaaaatgaa

SEQ ID NO: 467192 - DNA, 20 bp, Artificial Sequence
  chemically synthesized
cactgtttaagtgcctgccc

SEQ ID NO: 467193 - DNA, 20 bp, Artificial Sequence
  chemically synthesized
ggtcaccttaatagaaatgc

SEQ ID NO: 467194 - DNA, 20 bp, Artificial Sequence
  chemically synthesized
ttttgtgctttattagtgca

SEQ ID NO: 467195 - DNA, 20 bp, Artificial Sequence
  chemically synthesized
tattagtgcaaagaatttca

SEQ ID NO: 467196 - DNA, 20 bp, Artificial Sequence
  chemically synthesized
ttatattttagaaaatcact

SEQ ID NO: 467197 - DNA, 20 bp, Artificial Sequence
  chemically synthesized
ccaaactattggcccacttt

SEQ ID NO: 467198 - DNA, 20 bp, Artificial Sequence
  chemically synthesized
ctttgctgctccttagagct

SEQ ID NO: 467199 - DNA, 20 bp, Artificial Sequence
  chemically synthesized
gaataattatgcagatttcc

SEQ ID NO: 467200 - DNA, 20 bp, Artificial Sequence
  chemically synthesized
catctatcttcaatttatgc

SEQ ID NO: 467201 - DNA, 20 bp, Artificial Sequence
  chemically synthesized
ggacctttacaacatggtgc

SEQ ID NO: 467202 - DNA, 20 bp, Artificial Sequence
  chemically synthesized
tgtgggccatgagaaatact

SEQ ID NO: 467203 - DNA, 20 bp, Artificial Sequence
  chemically synthesized
ataagctgacaggaaaaaaa

SEQ ID NO: 467204 - DNA, 20 bp, Artificial Sequence
  chemically synthesized
tctttttaggctgtgtgcta

SEQ ID NO: 467205 - DNA, 20 bp, Artificial Sequence
  chemically synthesized
taaaacaaataaatgcattt

SEQ ID NO: 467206 - DNA, 20 bp, Artificial Sequence
  chemically synthesized
actaactggaaggaaaattc

SEQ ID NO: 467207 - DNA, 20 bp, Artificial Sequence
  chemically synthesized
ttatgcttcttgagagactc

SEQ ID NO: 467208 - DNA, 20 bp, Artificial Sequence
  chemically synthesized
tctcaagaagcataagttct

SEQ ID NO: 467209 - DNA, 20 bp, Artificial Sequence
  chemically synthesized
cggagtgtgcatggcacatt

SEQ ID NO: 467210 - DNA, 20 bp, Artificial Sequence
  chemically synthesized
aaggccacccaactttttgt

SEQ ID NO: 467211 - DNA, 20 bp, Artificial Sequence
  chemically synthesized
atgcacactccgacaaaaag

SEQ ID NO: 467212 - DNA, 20 bp, Artificial Sequence
  chemically synthesized
ctataaaaataaagaacttt

SEQ ID NO: 467213 - DNA, 20 bp, Artificial Sequence
  chemically synthesized
tcactaaatacctgctttac

SEQ ID NO: 467214 - DNA, 20 bp, Artificial Sequence
  chemically synthesized
aaaactccatggaaagaaat

SEQ ID NO: 467215 - DNA, 20 bp, Artificial Sequence
  chemically synthesized
ataattctaatttctttcca

SEQ ID NO: 467216 - DNA, 20 bp, Artificial Sequence
  chemically synthesized
aagagattgacttctttttt

SEQ ID NO: 467217 - DNA, 20 bp, Artificial Sequence
  chemically synthesized
ttttacaaactactgcccta

SEQ ID NO: 467218 - DNA, 20 bp, Artificial Sequence
  chemically synthesized
atcatactttaatccgttgg

SEQ ID NO: 467219 - DNA, 20 bp, Artificial Sequence
  chemically synthesized
agtgcagtcttacccctcca

SEQ ID NO: 467220 - DNA, 20 bp, Artificial Sequence
  chemically synthesized
acacacatggataatagaac

SEQ ID NO: 467221 - DNA, 20 bp, Artificial Sequence
  chemically synthesized
gaatgctctgccttacacac

SEQ ID NO: 467222 - DNA, 20 bp, Artificial Sequence
  chemically synthesized
caggtaacattaatgacctc

SEQ ID NO: 467223 - DNA, 20 bp, Artificial Sequence
  chemically synthesized
gagaggtactgaaaagcagc

SEQ ID NO: 467224 - DNA, 20 bp, Artificial Sequence
  chemically synthesized
ctgaaggtgattgcaaatgc

SEQ ID NO: 467225 - DNA, 20 bp, Artificial Sequence
  chemically synthesized
tattgatttaatccattctt

SEQ ID NO: 467226 - DNA, 20 bp, Artificial Sequence
  chemically synthesized
gtgttcaataatccttaaga

SEQ ID NO: 467227 - DNA, 20 bp, Artificial Sequence
  chemically synthesized
ctttgtgttcaataatcctt

SEQ ID NO: 467228 - DNA, 20 bp, Artificial Sequence
  chemically synthesized
cacacgtcaccactgcctga

SEQ ID NO: 467229 - DNA, 20 bp, Artificial Sequence
  chemically synthesized
gaattgttttccacagcgat

SEQ ID NO: 467230 - DNA, 20 bp, Artificial Sequence
  chemically synthesized
accagattgctattgaggtc

SEQ ID NO: 467231 - DNA, 20 bp, Artificial Sequence
  chemically synthesized
tgaatgctaacaatttattt

SEQ ID NO: 467232 - DNA, 20 bp, Artificial Sequence
  chemically synthesized
tccggctttcctttggacaa

SEQ ID NO: 467233 - DNA, 20 bp, Artificial Sequence
  chemically synthesized
tcagttgtccaaaggaaagc

SEQ ID NO: 467234 - DNA, 20 bp, Artificial Sequence
  chemically synthesized
aaatctgctttacgtacatt

SEQ ID NO: 467235 - DNA, 20 bp, Artificial Sequence
  chemically synthesized
agacaagtttccagaagcca

SEQ ID NO: 467236 - DNA, 20 bp, Artificial Sequence
  chemically synthesized
gccttttctgaaattcattt

SEQ ID NO: 467237 - DNA, 20 bp, Artificial Sequence
  chemically synthesized
taaacatgtttcactcacaa

SEQ ID NO: 467238 - DNA, 20 bp, Artificial Sequence
  chemically synthesized
tttttctacaaaaagttaaa

SEQ ID NO: 467239 - DNA, 20 bp, Artificial Sequence
  chemically synthesized
ttttaaggggcacttaccat

SEQ ID NO: 467240 - DNA, 20 bp, Artificial Sequence
  chemically synthesized
tacttcgtatgtgagacttc

SEQ ID NO: 467241 - DNA, 20 bp, Artificial Sequence
  chemically synthesized
aaacctgacttggtgaagca

SEQ ID NO: 467242 - DNA, 20 bp, Artificial Sequence
  chemically synthesized
ttgggcagtggggccaggga

SEQ ID NO: 467243 - DNA, 20 bp, Artificial Sequence
  chemically synthesized
gcactggcacagacacactg

SEQ ID NO: 467244 - DNA, 20 bp, Artificial Sequence
  chemically synthesized
cttgtatggcatgatgttgg

SEQ ID NO: 467245 - DNA, 20 bp, Artificial Sequence
  chemically synthesized
ccactgattcatttaaacac

SEQ ID NO: 467246 - DNA, 20 bp, Artificial Sequence
  chemically synthesized
attacgactcctgtgtttaa

SEQ ID NO: 467247 - DNA, 20 bp, Artificial Sequence
  chemically synthesized
tccagtccatcctgttgcta

SEQ ID NO: 467248 - DNA, 20 bp, Artificial Sequence
  chemically synthesized
gattctggattccttagcaa

SEQ ID NO: 467249 - DNA, 20 bp, Artificial Sequence
  chemically synthesized
catcctgttgctaaggaatc

SEQ ID NO: 467250 - DNA, 20 bp, Artificial Sequence
  chemically synthesized
ccttcttaaatgagaagatt

SEQ ID NO: 467251 - DNA, 20 bp, Artificial Sequence
  chemically synthesized
ggagacaggctggatgggtg

SEQ ID NO: 467252 - DNA, 20 bp, Artificial Sequence
  chemically synthesized
tgttctgggagacaggctgg

SEQ ID NO: 467253 - DNA, 20 bp, Artificial Sequence
  chemically synthesized
acagtgttctgggagacagg

SEQ ID NO: 467254 - DNA, 20 bp, Artificial Sequence
  chemically synthesized
agagaaggaaagctctccca

SEQ ID NO: 467255 - DNA, 20 bp, Artificial Sequence
  chemically synthesized
aaatcaaggttgtctttacc

SEQ ID NO: 467256 - DNA, 20 bp, Artificial Sequence
  chemically synthesized
attacctaattaagtgactg

SEQ ID NO: 467257 - DNA, 20 bp, Artificial Sequence
  chemically synthesized
ccaggaatattgtctgaata

SEQ ID NO: 467258 - DNA, 20 bp, Artificial Sequence
  chemically synthesized
tattccaccaggaatattgt

SEQ ID NO: 467259 - DNA, 20 bp, Artificial Sequence
  chemically synthesized
tattcagacaatattcctgg

SEQ ID NO: 467260 - DNA, 20 bp, Artificial Sequence
  chemically synthesized
cttcttactcctattccacc

SEQ ID NO: 467261 - DNA, 20 bp, Artificial Sequence
  chemically synthesized
gacaatattcctggtggaat

SEQ ID NO: 467262 - DNA, 20 bp, Artificial Sequence
  chemically synthesized
gatagggtgcagtcttatca

SEQ ID NO: 467263 - DNA, 20 bp, Artificial Sequence
  chemically synthesized
tatttatgggttgaaaggga

SEQ ID NO: 467264 - DNA, 20 bp, Artificial Sequence
  chemically synthesized
atgcctatttatgggttgaa

SEQ ID NO: 467265 - DNA, 20 bp, Artificial Sequence
  chemically synthesized
ggtttttaaaatgcctattt

SEQ ID NO: 467266 - DNA, 20 bp, Artificial Sequence
  chemically synthesized
tcgattaaaaaattaaatat

SEQ ID NO: 467267 - DNA, 20 bp, Artificial Sequence
  chemically synthesized
tccaatatttaattttttaa

SEQ ID NO: 467268 - DNA, 20 bp, Artificial Sequence
  chemically synthesized
ataaaaaagatcatcttctg

SEQ ID NO: 467269 - DNA, 20 bp, Artificial Sequence
  chemically synthesized
atgatgtaagcctttcaaat

SEQ ID NO: 467270 - DNA, 20 bp, Artificial Sequence
  chemically synthesized
aagcctttcaaatgagagtt

SEQ ID NO: 467271 - DNA, 20 bp, Artificial Sequence
  chemically synthesized
ttcaaatgagagttaagagt

SEQ ID NO: 467272 - DNA, 20 bp, Artificial Sequence
  chemically synthesized
tgggtctggagccagactgc

SEQ ID NO: 467273 - DNA, 20 bp, Artificial Sequence
  chemically synthesized
caggtgacagagccaaggat

SEQ ID NO: 467274 - DNA, 20 bp, Artificial Sequence
  chemically synthesized
gtgtcccaggtgacagagcc

SEQ ID NO: 467275 - DNA, 20 bp, Artificial Sequence
  chemically synthesized
taaggagactgagtcaatga

SEQ ID NO: 467276 - DNA, 20 bp, Artificial Sequence
  chemically synthesized
ccgttttacagataaggaga

SEQ ID NO: 467277 - DNA, 20 bp, Artificial Sequence
  chemically synthesized
cagtctccttatctgtaaaa

SEQ ID NO: 467278 - DNA, 20 bp, Artificial Sequence
  chemically synthesized
atctgtaaaacggggttaat

SEQ ID NO: 467279 - DNA, 20 bp, Artificial Sequence
  chemically synthesized
gcaaaatgaagtcatcccag

SEQ ID NO: 467280 - DNA, 20 bp, Artificial Sequence
  chemically synthesized
gcccttagtttttattcttc

SEQ ID NO: 467281 - DNA, 20 bp, Artificial Sequence
  chemically synthesized
tttagccttgaacataactg

SEQ ID NO: 467282 - DNA, 20 bp, Artificial Sequence
  chemically synthesized
tggcaacagatgatgaacgg

SEQ ID NO: 467283 - DNA, 20 bp, Artificial Sequence
  chemically synthesized
atcctttgtagtccctaggt

SEQ ID NO: 467284 - DNA, 20 bp, Artificial Sequence
  chemically synthesized
attccaacctagggactaca

SEQ ID NO: 467285 - DNA, 20 bp, Artificial Sequence
  chemically synthesized
acaagactggggttgggagc

SEQ ID NO: 467286 - DNA, 20 bp, Artificial Sequence
  chemically synthesized
catcaccatgacgacaagac

SEQ ID NO: 467287 - DNA, 20 bp, Artificial Sequence
  chemically synthesized
acaacggcaatgaacatttg

SEQ ID NO: 467288 - DNA, 20 bp, Artificial Sequence
  chemically synthesized
tacacattgtgtcatcatgt

SEQ ID NO: 467289 - DNA, 20 bp, Artificial Sequence
  chemically synthesized
tttatgtttggcgtttgtgt

SEQ ID NO: 467290 - DNA, 20 bp, Artificial Sequence
  chemically synthesized
caaacgccaaacataaaaag

SEQ ID NO: 467291 - DNA, 20 bp, Artificial Sequence
  chemically synthesized
cagaagccatggccgtgagc

SEQ ID NO: 467292 - DNA, 20 bp, Artificial Sequence
  chemically synthesized
acctctctcattggctttcc

SEQ ID NO: 467293 - DNA, 20 bp, Artificial Sequence
  chemically synthesized
ttttttttttttttccagca

SEQ ID NO: 467294 - DNA, 20 bp, Artificial Sequence
  chemically synthesized
tatttgactagatgtgtctt

SEQ ID NO: 467295 - DNA, 20 bp, Artificial Sequence
  chemically synthesized
gattttacaaatgacgtctt

SEQ ID NO: 467296 - DNA, 20 bp, Artificial Sequence
  chemically synthesized
gacgtcatttgtaaaatcca

SEQ ID NO: 467297 - DNA, 20 bp, Artificial Sequence
  chemically synthesized
cagtttaatgcgtgaactct

SEQ ID NO: 467298 - DNA, 20 bp, Artificial Sequence
  chemically synthesized
catagagttcacgcattaaa

SEQ ID NO: 467299 - DNA, 20 bp, Artificial Sequence
  chemically synthesized
aaactggatgaaaactggca

SEQ ID NO: 467300 - DNA, 20 bp, Artificial Sequence
  chemically synthesized
gactttttttaacattaagt

SEQ ID NO: 467301 - DNA, 20 bp, Artificial Sequence
  chemically synthesized
cttaatgttaaaaaaagtct

SEQ ID NO: 467302 - DNA, 20 bp, Artificial Sequence
  chemically synthesized
gtttcaatgtgctgattgtc

SEQ ID NO: 467303 - DNA, 20 bp, Artificial Sequence
  chemically synthesized
atgtgcagactttgggcaca

SEQ ID NO: 467304 - DNA, 20 bp, Artificial Sequence
  chemically synthesized
gatggagtccagcctctatg

SEQ ID NO: 467305 - DNA, 20 bp, Artificial Sequence
  chemically synthesized
aacaaattctcccaagagga

SEQ ID NO: 467306 - DNA, 20 bp, Artificial Sequence
  chemically synthesized
gctggactccatcctcttgg

SEQ ID NO: 467307 - DNA, 20 bp, Artificial Sequence
  chemically synthesized
gatagaacaaattctcccaa

SEQ ID NO: 467308 - DNA, 20 bp, Artificial Sequence
  chemically synthesized
caagccacagagccagatcc

SEQ ID NO: 467309 - DNA, 20 bp, Artificial Sequence
  chemically synthesized
aggaagtggaaagctcattc

SEQ ID NO: 467310 - DNA, 20 bp, Artificial Sequence
  chemically synthesized
cgtaaggctcctgatatttg

SEQ ID NO: 467311 - DNA, 20 bp, Artificial Sequence
  chemically synthesized
gaatctatgaatcaaggcca

SEQ ID NO: 467312 - DNA, 20 bp, Artificial Sequence
  chemically synthesized
gcatacagatgtaggaatct

SEQ ID NO: 467313 - DNA, 20 bp, Artificial Sequence
  chemically synthesized
aaataaatgcatacagatgt

SEQ ID NO: 467314 - DNA, 20 bp, Artificial Sequence
  chemically synthesized
atcatagaacactttctcat

SEQ ID NO: 467315 - DNA, 20 bp, Artificial Sequence
  chemically synthesized
tctcctaaaacaatcttata

SEQ ID NO: 467316 - DNA, 20 bp, Artificial Sequence
  chemically synthesized
ctttgaactgctcaaaatat

SEQ ID NO: 467317 - DNA, 20 bp, Artificial Sequence
  chemically synthesized
ggggaaagggagatgctgta

SEQ ID NO: 467318 - DNA, 20 bp, Artificial Sequence
  chemically synthesized
tcttggagccactgagaatg

SEQ ID NO: 467319 - DNA, 20 bp, Artificial Sequence
  chemically synthesized
ttagtcttcttggagccact

SEQ ID NO: 467320 - DNA, 20 bp, Artificial Sequence
  chemically synthesized
gtagttctcaaattgtttca

SEQ ID NO: 467321 - DNA, 20 bp, Artificial Sequence
  chemically synthesized
caatttgagaactactagtc

SEQ ID NO: 467322 - DNA, 20 bp, Artificial Sequence
  chemically synthesized
tttcaaaactcactcaaggt

SEQ ID NO: 467323 - DNA, 20 bp, Artificial Sequence
  chemically synthesized
gttttgaaccctaaccttga

SEQ ID NO: 467324 - DNA, 20 bp, Artificial Sequence
  chemically synthesized
agaagttttgaaccctaacc

SEQ ID NO: 467325 - DNA, 20 bp, Artificial Sequence
  chemically synthesized
aaaacttctagtatacattt

SEQ ID NO: 467326 - DNA, 20 bp, Artificial Sequence
  chemically synthesized
tctcccttcctctcttcctt

SEQ ID NO: 467327 - DNA, 20 bp, Artificial Sequence
  chemically synthesized
ctgatactcctaagaaatcg

SEQ ID NO: 467328 - DNA, 20 bp, Artificial Sequence
  chemically synthesized
acatgactcagcgatttctt

SEQ ID NO: 467329 - DNA, 20 bp, Artificial Sequence
  chemically synthesized
cagggaaaagagggagaaaa

SEQ ID NO: 467330 - DNA, 20 bp, Artificial Sequence
  chemically synthesized
tgggtactagctcctcagct

SEQ ID NO: 467331 - DNA, 20 bp, Artificial Sequence
  chemically synthesized
tgatgggaacatcatttggt

SEQ ID NO: 467332 - DNA, 20 bp, Artificial Sequence
  chemically synthesized
gggatttcagccatcaagga

SEQ ID NO: 467333 - DNA, 20 bp, Artificial Sequence
  chemically synthesized
ttgatggctgaaatcccagt

SEQ ID NO: 467334 - DNA, 20 bp, Artificial Sequence
  chemically synthesized
aaggggtgagtgattcatac

SEQ ID NO: 467335 - DNA, 20 bp, Artificial Sequence
  chemically synthesized
aaaggaatcaaaaagaaggg

SEQ ID NO: 467336 - DNA, 20 bp, Artificial Sequence
  chemically synthesized
tgctaaaggaatcaaaaaga

SEQ ID NO: 467337 - DNA, 20 bp, Artificial Sequence
  chemically synthesized
ttttaaaaaaaccttgctaa

SEQ ID NO: 467338 - DNA, 20 bp, Artificial Sequence
  chemically synthesized
ttcataatactgtctggtgg

SEQ ID NO: 467339 - DNA, 20 bp, Artificial Sequence
  chemically synthesized
cttatagtcttacaggggaa

SEQ ID NO: 467340 - DNA, 20 bp, Artificial Sequence
  chemically synthesized
gactataagcctcttgagga

SEQ ID NO: 467341 - DNA, 20 bp, Artificial Sequence
  chemically synthesized
agggcattgggcatagagag

SEQ ID NO: 467342 - DNA, 20 bp, Artificial Sequence
  chemically synthesized
tttgataaatactggctgaa

SEQ ID NO: 467343 - DNA, 20 bp, Artificial Sequence
  chemically synthesized
gtgaattggtaaagtagtag

SEQ ID NO: 467344 - DNA, 20 bp, Artificial Sequence
  chemically synthesized
gtagttgggtcatgaccaag

SEQ ID NO: 467345 - DNA, 20 bp, Artificial Sequence
  chemically synthesized
cttcactggcacactttagt

SEQ ID NO: 467346 - DNA, 20 bp, Artificial Sequence
  chemically synthesized
ctttagtttggatgccaaag

SEQ ID NO: 467347 - DNA, 20 bp, Artificial Sequence
  chemically synthesized
tgttagaaagccatgtgatt

SEQ ID NO: 467348 - DNA, 20 bp, Artificial Sequence
  chemically synthesized
gtaattatggttatgtactt

SEQ ID NO: 467349 - DNA, 20 bp, Artificial Sequence
  chemically synthesized
cagaatgtaacgatgattct

SEQ ID NO: 467350 - DNA, 20 bp, Artificial Sequence
  chemically synthesized
tatgtatcattaagcattca

SEQ ID NO: 467351 - DNA, 20 bp, Artificial Sequence
  chemically synthesized
gttctgaatatggcttagtg

SEQ ID NO: 467352 - DNA, 20 bp, Artificial Sequence
  chemically synthesized
aatcaattgataactgagtt

SEQ ID NO: 467353 - DNA, 20 bp, Artificial Sequence
  chemically synthesized
aagaaataatcaattgataa

SEQ ID NO: 467354 - DNA, 20 bp, Artificial Sequence
  chemically synthesized
ataaaatatggtttctgaag

SEQ ID NO: 467355 - DNA, 20 bp, Artificial Sequence
  chemically synthesized
gggaggattttagaagagat

SEQ ID NO: 467356 - DNA, 20 bp, Artificial Sequence
  chemically synthesized
tggggacccaagtgatgagg

SEQ ID NO: 467357 - DNA, 20 bp, Artificial Sequence
  chemically synthesized
ctaaaatcctccctcatcac

SEQ ID NO: 467358 - DNA, 20 bp, Artificial Sequence
  chemically synthesized
cttccttttgtaatgtgtta

SEQ ID NO: 467359 - DNA, 20 bp, Artificial Sequence
  chemically synthesized
acatttatttttttttggaa

SEQ ID NO: 467360 - DNA, 20 bp, Artificial Sequence
  chemically synthesized
atgtgatgtgttgtcaggaa

SEQ ID NO: 467361 - DNA, 20 bp, Artificial Sequence
  chemically synthesized
ggaagtgtgctggggcagtc

SEQ ID NO: 467362 - DNA, 20 bp, Artificial Sequence
  chemically synthesized
ttgattgtaattcattattt

SEQ ID NO: 467363 - DNA, 20 bp, Artificial Sequence
  chemically synthesized
gcaattccaactctaaaata

SEQ ID NO: 467364 - DNA, 20 bp, Artificial Sequence
  chemically synthesized
gtaattcattattttagagt

SEQ ID NO: 467365 - DNA, 20 bp, Artificial Sequence
  chemically synthesized
attgcaggacagtactgttt

SEQ ID NO: 467366 - DNA, 20 bp, Artificial Sequence
  chemically synthesized
ttaagtattttaaatagtca

SEQ ID NO: 467367 - DNA, 20 bp, Artificial Sequence
  chemically synthesized
actatttaaaatacttaagg

SEQ ID NO: 467368 - DNA, 20 bp, Artificial Sequence
  chemically synthesized
aggaagaataagtccctttt

SEQ ID NO: 467369 - DNA, 20 bp, Artificial Sequence
  chemically synthesized
gagcctgcaagtgtggccat

SEQ ID NO: 467370 - DNA, 20 bp, Artificial Sequence
  chemically synthesized
ccacacttgcaggctctttg

SEQ ID NO: 467371 - DNA, 20 bp, Artificial Sequence
  chemically synthesized
ttgcaggctctttggtgaat

SEQ ID NO: 467372 - DNA, 20 bp, Artificial Sequence
  chemically synthesized
acaagattattgagctgaaa

SEQ ID NO: 467373 - DNA, 20 bp, Artificial Sequence
  chemically synthesized
attctgactcattacatgta

SEQ ID NO: 467374 - DNA, 20 bp, Artificial Sequence
  chemically synthesized
cctgtgactctatacatgta

SEQ ID NO: 467375 - DNA, 20 bp, Artificial Sequence
  chemically synthesized
actctatacatgtaatgagt

SEQ ID NO: 467376 - DNA, 20 bp, Artificial Sequence
  chemically synthesized
acgaaataatagcgtaaagc

SEQ ID NO: 467377 - DNA, 20 bp, Artificial Sequence
  chemically synthesized
gcagagtagttgcagcagtg

SEQ ID NO: 467378 - DNA, 20 bp, Artificial Sequence
  chemically synthesized
ttgctttctcattaccaggg

SEQ ID NO: 467379 - DNA, 20 bp, Artificial Sequence
  chemically synthesized
caactataggcaacatgtaa

SEQ ID NO: 467380 - DNA, 20 bp, Artificial Sequence
  chemically synthesized
tataggcaacatgtaaatga

SEQ ID NO: 467381 - DNA, 20 bp, Artificial Sequence
  chemically synthesized
ctgtatgtagtttgctagtc

SEQ ID NO: 467382 - DNA, 20 bp, Artificial Sequence
  chemically synthesized
gtttgctagtcctggattaa

SEQ ID NO: 467383 - DNA, 20 bp, Artificial Sequence
  chemically synthesized
gtttcctgtatgctcccaca

SEQ ID NO: 467384 - DNA, 20 bp, Artificial Sequence
  chemically synthesized
ttgtgggagcatacaggaaa

SEQ ID NO: 467385 - DNA, 20 bp, Artificial Sequence
  chemically synthesized
gctcttccataaaagaacca

SEQ ID NO: 467386 - DNA, 20 bp, Artificial Sequence
  chemically synthesized
cggtaggttttacaaagctg

SEQ ID NO: 467387 - DNA, 20 bp, Artificial Sequence
  chemically synthesized
agctgttgggttggtaattt

SEQ ID NO: 467388 - DNA, 20 bp, Artificial Sequence
  chemically synthesized
ggtaatttaggggtatttga

SEQ ID NO: 467389 - DNA, 20 bp, Artificial Sequence
  chemically synthesized
gtacgcgggcttatttgaga

SEQ ID NO: 467390 - DNA, 20 bp, Artificial Sequence
  chemically synthesized
aggggatggtatgaaaaaaa

SEQ ID NO: 467391 - DNA, 20 bp, Artificial Sequence
  chemically synthesized
gtagcactgctaactgcttt

SEQ ID NO: 467392 - DNA, 20 bp, Artificial Sequence
  chemically synthesized
gtaccactttatatagatga

SEQ ID NO: 467393 - DNA, 20 bp, Artificial Sequence
  chemically synthesized
tgtggtaccactttatatag

SEQ ID NO: 467394 - DNA, 20 bp, Artificial Sequence
  chemically synthesized
cttatggacaaatcacttaa

SEQ ID NO: 467395 - DNA, 20 bp, Artificial Sequence
  chemically synthesized
ccattctataggaaaactac

SEQ ID NO: 467396 - DNA, 20 bp, Artificial Sequence
  chemically synthesized
gtacccatgtagttttccta

SEQ ID NO: 467397 - DNA, 20 bp, Artificial Sequence
  chemically synthesized
tatagaatggcagagcttta

SEQ ID NO: 467398 - DNA, 20 bp, Artificial Sequence
  chemically synthesized
tgtaagtatatgtgtagaaa

SEQ ID NO: 467399 - DNA, 20 bp, Artificial Sequence
  chemically synthesized
gctcagtgtatatttgaaca

SEQ ID NO: 467400 - DNA, 20 bp, Artificial Sequence
  chemically synthesized
ttcacaaacacttgggagat

SEQ ID NO: 467401 - DNA, 20 bp, Artificial Sequence
  chemically synthesized
agaaagatataatcacaaag

SEQ ID NO: 467402 - DNA, 20 bp, Artificial Sequence
  chemically synthesized
aatgtttacacattcatatc

SEQ ID NO: 467403 - DNA, 20 bp, Artificial Sequence
  chemically synthesized
agcaggagcatattcaagat

SEQ ID NO: 467404 - DNA, 20 bp, Artificial Sequence
  chemically synthesized
tgcttatattgcctattatg

SEQ ID NO: 467405 - DNA, 20 bp, Artificial Sequence
  chemically synthesized
actgttatcaaaattaataa

SEQ ID NO: 467406 - DNA, 20 bp, Artificial Sequence
  chemically synthesized
tagaagcctaacttaacctg

SEQ ID NO: 467407 - DNA, 20 bp, Artificial Sequence
  chemically synthesized
ctttatcttttattttcaca

SEQ ID NO: 467408 - DNA, 20 bp, Artificial Sequence
  chemically synthesized
ttttctgttgccccttgcca

SEQ ID NO: 467409 - DNA, 20 bp, Artificial Sequence
  chemically synthesized
ctctgtgggcaattatctag

SEQ ID NO: 467410 - DNA, 20 bp, Artificial Sequence
  chemically synthesized
ctctggctctcacatctgtt

SEQ ID NO: 467411 - DNA, 20 bp, Artificial Sequence
  chemically synthesized
cagctgttttggacagctgt

SEQ ID NO: 467412 - DNA, 20 bp, Artificial Sequence
  chemically synthesized
tgtaacacaacaatgagaac

SEQ ID NO: 467413 - DNA, 20 bp, Artificial Sequence
  chemically synthesized
gagaacatggatggtagtgt

SEQ ID NO: 467414 - DNA, 20 bp, Artificial Sequence
  chemically synthesized
tctcagtttttcttgcctgg

SEQ ID NO: 467415 - DNA, 20 bp, Artificial Sequence
  chemically synthesized
tggttcagaaaatccattta

SEQ ID NO: 467416 - DNA, 20 bp, Artificial Sequence
  chemically synthesized
tgctggttgcaacccactaa

SEQ ID NO: 467417 - DNA, 20 bp, Artificial Sequence
  chemically synthesized
aatgtgtgtgtgtacatatg

SEQ ID NO: 467418 - DNA, 20 bp, Artificial Sequence
  chemically synthesized
gaacattttacatcacaaac

SEQ ID NO: 467419 - DNA, 20 bp, Artificial Sequence
  chemically synthesized
atgtaaaatgttcctctgat

SEQ ID NO: 467420 - DNA, 20 bp, Artificial Sequence
  chemically synthesized
gatatggataaccatcaaaa

SEQ ID NO: 467421 - DNA, 20 bp, Artificial Sequence
  chemically synthesized
cagagtcagaaatcactgtc

SEQ ID NO: 467422 - DNA, 20 bp, Artificial Sequence
  chemically synthesized
tcttgagaatcttaacatct

SEQ ID NO: 467423 - DNA, 20 bp, Artificial Sequence
  chemically synthesized
cccaagatgttaagattctc

SEQ ID NO: 467424 - DNA, 20 bp, Artificial Sequence
  chemically synthesized
gatattaagcagaaattctt

SEQ ID NO: 467425 - DNA, 20 bp, Artificial Sequence
  chemically synthesized
tgcactcaaaaaagtggttt

SEQ ID NO: 467426 - DNA, 20 bp, Artificial Sequence
  chemically synthesized
agcatccaaaaaccactttt

SEQ ID NO: 467427 - DNA, 20 bp, Artificial Sequence
  chemically synthesized
taatgaaactttttatccac

SEQ ID NO: 467428 - DNA, 20 bp, Artificial Sequence
  chemically synthesized
ctttttctccccaaattcaa

SEQ ID NO: 467429 - DNA, 20 bp, Artificial Sequence
  chemically synthesized
aaaaaggcctgtaagaaagc

SEQ ID NO: 467430 - DNA, 20 bp, Artificial Sequence
  chemically synthesized
atgccaagatcatggtatta

SEQ ID NO: 467431 - DNA, 20 bp, Artificial Sequence
  chemically synthesized
taaatacacaaaaaacacaa

SEQ ID NO: 467432 - DNA, 20 bp, Artificial Sequence
  chemically synthesized
atttaattgttttgtttttt

SEQ ID NO: 467433 - DNA, 20 bp, Artificial Sequence
  chemically synthesized
ttgttttgttttttaagaat

SEQ ID NO: 467434 - DNA, 20 bp, Artificial Sequence
  chemically synthesized
aatttattttctcaggccac

SEQ ID NO: 467435 - DNA, 20 bp, Artificial Sequence
  chemically synthesized
ctcaggccacaagggtacca

SEQ ID NO: 467436 - DNA, 20 bp, Artificial Sequence
  chemically synthesized
taagccggaacttaagttaa

SEQ ID NO: 467437 - DNA, 20 bp, Artificial Sequence
  chemically synthesized
tactaaattagtgcttacgg

SEQ ID NO: 467438 - DNA, 20 bp, Artificial Sequence
  chemically synthesized
gtaaacactatccaggtggc

SEQ ID NO: 467439 - DNA, 20 bp, Artificial Sequence
  chemically synthesized
ggaaactcaattcaggccac

SEQ ID NO: 467440 - DNA, 20 bp, Artificial Sequence
  chemically synthesized
cactatccaggtggcctgaa

SEQ ID NO: 467441 - DNA, 20 bp, Artificial Sequence
  chemically synthesized
tccttaaagctagataccac

SEQ ID NO: 467442 - DNA, 20 bp, Artificial Sequence
  chemically synthesized
atctccctgtgtcccgcttt

SEQ ID NO: 467443 - DNA, 20 bp, Artificial Sequence
  chemically synthesized
ggacacagggagatggtgca

SEQ ID NO: 467444 - DNA, 20 bp, Artificial Sequence
  chemically synthesized
gatttcaccttacagctaat

SEQ ID NO: 467445 - DNA, 20 bp, Artificial Sequence
  chemically synthesized
tcctagactcctttttgtac

SEQ ID NO: 467446 - DNA, 20 bp, Artificial Sequence
  chemically synthesized
ccagaaactcaggtacaaaa

SEQ ID NO: 467447 - DNA, 20 bp, Artificial Sequence
  chemically synthesized
caaggctgcctatgaagaag

SEQ ID NO: 467448 - DNA, 20 bp, Artificial Sequence
  chemically synthesized
ttagatgtggaagaaatgcc

SEQ ID NO: 467449 - DNA, 20 bp, Artificial Sequence
  chemically synthesized
aagctgccagttcaaggggc

SEQ ID NO: 467450 - DNA, 20 bp, Artificial Sequence
  chemically synthesized
atcaatgattgtactgtgat

SEQ ID NO: 467451 - DNA, 20 bp, Artificial Sequence
  chemically synthesized
tactgtgatttgaatttctt

SEQ ID NO: 467452 - DNA, 20 bp, Artificial Sequence
  chemically synthesized
ccataagtaccttgaaggca

SEQ ID NO: 467453 - DNA, 20 bp, Artificial Sequence
  chemically synthesized
tacgtaccagtggaggtagt

SEQ ID NO: 467454 - DNA, 20 bp, Artificial Sequence
  chemically synthesized
aagatcatacacaggcttga

SEQ ID NO: 467455 - DNA, 20 bp, Artificial Sequence
  chemically synthesized
ctgtgtatgatcttctcatt

SEQ ID NO: 467456 - DNA, 20 bp, Artificial Sequence
  chemically synthesized
aaggagatacctaagatagt

SEQ ID NO: 467457 - DNA, 20 bp, Artificial Sequence
  chemically synthesized
atacctaagatagtcagaat

SEQ ID NO: 467458 - DNA, 20 bp, Artificial Sequence
  chemically synthesized
aagatagtcagaatggggat

SEQ ID NO: 467459 - DNA, 20 bp, Artificial Sequence
  chemically synthesized
tggggatgcgggtggcggtg

SEQ ID NO: 467460 - DNA, 20 bp, Artificial Sequence
  chemically synthesized
tggcggtgggggatgtggag

SEQ ID NO: 467461 - DNA, 20 bp, Artificial Sequence
  chemically synthesized
agggcaatgaggagggtgta

SEQ ID NO: 467462 - DNA, 20 bp, Artificial Sequence
  chemically synthesized
ctctccataagggcaatgag

SEQ ID NO: 467463 - DNA, 20 bp, Artificial Sequence
  chemically synthesized
gccagtgattggcacctcta

SEQ ID NO: 467464 - DNA, 20 bp, Artificial Sequence
  chemically synthesized
gccttccttcaacgaataaa

SEQ ID NO: 467465 - DNA, 20 bp, Artificial Sequence
  chemically synthesized
cactctctcgccttccttca

SEQ ID NO: 467466 - DNA, 20 bp, Artificial Sequence
  chemically synthesized
tattcgttgaaggaaggcga

SEQ ID NO: 467467 - DNA, 20 bp, Artificial Sequence
  chemically synthesized
agtagcagcaaaacatcatc

SEQ ID NO: 467468 - DNA, 20 bp, Artificial Sequence
  chemically synthesized
aagccagtgggaaaattctg

SEQ ID NO: 467469 - DNA, 20 bp, Artificial Sequence
  chemically synthesized
aaaaacagcattttaccctg

SEQ ID NO: 467470 - DNA, 20 bp, Artificial Sequence
  chemically synthesized
gtaaaatgctgtttttgtat

SEQ ID NO: 467471 - DNA, 20 bp, Artificial Sequence
  chemically synthesized
tagggacaattaaatcttca

SEQ ID NO: 467472 - DNA, 20 bp, Artificial Sequence
  chemically synthesized
ttgtccctatatttaaatga

SEQ ID NO: 467473 - DNA, 20 bp, Artificial Sequence
  chemically synthesized
aagggcatcagatggcaagt

SEQ ID NO: 467474 - DNA, 20 bp, Artificial Sequence
  chemically synthesized
ttgcttcacacattagtctg

SEQ ID NO: 467475 - DNA, 20 bp, Artificial Sequence
  chemically synthesized
agtaaaatacttgacaaata

SEQ ID NO: 467476 - DNA, 20 bp, Artificial Sequence
  chemically synthesized
ggcaacatgtttccaaaaat

SEQ ID NO: 467477 - DNA, 20 bp, Artificial Sequence
  chemically synthesized
tttggaaacatgttgccctc

SEQ ID NO: 467478 - DNA, 20 bp, Artificial Sequence
  chemically synthesized
catgttgccctcacgggtat

SEQ ID NO: 467479 - DNA, 20 bp, Artificial Sequence
  chemically synthesized
ccctcacgggtatttgaatt

SEQ ID NO: 467480 - DNA, 20 bp, Artificial Sequence
  chemically synthesized
aatttgtggtttagagtact

SEQ ID NO: 467481 - DNA, 20 bp, Artificial Sequence
  chemically synthesized
ttaagtgtgaatttgtggtt

SEQ ID NO: 467482 - DNA, 20 bp, Artificial Sequence
  chemically synthesized
aaaagatttgatttttaagt

SEQ ID NO: 467483 - DNA, 20 bp, Artificial Sequence
  chemically synthesized
cgcagtatcagaatggcaat

SEQ ID NO: 467484 - DNA, 20 bp, Artificial Sequence
  chemically synthesized
tggaagccaacacgcagtat

SEQ ID NO: 467485 - DNA, 20 bp, Artificial Sequence
  chemically synthesized
atggaaaatacacacaccag

SEQ ID NO: 467486 - DNA, 20 bp, Artificial Sequence
  chemically synthesized
cacaccagttgggtagggaa

SEQ ID NO: 467487 - DNA, 20 bp, Artificial Sequence
  chemically synthesized
gtggcctgatcccagcaaat

SEQ ID NO: 467488 - DNA, 20 bp, Artificial Sequence
  chemically synthesized
tagaagggactcagatttgc

SEQ ID NO: 467489 - DNA, 20 bp, Artificial Sequence
  chemically synthesized
cttacctcttgaactaggga

SEQ ID NO: 467490 - DNA, 20 bp, Artificial Sequence
  chemically synthesized
ttgaactagggaaggagttg

SEQ ID NO: 467491 - DNA, 20 bp, Artificial Sequence
  chemically synthesized
tcctccccaggacacaagca

SEQ ID NO: 467492 - DNA, 20 bp, Artificial Sequence
  chemically synthesized
gttatttatgagcaagtgaa

SEQ ID NO: 467493 - DNA, 20 bp, Artificial Sequence
  chemically synthesized
acttcctcattattaagctt

SEQ ID NO: 467494 - DNA, 20 bp, Artificial Sequence
  chemically synthesized
tggatttcttcttcccttta

SEQ ID NO: 467495 - DNA, 20 bp, Artificial Sequence
  chemically synthesized
tgatatagataaactactgt

SEQ ID NO: 467496 - DNA, 20 bp, Artificial Sequence
  chemically synthesized
tatacagtttttttttctcc

SEQ ID NO: 467497 - DNA, 20 bp, Artificial Sequence
  chemically synthesized
ttttttttttttttttgaga

SEQ ID NO: 467498 - DNA, 20 bp, Artificial Sequence
  chemically synthesized
tcttgctctgtcacccaggc

SEQ ID NO: 467499 - DNA, 20 bp, Artificial Sequence
  chemically synthesized
tcgtgccactgcactccagc

SEQ ID NO: 467500 - DNA, 20 bp, Artificial Sequence
  chemically synthesized
tactcgggaggctgaggcag

SEQ ID NO: 467501 - DNA, 20 bp, Artificial Sequence
  chemically synthesized
gattcttctgcctcagcctc

SEQ ID NO: 467502 - DNA, 20 bp, Artificial Sequence
  chemically synthesized
ttttgtatttttagtagaga

SEQ ID NO: 467503 - DNA, 20 bp, Artificial Sequence
  chemically synthesized
ggtgggcagatcatgaggtc

SEQ ID NO: 467504 - DNA, 20 bp, Artificial Sequence
  chemically synthesized
acctcagcctcccaaagtgc

SEQ ID NO: 467505 - DNA, 20 bp, Artificial Sequence
  chemically synthesized
aatgataaatacatgagata

SEQ ID NO: 467506 - DNA, 20 bp, Artificial Sequence
  chemically synthesized
aatgatcaagtcagggtatt

SEQ ID NO: 467507 - DNA, 20 bp, Artificial Sequence
  chemically synthesized
gaatgtgttaatgatcaagt

SEQ ID NO: 467508 - DNA, 20 bp, Artificial Sequence
  chemically synthesized
ttgatattttgttgcataca

SEQ ID NO: 467509 - DNA, 20 bp, Artificial Sequence
  chemically synthesized
ataatatttgtacatattta

SEQ ID NO: 467510 - DNA, 20 bp, Artificial Sequence
  chemically synthesized
atactacagtaaaaaacagg

SEQ ID NO: 467511 - DNA, 20 bp, Artificial Sequence
  chemically synthesized
acctcggcttcccaaagggc

SEQ ID NO: 467512 - DNA, 20 bp, Artificial Sequence
  chemically synthesized
cctttgggaagccgaggtgg

SEQ ID NO: 467513 - DNA, 20 bp, Artificial Sequence
  chemically synthesized
tgggaggattgtttgctgcc

SEQ ID NO: 467514 - DNA, 20 bp, Artificial Sequence
  chemically synthesized
tttttgtttttaaatagaga

SEQ ID NO: 467515 - DNA, 20 bp, Artificial Sequence
  chemically synthesized
aaataaatttaaaagttaaa

SEQ ID NO: 467516 - DNA, 20 bp, Artificial Sequence
  chemically synthesized
tagaacaaagtttcacattt

SEQ ID NO: 467517 - DNA, 20 bp, Artificial Sequence
  chemically synthesized
gtgctgtctcctcaacacaa

SEQ ID NO: 467518 - DNA, 20 bp, Artificial Sequence
  chemically synthesized
tctcctcaacacaaaagagt

SEQ ID NO: 467519 - DNA, 20 bp, Artificial Sequence
  chemically synthesized
tcacttcatgaaggtaagaa

SEQ ID NO: 467520 - DNA, 20 bp, Artificial Sequence
  chemically synthesized
tttggttaaatgtcaaaaca

SEQ ID NO: 467521 - DNA, 20 bp, Artificial Sequence
  chemically synthesized
acattggagtttaaaggtac

SEQ ID NO: 467522 - DNA, 20 bp, Artificial Sequence
  chemically synthesized
tatttttatttctattacat

SEQ ID NO: 467523 - DNA, 20 bp, Artificial Sequence
  chemically synthesized
ttcatatttcattacctata

SEQ ID NO: 467524 - DNA, 20 bp, Artificial Sequence
  chemically synthesized
tcctatataggtaatgaaat

SEQ ID NO: 467525 - DNA, 20 bp, Artificial Sequence
  chemically synthesized
tatgccatatctacagtttt

SEQ ID NO: 467526 - DNA, 20 bp, Artificial Sequence
  chemically synthesized
tgtagatatggcatatattg

SEQ ID NO: 467527 - DNA, 20 bp, Artificial Sequence
  chemically synthesized
tactttatcataattatgtt

SEQ ID NO: 467528 - DNA, 20 bp, Artificial Sequence
  chemically synthesized
tttgactgtttatgtgagga

SEQ ID NO: 467529 - DNA, 20 bp, Artificial Sequence
  chemically synthesized
atctggaagcaaagaaacct

SEQ ID NO: 467530 - DNA, 20 bp, Artificial Sequence
  chemically synthesized
ggaagcaaagaaacctatgg

SEQ ID NO: 467531 - DNA, 20 bp, Artificial Sequence
  chemically synthesized
atggatggatgatattcact

SEQ ID NO: 467532 - DNA, 20 bp, Artificial Sequence
  chemically synthesized
caaggagatttccattccca

SEQ ID NO: 467533 - DNA, 20 bp, Artificial Sequence
  chemically synthesized
gaaatctccttgtagatttt

SEQ ID NO: 467534 - DNA, 20 bp, Artificial Sequence
  chemically synthesized
atgtgcaaaacaaacagagc

SEQ ID NO: 467535 - DNA, 20 bp, Artificial Sequence
  chemically synthesized
tccaagtggcatagaccaaa

SEQ ID NO: 467536 - DNA, 20 bp, Artificial Sequence
  chemically synthesized
ttccctttggtctatgccac

SEQ ID NO: 467537 - DNA, 20 bp, Artificial Sequence
  chemically synthesized
cttggattttcatgtttgat

SEQ ID NO: 467538 - DNA, 20 bp, Artificial Sequence
  chemically synthesized
aaaaaaaaaaggaataaatg

SEQ ID NO: 467539 - DNA, 20 bp, Artificial Sequence
  chemically synthesized
ctgctgttaaaaaaaaaaaa

SEQ ID NO: 467540 - DNA, 20 bp, Artificial Sequence
  chemically synthesized
tttttaacagcagaagctaa

SEQ ID NO: 467541 - DNA, 20 bp, Artificial Sequence
  chemically synthesized
aagacaaaatcatattctag

SEQ ID NO: 467542 - DNA, 20 bp, Artificial Sequence
  chemically synthesized
tatgaagcctcacatccacc

SEQ ID NO: 467543 - DNA, 20 bp, Artificial Sequence
  chemically synthesized
gtgaggcttcatatttttat

SEQ ID NO: 467544 - DNA, 20 bp, Artificial Sequence
  chemically synthesized
tcatatttttattagaatgg

SEQ ID NO: 467545 - DNA, 20 bp, Artificial Sequence
  chemically synthesized
gataaaaagcctcagactac

SEQ ID NO: 467546 - DNA, 20 bp, Artificial Sequence
  chemically synthesized
tgcaatattaagtacaggaa

SEQ ID NO: 467547 - DNA, 20 bp, Artificial Sequence
  chemically synthesized
agtacaggaaatgggtgctg

SEQ ID NO: 467548 - DNA, 20 bp, Artificial Sequence
  chemically synthesized
ttaaggtcacaaagcagaaa

SEQ ID NO: 467549 - DNA, 20 bp, Artificial Sequence
  chemically synthesized
agagagagaaagaggagaga

SEQ ID NO: 467550 - DNA, 20 bp, Artificial Sequence
  chemically synthesized
gaaaaatgaaactaaaaata

SEQ ID NO: 467551 - DNA, 20 bp, Artificial Sequence
  chemically synthesized
cattatctggtgaagatgaa

SEQ ID NO: 467552 - DNA, 20 bp, Artificial Sequence
  chemically synthesized
aatgaatgaaatactaccaa

SEQ ID NO: 467553 - DNA, 20 bp, Artificial Sequence
  chemically synthesized
gtaatcagccctgcagttgt

SEQ ID NO: 467554 - DNA, 20 bp, Artificial Sequence
  chemically synthesized
ttcagtgacagtatgcctca

SEQ ID NO: 467555 - DNA, 20 bp, Artificial Sequence
  chemically synthesized
tgaattttaacacagtacaa

SEQ ID NO: 467556 - DNA, 20 bp, Artificial Sequence
  chemically synthesized
gtcacttcattgaactgtac

SEQ ID NO: 467557 - DNA, 20 bp, Artificial Sequence
  chemically synthesized
agtgactggcattcctgttc

SEQ ID NO: 467558 - DNA, 20 bp, Artificial Sequence
  chemically synthesized
ctttgaaataattcaggaac

SEQ ID NO: 467559 - DNA, 20 bp, Artificial Sequence
  chemically synthesized
tttttccagataaactctct

SEQ ID NO: 467560 - DNA, 20 bp, Artificial Sequence
  chemically synthesized
actcatattaaagactcaca

SEQ ID NO: 467561 - DNA, 20 bp, Artificial Sequence
  chemically synthesized
actctctgtgagtctttaat

SEQ ID NO: 467562 - DNA, 20 bp, Artificial Sequence
  chemically synthesized
gcactcaaaaaaatgtctga

SEQ ID NO: 467563 - DNA, 20 bp, Artificial Sequence
  chemically synthesized
ataggcactcaaaaaaatgt

SEQ ID NO: 467564 - DNA, 20 bp, Artificial Sequence
  chemically synthesized
gtatccattcagacattttt

SEQ ID NO: 467565 - DNA, 20 bp, Artificial Sequence
  chemically synthesized
ctacttgtttttatactacc

SEQ ID NO: 467566 - DNA, 20 bp, Artificial Sequence
  chemically synthesized
ctaggtagtataaaaacaag

SEQ ID NO: 467567 - DNA, 20 bp, Artificial Sequence
  chemically synthesized
ctttttctttttttttgaga

SEQ ID NO: 467568 - DNA, 20 bp, Artificial Sequence
  chemically synthesized
tcttgctctgtcacccaggc

SEQ ID NO: 467569 - DNA, 20 bp, Artificial Sequence
  chemically synthesized
ttccaccactgcactccagc

SEQ ID NO: 467570 - DNA, 20 bp, Artificial Sequence
  chemically synthesized
cccaggctggagtgcagtgg

SEQ ID NO: 467571 - DNA, 20 bp, Artificial Sequence
  chemically synthesized
ctagctgcaacctctgcctt

SEQ ID NO: 467572 - DNA, 20 bp, Artificial Sequence
  chemically synthesized
tactcaggaggctgaggcag

SEQ ID NO: 467573 - DNA, 20 bp, Artificial Sequence
  chemically synthesized
gattctcctgcctcagcctc

SEQ ID NO: 467574 - DNA, 20 bp, Artificial Sequence
  chemically synthesized
tttatattttttagtagaga

SEQ ID NO: 467575 - DNA, 20 bp, Artificial Sequence
  chemically synthesized
cagggtttcaccgtgttagc

SEQ ID NO: 467576 - DNA, 20 bp, Artificial Sequence
  chemically synthesized
actttgggaggccgaggcag

SEQ ID NO: 467577 - DNA, 20 bp, Artificial Sequence
  chemically synthesized
gcctcggcctcccaaagtgc

SEQ ID NO: 467578 - DNA, 20 bp, Artificial Sequence
  chemically synthesized
gcccaggctcatctcttttt

SEQ ID NO: 467579 - DNA, 20 bp, Artificial Sequence
  chemically synthesized
atcagacatcacatatgtgc

SEQ ID NO: 467580 - DNA, 20 bp, Artificial Sequence
  chemically synthesized
acatatgtgcatgagtagaa

SEQ ID NO: 467581 - DNA, 20 bp, Artificial Sequence
  chemically synthesized
taggcattaagcatttttca

SEQ ID NO: 467582 - DNA, 20 bp, Artificial Sequence
  chemically synthesized
atgcctaatattttctgtgt

SEQ ID NO: 467583 - DNA, 20 bp, Artificial Sequence
  chemically synthesized
ttaaaaggcattttaaaaat

SEQ ID NO: 467584 - DNA, 20 bp, Artificial Sequence
  chemically synthesized
ataaatatttgaataaataa

SEQ ID NO: 467585 - DNA, 20 bp, Artificial Sequence
  chemically synthesized
agttggattttaataaatat

SEQ ID NO: 467586 - DNA, 20 bp, Artificial Sequence
  chemically synthesized
acagtgcctggcatatatag

SEQ ID NO: 467587 - DNA, 20 bp, Artificial Sequence
  chemically synthesized
tcacagagagagtgtgtggg

SEQ ID NO: 467588 - DNA, 20 bp, Artificial Sequence
  chemically synthesized
gagtttcacagagagagtgt

SEQ ID NO: 467589 - DNA, 20 bp, Artificial Sequence
  chemically synthesized
atgaatgcgagtttcacaga

SEQ ID NO: 467590 - DNA, 20 bp, Artificial Sequence
  chemically synthesized
ctgtgtgcctccttatgaat

SEQ ID NO: 467591 - DNA, 20 bp, Artificial Sequence
  chemically synthesized
ttaagcctgtgtgcctcctt

SEQ ID NO: 467592 - DNA, 20 bp, Artificial Sequence
  chemically synthesized
aagtaaactatataggtatc

SEQ ID NO: 467593 - DNA, 20 bp, Artificial Sequence
  chemically synthesized
tcccttgctagccctctcct

SEQ ID NO: 467594 - DNA, 20 bp, Artificial Sequence
  chemically synthesized
gagggctagcaagggacaat

SEQ ID NO: 467595 - DNA, 20 bp, Artificial Sequence
  chemically synthesized
caatgagagtcatcagaaag

SEQ ID NO: 467596 - DNA, 20 bp, Artificial Sequence
  chemically synthesized
agcaaaagctttaagaactg

SEQ ID NO: 467597 - DNA, 20 bp, Artificial Sequence
  chemically synthesized
agctttaagaactggagggt

SEQ ID NO: 467598 - DNA, 20 bp, Artificial Sequence
  chemically synthesized
gggaaaagtgctccagacag

SEQ ID NO: 467599 - DNA, 20 bp, Artificial Sequence
  chemically synthesized
aaatgcaaagactctgagag

SEQ ID NO: 467600 - DNA, 20 bp, Artificial Sequence
  chemically synthesized
agccagtcacactctcctct

SEQ ID NO: 467601 - DNA, 20 bp, Artificial Sequence
  chemically synthesized
gaagtctaatgtagataaag

SEQ ID NO: 467602 - DNA, 20 bp, Artificial Sequence
  chemically synthesized
aaacagtacttccctggcct

SEQ ID NO: 467603 - DNA, 20 bp, Artificial Sequence
  chemically synthesized
tacttccctggcctggggat

SEQ ID NO: 467604 - DNA, 20 bp, Artificial Sequence
  chemically synthesized
agcaggttatgtggccaaat

SEQ ID NO: 467605 - DNA, 20 bp, Artificial Sequence
  chemically synthesized
acataacctgctttggaaaa

SEQ ID NO: 467606 - DNA, 20 bp, Artificial Sequence
  chemically synthesized
gcatgacaaaagtagaggct

SEQ ID NO: 467607 - DNA, 20 bp, Artificial Sequence
  chemically synthesized
ttagaatgtctttgactggt

SEQ ID NO: 467608 - DNA, 20 bp, Artificial Sequence
  chemically synthesized
aggtagcttgctagcccaag

SEQ ID NO: 467609 - DNA, 20 bp, Artificial Sequence
  chemically synthesized
acttgacaccaagttgtggt

SEQ ID NO: 467610 - DNA, 20 bp, Artificial Sequence
  chemically synthesized
ttcagccaaacaacagatgc

SEQ ID NO: 467611 - DNA, 20 bp, Artificial Sequence
  chemically synthesized
gaatgagaaatatgcaactt

SEQ ID NO: 467612 - DNA, 20 bp, Artificial Sequence
  chemically synthesized
atctctatagcagtgtgaaa

SEQ ID NO: 467613 - DNA, 20 bp, Artificial Sequence
  chemically synthesized
tatagagatactacctgaga

SEQ ID NO: 467614 - DNA, 20 bp, Artificial Sequence
  chemically synthesized
ctcctcacgcatctggaact

SEQ ID NO: 467615 - DNA, 20 bp, Artificial Sequence
  chemically synthesized
aggcctcatgattataagtt

SEQ ID NO: 467616 - DNA, 20 bp, Artificial Sequence
  chemically synthesized
tgctgttctcgtgatagtga

SEQ ID NO: 467617 - DNA, 20 bp, Artificial Sequence
  chemically synthesized
cccatgctgttctcgtgata

SEQ ID NO: 467618 - DNA, 20 bp, Artificial Sequence
  chemically synthesized
agggacctgatgggaggtga

SEQ ID NO: 467619 - DNA, 20 bp, Artificial Sequence
  chemically synthesized
aggtccctcccctgacacgt

SEQ ID NO: 467620 - DNA, 20 bp, Artificial Sequence
  chemically synthesized
gtgatgacaggtattattgt

SEQ ID NO: 467621 - DNA, 20 bp, Artificial Sequence
  chemically synthesized
tggaactcagtattttcttg

SEQ ID NO: 467622 - DNA, 20 bp, Artificial Sequence
  chemically synthesized
acttattcaacaagaaaata

SEQ ID NO: 467623 - DNA, 20 bp, Artificial Sequence
  chemically synthesized
aggcaatgaatctgtgaagt

SEQ ID NO: 467624 - DNA, 20 bp, Artificial Sequence
  chemically synthesized
atatgctatttgagcaggca

SEQ ID NO: 467625 - DNA, 20 bp, Artificial Sequence
  chemically synthesized
tagcatattgctagtctttg

SEQ ID NO: 467626 - DNA, 20 bp, Artificial Sequence
  chemically synthesized
ttgtggaaatcaccttggag

SEQ ID NO: 467627 - DNA, 20 bp, Artificial Sequence
  chemically synthesized
catgtttgtggaaatcacct

SEQ ID NO: 467628 - DNA, 20 bp, Artificial Sequence
  chemically synthesized
cataaataatagatgtcagt

SEQ ID NO: 467629 - DNA, 20 bp, Artificial Sequence
  chemically synthesized
aacacttttacactgctggt

SEQ ID NO: 467630 - DNA, 20 bp, Artificial Sequence
  chemically synthesized
gatatccagtagtgggactg

SEQ ID NO: 467631 - DNA, 20 bp, Artificial Sequence
  chemically synthesized
ttgatccagcagtcccacta

SEQ ID NO: 467632 - DNA, 20 bp, Artificial Sequence
  chemically synthesized
acataatgacttcctttcct

SEQ ID NO: 467633 - DNA, 20 bp, Artificial Sequence
  chemically synthesized
agttccgtatttctgcaatt

SEQ ID NO: 467634 - DNA, 20 bp, Artificial Sequence
  chemically synthesized
gcttaaatgcccatcaacca

SEQ ID NO: 467635 - DNA, 20 bp, Artificial Sequence
  chemically synthesized
aaatgcccatcaaccaacga

SEQ ID NO: 467636 - DNA, 20 bp, Artificial Sequence
  chemically synthesized
acacacacacacacacgcca

SEQ ID NO: 467637 - DNA, 20 bp, Artificial Sequence
  chemically synthesized
catggaatattagtcatgaa

SEQ ID NO: 467638 - DNA, 20 bp, Artificial Sequence
  chemically synthesized
ataatggcattcacagcaac

SEQ ID NO: 467639 - DNA, 20 bp, Artificial Sequence
  chemically synthesized
ccaactccatccaggttgct

SEQ ID NO: 467640 - DNA, 20 bp, Artificial Sequence
  chemically synthesized
ggcattcacagcaacctgga

SEQ ID NO: 467641 - DNA, 20 bp, Artificial Sequence
  chemically synthesized
tattcctgagttactttact

SEQ ID NO: 467642 - DNA, 20 bp, Artificial Sequence
  chemically synthesized
tactctaagtaaagtaactc

SEQ ID NO: 467643 - DNA, 20 bp, Artificial Sequence
  chemically synthesized
caatgtttggttgtctattc

SEQ ID NO: 467644 - DNA, 20 bp, Artificial Sequence
  chemically synthesized
ataagtgggagctaagctat

SEQ ID NO: 467645 - DNA, 20 bp, Artificial Sequence
  chemically synthesized
ctatgcggatgcaaaggcat

SEQ ID NO: 467646 - DNA, 20 bp, Artificial Sequence
  chemically synthesized
cacccttccccccaagtccc

SEQ ID NO: 467647 - DNA, 20 bp, Artificial Sequence
  chemically synthesized
gactctggggacttgggggg

SEQ ID NO: 467648 - DNA, 20 bp, Artificial Sequence
  chemically synthesized
cttggggggaagggtgggag

SEQ ID NO: 467649 - DNA, 20 bp, Artificial Sequence
  chemically synthesized
ggaagggtgggaggggggtg

SEQ ID NO: 467650 - DNA, 20 bp, Artificial Sequence
  chemically synthesized
gaaggataaaagactacacg

SEQ ID NO: 467651 - DNA, 20 bp, Artificial Sequence
  chemically synthesized
cagtgtacactgctcaggtg

SEQ ID NO: 467652 - DNA, 20 bp, Artificial Sequence
  chemically synthesized
tcggtggtgatttctgacat

SEQ ID NO: 467653 - DNA, 20 bp, Artificial Sequence
  chemically synthesized
cccaggtggtgtttggttac

SEQ ID NO: 467654 - DNA, 20 bp, Artificial Sequence
  chemically synthesized
ttcatgtaaccaaacaccac

SEQ ID NO: 467655 - DNA, 20 bp, Artificial Sequence
  chemically synthesized
aaagagaaaaataatgtttt

SEQ ID NO: 467656 - DNA, 20 bp, Artificial Sequence
  chemically synthesized
tgaagtgaagaaaaaagaag

SEQ ID NO: 467657 - DNA, 20 bp, Artificial Sequence
  chemically synthesized
ttcttttttctcggattaaa

SEQ ID NO: 467658 - DNA, 20 bp, Artificial Sequence
  chemically synthesized
agcattccttttcttttttc

SEQ ID NO: 467659 - DNA, 20 bp, Artificial Sequence
  chemically synthesized
ttaatccgagaaaaaagaaa

SEQ ID NO: 467660 - DNA, 20 bp, Artificial Sequence
  chemically synthesized
cgttatatttcagaagactg

SEQ ID NO: 467661 - DNA, 20 bp, Artificial Sequence
  chemically synthesized
ggatatcttcccttcaagaa

SEQ ID NO: 467662 - DNA, 20 bp, Artificial Sequence
  chemically synthesized
tcaaagggaagtgagtcaga

SEQ ID NO: 467663 - DNA, 20 bp, Artificial Sequence
  chemically synthesized
agcgtttgaatcaaagggaa

SEQ ID NO: 467664 - DNA, 20 bp, Artificial Sequence
  chemically synthesized
gatagaaccattatcagcgt

SEQ ID NO: 467665 - DNA, 20 bp, Artificial Sequence
  chemically synthesized
cagaacctacgcagcctatg

SEQ ID NO: 467666 - DNA, 20 bp, Artificial Sequence
  chemically synthesized
agcctatgcagaatagacac

SEQ ID NO: 467667 - DNA, 20 bp, Artificial Sequence
  chemically synthesized
ttagattcagacaaaaacac

SEQ ID NO: 467668 - DNA, 20 bp, Artificial Sequence
  chemically synthesized
aattactcctgtgtttttgt

SEQ ID NO: 467669 - DNA, 20 bp, Artificial Sequence
  chemically synthesized
acgcccaccaacatttttct

SEQ ID NO: 467670 - DNA, 20 bp, Artificial Sequence
  chemically synthesized
ttgtagccaaatgttgggta

SEQ ID NO: 467671 - DNA, 20 bp, Artificial Sequence
  chemically synthesized
aaattaattgtagccaaatg

SEQ ID NO: 467672 - DNA, 20 bp, Artificial Sequence
  chemically synthesized
tatgttaaaggtgttacaca

SEQ ID NO: 467673 - DNA, 20 bp, Artificial Sequence
  chemically synthesized
tgattattagctgatcagtt

SEQ ID NO: 467674 - DNA, 20 bp, Artificial Sequence
  chemically synthesized
gggctgttccatgtgtacac

SEQ ID NO: 467675 - DNA, 20 bp, Artificial Sequence
  chemically synthesized
aacaatcagtaaagtgcttg

SEQ ID NO: 467676 - DNA, 20 bp, Artificial Sequence
  chemically synthesized
tttactgattgtttgttgca

SEQ ID NO: 467677 - DNA, 20 bp, Artificial Sequence
  chemically synthesized
gctcattgtcgttactgtat

SEQ ID NO: 467678 - DNA, 20 bp, Artificial Sequence
  chemically synthesized
gaacttaagctccttaagga

SEQ ID NO: 467679 - DNA, 20 bp, Artificial Sequence
  chemically synthesized
cttaaggagcttaagttcta

SEQ ID NO: 467680 - DNA, 20 bp, Artificial Sequence
  chemically synthesized
gtaactggctgaaaacatgg

SEQ ID NO: 467681 - DNA, 20 bp, Artificial Sequence
  chemically synthesized
gcctcagcctcccaaagtgc

SEQ ID NO: 467682 - DNA, 20 bp, Artificial Sequence
  chemically synthesized
cagcactttgggaggctgag

SEQ ID NO: 467683 - DNA, 20 bp, Artificial Sequence
  chemically synthesized
actttgggaggctgaggcgg

SEQ ID NO: 467684 - DNA, 20 bp, Artificial Sequence
  chemically synthesized
cgggtggattgcttgaggtt

SEQ ID NO: 467685 - DNA, 20 bp, Artificial Sequence
  chemically synthesized
tcttgtatttttagtagaga

SEQ ID NO: 467686 - DNA, 20 bp, Artificial Sequence
  chemically synthesized
gcctcaccctcctgagtagc

SEQ ID NO: 467687 - DNA, 20 bp, Artificial Sequence
  chemically synthesized
ctgtaatcccagctactcag

SEQ ID NO: 467688 - DNA, 20 bp, Artificial Sequence
  chemically synthesized
gattctcctgcctcaccctc

SEQ ID NO: 467689 - DNA, 20 bp, Artificial Sequence
  chemically synthesized
tactcaggagggtgaggcag

SEQ ID NO: 467690 - DNA, 20 bp, Artificial Sequence
  chemically synthesized
ctcattgcaacctccacctc

SEQ ID NO: 467691 - DNA, 20 bp, Artificial Sequence
  chemically synthesized
tctcgctttattgcccaggc

SEQ ID NO: 467692 - DNA, 20 bp, Artificial Sequence
  chemically synthesized
gttgtttcttttgtgtgaga

SEQ ID NO: 467693 - DNA, 20 bp, Artificial Sequence
  chemically synthesized
aacaacaacaacaacaaaac

SEQ ID NO: 467694 - DNA, 20 bp, Artificial Sequence
  chemically synthesized
aagttccaaaagaaaactca

SEQ ID NO: 467695 - DNA, 20 bp, Artificial Sequence
  chemically synthesized
gcatcctttcttttcactca

SEQ ID NO: 467696 - DNA, 20 bp, Artificial Sequence
  chemically synthesized
aaactcactgagtgaaaaga

SEQ ID NO: 467697 - DNA, 20 bp, Artificial Sequence
  chemically synthesized
aataaatgtgctctttggcc

SEQ ID NO: 467698 - DNA, 20 bp, Artificial Sequence
  chemically synthesized
ttatgccttctgtttgacaa

SEQ ID NO: 467699 - DNA, 20 bp, Artificial Sequence
  chemically synthesized
ggcataaaatgcttaaagag

SEQ ID NO: 467700 - DNA, 20 bp, Artificial Sequence
  chemically synthesized
ggggaataatatgatataat

SEQ ID NO: 467701 - DNA, 20 bp, Artificial Sequence
  chemically synthesized
gtgttacctgaacagacaat

SEQ ID NO: 467702 - DNA, 20 bp, Artificial Sequence
  chemically synthesized
ctaaatttgggcagaagtag

SEQ ID NO: 467703 - DNA, 20 bp, Artificial Sequence
  chemically synthesized
gggcagaagtagctgaattg

SEQ ID NO: 467704 - DNA, 20 bp, Artificial Sequence
  chemically synthesized
aaacacactgaccttggtga

SEQ ID NO: 467705 - DNA, 20 bp, Artificial Sequence
  chemically synthesized
ggaaggcaggtaaaggaaga

SEQ ID NO: 467706 - DNA, 20 bp, Artificial Sequence
  chemically synthesized
acctcccacctgagcatctt

SEQ ID NO: 467707 - DNA, 20 bp, Artificial Sequence
  chemically synthesized
tgggctggaaatcttgactt

SEQ ID NO: 467708 - DNA, 20 bp, Artificial Sequence
  chemically synthesized
gtatggaaggagcgcccagg

SEQ ID NO: 467709 - DNA, 20 bp, Artificial Sequence
  chemically synthesized
ggagagtgaagaacggtgaa

SEQ ID NO: 467710 - DNA, 20 bp, Artificial Sequence
  chemically synthesized
gaagaacggtgaaggggatg

SEQ ID NO: 467711 - DNA, 20 bp, Artificial Sequence
  chemically synthesized
aaaccttgatgtgatgtact

SEQ ID NO: 467712 - DNA, 20 bp, Artificial Sequence
  chemically synthesized
ttgtatccaagtgattgggt

SEQ ID NO: 467713 - DNA, 20 bp, Artificial Sequence
  chemically synthesized
tttaacccgaacccaatcac

SEQ ID NO: 467714 - DNA, 20 bp, Artificial Sequence
  chemically synthesized
gtctgcttgtatccaagtga

SEQ ID NO: 467715 - DNA, 20 bp, Artificial Sequence
  chemically synthesized
tttgtagaatgtcccccaat

SEQ ID NO: 467716 - DNA, 20 bp, Artificial Sequence
  chemically synthesized
aggtcgggctagatgttttg

SEQ ID NO: 467717 - DNA, 20 bp, Artificial Sequence
  chemically synthesized
ctacagggacatcactgatc

SEQ ID NO: 467718 - DNA, 20 bp, Artificial Sequence
  chemically synthesized
tcatagcgatattttacatt

SEQ ID NO: 467719 - DNA, 20 bp, Artificial Sequence
  chemically synthesized
gaatgtaaaatatcgctatg

SEQ ID NO: 467720 - DNA, 20 bp, Artificial Sequence
  chemically synthesized
ctatgaagaatattaattgg

SEQ ID NO: 467721 - DNA, 20 bp, Artificial Sequence
  chemically synthesized
attggcagaattggaggtat

SEQ ID NO: 467722 - DNA, 20 bp, Artificial Sequence
  chemically synthesized
aacaatactgttatataatg

SEQ ID NO: 467723 - DNA, 20 bp, Artificial Sequence
  chemically synthesized
catgataattgtgcttatgc

SEQ ID NO: 467724 - DNA, 20 bp, Artificial Sequence
  chemically synthesized
aggcacgtgttcaagtgttt

SEQ ID NO: 467725 - DNA, 20 bp, Artificial Sequence
  chemically synthesized
ttatgtatgaaacctaacca

SEQ ID NO: 467726 - DNA, 20 bp, Artificial Sequence
  chemically synthesized
gtatgaaacctaaccattga

SEQ ID NO: 467727 - DNA, 20 bp, Artificial Sequence
  chemically synthesized
ttcatgcgtgtatatagttt

SEQ ID NO: 467728 - DNA, 20 bp, Artificial Sequence
  chemically synthesized
tccacaaactatatacacgc

SEQ ID NO: 467729 - DNA, 20 bp, Artificial Sequence
  chemically synthesized
ttacattcatgtgttgttaa

SEQ ID NO: 467730 - DNA, 20 bp, Artificial Sequence
  chemically synthesized
tgcaatccatttaacaacac

SEQ ID NO: 467731 - DNA, 20 bp, Artificial Sequence
  chemically synthesized
aaagcaaatgtggcaaactg

SEQ ID NO: 467732 - DNA, 20 bp, Artificial Sequence
  chemically synthesized
cagtaatctggtggaaagtt

SEQ ID NO: 467733 - DNA, 20 bp, Artificial Sequence
  chemically synthesized
gttaggagtcatcagagata

SEQ ID NO: 467734 - DNA, 20 bp, Artificial Sequence
  chemically synthesized
ggagcccatgagagccaata

SEQ ID NO: 467735 - DNA, 20 bp, Artificial Sequence
  chemically synthesized
tctgtatttgcttcctccaa

SEQ ID NO: 467736 - DNA, 20 bp, Artificial Sequence
  chemically synthesized
ttgtctcagtaagaactgta

SEQ ID NO: 467737 - DNA, 20 bp, Artificial Sequence
  chemically synthesized
aagccatgaaatacttatca

SEQ ID NO: 467738 - DNA, 20 bp, Artificial Sequence
  chemically synthesized
catattaggtgatgtgtcta

SEQ ID NO: 467739 - DNA, 20 bp, Artificial Sequence
  chemically synthesized
cttaaaagaaaatcagtcat

SEQ ID NO: 467740 - DNA, 20 bp, Artificial Sequence
  chemically synthesized
tcatcggggttgcatattta

SEQ ID NO: 467741 - DNA, 20 bp, Artificial Sequence
  chemically synthesized
ttaaagaatgcagctctatc

SEQ ID NO: 467742 - DNA, 20 bp, Artificial Sequence
  chemically synthesized
gggatctgctgaaccacatt

SEQ ID NO: 467743 - DNA, 20 bp, Artificial Sequence
  chemically synthesized
gaaggtttgagatacaaggc

SEQ ID NO: 467744 - DNA, 20 bp, Artificial Sequence
  chemically synthesized
aaagccttaccgtcttcttg

SEQ ID NO: 467745 - DNA, 20 bp, Artificial Sequence
  chemically synthesized
attacaattcaacatgagat

SEQ ID NO: 467746 - DNA, 20 bp, Artificial Sequence
  chemically synthesized
gtccccatccaaatctcatg

SEQ ID NO: 467747 - DNA, 20 bp, Artificial Sequence
  chemically synthesized
ggacccctcccgcagcacat

SEQ ID NO: 467748 - DNA, 20 bp, Artificial Sequence
  chemically synthesized
taatccccatgtgctgcggg

SEQ ID NO: 467749 - DNA, 20 bp, Artificial Sequence
  chemically synthesized
aggggtccggtgggaggtga

SEQ ID NO: 467750 - DNA, 20 bp, Artificial Sequence
  chemically synthesized
cccatgctgttctcatgata

SEQ ID NO: 467751 - DNA, 20 bp, Artificial Sequence
  chemically synthesized
gcctccccagccttgtggaa

SEQ ID NO: 467752 - DNA, 20 bp, Artificial Sequence
  chemically synthesized
ctataaagaactacctgaga

SEQ ID NO: 467753 - DNA, 20 bp, Artificial Sequence
  chemically synthesized
cagttcaagaaaaagtaccc

SEQ ID NO: 467754 - DNA, 20 bp, Artificial Sequence
  chemically synthesized
tgaaagaaaagactgaattc

SEQ ID NO: 467755 - DNA, 20 bp, Artificial Sequence
  chemically synthesized
ttgtcctctgaaagaaaaga

SEQ ID NO: 467756 - DNA, 20 bp, Artificial Sequence
  chemically synthesized
agataacttgctggcataaa

SEQ ID NO: 467757 - DNA, 20 bp, Artificial Sequence
  chemically synthesized
ttatctcttagcttagccat

SEQ ID NO: 467758 - DNA, 20 bp, Artificial Sequence
  chemically synthesized
ctaaaaagatcatggtagaa

SEQ ID NO: 467759 - DNA, 20 bp, Artificial Sequence
  chemically synthesized
actcaaattaaagtgcacat

SEQ ID NO: 467760 - DNA, 20 bp, Artificial Sequence
  chemically synthesized
atcctaatgtgcactttaat

SEQ ID NO: 467761 - DNA, 20 bp, Artificial Sequence
  chemically synthesized
actttaatttgagtgcttta

SEQ ID NO: 467762 - DNA, 20 bp, Artificial Sequence
  chemically synthesized
tatttaggtcgttgacaatg

SEQ ID NO: 467763 - DNA, 20 bp, Artificial Sequence
  chemically synthesized
gcttctaagcacccagggct

SEQ ID NO: 467764 - DNA, 20 bp, Artificial Sequence
  chemically synthesized
tagtggtcagattcagagcc

SEQ ID NO: 467765 - DNA, 20 bp, Artificial Sequence
  chemically synthesized
cctcttatttttttctactt

SEQ ID NO: 467766 - DNA, 20 bp, Artificial Sequence
  chemically synthesized
tactaaagctcagttgtttt

SEQ ID NO: 467767 - DNA, 20 bp, Artificial Sequence
  chemically synthesized
gaatatagctaataaactgt

SEQ ID NO: 467768 - DNA, 20 bp, Artificial Sequence
  chemically synthesized
tatctccctccacctgagat

SEQ ID NO: 467769 - DNA, 20 bp, Artificial Sequence
  chemically synthesized
atatgtttgaggttattttc

SEQ ID NO: 467770 - DNA, 20 bp, Artificial Sequence
  chemically synthesized
ttgatttttttgagaaggaa

SEQ ID NO: 467771 - DNA, 20 bp, Artificial Sequence
  chemically synthesized
aagatttggcttctccagag

SEQ ID NO: 467772 - DNA, 20 bp, Artificial Sequence
  chemically synthesized
aacatttctgaggaaagaga

SEQ ID NO: 467773 - DNA, 20 bp, Artificial Sequence
  chemically synthesized
tcctgacgacagtggtagat

SEQ ID NO: 467774 - DNA, 20 bp, Artificial Sequence
  chemically synthesized
tcctgatctaccactgtcgt

SEQ ID NO: 467775 - DNA, 20 bp, Artificial Sequence
  chemically synthesized
gttgctgagcttatcagcag

SEQ ID NO: 467776 - DNA, 20 bp, Artificial Sequence
  chemically synthesized
ggggtagggagtacagttca

SEQ ID NO: 467777 - DNA, 20 bp, Artificial Sequence
  chemically synthesized
ttggagatcactgaggggta

SEQ ID NO: 467778 - DNA, 20 bp, Artificial Sequence
  chemically synthesized
attttacttggagatcactg

SEQ ID NO: 467779 - DNA, 20 bp, Artificial Sequence
  chemically synthesized
acttccatgatatccaactt

SEQ ID NO: 467780 - DNA, 20 bp, Artificial Sequence
  chemically synthesized
cagtcgggaaaattcaaaag

SEQ ID NO: 467781 - DNA, 20 bp, Artificial Sequence
  chemically synthesized
aggaaaagtcaggggtgtgg

SEQ ID NO: 467782 - DNA, 20 bp, Artificial Sequence
  chemically synthesized
agaaaggaaaagtcaggggt

SEQ ID NO: 467783 - DNA, 20 bp, Artificial Sequence
  chemically synthesized
taggacagaaaggaaaagtc

SEQ ID NO: 467784 - DNA, 20 bp, Artificial Sequence
  chemically synthesized
ggcaaagtgccttaaccaaa

SEQ ID NO: 467785 - DNA, 20 bp, Artificial Sequence
  chemically synthesized
cttgagctcttccatgaggg

SEQ ID NO: 467786 - DNA, 20 bp, Artificial Sequence
  chemically synthesized
tcatacttgagctcttccat

SEQ ID NO: 467787 - DNA, 20 bp, Artificial Sequence
  chemically synthesized
tggaagagctcaagtatgaa

SEQ ID NO: 467788 - DNA, 20 bp, Artificial Sequence
  chemically synthesized
cctgatatgatgatgtgttc

SEQ ID NO: 467789 - DNA, 20 bp, Artificial Sequence
  chemically synthesized
gcaatagagctgtaagtgta

SEQ ID NO: 467790 - DNA, 20 bp, Artificial Sequence
  chemically synthesized
gctgtaagtgtatggaatca

SEQ ID NO: 467791 - DNA, 20 bp, Artificial Sequence
  chemically synthesized
tcctctcaaatcttacctca

SEQ ID NO: 467792 - DNA, 20 bp, Artificial Sequence
  chemically synthesized
cccagggaaaagtaaggaga

SEQ ID NO: 467793 - DNA, 20 bp, Artificial Sequence
  chemically synthesized
tttctctgtaaaggcccagt

SEQ ID NO: 467794 - DNA, 20 bp, Artificial Sequence
  chemically synthesized
ctgtgtctggctagacaata

SEQ ID NO: 467795 - DNA, 20 bp, Artificial Sequence
  chemically synthesized
tggtaatgaatggctaggac

SEQ ID NO: 467796 - DNA, 20 bp, Artificial Sequence
  chemically synthesized
tagggcattttacagtggta

SEQ ID NO: 467797 - DNA, 20 bp, Artificial Sequence
  chemically synthesized
aaatgatcaaaggtcaaaac

SEQ ID NO: 467798 - DNA, 20 bp, Artificial Sequence
  chemically synthesized
cctaggcagagaacattgct

SEQ ID NO: 467799 - DNA, 20 bp, Artificial Sequence
  chemically synthesized
aagccttaggcaaaagttgg

SEQ ID NO: 467800 - DNA, 20 bp, Artificial Sequence
  chemically synthesized
aaggaagccttaggcaaaag

SEQ ID NO: 467801 - DNA, 20 bp, Artificial Sequence
  chemically synthesized
taggtaatcttaaaatgaat

SEQ ID NO: 467802 - DNA, 20 bp, Artificial Sequence
  chemically synthesized
aaagactaggtaatcttaaa

SEQ ID NO: 467803 - DNA, 20 bp, Artificial Sequence
  chemically synthesized
attgggtcactataaatgca

SEQ ID NO: 467804 - DNA, 20 bp, Artificial Sequence
  chemically synthesized
ttaaaataaatcacagtcca

SEQ ID NO: 467805 - DNA, 20 bp, Artificial Sequence
  chemically synthesized
gggtaatgggatagtaaagg

SEQ ID NO: 467806 - DNA, 20 bp, Artificial Sequence
  chemically synthesized
atttgggtaatgggatagta

SEQ ID NO: 467807 - DNA, 20 bp, Artificial Sequence
  chemically synthesized
aaagacctccatttgggtaa

SEQ ID NO: 467808 - DNA, 20 bp, Artificial Sequence
  chemically synthesized
gccttggaaaagacctccat

SEQ ID NO: 467809 - DNA, 20 bp, Artificial Sequence
  chemically synthesized
tggaggtcttttccaaggca

SEQ ID NO: 467810 - DNA, 20 bp, Artificial Sequence
  chemically synthesized
tttcatagaattgattgctg

SEQ ID NO: 467811 - DNA, 20 bp, Artificial Sequence
  chemically synthesized
agatttgagaatgagtttca

SEQ ID NO: 467812 - DNA, 20 bp, Artificial Sequence
  chemically synthesized
caaactggagagatttgaga

SEQ ID NO: 467813 - DNA, 20 bp, Artificial Sequence
  chemically synthesized
tgggcaaactggagagattt

SEQ ID NO: 467814 - DNA, 20 bp, Artificial Sequence
  chemically synthesized
taagaagaggaatgaaggga

SEQ ID NO: 467815 - DNA, 20 bp, Artificial Sequence
  chemically synthesized
tgagtgcaaattgtaagaag

SEQ ID NO: 467816 - DNA, 20 bp, Artificial Sequence
  chemically synthesized
gagttcccagggtctgggga

SEQ ID NO: 467817 - DNA, 20 bp, Artificial Sequence
  chemically synthesized
aaaaaaaaaaatagagttcc

SEQ ID NO: 467818 - DNA, 20 bp, Artificial Sequence
  chemically synthesized
tcaaaaaaaaaaaaaaaaaa

SEQ ID NO: 467819 - DNA, 20 bp, Artificial Sequence
  chemically synthesized
tcttgctctgtcgcccaggc

SEQ ID NO: 467820 - DNA, 20 bp, Artificial Sequence
  chemically synthesized
tactcgggaggatgaggcag

SEQ ID NO: 467821 - DNA, 20 bp, Artificial Sequence
  chemically synthesized
gattctcctgcctcatcctc

SEQ ID NO: 467822 - DNA, 20 bp, Artificial Sequence
  chemically synthesized
ctatagtcccagctactcgg

SEQ ID NO: 467823 - DNA, 20 bp, Artificial Sequence
  chemically synthesized
ttttctatttttagtagaga

SEQ ID NO: 467824 - DNA, 20 bp, Artificial Sequence
  chemically synthesized
ggtgggcggatcacaaggtt

SEQ ID NO: 467825 - DNA, 20 bp, Artificial Sequence
  chemically synthesized
actttgggagggtgaggtgg

SEQ ID NO: 467826 - DNA, 20 bp, Artificial Sequence
  chemically synthesized
ctgtaatcccagcactttgg

SEQ ID NO: 467827 - DNA, 20 bp, Artificial Sequence
  chemically synthesized
acctcaccctcccaaagtgc

SEQ ID NO: 467828 - DNA, 20 bp, Artificial Sequence
  chemically synthesized
ccctggcaagtctattttta

SEQ ID NO: 467829 - DNA, 20 bp, Artificial Sequence
  chemically synthesized
aattgccaaggccaagattg

SEQ ID NO: 467830 - DNA, 20 bp, Artificial Sequence
  chemically synthesized
tgtgggccagatagagctgc

SEQ ID NO: 467831 - DNA, 20 bp, Artificial Sequence
  chemically synthesized
gctgccagaatacacctttt

SEQ ID NO: 467832 - DNA, 20 bp, Artificial Sequence
  chemically synthesized
agtggctccctgataccaag

SEQ ID NO: 467833 - DNA, 20 bp, Artificial Sequence
  chemically synthesized
tagagtcgtattacagggac

SEQ ID NO: 467834 - DNA, 20 bp, Artificial Sequence
  chemically synthesized
ttttgttgtctgaagaaagg

SEQ ID NO: 467835 - DNA, 20 bp, Artificial Sequence
  chemically synthesized
ttcttcagacaacaaaatct

SEQ ID NO: 467836 - DNA, 20 bp, Artificial Sequence
  chemically synthesized
gtagctaggacacttaccca

SEQ ID NO: 467837 - DNA, 20 bp, Artificial Sequence
  chemically synthesized
gcagtcaaacttcggactcc

SEQ ID NO: 467838 - DNA, 20 bp, Artificial Sequence
  chemically synthesized
agcagtcagcctatgctgct

SEQ ID NO: 467839 - DNA, 20 bp, Artificial Sequence
  chemically synthesized
agccccaggcagaggccaaa

SEQ ID NO: 467840 - DNA, 20 bp, Artificial Sequence
  chemically synthesized
ctaagtcatccaaaagaaaa

SEQ ID NO: 467841 - DNA, 20 bp, Artificial Sequence
  chemically synthesized
aaaagtaattctgttttctt

SEQ ID NO: 467842 - DNA, 20 bp, Artificial Sequence
  chemically synthesized
agggtcaaaatttatgagtc

SEQ ID NO: 467843 - DNA, 20 bp, Artificial Sequence
  chemically synthesized
agtaggaagggtcaaaattt

SEQ ID NO: 467844 - DNA, 20 bp, Artificial Sequence
  chemically synthesized
gggagggcttctaaagtagg

SEQ ID NO: 467845 - DNA, 20 bp, Artificial Sequence
  chemically synthesized
ctcccaaagattgtttaatt

SEQ ID NO: 467846 - DNA, 20 bp, Artificial Sequence
  chemically synthesized
cagatacaaagacagtttct

SEQ ID NO: 467847 - DNA, 20 bp, Artificial Sequence
  chemically synthesized
catagaaactgtctttgtat

SEQ ID NO: 467848 - DNA, 20 bp, Artificial Sequence
  chemically synthesized
gaaaaaaatcagagctacac

SEQ ID NO: 467849 - DNA, 20 bp, Artificial Sequence
  chemically synthesized
gaagatttagaaggtcatgt

SEQ ID NO: 467850 - DNA, 20 bp, Artificial Sequence
  chemically synthesized
acttaatacttcacaaagat

SEQ ID NO: 467851 - DNA, 20 bp, Artificial Sequence
  chemically synthesized
ggacatagttctggctttct

SEQ ID NO: 467852 - DNA, 20 bp, Artificial Sequence
  chemically synthesized
ggcttaaagaactatgtgtt

SEQ ID NO: 467853 - DNA, 20 bp, Artificial Sequence
  chemically synthesized
tttccactagttctctaaaa

SEQ ID NO: 467854 - DNA, 20 bp, Artificial Sequence
  chemically synthesized
cctgcaaagtgatagtatca

SEQ ID NO: 467855 - DNA, 20 bp, Artificial Sequence
  chemically synthesized
caggcacataccaagcactt

SEQ ID NO: 467856 - DNA, 20 bp, Artificial Sequence
  chemically synthesized
gttttgtttaagagggaaaa

SEQ ID NO: 467857 - DNA, 20 bp, Artificial Sequence
  chemically synthesized
ggagcaagtgaggagagaga

SEQ ID NO: 467858 - DNA, 20 bp, Artificial Sequence
  chemically synthesized
ggaagaccacaataaacagc

SEQ ID NO: 467859 - DNA, 20 bp, Artificial Sequence
  chemically synthesized
agctgtttattgtggtcttc

SEQ ID NO: 467860 - DNA, 20 bp, Artificial Sequence
  chemically synthesized
cacaaaggccgcctggaagc

SEQ ID NO: 467861 - DNA, 20 bp, Artificial Sequence
  chemically synthesized
ccacctctccccagagtccc

SEQ ID NO: 467862 - DNA, 20 bp, Artificial Sequence
  chemically synthesized
aaatgatgcccacctctccc

SEQ ID NO: 467863 - DNA, 20 bp, Artificial Sequence
  chemically synthesized
tgccaataggaatctgcaag

SEQ ID NO: 467864 - DNA, 20 bp, Artificial Sequence
  chemically synthesized
tttacttttttgatgccaat

SEQ ID NO: 467865 - DNA, 20 bp, Artificial Sequence
  chemically synthesized
aaaagaagaaaaaaagtaat

SEQ ID NO: 467866 - DNA, 20 bp, Artificial Sequence
  chemically synthesized
agcaagcaaaagaggcacta

SEQ ID NO: 467867 - DNA, 20 bp, Artificial Sequence
  chemically synthesized
gttcagataagtaagcagca

SEQ ID NO: 467868 - DNA, 20 bp, Artificial Sequence
  chemically synthesized
tattttcaacagaaatgtat

SEQ ID NO: 467869 - DNA, 20 bp, Artificial Sequence
  chemically synthesized
tcaacagaaatgtataagaa

SEQ ID NO: 467870 - DNA, 20 bp, Artificial Sequence
  chemically synthesized
caaggggaggtgataggaac

SEQ ID NO: 467871 - DNA, 20 bp, Artificial Sequence
  chemically synthesized
cttgagggcagcggggagga

SEQ ID NO: 467872 - DNA, 20 bp, Artificial Sequence
  chemically synthesized
ctcaaggagataatgccaca

SEQ ID NO: 467873 - DNA, 20 bp, Artificial Sequence
  chemically synthesized
atttcatgcccagtgttacc

SEQ ID NO: 467874 - DNA, 20 bp, Artificial Sequence
  chemically synthesized
attagattgaatcacataaa

SEQ ID NO: 467875 - DNA, 20 bp, Artificial Sequence
  chemically synthesized
tgcaaaataatgttattaga

SEQ ID NO: 467876 - DNA, 20 bp, Artificial Sequence
  chemically synthesized
aatttaagaacttcacattt

SEQ ID NO: 467877 - DNA, 20 bp, Artificial Sequence
  chemically synthesized
aagaatatacataccattct

SEQ ID NO: 467878 - DNA, 20 bp, Artificial Sequence
  chemically synthesized
tgaaggcaaaaagcaactct

SEQ ID NO: 467879 - DNA, 20 bp, Artificial Sequence
  chemically synthesized
aggtattattattctgttgc

SEQ ID NO: 467880 - DNA, 20 bp, Artificial Sequence
  chemically synthesized
atgttggcatattcaagcaa

SEQ ID NO: 467881 - DNA, 20 bp, Artificial Sequence
  chemically synthesized
ccaaggagataggtataaaa

SEQ ID NO: 467882 - DNA, 20 bp, Artificial Sequence
  chemically synthesized
tcttttttatacctatctcc

SEQ ID NO: 467883 - DNA, 20 bp, Artificial Sequence
  chemically synthesized
cctgttgaagagattcttta

SEQ ID NO: 467884 - DNA, 20 bp, Artificial Sequence
  chemically synthesized
acatcaaactatattctgta

SEQ ID NO: 467885 - DNA, 20 bp, Artificial Sequence
  chemically synthesized
ttacagaatatagtttgatg

SEQ ID NO: 467886 - DNA, 20 bp, Artificial Sequence
  chemically synthesized
tatagtttgatgtggaattg

SEQ ID NO: 467887 - DNA, 20 bp, Artificial Sequence
  chemically synthesized
ttcaacattgctacatgtca

SEQ ID NO: 467888 - DNA, 20 bp, Artificial Sequence
  chemically synthesized
ctacatgtcaccgaatcgct

SEQ ID NO: 467889 - DNA, 20 bp, Artificial Sequence
  chemically synthesized
acctcattcactactgaagc

SEQ ID NO: 467890 - DNA, 20 bp, Artificial Sequence
  chemically synthesized
aatttactctcgcttcagta

SEQ ID NO: 467891 - DNA, 20 bp, Artificial Sequence
  chemically synthesized
cccatcaggttaactaaaac

SEQ ID NO: 467892 - DNA, 20 bp, Artificial Sequence
  chemically synthesized
ttcaagttttagttaacctg

SEQ ID NO: 467893 - DNA, 20 bp, Artificial Sequence
  chemically synthesized
ttttaatttgcacatacatc

SEQ ID NO: 467894 - DNA, 20 bp, Artificial Sequence
  chemically synthesized
gtctaaccttgccagtaatc

SEQ ID NO: 467895 - DNA, 20 bp, Artificial Sequence
  chemically synthesized
ttcctttacccattttcctg

SEQ ID NO: 467896 - DNA, 20 bp, Artificial Sequence
  chemically synthesized
aaagacaatccagcaggaaa

SEQ ID NO: 467897 - DNA, 20 bp, Artificial Sequence
  chemically synthesized
gtctttttctttttaaacct

SEQ ID NO: 467898 - DNA, 20 bp, Artificial Sequence
  chemically synthesized
tgccatgcacataactaaca

SEQ ID NO: 467899 - DNA, 20 bp, Artificial Sequence
  chemically synthesized
aagataagctacactaagat

SEQ ID NO: 467900 - DNA, 20 bp, Artificial Sequence
  chemically synthesized
aatttacatcttttatacca

SEQ ID NO: 467901 - DNA, 20 bp, Artificial Sequence
  chemically synthesized
ataaaaagcagagaacatac

SEQ ID NO: 467902 - DNA, 20 bp, Artificial Sequence
  chemically synthesized
tggtttttcacatttaggac

SEQ ID NO: 467903 - DNA, 20 bp, Artificial Sequence
  chemically synthesized
atttaggacttgaatttacc

SEQ ID NO: 467904 - DNA, 20 bp, Artificial Sequence
  chemically synthesized
ggcaagcacaaaaatagatt

SEQ ID NO: 467905 - DNA, 20 bp, Artificial Sequence
  chemically synthesized
tctaattttacttttccccc

SEQ ID NO: 467906 - DNA, 20 bp, Artificial Sequence
  chemically synthesized
ggaaatagatggaccataca

SEQ ID NO: 467907 - DNA, 20 bp, Artificial Sequence
  chemically synthesized
atgcagatagaaccacagac

SEQ ID NO: 467908 - DNA, 20 bp, Artificial Sequence
  chemically synthesized
gctggagtgtgggatctacc

SEQ ID NO: 467909 - DNA, 20 bp, Artificial Sequence
  chemically synthesized
attgatttaaagctggagtg

SEQ ID NO: 467910 - DNA, 20 bp, Artificial Sequence
  chemically synthesized
gacatcaattgatttaaagc

SEQ ID NO: 467911 - DNA, 20 bp, Artificial Sequence
  chemically synthesized
atggagaagatcaaaggggt

SEQ ID NO: 467912 - DNA, 20 bp, Artificial Sequence
  chemically synthesized
aaaatcatggagaagatcaa

SEQ ID NO: 467913 - DNA, 20 bp, Artificial Sequence
  chemically synthesized
tgaaaatgcttgttgaaatt

SEQ ID NO: 467914 - DNA, 20 bp, Artificial Sequence
  chemically synthesized
tgcttgttgaaattttgagt

SEQ ID NO: 467915 - DNA, 20 bp, Artificial Sequence
  chemically synthesized
aattttgagtttgaattaca

SEQ ID NO: 467916 - DNA, 20 bp, Artificial Sequence
  chemically synthesized
agttcttcccagtttaacct

SEQ ID NO: 467917 - DNA, 20 bp, Artificial Sequence
  chemically synthesized
aagaactaagttcataataa

SEQ ID NO: 467918 - DNA, 20 bp, Artificial Sequence
  chemically synthesized
ataattgagtcttcacatcc

SEQ ID NO: 467919 - DNA, 20 bp, Artificial Sequence
  chemically synthesized
taaggagcttcactgcattc

SEQ ID NO: 467920 - DNA, 20 bp, Artificial Sequence
  chemically synthesized
tgtaaagcaagaggaaaaaa

SEQ ID NO: 467921 - DNA, 20 bp, Artificial Sequence
  chemically synthesized
ttttcctcttgctttacagg

SEQ ID NO: 467922 - DNA, 20 bp, Artificial Sequence
  chemically synthesized
ttatttttaatgaacacatt

SEQ ID NO: 467923 - DNA, 20 bp, Artificial Sequence
  chemically synthesized
acaaaacataaggcactgaa

SEQ ID NO: 467924 - DNA, 20 bp, Artificial Sequence
  chemically synthesized
gaattacaaaacataaggca

SEQ ID NO: 467925 - DNA, 20 bp, Artificial Sequence
  chemically synthesized
aagttaaaagaaatcacagt

SEQ ID NO: 467926 - DNA, 20 bp, Artificial Sequence
  chemically synthesized
cactgtgctcctaaatgact

SEQ ID NO: 467927 - DNA, 20 bp, Artificial Sequence
  chemically synthesized
tcaaaggatcagtatcatac

SEQ ID NO: 467928 - DNA, 20 bp, Artificial Sequence
  chemically synthesized
agaagtattgctaaatttca

SEQ ID NO: 467929 - DNA, 20 bp, Artificial Sequence
  chemically synthesized
tcactttctaaaaatgttca

SEQ ID NO: 467930 - DNA, 20 bp, Artificial Sequence
  chemically synthesized
gtatttttccattggaaaga

SEQ ID NO: 467931 - DNA, 20 bp, Artificial Sequence
  chemically synthesized
tagctatcaatttttgttag

SEQ ID NO: 467932 - DNA, 20 bp, Artificial Sequence
  chemically synthesized
atgagtgttgagatataatt

SEQ ID NO: 467933 - DNA, 20 bp, Artificial Sequence
  chemically synthesized
atatataaagtgaattatga

SEQ ID NO: 467934 - DNA, 20 bp, Artificial Sequence
  chemically synthesized
taggtctagaaatatataaa

SEQ ID NO: 467935 - DNA, 20 bp, Artificial Sequence
  chemically synthesized
agaaacagtgcaagaacaac

SEQ ID NO: 467936 - DNA, 20 bp, Artificial Sequence
  chemically synthesized
taaccatagaaacctttaaa

SEQ ID NO: 467937 - DNA, 20 bp, Artificial Sequence
  chemically synthesized
caaatataaccaaaagacag

SEQ ID NO: 467938 - DNA, 20 bp, Artificial Sequence
  chemically synthesized
tgtgaaggtcccaaatgctt

SEQ ID NO: 467939 - DNA, 20 bp, Artificial Sequence
  chemically synthesized
caaatgctttaggatttact

SEQ ID NO: 467940 - DNA, 20 bp, Artificial Sequence
  chemically synthesized
atatcagaaatgtcctcaat

SEQ ID NO: 467941 - DNA, 20 bp, Artificial Sequence
  chemically synthesized
tcaagagttctaatcagtca

SEQ ID NO: 467942 - DNA, 20 bp, Artificial Sequence
  chemically synthesized
acaagtagaagaaagatgtc

SEQ ID NO: 467943 - DNA, 20 bp, Artificial Sequence
  chemically synthesized
gatctcccacatttgtggat

SEQ ID NO: 467944 - DNA, 20 bp, Artificial Sequence
  chemically synthesized
gatatagatctcccacattt

SEQ ID NO: 467945 - DNA, 20 bp, Artificial Sequence
  chemically synthesized
aaagagatgaaatgtaagta

SEQ ID NO: 467946 - DNA, 20 bp, Artificial Sequence
  chemically synthesized
gtaagtagtgagtagccaag

SEQ ID NO: 467947 - DNA, 20 bp, Artificial Sequence
  chemically synthesized
attttctgttgtcccatact

SEQ ID NO: 467948 - DNA, 20 bp, Artificial Sequence
  chemically synthesized
tcccctgtggaatgttcatt

SEQ ID NO: 467949 - DNA, 20 bp, Artificial Sequence
  chemically synthesized
ggaagacatgccgtcccctg

SEQ ID NO: 467950 - DNA, 20 bp, Artificial Sequence
  chemically synthesized
aagaaaaaaaccagagtaga

SEQ ID NO: 467951 - DNA, 20 bp, Artificial Sequence
  chemically synthesized
aacaaaacaaagaaaaaaac

SEQ ID NO: 467952 - DNA, 20 bp, Artificial Sequence
  chemically synthesized
ttgtaatgttaggtactagg

SEQ ID NO: 467953 - DNA, 20 bp, Artificial Sequence
  chemically synthesized
cctaacattacaaggtttcc

SEQ ID NO: 467954 - DNA, 20 bp, Artificial Sequence
  chemically synthesized
atctttttcatctacagaaa

SEQ ID NO: 467955 - DNA, 20 bp, Artificial Sequence
  chemically synthesized
cccttgaaggctgatagcaa

SEQ ID NO: 467956 - DNA, 20 bp, Artificial Sequence
  chemically synthesized
tcctattgctatcagccttc

SEQ ID NO: 467957 - DNA, 20 bp, Artificial Sequence
  chemically synthesized
ctgaaggtgtacttacttcg

SEQ ID NO: 467958 - DNA, 20 bp, Artificial Sequence
  chemically synthesized
ccttcagtcagattctgcac

SEQ ID NO: 467959 - DNA, 20 bp, Artificial Sequence
  chemically synthesized
acacccagaagacccgtgtg

SEQ ID NO: 467960 - DNA, 20 bp, Artificial Sequence
  chemically synthesized
agattctgcacacgggtctt

SEQ ID NO: 467961 - DNA, 20 bp, Artificial Sequence
  chemically synthesized
ggaatgagaccttgtgaaca

SEQ ID NO: 467962 - DNA, 20 bp, Artificial Sequence
  chemically synthesized
ttcacaaggtctcattccat

SEQ ID NO: 467963 - DNA, 20 bp, Artificial Sequence
  chemically synthesized
aaaatagaaagtaattccta

SEQ ID NO: 467964 - DNA, 20 bp, Artificial Sequence
  chemically synthesized
aactggcaacactttttatg

SEQ ID NO: 467965 - DNA, 20 bp, Artificial Sequence
  chemically synthesized
ggtagaaagaaaaatttgaa

SEQ ID NO: 467966 - DNA, 20 bp, Artificial Sequence
  chemically synthesized
aatctggtagaaagaaaaat

SEQ ID NO: 467967 - DNA, 20 bp, Artificial Sequence
  chemically synthesized
ttccttggtatcttgatcct

SEQ ID NO: 467968 - DNA, 20 bp, Artificial Sequence
  chemically synthesized
cctgtggacaactaaaccca

SEQ ID NO: 467969 - DNA, 20 bp, Artificial Sequence
  chemically synthesized
ccaaaccatgcctcttgaac

SEQ ID NO: 467970 - DNA, 20 bp, Artificial Sequence
  chemically synthesized
tcagccaaagctgagctgta

SEQ ID NO: 467971 - DNA, 20 bp, Artificial Sequence
  chemically synthesized
ttccagaattgaagaaggat

SEQ ID NO: 467972 - DNA, 20 bp, Artificial Sequence
  chemically synthesized
agaatcttccagaattgaag

SEQ ID NO: 467973 - DNA, 20 bp, Artificial Sequence
  chemically synthesized
tgtcatagctgagaatcttc

SEQ ID NO: 467974 - DNA, 20 bp, Artificial Sequence
  chemically synthesized
tatttgaagctgtcatagct

SEQ ID NO: 467975 - DNA, 20 bp, Artificial Sequence
  chemically synthesized
tagaatttagaggtttgttt

SEQ ID NO: 467976 - DNA, 20 bp, Artificial Sequence
  chemically synthesized
ggctctacaatataccttac

SEQ ID NO: 467977 - DNA, 20 bp, Artificial Sequence
  chemically synthesized
atgagcaattaggagaaatg

SEQ ID NO: 467978 - DNA, 20 bp, Artificial Sequence
  chemically synthesized
tatatttcttatctttttct

SEQ ID NO: 467979 - DNA, 20 bp, Artificial Sequence
  chemically synthesized
gggaattagaagatgatgct

SEQ ID NO: 467980 - DNA, 20 bp, Artificial Sequence
  chemically synthesized
tgtcctgtcagagaaggcaa

SEQ ID NO: 467981 - DNA, 20 bp, Artificial Sequence
  chemically synthesized
ttctctgacaggacaaagtc

SEQ ID NO: 467982 - DNA, 20 bp, Artificial Sequence
  chemically synthesized
tctagaatttatcctgtata

SEQ ID NO: 467983 - DNA, 20 bp, Artificial Sequence
  chemically synthesized
aagttactaaactcaatata

SEQ ID NO: 467984 - DNA, 20 bp, Artificial Sequence
  chemically synthesized
caagaaactaagaaacagag

SEQ ID NO: 467985 - DNA, 20 bp, Artificial Sequence
  chemically synthesized
cttagtttcttgttatttta

SEQ ID NO: 467986 - DNA, 20 bp, Artificial Sequence
  chemically synthesized
gatgcttaaaggcataaata

SEQ ID NO: 467987 - DNA, 20 bp, Artificial Sequence
  chemically synthesized
tttttttttgagatggaggc

SEQ ID NO: 467988 - DNA, 20 bp, Artificial Sequence
  chemically synthesized
ctcactgcaaccaccacctc

SEQ ID NO: 467989 - DNA, 20 bp, Artificial Sequence
  chemically synthesized
tactcaggaggctgaggcag

SEQ ID NO: 467990 - DNA, 20 bp, Artificial Sequence
  chemically synthesized
gactctcctgcctcagcctc

SEQ ID NO: 467991 - DNA, 20 bp, Artificial Sequence
  chemically synthesized
gcctcagcctcctgagtagc

SEQ ID NO: 467992 - DNA, 20 bp, Artificial Sequence
  chemically synthesized
ttttgtatttttagtagagg

SEQ ID NO: 467993 - DNA, 20 bp, Artificial Sequence
  chemically synthesized
tgggtggatcacctgaggtc

SEQ ID NO: 467994 - DNA, 20 bp, Artificial Sequence
  chemically synthesized
actctgggaggctgagatgg

SEQ ID NO: 467995 - DNA, 20 bp, Artificial Sequence
  chemically synthesized
cagcactctgggaggctgag

SEQ ID NO: 467996 - DNA, 20 bp, Artificial Sequence
  chemically synthesized
atccacccatctcagcctcc

SEQ ID NO: 467997 - DNA, 20 bp, Artificial Sequence
  chemically synthesized
atctcagcctcccagagtgc

SEQ ID NO: 467998 - DNA, 20 bp, Artificial Sequence
  chemically synthesized
tgtattattttgctttcttc

SEQ ID NO: 467999 - DNA, 20 bp, Artificial Sequence
  chemically synthesized
tatctcaaaaaaaaaaaaag

SEQ ID NO: 468000 - DNA, 20 bp, Artificial Sequence
  chemically synthesized
atctttttttttttttgaga

SEQ ID NO: 468001 - DNA, 20 bp, Artificial Sequence
  chemically synthesized
tagggtctcactctgttgcc

SEQ ID NO: 468002 - DNA, 20 bp, Artificial Sequence
  chemically synthesized
ctgcactccatcctgggcaa

SEQ ID NO: 468003 - DNA, 20 bp, Artificial Sequence
  chemically synthesized
tctcactctgttgcccagga

SEQ ID NO: 468004 - DNA, 20 bp, Artificial Sequence
  chemically synthesized
ggaggatcgcttgagcccag

SEQ ID NO: 468005 - DNA, 20 bp, Artificial Sequence
  chemically synthesized
tactcaggaggctgagatag

SEQ ID NO: 468006 - DNA, 20 bp, Artificial Sequence
  chemically synthesized
gatcctcctatctcagcctc

SEQ ID NO: 468007 - DNA, 20 bp, Artificial Sequence
  chemically synthesized
taatttaaaatatattagcc

SEQ ID NO: 468008 - DNA, 20 bp, Artificial Sequence
  chemically synthesized
accttggcctcccaaagtga

SEQ ID NO: 468009 - DNA, 20 bp, Artificial Sequence
  chemically synthesized
cccaagttaaacatcaaaaa

SEQ ID NO: 468010 - DNA, 20 bp, Artificial Sequence
  chemically synthesized
ttcactttttgatgtttaac

SEQ ID NO: 468011 - DNA, 20 bp, Artificial Sequence
  chemically synthesized
tttgatgtttaacttgggtg

SEQ ID NO: 468012 - DNA, 20 bp, Artificial Sequence
  chemically synthesized
atccaaaatacatgaagaaa

SEQ ID NO: 468013 - DNA, 20 bp, Artificial Sequence
  chemically synthesized
atcccatttcttcatgtatt

SEQ ID NO: 468014 - DNA, 20 bp, Artificial Sequence
  chemically synthesized
atttggagacaaattttgca

SEQ ID NO: 468015 - DNA, 20 bp, Artificial Sequence
  chemically synthesized
atattaaagtacacacacat

SEQ ID NO: 468016 - DNA, 20 bp, Artificial Sequence
  chemically synthesized
aaccacctgagagagagata

SEQ ID NO: 468017 - DNA, 20 bp, Artificial Sequence
  chemically synthesized
cccagccatacccaggggct

SEQ ID NO: 468018 - DNA, 20 bp, Artificial Sequence
  chemically synthesized
tggctctaaactctaagccc

SEQ ID NO: 468019 - DNA, 20 bp, Artificial Sequence
  chemically synthesized
ggtagtttgcagctcctaca

SEQ ID NO: 468020 - DNA, 20 bp, Artificial Sequence
  chemically synthesized
acctactgcctggcaatgaa

SEQ ID NO: 468021 - DNA, 20 bp, Artificial Sequence
  chemically synthesized
tgatgctctctttcccaact

SEQ ID NO: 468022 - DNA, 20 bp, Artificial Sequence
  chemically synthesized
gaaaagaaacagtttgctgc

SEQ ID NO: 468023 - DNA, 20 bp, Artificial Sequence
  chemically synthesized
acaaggtagtggcccaaagc

SEQ ID NO: 468024 - DNA, 20 bp, Artificial Sequence
  chemically synthesized
ttgggccactaccttgtaag

SEQ ID NO: 468025 - DNA, 20 bp, Artificial Sequence
  chemically synthesized
tcagctcgtgctgtagtaac

SEQ ID NO: 468026 - DNA, 20 bp, Artificial Sequence
  chemically synthesized
atccagtggtagataatata

SEQ ID NO: 468027 - DNA, 20 bp, Artificial Sequence
  chemically synthesized
actccatatattatctacca

SEQ ID NO: 468028 - DNA, 20 bp, Artificial Sequence
  chemically synthesized
ctggcctgatgaattaaggc

SEQ ID NO: 468029 - DNA, 20 bp, Artificial Sequence
  chemically synthesized
caagccttaattcatcaggc

SEQ ID NO: 468030 - DNA, 20 bp, Artificial Sequence
  chemically synthesized
actcatttaatcctggcctg

SEQ ID NO: 468031 - DNA, 20 bp, Artificial Sequence
  chemically synthesized
attcatcaggccaggattaa

SEQ ID NO: 468032 - DNA, 20 bp, Artificial Sequence
  chemically synthesized
ataggacaagctgtcatgat

SEQ ID NO: 468033 - DNA, 20 bp, Artificial Sequence
  chemically synthesized
ttttaaccatttctggcttt

SEQ ID NO: 468034 - DNA, 20 bp, Artificial Sequence
  chemically synthesized
atgaaataaggttttttgat

SEQ ID NO: 468035 - DNA, 20 bp, Artificial Sequence
  chemically synthesized
taaggttttttgatttgagt

SEQ ID NO: 468036 - DNA, 20 bp, Artificial Sequence
  chemically synthesized
catttagaaataccttaaaa

SEQ ID NO: 468037 - DNA, 20 bp, Artificial Sequence
  chemically synthesized
aggtatttctaaatgttcat

SEQ ID NO: 468038 - DNA, 20 bp, Artificial Sequence
  chemically synthesized
atcaagaagaactgatgctg

SEQ ID NO: 468039 - DNA, 20 bp, Artificial Sequence
  chemically synthesized
tgttagggcatatttttgtt

SEQ ID NO: 468040 - DNA, 20 bp, Artificial Sequence
  chemically synthesized
agcccttatcaattacgcat

SEQ ID NO: 468041 - DNA, 20 bp, Artificial Sequence
  chemically synthesized
agggaaccttgatcatttat

SEQ ID NO: 468042 - DNA, 20 bp, Artificial Sequence
  chemically synthesized
ataaatgatcaaggttccct

SEQ ID NO: 468043 - DNA, 20 bp, Artificial Sequence
  chemically synthesized
aaaaaataaaaaaaaaacat

SEQ ID NO: 468044 - DNA, 20 bp, Artificial Sequence
  chemically synthesized
ttattttttattttttgaga

SEQ ID NO: 468045 - DNA, 20 bp, Artificial Sequence
  chemically synthesized
tctcgctctgtcgcccatgc

SEQ ID NO: 468046 - DNA, 20 bp, Artificial Sequence
  chemically synthesized
ctcactgcaagctctgcctc

SEQ ID NO: 468047 - DNA, 20 bp, Artificial Sequence
  chemically synthesized
gactctggaggctgaggcag

SEQ ID NO: 468048 - DNA, 20 bp, Artificial Sequence
  chemically synthesized
cattctcctgcctcagcctc

SEQ ID NO: 468049 - DNA, 20 bp, Artificial Sequence
  chemically synthesized
ttttgtatttttagtagaga

SEQ ID NO: 468050 - DNA, 20 bp, Artificial Sequence
  chemically synthesized
cagggtttcaccgtgttagc

SEQ ID NO: 468051 - DNA, 20 bp, Artificial Sequence
  chemically synthesized
actttgggaggccgaggcag

SEQ ID NO: 468052 - DNA, 20 bp, Artificial Sequence
  chemically synthesized
gcctcggcctcccaaagtgc

SEQ ID NO: 468053 - DNA, 20 bp, Artificial Sequence
  chemically synthesized
aataattgacagctgttaaa

SEQ ID NO: 468054 - DNA, 20 bp, Artificial Sequence
  chemically synthesized
ctaacaattagagaatcatt

SEQ ID NO: 468055 - DNA, 20 bp, Artificial Sequence
  chemically synthesized
cctaatgattctctaattgt

SEQ ID NO: 468056 - DNA, 20 bp, Artificial Sequence
  chemically synthesized
tgactacattctaacaatta

SEQ ID NO: 468057 - DNA, 20 bp, Artificial Sequence
  chemically synthesized
atgaagtcatttcaatacag

SEQ ID NO: 468058 - DNA, 20 bp, Artificial Sequence
  chemically synthesized
gatcagacaacgactccaca

SEQ ID NO: 468059 - DNA, 20 bp, Artificial Sequence
  chemically synthesized
gaacgtaaatagattctctg

SEQ ID NO: 468060 - DNA, 20 bp, Artificial Sequence
  chemically synthesized
agaagccatgtgtattgaat

SEQ ID NO: 468061 - DNA, 20 bp, Artificial Sequence
  chemically synthesized
agtgacagaagccatgtgta

SEQ ID NO: 468062 - DNA, 20 bp, Artificial Sequence
  chemically synthesized
actggatggaagactttttt

SEQ ID NO: 468063 - DNA, 20 bp, Artificial Sequence
  chemically synthesized
tctatagagaataagaaata

SEQ ID NO: 468064 - DNA, 20 bp, Artificial Sequence
  chemically synthesized
gggggattcttagctctata

SEQ ID NO: 468065 - DNA, 20 bp, Artificial Sequence
  chemically synthesized
ttcttattctctatagagct

SEQ ID NO: 468066 - DNA, 20 bp, Artificial Sequence
  chemically synthesized
tctacatatttgtagaatgg

SEQ ID NO: 468067 - DNA, 20 bp, Artificial Sequence
  chemically synthesized
cagatatatctacatatttg

SEQ ID NO: 468068 - DNA, 20 bp, Artificial Sequence
  chemically synthesized
ctgattaattttatgtcata

SEQ ID NO: 468069 - DNA, 20 bp, Artificial Sequence
  chemically synthesized
gtaaatttgtatgtagacaa

SEQ ID NO: 468070 - DNA, 20 bp, Artificial Sequence
  chemically synthesized
tagttggttgggaagttttt

SEQ ID NO: 468071 - DNA, 20 bp, Artificial Sequence
  chemically synthesized
gctttcatgttttcagcagg

SEQ ID NO: 468072 - DNA, 20 bp, Artificial Sequence
  chemically synthesized
ggcccttttagcaatgattt

SEQ ID NO: 468073 - DNA, 20 bp, Artificial Sequence
  chemically synthesized
tagtagggaagctccattta

SEQ ID NO: 468074 - DNA, 20 bp, Artificial Sequence
  chemically synthesized
accaaagcatgagcacacac

SEQ ID NO: 468075 - DNA, 20 bp, Artificial Sequence
  chemically synthesized
tacaaagattgccatctaaa

SEQ ID NO: 468076 - DNA, 20 bp, Artificial Sequence
  chemically synthesized
gagggtaaagccagatttct

SEQ ID NO: 468077 - DNA, 20 bp, Artificial Sequence
  chemically synthesized
agctgcttttaatattatat

SEQ ID NO: 468078 - DNA, 20 bp, Artificial Sequence
  chemically synthesized
atttgcctgaatttagattg

SEQ ID NO: 468079 - DNA, 20 bp, Artificial Sequence
  chemically synthesized
gtatgatttactacatttgc

SEQ ID NO: 468080 - DNA, 20 bp, Artificial Sequence
  chemically synthesized
tttaaagttcatcttgcttg

SEQ ID NO: 468081 - DNA, 20 bp, Artificial Sequence
  chemically synthesized
acctcaacctcccaaagtgc

SEQ ID NO: 468082 - DNA, 20 bp, Artificial Sequence
  chemically synthesized
actttgggaggttgaggtgg

SEQ ID NO: 468083 - DNA, 20 bp, Artificial Sequence
  chemically synthesized
tgggaggatcacttgagctc

SEQ ID NO: 468084 - DNA, 20 bp, Artificial Sequence
  chemically synthesized
aatttttttgtaaagatggt

SEQ ID NO: 468085 - DNA, 20 bp, Artificial Sequence
  chemically synthesized
cccaccccagcctcctcctc

SEQ ID NO: 468086 - DNA, 20 bp, Artificial Sequence
  chemically synthesized
gctactcaggaggaggaggc

SEQ ID NO: 468087 - DNA, 20 bp, Artificial Sequence
  chemically synthesized
ggctggggtgggaggaccgc

SEQ ID NO: 468088 - DNA, 20 bp, Artificial Sequence
  chemically synthesized
tcatgccactgcactccaag

SEQ ID NO: 468089 - DNA, 20 bp, Artificial Sequence
  chemically synthesized
tctccctctgttacccagct

SEQ ID NO: 468090 - DNA, 20 bp, Artificial Sequence
  chemically synthesized
ttgtcacttttttttttaaa

SEQ ID NO: 468091 - DNA, 20 bp, Artificial Sequence
  chemically synthesized
cacctagtttaggggtattt

SEQ ID NO: 468092 - DNA, 20 bp, Artificial Sequence
  chemically synthesized
tgtctttttccacctagttt

SEQ ID NO: 468093 - DNA, 20 bp, Artificial Sequence
  chemically synthesized
aggtggaaaaagacattaat

SEQ ID NO: 468094 - DNA, 20 bp, Artificial Sequence
  chemically synthesized
cattaataaggataagctca

SEQ ID NO: 468095 - DNA, 20 bp, Artificial Sequence
  chemically synthesized
gattagaaacaagagcctgg

SEQ ID NO: 468096 - DNA, 20 bp, Artificial Sequence
  chemically synthesized
aagggcttggaagtaaggct

SEQ ID NO: 468097 - DNA, 20 bp, Artificial Sequence
  chemically synthesized
ataagacatttacattttac

SEQ ID NO: 468098 - DNA, 20 bp, Artificial Sequence
  chemically synthesized
ttctaattctctcctcagcc

SEQ ID NO: 468099 - DNA, 20 bp, Artificial Sequence
  chemically synthesized
tcaccatccatggctgagga

SEQ ID NO: 468100 - DNA, 20 bp, Artificial Sequence
  chemically synthesized
acaaggcttgagagatggtc

SEQ ID NO: 468101 - DNA, 20 bp, Artificial Sequence
  chemically synthesized
aagtcataaatcaagatctt

SEQ ID NO: 468102 - DNA, 20 bp, Artificial Sequence
  chemically synthesized
ttaagcactaattcagttat

SEQ ID NO: 468103 - DNA, 20 bp, Artificial Sequence
  chemically synthesized
tggcttaataatcctcataa

SEQ ID NO: 468104 - DNA, 20 bp, Artificial Sequence
  chemically synthesized
ttcaaagaaagtttgacata

SEQ ID NO: 468105 - DNA, 20 bp, Artificial Sequence
  chemically synthesized
ctctatatattatttacttt

SEQ ID NO: 468106 - DNA, 20 bp, Artificial Sequence
  chemically synthesized
aggtatctacaggacaaata

SEQ ID NO: 468107 - DNA, 20 bp, Artificial Sequence
  chemically synthesized
agtatttgtcctgtagatac

SEQ ID NO: 468108 - DNA, 20 bp, Artificial Sequence
  chemically synthesized
ttgtagccacccccaaattt

SEQ ID NO: 468109 - DNA, 20 bp, Artificial Sequence
  chemically synthesized
acacaataattccaaaattt

SEQ ID NO: 468110 - DNA, 20 bp, Artificial Sequence
  chemically synthesized
actttactaaggcacagatg

SEQ ID NO: 468111 - DNA, 20 bp, Artificial Sequence
  chemically synthesized
atctgggcaaaatgaaatca

SEQ ID NO: 468112 - DNA, 20 bp, Artificial Sequence
  chemically synthesized
aatcactgagttaagatcac

SEQ ID NO: 468113 - DNA, 20 bp, Artificial Sequence
  chemically synthesized
ttcatcacatacctagcgta

SEQ ID NO: 468114 - DNA, 20 bp, Artificial Sequence
  chemically synthesized
tgtcaaattataatatgtcc

SEQ ID NO: 468115 - DNA, 20 bp, Artificial Sequence
  chemically synthesized
tgaaataaaatatgtggacc

SEQ ID NO: 468116 - DNA, 20 bp, Artificial Sequence
  chemically synthesized
aaatatgtggaccaagggta

SEQ ID NO: 468117 - DNA, 20 bp, Artificial Sequence
  chemically synthesized
acagggttaatgtatctagg

SEQ ID NO: 468118 - DNA, 20 bp, Artificial Sequence
  chemically synthesized
atctaggtggagtctatttt

SEQ ID NO: 468119 - DNA, 20 bp, Artificial Sequence
  chemically synthesized
taatgaattagcatctgatc

SEQ ID NO: 468120 - DNA, 20 bp, Artificial Sequence
  chemically synthesized
catttagtctatagacagta

SEQ ID NO: 468121 - DNA, 20 bp, Artificial Sequence
  chemically synthesized
aatcaaaagttcaacacaag

SEQ ID NO: 468122 - DNA, 20 bp, Artificial Sequence
  chemically synthesized
ataagtggttaaaatttctt

SEQ ID NO: 468123 - DNA, 20 bp, Artificial Sequence
  chemically synthesized
catcagccaaaaggaaaaac

SEQ ID NO: 468124 - DNA, 20 bp, Artificial Sequence
  chemically synthesized
ggtgaagaactctagtcctc

SEQ ID NO: 468125 - DNA, 20 bp, Artificial Sequence
  chemically synthesized
atggcagtattcctgaggac

SEQ ID NO: 468126 - DNA, 20 bp, Artificial Sequence
  chemically synthesized
aaagccgtaacagtctctag

SEQ ID NO: 468127 - DNA, 20 bp, Artificial Sequence
  chemically synthesized
actaagtctaactacgcatg

SEQ ID NO: 468128 - DNA, 20 bp, Artificial Sequence
  chemically synthesized
gtatatagcagtgcatgcca

SEQ ID NO: 468129 - DNA, 20 bp, Artificial Sequence
  chemically synthesized
gccataggatcatatatggc

SEQ ID NO: 468130 - DNA, 20 bp, Artificial Sequence
  chemically synthesized
cattgtaatagaggaggcca

SEQ ID NO: 468131 - DNA, 20 bp, Artificial Sequence
  chemically synthesized
tattacaatgacagaaacta

SEQ ID NO: 468132 - DNA, 20 bp, Artificial Sequence
  chemically synthesized
ccttgctctgtcacccaggc

SEQ ID NO: 468133 - DNA, 20 bp, Artificial Sequence
  chemically synthesized
ttacaccactgcactccagc

SEQ ID NO: 468134 - DNA, 20 bp, Artificial Sequence
  chemically synthesized
aatcatagctcactgtaacc

SEQ ID NO: 468135 - DNA, 20 bp, Artificial Sequence
  chemically synthesized
ctggaggatcacttgagccc

SEQ ID NO: 468136 - DNA, 20 bp, Artificial Sequence
  chemically synthesized
tactcaagaggctggggctg

SEQ ID NO: 468137 - DNA, 20 bp, Artificial Sequence
  chemically synthesized
gatcctccagccccagcctc

SEQ ID NO: 468138 - DNA, 20 bp, Artificial Sequence
  chemically synthesized
tgggaggatcacttgagacc

SEQ ID NO: 468139 - DNA, 20 bp, Artificial Sequence
  chemically synthesized
actttggcaggctgaggtgg

SEQ ID NO: 468140 - DNA, 20 bp, Artificial Sequence
  chemically synthesized
cacctcagcctgccaaagtg

SEQ ID NO: 468141 - DNA, 20 bp, Artificial Sequence
  chemically synthesized
gtgagccaccatgcccagcc

SEQ ID NO: 468142 - DNA, 20 bp, Artificial Sequence
  chemically synthesized
ataattaccggtacttgtac

SEQ ID NO: 468143 - DNA, 20 bp, Artificial Sequence
  chemically synthesized
atttctacttattgtctgtt

SEQ ID NO: 468144 - DNA, 20 bp, Artificial Sequence
  chemically synthesized
gcccaaatgtccatcaagta

SEQ ID NO: 468145 - DNA, 20 bp, Artificial Sequence
  chemically synthesized
gctgagtaacatttcattgt

SEQ ID NO: 468146 - DNA, 20 bp, Artificial Sequence
  chemically synthesized
atttcattctttctttaatg

SEQ ID NO: 468147 - DNA, 20 bp, Artificial Sequence
  chemically synthesized
atgttactcagcattaaaga

SEQ ID NO: 468148 - DNA, 20 bp, Artificial Sequence
  chemically synthesized
tttcatttacattaacagtc

SEQ ID NO: 468149 - DNA, 20 bp, Artificial Sequence
  chemically synthesized
ctgatctactttctgtctct

SEQ ID NO: 468150 - DNA, 20 bp, Artificial Sequence
  chemically synthesized
atagagacagaaagtagatc

SEQ ID NO: 468151 - DNA, 20 bp, Artificial Sequence
  chemically synthesized
tgtctactgctagggctgaa

SEQ ID NO: 468152 - DNA, 20 bp, Artificial Sequence
  chemically synthesized
gagtagttgcaggagaaacg

SEQ ID NO: 468153 - DNA, 20 bp, Artificial Sequence
  chemically synthesized
acgaggagtgacttgaaaat

SEQ ID NO: 468154 - DNA, 20 bp, Artificial Sequence
  chemically synthesized
gagtgacttgaaaatgggga

SEQ ID NO: 468155 - DNA, 20 bp, Artificial Sequence
  chemically synthesized
tggggatgggatttcttttg

SEQ ID NO: 468156 - DNA, 20 bp, Artificial Sequence
  chemically synthesized
taatcactggttattaatta

SEQ ID NO: 468157 - DNA, 20 bp, Artificial Sequence
  chemically synthesized
cagtgactaatacactgtaa

SEQ ID NO: 468158 - DNA, 20 bp, Artificial Sequence
  chemically synthesized
atgggtaactcctatggtac

SEQ ID NO: 468159 - DNA, 20 bp, Artificial Sequence
  chemically synthesized
agatataattctcgtaccat

SEQ ID NO: 468160 - DNA, 20 bp, Artificial Sequence
  chemically synthesized
gtgctataagaaataaaatt

SEQ ID NO: 468161 - DNA, 20 bp, Artificial Sequence
  chemically synthesized
taagattttattgttttcac

SEQ ID NO: 468162 - DNA, 20 bp, Artificial Sequence
  chemically synthesized
accatttttcttttatgtac

SEQ ID NO: 468163 - DNA, 20 bp, Artificial Sequence
  chemically synthesized
aaatggtatgcacatgtctt

SEQ ID NO: 468164 - DNA, 20 bp, Artificial Sequence
  chemically synthesized
tgaaaatatttaatgtccac

SEQ ID NO: 468165 - DNA, 20 bp, Artificial Sequence
  chemically synthesized
acattaaatattttcagatg

SEQ ID NO: 468166 - DNA, 20 bp, Artificial Sequence
  chemically synthesized
ttcagatgatgagttttaaa

SEQ ID NO: 468167 - DNA, 20 bp, Artificial Sequence
  chemically synthesized
agcccagaaaatgcttaagt

SEQ ID NO: 468168 - DNA, 20 bp, Artificial Sequence
  chemically synthesized
tctgggttagcctaaacaac

SEQ ID NO: 468169 - DNA, 20 bp, Artificial Sequence
  chemically synthesized
caaactaaacaggtatatta

SEQ ID NO: 468170 - DNA, 20 bp, Artificial Sequence
  chemically synthesized
tctgttacttgatgggtttt

SEQ ID NO: 468171 - DNA, 20 bp, Artificial Sequence
  chemically synthesized
tggagtttttctgttacttg

SEQ ID NO: 468172 - DNA, 20 bp, Artificial Sequence
  chemically synthesized
caagtaacagaaaaactcca

SEQ ID NO: 468173 - DNA, 20 bp, Artificial Sequence
  chemically synthesized
atgaatgggtaaatatcctt

SEQ ID NO: 468174 - DNA, 20 bp, Artificial Sequence
  chemically synthesized
taaatgtgtcataaaaatga

SEQ ID NO: 468175 - DNA, 20 bp, Artificial Sequence
  chemically synthesized
tacataaatgtgtcataaaa

SEQ ID NO: 468176 - DNA, 20 bp, Artificial Sequence
  chemically synthesized
atatctttatctccacagca

SEQ ID NO: 468177 - DNA, 20 bp, Artificial Sequence
  chemically synthesized
ctctagaatgtgagctcttc

SEQ ID NO: 468178 - DNA, 20 bp, Artificial Sequence
  chemically synthesized
cccttgaagagctcacattc

SEQ ID NO: 468179 - DNA, 20 bp, Artificial Sequence
  chemically synthesized
agagctcacattctagagtg

SEQ ID NO: 468180 - DNA, 20 bp, Artificial Sequence
  chemically synthesized
gtaaacaatatcccacactc

SEQ ID NO: 468181 - DNA, 20 bp, Artificial Sequence
  chemically synthesized
gattcccagtctttttgcct

SEQ ID NO: 468182 - DNA, 20 bp, Artificial Sequence
  chemically synthesized
tactcgaaggcaaaaagact

SEQ ID NO: 468183 - DNA, 20 bp, Artificial Sequence
  chemically synthesized
ttaccaggaaattacaggaa

SEQ ID NO: 468184 - DNA, 20 bp, Artificial Sequence
  chemically synthesized
aattacaggaaaagaatcat

SEQ ID NO: 468185 - DNA, 20 bp, Artificial Sequence
  chemically synthesized
actagcaccataaggtaact

SEQ ID NO: 468186 - DNA, 20 bp, Artificial Sequence
  chemically synthesized
ttttcttgtgtctccaaatt

SEQ ID NO: 468187 - DNA, 20 bp, Artificial Sequence
  chemically synthesized
taagatagtaaaaaaataaa

SEQ ID NO: 468188 - DNA, 20 bp, Artificial Sequence
  chemically synthesized
atagtaaaaaaataaaatgg

SEQ ID NO: 468189 - DNA, 20 bp, Artificial Sequence
  chemically synthesized
tgttggtattacatatgtac

SEQ ID NO: 468190 - DNA, 20 bp, Artificial Sequence
  chemically synthesized
ggacagagacctcctaggaa

SEQ ID NO: 468191 - DNA, 20 bp, Artificial Sequence
  chemically synthesized
aggagtaatgagttgcggga

SEQ ID NO: 468192 - DNA, 20 bp, Artificial Sequence
  chemically synthesized
gaagtcttgattaaggagta

SEQ ID NO: 468193 - DNA, 20 bp, Artificial Sequence
  chemically synthesized
tagaagagaagtcttgatta

SEQ ID NO: 468194 - DNA, 20 bp, Artificial Sequence
  chemically synthesized
cctatctctccaacattctc

SEQ ID NO: 468195 - DNA, 20 bp, Artificial Sequence
  chemically synthesized
tggctaatggagccatccag

SEQ ID NO: 468196 - DNA, 20 bp, Artificial Sequence
  chemically synthesized
gttgttgcttgaggcctctc

SEQ ID NO: 468197 - DNA, 20 bp, Artificial Sequence
  chemically synthesized
tagcttcatcacaattactg

SEQ ID NO: 468198 - DNA, 20 bp, Artificial Sequence
  chemically synthesized
gatgcaattaacttgctatc

SEQ ID NO: 468199 - DNA, 20 bp, Artificial Sequence
  chemically synthesized
tggcaatttttcttggtggt

SEQ ID NO: 468200 - DNA, 20 bp, Artificial Sequence
  chemically synthesized
tgaaaagccaagttattcgg

SEQ ID NO: 468201 - DNA, 20 bp, Artificial Sequence
  chemically synthesized
catttttgtagaatatccca

SEQ ID NO: 468202 - DNA, 20 bp, Artificial Sequence
  chemically synthesized
aattctttgcaccatttttg

SEQ ID NO: 468203 - DNA, 20 bp, Artificial Sequence
  chemically synthesized
tattctacaaaaatggtgca

SEQ ID NO: 468204 - DNA, 20 bp, Artificial Sequence
  chemically synthesized
aaagaattttctatgatcat

SEQ ID NO: 468205 - DNA, 20 bp, Artificial Sequence
  chemically synthesized
agactaaatcattctggctt

SEQ ID NO: 468206 - DNA, 20 bp, Artificial Sequence
  chemically synthesized
taccctgtagacccagaagc

SEQ ID NO: 468207 - DNA, 20 bp, Artificial Sequence
  chemically synthesized
cattctggcttctgggtcta

SEQ ID NO: 468208 - DNA, 20 bp, Artificial Sequence
  chemically synthesized
caggtgcccacgtaggaagc

SEQ ID NO: 468209 - DNA, 20 bp, Artificial Sequence
  chemically synthesized
ctgatgttcccagagacaca

SEQ ID NO: 468210 - DNA, 20 bp, Artificial Sequence
  chemically synthesized
gcttctcaacaactacagta

SEQ ID NO: 468211 - DNA, 20 bp, Artificial Sequence
  chemically synthesized
tttcaaagtttacttcagac

SEQ ID NO: 468212 - DNA, 20 bp, Artificial Sequence
  chemically synthesized
ttacgttagcatttgcactg

SEQ ID NO: 468213 - DNA, 20 bp, Artificial Sequence
  chemically synthesized
cgtaatgatgactttccagt

SEQ ID NO: 468214 - DNA, 20 bp, Artificial Sequence
  chemically synthesized
tttcaaagttttactgtcct

SEQ ID NO: 468215 - DNA, 20 bp, Artificial Sequence
  chemically synthesized
ccttggaatcctttttttct

SEQ ID NO: 468216 - DNA, 20 bp, Artificial Sequence
  chemically synthesized
ctgagatactctgagaaaaa

SEQ ID NO: 468217 - DNA, 20 bp, Artificial Sequence
  chemically synthesized
agtatctcagtggtattctg

SEQ ID NO: 468218 - DNA, 20 bp, Artificial Sequence
  chemically synthesized
gttgcctaaaatgtattctg

SEQ ID NO: 468219 - DNA, 20 bp, Artificial Sequence
  chemically synthesized
agatagggtgacagttctcc

SEQ ID NO: 468220 - DNA, 20 bp, Artificial Sequence
  chemically synthesized
taacattaaaacaccaaaga

SEQ ID NO: 468221 - DNA, 20 bp, Artificial Sequence
  chemically synthesized
cagccacatataatttccct

SEQ ID NO: 468222 - DNA, 20 bp, Artificial Sequence
  chemically synthesized
cttcaagtgtaacgctgctt

SEQ ID NO: 468223 - DNA, 20 bp, Artificial Sequence
  chemically synthesized
ttcaggaccaccacccaagt

SEQ ID NO: 468224 - DNA, 20 bp, Artificial Sequence
  chemically synthesized
aataggacctgtattcaaac

SEQ ID NO: 468225 - DNA, 20 bp, Artificial Sequence
  chemically synthesized
ttccagaggattacgtggca

SEQ ID NO: 468226 - DNA, 20 bp, Artificial Sequence
  chemically synthesized
tgaaagagaggctgtttcca

SEQ ID NO: 468227 - DNA, 20 bp, Artificial Sequence
  chemically synthesized
tggaaacagcctctctttca

SEQ ID NO: 468228 - DNA, 20 bp, Artificial Sequence
  chemically synthesized
ctctttcatagggttgtttt

SEQ ID NO: 468229 - DNA, 20 bp, Artificial Sequence
  chemically synthesized
ggttgttttaaggattaaat

SEQ ID NO: 468230 - DNA, 20 bp, Artificial Sequence
  chemically synthesized
tgctatggacaggaactgtt

SEQ ID NO: 468231 - DNA, 20 bp, Artificial Sequence
  chemically synthesized
ataacaaaaatagctgtcct

SEQ ID NO: 468232 - DNA, 20 bp, Artificial Sequence
  chemically synthesized
ggaaaacaatgatgtttctt

SEQ ID NO: 468233 - DNA, 20 bp, Artificial Sequence
  chemically synthesized
gatttgtctgtctcttaata

SEQ ID NO: 468234 - DNA, 20 bp, Artificial Sequence
  chemically synthesized
tggctacagggaagctcaaa

SEQ ID NO: 468235 - DNA, 20 bp, Artificial Sequence
  chemically synthesized
aatagatcaatgaacatcat

SEQ ID NO: 468236 - DNA, 20 bp, Artificial Sequence
  chemically synthesized
tgatctattatttatattgc

SEQ ID NO: 468237 - DNA, 20 bp, Artificial Sequence
  chemically synthesized
tgtattgctatgacttttta

SEQ ID NO: 468238 - DNA, 20 bp, Artificial Sequence
  chemically synthesized
ttacgtattcagttttcaga

SEQ ID NO: 468239 - DNA, 20 bp, Artificial Sequence
  chemically synthesized
taaagaatcctttctgaaaa

SEQ ID NO: 468240 - DNA, 20 bp, Artificial Sequence
  chemically synthesized
ttgaaatgtccttgggcaaa

SEQ ID NO: 468241 - DNA, 20 bp, Artificial Sequence
  chemically synthesized
agagctacgtatcagacata

SEQ ID NO: 468242 - DNA, 20 bp, Artificial Sequence
  chemically synthesized
ggaaaaactcctgatttgca

SEQ ID NO: 468243 - DNA, 20 bp, Artificial Sequence
  chemically synthesized
gcactaaccctttgcaaatc

SEQ ID NO: 468244 - DNA, 20 bp, Artificial Sequence
  chemically synthesized
ttgcaaatcaggagtttttc

SEQ ID NO: 468245 - DNA, 20 bp, Artificial Sequence
  chemically synthesized
agaaattagaaggtcactga

SEQ ID NO: 468246 - DNA, 20 bp, Artificial Sequence
  chemically synthesized
atggagaaattagaaggtca

SEQ ID NO: 468247 - DNA, 20 bp, Artificial Sequence
  chemically synthesized
tgtcttaggcaagtgaagaa

SEQ ID NO: 468248 - DNA, 20 bp, Artificial Sequence
  chemically synthesized
aagatgccaggttcttaact

SEQ ID NO: 468249 - DNA, 20 bp, Artificial Sequence
  chemically synthesized
gaagattggtagaagcacag

SEQ ID NO: 468250 - DNA, 20 bp, Artificial Sequence
  chemically synthesized
gatggctttttgacgggggg

SEQ ID NO: 468251 - DNA, 20 bp, Artificial Sequence
  chemically synthesized
catcactgttcacctgctta

SEQ ID NO: 468252 - DNA, 20 bp, Artificial Sequence
  chemically synthesized
tgtgcatcatactaaggagt

SEQ ID NO: 468253 - DNA, 20 bp, Artificial Sequence
  chemically synthesized
ggactttgtgcatcatacta

SEQ ID NO: 468254 - DNA, 20 bp, Artificial Sequence
  chemically synthesized
tgaggagaataagagggcag

SEQ ID NO: 468255 - DNA, 20 bp, Artificial Sequence
  chemically synthesized
aatgtgtggcttggaatgag

SEQ ID NO: 468256 - DNA, 20 bp, Artificial Sequence
  chemically synthesized
ccagtgagtaatgtgtggct

SEQ ID NO: 468257 - DNA, 20 bp, Artificial Sequence
  chemically synthesized
ttttccagactggtggacca

SEQ ID NO: 468258 - DNA, 20 bp, Artificial Sequence
  chemically synthesized
gtctgagagatgggggaagg

SEQ ID NO: 468259 - DNA, 20 bp, Artificial Sequence
  chemically synthesized
tccagtctgagagatggggg

SEQ ID NO: 468260 - DNA, 20 bp, Artificial Sequence
  chemically synthesized
ttaagagttgaagactgaat

SEQ ID NO: 468261 - DNA, 20 bp, Artificial Sequence
  chemically synthesized
gagagtttaagagttgaaga

SEQ ID NO: 468262 - DNA, 20 bp, Artificial Sequence
  chemically synthesized
ggcctttacaaagagagttt

SEQ ID NO: 468263 - DNA, 20 bp, Artificial Sequence
  chemically synthesized
agtagagaggcctttacaaa

SEQ ID NO: 468264 - DNA, 20 bp, Artificial Sequence
  chemically synthesized
ggcctctctactccctctga

SEQ ID NO: 468265 - DNA, 20 bp, Artificial Sequence
  chemically synthesized
gaatgatttattctatcaga

SEQ ID NO: 468266 - DNA, 20 bp, Artificial Sequence
  chemically synthesized
agtgctctgggggcacagag

SEQ ID NO: 468267 - DNA, 20 bp, Artificial Sequence
  chemically synthesized
ccccagagcacttgtaacag

SEQ ID NO: 468268 - DNA, 20 bp, Artificial Sequence
  chemically synthesized
aaataaattttgagctccat

SEQ ID NO: 468269 - DNA, 20 bp, Artificial Sequence
  chemically synthesized
aaaattatgagactacaaag

SEQ ID NO: 468270 - DNA, 20 bp, Artificial Sequence
  chemically synthesized
ttcaattctgcagatagtta

SEQ ID NO: 468271 - DNA, 20 bp, Artificial Sequence
  chemically synthesized
aagcactcagtaactatctg

SEQ ID NO: 468272 - DNA, 20 bp, Artificial Sequence
  chemically synthesized
taactatctgcagaattgaa

SEQ ID NO: 468273 - DNA, 20 bp, Artificial Sequence
  chemically synthesized
tttagctactttccaggcct

SEQ ID NO: 468274 - DNA, 20 bp, Artificial Sequence
  chemically synthesized
cagtagaattgattatggtc

SEQ ID NO: 468275 - DNA, 20 bp, Artificial Sequence
  chemically synthesized
tgccaattgtccctctacag

SEQ ID NO: 468276 - DNA, 20 bp, Artificial Sequence
  chemically synthesized
tggcaaatgaaggccaacag

SEQ ID NO: 468277 - DNA, 20 bp, Artificial Sequence
  chemically synthesized
atgaaggccaacaggaggat

SEQ ID NO: 468278 - DNA, 20 bp, Artificial Sequence
  chemically synthesized
aaaaaaaaaaaaaagggaaa

SEQ ID NO: 468279 - DNA, 20 bp, Artificial Sequence
  chemically synthesized
ctccctagaacatgctggat

SEQ ID NO: 468280 - DNA, 20 bp, Artificial Sequence
  chemically synthesized
tgccatctccctagaacatg

SEQ ID NO: 468281 - DNA, 20 bp, Artificial Sequence
  chemically synthesized
ggcagctgtacttgtaagat

SEQ ID NO: 468282 - DNA, 20 bp, Artificial Sequence
  chemically synthesized
tgaagcacccctctggcgat

SEQ ID NO: 468283 - DNA, 20 bp, Artificial Sequence
  chemically synthesized
gtgaatattctaatcgccag

SEQ ID NO: 468284 - DNA, 20 bp, Artificial Sequence
  chemically synthesized
tagaatcttggcatctaaaa

SEQ ID NO: 468285 - DNA, 20 bp, Artificial Sequence
  chemically synthesized
aaattgtgttctggtgagcc

SEQ ID NO: 468286 - DNA, 20 bp, Artificial Sequence
  chemically synthesized
ttattgtgattcctaagaca

SEQ ID NO: 468287 - DNA, 20 bp, Artificial Sequence
  chemically synthesized
gtcttagaatccagtgtctt

SEQ ID NO: 468288 - DNA, 20 bp, Artificial Sequence
  chemically synthesized
agacactggattctaagaca

SEQ ID NO: 468289 - DNA, 20 bp, Artificial Sequence
  chemically synthesized
gcacacagcatcctgtgtct

SEQ ID NO: 468290 - DNA, 20 bp, Artificial Sequence
  chemically synthesized
ggatgctgtgtgccgaaaaa

SEQ ID NO: 468291 - DNA, 20 bp, Artificial Sequence
  chemically synthesized
atactagatctattaaaatg

SEQ ID NO: 468292 - DNA, 20 bp, Artificial Sequence
  chemically synthesized
cagttaaaaagagagataat

SEQ ID NO: 468293 - DNA, 20 bp, Artificial Sequence
  chemically synthesized
gggagaaataaactttcatt

SEQ ID NO: 468294 - DNA, 20 bp, Artificial Sequence
  chemically synthesized
atggcagtgaatggataacc

SEQ ID NO: 468295 - DNA, 20 bp, Artificial Sequence
  chemically synthesized
tatgcagttcatggcagtga

SEQ ID NO: 468296 - DNA, 20 bp, Artificial Sequence
  chemically synthesized
atagtatgcagttcatggca

SEQ ID NO: 468297 - DNA, 20 bp, Artificial Sequence
  chemically synthesized
actgccatgaactgcatact

SEQ ID NO: 468298 - DNA, 20 bp, Artificial Sequence
  chemically synthesized
ccctcagacttcaattaact

SEQ ID NO: 468299 - DNA, 20 bp, Artificial Sequence
  chemically synthesized
ctggccctgctagttagaaa

SEQ ID NO: 468300 - DNA, 20 bp, Artificial Sequence
  chemically synthesized
gctagttagaaactgagtct

SEQ ID NO: 468301 - DNA, 20 bp, Artificial Sequence
  chemically synthesized
ggacaggaacatggtagaag

SEQ ID NO: 468302 - DNA, 20 bp, Artificial Sequence
  chemically synthesized
catgttcctgtcctccctgc

SEQ ID NO: 468303 - DNA, 20 bp, Artificial Sequence
  chemically synthesized
tttaagaagctgtgtaagaa

SEQ ID NO: 468304 - DNA, 20 bp, Artificial Sequence
  chemically synthesized
ccacatttaagaagctgtgt

SEQ ID NO: 468305 - DNA, 20 bp, Artificial Sequence
  chemically synthesized
caagaccttttatggcaagg

SEQ ID NO: 468306 - DNA, 20 bp, Artificial Sequence
  chemically synthesized
aagccaagaccttttatggc

SEQ ID NO: 468307 - DNA, 20 bp, Artificial Sequence
  chemically synthesized
caccaaatgatatagtttgg

SEQ ID NO: 468308 - DNA, 20 bp, Artificial Sequence
  chemically synthesized
gctataattcaagatcagat

SEQ ID NO: 468309 - DNA, 20 bp, Artificial Sequence
  chemically synthesized
atctccacccaaatctgatc

SEQ ID NO: 468310 - DNA, 20 bp, Artificial Sequence
  chemically synthesized
gggttcctcccatgatatgt

SEQ ID NO: 468311 - DNA, 20 bp, Artificial Sequence
  chemically synthesized
catgattcagttacctccca

SEQ ID NO: 468312 - DNA, 20 bp, Artificial Sequence
  chemically synthesized
aggaacccagtgggaggtaa

SEQ ID NO: 468313 - DNA, 20 bp, Artificial Sequence
  chemically synthesized
gtgggaggtaactgaatcat

SEQ ID NO: 468314 - DNA, 20 bp, Artificial Sequence
  chemically synthesized
aggtaactgaatcatggggg

SEQ ID NO: 468315 - DNA, 20 bp, Artificial Sequence
  chemically synthesized
ttaaaaccatcagatctcat

SEQ ID NO: 468316 - DNA, 20 bp, Artificial Sequence
  chemically synthesized
cttcccagccacacggaact

SEQ ID NO: 468317 - DNA, 20 bp, Artificial Sequence
  chemically synthesized
ggactaatacaccaagtaac

SEQ ID NO: 468318 - DNA, 20 bp, Artificial Sequence
  chemically synthesized
ttcccacatgtttttaaagt

SEQ ID NO: 468319 - DNA, 20 bp, Artificial Sequence
  chemically synthesized
aaacatgtgggaacagccgt

SEQ ID NO: 468320 - DNA, 20 bp, Artificial Sequence
  chemically synthesized
aacagccgtaggaatcagtc

SEQ ID NO: 468321 - DNA, 20 bp, Artificial Sequence
  chemically synthesized
gaggaaagaagcataatgga

SEQ ID NO: 468322 - DNA, 20 bp, Artificial Sequence
  chemically synthesized
aagggaggaaagaagcataa

SEQ ID NO: 468323 - DNA, 20 bp, Artificial Sequence
  chemically synthesized
aaagtggtaggtaaggaatt

SEQ ID NO: 468324 - DNA, 20 bp, Artificial Sequence
  chemically synthesized
tgaagacaaagtggtaggta

SEQ ID NO: 468325 - DNA, 20 bp, Artificial Sequence
  chemically synthesized
gtatgggaggaggcgtgacc

SEQ ID NO: 468326 - DNA, 20 bp, Artificial Sequence
  chemically synthesized
ccacaggaggcaggagagag

SEQ ID NO: 468327 - DNA, 20 bp, Artificial Sequence
  chemically synthesized
agaagaggagggcagagctt

SEQ ID NO: 468328 - DNA, 20 bp, Artificial Sequence
  chemically synthesized
tttaagtaaaaagagaaaac

SEQ ID NO: 468329 - DNA, 20 bp, Artificial Sequence
  chemically synthesized
gcaaacatatttatggttgt

SEQ ID NO: 468330 - DNA, 20 bp, Artificial Sequence
  chemically synthesized
gccaggggagaaggttggag

SEQ ID NO: 468331 - DNA, 20 bp, Artificial Sequence
  chemically synthesized
aaaaagacatatagagaaaa

SEQ ID NO: 468332 - DNA, 20 bp, Artificial Sequence
  chemically synthesized
tatatgtctttttgaaccct

SEQ ID NO: 468333 - DNA, 20 bp, Artificial Sequence
  chemically synthesized
atattattatacaaaatcca

SEQ ID NO: 468334 - DNA, 20 bp, Artificial Sequence
  chemically synthesized
aattacttttatttttagta

SEQ ID NO: 468335 - DNA, 20 bp, Artificial Sequence
  chemically synthesized
actttaatgttcacatcttc

SEQ ID NO: 468336 - DNA, 20 bp, Artificial Sequence
  chemically synthesized
catgtagcagaaggagaaca

SEQ ID NO: 468337 - DNA, 20 bp, Artificial Sequence
  chemically synthesized
ctccttctgctacatgctcc

SEQ ID NO: 468338 - DNA, 20 bp, Artificial Sequence
  chemically synthesized
tggtagttgaaaccgtgaga

SEQ ID NO: 468339 - DNA, 20 bp, Artificial Sequence
  chemically synthesized
caggtggtagttgaaaccgt

SEQ ID NO: 468340 - DNA, 20 bp, Artificial Sequence
  chemically synthesized
aagcctgagatattaggact

SEQ ID NO: 468341 - DNA, 20 bp, Artificial Sequence
  chemically synthesized
agaactctgatgcttgtaga

SEQ ID NO: 468342 - DNA, 20 bp, Artificial Sequence
  chemically synthesized
tatatcctttctacaagcat

SEQ ID NO: 468343 - DNA, 20 bp, Artificial Sequence
  chemically synthesized
taaatgaggtatggaagagg

SEQ ID NO: 468344 - DNA, 20 bp, Artificial Sequence
  chemically synthesized
tagaggtccttcctgaaggg

SEQ ID NO: 468345 - DNA, 20 bp, Artificial Sequence
  chemically synthesized
taataaacactgctgcatta

SEQ ID NO: 468346 - DNA, 20 bp, Artificial Sequence
  chemically synthesized
tggacctgctgcaactcctc

SEQ ID NO: 468347 - DNA, 20 bp, Artificial Sequence
  chemically synthesized
gctgggactgataattcagg

SEQ ID NO: 468348 - DNA, 20 bp, Artificial Sequence
  chemically synthesized
gttttgtagttaccagccct

SEQ ID NO: 468349 - DNA, 20 bp, Artificial Sequence
  chemically synthesized
tctgtgggactagggtatga

SEQ ID NO: 468350 - DNA, 20 bp, Artificial Sequence
  chemically synthesized
attcggtagttctgtgggac

SEQ ID NO: 468351 - DNA, 20 bp, Artificial Sequence
  chemically synthesized
accctagtcccacagaacta

SEQ ID NO: 468352 - DNA, 20 bp, Artificial Sequence
  chemically synthesized
atctgagtgatatttcgggg

SEQ ID NO: 468353 - DNA, 20 bp, Artificial Sequence
  chemically synthesized
aatgaagtagacaggctgat

SEQ ID NO: 468354 - DNA, 20 bp, Artificial Sequence
  chemically synthesized
aacgaggaaatcaagctggg

SEQ ID NO: 468355 - DNA, 20 bp, Artificial Sequence
  chemically synthesized
gccacacaggcagctgtgcg

SEQ ID NO: 468356 - DNA, 20 bp, Artificial Sequence
  chemically synthesized
agtcaggccatgatattgac

SEQ ID NO: 468357 - DNA, 20 bp, Artificial Sequence
  chemically synthesized
tcaatatcatggcctgactc

SEQ ID NO: 468358 - DNA, 20 bp, Artificial Sequence
  chemically synthesized
gcaactcaagggtgtgatcc

SEQ ID NO: 468359 - DNA, 20 bp, Artificial Sequence
  chemically synthesized
ctgactcctggatcacaccc

SEQ ID NO: 468360 - DNA, 20 bp, Artificial Sequence
  chemically synthesized
cctagtctagggagcaactc

SEQ ID NO: 468361 - DNA, 20 bp, Artificial Sequence
  chemically synthesized
acggaggcagcaactctgca

SEQ ID NO: 468362 - DNA, 20 bp, Artificial Sequence
  chemically synthesized
gaagggtgtggtacccactg

SEQ ID NO: 468363 - DNA, 20 bp, Artificial Sequence
  chemically synthesized
gtcagcaagggcaggtcggg

SEQ ID NO: 468364 - DNA, 20 bp, Artificial Sequence
  chemically synthesized
ttaccttttttaagaaggca

SEQ ID NO: 468365 - DNA, 20 bp, Artificial Sequence
  chemically synthesized
ggtgtcagggtgaggaatgg

SEQ ID NO: 468366 - DNA, 20 bp, Artificial Sequence
  chemically synthesized
taaacaaaggtgtcagggtg

SEQ ID NO: 468367 - DNA, 20 bp, Artificial Sequence
  chemically synthesized
tggaatataaacaaaggtgt

SEQ ID NO: 468368 - DNA, 20 bp, Artificial Sequence
  chemically synthesized
cacctttgtttatattccat

SEQ ID NO: 468369 - DNA, 20 bp, Artificial Sequence
  chemically synthesized
gttaggaatgggcattccta

SEQ ID NO: 468370 - DNA, 20 bp, Artificial Sequence
  chemically synthesized
gaagggaatctgaagaggtt

SEQ ID NO: 468371 - DNA, 20 bp, Artificial Sequence
  chemically synthesized
gaaaagatggccaaaatgaa

SEQ ID NO: 468372 - DNA, 20 bp, Artificial Sequence
  chemically synthesized
aaagacctaatgaaagaaca

SEQ ID NO: 468373 - DNA, 20 bp, Artificial Sequence
  chemically synthesized
tcaattacaaagtaaagcaa

SEQ ID NO: 468374 - DNA, 20 bp, Artificial Sequence
  chemically synthesized
tagatcagttactgatacca

SEQ ID NO: 468375 - DNA, 20 bp, Artificial Sequence
  chemically synthesized
taatcttgcacaatcactgg

SEQ ID NO: 468376 - DNA, 20 bp, Artificial Sequence
  chemically synthesized
agaccttatgaagccaaaat

SEQ ID NO: 468377 - DNA, 20 bp, Artificial Sequence
  chemically synthesized
aacaagacatatgaaaggtc

SEQ ID NO: 468378 - DNA, 20 bp, Artificial Sequence
  chemically synthesized
aaaggtcctgagtaggtatt

SEQ ID NO: 468379 - DNA, 20 bp, Artificial Sequence
  chemically synthesized
gagtaggtattaagaatcta

SEQ ID NO: 468380 - DNA, 20 bp, Artificial Sequence
  chemically synthesized
ctttaactttagactttatg

SEQ ID NO: 468381 - DNA, 20 bp, Artificial Sequence
  chemically synthesized
aaaggctaccttttcattgc

SEQ ID NO: 468382 - DNA, 20 bp, Artificial Sequence
  chemically synthesized
ttcattgctaggatcatacc

SEQ ID NO: 468383 - DNA, 20 bp, Artificial Sequence
  chemically synthesized
gcaagaaaaaaaagtaaacc

SEQ ID NO: 468384 - DNA, 20 bp, Artificial Sequence
  chemically synthesized
tggcaaagagccactggatc

SEQ ID NO: 468385 - DNA, 20 bp, Artificial Sequence
  chemically synthesized
ctttatttggcaaagagcca

SEQ ID NO: 468386 - DNA, 20 bp, Artificial Sequence
  chemically synthesized
tttgccaaataaagatgtat

SEQ ID NO: 468387 - DNA, 20 bp, Artificial Sequence
  chemically synthesized
ccatagtgcctcccataagt

SEQ ID NO: 468388 - DNA, 20 bp, Artificial Sequence
  chemically synthesized
tgagtaaaagctaaatctga

SEQ ID NO: 468389 - DNA, 20 bp, Artificial Sequence
  chemically synthesized
acagagataaggctaaagct

SEQ ID NO: 468390 - DNA, 20 bp, Artificial Sequence
  chemically synthesized
ttatctctgtggcatcaacc

SEQ ID NO: 468391 - DNA, 20 bp, Artificial Sequence
  chemically synthesized
agaatcagagaacaccaatg

SEQ ID NO: 468392 - DNA, 20 bp, Artificial Sequence
  chemically synthesized
cagtgcctgtgatttggaaa

SEQ ID NO: 468393 - DNA, 20 bp, Artificial Sequence
  chemically synthesized
gcatggctttgtcataaatt

SEQ ID NO: 468394 - DNA, 20 bp, Artificial Sequence
  chemically synthesized
caaggcagtttgaaaaaggg

SEQ ID NO: 468395 - DNA, 20 bp, Artificial Sequence
  chemically synthesized
aatgaataaatgaattgaag

SEQ ID NO: 468396 - DNA, 20 bp, Artificial Sequence
  chemically synthesized
ttgaatgcattaatgaataa

SEQ ID NO: 468397 - DNA, 20 bp, Artificial Sequence
  chemically synthesized
aatatttgttgaatgcatta

SEQ ID NO: 468398 - DNA, 20 bp, Artificial Sequence
  chemically synthesized
tagtattcaataaatatttg

SEQ ID NO: 468399 - DNA, 20 bp, Artificial Sequence
  chemically synthesized
atgcattcaacaaatattta

SEQ ID NO: 468400 - DNA, 20 bp, Artificial Sequence
  chemically synthesized
tgtgcaacaaccaggagaaa

SEQ ID NO: 468401 - DNA, 20 bp, Artificial Sequence
  chemically synthesized
aggtatcttatctctgcctt

SEQ ID NO: 468402 - DNA, 20 bp, Artificial Sequence
  chemically synthesized
tacaaccccctagaaaaaca

SEQ ID NO: 468403 - DNA, 20 bp, Artificial Sequence
  chemically synthesized
agccatcctctgtttttcta

SEQ ID NO: 468404 - DNA, 20 bp, Artificial Sequence
  chemically synthesized
gggggttgtagggaggtgtc

SEQ ID NO: 468405 - DNA, 20 bp, Artificial Sequence
  chemically synthesized
tcatgaataagaacaattaa

SEQ ID NO: 468406 - DNA, 20 bp, Artificial Sequence
  chemically synthesized
aatttaataaatatctagtc

SEQ ID NO: 468407 - DNA, 20 bp, Artificial Sequence
  chemically synthesized
ttgagattgccccaagtcct

SEQ ID NO: 468408 - DNA, 20 bp, Artificial Sequence
  chemically synthesized
atgcacagagagggcatcta

SEQ ID NO: 468409 - DNA, 20 bp, Artificial Sequence
  chemically synthesized
agagggcatctaaagaattc

SEQ ID NO: 468410 - DNA, 20 bp, Artificial Sequence
  chemically synthesized
atttcctgttgagaaaaccc

SEQ ID NO: 468411 - DNA, 20 bp, Artificial Sequence
  chemically synthesized
taaaggctccttaagcaaca

SEQ ID NO: 468412 - DNA, 20 bp, Artificial Sequence
  chemically synthesized
ccttaagcaacactgaattc

SEQ ID NO: 468413 - DNA, 20 bp, Artificial Sequence
  chemically synthesized
tagatttgccttcgctaccc

SEQ ID NO: 468414 - DNA, 20 bp, Artificial Sequence
  chemically synthesized
attccaaagaaatgtctcca

SEQ ID NO: 468415 - DNA, 20 bp, Artificial Sequence
  chemically synthesized
actctgtggagacatttctt

SEQ ID NO: 468416 - DNA, 20 bp, Artificial Sequence
  chemically synthesized
cttgaccttcacgaaatgat

SEQ ID NO: 468417 - DNA, 20 bp, Artificial Sequence
  chemically synthesized
acaaagatttgcatcaaccc

SEQ ID NO: 468418 - DNA, 20 bp, Artificial Sequence
  chemically synthesized
gagctccaaaatgaggactc

SEQ ID NO: 468419 - DNA, 20 bp, Artificial Sequence
  chemically synthesized
aacaaaccatcccattcttg

SEQ ID NO: 468420 - DNA, 20 bp, Artificial Sequence
  chemically synthesized
ccaagaccattctccaagaa

SEQ ID NO: 468421 - DNA, 20 bp, Artificial Sequence
  chemically synthesized
gatatccaagaccattctcc

SEQ ID NO: 468422 - DNA, 20 bp, Artificial Sequence
  chemically synthesized
cccattcttggagaatggtc

SEQ ID NO: 468423 - DNA, 20 bp, Artificial Sequence
  chemically synthesized
gaatggtcttggatatcttc

SEQ ID NO: 468424 - DNA, 20 bp, Artificial Sequence
  chemically synthesized
tctatgaggactgagtgtcc

SEQ ID NO: 468425 - DNA, 20 bp, Artificial Sequence
  chemically synthesized
tgagggactatctatgagga

SEQ ID NO: 468426 - DNA, 20 bp, Artificial Sequence
  chemically synthesized
tcaagttaaggcacattctg

SEQ ID NO: 468427 - DNA, 20 bp, Artificial Sequence
  chemically synthesized
tagaattgcggcatattccc

SEQ ID NO: 468428 - DNA, 20 bp, Artificial Sequence
  chemically synthesized
ctctgtgaatgtcatttaca

SEQ ID NO: 468429 - DNA, 20 bp, Artificial Sequence
  chemically synthesized
ataaagaagagtaagtctct

SEQ ID NO: 468430 - DNA, 20 bp, Artificial Sequence
  chemically synthesized
ccttcaaccagataataaag

SEQ ID NO: 468431 - DNA, 20 bp, Artificial Sequence
  chemically synthesized
ctttattatctggttgaagg

SEQ ID NO: 468432 - DNA, 20 bp, Artificial Sequence
  chemically synthesized
tgaaggcagagttgcctatt

SEQ ID NO: 468433 - DNA, 20 bp, Artificial Sequence
  chemically synthesized
ctatttagagtcagaaaaat

SEQ ID NO: 468434 - DNA, 20 bp, Artificial Sequence
  chemically synthesized
ccagtcagccagtggtagaa

SEQ ID NO: 468435 - DNA, 20 bp, Artificial Sequence
  chemically synthesized
gaagagactgtcgcctttct

SEQ ID NO: 468436 - DNA, 20 bp, Artificial Sequence
  chemically synthesized
ttatttatcattttatcatt

SEQ ID NO: 468437 - DNA, 20 bp, Artificial Sequence
  chemically synthesized
cgggtcaaagaatgtttgta

SEQ ID NO: 468438 - DNA, 20 bp, Artificial Sequence
  chemically synthesized
ctttacaaacattctttgac

SEQ ID NO: 468439 - DNA, 20 bp, Artificial Sequence
  chemically synthesized
gtaccattgcacccgggtca

SEQ ID NO: 468440 - DNA, 20 bp, Artificial Sequence
  chemically synthesized
ctttctccgtaccattgcac

SEQ ID NO: 468441 - DNA, 20 bp, Artificial Sequence
  chemically synthesized
aatagaatttgatgttacca

SEQ ID NO: 468442 - DNA, 20 bp, Artificial Sequence
  chemically synthesized
gttggaactgacactgtaaa

SEQ ID NO: 468443 - DNA, 20 bp, Artificial Sequence
  chemically synthesized
tgtaggggtcaaagtcaaat

SEQ ID NO: 468444 - DNA, 20 bp, Artificial Sequence
  chemically synthesized
gttaaatctgtaattattgt

SEQ ID NO: 468445 - DNA, 20 bp, Artificial Sequence
  chemically synthesized
taattacagatttaacataa

SEQ ID NO: 468446 - DNA, 20 bp, Artificial Sequence
  chemically synthesized
gaaaacatttctactttatt

SEQ ID NO: 468447 - DNA, 20 bp, Artificial Sequence
  chemically synthesized
aaaaagttcaatattatctc

SEQ ID NO: 468448 - DNA, 20 bp, Artificial Sequence
  chemically synthesized
aaatacagcaagaacatcac

SEQ ID NO: 468449 - DNA, 20 bp, Artificial Sequence
  chemically synthesized
aggtttttagcaaacatttc

SEQ ID NO: 468450 - DNA, 20 bp, Artificial Sequence
  chemically synthesized
tccagagtacttagcatggt

SEQ ID NO: 468451 - DNA, 20 bp, Artificial Sequence
  chemically synthesized
aaaccatgctaagtactctg

SEQ ID NO: 468452 - DNA, 20 bp, Artificial Sequence
  chemically synthesized
ttaatcatcttcatatcctc

SEQ ID NO: 468453 - DNA, 20 bp, Artificial Sequence
  chemically synthesized
gataaaaaggaaaactgtca

SEQ ID NO: 468454 - DNA, 20 bp, Artificial Sequence
  chemically synthesized
agaaaggtccaaagtgctct

SEQ ID NO: 468455 - DNA, 20 bp, Artificial Sequence
  chemically synthesized
gacagatttcttccaactgc

SEQ ID NO: 468456 - DNA, 20 bp, Artificial Sequence
  chemically synthesized
ttattttgagcagtgtgatg

SEQ ID NO: 468457 - DNA, 20 bp, Artificial Sequence
  chemically synthesized
gcagtgtgatggaggatagg

SEQ ID NO: 468458 - DNA, 20 bp, Artificial Sequence
  chemically synthesized
accactgccgtatctgacaa

SEQ ID NO: 468459 - DNA, 20 bp, Artificial Sequence
  chemically synthesized
ctttgtcagatacggcagtg

SEQ ID NO: 468460 - DNA, 20 bp, Artificial Sequence
  chemically synthesized
ctttggggtcaagctcaagc

SEQ ID NO: 468461 - DNA, 20 bp, Artificial Sequence
  chemically synthesized
atcctgctctcatctacctt

SEQ ID NO: 468462 - DNA, 20 bp, Artificial Sequence
  chemically synthesized
accccaaaggtagatgagag

SEQ ID NO: 468463 - DNA, 20 bp, Artificial Sequence
  chemically synthesized
tgctgttgtagctagtattt

SEQ ID NO: 468464 - DNA, 20 bp, Artificial Sequence
  chemically synthesized
gcatagaaaaagcaagtcaa

SEQ ID NO: 468465 - DNA, 20 bp, Artificial Sequence
  chemically synthesized
aagtcaagagaatattgtgg

SEQ ID NO: 468466 - DNA, 20 bp, Artificial Sequence
  chemically synthesized
atgcagaaatccagtgaaag

SEQ ID NO: 468467 - DNA, 20 bp, Artificial Sequence
  chemically synthesized
atcatggcattcccctttca

SEQ ID NO: 468468 - DNA, 20 bp, Artificial Sequence
  chemically synthesized
agtgaaaggggaatgccatg

SEQ ID NO: 468469 - DNA, 20 bp, Artificial Sequence
  chemically synthesized
gttctggcaagatgtacaag

SEQ ID NO: 468470 - DNA, 20 bp, Artificial Sequence
  chemically synthesized
gtacaagtagagtcagtatg

SEQ ID NO: 468471 - DNA, 20 bp, Artificial Sequence
  chemically synthesized
cagtatggaggatttattgc

SEQ ID NO: 468472 - DNA, 20 bp, Artificial Sequence
  chemically synthesized
gtggcagcaggaagcaatgg

SEQ ID NO: 468473 - DNA, 20 bp, Artificial Sequence
  chemically synthesized
ccctcgggagtatgccactt

SEQ ID NO: 468474 - DNA, 20 bp, Artificial Sequence
  chemically synthesized
tgtctgagatcagtgccctc

SEQ ID NO: 468475 - DNA, 20 bp, Artificial Sequence
  chemically synthesized
agtagatgttgctcagattt

SEQ ID NO: 468476 - DNA, 20 bp, Artificial Sequence
  chemically synthesized
tcagacagatgccaccaagc

SEQ ID NO: 468477 - DNA, 20 bp, Artificial Sequence
  chemically synthesized
ctgtctgaagaaggcacatt

SEQ ID NO: 468478 - DNA, 20 bp, Artificial Sequence
  chemically synthesized
tctggggtactgtattgtgt

SEQ ID NO: 468479 - DNA, 20 bp, Artificial Sequence
  chemically synthesized
aggacaaagatgtaaacatc

SEQ ID NO: 468480 - DNA, 20 bp, Artificial Sequence
  chemically synthesized
gtcctccctgcagtcattat

SEQ ID NO: 468481 - DNA, 20 bp, Artificial Sequence
  chemically synthesized
tacaggtgatggctgacaat

SEQ ID NO: 468482 - DNA, 20 bp, Artificial Sequence
  chemically synthesized
acctcaaacatttaagaaag

SEQ ID NO: 468483 - DNA, 20 bp, Artificial Sequence
  chemically synthesized
tttgattttatatttcagaa

SEQ ID NO: 468484 - DNA, 20 bp, Artificial Sequence
  chemically synthesized
aaggctttgattttatattt

SEQ ID NO: 468485 - DNA, 20 bp, Artificial Sequence
  chemically synthesized
aactcatattttaggtgtga

SEQ ID NO: 468486 - DNA, 20 bp, Artificial Sequence
  chemically synthesized
aactccttcacacctaaaat

SEQ ID NO: 468487 - DNA, 20 bp, Artificial Sequence
  chemically synthesized
ttgttatctgaaagaagaca

SEQ ID NO: 468488 - DNA, 20 bp, Artificial Sequence
  chemically synthesized
acaaaaaaaaaaaagagaga

SEQ ID NO: 468489 - DNA, 20 bp, Artificial Sequence
  chemically synthesized
aagtgccaggaatcttcact

SEQ ID NO: 468490 - DNA, 20 bp, Artificial Sequence
  chemically synthesized
tgcacacatagaaaagtgcc

SEQ ID NO: 468491 - DNA, 20 bp, Artificial Sequence
  chemically synthesized
ctagctttgtcattggtatg

SEQ ID NO: 468492 - DNA, 20 bp, Artificial Sequence
  chemically synthesized
gatcttgaggaagaaaacag

SEQ ID NO: 468493 - DNA, 20 bp, Artificial Sequence
  chemically synthesized
ttttcttcctcaagatctgc

SEQ ID NO: 468494 - DNA, 20 bp, Artificial Sequence
  chemically synthesized
gaggaaagaggggagctaga

SEQ ID NO: 468495 - DNA, 20 bp, Artificial Sequence
  chemically synthesized
cccagatcttgatttcctta

SEQ ID NO: 468496 - DNA, 20 bp, Artificial Sequence
  chemically synthesized
actacgaggctggctcaggg

SEQ ID NO: 468497 - DNA, 20 bp, Artificial Sequence
  chemically synthesized
ttcaaactttggcagtaatg

SEQ ID NO: 468498 - DNA, 20 bp, Artificial Sequence
  chemically synthesized
tcccccccttattttgcttt

SEQ ID NO: 468499 - DNA, 20 bp, Artificial Sequence
  chemically synthesized
gctttgggggttagggactc

SEQ ID NO: 468500 - DNA, 20 bp, Artificial Sequence
  chemically synthesized
ttctattttcaaatacactc

SEQ ID NO: 468501 - DNA, 20 bp, Artificial Sequence
  chemically synthesized
acactttgaattggtaccag

SEQ ID NO: 468502 - DNA, 20 bp, Artificial Sequence
  chemically synthesized
aatctgagcaagaaaacact

SEQ ID NO: 468503 - DNA, 20 bp, Artificial Sequence
  chemically synthesized
aaattgattggcctatttac

SEQ ID NO: 468504 - DNA, 20 bp, Artificial Sequence
  chemically synthesized
ttacacggataaatgaaagg

SEQ ID NO: 468505 - DNA, 20 bp, Artificial Sequence
  chemically synthesized
gctattgactaacatcaacg

SEQ ID NO: 468506 - DNA, 20 bp, Artificial Sequence
  chemically synthesized
ctactcagtacaacaatagc

SEQ ID NO: 468507 - DNA, 20 bp, Artificial Sequence
  chemically synthesized
taacccacgctattgttgta

SEQ ID NO: 468508 - DNA, 20 bp, Artificial Sequence
  chemically synthesized
acttatataagtcattgagg

SEQ ID NO: 468509 - DNA, 20 bp, Artificial Sequence
  chemically synthesized
ttcttctgtctaaacaataa

SEQ ID NO: 468510 - DNA, 20 bp, Artificial Sequence
  chemically synthesized
gaacatctcattcctcgggg

SEQ ID NO: 468511 - DNA, 20 bp, Artificial Sequence
  chemically synthesized
tttaaaaaaactctgccccg

SEQ ID NO: 468512 - DNA, 20 bp, Artificial Sequence
  chemically synthesized
aaagtttgtcctgtgtatta

SEQ ID NO: 468513 - DNA, 20 bp, Artificial Sequence
  chemically synthesized
tacacaggacaaactttttt

SEQ ID NO: 468514 - DNA, 20 bp, Artificial Sequence
  chemically synthesized
cctgtttacctccaagttat

SEQ ID NO: 468515 - DNA, 20 bp, Artificial Sequence
  chemically synthesized
acttaagtgggtatggagag

SEQ ID NO: 468516 - DNA, 20 bp, Artificial Sequence
  chemically synthesized
tctgatatttttcaacttaa

SEQ ID NO: 468517 - DNA, 20 bp, Artificial Sequence
  chemically synthesized
taggaaaaagtccttctcat

SEQ ID NO: 468518 - DNA, 20 bp, Artificial Sequence
  chemically synthesized
aagctgactaaaaataatta

SEQ ID NO: 468519 - DNA, 20 bp, Artificial Sequence
  chemically synthesized
aggtttggggaagtggtttg

SEQ ID NO: 468520 - DNA, 20 bp, Artificial Sequence
  chemically synthesized
aaacctgcccctaaaatgcc

SEQ ID NO: 468521 - DNA, 20 bp, Artificial Sequence
  chemically synthesized
tgagtttttgccatccaaca

SEQ ID NO: 468522 - DNA, 20 bp, Artificial Sequence
  chemically synthesized
aaatccattttgactcaatg

SEQ ID NO: 468523 - DNA, 20 bp, Artificial Sequence
  chemically synthesized
ccatccaacattgagtcaaa

SEQ ID NO: 468524 - DNA, 20 bp, Artificial Sequence
  chemically synthesized
caaaatggattttatgtcct

SEQ ID NO: 468525 - DNA, 20 bp, Artificial Sequence
  chemically synthesized
gtacaacttcagaatttgga

SEQ ID NO: 468526 - DNA, 20 bp, Artificial Sequence
  chemically synthesized
agcagtacaacttcagaatt

SEQ ID NO: 468527 - DNA, 20 bp, Artificial Sequence
  chemically synthesized
aagttctagcagtacaactt

SEQ ID NO: 468528 - DNA, 20 bp, Artificial Sequence
  chemically synthesized
tcccatgtttaattataacc

SEQ ID NO: 468529 - DNA, 20 bp, Artificial Sequence
  chemically synthesized
cctgttctcttaggcagtca

SEQ ID NO: 468530 - DNA, 20 bp, Artificial Sequence
  chemically synthesized
cactgttacgtagatacaac

SEQ ID NO: 468531 - DNA, 20 bp, Artificial Sequence
  chemically synthesized
tagatacaactcgaattaat

SEQ ID NO: 468532 - DNA, 20 bp, Artificial Sequence
  chemically synthesized
tctagcacattcagattaat

SEQ ID NO: 468533 - DNA, 20 bp, Artificial Sequence
  chemically synthesized
aacagtaaaatgtgtggcca

SEQ ID NO: 468534 - DNA, 20 bp, Artificial Sequence
  chemically synthesized
taagtcatatacaaatgact

SEQ ID NO: 468535 - DNA, 20 bp, Artificial Sequence
  chemically synthesized
aaacgatcaagctaataata

SEQ ID NO: 468536 - DNA, 20 bp, Artificial Sequence
  chemically synthesized
taactagttattgaagacat

SEQ ID NO: 468537 - DNA, 20 bp, Artificial Sequence
  chemically synthesized
gatgagaaaagaaccttcat

SEQ ID NO: 468538 - DNA, 20 bp, Artificial Sequence
  chemically synthesized
tggagaatatagacaaaggg

SEQ ID NO: 468539 - DNA, 20 bp, Artificial Sequence
  chemically synthesized
ctttgtctatattctccaag

SEQ ID NO: 468540 - DNA, 20 bp, Artificial Sequence
  chemically synthesized
aggatatctcacccatcttg

SEQ ID NO: 468541 - DNA, 20 bp, Artificial Sequence
  chemically synthesized
cctttttagtttgataaagt

SEQ ID NO: 468542 - DNA, 20 bp, Artificial Sequence
  chemically synthesized
aaaaaataaggatttgccaa

SEQ ID NO: 468543 - DNA, 20 bp, Artificial Sequence
  chemically synthesized
gcaaatatgaaggaaaaaat

SEQ ID NO: 468544 - DNA, 20 bp, Artificial Sequence
  chemically synthesized
cagggaaacaggcttcatta

SEQ ID NO: 468545 - DNA, 20 bp, Artificial Sequence
  chemically synthesized
tctccgtccttaaagtttaa

SEQ ID NO: 468546 - DNA, 20 bp, Artificial Sequence
  chemically synthesized
ttcaggttgcaggttgttag

SEQ ID NO: 468547 - DNA, 20 bp, Artificial Sequence
  chemically synthesized
tcctgctaacaacctgcaac

SEQ ID NO: 468548 - DNA, 20 bp, Artificial Sequence
  chemically synthesized
taaagtgaggcaatcttatg

SEQ ID NO: 468549 - DNA, 20 bp, Artificial Sequence
  chemically synthesized
aatcacaaaaatctacttct

SEQ ID NO: 468550 - DNA, 20 bp, Artificial Sequence
  chemically synthesized
gcccaactaacctaccatat

SEQ ID NO: 468551 - DNA, 20 bp, Artificial Sequence
  chemically synthesized
agatcacgtttccactcccc

SEQ ID NO: 468552 - DNA, 20 bp, Artificial Sequence
  chemically synthesized
tactattttctccactcatg

SEQ ID NO: 468553 - DNA, 20 bp, Artificial Sequence
  chemically synthesized
ctgccagatatttaaaggga

SEQ ID NO: 468554 - DNA, 20 bp, Artificial Sequence
  chemically synthesized
caaacctgccagatatttaa

SEQ ID NO: 468555 - DNA, 20 bp, Artificial Sequence
  chemically synthesized
taccatatgattacaaattg

SEQ ID NO: 468556 - DNA, 20 bp, Artificial Sequence
  chemically synthesized
ggtatgaaataagttcaaat

SEQ ID NO: 468557 - DNA, 20 bp, Artificial Sequence
  chemically synthesized
ggcaaactatttttgctact

SEQ ID NO: 468558 - DNA, 20 bp, Artificial Sequence
  chemically synthesized
attctggcattattagtatt

SEQ ID NO: 468559 - DNA, 20 bp, Artificial Sequence
  chemically synthesized
actctgaatactaataatgc

SEQ ID NO: 468560 - DNA, 20 bp, Artificial Sequence
  chemically synthesized
aatactaataatgccagaat

SEQ ID NO: 468561 - DNA, 20 bp, Artificial Sequence
  chemically synthesized
taattcttaatgccctggca

SEQ ID NO: 468562 - DNA, 20 bp, Artificial Sequence
  chemically synthesized
tcattccatgccagggcatt

SEQ ID NO: 468563 - DNA, 20 bp, Artificial Sequence
  chemically synthesized
gaattaaaggaaaaaagtaa

SEQ ID NO: 468564 - DNA, 20 bp, Artificial Sequence
  chemically synthesized
atggctccttaaaagatcaa

SEQ ID NO: 468565 - DNA, 20 bp, Artificial Sequence
  chemically synthesized
ggtaggatagcacaggatat

SEQ ID NO: 468566 - DNA, 20 bp, Artificial Sequence
  chemically synthesized
gatttagaggtaggatagca

SEQ ID NO: 468567 - DNA, 20 bp, Artificial Sequence
  chemically synthesized
tgctttgagggatttagagg

SEQ ID NO: 468568 - DNA, 20 bp, Artificial Sequence
  chemically synthesized
ctgacaatgaaattgctttg

SEQ ID NO: 468569 - DNA, 20 bp, Artificial Sequence
  chemically synthesized
gaacattttgtaaaaagaga

SEQ ID NO: 468570 - DNA, 20 bp, Artificial Sequence
  chemically synthesized
agcagaaatggaaaacagca

SEQ ID NO: 468571 - DNA, 20 bp, Artificial Sequence
  chemically synthesized
ttaaaacttatgtgacgtct

SEQ ID NO: 468572 - DNA, 20 bp, Artificial Sequence
  chemically synthesized
caggaatgttcgattaggtc

SEQ ID NO: 468573 - DNA, 20 bp, Artificial Sequence
  chemically synthesized
tgatttatcctttagttttc

SEQ ID NO: 468574 - DNA, 20 bp, Artificial Sequence
  chemically synthesized
tcgaacattcctgaaaacta

SEQ ID NO: 468575 - DNA, 20 bp, Artificial Sequence
  chemically synthesized
aaatcatggcaagaagagaa

SEQ ID NO: 468576 - DNA, 20 bp, Artificial Sequence
  chemically synthesized
gaaaggaatccttcaaatta

SEQ ID NO: 468577 - DNA, 20 bp, Artificial Sequence
  chemically synthesized
cacacacatcctttaatttg

SEQ ID NO: 468578 - DNA, 20 bp, Artificial Sequence
  chemically synthesized
cagtgaaatataactttcct

SEQ ID NO: 468579 - DNA, 20 bp, Artificial Sequence
  chemically synthesized
acaaggggtagtgtaaggta

SEQ ID NO: 468580 - DNA, 20 bp, Artificial Sequence
  chemically synthesized
agtaattgtcctaaaagaca

SEQ ID NO: 468581 - DNA, 20 bp, Artificial Sequence
  chemically synthesized
tggtaaacatgtccagcagt

SEQ ID NO: 468582 - DNA, 20 bp, Artificial Sequence
  chemically synthesized
cagcagttagaatattgaca

SEQ ID NO: 468583 - DNA, 20 bp, Artificial Sequence
  chemically synthesized
agttagaatattgacaaagg

SEQ ID NO: 468584 - DNA, 20 bp, Artificial Sequence
  chemically synthesized
ttaaaggtaaaaattggtgg

SEQ ID NO: 468585 - DNA, 20 bp, Artificial Sequence
  chemically synthesized
tcacctcaggcaattataca

SEQ ID NO: 468586 - DNA, 20 bp, Artificial Sequence
  chemically synthesized
aaaaagttaaccaaactctt

SEQ ID NO: 468587 - DNA, 20 bp, Artificial Sequence
  chemically synthesized
tttatgcttgttaaatccgt

SEQ ID NO: 468588 - DNA, 20 bp, Artificial Sequence
  chemically synthesized
atgatttttatacctaaaaa

SEQ ID NO: 468589 - DNA, 20 bp, Artificial Sequence
  chemically synthesized
aaggtgagacagaaaagtcc

SEQ ID NO: 468590 - DNA, 20 bp, Artificial Sequence
  chemically synthesized
acatgatatgctgtaaagaa

SEQ ID NO: 468591 - DNA, 20 bp, Artificial Sequence
  chemically synthesized
aaatgatactatattatatg

SEQ ID NO: 468592 - DNA, 20 bp, Artificial Sequence
  chemically synthesized
atagtatcattttttcatat

SEQ ID NO: 468593 - DNA, 20 bp, Artificial Sequence
  chemically synthesized
taccggaaatgtttaaaagc

SEQ ID NO: 468594 - DNA, 20 bp, Artificial Sequence
  chemically synthesized
caccaacaagagcattagtc

SEQ ID NO: 468595 - DNA, 20 bp, Artificial Sequence
  chemically synthesized
tagagggcaagttgattagt

SEQ ID NO: 468596 - DNA, 20 bp, Artificial Sequence
  chemically synthesized
gctagcataatgttcaatgc

SEQ ID NO: 468597 - DNA, 20 bp, Artificial Sequence
  chemically synthesized
gcataatgttcaatgcgtga

SEQ ID NO: 468598 - DNA, 20 bp, Artificial Sequence
  chemically synthesized
ggtgggttttttctccatta

SEQ ID NO: 468599 - DNA, 20 bp, Artificial Sequence
  chemically synthesized
gtgtataacataactgtgtg

SEQ ID NO: 468600 - DNA, 20 bp, Artificial Sequence
  chemically synthesized
gttatgttatacacatggcc

SEQ ID NO: 468601 - DNA, 20 bp, Artificial Sequence
  chemically synthesized
aatgcttttattctaattct

SEQ ID NO: 468602 - DNA, 20 bp, Artificial Sequence
  chemically synthesized
gtatacattatccatagaat

SEQ ID NO: 468603 - DNA, 20 bp, Artificial Sequence
  chemically synthesized
ctaaatgtatacattatcca

SEQ ID NO: 468604 - DNA, 20 bp, Artificial Sequence
  chemically synthesized
ttatcaagtattttaaaatc

SEQ ID NO: 468605 - DNA, 20 bp, Artificial Sequence
  chemically synthesized
tgagaaatcatctctcaatc

SEQ ID NO: 468606 - DNA, 20 bp, Artificial Sequence
  chemically synthesized
cccccaaccttttctacgat

SEQ ID NO: 468607 - DNA, 20 bp, Artificial Sequence
  chemically synthesized
ctaacacaatttcggaatta

SEQ ID NO: 468608 - DNA, 20 bp, Artificial Sequence
  chemically synthesized
acatagggctaacacaattt

SEQ ID NO: 468609 - DNA, 20 bp, Artificial Sequence
  chemically synthesized
atttataggctatcttctta

SEQ ID NO: 468610 - DNA, 20 bp, Artificial Sequence
  chemically synthesized
agttttaagaagtcttgtac

SEQ ID NO: 468611 - DNA, 20 bp, Artificial Sequence
  chemically synthesized
gatcaagacatcttgataca

SEQ ID NO: 468612 - DNA, 20 bp, Artificial Sequence
  chemically synthesized
ttagtggtatagtcttgctg

SEQ ID NO: 468613 - DNA, 20 bp, Artificial Sequence
  chemically synthesized
cactaatttctagcacaaaa

SEQ ID NO: 468614 - DNA, 20 bp, Artificial Sequence
  chemically synthesized
tagcacaaaatagaatgacc

SEQ ID NO: 468615 - DNA, 20 bp, Artificial Sequence
  chemically synthesized
taaaacctcacaatataatc

SEQ ID NO: 468616 - DNA, 20 bp, Artificial Sequence
  chemically synthesized
tatattgtgaggttttaaaa

SEQ ID NO: 468617 - DNA, 20 bp, Artificial Sequence
  chemically synthesized
aataagaggagatcattagc

SEQ ID NO: 468618 - DNA, 20 bp, Artificial Sequence
  chemically synthesized
cttttcttatctccataggc

SEQ ID NO: 468619 - DNA, 20 bp, Artificial Sequence
  chemically synthesized
tccataggctagaattctgg

SEQ ID NO: 468620 - DNA, 20 bp, Artificial Sequence
  chemically synthesized
tgaaaaaatgttaaccctac

SEQ ID NO: 468621 - DNA, 20 bp, Artificial Sequence
  chemically synthesized
aattaatagatcagatatga

SEQ ID NO: 468622 - DNA, 20 bp, Artificial Sequence
  chemically synthesized
aaagatactataaaaacttc

SEQ ID NO: 468623 - DNA, 20 bp, Artificial Sequence
  chemically synthesized
tgaagtttttatagtatctt

SEQ ID NO: 468624 - DNA, 20 bp, Artificial Sequence
  chemically synthesized
cttggactttttcttttaat

SEQ ID NO: 468625 - DNA, 20 bp, Artificial Sequence
  chemically synthesized
aattacattatcgttgactt

SEQ ID NO: 468626 - DNA, 20 bp, Artificial Sequence
  chemically synthesized
gggctaaaccagggtcctct

SEQ ID NO: 468627 - DNA, 20 bp, Artificial Sequence
  chemically synthesized
acttggacactgggctaaac

SEQ ID NO: 468628 - DNA, 20 bp, Artificial Sequence
  chemically synthesized
gacttggttgaaacactaag

SEQ ID NO: 468629 - DNA, 20 bp, Artificial Sequence
  chemically synthesized
actgtagtatattaagaaat

SEQ ID NO: 468630 - DNA, 20 bp, Artificial Sequence
  chemically synthesized
atagcaaataactagggaaa

SEQ ID NO: 468631 - DNA, 20 bp, Artificial Sequence
  chemically synthesized
aagacctttctctctcaggg

SEQ ID NO: 468632 - DNA, 20 bp, Artificial Sequence
  chemically synthesized
gtaatcataatcaaattgaa

SEQ ID NO: 468633 - DNA, 20 bp, Artificial Sequence
  chemically synthesized
ctttggatctgcttattaaa

SEQ ID NO: 468634 - DNA, 20 bp, Artificial Sequence
  chemically synthesized
gaagtttcacatggaaatct

SEQ ID NO: 468635 - DNA, 20 bp, Artificial Sequence
  chemically synthesized
gaaacttcactatagttttg

SEQ ID NO: 468636 - DNA, 20 bp, Artificial Sequence
  chemically synthesized
tttctaataatgggctatgc

SEQ ID NO: 468637 - DNA, 20 bp, Artificial Sequence
  chemically synthesized
agatcaagataaattaatac

SEQ ID NO: 468638 - DNA, 20 bp, Artificial Sequence
  chemically synthesized
ttcattcttgtacacacttc

SEQ ID NO: 468639 - DNA, 20 bp, Artificial Sequence
  chemically synthesized
gctatcctggaagtgtgtac

SEQ ID NO: 468640 - DNA, 20 bp, Artificial Sequence
  chemically synthesized
taaaatggtattaaagtatt

SEQ ID NO: 468641 - DNA, 20 bp, Artificial Sequence
  chemically synthesized
gagctttaattctttgcctc

SEQ ID NO: 468642 - DNA, 20 bp, Artificial Sequence
  chemically synthesized
atggaattatccttgaggca

SEQ ID NO: 468643 - DNA, 20 bp, Artificial Sequence
  chemically synthesized
tattaataagaaaaataaca

SEQ ID NO: 468644 - DNA, 20 bp, Artificial Sequence
  chemically synthesized
aaccagaaaatgagccaaaa

SEQ ID NO: 468645 - DNA, 20 bp, Artificial Sequence
  chemically synthesized
aaagggagtactggtcagag

SEQ ID NO: 468646 - DNA, 20 bp, Artificial Sequence
  chemically synthesized
agatgaatcatttaaaaacc

SEQ ID NO: 468647 - DNA, 20 bp, Artificial Sequence
  chemically synthesized
acacaaaaccatatacccag

SEQ ID NO: 468648 - DNA, 20 bp, Artificial Sequence
  chemically synthesized
tcttatagtaagtaatcctt

SEQ ID NO: 468649 - DNA, 20 bp, Artificial Sequence
  chemically synthesized
ccagaaggattacttactat

SEQ ID NO: 468650 - DNA, 20 bp, Artificial Sequence
  chemically synthesized
gaaggtggtggtgggtggga

SEQ ID NO: 468651 - DNA, 20 bp, Artificial Sequence
  chemically synthesized
aaagagaaggtggtggtggg

SEQ ID NO: 468652 - DNA, 20 bp, Artificial Sequence
  chemically synthesized
tcataaaagagaaggtggtg

SEQ ID NO: 468653 - DNA, 20 bp, Artificial Sequence
  chemically synthesized
gaatgtcagcttttaattaa

SEQ ID NO: 468654 - DNA, 20 bp, Artificial Sequence
  chemically synthesized
gattctgcattgaaacctaa

SEQ ID NO: 468655 - DNA, 20 bp, Artificial Sequence
  chemically synthesized
cattcatttaggtttcaatg

SEQ ID NO: 468656 - DNA, 20 bp, Artificial Sequence
  chemically synthesized
tttcaatgcagaatcgctca

SEQ ID NO: 468657 - DNA, 20 bp, Artificial Sequence
  chemically synthesized
tatgacaaacacaagcaaat

SEQ ID NO: 468658 - DNA, 20 bp, Artificial Sequence
  chemically synthesized
gatccatttgatatggatca

SEQ ID NO: 468659 - DNA, 20 bp, Artificial Sequence
  chemically synthesized
aattctgtgatccatatcaa

SEQ ID NO: 468660 - DNA, 20 bp, Artificial Sequence
  chemically synthesized
caatatttgatccatttgat

SEQ ID NO: 468661 - DNA, 20 bp, Artificial Sequence
  chemically synthesized
atcaaatattgtaatcatca

SEQ ID NO: 468662 - DNA, 20 bp, Artificial Sequence
  chemically synthesized
ttaggacctggctcttatgc

SEQ ID NO: 468663 - DNA, 20 bp, Artificial Sequence
  chemically synthesized
acctggctcttatgcctgaa

SEQ ID NO: 468664 - DNA, 20 bp, Artificial Sequence
  chemically synthesized
tatacagtatttataatcct

SEQ ID NO: 468665 - DNA, 20 bp, Artificial Sequence
  chemically synthesized
gtatttaaagtatttattca

SEQ ID NO: 468666 - DNA, 20 bp, Artificial Sequence
  chemically synthesized
attaaaacttcccactattt

SEQ ID NO: 468667 - DNA, 20 bp, Artificial Sequence
  chemically synthesized
tcccaatttgcctttttatg

SEQ ID NO: 468668 - DNA, 20 bp, Artificial Sequence
  chemically synthesized
gtagcaccaaataataaaca

SEQ ID NO: 468669 - DNA, 20 bp, Artificial Sequence
  chemically synthesized
ttctttagcatatttgtcgt

SEQ ID NO: 468670 - DNA, 20 bp, Artificial Sequence
  chemically synthesized
ctatgtggaaataagtttaa

SEQ ID NO: 468671 - DNA, 20 bp, Artificial Sequence
  chemically synthesized
cggttaaacttatttccaca

SEQ ID NO: 468672 - DNA, 20 bp, Artificial Sequence
  chemically synthesized
gattggatcctgataaggga

SEQ ID NO: 468673 - DNA, 20 bp, Artificial Sequence
  chemically synthesized
gagtaaatccattcccttat

SEQ ID NO: 468674 - DNA, 20 bp, Artificial Sequence
  chemically synthesized
gcttgattggatcctgataa

SEQ ID NO: 468675 - DNA, 20 bp, Artificial Sequence
  chemically synthesized
acactacagtttcagcttga

SEQ ID NO: 468676 - DNA, 20 bp, Artificial Sequence
  chemically synthesized
tcataaataagaaactttta

SEQ ID NO: 468677 - DNA, 20 bp, Artificial Sequence
  chemically synthesized
taacttctataacagactac

SEQ ID NO: 468678 - DNA, 20 bp, Artificial Sequence
  chemically synthesized
catcatgcttaaagaactta

SEQ ID NO: 468679 - DNA, 20 bp, Artificial Sequence
  chemically synthesized
ataatatgcatttatcacga

SEQ ID NO: 468680 - DNA, 20 bp, Artificial Sequence
  chemically synthesized
tcacgacagggtttttaaaa

SEQ ID NO: 468681 - DNA, 20 bp, Artificial Sequence
  chemically synthesized
aaagatttaataaaaagaaa

SEQ ID NO: 468682 - DNA, 20 bp, Artificial Sequence
  chemically synthesized
ttcggaagataagcttgtgt

SEQ ID NO: 468683 - DNA, 20 bp, Artificial Sequence
  chemically synthesized
ttcttacacaagcttatctt

SEQ ID NO: 468684 - DNA, 20 bp, Artificial Sequence
  chemically synthesized
gaaaatcagacagctctgtt

SEQ ID NO: 468685 - DNA, 20 bp, Artificial Sequence
  chemically synthesized
tattttaaaactacattatg

SEQ ID NO: 468686 - DNA, 20 bp, Artificial Sequence
  chemically synthesized
agaaatcacaggccccaaaa

SEQ ID NO: 468687 - DNA, 20 bp, Artificial Sequence
  chemically synthesized
taccagcagatgatttatct

SEQ ID NO: 468688 - DNA, 20 bp, Artificial Sequence
  chemically synthesized
aatgtataattgtttatgag

SEQ ID NO: 468689 - DNA, 20 bp, Artificial Sequence
  chemically synthesized
agcttggagaggagagcaaa

SEQ ID NO: 468690 - DNA, 20 bp, Artificial Sequence
  chemically synthesized
tttgactaatcattatatac

SEQ ID NO: 468691 - DNA, 20 bp, Artificial Sequence
  chemically synthesized
aagtatgatgctgagtttgg

SEQ ID NO: 468692 - DNA, 20 bp, Artificial Sequence
  chemically synthesized
attcgttttaaagtatgatg

SEQ ID NO: 468693 - DNA, 20 bp, Artificial Sequence
  chemically synthesized
actcagcatcatactttaaa

SEQ ID NO: 468694 - DNA, 20 bp, Artificial Sequence
  chemically synthesized
agtggactattaaaaatcag

SEQ ID NO: 468695 - DNA, 20 bp, Artificial Sequence
  chemically synthesized
tcgatgctttttagaatctt

SEQ ID NO: 468696 - DNA, 20 bp, Artificial Sequence
  chemically synthesized
cctaaagattctaaaaagca

SEQ ID NO: 468697 - DNA, 20 bp, Artificial Sequence
  chemically synthesized
tcttgagattcgatgctttt

SEQ ID NO: 468698 - DNA, 20 bp, Artificial Sequence
  chemically synthesized
aatctcaagaaatatggcta

SEQ ID NO: 468699 - DNA, 20 bp, Artificial Sequence
  chemically synthesized
aatatataaacatgtctccc

SEQ ID NO: 468700 - DNA, 20 bp, Artificial Sequence
  chemically synthesized
attataatcaaagaagttat

SEQ ID NO: 468701 - DNA, 20 bp, Artificial Sequence
  chemically synthesized
ataacttctttgattataat

SEQ ID NO: 468702 - DNA, 20 bp, Artificial Sequence
  chemically synthesized
attataatttgaattcaagc

SEQ ID NO: 468703 - DNA, 20 bp, Artificial Sequence
  chemically synthesized
aaaccagcagaaatcctggc

SEQ ID NO: 468704 - DNA, 20 bp, Artificial Sequence
  chemically synthesized
aagccaggatttctgctggt

SEQ ID NO: 468705 - DNA, 20 bp, Artificial Sequence
  chemically synthesized
cacagatcaggagaatcaga

SEQ ID NO: 468706 - DNA, 20 bp, Artificial Sequence
  chemically synthesized
tctacacagatcaggagaat

SEQ ID NO: 468707 - DNA, 20 bp, Artificial Sequence
  chemically synthesized
gtaccatctacacagatcag

SEQ ID NO: 468708 - DNA, 20 bp, Artificial Sequence
  chemically synthesized
aaaaactgaaatgaaggaag

SEQ ID NO: 468709 - DNA, 20 bp, Artificial Sequence
  chemically synthesized
aacaaaagagaaccaagcga

SEQ ID NO: 468710 - DNA, 20 bp, Artificial Sequence
  chemically synthesized
cgtgagtactttttttgctg

SEQ ID NO: 468711 - DNA, 20 bp, Artificial Sequence
  chemically synthesized
cagcaaaaaaagtactcacg

SEQ ID NO: 468712 - DNA, 20 bp, Artificial Sequence
  chemically synthesized
ttctggccagtagattctgc

SEQ ID NO: 468713 - DNA, 20 bp, Artificial Sequence
  chemically synthesized
tctactggccagaagttgat

SEQ ID NO: 468714 - DNA, 20 bp, Artificial Sequence
  chemically synthesized
ttcagtaaatttttttgcgg

SEQ ID NO: 468715 - DNA, 20 bp, Artificial Sequence
  chemically synthesized
catggttcatacttaattgg

SEQ ID NO: 468716 - DNA, 20 bp, Artificial Sequence
  chemically synthesized
tagccaaaccaaggtgtaaa

SEQ ID NO: 468717 - DNA, 20 bp, Artificial Sequence
  chemically synthesized
cacagttgtgtgactgccat

SEQ ID NO: 468718 - DNA, 20 bp, Artificial Sequence
  chemically synthesized
aagacgtcccctttgatctt

SEQ ID NO: 468719 - DNA, 20 bp, Artificial Sequence
  chemically synthesized
tcctgtgactatattttctt

SEQ ID NO: 468720 - DNA, 20 bp, Artificial Sequence
  chemically synthesized
ggaaaatcaaaatgaaatac

SEQ ID NO: 468721 - DNA, 20 bp, Artificial Sequence
  chemically synthesized
aaatatgggactgtttacaa

SEQ ID NO: 468722 - DNA, 20 bp, Artificial Sequence
  chemically synthesized
agaagagactgtttgcattt

SEQ ID NO: 468723 - DNA, 20 bp, Artificial Sequence
  chemically synthesized
gtttgcatttgggagtgaag

SEQ ID NO: 468724 - DNA, 20 bp, Artificial Sequence
  chemically synthesized
aaggagggtgttcagctgag

SEQ ID NO: 468725 - DNA, 20 bp, Artificial Sequence
  chemically synthesized
agttcaaatatacatcaaac

SEQ ID NO: 468726 - DNA, 20 bp, Artificial Sequence
  chemically synthesized
gagggggacaacatggaaac

SEQ ID NO: 468727 - DNA, 20 bp, Artificial Sequence
  chemically synthesized
cactggcaggtagcccattc

SEQ ID NO: 468728 - DNA, 20 bp, Artificial Sequence
  chemically synthesized
aggtattttgcgaagcatcc

SEQ ID NO: 468729 - DNA, 20 bp, Artificial Sequence
  chemically synthesized
tggtgagatcagatttagga

SEQ ID NO: 468730 - DNA, 20 bp, Artificial Sequence
  chemically synthesized
agtgtcatggggcagaagac

SEQ ID NO: 468731 - DNA, 20 bp, Artificial Sequence
  chemically synthesized
acacttgttttgtaattaag

SEQ ID NO: 468732 - DNA, 20 bp, Artificial Sequence
  chemically synthesized
gtggttgtgagcaaaggctt

SEQ ID NO: 468733 - DNA, 20 bp, Artificial Sequence
  chemically synthesized
cctggcatgtactaatttgg

SEQ ID NO: 468734 - DNA, 20 bp, Artificial Sequence
  chemically synthesized
gacctataaactaccattta

SEQ ID NO: 468735 - DNA, 20 bp, Artificial Sequence
  chemically synthesized
tatgaatagaccgaaattta

SEQ ID NO: 468736 - DNA, 20 bp, Artificial Sequence
  chemically synthesized
gattgagaatgtaccatgct

SEQ ID NO: 468737 - DNA, 20 bp, Artificial Sequence
  chemically synthesized
tatagagatggtcagtgatt

SEQ ID NO: 468738 - DNA, 20 bp, Artificial Sequence
  chemically synthesized
tcactgaccatctctataag

SEQ ID NO: 468739 - DNA, 20 bp, Artificial Sequence
  chemically synthesized
tgagacaggcaaatatctgg

SEQ ID NO: 468740 - DNA, 20 bp, Artificial Sequence
  chemically synthesized
gcatctctctcttccatcat

SEQ ID NO: 468741 - DNA, 20 bp, Artificial Sequence
  chemically synthesized
gctgcagatctcgctaaaat

SEQ ID NO: 468742 - DNA, 20 bp, Artificial Sequence
  chemically synthesized
gggttttgatttagagcatc

SEQ ID NO: 468743 - DNA, 20 bp, Artificial Sequence
  chemically synthesized
attagtcaacagaccgtatc

SEQ ID NO: 468744 - DNA, 20 bp, Artificial Sequence
  chemically synthesized
tttagagaagaggagactgt

SEQ ID NO: 468745 - DNA, 20 bp, Artificial Sequence
  chemically synthesized
agaaagagaagagaaacacg

SEQ ID NO: 468746 - DNA, 20 bp, Artificial Sequence
  chemically synthesized
acctgagtacaaatctgcct

SEQ ID NO: 468747 - DNA, 20 bp, Artificial Sequence
  chemically synthesized
gacttggtggccagacagac

SEQ ID NO: 468748 - DNA, 20 bp, Artificial Sequence
  chemically synthesized
aaaatcactagggaaatggc

SEQ ID NO: 468749 - DNA, 20 bp, Artificial Sequence
  chemically synthesized
ttactcaaggttctataagt

SEQ ID NO: 468750 - DNA, 20 bp, Artificial Sequence
  chemically synthesized
caactcttacttatagaacc

SEQ ID NO: 468751 - DNA, 20 bp, Artificial Sequence
  chemically synthesized
attatttaacctcaggacct

SEQ ID NO: 468752 - DNA, 20 bp, Artificial Sequence
  chemically synthesized
agggtcctcatctgtataga

SEQ ID NO: 468753 - DNA, 20 bp, Artificial Sequence
  chemically synthesized
atcatagtacttattttaca

SEQ ID NO: 468754 - DNA, 20 bp, Artificial Sequence
  chemically synthesized
agtaagtgttagcatataaa

SEQ ID NO: 468755 - DNA, 20 bp, Artificial Sequence
  chemically synthesized
ttgattaaaagtggtagttt

SEQ ID NO: 468756 - DNA, 20 bp, Artificial Sequence
  chemically synthesized
catgaggcatgttgagtatg

SEQ ID NO: 468757 - DNA, 20 bp, Artificial Sequence
  chemically synthesized
tcttatggccatgaggcatg

SEQ ID NO: 468758 - DNA, 20 bp, Artificial Sequence
  chemically synthesized
cttcaatacaaccatgcaca

SEQ ID NO: 468759 - DNA, 20 bp, Artificial Sequence
  chemically synthesized
aatattgttggatgaataaa

SEQ ID NO: 468760 - DNA, 20 bp, Artificial Sequence
  chemically synthesized
ccctcaataaatattgttgg

SEQ ID NO: 468761 - DNA, 20 bp, Artificial Sequence
  chemically synthesized
tagaccctcaataaatattg

SEQ ID NO: 468762 - DNA, 20 bp, Artificial Sequence
  chemically synthesized
ttcatccaacaatatttatt

SEQ ID NO: 468763 - DNA, 20 bp, Artificial Sequence
  chemically synthesized
accctatccctggtgcctag

SEQ ID NO: 468764 - DNA, 20 bp, Artificial Sequence
  chemically synthesized
caggcactcccctaggcacc

SEQ ID NO: 468765 - DNA, 20 bp, Artificial Sequence
  chemically synthesized
actcccctaggcaccaggga

SEQ ID NO: 468766 - DNA, 20 bp, Artificial Sequence
  chemically synthesized
tggctctcaactgtaggctt

SEQ ID NO: 468767 - DNA, 20 bp, Artificial Sequence
  chemically synthesized
gacgtgagagttagttcacc

SEQ ID NO: 468768 - DNA, 20 bp, Artificial Sequence
  chemically synthesized
gtttgacgccagcctgacgt

SEQ ID NO: 468769 - DNA, 20 bp, Artificial Sequence
  chemically synthesized
caggctggcgtcaaacttac

SEQ ID NO: 468770 - DNA, 20 bp, Artificial Sequence
  chemically synthesized
cggagtgcaatattccacca

SEQ ID NO: 468771 - DNA, 20 bp, Artificial Sequence
  chemically synthesized
taaaatgcactatcccatgg

SEQ ID NO: 468772 - DNA, 20 bp, Artificial Sequence
  chemically synthesized
caaagctgctttttttctgg

SEQ ID NO: 468773 - DNA, 20 bp, Artificial Sequence
  chemically synthesized
ttttgctctttatcaggtac

SEQ ID NO: 468774 - DNA, 20 bp, Artificial Sequence
  chemically synthesized
acaaacacgtatgtatttct

SEQ ID NO: 468775 - DNA, 20 bp, Artificial Sequence
  chemically synthesized
tttattaaagagtgttcttt

SEQ ID NO: 468776 - DNA, 20 bp, Artificial Sequence
  chemically synthesized
acgtggtagaaggtttatta

SEQ ID NO: 468777 - DNA, 20 bp, Artificial Sequence
  chemically synthesized
tccctccttccatatgttta

SEQ ID NO: 468778 - DNA, 20 bp, Artificial Sequence
  chemically synthesized
tagtggagtttaaataaaag

SEQ ID NO: 468779 - DNA, 20 bp, Artificial Sequence
  chemically synthesized
taatctcaaagagttcctag

SEQ ID NO: 468780 - DNA, 20 bp, Artificial Sequence
  chemically synthesized
taccttcctacttaatctca

SEQ ID NO: 468781 - DNA, 20 bp, Artificial Sequence
  chemically synthesized
tcctggaagttcttttaaat

SEQ ID NO: 468782 - DNA, 20 bp, Artificial Sequence
  chemically synthesized
cagaaaacttttgtcccatg

SEQ ID NO: 468783 - DNA, 20 bp, Artificial Sequence
  chemically synthesized
attcgagtaactgtttgaag

SEQ ID NO: 468784 - DNA, 20 bp, Artificial Sequence
  chemically synthesized
attcatcttcaaacagttac

SEQ ID NO: 468785 - DNA, 20 bp, Artificial Sequence
  chemically synthesized
atagagataaaagagttcat

SEQ ID NO: 468786 - DNA, 20 bp, Artificial Sequence
  chemically synthesized
ttctgaagagatagagataa

SEQ ID NO: 468787 - DNA, 20 bp, Artificial Sequence
  chemically synthesized
cagttatcatttgtaggtaa

SEQ ID NO: 468788 - DNA, 20 bp, Artificial Sequence
  chemically synthesized
gccccaagagaacatgaaat

SEQ ID NO: 468789 - DNA, 20 bp, Artificial Sequence
  chemically synthesized
atgaaatttggattagatgg

SEQ ID NO: 468790 - DNA, 20 bp, Artificial Sequence
  chemically synthesized
tggtacatttcctccattat

SEQ ID NO: 468791 - DNA, 20 bp, Artificial Sequence
  chemically synthesized
aggcaggagagtatgaaaca

SEQ ID NO: 468792 - DNA, 20 bp, Artificial Sequence
  chemically synthesized
tctgagaaagcaaaaggcag

SEQ ID NO: 468793 - DNA, 20 bp, Artificial Sequence
  chemically synthesized
gacataagaaatatgtttat

SEQ ID NO: 468794 - DNA, 20 bp, Artificial Sequence
  chemically synthesized
tccccctcttgaaagatggc

SEQ ID NO: 468795 - DNA, 20 bp, Artificial Sequence
  chemically synthesized
tctttcaagagggggacagg

SEQ ID NO: 468796 - DNA, 20 bp, Artificial Sequence
  chemically synthesized
gacaggaggaatgagaagtg

SEQ ID NO: 468797 - DNA, 20 bp, Artificial Sequence
  chemically synthesized
atataatatgataagggcaa

SEQ ID NO: 468798 - DNA, 20 bp, Artificial Sequence
  chemically synthesized
taaagaagaagaatgccttg

SEQ ID NO: 468799 - DNA, 20 bp, Artificial Sequence
  chemically synthesized
atttttataaaataaagaag

SEQ ID NO: 468800 - DNA, 20 bp, Artificial Sequence
  chemically synthesized
aaaatgataccatgggggtg

SEQ ID NO: 468801 - DNA, 20 bp, Artificial Sequence
  chemically synthesized
gcaggtaaaaatgataccat

SEQ ID NO: 468802 - DNA, 20 bp, Artificial Sequence
  chemically synthesized
tgaagcctagatagacaaca

SEQ ID NO: 468803 - DNA, 20 bp, Artificial Sequence
  chemically synthesized
accaaaagtaaaaaagcact

SEQ ID NO: 468804 - DNA, 20 bp, Artificial Sequence
  chemically synthesized
cagttcacacgtaactggaa

SEQ ID NO: 468805 - DNA, 20 bp, Artificial Sequence
  chemically synthesized
agtgtttactttgctgctaa

SEQ ID NO: 468806 - DNA, 20 bp, Artificial Sequence
  chemically synthesized
ctctatggtctatgcctgtg

SEQ ID NO: 468807 - DNA, 20 bp, Artificial Sequence
  chemically synthesized
acatcaaggtttctatagtg

SEQ ID NO: 468808 - DNA, 20 bp, Artificial Sequence
  chemically synthesized
actgcgatgtccttaaatgt

SEQ ID NO: 468809 - DNA, 20 bp, Artificial Sequence
  chemically synthesized
atttaaggacatcgcagttt

SEQ ID NO: 468810 - DNA, 20 bp, Artificial Sequence
  chemically synthesized
ggacatcgcagtttcagaat

SEQ ID NO: 468811 - DNA, 20 bp, Artificial Sequence
  chemically synthesized
gcagtttcagaattaggatt

SEQ ID NO: 468812 - DNA, 20 bp, Artificial Sequence
  chemically synthesized
gagacaggatttttttttaa

SEQ ID NO: 468813 - DNA, 20 bp, Artificial Sequence
  chemically synthesized
tgctgacctgtttggggaga

SEQ ID NO: 468814 - DNA, 20 bp, Artificial Sequence
  chemically synthesized
ccatgatattttaagactat

SEQ ID NO: 468815 - DNA, 20 bp, Artificial Sequence
  chemically synthesized
ggttgttttttagctgcttt

SEQ ID NO: 468816 - DNA, 20 bp, Artificial Sequence
  chemically synthesized
gtatcccagtgaacttctaa

SEQ ID NO: 468817 - DNA, 20 bp, Artificial Sequence
  chemically synthesized
ttattcctttagaagttcac

SEQ ID NO: 468818 - DNA, 20 bp, Artificial Sequence
  chemically synthesized
gttcactgggatactataca

SEQ ID NO: 468819 - DNA, 20 bp, Artificial Sequence
  chemically synthesized
tagaacttgcttctttatct

SEQ ID NO: 468820 - DNA, 20 bp, Artificial Sequence
  chemically synthesized
ttttttctcccttaagtaac

SEQ ID NO: 468821 - DNA, 20 bp, Artificial Sequence
  chemically synthesized
agaaaaaaaaatggtgcaaa

SEQ ID NO: 468822 - DNA, 20 bp, Artificial Sequence
  chemically synthesized
gctactattatggttcctcc

SEQ ID NO: 468823 - DNA, 20 bp, Artificial Sequence
  chemically synthesized
tattatggttcctcccagaa

SEQ ID NO: 468824 - DNA, 20 bp, Artificial Sequence
  chemically synthesized
cctgtttatagaaacttccc

SEQ ID NO: 468825 - DNA, 20 bp, Artificial Sequence
  chemically synthesized
aatgtggctccgaagagctg

SEQ ID NO: 468826 - DNA, 20 bp, Artificial Sequence
  chemically synthesized
ctgatcgctaggttattttg

SEQ ID NO: 468827 - DNA, 20 bp, Artificial Sequence
  chemically synthesized
caaaataacctagcgatcag

SEQ ID NO: 468828 - DNA, 20 bp, Artificial Sequence
  chemically synthesized
ctagcgatcaggagggtgac

SEQ ID NO: 468829 - DNA, 20 bp, Artificial Sequence
  chemically synthesized
ttttttttggttcctaatac

SEQ ID NO: 468830 - DNA, 20 bp, Artificial Sequence
  chemically synthesized
ctgcaaagagtgtccaatca

SEQ ID NO: 468831 - DNA, 20 bp, Artificial Sequence
  chemically synthesized
ggccaaatgtaacatctgca

SEQ ID NO: 468832 - DNA, 20 bp, Artificial Sequence
  chemically synthesized
gtgtggctgcccgtcctgca

SEQ ID NO: 468833 - DNA, 20 bp, Artificial Sequence
  chemically synthesized
cgggcagccacaccatggac

SEQ ID NO: 468834 - DNA, 20 bp, Artificial Sequence
  chemically synthesized
gaagcggccctcttcctaga

SEQ ID NO: 468835 - DNA, 20 bp, Artificial Sequence
  chemically synthesized
gggagagagaaggagggcaa

SEQ ID NO: 468836 - DNA, 20 bp, Artificial Sequence
  chemically synthesized
ccttaggagtgggtagctct

SEQ ID NO: 468837 - DNA, 20 bp, Artificial Sequence
  chemically synthesized
agtttaccaaagccttagga

SEQ ID NO: 468838 - DNA, 20 bp, Artificial Sequence
  chemically synthesized
tggcagtttaccaaagcctt

SEQ ID NO: 468839 - DNA, 20 bp, Artificial Sequence
  chemically synthesized
cttgtcatctagtagccaaa

SEQ ID NO: 468840 - DNA, 20 bp, Artificial Sequence
  chemically synthesized
acaactgatttttttttcta

SEQ ID NO: 468841 - DNA, 20 bp, Artificial Sequence
  chemically synthesized
tctagagaatctgtttctca

SEQ ID NO: 468842 - DNA, 20 bp, Artificial Sequence
  chemically synthesized
agatgaggctttggaaccag

SEQ ID NO: 468843 - DNA, 20 bp, Artificial Sequence
  chemically synthesized
gctagcagcagagctgataa

SEQ ID NO: 468844 - DNA, 20 bp, Artificial Sequence
  chemically synthesized
acagcgctaagccaggaggt

SEQ ID NO: 468845 - DNA, 20 bp, Artificial Sequence
  chemically synthesized
gagagaaatagagaggcaga

SEQ ID NO: 468846 - DNA, 20 bp, Artificial Sequence
  chemically synthesized
agatcattgtcctgtctggg

SEQ ID NO: 468847 - DNA, 20 bp, Artificial Sequence
  chemically synthesized
gttgagatcattgtcctgtc

SEQ ID NO: 468848 - DNA, 20 bp, Artificial Sequence
  chemically synthesized
atttatatgttactatattc

SEQ ID NO: 468849 - DNA, 20 bp, Artificial Sequence
  chemically synthesized
acaaggtataattaaaattc

SEQ ID NO: 468850 - DNA, 20 bp, Artificial Sequence
  chemically synthesized
ccttgtttttttcaacccta

SEQ ID NO: 468851 - DNA, 20 bp, Artificial Sequence
  chemically synthesized
aaaaaattaaaacaatccta

SEQ ID NO: 468852 - DNA, 20 bp, Artificial Sequence
  chemically synthesized
ttcatctcaaatcttccatc

SEQ ID NO: 468853 - DNA, 20 bp, Artificial Sequence
  chemically synthesized
tctgcctgaaatatgtccct

SEQ ID NO: 468854 - DNA, 20 bp, Artificial Sequence
  chemically synthesized
tgaagataactatcaggaat

SEQ ID NO: 468855 - DNA, 20 bp, Artificial Sequence
  chemically synthesized
atttaatgaagataactatc

SEQ ID NO: 468856 - DNA, 20 bp, Artificial Sequence
  chemically synthesized
tccagcctgggcaatagaga

SEQ ID NO: 468857 - DNA, 20 bp, Artificial Sequence
  chemically synthesized
tctatctctattgcccaggc

SEQ ID NO: 468858 - DNA, 20 bp, Artificial Sequence
  chemically synthesized
gctcctgcaatctccgcctc

SEQ ID NO: 468859 - DNA, 20 bp, Artificial Sequence
  chemically synthesized
tacttgggaggctgaggcat

SEQ ID NO: 468860 - DNA, 20 bp, Artificial Sequence
  chemically synthesized
aaatacaaaaagtagccggg

SEQ ID NO: 468861 - DNA, 20 bp, Artificial Sequence
  chemically synthesized
actaaaaatacaaaaagtag

SEQ ID NO: 468862 - DNA, 20 bp, Artificial Sequence
  chemically synthesized
ttttgtatttttagtagaga

SEQ ID NO: 468863 - DNA, 20 bp, Artificial Sequence
  chemically synthesized
cgggtggatcattttaagtc

SEQ ID NO: 468864 - DNA, 20 bp, Artificial Sequence
  chemically synthesized
actttgggaggccgaggcgg

SEQ ID NO: 468865 - DNA, 20 bp, Artificial Sequence
  chemically synthesized
cagcactttgggaggccgag

SEQ ID NO: 468866 - DNA, 20 bp, Artificial Sequence
  chemically synthesized
gcctcggcctcccaaagtgc

SEQ ID NO: 468867 - DNA, 20 bp, Artificial Sequence
  chemically synthesized
aatttttgattgaaaggttt

SEQ ID NO: 468868 - DNA, 20 bp, Artificial Sequence
  chemically synthesized
gtcttgtttttattttgttt

SEQ ID NO: 468869 - DNA, 20 bp, Artificial Sequence
  chemically synthesized
gcaacagagatagacgaaag

SEQ ID NO: 468870 - DNA, 20 bp, Artificial Sequence
  chemically synthesized
agataccatctcacaccagt

SEQ ID NO: 468871 - DNA, 20 bp, Artificial Sequence
  chemically synthesized
aggaaacaacaggtgctgga

SEQ ID NO: 468872 - DNA, 20 bp, Artificial Sequence
  chemically synthesized
agtcagtgtggcgattcctc

SEQ ID NO: 468873 - DNA, 20 bp, Artificial Sequence
  chemically synthesized
tttctagttctagatccctg

SEQ ID NO: 468874 - DNA, 20 bp, Artificial Sequence
  chemically synthesized
tatacccagtaatgggatgg

SEQ ID NO: 468875 - DNA, 20 bp, Artificial Sequence
  chemically synthesized
ttgacccagccatcccatta

SEQ ID NO: 468876 - DNA, 20 bp, Artificial Sequence
  chemically synthesized
tttgggtatatacccagtaa

SEQ ID NO: 468877 - DNA, 20 bp, Artificial Sequence
  chemically synthesized
gcagcatgatttatagtcct

SEQ ID NO: 468878 - DNA, 20 bp, Artificial Sequence
  chemically synthesized
ggttccaagtctttgctatt

SEQ ID NO: 468879 - DNA, 20 bp, Artificial Sequence
  chemically synthesized
agtctatcattgttgggcat

SEQ ID NO: 468880 - DNA, 20 bp, Artificial Sequence
  chemically synthesized
aaatgcccaacaatgataga

SEQ ID NO: 468881 - DNA, 20 bp, Artificial Sequence
  chemically synthesized
aatgtggcacatatacacca

SEQ ID NO: 468882 - DNA, 20 bp, Artificial Sequence
  chemically synthesized
aatactatgcagccataaaa

SEQ ID NO: 468883 - DNA, 20 bp, Artificial Sequence
  chemically synthesized
ctatgcagccataaaaaagg

SEQ ID NO: 468884 - DNA, 20 bp, Artificial Sequence
  chemically synthesized
ttcatgtcctttgtagggac

SEQ ID NO: 468885 - DNA, 20 bp, Artificial Sequence
  chemically synthesized
tgtccttgcgatagtttact

SEQ ID NO: 468886 - DNA, 20 bp, Artificial Sequence
  chemically synthesized
gcatgttctcactcataggt

SEQ ID NO: 468887 - DNA, 20 bp, Artificial Sequence
  chemically synthesized
tcattgttccattcccacct

SEQ ID NO: 468888 - DNA, 20 bp, Artificial Sequence
  chemically synthesized
ccccaccccacaacagtccc

SEQ ID NO: 468889 - DNA, 20 bp, Artificial Sequence
  chemically synthesized
tcacactctggggactgttg

SEQ ID NO: 468890 - DNA, 20 bp, Artificial Sequence
  chemically synthesized
gtggggtggggggagggggg

SEQ ID NO: 468891 - DNA, 20 bp, Artificial Sequence
  chemically synthesized
gatatacctaatgctagatg

SEQ ID NO: 468892 - DNA, 20 bp, Artificial Sequence
  chemically synthesized
taatgctagatgacgagtta

SEQ ID NO: 468893 - DNA, 20 bp, Artificial Sequence
  chemically synthesized
ttttattatactttaagttt

SEQ ID NO: 468894 - DNA, 20 bp, Artificial Sequence
  chemically synthesized
tttctatcttgtgctgtttc

SEQ ID NO: 468895 - DNA, 20 bp, Artificial Sequence
  chemically synthesized
aggatttgatttagactgct

SEQ ID NO: 468896 - DNA, 20 bp, Artificial Sequence
  chemically synthesized
tcacaggtttaagaagtcca

SEQ ID NO: 468897 - DNA, 20 bp, Artificial Sequence
  chemically synthesized
gacttcttaaacctgtgatt

SEQ ID NO: 468898 - DNA, 20 bp, Artificial Sequence
  chemically synthesized
ttagagtctttaatcagctg

SEQ ID NO: 468899 - DNA, 20 bp, Artificial Sequence
  chemically synthesized
gaagaggcactatttgttga

SEQ ID NO: 468900 - DNA, 20 bp, Artificial Sequence
  chemically synthesized
ttctgaaagtagaatggaga

SEQ ID NO: 468901 - DNA, 20 bp, Artificial Sequence
  chemically synthesized
atgtaacagagttctgaaag

SEQ ID NO: 468902 - DNA, 20 bp, Artificial Sequence
  chemically synthesized
gaagagtaacatttatgtaa

SEQ ID NO: 468903 - DNA, 20 bp, Artificial Sequence
  chemically synthesized
cagagaaatatagattgaag

SEQ ID NO: 468904 - DNA, 20 bp, Artificial Sequence
  chemically synthesized
ttaataagaatgaagcacag

SEQ ID NO: 468905 - DNA, 20 bp, Artificial Sequence
  chemically synthesized
gtaaggcagaaggaattaat

SEQ ID NO: 468906 - DNA, 20 bp, Artificial Sequence
  chemically synthesized
tacccagacagtaaggcaga

SEQ ID NO: 468907 - DNA, 20 bp, Artificial Sequence
  chemically synthesized
aattccttctgccttactgt

SEQ ID NO: 468908 - DNA, 20 bp, Artificial Sequence
  chemically synthesized
acagcagaccggcaagagaa

SEQ ID NO: 468909 - DNA, 20 bp, Artificial Sequence
  chemically synthesized
taatcaaaatttaaaactgt

SEQ ID NO: 468910 - DNA, 20 bp, Artificial Sequence
  chemically synthesized
aataatctgtctaataattc

SEQ ID NO: 468911 - DNA, 20 bp, Artificial Sequence
  chemically synthesized
cctacgataacatcatattc

SEQ ID NO: 468912 - DNA, 20 bp, Artificial Sequence
  chemically synthesized
ggaaaaagaaagaaatcaag

SEQ ID NO: 468913 - DNA, 20 bp, Artificial Sequence
  chemically synthesized
gataaataaaagcttgagcc

SEQ ID NO: 468914 - DNA, 20 bp, Artificial Sequence
  chemically synthesized
ggttcttggcaaaagcaaag

SEQ ID NO: 468915 - DNA, 20 bp, Artificial Sequence
  chemically synthesized
tattcaactgaaattggctg

SEQ ID NO: 468916 - DNA, 20 bp, Artificial Sequence
  chemically synthesized
tattccacagccaatttcag

SEQ ID NO: 468917 - DNA, 20 bp, Artificial Sequence
  chemically synthesized
ttcagttgaatatatgacat

SEQ ID NO: 468918 - DNA, 20 bp, Artificial Sequence
  chemically synthesized
tacttagtatcacacaagtc

SEQ ID NO: 468919 - DNA, 20 bp, Artificial Sequence
  chemically synthesized
cctgcctttctatctgaaat

SEQ ID NO: 468920 - DNA, 20 bp, Artificial Sequence
  chemically synthesized
catttcagatagaaaggcag

SEQ ID NO: 468921 - DNA, 20 bp, Artificial Sequence
  chemically synthesized
ttagaattaggggtaatgac

SEQ ID NO: 468922 - DNA, 20 bp, Artificial Sequence
  chemically synthesized
gtgttgctaaatttagaatt

SEQ ID NO: 468923 - DNA, 20 bp, Artificial Sequence
  chemically synthesized
tattatagtgttgctaaatt

SEQ ID NO: 468924 - DNA, 20 bp, Artificial Sequence
  chemically synthesized
ctataataaactgtttaact

SEQ ID NO: 468925 - DNA, 20 bp, Artificial Sequence
  chemically synthesized
gctactgtttaccaaagacc

SEQ ID NO: 468926 - DNA, 20 bp, Artificial Sequence
  chemically synthesized
aaatgcccaccaatggaaga

SEQ ID NO: 468927 - DNA, 20 bp, Artificial Sequence
  chemically synthesized
aacgtggtacatatacaccc

SEQ ID NO: 468928 - DNA, 20 bp, Artificial Sequence
  chemically synthesized
tttctggctccggagtattc

SEQ ID NO: 468929 - DNA, 20 bp, Artificial Sequence
  chemically synthesized
ctcattcttttttctggctc

SEQ ID NO: 468930 - DNA, 20 bp, Artificial Sequence
  chemically synthesized
aatactccggagccagaaaa

SEQ ID NO: 468931 - DNA, 20 bp, Artificial Sequence
  chemically synthesized
atcatgttctttgcaggaac

SEQ ID NO: 468932 - DNA, 20 bp, Artificial Sequence
  chemically synthesized
tgttcctgcattagtttgct

SEQ ID NO: 468933 - DNA, 20 bp, Artificial Sequence
  chemically synthesized
gcatgttttcacttataagt

SEQ ID NO: 468934 - DNA, 20 bp, Artificial Sequence
  chemically synthesized
acacacactgtggcttatca

SEQ ID NO: 468935 - DNA, 20 bp, Artificial Sequence
  chemically synthesized
ctgtggcttatcagaggatg

SEQ ID NO: 468936 - DNA, 20 bp, Artificial Sequence
  chemically synthesized
gaagatcaggaaaataacta

SEQ ID NO: 468937 - DNA, 20 bp, Artificial Sequence
  chemically synthesized
atgggtattaggcttaatac

SEQ ID NO: 468938 - DNA, 20 bp, Artificial Sequence
  chemically synthesized
atgaggtaaacttgtgtcat

SEQ ID NO: 468939 - DNA, 20 bp, Artificial Sequence
  chemically synthesized
aaaatttaacttgtaagttc

SEQ ID NO: 468940 - DNA, 20 bp, Artificial Sequence
  chemically synthesized
gctgagcacttttctctgtg

SEQ ID NO: 468941 - DNA, 20 bp, Artificial Sequence
  chemically synthesized
tgtggaaaaaaaagtttata

SEQ ID NO: 468942 - DNA, 20 bp, Artificial Sequence
  chemically synthesized
tgtggtgccatgccaaaagg

SEQ ID NO: 468943 - DNA, 20 bp, Artificial Sequence
  chemically synthesized
gctctgtggtgccatgccaa

SEQ ID NO: 468944 - DNA, 20 bp, Artificial Sequence
  chemically synthesized
ccacagagctgtaagacttt

SEQ ID NO: 468945 - DNA, 20 bp, Artificial Sequence
  chemically synthesized
tgtaagactttcaggattca

SEQ ID NO: 468946 - DNA, 20 bp, Artificial Sequence
  chemically synthesized
gaatgctgagtttggactca

SEQ ID NO: 468947 - DNA, 20 bp, Artificial Sequence
  chemically synthesized
gagtccaaactcagcattca

SEQ ID NO: 468948 - DNA, 20 bp, Artificial Sequence
  chemically synthesized
gagtttggactcgatgaatg

SEQ ID NO: 468949 - DNA, 20 bp, Artificial Sequence
  chemically synthesized
tgggtaagagtttggactcg

SEQ ID NO: 468950 - DNA, 20 bp, Artificial Sequence
  chemically synthesized
aagcacacactggcatgggt

SEQ ID NO: 468951 - DNA, 20 bp, Artificial Sequence
  chemically synthesized
ggctgtaagcacacactggc

SEQ ID NO: 468952 - DNA, 20 bp, Artificial Sequence
  chemically synthesized
atgtttcccagctctctcac

SEQ ID NO: 468953 - DNA, 20 bp, Artificial Sequence
  chemically synthesized
ggtgttcaggatcaccttct

SEQ ID NO: 468954 - DNA, 20 bp, Artificial Sequence
  chemically synthesized
ggtatctggacacaggtgtt

SEQ ID NO: 468955 - DNA, 20 bp, Artificial Sequence
  chemically synthesized
tgtgatgcagcacttttgac

SEQ ID NO: 468956 - DNA, 20 bp, Artificial Sequence
  chemically synthesized
aacttctatatgctgtgctg

SEQ ID NO: 468957 - DNA, 20 bp, Artificial Sequence
  chemically synthesized
agcacagcatatagaagttc

SEQ ID NO: 468958 - DNA, 20 bp, Artificial Sequence
  chemically synthesized
aagttccagagttaaaccac

SEQ ID NO: 468959 - DNA, 20 bp, Artificial Sequence
  chemically synthesized
ttcctaaggtcacacagcca

SEQ ID NO: 468960 - DNA, 20 bp, Artificial Sequence
  chemically synthesized
tattaatagtgcctacctca

SEQ ID NO: 468961 - DNA, 20 bp, Artificial Sequence
  chemically synthesized
tagagttattttatgattac

SEQ ID NO: 468962 - DNA, 20 bp, Artificial Sequence
  chemically synthesized
aaccgtgtctgacacatagc

SEQ ID NO: 468963 - DNA, 20 bp, Artificial Sequence
  chemically synthesized
acttctgggttgctggtcag

SEQ ID NO: 468964 - DNA, 20 bp, Artificial Sequence
  chemically synthesized
tgttcaaagaccaagaactt

SEQ ID NO: 468965 - DNA, 20 bp, Artificial Sequence
  chemically synthesized
gaagaagaagtaaaaagaat

SEQ ID NO: 468966 - DNA, 20 bp, Artificial Sequence
  chemically synthesized
tcatatgaagaagaagtaaa

SEQ ID NO: 468967 - DNA, 20 bp, Artificial Sequence
  chemically synthesized
attctccgcaatcatatttg

SEQ ID NO: 468968 - DNA, 20 bp, Artificial Sequence
  chemically synthesized
attcttcaaatatgattgcg

SEQ ID NO: 468969 - DNA, 20 bp, Artificial Sequence
  chemically synthesized
tatttctccagacagtgtaa

SEQ ID NO: 468970 - DNA, 20 bp, Artificial Sequence
  chemically synthesized
cactgactcagagattttag

SEQ ID NO: 468971 - DNA, 20 bp, Artificial Sequence
  chemically synthesized
ttcctactcaactaaaatct

SEQ ID NO: 468972 - DNA, 20 bp, Artificial Sequence
  chemically synthesized
ttaatatgttaacgtgctct

SEQ ID NO: 468973 - DNA, 20 bp, Artificial Sequence
  chemically synthesized
agcaacatgttaatcagctc

SEQ ID NO: 468974 - DNA, 20 bp, Artificial Sequence
  chemically synthesized
ctctctctctctctctctct

SEQ ID NO: 468975 - DNA, 20 bp, Artificial Sequence
  chemically synthesized
gagagagagagagaacaagc

SEQ ID NO: 468976 - DNA, 20 bp, Artificial Sequence
  chemically synthesized
taataacagttttcaattat

SEQ ID NO: 468977 - DNA, 20 bp, Artificial Sequence
  chemically synthesized
aaacagacttaagcagcatg

SEQ ID NO: 468978 - DNA, 20 bp, Artificial Sequence
  chemically synthesized
ttaggctgtagctcatatgg

SEQ ID NO: 468979 - DNA, 20 bp, Artificial Sequence
  chemically synthesized
aaagttgttaaagcattagt

SEQ ID NO: 468980 - DNA, 20 bp, Artificial Sequence
  chemically synthesized
tgaattaccaagggaggctg

SEQ ID NO: 468981 - DNA, 20 bp, Artificial Sequence
  chemically synthesized
aagaatctatagttttttga

SEQ ID NO: 468982 - DNA, 20 bp, Artificial Sequence
  chemically synthesized
tgttcaacctttaagcatag

SEQ ID NO: 468983 - DNA, 20 bp, Artificial Sequence
  chemically synthesized
atcttaggggctagaaattt

SEQ ID NO: 468984 - DNA, 20 bp, Artificial Sequence
  chemically synthesized
gttttaaaagagccaacatg

SEQ ID NO: 468985 - DNA, 20 bp, Artificial Sequence
  chemically synthesized
acagactgaagacaaggtac

SEQ ID NO: 468986 - DNA, 20 bp, Artificial Sequence
  chemically synthesized
gattgaaacagaatgagaac

SEQ ID NO: 468987 - DNA, 20 bp, Artificial Sequence
  chemically synthesized
ataaaaatgaaagattgaaa

SEQ ID NO: 468988 - DNA, 20 bp, Artificial Sequence
  chemically synthesized
gggaatataccactaggata

SEQ ID NO: 468989 - DNA, 20 bp, Artificial Sequence
  chemically synthesized
aaggagagggaatataccac

SEQ ID NO: 468990 - DNA, 20 bp, Artificial Sequence
  chemically synthesized
cattgccagacaaaaggaga

SEQ ID NO: 468991 - DNA, 20 bp, Artificial Sequence
  chemically synthesized
tgtctggcaatgaagaagga

SEQ ID NO: 468992 - DNA, 20 bp, Artificial Sequence
  chemically synthesized
ctgtaaagacctaacagaac

SEQ ID NO: 468993 - DNA, 20 bp, Artificial Sequence
  chemically synthesized
tgatcgaaatgtaattttag

SEQ ID NO: 468994 - DNA, 20 bp, Artificial Sequence
  chemically synthesized
tatccctatatatttttttc

SEQ ID NO: 468995 - DNA, 20 bp, Artificial Sequence
  chemically synthesized
cattccagaaaaaaatatat

SEQ ID NO: 468996 - DNA, 20 bp, Artificial Sequence
  chemically synthesized
aaaaatatatagggatagat

SEQ ID NO: 468997 - DNA, 20 bp, Artificial Sequence
  chemically synthesized
acaaagattatctcagtcca

SEQ ID NO: 468998 - DNA, 20 bp, Artificial Sequence
  chemically synthesized
ggtcacccttgatactgaga

SEQ ID NO: 468999 - DNA, 20 bp, Artificial Sequence
  chemically synthesized
tataatcccctctcagtatc

SEQ ID NO: 469000 - DNA, 20 bp, Artificial Sequence
  chemically synthesized
cttggaaaggtcatttagcc

SEQ ID NO: 469001 - DNA, 20 bp, Artificial Sequence
  chemically synthesized
catgacatagaaggggaaaa

SEQ ID NO: 469002 - DNA, 20 bp, Artificial Sequence
  chemically synthesized
ccattatgatggtcacagtt

SEQ ID NO: 469003 - DNA, 20 bp, Artificial Sequence
  chemically synthesized
ggtcacagtttggaattatg

SEQ ID NO: 469004 - DNA, 20 bp, Artificial Sequence
  chemically synthesized
cttcccctagcttttctgtt

SEQ ID NO: 469005 - DNA, 20 bp, Artificial Sequence
  chemically synthesized
ataacagaaaagctagggga

SEQ ID NO: 469006 - DNA, 20 bp, Artificial Sequence
  chemically synthesized
tgctctgttacagcacactg

SEQ ID NO: 469007 - DNA, 20 bp, Artificial Sequence
  chemically synthesized
tataacaaggtacacagaca

SEQ ID NO: 469008 - DNA, 20 bp, Artificial Sequence
  chemically synthesized
gacaaagaattctcaatatc

SEQ ID NO: 469009 - DNA, 20 bp, Artificial Sequence
  chemically synthesized
tgctagaaattccagatatt

SEQ ID NO: 469010 - DNA, 20 bp, Artificial Sequence
  chemically synthesized
catggcaagtttggaggtag

SEQ ID NO: 469011 - DNA, 20 bp, Artificial Sequence
  chemically synthesized
tttggaggtaggagagttgc

SEQ ID NO: 469012 - DNA, 20 bp, Artificial Sequence
  chemically synthesized
gctggggttccgaagaactt

SEQ ID NO: 469013 - DNA, 20 bp, Artificial Sequence
  chemically synthesized
cggttggcccttcagtgtcc

SEQ ID NO: 469014 - DNA, 20 bp, Artificial Sequence
  chemically synthesized
ccgcctgccaggaggtccac

SEQ ID NO: 469015 - DNA, 20 bp, Artificial Sequence
  chemically synthesized
tttattaccttgagagaaaa

SEQ ID NO: 469016 - DNA, 20 bp, Artificial Sequence
  chemically synthesized
attgcatttcttctgtagcc

SEQ ID NO: 469017 - DNA, 20 bp, Artificial Sequence
  chemically synthesized
atgtacgtgttcatggtagc

SEQ ID NO: 469018 - DNA, 20 bp, Artificial Sequence
  chemically synthesized
gcaacccctagcatatactg

SEQ ID NO: 469019 - DNA, 20 bp, Artificial Sequence
  chemically synthesized
gtcatccctcagtatatgct

SEQ ID NO: 469020 - DNA, 20 bp, Artificial Sequence
  chemically synthesized
cgccgcagccccactcccac

SEQ ID NO: 469021 - DNA, 20 bp, Artificial Sequence
  chemically synthesized
ctcaacagcaaaatccccgt

SEQ ID NO: 469022 - DNA, 20 bp, Artificial Sequence
  chemically synthesized
actgtgggacttgcgtatgc

SEQ ID NO: 469023 - DNA, 20 bp, Artificial Sequence
  chemically synthesized
actcaagagatgtgaaacct

SEQ ID NO: 469024 - DNA, 20 bp, Artificial Sequence
  chemically synthesized
atccgcaggtttcacatctc

SEQ ID NO: 469025 - DNA, 20 bp, Artificial Sequence
  chemically synthesized
ctgtgtgggtccacttataa

SEQ ID NO: 469026 - DNA, 20 bp, Artificial Sequence
  chemically synthesized
aaaacatagatttgaactgt

SEQ ID NO: 469027 - DNA, 20 bp, Artificial Sequence
  chemically synthesized
agttcaaatctatgtttttc

SEQ ID NO: 469028 - DNA, 20 bp, Artificial Sequence
  chemically synthesized
ccaatgtttacttctctata

SEQ ID NO: 469029 - DNA, 20 bp, Artificial Sequence
  chemically synthesized
atggtggtttcttgttatct

SEQ ID NO: 469030 - DNA, 20 bp, Artificial Sequence
  chemically synthesized
gtatcgttctgtattgtttc

SEQ ID NO: 469031 - DNA, 20 bp, Artificial Sequence
  chemically synthesized
aaagacaggaactatacttc

SEQ ID NO: 469032 - DNA, 20 bp, Artificial Sequence
  chemically synthesized
ggagtctctgttaaaatctg

SEQ ID NO: 469033 - DNA, 20 bp, Artificial Sequence
  chemically synthesized
aaaatctgctgaattgaaca

SEQ ID NO: 469034 - DNA, 20 bp, Artificial Sequence
  chemically synthesized
tgctgaattgaacagtgggt

SEQ ID NO: 469035 - DNA, 20 bp, Artificial Sequence
  chemically synthesized
ttcttgcgatcatattgcag

SEQ ID NO: 469036 - DNA, 20 bp, Artificial Sequence
  chemically synthesized
ttataaaatctgtatgaagt

SEQ ID NO: 469037 - DNA, 20 bp, Artificial Sequence
  chemically synthesized
aagtgtatgtttttgctctt

SEQ ID NO: 469038 - DNA, 20 bp, Artificial Sequence
  chemically synthesized
ctggacttagaaggtatgta

SEQ ID NO: 469039 - DNA, 20 bp, Artificial Sequence
  chemically synthesized
tcctttcaagggccccaagt

SEQ ID NO: 469040 - DNA, 20 bp, Artificial Sequence
  chemically synthesized
aaacattgttatatttcctc

SEQ ID NO: 469041 - DNA, 20 bp, Artificial Sequence
  chemically synthesized
agaggaaatataacaatgtt

SEQ ID NO: 469042 - DNA, 20 bp, Artificial Sequence
  chemically synthesized
caaatatgttaaatttattt

SEQ ID NO: 469043 - DNA, 20 bp, Artificial Sequence
  chemically synthesized
tttattttggaattagaaat

SEQ ID NO: 469044 - DNA, 20 bp, Artificial Sequence
  chemically synthesized
gtctcctcttcagatgcatc

SEQ ID NO: 469045 - DNA, 20 bp, Artificial Sequence
  chemically synthesized
actggtgtcagtttattagt

SEQ ID NO: 469046 - DNA, 20 bp, Artificial Sequence
  chemically synthesized
cactgctgcagtcctaacag

SEQ ID NO: 469047 - DNA, 20 bp, Artificial Sequence
  chemically synthesized
ccagggcagcatgaaaggag

SEQ ID NO: 469048 - DNA, 20 bp, Artificial Sequence
  chemically synthesized
atgtctcccgtaaaagatac

SEQ ID NO: 469049 - DNA, 20 bp, Artificial Sequence
  chemically synthesized
ggggagggggagggcgggga

SEQ ID NO: 469050 - DNA, 20 bp, Artificial Sequence
  chemically synthesized
agcatttagtagatagaggc

SEQ ID NO: 469051 - DNA, 20 bp, Artificial Sequence
  chemically synthesized
gtgtgctgctggatgttttg

SEQ ID NO: 469052 - DNA, 20 bp, Artificial Sequence
  chemically synthesized
ggaagctgccctgtgtgctg

SEQ ID NO: 469053 - DNA, 20 bp, Artificial Sequence
  chemically synthesized
agcttcccacaacaaagaac

SEQ ID NO: 469054 - DNA, 20 bp, Artificial Sequence
  chemically synthesized
ggtgctactgatgctttggc

SEQ ID NO: 469055 - DNA, 20 bp, Artificial Sequence
  chemically synthesized
gtaagatgttaacattgggg

SEQ ID NO: 469056 - DNA, 20 bp, Artificial Sequence
  chemically synthesized
gtgaatagtgatgaatcaat

SEQ ID NO: 469057 - DNA, 20 bp, Artificial Sequence
  chemically synthesized
ctgttgtttagtgaatagtg

SEQ ID NO: 469058 - DNA, 20 bp, Artificial Sequence
  chemically synthesized
tcagggaagtctgttgttta

SEQ ID NO: 469059 - DNA, 20 bp, Artificial Sequence
  chemically synthesized
actaaacaacagacttccct

SEQ ID NO: 469060 - DNA, 20 bp, Artificial Sequence
  chemically synthesized
ctcccagtttctgtgttgta

SEQ ID NO: 469061 - DNA, 20 bp, Artificial Sequence
  chemically synthesized
cgagtgtggcatttcggcag

SEQ ID NO: 469062 - DNA, 20 bp, Artificial Sequence
  chemically synthesized
tctctaccctcagtttatga

SEQ ID NO: 469063 - DNA, 20 bp, Artificial Sequence
  chemically synthesized
gccacactcgttcataaact

SEQ ID NO: 469064 - DNA, 20 bp, Artificial Sequence
  chemically synthesized
gaagcaacttgatttcaaat

SEQ ID NO: 469065 - DNA, 20 bp, Artificial Sequence
  chemically synthesized
ttatcctggaatacactgca

SEQ ID NO: 469066 - DNA, 20 bp, Artificial Sequence
  chemically synthesized
caactctatgcagtgtattc

SEQ ID NO: 469067 - DNA, 20 bp, Artificial Sequence
  chemically synthesized
atttctgcaactgtttatcc

SEQ ID NO: 469068 - DNA, 20 bp, Artificial Sequence
  chemically synthesized
cagacctgctttaccttgct

SEQ ID NO: 469069 - DNA, 20 bp, Artificial Sequence
  chemically synthesized
aatacatacatatccataaa

SEQ ID NO: 469070 - DNA, 20 bp, Artificial Sequence
  chemically synthesized
aatgtttaggaattctattt

SEQ ID NO: 469071 - DNA, 20 bp, Artificial Sequence
  chemically synthesized
ttctgtcaataaaaatgttt

SEQ ID NO: 469072 - DNA, 20 bp, Artificial Sequence
  chemically synthesized
gcaaaccacagatttttaaa

SEQ ID NO: 469073 - DNA, 20 bp, Artificial Sequence
  chemically synthesized
gttataattcaagatgagat

SEQ ID NO: 469074 - DNA, 20 bp, Artificial Sequence
  chemically synthesized
gtccccacccaaatctcatc

SEQ ID NO: 469075 - DNA, 20 bp, Artificial Sequence
  chemically synthesized
ccacgacatgtgggaattgt

SEQ ID NO: 469076 - DNA, 20 bp, Artificial Sequence
  chemically synthesized
aggctcctcccacgacatgt

SEQ ID NO: 469077 - DNA, 20 bp, Artificial Sequence
  chemically synthesized
gtgggaggtgattgacttat

SEQ ID NO: 469078 - DNA, 20 bp, Artificial Sequence
  chemically synthesized
cctgcgccgttctcgtgata

SEQ ID NO: 469079 - DNA, 20 bp, Artificial Sequence
  chemically synthesized
cgccgttctcgtgatagtga

SEQ ID NO: 469080 - DNA, 20 bp, Artificial Sequence
  chemically synthesized
tatctgatggttttaaaaac

SEQ ID NO: 469081 - DNA, 20 bp, Artificial Sequence
  chemically synthesized
aggagcaagtcacaacttac

SEQ ID NO: 469082 - DNA, 20 bp, Artificial Sequence
  chemically synthesized
ggggcaatttacaaaagaga

SEQ ID NO: 469083 - DNA, 20 bp, Artificial Sequence
  chemically synthesized
aatgacattgaaatgatttt

SEQ ID NO: 469084 - DNA, 20 bp, Artificial Sequence
  chemically synthesized
tataacgagggctagaaaag

SEQ ID NO: 469085 - DNA, 20 bp, Artificial Sequence
  chemically synthesized
ttagcatttggaaagatttg

SEQ ID NO: 469086 - DNA, 20 bp, Artificial Sequence
  chemically synthesized
aaatttataaaaactgtttt

SEQ ID NO: 469087 - DNA, 20 bp, Artificial Sequence
  chemically synthesized
ctacaaggagaacggttagt

SEQ ID NO: 469088 - DNA, 20 bp, Artificial Sequence
  chemically synthesized
aaatctaccaagggcatcag

SEQ ID NO: 469089 - DNA, 20 bp, Artificial Sequence
  chemically synthesized
aggaacaagaacaagctgta

SEQ ID NO: 469090 - DNA, 20 bp, Artificial Sequence
  chemically synthesized
aaattgggattgtttggaag

SEQ ID NO: 469091 - DNA, 20 bp, Artificial Sequence
  chemically synthesized
catttgattttcataaaaat

SEQ ID NO: 469092 - DNA, 20 bp, Artificial Sequence
  chemically synthesized
ccaatttttatgaaaatcaa

SEQ ID NO: 469093 - DNA, 20 bp, Artificial Sequence
  chemically synthesized
gcaggttttgtatagtttta

SEQ ID NO: 469094 - DNA, 20 bp, Artificial Sequence
  chemically synthesized
cccaagtatcttgtgtctaa

SEQ ID NO: 469095 - DNA, 20 bp, Artificial Sequence
  chemically synthesized
tcctcttagacacaagatac

SEQ ID NO: 469096 - DNA, 20 bp, Artificial Sequence
  chemically synthesized
aagatacttgggttttacct

SEQ ID NO: 469097 - DNA, 20 bp, Artificial Sequence
  chemically synthesized
aactatagtgtacggacgca

SEQ ID NO: 469098 - DNA, 20 bp, Artificial Sequence
  chemically synthesized
cacatgagaccaagtgttct

SEQ ID NO: 469099 - DNA, 20 bp, Artificial Sequence
  chemically synthesized
atagaaaacagtcttgtaca

SEQ ID NO: 469100 - DNA, 20 bp, Artificial Sequence
  chemically synthesized
atatcttatagctctgatac

SEQ ID NO: 469101 - DNA, 20 bp, Artificial Sequence
  chemically synthesized
gcaaagtcttacctgatctt

SEQ ID NO: 469102 - DNA, 20 bp, Artificial Sequence
  chemically synthesized
ttataaaggccgaaagggaa

SEQ ID NO: 469103 - DNA, 20 bp, Artificial Sequence
  chemically synthesized
ggcctttataacatttagca

SEQ ID NO: 469104 - DNA, 20 bp, Artificial Sequence
  chemically synthesized
gcatagaatcaaagacactt

SEQ ID NO: 469105 - DNA, 20 bp, Artificial Sequence
  chemically synthesized
ttaaagattcaaaagatttt

SEQ ID NO: 469106 - DNA, 20 bp, Artificial Sequence
  chemically synthesized
aaggcgatccccaaaatctt

SEQ ID NO: 469107 - DNA, 20 bp, Artificial Sequence
  chemically synthesized
tttaatttgtttgaaagtac

SEQ ID NO: 469108 - DNA, 20 bp, Artificial Sequence
  chemically synthesized
ccacttaggacaatttccag

SEQ ID NO: 469109 - DNA, 20 bp, Artificial Sequence
  chemically synthesized
aggtgaatataaatcttcaa

SEQ ID NO: 469110 - DNA, 20 bp, Artificial Sequence
  chemically synthesized
agagccaatggaaggtgcaa

SEQ ID NO: 469111 - DNA, 20 bp, Artificial Sequence
  chemically synthesized
gtatgcatttatcagtgttg

SEQ ID NO: 469112 - DNA, 20 bp, Artificial Sequence
  chemically synthesized
atgctgaaaagaagggggaa

SEQ ID NO: 469113 - DNA, 20 bp, Artificial Sequence
  chemically synthesized
agctacctggactgacaggt

SEQ ID NO: 469114 - DNA, 20 bp, Artificial Sequence
  chemically synthesized
gtgctgaattgagaagctca

SEQ ID NO: 469115 - DNA, 20 bp, Artificial Sequence
  chemically synthesized
cacgtaacatgaaaactgtg

SEQ ID NO: 469116 - DNA, 20 bp, Artificial Sequence
  chemically synthesized
tcaatgtgttgttcccataa

SEQ ID NO: 469117 - DNA, 20 bp, Artificial Sequence
  chemically synthesized
ttgtttaaaatggcagtgta

SEQ ID NO: 469118 - DNA, 20 bp, Artificial Sequence
  chemically synthesized
attggatactatttttgtct

SEQ ID NO: 469119 - DNA, 20 bp, Artificial Sequence
  chemically synthesized
ctctctttactgaactgcca

SEQ ID NO: 469120 - DNA, 20 bp, Artificial Sequence
  chemically synthesized
aaggtggttctgagtgtaca

SEQ ID NO: 469121 - DNA, 20 bp, Artificial Sequence
  chemically synthesized
tttgtacactcagaaccacc

SEQ ID NO: 469122 - DNA, 20 bp, Artificial Sequence
  chemically synthesized
tgtggacatccaaggtggtt

SEQ ID NO: 469123 - DNA, 20 bp, Artificial Sequence
  chemically synthesized
ggatgtccacagtgatattc

SEQ ID NO: 469124 - DNA, 20 bp, Artificial Sequence
  chemically synthesized
tacctctcccccgtctattc

SEQ ID NO: 469125 - DNA, 20 bp, Artificial Sequence
  chemically synthesized
aatacatgcagaaagtatgg

SEQ ID NO: 469126 - DNA, 20 bp, Artificial Sequence
  chemically synthesized
tgcaaccaccaatattataa

SEQ ID NO: 469127 - DNA, 20 bp, Artificial Sequence
  chemically synthesized
atattataactgaattagac

SEQ ID NO: 469128 - DNA, 20 bp, Artificial Sequence
  chemically synthesized
accctatggttttagcattt

SEQ ID NO: 469129 - DNA, 20 bp, Artificial Sequence
  chemically synthesized
atccataaatgctaaaacca

SEQ ID NO: 469130 - DNA, 20 bp, Artificial Sequence
  chemically synthesized
aaccatagggtaaaaggtta

SEQ ID NO: 469131 - DNA, 20 bp, Artificial Sequence
  chemically synthesized
atagggtaaaaggttaagga

SEQ ID NO: 469132 - DNA, 20 bp, Artificial Sequence
  chemically synthesized
ctttctcattacaaagggaa

SEQ ID NO: 469133 - DNA, 20 bp, Artificial Sequence
  chemically synthesized
ttgttcctattggtatcact

SEQ ID NO: 469134 - DNA, 20 bp, Artificial Sequence
  chemically synthesized
aggaaaccatcagaaaagcc

SEQ ID NO: 469135 - DNA, 20 bp, Artificial Sequence
  chemically synthesized
agttcagaccagttctcttg

SEQ ID NO: 469136 - DNA, 20 bp, Artificial Sequence
  chemically synthesized
ggctgacgttgacatttttg

SEQ ID NO: 469137 - DNA, 20 bp, Artificial Sequence
  chemically synthesized
gcctcggcctcccaaagtac

SEQ ID NO: 469138 - DNA, 20 bp, Artificial Sequence
  chemically synthesized
actttgggaggccgaggcag

SEQ ID NO: 469139 - DNA, 20 bp, Artificial Sequence
  chemically synthesized
caggtggatcacctgaggtc

SEQ ID NO: 469140 - DNA, 20 bp, Artificial Sequence
  chemically synthesized
ttttgtatttttagtagaga

SEQ ID NO: 469141 - DNA, 20 bp, Artificial Sequence
  chemically synthesized
actaaaaatacaaaaatcag

SEQ ID NO: 469142 - DNA, 20 bp, Artificial Sequence
  chemically synthesized
acctcagcctcaggagtagc

SEQ ID NO: 469143 - DNA, 20 bp, Artificial Sequence
  chemically synthesized
tgactctccacctcagcctc

SEQ ID NO: 469144 - DNA, 20 bp, Artificial Sequence
  chemically synthesized
ctactcctgaggctgaggtg

SEQ ID NO: 469145 - DNA, 20 bp, Artificial Sequence
  chemically synthesized
ctcactgcaacctctgcttc

SEQ ID NO: 469146 - DNA, 20 bp, Artificial Sequence
  chemically synthesized
ttgcgccactgcactccagc

SEQ ID NO: 469147 - DNA, 20 bp, Artificial Sequence
  chemically synthesized
tctcgctctgtcacccaggc

SEQ ID NO: 469148 - DNA, 20 bp, Artificial Sequence
  chemically synthesized
tgacttttttggtaggggga

SEQ ID NO: 469149 - DNA, 20 bp, Artificial Sequence
  chemically synthesized
ctgaactttccccagtgccc

SEQ ID NO: 469150 - DNA, 20 bp, Artificial Sequence
  chemically synthesized
tcagtgtggactgcatatca

SEQ ID NO: 469151 - DNA, 20 bp, Artificial Sequence
  chemically synthesized
ctgcatatcagagggtattg

SEQ ID NO: 469152 - DNA, 20 bp, Artificial Sequence
  chemically synthesized
atagcattgcagttatgtta

SEQ ID NO: 469153 - DNA, 20 bp, Artificial Sequence
  chemically synthesized
caccatacaccattttctta

SEQ ID NO: 469154 - DNA, 20 bp, Artificial Sequence
  chemically synthesized
tggtgtatggtgaagtgttt

SEQ ID NO: 469155 - DNA, 20 bp, Artificial Sequence
  chemically synthesized
acatacataaacagagctga

SEQ ID NO: 469156 - DNA, 20 bp, Artificial Sequence
  chemically synthesized
aagtagagcgaaaagcaacc

SEQ ID NO: 469157 - DNA, 20 bp, Artificial Sequence
  chemically synthesized
tgaacagatgtatgacacag

SEQ ID NO: 469158 - DNA, 20 bp, Artificial Sequence
  chemically synthesized
caagcacaaagagtagttga

SEQ ID NO: 469159 - DNA, 20 bp, Artificial Sequence
  chemically synthesized
ttggaaacatttcaagcaca

SEQ ID NO: 469160 - DNA, 20 bp, Artificial Sequence
  chemically synthesized
ctcccaagtcaccccttcat

SEQ ID NO: 469161 - DNA, 20 bp, Artificial Sequence
  chemically synthesized
cccacaacctattcccatga

SEQ ID NO: 469162 - DNA, 20 bp, Artificial Sequence
  chemically synthesized
ataggttgtgggcaaggcag

SEQ ID NO: 469163 - DNA, 20 bp, Artificial Sequence
  chemically synthesized
ggcaaggcaggagggtgggc

SEQ ID NO: 469164 - DNA, 20 bp, Artificial Sequence
  chemically synthesized
tggtattaatgtcaatagta

SEQ ID NO: 469165 - DNA, 20 bp, Artificial Sequence
  chemically synthesized
aatgagtgtgaaaagttccc

SEQ ID NO: 469166 - DNA, 20 bp, Artificial Sequence
  chemically synthesized
ggtttgtatttttagagaaa

SEQ ID NO: 469167 - DNA, 20 bp, Artificial Sequence
  chemically synthesized
ctaggaaaagcacatctagg

SEQ ID NO: 469168 - DNA, 20 bp, Artificial Sequence
  chemically synthesized
cttttcctagatccctaaat

SEQ ID NO: 469169 - DNA, 20 bp, Artificial Sequence
  chemically synthesized
atgcctggagattcacattt

SEQ ID NO: 469170 - DNA, 20 bp, Artificial Sequence
  chemically synthesized
gtgaatctccaggcatgaaa

SEQ ID NO: 469171 - DNA, 20 bp, Artificial Sequence
  chemically synthesized
ccaggcatgaaaatgagttt

SEQ ID NO: 469172 - DNA, 20 bp, Artificial Sequence
  chemically synthesized
agaagcagaactttttgttt

SEQ ID NO: 469173 - DNA, 20 bp, Artificial Sequence
  chemically synthesized
tgtttaaggattgagaggtc

SEQ ID NO: 469174 - DNA, 20 bp, Artificial Sequence
  chemically synthesized
ggcttcccataactaccatc

SEQ ID NO: 469175 - DNA, 20 bp, Artificial Sequence
  chemically synthesized
tctaaatattaatcaggact

SEQ ID NO: 469176 - DNA, 20 bp, Artificial Sequence
  chemically synthesized
tttatctttaatgggtgatt

SEQ ID NO: 469177 - DNA, 20 bp, Artificial Sequence
  chemically synthesized
ttgggctgattttatcttta

SEQ ID NO: 469178 - DNA, 20 bp, Artificial Sequence
  chemically synthesized
cttgaacatggaaatgaaga

SEQ ID NO: 469179 - DNA, 20 bp, Artificial Sequence
  chemically synthesized
tgtccttgaacatggaaatg

SEQ ID NO: 469180 - DNA, 20 bp, Artificial Sequence
  chemically synthesized
taattggtttattagtcagg

SEQ ID NO: 469181 - DNA, 20 bp, Artificial Sequence
  chemically synthesized
taatactgttgagtatactt

SEQ ID NO: 469182 - DNA, 20 bp, Artificial Sequence
  chemically synthesized
ggtagcataaattaatactg

SEQ ID NO: 469183 - DNA, 20 bp, Artificial Sequence
  chemically synthesized
aacagtattaatttatgcta

SEQ ID NO: 469184 - DNA, 20 bp, Artificial Sequence
  chemically synthesized
atatctgtctataggtacca

SEQ ID NO: 469185 - DNA, 20 bp, Artificial Sequence
  chemically synthesized
tggaatatactttcccaagt

SEQ ID NO: 469186 - DNA, 20 bp, Artificial Sequence
  chemically synthesized
ttttcctgaactggatttta

SEQ ID NO: 469187 - DNA, 20 bp, Artificial Sequence
  chemically synthesized
taattttgccttttcctgaa

SEQ ID NO: 469188 - DNA, 20 bp, Artificial Sequence
  chemically synthesized
agtgagatgatacagcatga

SEQ ID NO: 469189 - DNA, 20 bp, Artificial Sequence
  chemically synthesized
atacagcatgatggaatttt

SEQ ID NO: 469190 - DNA, 20 bp, Artificial Sequence
  chemically synthesized
ggaaggaaggaaggaaaaga

SEQ ID NO: 469191 - DNA, 20 bp, Artificial Sequence
  chemically synthesized
acaatgaagtgctactttag

SEQ ID NO: 469192 - DNA, 20 bp, Artificial Sequence
  chemically synthesized
gtaatggatgttttcttcac

SEQ ID NO: 469193 - DNA, 20 bp, Artificial Sequence
  chemically synthesized
ttaacttctctattggagta

SEQ ID NO: 469194 - DNA, 20 bp, Artificial Sequence
  chemically synthesized
tgtttgattaacttctctat

SEQ ID NO: 469195 - DNA, 20 bp, Artificial Sequence
  chemically synthesized
tttaaaaattttaagctacc

SEQ ID NO: 469196 - DNA, 20 bp, Artificial Sequence
  chemically synthesized
aatactgataatactctgat

SEQ ID NO: 469197 - DNA, 20 bp, Artificial Sequence
  chemically synthesized
ttttcagaaaagacccttat

SEQ ID NO: 469198 - DNA, 20 bp, Artificial Sequence
  chemically synthesized
gggtcttttctgaaaattgc

SEQ ID NO: 469199 - DNA, 20 bp, Artificial Sequence
  chemically synthesized
tggaaggctgattggactat

SEQ ID NO: 469200 - DNA, 20 bp, Artificial Sequence
  chemically synthesized
tataaagaggtggcctttcc

SEQ ID NO: 469201 - DNA, 20 bp, Artificial Sequence
  chemically synthesized
ctagtaactaagtaattagt

SEQ ID NO: 469202 - DNA, 20 bp, Artificial Sequence
  chemically synthesized
tactaattacttagttacta

SEQ ID NO: 469203 - DNA, 20 bp, Artificial Sequence
  chemically synthesized
tttacaccccttttggacgg

SEQ ID NO: 469204 - DNA, 20 bp, Artificial Sequence
  chemically synthesized
tgagtattcatccgtccaaa

SEQ ID NO: 469205 - DNA, 20 bp, Artificial Sequence
  chemically synthesized
tccttttacaccccttttgg

SEQ ID NO: 469206 - DNA, 20 bp, Artificial Sequence
  chemically synthesized
ccgtccaaaaggggtgtaaa

SEQ ID NO: 469207 - DNA, 20 bp, Artificial Sequence
  chemically synthesized
caaaggaaacctaagtgaag

SEQ ID NO: 469208 - DNA, 20 bp, Artificial Sequence
  chemically synthesized
ctaagtgaaggagggttttt

SEQ ID NO: 469209 - DNA, 20 bp, Artificial Sequence
  chemically synthesized
gggtttttaggagttacttt

SEQ ID NO: 469210 - DNA, 20 bp, Artificial Sequence
  chemically synthesized
tggaaaatctattaataaaa

SEQ ID NO: 469211 - DNA, 20 bp, Artificial Sequence
  chemically synthesized
acctcagcctcccaaagtgc

SEQ ID NO: 469212 - DNA, 20 bp, Artificial Sequence
  chemically synthesized
actttgggaggctgaggtgg

SEQ ID NO: 469213 - DNA, 20 bp, Artificial Sequence
  chemically synthesized
gaaggtttcaccatgttggc

SEQ ID NO: 469214 - DNA, 20 bp, Artificial Sequence
  chemically synthesized
tacttgggaggctgaggcag

SEQ ID NO: 469215 - DNA, 20 bp, Artificial Sequence
  chemically synthesized
gtctcgctctgttgccaggc

SEQ ID NO: 469216 - DNA, 20 bp, Artificial Sequence
  chemically synthesized
ttttttttttttttttgaga

SEQ ID NO: 469217 - DNA, 20 bp, Artificial Sequence
  chemically synthesized
aaaagtaatcagttgacccg

SEQ ID NO: 469218 - DNA, 20 bp, Artificial Sequence
  chemically synthesized
ggctggttagacagcattcc

SEQ ID NO: 469219 - DNA, 20 bp, Artificial Sequence
  chemically synthesized
ttttaacatttgcagagaaa

SEQ ID NO: 469220 - DNA, 20 bp, Artificial Sequence
  chemically synthesized
ttgcagagaaacagaatctc

SEQ ID NO: 469221 - DNA, 20 bp, Artificial Sequence
  chemically synthesized
tctataacaaaacatcatct

SEQ ID NO: 469222 - DNA, 20 bp, Artificial Sequence
  chemically synthesized
aaagcaactgttaacattgg

SEQ ID NO: 469223 - DNA, 20 bp, Artificial Sequence
  chemically synthesized
ggatacatagaaggtgccca

SEQ ID NO: 469224 - DNA, 20 bp, Artificial Sequence
  chemically synthesized
caaagcacttaagagctgta

SEQ ID NO: 469225 - DNA, 20 bp, Artificial Sequence
  chemically synthesized
gaactcctggaggtgattgt

SEQ ID NO: 469226 - DNA, 20 bp, Artificial Sequence
  chemically synthesized
taatcctcacaatcacctcc

SEQ ID NO: 469227 - DNA, 20 bp, Artificial Sequence
  chemically synthesized
gctttgaaaccgaactgtgc

SEQ ID NO: 469228 - DNA, 20 bp, Artificial Sequence
  chemically synthesized
atatctggagaagtgactgg

SEQ ID NO: 469229 - DNA, 20 bp, Artificial Sequence
  chemically synthesized
agtcacttctccagatattc

SEQ ID NO: 469230 - DNA, 20 bp, Artificial Sequence
  chemically synthesized
acataaatgagaaagcattc

SEQ ID NO: 469231 - DNA, 20 bp, Artificial Sequence
  chemically synthesized
tactcaggagactgaggtgg

SEQ ID NO: 469232 - DNA, 20 bp, Artificial Sequence
  chemically synthesized
gatcctcccacctcagtctc

SEQ ID NO: 469233 - DNA, 20 bp, Artificial Sequence
  chemically synthesized
gtatatttcaaaataactaa

SEQ ID NO: 469234 - DNA, 20 bp, Artificial Sequence
  chemically synthesized
tttcaaaataactaaaagag

SEQ ID NO: 469235 - DNA, 20 bp, Artificial Sequence
  chemically synthesized
ataactaaaagagtagaatt

SEQ ID NO: 469236 - DNA, 20 bp, Artificial Sequence
  chemically synthesized
atgtagaatgatatgaaaat

SEQ ID NO: 469237 - DNA, 20 bp, Artificial Sequence
  chemically synthesized
gcacagttgttgtaataatg

SEQ ID NO: 469238 - DNA, 20 bp, Artificial Sequence
  chemically synthesized
tctctatttgtatgacaaaa

SEQ ID NO: 469239 - DNA, 20 bp, Artificial Sequence
  chemically synthesized
gttgcttttccatctatctt

SEQ ID NO: 469240 - DNA, 20 bp, Artificial Sequence
  chemically synthesized
ggaaaagcaacttactcatt

SEQ ID NO: 469241 - DNA, 20 bp, Artificial Sequence
  chemically synthesized
tgttgtacttagtattccaa

SEQ ID NO: 469242 - DNA, 20 bp, Artificial Sequence
  chemically synthesized
tatgcttcacctatgagagc

SEQ ID NO: 469243 - DNA, 20 bp, Artificial Sequence
  chemically synthesized
gctctcataggtgaagcata

SEQ ID NO: 469244 - DNA, 20 bp, Artificial Sequence
  chemically synthesized
aacaatgctgcagtcaacat

SEQ ID NO: 469245 - DNA, 20 bp, Artificial Sequence
  chemically synthesized
tgttcacaatagccaagata

SEQ ID NO: 469246 - DNA, 20 bp, Artificial Sequence
  chemically synthesized
atcaacctaagcgcccatca

SEQ ID NO: 469247 - DNA, 20 bp, Artificial Sequence
  chemically synthesized
acctaagcgcccatcagtgg

SEQ ID NO: 469248 - DNA, 20 bp, Artificial Sequence
  chemically synthesized
aatgtactataaacacataa

SEQ ID NO: 469249 - DNA, 20 bp, Artificial Sequence
  chemically synthesized
tgggatttcattttttatgg

SEQ ID NO: 469250 - DNA, 20 bp, Artificial Sequence
  chemically synthesized
gtacatgttgctgcaaataa

SEQ ID NO: 469251 - DNA, 20 bp, Artificial Sequence
  chemically synthesized
cccacacatgagtgagaaca

SEQ ID NO: 469252 - DNA, 20 bp, Artificial Sequence
  chemically synthesized
tttttttttagctcccacac

SEQ ID NO: 469253 - DNA, 20 bp, Artificial Sequence
  chemically synthesized
aaaaattgaactcatggaga

SEQ ID NO: 469254 - DNA, 20 bp, Artificial Sequence
  chemically synthesized
catgattttactctatctcc

SEQ ID NO: 469255 - DNA, 20 bp, Artificial Sequence
  chemically synthesized
tagagtaaaatcatgactac

SEQ ID NO: 469256 - DNA, 20 bp, Artificial Sequence
  chemically synthesized
gggaaatgtagtgaagatcg

SEQ ID NO: 469257 - DNA, 20 bp, Artificial Sequence
  chemically synthesized
tgaagatcgggggataaaaa

SEQ ID NO: 469258 - DNA, 20 bp, Artificial Sequence
  chemically synthesized
ggataaaaaagggatggtta

SEQ ID NO: 469259 - DNA, 20 bp, Artificial Sequence
  chemically synthesized
tttttaaatctttttacaga

SEQ ID NO: 469260 - DNA, 20 bp, Artificial Sequence
  chemically synthesized
tctcactatgctgtccatgt

SEQ ID NO: 469261 - DNA, 20 bp, Artificial Sequence
  chemically synthesized
aatgcacaacaattgcacct

SEQ ID NO: 469262 - DNA, 20 bp, Artificial Sequence
  chemically synthesized
aattgttgtgcattacagcc

SEQ ID NO: 469263 - DNA, 20 bp, Artificial Sequence
  chemically synthesized
tgggaggatcacttgcgccc

SEQ ID NO: 469264 - DNA, 20 bp, Artificial Sequence
  chemically synthesized
gtttcaggaggctgaggtgg

SEQ ID NO: 469265 - DNA, 20 bp, Artificial Sequence
  chemically synthesized
gtatatttcaaaataactaa

SEQ ID NO: 469266 - DNA, 20 bp, Artificial Sequence
  chemically synthesized
aataactaaaagagtgaaat

SEQ ID NO: 469267 - DNA, 20 bp, Artificial Sequence
  chemically synthesized
atgttcctaccagagaaatg

SEQ ID NO: 469268 - DNA, 20 bp, Artificial Sequence
  chemically synthesized
ggtaacacaatcagagtaat

SEQ ID NO: 469269 - DNA, 20 bp, Artificial Sequence
  chemically synthesized
aatgtgtagggtaacacaat

SEQ ID NO: 469270 - DNA, 20 bp, Artificial Sequence
  chemically synthesized
tgatacaagcatacaatgtg

SEQ ID NO: 469271 - DNA, 20 bp, Artificial Sequence
  chemically synthesized
atatcacatgtaacccataa

SEQ ID NO: 469272 - DNA, 20 bp, Artificial Sequence
  chemically synthesized
acacataatagtactcattt

SEQ ID NO: 469273 - DNA, 20 bp, Artificial Sequence
  chemically synthesized
cattgtaacatcatagcacg

SEQ ID NO: 469274 - DNA, 20 bp, Artificial Sequence
  chemically synthesized
ctacagtgtcacaaagtaat

SEQ ID NO: 469275 - DNA, 20 bp, Artificial Sequence
  chemically synthesized
aactatacagtcatgtgctg

SEQ ID NO: 469276 - DNA, 20 bp, Artificial Sequence
  chemically synthesized
gatagactaaacagctatgt

SEQ ID NO: 469277 - DNA, 20 bp, Artificial Sequence
  chemically synthesized
ctaaacagctatgttgggat

SEQ ID NO: 469278 - DNA, 20 bp, Artificial Sequence
  chemically synthesized
ttagagtattttcaataaag

SEQ ID NO: 469279 - DNA, 20 bp, Artificial Sequence
  chemically synthesized
gcatgtatgtgttttggggg

SEQ ID NO: 469280 - DNA, 20 bp, Artificial Sequence
  chemically synthesized
atatgaattttagattgtaa

SEQ ID NO: 469281 - DNA, 20 bp, Artificial Sequence
  chemically synthesized
tacaatctaaaattcatata

SEQ ID NO: 469282 - DNA, 20 bp, Artificial Sequence
  chemically synthesized
gtgtcaatgtgatcccctat

SEQ ID NO: 469283 - DNA, 20 bp, Artificial Sequence
  chemically synthesized
cggagactagattgaaatga

SEQ ID NO: 469284 - DNA, 20 bp, Artificial Sequence
  chemically synthesized
aacaggcccacagtggcaca

SEQ ID NO: 469285 - DNA, 20 bp, Artificial Sequence
  chemically synthesized
agactgcctgaaggaacctt

SEQ ID NO: 469286 - DNA, 20 bp, Artificial Sequence
  chemically synthesized
aggccaagcctgccctggca

SEQ ID NO: 469287 - DNA, 20 bp, Artificial Sequence
  chemically synthesized
tctcaacagggctgtttcca

SEQ ID NO: 469288 - DNA, 20 bp, Artificial Sequence
  chemically synthesized
gatagaagtaaagttttgca

SEQ ID NO: 469289 - DNA, 20 bp, Artificial Sequence
  chemically synthesized
ttacttctatcactaccaaa

SEQ ID NO: 469290 - DNA, 20 bp, Artificial Sequence
  chemically synthesized
gtagatactaaatgaggcaa

SEQ ID NO: 469291 - DNA, 20 bp, Artificial Sequence
  chemically synthesized
cacatccatggatatgaaaa

SEQ ID NO: 469292 - DNA, 20 bp, Artificial Sequence
  chemically synthesized
actattcctttttcatatcc

SEQ ID NO: 469293 - DNA, 20 bp, Artificial Sequence
  chemically synthesized
caggaaatgaagtcacatcc

SEQ ID NO: 469294 - DNA, 20 bp, Artificial Sequence
  chemically synthesized
tgacttcatttcctggctta

SEQ ID NO: 469295 - DNA, 20 bp, Artificial Sequence
  chemically synthesized
aaatcactataggtcttcca

SEQ ID NO: 469296 - DNA, 20 bp, Artificial Sequence
  chemically synthesized
tttctaagtggttagtgggg

SEQ ID NO: 469297 - DNA, 20 bp, Artificial Sequence
  chemically synthesized
aacctttaatagataatcca

SEQ ID NO: 469298 - DNA, 20 bp, Artificial Sequence
  chemically synthesized
gtgtttgtgtgccacactct

SEQ ID NO: 469299 - DNA, 20 bp, Artificial Sequence
  chemically synthesized
tgccactactgggcccttgt

SEQ ID NO: 469300 - DNA, 20 bp, Artificial Sequence
  chemically synthesized
ttggtacagttagaaaggta

SEQ ID NO: 469301 - DNA, 20 bp, Artificial Sequence
  chemically synthesized
gaaatcaaatctgcaatgca

SEQ ID NO: 469302 - DNA, 20 bp, Artificial Sequence
  chemically synthesized
caatgcaaggaatgcacttg

SEQ ID NO: 469303 - DNA, 20 bp, Artificial Sequence
  chemically synthesized
tgtttgaagtataggacctt

SEQ ID NO: 469304 - DNA, 20 bp, Artificial Sequence
  chemically synthesized
ttgctgtagggaaagataac

SEQ ID NO: 469305 - DNA, 20 bp, Artificial Sequence
  chemically synthesized
aagcatgccagggccaggac

SEQ ID NO: 469306 - DNA, 20 bp, Artificial Sequence
  chemically synthesized
gtaaatacttaggaatactt

SEQ ID NO: 469307 - DNA, 20 bp, Artificial Sequence
  chemically synthesized
tggatccattgtaaatactt

SEQ ID NO: 469308 - DNA, 20 bp, Artificial Sequence
  chemically synthesized
agtattcctaagtatttaca

SEQ ID NO: 469309 - DNA, 20 bp, Artificial Sequence
  chemically synthesized
gcaatttgcaatcaggttga

SEQ ID NO: 469310 - DNA, 20 bp, Artificial Sequence
  chemically synthesized
tttagcaatttgcaatcagg

SEQ ID NO: 469311 - DNA, 20 bp, Artificial Sequence
  chemically synthesized
tgaaagcctcgccatacata

SEQ ID NO: 469312 - DNA, 20 bp, Artificial Sequence
  chemically synthesized
ggggacccttgagggggaag

SEQ ID NO: 469313 - DNA, 20 bp, Artificial Sequence
  chemically synthesized
actaattcctcttccccctc

SEQ ID NO: 469314 - DNA, 20 bp, Artificial Sequence
  chemically synthesized
tacttttcctgagtcctgga

SEQ ID NO: 469315 - DNA, 20 bp, Artificial Sequence
  chemically synthesized
acagctacttttcctgagtc

SEQ ID NO: 469316 - DNA, 20 bp, Artificial Sequence
  chemically synthesized
ccaaacaacagctacttttc

SEQ ID NO: 469317 - DNA, 20 bp, Artificial Sequence
  chemically synthesized
gtatcagaaactacatattt

SEQ ID NO: 469318 - DNA, 20 bp, Artificial Sequence
  chemically synthesized
ggcggtgggcatactggact

SEQ ID NO: 469319 - DNA, 20 bp, Artificial Sequence
  chemically synthesized
taaagtccctcagctggtgg

SEQ ID NO: 469320 - DNA, 20 bp, Artificial Sequence
  chemically synthesized
ttttattattgtttaagtgg

SEQ ID NO: 469321 - DNA, 20 bp, Artificial Sequence
  chemically synthesized
ttgcttttattattgtttaa

SEQ ID NO: 469322 - DNA, 20 bp, Artificial Sequence
  chemically synthesized
caccaagtctttgaggggaa

SEQ ID NO: 469323 - DNA, 20 bp, Artificial Sequence
  chemically synthesized
gttcccctcaaagacttggt

SEQ ID NO: 469324 - DNA, 20 bp, Artificial Sequence
  chemically synthesized
acttggtgaggattaaatga

SEQ ID NO: 469325 - DNA, 20 bp, Artificial Sequence
  chemically synthesized
actaacaaaactttgttcac

SEQ ID NO: 469326 - DNA, 20 bp, Artificial Sequence
  chemically synthesized
catgatagtgaaagcaaact

SEQ ID NO: 469327 - DNA, 20 bp, Artificial Sequence
  chemically synthesized
actatgggtggttatgaaac

SEQ ID NO: 469328 - DNA, 20 bp, Artificial Sequence
  chemically synthesized
aaccagagtaggaaaggtct

SEQ ID NO: 469329 - DNA, 20 bp, Artificial Sequence
  chemically synthesized
aaggtctgagagttaaatag

SEQ ID NO: 469330 - DNA, 20 bp, Artificial Sequence
  chemically synthesized
tgagagttaaatagaggaat

SEQ ID NO: 469331 - DNA, 20 bp, Artificial Sequence
  chemically synthesized
ataagaccaatgaaaaggac

SEQ ID NO: 469332 - DNA, 20 bp, Artificial Sequence
  chemically synthesized
agaaggcctggaaacaatgt

SEQ ID NO: 469333 - DNA, 20 bp, Artificial Sequence
  chemically synthesized
ctctgtactatttttatttt

SEQ ID NO: 469334 - DNA, 20 bp, Artificial Sequence
  chemically synthesized
ggggggaaatcagtcaagat

SEQ ID NO: 469335 - DNA, 20 bp, Artificial Sequence
  chemically synthesized
tcatagaaaacatttcaagg

SEQ ID NO: 469336 - DNA, 20 bp, Artificial Sequence
  chemically synthesized
cctcagcctcccaaaatgtt

SEQ ID NO: 469337 - DNA, 20 bp, Artificial Sequence
  chemically synthesized
caacattttgggaggctgag

SEQ ID NO: 469338 - DNA, 20 bp, Artificial Sequence
  chemically synthesized
tgtgtgtgtgtgtgtgtgta

SEQ ID NO: 469339 - DNA, 20 bp, Artificial Sequence
  chemically synthesized
gatcctcccacctcagcctc

SEQ ID NO: 469340 - DNA, 20 bp, Artificial Sequence
  chemically synthesized
tactcaggaggctgaggtgg

SEQ ID NO: 469341 - DNA, 20 bp, Artificial Sequence
  chemically synthesized
tcgtgccactgcactccagc

SEQ ID NO: 469342 - DNA, 20 bp, Artificial Sequence
  chemically synthesized
tctaacttcgtcacccaggc

SEQ ID NO: 469343 - DNA, 20 bp, Artificial Sequence
  chemically synthesized
tgttttgttttgttttcaga

SEQ ID NO: 469344 - DNA, 20 bp, Artificial Sequence
  chemically synthesized
agtccatccttgcatatttg

SEQ ID NO: 469345 - DNA, 20 bp, Artificial Sequence
  chemically synthesized
gaggcattcaacaaatatgc

SEQ ID NO: 469346 - DNA, 20 bp, Artificial Sequence
  chemically synthesized
aacaaatatgcaaggatgga

SEQ ID NO: 469347 - DNA, 20 bp, Artificial Sequence
  chemically synthesized
gtattctcagtctcaaagct

SEQ ID NO: 469348 - DNA, 20 bp, Artificial Sequence
  chemically synthesized
gaattcaaagctttgagact

SEQ ID NO: 469349 - DNA, 20 bp, Artificial Sequence
  chemically synthesized
aagctttgagactgagaata

SEQ ID NO: 469350 - DNA, 20 bp, Artificial Sequence
  chemically synthesized
aaccagagacatgggcttag

SEQ ID NO: 469351 - DNA, 20 bp, Artificial Sequence
  chemically synthesized
agtaggaggttatccagcaa

SEQ ID NO: 469352 - DNA, 20 bp, Artificial Sequence
  chemically synthesized
ctgcctgctacatccttttg

SEQ ID NO: 469353 - DNA, 20 bp, Artificial Sequence
  chemically synthesized
aaggatgtagcaggcagaaa

SEQ ID NO: 469354 - DNA, 20 bp, Artificial Sequence
  chemically synthesized
gccctcttggatttggttgt

SEQ ID NO: 469355 - DNA, 20 bp, Artificial Sequence
  chemically synthesized
cactgcagcctctggccctc

SEQ ID NO: 469356 - DNA, 20 bp, Artificial Sequence
  chemically synthesized
agagggccagaggctgcagt

SEQ ID NO: 469357 - DNA, 20 bp, Artificial Sequence
  chemically synthesized
aggatggtggtggcttcctg

SEQ ID NO: 469358 - DNA, 20 bp, Artificial Sequence
  chemically synthesized
tggattctttgttttctcgc

SEQ ID NO: 469359 - DNA, 20 bp, Artificial Sequence
  chemically synthesized
agtactcgggcgagaaaaca

SEQ ID NO: 469360 - DNA, 20 bp, Artificial Sequence
  chemically synthesized
aacaaagaatccagctggcc

SEQ ID NO: 469361 - DNA, 20 bp, Artificial Sequence
  chemically synthesized
taggctgtattcagggccag

SEQ ID NO: 469362 - DNA, 20 bp, Artificial Sequence
  chemically synthesized
atatgtgtgtgcattgtgac

SEQ ID NO: 469363 - DNA, 20 bp, Artificial Sequence
  chemically synthesized
acacacacgtgttcatatat

SEQ ID NO: 469364 - DNA, 20 bp, Artificial Sequence
  chemically synthesized
gtgtgtttcactagaactca

SEQ ID NO: 469365 - DNA, 20 bp, Artificial Sequence
  chemically synthesized
agtcaagtctcagttactct

SEQ ID NO: 469366 - DNA, 20 bp, Artificial Sequence
  chemically synthesized
gcctcggcctcccaaagtgc

SEQ ID NO: 469367 - DNA, 20 bp, Artificial Sequence
  chemically synthesized
actttgggaggccgaggcag

SEQ ID NO: 469368 - DNA, 20 bp, Artificial Sequence
  chemically synthesized
caggtggattgcttgagatc

SEQ ID NO: 469369 - DNA, 20 bp, Artificial Sequence
  chemically synthesized
tggctaattttttgtggaga

SEQ ID NO: 469370 - DNA, 20 bp, Artificial Sequence
  chemically synthesized
ctcccgagtagctgggatta

SEQ ID NO: 469371 - DNA, 20 bp, Artificial Sequence
  chemically synthesized
gcctcagcctcccgagtagc

SEQ ID NO: 469372 - DNA, 20 bp, Artificial Sequence
  chemically synthesized
aattgtcatgcctcagcctc

SEQ ID NO: 469373 - DNA, 20 bp, Artificial Sequence
  chemically synthesized
tctccctctgtcgcccaggc

SEQ ID NO: 469374 - DNA, 20 bp, Artificial Sequence
  chemically synthesized
tgttttgttttgttttgaga

SEQ ID NO: 469375 - DNA, 20 bp, Artificial Sequence
  chemically synthesized
taaaacaacttgccataaac

SEQ ID NO: 469376 - DNA, 20 bp, Artificial Sequence
  chemically synthesized
tatggcaagttgttttataa

SEQ ID NO: 469377 - DNA, 20 bp, Artificial Sequence
  chemically synthesized
acacaagtaacttccataca

SEQ ID NO: 469378 - DNA, 20 bp, Artificial Sequence
  chemically synthesized
gtctacattttgatgattga

SEQ ID NO: 469379 - DNA, 20 bp, Artificial Sequence
  chemically synthesized
ctatctgcattttggaaggt

SEQ ID NO: 469380 - DNA, 20 bp, Artificial Sequence
  chemically synthesized
tgtaaagtgggatatactgt

SEQ ID NO: 469381 - DNA, 20 bp, Artificial Sequence
  chemically synthesized
ataagttcatttatgtaaag

SEQ ID NO: 469382 - DNA, 20 bp, Artificial Sequence
  chemically synthesized
tagttagttggatagattta

SEQ ID NO: 469383 - DNA, 20 bp, Artificial Sequence
  chemically synthesized
agtatttatttaatagttag

SEQ ID NO: 469384 - DNA, 20 bp, Artificial Sequence
  chemically synthesized
atttaggtgtttaaagcagt

SEQ ID NO: 469385 - DNA, 20 bp, Artificial Sequence
  chemically synthesized
ggtttcctgggcagatcact

SEQ ID NO: 469386 - DNA, 20 bp, Artificial Sequence
  chemically synthesized
tgaagtctttgaccacagac

SEQ ID NO: 469387 - DNA, 20 bp, Artificial Sequence
  chemically synthesized
ggaactagctgtagaactaa

SEQ ID NO: 469388 - DNA, 20 bp, Artificial Sequence
  chemically synthesized
taaatctcagccattgttaa

SEQ ID NO: 469389 - DNA, 20 bp, Artificial Sequence
  chemically synthesized
tcagccattgttaatagaat

SEQ ID NO: 469390 - DNA, 20 bp, Artificial Sequence
  chemically synthesized
ccattgttaatagaattaga

SEQ ID NO: 469391 - DNA, 20 bp, Artificial Sequence
  chemically synthesized
taagagctgtttttcttatg

SEQ ID NO: 469392 - DNA, 20 bp, Artificial Sequence
  chemically synthesized
aacaaaaacataagaacact

SEQ ID NO: 469393 - DNA, 20 bp, Artificial Sequence
  chemically synthesized
tgtaacgctatcagtattga

SEQ ID NO: 469394 - DNA, 20 bp, Artificial Sequence
  chemically synthesized
tgtctggcaatcacacgcct

SEQ ID NO: 469395 - DNA, 20 bp, Artificial Sequence
  chemically synthesized
tgtctttgaagctttcttta

SEQ ID NO: 469396 - DNA, 20 bp, Artificial Sequence
  chemically synthesized
aaagacaaaagctaaacgat

SEQ ID NO: 469397 - DNA, 20 bp, Artificial Sequence
  chemically synthesized
gcctgtaatccgagcacttt

SEQ ID NO: 469398 - DNA, 20 bp, Artificial Sequence
  chemically synthesized
gcctcgaactcccaaagtgc

SEQ ID NO: 469399 - DNA, 20 bp, Artificial Sequence
  chemically synthesized
actttgggagttcgaggcag

SEQ ID NO: 469400 - DNA, 20 bp, Artificial Sequence
  chemically synthesized
caggtggatcacctgaggtc

SEQ ID NO: 469401 - DNA, 20 bp, Artificial Sequence
  chemically synthesized
ttttgtatttttagtagaga

SEQ ID NO: 469402 - DNA, 20 bp, Artificial Sequence
  chemically synthesized
taaaaatacaaaaattagct

SEQ ID NO: 469403 - DNA, 20 bp, Artificial Sequence
  chemically synthesized
acctcagcctcccgagtagc

SEQ ID NO: 469404 - DNA, 20 bp, Artificial Sequence
  chemically synthesized
gattctgctacctcagcctc

SEQ ID NO: 469405 - DNA, 20 bp, Artificial Sequence
  chemically synthesized
tactcgggaggctgaggtag

SEQ ID NO: 469406 - DNA, 20 bp, Artificial Sequence
  chemically synthesized
ctcactgcaacctccacctc

SEQ ID NO: 469407 - DNA, 20 bp, Artificial Sequence
  chemically synthesized
tctcaccactgcactccagc

SEQ ID NO: 469408 - DNA, 20 bp, Artificial Sequence
  chemically synthesized
tctcgctctgtcacccaggc

SEQ ID NO: 469409 - DNA, 20 bp, Artificial Sequence
  chemically synthesized
tttttttttttttttctttt

SEQ ID NO: 469410 - DNA, 20 bp, Artificial Sequence
  chemically synthesized
gaaaaaaaaattagaacaag

SEQ ID NO: 469411 - DNA, 20 bp, Artificial Sequence
  chemically synthesized
acaagatgaatgtctaccag

SEQ ID NO: 469412 - DNA, 20 bp, Artificial Sequence
  chemically synthesized
gctcaggcatttgggaagaa

SEQ ID NO: 469413 - DNA, 20 bp, Artificial Sequence
  chemically synthesized
acagagaaaaagcaatggga

SEQ ID NO: 469414 - DNA, 20 bp, Artificial Sequence
  chemically synthesized
ggataggaaagagaacggac

SEQ ID NO: 469415 - DNA, 20 bp, Artificial Sequence
  chemically synthesized
gtcagtgatggacattagca

SEQ ID NO: 469416 - DNA, 20 bp, Artificial Sequence
  chemically synthesized
gagtatacacctctagactt

SEQ ID NO: 469417 - DNA, 20 bp, Artificial Sequence
  chemically synthesized
tctagactttggaataatag

SEQ ID NO: 469418 - DNA, 20 bp, Artificial Sequence
  chemically synthesized
ttgaaaggaggctataatga

SEQ ID NO: 469419 - DNA, 20 bp, Artificial Sequence
  chemically synthesized
gtaggcgagtctcttagtct

SEQ ID NO: 469420 - DNA, 20 bp, Artificial Sequence
  chemically synthesized
taagaaaatggcctttgtag

SEQ ID NO: 469421 - DNA, 20 bp, Artificial Sequence
  chemically synthesized
aggccattttcttatataca

SEQ ID NO: 469422 - DNA, 20 bp, Artificial Sequence
  chemically synthesized
ctctagcacctcaataactg

SEQ ID NO: 469423 - DNA, 20 bp, Artificial Sequence
  chemically synthesized
ctgtcttctttcccaaaacc

SEQ ID NO: 469424 - DNA, 20 bp, Artificial Sequence
  chemically synthesized
taggcagtaggtatgggatt

SEQ ID NO: 469425 - DNA, 20 bp, Artificial Sequence
  chemically synthesized
tcttcagtaggcagtaggta

SEQ ID NO: 469426 - DNA, 20 bp, Artificial Sequence
  chemically synthesized
atatgagaaaacgaagctct

SEQ ID NO: 469427 - DNA, 20 bp, Artificial Sequence
  chemically synthesized
aattaatttctaaaatatga

SEQ ID NO: 469428 - DNA, 20 bp, Artificial Sequence
  chemically synthesized
ataaatatgttacctagaag

SEQ ID NO: 469429 - DNA, 20 bp, Artificial Sequence
  chemically synthesized
gctcaatgttactgccccca

SEQ ID NO: 469430 - DNA, 20 bp, Artificial Sequence
  chemically synthesized
gcaacttcacccaactgtct

SEQ ID NO: 469431 - DNA, 20 bp, Artificial Sequence
  chemically synthesized
ctatccaaattccaagacag

SEQ ID NO: 469432 - DNA, 20 bp, Artificial Sequence
  chemically synthesized
tcacccaactgtcttggaat

SEQ ID NO: 469433 - DNA, 20 bp, Artificial Sequence
  chemically synthesized
caactgtcttggaatttgga

SEQ ID NO: 469434 - DNA, 20 bp, Artificial Sequence
  chemically synthesized
caagcaagtggcaagttcaa

SEQ ID NO: 469435 - DNA, 20 bp, Artificial Sequence
  chemically synthesized
acagtcaaaacacagcaccc

SEQ ID NO: 469436 - DNA, 20 bp, Artificial Sequence
  chemically synthesized
gtcaggttctgctggcatcc

SEQ ID NO: 469437 - DNA, 20 bp, Artificial Sequence
  chemically synthesized
gaattgctactggaattgag

SEQ ID NO: 469438 - DNA, 20 bp, Artificial Sequence
  chemically synthesized
cttgagaattgctactggaa

SEQ ID NO: 469439 - DNA, 20 bp, Artificial Sequence
  chemically synthesized
ctactcttgagaattgctac

SEQ ID NO: 469440 - DNA, 20 bp, Artificial Sequence
  chemically synthesized
caattccagtagcaattctc

SEQ ID NO: 469441 - DNA, 20 bp, Artificial Sequence
  chemically synthesized
tggaaatactggctactctt

SEQ ID NO: 469442 - DNA, 20 bp, Artificial Sequence
  chemically synthesized
aagagtagccagtatttcca

SEQ ID NO: 469443 - DNA, 20 bp, Artificial Sequence
  chemically synthesized
tagccagtatttccacagag

SEQ ID NO: 469444 - DNA, 20 bp, Artificial Sequence
  chemically synthesized
tacttctaatttgtgctaat

SEQ ID NO: 469445 - DNA, 20 bp, Artificial Sequence
  chemically synthesized
tctggatatttattattttt

SEQ ID NO: 469446 - DNA, 20 bp, Artificial Sequence
  chemically synthesized
ttagaagaaatttaagtgtc

SEQ ID NO: 469447 - DNA, 20 bp, Artificial Sequence
  chemically synthesized
taagccagaacataatcctt

SEQ ID NO: 469448 - DNA, 20 bp, Artificial Sequence
  chemically synthesized
tcctatatacaataattccc

SEQ ID NO: 469449 - DNA, 20 bp, Artificial Sequence
  chemically synthesized
tccttgggaattattgtata

SEQ ID NO: 469450 - DNA, 20 bp, Artificial Sequence
  chemically synthesized
ttgaatctctggtgtccaag

SEQ ID NO: 469451 - DNA, 20 bp, Artificial Sequence
  chemically synthesized
gtcccaactgtggtacattt

SEQ ID NO: 469452 - DNA, 20 bp, Artificial Sequence
  chemically synthesized
ccacagttgggacttcttta

SEQ ID NO: 469453 - DNA, 20 bp, Artificial Sequence
  chemically synthesized
ccatcatgtatgtgttccca

SEQ ID NO: 469454 - DNA, 20 bp, Artificial Sequence
  chemically synthesized
gttgttgttgttttttgaga

SEQ ID NO: 469455 - DNA, 20 bp, Artificial Sequence
  chemically synthesized
ctcaccgcaacctctgcctc

SEQ ID NO: 469456 - DNA, 20 bp, Artificial Sequence
  chemically synthesized
tactcaggcggctgaggcag

SEQ ID NO: 469457 - DNA, 20 bp, Artificial Sequence
  chemically synthesized
cattctcctgcctcagccgc

SEQ ID NO: 469458 - DNA, 20 bp, Artificial Sequence
  chemically synthesized
agtaaaaatacaaaaattag

SEQ ID NO: 469459 - DNA, 20 bp, Artificial Sequence
  chemically synthesized
taggaggatcacttgaggtc

SEQ ID NO: 469460 - DNA, 20 bp, Artificial Sequence
  chemically synthesized
acttagggaggccgaggtag

SEQ ID NO: 469461 - DNA, 20 bp, Artificial Sequence
  chemically synthesized
acctcggcctccctaagtgc

SEQ ID NO: 469462 - DNA, 20 bp, Artificial Sequence
  chemically synthesized
ccaaaaacgatagacacata

SEQ ID NO: 469463 - DNA, 20 bp, Artificial Sequence
  chemically synthesized
gatatggttccttccctcaa

SEQ ID NO: 469464 - DNA, 20 bp, Artificial Sequence
  chemically synthesized
tgtgccagaagtatctacag

SEQ ID NO: 469465 - DNA, 20 bp, Artificial Sequence
  chemically synthesized
cagtagaatggcagtacccg

SEQ ID NO: 469466 - DNA, 20 bp, Artificial Sequence
  chemically synthesized
tattgggcacctactatcca

SEQ ID NO: 469467 - DNA, 20 bp, Artificial Sequence
  chemically synthesized
taggtgcccaatatatgtaa

SEQ ID NO: 469468 - DNA, 20 bp, Artificial Sequence
  chemically synthesized
tgcccaatatatgtaacaga

SEQ ID NO: 469469 - DNA, 20 bp, Artificial Sequence
  chemically synthesized
taacagaatgaatgaacata

SEQ ID NO: 469470 - DNA, 20 bp, Artificial Sequence
  chemically synthesized
ttttgaggggcaacttctag

SEQ ID NO: 469471 - DNA, 20 bp, Artificial Sequence
  chemically synthesized
tatgggtacagaaagctttc

SEQ ID NO: 469472 - DNA, 20 bp, Artificial Sequence
  chemically synthesized
ctagagtttaaagtgtgctt

SEQ ID NO: 469473 - DNA, 20 bp, Artificial Sequence
  chemically synthesized
tgttaaaacatttaatttcc

SEQ ID NO: 469474 - DNA, 20 bp, Artificial Sequence
  chemically synthesized
taggaaattaaatgttttaa

SEQ ID NO: 469475 - DNA, 20 bp, Artificial Sequence
  chemically synthesized
aggtgtttattttcaaagtt

SEQ ID NO: 469476 - DNA, 20 bp, Artificial Sequence
  chemically synthesized
ggaagctttgagttggtgtt

SEQ ID NO: 469477 - DNA, 20 bp, Artificial Sequence
  chemically synthesized
attgaataattgaggaagct

SEQ ID NO: 469478 - DNA, 20 bp, Artificial Sequence
  chemically synthesized
attgtaaatataatattaaa

SEQ ID NO: 469479 - DNA, 20 bp, Artificial Sequence
  chemically synthesized
aaaatgtatttcggatgaga

SEQ ID NO: 469480 - DNA, 20 bp, Artificial Sequence
  chemically synthesized
taaccattttaaaatgtatt

SEQ ID NO: 469481 - DNA, 20 bp, Artificial Sequence
  chemically synthesized
agttatttttctctcgttct

SEQ ID NO: 469482 - DNA, 20 bp, Artificial Sequence
  chemically synthesized
cacttttatgtagtttccac

SEQ ID NO: 469483 - DNA, 20 bp, Artificial Sequence
  chemically synthesized
ctactgatcatttctccttc

SEQ ID NO: 469484 - DNA, 20 bp, Artificial Sequence
  chemically synthesized
gagaaatgatcagtaggaga

SEQ ID NO: 469485 - DNA, 20 bp, Artificial Sequence
  chemically synthesized
gagagaaaagacaagctagg

SEQ ID NO: 469486 - DNA, 20 bp, Artificial Sequence
  chemically synthesized
ttataagcaatcttttcagt

SEQ ID NO: 469487 - DNA, 20 bp, Artificial Sequence
  chemically synthesized
caactgcagcctttcacaat

SEQ ID NO: 469488 - DNA, 20 bp, Artificial Sequence
  chemically synthesized
tgcagcctttcacaatatga

SEQ ID NO: 469489 - DNA, 20 bp, Artificial Sequence
  chemically synthesized
aaattaaaagccaatgctag

SEQ ID NO: 469490 - DNA, 20 bp, Artificial Sequence
  chemically synthesized
aatttccttttgattacgca

SEQ ID NO: 469491 - DNA, 20 bp, Artificial Sequence
  chemically synthesized
gtaatcaaaaggaaattctg

SEQ ID NO: 469492 - DNA, 20 bp, Artificial Sequence
  chemically synthesized
gatagatacgtaccacccta

SEQ ID NO: 469493 - DNA, 20 bp, Artificial Sequence
  chemically synthesized
agatagcttgctgtttctta

SEQ ID NO: 469494 - DNA, 20 bp, Artificial Sequence
  chemically synthesized
ataaaatgttagtcacgtca

SEQ ID NO: 469495 - DNA, 20 bp, Artificial Sequence
  chemically synthesized
atgttagtcacgtcacggaa

SEQ ID NO: 469496 - DNA, 20 bp, Artificial Sequence
  chemically synthesized
ataaacaatgtttcttgaac

SEQ ID NO: 469497 - DNA, 20 bp, Artificial Sequence
  chemically synthesized
agtctttgggttcttattta

SEQ ID NO: 469498 - DNA, 20 bp, Artificial Sequence
  chemically synthesized
tctctgcacttgtctagtct

SEQ ID NO: 469499 - DNA, 20 bp, Artificial Sequence
  chemically synthesized
gaataaaacacatgttccta

SEQ ID NO: 469500 - DNA, 20 bp, Artificial Sequence
  chemically synthesized
ttacattacattgactgtgt

SEQ ID NO: 469501 - DNA, 20 bp, Artificial Sequence
  chemically synthesized
caggcatttaagtagagaat

SEQ ID NO: 469502 - DNA, 20 bp, Artificial Sequence
  chemically synthesized
aaattgcaggcatttaagta

SEQ ID NO: 469503 - DNA, 20 bp, Artificial Sequence
  chemically synthesized
ctgcaatttaatgtttgaca

SEQ ID NO: 469504 - DNA, 20 bp, Artificial Sequence
  chemically synthesized
gtaagatgtagaactgcttt

SEQ ID NO: 469505 - DNA, 20 bp, Artificial Sequence
  chemically synthesized
gcagttctacatcttacatg

SEQ ID NO: 469506 - DNA, 20 bp, Artificial Sequence
  chemically synthesized
tgtcatttcccatctagaac

SEQ ID NO: 469507 - DNA, 20 bp, Artificial Sequence
  chemically synthesized
taattagccaacattaataa

SEQ ID NO: 469508 - DNA, 20 bp, Artificial Sequence
  chemically synthesized
ccagttttaaaagacaggac

SEQ ID NO: 469509 - DNA, 20 bp, Artificial Sequence
  chemically synthesized
cataataggggacgaacagg

SEQ ID NO: 469510 - DNA, 20 bp, Artificial Sequence
  chemically synthesized
cctgttcgtcccctattatg

SEQ ID NO: 469511 - DNA, 20 bp, Artificial Sequence
  chemically synthesized
caattactgaccctttccta

SEQ ID NO: 469512 - DNA, 20 bp, Artificial Sequence
  chemically synthesized
gaagtgtttaccctctagga

SEQ ID NO: 469513 - DNA, 20 bp, Artificial Sequence
  chemically synthesized
gagggtaaacacttctagtt

SEQ ID NO: 469514 - DNA, 20 bp, Artificial Sequence
  chemically synthesized
gccttgaaaaggaaaaataa

SEQ ID NO: 469515 - DNA, 20 bp, Artificial Sequence
  chemically synthesized
cttaataaaacagtggtcaa

SEQ ID NO: 469516 - DNA, 20 bp, Artificial Sequence
  chemically synthesized
ggtcatcagtcaaagagata

SEQ ID NO: 469517 - DNA, 20 bp, Artificial Sequence
  chemically synthesized
acattcagtggtcaagttgg

SEQ ID NO: 469518 - DNA, 20 bp, Artificial Sequence
  chemically synthesized
aaattcaaccaacttgacca

SEQ ID NO: 469519 - DNA, 20 bp, Artificial Sequence
  chemically synthesized
cagttcaaataagggttttt

SEQ ID NO: 469520 - DNA, 20 bp, Artificial Sequence
  chemically synthesized
agaacttttgcagttcaaat

SEQ ID NO: 469521 - DNA, 20 bp, Artificial Sequence
  chemically synthesized
ggtggctttccataggtgaa

SEQ ID NO: 469522 - DNA, 20 bp, Artificial Sequence
  chemically synthesized
accaaggtggctttccatag

SEQ ID NO: 469523 - DNA, 20 bp, Artificial Sequence
  chemically synthesized
tggtttaagttggtaagcag

SEQ ID NO: 469524 - DNA, 20 bp, Artificial Sequence
  chemically synthesized
aggccacataacacataata

SEQ ID NO: 469525 - DNA, 20 bp, Artificial Sequence
  chemically synthesized
tatatttgaatgttgtttaa

SEQ ID NO: 469526 - DNA, 20 bp, Artificial Sequence
  chemically synthesized
ttattttttagatcatatat

SEQ ID NO: 469527 - DNA, 20 bp, Artificial Sequence
  chemically synthesized
atttttcctttttttccccc

SEQ ID NO: 469528 - DNA, 20 bp, Artificial Sequence
  chemically synthesized
gggggaaaaaaaggaaaaat

SEQ ID NO: 469529 - DNA, 20 bp, Artificial Sequence
  chemically synthesized
agaaaatgtctttcaagaca

SEQ ID NO: 469530 - DNA, 20 bp, Artificial Sequence
  chemically synthesized
tttcaagacatggaatcaat

SEQ ID NO: 469531 - DNA, 20 bp, Artificial Sequence
  chemically synthesized
aatatggtacatatacacta

SEQ ID NO: 469532 - DNA, 20 bp, Artificial Sequence
  chemically synthesized
aataccatgcagctataaaa

SEQ ID NO: 469533 - DNA, 20 bp, Artificial Sequence
  chemically synthesized
tgagatcatgtcttttgaac

SEQ ID NO: 469534 - DNA, 20 bp, Artificial Sequence
  chemically synthesized
tgtttctgcattagtttgct

SEQ ID NO: 469535 - DNA, 20 bp, Artificial Sequence
  chemically synthesized
cacaagggaacaacagatac

SEQ ID NO: 469536 - DNA, 20 bp, Artificial Sequence
  chemically synthesized
acaacagatactggggtctt

SEQ ID NO: 469537 - DNA, 20 bp, Artificial Sequence
  chemically synthesized
atactggggtcttgagggtg

SEQ ID NO: 469538 - DNA, 20 bp, Artificial Sequence
  chemically synthesized
aggagcagaaaagacaactg

SEQ ID NO: 469539 - DNA, 20 bp, Artificial Sequence
  chemically synthesized
atatgcagcctccagcataa

SEQ ID NO: 469540 - DNA, 20 bp, Artificial Sequence
  chemically synthesized
ttggcgatgaccttgagcag

SEQ ID NO: 469541 - DNA, 20 bp, Artificial Sequence
  chemically synthesized
atgaccttgagcagtaggat

SEQ ID NO: 469542 - DNA, 20 bp, Artificial Sequence
  chemically synthesized
tattggaacactaagcttgt

SEQ ID NO: 469543 - DNA, 20 bp, Artificial Sequence
  chemically synthesized
taatggaacactaggcataa

SEQ ID NO: 469544 - DNA, 20 bp, Artificial Sequence
  chemically synthesized
aggcataaatgggttaatac

SEQ ID NO: 469545 - DNA, 20 bp, Artificial Sequence
  chemically synthesized
gtacaacaaacccccgtgac

SEQ ID NO: 469546 - DNA, 20 bp, Artificial Sequence
  chemically synthesized
cataggtaaactcacgtcac

SEQ ID NO: 469547 - DNA, 20 bp, Artificial Sequence
  chemically synthesized
ttaactttaattttaggttt

SEQ ID NO: 469548 - DNA, 20 bp, Artificial Sequence
  chemically synthesized
agaaaaaggagaaaatattt

SEQ ID NO: 469549 - DNA, 20 bp, Artificial Sequence
  chemically synthesized
tgattttgaagtgctaatag

SEQ ID NO: 469550 - DNA, 20 bp, Artificial Sequence
  chemically synthesized
attagcacttcaaaatcaca

SEQ ID NO: 469551 - DNA, 20 bp, Artificial Sequence
  chemically synthesized
ccaggatttctttttgactg

SEQ ID NO: 469552 - DNA, 20 bp, Artificial Sequence
  chemically synthesized
ttgtttagtccattagtgcc

SEQ ID NO: 469553 - DNA, 20 bp, Artificial Sequence
  chemically synthesized
taagaaaattttccagtgat

SEQ ID NO: 469554 - DNA, 20 bp, Artificial Sequence
  chemically synthesized
gacctgagttgctgtataaa

SEQ ID NO: 469555 - DNA, 20 bp, Artificial Sequence
  chemically synthesized
tacagcaactcaggtcttca

SEQ ID NO: 469556 - DNA, 20 bp, Artificial Sequence
  chemically synthesized
aattttaactccttgaagac

SEQ ID NO: 469557 - DNA, 20 bp, Artificial Sequence
  chemically synthesized
gtagaaggaagttatacatt

SEQ ID NO: 469558 - DNA, 20 bp, Artificial Sequence
  chemically synthesized
agatgacatgtgaatgcatt

SEQ ID NO: 469559 - DNA, 20 bp, Artificial Sequence
  chemically synthesized
gttttctttgcagatgacat

SEQ ID NO: 469560 - DNA, 20 bp, Artificial Sequence
  chemically synthesized
aaatatatttgaggggaaac

SEQ ID NO: 469561 - DNA, 20 bp, Artificial Sequence
  chemically synthesized
acgttcacattagttttgat

SEQ ID NO: 469562 - DNA, 20 bp, Artificial Sequence
  chemically synthesized
ctaccaagtccttgaacatg

SEQ ID NO: 469563 - DNA, 20 bp, Artificial Sequence
  chemically synthesized
ggacttggtagatgactatg

SEQ ID NO: 469564 - DNA, 20 bp, Artificial Sequence
  chemically synthesized
atctgggaaggttttctgaa

SEQ ID NO: 469565 - DNA, 20 bp, Artificial Sequence
  chemically synthesized
accttcccagatttccaaat

SEQ ID NO: 469566 - DNA, 20 bp, Artificial Sequence
  chemically synthesized
taataattttgagatctaag

SEQ ID NO: 469567 - DNA, 20 bp, Artificial Sequence
  chemically synthesized
caattgaagaagggagcaga

SEQ ID NO: 469568 - DNA, 20 bp, Artificial Sequence
  chemically synthesized
gaaaaaaaaaaatcagaact

SEQ ID NO: 469569 - DNA, 20 bp, Artificial Sequence
  chemically synthesized
ttagagaacaattgtttgtt

SEQ ID NO: 469570 - DNA, 20 bp, Artificial Sequence
  chemically synthesized
caaacaattgttctctaaga

SEQ ID NO: 469571 - DNA, 20 bp, Artificial Sequence
  chemically synthesized
ttgttctctaagagagagtg

SEQ ID NO: 469572 - DNA, 20 bp, Artificial Sequence
  chemically synthesized
ggacacttttgcagaagatt

SEQ ID NO: 469573 - DNA, 20 bp, Artificial Sequence
  chemically synthesized
tggcacacctgtctccagat

SEQ ID NO: 469574 - DNA, 20 bp, Artificial Sequence
  chemically synthesized
ggaattcttccatgcacttc

SEQ ID NO: 469575 - DNA, 20 bp, Artificial Sequence
  chemically synthesized
gccacccctgaagtgcatgg

SEQ ID NO: 469576 - DNA, 20 bp, Artificial Sequence
  chemically synthesized
cctttctcgcccatggattt

SEQ ID NO: 469577 - DNA, 20 bp, Artificial Sequence
  chemically synthesized
gttctttccctttctcgccc

SEQ ID NO: 469578 - DNA, 20 bp, Artificial Sequence
  chemically synthesized
ctcattttgcaaatagtgga

SEQ ID NO: 469579 - DNA, 20 bp, Artificial Sequence
  chemically synthesized
gacactcattttgcaaatag

SEQ ID NO: 469580 - DNA, 20 bp, Artificial Sequence
  chemically synthesized
ctcattccactatttgcaaa

SEQ ID NO: 469581 - DNA, 20 bp, Artificial Sequence
  chemically synthesized
tatttgcaaaatgagtgtct

SEQ ID NO: 469582 - DNA, 20 bp, Artificial Sequence
  chemically synthesized
ataagctaggagttaagagc

SEQ ID NO: 469583 - DNA, 20 bp, Artificial Sequence
  chemically synthesized
gaaaaatattttgataagct

SEQ ID NO: 469584 - DNA, 20 bp, Artificial Sequence
  chemically synthesized
gtcacaggaggcttagcgta

SEQ ID NO: 469585 - DNA, 20 bp, Artificial Sequence
  chemically synthesized
atatgtgtctgaactggctg

SEQ ID NO: 469586 - DNA, 20 bp, Artificial Sequence
  chemically synthesized
tggtcaacgtccctctctgc

SEQ ID NO: 469587 - DNA, 20 bp, Artificial Sequence
  chemically synthesized
gtcaaacaattaataatctg

SEQ ID NO: 469588 - DNA, 20 bp, Artificial Sequence
  chemically synthesized
tcaagcaaaatgaccagccc

SEQ ID NO: 469589 - DNA, 20 bp, Artificial Sequence
  chemically synthesized
gattttatttgttttttgca

SEQ ID NO: 469590 - DNA, 20 bp, Artificial Sequence
  chemically synthesized
ataaaatcacaaatgactca

SEQ ID NO: 469591 - DNA, 20 bp, Artificial Sequence
  chemically synthesized
tgaaaggaaggttttactct

SEQ ID NO: 469592 - DNA, 20 bp, Artificial Sequence
  chemically synthesized
ttcagtgtcctttttcctct

SEQ ID NO: 469593 - DNA, 20 bp, Artificial Sequence
  chemically synthesized
gggtatgagagagtcctagc

SEQ ID NO: 469594 - DNA, 20 bp, Artificial Sequence
  chemically synthesized
gtgtttattaaagggtatga

SEQ ID NO: 469595 - DNA, 20 bp, Artificial Sequence
  chemically synthesized
ttcacgtttggtgtttatta

SEQ ID NO: 469596 - DNA, 20 bp, Artificial Sequence
  chemically synthesized
aaaataaaacacctttcaaa

SEQ ID NO: 469597 - DNA, 20 bp, Artificial Sequence
  chemically synthesized
tatgcctcgactctaagttg

SEQ ID NO: 469598 - DNA, 20 bp, Artificial Sequence
  chemically synthesized
actgatcaaactcatcaact

SEQ ID NO: 469599 - DNA, 20 bp, Artificial Sequence
  chemically synthesized
tgatgagtttgatcagtatt

SEQ ID NO: 469600 - DNA, 20 bp, Artificial Sequence
  chemically synthesized
tttaagaacaacttcagatc

SEQ ID NO: 469601 - DNA, 20 bp, Artificial Sequence
  chemically synthesized
gttcttaaatctcactggca

SEQ ID NO: 469602 - DNA, 20 bp, Artificial Sequence
  chemically synthesized
caaagatataattcccatcc

SEQ ID NO: 469603 - DNA, 20 bp, Artificial Sequence
  chemically synthesized
ttccccagtaatccaaggat

SEQ ID NO: 469604 - DNA, 20 bp, Artificial Sequence
  chemically synthesized
cagatattccccagtaatcc

SEQ ID NO: 469605 - DNA, 20 bp, Artificial Sequence
  chemically synthesized
ttcccatccttggattactg

SEQ ID NO: 469606 - DNA, 20 bp, Artificial Sequence
  chemically synthesized
tggattactggggaatatct

SEQ ID NO: 469607 - DNA, 20 bp, Artificial Sequence
  chemically synthesized
cctagcctgttctacataaa

SEQ ID NO: 469608 - DNA, 20 bp, Artificial Sequence
  chemically synthesized
taaacagagtcaattgtcac

SEQ ID NO: 469609 - DNA, 20 bp, Artificial Sequence
  chemically synthesized
gctaatacaagaaagtatca

SEQ ID NO: 469610 - DNA, 20 bp, Artificial Sequence
  chemically synthesized
tataaatgcatagctagaaa

SEQ ID NO: 469611 - DNA, 20 bp, Artificial Sequence
  chemically synthesized
gtatttttttcacctaatat

SEQ ID NO: 469612 - DNA, 20 bp, Artificial Sequence
  chemically synthesized
gcctatagaaaattttagtg

SEQ ID NO: 469613 - DNA, 20 bp, Artificial Sequence
  chemically synthesized
gcgagcctcaggtctgaaaa

SEQ ID NO: 469614 - DNA, 20 bp, Artificial Sequence
  chemically synthesized
aagttgttagaggacttaga

SEQ ID NO: 469615 - DNA, 20 bp, Artificial Sequence
  chemically synthesized
taaacacctcctcagatcaa

SEQ ID NO: 469616 - DNA, 20 bp, Artificial Sequence
  chemically synthesized
tgcatcttttcatgacactt

SEQ ID NO: 469617 - DNA, 20 bp, Artificial Sequence
  chemically synthesized
ttatacacctaagctctggt

SEQ ID NO: 469618 - DNA, 20 bp, Artificial Sequence
  chemically synthesized
attccttgcctcaaaggact

SEQ ID NO: 469619 - DNA, 20 bp, Artificial Sequence
  chemically synthesized
attctcagtcctttgaggca

SEQ ID NO: 469620 - DNA, 20 bp, Artificial Sequence
  chemically synthesized
tatgtgaactacatttataa

SEQ ID NO: 469621 - DNA, 20 bp, Artificial Sequence
  chemically synthesized
tgggaaaggtgtttactgag

SEQ ID NO: 469622 - DNA, 20 bp, Artificial Sequence
  chemically synthesized
atatttaattagaactggcc

SEQ ID NO: 469623 - DNA, 20 bp, Artificial Sequence
  chemically synthesized
aaaaggaaaacagaaaatcc

SEQ ID NO: 469624 - DNA, 20 bp, Artificial Sequence
  chemically synthesized
tcatgcttctggggaaactc

SEQ ID NO: 469625 - DNA, 20 bp, Artificial Sequence
  chemically synthesized
acagacatggtggtggaagc

SEQ ID NO: 469626 - DNA, 20 bp, Artificial Sequence
  chemically synthesized
ggggccttcccttccaaggg

SEQ ID NO: 469627 - DNA, 20 bp, Artificial Sequence
  chemically synthesized
aagggtcatttctctatctt

SEQ ID NO: 469628 - DNA, 20 bp, Artificial Sequence
  chemically synthesized
aaagtctcagcttccatgaa

SEQ ID NO: 469629 - DNA, 20 bp, Artificial Sequence
  chemically synthesized
taacttgggagacttatctg

SEQ ID NO: 469630 - DNA, 20 bp, Artificial Sequence
  chemically synthesized
atcaagtgagaaaaataata

SEQ ID NO: 469631 - DNA, 20 bp, Artificial Sequence
  chemically synthesized
aggacgggaggacgtgagga

SEQ ID NO: 469632 - DNA, 20 bp, Artificial Sequence
  chemically synthesized
aagagagagagaagaaaagt

SEQ ID NO: 469633 - DNA, 20 bp, Artificial Sequence
  chemically synthesized
agtgttcctactacgtgcac

SEQ ID NO: 469634 - DNA, 20 bp, Artificial Sequence
  chemically synthesized
cagctccattactggaagag

SEQ ID NO: 469635 - DNA, 20 bp, Artificial Sequence
  chemically synthesized
tccattactggaagagagga

SEQ ID NO: 469636 - DNA, 20 bp, Artificial Sequence
  chemically synthesized
agtatataaggaaacatgtt

SEQ ID NO: 469637 - DNA, 20 bp, Artificial Sequence
  chemically synthesized
cttatatactgaaggaagct

SEQ ID NO: 469638 - DNA, 20 bp, Artificial Sequence
  chemically synthesized
aatatttatgatgactaaag

SEQ ID NO: 469639 - DNA, 20 bp, Artificial Sequence
  chemically synthesized
actagttacttcttaaatgc

SEQ ID NO: 469640 - DNA, 20 bp, Artificial Sequence
  chemically synthesized
aagtaactagtgaaaatttt

SEQ ID NO: 469641 - DNA, 20 bp, Artificial Sequence
  chemically synthesized
tttcgaatcacttttgtatt

SEQ ID NO: 469642 - DNA, 20 bp, Artificial Sequence
  chemically synthesized
ctgctcttatctctgtacag

SEQ ID NO: 469643 - DNA, 20 bp, Artificial Sequence
  chemically synthesized
tcttatctctgtacaggtga

SEQ ID NO: 469644 - DNA, 20 bp, Artificial Sequence
  chemically synthesized
aacacatagaacagcaaatg

SEQ ID NO: 469645 - DNA, 20 bp, Artificial Sequence
  chemically synthesized
tgcagtgtgctctgctaaaa

SEQ ID NO: 469646 - DNA, 20 bp, Artificial Sequence
  chemically synthesized
gtgctcttcagtcttctgtg

SEQ ID NO: 469647 - DNA, 20 bp, Artificial Sequence
  chemically synthesized
ccctaaacaaacatgtcaaa

SEQ ID NO: 469648 - DNA, 20 bp, Artificial Sequence
  chemically synthesized
tcaaaatagctccatgaaag

SEQ ID NO: 469649 - DNA, 20 bp, Artificial Sequence
  chemically synthesized
ctccttttcgggtccatagc

SEQ ID NO: 469650 - DNA, 20 bp, Artificial Sequence
  chemically synthesized
ttgatattctcacctccttt

SEQ ID NO: 469651 - DNA, 20 bp, Artificial Sequence
  chemically synthesized
tatggacccgaaaaggaggt

SEQ ID NO: 469652 - DNA, 20 bp, Artificial Sequence
  chemically synthesized
gtatctgctggttgcttatt

SEQ ID NO: 469653 - DNA, 20 bp, Artificial Sequence
  chemically synthesized
aaccattgtttccttaagct

SEQ ID NO: 469654 - DNA, 20 bp, Artificial Sequence
  chemically synthesized
ctttaaagatatatctacta

SEQ ID NO: 469655 - DNA, 20 bp, Artificial Sequence
  chemically synthesized
gtgaagatgtattagaatac

SEQ ID NO: 469656 - DNA, 20 bp, Artificial Sequence
  chemically synthesized
tttagaaagtgaagatgtat

SEQ ID NO: 469657 - DNA, 20 bp, Artificial Sequence
  chemically synthesized
tctaaattatgtttacagta

SEQ ID NO: 469658 - DNA, 20 bp, Artificial Sequence
  chemically synthesized
acccccacagccctcatgca

SEQ ID NO: 469659 - DNA, 20 bp, Artificial Sequence
  chemically synthesized
accctatgcatgagggctgt

SEQ ID NO: 469660 - DNA, 20 bp, Artificial Sequence
  chemically synthesized
tgagggctgtgggggtgaga

SEQ ID NO: 469661 - DNA, 20 bp, Artificial Sequence
  chemically synthesized
ggggtgagagagggtgggga

SEQ ID NO: 469662 - DNA, 20 bp, Artificial Sequence
  chemically synthesized
aaaagaaatggctgactctc

SEQ ID NO: 469663 - DNA, 20 bp, Artificial Sequence
  chemically synthesized
gcacagcaaagaggatcctg

SEQ ID NO: 469664 - DNA, 20 bp, Artificial Sequence
  chemically synthesized
tgcttttcctgcacagcaaa

SEQ ID NO: 469665 - DNA, 20 bp, Artificial Sequence
  chemically synthesized
agcaggcaggacttcaacac

SEQ ID NO: 469666 - DNA, 20 bp, Artificial Sequence
  chemically synthesized
agagcctcaggaaccattag

SEQ ID NO: 469667 - DNA, 20 bp, Artificial Sequence
  chemically synthesized
gtggcatacatagaaaggaa

SEQ ID NO: 469668 - DNA, 20 bp, Artificial Sequence
  chemically synthesized
cttacataggaaggaatagc

SEQ ID NO: 469669 - DNA, 20 bp, Artificial Sequence
  chemically synthesized
aaaatctgtcttacatagga

SEQ ID NO: 469670 - DNA, 20 bp, Artificial Sequence
  chemically synthesized
cagattttttttgtctttta

SEQ ID NO: 469671 - DNA, 20 bp, Artificial Sequence
  chemically synthesized
taaagcaaccttctggctct

SEQ ID NO: 469672 - DNA, 20 bp, Artificial Sequence
  chemically synthesized
cagagatatggagactcact

SEQ ID NO: 469673 - DNA, 20 bp, Artificial Sequence
  chemically synthesized
atcctgccataacacccaga

SEQ ID NO: 469674 - DNA, 20 bp, Artificial Sequence
  chemically synthesized
agatatcctgccataacacc

SEQ ID NO: 469675 - DNA, 20 bp, Artificial Sequence
  chemically synthesized
actcactctgggtgttatgg

SEQ ID NO: 469676 - DNA, 20 bp, Artificial Sequence
  chemically synthesized
acatattgtaagggggaaaa

SEQ ID NO: 469677 - DNA, 20 bp, Artificial Sequence
  chemically synthesized
gttgtcattagcatggaatg

SEQ ID NO: 469678 - DNA, 20 bp, Artificial Sequence
  chemically synthesized
tcctactgttgtcattagca

SEQ ID NO: 469679 - DNA, 20 bp, Artificial Sequence
  chemically synthesized
ttccatgctaatgacaacag

SEQ ID NO: 469680 - DNA, 20 bp, Artificial Sequence
  chemically synthesized
attgacctataggatgaact

SEQ ID NO: 469681 - DNA, 20 bp, Artificial Sequence
  chemically synthesized
agaatatacagattgaccta

SEQ ID NO: 469682 - DNA, 20 bp, Artificial Sequence
  chemically synthesized
gaattatttatacatcaaca

SEQ ID NO: 469683 - DNA, 20 bp, Artificial Sequence
  chemically synthesized
tttctgtgctaattagatca

SEQ ID NO: 469684 - DNA, 20 bp, Artificial Sequence
  chemically synthesized
tagcacagaaacagaaagag

SEQ ID NO: 469685 - DNA, 20 bp, Artificial Sequence
  chemically synthesized
ccataagtgtaagttgcctg

SEQ ID NO: 469686 - DNA, 20 bp, Artificial Sequence
  chemically synthesized
gatgtagttgtctgtgcagt

SEQ ID NO: 469687 - DNA, 20 bp, Artificial Sequence
  chemically synthesized
agggttaattccagagaggc

SEQ ID NO: 469688 - DNA, 20 bp, Artificial Sequence
  chemically synthesized
cgtgccaactccagcctctc

SEQ ID NO: 469689 - DNA, 20 bp, Artificial Sequence
  chemically synthesized
tactgtgttgaagtgtagcc

SEQ ID NO: 469690 - DNA, 20 bp, Artificial Sequence
  chemically synthesized
ttccgttggtctgactgtgc

SEQ ID NO: 469691 - DNA, 20 bp, Artificial Sequence
  chemically synthesized
agtcagaccaacggaagcca

SEQ ID NO: 469692 - DNA, 20 bp, Artificial Sequence
  chemically synthesized
cagtatgcctaggttaccca

SEQ ID NO: 469693 - DNA, 20 bp, Artificial Sequence
  chemically synthesized
gccagggtttcttatatccc

SEQ ID NO: 469694 - DNA, 20 bp, Artificial Sequence
  chemically synthesized
gcacaaattggagtttcagc

SEQ ID NO: 469695 - DNA, 20 bp, Artificial Sequence
  chemically synthesized
ggaaaccagggagcacaaat

SEQ ID NO: 469696 - DNA, 20 bp, Artificial Sequence
  chemically synthesized
ccacagcctgcctcacagca

SEQ ID NO: 469697 - DNA, 20 bp, Artificial Sequence
  chemically synthesized
tatacccacaacattaaaac

SEQ ID NO: 469698 - DNA, 20 bp, Artificial Sequence
  chemically synthesized
cttattcttgttttaatgtt

SEQ ID NO: 469699 - DNA, 20 bp, Artificial Sequence
  chemically synthesized
tctagagttccttgcagaaa

SEQ ID NO: 469700 - DNA, 20 bp, Artificial Sequence
  chemically synthesized
aatgacagtgcttacgaatc

SEQ ID NO: 469701 - DNA, 20 bp, Artificial Sequence
  chemically synthesized
ggaaccaaatgacagtgctt

SEQ ID NO: 469702 - DNA, 20 bp, Artificial Sequence
  chemically synthesized
agcactgtcatttggttcct

SEQ ID NO: 469703 - DNA, 20 bp, Artificial Sequence
  chemically synthesized
ccctgacagtggaagttaaa

SEQ ID NO: 469704 - DNA, 20 bp, Artificial Sequence
  chemically synthesized
taacttccactgtcagggca

SEQ ID NO: 469705 - DNA, 20 bp, Artificial Sequence
  chemically synthesized
agtcatacttttagctaaga

SEQ ID NO: 469706 - DNA, 20 bp, Artificial Sequence
  chemically synthesized
cctcagtcatacttttagct

SEQ ID NO: 469707 - DNA, 20 bp, Artificial Sequence
  chemically synthesized
aaaaagaagattctgataaa

SEQ ID NO: 469708 - DNA, 20 bp, Artificial Sequence
  chemically synthesized
ttctttttcatcccttttat

SEQ ID NO: 469709 - DNA, 20 bp, Artificial Sequence
  chemically synthesized
ctgatggtgtaactttctag

SEQ ID NO: 469710 - DNA, 20 bp, Artificial Sequence
  chemically synthesized
gaacctaaggagctaacaaa

SEQ ID NO: 469711 - DNA, 20 bp, Artificial Sequence
  chemically synthesized
tctgaacttaacattagctt

SEQ ID NO: 469712 - DNA, 20 bp, Artificial Sequence
  chemically synthesized
ccaaaagctaatgttaagtt

SEQ ID NO: 469713 - DNA, 20 bp, Artificial Sequence
  chemically synthesized
gactccacctgcaggccaga

SEQ ID NO: 469714 - DNA, 20 bp, Artificial Sequence
  chemically synthesized
caccctctctggcctgcagg

SEQ ID NO: 469715 - DNA, 20 bp, Artificial Sequence
  chemically synthesized
aatacctgtaagtgccccac

SEQ ID NO: 469716 - DNA, 20 bp, Artificial Sequence
  chemically synthesized
aagaaacctgtagtgacata

SEQ ID NO: 469717 - DNA, 20 bp, Artificial Sequence
  chemically synthesized
cctgaactggggctacaatt

SEQ ID NO: 469718 - DNA, 20 bp, Artificial Sequence
  chemically synthesized
atagccatagtatcttattt

SEQ ID NO: 469719 - DNA, 20 bp, Artificial Sequence
  chemically synthesized
cttaagcacaagcattccac

SEQ ID NO: 469720 - DNA, 20 bp, Artificial Sequence
  chemically synthesized
atccattccattgatccttg

SEQ ID NO: 469721 - DNA, 20 bp, Artificial Sequence
  chemically synthesized
aagcattccacaaggatcaa

SEQ ID NO: 469722 - DNA, 20 bp, Artificial Sequence
  chemically synthesized
attccacaaggatcaatgga

SEQ ID NO: 469723 - DNA, 20 bp, Artificial Sequence
  chemically synthesized
aattaggcaaggcacaagga

SEQ ID NO: 469724 - DNA, 20 bp, Artificial Sequence
  chemically synthesized
aagatattttcaacctatga

SEQ ID NO: 469725 - DNA, 20 bp, Artificial Sequence
  chemically synthesized
aaggtaggctaggctaagct

SEQ ID NO: 469726 - DNA, 20 bp, Artificial Sequence
  chemically synthesized
gctgctgcccagcaagggga

SEQ ID NO: 469727 - DNA, 20 bp, Artificial Sequence
  chemically synthesized
tagaaactctacttctagat

SEQ ID NO: 469728 - DNA, 20 bp, Artificial Sequence
  chemically synthesized
tcaaaattcaaatctagaag

SEQ ID NO: 469729 - DNA, 20 bp, Artificial Sequence
  chemically synthesized
atctagaagtagagtttcta

SEQ ID NO: 469730 - DNA, 20 bp, Artificial Sequence
  chemically synthesized
ttttttttttttttttgaga

SEQ ID NO: 469731 - DNA, 20 bp, Artificial Sequence
  chemically synthesized
tcgcgccactgtcctccagc

SEQ ID NO: 469732 - DNA, 20 bp, Artificial Sequence
  chemically synthesized
tactcgggagtctgaggcag

SEQ ID NO: 469733 - DNA, 20 bp, Artificial Sequence
  chemically synthesized
cattctcctgcctcagactc

SEQ ID NO: 469734 - DNA, 20 bp, Artificial Sequence
  chemically synthesized
gactgtagtcccagctactc

SEQ ID NO: 469735 - DNA, 20 bp, Artificial Sequence
  chemically synthesized
ttttgtatttttagtagaga

SEQ ID NO: 469736 - DNA, 20 bp, Artificial Sequence
  chemically synthesized
tggggtttcaccgtgttagc

SEQ ID NO: 469737 - DNA, 20 bp, Artificial Sequence
  chemically synthesized
ggcaggcagatcacgaggtc

SEQ ID NO: 469738 - DNA, 20 bp, Artificial Sequence
  chemically synthesized
gcctcggcctcccgaagtgc

SEQ ID NO: 469739 - DNA, 20 bp, Artificial Sequence
  chemically synthesized
tacggagaggtttaaaataa

SEQ ID NO: 469740 - DNA, 20 bp, Artificial Sequence
  chemically synthesized
tcccccaccccaagaggcat

SEQ ID NO: 469741 - DNA, 20 bp, Artificial Sequence
  chemically synthesized
gcttagactcagatgcctct

SEQ ID NO: 469742 - DNA, 20 bp, Artificial Sequence
  chemically synthesized
caaggaggaggaggttttag

SEQ ID NO: 469743 - DNA, 20 bp, Artificial Sequence
  chemically synthesized
ctccttgaaagagccaagat

SEQ ID NO: 469744 - DNA, 20 bp, Artificial Sequence
  chemically synthesized
aagagccaagatgtgagtgg

SEQ ID NO: 469745 - DNA, 20 bp, Artificial Sequence
  chemically synthesized
cagccaacctatccaacaca

SEQ ID NO: 469746 - DNA, 20 bp, Artificial Sequence
  chemically synthesized
ccatctcgtcatccagtgtg

SEQ ID NO: 469747 - DNA, 20 bp, Artificial Sequence
  chemically synthesized
agaagaaccaaaagacatta

SEQ ID NO: 469748 - DNA, 20 bp, Artificial Sequence
  chemically synthesized
tgtgtcaggaaataacctga

SEQ ID NO: 469749 - DNA, 20 bp, Artificial Sequence
  chemically synthesized
tcattgttcttcagatttga

SEQ ID NO: 469750 - DNA, 20 bp, Artificial Sequence
  chemically synthesized
cccactaatggctttccaca

SEQ ID NO: 469751 - DNA, 20 bp, Artificial Sequence
  chemically synthesized
ctccgtgtggaaagccatta

SEQ ID NO: 469752 - DNA, 20 bp, Artificial Sequence
  chemically synthesized
ggagggacaattgggacagc

SEQ ID NO: 469753 - DNA, 20 bp, Artificial Sequence
  chemically synthesized
atcagtgacagatatttaag

SEQ ID NO: 469754 - DNA, 20 bp, Artificial Sequence
  chemically synthesized
tgagactgaaaagctagaaa

SEQ ID NO: 469755 - DNA, 20 bp, Artificial Sequence
  chemically synthesized
tgaaaagctagaaattggat

SEQ ID NO: 469756 - DNA, 20 bp, Artificial Sequence
  chemically synthesized
actcctaaaaggactttggt

SEQ ID NO: 469757 - DNA, 20 bp, Artificial Sequence
  chemically synthesized
acccaaaccaaagtcctttt

SEQ ID NO: 469758 - DNA, 20 bp, Artificial Sequence
  chemically synthesized
tgtgactaggctaaaatcat

SEQ ID NO: 469759 - DNA, 20 bp, Artificial Sequence
  chemically synthesized
tgtctggtgggccaaggggc

SEQ ID NO: 469760 - DNA, 20 bp, Artificial Sequence
  chemically synthesized
agaagtttcttttatttcaa

SEQ ID NO: 469761 - DNA, 20 bp, Artificial Sequence
  chemically synthesized
ataaaagaaacttctattag

SEQ ID NO: 469762 - DNA, 20 bp, Artificial Sequence
  chemically synthesized
gctagagatacctggccagg

SEQ ID NO: 469763 - DNA, 20 bp, Artificial Sequence
  chemically synthesized
ctggccaggtagaatttgct

SEQ ID NO: 469764 - DNA, 20 bp, Artificial Sequence
  chemically synthesized
ccctatccttcctcctggaa

SEQ ID NO: 469765 - DNA, 20 bp, Artificial Sequence
  chemically synthesized
gggcatccaattccaggagg

SEQ ID NO: 469766 - DNA, 20 bp, Artificial Sequence
  chemically synthesized
gccatccctatccttcctcc

SEQ ID NO: 469767 - DNA, 20 bp, Artificial Sequence
  chemically synthesized
ccaattccaggaggaaggat

SEQ ID NO: 469768 - DNA, 20 bp, Artificial Sequence
  chemically synthesized
gctgccaaggttgatagctg

SEQ ID NO: 469769 - DNA, 20 bp, Artificial Sequence
  chemically synthesized
agaaaaccattctttcccta

SEQ ID NO: 469770 - DNA, 20 bp, Artificial Sequence
  chemically synthesized
tagctgttacccactaggga

SEQ ID NO: 469771 - DNA, 20 bp, Artificial Sequence
  chemically synthesized
gtatttcccctgggagatag

SEQ ID NO: 469772 - DNA, 20 bp, Artificial Sequence
  chemically synthesized
aggccatgtctctgttagtt

SEQ ID NO: 469773 - DNA, 20 bp, Artificial Sequence
  chemically synthesized
acaggctgcctccacagcaa

SEQ ID NO: 469774 - DNA, 20 bp, Artificial Sequence
  chemically synthesized
tgtggaggcagcctgtggct

SEQ ID NO: 469775 - DNA, 20 bp, Artificial Sequence
  chemically synthesized
aagagcattactgtcaggat

SEQ ID NO: 469776 - DNA, 20 bp, Artificial Sequence
  chemically synthesized
cattacaagagcattactgt

SEQ ID NO: 469777 - DNA, 20 bp, Artificial Sequence
  chemically synthesized
gccttttctggcaatagagc

SEQ ID NO: 469778 - DNA, 20 bp, Artificial Sequence
  chemically synthesized
gatttgtaagccatgttatt

SEQ ID NO: 469779 - DNA, 20 bp, Artificial Sequence
  chemically synthesized
gccatgttattgtgggtcct

SEQ ID NO: 469780 - DNA, 20 bp, Artificial Sequence
  chemically synthesized
tcaccttttgatggtgcgct

SEQ ID NO: 469781 - DNA, 20 bp, Artificial Sequence
  chemically synthesized
cctggtttgtcatggtgagg

SEQ ID NO: 469782 - DNA, 20 bp, Artificial Sequence
  chemically synthesized
ttggtacaggctggagttgt

SEQ ID NO: 469783 - DNA, 20 bp, Artificial Sequence
  chemically synthesized
tatagagatttggtacaggc

SEQ ID NO: 469784 - DNA, 20 bp, Artificial Sequence
  chemically synthesized
tataatgtgtgctttagttg

SEQ ID NO: 469785 - DNA, 20 bp, Artificial Sequence
  chemically synthesized
tctctatttcttactgtttg

SEQ ID NO: 469786 - DNA, 20 bp, Artificial Sequence
  chemically synthesized
tagtttattaataatgtgtg

SEQ ID NO: 469787 - DNA, 20 bp, Artificial Sequence
  chemically synthesized
ttttagaagcctcacacctg

SEQ ID NO: 469788 - DNA, 20 bp, Artificial Sequence
  chemically synthesized
accttcttcataactttcaa

SEQ ID NO: 469789 - DNA, 20 bp, Artificial Sequence
  chemically synthesized
aaagataaaatcttggtaag

SEQ ID NO: 469790 - DNA, 20 bp, Artificial Sequence
  chemically synthesized
caatgtgttgagaggcagta

SEQ ID NO: 469791 - DNA, 20 bp, Artificial Sequence
  chemically synthesized
tgatgctctccacttaaata

SEQ ID NO: 469792 - DNA, 20 bp, Artificial Sequence
  chemically synthesized
taaatagtgaattctctata

SEQ ID NO: 469793 - DNA, 20 bp, Artificial Sequence
  chemically synthesized
acccaattgtatccactata

SEQ ID NO: 469794 - DNA, 20 bp, Artificial Sequence
  chemically synthesized
attctctatagtggatacaa

SEQ ID NO: 469795 - DNA, 20 bp, Artificial Sequence
  chemically synthesized
tcctggtgccagtgaagagt

SEQ ID NO: 469796 - DNA, 20 bp, Artificial Sequence
  chemically synthesized
gtgatttcctggtgccagtg

SEQ ID NO: 469797 - DNA, 20 bp, Artificial Sequence
  chemically synthesized
tcattaattttccttaaagt

SEQ ID NO: 469798 - DNA, 20 bp, Artificial Sequence
  chemically synthesized
ttactttcaatatatgattt

SEQ ID NO: 469799 - DNA, 20 bp, Artificial Sequence
  chemically synthesized
accacacatatgttcaataa

SEQ ID NO: 469800 - DNA, 20 bp, Artificial Sequence
  chemically synthesized
acatatgttcaataaaagga

SEQ ID NO: 469801 - DNA, 20 bp, Artificial Sequence
  chemically synthesized
tatagtaaaactatagaatg

SEQ ID NO: 469802 - DNA, 20 bp, Artificial Sequence
  chemically synthesized
tgccatatatagtaaaacta

SEQ ID NO: 469803 - DNA, 20 bp, Artificial Sequence
  chemically synthesized
tgaattctcattaatgctag

SEQ ID NO: 469804 - DNA, 20 bp, Artificial Sequence
  chemically synthesized
ggcaccctcctagcattaat

SEQ ID NO: 469805 - DNA, 20 bp, Artificial Sequence
  chemically synthesized
gtatgtatctaaattaagta

SEQ ID NO: 469806 - DNA, 20 bp, Artificial Sequence
  chemically synthesized
acaccttaattttggcatac

SEQ ID NO: 469807 - DNA, 20 bp, Artificial Sequence
  chemically synthesized
atgctcagaaaggaaatgca

SEQ ID NO: 469808 - DNA, 20 bp, Artificial Sequence
  chemically synthesized
ataaaggtaagctccgaatg

SEQ ID NO: 469809 - DNA, 20 bp, Artificial Sequence
  chemically synthesized
ccttgtaataaaggtaagct

SEQ ID NO: 469810 - DNA, 20 bp, Artificial Sequence
  chemically synthesized
aataaactttgggaaaatgg

SEQ ID NO: 469811 - DNA, 20 bp, Artificial Sequence
  chemically synthesized
acagacaataaaacacatat

SEQ ID NO: 469812 - DNA, 20 bp, Artificial Sequence
  chemically synthesized
caataaaacacatatgtgaa

SEQ ID NO: 469813 - DNA, 20 bp, Artificial Sequence
  chemically synthesized
attttttttgagcaggaaaa

SEQ ID NO: 469814 - DNA, 20 bp, Artificial Sequence
  chemically synthesized
aatcgaataatgcctaaatc

SEQ ID NO: 469815 - DNA, 20 bp, Artificial Sequence
  chemically synthesized
ctataatgtccattttcacc

SEQ ID NO: 469816 - DNA, 20 bp, Artificial Sequence
  chemically synthesized
tttttccatctggtctattt

SEQ ID NO: 469817 - DNA, 20 bp, Artificial Sequence
  chemically synthesized
atggttagcttctgaacttt

SEQ ID NO: 469818 - DNA, 20 bp, Artificial Sequence
  chemically synthesized
ctgaacttttaggatctcac

SEQ ID NO: 469819 - DNA, 20 bp, Artificial Sequence
  chemically synthesized
ctggttatcatgaagtgcta

SEQ ID NO: 469820 - DNA, 20 bp, Artificial Sequence
  chemically synthesized
ctactgctttcctttaataa

SEQ ID NO: 469821 - DNA, 20 bp, Artificial Sequence
  chemically synthesized
ttaaaggaaagcagtagctc

SEQ ID NO: 469822 - DNA, 20 bp, Artificial Sequence
  chemically synthesized
gatgggatcgagtcaggggg

SEQ ID NO: 469823 - DNA, 20 bp, Artificial Sequence
  chemically synthesized
aaaagtagtttgggatggga

SEQ ID NO: 469824 - DNA, 20 bp, Artificial Sequence
  chemically synthesized
tgggaaaaagtagtttggga

SEQ ID NO: 469825 - DNA, 20 bp, Artificial Sequence
  chemically synthesized
atagctgggaaaaagtagtt

SEQ ID NO: 469826 - DNA, 20 bp, Artificial Sequence
  chemically synthesized
tttaaagggctttccaggtc

SEQ ID NO: 469827 - DNA, 20 bp, Artificial Sequence
  chemically synthesized
tgttttcatgagatgaatgc

SEQ ID NO: 469828 - DNA, 20 bp, Artificial Sequence
  chemically synthesized
gttcaatatgttttcatgag

SEQ ID NO: 469829 - DNA, 20 bp, Artificial Sequence
  chemically synthesized
caggttttgtactaagcatt

SEQ ID NO: 469830 - DNA, 20 bp, Artificial Sequence
  chemically synthesized
gagaagaaatgccttagaag

SEQ ID NO: 469831 - DNA, 20 bp, Artificial Sequence
  chemically synthesized
ggctagcaataagatagtca

SEQ ID NO: 469832 - DNA, 20 bp, Artificial Sequence
  chemically synthesized
gaaataaaggggttcaacca

SEQ ID NO: 469833 - DNA, 20 bp, Artificial Sequence
  chemically synthesized
tgccaggtcttcagaaataa

SEQ ID NO: 469834 - DNA, 20 bp, Artificial Sequence
  chemically synthesized
atttctgaagacctggcagc

SEQ ID NO: 469835 - DNA, 20 bp, Artificial Sequence
  chemically synthesized
atgccaatgttgaaatcatg

SEQ ID NO: 469836 - DNA, 20 bp, Artificial Sequence
  chemically synthesized
ctgagaggctagaatgatgc

SEQ ID NO: 469837 - DNA, 20 bp, Artificial Sequence
  chemically synthesized
aagttaaggaactgagaggc

SEQ ID NO: 469838 - DNA, 20 bp, Artificial Sequence
  chemically synthesized
gtggcagaggtagagtggat

SEQ ID NO: 469839 - DNA, 20 bp, Artificial Sequence
  chemically synthesized
gagtaggtggcagaggtaga

SEQ ID NO: 469840 - DNA, 20 bp, Artificial Sequence
  chemically synthesized
atttgagtaggtggcagagg

SEQ ID NO: 469841 - DNA, 20 bp, Artificial Sequence
  chemically synthesized
tagatctaggatatagccat

SEQ ID NO: 469842 - DNA, 20 bp, Artificial Sequence
  chemically synthesized
cagtttcaggtgattagatc

SEQ ID NO: 469843 - DNA, 20 bp, Artificial Sequence
  chemically synthesized
gtcaagaagttgtggtcaga

SEQ ID NO: 469844 - DNA, 20 bp, Artificial Sequence
  chemically synthesized
cttcttcccctacctccctg

SEQ ID NO: 469845 - DNA, 20 bp, Artificial Sequence
  chemically synthesized
aactggtaattaggaggtag

SEQ ID NO: 469846 - DNA, 20 bp, Artificial Sequence
  chemically synthesized
atgatactgacaagtccctg

SEQ ID NO: 469847 - DNA, 20 bp, Artificial Sequence
  chemically synthesized
aacagctgggcaagagaagt

SEQ ID NO: 469848 - DNA, 20 bp, Artificial Sequence
  chemically synthesized
ggagccagatgcttctgtcc

SEQ ID NO: 469849 - DNA, 20 bp, Artificial Sequence
  chemically synthesized
tcacggtagctccaatctgc

SEQ ID NO: 469850 - DNA, 20 bp, Artificial Sequence
  chemically synthesized
cgtgaaacactcagccgcct

SEQ ID NO: 469851 - DNA, 20 bp, Artificial Sequence
  chemically synthesized
ctgtgtgaacccagaggcgg

SEQ ID NO: 469852 - DNA, 20 bp, Artificial Sequence
  chemically synthesized
gtggagaataagagagaggg

SEQ ID NO: 469853 - DNA, 20 bp, Artificial Sequence
  chemically synthesized
aagttgggcttatctttgtg

SEQ ID NO: 469854 - DNA, 20 bp, Artificial Sequence
  chemically synthesized
tccattttttgtatggagtg

SEQ ID NO: 469855 - DNA, 20 bp, Artificial Sequence
  chemically synthesized
aaaggcttccattttttgta

SEQ ID NO: 469856 - DNA, 20 bp, Artificial Sequence
  chemically synthesized
aaccaggtagcagcaaggtg

SEQ ID NO: 469857 - DNA, 20 bp, Artificial Sequence
  chemically synthesized
gtaatgggtggggtagaggg

SEQ ID NO: 469858 - DNA, 20 bp, Artificial Sequence
  chemically synthesized
ctctcttccactgtaatggg

SEQ ID NO: 469859 - DNA, 20 bp, Artificial Sequence
  chemically synthesized
gatacctctcttccactgta

SEQ ID NO: 469860 - DNA, 20 bp, Artificial Sequence
  chemically synthesized
tctcttccctcccttgggct

SEQ ID NO: 469861 - DNA, 20 bp, Artificial Sequence
  chemically synthesized
ataaataatgggtgttctca

SEQ ID NO: 469862 - DNA, 20 bp, Artificial Sequence
  chemically synthesized
ccaagaggagatgataaata

SEQ ID NO: 469863 - DNA, 20 bp, Artificial Sequence
  chemically synthesized
tttatatgagtatgagaaga

SEQ ID NO: 469864 - DNA, 20 bp, Artificial Sequence
  chemically synthesized
attcgtgggaatgtatttat

SEQ ID NO: 469865 - DNA, 20 bp, Artificial Sequence
  chemically synthesized
actcatataaatacattccc

SEQ ID NO: 469866 - DNA, 20 bp, Artificial Sequence
  chemically synthesized
gccaaacatatagtattcgt

SEQ ID NO: 469867 - DNA, 20 bp, Artificial Sequence
  chemically synthesized
aactgcttgggtcaacttac

SEQ ID NO: 469868 - DNA, 20 bp, Artificial Sequence
  chemically synthesized
acaacatgggtttgaactgc

SEQ ID NO: 469869 - DNA, 20 bp, Artificial Sequence
  chemically synthesized
agttcaaacccatgttgttc

SEQ ID NO: 469870 - DNA, 20 bp, Artificial Sequence
  chemically synthesized
tacattgatccttgaacaac

SEQ ID NO: 469871 - DNA, 20 bp, Artificial Sequence
  chemically synthesized
ctgtacagcacgtgactgtt

SEQ ID NO: 469872 - DNA, 20 bp, Artificial Sequence
  chemically synthesized
tagtacacacctaggctgta

SEQ ID NO: 469873 - DNA, 20 bp, Artificial Sequence
  chemically synthesized
ttgttgttatgtcaatatag

SEQ ID NO: 469874 - DNA, 20 bp, Artificial Sequence
  chemically synthesized
gtcacgtgttgcttaacaat

SEQ ID NO: 469875 - DNA, 20 bp, Artificial Sequence
  chemically synthesized
tagctagttggagggggctg

SEQ ID NO: 469876 - DNA, 20 bp, Artificial Sequence
  chemically synthesized
acttatgaaggggagaagag

SEQ ID NO: 469877 - DNA, 20 bp, Artificial Sequence
  chemically synthesized
aatttacttatgaaggggag

SEQ ID NO: 469878 - DNA, 20 bp, Artificial Sequence
  chemically synthesized
cttcataagtaaatttctcc

SEQ ID NO: 469879 - DNA, 20 bp, Artificial Sequence
  chemically synthesized
agtggagaattagagaaggt

SEQ ID NO: 469880 - DNA, 20 bp, Artificial Sequence
  chemically synthesized
tcaaaagtgaaccaaaagtg

SEQ ID NO: 469881 - DNA, 20 bp, Artificial Sequence
  chemically synthesized
ggcacagtggaagtggtgtg

SEQ ID NO: 469882 - DNA, 20 bp, Artificial Sequence
  chemically synthesized
ttaccagggtcagatgttgc

SEQ ID NO: 469883 - DNA, 20 bp, Artificial Sequence
  chemically synthesized
agcaacatctgaccctggta

SEQ ID NO: 469884 - DNA, 20 bp, Artificial Sequence
  chemically synthesized
agaaagaaagaacccgttac

SEQ ID NO: 469885 - DNA, 20 bp, Artificial Sequence
  chemically synthesized
catgtggcatcataacctct

SEQ ID NO: 469886 - DNA, 20 bp, Artificial Sequence
  chemically synthesized
acctacagaagggactgcaa

SEQ ID NO: 469887 - DNA, 20 bp, Artificial Sequence
  chemically synthesized
aagggaagttatttaggaca

SEQ ID NO: 469888 - DNA, 20 bp, Artificial Sequence
  chemically synthesized
gcttgtaacgggggagagga

SEQ ID NO: 469889 - DNA, 20 bp, Artificial Sequence
  chemically synthesized
gtgctgcttgtaacggggga

SEQ ID NO: 469890 - DNA, 20 bp, Artificial Sequence
  chemically synthesized
gaaatatacaaacaacgttt

SEQ ID NO: 469891 - DNA, 20 bp, Artificial Sequence
  chemically synthesized
tgcttggcttggaatatcag

SEQ ID NO: 469892 - DNA, 20 bp, Artificial Sequence
  chemically synthesized
agacacttaggtgcttggct

SEQ ID NO: 469893 - DNA, 20 bp, Artificial Sequence
  chemically synthesized
gcttgatgtggtgggtgaaa

SEQ ID NO: 469894 - DNA, 20 bp, Artificial Sequence
  chemically synthesized
ggttggacaagcttgatgtg

SEQ ID NO: 469895 - DNA, 20 bp, Artificial Sequence
  chemically synthesized
agcttgtccaacctgtggcc

SEQ ID NO: 469896 - DNA, 20 bp, Artificial Sequence
  chemically synthesized
acctgtggcccaggatggct

SEQ ID NO: 469897 - DNA, 20 bp, Artificial Sequence
  chemically synthesized
tggctttgaatgaggcccaa

SEQ ID NO: 469898 - DNA, 20 bp, Artificial Sequence
  chemically synthesized
aaaatgttttaggaaagttt

SEQ ID NO: 469899 - DNA, 20 bp, Artificial Sequence
  chemically synthesized
tagcgttagtgtattttatg

SEQ ID NO: 469900 - DNA, 20 bp, Artificial Sequence
  chemically synthesized
tctccgggccacagtggaag

SEQ ID NO: 469901 - DNA, 20 bp, Artificial Sequence
  chemically synthesized
tgattcatttgatgtggtgc

SEQ ID NO: 469902 - DNA, 20 bp, Artificial Sequence
  chemically synthesized
acatccctgcaccacatcaa

SEQ ID NO: 469903 - DNA, 20 bp, Artificial Sequence
  chemically synthesized
aatttagaaatatttaggaa

SEQ ID NO: 469904 - DNA, 20 bp, Artificial Sequence
  chemically synthesized
tagtaagggagataagtgga

SEQ ID NO: 469905 - DNA, 20 bp, Artificial Sequence
  chemically synthesized
aatgtggtggcttgaattag

SEQ ID NO: 469906 - DNA, 20 bp, Artificial Sequence
  chemically synthesized
taaaccagcaatgtggtggc

SEQ ID NO: 469907 - DNA, 20 bp, Artificial Sequence
  chemically synthesized
agtatggattggtgcgatgt

SEQ ID NO: 469908 - DNA, 20 bp, Artificial Sequence
  chemically synthesized
ttcttgctgtggaacagagt

SEQ ID NO: 469909 - DNA, 20 bp, Artificial Sequence
  chemically synthesized
agatgattcttgctgtggaa

SEQ ID NO: 469910 - DNA, 20 bp, Artificial Sequence
  chemically synthesized
tccatactctgttccacagc

SEQ ID NO: 469911 - DNA, 20 bp, Artificial Sequence
  chemically synthesized
gaggtcaggggatttggcct

SEQ ID NO: 469912 - DNA, 20 bp, Artificial Sequence
  chemically synthesized
gttaaggaatttagaggtca

SEQ ID NO: 469913 - DNA, 20 bp, Artificial Sequence
  chemically synthesized
tgacctctaaattccttaac

SEQ ID NO: 469914 - DNA, 20 bp, Artificial Sequence
  chemically synthesized
ggtttttaaaacccaagtta

SEQ ID NO: 469915 - DNA, 20 bp, Artificial Sequence
  chemically synthesized
ttcacaatagatctttcccc

SEQ ID NO: 469916 - DNA, 20 bp, Artificial Sequence
  chemically synthesized
atgtcagtatggctaaagca

SEQ ID NO: 469917 - DNA, 20 bp, Artificial Sequence
  chemically synthesized
tactgacatattttcagttc

SEQ ID NO: 469918 - DNA, 20 bp, Artificial Sequence
  chemically synthesized
gagagagctgcttactcttc

SEQ ID NO: 469919 - DNA, 20 bp, Artificial Sequence
  chemically synthesized
tctaagctaggtaactctag

SEQ ID NO: 469920 - DNA, 20 bp, Artificial Sequence
  chemically synthesized
cctcttcaaacaaacattct

SEQ ID NO: 469921 - DNA, 20 bp, Artificial Sequence
  chemically synthesized
actgtgtggaatgagattca

SEQ ID NO: 469922 - DNA, 20 bp, Artificial Sequence
  chemically synthesized
tatgtgaacagctaactgtg

SEQ ID NO: 469923 - DNA, 20 bp, Artificial Sequence
  chemically synthesized
gttgtgcaacagtgggacaa

SEQ ID NO: 469924 - DNA, 20 bp, Artificial Sequence
  chemically synthesized
aaatatatgtataatgtatt

SEQ ID NO: 469925 - DNA, 20 bp, Artificial Sequence
  chemically synthesized
acagtctaacaagggataac

SEQ ID NO: 469926 - DNA, 20 bp, Artificial Sequence
  chemically synthesized
atggaacttacagtctaaca

SEQ ID NO: 469927 - DNA, 20 bp, Artificial Sequence
  chemically synthesized
gcctcagcctcccaaagtgc

SEQ ID NO: 469928 - DNA, 20 bp, Artificial Sequence
  chemically synthesized
cagcactttgggaggctgag

SEQ ID NO: 469929 - DNA, 20 bp, Artificial Sequence
  chemically synthesized
actttgggaggctgaggcgg

SEQ ID NO: 469930 - DNA, 20 bp, Artificial Sequence
  chemically synthesized
cgggtgaatcacctgaggtc

SEQ ID NO: 469931 - DNA, 20 bp, Artificial Sequence
  chemically synthesized
tttgtattttttaatagaga

SEQ ID NO: 469932 - DNA, 20 bp, Artificial Sequence
  chemically synthesized
tcctcggcctcccaaagtgc

SEQ ID NO: 469933 - DNA, 20 bp, Artificial Sequence
  chemically synthesized
actttgggaggccgaggagg

SEQ ID NO: 469934 - DNA, 20 bp, Artificial Sequence
  chemically synthesized
cggggtttcaccgtgttagc

SEQ ID NO: 469935 - DNA, 20 bp, Artificial Sequence
  chemically synthesized
ttttgtaattttagtagagg

SEQ ID NO: 469936 - DNA, 20 bp, Artificial Sequence
  chemically synthesized
aaaattagccaggcgtggtg

SEQ ID NO: 469937 - DNA, 20 bp, Artificial Sequence
  chemically synthesized
cattctcctggctcagcctc

SEQ ID NO: 469938 - DNA, 20 bp, Artificial Sequence
  chemically synthesized
tactccggaggctgagccag

SEQ ID NO: 469939 - DNA, 20 bp, Artificial Sequence
  chemically synthesized
aatggcgtgaacccgggagg

SEQ ID NO: 469940 - DNA, 20 bp, Artificial Sequence
  chemically synthesized
ctcactgcagactccacctc

SEQ ID NO: 469941 - DNA, 20 bp, Artificial Sequence
  chemically synthesized
acgcgccactgcactccagc

SEQ ID NO: 469942 - DNA, 20 bp, Artificial Sequence
  chemically synthesized
tctcgctctgtcaccctggc

SEQ ID NO: 469943 - DNA, 20 bp, Artificial Sequence
  chemically synthesized
tgttttgtttttttttgaga

SEQ ID NO: 469944 - DNA, 20 bp, Artificial Sequence
  chemically synthesized
gcgtcagcctcccaggtagc

SEQ ID NO: 469945 - DNA, 20 bp, Artificial Sequence
  chemically synthesized
tacctgggaggctgacgcag

SEQ ID NO: 469946 - DNA, 20 bp, Artificial Sequence
  chemically synthesized
ttgcccaggctggagtgcag

SEQ ID NO: 469947 - DNA, 20 bp, Artificial Sequence
  chemically synthesized
tcttgctctgttgcccaggc

SEQ ID NO: 469948 - DNA, 20 bp, Artificial Sequence
  chemically synthesized
ttttttttttttttttgaga

SEQ ID NO: 469949 - DNA, 20 bp, Artificial Sequence
  chemically synthesized
gtataactctactattgtct

SEQ ID NO: 469950 - DNA, 20 bp, Artificial Sequence
  chemically synthesized
cacagaccctcagacaatag

SEQ ID NO: 469951 - DNA, 20 bp, Artificial Sequence
  chemically synthesized
gatagagctgtgtaacactt

SEQ ID NO: 469952 - DNA, 20 bp, Artificial Sequence
  chemically synthesized
aagtggtagaggaaaaatga

SEQ ID NO: 469953 - DNA, 20 bp, Artificial Sequence
  chemically synthesized
gcttgaatgctaacgtgcag

SEQ ID NO: 469954 - DNA, 20 bp, Artificial Sequence
  chemically synthesized
gacatgtgtggtttattagc

SEQ ID NO: 469955 - DNA, 20 bp, Artificial Sequence
  chemically synthesized
aaaaaaaacaaaggtagaac

SEQ ID NO: 469956 - DNA, 20 bp, Artificial Sequence
  chemically synthesized
caagtttcacaaaggtaatt

SEQ ID NO: 469957 - DNA, 20 bp, Artificial Sequence
  chemically synthesized
tgatgttgaattaagatatt

SEQ ID NO: 469958 - DNA, 20 bp, Artificial Sequence
  chemically synthesized
ccattcctcagctactgatg

SEQ ID NO: 469959 - DNA, 20 bp, Artificial Sequence
  chemically synthesized
taattcaacatcagtagctg

SEQ ID NO: 469960 - DNA, 20 bp, Artificial Sequence
  chemically synthesized
agtagctgaggaatggtgac

SEQ ID NO: 469961 - DNA, 20 bp, Artificial Sequence
  chemically synthesized
agaatgttttgttttatttt

SEQ ID NO: 469962 - DNA, 20 bp, Artificial Sequence
  chemically synthesized
tccttggcctagagtttgcc

SEQ ID NO: 469963 - DNA, 20 bp, Artificial Sequence
  chemically synthesized
ttctaggcaaactctaggcc

SEQ ID NO: 469964 - DNA, 20 bp, Artificial Sequence
  chemically synthesized
tctttaatgtatccttggcc

SEQ ID NO: 469965 - DNA, 20 bp, Artificial Sequence
  chemically synthesized
tctaggccaaggatacatta

SEQ ID NO: 469966 - DNA, 20 bp, Artificial Sequence
  chemically synthesized
ggccaaggatacattaaaga

SEQ ID NO: 469967 - DNA, 20 bp, Artificial Sequence
  chemically synthesized
aatgaattatacattgcaac

SEQ ID NO: 469968 - DNA, 20 bp, Artificial Sequence
  chemically synthesized
tgcttagaataaaaagtagg

SEQ ID NO: 469969 - DNA, 20 bp, Artificial Sequence
  chemically synthesized
cttgatactatgtctttgct

SEQ ID NO: 469970 - DNA, 20 bp, Artificial Sequence
  chemically synthesized
aaagggccttctgcagtctt

SEQ ID NO: 469971 - DNA, 20 bp, Artificial Sequence
  chemically synthesized
tcatggcagtcctataagct

SEQ ID NO: 469972 - DNA, 20 bp, Artificial Sequence
  chemically synthesized
tttccctcttttcagctgac

SEQ ID NO: 469973 - DNA, 20 bp, Artificial Sequence
  chemically synthesized
gggttgtctgttatttctga

SEQ ID NO: 469974 - DNA, 20 bp, Artificial Sequence
  chemically synthesized
caaatcactgggcgtcgggg

SEQ ID NO: 469975 - DNA, 20 bp, Artificial Sequence
  chemically synthesized
ttggcaaatcactgggcgtc

SEQ ID NO: 469976 - DNA, 20 bp, Artificial Sequence
  chemically synthesized
ttttcttttccccacgttaa

SEQ ID NO: 469977 - DNA, 20 bp, Artificial Sequence
  chemically synthesized
cctggttgtcaaagggcaaa

SEQ ID NO: 469978 - DNA, 20 bp, Artificial Sequence
  chemically synthesized
cctcttgggaacaggactac

SEQ ID NO: 469979 - DNA, 20 bp, Artificial Sequence
  chemically synthesized
atttttttctagaaagtaat

SEQ ID NO: 469980 - DNA, 20 bp, Artificial Sequence
  chemically synthesized
agtaatctggatctactgta

SEQ ID NO: 469981 - DNA, 20 bp, Artificial Sequence
  chemically synthesized
agaagttatacatgctcact

SEQ ID NO: 469982 - DNA, 20 bp, Artificial Sequence
  chemically synthesized
atttttgagtttatgggctt

SEQ ID NO: 469983 - DNA, 20 bp, Artificial Sequence
  chemically synthesized
ccagccagttgtgcctattt

SEQ ID NO: 469984 - DNA, 20 bp, Artificial Sequence
  chemically synthesized
tcaaaaataggcacaactgg

SEQ ID NO: 469985 - DNA, 20 bp, Artificial Sequence
  chemically synthesized
gggattacaggcatgagcca

SEQ ID NO: 469986 - DNA, 20 bp, Artificial Sequence
  chemically synthesized
accttggcctctcaaagcgt

SEQ ID NO: 469987 - DNA, 20 bp, Artificial Sequence
  chemically synthesized
ataaactttttttgtagaga

SEQ ID NO: 469988 - DNA, 20 bp, Artificial Sequence
  chemically synthesized
aaataagcactgttaacatt

SEQ ID NO: 469989 - DNA, 20 bp, Artificial Sequence
  chemically synthesized
cacacacatagacacatatg

SEQ ID NO: 469990 - DNA, 20 bp, Artificial Sequence
  chemically synthesized
atgtatttaaaaatataatt

SEQ ID NO: 469991 - DNA, 20 bp, Artificial Sequence
  chemically synthesized
acattagaatgattgtacct

SEQ ID NO: 469992 - DNA, 20 bp, Artificial Sequence
  chemically synthesized
tgttattctgtgctgaacat

SEQ ID NO: 469993 - DNA, 20 bp, Artificial Sequence
  chemically synthesized
aatcattctaatgttcagca

SEQ ID NO: 469994 - DNA, 20 bp, Artificial Sequence
  chemically synthesized
atagcttcctgctaggtggc

SEQ ID NO: 469995 - DNA, 20 bp, Artificial Sequence
  chemically synthesized
ctatcaaggcttgtgcagac

SEQ ID NO: 469996 - DNA, 20 bp, Artificial Sequence
  chemically synthesized
cttcaaggagctttttggag

SEQ ID NO: 469997 - DNA, 20 bp, Artificial Sequence
  chemically synthesized
aaaatgacagaagtaggtga

SEQ ID NO: 469998 - DNA, 20 bp, Artificial Sequence
  chemically synthesized
atcatggaccgactgaccaa

SEQ ID NO: 469999 - DNA, 20 bp, Artificial Sequence
  chemically synthesized
ccaactgaatcaataaacaa

SEQ ID NO: 470000 - DNA, 20 bp, Artificial Sequence
  chemically synthesized
gccctttcctaacacctcat

SEQ ID NO: 470001 - DNA, 20 bp, Artificial Sequence
  chemically synthesized
ccaagtgacttggatatgga

SEQ ID NO: 470002 - DNA, 20 bp, Artificial Sequence
  chemically synthesized
ttgacccaagtgacttggat

SEQ ID NO: 470003 - DNA, 20 bp, Artificial Sequence
  chemically synthesized
tcaatccatatccaagtcac

SEQ ID NO: 470004 - DNA, 20 bp, Artificial Sequence
  chemically synthesized
aaaatgttgacccaagtgac

SEQ ID NO: 470005 - DNA, 20 bp, Artificial Sequence
  chemically synthesized
cagagaccaaacataaaagc

SEQ ID NO: 470006 - DNA, 20 bp, Artificial Sequence
  chemically synthesized
cttttaaacaaaattgtatg

SEQ ID NO: 470007 - DNA, 20 bp, Artificial Sequence
  chemically synthesized
tacaattttgtttaaaagac

SEQ ID NO: 470008 - DNA, 20 bp, Artificial Sequence
  chemically synthesized
ccggaataccaaatgttggt

SEQ ID NO: 470009 - DNA, 20 bp, Artificial Sequence
  chemically synthesized
tggtgaggatatggagcgac

SEQ ID NO: 470010 - DNA, 20 bp, Artificial Sequence
  chemically synthesized
attcccaacaagcagtgtct

SEQ ID NO: 470011 - DNA, 20 bp, Artificial Sequence
  chemically synthesized
attctcagacactgcttgtt

SEQ ID NO: 470012 - DNA, 20 bp, Artificial Sequence
  chemically synthesized
aatatccaggaaaagaatat

SEQ ID NO: 470013 - DNA, 20 bp, Artificial Sequence
  chemically synthesized
atgactcaaatattcttttc

SEQ ID NO: 470014 - DNA, 20 bp, Artificial Sequence
  chemically synthesized
tctgtgcaaatatccaggaa

SEQ ID NO: 470015 - DNA, 20 bp, Artificial Sequence
  chemically synthesized
tcttttcctggatatttgca

SEQ ID NO: 470016 - DNA, 20 bp, Artificial Sequence
  chemically synthesized
gtccacaaaaagatgtgtac

SEQ ID NO: 470017 - DNA, 20 bp, Artificial Sequence
  chemically synthesized
ctattatgaataaagctgct

SEQ ID NO: 470018 - DNA, 20 bp, Artificial Sequence
  chemically synthesized
gtttccggtttttgactatt

SEQ ID NO: 470019 - DNA, 20 bp, Artificial Sequence
  chemically synthesized
ggaaaccaaccagtaaggta

SEQ ID NO: 470020 - DNA, 20 bp, Artificial Sequence
  chemically synthesized
gttgtggtaaagtcattcag

SEQ ID NO: 470021 - DNA, 20 bp, Artificial Sequence
  chemically synthesized
ctttgcacagtagtatccca

SEQ ID NO: 470022 - DNA, 20 bp, Artificial Sequence
  chemically synthesized
ctgatctgaaaaacactaag

SEQ ID NO: 470023 - DNA, 20 bp, Artificial Sequence
  chemically synthesized
tactatgccagatggtagcc

SEQ ID NO: 470024 - DNA, 20 bp, Artificial Sequence
  chemically synthesized
atggtagcctggggtgtggt

SEQ ID NO: 470025 - DNA, 20 bp, Artificial Sequence
  chemically synthesized
aactgacctcaaaggaacac

SEQ ID NO: 470026 - DNA, 20 bp, Artificial Sequence
  chemically synthesized
ttgattggcatggtggttac

SEQ ID NO: 470027 - DNA, 20 bp, Artificial Sequence
  chemically synthesized
gccctgataaggtaaatttt

SEQ ID NO: 470028 - DNA, 20 bp, Artificial Sequence
  chemically synthesized
tcagagtgtactgttcatgt

SEQ ID NO: 470029 - DNA, 20 bp, Artificial Sequence
  chemically synthesized
aagctaacacacacatacat

SEQ ID NO: 470030 - DNA, 20 bp, Artificial Sequence
  chemically synthesized
ggtggtcagttgtcttaatc

SEQ ID NO: 470031 - DNA, 20 bp, Artificial Sequence
  chemically synthesized
cttaatcaggagtgaactcc

SEQ ID NO: 470032 - DNA, 20 bp, Artificial Sequence
  chemically synthesized
aattgctagccaaccaccct

SEQ ID NO: 470033 - DNA, 20 bp, Artificial Sequence
  chemically synthesized
gtaataagagctaaatataa

SEQ ID NO: 470034 - DNA, 20 bp, Artificial Sequence
  chemically synthesized
tatttagctcttattacacc

SEQ ID NO: 470035 - DNA, 20 bp, Artificial Sequence
  chemically synthesized
ttaaactcaatttaaaggca

SEQ ID NO: 470036 - DNA, 20 bp, Artificial Sequence
  chemically synthesized
aaacactccctgcctttaaa

SEQ ID NO: 470037 - DNA, 20 bp, Artificial Sequence
  chemically synthesized
gcctttaaattgagtttaag

SEQ ID NO: 470038 - DNA, 20 bp, Artificial Sequence
  chemically synthesized
ttctaaagatggagaaccta

SEQ ID NO: 470039 - DNA, 20 bp, Artificial Sequence
  chemically synthesized
tttagaaatggtgccctagg

SEQ ID NO: 470040 - DNA, 20 bp, Artificial Sequence
  chemically synthesized
tgaaccacagctggacattt

SEQ ID NO: 470041 - DNA, 20 bp, Artificial Sequence
  chemically synthesized
aaatgtccagctgtggttca

SEQ ID NO: 470042 - DNA, 20 bp, Artificial Sequence
  chemically synthesized
ttcaccggattcttagttgc

SEQ ID NO: 470043 - DNA, 20 bp, Artificial Sequence
  chemically synthesized
ctaactgaattctggcaact

SEQ ID NO: 470044 - DNA, 20 bp, Artificial Sequence
  chemically synthesized
ggattccctcaaccatctaa

SEQ ID NO: 470045 - DNA, 20 bp, Artificial Sequence
  chemically synthesized
gaattcagttagatggttga

SEQ ID NO: 470046 - DNA, 20 bp, Artificial Sequence
  chemically synthesized
gaaaaccattgttctagcag

SEQ ID NO: 470047 - DNA, 20 bp, Artificial Sequence
  chemically synthesized
tttcagacttgagcaaacat

SEQ ID NO: 470048 - DNA, 20 bp, Artificial Sequence
  chemically synthesized
gagcaaacatcagaatcacc

SEQ ID NO: 470049 - DNA, 20 bp, Artificial Sequence
  chemically synthesized
aaacatcagaatcacctgga

SEQ ID NO: 470050 - DNA, 20 bp, Artificial Sequence
  chemically synthesized
ccaggcccttcccataccta

SEQ ID NO: 470051 - DNA, 20 bp, Artificial Sequence
  chemically synthesized
agtaggtatgggaagggcct

SEQ ID NO: 470052 - DNA, 20 bp, Artificial Sequence
  chemically synthesized
tatgggaagggcctgggaat

SEQ ID NO: 470053 - DNA, 20 bp, Artificial Sequence
  chemically synthesized
cacaggccacagtcctctat

SEQ ID NO: 470054 - DNA, 20 bp, Artificial Sequence
  chemically synthesized
gaagtcacagttctgtcttt

SEQ ID NO: 470055 - DNA, 20 bp, Artificial Sequence
  chemically synthesized
ttaggagcatttattagcca

SEQ ID NO: 470056 - DNA, 20 bp, Artificial Sequence
  chemically synthesized
gtcctcaactacatctaacc

SEQ ID NO: 470057 - DNA, 20 bp, Artificial Sequence
  chemically synthesized
accaattacagagaacctgt

SEQ ID NO: 470058 - DNA, 20 bp, Artificial Sequence
  chemically synthesized
agtcaaagtgtgatttgagg

SEQ ID NO: 470059 - DNA, 20 bp, Artificial Sequence
  chemically synthesized
cttggagcttatgagaaatg

SEQ ID NO: 470060 - DNA, 20 bp, Artificial Sequence
  chemically synthesized
ctcaggccccacccagatct

SEQ ID NO: 470061 - DNA, 20 bp, Artificial Sequence
  chemically synthesized
attgattcggattcacagat

SEQ ID NO: 470062 - DNA, 20 bp, Artificial Sequence
  chemically synthesized
ccccacccagatctgtgaat

SEQ ID NO: 470063 - DNA, 20 bp, Artificial Sequence
  chemically synthesized
gctcttagtaaaatattgat

SEQ ID NO: 470064 - DNA, 20 bp, Artificial Sequence
  chemically synthesized
ttcatttaaagaacttccat

SEQ ID NO: 470065 - DNA, 20 bp, Artificial Sequence
  chemically synthesized
ttcatatggaagttctttaa

SEQ ID NO: 470066 - DNA, 20 bp, Artificial Sequence
  chemically synthesized
cacaggatggtgttggtata

SEQ ID NO: 470067 - DNA, 20 bp, Artificial Sequence
  chemically synthesized
tagaaaaacaaaagacaaca

SEQ ID NO: 470068 - DNA, 20 bp, Artificial Sequence
  chemically synthesized
ctacaccaaaacctcccctc

SEQ ID NO: 470069 - DNA, 20 bp, Artificial Sequence
  chemically synthesized
ctcccctctgggatatattt

SEQ ID NO: 470070 - DNA, 20 bp, Artificial Sequence
  chemically synthesized
tccgagatgcttttaattta

SEQ ID NO: 470071 - DNA, 20 bp, Artificial Sequence
  chemically synthesized
tcaataaattaaaagcatct

SEQ ID NO: 470072 - DNA, 20 bp, Artificial Sequence
  chemically synthesized
gtgagcagaacttgatctag

SEQ ID NO: 470073 - DNA, 20 bp, Artificial Sequence
  chemically synthesized
ggtctcagccaactcatggt

SEQ ID NO: 470074 - DNA, 20 bp, Artificial Sequence
  chemically synthesized
gccgcaagacaattcatacc

SEQ ID NO: 470075 - DNA, 20 bp, Artificial Sequence
  chemically synthesized
aggacaggaattggtttctc

SEQ ID NO: 470076 - DNA, 20 bp, Artificial Sequence
  chemically synthesized
accaatctggaggggaggac

SEQ ID NO: 470077 - DNA, 20 bp, Artificial Sequence
  chemically synthesized
aaaatttgatggtactggtg

SEQ ID NO: 470078 - DNA, 20 bp, Artificial Sequence
  chemically synthesized
ttttcctgtacttgctagtg

SEQ ID NO: 470079 - DNA, 20 bp, Artificial Sequence
  chemically synthesized
ccttacacacacactcatca

SEQ ID NO: 470080 - DNA, 20 bp, Artificial Sequence
  chemically synthesized
agagtcaaagggactcaatg

SEQ ID NO: 470081 - DNA, 20 bp, Artificial Sequence
  chemically synthesized
tctctacatttctttttata

SEQ ID NO: 470082 - DNA, 20 bp, Artificial Sequence
  chemically synthesized
caggctggtgttaatgggaa

SEQ ID NO: 470083 - DNA, 20 bp, Artificial Sequence
  chemically synthesized
ccagcctgtagcagtttcca

SEQ ID NO: 470084 - DNA, 20 bp, Artificial Sequence
  chemically synthesized
gaatgagagaaaatttggga

SEQ ID NO: 470085 - DNA, 20 bp, Artificial Sequence
  chemically synthesized
taaaggaatgagagaaaatt

SEQ ID NO: 470086 - DNA, 20 bp, Artificial Sequence
  chemically synthesized
caatacttttgcataagtaa

SEQ ID NO: 470087 - DNA, 20 bp, Artificial Sequence
  chemically synthesized
cctttacttatgcaaaagta

SEQ ID NO: 470088 - DNA, 20 bp, Artificial Sequence
  chemically synthesized
gttacgaggcagtggagaag

SEQ ID NO: 470089 - DNA, 20 bp, Artificial Sequence
  chemically synthesized
gatgataggaaactaggcac

SEQ ID NO: 470090 - DNA, 20 bp, Artificial Sequence
  chemically synthesized
tagaattggggtcataagag

SEQ ID NO: 470091 - DNA, 20 bp, Artificial Sequence
  chemically synthesized
ataggaaaagagggtagaat

SEQ ID NO: 470092 - DNA, 20 bp, Artificial Sequence
  chemically synthesized
aggaaaataggaaaagaggg

SEQ ID NO: 470093 - DNA, 20 bp, Artificial Sequence
  chemically synthesized
gaaccaggaaaataggaaaa

SEQ ID NO: 470094 - DNA, 20 bp, Artificial Sequence
  chemically synthesized
tagaccatttgttctaaatg

SEQ ID NO: 470095 - DNA, 20 bp, Artificial Sequence
  chemically synthesized
cttgatatgaacgctaagat

SEQ ID NO: 470096 - DNA, 20 bp, Artificial Sequence
  chemically synthesized
caaatcttagcgttcatatc

SEQ ID NO: 470097 - DNA, 20 bp, Artificial Sequence
  chemically synthesized
ccacttggatctctagctac

SEQ ID NO: 470098 - DNA, 20 bp, Artificial Sequence
  chemically synthesized
atcattcttgcctctcccac

SEQ ID NO: 470099 - DNA, 20 bp, Artificial Sequence
  chemically synthesized
gagatccaagtgggagaggc

SEQ ID NO: 470100 - DNA, 20 bp, Artificial Sequence
  chemically synthesized
tgatctgattctttcagggc

SEQ ID NO: 470101 - DNA, 20 bp, Artificial Sequence
  chemically synthesized
cactaatattcatgccctga

SEQ ID NO: 470102 - DNA, 20 bp, Artificial Sequence
  chemically synthesized
atattagtgtggaacagtat

SEQ ID NO: 470103 - DNA, 20 bp, Artificial Sequence
  chemically synthesized
cagggaggattaactagagg

SEQ ID NO: 470104 - DNA, 20 bp, Artificial Sequence
  chemically synthesized
taggctgaaaagatgtcagg

SEQ ID NO: 470105 - DNA, 20 bp, Artificial Sequence
  chemically synthesized
cttattcactgcagtgggtt

SEQ ID NO: 470106 - DNA, 20 bp, Artificial Sequence
  chemically synthesized
cctacccccaacccactgca

SEQ ID NO: 470107 - DNA, 20 bp, Artificial Sequence
  chemically synthesized
cagaaggcttattcactgca

SEQ ID NO: 470108 - DNA, 20 bp, Artificial Sequence
  chemically synthesized
gcctgaatcactgtttgaga

SEQ ID NO: 470109 - DNA, 20 bp, Artificial Sequence
  chemically synthesized
gtatgcctgaatcactgttt

SEQ ID NO: 470110 - DNA, 20 bp, Artificial Sequence
  chemically synthesized
gctactttcttctggtatgc

SEQ ID NO: 470111 - DNA, 20 bp, Artificial Sequence
  chemically synthesized
cataccagaagaaagtagca

SEQ ID NO: 470112 - DNA, 20 bp, Artificial Sequence
  chemically synthesized
gctaccaatgactttcttca

SEQ ID NO: 470113 - DNA, 20 bp, Artificial Sequence
  chemically synthesized
aaagtcattggtagcttgat

SEQ ID NO: 470114 - DNA, 20 bp, Artificial Sequence
  chemically synthesized
gtagcttgatggggatggca

SEQ ID NO: 470115 - DNA, 20 bp, Artificial Sequence
  chemically synthesized
attccatgctcatgggtagg

SEQ ID NO: 470116 - DNA, 20 bp, Artificial Sequence
  chemically synthesized
attcttcctacccatgagca

SEQ ID NO: 470117 - DNA, 20 bp, Artificial Sequence
  chemically synthesized
tggaagaacattccatgctc

SEQ ID NO: 470118 - DNA, 20 bp, Artificial Sequence
  chemically synthesized
cactgctcaaggaaataaaa

SEQ ID NO: 470119 - DNA, 20 bp, Artificial Sequence
  chemically synthesized
ggttccaagtctttgctatt

SEQ ID NO: 470120 - DNA, 20 bp, Artificial Sequence
  chemically synthesized
agtctatcattgttggacat

SEQ ID NO: 470121 - DNA, 20 bp, Artificial Sequence
  chemically synthesized
aaatgtccaacaatgataga

SEQ ID NO: 470122 - DNA, 20 bp, Artificial Sequence
  chemically synthesized
aatgtggcacatatacacca

SEQ ID NO: 470123 - DNA, 20 bp, Artificial Sequence
  chemically synthesized
aatactatgcagccataaaa

SEQ ID NO: 470124 - DNA, 20 bp, Artificial Sequence
  chemically synthesized
ctatgcagccataaaaaagg

SEQ ID NO: 470125 - DNA, 20 bp, Artificial Sequence
  chemically synthesized
ttcatgtcctttgtagggac

SEQ ID NO: 470126 - DNA, 20 bp, Artificial Sequence
  chemically synthesized
tgttcttgcgatagtttact

SEQ ID NO: 470127 - DNA, 20 bp, Artificial Sequence
  chemically synthesized
ttcaattcccacctatgagt

SEQ ID NO: 470128 - DNA, 20 bp, Artificial Sequence
  chemically synthesized
gcatattctcactcataggt

SEQ ID NO: 470129 - DNA, 20 bp, Artificial Sequence
  chemically synthesized
tcattgttcaattcccacct

SEQ ID NO: 470130 - DNA, 20 bp, Artificial Sequence
  chemically synthesized
gatcacatggacacaggaag

SEQ ID NO: 470131 - DNA, 20 bp, Artificial Sequence
  chemically synthesized
ccccaccccaccacagtccc

SEQ ID NO: 470132 - DNA, 20 bp, Artificial Sequence
  chemically synthesized
tcacactctggggactgtgg

SEQ ID NO: 470133 - DNA, 20 bp, Artificial Sequence
  chemically synthesized
ggggactgtggtggggtggg

SEQ ID NO: 470134 - DNA, 20 bp, Artificial Sequence
  chemically synthesized
ggtggggtggggggagtggg

SEQ ID NO: 470135 - DNA, 20 bp, Artificial Sequence
  chemically synthesized
ggggagtgggggggatagca

SEQ ID NO: 470136 - DNA, 20 bp, Artificial Sequence
  chemically synthesized
gatatacctaatgctagatg

SEQ ID NO: 470137 - DNA, 20 bp, Artificial Sequence
  chemically synthesized
taatgctagatgacgagtta

SEQ ID NO: 470138 - DNA, 20 bp, Artificial Sequence
  chemically synthesized
ttttattatactttaagttt

SEQ ID NO: 470139 - DNA, 20 bp, Artificial Sequence
  chemically synthesized
taactgtcagtgaactgcaa

SEQ ID NO: 470140 - DNA, 20 bp, Artificial Sequence
  chemically synthesized
cctacaagtctactactcaa

SEQ ID NO: 470141 - DNA, 20 bp, Artificial Sequence
  chemically synthesized
aacacaggcagttaactctc

SEQ ID NO: 470142 - DNA, 20 bp, Artificial Sequence
  chemically synthesized
gagttaactgcctgtgttgt

SEQ ID NO: 470143 - DNA, 20 bp, Artificial Sequence
  chemically synthesized
ttgagtccgcatgtgttgct

SEQ ID NO: 470144 - DNA, 20 bp, Artificial Sequence
  chemically synthesized
tcttccagctgtaagccgga

SEQ ID NO: 470145 - DNA, 20 bp, Artificial Sequence
  chemically synthesized
ctctgccttaggaaagtgtg

SEQ ID NO: 470146 - DNA, 20 bp, Artificial Sequence
  chemically synthesized
cactgtcctgggctaaagct

SEQ ID NO: 470147 - DNA, 20 bp, Artificial Sequence
  chemically synthesized
gacagtctctcatggggcac

SEQ ID NO: 470148 - DNA, 20 bp, Artificial Sequence
  chemically synthesized
gagctcattacaacttggat

SEQ ID NO: 470149 - DNA, 20 bp, Artificial Sequence
  chemically synthesized
gctagtgagctcattacaac

SEQ ID NO: 470150 - DNA, 20 bp, Artificial Sequence
  chemically synthesized
tctcacagccggaactcaag

SEQ ID NO: 470151 - DNA, 20 bp, Artificial Sequence
  chemically synthesized
cttggatagtctcactcctc

SEQ ID NO: 470152 - DNA, 20 bp, Artificial Sequence
  chemically synthesized
aacatggcgtaactggtttc

SEQ ID NO: 470153 - DNA, 20 bp, Artificial Sequence
  chemically synthesized
tgggagaaagcgcacttcag

SEQ ID NO: 470154 - DNA, 20 bp, Artificial Sequence
  chemically synthesized
tttataggctagaaccagcc

SEQ ID NO: 470155 - DNA, 20 bp, Artificial Sequence
  chemically synthesized
aaaccacctaccttctcaag

SEQ ID NO: 470156 - DNA, 20 bp, Artificial Sequence
  chemically synthesized
ttcatgtttcaaaataaaag

SEQ ID NO: 470157 - DNA, 20 bp, Artificial Sequence
  chemically synthesized
tgacacctgctactattaca

SEQ ID NO: 470158 - DNA, 20 bp, Artificial Sequence
  chemically synthesized
ccagttgttcctcttttctg

SEQ ID NO: 470159 - DNA, 20 bp, Artificial Sequence
  chemically synthesized
ttttttttctgtaatatctt

SEQ ID NO: 470160 - DNA, 20 bp, Artificial Sequence
  chemically synthesized
ctcagttcagtcagagatag

SEQ ID NO: 470161 - DNA, 20 bp, Artificial Sequence
  chemically synthesized
tctctgactgaactgaggtc

SEQ ID NO: 470162 - DNA, 20 bp, Artificial Sequence
  chemically synthesized
gaggtctagaatttaaaaca

SEQ ID NO: 470163 - DNA, 20 bp, Artificial Sequence
  chemically synthesized
ataatgacctcattaacttt

SEQ ID NO: 470164 - DNA, 20 bp, Artificial Sequence
  chemically synthesized
cactataccaatttatctgt

SEQ ID NO: 470165 - DNA, 20 bp, Artificial Sequence
  chemically synthesized
attaaatttcttctgggaaa

SEQ ID NO: 470166 - DNA, 20 bp, Artificial Sequence
  chemically synthesized
tcacttaccacctgggagat

SEQ ID NO: 470167 - DNA, 20 bp, Artificial Sequence
  chemically synthesized
tagagcacatatgcttttgg

SEQ ID NO: 470168 - DNA, 20 bp, Artificial Sequence
  chemically synthesized
tgcgtattgtatgccaaaca

SEQ ID NO: 470169 - DNA, 20 bp, Artificial Sequence
  chemically synthesized
atatgccacctttctataat

SEQ ID NO: 470170 - DNA, 20 bp, Artificial Sequence
  chemically synthesized
tttccagtctcactcctcca

SEQ ID NO: 470171 - DNA, 20 bp, Artificial Sequence
  chemically synthesized
agtccattagaatcctttgg

SEQ ID NO: 470172 - DNA, 20 bp, Artificial Sequence
  chemically synthesized
ttgtcatctgaaaagtccat

SEQ ID NO: 470173 - DNA, 20 bp, Artificial Sequence
  chemically synthesized
tctagtgagtttgagctggc

SEQ ID NO: 470174 - DNA, 20 bp, Artificial Sequence
  chemically synthesized
caaggttcttgtctgttcta

SEQ ID NO: 470175 - DNA, 20 bp, Artificial Sequence
  chemically synthesized
cactagaacagacaagaacc

SEQ ID NO: 470176 - DNA, 20 bp, Artificial Sequence
  chemically synthesized
ttaatgagacttcagacaaa

SEQ ID NO: 470177 - DNA, 20 bp, Artificial Sequence
  chemically synthesized
taatttgctttcaagacaga

SEQ ID NO: 470178 - DNA, 20 bp, Artificial Sequence
  chemically synthesized
taattctagacttctgaagc

SEQ ID NO: 470179 - DNA, 20 bp, Artificial Sequence
  chemically synthesized
atatccaggcttcagaagtc

SEQ ID NO: 470180 - DNA, 20 bp, Artificial Sequence
  chemically synthesized
gagatcttcaagaacagacc

SEQ ID NO: 470181 - DNA, 20 bp, Artificial Sequence
  chemically synthesized
aattctttaaagatatgttc

SEQ ID NO: 470182 - DNA, 20 bp, Artificial Sequence
  chemically synthesized
aattctggaacatatcttta

SEQ ID NO: 470183 - DNA, 20 bp, Artificial Sequence
  chemically synthesized
atgttgatgatgaggttttt

SEQ ID NO: 470184 - DNA, 20 bp, Artificial Sequence
  chemically synthesized
aaacctacacacagataaac

SEQ ID NO: 470185 - DNA, 20 bp, Artificial Sequence
  chemically synthesized
ctttctgtacttatctaagt

SEQ ID NO: 470186 - DNA, 20 bp, Artificial Sequence
  chemically synthesized
aagtacagaaagtacagtct

SEQ ID NO: 470187 - DNA, 20 bp, Artificial Sequence
  chemically synthesized
ccctctccttcatttcttag

SEQ ID NO: 470188 - DNA, 20 bp, Artificial Sequence
  chemically synthesized
gcctcgacctccataagtgc

SEQ ID NO: 470189 - DNA, 20 bp, Artificial Sequence
  chemically synthesized
acttatggaggtcgaggcgg

SEQ ID NO: 470190 - DNA, 20 bp, Artificial Sequence
  chemically synthesized
ggcgggcggatcacgaggtc

SEQ ID NO: 470191 - DNA, 20 bp, Artificial Sequence
  chemically synthesized
ttttgtgtttttaatagaga

SEQ ID NO: 470192 - DNA, 20 bp, Artificial Sequence
  chemically synthesized
gcttcagcctcctgagtagc

SEQ ID NO: 470193 - DNA, 20 bp, Artificial Sequence
  chemically synthesized
aattatcctgcttcagcctc

SEQ ID NO: 470194 - DNA, 20 bp, Artificial Sequence
  chemically synthesized
agctactcaggaggctgaag

SEQ ID NO: 470195 - DNA, 20 bp, Artificial Sequence
  chemically synthesized
ctcactacaacctccacctc

SEQ ID NO: 470196 - DNA, 20 bp, Artificial Sequence
  chemically synthesized
ctgcacttcagcctgggcga

SEQ ID NO: 470197 - DNA, 20 bp, Artificial Sequence
  chemically synthesized
cttttttttttttcttgaga

SEQ ID NO: 470198 - DNA, 20 bp, Artificial Sequence
  chemically synthesized
tggcacaaatgtggaagact

SEQ ID NO: 470199 - DNA, 20 bp, Artificial Sequence
  chemically synthesized
tttttctcttttcctcaatt

SEQ ID NO: 470200 - DNA, 20 bp, Artificial Sequence
  chemically synthesized
gatagcacaaaatcctggct

SEQ ID NO: 470201 - DNA, 20 bp, Artificial Sequence
  chemically synthesized
tgccttaaacaatccacagc

SEQ ID NO: 470202 - DNA, 20 bp, Artificial Sequence
  chemically synthesized
tcttgcttggccttcctcag

SEQ ID NO: 470203 - DNA, 20 bp, Artificial Sequence
  chemically synthesized
tagcaacactgtaataatgg

SEQ ID NO: 470204 - DNA, 20 bp, Artificial Sequence
  chemically synthesized
taacaatgagcaaaactaat

SEQ ID NO: 470205 - DNA, 20 bp, Artificial Sequence
  chemically synthesized
ttaagtaccatttctggggc

SEQ ID NO: 470206 - DNA, 20 bp, Artificial Sequence
  chemically synthesized
cagccctccattatctgggg

SEQ ID NO: 470207 - DNA, 20 bp, Artificial Sequence
  chemically synthesized
catggcacagtggtgcctat

SEQ ID NO: 470208 - DNA, 20 bp, Artificial Sequence
  chemically synthesized
aaatcaagcttcaagagcgg

SEQ ID NO: 470209 - DNA, 20 bp, Artificial Sequence
  chemically synthesized
ttatatataatgaaggtttt

SEQ ID NO: 470210 - DNA, 20 bp, Artificial Sequence
  chemically synthesized
acatacaatccataataatt

SEQ ID NO: 470211 - DNA, 20 bp, Artificial Sequence
  chemically synthesized
cttatggatccataattatt

SEQ ID NO: 470212 - DNA, 20 bp, Artificial Sequence
  chemically synthesized
cataataattatggatccat

SEQ ID NO: 470213 - DNA, 20 bp, Artificial Sequence
  chemically synthesized
tttagaagacatttatcctt

SEQ ID NO: 470214 - DNA, 20 bp, Artificial Sequence
  chemically synthesized
ttataaaacagttctgccta

SEQ ID NO: 470215 - DNA, 20 bp, Artificial Sequence
  chemically synthesized
gatgaaaggattatggatag

SEQ ID NO: 470216 - DNA, 20 bp, Artificial Sequence
  chemically synthesized
aaaggatagatgaaaggatt

SEQ ID NO: 470217 - DNA, 20 bp, Artificial Sequence
  chemically synthesized
aatattgaaaggatagatga

SEQ ID NO: 470218 - DNA, 20 bp, Artificial Sequence
  chemically synthesized
acatgcacaataaatattga

SEQ ID NO: 470219 - DNA, 20 bp, Artificial Sequence
  chemically synthesized
caagaaccatgccaagtaca

SEQ ID NO: 470220 - DNA, 20 bp, Artificial Sequence
  chemically synthesized
tttgcagtgtagcgaaggag

SEQ ID NO: 470221 - DNA, 20 bp, Artificial Sequence
  chemically synthesized
ccaccgcacctggcctacat

SEQ ID NO: 470222 - DNA, 20 bp, Artificial Sequence
  chemically synthesized
tgccttggcctcccaaaggc

SEQ ID NO: 470223 - DNA, 20 bp, Artificial Sequence
  chemically synthesized
ttttgtatttttagtagaga

SEQ ID NO: 470224 - DNA, 20 bp, Artificial Sequence
  chemically synthesized
ctaaaaatacaaaaaattag

SEQ ID NO: 470225 - DNA, 20 bp, Artificial Sequence
  chemically synthesized
tcagcctcccaggtagtagc

SEQ ID NO: 470226 - DNA, 20 bp, Artificial Sequence
  chemically synthesized
tacctgggaggctgaggcag

SEQ ID NO: 470227 - DNA, 20 bp, Artificial Sequence
  chemically synthesized
tttgctcttgttgcccaggc

SEQ ID NO: 470228 - DNA, 20 bp, Artificial Sequence
  chemically synthesized
gtttgttagtttgtttgaga

SEQ ID NO: 470229 - DNA, 20 bp, Artificial Sequence
  chemically synthesized
accattttaccacagtacat

SEQ ID NO: 470230 - DNA, 20 bp, Artificial Sequence
  chemically synthesized
gacattgaagcaaagacttg

SEQ ID NO: 470231 - DNA, 20 bp, Artificial Sequence
  chemically synthesized
agagaagaaggtggggcttt

SEQ ID NO: 470232 - DNA, 20 bp, Artificial Sequence
  chemically synthesized
ttcagcaatattggccttct

SEQ ID NO: 470233 - DNA, 20 bp, Artificial Sequence
  chemically synthesized
aatctcagagaggaaggagg

SEQ ID NO: 470234 - DNA, 20 bp, Artificial Sequence
  chemically synthesized
agagccctgcacatcgtgtg

SEQ ID NO: 470235 - DNA, 20 bp, Artificial Sequence
  chemically synthesized
tgcacatcgtgtgaaggatt

SEQ ID NO: 470236 - DNA, 20 bp, Artificial Sequence
  chemically synthesized
tcagggataaagagagacaa

SEQ ID NO: 470237 - DNA, 20 bp, Artificial Sequence
  chemically synthesized
tatcaacctggtagagtttc

SEQ ID NO: 470238 - DNA, 20 bp, Artificial Sequence
  chemically synthesized
ttcctcttctatcaacctgg

SEQ ID NO: 470239 - DNA, 20 bp, Artificial Sequence
  chemically synthesized
ctctaccaggttgatagaag

SEQ ID NO: 470240 - DNA, 20 bp, Artificial Sequence
  chemically synthesized
cctgttttgttaattttctt

SEQ ID NO: 470241 - DNA, 20 bp, Artificial Sequence
  chemically synthesized
ccaacatcattaattgagct

SEQ ID NO: 470242 - DNA, 20 bp, Artificial Sequence
  chemically synthesized
gagacaaggagattggggca

SEQ ID NO: 470243 - DNA, 20 bp, Artificial Sequence
  chemically synthesized
ttaagcctccagccttctgt

SEQ ID NO: 470244 - DNA, 20 bp, Artificial Sequence
  chemically synthesized
ggagaaggcactggaaacag

SEQ ID NO: 470245 - DNA, 20 bp, Artificial Sequence
  chemically synthesized
tttgaagatttactttcttt

SEQ ID NO: 470246 - DNA, 20 bp, Artificial Sequence
  chemically synthesized
aggagtaggaaatgaaggaa

SEQ ID NO: 470247 - DNA, 20 bp, Artificial Sequence
  chemically synthesized
gcagactaaatatggaattg

SEQ ID NO: 470248 - DNA, 20 bp, Artificial Sequence
  chemically synthesized
agaaaacagcagactaaata

SEQ ID NO: 470249 - DNA, 20 bp, Artificial Sequence
  chemically synthesized
aggtagaagagctttttaaa

SEQ ID NO: 470250 - DNA, 20 bp, Artificial Sequence
  chemically synthesized
gcatgaagaatatgatatat

SEQ ID NO: 470251 - DNA, 20 bp, Artificial Sequence
  chemically synthesized
gtagttgtaactgcagcatg

SEQ ID NO: 470252 - DNA, 20 bp, Artificial Sequence
  chemically synthesized
gaaagtgcattgatttgatt

SEQ ID NO: 470253 - DNA, 20 bp, Artificial Sequence
  chemically synthesized
acacaggccactctggctgc

SEQ ID NO: 470254 - DNA, 20 bp, Artificial Sequence
  chemically synthesized
gtattgtttattccagcagc

SEQ ID NO: 470255 - DNA, 20 bp, Artificial Sequence
  chemically synthesized
aaggttctgagccaaaggag

SEQ ID NO: 470256 - DNA, 20 bp, Artificial Sequence
  chemically synthesized
ctgtttttctcagtcacaac

SEQ ID NO: 470257 - DNA, 20 bp, Artificial Sequence
  chemically synthesized
tctgagagttctgtaagtag

SEQ ID NO: 470258 - DNA, 20 bp, Artificial Sequence
  chemically synthesized
tcagctacttacagaactct

SEQ ID NO: 470259 - DNA, 20 bp, Artificial Sequence
  chemically synthesized
ttataagtttgtgtcattct

SEQ ID NO: 470260 - DNA, 20 bp, Artificial Sequence
  chemically synthesized
agaatagagttgaaggagat

SEQ ID NO: 470261 - DNA, 20 bp, Artificial Sequence
  chemically synthesized
ttaattaatgaggttgagaa

SEQ ID NO: 470262 - DNA, 20 bp, Artificial Sequence
  chemically synthesized
attcgttaattaatgaggtt

SEQ ID NO: 470263 - DNA, 20 bp, Artificial Sequence
  chemically synthesized
attctcaacctcattaatta

SEQ ID NO: 470264 - DNA, 20 bp, Artificial Sequence
  chemically synthesized
tggctctgccctggcgaatc

SEQ ID NO: 470265 - DNA, 20 bp, Artificial Sequence
  chemically synthesized
attaaactggctctgccctg

SEQ ID NO: 470266 - DNA, 20 bp, Artificial Sequence
  chemically synthesized
aagtcacatctgatcatttt

SEQ ID NO: 470267 - DNA, 20 bp, Artificial Sequence
  chemically synthesized
atttggctttgcaaaggtat

SEQ ID NO: 470268 - DNA, 20 bp, Artificial Sequence
  chemically synthesized
aacattaaaaaaaaaaatct

SEQ ID NO: 470269 - DNA, 20 bp, Artificial Sequence
  chemically synthesized
aatgttgtgccttagctttt

SEQ ID NO: 470270 - DNA, 20 bp, Artificial Sequence
  chemically synthesized
gtaatgtcaaccatattatg

SEQ ID NO: 470271 - DNA, 20 bp, Artificial Sequence
  chemically synthesized
tatggttgacattacctatt

SEQ ID NO: 470272 - DNA, 20 bp, Artificial Sequence
  chemically synthesized
caaatttttcaactgtaaga

SEQ ID NO: 470273 - DNA, 20 bp, Artificial Sequence
  chemically synthesized
taccagagaagtaattgaaa

SEQ ID NO: 470274 - DNA, 20 bp, Artificial Sequence
  chemically synthesized
gaccagaggtcaccaactgg

SEQ ID NO: 470275 - DNA, 20 bp, Artificial Sequence
  chemically synthesized
aacacacacacacacaaaaa

SEQ ID NO: 470276 - DNA, 20 bp, Artificial Sequence
  chemically synthesized
atgtgagcccaaactgacca

SEQ ID NO: 470277 - DNA, 20 bp, Artificial Sequence
  chemically synthesized
cataatggtttttgaaattg

SEQ ID NO: 470278 - DNA, 20 bp, Artificial Sequence
  chemically synthesized
gctgactgttctatgagaat

SEQ ID NO: 470279 - DNA, 20 bp, Artificial Sequence
  chemically synthesized
gttgcagctgactgttctat

SEQ ID NO: 470280 - DNA, 20 bp, Artificial Sequence
  chemically synthesized
gcaacctgaaaagcttctgt

SEQ ID NO: 470281 - DNA, 20 bp, Artificial Sequence
  chemically synthesized
atttgaatgactgaaggtga

SEQ ID NO: 470282 - DNA, 20 bp, Artificial Sequence
  chemically synthesized
cctggggccaagctggtaat

SEQ ID NO: 470283 - DNA, 20 bp, Artificial Sequence
  chemically synthesized
aaaagcttttgggagaacaa

SEQ ID NO: 470284 - DNA, 20 bp, Artificial Sequence
  chemically synthesized
cctgaaaaagagtgtaactg

SEQ ID NO: 470285 - DNA, 20 bp, Artificial Sequence
  chemically synthesized
gccttgacagggacctgaaa

SEQ ID NO: 470286 - DNA, 20 bp, Artificial Sequence
  chemically synthesized
ccctgtcaaggctctgactg

SEQ ID NO: 470287 - DNA, 20 bp, Artificial Sequence
  chemically synthesized
aactgtttccatagagtaat

SEQ ID NO: 470288 - DNA, 20 bp, Artificial Sequence
  chemically synthesized
cccagtaacaactgtttcca

SEQ ID NO: 470289 - DNA, 20 bp, Artificial Sequence
  chemically synthesized
ctctatggaaacagttgtta

SEQ ID NO: 470290 - DNA, 20 bp, Artificial Sequence
  chemically synthesized
ttagtaaaaggtggagtcca

SEQ ID NO: 470291 - DNA, 20 bp, Artificial Sequence
  chemically synthesized
ttgaatgcattagtaaaagg

SEQ ID NO: 470292 - DNA, 20 bp, Artificial Sequence
  chemically synthesized
tggcagcacaatcatttagt

SEQ ID NO: 470293 - DNA, 20 bp, Artificial Sequence
  chemically synthesized
aggaagacaggccaaaatcc

SEQ ID NO: 470294 - DNA, 20 bp, Artificial Sequence
  chemically synthesized
gaaatatagtcaggagactc

SEQ ID NO: 470295 - DNA, 20 bp, Artificial Sequence
  chemically synthesized
cctaactgtgtactaagccc

SEQ ID NO: 470296 - DNA, 20 bp, Artificial Sequence
  chemically synthesized
ttccccaatatcttagaaac

SEQ ID NO: 470297 - DNA, 20 bp, Artificial Sequence
  chemically synthesized
gtgtactgattttttacagg

SEQ ID NO: 470298 - DNA, 20 bp, Artificial Sequence
  chemically synthesized
atacgtgtactgatttttta

SEQ ID NO: 470299 - DNA, 20 bp, Artificial Sequence
  chemically synthesized
cttgacacatcacaaatacc

SEQ ID NO: 470300 - DNA, 20 bp, Artificial Sequence
  chemically synthesized
acatacaaaactctggttat

SEQ ID NO: 470301 - DNA, 20 bp, Artificial Sequence
  chemically synthesized
ttctttgacactcacataac

SEQ ID NO: 470302 - DNA, 20 bp, Artificial Sequence
  chemically synthesized
ggtaaaaacagattttattc

SEQ ID NO: 470303 - DNA, 20 bp, Artificial Sequence
  chemically synthesized
ttcccactattgcaatattc

SEQ ID NO: 470304 - DNA, 20 bp, Artificial Sequence
  chemically synthesized
gtatagaactgggctcaact

SEQ ID NO: 470305 - DNA, 20 bp, Artificial Sequence
  chemically synthesized
ccacttgtccatgctgtatt

SEQ ID NO: 470306 - DNA, 20 bp, Artificial Sequence
  chemically synthesized
tgaatacagcatggacaagt

SEQ ID NO: 470307 - DNA, 20 bp, Artificial Sequence
  chemically synthesized
gggaattgatagccaaggag

SEQ ID NO: 470308 - DNA, 20 bp, Artificial Sequence
  chemically synthesized
ttgatagccaaggagcaggg

SEQ ID NO: 470309 - DNA, 20 bp, Artificial Sequence
  chemically synthesized
aaggagcagggtggggtttg

SEQ ID NO: 470310 - DNA, 20 bp, Artificial Sequence
  chemically synthesized
aaactactaagagaaagcat

SEQ ID NO: 470311 - DNA, 20 bp, Artificial Sequence
  chemically synthesized
agagaaagcatgggggtaag

SEQ ID NO: 470312 - DNA, 20 bp, Artificial Sequence
  chemically synthesized
cctgttaagttttttttagc

SEQ ID NO: 470313 - DNA, 20 bp, Artificial Sequence
  chemically synthesized
accttgctgaagacacaggc

SEQ ID NO: 470314 - DNA, 20 bp, Artificial Sequence
  chemically synthesized
gggtgatcagacgtcacatg

SEQ ID NO: 470315 - DNA, 20 bp, Artificial Sequence
  chemically synthesized
acgtcacatgggggatggtg

SEQ ID NO: 470316 - DNA, 20 bp, Artificial Sequence
  chemically synthesized
ttcttgctaaactgatttag

SEQ ID NO: 470317 - DNA, 20 bp, Artificial Sequence
  chemically synthesized
tagcaggattctcgctacag

SEQ ID NO: 470318 - DNA, 20 bp, Artificial Sequence
  chemically synthesized
tgtaaaaatccagctgtagc

SEQ ID NO: 470319 - DNA, 20 bp, Artificial Sequence
  chemically synthesized
gtgggcctaggagaaggttc

SEQ ID NO: 470320 - DNA, 20 bp, Artificial Sequence
  chemically synthesized
aagtagacaatctttatcat

SEQ ID NO: 470321 - DNA, 20 bp, Artificial Sequence
  chemically synthesized
ttaaccttaaaaatgttcat

SEQ ID NO: 470322 - DNA, 20 bp, Artificial Sequence
  chemically synthesized
ggcttagaaattactgtttc

SEQ ID NO: 470323 - DNA, 20 bp, Artificial Sequence
  chemically synthesized
gattttatttttattgtata

SEQ ID NO: 470324 - DNA, 20 bp, Artificial Sequence
  chemically synthesized
atcttttttccctcaagtat

SEQ ID NO: 470325 - DNA, 20 bp, Artificial Sequence
  chemically synthesized
catttattgccctagatgcc

SEQ ID NO: 470326 - DNA, 20 bp, Artificial Sequence
  chemically synthesized
tggtgctcaataaatgtatt

SEQ ID NO: 470327 - DNA, 20 bp, Artificial Sequence
  chemically synthesized
aaaagcaaggaagttccttt

SEQ ID NO: 470328 - DNA, 20 bp, Artificial Sequence
  chemically synthesized
ataattttccacttctatgg

SEQ ID NO: 470329 - DNA, 20 bp, Artificial Sequence
  chemically synthesized
cacttctatggctgaatcac

SEQ ID NO: 470330 - DNA, 20 bp, Artificial Sequence
  chemically synthesized
aagctccagctcaggttgta

SEQ ID NO: 470331 - DNA, 20 bp, Artificial Sequence
  chemically synthesized
aagatatcaagactttccta

SEQ ID NO: 470332 - DNA, 20 bp, Artificial Sequence
  chemically synthesized
aagactttcctaaggaataa

SEQ ID NO: 470333 - DNA, 20 bp, Artificial Sequence
  chemically synthesized
aagaaaataaatggtctaaa

SEQ ID NO: 470334 - DNA, 20 bp, Artificial Sequence
  chemically synthesized
aaagaatgcttatttgcaag

SEQ ID NO: 470335 - DNA, 20 bp, Artificial Sequence
  chemically synthesized
atctgccacaattaaataca

SEQ ID NO: 470336 - DNA, 20 bp, Artificial Sequence
  chemically synthesized
aaagaatttgggaaggggtg

SEQ ID NO: 470337 - DNA, 20 bp, Artificial Sequence
  chemically synthesized
caaggagaaagaatttggga

SEQ ID NO: 470338 - DNA, 20 bp, Artificial Sequence
  chemically synthesized
gcagagaaagaccaaggaga

SEQ ID NO: 470339 - DNA, 20 bp, Artificial Sequence
  chemically synthesized
tttctctgctacaaaggctg

SEQ ID NO: 470340 - DNA, 20 bp, Artificial Sequence
  chemically synthesized
agcttcccctggctggatca

SEQ ID NO: 470341 - DNA, 20 bp, Artificial Sequence
  chemically synthesized
gtccacacagcttcccctgg

SEQ ID NO: 470342 - DNA, 20 bp, Artificial Sequence
  chemically synthesized
ttgagaagatatctgcaaga

SEQ ID NO: 470343 - DNA, 20 bp, Artificial Sequence
  chemically synthesized
agagaaaggacgttcagcct

SEQ ID NO: 470344 - DNA, 20 bp, Artificial Sequence
  chemically synthesized
attctgctgtaccattttta

SEQ ID NO: 470345 - DNA, 20 bp, Artificial Sequence
  chemically synthesized
actcgttaaaaatggtacag

SEQ ID NO: 470346 - DNA, 20 bp, Artificial Sequence
  chemically synthesized
caggtagttgagagctatgg

SEQ ID NO: 470347 - DNA, 20 bp, Artificial Sequence
  chemically synthesized
caattgtatcttaaacacag

SEQ ID NO: 470348 - DNA, 20 bp, Artificial Sequence
  chemically synthesized
tccaccgcaaggaggattgc

SEQ ID NO: 470349 - DNA, 20 bp, Artificial Sequence
  chemically synthesized
cgtcatttctccaccgcaag

SEQ ID NO: 470350 - DNA, 20 bp, Artificial Sequence
  chemically synthesized
acgtgagcactaaagagatc

SEQ ID NO: 470351 - DNA, 20 bp, Artificial Sequence
  chemically synthesized
cagtggcaccacctggtagc

SEQ ID NO: 470352 - DNA, 20 bp, Artificial Sequence
  chemically synthesized
ttttataacagagggcttat

SEQ ID NO: 470353 - DNA, 20 bp, Artificial Sequence
  chemically synthesized
actttgcagactttgtctag

SEQ ID NO: 470354 - DNA, 20 bp, Artificial Sequence
  chemically synthesized
aaagtgtttagccatttgtt

SEQ ID NO: 470355 - DNA, 20 bp, Artificial Sequence
  chemically synthesized
atccttatcttacatctggg

SEQ ID NO: 470356 - DNA, 20 bp, Artificial Sequence
  chemically synthesized
attctgcccagatgtaagat

SEQ ID NO: 470357 - DNA, 20 bp, Artificial Sequence
  chemically synthesized
cccagatgtaagataaggat

SEQ ID NO: 470358 - DNA, 20 bp, Artificial Sequence
  chemically synthesized
gttcatttataggttgacac

SEQ ID NO: 470359 - DNA, 20 bp, Artificial Sequence
  chemically synthesized
ctagtttttcattaactctt

SEQ ID NO: 470360 - DNA, 20 bp, Artificial Sequence
  chemically synthesized
tgaacatttcattaactcta

SEQ ID NO: 470361 - DNA, 20 bp, Artificial Sequence
  chemically synthesized
ctgttagataaagggtagag

SEQ ID NO: 470362 - DNA, 20 bp, Artificial Sequence
  chemically synthesized
aaaatgtttactgttagata

SEQ ID NO: 470363 - DNA, 20 bp, Artificial Sequence
  chemically synthesized
aacagtaaacattttaggtt

SEQ ID NO: 470364 - DNA, 20 bp, Artificial Sequence
  chemically synthesized
gaaatggaaagaggcagatg

SEQ ID NO: 470365 - DNA, 20 bp, Artificial Sequence
  chemically synthesized
tattagagggcatggatatt

SEQ ID NO: 470366 - DNA, 20 bp, Artificial Sequence
  chemically synthesized
catgatgattattagagggc

SEQ ID NO: 470367 - DNA, 20 bp, Artificial Sequence
  chemically synthesized
catgccctctaataatcatc

SEQ ID NO: 470368 - DNA, 20 bp, Artificial Sequence
  chemically synthesized
taataatcatcatgaataaa

SEQ ID NO: 470369 - DNA, 20 bp, Artificial Sequence
  chemically synthesized
cattaggaaagatacattgt

SEQ ID NO: 470370 - DNA, 20 bp, Artificial Sequence
  chemically synthesized
ctgtttgagaggtgcaagaa

SEQ ID NO: 470371 - DNA, 20 bp, Artificial Sequence
  chemically synthesized
aggtgcaagaagagaatctg

SEQ ID NO: 470372 - DNA, 20 bp, Artificial Sequence
  chemically synthesized
aatctgttgagtctttatgc

SEQ ID NO: 470373 - DNA, 20 bp, Artificial Sequence
  chemically synthesized
tgagtctttatgcatgaata

SEQ ID NO: 470374 - DNA, 20 bp, Artificial Sequence
  chemically synthesized
atcctagatgcttaaatatc

SEQ ID NO: 470375 - DNA, 20 bp, Artificial Sequence
  chemically synthesized
attcaagatatttaagcatc

SEQ ID NO: 470376 - DNA, 20 bp, Artificial Sequence
  chemically synthesized
gttcccctcttctgttatgc

SEQ ID NO: 470377 - DNA, 20 bp, Artificial Sequence
  chemically synthesized
cttctgcatgcatgggcaat

SEQ ID NO: 470378 - DNA, 20 bp, Artificial Sequence
  chemically synthesized
gcatgcagaagcatgtgata

SEQ ID NO: 470379 - DNA, 20 bp, Artificial Sequence
  chemically synthesized
ttacatattagtgtcttcag

SEQ ID NO: 470380 - DNA, 20 bp, Artificial Sequence
  chemically synthesized
ctgctaagtaattttgttta

SEQ ID NO: 470381 - DNA, 20 bp, Artificial Sequence
  chemically synthesized
agactgaggtgcttttaata

SEQ ID NO: 470382 - DNA, 20 bp, Artificial Sequence
  chemically synthesized
atgtattgtccagatacaca

SEQ ID NO: 470383 - DNA, 20 bp, Artificial Sequence
  chemically synthesized
tgtgtatctggacaatacat

SEQ ID NO: 470384 - DNA, 20 bp, Artificial Sequence
  chemically synthesized
aaataaaaagagtattttcc

SEQ ID NO: 470385 - DNA, 20 bp, Artificial Sequence
  chemically synthesized
aaaaataaaaataaaataaa

SEQ ID NO: 470386 - DNA, 20 bp, Artificial Sequence
  chemically synthesized
ttatttttattttttttaga

SEQ ID NO: 470387 - DNA, 20 bp, Artificial Sequence
  chemically synthesized
ctgcattccagcctgggcga

SEQ ID NO: 470388 - DNA, 20 bp, Artificial Sequence
  chemically synthesized
tctcattctctcgcccaggc

SEQ ID NO: 470389 - DNA, 20 bp, Artificial Sequence
  chemically synthesized
ctcactgcaacctctgcctc

SEQ ID NO: 470390 - DNA, 20 bp, Artificial Sequence
  chemically synthesized
caggcagatcacttgaggtc

SEQ ID NO: 470391 - DNA, 20 bp, Artificial Sequence
  chemically synthesized
atagttttgaggtgataaag

SEQ ID NO: 470392 - DNA, 20 bp, Artificial Sequence
  chemically synthesized
ctcaaaactatgctgcattt

SEQ ID NO: 470393 - DNA, 20 bp, Artificial Sequence
  chemically synthesized
ccaatttgaagattcaatcc

SEQ ID NO: 470394 - DNA, 20 bp, Artificial Sequence
  chemically synthesized
gagtctgcccgattcttgga

SEQ ID NO: 470395 - DNA, 20 bp, Artificial Sequence
  chemically synthesized
actcagagtctgcccgattc

SEQ ID NO: 470396 - DNA, 20 bp, Artificial Sequence
  chemically synthesized
atccaagaatcgggcagact

SEQ ID NO: 470397 - DNA, 20 bp, Artificial Sequence
  chemically synthesized
atgaggtgggcagaggaact

SEQ ID NO: 470398 - DNA, 20 bp, Artificial Sequence
  chemically synthesized
tgagttcctctgcccacctc

SEQ ID NO: 470399 - DNA, 20 bp, Artificial Sequence
  chemically synthesized
atggatggccctgaagtcac

SEQ ID NO: 470400 - DNA, 20 bp, Artificial Sequence
  chemically synthesized
atggccctgaagtcacagga

SEQ ID NO: 470401 - DNA, 20 bp, Artificial Sequence
  chemically synthesized
tcctctcagtggcaatgacc

SEQ ID NO: 470402 - DNA, 20 bp, Artificial Sequence
  chemically synthesized
gaccacggattccttgtctt

SEQ ID NO: 470403 - DNA, 20 bp, Artificial Sequence
  chemically synthesized
aggaggcaatccaaaagaca

SEQ ID NO: 470404 - DNA, 20 bp, Artificial Sequence
  chemically synthesized
aacagagaggcagagaaagg

SEQ ID NO: 470405 - DNA, 20 bp, Artificial Sequence
  chemically synthesized
tcagctttcttttcaacaca

SEQ ID NO: 470406 - DNA, 20 bp, Artificial Sequence
  chemically synthesized
gattctgaggagaataaaag

SEQ ID NO: 470407 - DNA, 20 bp, Artificial Sequence
  chemically synthesized
gacccagcttttattctcct

SEQ ID NO: 470408 - DNA, 20 bp, Artificial Sequence
  chemically synthesized
gttttgtccaggattctgag

SEQ ID NO: 470409 - DNA, 20 bp, Artificial Sequence
  chemically synthesized
tatcctcaagtagttttgtc

SEQ ID NO: 470410 - DNA, 20 bp, Artificial Sequence
  chemically synthesized
aatcctggacaaaactactt

SEQ ID NO: 470411 - DNA, 20 bp, Artificial Sequence
  chemically synthesized
catacaaaaagagctgaagt

SEQ ID NO: 470412 - DNA, 20 bp, Artificial Sequence
  chemically synthesized
tttttctctttggctctaca

SEQ ID NO: 470413 - DNA, 20 bp, Artificial Sequence
  chemically synthesized
agtgacaggccgatggcaga

SEQ ID NO: 470414 - DNA, 20 bp, Artificial Sequence
  chemically synthesized
catttgcccttgagtgctca

SEQ ID NO: 470415 - DNA, 20 bp, Artificial Sequence
  chemically synthesized
ggtacacacgacatttgccc

SEQ ID NO: 470416 - DNA, 20 bp, Artificial Sequence
  chemically synthesized
gtcgtgtgtacctgatacca

SEQ ID NO: 470417 - DNA, 20 bp, Artificial Sequence
  chemically synthesized
catcgagtccttacaaggcc

SEQ ID NO: 470418 - DNA, 20 bp, Artificial Sequence
  chemically synthesized
ttggtcttgaatgcaggctc

SEQ ID NO: 470419 - DNA, 20 bp, Artificial Sequence
  chemically synthesized
agtgtcagaaagatttggtc

SEQ ID NO: 470420 - DNA, 20 bp, Artificial Sequence
  chemically synthesized
ggggaaggccatcagaggct

SEQ ID NO: 470421 - DNA, 20 bp, Artificial Sequence
  chemically synthesized
ttgtgctaattaggattaca

SEQ ID NO: 470422 - DNA, 20 bp, Artificial Sequence
  chemically synthesized
ccattcacccttgtgctaat

SEQ ID NO: 470423 - DNA, 20 bp, Artificial Sequence
  chemically synthesized
agtgtaatcctaattagcac

SEQ ID NO: 470424 - DNA, 20 bp, Artificial Sequence
  chemically synthesized
taatcctaattagcacaagg

SEQ ID NO: 470425 - DNA, 20 bp, Artificial Sequence
  chemically synthesized
cccggtatcatggttcttct

SEQ ID NO: 470426 - DNA, 20 bp, Artificial Sequence
  chemically synthesized
atgataccgggcaaggagca

SEQ ID NO: 470427 - DNA, 20 bp, Artificial Sequence
  chemically synthesized
cgggcaaggagcagagggta

SEQ ID NO: 470428 - DNA, 20 bp, Artificial Sequence
  chemically synthesized
cctccctgtggtccttgtgc

SEQ ID NO: 470429 - DNA, 20 bp, Artificial Sequence
  chemically synthesized
gagggaaactgaccagtcaa

SEQ ID NO: 470430 - DNA, 20 bp, Artificial Sequence
  chemically synthesized
ctgaccagtcaatgggatga

SEQ ID NO: 470431 - DNA, 20 bp, Artificial Sequence
  chemically synthesized
aatgggatgagggagtgacc

SEQ ID NO: 470432 - DNA, 20 bp, Artificial Sequence
  chemically synthesized
tccttatctagagaagtttg

SEQ ID NO: 470433 - DNA, 20 bp, Artificial Sequence
  chemically synthesized
gaataatcaacacctgcagt

SEQ ID NO: 470434 - DNA, 20 bp, Artificial Sequence
  chemically synthesized
tgcagtatatcaggcactct

SEQ ID NO: 470435 - DNA, 20 bp, Artificial Sequence
  chemically synthesized
acagaatcttagttaaccct

SEQ ID NO: 470436 - DNA, 20 bp, Artificial Sequence
  chemically synthesized
gtggttaggtccctaagtca

SEQ ID NO: 470437 - DNA, 20 bp, Artificial Sequence
  chemically synthesized
taagtcagttgcatacaatt

SEQ ID NO: 470438 - DNA, 20 bp, Artificial Sequence
  chemically synthesized
ataaacttggaacagagccc

SEQ ID NO: 470439 - DNA, 20 bp, Artificial Sequence
  chemically synthesized
cctaaatcttgtctcaaggt

SEQ ID NO: 470440 - DNA, 20 bp, Artificial Sequence
  chemically synthesized
ttaatggttactgggcaacc

SEQ ID NO: 470441 - DNA, 20 bp, Artificial Sequence
  chemically synthesized
gaatactcataagaaaaagg

SEQ ID NO: 470442 - DNA, 20 bp, Artificial Sequence
  chemically synthesized
tttaactctacctttttctt

SEQ ID NO: 470443 - DNA, 20 bp, Artificial Sequence
  chemically synthesized
ttcttatgagtattctttag

SEQ ID NO: 470444 - DNA, 20 bp, Artificial Sequence
  chemically synthesized
aaagtatatatattccccta

SEQ ID NO: 470445 - DNA, 20 bp, Artificial Sequence
  chemically synthesized
aatacatggtgccttagaaa

SEQ ID NO: 470446 - DNA, 20 bp, Artificial Sequence
  chemically synthesized
aaagctcttagtaacttgtt

SEQ ID NO: 470447 - DNA, 20 bp, Artificial Sequence
  chemically synthesized
gtttttctcctagctgacta

SEQ ID NO: 470448 - DNA, 20 bp, Artificial Sequence
  chemically synthesized
gctaggagaaaaacatcaac

SEQ ID NO: 470449 - DNA, 20 bp, Artificial Sequence
  chemically synthesized
acacttggggagaaaaagac

SEQ ID NO: 470450 - DNA, 20 bp, Artificial Sequence
  chemically synthesized
ttctgtggcttgctcaggga

SEQ ID NO: 470451 - DNA, 20 bp, Artificial Sequence
  chemically synthesized
agtagacttgaagtcccact

SEQ ID NO: 470452 - DNA, 20 bp, Artificial Sequence
  chemically synthesized
attgggagcccttaagctga

SEQ ID NO: 470453 - DNA, 20 bp, Artificial Sequence
  chemically synthesized
agcaattgggagcccttaag

SEQ ID NO: 470454 - DNA, 20 bp, Artificial Sequence
  chemically synthesized
gaaattcacgggccctctgt

SEQ ID NO: 470455 - DNA, 20 bp, Artificial Sequence
  chemically synthesized
ccaattcgaacagagggccc

SEQ ID NO: 470456 - DNA, 20 bp, Artificial Sequence
  chemically synthesized
caaattttcccaaaagcaag

SEQ ID NO: 470457 - DNA, 20 bp, Artificial Sequence
  chemically synthesized
gggtctaattttcccctgtt

SEQ ID NO: 470458 - DNA, 20 bp, Artificial Sequence
  chemically synthesized
tcagagcgggttaggaggag

SEQ ID NO: 470459 - DNA, 20 bp, Artificial Sequence
  chemically synthesized
ctatgactttatatgtcaga

SEQ ID NO: 470460 - DNA, 20 bp, Artificial Sequence
  chemically synthesized
atagaaggaagtcaggaagt

SEQ ID NO: 470461 - DNA, 20 bp, Artificial Sequence
  chemically synthesized
ggatgtgaacatttctttta

SEQ ID NO: 470462 - DNA, 20 bp, Artificial Sequence
  chemically synthesized
gagtagcagcagcctccatc

SEQ ID NO: 470463 - DNA, 20 bp, Artificial Sequence
  chemically synthesized
tgagacctggcttcttcatt

SEQ ID NO: 470464 - DNA, 20 bp, Artificial Sequence
  chemically synthesized
cttaaaggcggcacgtctaa

SEQ ID NO: 470465 - DNA, 20 bp, Artificial Sequence
  chemically synthesized
ctgatcatcagaagtacaga

SEQ ID NO: 470466 - DNA, 20 bp, Artificial Sequence
  chemically synthesized
tgatcagcttaatttcccat

SEQ ID NO: 470467 - DNA, 20 bp, Artificial Sequence
  chemically synthesized
cagttagcatttatgaagct

SEQ ID NO: 470468 - DNA, 20 bp, Artificial Sequence
  chemically synthesized
taaacttcgtacatttattt

SEQ ID NO: 470469 - DNA, 20 bp, Artificial Sequence
  chemically synthesized
gaatgaaaacttgcactatg

SEQ ID NO: 470470 - DNA, 20 bp, Artificial Sequence
  chemically synthesized
gcgcaatagactgacagatg

SEQ ID NO: 470471 - DNA, 20 bp, Artificial Sequence
  chemically synthesized
taccttttacataattaacc

SEQ ID NO: 470472 - DNA, 20 bp, Artificial Sequence
  chemically synthesized
tatgcccatttttgcacatt

SEQ ID NO: 470473 - DNA, 20 bp, Artificial Sequence
  chemically synthesized
gtctctaggaagtaaaatta

SEQ ID NO: 470474 - DNA, 20 bp, Artificial Sequence
  chemically synthesized
aaaattaggggattgatacc

SEQ ID NO: 470475 - DNA, 20 bp, Artificial Sequence
  chemically synthesized
taagaaatcaaacattgtaa

SEQ ID NO: 470476 - DNA, 20 bp, Artificial Sequence
  chemically synthesized
atgtgcactttttttaatga

SEQ ID NO: 470477 - DNA, 20 bp, Artificial Sequence
  chemically synthesized
cttttcaagatttctctatc

SEQ ID NO: 470478 - DNA, 20 bp, Artificial Sequence
  chemically synthesized
gaaggacagcgggtgaagct

SEQ ID NO: 470479 - DNA, 20 bp, Artificial Sequence
  chemically synthesized
tagtactctcctgaaggaca

SEQ ID NO: 470480 - DNA, 20 bp, Artificial Sequence
  chemically synthesized
cttcacccgctgtccttcag

SEQ ID NO: 470481 - DNA, 20 bp, Artificial Sequence
  chemically synthesized
attgtacaatggaaaaacta

SEQ ID NO: 470482 - DNA, 20 bp, Artificial Sequence
  chemically synthesized
tatgttatttattgcaaaca

SEQ ID NO: 470483 - DNA, 20 bp, Artificial Sequence
  chemically synthesized
cacctaataaatgataacct

SEQ ID NO: 470484 - DNA, 20 bp, Artificial Sequence
  chemically synthesized
tatgttatttattgcaaaca

SEQ ID NO: 470485 - DNA, 20 bp, Artificial Sequence
  chemically synthesized
acagttgaaggtaattatat

SEQ ID NO: 470486 - DNA, 20 bp, Artificial Sequence
  chemically synthesized
tggtttccttatttataaaa

SEQ ID NO: 470487 - DNA, 20 bp, Artificial Sequence
  chemically synthesized
ggctttagggtcaaatggat

SEQ ID NO: 470488 - DNA, 20 bp, Artificial Sequence
  chemically synthesized
aggaagggctttagggtcaa

SEQ ID NO: 470489 - DNA, 20 bp, Artificial Sequence
  chemically synthesized
gtgatgaagaggaagggctt

SEQ ID NO: 470490 - DNA, 20 bp, Artificial Sequence
  chemically synthesized
cttagttttgcaacagccct

SEQ ID NO: 470491 - DNA, 20 bp, Artificial Sequence
  chemically synthesized
ctccaaagaggagatgtatc

SEQ ID NO: 470492 - DNA, 20 bp, Artificial Sequence
  chemically synthesized
ttgaaaaggggaaccgaaga

SEQ ID NO: 470493 - DNA, 20 bp, Artificial Sequence
  chemically synthesized
ttccccttttcaaatggctt

SEQ ID NO: 470494 - DNA, 20 bp, Artificial Sequence
  chemically synthesized
aggggctaaatcgctggttt

SEQ ID NO: 470495 - DNA, 20 bp, Artificial Sequence
  chemically synthesized
attttctcacattgcaaagc

SEQ ID NO: 470496 - DNA, 20 bp, Artificial Sequence
  chemically synthesized
ggagatacaaatatctttta

SEQ ID NO: 470497 - DNA, 20 bp, Artificial Sequence
  chemically synthesized
atcttttacagggtttttga

SEQ ID NO: 470498 - DNA, 20 bp, Artificial Sequence
  chemically synthesized
tttgattgaattacatactt

SEQ ID NO: 470499 - DNA, 20 bp, Artificial Sequence
  chemically synthesized
gggaatagatatgaatttga

SEQ ID NO: 470500 - DNA, 20 bp, Artificial Sequence
  chemically synthesized
cggagcaacagggaatagat

SEQ ID NO: 470501 - DNA, 20 bp, Artificial Sequence
  chemically synthesized
gcaaactgagcggagcaaca

SEQ ID NO: 470502 - DNA, 20 bp, Artificial Sequence
  chemically synthesized
tttgaaggcgtggtgacaca

SEQ ID NO: 470503 - DNA, 20 bp, Artificial Sequence
  chemically synthesized
ggacaggttttaaagaaaaa

SEQ ID NO: 470504 - DNA, 20 bp, Artificial Sequence
  chemically synthesized
agaggtttttcttaacaagg

SEQ ID NO: 470505 - DNA, 20 bp, Artificial Sequence
  chemically synthesized
accttgttaagaaaaacctc

SEQ ID NO: 470506 - DNA, 20 bp, Artificial Sequence
  chemically synthesized
aattgacatgatgagggtct

SEQ ID NO: 470507 - DNA, 20 bp, Artificial Sequence
  chemically synthesized
tttgaggtaattgacatgat

SEQ ID NO: 470508 - DNA, 20 bp, Artificial Sequence
  chemically synthesized
ttggaataggaatttggtgg

SEQ ID NO: 470509 - DNA, 20 bp, Artificial Sequence
  chemically synthesized
tgttttggaataggaatttg

SEQ ID NO: 470510 - DNA, 20 bp, Artificial Sequence
  chemically synthesized
cgtcttctgtgttttggaat

SEQ ID NO: 470511 - DNA, 20 bp, Artificial Sequence
  chemically synthesized
gaagtccgtcttctgtgttt

SEQ ID NO: 470512 - DNA, 20 bp, Artificial Sequence
  chemically synthesized
gaactaagtgccttaaatta

SEQ ID NO: 470513 - DNA, 20 bp, Artificial Sequence
  chemically synthesized
cttagttcaccccaggggca

SEQ ID NO: 470514 - DNA, 20 bp, Artificial Sequence
  chemically synthesized
gaaatctgattcagtgcccc

SEQ ID NO: 470515 - DNA, 20 bp, Artificial Sequence
  chemically synthesized
agatttcccttttaaaaatc

SEQ ID NO: 470516 - DNA, 20 bp, Artificial Sequence
  chemically synthesized
tcctaaagtgctgggattac

SEQ ID NO: 470517 - DNA, 20 bp, Artificial Sequence
  chemically synthesized
atctcggcttcctaaagtgc

SEQ ID NO: 470518 - DNA, 20 bp, Artificial Sequence
  chemically synthesized
tgggcagatggcttgagctc

SEQ ID NO: 470519 - DNA, 20 bp, Artificial Sequence
  chemically synthesized
gctcaagagttgagaacagc

SEQ ID NO: 470520 - DNA, 20 bp, Artificial Sequence
  chemically synthesized
ttttgtatttttggtagaga

SEQ ID NO: 470521 - DNA, 20 bp, Artificial Sequence
  chemically synthesized
tgcctggggggctgaggcag

SEQ ID NO: 470522 - DNA, 20 bp, Artificial Sequence
  chemically synthesized
tctcactttgtcgcccaggc

SEQ ID NO: 470523 - DNA, 20 bp, Artificial Sequence
  chemically synthesized
tttttttttgctttttgaga

SEQ ID NO: 470524 - DNA, 20 bp, Artificial Sequence
  chemically synthesized
aaaaaaaaaaaaaaaaaatc

SEQ ID NO: 470525 - DNA, 20 bp, Artificial Sequence
  chemically synthesized
cagtgaagacattgttctct

SEQ ID NO: 470526 - DNA, 20 bp, Artificial Sequence
  chemically synthesized
tatgaaagactggcttgttt

SEQ ID NO: 470527 - DNA, 20 bp, Artificial Sequence
  chemically synthesized
gtttatgctgctacactatc

SEQ ID NO: 470528 - DNA, 20 bp, Artificial Sequence
  chemically synthesized
ggccctacattttactttac

SEQ ID NO: 470529 - DNA, 20 bp, Artificial Sequence
  chemically synthesized
taattagggagagttgtttg

SEQ ID NO: 470530 - DNA, 20 bp, Artificial Sequence
  chemically synthesized
tattaattagaataattagg

SEQ ID NO: 470531 - DNA, 20 bp, Artificial Sequence
  chemically synthesized
gtaggaagagcagtattaat

SEQ ID NO: 470532 - DNA, 20 bp, Artificial Sequence
  chemically synthesized
gctgacataggcttttttca

SEQ ID NO: 470533 - DNA, 20 bp, Artificial Sequence
  chemically synthesized
tgtgtgtgtcatatataaat

SEQ ID NO: 470534 - DNA, 20 bp, Artificial Sequence
  chemically synthesized
ttactttagatgtcttaggt

SEQ ID NO: 470535 - DNA, 20 bp, Artificial Sequence
  chemically synthesized
aagtaaccttgaaaagcaaa

SEQ ID NO: 470536 - DNA, 20 bp, Artificial Sequence
  chemically synthesized
taaaataatatggttgtcat

SEQ ID NO: 470537 - DNA, 20 bp, Artificial Sequence
  chemically synthesized
ttctacagacagaaaggact

SEQ ID NO: 470538 - DNA, 20 bp, Artificial Sequence
  chemically synthesized
ctccttcactctcataggca

SEQ ID NO: 470539 - DNA, 20 bp, Artificial Sequence
  chemically synthesized
tgatagaattccttgcctat

SEQ ID NO: 470540 - DNA, 20 bp, Artificial Sequence
  chemically synthesized
cagcggacttcatgatgtga

SEQ ID NO: 470541 - DNA, 20 bp, Artificial Sequence
  chemically synthesized
catgaagtccgctgcatgac

SEQ ID NO: 470542 - DNA, 20 bp, Artificial Sequence
  chemically synthesized
cgccagcttgggcaatgaac

SEQ ID NO: 470543 - DNA, 20 bp, Artificial Sequence
  chemically synthesized
caaaacctttctctgggtaa

SEQ ID NO: 470544 - DNA, 20 bp, Artificial Sequence
  chemically synthesized
agaatgttcaaaacctttct

SEQ ID NO: 470545 - DNA, 20 bp, Artificial Sequence
  chemically synthesized
ccccataaatatggagtact

SEQ ID NO: 470546 - DNA, 20 bp, Artificial Sequence
  chemically synthesized
atttttttcccccataaata

SEQ ID NO: 470547 - DNA, 20 bp, Artificial Sequence
  chemically synthesized
tgaccatatctatggtatac

SEQ ID NO: 470548 - DNA, 20 bp, Artificial Sequence
  chemically synthesized
ggaagattgcttcctgcctc

SEQ ID NO: 470549 - DNA, 20 bp, Artificial Sequence
  chemically synthesized
tcttccttttctgttaataa

SEQ ID NO: 470550 - DNA, 20 bp, Artificial Sequence
  chemically synthesized
tttaaaaaatgtgaagaaac

SEQ ID NO: 470551 - DNA, 20 bp, Artificial Sequence
  chemically synthesized
aagaaacaggagttggtata

SEQ ID NO: 470552 - DNA, 20 bp, Artificial Sequence
  chemically synthesized
agagaataaaatttaattta

SEQ ID NO: 470553 - DNA, 20 bp, Artificial Sequence
  chemically synthesized
gggtagataatagatccact

SEQ ID NO: 470554 - DNA, 20 bp, Artificial Sequence
  chemically synthesized
agataatagatccactaagg

SEQ ID NO: 470555 - DNA, 20 bp, Artificial Sequence
  chemically synthesized
tatccctttatccatcctta

SEQ ID NO: 470556 - DNA, 20 bp, Artificial Sequence
  chemically synthesized
gatccactaaggatggataa

SEQ ID NO: 470557 - DNA, 20 bp, Artificial Sequence
  chemically synthesized
attatatcagaaaagtttgg

SEQ ID NO: 470558 - DNA, 20 bp, Artificial Sequence
  chemically synthesized
ctgggtgtttttcttctttt

SEQ ID NO: 470559 - DNA, 20 bp, Artificial Sequence
  chemically synthesized
tgttttcttttaaatatctg

SEQ ID NO: 470560 - DNA, 20 bp, Artificial Sequence
  chemically synthesized
taaccatgtccttcccagca

SEQ ID NO: 470561 - DNA, 20 bp, Artificial Sequence
  chemically synthesized
gattggcactttgaagtatt

SEQ ID NO: 470562 - DNA, 20 bp, Artificial Sequence
  chemically synthesized
gttaatgtttctaagcttct

SEQ ID NO: 470563 - DNA, 20 bp, Artificial Sequence
  chemically synthesized
gattcatgtaagtggaatca

SEQ ID NO: 470564 - DNA, 20 bp, Artificial Sequence
  chemically synthesized
gactcagtgattccacttac

SEQ ID NO: 470565 - DNA, 20 bp, Artificial Sequence
  chemically synthesized
ctacatttgattcatgtaag

SEQ ID NO: 470566 - DNA, 20 bp, Artificial Sequence
  chemically synthesized
ttctggccaagacgcaatta

SEQ ID NO: 470567 - DNA, 20 bp, Artificial Sequence
  chemically synthesized
ctttaacttatctctccagg

SEQ ID NO: 470568 - DNA, 20 bp, Artificial Sequence
  chemically synthesized
tacagaaacccatcataaag

SEQ ID NO: 470569 - DNA, 20 bp, Artificial Sequence
  chemically synthesized
tacagaaactcaactttatg

SEQ ID NO: 470570 - DNA, 20 bp, Artificial Sequence
  chemically synthesized
caagtatccttgtaaacttt

SEQ ID NO: 470571 - DNA, 20 bp, Artificial Sequence
  chemically synthesized
ctgtaattcggaaagtttac

SEQ ID NO: 470572 - DNA, 20 bp, Artificial Sequence
  chemically synthesized
tttctaccacaaatatctta

SEQ ID NO: 470573 - DNA, 20 bp, Artificial Sequence
  chemically synthesized
atcctatgaaaaatatagct

SEQ ID NO: 470574 - DNA, 20 bp, Artificial Sequence
  chemically synthesized
attcatagctatatttttca

SEQ ID NO: 470575 - DNA, 20 bp, Artificial Sequence
  chemically synthesized
cttatgtataagtgatgtta

SEQ ID NO: 470576 - DNA, 20 bp, Artificial Sequence
  chemically synthesized
atttatggaaggaaatcttt

SEQ ID NO: 470577 - DNA, 20 bp, Artificial Sequence
  chemically synthesized
tttccttccataaattcaac

SEQ ID NO: 470578 - DNA, 20 bp, Artificial Sequence
  chemically synthesized
aaagaaaagtcaaattcgtg

SEQ ID NO: 470579 - DNA, 20 bp, Artificial Sequence
  chemically synthesized
tttcgctagttgcagtttat

SEQ ID NO: 470580 - DNA, 20 bp, Artificial Sequence
  chemically synthesized
aataacatctctgaggaact

SEQ ID NO: 470581 - DNA, 20 bp, Artificial Sequence
  chemically synthesized
gagaagacttatgattacag

SEQ ID NO: 470582 - DNA, 20 bp, Artificial Sequence
  chemically synthesized
tatatagttgtttgagataa

SEQ ID NO: 470583 - DNA, 20 bp, Artificial Sequence
  chemically synthesized
aatgtaaatagtggctattt

SEQ ID NO: 470584 - DNA, 20 bp, Artificial Sequence
  chemically synthesized
acttcaccttctaaaatttc

SEQ ID NO: 470585 - DNA, 20 bp, Artificial Sequence
  chemically synthesized
cttttattgaacattaaaac

SEQ ID NO: 470586 - DNA, 20 bp, Artificial Sequence
  chemically synthesized
caaggagaaaaacgtttact

SEQ ID NO: 470587 - DNA, 20 bp, Artificial Sequence
  chemically synthesized
ctttctttgtcatataaatt

SEQ ID NO: 470588 - DNA, 20 bp, Artificial Sequence
  chemically synthesized
aaaaagtgtcactatggatt

SEQ ID NO: 470589 - DNA, 20 bp, Artificial Sequence
  chemically synthesized
gacccgtaaaaagtgtcact

SEQ ID NO: 470590 - DNA, 20 bp, Artificial Sequence
  chemically synthesized
aatccatagtgacacttttt

SEQ ID NO: 470591 - DNA, 20 bp, Artificial Sequence
  chemically synthesized
ggaattaattttgccctaaa

SEQ ID NO: 470592 - DNA, 20 bp, Artificial Sequence
  chemically synthesized
ttttagggcaaaattaattc

SEQ ID NO: 470593 - DNA, 20 bp, Artificial Sequence
  chemically synthesized
aaccaagtgaactgctattc

SEQ ID NO: 470594 - DNA, 20 bp, Artificial Sequence
  chemically synthesized
gcctcaaagtaattaaaata

SEQ ID NO: 470595 - DNA, 20 bp, Artificial Sequence
  chemically synthesized
tggaaagaactccatctctc

SEQ ID NO: 470596 - DNA, 20 bp, Artificial Sequence
  chemically synthesized
aagatggaactctggagaga

SEQ ID NO: 470597 - DNA, 20 bp, Artificial Sequence
  chemically synthesized
acagatgagggttttctaag

SEQ ID NO: 470598 - DNA, 20 bp, Artificial Sequence
  chemically synthesized
gaagatggaaagatacagat

SEQ ID NO: 470599 - DNA, 20 bp, Artificial Sequence
  chemically synthesized
atctgtatctttccatcttc

SEQ ID NO: 470600 - DNA, 20 bp, Artificial Sequence
  chemically synthesized
tgaagcacagtagagcaagg

SEQ ID NO: 470601 - DNA, 20 bp, Artificial Sequence
  chemically synthesized
tctgaaaaaataattgttca

SEQ ID NO: 470602 - DNA, 20 bp, Artificial Sequence
  chemically synthesized
gtccatagacatgctcaaca

SEQ ID NO: 470603 - DNA, 20 bp, Artificial Sequence
  chemically synthesized
tccagcagcatgtgctcact

SEQ ID NO: 470604 - DNA, 20 bp, Artificial Sequence
  chemically synthesized
tgacaaatttgaaatattga

SEQ ID NO: 470605 - DNA, 20 bp, Artificial Sequence
  chemically synthesized
ttatttttatatctattatg

SEQ ID NO: 470606 - DNA, 20 bp, Artificial Sequence
  chemically synthesized
tgttactactgaaattgttt

SEQ ID NO: 470607 - DNA, 20 bp, Artificial Sequence
  chemically synthesized
aattaagtttgccatcttat

SEQ ID NO: 470608 - DNA, 20 bp, Artificial Sequence
  chemically synthesized
agacacaacaatattaaaat

SEQ ID NO: 470609 - DNA, 20 bp, Artificial Sequence
  chemically synthesized
tgaacacttagaggccattg

SEQ ID NO: 470610 - DNA, 20 bp, Artificial Sequence
  chemically synthesized
tcatgccaaacagtcaagtt

SEQ ID NO: 470611 - DNA, 20 bp, Artificial Sequence
  chemically synthesized
tcttatcatttgtgtgctcg

SEQ ID NO: 470612 - DNA, 20 bp, Artificial Sequence
  chemically synthesized
actcaaactttctccatatc

SEQ ID NO: 470613 - DNA, 20 bp, Artificial Sequence
  chemically synthesized
attcctgatatggagaaagt

SEQ ID NO: 470614 - DNA, 20 bp, Artificial Sequence
  chemically synthesized
atggagaaagtttgagtgct

SEQ ID NO: 470615 - DNA, 20 bp, Artificial Sequence
  chemically synthesized
aagggagttaaggttttgct

SEQ ID NO: 470616 - DNA, 20 bp, Artificial Sequence
  chemically synthesized
ttagccttcatagaattgaa

SEQ ID NO: 470617 - DNA, 20 bp, Artificial Sequence
  chemically synthesized
ctcatctcttttagccttca

SEQ ID NO: 470618 - DNA, 20 bp, Artificial Sequence
  chemically synthesized
tcatcttgcaccttaatgtt

SEQ ID NO: 470619 - DNA, 20 bp, Artificial Sequence
  chemically synthesized
ttccagatgaagctaaggtc

SEQ ID NO: 470620 - DNA, 20 bp, Artificial Sequence
  chemically synthesized
tcttaagggccctgtgattt

SEQ ID NO: 470621 - DNA, 20 bp, Artificial Sequence
  chemically synthesized
tctgaaatcacagggccctt

SEQ ID NO: 470622 - DNA, 20 bp, Artificial Sequence
  chemically synthesized
gcctcagcctcccaaagtgc

SEQ ID NO: 470623 - DNA, 20 bp, Artificial Sequence
  chemically synthesized
ggcgggcagatcacgaggtc

SEQ ID NO: 470624 - DNA, 20 bp, Artificial Sequence
  chemically synthesized
ttttgtatttttagtggaga

SEQ ID NO: 470625 - DNA, 20 bp, Artificial Sequence
  chemically synthesized
gcctcagcctcctgagtagc

SEQ ID NO: 470626 - DNA, 20 bp, Artificial Sequence
  chemically synthesized
aattctcctgcctcagcctc

SEQ ID NO: 470627 - DNA, 20 bp, Artificial Sequence
  chemically synthesized
tactcaggaggctgaggcag

SEQ ID NO: 470628 - DNA, 20 bp, Artificial Sequence
  chemically synthesized
ctcactgcaacctccacctc

SEQ ID NO: 470629 - DNA, 20 bp, Artificial Sequence
  chemically synthesized
tcgtaccactgcactccagc

SEQ ID NO: 470630 - DNA, 20 bp, Artificial Sequence
  chemically synthesized
tcttgctctgtcacccaggc

SEQ ID NO: 470631 - DNA, 20 bp, Artificial Sequence
  chemically synthesized
ttttttttttccttccaaga

SEQ ID NO: 470632 - DNA, 20 bp, Artificial Sequence
  chemically synthesized
cttggaaggaaaaaaaaaaa

SEQ ID NO: 470633 - DNA, 20 bp, Artificial Sequence
  chemically synthesized
tataaatggaaaaacaaagc

SEQ ID NO: 470634 - DNA, 20 bp, Artificial Sequence
  chemically synthesized
tctgtttacggcatggttta

SEQ ID NO: 470635 - DNA, 20 bp, Artificial Sequence
  chemically synthesized
gcaccttgtcacccaaaagc

SEQ ID NO: 470636 - DNA, 20 bp, Artificial Sequence
  chemically synthesized
gtacatctccatccaagctt

SEQ ID NO: 470637 - DNA, 20 bp, Artificial Sequence
  chemically synthesized
gtgtaagcgggcatgaaaac

SEQ ID NO: 470638 - DNA, 20 bp, Artificial Sequence
  chemically synthesized
cttaatccttgggctacaga

SEQ ID NO: 470639 - DNA, 20 bp, Artificial Sequence
  chemically synthesized
caacatccattctgtagccc

SEQ ID NO: 470640 - DNA, 20 bp, Artificial Sequence
  chemically synthesized
ttttcttaatccttgggcta

SEQ ID NO: 470641 - DNA, 20 bp, Artificial Sequence
  chemically synthesized
caaaatatttctcaactaat

SEQ ID NO: 470642 - DNA, 20 bp, Artificial Sequence
  chemically synthesized
catagacagtgattcctctg

SEQ ID NO: 470643 - DNA, 20 bp, Artificial Sequence
  chemically synthesized
actttgcccagatccatcag

SEQ ID NO: 470644 - DNA, 20 bp, Artificial Sequence
  chemically synthesized
gcctcggcctcccaaagtgc

SEQ ID NO: 470645 - DNA, 20 bp, Artificial Sequence
  chemically synthesized
actttgggaggccgaggcag

SEQ ID NO: 470646 - DNA, 20 bp, Artificial Sequence
  chemically synthesized
ggcaggtggatcatgaggtc

SEQ ID NO: 470647 - DNA, 20 bp, Artificial Sequence
  chemically synthesized
ttttgtatttttagtagaga

SEQ ID NO: 470648 - DNA, 20 bp, Artificial Sequence
  chemically synthesized
gattcttctgcctcagcttc

SEQ ID NO: 470649 - DNA, 20 bp, Artificial Sequence
  chemically synthesized
tactcgggaagctgaggcag

SEQ ID NO: 470650 - DNA, 20 bp, Artificial Sequence
  chemically synthesized
tcactgcaacctctgccttc

SEQ ID NO: 470651 - DNA, 20 bp, Artificial Sequence
  chemically synthesized
tcttgctatgttgtccaggc

SEQ ID NO: 470652 - DNA, 20 bp, Artificial Sequence
  chemically synthesized
caaatgttcttaatggcatc

SEQ ID NO: 470653 - DNA, 20 bp, Artificial Sequence
  chemically synthesized
gtcaaaatatcaacattacc

SEQ ID NO: 470654 - DNA, 20 bp, Artificial Sequence
  chemically synthesized
agacgttgattccaaccctc

SEQ ID NO: 470655 - DNA, 20 bp, Artificial Sequence
  chemically synthesized
tgacagtcatccatgagggt

SEQ ID NO: 470656 - DNA, 20 bp, Artificial Sequence
  chemically synthesized
aacccctgacagtcatccat

SEQ ID NO: 470657 - DNA, 20 bp, Artificial Sequence
  chemically synthesized
aaccctcatggatgactgtc

SEQ ID NO: 470658 - DNA, 20 bp, Artificial Sequence
  chemically synthesized
aggggttcaagacttcagtg

SEQ ID NO: 470659 - DNA, 20 bp, Artificial Sequence
  chemically synthesized
agtggggcgtgaagatatgg

SEQ ID NO: 470660 - DNA, 20 bp, Artificial Sequence
  chemically synthesized
aatttcatgatcaaacttta

SEQ ID NO: 470661 - DNA, 20 bp, Artificial Sequence
  chemically synthesized
tgatcaaactttaatggata

SEQ ID NO: 470662 - DNA, 20 bp, Artificial Sequence
  chemically synthesized
tggatagggagttgctactt

SEQ ID NO: 470663 - DNA, 20 bp, Artificial Sequence
  chemically synthesized
ttttgtgaaagatttctctg

SEQ ID NO: 470664 - DNA, 20 bp, Artificial Sequence
  chemically synthesized
gagaaatctttcacaaaagg

SEQ ID NO: 470665 - DNA, 20 bp, Artificial Sequence
  chemically synthesized
ttcacaaaaggaagagtcaa

SEQ ID NO: 470666 - DNA, 20 bp, Artificial Sequence
  chemically synthesized
gcatggtggttgctgaaggt

SEQ ID NO: 470667 - DNA, 20 bp, Artificial Sequence
  chemically synthesized
taatgatccttttgctggtg

SEQ ID NO: 470668 - DNA, 20 bp, Artificial Sequence
  chemically synthesized
gcaagaccctccaccagcaa

SEQ ID NO: 470669 - DNA, 20 bp, Artificial Sequence
  chemically synthesized
acacttactagactacatta

SEQ ID NO: 470670 - DNA, 20 bp, Artificial Sequence
  chemically synthesized
gtatgtctgtatttagtctt

SEQ ID NO: 470671 - DNA, 20 bp, Artificial Sequence
  chemically synthesized
tgcagagaagtccaaacact

SEQ ID NO: 470672 - DNA, 20 bp, Artificial Sequence
  chemically synthesized
agatcagtttcctttgaacc

SEQ ID NO: 470673 - DNA, 20 bp, Artificial Sequence
  chemically synthesized
taagataccagaaggacatc

SEQ ID NO: 470674 - DNA, 20 bp, Artificial Sequence
  chemically synthesized
aaaaactaaaaagctttcat

SEQ ID NO: 470675 - DNA, 20 bp, Artificial Sequence
  chemically synthesized
gttcccgaaatatctgcata

SEQ ID NO: 470676 - DNA, 20 bp, Artificial Sequence
  chemically synthesized
gttggttgccttactgtcca

SEQ ID NO: 470677 - DNA, 20 bp, Artificial Sequence
  chemically synthesized
tccaagtaagtttggccaat

SEQ ID NO: 470678 - DNA, 20 bp, Artificial Sequence
  chemically synthesized
gccagacctattgccggagg

SEQ ID NO: 470679 - DNA, 20 bp, Artificial Sequence
  chemically synthesized
agatgtcatgggcatcaagg

SEQ ID NO: 470680 - DNA, 20 bp, Artificial Sequence
  chemically synthesized
gcttctcagcacttccattc

SEQ ID NO: 470681 - DNA, 20 bp, Artificial Sequence
  chemically synthesized
atgcgggaaattggttactc

SEQ ID NO: 470682 - DNA, 20 bp, Artificial Sequence
  chemically synthesized
ctctagttatttcaaacaaa

SEQ ID NO: 470683 - DNA, 20 bp, Artificial Sequence
  chemically synthesized
ccctttgtttgaaataacta

SEQ ID NO: 470684 - DNA, 20 bp, Artificial Sequence
  chemically synthesized
gatttggaagatgtatcaat

SEQ ID NO: 470685 - DNA, 20 bp, Artificial Sequence
  chemically synthesized
ctgtggtagtggaggtatca

SEQ ID NO: 470686 - DNA, 20 bp, Artificial Sequence
  chemically synthesized
atttatgctcttttttgaga

SEQ ID NO: 470687 - DNA, 20 bp, Artificial Sequence
  chemically synthesized
ctgcacttcagcctgggcaa

SEQ ID NO: 470688 - DNA, 20 bp, Artificial Sequence
  chemically synthesized
attgcttgaacctgggaggc

SEQ ID NO: 470689 - DNA, 20 bp, Artificial Sequence
  chemically synthesized
tactcgggaagctgaggcag

SEQ ID NO: 470690 - DNA, 20 bp, Artificial Sequence
  chemically synthesized
aattctcctgcctcagcttc

SEQ ID NO: 470691 - DNA, 20 bp, Artificial Sequence
  chemically synthesized
aatttttattttagtagaga

SEQ ID NO: 470692 - DNA, 20 bp, Artificial Sequence
  chemically synthesized
caggtggatcacctgaggtc

SEQ ID NO: 470693 - DNA, 20 bp, Artificial Sequence
  chemically synthesized
actttgggaggccgaggcag

SEQ ID NO: 470694 - DNA, 20 bp, Artificial Sequence
  chemically synthesized
aaagtgtagtcttttttatc

SEQ ID NO: 470695 - DNA, 20 bp, Artificial Sequence
  chemically synthesized
ttctaaaataatatatcatt

SEQ ID NO: 470696 - DNA, 20 bp, Artificial Sequence
  chemically synthesized
tcctgaatgatatattattt

SEQ ID NO: 470697 - DNA, 20 bp, Artificial Sequence
  chemically synthesized
cgtgtatgctttccaaaagt

SEQ ID NO: 470698 - DNA, 20 bp, Artificial Sequence
  chemically synthesized
cagaaaaatttagtggctcc

SEQ ID NO: 470699 - DNA, 20 bp, Artificial Sequence
  chemically synthesized
acctaggtgtctctcactat

SEQ ID NO: 470700 - DNA, 20 bp, Artificial Sequence
  chemically synthesized
ggttcctgaattgagatacc

SEQ ID NO: 470701 - DNA, 20 bp, Artificial Sequence
  chemically synthesized
tttaataatctattgggttc

SEQ ID NO: 470702 - DNA, 20 bp, Artificial Sequence
  chemically synthesized
tctccttatttaataatcta

SEQ ID NO: 470703 - DNA, 20 bp, Artificial Sequence
  chemically synthesized
tctgatgtagtaactgctca

SEQ ID NO: 470704 - DNA, 20 bp, Artificial Sequence
  chemically synthesized
gaatgacatatgtaaggtaa

SEQ ID NO: 470705 - DNA, 20 bp, Artificial Sequence
  chemically synthesized
ttatcttgtgttgtgaggat

SEQ ID NO: 470706 - DNA, 20 bp, Artificial Sequence
  chemically synthesized
tgagacttatcttgtgttgt

SEQ ID NO: 470707 - DNA, 20 bp, Artificial Sequence
  chemically synthesized
tgaccacagagaactggtga

SEQ ID NO: 470708 - DNA, 20 bp, Artificial Sequence
  chemically synthesized
cagagaactggtgacagaat

SEQ ID NO: 470709 - DNA, 20 bp, Artificial Sequence
  chemically synthesized
attgttcattgactttgagg

SEQ ID NO: 470710 - DNA, 20 bp, Artificial Sequence
  chemically synthesized
gactttcctattgtcacttt

SEQ ID NO: 470711 - DNA, 20 bp, Artificial Sequence
  chemically synthesized
ataatcaattagttccccca

SEQ ID NO: 470712 - DNA, 20 bp, Artificial Sequence
  chemically synthesized
cccactgaatgcaccccata

SEQ ID NO: 470713 - DNA, 20 bp, Artificial Sequence
  chemically synthesized
tgtgatatatgcactcttta

SEQ ID NO: 470714 - DNA, 20 bp, Artificial Sequence
  chemically synthesized
aatacaggtttgcttttatc

SEQ ID NO: 470715 - DNA, 20 bp, Artificial Sequence
  chemically synthesized
atacattatatttaattata

SEQ ID NO: 470716 - DNA, 20 bp, Artificial Sequence
  chemically synthesized
gagtcaagttcaggcagagg

SEQ ID NO: 470717 - DNA, 20 bp, Artificial Sequence
  chemically synthesized
gcggtttaatgttttgccag

SEQ ID NO: 470718 - DNA, 20 bp, Artificial Sequence
  chemically synthesized
gttaattatcctcccccgac

SEQ ID NO: 470719 - DNA, 20 bp, Artificial Sequence
  chemically synthesized
tcaagtgactcaggtcgggg

SEQ ID NO: 470720 - DNA, 20 bp, Artificial Sequence
  chemically synthesized
cccgacctgagtcacttgat

SEQ ID NO: 470721 - DNA, 20 bp, Artificial Sequence
  chemically synthesized
tgcttgtgaaagaccatatt

SEQ ID NO: 470722 - DNA, 20 bp, Artificial Sequence
  chemically synthesized
tgaattcattgatcatgaat

SEQ ID NO: 470723 - DNA, 20 bp, Artificial Sequence
  chemically synthesized
gacatccaaattcatgatca

SEQ ID NO: 470724 - DNA, 20 bp, Artificial Sequence
  chemically synthesized
atgagatgaattcattgatc

SEQ ID NO: 470725 - DNA, 20 bp, Artificial Sequence
  chemically synthesized
tctgtaccctgctccatgag

SEQ ID NO: 470726 - DNA, 20 bp, Artificial Sequence
  chemically synthesized
aatgaattcatctcatggag

SEQ ID NO: 470727 - DNA, 20 bp, Artificial Sequence
  chemically synthesized
agtgttgttgaacttgactg

SEQ ID NO: 470728 - DNA, 20 bp, Artificial Sequence
  chemically synthesized
actgttgagttacatgtggt

SEQ ID NO: 470729 - DNA, 20 bp, Artificial Sequence
  chemically synthesized
gttaaaaaccaccaccgcgg

SEQ ID NO: 470730 - DNA, 20 bp, Artificial Sequence
  chemically synthesized
gcctccgcctcccaaactgc

SEQ ID NO: 470731 - DNA, 20 bp, Artificial Sequence
  chemically synthesized
cggggtttcaccatgttggc

SEQ ID NO: 470732 - DNA, 20 bp, Artificial Sequence
  chemically synthesized
ttttgcatttttagtagaga

SEQ ID NO: 470733 - DNA, 20 bp, Artificial Sequence
  chemically synthesized
actaaaaatgcaaaaattag

SEQ ID NO: 470734 - DNA, 20 bp, Artificial Sequence
  chemically synthesized
gcctcagcctcccgagtagc

SEQ ID NO: 470735 - DNA, 20 bp, Artificial Sequence
  chemically synthesized
gattttcctgcctcagcctc

SEQ ID NO: 470736 - DNA, 20 bp, Artificial Sequence
  chemically synthesized
aatcgcttgaacccgggagg

SEQ ID NO: 470737 - DNA, 20 bp, Artificial Sequence
  chemically synthesized
ctcactgcaaactctgcctc

SEQ ID NO: 470738 - DNA, 20 bp, Artificial Sequence
  chemically synthesized
gtcttgctctgttgccaggc

SEQ ID NO: 470739 - DNA, 20 bp, Artificial Sequence
  chemically synthesized
ttttttttgtttttttgaga

SEQ ID NO: 470740 - DNA, 20 bp, Artificial Sequence
  chemically synthesized
gggccaggtttttgttggtg

SEQ ID NO: 470741 - DNA, 20 bp, Artificial Sequence
  chemically synthesized
gatcccttgagcccaggaat

SEQ ID NO: 470742 - DNA, 20 bp, Artificial Sequence
  chemically synthesized
gactcaaattcctgggctca

SEQ ID NO: 470743 - DNA, 20 bp, Artificial Sequence
  chemically synthesized
cagaaggatcccttgagccc

SEQ ID NO: 470744 - DNA, 20 bp, Artificial Sequence
  chemically synthesized
gcttccagaggctgaggcag

SEQ ID NO: 470745 - DNA, 20 bp, Artificial Sequence
  chemically synthesized
atataagcttctatttatga

SEQ ID NO: 470746 - DNA, 20 bp, Artificial Sequence
  chemically synthesized
agggggtgtaatgactttcc

SEQ ID NO: 470747 - DNA, 20 bp, Artificial Sequence
  chemically synthesized
tgcaagcgatgaacgctttg

SEQ ID NO: 470748 - DNA, 20 bp, Artificial Sequence
  chemically synthesized
caaattttgaaacattccca

SEQ ID NO: 470749 - DNA, 20 bp, Artificial Sequence
  chemically synthesized
atgaattggtgatattctgt

SEQ ID NO: 470750 - DNA, 20 bp, Artificial Sequence
  chemically synthesized
gatgaatcattagcttattt

SEQ ID NO: 470751 - DNA, 20 bp, Artificial Sequence
  chemically synthesized
tctctcttatgacatagtgg

SEQ ID NO: 470752 - DNA, 20 bp, Artificial Sequence
  chemically synthesized
aaagtctctcttatgacata

SEQ ID NO: 470753 - DNA, 20 bp, Artificial Sequence
  chemically synthesized
tatgtcataagagagacttt

SEQ ID NO: 470754 - DNA, 20 bp, Artificial Sequence
  chemically synthesized
gtcattttattactaccgta

SEQ ID NO: 470755 - DNA, 20 bp, Artificial Sequence
  chemically synthesized
ttaaaaactatctattttat

SEQ ID NO: 470756 - DNA, 20 bp, Artificial Sequence
  chemically synthesized
atgtgagtgctctgactgtt

SEQ ID NO: 470757 - DNA, 20 bp, Artificial Sequence
  chemically synthesized
aaaagaaatattggaaatgt

SEQ ID NO: 470758 - DNA, 20 bp, Artificial Sequence
  chemically synthesized
cagaagatgatttttgcaca

SEQ ID NO: 470759 - DNA, 20 bp, Artificial Sequence
  chemically synthesized
atatgtacaattttatgtag

SEQ ID NO: 470760 - DNA, 20 bp, Artificial Sequence
  chemically synthesized
ctgcagctagaagaaaagtg

SEQ ID NO: 470761 - DNA, 20 bp, Artificial Sequence
  chemically synthesized
agtctaaggaacaattcttt

SEQ ID NO: 470762 - DNA, 20 bp, Artificial Sequence
  chemically synthesized
atttcagaaggaaactcaaa

SEQ ID NO: 470763 - DNA, 20 bp, Artificial Sequence
  chemically synthesized
gaagaacataatagatattt

SEQ ID NO: 470764 - DNA, 20 bp, Artificial Sequence
  chemically synthesized
tttacaaatggggaaagtca

SEQ ID NO: 470765 - DNA, 20 bp, Artificial Sequence
  chemically synthesized
tctgctcttttaactttgat

SEQ ID NO: 470766 - DNA, 20 bp, Artificial Sequence
  chemically synthesized
tttcttttttcttttataag

SEQ ID NO: 470767 - DNA, 20 bp, Artificial Sequence
  chemically synthesized
taacagccttaataacaaat

SEQ ID NO: 470768 - DNA, 20 bp, Artificial Sequence
  chemically synthesized
tgtgctaattttgtcagcta

SEQ ID NO: 470769 - DNA, 20 bp, Artificial Sequence
  chemically synthesized
attttgtcagctagggaata

SEQ ID NO: 470770 - DNA, 20 bp, Artificial Sequence
  chemically synthesized
tagggaataaagaatgtcat

SEQ ID NO: 470771 - DNA, 20 bp, Artificial Sequence
  chemically synthesized
ctttatcggcataattaaac

SEQ ID NO: 470772 - DNA, 20 bp, Artificial Sequence
  chemically synthesized
gcagttttataaatcatgct

SEQ ID NO: 470773 - DNA, 20 bp, Artificial Sequence
  chemically synthesized
tataaatcatgctaagagta

SEQ ID NO: 470774 - DNA, 20 bp, Artificial Sequence
  chemically synthesized
tcctttgagaacagagaact

SEQ ID NO: 470775 - DNA, 20 bp, Artificial Sequence
  chemically synthesized
gaacacacattttacaaact

SEQ ID NO: 470776 - DNA, 20 bp, Artificial Sequence
  chemically synthesized
gttccttatcttctaccata

SEQ ID NO: 470777 - DNA, 20 bp, Artificial Sequence
  chemically synthesized
agtataaatcaaatcaagtc

SEQ ID NO: 470778 - DNA, 20 bp, Artificial Sequence
  chemically synthesized
gaaataatgctaccataccg

SEQ ID NO: 470779 - DNA, 20 bp, Artificial Sequence
  chemically synthesized
aaaactggaaggacactcaa

SEQ ID NO: 470780 - DNA, 20 bp, Artificial Sequence
  chemically synthesized
ttttttgtcctgtcatccct

SEQ ID NO: 470781 - DNA, 20 bp, Artificial Sequence
  chemically synthesized
tagagtaggtggcatatgac

SEQ ID NO: 470782 - DNA, 20 bp, Artificial Sequence
  chemically synthesized
atttaatcctcacacagcta

SEQ ID NO: 470783 - DNA, 20 bp, Artificial Sequence
  chemically synthesized
cacctactctatagctgtgt

SEQ ID NO: 470784 - DNA, 20 bp, Artificial Sequence
  chemically synthesized
tgtagcactttacaatggcg

SEQ ID NO: 470785 - DNA, 20 bp, Artificial Sequence
  chemically synthesized
atccacccgcctcggcctcc

SEQ ID NO: 470786 - DNA, 20 bp, Artificial Sequence
  chemically synthesized
cagcactctgggaggccgag

SEQ ID NO: 470787 - DNA, 20 bp, Artificial Sequence
  chemically synthesized
actctgggaggccgaggcgg

SEQ ID NO: 470788 - DNA, 20 bp, Artificial Sequence
  chemically synthesized
cggggtttcaccatgttggc

SEQ ID NO: 470789 - DNA, 20 bp, Artificial Sequence
  chemically synthesized
ttttgtatttttagtagaga

SEQ ID NO: 470790 - DNA, 20 bp, Artificial Sequence
  chemically synthesized
gcgggaggctgctgaggcag

SEQ ID NO: 470791 - DNA, 20 bp, Artificial Sequence
  chemically synthesized
gtctcactctgtcgccaggc

SEQ ID NO: 470792 - DNA, 20 bp, Artificial Sequence
  chemically synthesized
actgcactccagcctggcga

SEQ ID NO: 470793 - DNA, 20 bp, Artificial Sequence
  chemically synthesized
ttaattttttttttttgaga

SEQ ID NO: 470794 - DNA, 20 bp, Artificial Sequence
  chemically synthesized
aacctaaaggatatgaataa

SEQ ID NO: 470795 - DNA, 20 bp, Artificial Sequence
  chemically synthesized
tcaccaccaacctaaaggat

SEQ ID NO: 470796 - DNA, 20 bp, Artificial Sequence
  chemically synthesized
tctttgtcaccaccaaccta

SEQ ID NO: 470797 - DNA, 20 bp, Artificial Sequence
  chemically synthesized
ggtggtgacaaagaggaact

SEQ ID NO: 470798 - DNA, 20 bp, Artificial Sequence
  chemically synthesized
ctagagtaaagcttggttgt

SEQ ID NO: 470799 - DNA, 20 bp, Artificial Sequence
  chemically synthesized
aaccaagctttactctagcc

SEQ ID NO: 470800 - DNA, 20 bp, Artificial Sequence
  chemically synthesized
gttttgttttaacccctggc

SEQ ID NO: 470801 - DNA, 20 bp, Artificial Sequence
  chemically synthesized
ggtcacaccaaagctggcat

SEQ ID NO: 470802 - DNA, 20 bp, Artificial Sequence
  chemically synthesized
ccataacgctttgaactgga

SEQ ID NO: 470803 - DNA, 20 bp, Artificial Sequence
  chemically synthesized
gagccaaggaaagctaaata

SEQ ID NO: 470804 - DNA, 20 bp, Artificial Sequence
  chemically synthesized
aagctcctaatgcaaaagga

SEQ ID NO: 470805 - DNA, 20 bp, Artificial Sequence
  chemically synthesized
ggaaggaattcatagtcatt

SEQ ID NO: 470806 - DNA, 20 bp, Artificial Sequence
  chemically synthesized
ctgcaggattctgaatgact

SEQ ID NO: 470807 - DNA, 20 bp, Artificial Sequence
  chemically synthesized
gggttagaaactgcaggatt

SEQ ID NO: 470808 - DNA, 20 bp, Artificial Sequence
  chemically synthesized
tgctcttgggttagaaactg

SEQ ID NO: 470809 - DNA, 20 bp, Artificial Sequence
  chemically synthesized
attccctcctgaggatgctc

SEQ ID NO: 470810 - DNA, 20 bp, Artificial Sequence
  chemically synthesized
acccaagagcatcctcagga

SEQ ID NO: 470811 - DNA, 20 bp, Artificial Sequence
  chemically synthesized
tccattaagtattccctcct

SEQ ID NO: 470812 - DNA, 20 bp, Artificial Sequence
  chemically synthesized
cctcaggagggaatacttaa

SEQ ID NO: 470813 - DNA, 20 bp, Artificial Sequence
  chemically synthesized
tagaaagcctatcaaaagag

SEQ ID NO: 470814 - DNA, 20 bp, Artificial Sequence
  chemically synthesized
cctcagcttgcccaagagga

SEQ ID NO: 470815 - DNA, 20 bp, Artificial Sequence
  chemically synthesized
caagctgaggaaagaggtac

SEQ ID NO: 470816 - DNA, 20 bp, Artificial Sequence
  chemically synthesized
tataaatcagcaatttgcaa

SEQ ID NO: 470817 - DNA, 20 bp, Artificial Sequence
  chemically synthesized
tctcctaactagaactgctg

SEQ ID NO: 470818 - DNA, 20 bp, Artificial Sequence
  chemically synthesized
ggtctgctgggcctgaggtt

SEQ ID NO: 470819 - DNA, 20 bp, Artificial Sequence
  chemically synthesized
ttaaaatgagggtttaattt

SEQ ID NO: 470820 - DNA, 20 bp, Artificial Sequence
  chemically synthesized
gagcttcagaatgttaaaat

SEQ ID NO: 470821 - DNA, 20 bp, Artificial Sequence
  chemically synthesized
ctatggtttgcagagagctt

SEQ ID NO: 470822 - DNA, 20 bp, Artificial Sequence
  chemically synthesized
ttttaaagaccacttttcct

SEQ ID NO: 470823 - DNA, 20 bp, Artificial Sequence
  chemically synthesized
aatggacttctgagtgtttt

SEQ ID NO: 470824 - DNA, 20 bp, Artificial Sequence
  chemically synthesized
caattttcaaaaatggactt

SEQ ID NO: 470825 - DNA, 20 bp, Artificial Sequence
  chemically synthesized
ctatccagcatgatgctcac

SEQ ID NO: 470826 - DNA, 20 bp, Artificial Sequence
  chemically synthesized
tcattcaggtgagcatcatg

SEQ ID NO: 470827 - DNA, 20 bp, Artificial Sequence
  chemically synthesized
gtgagcatcatgctggatag

SEQ ID NO: 470828 - DNA, 20 bp, Artificial Sequence
  chemically synthesized
tttaatctgttgcccaattt

SEQ ID NO: 470829 - DNA, 20 bp, Artificial Sequence
  chemically synthesized
taagttatagcgttcttcag

SEQ ID NO: 470830 - DNA, 20 bp, Artificial Sequence
  chemically synthesized
taaccacaagtgttttctca

SEQ ID NO: 470831 - DNA, 20 bp, Artificial Sequence
  chemically synthesized
tcaatgaaggaaaaggaaat

SEQ ID NO: 470832 - DNA, 20 bp, Artificial Sequence
  chemically synthesized
aaaataggataatgtgaaga

SEQ ID NO: 470833 - DNA, 20 bp, Artificial Sequence
  chemically synthesized
aggagacatgtaggtaaaaa

SEQ ID NO: 470834 - DNA, 20 bp, Artificial Sequence
  chemically synthesized
gttcctttttaaattacaat

SEQ ID NO: 470835 - DNA, 20 bp, Artificial Sequence
  chemically synthesized
cttagcctgtcttattgggg

SEQ ID NO: 470836 - DNA, 20 bp, Artificial Sequence
  chemically synthesized
taagaaataatgtttttaaa

SEQ ID NO: 470837 - DNA, 20 bp, Artificial Sequence
  chemically synthesized
tctcgttctgttgcccaggc

SEQ ID NO: 470838 - DNA, 20 bp, Artificial Sequence
  chemically synthesized
tactcaggaggctgaggtgg

SEQ ID NO: 470839 - DNA, 20 bp, Artificial Sequence
  chemically synthesized
gaccctcccacctcagcctc

SEQ ID NO: 470840 - DNA, 20 bp, Artificial Sequence
  chemically synthesized
tttttgtagagatggggaga

SEQ ID NO: 470841 - DNA, 20 bp, Artificial Sequence
  chemically synthesized
cgagcagctcacttgagctc

SEQ ID NO: 470842 - DNA, 20 bp, Artificial Sequence
  chemically synthesized
gcctcggcctccaaaagtgc

SEQ ID NO: 470843 - DNA, 20 bp, Artificial Sequence
  chemically synthesized
agatatactgaccaacagag

SEQ ID NO: 470844 - DNA, 20 bp, Artificial Sequence
  chemically synthesized
tggacagatatactgaccaa

SEQ ID NO: 470845 - DNA, 20 bp, Artificial Sequence
  chemically synthesized
tactacaaatttaagtaatc

SEQ ID NO: 470846 - DNA, 20 bp, Artificial Sequence
  chemically synthesized
caggtgcagtggctcaccct

SEQ ID NO: 470847 - DNA, 20 bp, Artificial Sequence
  chemically synthesized
tcccacagctctgagatccc

SEQ ID NO: 470848 - DNA, 20 bp, Artificial Sequence
  chemically synthesized
gctgtgggaggccaaggtgg

SEQ ID NO: 470849 - DNA, 20 bp, Artificial Sequence
  chemically synthesized
tgggaggatcgcttgagccc

SEQ ID NO: 470850 - DNA, 20 bp, Artificial Sequence
  chemically synthesized
tacttggaaggctgaggtgg

SEQ ID NO: 470851 - DNA, 20 bp, Artificial Sequence
  chemically synthesized
ggtgggagggtcacttgagc

SEQ ID NO: 470852 - DNA, 20 bp, Artificial Sequence
  chemically synthesized
tcttgctctgtcacatagac

SEQ ID NO: 470853 - DNA, 20 bp, Artificial Sequence
  chemically synthesized
ctgcttagagatacttttat

SEQ ID NO: 470854 - DNA, 20 bp, Artificial Sequence
  chemically synthesized
atatattatgtgtgtggggg

SEQ ID NO: 470855 - DNA, 20 bp, Artificial Sequence
  chemically synthesized
tgttagatagtaatatgctc

SEQ ID NO: 470856 - DNA, 20 bp, Artificial Sequence
  chemically synthesized
ttctggagccttgaagagct

SEQ ID NO: 470857 - DNA, 20 bp, Artificial Sequence
  chemically synthesized
agaaatctaaaactcacctc

SEQ ID NO: 470858 - DNA, 20 bp, Artificial Sequence
  chemically synthesized
taatatgtttgattcatgag

SEQ ID NO: 470859 - DNA, 20 bp, Artificial Sequence
  chemically synthesized
caaacatattattacttcta

SEQ ID NO: 470860 - DNA, 20 bp, Artificial Sequence
  chemically synthesized
attacttctagggagtgacg

SEQ ID NO: 470861 - DNA, 20 bp, Artificial Sequence
  chemically synthesized
ggtcattcatttgttattga

SEQ ID NO: 470862 - DNA, 20 bp, Artificial Sequence
  chemically synthesized
atgtaccctctcaataacaa

SEQ ID NO: 470863 - DNA, 20 bp, Artificial Sequence
  chemically synthesized
ataacaaatgaatgacccag

SEQ ID NO: 470864 - DNA, 20 bp, Artificial Sequence
  chemically synthesized
atatttcccattagactcct

SEQ ID NO: 470865 - DNA, 20 bp, Artificial Sequence
  chemically synthesized
acccatccgtgtcttacagg

SEQ ID NO: 470866 - DNA, 20 bp, Artificial Sequence
  chemically synthesized
cctcactcagcctgtaagac

SEQ ID NO: 470867 - DNA, 20 bp, Artificial Sequence
  chemically synthesized
actcagcctgtaagacacgg

SEQ ID NO: 470868 - DNA, 20 bp, Artificial Sequence
  chemically synthesized
tctcctgttgtttgttttct

SEQ ID NO: 470869 - DNA, 20 bp, Artificial Sequence
  chemically synthesized
gaatgtacattttaaaacat

SEQ ID NO: 470870 - DNA, 20 bp, Artificial Sequence
  chemically synthesized
tttagaaatccacttgtctg

SEQ ID NO: 470871 - DNA, 20 bp, Artificial Sequence
  chemically synthesized
tcggctaactctgcagacaa

SEQ ID NO: 470872 - DNA, 20 bp, Artificial Sequence
  chemically synthesized
tttttcttttactttgggct

SEQ ID NO: 470873 - DNA, 20 bp, Artificial Sequence
  chemically synthesized
ttttttttttttttttgaga

SEQ ID NO: 470874 - DNA, 20 bp, Artificial Sequence
  chemically synthesized
agcactccctcctgggcaac

SEQ ID NO: 470875 - DNA, 20 bp, Artificial Sequence
  chemically synthesized
ttcactcttgttgcccagga

SEQ ID NO: 470876 - DNA, 20 bp, Artificial Sequence
  chemically synthesized
ctcattgcaacctccgactc

SEQ ID NO: 470877 - DNA, 20 bp, Artificial Sequence
  chemically synthesized
ctgaagaatcacttgaaccc

SEQ ID NO: 470878 - DNA, 20 bp, Artificial Sequence
  chemically synthesized
tactcaagaggccgaggctg

SEQ ID NO: 470879 - DNA, 20 bp, Artificial Sequence
  chemically synthesized
gattcttcagcctcggcctc

SEQ ID NO: 470880 - DNA, 20 bp, Artificial Sequence
  chemically synthesized
gcctcggcctcttgagtagc

SEQ ID NO: 470881 - DNA, 20 bp, Artificial Sequence
  chemically synthesized
ttttgtttttttagtaaaga

SEQ ID NO: 470882 - DNA, 20 bp, Artificial Sequence
  chemically synthesized
ggtcgaggtgggcggatcac

SEQ ID NO: 470883 - DNA, 20 bp, Artificial Sequence
  chemically synthesized
actttgggaggtcgaggtgg

SEQ ID NO: 470884 - DNA, 20 bp, Artificial Sequence
  chemically synthesized
acctcgacctcccaaagtgc

SEQ ID NO: 470885 - DNA, 20 bp, Artificial Sequence
  chemically synthesized
gtgctttatctttaaaatgt

SEQ ID NO: 470886 - DNA, 20 bp, Artificial Sequence
  chemically synthesized
gagaatagtagtggagtaag

SEQ ID NO: 470887 - DNA, 20 bp, Artificial Sequence
  chemically synthesized
atggtagtagagaatagtag

SEQ ID NO: 470888 - DNA, 20 bp, Artificial Sequence
  chemically synthesized
atagtcatagaatggtagta

SEQ ID NO: 470889 - DNA, 20 bp, Artificial Sequence
  chemically synthesized
gtgactacccccaatagtca

SEQ ID NO: 470890 - DNA, 20 bp, Artificial Sequence
  chemically synthesized
actaccattctatgactatt

SEQ ID NO: 470891 - DNA, 20 bp, Artificial Sequence
  chemically synthesized
cattgtcttggattttcaca

SEQ ID NO: 470892 - DNA, 20 bp, Artificial Sequence
  chemically synthesized
ggtttgacaaaagcattgtc

SEQ ID NO: 470893 - DNA, 20 bp, Artificial Sequence
  chemically synthesized
actgaacagtcattaggaat

SEQ ID NO: 470894 - DNA, 20 bp, Artificial Sequence
  chemically synthesized
atgatgactgaacagtcatt

SEQ ID NO: 470895 - DNA, 20 bp, Artificial Sequence
  chemically synthesized
aaattgagagaaaatattgc

SEQ ID NO: 470896 - DNA, 20 bp, Artificial Sequence
  chemically synthesized
aaatacatgagatgatctct

SEQ ID NO: 470897 - DNA, 20 bp, Artificial Sequence
  chemically synthesized
agttacctgacaaagtccat

SEQ ID NO: 470898 - DNA, 20 bp, Artificial Sequence
  chemically synthesized
ctgacaaagtccatgagaat

SEQ ID NO: 470899 - DNA, 20 bp, Artificial Sequence
  chemically synthesized
tcataagttctcattagtta

SEQ ID NO: 470900 - DNA, 20 bp, Artificial Sequence
  chemically synthesized
tagagacactaagtaagaaa

SEQ ID NO: 470901 - DNA, 20 bp, Artificial Sequence
  chemically synthesized
cactaagtaagaaatggaat

SEQ ID NO: 470902 - DNA, 20 bp, Artificial Sequence
  chemically synthesized
ttttccactgattttctaca

SEQ ID NO: 470903 - DNA, 20 bp, Artificial Sequence
  chemically synthesized
ttgtagaaaatcagtggaaa

SEQ ID NO: 470904 - DNA, 20 bp, Artificial Sequence
  chemically synthesized
gaatgaaaaagaaaaccacc

SEQ ID NO: 470905 - DNA, 20 bp, Artificial Sequence
  chemically synthesized
ttggagctctctaatacatt

SEQ ID NO: 470906 - DNA, 20 bp, Artificial Sequence
  chemically synthesized
cacccagggtttgaacacaa

SEQ ID NO: 470907 - DNA, 20 bp, Artificial Sequence
  chemically synthesized
aatcctattgtgttcaaacc

SEQ ID NO: 470908 - DNA, 20 bp, Artificial Sequence
  chemically synthesized
ttcaggtgttcccctgcacc

SEQ ID NO: 470909 - DNA, 20 bp, Artificial Sequence
  chemically synthesized
ccctgggtgcaggggaacac

SEQ ID NO: 470910 - DNA, 20 bp, Artificial Sequence
  chemically synthesized
ttgggaactttggcaaatta

SEQ ID NO: 470911 - DNA, 20 bp, Artificial Sequence
  chemically synthesized
ccttagaagtgggcgtctct

SEQ ID NO: 470912 - DNA, 20 bp, Artificial Sequence
  chemically synthesized
aaccactgtagcttccacgg

SEQ ID NO: 470913 - DNA, 20 bp, Artificial Sequence
  chemically synthesized
cttccacggtagagtatgcc

SEQ ID NO: 470914 - DNA, 20 bp, Artificial Sequence
  chemically synthesized
cggtagagtatgcctggagt

SEQ ID NO: 470915 - DNA, 20 bp, Artificial Sequence
  chemically synthesized
ggtccaaattgctctttgag

SEQ ID NO: 470916 - DNA, 20 bp, Artificial Sequence
  chemically synthesized
aaagagcaatttggacctaa

SEQ ID NO: 470917 - DNA, 20 bp, Artificial Sequence
  chemically synthesized
tctccaaaattacagtgttt

SEQ ID NO: 470918 - DNA, 20 bp, Artificial Sequence
  chemically synthesized
tgctggtagttaatcttata

SEQ ID NO: 470919 - DNA, 20 bp, Artificial Sequence
  chemically synthesized
ttaatcttatatgggatctc

SEQ ID NO: 470920 - DNA, 20 bp, Artificial Sequence
  chemically synthesized
accttggcctcccaaattgt

SEQ ID NO: 470921 - DNA, 20 bp, Artificial Sequence
  chemically synthesized
aatttgggaggccaaggtgg

SEQ ID NO: 470922 - DNA, 20 bp, Artificial Sequence
  chemically synthesized
tgggaggatcacctgaggtc

SEQ ID NO: 470923 - DNA, 20 bp, Artificial Sequence
  chemically synthesized
ttttgtatttttactaggga

SEQ ID NO: 470924 - DNA, 20 bp, Artificial Sequence
  chemically synthesized
agtaaaaatacaaaaattag

SEQ ID NO: 470925 - DNA, 20 bp, Artificial Sequence
  chemically synthesized
aaaattagctgggtatggtg

SEQ ID NO: 470926 - DNA, 20 bp, Artificial Sequence
  chemically synthesized
gcttcagcctcccgagtagc

SEQ ID NO: 470927 - DNA, 20 bp, Artificial Sequence
  chemically synthesized
gattctcctgcttcagcctc

SEQ ID NO: 470928 - DNA, 20 bp, Artificial Sequence
  chemically synthesized
tactcgggaggctgaagcag

SEQ ID NO: 470929 - DNA, 20 bp, Artificial Sequence
  chemically synthesized
cacggcaacctccgcctccc

SEQ ID NO: 470930 - DNA, 20 bp, Artificial Sequence
  chemically synthesized
tcgtgccactgcattccagc

SEQ ID NO: 470931 - DNA, 20 bp, Artificial Sequence
  chemically synthesized
tctcactctgtcacccaggc

SEQ ID NO: 470932 - DNA, 20 bp, Artificial Sequence
  chemically synthesized
ctgcattccagcctgggtga

SEQ ID NO: 470933 - DNA, 20 bp, Artificial Sequence
  chemically synthesized
tccagcctgggtgacagagt

SEQ ID NO: 470934 - DNA, 20 bp, Artificial Sequence
  chemically synthesized
caaaaaacaaacaaacaaaa

SEQ ID NO: 470935 - DNA, 20 bp, Artificial Sequence
  chemically synthesized
tcactgttgcctggcacata

SEQ ID NO: 470936 - DNA, 20 bp, Artificial Sequence
  chemically synthesized
atgtgccaggcaacagtgaa

SEQ ID NO: 470937 - DNA, 20 bp, Artificial Sequence
  chemically synthesized
gtatttctggaaatggtatg

SEQ ID NO: 470938 - DNA, 20 bp, Artificial Sequence
  chemically synthesized
acctatgaatagtaagttac

SEQ ID NO: 470939 - DNA, 20 bp, Artificial Sequence
  chemically synthesized
aggaattgatagttttacct

SEQ ID NO: 470940 - DNA, 20 bp, Artificial Sequence
  chemically synthesized
catacctgctacacgtatat

SEQ ID NO: 470941 - DNA, 20 bp, Artificial Sequence
  chemically synthesized
acagctatgtggggctacac

SEQ ID NO: 470942 - DNA, 20 bp, Artificial Sequence
  chemically synthesized
cagcgaagccaggctcaggg

SEQ ID NO: 470943 - DNA, 20 bp, Artificial Sequence
  chemically synthesized
gcttcgctgtcctgtgaaat

SEQ ID NO: 470944 - DNA, 20 bp, Artificial Sequence
  chemically synthesized
gccagcaaccaacctgcatg

SEQ ID NO: 470945 - DNA, 20 bp, Artificial Sequence
  chemically synthesized
cctattgtatgttttccaca

SEQ ID NO: 470946 - DNA, 20 bp, Artificial Sequence
  chemically synthesized
taaatgggagatgttatctg

SEQ ID NO: 470947 - DNA, 20 bp, Artificial Sequence
  chemically synthesized
gttatctgatgaatcaccac

SEQ ID NO: 470948 - DNA, 20 bp, Artificial Sequence
  chemically synthesized
accacttggataaaagccca

SEQ ID NO: 470949 - DNA, 20 bp, Artificial Sequence
  chemically synthesized
gaagtttgcttttcaccttt

SEQ ID NO: 470950 - DNA, 20 bp, Artificial Sequence
  chemically synthesized
gttattgggctagcaagaaa

SEQ ID NO: 470951 - DNA, 20 bp, Artificial Sequence
  chemically synthesized
aacagaatttcaaagggggc

SEQ ID NO: 470952 - DNA, 20 bp, Artificial Sequence
  chemically synthesized
aaagagaaagtttgcaataa

SEQ ID NO: 470953 - DNA, 20 bp, Artificial Sequence
  chemically synthesized
aacagaattttacagttgca

SEQ ID NO: 470954 - DNA, 20 bp, Artificial Sequence
  chemically synthesized
cactcaattttgaattataa

SEQ ID NO: 470955 - DNA, 20 bp, Artificial Sequence
  chemically synthesized
aattctgttataattcaaaa

SEQ ID NO: 470956 - DNA, 20 bp, Artificial Sequence
  chemically synthesized
gcttgtgacatcactcaatt

SEQ ID NO: 470957 - DNA, 20 bp, Artificial Sequence
  chemically synthesized
gtcatgagagattatcagtt

SEQ ID NO: 470958 - DNA, 20 bp, Artificial Sequence
  chemically synthesized
aagctaattatggactatca

SEQ ID NO: 470959 - DNA, 20 bp, Artificial Sequence
  chemically synthesized
atgtttgcaatttctcatta

SEQ ID NO: 470960 - DNA, 20 bp, Artificial Sequence
  chemically synthesized
cagagtaattgaaagtggta

SEQ ID NO: 470961 - DNA, 20 bp, Artificial Sequence
  chemically synthesized
aaaaaaagcaagttataaga

SEQ ID NO: 470962 - DNA, 20 bp, Artificial Sequence
  chemically synthesized
tacatatatttttatagaag

SEQ ID NO: 470963 - DNA, 20 bp, Artificial Sequence
  chemically synthesized
ttagctggtgtttaatagtc

SEQ ID NO: 470964 - DNA, 20 bp, Artificial Sequence
  chemically synthesized
caccagctaactctaagaag

SEQ ID NO: 470965 - DNA, 20 bp, Artificial Sequence
  chemically synthesized
tcattcgtaaccccacttct

SEQ ID NO: 470966 - DNA, 20 bp, Artificial Sequence
  chemically synthesized
taactctaagaagtggggtt

SEQ ID NO: 470967 - DNA, 20 bp, Artificial Sequence
  chemically synthesized
tatttttaaacttcaaaaat

SEQ ID NO: 470968 - DNA, 20 bp, Artificial Sequence
  chemically synthesized
ttttaaaatcattattatta

SEQ ID NO: 470969 - DNA, 20 bp, Artificial Sequence
  chemically synthesized
aataataatgattttaaaat

SEQ ID NO: 470970 - DNA, 20 bp, Artificial Sequence
  chemically synthesized
ataatgattttaaaataaga

SEQ ID NO: 470971 - DNA, 20 bp, Artificial Sequence
  chemically synthesized
caactagaaattactgtaat

SEQ ID NO: 470972 - DNA, 20 bp, Artificial Sequence
  chemically synthesized
agtttttctcttgtacaatc

SEQ ID NO: 470973 - DNA, 20 bp, Artificial Sequence
  chemically synthesized
cttgtacaatcaggggtcct

SEQ ID NO: 470974 - DNA, 20 bp, Artificial Sequence
  chemically synthesized
atcaggggtcctgggagtac

SEQ ID NO: 470975 - DNA, 20 bp, Artificial Sequence
  chemically synthesized
gcttatcttttggcaaatga

SEQ ID NO: 470976 - DNA, 20 bp, Artificial Sequence
  chemically synthesized
ttataccacaggtggaaaac

SEQ ID NO: 470977 - DNA, 20 bp, Artificial Sequence
  chemically synthesized
tgctacatttccagccccta

SEQ ID NO: 470978 - DNA, 20 bp, Artificial Sequence
  chemically synthesized
tttaaaattttaaataaaat

SEQ ID NO: 470979 - DNA, 20 bp, Artificial Sequence
  chemically synthesized
ataatattactcgaaatgta

SEQ ID NO: 470980 - DNA, 20 bp, Artificial Sequence
  chemically synthesized
ccagagagatccaatacatt

SEQ ID NO: 470981 - DNA, 20 bp, Artificial Sequence
  chemically synthesized
atagctgcaattcattttgt

SEQ ID NO: 470982 - DNA, 20 bp, Artificial Sequence
  chemically synthesized
gtgtcatagattctcacaaa

SEQ ID NO: 470983 - DNA, 20 bp, Artificial Sequence
  chemically synthesized
agtggggtgtgtgtgtgtca

SEQ ID NO: 470984 - DNA, 20 bp, Artificial Sequence
  chemically synthesized
tctgtgtaggtatacgtaag

SEQ ID NO: 470985 - DNA, 20 bp, Artificial Sequence
  chemically synthesized
cccacttacgtatacctaca

SEQ ID NO: 470986 - DNA, 20 bp, Artificial Sequence
  chemically synthesized
gtgatgaacactgtgggaat

SEQ ID NO: 470987 - DNA, 20 bp, Artificial Sequence
  chemically synthesized
ggttatgtgatgaacactgt

SEQ ID NO: 470988 - DNA, 20 bp, Artificial Sequence
  chemically synthesized
aaacacataaggcgatctct

SEQ ID NO: 470989 - DNA, 20 bp, Artificial Sequence
  chemically synthesized
tttttcaagcctgcatttct

SEQ ID NO: 470990 - DNA, 20 bp, Artificial Sequence
  chemically synthesized
ttttatttatttttgtagag

SEQ ID NO: 470991 - DNA, 20 bp, Artificial Sequence
  chemically synthesized
aaataaattttaaaaatgag

SEQ ID NO: 470992 - DNA, 20 bp, Artificial Sequence
  chemically synthesized
tcctgagtagctgggacaac

SEQ ID NO: 470993 - DNA, 20 bp, Artificial Sequence
  chemically synthesized
ggttcttctgcctcagcctc

SEQ ID NO: 470994 - DNA, 20 bp, Artificial Sequence
  chemically synthesized
agaagaaccgccatgagccc

SEQ ID NO: 470995 - DNA, 20 bp, Artificial Sequence
  chemically synthesized
tcttgctctgtctcccaggc

SEQ ID NO: 470996 - DNA, 20 bp, Artificial Sequence
  chemically synthesized
ttttgggttttgttttggga

SEQ ID NO: 470997 - DNA, 20 bp, Artificial Sequence
  chemically synthesized
atcttaagttgcagcttgtt

SEQ ID NO: 470998 - DNA, 20 bp, Artificial Sequence
  chemically synthesized
caacttaagataactcattt

SEQ ID NO: 470999 - DNA, 20 bp, Artificial Sequence
  chemically synthesized
tctacaaggaatattctgaa

SEQ ID NO: 471000 - DNA, 20 bp, Artificial Sequence
  chemically synthesized
tttgtcgttttagatctaca

SEQ ID NO: 471001 - DNA, 20 bp, Artificial Sequence
  chemically synthesized
tgggtacagagcatacaaat

SEQ ID NO: 471002 - DNA, 20 bp, Artificial Sequence
  chemically synthesized
cataacttgaattattttga

SEQ ID NO: 471003 - DNA, 20 bp, Artificial Sequence
  chemically synthesized
ccctcataacttgaattatt

SEQ ID NO: 471004 - DNA, 20 bp, Artificial Sequence
  chemically synthesized
gttttctttcccctcataac

SEQ ID NO: 471005 - DNA, 20 bp, Artificial Sequence
  chemically synthesized
ctcacaattcctaaggcctg

SEQ ID NO: 471006 - DNA, 20 bp, Artificial Sequence
  chemically synthesized
ttaatgacccgccaggcctt

SEQ ID NO: 471007 - DNA, 20 bp, Artificial Sequence
  chemically synthesized
aaaccacaaatgttgtgtaa

SEQ ID NO: 471008 - DNA, 20 bp, Artificial Sequence
  chemically synthesized
caacatttgtggtttggcaa

SEQ ID NO: 471009 - DNA, 20 bp, Artificial Sequence
  chemically synthesized
tataggccctctcaggtata

SEQ ID NO: 471010 - DNA, 20 bp, Artificial Sequence
  chemically synthesized
ctcaggtatattgaattttt

SEQ ID NO: 471011 - DNA, 20 bp, Artificial Sequence
  chemically synthesized
aagaaagctgactgtcaatt

SEQ ID NO: 471012 - DNA, 20 bp, Artificial Sequence
  chemically synthesized
atacatcactagattgtttc

SEQ ID NO: 471013 - DNA, 20 bp, Artificial Sequence
  chemically synthesized
gttaaatgacaggtgacctt

SEQ ID NO: 471014 - DNA, 20 bp, Artificial Sequence
  chemically synthesized
ctggtagagctctgtcattt

SEQ ID NO: 471015 - DNA, 20 bp, Artificial Sequence
  chemically synthesized
ggatggtcccagcaagttgt

SEQ ID NO: 471016 - DNA, 20 bp, Artificial Sequence
  chemically synthesized
gaaagactttagcatttaca

SEQ ID NO: 471017 - DNA, 20 bp, Artificial Sequence
  chemically synthesized
atttttgcttttgaaccatt

SEQ ID NO: 471018 - DNA, 20 bp, Artificial Sequence
  chemically synthesized
agcgctttgaaataaagatt

SEQ ID NO: 471019 - DNA, 20 bp, Artificial Sequence
  chemically synthesized
atataaacattattcggttc

SEQ ID NO: 471020 - DNA, 20 bp, Artificial Sequence
  chemically synthesized
agaagaaacaaattctggaa

SEQ ID NO: 471021 - DNA, 20 bp, Artificial Sequence
  chemically synthesized
aactgaagtgcgatcgattt

SEQ ID NO: 471022 - DNA, 20 bp, Artificial Sequence
  chemically synthesized
tctgtagtgttccacattgg

SEQ ID NO: 471023 - DNA, 20 bp, Artificial Sequence
  chemically synthesized
cctttctgtagtgttccaca

SEQ ID NO: 471024 - DNA, 20 bp, Artificial Sequence
  chemically synthesized
ccggtatctctttgacagag

SEQ ID NO: 471025 - DNA, 20 bp, Artificial Sequence
  chemically synthesized
aatgtccggtatctctttga

SEQ ID NO: 471026 - DNA, 20 bp, Artificial Sequence
  chemically synthesized
agatctgtatatgtagagga

SEQ ID NO: 471027 - DNA, 20 bp, Artificial Sequence
  chemically synthesized
tgaaatgaaatacaggtatc

SEQ ID NO: 471028 - DNA, 20 bp, Artificial Sequence
  chemically synthesized
cttccttcttcccattattt

SEQ ID NO: 471029 - DNA, 20 bp, Artificial Sequence
  chemically synthesized
cttcctatatttacttgggc

SEQ ID NO: 471030 - DNA, 20 bp, Artificial Sequence
  chemically synthesized
tcaagaaatggaagacagct

SEQ ID NO: 471031 - DNA, 20 bp, Artificial Sequence
  chemically synthesized
tttgttcctcattcaattac

SEQ ID NO: 471032 - DNA, 20 bp, Artificial Sequence
  chemically synthesized
tccagggtttattcatgtaa

SEQ ID NO: 471033 - DNA, 20 bp, Artificial Sequence
  chemically synthesized
agtatatgtagttatttctc

SEQ ID NO: 471034 - DNA, 20 bp, Artificial Sequence
  chemically synthesized
gcgtcatatttccagttttc

SEQ ID NO: 471035 - DNA, 20 bp, Artificial Sequence
  chemically synthesized
tgatacagtaaaatgcagtt

SEQ ID NO: 471036 - DNA, 20 bp, Artificial Sequence
  chemically synthesized
aatgcagttctgaatgatat

SEQ ID NO: 471037 - DNA, 20 bp, Artificial Sequence
  chemically synthesized
tttatgaataggctctgcat

SEQ ID NO: 471038 - DNA, 20 bp, Artificial Sequence
  chemically synthesized
ccccttcccctcaaaagttt

SEQ ID NO: 471039 - DNA, 20 bp, Artificial Sequence
  chemically synthesized
caggggcctcacacagaaag

SEQ ID NO: 471040 - DNA, 20 bp, Artificial Sequence
  chemically synthesized
agtctggagaggcaacaatg

SEQ ID NO: 471041 - DNA, 20 bp, Artificial Sequence
  chemically synthesized
gaatggccttagcgtatgtt

SEQ ID NO: 471042 - DNA, 20 bp, Artificial Sequence
  chemically synthesized
aagcaagcctgcctaccttg

SEQ ID NO: 471043 - DNA, 20 bp, Artificial Sequence
  chemically synthesized
ctgcctaccttggagggtta

SEQ ID NO: 471044 - DNA, 20 bp, Artificial Sequence
  chemically synthesized
tagttgattacaatatagat

SEQ ID NO: 471045 - DNA, 20 bp, Artificial Sequence
  chemically synthesized
cttgattgacttaattacag

SEQ ID NO: 471046 - DNA, 20 bp, Artificial Sequence
  chemically synthesized
tgttggttttgctctctagg

SEQ ID NO: 471047 - DNA, 20 bp, Artificial Sequence
  chemically synthesized
ggtctttgaagttgtacagt

SEQ ID NO: 471048 - DNA, 20 bp, Artificial Sequence
  chemically synthesized
cactgactagtaaatattac

SEQ ID NO: 471049 - DNA, 20 bp, Artificial Sequence
  chemically synthesized
ccttgttatagtcctcaaat

SEQ ID NO: 471050 - DNA, 20 bp, Artificial Sequence
  chemically synthesized
aacaagggcttatcagttga

SEQ ID NO: 471051 - DNA, 20 bp, Artificial Sequence
  chemically synthesized
tatcagttgagggaatataa

SEQ ID NO: 471052 - DNA, 20 bp, Artificial Sequence
  chemically synthesized
ctcttcttgctctttaagac

SEQ ID NO: 471053 - DNA, 20 bp, Artificial Sequence
  chemically synthesized
gatatggtctctatgcttta

SEQ ID NO: 471054 - DNA, 20 bp, Artificial Sequence
  chemically synthesized
atcataaaccggcttggtca

SEQ ID NO: 471055 - DNA, 20 bp, Artificial Sequence
  chemically synthesized
gccggtttatgatctggaga

SEQ ID NO: 471056 - DNA, 20 bp, Artificial Sequence
  chemically synthesized
ggcatttctcagctcggaaa

SEQ ID NO: 471057 - DNA, 20 bp, Artificial Sequence
  chemically synthesized
ccttgctctgcacttatata

SEQ ID NO: 471058 - DNA, 20 bp, Artificial Sequence
  chemically synthesized
aaatagaggaggcctgaatg

SEQ ID NO: 471059 - DNA, 20 bp, Artificial Sequence
  chemically synthesized
cctttggaaatagaggaggc

SEQ ID NO: 471060 - DNA, 20 bp, Artificial Sequence
  chemically synthesized
ccctggtgcttatatcacat

SEQ ID NO: 471061 - DNA, 20 bp, Artificial Sequence
  chemically synthesized
taacaacaatgtcccatctc

SEQ ID NO: 471062 - DNA, 20 bp, Artificial Sequence
  chemically synthesized
cacggtgaaaagccaccatc

SEQ ID NO: 471063 - DNA, 20 bp, Artificial Sequence
  chemically synthesized
acagtgtgtacaatttacag

SEQ ID NO: 471064 - DNA, 20 bp, Artificial Sequence
  chemically synthesized
atttacaggagaatcccaca

SEQ ID NO: 471065 - DNA, 20 bp, Artificial Sequence
  chemically synthesized
acaggagaatcccacataga

SEQ ID NO: 471066 - DNA, 20 bp, Artificial Sequence
  chemically synthesized
aagccctcattcattctatg

SEQ ID NO: 471067 - DNA, 20 bp, Artificial Sequence
  chemically synthesized
aataaattctttaaaaaggc

SEQ ID NO: 471068 - DNA, 20 bp, Artificial Sequence
  chemically synthesized
catacattcctgccttttta

SEQ ID NO: 471069 - DNA, 20 bp, Artificial Sequence
  chemically synthesized
ttgaaggttaaaattatgaa

SEQ ID NO: 471070 - DNA, 20 bp, Artificial Sequence
  chemically synthesized
ttcagttttgccgaggactg

SEQ ID NO: 471071 - DNA, 20 bp, Artificial Sequence
  chemically synthesized
gggcaatggaattgggggct

SEQ ID NO: 471072 - DNA, 20 bp, Artificial Sequence
  chemically synthesized
cttaactcacaaatgggcaa

SEQ ID NO: 471073 - DNA, 20 bp, Artificial Sequence
  chemically synthesized
cccaattccattgcccattt

SEQ ID NO: 471074 - DNA, 20 bp, Artificial Sequence
  chemically synthesized
ccagaatcacagataactgg

SEQ ID NO: 471075 - DNA, 20 bp, Artificial Sequence
  chemically synthesized
tatctgtgattctgggggac

SEQ ID NO: 471076 - DNA, 20 bp, Artificial Sequence
  chemically synthesized
tctatgttattcaagtcccc

SEQ ID NO: 471077 - DNA, 20 bp, Artificial Sequence
  chemically synthesized
ttagcttctggaattgtttg

SEQ ID NO: 471078 - DNA, 20 bp, Artificial Sequence
  chemically synthesized
aggtgagaaaggttagcttc

SEQ ID NO: 471079 - DNA, 20 bp, Artificial Sequence
  chemically synthesized
agcacaagtggaaagaagaa

SEQ ID NO: 471080 - DNA, 20 bp, Artificial Sequence
  chemically synthesized
gtggaaagaagaaaagaata

SEQ ID NO: 471081 - DNA, 20 bp, Artificial Sequence
  chemically synthesized
aagactatttttctcgtttt

SEQ ID NO: 471082 - DNA, 20 bp, Artificial Sequence
  chemically synthesized
ggttcgtcatatagttacca

SEQ ID NO: 471083 - DNA, 20 bp, Artificial Sequence
  chemically synthesized
agaaaataacaagccgtgaa

SEQ ID NO: 471084 - DNA, 20 bp, Artificial Sequence
  chemically synthesized
cttgttattttctacctgtg

SEQ ID NO: 471085 - DNA, 20 bp, Artificial Sequence
  chemically synthesized
aaatgtgtcccagtggggct

SEQ ID NO: 471086 - DNA, 20 bp, Artificial Sequence
  chemically synthesized
catagttcctatctattttg

SEQ ID NO: 471087 - DNA, 20 bp, Artificial Sequence
  chemically synthesized
ctccaaaatagataggaact

SEQ ID NO: 471088 - DNA, 20 bp, Artificial Sequence
  chemically synthesized
ataggaactatgaatatgga

SEQ ID NO: 471089 - DNA, 20 bp, Artificial Sequence
  chemically synthesized
cttcaaggtacaagatagat

SEQ ID NO: 471090 - DNA, 20 bp, Artificial Sequence
  chemically synthesized
actgttttagaaggcaggca

SEQ ID NO: 471091 - DNA, 20 bp, Artificial Sequence
  chemically synthesized
gcctgccttctaaaacagta

SEQ ID NO: 471092 - DNA, 20 bp, Artificial Sequence
  chemically synthesized
gctcttctcatggagttact

SEQ ID NO: 471093 - DNA, 20 bp, Artificial Sequence
  chemically synthesized
gtaaatgtgggctcttctca

SEQ ID NO: 471094 - DNA, 20 bp, Artificial Sequence
  chemically synthesized
gagaagagcccacatttacc

SEQ ID NO: 471095 - DNA, 20 bp, Artificial Sequence
  chemically synthesized
acacggtgtgctagggagga

SEQ ID NO: 471096 - DNA, 20 bp, Artificial Sequence
  chemically synthesized
tgctagggaggagggagtgg

SEQ ID NO: 471097 - DNA, 20 bp, Artificial Sequence
  chemically synthesized
agggaggagggagtggaagg

SEQ ID NO: 471098 - DNA, 20 bp, Artificial Sequence
  chemically synthesized
gggagtgtatttccgatgtg

SEQ ID NO: 471099 - DNA, 20 bp, Artificial Sequence
  chemically synthesized
ttggttgttcatggtatatg

SEQ ID NO: 471100 - DNA, 20 bp, Artificial Sequence
  chemically synthesized
attaacatgtgaacaggttt

SEQ ID NO: 471101 - DNA, 20 bp, Artificial Sequence
  chemically synthesized
tgaaacctgttcacatgtta

SEQ ID NO: 471102 - DNA, 20 bp, Artificial Sequence
  chemically synthesized
aaagatgtaaagagcgtttt

SEQ ID NO: 471103 - DNA, 20 bp, Artificial Sequence
  chemically synthesized
ctttatattttaatttgcat

SEQ ID NO: 471104 - DNA, 20 bp, Artificial Sequence
  chemically synthesized
tattgacaagtaggtgttgc

SEQ ID NO: 471105 - DNA, 20 bp, Artificial Sequence
  chemically synthesized
taggtcagccttgtgctcag

SEQ ID NO: 471106 - DNA, 20 bp, Artificial Sequence
  chemically synthesized
gctgttcctgctgtcagtgc

SEQ ID NO: 471107 - DNA, 20 bp, Artificial Sequence
  chemically synthesized
gctggaataatcagacttat

SEQ ID NO: 471108 - DNA, 20 bp, Artificial Sequence
  chemically synthesized
tttttaaaaaggcaactgtt

SEQ ID NO: 471109 - DNA, 20 bp, Artificial Sequence
  chemically synthesized
gcgttctcttgcgatttgca

SEQ ID NO: 471110 - DNA, 20 bp, Artificial Sequence
  chemically synthesized
tcttgcgatttgcagaggat

SEQ ID NO: 471111 - DNA, 20 bp, Artificial Sequence
  chemically synthesized
aagggaaatcatttgtgtgt

SEQ ID NO: 471112 - DNA, 20 bp, Artificial Sequence
  chemically synthesized
aaatgatttccctttaatct

SEQ ID NO: 471113 - DNA, 20 bp, Artificial Sequence
  chemically synthesized
tgccaaggttcctctagaaa

SEQ ID NO: 471114 - DNA, 20 bp, Artificial Sequence
  chemically synthesized
ggaaccttggcatttgcgtg

SEQ ID NO: 471115 - DNA, 20 bp, Artificial Sequence
  chemically synthesized
ttgaacttggcttgcattgc

SEQ ID NO: 471116 - DNA, 20 bp, Artificial Sequence
  chemically synthesized
ttgcattgctggaatactgg

SEQ ID NO: 471117 - DNA, 20 bp, Artificial Sequence
  chemically synthesized
tgctggaatactggcagggt

SEQ ID NO: 471118 - DNA, 20 bp, Artificial Sequence
  chemically synthesized
agtttctgctaccgtggggc

SEQ ID NO: 471119 - DNA, 20 bp, Artificial Sequence
  chemically synthesized
accgtggggcaggggtttgg

SEQ ID NO: 471120 - DNA, 20 bp, Artificial Sequence
  chemically synthesized
acaagaaatggggaactaga

SEQ ID NO: 471121 - DNA, 20 bp, Artificial Sequence
  chemically synthesized
gggaacaagaaatggggaac

SEQ ID NO: 471122 - DNA, 20 bp, Artificial Sequence
  chemically synthesized
gttccccatttcttgttccc

SEQ ID NO: 471123 - DNA, 20 bp, Artificial Sequence
  chemically synthesized
ttgccctggctttagccaga

SEQ ID NO: 471124 - DNA, 20 bp, Artificial Sequence
  chemically synthesized
gaccaaagttgagggtgggt

SEQ ID NO: 471125 - DNA, 20 bp, Artificial Sequence
  chemically synthesized
tgctttgaccaaagttgagg

SEQ ID NO: 471126 - DNA, 20 bp, Artificial Sequence
  chemically synthesized
aaattgctttgaccaaagtt

SEQ ID NO: 471127 - DNA, 20 bp, Artificial Sequence
  chemically synthesized
tggtcaaagcaatttctttt

SEQ ID NO: 471128 - DNA, 20 bp, Artificial Sequence
  chemically synthesized
tctctgacccttgaacaccg

SEQ ID NO: 471129 - DNA, 20 bp, Artificial Sequence
  chemically synthesized
aaaccaattccacggtgttc

SEQ ID NO: 471130 - DNA, 20 bp, Artificial Sequence
  chemically synthesized
atacatttgctgttggagaa

SEQ ID NO: 471131 - DNA, 20 bp, Artificial Sequence
  chemically synthesized
tttactcaagcccctctttg

SEQ ID NO: 471132 - DNA, 20 bp, Artificial Sequence
  chemically synthesized
tgtatcctccaaagaggggc

SEQ ID NO: 471133 - DNA, 20 bp, Artificial Sequence
  chemically synthesized
caaaaaaagaaaggttgatt

SEQ ID NO: 471134 - DNA, 20 bp, Artificial Sequence
  chemically synthesized
attgggggtgtggggggggg

SEQ ID NO: 471135 - DNA, 20 bp, Artificial Sequence
  chemically synthesized
ggggtgtggggggggggggg

SEQ ID NO: 471136 - DNA, 20 bp, Artificial Sequence
  chemically synthesized
gggtgacaaggagagatgac

SEQ ID NO: 471137 - DNA, 20 bp, Artificial Sequence
  chemically synthesized
ggataaagcagaagaccaag

SEQ ID NO: 471138 - DNA, 20 bp, Artificial Sequence
  chemically synthesized
ttaaaagttcaccacttaaa

SEQ ID NO: 471139 - DNA, 20 bp, Artificial Sequence
  chemically synthesized
aagttcaccacttaaatcgg

SEQ ID NO: 471140 - DNA, 20 bp, Artificial Sequence
  chemically synthesized
agtttgaagctttaaattga

SEQ ID NO: 471141 - DNA, 20 bp, Artificial Sequence
  chemically synthesized
tgccctttttattgccgtgc

SEQ ID NO: 471142 - DNA, 20 bp, Artificial Sequence
  chemically synthesized
tttattgccgtgctgggatt

SEQ ID NO: 471143 - DNA, 20 bp, Artificial Sequence
  chemically synthesized
attgggtgtggagtcatttc

SEQ ID NO: 471144 - DNA, 20 bp, Artificial Sequence
  chemically synthesized
ttgcccttcgggattgggtg

SEQ ID NO: 471145 - DNA, 20 bp, Artificial Sequence
  chemically synthesized
tttttttttgcccttcggga

SEQ ID NO: 471146 - DNA, 20 bp, Artificial Sequence
  chemically synthesized
ttttttttttttttgccctt

SEQ ID NO: 471147 - DNA, 20 bp, Artificial Sequence
  chemically synthesized
agtcaaagatttcagggggt

SEQ ID NO: 471148 - DNA, 20 bp, Artificial Sequence
  chemically synthesized
cccagaagtcaaagatttca

SEQ ID NO: 471149 - DNA, 20 bp, Artificial Sequence
  chemically synthesized
tttctgcaggtcttggggca

SEQ ID NO: 471150 - DNA, 20 bp, Artificial Sequence
  chemically synthesized
gcagcgagggaaatgtcagt

SEQ ID NO: 471151 - DNA, 20 bp, Artificial Sequence
  chemically synthesized
ctttctgcctgatttcttcc

SEQ ID NO: 471152 - DNA, 20 bp, Artificial Sequence
  chemically synthesized
cgcgtgcgccccttccttct

SEQ ID NO: 471153 - DNA, 20 bp, Artificial Sequence
  chemically synthesized
tccacactggcagcctggaa

SEQ ID NO: 471154 - DNA, 20 bp, Artificial Sequence
  chemically synthesized
ggataacgcgttcctcacgc

SEQ ID NO: 471155 - DNA, 20 bp, Artificial Sequence
  chemically synthesized
gatttctccccgtccccaga

SEQ ID NO: 471156 - DNA, 20 bp, Artificial Sequence
  chemically synthesized
cgcggctgcaggtgcgcccc

SEQ ID NO: 471157 - DNA, 20 bp, Artificial Sequence
  chemically synthesized
ggcgtctaggaacctctccc

SEQ ID NO: 471158 - DNA, 20 bp, Artificial Sequence
  chemically synthesized
acgcccagccgcccggcgcc

SEQ ID NO: 471159 - DNA, 20 bp, Artificial Sequence
  chemically synthesized
cctgctcgcgccacaagtgc

SEQ ID NO: 471160 - DNA, 20 bp, Artificial Sequence
  chemically synthesized
gggaacagctcaaagggtaa

SEQ ID NO: 471161 - DNA, 20 bp, Artificial Sequence
  chemically synthesized
agccatgagggaacagctca

SEQ ID NO: 471162 - DNA, 20 bp, Artificial Sequence
  chemically synthesized
tggctgcaagggctccgcgg

SEQ ID NO: 471163 - DNA, 20 bp, Artificial Sequence
  chemically synthesized
caagggctccgcggtcgagt

SEQ ID NO: 471164 - DNA, 20 bp, Artificial Sequence
  chemically synthesized
ctccgcggtcgagtgtgggt

SEQ ID NO: 471165 - DNA, 20 bp, Artificial Sequence
  chemically synthesized
tcgagtgtgggtacgagtgg

SEQ ID NO: 471166 - DNA, 20 bp, Artificial Sequence
  chemically synthesized
actgcccagtctctgggtgt

SEQ ID NO: 471167 - DNA, 20 bp, Artificial Sequence
  chemically synthesized
aagccccaactgcccagtct

SEQ ID NO: 471168 - DNA, 20 bp, Artificial Sequence
  chemically synthesized
gaaagaaagaaagaaagaaa

SEQ ID NO: 471169 - DNA, 20 bp, Artificial Sequence
  chemically synthesized
aagaaagaaagaaagaggat

SEQ ID NO: 471170 - DNA, 20 bp, Artificial Sequence
  chemically synthesized
ggtgtgtggcttccaggttc

SEQ ID NO: 471171 - DNA, 20 bp, Artificial Sequence
  chemically synthesized
tgggatgaggtcatttgcac

SEQ ID NO: 471172 - DNA, 20 bp, Artificial Sequence
  chemically synthesized
tgacctcatcccagataatt

SEQ ID NO: 471173 - DNA, 20 bp, Artificial Sequence
  chemically synthesized
agcccacactcttaattatc

SEQ ID NO: 471174 - DNA, 20 bp, Artificial Sequence
  chemically synthesized
gataattaagagtgtgggct

SEQ ID NO: 471175 - DNA, 20 bp, Artificial Sequence
  chemically synthesized
actgaggaggaagggagagt

SEQ ID NO: 471176 - DNA, 20 bp, Artificial Sequence
  chemically synthesized
tcttcaactgaggaggaagg

SEQ ID NO: 471177 - DNA, 20 bp, Artificial Sequence
  chemically synthesized
taggctcatcctgggctaaa

SEQ ID NO: 471178 - DNA, 20 bp, Artificial Sequence
  chemically synthesized
tttaacaatcccttttagcc

SEQ ID NO: 471179 - DNA, 20 bp, Artificial Sequence
  chemically synthesized
aagggattgttaaaaagact

SEQ ID NO: 471180 - DNA, 20 bp, Artificial Sequence
  chemically synthesized
ttgttaaaaagactttggat

SEQ ID NO: 471181 - DNA, 20 bp, Artificial Sequence
  chemically synthesized
tttggatttgtgacatagca

SEQ ID NO: 471182 - DNA, 20 bp, Artificial Sequence
  chemically synthesized
atactgataactgctgttcc

SEQ ID NO: 471183 - DNA, 20 bp, Artificial Sequence
  chemically synthesized
ataggtctgggccgggccca

SEQ ID NO: 471184 - DNA, 20 bp, Artificial Sequence
  chemically synthesized
ttctcaaacattagtatgct

SEQ ID NO: 471185 - DNA, 20 bp, Artificial Sequence
  chemically synthesized
ctctgagcatactaatgttt

SEQ ID NO: 471186 - DNA, 20 bp, Artificial Sequence
  chemically synthesized
ggtggtattgtcttaattta

SEQ ID NO: 471187 - DNA, 20 bp, Artificial Sequence
  chemically synthesized
ttccttctagatcttcctaa

SEQ ID NO: 471188 - DNA, 20 bp, Artificial Sequence
  chemically synthesized
tagaaggaacttgtttctaa

SEQ ID NO: 471189 - DNA, 20 bp, Artificial Sequence
  chemically synthesized
agttcaaataattctaattt

SEQ ID NO: 471190 - DNA, 20 bp, Artificial Sequence
  chemically synthesized
catactgcaaactctaaaat

SEQ ID NO: 471191 - DNA, 20 bp, Artificial Sequence
  chemically synthesized
atgaaggctttcttcttctt

SEQ ID NO: 471192 - DNA, 20 bp, Artificial Sequence
  chemically synthesized
aagaaagccttcattagcac

SEQ ID NO: 471193 - DNA, 20 bp, Artificial Sequence
  chemically synthesized
agtttatcgtaagatgctct

SEQ ID NO: 471194 - DNA, 20 bp, Artificial Sequence
  chemically synthesized
ggaatgaatcaatcggaaag

SEQ ID NO: 471195 - DNA, 20 bp, Artificial Sequence
  chemically synthesized
aaactgtagaccgaagtgga

SEQ ID NO: 471196 - DNA, 20 bp, Artificial Sequence
  chemically synthesized
atttaaactgtagaccgaag

SEQ ID NO: 471197 - DNA, 20 bp, Artificial Sequence
  chemically synthesized
tttttaaaatttatttctta

SEQ ID NO: 471198 - DNA, 20 bp, Artificial Sequence
  chemically synthesized
aaatttatttcttaagggat

SEQ ID NO: 471199 - DNA, 20 bp, Artificial Sequence
  chemically synthesized
tgggaggattgcttgagccc

SEQ ID NO: 471200 - DNA, 20 bp, Artificial Sequence
  chemically synthesized
gcacttggaggctgaagtgg

SEQ ID NO: 471201 - DNA, 20 bp, Artificial Sequence
  chemically synthesized
aaggattatttcaaaagaag

SEQ ID NO: 471202 - DNA, 20 bp, Artificial Sequence
  chemically synthesized
gggaaaaatgttgagcagaa

SEQ ID NO: 471203 - DNA, 20 bp, Artificial Sequence
  chemically synthesized
ctgctcaacatttttccccc

SEQ ID NO: 471204 - DNA, 20 bp, Artificial Sequence
  chemically synthesized
atagcattagataaagcaaa

SEQ ID NO: 471205 - DNA, 20 bp, Artificial Sequence
  chemically synthesized
gtatctggacaaaagcaaaa

SEQ ID NO: 471206 - DNA, 20 bp, Artificial Sequence
  chemically synthesized
acaaaagcaaaagggaatgc

SEQ ID NO: 471207 - DNA, 20 bp, Artificial Sequence
  chemically synthesized
ttggtttgttaaaggtaata

SEQ ID NO: 471208 - DNA, 20 bp, Artificial Sequence
  chemically synthesized
agtaatctcagtgtatgagc

SEQ ID NO: 471209 - DNA, 20 bp, Artificial Sequence
  chemically synthesized
cctttagcaattttaagcta

SEQ ID NO: 471210 - DNA, 20 bp, Artificial Sequence
  chemically synthesized
cccaaggatcggagcagacc

SEQ ID NO: 471211 - DNA, 20 bp, Artificial Sequence
  chemically synthesized
tgctccgatccttggggaag

SEQ ID NO: 471212 - DNA, 20 bp, Artificial Sequence
  chemically synthesized
gacactaatccctcttcccc

SEQ ID NO: 471213 - DNA, 20 bp, Artificial Sequence
  chemically synthesized
atattacaaatcgataaact

SEQ ID NO: 471214 - DNA, 20 bp, Artificial Sequence
  chemically synthesized
aaactaaggatttgtaacac

SEQ ID NO: 471215 - DNA, 20 bp, Artificial Sequence
  chemically synthesized
aacaaaaaacaggaaaggaa

SEQ ID NO: 471216 - DNA, 20 bp, Artificial Sequence
  chemically synthesized
aaattacctgctcaaaattc

SEQ ID NO: 471217 - DNA, 20 bp, Artificial Sequence
  chemically synthesized
agagaagcgtgtcagaactc

SEQ ID NO: 471218 - DNA, 20 bp, Artificial Sequence
  chemically synthesized
tgtccaattagaaaactact

SEQ ID NO: 471219 - DNA, 20 bp, Artificial Sequence
  chemically synthesized
ataatctgttgacaagaaaa

SEQ ID NO: 471220 - DNA, 20 bp, Artificial Sequence
  chemically synthesized
ctgttgacaagaaaaaagaa

SEQ ID NO: 471221 - DNA, 20 bp, Artificial Sequence
  chemically synthesized
tgtcaatttttttaaaaagt

SEQ ID NO: 471222 - DNA, 20 bp, Artificial Sequence
  chemically synthesized
gaacttaaagatgtattttt

SEQ ID NO: 471223 - DNA, 20 bp, Artificial Sequence
  chemically synthesized
ctttaagttcttttttagac

SEQ ID NO: 471224 - DNA, 20 bp, Artificial Sequence
  chemically synthesized
tgttcaattgcagtcagatt

SEQ ID NO: 471225 - DNA, 20 bp, Artificial Sequence
  chemically synthesized
ttcagctaaaattttgactt

SEQ ID NO: 471226 - DNA, 20 bp, Artificial Sequence
  chemically synthesized
ttgttcccagtaccactgtc

SEQ ID NO: 471227 - DNA, 20 bp, Artificial Sequence
  chemically synthesized
accactgtctagaatggtgc

SEQ ID NO: 471228 - DNA, 20 bp, Artificial Sequence
  chemically synthesized
gtctagaatggtgcaaggat

SEQ ID NO: 471229 - DNA, 20 bp, Artificial Sequence
  chemically synthesized
tggtgcaaggattggaattg

SEQ ID NO: 471230 - DNA, 20 bp, Artificial Sequence
  chemically synthesized
taagcgcatgagtcttcgag

SEQ ID NO: 471231 - DNA, 20 bp, Artificial Sequence
  chemically synthesized
atagcagaatagctaagcgc

SEQ ID NO: 471232 - DNA, 20 bp, Artificial Sequence
  chemically synthesized
gtctcttcatggcagcatag

SEQ ID NO: 471233 - DNA, 20 bp, Artificial Sequence
  chemically synthesized
agccatcagtgagattgtct

SEQ ID NO: 471234 - DNA, 20 bp, Artificial Sequence
  chemically synthesized
actgatggctcagagcagag

SEQ ID NO: 471235 - DNA, 20 bp, Artificial Sequence
  chemically synthesized
gagataaagaagaaatgaaa

SEQ ID NO: 471236 - DNA, 20 bp, Artificial Sequence
  chemically synthesized
tttggctacgggaaaatgta

SEQ ID NO: 471237 - DNA, 20 bp, Artificial Sequence
  chemically synthesized
agtttaagtggttcaaagac

SEQ ID NO: 471238 - DNA, 20 bp, Artificial Sequence
  chemically synthesized
ctttgaaccacttaaacttt

SEQ ID NO: 471239 - DNA, 20 bp, Artificial Sequence
  chemically synthesized
aaactttgagggtatcttta

SEQ ID NO: 471240 - DNA, 20 bp, Artificial Sequence
  chemically synthesized
ctctgacctaagggactgtg

SEQ ID NO: 471241 - DNA, 20 bp, Artificial Sequence
  chemically synthesized
caaagaatagagatggatgg

SEQ ID NO: 471242 - DNA, 20 bp, Artificial Sequence
  chemically synthesized
gagaaggacaaagaatagag

SEQ ID NO: 471243 - DNA, 20 bp, Artificial Sequence
  chemically synthesized
gagcagaatggagaaggaca

SEQ ID NO: 471244 - DNA, 20 bp, Artificial Sequence
  chemically synthesized
caacctcctgggccacagag

SEQ ID NO: 471245 - DNA, 20 bp, Artificial Sequence
  chemically synthesized
ggacaggaggaaggtgatgt

SEQ ID NO: 471246 - DNA, 20 bp, Artificial Sequence
  chemically synthesized
gatcagtaggagggaacctg

SEQ ID NO: 471247 - DNA, 20 bp, Artificial Sequence
  chemically synthesized
gatctctggcctggcagctg

SEQ ID NO: 471248 - DNA, 20 bp, Artificial Sequence
  chemically synthesized
ggaatggtttgcgtaactgg

SEQ ID NO: 471249 - DNA, 20 bp, Artificial Sequence
  chemically synthesized
ttgcccaaagggataaaggg

SEQ ID NO: 471250 - DNA, 20 bp, Artificial Sequence
  chemically synthesized
aatggtaaacttttgcccaa

SEQ ID NO: 471251 - DNA, 20 bp, Artificial Sequence
  chemically synthesized
aggagaaaaaaaaaaaaaca

SEQ ID NO: 471252 - DNA, 20 bp, Artificial Sequence
  chemically synthesized
attcaaacggaacacttgaa

SEQ ID NO: 471253 - DNA, 20 bp, Artificial Sequence
  chemically synthesized
actctcttcaagtgttccgt

SEQ ID NO: 471254 - DNA, 20 bp, Artificial Sequence
  chemically synthesized
tggatgggtctcagtttggt

SEQ ID NO: 471255 - DNA, 20 bp, Artificial Sequence
  chemically synthesized
cagagggtggctttggctgg

SEQ ID NO: 471256 - DNA, 20 bp, Artificial Sequence
  chemically synthesized
gccccagagggtggctttgg

SEQ ID NO: 471257 - DNA, 20 bp, Artificial Sequence
  chemically synthesized
gcatcaagtctattgcccca

SEQ ID NO: 471258 - DNA, 20 bp, Artificial Sequence
  chemically synthesized
ctggggcaatagacttgatg

SEQ ID NO: 471259 - DNA, 20 bp, Artificial Sequence
  chemically synthesized
gctttttagccccagagtgg

SEQ ID NO: 471260 - DNA, 20 bp, Artificial Sequence
  chemically synthesized
tctcatctgctttttagccc

SEQ ID NO: 471261 - DNA, 20 bp, Artificial Sequence
  chemically synthesized
aagcagatgagactcagtca

SEQ ID NO: 471262 - DNA, 20 bp, Artificial Sequence
  chemically synthesized
tctgaatatttatccaatga

SEQ ID NO: 471263 - DNA, 20 bp, Artificial Sequence
  chemically synthesized
ggcctacagaggaggcttct

SEQ ID NO: 471264 - DNA, 20 bp, Artificial Sequence
  chemically synthesized
caaagagcttctggcctttt

SEQ ID NO: 471265 - DNA, 20 bp, Artificial Sequence
  chemically synthesized
atggtgacaacagcagatgt

SEQ ID NO: 471266 - DNA, 20 bp, Artificial Sequence
  chemically synthesized
acagcagatgtgagggtaaa

SEQ ID NO: 471267 - DNA, 20 bp, Artificial Sequence
  chemically synthesized
ggtctgcttgatcttttgga

SEQ ID NO: 471268 - DNA, 20 bp, Artificial Sequence
  chemically synthesized
tttggagagaatgtcaagat

SEQ ID NO: 471269 - DNA, 20 bp, Artificial Sequence
  chemically synthesized
aagggcttagtgtgacaatc

SEQ ID NO: 471270 - DNA, 20 bp, Artificial Sequence
  chemically synthesized
aaaagctccctcataccttt

SEQ ID NO: 471271 - DNA, 20 bp, Artificial Sequence
  chemically synthesized
agggagctttttaaggaaga

SEQ ID NO: 471272 - DNA, 20 bp, Artificial Sequence
  chemically synthesized
aaggaagaaagaattaaagc

SEQ ID NO: 471273 - DNA, 20 bp, Artificial Sequence
  chemically synthesized
tcaagcccccataccattgc

SEQ ID NO: 471274 - DNA, 20 bp, Artificial Sequence
  chemically synthesized
tgggggcttgatcagaagac

SEQ ID NO: 471275 - DNA, 20 bp, Artificial Sequence
  chemically synthesized
aatctccttgtacctgatgt

SEQ ID NO: 471276 - DNA, 20 bp, Artificial Sequence
  chemically synthesized
caaggagattgcagtatgag

SEQ ID NO: 471277 - DNA, 20 bp, Artificial Sequence
  chemically synthesized
gattgcagtatgaggaggat

SEQ ID NO: 471278 - DNA, 20 bp, Artificial Sequence
  chemically synthesized
tacaataaggttccaactac

SEQ ID NO: 471279 - DNA, 20 bp, Artificial Sequence
  chemically synthesized
actacaggagtcttgactga

SEQ ID NO: 471280 - DNA, 20 bp, Artificial Sequence
  chemically synthesized
agtcttgactgactggatgt

SEQ ID NO: 471281 - DNA, 20 bp, Artificial Sequence
  chemically synthesized
cctcaagcttggccgccctt

SEQ ID NO: 471282 - DNA, 20 bp, Artificial Sequence
  chemically synthesized
gccgccctttggaatcactc

SEQ ID NO: 471283 - DNA, 20 bp, Artificial Sequence
  chemically synthesized
tctaaatttattaacaatcc

SEQ ID NO: 471284 - DNA, 20 bp, Artificial Sequence
  chemically synthesized
ttgttaataaatttagatgt

SEQ ID NO: 471285 - DNA, 20 bp, Artificial Sequence
  chemically synthesized
gaccaattaaattagaatct

SEQ ID NO: 471286 - DNA, 20 bp, Artificial Sequence
  chemically synthesized
atgtccaagaccaattaaat

SEQ ID NO: 471287 - DNA, 20 bp, Artificial Sequence
  chemically synthesized
atttaattggtcttggacat

SEQ ID NO: 471288 - DNA, 20 bp, Artificial Sequence
  chemically synthesized
ctgcatattagaatcacttg

SEQ ID NO: 471289 - DNA, 20 bp, Artificial Sequence
  chemically synthesized
ccttaaccttcactgcatat

SEQ ID NO: 471290 - DNA, 20 bp, Artificial Sequence
  chemically synthesized
aaggttaaggaccattgtcc

SEQ ID NO: 471291 - DNA, 20 bp, Artificial Sequence
  chemically synthesized
tccttgagtgacaacaaaga

SEQ ID NO: 471292 - DNA, 20 bp, Artificial Sequence
  chemically synthesized
tgagtgacaacaaagattgg

SEQ ID NO: 471293 - DNA, 20 bp, Artificial Sequence
  chemically synthesized
tgagtagcattctccgagct

SEQ ID NO: 471294 - DNA, 20 bp, Artificial Sequence
  chemically synthesized
ctcctgaaattcctagctcg

SEQ ID NO: 471295 - DNA, 20 bp, Artificial Sequence
  chemically synthesized
ttcaggaggagggggcagaa

SEQ ID NO: 471296 - DNA, 20 bp, Artificial Sequence
  chemically synthesized
agagggttaggaaagagatg

SEQ ID NO: 471297 - DNA, 20 bp, Artificial Sequence
  chemically synthesized
ccaattcattatgttcaaga

SEQ ID NO: 471298 - DNA, 20 bp, Artificial Sequence
  chemically synthesized
tgaatccagtcttgaacata

SEQ ID NO: 471299 - DNA, 20 bp, Artificial Sequence
  chemically synthesized
ctcagatgtccaactgtctc

SEQ ID NO: 471300 - DNA, 20 bp, Artificial Sequence
  chemically synthesized
tccaagagacagttggacat

SEQ ID NO: 471301 - DNA, 20 bp, Artificial Sequence
  chemically synthesized
tgagctcagagggaagatgt

SEQ ID NO: 471302 - DNA, 20 bp, Artificial Sequence
  chemically synthesized
aagatgtctgaattggagct

SEQ ID NO: 471303 - DNA, 20 bp, Artificial Sequence
  chemically synthesized
gatttgcagtgtactgttgg

SEQ ID NO: 471304 - DNA, 20 bp, Artificial Sequence
  chemically synthesized
agtgtactgttggaagggtc

SEQ ID NO: 471305 - DNA, 20 bp, Artificial Sequence
  chemically synthesized
ctgttggaagggtcttgggt

SEQ ID NO: 471306 - DNA, 20 bp, Artificial Sequence
  chemically synthesized
caaacacatctttttccttt

SEQ ID NO: 471307 - DNA, 20 bp, Artificial Sequence
  chemically synthesized
atgctagctgtgtaaaaatg

SEQ ID NO: 471308 - DNA, 20 bp, Artificial Sequence
  chemically synthesized
cataggaaaggacaaagaca

SEQ ID NO: 471309 - DNA, 20 bp, Artificial Sequence
  chemically synthesized
aagacaaggaatggtttgaa

SEQ ID NO: 471310 - DNA, 20 bp, Artificial Sequence
  chemically synthesized
tgaactgggtacttgcctgg

SEQ ID NO: 471311 - DNA, 20 bp, Artificial Sequence
  chemically synthesized
cgagagacttcaccaactcc

SEQ ID NO: 471312 - DNA, 20 bp, Artificial Sequence
  chemically synthesized
atagagagaagctgaaccct

SEQ ID NO: 471313 - DNA, 20 bp, Artificial Sequence
  chemically synthesized
tcactttataaaaattcatt

SEQ ID NO: 471314 - DNA, 20 bp, Artificial Sequence
  chemically synthesized
aagtgatacctatactctaa

SEQ ID NO: 471315 - DNA, 20 bp, Artificial Sequence
  chemically synthesized
taggtatcacttcaattaac

SEQ ID NO: 471316 - DNA, 20 bp, Artificial Sequence
  chemically synthesized
ttttactatagaatatgtat

SEQ ID NO: 471317 - DNA, 20 bp, Artificial Sequence
  chemically synthesized
caaatgctgacattttacta

SEQ ID NO: 471318 - DNA, 20 bp, Artificial Sequence
  chemically synthesized
ctatagtaaaatgtcagcat

SEQ ID NO: 471319 - DNA, 20 bp, Artificial Sequence
  chemically synthesized
tgggtatacaataaagacat

SEQ ID NO: 471320 - DNA, 20 bp, Artificial Sequence
  chemically synthesized
gtactatgcaaagaggaata

SEQ ID NO: 471321 - DNA, 20 bp, Artificial Sequence
  chemically synthesized
agtacttgtactatgcaaag

SEQ ID NO: 471322 - DNA, 20 bp, Artificial Sequence
  chemically synthesized
ccaacccatttgttagatgt

SEQ ID NO: 471323 - DNA, 20 bp, Artificial Sequence
  chemically synthesized
gtgactcagacatctaacaa

SEQ ID NO: 471324 - DNA, 20 bp, Artificial Sequence
  chemically synthesized
aacaaatgggttggtgtatg

SEQ ID NO: 471325 - DNA, 20 bp, Artificial Sequence
  chemically synthesized
ttggtttcagattgatctag

SEQ ID NO: 471326 - DNA, 20 bp, Artificial Sequence
  chemically synthesized
caatctgaaaccaacatctt

SEQ ID NO: 471327 - DNA, 20 bp, Artificial Sequence
  chemically synthesized
aaccaacatcttctggatgt

SEQ ID NO: 471328 - DNA, 20 bp, Artificial Sequence
  chemically synthesized
tgctggttaatgtgacctgg

SEQ ID NO: 471329 - DNA, 20 bp, Artificial Sequence
  chemically synthesized
ctggaaaaataggcttttgt

SEQ ID NO: 471330 - DNA, 20 bp, Artificial Sequence
  chemically synthesized
gccctgtctctttagggagg

SEQ ID NO: 471331 - DNA, 20 bp, Artificial Sequence
  chemically synthesized
ctggctcacagagaactttc

SEQ ID NO: 471332 - DNA, 20 bp, Artificial Sequence
  chemically synthesized
ttattaaaagaaaactgtgt

SEQ ID NO: 471333 - DNA, 20 bp, Artificial Sequence
  chemically synthesized
agccgaacatctaaaaagat

SEQ ID NO: 471334 - DNA, 20 bp, Artificial Sequence
  chemically synthesized
ccgacggttgcttcatggga

SEQ ID NO: 471335 - DNA, 20 bp, Artificial Sequence
  chemically synthesized
ttgcttcatgggaaagaatt

SEQ ID NO: 471336 - DNA, 20 bp, Artificial Sequence
  chemically synthesized
aggtggtgtgggtcatatac

SEQ ID NO: 471337 - DNA, 20 bp, Artificial Sequence
  chemically synthesized
catttttagcaggaggtggt

SEQ ID NO: 471338 - DNA, 20 bp, Artificial Sequence
  chemically synthesized
cacaccacctcctgctaaaa

SEQ ID NO: 471339 - DNA, 20 bp, Artificial Sequence
  chemically synthesized
ttgagctgttaaggtagacc

SEQ ID NO: 471340 - DNA, 20 bp, Artificial Sequence
  chemically synthesized
caccgattgtgccaaataag

SEQ ID NO: 471341 - DNA, 20 bp, Artificial Sequence
  chemically synthesized
agagagattatgcagagtgt

SEQ ID NO: 471342 - DNA, 20 bp, Artificial Sequence
  chemically synthesized
gaagaggaagagagattatg

SEQ ID NO: 471343 - DNA, 20 bp, Artificial Sequence
  chemically synthesized
ttcacctgctgtgagtctaa

SEQ ID NO: 471344 - DNA, 20 bp, Artificial Sequence
  chemically synthesized
aattggggttttcacctgct

SEQ ID NO: 471345 - DNA, 20 bp, Artificial Sequence
  chemically synthesized
gcaggtgaaaaccccaatta

SEQ ID NO: 471346 - DNA, 20 bp, Artificial Sequence
  chemically synthesized
ctcagaatgaattcactaat

SEQ ID NO: 471347 - DNA, 20 bp, Artificial Sequence
  chemically synthesized
aggaaggtagaggcctcaga

SEQ ID NO: 471348 - DNA, 20 bp, Artificial Sequence
  chemically synthesized
tgggaggaaggtagaggcct

SEQ ID NO: 471349 - DNA, 20 bp, Artificial Sequence
  chemically synthesized
tagtttgcttgggtagatca

SEQ ID NO: 471350 - DNA, 20 bp, Artificial Sequence
  chemically synthesized
tcatgcagtaaatagtttgc

SEQ ID NO: 471351 - DNA, 20 bp, Artificial Sequence
  chemically synthesized
gacttttcactgcaaaatgg

SEQ ID NO: 471352 - DNA, 20 bp, Artificial Sequence
  chemically synthesized
cccttatggagtcaagaagg

SEQ ID NO: 471353 - DNA, 20 bp, Artificial Sequence
  chemically synthesized
attttctgtaacctccctta

SEQ ID NO: 471354 - DNA, 20 bp, Artificial Sequence
  chemically synthesized
aacaataaagtctgataaaa

SEQ ID NO: 471355 - DNA, 20 bp, Artificial Sequence
  chemically synthesized
atcagaaaatgtgagtattt

SEQ ID NO: 471356 - DNA, 20 bp, Artificial Sequence
  chemically synthesized
ttctagattgatcagaaaat

SEQ ID NO: 471357 - DNA, 20 bp, Artificial Sequence
  chemically synthesized
tgttagataatattagcatt

SEQ ID NO: 471358 - DNA, 20 bp, Artificial Sequence
  chemically synthesized
atggacagtctactacaaga

SEQ ID NO: 471359 - DNA, 20 bp, Artificial Sequence
  chemically synthesized
ctttggccttaggaaaggca

SEQ ID NO: 471360 - DNA, 20 bp, Artificial Sequence
  chemically synthesized
acatctatccttgtccaatg

SEQ ID NO: 471361 - DNA, 20 bp, Artificial Sequence
  chemically synthesized
aagaaaattcatcattggac

SEQ ID NO: 471362 - DNA, 20 bp, Artificial Sequence
  chemically synthesized
atcaacgcagctttagttct

SEQ ID NO: 471363 - DNA, 20 bp, Artificial Sequence
  chemically synthesized
agagaagcaattgacaaagt

SEQ ID NO: 471364 - DNA, 20 bp, Artificial Sequence
  chemically synthesized
ttcataaataaaactaggtt

SEQ ID NO: 471365 - DNA, 20 bp, Artificial Sequence
  chemically synthesized
tatatgctcagtattttctt

SEQ ID NO: 471366 - DNA, 20 bp, Artificial Sequence
  chemically synthesized
tgtcagaggttcatttcatt

SEQ ID NO: 471367 - DNA, 20 bp, Artificial Sequence
  chemically synthesized
gaaatttgagtatttcagaa

SEQ ID NO: 471368 - DNA, 20 bp, Artificial Sequence
  chemically synthesized
ttaaaatttttttttgaaat

SEQ ID NO: 471369 - DNA, 20 bp, Artificial Sequence
  chemically synthesized
caaatctcaagaagcaagtc

SEQ ID NO: 471370 - DNA, 20 bp, Artificial Sequence
  chemically synthesized
atttggaaaaaagtaaacaa

SEQ ID NO: 471371 - DNA, 20 bp, Artificial Sequence
  chemically synthesized
tttccttatctgtttcaact

SEQ ID NO: 471372 - DNA, 20 bp, Artificial Sequence
  chemically synthesized
ttctttttttttttcctgag

SEQ ID NO: 471373 - DNA, 20 bp, Artificial Sequence
  chemically synthesized
ttcctgagatgaatatctac

SEQ ID NO: 471374 - DNA, 20 bp, Artificial Sequence
  chemically synthesized
aaggcatgaagatagagggg

SEQ ID NO: 471375 - DNA, 20 bp, Artificial Sequence
  chemically synthesized
agtgacccacctctaagggg

SEQ ID NO: 471376 - DNA, 20 bp, Artificial Sequence
  chemically synthesized
accaattctaccccttagag

SEQ ID NO: 471377 - DNA, 20 bp, Artificial Sequence
  chemically synthesized
ggttaagtgacccacctcta

SEQ ID NO: 471378 - DNA, 20 bp, Artificial Sequence
  chemically synthesized
ggttaagtgacttgcctgta

SEQ ID NO: 471379 - DNA, 20 bp, Artificial Sequence
  chemically synthesized
agcttttgttaactcatcta

SEQ ID NO: 471380 - DNA, 20 bp, Artificial Sequence
  chemically synthesized
gtattatccacattctatag

SEQ ID NO: 471381 - DNA, 20 bp, Artificial Sequence
  chemically synthesized
tgttaactcatctatagaat

SEQ ID NO: 471382 - DNA, 20 bp, Artificial Sequence
  chemically synthesized
gtggataatactgccatatt

SEQ ID NO: 471383 - DNA, 20 bp, Artificial Sequence
  chemically synthesized
tgacagcaatttgaaggctg

SEQ ID NO: 471384 - DNA, 20 bp, Artificial Sequence
  chemically synthesized
aaagagaactcagtatgttc

SEQ ID NO: 471385 - DNA, 20 bp, Artificial Sequence
  chemically synthesized
cctaactattcctgaacata

SEQ ID NO: 471386 - DNA, 20 bp, Artificial Sequence
  chemically synthesized
atctaaaacagaatgttaaa

SEQ ID NO: 471387 - DNA, 20 bp, Artificial Sequence
  chemically synthesized
cctcacacgacaatctaaaa

SEQ ID NO: 471388 - DNA, 20 bp, Artificial Sequence
  chemically synthesized
tgtgagggaaaatgagaggt

SEQ ID NO: 471389 - DNA, 20 bp, Artificial Sequence
  chemically synthesized
actgaatgatagcaaacgct

SEQ ID NO: 471390 - DNA, 20 bp, Artificial Sequence
  chemically synthesized
atattttaatctcggcccca

SEQ ID NO: 471391 - DNA, 20 bp, Artificial Sequence
  chemically synthesized
agtggggccgagattaaaat

SEQ ID NO: 471392 - DNA, 20 bp, Artificial Sequence
  chemically synthesized
ggatataccttttaacatgc

SEQ ID NO: 471393 - DNA, 20 bp, Artificial Sequence
  chemically synthesized
tgctgtctgagaatatgaac

SEQ ID NO: 471394 - DNA, 20 bp, Artificial Sequence
  chemically synthesized
actccaggtttctgctgtct

SEQ ID NO: 471395 - DNA, 20 bp, Artificial Sequence
  chemically synthesized
attctcagacagcagaaacc

SEQ ID NO: 471396 - DNA, 20 bp, Artificial Sequence
  chemically synthesized
ctggagtagtcagagagcaa

SEQ ID NO: 471397 - DNA, 20 bp, Artificial Sequence
  chemically synthesized
agactttctccatcaagcta

SEQ ID NO: 471398 - DNA, 20 bp, Artificial Sequence
  chemically synthesized
ttgaacagccagcaagtggc

SEQ ID NO: 471399 - DNA, 20 bp, Artificial Sequence
  chemically synthesized
tatggatccctgtctttgtg

SEQ ID NO: 471400 - DNA, 20 bp, Artificial Sequence
  chemically synthesized
caggaattccacacaaagac

SEQ ID NO: 471401 - DNA, 20 bp, Artificial Sequence
  chemically synthesized
tttatcttatttcccctttt

SEQ ID NO: 471402 - DNA, 20 bp, Artificial Sequence
  chemically synthesized
tagatcattaattggttaaa

SEQ ID NO: 471403 - DNA, 20 bp, Artificial Sequence
  chemically synthesized
aattaatgatctaccaatgt

SEQ ID NO: 471404 - DNA, 20 bp, Artificial Sequence
  chemically synthesized
tgacaaaagtaagccagagc

SEQ ID NO: 471405 - DNA, 20 bp, Artificial Sequence
  chemically synthesized
aaaaacattcttggaaattt

SEQ ID NO: 471406 - DNA, 20 bp, Artificial Sequence
  chemically synthesized
ttatttatccacaaatttcc

SEQ ID NO: 471407 - DNA, 20 bp, Artificial Sequence
  chemically synthesized
gttatttaaagaacttaata

SEQ ID NO: 471408 - DNA, 20 bp, Artificial Sequence
  chemically synthesized
aaccataaagaaaaaatgag

SEQ ID NO: 471409 - DNA, 20 bp, Artificial Sequence
  chemically synthesized
tttatggttggtaaaaactg

SEQ ID NO: 471410 - DNA, 20 bp, Artificial Sequence
  chemically synthesized
taaaaactggggagtgtttg

SEQ ID NO: 471411 - DNA, 20 bp, Artificial Sequence
  chemically synthesized
ggatcccacttaaaaaaaaa

SEQ ID NO: 471412 - DNA, 20 bp, Artificial Sequence
  chemically synthesized
taatccagtttttttttaag

SEQ ID NO: 471413 - DNA, 20 bp, Artificial Sequence
  chemically synthesized
aggaaaaggccatatttcct

SEQ ID NO: 471414 - DNA, 20 bp, Artificial Sequence
  chemically synthesized
gatactgtgtttagctatat

SEQ ID NO: 471415 - DNA, 20 bp, Artificial Sequence
  chemically synthesized
aggtgattagtttggcctct

SEQ ID NO: 471416 - DNA, 20 bp, Artificial Sequence
  chemically synthesized
agtttggcctcttgggatta

SEQ ID NO: 471417 - DNA, 20 bp, Artificial Sequence
  chemically synthesized
tgtgtgtgtgttctttttgc

SEQ ID NO: 471418 - DNA, 20 bp, Artificial Sequence
  chemically synthesized
gttctttttgctagaatatg

SEQ ID NO: 471419 - DNA, 20 bp, Artificial Sequence
  chemically synthesized
taatatgagcgattagctca

SEQ ID NO: 471420 - DNA, 20 bp, Artificial Sequence
  chemically synthesized
attaataatttactaaggta

SEQ ID NO: 471421 - DNA, 20 bp, Artificial Sequence
  chemically synthesized
gacatcagtttaggcttttt

SEQ ID NO: 471422 - DNA, 20 bp, Artificial Sequence
  chemically synthesized
aatattggccaaatacattt

SEQ ID NO: 471423 - DNA, 20 bp, Artificial Sequence
  chemically synthesized
aaaaatgtatttggccaata

SEQ ID NO: 471424 - DNA, 20 bp, Artificial Sequence
  chemically synthesized
taggacatcaaagcacatta

SEQ ID NO: 471425 - DNA, 20 bp, Artificial Sequence
  chemically synthesized
tatgaacaagaccttcacgt

SEQ ID NO: 471426 - DNA, 20 bp, Artificial Sequence
  chemically synthesized
tcgacctgtttctaagggat

SEQ ID NO: 471427 - DNA, 20 bp, Artificial Sequence
  chemically synthesized
tctttgtcgacctgtttcta

SEQ ID NO: 471428 - DNA, 20 bp, Artificial Sequence
  chemically synthesized
cccttagaaacaggtcgaca

SEQ ID NO: 471429 - DNA, 20 bp, Artificial Sequence
  chemically synthesized
tggaagcctctttgcatatg

SEQ ID NO: 471430 - DNA, 20 bp, Artificial Sequence
  chemically synthesized
aattggcaccacctgtactt

SEQ ID NO: 471431 - DNA, 20 bp, Artificial Sequence
  chemically synthesized
gaatatctttctttttaaaa

SEQ ID NO: 471432 - DNA, 20 bp, Artificial Sequence
  chemically synthesized
aatttgaggtgggaagaaac

SEQ ID NO: 471433 - DNA, 20 bp, Artificial Sequence
  chemically synthesized
gaagaaacaagggtggaaaa

SEQ ID NO: 471434 - DNA, 20 bp, Artificial Sequence
  chemically synthesized
acaagggtggaaaagagggt

SEQ ID NO: 471435 - DNA, 20 bp, Artificial Sequence
  chemically synthesized
gtggaaaagagggtagggat

SEQ ID NO: 471436 - DNA, 20 bp, Artificial Sequence
  chemically synthesized
atgatgacaacagcccagtt

SEQ ID NO: 471437 - DNA, 20 bp, Artificial Sequence
  chemically synthesized
tgacaacagcccagttaaga

SEQ ID NO: 471438 - DNA, 20 bp, Artificial Sequence
  chemically synthesized
tgaactaagaaaggagcact

SEQ ID NO: 471439 - DNA, 20 bp, Artificial Sequence
  chemically synthesized
actgggaatttgtggagagg

SEQ ID NO: 471440 - DNA, 20 bp, Artificial Sequence
  chemically synthesized
attttattctataacctgtc

SEQ ID NO: 471441 - DNA, 20 bp, Artificial Sequence
  chemically synthesized
gctgaattcatgacaggtta

SEQ ID NO: 471442 - DNA, 20 bp, Artificial Sequence
  chemically synthesized
caatgctacttttgagccaa

SEQ ID NO: 471443 - DNA, 20 bp, Artificial Sequence
  chemically synthesized
ctagaggaaaaggaaaagtg

SEQ ID NO: 471444 - DNA, 20 bp, Artificial Sequence
  chemically synthesized
gccctattagctgtgcattc

SEQ ID NO: 471445 - DNA, 20 bp, Artificial Sequence
  chemically synthesized
atatacacaaatatgaatcc

SEQ ID NO: 471446 - DNA, 20 bp, Artificial Sequence
  chemically synthesized
tacatagtatatacacaaat

SEQ ID NO: 471447 - DNA, 20 bp, Artificial Sequence
  chemically synthesized
gctgggttttattaattttt

SEQ ID NO: 471448 - DNA, 20 bp, Artificial Sequence
  chemically synthesized
ctatttatatttccttagtg

SEQ ID NO: 471449 - DNA, 20 bp, Artificial Sequence
  chemically synthesized
ttttgttttttgttttgaga

SEQ ID NO: 471450 - DNA, 20 bp, Artificial Sequence
  chemically synthesized
ctgctctccgacctgggtga

SEQ ID NO: 471451 - DNA, 20 bp, Artificial Sequence
  chemically synthesized
tcgtgccactgctctccgac

SEQ ID NO: 471452 - DNA, 20 bp, Artificial Sequence
  chemically synthesized
aattgcttgaagctgggagg

SEQ ID NO: 471453 - DNA, 20 bp, Artificial Sequence
  chemically synthesized
tacttgggaggctgaggcac

SEQ ID NO: 471454 - DNA, 20 bp, Artificial Sequence
  chemically synthesized
gcctcagcctcccaagtagc

SEQ ID NO: 471455 - DNA, 20 bp, Artificial Sequence
  chemically synthesized
ttttgtatttttggtagaga

SEQ ID NO: 471456 - DNA, 20 bp, Artificial Sequence
  chemically synthesized
tgggctgatcactagaggtc

SEQ ID NO: 471457 - DNA, 20 bp, Artificial Sequence
  chemically synthesized
accttggcctcccaaagtgt

SEQ ID NO: 471458 - DNA, 20 bp, Artificial Sequence
  chemically synthesized
attttgctatgcatacccac

SEQ ID NO: 471459 - DNA, 20 bp, Artificial Sequence
  chemically synthesized
tgtttgtcttgctcattctg

SEQ ID NO: 471460 - DNA, 20 bp, Artificial Sequence
  chemically synthesized
aatgagcaagacaaacaaca

SEQ ID NO: 471461 - DNA, 20 bp, Artificial Sequence
  chemically synthesized
acaaacaacacagggttaga

SEQ ID NO: 471462 - DNA, 20 bp, Artificial Sequence
  chemically synthesized
cactcctactaacagagcat

SEQ ID NO: 471463 - DNA, 20 bp, Artificial Sequence
  chemically synthesized
aactctcatgctctgttagt

SEQ ID NO: 471464 - DNA, 20 bp, Artificial Sequence
  chemically synthesized
cacattggaaaactgtttgg

SEQ ID NO: 471465 - DNA, 20 bp, Artificial Sequence
  chemically synthesized
ggggtagaatttctgggtta

SEQ ID NO: 471466 - DNA, 20 bp, Artificial Sequence
  chemically synthesized
tatatcaaggggtagaattt

SEQ ID NO: 471467 - DNA, 20 bp, Artificial Sequence
  chemically synthesized
ttgaggactatatcaagggg

SEQ ID NO: 471468 - DNA, 20 bp, Artificial Sequence
  chemically synthesized
ttcctttgaggactatatca

SEQ ID NO: 471469 - DNA, 20 bp, Artificial Sequence
  chemically synthesized
ccccttgatatagtcctcaa

SEQ ID NO: 471470 - DNA, 20 bp, Artificial Sequence
  chemically synthesized
attctaagacatgccatttg

SEQ ID NO: 471471 - DNA, 20 bp, Artificial Sequence
  chemically synthesized
attcatcaaatggcatgtct

SEQ ID NO: 471472 - DNA, 20 bp, Artificial Sequence
  chemically synthesized
taccaaatgcccatccacag

SEQ ID NO: 471473 - DNA, 20 bp, Artificial Sequence
  chemically synthesized
agtatattatatactctact

SEQ ID NO: 471474 - DNA, 20 bp, Artificial Sequence
  chemically synthesized
gtagagtatataatatactg

SEQ ID NO: 471475 - DNA, 20 bp, Artificial Sequence
  chemically synthesized
actgcaggatattgacacaa

SEQ ID NO: 471476 - DNA, 20 bp, Artificial Sequence
  chemically synthesized
atgggatattacatagcaat

SEQ ID NO: 471477 - DNA, 20 bp, Artificial Sequence
  chemically synthesized
ccatgctgttgtatgaagtg

SEQ ID NO: 471478 - DNA, 20 bp, Artificial Sequence
  chemically synthesized
ccaccacttcatacaacagc

SEQ ID NO: 471479 - DNA, 20 bp, Artificial Sequence
  chemically synthesized
cacttcatacaacagcatgg

SEQ ID NO: 471480 - DNA, 20 bp, Artificial Sequence
  chemically synthesized
tgtgtctgacttctttaaac

SEQ ID NO: 471481 - DNA, 20 bp, Artificial Sequence
  chemically synthesized
tttaaagaagtcagacacaa

SEQ ID NO: 471482 - DNA, 20 bp, Artificial Sequence
  chemically synthesized
tataaaggacaagaacaggc

SEQ ID NO: 471483 - DNA, 20 bp, Artificial Sequence
  chemically synthesized
ctgatagttacctgtcctcc

SEQ ID NO: 471484 - DNA, 20 bp, Artificial Sequence
  chemically synthesized
gtaatgttctgtttctttat

SEQ ID NO: 471485 - DNA, 20 bp, Artificial Sequence
  chemically synthesized
tttatttggatgctggttaa

SEQ ID NO: 471486 - DNA, 20 bp, Artificial Sequence
  chemically synthesized
gcttaaacttatacagttca

SEQ ID NO: 471487 - DNA, 20 bp, Artificial Sequence
  chemically synthesized
tttgaaatatgtatacactg

SEQ ID NO: 471488 - DNA, 20 bp, Artificial Sequence
  chemically synthesized
atagtcttgaaaattgctaa

SEQ ID NO: 471489 - DNA, 20 bp, Artificial Sequence
  chemically synthesized
gatatgaaacttcggttagg

SEQ ID NO: 471490 - DNA, 20 bp, Artificial Sequence
  chemically synthesized
aataagggagatgctggtta

SEQ ID NO: 471491 - DNA, 20 bp, Artificial Sequence
  chemically synthesized
gtaaaaaagtgttttaaaag

SEQ ID NO: 471492 - DNA, 20 bp, Artificial Sequence
  chemically synthesized
aatatgatcgattttattat

SEQ ID NO: 471493 - DNA, 20 bp, Artificial Sequence
  chemically synthesized
tggattattgataaggagga

SEQ ID NO: 471494 - DNA, 20 bp, Artificial Sequence
  chemically synthesized
aacaaaggaaaatccaagtc

SEQ ID NO: 471495 - DNA, 20 bp, Artificial Sequence
  chemically synthesized
caatctaagtcattccagac

SEQ ID NO: 471496 - DNA, 20 bp, Artificial Sequence
  chemically synthesized
caagtctggaatgacttaga

SEQ ID NO: 471497 - DNA, 20 bp, Artificial Sequence
  chemically synthesized
attgaataaacagatctgca

SEQ ID NO: 471498 - DNA, 20 bp, Artificial Sequence
  chemically synthesized
ggggcactgaaaactgctga

SEQ ID NO: 471499 - DNA, 20 bp, Artificial Sequence
  chemically synthesized
aacatgatgccgaggtacac

SEQ ID NO: 471500 - DNA, 20 bp, Artificial Sequence
  chemically synthesized
gggccaaggcaaagtggtct

SEQ ID NO: 471501 - DNA, 20 bp, Artificial Sequence
  chemically synthesized
tatagatttcatgacgtact

SEQ ID NO: 471502 - DNA, 20 bp, Artificial Sequence
  chemically synthesized
tacgtcatgaaatctatata

SEQ ID NO: 471503 - DNA, 20 bp, Artificial Sequence
  chemically synthesized
ttgttcttaatgaaacagaa

SEQ ID NO: 471504 - DNA, 20 bp, Artificial Sequence
  chemically synthesized
aaatatgacagtgtagaggt

SEQ ID NO: 471505 - DNA, 20 bp, Artificial Sequence
  chemically synthesized
tagaggttggagtggggaaa

SEQ ID NO: 471506 - DNA, 20 bp, Artificial Sequence
  chemically synthesized
atgggttataaaactaccta

SEQ ID NO: 471507 - DNA, 20 bp, Artificial Sequence
  chemically synthesized
ttgggtactatgctcacaat

SEQ ID NO: 471508 - DNA, 20 bp, Artificial Sequence
  chemically synthesized
atgaaagtgtactatttggt

SEQ ID NO: 471509 - DNA, 20 bp, Artificial Sequence
  chemically synthesized
tttctttcaatcatacaagc

SEQ ID NO: 471510 - DNA, 20 bp, Artificial Sequence
  chemically synthesized
gtgtgcgtgtgtgtgtgtac

SEQ ID NO: 471511 - DNA, 20 bp, Artificial Sequence
  chemically synthesized
atataaaattaatttttata

SEQ ID NO: 471512 - DNA, 20 bp, Artificial Sequence
  chemically synthesized
tcattataatttctctagac

SEQ ID NO: 471513 - DNA, 20 bp, Artificial Sequence
  chemically synthesized
taatgttccagcccttacca

SEQ ID NO: 471514 - DNA, 20 bp, Artificial Sequence
  chemically synthesized
aacattacaagagactggag

SEQ ID NO: 471515 - DNA, 20 bp, Artificial Sequence
  chemically synthesized
tccccaacttgctccccctc

SEQ ID NO: 471516 - DNA, 20 bp, Artificial Sequence
  chemically synthesized
catgagatgctgcaggggct

SEQ ID NO: 471517 - DNA, 20 bp, Artificial Sequence
  chemically synthesized
agaatctgctccaagtttta

SEQ ID NO: 471518 - DNA, 20 bp, Artificial Sequence
  chemically synthesized
cttctctgccagctgttcgt

SEQ ID NO: 471519 - DNA, 20 bp, Artificial Sequence
  chemically synthesized
gttcgtttgggtggctgttt

SEQ ID NO: 471520 - DNA, 20 bp, Artificial Sequence
  chemically synthesized
tggctgtttgggagtatacc

SEQ ID NO: 471521 - DNA, 20 bp, Artificial Sequence
  chemically synthesized
tttggaagaaaacaaaaagg

SEQ ID NO: 471522 - DNA, 20 bp, Artificial Sequence
  chemically synthesized
ctgctaaaagtattgttaag

SEQ ID NO: 471523 - DNA, 20 bp, Artificial Sequence
  chemically synthesized
tgagcacactagcaaggact

SEQ ID NO: 471524 - DNA, 20 bp, Artificial Sequence
  chemically synthesized
attggcaagtgtgtgcctga

SEQ ID NO: 471525 - DNA, 20 bp, Artificial Sequence
  chemically synthesized
agaatggtcacattttaggg

SEQ ID NO: 471526 - DNA, 20 bp, Artificial Sequence
  chemically synthesized
atgaatttataagcattaaa

SEQ ID NO: 471527 - DNA, 20 bp, Artificial Sequence
  chemically synthesized
ttccccaagcacttaatagg

SEQ ID NO: 471528 - DNA, 20 bp, Artificial Sequence
  chemically synthesized
taatttccccaagcacttaa

SEQ ID NO: 471529 - DNA, 20 bp, Artificial Sequence
  chemically synthesized
aagtgcttggggaaattaat

SEQ ID NO: 471530 - DNA, 20 bp, Artificial Sequence
  chemically synthesized
aaatgttcctacaattatat

SEQ ID NO: 471531 - DNA, 20 bp, Artificial Sequence
  chemically synthesized
tttagacagtctgcagccat

SEQ ID NO: 471532 - DNA, 20 bp, Artificial Sequence
  chemically synthesized
atgggggtattaagcatatt

SEQ ID NO: 471533 - DNA, 20 bp, Artificial Sequence
  chemically synthesized
tgagtaaaaataacagcttt

SEQ ID NO: 471534 - DNA, 20 bp, Artificial Sequence
  chemically synthesized
aagaataaaattcctttcaa

SEQ ID NO: 471535 - DNA, 20 bp, Artificial Sequence
  chemically synthesized
aagctggtcactcttttgaa

SEQ ID NO: 471536 - DNA, 20 bp, Artificial Sequence
  chemically synthesized
atactgaaaaaagaaagatt

SEQ ID NO: 471537 - DNA, 20 bp, Artificial Sequence
  chemically synthesized
gttaaccacttattagtact

SEQ ID NO: 471538 - DNA, 20 bp, Artificial Sequence
  chemically synthesized
atttttaaaagcactagatt

SEQ ID NO: 471539 - DNA, 20 bp, Artificial Sequence
  chemically synthesized
gcaatgattactcacaaagc

SEQ ID NO: 471540 - DNA, 20 bp, Artificial Sequence
  chemically synthesized
gctgttaaaattcatgcttt

SEQ ID NO: 471541 - DNA, 20 bp, Artificial Sequence
  chemically synthesized
gaatttagatgtaggtaaaa

SEQ ID NO: 471542 - DNA, 20 bp, Artificial Sequence
  chemically synthesized
acctacatctaaattcagaa

SEQ ID NO: 471543 - DNA, 20 bp, Artificial Sequence
  chemically synthesized
tctgtggactaaattctctt

SEQ ID NO: 471544 - DNA, 20 bp, Artificial Sequence
  chemically synthesized
gaaccttcctgtaacttttc

SEQ ID NO: 471545 - DNA, 20 bp, Artificial Sequence
  chemically synthesized
tatctcttcccaccaacagg

SEQ ID NO: 471546 - DNA, 20 bp, Artificial Sequence
  chemically synthesized
ctttccccactccttacatc

SEQ ID NO: 471547 - DNA, 20 bp, Artificial Sequence
  chemically synthesized
atagggccatcccagatgta

SEQ ID NO: 471548 - DNA, 20 bp, Artificial Sequence
  chemically synthesized
aactagcctgaactagcatg

SEQ ID NO: 471549 - DNA, 20 bp, Artificial Sequence
  chemically synthesized
gcctgtcaaccatcagacat

SEQ ID NO: 471550 - DNA, 20 bp, Artificial Sequence
  chemically synthesized
catctgtagtcagctggcag

SEQ ID NO: 471551 - DNA, 20 bp, Artificial Sequence
  chemically synthesized
cttagctcactatttgatgg

SEQ ID NO: 471552 - DNA, 20 bp, Artificial Sequence
  chemically synthesized
tttacttagctcactatttg

SEQ ID NO: 471553 - DNA, 20 bp, Artificial Sequence
  chemically synthesized
aatggctggccattgtgtta

SEQ ID NO: 471554 - DNA, 20 bp, Artificial Sequence
  chemically synthesized
gctaagtatgactacatttt

SEQ ID NO: 471555 - DNA, 20 bp, Artificial Sequence
  chemically synthesized
tttagagttgtaaaaagaaa

SEQ ID NO: 471556 - DNA, 20 bp, Artificial Sequence
  chemically synthesized
agtgttaagccagtaagttt

SEQ ID NO: 471557 - DNA, 20 bp, Artificial Sequence
  chemically synthesized
ataaattgactaggtgctaa

SEQ ID NO: 471558 - DNA, 20 bp, Artificial Sequence
  chemically synthesized
gcaactggaggacatgcacc

SEQ ID NO: 471559 - DNA, 20 bp, Artificial Sequence
  chemically synthesized
ctcaaaagtaagattttata

SEQ ID NO: 471560 - DNA, 20 bp, Artificial Sequence
  chemically synthesized
gtttccagcttgaggatatt

SEQ ID NO: 471561 - DNA, 20 bp, Artificial Sequence
  chemically synthesized
aatgattttgtttccagctt

SEQ ID NO: 471562 - DNA, 20 bp, Artificial Sequence
  chemically synthesized
ctggaaacaaaatcattatg

SEQ ID NO: 471563 - DNA, 20 bp, Artificial Sequence
  chemically synthesized
tttcaagaattttctataaa

SEQ ID NO: 471564 - DNA, 20 bp, Artificial Sequence
  chemically synthesized
gtgtattactttgcattttc

SEQ ID NO: 471565 - DNA, 20 bp, Artificial Sequence
  chemically synthesized
aaagacgatcagtggttgcc

SEQ ID NO: 471566 - DNA, 20 bp, Artificial Sequence
  chemically synthesized
atcagtggttgcctagaatc

SEQ ID NO: 471567 - DNA, 20 bp, Artificial Sequence
  chemically synthesized
gggcacaaggaggcttttgg

SEQ ID NO: 471568 - DNA, 20 bp, Artificial Sequence
  chemically synthesized
ttgtgcagttgtatgcattt

SEQ ID NO: 471569 - DNA, 20 bp, Artificial Sequence
  chemically synthesized
aaaatgcatacaactgcaca

SEQ ID NO: 471570 - DNA, 20 bp, Artificial Sequence
  chemically synthesized
aaagaatgaggtgcatcaca

SEQ ID NO: 471571 - DNA, 20 bp, Artificial Sequence
  chemically synthesized
aagggaactgacagcatgac

SEQ ID NO: 471572 - DNA, 20 bp, Artificial Sequence
  chemically synthesized
atctaatgttttgatatttt

SEQ ID NO: 471573 - DNA, 20 bp, Artificial Sequence
  chemically synthesized
attaacctttaaggtcactt

SEQ ID NO: 471574 - DNA, 20 bp, Artificial Sequence
  chemically synthesized
acaagtgaccttaaaggtta

SEQ ID NO: 471575 - DNA, 20 bp, Artificial Sequence
  chemically synthesized
gcaatttctgtattggatga

SEQ ID NO: 471576 - DNA, 20 bp, Artificial Sequence
  chemically synthesized
ccctaaaggcaatttctgta

SEQ ID NO: 471577 - DNA, 20 bp, Artificial Sequence
  chemically synthesized
ccaatacagaaattgccttt

SEQ ID NO: 471578 - DNA, 20 bp, Artificial Sequence
  chemically synthesized
tcttgaaaatctactgtaca

SEQ ID NO: 471579 - DNA, 20 bp, Artificial Sequence
  chemically synthesized
gtttaatgcttttcaaagtg

SEQ ID NO: 471580 - DNA, 20 bp, Artificial Sequence
  chemically synthesized
tatctagctcaatccattct

SEQ ID NO: 471581 - DNA, 20 bp, Artificial Sequence
  chemically synthesized
tttcctgttttattctgaga

SEQ ID NO: 471582 - DNA, 20 bp, Artificial Sequence
  chemically synthesized
tttttttcctgttttattct

SEQ ID NO: 471583 - DNA, 20 bp, Artificial Sequence
  chemically synthesized
acaggaaaaaaataacaaaa

SEQ ID NO: 471584 - DNA, 20 bp, Artificial Sequence
  chemically synthesized
aaagagagttcacagtagta

SEQ ID NO: 471585 - DNA, 20 bp, Artificial Sequence
  chemically synthesized
tgaggtcttcaggcagaggg

SEQ ID NO: 471586 - DNA, 20 bp, Artificial Sequence
  chemically synthesized
agatctagatcaacacaaaa

SEQ ID NO: 471587 - DNA, 20 bp, Artificial Sequence
  chemically synthesized
tgattaaataatgacatcta

SEQ ID NO: 471588 - DNA, 20 bp, Artificial Sequence
  chemically synthesized
cagtggggctggctaatagg

SEQ ID NO: 471589 - DNA, 20 bp, Artificial Sequence
  chemically synthesized
caagttctcttttgagaata

SEQ ID NO: 471590 - DNA, 20 bp, Artificial Sequence
  chemically synthesized
catttttcaagttctctttt

SEQ ID NO: 471591 - DNA, 20 bp, Artificial Sequence
  chemically synthesized
ctgttagagacagcataact

SEQ ID NO: 471592 - DNA, 20 bp, Artificial Sequence
  chemically synthesized
catgtgacatggcagatttt

SEQ ID NO: 471593 - DNA, 20 bp, Artificial Sequence
  chemically synthesized
acataggataacatgctgct

SEQ ID NO: 471594 - DNA, 20 bp, Artificial Sequence
  chemically synthesized
actgattattaatgattaca

SEQ ID NO: 471595 - DNA, 20 bp, Artificial Sequence
  chemically synthesized
atcagtacgatgtcattttc

SEQ ID NO: 471596 - DNA, 20 bp, Artificial Sequence
  chemically synthesized
aacgtttaaaaagtaaagag

SEQ ID NO: 471597 - DNA, 20 bp, Artificial Sequence
  chemically synthesized
aactcagagaaaacatggga

SEQ ID NO: 471598 - DNA, 20 bp, Artificial Sequence
  chemically synthesized
aatcccttcccatgttttct

SEQ ID NO: 471599 - DNA, 20 bp, Artificial Sequence
  chemically synthesized
gtcactcctcctcccatgaa

SEQ ID NO: 471600 - DNA, 20 bp, Artificial Sequence
  chemically synthesized
gcaactcttttcatgggagg

SEQ ID NO: 471601 - DNA, 20 bp, Artificial Sequence
  chemically synthesized
gggaggaggagtgactttta

SEQ ID NO: 471602 - DNA, 20 bp, Artificial Sequence
  chemically synthesized
ggagtgacttttagtggata

SEQ ID NO: 471603 - DNA, 20 bp, Artificial Sequence
  chemically synthesized
tttagtggatactggataag

SEQ ID NO: 471604 - DNA, 20 bp, Artificial Sequence
  chemically synthesized
ataagaagaatgcactcctg

SEQ ID NO: 471605 - DNA, 20 bp, Artificial Sequence
  chemically synthesized
aagaatgcactcctgttgag

SEQ ID NO: 471606 - DNA, 20 bp, Artificial Sequence
  chemically synthesized
gggatctcattctactcaac

SEQ ID NO: 471607 - DNA, 20 bp, Artificial Sequence
  chemically synthesized
atttgttagaagtgctgcca

SEQ ID NO: 471608 - DNA, 20 bp, Artificial Sequence
  chemically synthesized
agtctctgaacaaaaacaat

SEQ ID NO: 471609 - DNA, 20 bp, Artificial Sequence
  chemically synthesized
gtccctaagattatctagaa

SEQ ID NO: 471610 - DNA, 20 bp, Artificial Sequence
  chemically synthesized
gttactcagctttatgggaa

SEQ ID NO: 471611 - DNA, 20 bp, Artificial Sequence
  chemically synthesized
agaatcccgttcccataaag

SEQ ID NO: 471612 - DNA, 20 bp, Artificial Sequence
  chemically synthesized
ttacctaaaaagcaagtgat

SEQ ID NO: 471613 - DNA, 20 bp, Artificial Sequence
  chemically synthesized
tactgatctatggccctcaa

SEQ ID NO: 471614 - DNA, 20 bp, Artificial Sequence
  chemically synthesized
gttctttatttctgatttgt

SEQ ID NO: 471615 - DNA, 20 bp, Artificial Sequence
  chemically synthesized
gtgagagtcatgcgacagca

SEQ ID NO: 471616 - DNA, 20 bp, Artificial Sequence
  chemically synthesized
gagtcatgcgacagcagtgg

SEQ ID NO: 471617 - DNA, 20 bp, Artificial Sequence
  chemically synthesized
attggagatttgcataggtt

SEQ ID NO: 471618 - DNA, 20 bp, Artificial Sequence
  chemically synthesized
tgcaaaaatatagaaggctt

SEQ ID NO: 471619 - DNA, 20 bp, Artificial Sequence
  chemically synthesized
attaatcacttttccctcca

SEQ ID NO: 471620 - DNA, 20 bp, Artificial Sequence
  chemically synthesized
aaatataaccggtgtcatca

SEQ ID NO: 471621 - DNA, 20 bp, Artificial Sequence
  chemically synthesized
aagtgttcatttatagcatt

SEQ ID NO: 471622 - DNA, 20 bp, Artificial Sequence
  chemically synthesized
gcaacacatttcattttgca

SEQ ID NO: 471623 - DNA, 20 bp, Artificial Sequence
  chemically synthesized
ggatttactgctgttaaata

SEQ ID NO: 471624 - DNA, 20 bp, Artificial Sequence
  chemically synthesized
aactgttttaccaaaacata

SEQ ID NO: 471625 - DNA, 20 bp, Artificial Sequence
  chemically synthesized
tctttctaatatacaatcaa

SEQ ID NO: 471626 - DNA, 20 bp, Artificial Sequence
  chemically synthesized
gaaaaacaaagatcatgcat

SEQ ID NO: 471627 - DNA, 20 bp, Artificial Sequence
  chemically synthesized
catgcatgaggattatgtgt

SEQ ID NO: 471628 - DNA, 20 bp, Artificial Sequence
  chemically synthesized
tgaggattatgtgtgagggt

SEQ ID NO: 471629 - DNA, 20 bp, Artificial Sequence
  chemically synthesized
tgtgtgagggtatggattga

SEQ ID NO: 471630 - DNA, 20 bp, Artificial Sequence
  chemically synthesized
aaggtgttctttgaaccaag

SEQ ID NO: 471631 - DNA, 20 bp, Artificial Sequence
  chemically synthesized
tggagtctgatttccaattt

SEQ ID NO: 471632 - DNA, 20 bp, Artificial Sequence
  chemically synthesized
ctgccttcattttcaggata

SEQ ID NO: 471633 - DNA, 20 bp, Artificial Sequence
  chemically synthesized
tgtgtatctgccttcatttt

SEQ ID NO: 471634 - DNA, 20 bp, Artificial Sequence
  chemically synthesized
caaatttcataactttttct

SEQ ID NO: 471635 - DNA, 20 bp, Artificial Sequence
  chemically synthesized
cagtttgaaaagttgaaaaa

SEQ ID NO: 471636 - DNA, 20 bp, Artificial Sequence
  chemically synthesized
tcattattattaaagatcaa

SEQ ID NO: 471637 - DNA, 20 bp, Artificial Sequence
  chemically synthesized
tccattgatctttaataata

SEQ ID NO: 471638 - DNA, 20 bp, Artificial Sequence
  chemically synthesized
ttctctgagttctttcacta

SEQ ID NO: 471639 - DNA, 20 bp, Artificial Sequence
  chemically synthesized
ttctttagtgaaagaactca

SEQ ID NO: 471640 - DNA, 20 bp, Artificial Sequence
  chemically synthesized
taggcacctaatcaaattct

SEQ ID NO: 471641 - DNA, 20 bp, Artificial Sequence
  chemically synthesized
aaaaaagccctcccctaccc

SEQ ID NO: 471642 - DNA, 20 bp, Artificial Sequence
  chemically synthesized
cacattcttatgcaggattc

SEQ ID NO: 471643 - DNA, 20 bp, Artificial Sequence
  chemically synthesized
cctaccccagaatcctgcat

SEQ ID NO: 471644 - DNA, 20 bp, Artificial Sequence
  chemically synthesized
taaccattcacattcttatg

SEQ ID NO: 471645 - DNA, 20 bp, Artificial Sequence
  chemically synthesized
ccagaatcctgcataagaat

SEQ ID NO: 471646 - DNA, 20 bp, Artificial Sequence
  chemically synthesized
gttatgtttgtttgcgcaga

SEQ ID NO: 471647 - DNA, 20 bp, Artificial Sequence
  chemically synthesized
ccatctagcaaatttaaatc

SEQ ID NO: 471648 - DNA, 20 bp, Artificial Sequence
  chemically synthesized
aaatgtagtcattatcgtgt

SEQ ID NO: 471649 - DNA, 20 bp, Artificial Sequence
  chemically synthesized
cttgccccctaccttaaatt

SEQ ID NO: 471650 - DNA, 20 bp, Artificial Sequence
  chemically synthesized
ttaaaaatatattttcaggt

SEQ ID NO: 471651 - DNA, 20 bp, Artificial Sequence
  chemically synthesized
ttagaatatttctctttttt

SEQ ID NO: 471652 - DNA, 20 bp, Artificial Sequence
  chemically synthesized
cttttataattaatattttc

SEQ ID NO: 471653 - DNA, 20 bp, Artificial Sequence
  chemically synthesized
aggaccataaacgttatgtt

SEQ ID NO: 471654 - DNA, 20 bp, Artificial Sequence
  chemically synthesized
tccaacacaatggcaagcca

SEQ ID NO: 471655 - DNA, 20 bp, Artificial Sequence
  chemically synthesized
attaagcaaacagttgactc

SEQ ID NO: 471656 - DNA, 20 bp, Artificial Sequence
  chemically synthesized
gtattgctagtaatgcatcc

SEQ ID NO: 471657 - DNA, 20 bp, Artificial Sequence
  chemically synthesized
aagttgaagagcatctgtat

SEQ ID NO: 471658 - DNA, 20 bp, Artificial Sequence
  chemically synthesized
tagaatattttcaacttatg

SEQ ID NO: 471659 - DNA, 20 bp, Artificial Sequence
  chemically synthesized
tgttaaatgcatttttgact

SEQ ID NO: 471660 - DNA, 20 bp, Artificial Sequence
  chemically synthesized
ggctaggctgagctatgatg

SEQ ID NO: 471661 - DNA, 20 bp, Artificial Sequence
  chemically synthesized
tgtaggctaacgtaagtgtt

SEQ ID NO: 471662 - DNA, 20 bp, Artificial Sequence
  chemically synthesized
gcctattttatactaaagca

SEQ ID NO: 471663 - DNA, 20 bp, Artificial Sequence
  chemically synthesized
tgaatagctcatgtaattta

SEQ ID NO: 471664 - DNA, 20 bp, Artificial Sequence
  chemically synthesized
gtactgaaagtgaaaaacag

SEQ ID NO: 471665 - DNA, 20 bp, Artificial Sequence
  chemically synthesized
gtgaaaaacagaggggttgt

SEQ ID NO: 471666 - DNA, 20 bp, Artificial Sequence
  chemically synthesized
tacctgaagtatggtttcta

SEQ ID NO: 471667 - DNA, 20 bp, Artificial Sequence
  chemically synthesized
tgacttacaatggttggatt

SEQ ID NO: 471668 - DNA, 20 bp, Artificial Sequence
  chemically synthesized
tgatccctgacttacaatgg

SEQ ID NO: 471669 - DNA, 20 bp, Artificial Sequence
  chemically synthesized
aaatccaaccattgtaagtc

SEQ ID NO: 471670 - DNA, 20 bp, Artificial Sequence
  chemically synthesized
tctctattctttcctcattt

SEQ ID NO: 471671 - DNA, 20 bp, Artificial Sequence
  chemically synthesized
caagcatccgcaaatgagga

SEQ ID NO: 471672 - DNA, 20 bp, Artificial Sequence
  chemically synthesized
gaaagtactagatgaagaca

SEQ ID NO: 471673 - DNA, 20 bp, Artificial Sequence
  chemically synthesized
agacaaagaatccttggtga

SEQ ID NO: 471674 - DNA, 20 bp, Artificial Sequence
  chemically synthesized
tgtctgaagatcctatcacc

SEQ ID NO: 471675 - DNA, 20 bp, Artificial Sequence
  chemically synthesized
gagtgatatcaaattgataa

SEQ ID NO: 471676 - DNA, 20 bp, Artificial Sequence
  chemically synthesized
tcaccatggcagtgatacaa

SEQ ID NO: 471677 - DNA, 20 bp, Artificial Sequence
  chemically synthesized
tcctttgtatcactgccatg

SEQ ID NO: 471678 - DNA, 20 bp, Artificial Sequence
  chemically synthesized
gttattgcagttcttaaaga

SEQ ID NO: 471679 - DNA, 20 bp, Artificial Sequence
  chemically synthesized
cttcttttttttggcagagg

SEQ ID NO: 471680 - DNA, 20 bp, Artificial Sequence
  chemically synthesized
acctcagcctcccaaagtgt

SEQ ID NO: 471681 - DNA, 20 bp, Artificial Sequence
  chemically synthesized
gcattatctttaaggaaagt

SEQ ID NO: 471682 - DNA, 20 bp, Artificial Sequence
  chemically synthesized
catactttgcgtgtgtgggt

SEQ ID NO: 471683 - DNA, 20 bp, Artificial Sequence
  chemically synthesized
agaatacatactttgcgtgt

SEQ ID NO: 471684 - DNA, 20 bp, Artificial Sequence
  chemically synthesized
acaggaggagagtgataaaa

SEQ ID NO: 471685 - DNA, 20 bp, Artificial Sequence
  chemically synthesized
aggtgtaagagggacaggag

SEQ ID NO: 471686 - DNA, 20 bp, Artificial Sequence
  chemically synthesized
ttcctacgtacattggcaga

SEQ ID NO: 471687 - DNA, 20 bp, Artificial Sequence
  chemically synthesized
aatagcattttaaagacatt

SEQ ID NO: 471688 - DNA, 20 bp, Artificial Sequence
  chemically synthesized
atggccctctttaaatgttt

SEQ ID NO: 471689 - DNA, 20 bp, Artificial Sequence
  chemically synthesized
taaagagggccatctgcaat

SEQ ID NO: 471690 - DNA, 20 bp, Artificial Sequence
  chemically synthesized
ttagatgatgataaacagta

SEQ ID NO: 471691 - DNA, 20 bp, Artificial Sequence
  chemically synthesized
gaaagcaatgatataataag

SEQ ID NO: 471692 - DNA, 20 bp, Artificial Sequence
  chemically synthesized
aatggcacctccatggacag

SEQ ID NO: 471693 - DNA, 20 bp, Artificial Sequence
  chemically synthesized
tgcccacttccctgttatct

SEQ ID NO: 471694 - DNA, 20 bp, Artificial Sequence
  chemically synthesized
gtctatacttctagtgtctt

SEQ ID NO: 471695 - DNA, 20 bp, Artificial Sequence
  chemically synthesized
gacactagaagtatagacta

SEQ ID NO: 471696 - DNA, 20 bp, Artificial Sequence
  chemically synthesized
agggttcacagtcttaaaat

SEQ ID NO: 471697 - DNA, 20 bp, Artificial Sequence
  chemically synthesized
agatccaaattgcaaaacct

SEQ ID NO: 471698 - DNA, 20 bp, Artificial Sequence
  chemically synthesized
ttatccttaggttttgcaat

SEQ ID NO: 471699 - DNA, 20 bp, Artificial Sequence
  chemically synthesized
agaaaaaaagtttgtgattc

SEQ ID NO: 471700 - DNA, 20 bp, Artificial Sequence
  chemically synthesized
agctggagtttattacaccc

SEQ ID NO: 471701 - DNA, 20 bp, Artificial Sequence
  chemically synthesized
taggctcatgatatgccagc

SEQ ID NO: 471702 - DNA, 20 bp, Artificial Sequence
  chemically synthesized
acaagtgaaatgaaaatagg

SEQ ID NO: 471703 - DNA, 20 bp, Artificial Sequence
  chemically synthesized
aatacataatcaatcagctt

SEQ ID NO: 471704 - DNA, 20 bp, Artificial Sequence
  chemically synthesized
tattagccagatcaaagcct

SEQ ID NO: 471705 - DNA, 20 bp, Artificial Sequence
  chemically synthesized
gtgataatgagccactgaac

SEQ ID NO: 471706 - DNA, 20 bp, Artificial Sequence
  chemically synthesized
aaaagctttttacttctggc

SEQ ID NO: 471707 - DNA, 20 bp, Artificial Sequence
  chemically synthesized
ttacttggtagcaagcggct

SEQ ID NO: 471708 - DNA, 20 bp, Artificial Sequence
  chemically synthesized
atatttctactttcttttga

SEQ ID NO: 471709 - DNA, 20 bp, Artificial Sequence
  chemically synthesized
agattcgtgagtaagaatat

SEQ ID NO: 471710 - DNA, 20 bp, Artificial Sequence
  chemically synthesized
ttattcctatattcttactc

SEQ ID NO: 471711 - DNA, 20 bp, Artificial Sequence
  chemically synthesized
taaaatgaagattcgtgagt

SEQ ID NO: 471712 - DNA, 20 bp, Artificial Sequence
  chemically synthesized
tttcaataaaatgaagattc

SEQ ID NO: 471713 - DNA, 20 bp, Artificial Sequence
  chemically synthesized
gacaatctttatttggtgct

SEQ ID NO: 471714 - DNA, 20 bp, Artificial Sequence
  chemically synthesized
taaagtcaccagtctgtttt

SEQ ID NO: 471715 - DNA, 20 bp, Artificial Sequence
  chemically synthesized
taagagttatcatggaacaa

SEQ ID NO: 471716 - DNA, 20 bp, Artificial Sequence
  chemically synthesized
agttatcatggaacaagtga

SEQ ID NO: 471717 - DNA, 20 bp, Artificial Sequence
  chemically synthesized
aaaatccagattatgagcca

SEQ ID NO: 471718 - DNA, 20 bp, Artificial Sequence
  chemically synthesized
tagacccactggctcataat

SEQ ID NO: 471719 - DNA, 20 bp, Artificial Sequence
  chemically synthesized
aatgtgcatacaaattgtct

SEQ ID NO: 471720 - DNA, 20 bp, Artificial Sequence
  chemically synthesized
aaaacgtgtagaaagaaaga

SEQ ID NO: 471721 - DNA, 20 bp, Artificial Sequence
  chemically synthesized
tttctttcttttttttgaga

SEQ ID NO: 471722 - DNA, 20 bp, Artificial Sequence
  chemically synthesized
gctttggtaagcctcggtaa

SEQ ID NO: 471723 - DNA, 20 bp, Artificial Sequence
  chemically synthesized
ttaccgaggcttaccaaagc

SEQ ID NO: 471724 - DNA, 20 bp, Artificial Sequence
  chemically synthesized
gtaatcccaggctgagttat

SEQ ID NO: 471725 - DNA, 20 bp, Artificial Sequence
  chemically synthesized
gtgattctcataactcagcc

SEQ ID NO: 471726 - DNA, 20 bp, Artificial Sequence
  chemically synthesized
atcccagctgtaatcccagg

SEQ ID NO: 471727 - DNA, 20 bp, Artificial Sequence
  chemically synthesized
actcagcctgggattacagc

SEQ ID NO: 471728 - DNA, 20 bp, Artificial Sequence
  chemically synthesized
ccaggctggtctaaacctcc

SEQ ID NO: 471729 - DNA, 20 bp, Artificial Sequence
  chemically synthesized
ctcggcctcccaaagcctgt

SEQ ID NO: 471730 - DNA, 20 bp, Artificial Sequence
  chemically synthesized
cctgtttctccactttgtat

SEQ ID NO: 471731 - DNA, 20 bp, Artificial Sequence
  chemically synthesized
ttgtattggaatgcttttat

SEQ ID NO: 471732 - DNA, 20 bp, Artificial Sequence
  chemically synthesized
caaaccacagcctaggaggc

SEQ ID NO: 471733 - DNA, 20 bp, Artificial Sequence
  chemically synthesized
ataaagaggaggtttcacat

SEQ ID NO: 471734 - DNA, 20 bp, Artificial Sequence
  chemically synthesized
agacagagaaattttcagat

SEQ ID NO: 471735 - DNA, 20 bp, Artificial Sequence
  chemically synthesized
tctgtctgccaaaagaaaca

SEQ ID NO: 471736 - DNA, 20 bp, Artificial Sequence
  chemically synthesized
ctcttgcgttgtgggagtag

SEQ ID NO: 471737 - DNA, 20 bp, Artificial Sequence
  chemically synthesized
cttttcctctcttgcgttgt

SEQ ID NO: 471738 - DNA, 20 bp, Artificial Sequence
  chemically synthesized
gctgccagttacttgccact

SEQ ID NO: 471739 - DNA, 20 bp, Artificial Sequence
  chemically synthesized
ccaagtgcaggtttgaaata

SEQ ID NO: 471740 - DNA, 20 bp, Artificial Sequence
  chemically synthesized
agcttttaatacacattgac

SEQ ID NO: 471741 - DNA, 20 bp, Artificial Sequence
  chemically synthesized
atgaggagattcaattaaaa

SEQ ID NO: 471742 - DNA, 20 bp, Artificial Sequence
  chemically synthesized
ctcccatcatccagttttaa

SEQ ID NO: 471743 - DNA, 20 bp, Artificial Sequence
  chemically synthesized
gactggacaaatcagaaaaa

SEQ ID NO: 471744 - DNA, 20 bp, Artificial Sequence
  chemically synthesized
aagagattgaaagctgatat

SEQ ID NO: 471745 - DNA, 20 bp, Artificial Sequence
  chemically synthesized
tgcctataactagcatggca

SEQ ID NO: 471746 - DNA, 20 bp, Artificial Sequence
  chemically synthesized
catgaggtcagtcattccta

SEQ ID NO: 471747 - DNA, 20 bp, Artificial Sequence
  chemically synthesized
ggcaccagaaaagattcatt

SEQ ID NO: 471748 - DNA, 20 bp, Artificial Sequence
  chemically synthesized
tctttgactggagtatttga

SEQ ID NO: 471749 - DNA, 20 bp, Artificial Sequence
  chemically synthesized
ccttaattggtgtctttgac

SEQ ID NO: 471750 - DNA, 20 bp, Artificial Sequence
  chemically synthesized
tccagtcaaagacaccaatt

SEQ ID NO: 471751 - DNA, 20 bp, Artificial Sequence
  chemically synthesized
ttggatatttatctattaag

SEQ ID NO: 471752 - DNA, 20 bp, Artificial Sequence
  chemically synthesized
cattttgaggacagcctggt

SEQ ID NO: 471753 - DNA, 20 bp, Artificial Sequence
  chemically synthesized
gatctgtcttttttgaacac

SEQ ID NO: 471754 - DNA, 20 bp, Artificial Sequence
  chemically synthesized
tctctcccttcaaccaaggg

SEQ ID NO: 471755 - DNA, 20 bp, Artificial Sequence
  chemically synthesized
cattttctctcccttcaacc

SEQ ID NO: 471756 - DNA, 20 bp, Artificial Sequence
  chemically synthesized
agtgggggcgggagaggaga

SEQ ID NO: 471757 - DNA, 20 bp, Artificial Sequence
  chemically synthesized
aatgggacagtaagatgttg

SEQ ID NO: 471758 - DNA, 20 bp, Artificial Sequence
  chemically synthesized
ttctatttcccaattgattt

SEQ ID NO: 471759 - DNA, 20 bp, Artificial Sequence
  chemically synthesized
aaaagaacacgccagtattt

SEQ ID NO: 471760 - DNA, 20 bp, Artificial Sequence
  chemically synthesized
aagtgcttgtctaaggtaga

SEQ ID NO: 471761 - DNA, 20 bp, Artificial Sequence
  chemically synthesized
gcttaaatttaggcacatcc

SEQ ID NO: 471762 - DNA, 20 bp, Artificial Sequence
  chemically synthesized
agggaaggactttcttactc

SEQ ID NO: 471763 - DNA, 20 bp, Artificial Sequence
  chemically synthesized
tgtcaggtaaaggaagcaat

SEQ ID NO: 471764 - DNA, 20 bp, Artificial Sequence
  chemically synthesized
gactatagccgttatcttaa

SEQ ID NO: 471765 - DNA, 20 bp, Artificial Sequence
  chemically synthesized
taagataacggctatagtcc

SEQ ID NO: 471766 - DNA, 20 bp, Artificial Sequence
  chemically synthesized
gtctaaaaaggacaaaggaa

SEQ ID NO: 471767 - DNA, 20 bp, Artificial Sequence
  chemically synthesized
agacttcagttcaaaatgct

SEQ ID NO: 471768 - DNA, 20 bp, Artificial Sequence
  chemically synthesized
actaatgtgattactttggt

SEQ ID NO: 471769 - DNA, 20 bp, Artificial Sequence
  chemically synthesized
tattgaaaatcataaactaa

SEQ ID NO: 471770 - DNA, 20 bp, Artificial Sequence
  chemically synthesized
tagtttatgattttcaataa

SEQ ID NO: 471771 - DNA, 20 bp, Artificial Sequence
  chemically synthesized
ataaatgaataatcatataa

SEQ ID NO: 471772 - DNA, 20 bp, Artificial Sequence
  chemically synthesized
aaaaacctaaaaataagatt

SEQ ID NO: 471773 - DNA, 20 bp, Artificial Sequence
  chemically synthesized
aaagcaaaaatgttgacaga

SEQ ID NO: 471774 - DNA, 20 bp, Artificial Sequence
  chemically synthesized
gcctcgacctcccaacgtgc

SEQ ID NO: 471775 - DNA, 20 bp, Artificial Sequence
  chemically synthesized
tggcacgttgggaggtcgag

SEQ ID NO: 471776 - DNA, 20 bp, Artificial Sequence
  chemically synthesized
acgttgggaggtcgaggcgg

SEQ ID NO: 471777 - DNA, 20 bp, Artificial Sequence
  chemically synthesized
cgggtggatcatctaaggcc

SEQ ID NO: 471778 - DNA, 20 bp, Artificial Sequence
  chemically synthesized
tttttgtatttttatagaga

SEQ ID NO: 471779 - DNA, 20 bp, Artificial Sequence
  chemically synthesized
aaaattagctgggcatgatg

SEQ ID NO: 471780 - DNA, 20 bp, Artificial Sequence
  chemically synthesized
gcctcagcctctcgagtggc

SEQ ID NO: 471781 - DNA, 20 bp, Artificial Sequence
  chemically synthesized
gattctcccgcctcagcctc

SEQ ID NO: 471782 - DNA, 20 bp, Artificial Sequence
  chemically synthesized
cactcgagaggctgaggcgg

SEQ ID NO: 471783 - DNA, 20 bp, Artificial Sequence
  chemically synthesized
tggactgcaacctccacctg

SEQ ID NO: 471784 - DNA, 20 bp, Artificial Sequence
  chemically synthesized
gcagtccactgcactccagc

SEQ ID NO: 471785 - DNA, 20 bp, Artificial Sequence
  chemically synthesized
ttttgctctgtcacccaggc

SEQ ID NO: 471786 - DNA, 20 bp, Artificial Sequence
  chemically synthesized
ttgatttttttttttttgag

SEQ ID NO: 471787 - DNA, 20 bp, Artificial Sequence
  chemically synthesized
aaataattataatggtatat

SEQ ID NO: 471788 - DNA, 20 bp, Artificial Sequence
  chemically synthesized
gttgttctgttcgttgtaaa

SEQ ID NO: 471789 - DNA, 20 bp, Artificial Sequence
  chemically synthesized
gatttagagctaacaaaaat

SEQ ID NO: 471790 - DNA, 20 bp, Artificial Sequence
  chemically synthesized
aatcaaattttaaaagtaaa

SEQ ID NO: 471791 - DNA, 20 bp, Artificial Sequence
  chemically synthesized
agcaaaatataagaccaggc

SEQ ID NO: 471792 - DNA, 20 bp, Artificial Sequence
  chemically synthesized
ttcatagaggagacagctca

SEQ ID NO: 471793 - DNA, 20 bp, Artificial Sequence
  chemically synthesized
acttcataaggcatcttaca

SEQ ID NO: 471794 - DNA, 20 bp, Artificial Sequence
  chemically synthesized
aaagaatatcgtaaaatatg

SEQ ID NO: 471795 - DNA, 20 bp, Artificial Sequence
  chemically synthesized
attacttcatttaattttaa

SEQ ID NO: 471796 - DNA, 20 bp, Artificial Sequence
  chemically synthesized
ataataataataataataaa

SEQ ID NO: 471797 - DNA, 20 bp, Artificial Sequence
  chemically synthesized
attattattattatttgaga

SEQ ID NO: 471798 - DNA, 20 bp, Artificial Sequence
  chemically synthesized
ctgcactccagcctgggcga

SEQ ID NO: 471799 - DNA, 20 bp, Artificial Sequence
  chemically synthesized
tctcactctgtcgcccaggc

SEQ ID NO: 471800 - DNA, 20 bp, Artificial Sequence
  chemically synthesized
ctcactgcaacctccgcctc

SEQ ID NO: 471801 - DNA, 20 bp, Artificial Sequence
  chemically synthesized
tactcgggaggctgaggcat

SEQ ID NO: 471802 - DNA, 20 bp, Artificial Sequence
  chemically synthesized
aattctcatgcctcagcctc

SEQ ID NO: 471803 - DNA, 20 bp, Artificial Sequence
  chemically synthesized
gcctcagcctcccgagtagc

SEQ ID NO: 471804 - DNA, 20 bp, Artificial Sequence
  chemically synthesized
ttttatatttttagtagaga

SEQ ID NO: 471805 - DNA, 20 bp, Artificial Sequence
  chemically synthesized
cgggtagattgcttgatgcc

SEQ ID NO: 471806 - DNA, 20 bp, Artificial Sequence
  chemically synthesized
tagcactttgggaggccgag

SEQ ID NO: 471807 - DNA, 20 bp, Artificial Sequence
  chemically synthesized
attttaaaaatcctaatttc

SEQ ID NO: 471808 - DNA, 20 bp, Artificial Sequence
  chemically synthesized
ccaggaaaaattcaggaaat

SEQ ID NO: 471809 - DNA, 20 bp, Artificial Sequence
  chemically synthesized
ggtaatctttgagctatttt

SEQ ID NO: 471810 - DNA, 20 bp, Artificial Sequence
  chemically synthesized
catattgactccctaaatat

SEQ ID NO: 471811 - DNA, 20 bp, Artificial Sequence
  chemically synthesized
atttgttattcacatattta

SEQ ID NO: 471812 - DNA, 20 bp, Artificial Sequence
  chemically synthesized
atggcagctatgattatttg

SEQ ID NO: 471813 - DNA, 20 bp, Artificial Sequence
  chemically synthesized
cagctatgattatttgctga

SEQ ID NO: 471814 - DNA, 20 bp, Artificial Sequence
  chemically synthesized
attcatatgaacacactttt

SEQ ID NO: 471815 - DNA, 20 bp, Artificial Sequence
  chemically synthesized
actctaaaaagtgtgttcat

SEQ ID NO: 471816 - DNA, 20 bp, Artificial Sequence
  chemically synthesized
atgcttaggatagaggcatc

SEQ ID NO: 471817 - DNA, 20 bp, Artificial Sequence
  chemically synthesized
gatcctatatataagatgct

SEQ ID NO: 471818 - DNA, 20 bp, Artificial Sequence
  chemically synthesized
tatcctaagcatcttatata

SEQ ID NO: 471819 - DNA, 20 bp, Artificial Sequence
  chemically synthesized
ggatcttaatccacagcaat

SEQ ID NO: 471820 - DNA, 20 bp, Artificial Sequence
  chemically synthesized
tgcagggaattcagattgct

SEQ ID NO: 471821 - DNA, 20 bp, Artificial Sequence
  chemically synthesized
gacttcttttaatttttgca

SEQ ID NO: 471822 - DNA, 20 bp, Artificial Sequence
  chemically synthesized
ttcaaggttatatagagtga

SEQ ID NO: 471823 - DNA, 20 bp, Artificial Sequence
  chemically synthesized
tgtttcttttcaaggttata

SEQ ID NO: 471824 - DNA, 20 bp, Artificial Sequence
  chemically synthesized
ggtagtctcatttcaagtta

SEQ ID NO: 471825 - DNA, 20 bp, Artificial Sequence
  chemically synthesized
aactaagcaattttaaagct

SEQ ID NO: 471826 - DNA, 20 bp, Artificial Sequence
  chemically synthesized
tttaagtcaaatcagttttt

SEQ ID NO: 471827 - DNA, 20 bp, Artificial Sequence
  chemically synthesized
aaaaataagtacacaaacat

SEQ ID NO: 471828 - DNA, 20 bp, Artificial Sequence
  chemically synthesized
catccaagtctgcaaataac

SEQ ID NO: 471829 - DNA, 20 bp, Artificial Sequence
  chemically synthesized
tattctagttatttgcagac

SEQ ID NO: 471830 - DNA, 20 bp, Artificial Sequence
  chemically synthesized
tatttaatttacacttaaat

SEQ ID NO: 471831 - DNA, 20 bp, Artificial Sequence
  chemically synthesized
taaataaatgtcaactataa

SEQ ID NO: 471832 - DNA, 20 bp, Artificial Sequence
  chemically synthesized
tgaattatattatttgaaaa

SEQ ID NO: 471833 - DNA, 20 bp, Artificial Sequence
  chemically synthesized
acagtttttttttttttaat

SEQ ID NO: 471834 - DNA, 20 bp, Artificial Sequence
  chemically synthesized
tatctctgaatatttaaatg

SEQ ID NO: 471835 - DNA, 20 bp, Artificial Sequence
  chemically synthesized
gattattctgtaaaatatct

SEQ ID NO: 471836 - DNA, 20 bp, Artificial Sequence
  chemically synthesized
aaatattcagagatatttta

SEQ ID NO: 471837 - DNA, 20 bp, Artificial Sequence
  chemically synthesized
ttaaatgagaagtcagaagg

SEQ ID NO: 471838 - DNA, 20 bp, Artificial Sequence
  chemically synthesized
cttctgacttctcatttaaa

SEQ ID NO: 471839 - DNA, 20 bp, Artificial Sequence
  chemically synthesized
ccggaaagttattgtcatgc

SEQ ID NO: 471840 - DNA, 20 bp, Artificial Sequence
  chemically synthesized
atagaatacatgtgccgtta

SEQ ID NO: 471841 - DNA, 20 bp, Artificial Sequence
  chemically synthesized
atgggagctggtagggacta

SEQ ID NO: 471842 - DNA, 20 bp, Artificial Sequence
  chemically synthesized
aaggctgaccatagcaatct

SEQ ID NO: 471843 - DNA, 20 bp, Artificial Sequence
  chemically synthesized
caaaagaagaaatagaaaat

SEQ ID NO: 471844 - DNA, 20 bp, Artificial Sequence
  chemically synthesized
ccagtgatatgatttggcct

SEQ ID NO: 471845 - DNA, 20 bp, Artificial Sequence
  chemically synthesized
ttgcctcttctagtctctgg

SEQ ID NO: 471846 - DNA, 20 bp, Artificial Sequence
  chemically synthesized
cctacttgcctttatgaaac

SEQ ID NO: 471847 - DNA, 20 bp, Artificial Sequence
  chemically synthesized
ttcttgtcaaggtttggtat

SEQ ID NO: 471848 - DNA, 20 bp, Artificial Sequence
  chemically synthesized
tccacataccaaaccttgac

SEQ ID NO: 471849 - DNA, 20 bp, Artificial Sequence
  chemically synthesized
tcatttgatagtatttcctt

SEQ ID NO: 471850 - DNA, 20 bp, Artificial Sequence
  chemically synthesized
tctaaaggaaatactatcaa

SEQ ID NO: 471851 - DNA, 20 bp, Artificial Sequence
  chemically synthesized
tactatcaaatgaattctaa

SEQ ID NO: 471852 - DNA, 20 bp, Artificial Sequence
  chemically synthesized
cttgatgctaaacattcatt

SEQ ID NO: 471853 - DNA, 20 bp, Artificial Sequence
  chemically synthesized
tgagttttatttttcataat

SEQ ID NO: 471854 - DNA, 20 bp, Artificial Sequence
  chemically synthesized
tgtaatatgtgagatagaga

SEQ ID NO: 471855 - DNA, 20 bp, Artificial Sequence
  chemically synthesized
atttagatatatagtacacc

SEQ ID NO: 471856 - DNA, 20 bp, Artificial Sequence
  chemically synthesized
gtttctagaagataataaaa

SEQ ID NO: 471857 - DNA, 20 bp, Artificial Sequence
  chemically synthesized
atctttcctaatacaagata

SEQ ID NO: 471858 - DNA, 20 bp, Artificial Sequence
  chemically synthesized
atttcttaaagaggacacaa

SEQ ID NO: 471859 - DNA, 20 bp, Artificial Sequence
  chemically synthesized
ccaatatgtaaatttttcct

SEQ ID NO: 471860 - DNA, 20 bp, Artificial Sequence
  chemically synthesized
atttacaaagggctacaaac

SEQ ID NO: 471861 - DNA, 20 bp, Artificial Sequence
  chemically synthesized
tctttttcttattgatctgt

SEQ ID NO: 471862 - DNA, 20 bp, Artificial Sequence
  chemically synthesized
tacagatcaataagaaaaag

SEQ ID NO: 471863 - DNA, 20 bp, Artificial Sequence
  chemically synthesized
gatcaataagaaaaagaagg

SEQ ID NO: 471864 - DNA, 20 bp, Artificial Sequence
  chemically synthesized
taaaaaaaataggcaagaga

SEQ ID NO: 471865 - DNA, 20 bp, Artificial Sequence
  chemically synthesized
tgaatagatacttcacacaa

SEQ ID NO: 471866 - DNA, 20 bp, Artificial Sequence
  chemically synthesized
acgtgtatttattgaccatt

SEQ ID NO: 471867 - DNA, 20 bp, Artificial Sequence
  chemically synthesized
ttgtctgattacttatgagg

SEQ ID NO: 471868 - DNA, 20 bp, Artificial Sequence
  chemically synthesized
cattgcagtgagtgtgtgag

SEQ ID NO: 471869 - DNA, 20 bp, Artificial Sequence
  chemically synthesized
ttcgccattgcagtgagtgt

SEQ ID NO: 471870 - DNA, 20 bp, Artificial Sequence
  chemically synthesized
ttaaaattttcgccattgca

SEQ ID NO: 471871 - DNA, 20 bp, Artificial Sequence
  chemically synthesized
tacaaccactttggaaaacc

SEQ ID NO: 471872 - DNA, 20 bp, Artificial Sequence
  chemically synthesized
gcagtaaaattgcctatgtt

SEQ ID NO: 471873 - DNA, 20 bp, Artificial Sequence
  chemically synthesized
gtgtgccaaaaaacgcatta

SEQ ID NO: 471874 - DNA, 20 bp, Artificial Sequence
  chemically synthesized
ctttccagtttgaagacatt

SEQ ID NO: 471875 - DNA, 20 bp, Artificial Sequence
  chemically synthesized
accaaaatgttccccaacaa

SEQ ID NO: 471876 - DNA, 20 bp, Artificial Sequence
  chemically synthesized
aaatgttccccaacaataga

SEQ ID NO: 471877 - DNA, 20 bp, Artificial Sequence
  chemically synthesized
attatagtatacattttaaa

SEQ ID NO: 471878 - DNA, 20 bp, Artificial Sequence
  chemically synthesized
agattaactcatgttgttgc

SEQ ID NO: 471879 - DNA, 20 bp, Artificial Sequence
  chemically synthesized
tgacagattcatgcaacaac

SEQ ID NO: 471880 - DNA, 20 bp, Artificial Sequence
  chemically synthesized
ttaatctcataaacacaatg

SEQ ID NO: 471881 - DNA, 20 bp, Artificial Sequence
  chemically synthesized
actgtacaattccattttta

SEQ ID NO: 471882 - DNA, 20 bp, Artificial Sequence
  chemically synthesized
ttatttgaactctataaaaa

SEQ ID NO: 471883 - DNA, 20 bp, Artificial Sequence
  chemically synthesized
tctgccttataacactatgg

SEQ ID NO: 471884 - DNA, 20 bp, Artificial Sequence
  chemically synthesized
tcaaccatagtgttataagg

SEQ ID NO: 471885 - DNA, 20 bp, Artificial Sequence
  chemically synthesized
agttacctttaagatgaggg

SEQ ID NO: 471886 - DNA, 20 bp, Artificial Sequence
  chemically synthesized
gaggaatagtgattgggaga

SEQ ID NO: 471887 - DNA, 20 bp, Artificial Sequence
  chemically synthesized
tagtgattgggagagggaat

SEQ ID NO: 471888 - DNA, 20 bp, Artificial Sequence
  chemically synthesized
gagagggaatgtgggtgagg

SEQ ID NO: 471889 - DNA, 20 bp, Artificial Sequence
  chemically synthesized
gaaaagcttgaggagaaaca

SEQ ID NO: 471890 - DNA, 20 bp, Artificial Sequence
  chemically synthesized
ggagtctaagtgaatggttt

SEQ ID NO: 471891 - DNA, 20 bp, Artificial Sequence
  chemically synthesized
ttaacagttggggagtctaa

SEQ ID NO: 471892 - DNA, 20 bp, Artificial Sequence
  chemically synthesized
gaatattatgttaacagttg

SEQ ID NO: 471893 - DNA, 20 bp, Artificial Sequence
  chemically synthesized
gtgagagagagagagagaaa

SEQ ID NO: 471894 - DNA, 20 bp, Artificial Sequence
  chemically synthesized
acacacacacaccgggttgg

SEQ ID NO: 471895 - DNA, 20 bp, Artificial Sequence
  chemically synthesized
cacacacacacacacacaca

SEQ ID NO: 471896 - DNA, 20 bp, Artificial Sequence
  chemically synthesized
ctcaatgcaattatcacaaa

SEQ ID NO: 471897 - DNA, 20 bp, Artificial Sequence
  chemically synthesized
atgtttcatctgtatacttt

SEQ ID NO: 471898 - DNA, 20 bp, Artificial Sequence
  chemically synthesized
catctgtatactttctgaat

SEQ ID NO: 471899 - DNA, 20 bp, Artificial Sequence
  chemically synthesized
gaatctcttttttttgcttg

SEQ ID NO: 471900 - DNA, 20 bp, Artificial Sequence
  chemically synthesized
gttttcaaaaaataagttga

SEQ ID NO: 471901 - DNA, 20 bp, Artificial Sequence
  chemically synthesized
tatttcagtaatgtgttgta

SEQ ID NO: 471902 - DNA, 20 bp, Artificial Sequence
  chemically synthesized
caacacattactgaaatact

SEQ ID NO: 471903 - DNA, 20 bp, Artificial Sequence
  chemically synthesized
ttctgatctatttattgaac

SEQ ID NO: 471904 - DNA, 20 bp, Artificial Sequence
  chemically synthesized
cctcaatgtggcagtgaggc

SEQ ID NO: 471905 - DNA, 20 bp, Artificial Sequence
  chemically synthesized
atataatacagaagcaagtg

SEQ ID NO: 471906 - DNA, 20 bp, Artificial Sequence
  chemically synthesized
agacaaggttgttcagggca

SEQ ID NO: 471907 - DNA, 20 bp, Artificial Sequence
  chemically synthesized
gagacacagagcggggctat

SEQ ID NO: 471908 - DNA, 20 bp, Artificial Sequence
  chemically synthesized
tatgggggttactgccagtg

SEQ ID NO: 471909 - DNA, 20 bp, Artificial Sequence
  chemically synthesized
ttaaccatttgtttggcagg

SEQ ID NO: 471910 - DNA, 20 bp, Artificial Sequence
  chemically synthesized
cgcctgtaatcccagcactt

SEQ ID NO: 471911 - DNA, 20 bp, Artificial Sequence
  chemically synthesized
gccttggcatcccaaagtgc

SEQ ID NO: 471912 - DNA, 20 bp, Artificial Sequence
  chemically synthesized
actttgggatgccaaggcag

SEQ ID NO: 471913 - DNA, 20 bp, Artificial Sequence
  chemically synthesized
caggaggatcgcttgagcca

SEQ ID NO: 471914 - DNA, 20 bp, Artificial Sequence
  chemically synthesized
ttttcgtagagatggcagca

SEQ ID NO: 471915 - DNA, 20 bp, Artificial Sequence
  chemically synthesized
tccaaagcttagataaaaag

SEQ ID NO: 471916 - DNA, 20 bp, Artificial Sequence
  chemically synthesized
aaaagtaggatagatgacct

SEQ ID NO: 471917 - DNA, 20 bp, Artificial Sequence
  chemically synthesized
tgtgttgtttaccaacagaa

SEQ ID NO: 471918 - DNA, 20 bp, Artificial Sequence
  chemically synthesized
ttagatcatttgctatggac

SEQ ID NO: 471919 - DNA, 20 bp, Artificial Sequence
  chemically synthesized
aaactgaggctttgagatgt

SEQ ID NO: 471920 - DNA, 20 bp, Artificial Sequence
  chemically synthesized
gcctcagtttccaagtctgt

SEQ ID NO: 471921 - DNA, 20 bp, Artificial Sequence
  chemically synthesized
gtttccaagtctgtgggaat

SEQ ID NO: 471922 - DNA, 20 bp, Artificial Sequence
  chemically synthesized
tacaatatcccatggaatgt

SEQ ID NO: 471923 - DNA, 20 bp, Artificial Sequence
  chemically synthesized
tatgatactcaaacattcca

SEQ ID NO: 471924 - DNA, 20 bp, Artificial Sequence
  chemically synthesized
ttgattcttacaatatccca

SEQ ID NO: 471925 - DNA, 20 bp, Artificial Sequence
  chemically synthesized
aacattccatgggatattgt

SEQ ID NO: 471926 - DNA, 20 bp, Artificial Sequence
  chemically synthesized
gctatctataagttatctac

SEQ ID NO: 471927 - DNA, 20 bp, Artificial Sequence
  chemically synthesized
atgccatggatgttcgggta

SEQ ID NO: 471928 - DNA, 20 bp, Artificial Sequence
  chemically synthesized
ctttctaatgccatggatgt

SEQ ID NO: 471929 - DNA, 20 bp, Artificial Sequence
  chemically synthesized
cccatggtctttctaatgcc

SEQ ID NO: 471930 - DNA, 20 bp, Artificial Sequence
  chemically synthesized
ccatggcattagaaagacca

SEQ ID NO: 471931 - DNA, 20 bp, Artificial Sequence
  chemically synthesized
attttcctatctgtaagatg

SEQ ID NO: 471932 - DNA, 20 bp, Artificial Sequence
  chemically synthesized
ctatctgtaagatgaagagt

SEQ ID NO: 471933 - DNA, 20 bp, Artificial Sequence
  chemically synthesized
tgtaagatgaagagtttggg

SEQ ID NO: 471934 - DNA, 20 bp, Artificial Sequence
  chemically synthesized
tgtgaaatgtaagaggaaga

SEQ ID NO: 471935 - DNA, 20 bp, Artificial Sequence
  chemically synthesized
acaattttatctcctcacat

SEQ ID NO: 471936 - DNA, 20 bp, Artificial Sequence
  chemically synthesized
tctgcagtctaattagctga

SEQ ID NO: 471937 - DNA, 20 bp, Artificial Sequence
  chemically synthesized
tctgaaagcacacctctata

SEQ ID NO: 471938 - DNA, 20 bp, Artificial Sequence
  chemically synthesized
aaaggacaagcttgtaatct

SEQ ID NO: 471939 - DNA, 20 bp, Artificial Sequence
  chemically synthesized
tgccattatcatttaaggga

SEQ ID NO: 471940 - DNA, 20 bp, Artificial Sequence
  chemically synthesized
tttctgccattatcatttaa

SEQ ID NO: 471941 - DNA, 20 bp, Artificial Sequence
  chemically synthesized
agtatctggtttatggcatt

SEQ ID NO: 471942 - DNA, 20 bp, Artificial Sequence
  chemically synthesized
tccatttggggaaatagatt

SEQ ID NO: 471943 - DNA, 20 bp, Artificial Sequence
  chemically synthesized
aacactacgtctctgagcac

SEQ ID NO: 471944 - DNA, 20 bp, Artificial Sequence
  chemically synthesized
cagagacgtagtgttgattg

SEQ ID NO: 471945 - DNA, 20 bp, Artificial Sequence
  chemically synthesized
tatgacactaagagaatcac

SEQ ID NO: 471946 - DNA, 20 bp, Artificial Sequence
  chemically synthesized
acacatgaatatgacactaa

SEQ ID NO: 471947 - DNA, 20 bp, Artificial Sequence
  chemically synthesized
tttacactactgaaacacac

SEQ ID NO: 471948 - DNA, 20 bp, Artificial Sequence
  chemically synthesized
gtgtttcagtagtgtaaact

SEQ ID NO: 471949 - DNA, 20 bp, Artificial Sequence
  chemically synthesized
tcagtagtgtaaactcggaa

SEQ ID NO: 471950 - DNA, 20 bp, Artificial Sequence
  chemically synthesized
acacaggcaactattcaatt

SEQ ID NO: 471951 - DNA, 20 bp, Artificial Sequence
  chemically synthesized
ttttattttttcttttgaga

SEQ ID NO: 471952 - DNA, 20 bp, Artificial Sequence
  chemically synthesized
ctgcactacagcctgggcaa

SEQ ID NO: 471953 - DNA, 20 bp, Artificial Sequence
  chemically synthesized
gctcactgcaagctccagcc

SEQ ID NO: 471954 - DNA, 20 bp, Artificial Sequence
  chemically synthesized
tactcgggaggctgaggcag

SEQ ID NO: 471955 - DNA, 20 bp, Artificial Sequence
  chemically synthesized
cattctcctgcctcagcctc

SEQ ID NO: 471956 - DNA, 20 bp, Artificial Sequence
  chemically synthesized
ttttgtatttttagtagaga

SEQ ID NO: 471957 - DNA, 20 bp, Artificial Sequence
  chemically synthesized
ctgggtttcaccgtgttagc

SEQ ID NO: 471958 - DNA, 20 bp, Artificial Sequence
  chemically synthesized
actttgtgaggccgaggtgg

SEQ ID NO: 471959 - DNA, 20 bp, Artificial Sequence
  chemically synthesized
acctcggcctcacaaagtgc

SEQ ID NO: 471960 - DNA, 20 bp, Artificial Sequence
  chemically synthesized
gtttgcttttaatatacttt

SEQ ID NO: 471961 - DNA, 20 bp, Artificial Sequence
  chemically synthesized
gaattgtacaccttaaatgg

SEQ ID NO: 471962 - DNA, 20 bp, Artificial Sequence
  chemically synthesized
caaacaaacaaacaaaaata

SEQ ID NO: 471963 - DNA, 20 bp, Artificial Sequence
  chemically synthesized
actctagcctgggtgacaga

SEQ ID NO: 471964 - DNA, 20 bp, Artificial Sequence
  chemically synthesized
actcgctctgtcacccaggc

SEQ ID NO: 471965 - DNA, 20 bp, Artificial Sequence
  chemically synthesized
tcatgccattgcactctagc

SEQ ID NO: 471966 - DNA, 20 bp, Artificial Sequence
  chemically synthesized
tacttgggaggctgaggcag

SEQ ID NO: 471967 - DNA, 20 bp, Artificial Sequence
  chemically synthesized
gcctcagcctcccaagtagc

SEQ ID NO: 471968 - DNA, 20 bp, Artificial Sequence
  chemically synthesized
gtttgtatttttagtagaga

SEQ ID NO: 471969 - DNA, 20 bp, Artificial Sequence
  chemically synthesized
cgggcagatcacttgatgtc

SEQ ID NO: 471970 - DNA, 20 bp, Artificial Sequence
  chemically synthesized
tacaaagtactaagtcaagg

SEQ ID NO: 471971 - DNA, 20 bp, Artificial Sequence
  chemically synthesized
tactttgtattggtgatata

SEQ ID NO: 471972 - DNA, 20 bp, Artificial Sequence
  chemically synthesized
ttcaacattttttgccattc

SEQ ID NO: 471973 - DNA, 20 bp, Artificial Sequence
  chemically synthesized
ttattgtagcactttcaccc

SEQ ID NO: 471974 - DNA, 20 bp, Artificial Sequence
  chemically synthesized
agaagaggcagctctcaatt

SEQ ID NO: 471975 - DNA, 20 bp, Artificial Sequence
  chemically synthesized
agctctcaattgtgaatgtt

SEQ ID NO: 471976 - DNA, 20 bp, Artificial Sequence
  chemically synthesized
tttttggattgtttctttca

SEQ ID NO: 471977 - DNA, 20 bp, Artificial Sequence
  chemically synthesized
aaaaaaaaaaaagtcacttt

SEQ ID NO: 471978 - DNA, 20 bp, Artificial Sequence
  chemically synthesized
ctgtcatcagggacatattg

SEQ ID NO: 471979 - DNA, 20 bp, Artificial Sequence
  chemically synthesized
tatgtccctgatgacagacc

SEQ ID NO: 471980 - DNA, 20 bp, Artificial Sequence
  chemically synthesized
tgaggtgttaaacattgaac

SEQ ID NO: 471981 - DNA, 20 bp, Artificial Sequence
  chemically synthesized
aagagatttcctatcttttc

SEQ ID NO: 471982 - DNA, 20 bp, Artificial Sequence
  chemically synthesized
aaagataggaaatctctttt

SEQ ID NO: 471983 - DNA, 20 bp, Artificial Sequence
  chemically synthesized
atctcttttctgaatcagaa

SEQ ID NO: 471984 - DNA, 20 bp, Artificial Sequence
  chemically synthesized
agagtagattcttgttgatc

SEQ ID NO: 471985 - DNA, 20 bp, Artificial Sequence
  chemically synthesized
ggaaaccactccagatcaac

SEQ ID NO: 471986 - DNA, 20 bp, Artificial Sequence
  chemically synthesized
tttccatttacttctgccat

SEQ ID NO: 471987 - DNA, 20 bp, Artificial Sequence
  chemically synthesized
acttctgccatgggaataaa

SEQ ID NO: 471988 - DNA, 20 bp, Artificial Sequence
  chemically synthesized
actgaatgattgctctataa

SEQ ID NO: 471989 - DNA, 20 bp, Artificial Sequence
  chemically synthesized
taagatagttatagaattta

SEQ ID NO: 471990 - DNA, 20 bp, Artificial Sequence
  chemically synthesized
ccatacttataagatagtta

SEQ ID NO: 471991 - DNA, 20 bp, Artificial Sequence
  chemically synthesized
ttcaatagtttttcacaact

SEQ ID NO: 471992 - DNA, 20 bp, Artificial Sequence
  chemically synthesized
gtaagctattttttaatcca

SEQ ID NO: 471993 - DNA, 20 bp, Artificial Sequence
  chemically synthesized
tttactgaaaccatcatcca

SEQ ID NO: 471994 - DNA, 20 bp, Artificial Sequence
  chemically synthesized
tttgtcacaaagatttttat

SEQ ID NO: 471995 - DNA, 20 bp, Artificial Sequence
  chemically synthesized
cagtaagcacgtttcctcag

SEQ ID NO: 471996 - DNA, 20 bp, Artificial Sequence
  chemically synthesized
tgctccctttacagtaggtc

SEQ ID NO: 471997 - DNA, 20 bp, Artificial Sequence
  chemically synthesized
cccactcatctgcctttagg

SEQ ID NO: 471998 - DNA, 20 bp, Artificial Sequence
  chemically synthesized
aaaaccctacctaaaggcag

SEQ ID NO: 471999 - DNA, 20 bp, Artificial Sequence
  chemically synthesized
tgtaattctttcacttagct

SEQ ID NO: 472000 - DNA, 20 bp, Artificial Sequence
  chemically synthesized
aactactctgagctaagtga

SEQ ID NO: 472001 - DNA, 20 bp, Artificial Sequence
  chemically synthesized
tagctgcaattactgctcac

SEQ ID NO: 472002 - DNA, 20 bp, Artificial Sequence
  chemically synthesized
agcatttatgacttggcatc

SEQ ID NO: 472003 - DNA, 20 bp, Artificial Sequence
  chemically synthesized
tcttactggcatgagattcc

SEQ ID NO: 472004 - DNA, 20 bp, Artificial Sequence
  chemically synthesized
taaaggataacaaaaatcct

SEQ ID NO: 472005 - DNA, 20 bp, Artificial Sequence
  chemically synthesized
ggtgtagaatataaaagcta

SEQ ID NO: 472006 - DNA, 20 bp, Artificial Sequence
  chemically synthesized
tagcttttatattctacacc

SEQ ID NO: 472007 - DNA, 20 bp, Artificial Sequence
  chemically synthesized
agtggtaccaatccatggtg

SEQ ID NO: 472008 - DNA, 20 bp, Artificial Sequence
  chemically synthesized
tggattggtaccactctaaa

SEQ ID NO: 472009 - DNA, 20 bp, Artificial Sequence
  chemically synthesized
ttccaaaatttgatccaatt

SEQ ID NO: 472010 - DNA, 20 bp, Artificial Sequence
  chemically synthesized
aattagctattcttagtcat

SEQ ID NO: 472011 - DNA, 20 bp, Artificial Sequence
  chemically synthesized
acatagaaattcaaatgact

SEQ ID NO: 472012 - DNA, 20 bp, Artificial Sequence
  chemically synthesized
aacacatgctttggcattta

SEQ ID NO: 472013 - DNA, 20 bp, Artificial Sequence
  chemically synthesized
agaagagattattttttctt

SEQ ID NO: 472014 - DNA, 20 bp, Artificial Sequence
  chemically synthesized
tgtagtatataattacagac

SEQ ID NO: 472015 - DNA, 20 bp, Artificial Sequence
  chemically synthesized
tgtaattatatactacatct

SEQ ID NO: 472016 - DNA, 20 bp, Artificial Sequence
  chemically synthesized
tttagtttaccactaaactt

SEQ ID NO: 472017 - DNA, 20 bp, Artificial Sequence
  chemically synthesized
tatggtctaaaaaagaggag

SEQ ID NO: 472018 - DNA, 20 bp, Artificial Sequence
  chemically synthesized
gggttgaaaagagcaagagg

SEQ ID NO: 472019 - DNA, 20 bp, Artificial Sequence
  chemically synthesized
aatctgaagaccgctattcc

SEQ ID NO: 472020 - DNA, 20 bp, Artificial Sequence
  chemically synthesized
gtcacttgctctatcactct

SEQ ID NO: 472021 - DNA, 20 bp, Artificial Sequence
  chemically synthesized
gatagagcaagtgactagta

SEQ ID NO: 472022 - DNA, 20 bp, Artificial Sequence
  chemically synthesized
aagaaagatataatgtttaa

SEQ ID NO: 472023 - DNA, 20 bp, Artificial Sequence
  chemically synthesized
ttttggcttgcacattctat

SEQ ID NO: 472024 - DNA, 20 bp, Artificial Sequence
  chemically synthesized
atgttggcttttcattctga

SEQ ID NO: 472025 - DNA, 20 bp, Artificial Sequence
  chemically synthesized
cagccattaatctttccctt

SEQ ID NO: 472026 - DNA, 20 bp, Artificial Sequence
  chemically synthesized
ttaatctttcccttatgagt

SEQ ID NO: 472027 - DNA, 20 bp, Artificial Sequence
  chemically synthesized
atttataatatgcacaatgt

SEQ ID NO: 472028 - DNA, 20 bp, Artificial Sequence
  chemically synthesized
agttcttttctggactagct

SEQ ID NO: 472029 - DNA, 20 bp, Artificial Sequence
  chemically synthesized
agctgtggattaggcctaga

SEQ ID NO: 472030 - DNA, 20 bp, Artificial Sequence
  chemically synthesized
ggatcgccattagaaaagtg

SEQ ID NO: 472031 - DNA, 20 bp, Artificial Sequence
  chemically synthesized
gttctatgggcctacagtcc

SEQ ID NO: 472032 - DNA, 20 bp, Artificial Sequence
  chemically synthesized
cactgagacatgtggcttct

SEQ ID NO: 472033 - DNA, 20 bp, Artificial Sequence
  chemically synthesized
gttgctgcctttcaatacca

SEQ ID NO: 472034 - DNA, 20 bp, Artificial Sequence
  chemically synthesized
ctttcaataccacagaatca

SEQ ID NO: 472035 - DNA, 20 bp, Artificial Sequence
  chemically synthesized
actgggttacagcccattgg

SEQ ID NO: 472036 - DNA, 20 bp, Artificial Sequence
  chemically synthesized
tcagctctgtcacataataa

SEQ ID NO: 472037 - DNA, 20 bp, Artificial Sequence
  chemically synthesized
gatctatctggctttcaatc

SEQ ID NO: 472038 - DNA, 20 bp, Artificial Sequence
  chemically synthesized
taacaaagcaaaatgaagca

SEQ ID NO: 472039 - DNA, 20 bp, Artificial Sequence
  chemically synthesized
acaggcttgcctttaggtac

SEQ ID NO: 472040 - DNA, 20 bp, Artificial Sequence
  chemically synthesized
cttgcctttaggtacctgag

SEQ ID NO: 472041 - DNA, 20 bp, Artificial Sequence
  chemically synthesized
tgtacattttacttttcaag

SEQ ID NO: 472042 - DNA, 20 bp, Artificial Sequence
  chemically synthesized
acctgtctatatccaagctt

SEQ ID NO: 472043 - DNA, 20 bp, Artificial Sequence
  chemically synthesized
cagaagtgttacccccaagc

SEQ ID NO: 472044 - DNA, 20 bp, Artificial Sequence
  chemically synthesized
caagcttgggggtaacactt

SEQ ID NO: 472045 - DNA, 20 bp, Artificial Sequence
  chemically synthesized
aaatgaaaattaaacttcat

SEQ ID NO: 472046 - DNA, 20 bp, Artificial Sequence
  chemically synthesized
atgccacttttaaagtttcc

SEQ ID NO: 472047 - DNA, 20 bp, Artificial Sequence
  chemically synthesized
tttaaagtttcccagaatat

SEQ ID NO: 472048 - DNA, 20 bp, Artificial Sequence
  chemically synthesized
atgtgtgtgtgtgtgtgtgt

SEQ ID NO: 472049 - DNA, 20 bp, Artificial Sequence
  chemically synthesized
cacatacacacacacacata

SEQ ID NO: 472050 - DNA, 20 bp, Artificial Sequence
  chemically synthesized
agagaacaatattatcttaa

SEQ ID NO: 472051 - DNA, 20 bp, Artificial Sequence
  chemically synthesized
atgtttagacggaattaaag

SEQ ID NO: 472052 - DNA, 20 bp, Artificial Sequence
  chemically synthesized
ctctttaattccgtctaaac

SEQ ID NO: 472053 - DNA, 20 bp, Artificial Sequence
  chemically synthesized
tattctcattcatgtttaga

SEQ ID NO: 472054 - DNA, 20 bp, Artificial Sequence
  chemically synthesized
aattccgtctaaacatgaat

SEQ ID NO: 472055 - DNA, 20 bp, Artificial Sequence
  chemically synthesized
tatatctacaacatgactaa

SEQ ID NO: 472056 - DNA, 20 bp, Artificial Sequence
  chemically synthesized
atgactaaatgagttcacca

SEQ ID NO: 472057 - DNA, 20 bp, Artificial Sequence
  chemically synthesized
acagcataaatctattttcc

SEQ ID NO: 472058 - DNA, 20 bp, Artificial Sequence
  chemically synthesized
atgaattaaattaaaaactc

SEQ ID NO: 472059 - DNA, 20 bp, Artificial Sequence
  chemically synthesized
taaaagtattatgtgtattc

SEQ ID NO: 472060 - DNA, 20 bp, Artificial Sequence
  chemically synthesized
agattgaaccaaatattttc

SEQ ID NO: 472061 - DNA, 20 bp, Artificial Sequence
  chemically synthesized
gggtttcctacgtggatgaa

SEQ ID NO: 472062 - DNA, 20 bp, Artificial Sequence
  chemically synthesized
tcaccaatagggtttcctac

SEQ ID NO: 472063 - DNA, 20 bp, Artificial Sequence
  chemically synthesized
gccaacctgctgctcaccaa

SEQ ID NO: 472064 - DNA, 20 bp, Artificial Sequence
  chemically synthesized
tggtgagcagcaggttggca

SEQ ID NO: 472065 - DNA, 20 bp, Artificial Sequence
  chemically synthesized
ttttttttaaaaattgcaat

SEQ ID NO: 472066 - DNA, 20 bp, Artificial Sequence
  chemically synthesized
actagacctctaagtctaca

SEQ ID NO: 472067 - DNA, 20 bp, Artificial Sequence
  chemically synthesized
ggaacataaatatcttctga

SEQ ID NO: 472068 - DNA, 20 bp, Artificial Sequence
  chemically synthesized
acaaaacacctcctgttgcc

SEQ ID NO: 472069 - DNA, 20 bp, Artificial Sequence
  chemically synthesized
catttgcagaagttaaaaca

SEQ ID NO: 472070 - DNA, 20 bp, Artificial Sequence
  chemically synthesized
tgtgccctcgctaatcatta

SEQ ID NO: 472071 - DNA, 20 bp, Artificial Sequence
  chemically synthesized
gcacaatgttccactttaat

SEQ ID NO: 472072 - DNA, 20 bp, Artificial Sequence
  chemically synthesized
ccactttaattagaataata

SEQ ID NO: 472073 - DNA, 20 bp, Artificial Sequence
  chemically synthesized
gatgcacaaaatacaggttt

SEQ ID NO: 472074 - DNA, 20 bp, Artificial Sequence
  chemically synthesized
cactgtcaaaattaattact

SEQ ID NO: 472075 - DNA, 20 bp, Artificial Sequence
  chemically synthesized
caaaattaattactacggat

SEQ ID NO: 472076 - DNA, 20 bp, Artificial Sequence
  chemically synthesized
tctttttttaaagaaagctt

SEQ ID NO: 472077 - DNA, 20 bp, Artificial Sequence
  chemically synthesized
cagttgtattttgacttaaa

SEQ ID NO: 472078 - DNA, 20 bp, Artificial Sequence
  chemically synthesized
ttaccttcaaatttaaaaga

SEQ ID NO: 472079 - DNA, 20 bp, Artificial Sequence
  chemically synthesized
gcaaaacaaaagttggaacc

SEQ ID NO: 472080 - DNA, 20 bp, Artificial Sequence
  chemically synthesized
gaacctagggtcagatattt

SEQ ID NO: 472081 - DNA, 20 bp, Artificial Sequence
  chemically synthesized
ctaattgttcgtttagaaaa

SEQ ID NO: 472082 - DNA, 20 bp, Artificial Sequence
  chemically synthesized
cgtttagaaaatagggtagg

SEQ ID NO: 472083 - DNA, 20 bp, Artificial Sequence
  chemically synthesized
acctcagcgtcccaaagtgc

SEQ ID NO: 472084 - DNA, 20 bp, Artificial Sequence
  chemically synthesized
cagcactttgggacgctgag

SEQ ID NO: 472085 - DNA, 20 bp, Artificial Sequence
  chemically synthesized
actttgggacgctgaggtgg

SEQ ID NO: 472086 - DNA, 20 bp, Artificial Sequence
  chemically synthesized
cagggtttcaccaatttggc

SEQ ID NO: 472087 - DNA, 20 bp, Artificial Sequence
  chemically synthesized
ttttgtatttttagtagaga

SEQ ID NO: 472088 - DNA, 20 bp, Artificial Sequence
  chemically synthesized
actaaaaatacaaaaattag

SEQ ID NO: 472089 - DNA, 20 bp, Artificial Sequence
  chemically synthesized
tacttgggaggctgaggcag

SEQ ID NO: 472090 - DNA, 20 bp, Artificial Sequence
  chemically synthesized
gtcttcctctgtcaccaggc

SEQ ID NO: 472091 - DNA, 20 bp, Artificial Sequence
  chemically synthesized
ttttttttttttttttaaga

SEQ ID NO: 472092 - DNA, 20 bp, Artificial Sequence
  chemically synthesized
aaaaaaaaaaaaaaaaaaaa

SEQ ID NO: 472093 - DNA, 20 bp, Artificial Sequence
  chemically synthesized
aaaaaaaaaaaaaggatggg

SEQ ID NO: 472094 - DNA, 20 bp, Artificial Sequence
  chemically synthesized
ggatgatacaggtaagctat

SEQ ID NO: 472095 - DNA, 20 bp, Artificial Sequence
  chemically synthesized
taccttgatattagatatat

SEQ ID NO: 472096 - DNA, 20 bp, Artificial Sequence
  chemically synthesized
cagagaacatttaaacaact

SEQ ID NO: 472097 - DNA, 20 bp, Artificial Sequence
  chemically synthesized
tcttttaccattggagagaa

SEQ ID NO: 472098 - DNA, 20 bp, Artificial Sequence
  chemically synthesized
ctcaatcttttaccattgga

SEQ ID NO: 472099 - DNA, 20 bp, Artificial Sequence
  chemically synthesized
ttctctccaatggtaaaaga

SEQ ID NO: 472100 - DNA, 20 bp, Artificial Sequence
  chemically synthesized
ttttaaagcaacatctgaag

SEQ ID NO: 472101 - DNA, 20 bp, Artificial Sequence
  chemically synthesized
acatctgaagatgagttgga

SEQ ID NO: 472102 - DNA, 20 bp, Artificial Sequence
  chemically synthesized
cgatgctctacatttccatt

SEQ ID NO: 472103 - DNA, 20 bp, Artificial Sequence
  chemically synthesized
tcactgaatagggggtgacc

SEQ ID NO: 472104 - DNA, 20 bp, Artificial Sequence
  chemically synthesized
taaaatgatttcactgaata

SEQ ID NO: 472105 - DNA, 20 bp, Artificial Sequence
  chemically synthesized
aatgacataaaatgatttca

SEQ ID NO: 472106 - DNA, 20 bp, Artificial Sequence
  chemically synthesized
aaaaaccgatggtgtatttg

SEQ ID NO: 472107 - DNA, 20 bp, Artificial Sequence
  chemically synthesized
ctacagaagttccaaacctg

SEQ ID NO: 472108 - DNA, 20 bp, Artificial Sequence
  chemically synthesized
ccaatactttatatagtttc

SEQ ID NO: 472109 - DNA, 20 bp, Artificial Sequence
  chemically synthesized
acccagaatacaagtctttc

SEQ ID NO: 472110 - DNA, 20 bp, Artificial Sequence
  chemically synthesized
atccttgaaagacttgtatt

SEQ ID NO: 472111 - DNA, 20 bp, Artificial Sequence
  chemically synthesized
atattacttgactgaagacc

SEQ ID NO: 472112 - DNA, 20 bp, Artificial Sequence
  chemically synthesized
tcttcagtcaagtaatatta

SEQ ID NO: 472113 - DNA, 20 bp, Artificial Sequence
  chemically synthesized
ctgtgttattgaggtgaaag

SEQ ID NO: 472114 - DNA, 20 bp, Artificial Sequence
  chemically synthesized
tgtctacctgatattaagcc

SEQ ID NO: 472115 - DNA, 20 bp, Artificial Sequence
  chemically synthesized
aaaaatgtaaagtaggaagt

SEQ ID NO: 472116 - DNA, 20 bp, Artificial Sequence
  chemically synthesized
ttgcattgctcaagaaaagg

SEQ ID NO: 472117 - DNA, 20 bp, Artificial Sequence
  chemically synthesized
cagaagcagtgcctgagcat

SEQ ID NO: 472118 - DNA, 20 bp, Artificial Sequence
  chemically synthesized
gtttatatggcatctgctcc

SEQ ID NO: 472119 - DNA, 20 bp, Artificial Sequence
  chemically synthesized
ggacatgtgggagctagcct

SEQ ID NO: 472120 - DNA, 20 bp, Artificial Sequence
  chemically synthesized
ccacctatggcagtagcccc

SEQ ID NO: 472121 - DNA, 20 bp, Artificial Sequence
  chemically synthesized
ctgggggctactgccatagg

SEQ ID NO: 472122 - DNA, 20 bp, Artificial Sequence
  chemically synthesized
ctgtaccttgccttcacaag

SEQ ID NO: 472123 - DNA, 20 bp, Artificial Sequence
  chemically synthesized
gccttcacaaggaggatgcg

SEQ ID NO: 472124 - DNA, 20 bp, Artificial Sequence
  chemically synthesized
cttccccaatcagcaacaca

SEQ ID NO: 472125 - DNA, 20 bp, Artificial Sequence
  chemically synthesized
ctctgtgttgctgattgggg

SEQ ID NO: 472126 - DNA, 20 bp, Artificial Sequence
  chemically synthesized
ggtcacagtagctagtcacc

SEQ ID NO: 472127 - DNA, 20 bp, Artificial Sequence
  chemically synthesized
atgtcttttcctctgaagag

SEQ ID NO: 472128 - DNA, 20 bp, Artificial Sequence
  chemically synthesized
ctataaagaactacccgtga

SEQ ID NO: 472129 - DNA, 20 bp, Artificial Sequence
  chemically synthesized
gctttataaactacccagtc

SEQ ID NO: 472130 - DNA, 20 bp, Artificial Sequence
  chemically synthesized
cctatacagcctgcagaact

SEQ ID NO: 472131 - DNA, 20 bp, Artificial Sequence
  chemically synthesized
agcacatcttcacacagcag

SEQ ID NO: 472132 - DNA, 20 bp, Artificial Sequence
  chemically synthesized
ctcaagagatctagttattt

SEQ ID NO: 472133 - DNA, 20 bp, Artificial Sequence
  chemically synthesized
tgctgtacttgtgatagtga

SEQ ID NO: 472134 - DNA, 20 bp, Artificial Sequence
  chemically synthesized
ccgttgctgtacttgtgata

SEQ ID NO: 472135 - DNA, 20 bp, Artificial Sequence
  chemically synthesized
aggggcctgatgggaggtga

SEQ ID NO: 472136 - DNA, 20 bp, Artificial Sequence
  chemically synthesized
gaggaggggcctgatgggag

SEQ ID NO: 472137 - DNA, 20 bp, Artificial Sequence
  chemically synthesized
aggcccctcctccaacatgt

SEQ ID NO: 472138 - DNA, 20 bp, Artificial Sequence
  chemically synthesized
attacaatttgacatgacat

SEQ ID NO: 472139 - DNA, 20 bp, Artificial Sequence
  chemically synthesized
gccatagactgagaacactg

SEQ ID NO: 472140 - DNA, 20 bp, Artificial Sequence
  chemically synthesized
attcccttcctggagctgca

SEQ ID NO: 472141 - DNA, 20 bp, Artificial Sequence
  chemically synthesized
atccactgcagctccaggaa

SEQ ID NO: 472142 - DNA, 20 bp, Artificial Sequence
  chemically synthesized
tctttcccttcctccagagg

SEQ ID NO: 472143 - DNA, 20 bp, Artificial Sequence
  chemically synthesized
acacagttggcctgggtctt

SEQ ID NO: 472144 - DNA, 20 bp, Artificial Sequence
  chemically synthesized
tgaattaatacacagttggc

SEQ ID NO: 472145 - DNA, 20 bp, Artificial Sequence
  chemically synthesized
gtgtattaattcaaacatta

SEQ ID NO: 472146 - DNA, 20 bp, Artificial Sequence
  chemically synthesized
gcagaggcattctctaatgt

SEQ ID NO: 472147 - DNA, 20 bp, Artificial Sequence
  chemically synthesized
gaagcttgttagtgtagtgg

SEQ ID NO: 472148 - DNA, 20 bp, Artificial Sequence
  chemically synthesized
tgaggaaacaaagttaccag

SEQ ID NO: 472149 - DNA, 20 bp, Artificial Sequence
  chemically synthesized
agttgctttggttgtcattg

SEQ ID NO: 472150 - DNA, 20 bp, Artificial Sequence
  chemically synthesized
taatttatcttaatctgact

SEQ ID NO: 472151 - DNA, 20 bp, Artificial Sequence
  chemically synthesized
ttaggcatgctttgtatctc

SEQ ID NO: 472152 - DNA, 20 bp, Artificial Sequence
  chemically synthesized
acagtctaaggagacaaagc

SEQ ID NO: 472153 - DNA, 20 bp, Artificial Sequence
  chemically synthesized
tattgtctttcttttccctc

SEQ ID NO: 472154 - DNA, 20 bp, Artificial Sequence
  chemically synthesized
tagagctggaaactataaga

SEQ ID NO: 472155 - DNA, 20 bp, Artificial Sequence
  chemically synthesized
aatatagagctggaaactat

SEQ ID NO: 472156 - DNA, 20 bp, Artificial Sequence
  chemically synthesized
tatagagctggaaactataa

SEQ ID NO: 472157 - DNA, 20 bp, Artificial Sequence
  chemically synthesized
tggttctttccttgtctttg

SEQ ID NO: 472158 - DNA, 20 bp, Artificial Sequence
  chemically synthesized
caaggaaagaaccagtgaac

SEQ ID NO: 472159 - DNA, 20 bp, Artificial Sequence
  chemically synthesized
agaaccagtgaacttgaata

SEQ ID NO: 472160 - DNA, 20 bp, Artificial Sequence
  chemically synthesized
ttgcttgtcagaggtcttct

SEQ ID NO: 472161 - DNA, 20 bp, Artificial Sequence
  chemically synthesized
tgcaatatttgatttagatt

SEQ ID NO: 472162 - DNA, 20 bp, Artificial Sequence
  chemically synthesized
cacatttgtttttttgtact

SEQ ID NO: 472163 - DNA, 20 bp, Artificial Sequence
  chemically synthesized
aatgtgttccttctaatgct

SEQ ID NO: 472164 - DNA, 20 bp, Artificial Sequence
  chemically synthesized
gagaggatcggaatttcatc

SEQ ID NO: 472165 - DNA, 20 bp, Artificial Sequence
  chemically synthesized
gagggggcatcagagaggat

SEQ ID NO: 472166 - DNA, 20 bp, Artificial Sequence
  chemically synthesized
atgggagagggggcatcaga

SEQ ID NO: 472167 - DNA, 20 bp, Artificial Sequence
  chemically synthesized
cactttaaaaagtgaccttc

SEQ ID NO: 472168 - DNA, 20 bp, Artificial Sequence
  chemically synthesized
gaccttccagaatttagcat

SEQ ID NO: 472169 - DNA, 20 bp, Artificial Sequence
  chemically synthesized
tagtaactgaaaccatgagt

SEQ ID NO: 472170 - DNA, 20 bp, Artificial Sequence
  chemically synthesized
tatagctagtaactgaaacc

SEQ ID NO: 472171 - DNA, 20 bp, Artificial Sequence
  chemically synthesized
agaaggaggcgcatctgggt

SEQ ID NO: 472172 - DNA, 20 bp, Artificial Sequence
  chemically synthesized
aaagaaagaaggaggcgcat

SEQ ID NO: 472173 - DNA, 20 bp, Artificial Sequence
  chemically synthesized
ctgtctatttacagtgcttt

SEQ ID NO: 472174 - DNA, 20 bp, Artificial Sequence
  chemically synthesized
ggcaatttgattgtaaatgt

SEQ ID NO: 472175 - DNA, 20 bp, Artificial Sequence
  chemically synthesized
ctctaaagaaagatcagatt

SEQ ID NO: 472176 - DNA, 20 bp, Artificial Sequence
  chemically synthesized
ccctaaatctgatctttctt

SEQ ID NO: 472177 - DNA, 20 bp, Artificial Sequence
  chemically synthesized
gagttccctaactcactgta

SEQ ID NO: 472178 - DNA, 20 bp, Artificial Sequence
  chemically synthesized
acagttggtaattctttaca

SEQ ID NO: 472179 - DNA, 20 bp, Artificial Sequence
  chemically synthesized
agagaaagcaaaacatgtca

SEQ ID NO: 472180 - DNA, 20 bp, Artificial Sequence
  chemically synthesized
gatatctatcctcaaatctt

SEQ ID NO: 472181 - DNA, 20 bp, Artificial Sequence
  chemically synthesized
ggtaaaaatccttaagattt

SEQ ID NO: 472182 - DNA, 20 bp, Artificial Sequence
  chemically synthesized
tggaccaagatgatgatagt

SEQ ID NO: 472183 - DNA, 20 bp, Artificial Sequence
  chemically synthesized
gaaagccaggtgagagaaga

SEQ ID NO: 472184 - DNA, 20 bp, Artificial Sequence
  chemically synthesized
atgaattggatgaggagcct

SEQ ID NO: 472185 - DNA, 20 bp, Artificial Sequence
  chemically synthesized
ctctggctgatgcaaatgaa

SEQ ID NO: 472186 - DNA, 20 bp, Artificial Sequence
  chemically synthesized
aagtcctctggctgatgcaa

SEQ ID NO: 472187 - DNA, 20 bp, Artificial Sequence
  chemically synthesized
tgcatcagccagaggacttt

SEQ ID NO: 472188 - DNA, 20 bp, Artificial Sequence
  chemically synthesized
ggagggaacttgtcaataca

SEQ ID NO: 472189 - DNA, 20 bp, Artificial Sequence
  chemically synthesized
tattaacacaaaaagagaga

SEQ ID NO: 472190 - DNA, 20 bp, Artificial Sequence
  chemically synthesized
taatggaaatgacactaaga

SEQ ID NO: 472191 - DNA, 20 bp, Artificial Sequence
  chemically synthesized
tagataatggaaatgacact

SEQ ID NO: 472192 - DNA, 20 bp, Artificial Sequence
  chemically synthesized
atacctccaaagtatagcca

SEQ ID NO: 472193 - DNA, 20 bp, Artificial Sequence
  chemically synthesized
cagatacattgctagatgta

SEQ ID NO: 472194 - DNA, 20 bp, Artificial Sequence
  chemically synthesized
gtcaatagatgtttatttat

SEQ ID NO: 472195 - DNA, 20 bp, Artificial Sequence
  chemically synthesized
aaataaacatctattgacaa

SEQ ID NO: 472196 - DNA, 20 bp, Artificial Sequence
  chemically synthesized
atctattgacaaatgaatca

SEQ ID NO: 472197 - DNA, 20 bp, Artificial Sequence
  chemically synthesized
attgacaaatgaatcaatga

SEQ ID NO: 472198 - DNA, 20 bp, Artificial Sequence
  chemically synthesized
aatcaatgaatgaatcagtc

SEQ ID NO: 472199 - DNA, 20 bp, Artificial Sequence
  chemically synthesized
aaatgtttttcttaggtaag

SEQ ID NO: 472200 - DNA, 20 bp, Artificial Sequence
  chemically synthesized
atcaaaccatttaagtgcat

SEQ ID NO: 472201 - DNA, 20 bp, Artificial Sequence
  chemically synthesized
ctgctacttgttactgcttt

SEQ ID NO: 472202 - DNA, 20 bp, Artificial Sequence
  chemically synthesized
tagtaagaagttatttttta

SEQ ID NO: 472203 - DNA, 20 bp, Artificial Sequence
  chemically synthesized
tcttactaacttggctaatt

SEQ ID NO: 472204 - DNA, 20 bp, Artificial Sequence
  chemically synthesized
cttaaagaagcatagtttcc

SEQ ID NO: 472205 - DNA, 20 bp, Artificial Sequence
  chemically synthesized
ttggaaactatgcttcttta

SEQ ID NO: 472206 - DNA, 20 bp, Artificial Sequence
  chemically synthesized
cttgaattggcctgtaatat

SEQ ID NO: 472207 - DNA, 20 bp, Artificial Sequence
  chemically synthesized
aatctgtgtgatttactttc

SEQ ID NO: 472208 - DNA, 20 bp, Artificial Sequence
  chemically synthesized
ggaaaaatttttagatgcct

SEQ ID NO: 472209 - DNA, 20 bp, Artificial Sequence
  chemically synthesized
ataacaaggtacaggaggta

SEQ ID NO: 472210 - DNA, 20 bp, Artificial Sequence
  chemically synthesized
tcttagatagatctttaata

SEQ ID NO: 472211 - DNA, 20 bp, Artificial Sequence
  chemically synthesized
ttacataaaggagctaaaat

SEQ ID NO: 472212 - DNA, 20 bp, Artificial Sequence
  chemically synthesized
tagtttgcttaattaatgta

SEQ ID NO: 472213 - DNA, 20 bp, Artificial Sequence
  chemically synthesized
tgcaaaaggcaaatgtatta

SEQ ID NO: 472214 - DNA, 20 bp, Artificial Sequence
  chemically synthesized
agctcgatattgtgaagtcc

SEQ ID NO: 472215 - DNA, 20 bp, Artificial Sequence
  chemically synthesized
ggggtgggatgccatcatat

SEQ ID NO: 472216 - DNA, 20 bp, Artificial Sequence
  chemically synthesized
tccttcttagagtcatgggg

SEQ ID NO: 472217 - DNA, 20 bp, Artificial Sequence
  chemically synthesized
atacatccttcttagagtca

SEQ ID NO: 472218 - DNA, 20 bp, Artificial Sequence
  chemically synthesized
tcccaccccatgactctaag

SEQ ID NO: 472219 - DNA, 20 bp, Artificial Sequence
  chemically synthesized
atcaatatatacatccttct

SEQ ID NO: 472220 - DNA, 20 bp, Artificial Sequence
  chemically synthesized
ctagctgtgcagttcaaaat

SEQ ID NO: 472221 - DNA, 20 bp, Artificial Sequence
  chemically synthesized
gtttaagtttgaggtactta

SEQ ID NO: 472222 - DNA, 20 bp, Artificial Sequence
  chemically synthesized
tgtctaaacccaggcagctc

SEQ ID NO: 472223 - DNA, 20 bp, Artificial Sequence
  chemically synthesized
tgtagaaaccctagagctgc

SEQ ID NO: 472224 - DNA, 20 bp, Artificial Sequence
  chemically synthesized
gctctagggtttctacacgg

SEQ ID NO: 472225 - DNA, 20 bp, Artificial Sequence
  chemically synthesized
ttttttaaagagatgtctta

SEQ ID NO: 472226 - DNA, 20 bp, Artificial Sequence
  chemically synthesized
aataatagtttgtatattta

SEQ ID NO: 472227 - DNA, 20 bp, Artificial Sequence
  chemically synthesized
atcttggtatatattgtaga

SEQ ID NO: 472228 - DNA, 20 bp, Artificial Sequence
  chemically synthesized
aatgatatgttggtgaggta

SEQ ID NO: 472229 - DNA, 20 bp, Artificial Sequence
  chemically synthesized
atatatttcaaaattgctaa

SEQ ID NO: 472230 - DNA, 20 bp, Artificial Sequence
  chemically synthesized
gctgaaagccgaggagacac

SEQ ID NO: 472231 - DNA, 20 bp, Artificial Sequence
  chemically synthesized
acaagaggtggttggaatca

SEQ ID NO: 472232 - DNA, 20 bp, Artificial Sequence
  chemically synthesized
tggagatcacaagaggtggt

SEQ ID NO: 472233 - DNA, 20 bp, Artificial Sequence
  chemically synthesized
ggtgaggaaatatgaagagc

SEQ ID NO: 472234 - DNA, 20 bp, Artificial Sequence
  chemically synthesized
tttggtggaacacgtgagtt

SEQ ID NO: 472235 - DNA, 20 bp, Artificial Sequence
  chemically synthesized
gaatgcatttggtggaacac

SEQ ID NO: 472236 - DNA, 20 bp, Artificial Sequence
  chemically synthesized
acataattggctgctgtgtg

SEQ ID NO: 472237 - DNA, 20 bp, Artificial Sequence
  chemically synthesized
atttcaaaaattttcctctt

SEQ ID NO: 472238 - DNA, 20 bp, Artificial Sequence
  chemically synthesized
cagaaaagaaatattcaggg

SEQ ID NO: 472239 - DNA, 20 bp, Artificial Sequence
  chemically synthesized
aaggttgctgaaattcagcc

SEQ ID NO: 472240 - DNA, 20 bp, Artificial Sequence
  chemically synthesized
ttactataatattcaagtca

SEQ ID NO: 472241 - DNA, 20 bp, Artificial Sequence
  chemically synthesized
gcaattctccattctttgac

SEQ ID NO: 472242 - DNA, 20 bp, Artificial Sequence
  chemically synthesized
aatattcaagtcaaagaatg

SEQ ID NO: 472243 - DNA, 20 bp, Artificial Sequence
  chemically synthesized
agaatggagaattgcccaat

SEQ ID NO: 472244 - DNA, 20 bp, Artificial Sequence
  chemically synthesized
ttataaagatataatttagt

SEQ ID NO: 472245 - DNA, 20 bp, Artificial Sequence
  chemically synthesized
ctttataatgtataaccctt

SEQ ID NO: 472246 - DNA, 20 bp, Artificial Sequence
  chemically synthesized
aagatatataaacaactctt

SEQ ID NO: 472247 - DNA, 20 bp, Artificial Sequence
  chemically synthesized
tcactgagaaatgaagttca

SEQ ID NO: 472248 - DNA, 20 bp, Artificial Sequence
  chemically synthesized
atattattttataacatcta

SEQ ID NO: 472249 - DNA, 20 bp, Artificial Sequence
  chemically synthesized
aggaaattaaatttaggcat

SEQ ID NO: 472250 - DNA, 20 bp, Artificial Sequence
  chemically synthesized
aatctgtgggaaatttaatt

SEQ ID NO: 472251 - DNA, 20 bp, Artificial Sequence
  chemically synthesized
aacagattattgccatttta

SEQ ID NO: 472252 - DNA, 20 bp, Artificial Sequence
  chemically synthesized
acgtagtactttgtcaattt

SEQ ID NO: 472253 - DNA, 20 bp, Artificial Sequence
  chemically synthesized
agaagttggtacagtcaagc

SEQ ID NO: 472254 - DNA, 20 bp, Artificial Sequence
  chemically synthesized
gtacagtcaagcatgaatct

SEQ ID NO: 472255 - DNA, 20 bp, Artificial Sequence
  chemically synthesized
tcaccaagttttataaagag

SEQ ID NO: 472256 - DNA, 20 bp, Artificial Sequence
  chemically synthesized
ctttatcaccaagttttata

SEQ ID NO: 472257 - DNA, 20 bp, Artificial Sequence
  chemically synthesized
acgatggaactaaaagttat

SEQ ID NO: 472258 - DNA, 20 bp, Artificial Sequence
  chemically synthesized
ggattaaaatattgctggtc

SEQ ID NO: 472259 - DNA, 20 bp, Artificial Sequence
  chemically synthesized
tcaatattgcttggggaagc

SEQ ID NO: 472260 - DNA, 20 bp, Artificial Sequence
  chemically synthesized
caagcaatattgatttgcta

SEQ ID NO: 472261 - DNA, 20 bp, Artificial Sequence
  chemically synthesized
aatattttaaattaaaaaga

SEQ ID NO: 472262 - DNA, 20 bp, Artificial Sequence
  chemically synthesized
gctttttttctgatgtttta

SEQ ID NO: 472263 - DNA, 20 bp, Artificial Sequence
  chemically synthesized
ttgccgtggcctggaaacta

SEQ ID NO: 472264 - DNA, 20 bp, Artificial Sequence
  chemically synthesized
caggccacggcaactactgt

SEQ ID NO: 472265 - DNA, 20 bp, Artificial Sequence
  chemically synthesized
ctgagatgagcagaggaaca

SEQ ID NO: 472266 - DNA, 20 bp, Artificial Sequence
  chemically synthesized
tgtaaaaatagcagcctctg

SEQ ID NO: 472267 - DNA, 20 bp, Artificial Sequence
  chemically synthesized
tttgagccctctgatatacc

SEQ ID NO: 472268 - DNA, 20 bp, Artificial Sequence
  chemically synthesized
ctgtaactgtaactataact

SEQ ID NO: 472269 - DNA, 20 bp, Artificial Sequence
  chemically synthesized
actggaaaaaattaacatgg

SEQ ID NO: 472270 - DNA, 20 bp, Artificial Sequence
  chemically synthesized
gaaaacaagattagtatgct

SEQ ID NO: 472271 - DNA, 20 bp, Artificial Sequence
  chemically synthesized
aaacaatacattcaaggact

SEQ ID NO: 472272 - DNA, 20 bp, Artificial Sequence
  chemically synthesized
gccaattatattccaagtcc

SEQ ID NO: 472273 - DNA, 20 bp, Artificial Sequence
  chemically synthesized
aattggcaattttgttgatg

SEQ ID NO: 472274 - DNA, 20 bp, Artificial Sequence
  chemically synthesized
tctttttactgaaagcacta

SEQ ID NO: 472275 - DNA, 20 bp, Artificial Sequence
  chemically synthesized
aaagaaatggcttgaggact

SEQ ID NO: 472276 - DNA, 20 bp, Artificial Sequence
  chemically synthesized
ggactaagagtatatgaaat

SEQ ID NO: 472277 - DNA, 20 bp, Artificial Sequence
  chemically synthesized
ttttttcacacatagttttt

SEQ ID NO: 472278 - DNA, 20 bp, Artificial Sequence
  chemically synthesized
atacaaaagattttaattgc

SEQ ID NO: 472279 - DNA, 20 bp, Artificial Sequence
  chemically synthesized
cagagaaaggcaaaaactgg

SEQ ID NO: 472280 - DNA, 20 bp, Artificial Sequence
  chemically synthesized
caaaaactggttgagtataa

SEQ ID NO: 472281 - DNA, 20 bp, Artificial Sequence
  chemically synthesized
ggaagaaaagacttcaagtt

SEQ ID NO: 472282 - DNA, 20 bp, Artificial Sequence
  chemically synthesized
ttgaagtcttttcttcccta

SEQ ID NO: 472283 - DNA, 20 bp, Artificial Sequence
  chemically synthesized
ctctgcctcaatgtatgtct

SEQ ID NO: 472284 - DNA, 20 bp, Artificial Sequence
  chemically synthesized
taatagatcttgaaaaaagt

SEQ ID NO: 472285 - DNA, 20 bp, Artificial Sequence
  chemically synthesized
cagcctttttggcaccaggc

SEQ ID NO: 472286 - DNA, 20 bp, Artificial Sequence
  chemically synthesized
acagactgggaggcaggggc

SEQ ID NO: 472287 - DNA, 20 bp, Artificial Sequence
  chemically synthesized
tattgtgaactatgtatgcg

SEQ ID NO: 472288 - DNA, 20 bp, Artificial Sequence
  chemically synthesized
atggactggaacagcaggag

SEQ ID NO: 472289 - DNA, 20 bp, Artificial Sequence
  chemically synthesized
cagtccatggtccagaggtt

SEQ ID NO: 472290 - DNA, 20 bp, Artificial Sequence
  chemically synthesized
gtaagcctatgtcttaatag

SEQ ID NO: 472291 - DNA, 20 bp, Artificial Sequence
  chemically synthesized
tcaggagccagcattgttca

SEQ ID NO: 472292 - DNA, 20 bp, Artificial Sequence
  chemically synthesized
ctggctcctgaagaaagctt

SEQ ID NO: 472293 - DNA, 20 bp, Artificial Sequence
  chemically synthesized
gcttgggagttttgatagaa

SEQ ID NO: 472294 - DNA, 20 bp, Artificial Sequence
  chemically synthesized
cctattaccaaaactgttgt

SEQ ID NO: 472295 - DNA, 20 bp, Artificial Sequence
  chemically synthesized
ttggtaataggagctactga

SEQ ID NO: 472296 - DNA, 20 bp, Artificial Sequence
  chemically synthesized
tttgaagaaagcatctttaa

SEQ ID NO: 472297 - DNA, 20 bp, Artificial Sequence
  chemically synthesized
cagatggggttgagtgttga

SEQ ID NO: 472298 - DNA, 20 bp, Artificial Sequence
  chemically synthesized
tttgttgagagcagatgggg

SEQ ID NO: 472299 - DNA, 20 bp, Artificial Sequence
  chemically synthesized
ttcagtttgttgagagcaga

SEQ ID NO: 472300 - DNA, 20 bp, Artificial Sequence
  chemically synthesized
gtaacaccagtggggctatc

SEQ ID NO: 472301 - DNA, 20 bp, Artificial Sequence
  chemically synthesized
tttatttatttatttctaga

SEQ ID NO: 472302 - DNA, 20 bp, Artificial Sequence
  chemically synthesized
caggaagatcacttgagtcc

SEQ ID NO: 472303 - DNA, 20 bp, Artificial Sequence
  chemically synthesized
agccgaagcaggaagatcac

SEQ ID NO: 472304 - DNA, 20 bp, Artificial Sequence
  chemically synthesized
attttttttttctttggaga

SEQ ID NO: 472305 - DNA, 20 bp, Artificial Sequence
  chemically synthesized
ttgcacttcagccagggcga

SEQ ID NO: 472306 - DNA, 20 bp, Artificial Sequence
  chemically synthesized
ctcactgcaacctctgcctc

SEQ ID NO: 472307 - DNA, 20 bp, Artificial Sequence
  chemically synthesized
tactcaggaggctgaggcag

SEQ ID NO: 472308 - DNA, 20 bp, Artificial Sequence
  chemically synthesized
gattctcctgcctcagcctc

SEQ ID NO: 472309 - DNA, 20 bp, Artificial Sequence
  chemically synthesized
gcctcagcctcctgagtagt

SEQ ID NO: 472310 - DNA, 20 bp, Artificial Sequence
  chemically synthesized
ttttgtatttttagtagaga

SEQ ID NO: 472311 - DNA, 20 bp, Artificial Sequence
  chemically synthesized
tgggcaaatcacctgaggtc

SEQ ID NO: 472312 - DNA, 20 bp, Artificial Sequence
  chemically synthesized
acctcagcctcccaaagtgc

SEQ ID NO: 472313 - DNA, 20 bp, Artificial Sequence
  chemically synthesized
ctttaaataagcatacctat

SEQ ID NO: 472314 - DNA, 20 bp, Artificial Sequence
  chemically synthesized
tgagatatataatacatgct

SEQ ID NO: 472315 - DNA, 20 bp, Artificial Sequence
  chemically synthesized
ataaggcacaagcgttgtca

SEQ ID NO: 472316 - DNA, 20 bp, Artificial Sequence
  chemically synthesized
acagctgaactgaggagaca

SEQ ID NO: 472317 - DNA, 20 bp, Artificial Sequence
  chemically synthesized
gaaaattaacaaaatatttc

SEQ ID NO: 472318 - DNA, 20 bp, Artificial Sequence
  chemically synthesized
gttaaacaagaaagaaaact

SEQ ID NO: 472319 - DNA, 20 bp, Artificial Sequence
  chemically synthesized
atagaggctcttgctatttc

SEQ ID NO: 472320 - DNA, 20 bp, Artificial Sequence
  chemically synthesized
tcacaagtctaagaaaaggc

SEQ ID NO: 472321 - DNA, 20 bp, Artificial Sequence
  chemically synthesized
gagcaagaggggaaaaaaag

SEQ ID NO: 472322 - DNA, 20 bp, Artificial Sequence
  chemically synthesized
aaattgtgtaagtataacat

SEQ ID NO: 472323 - DNA, 20 bp, Artificial Sequence
  chemically synthesized
gataagaatctgagatttgt

SEQ ID NO: 472324 - DNA, 20 bp, Artificial Sequence
  chemically synthesized
aataaagattggtactagat

SEQ ID NO: 472325 - DNA, 20 bp, Artificial Sequence
  chemically synthesized
caatctttattaatgactga

SEQ ID NO: 472326 - DNA, 20 bp, Artificial Sequence
  chemically synthesized
acatcataatgggaaataac

SEQ ID NO: 472327 - DNA, 20 bp, Artificial Sequence
  chemically synthesized
ttatgagtcgtggctggctg

SEQ ID NO: 472328 - DNA, 20 bp, Artificial Sequence
  chemically synthesized
aacctggaatgtttggattt

SEQ ID NO: 472329 - DNA, 20 bp, Artificial Sequence
  chemically synthesized
tgtaaataaacctggaatgt

SEQ ID NO: 472330 - DNA, 20 bp, Artificial Sequence
  chemically synthesized
tagcttattgtaaataaacc

SEQ ID NO: 472331 - DNA, 20 bp, Artificial Sequence
  chemically synthesized
tatctataaaatgattttag

SEQ ID NO: 472332 - DNA, 20 bp, Artificial Sequence
  chemically synthesized
actaaaatcattttatagat

SEQ ID NO: 472333 - DNA, 20 bp, Artificial Sequence
  chemically synthesized
tattccctgggggatgtgaa

SEQ ID NO: 472334 - DNA, 20 bp, Artificial Sequence
  chemically synthesized
tattcccttcacatccccca

SEQ ID NO: 472335 - DNA, 20 bp, Artificial Sequence
  chemically synthesized
ggtctgtgacttattccctg

SEQ ID NO: 472336 - DNA, 20 bp, Artificial Sequence
  chemically synthesized
agaggaaactaaagagaata

SEQ ID NO: 472337 - DNA, 20 bp, Artificial Sequence
  chemically synthesized
acaacgaagaggaaactaaa

SEQ ID NO: 472338 - DNA, 20 bp, Artificial Sequence
  chemically synthesized
gtatgtgtacatatagatat

SEQ ID NO: 472339 - DNA, 20 bp, Artificial Sequence
  chemically synthesized
tgtacacaaattacttttaa

SEQ ID NO: 472340 - DNA, 20 bp, Artificial Sequence
  chemically synthesized
tcagcccctcctgctctatc

SEQ ID NO: 472341 - DNA, 20 bp, Artificial Sequence
  chemically synthesized
aaatcaaataatagaaaaga

SEQ ID NO: 472342 - DNA, 20 bp, Artificial Sequence
  chemically synthesized
aaaaaaatcaaataatagaa

SEQ ID NO: 472343 - DNA, 20 bp, Artificial Sequence
  chemically synthesized
cttgtatttacatattaaca

SEQ ID NO: 472344 - DNA, 20 bp, Artificial Sequence
  chemically synthesized
acacagggtgcctacatttt

SEQ ID NO: 472345 - DNA, 20 bp, Artificial Sequence
  chemically synthesized
tttttttttattcctagaga

SEQ ID NO: 472346 - DNA, 20 bp, Artificial Sequence
  chemically synthesized
cacagcaagactctgtctct

SEQ ID NO: 472347 - DNA, 20 bp, Artificial Sequence
  chemically synthesized
tcttgctgtgttgcccaagc

SEQ ID NO: 472348 - DNA, 20 bp, Artificial Sequence
  chemically synthesized
cacacaggatgctgaggcag

SEQ ID NO: 472349 - DNA, 20 bp, Artificial Sequence
  chemically synthesized
tgcttgtggtcccaggcaca

SEQ ID NO: 472350 - DNA, 20 bp, Artificial Sequence
  chemically synthesized
caagcacatgccaccatgcc

SEQ ID NO: 472351 - DNA, 20 bp, Artificial Sequence
  chemically synthesized
cagaaggaacacttaagccc

SEQ ID NO: 472352 - DNA, 20 bp, Artificial Sequence
  chemically synthesized
cgtgtaatcccagcactttg

SEQ ID NO: 472353 - DNA, 20 bp, Artificial Sequence
  chemically synthesized
gctttgaccccccaaagtgc

SEQ ID NO: 472354 - DNA, 20 bp, Artificial Sequence
  chemically synthesized
agattaagaaaaatctctgt

SEQ ID NO: 472355 - DNA, 20 bp, Artificial Sequence
  chemically synthesized
cccagattgcttttgtaatt

SEQ ID NO: 472356 - DNA, 20 bp, Artificial Sequence
  chemically synthesized
atgataaaaaataaagacta

SEQ ID NO: 472357 - DNA, 20 bp, Artificial Sequence
  chemically synthesized
aagaatatcactctgcaata

SEQ ID NO: 472358 - DNA, 20 bp, Artificial Sequence
  chemically synthesized
cagaatgatattcattattg

SEQ ID NO: 472359 - DNA, 20 bp, Artificial Sequence
  chemically synthesized
aatgaatatcattctgcaat

SEQ ID NO: 472360 - DNA, 20 bp, Artificial Sequence
  chemically synthesized
atgatactttattcttattg

SEQ ID NO: 472361 - DNA, 20 bp, Artificial Sequence
  chemically synthesized
cagaacatttcatcttattg

SEQ ID NO: 472362 - DNA, 20 bp, Artificial Sequence
  chemically synthesized
agccttgagctgggggaata

SEQ ID NO: 472363 - DNA, 20 bp, Artificial Sequence
  chemically synthesized
tctcccaagccttgagctgg

SEQ ID NO: 472364 - DNA, 20 bp, Artificial Sequence
  chemically synthesized
ataggcctctggcttaaggg

SEQ ID NO: 472365 - DNA, 20 bp, Artificial Sequence
  chemically synthesized
aaggatgagacgatctgttc

SEQ ID NO: 472366 - DNA, 20 bp, Artificial Sequence
  chemically synthesized
ctgttctggaatggggggcg

SEQ ID NO: 472367 - DNA, 20 bp, Artificial Sequence
  chemically synthesized
tttcagaaagacttacaatt

SEQ ID NO: 472368 - DNA, 20 bp, Artificial Sequence
  chemically synthesized
accatacttaataaatgtca

SEQ ID NO: 472369 - DNA, 20 bp, Artificial Sequence
  chemically synthesized
atcagggcttccctaagata

SEQ ID NO: 472370 - DNA, 20 bp, Artificial Sequence
  chemically synthesized
ggaagccctgatggaggtgg

SEQ ID NO: 472371 - DNA, 20 bp, Artificial Sequence
  chemically synthesized
accaatggagcagaaaagca

SEQ ID NO: 472372 - DNA, 20 bp, Artificial Sequence
  chemically synthesized
ctgtagccttgtagtatagt

SEQ ID NO: 472373 - DNA, 20 bp, Artificial Sequence
  chemically synthesized
agctagaggcatcacaccac

SEQ ID NO: 472374 - DNA, 20 bp, Artificial Sequence
  chemically synthesized
ctagctttgttctttttgct

SEQ ID NO: 472375 - DNA, 20 bp, Artificial Sequence
  chemically synthesized
ttagaattgtcttggctata

SEQ ID NO: 472376 - DNA, 20 bp, Artificial Sequence
  chemically synthesized
aaactgttttaaatttcatg

SEQ ID NO: 472377 - DNA, 20 bp, Artificial Sequence
  chemically synthesized
aactaccatgaccttcttca

SEQ ID NO: 472378 - DNA, 20 bp, Artificial Sequence
  chemically synthesized
gaaggtcatggtagtttgat

SEQ ID NO: 472379 - DNA, 20 bp, Artificial Sequence
  chemically synthesized
gtagtttgatgggaatagca

SEQ ID NO: 472380 - DNA, 20 bp, Artificial Sequence
  chemically synthesized
tgaggtctttcatggatagg

SEQ ID NO: 472381 - DNA, 20 bp, Artificial Sequence
  chemically synthesized
tattatttctgaggtctttc

SEQ ID NO: 472382 - DNA, 20 bp, Artificial Sequence
  chemically synthesized
acaaaaacaagcaatgggga

SEQ ID NO: 472383 - DNA, 20 bp, Artificial Sequence
  chemically synthesized
agttttcccagcaccgttta

SEQ ID NO: 472384 - DNA, 20 bp, Artificial Sequence
  chemically synthesized
ctgttttctgcatatggcta

SEQ ID NO: 472385 - DNA, 20 bp, Artificial Sequence
  chemically synthesized
ttttgtgtaagctgtaaggg

SEQ ID NO: 472386 - DNA, 20 bp, Artificial Sequence
  chemically synthesized
tacacaaaaattaactcaag

SEQ ID NO: 472387 - DNA, 20 bp, Artificial Sequence
  chemically synthesized
atttaagtctttaatccatc

SEQ ID NO: 472388 - DNA, 20 bp, Artificial Sequence
  chemically synthesized
cttctagggtttttaggatt

SEQ ID NO: 472389 - DNA, 20 bp, Artificial Sequence
  chemically synthesized
aggtttccttctagggtttt

SEQ ID NO: 472390 - DNA, 20 bp, Artificial Sequence
  chemically synthesized
gtattgcctaggtttccttc

SEQ ID NO: 472391 - DNA, 20 bp, Artificial Sequence
  chemically synthesized
caaaagacaaaattgagaaa

SEQ ID NO: 472392 - DNA, 20 bp, Artificial Sequence
  chemically synthesized
caaaagaaactatcatcaaa

SEQ ID NO: 472393 - DNA, 20 bp, Artificial Sequence
  chemically synthesized
caaagtgaataggcaaccta

SEQ ID NO: 472394 - DNA, 20 bp, Artificial Sequence
  chemically synthesized
ggatattagacctttgtcag

SEQ ID NO: 472395 - DNA, 20 bp, Artificial Sequence
  chemically synthesized
tctgacaaaggtctaatatc

SEQ ID NO: 472396 - DNA, 20 bp, Artificial Sequence
  chemically synthesized
gtttaagttccttgtaaatt

SEQ ID NO: 472397 - DNA, 20 bp, Artificial Sequence
  chemically synthesized
gggttgtttgtctttttctt

SEQ ID NO: 472398 - DNA, 20 bp, Artificial Sequence
  chemically synthesized
atcctttgcccactttttga

SEQ ID NO: 472399 - DNA, 20 bp, Artificial Sequence
  chemically synthesized
accctatcaaaaagtgggca

SEQ ID NO: 472400 - DNA, 20 bp, Artificial Sequence
  chemically synthesized
agataccatctcacaccagt

SEQ ID NO: 472401 - DNA, 20 bp, Artificial Sequence
  chemically synthesized
aacgcttttgaactgttgat

SEQ ID NO: 472402 - DNA, 20 bp, Artificial Sequence
  chemically synthesized
aaacagtatggcaattcctc

SEQ ID NO: 472403 - DNA, 20 bp, Artificial Sequence
  chemically synthesized
tttctggttctagatccttg

SEQ ID NO: 472404 - DNA, 20 bp, Artificial Sequence
  chemically synthesized
ttggcccagccatcccatta

SEQ ID NO: 472405 - DNA, 20 bp, Artificial Sequence
  chemically synthesized
tttgggtgtatacccagtaa

SEQ ID NO: 472406 - DNA, 20 bp, Artificial Sequence
  chemically synthesized
attactgggtatacacccaa

SEQ ID NO: 472407 - DNA, 20 bp, Artificial Sequence
  chemically synthesized
gtagaatgatttatattcct

SEQ ID NO: 472408 - DNA, 20 bp, Artificial Sequence
  chemically synthesized
atatgcatgtgtctttatag

SEQ ID NO: 472409 - DNA, 20 bp, Artificial Sequence
  chemically synthesized
agtctatcattgatgggcat

SEQ ID NO: 472410 - DNA, 20 bp, Artificial Sequence
  chemically synthesized
aaatgcccatcaatgataga

SEQ ID NO: 472411 - DNA, 20 bp, Artificial Sequence
  chemically synthesized
aatgtggtacatataaacca

SEQ ID NO: 472412 - DNA, 20 bp, Artificial Sequence
  chemically synthesized
aatactacgcagccataaaa

SEQ ID NO: 472413 - DNA, 20 bp, Artificial Sequence
  chemically synthesized
tgttcctgtgttagtttgct

SEQ ID NO: 472414 - DNA, 20 bp, Artificial Sequence
  chemically synthesized
gcatgttctcactcacaagt

SEQ ID NO: 472415 - DNA, 20 bp, Artificial Sequence
  chemically synthesized
ttaatgttcaactctcactt

SEQ ID NO: 472416 - DNA, 20 bp, Artificial Sequence
  chemically synthesized
caatgcacaccagggcctgt

SEQ ID NO: 472417 - DNA, 20 bp, Artificial Sequence
  chemically synthesized
accagggcctgttggggttt

SEQ ID NO: 472418 - DNA, 20 bp, Artificial Sequence
  chemically synthesized
gaagggagggaacttagacg

SEQ ID NO: 472419 - DNA, 20 bp, Artificial Sequence
  chemically synthesized
tcattttaattgatttagac

SEQ ID NO: 472420 - DNA, 20 bp, Artificial Sequence
  chemically synthesized
ctcagcctgcagggaggtag

SEQ ID NO: 472421 - DNA, 20 bp, Artificial Sequence
  chemically synthesized
ctttattgcccaaagcagca

SEQ ID NO: 472422 - DNA, 20 bp, Artificial Sequence
  chemically synthesized
gtccttccctgcactgttag

SEQ ID NO: 472423 - DNA, 20 bp, Artificial Sequence
  chemically synthesized
acagtgcagggaaggactac

SEQ ID NO: 472424 - DNA, 20 bp, Artificial Sequence
  chemically synthesized
aagatggcagcctcacagtg

SEQ ID NO: 472425 - DNA, 20 bp, Artificial Sequence
  chemically synthesized
cttgtacctcagaaatttat

SEQ ID NO: 472426 - DNA, 20 bp, Artificial Sequence
  chemically synthesized
tacaagtgcagttttgttac

SEQ ID NO: 472427 - DNA, 20 bp, Artificial Sequence
  chemically synthesized
caaggtgcactactttggtg

SEQ ID NO: 472428 - DNA, 20 bp, Artificial Sequence
  chemically synthesized
ggataatgagacattactta

SEQ ID NO: 472429 - DNA, 20 bp, Artificial Sequence
  chemically synthesized
ggcagaatgctgggtgaggg

SEQ ID NO: 472430 - DNA, 20 bp, Artificial Sequence
  chemically synthesized
gaagggcagaatgctgggtg

SEQ ID NO: 472431 - DNA, 20 bp, Artificial Sequence
  chemically synthesized
agattcagaagggcagaatg

SEQ ID NO: 472432 - DNA, 20 bp, Artificial Sequence
  chemically synthesized
tcacccagcattctgccctt

SEQ ID NO: 472433 - DNA, 20 bp, Artificial Sequence
  chemically synthesized
acattggagattcagaaggg

SEQ ID NO: 472434 - DNA, 20 bp, Artificial Sequence
  chemically synthesized
cttaaaatcatcatgataag

SEQ ID NO: 472435 - DNA, 20 bp, Artificial Sequence
  chemically synthesized
ttctaataaaggggaggggg

SEQ ID NO: 472436 - DNA, 20 bp, Artificial Sequence
  chemically synthesized
ttctcccccctcccctttat

SEQ ID NO: 472437 - DNA, 20 bp, Artificial Sequence
  chemically synthesized
ctcccctttattagaatgac

SEQ ID NO: 472438 - DNA, 20 bp, Artificial Sequence
  chemically synthesized
tggataagcctccaactttt

SEQ ID NO: 472439 - DNA, 20 bp, Artificial Sequence
  chemically synthesized
tttatttatttattttgaga

SEQ ID NO: 472440 - DNA, 20 bp, Artificial Sequence
  chemically synthesized
ctgcactccagcctgggtga

SEQ ID NO: 472441 - DNA, 20 bp, Artificial Sequence
  chemically synthesized
tctcactctgtcacccaggc

SEQ ID NO: 472442 - DNA, 20 bp, Artificial Sequence
  chemically synthesized
tcacaccactgcactccagc

SEQ ID NO: 472443 - DNA, 20 bp, Artificial Sequence
  chemically synthesized
acctccgcctccctggttca

SEQ ID NO: 472444 - DNA, 20 bp, Artificial Sequence
  chemically synthesized
tactcaggaggctggggcag

SEQ ID NO: 472445 - DNA, 20 bp, Artificial Sequence
  chemically synthesized
gattcccctgccccagcctc

SEQ ID NO: 472446 - DNA, 20 bp, Artificial Sequence
  chemically synthesized
ccaaagatacaaaacagtag

SEQ ID NO: 472447 - DNA, 20 bp, Artificial Sequence
  chemically synthesized
ttttgtatctttggtagaga

SEQ ID NO: 472448 - DNA, 20 bp, Artificial Sequence
  chemically synthesized
actttggcaggccaaggtgg

SEQ ID NO: 472449 - DNA, 20 bp, Artificial Sequence
  chemically synthesized
cagcactttggcaggccaag

SEQ ID NO: 472450 - DNA, 20 bp, Artificial Sequence
  chemically synthesized
accttggcctgccaaagtgc

SEQ ID NO: 472451 - DNA, 20 bp, Artificial Sequence
  chemically synthesized
gatagccgtttttttcttta

SEQ ID NO: 472452 - DNA, 20 bp, Artificial Sequence
  chemically synthesized
tttctttattggataataag

SEQ ID NO: 472453 - DNA, 20 bp, Artificial Sequence
  chemically synthesized
gataataagtggagtgttac

SEQ ID NO: 472454 - DNA, 20 bp, Artificial Sequence
  chemically synthesized
ttggtcactatttcttgttc

SEQ ID NO: 472455 - DNA, 20 bp, Artificial Sequence
  chemically synthesized
tgcttctttgttgctttaga

SEQ ID NO: 472456 - DNA, 20 bp, Artificial Sequence
  chemically synthesized
caatggctttggggaccaag

SEQ ID NO: 472457 - DNA, 20 bp, Artificial Sequence
  chemically synthesized
ctttggggaccaagatggat

SEQ ID NO: 472458 - DNA, 20 bp, Artificial Sequence
  chemically synthesized
aaaaacagaaaaaagcagtt

SEQ ID NO: 472459 - DNA, 20 bp, Artificial Sequence
  chemically synthesized
cttttcagtttcatcccccc

SEQ ID NO: 472460 - DNA, 20 bp, Artificial Sequence
  chemically synthesized
gtgataccattaactcctgg

SEQ ID NO: 472461 - DNA, 20 bp, Artificial Sequence
  chemically synthesized
acagaaaacgtgatcatttg

SEQ ID NO: 472462 - DNA, 20 bp, Artificial Sequence
  chemically synthesized
acctgctcttagaagctttc

SEQ ID NO: 472463 - DNA, 20 bp, Artificial Sequence
  chemically synthesized
aagatagaaaaacagtatct

SEQ ID NO: 472464 - DNA, 20 bp, Artificial Sequence
  chemically synthesized
cttttttaaagaaatagact

SEQ ID NO: 472465 - DNA, 20 bp, Artificial Sequence
  chemically synthesized
cacagtctatttctttaaaa

SEQ ID NO: 472466 - DNA, 20 bp, Artificial Sequence
  chemically synthesized
gagagagagagagagagaga

SEQ ID NO: 472467 - DNA, 20 bp, Artificial Sequence
  chemically synthesized
gggggagtagggggtaggga

SEQ ID NO: 472468 - DNA, 20 bp, Artificial Sequence
  chemically synthesized
ggggatagggtgggggagta

SEQ ID NO: 472469 - DNA, 20 bp, Artificial Sequence
  chemically synthesized
ccttccaggggatagggtgg

SEQ ID NO: 472470 - DNA, 20 bp, Artificial Sequence
  chemically synthesized
ccctccttccttccagggga

SEQ ID NO: 472471 - DNA, 20 bp, Artificial Sequence
  chemically synthesized
tcttcccctccttccttcca

SEQ ID NO: 472472 - DNA, 20 bp, Artificial Sequence
  chemically synthesized
tggaaggaaggaggggaaga

SEQ ID NO: 472473 - DNA, 20 bp, Artificial Sequence
  chemically synthesized
ggaaggaggggaagactgaa

SEQ ID NO: 472474 - DNA, 20 bp, Artificial Sequence
  chemically synthesized
ggggaagactgaatgggatt

SEQ ID NO: 472475 - DNA, 20 bp, Artificial Sequence
  chemically synthesized
tgaactgcctctctcttctt

SEQ ID NO: 472476 - DNA, 20 bp, Artificial Sequence
  chemically synthesized
caaagaagagagaggcagtt

SEQ ID NO: 472477 - DNA, 20 bp, Artificial Sequence
  chemically synthesized
gctgacctttgtgaagggaa

SEQ ID NO: 472478 - DNA, 20 bp, Artificial Sequence
  chemically synthesized
gatgctgcttcccaggggaa

SEQ ID NO: 472479 - DNA, 20 bp, Artificial Sequence
  chemically synthesized
gagaagcctaggagaggccc

SEQ ID NO: 472480 - DNA, 20 bp, Artificial Sequence
  chemically synthesized
ggagaggcccgggaatgttt

SEQ ID NO: 472481 - DNA, 20 bp, Artificial Sequence
  chemically synthesized
ccacgtaatttggggtatgt

SEQ ID NO: 472482 - DNA, 20 bp, Artificial Sequence
  chemically synthesized
cttagcgttcccacgtaatt

SEQ ID NO: 472483 - DNA, 20 bp, Artificial Sequence
  chemically synthesized
ccaaattacgtgggaacgct

SEQ ID NO: 472484 - DNA, 20 bp, Artificial Sequence
  chemically synthesized
aactttgattagggacatat

SEQ ID NO: 472485 - DNA, 20 bp, Artificial Sequence
  chemically synthesized
cccagtgtgagctgcatttt

SEQ ID NO: 472486 - DNA, 20 bp, Artificial Sequence
  chemically synthesized
cacactggggctatatctct

SEQ ID NO: 472487 - DNA, 20 bp, Artificial Sequence
  chemically synthesized
ttattgacctctattagata

SEQ ID NO: 472488 - DNA, 20 bp, Artificial Sequence
  chemically synthesized
tttccttttctcctctgaaa

SEQ ID NO: 472489 - DNA, 20 bp, Artificial Sequence
  chemically synthesized
attctactttatgacacata

SEQ ID NO: 472490 - DNA, 20 bp, Artificial Sequence
  chemically synthesized
attccttatgtgtcataaag

SEQ ID NO: 472491 - DNA, 20 bp, Artificial Sequence
  chemically synthesized
cttatgtgtcataaagtaga

SEQ ID NO: 472492 - DNA, 20 bp, Artificial Sequence
  chemically synthesized
aagcaaatggctcaaacgaa

SEQ ID NO: 472493 - DNA, 20 bp, Artificial Sequence
  chemically synthesized
atggctcaaacgaacagagt

SEQ ID NO: 472494 - DNA, 20 bp, Artificial Sequence
  chemically synthesized
aataatttactcctcttctt

SEQ ID NO: 472495 - DNA, 20 bp, Artificial Sequence
  chemically synthesized
gttggtttatccaaaagaag

SEQ ID NO: 472496 - DNA, 20 bp, Artificial Sequence
  chemically synthesized
cttcttttggataaaccaac

SEQ ID NO: 472497 - DNA, 20 bp, Artificial Sequence
  chemically synthesized
cgtggcacttttggaaatgt

SEQ ID NO: 472498 - DNA, 20 bp, Artificial Sequence
  chemically synthesized
ctcacatttccaaaagtgcc

SEQ ID NO: 472499 - DNA, 20 bp, Artificial Sequence
  chemically synthesized
aaagtgccacgaatgaggca

SEQ ID NO: 472500 - DNA, 20 bp, Artificial Sequence
  chemically synthesized
ataccatgtgtattataata

SEQ ID NO: 472501 - DNA, 20 bp, Artificial Sequence
  chemically synthesized
tccacatgacatatgccata

SEQ ID NO: 472502 - DNA, 20 bp, Artificial Sequence
  chemically synthesized
tagtagccactgagtcttaa

SEQ ID NO: 472503 - DNA, 20 bp, Artificial Sequence
  chemically synthesized
gggccaggatatagtagcca

SEQ ID NO: 472504 - DNA, 20 bp, Artificial Sequence
  chemically synthesized
acaggacctactttttgggc

SEQ ID NO: 472505 - DNA, 20 bp, Artificial Sequence
  chemically synthesized
agaaaaccagaagaagcctc

SEQ ID NO: 472506 - DNA, 20 bp, Artificial Sequence
  chemically synthesized
tagctttgtttcagtagaac

SEQ ID NO: 472507 - DNA, 20 bp, Artificial Sequence
  chemically synthesized
actgaaacaaagctagagct

SEQ ID NO: 472508 - DNA, 20 bp, Artificial Sequence
  chemically synthesized
cttaatctaacaatatgata

SEQ ID NO: 472509 - DNA, 20 bp, Artificial Sequence
  chemically synthesized
attgttagattaagatagaa

SEQ ID NO: 472510 - DNA, 20 bp, Artificial Sequence
  chemically synthesized
tgaatggtacataccaaaac

SEQ ID NO: 472511 - DNA, 20 bp, Artificial Sequence
  chemically synthesized
acagtccttggcatggatgt

SEQ ID NO: 472512 - DNA, 20 bp, Artificial Sequence
  chemically synthesized
cttaagggacagtccttggc

SEQ ID NO: 472513 - DNA, 20 bp, Artificial Sequence
  chemically synthesized
gaagcatgccgagtgtttga

SEQ ID NO: 472514 - DNA, 20 bp, Artificial Sequence
  chemically synthesized
ctttagtgttaggaagcatg

SEQ ID NO: 472515 - DNA, 20 bp, Artificial Sequence
  chemically synthesized
atgtctagagggcatgagag

SEQ ID NO: 472516 - DNA, 20 bp, Artificial Sequence
  chemically synthesized
agagggcatgagagatggat

SEQ ID NO: 472517 - DNA, 20 bp, Artificial Sequence
  chemically synthesized
aagattgttttgaaggtgaa

SEQ ID NO: 472518 - DNA, 20 bp, Artificial Sequence
  chemically synthesized
tcagcaaactgaaaagcaca

SEQ ID NO: 472519 - DNA, 20 bp, Artificial Sequence
  chemically synthesized
agaattactgacatatgttc

SEQ ID NO: 472520 - DNA, 20 bp, Artificial Sequence
  chemically synthesized
ggtacttggtaaatattgga

SEQ ID NO: 472521 - DNA, 20 bp, Artificial Sequence
  chemically synthesized
aacaggtacttggtaaatat

SEQ ID NO: 472522 - DNA, 20 bp, Artificial Sequence
  chemically synthesized
gataacaacagctatcctcc

SEQ ID NO: 472523 - DNA, 20 bp, Artificial Sequence
  chemically synthesized
actgaaataacagactccag

SEQ ID NO: 472524 - DNA, 20 bp, Artificial Sequence
  chemically synthesized
cagcttatgaaactacaaaa

SEQ ID NO: 472525 - DNA, 20 bp, Artificial Sequence
  chemically synthesized
gaaactacaaaaaaggatgt

SEQ ID NO: 472526 - DNA, 20 bp, Artificial Sequence
  chemically synthesized
ccatagtgttgtgcagagtg

SEQ ID NO: 472527 - DNA, 20 bp, Artificial Sequence
  chemically synthesized
aggggtgccatagtgttgtg

SEQ ID NO: 472528 - DNA, 20 bp, Artificial Sequence
  chemically synthesized
attaactgaaagagagtgaa

SEQ ID NO: 472529 - DNA, 20 bp, Artificial Sequence
  chemically synthesized
ggttaagatattaactgaaa

SEQ ID NO: 472530 - DNA, 20 bp, Artificial Sequence
  chemically synthesized
ctttcagttaatatcttaac

SEQ ID NO: 472531 - DNA, 20 bp, Artificial Sequence
  chemically synthesized
aagctctggaaccacaatga

SEQ ID NO: 472532 - DNA, 20 bp, Artificial Sequence
  chemically synthesized
ggtttcaaaggtcacgttac

SEQ ID NO: 472533 - DNA, 20 bp, Artificial Sequence
  chemically synthesized
acagcagagaagattgacct

SEQ ID NO: 472534 - DNA, 20 bp, Artificial Sequence
  chemically synthesized
atttcaaaaatttaattacc

SEQ ID NO: 472535 - DNA, 20 bp, Artificial Sequence
  chemically synthesized
gaggatgctggtgaatgatt

SEQ ID NO: 472536 - DNA, 20 bp, Artificial Sequence
  chemically synthesized
gtcagtctttgaggatgctg

SEQ ID NO: 472537 - DNA, 20 bp, Artificial Sequence
  chemically synthesized
aatttgatctgtcagtcttt

SEQ ID NO: 472538 - DNA, 20 bp, Artificial Sequence
  chemically synthesized
gataagaagtggatgcaaca

SEQ ID NO: 472539 - DNA, 20 bp, Artificial Sequence
  chemically synthesized
agcactattgatgataagaa

SEQ ID NO: 472540 - DNA, 20 bp, Artificial Sequence
  chemically synthesized
tattgcaccatcaatcttat

SEQ ID NO: 472541 - DNA, 20 bp, Artificial Sequence
  chemically synthesized
gataagattgatggtgcaat

SEQ ID NO: 472542 - DNA, 20 bp, Artificial Sequence
  chemically synthesized
tgaatcttcatattgccctt

SEQ ID NO: 472543 - DNA, 20 bp, Artificial Sequence
  chemically synthesized
cattttccagagaagtgaaa

SEQ ID NO: 472544 - DNA, 20 bp, Artificial Sequence
  chemically synthesized
tactaacattttctgatttt

SEQ ID NO: 472545 - DNA, 20 bp, Artificial Sequence
  chemically synthesized
ccctctgtcatttaaggaag

SEQ ID NO: 472546 - DNA, 20 bp, Artificial Sequence
  chemically synthesized
ggtgacagtaaagctggaac

SEQ ID NO: 472547 - DNA, 20 bp, Artificial Sequence
  chemically synthesized
taggctaggcatcgcaagac

SEQ ID NO: 472548 - DNA, 20 bp, Artificial Sequence
  chemically synthesized
tgaagaaaaatatacataag

SEQ ID NO: 472549 - DNA, 20 bp, Artificial Sequence
  chemically synthesized
acattgggtttgaaaatcag

SEQ ID NO: 472550 - DNA, 20 bp, Artificial Sequence
  chemically synthesized
atgatacaagtcttctgaca

SEQ ID NO: 472551 - DNA, 20 bp, Artificial Sequence
  chemically synthesized
aagacttgtatcattcttag

SEQ ID NO: 472552 - DNA, 20 bp, Artificial Sequence
  chemically synthesized
tccagacacctcactcttct

SEQ ID NO: 472553 - DNA, 20 bp, Artificial Sequence
  chemically synthesized
tcttagaagagtgaggtgtc

SEQ ID NO: 472554 - DNA, 20 bp, Artificial Sequence
  chemically synthesized
ttttttttttttttttgagg

SEQ ID NO: 472555 - DNA, 20 bp, Artificial Sequence
  chemically synthesized
tcttgctctgtcacccaggc

SEQ ID NO: 472556 - DNA, 20 bp, Artificial Sequence
  chemically synthesized
tcgcgccactgcactccagc

SEQ ID NO: 472557 - DNA, 20 bp, Artificial Sequence
  chemically synthesized
tccactgcatgctccgcttc

SEQ ID NO: 472558 - DNA, 20 bp, Artificial Sequence
  chemically synthesized
tacttgggaggctgaggcag

SEQ ID NO: 472559 - DNA, 20 bp, Artificial Sequence
  chemically synthesized
ttttgtatttttagtagaga

SEQ ID NO: 472560 - DNA, 20 bp, Artificial Sequence
  chemically synthesized
cggggtttcaccatgttagc

SEQ ID NO: 472561 - DNA, 20 bp, Artificial Sequence
  chemically synthesized
gcctcagcctcccaaagtgc

SEQ ID NO: 472562 - DNA, 20 bp, Artificial Sequence
  chemically synthesized
atagaaaacatttcctcagg

SEQ ID NO: 472563 - DNA, 20 bp, Artificial Sequence
  chemically synthesized
ggctcttattataaagaaac

SEQ ID NO: 472564 - DNA, 20 bp, Artificial Sequence
  chemically synthesized
tactgcaaaccagccaacac

SEQ ID NO: 472565 - DNA, 20 bp, Artificial Sequence
  chemically synthesized
agaaatcaaccaaccaaaac

SEQ ID NO: 472566 - DNA, 20 bp, Artificial Sequence
  chemically synthesized
gtaccaacaggggctagaac

SEQ ID NO: 472567 - DNA, 20 bp, Artificial Sequence
  chemically synthesized
ctttaagcatgggacatatt

SEQ ID NO: 472568 - DNA, 20 bp, Artificial Sequence
  chemically synthesized
ctactttcatggcaattttt

SEQ ID NO: 472569 - DNA, 20 bp, Artificial Sequence
  chemically synthesized
tgtcaagattcagatgctac

SEQ ID NO: 472570 - DNA, 20 bp, Artificial Sequence
  chemically synthesized
tcccctaactccagtagcat

SEQ ID NO: 472571 - DNA, 20 bp, Artificial Sequence
  chemically synthesized
taaaaaccagaccaagatcc

SEQ ID NO: 472572 - DNA, 20 bp, Artificial Sequence
  chemically synthesized
ctacattctggtttgaactc

SEQ ID NO: 472573 - DNA, 20 bp, Artificial Sequence
  chemically synthesized
caagatccgtgagttcaaac

SEQ ID NO: 472574 - DNA, 20 bp, Artificial Sequence
  chemically synthesized
caaaccagaatgtagaccaa

SEQ ID NO: 472575 - DNA, 20 bp, Artificial Sequence
  chemically synthesized
gatggccacagttccaggca

SEQ ID NO: 472576 - DNA, 20 bp, Artificial Sequence
  chemically synthesized
attcctatagctctatttgt

SEQ ID NO: 472577 - DNA, 20 bp, Artificial Sequence
  chemically synthesized
actcgtacaaatagagctat

SEQ ID NO: 472578 - DNA, 20 bp, Artificial Sequence
  chemically synthesized
gtgctgacaaaattgctgat

SEQ ID NO: 472579 - DNA, 20 bp, Artificial Sequence
  chemically synthesized
aaatgcgatataaaacctta

SEQ ID NO: 472580 - DNA, 20 bp, Artificial Sequence
  chemically synthesized
tccacaaccatttattgcat

SEQ ID NO: 472581 - DNA, 20 bp, Artificial Sequence
  chemically synthesized
gtggaaacatgcctgagatt

SEQ ID NO: 472582 - DNA, 20 bp, Artificial Sequence
  chemically synthesized
ctgagattgagagtgaagag

SEQ ID NO: 472583 - DNA, 20 bp, Artificial Sequence
  chemically synthesized
atcttttcctgctggtaatt

SEQ ID NO: 472584 - DNA, 20 bp, Artificial Sequence
  chemically synthesized
agataaacactcctttggac

SEQ ID NO: 472585 - DNA, 20 bp, Artificial Sequence
  chemically synthesized
aagaagcaactcatgtccaa

SEQ ID NO: 472586 - DNA, 20 bp, Artificial Sequence
  chemically synthesized
cttcacagaagagtgaaaga

SEQ ID NO: 472587 - DNA, 20 bp, Artificial Sequence
  chemically synthesized
atctctgaagcccttcacag

SEQ ID NO: 472588 - DNA, 20 bp, Artificial Sequence
  chemically synthesized
atgaaatgcattactgctga

SEQ ID NO: 472589 - DNA, 20 bp, Artificial Sequence
  chemically synthesized
tggagtcagcaggtttactc

SEQ ID NO: 472590 - DNA, 20 bp, Artificial Sequence
  chemically synthesized
agaattcactaatgaaactc

SEQ ID NO: 472591 - DNA, 20 bp, Artificial Sequence
  chemically synthesized
tttactcctgagtttcatta

SEQ ID NO: 472592 - DNA, 20 bp, Artificial Sequence
  chemically synthesized
tgtggttgctaaatattggg

SEQ ID NO: 472593 - DNA, 20 bp, Artificial Sequence
  chemically synthesized
tctgccagctgtcccttagg

SEQ ID NO: 472594 - DNA, 20 bp, Artificial Sequence
  chemically synthesized
aaataacatttactttcttc

SEQ ID NO: 472595 - DNA, 20 bp, Artificial Sequence
  chemically synthesized
aacatttactttcttcatga

SEQ ID NO: 472596 - DNA, 20 bp, Artificial Sequence
  chemically synthesized
cttctttgggatgtcgtgac

SEQ ID NO: 472597 - DNA, 20 bp, Artificial Sequence
  chemically synthesized
cagctctgttatatcttctt

SEQ ID NO: 472598 - DNA, 20 bp, Artificial Sequence
  chemically synthesized
attatcttagttgtttttcc

SEQ ID NO: 472599 - DNA, 20 bp, Artificial Sequence
  chemically synthesized
ggacagactaaaagactaaa

SEQ ID NO: 472600 - DNA, 20 bp, Artificial Sequence
  chemically synthesized
actaaaagactaaaaaggat

SEQ ID NO: 472601 - DNA, 20 bp, Artificial Sequence
  chemically synthesized
aaaatgaaaagcattagtag

SEQ ID NO: 472602 - DNA, 20 bp, Artificial Sequence
  chemically synthesized
atgtgaggctaaagtcgact

SEQ ID NO: 472603 - DNA, 20 bp, Artificial Sequence
  chemically synthesized
taaaaacatttatatttatc

SEQ ID NO: 472604 - DNA, 20 bp, Artificial Sequence
  chemically synthesized
gataaatataaatgttttta

SEQ ID NO: 472605 - DNA, 20 bp, Artificial Sequence
  chemically synthesized
aatgtttttactgaatttca

SEQ ID NO: 472606 - DNA, 20 bp, Artificial Sequence
  chemically synthesized
atctgcatcctttaacctca

SEQ ID NO: 472607 - DNA, 20 bp, Artificial Sequence
  chemically synthesized
aaggccattccttgaggtta

SEQ ID NO: 472608 - DNA, 20 bp, Artificial Sequence
  chemically synthesized
tataggcattttaatttctc

SEQ ID NO: 472609 - DNA, 20 bp, Artificial Sequence
  chemically synthesized
attaagacaaagctgaagtg

SEQ ID NO: 472610 - DNA, 20 bp, Artificial Sequence
  chemically synthesized
ataggaaaagtttgacacca

SEQ ID NO: 472611 - DNA, 20 bp, Artificial Sequence
  chemically synthesized
gcattgtaaatcaactggca

SEQ ID NO: 472612 - DNA, 20 bp, Artificial Sequence
  chemically synthesized
aagaagtggtcatgatgtat

SEQ ID NO: 472613 - DNA, 20 bp, Artificial Sequence
  chemically synthesized
gtacattttaccttaaaaat

SEQ ID NO: 472614 - DNA, 20 bp, Artificial Sequence
  chemically synthesized
attggtatcttcatctggga

SEQ ID NO: 472615 - DNA, 20 bp, Artificial Sequence
  chemically synthesized
aaagcataagaaatatcaca

SEQ ID NO: 472616 - DNA, 20 bp, Artificial Sequence
  chemically synthesized
aggaatcccaaacatgcatg

SEQ ID NO: 472617 - DNA, 20 bp, Artificial Sequence
  chemically synthesized
gaacatcctgcatgcatgtt

SEQ ID NO: 472618 - DNA, 20 bp, Artificial Sequence
  chemically synthesized
ctggactgtcaaaagaattt

SEQ ID NO: 472619 - DNA, 20 bp, Artificial Sequence
  chemically synthesized
tctgtattctggactgtcaa

SEQ ID NO: 472620 - DNA, 20 bp, Artificial Sequence
  chemically synthesized
cctaaattcttttgacagtc

SEQ ID NO: 472621 - DNA, 20 bp, Artificial Sequence
  chemically synthesized
gggactctcttgctttctta

SEQ ID NO: 472622 - DNA, 20 bp, Artificial Sequence
  chemically synthesized
ctaactcattaagaaagcaa

SEQ ID NO: 472623 - DNA, 20 bp, Artificial Sequence
  chemically synthesized
tttatgttgcatgctcccat

SEQ ID NO: 472624 - DNA, 20 bp, Artificial Sequence
  chemically synthesized
aaaggtgaaagaaatcctaa

SEQ ID NO: 472625 - DNA, 20 bp, Artificial Sequence
  chemically synthesized
aaccagctgctgcattctgt

SEQ ID NO: 472626 - DNA, 20 bp, Artificial Sequence
  chemically synthesized
gctattatattgaaattttc

SEQ ID NO: 472627 - DNA, 20 bp, Artificial Sequence
  chemically synthesized
caaaaaactacaaaatggca

SEQ ID NO: 472628 - DNA, 20 bp, Artificial Sequence
  chemically synthesized
aacctgaaagagatgctggc

SEQ ID NO: 472629 - DNA, 20 bp, Artificial Sequence
  chemically synthesized
taagggagccccaagggaga

SEQ ID NO: 472630 - DNA, 20 bp, Artificial Sequence
  chemically synthesized
ctcatatgaaaagctgatgt

SEQ ID NO: 472631 - DNA, 20 bp, Artificial Sequence
  chemically synthesized
tgttaatgacttaaaatctc

SEQ ID NO: 472632 - DNA, 20 bp, Artificial Sequence
  chemically synthesized
aatgacttaaaatctcaaga

SEQ ID NO: 472633 - DNA, 20 bp, Artificial Sequence
  chemically synthesized
ggcacagttcctgttggttg

SEQ ID NO: 472634 - DNA, 20 bp, Artificial Sequence
  chemically synthesized
tcttttcaatgctgggataa

SEQ ID NO: 472635 - DNA, 20 bp, Artificial Sequence
  chemically synthesized
taactttttcttttcaatgc

SEQ ID NO: 472636 - DNA, 20 bp, Artificial Sequence
  chemically synthesized
gtttgtcttgacttccagtc

SEQ ID NO: 472637 - DNA, 20 bp, Artificial Sequence
  chemically synthesized
gatggtataatttctcaaat

SEQ ID NO: 472638 - DNA, 20 bp, Artificial Sequence
  chemically synthesized
attataatctctttgaaatt

SEQ ID NO: 472639 - DNA, 20 bp, Artificial Sequence
  chemically synthesized
aaagagattataattgtaga

SEQ ID NO: 472640 - DNA, 20 bp, Artificial Sequence
  chemically synthesized
gcaggaaaatttgccaaaag

SEQ ID NO: 472641 - DNA, 20 bp, Artificial Sequence
  chemically synthesized
tcaaatcttggtatataatt

SEQ ID NO: 472642 - DNA, 20 bp, Artificial Sequence
  chemically synthesized
aaagaggtgtgtggtgaaat

SEQ ID NO: 472643 - DNA, 20 bp, Artificial Sequence
  chemically synthesized
aggtgtgtggtgaaattgga

SEQ ID NO: 472644 - DNA, 20 bp, Artificial Sequence
  chemically synthesized
aaattcttactttaaaaaac

SEQ ID NO: 472645 - DNA, 20 bp, Artificial Sequence
  chemically synthesized
aaattcctgttttttaaagt

SEQ ID NO: 472646 - DNA, 20 bp, Artificial Sequence
  chemically synthesized
acattatgttcattaaaata

SEQ ID NO: 472647 - DNA, 20 bp, Artificial Sequence
  chemically synthesized
tttaagtttggacaggacaa

SEQ ID NO: 472648 - DNA, 20 bp, Artificial Sequence
  chemically synthesized
agtttggacaggacaactga

SEQ ID NO: 472649 - DNA, 20 bp, Artificial Sequence
  chemically synthesized
cattacgtcttagagctaaa

SEQ ID NO: 472650 - DNA, 20 bp, Artificial Sequence
  chemically synthesized
ggtttctaatttataaaata

SEQ ID NO: 472651 - DNA, 20 bp, Artificial Sequence
  chemically synthesized
gcctcggcctcccaaagtgc

SEQ ID NO: 472652 - DNA, 20 bp, Artificial Sequence
  chemically synthesized
cagcactttgggaggccgag

SEQ ID NO: 472653 - DNA, 20 bp, Artificial Sequence
  chemically synthesized
actttgggaggccgaggcgg

SEQ ID NO: 472654 - DNA, 20 bp, Artificial Sequence
  chemically synthesized
cgggtggatcacctgaggtc

SEQ ID NO: 472655 - DNA, 20 bp, Artificial Sequence
  chemically synthesized
caattctttcgtcttagctc

SEQ ID NO: 472656 - DNA, 20 bp, Artificial Sequence
  chemically synthesized
ctactcgggagctaagacga

SEQ ID NO: 472657 - DNA, 20 bp, Artificial Sequence
  chemically synthesized
attgcttgaacccgggaggc

SEQ ID NO: 472658 - DNA, 20 bp, Artificial Sequence
  chemically synthesized
ctcactgcaacccctgcctc

SEQ ID NO: 472659 - DNA, 20 bp, Artificial Sequence
  chemically synthesized
tttcactctgttgcccaggc

SEQ ID NO: 472660 - DNA, 20 bp, Artificial Sequence
  chemically synthesized
ctgcactccagcctgggcaa

SEQ ID NO: 472661 - DNA, 20 bp, Artificial Sequence
  chemically synthesized
ttttttttttttttttgaga

SEQ ID NO: 472662 - DNA, 20 bp, Artificial Sequence
  chemically synthesized
attgataagggcacagatct

SEQ ID NO: 472663 - DNA, 20 bp, Artificial Sequence
  chemically synthesized
atgaaggagcattggacaaa

SEQ ID NO: 472664 - DNA, 20 bp, Artificial Sequence
  chemically synthesized
agtctcttgctgtttctcag

SEQ ID NO: 472665 - DNA, 20 bp, Artificial Sequence
  chemically synthesized
caagagactaatacacagaa

SEQ ID NO: 472666 - DNA, 20 bp, Artificial Sequence
  chemically synthesized
gaagggaattacagcttttc

SEQ ID NO: 472667 - DNA, 20 bp, Artificial Sequence
  chemically synthesized
tctctttattattttttgga

SEQ ID NO: 472668 - DNA, 20 bp, Artificial Sequence
  chemically synthesized
atcccagtacattgctgtga

SEQ ID NO: 472669 - DNA, 20 bp, Artificial Sequence
  chemically synthesized
attccctcacagcaatgtac

SEQ ID NO: 472670 - DNA, 20 bp, Artificial Sequence
  chemically synthesized
gaagtaacatcagggagaag

SEQ ID NO: 472671 - DNA, 20 bp, Artificial Sequence
  chemically synthesized
agaggtctcacatggattgc

SEQ ID NO: 472672 - DNA, 20 bp, Artificial Sequence
  chemically synthesized
gggctcactagaggtctcac

SEQ ID NO: 472673 - DNA, 20 bp, Artificial Sequence
  chemically synthesized
cccaaacaagtagtcatttg

SEQ ID NO: 472674 - DNA, 20 bp, Artificial Sequence
  chemically synthesized
aataatagcttaaaggtgtc

SEQ ID NO: 472675 - DNA, 20 bp, Artificial Sequence
  chemically synthesized
atgaggttttaggatcactg

SEQ ID NO: 472676 - DNA, 20 bp, Artificial Sequence
  chemically synthesized
tcctttcatagatgaggttt

SEQ ID NO: 472677 - DNA, 20 bp, Artificial Sequence
  chemically synthesized
ctcatctatgaaaggagaaa

SEQ ID NO: 472678 - DNA, 20 bp, Artificial Sequence
  chemically synthesized
gtctttatttcagctcataa

SEQ ID NO: 472679 - DNA, 20 bp, Artificial Sequence
  chemically synthesized
tatttcagctcataaaggaa

SEQ ID NO: 472680 - DNA, 20 bp, Artificial Sequence
  chemically synthesized
tggataaaagtgagagcttt

SEQ ID NO: 472681 - DNA, 20 bp, Artificial Sequence
  chemically synthesized
tgatgtaggaaatcactgtc

SEQ ID NO: 472682 - DNA, 20 bp, Artificial Sequence
  chemically synthesized
attgttccataaaatataca

SEQ ID NO: 472683 - DNA, 20 bp, Artificial Sequence
  chemically synthesized
ggtatttaaaatgtacagtt

SEQ ID NO: 472684 - DNA, 20 bp, Artificial Sequence
  chemically synthesized
tgtacagttttgagtgacta

SEQ ID NO: 472685 - DNA, 20 bp, Artificial Sequence
  chemically synthesized
ctttttagttttcatatttt

SEQ ID NO: 472686 - DNA, 20 bp, Artificial Sequence
  chemically synthesized
aaaatatgaaaactaaaaag

SEQ ID NO: 472687 - DNA, 20 bp, Artificial Sequence
  chemically synthesized
cagaatcaaacatactaaaa

SEQ ID NO: 472688 - DNA, 20 bp, Artificial Sequence
  chemically synthesized
aaagtatgtatttctcctga

SEQ ID NO: 472689 - DNA, 20 bp, Artificial Sequence
  chemically synthesized
ctaccttcactcccattttt

SEQ ID NO: 472690 - DNA, 20 bp, Artificial Sequence
  chemically synthesized
ttttgttaactcagaaaaat

SEQ ID NO: 472691 - DNA, 20 bp, Artificial Sequence
  chemically synthesized
ctgctgttattgctttagaa

SEQ ID NO: 472692 - DNA, 20 bp, Artificial Sequence
  chemically synthesized
tgctttagaaccgaattaag

SEQ ID NO: 472693 - DNA, 20 bp, Artificial Sequence
  chemically synthesized
gaagaattgatggacagtga

SEQ ID NO: 472694 - DNA, 20 bp, Artificial Sequence
  chemically synthesized
tttccgcctgccatctttta

SEQ ID NO: 472695 - DNA, 20 bp, Artificial Sequence
  chemically synthesized
tctttgaacttgcttctgcc

SEQ ID NO: 472696 - DNA, 20 bp, Artificial Sequence
  chemically synthesized
tcaacaacaattacaattta

SEQ ID NO: 472697 - DNA, 20 bp, Artificial Sequence
  chemically synthesized
agtctaacttaaatttaact

SEQ ID NO: 472698 - DNA, 20 bp, Artificial Sequence
  chemically synthesized
aagttagactctagtgcaca

SEQ ID NO: 472699 - DNA, 20 bp, Artificial Sequence
  chemically synthesized
gtctctcatccattgtgcac

SEQ ID NO: 472700 - DNA, 20 bp, Artificial Sequence
  chemically synthesized
aagagagaggagagaggata

SEQ ID NO: 472701 - DNA, 20 bp, Artificial Sequence
  chemically synthesized
aacgtggaagagagaggaga

SEQ ID NO: 472702 - DNA, 20 bp, Artificial Sequence
  chemically synthesized
gaaatataaatgacaataca

SEQ ID NO: 472703 - DNA, 20 bp, Artificial Sequence
  chemically synthesized
tttgtgccagtcaaaagaat

SEQ ID NO: 472704 - DNA, 20 bp, Artificial Sequence
  chemically synthesized
gaaacatttgtgccagtcaa

SEQ ID NO: 472705 - DNA, 20 bp, Artificial Sequence
  chemically synthesized
ctgttgttaggtgacaaata

SEQ ID NO: 472706 - DNA, 20 bp, Artificial Sequence
  chemically synthesized
aatactgagtgttatgtatc

SEQ ID NO: 472707 - DNA, 20 bp, Artificial Sequence
  chemically synthesized
agaatgaacaactaagccct

SEQ ID NO: 472708 - DNA, 20 bp, Artificial Sequence
  chemically synthesized
tacacaactgttttgggtga

SEQ ID NO: 472709 - DNA, 20 bp, Artificial Sequence
  chemically synthesized
tatgtacacaactgttttgg

SEQ ID NO: 472710 - DNA, 20 bp, Artificial Sequence
  chemically synthesized
gttatatgtacacaactgtt

SEQ ID NO: 472711 - DNA, 20 bp, Artificial Sequence
  chemically synthesized
gagaacaatttcttttattt

SEQ ID NO: 472712 - DNA, 20 bp, Artificial Sequence
  chemically synthesized
cagataattttattgatagt

SEQ ID NO: 472713 - DNA, 20 bp, Artificial Sequence
  chemically synthesized
tgtgttttgtgacagagggg

SEQ ID NO: 472714 - DNA, 20 bp, Artificial Sequence
  chemically synthesized
taagaaaagtttatttaatg

SEQ ID NO: 472715 - DNA, 20 bp, Artificial Sequence
  chemically synthesized
caaatttacaatggtaattt

SEQ ID NO: 472716 - DNA, 20 bp, Artificial Sequence
  chemically synthesized
cttttttttcctgaggaagc

SEQ ID NO: 472717 - DNA, 20 bp, Artificial Sequence
  chemically synthesized
ttttaaaaataaactcactt

SEQ ID NO: 472718 - DNA, 20 bp, Artificial Sequence
  chemically synthesized
actaacctgtatattcacaa

SEQ ID NO: 472719 - DNA, 20 bp, Artificial Sequence
  chemically synthesized
ccttcttttcagcgtctgtc

SEQ ID NO: 472720 - DNA, 20 bp, Artificial Sequence
  chemically synthesized
tgttgtctttcctgtttgcg

SEQ ID NO: 472721 - DNA, 20 bp, Artificial Sequence
  chemically synthesized
ggaaagacaacattaatctc

SEQ ID NO: 472722 - DNA, 20 bp, Artificial Sequence
  chemically synthesized
tgctcagctgcccatgaaga

SEQ ID NO: 472723 - DNA, 20 bp, Artificial Sequence
  chemically synthesized
cagctgcccatgaagacagg

SEQ ID NO: 472724 - DNA, 20 bp, Artificial Sequence
  chemically synthesized
gcatttatctttgtgcctga

SEQ ID NO: 472725 - DNA, 20 bp, Artificial Sequence
  chemically synthesized
cttcgcatttatctttgtgc

SEQ ID NO: 472726 - DNA, 20 bp, Artificial Sequence
  chemically synthesized
gtttagcagtggaaatgttt

SEQ ID NO: 472727 - DNA, 20 bp, Artificial Sequence
  chemically synthesized
cctatagaacagataagaaa

SEQ ID NO: 472728 - DNA, 20 bp, Artificial Sequence
  chemically synthesized
tagaacagataagaaactga

SEQ ID NO: 472729 - DNA, 20 bp, Artificial Sequence
  chemically synthesized
aaactgaatgagtagactga

SEQ ID NO: 472730 - DNA, 20 bp, Artificial Sequence
  chemically synthesized
gtttcttgtatgtgtctccc

SEQ ID NO: 472731 - DNA, 20 bp, Artificial Sequence
  chemically synthesized
attttttactatttgactga

SEQ ID NO: 472732 - DNA, 20 bp, Artificial Sequence
  chemically synthesized
agaatgtaaatatatcacag

SEQ ID NO: 472733 - DNA, 20 bp, Artificial Sequence
  chemically synthesized
ttactttagcttcaataact

SEQ ID NO: 472734 - DNA, 20 bp, Artificial Sequence
  chemically synthesized
aaagataaaaacaaccatat

SEQ ID NO: 472735 - DNA, 20 bp, Artificial Sequence
  chemically synthesized
tttatctttattggtttaaa

SEQ ID NO: 472736 - DNA, 20 bp, Artificial Sequence
  chemically synthesized
catctatttggtaagtgaat

SEQ ID NO: 472737 - DNA, 20 bp, Artificial Sequence
  chemically synthesized
attaagcatctatttggtaa

SEQ ID NO: 472738 - DNA, 20 bp, Artificial Sequence
  chemically synthesized
gaaaaggtgaccaaaagtga

SEQ ID NO: 472739 - DNA, 20 bp, Artificial Sequence
  chemically synthesized
agcgtaataagacttttgtt

SEQ ID NO: 472740 - DNA, 20 bp, Artificial Sequence
  chemically synthesized
taagacttttgttatgagtg

SEQ ID NO: 472741 - DNA, 20 bp, Artificial Sequence
  chemically synthesized
gtgaaatgaaatttcacgta

SEQ ID NO: 472742 - DNA, 20 bp, Artificial Sequence
  chemically synthesized
gaaatttcatttcacatact

SEQ ID NO: 472743 - DNA, 20 bp, Artificial Sequence
  chemically synthesized
cttcactgtgtattggtcaa

SEQ ID NO: 472744 - DNA, 20 bp, Artificial Sequence
  chemically synthesized
tttttttcaggcttaagttg

SEQ ID NO: 472745 - DNA, 20 bp, Artificial Sequence
  chemically synthesized
tcaacaatataatcttcctc

SEQ ID NO: 472746 - DNA, 20 bp, Artificial Sequence
  chemically synthesized
cactggagctttaagaaaca

SEQ ID NO: 472747 - DNA, 20 bp, Artificial Sequence
  chemically synthesized
taaagttgctagatattaat

SEQ ID NO: 472748 - DNA, 20 bp, Artificial Sequence
  chemically synthesized
atgtgtctatactttttccc

SEQ ID NO: 472749 - DNA, 20 bp, Artificial Sequence
  chemically synthesized
gctgtgcttcaaattattag

SEQ ID NO: 472750 - DNA, 20 bp, Artificial Sequence
  chemically synthesized
actgtgagactaatttaaaa

SEQ ID NO: 472751 - DNA, 20 bp, Artificial Sequence
  chemically synthesized
acatctcaatacactgcgga

SEQ ID NO: 472752 - DNA, 20 bp, Artificial Sequence
  chemically synthesized
tcttacatctcaatacactg

SEQ ID NO: 472753 - DNA, 20 bp, Artificial Sequence
  chemically synthesized
tcatattatacagtgtagtc

SEQ ID NO: 472754 - DNA, 20 bp, Artificial Sequence
  chemically synthesized
tacgcttaaattgtctggca

SEQ ID NO: 472755 - DNA, 20 bp, Artificial Sequence
  chemically synthesized
tctatataaaacaaagaagc

SEQ ID NO: 472756 - DNA, 20 bp, Artificial Sequence
  chemically synthesized
tccagcttctttgttttata

SEQ ID NO: 472757 - DNA, 20 bp, Artificial Sequence
  chemically synthesized
tgttttatatagagtaatag

SEQ ID NO: 472758 - DNA, 20 bp, Artificial Sequence
  chemically synthesized
acagcatgtctggttaaagg

SEQ ID NO: 472759 - DNA, 20 bp, Artificial Sequence
  chemically synthesized
tcatttaaacgatataggaa

SEQ ID NO: 472760 - DNA, 20 bp, Artificial Sequence
  chemically synthesized
gcaggaggaagggaaaagaa

SEQ ID NO: 472761 - DNA, 20 bp, Artificial Sequence
  chemically synthesized
gacaagagaagagttgggaa

SEQ ID NO: 472762 - DNA, 20 bp, Artificial Sequence
  chemically synthesized
agaagaaaaaaggacaagag

SEQ ID NO: 472763 - DNA, 20 bp, Artificial Sequence
  chemically synthesized
tcttgtccttttttcttctg

SEQ ID NO: 472764 - DNA, 20 bp, Artificial Sequence
  chemically synthesized
ctcctgtccaaataagttca

SEQ ID NO: 472765 - DNA, 20 bp, Artificial Sequence
  chemically synthesized
gcctcagcctcccaaagtgt

SEQ ID NO: 472766 - DNA, 20 bp, Artificial Sequence
  chemically synthesized
ggctgaggcaggcagatcat

SEQ ID NO: 472767 - DNA, 20 bp, Artificial Sequence
  chemically synthesized
caggcagatcatctgagttc

SEQ ID NO: 472768 - DNA, 20 bp, Artificial Sequence
  chemically synthesized
gcctcagtctcccgagtagc

SEQ ID NO: 472769 - DNA, 20 bp, Artificial Sequence
  chemically synthesized
gattttcctgcctcagtctc

SEQ ID NO: 472770 - DNA, 20 bp, Artificial Sequence
  chemically synthesized
tcacttgaacccaggaggca

SEQ ID NO: 472771 - DNA, 20 bp, Artificial Sequence
  chemically synthesized
ctcactgcatcctttgcctc

SEQ ID NO: 472772 - DNA, 20 bp, Artificial Sequence
  chemically synthesized
tttgctcttgtcgcccaggc

SEQ ID NO: 472773 - DNA, 20 bp, Artificial Sequence
  chemically synthesized
ttgtttgtttgtttttcagt

SEQ ID NO: 472774 - DNA, 20 bp, Artificial Sequence
  chemically synthesized
gacttcctgacctatctggt

SEQ ID NO: 472775 - DNA, 20 bp, Artificial Sequence
  chemically synthesized
gggctggaccaagagctctc

SEQ ID NO: 472776 - DNA, 20 bp, Artificial Sequence
  chemically synthesized
tggtccagccctcactggct

SEQ ID NO: 472777 - DNA, 20 bp, Artificial Sequence
  chemically synthesized
tggctgtgaatgccaagcct

SEQ ID NO: 472778 - DNA, 20 bp, Artificial Sequence
  chemically synthesized
gtgaatacctaaactgagaa

SEQ ID NO: 472779 - DNA, 20 bp, Artificial Sequence
  chemically synthesized
cccatagatacctttaagga

SEQ ID NO: 472780 - DNA, 20 bp, Artificial Sequence
  chemically synthesized
agaaagaatttctggaccac

SEQ ID NO: 472781 - DNA, 20 bp, Artificial Sequence
  chemically synthesized
ctagcatcctccaaattaga

SEQ ID NO: 472782 - DNA, 20 bp, Artificial Sequence
  chemically synthesized
cagaaattctttctaatttg

SEQ ID NO: 472783 - DNA, 20 bp, Artificial Sequence
  chemically synthesized
aagtgattcttctgctatca

SEQ ID NO: 472784 - DNA, 20 bp, Artificial Sequence
  chemically synthesized
agaccatcctctgatagcag

SEQ ID NO: 472785 - DNA, 20 bp, Artificial Sequence
  chemically synthesized
ctgatagcagaagaatcact

SEQ ID NO: 472786 - DNA, 20 bp, Artificial Sequence
  chemically synthesized
cttctttctgagagacgcct

SEQ ID NO: 472787 - DNA, 20 bp, Artificial Sequence
  chemically synthesized
agctaatgggaagacctacg

SEQ ID NO: 472788 - DNA, 20 bp, Artificial Sequence
  chemically synthesized
gaagacctacgtagggtatc

SEQ ID NO: 472789 - DNA, 20 bp, Artificial Sequence
  chemically synthesized
ttaaatgtcagagaagttat

SEQ ID NO: 472790 - DNA, 20 bp, Artificial Sequence
  chemically synthesized
aatagctgaaaatattttta

SEQ ID NO: 472791 - DNA, 20 bp, Artificial Sequence
  chemically synthesized
cttgaaatttcatattgatc

SEQ ID NO: 472792 - DNA, 20 bp, Artificial Sequence
  chemically synthesized
tctttcagaaaaaaaataca

SEQ ID NO: 472793 - DNA, 20 bp, Artificial Sequence
  chemically synthesized
cttaggtgaatttataaact

SEQ ID NO: 472794 - DNA, 20 bp, Artificial Sequence
  chemically synthesized
actgcaaagcagttgcttag

SEQ ID NO: 472795 - DNA, 20 bp, Artificial Sequence
  chemically synthesized
tgattatgatggggcaggga

SEQ ID NO: 472796 - DNA, 20 bp, Artificial Sequence
  chemically synthesized
gctttagaaataacacacaa

SEQ ID NO: 472797 - DNA, 20 bp, Artificial Sequence
  chemically synthesized
acaattggatgatagttcta

SEQ ID NO: 472798 - DNA, 20 bp, Artificial Sequence
  chemically synthesized
tggatgatagttctacggaa

SEQ ID NO: 472799 - DNA, 20 bp, Artificial Sequence
  chemically synthesized
ctccttctcaagagattctt

SEQ ID NO: 472800 - DNA, 20 bp, Artificial Sequence
  chemically synthesized
tgaaattgtcgacaaccctt

SEQ ID NO: 472801 - DNA, 20 bp, Artificial Sequence
  chemically synthesized
cttttgaatagatggaagac

SEQ ID NO: 472802 - DNA, 20 bp, Artificial Sequence
  chemically synthesized
gccacatatttgatcaactt

SEQ ID NO: 472803 - DNA, 20 bp, Artificial Sequence
  chemically synthesized
cagtgctcacaagtgtgcca

SEQ ID NO: 472804 - DNA, 20 bp, Artificial Sequence
  chemically synthesized
ttacgtaggctagctttatg

SEQ ID NO: 472805 - DNA, 20 bp, Artificial Sequence
  chemically synthesized
caaatagtttctatatgaca

SEQ ID NO: 472806 - DNA, 20 bp, Artificial Sequence
  chemically synthesized
tctgaatcacaaagctgccc

SEQ ID NO: 472807 - DNA, 20 bp, Artificial Sequence
  chemically synthesized
cagctttgtgattcagattc

SEQ ID NO: 472808 - DNA, 20 bp, Artificial Sequence
  chemically synthesized
tgatttgtacattcaagaat

SEQ ID NO: 472809 - DNA, 20 bp, Artificial Sequence
  chemically synthesized
aatggttgatttgtacattc

SEQ ID NO: 472810 - DNA, 20 bp, Artificial Sequence
  chemically synthesized
atcatacggcaccagcatca

SEQ ID NO: 472811 - DNA, 20 bp, Artificial Sequence
  chemically synthesized
gcatcatggggtattgtcca

SEQ ID NO: 472812 - DNA, 20 bp, Artificial Sequence
  chemically synthesized
atttattgcaaaaccaacct

SEQ ID NO: 472813 - DNA, 20 bp, Artificial Sequence
  chemically synthesized
gtatgttattaagagcaaga

SEQ ID NO: 472814 - DNA, 20 bp, Artificial Sequence
  chemically synthesized
gaaggaaaagcatttgaaga

SEQ ID NO: 472815 - DNA, 20 bp, Artificial Sequence
  chemically synthesized
cttttccttccttgaggtga

SEQ ID NO: 472816 - DNA, 20 bp, Artificial Sequence
  chemically synthesized
aaactaccttgggcacaata

SEQ ID NO: 472817 - DNA, 20 bp, Artificial Sequence
  chemically synthesized
gtttttaaatgcatgatgaa

SEQ ID NO: 472818 - DNA, 20 bp, Artificial Sequence
  chemically synthesized
attaaaatatgacttaacac

SEQ ID NO: 472819 - DNA, 20 bp, Artificial Sequence
  chemically synthesized
ggcctaaccagaaaattaaa

SEQ ID NO: 472820 - DNA, 20 bp, Artificial Sequence
  chemically synthesized
catgccaaaagagcactttc

SEQ ID NO: 472821 - DNA, 20 bp, Artificial Sequence
  chemically synthesized
atgaatgaaggtatttgtgt

SEQ ID NO: 472822 - DNA, 20 bp, Artificial Sequence
  chemically synthesized
agtatgagaaaagtagagag

SEQ ID NO: 472823 - DNA, 20 bp, Artificial Sequence
  chemically synthesized
ctctacttttctcatacttg

SEQ ID NO: 472824 - DNA, 20 bp, Artificial Sequence
  chemically synthesized
tttctcatacttggtggatt

SEQ ID NO: 472825 - DNA, 20 bp, Artificial Sequence
  chemically synthesized
tttggagtttgataacatag

SEQ ID NO: 472826 - DNA, 20 bp, Artificial Sequence
  chemically synthesized
taaaatagaaaactcacctc

SEQ ID NO: 472827 - DNA, 20 bp, Artificial Sequence
  chemically synthesized
ccttttgttcaaccccagag

SEQ ID NO: 472828 - DNA, 20 bp, Artificial Sequence
  chemically synthesized
gttgaacaaaaggcattagg

SEQ ID NO: 472829 - DNA, 20 bp, Artificial Sequence
  chemically synthesized
tagacttgttttgtcttttc

SEQ ID NO: 472830 - DNA, 20 bp, Artificial Sequence
  chemically synthesized
aatatggattatgcattatg

SEQ ID NO: 472831 - DNA, 20 bp, Artificial Sequence
  chemically synthesized
caaatcgttgatacagcaat

SEQ ID NO: 472832 - DNA, 20 bp, Artificial Sequence
  chemically synthesized
gctaagtagtatgccattat

SEQ ID NO: 472833 - DNA, 20 bp, Artificial Sequence
  chemically synthesized
taatgtctttgaacaggtga

SEQ ID NO: 472834 - DNA, 20 bp, Artificial Sequence
  chemically synthesized
aacctaatgtctttgaacag

SEQ ID NO: 472835 - DNA, 20 bp, Artificial Sequence
  chemically synthesized
gcttttagcatttggcaatc

SEQ ID NO: 472836 - DNA, 20 bp, Artificial Sequence
  chemically synthesized
taagttttcatttctctaag

SEQ ID NO: 472837 - DNA, 20 bp, Artificial Sequence
  chemically synthesized
tttctctaagatgaatgctt

SEQ ID NO: 472838 - DNA, 20 bp, Artificial Sequence
  chemically synthesized
aatgcttaagagtgggcttg

SEQ ID NO: 472839 - DNA, 20 bp, Artificial Sequence
  chemically synthesized
ttgctaaaaaattcccactt

SEQ ID NO: 472840 - DNA, 20 bp, Artificial Sequence
  chemically synthesized
atcatggtacatccataagt

SEQ ID NO: 472841 - DNA, 20 bp, Artificial Sequence
  chemically synthesized
tatggatgtaccatgattta

SEQ ID NO: 472842 - DNA, 20 bp, Artificial Sequence
  chemically synthesized
aacttatatgttcccaaaga

SEQ ID NO: 472843 - DNA, 20 bp, Artificial Sequence
  chemically synthesized
aatcaagtaaatatacttct

SEQ ID NO: 472844 - DNA, 20 bp, Artificial Sequence
  chemically synthesized
tatttacttgattaaaggct

SEQ ID NO: 472845 - DNA, 20 bp, Artificial Sequence
  chemically synthesized
cagtatatctaacttgcttt

SEQ ID NO: 472846 - DNA, 20 bp, Artificial Sequence
  chemically synthesized
ggggaagaggagagtgtgag

SEQ ID NO: 472847 - DNA, 20 bp, Artificial Sequence
  chemically synthesized
acagtctatcaggggaagag

SEQ ID NO: 472848 - DNA, 20 bp, Artificial Sequence
  chemically synthesized
ccctgatagactgtaaaact

SEQ ID NO: 472849 - DNA, 20 bp, Artificial Sequence
  chemically synthesized
cctgagtgcctttctaaact

SEQ ID NO: 472850 - DNA, 20 bp, Artificial Sequence
  chemically synthesized
tcagagtttagaaaggcact

SEQ ID NO: 472851 - DNA, 20 bp, Artificial Sequence
  chemically synthesized
tgaaatagaaagccaacatc

SEQ ID NO: 472852 - DNA, 20 bp, Artificial Sequence
  chemically synthesized
tccagctccctctcaagatg

SEQ ID NO: 472853 - DNA, 20 bp, Artificial Sequence
  chemically synthesized
tccagcatcttgagagggag

SEQ ID NO: 472854 - DNA, 20 bp, Artificial Sequence
  chemically synthesized
tggatatagcagaaaatgtc

SEQ ID NO: 472855 - DNA, 20 bp, Artificial Sequence
  chemically synthesized
agagtacagattcagaagaa

SEQ ID NO: 472856 - DNA, 20 bp, Artificial Sequence
  chemically synthesized
aggactcaaatccagttctt

SEQ ID NO: 472857 - DNA, 20 bp, Artificial Sequence
  chemically synthesized
cagattcagaagaactggat

SEQ ID NO: 472858 - DNA, 20 bp, Artificial Sequence
  chemically synthesized
ttaagatcatgaagtgatag

SEQ ID NO: 472859 - DNA, 20 bp, Artificial Sequence
  chemically synthesized
tattttccttatattccaat

SEQ ID NO: 472860 - DNA, 20 bp, Artificial Sequence
  chemically synthesized
ggagatatcattattcccat

SEQ ID NO: 472861 - DNA, 20 bp, Artificial Sequence
  chemically synthesized
ctccctcaccaaaatgttgt

SEQ ID NO: 472862 - DNA, 20 bp, Artificial Sequence
  chemically synthesized
acatagctatgatgtgttgt

SEQ ID NO: 472863 - DNA, 20 bp, Artificial Sequence
  chemically synthesized
tgctgcccaggtgagagaga

SEQ ID NO: 472864 - DNA, 20 bp, Artificial Sequence
  chemically synthesized
ggcagcatttatctgcagcc

SEQ ID NO: 472865 - DNA, 20 bp, Artificial Sequence
  chemically synthesized
cacattaacagtagttagga

SEQ ID NO: 472866 - DNA, 20 bp, Artificial Sequence
  chemically synthesized
gtggcacattaacagtagtt

SEQ ID NO: 472867 - DNA, 20 bp, Artificial Sequence
  chemically synthesized
tatggcagagagaaatgcct

SEQ ID NO: 472868 - DNA, 20 bp, Artificial Sequence
  chemically synthesized
ggtggataaatggtctagct

SEQ ID NO: 472869 - DNA, 20 bp, Artificial Sequence
  chemically synthesized
atcattcatgctgatgaatg

SEQ ID NO: 472870 - DNA, 20 bp, Artificial Sequence
  chemically synthesized
tttatccaccattcatcagc

SEQ ID NO: 472871 - DNA, 20 bp, Artificial Sequence
  chemically synthesized
tctgtttatcattcatgctg

SEQ ID NO: 472872 - DNA, 20 bp, Artificial Sequence
  chemically synthesized
ctgattagcatttggcaatc

SEQ ID NO: 472873 - DNA, 20 bp, Artificial Sequence
  chemically synthesized
aaggacaagaccataagtac

SEQ ID NO: 472874 - DNA, 20 bp, Artificial Sequence
  chemically synthesized
agaatcatagcagatgctat

SEQ ID NO: 472875 - DNA, 20 bp, Artificial Sequence
  chemically synthesized
tgtacgatcttccttcctta

SEQ ID NO: 472876 - DNA, 20 bp, Artificial Sequence
  chemically synthesized
tacaccacattttcatacaa

SEQ ID NO: 472877 - DNA, 20 bp, Artificial Sequence
  chemically synthesized
gaaccttcttttttttaatg

SEQ ID NO: 472878 - DNA, 20 bp, Artificial Sequence
  chemically synthesized
ttcctaccattggtgacaat

SEQ ID NO: 472879 - DNA, 20 bp, Artificial Sequence
  chemically synthesized
gtgaaataagccagtcatag

SEQ ID NO: 472880 - DNA, 20 bp, Artificial Sequence
  chemically synthesized
tttcagacacttcataaaag

SEQ ID NO: 472881 - DNA, 20 bp, Artificial Sequence
  chemically synthesized
aaacgagaaattgttattca

SEQ ID NO: 472882 - DNA, 20 bp, Artificial Sequence
  chemically synthesized
taagtgaaactttatactca

SEQ ID NO: 472883 - DNA, 20 bp, Artificial Sequence
  chemically synthesized
taaagtttcacttatgcaag

SEQ ID NO: 472884 - DNA, 20 bp, Artificial Sequence
  chemically synthesized
gtagtgcacttaaaacttaa

SEQ ID NO: 472885 - DNA, 20 bp, Artificial Sequence
  chemically synthesized
ttaaaacttaaggggattaa

SEQ ID NO: 472886 - DNA, 20 bp, Artificial Sequence
  chemically synthesized
tcccaaagtgctgggattac

SEQ ID NO: 472887 - DNA, 20 bp, Artificial Sequence
  chemically synthesized
accttggcctcccaaagtgc

SEQ ID NO: 472888 - DNA, 20 bp, Artificial Sequence
  chemically synthesized
tggggtttcaccacatcggc

SEQ ID NO: 472889 - DNA, 20 bp, Artificial Sequence
  chemically synthesized
ttttgtatttttagtagaga

SEQ ID NO: 472890 - DNA, 20 bp, Artificial Sequence
  chemically synthesized
gattctcctgcctcagcctc

SEQ ID NO: 472891 - DNA, 20 bp, Artificial Sequence
  chemically synthesized
tactcgggaggctgaggcag

SEQ ID NO: 472892 - DNA, 20 bp, Artificial Sequence
  chemically synthesized
atcttgctctgtcgccaggc

SEQ ID NO: 472893 - DNA, 20 bp, Artificial Sequence
  chemically synthesized
ttttttttttttttttgaga

SEQ ID NO: 472894 - DNA, 20 bp, Artificial Sequence
  chemically synthesized
aaaaaaaaaaaaaaaaaaaa

SEQ ID NO: 472895 - DNA, 20 bp, Artificial Sequence
  chemically synthesized
acacaaaacttttgtaggta

SEQ ID NO: 472896 - DNA, 20 bp, Artificial Sequence
  chemically synthesized
ttgactgtggcaatagtatc

SEQ ID NO: 472897 - DNA, 20 bp, Artificial Sequence
  chemically synthesized
ttgtacttttatagctttct

SEQ ID NO: 472898 - DNA, 20 bp, Artificial Sequence
  chemically synthesized
aagtacaaaaaaaaaaaaag

SEQ ID NO: 472899 - DNA, 20 bp, Artificial Sequence
  chemically synthesized
tacagtggaggaaaacaaaa

SEQ ID NO: 472900 - DNA, 20 bp, Artificial Sequence
  chemically synthesized
cgccatttgggggcatttgc

SEQ ID NO: 472901 - DNA, 20 bp, Artificial Sequence
  chemically synthesized
aagaaaaataatacagaagc

SEQ ID NO: 472902 - DNA, 20 bp, Artificial Sequence
  chemically synthesized
atacagaagctagaataaag

SEQ ID NO: 472903 - DNA, 20 bp, Artificial Sequence
  chemically synthesized
acccttagtctgtcaggctc

SEQ ID NO: 472904 - DNA, 20 bp, Artificial Sequence
  chemically synthesized
attcttgagcctgacagact

SEQ ID NO: 472905 - DNA, 20 bp, Artificial Sequence
  chemically synthesized
tttgaggtcaccagtgatcg

SEQ ID NO: 472906 - DNA, 20 bp, Artificial Sequence
  chemically synthesized
agtgatcagaggctgaagga

SEQ ID NO: 472907 - DNA, 20 bp, Artificial Sequence
  chemically synthesized
tgggttacagagcacaagag

SEQ ID NO: 472908 - DNA, 20 bp, Artificial Sequence
  chemically synthesized
aatgaagtgaactgaatagg

SEQ ID NO: 472909 - DNA, 20 bp, Artificial Sequence
  chemically synthesized
aaattcagtaatgaagtgaa

SEQ ID NO: 472910 - DNA, 20 bp, Artificial Sequence
  chemically synthesized
ctattcagttcacttcatta

SEQ ID NO: 472911 - DNA, 20 bp, Artificial Sequence
  chemically synthesized
acttcattactgaatttgct

SEQ ID NO: 472912 - DNA, 20 bp, Artificial Sequence
  chemically synthesized
tcatttcctaaagtcataat

SEQ ID NO: 472913 - DNA, 20 bp, Artificial Sequence
  chemically synthesized
ctttcatgtagttattagtg

SEQ ID NO: 472914 - DNA, 20 bp, Artificial Sequence
  chemically synthesized
gaaatcatacagaaaaaaat

SEQ ID NO: 472915 - DNA, 20 bp, Artificial Sequence
  chemically synthesized
acgcatatagttcctgtagc

SEQ ID NO: 472916 - DNA, 20 bp, Artificial Sequence
  chemically synthesized
tcaaaacgttaaattaaaat

SEQ ID NO: 472917 - DNA, 20 bp, Artificial Sequence
  chemically synthesized
aagtgatcttaaagttttca

SEQ ID NO: 472918 - DNA, 20 bp, Artificial Sequence
  chemically synthesized
actcttgtgaccttcctctc

SEQ ID NO: 472919 - DNA, 20 bp, Artificial Sequence
  chemically synthesized
attccagagaggaaggtcac

SEQ ID NO: 472920 - DNA, 20 bp, Artificial Sequence
  chemically synthesized
agaggaaggtcacaagagtg

SEQ ID NO: 472921 - DNA, 20 bp, Artificial Sequence
  chemically synthesized
atggctaactaaaattccta

SEQ ID NO: 472922 - DNA, 20 bp, Artificial Sequence
  chemically synthesized
tttacaggttgttattcgtt

SEQ ID NO: 472923 - DNA, 20 bp, Artificial Sequence
  chemically synthesized
agaccattgcacatggtgaa

SEQ ID NO: 472924 - DNA, 20 bp, Artificial Sequence
  chemically synthesized
gtgaacagaataccacacca

SEQ ID NO: 472925 - DNA, 20 bp, Artificial Sequence
  chemically synthesized
cagtagattgccaagtcatt

SEQ ID NO: 472926 - DNA, 20 bp, Artificial Sequence
  chemically synthesized
cacatttgatctgggaagtc

SEQ ID NO: 472927 - DNA, 20 bp, Artificial Sequence
  chemically synthesized
tgcaactcagtcaccttgcc

SEQ ID NO: 472928 - DNA, 20 bp, Artificial Sequence
  chemically synthesized
taaaattcttggcaaggtga

SEQ ID NO: 472929 - DNA, 20 bp, Artificial Sequence
  chemically synthesized
tgactgtgcagccatcagca

SEQ ID NO: 472930 - DNA, 20 bp, Artificial Sequence
  chemically synthesized
tttttttctttttttttttc

SEQ ID NO: 472931 - DNA, 20 bp, Artificial Sequence
  chemically synthesized
aacatcacggtgattattag

SEQ ID NO: 472932 - DNA, 20 bp, Artificial Sequence
  chemically synthesized
atacctacataaatagagcc

SEQ ID NO: 472933 - DNA, 20 bp, Artificial Sequence
  chemically synthesized
ccatgaataatttatgctca

SEQ ID NO: 472934 - DNA, 20 bp, Artificial Sequence
  chemically synthesized
aatttatgctcaaggaattt

SEQ ID NO: 472935 - DNA, 20 bp, Artificial Sequence
  chemically synthesized
atgcagtcagccaattatgt

SEQ ID NO: 472936 - DNA, 20 bp, Artificial Sequence
  chemically synthesized
ggttacagtctttgggccat

SEQ ID NO: 472937 - DNA, 20 bp, Artificial Sequence
  chemically synthesized
gatcatttggtttttaatat

SEQ ID NO: 472938 - DNA, 20 bp, Artificial Sequence
  chemically synthesized
aaaaaccaaatgatcataga

SEQ ID NO: 472939 - DNA, 20 bp, Artificial Sequence
  chemically synthesized
ctcactcttctcgctttcta

SEQ ID NO: 472940 - DNA, 20 bp, Artificial Sequence
  chemically synthesized
tacatccattagaaagcgag

SEQ ID NO: 472941 - DNA, 20 bp, Artificial Sequence
  chemically synthesized
gaactagcaattaacgcaaa

SEQ ID NO: 472942 - DNA, 20 bp, Artificial Sequence
  chemically synthesized
caaaaagagtataggagaga

SEQ ID NO: 472943 - DNA, 20 bp, Artificial Sequence
  chemically synthesized
catgtttagttctttcacaa

SEQ ID NO: 472944 - DNA, 20 bp, Artificial Sequence
  chemically synthesized
gggttgtgagccccagacta

SEQ ID NO: 472945 - DNA, 20 bp, Artificial Sequence
  chemically synthesized
ttagatggtttctaaatgtg

SEQ ID NO: 472946 - DNA, 20 bp, Artificial Sequence
  chemically synthesized
cctgggttcgcctctaggct

SEQ ID NO: 472947 - DNA, 20 bp, Artificial Sequence
  chemically synthesized
tacttcatactgaagcatgc

SEQ ID NO: 472948 - DNA, 20 bp, Artificial Sequence
  chemically synthesized
tcaagttttatccagatcac

SEQ ID NO: 472949 - DNA, 20 bp, Artificial Sequence
  chemically synthesized
tcaactgtaattcgggtgat

SEQ ID NO: 472950 - DNA, 20 bp, Artificial Sequence
  chemically synthesized
gtctacaggtcaactgtaat

SEQ ID NO: 472951 - DNA, 20 bp, Artificial Sequence
  chemically synthesized
aagcttctgttctcatgctt

SEQ ID NO: 472952 - DNA, 20 bp, Artificial Sequence
  chemically synthesized
ccacaatataactactatac

SEQ ID NO: 472953 - DNA, 20 bp, Artificial Sequence
  chemically synthesized
agttatattgtggcattatt

SEQ ID NO: 472954 - DNA, 20 bp, Artificial Sequence
  chemically synthesized
tggatacagctgacagagag

SEQ ID NO: 472955 - DNA, 20 bp, Artificial Sequence
  chemically synthesized
aaacagtatcataaagatta

SEQ ID NO: 472956 - DNA, 20 bp, Artificial Sequence
  chemically synthesized
aatgggagagactttggctg

SEQ ID NO: 472957 - DNA, 20 bp, Artificial Sequence
  chemically synthesized
actaacatgcaaagattaat

SEQ ID NO: 472958 - DNA, 20 bp, Artificial Sequence
  chemically synthesized
tctcaactgcacagaccaaa

SEQ ID NO: 472959 - DNA, 20 bp, Artificial Sequence
  chemically synthesized
ggtctgtgcagttgagacgt

SEQ ID NO: 472960 - DNA, 20 bp, Artificial Sequence
  chemically synthesized
aaaaggggttccagacacca

SEQ ID NO: 472961 - DNA, 20 bp, Artificial Sequence
  chemically synthesized
tggattatcagccttagaaa

SEQ ID NO: 472962 - DNA, 20 bp, Artificial Sequence
  chemically synthesized
agttcatacttgtaactatt

SEQ ID NO: 472963 - DNA, 20 bp, Artificial Sequence
  chemically synthesized
taatagttacaagtatgaac

SEQ ID NO: 472964 - DNA, 20 bp, Artificial Sequence
  chemically synthesized
cttattttaaaggttggtgt

SEQ ID NO: 472965 - DNA, 20 bp, Artificial Sequence
  chemically synthesized
aaggttggtgtgaggattaa

SEQ ID NO: 472966 - DNA, 20 bp, Artificial Sequence
  chemically synthesized
ataattataaacgtaggagt

SEQ ID NO: 472967 - DNA, 20 bp, Artificial Sequence
  chemically synthesized
atgaaaataattataaacgt

SEQ ID NO: 472968 - DNA, 20 bp, Artificial Sequence
  chemically synthesized
tcattaatgtagctagttat

SEQ ID NO: 472969 - DNA, 20 bp, Artificial Sequence
  chemically synthesized
ctcacattggcagtaagttc

SEQ ID NO: 472970 - DNA, 20 bp, Artificial Sequence
  chemically synthesized
acgaacttactgccaatgtg

SEQ ID NO: 472971 - DNA, 20 bp, Artificial Sequence
  chemically synthesized
actgccaatgtgaggaatcc

SEQ ID NO: 472972 - DNA, 20 bp, Artificial Sequence
  chemically synthesized
tgtcactttcctggttaccc

SEQ ID NO: 472973 - DNA, 20 bp, Artificial Sequence
  chemically synthesized
acagagactttccatggttc

SEQ ID NO: 472974 - DNA, 20 bp, Artificial Sequence
  chemically synthesized
gaaccgcgtaacatttttta

SEQ ID NO: 472975 - DNA, 20 bp, Artificial Sequence
  chemically synthesized
aaaaaatgttacgcggttct

SEQ ID NO: 472976 - DNA, 20 bp, Artificial Sequence
  chemically synthesized
ttcatagtaaacatcagcat

SEQ ID NO: 472977 - DNA, 20 bp, Artificial Sequence
  chemically synthesized
atactatattagtattgctt

SEQ ID NO: 472978 - DNA, 20 bp, Artificial Sequence
  chemically synthesized
aaaatatttagctatttatt

SEQ ID NO: 472979 - DNA, 20 bp, Artificial Sequence
  chemically synthesized
accaacaattgaaattaaac

SEQ ID NO: 472980 - DNA, 20 bp, Artificial Sequence
  chemically synthesized
tttttcctatttaaattggt

SEQ ID NO: 472981 - DNA, 20 bp, Artificial Sequence
  chemically synthesized
gtgtgggtgattcatgttaa

SEQ ID NO: 472982 - DNA, 20 bp, Artificial Sequence
  chemically synthesized
ggtcagagaattccattaac

SEQ ID NO: 472983 - DNA, 20 bp, Artificial Sequence
  chemically synthesized
cagcacataacttcaggtca

SEQ ID NO: 472984 - DNA, 20 bp, Artificial Sequence
  chemically synthesized
ggttgtcatgagcttttgtg

SEQ ID NO: 472985 - DNA, 20 bp, Artificial Sequence
  chemically synthesized
gagcttttgtgttgggttcc

SEQ ID NO: 472986 - DNA, 20 bp, Artificial Sequence
  chemically synthesized
actgaagatgcagttcaaaa

SEQ ID NO: 472987 - DNA, 20 bp, Artificial Sequence
  chemically synthesized
gatctcctggaccaagtctt

SEQ ID NO: 472988 - DNA, 20 bp, Artificial Sequence
  chemically synthesized
cccttgatagctggtctagg

SEQ ID NO: 472989 - DNA, 20 bp, Artificial Sequence
  chemically synthesized
aagtgaaggagttcatgtta

SEQ ID NO: 472990 - DNA, 20 bp, Artificial Sequence
  chemically synthesized
tctcaggaggtgaaaagtga

SEQ ID NO: 472991 - DNA, 20 bp, Artificial Sequence
  chemically synthesized
tccttcacttttcacctcct

SEQ ID NO: 472992 - DNA, 20 bp, Artificial Sequence
  chemically synthesized
tggtgtgagttagggacaga

SEQ ID NO: 472993 - DNA, 20 bp, Artificial Sequence
  chemically synthesized
gaaatgagctcatttatggt

SEQ ID NO: 472994 - DNA, 20 bp, Artificial Sequence
  chemically synthesized
aaaaaaaaatcgaagaggaa

SEQ ID NO: 472995 - DNA, 20 bp, Artificial Sequence
  chemically synthesized
gtggaaaaaaaaaatcgaag

SEQ ID NO: 472996 - DNA, 20 bp, Artificial Sequence
  chemically synthesized
cagacgagagagaataattg

SEQ ID NO: 472997 - DNA, 20 bp, Artificial Sequence
  chemically synthesized
atagaaataggcagacgaga

SEQ ID NO: 472998 - DNA, 20 bp, Artificial Sequence
  chemically synthesized
ggatttcttacgtatgtata

SEQ ID NO: 472999 - DNA, 20 bp, Artificial Sequence
  chemically synthesized
accgcccttctgttcagaaa

SEQ ID NO: 473000 - DNA, 20 bp, Artificial Sequence
  chemically synthesized
atccaaaaaaaaaaaaaaag

SEQ ID NO: 473001 - DNA, 20 bp, Artificial Sequence
  chemically synthesized
attcatcttttttttttttt

SEQ ID NO: 473002 - DNA, 20 bp, Artificial Sequence
  chemically synthesized
tttttttttttttttggata

SEQ ID NO: 473003 - DNA, 20 bp, Artificial Sequence
  chemically synthesized
tcgcgccattgcgctccagc

SEQ ID NO: 473004 - DNA, 20 bp, Artificial Sequence
  chemically synthesized
ctcactgcaacctccgcctc

SEQ ID NO: 473005 - DNA, 20 bp, Artificial Sequence
  chemically synthesized
tacttgggaggctgaggcag

SEQ ID NO: 473006 - DNA, 20 bp, Artificial Sequence
  chemically synthesized
gcctcagcctcccaagtagc

SEQ ID NO: 473007 - DNA, 20 bp, Artificial Sequence
  chemically synthesized
tttgtatttttcagtagaga

SEQ ID NO: 473008 - DNA, 20 bp, Artificial Sequence
  chemically synthesized
tgggtggatcacctgaggtc

SEQ ID NO: 473009 - DNA, 20 bp, Artificial Sequence
  chemically synthesized
actttgggaggccaaggtgg

SEQ ID NO: 473010 - DNA, 20 bp, Artificial Sequence
  chemically synthesized
cagcactttgggaggccaag

SEQ ID NO: 473011 - DNA, 20 bp, Artificial Sequence
  chemically synthesized
accttggcctcccaaagtgc

SEQ ID NO: 473012 - DNA, 20 bp, Artificial Sequence
  chemically synthesized
gcccgagatattcatcttat

SEQ ID NO: 473013 - DNA, 20 bp, Artificial Sequence
  chemically synthesized
tacttagccattctgataag

SEQ ID NO: 473014 - DNA, 20 bp, Artificial Sequence
  chemically synthesized
gagaaactgatttttcatca

SEQ ID NO: 473015 - DNA, 20 bp, Artificial Sequence
  chemically synthesized
ggtccctgatctcacctagc

SEQ ID NO: 473016 - DNA, 20 bp, Artificial Sequence
  chemically synthesized
cttttgataggaacttagca

SEQ ID NO: 473017 - DNA, 20 bp, Artificial Sequence
  chemically synthesized
tttgctaagttcctatcaaa

SEQ ID NO: 473018 - DNA, 20 bp, Artificial Sequence
  chemically synthesized
caaaaggaataccctctact

SEQ ID NO: 473019 - DNA, 20 bp, Artificial Sequence
  chemically synthesized
ctacatgcaaatccaaagta

SEQ ID NO: 473020 - DNA, 20 bp, Artificial Sequence
  chemically synthesized
aaaggagatgttctatctag

SEQ ID NO: 473021 - DNA, 20 bp, Artificial Sequence
  chemically synthesized
acatctcctttctctcactg

SEQ ID NO: 473022 - DNA, 20 bp, Artificial Sequence
  chemically synthesized
ctcctttctctcactgtgga

SEQ ID NO: 473023 - DNA, 20 bp, Artificial Sequence
  chemically synthesized
atgggagtagaatggaaggg

SEQ ID NO: 473024 - DNA, 20 bp, Artificial Sequence
  chemically synthesized
aatagtgggtgcaatgggag

SEQ ID NO: 473025 - DNA, 20 bp, Artificial Sequence
  chemically synthesized
tagtaaatagtgggtgcaat

SEQ ID NO: 473026 - DNA, 20 bp, Artificial Sequence
  chemically synthesized
tcctacagtggtagtaaata

SEQ ID NO: 473027 - DNA, 20 bp, Artificial Sequence
  chemically synthesized
ctgaaatatgaagataaaaa

SEQ ID NO: 473028 - DNA, 20 bp, Artificial Sequence
  chemically synthesized
tcctatatttattaacaaaa

SEQ ID NO: 473029 - DNA, 20 bp, Artificial Sequence
  chemically synthesized
tcgtttttgttaataaatat

SEQ ID NO: 473030 - DNA, 20 bp, Artificial Sequence
  chemically synthesized
ttttgttaataaatatagga

SEQ ID NO: 473031 - DNA, 20 bp, Artificial Sequence
  chemically synthesized
gttaataaatataggaatga

SEQ ID NO: 473032 - DNA, 20 bp, Artificial Sequence
  chemically synthesized
ataaatataggaatgaatga

SEQ ID NO: 473033 - DNA, 20 bp, Artificial Sequence
  chemically synthesized
caccatgtcacttcttagct

SEQ ID NO: 473034 - DNA, 20 bp, Artificial Sequence
  chemically synthesized
ctttgtgagaagggaagtca

SEQ ID NO: 473035 - DNA, 20 bp, Artificial Sequence
  chemically synthesized
tgaccaagggccagacgagg

SEQ ID NO: 473036 - DNA, 20 bp, Artificial Sequence
  chemically synthesized
tggtgaatgataggaggtca

SEQ ID NO: 473037 - DNA, 20 bp, Artificial Sequence
  chemically synthesized
gaagccaaggaagaaagatg

SEQ ID NO: 473038 - DNA, 20 bp, Artificial Sequence
  chemically synthesized
tccaagatggagcatgctta

SEQ ID NO: 473039 - DNA, 20 bp, Artificial Sequence
  chemically synthesized
ccctctaagcatgctccatc

SEQ ID NO: 473040 - DNA, 20 bp, Artificial Sequence
  chemically synthesized
tggaggaaacagtaaaagta

SEQ ID NO: 473041 - DNA, 20 bp, Artificial Sequence
  chemically synthesized
acccttttagtggagtggtc

SEQ ID NO: 473042 - DNA, 20 bp, Artificial Sequence
  chemically synthesized
attcctgaccactccactaa

SEQ ID NO: 473043 - DNA, 20 bp, Artificial Sequence
  chemically synthesized
ggagaaggggacccttttag

SEQ ID NO: 473044 - DNA, 20 bp, Artificial Sequence
  chemically synthesized
aaagcaggctaaaggggcta

SEQ ID NO: 473045 - DNA, 20 bp, Artificial Sequence
  chemically synthesized
ataagtttgatttaaaaaca

SEQ ID NO: 473046 - DNA, 20 bp, Artificial Sequence
  chemically synthesized
cgtttccccagttcctagat

SEQ ID NO: 473047 - DNA, 20 bp, Artificial Sequence
  chemically synthesized
tgttactcaacaaatgtctg

SEQ ID NO: 473048 - DNA, 20 bp, Artificial Sequence
  chemically synthesized
ggtcattcaacagacatttg

SEQ ID NO: 473049 - DNA, 20 bp, Artificial Sequence
  chemically synthesized
gacatttgttgagtaacaaa

SEQ ID NO: 473050 - DNA, 20 bp, Artificial Sequence
  chemically synthesized
cactttatcttcagtcagtt

SEQ ID NO: 473051 - DNA, 20 bp, Artificial Sequence
  chemically synthesized
tgcttagtctaatgtccaga

SEQ ID NO: 473052 - DNA, 20 bp, Artificial Sequence
  chemically synthesized
gcaggatatgccttgattga

SEQ ID NO: 473053 - DNA, 20 bp, Artificial Sequence
  chemically synthesized
agatgcaggatatgccttga

SEQ ID NO: 473054 - DNA, 20 bp, Artificial Sequence
  chemically synthesized
aacatcttgcatattagatg

SEQ ID NO: 473055 - DNA, 20 bp, Artificial Sequence
  chemically synthesized
gatcttgaaaggaaatatgt

SEQ ID NO: 473056 - DNA, 20 bp, Artificial Sequence
  chemically synthesized
catacatgcccatgacaggc

SEQ ID NO: 473057 - DNA, 20 bp, Artificial Sequence
  chemically synthesized
tggggacagcataaaattac

SEQ ID NO: 473058 - DNA, 20 bp, Artificial Sequence
  chemically synthesized
atgaggttgattattttgtt

SEQ ID NO: 473059 - DNA, 20 bp, Artificial Sequence
  chemically synthesized
atcaacctcattatgaaagc

SEQ ID NO: 473060 - DNA, 20 bp, Artificial Sequence
  chemically synthesized
taataggcccattacagtca

SEQ ID NO: 473061 - DNA, 20 bp, Artificial Sequence
  chemically synthesized
ctgctctctaatcattgcct

SEQ ID NO: 473062 - DNA, 20 bp, Artificial Sequence
  chemically synthesized
ctaaggcaatgattagagag

SEQ ID NO: 473063 - DNA, 20 bp, Artificial Sequence
  chemically synthesized
ggaagggaagtgaaagaaac

SEQ ID NO: 473064 - DNA, 20 bp, Artificial Sequence
  chemically synthesized
agaaatagggagaagtcaag

SEQ ID NO: 473065 - DNA, 20 bp, Artificial Sequence
  chemically synthesized
ggggttgaatgagactgtca

SEQ ID NO: 473066 - DNA, 20 bp, Artificial Sequence
  chemically synthesized
gctcaagagctcccatgggg

SEQ ID NO: 473067 - DNA, 20 bp, Artificial Sequence
  chemically synthesized
ttctagctcaagagctccca

SEQ ID NO: 473068 - DNA, 20 bp, Artificial Sequence
  chemically synthesized
ccccatgggagctcttgagc

SEQ ID NO: 473069 - DNA, 20 bp, Artificial Sequence
  chemically synthesized
gctagaatgttaatgttctc

SEQ ID NO: 473070 - DNA, 20 bp, Artificial Sequence
  chemically synthesized
gctcttcctgatcagtgtag

SEQ ID NO: 473071 - DNA, 20 bp, Artificial Sequence
  chemically synthesized
caggaagagctgcccctgta

SEQ ID NO: 473072 - DNA, 20 bp, Artificial Sequence
  chemically synthesized
cccctgtaaggggtatgatc

SEQ ID NO: 473073 - DNA, 20 bp, Artificial Sequence
  chemically synthesized
gtcctcagcagacaatcttc

SEQ ID NO: 473074 - DNA, 20 bp, Artificial Sequence
  chemically synthesized
cctttagtctctcgatgaaa

SEQ ID NO: 473075 - DNA, 20 bp, Artificial Sequence
  chemically synthesized
tccctttcatcgagagacta

SEQ ID NO: 473076 - DNA, 20 bp, Artificial Sequence
  chemically synthesized
cgagagactaaagggtccct

SEQ ID NO: 473077 - DNA, 20 bp, Artificial Sequence
  chemically synthesized
aatacagtgacctatgcctg

SEQ ID NO: 473078 - DNA, 20 bp, Artificial Sequence
  chemically synthesized
ttgtgcaggcattggtataa

SEQ ID NO: 473079 - DNA, 20 bp, Artificial Sequence
  chemically synthesized
gggtgaaattgcccctagtt

SEQ ID NO: 473080 - DNA, 20 bp, Artificial Sequence
  chemically synthesized
tgtctgtctgatgtcccctg

SEQ ID NO: 473081 - DNA, 20 bp, Artificial Sequence
  chemically synthesized
ggttgtcacagctaagggag

SEQ ID NO: 473082 - DNA, 20 bp, Artificial Sequence
  chemically synthesized
gggagtgctactggcatgta

SEQ ID NO: 473083 - DNA, 20 bp, Artificial Sequence
  chemically synthesized
gctttgcgcaacagaaatgg

SEQ ID NO: 473084 - DNA, 20 bp, Artificial Sequence
  chemically synthesized
tagcattttgtcatctgtcc

SEQ ID NO: 473085 - DNA, 20 bp, Artificial Sequence
  chemically synthesized
aggcatttgtgagtttggcc

SEQ ID NO: 473086 - DNA, 20 bp, Artificial Sequence
  chemically synthesized
ctcagaaaatgaaggcattt

SEQ ID NO: 473087 - DNA, 20 bp, Artificial Sequence
  chemically synthesized
ctcacaaatgccttcatttt

SEQ ID NO: 473088 - DNA, 20 bp, Artificial Sequence
  chemically synthesized
atttggggccagataattag

SEQ ID NO: 473089 - DNA, 20 bp, Artificial Sequence
  chemically synthesized
tgagatggcattacccttag

SEQ ID NO: 473090 - DNA, 20 bp, Artificial Sequence
  chemically synthesized
tagttatttattatccatct

SEQ ID NO: 473091 - DNA, 20 bp, Artificial Sequence
  chemically synthesized
ctccaagacaaagcatctga

SEQ ID NO: 473092 - DNA, 20 bp, Artificial Sequence
  chemically synthesized
gatgctttgtcttggagagc

SEQ ID NO: 473093 - DNA, 20 bp, Artificial Sequence
  chemically synthesized
gagataaacagagatgacag

SEQ ID NO: 473094 - DNA, 20 bp, Artificial Sequence
  chemically synthesized
gggtggggaagtttaaaaag

SEQ ID NO: 473095 - DNA, 20 bp, Artificial Sequence
  chemically synthesized
aaaaaaaaagaaagaaagaa

SEQ ID NO: 473096 - DNA, 20 bp, Artificial Sequence
  chemically synthesized
ctttttttttttttttgaga

SEQ ID NO: 473097 - DNA, 20 bp, Artificial Sequence
  chemically synthesized
ctcactgcaacctccgtctc

SEQ ID NO: 473098 - DNA, 20 bp, Artificial Sequence
  chemically synthesized
tactcaggaggctgaggcag

SEQ ID NO: 473099 - DNA, 20 bp, Artificial Sequence
  chemically synthesized
gattctcctgcctcagcctc

SEQ ID NO: 473100 - DNA, 20 bp, Artificial Sequence
  chemically synthesized
gcctcagcctcctgagtagc

SEQ ID NO: 473101 - DNA, 20 bp, Artificial Sequence
  chemically synthesized
ttttgtgtctttagtagaga

SEQ ID NO: 473102 - DNA, 20 bp, Artificial Sequence
  chemically synthesized
ggcgggcggatcacgaggtc

SEQ ID NO: 473103 - DNA, 20 bp, Artificial Sequence
  chemically synthesized
actttgggaggctgaggcgg

SEQ ID NO: 473104 - DNA, 20 bp, Artificial Sequence
  chemically synthesized
gcctcagcctcccaaagtgc

SEQ ID NO: 473105 - DNA, 20 bp, Artificial Sequence
  chemically synthesized
tcaggatacagagaggcatg

SEQ ID NO: 473106 - DNA, 20 bp, Artificial Sequence
  chemically synthesized
taggtgataaggaacatttt

SEQ ID NO: 473107 - DNA, 20 bp, Artificial Sequence
  chemically synthesized
tccttaaggctgtaagggac

SEQ ID NO: 473108 - DNA, 20 bp, Artificial Sequence
  chemically synthesized
tgaaagtctatttaaaaatc

SEQ ID NO: 473109 - DNA, 20 bp, Artificial Sequence
  chemically synthesized
ttttcagaacacaaccagtt

SEQ ID NO: 473110 - DNA, 20 bp, Artificial Sequence
  chemically synthesized
cattactttcgtttttccat

SEQ ID NO: 473111 - DNA, 20 bp, Artificial Sequence
  chemically synthesized
aagtaatgattcttgcccac

SEQ ID NO: 473112 - DNA, 20 bp, Artificial Sequence
  chemically synthesized
gggatcacatccctgtgggc

SEQ ID NO: 473113 - DNA, 20 bp, Artificial Sequence
  chemically synthesized
gctttgcacaacagaaatag

SEQ ID NO: 473114 - DNA, 20 bp, Artificial Sequence
  chemically synthesized
aggcatttgtgaatttggcc

SEQ ID NO: 473115 - DNA, 20 bp, Artificial Sequence
  chemically synthesized
cccagaaaatgaaggcattt

SEQ ID NO: 473116 - DNA, 20 bp, Artificial Sequence
  chemically synthesized
ttcacaaatgccttcatttt

SEQ ID NO: 473117 - DNA, 20 bp, Artificial Sequence
  chemically synthesized
ttggtggaatgctggctctg

SEQ ID NO: 473118 - DNA, 20 bp, Artificial Sequence
  chemically synthesized
taacatgggcactattttgg

SEQ ID NO: 473119 - DNA, 20 bp, Artificial Sequence
  chemically synthesized
aagagaccagcaccagagtt

SEQ ID NO: 473120 - DNA, 20 bp, Artificial Sequence
  chemically synthesized
tagggccaagagaccagcac

SEQ ID NO: 473121 - DNA, 20 bp, Artificial Sequence
  chemically synthesized
tagctcctcatgaggcccag

SEQ ID NO: 473122 - DNA, 20 bp, Artificial Sequence
  chemically synthesized
tccatgtaagtccgtgacga

SEQ ID NO: 473123 - DNA, 20 bp, Artificial Sequence
  chemically synthesized
agctgaatgggcgcatttag

SEQ ID NO: 473124 - DNA, 20 bp, Artificial Sequence
  chemically synthesized
tgcataatctggctttagag

SEQ ID NO: 473125 - DNA, 20 bp, Artificial Sequence
  chemically synthesized
ctctaaagccagattatgca

SEQ ID NO: 473126 - DNA, 20 bp, Artificial Sequence
  chemically synthesized
accagctcagtaaaagggat

SEQ ID NO: 473127 - DNA, 20 bp, Artificial Sequence
  chemically synthesized
gggtgaaccagctcagtaaa

SEQ ID NO: 473128 - DNA, 20 bp, Artificial Sequence
  chemically synthesized
aacactcacaacaactgcgg

SEQ ID NO: 473129 - DNA, 20 bp, Artificial Sequence
  chemically synthesized
ttcacccagccgcagttgtt

SEQ ID NO: 473130 - DNA, 20 bp, Artificial Sequence
  chemically synthesized
cagttcccatttggccaagg

SEQ ID NO: 473131 - DNA, 20 bp, Artificial Sequence
  chemically synthesized
tcattggctgtggatttctg

SEQ ID NO: 473132 - DNA, 20 bp, Artificial Sequence
  chemically synthesized
gtgtgaattagtcattggct

SEQ ID NO: 473133 - DNA, 20 bp, Artificial Sequence
  chemically synthesized
ctgggcttttattttcccgt

SEQ ID NO: 473134 - DNA, 20 bp, Artificial Sequence
  chemically synthesized
gcctcggtctccaaaagtgc

SEQ ID NO: 473135 - DNA, 20 bp, Artificial Sequence
  chemically synthesized
acttttggagaccgaggcag

SEQ ID NO: 473136 - DNA, 20 bp, Artificial Sequence
  chemically synthesized
ggcaggcggatcaggagatc

SEQ ID NO: 473137 - DNA, 20 bp, Artificial Sequence
  chemically synthesized
ttttgtatttttactagaga

SEQ ID NO: 473138 - DNA, 20 bp, Artificial Sequence
  chemically synthesized
agtagctgggactaccgcgc

SEQ ID NO: 473139 - DNA, 20 bp, Artificial Sequence
  chemically synthesized
tattctcctgcctcagcctc

SEQ ID NO: 473140 - DNA, 20 bp, Artificial Sequence
  chemically synthesized
tactcgggaggctgaggcag

SEQ ID NO: 473141 - DNA, 20 bp, Artificial Sequence
  chemically synthesized
tcacgccattgcactccagt

SEQ ID NO: 473142 - DNA, 20 bp, Artificial Sequence
  chemically synthesized
tcttgttctgtcacccaaac

SEQ ID NO: 473143 - DNA, 20 bp, Artificial Sequence
  chemically synthesized
tttgtttgtttgttttgaga

SEQ ID NO: 473144 - DNA, 20 bp, Artificial Sequence
  chemically synthesized
ttgttctccagagctccctg

SEQ ID NO: 473145 - DNA, 20 bp, Artificial Sequence
  chemically synthesized
ccctgtgggatcaagctgaa

SEQ ID NO: 473146 - DNA, 20 bp, Artificial Sequence
  chemically synthesized
agtaagaaggatgctggtca

SEQ ID NO: 473147 - DNA, 20 bp, Artificial Sequence
  chemically synthesized
gggaagcaggataaagtaag

SEQ ID NO: 473148 - DNA, 20 bp, Artificial Sequence
  chemically synthesized
gtgaaagggagtgagggaag

SEQ ID NO: 473149 - DNA, 20 bp, Artificial Sequence
  chemically synthesized
agtaatttgttcaggtgaaa

SEQ ID NO: 473150 - DNA, 20 bp, Artificial Sequence
  chemically synthesized
ctaaatagggctctacttct

SEQ ID NO: 473151 - DNA, 20 bp, Artificial Sequence
  chemically synthesized
ctagggattttacctaaggc

SEQ ID NO: 473152 - DNA, 20 bp, Artificial Sequence
  chemically synthesized
acagagatttcctggaaaat

SEQ ID NO: 473153 - DNA, 20 bp, Artificial Sequence
  chemically synthesized
gactttcccggatttagcac

SEQ ID NO: 473154 - DNA, 20 bp, Artificial Sequence
  chemically synthesized
ctggtttgtctgggactttc

SEQ ID NO: 473155 - DNA, 20 bp, Artificial Sequence
  chemically synthesized
cgggaaagtcccagacaaac

SEQ ID NO: 473156 - DNA, 20 bp, Artificial Sequence
  chemically synthesized
aaagtcccagacaaaccagg

SEQ ID NO: 473157 - DNA, 20 bp, Artificial Sequence
  chemically synthesized
ccaaatatttatgtgcgttg

SEQ ID NO: 473158 - DNA, 20 bp, Artificial Sequence
  chemically synthesized
tctgcaacgcacataaatat

SEQ ID NO: 473159 - DNA, 20 bp, Artificial Sequence
  chemically synthesized
aacttagcaggaaggatgct

SEQ ID NO: 473160 - DNA, 20 bp, Artificial Sequence
  chemically synthesized
atcttcataaacttagcagg

SEQ ID NO: 473161 - DNA, 20 bp, Artificial Sequence
  chemically synthesized
cactcaagtccctgtaggca

SEQ ID NO: 473162 - DNA, 20 bp, Artificial Sequence
  chemically synthesized
gattctttgcctacagggac

SEQ ID NO: 473163 - DNA, 20 bp, Artificial Sequence
  chemically synthesized
gactaatttatctatgttat

SEQ ID NO: 473164 - DNA, 20 bp, Artificial Sequence
  chemically synthesized
gtagtatttgccaatttcca

SEQ ID NO: 473165 - DNA, 20 bp, Artificial Sequence
  chemically synthesized
gagccaattgtaaaatatac

SEQ ID NO: 473166 - DNA, 20 bp, Artificial Sequence
  chemically synthesized
aacgtttttgtttctgctat

SEQ ID NO: 473167 - DNA, 20 bp, Artificial Sequence
  chemically synthesized
tcctcatgtgttcaaattga

SEQ ID NO: 473168 - DNA, 20 bp, Artificial Sequence
  chemically synthesized
ataaatctgagagcttattg

SEQ ID NO: 473169 - DNA, 20 bp, Artificial Sequence
  chemically synthesized
atgacaacacattttaagaa

SEQ ID NO: 473170 - DNA, 20 bp, Artificial Sequence
  chemically synthesized
gggcattggaaaggctgtct

SEQ ID NO: 473171 - DNA, 20 bp, Artificial Sequence
  chemically synthesized
cacatgttgtcccaagtgtt

SEQ ID NO: 473172 - DNA, 20 bp, Artificial Sequence
  chemically synthesized
ttctctttcaagtaaaatct

SEQ ID NO: 473173 - DNA, 20 bp, Artificial Sequence
  chemically synthesized
ccctgagattttacttgaaa

SEQ ID NO: 473174 - DNA, 20 bp, Artificial Sequence
  chemically synthesized
ccatcatgataaaagtcaga

SEQ ID NO: 473175 - DNA, 20 bp, Artificial Sequence
  chemically synthesized
tgcactccagcctgggcaac

SEQ ID NO: 473176 - DNA, 20 bp, Artificial Sequence
  chemically synthesized
ttcactcttgttgcccaggc

SEQ ID NO: 473177 - DNA, 20 bp, Artificial Sequence
  chemically synthesized
ctcactgcaacctctgcctc

SEQ ID NO: 473178 - DNA, 20 bp, Artificial Sequence
  chemically synthesized
tactcgagaggctgaggcag

SEQ ID NO: 473179 - DNA, 20 bp, Artificial Sequence
  chemically synthesized
gattctcctgcctcagcctc

SEQ ID NO: 473180 - DNA, 20 bp, Artificial Sequence
  chemically synthesized
gcctcagcctctcgagtagc

SEQ ID NO: 473181 - DNA, 20 bp, Artificial Sequence
  chemically synthesized
ttttgtatttttagtagaga

SEQ ID NO: 473182 - DNA, 20 bp, Artificial Sequence
  chemically synthesized
cgggcagatcacctgaggtc

SEQ ID NO: 473183 - DNA, 20 bp, Artificial Sequence
  chemically synthesized
gcctcggcctcccaaagtgc

SEQ ID NO: 473184 - DNA, 20 bp, Artificial Sequence
  chemically synthesized
ttaaataagccatcatgagg

SEQ ID NO: 473185 - DNA, 20 bp, Artificial Sequence
  chemically synthesized
ggggacagacaatttgaaat

SEQ ID NO: 473186 - DNA, 20 bp, Artificial Sequence
  chemically synthesized
ttaagtgtgtatgtgtagtg

SEQ ID NO: 473187 - DNA, 20 bp, Artificial Sequence
  chemically synthesized
tatgtgtagtggggaatgtc

SEQ ID NO: 473188 - DNA, 20 bp, Artificial Sequence
  chemically synthesized
tagcagtttgtttctatctt

SEQ ID NO: 473189 - DNA, 20 bp, Artificial Sequence
  chemically synthesized
caaggagaaactgtaaaagc

SEQ ID NO: 473190 - DNA, 20 bp, Artificial Sequence
  chemically synthesized
agagagaaaaagacttaacc

SEQ ID NO: 473191 - DNA, 20 bp, Artificial Sequence
  chemically synthesized
tgtaaagcctgcaagaaata

SEQ ID NO: 473192 - DNA, 20 bp, Artificial Sequence
  chemically synthesized
tgaatttaaaagctgtttca

SEQ ID NO: 473193 - DNA, 20 bp, Artificial Sequence
  chemically synthesized
aatgaaacagcttttaaatt

SEQ ID NO: 473194 - DNA, 20 bp, Artificial Sequence
  chemically synthesized
tttcctttttactatttatt

SEQ ID NO: 473195 - DNA, 20 bp, Artificial Sequence
  chemically synthesized
taaaaaggaaatttgtcttt

SEQ ID NO: 473196 - DNA, 20 bp, Artificial Sequence
  chemically synthesized
agaggtcactggttaaaagc

SEQ ID NO: 473197 - DNA, 20 bp, Artificial Sequence
  chemically synthesized
aaaaacgaccatataaagtt

SEQ ID NO: 473198 - DNA, 20 bp, Artificial Sequence
  chemically synthesized
agaaaaggtcacattattta

SEQ ID NO: 473199 - DNA, 20 bp, Artificial Sequence
  chemically synthesized
ctctgtgtattatcaatgtc

SEQ ID NO: 473200 - DNA, 20 bp, Artificial Sequence
  chemically synthesized
gtgtattatcaatgtcaaga

SEQ ID NO: 473201 - DNA, 20 bp, Artificial Sequence
  chemically synthesized
tgaatttacctcttcttctt

SEQ ID NO: 473202 - DNA, 20 bp, Artificial Sequence
  chemically synthesized
gttcagtaaatatttacaga

SEQ ID NO: 473203 - DNA, 20 bp, Artificial Sequence
  chemically synthesized
agatgttcagtaaatattta

SEQ ID NO: 473204 - DNA, 20 bp, Artificial Sequence
  chemically synthesized
acataccacattaggtactg

SEQ ID NO: 473205 - DNA, 20 bp, Artificial Sequence
  chemically synthesized
gaccttaatctctaaaatgt

SEQ ID NO: 473206 - DNA, 20 bp, Artificial Sequence
  chemically synthesized
aatagttgtttgtataacta

SEQ ID NO: 473207 - DNA, 20 bp, Artificial Sequence
  chemically synthesized
cctttctgaagatgatttcc

SEQ ID NO: 473208 - DNA, 20 bp, Artificial Sequence
  chemically synthesized
atactgaccattaaatgcaa

SEQ ID NO: 473209 - DNA, 20 bp, Artificial Sequence
  chemically synthesized
tgaccattaaatgcaagaga

SEQ ID NO: 473210 - DNA, 20 bp, Artificial Sequence
  chemically synthesized
ataacttaatgcatgcctgt

SEQ ID NO: 473211 - DNA, 20 bp, Artificial Sequence
  chemically synthesized
ctaaagctaatagcaaacac

SEQ ID NO: 473212 - DNA, 20 bp, Artificial Sequence
  chemically synthesized
tatgttccaggcactactct

SEQ ID NO: 473213 - DNA, 20 bp, Artificial Sequence
  chemically synthesized
gttaatatttgtaaaaccct

SEQ ID NO: 473214 - DNA, 20 bp, Artificial Sequence
  chemically synthesized
aatatggctgtattatttca

SEQ ID NO: 473215 - DNA, 20 bp, Artificial Sequence
  chemically synthesized
aataatacagccatatttca

SEQ ID NO: 473216 - DNA, 20 bp, Artificial Sequence
  chemically synthesized
accatacgaccaatgggata

SEQ ID NO: 473217 - DNA, 20 bp, Artificial Sequence
  chemically synthesized
agaatgcaccatacgaccaa

SEQ ID NO: 473218 - DNA, 20 bp, Artificial Sequence
  chemically synthesized
cgtttcaacagttctgaaat

SEQ ID NO: 473219 - DNA, 20 bp, Artificial Sequence
  chemically synthesized
gatttcagaactgttgaaac

SEQ ID NO: 473220 - DNA, 20 bp, Artificial Sequence
  chemically synthesized
ttattcttcatctttaaaat

SEQ ID NO: 473221 - DNA, 20 bp, Artificial Sequence
  chemically synthesized
ttatccctattttaaagatg

SEQ ID NO: 473222 - DNA, 20 bp, Artificial Sequence
  chemically synthesized
aagaaaaaagcataaagtgt

SEQ ID NO: 473223 - DNA, 20 bp, Artificial Sequence
  chemically synthesized
aagctgtaaaatgaaactga

SEQ ID NO: 473224 - DNA, 20 bp, Artificial Sequence
  chemically synthesized
aaatggtatcgatagcggtt

SEQ ID NO: 473225 - DNA, 20 bp, Artificial Sequence
  chemically synthesized
ttaggttatgtaaatcaact

SEQ ID NO: 473226 - DNA, 20 bp, Artificial Sequence
  chemically synthesized
cttaggatggccaaacgaag

SEQ ID NO: 473227 - DNA, 20 bp, Artificial Sequence
  chemically synthesized
aaacgaagaggaatatacga

SEQ ID NO: 473228 - DNA, 20 bp, Artificial Sequence
  chemically synthesized
ggcctgggcatttcttctta

SEQ ID NO: 473229 - DNA, 20 bp, Artificial Sequence
  chemically synthesized
aaggcagtgtgatgtgtggc

SEQ ID NO: 473230 - DNA, 20 bp, Artificial Sequence
  chemically synthesized
gtggcttggatgtccagaaa

SEQ ID NO: 473231 - DNA, 20 bp, Artificial Sequence
  chemically synthesized
ctgtaaaataaggaaagggc

SEQ ID NO: 473232 - DNA, 20 bp, Artificial Sequence
  chemically synthesized
tcgaaatagtttgagaaaca

SEQ ID NO: 473233 - DNA, 20 bp, Artificial Sequence
  chemically synthesized
gtgtaaaacgtttttcttct

SEQ ID NO: 473234 - DNA, 20 bp, Artificial Sequence
  chemically synthesized
tggaacagattagaaaatat

SEQ ID NO: 473235 - DNA, 20 bp, Artificial Sequence
  chemically synthesized
ttgactggtatggaatggaa

SEQ ID NO: 473236 - DNA, 20 bp, Artificial Sequence
  chemically synthesized
aatttttgactggtatggaa

SEQ ID NO: 473237 - DNA, 20 bp, Artificial Sequence
  chemically synthesized
ccaacaatttttgactggta

SEQ ID NO: 473238 - DNA, 20 bp, Artificial Sequence
  chemically synthesized
gtaagtcattaaactgattt

SEQ ID NO: 473239 - DNA, 20 bp, Artificial Sequence
  chemically synthesized
tttgctaatgagccacacct

SEQ ID NO: 473240 - DNA, 20 bp, Artificial Sequence
  chemically synthesized
ccaggagccctcttgtgctg

SEQ ID NO: 473241 - DNA, 20 bp, Artificial Sequence
  chemically synthesized
tccacagcacaagagggctc

SEQ ID NO: 473242 - DNA, 20 bp, Artificial Sequence
  chemically synthesized
gcacaagagggctcctgggt

SEQ ID NO: 473243 - DNA, 20 bp, Artificial Sequence
  chemically synthesized
aatgagtatttatgaggcaa

SEQ ID NO: 473244 - DNA, 20 bp, Artificial Sequence
  chemically synthesized
gtgatccaattaaaaagaaa

SEQ ID NO: 473245 - DNA, 20 bp, Artificial Sequence
  chemically synthesized
aatactcattttctttttaa

SEQ ID NO: 473246 - DNA, 20 bp, Artificial Sequence
  chemically synthesized
actttatgccatggatcaca

SEQ ID NO: 473247 - DNA, 20 bp, Artificial Sequence
  chemically synthesized
ttcacactaaactttatgcc

SEQ ID NO: 473248 - DNA, 20 bp, Artificial Sequence
  chemically synthesized
actgagactctaagaggata

SEQ ID NO: 473249 - DNA, 20 bp, Artificial Sequence
  chemically synthesized
ctatagactccttatcctct

SEQ ID NO: 473250 - DNA, 20 bp, Artificial Sequence
  chemically synthesized
attatacactgagactctaa

SEQ ID NO: 473251 - DNA, 20 bp, Artificial Sequence
  chemically synthesized
cagtgtataataaaaattcc

SEQ ID NO: 473252 - DNA, 20 bp, Artificial Sequence
  chemically synthesized
ttatttcttgttagaattct

SEQ ID NO: 473253 - DNA, 20 bp, Artificial Sequence
  chemically synthesized
taagcaagtttatttcttgt

SEQ ID NO: 473254 - DNA, 20 bp, Artificial Sequence
  chemically synthesized
aagttccagaggtcccttaa

SEQ ID NO: 473255 - DNA, 20 bp, Artificial Sequence
  chemically synthesized
tgtaaaatattaagaaaacc

SEQ ID NO: 473256 - DNA, 20 bp, Artificial Sequence
  chemically synthesized
aatcattctataacagtaaa

SEQ ID NO: 473257 - DNA, 20 bp, Artificial Sequence
  chemically synthesized
atggattctttttactgtta

SEQ ID NO: 473258 - DNA, 20 bp, Artificial Sequence
  chemically synthesized
caagaaagatcactatatat

SEQ ID NO: 473259 - DNA, 20 bp, Artificial Sequence
  chemically synthesized
atctttcttggtgagaaaag

SEQ ID NO: 473260 - DNA, 20 bp, Artificial Sequence
  chemically synthesized
gaatttagaacagaagacca

SEQ ID NO: 473261 - DNA, 20 bp, Artificial Sequence
  chemically synthesized
gagagactctgtctcaaaaa

SEQ ID NO: 473262 - DNA, 20 bp, Artificial Sequence
  chemically synthesized
tttaaattctttttttgaga

SEQ ID NO: 473263 - DNA, 20 bp, Artificial Sequence
  chemically synthesized
tcatgccactgcagtccagc

SEQ ID NO: 473264 - DNA, 20 bp, Artificial Sequence
  chemically synthesized
ctcactgcaacctccacctc

SEQ ID NO: 473265 - DNA, 20 bp, Artificial Sequence
  chemically synthesized
tgcttaggaggctgaggcag

SEQ ID NO: 473266 - DNA, 20 bp, Artificial Sequence
  chemically synthesized
gcctcagcctcctaagcagc

SEQ ID NO: 473267 - DNA, 20 bp, Artificial Sequence
  chemically synthesized
ctaagcagctgggattacag

SEQ ID NO: 473268 - DNA, 20 bp, Artificial Sequence
  chemically synthesized
tttgtatttttagtacagat

SEQ ID NO: 473269 - DNA, 20 bp, Artificial Sequence
  chemically synthesized
tgggcagatcacttgaggtc

SEQ ID NO: 473270 - DNA, 20 bp, Artificial Sequence
  chemically synthesized
acctcagcctcccaaagtga

SEQ ID NO: 473271 - DNA, 20 bp, Artificial Sequence
  chemically synthesized
aaaattgtccttttcttttg

SEQ ID NO: 473272 - DNA, 20 bp, Artificial Sequence
  chemically synthesized
tcagactactatgccaacca

SEQ ID NO: 473273 - DNA, 20 bp, Artificial Sequence
  chemically synthesized
catatttgaagtcacactat

SEQ ID NO: 473274 - DNA, 20 bp, Artificial Sequence
  chemically synthesized
ttaagttgtagaagtcaatt

SEQ ID NO: 473275 - DNA, 20 bp, Artificial Sequence
  chemically synthesized
gttagtgtctatcagcggag

SEQ ID NO: 473276 - DNA, 20 bp, Artificial Sequence
  chemically synthesized
tgggccaccaggaagaaaca

SEQ ID NO: 473277 - DNA, 20 bp, Artificial Sequence
  chemically synthesized
ggcagccttttactaaaaaa

SEQ ID NO: 473278 - DNA, 20 bp, Artificial Sequence
  chemically synthesized
tttccaaataatttccaaag

SEQ ID NO: 473279 - DNA, 20 bp, Artificial Sequence
  chemically synthesized
gtgtgagagagagagagaga

SEQ ID NO: 473280 - DNA, 20 bp, Artificial Sequence
  chemically synthesized
gtgcgagacagagagagaga

SEQ ID NO: 473281 - DNA, 20 bp, Artificial Sequence
  chemically synthesized
cagtaagcatgtttacgctg

SEQ ID NO: 473282 - DNA, 20 bp, Artificial Sequence
  chemically synthesized
caggttactataaataataa

SEQ ID NO: 473283 - DNA, 20 bp, Artificial Sequence
  chemically synthesized
atacttttttttagacaggc

SEQ ID NO: 473284 - DNA, 20 bp, Artificial Sequence
  chemically synthesized
taaggtcatattaaatgaat

SEQ ID NO: 473285 - DNA, 20 bp, Artificial Sequence
  chemically synthesized
ttcctctaaggtcatattaa

SEQ ID NO: 473286 - DNA, 20 bp, Artificial Sequence
  chemically synthesized
ttcatttaatatgaccttag

SEQ ID NO: 473287 - DNA, 20 bp, Artificial Sequence
  chemically synthesized
aaagcagcttccccccacca

SEQ ID NO: 473288 - DNA, 20 bp, Artificial Sequence
  chemically synthesized
tttttttttttttttaaatt

SEQ ID NO: 473289 - DNA, 20 bp, Artificial Sequence
  chemically synthesized
tttttttttaaatttagggt

SEQ ID NO: 473290 - DNA, 20 bp, Artificial Sequence
  chemically synthesized
tcttgctctgtcacacagat

SEQ ID NO: 473291 - DNA, 20 bp, Artificial Sequence
  chemically synthesized
acacagattggagtgcgggg

SEQ ID NO: 473292 - DNA, 20 bp, Artificial Sequence
  chemically synthesized
agattggagtgcgggggggg

SEQ ID NO: 473293 - DNA, 20 bp, Artificial Sequence
  chemically synthesized
agtgcgggggggggtggatt

SEQ ID NO: 473294 - DNA, 20 bp, Artificial Sequence
  chemically synthesized
tctttgggaaactgaggcag

SEQ ID NO: 473295 - DNA, 20 bp, Artificial Sequence
  chemically synthesized
cctcctgcctcagtttccca

SEQ ID NO: 473296 - DNA, 20 bp, Artificial Sequence
  chemically synthesized
gcctcagtttcccaaagaat

SEQ ID NO: 473297 - DNA, 20 bp, Artificial Sequence
  chemically synthesized
atgcctagctcaaatacggt

SEQ ID NO: 473298 - DNA, 20 bp, Artificial Sequence
  chemically synthesized
ctagaaaattgcaccagaaa

SEQ ID NO: 473299 - DNA, 20 bp, Artificial Sequence
  chemically synthesized
caatacacttgaaaaggctt

SEQ ID NO: 473300 - DNA, 20 bp, Artificial Sequence
  chemically synthesized
aaggtggaattgtcatgtta

SEQ ID NO: 473301 - DNA, 20 bp, Artificial Sequence
  chemically synthesized
acaggataaatgcctaaagg

SEQ ID NO: 473302 - DNA, 20 bp, Artificial Sequence
  chemically synthesized
ttaggcatttatcctgtaga

SEQ ID NO: 473303 - DNA, 20 bp, Artificial Sequence
  chemically synthesized
aatatctcagattctttcta

SEQ ID NO: 473304 - DNA, 20 bp, Artificial Sequence
  chemically synthesized
gatatttgtaaaggtataaa

SEQ ID NO: 473305 - DNA, 20 bp, Artificial Sequence
  chemically synthesized
aatctttatattgagcaatt

SEQ ID NO: 473306 - DNA, 20 bp, Artificial Sequence
  chemically synthesized
aatttggtacagccacagaa

SEQ ID NO: 473307 - DNA, 20 bp, Artificial Sequence
  chemically synthesized
ttagaaaaattactctgaag

SEQ ID NO: 473308 - DNA, 20 bp, Artificial Sequence
  chemically synthesized
tgtgtttaaatattcttctt

SEQ ID NO: 473309 - DNA, 20 bp, Artificial Sequence
  chemically synthesized
caacactttgggaggcctca

SEQ ID NO: 473310 - DNA, 20 bp, Artificial Sequence
  chemically synthesized
actttgggaggcctcagtgg

SEQ ID NO: 473311 - DNA, 20 bp, Artificial Sequence
  chemically synthesized
ttttgtatttttagtagaga

SEQ ID NO: 473312 - DNA, 20 bp, Artificial Sequence
  chemically synthesized
tcccgagtagctgggattac

SEQ ID NO: 473313 - DNA, 20 bp, Artificial Sequence
  chemically synthesized
gactcagcctcccgagtagc

SEQ ID NO: 473314 - DNA, 20 bp, Artificial Sequence
  chemically synthesized
aatcccagctactcgggagg

SEQ ID NO: 473315 - DNA, 20 bp, Artificial Sequence
  chemically synthesized
gattctcatgactcagcctc

SEQ ID NO: 473316 - DNA, 20 bp, Artificial Sequence
  chemically synthesized
tactcgggaggctgagtcat

SEQ ID NO: 473317 - DNA, 20 bp, Artificial Sequence
  chemically synthesized
tcactgcaacctcccccgtc

SEQ ID NO: 473318 - DNA, 20 bp, Artificial Sequence
  chemically synthesized
tatttttttgttttttgaga

SEQ ID NO: 473319 - DNA, 20 bp, Artificial Sequence
  chemically synthesized
atttctgatagtgattatct

SEQ ID NO: 473320 - DNA, 20 bp, Artificial Sequence
  chemically synthesized
tagtgattatctctgagtca

SEQ ID NO: 473321 - DNA, 20 bp, Artificial Sequence
  chemically synthesized
tatctctgagtcataggatt

SEQ ID NO: 473322 - DNA, 20 bp, Artificial Sequence
  chemically synthesized
caaatttttcttgatgtgta

SEQ ID NO: 473323 - DNA, 20 bp, Artificial Sequence
  chemically synthesized
ataggacggtgagactaagg

SEQ ID NO: 473324 - DNA, 20 bp, Artificial Sequence
  chemically synthesized
agaaataggacggtgagact

SEQ ID NO: 473325 - DNA, 20 bp, Artificial Sequence
  chemically synthesized
gaaaataccaacttggttta

SEQ ID NO: 473326 - DNA, 20 bp, Artificial Sequence
  chemically synthesized
cagtctcttggatgcccatg

SEQ ID NO: 473327 - DNA, 20 bp, Artificial Sequence
  chemically synthesized
ccccggaagtcatcagtctc

SEQ ID NO: 473328 - DNA, 20 bp, Artificial Sequence
  chemically synthesized
aaagagactgatctacctgc

SEQ ID NO: 473329 - DNA, 20 bp, Artificial Sequence
  chemically synthesized
gcaggtagatcagtctcttt

SEQ ID NO: 473330 - DNA, 20 bp, Artificial Sequence
  chemically synthesized
tgatatggtttgaaaggtgt

SEQ ID NO: 473331 - DNA, 20 bp, Artificial Sequence
  chemically synthesized
tgttctaccacctcaggctt

SEQ ID NO: 473332 - DNA, 20 bp, Artificial Sequence
  chemically synthesized
aagtttaatgtgtacttctc

SEQ ID NO: 473333 - DNA, 20 bp, Artificial Sequence
  chemically synthesized
cattaaactttacctatcac

SEQ ID NO: 473334 - DNA, 20 bp, Artificial Sequence
  chemically synthesized
ttacctatcacttgggttaa

SEQ ID NO: 473335 - DNA, 20 bp, Artificial Sequence
  chemically synthesized
ttttctgaaaataggtttta

SEQ ID NO: 473336 - DNA, 20 bp, Artificial Sequence
  chemically synthesized
ggttttaatgggtaagacat

SEQ ID NO: 473337 - DNA, 20 bp, Artificial Sequence
  chemically synthesized
aagacatgggaattcagagg

SEQ ID NO: 473338 - DNA, 20 bp, Artificial Sequence
  chemically synthesized
tcttctccctgactccccct

SEQ ID NO: 473339 - DNA, 20 bp, Artificial Sequence
  chemically synthesized
ggagtcagggagaagaaaat

SEQ ID NO: 473340 - DNA, 20 bp, Artificial Sequence
  chemically synthesized
tcagggagaagaaaatatga

SEQ ID NO: 473341 - DNA, 20 bp, Artificial Sequence
  chemically synthesized
atgaatatacctggtgtctg

SEQ ID NO: 473342 - DNA, 20 bp, Artificial Sequence
  chemically synthesized
aaataaaaaatagtactatt

SEQ ID NO: 473343 - DNA, 20 bp, Artificial Sequence
  chemically synthesized
ctattttttatttatggttt

SEQ ID NO: 473344 - DNA, 20 bp, Artificial Sequence
  chemically synthesized
ttatggtttatgagtcgctt

SEQ ID NO: 473345 - DNA, 20 bp, Artificial Sequence
  chemically synthesized
cacatttaatctcaattaaa

SEQ ID NO: 473346 - DNA, 20 bp, Artificial Sequence
  chemically synthesized
ttaatctcaattaaatcgaa

SEQ ID NO: 473347 - DNA, 20 bp, Artificial Sequence
  chemically synthesized
aagcagtttatctaaatgag

SEQ ID NO: 473348 - DNA, 20 bp, Artificial Sequence
  chemically synthesized
agttaaagcagtttatctaa

SEQ ID NO: 473349 - DNA, 20 bp, Artificial Sequence
  chemically synthesized
ctttggagttgccaagaaaa

SEQ ID NO: 473350 - DNA, 20 bp, Artificial Sequence
  chemically synthesized
gacacagtttcacaatgctt

SEQ ID NO: 473351 - DNA, 20 bp, Artificial Sequence
  chemically synthesized
tccaaataactagaccacat

SEQ ID NO: 473352 - DNA, 20 bp, Artificial Sequence
  chemically synthesized
tcacaaatactttaaagtat

SEQ ID NO: 473353 - DNA, 20 bp, Artificial Sequence
  chemically synthesized
actttaaagtatttgtgagc

SEQ ID NO: 473354 - DNA, 20 bp, Artificial Sequence
  chemically synthesized
gatctttttattaacccgtg

SEQ ID NO: 473355 - DNA, 20 bp, Artificial Sequence
  chemically synthesized
tcctttcttttccattctcc

SEQ ID NO: 473356 - DNA, 20 bp, Artificial Sequence
  chemically synthesized
tgatcagaaaatggcaatga

SEQ ID NO: 473357 - DNA, 20 bp, Artificial Sequence
  chemically synthesized
gcaatgaaagaatatggcag

SEQ ID NO: 473358 - DNA, 20 bp, Artificial Sequence
  chemically synthesized
gcagaagaatggagatcata

SEQ ID NO: 473359 - DNA, 20 bp, Artificial Sequence
  chemically synthesized
gaaactcaagaagttggctc

SEQ ID NO: 473360 - DNA, 20 bp, Artificial Sequence
  chemically synthesized
cagactctggagccaacttc

SEQ ID NO: 473361 - DNA, 20 bp, Artificial Sequence
  chemically synthesized
cagctagtagatgagggagc

SEQ ID NO: 473362 - DNA, 20 bp, Artificial Sequence
  chemically synthesized
ctccctcatctactagctgt

SEQ ID NO: 473363 - DNA, 20 bp, Artificial Sequence
  chemically synthesized
tcagtttcttcatcattgaa

SEQ ID NO: 473364 - DNA, 20 bp, Artificial Sequence
  chemically synthesized
taataatggtacctacctta

SEQ ID NO: 473365 - DNA, 20 bp, Artificial Sequence
  chemically synthesized
tacctaccttaagggattga

SEQ ID NO: 473366 - DNA, 20 bp, Artificial Sequence
  chemically synthesized
gggattgaagggattgctat

SEQ ID NO: 473367 - DNA, 20 bp, Artificial Sequence
  chemically synthesized
aaagtaattgcgttaaaatg

SEQ ID NO: 473368 - DNA, 20 bp, Artificial Sequence
  chemically synthesized
ggtcatatatgagtatatat

SEQ ID NO: 473369 - DNA, 20 bp, Artificial Sequence
  chemically synthesized
gtatttccttgtggtcatat

SEQ ID NO: 473370 - DNA, 20 bp, Artificial Sequence
  chemically synthesized
atgaccacaaggaaatacat

SEQ ID NO: 473371 - DNA, 20 bp, Artificial Sequence
  chemically synthesized
aaaagccatactttaccaca

SEQ ID NO: 473372 - DNA, 20 bp, Artificial Sequence
  chemically synthesized
tgattataaaagtatatgtg

SEQ ID NO: 473373 - DNA, 20 bp, Artificial Sequence
  chemically synthesized
aatatgcaatattgtataaa

SEQ ID NO: 473374 - DNA, 20 bp, Artificial Sequence
  chemically synthesized
tagcaaaaccagtaaataaa

SEQ ID NO: 473375 - DNA, 20 bp, Artificial Sequence
  chemically synthesized
ctagaggtcaagaacaaaag

SEQ ID NO: 473376 - DNA, 20 bp, Artificial Sequence
  chemically synthesized
aaaaggagaatacaaggctc

SEQ ID NO: 473377 - DNA, 20 bp, Artificial Sequence
  chemically synthesized
gccttggcctcccaaagtgc

SEQ ID NO: 473378 - DNA, 20 bp, Artificial Sequence
  chemically synthesized
tagcactttgggaggccaag

SEQ ID NO: 473379 - DNA, 20 bp, Artificial Sequence
  chemically synthesized
actttgggaggccaaggcga

SEQ ID NO: 473380 - DNA, 20 bp, Artificial Sequence
  chemically synthesized
tattctcctgcctcagcctc

SEQ ID NO: 473381 - DNA, 20 bp, Artificial Sequence
  chemically synthesized
tactcgggaggctgaggcag

SEQ ID NO: 473382 - DNA, 20 bp, Artificial Sequence
  chemically synthesized
ctcactgcaacctccgcctc

SEQ ID NO: 473383 - DNA, 20 bp, Artificial Sequence
  chemically synthesized
cacgccactgcactcacagc

SEQ ID NO: 473384 - DNA, 20 bp, Artificial Sequence
  chemically synthesized
ctcattctgtcacccaggct

SEQ ID NO: 473385 - DNA, 20 bp, Artificial Sequence
  chemically synthesized
tgcactcacagcctgggtga

SEQ ID NO: 473386 - DNA, 20 bp, Artificial Sequence
  chemically synthesized
aaaaaaaaaaaaaaaaaagg

SEQ ID NO: 473387 - DNA, 20 bp, Artificial Sequence
  chemically synthesized
aatgtgatattttactggca

SEQ ID NO: 473388 - DNA, 20 bp, Artificial Sequence
  chemically synthesized
agaatgcataatgatcaagt

SEQ ID NO: 473389 - DNA, 20 bp, Artificial Sequence
  chemically synthesized
tatttgaggcatccattact

SEQ ID NO: 473390 - DNA, 20 bp, Artificial Sequence
  chemically synthesized
aatgacaaatactcaaagta

SEQ ID NO: 473391 - DNA, 20 bp, Artificial Sequence
  chemically synthesized
aagtaccaagaagaaagggc

SEQ ID NO: 473392 - DNA, 20 bp, Artificial Sequence
  chemically synthesized
tatatcatttgacagcagaa

SEQ ID NO: 473393 - DNA, 20 bp, Artificial Sequence
  chemically synthesized
tacgttatatcatttgacag

SEQ ID NO: 473394 - DNA, 20 bp, Artificial Sequence
  chemically synthesized
aacgtagtccttctatctaa

SEQ ID NO: 473395 - DNA, 20 bp, Artificial Sequence
  chemically synthesized
agataaagagagggtggtta

SEQ ID NO: 473396 - DNA, 20 bp, Artificial Sequence
  chemically synthesized
ggtagagggggagataaaga

SEQ ID NO: 473397 - DNA, 20 bp, Artificial Sequence
  chemically synthesized
ctagtggctgggaaaggtgt

SEQ ID NO: 473398 - DNA, 20 bp, Artificial Sequence
  chemically synthesized
aattgataataaacatagaa

SEQ ID NO: 473399 - DNA, 20 bp, Artificial Sequence
  chemically synthesized
aaaaaaattgataataaaca

SEQ ID NO: 473400 - DNA, 20 bp, Artificial Sequence
  chemically synthesized
tcaatttttttagctcccac

SEQ ID NO: 473401 - DNA, 20 bp, Artificial Sequence
  chemically synthesized
cgatttttgtctttctgtgc

SEQ ID NO: 473402 - DNA, 20 bp, Artificial Sequence
  chemically synthesized
ccagttccatccatgttgct

SEQ ID NO: 473403 - DNA, 20 bp, Artificial Sequence
  chemically synthesized
accatgtcattcacagcaac

SEQ ID NO: 473404 - DNA, 20 bp, Artificial Sequence
  chemically synthesized
tgtacacaatgaaacactgc

SEQ ID NO: 473405 - DNA, 20 bp, Artificial Sequence
  chemically synthesized
tatcaacagatgaatggata

SEQ ID NO: 473406 - DNA, 20 bp, Artificial Sequence
  chemically synthesized
aagtgtatatcaacagatga

SEQ ID NO: 473407 - DNA, 20 bp, Artificial Sequence
  chemically synthesized
acctaagtgtatatcaacag

SEQ ID NO: 473408 - DNA, 20 bp, Artificial Sequence
  chemically synthesized
ctaagaaatcagtatatcaa

SEQ ID NO: 473409 - DNA, 20 bp, Artificial Sequence
  chemically synthesized
atatactgatttcttagctt

SEQ ID NO: 473410 - DNA, 20 bp, Artificial Sequence
  chemically synthesized
actgatttcttagctttggg

SEQ ID NO: 473411 - DNA, 20 bp, Artificial Sequence
  chemically synthesized
ttgggatggataaccagtag

SEQ ID NO: 473412 - DNA, 20 bp, Artificial Sequence
  chemically synthesized
agttctatttacagtttgtt

SEQ ID NO: 473413 - DNA, 20 bp, Artificial Sequence
  chemically synthesized
cattttcatcaacactgtaa

SEQ ID NO: 473414 - DNA, 20 bp, Artificial Sequence
  chemically synthesized
ccctttcttcacattctcac

SEQ ID NO: 473415 - DNA, 20 bp, Artificial Sequence
  chemically synthesized
aaaaaataacagattctggt

SEQ ID NO: 473416 - DNA, 20 bp, Artificial Sequence
  chemically synthesized
aatctgttattttttgtctt

SEQ ID NO: 473417 - DNA, 20 bp, Artificial Sequence
  chemically synthesized
tgaataatagccattctaat

SEQ ID NO: 473418 - DNA, 20 bp, Artificial Sequence
  chemically synthesized
atatatcgtcttaccccaat

SEQ ID NO: 473419 - DNA, 20 bp, Artificial Sequence
  chemically synthesized
ccatttgtatgccttctttt

SEQ ID NO: 473420 - DNA, 20 bp, Artificial Sequence
  chemically synthesized
aatgatccctgccttatgaa

SEQ ID NO: 473421 - DNA, 20 bp, Artificial Sequence
  chemically synthesized
tgtcactcatttcataaggc

SEQ ID NO: 473422 - DNA, 20 bp, Artificial Sequence
  chemically synthesized
cataaggcagggatcattta

SEQ ID NO: 473423 - DNA, 20 bp, Artificial Sequence
  chemically synthesized
atcatttaatgaattattta

SEQ ID NO: 473424 - DNA, 20 bp, Artificial Sequence
  chemically synthesized
atgaattatttaaagaatta

SEQ ID NO: 473425 - DNA, 20 bp, Artificial Sequence
  chemically synthesized
tagagtcacagtaacatata

SEQ ID NO: 473426 - DNA, 20 bp, Artificial Sequence
  chemically synthesized
gctgaagcaaaaacatactt

SEQ ID NO: 473427 - DNA, 20 bp, Artificial Sequence
  chemically synthesized
agcagcccatatactaacat

SEQ ID NO: 473428 - DNA, 20 bp, Artificial Sequence
  chemically synthesized
aacattggaataatgataca

SEQ ID NO: 473429 - DNA, 20 bp, Artificial Sequence
  chemically synthesized
tgttaaccatattaatattt

SEQ ID NO: 473430 - DNA, 20 bp, Artificial Sequence
  chemically synthesized
tattaatatggttaacattt

SEQ ID NO: 473431 - DNA, 20 bp, Artificial Sequence
  chemically synthesized
gttaggaagaggaaggccaa

SEQ ID NO: 473432 - DNA, 20 bp, Artificial Sequence
  chemically synthesized
ttatcaaccaagttatattt

SEQ ID NO: 473433 - DNA, 20 bp, Artificial Sequence
  chemically synthesized
aaaaacaaaagaattaagag

SEQ ID NO: 473434 - DNA, 20 bp, Artificial Sequence
  chemically synthesized
gttgaaaaaacaaaagaatt

SEQ ID NO: 473435 - DNA, 20 bp, Artificial Sequence
  chemically synthesized
aataacagttgaaaaaacaa

SEQ ID NO: 473436 - DNA, 20 bp, Artificial Sequence
  chemically synthesized
tttattgcatcttgattaat

SEQ ID NO: 473437 - DNA, 20 bp, Artificial Sequence
  chemically synthesized
tcccaggtggccgtcgagga

SEQ ID NO: 473438 - DNA, 20 bp, Artificial Sequence
  chemically synthesized
tttaattgttcctcattata

SEQ ID NO: 473439 - DNA, 20 bp, Artificial Sequence
  chemically synthesized
actcaaagtatcttatcaga

SEQ ID NO: 473440 - DNA, 20 bp, Artificial Sequence
  chemically synthesized
atcctttctgataagatact

SEQ ID NO: 473441 - DNA, 20 bp, Artificial Sequence
  chemically synthesized
cggtaagtgaatattaaaac

SEQ ID NO: 473442 - DNA, 20 bp, Artificial Sequence
  chemically synthesized
tggaatactatatacggtaa

SEQ ID NO: 473443 - DNA, 20 bp, Artificial Sequence
  chemically synthesized
tggattgataaaaacgagtc

SEQ ID NO: 473444 - DNA, 20 bp, Artificial Sequence
  chemically synthesized
ttggccttggattgataaaa

SEQ ID NO: 473445 - DNA, 20 bp, Artificial Sequence
  chemically synthesized
gaaatcctttgtgtttggcc

SEQ ID NO: 473446 - DNA, 20 bp, Artificial Sequence
  chemically synthesized
tcaatccaaggccaaacaca

SEQ ID NO: 473447 - DNA, 20 bp, Artificial Sequence
  chemically synthesized
tagttcatttgtggctgcca

SEQ ID NO: 473448 - DNA, 20 bp, Artificial Sequence
  chemically synthesized
actttcacaaaaacattagg

SEQ ID NO: 473449 - DNA, 20 bp, Artificial Sequence
  chemically synthesized
acatttggtataggtgacta

SEQ ID NO: 473450 - DNA, 20 bp, Artificial Sequence
  chemically synthesized
gattaatagataataaatca

SEQ ID NO: 473451 - DNA, 20 bp, Artificial Sequence
  chemically synthesized
aaagtgctgggattacaggc

SEQ ID NO: 473452 - DNA, 20 bp, Artificial Sequence
  chemically synthesized
aacttggcctcccaaagtgc

SEQ ID NO: 473453 - DNA, 20 bp, Artificial Sequence
  chemically synthesized
actttgggaggccaagttgg

SEQ ID NO: 473454 - DNA, 20 bp, Artificial Sequence
  chemically synthesized
tttttgtatttctagtagag

SEQ ID NO: 473455 - DNA, 20 bp, Artificial Sequence
  chemically synthesized
tcacgccactgtactccagc

SEQ ID NO: 473456 - DNA, 20 bp, Artificial Sequence
  chemically synthesized
tttcactctgtcacccaggc

SEQ ID NO: 473457 - DNA, 20 bp, Artificial Sequence
  chemically synthesized
ctgtactccagcctgggtga

SEQ ID NO: 473458 - DNA, 20 bp, Artificial Sequence
  chemically synthesized
taatatttttttctttgagg

SEQ ID NO: 473459 - DNA, 20 bp, Artificial Sequence
  chemically synthesized
gtacaggcaaggcttaaatt

SEQ ID NO: 473460 - DNA, 20 bp, Artificial Sequence
  chemically synthesized
ggcttaaatttgggataaaa

SEQ ID NO: 473461 - DNA, 20 bp, Artificial Sequence
  chemically synthesized
taaatttgggataaaatagg

SEQ ID NO: 473462 - DNA, 20 bp, Artificial Sequence
  chemically synthesized
agtaagataaaactaatttt

SEQ ID NO: 473463 - DNA, 20 bp, Artificial Sequence
  chemically synthesized
atttccaagtccactgaaaa

SEQ ID NO: 473464 - DNA, 20 bp, Artificial Sequence
  chemically synthesized
gaaaaacctaataggaagaa

SEQ ID NO: 473465 - DNA, 20 bp, Artificial Sequence
  chemically synthesized
cacagtgtgctgtcaactta

SEQ ID NO: 473466 - DNA, 20 bp, Artificial Sequence
  chemically synthesized
ttattcctttcttccccacc

SEQ ID NO: 473467 - DNA, 20 bp, Artificial Sequence
  chemically synthesized
ctattcttggtggggaagaa

SEQ ID NO: 473468 - DNA, 20 bp, Artificial Sequence
  chemically synthesized
gggaagaaaggaataatttt

SEQ ID NO: 473469 - DNA, 20 bp, Artificial Sequence
  chemically synthesized
gcctggagccaccacttata

SEQ ID NO: 473470 - DNA, 20 bp, Artificial Sequence
  chemically synthesized
aaaatccagagttagagagc

SEQ ID NO: 473471 - DNA, 20 bp, Artificial Sequence
  chemically synthesized
ggcatcctagctctctaact

SEQ ID NO: 473472 - DNA, 20 bp, Artificial Sequence
  chemically synthesized
ttcacaactaaatcaaaatc

SEQ ID NO: 473473 - DNA, 20 bp, Artificial Sequence
  chemically synthesized
tgaacagtccatgctaaact

SEQ ID NO: 473474 - DNA, 20 bp, Artificial Sequence
  chemically synthesized
cacagagcaatcagaactca

SEQ ID NO: 473475 - DNA, 20 bp, Artificial Sequence
  chemically synthesized
cacaccacgggaactacccc

SEQ ID NO: 473476 - DNA, 20 bp, Artificial Sequence
  chemically synthesized
ggggtagttcccgtggtgtg

SEQ ID NO: 473477 - DNA, 20 bp, Artificial Sequence
  chemically synthesized
aacatcgatttttacctctc

SEQ ID NO: 473478 - DNA, 20 bp, Artificial Sequence
  chemically synthesized
cttaattgatattggaaggc

SEQ ID NO: 473479 - DNA, 20 bp, Artificial Sequence
  chemically synthesized
agtgaaaaaatgagattgtt

SEQ ID NO: 473480 - DNA, 20 bp, Artificial Sequence
  chemically synthesized
aaaatgggcaagtctaggga

SEQ ID NO: 473481 - DNA, 20 bp, Artificial Sequence
  chemically synthesized
tttttgcttggcccaaatac

SEQ ID NO: 473482 - DNA, 20 bp, Artificial Sequence
  chemically synthesized
caaatacgtggataaccaag

SEQ ID NO: 473483 - DNA, 20 bp, Artificial Sequence
  chemically synthesized
agtggggttcccctacaatg

SEQ ID NO: 473484 - DNA, 20 bp, Artificial Sequence
  chemically synthesized
gcaggtagagtttgggagtg

SEQ ID NO: 473485 - DNA, 20 bp, Artificial Sequence
  chemically synthesized
gggcttagcaggtagagttt

SEQ ID NO: 473486 - DNA, 20 bp, Artificial Sequence
  chemically synthesized
gttttggtgggcttagcagg

SEQ ID NO: 473487 - DNA, 20 bp, Artificial Sequence
  chemically synthesized
cgcacaagagttatattgga

SEQ ID NO: 473488 - DNA, 20 bp, Artificial Sequence
  chemically synthesized
agccacgcacaagagttata

SEQ ID NO: 473489 - DNA, 20 bp, Artificial Sequence
  chemically synthesized
agcatgaagaagccacgcac

SEQ ID NO: 473490 - DNA, 20 bp, Artificial Sequence
  chemically synthesized
gcattgatctgggagagaag

SEQ ID NO: 473491 - DNA, 20 bp, Artificial Sequence
  chemically synthesized
tacttcctcatctcccaggt

SEQ ID NO: 473492 - DNA, 20 bp, Artificial Sequence
  chemically synthesized
aggtataaaccatatactgt

SEQ ID NO: 473493 - DNA, 20 bp, Artificial Sequence
  chemically synthesized
ctcatgtccatataactaaa

SEQ ID NO: 473494 - DNA, 20 bp, Artificial Sequence
  chemically synthesized
ttcattttagttatatggac

SEQ ID NO: 473495 - DNA, 20 bp, Artificial Sequence
  chemically synthesized
ttttttgtttacctttctct

SEQ ID NO: 473496 - DNA, 20 bp, Artificial Sequence
  chemically synthesized
tactatgtgcctcctgcaga

SEQ ID NO: 473497 - DNA, 20 bp, Artificial Sequence
  chemically synthesized
atgactagttgaccaaacaa

SEQ ID NO: 473498 - DNA, 20 bp, Artificial Sequence
  chemically synthesized
ctagttgaccaaacaaatgg

SEQ ID NO: 473499 - DNA, 20 bp, Artificial Sequence
  chemically synthesized
ccaaacaaatggatgagtaa

SEQ ID NO: 473500 - DNA, 20 bp, Artificial Sequence
  chemically synthesized
aacaagtatgcctactgaca

SEQ ID NO: 473501 - DNA, 20 bp, Artificial Sequence
  chemically synthesized
agtccagtcaacttgacaca

SEQ ID NO: 473502 - DNA, 20 bp, Artificial Sequence
  chemically synthesized
gtgtcaagttgactggacta

SEQ ID NO: 473503 - DNA, 20 bp, Artificial Sequence
  chemically synthesized
gcccaggtaaaccactattt

SEQ ID NO: 473504 - DNA, 20 bp, Artificial Sequence
  chemically synthesized
ctatttctgggtgtgtctgt

SEQ ID NO: 473505 - DNA, 20 bp, Artificial Sequence
  chemically synthesized
caagattagcatttggttca

SEQ ID NO: 473506 - DNA, 20 bp, Artificial Sequence
  chemically synthesized
acattggggagggcaatcta

SEQ ID NO: 473507 - DNA, 20 bp, Artificial Sequence
  chemically synthesized
ctgtttaggacctcaactga

SEQ ID NO: 473508 - DNA, 20 bp, Artificial Sequence
  chemically synthesized
ccctgcaggcctgcttgagc

SEQ ID NO: 473509 - DNA, 20 bp, Artificial Sequence
  chemically synthesized
gtcttctcctgcacttgcac

SEQ ID NO: 473510 - DNA, 20 bp, Artificial Sequence
  chemically synthesized
tctgaaggcctgagaaccag

SEQ ID NO: 473511 - DNA, 20 bp, Artificial Sequence
  chemically synthesized
atatgtatgtctatgtgtgt

SEQ ID NO: 473512 - DNA, 20 bp, Artificial Sequence
  chemically synthesized
accttgactaatcaatgtcc

SEQ ID NO: 473513 - DNA, 20 bp, Artificial Sequence
  chemically synthesized
ttttactgataaggaaagtt

SEQ ID NO: 473514 - DNA, 20 bp, Artificial Sequence
  chemically synthesized
gtggaaaataatataactta

SEQ ID NO: 473515 - DNA, 20 bp, Artificial Sequence
  chemically synthesized
tataacttatagggttttgt

SEQ ID NO: 473516 - DNA, 20 bp, Artificial Sequence
  chemically synthesized
attatggttaataaaaggag

SEQ ID NO: 473517 - DNA, 20 bp, Artificial Sequence
  chemically synthesized
aaagtgctgggattacaggt

SEQ ID NO: 473518 - DNA, 20 bp, Artificial Sequence
  chemically synthesized
gcctcggcctcccaaagtgc

SEQ ID NO: 473519 - DNA, 20 bp, Artificial Sequence
  chemically synthesized
actttgggaggccgaggcag

SEQ ID NO: 473520 - DNA, 20 bp, Artificial Sequence
  chemically synthesized
caggcggatcacttgaggtc

SEQ ID NO: 473521 - DNA, 20 bp, Artificial Sequence
  chemically synthesized
gtctcagcttcccgagtagc

SEQ ID NO: 473522 - DNA, 20 bp, Artificial Sequence
  chemically synthesized
gattctcctgtctcagcttc

SEQ ID NO: 473523 - DNA, 20 bp, Artificial Sequence
  chemically synthesized
tactcgggaagctgagacag

SEQ ID NO: 473524 - DNA, 20 bp, Artificial Sequence
  chemically synthesized
agctgagacaggagaatcac

SEQ ID NO: 473525 - DNA, 20 bp, Artificial Sequence
  chemically synthesized
tcttgttctgttacctaggc

SEQ ID NO: 473526 - DNA, 20 bp, Artificial Sequence
  chemically synthesized
ttttttttttttttttgaga

SEQ ID NO: 473527 - DNA, 20 bp, Artificial Sequence
  chemically synthesized
gcaatatgtggcatgacaat

SEQ ID NO: 473528 - DNA, 20 bp, Artificial Sequence
  chemically synthesized
cttcacagtaactctgcaat

SEQ ID NO: 473529 - DNA, 20 bp, Artificial Sequence
  chemically synthesized
aataatattaactcctattg

SEQ ID NO: 473530 - DNA, 20 bp, Artificial Sequence
  chemically synthesized
tttatgtcaatgaagtcggg

SEQ ID NO: 473531 - DNA, 20 bp, Artificial Sequence
  chemically synthesized
agttagtaaattggcagagc

SEQ ID NO: 473532 - DNA, 20 bp, Artificial Sequence
  chemically synthesized
aagacccagactgaatgagt

SEQ ID NO: 473533 - DNA, 20 bp, Artificial Sequence
  chemically synthesized
aggattcaaactcattcagt

SEQ ID NO: 473534 - DNA, 20 bp, Artificial Sequence
  chemically synthesized
aagagcaagacccagactga

SEQ ID NO: 473535 - DNA, 20 bp, Artificial Sequence
  chemically synthesized
agttaagagcaagacccaga

SEQ ID NO: 473536 - DNA, 20 bp, Artificial Sequence
  chemically synthesized
tttttttcaactttaatctt

SEQ ID NO: 473537 - DNA, 20 bp, Artificial Sequence
  chemically synthesized
taatttctttaatcagttta

SEQ ID NO: 473538 - DNA, 20 bp, Artificial Sequence
  chemically synthesized
agtttcatcgatatgcacac

SEQ ID NO: 473539 - DNA, 20 bp, Artificial Sequence
  chemically synthesized
aaggtcaattcctggtcttg

SEQ ID NO: 473540 - DNA, 20 bp, Artificial Sequence
  chemically synthesized
gtatcacattcttcaagacc

SEQ ID NO: 473541 - DNA, 20 bp, Artificial Sequence
  chemically synthesized
tatgtcattatttctaaatt

SEQ ID NO: 473542 - DNA, 20 bp, Artificial Sequence
  chemically synthesized
tcattatttctaaatttaga

SEQ ID NO: 473543 - DNA, 20 bp, Artificial Sequence
  chemically synthesized
aatttagaatgggtcatttc

SEQ ID NO: 473544 - DNA, 20 bp, Artificial Sequence
  chemically synthesized
aaatcaatctagagataaat

SEQ ID NO: 473545 - DNA, 20 bp, Artificial Sequence
  chemically synthesized
agagataaatgtgagtgttt

SEQ ID NO: 473546 - DNA, 20 bp, Artificial Sequence
  chemically synthesized
agaagatgaagatgccatat

SEQ ID NO: 473547 - DNA, 20 bp, Artificial Sequence
  chemically synthesized
taccatctacatcttcccct

SEQ ID NO: 473548 - DNA, 20 bp, Artificial Sequence
  chemically synthesized
aggggaagatgtagatggta

SEQ ID NO: 473549 - DNA, 20 bp, Artificial Sequence
  chemically synthesized
cataggccactttctctagt

SEQ ID NO: 473550 - DNA, 20 bp, Artificial Sequence
  chemically synthesized
cagagagaagattgggagtc

SEQ ID NO: 473551 - DNA, 20 bp, Artificial Sequence
  chemically synthesized
aattcttcagagagaagatt

SEQ ID NO: 473552 - DNA, 20 bp, Artificial Sequence
  chemically synthesized
gactcccaatcttctctctg

SEQ ID NO: 473553 - DNA, 20 bp, Artificial Sequence
  chemically synthesized
attttaaaatcttgacaata

SEQ ID NO: 473554 - DNA, 20 bp, Artificial Sequence
  chemically synthesized
gattttaaaatgagatcaaa

SEQ ID NO: 473555 - DNA, 20 bp, Artificial Sequence
  chemically synthesized
tgtcataccttctcttaagt

SEQ ID NO: 473556 - DNA, 20 bp, Artificial Sequence
  chemically synthesized
agagaaggtatgacagcgag

SEQ ID NO: 473557 - DNA, 20 bp, Artificial Sequence
  chemically synthesized
tcactggagaaaggttttgt

SEQ ID NO: 473558 - DNA, 20 bp, Artificial Sequence
  chemically synthesized
ggagaaaggttttgtgtgga

SEQ ID NO: 473559 - DNA, 20 bp, Artificial Sequence
  chemically synthesized
ctaaataaagaaacaaattt

SEQ ID NO: 473560 - DNA, 20 bp, Artificial Sequence
  chemically synthesized
tttccttgcataattgctca

SEQ ID NO: 473561 - DNA, 20 bp, Artificial Sequence
  chemically synthesized
tattaacaaatacttataaa

SEQ ID NO: 473562 - DNA, 20 bp, Artificial Sequence
  chemically synthesized
gcagggtaaatcttgagcct

SEQ ID NO: 473563 - DNA, 20 bp, Artificial Sequence
  chemically synthesized
tcagtggttctctttgcctg

SEQ ID NO: 473564 - DNA, 20 bp, Artificial Sequence
  chemically synthesized
cctaactttcctctaaaata

SEQ ID NO: 473565 - DNA, 20 bp, Artificial Sequence
  chemically synthesized
tcactattttagaggaaagt

SEQ ID NO: 473566 - DNA, 20 bp, Artificial Sequence
  chemically synthesized
tctcagtctcaggtgccctt

SEQ ID NO: 473567 - DNA, 20 bp, Artificial Sequence
  chemically synthesized
gctgttgtaacttactagac

SEQ ID NO: 473568 - DNA, 20 bp, Artificial Sequence
  chemically synthesized
agacttgggttgatatgcat

SEQ ID NO: 473569 - DNA, 20 bp, Artificial Sequence
  chemically synthesized
catatgtaccttcttttaca

SEQ ID NO: 473570 - DNA, 20 bp, Artificial Sequence
  chemically synthesized
tattaatctccaacaccaaa

SEQ ID NO: 473571 - DNA, 20 bp, Artificial Sequence
  chemically synthesized
ctgaagaagcaaataaactc

SEQ ID NO: 473572 - DNA, 20 bp, Artificial Sequence
  chemically synthesized
agcaaataaactcttggatt

SEQ ID NO: 473573 - DNA, 20 bp, Artificial Sequence
  chemically synthesized
gtcttccttactcgaaatcc

SEQ ID NO: 473574 - DNA, 20 bp, Artificial Sequence
  chemically synthesized
tttcgagtaaggaagactgg

SEQ ID NO: 473575 - DNA, 20 bp, Artificial Sequence
  chemically synthesized
aagaaatagcatatgtatgt

SEQ ID NO: 473576 - DNA, 20 bp, Artificial Sequence
  chemically synthesized
acaaattcattatgttccaa

SEQ ID NO: 473577 - DNA, 20 bp, Artificial Sequence
  chemically synthesized
atgaattcatttggaacata

SEQ ID NO: 473578 - DNA, 20 bp, Artificial Sequence
  chemically synthesized
gaaagggaagtgagactaaa

SEQ ID NO: 473579 - DNA, 20 bp, Artificial Sequence
  chemically synthesized
gaagtgagactaaaaggggt

SEQ ID NO: 473580 - DNA, 20 bp, Artificial Sequence
  chemically synthesized
agccaagaaagaagagataa

SEQ ID NO: 473581 - DNA, 20 bp, Artificial Sequence
  chemically synthesized
aagagataaaggagtttaaa

SEQ ID NO: 473582 - DNA, 20 bp, Artificial Sequence
  chemically synthesized
caggaggaacccaatctctt

SEQ ID NO: 473583 - DNA, 20 bp, Artificial Sequence
  chemically synthesized
ccctattaattcagaagaga

SEQ ID NO: 473584 - DNA, 20 bp, Artificial Sequence
  chemically synthesized
ctatgatctaatagttgaaa

SEQ ID NO: 473585 - DNA, 20 bp, Artificial Sequence
  chemically synthesized
agaaaccttgattgatacac

SEQ ID NO: 473586 - DNA, 20 bp, Artificial Sequence
  chemically synthesized
gcccatctgggatagttctg

SEQ ID NO: 473587 - DNA, 20 bp, Artificial Sequence
  chemically synthesized
atggcagttttctgcccatc

SEQ ID NO: 473588 - DNA, 20 bp, Artificial Sequence
  chemically synthesized
gaattgctgcaacctagatt

SEQ ID NO: 473589 - DNA, 20 bp, Artificial Sequence
  chemically synthesized
ttcctgagatgcttttactg

SEQ ID NO: 473590 - DNA, 20 bp, Artificial Sequence
  chemically synthesized
ctttccctgctaaatcctca

SEQ ID NO: 473591 - DNA, 20 bp, Artificial Sequence
  chemically synthesized
caggtactgtgctactcact

SEQ ID NO: 473592 - DNA, 20 bp, Artificial Sequence
  chemically synthesized
aggtgctaaattaatattag

SEQ ID NO: 473593 - DNA, 20 bp, Artificial Sequence
  chemically synthesized
gctaaattaatattagttga

SEQ ID NO: 473594 - DNA, 20 bp, Artificial Sequence
  chemically synthesized
aattaatgtactgtttattc

SEQ ID NO: 473595 - DNA, 20 bp, Artificial Sequence
  chemically synthesized
gttgttaatagtaaagatcc

SEQ ID NO: 473596 - DNA, 20 bp, Artificial Sequence
  chemically synthesized
ttactattaacaactatatt

SEQ ID NO: 473597 - DNA, 20 bp, Artificial Sequence
  chemically synthesized
tattaacaactatattttga

SEQ ID NO: 473598 - DNA, 20 bp, Artificial Sequence
  chemically synthesized
gtttttcaaaagcttgtgtc

SEQ ID NO: 473599 - DNA, 20 bp, Artificial Sequence
  chemically synthesized
atctagtattataggcaaaa

SEQ ID NO: 473600 - DNA, 20 bp, Artificial Sequence
  chemically synthesized
tgtggaggagatttggactt

SEQ ID NO: 473601 - DNA, 20 bp, Artificial Sequence
  chemically synthesized
aaatatgattatttaaaaac

SEQ ID NO: 473602 - DNA, 20 bp, Artificial Sequence
  chemically synthesized
aataatcatatttaagattt

SEQ ID NO: 473603 - DNA, 20 bp, Artificial Sequence
  chemically synthesized
tctgaaatgagaagaccaag

SEQ ID NO: 473604 - DNA, 20 bp, Artificial Sequence
  chemically synthesized
ccttggtcttctcatttcag

SEQ ID NO: 473605 - DNA, 20 bp, Artificial Sequence
  chemically synthesized
ttctagtcaatatcttttga

SEQ ID NO: 473606 - DNA, 20 bp, Artificial Sequence
  chemically synthesized
tacattctagtcaatatctt

SEQ ID NO: 473607 - DNA, 20 bp, Artificial Sequence
  chemically synthesized
ttcattcaaaagatattgac

SEQ ID NO: 473608 - DNA, 20 bp, Artificial Sequence
  chemically synthesized
gagatcttatctgtcttgtt

SEQ ID NO: 473609 - DNA, 20 bp, Artificial Sequence
  chemically synthesized
tagaagatgatcaagaaata

SEQ ID NO: 473610 - DNA, 20 bp, Artificial Sequence
  chemically synthesized
agatgatcaagaaatactga

SEQ ID NO: 473611 - DNA, 20 bp, Artificial Sequence
  chemically synthesized
gatcaagaaatactgaatgg

SEQ ID NO: 473612 - DNA, 20 bp, Artificial Sequence
  chemically synthesized
aagaaatactgaatggatga

SEQ ID NO: 473613 - DNA, 20 bp, Artificial Sequence
  chemically synthesized
atgaatgaatgaaaggcttt

SEQ ID NO: 473614 - DNA, 20 bp, Artificial Sequence
  chemically synthesized
tgtcaggcactgagataagt

SEQ ID NO: 473615 - DNA, 20 bp, Artificial Sequence
  chemically synthesized
gtagacttgaaagcgtaatt

SEQ ID NO: 473616 - DNA, 20 bp, Artificial Sequence
  chemically synthesized
aaagcgtaattctgggtata

SEQ ID NO: 473617 - DNA, 20 bp, Artificial Sequence
  chemically synthesized
tggtgctcattcattatacc

SEQ ID NO: 473618 - DNA, 20 bp, Artificial Sequence
  chemically synthesized
tgtgtcgtatcgtaatttag

SEQ ID NO: 473619 - DNA, 20 bp, Artificial Sequence
  chemically synthesized
aacagtcacagcttggaatt

SEQ ID NO: 473620 - DNA, 20 bp, Artificial Sequence
  chemically synthesized
tttgggaaacagtcacagct

SEQ ID NO: 473621 - DNA, 20 bp, Artificial Sequence
  chemically synthesized
ttatctttcacaatacacag

SEQ ID NO: 473622 - DNA, 20 bp, Artificial Sequence
  chemically synthesized
attgcttttaaataagccaa

SEQ ID NO: 473623 - DNA, 20 bp, Artificial Sequence
  chemically synthesized
aagacaaagtggaagccctt

SEQ ID NO: 473624 - DNA, 20 bp, Artificial Sequence
  chemically synthesized
tttctgttaattactctact

SEQ ID NO: 473625 - DNA, 20 bp, Artificial Sequence
  chemically synthesized
agtgaagataaaactcaaag

SEQ ID NO: 473626 - DNA, 20 bp, Artificial Sequence
  chemically synthesized
gttacatattttctctagac

SEQ ID NO: 473627 - DNA, 20 bp, Artificial Sequence
  chemically synthesized
cattcccatggatatttatc

SEQ ID NO: 473628 - DNA, 20 bp, Artificial Sequence
  chemically synthesized
gaccctagataaatatccat

SEQ ID NO: 473629 - DNA, 20 bp, Artificial Sequence
  chemically synthesized
tgtctgtttcttgcattccc

SEQ ID NO: 473630 - DNA, 20 bp, Artificial Sequence
  chemically synthesized
atttactagcatcacagcac

SEQ ID NO: 473631 - DNA, 20 bp, Artificial Sequence
  chemically synthesized
aaaaactcgtgaatagactg

SEQ ID NO: 473632 - DNA, 20 bp, Artificial Sequence
  chemically synthesized
aatgactctccagtctattc

SEQ ID NO: 473633 - DNA, 20 bp, Artificial Sequence
  chemically synthesized
aaacttcaggacaaaaactc

SEQ ID NO: 473634 - DNA, 20 bp, Artificial Sequence
  chemically synthesized
acttgtgaggatttgggagt

SEQ ID NO: 473635 - DNA, 20 bp, Artificial Sequence
  chemically synthesized
agtgttacttgtgaggattt

SEQ ID NO: 473636 - DNA, 20 bp, Artificial Sequence
  chemically synthesized
tatttatgagtgttacttgt

SEQ ID NO: 473637 - DNA, 20 bp, Artificial Sequence
  chemically synthesized
taatgtttgggcacgtattt

SEQ ID NO: 473638 - DNA, 20 bp, Artificial Sequence
  chemically synthesized
atcagtctcaggagcgtttc

SEQ ID NO: 473639 - DNA, 20 bp, Artificial Sequence
  chemically synthesized
aagggattaccattagttaa

SEQ ID NO: 473640 - DNA, 20 bp, Artificial Sequence
  chemically synthesized
aataatggattttaactgaa

SEQ ID NO: 473641 - DNA, 20 bp, Artificial Sequence
  chemically synthesized
gaatcagaattagaataata

SEQ ID NO: 473642 - DNA, 20 bp, Artificial Sequence
  chemically synthesized
caactcaaaagaatcagaat

SEQ ID NO: 473643 - DNA, 20 bp, Artificial Sequence
  chemically synthesized
ttattctaattctgattctt

SEQ ID NO: 473644 - DNA, 20 bp, Artificial Sequence
  chemically synthesized
cagttacaactcaaaagaat

SEQ ID NO: 473645 - DNA, 20 bp, Artificial Sequence
  chemically synthesized
ttttttcagttacaactcaa

SEQ ID NO: 473646 - DNA, 20 bp, Artificial Sequence
  chemically synthesized
cagcactctgggaggcccag

SEQ ID NO: 473647 - DNA, 20 bp, Artificial Sequence
  chemically synthesized
tcaaactctcctgggcctcc

SEQ ID NO: 473648 - DNA, 20 bp, Artificial Sequence
  chemically synthesized
tcctgggcctcccagagtgc

SEQ ID NO: 473649 - DNA, 20 bp, Artificial Sequence
  chemically synthesized
cacctctaccggccatcttc

SEQ ID NO: 473650 - DNA, 20 bp, Artificial Sequence
  chemically synthesized
ggcaaaacaacctgggcttg

SEQ ID NO: 473651 - DNA, 20 bp, Artificial Sequence
  chemically synthesized
ttgttgaatgcaaagattaa

SEQ ID NO: 473652 - DNA, 20 bp, Artificial Sequence
  chemically synthesized
ttaactgaattgtctttcct

SEQ ID NO: 473653 - DNA, 20 bp, Artificial Sequence
  chemically synthesized
ttcctgacattagggcactt

SEQ ID NO: 473654 - DNA, 20 bp, Artificial Sequence
  chemically synthesized
gtgtttcttgcgtttgactt

SEQ ID NO: 473655 - DNA, 20 bp, Artificial Sequence
  chemically synthesized
gtgctaacatggcactcact

SEQ ID NO: 473656 - DNA, 20 bp, Artificial Sequence
  chemically synthesized
gaattatgctcctactcaga

SEQ ID NO: 473657 - DNA, 20 bp, Artificial Sequence
  chemically synthesized
ttaagaattatgctcctact

SEQ ID NO: 473658 - DNA, 20 bp, Artificial Sequence
  chemically synthesized
taagtcacacaaaatctatt

SEQ ID NO: 473659 - DNA, 20 bp, Artificial Sequence
  chemically synthesized
ggaaccttaaaaggtagatt

SEQ ID NO: 473660 - DNA, 20 bp, Artificial Sequence
  chemically synthesized
aaaaaggagggaataaaaaa

SEQ ID NO: 473661 - DNA, 20 bp, Artificial Sequence
  chemically synthesized
gagaaaggacagaaaaagga

SEQ ID NO: 473662 - DNA, 20 bp, Artificial Sequence
  chemically synthesized
tgttctatacaacctaccag

SEQ ID NO: 473663 - DNA, 20 bp, Artificial Sequence
  chemically synthesized
tgaggcactgtttgcctcag

SEQ ID NO: 473664 - DNA, 20 bp, Artificial Sequence
  chemically synthesized
tgcttgcaagacaagcgagg

SEQ ID NO: 473665 - DNA, 20 bp, Artificial Sequence
  chemically synthesized
caagacaagcgaggcaggat

SEQ ID NO: 473666 - DNA, 20 bp, Artificial Sequence
  chemically synthesized
cgttgggctggcactaggct

SEQ ID NO: 473667 - DNA, 20 bp, Artificial Sequence
  chemically synthesized
gagttcatcagaattagagg

SEQ ID NO: 473668 - DNA, 20 bp, Artificial Sequence
  chemically synthesized
agtttgatggcagagttcat

SEQ ID NO: 473669 - DNA, 20 bp, Artificial Sequence
  chemically synthesized
cttgccttccagtttgatgg

SEQ ID NO: 473670 - DNA, 20 bp, Artificial Sequence
  chemically synthesized
accgatttctaaaatgcact

SEQ ID NO: 473671 - DNA, 20 bp, Artificial Sequence
  chemically synthesized
actgcctcattctgtgataa

SEQ ID NO: 473672 - DNA, 20 bp, Artificial Sequence
  chemically synthesized
ataacctgactccattatca

SEQ ID NO: 473673 - DNA, 20 bp, Artificial Sequence
  chemically synthesized
ttcatagacccaagtacctt

SEQ ID NO: 473674 - DNA, 20 bp, Artificial Sequence
  chemically synthesized
gaatgatacccttaaggtac

SEQ ID NO: 473675 - DNA, 20 bp, Artificial Sequence
  chemically synthesized
tgctgcttttctaaattaaa

SEQ ID NO: 473676 - DNA, 20 bp, Artificial Sequence
  chemically synthesized
aaagattttgacaaatgaaa

SEQ ID NO: 473677 - DNA, 20 bp, Artificial Sequence
  chemically synthesized
tcagagagaaaagaggaaag

SEQ ID NO: 473678 - DNA, 20 bp, Artificial Sequence
  chemically synthesized
caagaataaatagctaaggc

SEQ ID NO: 473679 - DNA, 20 bp, Artificial Sequence
  chemically synthesized
atgtggtataaataaagctc

SEQ ID NO: 473680 - DNA, 20 bp, Artificial Sequence
  chemically synthesized
gggccaaaatgcccctagaa

SEQ ID NO: 473681 - DNA, 20 bp, Artificial Sequence
  chemically synthesized
gcctcctggtatttgaacac

SEQ ID NO: 473682 - DNA, 20 bp, Artificial Sequence
  chemically synthesized
atattaggaaattcatatta

SEQ ID NO: 473683 - DNA, 20 bp, Artificial Sequence
  chemically synthesized
tgtttcagtcattcgttaat

SEQ ID NO: 473684 - DNA, 20 bp, Artificial Sequence
  chemically synthesized
gtggcagaagcttttatatt

SEQ ID NO: 473685 - DNA, 20 bp, Artificial Sequence
  chemically synthesized
ctttaataaaggctggaagg

SEQ ID NO: 473686 - DNA, 20 bp, Artificial Sequence
  chemically synthesized
gagggttgatttcctcggtt

SEQ ID NO: 473687 - DNA, 20 bp, Artificial Sequence
  chemically synthesized
aggatggtacgggatttaag

SEQ ID NO: 473688 - DNA, 20 bp, Artificial Sequence
  chemically synthesized
gaaatgctgcaaggatggta

SEQ ID NO: 473689 - DNA, 20 bp, Artificial Sequence
  chemically synthesized
ggaagctttggaaatgctgc

SEQ ID NO: 473690 - DNA, 20 bp, Artificial Sequence
  chemically synthesized
gtggtcaaattgactgtgaa

SEQ ID NO: 473691 - DNA, 20 bp, Artificial Sequence
  chemically synthesized
cttctggcggacaagcttcc

SEQ ID NO: 473692 - DNA, 20 bp, Artificial Sequence
  chemically synthesized
ggagagccgggaagtggaaa

SEQ ID NO: 473693 - DNA, 20 bp, Artificial Sequence
  chemically synthesized
agagagaagacagaatgttg

SEQ ID NO: 473694 - DNA, 20 bp, Artificial Sequence
  chemically synthesized
tatgcgaagaagagagaaga

SEQ ID NO: 473695 - DNA, 20 bp, Artificial Sequence
  chemically synthesized
acgcttcttagtaaaggaca

SEQ ID NO: 473696 - DNA, 20 bp, Artificial Sequence
  chemically synthesized
ctgtgtagatgtgtgagaac

SEQ ID NO: 473697 - DNA, 20 bp, Artificial Sequence
  chemically synthesized
tagagactgtgagtccatgg

SEQ ID NO: 473698 - DNA, 20 bp, Artificial Sequence
  chemically synthesized
ggagagagaccgtagagact

SEQ ID NO: 473699 - DNA, 20 bp, Artificial Sequence
  chemically synthesized
gccttgggggtggggtgagg

SEQ ID NO: 473700 - DNA, 20 bp, Artificial Sequence
  chemically synthesized
cttacaaacagccttggggg

SEQ ID NO: 473701 - DNA, 20 bp, Artificial Sequence
  chemically synthesized
gggagcttacaaacagcctt

SEQ ID NO: 473702 - DNA, 20 bp, Artificial Sequence
  chemically synthesized
aaaacaaaatagttttagtt

SEQ ID NO: 473703 - DNA, 20 bp, Artificial Sequence
  chemically synthesized
ataaaagatcacattgtact

SEQ ID NO: 473704 - DNA, 20 bp, Artificial Sequence
  chemically synthesized
tttataggagaaacaaaaga

SEQ ID NO: 473705 - DNA, 20 bp, Artificial Sequence
  chemically synthesized
gcacgtatcttgatggattt

SEQ ID NO: 473706 - DNA, 20 bp, Artificial Sequence
  chemically synthesized
ggcacagtgcacgtatcttg

SEQ ID NO: 473707 - DNA, 20 bp, Artificial Sequence
  chemically synthesized
tttcacttgaggattaaaaa

SEQ ID NO: 473708 - DNA, 20 bp, Artificial Sequence
  chemically synthesized
gtactgtgttgatttcactt

SEQ ID NO: 473709 - DNA, 20 bp, Artificial Sequence
  chemically synthesized
cctgacttcatatgtctact

SEQ ID NO: 473710 - DNA, 20 bp, Artificial Sequence
  chemically synthesized
ataatcagtcactgcgtttt

SEQ ID NO: 473711 - DNA, 20 bp, Artificial Sequence
  chemically synthesized
ttcttgtcacaccacaaaca

SEQ ID NO: 473712 - DNA, 20 bp, Artificial Sequence
  chemically synthesized
ctccatgtttgtggtgtgac

SEQ ID NO: 473713 - DNA, 20 bp, Artificial Sequence
  chemically synthesized
tttgtggtgtgacaagaata

SEQ ID NO: 473714 - DNA, 20 bp, Artificial Sequence
  chemically synthesized
acctgttttaaagaaagaaa

SEQ ID NO: 473715 - DNA, 20 bp, Artificial Sequence
  chemically synthesized
aaactacaatggtgtgaggg

SEQ ID NO: 473716 - DNA, 20 bp, Artificial Sequence
  chemically synthesized
tgaacaatcatttatcttcc

SEQ ID NO: 473717 - DNA, 20 bp, Artificial Sequence
  chemically synthesized
aggcttccagtaccacagct

SEQ ID NO: 473718 - DNA, 20 bp, Artificial Sequence
  chemically synthesized
attaattactcaaatactta

SEQ ID NO: 473719 - DNA, 20 bp, Artificial Sequence
  chemically synthesized
tataaacactcaataagtat

SEQ ID NO: 473720 - DNA, 20 bp, Artificial Sequence
  chemically synthesized
aaaaataaataagaaaacaa

SEQ ID NO: 473721 - DNA, 20 bp, Artificial Sequence
  chemically synthesized
aaacaaggggatggtcttta

SEQ ID NO: 473722 - DNA, 20 bp, Artificial Sequence
  chemically synthesized
tgtgatacactgtcaaattg

SEQ ID NO: 473723 - DNA, 20 bp, Artificial Sequence
  chemically synthesized
agaaattatttagacgagct

SEQ ID NO: 473724 - DNA, 20 bp, Artificial Sequence
  chemically synthesized
ttaatttgaggctgaggctt

SEQ ID NO: 473725 - DNA, 20 bp, Artificial Sequence
  chemically synthesized
gtggcatttccactacactg

SEQ ID NO: 473726 - DNA, 20 bp, Artificial Sequence
  chemically synthesized
atcagtgtagtggaaatgcc

SEQ ID NO: 473727 - DNA, 20 bp, Artificial Sequence
  chemically synthesized
attttatgactcaggaagac

SEQ ID NO: 473728 - DNA, 20 bp, Artificial Sequence
  chemically synthesized
ggactccaactcaggtcttc

SEQ ID NO: 473729 - DNA, 20 bp, Artificial Sequence
  chemically synthesized
tgactcaggaagacctgagt

SEQ ID NO: 473730 - DNA, 20 bp, Artificial Sequence
  chemically synthesized
aatgctcttgaaatagcact

SEQ ID NO: 473731 - DNA, 20 bp, Artificial Sequence
  chemically synthesized
acagtaatgaataaaataga

SEQ ID NO: 473732 - DNA, 20 bp, Artificial Sequence
  chemically synthesized
tgggtcctgggggtacagta

SEQ ID NO: 473733 - DNA, 20 bp, Artificial Sequence
  chemically synthesized
caggcactgacctgggtcct

SEQ ID NO: 473734 - DNA, 20 bp, Artificial Sequence
  chemically synthesized
actatgagacaggcactgac

SEQ ID NO: 473735 - DNA, 20 bp, Artificial Sequence
  chemically synthesized
gtacctaactaactacttga

SEQ ID NO: 473736 - DNA, 20 bp, Artificial Sequence
  chemically synthesized
gatgaggaaatggaggcaca

SEQ ID NO: 473737 - DNA, 20 bp, Artificial Sequence
  chemically synthesized
atcagaaaaatgagtacata

SEQ ID NO: 473738 - DNA, 20 bp, Artificial Sequence
  chemically synthesized
aatttgcagttatcagaaaa

SEQ ID NO: 473739 - DNA, 20 bp, Artificial Sequence
  chemically synthesized
gaacaagcctaaacagctat

SEQ ID NO: 473740 - DNA, 20 bp, Artificial Sequence
  chemically synthesized
ctaaacagctatgggggtta

SEQ ID NO: 473741 - DNA, 20 bp, Artificial Sequence
  chemically synthesized
ctatgggggttacagagtat

SEQ ID NO: 473742 - DNA, 20 bp, Artificial Sequence
  chemically synthesized
ttgaaactgggccttcacaa

SEQ ID NO: 473743 - DNA, 20 bp, Artificial Sequence
  chemically synthesized
gcaaaaacagaagaaacact

SEQ ID NO: 473744 - DNA, 20 bp, Artificial Sequence
  chemically synthesized
gaagaaacactctgggtgac

SEQ ID NO: 473745 - DNA, 20 bp, Artificial Sequence
  chemically synthesized
ctcattctactcttgtcacc

SEQ ID NO: 473746 - DNA, 20 bp, Artificial Sequence
  chemically synthesized
aacactctgggtgacaagag

SEQ ID NO: 473747 - DNA, 20 bp, Artificial Sequence
  chemically synthesized
tttttggcactagtaaaggc

SEQ ID NO: 473748 - DNA, 20 bp, Artificial Sequence
  chemically synthesized
ctagtaaaggcccggatatg

SEQ ID NO: 473749 - DNA, 20 bp, Artificial Sequence
  chemically synthesized
atatgaaggataaacagaaa

SEQ ID NO: 473750 - DNA, 20 bp, Artificial Sequence
  chemically synthesized
aaggataaacagaaaaagag

SEQ ID NO: 473751 - DNA, 20 bp, Artificial Sequence
  chemically synthesized
acaaggctagaaatgtagct

SEQ ID NO: 473752 - DNA, 20 bp, Artificial Sequence
  chemically synthesized
tgtacttgactgtcaggttt

SEQ ID NO: 473753 - DNA, 20 bp, Artificial Sequence
  chemically synthesized
aataattattaaaaaaatat

SEQ ID NO: 473754 - DNA, 20 bp, Artificial Sequence
  chemically synthesized
ttcttgaattttattatcat

SEQ ID NO: 473755 - DNA, 20 bp, Artificial Sequence
  chemically synthesized
aataactttttttgtttttc

SEQ ID NO: 473756 - DNA, 20 bp, Artificial Sequence
  chemically synthesized
tatggaaatacttgccatca

SEQ ID NO: 473757 - DNA, 20 bp, Artificial Sequence
  chemically synthesized
tcttacttaaaaaattaatg

SEQ ID NO: 473758 - DNA, 20 bp, Artificial Sequence
  chemically synthesized
accaacctaaatatcattgt

SEQ ID NO: 473759 - DNA, 20 bp, Artificial Sequence
  chemically synthesized
tcattgtcagaatggtgttt

SEQ ID NO: 473760 - DNA, 20 bp, Artificial Sequence
  chemically synthesized
tgtcagaatggtgttttagg

SEQ ID NO: 473761 - DNA, 20 bp, Artificial Sequence
  chemically synthesized
aagcatggagaaagcgaaga

SEQ ID NO: 473762 - DNA, 20 bp, Artificial Sequence
  chemically synthesized
ggtgagagtctgaggcttcc

SEQ ID NO: 473763 - DNA, 20 bp, Artificial Sequence
  chemically synthesized
atctcctcctcacctagggt

SEQ ID NO: 473764 - DNA, 20 bp, Artificial Sequence
  chemically synthesized
ttatccatctcctcctcacc

SEQ ID NO: 473765 - DNA, 20 bp, Artificial Sequence
  chemically synthesized
tcaccctaggtgaggaggag

SEQ ID NO: 473766 - DNA, 20 bp, Artificial Sequence
  chemically synthesized
gacggttgaacaaagactgg

SEQ ID NO: 473767 - DNA, 20 bp, Artificial Sequence
  chemically synthesized
aaattatgaaaggtgtggca

SEQ ID NO: 473768 - DNA, 20 bp, Artificial Sequence
  chemically synthesized
atgataagaggggctttaag

SEQ ID NO: 473769 - DNA, 20 bp, Artificial Sequence
  chemically synthesized
ggatcttgctaacaatgaga

SEQ ID NO: 473770 - DNA, 20 bp, Artificial Sequence
  chemically synthesized
gtagggatcttgctaacaat

SEQ ID NO: 473771 - DNA, 20 bp, Artificial Sequence
  chemically synthesized
gtttttgccccagctatggt

SEQ ID NO: 473772 - DNA, 20 bp, Artificial Sequence
  chemically synthesized
catctgttataaggtgagca

SEQ ID NO: 473773 - DNA, 20 bp, Artificial Sequence
  chemically synthesized
gacctgggaggctgaagtgg

SEQ ID NO: 473774 - DNA, 20 bp, Artificial Sequence
  chemically synthesized
tgggaggatcacttgaaccc

SEQ ID NO: 473775 - DNA, 20 bp, Artificial Sequence
  chemically synthesized
cccaggctggtcttgaactc

SEQ ID NO: 473776 - DNA, 20 bp, Artificial Sequence
  chemically synthesized
tgttatttttttttaagaga

SEQ ID NO: 473777 - DNA, 20 bp, Artificial Sequence
  chemically synthesized
caaaaaacatggtgtcagag

SEQ ID NO: 473778 - DNA, 20 bp, Artificial Sequence
  chemically synthesized
ggtgtcagagcagaatacaa

SEQ ID NO: 473779 - DNA, 20 bp, Artificial Sequence
  chemically synthesized
tcagagcagaatacaatggg

SEQ ID NO: 473780 - DNA, 20 bp, Artificial Sequence
  chemically synthesized
atatggaacttcccctaaag

SEQ ID NO: 473781 - DNA, 20 bp, Artificial Sequence
  chemically synthesized
aatacttgagctggtttgtt

SEQ ID NO: 473782 - DNA, 20 bp, Artificial Sequence
  chemically synthesized
tggtaaatgattaaaatcgt

SEQ ID NO: 473783 - DNA, 20 bp, Artificial Sequence
  chemically synthesized
aaatctggaaagtatgacag

SEQ ID NO: 473784 - DNA, 20 bp, Artificial Sequence
  chemically synthesized
aaagtatgacagttgggttc

SEQ ID NO: 473785 - DNA, 20 bp, Artificial Sequence
  chemically synthesized
gcagcccttgaaaatgctgg

SEQ ID NO: 473786 - DNA, 20 bp, Artificial Sequence
  chemically synthesized
tactgtatgttcatcgtgtg

SEQ ID NO: 473787 - DNA, 20 bp, Artificial Sequence
  chemically synthesized
gggagatgactgcagctgag

SEQ ID NO: 473788 - DNA, 20 bp, Artificial Sequence
  chemically synthesized
gagatgctaagctgctgata

SEQ ID NO: 473789 - DNA, 20 bp, Artificial Sequence
  chemically synthesized
cttagcatctcatgtccatg

SEQ ID NO: 473790 - DNA, 20 bp, Artificial Sequence
  chemically synthesized
gtttgaaatctcaggaatct

SEQ ID NO: 473791 - DNA, 20 bp, Artificial Sequence
  chemically synthesized
gtgatactgtttgaaatctc

SEQ ID NO: 473792 - DNA, 20 bp, Artificial Sequence
  chemically synthesized
aaaaaaaaaaaagatggtaa

SEQ ID NO: 473793 - DNA, 20 bp, Artificial Sequence
  chemically synthesized
tcctgctctgttgcccagtc

SEQ ID NO: 473794 - DNA, 20 bp, Artificial Sequence
  chemically synthesized
attgcttgaacctgggaggc

SEQ ID NO: 473795 - DNA, 20 bp, Artificial Sequence
  chemically synthesized
tactcgggaggctgaggcag

SEQ ID NO: 473796 - DNA, 20 bp, Artificial Sequence
  chemically synthesized
aattctcctgcctcagcctc

SEQ ID NO: 473797 - DNA, 20 bp, Artificial Sequence
  chemically synthesized
gcctcagcctcccgagtacc

SEQ ID NO: 473798 - DNA, 20 bp, Artificial Sequence
  chemically synthesized
gttggcgcatgcctgtaatc

SEQ ID NO: 473799 - DNA, 20 bp, Artificial Sequence
  chemically synthesized
aaaatacaaaaattagccgg

SEQ ID NO: 473800 - DNA, 20 bp, Artificial Sequence
  chemically synthesized
ctaaaaaatacaaaaattag

SEQ ID NO: 473801 - DNA, 20 bp, Artificial Sequence
  chemically synthesized
tttgtattttttagaagaga

SEQ ID NO: 473802 - DNA, 20 bp, Artificial Sequence
  chemically synthesized
atggagaccagcctggccaa

SEQ ID NO: 473803 - DNA, 20 bp, Artificial Sequence
  chemically synthesized
gtgaaatggttaaaagatag

SEQ ID NO: 473804 - DNA, 20 bp, Artificial Sequence
  chemically synthesized
aactttcaaaatacagtgat

SEQ ID NO: 473805 - DNA, 20 bp, Artificial Sequence
  chemically synthesized
agtaaggaaaagacaagaaa

SEQ ID NO: 473806 - DNA, 20 bp, Artificial Sequence
  chemically synthesized
aattgattttttatggttag

SEQ ID NO: 473807 - DNA, 20 bp, Artificial Sequence
  chemically synthesized
gatgattaaatataaaagca

SEQ ID NO: 473808 - DNA, 20 bp, Artificial Sequence
  chemically synthesized
gtgttgtttagataaaaact

SEQ ID NO: 473809 - DNA, 20 bp, Artificial Sequence
  chemically synthesized
ataaaaactgtgaattttgc

SEQ ID NO: 473810 - DNA, 20 bp, Artificial Sequence
  chemically synthesized
gctccaaattttgaaacttt

SEQ ID NO: 473811 - DNA, 20 bp, Artificial Sequence
  chemically synthesized
atattgtataaaatttcctt

SEQ ID NO: 473812 - DNA, 20 bp, Artificial Sequence
  chemically synthesized
aaggtatatacgaaatataa

SEQ ID NO: 473813 - DNA, 20 bp, Artificial Sequence
  chemically synthesized
aatgaatttcatgtttaggc

SEQ ID NO: 473814 - DNA, 20 bp, Artificial Sequence
  chemically synthesized
atattcctcatgagatatct

SEQ ID NO: 473815 - DNA, 20 bp, Artificial Sequence
  chemically synthesized
ccatcccaagatatctcatg

SEQ ID NO: 473816 - DNA, 20 bp, Artificial Sequence
  chemically synthesized
ttttttatttttgtggattt

SEQ ID NO: 473817 - DNA, 20 bp, Artificial Sequence
  chemically synthesized
gttttggattttttattttt

SEQ ID NO: 473818 - DNA, 20 bp, Artificial Sequence
  chemically synthesized
tgcttgggaccagaagtgtt

SEQ ID NO: 473819 - DNA, 20 bp, Artificial Sequence
  chemically synthesized
cacttctggtcccaagcatt

SEQ ID NO: 473820 - DNA, 20 bp, Artificial Sequence
  chemically synthesized
ggtcccaagcattttggata

SEQ ID NO: 473821 - DNA, 20 bp, Artificial Sequence
  chemically synthesized
cttcattatatattacaaag

SEQ ID NO: 473822 - DNA, 20 bp, Artificial Sequence
  chemically synthesized
ataatgaagaaataaaacaa

SEQ ID NO: 473823 - DNA, 20 bp, Artificial Sequence
  chemically synthesized
aataaaacaacagagtaagg

SEQ ID NO: 473824 - DNA, 20 bp, Artificial Sequence
  chemically synthesized
gcctcggcctcccgaagtgc

SEQ ID NO: 473825 - DNA, 20 bp, Artificial Sequence
  chemically synthesized
acttcgggaggccgaggctg

SEQ ID NO: 473826 - DNA, 20 bp, Artificial Sequence
  chemically synthesized
cggggtttcaccgtgttagc

SEQ ID NO: 473827 - DNA, 20 bp, Artificial Sequence
  chemically synthesized
ttttgtgtttttactagaga

SEQ ID NO: 473828 - DNA, 20 bp, Artificial Sequence
  chemically synthesized
tgctcgggaggttgaggcag

SEQ ID NO: 473829 - DNA, 20 bp, Artificial Sequence
  chemically synthesized
ctcactgcaagctccgcctc

SEQ ID NO: 473830 - DNA, 20 bp, Artificial Sequence
  chemically synthesized
tcgtgccactgcactccagc

SEQ ID NO: 473831 - DNA, 20 bp, Artificial Sequence
  chemically synthesized
tctcactctgtcacccaggc

SEQ ID NO: 473832 - DNA, 20 bp, Artificial Sequence
  chemically synthesized
ctgcactccagcctgggtga

SEQ ID NO: 473833 - DNA, 20 bp, Artificial Sequence
  chemically synthesized
aaaaacaaacaaacaaacaa

SEQ ID NO: 473834 - DNA, 20 bp, Artificial Sequence
  chemically synthesized
caaacaacagagtaaacttc

SEQ ID NO: 473835 - DNA, 20 bp, Artificial Sequence
  chemically synthesized
agtaaacaaatctatacctc

SEQ ID NO: 473836 - DNA, 20 bp, Artificial Sequence
  chemically synthesized
gaagatggtaagtcaaaagt

SEQ ID NO: 473837 - DNA, 20 bp, Artificial Sequence
  chemically synthesized
ccttagtttggtgaacagat

SEQ ID NO: 473838 - DNA, 20 bp, Artificial Sequence
  chemically synthesized
ctttaaggactttaactact

SEQ ID NO: 473839 - DNA, 20 bp, Artificial Sequence
  chemically synthesized
tttttaaaacaaatattaac

SEQ ID NO: 473840 - DNA, 20 bp, Artificial Sequence
  chemically synthesized
ttaatatttgttttaaaaaa

SEQ ID NO: 473841 - DNA, 20 bp, Artificial Sequence
  chemically synthesized
aacagaatcttttaaatatt

SEQ ID NO: 473842 - DNA, 20 bp, Artificial Sequence
  chemically synthesized
attggtgaaacatctatatc

SEQ ID NO: 473843 - DNA, 20 bp, Artificial Sequence
  chemically synthesized
ttttgaccagaaagggtaga

SEQ ID NO: 473844 - DNA, 20 bp, Artificial Sequence
  chemically synthesized
ttatttaacttttgaccaga

SEQ ID NO: 473845 - DNA, 20 bp, Artificial Sequence
  chemically synthesized
ctggtcaaaagttaaataaa

SEQ ID NO: 473846 - DNA, 20 bp, Artificial Sequence
  chemically synthesized
caaaagttaaataaattgga

SEQ ID NO: 473847 - DNA, 20 bp, Artificial Sequence
  chemically synthesized
ttttgttcttatatgtagtt

SEQ ID NO: 473848 - DNA, 20 bp, Artificial Sequence
  chemically synthesized
atataagaacaaaaactatc

SEQ ID NO: 473849 - DNA, 20 bp, Artificial Sequence
  chemically synthesized
ttttttttttttttttgaga

SEQ ID NO: 473850 - DNA, 20 bp, Artificial Sequence
  chemically synthesized
gtcttgctctgtcaccaggc

SEQ ID NO: 473851 - DNA, 20 bp, Artificial Sequence
  chemically synthesized
ctcactgcaacttccgcttc

SEQ ID NO: 473852 - DNA, 20 bp, Artificial Sequence
  chemically synthesized
tactggggaggccgaggcag

SEQ ID NO: 473853 - DNA, 20 bp, Artificial Sequence
  chemically synthesized
tttttgtatttttagtagag

SEQ ID NO: 473854 - DNA, 20 bp, Artificial Sequence
  chemically synthesized
atgagtttcaccatgttgcc

SEQ ID NO: 473855 - DNA, 20 bp, Artificial Sequence
  chemically synthesized
actttgggaggccgaggtgg

SEQ ID NO: 473856 - DNA, 20 bp, Artificial Sequence
  chemically synthesized
acctcggcctcccaaagtac

SEQ ID NO: 473857 - DNA, 20 bp, Artificial Sequence
  chemically synthesized
tttgttgtgctatctatccc

SEQ ID NO: 473858 - DNA, 20 bp, Artificial Sequence
  chemically synthesized
taggcattctctataattcg

SEQ ID NO: 473859 - DNA, 20 bp, Artificial Sequence
  chemically synthesized
tatctatcccacgaattata

SEQ ID NO: 473860 - DNA, 20 bp, Artificial Sequence
  chemically synthesized
gcatctagtgggtagaagtt

SEQ ID NO: 473861 - DNA, 20 bp, Artificial Sequence
  chemically synthesized
ggaggtgctactggcatcta

SEQ ID NO: 473862 - DNA, 20 bp, Artificial Sequence
  chemically synthesized
atatctgtgtatatgaagta

SEQ ID NO: 473863 - DNA, 20 bp, Artificial Sequence
  chemically synthesized
gatattgatgtttgagataa

SEQ ID NO: 473864 - DNA, 20 bp, Artificial Sequence
  chemically synthesized
tcctcaaccagttatagaca

SEQ ID NO: 473865 - DNA, 20 bp, Artificial Sequence
  chemically synthesized
ggaaggagaagttaacagtc

SEQ ID NO: 473866 - DNA, 20 bp, Artificial Sequence
  chemically synthesized
gactgccaattagaggaata

SEQ ID NO: 473867 - DNA, 20 bp, Artificial Sequence
  chemically synthesized
gagcaaagactgccaattag

SEQ ID NO: 473868 - DNA, 20 bp, Artificial Sequence
  chemically synthesized
gactctgtgtcagcacaaca

SEQ ID NO: 473869 - DNA, 20 bp, Artificial Sequence
  chemically synthesized
cattccttgttgtgctgaca

SEQ ID NO: 473870 - DNA, 20 bp, Artificial Sequence
  chemically synthesized
tgaagaaataggggtggaag

SEQ ID NO: 473871 - DNA, 20 bp, Artificial Sequence
  chemically synthesized
aataacacctgtgaagaaat

SEQ ID NO: 473872 - DNA, 20 bp, Artificial Sequence
  chemically synthesized
atgccagggcagatttattg

SEQ ID NO: 473873 - DNA, 20 bp, Artificial Sequence
  chemically synthesized
tgattgattattgttgcagg

SEQ ID NO: 473874 - DNA, 20 bp, Artificial Sequence
  chemically synthesized
aggctaggggaatggaatcg

SEQ ID NO: 473875 - DNA, 20 bp, Artificial Sequence
  chemically synthesized
gcccacctaggctaggggaa

SEQ ID NO: 473876 - DNA, 20 bp, Artificial Sequence
  chemically synthesized
cacatgcccacctaggctag

SEQ ID NO: 473877 - DNA, 20 bp, Artificial Sequence
  chemically synthesized
ttgactctttatggcccaaa

SEQ ID NO: 473878 - DNA, 20 bp, Artificial Sequence
  chemically synthesized
gtgacccaatttgggccata

SEQ ID NO: 473879 - DNA, 20 bp, Artificial Sequence
  chemically synthesized
cttgaccagtctttaagctc

SEQ ID NO: 473880 - DNA, 20 bp, Artificial Sequence
  chemically synthesized
cagtctttaagctctcgggt

SEQ ID NO: 473881 - DNA, 20 bp, Artificial Sequence
  chemically synthesized
gagtagctctctcttttctg

SEQ ID NO: 473882 - DNA, 20 bp, Artificial Sequence
  chemically synthesized
tcttttctgcagggtatgtt

SEQ ID NO: 473883 - DNA, 20 bp, Artificial Sequence
  chemically synthesized
gggtatgttgagggtgttaa

SEQ ID NO: 473884 - DNA, 20 bp, Artificial Sequence
  chemically synthesized
tcagattagttaagaaacaa

SEQ ID NO: 473885 - DNA, 20 bp, Artificial Sequence
  chemically synthesized
ccttttgtttcttaactaat

SEQ ID NO: 473886 - DNA, 20 bp, Artificial Sequence
  chemically synthesized
tgtttcttaactaatctgag

SEQ ID NO: 473887 - DNA, 20 bp, Artificial Sequence
  chemically synthesized
gttttctgtcacttacagcc

SEQ ID NO: 473888 - DNA, 20 bp, Artificial Sequence
  chemically synthesized
aggtaatttgtaacaacttt

SEQ ID NO: 473889 - DNA, 20 bp, Artificial Sequence
  chemically synthesized
agcaacttaaatacgttgct

SEQ ID NO: 473890 - DNA, 20 bp, Artificial Sequence
  chemically synthesized
cataaaaatgtgggacagag

SEQ ID NO: 473891 - DNA, 20 bp, Artificial Sequence
  chemically synthesized
cagaatggtacccattatta

SEQ ID NO: 473892 - DNA, 20 bp, Artificial Sequence
  chemically synthesized
ggtaaaatcattctataata

SEQ ID NO: 473893 - DNA, 20 bp, Artificial Sequence
  chemically synthesized
gagactgggggaaatctttg

SEQ ID NO: 473894 - DNA, 20 bp, Artificial Sequence
  chemically synthesized
ttatgaagaaataatagaca

SEQ ID NO: 473895 - DNA, 20 bp, Artificial Sequence
  chemically synthesized
aatagacatagaatactagg

SEQ ID NO: 473896 - DNA, 20 bp, Artificial Sequence
  chemically synthesized
gcctcggcctcccaaagtgc

SEQ ID NO: 473897 - DNA, 20 bp, Artificial Sequence
  chemically synthesized
gacggggtttcaccgttagc

SEQ ID NO: 473898 - DNA, 20 bp, Artificial Sequence
  chemically synthesized
ttttgtatttttagtacaga

SEQ ID NO: 473899 - DNA, 20 bp, Artificial Sequence
  chemically synthesized
gcctcagcctcctgagtagc

SEQ ID NO: 473900 - DNA, 20 bp, Artificial Sequence
  chemically synthesized
gattctcctgcctcagcctc

SEQ ID NO: 473901 - DNA, 20 bp, Artificial Sequence
  chemically synthesized
tactcaggaggctgaggcag

SEQ ID NO: 473902 - DNA, 20 bp, Artificial Sequence
  chemically synthesized
ctcactgcaacctccacctc

SEQ ID NO: 473903 - DNA, 20 bp, Artificial Sequence
  chemically synthesized
tctcgctctgtcgcccaggc

SEQ ID NO: 473904 - DNA, 20 bp, Artificial Sequence
  chemically synthesized
ttttttttttttttttgaga

SEQ ID NO: 473905 - DNA, 20 bp, Artificial Sequence
  chemically synthesized
ctcaaaaaaaaaaaaaaaaa

SEQ ID NO: 473906 - DNA, 20 bp, Artificial Sequence
  chemically synthesized
aggggcgggatatgctggat

SEQ ID NO: 473907 - DNA, 20 bp, Artificial Sequence
  chemically synthesized
atagagaggggcgggatatg

SEQ ID NO: 473908 - DNA, 20 bp, Artificial Sequence
  chemically synthesized
gaatgtgaaatagagagggg

SEQ ID NO: 473909 - DNA, 20 bp, Artificial Sequence
  chemically synthesized
ttttcctaatattagcaaca

SEQ ID NO: 473910 - DNA, 20 bp, Artificial Sequence
  chemically synthesized
taggaaaagagaacgtttac

SEQ ID NO: 473911 - DNA, 20 bp, Artificial Sequence
  chemically synthesized
tttgatttgaaccaacctct

SEQ ID NO: 473912 - DNA, 20 bp, Artificial Sequence
  chemically synthesized
actaaatctttctgtttaaa

SEQ ID NO: 473913 - DNA, 20 bp, Artificial Sequence
  chemically synthesized
ttcagtggacaaatgtggct

SEQ ID NO: 473914 - DNA, 20 bp, Artificial Sequence
  chemically synthesized
acacattgaccagagctgct

SEQ ID NO: 473915 - DNA, 20 bp, Artificial Sequence
  chemically synthesized
ctggggatcattaatgaaag

SEQ ID NO: 473916 - DNA, 20 bp, Artificial Sequence
  chemically synthesized
ccaagtacctttttgtaaca

SEQ ID NO: 473917 - DNA, 20 bp, Artificial Sequence
  chemically synthesized
tgtgatttggccatttgata

SEQ ID NO: 473918 - DNA, 20 bp, Artificial Sequence
  chemically synthesized
ttttaaaaagaagagacata

SEQ ID NO: 473919 - DNA, 20 bp, Artificial Sequence
  chemically synthesized
gtaaggtaccttcttctaga

SEQ ID NO: 473920 - DNA, 20 bp, Artificial Sequence
  chemically synthesized
ggtaccttacattttctaac

SEQ ID NO: 473921 - DNA, 20 bp, Artificial Sequence
  chemically synthesized
tgctctccagccaggaggtg

SEQ ID NO: 473922 - DNA, 20 bp, Artificial Sequence
  chemically synthesized
ctcctctgttatgttggaga

SEQ ID NO: 473923 - DNA, 20 bp, Artificial Sequence
  chemically synthesized
agacagagtgacacacgtag

SEQ ID NO: 473924 - DNA, 20 bp, Artificial Sequence
  chemically synthesized
gagtgacacacgtaggtgaa

SEQ ID NO: 473925 - DNA, 20 bp, Artificial Sequence
  chemically synthesized
taaaccaattaaatccttgt

SEQ ID NO: 473926 - DNA, 20 bp, Artificial Sequence
  chemically synthesized
taatcggtttagacccagac

SEQ ID NO: 473927 - DNA, 20 bp, Artificial Sequence
  chemically synthesized
caatctgagagaaaatagat

SEQ ID NO: 473928 - DNA, 20 bp, Artificial Sequence
  chemically synthesized
tctattttctctcagattgg

SEQ ID NO: 473929 - DNA, 20 bp, Artificial Sequence
  chemically synthesized
agaaatgctgcccagttgca

SEQ ID NO: 473930 - DNA, 20 bp, Artificial Sequence
  chemically synthesized
ccggtaactagtgactgtca

SEQ ID NO: 473931 - DNA, 20 bp, Artificial Sequence
  chemically synthesized
tagagttctctacttcttaa

SEQ ID NO: 473932 - DNA, 20 bp, Artificial Sequence
  chemically synthesized
aagaagtagagaactctaag

SEQ ID NO: 473933 - DNA, 20 bp, Artificial Sequence
  chemically synthesized
tctatggtcaaaactcagct

SEQ ID NO: 473934 - DNA, 20 bp, Artificial Sequence
  chemically synthesized
tgatcttgtaaatcacttcc

SEQ ID NO: 473935 - DNA, 20 bp, Artificial Sequence
  chemically synthesized
catgggcttcttgtgtttct

SEQ ID NO: 473936 - DNA, 20 bp, Artificial Sequence
  chemically synthesized
ttcgagagctggcataggtc

SEQ ID NO: 473937 - DNA, 20 bp, Artificial Sequence
  chemically synthesized
aagggttcaaaaccactttc

SEQ ID NO: 473938 - DNA, 20 bp, Artificial Sequence
  chemically synthesized
gaaagtggttttgaaccctt

SEQ ID NO: 473939 - DNA, 20 bp, Artificial Sequence
  chemically synthesized
ccctttccagtgagatccac

SEQ ID NO: 473940 - DNA, 20 bp, Artificial Sequence
  chemically synthesized
ccttgtggatctcactggaa

SEQ ID NO: 473941 - DNA, 20 bp, Artificial Sequence
  chemically synthesized
tctcactggaaagggattag

SEQ ID NO: 473942 - DNA, 20 bp, Artificial Sequence
  chemically synthesized
gagtggatcagccttaataa

SEQ ID NO: 473943 - DNA, 20 bp, Artificial Sequence
  chemically synthesized
ttttttgagagagagagaga

SEQ ID NO: 473944 - DNA, 20 bp, Artificial Sequence
  chemically synthesized
ttttttttttgagagagaga

SEQ ID NO: 473945 - DNA, 20 bp, Artificial Sequence
  chemically synthesized
cttaagtaggagggaaagtc

SEQ ID NO: 473946 - DNA, 20 bp, Artificial Sequence
  chemically synthesized
gtgaaaagcttctaaaaaga

SEQ ID NO: 473947 - DNA, 20 bp, Artificial Sequence
  chemically synthesized
ggaggtgaaaagcttctaaa

SEQ ID NO: 473948 - DNA, 20 bp, Artificial Sequence
  chemically synthesized
taatagaggagaaaatgtct

SEQ ID NO: 473949 - DNA, 20 bp, Artificial Sequence
  chemically synthesized
ggaccccctaatttagagat

SEQ ID NO: 473950 - DNA, 20 bp, Artificial Sequence
  chemically synthesized
ccatccatatctctaaatta

SEQ ID NO: 473951 - DNA, 20 bp, Artificial Sequence
  chemically synthesized
aatagcaaaatgaaacttac

SEQ ID NO: 473952 - DNA, 20 bp, Artificial Sequence
  chemically synthesized
cttctaaagtgcttttggga

SEQ ID NO: 473953 - DNA, 20 bp, Artificial Sequence
  chemically synthesized
ccatccttctaaagtgcttt

SEQ ID NO: 473954 - DNA, 20 bp, Artificial Sequence
  chemically synthesized
caatcccaaaagcactttag

SEQ ID NO: 473955 - DNA, 20 bp, Artificial Sequence
  chemically synthesized
ccaaaagcactttagaagga

SEQ ID NO: 473956 - DNA, 20 bp, Artificial Sequence
  chemically synthesized
ggaatcttatcatttactcc

SEQ ID NO: 473957 - DNA, 20 bp, Artificial Sequence
  chemically synthesized
gtactgatgatagtgattca

SEQ ID NO: 473958 - DNA, 20 bp, Artificial Sequence
  chemically synthesized
ttatccaatgagccccagaa

SEQ ID NO: 473959 - DNA, 20 bp, Artificial Sequence
  chemically synthesized
gtattccattctggggctca

SEQ ID NO: 473960 - DNA, 20 bp, Artificial Sequence
  chemically synthesized
catacttatccaatgagccc

SEQ ID NO: 473961 - DNA, 20 bp, Artificial Sequence
  chemically synthesized
ctggggctcattggataagt

SEQ ID NO: 473962 - DNA, 20 bp, Artificial Sequence
  chemically synthesized
cctttatagctcggaaattt

SEQ ID NO: 473963 - DNA, 20 bp, Artificial Sequence
  chemically synthesized
acaatttcattttcatttta

SEQ ID NO: 473964 - DNA, 20 bp, Artificial Sequence
  chemically synthesized
attaaactacatgctcgagg

SEQ ID NO: 473965 - DNA, 20 bp, Artificial Sequence
  chemically synthesized
tgctaggttctccggaaatg

SEQ ID NO: 473966 - DNA, 20 bp, Artificial Sequence
  chemically synthesized
tgcagggacagtcattaaaa

SEQ ID NO: 473967 - DNA, 20 bp, Artificial Sequence
  chemically synthesized
aacactgacttctatgtaat

SEQ ID NO: 473968 - DNA, 20 bp, Artificial Sequence
  chemically synthesized
ttatcagccccacatcagca

SEQ ID NO: 473969 - DNA, 20 bp, Artificial Sequence
  chemically synthesized
caattattattattgattgt

SEQ ID NO: 473970 - DNA, 20 bp, Artificial Sequence
  chemically synthesized
tgtataaacattaacatgta

SEQ ID NO: 473971 - DNA, 20 bp, Artificial Sequence
  chemically synthesized
ttgatctttgtaataacccc

SEQ ID NO: 473972 - DNA, 20 bp, Artificial Sequence
  chemically synthesized
ttgtaataaccccatgagtt

SEQ ID NO: 473973 - DNA, 20 bp, Artificial Sequence
  chemically synthesized
gcatttgtattcttaactca

SEQ ID NO: 473974 - DNA, 20 bp, Artificial Sequence
  chemically synthesized
atacaaatgctctggcatat

SEQ ID NO: 473975 - DNA, 20 bp, Artificial Sequence
  chemically synthesized
acagtttttaaaagtcgata

SEQ ID NO: 473976 - DNA, 20 bp, Artificial Sequence
  chemically synthesized
gataggctttgtgtcattgg

SEQ ID NO: 473977 - DNA, 20 bp, Artificial Sequence
  chemically synthesized
gacacaaagcctatcctgct

SEQ ID NO: 473978 - DNA, 20 bp, Artificial Sequence
  chemically synthesized
aataatacaagaattcaaag

SEQ ID NO: 473979 - DNA, 20 bp, Artificial Sequence
  chemically synthesized
tatatgaataataataatac

SEQ ID NO: 473980 - DNA, 20 bp, Artificial Sequence
  chemically synthesized
attattattattcatatagg

SEQ ID NO: 473981 - DNA, 20 bp, Artificial Sequence
  chemically synthesized
atttgttgaattctccctat

SEQ ID NO: 473982 - DNA, 20 bp, Artificial Sequence
  chemically synthesized
atagaatacctgtttatttg

SEQ ID NO: 473983 - DNA, 20 bp, Artificial Sequence
  chemically synthesized
gtcagtcttcttggtgtcaa

SEQ ID NO: 473984 - DNA, 20 bp, Artificial Sequence
  chemically synthesized
ccgtccactactgctgacac

SEQ ID NO: 473985 - DNA, 20 bp, Artificial Sequence
  chemically synthesized
agggatgctggctatacagc

SEQ ID NO: 473986 - DNA, 20 bp, Artificial Sequence
  chemically synthesized
agccagcatcccttctcaaa

SEQ ID NO: 473987 - DNA, 20 bp, Artificial Sequence
  chemically synthesized
ctcagggatcccttttgaga

SEQ ID NO: 473988 - DNA, 20 bp, Artificial Sequence
  chemically synthesized
aacagaaagctgaaaggctc

SEQ ID NO: 473989 - DNA, 20 bp, Artificial Sequence
  chemically synthesized
ccaggaagctcccatgtcat

SEQ ID NO: 473990 - DNA, 20 bp, Artificial Sequence
  chemically synthesized
ccccatgacatgggagcttc

SEQ ID NO: 473991 - DNA, 20 bp, Artificial Sequence
  chemically synthesized
gggcaagcatagccagccac

SEQ ID NO: 473992 - DNA, 20 bp, Artificial Sequence
  chemically synthesized
agaagttgggaggggaaaaa

SEQ ID NO: 473993 - DNA, 20 bp, Artificial Sequence
  chemically synthesized
aaagctgtgaactatatgat

SEQ ID NO: 473994 - DNA, 20 bp, Artificial Sequence
  chemically synthesized
cttagattttctacattgtt

SEQ ID NO: 473995 - DNA, 20 bp, Artificial Sequence
  chemically synthesized
ttcagagcagcggaaaaggc

SEQ ID NO: 473996 - DNA, 20 bp, Artificial Sequence
  chemically synthesized
aaaggcaggggtgcactgga

SEQ ID NO: 473997 - DNA, 20 bp, Artificial Sequence
  chemically synthesized
gatatgggcaagcattggat

SEQ ID NO: 473998 - DNA, 20 bp, Artificial Sequence
  chemically synthesized
tcatctgatatgggcaagca

SEQ ID NO: 473999 - DNA, 20 bp, Artificial Sequence
  chemically synthesized
ttgcccatatcagatgaaaa

SEQ ID NO: 474000 - DNA, 20 bp, Artificial Sequence
  chemically synthesized
tgctcctgctcccactggtt

SEQ ID NO: 474001 - DNA, 20 bp, Artificial Sequence
  chemically synthesized
gtgtacagaagaaaacaaat

SEQ ID NO: 474002 - DNA, 20 bp, Artificial Sequence
  chemically synthesized
tacacttctcaacagttcca

SEQ ID NO: 474003 - DNA, 20 bp, Artificial Sequence
  chemically synthesized
agcaggaataagagaacaag

SEQ ID NO: 474004 - DNA, 20 bp, Artificial Sequence
  chemically synthesized
gttctcttattcctgcttct

SEQ ID NO: 474005 - DNA, 20 bp, Artificial Sequence
  chemically synthesized
tgcaagtaattctaagaagc

SEQ ID NO: 474006 - DNA, 20 bp, Artificial Sequence
  chemically synthesized
aaaaaaaagggcggggggac

SEQ ID NO: 474007 - DNA, 20 bp, Artificial Sequence
  chemically synthesized
ccgcccttttttttttgaga

SEQ ID NO: 474008 - DNA, 20 bp, Artificial Sequence
  chemically synthesized
tcttgctctgtcgcccaggc

SEQ ID NO: 474009 - DNA, 20 bp, Artificial Sequence
  chemically synthesized
ctcagtgcagcctctgcctc

SEQ ID NO: 474010 - DNA, 20 bp, Artificial Sequence
  chemically synthesized
tacttgggaggctgagacag

SEQ ID NO: 474011 - DNA, 20 bp, Artificial Sequence
  chemically synthesized
gtctcagcctcccaagtagc

SEQ ID NO: 474012 - DNA, 20 bp, Artificial Sequence
  chemically synthesized
ttttgtatttttagtagaga

SEQ ID NO: 474013 - DNA, 20 bp, Artificial Sequence
  chemically synthesized
tgggcagatcacctgaggtc

SEQ ID NO: 474014 - DNA, 20 bp, Artificial Sequence
  chemically synthesized
agtgaggggttacctcatca

SEQ ID NO: 474015 - DNA, 20 bp, Artificial Sequence
  chemically synthesized
taagacctggctttgtagtg

SEQ ID NO: 474016 - DNA, 20 bp, Artificial Sequence
  chemically synthesized
ctcactacaaagccaggtct

SEQ ID NO: 474017 - DNA, 20 bp, Artificial Sequence
  chemically synthesized
tattcacatttgccttctcc

SEQ ID NO: 474018 - DNA, 20 bp, Artificial Sequence
  chemically synthesized
gactcttggagaaggcaaat

SEQ ID NO: 474019 - DNA, 20 bp, Artificial Sequence
  chemically synthesized
atgtgaataccattaaaaac

SEQ ID NO: 474020 - DNA, 20 bp, Artificial Sequence
  chemically synthesized
gacaaagagggtcttaaata

SEQ ID NO: 474021 - DNA, 20 bp, Artificial Sequence
  chemically synthesized
gaacatttattgatgacaaa

SEQ ID NO: 474022 - DNA, 20 bp, Artificial Sequence
  chemically synthesized
agtgggacctaagatagtgc

SEQ ID NO: 474023 - DNA, 20 bp, Artificial Sequence
  chemically synthesized
ttaggtcccactgctgaggc

SEQ ID NO: 474024 - DNA, 20 bp, Artificial Sequence
  chemically synthesized
gctgaggccgggatttaatc

SEQ ID NO: 474025 - DNA, 20 bp, Artificial Sequence
  chemically synthesized
acaaatcttgttatcagatt

SEQ ID NO: 474026 - DNA, 20 bp, Artificial Sequence
  chemically synthesized
aagaaagactttaaaataag

SEQ ID NO: 474027 - DNA, 20 bp, Artificial Sequence
  chemically synthesized
taatcagatctgcattttag

SEQ ID NO: 474028 - DNA, 20 bp, Artificial Sequence
  chemically synthesized
ctataggcgcattgtggaaa

SEQ ID NO: 474029 - DNA, 20 bp, Artificial Sequence
  chemically synthesized
ccctgatattgttcttgctt

SEQ ID NO: 474030 - DNA, 20 bp, Artificial Sequence
  chemically synthesized
aattagaggctatgtagcat

SEQ ID NO: 474031 - DNA, 20 bp, Artificial Sequence
  chemically synthesized
gcatttgagtcaaaagatat

SEQ ID NO: 474032 - DNA, 20 bp, Artificial Sequence
  chemically synthesized
gtcaagggaggtgtaaataa

SEQ ID NO: 474033 - DNA, 20 bp, Artificial Sequence
  chemically synthesized
agggaggtgtaaataaggga

SEQ ID NO: 474034 - DNA, 20 bp, Artificial Sequence
  chemically synthesized
aatgaattaagagatggctt

SEQ ID NO: 474035 - DNA, 20 bp, Artificial Sequence
  chemically synthesized
tggcttggggatagagctga

SEQ ID NO: 474036 - DNA, 20 bp, Artificial Sequence
  chemically synthesized
caaaaattagggtattattt

SEQ ID NO: 474037 - DNA, 20 bp, Artificial Sequence
  chemically synthesized
caattgcccaagtcaaaaat

SEQ ID NO: 474038 - DNA, 20 bp, Artificial Sequence
  chemically synthesized
ctaatttttgacttgggcaa

SEQ ID NO: 474039 - DNA, 20 bp, Artificial Sequence
  chemically synthesized
attagggagggaaaaatgtt

SEQ ID NO: 474040 - DNA, 20 bp, Artificial Sequence
  chemically synthesized
gggagggaaaaatgttgagg

SEQ ID NO: 474041 - DNA, 20 bp, Artificial Sequence
  chemically synthesized
agggtggattgggacaaaag

SEQ ID NO: 474042 - DNA, 20 bp, Artificial Sequence
  chemically synthesized
tgtttcttgtccaccacaac

SEQ ID NO: 474043 - DNA, 20 bp, Artificial Sequence
  chemically synthesized
acaagaaacatagaaggtgg

SEQ ID NO: 474044 - DNA, 20 bp, Artificial Sequence
  chemically synthesized
ttgaggtttattttttgcat

SEQ ID NO: 474045 - DNA, 20 bp, Artificial Sequence
  chemically synthesized
atactttatataaaaatcaa

SEQ ID NO: 474046 - DNA, 20 bp, Artificial Sequence
  chemically synthesized
ttttgtatttttagtagaga

SEQ ID NO: 474047 - DNA, 20 bp, Artificial Sequence
  chemically synthesized
ctaaaaatacaaaaaattag

SEQ ID NO: 474048 - DNA, 20 bp, Artificial Sequence
  chemically synthesized
cattctcctgcctcagcctc

SEQ ID NO: 474049 - DNA, 20 bp, Artificial Sequence
  chemically synthesized
tactcgggaggctgaggcag

SEQ ID NO: 474050 - DNA, 20 bp, Artificial Sequence
  chemically synthesized
ctcactgcaagttccgcctc

SEQ ID NO: 474051 - DNA, 20 bp, Artificial Sequence
  chemically synthesized
cctcgctctgtcgcccagct

SEQ ID NO: 474052 - DNA, 20 bp, Artificial Sequence
  chemically synthesized
aaagaacaggagaaaatctt

SEQ ID NO: 474053 - DNA, 20 bp, Artificial Sequence
  chemically synthesized
taagaatactttgcctagcc

SEQ ID NO: 474054 - DNA, 20 bp, Artificial Sequence
  chemically synthesized
catgcttttgtgttgagtct

SEQ ID NO: 474055 - DNA, 20 bp, Artificial Sequence
  chemically synthesized
ttatggatcatgcttttgtg

SEQ ID NO: 474056 - DNA, 20 bp, Artificial Sequence
  chemically synthesized
atttatcgctttttcctttt

SEQ ID NO: 474057 - DNA, 20 bp, Artificial Sequence
  chemically synthesized
gaattttaattttggcgagg

SEQ ID NO: 474058 - DNA, 20 bp, Artificial Sequence
  chemically synthesized
cttcttaacaggggatgaaa

SEQ ID NO: 474059 - DNA, 20 bp, Artificial Sequence
  chemically synthesized
atcttttcatcttcttaaca

SEQ ID NO: 474060 - DNA, 20 bp, Artificial Sequence
  chemically synthesized
tactagtcctttcttgtgta

SEQ ID NO: 474061 - DNA, 20 bp, Artificial Sequence
  chemically synthesized
tttttttatagttcggtttt

SEQ ID NO: 474062 - DNA, 20 bp, Artificial Sequence
  chemically synthesized
accgaactataaaaaaactt

SEQ ID NO: 474063 - DNA, 20 bp, Artificial Sequence
  chemically synthesized
tgaacagacatttcaatgag

SEQ ID NO: 474064 - DNA, 20 bp, Artificial Sequence
  chemically synthesized
agccattctgatatgtgtgt

SEQ ID NO: 474065 - DNA, 20 bp, Artificial Sequence
  chemically synthesized
agatattcctacacacatat

SEQ ID NO: 474066 - DNA, 20 bp, Artificial Sequence
  chemically synthesized
ttggtgaagatgcagagaaa

SEQ ID NO: 474067 - DNA, 20 bp, Artificial Sequence
  chemically synthesized
ttatattccaccagcaatgt

SEQ ID NO: 474068 - DNA, 20 bp, Artificial Sequence
  chemically synthesized
gatcactcatacattgctgg

SEQ ID NO: 474069 - DNA, 20 bp, Artificial Sequence
  chemically synthesized
attgttaggtcatatggtag

SEQ ID NO: 474070 - DNA, 20 bp, Artificial Sequence
  chemically synthesized
tttccctgagataaatgctg

SEQ ID NO: 474071 - DNA, 20 bp, Artificial Sequence
  chemically synthesized
atctgtagttttggactatt

SEQ ID NO: 474072 - DNA, 20 bp, Artificial Sequence
  chemically synthesized
cactcaccccttgaagacat

SEQ ID NO: 474073 - DNA, 20 bp, Artificial Sequence
  chemically synthesized
agataactcagatgtcttca

SEQ ID NO: 474074 - DNA, 20 bp, Artificial Sequence
  chemically synthesized
aactcagatgtcttcaaggg

SEQ ID NO: 474075 - DNA, 20 bp, Artificial Sequence
  chemically synthesized
gggtgagtgattaaataaac

SEQ ID NO: 474076 - DNA, 20 bp, Artificial Sequence
  chemically synthesized
cgtgagttgtatgctatggt

SEQ ID NO: 474077 - DNA, 20 bp, Artificial Sequence
  chemically synthesized
agacttgtttcctttttatc

SEQ ID NO: 474078 - DNA, 20 bp, Artificial Sequence
  chemically synthesized
tataaaaagagaaatctcta

SEQ ID NO: 474079 - DNA, 20 bp, Artificial Sequence
  chemically synthesized
gaaatctctagggaattatg

SEQ ID NO: 474080 - DNA, 20 bp, Artificial Sequence
  chemically synthesized
tctctagggaattatgttga

SEQ ID NO: 474081 - DNA, 20 bp, Artificial Sequence
  chemically synthesized
ccatacagtatgtaatattt

SEQ ID NO: 474082 - DNA, 20 bp, Artificial Sequence
  chemically synthesized
tgttatttcaataatgttat

SEQ ID NO: 474083 - DNA, 20 bp, Artificial Sequence
  chemically synthesized
gaggtagggggggcagggaa

SEQ ID NO: 474084 - DNA, 20 bp, Artificial Sequence
  chemically synthesized
ggctataaaaggccaatagg

SEQ ID NO: 474085 - DNA, 20 bp, Artificial Sequence
  chemically synthesized
ctctagttcaatgtcacaac

SEQ ID NO: 474086 - DNA, 20 bp, Artificial Sequence
  chemically synthesized
tcctggttgtgacattgaac

SEQ ID NO: 474087 - DNA, 20 bp, Artificial Sequence
  chemically synthesized
ggactccacataccttttta

SEQ ID NO: 474088 - DNA, 20 bp, Artificial Sequence
  chemically synthesized
aaactcggtaaaaaggtatg

SEQ ID NO: 474089 - DNA, 20 bp, Artificial Sequence
  chemically synthesized
ataatttcttacaactccat

SEQ ID NO: 474090 - DNA, 20 bp, Artificial Sequence
  chemically synthesized
tttttaattgtagattcaca

SEQ ID NO: 474091 - DNA, 20 bp, Artificial Sequence
  chemically synthesized
tctcagtaatgtatcaatga

SEQ ID NO: 474092 - DNA, 20 bp, Artificial Sequence
  chemically synthesized
ttttcatcagattagttata

SEQ ID NO: 474093 - DNA, 20 bp, Artificial Sequence
  chemically synthesized
aagggatagtgacagaacct

SEQ ID NO: 474094 - DNA, 20 bp, Artificial Sequence
  chemically synthesized
ttctgtcactatcccttttc

SEQ ID NO: 474095 - DNA, 20 bp, Artificial Sequence
  chemically synthesized
aagcttctagattcttgaaa

SEQ ID NO: 474096 - DNA, 20 bp, Artificial Sequence
  chemically synthesized
ttattcgccattgaagcctt

SEQ ID NO: 474097 - DNA, 20 bp, Artificial Sequence
  chemically synthesized
aaattcagaaggcttcaatg

SEQ ID NO: 474098 - DNA, 20 bp, Artificial Sequence
  chemically synthesized
tggtaataagaaaaaaaact

SEQ ID NO: 474099 - DNA, 20 bp, Artificial Sequence
  chemically synthesized
taagatctagatatgtgaaa

SEQ ID NO: 474100 - DNA, 20 bp, Artificial Sequence
  chemically synthesized
gtccggtgaaaggctcgttt

SEQ ID NO: 474101 - DNA, 20 bp, Artificial Sequence
  chemically synthesized
tggaggacgctgagcttgag

SEQ ID NO: 474102 - DNA, 20 bp, Artificial Sequence
  chemically synthesized
agctggatctgcaatcacat

SEQ ID NO: 474103 - DNA, 20 bp, Artificial Sequence
  chemically synthesized
tgcaatcacatctggattga

SEQ ID NO: 474104 - DNA, 20 bp, Artificial Sequence
  chemically synthesized
tgctatttgctgagtgctgg

SEQ ID NO: 474105 - DNA, 20 bp, Artificial Sequence
  chemically synthesized
acagtttttcctgctatttg

SEQ ID NO: 474106 - DNA, 20 bp, Artificial Sequence
  chemically synthesized
tggacatacaaggagacaga

SEQ ID NO: 474107 - DNA, 20 bp, Artificial Sequence
  chemically synthesized
agacagaaagaatattgata

SEQ ID NO: 474108 - DNA, 20 bp, Artificial Sequence
  chemically synthesized
gctcaacattgtcaccaaga

SEQ ID NO: 474109 - DNA, 20 bp, Artificial Sequence
  chemically synthesized
aggcagtccaacttcagtac

SEQ ID NO: 474110 - DNA, 20 bp, Artificial Sequence
  chemically synthesized
gatacaaaagcagaaactta

SEQ ID NO: 474111 - DNA, 20 bp, Artificial Sequence
  chemically synthesized
tactttctgaggtacctctg

SEQ ID NO: 474112 - DNA, 20 bp, Artificial Sequence
  chemically synthesized
gtacctcagaaagtagttgt

SEQ ID NO: 474113 - DNA, 20 bp, Artificial Sequence
  chemically synthesized
gtccttagcacagtgactgg

SEQ ID NO: 474114 - DNA, 20 bp, Artificial Sequence
  chemically synthesized
atattagctctgagcttaat

SEQ ID NO: 474115 - DNA, 20 bp, Artificial Sequence
  chemically synthesized
caaaactcctgctgtgtgcc

SEQ ID NO: 474116 - DNA, 20 bp, Artificial Sequence
  chemically synthesized
ggacactcctggcacacagc

SEQ ID NO: 474117 - DNA, 20 bp, Artificial Sequence
  chemically synthesized
ggaaggagagattttaggca

SEQ ID NO: 474118 - DNA, 20 bp, Artificial Sequence
  chemically synthesized
acaacttcactcctcatgac

SEQ ID NO: 474119 - DNA, 20 bp, Artificial Sequence
  chemically synthesized
tttttctgacccttgtcatg

SEQ ID NO: 474120 - DNA, 20 bp, Artificial Sequence
  chemically synthesized
aaaaaatggttggtgtcagc

SEQ ID NO: 474121 - DNA, 20 bp, Artificial Sequence
  chemically synthesized
tggtgtcagcgggaatgata

SEQ ID NO: 474122 - DNA, 20 bp, Artificial Sequence
  chemically synthesized
gaataggtaagtaatgaaag

SEQ ID NO: 474123 - DNA, 20 bp, Artificial Sequence
  chemically synthesized
atctattcatagttaaaatg

SEQ ID NO: 474124 - DNA, 20 bp, Artificial Sequence
  chemically synthesized
tttgactccacattttaact

SEQ ID NO: 474125 - DNA, 20 bp, Artificial Sequence
  chemically synthesized
ttgcacactacagtcaagct

SEQ ID NO: 474126 - DNA, 20 bp, Artificial Sequence
  chemically synthesized
cccagtatagcagaaagaac

SEQ ID NO: 474127 - DNA, 20 bp, Artificial Sequence
  chemically synthesized
gtttttagcatgaagggttg

SEQ ID NO: 474128 - DNA, 20 bp, Artificial Sequence
  chemically synthesized
tattgagagtttttagcatg

SEQ ID NO: 474129 - DNA, 20 bp, Artificial Sequence
  chemically synthesized
ccatcaatacctaatttatt

SEQ ID NO: 474130 - DNA, 20 bp, Artificial Sequence
  chemically synthesized
cattcagtatgatattggct

SEQ ID NO: 474131 - DNA, 20 bp, Artificial Sequence
  chemically synthesized
aacccacagccaatatcata

SEQ ID NO: 474132 - DNA, 20 bp, Artificial Sequence
  chemically synthesized
gtcttgtgccagttttcaga

SEQ ID NO: 474133 - DNA, 20 bp, Artificial Sequence
  chemically synthesized
tctgaaaactggcacaagac

SEQ ID NO: 474134 - DNA, 20 bp, Artificial Sequence
  chemically synthesized
cttccaacactatgttgaat

SEQ ID NO: 474135 - DNA, 20 bp, Artificial Sequence
  chemically synthesized
ccagaacttccaacactatg

SEQ ID NO: 474136 - DNA, 20 bp, Artificial Sequence
  chemically synthesized
tcaggcaggagaaggaaata

SEQ ID NO: 474137 - DNA, 20 bp, Artificial Sequence
  chemically synthesized
ttgacttcctcttttcctaa

SEQ ID NO: 474138 - DNA, 20 bp, Artificial Sequence
  chemically synthesized
gagatttggggttgagacga

SEQ ID NO: 474139 - DNA, 20 bp, Artificial Sequence
  chemically synthesized
cttatcagcttaaggagatt

SEQ ID NO: 474140 - DNA, 20 bp, Artificial Sequence
  chemically synthesized
aagcaacttcagcaaagtct

SEQ ID NO: 474141 - DNA, 20 bp, Artificial Sequence
  chemically synthesized
tctgtctgttattggtgtat

SEQ ID NO: 474142 - DNA, 20 bp, Artificial Sequence
  chemically synthesized
aacagacagagagccaaatc

SEQ ID NO: 474143 - DNA, 20 bp, Artificial Sequence
  chemically synthesized
tctttgaagcaattgtgaat

SEQ ID NO: 474144 - DNA, 20 bp, Artificial Sequence
  chemically synthesized
ttattctctttgaagcaatt

SEQ ID NO: 474145 - DNA, 20 bp, Artificial Sequence
  chemically synthesized
ccattcacaattgcttcaaa

SEQ ID NO: 474146 - DNA, 20 bp, Artificial Sequence
  chemically synthesized
tcaaagagaataaaatacct

SEQ ID NO: 474147 - DNA, 20 bp, Artificial Sequence
  chemically synthesized
acctaggaatccaacttaca

SEQ ID NO: 474148 - DNA, 20 bp, Artificial Sequence
  chemically synthesized
tccttcacatcccttgtaag

SEQ ID NO: 474149 - DNA, 20 bp, Artificial Sequence
  chemically synthesized
cactgctcaaggaaataaaa

SEQ ID NO: 474150 - DNA, 20 bp, Artificial Sequence
  chemically synthesized
tggaagaacattccatgctc

SEQ ID NO: 474151 - DNA, 20 bp, Artificial Sequence
  chemically synthesized
attcttcctacccatgagca

SEQ ID NO: 474152 - DNA, 20 bp, Artificial Sequence
  chemically synthesized
attccatgctcatgggtagg

SEQ ID NO: 474153 - DNA, 20 bp, Artificial Sequence
  chemically synthesized
gtagcttgatggggatggca

SEQ ID NO: 474154 - DNA, 20 bp, Artificial Sequence
  chemically synthesized
aaagtcattggtagcttgat

SEQ ID NO: 474155 - DNA, 20 bp, Artificial Sequence
  chemically synthesized
gctaccaatgactttcttca

SEQ ID NO: 474156 - DNA, 20 bp, Artificial Sequence
  chemically synthesized
ccagctttgttcttttggct

SEQ ID NO: 474157 - DNA, 20 bp, Artificial Sequence
  chemically synthesized
agaaaaacaagcaatgggga

SEQ ID NO: 474158 - DNA, 20 bp, Artificial Sequence
  chemically synthesized
ccagcaccatttattaaata

SEQ ID NO: 474159 - DNA, 20 bp, Artificial Sequence
  chemically synthesized
ccatatgtagaaagctgaaa

SEQ ID NO: 474160 - DNA, 20 bp, Artificial Sequence
  chemically synthesized
tttcgtataaggtgtaagga

SEQ ID NO: 474161 - DNA, 20 bp, Artificial Sequence
  chemically synthesized
tatacgaaaattaattcaag

SEQ ID NO: 474162 - DNA, 20 bp, Artificial Sequence
  chemically synthesized
atttaagtctttaatccatc

SEQ ID NO: 474163 - DNA, 20 bp, Artificial Sequence
  chemically synthesized
gtaatgcctaggttttcttc

SEQ ID NO: 474164 - DNA, 20 bp, Artificial Sequence
  chemically synthesized
tccttgcccatgcctatgtc

SEQ ID NO: 474165 - DNA, 20 bp, Artificial Sequence
  chemically synthesized
caaaagccaaaattgacaaa

SEQ ID NO: 474166 - DNA, 20 bp, Artificial Sequence
  chemically synthesized
acagcaaaagaaactaccat

SEQ ID NO: 474167 - DNA, 20 bp, Artificial Sequence
  chemically synthesized
tctgacaaagggctaatatc

SEQ ID NO: 474168 - DNA, 20 bp, Artificial Sequence
  chemically synthesized
gtttgagttcattgtagatt

SEQ ID NO: 474169 - DNA, 20 bp, Artificial Sequence
  chemically synthesized
tttttttcttgtacatttgt

SEQ ID NO: 474170 - DNA, 20 bp, Artificial Sequence
  chemically synthesized
gtccttcgcccactttttga

SEQ ID NO: 474171 - DNA, 20 bp, Artificial Sequence
  chemically synthesized
agataccatctcacaccagt

SEQ ID NO: 474172 - DNA, 20 bp, Artificial Sequence
  chemically synthesized
aggaaacaacaggtgctgga

SEQ ID NO: 474173 - DNA, 20 bp, Artificial Sequence
  chemically synthesized
agtcagtgtggcgattcctc

SEQ ID NO: 474174 - DNA, 20 bp, Artificial Sequence
  chemically synthesized
tttctagttctagatccctg

SEQ ID NO: 474175 - DNA, 20 bp, Artificial Sequence
  chemically synthesized
tatacccagtaatgggatgg

SEQ ID NO: 474176 - DNA, 20 bp, Artificial Sequence
  chemically synthesized
ttgacccagccatcccatta

SEQ ID NO: 474177 - DNA, 20 bp, Artificial Sequence
  chemically synthesized
tttgggtatatacccagtaa

SEQ ID NO: 474178 - DNA, 20 bp, Artificial Sequence
  chemically synthesized
gcagcatgatttatagtcct

SEQ ID NO: 474179 - DNA, 20 bp, Artificial Sequence
  chemically synthesized
ggttccaagtctttgctgtt

SEQ ID NO: 474180 - DNA, 20 bp, Artificial Sequence
  chemically synthesized
agcctatcattgttggacat

SEQ ID NO: 474181 - DNA, 20 bp, Artificial Sequence
  chemically synthesized
aaatgtccaacaatgatagg

SEQ ID NO: 474182 - DNA, 20 bp, Artificial Sequence
  chemically synthesized
aatgtggcacatacgcacca

SEQ ID NO: 474183 - DNA, 20 bp, Artificial Sequence
  chemically synthesized
ctatgcagccataaaaaatg

SEQ ID NO: 474184 - DNA, 20 bp, Artificial Sequence
  chemically synthesized
ttcatgtcctttgtagggac

SEQ ID NO: 474185 - DNA, 20 bp, Artificial Sequence
  chemically synthesized
tgtccatgtgatagtttact

SEQ ID NO: 474186 - DNA, 20 bp, Artificial Sequence
  chemically synthesized
gcatgttctcactcataggt

SEQ ID NO: 474187 - DNA, 20 bp, Artificial Sequence
  chemically synthesized
tcattgttcaattcccacct

SEQ ID NO: 474188 - DNA, 20 bp, Artificial Sequence
  chemically synthesized
ccccaccccacaacagtccc

SEQ ID NO: 474189 - DNA, 20 bp, Artificial Sequence
  chemically synthesized
tcacactctggggactgttg

SEQ ID NO: 474190 - DNA, 20 bp, Artificial Sequence
  chemically synthesized
gtggggtggggggagggggg

SEQ ID NO: 474191 - DNA, 20 bp, Artificial Sequence
  chemically synthesized
gatatacctaatgctaaatg

SEQ ID NO: 474192 - DNA, 20 bp, Artificial Sequence
  chemically synthesized
taatgctaaatgacgagtta

SEQ ID NO: 474193 - DNA, 20 bp, Artificial Sequence
  chemically synthesized
ttttattatactttaagttt

SEQ ID NO: 474194 - DNA, 20 bp, Artificial Sequence
  chemically synthesized
gtgtctactacagatgctga

SEQ ID NO: 474195 - DNA, 20 bp, Artificial Sequence
  chemically synthesized
aaggccctaaagaggaggtc

SEQ ID NO: 474196 - DNA, 20 bp, Artificial Sequence
  chemically synthesized
ctcacagctggggccttcat

SEQ ID NO: 474197 - DNA, 20 bp, Artificial Sequence
  chemically synthesized
ctaggtctctccctgaggga

SEQ ID NO: 474198 - DNA, 20 bp, Artificial Sequence
  chemically synthesized
ggccaatgactggctgatgc

SEQ ID NO: 474199 - DNA, 20 bp, Artificial Sequence
  chemically synthesized
taatggaacactaggcataa

SEQ ID NO: 474200 - DNA, 20 bp, Artificial Sequence
  chemically synthesized
tattgggacgctaagcttgt

SEQ ID NO: 474201 - DNA, 20 bp, Artificial Sequence
  chemically synthesized
ttggcgatgaccttgagcag

SEQ ID NO: 474202 - DNA, 20 bp, Artificial Sequence
  chemically synthesized
ttttgcaacctccagcataa

SEQ ID NO: 474203 - DNA, 20 bp, Artificial Sequence
  chemically synthesized
agttgtccccagtaaatcaa

SEQ ID NO: 474204 - DNA, 20 bp, Artificial Sequence
  chemically synthesized
ctggagtaggtttggccttt

SEQ ID NO: 474205 - DNA, 20 bp, Artificial Sequence
  chemically synthesized
aggagcatgcagggaagctc

SEQ ID NO: 474206 - DNA, 20 bp, Artificial Sequence
  chemically synthesized
gtcatactgggaagtgctct

SEQ ID NO: 474207 - DNA, 20 bp, Artificial Sequence
  chemically synthesized
agttggagagttgcttgcag

SEQ ID NO: 474208 - DNA, 20 bp, Artificial Sequence
  chemically synthesized
ctcagaagcagaagcagttg

SEQ ID NO: 474209 - DNA, 20 bp, Artificial Sequence
  chemically synthesized
ttttttccctttcacagatt

SEQ ID NO: 474210 - DNA, 20 bp, Artificial Sequence
  chemically synthesized
aaaggtacacagttgttatt

SEQ ID NO: 474211 - DNA, 20 bp, Artificial Sequence
  chemically synthesized
ttgttattgagagttgtgct

SEQ ID NO: 474212 - DNA, 20 bp, Artificial Sequence
  chemically synthesized
ttctaggaacatcatgtaag

SEQ ID NO: 474213 - DNA, 20 bp, Artificial Sequence
  chemically synthesized
ttccgcttacatgatgttcc

SEQ ID NO: 474214 - DNA, 20 bp, Artificial Sequence
  chemically synthesized
aggaaatgagaagtggttta

SEQ ID NO: 474215 - DNA, 20 bp, Artificial Sequence
  chemically synthesized
caagtccactacatgacaac

SEQ ID NO: 474216 - DNA, 20 bp, Artificial Sequence
  chemically synthesized
ttaccattttaaccattttt

SEQ ID NO: 474217 - DNA, 20 bp, Artificial Sequence
  chemically synthesized
tgtgggtaaaatcaattaaa

SEQ ID NO: 474218 - DNA, 20 bp, Artificial Sequence
  chemically synthesized
gccagaaaaggtacctgctt

SEQ ID NO: 474219 - DNA, 20 bp, Artificial Sequence
  chemically synthesized
tcctgtattttctcatcctg

SEQ ID NO: 474220 - DNA, 20 bp, Artificial Sequence
  chemically synthesized
aaactataggtcccacccaa

SEQ ID NO: 474221 - DNA, 20 bp, Artificial Sequence
  chemically synthesized
tccctgcctcctctgacacc

SEQ ID NO: 474222 - DNA, 20 bp, Artificial Sequence
  chemically synthesized
gattacggagacgtaatatc

SEQ ID NO: 474223 - DNA, 20 bp, Artificial Sequence
  chemically synthesized
agggtgatttcagctcatga

SEQ ID NO: 474224 - DNA, 20 bp, Artificial Sequence
  chemically synthesized
cagttcctcagagcctatgc

SEQ ID NO: 474225 - DNA, 20 bp, Artificial Sequence
  chemically synthesized
tttcaacaacctggcaccga

SEQ ID NO: 474226 - DNA, 20 bp, Artificial Sequence
  chemically synthesized
gtgccaggttgttgaaaata

SEQ ID NO: 474227 - DNA, 20 bp, Artificial Sequence
  chemically synthesized
gaaaataagggattgagatc

SEQ ID NO: 474228 - DNA, 20 bp, Artificial Sequence
  chemically synthesized
tgatgtgcttagatatcctg

SEQ ID NO: 474229 - DNA, 20 bp, Artificial Sequence
  chemically synthesized
gaatctgtgtcaaaatccat

SEQ ID NO: 474230 - DNA, 20 bp, Artificial Sequence
  chemically synthesized
ttgacacagattctctgctt

SEQ ID NO: 474231 - DNA, 20 bp, Artificial Sequence
  chemically synthesized
attacactcacccccaagca

SEQ ID NO: 474232 - DNA, 20 bp, Artificial Sequence
  chemically synthesized
cacagattctctgcttgggg

SEQ ID NO: 474233 - DNA, 20 bp, Artificial Sequence
  chemically synthesized
attactatttgtacagagag

SEQ ID NO: 474234 - DNA, 20 bp, Artificial Sequence
  chemically synthesized
aagtcctctactttagcttg

SEQ ID NO: 474235 - DNA, 20 bp, Artificial Sequence
  chemically synthesized
agaggactttaaagtggttg

SEQ ID NO: 474236 - DNA, 20 bp, Artificial Sequence
  chemically synthesized
ctgctgaccagtttgagctt

SEQ ID NO: 474237 - DNA, 20 bp, Artificial Sequence
  chemically synthesized
caaactggtcagcaggacaa

SEQ ID NO: 474238 - DNA, 20 bp, Artificial Sequence
  chemically synthesized
cagcaggacaaaagaatata

SEQ ID NO: 474239 - DNA, 20 bp, Artificial Sequence
  chemically synthesized
gacaaaagaatatacagagt

SEQ ID NO: 474240 - DNA, 20 bp, Artificial Sequence
  chemically synthesized
tagacaggaatttctggata

SEQ ID NO: 474241 - DNA, 20 bp, Artificial Sequence
  chemically synthesized
ttcttgctagacaggaattt

SEQ ID NO: 474242 - DNA, 20 bp, Artificial Sequence
  chemically synthesized
tccagaaattcctgtctagc

SEQ ID NO: 474243 - DNA, 20 bp, Artificial Sequence
  chemically synthesized
cctctccattcttgctagac

SEQ ID NO: 474244 - DNA, 20 bp, Artificial Sequence
  chemically synthesized
tggagaggaaatgtcagagc

SEQ ID NO: 474245 - DNA, 20 bp, Artificial Sequence
  chemically synthesized
ggaaatgtcagagcatgggt

SEQ ID NO: 474246 - DNA, 20 bp, Artificial Sequence
  chemically synthesized
tcagagcatgggttggaatt

SEQ ID NO: 474247 - DNA, 20 bp, Artificial Sequence
  chemically synthesized
ggaggtgccactgcaaaatt

SEQ ID NO: 474248 - DNA, 20 bp, Artificial Sequence
  chemically synthesized
actgcaaaatttggaataaa

SEQ ID NO: 474249 - DNA, 20 bp, Artificial Sequence
  chemically synthesized
agaagaaacaaccactggct

SEQ ID NO: 474250 - DNA, 20 bp, Artificial Sequence
  chemically synthesized
ttttaagcagctttcctagt

SEQ ID NO: 474251 - DNA, 20 bp, Artificial Sequence
  chemically synthesized
aagcagctttcctagtgagg

SEQ ID NO: 474252 - DNA, 20 bp, Artificial Sequence
  chemically synthesized
aagagcactgggcttctccc

SEQ ID NO: 474253 - DNA, 20 bp, Artificial Sequence
  chemically synthesized
ggcttctccccagagtcaca

SEQ ID NO: 474254 - DNA, 20 bp, Artificial Sequence
  chemically synthesized
gctgtaatcattaaaacctg

SEQ ID NO: 474255 - DNA, 20 bp, Artificial Sequence
  chemically synthesized
gtcagattcaatgcattttg

SEQ ID NO: 474256 - DNA, 20 bp, Artificial Sequence
  chemically synthesized
ttctaacccagcaaaatgca

SEQ ID NO: 474257 - DNA, 20 bp, Artificial Sequence
  chemically synthesized
cttagtacatatatgcagtt

SEQ ID NO: 474258 - DNA, 20 bp, Artificial Sequence
  chemically synthesized
ttataaaatctttttgtgta

SEQ ID NO: 474259 - DNA, 20 bp, Artificial Sequence
  chemically synthesized
tatcaaaatcaaaacaaaca

SEQ ID NO: 474260 - DNA, 20 bp, Artificial Sequence
  chemically synthesized
tcactaccaagtctttagaa

SEQ ID NO: 474261 - DNA, 20 bp, Artificial Sequence
  chemically synthesized
tactctcactaccaagtctt

SEQ ID NO: 474262 - DNA, 20 bp, Artificial Sequence
  chemically synthesized
tattctaaagacttggtagt

SEQ ID NO: 474263 - DNA, 20 bp, Artificial Sequence
  chemically synthesized
gtagagcgggaggtggcggg

SEQ ID NO: 474264 - DNA, 20 bp, Artificial Sequence
  chemically synthesized
gcgggaggtggcggggggaa

SEQ ID NO: 474265 - DNA, 20 bp, Artificial Sequence
  chemically synthesized
tgaagggctgtctttgccaa

SEQ ID NO: 474266 - DNA, 20 bp, Artificial Sequence
  chemically synthesized
agagataacagcctaattat

SEQ ID NO: 474267 - DNA, 20 bp, Artificial Sequence
  chemically synthesized
acaggctgctttacaaagtg

SEQ ID NO: 474268 - DNA, 20 bp, Artificial Sequence
  chemically synthesized
aaatgtggaagaactcctga

SEQ ID NO: 474269 - DNA, 20 bp, Artificial Sequence
  chemically synthesized
gatctagtctaaatcctttc

SEQ ID NO: 474270 - DNA, 20 bp, Artificial Sequence
  chemically synthesized
ttaatcacatcttaacaagt

SEQ ID NO: 474271 - DNA, 20 bp, Artificial Sequence
  chemically synthesized
gcttaaataagttaactatc

SEQ ID NO: 474272 - DNA, 20 bp, Artificial Sequence
  chemically synthesized
agtcagcctaatgtaatggt

SEQ ID NO: 474273 - DNA, 20 bp, Artificial Sequence
  chemically synthesized
caggtctgcagccatattac

SEQ ID NO: 474274 - DNA, 20 bp, Artificial Sequence
  chemically synthesized
tgcagccatattacctgggt

SEQ ID NO: 474275 - DNA, 20 bp, Artificial Sequence
  chemically synthesized
aagactaaggtatagagaga

SEQ ID NO: 474276 - DNA, 20 bp, Artificial Sequence
  chemically synthesized
agtcttcttatttgtaaact

SEQ ID NO: 474277 - DNA, 20 bp, Artificial Sequence
  chemically synthesized
atgtatacgtgcaggtcaca

SEQ ID NO: 474278 - DNA, 20 bp, Artificial Sequence
  chemically synthesized
tttcagttacttcaggcctt

SEQ ID NO: 474279 - DNA, 20 bp, Artificial Sequence
  chemically synthesized
cattttcacttcttttgtgg

SEQ ID NO: 474280 - DNA, 20 bp, Artificial Sequence
  chemically synthesized
agccaggatgagccagggaa

SEQ ID NO: 474281 - DNA, 20 bp, Artificial Sequence
  chemically synthesized
agtggggaagctttttgagc

SEQ ID NO: 474282 - DNA, 20 bp, Artificial Sequence
  chemically synthesized
gttttctggcgggcaggagt

SEQ ID NO: 474283 - DNA, 20 bp, Artificial Sequence
  chemically synthesized
ggggtggttttctggcgggc

SEQ ID NO: 474284 - DNA, 20 bp, Artificial Sequence
  chemically synthesized
aggaaaattacagtcaaatg

SEQ ID NO: 474285 - DNA, 20 bp, Artificial Sequence
  chemically synthesized
gtggggccgttttataagat

SEQ ID NO: 474286 - DNA, 20 bp, Artificial Sequence
  chemically synthesized
aagagtcagcaaagggagac

SEQ ID NO: 474287 - DNA, 20 bp, Artificial Sequence
  chemically synthesized
gcaggcgggctgagtccaaa

SEQ ID NO: 474288 - DNA, 20 bp, Artificial Sequence
  chemically synthesized
atcacctggatgcaggcggg

SEQ ID NO: 474289 - DNA, 20 bp, Artificial Sequence
  chemically synthesized
caataaaactttttaatcac

SEQ ID NO: 474290 - DNA, 20 bp, Artificial Sequence
  chemically synthesized
atgaaatttggtgccatcac

SEQ ID NO: 474291 - DNA, 20 bp, Artificial Sequence
  chemically synthesized
cccaagggaggtcccctgat

SEQ ID NO: 474292 - DNA, 20 bp, Artificial Sequence
  chemically synthesized
gagcaaggagcaggaggaca

SEQ ID NO: 474293 - DNA, 20 bp, Artificial Sequence
  chemically synthesized
ctgaggaccagaggtcgtag

SEQ ID NO: 474294 - DNA, 20 bp, Artificial Sequence
  chemically synthesized
gatagtgagaggttggagga

SEQ ID NO: 474295 - DNA, 20 bp, Artificial Sequence
  chemically synthesized
ttgaaaggagaaagaggttg

SEQ ID NO: 474296 - DNA, 20 bp, Artificial Sequence
  chemically synthesized
ggtgccggagttttgggtcc

SEQ ID NO: 474297 - DNA, 20 bp, Artificial Sequence
  chemically synthesized
ccgtgaccggtgccggagtt

SEQ ID NO: 474298 - DNA, 20 bp, Artificial Sequence
  chemically synthesized
tccgagtccgtgaccggtgc

SEQ ID NO: 474299 - DNA, 20 bp, Artificial Sequence
  chemically synthesized
ggcaccggtcacggactcgg

SEQ ID NO: 474300 - DNA, 20 bp, Artificial Sequence
  chemically synthesized
aataccaagggaagactctt

SEQ ID NO: 474301 - DNA, 20 bp, Artificial Sequence
  chemically synthesized
cccttggtatttaatcacgc

SEQ ID NO: 474302 - DNA, 20 bp, Artificial Sequence
  chemically synthesized
cagacacctctgaaatgtgg

SEQ ID NO: 474303 - DNA, 20 bp, Artificial Sequence
  chemically synthesized
tggtcagacacctctgaaat

SEQ ID NO: 474304 - DNA, 20 bp, Artificial Sequence
  chemically synthesized
agacatggagagaagggttg

SEQ ID NO: 474305 - DNA, 20 bp, Artificial Sequence
  chemically synthesized
aggggtagagacatggagag

SEQ ID NO: 474306 - DNA, 20 bp, Artificial Sequence
  chemically synthesized
gtcccccagaaaagcggaga

SEQ ID NO: 474307 - DNA, 20 bp, Artificial Sequence
  chemically synthesized
agacacggagagaaggggtg

SEQ ID NO: 474308 - DNA, 20 bp, Artificial Sequence
  chemically synthesized
ggagtagagacacggagaga

SEQ ID NO: 474309 - DNA, 20 bp, Artificial Sequence
  chemically synthesized
ggaggcaagcccagagaaaa

SEQ ID NO: 474310 - DNA, 20 bp, Artificial Sequence
  chemically synthesized
agggagaaaaaggaggaatg

SEQ ID NO: 474311 - DNA, 20 bp, Artificial Sequence
  chemically synthesized
caggctaagggagaaaaagg

SEQ ID NO: 474312 - DNA, 20 bp, Artificial Sequence
  chemically synthesized
atttaggttttaggtcaggt

SEQ ID NO: 474313 - DNA, 20 bp, Artificial Sequence
  chemically synthesized
aactactgtcaagtttgtac

SEQ ID NO: 474314 - DNA, 20 bp, Artificial Sequence
  chemically synthesized
caagaattatttagagcttg

SEQ ID NO: 474315 - DNA, 20 bp, Artificial Sequence
  chemically synthesized
ccgtttgcctattttatgac

SEQ ID NO: 474316 - DNA, 20 bp, Artificial Sequence
  chemically synthesized
ggggaggggcagatgtgtaa

SEQ ID NO: 474317 - DNA, 20 bp, Artificial Sequence
  chemically synthesized
ggaaagaaggaagatttgga

SEQ ID NO: 474318 - DNA, 20 bp, Artificial Sequence
  chemically synthesized
tagaaagactgagcgatgct

SEQ ID NO: 474319 - DNA, 20 bp, Artificial Sequence
  chemically synthesized
gcgaggaggggagaggtcag

SEQ ID NO: 474320 - DNA, 20 bp, Artificial Sequence
  chemically synthesized
gggtggaggagcagaggctg

SEQ ID NO: 474321 - DNA, 20 bp, Artificial Sequence
  chemically synthesized
cggaggtgataaaaggatta

SEQ ID NO: 474322 - DNA, 20 bp, Artificial Sequence
  chemically synthesized
gtgaggagcggaggtgataa

SEQ ID NO: 474323 - DNA, 20 bp, Artificial Sequence
  chemically synthesized
gaaggaaactgtaagccgga

SEQ ID NO: 474324 - DNA, 20 bp, Artificial Sequence
  chemically synthesized
agcctaaacgctatctgatt

SEQ ID NO: 474325 - DNA, 20 bp, Artificial Sequence
  chemically synthesized
tctagggctgtaaagcatct

SEQ ID NO: 474326 - DNA, 20 bp, Artificial Sequence
  chemically synthesized
aagacggccttttgaccttt

SEQ ID NO: 474327 - DNA, 20 bp, Artificial Sequence
  chemically synthesized
tgggtaataaaatatatatt

SEQ ID NO: 474328 - DNA, 20 bp, Artificial Sequence
  chemically synthesized
agtttaatgtcgggagcaga

SEQ ID NO: 474329 - DNA, 20 bp, Artificial Sequence
  chemically synthesized
gagggctggaatttaatttt

SEQ ID NO: 474330 - DNA, 20 bp, Artificial Sequence
  chemically synthesized
gtcttgtggggtttgagggc

SEQ ID NO: 474331 - DNA, 20 bp, Artificial Sequence
  chemically synthesized
gcgaggttaattaagtcttg

SEQ ID NO: 474332 - DNA, 20 bp, Artificial Sequence
  chemically synthesized
agccaagtagcaatgtattt

SEQ ID NO: 474333 - DNA, 20 bp, Artificial Sequence
  chemically synthesized
tttgtctcacagtggaggga

SEQ ID NO: 474334 - DNA, 20 bp, Artificial Sequence
  chemically synthesized
ttctgtgctggagatatggc

SEQ ID NO: 474335 - DNA, 20 bp, Artificial Sequence
  chemically synthesized
gcagctgcagttcaggcatt

SEQ ID NO: 474336 - DNA, 20 bp, Artificial Sequence
  chemically synthesized
atgcctgaactgcagctgcg

SEQ ID NO: 474337 - DNA, 20 bp, Artificial Sequence
  chemically synthesized
gcagctgcgaggggttcctc

SEQ ID NO: 474338 - DNA, 20 bp, Artificial Sequence
  chemically synthesized
gaaatctggccactgggcca

SEQ ID NO: 474339 - DNA, 20 bp, Artificial Sequence
  chemically synthesized
gccaaggaatgcccgcagcc

SEQ ID NO: 474340 - DNA, 20 bp, Artificial Sequence
  chemically synthesized
cagatgggacatggcttagg

SEQ ID NO: 474341 - DNA, 20 bp, Artificial Sequence
  chemically synthesized
ttgaacagtccgattttcag

SEQ ID NO: 474342 - DNA, 20 bp, Artificial Sequence
  chemically synthesized
gctctgggagtggctgccag

SEQ ID NO: 474343 - DNA, 20 bp, Artificial Sequence
  chemically synthesized
gccagagttccaggggctct

SEQ ID NO: 474344 - DNA, 20 bp, Artificial Sequence
  chemically synthesized
ggagtcagagagccttgggc

SEQ ID NO: 474345 - DNA, 20 bp, Artificial Sequence
  chemically synthesized
taaaccgagaagatctggga

SEQ ID NO: 474346 - DNA, 20 bp, Artificial Sequence
  chemically synthesized
ttcaggtaactctcacagtg

SEQ ID NO: 474347 - DNA, 20 bp, Artificial Sequence
  chemically synthesized
acggacttaccctccactgt

SEQ ID NO: 474348 - DNA, 20 bp, Artificial Sequence
  chemically synthesized
tgaaaagaaggtaatgtgga

SEQ ID NO: 474349 - DNA, 20 bp, Artificial Sequence
  chemically synthesized
cccttgaaaagaaggtaatg

SEQ ID NO: 474350 - DNA, 20 bp, Artificial Sequence
  chemically synthesized
ctaagttggcaccagagttt

SEQ ID NO: 474351 - DNA, 20 bp, Artificial Sequence
  chemically synthesized
agtatcgtctaagttggcac

SEQ ID NO: 474352 - DNA, 20 bp, Artificial Sequence
  chemically synthesized
aactaaaaaggagtgcttaa

SEQ ID NO: 474353 - DNA, 20 bp, Artificial Sequence
  chemically synthesized
gcaggtggggataactaaaa

SEQ ID NO: 474354 - DNA, 20 bp, Artificial Sequence
  chemically synthesized
taatagggaactgggcaggt

SEQ ID NO: 474355 - DNA, 20 bp, Artificial Sequence
  chemically synthesized
atgaggtgtggctctagcct

SEQ ID NO: 474356 - DNA, 20 bp, Artificial Sequence
  chemically synthesized
agtagaggtgtcttatgctt

SEQ ID NO: 474357 - DNA, 20 bp, Artificial Sequence
  chemically synthesized
gcatgattggtcgctaagga

SEQ ID NO: 474358 - DNA, 20 bp, Artificial Sequence
  chemically synthesized
taggttttaatgggatggta

SEQ ID NO: 474359 - DNA, 20 bp, Artificial Sequence
  chemically synthesized
taagggtgattaggttttaa

SEQ ID NO: 474360 - DNA, 20 bp, Artificial Sequence
  chemically synthesized
atgttggcattgagcggagt

SEQ ID NO: 474361 - DNA, 20 bp, Artificial Sequence
  chemically synthesized
gatgggatgttggcattgag

SEQ ID NO: 474362 - DNA, 20 bp, Artificial Sequence
  chemically synthesized
ttttaaagcgtgctgtggga

SEQ ID NO: 474363 - DNA, 20 bp, Artificial Sequence
  chemically synthesized
aatccttttaaagcgtgctg

SEQ ID NO: 474364 - DNA, 20 bp, Artificial Sequence
  chemically synthesized
catcccacagcacgctttaa

SEQ ID NO: 474365 - DNA, 20 bp, Artificial Sequence
  chemically synthesized
aaaaggccatgctgtagcag

SEQ ID NO: 474366 - DNA, 20 bp, Artificial Sequence
  chemically synthesized
taaaatgggggaattgtaag

SEQ ID NO: 474367 - DNA, 20 bp, Artificial Sequence
  chemically synthesized
ttttaggacaggtaaaatgg

SEQ ID NO: 474368 - DNA, 20 bp, Artificial Sequence
  chemically synthesized
acaaggtttacaggttagtt

SEQ ID NO: 474369 - DNA, 20 bp, Artificial Sequence
  chemically synthesized
agtatatgggtttggcacca

SEQ ID NO: 474370 - DNA, 20 bp, Artificial Sequence
  chemically synthesized
tattgaggacaggagagtat

SEQ ID NO: 474371 - DNA, 20 bp, Artificial Sequence
  chemically synthesized
gagggaggtattgaggacag

SEQ ID NO: 474372 - DNA, 20 bp, Artificial Sequence
  chemically synthesized
ttgagatccagaacagaata

SEQ ID NO: 474373 - DNA, 20 bp, Artificial Sequence
  chemically synthesized
ccacaacccattattctgtt

SEQ ID NO: 474374 - DNA, 20 bp, Artificial Sequence
  chemically synthesized
agcatgtttgagatccagaa

SEQ ID NO: 474375 - DNA, 20 bp, Artificial Sequence
  chemically synthesized
ggctggggtgaagggtgcaa

SEQ ID NO: 474376 - DNA, 20 bp, Artificial Sequence
  chemically synthesized
agtgaagagaggctggggtg

SEQ ID NO: 474377 - DNA, 20 bp, Artificial Sequence
  chemically synthesized
aagtgaaagtgaagagaggc

SEQ ID NO: 474378 - DNA, 20 bp, Artificial Sequence
  chemically synthesized
ttgctgagcctgatgggtgt

SEQ ID NO: 474379 - DNA, 20 bp, Artificial Sequence
  chemically synthesized
caggtaatttgctgagcctg

SEQ ID NO: 474380 - DNA, 20 bp, Artificial Sequence
  chemically synthesized
gagagcacgtgtgtttttat

SEQ ID NO: 474381 - DNA, 20 bp, Artificial Sequence
  chemically synthesized
tgttgttttctagaagggat

SEQ ID NO: 474382 - DNA, 20 bp, Artificial Sequence
  chemically synthesized
aaaacttgttgttttctaga

SEQ ID NO: 474383 - DNA, 20 bp, Artificial Sequence
  chemically synthesized
agtttatataatggttttgt

SEQ ID NO: 474384 - DNA, 20 bp, Artificial Sequence
  chemically synthesized
ggtcagctaggtttcctttt

SEQ ID NO: 474385 - DNA, 20 bp, Artificial Sequence
  chemically synthesized
gggaaaggatttaggatcta

SEQ ID NO: 474386 - DNA, 20 bp, Artificial Sequence
  chemically synthesized
agaggagtggggaaaggatt

SEQ ID NO: 474387 - DNA, 20 bp, Artificial Sequence
  chemically synthesized
aatggaaagaggagtgggga

SEQ ID NO: 474388 - DNA, 20 bp, Artificial Sequence
  chemically synthesized
tgtcttcaaggaatggaaag

SEQ ID NO: 474389 - DNA, 20 bp, Artificial Sequence
  chemically synthesized
agtctctaaagctgtcttca

SEQ ID NO: 474390 - DNA, 20 bp, Artificial Sequence
  chemically synthesized
tgggatgagtcagggagagc

SEQ ID NO: 474391 - DNA, 20 bp, Artificial Sequence
  chemically synthesized
gtgtaatgaaaagggttggg

SEQ ID NO: 474392 - DNA, 20 bp, Artificial Sequence
  chemically synthesized
cggtgtgtaatgaaaagggt

SEQ ID NO: 474393 - DNA, 20 bp, Artificial Sequence
  chemically synthesized
cttcagcggtgtgtaatgaa

SEQ ID NO: 474394 - DNA, 20 bp, Artificial Sequence
  chemically synthesized
gaagtgcagggctgtgcagt

SEQ ID NO: 474395 - DNA, 20 bp, Artificial Sequence
  chemically synthesized
cgtgatcccagtccttatgt

SEQ ID NO: 474396 - DNA, 20 bp, Artificial Sequence
  chemically synthesized
caggattcttacataaggac

SEQ ID NO: 474397 - DNA, 20 bp, Artificial Sequence
  chemically synthesized
aaacagtaaggtcaagttgt

SEQ ID NO: 474398 - DNA, 20 bp, Artificial Sequence
  chemically synthesized
ttgagggcctctaaaagtat

SEQ ID NO: 474399 - DNA, 20 bp, Artificial Sequence
  chemically synthesized
agttatgagaactgtagaga

SEQ ID NO: 474400 - DNA, 20 bp, Artificial Sequence
  chemically synthesized
tggaagttatgagaactgta

SEQ ID NO: 474401 - DNA, 20 bp, Artificial Sequence
  chemically synthesized
tcagctgtactcactctttg

SEQ ID NO: 474402 - DNA, 20 bp, Artificial Sequence
  chemically synthesized
tgtgggagactcaacaaaga

SEQ ID NO: 474403 - DNA, 20 bp, Artificial Sequence
  chemically synthesized
taattgtgggagactcaaca

SEQ ID NO: 474404 - DNA, 20 bp, Artificial Sequence
  chemically synthesized
atcaggaataatgtgggagg

SEQ ID NO: 474405 - DNA, 20 bp, Artificial Sequence
  chemically synthesized
tgggggtcaggcgtggtatc

SEQ ID NO: 474406 - DNA, 20 bp, Artificial Sequence
  chemically synthesized
tggatcagagatacagtcat

SEQ ID NO: 474407 - DNA, 20 bp, Artificial Sequence
  chemically synthesized
gaaatggggttgaatgtctg

SEQ ID NO: 474408 - DNA, 20 bp, Artificial Sequence
  chemically synthesized
ggaaatatggggaaatgggg

SEQ ID NO: 474409 - DNA, 20 bp, Artificial Sequence
  chemically synthesized
aagaaggaaatatggggaaa

SEQ ID NO: 474410 - DNA, 20 bp, Artificial Sequence
  chemically synthesized
atcaataaaccaagtgtgat

SEQ ID NO: 474411 - DNA, 20 bp, Artificial Sequence
  chemically synthesized
cactgagaagttatttcttt

SEQ ID NO: 474412 - DNA, 20 bp, Artificial Sequence
  chemically synthesized
gaataatccctgaggagtag

SEQ ID NO: 474413 - DNA, 20 bp, Artificial Sequence
  chemically synthesized
ctgctattctactactcctc

SEQ ID NO: 474414 - DNA, 20 bp, Artificial Sequence
  chemically synthesized
gggggcctgaataatccctg

SEQ ID NO: 474415 - DNA, 20 bp, Artificial Sequence
  chemically synthesized
gtgtggggaagggagggggc

SEQ ID NO: 474416 - DNA, 20 bp, Artificial Sequence
  chemically synthesized
cttccccacacatcaagttc

SEQ ID NO: 474417 - DNA, 20 bp, Artificial Sequence
  chemically synthesized
ttggctttactaaacatgcc

SEQ ID NO: 474418 - DNA, 20 bp, Artificial Sequence
  chemically synthesized
ggtctaggtagacactttca

SEQ ID NO: 474419 - DNA, 20 bp, Artificial Sequence
  chemically synthesized
gaggtgggaaggccaaaccg

SEQ ID NO: 474420 - DNA, 20 bp, Artificial Sequence
  chemically synthesized
ctaagagcctgagaaactgc

SEQ ID NO: 474421 - DNA, 20 bp, Artificial Sequence
  chemically synthesized
tttaaaagaccattagttca

SEQ ID NO: 474422 - DNA, 20 bp, Artificial Sequence
  chemically synthesized
cttttaccacttgcccttct

SEQ ID NO: 474423 - DNA, 20 bp, Artificial Sequence
  chemically synthesized
gtagcattctgaggacaggc

SEQ ID NO: 474424 - DNA, 20 bp, Artificial Sequence
  chemically synthesized
tcagaattcaggcctgtcct

SEQ ID NO: 474425 - DNA, 20 bp, Artificial Sequence
  chemically synthesized
gtctaagttggtctggtgtc

SEQ ID NO: 474426 - DNA, 20 bp, Artificial Sequence
  chemically synthesized
aggagggatgacaagttttt

SEQ ID NO: 474427 - DNA, 20 bp, Artificial Sequence
  chemically synthesized
atgactagacagaagatagg

SEQ ID NO: 474428 - DNA, 20 bp, Artificial Sequence
  chemically synthesized
actagttgagactggtgaat

SEQ ID NO: 474429 - DNA, 20 bp, Artificial Sequence
  chemically synthesized
tttatgactagttgagactg

SEQ ID NO: 474430 - DNA, 20 bp, Artificial Sequence
  chemically synthesized
agagttaagagtggtggttt

SEQ ID NO: 474431 - DNA, 20 bp, Artificial Sequence
  chemically synthesized
gattatttactttaagagtt

SEQ ID NO: 474432 - DNA, 20 bp, Artificial Sequence
  chemically synthesized
cagcaaagattatttacttt

SEQ ID NO: 474433 - DNA, 20 bp, Artificial Sequence
  chemically synthesized
ggacctaggacgtctaatta

SEQ ID NO: 474434 - DNA, 20 bp, Artificial Sequence
  chemically synthesized
aaaacaggtattaaaggacg

SEQ ID NO: 474435 - DNA, 20 bp, Artificial Sequence
  chemically synthesized
gtatgaattgaaaaactaaa

SEQ ID NO: 474436 - DNA, 20 bp, Artificial Sequence
  chemically synthesized
tggcctggatacggttttgt

SEQ ID NO: 474437 - DNA, 20 bp, Artificial Sequence
  chemically synthesized
gtagaattattggtgatggc

SEQ ID NO: 474438 - DNA, 20 bp, Artificial Sequence
  chemically synthesized
tagaagaaacatttgtcatg

SEQ ID NO: 474439 - DNA, 20 bp, Artificial Sequence
  chemically synthesized
tgtggtaaggggtgatattg

SEQ ID NO: 474440 - DNA, 20 bp, Artificial Sequence
  chemically synthesized
tgaaggaagattttgtggta

SEQ ID NO: 474441 - DNA, 20 bp, Artificial Sequence
  chemically synthesized
gcgtgggaacctagagtggg

SEQ ID NO: 474442 - DNA, 20 bp, Artificial Sequence
  chemically synthesized
tcaggggtggcgtgggaacc

SEQ ID NO: 474443 - DNA, 20 bp, Artificial Sequence
  chemically synthesized
gggctgcttcgaggtggatc

SEQ ID NO: 474444 - DNA, 20 bp, Artificial Sequence
  chemically synthesized
tttctcagggctgcttcgag

SEQ ID NO: 474445 - DNA, 20 bp, Artificial Sequence
  chemically synthesized
cggggtggtgtggagagata

SEQ ID NO: 474446 - DNA, 20 bp, Artificial Sequence
  chemically synthesized
gttggggcggcgaaaatttt

SEQ ID NO: 474447 - DNA, 20 bp, Artificial Sequence
  chemically synthesized
tcttattaatataagaagac

SEQ ID NO: 474448 - DNA, 20 bp, Artificial Sequence
  chemically synthesized
atgtatatgtgtaggtcaca

SEQ ID NO: 474449 - DNA, 20 bp, Artificial Sequence
  chemically synthesized
tttcagttacttcaggccat

SEQ ID NO: 474450 - DNA, 20 bp, Artificial Sequence
  chemically synthesized
cattttcacttcttttgtgg

SEQ ID NO: 474451 - DNA, 20 bp, Artificial Sequence
  chemically synthesized
agccaggaagagccaggaga

SEQ ID NO: 474452 - DNA, 20 bp, Artificial Sequence
  chemically synthesized
gtcctctggtgggcaggagt

SEQ ID NO: 474453 - DNA, 20 bp, Artificial Sequence
  chemically synthesized
ggggttgtcctctggtgggc

SEQ ID NO: 474454 - DNA, 20 bp, Artificial Sequence
  chemically synthesized
aaggaaaattacagtcaaag

SEQ ID NO: 474455 - DNA, 20 bp, Artificial Sequence
  chemically synthesized
gtagggccgttctataagat

SEQ ID NO: 474456 - DNA, 20 bp, Artificial Sequence
  chemically synthesized
aagagtcagcgaagggagat

SEQ ID NO: 474457 - DNA, 20 bp, Artificial Sequence
  chemically synthesized
gcaggcgagctgagtccgaa

SEQ ID NO: 474458 - DNA, 20 bp, Artificial Sequence
  chemically synthesized
atcacctgggcgcaggcgag

SEQ ID NO: 474459 - DNA, 20 bp, Artificial Sequence
  chemically synthesized
ggtggtctcttcacacggac

SEQ ID NO: 474460 - DNA, 20 bp, Artificial Sequence
  chemically synthesized
aagttgtaacaattaggttg

SEQ ID NO: 474461 - DNA, 20 bp, Artificial Sequence
  chemically synthesized
gagacccgccctcttctgtc

SEQ ID NO: 474462 - DNA, 20 bp, Artificial Sequence
  chemically synthesized
gaaattctggacagaagagg

SEQ ID NO: 474463 - DNA, 20 bp, Artificial Sequence
  chemically synthesized
agttccaggcttttaggctt

SEQ ID NO: 474464 - DNA, 20 bp, Artificial Sequence
  chemically synthesized
caacatttgagcaggaaaac

SEQ ID NO: 474465 - DNA, 20 bp, Artificial Sequence
  chemically synthesized
gatggagggcagggtgggct

SEQ ID NO: 474466 - DNA, 20 bp, Artificial Sequence
  chemically synthesized
tacaggcacaggatggaggg

SEQ ID NO: 474467 - DNA, 20 bp, Artificial Sequence
  chemically synthesized
gcctgggatttttacaggca

SEQ ID NO: 474468 - DNA, 20 bp, Artificial Sequence
  chemically synthesized
tcctctgtgccggctgagcc

SEQ ID NO: 474469 - DNA, 20 bp, Artificial Sequence
  chemically synthesized
ccggcacagaggagaagcag

SEQ ID NO: 474470 - DNA, 20 bp, Artificial Sequence
  chemically synthesized
ctggcagcatagcttcagag

SEQ ID NO: 474471 - DNA, 20 bp, Artificial Sequence
  chemically synthesized
gcaggaaggtaatcttcacc

SEQ ID NO: 474472 - DNA, 20 bp, Artificial Sequence
  chemically synthesized
aattggagatggtaaatgcg

SEQ ID NO: 474473 - DNA, 20 bp, Artificial Sequence
  chemically synthesized
gatcttgcccattttccagg

SEQ ID NO: 474474 - DNA, 20 bp, Artificial Sequence
  chemically synthesized
agatctgaggtgccacaagt

SEQ ID NO: 474475 - DNA, 20 bp, Artificial Sequence
  chemically synthesized
taagtgttaacagctcagtg

SEQ ID NO: 474476 - DNA, 20 bp, Artificial Sequence
  chemically synthesized
ggccctgtaacactccttct

SEQ ID NO: 474477 - DNA, 20 bp, Artificial Sequence
  chemically synthesized
gcgacccttgaatccccaga

SEQ ID NO: 474478 - DNA, 20 bp, Artificial Sequence
  chemically synthesized
aacactccttctggggattc

SEQ ID NO: 474479 - DNA, 20 bp, Artificial Sequence
  chemically synthesized
taggagggtgcccgcgaccc

SEQ ID NO: 474480 - DNA, 20 bp, Artificial Sequence
  chemically synthesized
ggccccatggcagtgtctag

SEQ ID NO: 474481 - DNA, 20 bp, Artificial Sequence
  chemically synthesized
acactgccatggggcccaca

SEQ ID NO: 474482 - DNA, 20 bp, Artificial Sequence
  chemically synthesized
gagtgggtacaggagccagg

SEQ ID NO: 474483 - DNA, 20 bp, Artificial Sequence
  chemically synthesized
aggtgagtgggtacaggagc

SEQ ID NO: 474484 - DNA, 20 bp, Artificial Sequence
  chemically synthesized
gggagaggaagcacaggtga

SEQ ID NO: 474485 - DNA, 20 bp, Artificial Sequence
  chemically synthesized
tcatgggagaggaagcacag

SEQ ID NO: 474486 - DNA, 20 bp, Artificial Sequence
  chemically synthesized
cctgtgcttcctctcccatg

SEQ ID NO: 474487 - DNA, 20 bp, Artificial Sequence
  chemically synthesized
actccactggctcagtctca

SEQ ID NO: 474488 - DNA, 20 bp, Artificial Sequence
  chemically synthesized
actcagtgagactgagccag

SEQ ID NO: 474489 - DNA, 20 bp, Artificial Sequence
  chemically synthesized
agtccagttcccgcccgcga

SEQ ID NO: 474490 - DNA, 20 bp, Artificial Sequence
  chemically synthesized
gttcccgcccgcgaggggat

SEQ ID NO: 474491 - DNA, 20 bp, Artificial Sequence
  chemically synthesized
tagtagtagtagtagtgaag

SEQ ID NO: 474492 - DNA, 20 bp, Artificial Sequence
  chemically synthesized
caaaatcacaaccaaaaagc

SEQ ID NO: 474493 - DNA, 20 bp, Artificial Sequence
  chemically synthesized
ctgttctcttctctggtcat

SEQ ID NO: 474494 - DNA, 20 bp, Artificial Sequence
  chemically synthesized
gagaagagaacagggacctg

SEQ ID NO: 474495 - DNA, 20 bp, Artificial Sequence
  chemically synthesized
aacataacatgtacttcacc

SEQ ID NO: 474496 - DNA, 20 bp, Artificial Sequence
  chemically synthesized
tctacatttcagggtttttc

SEQ ID NO: 474497 - DNA, 20 bp, Artificial Sequence
  chemically synthesized
ggggaaatgagtctacattt

SEQ ID NO: 474498 - DNA, 20 bp, Artificial Sequence
  chemically synthesized
aacaaacctgcatgggggaa

SEQ ID NO: 474499 - DNA, 20 bp, Artificial Sequence
  chemically synthesized
tctaaattgtgccctaatgt

SEQ ID NO: 474500 - DNA, 20 bp, Artificial Sequence
  chemically synthesized
tgtaataggatcttctctga

SEQ ID NO: 474501 - DNA, 20 bp, Artificial Sequence
  chemically synthesized
tttctgtaataggatcttct

SEQ ID NO: 474502 - DNA, 20 bp, Artificial Sequence
  chemically synthesized
tgggtattgtttttctgtaa

SEQ ID NO: 474503 - DNA, 20 bp, Artificial Sequence
  chemically synthesized
agctctgagttaaattgcag

SEQ ID NO: 474504 - DNA, 20 bp, Artificial Sequence
  chemically synthesized
gggtagagggtttctcagct

SEQ ID NO: 474505 - DNA, 20 bp, Artificial Sequence
  chemically synthesized
gggcccataatcattgggta

SEQ ID NO: 474506 - DNA, 20 bp, Artificial Sequence
  chemically synthesized
caaaagtgggcccataatca

SEQ ID NO: 474507 - DNA, 20 bp, Artificial Sequence
  chemically synthesized
catcctacgcacatcgttga

SEQ ID NO: 474508 - DNA, 20 bp, Artificial Sequence
  chemically synthesized
cattctttcaacgatgtgcg

SEQ ID NO: 474509 - DNA, 20 bp, Artificial Sequence
  chemically synthesized
attttaagaacagacttgat

SEQ ID NO: 474510 - DNA, 20 bp, Artificial Sequence
  chemically synthesized
gcaaacttccaaagtccctt

SEQ ID NO: 474511 - DNA, 20 bp, Artificial Sequence
  chemically synthesized
aaccttgtgaaccttcatgt

SEQ ID NO: 474512 - DNA, 20 bp, Artificial Sequence
  chemically synthesized
cacaaacaaatctacctcag

SEQ ID NO: 474513 - DNA, 20 bp, Artificial Sequence
  chemically synthesized
gaggagaaattggtcctgag

SEQ ID NO: 474514 - DNA, 20 bp, Artificial Sequence
  chemically synthesized
tatccaagcagggctgctaa

SEQ ID NO: 474515 - DNA, 20 bp, Artificial Sequence
  chemically synthesized
tattcatttagcagccctgc

SEQ ID NO: 474516 - DNA, 20 bp, Artificial Sequence
  chemically synthesized
gcagtaggaagggacgttta

SEQ ID NO: 474517 - DNA, 20 bp, Artificial Sequence
  chemically synthesized
tatgcctgcgctgttaacaa

SEQ ID NO: 474518 - DNA, 20 bp, Artificial Sequence
  chemically synthesized
gagcaccttcagagcctagt

SEQ ID NO: 474519 - DNA, 20 bp, Artificial Sequence
  chemically synthesized
gtttaagtggtaagcatcca

SEQ ID NO: 474520 - DNA, 20 bp, Artificial Sequence
  chemically synthesized
caggatggccacagaaccct

SEQ ID NO: 474521 - DNA, 20 bp, Artificial Sequence
  chemically synthesized
aatatatccatgtttgtgaa

SEQ ID NO: 474522 - DNA, 20 bp, Artificial Sequence
  chemically synthesized
tggccatcctgttcacaaac

SEQ ID NO: 474523 - DNA, 20 bp, Artificial Sequence
  chemically synthesized
tgtgtacctacaaaaattat

SEQ ID NO: 474524 - DNA, 20 bp, Artificial Sequence
  chemically synthesized
aggtaccatctcacaccagt

SEQ ID NO: 474525 - DNA, 20 bp, Artificial Sequence
  chemically synthesized
catctgttgtttcctgactt

SEQ ID NO: 474526 - DNA, 20 bp, Artificial Sequence
  chemically synthesized
aggaaacaacagatgccaga

SEQ ID NO: 474527 - DNA, 20 bp, Artificial Sequence
  chemically synthesized
agacagtgtggcaattcctc

SEQ ID NO: 474528 - DNA, 20 bp, Artificial Sequence
  chemically synthesized
tttctagttctagatccttg

SEQ ID NO: 474529 - DNA, 20 bp, Artificial Sequence
  chemically synthesized
tatacccagtaatgggatgg

SEQ ID NO: 474530 - DNA, 20 bp, Artificial Sequence
  chemically synthesized
ttgacccagccatcccatta

SEQ ID NO: 474531 - DNA, 20 bp, Artificial Sequence
  chemically synthesized
tttgggtatatacccagtaa

SEQ ID NO: 474532 - DNA, 20 bp, Artificial Sequence
  chemically synthesized
cattactgggtatataccca

SEQ ID NO: 474533 - DNA, 20 bp, Artificial Sequence
  chemically synthesized
gcagcatgatttataatcct

SEQ ID NO: 474534 - DNA, 20 bp, Artificial Sequence
  chemically synthesized
agtctatcattgatggacat

SEQ ID NO: 474535 - DNA, 20 bp, Artificial Sequence
  chemically synthesized
aaatgtccatcaatgataga

SEQ ID NO: 474536 - DNA, 20 bp, Artificial Sequence
  chemically synthesized
aatgtggcacatatacacca

SEQ ID NO: 474537 - DNA, 20 bp, Artificial Sequence
  chemically synthesized
aatactatgcagccataaaa

SEQ ID NO: 474538 - DNA, 20 bp, Artificial Sequence
  chemically synthesized
ctatgcagccataaaaaagg

SEQ ID NO: 474539 - DNA, 20 bp, Artificial Sequence
  chemically synthesized
tccatgtccctacaaaggat

SEQ ID NO: 474540 - DNA, 20 bp, Artificial Sequence
  chemically synthesized
gcttcatccatgtccctaca

SEQ ID NO: 474541 - DNA, 20 bp, Artificial Sequence
  chemically synthesized
ttcatatcctttgtagggac

SEQ ID NO: 474542 - DNA, 20 bp, Artificial Sequence
  chemically synthesized
tgtccttgtgatagtttgct

SEQ ID NO: 474543 - DNA, 20 bp, Artificial Sequence
  chemically synthesized
gcatgttctcactcataagt

SEQ ID NO: 474544 - DNA, 20 bp, Artificial Sequence
  chemically synthesized
tcattgttcaattcccactt

SEQ ID NO: 474545 - DNA, 20 bp, Artificial Sequence
  chemically synthesized
tcacacaccagggactgttt

SEQ ID NO: 474546 - DNA, 20 bp, Artificial Sequence
  chemically synthesized
ttggggtgaggggagggagg

SEQ ID NO: 474547 - DNA, 20 bp, Artificial Sequence
  chemically synthesized
agatatacctaatgtaaatg

SEQ ID NO: 474548 - DNA, 20 bp, Artificial Sequence
  chemically synthesized
ctaatgtaaatgacgagtta

SEQ ID NO: 474549 - DNA, 20 bp, Artificial Sequence
  chemically synthesized
tattactatagtttaagttc

SEQ ID NO: 474550 - DNA, 20 bp, Artificial Sequence
  chemically synthesized
aaagaagagatgatgttgat

SEQ ID NO: 474551 - DNA, 20 bp, Artificial Sequence
  chemically synthesized
ttcagaaaatgccttcccct

SEQ ID NO: 474552 - DNA, 20 bp, Artificial Sequence
  chemically synthesized
ccagggagcataaagactag

SEQ ID NO: 474553 - DNA, 20 bp, Artificial Sequence
  chemically synthesized
tctttatgctccctggggac

SEQ ID NO: 474554 - DNA, 20 bp, Artificial Sequence
  chemically synthesized
taaattctggaaacacagag

SEQ ID NO: 474555 - DNA, 20 bp, Artificial Sequence
  chemically synthesized
ctaatccatctctgtgtttc

SEQ ID NO: 474556 - DNA, 20 bp, Artificial Sequence
  chemically synthesized
aacacagtgcttggcacata

SEQ ID NO: 474557 - DNA, 20 bp, Artificial Sequence
  chemically synthesized
tggatgctcaatattgttta

SEQ ID NO: 474558 - DNA, 20 bp, Artificial Sequence
  chemically synthesized
actgaatcactgactgtatg

SEQ ID NO: 474559 - DNA, 20 bp, Artificial Sequence
  chemically synthesized
aatcactgactgtatgatga

SEQ ID NO: 474560 - DNA, 20 bp, Artificial Sequence
  chemically synthesized
catgaagtaaaaacatgatt

SEQ ID NO: 474561 - DNA, 20 bp, Artificial Sequence
  chemically synthesized
tacttgatagattgaaacca

SEQ ID NO: 474562 - DNA, 20 bp, Artificial Sequence
  chemically synthesized
aacacctgagtatatgtgtc

SEQ ID NO: 474563 - DNA, 20 bp, Artificial Sequence
  chemically synthesized
aggaagcagctcaggaacac

SEQ ID NO: 474564 - DNA, 20 bp, Artificial Sequence
  chemically synthesized
acaactaacatgaccacctt

SEQ ID NO: 474565 - DNA, 20 bp, Artificial Sequence
  chemically synthesized
aaatgtacttaatgtcaacc

SEQ ID NO: 474566 - DNA, 20 bp, Artificial Sequence
  chemically synthesized
ggttgacattaagtacattt

SEQ ID NO: 474567 - DNA, 20 bp, Artificial Sequence
  chemically synthesized
acttgccaagggagtcacag

SEQ ID NO: 474568 - DNA, 20 bp, Artificial Sequence
  chemically synthesized
ctaagacttgaacttgccaa

SEQ ID NO: 474569 - DNA, 20 bp, Artificial Sequence
  chemically synthesized
tgaccatttttagcttccta

SEQ ID NO: 474570 - DNA, 20 bp, Artificial Sequence
  chemically synthesized
ctcaaagagcacaatttgag

SEQ ID NO: 474571 - DNA, 20 bp, Artificial Sequence
  chemically synthesized
ttgagaggaattcagatgag

SEQ ID NO: 474572 - DNA, 20 bp, Artificial Sequence
  chemically synthesized
tgggttagaattcacctcat

SEQ ID NO: 474573 - DNA, 20 bp, Artificial Sequence
  chemically synthesized
atttaatgtgatatctgggt

SEQ ID NO: 474574 - DNA, 20 bp, Artificial Sequence
  chemically synthesized
acagctatttaatgtgatat

SEQ ID NO: 474575 - DNA, 20 bp, Artificial Sequence
  chemically synthesized
cctttttgaacttgtctagt

SEQ ID NO: 474576 - DNA, 20 bp, Artificial Sequence
  chemically synthesized
ctgtctcaaacaaaaaaaaa

SEQ ID NO: 474577 - DNA, 20 bp, Artificial Sequence
  chemically synthesized
ctttttttttttgtttgaga

SEQ ID NO: 474578 - DNA, 20 bp, Artificial Sequence
  chemically synthesized
tctcgctctgtcacccaggc

SEQ ID NO: 474579 - DNA, 20 bp, Artificial Sequence
  chemically synthesized
ttgcaccactgtactccagc

SEQ ID NO: 474580 - DNA, 20 bp, Artificial Sequence
  chemically synthesized
ctcactgcatcctctgcctc

SEQ ID NO: 474581 - DNA, 20 bp, Artificial Sequence
  chemically synthesized
tcacatgaacccaggaggca

SEQ ID NO: 474582 - DNA, 20 bp, Artificial Sequence
  chemically synthesized
tacttgggaggctgaggcag

SEQ ID NO: 474583 - DNA, 20 bp, Artificial Sequence
  chemically synthesized
cgggtggatcacctgaggtc

SEQ ID NO: 474584 - DNA, 20 bp, Artificial Sequence
  chemically synthesized
acttttggaggccaaggcgg

SEQ ID NO: 474585 - DNA, 20 bp, Artificial Sequence
  chemically synthesized
cagcacttttggaggccaag

SEQ ID NO: 474586 - DNA, 20 bp, Artificial Sequence
  chemically synthesized
gccttggcctccaaaagtgc

SEQ ID NO: 474587 - DNA, 20 bp, Artificial Sequence
  chemically synthesized
gctgattatataacatttaa

SEQ ID NO: 474588 - DNA, 20 bp, Artificial Sequence
  chemically synthesized
gggagacccgaaagttcatg

SEQ ID NO: 474589 - DNA, 20 bp, Artificial Sequence
  chemically synthesized
acacaattcctcatgaactt

SEQ ID NO: 474590 - DNA, 20 bp, Artificial Sequence
  chemically synthesized
gctagagagttgttcatgga

SEQ ID NO: 474591 - DNA, 20 bp, Artificial Sequence
  chemically synthesized
ataaagcaaggaagacgcta

SEQ ID NO: 474592 - DNA, 20 bp, Artificial Sequence
  chemically synthesized
ggttttttttttttttgaga

SEQ ID NO: 474593 - DNA, 20 bp, Artificial Sequence
  chemically synthesized
tcttgctcagtcacccaggc

SEQ ID NO: 474594 - DNA, 20 bp, Artificial Sequence
  chemically synthesized
tcgtgccactgcactccagc

SEQ ID NO: 474595 - DNA, 20 bp, Artificial Sequence
  chemically synthesized
tactcgggaggctgaggcag

SEQ ID NO: 474596 - DNA, 20 bp, Artificial Sequence
  chemically synthesized
cattctcctgcctcagcctc

SEQ ID NO: 474597 - DNA, 20 bp, Artificial Sequence
  chemically synthesized
ttttgtatttttagtagaga

SEQ ID NO: 474598 - DNA, 20 bp, Artificial Sequence
  chemically synthesized
actttgggaggccaaggcgg

SEQ ID NO: 474599 - DNA, 20 bp, Artificial Sequence
  chemically synthesized
cagcactttgggaggccaag

SEQ ID NO: 474600 - DNA, 20 bp, Artificial Sequence
  chemically synthesized
tcccaaagtgctgagattac

SEQ ID NO: 474601 - DNA, 20 bp, Artificial Sequence
  chemically synthesized
ctatcatctgtcttctttac

SEQ ID NO: 474602 - DNA, 20 bp, Artificial Sequence
  chemically synthesized
atgtaagctctcctgagggc

SEQ ID NO: 474603 - DNA, 20 bp, Artificial Sequence
  chemically synthesized
tcattcaattaatatctatt

SEQ ID NO: 474604 - DNA, 20 bp, Artificial Sequence
  chemically synthesized
agacccacaatagatattaa

SEQ ID NO: 474605 - DNA, 20 bp, Artificial Sequence
  chemically synthesized
gatattaattgaatgactaa

SEQ ID NO: 474606 - DNA, 20 bp, Artificial Sequence
  chemically synthesized
accctgaagactttttagct

SEQ ID NO: 474607 - DNA, 20 bp, Artificial Sequence
  chemically synthesized
actcctagctaaaaagtctt

SEQ ID NO: 474608 - DNA, 20 bp, Artificial Sequence
  chemically synthesized
ctggtttaacacaccaagtt

SEQ ID NO: 474609 - DNA, 20 bp, Artificial Sequence
  chemically synthesized
acacaccaagttgagaatca

SEQ ID NO: 474610 - DNA, 20 bp, Artificial Sequence
  chemically synthesized
accttggcctcctaaagtgc

SEQ ID NO: 474611 - DNA, 20 bp, Artificial Sequence
  chemically synthesized
actttaggaggccaaggtgg

SEQ ID NO: 474612 - DNA, 20 bp, Artificial Sequence
  chemically synthesized
tgggcggatcacctgaggtc

SEQ ID NO: 474613 - DNA, 20 bp, Artificial Sequence
  chemically synthesized
ttttgtatttttagtagaga

SEQ ID NO: 474614 - DNA, 20 bp, Artificial Sequence
  chemically synthesized
gcctcagcctcccaagcagc

SEQ ID NO: 474615 - DNA, 20 bp, Artificial Sequence
  chemically synthesized
tgcttgggaggctgaggcag

SEQ ID NO: 474616 - DNA, 20 bp, Artificial Sequence
  chemically synthesized
ctcactgcaacctccacctc

SEQ ID NO: 474617 - DNA, 20 bp, Artificial Sequence
  chemically synthesized
tcacgccactgcactccagc

SEQ ID NO: 474618 - DNA, 20 bp, Artificial Sequence
  chemically synthesized
tctcactctgtcacccaggc

SEQ ID NO: 474619 - DNA, 20 bp, Artificial Sequence
  chemically synthesized
ctgcactccagcctgggtga

SEQ ID NO: 474620 - DNA, 20 bp, Artificial Sequence
  chemically synthesized
ttttgttttgttttttgaga

SEQ ID NO: 474621 - DNA, 20 bp, Artificial Sequence
  chemically synthesized
atttgagaccattggaagag

SEQ ID NO: 474622 - DNA, 20 bp, Artificial Sequence
  chemically synthesized
gtaagtttaacttttcctaa

SEQ ID NO: 474623 - DNA, 20 bp, Artificial Sequence
  chemically synthesized
ctgcccaagaaatgtctgca

SEQ ID NO: 474624 - DNA, 20 bp, Artificial Sequence
  chemically synthesized
atctcaagtttcaatatgta

SEQ ID NO: 474625 - DNA, 20 bp, Artificial Sequence
  chemically synthesized
atctacactcccccaagata

SEQ ID NO: 474626 - DNA, 20 bp, Artificial Sequence
  chemically synthesized
tgacttattcattatcttgg

SEQ ID NO: 474627 - DNA, 20 bp, Artificial Sequence
  chemically synthesized
tggataaaatggcttaaaat

SEQ ID NO: 474628 - DNA, 20 bp, Artificial Sequence
  chemically synthesized
tgttaaatcatttgatgacg

SEQ ID NO: 474629 - DNA, 20 bp, Artificial Sequence
  chemically synthesized
caagagacttttaaacttct

SEQ ID NO: 474630 - DNA, 20 bp, Artificial Sequence
  chemically synthesized
acctcctgttatttataagg

SEQ ID NO: 474631 - DNA, 20 bp, Artificial Sequence
  chemically synthesized
aacaggaggtgccttagttt

SEQ ID NO: 474632 - DNA, 20 bp, Artificial Sequence
  chemically synthesized
attgactgatatcagctgcc

SEQ ID NO: 474633 - DNA, 20 bp, Artificial Sequence
  chemically synthesized
attccttactgcactatatc

SEQ ID NO: 474634 - DNA, 20 bp, Artificial Sequence
  chemically synthesized
attccagatatagtgcagta

SEQ ID NO: 474635 - DNA, 20 bp, Artificial Sequence
  chemically synthesized
atctgtgattataatagaat

SEQ ID NO: 474636 - DNA, 20 bp, Artificial Sequence
  chemically synthesized
tggataatctgtgattataa

SEQ ID NO: 474637 - DNA, 20 bp, Artificial Sequence
  chemically synthesized
aaaactcactaagctaatca

SEQ ID NO: 474638 - DNA, 20 bp, Artificial Sequence
  chemically synthesized
attatccattgattagctta

SEQ ID NO: 474639 - DNA, 20 bp, Artificial Sequence
  chemically synthesized
tgtgccctacttcacacagt

SEQ ID NO: 474640 - DNA, 20 bp, Artificial Sequence
  chemically synthesized
ctacttcacacagttaggat

SEQ ID NO: 474641 - DNA, 20 bp, Artificial Sequence
  chemically synthesized
cagttaggatgagggttaaa

SEQ ID NO: 474642 - DNA, 20 bp, Artificial Sequence
  chemically synthesized
aaggtgctttgtgaaatgta

SEQ ID NO: 474643 - DNA, 20 bp, Artificial Sequence
  chemically synthesized
atatacatgaaacctgatct

SEQ ID NO: 474644 - DNA, 20 bp, Artificial Sequence
  chemically synthesized
catttctatggtcaattttc

SEQ ID NO: 474645 - DNA, 20 bp, Artificial Sequence
  chemically synthesized
gcatttctccaatatacttt

SEQ ID NO: 474646 - DNA, 20 bp, Artificial Sequence
  chemically synthesized
aaacagatggtagaaaaaca

SEQ ID NO: 474647 - DNA, 20 bp, Artificial Sequence
  chemically synthesized
acttcagttctgttggacat

SEQ ID NO: 474648 - DNA, 20 bp, Artificial Sequence
  chemically synthesized
atgtccaacagaactgaagt

SEQ ID NO: 474649 - DNA, 20 bp, Artificial Sequence
  chemically synthesized
tttattccattagctgaaga

SEQ ID NO: 474650 - DNA, 20 bp, Artificial Sequence
  chemically synthesized
gagattccttcttcagctaa

SEQ ID NO: 474651 - DNA, 20 bp, Artificial Sequence
  chemically synthesized
aataaatgatatagagctca

SEQ ID NO: 474652 - DNA, 20 bp, Artificial Sequence
  chemically synthesized
ctcagtggataaacatgtgc

SEQ ID NO: 474653 - DNA, 20 bp, Artificial Sequence
  chemically synthesized
gctgtcatgagggcttgctc

SEQ ID NO: 474654 - DNA, 20 bp, Artificial Sequence
  chemically synthesized
cacaccctcccaaattatct

SEQ ID NO: 474655 - DNA, 20 bp, Artificial Sequence
  chemically synthesized
aacatcctcagataatttgg

SEQ ID NO: 474656 - DNA, 20 bp, Artificial Sequence
  chemically synthesized
tcagataatttgggagggtg

SEQ ID NO: 474657 - DNA, 20 bp, Artificial Sequence
  chemically synthesized
ggagggtgtgggattcgtag

SEQ ID NO: 474658 - DNA, 20 bp, Artificial Sequence
  chemically synthesized
aactttgctacaatccggct

SEQ ID NO: 474659 - DNA, 20 bp, Artificial Sequence
  chemically synthesized
tgtgaataaatgtgtaagtg

SEQ ID NO: 474660 - DNA, 20 bp, Artificial Sequence
  chemically synthesized
ttacacatttattcacatcc

SEQ ID NO: 474661 - DNA, 20 bp, Artificial Sequence
  chemically synthesized
acatctcagaattcaaggat

SEQ ID NO: 474662 - DNA, 20 bp, Artificial Sequence
  chemically synthesized
aatatgacatctcagaattc

SEQ ID NO: 474663 - DNA, 20 bp, Artificial Sequence
  chemically synthesized
atcaaaagaatatgacatct

SEQ ID NO: 474664 - DNA, 20 bp, Artificial Sequence
  chemically synthesized
agaagtcagtcaaaaatcaa

SEQ ID NO: 474665 - DNA, 20 bp, Artificial Sequence
  chemically synthesized
catgctaagtgatttccatt

SEQ ID NO: 474666 - DNA, 20 bp, Artificial Sequence
  chemically synthesized
aaaatggaatttagagcatc

SEQ ID NO: 474667 - DNA, 20 bp, Artificial Sequence
  chemically synthesized
agaaaaatattgatacaaaa

SEQ ID NO: 474668 - DNA, 20 bp, Artificial Sequence
  chemically synthesized
ttctcatttacgcttctagc

SEQ ID NO: 474669 - DNA, 20 bp, Artificial Sequence
  chemically synthesized
gtctctcctttgagctataa

SEQ ID NO: 474670 - DNA, 20 bp, Artificial Sequence
  chemically synthesized
tgatcaaacaaaaaaaactt

SEQ ID NO: 474671 - DNA, 20 bp, Artificial Sequence
  chemically synthesized
gatgtcaggcatgagggatt

SEQ ID NO: 474672 - DNA, 20 bp, Artificial Sequence
  chemically synthesized
tggattagatgtcaggcatg

SEQ ID NO: 474673 - DNA, 20 bp, Artificial Sequence
  chemically synthesized
aaaatctgtatgacttggtg

SEQ ID NO: 474674 - DNA, 20 bp, Artificial Sequence
  chemically synthesized
gatgaaagaaaatgactact

SEQ ID NO: 474675 - DNA, 20 bp, Artificial Sequence
  chemically synthesized
aatgagagattgaatgtggc

SEQ ID NO: 474676 - DNA, 20 bp, Artificial Sequence
  chemically synthesized
cctgctgtataaatgagaga

SEQ ID NO: 474677 - DNA, 20 bp, Artificial Sequence
  chemically synthesized
aaggctggagagtttatttt

SEQ ID NO: 474678 - DNA, 20 bp, Artificial Sequence
  chemically synthesized
agtggtacaggacaaggctg

SEQ ID NO: 474679 - DNA, 20 bp, Artificial Sequence
  chemically synthesized
aggagctaatgactgagggg

SEQ ID NO: 474680 - DNA, 20 bp, Artificial Sequence
  chemically synthesized
ggctaggagctaatgactga

SEQ ID NO: 474681 - DNA, 20 bp, Artificial Sequence
  chemically synthesized
catatgaacagggaggggaa

SEQ ID NO: 474682 - DNA, 20 bp, Artificial Sequence
  chemically synthesized
tcagtcatatgaacagggag

SEQ ID NO: 474683 - DNA, 20 bp, Artificial Sequence
  chemically synthesized
tctaggaaggcctctctgaa

SEQ ID NO: 474684 - DNA, 20 bp, Artificial Sequence
  chemically synthesized
caaagaataggctactttgg

SEQ ID NO: 474685 - DNA, 20 bp, Artificial Sequence
  chemically synthesized
tgagaaatgttatgaagaca

SEQ ID NO: 474686 - DNA, 20 bp, Artificial Sequence
  chemically synthesized
ttatttttatttttttgaga

SEQ ID NO: 474687 - DNA, 20 bp, Artificial Sequence
  chemically synthesized
tcacgtcactgtgctccagc

SEQ ID NO: 474688 - DNA, 20 bp, Artificial Sequence
  chemically synthesized
ctcactgcaacctccgcctc

SEQ ID NO: 474689 - DNA, 20 bp, Artificial Sequence
  chemically synthesized
tacttaagaggctgaggccg

SEQ ID NO: 474690 - DNA, 20 bp, Artificial Sequence
  chemically synthesized
taagtagctggaagtacaga

SEQ ID NO: 474691 - DNA, 20 bp, Artificial Sequence
  chemically synthesized
cgggcggatcacttgaggtc

SEQ ID NO: 474692 - DNA, 20 bp, Artificial Sequence
  chemically synthesized
ctcaagtgatccgcccgcct

SEQ ID NO: 474693 - DNA, 20 bp, Artificial Sequence
  chemically synthesized
actttgggaccccgaggcgg

SEQ ID NO: 474694 - DNA, 20 bp, Artificial Sequence
  chemically synthesized
gcctcggggtcccaaagtgc

SEQ ID NO: 474695 - DNA, 20 bp, Artificial Sequence
  chemically synthesized
aaatatttttggacgtgcca

SEQ ID NO: 474696 - DNA, 20 bp, Artificial Sequence
  chemically synthesized
attttgtgccagacaatatg

SEQ ID NO: 474697 - DNA, 20 bp, Artificial Sequence
  chemically synthesized
actaaaaggctacacattgg

SEQ ID NO: 474698 - DNA, 20 bp, Artificial Sequence
  chemically synthesized
aaagtgctgggattacaggt

SEQ ID NO: 474699 - DNA, 20 bp, Artificial Sequence
  chemically synthesized
atctcagcctcccaaagtgc

SEQ ID NO: 474700 - DNA, 20 bp, Artificial Sequence
  chemically synthesized
actttgggaggctgagatgg

SEQ ID NO: 474701 - DNA, 20 bp, Artificial Sequence
  chemically synthesized
gatgggcggatcacgaggtc

SEQ ID NO: 474702 - DNA, 20 bp, Artificial Sequence
  chemically synthesized
ttttgtatttttaggagaca

SEQ ID NO: 474703 - DNA, 20 bp, Artificial Sequence
  chemically synthesized
gcctcagcctcctgagtagc

SEQ ID NO: 474704 - DNA, 20 bp, Artificial Sequence
  chemically synthesized
aattctcctgcctcagcctc

SEQ ID NO: 474705 - DNA, 20 bp, Artificial Sequence
  chemically synthesized
tactcaggaggctgaggcag

SEQ ID NO: 474706 - DNA, 20 bp, Artificial Sequence
  chemically synthesized
cctcactctctcccccaggc

SEQ ID NO: 474707 - DNA, 20 bp, Artificial Sequence
  chemically synthesized
ctgcactccagcctggggga

SEQ ID NO: 474708 - DNA, 20 bp, Artificial Sequence
  chemically synthesized
atcaagaaaaggtttataaa

SEQ ID NO: 474709 - DNA, 20 bp, Artificial Sequence
  chemically synthesized
actagagaaaaaagggagag

SEQ ID NO: 474710 - DNA, 20 bp, Artificial Sequence
  chemically synthesized
taatcactagagaaaaaagg

SEQ ID NO: 474711 - DNA, 20 bp, Artificial Sequence
  chemically synthesized
gtgtgaatggaaaataaagg

SEQ ID NO: 474712 - DNA, 20 bp, Artificial Sequence
  chemically synthesized
aggaattgcatcatgacagt

SEQ ID NO: 474713 - DNA, 20 bp, Artificial Sequence
  chemically synthesized
cactgtcatgatgcaattcc

SEQ ID NO: 474714 - DNA, 20 bp, Artificial Sequence
  chemically synthesized
taaaatggctgccacactcc

SEQ ID NO: 474715 - DNA, 20 bp, Artificial Sequence
  chemically synthesized
tagcctttggctttggtctt

SEQ ID NO: 474716 - DNA, 20 bp, Artificial Sequence
  chemically synthesized
aaagaccaaagccaaaggct

SEQ ID NO: 474717 - DNA, 20 bp, Artificial Sequence
  chemically synthesized
aatgcaaagatggaaagaca

SEQ ID NO: 474718 - DNA, 20 bp, Artificial Sequence
  chemically synthesized
agatggaaagacattggatt

SEQ ID NO: 474719 - DNA, 20 bp, Artificial Sequence
  chemically synthesized
attagctcaacagtttcatt

SEQ ID NO: 474720 - DNA, 20 bp, Artificial Sequence
  chemically synthesized
gttgagctaataaaccaatt

SEQ ID NO: 474721 - DNA, 20 bp, Artificial Sequence
  chemically synthesized
gtttatttttctcacataat

SEQ ID NO: 474722 - DNA, 20 bp, Artificial Sequence
  chemically synthesized
gaggctttaacttctagtaa

SEQ ID NO: 474723 - DNA, 20 bp, Artificial Sequence
  chemically synthesized
caatcttgacaccagggtca

SEQ ID NO: 474724 - DNA, 20 bp, Artificial Sequence
  chemically synthesized
agaagacccaatcttgacac

SEQ ID NO: 474725 - DNA, 20 bp, Artificial Sequence
  chemically synthesized
ccctgaccctggtgtcaaga

SEQ ID NO: 474726 - DNA, 20 bp, Artificial Sequence
  chemically synthesized
tgggtcttctaattctgcat

SEQ ID NO: 474727 - DNA, 20 bp, Artificial Sequence
  chemically synthesized
cttcctagagtacccagatg

SEQ ID NO: 474728 - DNA, 20 bp, Artificial Sequence
  chemically synthesized
tgggaagccacaaagcttcc

SEQ ID NO: 474729 - DNA, 20 bp, Artificial Sequence
  chemically synthesized
tagccttcaagtctcaattg

SEQ ID NO: 474730 - DNA, 20 bp, Artificial Sequence
  chemically synthesized
tagatttcaggagcctaata

SEQ ID NO: 474731 - DNA, 20 bp, Artificial Sequence
  chemically synthesized
ttttcattatttcaaagact

SEQ ID NO: 474732 - DNA, 20 bp, Artificial Sequence
  chemically synthesized
tgcctcagagagaaagaatt

SEQ ID NO: 474733 - DNA, 20 bp, Artificial Sequence
  chemically synthesized
tttgtgatgcctcagagaga

SEQ ID NO: 474734 - DNA, 20 bp, Artificial Sequence
  chemically synthesized
agcttccatagaaacagata

SEQ ID NO: 474735 - DNA, 20 bp, Artificial Sequence
  chemically synthesized
tccatagaaacagatagaga

SEQ ID NO: 474736 - DNA, 20 bp, Artificial Sequence
  chemically synthesized
tagagaatgaatgtcacacc

SEQ ID NO: 474737 - DNA, 20 bp, Artificial Sequence
  chemically synthesized
agtcattaatgaaaggtata

SEQ ID NO: 474738 - DNA, 20 bp, Artificial Sequence
  chemically synthesized
ggtctctgagccaaaaggtt

SEQ ID NO: 474739 - DNA, 20 bp, Artificial Sequence
  chemically synthesized
gagatgatgacagaatatgg

SEQ ID NO: 474740 - DNA, 20 bp, Artificial Sequence
  chemically synthesized
atgatatgtggagatgatga

SEQ ID NO: 474741 - DNA, 20 bp, Artificial Sequence
  chemically synthesized
gatgcagttcagttttttaa

SEQ ID NO: 474742 - DNA, 20 bp, Artificial Sequence
  chemically synthesized
gcctcggcctcccaaagtgc

SEQ ID NO: 474743 - DNA, 20 bp, Artificial Sequence
  chemically synthesized
actttgggaggccgaggcag

SEQ ID NO: 474744 - DNA, 20 bp, Artificial Sequence
  chemically synthesized
ggcaggtggatcacaagatc

SEQ ID NO: 474745 - DNA, 20 bp, Artificial Sequence
  chemically synthesized
ttttgtatttttagtggaga

SEQ ID NO: 474746 - DNA, 20 bp, Artificial Sequence
  chemically synthesized
aattcccctgcctcagcctc

SEQ ID NO: 474747 - DNA, 20 bp, Artificial Sequence
  chemically synthesized
tactctggaggctgaggcag

SEQ ID NO: 474748 - DNA, 20 bp, Artificial Sequence
  chemically synthesized
ctcactgcaacctctgtctc

SEQ ID NO: 474749 - DNA, 20 bp, Artificial Sequence
  chemically synthesized
tctcactctgtcgcccaggc

SEQ ID NO: 474750 - DNA, 20 bp, Artificial Sequence
  chemically synthesized
ctgcactctggcctgggcga

SEQ ID NO: 474751 - DNA, 20 bp, Artificial Sequence
  chemically synthesized
gtttttttttttttttgaga

SEQ ID NO: 474752 - DNA, 20 bp, Artificial Sequence
  chemically synthesized
tatttgattttaagaaaaag

SEQ ID NO: 474753 - DNA, 20 bp, Artificial Sequence
  chemically synthesized
tcttaaaatcaaatattcca

SEQ ID NO: 474754 - DNA, 20 bp, Artificial Sequence
  chemically synthesized
atgctcatcacaccatccta

SEQ ID NO: 474755 - DNA, 20 bp, Artificial Sequence
  chemically synthesized
gatgagcattcacatatcaa

SEQ ID NO: 474756 - DNA, 20 bp, Artificial Sequence
  chemically synthesized
atgatgtattctcttgatat

SEQ ID NO: 474757 - DNA, 20 bp, Artificial Sequence
  chemically synthesized
atatcaacaactagaaatta

SEQ ID NO: 474758 - DNA, 20 bp, Artificial Sequence
  chemically synthesized
actcgctcaaagagttgtct

SEQ ID NO: 474759 - DNA, 20 bp, Artificial Sequence
  chemically synthesized
atcctcagacaactctttga

SEQ ID NO: 474760 - DNA, 20 bp, Artificial Sequence
  chemically synthesized
gtaataatagcactcgctca

SEQ ID NO: 474761 - DNA, 20 bp, Artificial Sequence
  chemically synthesized
catttatttatctgttcaat

SEQ ID NO: 474762 - DNA, 20 bp, Artificial Sequence
  chemically synthesized
taaatggaagcactacaaaa

SEQ ID NO: 474763 - DNA, 20 bp, Artificial Sequence
  chemically synthesized
tgggagtcaacgtgtggggt

SEQ ID NO: 474764 - DNA, 20 bp, Artificial Sequence
  chemically synthesized
agagtctgggagtcaacgtg

SEQ ID NO: 474765 - DNA, 20 bp, Artificial Sequence
  chemically synthesized
tctgaaaattttcagagtct

SEQ ID NO: 474766 - DNA, 20 bp, Artificial Sequence
  chemically synthesized
gcttagagtctgaaaatttt

SEQ ID NO: 474767 - DNA, 20 bp, Artificial Sequence
  chemically synthesized
tatttctatatttttaagct

SEQ ID NO: 474768 - DNA, 20 bp, Artificial Sequence
  chemically synthesized
aaaaatatagaaataagcaa

SEQ ID NO: 474769 - DNA, 20 bp, Artificial Sequence
  chemically synthesized
gcgttcttatcagcccagaa

SEQ ID NO: 474770 - DNA, 20 bp, Artificial Sequence
  chemically synthesized
agcaaatattgacatagctt

SEQ ID NO: 474771 - DNA, 20 bp, Artificial Sequence
  chemically synthesized
tataatctaatatttttgag

SEQ ID NO: 474772 - DNA, 20 bp, Artificial Sequence
  chemically synthesized
aagatgaagttatttggaaa

SEQ ID NO: 474773 - DNA, 20 bp, Artificial Sequence
  chemically synthesized
agatatgaagattgtgatat

SEQ ID NO: 474774 - DNA, 20 bp, Artificial Sequence
  chemically synthesized
atggaaaggtttatgcgcac

SEQ ID NO: 474775 - DNA, 20 bp, Artificial Sequence
  chemically synthesized
aaaaatatgatccttgttag

SEQ ID NO: 474776 - DNA, 20 bp, Artificial Sequence
  chemically synthesized
atattagatatcctgctaac

SEQ ID NO: 474777 - DNA, 20 bp, Artificial Sequence
  chemically synthesized
atgctatcaatggaacaaga

SEQ ID NO: 474778 - DNA, 20 bp, Artificial Sequence
  chemically synthesized
tcaaatgctatcaatggaac

SEQ ID NO: 474779 - DNA, 20 bp, Artificial Sequence
  chemically synthesized
taaaaatatttttaaaacct

SEQ ID NO: 474780 - DNA, 20 bp, Artificial Sequence
  chemically synthesized
caattaaatcgatattccag

SEQ ID NO: 474781 - DNA, 20 bp, Artificial Sequence
  chemically synthesized
cacgagccactgcacccagc

SEQ ID NO: 474782 - DNA, 20 bp, Artificial Sequence
  chemically synthesized
acctcgacctcccaaagtgc

SEQ ID NO: 474783 - DNA, 20 bp, Artificial Sequence
  chemically synthesized
cagcactttgggaggtcgag

SEQ ID NO: 474784 - DNA, 20 bp, Artificial Sequence
  chemically synthesized
actttgggaggtcgaggtgg

SEQ ID NO: 474785 - DNA, 20 bp, Artificial Sequence
  chemically synthesized
tgggtggatcacctgaggtc

SEQ ID NO: 474786 - DNA, 20 bp, Artificial Sequence
  chemically synthesized
ttttgtattttcagtagaga

SEQ ID NO: 474787 - DNA, 20 bp, Artificial Sequence
  chemically synthesized
actgaaaatacaaaaattag

SEQ ID NO: 474788 - DNA, 20 bp, Artificial Sequence
  chemically synthesized
aattctcctgcctcagcctc

SEQ ID NO: 474789 - DNA, 20 bp, Artificial Sequence
  chemically synthesized
tactcaggaggctgaggcag

SEQ ID NO: 474790 - DNA, 20 bp, Artificial Sequence
  chemically synthesized
ctcactgcaacctctggctc

SEQ ID NO: 474791 - DNA, 20 bp, Artificial Sequence
  chemically synthesized
tctcgctccgtggcccagac

SEQ ID NO: 474792 - DNA, 20 bp, Artificial Sequence
  chemically synthesized
ttaaaaaattttttttgaga

SEQ ID NO: 474793 - DNA, 20 bp, Artificial Sequence
  chemically synthesized
tttaagtggagaaaaataaa

SEQ ID NO: 474794 - DNA, 20 bp, Artificial Sequence
  chemically synthesized
gattttttttatgatctcat

SEQ ID NO: 474795 - DNA, 20 bp, Artificial Sequence
  chemically synthesized
atgatctcataaggatcaca

SEQ ID NO: 474796 - DNA, 20 bp, Artificial Sequence
  chemically synthesized
cattactatgagagagagag

SEQ ID NO: 474797 - DNA, 20 bp, Artificial Sequence
  chemically synthesized
agaagacatatgttgtcttt

SEQ ID NO: 474798 - DNA, 20 bp, Artificial Sequence
  chemically synthesized
aacaaccaggcagttagtag

SEQ ID NO: 474799 - DNA, 20 bp, Artificial Sequence
  chemically synthesized
ctgtttttgtttttcctttg

SEQ ID NO: 474800 - DNA, 20 bp, Artificial Sequence
  chemically synthesized
accatgattggcagctctac

SEQ ID NO: 474801 - DNA, 20 bp, Artificial Sequence
  chemically synthesized
tgccttcctcaattccccta

SEQ ID NO: 474802 - DNA, 20 bp, Artificial Sequence
  chemically synthesized
ggggtctttgaactctttag

SEQ ID NO: 474803 - DNA, 20 bp, Artificial Sequence
  chemically synthesized
ggcagagtctgagtaaccta

SEQ ID NO: 474804 - DNA, 20 bp, Artificial Sequence
  chemically synthesized
agcttcctgagtggcagagt

SEQ ID NO: 474805 - DNA, 20 bp, Artificial Sequence
  chemically synthesized
tttgtcagcttcctgagtgg

SEQ ID NO: 474806 - DNA, 20 bp, Artificial Sequence
  chemically synthesized
tttcttcctttgtcagcttc

SEQ ID NO: 474807 - DNA, 20 bp, Artificial Sequence
  chemically synthesized
cagaataggacatgaagtat

SEQ ID NO: 474808 - DNA, 20 bp, Artificial Sequence
  chemically synthesized
gtaatttgaaaactaggtct

SEQ ID NO: 474809 - DNA, 20 bp, Artificial Sequence
  chemically synthesized
aaattacttcgttcatttct

SEQ ID NO: 474810 - DNA, 20 bp, Artificial Sequence
  chemically synthesized
gtcagggaaaacaaagggga

SEQ ID NO: 474811 - DNA, 20 bp, Artificial Sequence
  chemically synthesized
ttcaagtcagggaaaacaaa

SEQ ID NO: 474812 - DNA, 20 bp, Artificial Sequence
  chemically synthesized
tcccctttgttttccctgac

SEQ ID NO: 474813 - DNA, 20 bp, Artificial Sequence
  chemically synthesized
tttccctgacttgaattagc

SEQ ID NO: 474814 - DNA, 20 bp, Artificial Sequence
  chemically synthesized
aggcaaaaagggtgtactat

SEQ ID NO: 474815 - DNA, 20 bp, Artificial Sequence
  chemically synthesized
ggtgaaaaagagaaggcaaa

SEQ ID NO: 474816 - DNA, 20 bp, Artificial Sequence
  chemically synthesized
tagcagccaccattatttca

SEQ ID NO: 474817 - DNA, 20 bp, Artificial Sequence
  chemically synthesized
tctacagtggcttaaataaa

SEQ ID NO: 474818 - DNA, 20 bp, Artificial Sequence
  chemically synthesized
cccattttattggctggggt

SEQ ID NO: 474819 - DNA, 20 bp, Artificial Sequence
  chemically synthesized
catattcccattttattggc

SEQ ID NO: 474820 - DNA, 20 bp, Artificial Sequence
  chemically synthesized
ctaaccccagccaataaaat

SEQ ID NO: 474821 - DNA, 20 bp, Artificial Sequence
  chemically synthesized
atgaaaaacaaacaaaaaat

SEQ ID NO: 474822 - DNA, 20 bp, Artificial Sequence
  chemically synthesized
ataaattcttcattgtttag

SEQ ID NO: 474823 - DNA, 20 bp, Artificial Sequence
  chemically synthesized
atgaatccttctaaacaatg

SEQ ID NO: 474824 - DNA, 20 bp, Artificial Sequence
  chemically synthesized
tctaaacaatgaagaattta

SEQ ID NO: 474825 - DNA, 20 bp, Artificial Sequence
  chemically synthesized
caatgaagaatttatggggt

SEQ ID NO: 474826 - DNA, 20 bp, Artificial Sequence
  chemically synthesized
ggaacagaagatatagccag

SEQ ID NO: 474827 - DNA, 20 bp, Artificial Sequence
  chemically synthesized
aaactggagaacattgcatc

SEQ ID NO: 474828 - DNA, 20 bp, Artificial Sequence
  chemically synthesized
tatcagaatatacctatatc

SEQ ID NO: 474829 - DNA, 20 bp, Artificial Sequence
  chemically synthesized
agggccctgtatcagagtat

SEQ ID NO: 474830 - DNA, 20 bp, Artificial Sequence
  chemically synthesized
ggaagctaagggccctgtat

SEQ ID NO: 474831 - DNA, 20 bp, Artificial Sequence
  chemically synthesized
ttttttttttttttttgaga

SEQ ID NO: 474832 - DNA, 20 bp, Artificial Sequence
  chemically synthesized
tctcgctctgtggcccaggc

SEQ ID NO: 474833 - DNA, 20 bp, Artificial Sequence
  chemically synthesized
ctcactgcaagctccgcctc

SEQ ID NO: 474834 - DNA, 20 bp, Artificial Sequence
  chemically synthesized
tactcaggaggctgaggcag

SEQ ID NO: 474835 - DNA, 20 bp, Artificial Sequence
  chemically synthesized
cattctcctgcctcagcctc

SEQ ID NO: 474836 - DNA, 20 bp, Artificial Sequence
  chemically synthesized
ttttgtatttttagtagaga

SEQ ID NO: 474837 - DNA, 20 bp, Artificial Sequence
  chemically synthesized
cggggtttcaccgtgttagc

SEQ ID NO: 474838 - DNA, 20 bp, Artificial Sequence
  chemically synthesized
actttgggaggccgaggcgg

SEQ ID NO: 474839 - DNA, 20 bp, Artificial Sequence
  chemically synthesized
gcctcggcctcccaaagtgc

SEQ ID NO: 474840 - DNA, 20 bp, Artificial Sequence
  chemically synthesized
taaatatgtgtgcacttgta

SEQ ID NO: 474841 - DNA, 20 bp, Artificial Sequence
  chemically synthesized
tgtctaagtagaattgacgt

SEQ ID NO: 474842 - DNA, 20 bp, Artificial Sequence
  chemically synthesized
tgggatttcctttgtctaag

SEQ ID NO: 474843 - DNA, 20 bp, Artificial Sequence
  chemically synthesized
tacttagacaaaggaaatcc

SEQ ID NO: 474844 - DNA, 20 bp, Artificial Sequence
  chemically synthesized
aaaaaaaaaaaaaaaaaccc

SEQ ID NO: 474845 - DNA, 20 bp, Artificial Sequence
  chemically synthesized
tgtatgtcttgcctacagtc

SEQ ID NO: 474846 - DNA, 20 bp, Artificial Sequence
  chemically synthesized
ctcaggaaatcatgcagttt

SEQ ID NO: 474847 - DNA, 20 bp, Artificial Sequence
  chemically synthesized
tgatttcctgaggtgacctc

SEQ ID NO: 474848 - DNA, 20 bp, Artificial Sequence
  chemically synthesized
ctaatgcaatcaataaaatc

SEQ ID NO: 474849 - DNA, 20 bp, Artificial Sequence
  chemically synthesized
gaatctgtgttaggcatttt

SEQ ID NO: 474850 - DNA, 20 bp, Artificial Sequence
  chemically synthesized
gttaggcattttgagagttt

SEQ ID NO: 474851 - DNA, 20 bp, Artificial Sequence
  chemically synthesized
ggcattttgagagttttgga

SEQ ID NO: 474852 - DNA, 20 bp, Artificial Sequence
  chemically synthesized
gatgagaaaagtcttcctaa

SEQ ID NO: 474853 - DNA, 20 bp, Artificial Sequence
  chemically synthesized
ctaagagaataaactagatt

SEQ ID NO: 474854 - DNA, 20 bp, Artificial Sequence
  chemically synthesized
gaagccccaaaattatacaa

SEQ ID NO: 474855 - DNA, 20 bp, Artificial Sequence
  chemically synthesized
tttatcatagctaagagcac

SEQ ID NO: 474856 - DNA, 20 bp, Artificial Sequence
  chemically synthesized
ttcttgatgataccaaagag

SEQ ID NO: 474857 - DNA, 20 bp, Artificial Sequence
  chemically synthesized
tactgagatgaaattaaaac

SEQ ID NO: 474858 - DNA, 20 bp, Artificial Sequence
  chemically synthesized
gtcatccctgagacatcatt

SEQ ID NO: 474859 - DNA, 20 bp, Artificial Sequence
  chemically synthesized
caaatccaaaatgatgtctc

SEQ ID NO: 474860 - DNA, 20 bp, Artificial Sequence
  chemically synthesized
atgatgtctcagggatgact

SEQ ID NO: 474861 - DNA, 20 bp, Artificial Sequence
  chemically synthesized
cacatatcccatctggaatt

SEQ ID NO: 474862 - DNA, 20 bp, Artificial Sequence
  chemically synthesized
ggatgactcagaattccaga

SEQ ID NO: 474863 - DNA, 20 bp, Artificial Sequence
  chemically synthesized
aaaagtacacatatcccatc

SEQ ID NO: 474864 - DNA, 20 bp, Artificial Sequence
  chemically synthesized
ctctgacagttgtgttgtca

SEQ ID NO: 474865 - DNA, 20 bp, Artificial Sequence
  chemically synthesized
ttcaatttccagtttcaaga

SEQ ID NO: 474866 - DNA, 20 bp, Artificial Sequence
  chemically synthesized
aagagggaatgagatcaggc

SEQ ID NO: 474867 - DNA, 20 bp, Artificial Sequence
  chemically synthesized
tgaatgatcatttatggtga

SEQ ID NO: 474868 - DNA, 20 bp, Artificial Sequence
  chemically synthesized
ctcacttgttcgtggacttt

SEQ ID NO: 474869 - DNA, 20 bp, Artificial Sequence
  chemically synthesized
agtattttcgaaagacacaa

SEQ ID NO: 474870 - DNA, 20 bp, Artificial Sequence
  chemically synthesized
aatagctatctgcaacgata

SEQ ID NO: 474871 - DNA, 20 bp, Artificial Sequence
  chemically synthesized
aagcgaacaggaggaccgtt

SEQ ID NO: 474872 - DNA, 20 bp, Artificial Sequence
  chemically synthesized
caaaattgtaaggctggtgt

SEQ ID NO: 474873 - DNA, 20 bp, Artificial Sequence
  chemically synthesized
ggctggtgtgggggtatggc

SEQ ID NO: 474874 - DNA, 20 bp, Artificial Sequence
  chemically synthesized
ccaaatttcacatctccgtt

SEQ ID NO: 474875 - DNA, 20 bp, Artificial Sequence
  chemically synthesized
cttctctcactttgagctca

SEQ ID NO: 474876 - DNA, 20 bp, Artificial Sequence
  chemically synthesized
cactttgagctcagtgaatc

SEQ ID NO: 474877 - DNA, 20 bp, Artificial Sequence
  chemically synthesized
acaaatgcatgaacaaagta

SEQ ID NO: 474878 - DNA, 20 bp, Artificial Sequence
  chemically synthesized
tgtaacttgacttatgtgct

SEQ ID NO: 474879 - DNA, 20 bp, Artificial Sequence
  chemically synthesized
atgtactgtgttatgtacat

SEQ ID NO: 474880 - DNA, 20 bp, Artificial Sequence
  chemically synthesized
ttttttcatagggttgtagt

SEQ ID NO: 474881 - DNA, 20 bp, Artificial Sequence
  chemically synthesized
atacagtagtgcttttttca

SEQ ID NO: 474882 - DNA, 20 bp, Artificial Sequence
  chemically synthesized
tgcctcagtttcctcatcag

SEQ ID NO: 474883 - DNA, 20 bp, Artificial Sequence
  chemically synthesized
attgaggttggcaaagcaga

SEQ ID NO: 474884 - DNA, 20 bp, Artificial Sequence
  chemically synthesized
gcaaagcagacagaatctga

SEQ ID NO: 474885 - DNA, 20 bp, Artificial Sequence
  chemically synthesized
gccactaaaatggactggct

SEQ ID NO: 474886 - DNA, 20 bp, Artificial Sequence
  chemically synthesized
taaaatggactggctcagag

SEQ ID NO: 474887 - DNA, 20 bp, Artificial Sequence
  chemically synthesized
ggactggctcagagttgaat

SEQ ID NO: 474888 - DNA, 20 bp, Artificial Sequence
  chemically synthesized
gctcagagttgaataagaat

SEQ ID NO: 474889 - DNA, 20 bp, Artificial Sequence
  chemically synthesized
aagggctttccaggcataga

SEQ ID NO: 474890 - DNA, 20 bp, Artificial Sequence
  chemically synthesized
agcgagagggccagaggccg

SEQ ID NO: 474891 - DNA, 20 bp, Artificial Sequence
  chemically synthesized
aagagtaaataaggttgcaa

SEQ ID NO: 474892 - DNA, 20 bp, Artificial Sequence
  chemically synthesized
taaataaggttgcaaggggg

SEQ ID NO: 474893 - DNA, 20 bp, Artificial Sequence
  chemically synthesized
ctacaacacattttttcaaa

SEQ ID NO: 474894 - DNA, 20 bp, Artificial Sequence
  chemically synthesized
caggagaattgcttgagccc

SEQ ID NO: 474895 - DNA, 20 bp, Artificial Sequence
  chemically synthesized
actttgagaggccaagacag

SEQ ID NO: 474896 - DNA, 20 bp, Artificial Sequence
  chemically synthesized
gtcttggcctctcaaagtgc

SEQ ID NO: 474897 - DNA, 20 bp, Artificial Sequence
  chemically synthesized
actgtgcccagccaggagga

SEQ ID NO: 474898 - DNA, 20 bp, Artificial Sequence
  chemically synthesized
tcactgatctagcctcttaa

SEQ ID NO: 474899 - DNA, 20 bp, Artificial Sequence
  chemically synthesized
tcagttaagaggctagatca

SEQ ID NO: 474900 - DNA, 20 bp, Artificial Sequence
  chemically synthesized
taggcactgtggttgtacct

SEQ ID NO: 474901 - DNA, 20 bp, Artificial Sequence
  chemically synthesized
gtgcctacagcctcaaactt

SEQ ID NO: 474902 - DNA, 20 bp, Artificial Sequence
  chemically synthesized
tactgaagaggctgaggtgg

SEQ ID NO: 474903 - DNA, 20 bp, Artificial Sequence
  chemically synthesized
gtgcctcactggagctgaag

SEQ ID NO: 474904 - DNA, 20 bp, Artificial Sequence
  chemically synthesized
gatatttccctgatcccttc

SEQ ID NO: 474905 - DNA, 20 bp, Artificial Sequence
  chemically synthesized
cctccagttcccacccacga

SEQ ID NO: 474906 - DNA, 20 bp, Artificial Sequence
  chemically synthesized
ggggtggaccagcgagtgag

SEQ ID NO: 474907 - DNA, 20 bp, Artificial Sequence
  chemically synthesized
catgaggggtggaccagcga

SEQ ID NO: 474908 - DNA, 20 bp, Artificial Sequence
  chemically synthesized
cttccatgaggggtggacca

SEQ ID NO: 474909 - DNA, 20 bp, Artificial Sequence
  chemically synthesized
cctgtgctcccccttccatg

SEQ ID NO: 474910 - DNA, 20 bp, Artificial Sequence
  chemically synthesized
agcagctggggccagcattt

SEQ ID NO: 474911 - DNA, 20 bp, Artificial Sequence
  chemically synthesized
cagcatttttgagtgctggc

SEQ ID NO: 474912 - DNA, 20 bp, Artificial Sequence
  chemically synthesized
ccctgcagcagcctctaggg

SEQ ID NO: 474913 - DNA, 20 bp, Artificial Sequence
  chemically synthesized
tgttaacacttaagccatct

SEQ ID NO: 474914 - DNA, 20 bp, Artificial Sequence
  chemically synthesized
taagtgttaacagctcagtg

SEQ ID NO: 474915 - DNA, 20 bp, Artificial Sequence
  chemically synthesized
agaacttgggtgccatgcgt

SEQ ID NO: 474916 - DNA, 20 bp, Artificial Sequence
  chemically synthesized
cctggatgctggacaagaac

SEQ ID NO: 474917 - DNA, 20 bp, Artificial Sequence
  chemically synthesized
gttcttgtccagcatccagg

SEQ ID NO: 474918 - DNA, 20 bp, Artificial Sequence
  chemically synthesized
ttcatgtgacctcattcctc

SEQ ID NO: 474919 - DNA, 20 bp, Artificial Sequence
  chemically synthesized
aattgaagatggtaaatatg

SEQ ID NO: 474920 - DNA, 20 bp, Artificial Sequence
  chemically synthesized
gtgggaaggggagctgaaaa

SEQ ID NO: 474921 - DNA, 20 bp, Artificial Sequence
  chemically synthesized
aaggggagctgaaaagggga

SEQ ID NO: 474922 - DNA, 20 bp, Artificial Sequence
  chemically synthesized
gtgggaaggtaatcttcccc

SEQ ID NO: 474923 - DNA, 20 bp, Artificial Sequence
  chemically synthesized
ctttggagaggagtccagct

SEQ ID NO: 474924 - DNA, 20 bp, Artificial Sequence
  chemically synthesized
ttgacagcatagctttggag

SEQ ID NO: 474925 - DNA, 20 bp, Artificial Sequence
  chemically synthesized
ggcagaaggaggagaagcag

SEQ ID NO: 474926 - DNA, 20 bp, Artificial Sequence
  chemically synthesized
tccttctgccagctgagctc

SEQ ID NO: 474927 - DNA, 20 bp, Artificial Sequence
  chemically synthesized
gtttttataggcacaggttg

SEQ ID NO: 474928 - DNA, 20 bp, Artificial Sequence
  chemically synthesized
ttataggcacaggttggggg

SEQ ID NO: 474929 - DNA, 20 bp, Artificial Sequence
  chemically synthesized
cacaggttggggggtgggtg

SEQ ID NO: 474930 - DNA, 20 bp, Artificial Sequence
  chemically synthesized
tggggggtgggtggggggta

SEQ ID NO: 474931 - DNA, 20 bp, Artificial Sequence
  chemically synthesized
catccctgttttccctcttg

SEQ ID NO: 474932 - DNA, 20 bp, Artificial Sequence
  chemically synthesized
cacccttcaagagggaaaac

SEQ ID NO: 474933 - DNA, 20 bp, Artificial Sequence
  chemically synthesized
ggttccaggctttttggctt

SEQ ID NO: 474934 - DNA, 20 bp, Artificial Sequence
  chemically synthesized
ccaggctttttggcttgagg

SEQ ID NO: 474935 - DNA, 20 bp, Artificial Sequence
  chemically synthesized
gggacctgccctcttctgcc

SEQ ID NO: 474936 - DNA, 20 bp, Artificial Sequence
  chemically synthesized
aagccacatcttgacaggct

SEQ ID NO: 474937 - DNA, 20 bp, Artificial Sequence
  chemically synthesized
agaagatttttttaatataa

SEQ ID NO: 474938 - DNA, 20 bp, Artificial Sequence
  chemically synthesized
tttttaatataatggggtac

SEQ ID NO: 474939 - DNA, 20 bp, Artificial Sequence
  chemically synthesized
aactagccatagtgataaag

SEQ ID NO: 474940 - DNA, 20 bp, Artificial Sequence
  chemically synthesized
agaaaggactgagggaaggg

SEQ ID NO: 474941 - DNA, 20 bp, Artificial Sequence
  chemically synthesized
gaagggcagagtagttagag

SEQ ID NO: 474942 - DNA, 20 bp, Artificial Sequence
  chemically synthesized
gagtagttagagaggaatag

SEQ ID NO: 474943 - DNA, 20 bp, Artificial Sequence
  chemically synthesized
ttagagaggaatagctggat

SEQ ID NO: 474944 - DNA, 20 bp, Artificial Sequence
  chemically synthesized
gtgtttttatttttagatat

SEQ ID NO: 474945 - DNA, 20 bp, Artificial Sequence
  chemically synthesized
tagatataagagtcagcaaa

SEQ ID NO: 474946 - DNA, 20 bp, Artificial Sequence
  chemically synthesized
tccattggttgggccatatc

SEQ ID NO: 474947 - DNA, 20 bp, Artificial Sequence
  chemically synthesized
ctggaatattatcatcagtt

SEQ ID NO: 474948 - DNA, 20 bp, Artificial Sequence
  chemically synthesized
agcagagggatgactttgaa

SEQ ID NO: 474949 - DNA, 20 bp, Artificial Sequence
  chemically synthesized
cagtgagcagagggatgact

SEQ ID NO: 474950 - DNA, 20 bp, Artificial Sequence
  chemically synthesized
gcatctatctcagtgagcag

SEQ ID NO: 474951 - DNA, 20 bp, Artificial Sequence
  chemically synthesized
tgattgcctcctttggaaag

SEQ ID NO: 474952 - DNA, 20 bp, Artificial Sequence
  chemically synthesized
aaggcgaatcagatactcaa

SEQ ID NO: 474953 - DNA, 20 bp, Artificial Sequence
  chemically synthesized
agataaatggttgcattctt

SEQ ID NO: 474954 - DNA, 20 bp, Artificial Sequence
  chemically synthesized
cttcaagttgtcccaccctt

SEQ ID NO: 474955 - DNA, 20 bp, Artificial Sequence
  chemically synthesized
tgtacatttgttccatccag

SEQ ID NO: 474956 - DNA, 20 bp, Artificial Sequence
  chemically synthesized
gaacctcctgaggctgtttc

SEQ ID NO: 474957 - DNA, 20 bp, Artificial Sequence
  chemically synthesized
aagtttattttgccaaggtt

SEQ ID NO: 474958 - DNA, 20 bp, Artificial Sequence
  chemically synthesized
tcgtctttatcttcctctgc

SEQ ID NO: 474959 - DNA, 20 bp, Artificial Sequence
  chemically synthesized
cgaagatgaaagtcttgact

SEQ ID NO: 474960 - DNA, 20 bp, Artificial Sequence
  chemically synthesized
aacgaaaaaaatcaatataa

SEQ ID NO: 474961 - DNA, 20 bp, Artificial Sequence
  chemically synthesized
cttttacaaaagcagttatt

SEQ ID NO: 474962 - DNA, 20 bp, Artificial Sequence
  chemically synthesized
tgtgtaacagaacttgagtt

SEQ ID NO: 474963 - DNA, 20 bp, Artificial Sequence
  chemically synthesized
atcccactgtgtaacagaac

SEQ ID NO: 474964 - DNA, 20 bp, Artificial Sequence
  chemically synthesized
actcaagttctgttacacag

SEQ ID NO: 474965 - DNA, 20 bp, Artificial Sequence
  chemically synthesized
ttcaagctgatgtgaactag

SEQ ID NO: 474966 - DNA, 20 bp, Artificial Sequence
  chemically synthesized
agttcacatcagcttgaaac

SEQ ID NO: 474967 - DNA, 20 bp, Artificial Sequence
  chemically synthesized
agaagatacgaaaattgaca

SEQ ID NO: 474968 - DNA, 20 bp, Artificial Sequence
  chemically synthesized
tctctttggctccagtgggc

SEQ ID NO: 474969 - DNA, 20 bp, Artificial Sequence
  chemically synthesized
ccagaactgctccctgggaa

SEQ ID NO: 474970 - DNA, 20 bp, Artificial Sequence
  chemically synthesized
catcaatgactgtactcaaa

SEQ ID NO: 474971 - DNA, 20 bp, Artificial Sequence
  chemically synthesized
tgactgtactcaaactgggt

SEQ ID NO: 474972 - DNA, 20 bp, Artificial Sequence
  chemically synthesized
tttggtcattcaaacccagt

SEQ ID NO: 474973 - DNA, 20 bp, Artificial Sequence
  chemically synthesized
gtttgaatgaccaaactgac

SEQ ID NO: 474974 - DNA, 20 bp, Artificial Sequence
  chemically synthesized
ccaaactgacagggatttta

SEQ ID NO: 474975 - DNA, 20 bp, Artificial Sequence
  chemically synthesized
ctgacagggattttataggg

SEQ ID NO: 474976 - DNA, 20 bp, Artificial Sequence
  chemically synthesized
cattcattttcttcctaagg

SEQ ID NO: 474977 - DNA, 20 bp, Artificial Sequence
  chemically synthesized
aatcctgccttaggaagaaa

SEQ ID NO: 474978 - DNA, 20 bp, Artificial Sequence
  chemically synthesized
ctcagaatttaaagggattt

SEQ ID NO: 474979 - DNA, 20 bp, Artificial Sequence
  chemically synthesized
catgcaatctcagaatttaa

SEQ ID NO: 474980 - DNA, 20 bp, Artificial Sequence
  chemically synthesized
gtgcttctgccatgcaatct

SEQ ID NO: 474981 - DNA, 20 bp, Artificial Sequence
  chemically synthesized
gatcacactacctaaaaaga

SEQ ID NO: 474982 - DNA, 20 bp, Artificial Sequence
  chemically synthesized
ttagtttccatatctatgat

SEQ ID NO: 474983 - DNA, 20 bp, Artificial Sequence
  chemically synthesized
tatctatgatatgagtttag

SEQ ID NO: 474984 - DNA, 20 bp, Artificial Sequence
  chemically synthesized
tttaaaacattcaatgattt

SEQ ID NO: 474985 - DNA, 20 bp, Artificial Sequence
  chemically synthesized
atcaagcaactctaaaatca

SEQ ID NO: 474986 - DNA, 20 bp, Artificial Sequence
  chemically synthesized
gcttgatgtcgttagaaata

SEQ ID NO: 474987 - DNA, 20 bp, Artificial Sequence
  chemically synthesized
tcgttagaaatattgaatgc

SEQ ID NO: 474988 - DNA, 20 bp, Artificial Sequence
  chemically synthesized
aaatattgaatgccagaatg

SEQ ID NO: 474989 - DNA, 20 bp, Artificial Sequence
  chemically synthesized
aatgtggaatatttatttaa

SEQ ID NO: 474990 - DNA, 20 bp, Artificial Sequence
  chemically synthesized
gaggctatttatctgcaaca

SEQ ID NO: 474991 - DNA, 20 bp, Artificial Sequence
  chemically synthesized
gcttagctcactagctgaaa

SEQ ID NO: 474992 - DNA, 20 bp, Artificial Sequence
  chemically synthesized
ctatgttacagggttgttat

SEQ ID NO: 474993 - DNA, 20 bp, Artificial Sequence
  chemically synthesized
tgtgaatagtacctatgtta

SEQ ID NO: 474994 - DNA, 20 bp, Artificial Sequence
  chemically synthesized
aaggtttggtttccctgact

SEQ ID NO: 474995 - DNA, 20 bp, Artificial Sequence
  chemically synthesized
cacagtttctaagtggtaga

SEQ ID NO: 474996 - DNA, 20 bp, Artificial Sequence
  chemically synthesized
ctgttgacagctgtcagggt

SEQ ID NO: 474997 - DNA, 20 bp, Artificial Sequence
  chemically synthesized
taattcctgttgacagctgt

SEQ ID NO: 474998 - DNA, 20 bp, Artificial Sequence
  chemically synthesized
ataccctgacagctgtcaac

SEQ ID NO: 474999 - DNA, 20 bp, Artificial Sequence
  chemically synthesized
tctccgttacatattcttct

SEQ ID NO: 475000 - DNA, 20 bp, Artificial Sequence
  chemically synthesized
aagttgtacgaaacccaaag

SEQ ID NO: 475001 - DNA, 20 bp, Artificial Sequence
  chemically synthesized
gtacaaattcaacatggggc

SEQ ID NO: 475002 - DNA, 20 bp, Artificial Sequence
  chemically synthesized
aaaaaaacccaggccccatg

SEQ ID NO: 475003 - DNA, 20 bp, Artificial Sequence
  chemically synthesized
tagtagtcttggggaagcag

SEQ ID NO: 475004 - DNA, 20 bp, Artificial Sequence
  chemically synthesized
ctctgtaatacaacgagcct

SEQ ID NO: 475005 - DNA, 20 bp, Artificial Sequence
  chemically synthesized
atagatggaaaataggctta

SEQ ID NO: 475006 - DNA, 20 bp, Artificial Sequence
  chemically synthesized
gtggcagagctgtgagcttt

SEQ ID NO: 475007 - DNA, 20 bp, Artificial Sequence
  chemically synthesized
tactcagcctctctactgca

SEQ ID NO: 475008 - DNA, 20 bp, Artificial Sequence
  chemically synthesized
tatccattgcagtagagagg

SEQ ID NO: 475009 - DNA, 20 bp, Artificial Sequence
  chemically synthesized
attgcagtagagaggctgag

SEQ ID NO: 475010 - DNA, 20 bp, Artificial Sequence
  chemically synthesized
ggactggggcagggagggac

SEQ ID NO: 475011 - DNA, 20 bp, Artificial Sequence
  chemically synthesized
cactgtagcttcataatcaa

SEQ ID NO: 475012 - DNA, 20 bp, Artificial Sequence
  chemically synthesized
caactggatttgtcagttta

SEQ ID NO: 475013 - DNA, 20 bp, Artificial Sequence
  chemically synthesized
tcagtttattggatgtcagg

SEQ ID NO: 475014 - DNA, 20 bp, Artificial Sequence
  chemically synthesized
tttattggatgtcaggcagg

SEQ ID NO: 475015 - DNA, 20 bp, Artificial Sequence
  chemically synthesized
agtaagccaagctcagacct

SEQ ID NO: 475016 - DNA, 20 bp, Artificial Sequence
  chemically synthesized
gggctgctttgaggagataa

SEQ ID NO: 475017 - DNA, 20 bp, Artificial Sequence
  chemically synthesized
gtgaagcagccaaaactata

SEQ ID NO: 475018 - DNA, 20 bp, Artificial Sequence
  chemically synthesized
aacaccctcgttttgtactt

SEQ ID NO: 475019 - DNA, 20 bp, Artificial Sequence
  chemically synthesized
agtatcctaaagtacaaaac

SEQ ID NO: 475020 - DNA, 20 bp, Artificial Sequence
  chemically synthesized
taaagtacaaaacgagggtg

SEQ ID NO: 475021 - DNA, 20 bp, Artificial Sequence
  chemically synthesized
tctttcttttggcagtttcc

SEQ ID NO: 475022 - DNA, 20 bp, Artificial Sequence
  chemically synthesized
aactgccaaaagaaagagcc

SEQ ID NO: 475023 - DNA, 20 bp, Artificial Sequence
  chemically synthesized
tgagggaacgatttctgaaa

SEQ ID NO: 475024 - DNA, 20 bp, Artificial Sequence
  chemically synthesized
tctgaaaaagaattgaacag

SEQ ID NO: 475025 - DNA, 20 bp, Artificial Sequence
  chemically synthesized
tgctgagagcagtaagacag

SEQ ID NO: 475026 - DNA, 20 bp, Artificial Sequence
  chemically synthesized
ctcagcaaataaagatcaaa

SEQ ID NO: 475027 - DNA, 20 bp, Artificial Sequence
  chemically synthesized
tagtgtccattatcaaatgg

SEQ ID NO: 475028 - DNA, 20 bp, Artificial Sequence
  chemically synthesized
gatctttctctgagccagtt

SEQ ID NO: 475029 - DNA, 20 bp, Artificial Sequence
  chemically synthesized
tataggagaaaactaatgga

SEQ ID NO: 475030 - DNA, 20 bp, Artificial Sequence
  chemically synthesized
cgtgatcgtttctggctcca

SEQ ID NO: 475031 - DNA, 20 bp, Artificial Sequence
  chemically synthesized
gaacaggtcactatgattat

SEQ ID NO: 475032 - DNA, 20 bp, Artificial Sequence
  chemically synthesized
atcactaggaaaagacatag

SEQ ID NO: 475033 - DNA, 20 bp, Artificial Sequence
  chemically synthesized
agacatagaagaattacttt

SEQ ID NO: 475034 - DNA, 20 bp, Artificial Sequence
  chemically synthesized
cttttgcaaaaagcacagaa

SEQ ID NO: 475035 - DNA, 20 bp, Artificial Sequence
  chemically synthesized
ttgaagcaaatgaaactaat

SEQ ID NO: 475036 - DNA, 20 bp, Artificial Sequence
  chemically synthesized
gacaaagcgtgttaaaatag

SEQ ID NO: 475037 - DNA, 20 bp, Artificial Sequence
  chemically synthesized
ctgatgagagcatgtagtat

SEQ ID NO: 475038 - DNA, 20 bp, Artificial Sequence
  chemically synthesized
tttccttagaaatctttaaa

SEQ ID NO: 475039 - DNA, 20 bp, Artificial Sequence
  chemically synthesized
attgatattatttcagaaca

SEQ ID NO: 475040 - DNA, 20 bp, Artificial Sequence
  chemically synthesized
ttttttcacatacataaaat

SEQ ID NO: 475041 - DNA, 20 bp, Artificial Sequence
  chemically synthesized
tatttgtttctcgaatgaat

SEQ ID NO: 475042 - DNA, 20 bp, Artificial Sequence
  chemically synthesized
ttggagtatttgtttctcga

SEQ ID NO: 475043 - DNA, 20 bp, Artificial Sequence
  chemically synthesized
caacttggagtatttgtttc

SEQ ID NO: 475044 - DNA, 20 bp, Artificial Sequence
  chemically synthesized
cgagaaacaaatactccaag

SEQ ID NO: 475045 - DNA, 20 bp, Artificial Sequence
  chemically synthesized
aaactccttgatatccaact

SEQ ID NO: 475046 - DNA, 20 bp, Artificial Sequence
  chemically synthesized
atactccaagttggatatca

SEQ ID NO: 475047 - DNA, 20 bp, Artificial Sequence
  chemically synthesized
tttcagttatcctttgttca

SEQ ID NO: 475048 - DNA, 20 bp, Artificial Sequence
  chemically synthesized
gcatttatatccactgaaca

SEQ ID NO: 475049 - DNA, 20 bp, Artificial Sequence
  chemically synthesized
aaatgctgtgctccttaata

SEQ ID NO: 475050 - DNA, 20 bp, Artificial Sequence
  chemically synthesized
actaaacagaaatctatttg

SEQ ID NO: 475051 - DNA, 20 bp, Artificial Sequence
  chemically synthesized
tttgtagggtttaaaacacc

SEQ ID NO: 475052 - DNA, 20 bp, Artificial Sequence
  chemically synthesized
ttgagaaatgcaaggataga

SEQ ID NO: 475053 - DNA, 20 bp, Artificial Sequence
  chemically synthesized
aaatagaatttgagaaatgc

SEQ ID NO: 475054 - DNA, 20 bp, Artificial Sequence
  chemically synthesized
cataggcagtgatttcaaaa

SEQ ID NO: 475055 - DNA, 20 bp, Artificial Sequence
  chemically synthesized
tcattttcataagatcatct

SEQ ID NO: 475056 - DNA, 20 bp, Artificial Sequence
  chemically synthesized
tatttacaccaaacagttta

SEQ ID NO: 475057 - DNA, 20 bp, Artificial Sequence
  chemically synthesized
tattattttatatgccagtt

SEQ ID NO: 475058 - DNA, 20 bp, Artificial Sequence
  chemically synthesized
ttatatgccagtttaggatg

SEQ ID NO: 475059 - DNA, 20 bp, Artificial Sequence
  chemically synthesized
tttaggatgatgaataagta

SEQ ID NO: 475060 - DNA, 20 bp, Artificial Sequence
  chemically synthesized
gatgaataagtaatgaatca

SEQ ID NO: 475061 - DNA, 20 bp, Artificial Sequence
  chemically synthesized
ggaaagaagtgaagaaggct

SEQ ID NO: 475062 - DNA, 20 bp, Artificial Sequence
  chemically synthesized
gtatgtcaataaagaaatga

SEQ ID NO: 475063 - DNA, 20 bp, Artificial Sequence
  chemically synthesized
tggggttactttagaagatg

SEQ ID NO: 475064 - DNA, 20 bp, Artificial Sequence
  chemically synthesized
cacctgagcgtttcttccca

SEQ ID NO: 475065 - DNA, 20 bp, Artificial Sequence
  chemically synthesized
gtggttatattaaaaaaatc

SEQ ID NO: 475066 - DNA, 20 bp, Artificial Sequence
  chemically synthesized
aatcgagggtatgaaaatct

SEQ ID NO: 475067 - DNA, 20 bp, Artificial Sequence
  chemically synthesized
caattttttcatttttatgt

SEQ ID NO: 475068 - DNA, 20 bp, Artificial Sequence
  chemically synthesized
tttttcatttttatgtgtga

SEQ ID NO: 475069 - DNA, 20 bp, Artificial Sequence
  chemically synthesized
gctacaaaacacagaaagtc

SEQ ID NO: 475070 - DNA, 20 bp, Artificial Sequence
  chemically synthesized
aaaacagcagcttgccatgt

SEQ ID NO: 475071 - DNA, 20 bp, Artificial Sequence
  chemically synthesized
tctttacaaccatccaccat

SEQ ID NO: 475072 - DNA, 20 bp, Artificial Sequence
  chemically synthesized
taaagaaatgcatccacatg

SEQ ID NO: 475073 - DNA, 20 bp, Artificial Sequence
  chemically synthesized
aatttgcagaatgtaaccta

SEQ ID NO: 475074 - DNA, 20 bp, Artificial Sequence
  chemically synthesized
tttgtccatgttcaaatttg

SEQ ID NO: 475075 - DNA, 20 bp, Artificial Sequence
  chemically synthesized
caagacatctgtgcagtgtt

SEQ ID NO: 475076 - DNA, 20 bp, Artificial Sequence
  chemically synthesized
agaaatcattcaccaggagg

SEQ ID NO: 475077 - DNA, 20 bp, Artificial Sequence
  chemically synthesized
cttcgacattcagcctcctg

SEQ ID NO: 475078 - DNA, 20 bp, Artificial Sequence
  chemically synthesized
caccaggaggctgaatgtcg

SEQ ID NO: 475079 - DNA, 20 bp, Artificial Sequence
  chemically synthesized
ttgtgatttcattatgacca

SEQ ID NO: 475080 - DNA, 20 bp, Artificial Sequence
  chemically synthesized
tacataggaggaaaggaggt

SEQ ID NO: 475081 - DNA, 20 bp, Artificial Sequence
  chemically synthesized
aaacaggagggagaagccta

SEQ ID NO: 475082 - DNA, 20 bp, Artificial Sequence
  chemically synthesized
atgaatgatcttcagatgaa

SEQ ID NO: 475083 - DNA, 20 bp, Artificial Sequence
  chemically synthesized
ttgaaagcatttaaccacag

SEQ ID NO: 475084 - DNA, 20 bp, Artificial Sequence
  chemically synthesized
ccatttatgcaattgatgca

SEQ ID NO: 475085 - DNA, 20 bp, Artificial Sequence
  chemically synthesized
aataggtatttgtcagtgca

SEQ ID NO: 475086 - DNA, 20 bp, Artificial Sequence
  chemically synthesized
aacattattatgaaacagag

SEQ ID NO: 475087 - DNA, 20 bp, Artificial Sequence
  chemically synthesized
tatttcattggtattttgcc

SEQ ID NO: 475088 - DNA, 20 bp, Artificial Sequence
  chemically synthesized
tttcaatagtaaggaaaatg

SEQ ID NO: 475089 - DNA, 20 bp, Artificial Sequence
  chemically synthesized
attcttccaggaatagtgcc

SEQ ID NO: 475090 - DNA, 20 bp, Artificial Sequence
  chemically synthesized
actctcggcactattcctgg

SEQ ID NO: 475091 - DNA, 20 bp, Artificial Sequence
  chemically synthesized
agcatggtggttattcttcc

SEQ ID NO: 475092 - DNA, 20 bp, Artificial Sequence
  chemically synthesized
ccaccatgcttagaaatccg

SEQ ID NO: 475093 - DNA, 20 bp, Artificial Sequence
  chemically synthesized
ccattgtttcccagaactct

SEQ ID NO: 475094 - DNA, 20 bp, Artificial Sequence
  chemically synthesized
gaaaaataatatgtataggc

SEQ ID NO: 475095 - DNA, 20 bp, Artificial Sequence
  chemically synthesized
tacttaaccattcgtatcag

SEQ ID NO: 475096 - DNA, 20 bp, Artificial Sequence
  chemically synthesized
ttgttctgtatccatctgat

SEQ ID NO: 475097 - DNA, 20 bp, Artificial Sequence
  chemically synthesized
caggcaatgaaaaattagaa

SEQ ID NO: 475098 - DNA, 20 bp, Artificial Sequence
  chemically synthesized
aaggtttaaaatggaaagac

SEQ ID NO: 475099 - DNA, 20 bp, Artificial Sequence
  chemically synthesized
gatgtattggaacatactgg

SEQ ID NO: 475100 - DNA, 20 bp, Artificial Sequence
  chemically synthesized
tcattctattaaagggacaa

SEQ ID NO: 475101 - DNA, 20 bp, Artificial Sequence
  chemically synthesized
gcacccttttgtccctttaa

SEQ ID NO: 475102 - DNA, 20 bp, Artificial Sequence
  chemically synthesized
ttcaaaaatcccaactttta

SEQ ID NO: 475103 - DNA, 20 bp, Artificial Sequence
  chemically synthesized
gaaggtaattctttaaaagt

SEQ ID NO: 475104 - DNA, 20 bp, Artificial Sequence
  chemically synthesized
gtcaattatagatggttgtc

SEQ ID NO: 475105 - DNA, 20 bp, Artificial Sequence
  chemically synthesized
tgtagctctttcttattaat

SEQ ID NO: 475106 - DNA, 20 bp, Artificial Sequence
  chemically synthesized
ggctaaacaggtgatttagg

SEQ ID NO: 475107 - DNA, 20 bp, Artificial Sequence
  chemically synthesized
tcacctgtttagccgaagtt

SEQ ID NO: 475108 - DNA, 20 bp, Artificial Sequence
  chemically synthesized
atgtaaatcaatttccactt

SEQ ID NO: 475109 - DNA, 20 bp, Artificial Sequence
  chemically synthesized
agtacttttgagaacctgta

SEQ ID NO: 475110 - DNA, 20 bp, Artificial Sequence
  chemically synthesized
tattattggaactttcactt

SEQ ID NO: 475111 - DNA, 20 bp, Artificial Sequence
  chemically synthesized
actacactaacaaacagtgc

SEQ ID NO: 475112 - DNA, 20 bp, Artificial Sequence
  chemically synthesized
agcaactctgtattgaatgt

SEQ ID NO: 475113 - DNA, 20 bp, Artificial Sequence
  chemically synthesized
ttgtacccatacattcaata

SEQ ID NO: 475114 - DNA, 20 bp, Artificial Sequence
  chemically synthesized
agatattcagcaactctgta

SEQ ID NO: 475115 - DNA, 20 bp, Artificial Sequence
  chemically synthesized
atacattcaatacagagttg

SEQ ID NO: 475116 - DNA, 20 bp, Artificial Sequence
  chemically synthesized
aatatcaatgttttttcaac

SEQ ID NO: 475117 - DNA, 20 bp, Artificial Sequence
  chemically synthesized
tactatacatatcttaaaat

SEQ ID NO: 475118 - DNA, 20 bp, Artificial Sequence
  chemically synthesized
aagatatgtatagtatactt

SEQ ID NO: 475119 - DNA, 20 bp, Artificial Sequence
  chemically synthesized
tacttggggataatgaaaat

SEQ ID NO: 475120 - DNA, 20 bp, Artificial Sequence
  chemically synthesized
gtaggcagaaaagataacta

SEQ ID NO: 475121 - DNA, 20 bp, Artificial Sequence
  chemically synthesized
ttgagtactgggcttaatat

SEQ ID NO: 475122 - DNA, 20 bp, Artificial Sequence
  chemically synthesized
aaaagtaatattattaatat

SEQ ID NO: 475123 - DNA, 20 bp, Artificial Sequence
  chemically synthesized
aattaattattttcatatgg

SEQ ID NO: 475124 - DNA, 20 bp, Artificial Sequence
  chemically synthesized
tacagcatggtcttgacatt

SEQ ID NO: 475125 - DNA, 20 bp, Artificial Sequence
  chemically synthesized
gtcttgacattaagagtttg

SEQ ID NO: 475126 - DNA, 20 bp, Artificial Sequence
  chemically synthesized
tttctgatacccaataatct

SEQ ID NO: 475127 - DNA, 20 bp, Artificial Sequence
  chemically synthesized
atgacataactcaaagatta

SEQ ID NO: 475128 - DNA, 20 bp, Artificial Sequence
  chemically synthesized
ccaacttcgtgaggcttttg

SEQ ID NO: 475129 - DNA, 20 bp, Artificial Sequence
  chemically synthesized
cagtttcctcatctgtaaaa

SEQ ID NO: 475130 - DNA, 20 bp, Artificial Sequence
  chemically synthesized
ccattgatagatatataacc

SEQ ID NO: 475131 - DNA, 20 bp, Artificial Sequence
  chemically synthesized
caaggttatatatctatcaa

SEQ ID NO: 475132 - DNA, 20 bp, Artificial Sequence
  chemically synthesized
gttatatatctatcaatgga

SEQ ID NO: 475133 - DNA, 20 bp, Artificial Sequence
  chemically synthesized
tatcaatggagtggattgat

SEQ ID NO: 475134 - DNA, 20 bp, Artificial Sequence
  chemically synthesized
atggagtggattgattagaa

SEQ ID NO: 475135 - DNA, 20 bp, Artificial Sequence
  chemically synthesized
gcatgtagtttgtaaaagaa

SEQ ID NO: 475136 - DNA, 20 bp, Artificial Sequence
  chemically synthesized
aggagtagcagttagactag

SEQ ID NO: 475137 - DNA, 20 bp, Artificial Sequence
  chemically synthesized
gttagactagaagggtgact

SEQ ID NO: 475138 - DNA, 20 bp, Artificial Sequence
  chemically synthesized
gaaatgaacatgccttggat

SEQ ID NO: 475139 - DNA, 20 bp, Artificial Sequence
  chemically synthesized
cttgtggaaatgaacatgcc

SEQ ID NO: 475140 - DNA, 20 bp, Artificial Sequence
  chemically synthesized
attaataccataaacaccaa

SEQ ID NO: 475141 - DNA, 20 bp, Artificial Sequence
  chemically synthesized
ttcattgatgacttaatgta

SEQ ID NO: 475142 - DNA, 20 bp, Artificial Sequence
  chemically synthesized
tgagcagagttcaagaactt

SEQ ID NO: 475143 - DNA, 20 bp, Artificial Sequence
  chemically synthesized
agataactgaatttcatgag

SEQ ID NO: 475144 - DNA, 20 bp, Artificial Sequence
  chemically synthesized
tcatgaaattcagttatctt

SEQ ID NO: 475145 - DNA, 20 bp, Artificial Sequence
  chemically synthesized
ctatgatattcaaaagataa

SEQ ID NO: 475146 - DNA, 20 bp, Artificial Sequence
  chemically synthesized
ttatttcattttatttgaga

SEQ ID NO: 475147 - DNA, 20 bp, Artificial Sequence
  chemically synthesized
ttcgttcttgttgcccaggc

SEQ ID NO: 475148 - DNA, 20 bp, Artificial Sequence
  chemically synthesized
ctcactgcaacctctgcctc

SEQ ID NO: 475149 - DNA, 20 bp, Artificial Sequence
  chemically synthesized
tactacggaggctgaggcag

SEQ ID NO: 475150 - DNA, 20 bp, Artificial Sequence
  chemically synthesized
ttttgtatttttagtagaga

SEQ ID NO: 475151 - DNA, 20 bp, Artificial Sequence
  chemically synthesized
ctatgttggccaggctggtc

SEQ ID NO: 475152 - DNA, 20 bp, Artificial Sequence
  chemically synthesized
tgggtggatcacctgaggtc

SEQ ID NO: 475153 - DNA, 20 bp, Artificial Sequence
  chemically synthesized
actttgagaggccgaggtgg

SEQ ID NO: 475154 - DNA, 20 bp, Artificial Sequence
  chemically synthesized
cagcactttgagaggccgag

SEQ ID NO: 475155 - DNA, 20 bp, Artificial Sequence
  chemically synthesized
acctcggcctctcaaagtgc

SEQ ID NO: 475156 - DNA, 20 bp, Artificial Sequence
  chemically synthesized
ttttctttttttttttgaga

SEQ ID NO: 475157 - DNA, 20 bp, Artificial Sequence
  chemically synthesized
tctggctctgttgcccaggc

SEQ ID NO: 475158 - DNA, 20 bp, Artificial Sequence
  chemically synthesized
ctcactgcgagcttcacctc

SEQ ID NO: 475159 - DNA, 20 bp, Artificial Sequence
  chemically synthesized
tactcgggaggctgaggcag

SEQ ID NO: 475160 - DNA, 20 bp, Artificial Sequence
  chemically synthesized
cattctcctgcctcagcctc

SEQ ID NO: 475161 - DNA, 20 bp, Artificial Sequence
  chemically synthesized
aaaattagccaggcgtggtg

SEQ ID NO: 475162 - DNA, 20 bp, Artificial Sequence
  chemically synthesized
tttttttttttaagtagaga

SEQ ID NO: 475163 - DNA, 20 bp, Artificial Sequence
  chemically synthesized
tggggtttcaccatgttagc

SEQ ID NO: 475164 - DNA, 20 bp, Artificial Sequence
  chemically synthesized
ggcggatggatcacgaggtc

SEQ ID NO: 475165 - DNA, 20 bp, Artificial Sequence
  chemically synthesized
actttgagaggccgaggcgg

SEQ ID NO: 475166 - DNA, 20 bp, Artificial Sequence
  chemically synthesized
cagcactttgagaggccgag

SEQ ID NO: 475167 - DNA, 20 bp, Artificial Sequence
  chemically synthesized
gcctcggcctctcaaagtgc

SEQ ID NO: 475168 - DNA, 20 bp, Artificial Sequence
  chemically synthesized
atttttaaaaataagataga

SEQ ID NO: 475169 - DNA, 20 bp, Artificial Sequence
  chemically synthesized
tggatgatttgagctgtacg

SEQ ID NO: 475170 - DNA, 20 bp, Artificial Sequence
  chemically synthesized
cagctaaataaaattatact

SEQ ID NO: 475171 - DNA, 20 bp, Artificial Sequence
  chemically synthesized
agtataattttatttagctg

SEQ ID NO: 475172 - DNA, 20 bp, Artificial Sequence
  chemically synthesized
taattttatttagctgaagg

SEQ ID NO: 475173 - DNA, 20 bp, Artificial Sequence
  chemically synthesized
ataaagtcaagagagagaac

SEQ ID NO: 475174 - DNA, 20 bp, Artificial Sequence
  chemically synthesized
cataatttaataaattttta

SEQ ID NO: 475175 - DNA, 20 bp, Artificial Sequence
  chemically synthesized
aaatttattaaattatgaaa

SEQ ID NO: 475176 - DNA, 20 bp, Artificial Sequence
  chemically synthesized
catgatgccttctctcatat

SEQ ID NO: 475177 - DNA, 20 bp, Artificial Sequence
  chemically synthesized
tatatgagagaaggcatcat

SEQ ID NO: 475178 - DNA, 20 bp, Artificial Sequence
  chemically synthesized
catcatgaggatctcagctt

SEQ ID NO: 475179 - DNA, 20 bp, Artificial Sequence
  chemically synthesized
aaatgcctgtcattgctaac

SEQ ID NO: 475180 - DNA, 20 bp, Artificial Sequence
  chemically synthesized
tttgctgtgctctgcacctg

SEQ ID NO: 475181 - DNA, 20 bp, Artificial Sequence
  chemically synthesized
agcaaagctgcatggctcac

SEQ ID NO: 475182 - DNA, 20 bp, Artificial Sequence
  chemically synthesized
ctgcatggctcactagagta

SEQ ID NO: 475183 - DNA, 20 bp, Artificial Sequence
  chemically synthesized
actgccccattggttactaa

SEQ ID NO: 475184 - DNA, 20 bp, Artificial Sequence
  chemically synthesized
taaaaaccacaaatgtttgt

SEQ ID NO: 475185 - DNA, 20 bp, Artificial Sequence
  chemically synthesized
tttttttttttaatttgaga

SEQ ID NO: 475186 - DNA, 20 bp, Artificial Sequence
  chemically synthesized
tcttgctttgttgcccacat

SEQ ID NO: 475187 - DNA, 20 bp, Artificial Sequence
  chemically synthesized
tcccagctacactgaggcat

SEQ ID NO: 475188 - DNA, 20 bp, Artificial Sequence
  chemically synthesized
ttctcatgcctcagtgtagc

SEQ ID NO: 475189 - DNA, 20 bp, Artificial Sequence
  chemically synthesized
actaaaaatacaaaaattag

SEQ ID NO: 475190 - DNA, 20 bp, Artificial Sequence
  chemically synthesized
actttgggaggccgaggcag

SEQ ID NO: 475191 - DNA, 20 bp, Artificial Sequence
  chemically synthesized
gcctcggcctcccaaagtgc

SEQ ID NO: 475192 - DNA, 20 bp, Artificial Sequence
  chemically synthesized
caaaaaaaagttcaaagagg

SEQ ID NO: 475193 - DNA, 20 bp, Artificial Sequence
  chemically synthesized
tattattatacttaaagttt

SEQ ID NO: 475194 - DNA, 20 bp, Artificial Sequence
  chemically synthesized
taacgctaaatgatgagtta

SEQ ID NO: 475195 - DNA, 20 bp, Artificial Sequence
  chemically synthesized
gatatacgtaacgctaaatg

SEQ ID NO: 475196 - DNA, 20 bp, Artificial Sequence
  chemically synthesized
ttggggttgggggagtgggg

SEQ ID NO: 475197 - DNA, 20 bp, Artificial Sequence
  chemically synthesized
ggggaatgttttggggttgg

SEQ ID NO: 475198 - DNA, 20 bp, Artificial Sequence
  chemically synthesized
tcacacaccggggaatgttt

SEQ ID NO: 475199 - DNA, 20 bp, Artificial Sequence
  chemically synthesized
aaggggaacatcacacaccg

SEQ ID NO: 475200 - DNA, 20 bp, Artificial Sequence
  chemically synthesized
tcattgttcaattcccacct

SEQ ID NO: 475201 - DNA, 20 bp, Artificial Sequence
  chemically synthesized
ccatgttctcactcataggt

SEQ ID NO: 475202 - DNA, 20 bp, Artificial Sequence
  chemically synthesized
cccacctatgagtgagaaca

SEQ ID NO: 475203 - DNA, 20 bp, Artificial Sequence
  chemically synthesized
ggtccttgtgatagtttgct

SEQ ID NO: 475204 - DNA, 20 bp, Artificial Sequence
  chemically synthesized
ttcatgtcctttgtagggac

SEQ ID NO: 475205 - DNA, 20 bp, Artificial Sequence
  chemically synthesized
tccatgtccctacaaaggac

SEQ ID NO: 475206 - DNA, 20 bp, Artificial Sequence
  chemically synthesized
ctatgcagccataaaaaatg

SEQ ID NO: 475207 - DNA, 20 bp, Artificial Sequence
  chemically synthesized
caaagagcacatatacacca

SEQ ID NO: 475208 - DNA, 20 bp, Artificial Sequence
  chemically synthesized
atacctttccttggatggga

SEQ ID NO: 475209 - DNA, 20 bp, Artificial Sequence
  chemically synthesized
aatgggctagatacctttcc

SEQ ID NO: 475210 - DNA, 20 bp, Artificial Sequence
  chemically synthesized
cagacattagaacatctgga

SEQ ID NO: 475211 - DNA, 20 bp, Artificial Sequence
  chemically synthesized
ctaatgtctgctccaaaatg

SEQ ID NO: 475212 - DNA, 20 bp, Artificial Sequence
  chemically synthesized
ccatgtgagcagctctagga

SEQ ID NO: 475213 - DNA, 20 bp, Artificial Sequence
  chemically synthesized
gtataccatgtgagcagctc

SEQ ID NO: 475214 - DNA, 20 bp, Artificial Sequence
  chemically synthesized
agagctgctcacatggtata

SEQ ID NO: 475215 - DNA, 20 bp, Artificial Sequence
  chemically synthesized
atcatagcacttttgcttaa

SEQ ID NO: 475216 - DNA, 20 bp, Artificial Sequence
  chemically synthesized
aacccccattgtagtaaagg

SEQ ID NO: 475217 - DNA, 20 bp, Artificial Sequence
  chemically synthesized
aacccctcctttactacaat

SEQ ID NO: 475218 - DNA, 20 bp, Artificial Sequence
  chemically synthesized
tttatatctgcattgcactt

SEQ ID NO: 475219 - DNA, 20 bp, Artificial Sequence
  chemically synthesized
tcatgattgtattagggccc

SEQ ID NO: 475220 - DNA, 20 bp, Artificial Sequence
  chemically synthesized
agttttgtttacttaatggg

SEQ ID NO: 475221 - DNA, 20 bp, Artificial Sequence
  chemically synthesized
cccattaagtaaacaaaact

SEQ ID NO: 475222 - DNA, 20 bp, Artificial Sequence
  chemically synthesized
ggcaccagaaaacacctaaa

SEQ ID NO: 475223 - DNA, 20 bp, Artificial Sequence
  chemically synthesized
tatctatctcaaaaaaataa

SEQ ID NO: 475224 - DNA, 20 bp, Artificial Sequence
  chemically synthesized
atttatttttttgagataga

SEQ ID NO: 475225 - DNA, 20 bp, Artificial Sequence
  chemically synthesized
ctcactgcaacctctgcctt

SEQ ID NO: 475226 - DNA, 20 bp, Artificial Sequence
  chemically synthesized
gattgtcctgcctcagcctc

SEQ ID NO: 475227 - DNA, 20 bp, Artificial Sequence
  chemically synthesized
gcctcagcctcccgagtagc

SEQ ID NO: 475228 - DNA, 20 bp, Artificial Sequence
  chemically synthesized
tttgtattttttagtagaga

SEQ ID NO: 475229 - DNA, 20 bp, Artificial Sequence
  chemically synthesized
ctggtcttgaacgtctgacc

SEQ ID NO: 475230 - DNA, 20 bp, Artificial Sequence
  chemically synthesized
acctcagcctcccaaagtgc

SEQ ID NO: 475231 - DNA, 20 bp, Artificial Sequence
  chemically synthesized
aaagtgccaggattatagac

SEQ ID NO: 475232 - DNA, 20 bp, Artificial Sequence
  chemically synthesized
agtttaaagcattgcattgc

SEQ ID NO: 475233 - DNA, 20 bp, Artificial Sequence
  chemically synthesized
atgtgcatattttgtggtca

SEQ ID NO: 475234 - DNA, 20 bp, Artificial Sequence
  chemically synthesized
ggtaccgagttctataataa

SEQ ID NO: 475235 - DNA, 20 bp, Artificial Sequence
  chemically synthesized
ttatatcatacctagtggta

SEQ ID NO: 475236 - DNA, 20 bp, Artificial Sequence
  chemically synthesized
tataaatggttactgagaaa

SEQ ID NO: 475237 - DNA, 20 bp, Artificial Sequence
  chemically synthesized
aaatagttgcacagtattta

SEQ ID NO: 475238 - DNA, 20 bp, Artificial Sequence
  chemically synthesized
tactatcataattttacatg

SEQ ID NO: 475239 - DNA, 20 bp, Artificial Sequence
  chemically synthesized
cataattttacatgttgggt

SEQ ID NO: 475240 - DNA, 20 bp, Artificial Sequence
  chemically synthesized
catgttgggtaagaatttcc

SEQ ID NO: 475241 - DNA, 20 bp, Artificial Sequence
  chemically synthesized
acaggaggccaaattgtaca

SEQ ID NO: 475242 - DNA, 20 bp, Artificial Sequence
  chemically synthesized
ctctccctttctcttatagt

SEQ ID NO: 475243 - DNA, 20 bp, Artificial Sequence
  chemically synthesized
agttggaatgaaacagagga

SEQ ID NO: 475244 - DNA, 20 bp, Artificial Sequence
  chemically synthesized
tttgacctacattacatttt

SEQ ID NO: 475245 - DNA, 20 bp, Artificial Sequence
  chemically synthesized
tacattacattttgagagtt

SEQ ID NO: 475246 - DNA, 20 bp, Artificial Sequence
  chemically synthesized
atatttatatatttatgaga

SEQ ID NO: 475247 - DNA, 20 bp, Artificial Sequence
  chemically synthesized
cttcactccagcctgagtga

SEQ ID NO: 475248 - DNA, 20 bp, Artificial Sequence
  chemically synthesized
tctcactctgtcactcaggc

SEQ ID NO: 475249 - DNA, 20 bp, Artificial Sequence
  chemically synthesized
tcgcaccacttcactccagc

SEQ ID NO: 475250 - DNA, 20 bp, Artificial Sequence
  chemically synthesized
tacttgggaggctgatgtgg

SEQ ID NO: 475251 - DNA, 20 bp, Artificial Sequence
  chemically synthesized
tttttttttttcagtagaga

SEQ ID NO: 475252 - DNA, 20 bp, Artificial Sequence
  chemically synthesized
cagggggatcacttgaggtc

SEQ ID NO: 475253 - DNA, 20 bp, Artificial Sequence
  chemically synthesized
actttgggaggccgaagcag

SEQ ID NO: 475254 - DNA, 20 bp, Artificial Sequence
  chemically synthesized
gcttcggcctcccaaagtgt

SEQ ID NO: 475255 - DNA, 20 bp, Artificial Sequence
  chemically synthesized
cacagaaaaagttatcgggg

SEQ ID NO: 475256 - DNA, 20 bp, Artificial Sequence
  chemically synthesized
ccttacacagaaaaagttat

SEQ ID NO: 475257 - DNA, 20 bp, Artificial Sequence
  chemically synthesized
aacatgctctgtgaacttat

SEQ ID NO: 475258 - DNA, 20 bp, Artificial Sequence
  chemically synthesized
atcattgtaagtaaggaata

SEQ ID NO: 475259 - DNA, 20 bp, Artificial Sequence
  chemically synthesized
gtgaacaatcattgtaagta

SEQ ID NO: 475260 - DNA, 20 bp, Artificial Sequence
  chemically synthesized
tagagaagtttctttactac

SEQ ID NO: 475261 - DNA, 20 bp, Artificial Sequence
  chemically synthesized
acagcagaagcatggcaatg

SEQ ID NO: 475262 - DNA, 20 bp, Artificial Sequence
  chemically synthesized
cgctatgttcaaaagtacaa

SEQ ID NO: 475263 - DNA, 20 bp, Artificial Sequence
  chemically synthesized
caaaagagaacttattgtag

SEQ ID NO: 475264 - DNA, 20 bp, Artificial Sequence
  chemically synthesized
cattttggacttaaaaggaa

SEQ ID NO: 475265 - DNA, 20 bp, Artificial Sequence
  chemically synthesized
caacctcctttctctacaaa

SEQ ID NO: 475266 - DNA, 20 bp, Artificial Sequence
  chemically synthesized
tgtatgttgtctataaatta

SEQ ID NO: 475267 - DNA, 20 bp, Artificial Sequence
  chemically synthesized
taactcaaaaaacaaacaaa

SEQ ID NO: 475268 - DNA, 20 bp, Artificial Sequence
  chemically synthesized
agactctttttgtttgtttt

SEQ ID NO: 475269 - DNA, 20 bp, Artificial Sequence
  chemically synthesized
tttttgtttgttttttgagt

SEQ ID NO: 475270 - DNA, 20 bp, Artificial Sequence
  chemically synthesized
agtctcactgtcacccaggc

SEQ ID NO: 475271 - DNA, 20 bp, Artificial Sequence
  chemically synthesized
tcgtgccactgcactccagc

SEQ ID NO: 475272 - DNA, 20 bp, Artificial Sequence
  chemically synthesized
ctcactgtaaccttggcctc

SEQ ID NO: 475273 - DNA, 20 bp, Artificial Sequence
  chemically synthesized
tactcgggaggctgaggcag

SEQ ID NO: 475274 - DNA, 20 bp, Artificial Sequence
  chemically synthesized
tattctcctgcctcagcctc

SEQ ID NO: 475275 - DNA, 20 bp, Artificial Sequence
  chemically synthesized
actaaaagtacaaaaattag

SEQ ID NO: 475276 - DNA, 20 bp, Artificial Sequence
  chemically synthesized
ttttgtacttttagtagaga

SEQ ID NO: 475277 - DNA, 20 bp, Artificial Sequence
  chemically synthesized
cagggggatcacttgaggtc

SEQ ID NO: 475278 - DNA, 20 bp, Artificial Sequence
  chemically synthesized
cagatcatctctggaggcag

SEQ ID NO: 475279 - DNA, 20 bp, Artificial Sequence
  chemically synthesized
acctccctaagtgctgggat

SEQ ID NO: 475280 - DNA, 20 bp, Artificial Sequence
  chemically synthesized
gcctcgacctccctaagtgc

SEQ ID NO: 475281 - DNA, 20 bp, Artificial Sequence
  chemically synthesized
acttagggaggtcgaggcgg

SEQ ID NO: 475282 - DNA, 20 bp, Artificial Sequence
  chemically synthesized
cgggcgagtcacctgaggtc

SEQ ID NO: 475283 - DNA, 20 bp, Artificial Sequence
  chemically synthesized
ttttgtatttttagtagaga

SEQ ID NO: 475284 - DNA, 20 bp, Artificial Sequence
  chemically synthesized
gattcttctgcctcagcctc

SEQ ID NO: 475285 - DNA, 20 bp, Artificial Sequence
  chemically synthesized
tactcgggaggctgaggcag

SEQ ID NO: 475286 - DNA, 20 bp, Artificial Sequence
  chemically synthesized
ctcactgtaacctccacctc

SEQ ID NO: 475287 - DNA, 20 bp, Artificial Sequence
  chemically synthesized
tcgcaccactacattccagc

SEQ ID NO: 475288 - DNA, 20 bp, Artificial Sequence
  chemically synthesized
tctcgctctgtcacccaggc

SEQ ID NO: 475289 - DNA, 20 bp, Artificial Sequence
  chemically synthesized
tttttttttttttttgagac

SEQ ID NO: 475290 - DNA, 20 bp, Artificial Sequence
  chemically synthesized
aaaaaaaaaaaagagagaga

SEQ ID NO: 475291 - DNA, 20 bp, Artificial Sequence
  chemically synthesized
aaagagagagagagagttga

SEQ ID NO: 475292 - DNA, 20 bp, Artificial Sequence
  chemically synthesized
cttgtaaaattcccaggtaa

SEQ ID NO: 475293 - DNA, 20 bp, Artificial Sequence
  chemically synthesized
agagaattactcttttacct

SEQ ID NO: 475294 - DNA, 20 bp, Artificial Sequence
  chemically synthesized
ttgcacaaagatgttttaca

SEQ ID NO: 475295 - DNA, 20 bp, Artificial Sequence
  chemically synthesized
tacatacccaactgaaaatt

SEQ ID NO: 475296 - DNA, 20 bp, Artificial Sequence
  chemically synthesized
atagaactcataattttcag

SEQ ID NO: 475297 - DNA, 20 bp, Artificial Sequence
  chemically synthesized
gtatgtagatgcctgaagga

SEQ ID NO: 475298 - DNA, 20 bp, Artificial Sequence
  chemically synthesized
ttctggtgaaggaactatca

SEQ ID NO: 475299 - DNA, 20 bp, Artificial Sequence
  chemically synthesized
ttcagctccagccaacacat

SEQ ID NO: 475300 - DNA, 20 bp, Artificial Sequence
  chemically synthesized
ttggaccatgtggtgacaac

SEQ ID NO: 475301 - DNA, 20 bp, Artificial Sequence
  chemically synthesized
ggacttcggacttagtgaag

SEQ ID NO: 475302 - DNA, 20 bp, Artificial Sequence
  chemically synthesized
acagtttgtcctattagcag

SEQ ID NO: 475303 - DNA, 20 bp, Artificial Sequence
  chemically synthesized
agtaaggaaaatgtaaacgt

SEQ ID NO: 475304 - DNA, 20 bp, Artificial Sequence
  chemically synthesized
acgtttacattttccttact

SEQ ID NO: 475305 - DNA, 20 bp, Artificial Sequence
  chemically synthesized
gtgttacagtggagcttact

SEQ ID NO: 475306 - DNA, 20 bp, Artificial Sequence
  chemically synthesized
tcttcatgcatctggggagg

SEQ ID NO: 475307 - DNA, 20 bp, Artificial Sequence
  chemically synthesized
agcttcttcatgcatctggg

SEQ ID NO: 475308 - DNA, 20 bp, Artificial Sequence
  chemically synthesized
gacaaatatttgaaagaatc

SEQ ID NO: 475309 - DNA, 20 bp, Artificial Sequence
  chemically synthesized
gttatatgacaaatatttga

SEQ ID NO: 475310 - DNA, 20 bp, Artificial Sequence
  chemically synthesized
aagagattaatggaacattt

SEQ ID NO: 475311 - DNA, 20 bp, Artificial Sequence
  chemically synthesized
gctttatatgaaaaacaaat

SEQ ID NO: 475312 - DNA, 20 bp, Artificial Sequence
  chemically synthesized
aaaataagattataacagac

SEQ ID NO: 475313 - DNA, 20 bp, Artificial Sequence
  chemically synthesized
cagtctgttataatcttatt

SEQ ID NO: 475314 - DNA, 20 bp, Artificial Sequence
  chemically synthesized
aatgacacaaaggtgagaat

SEQ ID NO: 475315 - DNA, 20 bp, Artificial Sequence
  chemically synthesized
ttttcaaatgacacaaaggt

SEQ ID NO: 475316 - DNA, 20 bp, Artificial Sequence
  chemically synthesized
tctagaaaaatgacaaaaat

SEQ ID NO: 475317 - DNA, 20 bp, Artificial Sequence
  chemically synthesized
tttagggggcactatttatg

SEQ ID NO: 475318 - DNA, 20 bp, Artificial Sequence
  chemically synthesized
ggttgtgaaatgaagtagaa

SEQ ID NO: 475319 - DNA, 20 bp, Artificial Sequence
  chemically synthesized
tttgtggtgctaaccacaga

SEQ ID NO: 475320 - DNA, 20 bp, Artificial Sequence
  chemically synthesized
gtgttttgtggtgctaacca

SEQ ID NO: 475321 - DNA, 20 bp, Artificial Sequence
  chemically synthesized
ttcaataaccatgcccaagg

SEQ ID NO: 475322 - DNA, 20 bp, Artificial Sequence
  chemically synthesized
tcacaatcttattaaactac

SEQ ID NO: 475323 - DNA, 20 bp, Artificial Sequence
  chemically synthesized
gttatgctgcagcagtgtat

SEQ ID NO: 475324 - DNA, 20 bp, Artificial Sequence
  chemically synthesized
aactttacaacatgactcta

SEQ ID NO: 475325 - DNA, 20 bp, Artificial Sequence
  chemically synthesized
ttttagactttaatattcac

SEQ ID NO: 475326 - DNA, 20 bp, Artificial Sequence
  chemically synthesized
tttattattattttttgaga

SEQ ID NO: 475327 - DNA, 20 bp, Artificial Sequence
  chemically synthesized
ctgcactccagcctgggcaa

SEQ ID NO: 475328 - DNA, 20 bp, Artificial Sequence
  chemically synthesized
tttcactctgttgcccaggc

SEQ ID NO: 475329 - DNA, 20 bp, Artificial Sequence
  chemically synthesized
ctcactgcaaccttagcccc

SEQ ID NO: 475330 - DNA, 20 bp, Artificial Sequence
  chemically synthesized
tacttgggaggctgaggcag

SEQ ID NO: 475331 - DNA, 20 bp, Artificial Sequence
  chemically synthesized
gcctcagcctcccaagtagc

SEQ ID NO: 475332 - DNA, 20 bp, Artificial Sequence
  chemically synthesized
ctgaatacaaaaaaaactag

SEQ ID NO: 475333 - DNA, 20 bp, Artificial Sequence
  chemically synthesized
ttttttgtattcagtagaga

SEQ ID NO: 475334 - DNA, 20 bp, Artificial Sequence
  chemically synthesized
atgacgaaaccctgtctcta

SEQ ID NO: 475335 - DNA, 20 bp, Artificial Sequence
  chemically synthesized
tgggtagatcatttgatgtc

SEQ ID NO: 475336 - DNA, 20 bp, Artificial Sequence
  chemically synthesized
cagcactttgggaggccgag

SEQ ID NO: 475337 - DNA, 20 bp, Artificial Sequence
  chemically synthesized
acctcggcctcccaaagtgc

SEQ ID NO: 475338 - DNA, 20 bp, Artificial Sequence
  chemically synthesized
aaaaactataaatctggggg

SEQ ID NO: 475339 - DNA, 20 bp, Artificial Sequence
  chemically synthesized
tctttgaggaaaaatgattt

SEQ ID NO: 475340 - DNA, 20 bp, Artificial Sequence
  chemically synthesized
tcaaaaatcatttttcctca

SEQ ID NO: 475341 - DNA, 20 bp, Artificial Sequence
  chemically synthesized
atcatttttcctcaaagagt

SEQ ID NO: 475342 - DNA, 20 bp, Artificial Sequence
  chemically synthesized
tcatttaattgaacatgtag

SEQ ID NO: 475343 - DNA, 20 bp, Artificial Sequence
  chemically synthesized
gatgagcggaagaaatgtaa

SEQ ID NO: 475344 - DNA, 20 bp, Artificial Sequence
  chemically synthesized
catattttcttttataatat

SEQ ID NO: 475345 - DNA, 20 bp, Artificial Sequence
  chemically synthesized
taaaagaaaatatgaaaaac

SEQ ID NO: 475346 - DNA, 20 bp, Artificial Sequence
  chemically synthesized
tcagtagctccttaagaagc

SEQ ID NO: 475347 - DNA, 20 bp, Artificial Sequence
  chemically synthesized
ttaagaagctggaattttaa

SEQ ID NO: 475348 - DNA, 20 bp, Artificial Sequence
  chemically synthesized
cacatctattggttttcccc

SEQ ID NO: 475349 - DNA, 20 bp, Artificial Sequence
  chemically synthesized
agagagaaatttattttcag

SEQ ID NO: 475350 - DNA, 20 bp, Artificial Sequence
  chemically synthesized
tttatatctaaggtgctgca

SEQ ID NO: 475351 - DNA, 20 bp, Artificial Sequence
  chemically synthesized
gttttctaccagcaaaagac

SEQ ID NO: 475352 - DNA, 20 bp, Artificial Sequence
  chemically synthesized
gacaagaatttttgaagaca

SEQ ID NO: 475353 - DNA, 20 bp, Artificial Sequence
  chemically synthesized
tagcacagaagtgttataac

SEQ ID NO: 475354 - DNA, 20 bp, Artificial Sequence
  chemically synthesized
gcctttctgagccgctatta

SEQ ID NO: 475355 - DNA, 20 bp, Artificial Sequence
  chemically synthesized
attccaaactgtttctctta

SEQ ID NO: 475356 - DNA, 20 bp, Artificial Sequence
  chemically synthesized
actctttaagagaaacagtt

SEQ ID NO: 475357 - DNA, 20 bp, Artificial Sequence
  chemically synthesized
tggatacaatacaaggaagc

SEQ ID NO: 475358 - DNA, 20 bp, Artificial Sequence
  chemically synthesized
gtttttttccatttggaagt

SEQ ID NO: 475359 - DNA, 20 bp, Artificial Sequence
  chemically synthesized
acttgcatatagaatgaagc

SEQ ID NO: 475360 - DNA, 20 bp, Artificial Sequence
  chemically synthesized
actggagaataacttgcata

SEQ ID NO: 475361 - DNA, 20 bp, Artificial Sequence
  chemically synthesized
tatatgcaagttattctcca

SEQ ID NO: 475362 - DNA, 20 bp, Artificial Sequence
  chemically synthesized
caacctttgtttactcactg

SEQ ID NO: 475363 - DNA, 20 bp, Artificial Sequence
  chemically synthesized
aataaaataagtttgggagt

SEQ ID NO: 475364 - DNA, 20 bp, Artificial Sequence
  chemically synthesized
atgattaataaaataagttt

SEQ ID NO: 475365 - DNA, 20 bp, Artificial Sequence
  chemically synthesized
gcaattaaaaggacaactgt

SEQ ID NO: 475366 - DNA, 20 bp, Artificial Sequence
  chemically synthesized
tgtccttttaattgctctgc

SEQ ID NO: 475367 - DNA, 20 bp, Artificial Sequence
  chemically synthesized
aatttgttgattttagatgg

SEQ ID NO: 475368 - DNA, 20 bp, Artificial Sequence
  chemically synthesized
gaagacgactggggtaaata

SEQ ID NO: 475369 - DNA, 20 bp, Artificial Sequence
  chemically synthesized
acagcaatctggaagacgac

SEQ ID NO: 475370 - DNA, 20 bp, Artificial Sequence
  chemically synthesized
aaatgttcctttaagaaata

SEQ ID NO: 475371 - DNA, 20 bp, Artificial Sequence
  chemically synthesized
aagaaatacagagttactcc

SEQ ID NO: 475372 - DNA, 20 bp, Artificial Sequence
  chemically synthesized
tggcaggtagtggtcattcc

SEQ ID NO: 475373 - DNA, 20 bp, Artificial Sequence
  chemically synthesized
accactacctgccattacta

SEQ ID NO: 475374 - DNA, 20 bp, Artificial Sequence
  chemically synthesized
attactatggagtccagagg

SEQ ID NO: 475375 - DNA, 20 bp, Artificial Sequence
  chemically synthesized
aggtagggtcaggtacaggc

SEQ ID NO: 475376 - DNA, 20 bp, Artificial Sequence
  chemically synthesized
aatttcatttgcttctaatc

SEQ ID NO: 475377 - DNA, 20 bp, Artificial Sequence
  chemically synthesized
caagagtctggtaaattagg

SEQ ID NO: 475378 - DNA, 20 bp, Artificial Sequence
  chemically synthesized
atgagactttggctacgatg

SEQ ID NO: 475379 - DNA, 20 bp, Artificial Sequence
  chemically synthesized
caaagtctcatgagacaagg

SEQ ID NO: 475380 - DNA, 20 bp, Artificial Sequence
  chemically synthesized
ttatccataattgacttttc

SEQ ID NO: 475381 - DNA, 20 bp, Artificial Sequence
  chemically synthesized
tgattcatgaaaagtcaatt

SEQ ID NO: 475382 - DNA, 20 bp, Artificial Sequence
  chemically synthesized
aagcagaaccaggaatgagg

SEQ ID NO: 475383 - DNA, 20 bp, Artificial Sequence
  chemically synthesized
gctgtttgccaagcagaacc

SEQ ID NO: 475384 - DNA, 20 bp, Artificial Sequence
  chemically synthesized
tgtaataagagaatgggagg

SEQ ID NO: 475385 - DNA, 20 bp, Artificial Sequence
  chemically synthesized
tcctcccattctcttattac

SEQ ID NO: 475386 - DNA, 20 bp, Artificial Sequence
  chemically synthesized
tttgcaaacccttgtaataa

SEQ ID NO: 475387 - DNA, 20 bp, Artificial Sequence
  chemically synthesized
tcaccgcactttgtaatcct

SEQ ID NO: 475388 - DNA, 20 bp, Artificial Sequence
  chemically synthesized
cagcatttgttgaaaatccc

SEQ ID NO: 475389 - DNA, 20 bp, Artificial Sequence
  chemically synthesized
ttggagcccacccccagaga

SEQ ID NO: 475390 - DNA, 20 bp, Artificial Sequence
  chemically synthesized
ctcagaccaattcaatctct

SEQ ID NO: 475391 - DNA, 20 bp, Artificial Sequence
  chemically synthesized
ggagctttataagctgccca

SEQ ID NO: 475392 - DNA, 20 bp, Artificial Sequence
  chemically synthesized
ctaaagcgcagaccacatat

SEQ ID NO: 475393 - DNA, 20 bp, Artificial Sequence
  chemically synthesized
gcgctttaggcctgtcaagg

SEQ ID NO: 475394 - DNA, 20 bp, Artificial Sequence
  chemically synthesized
tttatttcctgatcagttaa

SEQ ID NO: 475395 - DNA, 20 bp, Artificial Sequence
  chemically synthesized
taaattccattacaggtcct

SEQ ID NO: 475396 - DNA, 20 bp, Artificial Sequence
  chemically synthesized
catactcaaaggacctgtaa

SEQ ID NO: 475397 - DNA, 20 bp, Artificial Sequence
  chemically synthesized
aaatatctcaacatagatag

SEQ ID NO: 475398 - DNA, 20 bp, Artificial Sequence
  chemically synthesized
aaccatttgcctcaagcctc

SEQ ID NO: 475399 - DNA, 20 bp, Artificial Sequence
  chemically synthesized
ggcaaatggttattttaatt

SEQ ID NO: 475400 - DNA, 20 bp, Artificial Sequence
  chemically synthesized
aggctgtgctgtcctagaat

SEQ ID NO: 475401 - DNA, 20 bp, Artificial Sequence
  chemically synthesized
agatgaaggctgtgctgtcc

SEQ ID NO: 475402 - DNA, 20 bp, Artificial Sequence
  chemically synthesized
atatatagtagtagcagtct

SEQ ID NO: 475403 - DNA, 20 bp, Artificial Sequence
  chemically synthesized
atatatctctgtgaaccttg

SEQ ID NO: 475404 - DNA, 20 bp, Artificial Sequence
  chemically synthesized
tgtttttgctgagggaaata

SEQ ID NO: 475405 - DNA, 20 bp, Artificial Sequence
  chemically synthesized
gagggaaatagtggattgca

SEQ ID NO: 475406 - DNA, 20 bp, Artificial Sequence
  chemically synthesized
gattgcaatgaatatcccta

SEQ ID NO: 475407 - DNA, 20 bp, Artificial Sequence
  chemically synthesized
ttttactaatgagatcctat

SEQ ID NO: 475408 - DNA, 20 bp, Artificial Sequence
  chemically synthesized
atttaagacaatcaagatac

SEQ ID NO: 475409 - DNA, 20 bp, Artificial Sequence
  chemically synthesized
atcctgtttatgcaatgtta

SEQ ID NO: 475410 - DNA, 20 bp, Artificial Sequence
  chemically synthesized
atcccctaacattgcataaa

SEQ ID NO: 475411 - DNA, 20 bp, Artificial Sequence
  chemically synthesized
acattgcataaacaggatat

SEQ ID NO: 475412 - DNA, 20 bp, Artificial Sequence
  chemically synthesized
agcccaagcaacaggttttg

SEQ ID NO: 475413 - DNA, 20 bp, Artificial Sequence
  chemically synthesized
aattcttcctaagccaatgg

SEQ ID NO: 475414 - DNA, 20 bp, Artificial Sequence
  chemically synthesized
tatccaaccattggcttagg

SEQ ID NO: 475415 - DNA, 20 bp, Artificial Sequence
  chemically synthesized
tagatttggcatcaggtcac

SEQ ID NO: 475416 - DNA, 20 bp, Artificial Sequence
  chemically synthesized
gatgccaaatctaaaggtaa

SEQ ID NO: 475417 - DNA, 20 bp, Artificial Sequence
  chemically synthesized
tctacaatttttatgaagtg

SEQ ID NO: 475418 - DNA, 20 bp, Artificial Sequence
  chemically synthesized
agatgtgtttgaggtggatg

SEQ ID NO: 475419 - DNA, 20 bp, Artificial Sequence
  chemically synthesized
gaaccacagatgtgtttgag

SEQ ID NO: 475420 - DNA, 20 bp, Artificial Sequence
  chemically synthesized
cctgctgtgaactgacctaa

SEQ ID NO: 475421 - DNA, 20 bp, Artificial Sequence
  chemically synthesized
ttaggtcagttcacagcagg

SEQ ID NO: 475422 - DNA, 20 bp, Artificial Sequence
  chemically synthesized
atgagcggtaagtaaatatt

SEQ ID NO: 475423 - DNA, 20 bp, Artificial Sequence
  chemically synthesized
taagtaaatatttggggtaa

SEQ ID NO: 475424 - DNA, 20 bp, Artificial Sequence
  chemically synthesized
tttctaatctcctcatttat

SEQ ID NO: 475425 - DNA, 20 bp, Artificial Sequence
  chemically synthesized
gtggacagagtagctgaaag

SEQ ID NO: 475426 - DNA, 20 bp, Artificial Sequence
  chemically synthesized
tttgtctttgaataagtgga

SEQ ID NO: 475427 - DNA, 20 bp, Artificial Sequence
  chemically synthesized
gtttcctttcaagtttgtct

SEQ ID NO: 475428 - DNA, 20 bp, Artificial Sequence
  chemically synthesized
tttcatttagcttgcattcc

SEQ ID NO: 475429 - DNA, 20 bp, Artificial Sequence
  chemically synthesized
ttggaacaaatgaacattcc

SEQ ID NO: 475430 - DNA, 20 bp, Artificial Sequence
  chemically synthesized
caagcaacattagaaattaa

SEQ ID NO: 475431 - DNA, 20 bp, Artificial Sequence
  chemically synthesized
agaaattaatggggtaagtg

SEQ ID NO: 475432 - DNA, 20 bp, Artificial Sequence
  chemically synthesized
attaatggggtaagtgctgg

SEQ ID NO: 475433 - DNA, 20 bp, Artificial Sequence
  chemically synthesized
tcggtataaaggctgctttc

SEQ ID NO: 475434 - DNA, 20 bp, Artificial Sequence
  chemically synthesized
tttttcttttttttttgaga

SEQ ID NO: 475435 - DNA, 20 bp, Artificial Sequence
  chemically synthesized
gtctcgctctgtcgccaggc

SEQ ID NO: 475436 - DNA, 20 bp, Artificial Sequence
  chemically synthesized
tactcgggaggctgaggcag

SEQ ID NO: 475437 - DNA, 20 bp, Artificial Sequence
  chemically synthesized
gattctcctgcctcagcctc

SEQ ID NO: 475438 - DNA, 20 bp, Artificial Sequence
  chemically synthesized
cctcccgagtagctgggact

SEQ ID NO: 475439 - DNA, 20 bp, Artificial Sequence
  chemically synthesized
tttttgtatttttagtagag

SEQ ID NO: 475440 - DNA, 20 bp, Artificial Sequence
  chemically synthesized
acgagtttcaccatgttggc

SEQ ID NO: 475441 - DNA, 20 bp, Artificial Sequence
  chemically synthesized
agtcctgtttcatttgaagt

SEQ ID NO: 475442 - DNA, 20 bp, Artificial Sequence
  chemically synthesized
agtactaatgactgcagggg

SEQ ID NO: 475443 - DNA, 20 bp, Artificial Sequence
  chemically synthesized
cattgcactctagcctggac

SEQ ID NO: 475444 - DNA, 20 bp, Artificial Sequence
  chemically synthesized
ttcactattcttgtccaggc

SEQ ID NO: 475445 - DNA, 20 bp, Artificial Sequence
  chemically synthesized
tccaggctagagtgcaatgg

SEQ ID NO: 475446 - DNA, 20 bp, Artificial Sequence
  chemically synthesized
ctcactgcaacctctgcctc

SEQ ID NO: 475447 - DNA, 20 bp, Artificial Sequence
  chemically synthesized
tactcaggaggctgaggcag

SEQ ID NO: 475448 - DNA, 20 bp, Artificial Sequence
  chemically synthesized
gattctcctgcctcagcctc

SEQ ID NO: 475449 - DNA, 20 bp, Artificial Sequence
  chemically synthesized
gcctcagcctcctgagtagc

SEQ ID NO: 475450 - DNA, 20 bp, Artificial Sequence
  chemically synthesized
aaaattagccgggcatggtg

SEQ ID NO: 475451 - DNA, 20 bp, Artificial Sequence
  chemically synthesized
ttttgtatttttagtagaga

SEQ ID NO: 475452 - DNA, 20 bp, Artificial Sequence
  chemically synthesized
tgggtggatcacctgaggtc

SEQ ID NO: 475453 - DNA, 20 bp, Artificial Sequence
  chemically synthesized
actttgggaggccacagtgg

SEQ ID NO: 475454 - DNA, 20 bp, Artificial Sequence
  chemically synthesized
cagcactttgggaggccaca

SEQ ID NO: 475455 - DNA, 20 bp, Artificial Sequence
  chemically synthesized
actgtggcctcccaaagtgc

SEQ ID NO: 475456 - DNA, 20 bp, Artificial Sequence
  chemically synthesized
cagatctctgcagaaacatg

SEQ ID NO: 475457 - DNA, 20 bp, Artificial Sequence
  chemically synthesized
aaaattaaaaaaaaaaaaaa

SEQ ID NO: 475458 - DNA, 20 bp, Artificial Sequence
  chemically synthesized
aaagaatgctggcttataaa

SEQ ID NO: 475459 - DNA, 20 bp, Artificial Sequence
  chemically synthesized
tggagtagattttctggaaa

SEQ ID NO: 475460 - DNA, 20 bp, Artificial Sequence
  chemically synthesized
aaatgaatgttttagtccgt

SEQ ID NO: 475461 - DNA, 20 bp, Artificial Sequence
  chemically synthesized
ctataacaaaatatcataaa

SEQ ID NO: 475462 - DNA, 20 bp, Artificial Sequence
  chemically synthesized
atatcagacttcctagcctt

SEQ ID NO: 475463 - DNA, 20 bp, Artificial Sequence
  chemically synthesized
aagcaggccttcaccaaaca

SEQ ID NO: 475464 - DNA, 20 bp, Artificial Sequence
  chemically synthesized
aaaaagggcaaagcagctct

SEQ ID NO: 475465 - DNA, 20 bp, Artificial Sequence
  chemically synthesized
gctctctgggtctcttttat

SEQ ID NO: 475466 - DNA, 20 bp, Artificial Sequence
  chemically synthesized
atcatgagggcagagcccac

SEQ ID NO: 475467 - DNA, 20 bp, Artificial Sequence
  chemically synthesized
cctcctaataccatcatata

SEQ ID NO: 475468 - DNA, 20 bp, Artificial Sequence
  chemically synthesized
atggaattaggtttccacat

SEQ ID NO: 475469 - DNA, 20 bp, Artificial Sequence
  chemically synthesized
gattgccttactgctgtggc

SEQ ID NO: 475470 - DNA, 20 bp, Artificial Sequence
  chemically synthesized
gatttaagtgtaatatacta

SEQ ID NO: 475471 - DNA, 20 bp, Artificial Sequence
  chemically synthesized
gtttttgctattggtgcgca

SEQ ID NO: 475472 - DNA, 20 bp, Artificial Sequence
  chemically synthesized
ctttcctaacctataaagca

SEQ ID NO: 475473 - DNA, 20 bp, Artificial Sequence
  chemically synthesized
gcccctctctttatttacga

SEQ ID NO: 475474 - DNA, 20 bp, Artificial Sequence
  chemically synthesized
acatctcaatgaaatcactt

SEQ ID NO: 475475 - DNA, 20 bp, Artificial Sequence
  chemically synthesized
cacttctctttggataaaat

SEQ ID NO: 475476 - DNA, 20 bp, Artificial Sequence
  chemically synthesized
gcatgttccaacacttctct

SEQ ID NO: 475477 - DNA, 20 bp, Artificial Sequence
  chemically synthesized
agattggtaactctcctcca

SEQ ID NO: 475478 - DNA, 20 bp, Artificial Sequence
  chemically synthesized
aggtcttgcattcattggag

SEQ ID NO: 475479 - DNA, 20 bp, Artificial Sequence
  chemically synthesized
aaaaacaaaaaacaaaaaaa

SEQ ID NO: 475480 - DNA, 20 bp, Artificial Sequence
  chemically synthesized
ttgttttttgtttttttcca

SEQ ID NO: 475481 - DNA, 20 bp, Artificial Sequence
  chemically synthesized
ctgcactccggcctgggcca

SEQ ID NO: 475482 - DNA, 20 bp, Artificial Sequence
  chemically synthesized
tctcactctgtggcccaggc

SEQ ID NO: 475483 - DNA, 20 bp, Artificial Sequence
  chemically synthesized
ctcacggcaacttccgcctc

SEQ ID NO: 475484 - DNA, 20 bp, Artificial Sequence
  chemically synthesized
tactggggaggctgaggcag

SEQ ID NO: 475485 - DNA, 20 bp, Artificial Sequence
  chemically synthesized
caggtggatcacttgaggcc

SEQ ID NO: 475486 - DNA, 20 bp, Artificial Sequence
  chemically synthesized
actttgggaggccaaggcag

SEQ ID NO: 475487 - DNA, 20 bp, Artificial Sequence
  chemically synthesized
gccttggcctcccaaagtgc

SEQ ID NO: 475488 - DNA, 20 bp, Artificial Sequence
  chemically synthesized
cacatgacctctactatccc

SEQ ID NO: 475489 - DNA, 20 bp, Artificial Sequence
  chemically synthesized
ctaactagtattataattcc

SEQ ID NO: 475490 - DNA, 20 bp, Artificial Sequence
  chemically synthesized
atgtattctaagtaactatg

SEQ ID NO: 475491 - DNA, 20 bp, Artificial Sequence
  chemically synthesized
atacattcatcatagttact

SEQ ID NO: 475492 - DNA, 20 bp, Artificial Sequence
  chemically synthesized
cccatgaatgtatacgtgtg

SEQ ID NO: 475493 - DNA, 20 bp, Artificial Sequence
  chemically synthesized
ttctccacacgtatacattc

SEQ ID NO: 475494 - DNA, 20 bp, Artificial Sequence
  chemically synthesized
aacaacacacacatacaccc

SEQ ID NO: 475495 - DNA, 20 bp, Artificial Sequence
  chemically synthesized
ggacaaaagcagagtgctga

SEQ ID NO: 475496 - DNA, 20 bp, Artificial Sequence
  chemically synthesized
gtacttagaaaggacaaaag

SEQ ID NO: 475497 - DNA, 20 bp, Artificial Sequence
  chemically synthesized
ttctaagtactcattacaat

SEQ ID NO: 475498 - DNA, 20 bp, Artificial Sequence
  chemically synthesized
attatttcattccaattgta

SEQ ID NO: 475499 - DNA, 20 bp, Artificial Sequence
  chemically synthesized
cctagaatacagatctagag

SEQ ID NO: 475500 - DNA, 20 bp, Artificial Sequence
  chemically synthesized
tccctgccctcagaaagccc

SEQ ID NO: 475501 - DNA, 20 bp, Artificial Sequence
  chemically synthesized
gcttaattagtacttgtgac

SEQ ID NO: 475502 - DNA, 20 bp, Artificial Sequence
  chemically synthesized
agtacttgtgacctgagtaa

SEQ ID NO: 475503 - DNA, 20 bp, Artificial Sequence
  chemically synthesized
agacctcagcaaggagatcc

SEQ ID NO: 475504 - DNA, 20 bp, Artificial Sequence
  chemically synthesized
tccaaataagaaaaggaccc

SEQ ID NO: 475505 - DNA, 20 bp, Artificial Sequence
  chemically synthesized
tggaaatcttgaggtagagc

SEQ ID NO: 475506 - DNA, 20 bp, Artificial Sequence
  chemically synthesized
aagctatgccaatgaacatg

SEQ ID NO: 475507 - DNA, 20 bp, Artificial Sequence
  chemically synthesized
caacatggtgccaggacaga

SEQ ID NO: 475508 - DNA, 20 bp, Artificial Sequence
  chemically synthesized
agcaaggtgtgatacgagag

SEQ ID NO: 475509 - DNA, 20 bp, Artificial Sequence
  chemically synthesized
gaaagaggcaataaatatga

SEQ ID NO: 475510 - DNA, 20 bp, Artificial Sequence
  chemically synthesized
tgaagaaagaggcaataaat

SEQ ID NO: 475511 - DNA, 20 bp, Artificial Sequence
  chemically synthesized
caaaaagaagataaataaaa

SEQ ID NO: 475512 - DNA, 20 bp, Artificial Sequence
  chemically synthesized
aatatcaaaacttaagaaaa

SEQ ID NO: 475513 - DNA, 20 bp, Artificial Sequence
  chemically synthesized
aatgggtgttttctagaaag

SEQ ID NO: 475514 - DNA, 20 bp, Artificial Sequence
  chemically synthesized
aaaataagctcaataaagac

SEQ ID NO: 475515 - DNA, 20 bp, Artificial Sequence
  chemically synthesized
ctgagggaaagccctttcta

SEQ ID NO: 475516 - DNA, 20 bp, Artificial Sequence
  chemically synthesized
ggaaagccctttctatagaa

SEQ ID NO: 475517 - DNA, 20 bp, Artificial Sequence
  chemically synthesized
tagaatagaatttacatcct

SEQ ID NO: 475518 - DNA, 20 bp, Artificial Sequence
  chemically synthesized
ctaaaaacatgaccaactca

SEQ ID NO: 475519 - DNA, 20 bp, Artificial Sequence
  chemically synthesized
ttggtcatgtttttagtaag

SEQ ID NO: 475520 - DNA, 20 bp, Artificial Sequence
  chemically synthesized
ttaaattgcatgtatatgtc

SEQ ID NO: 475521 - DNA, 20 bp, Artificial Sequence
  chemically synthesized
attaatgggaaacatagaac

SEQ ID NO: 475522 - DNA, 20 bp, Artificial Sequence
  chemically synthesized
aagtaatggacaaaattgac

SEQ ID NO: 475523 - DNA, 20 bp, Artificial Sequence
  chemically synthesized
ttgtccattacttctttctc

SEQ ID NO: 475524 - DNA, 20 bp, Artificial Sequence
  chemically synthesized
tcaagagtaaacaccctcag

SEQ ID NO: 475525 - DNA, 20 bp, Artificial Sequence
  chemically synthesized
tcattatttgtcatccagct

SEQ ID NO: 475526 - DNA, 20 bp, Artificial Sequence
  chemically synthesized
aaaaaaaacagatgtcaggt

SEQ ID NO: 475527 - DNA, 20 bp, Artificial Sequence
  chemically synthesized
ctttaaaactaacttgctat

SEQ ID NO: 475528 - DNA, 20 bp, Artificial Sequence
  chemically synthesized
cctttgttaccttatggcct

SEQ ID NO: 475529 - DNA, 20 bp, Artificial Sequence
  chemically synthesized
tgtccacatttctcacttct

SEQ ID NO: 475530 - DNA, 20 bp, Artificial Sequence
  chemically synthesized
cacatttctcacttctatga

SEQ ID NO: 475531 - DNA, 20 bp, Artificial Sequence
  chemically synthesized
ttctatgaatgagtgcccac

SEQ ID NO: 475532 - DNA, 20 bp, Artificial Sequence
  chemically synthesized
acatgtaacaaagtcaactt

SEQ ID NO: 475533 - DNA, 20 bp, Artificial Sequence
  chemically synthesized
tgccgggcaaggacactgcc

SEQ ID NO: 475534 - DNA, 20 bp, Artificial Sequence
  chemically synthesized
agctagggagtatgcctcat

SEQ ID NO: 475535 - DNA, 20 bp, Artificial Sequence
  chemically synthesized
caggactcttgtaatagcta

SEQ ID NO: 475536 - DNA, 20 bp, Artificial Sequence
  chemically synthesized
gcatactccctagctattac

SEQ ID NO: 475537 - DNA, 20 bp, Artificial Sequence
  chemically synthesized
tccttggatttcatgtggca

SEQ ID NO: 475538 - DNA, 20 bp, Artificial Sequence
  chemically synthesized
ccagtgccacatgaaatcca

SEQ ID NO: 475539 - DNA, 20 bp, Artificial Sequence
  chemically synthesized
ggagattacactttgattcc

SEQ ID NO: 475540 - DNA, 20 bp, Artificial Sequence
  chemically synthesized
tggtccatgttttgaacatg

SEQ ID NO: 475541 - DNA, 20 bp, Artificial Sequence
  chemically synthesized
ccattatgcaatattaaagc

SEQ ID NO: 475542 - DNA, 20 bp, Artificial Sequence
  chemically synthesized
tcacaacattaacagagttc

SEQ ID NO: 475543 - DNA, 20 bp, Artificial Sequence
  chemically synthesized
cacctatttcacaacattaa

SEQ ID NO: 475544 - DNA, 20 bp, Artificial Sequence
  chemically synthesized
ctgttaatgttgtgaaatag

SEQ ID NO: 475545 - DNA, 20 bp, Artificial Sequence
  chemically synthesized
gaaataggtgagtagttagc

SEQ ID NO: 475546 - DNA, 20 bp, Artificial Sequence
  chemically synthesized
aagtttttccactgcactgt

SEQ ID NO: 475547 - DNA, 20 bp, Artificial Sequence
  chemically synthesized
tcaactccctgctttttaca

SEQ ID NO: 475548 - DNA, 20 bp, Artificial Sequence
  chemically synthesized
ttcattcattgtaaaaagca

SEQ ID NO: 475549 - DNA, 20 bp, Artificial Sequence
  chemically synthesized
tcattgtaaaaagcagggag

SEQ ID NO: 475550 - DNA, 20 bp, Artificial Sequence
  chemically synthesized
cagggagttgagtttctata

SEQ ID NO: 475551 - DNA, 20 bp, Artificial Sequence
  chemically synthesized
ttttccaagaggttctttgg

SEQ ID NO: 475552 - DNA, 20 bp, Artificial Sequence
  chemically synthesized
aatagaggtaaaataagctt

SEQ ID NO: 475553 - DNA, 20 bp, Artificial Sequence
  chemically synthesized
acttgtttattttattctag

SEQ ID NO: 475554 - DNA, 20 bp, Artificial Sequence
  chemically synthesized
ttaagttaataaaattcacc

SEQ ID NO: 475555 - DNA, 20 bp, Artificial Sequence
  chemically synthesized
aggtgaattttattaactta

SEQ ID NO: 475556 - DNA, 20 bp, Artificial Sequence
  chemically synthesized
atataataattgatagaaat

SEQ ID NO: 475557 - DNA, 20 bp, Artificial Sequence
  chemically synthesized
atctttttatctgtacacac

SEQ ID NO: 475558 - DNA, 20 bp, Artificial Sequence
  chemically synthesized
atctctaggtttagttgtac

SEQ ID NO: 475559 - DNA, 20 bp, Artificial Sequence
  chemically synthesized
ttgcaatagcagctcatttt

SEQ ID NO: 475560 - DNA, 20 bp, Artificial Sequence
  chemically synthesized
aaacagcataaatttttgaa

SEQ ID NO: 475561 - DNA, 20 bp, Artificial Sequence
  chemically synthesized
acaaggtgtagtgaagagcg

SEQ ID NO: 475562 - DNA, 20 bp, Artificial Sequence
  chemically synthesized
atttcctaatctataaatta

SEQ ID NO: 475563 - DNA, 20 bp, Artificial Sequence
  chemically synthesized
gagagagagagtaagcaggg

SEQ ID NO: 475564 - DNA, 20 bp, Artificial Sequence
  chemically synthesized
gagagagagagagagagaga

SEQ ID NO: 475565 - DNA, 20 bp, Artificial Sequence
  chemically synthesized
ttttctttttctttttgaga

SEQ ID NO: 475566 - DNA, 20 bp, Artificial Sequence
  chemically synthesized
tgaacccggagcctgggtga

SEQ ID NO: 475567 - DNA, 20 bp, Artificial Sequence
  chemically synthesized
cttactctgtcacccaggct

SEQ ID NO: 475568 - DNA, 20 bp, Artificial Sequence
  chemically synthesized
gaattgcttgaacccggagc

SEQ ID NO: 475569 - DNA, 20 bp, Artificial Sequence
  chemically synthesized
tactcgggaggctgaggtgg

SEQ ID NO: 475570 - DNA, 20 bp, Artificial Sequence
  chemically synthesized
aattctcccacctcagcctc

SEQ ID NO: 475571 - DNA, 20 bp, Artificial Sequence
  chemically synthesized
cctcccgagtagctgggact

SEQ ID NO: 475572 - DNA, 20 bp, Artificial Sequence
  chemically synthesized
aaaatacaaaaaacatttag

SEQ ID NO: 475573 - DNA, 20 bp, Artificial Sequence
  chemically synthesized
ttttgtatttttagtagaga

SEQ ID NO: 475574 - DNA, 20 bp, Artificial Sequence
  chemically synthesized
caggcagatcacctgaggcc

SEQ ID NO: 475575 - DNA, 20 bp, Artificial Sequence
  chemically synthesized
gccttggcctctcaaagtgc

SEQ ID NO: 475576 - DNA, 20 bp, Artificial Sequence
  chemically synthesized
tgcaggtatctttaacaggt

SEQ ID NO: 475577 - DNA, 20 bp, Artificial Sequence
  chemically synthesized
ttaacaggttggagtgttac

SEQ ID NO: 475578 - DNA, 20 bp, Artificial Sequence
  chemically synthesized
tatgttaaacgagttaaaca

SEQ ID NO: 475579 - DNA, 20 bp, Artificial Sequence
  chemically synthesized
tgcgtgttttaatatgttaa

SEQ ID NO: 475580 - DNA, 20 bp, Artificial Sequence
  chemically synthesized
gaagaaaagcatcgtggaaa

SEQ ID NO: 475581 - DNA, 20 bp, Artificial Sequence
  chemically synthesized
tgggaggttttaaacacttc

SEQ ID NO: 475582 - DNA, 20 bp, Artificial Sequence
  chemically synthesized
atggttaaattgtaaaataa

SEQ ID NO: 475583 - DNA, 20 bp, Artificial Sequence
  chemically synthesized
aatttgttgtcactgaaatt

SEQ ID NO: 475584 - DNA, 20 bp, Artificial Sequence
  chemically synthesized
ggcaaaacataagaagaggt

SEQ ID NO: 475585 - DNA, 20 bp, Artificial Sequence
  chemically synthesized
gagctcagaaataaagtgat

SEQ ID NO: 475586 - DNA, 20 bp, Artificial Sequence
  chemically synthesized
ttactttggaaagtatccta

SEQ ID NO: 475587 - DNA, 20 bp, Artificial Sequence
  chemically synthesized
ctactaaaatcaaaactcca

SEQ ID NO: 475588 - DNA, 20 bp, Artificial Sequence
  chemically synthesized
ctatggagttttgattttag

SEQ ID NO: 475589 - DNA, 20 bp, Artificial Sequence
  chemically synthesized
taagccatcttttgcctcac

SEQ ID NO: 475590 - DNA, 20 bp, Artificial Sequence
  chemically synthesized
cacaggtcaaggctataggt

SEQ ID NO: 475591 - DNA, 20 bp, Artificial Sequence
  chemically synthesized
aattttttgttattgctgct

SEQ ID NO: 475592 - DNA, 20 bp, Artificial Sequence
  chemically synthesized
acaggcaagactcttgctgc

SEQ ID NO: 475593 - DNA, 20 bp, Artificial Sequence
  chemically synthesized
aatacatatatccgtgcagc

SEQ ID NO: 475594 - DNA, 20 bp, Artificial Sequence
  chemically synthesized
gtagaaaagatcaaactaaa

SEQ ID NO: 475595 - DNA, 20 bp, Artificial Sequence
  chemically synthesized
tgaaaacatgatgccaggca

SEQ ID NO: 475596 - DNA, 20 bp, Artificial Sequence
  chemically synthesized
atctgccttccattttccac

SEQ ID NO: 475597 - DNA, 20 bp, Artificial Sequence
  chemically synthesized
attgcctaagtctaagcaag

SEQ ID NO: 475598 - DNA, 20 bp, Artificial Sequence
  chemically synthesized
ttttagaggacattaagatc

SEQ ID NO: 475599 - DNA, 20 bp, Artificial Sequence
  chemically synthesized
taagagacaccattacctga

SEQ ID NO: 475600 - DNA, 20 bp, Artificial Sequence
  chemically synthesized
agttttatttgcactggtga

SEQ ID NO: 475601 - DNA, 20 bp, Artificial Sequence
  chemically synthesized
taaaatgataatttttttga

SEQ ID NO: 475602 - DNA, 20 bp, Artificial Sequence
  chemically synthesized
caaaggaagatgaattgcta

SEQ ID NO: 475603 - DNA, 20 bp, Artificial Sequence
  chemically synthesized
attcatgcgcccaaaggaag

SEQ ID NO: 475604 - DNA, 20 bp, Artificial Sequence
  chemically synthesized
attcatcttcctttgggcgc

SEQ ID NO: 475605 - DNA, 20 bp, Artificial Sequence
  chemically synthesized
attttaaggcagcatctccg

SEQ ID NO: 475606 - DNA, 20 bp, Artificial Sequence
  chemically synthesized
cgacaaaccttggtagaaaa

SEQ ID NO: 475607 - DNA, 20 bp, Artificial Sequence
  chemically synthesized
aaaacagaatactcttaatt

SEQ ID NO: 475608 - DNA, 20 bp, Artificial Sequence
  chemically synthesized
tagttaatttattcataatt

SEQ ID NO: 475609 - DNA, 20 bp, Artificial Sequence
  chemically synthesized
aactaaattagtaacatgag

SEQ ID NO: 475610 - DNA, 20 bp, Artificial Sequence
  chemically synthesized
atgagatggatatgcaatta

SEQ ID NO: 475611 - DNA, 20 bp, Artificial Sequence
  chemically synthesized
cagctgtatacagcttagag

SEQ ID NO: 475612 - DNA, 20 bp, Artificial Sequence
  chemically synthesized
ccatttcagtgacacaatat

SEQ ID NO: 475613 - DNA, 20 bp, Artificial Sequence
  chemically synthesized
tttttaaacccgtgaacacc

SEQ ID NO: 475614 - DNA, 20 bp, Artificial Sequence
  chemically synthesized
gatcctgattcctggtgttc

SEQ ID NO: 475615 - DNA, 20 bp, Artificial Sequence
  chemically synthesized
aacccgtgaacaccaggaat

SEQ ID NO: 475616 - DNA, 20 bp, Artificial Sequence
  chemically synthesized
gggacggcaaattaggctcc

SEQ ID NO: 475617 - DNA, 20 bp, Artificial Sequence
  chemically synthesized
aaattaggctccctggatat

SEQ ID NO: 475618 - DNA, 20 bp, Artificial Sequence
  chemically synthesized
gatatgggaattagtgttgt

SEQ ID NO: 475619 - DNA, 20 bp, Artificial Sequence
  chemically synthesized
tctacattctttgaaagctg

SEQ ID NO: 475620 - DNA, 20 bp, Artificial Sequence
  chemically synthesized
atttgattctccagctttca

SEQ ID NO: 475621 - DNA, 20 bp, Artificial Sequence
  chemically synthesized
aggtctctggcactgtgccc

SEQ ID NO: 475622 - DNA, 20 bp, Artificial Sequence
  chemically synthesized
tgaagattttgttttttctt

SEQ ID NO: 475623 - DNA, 20 bp, Artificial Sequence
  chemically synthesized
ttagtacatttcaacataca

SEQ ID NO: 475624 - DNA, 20 bp, Artificial Sequence
  chemically synthesized
cggaagtttccaaagtgcaa

SEQ ID NO: 475625 - DNA, 20 bp, Artificial Sequence
  chemically synthesized
tgcacatgggggaaaatggt

SEQ ID NO: 475626 - DNA, 20 bp, Artificial Sequence
  chemically synthesized
ttcccttccctggggcaaat

SEQ ID NO: 475627 - DNA, 20 bp, Artificial Sequence
  chemically synthesized
tctatggttctagattttaa

SEQ ID NO: 475628 - DNA, 20 bp, Artificial Sequence
  chemically synthesized
tggacaaggttgaggggaga

SEQ ID NO: 475629 - DNA, 20 bp, Artificial Sequence
  chemically synthesized
taaccatagtttaatgatta

SEQ ID NO: 475630 - DNA, 20 bp, Artificial Sequence
  chemically synthesized
ccagcctaatagttgttggt

SEQ ID NO: 475631 - DNA, 20 bp, Artificial Sequence
  chemically synthesized
tcaaaccaacaactattagg

SEQ ID NO: 475632 - DNA, 20 bp, Artificial Sequence
  chemically synthesized
ttaatactttcctctatcaa

SEQ ID NO: 475633 - DNA, 20 bp, Artificial Sequence
  chemically synthesized
gaaaacttagggcatcctcc

SEQ ID NO: 475634 - DNA, 20 bp, Artificial Sequence
  chemically synthesized
aggtctcccctgaattcaag

SEQ ID NO: 475635 - DNA, 20 bp, Artificial Sequence
  chemically synthesized
gttgtagtaaaaggtctccc

SEQ ID NO: 475636 - DNA, 20 bp, Artificial Sequence
  chemically synthesized
tacaacgtttaacgaagtat

SEQ ID NO: 475637 - DNA, 20 bp, Artificial Sequence
  chemically synthesized
acagtcaacacagtggaaaa

SEQ ID NO: 475638 - DNA, 20 bp, Artificial Sequence
  chemically synthesized
ctgtgttgactgtgggcata

SEQ ID NO: 475639 - DNA, 20 bp, Artificial Sequence
  chemically synthesized
tgtgggcatatggggtgtag

SEQ ID NO: 475640 - DNA, 20 bp, Artificial Sequence
  chemically synthesized
atatggggtgtagctgagtt

SEQ ID NO: 475641 - DNA, 20 bp, Artificial Sequence
  chemically synthesized
ttaaaagaaaatacactttc

SEQ ID NO: 475642 - DNA, 20 bp, Artificial Sequence
  chemically synthesized
aagaaaatacactttcagga

SEQ ID NO: 475643 - DNA, 20 bp, Artificial Sequence
  chemically synthesized
tatatagttttctctctatg

SEQ ID NO: 475644 - DNA, 20 bp, Artificial Sequence
  chemically synthesized
atgttggatacctataaatg

SEQ ID NO: 475645 - DNA, 20 bp, Artificial Sequence
  chemically synthesized
acctataaatgtgggatttg

SEQ ID NO: 475646 - DNA, 20 bp, Artificial Sequence
  chemically synthesized
tacttgtgcagactaacaca

SEQ ID NO: 475647 - DNA, 20 bp, Artificial Sequence
  chemically synthesized
gcttttattatacctgtata

SEQ ID NO: 475648 - DNA, 20 bp, Artificial Sequence
  chemically synthesized
acaggtataataaaagcaag

SEQ ID NO: 475649 - DNA, 20 bp, Artificial Sequence
  chemically synthesized
aacagaataacagtctcatg

SEQ ID NO: 475650 - DNA, 20 bp, Artificial Sequence
  chemically synthesized
tttcttatcaccatttgcaa

SEQ ID NO: 475651 - DNA, 20 bp, Artificial Sequence
  chemically synthesized
agtgtgattataatgaggtt

SEQ ID NO: 475652 - DNA, 20 bp, Artificial Sequence
  chemically synthesized
atagctgggtatgtccacaa

SEQ ID NO: 475653 - DNA, 20 bp, Artificial Sequence
  chemically synthesized
gctgttagttaggcaaatag

SEQ ID NO: 475654 - DNA, 20 bp, Artificial Sequence
  chemically synthesized
ttcttatgtgtcaactagaa

SEQ ID NO: 475655 - DNA, 20 bp, Artificial Sequence
  chemically synthesized
ccaaacacagacacacaggc

SEQ ID NO: 475656 - DNA, 20 bp, Artificial Sequence
  chemically synthesized
ggcaagaaggaataaggttc

SEQ ID NO: 475657 - DNA, 20 bp, Artificial Sequence
  chemically synthesized
caacaataaccaaggcaaga

SEQ ID NO: 475658 - DNA, 20 bp, Artificial Sequence
  chemically synthesized
tgccttggttattgttgtct

SEQ ID NO: 475659 - DNA, 20 bp, Artificial Sequence
  chemically synthesized
gaccatgaggaaaaagacaa

SEQ ID NO: 475660 - DNA, 20 bp, Artificial Sequence
  chemically synthesized
agacttgaggtcagcttctc

SEQ ID NO: 475661 - DNA, 20 bp, Artificial Sequence
  chemically synthesized
gtcttgatatagctaatctg

SEQ ID NO: 475662 - DNA, 20 bp, Artificial Sequence
  chemically synthesized
aaagtgcagttcctgaccac

SEQ ID NO: 475663 - DNA, 20 bp, Artificial Sequence
  chemically synthesized
ttggcaacctactagaaatg

SEQ ID NO: 475664 - DNA, 20 bp, Artificial Sequence
  chemically synthesized
ctgatgcagtaggtccagcg

SEQ ID NO: 475665 - DNA, 20 bp, Artificial Sequence
  chemically synthesized
tgtagtttaacaagccccca

SEQ ID NO: 475666 - DNA, 20 bp, Artificial Sequence
  chemically synthesized
tcccaaactttagtatgcat

SEQ ID NO: 475667 - DNA, 20 bp, Artificial Sequence
  chemically synthesized
aatgtgtctattattaacga

SEQ ID NO: 475668 - DNA, 20 bp, Artificial Sequence
  chemically synthesized
cacttcttgcctgattccac

SEQ ID NO: 475669 - DNA, 20 bp, Artificial Sequence
  chemically synthesized
ttttttaacacgaactccag

SEQ ID NO: 475670 - DNA, 20 bp, Artificial Sequence
  chemically synthesized
gattctgatgcaatagactt

SEQ ID NO: 475671 - DNA, 20 bp, Artificial Sequence
  chemically synthesized
tattcccaagtctattgcat

SEQ ID NO: 475672 - DNA, 20 bp, Artificial Sequence
  chemically synthesized
aatctccagtgaaggggctt

SEQ ID NO: 475673 - DNA, 20 bp, Artificial Sequence
  chemically synthesized
tcccaaggttttctggtcat

SEQ ID NO: 475674 - DNA, 20 bp, Artificial Sequence
  chemically synthesized
attgcagatggaatgtcagt

SEQ ID NO: 475675 - DNA, 20 bp, Artificial Sequence
  chemically synthesized
ttgaaacaggagattgcaga

SEQ ID NO: 475676 - DNA, 20 bp, Artificial Sequence
  chemically synthesized
aagagctagtatctgcttac

SEQ ID NO: 475677 - DNA, 20 bp, Artificial Sequence
  chemically synthesized
ttcttgacttaactgtctat

SEQ ID NO: 475678 - DNA, 20 bp, Artificial Sequence
  chemically synthesized
ggctctgaatggaaaagatc

SEQ ID NO: 475679 - DNA, 20 bp, Artificial Sequence
  chemically synthesized
ggagttcgggtaaacaggct

SEQ ID NO: 475680 - DNA, 20 bp, Artificial Sequence
  chemically synthesized
ctgtagctgaagtggggagt

SEQ ID NO: 475681 - DNA, 20 bp, Artificial Sequence
  chemically synthesized
ttcagactgtagctgaagtg

SEQ ID NO: 475682 - DNA, 20 bp, Artificial Sequence
  chemically synthesized
ctccccacttcagctacagt

SEQ ID NO: 475683 - DNA, 20 bp, Artificial Sequence
  chemically synthesized
tcaagaatgtacacgaggtt

SEQ ID NO: 475684 - DNA, 20 bp, Artificial Sequence
  chemically synthesized
gccaccagataacactgatc

SEQ ID NO: 475685 - DNA, 20 bp, Artificial Sequence
  chemically synthesized
ggtggcctcaccaaccctgc

SEQ ID NO: 475686 - DNA, 20 bp, Artificial Sequence
  chemically synthesized
gaggggctctgaaattctgg

SEQ ID NO: 475687 - DNA, 20 bp, Artificial Sequence
  chemically synthesized
agcccctctcaagtaattac

SEQ ID NO: 475688 - DNA, 20 bp, Artificial Sequence
  chemically synthesized
agaatgcagcctaagagtta

SEQ ID NO: 475689 - DNA, 20 bp, Artificial Sequence
  chemically synthesized
gccccctaagaatgcagcct

SEQ ID NO: 475690 - DNA, 20 bp, Artificial Sequence
  chemically synthesized
taggtaggaatctgccccct

SEQ ID NO: 475691 - DNA, 20 bp, Artificial Sequence
  chemically synthesized
caggttcaaggttagtaggt

SEQ ID NO: 475692 - DNA, 20 bp, Artificial Sequence
  chemically synthesized
agaaccttttttcagacttc

SEQ ID NO: 475693 - DNA, 20 bp, Artificial Sequence
  chemically synthesized
tctcaattatttctatttgg

SEQ ID NO: 475694 - DNA, 20 bp, Artificial Sequence
  chemically synthesized
gagttctcaattatttctat

SEQ ID NO: 475695 - DNA, 20 bp, Artificial Sequence
  chemically synthesized
ccatttaaagttaaatattt

SEQ ID NO: 475696 - DNA, 20 bp, Artificial Sequence
  chemically synthesized
atatttaactttaaatggtc

SEQ ID NO: 475697 - DNA, 20 bp, Artificial Sequence
  chemically synthesized
atcatcaatgttctttcagg

SEQ ID NO: 475698 - DNA, 20 bp, Artificial Sequence
  chemically synthesized
tcaatgttctttcaggttga

SEQ ID NO: 475699 - DNA, 20 bp, Artificial Sequence
  chemically synthesized
cttagtgaaattgtttcctt

SEQ ID NO: 475700 - DNA, 20 bp, Artificial Sequence
  chemically synthesized
ccttatgaatgacaaatgta

SEQ ID NO: 475701 - DNA, 20 bp, Artificial Sequence
  chemically synthesized
caaatgtaaagagtcaaaag

SEQ ID NO: 475702 - DNA, 20 bp, Artificial Sequence
  chemically synthesized
agtctggaatgactgagtta

SEQ ID NO: 475703 - DNA, 20 bp, Artificial Sequence
  chemically synthesized
agtttataagtctggaatga

SEQ ID NO: 475704 - DNA, 20 bp, Artificial Sequence
  chemically synthesized
cctgaggtagtttataagtc

SEQ ID NO: 475705 - DNA, 20 bp, Artificial Sequence
  chemically synthesized
ccaagaggtaaagaaaaaaa

SEQ ID NO: 475706 - DNA, 20 bp, Artificial Sequence
  chemically synthesized
gcttagactcgagcaatgag

SEQ ID NO: 475707 - DNA, 20 bp, Artificial Sequence
  chemically synthesized
cttggaaccctactcattgc

SEQ ID NO: 475708 - DNA, 20 bp, Artificial Sequence
  chemically synthesized
tttgagcttagactcgagca

SEQ ID NO: 475709 - DNA, 20 bp, Artificial Sequence
  chemically synthesized
ttagcaataaattttgcaca

SEQ ID NO: 475710 - DNA, 20 bp, Artificial Sequence
  chemically synthesized
gaaatgatattaatgtgcag

SEQ ID NO: 475711 - DNA, 20 bp, Artificial Sequence
  chemically synthesized
gtacatctttgtccctccta

SEQ ID NO: 475712 - DNA, 20 bp, Artificial Sequence
  chemically synthesized
tttgtccctcctattgggta

SEQ ID NO: 475713 - DNA, 20 bp, Artificial Sequence
  chemically synthesized
gtggtgaggggcatcccagc

SEQ ID NO: 475714 - DNA, 20 bp, Artificial Sequence
  chemically synthesized
gggacctctaccactcaagc

SEQ ID NO: 475715 - DNA, 20 bp, Artificial Sequence
  chemically synthesized
agataaatgtggcaaattgg

SEQ ID NO: 475716 - DNA, 20 bp, Artificial Sequence
  chemically synthesized
acctccttagtgtccctgca

SEQ ID NO: 475717 - DNA, 20 bp, Artificial Sequence
  chemically synthesized
cggtcaacaagagaaagaga

SEQ ID NO: 475718 - DNA, 20 bp, Artificial Sequence
  chemically synthesized
gaaagagaaagagtggtttt

SEQ ID NO: 475719 - DNA, 20 bp, Artificial Sequence
  chemically synthesized
atcttctggttcagtcatat

SEQ ID NO: 475720 - DNA, 20 bp, Artificial Sequence
  chemically synthesized
tgagtcccatgcatctaagt

SEQ ID NO: 475721 - DNA, 20 bp, Artificial Sequence
  chemically synthesized
gcaggttgtagaaaactgat

SEQ ID NO: 475722 - DNA, 20 bp, Artificial Sequence
  chemically synthesized
ttgtagaaaactgatatggg

SEQ ID NO: 475723 - DNA, 20 bp, Artificial Sequence
  chemically synthesized
ctgaaatgtaatccccagtg

SEQ ID NO: 475724 - DNA, 20 bp, Artificial Sequence
  chemically synthesized
cgggccccacatccaacact

SEQ ID NO: 475725 - DNA, 20 bp, Artificial Sequence
  chemically synthesized
gtggggcccggtgggggaga

SEQ ID NO: 475726 - DNA, 20 bp, Artificial Sequence
  chemically synthesized
ggggagactggatcatgggg

SEQ ID NO: 475727 - DNA, 20 bp, Artificial Sequence
  chemically synthesized
atcatggggctggatccctc

SEQ ID NO: 475728 - DNA, 20 bp, Artificial Sequence
  chemically synthesized
atggcactgagccattcgtg

SEQ ID NO: 475729 - DNA, 20 bp, Artificial Sequence
  chemically synthesized
gagaactcacttattactgc

SEQ ID NO: 475730 - DNA, 20 bp, Artificial Sequence
  chemically synthesized
tgccattcttgcagtaataa

SEQ ID NO: 475731 - DNA, 20 bp, Artificial Sequence
  chemically synthesized
gtaataagtgagttctcact

SEQ ID NO: 475732 - DNA, 20 bp, Artificial Sequence
  chemically synthesized
taagtgagttctcactcaga

SEQ ID NO: 475733 - DNA, 20 bp, Artificial Sequence
  chemically synthesized
agatcccacatgaactcact

SEQ ID NO: 475734 - DNA, 20 bp, Artificial Sequence
  chemically synthesized
tcactcagagtgagttcatg

SEQ ID NO: 475735 - DNA, 20 bp, Artificial Sequence
  chemically synthesized
tgtgggatctgactgtttaa

SEQ ID NO: 475736 - DNA, 20 bp, Artificial Sequence
  chemically synthesized
catggtgagagatggagtga

SEQ ID NO: 475737 - DNA, 20 bp, Artificial Sequence
  chemically synthesized
gcgtgtcacatggtgagaga

SEQ ID NO: 475738 - DNA, 20 bp, Artificial Sequence
  chemically synthesized
ctataaaggaatacctgagg

SEQ ID NO: 475739 - DNA, 20 bp, Artificial Sequence
  chemically synthesized
ttccatttgcatcactataa

SEQ ID NO: 475740 - DNA, 20 bp, Artificial Sequence
  chemically synthesized
ttcctttatagtgatgcaaa

SEQ ID NO: 475741 - DNA, 20 bp, Artificial Sequence
  chemically synthesized
actagtcaagacattttgtg

SEQ ID NO: 475742 - DNA, 20 bp, Artificial Sequence
  chemically synthesized
gaggcaaagctgctccagga

SEQ ID NO: 475743 - DNA, 20 bp, Artificial Sequence
  chemically synthesized
ggaataatgtcattgtgctt

SEQ ID NO: 475744 - DNA, 20 bp, Artificial Sequence
  chemically synthesized
atggaaggatgggaggaacc

SEQ ID NO: 475745 - DNA, 20 bp, Artificial Sequence
  chemically synthesized
caccaagaatggcagaatgg

SEQ ID NO: 475746 - DNA, 20 bp, Artificial Sequence
  chemically synthesized
ggacagttcaccaagaatgg

SEQ ID NO: 475747 - DNA, 20 bp, Artificial Sequence
  chemically synthesized
gagtatgtggacagttcacc

SEQ ID NO: 475748 - DNA, 20 bp, Artificial Sequence
  chemically synthesized
agaatttcagtagctacgtt

SEQ ID NO: 475749 - DNA, 20 bp, Artificial Sequence
  chemically synthesized
gaatgaacgagtgaatagat

SEQ ID NO: 475750 - DNA, 20 bp, Artificial Sequence
  chemically synthesized
aatatttgttgaatgaacga

SEQ ID NO: 475751 - DNA, 20 bp, Artificial Sequence
  chemically synthesized
ggtaaatatttgttgaatga

SEQ ID NO: 475752 - DNA, 20 bp, Artificial Sequence
  chemically synthesized
cttagcgtggtaaatatttg

SEQ ID NO: 475753 - DNA, 20 bp, Artificial Sequence
  chemically synthesized
aagatctattcttaggtaat

SEQ ID NO: 475754 - DNA, 20 bp, Artificial Sequence
  chemically synthesized
ctaatgtatccaaattacct

SEQ ID NO: 475755 - DNA, 20 bp, Artificial Sequence
  chemically synthesized
aaggtgagctccatgaggcc

SEQ ID NO: 475756 - DNA, 20 bp, Artificial Sequence
  chemically synthesized
ttaaaaaagtatattaggcc

SEQ ID NO: 475757 - DNA, 20 bp, Artificial Sequence
  chemically synthesized
cgccttggcctcccaagtgc

SEQ ID NO: 475758 - DNA, 20 bp, Artificial Sequence
  chemically synthesized
ggcgggcagatcacgaggtc

SEQ ID NO: 475759 - DNA, 20 bp, Artificial Sequence
  chemically synthesized
ttttttatttttagtagaga

SEQ ID NO: 475760 - DNA, 20 bp, Artificial Sequence
  chemically synthesized
aaaactagctgggcgtggtg

SEQ ID NO: 475761 - DNA, 20 bp, Artificial Sequence
  chemically synthesized
aattctcctgcctcagcctc

SEQ ID NO: 475762 - DNA, 20 bp, Artificial Sequence
  chemically synthesized
tactcgggaggctgaggcag

SEQ ID NO: 475763 - DNA, 20 bp, Artificial Sequence
  chemically synthesized
ctcactgcaacctccgcctg

SEQ ID NO: 475764 - DNA, 20 bp, Artificial Sequence
  chemically synthesized
tctcaatctgtcgcccaggc

SEQ ID NO: 475765 - DNA, 20 bp, Artificial Sequence
  chemically synthesized
ctttttttttttttttgaga

SEQ ID NO: 475766 - DNA, 20 bp, Artificial Sequence
  chemically synthesized
tattacacatgttaatcctg

SEQ ID NO: 475767 - DNA, 20 bp, Artificial Sequence
  chemically synthesized
acacatgttaatcctgcaga

SEQ ID NO: 475768 - DNA, 20 bp, Artificial Sequence
  chemically synthesized
cctatcatacactcattctg

SEQ ID NO: 475769 - DNA, 20 bp, Artificial Sequence
  chemically synthesized
tatttttagccagtaagttc

SEQ ID NO: 475770 - DNA, 20 bp, Artificial Sequence
  chemically synthesized
tcagtattgctcatggttct

SEQ ID NO: 475771 - DNA, 20 bp, Artificial Sequence
  chemically synthesized
tgtgagttgactgtgctcag

SEQ ID NO: 475772 - DNA, 20 bp, Artificial Sequence
  chemically synthesized
ctcaggtgggtgtttcttgc

SEQ ID NO: 475773 - DNA, 20 bp, Artificial Sequence
  chemically synthesized
cagtcagatagtagccaaag

SEQ ID NO: 475774 - DNA, 20 bp, Artificial Sequence
  chemically synthesized
aattgatctgaaggctccat

SEQ ID NO: 475775 - DNA, 20 bp, Artificial Sequence
  chemically synthesized
tgtacatctggctcctcact

SEQ ID NO: 475776 - DNA, 20 bp, Artificial Sequence
  chemically synthesized
gctcctcacttgggatggct

SEQ ID NO: 475777 - DNA, 20 bp, Artificial Sequence
  chemically synthesized
tgtagacagcacagtggcct

SEQ ID NO: 475778 - DNA, 20 bp, Artificial Sequence
  chemically synthesized
acagggcagatcactttccc

SEQ ID NO: 475779 - DNA, 20 bp, Artificial Sequence
  chemically synthesized
tagcttctgtcttggtcttc

SEQ ID NO: 475780 - DNA, 20 bp, Artificial Sequence
  chemically synthesized
aagttcaaagctaaataaga

SEQ ID NO: 475781 - DNA, 20 bp, Artificial Sequence
  chemically synthesized
atttagctttgaacttcttg

SEQ ID NO: 475782 - DNA, 20 bp, Artificial Sequence
  chemically synthesized
gtacaacaaactgaaggagg

SEQ ID NO: 475783 - DNA, 20 bp, Artificial Sequence
  chemically synthesized
gaaggcactccctcctccct

SEQ ID NO: 475784 - DNA, 20 bp, Artificial Sequence
  chemically synthesized
gacatgattcacagggagga

SEQ ID NO: 475785 - DNA, 20 bp, Artificial Sequence
  chemically synthesized
cataaaaaggtaagtgggaa

SEQ ID NO: 475786 - DNA, 20 bp, Artificial Sequence
  chemically synthesized
atctccctcttcccagccat

SEQ ID NO: 475787 - DNA, 20 bp, Artificial Sequence
  chemically synthesized
ttttttttttaagttgagat

SEQ ID NO: 475788 - DNA, 20 bp, Artificial Sequence
  chemically synthesized
ataagacttgaaggaaatga

SEQ ID NO: 475789 - DNA, 20 bp, Artificial Sequence
  chemically synthesized
gtcacaaagatttctggaga

SEQ ID NO: 475790 - DNA, 20 bp, Artificial Sequence
  chemically synthesized
tggagaaagaatgttccagg

SEQ ID NO: 475791 - DNA, 20 bp, Artificial Sequence
  chemically synthesized
actacgcatagtgcccggag

SEQ ID NO: 475792 - DNA, 20 bp, Artificial Sequence
  chemically synthesized
tttctcagaaggtcccttag

SEQ ID NO: 475793 - DNA, 20 bp, Artificial Sequence
  chemically synthesized
gcagtcttgattgccctctt

SEQ ID NO: 475794 - DNA, 20 bp, Artificial Sequence
  chemically synthesized
gactatcattatgtattccc

SEQ ID NO: 475795 - DNA, 20 bp, Artificial Sequence
  chemically synthesized
caagggaagccccaacccaa

SEQ ID NO: 475796 - DNA, 20 bp, Artificial Sequence
  chemically synthesized
gatgcacatgatatgcagag

SEQ ID NO: 475797 - DNA, 20 bp, Artificial Sequence
  chemically synthesized
tggcagccaccaggcttgtt

SEQ ID NO: 475798 - DNA, 20 bp, Artificial Sequence
  chemically synthesized
ggtggctgccagcaaaggag

SEQ ID NO: 475799 - DNA, 20 bp, Artificial Sequence
  chemically synthesized
acatttggggaaaagaaaac

SEQ ID NO: 475800 - DNA, 20 bp, Artificial Sequence
  chemically synthesized
atctttcttccccacaccct

SEQ ID NO: 475801 - DNA, 20 bp, Artificial Sequence
  chemically synthesized
aaggagtattgtttaatccc

SEQ ID NO: 475802 - DNA, 20 bp, Artificial Sequence
  chemically synthesized
tcctgttagacaggcccaaa

SEQ ID NO: 475803 - DNA, 20 bp, Artificial Sequence
  chemically synthesized
tctagggctgggaaaatggg

SEQ ID NO: 475804 - DNA, 20 bp, Artificial Sequence
  chemically synthesized
aggatctagggctgggaaaa

SEQ ID NO: 475805 - DNA, 20 bp, Artificial Sequence
  chemically synthesized
aagaattctctgctgatagt

SEQ ID NO: 475806 - DNA, 20 bp, Artificial Sequence
  chemically synthesized
ctagatcctgactatcagca

SEQ ID NO: 475807 - DNA, 20 bp, Artificial Sequence
  chemically synthesized
tctgctcttacaccaagcac

SEQ ID NO: 475808 - DNA, 20 bp, Artificial Sequence
  chemically synthesized
ggaaaggcagcgataatgac

SEQ ID NO: 475809 - DNA, 20 bp, Artificial Sequence
  chemically synthesized
ggtggcccctttgccactgg

SEQ ID NO: 475810 - DNA, 20 bp, Artificial Sequence
  chemically synthesized
gggtggtggcccctttgcca

SEQ ID NO: 475811 - DNA, 20 bp, Artificial Sequence
  chemically synthesized
tgtacacttttaaaccttct

SEQ ID NO: 475812 - DNA, 20 bp, Artificial Sequence
  chemically synthesized
tgctacctactgcttatctg

SEQ ID NO: 475813 - DNA, 20 bp, Artificial Sequence
  chemically synthesized
cagagtcatattttcccatt

SEQ ID NO: 475814 - DNA, 20 bp, Artificial Sequence
  chemically synthesized
gccacataaaaattttcttt

SEQ ID NO: 475815 - DNA, 20 bp, Artificial Sequence
  chemically synthesized
aatgaaggacctaattcaaa

SEQ ID NO: 475816 - DNA, 20 bp, Artificial Sequence
  chemically synthesized
gaattttaatgttaccctct

SEQ ID NO: 475817 - DNA, 20 bp, Artificial Sequence
  chemically synthesized
tttgtggctgtgctgtactt

SEQ ID NO: 475818 - DNA, 20 bp, Artificial Sequence
  chemically synthesized
ctacagtttaagtgtctgat

SEQ ID NO: 475819 - DNA, 20 bp, Artificial Sequence
  chemically synthesized
ctgatgggaatgccagacct

SEQ ID NO: 475820 - DNA, 20 bp, Artificial Sequence
  chemically synthesized
ggaatgccagacctaagaat

SEQ ID NO: 475821 - DNA, 20 bp, Artificial Sequence
  chemically synthesized
cagacctaagaattggaatt

SEQ ID NO: 475822 - DNA, 20 bp, Artificial Sequence
  chemically synthesized
ttttttttttttttttgaga

SEQ ID NO: 475823 - DNA, 20 bp, Artificial Sequence
  chemically synthesized
actgcactccagactggtga

SEQ ID NO: 475824 - DNA, 20 bp, Artificial Sequence
  chemically synthesized
gtctcactctgtcaccagtc

SEQ ID NO: 475825 - DNA, 20 bp, Artificial Sequence
  chemically synthesized
tacttgggaggctgaggctg

SEQ ID NO: 475826 - DNA, 20 bp, Artificial Sequence
  chemically synthesized
gttttgtatttcagtagaga

SEQ ID NO: 475827 - DNA, 20 bp, Artificial Sequence
  chemically synthesized
acaggatttcaccatttggt

SEQ ID NO: 475828 - DNA, 20 bp, Artificial Sequence
  chemically synthesized
actttgggaggccgaggcgg

SEQ ID NO: 475829 - DNA, 20 bp, Artificial Sequence
  chemically synthesized
caccactttgggaggccgag

SEQ ID NO: 475830 - DNA, 20 bp, Artificial Sequence
  chemically synthesized
gcctcggcctcccaaagtgg

SEQ ID NO: 475831 - DNA, 20 bp, Artificial Sequence
  chemically synthesized
acagagaaaatcaagtgtag

SEQ ID NO: 475832 - DNA, 20 bp, Artificial Sequence
  chemically synthesized
aggtagttcagtcgatattt

SEQ ID NO: 475833 - DNA, 20 bp, Artificial Sequence
  chemically synthesized
atttatggatggaaacagag

SEQ ID NO: 475834 - DNA, 20 bp, Artificial Sequence
  chemically synthesized
aaatataagctataattcag

SEQ ID NO: 475835 - DNA, 20 bp, Artificial Sequence
  chemically synthesized
taagctataattcagaggaa

SEQ ID NO: 475836 - DNA, 20 bp, Artificial Sequence
  chemically synthesized
acttttggcattccattcct

SEQ ID NO: 475837 - DNA, 20 bp, Artificial Sequence
  chemically synthesized
aatggaatgccaaaagtaag

SEQ ID NO: 475838 - DNA, 20 bp, Artificial Sequence
  chemically synthesized
aatgccaaaagtaaggggag

SEQ ID NO: 475839 - DNA, 20 bp, Artificial Sequence
  chemically synthesized
tgattattattattttgaga

SEQ ID NO: 475840 - DNA, 20 bp, Artificial Sequence
  chemically synthesized
ttcgctcttgttgccccggc

SEQ ID NO: 475841 - DNA, 20 bp, Artificial Sequence
  chemically synthesized
ctcacagcaacctccgcctc

SEQ ID NO: 475842 - DNA, 20 bp, Artificial Sequence
  chemically synthesized
tactcgggaggctgaggcag

SEQ ID NO: 475843 - DNA, 20 bp, Artificial Sequence
  chemically synthesized
cattctcctgcctcagcctc

SEQ ID NO: 475844 - DNA, 20 bp, Artificial Sequence
  chemically synthesized
ttttgtatttttagtagaga

SEQ ID NO: 475845 - DNA, 20 bp, Artificial Sequence
  chemically synthesized
cgggtggatcacctgaggtc

SEQ ID NO: 475846 - DNA, 20 bp, Artificial Sequence
  chemically synthesized
actttgggaggccgaggcgg

SEQ ID NO: 475847 - DNA, 20 bp, Artificial Sequence
  chemically synthesized
cagcactttgggaggccgag

SEQ ID NO: 475848 - DNA, 20 bp, Artificial Sequence
  chemically synthesized
gcctcggcctcccaaagtgc

SEQ ID NO: 475849 - DNA, 20 bp, Artificial Sequence
  chemically synthesized
agcctgttcaattttaacaa

SEQ ID NO: 475850 - DNA, 20 bp, Artificial Sequence
  chemically synthesized
ctctttctttcttttttaga

SEQ ID NO: 475851 - DNA, 20 bp, Artificial Sequence
  chemically synthesized
gtctccctctctacccaggc

SEQ ID NO: 475852 - DNA, 20 bp, Artificial Sequence
  chemically synthesized
tcatgccactgcactccagc

SEQ ID NO: 475853 - DNA, 20 bp, Artificial Sequence
  chemically synthesized
ctcactgcaacctccacctc

SEQ ID NO: 475854 - DNA, 20 bp, Artificial Sequence
  chemically synthesized
tactcaggaggctgaggcag

SEQ ID NO: 475855 - DNA, 20 bp, Artificial Sequence
  chemically synthesized
gattctcctgcctcagcctc

SEQ ID NO: 475856 - DNA, 20 bp, Artificial Sequence
  chemically synthesized
gcctcagcctcctgagtagt

SEQ ID NO: 475857 - DNA, 20 bp, Artificial Sequence
  chemically synthesized
ttttgtatttttgattgaga

SEQ ID NO: 475858 - DNA, 20 bp, Artificial Sequence
  chemically synthesized
atctgctcacctcggcctcc

SEQ ID NO: 475859 - DNA, 20 bp, Artificial Sequence
  chemically synthesized
aatcctgatctttaaataga

SEQ ID NO: 475860 - DNA, 20 bp, Artificial Sequence
  chemically synthesized
taccctttctatttaaagat

SEQ ID NO: 475861 - DNA, 20 bp, Artificial Sequence
  chemically synthesized
cccaataaatacatagtgaa

SEQ ID NO: 475862 - DNA, 20 bp, Artificial Sequence
  chemically synthesized
gggttcccaataaatacata

SEQ ID NO: 475863 - DNA, 20 bp, Artificial Sequence
  chemically synthesized
ttgattatattacacatcta

SEQ ID NO: 475864 - DNA, 20 bp, Artificial Sequence
  chemically synthesized
caatagattatagaaaagaa

SEQ ID NO: 475865 - DNA, 20 bp, Artificial Sequence
  chemically synthesized
atttaatcctttccgccctg

SEQ ID NO: 475866 - DNA, 20 bp, Artificial Sequence
  chemically synthesized
ttacaacccagcagggcgga

SEQ ID NO: 475867 - DNA, 20 bp, Artificial Sequence
  chemically synthesized
atttgttctccctttataag

SEQ ID NO: 475868 - DNA, 20 bp, Artificial Sequence
  chemically synthesized
catggaccttgtaagacagg

SEQ ID NO: 475869 - DNA, 20 bp, Artificial Sequence
  chemically synthesized
ccttgtaagacaggtgggat

SEQ ID NO: 475870 - DNA, 20 bp, Artificial Sequence
  chemically synthesized
agttcctttaaaaaatgtct

SEQ ID NO: 475871 - DNA, 20 bp, Artificial Sequence
  chemically synthesized
agactgacaaatgcctttat

SEQ ID NO: 475872 - DNA, 20 bp, Artificial Sequence
  chemically synthesized
agagacatagagagcaaatt

SEQ ID NO: 475873 - DNA, 20 bp, Artificial Sequence
  chemically synthesized
tgtggtgtctttgtaaactc

SEQ ID NO: 475874 - DNA, 20 bp, Artificial Sequence
  chemically synthesized
tgtctttgtaaactcaaggg

SEQ ID NO: 475875 - DNA, 20 bp, Artificial Sequence
  chemically synthesized
aaagtccagaaatccaaccc

SEQ ID NO: 475876 - DNA, 20 bp, Artificial Sequence
  chemically synthesized
aaaatatccactttgaatta

SEQ ID NO: 475877 - DNA, 20 bp, Artificial Sequence
  chemically synthesized
aaaatattcagtaattcaaa

SEQ ID NO: 475878 - DNA, 20 bp, Artificial Sequence
  chemically synthesized
ttgcttttaaaatatccact

SEQ ID NO: 475879 - DNA, 20 bp, Artificial Sequence
  chemically synthesized
aaaaataaataagaaaacaa

SEQ ID NO: 475880 - DNA, 20 bp, Artificial Sequence
  chemically synthesized
caatttttattttagactca

SEQ ID NO: 475881 - DNA, 20 bp, Artificial Sequence
  chemically synthesized
taaacctgcacatgtacccc

SEQ ID NO: 475882 - DNA, 20 bp, Artificial Sequence
  chemically synthesized
tacatgtgcaggtttattac

SEQ ID NO: 475883 - DNA, 20 bp, Artificial Sequence
  chemically synthesized
tattgtgtgacactgaggtt

SEQ ID NO: 475884 - DNA, 20 bp, Artificial Sequence
  chemically synthesized
ttgaacctgtcacccaggta

SEQ ID NO: 475885 - DNA, 20 bp, Artificial Sequence
  chemically synthesized
tcgagtactatactcactac

SEQ ID NO: 475886 - DNA, 20 bp, Artificial Sequence
  chemically synthesized
agggctgaaaaaactaccta

SEQ ID NO: 475887 - DNA, 20 bp, Artificial Sequence
  chemically synthesized
ggcactagtgacaagggcag

SEQ ID NO: 475888 - DNA, 20 bp, Artificial Sequence
  chemically synthesized
gagctaacctttgggtacac

SEQ ID NO: 475889 - DNA, 20 bp, Artificial Sequence
  chemically synthesized
ttataagcaggagctaacct

SEQ ID NO: 475890 - DNA, 20 bp, Artificial Sequence
  chemically synthesized
tgtttctgctttaattcgct

SEQ ID NO: 475891 - DNA, 20 bp, Artificial Sequence
  chemically synthesized
actggaggtcattatcctaa

SEQ ID NO: 475892 - DNA, 20 bp, Artificial Sequence
  chemically synthesized
aacgtggcatatatgcacca

SEQ ID NO: 475893 - DNA, 20 bp, Artificial Sequence
  chemically synthesized
aggtgcccatcaatggtgga

SEQ ID NO: 475894 - DNA, 20 bp, Artificial Sequence
  chemically synthesized
aacctaggtgcccatcaatg

SEQ ID NO: 475895 - DNA, 20 bp, Artificial Sequence
  chemically synthesized
gactttatgtctttgctatt

SEQ ID NO: 475896 - DNA, 20 bp, Artificial Sequence
  chemically synthesized
gtagaaaaatttatatttct

SEQ ID NO: 475897 - DNA, 20 bp, Artificial Sequence
  chemically synthesized
cataccaagtaatggaagtg

SEQ ID NO: 475898 - DNA, 20 bp, Artificial Sequence
  chemically synthesized
tcttttttttttttttgaga

SEQ ID NO: 475899 - DNA, 20 bp, Artificial Sequence
  chemically synthesized
tcttgctctgttgcccaggc

SEQ ID NO: 475900 - DNA, 20 bp, Artificial Sequence
  chemically synthesized
ggttctcctgcctcagcctt

SEQ ID NO: 475901 - DNA, 20 bp, Artificial Sequence
  chemically synthesized
gcctcagccttccgagtaac

SEQ ID NO: 475902 - DNA, 20 bp, Artificial Sequence
  chemically synthesized
ttttgtatttttagtagaga

SEQ ID NO: 475903 - DNA, 20 bp, Artificial Sequence
  chemically synthesized
tgggtggatcacctgaggtt

SEQ ID NO: 475904 - DNA, 20 bp, Artificial Sequence
  chemically synthesized
actttgggaggtcgaggtgg

SEQ ID NO: 475905 - DNA, 20 bp, Artificial Sequence
  chemically synthesized
cagcactttgggaggtcgag

SEQ ID NO: 475906 - DNA, 20 bp, Artificial Sequence
  chemically synthesized
acctcgacctcccaaagtgc

SEQ ID NO: 475907 - DNA, 20 bp, Artificial Sequence
  chemically synthesized
aaactccaagaaaaaaatga

SEQ ID NO: 475908 - DNA, 20 bp, Artificial Sequence
  chemically synthesized
acacccggtcatttttttct

SEQ ID NO: 475909 - DNA, 20 bp, Artificial Sequence
  chemically synthesized
tctataaatgtcttgaatag

SEQ ID NO: 475910 - DNA, 20 bp, Artificial Sequence
  chemically synthesized
gtaagcattctataaatgtc

SEQ ID NO: 475911 - DNA, 20 bp, Artificial Sequence
  chemically synthesized
tcatctattcaagacattta

SEQ ID NO: 475912 - DNA, 20 bp, Artificial Sequence
  chemically synthesized
gctccataaggacagaggcc

SEQ ID NO: 475913 - DNA, 20 bp, Artificial Sequence
  chemically synthesized
tgaaagtctgtttcccctat

SEQ ID NO: 475914 - DNA, 20 bp, Artificial Sequence
  chemically synthesized
agtgctgtgaagaaagcaaa

SEQ ID NO: 475915 - DNA, 20 bp, Artificial Sequence
  chemically synthesized
tcatttgaagtaatggactg

SEQ ID NO: 475916 - DNA, 20 bp, Artificial Sequence
  chemically synthesized
agtatgtaaattgaataact

SEQ ID NO: 475917 - DNA, 20 bp, Artificial Sequence
  chemically synthesized
gtaaaattccagtatgtaaa

SEQ ID NO: 475918 - DNA, 20 bp, Artificial Sequence
  chemically synthesized
tagttattcaatttacatac

SEQ ID NO: 475919 - DNA, 20 bp, Artificial Sequence
  chemically synthesized
gaagcctgggactaactaaa

SEQ ID NO: 475920 - DNA, 20 bp, Artificial Sequence
  chemically synthesized
atttaaaacaaaagatatag

SEQ ID NO: 475921 - DNA, 20 bp, Artificial Sequence
  chemically synthesized
caaaagatatagatgaatag

SEQ ID NO: 475922 - DNA, 20 bp, Artificial Sequence
  chemically synthesized
atctgaaggatgaagacaag

SEQ ID NO: 475923 - DNA, 20 bp, Artificial Sequence
  chemically synthesized
tgacctttgaccgagatctg

SEQ ID NO: 475924 - DNA, 20 bp, Artificial Sequence
  chemically synthesized
tcaaaggtcacttttattgg

SEQ ID NO: 475925 - DNA, 20 bp, Artificial Sequence
  chemically synthesized
gtgtgcgcgcgcgctgcagt

SEQ ID NO: 475926 - DNA, 20 bp, Artificial Sequence
  chemically synthesized
aagaaaatacaggacactac

SEQ ID NO: 475927 - DNA, 20 bp, Artificial Sequence
  chemically synthesized
tcatggaggttatggtttct

SEQ ID NO: 475928 - DNA, 20 bp, Artificial Sequence
  chemically synthesized
cagagaaggtctgtctatga

SEQ ID NO: 475929 - DNA, 20 bp, Artificial Sequence
  chemically synthesized
caaactctgtttgagatgat

SEQ ID NO: 475930 - DNA, 20 bp, Artificial Sequence
  chemically synthesized
tgaatccctatcatctcaaa

SEQ ID NO: 475931 - DNA, 20 bp, Artificial Sequence
  chemically synthesized
atctcaaacagagtttggta

SEQ ID NO: 475932 - DNA, 20 bp, Artificial Sequence
  chemically synthesized
acaccagaaaaaaataatta

SEQ ID NO: 475933 - DNA, 20 bp, Artificial Sequence
  chemically synthesized
cagaaaaaaataattattga

SEQ ID NO: 475934 - DNA, 20 bp, Artificial Sequence
  chemically synthesized
gaatgaatgattgaacaaag

SEQ ID NO: 475935 - DNA, 20 bp, Artificial Sequence
  chemically synthesized
cttctgtaggaccaagaggg

SEQ ID NO: 475936 - DNA, 20 bp, Artificial Sequence
  chemically synthesized
tcactcttctgtaggaccaa

SEQ ID NO: 475937 - DNA, 20 bp, Artificial Sequence
  chemically synthesized
caaccctcttggtcctacag

SEQ ID NO: 475938 - DNA, 20 bp, Artificial Sequence
  chemically synthesized
atcattcacagactaaaaac

SEQ ID NO: 475939 - DNA, 20 bp, Artificial Sequence
  chemically synthesized
gtgattctagtttttagtct

SEQ ID NO: 475940 - DNA, 20 bp, Artificial Sequence
  chemically synthesized
gtctgtgaatgattcaggct

SEQ ID NO: 475941 - DNA, 20 bp, Artificial Sequence
  chemically synthesized
ttgcctgtttaactcagagc

SEQ ID NO: 475942 - DNA, 20 bp, Artificial Sequence
  chemically synthesized
gaatttcagaccacgatctc

SEQ ID NO: 475943 - DNA, 20 bp, Artificial Sequence
  chemically synthesized
atttaaagtaggagggttgt

SEQ ID NO: 475944 - DNA, 20 bp, Artificial Sequence
  chemically synthesized
gttgaggaaatttaaagtag

SEQ ID NO: 475945 - DNA, 20 bp, Artificial Sequence
  chemically synthesized
tgtcaggaatcacctggatc

SEQ ID NO: 475946 - DNA, 20 bp, Artificial Sequence
  chemically synthesized
attaatttgtcaggaatcac

SEQ ID NO: 475947 - DNA, 20 bp, Artificial Sequence
  chemically synthesized
ctcacatttattaatttgtc

SEQ ID NO: 475948 - DNA, 20 bp, Artificial Sequence
  chemically synthesized
cctgacaaattaataaatgt

SEQ ID NO: 475949 - DNA, 20 bp, Artificial Sequence
  chemically synthesized
gatgctgttctttttgttta

SEQ ID NO: 475950 - DNA, 20 bp, Artificial Sequence
  chemically synthesized
tgttctttttgtttaaaggg

SEQ ID NO: 475951 - DNA, 20 bp, Artificial Sequence
  chemically synthesized
tttaaagggtcgaatcataa

SEQ ID NO: 475952 - DNA, 20 bp, Artificial Sequence
  chemically synthesized
accactcctctgataaaaag

SEQ ID NO: 475953 - DNA, 20 bp, Artificial Sequence
  chemically synthesized
tcaattcaactttttatcag

SEQ ID NO: 475954 - DNA, 20 bp, Artificial Sequence
  chemically synthesized
aggagtggtactgcatagtt

SEQ ID NO: 475955 - DNA, 20 bp, Artificial Sequence
  chemically synthesized
gaacccagacagtctgcctg

SEQ ID NO: 475956 - DNA, 20 bp, Artificial Sequence
  chemically synthesized
agattccccaggcagactgt

SEQ ID NO: 475957 - DNA, 20 bp, Artificial Sequence
  chemically synthesized
tatcaggtaagtgagagagc

SEQ ID NO: 475958 - DNA, 20 bp, Artificial Sequence
  chemically synthesized
gttagaaaaatgaggagccc

SEQ ID NO: 475959 - DNA, 20 bp, Artificial Sequence
  chemically synthesized
ttaaaattgtacctccctca

SEQ ID NO: 475960 - DNA, 20 bp, Artificial Sequence
  chemically synthesized
atgcaaaagtgcttataatt

SEQ ID NO: 475961 - DNA, 20 bp, Artificial Sequence
  chemically synthesized
catatgactacattgattgt

SEQ ID NO: 475962 - DNA, 20 bp, Artificial Sequence
  chemically synthesized
aaaggctgtacttctgatat

SEQ ID NO: 475963 - DNA, 20 bp, Artificial Sequence
  chemically synthesized
taatttactaaaggagacgg

SEQ ID NO: 475964 - DNA, 20 bp, Artificial Sequence
  chemically synthesized
gaagtattatgataaactgt

SEQ ID NO: 475965 - DNA, 20 bp, Artificial Sequence
  chemically synthesized
ttaaaggtaaataccacaaa

SEQ ID NO: 475966 - DNA, 20 bp, Artificial Sequence
  chemically synthesized
tacctttaaaagtagcattt

SEQ ID NO: 475967 - DNA, 20 bp, Artificial Sequence
  chemically synthesized
ctagtttccattccccttta

SEQ ID NO: 475968 - DNA, 20 bp, Artificial Sequence
  chemically synthesized
ttaaagccaactccataaag

SEQ ID NO: 475969 - DNA, 20 bp, Artificial Sequence
  chemically synthesized
gcttctcatgtggcctgaaa

SEQ ID NO: 475970 - DNA, 20 bp, Artificial Sequence
  chemically synthesized
acattcctctagaaagtaga

SEQ ID NO: 475971 - DNA, 20 bp, Artificial Sequence
  chemically synthesized
ggattctttctactttctag

SEQ ID NO: 475972 - DNA, 20 bp, Artificial Sequence
  chemically synthesized
agaggaatgtgctgtgaagg

SEQ ID NO: 475973 - DNA, 20 bp, Artificial Sequence
  chemically synthesized
tgtgctgtgaaggaggagtc

SEQ ID NO: 475974 - DNA, 20 bp, Artificial Sequence
  chemically synthesized
catgtgagaacagcagctct

SEQ ID NO: 475975 - DNA, 20 bp, Artificial Sequence
  chemically synthesized
gaacagcagctctttgaatg

SEQ ID NO: 475976 - DNA, 20 bp, Artificial Sequence
  chemically synthesized
gaactgtgagcagctactgg

SEQ ID NO: 475977 - DNA, 20 bp, Artificial Sequence
  chemically synthesized
gtgcaaacaaatgcagaaga

SEQ ID NO: 475978 - DNA, 20 bp, Artificial Sequence
  chemically synthesized
atgcagaagaaagggtgggg

SEQ ID NO: 475979 - DNA, 20 bp, Artificial Sequence
  chemically synthesized
ggctgacctctctccttccc

SEQ ID NO: 475980 - DNA, 20 bp, Artificial Sequence
  chemically synthesized
caagaacacttacaagaaca

SEQ ID NO: 475981 - DNA, 20 bp, Artificial Sequence
  chemically synthesized
acaagggcaaatgtcagttg

SEQ ID NO: 475982 - DNA, 20 bp, Artificial Sequence
  chemically synthesized
tcatggcaattttaaatgcc

SEQ ID NO: 475983 - DNA, 20 bp, Artificial Sequence
  chemically synthesized
tttattattgtttttaaaaa

SEQ ID NO: 475984 - DNA, 20 bp, Artificial Sequence
  chemically synthesized
acaataataaacacacttac

SEQ ID NO: 475985 - DNA, 20 bp, Artificial Sequence
  chemically synthesized
aattaatactttataatgat

SEQ ID NO: 475986 - DNA, 20 bp, Artificial Sequence
  chemically synthesized
agaaatatttatgaatttaa

SEQ ID NO: 475987 - DNA, 20 bp, Artificial Sequence
  chemically synthesized
caggagccaaagaaatattt

SEQ ID NO: 475988 - DNA, 20 bp, Artificial Sequence
  chemically synthesized
aattatatgaagtataaaat

SEQ ID NO: 475989 - DNA, 20 bp, Artificial Sequence
  chemically synthesized
ggggataaatgaacgatgta

SEQ ID NO: 475990 - DNA, 20 bp, Artificial Sequence
  chemically synthesized
caggatgtgtgaaactacag

SEQ ID NO: 475991 - DNA, 20 bp, Artificial Sequence
  chemically synthesized
ttttttttttttgaaggcat

SEQ ID NO: 475992 - DNA, 20 bp, Artificial Sequence
  chemically synthesized
gccttcaaaaaaaaaaaata

SEQ ID NO: 475993 - DNA, 20 bp, Artificial Sequence
  chemically synthesized
aagaatggtctggttttcaa

SEQ ID NO: 475994 - DNA, 20 bp, Artificial Sequence
  chemically synthesized
aaaccagaccattcttctcc

SEQ ID NO: 475995 - DNA, 20 bp, Artificial Sequence
  chemically synthesized
tgtctttctcaccctaggag

SEQ ID NO: 475996 - DNA, 20 bp, Artificial Sequence
  chemically synthesized
agggtgagaaagacagactc

SEQ ID NO: 475997 - DNA, 20 bp, Artificial Sequence
  chemically synthesized
ctaatatggcccaaatattc

SEQ ID NO: 475998 - DNA, 20 bp, Artificial Sequence
  chemically synthesized
ctttgacctcagtatgctct

SEQ ID NO: 475999 - DNA, 20 bp, Artificial Sequence
  chemically synthesized
cctttaaagaattgaagaag

SEQ ID NO: 476000 - DNA, 20 bp, Artificial Sequence
  chemically synthesized
tctccttcttcaattcttta

SEQ ID NO: 476001 - DNA, 20 bp, Artificial Sequence
  chemically synthesized
gatgtaaacaaaacccttta

SEQ ID NO: 476002 - DNA, 20 bp, Artificial Sequence
  chemically synthesized
ctcaactctgttaggaaaaa

SEQ ID NO: 476003 - DNA, 20 bp, Artificial Sequence
  chemically synthesized
ttacatcctttttttcctaa

SEQ ID NO: 476004 - DNA, 20 bp, Artificial Sequence
  chemically synthesized
aaacatcttttcagtaagga

SEQ ID NO: 476005 - DNA, 20 bp, Artificial Sequence
  chemically synthesized
aacttaattgtccttttttc

SEQ ID NO: 476006 - DNA, 20 bp, Artificial Sequence
  chemically synthesized
ggatttgttgatattaggaa

SEQ ID NO: 476007 - DNA, 20 bp, Artificial Sequence
  chemically synthesized
cagaaggatttgttgatatt

SEQ ID NO: 476008 - DNA, 20 bp, Artificial Sequence
  chemically synthesized
ttgaaaaggttaggtcacag

SEQ ID NO: 476009 - DNA, 20 bp, Artificial Sequence
  chemically synthesized
agtctgatgtgcccactggc

SEQ ID NO: 476010 - DNA, 20 bp, Artificial Sequence
  chemically synthesized
cataagagcaacctatagtt

SEQ ID NO: 476011 - DNA, 20 bp, Artificial Sequence
  chemically synthesized
gaatgttattgagaaataca

SEQ ID NO: 476012 - DNA, 20 bp, Artificial Sequence
  chemically synthesized
caataacattccaaaaactg

SEQ ID NO: 476013 - DNA, 20 bp, Artificial Sequence
  chemically synthesized
tgtggcaattctccagtttt

SEQ ID NO: 476014 - DNA, 20 bp, Artificial Sequence
  chemically synthesized
catcaagcattgtctgtagc

SEQ ID NO: 476015 - DNA, 20 bp, Artificial Sequence
  chemically synthesized
cattcccaaactacagatga

SEQ ID NO: 476016 - DNA, 20 bp, Artificial Sequence
  chemically synthesized
aactctatcatctgtagttt

SEQ ID NO: 476017 - DNA, 20 bp, Artificial Sequence
  chemically synthesized
ctatcatctgtagtttggga

SEQ ID NO: 476018 - DNA, 20 bp, Artificial Sequence
  chemically synthesized
ctgggagcatgatagaaatg

SEQ ID NO: 476019 - DNA, 20 bp, Artificial Sequence
  chemically synthesized
ccgcccccagaaatttagta

SEQ ID NO: 476020 - DNA, 20 bp, Artificial Sequence
  chemically synthesized
ccgatactaaatttctgggg

SEQ ID NO: 476021 - DNA, 20 bp, Artificial Sequence
  chemically synthesized
tttcaaaatctagcatggat

SEQ ID NO: 476022 - DNA, 20 bp, Artificial Sequence
  chemically synthesized
aaaagttttcaaaatctagc

SEQ ID NO: 476023 - DNA, 20 bp, Artificial Sequence
  chemically synthesized
tagcactcattatatttctg

SEQ ID NO: 476024 - DNA, 20 bp, Artificial Sequence
  chemically synthesized
tgctatccaacagaaatata

SEQ ID NO: 476025 - DNA, 20 bp, Artificial Sequence
  chemically synthesized
cttggttatttttcttgaaa

SEQ ID NO: 476026 - DNA, 20 bp, Artificial Sequence
  chemically synthesized
ttcaagaaaaataaccaagt

SEQ ID NO: 476027 - DNA, 20 bp, Artificial Sequence
  chemically synthesized
agtttgaataatcataataa

SEQ ID NO: 476028 - DNA, 20 bp, Artificial Sequence
  chemically synthesized
tgcttgggtaaaatgtcata

SEQ ID NO: 476029 - DNA, 20 bp, Artificial Sequence
  chemically synthesized
tagtatttttatgtatttgc

SEQ ID NO: 476030 - DNA, 20 bp, Artificial Sequence
  chemically synthesized
caaagacttagtaccaaaaa

SEQ ID NO: 476031 - DNA, 20 bp, Artificial Sequence
  chemically synthesized
ttatatatatatatatatat

SEQ ID NO: 476032 - DNA, 20 bp, Artificial Sequence
  chemically synthesized
gaaacacaatttgctgctat

SEQ ID NO: 476033 - DNA, 20 bp, Artificial Sequence
  chemically synthesized
tagcagcaaattgtgtttct

SEQ ID NO: 476034 - DNA, 20 bp, Artificial Sequence
  chemically synthesized
ggaagataaagggaaacgtg

SEQ ID NO: 476035 - DNA, 20 bp, Artificial Sequence
  chemically synthesized
ggaggagtgttcaagtgctg

SEQ ID NO: 476036 - DNA, 20 bp, Artificial Sequence
  chemically synthesized
acttgaacactcctccaaca

SEQ ID NO: 476037 - DNA, 20 bp, Artificial Sequence
  chemically synthesized
tcccaaaaactctgtgttgg

SEQ ID NO: 476038 - DNA, 20 bp, Artificial Sequence
  chemically synthesized
ctcctccaacacagagtttt

SEQ ID NO: 476039 - DNA, 20 bp, Artificial Sequence
  chemically synthesized
ggcattatacttaatttccc

SEQ ID NO: 476040 - DNA, 20 bp, Artificial Sequence
  chemically synthesized
gacttctgtaagacactgtg

SEQ ID NO: 476041 - DNA, 20 bp, Artificial Sequence
  chemically synthesized
acaagtacttaacatagaac

SEQ ID NO: 476042 - DNA, 20 bp, Artificial Sequence
  chemically synthesized
ttcaagtgaggctaatgctg

SEQ ID NO: 476043 - DNA, 20 bp, Artificial Sequence
  chemically synthesized
gtgggtctggtgtggagctt

SEQ ID NO: 476044 - DNA, 20 bp, Artificial Sequence
  chemically synthesized
caagctccacaccagaccca

SEQ ID NO: 476045 - DNA, 20 bp, Artificial Sequence
  chemically synthesized
accaagtttcaaatgattca

SEQ ID NO: 476046 - DNA, 20 bp, Artificial Sequence
  chemically synthesized
tgttttaataagccttccag

SEQ ID NO: 476047 - DNA, 20 bp, Artificial Sequence
  chemically synthesized
taggaaaacatatttatttg

SEQ ID NO: 476048 - DNA, 20 bp, Artificial Sequence
  chemically synthesized
ctcatatttatcattttctc

SEQ ID NO: 476049 - DNA, 20 bp, Artificial Sequence
  chemically synthesized
ttctgtggtagaaccacaag

SEQ ID NO: 476050 - DNA, 20 bp, Artificial Sequence
  chemically synthesized
atgtcggcctatcactaact

SEQ ID NO: 476051 - DNA, 20 bp, Artificial Sequence
  chemically synthesized
gtactaatcattttgcatta

SEQ ID NO: 476052 - DNA, 20 bp, Artificial Sequence
  chemically synthesized
ataatgcaaaatgattagta

SEQ ID NO: 476053 - DNA, 20 bp, Artificial Sequence
  chemically synthesized
aaaatctgtcaacacattta

SEQ ID NO: 476054 - DNA, 20 bp, Artificial Sequence
  chemically synthesized
gttcttaccatcattgagca

SEQ ID NO: 476055 - DNA, 20 bp, Artificial Sequence
  chemically synthesized
tattctttactttggtgaga

SEQ ID NO: 476056 - DNA, 20 bp, Artificial Sequence
  chemically synthesized
aatcctatctcaccaaagta

SEQ ID NO: 476057 - DNA, 20 bp, Artificial Sequence
  chemically synthesized
aatataaatggttctgatat

SEQ ID NO: 476058 - DNA, 20 bp, Artificial Sequence
  chemically synthesized
atcatagttagctaaacaat

SEQ ID NO: 476059 - DNA, 20 bp, Artificial Sequence
  chemically synthesized
agctttgtgagaggatgtga

SEQ ID NO: 476060 - DNA, 20 bp, Artificial Sequence
  chemically synthesized
catagtagtaagctttgtga

SEQ ID NO: 476061 - DNA, 20 bp, Artificial Sequence
  chemically synthesized
aagtttccagtaagaaatta

SEQ ID NO: 476062 - DNA, 20 bp, Artificial Sequence
  chemically synthesized
tttgtaaaccagagataata

SEQ ID NO: 476063 - DNA, 20 bp, Artificial Sequence
  chemically synthesized
tctggtttttaacactgaga

SEQ ID NO: 476064 - DNA, 20 bp, Artificial Sequence
  chemically synthesized
taacactgagaaaggatgag

SEQ ID NO: 476065 - DNA, 20 bp, Artificial Sequence
  chemically synthesized
tattaagtaaagctttaaag

SEQ ID NO: 476066 - DNA, 20 bp, Artificial Sequence
  chemically synthesized
aatatagcataagcagtaaa

SEQ ID NO: 476067 - DNA, 20 bp, Artificial Sequence
  chemically synthesized
tagtatgtccttggaccaaa

SEQ ID NO: 476068 - DNA, 20 bp, Artificial Sequence
  chemically synthesized
agatgctcaatcagtgctga

SEQ ID NO: 476069 - DNA, 20 bp, Artificial Sequence
  chemically synthesized
ctgactgaatgaaagaacaa

SEQ ID NO: 476070 - DNA, 20 bp, Artificial Sequence
  chemically synthesized
aagaacaaagggatgaaaga

SEQ ID NO: 476071 - DNA, 20 bp, Artificial Sequence
  chemically synthesized
ctgtggtaacttgctgtcgc

SEQ ID NO: 476072 - DNA, 20 bp, Artificial Sequence
  chemically synthesized
ttaccacagaggtatacaga

SEQ ID NO: 476073 - DNA, 20 bp, Artificial Sequence
  chemically synthesized
actgttctttgacatatgta

SEQ ID NO: 476074 - DNA, 20 bp, Artificial Sequence
  chemically synthesized
aatgcaaacacctttaaaat

SEQ ID NO: 476075 - DNA, 20 bp, Artificial Sequence
  chemically synthesized
tttaaaggtgtttgcattcc

SEQ ID NO: 476076 - DNA, 20 bp, Artificial Sequence
  chemically synthesized
ttattgactgtaggaactca

SEQ ID NO: 476077 - DNA, 20 bp, Artificial Sequence
  chemically synthesized
tgcaaaaacactttaacata

SEQ ID NO: 476078 - DNA, 20 bp, Artificial Sequence
  chemically synthesized
ttgcagcttttgtgctattt

SEQ ID NO: 476079 - DNA, 20 bp, Artificial Sequence
  chemically synthesized
tgctatttgtgggtttactc

SEQ ID NO: 476080 - DNA, 20 bp, Artificial Sequence
  chemically synthesized
tataccatttttctttactc

SEQ ID NO: 476081 - DNA, 20 bp, Artificial Sequence
  chemically synthesized
caagcgcaagtagtatataa

SEQ ID NO: 476082 - DNA, 20 bp, Artificial Sequence
  chemically synthesized
ttatatactacttgcgcttg

SEQ ID NO: 476083 - DNA, 20 bp, Artificial Sequence
  chemically synthesized
attttgaaatagtacacaca

SEQ ID NO: 476084 - DNA, 20 bp, Artificial Sequence
  chemically synthesized
taatatttgaccaagtagaa

SEQ ID NO: 476085 - DNA, 20 bp, Artificial Sequence
  chemically synthesized
atcagccaaaagtgatttca

SEQ ID NO: 476086 - DNA, 20 bp, Artificial Sequence
  chemically synthesized
ggctgattttagtacaattg

SEQ ID NO: 476087 - DNA, 20 bp, Artificial Sequence
  chemically synthesized
gctgagttctaaaggcaatg

SEQ ID NO: 476088 - DNA, 20 bp, Artificial Sequence
  chemically synthesized
tgaaacaagtgtgatttcta

SEQ ID NO: 476089 - DNA, 20 bp, Artificial Sequence
  chemically synthesized
tttctaaggggtacactgaa

SEQ ID NO: 476090 - DNA, 20 bp, Artificial Sequence
  chemically synthesized
aatcttccttttataaacca

SEQ ID NO: 476091 - DNA, 20 bp, Artificial Sequence
  chemically synthesized
atttaaaagttaatatacct

SEQ ID NO: 476092 - DNA, 20 bp, Artificial Sequence
  chemically synthesized
tcttgctctgttgcccaggc

SEQ ID NO: 476093 - DNA, 20 bp, Artificial Sequence
  chemically synthesized
cttactgcaacatccgcctc

SEQ ID NO: 476094 - DNA, 20 bp, Artificial Sequence
  chemically synthesized
gaatcgcttgaacccgggag

SEQ ID NO: 476095 - DNA, 20 bp, Artificial Sequence
  chemically synthesized
tacttgggaagctgaggcag

SEQ ID NO: 476096 - DNA, 20 bp, Artificial Sequence
  chemically synthesized
actaaaaatacaaaaattag

SEQ ID NO: 476097 - DNA, 20 bp, Artificial Sequence
  chemically synthesized
ttttgtatttttagtagtga

SEQ ID NO: 476098 - DNA, 20 bp, Artificial Sequence
  chemically synthesized
cgggtggatcacttgagatc

SEQ ID NO: 476099 - DNA, 20 bp, Artificial Sequence
  chemically synthesized
actttgggagggtgaggcgg

SEQ ID NO: 476100 - DNA, 20 bp, Artificial Sequence
  chemically synthesized
cagtactttgggagggtgag

SEQ ID NO: 476101 - DNA, 20 bp, Artificial Sequence
  chemically synthesized
ctgtaatcccagtactttgg

SEQ ID NO: 476102 - DNA, 20 bp, Artificial Sequence
  chemically synthesized
gcctcaccctcccaaagtac

SEQ ID NO: 476103 - DNA, 20 bp, Artificial Sequence
  chemically synthesized
acttaacaaagcaataatgg

SEQ ID NO: 476104 - DNA, 20 bp, Artificial Sequence
  chemically synthesized
tttgttaagtccaaacgtaa

SEQ ID NO: 476105 - DNA, 20 bp, Artificial Sequence
  chemically synthesized
agaggagacaaaaagagcat

SEQ ID NO: 476106 - DNA, 20 bp, Artificial Sequence
  chemically synthesized
taacttgtatcagtcaagat

SEQ ID NO: 476107 - DNA, 20 bp, Artificial Sequence
  chemically synthesized
cggtttccttacacgtaaaa

SEQ ID NO: 476108 - DNA, 20 bp, Artificial Sequence
  chemically synthesized
aggttgtgattcttagatga

SEQ ID NO: 476109 - DNA, 20 bp, Artificial Sequence
  chemically synthesized
tcatgtgcattctctcatct

SEQ ID NO: 476110 - DNA, 20 bp, Artificial Sequence
  chemically synthesized
gaggactttttctaactgca

SEQ ID NO: 476111 - DNA, 20 bp, Artificial Sequence
  chemically synthesized
gcctgtttgaaattttctgt

SEQ ID NO: 476112 - DNA, 20 bp, Artificial Sequence
  chemically synthesized
tagagaattccaaactgact

SEQ ID NO: 476113 - DNA, 20 bp, Artificial Sequence
  chemically synthesized
tagaagattcaaagtcagtt

SEQ ID NO: 476114 - DNA, 20 bp, Artificial Sequence
  chemically synthesized
gtatagaatcataatgtata

SEQ ID NO: 476115 - DNA, 20 bp, Artificial Sequence
  chemically synthesized
agtcacaatttacctatgta

SEQ ID NO: 476116 - DNA, 20 bp, Artificial Sequence
  chemically synthesized
tatacataggtaaattgtga

SEQ ID NO: 476117 - DNA, 20 bp, Artificial Sequence
  chemically synthesized
caaaatggtgaaaccagtta

SEQ ID NO: 476118 - DNA, 20 bp, Artificial Sequence
  chemically synthesized
tggctttccttgaaaattaa

SEQ ID NO: 476119 - DNA, 20 bp, Artificial Sequence
  chemically synthesized
tttccttgaaaattaaatga

SEQ ID NO: 476120 - DNA, 20 bp, Artificial Sequence
  chemically synthesized
aatggataatgcaaagaacc

SEQ ID NO: 476121 - DNA, 20 bp, Artificial Sequence
  chemically synthesized
ctacttgatatcagaatatc

SEQ ID NO: 476122 - DNA, 20 bp, Artificial Sequence
  chemically synthesized
aggccgtgtctacttgatat

SEQ ID NO: 476123 - DNA, 20 bp, Artificial Sequence
  chemically synthesized
aaatagtataatagaaagat

SEQ ID NO: 476124 - DNA, 20 bp, Artificial Sequence
  chemically synthesized
tgtaaacctgagaaaagaag

SEQ ID NO: 476125 - DNA, 20 bp, Artificial Sequence
  chemically synthesized
ataaaataaaaatagagaac

SEQ ID NO: 476126 - DNA, 20 bp, Artificial Sequence
  chemically synthesized
attttattttatttttgaga

SEQ ID NO: 476127 - DNA, 20 bp, Artificial Sequence
  chemically synthesized
tctggctctgtcgcccaggc

SEQ ID NO: 476128 - DNA, 20 bp, Artificial Sequence
  chemically synthesized
tactctggaggctgaggcag

SEQ ID NO: 476129 - DNA, 20 bp, Artificial Sequence
  chemically synthesized
aattctcctgcctcagcctc

SEQ ID NO: 476130 - DNA, 20 bp, Artificial Sequence
  chemically synthesized
gcctcagcctccagagtagc

SEQ ID NO: 476131 - DNA, 20 bp, Artificial Sequence
  chemically synthesized
actaaaaatacaaaacttac

SEQ ID NO: 476132 - DNA, 20 bp, Artificial Sequence
  chemically synthesized
caggcggatcacttgaggtc

SEQ ID NO: 476133 - DNA, 20 bp, Artificial Sequence
  chemically synthesized
actttgggaggccgaggcag

SEQ ID NO: 476134 - DNA, 20 bp, Artificial Sequence
  chemically synthesized
gcctcggcctcccaaagtgc

SEQ ID NO: 476135 - DNA, 20 bp, Artificial Sequence
  chemically synthesized
ggcgtgagccaccatgccca

SEQ ID NO: 476136 - DNA, 20 bp, Artificial Sequence
  chemically synthesized
gacatatttctatgaaaata

SEQ ID NO: 476137 - DNA, 20 bp, Artificial Sequence
  chemically synthesized
caagcttcccgccatagaac

SEQ ID NO: 476138 - DNA, 20 bp, Artificial Sequence
  chemically synthesized
taaatataaaatattctcaa

SEQ ID NO: 476139 - DNA, 20 bp, Artificial Sequence
  chemically synthesized
agcaattcatacatcctgtt

SEQ ID NO: 476140 - DNA, 20 bp, Artificial Sequence
  chemically synthesized
aaatattctcaacaggatgt

SEQ ID NO: 476141 - DNA, 20 bp, Artificial Sequence
  chemically synthesized
gcctcacatttataatgtag

SEQ ID NO: 476142 - DNA, 20 bp, Artificial Sequence
  chemically synthesized
gcagaattactatcaaagaa

SEQ ID NO: 476143 - DNA, 20 bp, Artificial Sequence
  chemically synthesized
aggttttggtttgcatataa

SEQ ID NO: 476144 - DNA, 20 bp, Artificial Sequence
  chemically synthesized
gttatatgcaaaccaaaacc

SEQ ID NO: 476145 - DNA, 20 bp, Artificial Sequence
  chemically synthesized
taggagaaggctgtgtatat

SEQ ID NO: 476146 - DNA, 20 bp, Artificial Sequence
  chemically synthesized
gggaagaagagattaaaagt

SEQ ID NO: 476147 - DNA, 20 bp, Artificial Sequence
  chemically synthesized
caacaaaccacatttgtatt

SEQ ID NO: 476148 - DNA, 20 bp, Artificial Sequence
  chemically synthesized
tgggggagatacacatttga

SEQ ID NO: 476149 - DNA, 20 bp, Artificial Sequence
  chemically synthesized
ctcccccagatatctagaga

SEQ ID NO: 476150 - DNA, 20 bp, Artificial Sequence
  chemically synthesized
ttctgcattttaaaaatgag

SEQ ID NO: 476151 - DNA, 20 bp, Artificial Sequence
  chemically synthesized
atgatatagcgaaaagagca

SEQ ID NO: 476152 - DNA, 20 bp, Artificial Sequence
  chemically synthesized
ccaagtttttactcattgta

SEQ ID NO: 476153 - DNA, 20 bp, Artificial Sequence
  chemically synthesized
ctatgtagccattctttaca

SEQ ID NO: 476154 - DNA, 20 bp, Artificial Sequence
  chemically synthesized
atgcaaataaatagtgcaac

SEQ ID NO: 476155 - DNA, 20 bp, Artificial Sequence
  chemically synthesized
aaataaatagtgcaactaga

SEQ ID NO: 476156 - DNA, 20 bp, Artificial Sequence
  chemically synthesized
tagatttccaaatgaggtca

SEQ ID NO: 476157 - DNA, 20 bp, Artificial Sequence
  chemically synthesized
ttataatttcttttagagag

SEQ ID NO: 476158 - DNA, 20 bp, Artificial Sequence
  chemically synthesized
cttaagatgaaaaacatact

SEQ ID NO: 476159 - DNA, 20 bp, Artificial Sequence
  chemically synthesized
ctctgtttgctccatagtag

SEQ ID NO: 476160 - DNA, 20 bp, Artificial Sequence
  chemically synthesized
cgatgccacttataacaatc

SEQ ID NO: 476161 - DNA, 20 bp, Artificial Sequence
  chemically synthesized
tcaggactatccatcacaac

SEQ ID NO: 476162 - DNA, 20 bp, Artificial Sequence
  chemically synthesized
ataatttaattcttgttgtg

SEQ ID NO: 476163 - DNA, 20 bp, Artificial Sequence
  chemically synthesized
atgtgagatctcaagaggtc

SEQ ID NO: 476164 - DNA, 20 bp, Artificial Sequence
  chemically synthesized
tgtgattgagaggcctgtta

SEQ ID NO: 476165 - DNA, 20 bp, Artificial Sequence
  chemically synthesized
ttcctattgtcagtccattt

SEQ ID NO: 476166 - DNA, 20 bp, Artificial Sequence
  chemically synthesized
aaggtatgcctctgaggaaa

SEQ ID NO: 476167 - DNA, 20 bp, Artificial Sequence
  chemically synthesized
tccaattttctcctttccaa

SEQ ID NO: 476168 - DNA, 20 bp, Artificial Sequence
  chemically synthesized
ttagtttaaccgtagaatta

SEQ ID NO: 476169 - DNA, 20 bp, Artificial Sequence
  chemically synthesized
ccctaaaattagtttaaccg

SEQ ID NO: 476170 - DNA, 20 bp, Artificial Sequence
  chemically synthesized
ttctacggttaaactaattt

SEQ ID NO: 476171 - DNA, 20 bp, Artificial Sequence
  chemically synthesized
ttaaactaattttagggttt

SEQ ID NO: 476172 - DNA, 20 bp, Artificial Sequence
  chemically synthesized
cactacaaccattactctgc

SEQ ID NO: 476173 - DNA, 20 bp, Artificial Sequence
  chemically synthesized
atcgaatgagttaattcatg

SEQ ID NO: 476174 - DNA, 20 bp, Artificial Sequence
  chemically synthesized
catggttactgtaacatcga

SEQ ID NO: 476175 - DNA, 20 bp, Artificial Sequence
  chemically synthesized
ctaacatggttactgtaaca

SEQ ID NO: 476176 - DNA, 20 bp, Artificial Sequence
  chemically synthesized
ttacagtaaccatgttagag

SEQ ID NO: 476177 - DNA, 20 bp, Artificial Sequence
  chemically synthesized
tttggaatccaacatattag

SEQ ID NO: 476178 - DNA, 20 bp, Artificial Sequence
  chemically synthesized
aaggtcactcagctaatatg

SEQ ID NO: 476179 - DNA, 20 bp, Artificial Sequence
  chemically synthesized
ttattacagtacacaggttt

SEQ ID NO: 476180 - DNA, 20 bp, Artificial Sequence
  chemically synthesized
ataataacaacatcaagagc

SEQ ID NO: 476181 - DNA, 20 bp, Artificial Sequence
  chemically synthesized
acatcaagagctagaatttg

SEQ ID NO: 476182 - DNA, 20 bp, Artificial Sequence
  chemically synthesized
aatatcagtttattattagg

SEQ ID NO: 476183 - DNA, 20 bp, Artificial Sequence
  chemically synthesized
ctgcaatatcagtttattat

SEQ ID NO: 476184 - DNA, 20 bp, Artificial Sequence
  chemically synthesized
aataataaactgatattgca

SEQ ID NO: 476185 - DNA, 20 bp, Artificial Sequence
  chemically synthesized
ttccacatgtaagtttgtga

SEQ ID NO: 476186 - DNA, 20 bp, Artificial Sequence
  chemically synthesized
tttagaatcctaatttaaac

SEQ ID NO: 476187 - DNA, 20 bp, Artificial Sequence
  chemically synthesized
ctattgactcttgtttaaat

SEQ ID NO: 476188 - DNA, 20 bp, Artificial Sequence
  chemically synthesized
ctcaaaaacatctttccctt

SEQ ID NO: 476189 - DNA, 20 bp, Artificial Sequence
  chemically synthesized
ctaaagggaaagatgttttt

SEQ ID NO: 476190 - DNA, 20 bp, Artificial Sequence
  chemically synthesized
tttttgagaatccaagcagt

SEQ ID NO: 476191 - DNA, 20 bp, Artificial Sequence
  chemically synthesized
ttcctttgtactcttactgc

SEQ ID NO: 476192 - DNA, 20 bp, Artificial Sequence
  chemically synthesized
gctgaatcatgatggaagat

SEQ ID NO: 476193 - DNA, 20 bp, Artificial Sequence
  chemically synthesized
acgataaacagaaaataatg

SEQ ID NO: 476194 - DNA, 20 bp, Artificial Sequence
  chemically synthesized
cattattttctgtttatcgt

SEQ ID NO: 476195 - DNA, 20 bp, Artificial Sequence
  chemically synthesized
atcgtaagaatactgctaca

SEQ ID NO: 476196 - DNA, 20 bp, Artificial Sequence
  chemically synthesized
agaatactgctacacagagt

SEQ ID NO: 476197 - DNA, 20 bp, Artificial Sequence
  chemically synthesized
gggggatcagatttcaacac

SEQ ID NO: 476198 - DNA, 20 bp, Artificial Sequence
  chemically synthesized
taggcctcaccaccaacacg

SEQ ID NO: 476199 - DNA, 20 bp, Artificial Sequence
  chemically synthesized
tgaggcctagtggaaggtgt

SEQ ID NO: 476200 - DNA, 20 bp, Artificial Sequence
  chemically synthesized
gtggaaggtgtctgggttgt

SEQ ID NO: 476201 - DNA, 20 bp, Artificial Sequence
  chemically synthesized
aaggtgtctgggttgtagga

SEQ ID NO: 476202 - DNA, 20 bp, Artificial Sequence
  chemically synthesized
gttgtaggagtgaatccctc

SEQ ID NO: 476203 - DNA, 20 bp, Artificial Sequence
  chemically synthesized
atggcaccaaaccattcatg

SEQ ID NO: 476204 - DNA, 20 bp, Artificial Sequence
  chemically synthesized
aaaacctcgctcactaccgt

SEQ ID NO: 476205 - DNA, 20 bp, Artificial Sequence
  chemically synthesized
gctcccctttgccttctgcc

SEQ ID NO: 476206 - DNA, 20 bp, Artificial Sequence
  chemically synthesized
caaataaacacctgttcttt

SEQ ID NO: 476207 - DNA, 20 bp, Artificial Sequence
  chemically synthesized
ctataaaagaatacttgggg

SEQ ID NO: 476208 - DNA, 20 bp, Artificial Sequence
  chemically synthesized
tctgtttagtgttgctataa

SEQ ID NO: 476209 - DNA, 20 bp, Artificial Sequence
  chemically synthesized
taatttgaaaatgtttagat

SEQ ID NO: 476210 - DNA, 20 bp, Artificial Sequence
  chemically synthesized
catggtaatatttgtgagga

SEQ ID NO: 476211 - DNA, 20 bp, Artificial Sequence
  chemically synthesized
atgttcatggtaatatttgt

SEQ ID NO: 476212 - DNA, 20 bp, Artificial Sequence
  chemically synthesized
catctggtgttcaggtcttc

SEQ ID NO: 476213 - DNA, 20 bp, Artificial Sequence
  chemically synthesized
ctgaggttatacggtgagag

SEQ ID NO: 476214 - DNA, 20 bp, Artificial Sequence
  chemically synthesized
tcaaaagcaaattggaagat

SEQ ID NO: 476215 - DNA, 20 bp, Artificial Sequence
  chemically synthesized
atacctgggcttattctctt

SEQ ID NO: 476216 - DNA, 20 bp, Artificial Sequence
  chemically synthesized
tactggcactgcaccctaaa

SEQ ID NO: 476217 - DNA, 20 bp, Artificial Sequence
  chemically synthesized
tgtttgctctatgctacggt

SEQ ID NO: 476218 - DNA, 20 bp, Artificial Sequence
  chemically synthesized
attttttaggatttcaacat

SEQ ID NO: 476219 - DNA, 20 bp, Artificial Sequence
  chemically synthesized
ttcgtttcctttttattttt

SEQ ID NO: 476220 - DNA, 20 bp, Artificial Sequence
  chemically synthesized
gcctttagggaggtgatttt

SEQ ID NO: 476221 - DNA, 20 bp, Artificial Sequence
  chemically synthesized
gctagctcctttcagcatgt

SEQ ID NO: 476222 - DNA, 20 bp, Artificial Sequence
  chemically synthesized
gtgagaaggtgctttgtatg

SEQ ID NO: 476223 - DNA, 20 bp, Artificial Sequence
  chemically synthesized
tataatagaaatgccataaa

SEQ ID NO: 476224 - DNA, 20 bp, Artificial Sequence
  chemically synthesized
cttgtggtagtattataaca

SEQ ID NO: 476225 - DNA, 20 bp, Artificial Sequence
  chemically synthesized
caatggatatttgttaatgg

SEQ ID NO: 476226 - DNA, 20 bp, Artificial Sequence
  chemically synthesized
gaaataaaatcagtttatgt

SEQ ID NO: 476227 - DNA, 20 bp, Artificial Sequence
  chemically synthesized
ctactggcctcataggattg

SEQ ID NO: 476228 - DNA, 20 bp, Artificial Sequence
  chemically synthesized
ttctccaactactggcctca

SEQ ID NO: 476229 - DNA, 20 bp, Artificial Sequence
  chemically synthesized
tcctatgaggccagtagttg

SEQ ID NO: 476230 - DNA, 20 bp, Artificial Sequence
  chemically synthesized
tgttttctcatgtataaaat

SEQ ID NO: 476231 - DNA, 20 bp, Artificial Sequence
  chemically synthesized
acaaaccttgccaagctctc

SEQ ID NO: 476232 - DNA, 20 bp, Artificial Sequence
  chemically synthesized
tgggtaaaaattgaggaacc

SEQ ID NO: 476233 - DNA, 20 bp, Artificial Sequence
  chemically synthesized
tatgcaggtttgcctgcctc

SEQ ID NO: 476234 - DNA, 20 bp, Artificial Sequence
  chemically synthesized
aagcatataacataatagtt

SEQ ID NO: 476235 - DNA, 20 bp, Artificial Sequence
  chemically synthesized
tatgcttcccctaagaaatt

SEQ ID NO: 476236 - DNA, 20 bp, Artificial Sequence
  chemically synthesized
ttcttgttactttgccaatc

SEQ ID NO: 476237 - DNA, 20 bp, Artificial Sequence
  chemically synthesized
acaagaaaaatatattgctg

SEQ ID NO: 476238 - DNA, 20 bp, Artificial Sequence
  chemically synthesized
gttgtgacatgagtagaatt

SEQ ID NO: 476239 - DNA, 20 bp, Artificial Sequence
  chemically synthesized
atttctggttgtgacatgag

SEQ ID NO: 476240 - DNA, 20 bp, Artificial Sequence
  chemically synthesized
gatccatttctggttgtgac

SEQ ID NO: 476241 - DNA, 20 bp, Artificial Sequence
  chemically synthesized
tactcatgtcacaaccagaa

SEQ ID NO: 476242 - DNA, 20 bp, Artificial Sequence
  chemically synthesized
atctttctattgtaaaaaat

SEQ ID NO: 476243 - DNA, 20 bp, Artificial Sequence
  chemically synthesized
atgcatgcaatattttatga

SEQ ID NO: 476244 - DNA, 20 bp, Artificial Sequence
  chemically synthesized
catcataacagtttcattta

SEQ ID NO: 476245 - DNA, 20 bp, Artificial Sequence
  chemically synthesized
taacagtttcatttagggag

SEQ ID NO: 476246 - DNA, 20 bp, Artificial Sequence
  chemically synthesized
agggtattttgtcaagtcct

SEQ ID NO: 476247 - DNA, 20 bp, Artificial Sequence
  chemically synthesized
tgtctttgaagcactagagc

SEQ ID NO: 476248 - DNA, 20 bp, Artificial Sequence
  chemically synthesized
gcatagggttcttctgctca

SEQ ID NO: 476249 - DNA, 20 bp, Artificial Sequence
  chemically synthesized
atatcctccccatatctgca

SEQ ID NO: 476250 - DNA, 20 bp, Artificial Sequence
  chemically synthesized
gaaccctatgcagatatggg

SEQ ID NO: 476251 - DNA, 20 bp, Artificial Sequence
  chemically synthesized
atccataaatgccatctcga

SEQ ID NO: 476252 - DNA, 20 bp, Artificial Sequence
  chemically synthesized
accctatcgagatggcattt

SEQ ID NO: 476253 - DNA, 20 bp, Artificial Sequence
  chemically synthesized
caaactgttctcctaagtga

SEQ ID NO: 476254 - DNA, 20 bp, Artificial Sequence
  chemically synthesized
tcatactggctccttttatt

SEQ ID NO: 476255 - DNA, 20 bp, Artificial Sequence
  chemically synthesized
aggataatgtcgttcttatt

SEQ ID NO: 476256 - DNA, 20 bp, Artificial Sequence
  chemically synthesized
aagtattcaggttgatttga

SEQ ID NO: 476257 - DNA, 20 bp, Artificial Sequence
  chemically synthesized
cattatcctctcaaatcaac

SEQ ID NO: 476258 - DNA, 20 bp, Artificial Sequence
  chemically synthesized
ttttaaaactttaagttcaa

SEQ ID NO: 476259 - DNA, 20 bp, Artificial Sequence
  chemically synthesized
aacattacgttaagcaatca

SEQ ID NO: 476260 - DNA, 20 bp, Artificial Sequence
  chemically synthesized
ggtgatggtggcacaatctt

SEQ ID NO: 476261 - DNA, 20 bp, Artificial Sequence
  chemically synthesized
tgtgaatatactaaacacca

SEQ ID NO: 476262 - DNA, 20 bp, Artificial Sequence
  chemically synthesized
cactgaattgtacactttga

SEQ ID NO: 476263 - DNA, 20 bp, Artificial Sequence
  chemically synthesized
gaattgtacactttgaaaga

SEQ ID NO: 476264 - DNA, 20 bp, Artificial Sequence
  chemically synthesized
aagagtgaattttaaagtat

SEQ ID NO: 476265 - DNA, 20 bp, Artificial Sequence
  chemically synthesized
taacacgaagttgaatacag

SEQ ID NO: 476266 - DNA, 20 bp, Artificial Sequence
  chemically synthesized
gacattccactaacacgaag

SEQ ID NO: 476267 - DNA, 20 bp, Artificial Sequence
  chemically synthesized
tgtattcaacttcgtgttag

SEQ ID NO: 476268 - DNA, 20 bp, Artificial Sequence
  chemically synthesized
tcgtgttagtggaatgtcac

SEQ ID NO: 476269 - DNA, 20 bp, Artificial Sequence
  chemically synthesized
atccacccctataaaacttt

SEQ ID NO: 476270 - DNA, 20 bp, Artificial Sequence
  chemically synthesized
tgaaattcagaaagttttat

SEQ ID NO: 476271 - DNA, 20 bp, Artificial Sequence
  chemically synthesized
attcagaaagttttataggg

SEQ ID NO: 476272 - DNA, 20 bp, Artificial Sequence
  chemically synthesized
aaatattgttccatttcctt

SEQ ID NO: 476273 - DNA, 20 bp, Artificial Sequence
  chemically synthesized
atttccttatgaataaatac

SEQ ID NO: 476274 - DNA, 20 bp, Artificial Sequence
  chemically synthesized
aatacatggattaaaagtat

SEQ ID NO: 476275 - DNA, 20 bp, Artificial Sequence
  chemically synthesized
ggtggtttaaatccatatat

SEQ ID NO: 476276 - DNA, 20 bp, Artificial Sequence
  chemically synthesized
agagataagtattcatatat

SEQ ID NO: 476277 - DNA, 20 bp, Artificial Sequence
  chemically synthesized
ttatgcaaaacaaaattaat

SEQ ID NO: 476278 - DNA, 20 bp, Artificial Sequence
  chemically synthesized
caaaatgaaatcattctctt

SEQ ID NO: 476279 - DNA, 20 bp, Artificial Sequence
  chemically synthesized
atgcacgttattatccagaa

SEQ ID NO: 476280 - DNA, 20 bp, Artificial Sequence
  chemically synthesized
agcatctttcagtgatacag

SEQ ID NO: 476281 - DNA, 20 bp, Artificial Sequence
  chemically synthesized
gataatcaacttaatggctt

SEQ ID NO: 476282 - DNA, 20 bp, Artificial Sequence
  chemically synthesized
ctagctatggcttaacgagg

SEQ ID NO: 476283 - DNA, 20 bp, Artificial Sequence
  chemically synthesized
cattttcaaatgtctcttat

SEQ ID NO: 476284 - DNA, 20 bp, Artificial Sequence
  chemically synthesized
caggattaatatgtgtgctc

SEQ ID NO: 476285 - DNA, 20 bp, Artificial Sequence
  chemically synthesized
catcctccaaaacattgaag

SEQ ID NO: 476286 - DNA, 20 bp, Artificial Sequence
  chemically synthesized
aatcctgcttcaatgttttg

SEQ ID NO: 476287 - DNA, 20 bp, Artificial Sequence
  chemically synthesized
tcaatgttttggaggatgaa

SEQ ID NO: 476288 - DNA, 20 bp, Artificial Sequence
  chemically synthesized
atgagtaccaaaacttattt

SEQ ID NO: 476289 - DNA, 20 bp, Artificial Sequence
  chemically synthesized
ggagagcattgcaattaatt

SEQ ID NO: 476290 - DNA, 20 bp, Artificial Sequence
  chemically synthesized
taaactttaccataagatct

SEQ ID NO: 476291 - DNA, 20 bp, Artificial Sequence
  chemically synthesized
tgaagactttggctaatttg

SEQ ID NO: 476292 - DNA, 20 bp, Artificial Sequence
  chemically synthesized
catcactgctgtttcacaaa

SEQ ID NO: 476293 - DNA, 20 bp, Artificial Sequence
  chemically synthesized
aaaccaggccaaatactctg

SEQ ID NO: 476294 - DNA, 20 bp, Artificial Sequence
  chemically synthesized
ttctttttgaagcaactctc

SEQ ID NO: 476295 - DNA, 20 bp, Artificial Sequence
  chemically synthesized
agaaaacaacccagaccagg

SEQ ID NO: 476296 - DNA, 20 bp, Artificial Sequence
  chemically synthesized
cttgagccaccccacctggt

SEQ ID NO: 476297 - DNA, 20 bp, Artificial Sequence
  chemically synthesized
acctcagcctcccaaagtgc

SEQ ID NO: 476298 - DNA, 20 bp, Artificial Sequence
  chemically synthesized
cagcactttgggaggctgag

SEQ ID NO: 476299 - DNA, 20 bp, Artificial Sequence
  chemically synthesized
actttgggaggctgaggtgg

SEQ ID NO: 476300 - DNA, 20 bp, Artificial Sequence
  chemically synthesized
tgggaggctgaggtgggtgg

SEQ ID NO: 476301 - DNA, 20 bp, Artificial Sequence
  chemically synthesized
aggctgaggtgggtggatgg

SEQ ID NO: 476302 - DNA, 20 bp, Artificial Sequence
  chemically synthesized
ttttgtatctttagtagaga

SEQ ID NO: 476303 - DNA, 20 bp, Artificial Sequence
  chemically synthesized
acaggcatgtgccaccacgc

SEQ ID NO: 476304 - DNA, 20 bp, Artificial Sequence
  chemically synthesized
gcttctcatgcctcagcccc

SEQ ID NO: 476305 - DNA, 20 bp, Artificial Sequence
  chemically synthesized
accactgcactcactccagc

SEQ ID NO: 476306 - DNA, 20 bp, Artificial Sequence
  chemically synthesized
gctgggtcacccaggctgga

SEQ ID NO: 476307 - DNA, 20 bp, Artificial Sequence
  chemically synthesized
tcttgctgggtcacccaggc

SEQ ID NO: 476308 - DNA, 20 bp, Artificial Sequence
  chemically synthesized
tttttggagacagagtcttg

SEQ ID NO: 476309 - DNA, 20 bp, Artificial Sequence
  chemically synthesized
tttttttttttttttggaga

SEQ ID NO: 476310 - DNA, 20 bp, Artificial Sequence
  chemically synthesized
tgccaaatattcagtttaat

SEQ ID NO: 476311 - DNA, 20 bp, Artificial Sequence
  chemically synthesized
atttaggaattcagattaaa

SEQ ID NO: 476312 - DNA, 20 bp, Artificial Sequence
  chemically synthesized
aaatattttaacagaaattt

SEQ ID NO: 476313 - DNA, 20 bp, Artificial Sequence
  chemically synthesized
actttggggaagtctctaga

SEQ ID NO: 476314 - DNA, 20 bp, Artificial Sequence
  chemically synthesized
ctttcttccaccttcatgcg

SEQ ID NO: 476315 - DNA, 20 bp, Artificial Sequence
  chemically synthesized
taaaaaggaaaaggaggcag

SEQ ID NO: 476316 - DNA, 20 bp, Artificial Sequence
  chemically synthesized
ggtagcagcttttaccaccc

SEQ ID NO: 476317 - DNA, 20 bp, Artificial Sequence
  chemically synthesized
cccacagtggtgagccatcc

SEQ ID NO: 476318 - DNA, 20 bp, Artificial Sequence
  chemically synthesized
gaagtatggccgcctaaaca

SEQ ID NO: 476319 - DNA, 20 bp, Artificial Sequence
  chemically synthesized
cacaagaccttcaccctgta

SEQ ID NO: 476320 - DNA, 20 bp, Artificial Sequence
  chemically synthesized
gtacctgtgttcacccttta

SEQ ID NO: 476321 - DNA, 20 bp, Artificial Sequence
  chemically synthesized
aggtgctatttaagtgatat

SEQ ID NO: 476322 - DNA, 20 bp, Artificial Sequence
  chemically synthesized
ttgaagaaagccattatatt

SEQ ID NO: 476323 - DNA, 20 bp, Artificial Sequence
  chemically synthesized
cattatattgtgggttttct

SEQ ID NO: 476324 - DNA, 20 bp, Artificial Sequence
  chemically synthesized
ctttgaatcacttaaacatc

SEQ ID NO: 476325 - DNA, 20 bp, Artificial Sequence
  chemically synthesized
tatgactagtttctcacagg

SEQ ID NO: 476326 - DNA, 20 bp, Artificial Sequence
  chemically synthesized
tagatacaaaagtactgatt

SEQ ID NO: 476327 - DNA, 20 bp, Artificial Sequence
  chemically synthesized
ttgcttatctttatgtagct

SEQ ID NO: 476328 - DNA, 20 bp, Artificial Sequence
  chemically synthesized
ctacttttctaagaaaataa

SEQ ID NO: 476329 - DNA, 20 bp, Artificial Sequence
  chemically synthesized
aaggaattgtctattaacaa

SEQ ID NO: 476330 - DNA, 20 bp, Artificial Sequence
  chemically synthesized
gggaatcttatttttgaggg

SEQ ID NO: 476331 - DNA, 20 bp, Artificial Sequence
  chemically synthesized
gaccttctgtgctttgcagt

SEQ ID NO: 476332 - DNA, 20 bp, Artificial Sequence
  chemically synthesized
ggtcagttggaaagactaga

SEQ ID NO: 476333 - DNA, 20 bp, Artificial Sequence
  chemically synthesized
gactagaaagagtaaattga

SEQ ID NO: 476334 - DNA, 20 bp, Artificial Sequence
  chemically synthesized
attgagggaattctgcttgg

SEQ ID NO: 476335 - DNA, 20 bp, Artificial Sequence
  chemically synthesized
ggaaataaaacccctccaag

SEQ ID NO: 476336 - DNA, 20 bp, Artificial Sequence
  chemically synthesized
ttttatttcctctgtgaagt

SEQ ID NO: 476337 - DNA, 20 bp, Artificial Sequence
  chemically synthesized
cgtgcagtgcctggtgtgca

SEQ ID NO: 476338 - DNA, 20 bp, Artificial Sequence
  chemically synthesized
tggtgtgcaatgaatagtca

SEQ ID NO: 476339 - DNA, 20 bp, Artificial Sequence
  chemically synthesized
aatagtcactgaatgaaaac

SEQ ID NO: 476340 - DNA, 20 bp, Artificial Sequence
  chemically synthesized
actgaatgaaaacatgaatt

SEQ ID NO: 476341 - DNA, 20 bp, Artificial Sequence
  chemically synthesized
ttaagggtaagtgggaacat

SEQ ID NO: 476342 - DNA, 20 bp, Artificial Sequence
  chemically synthesized
tcgtaatagagactgtgaga

SEQ ID NO: 476343 - DNA, 20 bp, Artificial Sequence
  chemically synthesized
acagtgttgagggcccactt

SEQ ID NO: 476344 - DNA, 20 bp, Artificial Sequence
  chemically synthesized
gaaaacagttgatccaggtt

SEQ ID NO: 476345 - DNA, 20 bp, Artificial Sequence
  chemically synthesized
catctgacgaaaccccaaac

SEQ ID NO: 476346 - DNA, 20 bp, Artificial Sequence
  chemically synthesized
tgactgtggctcacacattt

SEQ ID NO: 476347 - DNA, 20 bp, Artificial Sequence
  chemically synthesized
gctcacacatttagggataa

SEQ ID NO: 476348 - DNA, 20 bp, Artificial Sequence
  chemically synthesized
aagggagtttcgatattagc

SEQ ID NO: 476349 - DNA, 20 bp, Artificial Sequence
  chemically synthesized
gtaattgaaaaaatatactg

SEQ ID NO: 476350 - DNA, 20 bp, Artificial Sequence
  chemically synthesized
aatatactgtggaatctaaa

SEQ ID NO: 476351 - DNA, 20 bp, Artificial Sequence
  chemically synthesized
tgtagatggagagaaagtag

SEQ ID NO: 476352 - DNA, 20 bp, Artificial Sequence
  chemically synthesized
aggggtcagttgtagaagtc

SEQ ID NO: 476353 - DNA, 20 bp, Artificial Sequence
  chemically synthesized
tactcctgctgtggcctttt

SEQ ID NO: 476354 - DNA, 20 bp, Artificial Sequence
  chemically synthesized
aatccataaaaggccacagc

SEQ ID NO: 476355 - DNA, 20 bp, Artificial Sequence
  chemically synthesized
gcgacagagaggggagactc

SEQ ID NO: 476356 - DNA, 20 bp, Artificial Sequence
  chemically synthesized
tagagctaatctgagcatcc

SEQ ID NO: 476357 - DNA, 20 bp, Artificial Sequence
  chemically synthesized
ggatgctcagattagctcta

SEQ ID NO: 476358 - DNA, 20 bp, Artificial Sequence
  chemically synthesized
ctctactggatttgccactt

SEQ ID NO: 476359 - DNA, 20 bp, Artificial Sequence
  chemically synthesized
gaagggaagtttttcaaaca

SEQ ID NO: 476360 - DNA, 20 bp, Artificial Sequence
  chemically synthesized
tttgaaaaacttcccttctt

SEQ ID NO: 476361 - DNA, 20 bp, Artificial Sequence
  chemically synthesized
tagcaggttaagattttagg

SEQ ID NO: 476362 - DNA, 20 bp, Artificial Sequence
  chemically synthesized
gtaagtgagataggacgtct

SEQ ID NO: 476363 - DNA, 20 bp, Artificial Sequence
  chemically synthesized
gacgtcctatctcacttact

SEQ ID NO: 476364 - DNA, 20 bp, Artificial Sequence
  chemically synthesized
atttttggaacctagtaatt

SEQ ID NO: 476365 - DNA, 20 bp, Artificial Sequence
  chemically synthesized
tctgcacgtgtatgtagccc

SEQ ID NO: 476366 - DNA, 20 bp, Artificial Sequence
  chemically synthesized
taatggcattgctgtctacc

SEQ ID NO: 476367 - DNA, 20 bp, Artificial Sequence
  chemically synthesized
ttaacaaacatttgtttgac

SEQ ID NO: 476368 - DNA, 20 bp, Artificial Sequence
  chemically synthesized
ctctttttaggctgttttcc

SEQ ID NO: 476369 - DNA, 20 bp, Artificial Sequence
  chemically synthesized
ctcatgactagctcagcatg

SEQ ID NO: 476370 - DNA, 20 bp, Artificial Sequence
  chemically synthesized
tgagctagtcatgagaaggc

SEQ ID NO: 476371 - DNA, 20 bp, Artificial Sequence
  chemically synthesized
tgaaccacgaggaagagccc

SEQ ID NO: 476372 - DNA, 20 bp, Artificial Sequence
  chemically synthesized
gtggttcagggaagccctca

SEQ ID NO: 476373 - DNA, 20 bp, Artificial Sequence
  chemically synthesized
ctcacagaatgcaattaccc

SEQ ID NO: 476374 - DNA, 20 bp, Artificial Sequence
  chemically synthesized
gctgtacctgctgccaattc

SEQ ID NO: 476375 - DNA, 20 bp, Artificial Sequence
  chemically synthesized
cttgactctcttggccccat

SEQ ID NO: 476376 - DNA, 20 bp, Artificial Sequence
  chemically synthesized
tatcatcctcatggggccaa

SEQ ID NO: 476377 - DNA, 20 bp, Artificial Sequence
  chemically synthesized
actgtatcttgctttttcca

SEQ ID NO: 476378 - DNA, 20 bp, Artificial Sequence
  chemically synthesized
ccagaggatcagaggcctac

SEQ ID NO: 476379 - DNA, 20 bp, Artificial Sequence
  chemically synthesized
gaatctctcaaatacctggg

SEQ ID NO: 476380 - DNA, 20 bp, Artificial Sequence
  chemically synthesized
tttaattgtttcaacagcat

SEQ ID NO: 476381 - DNA, 20 bp, Artificial Sequence
  chemically synthesized
agagcagtcagggaaccaac

SEQ ID NO: 476382 - DNA, 20 bp, Artificial Sequence
  chemically synthesized
tccctgactgctctgatgcc

SEQ ID NO: 476383 - DNA, 20 bp, Artificial Sequence
  chemically synthesized
tcagccaggtttaagagaag

SEQ ID NO: 476384 - DNA, 20 bp, Artificial Sequence
  chemically synthesized
aggtttaagagaagcagagt

SEQ ID NO: 476385 - DNA, 20 bp, Artificial Sequence
  chemically synthesized
ctgagtgctcttaagaaaaa

SEQ ID NO: 476386 - DNA, 20 bp, Artificial Sequence
  chemically synthesized
acagggcaagaaagttaagt

SEQ ID NO: 476387 - DNA, 20 bp, Artificial Sequence
  chemically synthesized
cagcatcaatctggccccat

SEQ ID NO: 476388 - DNA, 20 bp, Artificial Sequence
  chemically synthesized
tgttgtacaatttgtgatct

SEQ ID NO: 476389 - DNA, 20 bp, Artificial Sequence
  chemically synthesized
caggtgccatgatgaggcaa

SEQ ID NO: 476390 - DNA, 20 bp, Artificial Sequence
  chemically synthesized
ccttctctcttaaaaccacc

SEQ ID NO: 476391 - DNA, 20 bp, Artificial Sequence
  chemically synthesized
ctgagggaggttctctggaa

SEQ ID NO: 476392 - DNA, 20 bp, Artificial Sequence
  chemically synthesized
aggctttagcagctaatact

SEQ ID NO: 476393 - DNA, 20 bp, Artificial Sequence
  chemically synthesized
gcacccattcctcagtgact

SEQ ID NO: 476394 - DNA, 20 bp, Artificial Sequence
  chemically synthesized
gctaatactcagagtcactg

SEQ ID NO: 476395 - DNA, 20 bp, Artificial Sequence
  chemically synthesized
atactcagagtcactgagga

SEQ ID NO: 476396 - DNA, 20 bp, Artificial Sequence
  chemically synthesized
tgggtgcaccaacccagtga

SEQ ID NO: 476397 - DNA, 20 bp, Artificial Sequence
  chemically synthesized
gccccagtcagattcgttca

SEQ ID NO: 476398 - DNA, 20 bp, Artificial Sequence
  chemically synthesized
agatgaagttaatctaagta

SEQ ID NO: 476399 - DNA, 20 bp, Artificial Sequence
  chemically synthesized
gtgcttgacaactgaagttc

SEQ ID NO: 476400 - DNA, 20 bp, Artificial Sequence
  chemically synthesized
ttttttttttttttccaagg

SEQ ID NO: 476401 - DNA, 20 bp, Artificial Sequence
  chemically synthesized
tgtactccagcctgggcagc

SEQ ID NO: 476402 - DNA, 20 bp, Artificial Sequence
  chemically synthesized
ttcactcttgctgcccaggc

SEQ ID NO: 476403 - DNA, 20 bp, Artificial Sequence
  chemically synthesized
ctcactgcaacttctacctc

SEQ ID NO: 476404 - DNA, 20 bp, Artificial Sequence
  chemically synthesized
tactcaggaggctgaggcag

SEQ ID NO: 476405 - DNA, 20 bp, Artificial Sequence
  chemically synthesized
gattctcctgcctcagcctc

SEQ ID NO: 476406 - DNA, 20 bp, Artificial Sequence
  chemically synthesized
gcctcagcctcctgagtagc

SEQ ID NO: 476407 - DNA, 20 bp, Artificial Sequence
  chemically synthesized
ttttgtatttttagaagaga

SEQ ID NO: 476408 - DNA, 20 bp, Artificial Sequence
  chemically synthesized
tgggtggatcacctgaggtc

SEQ ID NO: 476409 - DNA, 20 bp, Artificial Sequence
  chemically synthesized
actttgggaggcctacgtgg

SEQ ID NO: 476410 - DNA, 20 bp, Artificial Sequence
  chemically synthesized
cagcactttgggaggcctac

SEQ ID NO: 476411 - DNA, 20 bp, Artificial Sequence
  chemically synthesized
acgtaggcctcccaaagtgc

SEQ ID NO: 476412 - DNA, 20 bp, Artificial Sequence
  chemically synthesized
gcctgcaggagacttcttaa

SEQ ID NO: 476413 - DNA, 20 bp, Artificial Sequence
  chemically synthesized
tcatagctctccaacaaaac

SEQ ID NO: 476414 - DNA, 20 bp, Artificial Sequence
  chemically synthesized
gagggactcaactttcgaga

SEQ ID NO: 476415 - DNA, 20 bp, Artificial Sequence
  chemically synthesized
ttgtcaccctttctcgaaag

SEQ ID NO: 476416 - DNA, 20 bp, Artificial Sequence
  chemically synthesized
cttagctccacacagtccct

SEQ ID NO: 476417 - DNA, 20 bp, Artificial Sequence
  chemically synthesized
ctgtgtggagctaagacaaa

SEQ ID NO: 476418 - DNA, 20 bp, Artificial Sequence
  chemically synthesized
ggggatactttgcagactga

SEQ ID NO: 476419 - DNA, 20 bp, Artificial Sequence
  chemically synthesized
cataagtgatactaaaggca

SEQ ID NO: 476420 - DNA, 20 bp, Artificial Sequence
  chemically synthesized
caatggcataatttattgtc

SEQ ID NO: 476421 - DNA, 20 bp, Artificial Sequence
  chemically synthesized
acgtactttaaaaaaaaaaa

SEQ ID NO: 476422 - DNA, 20 bp, Artificial Sequence
  chemically synthesized
gcccaaatatgaaagtttac

SEQ ID NO: 476423 - DNA, 20 bp, Artificial Sequence
  chemically synthesized
tttgggcatgatcacttttg

SEQ ID NO: 476424 - DNA, 20 bp, Artificial Sequence
  chemically synthesized
gatcacttttgacgagtaaa

SEQ ID NO: 476425 - DNA, 20 bp, Artificial Sequence
  chemically synthesized
ctaaatctaggccattagtt

SEQ ID NO: 476426 - DNA, 20 bp, Artificial Sequence
  chemically synthesized
gtcacaaatttggaagcgtg

SEQ ID NO: 476427 - DNA, 20 bp, Artificial Sequence
  chemically synthesized
actgctctgtgttttccata

SEQ ID NO: 476428 - DNA, 20 bp, Artificial Sequence
  chemically synthesized
attgttttttataaaaagat

SEQ ID NO: 476429 - DNA, 20 bp, Artificial Sequence
  chemically synthesized
acctcagcctcccaaagtgc

SEQ ID NO: 476430 - DNA, 20 bp, Artificial Sequence
  chemically synthesized
tagcactttgggaggctgag

SEQ ID NO: 476431 - DNA, 20 bp, Artificial Sequence
  chemically synthesized
actttgggaggctgaggtgg

SEQ ID NO: 476432 - DNA, 20 bp, Artificial Sequence
  chemically synthesized
tgggtggatcacctgaggtc

SEQ ID NO: 476433 - DNA, 20 bp, Artificial Sequence
  chemically synthesized
ttttctgtttttagtagaga

SEQ ID NO: 476434 - DNA, 20 bp, Artificial Sequence
  chemically synthesized
gcctcagcctccagagtggc

SEQ ID NO: 476435 - DNA, 20 bp, Artificial Sequence
  chemically synthesized
aattctcctgcctcagcctc

SEQ ID NO: 476436 - DNA, 20 bp, Artificial Sequence
  chemically synthesized
cactctggaggctgaggcag

SEQ ID NO: 476437 - DNA, 20 bp, Artificial Sequence
  chemically synthesized
ctcactgcaacctccacctc

SEQ ID NO: 476438 - DNA, 20 bp, Artificial Sequence
  chemically synthesized
tttgctcttgttgcccaggc

SEQ ID NO: 476439 - DNA, 20 bp, Artificial Sequence
  chemically synthesized
ttttgttcttgtttttgaga

SEQ ID NO: 476440 - DNA, 20 bp, Artificial Sequence
  chemically synthesized
tcgatattgtaaagagaaac

SEQ ID NO: 476441 - DNA, 20 bp, Artificial Sequence
  chemically synthesized
ttctctttacaatatcgaaa

SEQ ID NO: 476442 - DNA, 20 bp, Artificial Sequence
  chemically synthesized
gaatatatacccaaacataa

SEQ ID NO: 476443 - DNA, 20 bp, Artificial Sequence
  chemically synthesized
aaaaagttatccttttatgt

SEQ ID NO: 476444 - DNA, 20 bp, Artificial Sequence
  chemically synthesized
aagccatgtcctaaaagatg

SEQ ID NO: 476445 - DNA, 20 bp, Artificial Sequence
  chemically synthesized
ggcttttattataagaacat

SEQ ID NO: 476446 - DNA, 20 bp, Artificial Sequence
  chemically synthesized
caatgttcttataataaaag

SEQ ID NO: 476447 - DNA, 20 bp, Artificial Sequence
  chemically synthesized
gtgtctatcttctttctttt

SEQ ID NO: 476448 - DNA, 20 bp, Artificial Sequence
  chemically synthesized
tgcaaaccatacacccggta

SEQ ID NO: 476449 - DNA, 20 bp, Artificial Sequence
  chemically synthesized
ttttgaatactgacccctta

SEQ ID NO: 476450 - DNA, 20 bp, Artificial Sequence
  chemically synthesized
gtaggagttccttgtgtatt

SEQ ID NO: 476451 - DNA, 20 bp, Artificial Sequence
  chemically synthesized
ttttcttgctattgagttgt

SEQ ID NO: 476452 - DNA, 20 bp, Artificial Sequence
  chemically synthesized
ggtgatttgttttcttgcta

SEQ ID NO: 476453 - DNA, 20 bp, Artificial Sequence
  chemically synthesized
ctaaaaaatgagcaagtaac

SEQ ID NO: 476454 - DNA, 20 bp, Artificial Sequence
  chemically synthesized
tctccaaagaagatatagaa

SEQ ID NO: 476455 - DNA, 20 bp, Artificial Sequence
  chemically synthesized
tctatttcctgtctataaat

SEQ ID NO: 476456 - DNA, 20 bp, Artificial Sequence
  chemically synthesized
tcagatttatagacaggaaa

SEQ ID NO: 476457 - DNA, 20 bp, Artificial Sequence
  chemically synthesized
gctgggggcaggaagcaatg

SEQ ID NO: 476458 - DNA, 20 bp, Artificial Sequence
  chemically synthesized
cttttttgttccttttgaga

SEQ ID NO: 476459 - DNA, 20 bp, Artificial Sequence
  chemically synthesized
tctcgctctgttgcccaggc

SEQ ID NO: 476460 - DNA, 20 bp, Artificial Sequence
  chemically synthesized
tacttgggaggctgaggcag

SEQ ID NO: 476461 - DNA, 20 bp, Artificial Sequence
  chemically synthesized
gcctcagcctcccaagtagc

SEQ ID NO: 476462 - DNA, 20 bp, Artificial Sequence
  chemically synthesized
ttttgtatttttagtagaga

SEQ ID NO: 476463 - DNA, 20 bp, Artificial Sequence
  chemically synthesized
caggcggatcacctgaggcc

SEQ ID NO: 476464 - DNA, 20 bp, Artificial Sequence
  chemically synthesized
actttgggaggccaaggcag

SEQ ID NO: 476465 - DNA, 20 bp, Artificial Sequence
  chemically synthesized
tgtgagccaccatgcctggt

SEQ ID NO: 476466 - DNA, 20 bp, Artificial Sequence
  chemically synthesized
atgcctggtggggattatcg

SEQ ID NO: 476467 - DNA, 20 bp, Artificial Sequence
  chemically synthesized
ggattatcgttgaatagaca

SEQ ID NO: 476468 - DNA, 20 bp, Artificial Sequence
  chemically synthesized
tttcagttttgcaagatgag

SEQ ID NO: 476469 - DNA, 20 bp, Artificial Sequence
  chemically synthesized
agatgagaagagttctggag

SEQ ID NO: 476470 - DNA, 20 bp, Artificial Sequence
  chemically synthesized
agataactggcagttgcagt

SEQ ID NO: 476471 - DNA, 20 bp, Artificial Sequence
  chemically synthesized
aacaaataaaaagatagttc

SEQ ID NO: 476472 - DNA, 20 bp, Artificial Sequence
  chemically synthesized
ggttgatattttaatggttt

SEQ ID NO: 476473 - DNA, 20 bp, Artificial Sequence
  chemically synthesized
accattaaaatatcaaccat

SEQ ID NO: 476474 - DNA, 20 bp, Artificial Sequence
  chemically synthesized
tcatctgtctgaagtaactt

SEQ ID NO: 476475 - DNA, 20 bp, Artificial Sequence
  chemically synthesized
gttttactttttttttgaga

SEQ ID NO: 476476 - DNA, 20 bp, Artificial Sequence
  chemically synthesized
tttgctcttgtcgccccggc

SEQ ID NO: 476477 - DNA, 20 bp, Artificial Sequence
  chemically synthesized
ctcactgcaacctccgcctc

SEQ ID NO: 476478 - DNA, 20 bp, Artificial Sequence
  chemically synthesized
tacttgggaggttgaagcag

SEQ ID NO: 476479 - DNA, 20 bp, Artificial Sequence
  chemically synthesized
gcttcaacctcccaagtagc

SEQ ID NO: 476480 - DNA, 20 bp, Artificial Sequence
  chemically synthesized
ttttctatttttactagaga

SEQ ID NO: 476481 - DNA, 20 bp, Artificial Sequence
  chemically synthesized
cgggtggatcatctgatgtc

SEQ ID NO: 476482 - DNA, 20 bp, Artificial Sequence
  chemically synthesized
actttgggaggccgaggcgg

SEQ ID NO: 476483 - DNA, 20 bp, Artificial Sequence
  chemically synthesized
cagcactttgggaggccgag

SEQ ID NO: 476484 - DNA, 20 bp, Artificial Sequence
  chemically synthesized
gcctcggcctcccaaagtgc

SEQ ID NO: 476485 - DNA, 20 bp, Artificial Sequence
  chemically synthesized
tgtgttaaccaccattgtcc

SEQ ID NO: 476486 - DNA, 20 bp, Artificial Sequence
  chemically synthesized
tgagatgcacactattgtgt

SEQ ID NO: 476487 - DNA, 20 bp, Artificial Sequence
  chemically synthesized
gcttgttaacacagagactg

SEQ ID NO: 476488 - DNA, 20 bp, Artificial Sequence
  chemically synthesized
cacttagtgcttttgattca

SEQ ID NO: 476489 - DNA, 20 bp, Artificial Sequence
  chemically synthesized
tcaggcccaccttacaccca

SEQ ID NO: 476490 - DNA, 20 bp, Artificial Sequence
  chemically synthesized
agtgggtgtaaggtgggcct

SEQ ID NO: 476491 - DNA, 20 bp, Artificial Sequence
  chemically synthesized
taataagaagttagaaaatg

SEQ ID NO: 476492 - DNA, 20 bp, Artificial Sequence
  chemically synthesized
ataaagaaataaaaagcttg

SEQ ID NO: 476493 - DNA, 20 bp, Artificial Sequence
  chemically synthesized
cctctttctgtcgcccaggc

SEQ ID NO: 476494 - DNA, 20 bp, Artificial Sequence
  chemically synthesized
caggaggatcgcttgagccc

SEQ ID NO: 476495 - DNA, 20 bp, Artificial Sequence
  chemically synthesized
aacttgggaggctgaagcag

SEQ ID NO: 476496 - DNA, 20 bp, Artificial Sequence
  chemically synthesized
ttttttttttttttgcgaga

SEQ ID NO: 476497 - DNA, 20 bp, Artificial Sequence
  chemically synthesized
tgggaggatcacttgagccc

SEQ ID NO: 476498 - DNA, 20 bp, Artificial Sequence
  chemically synthesized
actttgggaggccgaagtgg

SEQ ID NO: 476499 - DNA, 20 bp, Artificial Sequence
  chemically synthesized
acttcggcctcccaaagtgt

SEQ ID NO: 476500 - DNA, 20 bp, Artificial Sequence
  chemically synthesized
gtatctgaaggttctaagtc

SEQ ID NO: 476501 - DNA, 20 bp, Artificial Sequence
  chemically synthesized
gatacactgttccctctgct

SEQ ID NO: 476502 - DNA, 20 bp, Artificial Sequence
  chemically synthesized
aagagccagctaggcataaa

SEQ ID NO: 476503 - DNA, 20 bp, Artificial Sequence
  chemically synthesized
ctaactgagatcagaagtat

SEQ ID NO: 476504 - DNA, 20 bp, Artificial Sequence
  chemically synthesized
tttacgtagggcaaccaact

SEQ ID NO: 476505 - DNA, 20 bp, Artificial Sequence
  chemically synthesized
cagaaggaaaatagggtgtt

SEQ ID NO: 476506 - DNA, 20 bp, Artificial Sequence
  chemically synthesized
atcagggttcagaaggaaaa

SEQ ID NO: 476507 - DNA, 20 bp, Artificial Sequence
  chemically synthesized
atgtacttgcaaattgtgat

SEQ ID NO: 476508 - DNA, 20 bp, Artificial Sequence
  chemically synthesized
aaggaacagacaatgaataa

SEQ ID NO: 476509 - DNA, 20 bp, Artificial Sequence
  chemically synthesized
gtcttgggaaggaacagaca

SEQ ID NO: 476510 - DNA, 20 bp, Artificial Sequence
  chemically synthesized
actggtgaaaaacaataatg

SEQ ID NO: 476511 - DNA, 20 bp, Artificial Sequence
  chemically synthesized
tctttaataaaaatgtattg

SEQ ID NO: 476512 - DNA, 20 bp, Artificial Sequence
  chemically synthesized
attaaagaacaagcagtcaa

SEQ ID NO: 476513 - DNA, 20 bp, Artificial Sequence
  chemically synthesized
tttctcacagaaacctgaca

SEQ ID NO: 476514 - DNA, 20 bp, Artificial Sequence
  chemically synthesized
tcagatatgggataaggaaa

SEQ ID NO: 476515 - DNA, 20 bp, Artificial Sequence
  chemically synthesized
ccattttccttatcccatat

SEQ ID NO: 476516 - DNA, 20 bp, Artificial Sequence
  chemically synthesized
agatataaataattcagata

SEQ ID NO: 476517 - DNA, 20 bp, Artificial Sequence
  chemically synthesized
gcatctctcattctttgggc

SEQ ID NO: 476518 - DNA, 20 bp, Artificial Sequence
  chemically synthesized
aaatgttatattcttgccca

SEQ ID NO: 476519 - DNA, 20 bp, Artificial Sequence
  chemically synthesized
ttcagtttttggtctctacc

SEQ ID NO: 476520 - DNA, 20 bp, Artificial Sequence
  chemically synthesized
agggatttttaaaataaaaa

SEQ ID NO: 476521 - DNA, 20 bp, Artificial Sequence
  chemically synthesized
atttttaaaataaaaatgga

SEQ ID NO: 476522 - DNA, 20 bp, Artificial Sequence
  chemically synthesized
ccaagcagaatatattttcc

SEQ ID NO: 476523 - DNA, 20 bp, Artificial Sequence
  chemically synthesized
cttgtgccaccaccaccaag

SEQ ID NO: 476524 - DNA, 20 bp, Artificial Sequence
  chemically synthesized
tggagggcattttaacaaca

SEQ ID NO: 476525 - DNA, 20 bp, Artificial Sequence
  chemically synthesized
atttggtagtagagcccagg

SEQ ID NO: 476526 - DNA, 20 bp, Artificial Sequence
  chemically synthesized
gttaggcttggcataggacc

SEQ ID NO: 476527 - DNA, 20 bp, Artificial Sequence
  chemically synthesized
ttgcccaaagaggcccttgc

SEQ ID NO: 476528 - DNA, 20 bp, Artificial Sequence
  chemically synthesized
aaagaggcccttgcagggat

SEQ ID NO: 476529 - DNA, 20 bp, Artificial Sequence
  chemically synthesized
agagagagagagagagagag

SEQ ID NO: 476530 - DNA, 20 bp, Artificial Sequence
  chemically synthesized
attttccacttgtgtagaaa

SEQ ID NO: 476531 - DNA, 20 bp, Artificial Sequence
  chemically synthesized
actttagggctgttacaaag

SEQ ID NO: 476532 - DNA, 20 bp, Artificial Sequence
  chemically synthesized
cagagtctccctggactagc

SEQ ID NO: 476533 - DNA, 20 bp, Artificial Sequence
  chemically synthesized
acttattacctactgctttg

SEQ ID NO: 476534 - DNA, 20 bp, Artificial Sequence
  chemically synthesized
ggtaataagttcatccatga

SEQ ID NO: 476535 - DNA, 20 bp, Artificial Sequence
  chemically synthesized
tcttagtctgtgactctctc

SEQ ID NO: 476536 - DNA, 20 bp, Artificial Sequence
  chemically synthesized
tcacagactaagatcctttg

SEQ ID NO: 476537 - DNA, 20 bp, Artificial Sequence
  chemically synthesized
aaaaaggtagctacccggca

SEQ ID NO: 476538 - DNA, 20 bp, Artificial Sequence
  chemically synthesized
atgtgttcagaacttgaaca

SEQ ID NO: 476539 - DNA, 20 bp, Artificial Sequence
  chemically synthesized
gtacagggcagctgtaaaag

SEQ ID NO: 476540 - DNA, 20 bp, Artificial Sequence
  chemically synthesized
gcagctgtaaaagatgaatc

SEQ ID NO: 476541 - DNA, 20 bp, Artificial Sequence
  chemically synthesized
gatgaatcatgggtgttttc

SEQ ID NO: 476542 - DNA, 20 bp, Artificial Sequence
  chemically synthesized
tttctgggatcaagattgtg

SEQ ID NO: 476543 - DNA, 20 bp, Artificial Sequence
  chemically synthesized
gatcaagattgtggtgggtc

SEQ ID NO: 476544 - DNA, 20 bp, Artificial Sequence
  chemically synthesized
atgaggtggcctttacaatg

SEQ ID NO: 476545 - DNA, 20 bp, Artificial Sequence
  chemically synthesized
aatgaagatgtccacaaaac

SEQ ID NO: 476546 - DNA, 20 bp, Artificial Sequence
  chemically synthesized
agtgagtagtaattaaatct

SEQ ID NO: 476547 - DNA, 20 bp, Artificial Sequence
  chemically synthesized
tataaagtaagtgttttcaa

SEQ ID NO: 476548 - DNA, 20 bp, Artificial Sequence
  chemically synthesized
atatgtgggcacagtatcta

SEQ ID NO: 476549 - DNA, 20 bp, Artificial Sequence
  chemically synthesized
ttgagacttccatttttcca

SEQ ID NO: 476550 - DNA, 20 bp, Artificial Sequence
  chemically synthesized
gtgtacctctgctaatgatt

SEQ ID NO: 476551 - DNA, 20 bp, Artificial Sequence
  chemically synthesized
tagcagaggtacacaattta

SEQ ID NO: 476552 - DNA, 20 bp, Artificial Sequence
  chemically synthesized
atgactcaacttctcataat

SEQ ID NO: 476553 - DNA, 20 bp, Artificial Sequence
  chemically synthesized
gcaatccatattatgagaag

SEQ ID NO: 476554 - DNA, 20 bp, Artificial Sequence
  chemically synthesized
attatgagaagttgagtcat

SEQ ID NO: 476555 - DNA, 20 bp, Artificial Sequence
  chemically synthesized
tggaggggaagagagacctc

SEQ ID NO: 476556 - DNA, 20 bp, Artificial Sequence
  chemically synthesized
ctcttctagtgttcccctct

SEQ ID NO: 476557 - DNA, 20 bp, Artificial Sequence
  chemically synthesized
tgtggaaaggagaagagaca

SEQ ID NO: 476558 - DNA, 20 bp, Artificial Sequence
  chemically synthesized
ttatttgcaaaataattttt

SEQ ID NO: 476559 - DNA, 20 bp, Artificial Sequence
  chemically synthesized
aataatagtttttggaataa

SEQ ID NO: 476560 - DNA, 20 bp, Artificial Sequence
  chemically synthesized
aggtacccaataatagtttt

SEQ ID NO: 476561 - DNA, 20 bp, Artificial Sequence
  chemically synthesized
atttattccaaaaactatta

SEQ ID NO: 476562 - DNA, 20 bp, Artificial Sequence
  chemically synthesized
tgggtacctattatatgcca

SEQ ID NO: 476563 - DNA, 20 bp, Artificial Sequence
  chemically synthesized
aatcatgcagcttaaggcta

SEQ ID NO: 476564 - DNA, 20 bp, Artificial Sequence
  chemically synthesized
agccatgatatattttggct

SEQ ID NO: 476565 - DNA, 20 bp, Artificial Sequence
  chemically synthesized
tttgctttaataagtgaaaa

SEQ ID NO: 476566 - DNA, 20 bp, Artificial Sequence
  chemically synthesized
attaagctacctctgcatgt

SEQ ID NO: 476567 - DNA, 20 bp, Artificial Sequence
  chemically synthesized
gtctgaataatgattaatag

SEQ ID NO: 476568 - DNA, 20 bp, Artificial Sequence
  chemically synthesized
taatgattaatagaggaatc

SEQ ID NO: 476569 - DNA, 20 bp, Artificial Sequence
  chemically synthesized
taatagaggaatctagaatt

SEQ ID NO: 476570 - DNA, 20 bp, Artificial Sequence
  chemically synthesized
aaccaggtacagcatattgc

SEQ ID NO: 476571 - DNA, 20 bp, Artificial Sequence
  chemically synthesized
aaatccattttgtttcagta

SEQ ID NO: 476572 - DNA, 20 bp, Artificial Sequence
  chemically synthesized
gcactcactactgaaacaaa

SEQ ID NO: 476573 - DNA, 20 bp, Artificial Sequence
  chemically synthesized
atttctaagttaataatata

SEQ ID NO: 476574 - DNA, 20 bp, Artificial Sequence
  chemically synthesized
atacacagaagagggctaaa

SEQ ID NO: 476575 - DNA, 20 bp, Artificial Sequence
  chemically synthesized
acaataatctgaaagtaaaa

SEQ ID NO: 476576 - DNA, 20 bp, Artificial Sequence
  chemically synthesized
ttgcaaacaaaataaaaaag

SEQ ID NO: 476577 - DNA, 20 bp, Artificial Sequence
  chemically synthesized
tcaaacgaaaggaacagaaa

SEQ ID NO: 476578 - DNA, 20 bp, Artificial Sequence
  chemically synthesized
taagactttcttttcagcct

SEQ ID NO: 476579 - DNA, 20 bp, Artificial Sequence
  chemically synthesized
agggcccacattgctcagaa

SEQ ID NO: 476580 - DNA, 20 bp, Artificial Sequence
  chemically synthesized
tagttgttatttttacttct

SEQ ID NO: 476581 - DNA, 20 bp, Artificial Sequence
  chemically synthesized
gttgtgaaaagtctagcttc

SEQ ID NO: 476582 - DNA, 20 bp, Artificial Sequence
  chemically synthesized
aaagtctagcttcttgagtc

SEQ ID NO: 476583 - DNA, 20 bp, Artificial Sequence
  chemically synthesized
atggtgagaaaaatgacaaa

SEQ ID NO: 476584 - DNA, 20 bp, Artificial Sequence
  chemically synthesized
taagatgtgatcataaaaat

SEQ ID NO: 476585 - DNA, 20 bp, Artificial Sequence
  chemically synthesized
ataacagactattacaggat

SEQ ID NO: 476586 - DNA, 20 bp, Artificial Sequence
  chemically synthesized
gttgtcataacagactatta

SEQ ID NO: 476587 - DNA, 20 bp, Artificial Sequence
  chemically synthesized
cagttaagtacatgcaaatg

SEQ ID NO: 476588 - DNA, 20 bp, Artificial Sequence
  chemically synthesized
ataaattactacttacacaa

SEQ ID NO: 476589 - DNA, 20 bp, Artificial Sequence
  chemically synthesized
ctaaagggtagatttggcca

SEQ ID NO: 476590 - DNA, 20 bp, Artificial Sequence
  chemically synthesized
aatatcaatcactttttcta

SEQ ID NO: 476591 - DNA, 20 bp, Artificial Sequence
  chemically synthesized
ctattaaatatatctgttag

SEQ ID NO: 476592 - DNA, 20 bp, Artificial Sequence
  chemically synthesized
acttttttctttttcaaaat

SEQ ID NO: 476593 - DNA, 20 bp, Artificial Sequence
  chemically synthesized
tagtgccctcaaaaatctgt

SEQ ID NO: 476594 - DNA, 20 bp, Artificial Sequence
  chemically synthesized
gctgcattgattatctaaag

SEQ ID NO: 476595 - DNA, 20 bp, Artificial Sequence
  chemically synthesized
aatacaatttcagtaggaaa

SEQ ID NO: 476596 - DNA, 20 bp, Artificial Sequence
  chemically synthesized
agtgaaaagattattttaaa

SEQ ID NO: 476597 - DNA, 20 bp, Artificial Sequence
  chemically synthesized
ccactttgaatctaaaatta

SEQ ID NO: 476598 - DNA, 20 bp, Artificial Sequence
  chemically synthesized
tcagtaattttagattcaaa

SEQ ID NO: 476599 - DNA, 20 bp, Artificial Sequence
  chemically synthesized
ttggtgaaatctgacccact

SEQ ID NO: 476600 - DNA, 20 bp, Artificial Sequence
  chemically synthesized
ggttgattgttgtatgcaag

SEQ ID NO: 476601 - DNA, 20 bp, Artificial Sequence
  chemically synthesized
ctataaaactgcctagggtt

SEQ ID NO: 476602 - DNA, 20 bp, Artificial Sequence
  chemically synthesized
gtttctcctataaaactgcc

SEQ ID NO: 476603 - DNA, 20 bp, Artificial Sequence
  chemically synthesized
ttactccgttggcttatgct

SEQ ID NO: 476604 - DNA, 20 bp, Artificial Sequence
  chemically synthesized
ttattcacagcataagccaa

SEQ ID NO: 476605 - DNA, 20 bp, Artificial Sequence
  chemically synthesized
tcttttaaccttatgcttta

SEQ ID NO: 476606 - DNA, 20 bp, Artificial Sequence
  chemically synthesized
gcacaaaagtcaccctgata

SEQ ID NO: 476607 - DNA, 20 bp, Artificial Sequence
  chemically synthesized
ccacaaaggttatccaatat

SEQ ID NO: 476608 - DNA, 20 bp, Artificial Sequence
  chemically synthesized
tttgtggagattctagtata

SEQ ID NO: 476609 - DNA, 20 bp, Artificial Sequence
  chemically synthesized
ctttcacaaacccaatatac

SEQ ID NO: 476610 - DNA, 20 bp, Artificial Sequence
  chemically synthesized
gatggggctaaagcaaggga

SEQ ID NO: 476611 - DNA, 20 bp, Artificial Sequence
  chemically synthesized
ggtcttcacatgtttctagc

SEQ ID NO: 476612 - DNA, 20 bp, Artificial Sequence
  chemically synthesized
ttaaatcacaggtcagttaa

SEQ ID NO: 476613 - DNA, 20 bp, Artificial Sequence
  chemically synthesized
taggctttaggttcacaaca

SEQ ID NO: 476614 - DNA, 20 bp, Artificial Sequence
  chemically synthesized
aacaatggatagatctcaaa

SEQ ID NO: 476615 - DNA, 20 bp, Artificial Sequence
  chemically synthesized
aaaatgggttacaatgtttt

SEQ ID NO: 476616 - DNA, 20 bp, Artificial Sequence
  chemically synthesized
gaaccaatgataaactactg

SEQ ID NO: 476617 - DNA, 20 bp, Artificial Sequence
  chemically synthesized
aagtagaaacaaaagtgaat

SEQ ID NO: 476618 - DNA, 20 bp, Artificial Sequence
  chemically synthesized
ggaattaagtagaaacaaaa

SEQ ID NO: 476619 - DNA, 20 bp, Artificial Sequence
  chemically synthesized
ggcaatatatgccgaagtac

SEQ ID NO: 476620 - DNA, 20 bp, Artificial Sequence
  chemically synthesized
ggcataagcaagttagtgaa

SEQ ID NO: 476621 - DNA, 20 bp, Artificial Sequence
  chemically synthesized
ccgtgttaagatcatgatga

SEQ ID NO: 476622 - DNA, 20 bp, Artificial Sequence
  chemically synthesized
taagatcatgatgatagaat

SEQ ID NO: 476623 - DNA, 20 bp, Artificial Sequence
  chemically synthesized
ttgatagggaaaagttctaa

SEQ ID NO: 476624 - DNA, 20 bp, Artificial Sequence
  chemically synthesized
aaaagttctaaatgagtcat

SEQ ID NO: 476625 - DNA, 20 bp, Artificial Sequence
  chemically synthesized
tttttagaagtttggttttc

SEQ ID NO: 476626 - DNA, 20 bp, Artificial Sequence
  chemically synthesized
cagatttctattttctttta

SEQ ID NO: 476627 - DNA, 20 bp, Artificial Sequence
  chemically synthesized
tcttaaccagaatgaggctg

SEQ ID NO: 476628 - DNA, 20 bp, Artificial Sequence
  chemically synthesized
tccagcctcattctggttaa

SEQ ID NO: 476629 - DNA, 20 bp, Artificial Sequence
  chemically synthesized
aaacgccaaattctcttaac

SEQ ID NO: 476630 - DNA, 20 bp, Artificial Sequence
  chemically synthesized
attgagttaactgaattagg

SEQ ID NO: 476631 - DNA, 20 bp, Artificial Sequence
  chemically synthesized
acattaaataattgagttaa

SEQ ID NO: 476632 - DNA, 20 bp, Artificial Sequence
  chemically synthesized
atcaagtgtacattaaataa

SEQ ID NO: 476633 - DNA, 20 bp, Artificial Sequence
  chemically synthesized
ttatttaatgtacacttgat

SEQ ID NO: 476634 - DNA, 20 bp, Artificial Sequence
  chemically synthesized
ttaatgtacacttgatttga

SEQ ID NO: 476635 - DNA, 20 bp, Artificial Sequence
  chemically synthesized
cctagaatctgggagaggag

SEQ ID NO: 476636 - DNA, 20 bp, Artificial Sequence
  chemically synthesized
ccttctcctctcccagattc

SEQ ID NO: 476637 - DNA, 20 bp, Artificial Sequence
  chemically synthesized
cttaaacttttcccttatcc

SEQ ID NO: 476638 - DNA, 20 bp, Artificial Sequence
  chemically synthesized
ggtatatgaaaagagaatta

SEQ ID NO: 476639 - DNA, 20 bp, Artificial Sequence
  chemically synthesized
gggtgagtggtatatgaaaa

SEQ ID NO: 476640 - DNA, 20 bp, Artificial Sequence
  chemically synthesized
gttcatggttgtggtatagg

SEQ ID NO: 476641 - DNA, 20 bp, Artificial Sequence
  chemically synthesized
aaaagttcatggttgtggta

SEQ ID NO: 476642 - DNA, 20 bp, Artificial Sequence
  chemically synthesized
agctgaagtggttgaggaag

SEQ ID NO: 476643 - DNA, 20 bp, Artificial Sequence
  chemically synthesized
tcaactgggagaaagtagaa

SEQ ID NO: 476644 - DNA, 20 bp, Artificial Sequence
  chemically synthesized
gagatgaaatagagatgatg

SEQ ID NO: 476645 - DNA, 20 bp, Artificial Sequence
  chemically synthesized
tgaggctctgtgttcagggg

SEQ ID NO: 476646 - DNA, 20 bp, Artificial Sequence
  chemically synthesized
cccctgaacacagagcctca

SEQ ID NO: 476647 - DNA, 20 bp, Artificial Sequence
  chemically synthesized
gaatagctaacagcttctcc

SEQ ID NO: 476648 - DNA, 20 bp, Artificial Sequence
  chemically synthesized
gtaaaatctacttgctagat

SEQ ID NO: 476649 - DNA, 20 bp, Artificial Sequence
  chemically synthesized
tctaggatattaaaaatagt

SEQ ID NO: 476650 - DNA, 20 bp, Artificial Sequence
  chemically synthesized
ctttatagagtttctgaatc

SEQ ID NO: 476651 - DNA, 20 bp, Artificial Sequence
  chemically synthesized
aatagtactttatagagttt

SEQ ID NO: 476652 - DNA, 20 bp, Artificial Sequence
  chemically synthesized
gatgataaaatagtacttta

SEQ ID NO: 476653 - DNA, 20 bp, Artificial Sequence
  chemically synthesized
gtttggtagaaaagtgtaag

SEQ ID NO: 476654 - DNA, 20 bp, Artificial Sequence
  chemically synthesized
tcttgctttgtcactcagcc

SEQ ID NO: 476655 - DNA, 20 bp, Artificial Sequence
  chemically synthesized
tcactccactgtactccagg

SEQ ID NO: 476656 - DNA, 20 bp, Artificial Sequence
  chemically synthesized
tcactcagcctggagtacag

SEQ ID NO: 476657 - DNA, 20 bp, Artificial Sequence
  chemically synthesized
agtcctcctgccccagcctt

SEQ ID NO: 476658 - DNA, 20 bp, Artificial Sequence
  chemically synthesized
tgggtgggttgcatgagctc

SEQ ID NO: 476659 - DNA, 20 bp, Artificial Sequence
  chemically synthesized
actttgggaggccgaggtgg

SEQ ID NO: 476660 - DNA, 20 bp, Artificial Sequence
  chemically synthesized
cagcactttgggaggccgag

SEQ ID NO: 476661 - DNA, 20 bp, Artificial Sequence
  chemically synthesized
acctcggcctcccaaagtgc

SEQ ID NO: 476662 - DNA, 20 bp, Artificial Sequence
  chemically synthesized
taatgacactggtacaattt

SEQ ID NO: 476663 - DNA, 20 bp, Artificial Sequence
  chemically synthesized
tttcgcttaggaaccttgaa

SEQ ID NO: 476664 - DNA, 20 bp, Artificial Sequence
  chemically synthesized
tgcaggcacacagcctcttg

SEQ ID NO: 476665 - DNA, 20 bp, Artificial Sequence
  chemically synthesized
ccagaagatttagtttaaaa

SEQ ID NO: 476666 - DNA, 20 bp, Artificial Sequence
  chemically synthesized
tcatttttaaactaaatctt

SEQ ID NO: 476667 - DNA, 20 bp, Artificial Sequence
  chemically synthesized
catacacagtagctttacta

SEQ ID NO: 476668 - DNA, 20 bp, Artificial Sequence
  chemically synthesized
tactatggaatattggttct

SEQ ID NO: 476669 - DNA, 20 bp, Artificial Sequence
  chemically synthesized
ttagccttgccccagacatt

SEQ ID NO: 476670 - DNA, 20 bp, Artificial Sequence
  chemically synthesized
tgaatcaggaactctgggga

SEQ ID NO: 476671 - DNA, 20 bp, Artificial Sequence
  chemically synthesized
aggttggtgaaccccttccc

SEQ ID NO: 476672 - DNA, 20 bp, Artificial Sequence
  chemically synthesized
tggggaaggggttcaccaac

SEQ ID NO: 476673 - DNA, 20 bp, Artificial Sequence
  chemically synthesized
gttctcacctcagcatacat

SEQ ID NO: 476674 - DNA, 20 bp, Artificial Sequence
  chemically synthesized
cagacatcattgagaatgtc

SEQ ID NO: 476675 - DNA, 20 bp, Artificial Sequence
  chemically synthesized
agacatgtccagacatcatt

SEQ ID NO: 476676 - DNA, 20 bp, Artificial Sequence
  chemically synthesized
tcaatgatgtctggacatgt

SEQ ID NO: 476677 - DNA, 20 bp, Artificial Sequence
  chemically synthesized
tgagtttggctttatagtta

SEQ ID NO: 476678 - DNA, 20 bp, Artificial Sequence
  chemically synthesized
gtaagaaaatggcctcataa

SEQ ID NO: 476679 - DNA, 20 bp, Artificial Sequence
  chemically synthesized
gtgatggaagagaagagtta

SEQ ID NO: 476680 - DNA, 20 bp, Artificial Sequence
  chemically synthesized
cagaattagtgatggaagag

SEQ ID NO: 476681 - DNA, 20 bp, Artificial Sequence
  chemically synthesized
atagcttgatagctgttcat

SEQ ID NO: 476682 - DNA, 20 bp, Artificial Sequence
  chemically synthesized
agctatcaagctattcatgg

SEQ ID NO: 476683 - DNA, 20 bp, Artificial Sequence
  chemically synthesized
cacctaccctccaccctacc

SEQ ID NO: 476684 - DNA, 20 bp, Artificial Sequence
  chemically synthesized
aagctattcatggtagggtg

SEQ ID NO: 476685 - DNA, 20 bp, Artificial Sequence
  chemically synthesized
catggtagggtggagggtag

SEQ ID NO: 476686 - DNA, 20 bp, Artificial Sequence
  chemically synthesized
agtaattctttataaataat

SEQ ID NO: 476687 - DNA, 20 bp, Artificial Sequence
  chemically synthesized
caaaattctcattatttata

SEQ ID NO: 476688 - DNA, 20 bp, Artificial Sequence
  chemically synthesized
cagcattaaaaaaagccaag

SEQ ID NO: 476689 - DNA, 20 bp, Artificial Sequence
  chemically synthesized
aaaaagccaagttgaatatg

SEQ ID NO: 476690 - DNA, 20 bp, Artificial Sequence
  chemically synthesized
agccaagttgaatatgaaga

SEQ ID NO: 476691 - DNA, 20 bp, Artificial Sequence
  chemically synthesized
aagttgaatatgaagagtga

SEQ ID NO: 476692 - DNA, 20 bp, Artificial Sequence
  chemically synthesized
accatcacagcagctgaagg

SEQ ID NO: 476693 - DNA, 20 bp, Artificial Sequence
  chemically synthesized
gtcaaccatcacagcagctg

SEQ ID NO: 476694 - DNA, 20 bp, Artificial Sequence
  chemically synthesized
caggaagtaacccatatccc

SEQ ID NO: 476695 - DNA, 20 bp, Artificial Sequence
  chemically synthesized
ctgtggtccactcctgggat

SEQ ID NO: 476696 - DNA, 20 bp, Artificial Sequence
  chemically synthesized
cactggctgtggtccactcc

SEQ ID NO: 476697 - DNA, 20 bp, Artificial Sequence
  chemically synthesized
cgacataatgccactgagta

SEQ ID NO: 476698 - DNA, 20 bp, Artificial Sequence
  chemically synthesized
cagctaccgacataatgcca

SEQ ID NO: 476699 - DNA, 20 bp, Artificial Sequence
  chemically synthesized
agctggagatcagtggtaga

SEQ ID NO: 476700 - DNA, 20 bp, Artificial Sequence
  chemically synthesized
aaactggttttgatacacac

SEQ ID NO: 476701 - DNA, 20 bp, Artificial Sequence
  chemically synthesized
tcgactagctctgaggtggg

SEQ ID NO: 476702 - DNA, 20 bp, Artificial Sequence
  chemically synthesized
tttgtcgactagctctgagg

SEQ ID NO: 476703 - DNA, 20 bp, Artificial Sequence
  chemically synthesized
cgtaagccacaacaccgagc

SEQ ID NO: 476704 - DNA, 20 bp, Artificial Sequence
  chemically synthesized
acctcagcctcccaaagtgc

SEQ ID NO: 476705 - DNA, 20 bp, Artificial Sequence
  chemically synthesized
tgggcagatcacctgaggtc

SEQ ID NO: 476706 - DNA, 20 bp, Artificial Sequence
  chemically synthesized
ttttgtgtttttagtagaga

SEQ ID NO: 476707 - DNA, 20 bp, Artificial Sequence
  chemically synthesized
gcctcagcctcctgagtagc

SEQ ID NO: 476708 - DNA, 20 bp, Artificial Sequence
  chemically synthesized
gattctcctgcctcagcctc

SEQ ID NO: 476709 - DNA, 20 bp, Artificial Sequence
  chemically synthesized
tactcaggaggctgaggcag

SEQ ID NO: 476710 - DNA, 20 bp, Artificial Sequence
  chemically synthesized
ttcgctcttgttgcccaggc

SEQ ID NO: 476711 - DNA, 20 bp, Artificial Sequence
  chemically synthesized
tttattttatttttttgaga

SEQ ID NO: 476712 - DNA, 20 bp, Artificial Sequence
  chemically synthesized
caaaaaaataaaataaaata

SEQ ID NO: 476713 - DNA, 20 bp, Artificial Sequence
  chemically synthesized
ctcgagcagaaacctcgctg

SEQ ID NO: 476714 - DNA, 20 bp, Artificial Sequence
  chemically synthesized
ctcgagggcttgctctctct

SEQ ID NO: 476715 - DNA, 20 bp, Artificial Sequence
  chemically synthesized
ctctcaggagaagcctgtat

SEQ ID NO: 476716 - DNA, 20 bp, Artificial Sequence
  chemically synthesized
ctaggtgcctgtgatttata

SEQ ID NO: 476717 - DNA, 20 bp, Artificial Sequence
  chemically synthesized
ggcacctagacccctgttct

SEQ ID NO: 476718 - DNA, 20 bp, Artificial Sequence
  chemically synthesized
tgaacgcagaccctgagaac

SEQ ID NO: 476719 - DNA, 20 bp, Artificial Sequence
  chemically synthesized
tgtgcatagtcacttaacta

SEQ ID NO: 476720 - DNA, 20 bp, Artificial Sequence
  chemically synthesized
gagctgctagtcatggaact

SEQ ID NO: 476721 - DNA, 20 bp, Artificial Sequence
  chemically synthesized
aaagataaatttgaaatagc

SEQ ID NO: 476722 - DNA, 20 bp, Artificial Sequence
  chemically synthesized
aagttgagaatcacagtata

SEQ ID NO: 476723 - DNA, 20 bp, Artificial Sequence
  chemically synthesized
tggacatgaaagcgtaagtt

SEQ ID NO: 476724 - DNA, 20 bp, Artificial Sequence
  chemically synthesized
ttacgctttcatgtccatag

SEQ ID NO: 476725 - DNA, 20 bp, Artificial Sequence
  chemically synthesized
tgctgaaagattccttactt

SEQ ID NO: 476726 - DNA, 20 bp, Artificial Sequence
  chemically synthesized
tttcttcaaattctgaagta

SEQ ID NO: 476727 - DNA, 20 bp, Artificial Sequence
  chemically synthesized
catcttcatattaaaacatg

SEQ ID NO: 476728 - DNA, 20 bp, Artificial Sequence
  chemically synthesized
attttatggtattttccata

SEQ ID NO: 476729 - DNA, 20 bp, Artificial Sequence
  chemically synthesized
taactgaagtaaataagttt

SEQ ID NO: 476730 - DNA, 20 bp, Artificial Sequence
  chemically synthesized
tttcttggtaaatcagtttt

SEQ ID NO: 476731 - DNA, 20 bp, Artificial Sequence
  chemically synthesized
aactaagttaagtaatggca

SEQ ID NO: 476732 - DNA, 20 bp, Artificial Sequence
  chemically synthesized
gacaggaagaagcgaactcc

SEQ ID NO: 476733 - DNA, 20 bp, Artificial Sequence
  chemically synthesized
ctttaagatcaaataaccca

SEQ ID NO: 476734 - DNA, 20 bp, Artificial Sequence
  chemically synthesized
cctgttttactgaacggtag

SEQ ID NO: 476735 - DNA, 20 bp, Artificial Sequence
  chemically synthesized
actgaacggtaggagagtaa

SEQ ID NO: 476736 - DNA, 20 bp, Artificial Sequence
  chemically synthesized
acatctaccaaagttgtgac

SEQ ID NO: 476737 - DNA, 20 bp, Artificial Sequence
  chemically synthesized
ttccatatttcctaagaaaa

SEQ ID NO: 476738 - DNA, 20 bp, Artificial Sequence
  chemically synthesized
ttccattttcttaggaaata

SEQ ID NO: 476739 - DNA, 20 bp, Artificial Sequence
  chemically synthesized
actagaaacagtgctaaaat

SEQ ID NO: 476740 - DNA, 20 bp, Artificial Sequence
  chemically synthesized
tagcaccaagctgagggagc

SEQ ID NO: 476741 - DNA, 20 bp, Artificial Sequence
  chemically synthesized
gatggcatcttagttttcct

SEQ ID NO: 476742 - DNA, 20 bp, Artificial Sequence
  chemically synthesized
tcaaaaacaaaaattatatt

SEQ ID NO: 476743 - DNA, 20 bp, Artificial Sequence
  chemically synthesized
agagaagtctgatctcatta

SEQ ID NO: 476744 - DNA, 20 bp, Artificial Sequence
  chemically synthesized
tataatgagatcagacttct

SEQ ID NO: 476745 - DNA, 20 bp, Artificial Sequence
  chemically synthesized
gtataggtttcaatcatatc

SEQ ID NO: 476746 - DNA, 20 bp, Artificial Sequence
  chemically synthesized
ttcaatcatatcatgaatta

SEQ ID NO: 476747 - DNA, 20 bp, Artificial Sequence
  chemically synthesized
atcatatcatgaattaatga

SEQ ID NO: 476748 - DNA, 20 bp, Artificial Sequence
  chemically synthesized
tttgtatatcctctaatact

SEQ ID NO: 476749 - DNA, 20 bp, Artificial Sequence
  chemically synthesized
gtaatatactctcagtatta

SEQ ID NO: 476750 - DNA, 20 bp, Artificial Sequence
  chemically synthesized
gagtatattacttaagtttt

SEQ ID NO: 476751 - DNA, 20 bp, Artificial Sequence
  chemically synthesized
aatactattcctcaagagtc

SEQ ID NO: 476752 - DNA, 20 bp, Artificial Sequence
  chemically synthesized
tttattacccgagactcttg

SEQ ID NO: 476753 - DNA, 20 bp, Artificial Sequence
  chemically synthesized
aactagaaatactattcctc

SEQ ID NO: 476754 - DNA, 20 bp, Artificial Sequence
  chemically synthesized
ttctgaaagctttgtttgtg

SEQ ID NO: 476755 - DNA, 20 bp, Artificial Sequence
  chemically synthesized
tttcagaaaatcctagcaaa

SEQ ID NO: 476756 - DNA, 20 bp, Artificial Sequence
  chemically synthesized
aatatgccaatcctgtttgc

SEQ ID NO: 476757 - DNA, 20 bp, Artificial Sequence
  chemically synthesized
caaacaggattggcatatta

SEQ ID NO: 476758 - DNA, 20 bp, Artificial Sequence
  chemically synthesized
ggttgttttcaaatagtagg

SEQ ID NO: 476759 - DNA, 20 bp, Artificial Sequence
  chemically synthesized
attatctgattaaacacttc

SEQ ID NO: 476760 - DNA, 20 bp, Artificial Sequence
  chemically synthesized
ctgattaaacacttcttgag

SEQ ID NO: 476761 - DNA, 20 bp, Artificial Sequence
  chemically synthesized
gtaatcaaaatgttcagcta

SEQ ID NO: 476762 - DNA, 20 bp, Artificial Sequence
  chemically synthesized
catgggatatttaggagaac

SEQ ID NO: 476763 - DNA, 20 bp, Artificial Sequence
  chemically synthesized
cctaaatatcccatgaccag

SEQ ID NO: 476764 - DNA, 20 bp, Artificial Sequence
  chemically synthesized
tacagctactcttctggtca

SEQ ID NO: 476765 - DNA, 20 bp, Artificial Sequence
  chemically synthesized
ttattgttattggattaaat

SEQ ID NO: 476766 - DNA, 20 bp, Artificial Sequence
  chemically synthesized
agaattggttattattgtta

SEQ ID NO: 476767 - DNA, 20 bp, Artificial Sequence
  chemically synthesized
actgtgataaaagaaggagc

SEQ ID NO: 476768 - DNA, 20 bp, Artificial Sequence
  chemically synthesized
tttcatagatgagataatga

SEQ ID NO: 476769 - DNA, 20 bp, Artificial Sequence
  chemically synthesized
atctatgaaagtaaaagcag

SEQ ID NO: 476770 - DNA, 20 bp, Artificial Sequence
  chemically synthesized
cagtcaaaaaaggaagcgtt

SEQ ID NO: 476771 - DNA, 20 bp, Artificial Sequence
  chemically synthesized
aaaacagtgggtgggaggaa

SEQ ID NO: 476772 - DNA, 20 bp, Artificial Sequence
  chemically synthesized
caaacaaacgatttaaaaca

SEQ ID NO: 476773 - DNA, 20 bp, Artificial Sequence
  chemically synthesized
gtctttgcaattgtttttgt

SEQ ID NO: 476774 - DNA, 20 bp, Artificial Sequence
  chemically synthesized
ggaatttggagagctgacaa

SEQ ID NO: 476775 - DNA, 20 bp, Artificial Sequence
  chemically synthesized
gtagaaaatggcaattctac

SEQ ID NO: 476776 - DNA, 20 bp, Artificial Sequence
  chemically synthesized
gacttaaaagctaattcatg

SEQ ID NO: 476777 - DNA, 20 bp, Artificial Sequence
  chemically synthesized
caccgaagtctataatcaat

SEQ ID NO: 476778 - DNA, 20 bp, Artificial Sequence
  chemically synthesized
tagacttcggtgaagacagc

SEQ ID NO: 476779 - DNA, 20 bp, Artificial Sequence
  chemically synthesized
aaacttctgaaaaggcagag

SEQ ID NO: 476780 - DNA, 20 bp, Artificial Sequence
  chemically synthesized
cttttcagaagtttcaaagg

SEQ ID NO: 476781 - DNA, 20 bp, Artificial Sequence
  chemically synthesized
agaagtttcaaaggcgggat

SEQ ID NO: 476782 - DNA, 20 bp, Artificial Sequence
  chemically synthesized
aaacaaagcaggagatgaga

SEQ ID NO: 476783 - DNA, 20 bp, Artificial Sequence
  chemically synthesized
aacttacaattaatttcaca

SEQ ID NO: 476784 - DNA, 20 bp, Artificial Sequence
  chemically synthesized
cattgaataaataatttggt

SEQ ID NO: 476785 - DNA, 20 bp, Artificial Sequence
  chemically synthesized
tattattatactttaagttc

SEQ ID NO: 476786 - DNA, 20 bp, Artificial Sequence
  chemically synthesized
ctaatgtagatgacaggttg

SEQ ID NO: 476787 - DNA, 20 bp, Artificial Sequence
  chemically synthesized
gaggggtgggaggttagggg

SEQ ID NO: 476788 - DNA, 20 bp, Artificial Sequence
  chemically synthesized
tcacacaccggggcctgtcg

SEQ ID NO: 476789 - DNA, 20 bp, Artificial Sequence
  chemically synthesized
tcgttgttcaactcccactt

SEQ ID NO: 476790 - DNA, 20 bp, Artificial Sequence
  chemically synthesized
gcatgttctcactcgtaagt

SEQ ID NO: 476791 - DNA, 20 bp, Artificial Sequence
  chemically synthesized
ttcatgtccttggcagggac

SEQ ID NO: 476792 - DNA, 20 bp, Artificial Sequence
  chemically synthesized
ctatgcagccataagaaagg

SEQ ID NO: 476793 - DNA, 20 bp, Artificial Sequence
  chemically synthesized
aatactatgcagccataaga

SEQ ID NO: 476794 - DNA, 20 bp, Artificial Sequence
  chemically synthesized
aacgtggcacagatacacca

SEQ ID NO: 476795 - DNA, 20 bp, Artificial Sequence
  chemically synthesized
aaatgctcatcaatgataga

SEQ ID NO: 476796 - DNA, 20 bp, Artificial Sequence
  chemically synthesized
agtctatcattgatgagcat

SEQ ID NO: 476797 - DNA, 20 bp, Artificial Sequence
  chemically synthesized
atgtgcatgtgtctttatag

SEQ ID NO: 476798 - DNA, 20 bp, Artificial Sequence
  chemically synthesized
gtagaatgatttataatcct

SEQ ID NO: 476799 - DNA, 20 bp, Artificial Sequence
  chemically synthesized
cattactggttatataccca

SEQ ID NO: 476800 - DNA, 20 bp, Artificial Sequence
  chemically synthesized
tttgggtatataaccagtaa

SEQ ID NO: 476801 - DNA, 20 bp, Artificial Sequence
  chemically synthesized
tataaccagtaatgggattg

SEQ ID NO: 476802 - DNA, 20 bp, Artificial Sequence
  chemically synthesized
cttctggttctagatccttg

SEQ ID NO: 476803 - DNA, 20 bp, Artificial Sequence
  chemically synthesized
agacagtgtggcaattcctc

SEQ ID NO: 476804 - DNA, 20 bp, Artificial Sequence
  chemically synthesized
tgtgcttttacactgttggt

SEQ ID NO: 476805 - DNA, 20 bp, Artificial Sequence
  chemically synthesized
acctaatcaaaaattgggca

SEQ ID NO: 476806 - DNA, 20 bp, Artificial Sequence
  chemically synthesized
gtttaagttccttgtagatt

SEQ ID NO: 476807 - DNA, 20 bp, Artificial Sequence
  chemically synthesized
tctgacaaagggctgatatc

SEQ ID NO: 476808 - DNA, 20 bp, Artificial Sequence
  chemically synthesized
ggatatcagccctttgtcag

SEQ ID NO: 476809 - DNA, 20 bp, Artificial Sequence
  chemically synthesized
cagagtgaacaagcaaccta

SEQ ID NO: 476810 - DNA, 20 bp, Artificial Sequence
  chemically synthesized
acagcaaaagaaactatcat

SEQ ID NO: 476811 - DNA, 20 bp, Artificial Sequence
  chemically synthesized
caaaagccaaaattgacaaa

SEQ ID NO: 476812 - DNA, 20 bp, Artificial Sequence
  chemically synthesized
tctttgcccatgcctatatc

SEQ ID NO: 476813 - DNA, 20 bp, Artificial Sequence
  chemically synthesized
aaaacctaggcaataccatt

SEQ ID NO: 476814 - DNA, 20 bp, Artificial Sequence
  chemically synthesized
gtattgcctaggttttcttc

SEQ ID NO: 476815 - DNA, 20 bp, Artificial Sequence
  chemically synthesized
ttaggttttatgtttaagtc

SEQ ID NO: 476816 - DNA, 20 bp, Artificial Sequence
  chemically synthesized
ttttgtataaggtgtaagga

SEQ ID NO: 476817 - DNA, 20 bp, Artificial Sequence
  chemically synthesized
tccctattcagtaaatggtg

SEQ ID NO: 476818 - DNA, 20 bp, Artificial Sequence
  chemically synthesized
ggtttacccagcaccattta

SEQ ID NO: 476819 - DNA, 20 bp, Artificial Sequence
  chemically synthesized
ccagcaccatttactgaata

SEQ ID NO: 476820 - DNA, 20 bp, Artificial Sequence
  chemically synthesized
acaaaaacaagcaatggaga

SEQ ID NO: 476821 - DNA, 20 bp, Artificial Sequence
  chemically synthesized
ccagctttgttctttttgct

SEQ ID NO: 476822 - DNA, 20 bp, Artificial Sequence
  chemically synthesized
gtagcttgatggagactgca

SEQ ID NO: 476823 - DNA, 20 bp, Artificial Sequence
  chemically synthesized
attccatgctcatggatagg

SEQ ID NO: 476824 - DNA, 20 bp, Artificial Sequence
  chemically synthesized
attcttcctatccatgagca

SEQ ID NO: 476825 - DNA, 20 bp, Artificial Sequence
  chemically synthesized
tggaagaacattccatgctc

SEQ ID NO: 476826 - DNA, 20 bp, Artificial Sequence
  chemically synthesized
acctaggaatacaacttaga

SEQ ID NO: 476827 - DNA, 20 bp, Artificial Sequence
  chemically synthesized
tcaaagagaataaaatacct

SEQ ID NO: 476828 - DNA, 20 bp, Artificial Sequence
  chemically synthesized
ccattcacaattgcttcaaa

SEQ ID NO: 476829 - DNA, 20 bp, Artificial Sequence
  chemically synthesized
ttattctctttgaagcaatt

SEQ ID NO: 476830 - DNA, 20 bp, Artificial Sequence
  chemically synthesized
tctttgaagcaattgtgaat

SEQ ID NO: 476831 - DNA, 20 bp, Artificial Sequence
  chemically synthesized
aagagagtgccaaatcatga

SEQ ID NO: 476832 - DNA, 20 bp, Artificial Sequence
  chemically synthesized
gacaaagagagtgccaaatc

SEQ ID NO: 476833 - DNA, 20 bp, Artificial Sequence
  chemically synthesized
atacgccaataatagacaaa

SEQ ID NO: 476834 - DNA, 20 bp, Artificial Sequence
  chemically synthesized
tttgtctattattggcgtat

SEQ ID NO: 476835 - DNA, 20 bp, Artificial Sequence
  chemically synthesized
aagcaacttcagcaaagtct

SEQ ID NO: 476836 - DNA, 20 bp, Artificial Sequence
  chemically synthesized
cttatcagcttaagaagatt

SEQ ID NO: 476837 - DNA, 20 bp, Artificial Sequence
  chemically synthesized
aagattttgggttgagacga

SEQ ID NO: 476838 - DNA, 20 bp, Artificial Sequence
  chemically synthesized
ctgacttcctctcttcctat

SEQ ID NO: 476839 - DNA, 20 bp, Artificial Sequence
  chemically synthesized
tcaggcaagggaaagaaata

SEQ ID NO: 476840 - DNA, 20 bp, Artificial Sequence
  chemically synthesized
ccaaaacttccaatattatg

SEQ ID NO: 476841 - DNA, 20 bp, Artificial Sequence
  chemically synthesized
cttccaatattatgttgaat

SEQ ID NO: 476842 - DNA, 20 bp, Artificial Sequence
  chemically synthesized
tttaaaaaccggcacaagac

SEQ ID NO: 476843 - DNA, 20 bp, Artificial Sequence
  chemically synthesized
gtcttgtgccggtttttaaa

SEQ ID NO: 476844 - DNA, 20 bp, Artificial Sequence
  chemically synthesized
aacccacagccattatcata

SEQ ID NO: 476845 - DNA, 20 bp, Artificial Sequence
  chemically synthesized
cattcagtatgataatggct

SEQ ID NO: 476846 - DNA, 20 bp, Artificial Sequence
  chemically synthesized
ccatcagtacctaatttatt

SEQ ID NO: 476847 - DNA, 20 bp, Artificial Sequence
  chemically synthesized
attgagagtttttagcatga

SEQ ID NO: 476848 - DNA, 20 bp, Artificial Sequence
  chemically synthesized
gtttttagcatgaaggggtg

SEQ ID NO: 476849 - DNA, 20 bp, Artificial Sequence
  chemically synthesized
tcattggttctgtttaagtg

SEQ ID NO: 476850 - DNA, 20 bp, Artificial Sequence
  chemically synthesized
ttgaaccagcctggcatccc

SEQ ID NO: 476851 - DNA, 20 bp, Artificial Sequence
  chemically synthesized
gatcaagttggcttcatccc

SEQ ID NO: 476852 - DNA, 20 bp, Artificial Sequence
  chemically synthesized
atgaagccaacttgatcatg

SEQ ID NO: 476853 - DNA, 20 bp, Artificial Sequence
  chemically synthesized
ataagctttttcatgtgctg

SEQ ID NO: 476854 - DNA, 20 bp, Artificial Sequence
  chemically synthesized
ctcaataaaatactggcaaa

SEQ ID NO: 476855 - DNA, 20 bp, Artificial Sequence
  chemically synthesized
cggtttgccagtattttatt

SEQ ID NO: 476856 - DNA, 20 bp, Artificial Sequence
  chemically synthesized
ttttcgcattgatgttcatc

SEQ ID NO: 476857 - DNA, 20 bp, Artificial Sequence
  chemically synthesized
tctctgccaggttttggtat

SEQ ID NO: 476858 - DNA, 20 bp, Artificial Sequence
  chemically synthesized
gatgatgctggcctcataaa

SEQ ID NO: 476859 - DNA, 20 bp, Artificial Sequence
  chemically synthesized
cctcataaaaagagttaggg

SEQ ID NO: 476860 - DNA, 20 bp, Artificial Sequence
  chemically synthesized
gtccctcttttcctattgtt

SEQ ID NO: 476861 - DNA, 20 bp, Artificial Sequence
  chemically synthesized
ttgtttagaatagtttcaga

SEQ ID NO: 476862 - DNA, 20 bp, Artificial Sequence
  chemically synthesized
gctcctctttgtacctctgg

SEQ ID NO: 476863 - DNA, 20 bp, Artificial Sequence
  chemically synthesized
acctctggtagaattcagct

SEQ ID NO: 476864 - DNA, 20 bp, Artificial Sequence
  chemically synthesized
aggaacagatggattcacag

SEQ ID NO: 476865 - DNA, 20 bp, Artificial Sequence
  chemically synthesized
caaaaaaagcccaggaacag

SEQ ID NO: 476866 - DNA, 20 bp, Artificial Sequence
  chemically synthesized
aatccctgaatagaccaata

SEQ ID NO: 476867 - DNA, 20 bp, Artificial Sequence
  chemically synthesized
aactcgttattggtctattc

SEQ ID NO: 476868 - DNA, 20 bp, Artificial Sequence
  chemically synthesized
accaggaagaaatcgaatcc

SEQ ID NO: 476869 - DNA, 20 bp, Artificial Sequence
  chemically synthesized
aagactaaaccaggaagaaa

SEQ ID NO: 476870 - DNA, 20 bp, Artificial Sequence
  chemically synthesized
tcttcctggtttagtcttgg

SEQ ID NO: 476871 - DNA, 20 bp, Artificial Sequence
  chemically synthesized
agaaatacaaactaccatca

SEQ ID NO: 476872 - DNA, 20 bp, Artificial Sequence
  chemically synthesized
gatggtagtttgtatttctg

SEQ ID NO: 476873 - DNA, 20 bp, Artificial Sequence
  chemically synthesized
acacaagaaaaaatgataaa

SEQ ID NO: 476874 - DNA, 20 bp, Artificial Sequence
  chemically synthesized
taataaagaagaaaagagag

SEQ ID NO: 476875 - DNA, 20 bp, Artificial Sequence
  chemically synthesized
ctggcttcattgattttttg

SEQ ID NO: 476876 - DNA, 20 bp, Artificial Sequence
  chemically synthesized
ttcttctcttctgctagctt

SEQ ID NO: 476877 - DNA, 20 bp, Artificial Sequence
  chemically synthesized
tatttcctgctttctcctgt

SEQ ID NO: 476878 - DNA, 20 bp, Artificial Sequence
  chemically synthesized
agaataaatacacaacggac

SEQ ID NO: 476879 - DNA, 20 bp, Artificial Sequence
  chemically synthesized
ataagttctttcaaaccaat

SEQ ID NO: 476880 - DNA, 20 bp, Artificial Sequence
  chemically synthesized
ataaggaaattaaggcagaa

SEQ ID NO: 476881 - DNA, 20 bp, Artificial Sequence
  chemically synthesized
aacctgctcctgaatgactg

SEQ ID NO: 476882 - DNA, 20 bp, Artificial Sequence
  chemically synthesized
ggaaactgagcaacctgctc

SEQ ID NO: 476883 - DNA, 20 bp, Artificial Sequence
  chemically synthesized
ttccatgtagttgtgtggtt

SEQ ID NO: 476884 - DNA, 20 bp, Artificial Sequence
  chemically synthesized
atgtagttgtgtggttttga

SEQ ID NO: 476885 - DNA, 20 bp, Artificial Sequence
  chemically synthesized
tttgagtgagtttcttaatc

SEQ ID NO: 476886 - DNA, 20 bp, Artificial Sequence
  chemically synthesized
agtacaatcaaattagaact

SEQ ID NO: 476887 - DNA, 20 bp, Artificial Sequence
  chemically synthesized
tgcaaaaaaacagaaatcat

SEQ ID NO: 476888 - DNA, 20 bp, Artificial Sequence
  chemically synthesized
ctgtttttttgcatttgctg

SEQ ID NO: 476889 - DNA, 20 bp, Artificial Sequence
  chemically synthesized
aataagtgtgatgtggtgct

SEQ ID NO: 476890 - DNA, 20 bp, Artificial Sequence
  chemically synthesized
taatgtatattctgttgatt

SEQ ID NO: 476891 - DNA, 20 bp, Artificial Sequence
  chemically synthesized
aactccccaccccaaatcaa

SEQ ID NO: 476892 - DNA, 20 bp, Artificial Sequence
  chemically synthesized
tattctgttgatttggggtg

SEQ ID NO: 476893 - DNA, 20 bp, Artificial Sequence
  chemically synthesized
taagtccacttggtccagag

SEQ ID NO: 476894 - DNA, 20 bp, Artificial Sequence
  chemically synthesized
tccagagctgagtttaagtc

SEQ ID NO: 476895 - DNA, 20 bp, Artificial Sequence
  chemically synthesized
caacgaaacagaaaattaac

SEQ ID NO: 476896 - DNA, 20 bp, Artificial Sequence
  chemically synthesized
caccccactgtcaatattag

SEQ ID NO: 476897 - DNA, 20 bp, Artificial Sequence
  chemically synthesized
gatccgtctaatattgacag

SEQ ID NO: 476898 - DNA, 20 bp, Artificial Sequence
  chemically synthesized
ggtctctaagaacttacttt

SEQ ID NO: 476899 - DNA, 20 bp, Artificial Sequence
  chemically synthesized
taagaacttactttatgaat

SEQ ID NO: 476900 - DNA, 20 bp, Artificial Sequence
  chemically synthesized
tgcacccaatataggagcac

SEQ ID NO: 476901 - DNA, 20 bp, Artificial Sequence
  chemically synthesized
tgaatccgggtgctcctata

SEQ ID NO: 476902 - DNA, 20 bp, Artificial Sequence
  chemically synthesized
atattgggtgcatatatatt

SEQ ID NO: 476903 - DNA, 20 bp, Artificial Sequence
  chemically synthesized
aagtctgttttgtctgagac

SEQ ID NO: 476904 - DNA, 20 bp, Artificial Sequence
  chemically synthesized
aatggaaagaaaaaaaaagc

SEQ ID NO: 476905 - DNA, 20 bp, Artificial Sequence
  chemically synthesized
ggctcaaaataaagggatcg

SEQ ID NO: 476906 - DNA, 20 bp, Artificial Sequence
  chemically synthesized
cacacataggctcaaaataa

SEQ ID NO: 476907 - DNA, 20 bp, Artificial Sequence
  chemically synthesized
tgtgtgtctctgcacatgag

SEQ ID NO: 476908 - DNA, 20 bp, Artificial Sequence
  chemically synthesized
ctgcacatgaggtgggtctt

SEQ ID NO: 476909 - DNA, 20 bp, Artificial Sequence
  chemically synthesized
cttctgaatacagcacactg

SEQ ID NO: 476910 - DNA, 20 bp, Artificial Sequence
  chemically synthesized
atacagcacactgatgggtc

SEQ ID NO: 476911 - DNA, 20 bp, Artificial Sequence
  chemically synthesized
aaaagacacagactggcaaa

SEQ ID NO: 476912 - DNA, 20 bp, Artificial Sequence
  chemically synthesized
taaggttaatattgttatgt

SEQ ID NO: 476913 - DNA, 20 bp, Artificial Sequence
  chemically synthesized
accagctagcatcataatga

SEQ ID NO: 476914 - DNA, 20 bp, Artificial Sequence
  chemically synthesized
tcagcatttgcttgtctgta

SEQ ID NO: 476915 - DNA, 20 bp, Artificial Sequence
  chemically synthesized
gcttatgaagcttagtttgg

SEQ ID NO: 476916 - DNA, 20 bp, Artificial Sequence
  chemically synthesized
gtttggctggatatgaaatt

SEQ ID NO: 476917 - DNA, 20 bp, Artificial Sequence
  chemically synthesized
aaagaaaagaattttcaacc

SEQ ID NO: 476918 - DNA, 20 bp, Artificial Sequence
  chemically synthesized
ggttgaaaattcttttcttt

SEQ ID NO: 476919 - DNA, 20 bp, Artificial Sequence
  chemically synthesized
tattcaacattcttaaagaa

SEQ ID NO: 476920 - DNA, 20 bp, Artificial Sequence
  chemically synthesized
aattcttttctttaagaatg

SEQ ID NO: 476921 - DNA, 20 bp, Artificial Sequence
  chemically synthesized
agaaaccctacaagccagaa

SEQ ID NO: 476922 - DNA, 20 bp, Artificial Sequence
  chemically synthesized
ccccactctcttctggcttg

SEQ ID NO: 476923 - DNA, 20 bp, Artificial Sequence
  chemically synthesized
gaaagcccatcagactaaca

SEQ ID NO: 476924 - DNA, 20 bp, Artificial Sequence
  chemically synthesized
tagtctgatgggctttcctt

SEQ ID NO: 476925 - DNA, 20 bp, Artificial Sequence
  chemically synthesized
tttccttcatttcaaccttg

SEQ ID NO: 476926 - DNA, 20 bp, Artificial Sequence
  chemically synthesized
caacccaagacacataataa

SEQ ID NO: 476927 - DNA, 20 bp, Artificial Sequence
  chemically synthesized
gaatccgattattatgtgtc

SEQ ID NO: 476928 - DNA, 20 bp, Artificial Sequence
  chemically synthesized
gtcttgggttgctcttctca

SEQ ID NO: 476929 - DNA, 20 bp, Artificial Sequence
  chemically synthesized
tgtggtgttctccatatttc

SEQ ID NO: 476930 - DNA, 20 bp, Artificial Sequence
  chemically synthesized
gttctccatatttcctgaat

SEQ ID NO: 476931 - DNA, 20 bp, Artificial Sequence
  chemically synthesized
gctaggttggggaagttctc

SEQ ID NO: 476932 - DNA, 20 bp, Artificial Sequence
  chemically synthesized
ttctcctggataataacctg

SEQ ID NO: 476933 - DNA, 20 bp, Artificial Sequence
  chemically synthesized
gtgtacctgaaagtgatggg

SEQ ID NO: 476934 - DNA, 20 bp, Artificial Sequence
  chemically synthesized
gaagagaagattactgaaaa

SEQ ID NO: 476935 - DNA, 20 bp, Artificial Sequence
  chemically synthesized
caaatcgaccaagcaaaaga

SEQ ID NO: 476936 - DNA, 20 bp, Artificial Sequence
  chemically synthesized
aggttagaggaattgctaac

SEQ ID NO: 476937 - DNA, 20 bp, Artificial Sequence
  chemically synthesized
aaccttaaaaaaaaggttag

SEQ ID NO: 476938 - DNA, 20 bp, Artificial Sequence
  chemically synthesized
aggttcttagcttccttgca

SEQ ID NO: 476939 - DNA, 20 bp, Artificial Sequence
  chemically synthesized
aacacgctcctttagctcgt

SEQ ID NO: 476940 - DNA, 20 bp, Artificial Sequence
  chemically synthesized
acggaagtaggcttcagaag

SEQ ID NO: 476941 - DNA, 20 bp, Artificial Sequence
  chemically synthesized
ctggatggagaatgagtttg

SEQ ID NO: 476942 - DNA, 20 bp, Artificial Sequence
  chemically synthesized
ggaacaaaactggatggaga

SEQ ID NO: 476943 - DNA, 20 bp, Artificial Sequence
  chemically synthesized
caagggaacaaaactggatg

SEQ ID NO: 476944 - DNA, 20 bp, Artificial Sequence
  chemically synthesized
tctccagcaagggaacaaaa

SEQ ID NO: 476945 - DNA, 20 bp, Artificial Sequence
  chemically synthesized
gttttgttcccttgctggag

SEQ ID NO: 476946 - DNA, 20 bp, Artificial Sequence
  chemically synthesized
agaagaggcgttccggtttt

SEQ ID NO: 476947 - DNA, 20 bp, Artificial Sequence
  chemically synthesized
gctggtttttcctcatcttc

SEQ ID NO: 476948 - DNA, 20 bp, Artificial Sequence
  chemically synthesized
tgatgttggtgaccttcaga

SEQ ID NO: 476949 - DNA, 20 bp, Artificial Sequence
  chemically synthesized
attccagcagacctgcagca

SEQ ID NO: 476950 - DNA, 20 bp, Artificial Sequence
  chemically synthesized
accctctgctgcaggtctgc

SEQ ID NO: 476951 - DNA, 20 bp, Artificial Sequence
  chemically synthesized
atactcaggcaaacagggtc

SEQ ID NO: 476952 - DNA, 20 bp, Artificial Sequence
  chemically synthesized
ccactccagaccctgtttgc

SEQ ID NO: 476953 - DNA, 20 bp, Artificial Sequence
  chemically synthesized
gctggtgatactcaggcaaa

SEQ ID NO: 476954 - DNA, 20 bp, Artificial Sequence
  chemically synthesized
gcatctggcaggtgcccctc

SEQ ID NO: 476955 - DNA, 20 bp, Artificial Sequence
  chemically synthesized
cagccagagctctcctgtat

SEQ ID NO: 476956 - DNA, 20 bp, Artificial Sequence
  chemically synthesized
actgggagacacctcccagc

SEQ ID NO: 476957 - DNA, 20 bp, Artificial Sequence
  chemically synthesized
gtctcccagtcaggaggcac

SEQ ID NO: 476958 - DNA, 20 bp, Artificial Sequence
  chemically synthesized
ggacagactgccttctcaag

SEQ ID NO: 476959 - DNA, 20 bp, Artificial Sequence
  chemically synthesized
agtctgtcccttagcagagc

SEQ ID NO: 476960 - DNA, 20 bp, Artificial Sequence
  chemically synthesized
accacggggaaggggcagct

SEQ ID NO: 476961 - DNA, 20 bp, Artificial Sequence
  chemically synthesized
gtgctctgtcccagggagat

SEQ ID NO: 476962 - DNA, 20 bp, Artificial Sequence
  chemically synthesized
agatgccctgcccagagaga

SEQ ID NO: 476963 - DNA, 20 bp, Artificial Sequence
  chemically synthesized
gcacctgccattactgaagc

SEQ ID NO: 476964 - DNA, 20 bp, Artificial Sequence
  chemically synthesized
tgcccctccccacactaagc

SEQ ID NO: 476965 - DNA, 20 bp, Artificial Sequence
  chemically synthesized
acagcagtctgaagtggacc

SEQ ID NO: 476966 - DNA, 20 bp, Artificial Sequence
  chemically synthesized
cagactgctgtgctggcagc

SEQ ID NO: 476967 - DNA, 20 bp, Artificial Sequence
  chemically synthesized
gcagcgagaatttcaagcca

SEQ ID NO: 476968 - DNA, 20 bp, Artificial Sequence
  chemically synthesized
ttagctggctgggctccgtt

SEQ ID NO: 476969 - DNA, 20 bp, Artificial Sequence
  chemically synthesized
tggctgggctccgttggggg

SEQ ID NO: 476970 - DNA, 20 bp, Artificial Sequence
  chemically synthesized
gagccaagtggtctagctca

SEQ ID NO: 476971 - DNA, 20 bp, Artificial Sequence
  chemically synthesized
gacttcagtcccctttccag

SEQ ID NO: 476972 - DNA, 20 bp, Artificial Sequence
  chemically synthesized
tcagtcccctttccagggga

SEQ ID NO: 476973 - DNA, 20 bp, Artificial Sequence
  chemically synthesized
gctggtgttccaggtgacgc

SEQ ID NO: 476974 - DNA, 20 bp, Artificial Sequence
  chemically synthesized
gtgcctacgccaccagggcc

SEQ ID NO: 476975 - DNA, 20 bp, Artificial Sequence
  chemically synthesized
ctggtggcgtaggcacccga

SEQ ID NO: 476976 - DNA, 20 bp, Artificial Sequence
  chemically synthesized
atgcagaccaggagattccc

SEQ ID NO: 476977 - DNA, 20 bp, Artificial Sequence
  chemically synthesized
gaaaagcatagtgtctgggc

SEQ ID NO: 476978 - DNA, 20 bp, Artificial Sequence
  chemically synthesized
ggcttctgttggctagggga

SEQ ID NO: 476979 - DNA, 20 bp, Artificial Sequence
  chemically synthesized
cccggaagcacaaggggtca

SEQ ID NO: 476980 - DNA, 20 bp, Artificial Sequence
  chemically synthesized
cgcctcaccccggaagcaca

SEQ ID NO: 476981 - DNA, 20 bp, Artificial Sequence
  chemically synthesized
tccctgaccccttgtgcttc

SEQ ID NO: 476982 - DNA, 20 bp, Artificial Sequence
  chemically synthesized
cagagggcgcagaagcacgg

SEQ ID NO: 476983 - DNA, 20 bp, Artificial Sequence
  chemically synthesized
tcactgggactggttagaca

SEQ ID NO: 476984 - DNA, 20 bp, Artificial Sequence
  chemically synthesized
accagtcccagtgagatgag

SEQ ID NO: 476985 - DNA, 20 bp, Artificial Sequence
  chemically synthesized
tagtgagatcaacacagaag

SEQ ID NO: 476986 - DNA, 20 bp, Artificial Sequence
  chemically synthesized
agaagtggctggcaagatgg

SEQ ID NO: 476987 - DNA, 20 bp, Artificial Sequence
  chemically synthesized
ttgccagccacttctttggt

SEQ ID NO: 476988 - DNA, 20 bp, Artificial Sequence
  chemically synthesized
ctttggtcaggattttaaag

SEQ ID NO: 476989 - DNA, 20 bp, Artificial Sequence
  chemically synthesized
tacagcttagaaactaaagc

SEQ ID NO: 476990 - DNA, 20 bp, Artificial Sequence
  chemically synthesized
tagcttttcaatagaatatc

SEQ ID NO: 476991 - DNA, 20 bp, Artificial Sequence
  chemically synthesized
tactttcagtagcttttcaa

SEQ ID NO: 476992 - DNA, 20 bp, Artificial Sequence
  chemically synthesized
ctgaaagtaaatcaatatat

SEQ ID NO: 476993 - DNA, 20 bp, Artificial Sequence
  chemically synthesized
attgtaagattatggattat

SEQ ID NO: 476994 - DNA, 20 bp, Artificial Sequence
  chemically synthesized
ttttatgctattgtaagatt

SEQ ID NO: 476995 - DNA, 20 bp, Artificial Sequence
  chemically synthesized
ttctaaaccagtactgtatt

SEQ ID NO: 476996 - DNA, 20 bp, Artificial Sequence
  chemically synthesized
actggtgataagagatgtta

SEQ ID NO: 476997 - DNA, 20 bp, Artificial Sequence
  chemically synthesized
taagtacggtatatttttaa

SEQ ID NO: 476998 - DNA, 20 bp, Artificial Sequence
  chemically synthesized
tataccgtacttataaagta

SEQ ID NO: 476999 - DNA, 20 bp, Artificial Sequence
  chemically synthesized
ctatcaaaggccatattata

SEQ ID NO: 477000 - DNA, 20 bp, Artificial Sequence
  chemically synthesized
ttcctgttatttggagtaac

SEQ ID NO: 477001 - DNA, 20 bp, Artificial Sequence
  chemically synthesized
ccctggttactccaaataac

SEQ ID NO: 477002 - DNA, 20 bp, Artificial Sequence
  chemically synthesized
tgaagctaattcctgttatt

SEQ ID NO: 477003 - DNA, 20 bp, Artificial Sequence
  chemically synthesized
atatttaacccagatttatg

SEQ ID NO: 477004 - DNA, 20 bp, Artificial Sequence
  chemically synthesized
atatttaatccttcataaat

SEQ ID NO: 477005 - DNA, 20 bp, Artificial Sequence
  chemically synthesized
gcattgttaaagaactacaa

SEQ ID NO: 477006 - DNA, 20 bp, Artificial Sequence
  chemically synthesized
aaacttgtgatatcttcata

SEQ ID NO: 477007 - DNA, 20 bp, Artificial Sequence
  chemically synthesized
gaagatatcacaagtttatt

SEQ ID NO: 477008 - DNA, 20 bp, Artificial Sequence
  chemically synthesized
acatgtaagctctcccaact

SEQ ID NO: 477009 - DNA, 20 bp, Artificial Sequence
  chemically synthesized
gttgggagagcttacatgtt

SEQ ID NO: 477010 - DNA, 20 bp, Artificial Sequence
  chemically synthesized
tacatgttttgaatgatttt

SEQ ID NO: 477011 - DNA, 20 bp, Artificial Sequence
  chemically synthesized
ttttcttatagaattagggg

SEQ ID NO: 477012 - DNA, 20 bp, Artificial Sequence
  chemically synthesized
tatcttttcttatagaatta

SEQ ID NO: 477013 - DNA, 20 bp, Artificial Sequence
  chemically synthesized
ggaaaacttatcttttctta

SEQ ID NO: 477014 - DNA, 20 bp, Artificial Sequence
  chemically synthesized
ccttacttgatttcttatat

SEQ ID NO: 477015 - DNA, 20 bp, Artificial Sequence
  chemically synthesized
ttgttatgcttcccatttat

SEQ ID NO: 477016 - DNA, 20 bp, Artificial Sequence
  chemically synthesized
tgaaatgtgatataatgtat

SEQ ID NO: 477017 - DNA, 20 bp, Artificial Sequence
  chemically synthesized
ggaagccaagcatatttcct

SEQ ID NO: 477018 - DNA, 20 bp, Artificial Sequence
  chemically synthesized
ttgtcaaagaaacgctatgt

SEQ ID NO: 477019 - DNA, 20 bp, Artificial Sequence
  chemically synthesized
catcctcagtccctgtggct

SEQ ID NO: 477020 - DNA, 20 bp, Artificial Sequence
  chemically synthesized
aacccaaagccacagggact

SEQ ID NO: 477021 - DNA, 20 bp, Artificial Sequence
  chemically synthesized
aggatggtaagcctaaaaag

SEQ ID NO: 477022 - DNA, 20 bp, Artificial Sequence
  chemically synthesized
ttcttcttaaaactttagat

SEQ ID NO: 477023 - DNA, 20 bp, Artificial Sequence
  chemically synthesized
tgtgaatgctgaagataaat

SEQ ID NO: 477024 - DNA, 20 bp, Artificial Sequence
  chemically synthesized
atcattaaatcaatctcaat

SEQ ID NO: 477025 - DNA, 20 bp, Artificial Sequence
  chemically synthesized
aactttaaagaaaaaactca

SEQ ID NO: 477026 - DNA, 20 bp, Artificial Sequence
  chemically synthesized
aaagtcagggcagggattct

SEQ ID NO: 477027 - DNA, 20 bp, Artificial Sequence
  chemically synthesized
ttactgtgaaaagtcagggc

SEQ ID NO: 477028 - DNA, 20 bp, Artificial Sequence
  chemically synthesized
actctcccaggctgccatct

SEQ ID NO: 477029 - DNA, 20 bp, Artificial Sequence
  chemically synthesized
attccaagatggcagcctgg

SEQ ID NO: 477030 - DNA, 20 bp, Artificial Sequence
  chemically synthesized
agtgtatgaaaaactgtgtt

SEQ ID NO: 477031 - DNA, 20 bp, Artificial Sequence
  chemically synthesized
tggtatgtccttcttgagcc

SEQ ID NO: 477032 - DNA, 20 bp, Artificial Sequence
  chemically synthesized
accttggcctcccaaagtgc

SEQ ID NO: 477033 - DNA, 20 bp, Artificial Sequence
  chemically synthesized
actttgggaggccaaggtga

SEQ ID NO: 477034 - DNA, 20 bp, Artificial Sequence
  chemically synthesized
tttggattttttagtagaga

SEQ ID NO: 477035 - DNA, 20 bp, Artificial Sequence
  chemically synthesized
ggctaatttttttttttttt

SEQ ID NO: 477036 - DNA, 20 bp, Artificial Sequence
  chemically synthesized
gcctcagcctcctgagtagc

SEQ ID NO: 477037 - DNA, 20 bp, Artificial Sequence
  chemically synthesized
caattctctgcctcagcctc

SEQ ID NO: 477038 - DNA, 20 bp, Artificial Sequence
  chemically synthesized
ctactcaggaggctgaggca

SEQ ID NO: 477039 - DNA, 20 bp, Artificial Sequence
  chemically synthesized
ctcactgcaacctccgcctc

SEQ ID NO: 477040 - DNA, 20 bp, Artificial Sequence
  chemically synthesized
cagcaccactgcactccagc

SEQ ID NO: 477041 - DNA, 20 bp, Artificial Sequence
  chemically synthesized
tctcactctgtcacccaggc

SEQ ID NO: 477042 - DNA, 20 bp, Artificial Sequence
  chemically synthesized
ctgcactccagcctgggtga

SEQ ID NO: 477043 - DNA, 20 bp, Artificial Sequence
  chemically synthesized
accttggcctcccaaagtgc

SEQ ID NO: 477044 - DNA, 20 bp, Artificial Sequence
  chemically synthesized
actttgggaggccaaggtgg

SEQ ID NO: 477045 - DNA, 20 bp, Artificial Sequence
  chemically synthesized
cggggtttcaccatgttggc

SEQ ID NO: 477046 - DNA, 20 bp, Artificial Sequence
  chemically synthesized
ttttgtaattttagtagaga

SEQ ID NO: 477047 - DNA, 20 bp, Artificial Sequence
  chemically synthesized
aattctcctgcctcagcctc

SEQ ID NO: 477048 - DNA, 20 bp, Artificial Sequence
  chemically synthesized
tactcaggaggctgaggcag

SEQ ID NO: 477049 - DNA, 20 bp, Artificial Sequence
  chemically synthesized
atctcggctcgctgaacctc

SEQ ID NO: 477050 - DNA, 20 bp, Artificial Sequence
  chemically synthesized
gtctcactctgtcaccaggc

SEQ ID NO: 477051 - DNA, 20 bp, Artificial Sequence
  chemically synthesized
actgcactccagcctggtga

SEQ ID NO: 477052 - DNA, 20 bp, Artificial Sequence
  chemically synthesized
ttttttttttttttttgaga

SEQ ID NO: 477053 - DNA, 20 bp, Artificial Sequence
  chemically synthesized
atcccaaggtgaaaaggttt

SEQ ID NO: 477054 - DNA, 20 bp, Artificial Sequence
  chemically synthesized
atccacaaaccttttcacct

SEQ ID NO: 477055 - DNA, 20 bp, Artificial Sequence
  chemically synthesized
ataacttttaaacctgtagt

SEQ ID NO: 477056 - DNA, 20 bp, Artificial Sequence
  chemically synthesized
atataaaggctttaataaag

SEQ ID NO: 477057 - DNA, 20 bp, Artificial Sequence
  chemically synthesized
gttccacatagatctgtaag

SEQ ID NO: 477058 - DNA, 20 bp, Artificial Sequence
  chemically synthesized
tggggaataggaataacttt

SEQ ID NO: 477059 - DNA, 20 bp, Artificial Sequence
  chemically synthesized
ccttccttgtaatggggaat

SEQ ID NO: 477060 - DNA, 20 bp, Artificial Sequence
  chemically synthesized
attctaccttccttgtaatg

SEQ ID NO: 477061 - DNA, 20 bp, Artificial Sequence
  chemically synthesized
attccccattacaaggaagg

SEQ ID NO: 477062 - DNA, 20 bp, Artificial Sequence
  chemically synthesized
tttgataagcagtataaatc

SEQ ID NO: 477063 - DNA, 20 bp, Artificial Sequence
  chemically synthesized
gcttccataggaaaaaacag

SEQ ID NO: 477064 - DNA, 20 bp, Artificial Sequence
  chemically synthesized
ttgactatattgctcactaa

SEQ ID NO: 477065 - DNA, 20 bp, Artificial Sequence
  chemically synthesized
ttattgctagctgatcatct

SEQ ID NO: 477066 - DNA, 20 bp, Artificial Sequence
  chemically synthesized
gtggcttttggatttaaaga

SEQ ID NO: 477067 - DNA, 20 bp, Artificial Sequence
  chemically synthesized
aaatgtggcttttggattta

SEQ ID NO: 477068 - DNA, 20 bp, Artificial Sequence
  chemically synthesized
tgtattagcaaatgtggctt

SEQ ID NO: 477069 - DNA, 20 bp, Artificial Sequence
  chemically synthesized
cacatttgctaatacaatta

SEQ ID NO: 477070 - DNA, 20 bp, Artificial Sequence
  chemically synthesized
aacacatattacttagtttc

SEQ ID NO: 477071 - DNA, 20 bp, Artificial Sequence
  chemically synthesized
agttatttaacacataagat

SEQ ID NO: 477072 - DNA, 20 bp, Artificial Sequence
  chemically synthesized
acataagatcagaatggagg

SEQ ID NO: 477073 - DNA, 20 bp, Artificial Sequence
  chemically synthesized
atggagggggggtactatga

SEQ ID NO: 477074 - DNA, 20 bp, Artificial Sequence
  chemically synthesized
ggtactatgatagagtgtct

SEQ ID NO: 477075 - DNA, 20 bp, Artificial Sequence
  chemically synthesized
ggtaaggaaaatgaactgat

SEQ ID NO: 477076 - DNA, 20 bp, Artificial Sequence
  chemically synthesized
actcaccttggcctcccaaa

SEQ ID NO: 477077 - DNA, 20 bp, Artificial Sequence
  chemically synthesized
atccactttgggaggccaag

SEQ ID NO: 477078 - DNA, 20 bp, Artificial Sequence
  chemically synthesized
actttgggaggccaaggtga

SEQ ID NO: 477079 - DNA, 20 bp, Artificial Sequence
  chemically synthesized
tttgtattttttagtagaga

SEQ ID NO: 477080 - DNA, 20 bp, Artificial Sequence
  chemically synthesized
tagcaccactgcactccagc

SEQ ID NO: 477081 - DNA, 20 bp, Artificial Sequence
  chemically synthesized
tctcgctctgtcacccaggc

SEQ ID NO: 477082 - DNA, 20 bp, Artificial Sequence
  chemically synthesized
ttagaaaagttccctacagc

SEQ ID NO: 477083 - DNA, 20 bp, Artificial Sequence
  chemically synthesized
ctcagcaatttaagccctca

SEQ ID NO: 477084 - DNA, 20 bp, Artificial Sequence
  chemically synthesized
tcctctgagggcttaaattg

SEQ ID NO: 477085 - DNA, 20 bp, Artificial Sequence
  chemically synthesized
ttgctgagtggaaaaatggg

SEQ ID NO: 477086 - DNA, 20 bp, Artificial Sequence
  chemically synthesized
ggggtagtagtttacaaaga

SEQ ID NO: 477087 - DNA, 20 bp, Artificial Sequence
  chemically synthesized
tttgggggtagtagtttaca

SEQ ID NO: 477088 - DNA, 20 bp, Artificial Sequence
  chemically synthesized
aactactacccccaaagctt

SEQ ID NO: 477089 - DNA, 20 bp, Artificial Sequence
  chemically synthesized
gtttgaaactctgaagcttt

SEQ ID NO: 477090 - DNA, 20 bp, Artificial Sequence
  chemically synthesized
tccactgcatcttattgaca

SEQ ID NO: 477091 - DNA, 20 bp, Artificial Sequence
  chemically synthesized
ccgaagggagataaatatat

SEQ ID NO: 477092 - DNA, 20 bp, Artificial Sequence
  chemically synthesized
tgtttcaaactatgaattac

SEQ ID NO: 477093 - DNA, 20 bp, Artificial Sequence
  chemically synthesized
ttttatgcgtgtttcaaact

SEQ ID NO: 477094 - DNA, 20 bp, Artificial Sequence
  chemically synthesized
tagtagatgtgattgggctt

SEQ ID NO: 477095 - DNA, 20 bp, Artificial Sequence
  chemically synthesized
acttaagttatggtacttat

SEQ ID NO: 477096 - DNA, 20 bp, Artificial Sequence
  chemically synthesized
gtctgagaaagatagatgtg

SEQ ID NO: 477097 - DNA, 20 bp, Artificial Sequence
  chemically synthesized
tttatatgttttgctatcat

SEQ ID NO: 477098 - DNA, 20 bp, Artificial Sequence
  chemically synthesized
tgttttgctatcattgggat

SEQ ID NO: 477099 - DNA, 20 bp, Artificial Sequence
  chemically synthesized
gctatcattgggatcagaat

SEQ ID NO: 477100 - DNA, 20 bp, Artificial Sequence
  chemically synthesized
agaatgagagttttaccaat

SEQ ID NO: 477101 - DNA, 20 bp, Artificial Sequence
  chemically synthesized
gataagacagggaaactaaa

SEQ ID NO: 477102 - DNA, 20 bp, Artificial Sequence
  chemically synthesized
actaaaaggaataccgcaaa

SEQ ID NO: 477103 - DNA, 20 bp, Artificial Sequence
  chemically synthesized
aaggaataccgcaaataggg

SEQ ID NO: 477104 - DNA, 20 bp, Artificial Sequence
  chemically synthesized
tactgagtatggatggagaa

SEQ ID NO: 477105 - DNA, 20 bp, Artificial Sequence
  chemically synthesized
gcatttgtaagatactgagt

SEQ ID NO: 477106 - DNA, 20 bp, Artificial Sequence
  chemically synthesized
acaggtgcatttgtaagata

SEQ ID NO: 477107 - DNA, 20 bp, Artificial Sequence
  chemically synthesized
tgtgacaagtatggctaaaa

SEQ ID NO: 477108 - DNA, 20 bp, Artificial Sequence
  chemically synthesized
taggctgtagagcagacata

SEQ ID NO: 477109 - DNA, 20 bp, Artificial Sequence
  chemically synthesized
aaaaattagtccctatattt

SEQ ID NO: 477110 - DNA, 20 bp, Artificial Sequence
  chemically synthesized
ttgctgtgtactggaaaact

SEQ ID NO: 477111 - DNA, 20 bp, Artificial Sequence
  chemically synthesized
ccatgtctaacatttaaagt

SEQ ID NO: 477112 - DNA, 20 bp, Artificial Sequence
  chemically synthesized
cttactttaaatgttagaca

SEQ ID NO: 477113 - DNA, 20 bp, Artificial Sequence
  chemically synthesized
gacatggggtcataaaacat

SEQ ID NO: 477114 - DNA, 20 bp, Artificial Sequence
  chemically synthesized
tcataaaacattggggtaga

SEQ ID NO: 477115 - DNA, 20 bp, Artificial Sequence
  chemically synthesized
agaagggattttacaagtat

SEQ ID NO: 477116 - DNA, 20 bp, Artificial Sequence
  chemically synthesized
atgaagcctatggtctaatg

SEQ ID NO: 477117 - DNA, 20 bp, Artificial Sequence
  chemically synthesized
tattcactcaacaactgttt

SEQ ID NO: 477118 - DNA, 20 bp, Artificial Sequence
  chemically synthesized
taatgactcataaacagttg

SEQ ID NO: 477119 - DNA, 20 bp, Artificial Sequence
  chemically synthesized
gactcataaacagttgttga

SEQ ID NO: 477120 - DNA, 20 bp, Artificial Sequence
  chemically synthesized
cccagggccagcaacatatg

SEQ ID NO: 477121 - DNA, 20 bp, Artificial Sequence
  chemically synthesized
aaagtgaagttgctaagagc

SEQ ID NO: 477122 - DNA, 20 bp, Artificial Sequence
  chemically synthesized
tagcatgcttggtgatctat

SEQ ID NO: 477123 - DNA, 20 bp, Artificial Sequence
  chemically synthesized
agcagtttcttctgcttggt

SEQ ID NO: 477124 - DNA, 20 bp, Artificial Sequence
  chemically synthesized
tcttctgcttggtgggagtt

SEQ ID NO: 477125 - DNA, 20 bp, Artificial Sequence
  chemically synthesized
acctatctttgttgtctttc

SEQ ID NO: 477126 - DNA, 20 bp, Artificial Sequence
  chemically synthesized
ctggtccttgagggctgaag

SEQ ID NO: 477127 - DNA, 20 bp, Artificial Sequence
  chemically synthesized
ccccctacgttgtctacttg

SEQ ID NO: 477128 - DNA, 20 bp, Artificial Sequence
  chemically synthesized
tcgccaagtagacaacgtag

SEQ ID NO: 477129 - DNA, 20 bp, Artificial Sequence
  chemically synthesized
gcaaatgctgttctctctgt

SEQ ID NO: 477130 - DNA, 20 bp, Artificial Sequence
  chemically synthesized
ggtgatatgggcagagtgta

SEQ ID NO: 477131 - DNA, 20 bp, Artificial Sequence
  chemically synthesized
ggaaaaaggggtgatatggg

SEQ ID NO: 477132 - DNA, 20 bp, Artificial Sequence
  chemically synthesized
tgatggcatatttgggaaaa

SEQ ID NO: 477133 - DNA, 20 bp, Artificial Sequence
  chemically synthesized
atatatatatatcatatggg

SEQ ID NO: 477134 - DNA, 20 bp, Artificial Sequence
  chemically synthesized
agagtgtattaaatggtctg

SEQ ID NO: 477135 - DNA, 20 bp, Artificial Sequence
  chemically synthesized
ccacgtaatctccttattca

SEQ ID NO: 477136 - DNA, 20 bp, Artificial Sequence
  chemically synthesized
tgcctagagaatgaaatcca

SEQ ID NO: 477137 - DNA, 20 bp, Artificial Sequence
  chemically synthesized
tgcgggagaatacttgccta

SEQ ID NO: 477138 - DNA, 20 bp, Artificial Sequence
  chemically synthesized
taggcaagtattctcccgca

SEQ ID NO: 477139 - DNA, 20 bp, Artificial Sequence
  chemically synthesized
ccaatccaaactccttgcgg

SEQ ID NO: 477140 - DNA, 20 bp, Artificial Sequence
  chemically synthesized
agtattctcccgcaaggagt

SEQ ID NO: 477141 - DNA, 20 bp, Artificial Sequence
  chemically synthesized
ctcccgcaaggagtttggat

SEQ ID NO: 477142 - DNA, 20 bp, Artificial Sequence
  chemically synthesized
tggattggaattggaagaag

SEQ ID NO: 477143 - DNA, 20 bp, Artificial Sequence
  chemically synthesized
tttggtgaattaatggatgg

SEQ ID NO: 477144 - DNA, 20 bp, Artificial Sequence
  chemically synthesized
aacatttggtgaattaatgg

SEQ ID NO: 477145 - DNA, 20 bp, Artificial Sequence
  chemically synthesized
tttaaacatttggtgaatta

SEQ ID NO: 477146 - DNA, 20 bp, Artificial Sequence
  chemically synthesized
tactgcattttaaacatttg

SEQ ID NO: 477147 - DNA, 20 bp, Artificial Sequence
  chemically synthesized
gagatatgccaggcacacag

SEQ ID NO: 477148 - DNA, 20 bp, Artificial Sequence
  chemically synthesized
tatgccaggcacacagaggg

SEQ ID NO: 477149 - DNA, 20 bp, Artificial Sequence
  chemically synthesized
caggcacacagaggggtgaa

SEQ ID NO: 477150 - DNA, 20 bp, Artificial Sequence
  chemically synthesized
tcatctaagtaaaagatgct

SEQ ID NO: 477151 - DNA, 20 bp, Artificial Sequence
  chemically synthesized
catgatggctcatgttacct

SEQ ID NO: 477152 - DNA, 20 bp, Artificial Sequence
  chemically synthesized
tgccatcagtgaaaatgcag

SEQ ID NO: 477153 - DNA, 20 bp, Artificial Sequence
  chemically synthesized
gtgaaaatgcagaagggttt

SEQ ID NO: 477154 - DNA, 20 bp, Artificial Sequence
  chemically synthesized
tttctagcctggaaaatttg

SEQ ID NO: 477155 - DNA, 20 bp, Artificial Sequence
  chemically synthesized
cctgtttcctatttcagtta

SEQ ID NO: 477156 - DNA, 20 bp, Artificial Sequence
  chemically synthesized
agaacaaatgaacttggttt

SEQ ID NO: 477157 - DNA, 20 bp, Artificial Sequence
  chemically synthesized
atttgtgatcgtaatgccac

SEQ ID NO: 477158 - DNA, 20 bp, Artificial Sequence
  chemically synthesized
ccgcatctctcttctgatct

SEQ ID NO: 477159 - DNA, 20 bp, Artificial Sequence
  chemically synthesized
ccctccctgtttgagatggc

SEQ ID NO: 477160 - DNA, 20 bp, Artificial Sequence
  chemically synthesized
tccaggccatctcaaacagg

SEQ ID NO: 477161 - DNA, 20 bp, Artificial Sequence
  chemically synthesized
gagggtttaaacaatcaaaa

SEQ ID NO: 477162 - DNA, 20 bp, Artificial Sequence
  chemically synthesized
cttgggcacaacagtatttg

SEQ ID NO: 477163 - DNA, 20 bp, Artificial Sequence
  chemically synthesized
atttgaggggtggctaggag

SEQ ID NO: 477164 - DNA, 20 bp, Artificial Sequence
  chemically synthesized
aaaaatataggaagaagaac

SEQ ID NO: 477165 - DNA, 20 bp, Artificial Sequence
  chemically synthesized
ccaaggaagaggacaacttc

SEQ ID NO: 477166 - DNA, 20 bp, Artificial Sequence
  chemically synthesized
aagaggacaacttctagaat

SEQ ID NO: 477167 - DNA, 20 bp, Artificial Sequence
  chemically synthesized
ctgagatgctggcaaacatg

SEQ ID NO: 477168 - DNA, 20 bp, Artificial Sequence
  chemically synthesized
caaacatgctgagtgcatga

SEQ ID NO: 477169 - DNA, 20 bp, Artificial Sequence
  chemically synthesized
atgagggaatttaacttctt

SEQ ID NO: 477170 - DNA, 20 bp, Artificial Sequence
  chemically synthesized
tcttttgaattttaatctag

SEQ ID NO: 477171 - DNA, 20 bp, Artificial Sequence
  chemically synthesized
ttttgtgattttgacaatag

SEQ ID NO: 477172 - DNA, 20 bp, Artificial Sequence
  chemically synthesized
gtagaaaaaaatacatattt

SEQ ID NO: 477173 - DNA, 20 bp, Artificial Sequence
  chemically synthesized
taaatatgtatttttttcta

SEQ ID NO: 477174 - DNA, 20 bp, Artificial Sequence
  chemically synthesized
ttgccatctttgtgccacaa

SEQ ID NO: 477175 - DNA, 20 bp, Artificial Sequence
  chemically synthesized
tgctaaccaaattacatgac

SEQ ID NO: 477176 - DNA, 20 bp, Artificial Sequence
  chemically synthesized
aaaacacttaatcaaaagcc

SEQ ID NO: 477177 - DNA, 20 bp, Artificial Sequence
  chemically synthesized
ttgcttgtgttacttagtat

SEQ ID NO: 477178 - DNA, 20 bp, Artificial Sequence
  chemically synthesized
tctcttggagaaaataccat

SEQ ID NO: 477179 - DNA, 20 bp, Artificial Sequence
  chemically synthesized
aaataccatgtgaatgaaga

SEQ ID NO: 477180 - DNA, 20 bp, Artificial Sequence
  chemically synthesized
aaagagcttctaatctgaac

SEQ ID NO: 477181 - DNA, 20 bp, Artificial Sequence
  chemically synthesized
agttcagattagaagctctt

SEQ ID NO: 477182 - DNA, 20 bp, Artificial Sequence
  chemically synthesized
tttctcgaggtgatcttgga

SEQ ID NO: 477183 - DNA, 20 bp, Artificial Sequence
  chemically synthesized
ggagatcgcccacgggctgc

SEQ ID NO: 477184 - DNA, 20 bp, Artificial Sequence
  chemically synthesized
gcgccaagctgaggtgatca

SEQ ID NO: 477185 - DNA, 20 bp, Artificial Sequence
  chemically synthesized
tccaggaacttcaagaggcc

SEQ ID NO: 477186 - DNA, 20 bp, Artificial Sequence
  chemically synthesized
ccgtggcctcttgaagttcc

SEQ ID NO: 477187 - DNA, 20 bp, Artificial Sequence
  chemically synthesized
tgaagttcctggagtctttc

SEQ ID NO: 477188 - DNA, 20 bp, Artificial Sequence
  chemically synthesized
tatttttctctgccagtcag

SEQ ID NO: 477189 - DNA, 20 bp, Artificial Sequence
  chemically synthesized
gcaggctgaggaggtcaata

SEQ ID NO: 477190 - DNA, 20 bp, Artificial Sequence
  chemically synthesized
tcagcctgctttcgtagaag

SEQ ID NO: 477191 - DNA, 20 bp, Artificial Sequence
  chemically synthesized
tgcctcctgaggagagagcc

SEQ ID NO: 477192 - DNA, 20 bp, Artificial Sequence
  chemically synthesized
tttgacaatgtttaaaaaaa

SEQ ID NO: 477193 - DNA, 20 bp, Artificial Sequence
  chemically synthesized
aggtcatactggaagaaaga

SEQ ID NO: 477194 - DNA, 20 bp, Artificial Sequence
  chemically synthesized
gaaagagtacagttgaacaa

SEQ ID NO: 477195 - DNA, 20 bp, Artificial Sequence
  chemically synthesized
aacatctaaagtatatcttc

SEQ ID NO: 477196 - DNA, 20 bp, Artificial Sequence
  chemically synthesized
cttaagtgaatcttaaattg

SEQ ID NO: 477197 - DNA, 20 bp, Artificial Sequence
  chemically synthesized
ttttctcctcaatagcttaa

SEQ ID NO: 477198 - DNA, 20 bp, Artificial Sequence
  chemically synthesized
gctattgaggagaaaaacgt

SEQ ID NO: 477199 - DNA, 20 bp, Artificial Sequence
  chemically synthesized
acttgtagtctttgcaacaa

SEQ ID NO: 477200 - DNA, 20 bp, Artificial Sequence
  chemically synthesized
aaagggagttatctgtgagg

SEQ ID NO: 477201 - DNA, 20 bp, Artificial Sequence
  chemically synthesized
tttagaaaataataaacaaa

SEQ ID NO: 477202 - DNA, 20 bp, Artificial Sequence
  chemically synthesized
atctcttttgatgtttattt

SEQ ID NO: 477203 - DNA, 20 bp, Artificial Sequence
  chemically synthesized
tgatttatgcatggtagttt

SEQ ID NO: 477204 - DNA, 20 bp, Artificial Sequence
  chemically synthesized
tttcagcatctatgtttaat

SEQ ID NO: 477205 - DNA, 20 bp, Artificial Sequence
  chemically synthesized
ctcatattttcttggttaaa

SEQ ID NO: 477206 - DNA, 20 bp, Artificial Sequence
  chemically synthesized
tccattcttgctgccagggt

SEQ ID NO: 477207 - DNA, 20 bp, Artificial Sequence
  chemically synthesized
gctatccagaccctggcagc

SEQ ID NO: 477208 - DNA, 20 bp, Artificial Sequence
  chemically synthesized
agcccatccattcttgctgc

SEQ ID NO: 477209 - DNA, 20 bp, Artificial Sequence
  chemically synthesized
tccagaccctggcagcaaga

SEQ ID NO: 477210 - DNA, 20 bp, Artificial Sequence
  chemically synthesized
ctataataacatattgatag

SEQ ID NO: 477211 - DNA, 20 bp, Artificial Sequence
  chemically synthesized
taccaggagcccagaggtaa

SEQ ID NO: 477212 - DNA, 20 bp, Artificial Sequence
  chemically synthesized
aattacctctgggctcctgg

SEQ ID NO: 477213 - DNA, 20 bp, Artificial Sequence
  chemically synthesized
atgagtactcttgagactgt

SEQ ID NO: 477214 - DNA, 20 bp, Artificial Sequence
  chemically synthesized
agaaatattcgtacagtctc

SEQ ID NO: 477215 - DNA, 20 bp, Artificial Sequence
  chemically synthesized
aaactaaagaacctgtaatc

SEQ ID NO: 477216 - DNA, 20 bp, Artificial Sequence
  chemically synthesized
catttcacaggccttcaaga

SEQ ID NO: 477217 - DNA, 20 bp, Artificial Sequence
  chemically synthesized
cacccaggattaattttgag

SEQ ID NO: 477218 - DNA, 20 bp, Artificial Sequence
  chemically synthesized
cattcttctcaaaattaatc

SEQ ID NO: 477219 - DNA, 20 bp, Artificial Sequence
  chemically synthesized
ataaacaagttctgagcacc

SEQ ID NO: 477220 - DNA, 20 bp, Artificial Sequence
  chemically synthesized
aaagagatagaaattgacct

SEQ ID NO: 477221 - DNA, 20 bp, Artificial Sequence
  chemically synthesized
tgattttttttaaaggctat

SEQ ID NO: 477222 - DNA, 20 bp, Artificial Sequence
  chemically synthesized
gaatgctccccccatctccc

SEQ ID NO: 477223 - DNA, 20 bp, Artificial Sequence
  chemically synthesized
ggggagatggggggagcatt

SEQ ID NO: 477224 - DNA, 20 bp, Artificial Sequence
  chemically synthesized
atgagagggcattaactatc

SEQ ID NO: 477225 - DNA, 20 bp, Artificial Sequence
  chemically synthesized
taatgccctctcattgagat

SEQ ID NO: 477226 - DNA, 20 bp, Artificial Sequence
  chemically synthesized
taagtcctcattagccatgc

SEQ ID NO: 477227 - DNA, 20 bp, Artificial Sequence
  chemically synthesized
acttaaacataccccaaata

SEQ ID NO: 477228 - DNA, 20 bp, Artificial Sequence
  chemically synthesized
tgttctggatatccactatt

SEQ ID NO: 477229 - DNA, 20 bp, Artificial Sequence
  chemically synthesized
ttaaggcttcccattatgtt

SEQ ID NO: 477230 - DNA, 20 bp, Artificial Sequence
  chemically synthesized
aggctatattaaagtataca

SEQ ID NO: 477231 - DNA, 20 bp, Artificial Sequence
  chemically synthesized
aattaactggtgattgtcag

SEQ ID NO: 477232 - DNA, 20 bp, Artificial Sequence
  chemically synthesized
taccttgtcagacattttga

SEQ ID NO: 477233 - DNA, 20 bp, Artificial Sequence
  chemically synthesized
ctattctcaaagaggtcaca

SEQ ID NO: 477234 - DNA, 20 bp, Artificial Sequence
  chemically synthesized
tcatccattgtgacctcttt

SEQ ID NO: 477235 - DNA, 20 bp, Artificial Sequence
  chemically synthesized
tagaaatgttttgagctatt

SEQ ID NO: 477236 - DNA, 20 bp, Artificial Sequence
  chemically synthesized
ttttgagctattatggatgt

SEQ ID NO: 477237 - DNA, 20 bp, Artificial Sequence
  chemically synthesized
tttctataaatgaacagatc

SEQ ID NO: 477238 - DNA, 20 bp, Artificial Sequence
  chemically synthesized
ctgtaatcttcctttatcca

SEQ ID NO: 477239 - DNA, 20 bp, Artificial Sequence
  chemically synthesized
tttgtttttctcttgatccc

SEQ ID NO: 477240 - DNA, 20 bp, Artificial Sequence
  chemically synthesized
gggatcaagagaaaaacaaa

SEQ ID NO: 477241 - DNA, 20 bp, Artificial Sequence
  chemically synthesized
gtgttaattttctcccttct

SEQ ID NO: 477242 - DNA, 20 bp, Artificial Sequence
  chemically synthesized
gagaaaattaacactagaag

SEQ ID NO: 477243 - DNA, 20 bp, Artificial Sequence
  chemically synthesized
aacagtaagttcacacataa

SEQ ID NO: 477244 - DNA, 20 bp, Artificial Sequence
  chemically synthesized
cacacataatcgagtgctaa

SEQ ID NO: 477245 - DNA, 20 bp, Artificial Sequence
  chemically synthesized
cgtgaggtataccgtgagcc

SEQ ID NO: 477246 - DNA, 20 bp, Artificial Sequence
  chemically synthesized
cgtgagcctagaataaccta

SEQ ID NO: 477247 - DNA, 20 bp, Artificial Sequence
  chemically synthesized
ataactctcttcaatggtgt

SEQ ID NO: 477248 - DNA, 20 bp, Artificial Sequence
  chemically synthesized
gatactctgacaccattgaa

SEQ ID NO: 477249 - DNA, 20 bp, Artificial Sequence
  chemically synthesized
cacttctgagatcaaagaat

SEQ ID NO: 477250 - DNA, 20 bp, Artificial Sequence
  chemically synthesized
taccctcacttctgagatca

SEQ ID NO: 477251 - DNA, 20 bp, Artificial Sequence
  chemically synthesized
gattctttgatctcagaagt

SEQ ID NO: 477252 - DNA, 20 bp, Artificial Sequence
  chemically synthesized
caggcaacattgctaaaaga

SEQ ID NO: 477253 - DNA, 20 bp, Artificial Sequence
  chemically synthesized
tcttttagcaatgttgcctg

SEQ ID NO: 477254 - DNA, 20 bp, Artificial Sequence
  chemically synthesized
caaattagcagtattcttcc

SEQ ID NO: 477255 - DNA, 20 bp, Artificial Sequence
  chemically synthesized
ggcatatctgaaattcaagg

SEQ ID NO: 477256 - DNA, 20 bp, Artificial Sequence
  chemically synthesized
tagcggtgttcaccattcaa

SEQ ID NO: 477257 - DNA, 20 bp, Artificial Sequence
  chemically synthesized
gttcaccattcaaaagaatc

SEQ ID NO: 477258 - DNA, 20 bp, Artificial Sequence
  chemically synthesized
gtatcagactcaggattctt

SEQ ID NO: 477259 - DNA, 20 bp, Artificial Sequence
  chemically synthesized
attttgcaaagtatcagact

SEQ ID NO: 477260 - DNA, 20 bp, Artificial Sequence
  chemically synthesized
attgtaaatagctgtggatg

SEQ ID NO: 477261 - DNA, 20 bp, Artificial Sequence
  chemically synthesized
ctattgaattgtaaatagct

SEQ ID NO: 477262 - DNA, 20 bp, Artificial Sequence
  chemically synthesized
aaacgccttccctttctcta

SEQ ID NO: 477263 - DNA, 20 bp, Artificial Sequence
  chemically synthesized
aggcgtttgaaccaaaatac

SEQ ID NO: 477264 - DNA, 20 bp, Artificial Sequence
  chemically synthesized
aaatactggagttctgtaag

SEQ ID NO: 477265 - DNA, 20 bp, Artificial Sequence
  chemically synthesized
gagttctgtaagtagaatat

SEQ ID NO: 477266 - DNA, 20 bp, Artificial Sequence
  chemically synthesized
agtacttccctatctgtagg

SEQ ID NO: 477267 - DNA, 20 bp, Artificial Sequence
  chemically synthesized
tacagatagggaagtacttt

SEQ ID NO: 477268 - DNA, 20 bp, Artificial Sequence
  chemically synthesized
gggaagtactttctgaataa

SEQ ID NO: 477269 - DNA, 20 bp, Artificial Sequence
  chemically synthesized
tcacgtatctagcatgattt

SEQ ID NO: 477270 - DNA, 20 bp, Artificial Sequence
  chemically synthesized
cctaaaatcatgctagatac

SEQ ID NO: 477271 - DNA, 20 bp, Artificial Sequence
  chemically synthesized
gaatcagctttatatgtaag

SEQ ID NO: 477272 - DNA, 20 bp, Artificial Sequence
  chemically synthesized
gatttcaagtgaaatatcag

SEQ ID NO: 477273 - DNA, 20 bp, Artificial Sequence
  chemically synthesized
aattgtatgaaaaaaaacac

SEQ ID NO: 477274 - DNA, 20 bp, Artificial Sequence
  chemically synthesized
taggcaaaatgataatttac

SEQ ID NO: 477275 - DNA, 20 bp, Artificial Sequence
  chemically synthesized
ctgaaactggaaatacaaag

SEQ ID NO: 477276 - DNA, 20 bp, Artificial Sequence
  chemically synthesized
caaaacagccctttctattt

SEQ ID NO: 477277 - DNA, 20 bp, Artificial Sequence
  chemically synthesized
gaatatttaacatataatag

SEQ ID NO: 477278 - DNA, 20 bp, Artificial Sequence
  chemically synthesized
aggagaagctagtaatcaca

SEQ ID NO: 477279 - DNA, 20 bp, Artificial Sequence
  chemically synthesized
aataagtcatgttcatgctt

SEQ ID NO: 477280 - DNA, 20 bp, Artificial Sequence
  chemically synthesized
tgaacatgacttattcaagg

SEQ ID NO: 477281 - DNA, 20 bp, Artificial Sequence
  chemically synthesized
gttctctagcatactcttcc

SEQ ID NO: 477282 - DNA, 20 bp, Artificial Sequence
  chemically synthesized
cacttgcattttcctcttct

SEQ ID NO: 477283 - DNA, 20 bp, Artificial Sequence
  chemically synthesized
agaagaggaaaatgcaagtg

SEQ ID NO: 477284 - DNA, 20 bp, Artificial Sequence
  chemically synthesized
tagtgcagtatggtatgtat

SEQ ID NO: 477285 - DNA, 20 bp, Artificial Sequence
  chemically synthesized
aatacattagatttttaaac

SEQ ID NO: 477286 - DNA, 20 bp, Artificial Sequence
  chemically synthesized
ctttgaacggttttaaccaa

SEQ ID NO: 477287 - DNA, 20 bp, Artificial Sequence
  chemically synthesized
tttaaccaagggagtggcac

SEQ ID NO: 477288 - DNA, 20 bp, Artificial Sequence
  chemically synthesized
agatcttcctgatataaata

SEQ ID NO: 477289 - DNA, 20 bp, Artificial Sequence
  chemically synthesized
gtatttgagaagaacagaaa

SEQ ID NO: 477290 - DNA, 20 bp, Artificial Sequence
  chemically synthesized
agagataatgaggcaattgt

SEQ ID NO: 477291 - DNA, 20 bp, Artificial Sequence
  chemically synthesized
caaatcctcataatcttgca

SEQ ID NO: 477292 - DNA, 20 bp, Artificial Sequence
  chemically synthesized
agaattcagtgcaagattat

SEQ ID NO: 477293 - DNA, 20 bp, Artificial Sequence
  chemically synthesized
tttttcctggtaccattgcc

SEQ ID NO: 477294 - DNA, 20 bp, Artificial Sequence
  chemically synthesized
atggtaccaggaaaaatgac

SEQ ID NO: 477295 - DNA, 20 bp, Artificial Sequence
  chemically synthesized
accaggaaaaatgacaggga

SEQ ID NO: 477296 - DNA, 20 bp, Artificial Sequence
  chemically synthesized
gaagtgtgaaaatttggtga

SEQ ID NO: 477297 - DNA, 20 bp, Artificial Sequence
  chemically synthesized
gagaagagagaaaaagaaac

SEQ ID NO: 477298 - DNA, 20 bp, Artificial Sequence
  chemically synthesized
aatgacacttagtgtctagg

SEQ ID NO: 477299 - DNA, 20 bp, Artificial Sequence
  chemically synthesized
gttgagtagatgagcaaacg

SEQ ID NO: 477300 - DNA, 20 bp, Artificial Sequence
  chemically synthesized
gtttatttcctcatacttag

SEQ ID NO: 477301 - DNA, 20 bp, Artificial Sequence
  chemically synthesized
gtatgaggaaataaactttc

SEQ ID NO: 477302 - DNA, 20 bp, Artificial Sequence
  chemically synthesized
agttcatttctctgatccaa

SEQ ID NO: 477303 - DNA, 20 bp, Artificial Sequence
  chemically synthesized
gctataaccgtttgaccctc

SEQ ID NO: 477304 - DNA, 20 bp, Artificial Sequence
  chemically synthesized
agggtcaaacggttatagct

SEQ ID NO: 477305 - DNA, 20 bp, Artificial Sequence
  chemically synthesized
ctccagtctttctaacaaca

SEQ ID NO: 477306 - DNA, 20 bp, Artificial Sequence
  chemically synthesized
ctctatgttgttagaaagac

SEQ ID NO: 477307 - DNA, 20 bp, Artificial Sequence
  chemically synthesized
atgttgttagaaagactgga

SEQ ID NO: 477308 - DNA, 20 bp, Artificial Sequence
  chemically synthesized
tagctggtttctgcagaagc

SEQ ID NO: 477309 - DNA, 20 bp, Artificial Sequence
  chemically synthesized
tctgtggaaacataacaggc

SEQ ID NO: 477310 - DNA, 20 bp, Artificial Sequence
  chemically synthesized
tgtttccacagagaaccttt

SEQ ID NO: 477311 - DNA, 20 bp, Artificial Sequence
  chemically synthesized
agaacctttcagaatgagag

SEQ ID NO: 477312 - DNA, 20 bp, Artificial Sequence
  chemically synthesized
ttttcctagtctcccactta

SEQ ID NO: 477313 - DNA, 20 bp, Artificial Sequence
  chemically synthesized
acattttcctacttgagtgg

SEQ ID NO: 477314 - DNA, 20 bp, Artificial Sequence
  chemically synthesized
ctgatgaaacattttcctac

SEQ ID NO: 477315 - DNA, 20 bp, Artificial Sequence
  chemically synthesized
agcgttcatcatgttgccct

SEQ ID NO: 477316 - DNA, 20 bp, Artificial Sequence
  chemically synthesized
ctgaatgagcatgaggggtt

SEQ ID NO: 477317 - DNA, 20 bp, Artificial Sequence
  chemically synthesized
ttttatcctgaatgagcatg

SEQ ID NO: 477318 - DNA, 20 bp, Artificial Sequence
  chemically synthesized
cagaacccctcatgctcatt

SEQ ID NO: 477319 - DNA, 20 bp, Artificial Sequence
  chemically synthesized
tactcttcaataattttatc

SEQ ID NO: 477320 - DNA, 20 bp, Artificial Sequence
  chemically synthesized
cattcaggataaaattattg

SEQ ID NO: 477321 - DNA, 20 bp, Artificial Sequence
  chemically synthesized
tgtgtgtgtgtgtgtgtggg

SEQ ID NO: 477322 - DNA, 20 bp, Artificial Sequence
  chemically synthesized
ggtgttctgtgcatggggga

SEQ ID NO: 477323 - DNA, 20 bp, Artificial Sequence
  chemically synthesized
atttattatttccttgtgga

SEQ ID NO: 477324 - DNA, 20 bp, Artificial Sequence
  chemically synthesized
ttttttttctcctcaaacct

SEQ ID NO: 477325 - DNA, 20 bp, Artificial Sequence
  chemically synthesized
tgaggagaaaaaaaatactt

SEQ ID NO: 477326 - DNA, 20 bp, Artificial Sequence
  chemically synthesized
aggcactcaacgtatattag

SEQ ID NO: 477327 - DNA, 20 bp, Artificial Sequence
  chemically synthesized
tctcattcagctaatatacg

SEQ ID NO: 477328 - DNA, 20 bp, Artificial Sequence
  chemically synthesized
ttaatgggcaaacagaggaa

SEQ ID NO: 477329 - DNA, 20 bp, Artificial Sequence
  chemically synthesized
tggagagattaggggaaatg

SEQ ID NO: 477330 - DNA, 20 bp, Artificial Sequence
  chemically synthesized
gagtgtagaaatttcaagga

SEQ ID NO: 477331 - DNA, 20 bp, Artificial Sequence
  chemically synthesized
agaaatttcaaggagagagt

SEQ ID NO: 477332 - DNA, 20 bp, Artificial Sequence
  chemically synthesized
agtgagaattttgagaggaa

SEQ ID NO: 477333 - DNA, 20 bp, Artificial Sequence
  chemically synthesized
gagaggaagagggtgaccaa

SEQ ID NO: 477334 - DNA, 20 bp, Artificial Sequence
  chemically synthesized
gtaaagtaagatcagcattg

SEQ ID NO: 477335 - DNA, 20 bp, Artificial Sequence
  chemically synthesized
ctcagaagtaggcatagctg

SEQ ID NO: 477336 - DNA, 20 bp, Artificial Sequence
  chemically synthesized
gaagtaggcatagctgagga

SEQ ID NO: 477337 - DNA, 20 bp, Artificial Sequence
  chemically synthesized
gctgaggagtgagtggaaga

SEQ ID NO: 477338 - DNA, 20 bp, Artificial Sequence
  chemically synthesized
agacacgacaggaggacaga

SEQ ID NO: 477339 - DNA, 20 bp, Artificial Sequence
  chemically synthesized
cagagaggataacaagacaa

SEQ ID NO: 477340 - DNA, 20 bp, Artificial Sequence
  chemically synthesized
taagaagttctttttagcat

SEQ ID NO: 477341 - DNA, 20 bp, Artificial Sequence
  chemically synthesized
gcataggaatgatttgaacc

SEQ ID NO: 477342 - DNA, 20 bp, Artificial Sequence
  chemically synthesized
tgaaagacggaagctagcag

SEQ ID NO: 477343 - DNA, 20 bp, Artificial Sequence
  chemically synthesized
ccatcttggtttgtccagca

SEQ ID NO: 477344 - DNA, 20 bp, Artificial Sequence
  chemically synthesized
ttgtccagcattgagttttt

SEQ ID NO: 477345 - DNA, 20 bp, Artificial Sequence
  chemically synthesized
gagactttcgatgttaaaac

SEQ ID NO: 477346 - DNA, 20 bp, Artificial Sequence
  chemically synthesized
tcaaggtcgtaacatatatc

SEQ ID NO: 477347 - DNA, 20 bp, Artificial Sequence
  chemically synthesized
aaggtctgtaaaataaggaa

SEQ ID NO: 477348 - DNA, 20 bp, Artificial Sequence
  chemically synthesized
ttttttttttttttttgaga

SEQ ID NO: 477349 - DNA, 20 bp, Artificial Sequence
  chemically synthesized
tctcgctctgtcgcccaggc

SEQ ID NO: 477350 - DNA, 20 bp, Artificial Sequence
  chemically synthesized
tactcgggaggctgaggcag

SEQ ID NO: 477351 - DNA, 20 bp, Artificial Sequence
  chemically synthesized
cattctcctgcctcagcctc

SEQ ID NO: 477352 - DNA, 20 bp, Artificial Sequence
  chemically synthesized
ttttgtatttttagtagaga

SEQ ID NO: 477353 - DNA, 20 bp, Artificial Sequence
  chemically synthesized
cggggtttcaccgtgttagc

SEQ ID NO: 477354 - DNA, 20 bp, Artificial Sequence
  chemically synthesized
gccttggcctcccaaagtgc

SEQ ID NO: 477355 - DNA, 20 bp, Artificial Sequence
  chemically synthesized
gccaccacgcccggccggaa

SEQ ID NO: 477356 - DNA, 20 bp, Artificial Sequence
  chemically synthesized
ttactgtccagttttaacaa

SEQ ID NO: 477357 - DNA, 20 bp, Artificial Sequence
  chemically synthesized
acaatggatgctccttagct

SEQ ID NO: 477358 - DNA, 20 bp, Artificial Sequence
  chemically synthesized
caaacacgtggtctctcaca

SEQ ID NO: 477359 - DNA, 20 bp, Artificial Sequence
  chemically synthesized
agagaccacgtgtttgccca

SEQ ID NO: 477360 - DNA, 20 bp, Artificial Sequence
  chemically synthesized
aaatgaactgtgcagctgtg

SEQ ID NO: 477361 - DNA, 20 bp, Artificial Sequence
  chemically synthesized
gcacagttcatttcttaaat

SEQ ID NO: 477362 - DNA, 20 bp, Artificial Sequence
  chemically synthesized
cctgaaattaagaaaagaaa

SEQ ID NO: 477363 - DNA, 20 bp, Artificial Sequence
  chemically synthesized
aaaagaaagtggatggaaga

SEQ ID NO: 477364 - DNA, 20 bp, Artificial Sequence
  chemically synthesized
gggttaagtgattgtatctt

SEQ ID NO: 477365 - DNA, 20 bp, Artificial Sequence
  chemically synthesized
tttatccttttgtatttaat

SEQ ID NO: 477366 - DNA, 20 bp, Artificial Sequence
  chemically synthesized
aagattcagattaaatacaa

SEQ ID NO: 477367 - DNA, 20 bp, Artificial Sequence
  chemically synthesized
aactatttctctctttttgt

SEQ ID NO: 477368 - DNA, 20 bp, Artificial Sequence
  chemically synthesized
tatagtttttcccacatgat

SEQ ID NO: 477369 - DNA, 20 bp, Artificial Sequence
  chemically synthesized
tgttaagtgactaaattaaa

SEQ ID NO: 477370 - DNA, 20 bp, Artificial Sequence
  chemically synthesized
gtagtaaaaaaaaagcaatg

SEQ ID NO: 477371 - DNA, 20 bp, Artificial Sequence
  chemically synthesized
actacaacatgcagtttatg

SEQ ID NO: 477372 - DNA, 20 bp, Artificial Sequence
  chemically synthesized
ttttttaaaaaaagacaaac

SEQ ID NO: 477373 - DNA, 20 bp, Artificial Sequence
  chemically synthesized
atatgacaaaatcagtatat

SEQ ID NO: 477374 - DNA, 20 bp, Artificial Sequence
  chemically synthesized
tattttctcccatgtacata

SEQ ID NO: 477375 - DNA, 20 bp, Artificial Sequence
  chemically synthesized
taacatctgaatgctaacat

SEQ ID NO: 477376 - DNA, 20 bp, Artificial Sequence
  chemically synthesized
ggaagtaattatcttaacat

SEQ ID NO: 477377 - DNA, 20 bp, Artificial Sequence
  chemically synthesized
gatgttaagataattacttc

SEQ ID NO: 477378 - DNA, 20 bp, Artificial Sequence
  chemically synthesized
aagataattttatctgttca

SEQ ID NO: 477379 - DNA, 20 bp, Artificial Sequence
  chemically synthesized
gaaaagaaaggtatggggaa

SEQ ID NO: 477380 - DNA, 20 bp, Artificial Sequence
  chemically synthesized
tttccaagacagccagaccc

SEQ ID NO: 477381 - DNA, 20 bp, Artificial Sequence
  chemically synthesized
catatcactattttggaccc

SEQ ID NO: 477382 - DNA, 20 bp, Artificial Sequence
  chemically synthesized
ggtccaaaatagtgatatga

SEQ ID NO: 477383 - DNA, 20 bp, Artificial Sequence
  chemically synthesized
tatgcaatttagaaaatgtt

SEQ ID NO: 477384 - DNA, 20 bp, Artificial Sequence
  chemically synthesized
aaatctatttattatgaagg

SEQ ID NO: 477385 - DNA, 20 bp, Artificial Sequence
  chemically synthesized
acaccataggtactggccaa

SEQ ID NO: 477386 - DNA, 20 bp, Artificial Sequence
  chemically synthesized
ttttttgaatgaacaaatta

SEQ ID NO: 477387 - DNA, 20 bp, Artificial Sequence
  chemically synthesized
aggttcaaaataaatatttt

SEQ ID NO: 477388 - DNA, 20 bp, Artificial Sequence
  chemically synthesized
ttaaggagccaatagtttgg

SEQ ID NO: 477389 - DNA, 20 bp, Artificial Sequence
  chemically synthesized
gtggtgtatacttttatatt

SEQ ID NO: 477390 - DNA, 20 bp, Artificial Sequence
  chemically synthesized
ttatctgtatctcaatttgc

SEQ ID NO: 477391 - DNA, 20 bp, Artificial Sequence
  chemically synthesized
aaattgagatacagataagt

SEQ ID NO: 477392 - DNA, 20 bp, Artificial Sequence
  chemically synthesized
ccatcagttaattacacact

SEQ ID NO: 477393 - DNA, 20 bp, Artificial Sequence
  chemically synthesized
actcactttcagcttcactt

SEQ ID NO: 477394 - DNA, 20 bp, Artificial Sequence
  chemically synthesized
attctaaagtgaagctgaaa

SEQ ID NO: 477395 - DNA, 20 bp, Artificial Sequence
  chemically synthesized
aacataaaatctccctgact

SEQ ID NO: 477396 - DNA, 20 bp, Artificial Sequence
  chemically synthesized
ctgatttcttccatggccat

SEQ ID NO: 477397 - DNA, 20 bp, Artificial Sequence
  chemically synthesized
ggttcttctctattactttc

SEQ ID NO: 477398 - DNA, 20 bp, Artificial Sequence
  chemically synthesized
ttatttatttatttttgaga

SEQ ID NO: 477399 - DNA, 20 bp, Artificial Sequence
  chemically synthesized
tctcgctctgtcacccagtc

SEQ ID NO: 477400 - DNA, 20 bp, Artificial Sequence
  chemically synthesized
tcgtgccactgcactccaga

SEQ ID NO: 477401 - DNA, 20 bp, Artificial Sequence
  chemically synthesized
cttactgcaacctctgcctc

SEQ ID NO: 477402 - DNA, 20 bp, Artificial Sequence
  chemically synthesized
tactcaggaggctgaggcag

SEQ ID NO: 477403 - DNA, 20 bp, Artificial Sequence
  chemically synthesized
gattctcctgcctcagcctc

SEQ ID NO: 477404 - DNA, 20 bp, Artificial Sequence
  chemically synthesized
ctaaaaatacaaaaaattag

SEQ ID NO: 477405 - DNA, 20 bp, Artificial Sequence
  chemically synthesized
ttttgtatttttagtagaga

SEQ ID NO: 477406 - DNA, 20 bp, Artificial Sequence
  chemically synthesized
caaacggatcacctgaggtc

SEQ ID NO: 477407 - DNA, 20 bp, Artificial Sequence
  chemically synthesized
actttgcgaggccgaggcaa

SEQ ID NO: 477408 - DNA, 20 bp, Artificial Sequence
  chemically synthesized
gcctcggcctcgcaaagtgc

SEQ ID NO: 477409 - DNA, 20 bp, Artificial Sequence
  chemically synthesized
agctcagaaccacgtatgga

SEQ ID NO: 477410 - DNA, 20 bp, Artificial Sequence
  chemically synthesized
gtcatgtcattacctatgcc

SEQ ID NO: 477411 - DNA, 20 bp, Artificial Sequence
  chemically synthesized
cttgctttctcctggggaca

SEQ ID NO: 477412 - DNA, 20 bp, Artificial Sequence
  chemically synthesized
tctcctggggacagtggatt

SEQ ID NO: 477413 - DNA, 20 bp, Artificial Sequence
  chemically synthesized
ggatttaggatcatattact

SEQ ID NO: 477414 - DNA, 20 bp, Artificial Sequence
  chemically synthesized
aggatcatattactatggat

SEQ ID NO: 477415 - DNA, 20 bp, Artificial Sequence
  chemically synthesized
catgtacagcttgcctggcg

SEQ ID NO: 477416 - DNA, 20 bp, Artificial Sequence
  chemically synthesized
cacaaatttaccatttcaat

SEQ ID NO: 477417 - DNA, 20 bp, Artificial Sequence
  chemically synthesized
aatggtaaatttgtgttttt

SEQ ID NO: 477418 - DNA, 20 bp, Artificial Sequence
  chemically synthesized
tttttcagaataaaatctga

SEQ ID NO: 477419 - DNA, 20 bp, Artificial Sequence
  chemically synthesized
aggaagttctgcttacaaat

SEQ ID NO: 477420 - DNA, 20 bp, Artificial Sequence
  chemically synthesized
tatttgtaagcagaacttcc

SEQ ID NO: 477421 - DNA, 20 bp, Artificial Sequence
  chemically synthesized
caccacttcagcctgcctcc

SEQ ID NO: 477422 - DNA, 20 bp, Artificial Sequence
  chemically synthesized
gtggtgaaaagagcactgtt

SEQ ID NO: 477423 - DNA, 20 bp, Artificial Sequence
  chemically synthesized
ggaagagtttatcacctttt

SEQ ID NO: 477424 - DNA, 20 bp, Artificial Sequence
  chemically synthesized
tgaggacacagaggagcagg

SEQ ID NO: 477425 - DNA, 20 bp, Artificial Sequence
  chemically synthesized
ttgattatagtatatgagaa

SEQ ID NO: 477426 - DNA, 20 bp, Artificial Sequence
  chemically synthesized
ctgctctatggtggcagttt

SEQ ID NO: 477427 - DNA, 20 bp, Artificial Sequence
  chemically synthesized
aacacactctagtgttctaa

SEQ ID NO: 477428 - DNA, 20 bp, Artificial Sequence
  chemically synthesized
agaacacccagttagaacac

SEQ ID NO: 477429 - DNA, 20 bp, Artificial Sequence
  chemically synthesized
gcaggggaaagcctggactc

SEQ ID NO: 477430 - DNA, 20 bp, Artificial Sequence
  chemically synthesized
aattttttcacttatgattc

SEQ ID NO: 477431 - DNA, 20 bp, Artificial Sequence
  chemically synthesized
atctggaacatgagtagacc

SEQ ID NO: 477432 - DNA, 20 bp, Artificial Sequence
  chemically synthesized
ctcagctttggatctggaac

SEQ ID NO: 477433 - DNA, 20 bp, Artificial Sequence
  chemically synthesized
ctcatgttccagatccaaag

SEQ ID NO: 477434 - DNA, 20 bp, Artificial Sequence
  chemically synthesized
ctcagcagtgacactcagct

SEQ ID NO: 477435 - DNA, 20 bp, Artificial Sequence
  chemically synthesized
tccaaagctgagtgtcactg

SEQ ID NO: 477436 - DNA, 20 bp, Artificial Sequence
  chemically synthesized
tgagtgtcactgctgagtta

SEQ ID NO: 477437 - DNA, 20 bp, Artificial Sequence
  chemically synthesized
gtcactgctgagttactggg

SEQ ID NO: 477438 - DNA, 20 bp, Artificial Sequence
  chemically synthesized
cagttcaaaccatggaactt

SEQ ID NO: 477439 - DNA, 20 bp, Artificial Sequence
  chemically synthesized
ggggctttttctgtagtctg

SEQ ID NO: 477440 - DNA, 20 bp, Artificial Sequence
  chemically synthesized
actagacaggctctgaaatg

SEQ ID NO: 477441 - DNA, 20 bp, Artificial Sequence
  chemically synthesized
ttgttgaatgaacagaactg

SEQ ID NO: 477442 - DNA, 20 bp, Artificial Sequence
  chemically synthesized
cagttctgttcattcaacaa

SEQ ID NO: 477443 - DNA, 20 bp, Artificial Sequence
  chemically synthesized
gcctgctcggtatccatttg

SEQ ID NO: 477444 - DNA, 20 bp, Artificial Sequence
  chemically synthesized
caggaacaagaatgatgacg

SEQ ID NO: 477445 - DNA, 20 bp, Artificial Sequence
  chemically synthesized
ggtagaaataacacaggaac

SEQ ID NO: 477446 - DNA, 20 bp, Artificial Sequence
  chemically synthesized
tatgtctgacaagaaagttg

SEQ ID NO: 477447 - DNA, 20 bp, Artificial Sequence
  chemically synthesized
aaagaaggtccttttggtga

SEQ ID NO: 477448 - DNA, 20 bp, Artificial Sequence
  chemically synthesized
ttaaagagccaccatattta

SEQ ID NO: 477449 - DNA, 20 bp, Artificial Sequence
  chemically synthesized
ttattgagtctcaaacacat

SEQ ID NO: 477450 - DNA, 20 bp, Artificial Sequence
  chemically synthesized
ttggaaaagggcaagcaatc

SEQ ID NO: 477451 - DNA, 20 bp, Artificial Sequence
  chemically synthesized
gccaccctgccatgtacatc

SEQ ID NO: 477452 - DNA, 20 bp, Artificial Sequence
  chemically synthesized
gcaatccaggatgtacatgg

SEQ ID NO: 477453 - DNA, 20 bp, Artificial Sequence
  chemically synthesized
gatgtacatggcagggtggc

SEQ ID NO: 477454 - DNA, 20 bp, Artificial Sequence
  chemically synthesized
gtaatctaaagcaaattcat

SEQ ID NO: 477455 - DNA, 20 bp, Artificial Sequence
  chemically synthesized
tttttcttccatgaacccct

SEQ ID NO: 477456 - DNA, 20 bp, Artificial Sequence
  chemically synthesized
gtattacagaagttatgaac

SEQ ID NO: 477457 - DNA, 20 bp, Artificial Sequence
  chemically synthesized
aaaaaaaaaaaatgtgttaa

SEQ ID NO: 477458 - DNA, 20 bp, Artificial Sequence
  chemically synthesized
atttttttttttttttgaga

SEQ ID NO: 477459 - DNA, 20 bp, Artificial Sequence
  chemically synthesized
tctcgctctgtcactcaggc

SEQ ID NO: 477460 - DNA, 20 bp, Artificial Sequence
  chemically synthesized
gcgcaccactgcactccagc

SEQ ID NO: 477461 - DNA, 20 bp, Artificial Sequence
  chemically synthesized
tactcgggaggctgaggcag

SEQ ID NO: 477462 - DNA, 20 bp, Artificial Sequence
  chemically synthesized
cattctcctgcctcagcctc

SEQ ID NO: 477463 - DNA, 20 bp, Artificial Sequence
  chemically synthesized
ttttgtatttttagtagaga

SEQ ID NO: 477464 - DNA, 20 bp, Artificial Sequence
  chemically synthesized
tggggtttcaccgtgttagc

SEQ ID NO: 477465 - DNA, 20 bp, Artificial Sequence
  chemically synthesized
taagggcgagttgttgctca

SEQ ID NO: 477466 - DNA, 20 bp, Artificial Sequence
  chemically synthesized
ggttgccatacattgtaagg

SEQ ID NO: 477467 - DNA, 20 bp, Artificial Sequence
  chemically synthesized
tttttctactctctgcttct

SEQ ID NO: 477468 - DNA, 20 bp, Artificial Sequence
  chemically synthesized
tagtcaaactcatagaagca

SEQ ID NO: 477469 - DNA, 20 bp, Artificial Sequence
  chemically synthesized
gccttattttcactccactt

SEQ ID NO: 477470 - DNA, 20 bp, Artificial Sequence
  chemically synthesized
tcttcacttttattcagaag

SEQ ID NO: 477471 - DNA, 20 bp, Artificial Sequence
  chemically synthesized
tctgaataaaagtgaagata

SEQ ID NO: 477472 - DNA, 20 bp, Artificial Sequence
  chemically synthesized
ttgactatctgaaacaatga

SEQ ID NO: 477473 - DNA, 20 bp, Artificial Sequence
  chemically synthesized
gttgttgactatctgaaaca

SEQ ID NO: 477474 - DNA, 20 bp, Artificial Sequence
  chemically synthesized
atattaatttataaatgaga

SEQ ID NO: 477475 - DNA, 20 bp, Artificial Sequence
  chemically synthesized
tagtcaatgaaaaaacattt

SEQ ID NO: 477476 - DNA, 20 bp, Artificial Sequence
  chemically synthesized
cagaaaaataaatctcaaca

SEQ ID NO: 477477 - DNA, 20 bp, Artificial Sequence
  chemically synthesized
agcccgtgcccttgatctca

SEQ ID NO: 477478 - DNA, 20 bp, Artificial Sequence
  chemically synthesized
ctgagatcaagggcacgggc

SEQ ID NO: 477479 - DNA, 20 bp, Artificial Sequence
  chemically synthesized
gcaggtctgtgatactatgg

SEQ ID NO: 477480 - DNA, 20 bp, Artificial Sequence
  chemically synthesized
agcagcccagccttagaatt

SEQ ID NO: 477481 - DNA, 20 bp, Artificial Sequence
  chemically synthesized
tgttggaagcagcccagcct

SEQ ID NO: 477482 - DNA, 20 bp, Artificial Sequence
  chemically synthesized
aaatggccacgggaactaga

SEQ ID NO: 477483 - DNA, 20 bp, Artificial Sequence
  chemically synthesized
ctagttcccgtggccattta

SEQ ID NO: 477484 - DNA, 20 bp, Artificial Sequence
  chemically synthesized
cttctgaaatgttagtagaa

SEQ ID NO: 477485 - DNA, 20 bp, Artificial Sequence
  chemically synthesized
tgaaatgttagtagaaatga

SEQ ID NO: 477486 - DNA, 20 bp, Artificial Sequence
  chemically synthesized
atacacaaattaatttgtca

SEQ ID NO: 477487 - DNA, 20 bp, Artificial Sequence
  chemically synthesized
gtataagtggtaaataatat

SEQ ID NO: 477488 - DNA, 20 bp, Artificial Sequence
  chemically synthesized
tatgttgatagacagacaca

SEQ ID NO: 477489 - DNA, 20 bp, Artificial Sequence
  chemically synthesized
aatgaaccagggttccattt

SEQ ID NO: 477490 - DNA, 20 bp, Artificial Sequence
  chemically synthesized
tgtatgtgcttagaatgaac

SEQ ID NO: 477491 - DNA, 20 bp, Artificial Sequence
  chemically synthesized
cacgtttgagtgtatgtgct

SEQ ID NO: 477492 - DNA, 20 bp, Artificial Sequence
  chemically synthesized
agacttgggaatgatcacgt

SEQ ID NO: 477493 - DNA, 20 bp, Artificial Sequence
  chemically synthesized
ttgccatctgagaaagactt

SEQ ID NO: 477494 - DNA, 20 bp, Artificial Sequence
  chemically synthesized
tttgttcaagccattgacct

SEQ ID NO: 477495 - DNA, 20 bp, Artificial Sequence
  chemically synthesized
gtggagtttgagaggaagca

SEQ ID NO: 477496 - DNA, 20 bp, Artificial Sequence
  chemically synthesized
aacttaagatagatagaatg

SEQ ID NO: 477497 - DNA, 20 bp, Artificial Sequence
  chemically synthesized
ttgatagaacttaagataga

SEQ ID NO: 477498 - DNA, 20 bp, Artificial Sequence
  chemically synthesized
tcgaagatatatttggaggg

SEQ ID NO: 477499 - DNA, 20 bp, Artificial Sequence
  chemically synthesized
tttgatcgaagatatatttg

SEQ ID NO: 477500 - DNA, 20 bp, Artificial Sequence
  chemically synthesized
gagtggaaatgataggtatg

SEQ ID NO: 477501 - DNA, 20 bp, Artificial Sequence
  chemically synthesized
aaggaaatgattacttggac

SEQ ID NO: 477502 - DNA, 20 bp, Artificial Sequence
  chemically synthesized
gacacagaaaaggagggtgg

SEQ ID NO: 477503 - DNA, 20 bp, Artificial Sequence
  chemically synthesized
aaactgaagacacagaaaag

SEQ ID NO: 477504 - DNA, 20 bp, Artificial Sequence
  chemically synthesized
agttgactcttgctgctatg

SEQ ID NO: 477505 - DNA, 20 bp, Artificial Sequence
  chemically synthesized
agtcaattctccatagcagc

SEQ ID NO: 477506 - DNA, 20 bp, Artificial Sequence
  chemically synthesized
atcactggaaggctctcagc

SEQ ID NO: 477507 - DNA, 20 bp, Artificial Sequence
  chemically synthesized
cagtgatgtctctttactca

SEQ ID NO: 477508 - DNA, 20 bp, Artificial Sequence
  chemically synthesized
ttggaggtggattttattct

SEQ ID NO: 477509 - DNA, 20 bp, Artificial Sequence
  chemically synthesized
ttgcaggccatagtttggag

SEQ ID NO: 477510 - DNA, 20 bp, Artificial Sequence
  chemically synthesized
aaagagggaaaggccagata

SEQ ID NO: 477511 - DNA, 20 bp, Artificial Sequence
  chemically synthesized
cccaatggtaagaacaggtt

SEQ ID NO: 477512 - DNA, 20 bp, Artificial Sequence
  chemically synthesized
ctgttcttaccattgggctt

SEQ ID NO: 477513 - DNA, 20 bp, Artificial Sequence
  chemically synthesized
aatttggtgcttcttctgcc

SEQ ID NO: 477514 - DNA, 20 bp, Artificial Sequence
  chemically synthesized
atgcaaaaaccttgaatgaa

SEQ ID NO: 477515 - DNA, 20 bp, Artificial Sequence
  chemically synthesized
gagtaaaccatgcaaaaacc

SEQ ID NO: 477516 - DNA, 20 bp, Artificial Sequence
  chemically synthesized
aacaaacaaaacctgtgtga

SEQ ID NO: 477517 - DNA, 20 bp, Artificial Sequence
  chemically synthesized
aacaaacaaacaaaacctgt

SEQ ID NO: 477518 - DNA, 20 bp, Artificial Sequence
  chemically synthesized
gtttgtttgtttttttgaga

SEQ ID NO: 477519 - DNA, 20 bp, Artificial Sequence
  chemically synthesized
ctgcactctagcctgggtgg

SEQ ID NO: 477520 - DNA, 20 bp, Artificial Sequence
  chemically synthesized
tctcactctgccacccaggc

SEQ ID NO: 477521 - DNA, 20 bp, Artificial Sequence
  chemically synthesized
ttgtgccactgcactctagc

SEQ ID NO: 477522 - DNA, 20 bp, Artificial Sequence
  chemically synthesized
tacccaggaggctgaggtac

SEQ ID NO: 477523 - DNA, 20 bp, Artificial Sequence
  chemically synthesized
gattctggtacctcagcctc

SEQ ID NO: 477524 - DNA, 20 bp, Artificial Sequence
  chemically synthesized
gtttcgaactcttgacgtcc

SEQ ID NO: 477525 - DNA, 20 bp, Artificial Sequence
  chemically synthesized
caggcagatccctggacgtc

SEQ ID NO: 477526 - DNA, 20 bp, Artificial Sequence
  chemically synthesized
gtttcagccacccaaagtgc

SEQ ID NO: 477527 - DNA, 20 bp, Artificial Sequence
  chemically synthesized
atgcctgtaatcccagcact

SEQ ID NO: 477528 - DNA, 20 bp, Artificial Sequence
  chemically synthesized
gggtaaagacttgtgtgagg

SEQ ID NO: 477529 - DNA, 20 bp, Artificial Sequence
  chemically synthesized
cctatgtgaggaggttattt

SEQ ID NO: 477530 - DNA, 20 bp, Artificial Sequence
  chemically synthesized
gcatgaatagagaaagattg

SEQ ID NO: 477531 - DNA, 20 bp, Artificial Sequence
  chemically synthesized
gaagagaaaataaacaaagc

SEQ ID NO: 477532 - DNA, 20 bp, Artificial Sequence
  chemically synthesized
aattaatatatgaaattatg

SEQ ID NO: 477533 - DNA, 20 bp, Artificial Sequence
  chemically synthesized
ataatttcatatattaattt

SEQ ID NO: 477534 - DNA, 20 bp, Artificial Sequence
  chemically synthesized
caaaatgagtctctgcccct

SEQ ID NO: 477535 - DNA, 20 bp, Artificial Sequence
  chemically synthesized
agcatatgttagggaacaaa

SEQ ID NO: 477536 - DNA, 20 bp, Artificial Sequence
  chemically synthesized
tccctaacatatgcttaaca

SEQ ID NO: 477537 - DNA, 20 bp, Artificial Sequence
  chemically synthesized
tgaaagaaccaataaattct

SEQ ID NO: 477538 - DNA, 20 bp, Artificial Sequence
  chemically synthesized
aaccaataaattctaggaat

SEQ ID NO: 477539 - DNA, 20 bp, Artificial Sequence
  chemically synthesized
tataccataactcagattcc

SEQ ID NO: 477540 - DNA, 20 bp, Artificial Sequence
  chemically synthesized
agagcacagaaaaaaatcaa

SEQ ID NO: 477541 - DNA, 20 bp, Artificial Sequence
  chemically synthesized
aggggatcatttgtaattaa

SEQ ID NO: 477542 - DNA, 20 bp, Artificial Sequence
  chemically synthesized
actatgcagatactgtttta

SEQ ID NO: 477543 - DNA, 20 bp, Artificial Sequence
  chemically synthesized
tgactgtaacaagatgagat

SEQ ID NO: 477544 - DNA, 20 bp, Artificial Sequence
  chemically synthesized
actgaagaactgagtcatct

SEQ ID NO: 477545 - DNA, 20 bp, Artificial Sequence
  chemically synthesized
ttatcatcaaaactgaagaa

SEQ ID NO: 477546 - DNA, 20 bp, Artificial Sequence
  chemically synthesized
agaactgcatttctaggcat

SEQ ID NO: 477547 - DNA, 20 bp, Artificial Sequence
  chemically synthesized
tgcagtcatatttagggatg

SEQ ID NO: 477548 - DNA, 20 bp, Artificial Sequence
  chemically synthesized
tatcctatgcagtcatattt

SEQ ID NO: 477549 - DNA, 20 bp, Artificial Sequence
  chemically synthesized
catccctaaatatgactgca

SEQ ID NO: 477550 - DNA, 20 bp, Artificial Sequence
  chemically synthesized
aaacttatacaaaaatgatg

SEQ ID NO: 477551 - DNA, 20 bp, Artificial Sequence
  chemically synthesized
acgcggctaaaaagacacct

SEQ ID NO: 477552 - DNA, 20 bp, Artificial Sequence
  chemically synthesized
cattcaatgacctggcctct

SEQ ID NO: 477553 - DNA, 20 bp, Artificial Sequence
  chemically synthesized
aactctaagaggccaggtca

SEQ ID NO: 477554 - DNA, 20 bp, Artificial Sequence
  chemically synthesized
gaggccaggtcattgaatgt

SEQ ID NO: 477555 - DNA, 20 bp, Artificial Sequence
  chemically synthesized
ccaggtcattgaatgttaga

SEQ ID NO: 477556 - DNA, 20 bp, Artificial Sequence
  chemically synthesized
cgtgagccaccgcgcccggc

SEQ ID NO: 477557 - DNA, 20 bp, Artificial Sequence
  chemically synthesized
gcctcagcctcccaaagtgc

SEQ ID NO: 477558 - DNA, 20 bp, Artificial Sequence
  chemically synthesized
cagcactttgggaggctgag

SEQ ID NO: 477559 - DNA, 20 bp, Artificial Sequence
  chemically synthesized
actttgggaggctgaggcgg

SEQ ID NO: 477560 - DNA, 20 bp, Artificial Sequence
  chemically synthesized
cggggtttcaccgtgttagc

SEQ ID NO: 477561 - DNA, 20 bp, Artificial Sequence
  chemically synthesized
ttttgtatttttagtagaga

SEQ ID NO: 477562 - DNA, 20 bp, Artificial Sequence
  chemically synthesized
aacattagccaggtgtggtg

SEQ ID NO: 477563 - DNA, 20 bp, Artificial Sequence
  chemically synthesized
cccagctgaggcaggagaag

SEQ ID NO: 477564 - DNA, 20 bp, Artificial Sequence
  chemically synthesized
ctcaccgcaagctccacctc

SEQ ID NO: 477565 - DNA, 20 bp, Artificial Sequence
  chemically synthesized
gtctcgcctgcagcccaggc

SEQ ID NO: 477566 - DNA, 20 bp, Artificial Sequence
  chemically synthesized
tctttaatttttttttgaga

SEQ ID NO: 477567 - DNA, 20 bp, Artificial Sequence
  chemically synthesized
taaataaaaagaaaagaaaa

SEQ ID NO: 477568 - DNA, 20 bp, Artificial Sequence
  chemically synthesized
taaaaagaaaagaaaaaaga

SEQ ID NO: 477569 - DNA, 20 bp, Artificial Sequence
  chemically synthesized
aaaacaaccaaaagttgcga

SEQ ID NO: 477570 - DNA, 20 bp, Artificial Sequence
  chemically synthesized
aatatctttggatgtcattt

SEQ ID NO: 477571 - DNA, 20 bp, Artificial Sequence
  chemically synthesized
tacagaaagagaaaatatct

SEQ ID NO: 477572 - DNA, 20 bp, Artificial Sequence
  chemically synthesized
ttagtatgtatgttagcttg

SEQ ID NO: 477573 - DNA, 20 bp, Artificial Sequence
  chemically synthesized
tcagtgctggcctgcttacg

SEQ ID NO: 477574 - DNA, 20 bp, Artificial Sequence
  chemically synthesized
aagcaggccagcactgataa

SEQ ID NO: 477575 - DNA, 20 bp, Artificial Sequence
  chemically synthesized
tataatctacaacatgattt

SEQ ID NO: 477576 - DNA, 20 bp, Artificial Sequence
  chemically synthesized
atgatttcaggataatttta

SEQ ID NO: 477577 - DNA, 20 bp, Artificial Sequence
  chemically synthesized
ctgttgacaaatgaaaaggc

SEQ ID NO: 477578 - DNA, 20 bp, Artificial Sequence
  chemically synthesized
ggacagaaagccattattgc

SEQ ID NO: 477579 - DNA, 20 bp, Artificial Sequence
  chemically synthesized
atcaatacatacattattaa

SEQ ID NO: 477580 - DNA, 20 bp, Artificial Sequence
  chemically synthesized
tcccttccctagagatcatt

SEQ ID NO: 477581 - DNA, 20 bp, Artificial Sequence
  chemically synthesized
tccttaatgatctctaggga

SEQ ID NO: 477582 - DNA, 20 bp, Artificial Sequence
  chemically synthesized
aatcaagatctaatctccat

SEQ ID NO: 477583 - DNA, 20 bp, Artificial Sequence
  chemically synthesized
atctaatctccatttggatt

SEQ ID NO: 477584 - DNA, 20 bp, Artificial Sequence
  chemically synthesized
tggatttggggtaggaggaa

SEQ ID NO: 477585 - DNA, 20 bp, Artificial Sequence
  chemically synthesized
ttggggtaggaggaagggag

SEQ ID NO: 477586 - DNA, 20 bp, Artificial Sequence
  chemically synthesized
taaaggagcaaatcatagtg

SEQ ID NO: 477587 - DNA, 20 bp, Artificial Sequence
  chemically synthesized
acttctgtgattaacctaga

SEQ ID NO: 477588 - DNA, 20 bp, Artificial Sequence
  chemically synthesized
tttttaaaatatatctggac

SEQ ID NO: 477589 - DNA, 20 bp, Artificial Sequence
  chemically synthesized
gactgactcgttttcaatta

SEQ ID NO: 477590 - DNA, 20 bp, Artificial Sequence
  chemically synthesized
ataacacccactaattgaaa

SEQ ID NO: 477591 - DNA, 20 bp, Artificial Sequence
  chemically synthesized
taatgaggaactgtaaaagc

SEQ ID NO: 477592 - DNA, 20 bp, Artificial Sequence
  chemically synthesized
ctgaccaatttttatgtctt

SEQ ID NO: 477593 - DNA, 20 bp, Artificial Sequence
  chemically synthesized
gggcagcataacaactgcaa

SEQ ID NO: 477594 - DNA, 20 bp, Artificial Sequence
  chemically synthesized
gggagcacagatctactccc

SEQ ID NO: 477595 - DNA, 20 bp, Artificial Sequence
  chemically synthesized
aaagcaattttcacacccat

SEQ ID NO: 477596 - DNA, 20 bp, Artificial Sequence
  chemically synthesized
tgggtgtgaaaattgctttg

SEQ ID NO: 477597 - DNA, 20 bp, Artificial Sequence
  chemically synthesized
atggtccccaaatatgtctg

SEQ ID NO: 477598 - DNA, 20 bp, Artificial Sequence
  chemically synthesized
aatatgtctgtggagtatct

SEQ ID NO: 477599 - DNA, 20 bp, Artificial Sequence
  chemically synthesized
gtatattttctctacaagaa

SEQ ID NO: 477600 - DNA, 20 bp, Artificial Sequence
  chemically synthesized
cactttcattttctataaat

SEQ ID NO: 477601 - DNA, 20 bp, Artificial Sequence
  chemically synthesized
ttcaactattgacattttaa

SEQ ID NO: 477602 - DNA, 20 bp, Artificial Sequence
  chemically synthesized
cctttgctgatgctttttat

SEQ ID NO: 477603 - DNA, 20 bp, Artificial Sequence
  chemically synthesized
ccccataaaaagcatcagca

SEQ ID NO: 477604 - DNA, 20 bp, Artificial Sequence
  chemically synthesized
agcaaaggatattaataatt

SEQ ID NO: 477605 - DNA, 20 bp, Artificial Sequence
  chemically synthesized
gatattaataatttagaata

SEQ ID NO: 477606 - DNA, 20 bp, Artificial Sequence
  chemically synthesized
aaacttattccgcaagtatt

SEQ ID NO: 477607 - DNA, 20 bp, Artificial Sequence
  chemically synthesized
agtggcactctaaatacttg

SEQ ID NO: 477608 - DNA, 20 bp, Artificial Sequence
  chemically synthesized
atagaatccttggtatcaag

SEQ ID NO: 477609 - DNA, 20 bp, Artificial Sequence
  chemically synthesized
cagtgacccatcttgatacc

SEQ ID NO: 477610 - DNA, 20 bp, Artificial Sequence
  chemically synthesized
tgatttaattgttgtttgta

SEQ ID NO: 477611 - DNA, 20 bp, Artificial Sequence
  chemically synthesized
tgtacattgtattgctcttt

SEQ ID NO: 477612 - DNA, 20 bp, Artificial Sequence
  chemically synthesized
gttttactttgccatgtttc

SEQ ID NO: 477613 - DNA, 20 bp, Artificial Sequence
  chemically synthesized
tgtcaactattagatcttga

SEQ ID NO: 477614 - DNA, 20 bp, Artificial Sequence
  chemically synthesized
ttagaaaaagagaaaaagaa

SEQ ID NO: 477615 - DNA, 20 bp, Artificial Sequence
  chemically synthesized
ttctttttctctttttctaa

SEQ ID NO: 477616 - DNA, 20 bp, Artificial Sequence
  chemically synthesized
tgatacgcagatccagtttc

SEQ ID NO: 477617 - DNA, 20 bp, Artificial Sequence
  chemically synthesized
acaatggaaaatccttgaaa

SEQ ID NO: 477618 - DNA, 20 bp, Artificial Sequence
  chemically synthesized
cacatacatgtgacaaaact

SEQ ID NO: 477619 - DNA, 20 bp, Artificial Sequence
  chemically synthesized
ctcaaacaacatcatcgctc

SEQ ID NO: 477620 - DNA, 20 bp, Artificial Sequence
  chemically synthesized
gatgatgttgtttgaggaag

SEQ ID NO: 477621 - DNA, 20 bp, Artificial Sequence
  chemically synthesized
gaaggagagtgttttgtgtc

SEQ ID NO: 477622 - DNA, 20 bp, Artificial Sequence
  chemically synthesized
ggttccacgcctttgctatt

SEQ ID NO: 477623 - DNA, 20 bp, Artificial Sequence
  chemically synthesized
agtatatcattgatgggcat

SEQ ID NO: 477624 - DNA, 20 bp, Artificial Sequence
  chemically synthesized
aaatgcccatcaatgatata

SEQ ID NO: 477625 - DNA, 20 bp, Artificial Sequence
  chemically synthesized
aatgtggcacatgtacacca

SEQ ID NO: 477626 - DNA, 20 bp, Artificial Sequence
  chemically synthesized
aatactgtgaagccataaaa

SEQ ID NO: 477627 - DNA, 20 bp, Artificial Sequence
  chemically synthesized
atcatgtcctttgcagggac

SEQ ID NO: 477628 - DNA, 20 bp, Artificial Sequence
  chemically synthesized
ggttcctctgttagtttgct

SEQ ID NO: 477629 - DNA, 20 bp, Artificial Sequence
  chemically synthesized
tcattgtttatctcccactt

SEQ ID NO: 477630 - DNA, 20 bp, Artificial Sequence
  chemically synthesized
tcacacactggggcctgtca

SEQ ID NO: 477631 - DNA, 20 bp, Artificial Sequence
  chemically synthesized
agggggtggggggctagggg

SEQ ID NO: 477632 - DNA, 20 bp, Artificial Sequence
  chemically synthesized
agaaatacctaatgtagatg

SEQ ID NO: 477633 - DNA, 20 bp, Artificial Sequence
  chemically synthesized
ctaatgtagatgacgggttg

SEQ ID NO: 477634 - DNA, 20 bp, Artificial Sequence
  chemically synthesized
cactttctgcacatgtatcc

SEQ ID NO: 477635 - DNA, 20 bp, Artificial Sequence
  chemically synthesized
tattattatactttacattc

SEQ ID NO: 477636 - DNA, 20 bp, Artificial Sequence
  chemically synthesized
ggtattcccttcttatttac

SEQ ID NO: 477637 - DNA, 20 bp, Artificial Sequence
  chemically synthesized
aaaactcctgtaaataagaa

SEQ ID NO: 477638 - DNA, 20 bp, Artificial Sequence
  chemically synthesized
aagagcagggaaagaaagaa

SEQ ID NO: 477639 - DNA, 20 bp, Artificial Sequence
  chemically synthesized
agaccaagagcagggaaaga

SEQ ID NO: 477640 - DNA, 20 bp, Artificial Sequence
  chemically synthesized
ctactgtatactaggcactt

SEQ ID NO: 477641 - DNA, 20 bp, Artificial Sequence
  chemically synthesized
actaggcactttggaatgtg

SEQ ID NO: 477642 - DNA, 20 bp, Artificial Sequence
  chemically synthesized
cttgaaggacatggtttagc

SEQ ID NO: 477643 - DNA, 20 bp, Artificial Sequence
  chemically synthesized
aatgtccgagccaagatgta

SEQ ID NO: 477644 - DNA, 20 bp, Artificial Sequence
  chemically synthesized
aaggattattagatgataac

SEQ ID NO: 477645 - DNA, 20 bp, Artificial Sequence
  chemically synthesized
tagatgataaccaggatatt

SEQ ID NO: 477646 - DNA, 20 bp, Artificial Sequence
  chemically synthesized
tgataaccaggatattatga

SEQ ID NO: 477647 - DNA, 20 bp, Artificial Sequence
  chemically synthesized
aaccaggatattatgagtgg

SEQ ID NO: 477648 - DNA, 20 bp, Artificial Sequence
  chemically synthesized
gagtgggtgggtataggtaa

SEQ ID NO: 477649 - DNA, 20 bp, Artificial Sequence
  chemically synthesized
ccccacataagagggacacg

SEQ ID NO: 477650 - DNA, 20 bp, Artificial Sequence
  chemically synthesized
agatgctcttcccttgctgt

SEQ ID NO: 477651 - DNA, 20 bp, Artificial Sequence
  chemically synthesized
agtgccttgtcacccttgtt

SEQ ID NO: 477652 - DNA, 20 bp, Artificial Sequence
  chemically synthesized
aaaagaccaaaatcctcaac

SEQ ID NO: 477653 - DNA, 20 bp, Artificial Sequence
  chemically synthesized
taagataaggactgatataa

SEQ ID NO: 477654 - DNA, 20 bp, Artificial Sequence
  chemically synthesized
tgcaatctctacatttcagt

SEQ ID NO: 477655 - DNA, 20 bp, Artificial Sequence
  chemically synthesized
gaaatgtagagattgcattg

SEQ ID NO: 477656 - DNA, 20 bp, Artificial Sequence
  chemically synthesized
agattgcattgtagggtggc

SEQ ID NO: 477657 - DNA, 20 bp, Artificial Sequence
  chemically synthesized
gtcttggcctcccaaagtgc

SEQ ID NO: 477658 - DNA, 20 bp, Artificial Sequence
  chemically synthesized
gtttgtatttttagtagaga

SEQ ID NO: 477659 - DNA, 20 bp, Artificial Sequence
  chemically synthesized
aattctcccgcctcagcctc

SEQ ID NO: 477660 - DNA, 20 bp, Artificial Sequence
  chemically synthesized
tactcgggaggctgaggcgg

SEQ ID NO: 477661 - DNA, 20 bp, Artificial Sequence
  chemically synthesized
gtcttgctctgtcaccaggc

SEQ ID NO: 477662 - DNA, 20 bp, Artificial Sequence
  chemically synthesized
ttttttttttttttttgaga

SEQ ID NO: 477663 - DNA, 20 bp, Artificial Sequence
  chemically synthesized
cttccactaccaagacatca

SEQ ID NO: 477664 - DNA, 20 bp, Artificial Sequence
  chemically synthesized
tgtctggtacagtacctttt

SEQ ID NO: 477665 - DNA, 20 bp, Artificial Sequence
  chemically synthesized
ggtatgagaaaatatttagt

SEQ ID NO: 477666 - DNA, 20 bp, Artificial Sequence
  chemically synthesized
aaaatatttagttagagtct

SEQ ID NO: 477667 - DNA, 20 bp, Artificial Sequence
  chemically synthesized
agagtctcggaatatttagc

SEQ ID NO: 477668 - DNA, 20 bp, Artificial Sequence
  chemically synthesized
ggaatatttagctagagttt

SEQ ID NO: 477669 - DNA, 20 bp, Artificial Sequence
  chemically synthesized
aacaaaaagataaagaagca

SEQ ID NO: 477670 - DNA, 20 bp, Artificial Sequence
  chemically synthesized
agttattaaaatttagatga

SEQ ID NO: 477671 - DNA, 20 bp, Artificial Sequence
  chemically synthesized
aggaactaatgtataaaaca

SEQ ID NO: 477672 - DNA, 20 bp, Artificial Sequence
  chemically synthesized
tagctacctgttaacctttc

SEQ ID NO: 477673 - DNA, 20 bp, Artificial Sequence
  chemically synthesized
agcacactaaccaagtgggg

SEQ ID NO: 477674 - DNA, 20 bp, Artificial Sequence
  chemically synthesized
gacggattaacttcattctg

SEQ ID NO: 477675 - DNA, 20 bp, Artificial Sequence
  chemically synthesized
gagttatgagtgatactcac

SEQ ID NO: 477676 - DNA, 20 bp, Artificial Sequence
  chemically synthesized
gagatggtgatgctagagtt

SEQ ID NO: 477677 - DNA, 20 bp, Artificial Sequence
  chemically synthesized
acttggggagatggtgatgc

SEQ ID NO: 477678 - DNA, 20 bp, Artificial Sequence
  chemically synthesized
tgttctttgtcatgagattc

SEQ ID NO: 477679 - DNA, 20 bp, Artificial Sequence
  chemically synthesized
acttaacgcagtccttactc

SEQ ID NO: 477680 - DNA, 20 bp, Artificial Sequence
  chemically synthesized
attagttttggttgcttgtt

SEQ ID NO: 477681 - DNA, 20 bp, Artificial Sequence
  chemically synthesized
agcaaccaaaactaataacc

SEQ ID NO: 477682 - DNA, 20 bp, Artificial Sequence
  chemically synthesized
ttgaagaacaaaatagcaat

SEQ ID NO: 477683 - DNA, 20 bp, Artificial Sequence
  chemically synthesized
tagtcatatttcttcataag

SEQ ID NO: 477684 - DNA, 20 bp, Artificial Sequence
  chemically synthesized
atcttatgaagaaatatgac

SEQ ID NO: 477685 - DNA, 20 bp, Artificial Sequence
  chemically synthesized
aatcactggacatgtgcact

SEQ ID NO: 477686 - DNA, 20 bp, Artificial Sequence
  chemically synthesized
agttccagaaaccaaagaaa

SEQ ID NO: 477687 - DNA, 20 bp, Artificial Sequence
  chemically synthesized
agacagaatttctacaaaag

SEQ ID NO: 477688 - DNA, 20 bp, Artificial Sequence
  chemically synthesized
tgcgatatagtgaaatgaga

SEQ ID NO: 477689 - DNA, 20 bp, Artificial Sequence
  chemically synthesized
aaaaaggcccatccttctca

SEQ ID NO: 477690 - DNA, 20 bp, Artificial Sequence
  chemically synthesized
atagaaaagcactcattgag

SEQ ID NO: 477691 - DNA, 20 bp, Artificial Sequence
  chemically synthesized
gtgcttttctatatgtacac

SEQ ID NO: 477692 - DNA, 20 bp, Artificial Sequence
  chemically synthesized
gtgttttaaatgttctgact

SEQ ID NO: 477693 - DNA, 20 bp, Artificial Sequence
  chemically synthesized
tattaaattagcttttgtgg

SEQ ID NO: 477694 - DNA, 20 bp, Artificial Sequence
  chemically synthesized
ccatttgccttcatatattt

SEQ ID NO: 477695 - DNA, 20 bp, Artificial Sequence
  chemically synthesized
ttttttttttgcaaagatcc

SEQ ID NO: 477696 - DNA, 20 bp, Artificial Sequence
  chemically synthesized
gagaacatgaaagaagaccc

SEQ ID NO: 477697 - DNA, 20 bp, Artificial Sequence
  chemically synthesized
atttcctatatcctcttctc

SEQ ID NO: 477698 - DNA, 20 bp, Artificial Sequence
  chemically synthesized
gtttatattattctggagaa

SEQ ID NO: 477699 - DNA, 20 bp, Artificial Sequence
  chemically synthesized
tggcatcttgaggaaaggtc

SEQ ID NO: 477700 - DNA, 20 bp, Artificial Sequence
  chemically synthesized
taaaagatacaagaacagaa

SEQ ID NO: 477701 - DNA, 20 bp, Artificial Sequence
  chemically synthesized
ctgataagtgttttggaaat

SEQ ID NO: 477702 - DNA, 20 bp, Artificial Sequence
  chemically synthesized
agtaaagtgtctggtgtaga

SEQ ID NO: 477703 - DNA, 20 bp, Artificial Sequence
  chemically synthesized
gtctagtaaagtgtctggtg

SEQ ID NO: 477704 - DNA, 20 bp, Artificial Sequence
  chemically synthesized
ccagacactttactagactc

SEQ ID NO: 477705 - DNA, 20 bp, Artificial Sequence
  chemically synthesized
cttgttcacctccaagaccc

SEQ ID NO: 477706 - DNA, 20 bp, Artificial Sequence
  chemically synthesized
tctatcttctctactaagct

SEQ ID NO: 477707 - DNA, 20 bp, Artificial Sequence
  chemically synthesized
gaaataattggtcatcgttg

SEQ ID NO: 477708 - DNA, 20 bp, Artificial Sequence
  chemically synthesized
tgttcggtatgaaaggtata

SEQ ID NO: 477709 - DNA, 20 bp, Artificial Sequence
  chemically synthesized
tttttcatagacctacccca

SEQ ID NO: 477710 - DNA, 20 bp, Artificial Sequence
  chemically synthesized
ttccttcttcatttattcac

SEQ ID NO: 477711 - DNA, 20 bp, Artificial Sequence
  chemically synthesized
ccccagtgaataaatgaaga

SEQ ID NO: 477712 - DNA, 20 bp, Artificial Sequence
  chemically synthesized
gctgttcacgatcagtggct

SEQ ID NO: 477713 - DNA, 20 bp, Artificial Sequence
  chemically synthesized
ataccacctcctgatgatgg

SEQ ID NO: 477714 - DNA, 20 bp, Artificial Sequence
  chemically synthesized
gttctatagtttgattgtat

SEQ ID NO: 477715 - DNA, 20 bp, Artificial Sequence
  chemically synthesized
ctactggcaacatctggcta

SEQ ID NO: 477716 - DNA, 20 bp, Artificial Sequence
  chemically synthesized
acatctggctactgagtact

SEQ ID NO: 477717 - DNA, 20 bp, Artificial Sequence
  chemically synthesized
gtacttggaatgtaatgagc

SEQ ID NO: 477718 - DNA, 20 bp, Artificial Sequence
  chemically synthesized
ttgcatgttgaaatgacaat

SEQ ID NO: 477719 - DNA, 20 bp, Artificial Sequence
  chemically synthesized
catataatgatgaaaagaaa

SEQ ID NO: 477720 - DNA, 20 bp, Artificial Sequence
  chemically synthesized
ttcacagtaagtttctaaaa

SEQ ID NO: 477721 - DNA, 20 bp, Artificial Sequence
  chemically synthesized
ttctattttagaaacttact

SEQ ID NO: 477722 - DNA, 20 bp, Artificial Sequence
  chemically synthesized
ccaactaaccaaagtaaggt

SEQ ID NO: 477723 - DNA, 20 bp, Artificial Sequence
  chemically synthesized
tgtatgagaaaaatggaaat

SEQ ID NO: 477724 - DNA, 20 bp, Artificial Sequence
  chemically synthesized
aatggaaatttgaatatgga

SEQ ID NO: 477725 - DNA, 20 bp, Artificial Sequence
  chemically synthesized
tagcaaggtgattaccttaa

SEQ ID NO: 477726 - DNA, 20 bp, Artificial Sequence
  chemically synthesized
aaggtgattaccttaaaaga

SEQ ID NO: 477727 - DNA, 20 bp, Artificial Sequence
  chemically synthesized
tatttcaaaaggttaaaaga

SEQ ID NO: 477728 - DNA, 20 bp, Artificial Sequence
  chemically synthesized
aaacaatctgggaagagcta

SEQ ID NO: 477729 - DNA, 20 bp, Artificial Sequence
  chemically synthesized
tgataattgttgatgtcttg

SEQ ID NO: 477730 - DNA, 20 bp, Artificial Sequence
  chemically synthesized
ttgttgatgtcttgatgagt

SEQ ID NO: 477731 - DNA, 20 bp, Artificial Sequence
  chemically synthesized
tgaacatatacaaaagtaga

SEQ ID NO: 477732 - DNA, 20 bp, Artificial Sequence
  chemically synthesized
aagagatggacgatttctta

SEQ ID NO: 477733 - DNA, 20 bp, Artificial Sequence
  chemically synthesized
agattatttataattgaccc

SEQ ID NO: 477734 - DNA, 20 bp, Artificial Sequence
  chemically synthesized
ataattgacccttgggtgag

SEQ ID NO: 477735 - DNA, 20 bp, Artificial Sequence
  chemically synthesized
cttttttactcttctcaccc

SEQ ID NO: 477736 - DNA, 20 bp, Artificial Sequence
  chemically synthesized
taattttgtttgaaattaag

SEQ ID NO: 477737 - DNA, 20 bp, Artificial Sequence
  chemically synthesized
aattaattttaaaatagtca

SEQ ID NO: 477738 - DNA, 20 bp, Artificial Sequence
  chemically synthesized
cagaagcagaacgatgtaca

SEQ ID NO: 477739 - DNA, 20 bp, Artificial Sequence
  chemically synthesized
gtggctacagctgaaagatg

SEQ ID NO: 477740 - DNA, 20 bp, Artificial Sequence
  chemically synthesized
agaacagcagcgtaccatgt

SEQ ID NO: 477741 - DNA, 20 bp, Artificial Sequence
  chemically synthesized
tactttttcaatggaattgt

SEQ ID NO: 477742 - DNA, 20 bp, Artificial Sequence
  chemically synthesized
ggtttattgtactttttcaa

SEQ ID NO: 477743 - DNA, 20 bp, Artificial Sequence
  chemically synthesized
ttgtgaactacaaagcagtc

SEQ ID NO: 477744 - DNA, 20 bp, Artificial Sequence
  chemically synthesized
cttttgagagccacaaaaca

SEQ ID NO: 477745 - DNA, 20 bp, Artificial Sequence
  chemically synthesized
catatgtttatttccacatg

SEQ ID NO: 477746 - DNA, 20 bp, Artificial Sequence
  chemically synthesized
ttttggcatgaaatacacac

SEQ ID NO: 477747 - DNA, 20 bp, Artificial Sequence
  chemically synthesized
ttttttctaccagaaatatt

SEQ ID NO: 477748 - DNA, 20 bp, Artificial Sequence
  chemically synthesized
aatatttctggtagaaaaaa

SEQ ID NO: 477749 - DNA, 20 bp, Artificial Sequence
  chemically synthesized
aaaagaattccagtactagc

SEQ ID NO: 477750 - DNA, 20 bp, Artificial Sequence
  chemically synthesized
catgtgactcatgctagtac

SEQ ID NO: 477751 - DNA, 20 bp, Artificial Sequence
  chemically synthesized
tttccatttctcaaggcaaa

SEQ ID NO: 477752 - DNA, 20 bp, Artificial Sequence
  chemically synthesized
actcaatggaaaaggctgcc

SEQ ID NO: 477753 - DNA, 20 bp, Artificial Sequence
  chemically synthesized
accctaggcagccttttcca

SEQ ID NO: 477754 - DNA, 20 bp, Artificial Sequence
  chemically synthesized
ccaggtgcacacaaataaag

SEQ ID NO: 477755 - DNA, 20 bp, Artificial Sequence
  chemically synthesized
cttctttatttgtgtgcacc

SEQ ID NO: 477756 - DNA, 20 bp, Artificial Sequence
  chemically synthesized
taagacaacaactcacatgg

SEQ ID NO: 477757 - DNA, 20 bp, Artificial Sequence
  chemically synthesized
gtctgattttactcttccat

SEQ ID NO: 477758 - DNA, 20 bp, Artificial Sequence
  chemically synthesized
tctgaaagcttcccccgaac

SEQ ID NO: 477759 - DNA, 20 bp, Artificial Sequence
  chemically synthesized
tgaataatttaggcaggaga

SEQ ID NO: 477760 - DNA, 20 bp, Artificial Sequence
  chemically synthesized
tgtattcttaaatggcttct

SEQ ID NO: 477761 - DNA, 20 bp, Artificial Sequence
  chemically synthesized
ttaatccttagaagccattt

SEQ ID NO: 477762 - DNA, 20 bp, Artificial Sequence
  chemically synthesized
agccatttaagaatacacaa

SEQ ID NO: 477763 - DNA, 20 bp, Artificial Sequence
  chemically synthesized
ttctcatcttcaagtgaaat

SEQ ID NO: 477764 - DNA, 20 bp, Artificial Sequence
  chemically synthesized
ctgcgtttcctctttgtttt

SEQ ID NO: 477765 - DNA, 20 bp, Artificial Sequence
  chemically synthesized
ttagtaattgctgataatag

SEQ ID NO: 477766 - DNA, 20 bp, Artificial Sequence
  chemically synthesized
atgttataggtagcgttatt

SEQ ID NO: 477767 - DNA, 20 bp, Artificial Sequence
  chemically synthesized
tgtttgactaaggccaaaag

SEQ ID NO: 477768 - DNA, 20 bp, Artificial Sequence
  chemically synthesized
tccttttggccttagtcaaa

SEQ ID NO: 477769 - DNA, 20 bp, Artificial Sequence
  chemically synthesized
ttagtcaaacagaatcacca

SEQ ID NO: 477770 - DNA, 20 bp, Artificial Sequence
  chemically synthesized
aaattgttccaaactttctg

SEQ ID NO: 477771 - DNA, 20 bp, Artificial Sequence
  chemically synthesized
atttccttgaatttaagcct

SEQ ID NO: 477772 - DNA, 20 bp, Artificial Sequence
  chemically synthesized
tctttgttagtataatttcc

SEQ ID NO: 477773 - DNA, 20 bp, Artificial Sequence
  chemically synthesized
aacttaaatattcaatatga

SEQ ID NO: 477774 - DNA, 20 bp, Artificial Sequence
  chemically synthesized
tctcaagcaattccctcata

SEQ ID NO: 477775 - DNA, 20 bp, Artificial Sequence
  chemically synthesized
tttgaaaacaatcagtaggt

SEQ ID NO: 477776 - DNA, 20 bp, Artificial Sequence
  chemically synthesized
gaaattaatgaaatttatat

SEQ ID NO: 477777 - DNA, 20 bp, Artificial Sequence
  chemically synthesized
aaatagctcttaatttaaaa

SEQ ID NO: 477778 - DNA, 20 bp, Artificial Sequence
  chemically synthesized
cttgcaaaggattttactgt

SEQ ID NO: 477779 - DNA, 20 bp, Artificial Sequence
  chemically synthesized
tcatcatattgaaccttgca

SEQ ID NO: 477780 - DNA, 20 bp, Artificial Sequence
  chemically synthesized
gatgacatagccaaatattt

SEQ ID NO: 477781 - DNA, 20 bp, Artificial Sequence
  chemically synthesized
ctgttttctcatttagtaac

SEQ ID NO: 477782 - DNA, 20 bp, Artificial Sequence
  chemically synthesized
ttacaaaacaaatacatttt

SEQ ID NO: 477783 - DNA, 20 bp, Artificial Sequence
  chemically synthesized
cacctgtaaatctacctctg

SEQ ID NO: 477784 - DNA, 20 bp, Artificial Sequence
  chemically synthesized
attaaattgttccagactct

SEQ ID NO: 477785 - DNA, 20 bp, Artificial Sequence
  chemically synthesized
ttcttgggaaataataccct

SEQ ID NO: 477786 - DNA, 20 bp, Artificial Sequence
  chemically synthesized
agggtattatttcccaagaa

SEQ ID NO: 477787 - DNA, 20 bp, Artificial Sequence
  chemically synthesized
cgtgaaataccataaatgtc

SEQ ID NO: 477788 - DNA, 20 bp, Artificial Sequence
  chemically synthesized
aataccataaatgtcatgaa

SEQ ID NO: 477789 - DNA, 20 bp, Artificial Sequence
  chemically synthesized
catggaaaagtggtaactga

SEQ ID NO: 477790 - DNA, 20 bp, Artificial Sequence
  chemically synthesized
aacagctaaaatcttgcatg

SEQ ID NO: 477791 - DNA, 20 bp, Artificial Sequence
  chemically synthesized
atgtaatgtgtaatggttaa

SEQ ID NO: 477792 - DNA, 20 bp, Artificial Sequence
  chemically synthesized
taatggttaaacgaattcct

SEQ ID NO: 477793 - DNA, 20 bp, Artificial Sequence
  chemically synthesized
tgtgaattccagacacccca

SEQ ID NO: 477794 - DNA, 20 bp, Artificial Sequence
  chemically synthesized
aacgaattccttggggtgtc

SEQ ID NO: 477795 - DNA, 20 bp, Artificial Sequence
  chemically synthesized
actctcaaagggaccaagct

SEQ ID NO: 477796 - DNA, 20 bp, Artificial Sequence
  chemically synthesized
attcacagcttggtcccttt

SEQ ID NO: 477797 - DNA, 20 bp, Artificial Sequence
  chemically synthesized
attgactgcccctaagtctc

SEQ ID NO: 477798 - DNA, 20 bp, Artificial Sequence
  chemically synthesized
taagtctctaggatacattg

SEQ ID NO: 477799 - DNA, 20 bp, Artificial Sequence
  chemically synthesized
agggagagaggaagggaaga

SEQ ID NO: 477800 - DNA, 20 bp, Artificial Sequence
  chemically synthesized
cctctagacctctctgccac

SEQ ID NO: 477801 - DNA, 20 bp, Artificial Sequence
  chemically synthesized
tgtggcagagaggtctagag

SEQ ID NO: 477802 - DNA, 20 bp, Artificial Sequence
  chemically synthesized
agcaccatttaacctagaac

SEQ ID NO: 477803 - DNA, 20 bp, Artificial Sequence
  chemically synthesized
atggtgctgactcattatta

SEQ ID NO: 477804 - DNA, 20 bp, Artificial Sequence
  chemically synthesized
ggttcattgacccactaata

SEQ ID NO: 477805 - DNA, 20 bp, Artificial Sequence
  chemically synthesized
ctctctcttaggggacctaa

SEQ ID NO: 477806 - DNA, 20 bp, Artificial Sequence
  chemically synthesized
agcaaaataactgagaccta

SEQ ID NO: 477807 - DNA, 20 bp, Artificial Sequence
  chemically synthesized
aaaaaaaaaaaaaaaaagaa

SEQ ID NO: 477808 - DNA, 20 bp, Artificial Sequence
  chemically synthesized
tttttttttttttggtgaga

SEQ ID NO: 477809 - DNA, 20 bp, Artificial Sequence
  chemically synthesized
tcttgatctatcacccaggc

SEQ ID NO: 477810 - DNA, 20 bp, Artificial Sequence
  chemically synthesized
tcgtgccattgcactccagc

SEQ ID NO: 477811 - DNA, 20 bp, Artificial Sequence
  chemically synthesized
gctcactgcacctccacctc

SEQ ID NO: 477812 - DNA, 20 bp, Artificial Sequence
  chemically synthesized
cacttgggaggctgatgcag

SEQ ID NO: 477813 - DNA, 20 bp, Artificial Sequence
  chemically synthesized
gcatcagcctcccaagtggc

SEQ ID NO: 477814 - DNA, 20 bp, Artificial Sequence
  chemically synthesized
ctaaaaataccaaaaattag

SEQ ID NO: 477815 - DNA, 20 bp, Artificial Sequence
  chemically synthesized
tttggtatttttagtagaga

SEQ ID NO: 477816 - DNA, 20 bp, Artificial Sequence
  chemically synthesized
caggtggatcacctgaggtc

SEQ ID NO: 477817 - DNA, 20 bp, Artificial Sequence
  chemically synthesized
actttgggaggctgaggcag

SEQ ID NO: 477818 - DNA, 20 bp, Artificial Sequence
  chemically synthesized
cctcagcctcccaaagtgtt

SEQ ID NO: 477819 - DNA, 20 bp, Artificial Sequence
  chemically synthesized
gtaagctaccacacccagcc

SEQ ID NO: 477820 - DNA, 20 bp, Artificial Sequence
  chemically synthesized
ctttagaactgaattcccgg

SEQ ID NO: 477821 - DNA, 20 bp, Artificial Sequence
  chemically synthesized
cagccgggaattcagttcta

SEQ ID NO: 477822 - DNA, 20 bp, Artificial Sequence
  chemically synthesized
ttctcttagatcctttagaa

SEQ ID NO: 477823 - DNA, 20 bp, Artificial Sequence
  chemically synthesized
gacgaaaagctctcacatat

SEQ ID NO: 477824 - DNA, 20 bp, Artificial Sequence
  chemically synthesized
tttaatttttttctaagctg

SEQ ID NO: 477825 - DNA, 20 bp, Artificial Sequence
  chemically synthesized
tgtggagttagataaaattt

SEQ ID NO: 477826 - DNA, 20 bp, Artificial Sequence
  chemically synthesized
gaagcaatttgatatgtagt

SEQ ID NO: 477827 - DNA, 20 bp, Artificial Sequence
  chemically synthesized
tttttcctctcctaaagctc

SEQ ID NO: 477828 - DNA, 20 bp, Artificial Sequence
  chemically synthesized
cttacaaaggacagagaaca

SEQ ID NO: 477829 - DNA, 20 bp, Artificial Sequence
  chemically synthesized
gaagaggtgaaaggcagcca

SEQ ID NO: 477830 - DNA, 20 bp, Artificial Sequence
  chemically synthesized
aggtgaaaggcagccagaga

SEQ ID NO: 477831 - DNA, 20 bp, Artificial Sequence
  chemically synthesized
ttgagacccagagctttagg

SEQ ID NO: 477832 - DNA, 20 bp, Artificial Sequence
  chemically synthesized
aatgtattcaacctaaagct

SEQ ID NO: 477833 - DNA, 20 bp, Artificial Sequence
  chemically synthesized
atagtgtgtataagaaacat

SEQ ID NO: 477834 - DNA, 20 bp, Artificial Sequence
  chemically synthesized
ttgaaagcagagattgttga

SEQ ID NO: 477835 - DNA, 20 bp, Artificial Sequence
  chemically synthesized
atggttctggagcttacctg

SEQ ID NO: 477836 - DNA, 20 bp, Artificial Sequence
  chemically synthesized
ctttaataaatgctttatca

SEQ ID NO: 477837 - DNA, 20 bp, Artificial Sequence
  chemically synthesized
gttgccctatttttattttc

SEQ ID NO: 477838 - DNA, 20 bp, Artificial Sequence
  chemically synthesized
gattaacctatgtttgcatg

SEQ ID NO: 477839 - DNA, 20 bp, Artificial Sequence
  chemically synthesized
ttatatcatacataggctgt

SEQ ID NO: 477840 - DNA, 20 bp, Artificial Sequence
  chemically synthesized
ggttaaaaccactaaggttt

SEQ ID NO: 477841 - DNA, 20 bp, Artificial Sequence
  chemically synthesized
gggttgcagtttgctatgta

SEQ ID NO: 477842 - DNA, 20 bp, Artificial Sequence
  chemically synthesized
catattgcttacatgccaag

SEQ ID NO: 477843 - DNA, 20 bp, Artificial Sequence
  chemically synthesized
atgtaagcaatatgcaactt

SEQ ID NO: 477844 - DNA, 20 bp, Artificial Sequence
  chemically synthesized
gaggctcagctatttgttac

SEQ ID NO: 477845 - DNA, 20 bp, Artificial Sequence
  chemically synthesized
attagctgaaacttgactgc

SEQ ID NO: 477846 - DNA, 20 bp, Artificial Sequence
  chemically synthesized
cagcttgactggttacagct

SEQ ID NO: 477847 - DNA, 20 bp, Artificial Sequence
  chemically synthesized
aatactgcctgcccaccttg

SEQ ID NO: 477848 - DNA, 20 bp, Artificial Sequence
  chemically synthesized
agctttctgaacttctaatt

SEQ ID NO: 477849 - DNA, 20 bp, Artificial Sequence
  chemically synthesized
ttcatgaatcagacagtact

SEQ ID NO: 477850 - DNA, 20 bp, Artificial Sequence
  chemically synthesized
ttctgagtactgtctgattc

SEQ ID NO: 477851 - DNA, 20 bp, Artificial Sequence
  chemically synthesized
atttgagcaaaaaacaattc

SEQ ID NO: 477852 - DNA, 20 bp, Artificial Sequence
  chemically synthesized
ctcaaataaactctgcaaaa

SEQ ID NO: 477853 - DNA, 20 bp, Artificial Sequence
  chemically synthesized
tttagacaaattccgttttg

SEQ ID NO: 477854 - DNA, 20 bp, Artificial Sequence
  chemically synthesized
gttgagtgggtaggagtaag

SEQ ID NO: 477855 - DNA, 20 bp, Artificial Sequence
  chemically synthesized
ttattttccgttgagtgggt

SEQ ID NO: 477856 - DNA, 20 bp, Artificial Sequence
  chemically synthesized
cctcttttattttccgttga

SEQ ID NO: 477857 - DNA, 20 bp, Artificial Sequence
  chemically synthesized
accacctcttttattttccg

SEQ ID NO: 477858 - DNA, 20 bp, Artificial Sequence
  chemically synthesized
attagtgaagacaagagctt

SEQ ID NO: 477859 - DNA, 20 bp, Artificial Sequence
  chemically synthesized
cgcagagcctttagatgtgc

SEQ ID NO: 477860 - DNA, 20 bp, Artificial Sequence
  chemically synthesized
ttcttagtgtcctgacactg

SEQ ID NO: 477861 - DNA, 20 bp, Artificial Sequence
  chemically synthesized
ctcctcagtgtcaggacact

SEQ ID NO: 477862 - DNA, 20 bp, Artificial Sequence
  chemically synthesized
tttcagagtaaagttttatt

SEQ ID NO: 477863 - DNA, 20 bp, Artificial Sequence
  chemically synthesized
ctttaagaatgcatgccttt

SEQ ID NO: 477864 - DNA, 20 bp, Artificial Sequence
  chemically synthesized
aatataacacatttcacttt

SEQ ID NO: 477865 - DNA, 20 bp, Artificial Sequence
  chemically synthesized
ttaaagtgaaatgtgttata

SEQ ID NO: 477866 - DNA, 20 bp, Artificial Sequence
  chemically synthesized
aaaggaagtcaaagtgaaaa

SEQ ID NO: 477867 - DNA, 20 bp, Artificial Sequence
  chemically synthesized
tgagggtactaaagatttat

SEQ ID NO: 477868 - DNA, 20 bp, Artificial Sequence
  chemically synthesized
taagtgctattttattacat

SEQ ID NO: 477869 - DNA, 20 bp, Artificial Sequence
  chemically synthesized
aacatgcagaaagaaaaggg

SEQ ID NO: 477870 - DNA, 20 bp, Artificial Sequence
  chemically synthesized
tgggttctctagtcttttcc

SEQ ID NO: 477871 - DNA, 20 bp, Artificial Sequence
  chemically synthesized
aaagactagagaacccaaaa

SEQ ID NO: 477872 - DNA, 20 bp, Artificial Sequence
  chemically synthesized
gtaggtgtgtggattcgttt

SEQ ID NO: 477873 - DNA, 20 bp, Artificial Sequence
  chemically synthesized
aatgagttaactgtaggtgt

SEQ ID NO: 477874 - DNA, 20 bp, Artificial Sequence
  chemically synthesized
tcttggcacctttgtcaaaa

SEQ ID NO: 477875 - DNA, 20 bp, Artificial Sequence
  chemically synthesized
caacaaatggtgcggaaaaa

SEQ ID NO: 477876 - DNA, 20 bp, Artificial Sequence
  chemically synthesized
aaaaactggatatccatatg

SEQ ID NO: 477877 - DNA, 20 bp, Artificial Sequence
  chemically synthesized
actggatatccatatgcaga

SEQ ID NO: 477878 - DNA, 20 bp, Artificial Sequence
  chemically synthesized
ggtctagattcattctgcat

SEQ ID NO: 477879 - DNA, 20 bp, Artificial Sequence
  chemically synthesized
ttttgtatatggtgagagat

SEQ ID NO: 477880 - DNA, 20 bp, Artificial Sequence
  chemically synthesized
agaacactgagaaaaatctc

SEQ ID NO: 477881 - DNA, 20 bp, Artificial Sequence
  chemically synthesized
ctccagggtgtcatcaacag

SEQ ID NO: 477882 - DNA, 20 bp, Artificial Sequence
  chemically synthesized
gtcatcaacagatgaataat

SEQ ID NO: 477883 - DNA, 20 bp, Artificial Sequence
  chemically synthesized
caaaaaaaattaaagaacca

SEQ ID NO: 477884 - DNA, 20 bp, Artificial Sequence
  chemically synthesized
gagctatctctttaaataga

SEQ ID NO: 477885 - DNA, 20 bp, Artificial Sequence
  chemically synthesized
aaaaaatgttgacttctctt

SEQ ID NO: 477886 - DNA, 20 bp, Artificial Sequence
  chemically synthesized
tgttaattatgtttggatgt

SEQ ID NO: 477887 - DNA, 20 bp, Artificial Sequence
  chemically synthesized
ttttagaatgttaattatgt

SEQ ID NO: 477888 - DNA, 20 bp, Artificial Sequence
  chemically synthesized
gaccttctttctctctcttt

SEQ ID NO: 477889 - DNA, 20 bp, Artificial Sequence
  chemically synthesized
agaaaactgcaacttggaca

SEQ ID NO: 477890 - DNA, 20 bp, Artificial Sequence
  chemically synthesized
aaaagaagggcaaaaagagg

SEQ ID NO: 477891 - DNA, 20 bp, Artificial Sequence
  chemically synthesized
gagtgcttgctattagaggt

SEQ ID NO: 477892 - DNA, 20 bp, Artificial Sequence
  chemically synthesized
tagaagccataaatctattg

SEQ ID NO: 477893 - DNA, 20 bp, Artificial Sequence
  chemically synthesized
tgttatcaacataatttcag

SEQ ID NO: 477894 - DNA, 20 bp, Artificial Sequence
  chemically synthesized
aatccttgcatttttaattt

SEQ ID NO: 477895 - DNA, 20 bp, Artificial Sequence
  chemically synthesized
tattctaaaattaaaaatgc

SEQ ID NO: 477896 - DNA, 20 bp, Artificial Sequence
  chemically synthesized
aaattaaaaatgcaaggatt

SEQ ID NO: 477897 - DNA, 20 bp, Artificial Sequence
  chemically synthesized
aaatgcaaggattgtggata

SEQ ID NO: 477898 - DNA, 20 bp, Artificial Sequence
  chemically synthesized
ggattgtggatatggaattt

SEQ ID NO: 477899 - DNA, 20 bp, Artificial Sequence
  chemically synthesized
gactaattaccatcttaata

SEQ ID NO: 477900 - DNA, 20 bp, Artificial Sequence
  chemically synthesized
atgtgatgtaataatgcatg

SEQ ID NO: 477901 - DNA, 20 bp, Artificial Sequence
  chemically synthesized
aatgatagcatatacttttc

SEQ ID NO: 477902 - DNA, 20 bp, Artificial Sequence
  chemically synthesized
tcttgaattaaattatgaga

SEQ ID NO: 477903 - DNA, 20 bp, Artificial Sequence
  chemically synthesized
aagtgtgattgcagaactaa

SEQ ID NO: 477904 - DNA, 20 bp, Artificial Sequence
  chemically synthesized
ttttctccttcactgaaatg

SEQ ID NO: 477905 - DNA, 20 bp, Artificial Sequence
  chemically synthesized
tatgctaagacagttagtga

SEQ ID NO: 477906 - DNA, 20 bp, Artificial Sequence
  chemically synthesized
agaatagaacagaagggaaa

SEQ ID NO: 477907 - DNA, 20 bp, Artificial Sequence
  chemically synthesized
ctcgaaatatgtgagtatgg

SEQ ID NO: 477908 - DNA, 20 bp, Artificial Sequence
  chemically synthesized
ctctaccatactcacatatt

SEQ ID NO: 477909 - DNA, 20 bp, Artificial Sequence
  chemically synthesized
aaatttcaaactcgaaatat

SEQ ID NO: 477910 - DNA, 20 bp, Artificial Sequence
  chemically synthesized
actgcctccagctaacttat

SEQ ID NO: 477911 - DNA, 20 bp, Artificial Sequence
  chemically synthesized
acatgtttcttcaagtgttc

SEQ ID NO: 477912 - DNA, 20 bp, Artificial Sequence
  chemically synthesized
acatgttatcaagtgtaaat

SEQ ID NO: 477913 - DNA, 20 bp, Artificial Sequence
  chemically synthesized
agaaaagaaaagatttgtta

SEQ ID NO: 477914 - DNA, 20 bp, Artificial Sequence
  chemically synthesized
gaaaagatttgttatggaat

SEQ ID NO: 477915 - DNA, 20 bp, Artificial Sequence
  chemically synthesized
ggaatatgaatcaaaatttg

SEQ ID NO: 477916 - DNA, 20 bp, Artificial Sequence
  chemically synthesized
atttggagaataagaggaaa

SEQ ID NO: 477917 - DNA, 20 bp, Artificial Sequence
  chemically synthesized
ttgcaagtgtgagaaccagc

SEQ ID NO: 477918 - DNA, 20 bp, Artificial Sequence
  chemically synthesized
aagggtacatactcatatgg

SEQ ID NO: 477919 - DNA, 20 bp, Artificial Sequence
  chemically synthesized
caatttcctcactctcccat

SEQ ID NO: 477920 - DNA, 20 bp, Artificial Sequence
  chemically synthesized
ggagagtgaggaaattgttg

SEQ ID NO: 477921 - DNA, 20 bp, Artificial Sequence
  chemically synthesized
tgaggaaattgttggagagt

SEQ ID NO: 477922 - DNA, 20 bp, Artificial Sequence
  chemically synthesized
aaattgttggagagtaggaa

SEQ ID NO: 477923 - DNA, 20 bp, Artificial Sequence
  chemically synthesized
gtaggaatggggttagaaaa

SEQ ID NO: 477924 - DNA, 20 bp, Artificial Sequence
  chemically synthesized
acatagattctctgagccaa

SEQ ID NO: 477925 - DNA, 20 bp, Artificial Sequence
  chemically synthesized
ttattgattctcttggctca

SEQ ID NO: 477926 - DNA, 20 bp, Artificial Sequence
  chemically synthesized
ggctcagagaatctatgttg

SEQ ID NO: 477927 - DNA, 20 bp, Artificial Sequence
  chemically synthesized
gaatctatgttggggagtaa

SEQ ID NO: 477928 - DNA, 20 bp, Artificial Sequence
  chemically synthesized
gaaaaagaaaagagaaggga

SEQ ID NO: 477929 - DNA, 20 bp, Artificial Sequence
  chemically synthesized
atgaagttatatttaatcat

SEQ ID NO: 477930 - DNA, 20 bp, Artificial Sequence
  chemically synthesized
tgggcacggaggatgcaacc

SEQ ID NO: 477931 - DNA, 20 bp, Artificial Sequence
  chemically synthesized
taggcactcttctgggcacg

SEQ ID NO: 477932 - DNA, 20 bp, Artificial Sequence
  chemically synthesized
gttgcatcctccgtgcccag

SEQ ID NO: 477933 - DNA, 20 bp, Artificial Sequence
  chemically synthesized
gttcattcaacaaatattta

SEQ ID NO: 477934 - DNA, 20 bp, Artificial Sequence
  chemically synthesized
aggcattcattaaatatttg

SEQ ID NO: 477935 - DNA, 20 bp, Artificial Sequence
  chemically synthesized
tttgttgaatgaacaaataa

SEQ ID NO: 477936 - DNA, 20 bp, Artificial Sequence
  chemically synthesized
aagattgaagctttgaacaa

SEQ ID NO: 477937 - DNA, 20 bp, Artificial Sequence
  chemically synthesized
gatataaacagcgtccaagg

SEQ ID NO: 477938 - DNA, 20 bp, Artificial Sequence
  chemically synthesized
tgccatattgatacatttgc

SEQ ID NO: 477939 - DNA, 20 bp, Artificial Sequence
  chemically synthesized
cataacatgatgacttaaat

SEQ ID NO: 477940 - DNA, 20 bp, Artificial Sequence
  chemically synthesized
ggacttgtatttggaagcac

SEQ ID NO: 477941 - DNA, 20 bp, Artificial Sequence
  chemically synthesized
ggatatctcttatgagccaa

SEQ ID NO: 477942 - DNA, 20 bp, Artificial Sequence
  chemically synthesized
aagggaaacttcgaaatcat

SEQ ID NO: 477943 - DNA, 20 bp, Artificial Sequence
  chemically synthesized
ccatttttaaagaaacaaaa

SEQ ID NO: 477944 - DNA, 20 bp, Artificial Sequence
  chemically synthesized
ttgaaatataagagcagttt

SEQ ID NO: 477945 - DNA, 20 bp, Artificial Sequence
  chemically synthesized
aatcttgtcacttcttccat

SEQ ID NO: 477946 - DNA, 20 bp, Artificial Sequence
  chemically synthesized
ggcactgataaacctgcatt

SEQ ID NO: 477947 - DNA, 20 bp, Artificial Sequence
  chemically synthesized
atagaatagaataacactgg

SEQ ID NO: 477948 - DNA, 20 bp, Artificial Sequence
  chemically synthesized
gggatgattatgaaatagaa

SEQ ID NO: 477949 - DNA, 20 bp, Artificial Sequence
  chemically synthesized
aattagggatgattatgaaa

SEQ ID NO: 477950 - DNA, 20 bp, Artificial Sequence
  chemically synthesized
gtacagtataggcagtaatt

SEQ ID NO: 477951 - DNA, 20 bp, Artificial Sequence
  chemically synthesized
gatcaatctacagcaaatgg

SEQ ID NO: 477952 - DNA, 20 bp, Artificial Sequence
  chemically synthesized
tcctgacacttgattgaaat

SEQ ID NO: 477953 - DNA, 20 bp, Artificial Sequence
  chemically synthesized
agctaaattgctttgatgtg

SEQ ID NO: 477954 - DNA, 20 bp, Artificial Sequence
  chemically synthesized
gaattacttctttgcttttt

SEQ ID NO: 477955 - DNA, 20 bp, Artificial Sequence
  chemically synthesized
tataggcctatgtaataata

SEQ ID NO: 477956 - DNA, 20 bp, Artificial Sequence
  chemically synthesized
taaaagccaaaaccattgat

SEQ ID NO: 477957 - DNA, 20 bp, Artificial Sequence
  chemically synthesized
tgatctgaatatttaaattc

SEQ ID NO: 477958 - DNA, 20 bp, Artificial Sequence
  chemically synthesized
atctaaggtgctgccaattc

SEQ ID NO: 477959 - DNA, 20 bp, Artificial Sequence
  chemically synthesized
tctacctgattaatgacagc

SEQ ID NO: 477960 - DNA, 20 bp, Artificial Sequence
  chemically synthesized
agctgacatgggaaactgct

SEQ ID NO: 477961 - DNA, 20 bp, Artificial Sequence
  chemically synthesized
atgggaaactgctgagaatg

SEQ ID NO: 477962 - DNA, 20 bp, Artificial Sequence
  chemically synthesized
tgaacttgataaaataaaag

SEQ ID NO: 477963 - DNA, 20 bp, Artificial Sequence
  chemically synthesized
agaaagatgctataattgtt

SEQ ID NO: 477964 - DNA, 20 bp, Artificial Sequence
  chemically synthesized
tctttttcttttgtgcagaa

SEQ ID NO: 477965 - DNA, 20 bp, Artificial Sequence
  chemically synthesized
gataaccttcgtcattaaaa

SEQ ID NO: 477966 - DNA, 20 bp, Artificial Sequence
  chemically synthesized
cacacatactgacctctctt

SEQ ID NO: 477967 - DNA, 20 bp, Artificial Sequence
  chemically synthesized
cttatctccctattttgtat

SEQ ID NO: 477968 - DNA, 20 bp, Artificial Sequence
  chemically synthesized
aggaacaatgtctgggaagc

SEQ ID NO: 477969 - DNA, 20 bp, Artificial Sequence
  chemically synthesized
tttatgagaagtagattgct

SEQ ID NO: 477970 - DNA, 20 bp, Artificial Sequence
  chemically synthesized
gattttttctaggagtagaa

SEQ ID NO: 477971 - DNA, 20 bp, Artificial Sequence
  chemically synthesized
atagagagtagattttttct

SEQ ID NO: 477972 - DNA, 20 bp, Artificial Sequence
  chemically synthesized
ctaattgaaaggatgaaata

SEQ ID NO: 477973 - DNA, 20 bp, Artificial Sequence
  chemically synthesized
aagaaatgcatactaattga

SEQ ID NO: 477974 - DNA, 20 bp, Artificial Sequence
  chemically synthesized
gaaatcagggagtctgactt

SEQ ID NO: 477975 - DNA, 20 bp, Artificial Sequence
  chemically synthesized
agtaaaagaaaaagaaatca

SEQ ID NO: 477976 - DNA, 20 bp, Artificial Sequence
  chemically synthesized
ttttcttttttcttttgaga

SEQ ID NO: 477977 - DNA, 20 bp, Artificial Sequence
  chemically synthesized
cttcactccagcctagggga

SEQ ID NO: 477978 - DNA, 20 bp, Artificial Sequence
  chemically synthesized
tctcactctgtcccctaggc

SEQ ID NO: 477979 - DNA, 20 bp, Artificial Sequence
  chemically synthesized
ctcactgcaacctccacctc

SEQ ID NO: 477980 - DNA, 20 bp, Artificial Sequence
  chemically synthesized
tactcaggaggctgaggcag

SEQ ID NO: 477981 - DNA, 20 bp, Artificial Sequence
  chemically synthesized
gattctcctgcctcagcctc

SEQ ID NO: 477982 - DNA, 20 bp, Artificial Sequence
  chemically synthesized
ttttgtatttttggtagaga

SEQ ID NO: 477983 - DNA, 20 bp, Artificial Sequence
  chemically synthesized
cgggatttcaccatgttggc

SEQ ID NO: 477984 - DNA, 20 bp, Artificial Sequence
  chemically synthesized
actttgggaggccgaggcag

SEQ ID NO: 477985 - DNA, 20 bp, Artificial Sequence
  chemically synthesized
gcctcggcctcccaaagtgc

SEQ ID NO: 477986 - DNA, 20 bp, Artificial Sequence
  chemically synthesized
acaagatgaaaacagggagt

SEQ ID NO: 477987 - DNA, 20 bp, Artificial Sequence
  chemically synthesized
gaagatacaagatgaaaaca

SEQ ID NO: 477988 - DNA, 20 bp, Artificial Sequence
  chemically synthesized
gagaggctaaataatttcct

SEQ ID NO: 477989 - DNA, 20 bp, Artificial Sequence
  chemically synthesized
tcactttcttcaaatgtaaa

SEQ ID NO: 477990 - DNA, 20 bp, Artificial Sequence
  chemically synthesized
ctaagaggtagattttatta

SEQ ID NO: 477991 - DNA, 20 bp, Artificial Sequence
  chemically synthesized
caataataaaatctacctct

SEQ ID NO: 477992 - DNA, 20 bp, Artificial Sequence
  chemically synthesized
tgagagcattaaaccggtca

SEQ ID NO: 477993 - DNA, 20 bp, Artificial Sequence
  chemically synthesized
agacatttacaatagtgctt

SEQ ID NO: 477994 - DNA, 20 bp, Artificial Sequence
  chemically synthesized
gggagtatacactaaatgac

SEQ ID NO: 477995 - DNA, 20 bp, Artificial Sequence
  chemically synthesized
atggacttaataatagttat

SEQ ID NO: 477996 - DNA, 20 bp, Artificial Sequence
  chemically synthesized
aatatttttaataaagagaa

SEQ ID NO: 477997 - DNA, 20 bp, Artificial Sequence
  chemically synthesized
taaatgatctagcaagggcg

SEQ ID NO: 477998 - DNA, 20 bp, Artificial Sequence
  chemically synthesized
atagttccgtggaggaacaa

SEQ ID NO: 477999 - DNA, 20 bp, Artificial Sequence
  chemically synthesized
ttctttggagaagttagtta

SEQ ID NO: 478000 - DNA, 20 bp, Artificial Sequence
  chemically synthesized
gggggcaaaatataaagtat

SEQ ID NO: 478001 - DNA, 20 bp, Artificial Sequence
  chemically synthesized
aactaaaagcttagtttaca

SEQ ID NO: 478002 - DNA, 20 bp, Artificial Sequence
  chemically synthesized
tataattgtaatgtgttata

SEQ ID NO: 478003 - DNA, 20 bp, Artificial Sequence
  chemically synthesized
aaattaacggatatgtatta

SEQ ID NO: 478004 - DNA, 20 bp, Artificial Sequence
  chemically synthesized
caaaaagtgataaaaaatta

SEQ ID NO: 478005 - DNA, 20 bp, Artificial Sequence
  chemically synthesized
atttctctcttggcatatca

SEQ ID NO: 478006 - DNA, 20 bp, Artificial Sequence
  chemically synthesized
aagagagaaatttatgaaac

SEQ ID NO: 478007 - DNA, 20 bp, Artificial Sequence
  chemically synthesized
catcagagtgaatttaaatg

SEQ ID NO: 478008 - DNA, 20 bp, Artificial Sequence
  chemically synthesized
atgcatattaagacatcaga

SEQ ID NO: 478009 - DNA, 20 bp, Artificial Sequence
  chemically synthesized
agacatgcatattaagacat

SEQ ID NO: 478010 - DNA, 20 bp, Artificial Sequence
  chemically synthesized
cattaccactttaatctaat

SEQ ID NO: 478011 - DNA, 20 bp, Artificial Sequence
  chemically synthesized
ttggtatggagatgatactt

SEQ ID NO: 478012 - DNA, 20 bp, Artificial Sequence
  chemically synthesized
attcactgtattttgaataa

SEQ ID NO: 478013 - DNA, 20 bp, Artificial Sequence
  chemically synthesized
attcatttattcaaaataca

SEQ ID NO: 478014 - DNA, 20 bp, Artificial Sequence
  chemically synthesized
tcagaatgattcactgtatt

SEQ ID NO: 478015 - DNA, 20 bp, Artificial Sequence
  chemically synthesized
tacagtgaatcattctgaaa

SEQ ID NO: 478016 - DNA, 20 bp, Artificial Sequence
  chemically synthesized
ctacgtaaatcatccaattt

SEQ ID NO: 478017 - DNA, 20 bp, Artificial Sequence
  chemically synthesized
gtggagcaaaaaggccacaa

SEQ ID NO: 478018 - DNA, 20 bp, Artificial Sequence
  chemically synthesized
tggataacatgaacttcaag

SEQ ID NO: 478019 - DNA, 20 bp, Artificial Sequence
  chemically synthesized
cagtcctgttacaaagacgt

SEQ ID NO: 478020 - DNA, 20 bp, Artificial Sequence
  chemically synthesized
ctgcatcatcggaaccttcc

SEQ ID NO: 478021 - DNA, 20 bp, Artificial Sequence
  chemically synthesized
tcggaaccttccagggatct

SEQ ID NO: 478022 - DNA, 20 bp, Artificial Sequence
  chemically synthesized
acacagatgtttatcacaac

SEQ ID NO: 478023 - DNA, 20 bp, Artificial Sequence
  chemically synthesized
tcctacaggacagcaggaag

SEQ ID NO: 478024 - DNA, 20 bp, Artificial Sequence
  chemically synthesized
agcaggaagaagaatatgtg

SEQ ID NO: 478025 - DNA, 20 bp, Artificial Sequence
  chemically synthesized
ccaaacaaaagaaacaagcg

SEQ ID NO: 478026 - DNA, 20 bp, Artificial Sequence
  chemically synthesized
aaaagaaacaagcgatgaat

SEQ ID NO: 478027 - DNA, 20 bp, Artificial Sequence
  chemically synthesized
aagcgatgaatgtgaatttg

SEQ ID NO: 478028 - DNA, 20 bp, Artificial Sequence
  chemically synthesized
gaaggcaatacgccaagaaa

SEQ ID NO: 478029 - DNA, 20 bp, Artificial Sequence
  chemically synthesized
tagatttattccttgccatt

SEQ ID NO: 478030 - DNA, 20 bp, Artificial Sequence
  chemically synthesized
ctttccaactcataatggca

SEQ ID NO: 478031 - DNA, 20 bp, Artificial Sequence
  chemically synthesized
cactggggtacactttatca

SEQ ID NO: 478032 - DNA, 20 bp, Artificial Sequence
  chemically synthesized
agtaatgaaattattggcac

SEQ ID NO: 478033 - DNA, 20 bp, Artificial Sequence
  chemically synthesized
gccaataatttcattactat

SEQ ID NO: 478034 - DNA, 20 bp, Artificial Sequence
  chemically synthesized
tctatttacgtagtaatctg

SEQ ID NO: 478035 - DNA, 20 bp, Artificial Sequence
  chemically synthesized
tctctccacgcttttatggt

SEQ ID NO: 478036 - DNA, 20 bp, Artificial Sequence
  chemically synthesized
cacagcaccagcacattcct

SEQ ID NO: 478037 - DNA, 20 bp, Artificial Sequence
  chemically synthesized
ctctcccatgacagactccc

SEQ ID NO: 478038 - DNA, 20 bp, Artificial Sequence
  chemically synthesized
aaagtacataggaccttggt

SEQ ID NO: 478039 - DNA, 20 bp, Artificial Sequence
  chemically synthesized
ctgtgtgtatacaagtgaag

SEQ ID NO: 478040 - DNA, 20 bp, Artificial Sequence
  chemically synthesized
caagaaaattattatagtag

SEQ ID NO: 478041 - DNA, 20 bp, Artificial Sequence
  chemically synthesized
ttctcaggattgctatgcaa

SEQ ID NO: 478042 - DNA, 20 bp, Artificial Sequence
  chemically synthesized
tttcagtttctgggttttct

SEQ ID NO: 478043 - DNA, 20 bp, Artificial Sequence
  chemically synthesized
aagcagggctctttcagttt

SEQ ID NO: 478044 - DNA, 20 bp, Artificial Sequence
  chemically synthesized
ctttgcttacattctgttga

SEQ ID NO: 478045 - DNA, 20 bp, Artificial Sequence
  chemically synthesized
tccaaaattcattctgtcaa

SEQ ID NO: 478046 - DNA, 20 bp, Artificial Sequence
  chemically synthesized
gcttacattctgttgacaga

SEQ ID NO: 478047 - DNA, 20 bp, Artificial Sequence
  chemically synthesized
cgcctggctactgtttagtg

SEQ ID NO: 478048 - DNA, 20 bp, Artificial Sequence
  chemically synthesized
actaaacagtagccaggcgt

SEQ ID NO: 478049 - DNA, 20 bp, Artificial Sequence
  chemically synthesized
aacctcaaagagaggaggcc

SEQ ID NO: 478050 - DNA, 20 bp, Artificial Sequence
  chemically synthesized
atgtctctggcttgtaatgg

SEQ ID NO: 478051 - DNA, 20 bp, Artificial Sequence
  chemically synthesized
gaaggaaacacatatataaa

SEQ ID NO: 478052 - DNA, 20 bp, Artificial Sequence
  chemically synthesized
gtttccttccttgttcccag

SEQ ID NO: 478053 - DNA, 20 bp, Artificial Sequence
  chemically synthesized
tggtacccggcagctctctg

SEQ ID NO: 478054 - DNA, 20 bp, Artificial Sequence
  chemically synthesized
gaacattcctcagagagctg

SEQ ID NO: 478055 - DNA, 20 bp, Artificial Sequence
  chemically synthesized
cattcattgtgtaggcagaa

SEQ ID NO: 478056 - DNA, 20 bp, Artificial Sequence
  chemically synthesized
cattcctttctgcctacaca

SEQ ID NO: 478057 - DNA, 20 bp, Artificial Sequence
  chemically synthesized
caattgtttggagcttcaga

SEQ ID NO: 478058 - DNA, 20 bp, Artificial Sequence
  chemically synthesized
aatccaattgtttggagctt

SEQ ID NO: 478059 - DNA, 20 bp, Artificial Sequence
  chemically synthesized
cattctgaagctccaaacaa

SEQ ID NO: 478060 - DNA, 20 bp, Artificial Sequence
  chemically synthesized
ttttctctctctctctcaaa

SEQ ID NO: 478061 - DNA, 20 bp, Artificial Sequence
  chemically synthesized
ctttttctcccttactttag

SEQ ID NO: 478062 - DNA, 20 bp, Artificial Sequence
  chemically synthesized
gaaaacttgagccagttctt

SEQ ID NO: 478063 - DNA, 20 bp, Artificial Sequence
  chemically synthesized
agccacagcctcttaagatg

SEQ ID NO: 478064 - DNA, 20 bp, Artificial Sequence
  chemically synthesized
gcctcttaagatgcagaatt

SEQ ID NO: 478065 - DNA, 20 bp, Artificial Sequence
  chemically synthesized
taccttacttgttcaacatt

SEQ ID NO: 478066 - DNA, 20 bp, Artificial Sequence
  chemically synthesized
acaagtaaggtagacagaca

SEQ ID NO: 478067 - DNA, 20 bp, Artificial Sequence
  chemically synthesized
catcactgatggactctaaa

SEQ ID NO: 478068 - DNA, 20 bp, Artificial Sequence
  chemically synthesized
gaatgggacacaactctctt

SEQ ID NO: 478069 - DNA, 20 bp, Artificial Sequence
  chemically synthesized
ctgcctgtctcccagtcaaa

SEQ ID NO: 478070 - DNA, 20 bp, Artificial Sequence
  chemically synthesized
tttgactgggagacaggcag

SEQ ID NO: 478071 - DNA, 20 bp, Artificial Sequence
  chemically synthesized
tgggagacaggcaggggaat

SEQ ID NO: 478072 - DNA, 20 bp, Artificial Sequence
  chemically synthesized
gacaggcaggggaatatgga

SEQ ID NO: 478073 - DNA, 20 bp, Artificial Sequence
  chemically synthesized
gggaaatactgaaagtattt

SEQ ID NO: 478074 - DNA, 20 bp, Artificial Sequence
  chemically synthesized
agtatttctgagtagtatct

SEQ ID NO: 478075 - DNA, 20 bp, Artificial Sequence
  chemically synthesized
acaaaccaggtttgtactgg

SEQ ID NO: 478076 - DNA, 20 bp, Artificial Sequence
  chemically synthesized
atatggtagaaggttagtat

SEQ ID NO: 478077 - DNA, 20 bp, Artificial Sequence
  chemically synthesized
ttgaccaaacttcgttctgc

SEQ ID NO: 478078 - DNA, 20 bp, Artificial Sequence
  chemically synthesized
cttttttccttttgcctacg

SEQ ID NO: 478079 - DNA, 20 bp, Artificial Sequence
  chemically synthesized
ttcttcagcaaaagagaaaa

SEQ ID NO: 478080 - DNA, 20 bp, Artificial Sequence
  chemically synthesized
gtaaagtaaaagacaagtga

SEQ ID NO: 478081 - DNA, 20 bp, Artificial Sequence
  chemically synthesized
tccttttgtgtatgcactta

SEQ ID NO: 478082 - DNA, 20 bp, Artificial Sequence
  chemically synthesized
agaaaactgatgctactagt

SEQ ID NO: 478083 - DNA, 20 bp, Artificial Sequence
  chemically synthesized
actacattaacatacatata

SEQ ID NO: 478084 - DNA, 20 bp, Artificial Sequence
  chemically synthesized
ctgggtctctgctatcaatg

SEQ ID NO: 478085 - DNA, 20 bp, Artificial Sequence
  chemically synthesized
taaggagctcgtgattgagc

SEQ ID NO: 478086 - DNA, 20 bp, Artificial Sequence
  chemically synthesized
tttgtcttctcaagcataaa

SEQ ID NO: 478087 - DNA, 20 bp, Artificial Sequence
  chemically synthesized
cataaataggatgttgattc

SEQ ID NO: 478088 - DNA, 20 bp, Artificial Sequence
  chemically synthesized
agatgaaaagtagcaaattc

SEQ ID NO: 478089 - DNA, 20 bp, Artificial Sequence
  chemically synthesized
gttgtattatcaacaaataa

SEQ ID NO: 478090 - DNA, 20 bp, Artificial Sequence
  chemically synthesized
agcactttgggaaatgtaag

SEQ ID NO: 478091 - DNA, 20 bp, Artificial Sequence
  chemically synthesized
atatttagttggtaatataa

SEQ ID NO: 478092 - DNA, 20 bp, Artificial Sequence
  chemically synthesized
agtatctatgaagacttggc

SEQ ID NO: 478093 - DNA, 20 bp, Artificial Sequence
  chemically synthesized
tgccaagtcttcatagatac

SEQ ID NO: 478094 - DNA, 20 bp, Artificial Sequence
  chemically synthesized
atttctgcatttctaaagga

SEQ ID NO: 478095 - DNA, 20 bp, Artificial Sequence
  chemically synthesized
tacttcacagagccaggggg

SEQ ID NO: 478096 - DNA, 20 bp, Artificial Sequence
  chemically synthesized
gcagatgagagcactgagac

SEQ ID NO: 478097 - DNA, 20 bp, Artificial Sequence
  chemically synthesized
taggcaagtcagttaaacat

SEQ ID NO: 478098 - DNA, 20 bp, Artificial Sequence
  chemically synthesized
ataagtgttagaactgggaa

SEQ ID NO: 478099 - DNA, 20 bp, Artificial Sequence
  chemically synthesized
atcttctagaatcaagagaa

SEQ ID NO: 478100 - DNA, 20 bp, Artificial Sequence
  chemically synthesized
ccaagatcttctagaatcaa

SEQ ID NO: 478101 - DNA, 20 bp, Artificial Sequence
  chemically synthesized
ggaggcagcccaagatcttc

SEQ ID NO: 478102 - DNA, 20 bp, Artificial Sequence
  chemically synthesized
atatccaatgcttctggcaa

SEQ ID NO: 478103 - DNA, 20 bp, Artificial Sequence
  chemically synthesized
caacccacttgccagaagca

SEQ ID NO: 478104 - DNA, 20 bp, Artificial Sequence
  chemically synthesized
aactcaagaatgctgtcttt

SEQ ID NO: 478105 - DNA, 20 bp, Artificial Sequence
  chemically synthesized
caccctgaaagacagcattc

SEQ ID NO: 478106 - DNA, 20 bp, Artificial Sequence
  chemically synthesized
gtaaacattttatcaaactc

SEQ ID NO: 478107 - DNA, 20 bp, Artificial Sequence
  chemically synthesized
ttgataaaatgtttacccac

SEQ ID NO: 478108 - DNA, 20 bp, Artificial Sequence
  chemically synthesized
ttcagaacaaatcaatccac

SEQ ID NO: 478109 - DNA, 20 bp, Artificial Sequence
  chemically synthesized
cccacgtggattgatttgtt

SEQ ID NO: 478110 - DNA, 20 bp, Artificial Sequence
  chemically synthesized
gatttgttctgaatgaaaaa

SEQ ID NO: 478111 - DNA, 20 bp, Artificial Sequence
  chemically synthesized
aaaaaaaaaaaaagagcagt

SEQ ID NO: 478112 - DNA, 20 bp, Artificial Sequence
  chemically synthesized
ttttttttttttttttgaga

SEQ ID NO: 478113 - DNA, 20 bp, Artificial Sequence
  chemically synthesized
tcgcgccactgtgctccagc

SEQ ID NO: 478114 - DNA, 20 bp, Artificial Sequence
  chemically synthesized
tacttgggaggctgaggcag

SEQ ID NO: 478115 - DNA, 20 bp, Artificial Sequence
  chemically synthesized
ttttgtatttttagtagaaa

SEQ ID NO: 478116 - DNA, 20 bp, Artificial Sequence
  chemically synthesized
cagggtttcaccatgttagc

SEQ ID NO: 478117 - DNA, 20 bp, Artificial Sequence
  chemically synthesized
actttgggaggccaaggtgg

SEQ ID NO: 478118 - DNA, 20 bp, Artificial Sequence
  chemically synthesized
accttggcctcccaaagtgc

SEQ ID NO: 478119 - DNA, 20 bp, Artificial Sequence
  chemically synthesized
ttttttgctcacaggtggtc

SEQ ID NO: 478120 - DNA, 20 bp, Artificial Sequence
  chemically synthesized
aagagatgaattactgatgg

SEQ ID NO: 478121 - DNA, 20 bp, Artificial Sequence
  chemically synthesized
tggctcttgtagacaaagag

SEQ ID NO: 478122 - DNA, 20 bp, Artificial Sequence
  chemically synthesized
atagttcatccatgttcctt

SEQ ID NO: 478123 - DNA, 20 bp, Artificial Sequence
  chemically synthesized
gcctgccatcccaaaggaac

SEQ ID NO: 478124 - DNA, 20 bp, Artificial Sequence
  chemically synthesized
ttccttttagggcaacctat

SEQ ID NO: 478125 - DNA, 20 bp, Artificial Sequence
  chemically synthesized
ccagcttttgaaagagagcc

SEQ ID NO: 478126 - DNA, 20 bp, Artificial Sequence
  chemically synthesized
ttcagtatcaataaggcagc

SEQ ID NO: 478127 - DNA, 20 bp, Artificial Sequence
  chemically synthesized
ggcagcatgagtcatagatt

SEQ ID NO: 478128 - DNA, 20 bp, Artificial Sequence
  chemically synthesized
ggaatgcagggcaggctgca

SEQ ID NO: 478129 - DNA, 20 bp, Artificial Sequence
  chemically synthesized
aaataaataaataaaaaatg

SEQ ID NO: 478130 - DNA, 20 bp, Artificial Sequence
  chemically synthesized
tattattatactttaaattt

SEQ ID NO: 478131 - DNA, 20 bp, Artificial Sequence
  chemically synthesized
taatgctagatgatgagtta

SEQ ID NO: 478132 - DNA, 20 bp, Artificial Sequence
  chemically synthesized
gatatacctaatgctagatg

SEQ ID NO: 478133 - DNA, 20 bp, Artificial Sequence
  chemically synthesized
gtggggtggggggagggggg

SEQ ID NO: 478134 - DNA, 20 bp, Artificial Sequence
  chemically synthesized
tcacactctggggactgttg

SEQ ID NO: 478135 - DNA, 20 bp, Artificial Sequence
  chemically synthesized
ccccaccccacaacagtccc

SEQ ID NO: 478136 - DNA, 20 bp, Artificial Sequence
  chemically synthesized
tcattgttcaattcccacct

SEQ ID NO: 478137 - DNA, 20 bp, Artificial Sequence
  chemically synthesized
gcatattctcactcataggt

SEQ ID NO: 478138 - DNA, 20 bp, Artificial Sequence
  chemically synthesized
ttcaattcccacctatgagt

SEQ ID NO: 478139 - DNA, 20 bp, Artificial Sequence
  chemically synthesized
tgttcttgtgatagtttact

SEQ ID NO: 478140 - DNA, 20 bp, Artificial Sequence
  chemically synthesized
ttcacatcctttgtagggac

SEQ ID NO: 478141 - DNA, 20 bp, Artificial Sequence
  chemically synthesized
atttcatccatgtccctaca

SEQ ID NO: 478142 - DNA, 20 bp, Artificial Sequence
  chemically synthesized
tatgcagccataaaaaaagg

SEQ ID NO: 478143 - DNA, 20 bp, Artificial Sequence
  chemically synthesized
atactatgcagccataaaaa

SEQ ID NO: 478144 - DNA, 20 bp, Artificial Sequence
  chemically synthesized
aatgtggcacatatacacca

SEQ ID NO: 478145 - DNA, 20 bp, Artificial Sequence
  chemically synthesized
aaatgtccaacagtgataga

SEQ ID NO: 478146 - DNA, 20 bp, Artificial Sequence
  chemically synthesized
agtctatcactgttggacat

SEQ ID NO: 478147 - DNA, 20 bp, Artificial Sequence
  chemically synthesized
ggttccaagtctttgctatt

SEQ ID NO: 478148 - DNA, 20 bp, Artificial Sequence
  chemically synthesized
gcagcatgatttatagtcct

SEQ ID NO: 478149 - DNA, 20 bp, Artificial Sequence
  chemically synthesized
tttgggtatatacccagtaa

SEQ ID NO: 478150 - DNA, 20 bp, Artificial Sequence
  chemically synthesized
ttgacccagccatcccatta

SEQ ID NO: 478151 - DNA, 20 bp, Artificial Sequence
  chemically synthesized
tatacccagtaatgggatgg

SEQ ID NO: 478152 - DNA, 20 bp, Artificial Sequence
  chemically synthesized
tttctagttctagatccctg

SEQ ID NO: 478153 - DNA, 20 bp, Artificial Sequence
  chemically synthesized
agtcagtgtggcgattcctc

SEQ ID NO: 478154 - DNA, 20 bp, Artificial Sequence
  chemically synthesized
aggaaacaacaggtgctgga

SEQ ID NO: 478155 - DNA, 20 bp, Artificial Sequence
  chemically synthesized
agataccatctcacaccagt

SEQ ID NO: 478156 - DNA, 20 bp, Artificial Sequence
  chemically synthesized
gtccttcacccactttttga

SEQ ID NO: 478157 - DNA, 20 bp, Artificial Sequence
  chemically synthesized
acaaacaaccccatcaaaaa

SEQ ID NO: 478158 - DNA, 20 bp, Artificial Sequence
  chemically synthesized
tttttttcttgtacatttgt

SEQ ID NO: 478159 - DNA, 20 bp, Artificial Sequence
  chemically synthesized
gtttgagttcattgtagatt

SEQ ID NO: 478160 - DNA, 20 bp, Artificial Sequence
  chemically synthesized
tctgacaaagggctaatatc

SEQ ID NO: 478161 - DNA, 20 bp, Artificial Sequence
  chemically synthesized
ggatattagccctttgtcag

SEQ ID NO: 478162 - DNA, 20 bp, Artificial Sequence
  chemically synthesized
acagcaaaagaaactaccat

SEQ ID NO: 478163 - DNA, 20 bp, Artificial Sequence
  chemically synthesized
caaaagccagaattgacaaa

SEQ ID NO: 478164 - DNA, 20 bp, Artificial Sequence
  chemically synthesized
aaagcaatggcaacaaaagc

SEQ ID NO: 478165 - DNA, 20 bp, Artificial Sequence
  chemically synthesized
tccttgcccatgcctatgtc

SEQ ID NO: 478166 - DNA, 20 bp, Artificial Sequence
  chemically synthesized
gtaatgcctaggttttcttc

SEQ ID NO: 478167 - DNA, 20 bp, Artificial Sequence
  chemically synthesized
gtttaagtctttaatccatc

SEQ ID NO: 478168 - DNA, 20 bp, Artificial Sequence
  chemically synthesized
tatacaaaaatcaattcaag

SEQ ID NO: 478169 - DNA, 20 bp, Artificial Sequence
  chemically synthesized
ttttgtataaggtgtaagga

SEQ ID NO: 478170 - DNA, 20 bp, Artificial Sequence
  chemically synthesized
ccatatgtagaaagctgaaa

SEQ ID NO: 478171 - DNA, 20 bp, Artificial Sequence
  chemically synthesized
ccagcaccatttattaaata

SEQ ID NO: 478172 - DNA, 20 bp, Artificial Sequence
  chemically synthesized
agaaaaacaagcaatgggga

SEQ ID NO: 478173 - DNA, 20 bp, Artificial Sequence
  chemically synthesized
ccagctttgttcttttggct

SEQ ID NO: 478174 - DNA, 20 bp, Artificial Sequence
  chemically synthesized
gctaccaatgcctttcttca

SEQ ID NO: 478175 - DNA, 20 bp, Artificial Sequence
  chemically synthesized
aaaggcattggtagcttgat

SEQ ID NO: 478176 - DNA, 20 bp, Artificial Sequence
  chemically synthesized
gtagcttgatggggatggca

SEQ ID NO: 478177 - DNA, 20 bp, Artificial Sequence
  chemically synthesized
attccatgctcatgggtagg

SEQ ID NO: 478178 - DNA, 20 bp, Artificial Sequence
  chemically synthesized
attcttcctacccatgagca

SEQ ID NO: 478179 - DNA, 20 bp, Artificial Sequence
  chemically synthesized
tggaagaacattccatgctc

SEQ ID NO: 478180 - DNA, 20 bp, Artificial Sequence
  chemically synthesized
acctaggaatgcaacttaca

SEQ ID NO: 478181 - DNA, 20 bp, Artificial Sequence
  chemically synthesized
tcaaagagaataaaatacct

SEQ ID NO: 478182 - DNA, 20 bp, Artificial Sequence
  chemically synthesized
ccattcacaattgcttcaaa

SEQ ID NO: 478183 - DNA, 20 bp, Artificial Sequence
  chemically synthesized
ttattctctttgaagcaatt

SEQ ID NO: 478184 - DNA, 20 bp, Artificial Sequence
  chemically synthesized
tctttgaagcaattgtgaat

SEQ ID NO: 478185 - DNA, 20 bp, Artificial Sequence
  chemically synthesized
gacaaacagagagccaaatc

SEQ ID NO: 478186 - DNA, 20 bp, Artificial Sequence
  chemically synthesized
tttgtctgttgttggtgtat

SEQ ID NO: 478187 - DNA, 20 bp, Artificial Sequence
  chemically synthesized
aagcaacttcagcaaagtct

SEQ ID NO: 478188 - DNA, 20 bp, Artificial Sequence
  chemically synthesized
gagattttgggctgagacga

SEQ ID NO: 478189 - DNA, 20 bp, Artificial Sequence
  chemically synthesized
ttgacttcctcttttcctaa

SEQ ID NO: 478190 - DNA, 20 bp, Artificial Sequence
  chemically synthesized
tcaggcaggagaaggaaata

SEQ ID NO: 478191 - DNA, 20 bp, Artificial Sequence
  chemically synthesized
ccagaacttccaacactatg

SEQ ID NO: 478192 - DNA, 20 bp, Artificial Sequence
  chemically synthesized
cttccaacactatgttgaat

SEQ ID NO: 478193 - DNA, 20 bp, Artificial Sequence
  chemically synthesized
tgagtttattggcacaagac

SEQ ID NO: 478194 - DNA, 20 bp, Artificial Sequence
  chemically synthesized
tgaggtgtagtctttaaatg

SEQ ID NO: 478195 - DNA, 20 bp, Artificial Sequence
  chemically synthesized
cttttgctcttttgtgctac

SEQ ID NO: 478196 - DNA, 20 bp, Artificial Sequence
  chemically synthesized
aagagcaaaagattgatatg

SEQ ID NO: 478197 - DNA, 20 bp, Artificial Sequence
  chemically synthesized
gattgatatggagaatcaag

SEQ ID NO: 478198 - DNA, 20 bp, Artificial Sequence
  chemically synthesized
agaatcaagtggagttctca

SEQ ID NO: 478199 - DNA, 20 bp, Artificial Sequence
  chemically synthesized
gtgggtagccaatctggaca

SEQ ID NO: 478200 - DNA, 20 bp, Artificial Sequence
  chemically synthesized
gataattttcatagaaattt

SEQ ID NO: 478201 - DNA, 20 bp, Artificial Sequence
  chemically synthesized
gtgaatgcagtaatgaaggc

SEQ ID NO: 478202 - DNA, 20 bp, Artificial Sequence
  chemically synthesized
aaaaaattagagagcataca

SEQ ID NO: 478203 - DNA, 20 bp, Artificial Sequence
  chemically synthesized
agtctttaggaaaagcaata

SEQ ID NO: 478204 - DNA, 20 bp, Artificial Sequence
  chemically synthesized
ttctcctctcaacaaccctc

SEQ ID NO: 478205 - DNA, 20 bp, Artificial Sequence
  chemically synthesized
taatagtagcccctacccta

SEQ ID NO: 478206 - DNA, 20 bp, Artificial Sequence
  chemically synthesized
aacctcgtcagtcagacttc

SEQ ID NO: 478207 - DNA, 20 bp, Artificial Sequence
  chemically synthesized
agcactgccattagaaaata

SEQ ID NO: 478208 - DNA, 20 bp, Artificial Sequence
  chemically synthesized
tattaaacagatttgtagca

SEQ ID NO: 478209 - DNA, 20 bp, Artificial Sequence
  chemically synthesized
ttgtgttttctcttgttgta

SEQ ID NO: 478210 - DNA, 20 bp, Artificial Sequence
  chemically synthesized
aacacaaagtaattgagaaa

SEQ ID NO: 478211 - DNA, 20 bp, Artificial Sequence
  chemically synthesized
ttatagagcaaatttcagct

SEQ ID NO: 478212 - DNA, 20 bp, Artificial Sequence
  chemically synthesized
gttcacagtatagcagtttt

SEQ ID NO: 478213 - DNA, 20 bp, Artificial Sequence
  chemically synthesized
tgaaaaagcccttcagaaaa

SEQ ID NO: 478214 - DNA, 20 bp, Artificial Sequence
  chemically synthesized
actcagataagaaggaagtg

SEQ ID NO: 478215 - DNA, 20 bp, Artificial Sequence
  chemically synthesized
attccacacttccttcttat

SEQ ID NO: 478216 - DNA, 20 bp, Artificial Sequence
  chemically synthesized
gagtctcatctactcttgtt

SEQ ID NO: 478217 - DNA, 20 bp, Artificial Sequence
  chemically synthesized
tgagaaaggagattcacaac

SEQ ID NO: 478218 - DNA, 20 bp, Artificial Sequence
  chemically synthesized
ctatttaactgcactttgcc

SEQ ID NO: 478219 - DNA, 20 bp, Artificial Sequence
  chemically synthesized
taataagggaaagagaagag

SEQ ID NO: 478220 - DNA, 20 bp, Artificial Sequence
  chemically synthesized
tagtgaaaccaaagtaatga

SEQ ID NO: 478221 - DNA, 20 bp, Artificial Sequence
  chemically synthesized
gaaataataatacatacctg

SEQ ID NO: 478222 - DNA, 20 bp, Artificial Sequence
  chemically synthesized
atacatacctgctgaatttt

SEQ ID NO: 478223 - DNA, 20 bp, Artificial Sequence
  chemically synthesized
tgaattttttgaatattaca

SEQ ID NO: 478224 - DNA, 20 bp, Artificial Sequence
  chemically synthesized
tggaatttttgtaaaatact

SEQ ID NO: 478225 - DNA, 20 bp, Artificial Sequence
  chemically synthesized
ttctaacatctgatttccac

SEQ ID NO: 478226 - DNA, 20 bp, Artificial Sequence
  chemically synthesized
aggacttggcttgagccttg

SEQ ID NO: 478227 - DNA, 20 bp, Artificial Sequence
  chemically synthesized
aagaaaatattccaggtaaa

SEQ ID NO: 478228 - DNA, 20 bp, Artificial Sequence
  chemically synthesized
cccatgctattctttttacc

SEQ ID NO: 478229 - DNA, 20 bp, Artificial Sequence
  chemically synthesized
ccaggtaaaaagaatagcat

SEQ ID NO: 478230 - DNA, 20 bp, Artificial Sequence
  chemically synthesized
taaaaagaatagcatgggaa

SEQ ID NO: 478231 - DNA, 20 bp, Artificial Sequence
  chemically synthesized
gggaatggagtaaaggtgaa

SEQ ID NO: 478232 - DNA, 20 bp, Artificial Sequence
  chemically synthesized
ttggtttatgagcagggaca

SEQ ID NO: 478233 - DNA, 20 bp, Artificial Sequence
  chemically synthesized
aatgaattgcacaacctgat

SEQ ID NO: 478234 - DNA, 20 bp, Artificial Sequence
  chemically synthesized
acctgattggaatggacaat

SEQ ID NO: 478235 - DNA, 20 bp, Artificial Sequence
  chemically synthesized
tgagagttgagagaaatagg

SEQ ID NO: 478236 - DNA, 20 bp, Artificial Sequence
  chemically synthesized
gaccaactgcttaaaccaag

SEQ ID NO: 478237 - DNA, 20 bp, Artificial Sequence
  chemically synthesized
tcttcctttaggaagccacc

SEQ ID NO: 478238 - DNA, 20 bp, Artificial Sequence
  chemically synthesized
aaagtacaaagacaagatta

SEQ ID NO: 478239 - DNA, 20 bp, Artificial Sequence
  chemically synthesized
gtactatttcattcaaaaag

SEQ ID NO: 478240 - DNA, 20 bp, Artificial Sequence
  chemically synthesized
accatggatcattctacttt

SEQ ID NO: 478241 - DNA, 20 bp, Artificial Sequence
  chemically synthesized
tattattacttatgaacacc

SEQ ID NO: 478242 - DNA, 20 bp, Artificial Sequence
  chemically synthesized
aagtaataatacaactgggg

SEQ ID NO: 478243 - DNA, 20 bp, Artificial Sequence
  chemically synthesized
ggggaagaataggaaaagtt

SEQ ID NO: 478244 - DNA, 20 bp, Artificial Sequence
  chemically synthesized
aaataaagaagggagatgtc

SEQ ID NO: 478245 - DNA, 20 bp, Artificial Sequence
  chemically synthesized
aaatggttaataataaaaag

SEQ ID NO: 478246 - DNA, 20 bp, Artificial Sequence
  chemically synthesized
tgatactattctagaacatc

SEQ ID NO: 478247 - DNA, 20 bp, Artificial Sequence
  chemically synthesized
tacgattattcatgatgttc

SEQ ID NO: 478248 - DNA, 20 bp, Artificial Sequence
  chemically synthesized
ttacataggaaaggaaatat

SEQ ID NO: 478249 - DNA, 20 bp, Artificial Sequence
  chemically synthesized
tatttcctttcctatgtaaa

SEQ ID NO: 478250 - DNA, 20 bp, Artificial Sequence
  chemically synthesized
aatggggaagttttcatttg

SEQ ID NO: 478251 - DNA, 20 bp, Artificial Sequence
  chemically synthesized
aacaaacacaatggtgtaga

SEQ ID NO: 478252 - DNA, 20 bp, Artificial Sequence
  chemically synthesized
ataagtgaccaaatctcctt

SEQ ID NO: 478253 - DNA, 20 bp, Artificial Sequence
  chemically synthesized
tttctgaaagcagttagtat

SEQ ID NO: 478254 - DNA, 20 bp, Artificial Sequence
  chemically synthesized
aggataatttctttactatt

SEQ ID NO: 478255 - DNA, 20 bp, Artificial Sequence
  chemically synthesized
ctactctcaatttagccact

SEQ ID NO: 478256 - DNA, 20 bp, Artificial Sequence
  chemically synthesized
ttatcctaagtggctaaatt

SEQ ID NO: 478257 - DNA, 20 bp, Artificial Sequence
  chemically synthesized
ggaagaagtgacaccttaca

SEQ ID NO: 478258 - DNA, 20 bp, Artificial Sequence
  chemically synthesized
catgggcatgcataattgac

SEQ ID NO: 478259 - DNA, 20 bp, Artificial Sequence
  chemically synthesized
gaagcaaaatagttaatgct

SEQ ID NO: 478260 - DNA, 20 bp, Artificial Sequence
  chemically synthesized
taatgctcaggatgatgatg

SEQ ID NO: 478261 - DNA, 20 bp, Artificial Sequence
  chemically synthesized
ttcttcttaaacagatttta

SEQ ID NO: 478262 - DNA, 20 bp, Artificial Sequence
  chemically synthesized
atgttggataaccagtctaa

SEQ ID NO: 478263 - DNA, 20 bp, Artificial Sequence
  chemically synthesized
ctcatgtttaatgagtcatg

SEQ ID NO: 478264 - DNA, 20 bp, Artificial Sequence
  chemically synthesized
ctatttagagctcatgttta

SEQ ID NO: 478265 - DNA, 20 bp, Artificial Sequence
  chemically synthesized
gtttctgtgtgtgtatacgt

SEQ ID NO: 478266 - DNA, 20 bp, Artificial Sequence
  chemically synthesized
ctgttcttatgtcttcataa

SEQ ID NO: 478267 - DNA, 20 bp, Artificial Sequence
  chemically synthesized
ttttgtaacatgcaataaaa

SEQ ID NO: 478268 - DNA, 20 bp, Artificial Sequence
  chemically synthesized
tacaaaagtatcagtctatt

SEQ ID NO: 478269 - DNA, 20 bp, Artificial Sequence
  chemically synthesized
gtatcagtctattatggatt

SEQ ID NO: 478270 - DNA, 20 bp, Artificial Sequence
  chemically synthesized
aaaaaaaaaaaaaacccgaa

SEQ ID NO: 478271 - DNA, 20 bp, Artificial Sequence
  chemically synthesized
cttgttaggaaagatccact

SEQ ID NO: 478272 - DNA, 20 bp, Artificial Sequence
  chemically synthesized
ttcctaacaagtttttcgag

SEQ ID NO: 478273 - DNA, 20 bp, Artificial Sequence
  chemically synthesized
tgtgggtccaatttcttcct

SEQ ID NO: 478274 - DNA, 20 bp, Artificial Sequence
  chemically synthesized
atcctgataaggccaagact

SEQ ID NO: 478275 - DNA, 20 bp, Artificial Sequence
  chemically synthesized
acccacagtcttggccttat

SEQ ID NO: 478276 - DNA, 20 bp, Artificial Sequence
  chemically synthesized
ggaacctccggtggttagat

SEQ ID NO: 478277 - DNA, 20 bp, Artificial Sequence
  chemically synthesized
aaccagatcagaaaatgcag

SEQ ID NO: 478278 - DNA, 20 bp, Artificial Sequence
  chemically synthesized
agttggatacagactcacaa

SEQ ID NO: 478279 - DNA, 20 bp, Artificial Sequence
  chemically synthesized
aaaaacagtcacaccctctt

SEQ ID NO: 478280 - DNA, 20 bp, Artificial Sequence
  chemically synthesized
aggtgttgcgtggccacata

SEQ ID NO: 478281 - DNA, 20 bp, Artificial Sequence
  chemically synthesized
cgcaacacctttaaaagcag

SEQ ID NO: 478282 - DNA, 20 bp, Artificial Sequence
  chemically synthesized
gttgtcgtcccaagagaaac

SEQ ID NO: 478283 - DNA, 20 bp, Artificial Sequence
  chemically synthesized
ctggttgctctaggtagata

SEQ ID NO: 478284 - DNA, 20 bp, Artificial Sequence
  chemically synthesized
tgcatcttaaacgagcagct

SEQ ID NO: 478285 - DNA, 20 bp, Artificial Sequence
  chemically synthesized
aaacgagcagctatggattt

SEQ ID NO: 478286 - DNA, 20 bp, Artificial Sequence
  chemically synthesized
cctcagagactattatcctg

SEQ ID NO: 478287 - DNA, 20 bp, Artificial Sequence
  chemically synthesized
agcaaagacaacaaaccctg

SEQ ID NO: 478288 - DNA, 20 bp, Artificial Sequence
  chemically synthesized
gtgcttaagtgtgagaattt

SEQ ID NO: 478289 - DNA, 20 bp, Artificial Sequence
  chemically synthesized
ctgttgcagtgcttaagtgt

SEQ ID NO: 478290 - DNA, 20 bp, Artificial Sequence
  chemically synthesized
gcactgcaacagcagagaga

SEQ ID NO: 478291 - DNA, 20 bp, Artificial Sequence
  chemically synthesized
atgctctctcagcagggaga

SEQ ID NO: 478292 - DNA, 20 bp, Artificial Sequence
  chemically synthesized
tgaaatgaagctttgcactt

SEQ ID NO: 478293 - DNA, 20 bp, Artificial Sequence
  chemically synthesized
atctttaaaaatgcctggcc

SEQ ID NO: 478294 - DNA, 20 bp, Artificial Sequence
  chemically synthesized
ttaaaaatgcctggcctagg

SEQ ID NO: 478295 - DNA, 20 bp, Artificial Sequence
  chemically synthesized
gcggtttgacagtttcctcc

SEQ ID NO: 478296 - DNA, 20 bp, Artificial Sequence
  chemically synthesized
catcacgtattaccagagtt

SEQ ID NO: 478297 - DNA, 20 bp, Artificial Sequence
  chemically synthesized
gagaaagcatcacgtattac

SEQ ID NO: 478298 - DNA, 20 bp, Artificial Sequence
  chemically synthesized
taatcttaagaatggagtca

SEQ ID NO: 478299 - DNA, 20 bp, Artificial Sequence
  chemically synthesized
ttaaaaggtaatcttaagaa

SEQ ID NO: 478300 - DNA, 20 bp, Artificial Sequence
  chemically synthesized
cagttttaaaaggtaatctt

SEQ ID NO: 478301 - DNA, 20 bp, Artificial Sequence
  chemically synthesized
aagattaccttttaaaactg

SEQ ID NO: 478302 - DNA, 20 bp, Artificial Sequence
  chemically synthesized
cgggaatttttgcattgtga

SEQ ID NO: 478303 - DNA, 20 bp, Artificial Sequence
  chemically synthesized
cagtcacaatgcaaaaattc

SEQ ID NO: 478304 - DNA, 20 bp, Artificial Sequence
  chemically synthesized
tttgtgatgaataaatattc

SEQ ID NO: 478305 - DNA, 20 bp, Artificial Sequence
  chemically synthesized
acttaatgcacatttttgtg

SEQ ID NO: 478306 - DNA, 20 bp, Artificial Sequence
  chemically synthesized
caaagattagatgagatgat

SEQ ID NO: 478307 - DNA, 20 bp, Artificial Sequence
  chemically synthesized
acctcacaataggttaggca

SEQ ID NO: 478308 - DNA, 20 bp, Artificial Sequence
  chemically synthesized
gaaagtgagagggggactag

SEQ ID NO: 478309 - DNA, 20 bp, Artificial Sequence
  chemically synthesized
atcttctctgctagcaggat

SEQ ID NO: 478310 - DNA, 20 bp, Artificial Sequence
  chemically synthesized
cctcatatcttctctgctag

SEQ ID NO: 478311 - DNA, 20 bp, Artificial Sequence
  chemically synthesized
atgaggccgttcaaaagaaa

SEQ ID NO: 478312 - DNA, 20 bp, Artificial Sequence
  chemically synthesized
tctcaggaagttcaggttca

SEQ ID NO: 478313 - DNA, 20 bp, Artificial Sequence
  chemically synthesized
cagtgtagccaatgagagct

SEQ ID NO: 478314 - DNA, 20 bp, Artificial Sequence
  chemically synthesized
agatttttatctgattctgt

SEQ ID NO: 478315 - DNA, 20 bp, Artificial Sequence
  chemically synthesized
acagtggaatattatcctta

SEQ ID NO: 478316 - DNA, 20 bp, Artificial Sequence
  chemically synthesized
ctttacacaagaagctacag

SEQ ID NO: 478317 - DNA, 20 bp, Artificial Sequence
  chemically synthesized
catctggtaatgattattgg

SEQ ID NO: 478318 - DNA, 20 bp, Artificial Sequence
  chemically synthesized
attattgggaggatggtgtt

SEQ ID NO: 478319 - DNA, 20 bp, Artificial Sequence
  chemically synthesized
ggtgttcagggtaaatgtag

SEQ ID NO: 478320 - DNA, 20 bp, Artificial Sequence
  chemically synthesized
cagggtaaatgtagcagggt

SEQ ID NO: 478321 - DNA, 20 bp, Artificial Sequence
  chemically synthesized
aaccaaaacagcagtggctt

SEQ ID NO: 478322 - DNA, 20 bp, Artificial Sequence
  chemically synthesized
tcagagagaaggtaaagaag

SEQ ID NO: 478323 - DNA, 20 bp, Artificial Sequence
  chemically synthesized
gaagagggatgctaccatca

SEQ ID NO: 478324 - DNA, 20 bp, Artificial Sequence
  chemically synthesized
aaggtaggacaagagaagga

SEQ ID NO: 478325 - DNA, 20 bp, Artificial Sequence
  chemically synthesized
ttccaaaggtaggacaagag

SEQ ID NO: 478326 - DNA, 20 bp, Artificial Sequence
  chemically synthesized
cttgtcctacctttggaagg

SEQ ID NO: 478327 - DNA, 20 bp, Artificial Sequence
  chemically synthesized
tgtgaatagttatcactttc

SEQ ID NO: 478328 - DNA, 20 bp, Artificial Sequence
  chemically synthesized
tctatctttaaaatgtactt

SEQ ID NO: 478329 - DNA, 20 bp, Artificial Sequence
  chemically synthesized
atttaaagttctatttctca

SEQ ID NO: 478330 - DNA, 20 bp, Artificial Sequence
  chemically synthesized
caccttggggccaaataaat

SEQ ID NO: 478331 - DNA, 20 bp, Artificial Sequence
  chemically synthesized
tgatagggtatattttaggt

SEQ ID NO: 478332 - DNA, 20 bp, Artificial Sequence
  chemically synthesized
tatagtttaggaatgcttga

SEQ ID NO: 478333 - DNA, 20 bp, Artificial Sequence
  chemically synthesized
atcaagcattcctaaactat

SEQ ID NO: 478334 - DNA, 20 bp, Artificial Sequence
  chemically synthesized
aactggcacccatatagttt

SEQ ID NO: 478335 - DNA, 20 bp, Artificial Sequence
  chemically synthesized
acacaatttcctgagaaaaa

SEQ ID NO: 478336 - DNA, 20 bp, Artificial Sequence
  chemically synthesized
atttcctgagaaaaagtggg

SEQ ID NO: 478337 - DNA, 20 bp, Artificial Sequence
  chemically synthesized
atatcaacattagttctcca

SEQ ID NO: 478338 - DNA, 20 bp, Artificial Sequence
  chemically synthesized
aagtttatgtgcagagccaa

SEQ ID NO: 478339 - DNA, 20 bp, Artificial Sequence
  chemically synthesized
tctgcacataaactttaaaa

SEQ ID NO: 478340 - DNA, 20 bp, Artificial Sequence
  chemically synthesized
ctcgttttctctttcaacac

SEQ ID NO: 478341 - DNA, 20 bp, Artificial Sequence
  chemically synthesized
ttctggtgttgaaagagaaa

SEQ ID NO: 478342 - DNA, 20 bp, Artificial Sequence
  chemically synthesized
aaacgagtcttaaagacagg

SEQ ID NO: 478343 - DNA, 20 bp, Artificial Sequence
  chemically synthesized
attgcagcacagtattttct

SEQ ID NO: 478344 - DNA, 20 bp, Artificial Sequence
  chemically synthesized
tacagcctcagtgctcataa

SEQ ID NO: 478345 - DNA, 20 bp, Artificial Sequence
  chemically synthesized
tgtgacttaaatgtacaatc

SEQ ID NO: 478346 - DNA, 20 bp, Artificial Sequence
  chemically synthesized
ttatattatattttatgtgc

SEQ ID NO: 478347 - DNA, 20 bp, Artificial Sequence
  chemically synthesized
ccatctggtctttctcagat

SEQ ID NO: 478348 - DNA, 20 bp, Artificial Sequence
  chemically synthesized
ccttatctgagaaagaccag

SEQ ID NO: 478349 - DNA, 20 bp, Artificial Sequence
  chemically synthesized
ctgcaaaaacaaatatgtct

SEQ ID NO: 478350 - DNA, 20 bp, Artificial Sequence
  chemically synthesized
gtttttgcagagccatgatg

SEQ ID NO: 478351 - DNA, 20 bp, Artificial Sequence
  chemically synthesized
gcagagccatgatgaggggt

SEQ ID NO: 478352 - DNA, 20 bp, Artificial Sequence
  chemically synthesized
gccatgatgaggggtggggg

SEQ ID NO: 478353 - DNA, 20 bp, Artificial Sequence
  chemically synthesized
gaggggtgggggtagggtag

SEQ ID NO: 478354 - DNA, 20 bp, Artificial Sequence
  chemically synthesized
tatttcatagagttggtgta

SEQ ID NO: 478355 - DNA, 20 bp, Artificial Sequence
  chemically synthesized
gataaagaaggcctatttca

SEQ ID NO: 478356 - DNA, 20 bp, Artificial Sequence
  chemically synthesized
aactcgtggtttcctcgata

SEQ ID NO: 478357 - DNA, 20 bp, Artificial Sequence
  chemically synthesized
tatcccctatcgaggaaacc

SEQ ID NO: 478358 - DNA, 20 bp, Artificial Sequence
  chemically synthesized
aaagtaacttatacaaatca

SEQ ID NO: 478359 - DNA, 20 bp, Artificial Sequence
  chemically synthesized
ttgttgttatgtggcagaag

SEQ ID NO: 478360 - DNA, 20 bp, Artificial Sequence
  chemically synthesized
acactggagcttggagggaa

SEQ ID NO: 478361 - DNA, 20 bp, Artificial Sequence
  chemically synthesized
agtcacttgctttgtattta

SEQ ID NO: 478362 - DNA, 20 bp, Artificial Sequence
  chemically synthesized
aatatctcacagatgcctta

SEQ ID NO: 478363 - DNA, 20 bp, Artificial Sequence
  chemically synthesized
tttagtttcagagcactgat

SEQ ID NO: 478364 - DNA, 20 bp, Artificial Sequence
  chemically synthesized
ctgataggaatggtcaacaa

SEQ ID NO: 478365 - DNA, 20 bp, Artificial Sequence
  chemically synthesized
atattagttctgagttgact

SEQ ID NO: 478366 - DNA, 20 bp, Artificial Sequence
  chemically synthesized
aaacatcaatgatattagtt

SEQ ID NO: 478367 - DNA, 20 bp, Artificial Sequence
  chemically synthesized
aactaatatcattgatgttt

SEQ ID NO: 478368 - DNA, 20 bp, Artificial Sequence
  chemically synthesized
gagttacctatttgaagaat

SEQ ID NO: 478369 - DNA, 20 bp, Artificial Sequence
  chemically synthesized
ggaagagagttacctatttg

SEQ ID NO: 478370 - DNA, 20 bp, Artificial Sequence
  chemically synthesized
tatgtattggtccatgggaa

SEQ ID NO: 478371 - DNA, 20 bp, Artificial Sequence
  chemically synthesized
caatttgtctatattacata

SEQ ID NO: 478372 - DNA, 20 bp, Artificial Sequence
  chemically synthesized
gctcgaaaagctcttatttc

SEQ ID NO: 478373 - DNA, 20 bp, Artificial Sequence
  chemically synthesized
aagctattttttgtcctcca

SEQ ID NO: 478374 - DNA, 20 bp, Artificial Sequence
  chemically synthesized
aataattaaaacaagccaga

SEQ ID NO: 478375 - DNA, 20 bp, Artificial Sequence
  chemically synthesized
ctctggcttgttttaattat

SEQ ID NO: 478376 - DNA, 20 bp, Artificial Sequence
  chemically synthesized
ttagggggtaaagtggggga

SEQ ID NO: 478377 - DNA, 20 bp, Artificial Sequence
  chemically synthesized
ggtttttagggggtaaagtg

SEQ ID NO: 478378 - DNA, 20 bp, Artificial Sequence
  chemically synthesized
ggagtattttgaggttttta

SEQ ID NO: 478379 - DNA, 20 bp, Artificial Sequence
  chemically synthesized
gggttgttttgtggttgcgt

SEQ ID NO: 478380 - DNA, 20 bp, Artificial Sequence
  chemically synthesized
tgtaaacaattacatcagtg

SEQ ID NO: 478381 - DNA, 20 bp, Artificial Sequence
  chemically synthesized
aatgaatacagttgtgtctg

SEQ ID NO: 478382 - DNA, 20 bp, Artificial Sequence
  chemically synthesized
agacacaactgtattcattt

SEQ ID NO: 478383 - DNA, 20 bp, Artificial Sequence
  chemically synthesized
gggctaaagagtacccacaa

SEQ ID NO: 478384 - DNA, 20 bp, Artificial Sequence
  chemically synthesized
tatctctatgctgtgggcta

SEQ ID NO: 478385 - DNA, 20 bp, Artificial Sequence
  chemically synthesized
tttctaggtattcataagtt

SEQ ID NO: 478386 - DNA, 20 bp, Artificial Sequence
  chemically synthesized
ttctttaacattcaaaactt

SEQ ID NO: 478387 - DNA, 20 bp, Artificial Sequence
  chemically synthesized
ctaaagtcctgctgatataa

SEQ ID NO: 478388 - DNA, 20 bp, Artificial Sequence
  chemically synthesized
taactcactgaagatcacca

SEQ ID NO: 478389 - DNA, 20 bp, Artificial Sequence
  chemically synthesized
tgattctctggtgatcttca

SEQ ID NO: 478390 - DNA, 20 bp, Artificial Sequence
  chemically synthesized
agagcaaattctttcttctg

SEQ ID NO: 478391 - DNA, 20 bp, Artificial Sequence
  chemically synthesized
aagtcacactctccagaaga

SEQ ID NO: 478392 - DNA, 20 bp, Artificial Sequence
  chemically synthesized
ataagagaagaaaagcaaaa

SEQ ID NO: 478393 - DNA, 20 bp, Artificial Sequence
  chemically synthesized
gcttttcttctcttatacaa

SEQ ID NO: 478394 - DNA, 20 bp, Artificial Sequence
  chemically synthesized
ttttcctcatacattaacaa

SEQ ID NO: 478395 - DNA, 20 bp, Artificial Sequence
  chemically synthesized
tgaggaaaaggaggaagaca

SEQ ID NO: 478396 - DNA, 20 bp, Artificial Sequence
  chemically synthesized
aaagctcatgaatgggttct

SEQ ID NO: 478397 - DNA, 20 bp, Artificial Sequence
  chemically synthesized
tcacaatggaaagctcatga

SEQ ID NO: 478398 - DNA, 20 bp, Artificial Sequence
  chemically synthesized
catatcacaatggaaagctc

SEQ ID NO: 478399 - DNA, 20 bp, Artificial Sequence
  chemically synthesized
attacagttctagatgagat

SEQ ID NO: 478400 - DNA, 20 bp, Artificial Sequence
  chemically synthesized
tcacctcccaccaggttccc

SEQ ID NO: 478401 - DNA, 20 bp, Artificial Sequence
  chemically synthesized
gggaacctggtgggaggtga

SEQ ID NO: 478402 - DNA, 20 bp, Artificial Sequence
  chemically synthesized
gtgggaggtgattggatcat

SEQ ID NO: 478403 - DNA, 20 bp, Artificial Sequence
  chemically synthesized
tgctgttttcccatgtgata

SEQ ID NO: 478404 - DNA, 20 bp, Artificial Sequence
  chemically synthesized
gttttcccatgtgatagtga

SEQ ID NO: 478405 - DNA, 20 bp, Artificial Sequence
  chemically synthesized
gcaggagagagagagaaaga

SEQ ID NO: 478406 - DNA, 20 bp, Artificial Sequence
  chemically synthesized
ggcagcaggagagagagaga

SEQ ID NO: 478407 - DNA, 20 bp, Artificial Sequence
  chemically synthesized
ctccccagccacacagaact

SEQ ID NO: 478408 - DNA, 20 bp, Artificial Sequence
  chemically synthesized
ataaagaacttccctgagac

SEQ ID NO: 478409 - DNA, 20 bp, Artificial Sequence
  chemically synthesized
actgaactgaatgctttggg

SEQ ID NO: 478410 - DNA, 20 bp, Artificial Sequence
  chemically synthesized
ctagcatcttctgaactgaa

SEQ ID NO: 478411 - DNA, 20 bp, Artificial Sequence
  chemically synthesized
ctgcttcagtgagatggtct

SEQ ID NO: 478412 - DNA, 20 bp, Artificial Sequence
  chemically synthesized
ccatctcactgaagcaggtc

SEQ ID NO: 478413 - DNA, 20 bp, Artificial Sequence
  chemically synthesized
cttcttctttttttttgaga

SEQ ID NO: 478414 - DNA, 20 bp, Artificial Sequence
  chemically synthesized
tcttgctctgttgcccaggc

SEQ ID NO: 478415 - DNA, 20 bp, Artificial Sequence
  chemically synthesized
ctcactgcaagctccacctc

SEQ ID NO: 478416 - DNA, 20 bp, Artificial Sequence
  chemically synthesized
tacttgggaggctgaggcag

SEQ ID NO: 478417 - DNA, 20 bp, Artificial Sequence
  chemically synthesized
ttttgtattttaagtagata

SEQ ID NO: 478418 - DNA, 20 bp, Artificial Sequence
  chemically synthesized
cggggtgtcaccatgttagc

SEQ ID NO: 478419 - DNA, 20 bp, Artificial Sequence
  chemically synthesized
acctcagcctcccaaagtgc

SEQ ID NO: 478420 - DNA, 20 bp, Artificial Sequence
  chemically synthesized
ttcccaaaccttgctctttt

SEQ ID NO: 478421 - DNA, 20 bp, Artificial Sequence
  chemically synthesized
tgaagaactagaacagataa

SEQ ID NO: 478422 - DNA, 20 bp, Artificial Sequence
  chemically synthesized
gactttacagattattttac

SEQ ID NO: 478423 - DNA, 20 bp, Artificial Sequence
  chemically synthesized
ttttacaagaatttttacat

SEQ ID NO: 478424 - DNA, 20 bp, Artificial Sequence
  chemically synthesized
acttttttttttttttgaga

SEQ ID NO: 478425 - DNA, 20 bp, Artificial Sequence
  chemically synthesized
tttgctcttgtcgcccaggc

SEQ ID NO: 478426 - DNA, 20 bp, Artificial Sequence
  chemically synthesized
ctgcaacctctgtccccctc

SEQ ID NO: 478427 - DNA, 20 bp, Artificial Sequence
  chemically synthesized
tactcaggaggctgaggcag

SEQ ID NO: 478428 - DNA, 20 bp, Artificial Sequence
  chemically synthesized
gattctcctgcctcagcctc

SEQ ID NO: 478429 - DNA, 20 bp, Artificial Sequence
  chemically synthesized
gcctcagcctcctgagtagc

SEQ ID NO: 478430 - DNA, 20 bp, Artificial Sequence
  chemically synthesized
ttttttatttttagtagaga

SEQ ID NO: 478431 - DNA, 20 bp, Artificial Sequence
  chemically synthesized
caggtgggtcacataaggtt

SEQ ID NO: 478432 - DNA, 20 bp, Artificial Sequence
  chemically synthesized
actttgggaagctgaggcag

SEQ ID NO: 478433 - DNA, 20 bp, Artificial Sequence
  chemically synthesized
gcctcagcttcccaaagtgc

SEQ ID NO: 478434 - DNA, 20 bp, Artificial Sequence
  chemically synthesized
gaaatctgcttcataacacc

SEQ ID NO: 478435 - DNA, 20 bp, Artificial Sequence
  chemically synthesized
acaatttctcatttcttact

SEQ ID NO: 478436 - DNA, 20 bp, Artificial Sequence
  chemically synthesized
tatcagcattgtcgctgacc

SEQ ID NO: 478437 - DNA, 20 bp, Artificial Sequence
  chemically synthesized
gaggcttcttcgtttatact

SEQ ID NO: 478438 - DNA, 20 bp, Artificial Sequence
  chemically synthesized
gcctcatggtgacccaaaca

SEQ ID NO: 478439 - DNA, 20 bp, Artificial Sequence
  chemically synthesized
cttagttaacaattctctgt

SEQ ID NO: 478440 - DNA, 20 bp, Artificial Sequence
  chemically synthesized
tctacccctgccttagaagg

SEQ ID NO: 478441 - DNA, 20 bp, Artificial Sequence
  chemically synthesized
ttgatccacccttctaaggc

SEQ ID NO: 478442 - DNA, 20 bp, Artificial Sequence
  chemically synthesized
cttttctacccctgccttag

SEQ ID NO: 478443 - DNA, 20 bp, Artificial Sequence
  chemically synthesized
gaaatgttgtaaatctctgc

SEQ ID NO: 478444 - DNA, 20 bp, Artificial Sequence
  chemically synthesized
agaaaaatattcaccaacag

SEQ ID NO: 478445 - DNA, 20 bp, Artificial Sequence
  chemically synthesized
ggtttctcattctcctgttg

SEQ ID NO: 478446 - DNA, 20 bp, Artificial Sequence
  chemically synthesized
caggagaatgagaaaccaac

SEQ ID NO: 478447 - DNA, 20 bp, Artificial Sequence
  chemically synthesized
aagtctttttattttctgtt

SEQ ID NO: 478448 - DNA, 20 bp, Artificial Sequence
  chemically synthesized
acctttctgcctggttttgt

SEQ ID NO: 478449 - DNA, 20 bp, Artificial Sequence
  chemically synthesized
caaaaggaaaacatcaaaaa

SEQ ID NO: 478450 - DNA, 20 bp, Artificial Sequence
  chemically synthesized
ttgtgggctggcagaaagat

SEQ ID NO: 478451 - DNA, 20 bp, Artificial Sequence
  chemically synthesized
gagtatttttagtaaaagtt

SEQ ID NO: 478452 - DNA, 20 bp, Artificial Sequence
  chemically synthesized
aacttacatcttgtagtttt

SEQ ID NO: 478453 - DNA, 20 bp, Artificial Sequence
  chemically synthesized
tacaagtgatgatatttgat

SEQ ID NO: 478454 - DNA, 20 bp, Artificial Sequence
  chemically synthesized
gatatttgatcagggtcttg

SEQ ID NO: 478455 - DNA, 20 bp, Artificial Sequence
  chemically synthesized
tttgatcagggtcttgaggg

SEQ ID NO: 478456 - DNA, 20 bp, Artificial Sequence
  chemically synthesized
gctggccaggggagaagtgg

SEQ ID NO: 478457 - DNA, 20 bp, Artificial Sequence
  chemically synthesized
tttgaagcagtgggaaaaac

SEQ ID NO: 478458 - DNA, 20 bp, Artificial Sequence
  chemically synthesized
agttgaagataagacgagat

SEQ ID NO: 478459 - DNA, 20 bp, Artificial Sequence
  chemically synthesized
gggtcttcccctcttccctc

SEQ ID NO: 478460 - DNA, 20 bp, Artificial Sequence
  chemically synthesized
actctgtctctcttcccgcc

SEQ ID NO: 478461 - DNA, 20 bp, Artificial Sequence
  chemically synthesized
acccatggcgggaagagaga

SEQ ID NO: 478462 - DNA, 20 bp, Artificial Sequence
  chemically synthesized
agctgcacaggaaggagggc

SEQ ID NO: 478463 - DNA, 20 bp, Artificial Sequence
  chemically synthesized
aggggcttgtgtatcaagct

SEQ ID NO: 478464 - DNA, 20 bp, Artificial Sequence
  chemically synthesized
aaacagattagacatcttca

SEQ ID NO: 478465 - DNA, 20 bp, Artificial Sequence
  chemically synthesized
ggcaagaacattagaggcaa

SEQ ID NO: 478466 - DNA, 20 bp, Artificial Sequence
  chemically synthesized
ctaaactgaggtaatagaca

SEQ ID NO: 478467 - DNA, 20 bp, Artificial Sequence
  chemically synthesized
ggagatatttttgagagatc

SEQ ID NO: 478468 - DNA, 20 bp, Artificial Sequence
  chemically synthesized
gaatacaacttagagactga

SEQ ID NO: 478469 - DNA, 20 bp, Artificial Sequence
  chemically synthesized
cttagagactgactgaatgc

SEQ ID NO: 478470 - DNA, 20 bp, Artificial Sequence
  chemically synthesized
ataacatatagggaggcaag

SEQ ID NO: 478471 - DNA, 20 bp, Artificial Sequence
  chemically synthesized
tctggcttagagaagaagat

SEQ ID NO: 478472 - DNA, 20 bp, Artificial Sequence
  chemically synthesized
tgctacctattattaaagtg

SEQ ID NO: 478473 - DNA, 20 bp, Artificial Sequence
  chemically synthesized
cttagcctgtcacttagtga

SEQ ID NO: 478474 - DNA, 20 bp, Artificial Sequence
  chemically synthesized
tagtgatagggtgtggaagg

SEQ ID NO: 478475 - DNA, 20 bp, Artificial Sequence
  chemically synthesized
agtggtgttgacctttgtcg

SEQ ID NO: 478476 - DNA, 20 bp, Artificial Sequence
  chemically synthesized
tcaggctaccatgcccatga

SEQ ID NO: 478477 - DNA, 20 bp, Artificial Sequence
  chemically synthesized
tatttcaggctaccatgccc

SEQ ID NO: 478478 - DNA, 20 bp, Artificial Sequence
  chemically synthesized
cggtaaagaagggcccagca

SEQ ID NO: 478479 - DNA, 20 bp, Artificial Sequence
  chemically synthesized
gttcacgctcacaggcacgt

SEQ ID NO: 478480 - DNA, 20 bp, Artificial Sequence
  chemically synthesized
tagtacagtggttctcaaac

SEQ ID NO: 478481 - DNA, 20 bp, Artificial Sequence
  chemically synthesized
tctcaaacttgagtgggctt

SEQ ID NO: 478482 - DNA, 20 bp, Artificial Sequence
  chemically synthesized
cctgtgttttaatgagccct

SEQ ID NO: 478483 - DNA, 20 bp, Artificial Sequence
  chemically synthesized
catacagaatcatgatctct

SEQ ID NO: 478484 - DNA, 20 bp, Artificial Sequence
  chemically synthesized
agatcatgattctgtatgtc

SEQ ID NO: 478485 - DNA, 20 bp, Artificial Sequence
  chemically synthesized
tgagttctaccccagacata

SEQ ID NO: 478486 - DNA, 20 bp, Artificial Sequence
  chemically synthesized
gtatgtctggggtagaactc

SEQ ID NO: 478487 - DNA, 20 bp, Artificial Sequence
  chemically synthesized
cttctaagaaatgcaaattc

SEQ ID NO: 478488 - DNA, 20 bp, Artificial Sequence
  chemically synthesized
tagtccagagaccccatttt

SEQ ID NO: 478489 - DNA, 20 bp, Artificial Sequence
  chemically synthesized
acagtgtttcattcttaaaa

SEQ ID NO: 478490 - DNA, 20 bp, Artificial Sequence
  chemically synthesized
cccttaatcttctggaggtc

SEQ ID NO: 478491 - DNA, 20 bp, Artificial Sequence
  chemically synthesized
gaggtcatgaatgcctttat

SEQ ID NO: 478492 - DNA, 20 bp, Artificial Sequence
  chemically synthesized
tgaatgcctttataagaatg

SEQ ID NO: 478493 - DNA, 20 bp, Artificial Sequence
  chemically synthesized
attaatccattgtatgtccc

SEQ ID NO: 478494 - DNA, 20 bp, Artificial Sequence
  chemically synthesized
ctccacccccgggacataca

SEQ ID NO: 478495 - DNA, 20 bp, Artificial Sequence
  chemically synthesized
ctcctttaaaatggtactgg

SEQ ID NO: 478496 - DNA, 20 bp, Artificial Sequence
  chemically synthesized
aaaggagaacccccaagaag

SEQ ID NO: 478497 - DNA, 20 bp, Artificial Sequence
  chemically synthesized
tccaatgtattcttcttctt

SEQ ID NO: 478498 - DNA, 20 bp, Artificial Sequence
  chemically synthesized
ttttacttatttagttgtct

SEQ ID NO: 478499 - DNA, 20 bp, Artificial Sequence
  chemically synthesized
attttgtacgtaggctcact

SEQ ID NO: 478500 - DNA, 20 bp, Artificial Sequence
  chemically synthesized
gacaggtctccttccccaaa

SEQ ID NO: 478501 - DNA, 20 bp, Artificial Sequence
  chemically synthesized
gacctgtcaaaggacagttc

SEQ ID NO: 478502 - DNA, 20 bp, Artificial Sequence
  chemically synthesized
ctgaatgtggttagagtgaa

SEQ ID NO: 478503 - DNA, 20 bp, Artificial Sequence
  chemically synthesized
tcaggttatctgaatgtggt

SEQ ID NO: 478504 - DNA, 20 bp, Artificial Sequence
  chemically synthesized
atgggaaaaggtcaggttat

SEQ ID NO: 478505 - DNA, 20 bp, Artificial Sequence
  chemically synthesized
tgttatttgttacttcccaa

SEQ ID NO: 478506 - DNA, 20 bp, Artificial Sequence
  chemically synthesized
aagtaacaaataacagagag

SEQ ID NO: 478507 - DNA, 20 bp, Artificial Sequence
  chemically synthesized
aacaaataacagagaggtgg

SEQ ID NO: 478508 - DNA, 20 bp, Artificial Sequence
  chemically synthesized
gggtgggtaaccatggagaa

SEQ ID NO: 478509 - DNA, 20 bp, Artificial Sequence
  chemically synthesized
ttccacaggcaggcccctgg

SEQ ID NO: 478510 - DNA, 20 bp, Artificial Sequence
  chemically synthesized
gatcaaaggaaaagataatt

SEQ ID NO: 478511 - DNA, 20 bp, Artificial Sequence
  chemically synthesized
gagcattttgactttaccct

SEQ ID NO: 478512 - DNA, 20 bp, Artificial Sequence
  chemically synthesized
aagcacataagaaagattct

SEQ ID NO: 478513 - DNA, 20 bp, Artificial Sequence
  chemically synthesized
gaacacctctgcttcctttc

SEQ ID NO: 478514 - DNA, 20 bp, Artificial Sequence
  chemically synthesized
gcagaggtgttctttattgc

SEQ ID NO: 478515 - DNA, 20 bp, Artificial Sequence
  chemically synthesized
cttcatgcatgcatgcagag

SEQ ID NO: 478516 - DNA, 20 bp, Artificial Sequence
  chemically synthesized
ttgaatttatagttgccaaa

SEQ ID NO: 478517 - DNA, 20 bp, Artificial Sequence
  chemically synthesized
cccaacctcagagccatcat

SEQ ID NO: 478518 - DNA, 20 bp, Artificial Sequence
  chemically synthesized
gaagtgatagtgctacaggc

SEQ ID NO: 478519 - DNA, 20 bp, Artificial Sequence
  chemically synthesized
aatctagggaaaatacgcct

SEQ ID NO: 478520 - DNA, 20 bp, Artificial Sequence
  chemically synthesized
gctaaaacattaccatcaga

SEQ ID NO: 478521 - DNA, 20 bp, Artificial Sequence
  chemically synthesized
aagaattgaagacagaggag

SEQ ID NO: 478522 - DNA, 20 bp, Artificial Sequence
  chemically synthesized
cccaataaaagtttgctgag

SEQ ID NO: 478523 - DNA, 20 bp, Artificial Sequence
  chemically synthesized
ttcttctcagcaaactttta

SEQ ID NO: 478524 - DNA, 20 bp, Artificial Sequence
  chemically synthesized
aattgctctgtaaatgtgcc

SEQ ID NO: 478525 - DNA, 20 bp, Artificial Sequence
  chemically synthesized
ggggtcattccataggctgg

SEQ ID NO: 478526 - DNA, 20 bp, Artificial Sequence
  chemically synthesized
gctctcactcagccagccta

SEQ ID NO: 478527 - DNA, 20 bp, Artificial Sequence
  chemically synthesized
gaatcttatcagagtgaaac

SEQ ID NO: 478528 - DNA, 20 bp, Artificial Sequence
  chemically synthesized
acaaagccatggaatcttat

SEQ ID NO: 478529 - DNA, 20 bp, Artificial Sequence
  chemically synthesized
attagcctcaaacaaagcca

SEQ ID NO: 478530 - DNA, 20 bp, Artificial Sequence
  chemically synthesized
aagagacagaacgaagggag

SEQ ID NO: 478531 - DNA, 20 bp, Artificial Sequence
  chemically synthesized
caaggagtttcttgttgcct

SEQ ID NO: 478532 - DNA, 20 bp, Artificial Sequence
  chemically synthesized
agtgttcacttccgtgctca

SEQ ID NO: 478533 - DNA, 20 bp, Artificial Sequence
  chemically synthesized
aacggacaggtgaaagctga

SEQ ID NO: 478534 - DNA, 20 bp, Artificial Sequence
  chemically synthesized
gcaatcacacttaaaaccat

SEQ ID NO: 478535 - DNA, 20 bp, Artificial Sequence
  chemically synthesized
aaactacaggttacaattcc

SEQ ID NO: 478536 - DNA, 20 bp, Artificial Sequence
  chemically synthesized
tacaggttacaattccctga

SEQ ID NO: 478537 - DNA, 20 bp, Artificial Sequence
  chemically synthesized
ggttacaattccctgaatgg

SEQ ID NO: 478538 - DNA, 20 bp, Artificial Sequence
  chemically synthesized
agcaagcattcatccattca

SEQ ID NO: 478539 - DNA, 20 bp, Artificial Sequence
  chemically synthesized
agaaagcaaggaaatactcc

SEQ ID NO: 478540 - DNA, 20 bp, Artificial Sequence
  chemically synthesized
tttcaaacattgactactca

SEQ ID NO: 478541 - DNA, 20 bp, Artificial Sequence
  chemically synthesized
taggcaagctattttcgggt

SEQ ID NO: 478542 - DNA, 20 bp, Artificial Sequence
  chemically synthesized
tctgggtaggcaagctattt

SEQ ID NO: 478543 - DNA, 20 bp, Artificial Sequence
  chemically synthesized
tgaatactatgagtcaggat

SEQ ID NO: 478544 - DNA, 20 bp, Artificial Sequence
  chemically synthesized
atttaatgaatactatgagt

SEQ ID NO: 478545 - DNA, 20 bp, Artificial Sequence
  chemically synthesized
catatcatttaatgaatact

SEQ ID NO: 478546 - DNA, 20 bp, Artificial Sequence
  chemically synthesized
aaatcagttcatatcattta

SEQ ID NO: 478547 - DNA, 20 bp, Artificial Sequence
  chemically synthesized
aaatcatattaacacatggg

SEQ ID NO: 478548 - DNA, 20 bp, Artificial Sequence
  chemically synthesized
tctattatttaatgatcatc

SEQ ID NO: 478549 - DNA, 20 bp, Artificial Sequence
  chemically synthesized
aagtcctcttttaaatgctt

SEQ ID NO: 478550 - DNA, 20 bp, Artificial Sequence
  chemically synthesized
acatggcatattgagtctcc

SEQ ID NO: 478551 - DNA, 20 bp, Artificial Sequence
  chemically synthesized
cgtagacattacatggcata

SEQ ID NO: 478552 - DNA, 20 bp, Artificial Sequence
  chemically synthesized
tgtctacgttacttacagca

SEQ ID NO: 478553 - DNA, 20 bp, Artificial Sequence
  chemically synthesized
ttagcacaatattttgtttg

SEQ ID NO: 478554 - DNA, 20 bp, Artificial Sequence
  chemically synthesized
ttcataactcccaacatcac

SEQ ID NO: 478555 - DNA, 20 bp, Artificial Sequence
  chemically synthesized
aaatttatccttgtgatgtt

SEQ ID NO: 478556 - DNA, 20 bp, Artificial Sequence
  chemically synthesized
ttaatgatattttaaaacac

SEQ ID NO: 478557 - DNA, 20 bp, Artificial Sequence
  chemically synthesized
ttaaaatatcattaaatgta

SEQ ID NO: 478558 - DNA, 20 bp, Artificial Sequence
  chemically synthesized
ataattagtagaaatcattt

SEQ ID NO: 478559 - DNA, 20 bp, Artificial Sequence
  chemically synthesized
aagcacagtaactatttgat

SEQ ID NO: 478560 - DNA, 20 bp, Artificial Sequence
  chemically synthesized
aacgtagcatttcaccgtca

SEQ ID NO: 478561 - DNA, 20 bp, Artificial Sequence
  chemically synthesized
ggaaggttatttggttaaaa

SEQ ID NO: 478562 - DNA, 20 bp, Artificial Sequence
  chemically synthesized
caaataaccttccttaaacc

SEQ ID NO: 478563 - DNA, 20 bp, Artificial Sequence
  chemically synthesized
atggtgatagtgtgaaacag

SEQ ID NO: 478564 - DNA, 20 bp, Artificial Sequence
  chemically synthesized
actatcaccatcacagataa

SEQ ID NO: 478565 - DNA, 20 bp, Artificial Sequence
  chemically synthesized
tgtaagcaaacagttctact

SEQ ID NO: 478566 - DNA, 20 bp, Artificial Sequence
  chemically synthesized
ggtagtagaagcttggctaa

SEQ ID NO: 478567 - DNA, 20 bp, Artificial Sequence
  chemically synthesized
cattgccatggaaaatcctc

SEQ ID NO: 478568 - DNA, 20 bp, Artificial Sequence
  chemically synthesized
ctgctacccaagttatcctg

SEQ ID NO: 478569 - DNA, 20 bp, Artificial Sequence
  chemically synthesized
ggaaaatcctccaggataac

SEQ ID NO: 478570 - DNA, 20 bp, Artificial Sequence
  chemically synthesized
acagtagcaactggaagcag

SEQ ID NO: 478571 - DNA, 20 bp, Artificial Sequence
  chemically synthesized
ctcttccgcatttaaaacac

SEQ ID NO: 478572 - DNA, 20 bp, Artificial Sequence
  chemically synthesized
atatttcttctcactaaata

SEQ ID NO: 478573 - DNA, 20 bp, Artificial Sequence
  chemically synthesized
tttatgagtaaagatgtcaa

SEQ ID NO: 478574 - DNA, 20 bp, Artificial Sequence
  chemically synthesized
ggattgcttttacttatttt

SEQ ID NO: 478575 - DNA, 20 bp, Artificial Sequence
  chemically synthesized
tagagaactctttgtaagtt

SEQ ID NO: 478576 - DNA, 20 bp, Artificial Sequence
  chemically synthesized
aaagcaatccccaacttaca

SEQ ID NO: 478577 - DNA, 20 bp, Artificial Sequence
  chemically synthesized
tgtccatggaaatttgagtt

SEQ ID NO: 478578 - DNA, 20 bp, Artificial Sequence
  chemically synthesized
actattgtgtccatggaaat

SEQ ID NO: 478579 - DNA, 20 bp, Artificial Sequence
  chemically synthesized
atagctatttaacctatacc

SEQ ID NO: 478580 - DNA, 20 bp, Artificial Sequence
  chemically synthesized
atcattttgatagcatgact

SEQ ID NO: 478581 - DNA, 20 bp, Artificial Sequence
  chemically synthesized
tttgggaaatatgcatcttt

SEQ ID NO: 478582 - DNA, 20 bp, Artificial Sequence
  chemically synthesized
gtatttcttttccgtacttc

SEQ ID NO: 478583 - DNA, 20 bp, Artificial Sequence
  chemically synthesized
aatacttcctattttaagac

SEQ ID NO: 478584 - DNA, 20 bp, Artificial Sequence
  chemically synthesized
ccatttatatatctcctttg

SEQ ID NO: 478585 - DNA, 20 bp, Artificial Sequence
  chemically synthesized
attaaaacataaggaagttt

SEQ ID NO: 478586 - DNA, 20 bp, Artificial Sequence
  chemically synthesized
ttcaacagatagaagagaat

SEQ ID NO: 478587 - DNA, 20 bp, Artificial Sequence
  chemically synthesized
aagattttcaacagatagaa

SEQ ID NO: 478588 - DNA, 20 bp, Artificial Sequence
  chemically synthesized
aagttgtcagtctatacttt

SEQ ID NO: 478589 - DNA, 20 bp, Artificial Sequence
  chemically synthesized
tttaaaatataaaaatctcc

SEQ ID NO: 478590 - DNA, 20 bp, Artificial Sequence
  chemically synthesized
accttggcctgacaacgtgc

SEQ ID NO: 478591 - DNA, 20 bp, Artificial Sequence
  chemically synthesized
cagcacgttgtcaggccaag

SEQ ID NO: 478592 - DNA, 20 bp, Artificial Sequence
  chemically synthesized
acgttgtcaggccaaggtgg

SEQ ID NO: 478593 - DNA, 20 bp, Artificial Sequence
  chemically synthesized
tgggtggatcacttcagccc

SEQ ID NO: 478594 - DNA, 20 bp, Artificial Sequence
  chemically synthesized
ttttgtattttctgtagaaa

SEQ ID NO: 478595 - DNA, 20 bp, Artificial Sequence
  chemically synthesized
acagaaaatacaaaaagtag

SEQ ID NO: 478596 - DNA, 20 bp, Artificial Sequence
  chemically synthesized
tgggaggctgaggtgggagg

SEQ ID NO: 478597 - DNA, 20 bp, Artificial Sequence
  chemically synthesized
agggaggatcacctgagccc

SEQ ID NO: 478598 - DNA, 20 bp, Artificial Sequence
  chemically synthesized
ttgtgccactgcactccagc

SEQ ID NO: 478599 - DNA, 20 bp, Artificial Sequence
  chemically synthesized
tcataccctgtcacccaggc

SEQ ID NO: 478600 - DNA, 20 bp, Artificial Sequence
  chemically synthesized
ctgcactccagcctgggtga

SEQ ID NO: 478601 - DNA, 20 bp, Artificial Sequence
  chemically synthesized
cttccccttttttttggaga

SEQ ID NO: 478602 - DNA, 20 bp, Artificial Sequence
  chemically synthesized
tctccaaaaaaaaggggaag

SEQ ID NO: 478603 - DNA, 20 bp, Artificial Sequence
  chemically synthesized
ctgagttaaaccaaaccaat

SEQ ID NO: 478604 - DNA, 20 bp, Artificial Sequence
  chemically synthesized
caatctgaatcacagattga

SEQ ID NO: 478605 - DNA, 20 bp, Artificial Sequence
  chemically synthesized
cacagattgataggatttcc

SEQ ID NO: 478606 - DNA, 20 bp, Artificial Sequence
  chemically synthesized
gataggatttccaagaatat

SEQ ID NO: 478607 - DNA, 20 bp, Artificial Sequence
  chemically synthesized
ccagacgcttatgctaccat

SEQ ID NO: 478608 - DNA, 20 bp, Artificial Sequence
  chemically synthesized
accaaagtagattgcctacc

SEQ ID NO: 478609 - DNA, 20 bp, Artificial Sequence
  chemically synthesized
tttccaacctgtccaactgg

SEQ ID NO: 478610 - DNA, 20 bp, Artificial Sequence
  chemically synthesized
atgcagctagtgttctgatt

SEQ ID NO: 478611 - DNA, 20 bp, Artificial Sequence
  chemically synthesized
ctagtgttctgattatgaat

SEQ ID NO: 478612 - DNA, 20 bp, Artificial Sequence
  chemically synthesized
tgaattaggatataataagt

SEQ ID NO: 478613 - DNA, 20 bp, Artificial Sequence
  chemically synthesized
tgtagaaaatttaaatttaa

SEQ ID NO: 478614 - DNA, 20 bp, Artificial Sequence
  chemically synthesized
aaacatgagatttcctacat

SEQ ID NO: 478615 - DNA, 20 bp, Artificial Sequence
  chemically synthesized
caataagaaactaccatctc

SEQ ID NO: 478616 - DNA, 20 bp, Artificial Sequence
  chemically synthesized
ccggagatggtagtttctta

SEQ ID NO: 478617 - DNA, 20 bp, Artificial Sequence
  chemically synthesized
tgatatgtgtctaacgtacc

SEQ ID NO: 478618 - DNA, 20 bp, Artificial Sequence
  chemically synthesized
ggccctgaaggtcaatataa

SEQ ID NO: 478619 - DNA, 20 bp, Artificial Sequence
  chemically synthesized
gcagagatttcccatcacag

SEQ ID NO: 478620 - DNA, 20 bp, Artificial Sequence
  chemically synthesized
atttcccatcacagaaggat

SEQ ID NO: 478621 - DNA, 20 bp, Artificial Sequence
  chemically synthesized
ataggaattgaggaaggcaa

SEQ ID NO: 478622 - DNA, 20 bp, Artificial Sequence
  chemically synthesized
ataatagtaaagtgttccta

SEQ ID NO: 478623 - DNA, 20 bp, Artificial Sequence
  chemically synthesized
catgttatgaaactgttgaa

SEQ ID NO: 478624 - DNA, 20 bp, Artificial Sequence
  chemically synthesized
gacatcatgttatgaaactg

SEQ ID NO: 478625 - DNA, 20 bp, Artificial Sequence
  chemically synthesized
acatacgtatagtcacatgg

SEQ ID NO: 478626 - DNA, 20 bp, Artificial Sequence
  chemically synthesized
atagtcacatggaggggtgg

SEQ ID NO: 478627 - DNA, 20 bp, Artificial Sequence
  chemically synthesized
agctcgatttattgagcgcc

SEQ ID NO: 478628 - DNA, 20 bp, Artificial Sequence
  chemically synthesized
aattgtacatgagatatatg

SEQ ID NO: 478629 - DNA, 20 bp, Artificial Sequence
  chemically synthesized
catcaggaagaaaatatatg

SEQ ID NO: 478630 - DNA, 20 bp, Artificial Sequence
  chemically synthesized
caccctaattacatgagatt

SEQ ID NO: 478631 - DNA, 20 bp, Artificial Sequence
  chemically synthesized
tactcttaatctcatgtaat

SEQ ID NO: 478632 - DNA, 20 bp, Artificial Sequence
  chemically synthesized
caggtttggacaatgaacta

SEQ ID NO: 478633 - DNA, 20 bp, Artificial Sequence
  chemically synthesized
gtccaaacctgaacactttt

SEQ ID NO: 478634 - DNA, 20 bp, Artificial Sequence
  chemically synthesized
tgaacacttttgagagtgtc

SEQ ID NO: 478635 - DNA, 20 bp, Artificial Sequence
  chemically synthesized
ggatgctaataataatcaca

SEQ ID NO: 478636 - DNA, 20 bp, Artificial Sequence
  chemically synthesized
acctcggcctcccaaagcac

SEQ ID NO: 478637 - DNA, 20 bp, Artificial Sequence
  chemically synthesized
gtgctttgggaggccgaggt

SEQ ID NO: 478638 - DNA, 20 bp, Artificial Sequence
  chemically synthesized
taggagtattgcttgaagcc

SEQ ID NO: 478639 - DNA, 20 bp, Artificial Sequence
  chemically synthesized
ttaaaacatattgtagagat

SEQ ID NO: 478640 - DNA, 20 bp, Artificial Sequence
  chemically synthesized
aaaaataaaaaaacagttaa

SEQ ID NO: 478641 - DNA, 20 bp, Artificial Sequence
  chemically synthesized
ttttgtatttttagtagaga

SEQ ID NO: 478642 - DNA, 20 bp, Artificial Sequence
  chemically synthesized
gcctcagcctcctgagtagc

SEQ ID NO: 478643 - DNA, 20 bp, Artificial Sequence
  chemically synthesized
gattctcctgcctcagcctc

SEQ ID NO: 478644 - DNA, 20 bp, Artificial Sequence
  chemically synthesized
tactcaggaggctgaggcag

SEQ ID NO: 478645 - DNA, 20 bp, Artificial Sequence
  chemically synthesized
ctcactgcaacctccacctc

SEQ ID NO: 478646 - DNA, 20 bp, Artificial Sequence
  chemically synthesized
tcgcaccactgcactgcagc

SEQ ID NO: 478647 - DNA, 20 bp, Artificial Sequence
  chemically synthesized
aattttttttttttttgaaa

SEQ ID NO: 478648 - DNA, 20 bp, Artificial Sequence
  chemically synthesized
ccttcagcctactgagtagc

SEQ ID NO: 478649 - DNA, 20 bp, Artificial Sequence
  chemically synthesized
aatcctcctccttcagccta

SEQ ID NO: 478650 - DNA, 20 bp, Artificial Sequence
  chemically synthesized
tactcagtaggctgaaggag

SEQ ID NO: 478651 - DNA, 20 bp, Artificial Sequence
  chemically synthesized
gaggaggattgcttgagctc

SEQ ID NO: 478652 - DNA, 20 bp, Artificial Sequence
  chemically synthesized
tcatgccactccactccagc

SEQ ID NO: 478653 - DNA, 20 bp, Artificial Sequence
  chemically synthesized
ctctgtcacccaggctggag

SEQ ID NO: 478654 - DNA, 20 bp, Artificial Sequence
  chemically synthesized
tcttgctctgtcacccaggc

SEQ ID NO: 478655 - DNA, 20 bp, Artificial Sequence
  chemically synthesized
tattttatttattttagaga

SEQ ID NO: 478656 - DNA, 20 bp, Artificial Sequence
  chemically synthesized
atagtaaagtaaagtaacac

SEQ ID NO: 478657 - DNA, 20 bp, Artificial Sequence
  chemically synthesized
taaagtaacacaagaataac

SEQ ID NO: 478658 - DNA, 20 bp, Artificial Sequence
  chemically synthesized
tgggacagccggagacaaat

SEQ ID NO: 478659 - DNA, 20 bp, Artificial Sequence
  chemically synthesized
gcagtcaataaaatgggcaa

SEQ ID NO: 478660 - DNA, 20 bp, Artificial Sequence
  chemically synthesized
cagaccttttgttacttgga

SEQ ID NO: 478661 - DNA, 20 bp, Artificial Sequence
  chemically synthesized
cacgacgttctctttctgcc

SEQ ID NO: 478662 - DNA, 20 bp, Artificial Sequence
  chemically synthesized
cctggggttcactgcacgca

SEQ ID NO: 478663 - DNA, 20 bp, Artificial Sequence
  chemically synthesized
ctttctctgctttccgttcc

SEQ ID NO: 478664 - DNA, 20 bp, Artificial Sequence
  chemically synthesized
tccccacggtgagagggcac

SEQ ID NO: 478665 - DNA, 20 bp, Artificial Sequence
  chemically synthesized
ccaggtgccctctcaccgtg

SEQ ID NO: 478666 - DNA, 20 bp, Artificial Sequence
  chemically synthesized
cactgtcatgagaaagatcc

SEQ ID NO: 478667 - DNA, 20 bp, Artificial Sequence
  chemically synthesized
tttctttcaagaagctattc

SEQ ID NO: 478668 - DNA, 20 bp, Artificial Sequence
  chemically synthesized
tttctttaaaaaaaaaaaaa

SEQ ID NO: 478669 - DNA, 20 bp, Artificial Sequence
  chemically synthesized
taaaaaaaaaaaaaaagaat

SEQ ID NO: 478670 - DNA, 20 bp, Artificial Sequence
  chemically synthesized
aaaaaaaaaaaagaatgcga

SEQ ID NO: 478671 - DNA, 20 bp, Artificial Sequence
  chemically synthesized
tttaatcgtcatttgctaag

SEQ ID NO: 478672 - DNA, 20 bp, Artificial Sequence
  chemically synthesized
tgtcggtaatgcaaacggga

SEQ ID NO: 478673 - DNA, 20 bp, Artificial Sequence
  chemically synthesized
ttaaagtaaatttcaggaaa

SEQ ID NO: 478674 - DNA, 20 bp, Artificial Sequence
  chemically synthesized
aggtatgaaatacaggggga

SEQ ID NO: 478675 - DNA, 20 bp, Artificial Sequence
  chemically synthesized
tatcaggtatgaaatacagg

SEQ ID NO: 478676 - DNA, 20 bp, Artificial Sequence
  chemically synthesized
cacaacaacacagcaaaatc

SEQ ID NO: 478677 - DNA, 20 bp, Artificial Sequence
  chemically synthesized
gactttataaattgaaaatc

SEQ ID NO: 478678 - DNA, 20 bp, Artificial Sequence
  chemically synthesized
gattttcaatttataaagtc

SEQ ID NO: 478679 - DNA, 20 bp, Artificial Sequence
  chemically synthesized
ctctttgaagttctctgatt

SEQ ID NO: 478680 - DNA, 20 bp, Artificial Sequence
  chemically synthesized
tcccagcccttaggagctcc

SEQ ID NO: 478681 - DNA, 20 bp, Artificial Sequence
  chemically synthesized
ttttgctttcaataaagtta

SEQ ID NO: 478682 - DNA, 20 bp, Artificial Sequence
  chemically synthesized
taaagttatcgagtaaatga

SEQ ID NO: 478683 - DNA, 20 bp, Artificial Sequence
  chemically synthesized
catcaaagaaggctaataat

SEQ ID NO: 478684 - DNA, 20 bp, Artificial Sequence
  chemically synthesized
ctaataatgagagtcaagca

SEQ ID NO: 478685 - DNA, 20 bp, Artificial Sequence
  chemically synthesized
ttttattatactctaagttt

SEQ ID NO: 478686 - DNA, 20 bp, Artificial Sequence
  chemically synthesized
tgcacatgtaccctaaaact

SEQ ID NO: 478687 - DNA, 20 bp, Artificial Sequence
  chemically synthesized
taatgctagatgacacgtta

SEQ ID NO: 478688 - DNA, 20 bp, Artificial Sequence
  chemically synthesized
gtggggtcgggggagggggg

SEQ ID NO: 478689 - DNA, 20 bp, Artificial Sequence
  chemically synthesized
tcacactctggggactgtgg

SEQ ID NO: 478690 - DNA, 20 bp, Artificial Sequence
  chemically synthesized
cccgaccccaccacagtccc

SEQ ID NO: 478691 - DNA, 20 bp, Artificial Sequence
  chemically synthesized
gatcacatggacacaggaag

SEQ ID NO: 478692 - DNA, 20 bp, Artificial Sequence
  chemically synthesized
tcattgttcaattcccacct

SEQ ID NO: 478693 - DNA, 20 bp, Artificial Sequence
  chemically synthesized
gcatattctcactcataggt

SEQ ID NO: 478694 - DNA, 20 bp, Artificial Sequence
  chemically synthesized
ttcaattcccacctatgagt

SEQ ID NO: 478695 - DNA, 20 bp, Artificial Sequence
  chemically synthesized
tgttcttgcgatagtttact

SEQ ID NO: 478696 - DNA, 20 bp, Artificial Sequence
  chemically synthesized
ttcatgtccgttgtagggac

SEQ ID NO: 478697 - DNA, 20 bp, Artificial Sequence
  chemically synthesized
ctatgcagccataaaaaatg

SEQ ID NO: 478698 - DNA, 20 bp, Artificial Sequence
  chemically synthesized
tggctgcatagtattccatg

SEQ ID NO: 478699 - DNA, 20 bp, Artificial Sequence
  chemically synthesized
aatgtggcacatatccacca

SEQ ID NO: 478700 - DNA, 20 bp, Artificial Sequence
  chemically synthesized
aaatgtccaacaatgataga

SEQ ID NO: 478701 - DNA, 20 bp, Artificial Sequence
  chemically synthesized
agtctatcattgttggacat

SEQ ID NO: 478702 - DNA, 20 bp, Artificial Sequence
  chemically synthesized
ggttccaagtctttgctatt

SEQ ID NO: 478703 - DNA, 20 bp, Artificial Sequence
  chemically synthesized
gcagcatgatttatagtcct

SEQ ID NO: 478704 - DNA, 20 bp, Artificial Sequence
  chemically synthesized
tttgggtatatacccagtaa

SEQ ID NO: 478705 - DNA, 20 bp, Artificial Sequence
  chemically synthesized
ttgacccagccatcccatta

SEQ ID NO: 478706 - DNA, 20 bp, Artificial Sequence
  chemically synthesized
tatacccagtaatgggatgg

SEQ ID NO: 478707 - DNA, 20 bp, Artificial Sequence
  chemically synthesized
tttctagttctagatccctg

SEQ ID NO: 478708 - DNA, 20 bp, Artificial Sequence
  chemically synthesized
agtcagtgtggcgattcctc

SEQ ID NO: 478709 - DNA, 20 bp, Artificial Sequence
  chemically synthesized
tacagtcccaccaacagtgt

SEQ ID NO: 478710 - DNA, 20 bp, Artificial Sequence
  chemically synthesized
aggaaacaacaggtgctgga

SEQ ID NO: 478711 - DNA, 20 bp, Artificial Sequence
  chemically synthesized
agatatcatctcacaccagt

SEQ ID NO: 478712 - DNA, 20 bp, Artificial Sequence
  chemically synthesized
gtccttcgcccactttttga

SEQ ID NO: 478713 - DNA, 20 bp, Artificial Sequence
  chemically synthesized
tttttttcttgtaaatttgt

SEQ ID NO: 478714 - DNA, 20 bp, Artificial Sequence
  chemically synthesized
gtttgagttcattgtagatt

SEQ ID NO: 478715 - DNA, 20 bp, Artificial Sequence
  chemically synthesized
tctgacaaagggctaatatc

SEQ ID NO: 478716 - DNA, 20 bp, Artificial Sequence
  chemically synthesized
ggatattagccctttgtcag

SEQ ID NO: 478717 - DNA, 20 bp, Artificial Sequence
  chemically synthesized
acagcaaaagaaactaccat

SEQ ID NO: 478718 - DNA, 20 bp, Artificial Sequence
  chemically synthesized
cttttgctgtgcagaagctc

SEQ ID NO: 478719 - DNA, 20 bp, Artificial Sequence
  chemically synthesized
caaaagccaaaattgacaaa

SEQ ID NO: 478720 - DNA, 20 bp, Artificial Sequence
  chemically synthesized
aaactttgaaaaaaatttag

SEQ ID NO: 478721 - DNA, 20 bp, Artificial Sequence
  chemically synthesized
aatttagaagaatgtataac

SEQ ID NO: 478722 - DNA, 20 bp, Artificial Sequence
  chemically synthesized
aagaatgtataactagaata

SEQ ID NO: 478723 - DNA, 20 bp, Artificial Sequence
  chemically synthesized
caaggctcgagaactacgtg

SEQ ID NO: 478724 - DNA, 20 bp, Artificial Sequence
  chemically synthesized
cgatgcgatcaactggaaga

SEQ ID NO: 478725 - DNA, 20 bp, Artificial Sequence
  chemically synthesized
tatcagcaatggaagatgaa

SEQ ID NO: 478726 - DNA, 20 bp, Artificial Sequence
  chemically synthesized
gaagggaagtttagagaaaa

SEQ ID NO: 478727 - DNA, 20 bp, Artificial Sequence
  chemically synthesized
gtgtacctgaaagtgatgtg

SEQ ID NO: 478728 - DNA, 20 bp, Artificial Sequence
  chemically synthesized
ccaagttggaaaacactctg

SEQ ID NO: 478729 - DNA, 20 bp, Artificial Sequence
  chemically synthesized
ttctcctggataatatcctg

SEQ ID NO: 478730 - DNA, 20 bp, Artificial Sequence
  chemically synthesized
actagattggggaagttctc

SEQ ID NO: 478731 - DNA, 20 bp, Artificial Sequence
  chemically synthesized
tgtggcgttctctgtatttc

SEQ ID NO: 478732 - DNA, 20 bp, Artificial Sequence
  chemically synthesized
tcttggagttgctcttctcg

SEQ ID NO: 478733 - DNA, 20 bp, Artificial Sequence
  chemically synthesized
aatctgacaattatgtgtct

SEQ ID NO: 478734 - DNA, 20 bp, Artificial Sequence
  chemically synthesized
ttttccttcatttcaacttg

SEQ ID NO: 478735 - DNA, 20 bp, Artificial Sequence
  chemically synthesized
agggcagccagagagaaagg

SEQ ID NO: 478736 - DNA, 20 bp, Artificial Sequence
  chemically synthesized
agtctgatgggctttccttt

SEQ ID NO: 478737 - DNA, 20 bp, Artificial Sequence
  chemically synthesized
gaaagcccatcagactaaca

SEQ ID NO: 478738 - DNA, 20 bp, Artificial Sequence
  chemically synthesized
ccccactctcttctggcttg

SEQ ID NO: 478739 - DNA, 20 bp, Artificial Sequence
  chemically synthesized
agaaaccctacaagccagaa

SEQ ID NO: 478740 - DNA, 20 bp, Artificial Sequence
  chemically synthesized
aattcttttctttaagaatg

SEQ ID NO: 478741 - DNA, 20 bp, Artificial Sequence
  chemically synthesized
tattcaacattcttaaagaa

SEQ ID NO: 478742 - DNA, 20 bp, Artificial Sequence
  chemically synthesized
ggttgaaaattcttttcttt

SEQ ID NO: 478743 - DNA, 20 bp, Artificial Sequence
  chemically synthesized
aaagaaaagaattttcaacc

SEQ ID NO: 478744 - DNA, 20 bp, Artificial Sequence
  chemically synthesized
gtttggctggatatgaaatt

SEQ ID NO: 478745 - DNA, 20 bp, Artificial Sequence
  chemically synthesized
acttatgaagcttagtttgg

SEQ ID NO: 478746 - DNA, 20 bp, Artificial Sequence
  chemically synthesized
accagctaacatcataatga

SEQ ID NO: 478747 - DNA, 20 bp, Artificial Sequence
  chemically synthesized
taaagttaatattgttatgt

SEQ ID NO: 478748 - DNA, 20 bp, Artificial Sequence
  chemically synthesized
cagtctgtgtcttttaattg

SEQ ID NO: 478749 - DNA, 20 bp, Artificial Sequence
  chemically synthesized
aaaagacacagactggcaag

SEQ ID NO: 478750 - DNA, 20 bp, Artificial Sequence
  chemically synthesized
acagactggcaagttggata

SEQ ID NO: 478751 - DNA, 20 bp, Artificial Sequence
  chemically synthesized
ttcctgaatacagcacactg

SEQ ID NO: 478752 - DNA, 20 bp, Artificial Sequence
  chemically synthesized
ctgcacgtgagatgggtttc

SEQ ID NO: 478753 - DNA, 20 bp, Artificial Sequence
  chemically synthesized
tgtgtgtctctgcacgtgag

SEQ ID NO: 478754 - DNA, 20 bp, Artificial Sequence
  chemically synthesized
cacacataggctcaaaataa

SEQ ID NO: 478755 - DNA, 20 bp, Artificial Sequence
  chemically synthesized
aatggaaaacaaaaaaaggc

SEQ ID NO: 478756 - DNA, 20 bp, Artificial Sequence
  chemically synthesized
aagtctgttttatcagagac

SEQ ID NO: 478757 - DNA, 20 bp, Artificial Sequence
  chemically synthesized
aggccattacataatggtaa

SEQ ID NO: 478758 - DNA, 20 bp, Artificial Sequence
  chemically synthesized
aggatagttagctcctcttg

SEQ ID NO: 478759 - DNA, 20 bp, Artificial Sequence
  chemically synthesized
gtattgggtgcataaatatt

SEQ ID NO: 478760 - DNA, 20 bp, Artificial Sequence
  chemically synthesized
tgaatctgggtgctcctgta

SEQ ID NO: 478761 - DNA, 20 bp, Artificial Sequence
  chemically synthesized
tcaggacttgctttatgaat

SEQ ID NO: 478762 - DNA, 20 bp, Artificial Sequence
  chemically synthesized
ggtcactcaggacttgcttt

SEQ ID NO: 478763 - DNA, 20 bp, Artificial Sequence
  chemically synthesized
ccagattcataaagcaagtc

SEQ ID NO: 478764 - DNA, 20 bp, Artificial Sequence
  chemically synthesized
gtctcccattattaatgtgt

SEQ ID NO: 478765 - DNA, 20 bp, Artificial Sequence
  chemically synthesized
gatctgtctaatgttgacag

SEQ ID NO: 478766 - DNA, 20 bp, Artificial Sequence
  chemically synthesized
caacgagacagaaagtcaac

SEQ ID NO: 478767 - DNA, 20 bp, Artificial Sequence
  chemically synthesized
gaaagtcaacaaggataccc

SEQ ID NO: 478768 - DNA, 20 bp, Artificial Sequence
  chemically synthesized
tgcagagctgagttcaattc

SEQ ID NO: 478769 - DNA, 20 bp, Artificial Sequence
  chemically synthesized
taggtctccttggtgcagag

SEQ ID NO: 478770 - DNA, 20 bp, Artificial Sequence
  chemically synthesized
tattctgttgatttggggtg

SEQ ID NO: 478771 - DNA, 20 bp, Artificial Sequence
  chemically synthesized
aactctccaccccaaatcaa

SEQ ID NO: 478772 - DNA, 20 bp, Artificial Sequence
  chemically synthesized
aaatgtatattctgttgatt

SEQ ID NO: 478773 - DNA, 20 bp, Artificial Sequence
  chemically synthesized
tccaagtatgtggtcaattt

SEQ ID NO: 478774 - DNA, 20 bp, Artificial Sequence
  chemically synthesized
agtgcaatcaaactagaact

SEQ ID NO: 478775 - DNA, 20 bp, Artificial Sequence
  chemically synthesized
tcaaactagaactcaggatt

SEQ ID NO: 478776 - DNA, 20 bp, Artificial Sequence
  chemically synthesized
tttgagtgagattcttaatc

SEQ ID NO: 478777 - DNA, 20 bp, Artificial Sequence
  chemically synthesized
ttccatgtagttgagcggct

SEQ ID NO: 478778 - DNA, 20 bp, Artificial Sequence
  chemically synthesized
ggaaactgaacaacctgctc

SEQ ID NO: 478779 - DNA, 20 bp, Artificial Sequence
  chemically synthesized
aacctgctcctgaatgacta

SEQ ID NO: 478780 - DNA, 20 bp, Artificial Sequence
  chemically synthesized
agaacaaagacaccacatac

SEQ ID NO: 478781 - DNA, 20 bp, Artificial Sequence
  chemically synthesized
atttccctctacacactgct

SEQ ID NO: 478782 - DNA, 20 bp, Artificial Sequence
  chemically synthesized
gtgatgttagggtgtcaatt

SEQ ID NO: 478783 - DNA, 20 bp, Artificial Sequence
  chemically synthesized
agttcttttaattgtgatgt

SEQ ID NO: 478784 - DNA, 20 bp, Artificial Sequence
  chemically synthesized
ttcttgccttctgctagctt

SEQ ID NO: 478785 - DNA, 20 bp, Artificial Sequence
  chemically synthesized
ctggattcattgattttttg

SEQ ID NO: 478786 - DNA, 20 bp, Artificial Sequence
  chemically synthesized
aaaaacccttcaaaaaatca

SEQ ID NO: 478787 - DNA, 20 bp, Artificial Sequence
  chemically synthesized
tcctttcaaaaaaccagctc

SEQ ID NO: 478788 - DNA, 20 bp, Artificial Sequence
  chemically synthesized
tccaggagctggttttttga

SEQ ID NO: 478789 - DNA, 20 bp, Artificial Sequence
  chemically synthesized
taataaagaaaaaaagagag

SEQ ID NO: 478790 - DNA, 20 bp, Artificial Sequence
  chemically synthesized
acacaataaaaaatgataaa

SEQ ID NO: 478791 - DNA, 20 bp, Artificial Sequence
  chemically synthesized
gatggtagtttgtatttctg

SEQ ID NO: 478792 - DNA, 20 bp, Artificial Sequence
  chemically synthesized
agaaatacaaactaccatca

SEQ ID NO: 478793 - DNA, 20 bp, Artificial Sequence
  chemically synthesized
aactagaaaatctagaagaa

SEQ ID NO: 478794 - DNA, 20 bp, Artificial Sequence
  chemically synthesized
ttgggagagtgtatgtgtcg

SEQ ID NO: 478795 - DNA, 20 bp, Artificial Sequence
  chemically synthesized
tcttcctggtttagtcttgg

SEQ ID NO: 478796 - DNA, 20 bp, Artificial Sequence
  chemically synthesized
aagactaaaccaggaagaag

SEQ ID NO: 478797 - DNA, 20 bp, Artificial Sequence
  chemically synthesized
accaggaagaagttgaatct

SEQ ID NO: 478798 - DNA, 20 bp, Artificial Sequence
  chemically synthesized
tcaatattttaccaaccaaa

SEQ ID NO: 478799 - DNA, 20 bp, Artificial Sequence
  chemically synthesized
caaaaagagtccaggaccag

SEQ ID NO: 478800 - DNA, 20 bp, Artificial Sequence
  chemically synthesized
aggaccagatggattcacag

SEQ ID NO: 478801 - DNA, 20 bp, Artificial Sequence
  chemically synthesized
acctctggtagaattcggct

SEQ ID NO: 478802 - DNA, 20 bp, Artificial Sequence
  chemically synthesized
gttcctccttgtacctctgg

SEQ ID NO: 478803 - DNA, 20 bp, Artificial Sequence
  chemically synthesized
ttgattggaatagtttcaga

SEQ ID NO: 478804 - DNA, 20 bp, Artificial Sequence
  chemically synthesized
ttccctctttttctattgat

SEQ ID NO: 478805 - DNA, 20 bp, Artificial Sequence
  chemically synthesized
ttccaatcaatagaaaaaga

SEQ ID NO: 478806 - DNA, 20 bp, Artificial Sequence
  chemically synthesized
gcctcataaaatgagttagg

SEQ ID NO: 478807 - DNA, 20 bp, Artificial Sequence
  chemically synthesized
aatgatgctggcctcataaa

SEQ ID NO: 478808 - DNA, 20 bp, Artificial Sequence
  chemically synthesized
tctctgcccggctttggtat

SEQ ID NO: 478809 - DNA, 20 bp, Artificial Sequence
  chemically synthesized
gcagagacacaaccaaaaaa

SEQ ID NO: 478810 - DNA, 20 bp, Artificial Sequence
  chemically synthesized
gttttgcatcaatgttcatc

SEQ ID NO: 478811 - DNA, 20 bp, Artificial Sequence
  chemically synthesized
ggtttgccagtattttattg

SEQ ID NO: 478812 - DNA, 20 bp, Artificial Sequence
  chemically synthesized
ctcaataaaatactggcaaa

SEQ ID NO: 478813 - DNA, 20 bp, Artificial Sequence
  chemically synthesized
ataagctttttgatgtgctg

SEQ ID NO: 478814 - DNA, 20 bp, Artificial Sequence
  chemically synthesized
atgaagcccacttgatcatg

SEQ ID NO: 478815 - DNA, 20 bp, Artificial Sequence
  chemically synthesized
gatcaagtgggcttcatccc

SEQ ID NO: 478816 - DNA, 20 bp, Artificial Sequence
  chemically synthesized
ttgaaccagccttgcatccc

SEQ ID NO: 478817 - DNA, 20 bp, Artificial Sequence
  chemically synthesized
tctttggctctgtttatatg

SEQ ID NO: 478818 - DNA, 20 bp, Artificial Sequence
  chemically synthesized
gtttttagcatgaagggttg

SEQ ID NO: 478819 - DNA, 20 bp, Artificial Sequence
  chemically synthesized
tattgagagtttttagcatg

SEQ ID NO: 478820 - DNA, 20 bp, Artificial Sequence
  chemically synthesized
ccatcaatacctaatttatt

SEQ ID NO: 478821 - DNA, 20 bp, Artificial Sequence
  chemically synthesized
cattcagtatgatattggct

SEQ ID NO: 478822 - DNA, 20 bp, Artificial Sequence
  chemically synthesized
aacccacagccaatatcata

SEQ ID NO: 478823 - DNA, 20 bp, Artificial Sequence
  chemically synthesized
gtcttgtgccagtttttaaa

SEQ ID NO: 478824 - DNA, 20 bp, Artificial Sequence
  chemically synthesized
tttaaaaactggcacaagac

SEQ ID NO: 478825 - DNA, 20 bp, Artificial Sequence
  chemically synthesized
cttccaacactatgttgaat

SEQ ID NO: 478826 - DNA, 20 bp, Artificial Sequence
  chemically synthesized
ccagaacttccaacactatg

SEQ ID NO: 478827 - DNA, 20 bp, Artificial Sequence
  chemically synthesized
tcaggcaggagaaggaaata

SEQ ID NO: 478828 - DNA, 20 bp, Artificial Sequence
  chemically synthesized
ttgacttcctcttttcctaa

SEQ ID NO: 478829 - DNA, 20 bp, Artificial Sequence
  chemically synthesized
gagattttgggctgagacga

SEQ ID NO: 478830 - DNA, 20 bp, Artificial Sequence
  chemically synthesized
aagcaacttcagcaaagtct

SEQ ID NO: 478831 - DNA, 20 bp, Artificial Sequence
  chemically synthesized
tttgtctgttgttggtgtat

SEQ ID NO: 478832 - DNA, 20 bp, Artificial Sequence
  chemically synthesized
gacaaacagagagccaaatc

SEQ ID NO: 478833 - DNA, 20 bp, Artificial Sequence
  chemically synthesized
tctttgaagcaattgtgaat

SEQ ID NO: 478834 - DNA, 20 bp, Artificial Sequence
  chemically synthesized
ttattctctttgaagcaatt

SEQ ID NO: 478835 - DNA, 20 bp, Artificial Sequence
  chemically synthesized
ccattcacaattgcttcaaa

SEQ ID NO: 478836 - DNA, 20 bp, Artificial Sequence
  chemically synthesized
tcaaagagaataaaatacct

SEQ ID NO: 478837 - DNA, 20 bp, Artificial Sequence
  chemically synthesized
acctaggaatccaacttaca

SEQ ID NO: 478838 - DNA, 20 bp, Artificial Sequence
  chemically synthesized
tccttcacatcccttgtaag

SEQ ID NO: 478839 - DNA, 20 bp, Artificial Sequence
  chemically synthesized
aagaggacacaaacaaatgg

SEQ ID NO: 478840 - DNA, 20 bp, Artificial Sequence
  chemically synthesized
tggaagaatattccatgctc

SEQ ID NO: 478841 - DNA, 20 bp, Artificial Sequence
  chemically synthesized
attcttcctacccatgagca

SEQ ID NO: 478842 - DNA, 20 bp, Artificial Sequence
  chemically synthesized
attccatgctcatgggtagg

SEQ ID NO: 478843 - DNA, 20 bp, Artificial Sequence
  chemically synthesized
gtagcttgatggggatggca

SEQ ID NO: 478844 - DNA, 20 bp, Artificial Sequence
  chemically synthesized
aaagtcattggtagcttgat

SEQ ID NO: 478845 - DNA, 20 bp, Artificial Sequence
  chemically synthesized
gctaccaatgactttcttca

SEQ ID NO: 478846 - DNA, 20 bp, Artificial Sequence
  chemically synthesized
ccagctttgttcttttggct

SEQ ID NO: 478847 - DNA, 20 bp, Artificial Sequence
  chemically synthesized
agaaaaacaagcaatgggga

SEQ ID NO: 478848 - DNA, 20 bp, Artificial Sequence
  chemically synthesized
ccagcaccatttattaaata

SEQ ID NO: 478849 - DNA, 20 bp, Artificial Sequence
  chemically synthesized
ccatatgtagaaagctgaaa

SEQ ID NO: 478850 - DNA, 20 bp, Artificial Sequence
  chemically synthesized
ttttgtataaggtgtaagga

SEQ ID NO: 478851 - DNA, 20 bp, Artificial Sequence
  chemically synthesized
tatacaaaaatcaattcaag

SEQ ID NO: 478852 - DNA, 20 bp, Artificial Sequence
  chemically synthesized
gtttaaatctttaatccatc

SEQ ID NO: 478853 - DNA, 20 bp, Artificial Sequence
  chemically synthesized
gtaatgcctaggttttcttc

SEQ ID NO: 478854 - DNA, 20 bp, Artificial Sequence
  chemically synthesized
tccttgcccacgcctatgtc

SEQ ID NO: 478855 - DNA, 20 bp, Artificial Sequence
  chemically synthesized
tctccctcagtatttgtaga

SEQ ID NO: 478856 - DNA, 20 bp, Artificial Sequence
  chemically synthesized
tgcatctccctcagtatttg

SEQ ID NO: 478857 - DNA, 20 bp, Artificial Sequence
  chemically synthesized
gacactgtcccagtctaatc

SEQ ID NO: 478858 - DNA, 20 bp, Artificial Sequence
  chemically synthesized
ttcttttataacagaaaacc

SEQ ID NO: 478859 - DNA, 20 bp, Artificial Sequence
  chemically synthesized
tccggggttttctgttataa

SEQ ID NO: 478860 - DNA, 20 bp, Artificial Sequence
  chemically synthesized
ctgttataaaagaatgatat

SEQ ID NO: 478861 - DNA, 20 bp, Artificial Sequence
  chemically synthesized
cagggtttagattaggtact

SEQ ID NO: 478862 - DNA, 20 bp, Artificial Sequence
  chemically synthesized
ctttcaaagggctttgcatt

SEQ ID NO: 478863 - DNA, 20 bp, Artificial Sequence
  chemically synthesized
actaggatccctgatgtgtt

SEQ ID NO: 478864 - DNA, 20 bp, Artificial Sequence
  chemically synthesized
tggacaactctgaacacatc

SEQ ID NO: 478865 - DNA, 20 bp, Artificial Sequence
  chemically synthesized
gatacttgttcatcatgtac

SEQ ID NO: 478866 - DNA, 20 bp, Artificial Sequence
  chemically synthesized
catgatgaacaagtatctga

SEQ ID NO: 478867 - DNA, 20 bp, Artificial Sequence
  chemically synthesized
acacctagaaaatcagctaa

SEQ ID NO: 478868 - DNA, 20 bp, Artificial Sequence
  chemically synthesized
ccaaaccatttaagaagaga

SEQ ID NO: 478869 - DNA, 20 bp, Artificial Sequence
  chemically synthesized
taggttttctacctgatcaa

SEQ ID NO: 478870 - DNA, 20 bp, Artificial Sequence
  chemically synthesized
tcaggtagaaaacctatcct

SEQ ID NO: 478871 - DNA, 20 bp, Artificial Sequence
  chemically synthesized
tatcttgagattttaactcc

SEQ ID NO: 478872 - DNA, 20 bp, Artificial Sequence
  chemically synthesized
aattgaaaactatcctccac

SEQ ID NO: 478873 - DNA, 20 bp, Artificial Sequence
  chemically synthesized
aaaatgaggagattctagtg

SEQ ID NO: 478874 - DNA, 20 bp, Artificial Sequence
  chemically synthesized
tgcaaggttgcttagtggcc

SEQ ID NO: 478875 - DNA, 20 bp, Artificial Sequence
  chemically synthesized
actgcaaaatcagtttggga

SEQ ID NO: 478876 - DNA, 20 bp, Artificial Sequence
  chemically synthesized
aagatactgcaaaatcagtt

SEQ ID NO: 478877 - DNA, 20 bp, Artificial Sequence
  chemically synthesized
cctccccagtttaaacagtc

SEQ ID NO: 478878 - DNA, 20 bp, Artificial Sequence
  chemically synthesized
aaggtacttgaaactgcaaa

SEQ ID NO: 478879 - DNA, 20 bp, Artificial Sequence
  chemically synthesized
acttgaaactgcaaacagaa

SEQ ID NO: 478880 - DNA, 20 bp, Artificial Sequence
  chemically synthesized
cctatttaacagagaaaatg

SEQ ID NO: 478881 - DNA, 20 bp, Artificial Sequence
  chemically synthesized
tcaacattttctctgttaaa

SEQ ID NO: 478882 - DNA, 20 bp, Artificial Sequence
  chemically synthesized
gcaatttgaaatagctgctc

SEQ ID NO: 478883 - DNA, 20 bp, Artificial Sequence
  chemically synthesized
gttggagtctgagatttaag

SEQ ID NO: 478884 - DNA, 20 bp, Artificial Sequence
  chemically synthesized
cccagtgatgaggaaggtgt

SEQ ID NO: 478885 - DNA, 20 bp, Artificial Sequence
  chemically synthesized
ggttaagtaggattgttgta

SEQ ID NO: 478886 - DNA, 20 bp, Artificial Sequence
  chemically synthesized
aagtttggtgaaaggttaag

SEQ ID NO: 478887 - DNA, 20 bp, Artificial Sequence
  chemically synthesized
acatcaggggagaagggaag

SEQ ID NO: 478888 - DNA, 20 bp, Artificial Sequence
  chemically synthesized
atggtagagagggagaggtt

SEQ ID NO: 478889 - DNA, 20 bp, Artificial Sequence
  chemically synthesized
gtgtaagtcactaccctttt

SEQ ID NO: 478890 - DNA, 20 bp, Artificial Sequence
  chemically synthesized
caggaagaacacactcttaa

SEQ ID NO: 478891 - DNA, 20 bp, Artificial Sequence
  chemically synthesized
aagggccatagtagcagaag

SEQ ID NO: 478892 - DNA, 20 bp, Artificial Sequence
  chemically synthesized
cagtacgttcaggcatgatt

SEQ ID NO: 478893 - DNA, 20 bp, Artificial Sequence
  chemically synthesized
tagttaccaccaagtaatta

SEQ ID NO: 478894 - DNA, 20 bp, Artificial Sequence
  chemically synthesized
cttccttgttgctaaattaa

SEQ ID NO: 478895 - DNA, 20 bp, Artificial Sequence
  chemically synthesized
tcttgaaaacctctcttccc

SEQ ID NO: 478896 - DNA, 20 bp, Artificial Sequence
  chemically synthesized
actaggttcgtgtgatgtca

SEQ ID NO: 478897 - DNA, 20 bp, Artificial Sequence
  chemically synthesized
caggaaaatggcaaagtttc

SEQ ID NO: 478898 - DNA, 20 bp, Artificial Sequence
  chemically synthesized
cctgaaactttgccattttc

SEQ ID NO: 478899 - DNA, 20 bp, Artificial Sequence
  chemically synthesized
cgtagatgagaagagggcct

SEQ ID NO: 478900 - DNA, 20 bp, Artificial Sequence
  chemically synthesized
tgcaagggtttgaaatggtt

SEQ ID NO: 478901 - DNA, 20 bp, Artificial Sequence
  chemically synthesized
atacgtaattaaaaccttgc

SEQ ID NO: 478902 - DNA, 20 bp, Artificial Sequence
  chemically synthesized
ctaggctagagaatctttaa

SEQ ID NO: 478903 - DNA, 20 bp, Artificial Sequence
  chemically synthesized
tggagaaatgttctaggcta

SEQ ID NO: 478904 - DNA, 20 bp, Artificial Sequence
  chemically synthesized
acactattgaaattgtccag

SEQ ID NO: 478905 - DNA, 20 bp, Artificial Sequence
  chemically synthesized
ggaggtggagtcccagcaga

SEQ ID NO: 478906 - DNA, 20 bp, Artificial Sequence
  chemically synthesized
agttggggatttggaggagg

SEQ ID NO: 478907 - DNA, 20 bp, Artificial Sequence
  chemically synthesized
ggagttagacaggtcaagtt

SEQ ID NO: 478908 - DNA, 20 bp, Artificial Sequence
  chemically synthesized
gctgagacctgaagagaagc

SEQ ID NO: 478909 - DNA, 20 bp, Artificial Sequence
  chemically synthesized
ccttctgcatcctgccaagc

SEQ ID NO: 478910 - DNA, 20 bp, Artificial Sequence
  chemically synthesized
ggtaattgaccctggcttgg

SEQ ID NO: 478911 - DNA, 20 bp, Artificial Sequence
  chemically synthesized
ggtattactatgatagtgct

SEQ ID NO: 478912 - DNA, 20 bp, Artificial Sequence
  chemically synthesized
atattcaacctatagatggt

SEQ ID NO: 478913 - DNA, 20 bp, Artificial Sequence
  chemically synthesized
atacccttaccatctatagg

SEQ ID NO: 478914 - DNA, 20 bp, Artificial Sequence
  chemically synthesized
tactttcagtcgcaagtatt

SEQ ID NO: 478915 - DNA, 20 bp, Artificial Sequence
  chemically synthesized
gtatttcaaatttcaggttt

SEQ ID NO: 478916 - DNA, 20 bp, Artificial Sequence
  chemically synthesized
tggaatatttgcattaccct

SEQ ID NO: 478917 - DNA, 20 bp, Artificial Sequence
  chemically synthesized
aaaggcctgcatgatatcca

SEQ ID NO: 478918 - DNA, 20 bp, Artificial Sequence
  chemically synthesized
acaatatcttgacaccacca

SEQ ID NO: 478919 - DNA, 20 bp, Artificial Sequence
  chemically synthesized
tggccccatgctggacattg

SEQ ID NO: 478920 - DNA, 20 bp, Artificial Sequence
  chemically synthesized
tgccatttttcgtacctttt

SEQ ID NO: 478921 - DNA, 20 bp, Artificial Sequence
  chemically synthesized
ttgtgggtttgcttgtatga

SEQ ID NO: 478922 - DNA, 20 bp, Artificial Sequence
  chemically synthesized
gtttgcttgtatgatggaat

SEQ ID NO: 478923 - DNA, 20 bp, Artificial Sequence
  chemically synthesized
ttgtatgatggaatctgggt

SEQ ID NO: 478924 - DNA, 20 bp, Artificial Sequence
  chemically synthesized
tcacagctaacgggggctga

SEQ ID NO: 478925 - DNA, 20 bp, Artificial Sequence
  chemically synthesized
gagaggatctttcttccctt

SEQ ID NO: 478926 - DNA, 20 bp, Artificial Sequence
  chemically synthesized
tctttcttcccttggggatg

SEQ ID NO: 478927 - DNA, 20 bp, Artificial Sequence
  chemically synthesized
gaaaatgcaggcacaccaca

SEQ ID NO: 478928 - DNA, 20 bp, Artificial Sequence
  chemically synthesized
ttgtcacatgaggtcagaag

SEQ ID NO: 478929 - DNA, 20 bp, Artificial Sequence
  chemically synthesized
tgtcagcattcaaacagttt

SEQ ID NO: 478930 - DNA, 20 bp, Artificial Sequence
  chemically synthesized
gttccaaattccaaaactgt

SEQ ID NO: 478931 - DNA, 20 bp, Artificial Sequence
  chemically synthesized
agttttggaatttggaacat

SEQ ID NO: 478932 - DNA, 20 bp, Artificial Sequence
  chemically synthesized
aacatttggatttcaggttt

SEQ ID NO: 478933 - DNA, 20 bp, Artificial Sequence
  chemically synthesized
ggatttcaggtttttggatc

SEQ ID NO: 478934 - DNA, 20 bp, Artificial Sequence
  chemically synthesized
aataaatattcatgaaagaa

SEQ ID NO: 478935 - DNA, 20 bp, Artificial Sequence
  chemically synthesized
gttatttatccatttctttc

SEQ ID NO: 478936 - DNA, 20 bp, Artificial Sequence
  chemically synthesized
aggattagaaaagactgctg

SEQ ID NO: 478937 - DNA, 20 bp, Artificial Sequence
  chemically synthesized
cttttctaatccttggtaat

SEQ ID NO: 478938 - DNA, 20 bp, Artificial Sequence
  chemically synthesized
tacaaaaaattcaaattacc

SEQ ID NO: 478939 - DNA, 20 bp, Artificial Sequence
  chemically synthesized
gcccatgcttttcattataa

SEQ ID NO: 478940 - DNA, 20 bp, Artificial Sequence
  chemically synthesized
tgaggtacagctatttagaa

SEQ ID NO: 478941 - DNA, 20 bp, Artificial Sequence
  chemically synthesized
aaagaagtaccattcacatc

SEQ ID NO: 478942 - DNA, 20 bp, Artificial Sequence
  chemically synthesized
tgaaacatacaactcatgat

SEQ ID NO: 478943 - DNA, 20 bp, Artificial Sequence
  chemically synthesized
gacggctcttcatggcagtc

SEQ ID NO: 478944 - DNA, 20 bp, Artificial Sequence
  chemically synthesized
cctgaattgtagtaaaagag

SEQ ID NO: 478945 - DNA, 20 bp, Artificial Sequence
  chemically synthesized
ctgaggaaaaaataatgaga

SEQ ID NO: 478946 - DNA, 20 bp, Artificial Sequence
  chemically synthesized
atcatccctcaccatgaaga

SEQ ID NO: 478947 - DNA, 20 bp, Artificial Sequence
  chemically synthesized
cagactctctcttcatggtg

SEQ ID NO: 478948 - DNA, 20 bp, Artificial Sequence
  chemically synthesized
agactgaaatttaagaatac

SEQ ID NO: 478949 - DNA, 20 bp, Artificial Sequence
  chemically synthesized
actctattagactgaaattt

SEQ ID NO: 478950 - DNA, 20 bp, Artificial Sequence
  chemically synthesized
attcttaaatttcagtctaa

SEQ ID NO: 478951 - DNA, 20 bp, Artificial Sequence
  chemically synthesized
tttcagtctaatagagttat

SEQ ID NO: 478952 - DNA, 20 bp, Artificial Sequence
  chemically synthesized
ttattagaattttaaagctg

SEQ ID NO: 478953 - DNA, 20 bp, Artificial Sequence
  chemically synthesized
ctatgtgctaactctcatta

SEQ ID NO: 478954 - DNA, 20 bp, Artificial Sequence
  chemically synthesized
ggtagctaccactcactaat

SEQ ID NO: 478955 - DNA, 20 bp, Artificial Sequence
  chemically synthesized
actgactagccatgtctttc

SEQ ID NO: 478956 - DNA, 20 bp, Artificial Sequence
  chemically synthesized
ggaacaaggaaggaaaatac

SEQ ID NO: 478957 - DNA, 20 bp, Artificial Sequence
  chemically synthesized
ttaattttctcttctggaaa

SEQ ID NO: 478958 - DNA, 20 bp, Artificial Sequence
  chemically synthesized
taggctagaagtacagaaac

SEQ ID NO: 478959 - DNA, 20 bp, Artificial Sequence
  chemically synthesized
gaatttataatttatcttta

SEQ ID NO: 478960 - DNA, 20 bp, Artificial Sequence
  chemically synthesized
aaggcagcaaatcttagggc

SEQ ID NO: 478961 - DNA, 20 bp, Artificial Sequence
  chemically synthesized
ggtcaccagcataaataaat

SEQ ID NO: 478962 - DNA, 20 bp, Artificial Sequence
  chemically synthesized
aggcacatgttataagtagt

SEQ ID NO: 478963 - DNA, 20 bp, Artificial Sequence
  chemically synthesized
cgttttgagacatatttggc

SEQ ID NO: 478964 - DNA, 20 bp, Artificial Sequence
  chemically synthesized
tgaatctatacaaatggcag

SEQ ID NO: 478965 - DNA, 20 bp, Artificial Sequence
  chemically synthesized
cagtgtgaagaggtaacaac

SEQ ID NO: 478966 - DNA, 20 bp, Artificial Sequence
  chemically synthesized
atgaccaatgttaatagacg

SEQ ID NO: 478967 - DNA, 20 bp, Artificial Sequence
  chemically synthesized
tggtcatggtgctagatact

SEQ ID NO: 478968 - DNA, 20 bp, Artificial Sequence
  chemically synthesized
tatgtctttcctgtttactg

SEQ ID NO: 478969 - DNA, 20 bp, Artificial Sequence
  chemically synthesized
gtgaggcactgaacaatgat

SEQ ID NO: 478970 - DNA, 20 bp, Artificial Sequence
  chemically synthesized
ggaagtacaaggaacttctt

SEQ ID NO: 478971 - DNA, 20 bp, Artificial Sequence
  chemically synthesized
aggaacttcttaggggtggg

SEQ ID NO: 478972 - DNA, 20 bp, Artificial Sequence
  chemically synthesized
agtggcaattgtcaaaaatt

SEQ ID NO: 478973 - DNA, 20 bp, Artificial Sequence
  chemically synthesized
tgacaattgccactcggaaa

SEQ ID NO: 478974 - DNA, 20 bp, Artificial Sequence
  chemically synthesized
ttgatctctatattctgttt

SEQ ID NO: 478975 - DNA, 20 bp, Artificial Sequence
  chemically synthesized
ttggatatccagcctggatg

SEQ ID NO: 478976 - DNA, 20 bp, Artificial Sequence
  chemically synthesized
gcagctattctgcatccagg

SEQ ID NO: 478977 - DNA, 20 bp, Artificial Sequence
  chemically synthesized
gtttgttttggatatccagc

SEQ ID NO: 478978 - DNA, 20 bp, Artificial Sequence
  chemically synthesized
ccagcaatccagtgtttgtt

SEQ ID NO: 478979 - DNA, 20 bp, Artificial Sequence
  chemically synthesized
ctggatatccaaaacaaaca

SEQ ID NO: 478980 - DNA, 20 bp, Artificial Sequence
  chemically synthesized
actggattgctggaaaactt

SEQ ID NO: 478981 - DNA, 20 bp, Artificial Sequence
  chemically synthesized
ttattttagaatatcgattt

SEQ ID NO: 478982 - DNA, 20 bp, Artificial Sequence
  chemically synthesized
ctaattgtttttacttattt

SEQ ID NO: 478983 - DNA, 20 bp, Artificial Sequence
  chemically synthesized
ttagaaaagacagattcaca

SEQ ID NO: 478984 - DNA, 20 bp, Artificial Sequence
  chemically synthesized
tcaaatggttattactctgt

SEQ ID NO: 478985 - DNA, 20 bp, Artificial Sequence
  chemically synthesized
tcacacagagtaataaccat

SEQ ID NO: 478986 - DNA, 20 bp, Artificial Sequence
  chemically synthesized
agcaagtgaaaaagagtcta

SEQ ID NO: 478987 - DNA, 20 bp, Artificial Sequence
  chemically synthesized
gatttgcaaagcaagtgaaa

SEQ ID NO: 478988 - DNA, 20 bp, Artificial Sequence
  chemically synthesized
tttaaacatacatggtaatc

SEQ ID NO: 478989 - DNA, 20 bp, Artificial Sequence
  chemically synthesized
aggtacttctgactttccaa

SEQ ID NO: 478990 - DNA, 20 bp, Artificial Sequence
  chemically synthesized
acccataaaatctccaaatg

SEQ ID NO: 478991 - DNA, 20 bp, Artificial Sequence
  chemically synthesized
acccttcatttggagatttt

SEQ ID NO: 478992 - DNA, 20 bp, Artificial Sequence
  chemically synthesized
aaatgatttatgacttatca

SEQ ID NO: 478993 - DNA, 20 bp, Artificial Sequence
  chemically synthesized
tgacttatcaaaggatatgc

SEQ ID NO: 478994 - DNA, 20 bp, Artificial Sequence
  chemically synthesized
agagaaatggagaaagtcag

SEQ ID NO: 478995 - DNA, 20 bp, Artificial Sequence
  chemically synthesized
acaccaacctatatttgact

SEQ ID NO: 478996 - DNA, 20 bp, Artificial Sequence
  chemically synthesized
ctatatttgactcagggttg

SEQ ID NO: 478997 - DNA, 20 bp, Artificial Sequence
  chemically synthesized
tgtttcacaattccccaacc

SEQ ID NO: 478998 - DNA, 20 bp, Artificial Sequence
  chemically synthesized
ttttagatgaaaattgctct

SEQ ID NO: 478999 - DNA, 20 bp, Artificial Sequence
  chemically synthesized
cttggtttccttctactttt

SEQ ID NO: 479000 - DNA, 20 bp, Artificial Sequence
  chemically synthesized
tgaaaagtagaaggaaacca

SEQ ID NO: 479001 - DNA, 20 bp, Artificial Sequence
  chemically synthesized
atagaaacgctgctaaaatg

SEQ ID NO: 479002 - DNA, 20 bp, Artificial Sequence
  chemically synthesized
tctgctcagaaagaagtaag

SEQ ID NO: 479003 - DNA, 20 bp, Artificial Sequence
  chemically synthesized
atataaaacttggccctttt

SEQ ID NO: 479004 - DNA, 20 bp, Artificial Sequence
  chemically synthesized
ttttgagagtgtgggagaaa

SEQ ID NO: 479005 - DNA, 20 bp, Artificial Sequence
  chemically synthesized
aaaatttgcagtgattatgt

SEQ ID NO: 479006 - DNA, 20 bp, Artificial Sequence
  chemically synthesized
ttcttcaataaacatcgatt

SEQ ID NO: 479007 - DNA, 20 bp, Artificial Sequence
  chemically synthesized
tatatttaaatttaataaaa

SEQ ID NO: 479008 - DNA, 20 bp, Artificial Sequence
  chemically synthesized
agtttttcaataactgaacc

SEQ ID NO: 479009 - DNA, 20 bp, Artificial Sequence
  chemically synthesized
gtgtatgtttggaacaactt

SEQ ID NO: 479010 - DNA, 20 bp, Artificial Sequence
  chemically synthesized
gtttggaacaacttaggaat

SEQ ID NO: 479011 - DNA, 20 bp, Artificial Sequence
  chemically synthesized
agggcacatgtgcacaacgt

SEQ ID NO: 479012 - DNA, 20 bp, Artificial Sequence
  chemically synthesized
ctaatgtaaatgacgagtta

SEQ ID NO: 479013 - DNA, 20 bp, Artificial Sequence
  chemically synthesized
agatatacctaatgtaaatg

SEQ ID NO: 479014 - DNA, 20 bp, Artificial Sequence
  chemically synthesized
gtggggtggggggagggggg

SEQ ID NO: 479015 - DNA, 20 bp, Artificial Sequence
  chemically synthesized
tcacacaccagggcctgtcg

SEQ ID NO: 479016 - DNA, 20 bp, Artificial Sequence
  chemically synthesized
gcaatgagaacacttggaca

SEQ ID NO: 479017 - DNA, 20 bp, Artificial Sequence
  chemically synthesized
tcattgctcaattcccgcct

SEQ ID NO: 479018 - DNA, 20 bp, Artificial Sequence
  chemically synthesized
acatgttcttactcacaggc

SEQ ID NO: 479019 - DNA, 20 bp, Artificial Sequence
  chemically synthesized
tgtccttgtgatagtttgct

SEQ ID NO: 479020 - DNA, 20 bp, Artificial Sequence
  chemically synthesized
ttcaagtcctttgtagggac

SEQ ID NO: 479021 - DNA, 20 bp, Artificial Sequence
  chemically synthesized
actatgcagccataaagagg

SEQ ID NO: 479022 - DNA, 20 bp, Artificial Sequence
  chemically synthesized
gaatactatgcagccataaa

SEQ ID NO: 479023 - DNA, 20 bp, Artificial Sequence
  chemically synthesized
aatgtggcacatatatatca

SEQ ID NO: 479024 - DNA, 20 bp, Artificial Sequence
  chemically synthesized
aaatgtccatcaatgataga

SEQ ID NO: 479025 - DNA, 20 bp, Artificial Sequence
  chemically synthesized
ggtctatcattgatggacat

SEQ ID NO: 479026 - DNA, 20 bp, Artificial Sequence
  chemically synthesized
atacggtgtccaaattgaga

SEQ ID NO: 479027 - DNA, 20 bp, Artificial Sequence
  chemically synthesized
catgccagatttcaaagact

SEQ ID NO: 479028 - DNA, 20 bp, Artificial Sequence
  chemically synthesized
catattgaaataataatatg

SEQ ID NO: 479029 - DNA, 20 bp, Artificial Sequence
  chemically synthesized
taataatatgttggatatat

SEQ ID NO: 479030 - DNA, 20 bp, Artificial Sequence
  chemically synthesized
cttttaaagaacgtggctac

SEQ ID NO: 479031 - DNA, 20 bp, Artificial Sequence
  chemically synthesized
ataaaactaaacattccctt

SEQ ID NO: 479032 - DNA, 20 bp, Artificial Sequence
  chemically synthesized
ccattccgtaaaatccttaa

SEQ ID NO: 479033 - DNA, 20 bp, Artificial Sequence
  chemically synthesized
acattcccttaaggatttta

SEQ ID NO: 479034 - DNA, 20 bp, Artificial Sequence
  chemically synthesized
gctatagcagagagatatag

SEQ ID NO: 479035 - DNA, 20 bp, Artificial Sequence
  chemically synthesized
aggacgctatggggacatag

SEQ ID NO: 479036 - DNA, 20 bp, Artificial Sequence
  chemically synthesized
cttaaattgatccttaaagt

SEQ ID NO: 479037 - DNA, 20 bp, Artificial Sequence
  chemically synthesized
ctaacttccactcaaacttt

SEQ ID NO: 479038 - DNA, 20 bp, Artificial Sequence
  chemically synthesized
aagttagatgaagaaagacg

SEQ ID NO: 479039 - DNA, 20 bp, Artificial Sequence
  chemically synthesized
cgaagggtattccaggaaga

SEQ ID NO: 479040 - DNA, 20 bp, Artificial Sequence
  chemically synthesized
tacatgccattccgtcttcc

SEQ ID NO: 479041 - DNA, 20 bp, Artificial Sequence
  chemically synthesized
agtagtacaatacagtgatt

SEQ ID NO: 479042 - DNA, 20 bp, Artificial Sequence
  chemically synthesized
gaatctagaacctctaccct

SEQ ID NO: 479043 - DNA, 20 bp, Artificial Sequence
  chemically synthesized
gcttgagtgcatatgactca

SEQ ID NO: 479044 - DNA, 20 bp, Artificial Sequence
  chemically synthesized
cagatagtaagtggtacagc

SEQ ID NO: 479045 - DNA, 20 bp, Artificial Sequence
  chemically synthesized
tctttccttctctgtgaaat

SEQ ID NO: 479046 - DNA, 20 bp, Artificial Sequence
  chemically synthesized
aaagttatcgtaagaaatgc

SEQ ID NO: 479047 - DNA, 20 bp, Artificial Sequence
  chemically synthesized
ttgtatttcctgctattatt

SEQ ID NO: 479048 - DNA, 20 bp, Artificial Sequence
  chemically synthesized
tagaaaatactcccacaggt

SEQ ID NO: 479049 - DNA, 20 bp, Artificial Sequence
  chemically synthesized
ttccctttactccaacctgt

SEQ ID NO: 479050 - DNA, 20 bp, Artificial Sequence
  chemically synthesized
ctcccacaggttggagtaaa

SEQ ID NO: 479051 - DNA, 20 bp, Artificial Sequence
  chemically synthesized
taaaaggtcaaactgctctg

SEQ ID NO: 479052 - DNA, 20 bp, Artificial Sequence
  chemically synthesized
actaatcctctcacagcttg

SEQ ID NO: 479053 - DNA, 20 bp, Artificial Sequence
  chemically synthesized
ttttatccttcaagctgtga

SEQ ID NO: 479054 - DNA, 20 bp, Artificial Sequence
  chemically synthesized
tgaaaacatattccaggcat

SEQ ID NO: 479055 - DNA, 20 bp, Artificial Sequence
  chemically synthesized
tgctctgctactcttatgcc

SEQ ID NO: 479056 - DNA, 20 bp, Artificial Sequence
  chemically synthesized
aagagtagcagagcatttag

SEQ ID NO: 479057 - DNA, 20 bp, Artificial Sequence
  chemically synthesized
agcagtgctgcggggccact

SEQ ID NO: 479058 - DNA, 20 bp, Artificial Sequence
  chemically synthesized
ctgcgaatagagggcagggc

SEQ ID NO: 479059 - DNA, 20 bp, Artificial Sequence
  chemically synthesized
gagggcagggcatgaataag

SEQ ID NO: 479060 - DNA, 20 bp, Artificial Sequence
  chemically synthesized
tgttacatgtggccacaggg

SEQ ID NO: 479061 - DNA, 20 bp, Artificial Sequence
  chemically synthesized
gagttctagccagtagaagg

SEQ ID NO: 479062 - DNA, 20 bp, Artificial Sequence
  chemically synthesized
gatattcagccagcccaaag

SEQ ID NO: 479063 - DNA, 20 bp, Artificial Sequence
  chemically synthesized
ctcattcccctttgggctgg

SEQ ID NO: 479064 - DNA, 20 bp, Artificial Sequence
  chemically synthesized
taaaaaaaaaacaggccagc

SEQ ID NO: 479065 - DNA, 20 bp, Artificial Sequence
  chemically synthesized
tttattttattttttttaga

SEQ ID NO: 479066 - DNA, 20 bp, Artificial Sequence
  chemically synthesized
gtcttgctctgtcgccaggc

SEQ ID NO: 479067 - DNA, 20 bp, Artificial Sequence
  chemically synthesized
tacttgggaggctgaagcag

SEQ ID NO: 479068 - DNA, 20 bp, Artificial Sequence
  chemically synthesized
gcttcagcctcccaagtagc

SEQ ID NO: 479069 - DNA, 20 bp, Artificial Sequence
  chemically synthesized
taaaaatacaaaaaatagct

SEQ ID NO: 479070 - DNA, 20 bp, Artificial Sequence
  chemically synthesized
ttttgtatttttagtagaga

SEQ ID NO: 479071 - DNA, 20 bp, Artificial Sequence
  chemically synthesized
tggggtttcatcatgttggc

SEQ ID NO: 479072 - DNA, 20 bp, Artificial Sequence
  chemically synthesized
actttgggaggccaaggtgg

SEQ ID NO: 479073 - DNA, 20 bp, Artificial Sequence
  chemically synthesized
accttggcctcccaaagtgc

SEQ ID NO: 479074 - DNA, 20 bp, Artificial Sequence
  chemically synthesized
acctggcctggcctgtattc

SEQ ID NO: 479075 - DNA, 20 bp, Artificial Sequence
  chemically synthesized
tgacacccacataattattc

SEQ ID NO: 479076 - DNA, 20 bp, Artificial Sequence
  chemically synthesized
ctgtattcttgaataattat

SEQ ID NO: 479077 - DNA, 20 bp, Artificial Sequence
  chemically synthesized
ggatgtgtgtgtgggaaggg

SEQ ID NO: 479078 - DNA, 20 bp, Artificial Sequence
  chemically synthesized
tgaattcatgttagttggtg

SEQ ID NO: 479079 - DNA, 20 bp, Artificial Sequence
  chemically synthesized
cacatccaacaccaactaac

SEQ ID NO: 479080 - DNA, 20 bp, Artificial Sequence
  chemically synthesized
tctcatgtaaacagtctaag

SEQ ID NO: 479081 - DNA, 20 bp, Artificial Sequence
  chemically synthesized
tcattttaatagtccatttg

SEQ ID NO: 479082 - DNA, 20 bp, Artificial Sequence
  chemically synthesized
cttgatgacagataagatat

SEQ ID NO: 479083 - DNA, 20 bp, Artificial Sequence
  chemically synthesized
gaaagttgtcactaaattct

SEQ ID NO: 479084 - DNA, 20 bp, Artificial Sequence
  chemically synthesized
acttgaggccctgctactca

SEQ ID NO: 479085 - DNA, 20 bp, Artificial Sequence
  chemically synthesized
gcagggcctcaagtgttatc

SEQ ID NO: 479086 - DNA, 20 bp, Artificial Sequence
  chemically synthesized
ctggctgaaaatttactttg

SEQ ID NO: 479087 - DNA, 20 bp, Artificial Sequence
  chemically synthesized
aatgaacaacagtaagaagt

SEQ ID NO: 479088 - DNA, 20 bp, Artificial Sequence
  chemically synthesized
gaaacttgacctcttttctg

SEQ ID NO: 479089 - DNA, 20 bp, Artificial Sequence
  chemically synthesized
ttcaaaagacattgggaagt

SEQ ID NO: 479090 - DNA, 20 bp, Artificial Sequence
  chemically synthesized
gggaagtgtgggtgaccctc

SEQ ID NO: 479091 - DNA, 20 bp, Artificial Sequence
  chemically synthesized
ctcttcttatctaaattctt

SEQ ID NO: 479092 - DNA, 20 bp, Artificial Sequence
  chemically synthesized
gataagaagaggaaaactgt

SEQ ID NO: 479093 - DNA, 20 bp, Artificial Sequence
  chemically synthesized
accgcacccagccgcatagc

SEQ ID NO: 479094 - DNA, 20 bp, Artificial Sequence
  chemically synthesized
ataagattcaagctatgcgg

SEQ ID NO: 479095 - DNA, 20 bp, Artificial Sequence
  chemically synthesized
agtgggcggaccacgaggtc

SEQ ID NO: 479096 - DNA, 20 bp, Artificial Sequence
  chemically synthesized
ttttgtatctttagtagaga

SEQ ID NO: 479097 - DNA, 20 bp, Artificial Sequence
  chemically synthesized
gcctcagcctcccgagtaac

SEQ ID NO: 479098 - DNA, 20 bp, Artificial Sequence
  chemically synthesized
gattctcctgcctcagcctc

SEQ ID NO: 479099 - DNA, 20 bp, Artificial Sequence
  chemically synthesized
tactcgggaggctgaggcag

SEQ ID NO: 479100 - DNA, 20 bp, Artificial Sequence
  chemically synthesized
ttgtgccattgcactccagc

SEQ ID NO: 479101 - DNA, 20 bp, Artificial Sequence
  chemically synthesized
tctcaccctgtaacccaggc

SEQ ID NO: 479102 - DNA, 20 bp, Artificial Sequence
  chemically synthesized
ttgcactccagcctgggtta

SEQ ID NO: 479103 - DNA, 20 bp, Artificial Sequence
  chemically synthesized
ttttttttttttttttgaga

SEQ ID NO: 479104 - DNA, 20 bp, Artificial Sequence
  chemically synthesized
tctcaaaaaaaaaaaaaaaa

SEQ ID NO: 479105 - DNA, 20 bp, Artificial Sequence
  chemically synthesized
ggattttggagtagcgtaac

SEQ ID NO: 479106 - DNA, 20 bp, Artificial Sequence
  chemically synthesized
agctgccatattgtggattt

SEQ ID NO: 479107 - DNA, 20 bp, Artificial Sequence
  chemically synthesized
aaataccaagctgccatatt

SEQ ID NO: 479108 - DNA, 20 bp, Artificial Sequence
  chemically synthesized
atttgagaagacagcagaag

SEQ ID NO: 479109 - DNA, 20 bp, Artificial Sequence
  chemically synthesized
agaagggggaaggggaaggt

SEQ ID NO: 479110 - DNA, 20 bp, Artificial Sequence
  chemically synthesized
aaaggggaatggtaataaac

SEQ ID NO: 479111 - DNA, 20 bp, Artificial Sequence
  chemically synthesized
tccagtatgactggacaaag

SEQ ID NO: 479112 - DNA, 20 bp, Artificial Sequence
  chemically synthesized
acacacttttccctgattct

SEQ ID NO: 479113 - DNA, 20 bp, Artificial Sequence
  chemically synthesized
gagccttcagaaatgaccca

SEQ ID NO: 479114 - DNA, 20 bp, Artificial Sequence
  chemically synthesized
aatcaacaacataaaagcat

SEQ ID NO: 479115 - DNA, 20 bp, Artificial Sequence
  chemically synthesized
cctcagccatgaacctagcg

SEQ ID NO: 479116 - DNA, 20 bp, Artificial Sequence
  chemically synthesized
agagatcttttctcccctgt

SEQ ID NO: 479117 - DNA, 20 bp, Artificial Sequence
  chemically synthesized
aacctgcttgtttagaattt

SEQ ID NO: 479118 - DNA, 20 bp, Artificial Sequence
  chemically synthesized
gaacccgaaacctgcttgtt

SEQ ID NO: 479119 - DNA, 20 bp, Artificial Sequence
  chemically synthesized
aaattctaaacaagcaggtt

SEQ ID NO: 479120 - DNA, 20 bp, Artificial Sequence
  chemically synthesized
tttcgggttctcagaaaaca

SEQ ID NO: 479121 - DNA, 20 bp, Artificial Sequence
  chemically synthesized
tcagaaaacagggggttgac

SEQ ID NO: 479122 - DNA, 20 bp, Artificial Sequence
  chemically synthesized
catagcccaaactgtgaaaa

SEQ ID NO: 479123 - DNA, 20 bp, Artificial Sequence
  chemically synthesized
agtattaaatgctattgcct

SEQ ID NO: 479124 - DNA, 20 bp, Artificial Sequence
  chemically synthesized
gcatttaatactcatgcttg

SEQ ID NO: 479125 - DNA, 20 bp, Artificial Sequence
  chemically synthesized
cccttgcctattcaacaagc

SEQ ID NO: 479126 - DNA, 20 bp, Artificial Sequence
  chemically synthesized
acctagatgtggtttactct

SEQ ID NO: 479127 - DNA, 20 bp, Artificial Sequence
  chemically synthesized
acttagccctttttcattct

SEQ ID NO: 479128 - DNA, 20 bp, Artificial Sequence
  chemically synthesized
ctctaaggactctccctgtg

SEQ ID NO: 479129 - DNA, 20 bp, Artificial Sequence
  chemically synthesized
ctttttctattcaacacagg

SEQ ID NO: 479130 - DNA, 20 bp, Artificial Sequence
  chemically synthesized
tccctgtgttgaatagaaaa

SEQ ID NO: 479131 - DNA, 20 bp, Artificial Sequence
  chemically synthesized
aaaaagggataaaccttcaa

SEQ ID NO: 479132 - DNA, 20 bp, Artificial Sequence
  chemically synthesized
tgtaaaatatcgttgttcca

SEQ ID NO: 479133 - DNA, 20 bp, Artificial Sequence
  chemically synthesized
catcacttttgaccttggtc

SEQ ID NO: 479134 - DNA, 20 bp, Artificial Sequence
  chemically synthesized
ttgctttctctgaccctacc

SEQ ID NO: 479135 - DNA, 20 bp, Artificial Sequence
  chemically synthesized
gctctggttctgatcctggg

SEQ ID NO: 479136 - DNA, 20 bp, Artificial Sequence
  chemically synthesized
tgaaggctctggttctgatc

SEQ ID NO: 479137 - DNA, 20 bp, Artificial Sequence
  chemically synthesized
ggattggtttcagcagcaga

SEQ ID NO: 479138 - DNA, 20 bp, Artificial Sequence
  chemically synthesized
tgctgaattgcctggctggt

SEQ ID NO: 479139 - DNA, 20 bp, Artificial Sequence
  chemically synthesized
tgtccctgagtgagcttctg

SEQ ID NO: 479140 - DNA, 20 bp, Artificial Sequence
  chemically synthesized
acgcctcttccatgctgtcc

SEQ ID NO: 479141 - DNA, 20 bp, Artificial Sequence
  chemically synthesized
cagcatggaagaggcgtgag

SEQ ID NO: 479142 - DNA, 20 bp, Artificial Sequence
  chemically synthesized
ctagagctcacaccggttaa

SEQ ID NO: 479143 - DNA, 20 bp, Artificial Sequence
  chemically synthesized
ctatatttccttctgccttc

SEQ ID NO: 479144 - DNA, 20 bp, Artificial Sequence
  chemically synthesized
aaactgaaacaagtgtcaga

SEQ ID NO: 479145 - DNA, 20 bp, Artificial Sequence
  chemically synthesized
tccttatgctgtttcttcac

SEQ ID NO: 479146 - DNA, 20 bp, Artificial Sequence
  chemically synthesized
tttctttttaaggcaaagga

SEQ ID NO: 479147 - DNA, 20 bp, Artificial Sequence
  chemically synthesized
aaaagaaagtattctaggga

SEQ ID NO: 479148 - DNA, 20 bp, Artificial Sequence
  chemically synthesized
ggtgttttccatcctttccc

SEQ ID NO: 479149 - DNA, 20 bp, Artificial Sequence
  chemically synthesized
gaaaacaccacagaagttgt

SEQ ID NO: 479150 - DNA, 20 bp, Artificial Sequence
  chemically synthesized
gggcatttgtgatttctaac

SEQ ID NO: 479151 - DNA, 20 bp, Artificial Sequence
  chemically synthesized
ccacagttgctgaagacatg

SEQ ID NO: 479152 - DNA, 20 bp, Artificial Sequence
  chemically synthesized
tacatttgggggcaggttta

SEQ ID NO: 479153 - DNA, 20 bp, Artificial Sequence
  chemically synthesized
tcagaccctgcctgctagtg

SEQ ID NO: 479154 - DNA, 20 bp, Artificial Sequence
  chemically synthesized
ctggaccctccactagcagg

SEQ ID NO: 479155 - DNA, 20 bp, Artificial Sequence
  chemically synthesized
tccttgagcactcactatgt

SEQ ID NO: 479156 - DNA, 20 bp, Artificial Sequence
  chemically synthesized
aggacagtaactcgcacata

SEQ ID NO: 479157 - DNA, 20 bp, Artificial Sequence
  chemically synthesized
agggttgttattagaatgaa

SEQ ID NO: 479158 - DNA, 20 bp, Artificial Sequence
  chemically synthesized
tgacctcatagggttgttat

SEQ ID NO: 479159 - DNA, 20 bp, Artificial Sequence
  chemically synthesized
agtgaagattaatgacctca

SEQ ID NO: 479160 - DNA, 20 bp, Artificial Sequence
  chemically synthesized
tgaggtcattaatcttcact

SEQ ID NO: 479161 - DNA, 20 bp, Artificial Sequence
  chemically synthesized
gtatatagaggtgactcagc

SEQ ID NO: 479162 - DNA, 20 bp, Artificial Sequence
  chemically synthesized
acttgactgccacattctag

SEQ ID NO: 479163 - DNA, 20 bp, Artificial Sequence
  chemically synthesized
cttcaggaaaggcagttgta

SEQ ID NO: 479164 - DNA, 20 bp, Artificial Sequence
  chemically synthesized
tgtgtataatattgttaaga

SEQ ID NO: 479165 - DNA, 20 bp, Artificial Sequence
  chemically synthesized
agcccaagccccgccaacag

SEQ ID NO: 479166 - DNA, 20 bp, Artificial Sequence
  chemically synthesized
tcgggaaaatcatctaatac

SEQ ID NO: 479167 - DNA, 20 bp, Artificial Sequence
  chemically synthesized
tcctgtattagatgattttc

SEQ ID NO: 479168 - DNA, 20 bp, Artificial Sequence
  chemically synthesized
agcattatctgcaaatattt

SEQ ID NO: 479169 - DNA, 20 bp, Artificial Sequence
  chemically synthesized
tgctgacgcccactggatac

SEQ ID NO: 479170 - DNA, 20 bp, Artificial Sequence
  chemically synthesized
ggcagctctgctgacgccca

SEQ ID NO: 479171 - DNA, 20 bp, Artificial Sequence
  chemically synthesized
tagcccagccaaaatgacta

SEQ ID NO: 479172 - DNA, 20 bp, Artificial Sequence
  chemically synthesized
cctggggtatgaatcaccac

SEQ ID NO: 479173 - DNA, 20 bp, Artificial Sequence
  chemically synthesized
ctcaggcaaggccctggggt

SEQ ID NO: 479174 - DNA, 20 bp, Artificial Sequence
  chemically synthesized
cttcagctcaggcaaggccc

SEQ ID NO: 479175 - DNA, 20 bp, Artificial Sequence
  chemically synthesized
gcaaaatataggcaggtttc

SEQ ID NO: 479176 - DNA, 20 bp, Artificial Sequence
  chemically synthesized
ctgaaacctagctggtacct

SEQ ID NO: 479177 - DNA, 20 bp, Artificial Sequence
  chemically synthesized
aaatatgaataactaaaggt

SEQ ID NO: 479178 - DNA, 20 bp, Artificial Sequence
  chemically synthesized
ttaagtgaaatgactaaaat

SEQ ID NO: 479179 - DNA, 20 bp, Artificial Sequence
  chemically synthesized
ttcctcttgcccactgattt

SEQ ID NO: 479180 - DNA, 20 bp, Artificial Sequence
  chemically synthesized
tggtttcctttcttgaagac

SEQ ID NO: 479181 - DNA, 20 bp, Artificial Sequence
  chemically synthesized
tgcttcttgtcagaggcaat

SEQ ID NO: 479182 - DNA, 20 bp, Artificial Sequence
  chemically synthesized
ggtcatgctttacctctaaa

SEQ ID NO: 479183 - DNA, 20 bp, Artificial Sequence
  chemically synthesized
atagccccctatctatgaca

SEQ ID NO: 479184 - DNA, 20 bp, Artificial Sequence
  chemically synthesized
aataggaaatgcctgcaggc

SEQ ID NO: 479185 - DNA, 20 bp, Artificial Sequence
  chemically synthesized
gtctatgtgctaagaacaga

SEQ ID NO: 479186 - DNA, 20 bp, Artificial Sequence
  chemically synthesized
acatagactattcttaatac

SEQ ID NO: 479187 - DNA, 20 bp, Artificial Sequence
  chemically synthesized
ccttcattcattcacgtatt

SEQ ID NO: 479188 - DNA, 20 bp, Artificial Sequence
  chemically synthesized
agactattcttaatacgtga

SEQ ID NO: 479189 - DNA, 20 bp, Artificial Sequence
  chemically synthesized
cttaatacgtgaatgaatga

SEQ ID NO: 479190 - DNA, 20 bp, Artificial Sequence
  chemically synthesized
cgtgaatgaatgaaggaatg

SEQ ID NO: 479191 - DNA, 20 bp, Artificial Sequence
  chemically synthesized
aatgaatgaaggaatgaaga

SEQ ID NO: 479192 - DNA, 20 bp, Artificial Sequence
  chemically synthesized
gtttcattctaattggaaat

SEQ ID NO: 479193 - DNA, 20 bp, Artificial Sequence
  chemically synthesized
cgataactcaaatttccaat

SEQ ID NO: 479194 - DNA, 20 bp, Artificial Sequence
  chemically synthesized
tgcagtataattttttctgt

SEQ ID NO: 479195 - DNA, 20 bp, Artificial Sequence
  chemically synthesized
aaaattttccatcacgtaac

SEQ ID NO: 479196 - DNA, 20 bp, Artificial Sequence
  chemically synthesized
ccaatacatttctactatct

SEQ ID NO: 479197 - DNA, 20 bp, Artificial Sequence
  chemically synthesized
ttggtgcagtatgaaatgaa

SEQ ID NO: 479198 - DNA, 20 bp, Artificial Sequence
  chemically synthesized
ttgaaagctattaatcttcc

SEQ ID NO: 479199 - DNA, 20 bp, Artificial Sequence
  chemically synthesized
ttgtagacttcagtctttgt

SEQ ID NO: 479200 - DNA, 20 bp, Artificial Sequence
  chemically synthesized
agtgtggcaatagttggagg

SEQ ID NO: 479201 - DNA, 20 bp, Artificial Sequence
  chemically synthesized
tagttggaggtggaatttca

SEQ ID NO: 479202 - DNA, 20 bp, Artificial Sequence
  chemically synthesized
caatggctggagatataatt

SEQ ID NO: 479203 - DNA, 20 bp, Artificial Sequence
  chemically synthesized
atattaattaccttctgttt

SEQ ID NO: 479204 - DNA, 20 bp, Artificial Sequence
  chemically synthesized
taatatatcttcggggaaag

SEQ ID NO: 479205 - DNA, 20 bp, Artificial Sequence
  chemically synthesized
cggggaaagctggattttta

SEQ ID NO: 479206 - DNA, 20 bp, Artificial Sequence
  chemically synthesized
gttttagctaaccagactaa

SEQ ID NO: 479207 - DNA, 20 bp, Artificial Sequence
  chemically synthesized
gcactaggaggtccctagtg

SEQ ID NO: 479208 - DNA, 20 bp, Artificial Sequence
  chemically synthesized
actagggacctcctagtgca

SEQ ID NO: 479209 - DNA, 20 bp, Artificial Sequence
  chemically synthesized
cagcatgcccagtatgctgc

SEQ ID NO: 479210 - DNA, 20 bp, Artificial Sequence
  chemically synthesized
gcatactgggcatgctgtgg

SEQ ID NO: 479211 - DNA, 20 bp, Artificial Sequence
  chemically synthesized
ggcatgctgtggaaggatca

SEQ ID NO: 479212 - DNA, 20 bp, Artificial Sequence
  chemically synthesized
tggaaggatcagagaatttt

SEQ ID NO: 479213 - DNA, 20 bp, Artificial Sequence
  chemically synthesized
ttctatacagttttaaataa

SEQ ID NO: 479214 - DNA, 20 bp, Artificial Sequence
  chemically synthesized
aaatgagtcattttcagact

SEQ ID NO: 479215 - DNA, 20 bp, Artificial Sequence
  chemically synthesized
gtatggtttcatttagaaaa

SEQ ID NO: 479216 - DNA, 20 bp, Artificial Sequence
  chemically synthesized
aatgaaaccatactcaaaag

SEQ ID NO: 479217 - DNA, 20 bp, Artificial Sequence
  chemically synthesized
ctctttcatatattccactt

SEQ ID NO: 479218 - DNA, 20 bp, Artificial Sequence
  chemically synthesized
taaaagatgaaagtattcaa

SEQ ID NO: 479219 - DNA, 20 bp, Artificial Sequence
  chemically synthesized
tccaaggttccctaacccac

SEQ ID NO: 479220 - DNA, 20 bp, Artificial Sequence
  chemically synthesized
gggagagatgggaagaggga

SEQ ID NO: 479221 - DNA, 20 bp, Artificial Sequence
  chemically synthesized
ccaaagggagagatgggaag

SEQ ID NO: 479222 - DNA, 20 bp, Artificial Sequence
  chemically synthesized
aggcaccttgcagaactttc

SEQ ID NO: 479223 - DNA, 20 bp, Artificial Sequence
  chemically synthesized
gcagaactttctagaatgac

SEQ ID NO: 479224 - DNA, 20 bp, Artificial Sequence
  chemically synthesized
acttgaatggtttgcatggt

SEQ ID NO: 479225 - DNA, 20 bp, Artificial Sequence
  chemically synthesized
aggctttcagaccatgcaaa

SEQ ID NO: 479226 - DNA, 20 bp, Artificial Sequence
  chemically synthesized
agttacctcacctgaaaagt

SEQ ID NO: 479227 - DNA, 20 bp, Artificial Sequence
  chemically synthesized
tacttttcaggtgaggtaac

SEQ ID NO: 479228 - DNA, 20 bp, Artificial Sequence
  chemically synthesized
aactgggatttaagaagttc

SEQ ID NO: 479229 - DNA, 20 bp, Artificial Sequence
  chemically synthesized
tcagttgagagggaaggaac

SEQ ID NO: 479230 - DNA, 20 bp, Artificial Sequence
  chemically synthesized
tgctggcaacctatgaacca

SEQ ID NO: 479231 - DNA, 20 bp, Artificial Sequence
  chemically synthesized
atggttcataggttgccagc

SEQ ID NO: 479232 - DNA, 20 bp, Artificial Sequence
  chemically synthesized
ctgggagctggttagcaatg

SEQ ID NO: 479233 - DNA, 20 bp, Artificial Sequence
  chemically synthesized
ttgccacagacctgctaaat

SEQ ID NO: 479234 - DNA, 20 bp, Artificial Sequence
  chemically synthesized
ctaaatcagaatctctgtgg

SEQ ID NO: 479235 - DNA, 20 bp, Artificial Sequence
  chemically synthesized
gcttatgaaaatgcagttgt

SEQ ID NO: 479236 - DNA, 20 bp, Artificial Sequence
  chemically synthesized
gttcaagggtgaggatgctt

SEQ ID NO: 479237 - DNA, 20 bp, Artificial Sequence
  chemically synthesized
cgggaaagatgttcaagggt

SEQ ID NO: 479238 - DNA, 20 bp, Artificial Sequence
  chemically synthesized
gaaagacgggaaagatgttc

SEQ ID NO: 479239 - DNA, 20 bp, Artificial Sequence
  chemically synthesized
acttttgagcttgggagttg

SEQ ID NO: 479240 - DNA, 20 bp, Artificial Sequence
  chemically synthesized
ttttcactacttttgagctt

SEQ ID NO: 479241 - DNA, 20 bp, Artificial Sequence
  chemically synthesized
aacagaaaaaaaattaggag

SEQ ID NO: 479242 - DNA, 20 bp, Artificial Sequence
  chemically synthesized
aaaaaattaggagaggaata

SEQ ID NO: 479243 - DNA, 20 bp, Artificial Sequence
  chemically synthesized
aggtgagggaataaaggctc

SEQ ID NO: 479244 - DNA, 20 bp, Artificial Sequence
  chemically synthesized
ttcagtgggacctgaggtga

SEQ ID NO: 479245 - DNA, 20 bp, Artificial Sequence
  chemically synthesized
ttttttttttttttttgaga

SEQ ID NO: 479246 - DNA, 20 bp, Artificial Sequence
  chemically synthesized
agggcagatcacttgaggtc

SEQ ID NO: 479247 - DNA, 20 bp, Artificial Sequence
  chemically synthesized
tcctcagcctcccaaagtac

SEQ ID NO: 479248 - DNA, 20 bp, Artificial Sequence
  chemically synthesized
aagctgaagtaaccgggaag

SEQ ID NO: 479249 - DNA, 20 bp, Artificial Sequence
  chemically synthesized
gttacttcagctttttttaa

SEQ ID NO: 479250 - DNA, 20 bp, Artificial Sequence
  chemically synthesized
ctagtccttctatttaaaca

SEQ ID NO: 479251 - DNA, 20 bp, Artificial Sequence
  chemically synthesized
ttaaatgttaaaacttatgt

SEQ ID NO: 479252 - DNA, 20 bp, Artificial Sequence
  chemically synthesized
tgaaggcccataaaaatgag

SEQ ID NO: 479253 - DNA, 20 bp, Artificial Sequence
  chemically synthesized
cccataaaaatgaggagggt

SEQ ID NO: 479254 - DNA, 20 bp, Artificial Sequence
  chemically synthesized
aactacatagaaacattccc

SEQ ID NO: 479255 - DNA, 20 bp, Artificial Sequence
  chemically synthesized
ctttgtctccttgcattcac

SEQ ID NO: 479256 - DNA, 20 bp, Artificial Sequence
  chemically synthesized
ttttaaaggagcagatatgg

SEQ ID NO: 479257 - DNA, 20 bp, Artificial Sequence
  chemically synthesized
tttacaccaaaaacttttag

SEQ ID NO: 479258 - DNA, 20 bp, Artificial Sequence
  chemically synthesized
tggtgtaaattaaagatgat

SEQ ID NO: 479259 - DNA, 20 bp, Artificial Sequence
  chemically synthesized
agtaatccattttttttttt

SEQ ID NO: 479260 - DNA, 20 bp, Artificial Sequence
  chemically synthesized
aactaccctgaaaaaaaaaa

SEQ ID NO: 479261 - DNA, 20 bp, Artificial Sequence
  chemically synthesized
aaaaaaaaaatggattactt

SEQ ID NO: 479262 - DNA, 20 bp, Artificial Sequence
  chemically synthesized
tggattactttagaatgtga

SEQ ID NO: 479263 - DNA, 20 bp, Artificial Sequence
  chemically synthesized
tatgcaaagttatttttgct

SEQ ID NO: 479264 - DNA, 20 bp, Artificial Sequence
  chemically synthesized
ttttgctttgaatagaaacc

SEQ ID NO: 479265 - DNA, 20 bp, Artificial Sequence
  chemically synthesized
atattcttaaacattgcact

SEQ ID NO: 479266 - DNA, 20 bp, Artificial Sequence
  chemically synthesized
aaaccctgagtgcaatgttt

SEQ ID NO: 479267 - DNA, 20 bp, Artificial Sequence
  chemically synthesized
ctatagaatttttgcatgtt

SEQ ID NO: 479268 - DNA, 20 bp, Artificial Sequence
  chemically synthesized
cccaacatgcaaaaattcta

SEQ ID NO: 479269 - DNA, 20 bp, Artificial Sequence
  chemically synthesized
ggttcatttgaagaattcta

SEQ ID NO: 479270 - DNA, 20 bp, Artificial Sequence
  chemically synthesized
tgacttggagggttcatttg

SEQ ID NO: 479271 - DNA, 20 bp, Artificial Sequence
  chemically synthesized
agagttaaaatactgacttg

SEQ ID NO: 479272 - DNA, 20 bp, Artificial Sequence
  chemically synthesized
acctagcacatacacagtag

SEQ ID NO: 479273 - DNA, 20 bp, Artificial Sequence
  chemically synthesized
tatgtgctaggtttcccaaa

SEQ ID NO: 479274 - DNA, 20 bp, Artificial Sequence
  chemically synthesized
aaaagattgttctgggaata

SEQ ID NO: 479275 - DNA, 20 bp, Artificial Sequence
  chemically synthesized
gctttagaaaagattgttct

SEQ ID NO: 479276 - DNA, 20 bp, Artificial Sequence
  chemically synthesized
aaagccacaaaaaacacaaa

SEQ ID NO: 479277 - DNA, 20 bp, Artificial Sequence
  chemically synthesized
gtatatcaagcataagaact

SEQ ID NO: 479278 - DNA, 20 bp, Artificial Sequence
  chemically synthesized
cacctagttttcacgtttct

SEQ ID NO: 479279 - DNA, 20 bp, Artificial Sequence
  chemically synthesized
atatatcttttgtgacaaca

SEQ ID NO: 479280 - DNA, 20 bp, Artificial Sequence
  chemically synthesized
aatttcataagcatgaattt

SEQ ID NO: 479281 - DNA, 20 bp, Artificial Sequence
  chemically synthesized
taagtcataatttcataagc

SEQ ID NO: 479282 - DNA, 20 bp, Artificial Sequence
  chemically synthesized
aaacgattcttttaaatatc

SEQ ID NO: 479283 - DNA, 20 bp, Artificial Sequence
  chemically synthesized
aagttattcttgatatttaa

SEQ ID NO: 479284 - DNA, 20 bp, Artificial Sequence
  chemically synthesized
gatatttaaaagaatcgttt

SEQ ID NO: 479285 - DNA, 20 bp, Artificial Sequence
  chemically synthesized
gtttatgagtttttgtcatc

SEQ ID NO: 479286 - DNA, 20 bp, Artificial Sequence
  chemically synthesized
gtattatttgtttttacctg

SEQ ID NO: 479287 - DNA, 20 bp, Artificial Sequence
  chemically synthesized
tagctcatcagttttttgtt

SEQ ID NO: 479288 - DNA, 20 bp, Artificial Sequence
  chemically synthesized
aatgctctctctcaccttcc

SEQ ID NO: 479289 - DNA, 20 bp, Artificial Sequence
  chemically synthesized
agagagcatttgccaccctc

SEQ ID NO: 479290 - DNA, 20 bp, Artificial Sequence
  chemically synthesized
gaagttcagttgccaccctg

SEQ ID NO: 479291 - DNA, 20 bp, Artificial Sequence
  chemically synthesized
cagggtggcaactgaacttc

SEQ ID NO: 479292 - DNA, 20 bp, Artificial Sequence
  chemically synthesized
atcaattggctgtatctcca

SEQ ID NO: 479293 - DNA, 20 bp, Artificial Sequence
  chemically synthesized
ttgtggattccatggcaatg

SEQ ID NO: 479294 - DNA, 20 bp, Artificial Sequence
  chemically synthesized
ccatcaattctccattgcca

SEQ ID NO: 479295 - DNA, 20 bp, Artificial Sequence
  chemically synthesized
aagtgtggcacatttccatt

SEQ ID NO: 479296 - DNA, 20 bp, Artificial Sequence
  chemically synthesized
ccaaggagaatatgaaaagg

SEQ ID NO: 479297 - DNA, 20 bp, Artificial Sequence
  chemically synthesized
ttttcatattctccttggaa

SEQ ID NO: 479298 - DNA, 20 bp, Artificial Sequence
  chemically synthesized
gtaactcattcagttccaag

SEQ ID NO: 479299 - DNA, 20 bp, Artificial Sequence
  chemically synthesized
catattctccttggaactga

SEQ ID NO: 479300 - DNA, 20 bp, Artificial Sequence
  chemically synthesized
ctgaatgagttactgtttca

SEQ ID NO: 479301 - DNA, 20 bp, Artificial Sequence
  chemically synthesized
atgggggccctgtactaggg

SEQ ID NO: 479302 - DNA, 20 bp, Artificial Sequence
  chemically synthesized
ggccctgtactagggaaggg

SEQ ID NO: 479303 - DNA, 20 bp, Artificial Sequence
  chemically synthesized
gacaagcaagttcatttgtt

SEQ ID NO: 479304 - DNA, 20 bp, Artificial Sequence
  chemically synthesized
gccttcagtttatcaacaca

SEQ ID NO: 479305 - DNA, 20 bp, Artificial Sequence
  chemically synthesized
gagttttcttcatgacttcc

SEQ ID NO: 479306 - DNA, 20 bp, Artificial Sequence
  chemically synthesized
atgtcagttgcatttaaata

SEQ ID NO: 479307 - DNA, 20 bp, Artificial Sequence
  chemically synthesized
atatccgattgcataattaa

SEQ ID NO: 479308 - DNA, 20 bp, Artificial Sequence
  chemically synthesized
ttactcgtttaattatgcaa

SEQ ID NO: 479309 - DNA, 20 bp, Artificial Sequence
  chemically synthesized
tgcaatcggatattaaagca

SEQ ID NO: 479310 - DNA, 20 bp, Artificial Sequence
  chemically synthesized
caatataaattggaaataaa

SEQ ID NO: 479311 - DNA, 20 bp, Artificial Sequence
  chemically synthesized
aatcttggccagtaaataat

SEQ ID NO: 479312 - DNA, 20 bp, Artificial Sequence
  chemically synthesized
attgttactttaggacttta

SEQ ID NO: 479313 - DNA, 20 bp, Artificial Sequence
  chemically synthesized
gtctgttatggtgactcagt

SEQ ID NO: 479314 - DNA, 20 bp, Artificial Sequence
  chemically synthesized
tgctgtatgggaaacccaga

SEQ ID NO: 479315 - DNA, 20 bp, Artificial Sequence
  chemically synthesized
ctgttccctacagtgtttcc

SEQ ID NO: 479316 - DNA, 20 bp, Artificial Sequence
  chemically synthesized
aggaaaaggaagaaacaatc

SEQ ID NO: 479317 - DNA, 20 bp, Artificial Sequence
  chemically synthesized
gcccagcccaataaagaact

SEQ ID NO: 479318 - DNA, 20 bp, Artificial Sequence
  chemically synthesized
gccttggcctcccaaagtcc

SEQ ID NO: 479319 - DNA, 20 bp, Artificial Sequence
  chemically synthesized
actttgggaggccaaggcgg

SEQ ID NO: 479320 - DNA, 20 bp, Artificial Sequence
  chemically synthesized
cgggcggatcacttgagatc

SEQ ID NO: 479321 - DNA, 20 bp, Artificial Sequence
  chemically synthesized
ttttgtatttttagtagaga

SEQ ID NO: 479322 - DNA, 20 bp, Artificial Sequence
  chemically synthesized
actaaaaatacaaaaattag

SEQ ID NO: 479323 - DNA, 20 bp, Artificial Sequence
  chemically synthesized
gattctcctgcctcagcctc

SEQ ID NO: 479324 - DNA, 20 bp, Artificial Sequence
  chemically synthesized
tactcaagaggctgaggcag

SEQ ID NO: 479325 - DNA, 20 bp, Artificial Sequence
  chemically synthesized
ctcactgcaacctccacctc

SEQ ID NO: 479326 - DNA, 20 bp, Artificial Sequence
  chemically synthesized
ttgtgccactgcactccagc

SEQ ID NO: 479327 - DNA, 20 bp, Artificial Sequence
  chemically synthesized
gtctcactctgcaccctggc

SEQ ID NO: 479328 - DNA, 20 bp, Artificial Sequence
  chemically synthesized
actgcactccagccagggtg

SEQ ID NO: 479329 - DNA, 20 bp, Artificial Sequence
  chemically synthesized
tttttttttttttcccgaga

SEQ ID NO: 479330 - DNA, 20 bp, Artificial Sequence
  chemically synthesized
aaaaaaaaaagaggtattta

SEQ ID NO: 479331 - DNA, 20 bp, Artificial Sequence
  chemically synthesized
aactggggctcaatgctgtt

SEQ ID NO: 479332 - DNA, 20 bp, Artificial Sequence
  chemically synthesized
aatgctgttggggatgctct

SEQ ID NO: 479333 - DNA, 20 bp, Artificial Sequence
  chemically synthesized
ggggatgctctgaggatctt

SEQ ID NO: 479334 - DNA, 20 bp, Artificial Sequence
  chemically synthesized
tcagctttctctcccctcac

SEQ ID NO: 479335 - DNA, 20 bp, Artificial Sequence
  chemically synthesized
caaccaataagggagagtag

SEQ ID NO: 479336 - DNA, 20 bp, Artificial Sequence
  chemically synthesized
gcaagactcaaccaataagg

SEQ ID NO: 479337 - DNA, 20 bp, Artificial Sequence
  chemically synthesized
catctactctcccttattgg

SEQ ID NO: 479338 - DNA, 20 bp, Artificial Sequence
  chemically synthesized
atggaccaagcccaaagtga

SEQ ID NO: 479339 - DNA, 20 bp, Artificial Sequence
  chemically synthesized
tttccatgtcctcttagctt

SEQ ID NO: 479340 - DNA, 20 bp, Artificial Sequence
  chemically synthesized
caaagctaagaggacatgga

SEQ ID NO: 479341 - DNA, 20 bp, Artificial Sequence
  chemically synthesized
ctgttttgtgggcacatatt

SEQ ID NO: 479342 - DNA, 20 bp, Artificial Sequence
  chemically synthesized
tgtgcccacaaaacagtata

SEQ ID NO: 479343 - DNA, 20 bp, Artificial Sequence
  chemically synthesized
ctgtttattttgctgtcatt

SEQ ID NO: 479344 - DNA, 20 bp, Artificial Sequence
  chemically synthesized
agatgcacacactgttcaca

SEQ ID NO: 479345 - DNA, 20 bp, Artificial Sequence
  chemically synthesized
actgttcacaaaggatttga

SEQ ID NO: 479346 - DNA, 20 bp, Artificial Sequence
  chemically synthesized
tttactttgaaatttaaggg

SEQ ID NO: 479347 - DNA, 20 bp, Artificial Sequence
  chemically synthesized
agattttactttgaaattta

SEQ ID NO: 479348 - DNA, 20 bp, Artificial Sequence
  chemically synthesized
gctgtggcacagaagttcct

SEQ ID NO: 479349 - DNA, 20 bp, Artificial Sequence
  chemically synthesized
agagttttaaaagatgtgct

SEQ ID NO: 479350 - DNA, 20 bp, Artificial Sequence
  chemically synthesized
tggttttatatgtatgtggt

SEQ ID NO: 479351 - DNA, 20 bp, Artificial Sequence
  chemically synthesized
ttatgaaaatgctctgagat

SEQ ID NO: 479352 - DNA, 20 bp, Artificial Sequence
  chemically synthesized
atctcagagcattttcataa

SEQ ID NO: 479353 - DNA, 20 bp, Artificial Sequence
  chemically synthesized
aattttgcctgcaaatgcaa

SEQ ID NO: 479354 - DNA, 20 bp, Artificial Sequence
  chemically synthesized
tgcaggcaaaattgtaaatg

SEQ ID NO: 479355 - DNA, 20 bp, Artificial Sequence
  chemically synthesized
agggaaatttcttctctgtt

SEQ ID NO: 479356 - DNA, 20 bp, Artificial Sequence
  chemically synthesized
gatactatttacaatcttct

SEQ ID NO: 479357 - DNA, 20 bp, Artificial Sequence
  chemically synthesized
tagaagattgtaaatagtat

SEQ ID NO: 479358 - DNA, 20 bp, Artificial Sequence
  chemically synthesized
atagtatctgaatgtgcact

SEQ ID NO: 479359 - DNA, 20 bp, Artificial Sequence
  chemically synthesized
ttgcgcaattgttcctgggg

SEQ ID NO: 479360 - DNA, 20 bp, Artificial Sequence
  chemically synthesized
agcatttgcgcaattgttcc

SEQ ID NO: 479361 - DNA, 20 bp, Artificial Sequence
  chemically synthesized
aaaagcagcagctctgaaaa

SEQ ID NO: 479362 - DNA, 20 bp, Artificial Sequence
  chemically synthesized
gctttttgtttttctggaga

SEQ ID NO: 479363 - DNA, 20 bp, Artificial Sequence
  chemically synthesized
ctgcactccagcttgggcag

SEQ ID NO: 479364 - DNA, 20 bp, Artificial Sequence
  chemically synthesized
tctcaccctgctgcccaagc

SEQ ID NO: 479365 - DNA, 20 bp, Artificial Sequence
  chemically synthesized
tactcaggaggctgaggtgg

SEQ ID NO: 479366 - DNA, 20 bp, Artificial Sequence
  chemically synthesized
aatcctcccacctcagcctc

SEQ ID NO: 479367 - DNA, 20 bp, Artificial Sequence
  chemically synthesized
acctcagcctcctgagtagt

SEQ ID NO: 479368 - DNA, 20 bp, Artificial Sequence
  chemically synthesized
aataaaaataaaaaacttag

SEQ ID NO: 479369 - DNA, 20 bp, Artificial Sequence
  chemically synthesized
atgaagtcccactagattgc

SEQ ID NO: 479370 - DNA, 20 bp, Artificial Sequence
  chemically synthesized
gctttgggaggctgaggcgg

SEQ ID NO: 479371 - DNA, 20 bp, Artificial Sequence
  chemically synthesized
gcctcagcctcccaaagcac

SEQ ID NO: 479372 - DNA, 20 bp, Artificial Sequence
  chemically synthesized
attgtccccttcttttatta

SEQ ID NO: 479373 - DNA, 20 bp, Artificial Sequence
  chemically synthesized
aggagcaggcactgtgctgg

SEQ ID NO: 479374 - DNA, 20 bp, Artificial Sequence
  chemically synthesized
atcttcaccactgaaatgtt

SEQ ID NO: 479375 - DNA, 20 bp, Artificial Sequence
  chemically synthesized
gtctgtttgactttaaagcc

SEQ ID NO: 479376 - DNA, 20 bp, Artificial Sequence
  chemically synthesized
ggctttaaagtcaaacagac

SEQ ID NO: 479377 - DNA, 20 bp, Artificial Sequence
  chemically synthesized
gtcaaacagacatgggttac

SEQ ID NO: 479378 - DNA, 20 bp, Artificial Sequence
  chemically synthesized
cagacatgggttacatgggt

SEQ ID NO: 479379 - DNA, 20 bp, Artificial Sequence
  chemically synthesized
cttatctatttccttatccg

SEQ ID NO: 479380 - DNA, 20 bp, Artificial Sequence
  chemically synthesized
ggtattatcatctccattct

SEQ ID NO: 479381 - DNA, 20 bp, Artificial Sequence
  chemically synthesized
tttgtgatgtatatatagtg

SEQ ID NO: 479382 - DNA, 20 bp, Artificial Sequence
  chemically synthesized
gaaagggaaagctctctctg

SEQ ID NO: 479383 - DNA, 20 bp, Artificial Sequence
  chemically synthesized
tcaggggatgttgccggccc

SEQ ID NO: 479384 - DNA, 20 bp, Artificial Sequence
  chemically synthesized
gcatctctaacaagttctca

SEQ ID NO: 479385 - DNA, 20 bp, Artificial Sequence
  chemically synthesized
gttggtctgggatggggcct

SEQ ID NO: 479386 - DNA, 20 bp, Artificial Sequence
  chemically synthesized
agtttctgtgtcagttggtc

SEQ ID NO: 479387 - DNA, 20 bp, Artificial Sequence
  chemically synthesized
ccaactgacacagaaactct

SEQ ID NO: 479388 - DNA, 20 bp, Artificial Sequence
  chemically synthesized
agctggctgggccccatccc

SEQ ID NO: 479389 - DNA, 20 bp, Artificial Sequence
  chemically synthesized
ttgacctgtaatggaatctt

SEQ ID NO: 479390 - DNA, 20 bp, Artificial Sequence
  chemically synthesized
tctcaaaagttgacctgtaa

SEQ ID NO: 479391 - DNA, 20 bp, Artificial Sequence
  chemically synthesized
tttgagaagcactgctctag

SEQ ID NO: 479392 - DNA, 20 bp, Artificial Sequence
  chemically synthesized
tgctctagcggaatagcagg

SEQ ID NO: 479393 - DNA, 20 bp, Artificial Sequence
  chemically synthesized
tacttatataccatgcagtc

SEQ ID NO: 479394 - DNA, 20 bp, Artificial Sequence
  chemically synthesized
gcaccaacctaacagctgta

SEQ ID NO: 479395 - DNA, 20 bp, Artificial Sequence
  chemically synthesized
aatcatataatcacgcccat

SEQ ID NO: 479396 - DNA, 20 bp, Artificial Sequence
  chemically synthesized
atgatttctaagtagattta

SEQ ID NO: 479397 - DNA, 20 bp, Artificial Sequence
  chemically synthesized
aaatctacttagaaatcata

SEQ ID NO: 479398 - DNA, 20 bp, Artificial Sequence
  chemically synthesized
tctgactttatgttaataca

SEQ ID NO: 479399 - DNA, 20 bp, Artificial Sequence
  chemically synthesized
tttcaaatcttaaaggcttg

SEQ ID NO: 479400 - DNA, 20 bp, Artificial Sequence
  chemically synthesized
ctaaatgaaggacaatactt

SEQ ID NO: 479401 - DNA, 20 bp, Artificial Sequence
  chemically synthesized
cttaagtattgtccttcatt

SEQ ID NO: 479402 - DNA, 20 bp, Artificial Sequence
  chemically synthesized
atatgtccttttgattttca

SEQ ID NO: 479403 - DNA, 20 bp, Artificial Sequence
  chemically synthesized
acagctatgcagtgtcaaga

SEQ ID NO: 479404 - DNA, 20 bp, Artificial Sequence
  chemically synthesized
atgcagtgtcaagatgggat

SEQ ID NO: 479405 - DNA, 20 bp, Artificial Sequence
  chemically synthesized
tgctgacatatgcactgtta

SEQ ID NO: 479406 - DNA, 20 bp, Artificial Sequence
  chemically synthesized
tctcttcttctcgcatagat

SEQ ID NO: 479407 - DNA, 20 bp, Artificial Sequence
  chemically synthesized
tcttatctatgcgagaagaa

SEQ ID NO: 479408 - DNA, 20 bp, Artificial Sequence
  chemically synthesized
atgcgagaagaagagaatat

SEQ ID NO: 479409 - DNA, 20 bp, Artificial Sequence
  chemically synthesized
tgattccaatttagccaaag

SEQ ID NO: 479410 - DNA, 20 bp, Artificial Sequence
  chemically synthesized
agactcaactttggctaaat

SEQ ID NO: 479411 - DNA, 20 bp, Artificial Sequence
  chemically synthesized
aagattaaaaacaatgatat

SEQ ID NO: 479412 - DNA, 20 bp, Artificial Sequence
  chemically synthesized
aaagtctgatatcattggct

SEQ ID NO: 479413 - DNA, 20 bp, Artificial Sequence
  chemically synthesized
actagctggtatctggttgg

SEQ ID NO: 479414 - DNA, 20 bp, Artificial Sequence
  chemically synthesized
ggttgggagaatcactagta

SEQ ID NO: 479415 - DNA, 20 bp, Artificial Sequence
  chemically synthesized
gcgttgatcatattttacat

SEQ ID NO: 479416 - DNA, 20 bp, Artificial Sequence
  chemically synthesized
atgttatcactttgatacaa

SEQ ID NO: 479417 - DNA, 20 bp, Artificial Sequence
  chemically synthesized
ttgatacaaatgaatcataa

SEQ ID NO: 479418 - DNA, 20 bp, Artificial Sequence
  chemically synthesized
taagtgaatggagtgagtga

SEQ ID NO: 479419 - DNA, 20 bp, Artificial Sequence
  chemically synthesized
taagtaagtgaatggagtga

SEQ ID NO: 479420 - DNA, 20 bp, Artificial Sequence
  chemically synthesized
tgaataagtaagtgaatgga

SEQ ID NO: 479421 - DNA, 20 bp, Artificial Sequence
  chemically synthesized
ttaatgaataagtaagtgaa

SEQ ID NO: 479422 - DNA, 20 bp, Artificial Sequence
  chemically synthesized
aagcattaatgaataagtaa

SEQ ID NO: 479423 - DNA, 20 bp, Artificial Sequence
  chemically synthesized
aatatttaatgaaagcatta

SEQ ID NO: 479424 - DNA, 20 bp, Artificial Sequence
  chemically synthesized
acaaagcttaagatctaaac

SEQ ID NO: 479425 - DNA, 20 bp, Artificial Sequence
  chemically synthesized
atatggtatttcaattgccc

SEQ ID NO: 479426 - DNA, 20 bp, Artificial Sequence
  chemically synthesized
aattgaaataccatatggca

SEQ ID NO: 479427 - DNA, 20 bp, Artificial Sequence
  chemically synthesized
aaggtgcaggagatccggtt

SEQ ID NO: 479428 - DNA, 20 bp, Artificial Sequence
  chemically synthesized
agattcctgaacatcccaaa

SEQ ID NO: 479429 - DNA, 20 bp, Artificial Sequence
  chemically synthesized
agatccggtttgggatgttc

SEQ ID NO: 479430 - DNA, 20 bp, Artificial Sequence
  chemically synthesized
ttatgaggtgctgtctgaaa

SEQ ID NO: 479431 - DNA, 20 bp, Artificial Sequence
  chemically synthesized
aaagatattttatttgattg

SEQ ID NO: 479432 - DNA, 20 bp, Artificial Sequence
  chemically synthesized
gattgtagagttcagtaaag

SEQ ID NO: 479433 - DNA, 20 bp, Artificial Sequence
  chemically synthesized
tcagtaaagagggataaggc

SEQ ID NO: 479434 - DNA, 20 bp, Artificial Sequence
  chemically synthesized
ataaggcttgagtggtcaca

SEQ ID NO: 479435 - DNA, 20 bp, Artificial Sequence
  chemically synthesized
atgaagggccatgtaagtag

SEQ ID NO: 479436 - DNA, 20 bp, Artificial Sequence
  chemically synthesized
aagcaactaacttgatgtca

SEQ ID NO: 479437 - DNA, 20 bp, Artificial Sequence
  chemically synthesized
attatgtgtatctctttcca

SEQ ID NO: 479438 - DNA, 20 bp, Artificial Sequence
  chemically synthesized
agatacacataattggctct

SEQ ID NO: 479439 - DNA, 20 bp, Artificial Sequence
  chemically synthesized
tgtactaaacatagatagtg

SEQ ID NO: 479440 - DNA, 20 bp, Artificial Sequence
  chemically synthesized
acccaggtgcctcatgaata

SEQ ID NO: 479441 - DNA, 20 bp, Artificial Sequence
  chemically synthesized
acccaatattcatgaggcac

SEQ ID NO: 479442 - DNA, 20 bp, Artificial Sequence
  chemically synthesized
atttagtacccaggtgcctc

SEQ ID NO: 479443 - DNA, 20 bp, Artificial Sequence
  chemically synthesized
tcatgtgtatttagcatatt

SEQ ID NO: 479444 - DNA, 20 bp, Artificial Sequence
  chemically synthesized
tcatgtgtatttatttgatc

SEQ ID NO: 479445 - DNA, 20 bp, Artificial Sequence
  chemically synthesized
taggtatcacctatggatgc

SEQ ID NO: 479446 - DNA, 20 bp, Artificial Sequence
  chemically synthesized
tgctggaataggtatcacct

SEQ ID NO: 479447 - DNA, 20 bp, Artificial Sequence
  chemically synthesized
aggcagaagacttacggtgc

SEQ ID NO: 479448 - DNA, 20 bp, Artificial Sequence
  chemically synthesized
gcaccgtaagtcttctgcct

SEQ ID NO: 479449 - DNA, 20 bp, Artificial Sequence
  chemically synthesized
tttatcagagacacagagac

SEQ ID NO: 479450 - DNA, 20 bp, Artificial Sequence
  chemically synthesized
ctctgataaaccacatgcca

SEQ ID NO: 479451 - DNA, 20 bp, Artificial Sequence
  chemically synthesized
tcccaacaagggagtccaaa

SEQ ID NO: 479452 - DNA, 20 bp, Artificial Sequence
  chemically synthesized
caaagttgacttcccaacaa

SEQ ID NO: 479453 - DNA, 20 bp, Artificial Sequence
  chemically synthesized
acatataatgttgtgtactg

SEQ ID NO: 479454 - DNA, 20 bp, Artificial Sequence
  chemically synthesized
gactgtgaagattagagtac

SEQ ID NO: 479455 - DNA, 20 bp, Artificial Sequence
  chemically synthesized
tgtaagcagactgtgaagat

SEQ ID NO: 479456 - DNA, 20 bp, Artificial Sequence
  chemically synthesized
ctaagttaacacgcttagaa

SEQ ID NO: 479457 - DNA, 20 bp, Artificial Sequence
  chemically synthesized
atgtgctaagttaacacgct

SEQ ID NO: 479458 - DNA, 20 bp, Artificial Sequence
  chemically synthesized
aaattaaaatacttgaatca

SEQ ID NO: 479459 - DNA, 20 bp, Artificial Sequence
  chemically synthesized
catagaccaaattaaaatac

SEQ ID NO: 479460 - DNA, 20 bp, Artificial Sequence
  chemically synthesized
gagcctttctgtttcatgat

SEQ ID NO: 479461 - DNA, 20 bp, Artificial Sequence
  chemically synthesized
taaacttcctctgtcatctg

SEQ ID NO: 479462 - DNA, 20 bp, Artificial Sequence
  chemically synthesized
acctcggcctcccaaagtgc

SEQ ID NO: 479463 - DNA, 20 bp, Artificial Sequence
  chemically synthesized
cagcactttgggaggccgag

SEQ ID NO: 479464 - DNA, 20 bp, Artificial Sequence
  chemically synthesized
actttgggaggccgaggtgg

SEQ ID NO: 479465 - DNA, 20 bp, Artificial Sequence
  chemically synthesized
tggggtttctccttgttagc

SEQ ID NO: 479466 - DNA, 20 bp, Artificial Sequence
  chemically synthesized
ttgtgcatttttagtagaga

SEQ ID NO: 479467 - DNA, 20 bp, Artificial Sequence
  chemically synthesized
tgctcgggaggctgaggcag

SEQ ID NO: 479468 - DNA, 20 bp, Artificial Sequence
  chemically synthesized
ctcactgcaagctccacctc

SEQ ID NO: 479469 - DNA, 20 bp, Artificial Sequence
  chemically synthesized
tcacaccactgcactctagc

SEQ ID NO: 479470 - DNA, 20 bp, Artificial Sequence
  chemically synthesized
tctcactctgttacccaggc

SEQ ID NO: 479471 - DNA, 20 bp, Artificial Sequence
  chemically synthesized
ctgcactctagcctgggtaa

SEQ ID NO: 479472 - DNA, 20 bp, Artificial Sequence
  chemically synthesized
ctttttttttttttttgata

SEQ ID NO: 479473 - DNA, 20 bp, Artificial Sequence
  chemically synthesized
ttcaagggggaaaaacacct

SEQ ID NO: 479474 - DNA, 20 bp, Artificial Sequence
  chemically synthesized
gagttgatgaagatcattcg

SEQ ID NO: 479475 - DNA, 20 bp, Artificial Sequence
  chemically synthesized
caaatgattaagcaaattca

SEQ ID NO: 479476 - DNA, 20 bp, Artificial Sequence
  chemically synthesized
taatcatttgctacatttta

SEQ ID NO: 479477 - DNA, 20 bp, Artificial Sequence
  chemically synthesized
aaaaaaaaaaaaatcttgaa

SEQ ID NO: 479478 - DNA, 20 bp, Artificial Sequence
  chemically synthesized
ttgtgaggccacatccagaa

SEQ ID NO: 479479 - DNA, 20 bp, Artificial Sequence
  chemically synthesized
gactttttctcaattccttt

SEQ ID NO: 479480 - DNA, 20 bp, Artificial Sequence
  chemically synthesized
aatatatgatcaaagaaatg

SEQ ID NO: 479481 - DNA, 20 bp, Artificial Sequence
  chemically synthesized
gtgtcatcagaatatgatgc

SEQ ID NO: 479482 - DNA, 20 bp, Artificial Sequence
  chemically synthesized
tgaaaatgagcaagtgtcat

SEQ ID NO: 479483 - DNA, 20 bp, Artificial Sequence
  chemically synthesized
aatattaaaaaacacaagag

SEQ ID NO: 479484 - DNA, 20 bp, Artificial Sequence
  chemically synthesized
agtgtcattgaaagacctaa

SEQ ID NO: 479485 - DNA, 20 bp, Artificial Sequence
  chemically synthesized
aaataatattcagaaacaga

SEQ ID NO: 479486 - DNA, 20 bp, Artificial Sequence
  chemically synthesized
gagcataatcctctctgttt

SEQ ID NO: 479487 - DNA, 20 bp, Artificial Sequence
  chemically synthesized
gaaatttaatttaagtttgt

SEQ ID NO: 479488 - DNA, 20 bp, Artificial Sequence
  chemically synthesized
tagccccctgcagtatctag

SEQ ID NO: 479489 - DNA, 20 bp, Artificial Sequence
  chemically synthesized
taattagactgtaaagtcct

SEQ ID NO: 479490 - DNA, 20 bp, Artificial Sequence
  chemically synthesized
acagtctaattacaactatg

SEQ ID NO: 479491 - DNA, 20 bp, Artificial Sequence
  chemically synthesized
aggagaaacatagctgctgg

SEQ ID NO: 479492 - DNA, 20 bp, Artificial Sequence
  chemically synthesized
ggagacagtacttcaataat

SEQ ID NO: 479493 - DNA, 20 bp, Artificial Sequence
  chemically synthesized
agccactgtcttgcctttta

SEQ ID NO: 479494 - DNA, 20 bp, Artificial Sequence
  chemically synthesized
catgtggcctgtaaactctt

SEQ ID NO: 479495 - DNA, 20 bp, Artificial Sequence
  chemically synthesized
agtttggggtctttattcaa

SEQ ID NO: 479496 - DNA, 20 bp, Artificial Sequence
  chemically synthesized
aataaagaccccaaacttct

SEQ ID NO: 479497 - DNA, 20 bp, Artificial Sequence
  chemically synthesized
agtaattacccatagaagtt

SEQ ID NO: 479498 - DNA, 20 bp, Artificial Sequence
  chemically synthesized
aataatgatgtttggggtga

SEQ ID NO: 479499 - DNA, 20 bp, Artificial Sequence
  chemically synthesized
atcagtttaataatgatgtt

SEQ ID NO: 479500 - DNA, 20 bp, Artificial Sequence
  chemically synthesized
tcccagggcaacattggaaa

SEQ ID NO: 479501 - DNA, 20 bp, Artificial Sequence
  chemically synthesized
gaaacagagtcatctccagt

SEQ ID NO: 479502 - DNA, 20 bp, Artificial Sequence
  chemically synthesized
cacaactgtctgttttaaca

SEQ ID NO: 479503 - DNA, 20 bp, Artificial Sequence
  chemically synthesized
aacccttggcctctagagcc

SEQ ID NO: 479504 - DNA, 20 bp, Artificial Sequence
  chemically synthesized
cactctaggctctagaggcc

SEQ ID NO: 479505 - DNA, 20 bp, Artificial Sequence
  chemically synthesized
atgtactaattgctagattt

SEQ ID NO: 479506 - DNA, 20 bp, Artificial Sequence
  chemically synthesized
aagtgctcaattaatgctta

SEQ ID NO: 479507 - DNA, 20 bp, Artificial Sequence
  chemically synthesized
ctcctttggcaaccaagaca

SEQ ID NO: 479508 - DNA, 20 bp, Artificial Sequence
  chemically synthesized
gccaaaggaggggaaagaga

SEQ ID NO: 479509 - DNA, 20 bp, Artificial Sequence
  chemically synthesized
aggaggggaaagagaaaggg

SEQ ID NO: 479510 - DNA, 20 bp, Artificial Sequence
  chemically synthesized
aatctgttcattgtgctagt

SEQ ID NO: 479511 - DNA, 20 bp, Artificial Sequence
  chemically synthesized
aactagcacaatgaacagat

SEQ ID NO: 479512 - DNA, 20 bp, Artificial Sequence
  chemically synthesized
tttccaatctgtatttgtat

SEQ ID NO: 479513 - DNA, 20 bp, Artificial Sequence
  chemically synthesized
ctccactcctcgtagcccag

SEQ ID NO: 479514 - DNA, 20 bp, Artificial Sequence
  chemically synthesized
aaaaaccccactgggctacg

SEQ ID NO: 479515 - DNA, 20 bp, Artificial Sequence
  chemically synthesized
ccccactgggctacgaggag

SEQ ID NO: 479516 - DNA, 20 bp, Artificial Sequence
  chemically synthesized
gctagaggggatatatagca

SEQ ID NO: 479517 - DNA, 20 bp, Artificial Sequence
  chemically synthesized
gtcacctaaggccagctaga

SEQ ID NO: 479518 - DNA, 20 bp, Artificial Sequence
  chemically synthesized
caaggctcctttagacattc

SEQ ID NO: 479519 - DNA, 20 bp, Artificial Sequence
  chemically synthesized
attctgcaatattttcattc

SEQ ID NO: 479520 - DNA, 20 bp, Artificial Sequence
  chemically synthesized
attctagaatgaaaatattg

SEQ ID NO: 479521 - DNA, 20 bp, Artificial Sequence
  chemically synthesized
gaatgaaaatattgcagaat

SEQ ID NO: 479522 - DNA, 20 bp, Artificial Sequence
  chemically synthesized
attattcaggctttatctaa

SEQ ID NO: 479523 - DNA, 20 bp, Artificial Sequence
  chemically synthesized
tttactctcttagataaagc

SEQ ID NO: 479524 - DNA, 20 bp, Artificial Sequence
  chemically synthesized
ggaagataacaaagtgtcat

SEQ ID NO: 479525 - DNA, 20 bp, Artificial Sequence
  chemically synthesized
ttatctaagaaagataacat

SEQ ID NO: 479526 - DNA, 20 bp, Artificial Sequence
  chemically synthesized
taagaaagataacattaggg

SEQ ID NO: 479527 - DNA, 20 bp, Artificial Sequence
  chemically synthesized
gggtggaatgaagagctctg

SEQ ID NO: 479528 - DNA, 20 bp, Artificial Sequence
  chemically synthesized
gctctgaagagtgccaatat

SEQ ID NO: 479529 - DNA, 20 bp, Artificial Sequence
  chemically synthesized
agaaagccttttcttttttg

SEQ ID NO: 479530 - DNA, 20 bp, Artificial Sequence
  chemically synthesized
cttttttggtgaatacatga

SEQ ID NO: 479531 - DNA, 20 bp, Artificial Sequence
  chemically synthesized
ttggtgaatacatgattgag

SEQ ID NO: 479532 - DNA, 20 bp, Artificial Sequence
  chemically synthesized
aattttacgttgctggaagg

SEQ ID NO: 479533 - DNA, 20 bp, Artificial Sequence
  chemically synthesized
ctctttctctctctttggtg

SEQ ID NO: 479534 - DNA, 20 bp, Artificial Sequence
  chemically synthesized
aacgtgcgtgcagatccctt

SEQ ID NO: 479535 - DNA, 20 bp, Artificial Sequence
  chemically synthesized
ccattgtaagacaatcccca

SEQ ID NO: 479536 - DNA, 20 bp, Artificial Sequence
  chemically synthesized
ttggggattgtcttacaatg

SEQ ID NO: 479537 - DNA, 20 bp, Artificial Sequence
  chemically synthesized
ccacttcagaactgttgaat

SEQ ID NO: 479538 - DNA, 20 bp, Artificial Sequence
  chemically synthesized
caggccccacttcagaactg

SEQ ID NO: 479539 - DNA, 20 bp, Artificial Sequence
  chemically synthesized
aacagttctgaagtggggcc

SEQ ID NO: 479540 - DNA, 20 bp, Artificial Sequence
  chemically synthesized
acatctcttgggagtttttt

SEQ ID NO: 479541 - DNA, 20 bp, Artificial Sequence
  chemically synthesized
ttgaagcctcaacatctctt

SEQ ID NO: 479542 - DNA, 20 bp, Artificial Sequence
  chemically synthesized
agtatgtaattataacagaa

SEQ ID NO: 479543 - DNA, 20 bp, Artificial Sequence
  chemically synthesized
cacaaaagaaagaactatga

SEQ ID NO: 479544 - DNA, 20 bp, Artificial Sequence
  chemically synthesized
gaactatgaaagaattatgt

SEQ ID NO: 479545 - DNA, 20 bp, Artificial Sequence
  chemically synthesized
atctttcactttgttgcttc

SEQ ID NO: 479546 - DNA, 20 bp, Artificial Sequence
  chemically synthesized
tgtaggggaaaaaagaagaa

SEQ ID NO: 479547 - DNA, 20 bp, Artificial Sequence
  chemically synthesized
gcatctccagatctccttga

SEQ ID NO: 479548 - DNA, 20 bp, Artificial Sequence
  chemically synthesized
atctccttgaaagggtcaag

SEQ ID NO: 479549 - DNA, 20 bp, Artificial Sequence
  chemically synthesized
gctatctaactatgttggta

SEQ ID NO: 479550 - DNA, 20 bp, Artificial Sequence
  chemically synthesized
taactatgttggtaaggagt

SEQ ID NO: 479551 - DNA, 20 bp, Artificial Sequence
  chemically synthesized
tagatatgcattgaatgtca

SEQ ID NO: 479552 - DNA, 20 bp, Artificial Sequence
  chemically synthesized
cagcttggcttagatatgca

SEQ ID NO: 479553 - DNA, 20 bp, Artificial Sequence
  chemically synthesized
tacgaactcctttggcaggc

SEQ ID NO: 479554 - DNA, 20 bp, Artificial Sequence
  chemically synthesized
aacacactcaagcctgccaa

SEQ ID NO: 479555 - DNA, 20 bp, Artificial Sequence
  chemically synthesized
gaattatttcttctgataat

SEQ ID NO: 479556 - DNA, 20 bp, Artificial Sequence
  chemically synthesized
tatttctaatttttcttaat

SEQ ID NO: 479557 - DNA, 20 bp, Artificial Sequence
  chemically synthesized
aaaatgaagagatgacactg

SEQ ID NO: 479558 - DNA, 20 bp, Artificial Sequence
  chemically synthesized
tttcagctattattcagtaa

SEQ ID NO: 479559 - DNA, 20 bp, Artificial Sequence
  chemically synthesized
gaaactgttggactcactta

SEQ ID NO: 479560 - DNA, 20 bp, Artificial Sequence
  chemically synthesized
caacagtttcctctgatatt

SEQ ID NO: 479561 - DNA, 20 bp, Artificial Sequence
  chemically synthesized
aggcaatttgctcatgaaat

SEQ ID NO: 479562 - DNA, 20 bp, Artificial Sequence
  chemically synthesized
agaatctagcccttcccttg

SEQ ID NO: 479563 - DNA, 20 bp, Artificial Sequence
  chemically synthesized
gcccttcccttgctgggttg

SEQ ID NO: 479564 - DNA, 20 bp, Artificial Sequence
  chemically synthesized
caatagctagagaagaatat

SEQ ID NO: 479565 - DNA, 20 bp, Artificial Sequence
  chemically synthesized
aaatgaggcaatagctagag

SEQ ID NO: 479566 - DNA, 20 bp, Artificial Sequence
  chemically synthesized
aatggagatgaagacatgaa

SEQ ID NO: 479567 - DNA, 20 bp, Artificial Sequence
  chemically synthesized
gaagtagggaggtggaaata

SEQ ID NO: 479568 - DNA, 20 bp, Artificial Sequence
  chemically synthesized
agccaagaagtcttatggtg

SEQ ID NO: 479569 - DNA, 20 bp, Artificial Sequence
  chemically synthesized
gtctcggcctcccaaagtgc

SEQ ID NO: 479570 - DNA, 20 bp, Artificial Sequence
  chemically synthesized
actttgggaggccgagacgg

SEQ ID NO: 479571 - DNA, 20 bp, Artificial Sequence
  chemically synthesized
cggggtttcaccgtgttagc

SEQ ID NO: 479572 - DNA, 20 bp, Artificial Sequence
  chemically synthesized
ttttgtatttttagtagaga

SEQ ID NO: 479573 - DNA, 20 bp, Artificial Sequence
  chemically synthesized
tacacgggaggctgaggcag

SEQ ID NO: 479574 - DNA, 20 bp, Artificial Sequence
  chemically synthesized
ctcactgcaagctccgcctc

SEQ ID NO: 479575 - DNA, 20 bp, Artificial Sequence
  chemically synthesized
cccgggaggcggagcttgca

SEQ ID NO: 479576 - DNA, 20 bp, Artificial Sequence
  chemically synthesized
tttcgctctgtcgcccaggc

SEQ ID NO: 479577 - DNA, 20 bp, Artificial Sequence
  chemically synthesized
ttttttttttttttttgaga

SEQ ID NO: 479578 - DNA, 20 bp, Artificial Sequence
  chemically synthesized
ggttcatgatgatgcaatca

SEQ ID NO: 479579 - DNA, 20 bp, Artificial Sequence
  chemically synthesized
agttgaccctcaaacagtgt

SEQ ID NO: 479580 - DNA, 20 bp, Artificial Sequence
  chemically synthesized
cccgaaccctcacactgttt

SEQ ID NO: 479581 - DNA, 20 bp, Artificial Sequence
  chemically synthesized
aagtcttattgtggtgagtt

SEQ ID NO: 479582 - DNA, 20 bp, Artificial Sequence
  chemically synthesized
agccaagaagtcttattgtg

SEQ ID NO: 479583 - DNA, 20 bp, Artificial Sequence
  chemically synthesized
aggttcatgatgatgcctca

SEQ ID NO: 479584 - DNA, 20 bp, Artificial Sequence
  chemically synthesized
taggtgtgaacactatttct

SEQ ID NO: 479585 - DNA, 20 bp, Artificial Sequence
  chemically synthesized
aatggcaggctacaaaggag

SEQ ID NO: 479586 - DNA, 20 bp, Artificial Sequence
  chemically synthesized
taggggtgtgatttctcagg

SEQ ID NO: 479587 - DNA, 20 bp, Artificial Sequence
  chemically synthesized
tttcccacttatgcaagagt

SEQ ID NO: 479588 - DNA, 20 bp, Artificial Sequence
  chemically synthesized
gaagaatttcccacttatgc

SEQ ID NO: 479589 - DNA, 20 bp, Artificial Sequence
  chemically synthesized
cattcctcacctaagatttg

SEQ ID NO: 479590 - DNA, 20 bp, Artificial Sequence
  chemically synthesized
aattcttcaaatcttaggtg

SEQ ID NO: 479591 - DNA, 20 bp, Artificial Sequence
  chemically synthesized
cttgtgcatgcagatctttt

SEQ ID NO: 479592 - DNA, 20 bp, Artificial Sequence
  chemically synthesized
ccacttcaaaactgttgaat

SEQ ID NO: 479593 - DNA, 20 bp, Artificial Sequence
  chemically synthesized
caggccccacttcaaaactg

SEQ ID NO: 479594 - DNA, 20 bp, Artificial Sequence
  chemically synthesized
aacagttttgaagtggggcc

SEQ ID NO: 479595 - DNA, 20 bp, Artificial Sequence
  chemically synthesized
ttgaagccttgacataactt

SEQ ID NO: 479596 - DNA, 20 bp, Artificial Sequence
  chemically synthesized
caaggttgacactgtcttta

SEQ ID NO: 479597 - DNA, 20 bp, Artificial Sequence
  chemically synthesized
aatctctaattattacagaa

SEQ ID NO: 479598 - DNA, 20 bp, Artificial Sequence
  chemically synthesized
tgaaagaaaagacattatgt

SEQ ID NO: 479599 - DNA, 20 bp, Artificial Sequence
  chemically synthesized
aagataagctcttcacaaag

SEQ ID NO: 479600 - DNA, 20 bp, Artificial Sequence
  chemically synthesized
tgaatgggcttcacaatgat

SEQ ID NO: 479601 - DNA, 20 bp, Artificial Sequence
  chemically synthesized
cttcacaatgatcagggtgg

SEQ ID NO: 479602 - DNA, 20 bp, Artificial Sequence
  chemically synthesized
caaaggagtttgtgggccca

SEQ ID NO: 479603 - DNA, 20 bp, Artificial Sequence
  chemically synthesized
atccgtaatataagttgcaa

SEQ ID NO: 479604 - DNA, 20 bp, Artificial Sequence
  chemically synthesized
actcctttgcaacttatatt

SEQ ID NO: 479605 - DNA, 20 bp, Artificial Sequence
  chemically synthesized
cagatcacggcactgtctgt

SEQ ID NO: 479606 - DNA, 20 bp, Artificial Sequence
  chemically synthesized
cagacagtgccgtgatctgt

SEQ ID NO: 479607 - DNA, 20 bp, Artificial Sequence
  chemically synthesized
ctaaatgctgggcccagcca

SEQ ID NO: 479608 - DNA, 20 bp, Artificial Sequence
  chemically synthesized
tgaggaggtggagggagagg

SEQ ID NO: 479609 - DNA, 20 bp, Artificial Sequence
  chemically synthesized
ctacttaacgtgaagataat

SEQ ID NO: 479610 - DNA, 20 bp, Artificial Sequence
  chemically synthesized
ttactattaattaagtggaa

SEQ ID NO: 479611 - DNA, 20 bp, Artificial Sequence
  chemically synthesized
tctctaacttactttattgc

SEQ ID NO: 479612 - DNA, 20 bp, Artificial Sequence
  chemically synthesized
gaagccatactgataacata

SEQ ID NO: 479613 - DNA, 20 bp, Artificial Sequence
  chemically synthesized
tattagtagttacgttttgg

SEQ ID NO: 479614 - DNA, 20 bp, Artificial Sequence
  chemically synthesized
agttgaccctcaaacaatgt

SEQ ID NO: 479615 - DNA, 20 bp, Artificial Sequence
  chemically synthesized
ccctaaccctcacattgttt

SEQ ID NO: 479616 - DNA, 20 bp, Artificial Sequence
  chemically synthesized
gttcttagacacggcccagc

SEQ ID NO: 479617 - DNA, 20 bp, Artificial Sequence
  chemically synthesized
gccacatactgtctaacaag

SEQ ID NO: 479618 - DNA, 20 bp, Artificial Sequence
  chemically synthesized
tatacaaaacttttgaaaaa

SEQ ID NO: 479619 - DNA, 20 bp, Artificial Sequence
  chemically synthesized
caaatttggcttcctggaga

SEQ ID NO: 479620 - DNA, 20 bp, Artificial Sequence
  chemically synthesized
gaggtgaactgggattttgg

SEQ ID NO: 479621 - DNA, 20 bp, Artificial Sequence
  chemically synthesized
catcagtccctgaggtgaac

SEQ ID NO: 479622 - DNA, 20 bp, Artificial Sequence
  chemically synthesized
gttcacctcagggactgatg

SEQ ID NO: 479623 - DNA, 20 bp, Artificial Sequence
  chemically synthesized
gaaactgaaaaagcaaaaaa

SEQ ID NO: 479624 - DNA, 20 bp, Artificial Sequence
  chemically synthesized
aaaagcaaaaaacggggtgg

SEQ ID NO: 479625 - DNA, 20 bp, Artificial Sequence
  chemically synthesized
cttaggacctctccaatgaa

SEQ ID NO: 479626 - DNA, 20 bp, Artificial Sequence
  chemically synthesized
aggtcctaaggaaacctggc

SEQ ID NO: 479627 - DNA, 20 bp, Artificial Sequence
  chemically synthesized
gtgtattggcctggggatgg

SEQ ID NO: 479628 - DNA, 20 bp, Artificial Sequence
  chemically synthesized
aatatgatgtgtattggcct

SEQ ID NO: 479629 - DNA, 20 bp, Artificial Sequence
  chemically synthesized
gcactgttgaaggaggacaa

SEQ ID NO: 479630 - DNA, 20 bp, Artificial Sequence
  chemically synthesized
attatatactaatggtaaac

SEQ ID NO: 479631 - DNA, 20 bp, Artificial Sequence
  chemically synthesized
ataacacttgtccttaaaat

SEQ ID NO: 479632 - DNA, 20 bp, Artificial Sequence
  chemically synthesized
tagattgatgcccagcagca

SEQ ID NO: 479633 - DNA, 20 bp, Artificial Sequence
  chemically synthesized
tagttattgattattattat

SEQ ID NO: 479634 - DNA, 20 bp, Artificial Sequence
  chemically synthesized
taatcaataactatcattta

SEQ ID NO: 479635 - DNA, 20 bp, Artificial Sequence
  chemically synthesized
ttggttttattatgaggtgg

SEQ ID NO: 479636 - DNA, 20 bp, Artificial Sequence
  chemically synthesized
cgataagataatatagaaaa

SEQ ID NO: 479637 - DNA, 20 bp, Artificial Sequence
  chemically synthesized
ttactgcaaatatataacca

SEQ ID NO: 479638 - DNA, 20 bp, Artificial Sequence
  chemically synthesized
tttcacaaaaagtgaaaagg

SEQ ID NO: 479639 - DNA, 20 bp, Artificial Sequence
  chemically synthesized
gttaccttggattttcaaag

SEQ ID NO: 479640 - DNA, 20 bp, Artificial Sequence
  chemically synthesized
ggttatcagtatttgttacc

SEQ ID NO: 479641 - DNA, 20 bp, Artificial Sequence
  chemically synthesized
ggattacataaccatgaagg

SEQ ID NO: 479642 - DNA, 20 bp, Artificial Sequence
  chemically synthesized
aaaagataaaattaatctta

SEQ ID NO: 479643 - DNA, 20 bp, Artificial Sequence
  chemically synthesized
tatcttttttattttaaaaa

SEQ ID NO: 479644 - DNA, 20 bp, Artificial Sequence
  chemically synthesized
agctgtgtctactgtcctga

SEQ ID NO: 479645 - DNA, 20 bp, Artificial Sequence
  chemically synthesized
gactaaataataattcattc

SEQ ID NO: 479646 - DNA, 20 bp, Artificial Sequence
  chemically synthesized
aattatttgggcatcccaga

SEQ ID NO: 479647 - DNA, 20 bp, Artificial Sequence
  chemically synthesized
atggaattatttgggcatcc

SEQ ID NO: 479648 - DNA, 20 bp, Artificial Sequence
  chemically synthesized
ggaaattattgaatatgtta

SEQ ID NO: 479649 - DNA, 20 bp, Artificial Sequence
  chemically synthesized
acccttcagtgtggaaatta

SEQ ID NO: 479650 - DNA, 20 bp, Artificial Sequence
  chemically synthesized
attcaataatttccacactg

SEQ ID NO: 479651 - DNA, 20 bp, Artificial Sequence
  chemically synthesized
agtatgaaaggctgtatgta

SEQ ID NO: 479652 - DNA, 20 bp, Artificial Sequence
  chemically synthesized
gtagtattgattctcagaaa

SEQ ID NO: 479653 - DNA, 20 bp, Artificial Sequence
  chemically synthesized
tgatcagtcactccatttct

SEQ ID NO: 479654 - DNA, 20 bp, Artificial Sequence
  chemically synthesized
gcgtttcatctgcaatatct

SEQ ID NO: 479655 - DNA, 20 bp, Artificial Sequence
  chemically synthesized
ctaacaaatagacagaaatt

SEQ ID NO: 479656 - DNA, 20 bp, Artificial Sequence
  chemically synthesized
tatgcttcctcatagtagta

SEQ ID NO: 479657 - DNA, 20 bp, Artificial Sequence
  chemically synthesized
agttttatttttccagctat

SEQ ID NO: 479658 - DNA, 20 bp, Artificial Sequence
  chemically synthesized
ctatctggatatcctcttct

SEQ ID NO: 479659 - DNA, 20 bp, Artificial Sequence
  chemically synthesized
ggaatatgcaattcccagaa

SEQ ID NO: 479660 - DNA, 20 bp, Artificial Sequence
  chemically synthesized
tacaaaactggccgaagtat

SEQ ID NO: 479661 - DNA, 20 bp, Artificial Sequence
  chemically synthesized
atacttcggccagttttgta

SEQ ID NO: 479662 - DNA, 20 bp, Artificial Sequence
  chemically synthesized
ccagttttgtactgggttgt

SEQ ID NO: 479663 - DNA, 20 bp, Artificial Sequence
  chemically synthesized
atctctttatgtcacatgtt

SEQ ID NO: 479664 - DNA, 20 bp, Artificial Sequence
  chemically synthesized
gtcaaaagaaaaacagcaaa

SEQ ID NO: 479665 - DNA, 20 bp, Artificial Sequence
  chemically synthesized
atattttttccttatagctt

SEQ ID NO: 479666 - DNA, 20 bp, Artificial Sequence
  chemically synthesized
gaaaacgtcttcctcattcc

SEQ ID NO: 479667 - DNA, 20 bp, Artificial Sequence
  chemically synthesized
aatgtaaaaacaaaaattct

SEQ ID NO: 479668 - DNA, 20 bp, Artificial Sequence
  chemically synthesized
cctcctagcttatgcaatgt

SEQ ID NO: 479669 - DNA, 20 bp, Artificial Sequence
  chemically synthesized
ggcaatctgtgttttctaag

SEQ ID NO: 479670 - DNA, 20 bp, Artificial Sequence
  chemically synthesized
gttttctaagaggaattgca

SEQ ID NO: 479671 - DNA, 20 bp, Artificial Sequence
  chemically synthesized
aagagtgctggcaccattta

SEQ ID NO: 479672 - DNA, 20 bp, Artificial Sequence
  chemically synthesized
gaataaaacacctttattcc

SEQ ID NO: 479673 - DNA, 20 bp, Artificial Sequence
  chemically synthesized
aaatgtgttattttaattca

SEQ ID NO: 479674 - DNA, 20 bp, Artificial Sequence
  chemically synthesized
tatttatttattttttgaga

SEQ ID NO: 479675 - DNA, 20 bp, Artificial Sequence
  chemically synthesized
ttcgctcttgttgcccaggc

SEQ ID NO: 479676 - DNA, 20 bp, Artificial Sequence
  chemically synthesized
ctcactgcaacctccgcctc

SEQ ID NO: 479677 - DNA, 20 bp, Artificial Sequence
  chemically synthesized
tacttgggaggctgaggcag

SEQ ID NO: 479678 - DNA, 20 bp, Artificial Sequence
  chemically synthesized
ttttgtatttttagtagaga

SEQ ID NO: 479679 - DNA, 20 bp, Artificial Sequence
  chemically synthesized
tgaggtgggtggattacctg

SEQ ID NO: 479680 - DNA, 20 bp, Artificial Sequence
  chemically synthesized
actttgggagtctgaggtgg

SEQ ID NO: 479681 - DNA, 20 bp, Artificial Sequence
  chemically synthesized
cagcactttgggagtctgag

SEQ ID NO: 479682 - DNA, 20 bp, Artificial Sequence
  chemically synthesized
acctcagactcccaaagtgc

SEQ ID NO: 479683 - DNA, 20 bp, Artificial Sequence
  chemically synthesized
gcctgtaatcccagcacttt

SEQ ID NO: 479684 - DNA, 20 bp, Artificial Sequence
  chemically synthesized
tagatcactgaagcaaaatt

SEQ ID NO: 479685 - DNA, 20 bp, Artificial Sequence
  chemically synthesized
ttgtgctaatactatactat

SEQ ID NO: 479686 - DNA, 20 bp, Artificial Sequence
  chemically synthesized
gctttacagcaagtttaata

SEQ ID NO: 479687 - DNA, 20 bp, Artificial Sequence
  chemically synthesized
taaataatcgcaagtatctc

SEQ ID NO: 479688 - DNA, 20 bp, Artificial Sequence
  chemically synthesized
caaggcacttgaaatttaca

SEQ ID NO: 479689 - DNA, 20 bp, Artificial Sequence
  chemically synthesized
tcaagattttatttaaatct

SEQ ID NO: 479690 - DNA, 20 bp, Artificial Sequence
  chemically synthesized
taatattggtgtctgtttca

SEQ ID NO: 479691 - DNA, 20 bp, Artificial Sequence
  chemically synthesized
actacatattgttccatttt

SEQ ID NO: 479692 - DNA, 20 bp, Artificial Sequence
  chemically synthesized
taacggttaagttctttgct

SEQ ID NO: 479693 - DNA, 20 bp, Artificial Sequence
  chemically synthesized
gttaagttctttgctatggg

SEQ ID NO: 479694 - DNA, 20 bp, Artificial Sequence
  chemically synthesized
aaatttggagaaaatttgga

SEQ ID NO: 479695 - DNA, 20 bp, Artificial Sequence
  chemically synthesized
agtcctaacccctggtacct

SEQ ID NO: 479696 - DNA, 20 bp, Artificial Sequence
  chemically synthesized
gggtcacattctgaggtacc

SEQ ID NO: 479697 - DNA, 20 bp, Artificial Sequence
  chemically synthesized
gtaatgaccctatctccaaa

SEQ ID NO: 479698 - DNA, 20 bp, Artificial Sequence
  chemically synthesized
aatgtgaccctatttggaga

SEQ ID NO: 479699 - DNA, 20 bp, Artificial Sequence
  chemically synthesized
atgaggtcatttggttgggc

SEQ ID NO: 479700 - DNA, 20 bp, Artificial Sequence
  chemically synthesized
ccaacttccccttttaagga

SEQ ID NO: 479701 - DNA, 20 bp, Artificial Sequence
  chemically synthesized
aacaaaccatcagaaactag

SEQ ID NO: 479702 - DNA, 20 bp, Artificial Sequence
  chemically synthesized
accatcagaaactaggggaa

SEQ ID NO: 479703 - DNA, 20 bp, Artificial Sequence
  chemically synthesized
tccttctgagggctcggaag

SEQ ID NO: 479704 - DNA, 20 bp, Artificial Sequence
  chemically synthesized
gtctgagatcaaggtgtcag

SEQ ID NO: 479705 - DNA, 20 bp, Artificial Sequence
  chemically synthesized
tctgttgtcttacagttctg

SEQ ID NO: 479706 - DNA, 20 bp, Artificial Sequence
  chemically synthesized
caatagtgaaataccacaaa

SEQ ID NO: 479707 - DNA, 20 bp, Artificial Sequence
  chemically synthesized
ttttcctgtatcagtacata

SEQ ID NO: 479708 - DNA, 20 bp, Artificial Sequence
  chemically synthesized
catacgatacacattttctt

SEQ ID NO: 479709 - DNA, 20 bp, Artificial Sequence
  chemically synthesized
gagatatgtacgaatttcaa

SEQ ID NO: 479710 - DNA, 20 bp, Artificial Sequence
  chemically synthesized
atatccttcaggagatatgt

SEQ ID NO: 479711 - DNA, 20 bp, Artificial Sequence
  chemically synthesized
aaattcgtacatatctcctg

SEQ ID NO: 479712 - DNA, 20 bp, Artificial Sequence
  chemically synthesized
gctgacaatactgattggtg

SEQ ID NO: 479713 - DNA, 20 bp, Artificial Sequence
  chemically synthesized
tactgattggtggtgggtag

SEQ ID NO: 479714 - DNA, 20 bp, Artificial Sequence
  chemically synthesized
tctcctacctctatgcactg

SEQ ID NO: 479715 - DNA, 20 bp, Artificial Sequence
  chemically synthesized
ctttttgtaaattttcattt

SEQ ID NO: 479716 - DNA, 20 bp, Artificial Sequence
  chemically synthesized
aaaagaaagctgataattta

SEQ ID NO: 479717 - DNA, 20 bp, Artificial Sequence
  chemically synthesized
aacattgtaaaagttgttgt

SEQ ID NO: 479718 - DNA, 20 bp, Artificial Sequence
  chemically synthesized
aacattgcttgaagtaatat

SEQ ID NO: 479719 - DNA, 20 bp, Artificial Sequence
  chemically synthesized
tgaagtaatatgggagttaa

SEQ ID NO: 479720 - DNA, 20 bp, Artificial Sequence
  chemically synthesized
tgtattacagaagctcttaa

SEQ ID NO: 479721 - DNA, 20 bp, Artificial Sequence
  chemically synthesized
ctgttgaagtcttaaaattt

SEQ ID NO: 479722 - DNA, 20 bp, Artificial Sequence
  chemically synthesized
accttcagggagacggggtc

SEQ ID NO: 479723 - DNA, 20 bp, Artificial Sequence
  chemically synthesized
aggttttaccttcagggaga

SEQ ID NO: 479724 - DNA, 20 bp, Artificial Sequence
  chemically synthesized
atatagtacaatatcataac

SEQ ID NO: 479725 - DNA, 20 bp, Artificial Sequence
  chemically synthesized
aagaacagttccaacactac

SEQ ID NO: 479726 - DNA, 20 bp, Artificial Sequence
  chemically synthesized
tgcctcctgtgttgcccttt

SEQ ID NO: 479727 - DNA, 20 bp, Artificial Sequence
  chemically synthesized
ggggaaagagagagagagag

SEQ ID NO: 479728 - DNA, 20 bp, Artificial Sequence
  chemically synthesized
agaacagattggtgattgca

SEQ ID NO: 479729 - DNA, 20 bp, Artificial Sequence
  chemically synthesized
gtcttgaagtgacagaatta

SEQ ID NO: 479730 - DNA, 20 bp, Artificial Sequence
  chemically synthesized
atatagccgtcttgaagtga

SEQ ID NO: 479731 - DNA, 20 bp, Artificial Sequence
  chemically synthesized
cttcaagacggctatataaa

SEQ ID NO: 479732 - DNA, 20 bp, Artificial Sequence
  chemically synthesized
tcatctgaaaaggttacata

SEQ ID NO: 479733 - DNA, 20 bp, Artificial Sequence
  chemically synthesized
tcaatctccacagaattatg

SEQ ID NO: 479734 - DNA, 20 bp, Artificial Sequence
  chemically synthesized
aacttttagatcaatctcca

SEQ ID NO: 479735 - DNA, 20 bp, Artificial Sequence
  chemically synthesized
aatactattcagcaataaaa

SEQ ID NO: 479736 - DNA, 20 bp, Artificial Sequence
  chemically synthesized
tatttcattccattttattg

SEQ ID NO: 479737 - DNA, 20 bp, Artificial Sequence
  chemically synthesized
aatagtattgcctggtatgt

SEQ ID NO: 479738 - DNA, 20 bp, Artificial Sequence
  chemically synthesized
aagaacccagacggtcaaca

SEQ ID NO: 479739 - DNA, 20 bp, Artificial Sequence
  chemically synthesized
aaccattcattgttgaccgt

SEQ ID NO: 479740 - DNA, 20 bp, Artificial Sequence
  chemically synthesized
ctttccagtttttggctata

SEQ ID NO: 479741 - DNA, 20 bp, Artificial Sequence
  chemically synthesized
ctataatgaataatggtggt

SEQ ID NO: 479742 - DNA, 20 bp, Artificial Sequence
  chemically synthesized
aggttgtaagataaatgtcc

SEQ ID NO: 479743 - DNA, 20 bp, Artificial Sequence
  chemically synthesized
aatgtccaagagtgcaattg

SEQ ID NO: 479744 - DNA, 20 bp, Artificial Sequence
  chemically synthesized
tacatttccaccagcaatat

SEQ ID NO: 479745 - DNA, 20 bp, Artificial Sequence
  chemically synthesized
ctagcaaggatgtggagaaa

SEQ ID NO: 479746 - DNA, 20 bp, Artificial Sequence
  chemically synthesized
ttacaacaccagatgctagc

SEQ ID NO: 479747 - DNA, 20 bp, Artificial Sequence
  chemically synthesized
atatattcctacacatctat

SEQ ID NO: 479748 - DNA, 20 bp, Artificial Sequence
  chemically synthesized
agccattctgatagatgtgt

SEQ ID NO: 479749 - DNA, 20 bp, Artificial Sequence
  chemically synthesized
tcaagaaacgtttcaccaaa

SEQ ID NO: 479750 - DNA, 20 bp, Artificial Sequence
  chemically synthesized
ttgttttaccttgcagtttt

SEQ ID NO: 479751 - DNA, 20 bp, Artificial Sequence
  chemically synthesized
atagccaaaagatggatgtc

SEQ ID NO: 479752 - DNA, 20 bp, Artificial Sequence
  chemically synthesized
tcaagccatatagccaaaag

SEQ ID NO: 479753 - DNA, 20 bp, Artificial Sequence
  chemically synthesized
actgcaaaagacctgtgagg

SEQ ID NO: 479754 - DNA, 20 bp, Artificial Sequence
  chemically synthesized
caactgatttttttctgtgt

SEQ ID NO: 479755 - DNA, 20 bp, Artificial Sequence
  chemically synthesized
aaatcttcaggctctagggc

SEQ ID NO: 479756 - DNA, 20 bp, Artificial Sequence
  chemically synthesized
atttaagtccatgatctatt

SEQ ID NO: 479757 - DNA, 20 bp, Artificial Sequence
  chemically synthesized
ttctttttttttcccactct

SEQ ID NO: 479758 - DNA, 20 bp, Artificial Sequence
  chemically synthesized
ctgcagaaattggacatccc

SEQ ID NO: 479759 - DNA, 20 bp, Artificial Sequence
  chemically synthesized
gaaaaggtgagctttctcta

SEQ ID NO: 479760 - DNA, 20 bp, Artificial Sequence
  chemically synthesized
aatctgttgggcacatttgc

SEQ ID NO: 479761 - DNA, 20 bp, Artificial Sequence
  chemically synthesized
acatttgcatgggtctgttt

SEQ ID NO: 479762 - DNA, 20 bp, Artificial Sequence
  chemically synthesized
gactcatagaccaaatgaaa

SEQ ID NO: 479763 - DNA, 20 bp, Artificial Sequence
  chemically synthesized
tattctgtttcatttggtct

SEQ ID NO: 479764 - DNA, 20 bp, Artificial Sequence
  chemically synthesized
atacagtatgatgttgctgg

SEQ ID NO: 479765 - DNA, 20 bp, Artificial Sequence
  chemically synthesized
ctatattgttagccataata

SEQ ID NO: 479766 - DNA, 20 bp, Artificial Sequence
  chemically synthesized
tttaaaaaggtaaataaagt

SEQ ID NO: 479767 - DNA, 20 bp, Artificial Sequence
  chemically synthesized
ataagaaaagtcacaggcca

SEQ ID NO: 479768 - DNA, 20 bp, Artificial Sequence
  chemically synthesized
gtgacttttcttatagattt

SEQ ID NO: 479769 - DNA, 20 bp, Artificial Sequence
  chemically synthesized
gtttctatcaaaatcttatc

SEQ ID NO: 479770 - DNA, 20 bp, Artificial Sequence
  chemically synthesized
atggcatgtttatagactgg

SEQ ID NO: 479771 - DNA, 20 bp, Artificial Sequence
  chemically synthesized
attaaaaacaacctaaataa

SEQ ID NO: 479772 - DNA, 20 bp, Artificial Sequence
  chemically synthesized
ataaatctatcatacatgta

SEQ ID NO: 479773 - DNA, 20 bp, Artificial Sequence
  chemically synthesized
tatacctacgtatttcattt

SEQ ID NO: 479774 - DNA, 20 bp, Artificial Sequence
  chemically synthesized
aaggcaagccatcacaactt

SEQ ID NO: 479775 - DNA, 20 bp, Artificial Sequence
  chemically synthesized
tatgattttttgactttatg

SEQ ID NO: 479776 - DNA, 20 bp, Artificial Sequence
  chemically synthesized
ggtgtgttgatcttgtattt

SEQ ID NO: 479777 - DNA, 20 bp, Artificial Sequence
  chemically synthesized
tatttttgcttttgtttttg

SEQ ID NO: 479778 - DNA, 20 bp, Artificial Sequence
  chemically synthesized
aaataaaattatttctattt

SEQ ID NO: 479779 - DNA, 20 bp, Artificial Sequence
  chemically synthesized
cttccagaactatgttaaaa

SEQ ID NO: 479780 - DNA, 20 bp, Artificial Sequence
  chemically synthesized
cccatgattgctaattaggg

SEQ ID NO: 479781 - DNA, 20 bp, Artificial Sequence
  chemically synthesized
tccttccctaattagcaatc

SEQ ID NO: 479782 - DNA, 20 bp, Artificial Sequence
  chemically synthesized
ataacttccacatcttaata

SEQ ID NO: 479783 - DNA, 20 bp, Artificial Sequence
  chemically synthesized
ctatgagaaaactgggaata

SEQ ID NO: 479784 - DNA, 20 bp, Artificial Sequence
  chemically synthesized
ataaaaactatgagaaaact

SEQ ID NO: 479785 - DNA, 20 bp, Artificial Sequence
  chemically synthesized
gttttctcatagtttttatc

SEQ ID NO: 479786 - DNA, 20 bp, Artificial Sequence
  chemically synthesized
tctcatagtttttatcatga

SEQ ID NO: 479787 - DNA, 20 bp, Artificial Sequence
  chemically synthesized
gtttttatcatgaatggatg

SEQ ID NO: 479788 - DNA, 20 bp, Artificial Sequence
  chemically synthesized
agtgtcataccataactaac

SEQ ID NO: 479789 - DNA, 20 bp, Artificial Sequence
  chemically synthesized
catgcgtcaaagtttaaaaa

SEQ ID NO: 479790 - DNA, 20 bp, Artificial Sequence
  chemically synthesized
gatgtcataaaagcagtatt

SEQ ID NO: 479791 - DNA, 20 bp, Artificial Sequence
  chemically synthesized
tctttgactactgctttgct

SEQ ID NO: 479792 - DNA, 20 bp, Artificial Sequence
  chemically synthesized
ttttattgagccagttccca

SEQ ID NO: 479793 - DNA, 20 bp, Artificial Sequence
  chemically synthesized
aggtgtctcctgaacttctt

SEQ ID NO: 479794 - DNA, 20 bp, Artificial Sequence
  chemically synthesized
aggagacacctgtacacaca

SEQ ID NO: 479795 - DNA, 20 bp, Artificial Sequence
  chemically synthesized
agattaagcttccttaagct

SEQ ID NO: 479796 - DNA, 20 bp, Artificial Sequence
  chemically synthesized
gatatgcttgccctttgctt

SEQ ID NO: 479797 - DNA, 20 bp, Artificial Sequence
  chemically synthesized
aatgaaaataaaacatcaac

SEQ ID NO: 479798 - DNA, 20 bp, Artificial Sequence
  chemically synthesized
atgttctgggaacatataag

SEQ ID NO: 479799 - DNA, 20 bp, Artificial Sequence
  chemically synthesized
aagcaacttcagcaaattta

SEQ ID NO: 479800 - DNA, 20 bp, Artificial Sequence
  chemically synthesized
ctaaatttgctgaagttgct

SEQ ID NO: 479801 - DNA, 20 bp, Artificial Sequence
  chemically synthesized
tgctgaagttgcttggagtc

SEQ ID NO: 479802 - DNA, 20 bp, Artificial Sequence
  chemically synthesized
ccagaatatggcttatatca

SEQ ID NO: 479803 - DNA, 20 bp, Artificial Sequence
  chemically synthesized
agcactcctcccaacagtag

SEQ ID NO: 479804 - DNA, 20 bp, Artificial Sequence
  chemically synthesized
tgtattctgctactgttggg

SEQ ID NO: 479805 - DNA, 20 bp, Artificial Sequence
  chemically synthesized
tgaacaacaccatcaaccaa

SEQ ID NO: 479806 - DNA, 20 bp, Artificial Sequence
  chemically synthesized
ctactaaatggaaaataagc

SEQ ID NO: 479807 - DNA, 20 bp, Artificial Sequence
  chemically synthesized
gttctatcaactgaagagag

SEQ ID NO: 479808 - DNA, 20 bp, Artificial Sequence
  chemically synthesized
tgaagtccctaactagaaat

SEQ ID NO: 479809 - DNA, 20 bp, Artificial Sequence
  chemically synthesized
tccaaatacatgaagcaaaa

SEQ ID NO: 479810 - DNA, 20 bp, Artificial Sequence
  chemically synthesized
ttgttaggtgcaaacacatt

SEQ ID NO: 479811 - DNA, 20 bp, Artificial Sequence
  chemically synthesized
aggattattatgtcttccca

SEQ ID NO: 479812 - DNA, 20 bp, Artificial Sequence
  chemically synthesized
cctaggtaggttaaaattaa

SEQ ID NO: 479813 - DNA, 20 bp, Artificial Sequence
  chemically synthesized
attaaaagagatttagctga

SEQ ID NO: 479814 - DNA, 20 bp, Artificial Sequence
  chemically synthesized
accaattaaaagagatttag

SEQ ID NO: 479815 - DNA, 20 bp, Artificial Sequence
  chemically synthesized
catttgcatttaaggtaatt

SEQ ID NO: 479816 - DNA, 20 bp, Artificial Sequence
  chemically synthesized
aggtaagaaaaaagaaagag

SEQ ID NO: 479817 - DNA, 20 bp, Artificial Sequence
  chemically synthesized
ttcttttttcttaccttctt

SEQ ID NO: 479818 - DNA, 20 bp, Artificial Sequence
  chemically synthesized
atacaacaaataaattttga

SEQ ID NO: 479819 - DNA, 20 bp, Artificial Sequence
  chemically synthesized
gcattaacattgcaatctac

SEQ ID NO: 479820 - DNA, 20 bp, Artificial Sequence
  chemically synthesized
agacatacctaagtggaagt

SEQ ID NO: 479821 - DNA, 20 bp, Artificial Sequence
  chemically synthesized
tgtatgtagagaaaatactt

SEQ ID NO: 479822 - DNA, 20 bp, Artificial Sequence
  chemically synthesized
cacttcaaacttatggtaaa

SEQ ID NO: 479823 - DNA, 20 bp, Artificial Sequence
  chemically synthesized
atagtagaatgggtaaaaat

SEQ ID NO: 479824 - DNA, 20 bp, Artificial Sequence
  chemically synthesized
ttcagaaagaaaatagtaga

SEQ ID NO: 479825 - DNA, 20 bp, Artificial Sequence
  chemically synthesized
acatttcagaaagaaaatag

SEQ ID NO: 479826 - DNA, 20 bp, Artificial Sequence
  chemically synthesized
tataatttcctttctgttta

SEQ ID NO: 479827 - DNA, 20 bp, Artificial Sequence
  chemically synthesized
tgctagcaaatctgctctta

SEQ ID NO: 479828 - DNA, 20 bp, Artificial Sequence
  chemically synthesized
ttctcagattaaggaaaaca

SEQ ID NO: 479829 - DNA, 20 bp, Artificial Sequence
  chemically synthesized
ttctttgttttccttaatct

SEQ ID NO: 479830 - DNA, 20 bp, Artificial Sequence
  chemically synthesized
taactcctaaggttttccta

SEQ ID NO: 479831 - DNA, 20 bp, Artificial Sequence
  chemically synthesized
taattccttaggaaaacctt

SEQ ID NO: 479832 - DNA, 20 bp, Artificial Sequence
  chemically synthesized
taggagttatctgattatct

SEQ ID NO: 479833 - DNA, 20 bp, Artificial Sequence
  chemically synthesized
caaattgacttttaaacgta

SEQ ID NO: 479834 - DNA, 20 bp, Artificial Sequence
  chemically synthesized
tttactggcatctagtgaac

SEQ ID NO: 479835 - DNA, 20 bp, Artificial Sequence
  chemically synthesized
ctgatcactaactgtagggc

SEQ ID NO: 479836 - DNA, 20 bp, Artificial Sequence
  chemically synthesized
aaacactctagaatgctgat

SEQ ID NO: 479837 - DNA, 20 bp, Artificial Sequence
  chemically synthesized
taaaattcctatcagcattc

SEQ ID NO: 479838 - DNA, 20 bp, Artificial Sequence
  chemically synthesized
tatatatataaaaaacactc

SEQ ID NO: 479839 - DNA, 20 bp, Artificial Sequence
  chemically synthesized
ttggttcaaaggagagtctg

SEQ ID NO: 479840 - DNA, 20 bp, Artificial Sequence
  chemically synthesized
tagttacagttggttcaaag

SEQ ID NO: 479841 - DNA, 20 bp, Artificial Sequence
  chemically synthesized
attagatcattaactgatga

SEQ ID NO: 479842 - DNA, 20 bp, Artificial Sequence
  chemically synthesized
gagtcccataaaaatataaa

SEQ ID NO: 479843 - DNA, 20 bp, Artificial Sequence
  chemically synthesized
atttctaaagagacaaaatt

SEQ ID NO: 479844 - DNA, 20 bp, Artificial Sequence
  chemically synthesized
gtaagtaaaataatgaatta

SEQ ID NO: 479845 - DNA, 20 bp, Artificial Sequence
  chemically synthesized
taccttttgtaagtaaaata

SEQ ID NO: 479846 - DNA, 20 bp, Artificial Sequence
  chemically synthesized
taaatctctcatgcgtacag

SEQ ID NO: 479847 - DNA, 20 bp, Artificial Sequence
  chemically synthesized
agtggaaaaactggtgaaat

SEQ ID NO: 479848 - DNA, 20 bp, Artificial Sequence
  chemically synthesized
tcctgaaacagaaaaatgac

SEQ ID NO: 479849 - DNA, 20 bp, Artificial Sequence
  chemically synthesized
ctcatgtcatttttctgttt

SEQ ID NO: 479850 - DNA, 20 bp, Artificial Sequence
  chemically synthesized
ttctgtttcaggatccaatc

SEQ ID NO: 479851 - DNA, 20 bp, Artificial Sequence
  chemically synthesized
atgcagtaggagattctgga

SEQ ID NO: 479852 - DNA, 20 bp, Artificial Sequence
  chemically synthesized
accaaatgcagtaggagatt

SEQ ID NO: 479853 - DNA, 20 bp, Artificial Sequence
  chemically synthesized
tctcctactgcatttggtcc

SEQ ID NO: 479854 - DNA, 20 bp, Artificial Sequence
  chemically synthesized
tcttcatgaccttgaaactt

SEQ ID NO: 479855 - DNA, 20 bp, Artificial Sequence
  chemically synthesized
gtcaaatcttaagagacttc

SEQ ID NO: 479856 - DNA, 20 bp, Artificial Sequence
  chemically synthesized
agaagttacaggttttgggg

SEQ ID NO: 479857 - DNA, 20 bp, Artificial Sequence
  chemically synthesized
ataatagaatatggaaaagt

SEQ ID NO: 479858 - DNA, 20 bp, Artificial Sequence
  chemically synthesized
ggtaacttacttccagataa

SEQ ID NO: 479859 - DNA, 20 bp, Artificial Sequence
  chemically synthesized
gttcatggaggggcttaggg

SEQ ID NO: 479860 - DNA, 20 bp, Artificial Sequence
  chemically synthesized
gatactcctttcctgggatg

SEQ ID NO: 479861 - DNA, 20 bp, Artificial Sequence
  chemically synthesized
taaactctacatcccaggaa

SEQ ID NO: 479862 - DNA, 20 bp, Artificial Sequence
  chemically synthesized
atacatagatactcctttcc

SEQ ID NO: 479863 - DNA, 20 bp, Artificial Sequence
  chemically synthesized
gagtatctatgtatattatt

SEQ ID NO: 479864 - DNA, 20 bp, Artificial Sequence
  chemically synthesized
cagagaaaacacattattat

SEQ ID NO: 479865 - DNA, 20 bp, Artificial Sequence
  chemically synthesized
aagggaaaaaagaccagttt

SEQ ID NO: 479866 - DNA, 20 bp, Artificial Sequence
  chemically synthesized
ttcgggccagtataacttaa

SEQ ID NO: 479867 - DNA, 20 bp, Artificial Sequence
  chemically synthesized
gagtgccagaacctaccaaa

SEQ ID NO: 479868 - DNA, 20 bp, Artificial Sequence
  chemically synthesized
tatggaaaaacctattagtc

SEQ ID NO: 479869 - DNA, 20 bp, Artificial Sequence
  chemically synthesized
aggtttttccatatatttct

SEQ ID NO: 479870 - DNA, 20 bp, Artificial Sequence
  chemically synthesized
ctgacagtatatgtgtcact

SEQ ID NO: 479871 - DNA, 20 bp, Artificial Sequence
  chemically synthesized
atatgtgtcactttgaatca

SEQ ID NO: 479872 - DNA, 20 bp, Artificial Sequence
  chemically synthesized
gaatcactgggtatcctaca

SEQ ID NO: 479873 - DNA, 20 bp, Artificial Sequence
  chemically synthesized
aagtaactcgatattccctg

SEQ ID NO: 479874 - DNA, 20 bp, Artificial Sequence
  chemically synthesized
tgggtatcctacagggaata

SEQ ID NO: 479875 - DNA, 20 bp, Artificial Sequence
  chemically synthesized
tggttaaccataatttagat

SEQ ID NO: 479876 - DNA, 20 bp, Artificial Sequence
  chemically synthesized
tgatgggccagccaggctgt

SEQ ID NO: 479877 - DNA, 20 bp, Artificial Sequence
  chemically synthesized
taaaggataatacaaatggc

SEQ ID NO: 479878 - DNA, 20 bp, Artificial Sequence
  chemically synthesized
aaagtattgattttttcata

SEQ ID NO: 479879 - DNA, 20 bp, Artificial Sequence
  chemically synthesized
tactttatttaacaatgcta

SEQ ID NO: 479880 - DNA, 20 bp, Artificial Sequence
  chemically synthesized
aatagcattgttaaataaag

SEQ ID NO: 479881 - DNA, 20 bp, Artificial Sequence
  chemically synthesized
agagaatacatataaaatac

SEQ ID NO: 479882 - DNA, 20 bp, Artificial Sequence
  chemically synthesized
ttatatgtattctctgacaa

SEQ ID NO: 479883 - DNA, 20 bp, Artificial Sequence
  chemically synthesized
cttattttacccttttgtca

SEQ ID NO: 479884 - DNA, 20 bp, Artificial Sequence
  chemically synthesized
aaagggtaaaataagaagca

SEQ ID NO: 479885 - DNA, 20 bp, Artificial Sequence
  chemically synthesized
ttacatgataaaagatttaa

SEQ ID NO: 479886 - DNA, 20 bp, Artificial Sequence
  chemically synthesized
acattacagtattctgagct

SEQ ID NO: 479887 - DNA, 20 bp, Artificial Sequence
  chemically synthesized
gtgaatttccacccttagct

SEQ ID NO: 479888 - DNA, 20 bp, Artificial Sequence
  chemically synthesized
aagggtggaaattcacctca

SEQ ID NO: 479889 - DNA, 20 bp, Artificial Sequence
  chemically synthesized
acaattaaaaattctctgag

SEQ ID NO: 479890 - DNA, 20 bp, Artificial Sequence
  chemically synthesized
gagaatttttaattgtctgt

SEQ ID NO: 479891 - DNA, 20 bp, Artificial Sequence
  chemically synthesized
atgctacagtactgcacatc

SEQ ID NO: 479892 - DNA, 20 bp, Artificial Sequence
  chemically synthesized
aaaatatcttcatcatcgca

SEQ ID NO: 479893 - DNA, 20 bp, Artificial Sequence
  chemically synthesized
ctctaaatcaggactgtgat

SEQ ID NO: 479894 - DNA, 20 bp, Artificial Sequence
  chemically synthesized
atcacagtcctgatttagag

SEQ ID NO: 479895 - DNA, 20 bp, Artificial Sequence
  chemically synthesized
caagacagccccccacaaca

SEQ ID NO: 479896 - DNA, 20 bp, Artificial Sequence
  chemically synthesized
tcatcaagtgggcagaggcc

SEQ ID NO: 479897 - DNA, 20 bp, Artificial Sequence
  chemically synthesized
ttggttgtcacattgggggc

SEQ ID NO: 479898 - DNA, 20 bp, Artificial Sequence
  chemically synthesized
ccgcccccaatgtgacaacc

SEQ ID NO: 479899 - DNA, 20 bp, Artificial Sequence
  chemically synthesized
gatactgtcaaatgttctct

SEQ ID NO: 479900 - DNA, 20 bp, Artificial Sequence
  chemically synthesized
tagataaatactccctgaac

SEQ ID NO: 479901 - DNA, 20 bp, Artificial Sequence
  chemically synthesized
gtttccaggactctagttca

SEQ ID NO: 479902 - DNA, 20 bp, Artificial Sequence
  chemically synthesized
ggtggccaagacttattcta

SEQ ID NO: 479903 - DNA, 20 bp, Artificial Sequence
  chemically synthesized
aataatttttagcaattctt

SEQ ID NO: 479904 - DNA, 20 bp, Artificial Sequence
  chemically synthesized
aggagcagaaaagataacta

SEQ ID NO: 479905 - DNA, 20 bp, Artificial Sequence
  chemically synthesized
cataggcaaaccggtgtcac

SEQ ID NO: 479906 - DNA, 20 bp, Artificial Sequence
  chemically synthesized
taacttttattttaggtttg

SEQ ID NO: 479907 - DNA, 20 bp, Artificial Sequence
  chemically synthesized
ataaaagttaaaaaaatgaa

SEQ ID NO: 479908 - DNA, 20 bp, Artificial Sequence
  chemically synthesized
gttaaaaaaatgaaaagaat

SEQ ID NO: 479909 - DNA, 20 bp, Artificial Sequence
  chemically synthesized
aaaagaaaaatttagtatag

SEQ ID NO: 479910 - DNA, 20 bp, Artificial Sequence
  chemically synthesized
gttggttaagagaaatgggg

SEQ ID NO: 479911 - DNA, 20 bp, Artificial Sequence
  chemically synthesized
tttctcttaaccaacacacc

SEQ ID NO: 479912 - DNA, 20 bp, Artificial Sequence
  chemically synthesized
ttatgcaagaatttaatttg

SEQ ID NO: 479913 - DNA, 20 bp, Artificial Sequence
  chemically synthesized
aaggtggttacctcttatgc

SEQ ID NO: 479914 - DNA, 20 bp, Artificial Sequence
  chemically synthesized
ccagtctgcactaaagtggt

SEQ ID NO: 479915 - DNA, 20 bp, Artificial Sequence
  chemically synthesized
ctggcctggctttcaactat

SEQ ID NO: 479916 - DNA, 20 bp, Artificial Sequence
  chemically synthesized
agccattagggaaaaaaaat

SEQ ID NO: 479917 - DNA, 20 bp, Artificial Sequence
  chemically synthesized
aagaaaaattattttgtgtc

SEQ ID NO: 479918 - DNA, 20 bp, Artificial Sequence
  chemically synthesized
tttaggactgcttccaacgg

SEQ ID NO: 479919 - DNA, 20 bp, Artificial Sequence
  chemically synthesized
agtcctaaaccaatgactag

SEQ ID NO: 479920 - DNA, 20 bp, Artificial Sequence
  chemically synthesized
tttcaaaggggcaagggagc

SEQ ID NO: 479921 - DNA, 20 bp, Artificial Sequence
  chemically synthesized
cagctcccttgcccctttga

SEQ ID NO: 479922 - DNA, 20 bp, Artificial Sequence
  chemically synthesized
tggattgaagacatgtgttt

SEQ ID NO: 479923 - DNA, 20 bp, Artificial Sequence
  chemically synthesized
acacatgtcttcaatccatt

SEQ ID NO: 479924 - DNA, 20 bp, Artificial Sequence
  chemically synthesized
tcccactggggaaattctaa

SEQ ID NO: 479925 - DNA, 20 bp, Artificial Sequence
  chemically synthesized
tccatttagaatttccccag

SEQ ID NO: 479926 - DNA, 20 bp, Artificial Sequence
  chemically synthesized
gccaactgccactggtctag

SEQ ID NO: 479927 - DNA, 20 bp, Artificial Sequence
  chemically synthesized
gcttgataatgcatttttta

SEQ ID NO: 479928 - DNA, 20 bp, Artificial Sequence
  chemically synthesized
agctactgcagaaggcagag

SEQ ID NO: 479929 - DNA, 20 bp, Artificial Sequence
  chemically synthesized
cttcccaagttctaagtact

SEQ ID NO: 479930 - DNA, 20 bp, Artificial Sequence
  chemically synthesized
agttagcatatcttggaaac

SEQ ID NO: 479931 - DNA, 20 bp, Artificial Sequence
  chemically synthesized
taggaatatgcagagaatgg

SEQ ID NO: 479932 - DNA, 20 bp, Artificial Sequence
  chemically synthesized
aaaaaatttaggaatatgca

SEQ ID NO: 479933 - DNA, 20 bp, Artificial Sequence
  chemically synthesized
ataaaaaagataaaaaattt

SEQ ID NO: 479934 - DNA, 20 bp, Artificial Sequence
  chemically synthesized
cttcactaaaatgagaatag

SEQ ID NO: 479935 - DNA, 20 bp, Artificial Sequence
  chemically synthesized
tctttaaccttcactaaaat

SEQ ID NO: 479936 - DNA, 20 bp, Artificial Sequence
  chemically synthesized
ctttccatagatcacttata

SEQ ID NO: 479937 - DNA, 20 bp, Artificial Sequence
  chemically synthesized
aaagacatttgactagttgc

SEQ ID NO: 479938 - DNA, 20 bp, Artificial Sequence
  chemically synthesized
tttgactagttgcatgagtc

SEQ ID NO: 479939 - DNA, 20 bp, Artificial Sequence
  chemically synthesized
gtcaagggttaagtaaagga

SEQ ID NO: 479940 - DNA, 20 bp, Artificial Sequence
  chemically synthesized
gaattctagcttacagagag

SEQ ID NO: 479941 - DNA, 20 bp, Artificial Sequence
  chemically synthesized
agactcctctctctgtaagc

SEQ ID NO: 479942 - DNA, 20 bp, Artificial Sequence
  chemically synthesized
ctgggaaatttaaggctata

SEQ ID NO: 479943 - DNA, 20 bp, Artificial Sequence
  chemically synthesized
cttaaagttacaaatggttt

SEQ ID NO: 479944 - DNA, 20 bp, Artificial Sequence
  chemically synthesized
ctttaacctaatcattaaat

SEQ ID NO: 479945 - DNA, 20 bp, Artificial Sequence
  chemically synthesized
ccatataggattgccaatat
